United States Patent 8,178,503 (RIBONUCLEIC ACID INTERFERENCE MOLECULES AND BINDING SITES DERIVED BY ANALYZING INTERGENIC AND INTRONIC REGIONS OF GENOMES) - sequence listing, part 4

SEQ ID NO: 134179 - DNA, 16 bp, H. sapiens
tcaggaggctgaggtt

SEQ ID NO: 134180 - DNA, 16 bp, H. sapiens
tcaggaggctggagaa

SEQ ID NO: 134181 - DNA, 16 bp, H. sapiens
tcaggaggctggagtg

SEQ ID NO: 134182 - DNA, 16 bp, H. sapiens
tcaggaggctgtgaca

SEQ ID NO: 134183 - DNA, 16 bp, H. sapiens
tcaggagggaggctga

SEQ ID NO: 134184 - DNA, 16 bp, H. sapiens
tcaggaggtggaggtt

SEQ ID NO: 134185 - DNA, 16 bp, H. sapiens
tcaggaggttgaggtt

SEQ ID NO: 134186 - DNA, 28 bp, H. sapiens
tcaggagtcactggaaaagttgttaggc

SEQ ID NO: 134187 - DNA, 16 bp, H. sapiens
tcaggagttagaccag

SEQ ID NO: 134188 - DNA, 18 bp, H. sapiens
tcaggagttcaagaccac

SEQ ID NO: 134189 - DNA, 16 bp, H. sapiens
tcaggagttcaaggcc

SEQ ID NO: 134190 - DNA, 16 bp, H. sapiens
tcaggagttccaggcc

SEQ ID NO: 134191 - DNA, 16 bp, H. sapiens
tcaggagttggagaac

SEQ ID NO: 134192 - DNA, 24 bp, H. sapiens
tcaggagtttgagaccagcctggg

SEQ ID NO: 134193 - DNA, 16 bp, H. sapiens
tcaggatgagggctgg

SEQ ID NO: 134194 - DNA, 16 bp, H. sapiens
tcaggatgatactggc

SEQ ID NO: 134195 - DNA, 16 bp, H. sapiens
tcaggatgatgctggg

SEQ ID NO: 134196 - DNA, 16 bp, H. sapiens
tcaggatgctgctggc

SEQ ID NO: 134197 - DNA, 16 bp, H. sapiens
tcaggatggtgggaaa

SEQ ID NO: 134198 - DNA, 16 bp, H. sapiens
tcaggattctctagag

SEQ ID NO: 134199 - DNA, 16 bp, H. sapiens
tcaggatttcagtttc

SEQ ID NO: 134200 - DNA, 16 bp, H. sapiens
tcaggatttttgctaa

SEQ ID NO: 134201 - DNA, 16 bp, H. sapiens
tcaggcaacaaatagc

SEQ ID NO: 134202 - DNA, 16 bp, H. sapiens
tcaggcaagagaaaaa

SEQ ID NO: 134203 - DNA, 16 bp, H. sapiens
tcaggcaagagaagga

SEQ ID NO: 134204 - DNA, 16 bp, H. sapiens
tcaggcaagaggaaga

SEQ ID NO: 134205 - DNA, 16 bp, H. sapiens
tcaggcaagataaaga

SEQ ID NO: 134206 - DNA, 16 bp, H. sapiens
tcaggcaagttactta

SEQ ID NO: 134207 - DNA, 16 bp, H. sapiens
tcaggcaattctcctg

SEQ ID NO: 134208 - DNA, 16 bp, H. sapiens
tcaggcacagaaagaa

SEQ ID NO: 134209 - DNA, 16 bp, H. sapiens
tcaggcacagaaagat

SEQ ID NO: 134210 - DNA, 16 bp, H. sapiens
tcaggcacagctgacc

SEQ ID NO: 134211 - DNA, 16 bp, H. sapiens
tcaggcacagctggat

SEQ ID NO: 134212 - DNA, 16 bp, H. sapiens
tcaggcacccaccacc

SEQ ID NO: 134213 - DNA, 16 bp, H. sapiens
tcaggcactgtgccag

SEQ ID NO: 134214 - DNA, 16 bp, H. sapiens
tcaggcagaggaaaca

SEQ ID NO: 134215 - DNA, 16 bp, H. sapiens
tcaggcaggagaaaaa

SEQ ID NO: 134216 - DNA, 16 bp, H. sapiens
tcaggcaggaggagtt

SEQ ID NO: 134217 - DNA, 16 bp, H. sapiens
tcaggcagggtgcagt

SEQ ID NO: 134218 - DNA, 16 bp, H. sapiens
tcaggcattcaaagaa

SEQ ID NO: 134219 - DNA, 16 bp, H. sapiens
tcaggccactgcactg

SEQ ID NO: 134220 - DNA, 16 bp, H. sapiens
tcaggccagagaaaga

SEQ ID NO: 134221 - DNA, 16 bp, H. sapiens
tcaggccaggcactgt

SEQ ID NO: 134222 - DNA, 16 bp, H. sapiens
tcaggccatgatggga

SEQ ID NO: 134223 - DNA, 16 bp, H. sapiens
tcaggcccacccagat

SEQ ID NO: 134224 - DNA, 16 bp, H. sapiens
tcaggcccagtggctc

SEQ ID NO: 134225 - DNA, 23 bp, H. sapiens
tcaggcccatggggctcattcct

SEQ ID NO: 134226 - DNA, 16 bp, H. sapiens
tcaggccccacctccc

SEQ ID NO: 134227 - DNA, 16 bp, H. sapiens
tcaggccccatcccag

SEQ ID NO: 134228 - DNA, 16 bp, H. sapiens
tcaggcccctctgctg

SEQ ID NO: 134229 - DNA, 16 bp, H. sapiens
tcaggcctctcaaaaa

SEQ ID NO: 134230 - DNA, 16 bp, H. sapiens
tcaggcctctgggccc

SEQ ID NO: 134231 - DNA, 16 bp, H. sapiens
tcaggcctgcctagac

SEQ ID NO: 134232 - DNA, 16 bp, H. sapiens
tcaggcctgtgcccac

SEQ ID NO: 134233 - DNA, 18 bp, H. sapiens
tcaggctagagtgcagtg

SEQ ID NO: 134234 - DNA, 16 bp, H. sapiens
tcaggctccaccccag

SEQ ID NO: 134235 - DNA, 16 bp, H. sapiens
tcaggctcctctcctc

SEQ ID NO: 134236 - DNA, 16 bp, H. sapiens
tcaggctgaaggaaaa

SEQ ID NO: 134237 - DNA, 16 bp, H. sapiens
tcaggctgaagggaaa

SEQ ID NO: 134238 - DNA, 16 bp, H. sapiens
tcaggctgaatttatt

SEQ ID NO: 134239 - DNA, 16 bp, H. sapiens
tcaggctgcacatttt

SEQ ID NO: 134240 - DNA, 16 bp, H. sapiens
tcaggctgctatgaca

SEQ ID NO: 134241 - DNA, 16 bp, H. sapiens
tcaggctgctgaacca

SEQ ID NO: 134242 - DNA, 16 bp, H. sapiens
tcaggctgctgctcca

SEQ ID NO: 134243 - DNA, 16 bp, H. sapiens
tcaggctggactgcag

SEQ ID NO: 134244 - DNA, 16 bp, H. sapiens
tcaggctggagcgcag

SEQ ID NO: 134245 - DNA, 16 bp, H. sapiens
tcaggctggagggcaa

SEQ ID NO: 134246 - DNA, 20 bp, H. sapiens
tcaggctggagtacagtggt

SEQ ID NO: 134247 - DNA, 18 bp, H. sapiens
tcaggctggagtgcaatg

SEQ ID NO: 134248 - DNA, 22 bp, H. sapiens
tcaggctggagtgcagtggcgc

SEQ ID NO: 134249 - DNA, 21 bp, H. sapiens
tcaggctggagtgcagtggtg

SEQ ID NO: 134250 - DNA, 16 bp, H. sapiens
tcaggctggcttttct

SEQ ID NO: 134251 - DNA, 16 bp, H. sapiens
tcaggctgggcaaggt

SEQ ID NO: 134252 - DNA, 20 bp, H. sapiens
tcaggctgggcacggtggct

SEQ ID NO: 134253 - DNA, 16 bp, H. sapiens
tcaggctggggtacag

SEQ ID NO: 134254 - DNA, 19 bp, H. sapiens
tcaggctggtctcgaactt

SEQ ID NO: 134255 - DNA, 16 bp, H. sapiens
tcaggctggtgcccct

SEQ ID NO: 134256 - DNA, 16 bp, H. sapiens
tcaggctgtccctggc

SEQ ID NO: 134257 - DNA, 16 bp, H. sapiens
tcaggctttaaactgt

SEQ ID NO: 134258 - DNA, 16 bp, H. sapiens
tcagggaaaagaagaa

SEQ ID NO: 134259 - DNA, 16 bp, H. sapiens
tcagggaaacacattt

SEQ ID NO: 134260 - DNA, 16 bp, H. sapiens
tcagggaaataagaga

SEQ ID NO: 134261 - DNA, 16 bp, H. sapiens
tcagggaaatacaaat

SEQ ID NO: 134262 - DNA, 16 bp, H. sapiens
tcagggaaatacaagt

SEQ ID NO: 134263 - DNA, 16 bp, H. sapiens
tcagggaaatgcaaat

SEQ ID NO: 134264 - DNA, 16 bp, H. sapiens
tcagggaaatgcaact

SEQ ID NO: 134265 - DNA, 16 bp, H. sapiens
tcagggaaggcctctt

SEQ ID NO: 134266 - DNA, 16 bp, H. sapiens
tcagggaagtggggga

SEQ ID NO: 134267 - DNA, 16 bp, H. sapiens
tcagggacccaggctc

SEQ ID NO: 134268 - DNA, 16 bp, H. sapiens
tcagggactactggac

SEQ ID NO: 134269 - DNA, 16 bp, H. sapiens
tcagggagatggattt

SEQ ID NO: 134270 - DNA, 16 bp, H. sapiens
tcagggagcacagggt

SEQ ID NO: 134271 - DNA, 16 bp, H. sapiens
tcagggagccaatgtg

SEQ ID NO: 134272 - DNA, 16 bp, H. sapiens
tcagggagctcccagg

SEQ ID NO: 134273 - DNA, 16 bp, H. sapiens
tcagggagcttacagt

SEQ ID NO: 134274 - DNA, 16 bp, H. sapiens
tcagggatgctgctga

SEQ ID NO: 134275 - DNA, 16 bp, H. sapiens
tcagggatttcttctt

SEQ ID NO: 134276 - DNA, 16 bp, H. sapiens
tcagggcaaacctgcc

SEQ ID NO: 134277 - DNA, 16 bp, H. sapiens
tcagggcacacctgaa

SEQ ID NO: 134278 - DNA, 16 bp, H. sapiens
tcagggcagagcaggt

SEQ ID NO: 134279 - DNA, 16 bp, H. sapiens
tcagggccagggccag

SEQ ID NO: 134280 - DNA, 16 bp, H. sapiens
tcagggccaggtgcag

SEQ ID NO: 134281 - DNA, 16 bp, H. sapiens
tcagggcccaagggct

SEQ ID NO: 134282 - DNA, 16 bp, H. sapiens
tcagggccccaccctt

SEQ ID NO: 134283 - DNA, 16 bp, H. sapiens
tcagggccgggtgtgg

SEQ ID NO: 134284 - DNA, 16 bp, H. sapiens
tcagggcctcctgagg

SEQ ID NO: 134285 - DNA, 16 bp, H. sapiens
tcagggctgggcacag

SEQ ID NO: 134286 - DNA, 16 bp, H. sapiens
tcaggggagcaggctg

SEQ ID NO: 134287 - DNA, 16 bp, H. sapiens
tcaggggagggggaag

SEQ ID NO: 134288 - DNA, 16 bp, H. sapiens
tcaggggcacctccac

SEQ ID NO: 134289 - DNA, 16 bp, H. sapiens
tcaggggccaggccca

SEQ ID NO: 134290 - DNA, 16 bp, H. sapiens
tcagggggaaaggatg

SEQ ID NO: 134291 - DNA, 16 bp, H. sapiens
tcagggggcatcatgg

SEQ ID NO: 134292 - DNA, 16 bp, H. sapiens
tcagggggtgtacacc

SEQ ID NO: 134293 - DNA, 16 bp, H. sapiens
tcaggggtagcagagg

SEQ ID NO: 134294 - DNA, 16 bp, H. sapiens
tcaggggtccccagcc

SEQ ID NO: 134295 - DNA, 16 bp, H. sapiens
tcaggggttgattttt

SEQ ID NO: 134296 - DNA, 16 bp, H. sapiens
tcagggtctctgtgta

SEQ ID NO: 134297 - DNA, 16 bp, H. sapiens
tcagggttcccactga

SEQ ID NO: 134298 - DNA, 16 bp, H. sapiens
tcagggttctctaaag

SEQ ID NO: 134299 - DNA, 16 bp, H. sapiens
tcagggttctctggag

SEQ ID NO: 134300 - DNA, 16 bp, H. sapiens
tcagggtttcactgtg

SEQ ID NO: 134301 - DNA, 16 bp, H. sapiens
tcagggttttattttt

SEQ ID NO: 134302 - DNA, 16 bp, H. sapiens
tcaggtatgtctttat

SEQ ID NO: 134303 - DNA, 16 bp, H. sapiens
tcaggtatttctttac

SEQ ID NO: 134304 - DNA, 16 bp, H. sapiens
tcaggtcaggagttcg

SEQ ID NO: 134305 - DNA, 16 bp, H. sapiens
tcaggtcccaggctcc

SEQ ID NO: 134306 - DNA, 16 bp, H. sapiens
tcaggtccccttccac

SEQ ID NO: 134307 - DNA, 16 bp, H. sapiens
tcaggtccctcttctg

SEQ ID NO: 134308 - DNA, 19 bp, H. sapiens
tcaggtctttcccttccca

SEQ ID NO: 134309 - DNA, 16 bp, H. sapiens
tcaggtgatagatgat

SEQ ID NO: 134310 - DNA, 17 bp, H. sapiens
tcaggtgatccacctga

SEQ ID NO: 134311 - DNA, 21 bp, H. sapiens
tcaggtgatccgcccaccttg

SEQ ID NO: 134312 - DNA, 19 bp, H. sapiens
tcaggtgatccgcctgcct

SEQ ID NO: 134313 - DNA, 19 bp, H. sapiens
tcaggtgatctgcctgcct

SEQ ID NO: 134314 - DNA, 19 bp, H. sapiens
tcaggtgatctgctcgcct

SEQ ID NO: 134315 - DNA, 16 bp, H. sapiens
tcaggtgattatcctg

SEQ ID NO: 134316 - DNA, 16 bp, H. sapiens
tcaggtgattctccta

SEQ ID NO: 134317 - DNA, 16 bp, H. sapiens
tcaggtgctgcagctg

SEQ ID NO: 134318 - DNA, 16 bp, H. sapiens
tcaggtggtccacccg

SEQ ID NO: 134319 - DNA, 16 bp, H. sapiens
tcaggtgttcctccca

SEQ ID NO: 134320 - DNA, 16 bp, H. sapiens
tcaggtgtttgagacc

SEQ ID NO: 134321 - DNA, 16 bp, H. sapiens
tcaggttaagataaag

SEQ ID NO: 134322 - DNA, 16 bp, H. sapiens
tcaggttaatttttgt

SEQ ID NO: 134323 - DNA, 16 bp, H. sapiens
tcaggttatcctccca

SEQ ID NO: 134324 - DNA, 16 bp, H. sapiens
tcaggttcaagcgatt

SEQ ID NO: 134325 - DNA, 16 bp, H. sapiens
tcaggttcacgccatt

SEQ ID NO: 134326 - DNA, 16 bp, H. sapiens
tcaggttcttttttgg

SEQ ID NO: 134327 - DNA, 16 bp, H. sapiens
tcaggttgcaaatttt

SEQ ID NO: 134328 - DNA, 16 bp, H. sapiens
tcaggttggagatgaa

SEQ ID NO: 134329 - DNA, 16 bp, H. sapiens
tcaggttggtttcaaa

SEQ ID NO: 134330 - DNA, 16 bp, H. sapiens
tcaggtttgacaaaga

SEQ ID NO: 134331 - DNA, 22 bp, H. sapiens
tcaggtttgtcaaagatcagat

SEQ ID NO: 134332 - DNA, 16 bp, H. sapiens
tcaggtttgtcacaga

SEQ ID NO: 134333 - DNA, 16 bp, H. sapiens
tcaggtttgtttgttt

SEQ ID NO: 134334 - DNA, 16 bp, H. sapiens
tcaggttttccttgtt

SEQ ID NO: 134335 - DNA, 16 bp, H. sapiens
tcaggttttctgtttc

SEQ ID NO: 134336 - DNA, 16 bp, H. sapiens
tcagtaaagtccctct

SEQ ID NO: 134337 - DNA, 16 bp, H. sapiens
tcagtaaatacttgtt

SEQ ID NO: 134338 - DNA, 16 bp, H. sapiens
tcagtaaatatttcct

SEQ ID NO: 134339 - DNA, 16 bp, H. sapiens
tcagtaaatatttgct

SEQ ID NO: 134340 - DNA, 16 bp, H. sapiens
tcagtaaatatttgtt

SEQ ID NO: 134341 - DNA, 16 bp, H. sapiens
tcagtaaatggtagtt

SEQ ID NO: 134342 - DNA, 16 bp, H. sapiens
tcagtaaatgttcatt

SEQ ID NO: 134343 - DNA, 16 bp, H. sapiens
tcagtaaatttagaaa

SEQ ID NO: 134344 - DNA, 16 bp, H. sapiens
tcagtaagaaaaagaa

SEQ ID NO: 134345 - DNA, 16 bp, H. sapiens
tcagtaataataaaac

SEQ ID NO: 134346 - DNA, 16 bp, H. sapiens
tcagtaatgttaagta

SEQ ID NO: 134347 - DNA, 16 bp, H. sapiens
tcagtaattaaaataa

SEQ ID NO: 134348 - DNA, 16 bp, H. sapiens
tcagtaatttttaaga

SEQ ID NO: 134349 - DNA, 16 bp, H. sapiens
tcagtaccatttattg

SEQ ID NO: 134350 - DNA, 16 bp, H. sapiens
tcagtactttattcct

SEQ ID NO: 134351 - DNA, 16 bp, H. sapiens
tcagtactttgggaag

SEQ ID NO: 134352 - DNA, 16 bp, H. sapiens
tcagtactttgggagg

SEQ ID NO: 134353 - DNA, 16 bp, H. sapiens
tcagtagaaactctac

SEQ ID NO: 134354 - DNA, 17 bp, H. sapiens
tcagtagatgcagaaaa

SEQ ID NO: 134355 - DNA, 16 bp, H. sapiens
tcagtagccacatgtg

SEQ ID NO: 134356 - DNA, 16 bp, H. sapiens
tcagtagcccaggctg

SEQ ID NO: 134357 - DNA, 16 bp, H. sapiens
tcagtataaactcatg

SEQ ID NO: 134358 - DNA, 16 bp, H. sapiens
tcagtatcattaaaat

SEQ ID NO: 134359 - DNA, 16 bp, H. sapiens
tcagtatgttgaagaa

SEQ ID NO: 134360 - DNA, 16 bp, H. sapiens
tcagtatttaaaaaaa

SEQ ID NO: 134361 - DNA, 16 bp, H. sapiens
tcagtatttcattctt

SEQ ID NO: 134362 - DNA, 16 bp, H. sapiens
tcagtatttctttata

SEQ ID NO: 134363 - DNA, 16 bp, H. sapiens
tcagtattttaaaatt

SEQ ID NO: 134364 - DNA, 16 bp, H. sapiens
tcagtattttaataaa

SEQ ID NO: 134365 - DNA, 16 bp, H. sapiens
tcagtattttattata

SEQ ID NO: 134366 - DNA, 16 bp, H. sapiens
tcagtattttgaaaat

SEQ ID NO: 134367 - DNA, 16 bp, H. sapiens
tcagtcacatcttcag

SEQ ID NO: 134368 - DNA, 16 bp, H. sapiens
tcagtcacccaggctg

SEQ ID NO: 134369 - DNA, 16 bp, H. sapiens
tcagtcagggtggtgg

SEQ ID NO: 134370 - DNA, 16 bp, H. sapiens
tcagtcattctccatc

SEQ ID NO: 134371 - DNA, 16 bp, H. sapiens
tcagtcccagcagctt

SEQ ID NO: 134372 - DNA, 16 bp, H. sapiens
tcagtccctcatggct

SEQ ID NO: 134373 - DNA, 16 bp, H. sapiens
tcagtcctctcaaact

SEQ ID NO: 134374 - DNA, 16 bp, H. sapiens
tcagtccttccttcct

SEQ ID NO: 134375 - DNA, 16 bp, H. sapiens
tcagtctccaccccaa

SEQ ID NO: 134376 - DNA, 16 bp, H. sapiens
tcagtctccccatctg

SEQ ID NO: 134377 - DNA, 17 bp, H. sapiens
tcagtctcctcagtagc

SEQ ID NO: 134378 - DNA, 16 bp, H. sapiens
tcagtctcctcatctg

SEQ ID NO: 134379 - DNA, 16 bp, H. sapiens
tcagtctcctcctctg

SEQ ID NO: 134380 - DNA, 16 bp, H. sapiens
tcagtctcctggcctc

SEQ ID NO: 134381 - DNA, 16 bp, H. sapiens
tcagtctctctgattc

SEQ ID NO: 134382 - DNA, 16 bp, H. sapiens
tcagtctgatgatagt

SEQ ID NO: 134383 - DNA, 16 bp, H. sapiens
tcagtcttaaaaagga

SEQ ID NO: 134384 - DNA, 16 bp, H. sapiens
tcagtcttcaaatttt

SEQ ID NO: 134385 - DNA, 16 bp, H. sapiens
tcagtcttctcaaacc

SEQ ID NO: 134386 - DNA, 16 bp, H. sapiens
tcagtcttttacattt

SEQ ID NO: 134387 - DNA, 16 bp, H. sapiens
tcagtcttttccccac

SEQ ID NO: 134388 - DNA, 16 bp, H. sapiens
tcagtctttttaattt

SEQ ID NO: 134389 - DNA, 16 bp, H. sapiens
tcagtctttttctgtt

SEQ ID NO: 134390 - DNA, 16 bp, H. sapiens
tcagtgaaaaataaaa

SEQ ID NO: 134391 - DNA, 16 bp, H. sapiens
tcagtgaaattgaaaa

SEQ ID NO: 134392 - DNA, 16 bp, H. sapiens
tcagtgaatattttta

SEQ ID NO: 134393 - DNA, 16 bp, H. sapiens
tcagtgaatttttcat

SEQ ID NO: 134394 - DNA, 16 bp, H. sapiens
tcagtgaccttgggca

SEQ ID NO: 134395 - DNA, 16 bp, H. sapiens
tcagtgagccatgatt

SEQ ID NO: 134396 - DNA, 16 bp, H. sapiens
tcagtgagctatgatt

SEQ ID NO: 134397 - DNA, 16 bp, H. sapiens
tcagtgaggaatgtat

SEQ ID NO: 134398 - DNA, 16 bp, H. sapiens
tcagtgagtgttacag

SEQ ID NO: 134399 - DNA, 16 bp, H. sapiens
tcagtgatattggcct

SEQ ID NO: 134400 - DNA, 16 bp, H. sapiens
tcagtgatgatgatga

SEQ ID NO: 134401 - DNA, 16 bp, H. sapiens
tcagtgatggaagaca

SEQ ID NO: 134402 - DNA, 16 bp, H. sapiens
tcagtgatgtggagct

SEQ ID NO: 134403 - DNA, 16 bp, H. sapiens
tcagtgatgttaagca

SEQ ID NO: 134404 - DNA, 16 bp, H. sapiens
tcagtgatgttgagat

SEQ ID NO: 134405 - DNA, 16 bp, H. sapiens
tcagtgattttgaaat

SEQ ID NO: 134406 - DNA, 16 bp, H. sapiens
tcagtgatttttagta

SEQ ID NO: 134407 - DNA, 17 bp, H. sapiens
tcagtgcacggttagtg

SEQ ID NO: 134408 - DNA, 16 bp, H. sapiens
tcagtgcccatatcat

SEQ ID NO: 134409 - DNA, 16 bp, H. sapiens
tcagtgccctaaagag

SEQ ID NO: 134410 - DNA, 16 bp, H. sapiens
tcagtgcctactatgt

SEQ ID NO: 134411 - DNA, 16 bp, H. sapiens
tcagtgctcaatggtg

SEQ ID NO: 134412 - DNA, 16 bp, H. sapiens
tcagtgctttgagagg

SEQ ID NO: 134413 - DNA, 16 bp, H. sapiens
tcagtggaaacattac

SEQ ID NO: 134414 - DNA, 16 bp, H. sapiens
tcagtggaagaagtaa

SEQ ID NO: 134415 - DNA, 16 bp, H. sapiens
tcagtggaatagaatt

SEQ ID NO: 134416 - DNA, 16 bp, H. sapiens
tcagtggaatcataca

SEQ ID NO: 134417 - DNA, 16 bp, H. sapiens
tcagtggactgagaga

SEQ ID NO: 134418 - DNA, 16 bp, H. sapiens
tcagtggagaggagac

SEQ ID NO: 134419 - DNA, 16 bp, H. sapiens
tcagtggcacaatctt

SEQ ID NO: 134420 - DNA, 16 bp, H. sapiens
tcagtggctcacacct

SEQ ID NO: 134421 - DNA, 16 bp, H. sapiens
tcagtgggaaggggag

SEQ ID NO: 134422 - DNA, 16 bp, H. sapiens
tcagtgggacaagatg

SEQ ID NO: 134423 - DNA, 16 bp, H. sapiens
tcagtgggatggatgg

SEQ ID NO: 134424 - DNA, 16 bp, H. sapiens
tcagtggtaataaata

SEQ ID NO: 134425 - DNA, 16 bp, H. sapiens
tcagtggtgtctgtga

SEQ ID NO: 134426 - DNA, 16 bp, H. sapiens
tcagtggttcccaaat

SEQ ID NO: 134427 - DNA, 16 bp, H. sapiens
tcagtggttgccagga

SEQ ID NO: 134428 - DNA, 16 bp, H. sapiens
tcagtggttgcctggg

SEQ ID NO: 134429 - DNA, 16 bp, H. sapiens
tcagtggttttatttt

SEQ ID NO: 134430 - DNA, 16 bp, H. sapiens
tcagtgtacaagtctt

SEQ ID NO: 134431 - DNA, 16 bp, H. sapiens
tcagtgtccagagttt

SEQ ID NO: 134432 - DNA, 16 bp, H. sapiens
tcagtgtcttcatttt

SEQ ID NO: 134433 - DNA, 16 bp, H. sapiens
tcagtgtggcctggat

SEQ ID NO: 134434 - DNA, 16 bp, H. sapiens
tcagtgtggctggagg

SEQ ID NO: 134435 - DNA, 16 bp, H. sapiens
tcagtgtggttttgat

SEQ ID NO: 134436 - DNA, 16 bp, H. sapiens
tcagtgttctggaatc

SEQ ID NO: 134437 - DNA, 16 bp, H. sapiens
tcagtgtttcttttct

SEQ ID NO: 134438 - DNA, 16 bp, H. sapiens
tcagtgttttgtggtt

SEQ ID NO: 134439 - DNA, 16 bp, H. sapiens
tcagttaaacttcttt

SEQ ID NO: 134440 - DNA, 16 bp, H. sapiens
tcagttaatgaaaact

SEQ ID NO: 134441 - DNA, 16 bp, H. sapiens
tcagttactggggagg

SEQ ID NO: 134442 - DNA, 16 bp, H. sapiens
tcagttatcagatcaa

SEQ ID NO: 134443 - DNA, 16 bp, H. sapiens
tcagttattttgaaat

SEQ ID NO: 134444 - DNA, 16 bp, H. sapiens
tcagttcaaagaattt

SEQ ID NO: 134445 - DNA, 17 bp, H. sapiens
tcagttccagaccacca

SEQ ID NO: 134446 - DNA, 16 bp, H. sapiens
tcagttcccttctctg

SEQ ID NO: 134447 - DNA, 16 bp, H. sapiens
tcagttcctggtgagg

SEQ ID NO: 134448 - DNA, 16 bp, H. sapiens
tcagttctcatgctgc

SEQ ID NO: 134449 - DNA, 16 bp, H. sapiens
tcagttctccaacttt

SEQ ID NO: 134450 - DNA, 16 bp, H. sapiens
tcagttctgcaagatg

SEQ ID NO: 134451 - DNA, 41 bp, H. sapiens
tcagttcttgttaagaatctgacccctcaaactctacaacc

SEQ ID NO: 134452 - DNA, 16 bp, H. sapiens
tcagttctttaaaaaa

SEQ ID NO: 134453 - DNA, 16 bp, H. sapiens
tcagttgcactagcca

SEQ ID NO: 134454 - DNA, 16 bp, H. sapiens
tcagttgcatttttat

SEQ ID NO: 134455 - DNA, 16 bp, H. sapiens
tcagttggaagtgcag

SEQ ID NO: 134456 - DNA, 16 bp, H. sapiens
tcagttggctgtaagt

SEQ ID NO: 134457 - DNA, 16 bp, H. sapiens
tcagttggttccaagt

SEQ ID NO: 134458 - DNA, 16 bp, H. sapiens
tcagttgtaatttctc

SEQ ID NO: 134459 - DNA, 16 bp, H. sapiens
tcagttgttgtgtcta

SEQ ID NO: 134460 - DNA, 16 bp, H. sapiens
tcagttgttttaaaat

SEQ ID NO: 134461 - DNA, 16 bp, H. sapiens
tcagttgttttaattt

SEQ ID NO: 134462 - DNA, 16 bp, H. sapiens
tcagttgttttctttg

SEQ ID NO: 134463 - DNA, 16 bp, H. sapiens
tcagtttaatttgcag

SEQ ID NO: 134464 - DNA, 16 bp, H. sapiens
tcagtttactcatctg

SEQ ID NO: 134465 - DNA, 16 bp, H. sapiens
tcagtttcatcatttg

SEQ ID NO: 134466 - DNA, 16 bp, H. sapiens
tcagtttcatcttctg

SEQ ID NO: 134467 - DNA, 16 bp, H. sapiens
tcagtttccacagctg

SEQ ID NO: 134468 - DNA, 16 bp, H. sapiens
tcagtttccacatctg

SEQ ID NO: 134469 - DNA, 16 bp, H. sapiens
tcagtttccattttct

SEQ ID NO: 134470 - DNA, 16 bp, H. sapiens
tcagtttccccatttg

SEQ ID NO: 134471 - DNA, 16 bp, H. sapiens
tcagtttccccctctg

SEQ ID NO: 134472 - DNA, 16 bp, H. sapiens
tcagtttccccttctg

SEQ ID NO: 134473 - DNA, 16 bp, H. sapiens
tcagtttccctcctct

SEQ ID NO: 134474 - DNA, 16 bp, H. sapiens
tcagtttccctctctg

SEQ ID NO: 134475 - DNA, 16 bp, H. sapiens
tcagtttccctttctg

SEQ ID NO: 134476 - DNA, 16 bp, H. sapiens
tcagtttcctcaacta

SEQ ID NO: 134477 - DNA, 16 bp, H. sapiens
tcagtttcctcaagtg

SEQ ID NO: 134478 - DNA, 16 bp, H. sapiens
tcagtttcctctcctg

SEQ ID NO: 134479 - DNA, 16 bp, H. sapiens
tcagtttccttcagtt

SEQ ID NO: 134480 - DNA, 16 bp, H. sapiens
tcagtttccttccttt

SEQ ID NO: 134481 - DNA, 16 bp, H. sapiens
tcagtttccttctctg

SEQ ID NO: 134482 - DNA, 16 bp, H. sapiens
tcagtttctcagtcac

SEQ ID NO: 134483 - DNA, 16 bp, H. sapiens
tcagtttctccagctg

SEQ ID NO: 134484 - DNA, 16 bp, H. sapiens
tcagtttctctctctg

SEQ ID NO: 134485 - DNA, 16 bp, H. sapiens
tcagtttctctggaga

SEQ ID NO: 134486 - DNA, 16 bp, H. sapiens
tcagtttctgttgttt

SEQ ID NO: 134487 - DNA, 16 bp, H. sapiens
tcagtttctgttttct

SEQ ID NO: 134488 - DNA, 16 bp, H. sapiens
tcagtttctttctctg

SEQ ID NO: 134489 - DNA, 16 bp, H. sapiens
tcagtttgattctttc

SEQ ID NO: 134490 - DNA, 16 bp, H. sapiens
tcagtttgccaacatt

SEQ ID NO: 134491 - DNA, 16 bp, H. sapiens
tcagtttgggaagaat

SEQ ID NO: 134492 - DNA, 16 bp, H. sapiens
tcagttttaacaaatg

SEQ ID NO: 134493 - DNA, 16 bp, H. sapiens
tcagttttatcagaga

SEQ ID NO: 134494 - DNA, 16 bp, H. sapiens
tcagttttcaaatttt

SEQ ID NO: 134495 - DNA, 16 bp, H. sapiens
tcagttttccaaagtg

SEQ ID NO: 134496 - DNA, 16 bp, H. sapiens
tcagttttccagaaat

SEQ ID NO: 134497 - DNA, 16 bp, H. sapiens
tcagttttcctctctg

SEQ ID NO: 134498 - DNA, 16 bp, H. sapiens
tcagttttctcatttg

SEQ ID NO: 134499 - DNA, 16 bp, H. sapiens
tcagttttctcttctg

SEQ ID NO: 134500 - DNA, 16 bp, H. sapiens
tcagttttctctttta

SEQ ID NO: 134501 - DNA, 16 bp, H. sapiens
tcagttttggaagatg

SEQ ID NO: 134502 - DNA, 16 bp, H. sapiens
tcagttttgtcatctg

SEQ ID NO: 134503 - DNA, 16 bp, H. sapiens
tcagttttgttgttgt

SEQ ID NO: 134504 - DNA, 16 bp, H. sapiens
tcagttttgtttttaa

SEQ ID NO: 134505 - DNA, 16 bp, H. sapiens
tcagtttttaaaaact

SEQ ID NO: 134506 - DNA, 16 bp, H. sapiens
tcagtttttaaaataa

SEQ ID NO: 134507 - DNA, 16 bp, H. sapiens
tcagtttttaaaattt

SEQ ID NO: 134508 - DNA, 16 bp, H. sapiens
tcagtttttaaattta

SEQ ID NO: 134509 - DNA, 16 bp, H. sapiens
tcagtttttccatctg

SEQ ID NO: 134510 - DNA, 16 bp, H. sapiens
tcagtttttccctatt

SEQ ID NO: 134511 - DNA, 16 bp, H. sapiens
tcagtttttcttcctt

SEQ ID NO: 134512 - DNA, 16 bp, H. sapiens
tcagttttttaaaaat

SEQ ID NO: 134513 - DNA, 16 bp, H. sapiens
tcagttttttcacctg

SEQ ID NO: 134514 - DNA, 16 bp, H. sapiens
tcataaaaaaggaatg

SEQ ID NO: 134515 - DNA, 16 bp, H. sapiens
tcataaaaaggaatga

SEQ ID NO: 134516 - DNA, 16 bp, H. sapiens
tcataaaaaggatgag

SEQ ID NO: 134517 - DNA, 16 bp, H. sapiens
tcataaaagcaaaata

SEQ ID NO: 134518 - DNA, 16 bp, H. sapiens
tcataaaatgagtttg

SEQ ID NO: 134519 - DNA, 16 bp, H. sapiens
tcataaagacatacct

SEQ ID NO: 134520 - DNA, 16 bp, H. sapiens
tcataaagcaagctct

SEQ ID NO: 134521 - DNA, 16 bp, H. sapiens
tcataaagcaagtttt

SEQ ID NO: 134522 - DNA, 16 bp, H. sapiens
tcataaaggaaataaa

SEQ ID NO: 134523 - DNA, 16 bp, H. sapiens
tcataaaggtcttcat

SEQ ID NO: 134524 - DNA, 16 bp, H. sapiens
tcataaaggttttcat

SEQ ID NO: 134525 - DNA, 16 bp, H. sapiens
tcataaagtgctggga

SEQ ID NO: 134526 - DNA, 16 bp, H. sapiens
tcataaatattcatga

SEQ ID NO: 134527 - DNA, 16 bp, H. sapiens
tcataaattatttccc

SEQ ID NO: 134528 - DNA, 16 bp, H. sapiens
tcataaattctttccc

SEQ ID NO: 134529 - DNA, 16 bp, H. sapiens
tcataaatttgtttaa

SEQ ID NO: 134530 - DNA, 16 bp, H. sapiens
tcataacatggcagaa

SEQ ID NO: 134531 - DNA, 17 bp, H. sapiens
tcataacttccaaaatc

SEQ ID NO: 134532 - DNA, 16 bp, H. sapiens
tcataacttggctgtt

SEQ ID NO: 134533 - DNA, 16 bp, H. sapiens
tcataaggaaccaaaa

SEQ ID NO: 134534 - DNA, 16 bp, H. sapiens
tcataagttttaaatt

SEQ ID NO: 134535 - DNA, 16 bp, H. sapiens
tcataatattctctta

SEQ ID NO: 134536 - DNA, 16 bp, H. sapiens
tcataatcagtcaaaa

SEQ ID NO: 134537 - DNA, 16 bp, H. sapiens
tcataatgaagagaaa

SEQ ID NO: 134538 - DNA, 16 bp, H. sapiens
tcataatgaagtccag

SEQ ID NO: 134539 - DNA, 16 bp, H. sapiens
tcataatgttgtacaa

SEQ ID NO: 134540 - DNA, 16 bp, H. sapiens
tcataattaagttcaa

SEQ ID NO: 134541 - DNA, 16 bp, H. sapiens
tcataattattttgtt

SEQ ID NO: 134542 - DNA, 16 bp, H. sapiens
tcatacaatatgtggt

SEQ ID NO: 134543 - DNA, 16 bp, H. sapiens
tcatacaatccagcaa

SEQ ID NO: 134544 - DNA, 16 bp, H. sapiens
tcatacactgctggtg

SEQ ID NO: 134545 - DNA, 16 bp, H. sapiens
tcatacagatgaacaa

SEQ ID NO: 134546 - DNA, 16 bp, H. sapiens
tcatacatatatatat

SEQ ID NO: 134547 - DNA, 16 bp, H. sapiens
tcatacattcatttta

SEQ ID NO: 134548 - DNA, 16 bp, H. sapiens
tcatacattgttgatg

SEQ ID NO: 134549 - DNA, 16 bp, H. sapiens
tcataccactgcactt

SEQ ID NO: 134550 - DNA, 16 bp, H. sapiens
tcatactcaatgggca

SEQ ID NO: 134551 - DNA, 16 bp, H. sapiens
tcatactgaagagaaa

SEQ ID NO: 134552 - DNA, 18 bp, H. sapiens
tcatactgaatgggaaaa

SEQ ID NO: 134553 - DNA, 16 bp, H. sapiens
tcatactgctgataaa

SEQ ID NO: 134554 - DNA, 16 bp, H. sapiens
tcatactggaaagaaa

SEQ ID NO: 134555 - DNA, 16 bp, H. sapiens
tcatactggagagaaa

SEQ ID NO: 134556 - DNA, 16 bp, H. sapiens
tcatacttttttatgg

SEQ ID NO: 134557 - DNA, 16 bp, H. sapiens
tcatagaaaaggaaat

SEQ ID NO: 134558 - DNA, 16 bp, H. sapiens
tcatagaagaaaaaat

SEQ ID NO: 134559 - DNA, 16 bp, H. sapiens
tcatagaagaggaaac

SEQ ID NO: 134560 - DNA, 16 bp, H. sapiens
tcatagatttttaaaa

SEQ ID NO: 134561 - DNA, 16 bp, H. sapiens
tcatagcaaacagtct

SEQ ID NO: 134562 - DNA, 16 bp, H. sapiens
tcatagcaacattatt

SEQ ID NO: 134563 - DNA, 16 bp, H. sapiens
tcatagccaaattcta

SEQ ID NO: 134564 - DNA, 16 bp, H. sapiens
tcatagctcactgcat

SEQ ID NO: 134565 - DNA, 16 bp, H. sapiens
tcatagcttactgcag

SEQ ID NO: 134566 - DNA, 16 bp, H. sapiens
tcatagggttgttgag

SEQ ID NO: 134567 - DNA, 16 bp, H. sapiens
tcatagtattttaaaa

SEQ ID NO: 134568 - DNA, 16 bp, H. sapiens
tcatagtggagagaaa

SEQ ID NO: 134569 - DNA, 16 bp, H. sapiens
tcatataaacagaatc

SEQ ID NO: 134570 - DNA, 16 bp, H. sapiens
tcatataaatggaatt

SEQ ID NO: 134571 - DNA, 16 bp, H. sapiens
tcatataatcatttca

SEQ ID NO: 134572 - DNA, 16 bp, H. sapiens
tcatataatttttctc

SEQ ID NO: 134573 - DNA, 16 bp, H. sapiens
tcatatactgctggtg

SEQ ID NO: 134574 - DNA, 17 bp, H. sapiens
tcatataggtggctgcc

SEQ ID NO: 134575 - DNA, 16 bp, H. sapiens
tcatatataatcatat

SEQ ID NO: 134576 - DNA, 16 bp, H. sapiens
tcatatatacatatat

SEQ ID NO: 134577 - DNA, 16 bp, H. sapiens
tcatatatagccttta

SEQ ID NO: 134578 - DNA, 16 bp, H. sapiens
tcatatatatacacac

SEQ ID NO: 134579 - DNA, 16 bp, H. sapiens
tcatatatatgtgtat

SEQ ID NO: 134580 - DNA, 16 bp, H. sapiens
tcatatattctgaata

SEQ ID NO: 134581 - DNA, 16 bp, H. sapiens
tcatatattttctgtt

SEQ ID NO: 134582 - DNA, 16 bp, H. sapiens
tcatatattttggata

SEQ ID NO: 134583 - DNA, 16 bp, H. sapiens
tcatatcatcaacaaa

SEQ ID NO: 134584 - DNA, 16 bp, H. sapiens
tcatatcctttgcaca

SEQ ID NO: 134585 - DNA, 16 bp, H. sapiens
tcatatcctttgcccc

SEQ ID NO: 134586 - DNA, 16 bp, H. sapiens
tcatatctaagaaata

SEQ ID NO: 134587 - DNA, 16 bp, H. sapiens
tcatatctcagcctcc

SEQ ID NO: 134588 - DNA, 16 bp, H. sapiens
tcatatgcatattaaa

SEQ ID NO: 134589 - DNA, 16 bp, H. sapiens
tcatatgcattatctc

SEQ ID NO: 134590 - DNA, 16 bp, H. sapiens
tcatatgctgctggtg

SEQ ID NO: 134591 - DNA, 16 bp, H. sapiens
tcatatgtaaaatgga

SEQ ID NO: 134592 - DNA, 16 bp, H. sapiens
tcatatgtatttatat

SEQ ID NO: 134593 - DNA, 16 bp, H. sapiens
tcatatgttctcattg

SEQ ID NO: 134594 - DNA, 16 bp, H. sapiens
tcatattaatccttgt

SEQ ID NO: 134595 - DNA, 16 bp, H. sapiens
tcatattacctgactt

SEQ ID NO: 134596 - DNA, 16 bp, H. sapiens
tcatattattttgaaa

SEQ ID NO: 134597 - DNA, 16 bp, H. sapiens
tcatattgtaattcta

SEQ ID NO: 134598 - DNA, 16 bp, H. sapiens
tcatatttaatcctca

SEQ ID NO: 134599 - DNA, 16 bp, H. sapiens
tcatatttggaaaaac

SEQ ID NO: 134600 - DNA, 16 bp, H. sapiens
tcatattttaaaatgt

SEQ ID NO: 134601 - DNA, 16 bp, H. sapiens
tcatatttttaaagtt

SEQ ID NO: 134602 - DNA, 16 bp, H. sapiens
tcatcaaaaaccaaag

SEQ ID NO: 134603 - DNA, 16 bp, H. sapiens
tcatcaaaactaagaa

SEQ ID NO: 134604 - DNA, 16 bp, H. sapiens
tcatcaaaactttaaa

SEQ ID NO: 134605 - DNA, 16 bp, H. sapiens
tcatcaaaatttgaaa

SEQ ID NO: 134606 - DNA, 16 bp, H. sapiens
tcatcaaagtgaacag

SEQ ID NO: 134607 - DNA, 16 bp, H. sapiens
tcatcaaatatttact

SEQ ID NO: 134608 - DNA, 16 bp, H. sapiens
tcatcaaattcataga

SEQ ID NO: 134609 - DNA, 16 bp, H. sapiens
tcatcaacatcaccat

SEQ ID NO: 134610 - DNA, 16 bp, H. sapiens
tcatcacagtgggaac

SEQ ID NO: 134611 - DNA, 16 bp, H. sapiens
tcatcacatttttaaa

SEQ ID NO: 134612 - DNA, 16 bp, H. sapiens
tcatcaccaacatcat

SEQ ID NO: 134613 - DNA, 17 bp, H. sapiens
tcatcaccatcatcttc

SEQ ID NO: 134614 - DNA, 16 bp, H. sapiens
tcatcaccccccaaaa

SEQ ID NO: 134615 - DNA, 16 bp, H. sapiens
tcatcacctcccaaag

SEQ ID NO: 134616 - DNA, 16 bp, H. sapiens
tcatcactccagaaag

SEQ ID NO: 134617 - DNA, 16 bp, H. sapiens
tcatcagaaaaataca

SEQ ID NO: 134618 - DNA, 16 bp, H. sapiens
tcatcagaaacaatga

SEQ ID NO: 134619 - DNA, 16 bp, H. sapiens
tcatcagaatggcctt

SEQ ID NO: 134620 - DNA, 16 bp, H. sapiens
tcatcagaattaaaaa

SEQ ID NO: 134621 - DNA, 16 bp, H. sapiens
tcatcagacactgaat

SEQ ID NO: 134622 - DNA, 17 bp, H. sapiens
tcatcagactaacagca

SEQ ID NO: 134623 - DNA, 16 bp, H. sapiens
tcatcagagaatacta

SEQ ID NO: 134624 - DNA, 16 bp, H. sapiens
tcatcagcaaacagta

SEQ ID NO: 134625 - DNA, 16 bp, H. sapiens
tcatcagcagcagcag

SEQ ID NO: 134626 - DNA, 16 bp, H. sapiens
tcatcagcatatggaa

SEQ ID NO: 134627 - DNA, 16 bp, H. sapiens
tcatcagcatcaaaga

SEQ ID NO: 134628 - DNA, 16 bp, H. sapiens
tcatcaggaatattga

SEQ ID NO: 134629 - DNA, 16 bp, H. sapiens
tcatcaggctggtctc

SEQ ID NO: 134630 - DNA, 19 bp, H. sapiens
tcatcagtaattctaattt

SEQ ID NO: 134631 - DNA, 16 bp, H. sapiens
tcatcagtcagcagcc

SEQ ID NO: 134632 - DNA, 16 bp, H. sapiens
tcatcagtgaacagag

SEQ ID NO: 134633 - DNA, 16 bp, H. sapiens
tcatcagtgatattgg

SEQ ID NO: 134634 - DNA, 16 bp, H. sapiens
tcatcagtgttttgta

SEQ ID NO: 134635 - DNA, 16 bp, H. sapiens
tcatcagttaaagcag

SEQ ID NO: 134636 - DNA, 16 bp, H. sapiens
tcatcataaaggtttt

SEQ ID NO: 134637 - DNA, 16 bp, H. sapiens
tcatcataaagttctt

SEQ ID NO: 134638 - DNA, 16 bp, H. sapiens
tcatcatcaaaaggaa

SEQ ID NO: 134639 - DNA, 16 bp, H. sapiens
tcatcatcaagtggaa

SEQ ID NO: 134640 - DNA, 16 bp, H. sapiens
tcatcatcaatggcca

SEQ ID NO: 134641 - DNA, 16 bp, H. sapiens
tcatcatcaccaccac

SEQ ID NO: 134642 - DNA, 17 bp, H. sapiens
tcatcatcaccaccatc

SEQ ID NO: 134643 - DNA, 16 bp, H. sapiens
tcatcatcaccatcat

SEQ ID NO: 134644 - DNA, 17 bp, H. sapiens
tcatcatcactggtcat

SEQ ID NO: 134645 - DNA, 16 bp, H. sapiens
tcatcatcactgtcat

SEQ ID NO: 134646 - DNA, 16 bp, H. sapiens
tcatcatcataaaaat

SEQ ID NO: 134647 - DNA, 16 bp, H. sapiens
tcatcatcatcacaac

SEQ ID NO: 134648 - DNA, 16 bp, H. sapiens
tcatcatcatcaccac

SEQ ID NO: 134649 - DNA, 16 bp, H. sapiens
tcatcatcatcacctt

SEQ ID NO: 134650 - DNA, 16 bp, H. sapiens
tcatcatcatcactgt

SEQ ID NO: 134651 - DNA, 16 bp, H. sapiens
tcatcatcatcagcag

SEQ ID NO: 134652 - DNA, 16 bp, H. sapiens
tcatcatcatcataaa

SEQ ID NO: 134653 - DNA, 16 bp, H. sapiens
tcatcatcatcatcct

SEQ ID NO: 134654 - DNA, 16 bp, H. sapiens
tcatcatcatcatctc

SEQ ID NO: 134655 - DNA, 16 bp, H. sapiens
tcatcatcatcatctt

SEQ ID NO: 134656 - DNA, 16 bp, H. sapiens
tcatcatcatcattgt

SEQ ID NO: 134657 - DNA, 16 bp, H. sapiens
tcatcatcatcatttt

SEQ ID NO: 134658 - DNA, 16 bp, H. sapiens
tcatcatcatcttcac

SEQ ID NO: 134659 - DNA, 16 bp, H. sapiens
tcatcatcatcttctt

SEQ ID NO: 134660 - DNA, 16 bp, H. sapiens
tcatcatcatctttat

SEQ ID NO: 134661 - DNA, 16 bp, H. sapiens
tcatcatcatggtcat

SEQ ID NO: 134662 - DNA, 16 bp, H. sapiens
tcatcatcattattaa

SEQ ID NO: 134663 - DNA, 17 bp, H. sapiens
tcatcatcattggccat

SEQ ID NO: 134664 - DNA, 16 bp, H. sapiens
tcatcatcattgttgt

SEQ ID NO: 134665 - DNA, 16 bp, H. sapiens
tcatcatcctcatcac

SEQ ID NO: 134666 - DNA, 16 bp, H. sapiens
tcatcatcgtcatcat

SEQ ID NO: 134667 - DNA, 16 bp, H. sapiens
tcatcatctaggtttt

SEQ ID NO: 134668 - DNA, 16 bp, H. sapiens
tcatcatctctggcca

SEQ ID NO: 134669 - DNA, 16 bp, H. sapiens
tcatcatcttcatcac

SEQ ID NO: 134670 - DNA, 16 bp, H. sapiens
tcatcatcttcatgtt

SEQ ID NO: 134671 - DNA, 16 bp, H. sapiens
tcatcatcttgaaatt

SEQ ID NO: 134672 - DNA, 16 bp, H. sapiens
tcatcatctttgtcat

SEQ ID NO: 134673 - DNA, 16 bp, H. sapiens
tcatcatgaaatattt

SEQ ID NO: 134674 - DNA, 16 bp, H. sapiens
tcatcatgaaatcttt

SEQ ID NO: 134675 - DNA, 16 bp, H. sapiens
tcatcatgcccggcta

SEQ ID NO: 134676 - DNA, 16 bp, H. sapiens
tcatcatggaaatgca

SEQ ID NO: 134677 - DNA, 16 bp, H. sapiens
tcatcattagagaaat

SEQ ID NO: 134678 - DNA, 16 bp, H. sapiens
tcatcattcttcagtt

SEQ ID NO: 134679 - DNA, 16 bp, H. sapiens
tcatcattgtcatcat

SEQ ID NO: 134680 - DNA, 16 bp, H. sapiens
tcatcatttctactca

SEQ ID NO: 134681 - DNA, 16 bp, H. sapiens
tcatcattttctatgg

SEQ ID NO: 134682 - DNA, 16 bp, H. sapiens
tcatccaacaaccaca

SEQ ID NO: 134683 - DNA, 16 bp, H. sapiens
tcatccacctcggcct

SEQ ID NO: 134684 - DNA, 16 bp, H. sapiens
tcatccacgctggagt

SEQ ID NO: 134685 - DNA, 16 bp, H. sapiens
tcatccagactttgtt

SEQ ID NO: 134686 - DNA, 16 bp, H. sapiens
tcatccaggctaaagt

SEQ ID NO: 134687 - DNA, 16 bp, H. sapiens
tcatccaggctgaagt

SEQ ID NO: 134688 - DNA, 16 bp, H. sapiens
tcatccaggctggatt

SEQ ID NO: 134689 - DNA, 16 bp, H. sapiens
tcatccaggctggggt

SEQ ID NO: 134690 - DNA, 16 bp, H. sapiens
tcatccaggtccctgc

SEQ ID NO: 134691 - DNA, 16 bp, H. sapiens
tcatccataagaagca

SEQ ID NO: 134692 - DNA, 16 bp, H. sapiens
tcatccatccatctgt

SEQ ID NO: 134693 - DNA, 16 bp, H. sapiens
tcatccatgttgttac

SEQ ID NO: 134694 - DNA, 16 bp, H. sapiens
tcatccattcattcat

SEQ ID NO: 134695 - DNA, 16 bp, H. sapiens
tcatccattgtggaag

SEQ ID NO: 134696 - DNA, 16 bp, H. sapiens
tcatcccaaaaccatc

SEQ ID NO: 134697 - DNA, 16 bp, H. sapiens
tcatcccagggccagg

SEQ ID NO: 134698 - DNA, 16 bp, H. sapiens
tcatccccatcctgag

SEQ ID NO: 134699 - DNA, 16 bp, H. sapiens
tcatccccattttatg

SEQ ID NO: 134700 - DNA, 16 bp, H. sapiens
tcatccccattttcca

SEQ ID NO: 134701 - DNA, 16 bp, H. sapiens
tcatccctgggatgga

SEQ ID NO: 134702 - DNA, 16 bp, H. sapiens
tcatcccttatctaca

SEQ ID NO: 134703 - DNA, 16 bp, H. sapiens
tcatcctacaggaatc

SEQ ID NO: 134704 - DNA, 16 bp, H. sapiens
tcatcctactataaag

SEQ ID NO: 134705 - DNA, 16 bp, H. sapiens
tcatcctcactgctac

SEQ ID NO: 134706 - DNA, 16 bp, H. sapiens
tcatcctcatcatcct

SEQ ID NO: 134707 - DNA, 16 bp, H. sapiens
tcatcctcattgtctt

SEQ ID NO: 134708 - DNA, 16 bp, H. sapiens
tcatcctccagctgaa

SEQ ID NO: 134709 - DNA, 16 bp, H. sapiens
tcatcctctcacctca

SEQ ID NO: 134710 - DNA, 16 bp, H. sapiens
tcatcctcttcatctt

SEQ ID NO: 134711 - DNA, 16 bp, H. sapiens
tcatcctcttcttcat

SEQ ID NO: 134712 - DNA, 16 bp, H. sapiens
tcatcctcttttatgg

SEQ ID NO: 134713 - DNA, 16 bp, H. sapiens
tcatcctgaaaccaaa

SEQ ID NO: 134714 - DNA, 16 bp, H. sapiens
tcatcctgaagccatc

SEQ ID NO: 134715 - DNA, 16 bp, H. sapiens
tcatcctgaagctatc

SEQ ID NO: 134716 - DNA, 16 bp, H. sapiens
tcatcctgcctcagcc

SEQ ID NO: 134717 - DNA, 16 bp, H. sapiens
tcatcctgggcaacat

SEQ ID NO: 134718 - DNA, 16 bp, H. sapiens
tcatcctgggcctcac

SEQ ID NO: 134719 - DNA, 22 bp, H. sapiens
tcatccttcaacctggcacttt

SEQ ID NO: 134720 - DNA, 16 bp, H. sapiens
tcatccttcccatcat

SEQ ID NO: 134721 - DNA, 16 bp, H. sapiens
tcatccttgactcctt

SEQ ID NO: 134722 - DNA, 16 bp, H. sapiens
tcatccttgcattcct

SEQ ID NO: 134723 - DNA, 16 bp, H. sapiens
tcatccttgtcttcat

SEQ ID NO: 134724 - DNA, 16 bp, H. sapiens
tcatcctttctctcat

SEQ ID NO: 134725 - DNA, 16 bp, H. sapiens
tcatcgtcatcatcat

SEQ ID NO: 134726 - DNA, 16 bp, H. sapiens
tcatctaaaaaatggg

SEQ ID NO: 134727 - DNA, 16 bp, H. sapiens
tcatctaatttttgta

SEQ ID NO: 134728 - DNA, 16 bp, H. sapiens
tcatctacactgaaaa

SEQ ID NO: 134729 - DNA, 16 bp, H. sapiens
tcatctacattgtagc

SEQ ID NO: 134730 - DNA, 16 bp, H. sapiens
tcatctatatcctttg

SEQ ID NO: 134731 - DNA, 16 bp, H. sapiens
tcatctatgtagaaaa

SEQ ID NO: 134732 - DNA, 16 bp, H. sapiens
tcatctatgtgtctgt

SEQ ID NO: 134733 - DNA, 16 bp, H. sapiens
tcatctcaaaaaaaca

SEQ ID NO: 134734 - DNA, 16 bp, H. sapiens
tcatctcaaaaggaaa

SEQ ID NO: 134735 - DNA, 16 bp, H. sapiens
tcatctcaagaaacca

SEQ ID NO: 134736 - DNA, 16 bp, H. sapiens
tcatctcaccccattt

SEQ ID NO: 134737 - DNA, 16 bp, H. sapiens
tcatctcagcactttg

SEQ ID NO: 134738 - DNA, 16 bp, H. sapiens
tcatctcagcctcctg

SEQ ID NO: 134739 - DNA, 16 bp, H. sapiens
tcatctcagccttcca

SEQ ID NO: 134740 - DNA, 16 bp, H. sapiens
tcatctcattgggact

SEQ ID NO: 134741 - DNA, 16 bp, H. sapiens
tcatctccaaagccca

SEQ ID NO: 134742 - DNA, 16 bp, H. sapiens
tcatctccatctgaga

SEQ ID NO: 134743 - DNA, 16 bp, H. sapiens
tcatctcccaccaggc

SEQ ID NO: 134744 - DNA, 16 bp, H. sapiens
tcatctcccaggttca

SEQ ID NO: 134745 - DNA, 16 bp, H. sapiens
tcatctccctcagcag

SEQ ID NO: 134746 - DNA, 16 bp, H. sapiens
tcatctcctgctgtgt

SEQ ID NO: 134747 - DNA, 16 bp, H. sapiens
tcatctctaaaaaata

SEQ ID NO: 134748 - DNA, 16 bp, H. sapiens
tcatctctaaaatggg

SEQ ID NO: 134749 - DNA, 17 bp, H. sapiens
tcatctctacaaaaaaa

SEQ ID NO: 134750 - DNA, 17 bp, H. sapiens
tcatctctacaaaaaat

SEQ ID NO: 134751 - DNA, 16 bp, H. sapiens
tcatctctcacctgaa

SEQ ID NO: 134752 - DNA, 16 bp, H. sapiens
tcatctctcattttat

SEQ ID NO: 134753 - DNA, 16 bp, H. sapiens
tcatctctgatttctc

SEQ ID NO: 134754 - DNA, 16 bp, H. sapiens
tcatctctgcctccca

SEQ ID NO: 134755 - DNA, 16 bp, H. sapiens
tcatctcttgcctgaa

SEQ ID NO: 134756 - DNA, 16 bp, H. sapiens
tcatctgatcttgtgg

SEQ ID NO: 134757 - DNA, 16 bp, H. sapiens
tcatctgatttttaaa

SEQ ID NO: 134758 - DNA, 16 bp, H. sapiens
tcatctgcaaaatgga

SEQ ID NO: 134759 - DNA, 16 bp, H. sapiens
tcatctgcaaacaaag

SEQ ID NO: 134760 - DNA, 16 bp, H. sapiens
tcatctgcaaacagac

SEQ ID NO: 134761 - DNA, 16 bp, H. sapiens
tcatctgcaaataaag

SEQ ID NO: 134762 - DNA, 16 bp, H. sapiens
tcatctgcctcttcct

SEQ ID NO: 134763 - DNA, 16 bp, H. sapiens
tcatctgggaaatggg

SEQ ID NO: 134764 - DNA, 16 bp, H. sapiens
tcatctgggaagcttt

SEQ ID NO: 134765 - DNA, 16 bp, H. sapiens
tcatctgggacaaggc

SEQ ID NO: 134766 - DNA, 16 bp, H. sapiens
tcatctgggctgcctg

SEQ ID NO: 134767 - DNA, 16 bp, H. sapiens
tcatctgtaaaactgg

SEQ ID NO: 134768 - DNA, 16 bp, H. sapiens
tcatctgtaaaatagg

SEQ ID NO: 134769 - DNA, 16 bp, H. sapiens
tcatctgtaaaatagt

SEQ ID NO: 134770 - DNA, 16 bp, H. sapiens
tcatctgtaaaatggt

SEQ ID NO: 134771 - DNA, 16 bp, H. sapiens
tcatctgtaacatggg

SEQ ID NO: 134772 - DNA, 16 bp, H. sapiens
tcatctgtaagatgga

SEQ ID NO: 134773 - DNA, 16 bp, H. sapiens
tcatctgtcaaatgga

SEQ ID NO: 134774 - DNA, 16 bp, H. sapiens
tcatctgtgaaagggg

SEQ ID NO: 134775 - DNA, 16 bp, H. sapiens
tcatctgtgaaatggg

SEQ ID NO: 134776 - DNA, 16 bp, H. sapiens
tcatctgtgaataaag

SEQ ID NO: 134777 - DNA, 16 bp, H. sapiens
tcatctgtgggagcta

SEQ ID NO: 134778 - DNA, 16 bp, H. sapiens
tcatctgtttatggac

SEQ ID NO: 134779 - DNA, 16 bp, H. sapiens
tcatcttaatttcttc

SEQ ID NO: 134780 - DNA, 16 bp, H. sapiens
tcatcttacaaaactg

SEQ ID NO: 134781 - DNA, 16 bp, H. sapiens
tcatcttcaatttatt

SEQ ID NO: 134782 - DNA, 16 bp, H. sapiens
tcatcttcaccatcat

SEQ ID NO: 134783 - DNA, 16 bp, H. sapiens
tcatcttcatatttga

SEQ ID NO: 134784 - DNA, 16 bp, H. sapiens
tcatcttcatcttcat

SEQ ID NO: 134785 - DNA, 16 bp, H. sapiens
tcatcttccctgttgg

SEQ ID NO: 134786 - DNA, 16 bp, H. sapiens
tcatcttcctaaactg

SEQ ID NO: 134787 - DNA, 16 bp, H. sapiens
tcatcttcctcatctg

SEQ ID NO: 134788 - DNA, 16 bp, H. sapiens
tcatcttctagaattt

SEQ ID NO: 134789 - DNA, 16 bp, H. sapiens
tcatcttctgagaagg

SEQ ID NO: 134790 - DNA, 16 bp, H. sapiens
tcatcttctgccatga

SEQ ID NO: 134791 - DNA, 16 bp, H. sapiens
tcatcttcttcctggt

SEQ ID NO: 134792 - DNA, 16 bp, H. sapiens
tcatcttgaatggtaa

SEQ ID NO: 134793 - DNA, 17 bp, H. sapiens
tcatcttgaattgtaat

SEQ ID NO: 134794 - DNA, 16 bp, H. sapiens
tcatcttgaattttag

SEQ ID NO: 134795 - DNA, 16 bp, H. sapiens
tcatcttgagatcttt

SEQ ID NO: 134796 - DNA, 16 bp, H. sapiens
tcatcttgagttaatt

SEQ ID NO: 134797 - DNA, 16 bp, H. sapiens
tcatcttgtacatttc

SEQ ID NO: 134798 - DNA, 16 bp, H. sapiens
tcatctttaaaagaaa

SEQ ID NO: 134799 - DNA, 16 bp, H. sapiens
tcatctttaaaataaa

SEQ ID NO: 134800 - DNA, 16 bp, H. sapiens
tcatctttacaaaaat

SEQ ID NO: 134801 - DNA, 16 bp, H. sapiens
tcatctttggaatttt

SEQ ID NO: 134802 - DNA, 16 bp, H. sapiens
tcatctttggagaaat

SEQ ID NO: 134803 - DNA, 16 bp, H. sapiens
tcatctttgtatctcc

SEQ ID NO: 134804 - DNA, 16 bp, H. sapiens
tcatctttgtggtttt

SEQ ID NO: 134805 - DNA, 16 bp, H. sapiens
tcatcttttaaaaata

SEQ ID NO: 134806 - DNA, 16 bp, H. sapiens
tcatcttttcaaagaa

SEQ ID NO: 134807 - DNA, 16 bp, H. sapiens
tcatcttttgagaaat

SEQ ID NO: 134808 - DNA, 16 bp, H. sapiens
tcatcttttgcctgga

SEQ ID NO: 134809 - DNA, 16 bp, H. sapiens
tcatctttttactttg

SEQ ID NO: 134810 - DNA, 16 bp, H. sapiens
tcatgaaaaagtttct

SEQ ID NO: 134811 - DNA, 16 bp, H. sapiens
tcatgaaaaataaaat

SEQ ID NO: 134812 - DNA, 16 bp, H. sapiens
tcatgaaaaatgaaaa

SEQ ID NO: 134813 - DNA, 16 bp, H. sapiens
tcatgaaaatgaaaat

SEQ ID NO: 134814 - DNA, 16 bp, H. sapiens
tcatgaaaatgtccat

SEQ ID NO: 134815 - DNA, 16 bp, H. sapiens
tcatgaaacaagttct

SEQ ID NO: 134816 - DNA, 16 bp, H. sapiens
tcatgaaagacaaaaa

SEQ ID NO: 134817 - DNA, 16 bp, H. sapiens
tcatgaaagacaaaga

SEQ ID NO: 134818 - DNA, 16 bp, H. sapiens
tcatgaaagataaaga

SEQ ID NO: 134819 - DNA, 16 bp, H. sapiens
tcatgaaaggaagagt

SEQ ID NO: 134820 - DNA, 16 bp, H. sapiens
tcatgaaataaaatta

SEQ ID NO: 134821 - DNA, 16 bp, H. sapiens
tcatgaaatctttgcc

SEQ ID NO: 134822 - DNA, 16 bp, H. sapiens
tcatgaaatctttgtc

SEQ ID NO: 134823 - DNA, 16 bp, H. sapiens
tcatgaacacaaagaa

SEQ ID NO: 134824 - DNA, 16 bp, H. sapiens
tcatgaacaggaagaa

SEQ ID NO: 134825 - DNA, 16 bp, H. sapiens
tcatgaacatagatgt

SEQ ID NO: 134826 - DNA, 16 bp, H. sapiens
tcatgaacatgaaata

SEQ ID NO: 134827 - DNA, 16 bp, H. sapiens
tcatgaacatggtata

SEQ ID NO: 134828 - DNA, 16 bp, H. sapiens
tcatgaacatttcagc

SEQ ID NO: 134829 - DNA, 16 bp, H. sapiens
tcatgaaccagcctct

SEQ ID NO: 134830 - DNA, 16 bp, H. sapiens
tcatgaagaaatgttg

SEQ ID NO: 134831 - DNA, 16 bp, H. sapiens
tcatgaagaactttct

SEQ ID NO: 134832 - DNA, 16 bp, H. sapiens
tcatgaagacagcacc

SEQ ID NO: 134833 - DNA, 16 bp, H. sapiens
tcatgaagatggagcc

SEQ ID NO: 134834 - DNA, 16 bp, H. sapiens
tcatgaagcttatatt

SEQ ID NO: 134835 - DNA, 16 bp, H. sapiens
tcatgaaggtagagag

SEQ ID NO: 134836 - DNA, 16 bp, H. sapiens
tcatgaagtatttgtc

SEQ ID NO: 134837 - DNA, 16 bp, H. sapiens
tcatgaatatattaat

SEQ ID NO: 134838 - DNA, 16 bp, H. sapiens
tcatgaatatttttct

SEQ ID NO: 134839 - DNA, 16 bp, H. sapiens
tcatgaatgacttggt

SEQ ID NO: 134840 - DNA, 16 bp, H. sapiens
tcatgaatggattaat

SEQ ID NO: 134841 - DNA, 16 bp, H. sapiens
tcatgaatgggattcg

SEQ ID NO: 134842 - DNA, 16 bp, H. sapiens
tcatgacattacaaga

SEQ ID NO: 134843 - DNA, 16 bp, H. sapiens
tcatgacattttattt

SEQ ID NO: 134844 - DNA, 16 bp, H. sapiens
tcatgactcaatcacc

SEQ ID NO: 134845 - DNA, 16 bp, H. sapiens
tcatgactttcacaga

SEQ ID NO: 134846 - DNA, 16 bp, H. sapiens
tcatgagaacagaaag

SEQ ID NO: 134847 - DNA, 17 bp, H. sapiens
tcatgagacttattcat

SEQ ID NO: 134848 - DNA, 16 bp, H. sapiens
tcatgagagcagagcc

SEQ ID NO: 134849 - DNA, 16 bp, H. sapiens
tcatgagcatgaaatg

SEQ ID NO: 134850 - DNA, 16 bp, H. sapiens
tcatgagctaatcacc

SEQ ID NO: 134851 - DNA, 16 bp, H. sapiens
tcatgagctcaggaga

SEQ ID NO: 134852 - DNA, 16 bp, H. sapiens
tcatgaggatggggcc

SEQ ID NO: 134853 - DNA, 16 bp, H. sapiens
tcatgaggctgcagtc

SEQ ID NO: 134854 - DNA, 16 bp, H. sapiens
tcatgagggctctgcc

SEQ ID NO: 134855 - DNA, 16 bp, H. sapiens
tcatgagtgggagttg

SEQ ID NO: 134856 - DNA, 16 bp, H. sapiens
tcatgataaaagccct

SEQ ID NO: 134857 - DNA, 16 bp, H. sapiens
tcatgatagtgaattc

SEQ ID NO: 134858 - DNA, 16 bp, H. sapiens
tcatgatcaaacttga

SEQ ID NO: 134859 - DNA, 16 bp, H. sapiens
tcatgatccaaacacc

SEQ ID NO: 134860 - DNA, 16 bp, H. sapiens
tcatgatccaccagcc

SEQ ID NO: 134861 - DNA, 16 bp, H. sapiens
tcatgatgatgataat

SEQ ID NO: 134862 - DNA, 16 bp, H. sapiens
tcatgatggaagggga

SEQ ID NO: 134863 - DNA, 16 bp, H. sapiens
tcatgatgtctttgcc

SEQ ID NO: 134864 - DNA, 16 bp, H. sapiens
tcatgatgttctctct

SEQ ID NO: 134865 - DNA, 16 bp, H. sapiens
tcatgattaaattcag

SEQ ID NO: 134866 - DNA, 16 bp, H. sapiens
tcatgattagattgag

SEQ ID NO: 134867 - DNA, 16 bp, H. sapiens
tcatgattgcaccact

SEQ ID NO: 134868 - DNA, 16 bp, H. sapiens
tcatgatttcatttca

SEQ ID NO: 134869 - DNA, 17 bp, H. sapiens
tcatgatttgcccgcct

SEQ ID NO: 134870 - DNA, 16 bp, H. sapiens
tcatgatttttatctt

SEQ ID NO: 134871 - DNA, 16 bp, H. sapiens
tcatgcaagatctggt

SEQ ID NO: 134872 - DNA, 16 bp, H. sapiens
tcatgcactaggcccc

SEQ ID NO: 134873 - DNA, 16 bp, H. sapiens
tcatgcagaaccatct

SEQ ID NO: 134874 - DNA, 16 bp, H. sapiens
tcatgcatatttattt

SEQ ID NO: 134875 - DNA, 16 bp, H. sapiens
tcatgcatattttaaa

SEQ ID NO: 134876 - DNA, 16 bp, H. sapiens
tcatgcatgcattcat

SEQ ID NO: 134877 - DNA, 16 bp, H. sapiens
tcatgccaaattgtaa

SEQ ID NO: 134878 - DNA, 16 bp, H. sapiens
tcatgccactgcacta

SEQ ID NO: 134879 - DNA, 16 bp, H. sapiens
tcatgccactgcagcc

SEQ ID NO: 134880 - DNA, 16 bp, H. sapiens
tcatgccactgcagtc

SEQ ID NO: 134881 - DNA, 16 bp, H. sapiens
tcatgccactgctttc

SEQ ID NO: 134882 - DNA, 16 bp, H. sapiens
tcatgccactgtactg

SEQ ID NO: 134883 - DNA, 16 bp, H. sapiens
tcatgccactgtagtc

SEQ ID NO: 134884 - DNA, 16 bp, H. sapiens
tcatgccagtcagaat

SEQ ID NO: 134885 - DNA, 16 bp, H. sapiens
tcatgccatttagaat

SEQ ID NO: 134886 - DNA, 17 bp, H. sapiens
tcatgcctcagcctccg

SEQ ID NO: 134887 - DNA, 17 bp, H. sapiens
tcatgcctgaaatccca

SEQ ID NO: 134888 - DNA, 16 bp, H. sapiens
tcatgccttcccaaga

SEQ ID NO: 134889 - DNA, 16 bp, H. sapiens
tcatgctacagagaaa

SEQ ID NO: 134890 - DNA, 16 bp, H. sapiens
tcatgctacctgacct

SEQ ID NO: 134891 - DNA, 16 bp, H. sapiens
tcatgctcctgcactc

SEQ ID NO: 134892 - DNA, 16 bp, H. sapiens
tcatgctgaaatttaa

SEQ ID NO: 134893 - DNA, 17 bp, H. sapiens
tcatgctgaattgtaat

SEQ ID NO: 134894 - DNA, 16 bp, H. sapiens
tcatgctgctgagaaa

SEQ ID NO: 134895 - DNA, 16 bp, H. sapiens
tcatgctgctgctgct

SEQ ID NO: 134896 - DNA, 16 bp, H. sapiens
tcatgctgcttgctgt

SEQ ID NO: 134897 - DNA, 16 bp, H. sapiens
tcatgctgttgcccag

SEQ ID NO: 134898 - DNA, 16 bp, H. sapiens
tcatgctgttttgttt

SEQ ID NO: 134899 - DNA, 16 bp, H. sapiens
tcatgctttcccaaca

SEQ ID NO: 134900 - DNA, 16 bp, H. sapiens
tcatgctttttaaaaa

SEQ ID NO: 134901 - DNA, 16 bp, H. sapiens
tcatgctttttaaatt

SEQ ID NO: 134902 - DNA, 16 bp, H. sapiens
tcatggaaaaaataaa

SEQ ID NO: 134903 - DNA, 16 bp, H. sapiens
tcatggaaaagataaa

SEQ ID NO: 134904 - DNA, 16 bp, H. sapiens
tcatggaaattatttt

SEQ ID NO: 134905 - DNA, 16 bp, H. sapiens
tcatggagaacctctt

SEQ ID NO: 134906 - DNA, 16 bp, H. sapiens
tcatggagcttacatt

SEQ ID NO: 134907 - DNA, 16 bp, H. sapiens
tcatggagcttatatt

SEQ ID NO: 134908 - DNA, 16 bp, H. sapiens
tcatggaggcagtttc

SEQ ID NO: 134909 - DNA, 16 bp, H. sapiens
tcatggaggtggtttc

SEQ ID NO: 134910 - DNA, 19 bp, H. sapiens
tcatggataggaagaatca

SEQ ID NO: 134911 - DNA, 16 bp, H. sapiens
tcatggataggaataa

SEQ ID NO: 134912 - DNA, 16 bp, H. sapiens
tcatggatcatgcctt

SEQ ID NO: 134913 - DNA, 17 bp, H. sapiens
tcatggatgaagctgga

SEQ ID NO: 134914 - DNA, 16 bp, H. sapiens
tcatggatgacttgga

SEQ ID NO: 134915 - DNA, 16 bp, H. sapiens
tcatggattctgccaa

SEQ ID NO: 134916 - DNA, 16 bp, H. sapiens
tcatggattggaagaa

SEQ ID NO: 134917 - DNA, 16 bp, H. sapiens
tcatggattttttgaa

SEQ ID NO: 134918 - DNA, 16 bp, H. sapiens
tcatggcaccccaaaa

SEQ ID NO: 134919 - DNA, 16 bp, H. sapiens
tcatggcagaagagaa

SEQ ID NO: 134920 - DNA, 16 bp, H. sapiens
tcatggcagaaggaaa

SEQ ID NO: 134921 - DNA, 16 bp, H. sapiens
tcatggcagaagtgga

SEQ ID NO: 134922 - DNA, 16 bp, H. sapiens
tcatggcagagggcaa

SEQ ID NO: 134923 - DNA, 16 bp, H. sapiens
tcatggcaggaggcaa

SEQ ID NO: 134924 - DNA, 16 bp, H. sapiens
tcatggcccactgcaa

SEQ ID NO: 134925 - DNA, 16 bp, H. sapiens
tcatggcccccttcct

SEQ ID NO: 134926 - DNA, 16 bp, H. sapiens
tcatggccccttcctc

SEQ ID NO: 134927 - DNA, 16 bp, H. sapiens
tcatggcgaaaggcaa

SEQ ID NO: 134928 - DNA, 16 bp, H. sapiens
tcatggctattgtaaa

SEQ ID NO: 134929 - DNA, 16 bp, H. sapiens
tcatggctcacacctg

SEQ ID NO: 134930 - DNA, 16 bp, H. sapiens
tcatggctcactgaag

SEQ ID NO: 134931 - DNA, 16 bp, H. sapiens
tcatggctggagcagc

SEQ ID NO: 134932 - DNA, 16 bp, H. sapiens
tcatggctgggaactc

SEQ ID NO: 134933 - DNA, 16 bp, H. sapiens
tcatgggaagatattt

SEQ ID NO: 134934 - DNA, 16 bp, H. sapiens
tcatgggaaggacctg

SEQ ID NO: 134935 - DNA, 16 bp, H. sapiens
tcatgggaccaccatc

SEQ ID NO: 134936 - DNA, 16 bp, H. sapiens
tcatgggagaaggtca

SEQ ID NO: 134937 - DNA, 16 bp, H. sapiens
tcatgggagcccacct

SEQ ID NO: 134938 - DNA, 16 bp, H. sapiens
tcatgggctcaagcga

SEQ ID NO: 134939 - DNA, 16 bp, H. sapiens
tcatgggggaaggtga

SEQ ID NO: 134940 - DNA, 16 bp, H. sapiens
tcatgggggcagagcc

SEQ ID NO: 134941 - DNA, 16 bp, H. sapiens
tcatgggggcagatct

SEQ ID NO: 134942 - DNA, 16 bp, H. sapiens
tcatgggggcggttcc

SEQ ID NO: 134943 - DNA, 16 bp, H. sapiens
tcatggggtctcctgc

SEQ ID NO: 134944 - DNA, 16 bp, H. sapiens
tcatggggtggggaga

SEQ ID NO: 134945 - DNA, 16 bp, H. sapiens
tcatggggtgggggag

SEQ ID NO: 134946 - DNA, 16 bp, H. sapiens
tcatggggttgctgtg

SEQ ID NO: 134947 - DNA, 16 bp, H. sapiens
tcatggtgaattatct

SEQ ID NO: 134948 - DNA, 16 bp, H. sapiens
tcatggtgcattatct

SEQ ID NO: 134949 - DNA, 16 bp, H. sapiens
tcatggtggaaagcaa

SEQ ID NO: 134950 - DNA, 16 bp, H. sapiens
tcatggtggcaggcac

SEQ ID NO: 134951 - DNA, 16 bp, H. sapiens
tcatggttctgcagcc

SEQ ID NO: 134952 - DNA, 16 bp, H. sapiens
tcatggttctggaggc

SEQ ID NO: 134953 - DNA, 16 bp, H. sapiens
tcatggtttcagttac

SEQ ID NO: 134954 - DNA, 16 bp, H. sapiens
tcatggtttttaaaat

SEQ ID NO: 134955 - DNA, 16 bp, H. sapiens
tcatgtaaataaaaat

SEQ ID NO: 134956 - DNA, 16 bp, H. sapiens
tcatgtaaatgaaatc

SEQ ID NO: 134957 - DNA, 16 bp, H. sapiens
tcatgtaacaaacctg

SEQ ID NO: 134958 - DNA, 16 bp, H. sapiens
tcatgtaatttattaa

SEQ ID NO: 134959 - DNA, 16 bp, H. sapiens
tcatgtaatttattga

SEQ ID NO: 134960 - DNA, 16 bp, H. sapiens
tcatgtaatttttgtt

SEQ ID NO: 134961 - DNA, 16 bp, H. sapiens
tcatgtacatgttttt

SEQ ID NO: 134962 - DNA, 16 bp, H. sapiens
tcatgtaccccataaa

SEQ ID NO: 134963 - DNA, 16 bp, H. sapiens
tcatgtagtcccagct

SEQ ID NO: 134964 - DNA, 16 bp, H. sapiens
tcatgtagtttttgtc

SEQ ID NO: 134965 - DNA, 16 bp, H. sapiens
tcatgtatttctttat

SEQ ID NO: 134966 - DNA, 16 bp, H. sapiens
tcatgtatttgtttat

SEQ ID NO: 134967 - DNA, 16 bp, H. sapiens
tcatgtattttaattt

SEQ ID NO: 134968 - DNA, 16 bp, H. sapiens
tcatgtcaaattgtaa

SEQ ID NO: 134969 - DNA, 16 bp, H. sapiens
tcatgtcatctacaaa

SEQ ID NO: 134970 - DNA, 16 bp, H. sapiens
tcatgtcatctgtaaa

SEQ ID NO: 134971 - DNA, 16 bp, H. sapiens
tcatgtcatttgtagc

SEQ ID NO: 134972 - DNA, 16 bp, H. sapiens
tcatgtccttcacagg

SEQ ID NO: 134973 - DNA, 16 bp, H. sapiens
tcatgtccttcaccca

SEQ ID NO: 134974 - DNA, 16 bp, H. sapiens
tcatgtcctttgcagg

SEQ ID NO: 134975 - DNA, 16 bp, H. sapiens
tcatgtctccgtgcag

SEQ ID NO: 134976 - DNA, 16 bp, H. sapiens
tcatgtctgtagtccc

SEQ ID NO: 134977 - DNA, 16 bp, H. sapiens
tcatgtgaactgaaag

SEQ ID NO: 134978 - DNA, 16 bp, H. sapiens
tcatgtgcagagacat

SEQ ID NO: 134979 - DNA, 16 bp, H. sapiens
tcatgtgccaccacgc

SEQ ID NO: 134980 - DNA, 16 bp, H. sapiens
tcatgtgctgatgaaa

SEQ ID NO: 134981 - DNA, 16 bp, H. sapiens
tcatgtgcttattgtc

SEQ ID NO: 134982 - DNA, 16 bp, H. sapiens
tcatgtggtttttctt

SEQ ID NO: 134983 - DNA, 16 bp, H. sapiens
tcatgtggtttttgtg

SEQ ID NO: 134984 - DNA, 16 bp, H. sapiens
tcatgtggtttttgtt

SEQ ID NO: 134985 - DNA, 16 bp, H. sapiens
tcatgtgttcactgga

SEQ ID NO: 134986 - DNA, 16 bp, H. sapiens
tcatgtgttgaagtcc

SEQ ID NO: 134987 - DNA, 16 bp, H. sapiens
tcatgtgtttgttggt

SEQ ID NO: 134988 - DNA, 16 bp, H. sapiens
tcatgttaaaaagtct

SEQ ID NO: 134989 - DNA, 16 bp, H. sapiens
tcatgttattttttaa

SEQ ID NO: 134990 - DNA, 16 bp, H. sapiens
tcatgttccagatctt

SEQ ID NO: 134991 - DNA, 16 bp, H. sapiens
tcatgttctttgccca

SEQ ID NO: 134992 - DNA, 16 bp, H. sapiens
tcatgttctttgtagc

SEQ ID NO: 134993 - DNA, 16 bp, H. sapiens
tcatgttgatagcatg

SEQ ID NO: 134994 - DNA, 16 bp, H. sapiens
tcatgttgctcaggct

SEQ ID NO: 134995 - DNA, 16 bp, H. sapiens
tcatgttggattaagg

SEQ ID NO: 134996 - DNA, 16 bp, H. sapiens
tcatgttggcactcaa

SEQ ID NO: 134997 - DNA, 16 bp, H. sapiens
tcatgttggcctggct

SEQ ID NO: 134998 - DNA, 16 bp, H. sapiens
tcatgttgtatgcctt

SEQ ID NO: 134999 - DNA, 16 bp, H. sapiens
tcatgttgtctgtaaa

SEQ ID NO: 135000 - DNA, 16 bp, H. sapiens
tcatgtttaaaaaaaa

SEQ ID NO: 135001 - DNA, 16 bp, H. sapiens
tcatgtttgttagcca

SEQ ID NO: 135002 - DNA, 16 bp, H. sapiens
tcatgttttaaaatat

SEQ ID NO: 135003 - DNA, 16 bp, H. sapiens
tcatgtttttataaaa

SEQ ID NO: 135004 - DNA, 16 bp, H. sapiens
tcatgtttttggtgtt

SEQ ID NO: 135005 - DNA, 16 bp, H. sapiens
tcatgtttttttcctg

SEQ ID NO: 135006 - DNA, 16 bp, H. sapiens
tcattaaaaagataaa

SEQ ID NO: 135007 - DNA, 16 bp, H. sapiens
tcattaaaaagtcaaa

SEQ ID NO: 135008 - DNA, 16 bp, H. sapiens
tcattaaaacattttt

SEQ ID NO: 135009 - DNA, 16 bp, H. sapiens
tcattaaaaggaaaat

SEQ ID NO: 135010 - DNA, 16 bp, H. sapiens
tcattaaaatgtccat

SEQ ID NO: 135011 - DNA, 16 bp, H. sapiens
tcattaaaatgttcat

SEQ ID NO: 135012 - DNA, 16 bp, H. sapiens
tcattaaacaataact

SEQ ID NO: 135013 - DNA, 16 bp, H. sapiens
tcattaaataatgacc

SEQ ID NO: 135014 - DNA, 16 bp, H. sapiens
tcattaaatagatttt

SEQ ID NO: 135015 - DNA, 16 bp, H. sapiens
tcattaaatggaagtg

SEQ ID NO: 135016 - DNA, 16 bp, H. sapiens
tcattaagaaaaaata

SEQ ID NO: 135017 - DNA, 16 bp, H. sapiens
tcattaagtcaaaaat

SEQ ID NO: 135018 - DNA, 16 bp, H. sapiens
tcattaataaagaaaa

SEQ ID NO: 135019 - DNA, 16 bp, H. sapiens
tcattaatcttttcaa

SEQ ID NO: 135020 - DNA, 16 bp, H. sapiens
tcattaatttattcaa

SEQ ID NO: 135021 - DNA, 16 bp, H. sapiens
tcattaattttgaaaa

SEQ ID NO: 135022 - DNA, 16 bp, H. sapiens
tcattacaaaatattt

SEQ ID NO: 135023 - DNA, 16 bp, H. sapiens
tcattagattctcaaa

SEQ ID NO: 135024 - DNA, 16 bp, H. sapiens
tcattagcaaaatgca

SEQ ID NO: 135025 - DNA, 16 bp, H. sapiens
tcattaggaaaatgca

SEQ ID NO: 135026 - DNA, 16 bp, H. sapiens
tcattagtttcaaaga

SEQ ID NO: 135027 - DNA, 16 bp, H. sapiens
tcattataattttgat

SEQ ID NO: 135028 - DNA, 16 bp, H. sapiens
tcattatataatgata

SEQ ID NO: 135029 - DNA, 16 bp, H. sapiens
tcattatatgacaact

SEQ ID NO: 135030 - DNA, 16 bp, H. sapiens
tcattatatgtatata

SEQ ID NO: 135031 - DNA, 16 bp, H. sapiens
tcattatcaatggaaa

SEQ ID NO: 135032 - DNA, 16 bp, H. sapiens
tcattatcaccatcat

SEQ ID NO: 135033 - DNA, 16 bp, H. sapiens
tcattatcactggcca

SEQ ID NO: 135034 - DNA, 16 bp, H. sapiens
tcattatccatccatc

SEQ ID NO: 135035 - DNA, 16 bp, H. sapiens
tcattatccccatttt

SEQ ID NO: 135036 - DNA, 18 bp, H. sapiens
tcattatctctaccatct

SEQ ID NO: 135037 - DNA, 16 bp, H. sapiens
tcattatcttcatgtt

SEQ ID NO: 135038 - DNA, 16 bp, H. sapiens
tcattattattattgt

SEQ ID NO: 135039 - DNA, 16 bp, H. sapiens
tcattattgcttcaaa

SEQ ID NO: 135040 - DNA, 16 bp, H. sapiens
tcattattgttttgat

SEQ ID NO: 135041 - DNA, 16 bp, H. sapiens
tcattatttacccaat

SEQ ID NO: 135042 - DNA, 16 bp, H. sapiens
tcattatttaccttat

SEQ ID NO: 135043 - DNA, 16 bp, H. sapiens
tcattatttatgtatt

SEQ ID NO: 135044 - DNA, 16 bp, H. sapiens
tcattattttcaaaga

SEQ ID NO: 135045 - DNA, 16 bp, H. sapiens
tcattattttcaaatg

SEQ ID NO: 135046 - DNA, 16 bp, H. sapiens
tcattattttgaatta

SEQ ID NO: 135047 - DNA, 16 bp, H. sapiens
tcattattttgatgct

SEQ ID NO: 135048 - DNA, 16 bp, H. sapiens
tcattattttgattgt

SEQ ID NO: 135049 - DNA, 16 bp, H. sapiens
tcattatttttctgaa

SEQ ID NO: 135050 - DNA, 16 bp, H. sapiens
tcattcaaaaacattt

SEQ ID NO: 135051 - DNA, 16 bp, H. sapiens
tcattcaaaagtcagg

SEQ ID NO: 135052 - DNA, 16 bp, H. sapiens
tcattcaaaatattta

SEQ ID NO: 135053 - DNA, 16 bp, H. sapiens
tcattcaaatatatat

SEQ ID NO: 135054 - DNA, 16 bp, H. sapiens
tcattcaacaactatt

SEQ ID NO: 135055 - DNA, 16 bp, H. sapiens
tcattcaacaagtact

SEQ ID NO: 135056 - DNA, 16 bp, H. sapiens
tcattcaacacatact

SEQ ID NO: 135057 - DNA, 16 bp, H. sapiens
tcattcaataaacact

SEQ ID NO: 135058 - DNA, 16 bp, H. sapiens
tcattcaataaacatg

SEQ ID NO: 135059 - DNA, 16 bp, H. sapiens
tcattcaatatttact

SEQ ID NO: 135060 - DNA, 16 bp, H. sapiens
tcattcaattattcat

SEQ ID NO: 135061 - DNA, 16 bp, H. sapiens
tcattcaattcaaaat

SEQ ID NO: 135062 - DNA, 16 bp, H. sapiens
tcattcacattaggta

SEQ ID NO: 135063 - DNA, 16 bp, H. sapiens
tcattcactcaacaaa

SEQ ID NO: 135064 - DNA, 16 bp, H. sapiens
tcattcactcaacaga

SEQ ID NO: 135065 - DNA, 16 bp, H. sapiens
tcattcactgatggac

SEQ ID NO: 135066 - DNA, 16 bp, H. sapiens
tcattcagaaaatgtt

SEQ ID NO: 135067 - DNA, 16 bp, H. sapiens
tcattcagaagtttgg

SEQ ID NO: 135068 - DNA, 16 bp, H. sapiens
tcattcagcagcaggt

SEQ ID NO: 135069 - DNA, 16 bp, H. sapiens
tcattcagcatttatt

SEQ ID NO: 135070 - DNA, 16 bp, H. sapiens
tcattcaggagcatgt

SEQ ID NO: 135071 - DNA, 16 bp, H. sapiens
tcattcaggttgttgg

SEQ ID NO: 135072 - DNA, 16 bp, H. sapiens
tcattcagttaaaaat

SEQ ID NO: 135073 - DNA, 16 bp, H. sapiens
tcattcagttcgaaga

SEQ ID NO: 135074 - DNA, 16 bp, H. sapiens
tcattcatcagttttg

SEQ ID NO: 135075 - DNA, 16 bp, H. sapiens
tcattcatccatccat

SEQ ID NO: 135076 - DNA, 16 bp, H. sapiens
tcattcatccattcac

SEQ ID NO: 135077 - DNA, 16 bp, H. sapiens
tcattcatctgtggat

SEQ ID NO: 135078 - DNA, 16 bp, H. sapiens
tcattcatgagggtgg

SEQ ID NO: 135079 - DNA, 16 bp, H. sapiens
tcattcattcaacaca

SEQ ID NO: 135080 - DNA, 16 bp, H. sapiens
tcattcattcaataga

SEQ ID NO: 135081 - DNA, 16 bp, H. sapiens
tcattcattcactcag

SEQ ID NO: 135082 - DNA, 16 bp, H. sapiens
tcattcattcagcaaa

SEQ ID NO: 135083 - DNA, 16 bp, H. sapiens
tcattcattcagtcaa

SEQ ID NO: 135084 - DNA, 16 bp, H. sapiens
tcattcattccttcct

SEQ ID NO: 135085 - DNA, 16 bp, H. sapiens
tcattcattctttcat

SEQ ID NO: 135086 - DNA, 16 bp, H. sapiens
tcattcattgatggac

SEQ ID NO: 135087 - DNA, 16 bp, H. sapiens
tcattcattgctagtg

SEQ ID NO: 135088 - DNA, 16 bp, H. sapiens
tcattcatttaaaaaa

SEQ ID NO: 135089 - DNA, 16 bp, H. sapiens
tcattcatttaacaga

SEQ ID NO: 135090 - DNA, 16 bp, H. sapiens
tcattcatttataaat

SEQ ID NO: 135091 - DNA, 16 bp, H. sapiens
tcattcatttgctcaa

SEQ ID NO: 135092 - DNA, 16 bp, H. sapiens
tcattcatttgttcaa

SEQ ID NO: 135093 - DNA, 16 bp, H. sapiens
tcattcatttgttcag

SEQ ID NO: 135094 - DNA, 16 bp, H. sapiens
tcattcatttttaatg

SEQ ID NO: 135095 - DNA, 16 bp, H. sapiens
tcattccactgcagtc

SEQ ID NO: 135096 - DNA, 16 bp, H. sapiens
tcattccagcatcaac

SEQ ID NO: 135097 - DNA, 16 bp, H. sapiens
tcattccagcctgggt

SEQ ID NO: 135098 - DNA, 16 bp, H. sapiens
tcattccatatgaatt

SEQ ID NO: 135099 - DNA, 16 bp, H. sapiens
tcattccctttttatg

SEQ ID NO: 135100 - DNA, 16 bp, H. sapiens
tcattcctcccctggc

SEQ ID NO: 135101 - DNA, 16 bp, H. sapiens
tcattcctgggataaa

SEQ ID NO: 135102 - DNA, 16 bp, H. sapiens
tcattcctttttatgg

SEQ ID NO: 135103 - DNA, 16 bp, H. sapiens
tcattctactctaaag

SEQ ID NO: 135104 - DNA, 16 bp, H. sapiens
tcattctactttctat

SEQ ID NO: 135105 - DNA, 16 bp, H. sapiens
tcattctactttctgt

SEQ ID NO: 135106 - DNA, 16 bp, H. sapiens
tcattctcaagttcaa

SEQ ID NO: 135107 - DNA, 16 bp, H. sapiens
tcattctcattttata

SEQ ID NO: 135108 - DNA, 16 bp, H. sapiens
tcattctccacccagc

SEQ ID NO: 135109 - DNA, 16 bp, H. sapiens
tcattctcctccctca

SEQ ID NO: 135110 - DNA, 16 bp, H. sapiens
tcattctccttcctca

SEQ ID NO: 135111 - DNA, 16 bp, H. sapiens
tcattctctgtccagc

SEQ ID NO: 135112 - DNA, 16 bp, H. sapiens
tcattctcttgcctca

SEQ ID NO: 135113 - DNA, 16 bp, H. sapiens
tcattctctttttaaa

SEQ ID NO: 135114 - DNA, 16 bp, H. sapiens
tcattctgattggtgt

SEQ ID NO: 135115 - DNA, 16 bp, H. sapiens
tcattctggagcaaaa

SEQ ID NO: 135116 - DNA, 16 bp, H. sapiens
tcattcttcttttatg

SEQ ID NO: 135117 - DNA, 16 bp, H. sapiens
tcattctttaaaaaaa

SEQ ID NO: 135118 - DNA, 16 bp, H. sapiens
tcattctttcaatatt

SEQ ID NO: 135119 - DNA, 16 bp, H. sapiens
tcattctttgtccagc

SEQ ID NO: 135120 - DNA, 16 bp, H. sapiens
tcattcttttaaaaaa

SEQ ID NO: 135121 - DNA, 16 bp, H. sapiens
tcattcttttaacaaa

SEQ ID NO: 135122 - DNA, 16 bp, H. sapiens
tcattcttttctatgg

SEQ ID NO: 135123 - DNA, 16 bp, H. sapiens
tcattctttttaatgg

SEQ ID NO: 135124 - DNA, 16 bp, H. sapiens
tcattcttttttatgg

SEQ ID NO: 135125 - DNA, 17 bp, H. sapiens
tcattcttttttatggt

SEQ ID NO: 135126 - DNA, 16 bp, H. sapiens
tcattgaacaaatatt

SEQ ID NO: 135127 - DNA, 16 bp, H. sapiens
tcattgaagaaaaaat

SEQ ID NO: 135128 - DNA, 16 bp, H. sapiens
tcattgaaggagaata

SEQ ID NO: 135129 - DNA, 16 bp, H. sapiens
tcattgaatccaggag

SEQ ID NO: 135130 - DNA, 16 bp, H. sapiens
tcattgaatcctcaca

SEQ ID NO: 135131 - DNA, 16 bp, H. sapiens
tcattgaattctcaca

SEQ ID NO: 135132 - DNA, 16 bp, H. sapiens
tcattgaccaaaacat

SEQ ID NO: 135133 - DNA, 16 bp, H. sapiens
tcattgactcactggt

SEQ ID NO: 135134 - DNA, 16 bp, H. sapiens
tcattgaggacaatgg

SEQ ID NO: 135135 - DNA, 16 bp, H. sapiens
tcattgaggcagaaaa

SEQ ID NO: 135136 - DNA, 16 bp, H. sapiens
tcattgaggccaggag

SEQ ID NO: 135137 - DNA, 16 bp, H. sapiens
tcattgatggatactt

SEQ ID NO: 135138 - DNA, 16 bp, H. sapiens
tcattgatggtcattt

SEQ ID NO: 135139 - DNA, 16 bp, H. sapiens
tcattgattcattcaa

SEQ ID NO: 135140 - DNA, 16 bp, H. sapiens
tcattgatttctgctg

SEQ ID NO: 135141 - DNA, 16 bp, H. sapiens
tcattgattttctgaa

SEQ ID NO: 135142 - DNA, 16 bp, H. sapiens
tcattgcaacgtctgc

SEQ ID NO: 135143 - DNA, 16 bp, H. sapiens
tcattgcaagtgtata

SEQ ID NO: 135144 - DNA, 16 bp, H. sapiens
tcattgcagcactgct

SEQ ID NO: 135145 - DNA, 16 bp, H. sapiens
tcattgcagcattact

SEQ ID NO: 135146 - DNA, 16 bp, H. sapiens
tcattgcagcctcaat

SEQ ID NO: 135147 - DNA, 16 bp, H. sapiens
tcattgcagccttgac

SEQ ID NO: 135148 - DNA, 16 bp, H. sapiens
tcattgccaagatcaa

SEQ ID NO: 135149 - DNA, 16 bp, H. sapiens
tcattgccatccccat

SEQ ID NO: 135150 - DNA, 16 bp, H. sapiens
tcattgctagcacagc

SEQ ID NO: 135151 - DNA, 16 bp, H. sapiens
tcattgcttatctgaa

SEQ ID NO: 135152 - DNA, 16 bp, H. sapiens
tcattggaacatttca

SEQ ID NO: 135153 - DNA, 16 bp, H. sapiens
tcattggagtgaacag

SEQ ID NO: 135154 - DNA, 16 bp, H. sapiens
tcattggatgaaatgt

SEQ ID NO: 135155 - DNA, 16 bp, H. sapiens
tcattggattgaagga

SEQ ID NO: 135156 - DNA, 16 bp, H. sapiens
tcattggtctttatat

SEQ ID NO: 135157 - DNA, 16 bp, H. sapiens
tcattggtgatgttga

SEQ ID NO: 135158 - DNA, 16 bp, H. sapiens
tcattggtgtgctgta

SEQ ID NO: 135159 - DNA, 16 bp, H. sapiens
tcattgtaaattattt

SEQ ID NO: 135160 - DNA, 16 bp, H. sapiens
tcattgtatgttattt

SEQ ID NO: 135161 - DNA, 16 bp, H. sapiens
tcattgtcatcatcat

SEQ ID NO: 135162 - DNA, 16 bp, H. sapiens
tcattgtcattgtcat

SEQ ID NO: 135163 - DNA, 16 bp, H. sapiens
tcattgtccacatcat

SEQ ID NO: 135164 - DNA, 16 bp, H. sapiens
tcattgtctttgagct

SEQ ID NO: 135165 - DNA, 16 bp, H. sapiens
tcattgtgaggattaa

SEQ ID NO: 135166 - DNA, 16 bp, H. sapiens
tcattgtgatgctagc

SEQ ID NO: 135167 - DNA, 16 bp, H. sapiens
tcattgtgcagcacct

SEQ ID NO: 135168 - DNA, 16 bp, H. sapiens
tcattgtggtttagat

SEQ ID NO: 135169 - DNA, 16 bp, H. sapiens
tcattgtggtttcatt

SEQ ID NO: 135170 - DNA, 16 bp, H. sapiens
tcattgtgtaaacatc

SEQ ID NO: 135171 - DNA, 16 bp, H. sapiens
tcattgtgtctctgcc

SEQ ID NO: 135172 - DNA, 16 bp, H. sapiens
tcattgtgtgaacatc

SEQ ID NO: 135173 - DNA, 16 bp, H. sapiens
tcattgtgtttagtgc

SEQ ID NO: 135174 - DNA, 16 bp, H. sapiens
tcattgttaatgtata

SEQ ID NO: 135175 - DNA, 17 bp, H. sapiens
tcattgttggacatctg

SEQ ID NO: 135176 - DNA, 16 bp, H. sapiens
tcattgttgttttaac

SEQ ID NO: 135177 - DNA, 16 bp, H. sapiens
tcattgtttaaatttt

SEQ ID NO: 135178 - DNA, 16 bp, H. sapiens
tcattgtttatttgaa

SEQ ID NO: 135179 - DNA, 16 bp, H. sapiens
tcatttaaaaaaatct

SEQ ID NO: 135180 - DNA, 16 bp, H. sapiens
tcatttaaaaaatgtt

SEQ ID NO: 135181 - DNA, 16 bp, H. sapiens
tcatttaaaaatagtt

SEQ ID NO: 135182 - DNA, 16 bp, H. sapiens
tcatttaaaaatgtgt

SEQ ID NO: 135183 - DNA, 16 bp, H. sapiens
tcatttaaaaatgttt

SEQ ID NO: 135184 - DNA, 16 bp, H. sapiens
tcatttaaaacatttt

SEQ ID NO: 135185 - DNA, 16 bp, H. sapiens
tcatttaaaatggaaa

SEQ ID NO: 135186 - DNA, 16 bp, H. sapiens
tcatttaaaatgtaaa

SEQ ID NO: 135187 - DNA, 16 bp, H. sapiens
tcatttaaattgtttt

SEQ ID NO: 135188 - DNA, 16 bp, H. sapiens
tcatttaaccctcaaa

SEQ ID NO: 135189 - DNA, 16 bp, H. sapiens
tcatttaaccttcaca

SEQ ID NO: 135190 - DNA, 16 bp, H. sapiens
tcatttaagtattttt

SEQ ID NO: 135191 - DNA, 16 bp, H. sapiens
tcatttaatcatttca

SEQ ID NO: 135192 - DNA, 16 bp, H. sapiens
tcatttaatcctcaaa

SEQ ID NO: 135193 - DNA, 16 bp, H. sapiens
tcatttaatcctctca

SEQ ID NO: 135194 - DNA, 16 bp, H. sapiens
tcatttaatccttaca

SEQ ID NO: 135195 - DNA, 16 bp, H. sapiens
tcatttaatcttcaca

SEQ ID NO: 135196 - DNA, 16 bp, H. sapiens
tcatttaatcttcaga

SEQ ID NO: 135197 - DNA, 16 bp, H. sapiens
tcatttaatctttaaa

SEQ ID NO: 135198 - DNA, 16 bp, H. sapiens
tcatttaatgttttca

SEQ ID NO: 135199 - DNA, 16 bp, H. sapiens
tcatttaattctcaca

SEQ ID NO: 135200 - DNA, 16 bp, H. sapiens
tcatttaattcttaaa

SEQ ID NO: 135201 - DNA, 16 bp, H. sapiens
tcatttaattgtcaca

SEQ ID NO: 135202 - DNA, 16 bp, H. sapiens
tcatttaattttctca

SEQ ID NO: 135203 - DNA, 16 bp, H. sapiens
tcatttagcattaagt

SEQ ID NO: 135204 - DNA, 16 bp, H. sapiens
tcatttagctctcatt

SEQ ID NO: 135205 - DNA, 16 bp, H. sapiens
tcatttagtcctcaaa

SEQ ID NO: 135206 - DNA, 16 bp, H. sapiens
tcatttagtcctcaca

SEQ ID NO: 135207 - DNA, 16 bp, H. sapiens
tcatttagttttaatt

SEQ ID NO: 135208 - DNA, 16 bp, H. sapiens
tcatttataaagaaca

SEQ ID NO: 135209 - DNA, 16 bp, H. sapiens
tcatttataatagaaa

SEQ ID NO: 135210 - DNA, 16 bp, H. sapiens
tcatttatacacttgt

SEQ ID NO: 135211 - DNA, 16 bp, H. sapiens
tcatttatatgtgaaa

SEQ ID NO: 135212 - DNA, 16 bp, H. sapiens
tcatttatcattctga

SEQ ID NO: 135213 - DNA, 16 bp, H. sapiens
tcatttatgaaaaata

SEQ ID NO: 135214 - DNA, 16 bp, H. sapiens
tcatttattaaatatg

SEQ ID NO: 135215 - DNA, 16 bp, H. sapiens
tcatttattcaacaaa

SEQ ID NO: 135216 - DNA, 16 bp, H. sapiens
tcatttattcaacaca

SEQ ID NO: 135217 - DNA, 16 bp, H. sapiens
tcatttattcacccat

SEQ ID NO: 135218 - DNA, 16 bp, H. sapiens
tcatttattcagcaaa

SEQ ID NO: 135219 - DNA, 16 bp, H. sapiens
tcatttattcagcaag

SEQ ID NO: 135220 - DNA, 16 bp, H. sapiens
tcatttattcattcat

SEQ ID NO: 135221 - DNA, 16 bp, H. sapiens
tcatttattgaaaaat

SEQ ID NO: 135222 - DNA, 16 bp, H. sapiens
tcatttatttacatct

SEQ ID NO: 135223 - DNA, 16 bp, H. sapiens
tcatttatttgaaaat

SEQ ID NO: 135224 - DNA, 16 bp, H. sapiens
tcatttatttgctgtt

SEQ ID NO: 135225 - DNA, 16 bp, H. sapiens
tcatttattttggata

SEQ ID NO: 135226 - DNA, 16 bp, H. sapiens
tcatttatttttgcat

SEQ ID NO: 135227 - DNA, 16 bp, H. sapiens
tcatttcaaaatatgt

SEQ ID NO: 135228 - DNA, 16 bp, H. sapiens
tcatttcaaaatgttt

SEQ ID NO: 135229 - DNA, 16 bp, H. sapiens
tcatttcaaaattatt

SEQ ID NO: 135230 - DNA, 16 bp, H. sapiens
tcatttcaaagaactt

SEQ ID NO: 135231 - DNA, 16 bp, H. sapiens
tcatttcaaagaattt

SEQ ID NO: 135232 - DNA, 16 bp, H. sapiens
tcatttcaatttcatt

SEQ ID NO: 135233 - DNA, 16 bp, H. sapiens
tcatttcaccctcaca

SEQ ID NO: 135234 - DNA, 16 bp, H. sapiens
tcatttcacctataaa

SEQ ID NO: 135235 - DNA, 16 bp, H. sapiens
tcatttcacctgtaaa

SEQ ID NO: 135236 - DNA, 16 bp, H. sapiens
tcatttcacttaaagt

SEQ ID NO: 135237 - DNA, 16 bp, H. sapiens
tcatttcagccatttt

SEQ ID NO: 135238 - DNA, 29 bp, H. sapiens
tcatttcataacctcttccatgtaggtta

SEQ ID NO: 135239 - DNA, 16 bp, H. sapiens
tcatttcatcctcaca

SEQ ID NO: 135240 - DNA, 16 bp, H. sapiens
tcatttcatcctttca

SEQ ID NO: 135241 - DNA, 16 bp, H. sapiens
tcatttcatctcattt

SEQ ID NO: 135242 - DNA, 16 bp, H. sapiens
tcatttcatcttcaca

SEQ ID NO: 135243 - DNA, 16 bp, H. sapiens
tcatttcattaaaaat

SEQ ID NO: 135244 - DNA, 16 bp, H. sapiens
tcatttcattcattta

SEQ ID NO: 135245 - DNA, 16 bp, H. sapiens
tcatttcattctcaca

SEQ ID NO: 135246 - DNA, 16 bp, H. sapiens
tcatttcattgatctt

SEQ ID NO: 135247 - DNA, 16 bp, H. sapiens
tcatttccaaatattt

SEQ ID NO: 135248 - DNA, 16 bp, H. sapiens
tcatttccacattttc

SEQ ID NO: 135249 - DNA, 16 bp, H. sapiens
tcatttccagaagttg

SEQ ID NO: 135250 - DNA, 16 bp, H. sapiens
tcatttcccctctgtt

SEQ ID NO: 135251 - DNA, 16 bp, H. sapiens
tcatttccttcaagaa

SEQ ID NO: 135252 - DNA, 16 bp, H. sapiens
tcatttctaaaggaca

SEQ ID NO: 135253 - DNA, 16 bp, H. sapiens
tcatttctgagttctc

SEQ ID NO: 135254 - DNA, 16 bp, H. sapiens
tcatttctgatattga

SEQ ID NO: 135255 - DNA, 16 bp, H. sapiens
tcatttctgatttcag

SEQ ID NO: 135256 - DNA, 16 bp, H. sapiens
tcatttctgttttctg

SEQ ID NO: 135257 - DNA, 16 bp, H. sapiens
tcatttcttaaaaaaa

SEQ ID NO: 135258 - DNA, 16 bp, H. sapiens
tcatttcttcattgaa

SEQ ID NO: 135259 - DNA, 16 bp, H. sapiens
tcatttctttaaaaat

SEQ ID NO: 135260 - DNA, 16 bp, H. sapiens
tcatttctttcataaa

SEQ ID NO: 135261 - DNA, 16 bp, H. sapiens
tcatttctttgtattc

SEQ ID NO: 135262 - DNA, 16 bp, H. sapiens
tcatttgaaaattatt

SEQ ID NO: 135263 - DNA, 16 bp, H. sapiens
tcatttgaacctggaa

SEQ ID NO: 135264 - DNA, 16 bp, H. sapiens
tcatttgacattttaa

SEQ ID NO: 135265 - DNA, 16 bp, H. sapiens
tcatttgaggacagga

SEQ ID NO: 135266 - DNA, 16 bp, H. sapiens
tcatttgatcctcaca

SEQ ID NO: 135267 - DNA, 16 bp, H. sapiens
tcatttgcagcaaaat

SEQ ID NO: 135268 - DNA, 16 bp, H. sapiens
tcatttgcatataatt

SEQ ID NO: 135269 - DNA, 16 bp, H. sapiens
tcatttgccttcagcc

SEQ ID NO: 135270 - DNA, 16 bp, H. sapiens
tcatttgctaataaat

SEQ ID NO: 135271 - DNA, 16 bp, H. sapiens
tcatttgctttttaaa

SEQ ID NO: 135272 - DNA, 16 bp, H. sapiens
tcatttggaaaaataa

SEQ ID NO: 135273 - DNA, 16 bp, H. sapiens
tcatttgggtgtgtta

SEQ ID NO: 135274 - DNA, 16 bp, H. sapiens
tcatttggtttttgtc

SEQ ID NO: 135275 - DNA, 16 bp, H. sapiens
tcatttgtaaaacaag

SEQ ID NO: 135276 - DNA, 16 bp, H. sapiens
tcatttgtaaaacaga

SEQ ID NO: 135277 - DNA, 16 bp, H. sapiens
tcatttgtaaagtgga

SEQ ID NO: 135278 - DNA, 16 bp, H. sapiens
tcatttgtatttcctt

SEQ ID NO: 135279 - DNA, 16 bp, H. sapiens
tcatttgtgaaaacat

SEQ ID NO: 135280 - DNA, 16 bp, H. sapiens
tcatttgtgacaacat

SEQ ID NO: 135281 - DNA, 16 bp, H. sapiens
tcatttgtggaaaaga

SEQ ID NO: 135282 - DNA, 16 bp, H. sapiens
tcatttgttcattaaa

SEQ ID NO: 135283 - DNA, 16 bp, H. sapiens
tcatttgtttaaaaag

SEQ ID NO: 135284 - DNA, 16 bp, H. sapiens
tcatttgtttacattt

SEQ ID NO: 135285 - DNA, 16 bp, H. sapiens
tcatttgtttagaaaa

SEQ ID NO: 135286 - DNA, 16 bp, H. sapiens
tcatttgtttcaagag

SEQ ID NO: 135287 - DNA, 16 bp, H. sapiens
tcatttgtttcaggaa

SEQ ID NO: 135288 - DNA, 16 bp, H. sapiens
tcatttgtttgaagaa

SEQ ID NO: 135289 - DNA, 16 bp, H. sapiens
tcatttgtttgctgtt

SEQ ID NO: 135290 - DNA, 16 bp, H. sapiens
tcatttgttttaaata

SEQ ID NO: 135291 - DNA, 16 bp, H. sapiens
tcatttgttttctggt

SEQ ID NO: 135292 - DNA, 16 bp, H. sapiens
tcatttgtttttaaaa

SEQ ID NO: 135293 - DNA, 16 bp, H. sapiens
tcattttaaaaaactg

SEQ ID NO: 135294 - DNA, 16 bp, H. sapiens
tcattttaaaaaagaa

SEQ ID NO: 135295 - DNA, 16 bp, H. sapiens
tcattttaaaaagtca

SEQ ID NO: 135296 - DNA, 16 bp, H. sapiens
tcattttaaagttaaa

SEQ ID NO: 135297 - DNA, 16 bp, H. sapiens
tcattttaaatcaaaa

SEQ ID NO: 135298 - DNA, 16 bp, H. sapiens
tcattttaacaaatat

SEQ ID NO: 135299 - DNA, 16 bp, H. sapiens
tcattttaaccatttt

SEQ ID NO: 135300 - DNA, 16 bp, H. sapiens
tcattttaatatctgt

SEQ ID NO: 135301 - DNA, 16 bp, H. sapiens
tcattttaatgaattt

SEQ ID NO: 135302 - DNA, 16 bp, H. sapiens
tcattttaatgtgttt

SEQ ID NO: 135303 - DNA, 16 bp, H. sapiens
tcattttaattgcttt

SEQ ID NO: 135304 - DNA, 16 bp, H. sapiens
tcattttaattttagt

SEQ ID NO: 135305 - DNA, 16 bp, H. sapiens
tcattttacaaaaaag

SEQ ID NO: 135306 - DNA, 16 bp, H. sapiens
tcattttacaaagaaa

SEQ ID NO: 135307 - DNA, 16 bp, H. sapiens
tcattttacaaagcca

SEQ ID NO: 135308 - DNA, 16 bp, H. sapiens
tcattttacaaatgag

SEQ ID NO: 135309 - DNA, 16 bp, H. sapiens
tcattttacaatgtat

SEQ ID NO: 135310 - DNA, 16 bp, H. sapiens
tcattttacaggtgag

SEQ ID NO: 135311 - DNA, 16 bp, H. sapiens
tcattttacagttgag

SEQ ID NO: 135312 - DNA, 16 bp, H. sapiens
tcattttactccctct

SEQ ID NO: 135313 - DNA, 16 bp, H. sapiens
tcattttactgaaaaa

SEQ ID NO: 135314 - DNA, 16 bp, H. sapiens
tcattttagaaaagaa

SEQ ID NO: 135315 - DNA, 16 bp, H. sapiens
tcattttagaaatgag

SEQ ID NO: 135316 - DNA, 16 bp, H. sapiens
tcattttataaacaaa

SEQ ID NO: 135317 - DNA, 16 bp, H. sapiens
tcattttatagattaa

SEQ ID NO: 135318 - DNA, 16 bp, H. sapiens
tcattttatcttcaat

SEQ ID NO: 135319 - DNA, 16 bp, H. sapiens
tcattttatgaagcta

SEQ ID NO: 135320 - DNA, 16 bp, H. sapiens
tcattttatgaataat

SEQ ID NO: 135321 - DNA, 16 bp, H. sapiens
tcattttatgtcattt

SEQ ID NO: 135322 - DNA, 16 bp, H. sapiens
tcattttattctctgt

SEQ ID NO: 135323 - DNA, 16 bp, H. sapiens
tcattttattgatatt

SEQ ID NO: 135324 - DNA, 16 bp, H. sapiens
tcattttattgtgctt

SEQ ID NO: 135325 - DNA, 16 bp, H. sapiens
tcattttatttgtggc

SEQ ID NO: 135326 - DNA, 16 bp, H. sapiens
tcattttattttccca

SEQ ID NO: 135327 - DNA, 16 bp, H. sapiens
tcattttcaaaagaaa

SEQ ID NO: 135328 - DNA, 16 bp, H. sapiens
tcattttcaaaggaaa

SEQ ID NO: 135329 - DNA, 16 bp, H. sapiens
tcattttcaaataaaa

SEQ ID NO: 135330 - DNA, 16 bp, H. sapiens
tcattttcaaatgttt

SEQ ID NO: 135331 - DNA, 16 bp, H. sapiens
tcattttcaacaaaga

SEQ ID NO: 135332 - DNA, 16 bp, H. sapiens
tcattttcaacaacat

SEQ ID NO: 135333 - DNA, 16 bp, H. sapiens
tcattttcacattatt

SEQ ID NO: 135334 - DNA, 16 bp, H. sapiens
tcattttcagcaaact

SEQ ID NO: 135335 - DNA, 16 bp, H. sapiens
tcattttcattgattt

SEQ ID NO: 135336 - DNA, 16 bp, H. sapiens
tcattttcattgctgt

SEQ ID NO: 135337 - DNA, 16 bp, H. sapiens
tcattttcattgttgt

SEQ ID NO: 135338 - DNA, 16 bp, H. sapiens
tcattttccattccca

SEQ ID NO: 135339 - DNA, 16 bp, H. sapiens
tcattttcctgcttta

SEQ ID NO: 135340 - DNA, 16 bp, H. sapiens
tcattttcctgtcttc

SEQ ID NO: 135341 - DNA, 16 bp, H. sapiens
tcattttccttctaac

SEQ ID NO: 135342 - DNA, 16 bp, H. sapiens
tcattttctgttttcc

SEQ ID NO: 135343 - DNA, 16 bp, H. sapiens
tcattttcttaacaat

SEQ ID NO: 135344 - DNA, 16 bp, H. sapiens
tcattttcttactgat

SEQ ID NO: 135345 - DNA, 16 bp, H. sapiens
tcattttcttcatctg

SEQ ID NO: 135346 - DNA, 16 bp, H. sapiens
tcattttcttgataat

SEQ ID NO: 135347 - DNA, 16 bp, H. sapiens
tcattttctttatcca

SEQ ID NO: 135348 - DNA, 16 bp, H. sapiens
tcattttctttgtaaa

SEQ ID NO: 135349 - DNA, 16 bp, H. sapiens
tcattttcttttgcca

SEQ ID NO: 135350 - DNA, 16 bp, H. sapiens
tcattttgaaaaaaaa

SEQ ID NO: 135351 - DNA, 16 bp, H. sapiens
tcattttgaaagaaaa

SEQ ID NO: 135352 - DNA, 16 bp, H. sapiens
tcattttgaactgtag

SEQ ID NO: 135353 - DNA, 16 bp, H. sapiens
tcattttgaagatgag

SEQ ID NO: 135354 - DNA, 16 bp, H. sapiens
tcattttgaattgtat

SEQ ID NO: 135355 - DNA, 16 bp, H. sapiens
tcattttgacttttaa

SEQ ID NO: 135356 - DNA, 16 bp, H. sapiens
tcattttgataatttt

SEQ ID NO: 135357 - DNA, 16 bp, H. sapiens
tcattttgatcatttt

SEQ ID NO: 135358 - DNA, 16 bp, H. sapiens
tcattttgcagatgaa

SEQ ID NO: 135359 - DNA, 16 bp, H. sapiens
tcattttgcatatttt

SEQ ID NO: 135360 - DNA, 16 bp, H. sapiens
tcattttgctaaaaat

SEQ ID NO: 135361 - DNA, 16 bp, H. sapiens
tcattttgctcaagat

SEQ ID NO: 135362 - DNA, 16 bp, H. sapiens
tcattttggaaaataa

SEQ ID NO: 135363 - DNA, 16 bp, H. sapiens
tcattttggaaaatta

SEQ ID NO: 135364 - DNA, 16 bp, H. sapiens
tcattttggtaaaata

SEQ ID NO: 135365 - DNA, 16 bp, H. sapiens
tcattttggttgctgt

SEQ ID NO: 135366 - DNA, 16 bp, H. sapiens
tcattttgtgtgtgtg

SEQ ID NO: 135367 - DNA, 16 bp, H. sapiens
tcattttgttaatatt

SEQ ID NO: 135368 - DNA, 16 bp, H. sapiens
tcattttgttgattgt

SEQ ID NO: 135369 - DNA, 16 bp, H. sapiens
tcattttgtttcctat

SEQ ID NO: 135370 - DNA, 16 bp, H. sapiens
tcatttttaaaaactt

SEQ ID NO: 135371 - DNA, 16 bp, H. sapiens
tcatttttaaaaatga

SEQ ID NO: 135372 - DNA, 16 bp, H. sapiens
tcatttttaaaagtaa

SEQ ID NO: 135373 - DNA, 16 bp, H. sapiens
tcatttttaaatgtac

SEQ ID NO: 135374 - DNA, 16 bp, H. sapiens
tcatttttacattaaa

SEQ ID NO: 135375 - DNA, 16 bp, H. sapiens
tcatttttagcttttg

SEQ ID NO: 135376 - DNA, 16 bp, H. sapiens
tcatttttatagaaat

SEQ ID NO: 135377 - DNA, 16 bp, H. sapiens
tcatttttattgctat

SEQ ID NO: 135378 - DNA, 16 bp, H. sapiens
tcatttttcaaaagta

SEQ ID NO: 135379 - DNA, 16 bp, H. sapiens
tcatttttcaaataaa

SEQ ID NO: 135380 - DNA, 16 bp, H. sapiens
tcatttttctcagttt

SEQ ID NO: 135381 - DNA, 16 bp, H. sapiens
tcatttttctctctgt

SEQ ID NO: 135382 - DNA, 16 bp, H. sapiens
tcatttttctcttctg

SEQ ID NO: 135383 - DNA, 16 bp, H. sapiens
tcatttttctgaattt

SEQ ID NO: 135384 - DNA, 16 bp, H. sapiens
tcatttttcttgagta

SEQ ID NO: 135385 - DNA, 16 bp, H. sapiens
tcatttttcttgtgta

SEQ ID NO: 135386 - DNA, 16 bp, H. sapiens
tcatttttgaaaaatt

SEQ ID NO: 135387 - DNA, 16 bp, H. sapiens
tcatttttgacccagt

SEQ ID NO: 135388 - DNA, 16 bp, H. sapiens
tcatttttgagaaaat

SEQ ID NO: 135389 - DNA, 16 bp, H. sapiens
tcatttttgataattt

SEQ ID NO: 135390 - DNA, 16 bp, H. sapiens
tcatttttgatggctg

SEQ ID NO: 135391 - DNA, 16 bp, H. sapiens
tcatttttgccatttt

SEQ ID NO: 135392 - DNA, 16 bp, H. sapiens
tcatttttgtggtgag

SEQ ID NO: 135393 - DNA, 16 bp, H. sapiens
tcattttttaaaaaca

SEQ ID NO: 135394 - DNA, 16 bp, H. sapiens
tcattttttaatgaaa

SEQ ID NO: 135395 - DNA, 16 bp, H. sapiens
tcattttttaatgtgt

SEQ ID NO: 135396 - DNA, 16 bp, H. sapiens
tcattttttattatga

SEQ ID NO: 135397 - DNA, 16 bp, H. sapiens
tcattttttattgcat

SEQ ID NO: 135398 - DNA, 16 bp, H. sapiens
tcatttttttaaaaga

SEQ ID NO: 135399 - DNA, 16 bp, H. sapiens
tcatttttttaatggc

SEQ ID NO: 135400 - DNA, 16 bp, H. sapiens
tcatttttttatggct

SEQ ID NO: 135401 - DNA, 16 bp, H. sapiens
tcatttttttcctctg

SEQ ID NO: 135402 - DNA, 16 bp, H. sapiens
tcatttttttctgcac

SEQ ID NO: 135403 - DNA, 16 bp, H. sapiens
tccaaaaaaattgaag

SEQ ID NO: 135404 - DNA, 16 bp, H. sapiens
tccaaaaaactgaaga

SEQ ID NO: 135405 - DNA, 16 bp, H. sapiens
tccaaaaaatagagaa

SEQ ID NO: 135406 - DNA, 16 bp, H. sapiens
tccaaaaaatcaagga

SEQ ID NO: 135407 - DNA, 16 bp, H. sapiens
tccaaaaacagttttt

SEQ ID NO: 135408 - DNA, 16 bp, H. sapiens
tccaaaaacattaaat

SEQ ID NO: 135409 - DNA, 16 bp, H. sapiens
tccaaaaactgaagaa

SEQ ID NO: 135410 - DNA, 16 bp, H. sapiens
tccaaaaagctcctgg

SEQ ID NO: 135411 - DNA, 16 bp, H. sapiens
tccaaaaatgttaaat

SEQ ID NO: 135412 - DNA, 16 bp, H. sapiens
tccaaaacagaaagca

SEQ ID NO: 135413 - DNA, 16 bp, H. sapiens
tccaaaacattgacaa

SEQ ID NO: 135414 - DNA, 16 bp, H. sapiens
tccaaaacatttctgg

SEQ ID NO: 135415 - DNA, 16 bp, H. sapiens
tccaaaaccaccaagg

SEQ ID NO: 135416 - DNA, 16 bp, H. sapiens
tccaaaaccagcctgg

SEQ ID NO: 135417 - DNA, 16 bp, H. sapiens
tccaaaactcatgctg

SEQ ID NO: 135418 - DNA, 30 bp, H. sapiens
tccaaaactgaccacatagttggaagtaaa

SEQ ID NO: 135419 - DNA, 16 bp, H. sapiens
tccaaaagaactgctt

SEQ ID NO: 135420 - DNA, 16 bp, H. sapiens
tccaaaagaactttct

SEQ ID NO: 135421 - DNA, 16 bp, H. sapiens
tccaaaagaattgaaa

SEQ ID NO: 135422 - DNA, 16 bp, H. sapiens
tccaaaagacaagcaa

SEQ ID NO: 135423 - DNA, 16 bp, H. sapiens
tccaaaagacagagaa

SEQ ID NO: 135424 - DNA, 16 bp, H. sapiens
tccaaaagcctgagaa

SEQ ID NO: 135425 - DNA, 16 bp, H. sapiens
tccaaaagggagaaat

SEQ ID NO: 135426 - DNA, 16 bp, H. sapiens
tccaaaataaacctgt

SEQ ID NO: 135427 - DNA, 16 bp, H. sapiens
tccaaaataatctctt

SEQ ID NO: 135428 - DNA, 16 bp, H. sapiens
tccaaaatatagaaag

SEQ ID NO: 135429 - DNA, 16 bp, H. sapiens
tccaaaatatatatat

SEQ ID NO: 135430 - DNA, 16 bp, H. sapiens
tccaaaatatttatta

SEQ ID NO: 135431 - DNA, 16 bp, H. sapiens
tccaaaatattttcat

SEQ ID NO: 135432 - DNA, 16 bp, H. sapiens
tccaaaatcatctcct

SEQ ID NO: 135433 - DNA, 16 bp, H. sapiens
tccaaaatctgaaaaa

SEQ ID NO: 135434 - DNA, 16 bp, H. sapiens
tccaaaatctgcagag

SEQ ID NO: 135435 - DNA, 16 bp, H. sapiens
tccaaaatgaaacaga

SEQ ID NO: 135436 - DNA, 16 bp, H. sapiens
tccaaaatgcaaaatg

SEQ ID NO: 135437 - DNA, 16 bp, H. sapiens
tccaaaatgcctggga

SEQ ID NO: 135438 - DNA, 16 bp, H. sapiens
tccaaaatggtctcct

SEQ ID NO: 135439 - DNA, 16 bp, H. sapiens
tccaaaattggccaca

SEQ ID NO: 135440 - DNA, 16 bp, H. sapiens
tccaaacacactttgt

SEQ ID NO: 135441 - DNA, 16 bp, H. sapiens
tccaaacagaaaataa

SEQ ID NO: 135442 - DNA, 16 bp, H. sapiens
tccaaaccaagaaaaa

SEQ ID NO: 135443 - DNA, 16 bp, H. sapiens
tccaaaccagcctggc

SEQ ID NO: 135444 - DNA, 16 bp, H. sapiens
tccaaaccttcccaca

SEQ ID NO: 135445 - DNA, 16 bp, H. sapiens
tccaaactcatagaat

SEQ ID NO: 135446 - DNA, 16 bp, H. sapiens
tccaaactcctgaatg

SEQ ID NO: 135447 - DNA, 16 bp, H. sapiens
tccaaactctgcctgt

SEQ ID NO: 135448 - DNA, 16 bp, H. sapiens
tccaaactgactctgg

SEQ ID NO: 135449 - DNA, 16 bp, H. sapiens
tccaaactgggacact

SEQ ID NO: 135450 - DNA, 16 bp, H. sapiens
tccaaagaaaggaaat

SEQ ID NO: 135451 - DNA, 16 bp, H. sapiens
tccaaagaaatattta

SEQ ID NO: 135452 - DNA, 16 bp, H. sapiens
tccaaagagcttttgt

SEQ ID NO: 135453 - DNA, 16 bp, H. sapiens
tccaaagcatttatta

SEQ ID NO: 135454 - DNA, 16 bp, H. sapiens
tccaaagccacacagc

SEQ ID NO: 135455 - DNA, 16 bp, H. sapiens
tccaaagcctcatctg

SEQ ID NO: 135456 - DNA, 16 bp, H. sapiens
tccaaagctcctgcct

SEQ ID NO: 135457 - DNA, 16 bp, H. sapiens
tccaaaggaaaataat

SEQ ID NO: 135458 - DNA, 16 bp, H. sapiens
tccaaaggaggcagtc

SEQ ID NO: 135459 - DNA, 17 bp, H. sapiens
tccaaaggaggcagtca

SEQ ID NO: 135460 - DNA, 16 bp, H. sapiens
tccaaaggcctcacct

SEQ ID NO: 135461 - DNA, 16 bp, H. sapiens
tccaaaggctggagaa

SEQ ID NO: 135462 - DNA, 16 bp, H. sapiens
tccaaagtcacacaga

SEQ ID NO: 135463 - DNA, 16 bp, H. sapiens
tccaaagtcacttcca

SEQ ID NO: 135464 - DNA, 16 bp, H. sapiens
tccaaagtccatgctt

SEQ ID NO: 135465 - DNA, 16 bp, H. sapiens
tccaaagtctcatcca

SEQ ID NO: 135466 - DNA, 18 bp, H. sapiens
tccaaagtgctaggatta

SEQ ID NO: 135467 - DNA, 18 bp, H. sapiens
tccaaagtgctgggatta

SEQ ID NO: 135468 - DNA, 16 bp, H. sapiens
tccaaagtggctgccc

SEQ ID NO: 135469 - DNA, 18 bp, H. sapiens
tccaaagtgttgggatta

SEQ ID NO: 135470 - DNA, 17 bp, H. sapiens
tccaaagttctgggatt

SEQ ID NO: 135471 - DNA, 16 bp, H. sapiens
tccaaagttgtttcca

SEQ ID NO: 135472 - DNA, 16 bp, H. sapiens
tccaaagtttttattt

SEQ ID NO: 135473 - DNA, 16 bp, H. sapiens
tccaaataaattattt

SEQ ID NO: 135474 - DNA, 16 bp, H. sapiens
tccaaataccaccaca

SEQ ID NO: 135475 - DNA, 16 bp, H. sapiens
tccaaataggaaagaa

SEQ ID NO: 135476 - DNA, 16 bp, H. sapiens
tccaaatatactcttt

SEQ ID NO: 135477 - DNA, 16 bp, H. sapiens
tccaaatatagtcaca

SEQ ID NO: 135478 - DNA, 16 bp, H. sapiens
tccaaatatccacctg

SEQ ID NO: 135479 - DNA, 16 bp, H. sapiens
tccaaatatctacttg

SEQ ID NO: 135480 - DNA, 16 bp, H. sapiens
tccaaatgcagccaca

SEQ ID NO: 135481 - DNA, 16 bp, H. sapiens
tccaaatgctcatcaa

SEQ ID NO: 135482 - DNA, 16 bp, H. sapiens
tccaaattcattttat

SEQ ID NO: 135483 - DNA, 16 bp, H. sapiens
tccaaattgggaagga

SEQ ID NO: 135484 - DNA, 16 bp, H. sapiens
tccaaatttccccttc

SEQ ID NO: 135485 - DNA, 16 bp, H. sapiens
tccaaatttccttttc

SEQ ID NO: 135486 - DNA, 16 bp, H. sapiens
tccaaatttgaaagga

SEQ ID NO: 135487 - DNA, 16 bp, H. sapiens
tccaaatttgatgaaa

SEQ ID NO: 135488 - DNA, 16 bp, H. sapiens
tccaaattttctttaa

SEQ ID NO: 135489 - DNA, 16 bp, H. sapiens
tccaaattttgtttat

SEQ ID NO: 135490 - DNA, 16 bp, H. sapiens
tccaacactggtgatt

SEQ ID NO: 135491 - DNA, 16 bp, H. sapiens
tccaacagaactgcag

SEQ ID NO: 135492 - DNA, 23 bp, H. sapiens
tccaacagacctgcagctgaggg

SEQ ID NO: 135493 - DNA, 16 bp, H. sapiens
tccaacaggaagatat

SEQ ID NO: 135494 - DNA, 16 bp, H. sapiens
tccaacagggcagtca

SEQ ID NO: 135495 - DNA, 16 bp, H. sapiens
tccaacatctataagg

SEQ ID NO: 135496 - DNA, 16 bp, H. sapiens
tccaacatggtaaaac

SEQ ID NO: 135497 - DNA, 16 bp, H. sapiens
tccaacattgtggatt

SEQ ID NO: 135498 - DNA, 16 bp, H. sapiens
tccaaccagtcccaat

SEQ ID NO: 135499 - DNA, 16 bp, H. sapiens
tccaacccaggtgaca

SEQ ID NO: 135500 - DNA, 16 bp, H. sapiens
tccaacccctggcctc

SEQ ID NO: 135501 - DNA, 16 bp, H. sapiens
tccaaccctttatttt

SEQ ID NO: 135502 - DNA, 16 bp, H. sapiens
tccaaccgcctcagcc

SEQ ID NO: 135503 - DNA, 16 bp, H. sapiens
tccaacctcaggtgat

SEQ ID NO: 135504 - DNA, 16 bp, H. sapiens
tccaacctctgcctga

SEQ ID NO: 135505 - DNA, 16 bp, H. sapiens
tccaacctgactctgg

SEQ ID NO: 135506 - DNA, 16 bp, H. sapiens
tccaacctggagacag

SEQ ID NO: 135507 - DNA, 16 bp, H. sapiens
tccaacctgggcaaca

SEQ ID NO: 135508 - DNA, 16 bp, H. sapiens
tccaactatgtgacat

SEQ ID NO: 135509 - DNA, 17 bp, H. sapiens
tccaactcccgggttca

SEQ ID NO: 135510 - DNA, 16 bp, H. sapiens
tccaactcctgacctc

SEQ ID NO: 135511 - DNA, 16 bp, H. sapiens
tccaactgcagatttt

SEQ ID NO: 135512 - DNA, 16 bp, H. sapiens
tccaactgcctactca

SEQ ID NO: 135513 - DNA, 16 bp, H. sapiens
tccaacttcttcctgg

SEQ ID NO: 135514 - DNA, 16 bp, H. sapiens
tccaacttgcaaggga

SEQ ID NO: 135515 - DNA, 16 bp, H. sapiens
tccaacttgggtgaca

SEQ ID NO: 135516 - DNA, 16 bp, H. sapiens
tccaacttgtcaattt

SEQ ID NO: 135517 - DNA, 16 bp, H. sapiens
tccaactttgttcttt

SEQ ID NO: 135518 - DNA, 16 bp, H. sapiens
tccaagaaaaatgaaa

SEQ ID NO: 135519 - DNA, 16 bp, H. sapiens
tccaagaaaggaaaaa

SEQ ID NO: 135520 - DNA, 16 bp, H. sapiens
tccaagaaatatagga

SEQ ID NO: 135521 - DNA, 16 bp, H. sapiens
tccaagaactgcagaa

SEQ ID NO: 135522 - DNA, 16 bp, H. sapiens
tccaagaagcagatgc

SEQ ID NO: 135523 - DNA, 22 bp, H. sapiens
tccaagactaaaccaggaagaa

SEQ ID NO: 135524 - DNA, 16 bp, H. sapiens
tccaagactgggcaat

SEQ ID NO: 135525 - DNA, 16 bp, H. sapiens
tccaagagctggtttt

SEQ ID NO: 135526 - DNA, 16 bp, H. sapiens
tccaagatcaaggcac

SEQ ID NO: 135527 - DNA, 16 bp, H. sapiens
tccaagatcacacagc

SEQ ID NO: 135528 - DNA, 16 bp, H. sapiens
tccaagatcacagagc

SEQ ID NO: 135529 - DNA, 16 bp, H. sapiens
tccaagatgaaggtgc

SEQ ID NO: 135530 - DNA, 16 bp, H. sapiens
tccaagatggcagatt

SEQ ID NO: 135531 - DNA, 16 bp, H. sapiens
tccaagattaaaaaaa

SEQ ID NO: 135532 - DNA, 16 bp, H. sapiens
tccaagcattttggga

SEQ ID NO: 135533 - DNA, 16 bp, H. sapiens
tccaagcctcattttc

SEQ ID NO: 135534 - DNA, 17 bp, H. sapiens
tccaagctgaagacagt

SEQ ID NO: 135535 - DNA, 16 bp, H. sapiens
tccaagctgagaacca

SEQ ID NO: 135536 - DNA, 16 bp, H. sapiens
tccaagctgggcaaca

SEQ ID NO: 135537 - DNA, 16 bp, H. sapiens
tccaagcttctaatca

SEQ ID NO: 135538 - DNA, 16 bp, H. sapiens
tccaaggagccctggt

SEQ ID NO: 135539 - DNA, 16 bp, H. sapiens
tccaagggaaaaaaaa

SEQ ID NO: 135540 - DNA, 16 bp, H. sapiens
tccaagggctcttcag

SEQ ID NO: 135541 - DNA, 16 bp, H. sapiens
tccaaggtcaaggtgc

SEQ ID NO: 135542 - DNA, 16 bp, H. sapiens
tccaaggtcacacagc

SEQ ID NO: 135543 - DNA, 16 bp, H. sapiens
tccaagtattttattt

SEQ ID NO: 135544 - DNA, 16 bp, H. sapiens
tccaagtcctaacccc

SEQ ID NO: 135545 - DNA, 16 bp, H. sapiens
tccaagtctgtggctt

SEQ ID NO: 135546 - DNA, 16 bp, H. sapiens
tccaagtgattctgat

SEQ ID NO: 135547 - DNA, 16 bp, H. sapiens
tccaagttcaagtgat

SEQ ID NO: 135548 - DNA, 17 bp, H. sapiens
tccaagttcttcagctt

SEQ ID NO: 135549 - DNA, 16 bp, H. sapiens
tccaagttctttggct

SEQ ID NO: 135550 - DNA, 16 bp, H. sapiens
tccaagttgctgcaaa

SEQ ID NO: 135551 - DNA, 16 bp, H. sapiens
tccaagttggagtgca

SEQ ID NO: 135552 - DNA, 16 bp, H. sapiens
tccaataaattatttt

SEQ ID NO: 135553 - DNA, 16 bp, H. sapiens
tccaatagaaataaaa

SEQ ID NO: 135554 - DNA, 16 bp, H. sapiens
tccaatatggtaacca

SEQ ID NO: 135555 - DNA, 16 bp, H. sapiens
tccaatatggtagcca

SEQ ID NO: 135556 - DNA, 16 bp, H. sapiens
tccaatcaaaagatat

SEQ ID NO: 135557 - DNA, 16 bp, H. sapiens
tccaatcatggtggaa

SEQ ID NO: 135558 - DNA, 16 bp, H. sapiens
tccaatcttttggctt

SEQ ID NO: 135559 - DNA, 16 bp, H. sapiens
tccaatgtattggcat

SEQ ID NO: 135560 - DNA, 16 bp, H. sapiens
tccaatgtgtgttctt

SEQ ID NO: 135561 - DNA, 16 bp, H. sapiens
tccaattcaagatgag

SEQ ID NO: 135562 - DNA, 16 bp, H. sapiens
tccaattctgtggaga

SEQ ID NO: 135563 - DNA, 16 bp, H. sapiens
tccaattctgtgggtt

SEQ ID NO: 135564 - DNA, 16 bp, H. sapiens
tccaattctttcttca

SEQ ID NO: 135565 - DNA, 16 bp, H. sapiens
tccaatttaaaacttt

SEQ ID NO: 135566 - DNA, 16 bp, H. sapiens
tccaatttcagagcaa

SEQ ID NO: 135567 - DNA, 16 bp, H. sapiens
tccaattttatggatt

SEQ ID NO: 135568 - DNA, 16 bp, H. sapiens
tccaattttttggcat

SEQ ID NO: 135569 - DNA, 16 bp, H. sapiens
tccacaaatttgataa

SEQ ID NO: 135570 - DNA, 16 bp, H. sapiens
tccacaacctagcaag

SEQ ID NO: 135571 - DNA, 16 bp, H. sapiens
tccacaagaagctggt

SEQ ID NO: 135572 - DNA, 16 bp, H. sapiens
tccacaagggcagaga

SEQ ID NO: 135573 - DNA, 16 bp, H. sapiens
tccacacaaaaacttg

SEQ ID NO: 135574 - DNA, 16 bp, H. sapiens
tccacacagcagccag

SEQ ID NO: 135575 - DNA, 19 bp, H. sapiens
tccacacccggctaatttt

SEQ ID NO: 135576 - DNA, 16 bp, H. sapiens
tccacacctctttctg

SEQ ID NO: 135577 - DNA, 16 bp, H. sapiens
tccacactgcagccag

SEQ ID NO: 135578 - DNA, 16 bp, H. sapiens
tccacactgtcttcca

SEQ ID NO: 135579 - DNA, 16 bp, H. sapiens
tccacagaccaggaga

SEQ ID NO: 135580 - DNA, 16 bp, H. sapiens
tccacagatctccagg

SEQ ID NO: 135581 - DNA, 16 bp, H. sapiens
tccacagatgaagaaa

SEQ ID NO: 135582 - DNA, 16 bp, H. sapiens
tccacagatgctcaag

SEQ ID NO: 135583 - DNA, 16 bp, H. sapiens
tccacagcaaaagaaa

SEQ ID NO: 135584 - DNA, 16 bp, H. sapiens
tccacagcagctgcac

SEQ ID NO: 135585 - DNA, 16 bp, H. sapiens
tccacagcagctgcat

SEQ ID NO: 135586 - DNA, 16 bp, H. sapiens
tccacagccaacatca

SEQ ID NO: 135587 - DNA, 16 bp, H. sapiens
tccacagccacatgga

SEQ ID NO: 135588 - DNA, 16 bp, H. sapiens
tccacagccatgtgga

SEQ ID NO: 135589 - DNA, 16 bp, H. sapiens
tccacagcctcatcag

SEQ ID NO: 135590 - DNA, 16 bp, H. sapiens
tccacaggcagagcag

SEQ ID NO: 135591 - DNA, 16 bp, H. sapiens
tccacaggctgcacag

SEQ ID NO: 135592 - DNA, 16 bp, H. sapiens
tccacagtgtatatat

SEQ ID NO: 135593 - DNA, 16 bp, H. sapiens
tccacagttttgcctt

SEQ ID NO: 135594 - DNA, 16 bp, H. sapiens
tccacatacctcttcc

SEQ ID NO: 135595 - DNA, 16 bp, H. sapiens
tccacatcctaacccc

SEQ ID NO: 135596 - DNA, 16 bp, H. sapiens
tccacatcctctacag

SEQ ID NO: 135597 - DNA, 16 bp, H. sapiens
tccacatctgaaaaat

SEQ ID NO: 135598 - DNA, 16 bp, H. sapiens
tccacatctgtaaagt

SEQ ID NO: 135599 - DNA, 16 bp, H. sapiens
tccacatcttcactga

SEQ ID NO: 135600 - DNA, 16 bp, H. sapiens
tccacatgactgagga

SEQ ID NO: 135601 - DNA, 16 bp, H. sapiens
tccacatggtgttaag

SEQ ID NO: 135602 - DNA, 16 bp, H. sapiens
tccacattctctccaa

SEQ ID NO: 135603 - DNA, 16 bp, H. sapiens
tccacatttttgccaa

SEQ ID NO: 135604 - DNA, 16 bp, H. sapiens
tccaccaaaaaactat

SEQ ID NO: 135605 - DNA, 16 bp, H. sapiens
tccaccaagggacagt

SEQ ID NO: 135606 - DNA, 16 bp, H. sapiens
tccaccaccatgccca

SEQ ID NO: 135607 - DNA, 16 bp, H. sapiens
tccaccacctccaaaa

SEQ ID NO: 135608 - DNA, 22 bp, H. sapiens
tccaccacgcccggctaatttt

SEQ ID NO: 135609 - DNA, 16 bp, H. sapiens
tccaccagcaaaaaga

SEQ ID NO: 135610 - DNA, 16 bp, H. sapiens
tccaccatcctcagcc

SEQ ID NO: 135611 - DNA, 16 bp, H. sapiens
tccaccatgatccagt

SEQ ID NO: 135612 - DNA, 16 bp, H. sapiens
tccaccatgattggaa

SEQ ID NO: 135613 - DNA, 16 bp, H. sapiens
tccaccatgcctggct

SEQ ID NO: 135614 - DNA, 16 bp, H. sapiens
tccaccattataatat

SEQ ID NO: 135615 - DNA, 16 bp, H. sapiens
tccacccaactcagcc

SEQ ID NO: 135616 - DNA, 16 bp, H. sapiens
tccacccacctcaact

SEQ ID NO: 135617 - DNA, 16 bp, H. sapiens
tccacccacctccctg

SEQ ID NO: 135618 - DNA, 17 bp, H. sapiens
tccacccacctctgcct

SEQ ID NO: 135619 - DNA, 16 bp, H. sapiens
tccacccacctgggct

SEQ ID NO: 135620 - DNA, 16 bp, H. sapiens
tccacccaccttgccc

SEQ ID NO: 135621 - DNA, 16 bp, H. sapiens
tccacccatcacaaag

SEQ ID NO: 135622 - DNA, 16 bp, H. sapiens
tccacccatcattcca

SEQ ID NO: 135623 - DNA, 16 bp, H. sapiens
tccaccccagaccctg

SEQ ID NO: 135624 - DNA, 16 bp, H. sapiens
tccaccccagtgtgca

SEQ ID NO: 135625 - DNA, 16 bp, H. sapiens
tccaccccctcggcct

SEQ ID NO: 135626 - DNA, 17 bp, H. sapiens
tccacccctctcggcct

SEQ ID NO: 135627 - DNA, 16 bp, H. sapiens
tccacccctgtgatcc

SEQ ID NO: 135628 - DNA, 16 bp, H. sapiens
tccacccgcctgggcc

SEQ ID NO: 135629 - DNA, 16 bp, H. sapiens
tccacccgcctgggct

SEQ ID NO: 135630 - DNA, 18 bp, H. sapiens
tccacccgccttgacctc

SEQ ID NO: 135631 - DNA, 16 bp, H. sapiens
tccacccgcttcggcc

SEQ ID NO: 135632 - DNA, 16 bp, H. sapiens
tccaccctcagcctcc

SEQ ID NO: 135633 - DNA, 34 bp, H. sapiens
tccaccctcagcggatgataatctcaagacacct

SEQ ID NO: 135634 - DNA, 16 bp, H. sapiens
tccaccctcctcaggc

SEQ ID NO: 135635 - DNA, 16 bp, H. sapiens
tccaccctgctctgtg

SEQ ID NO: 135636 - DNA, 16 bp, H. sapiens
tccaccctgggcaaaa

SEQ ID NO: 135637 - DNA, 16 bp, H. sapiens
tccaccctgggcaaca

SEQ ID NO: 135638 - DNA, 16 bp, H. sapiens
tccaccctgggggaca

SEQ ID NO: 135639 - DNA, 16 bp, H. sapiens
tccaccctgggtgaca

SEQ ID NO: 135640 - DNA, 16 bp, H. sapiens
tccaccgcctcggcct

SEQ ID NO: 135641 - DNA, 16 bp, H. sapiens
tccaccgccttggcct

SEQ ID NO: 135642 - DNA, 17 bp, H. sapiens
tccacctaccgggttca

SEQ ID NO: 135643 - DNA, 16 bp, H. sapiens
tccacctatgacctca

SEQ ID NO: 135644 - DNA, 16 bp, H. sapiens
tccacctcagccacct

SEQ ID NO: 135645 - DNA, 16 bp, H. sapiens
tccacctcagcctccc

SEQ ID NO: 135646 - DNA, 16 bp, H. sapiens
tccacctccaaggttc

SEQ ID NO: 135647 - DNA, 16 bp, H. sapiens
tccacctccagaactt

SEQ ID NO: 135648 - DNA, 16 bp, H. sapiens
tccacctccagggctc

SEQ ID NO: 135649 - DNA, 17 bp, H. sapiens
tccacctccagggttca

SEQ ID NO: 135650 - DNA, 16 bp, H. sapiens
tccacctcccagagtg

SEQ ID NO: 135651 - DNA, 16 bp, H. sapiens
tccacctccctcccgg

SEQ ID NO: 135652 - DNA, 16 bp, H. sapiens
tccacctccctgcctc

SEQ ID NO: 135653 - DNA, 17 bp, H. sapiens
tccacctccctggttca

SEQ ID NO: 135654 - DNA, 16 bp, H. sapiens
tccacctcctggggtc

SEQ ID NO: 135655 - DNA, 17 bp, H. sapiens
tccacctcctgggttca

SEQ ID NO: 135656 - DNA, 16 bp, H. sapiens
tccacctcctggtctc

SEQ ID NO: 135657 - DNA, 16 bp, H. sapiens
tccacctcggcctctc

SEQ ID NO: 135658 - DNA, 16 bp, H. sapiens
tccacctctacaaaaa

SEQ ID NO: 135659 - DNA, 16 bp, H. sapiens
tccacctctggcccct

SEQ ID NO: 135660 - DNA, 16 bp, H. sapiens
tccacctctttacctt

SEQ ID NO: 135661 - DNA, 16 bp, H. sapiens
tccacctgcagagtct

SEQ ID NO: 135662 - DNA, 16 bp, H. sapiens
tccacctgcagcccag

SEQ ID NO: 135663 - DNA, 16 bp, H. sapiens
tccacctgcagccccc

SEQ ID NO: 135664 - DNA, 16 bp, H. sapiens
tccacctgccaaagtg

SEQ ID NO: 135665 - DNA, 16 bp, H. sapiens
tccacctgccccagcc

SEQ ID NO: 135666 - DNA, 16 bp, H. sapiens
tccacctgcctcacct

SEQ ID NO: 135667 - DNA, 16 bp, H. sapiens
tccacctgcctcagct

SEQ ID NO: 135668 - DNA, 16 bp, H. sapiens
tccacctgcctcaggc

SEQ ID NO: 135669 - DNA, 16 bp, H. sapiens
tccacctgcctccacc

SEQ ID NO: 135670 - DNA, 16 bp, H. sapiens
tccacctgcctccgcc

SEQ ID NO: 135671 - DNA, 16 bp, H. sapiens
tccacctgcctctgcc

SEQ ID NO: 135672 - DNA, 16 bp, H. sapiens
tccacctgccttcgcc

SEQ ID NO: 135673 - DNA, 16 bp, H. sapiens
tccacctgctcctggc

SEQ ID NO: 135674 - DNA, 16 bp, H. sapiens
tccacctgctgtggcc

SEQ ID NO: 135675 - DNA, 16 bp, H. sapiens
tccacctggcctccca

SEQ ID NO: 135676 - DNA, 16 bp, H. sapiens
tccacctgggcctccc

SEQ ID NO: 135677 - DNA, 16 bp, H. sapiens
tccacctggttcctcc

SEQ ID NO: 135678 - DNA, 16 bp, H. sapiens
tccaccttacagtcct

SEQ ID NO: 135679 - DNA, 16 bp, H. sapiens
tccaccttaggcctca

SEQ ID NO: 135680 - DNA, 16 bp, H. sapiens
tccaccttcaccatcc

SEQ ID NO: 135681 - DNA, 16 bp, H. sapiens
tccaccttctgggctc

SEQ ID NO: 135682 - DNA, 16 bp, H. sapiens
tccaccttgtcctccc

SEQ ID NO: 135683 - DNA, 19 bp, H. sapiens
tccacgcccagctaatttt

SEQ ID NO: 135684 - DNA, 16 bp, H. sapiens
tccacggtctccctct

SEQ ID NO: 135685 - DNA, 16 bp, H. sapiens
tccacgtgtgtgtgtg

SEQ ID NO: 135686 - DNA, 16 bp, H. sapiens
tccactaaaaacacac

SEQ ID NO: 135687 - DNA, 16 bp, H. sapiens
tccactagaatataag

SEQ ID NO: 135688 - DNA, 17 bp, H. sapiens
tccactagaggcaaggt

SEQ ID NO: 135689 - DNA, 16 bp, H. sapiens
tccactcagaaacccc

SEQ ID NO: 135690 - DNA, 16 bp, H. sapiens
tccactcattcaccca

SEQ ID NO: 135691 - DNA, 16 bp, H. sapiens
tccactccagacactg

SEQ ID NO: 135692 - DNA, 16 bp, H. sapiens
tccactcccctcggcc

SEQ ID NO: 135693 - DNA, 16 bp, H. sapiens
tccactcgattccact

SEQ ID NO: 135694 - DNA, 16 bp, H. sapiens
tccactctctgtgtcc

SEQ ID NO: 135695 - DNA, 16 bp, H. sapiens
tccactgagagctgga

SEQ ID NO: 135696 - DNA, 17 bp, H. sapiens
tccactgcaacctctgc

SEQ ID NO: 135697 - DNA, 16 bp, H. sapiens
tccactgcagcctggg

SEQ ID NO: 135698 - DNA, 16 bp, H. sapiens
tccactgccaccacca

SEQ ID NO: 135699 - DNA, 16 bp, H. sapiens
tccactgtcaatatta

SEQ ID NO: 135700 - DNA, 16 bp, H. sapiens
tccactgtcttctggc

SEQ ID NO: 135701 - DNA, 17 bp, H. sapiens
tccactgtgtgtgtgac

SEQ ID NO: 135702 - DNA, 16 bp, H. sapiens
tccacttatatgtgga

SEQ ID NO: 135703 - DNA, 16 bp, H. sapiens
tccacttcactccagc

SEQ ID NO: 135704 - DNA, 16 bp, H. sapiens
tccacttcagcttccc

SEQ ID NO: 135705 - DNA, 17 bp, H. sapiens
tccacttcctgggttca

SEQ ID NO: 135706 - DNA, 16 bp, H. sapiens
tccacttctgcctccc

SEQ ID NO: 135707 - DNA, 16 bp, H. sapiens
tccacttctgggggca

SEQ ID NO: 135708 - DNA, 16 bp, H. sapiens
tccacttgaagattct

SEQ ID NO: 135709 - DNA, 16 bp, H. sapiens
tccacttgccttggct

SEQ ID NO: 135710 - DNA, 16 bp, H. sapiens
tccacttggtctctcc

SEQ ID NO: 135711 - DNA, 16 bp, H. sapiens
tccactttacagatga

SEQ ID NO: 135712 - DNA, 16 bp, H. sapiens
tccactttcacactgc

SEQ ID NO: 135713 - DNA, 16 bp, H. sapiens
tccactttccagatga

SEQ ID NO: 135714 - DNA, 16 bp, H. sapiens
tccagaaaaaaatgaa

SEQ ID NO: 135715 - DNA, 16 bp, H. sapiens
tccagaaaaaggaaga

SEQ ID NO: 135716 - DNA, 16 bp, H. sapiens
tccagaaaaatatttt

SEQ ID NO: 135717 - DNA, 16 bp, H. sapiens
tccagaaaactgaaga

SEQ ID NO: 135718 - DNA, 16 bp, H. sapiens
tccagaaaagaagtct

SEQ ID NO: 135719 - DNA, 16 bp, H. sapiens
tccagaaacaaaacca

SEQ ID NO: 135720 - DNA, 16 bp, H. sapiens
tccagaaacaacagat

SEQ ID NO: 135721 - DNA, 16 bp, H. sapiens
tccagaaagaagagaa

SEQ ID NO: 135722 - DNA, 16 bp, H. sapiens
tccagaaagcatttta

SEQ ID NO: 135723 - DNA, 16 bp, H. sapiens
tccagaaataaaacaa

SEQ ID NO: 135724 - DNA, 16 bp, H. sapiens
tccagaaataaaccct

SEQ ID NO: 135725 - DNA, 16 bp, H. sapiens
tccagaaataccctca

SEQ ID NO: 135726 - DNA, 16 bp, H. sapiens
tccagaaatagatcca

SEQ ID NO: 135727 - DNA, 16 bp, H. sapiens
tccagaaatttatcca

SEQ ID NO: 135728 - DNA, 16 bp, H. sapiens
tccagaacaatgagaa

SEQ ID NO: 135729 - DNA, 16 bp, H. sapiens
tccagaacagctggga

SEQ ID NO: 135730 - DNA, 16 bp, H. sapiens
tccagaacagggaaat

SEQ ID NO: 135731 - DNA, 16 bp, H. sapiens
tccagaacagtgagaa

SEQ ID NO: 135732 - DNA, 16 bp, H. sapiens
tccagaacatttcatc

SEQ ID NO: 135733 - DNA, 16 bp, H. sapiens
tccagaactttgggag

SEQ ID NO: 135734 - DNA, 16 bp, H. sapiens
tccagaagaaatgcag

SEQ ID NO: 135735 - DNA, 16 bp, H. sapiens
tccagaagatctggct

SEQ ID NO: 135736 - DNA, 16 bp, H. sapiens
tccagaagctggaaaa

SEQ ID NO: 135737 - DNA, 16 bp, H. sapiens
tccagaaggagaagag

SEQ ID NO: 135738 - DNA, 16 bp, H. sapiens
tccagaaggttttcaa

SEQ ID NO: 135739 - DNA, 16 bp, H. sapiens
tccagaatagacaaat

SEQ ID NO: 135740 - DNA, 16 bp, H. sapiens
tccagaataggcaaat

SEQ ID NO: 135741 - DNA, 16 bp, H. sapiens
tccagaatataaaaag

SEQ ID NO: 135742 - DNA, 16 bp, H. sapiens
tccagaatatctttgt

SEQ ID NO: 135743 - DNA, 16 bp, H. sapiens
tccagaatccataagg

SEQ ID NO: 135744 - DNA, 16 bp, H. sapiens
tccagaatcccatcca

SEQ ID NO: 135745 - DNA, 16 bp, H. sapiens
tccagaatggtattgc

SEQ ID NO: 135746 - DNA, 16 bp, H. sapiens
tccagaatggtgagaa

SEQ ID NO: 135747 - DNA, 16 bp, H. sapiens
tccagaatggtgtttc

SEQ ID NO: 135748 - DNA, 16 bp, H. sapiens
tccagaatgtcatata

SEQ ID NO: 135749 - DNA, 16 bp, H. sapiens
tccagaatgtgggaaa

SEQ ID NO: 135750 - DNA, 16 bp, H. sapiens
tccagaattatgagaa

SEQ ID NO: 135751 - DNA, 16 bp, H. sapiens
tccagaattcagaaac

SEQ ID NO: 135752 - DNA, 16 bp, H. sapiens
tccagaattttcattt

SEQ ID NO: 135753 - DNA, 16 bp, H. sapiens
tccagaatttttcatc

SEQ ID NO: 135754 - DNA, 16 bp, H. sapiens
tccagaatttttcttt

SEQ ID NO: 135755 - DNA, 16 bp, H. sapiens
tccagacaagcctggc

SEQ ID NO: 135756 - DNA, 16 bp, H. sapiens
tccagacacctcccac

SEQ ID NO: 135757 - DNA, 16 bp, H. sapiens
tccagacagagcagca

SEQ ID NO: 135758 - DNA, 16 bp, H. sapiens
tccagacagagtctca

SEQ ID NO: 135759 - DNA, 16 bp, H. sapiens
tccagaccaatgtcat

SEQ ID NO: 135760 - DNA, 16 bp, H. sapiens
tccagaccatcacaat

SEQ ID NO: 135761 - DNA, 17 bp, H. sapiens
tccagaccatcctggcc

SEQ ID NO: 135762 - DNA, 16 bp, H. sapiens
tccagaccccagcccc

SEQ ID NO: 135763 - DNA, 16 bp, H. sapiens
tccagacctgctgaat

SEQ ID NO: 135764 - DNA, 16 bp, H. sapiens
tccagactcagcctcc

SEQ ID NO: 135765 - DNA, 16 bp, H. sapiens
tccagactccaagaga

SEQ ID NO: 135766 - DNA, 16 bp, H. sapiens
tccagactcccagaag

SEQ ID NO: 135767 - DNA, 16 bp, H. sapiens
tccagactgtgggaaa

SEQ ID NO: 135768 - DNA, 16 bp, H. sapiens
tccagagaaacagaat

SEQ ID NO: 135769 - DNA, 16 bp, H. sapiens
tccagagaatccctga

SEQ ID NO: 135770 - DNA, 16 bp, H. sapiens
tccagagagcatcagc

SEQ ID NO: 135771 - DNA, 16 bp, H. sapiens
tccagagagctgcctt

SEQ ID NO: 135772 - DNA, 17 bp, H. sapiens
tccagagcattttgcat

SEQ ID NO: 135773 - DNA, 16 bp, H. sapiens
tccagagcccatgctc

SEQ ID NO: 135774 - DNA, 16 bp, H. sapiens
tccagagcctgggcga

SEQ ID NO: 135775 - DNA, 16 bp, H. sapiens
tccagaggaacagaac

SEQ ID NO: 135776 - DNA, 16 bp, H. sapiens
tccagaggcccttatt

SEQ ID NO: 135777 - DNA, 16 bp, H. sapiens
tccagaggctccaggg

SEQ ID NO: 135778 - DNA, 16 bp, H. sapiens
tccagaggctgaggaa

SEQ ID NO: 135779 - DNA, 16 bp, H. sapiens
tccagagggagcacag

SEQ ID NO: 135780 - DNA, 18 bp, H. sapiens
tccagagtgctgggatta

SEQ ID NO: 135781 - DNA, 16 bp, H. sapiens
tccagagttcaagcga

SEQ ID NO: 135782 - DNA, 16 bp, H. sapiens
tccagagtttctttct

SEQ ID NO: 135783 - DNA, 16 bp, H. sapiens
tccagagtttgttcct

SEQ ID NO: 135784 - DNA, 16 bp, H. sapiens
tccagataattcttcc

SEQ ID NO: 135785 - DNA, 16 bp, H. sapiens
tccagatattgtcaaa

SEQ ID NO: 135786 - DNA, 16 bp, H. sapiens
tccagatcagcctggg

SEQ ID NO: 135787 - DNA, 16 bp, H. sapiens
tccagatggctgggga

SEQ ID NO: 135788 - DNA, 16 bp, H. sapiens
tccagatggctggttc

SEQ ID NO: 135789 - DNA, 16 bp, H. sapiens
tccagattggaaaaga

SEQ ID NO: 135790 - DNA, 16 bp, H. sapiens
tccagatttgctcttt

SEQ ID NO: 135791 - DNA, 16 bp, H. sapiens
tccagattttctttct

SEQ ID NO: 135792 - DNA, 16 bp, H. sapiens
tccagattttggctat

SEQ ID NO: 135793 - DNA, 16 bp, H. sapiens
tccagattttttttaa

SEQ ID NO: 135794 - DNA, 16 bp, H. sapiens
tccagcaaaattaagc

SEQ ID NO: 135795 - DNA, 16 bp, H. sapiens
tccagcaatccaccca

SEQ ID NO: 135796 - DNA, 16 bp, H. sapiens
tccagcacaaggcagc

SEQ ID NO: 135797 - DNA, 16 bp, H. sapiens
tccagcaccatccatg

SEQ ID NO: 135798 - DNA, 16 bp, H. sapiens
tccagcactggagatt

SEQ ID NO: 135799 - DNA, 16 bp, H. sapiens
tccagcactttaaata

SEQ ID NO: 135800 - DNA, 16 bp, H. sapiens
tccagcactttgagaa

SEQ ID NO: 135801 - DNA, 16 bp, H. sapiens
tccagcactttgcaag

SEQ ID NO: 135802 - DNA, 16 bp, H. sapiens
tccagcactttgggag

SEQ ID NO: 135803 - DNA, 16 bp, H. sapiens
tccagcagaaaaaaaa

SEQ ID NO: 135804 - DNA, 16 bp, H. sapiens
tccagcagatctgcag

SEQ ID NO: 135805 - DNA, 16 bp, H. sapiens
tccagcagattcagtg

SEQ ID NO: 135806 - DNA, 19 bp, H. sapiens
tccagcagcacatcaaaaa

SEQ ID NO: 135807 - DNA, 16 bp, H. sapiens
tccagcagcctgggtg

SEQ ID NO: 135808 - DNA, 16 bp, H. sapiens
tccagcagctcaggct

SEQ ID NO: 135809 - DNA, 16 bp, H. sapiens
tccagcaggaagtagc

SEQ ID NO: 135810 - DNA, 16 bp, H. sapiens
tccagcaggacagtca

SEQ ID NO: 135811 - DNA, 16 bp, H. sapiens
tccagcatctacaaag

SEQ ID NO: 135812 - DNA, 16 bp, H. sapiens
tccagcatctagcaca

SEQ ID NO: 135813 - DNA, 16 bp, H. sapiens
tccagcatggatgaca

SEQ ID NO: 135814 - DNA, 16 bp, H. sapiens
tccagcatgggcaaca

SEQ ID NO: 135815 - DNA, 16 bp, H. sapiens
tccagcatttctttat

SEQ ID NO: 135816 - DNA, 16 bp, H. sapiens
tccagccacactggtc

SEQ ID NO: 135817 - DNA, 16 bp, H. sapiens
tccagccacagcctca

SEQ ID NO: 135818 - DNA, 16 bp, H. sapiens
tccagccacagcctcc

SEQ ID NO: 135819 - DNA, 16 bp, H. sapiens
tccagccacccatcca

SEQ ID NO: 135820 - DNA, 16 bp, H. sapiens
tccagccacccctgcc

SEQ ID NO: 135821 - DNA, 16 bp, H. sapiens
tccagccaccttggcc

SEQ ID NO: 135822 - DNA, 16 bp, H. sapiens
tccagccactcaggag

SEQ ID NO: 135823 - DNA, 16 bp, H. sapiens
tccagccagccagcca

SEQ ID NO: 135824 - DNA, 16 bp, H. sapiens
tccagccagcctgggc

SEQ ID NO: 135825 - DNA, 16 bp, H. sapiens
tccagccaggagatgg

SEQ ID NO: 135826 - DNA, 20 bp, H. sapiens
tccagccaggcgcagtggct

SEQ ID NO: 135827 - DNA, 16 bp, H. sapiens
tccagccagggccaca

SEQ ID NO: 135828 - DNA, 16 bp, H. sapiens
tccagccaggtgcagt

SEQ ID NO: 135829 - DNA, 16 bp, H. sapiens
tccagccagtccctct

SEQ ID NO: 135830 - DNA, 16 bp, H. sapiens
tccagccatgcagaac

SEQ ID NO: 135831 - DNA, 16 bp, H. sapiens
tccagccatgctggcc

SEQ ID NO: 135832 - DNA, 16 bp, H. sapiens
tccagcccactgcctg

SEQ ID NO: 135833 - DNA, 16 bp, H. sapiens
tccagcccagcctggg

SEQ ID NO: 135834 - DNA, 16 bp, H. sapiens
tccagccccaaatgcc

SEQ ID NO: 135835 - DNA, 16 bp, H. sapiens
tccagccccactggcc

SEQ ID NO: 135836 - DNA, 16 bp, H. sapiens
tccagccccagccaag

SEQ ID NO: 135837 - DNA, 16 bp, H. sapiens
tccagccccagcccct

SEQ ID NO: 135838 - DNA, 16 bp, H. sapiens
tccagccccagccctg

SEQ ID NO: 135839 - DNA, 16 bp, H. sapiens
tccagccccagcctgg

SEQ ID NO: 135840 - DNA, 16 bp, H. sapiens
tccagccccagctcct

SEQ ID NO: 135841 - DNA, 16 bp, H. sapiens
tccagccccagctgag

SEQ ID NO: 135842 - DNA, 16 bp, H. sapiens
tccagcccctctgggg

SEQ ID NO: 135843 - DNA, 16 bp, H. sapiens
tccagcccctgacaac

SEQ ID NO: 135844 - DNA, 16 bp, H. sapiens
tccagcccctgctgcc

SEQ ID NO: 135845 - DNA, 16 bp, H. sapiens
tccagcccgagcaaca

SEQ ID NO: 135846 - DNA, 16 bp, H. sapiens
tccagcccggggaaca

SEQ ID NO: 135847 - DNA, 16 bp, H. sapiens
tccagccgctgcctcc

SEQ ID NO: 135848 - DNA, 16 bp, H. sapiens
tccagcctacgcaaca

SEQ ID NO: 135849 - DNA, 19 bp, H. sapiens
tccagcctaggtgacagaa

SEQ ID NO: 135850 - DNA, 16 bp, H. sapiens
tccagcctatactggc

SEQ ID NO: 135851 - DNA, 16 bp, H. sapiens
tccagcctcagcctgg

SEQ ID NO: 135852 - DNA, 16 bp, H. sapiens
tccagcctcatctcct

SEQ ID NO: 135853 - DNA, 16 bp, H. sapiens
tccagcctccagccca

SEQ ID NO: 135854 - DNA, 16 bp, H. sapiens
tccagcctccagcctg

SEQ ID NO: 135855 - DNA, 16 bp, H. sapiens
tccagcctccatcttt

SEQ ID NO: 135856 - DNA, 16 bp, H. sapiens
tccagcctcctcctcc

SEQ ID NO: 135857 - DNA, 16 bp, H. sapiens
tccagcctcggcaaca

SEQ ID NO: 135858 - DNA, 16 bp, H. sapiens
tccagcctctccctcc

SEQ ID NO: 135859 - DNA, 16 bp, H. sapiens
tccagcctctgcctcc

SEQ ID NO: 135860 - DNA, 16 bp, H. sapiens
tccagcctctgcctgt

SEQ ID NO: 135861 - DNA, 16 bp, H. sapiens
tccagcctctgccttt

SEQ ID NO: 135862 - DNA, 16 bp, H. sapiens
tccagcctctggaact

SEQ ID NO: 135863 - DNA, 16 bp, H. sapiens
tccagcctgaataaca

SEQ ID NO: 135864 - DNA, 16 bp, H. sapiens
tccagcctgagaaaca

SEQ ID NO: 135865 - DNA, 18 bp, H. sapiens
tccagcctgagcgacagg

SEQ ID NO: 135866 - DNA, 16 bp, H. sapiens
tccagcctgagctaca

SEQ ID NO: 135867 - DNA, 16 bp, H. sapiens
tccagcctgaggtggt

SEQ ID NO: 135868 - DNA, 16 bp, H. sapiens
tccagcctgagtgaca

SEQ ID NO: 135869 - DNA, 16 bp, H. sapiens
tccagcctgcagcctg

SEQ ID NO: 135870 - DNA, 16 bp, H. sapiens
tccagcctgcaggctt

SEQ ID NO: 135871 - DNA, 16 bp, H. sapiens
tccagcctgcccttcc

SEQ ID NO: 135872 - DNA, 16 bp, H. sapiens
tccagcctgcgtgaca

SEQ ID NO: 135873 - DNA, 16 bp, H. sapiens
tccagcctggacagag

SEQ ID NO: 135874 - DNA, 16 bp, H. sapiens
tccagcctggactgca

SEQ ID NO: 135875 - DNA, 16 bp, H. sapiens
tccagcctggaggcag

SEQ ID NO: 135876 - DNA, 16 bp, H. sapiens
tccagcctggatgacc

SEQ ID NO: 135877 - DNA, 16 bp, H. sapiens
tccagcctggatgcca

SEQ ID NO: 135878 - DNA, 16 bp, H. sapiens
tccagcctggatggca

SEQ ID NO: 135879 - DNA, 17 bp, H. sapiens
tccagcctggccaacat

SEQ ID NO: 135880 - DNA, 16 bp, H. sapiens
tccagcctggctgaaa

SEQ ID NO: 135881 - DNA, 16 bp, H. sapiens
tccagcctgggacaga

SEQ ID NO: 135882 - DNA, 16 bp, H. sapiens
tccagcctgggcaaca

SEQ ID NO: 135883 - DNA, 18 bp, H. sapiens
tccagcctgggcaacatg

SEQ ID NO: 135884 - DNA, 16 bp, H. sapiens
tccagcctgggcaacc

SEQ ID NO: 135885 - DNA, 16 bp, H. sapiens
tccagcctgggcgcca

SEQ ID NO: 135886 - DNA, 16 bp, H. sapiens
tccagcctgggcgtca

SEQ ID NO: 135887 - DNA, 16 bp, H. sapiens
tccagcctgggctctg

SEQ ID NO: 135888 - DNA, 16 bp, H. sapiens
tccagcctggggaaga

SEQ ID NO: 135889 - DNA, 16 bp, H. sapiens
tccagcctggggcctg

SEQ ID NO: 135890 - DNA, 16 bp, H. sapiens
tccagcctgggtcaga

SEQ ID NO: 135891 - DNA, 16 bp, H. sapiens
tccagcctgggtgagg

SEQ ID NO: 135892 - DNA, 16 bp, H. sapiens
tccagcctgggtgcag

SEQ ID NO: 135893 - DNA, 16 bp, H. sapiens
tccagcctgggtgtcg

SEQ ID NO: 135894 - DNA, 16 bp, H. sapiens
tccagcctgggttata

SEQ ID NO: 135895 - DNA, 16 bp, H. sapiens
tccagcctggttgaca

SEQ ID NO: 135896 - DNA, 17 bp, H. sapiens
tccagcctgtgcgacag

SEQ ID NO: 135897 - DNA, 16 bp, H. sapiens
tccagcctgtgtgaca

SEQ ID NO: 135898 - DNA, 16 bp, H. sapiens
tccagccttgacctcc

SEQ ID NO: 135899 - DNA, 16 bp, H. sapiens
tccagccttggcaaga

SEQ ID NO: 135900 - DNA, 16 bp, H. sapiens
tccagccttggggaca

SEQ ID NO: 135901 - DNA, 16 bp, H. sapiens
tccagccttggtgaaa

SEQ ID NO: 135902 - DNA, 16 bp, H. sapiens
tccagccttgtgacag

SEQ ID NO: 135903 - DNA, 16 bp, H. sapiens
tccagcgatcctcccg

SEQ ID NO: 135904 - DNA, 16 bp, H. sapiens
tccagcgtgagcaaca

SEQ ID NO: 135905 - DNA, 16 bp, H. sapiens
tccagcgtgggccaca

SEQ ID NO: 135906 - DNA, 16 bp, H. sapiens
tccagctaattattgt

SEQ ID NO: 135907 - DNA, 16 bp, H. sapiens
tccagctactcgggtg

SEQ ID NO: 135908 - DNA, 21 bp, H. sapiens
tccagctacttgggaggctgg

SEQ ID NO: 135909 - DNA, 16 bp, H. sapiens
tccagctcagaggcca

SEQ ID NO: 135910 - DNA, 16 bp, H. sapiens
tccagctccagctcca

SEQ ID NO: 135911 - DNA, 16 bp, H. sapiens
tccagctccatcaatg

SEQ ID NO: 135912 - DNA, 16 bp, H. sapiens
tccagctccatctatg

SEQ ID NO: 135913 - DNA, 16 bp, H. sapiens
tccagctccccatcct

SEQ ID NO: 135914 - DNA, 16 bp, H. sapiens
tccagctctccttcct

SEQ ID NO: 135915 - DNA, 16 bp, H. sapiens
tccagctctgctgctt

SEQ ID NO: 135916 - DNA, 17 bp, H. sapiens
tccagctgcacatcaaa

SEQ ID NO: 135917 - DNA, 16 bp, H. sapiens
tccagctgctcaggag

SEQ ID NO: 135918 - DNA, 16 bp, H. sapiens
tccagctgctgctgct

SEQ ID NO: 135919 - DNA, 16 bp, H. sapiens
tccagctgctgcttct

SEQ ID NO: 135920 - DNA, 16 bp, H. sapiens
tccagctgctggggag

SEQ ID NO: 135921 - DNA, 16 bp, H. sapiens
tccagctggagtgcag

SEQ ID NO: 135922 - DNA, 16 bp, H. sapiens
tccagctgggacaaca

SEQ ID NO: 135923 - DNA, 16 bp, H. sapiens
tccagctgggagacag

SEQ ID NO: 135924 - DNA, 16 bp, H. sapiens
tccagctgggtgctgg

SEQ ID NO: 135925 - DNA, 16 bp, H. sapiens
tccagctgggtgtggt

SEQ ID NO: 135926 - DNA, 16 bp, H. sapiens
tccagctgtggctcaa

SEQ ID NO: 135927 - DNA, 16 bp, H. sapiens
tccagcttcagcctct

SEQ ID NO: 135928 - DNA, 16 bp, H. sapiens
tccagcttcagcttct

SEQ ID NO: 135929 - DNA, 16 bp, H. sapiens
tccagcttcagtgaca

SEQ ID NO: 135930 - DNA, 16 bp, H. sapiens
tccagcttcatccaca

SEQ ID NO: 135931 - DNA, 16 bp, H. sapiens
tccagcttccagagct

SEQ ID NO: 135932 - DNA, 16 bp, H. sapiens
tccagcttctcaggag

SEQ ID NO: 135933 - DNA, 16 bp, H. sapiens
tccagcttctccacat

SEQ ID NO: 135934 - DNA, 16 bp, H. sapiens
tccagcttgggcaaca

SEQ ID NO: 135935 - DNA, 17 bp, H. sapiens
tccagcttgggtgacac

SEQ ID NO: 135936 - DNA, 16 bp, H. sapiens
tccagcttggtggggg

SEQ ID NO: 135937 - DNA, 16 bp, H. sapiens
tccagctttaagcctt

SEQ ID NO: 135938 - DNA, 16 bp, H. sapiens
tccagctttgttcttc

SEQ ID NO: 135939 - DNA, 16 bp, H. sapiens
tccaggaaaatatttt

SEQ ID NO: 135940 - DNA, 16 bp, H. sapiens
tccaggaaagaattca

SEQ ID NO: 135941 - DNA, 16 bp, H. sapiens
tccaggaaaggcaagg

SEQ ID NO: 135942 - DNA, 16 bp, H. sapiens
tccaggaaccacactt

SEQ ID NO: 135943 - DNA, 16 bp, H. sapiens
tccaggaactgaactc

SEQ ID NO: 135944 - DNA, 16 bp, H. sapiens
tccaggaactgactca

SEQ ID NO: 135945 - DNA, 16 bp, H. sapiens
tccaggaagaatgagg

SEQ ID NO: 135946 - DNA, 16 bp, H. sapiens
tccaggaagcagcagg

SEQ ID NO: 135947 - DNA, 16 bp, H. sapiens
tccaggaagccctcca

SEQ ID NO: 135948 - DNA, 16 bp, H. sapiens
tccaggaaggcttcct

SEQ ID NO: 135949 - DNA, 16 bp, H. sapiens
tccaggaatctgcatt

SEQ ID NO: 135950 - DNA, 16 bp, H. sapiens
tccaggacaatgttga

SEQ ID NO: 135951 - DNA, 16 bp, H. sapiens
tccaggaccagacaga

SEQ ID NO: 135952 - DNA, 16 bp, H. sapiens
tccaggactatgagaa

SEQ ID NO: 135953 - DNA, 16 bp, H. sapiens
tccaggacttggtgac

SEQ ID NO: 135954 - DNA, 16 bp, H. sapiens
tccaggactttgagac

SEQ ID NO: 135955 - DNA, 16 bp, H. sapiens
tccaggagaacttcca

SEQ ID NO: 135956 - DNA, 16 bp, H. sapiens
tccaggagaagttccc

SEQ ID NO: 135957 - DNA, 16 bp, H. sapiens
tccaggagagagatga

SEQ ID NO: 135958 - DNA, 16 bp, H. sapiens
tccaggagataatcaa

SEQ ID NO: 135959 - DNA, 16 bp, H. sapiens
tccaggagatggaggc

SEQ ID NO: 135960 - DNA, 16 bp, H. sapiens
tccaggagcacatcaa

SEQ ID NO: 135961 - DNA, 16 bp, H. sapiens
tccaggagcagtggct

SEQ ID NO: 135962 - DNA, 16 bp, H. sapiens
tccaggagcccccagc

SEQ ID NO: 135963 - DNA, 16 bp, H. sapiens
tccaggaggccaaggc

SEQ ID NO: 135964 - DNA, 16 bp, H. sapiens
tccaggaggcggagct

SEQ ID NO: 135965 - DNA, 16 bp, H. sapiens
tccaggagggcaggga

SEQ ID NO: 135966 - DNA, 16 bp, H. sapiens
tccaggaggtcaaggc

SEQ ID NO: 135967 - DNA, 16 bp, H. sapiens
tccaggaggtggaagt

SEQ ID NO: 135968 - DNA, 16 bp, H. sapiens
tccaggagtggtggct

SEQ ID NO: 135969 - DNA, 16 bp, H. sapiens
tccaggagtttgagaa

SEQ ID NO: 135970 - DNA, 16 bp, H. sapiens
tccaggataatttccc

SEQ ID NO: 135971 - DNA, 16 bp, H. sapiens
tccaggatctggtttt

SEQ ID NO: 135972 - DNA, 16 bp, H. sapiens
tccaggcaaaagatga

SEQ ID NO: 135973 - DNA, 16 bp, H. sapiens
tccaggcagaaatctg

SEQ ID NO: 135974 - DNA, 16 bp, H. sapiens
tccaggcagaggaaac

SEQ ID NO: 135975 - DNA, 16 bp, H. sapiens
tccaggcagaggtggt

SEQ ID NO: 135976 - DNA, 16 bp, H. sapiens
tccaggcaggagagga

SEQ ID NO: 135977 - DNA, 16 bp, H. sapiens
tccaggcatagtggct

SEQ ID NO: 135978 - DNA, 16 bp, H. sapiens
tccaggcatggtggca

SEQ ID NO: 135979 - DNA, 19 bp, H. sapiens
tccaggcatggtggtgcac

SEQ ID NO: 135980 - DNA, 16 bp, H. sapiens
tccaggccagagtgca

SEQ ID NO: 135981 - DNA, 16 bp, H. sapiens
tccaggccagcctggg

SEQ ID NO: 135982 - DNA, 16 bp, H. sapiens
tccaggccaggaacaa

SEQ ID NO: 135983 - DNA, 16 bp, H. sapiens
tccaggcccagaactt

SEQ ID NO: 135984 - DNA, 16 bp, H. sapiens
tccaggcccagatggt

SEQ ID NO: 135985 - DNA, 16 bp, H. sapiens
tccaggcccagcccct

SEQ ID NO: 135986 - DNA, 16 bp, H. sapiens
tccaggcctctctcca

SEQ ID NO: 135987 - DNA, 16 bp, H. sapiens
tccaggcctggcagca

SEQ ID NO: 135988 - DNA, 16 bp, H. sapiens
tccaggcctgggcctc

SEQ ID NO: 135989 - DNA, 16 bp, H. sapiens
tccaggcctgggtgac

SEQ ID NO: 135990 - DNA, 16 bp, H. sapiens
tccaggcctgtggtgg

SEQ ID NO: 135991 - DNA, 16 bp, H. sapiens
tccaggccttcttgtt

SEQ ID NO: 135992 - DNA, 16 bp, H. sapiens
tccaggctctgccact

SEQ ID NO: 135993 - DNA, 16 bp, H. sapiens
tccaggctgcagtgag

SEQ ID NO: 135994 - DNA, 16 bp, H. sapiens
tccaggctgctgtgag

SEQ ID NO: 135995 - DNA, 16 bp, H. sapiens
tccaggctggaggaca

SEQ ID NO: 135996 - DNA, 16 bp, H. sapiens
tccaggctggagggca

SEQ ID NO: 135997 - DNA, 16 bp, H. sapiens
tccaggctggagtaca

SEQ ID NO: 135998 - DNA, 16 bp, H. sapiens
tccaggctggagtcca

SEQ ID NO: 135999 - DNA, 16 bp, H. sapiens
tccaggctggagtgca

SEQ ID NO: 136000 - DNA, 16 bp, H. sapiens
tccaggctggagtgcg

SEQ ID NO: 136001 - DNA, 16 bp, H. sapiens
tccaggctggagttca

SEQ ID NO: 136002 - DNA, 16 bp, H. sapiens
tccaggctggattgca

SEQ ID NO: 136003 - DNA, 16 bp, H. sapiens
tccaggctggcgtgca

SEQ ID NO: 136004 - DNA, 16 bp, H. sapiens
tccaggctgggagaca

SEQ ID NO: 136005 - DNA, 16 bp, H. sapiens
tccaggctgggtgaca

SEQ ID NO: 136006 - DNA, 16 bp, H. sapiens
tccaggctgggtgaga

SEQ ID NO: 136007 - DNA, 16 bp, H. sapiens
tccaggctgtggtggt

SEQ ID NO: 136008 - DNA, 16 bp, H. sapiens
tccaggcttccttctg

SEQ ID NO: 136009 - DNA, 16 bp, H. sapiens
tccagggaattctcct

SEQ ID NO: 136010 - DNA, 16 bp, H. sapiens
tccagggactgttgtg

SEQ ID NO: 136011 - DNA, 16 bp, H. sapiens
tccagggaggaggagg

SEQ ID NO: 136012 - DNA, 16 bp, H. sapiens
tccagggaggggagag

SEQ ID NO: 136013 - DNA, 16 bp, H. sapiens
tccagggctcagggca

SEQ ID NO: 136014 - DNA, 16 bp, H. sapiens
tccaggggaacttccc

SEQ ID NO: 136015 - DNA, 16 bp, H. sapiens
tccaggggcaggcagg

SEQ ID NO: 136016 - DNA, 16 bp, H. sapiens
tccaggggggtcactg

SEQ ID NO: 136017 - DNA, 16 bp, H. sapiens
tccagggtctaaaacc

SEQ ID NO: 136018 - DNA, 16 bp, H. sapiens
tccagggtctccagct

SEQ ID NO: 136019 - DNA, 16 bp, H. sapiens
tccagggtggtcttga

SEQ ID NO: 136020 - DNA, 16 bp, H. sapiens
tccaggtactggaaaa

SEQ ID NO: 136021 - DNA, 16 bp, H. sapiens
tccaggtagacagtgt

SEQ ID NO: 136022 - DNA, 16 bp, H. sapiens
tccaggtggctcagaa

SEQ ID NO: 136023 - DNA, 16 bp, H. sapiens
tccaggtgggcccaat

SEQ ID NO: 136024 - DNA, 16 bp, H. sapiens
tccaggtgtgggcagg

SEQ ID NO: 136025 - DNA, 16 bp, H. sapiens
tccaggttcaagcaat

SEQ ID NO: 136026 - DNA, 16 bp, H. sapiens
tccaggttcatccatg

SEQ ID NO: 136027 - DNA, 16 bp, H. sapiens
tccaggttttgtgggg

SEQ ID NO: 136028 - DNA, 16 bp, H. sapiens
tccagtaaaaatatcc

SEQ ID NO: 136029 - DNA, 16 bp, H. sapiens
tccagtaagaacaaaa

SEQ ID NO: 136030 - DNA, 16 bp, H. sapiens
tccagtacaatgttga

SEQ ID NO: 136031 - DNA, 16 bp, H. sapiens
tccagtacagtagcca

SEQ ID NO: 136032 - DNA, 16 bp, H. sapiens
tccagtcaatagaaaa

SEQ ID NO: 136033 - DNA, 16 bp, H. sapiens
tccagtcacctcccat

SEQ ID NO: 136034 - DNA, 16 bp, H. sapiens
tccagtccaccattga

SEQ ID NO: 136035 - DNA, 16 bp, H. sapiens
tccagtccagcctggg

SEQ ID NO: 136036 - DNA, 16 bp, H. sapiens
tccagtccaggcaaca

SEQ ID NO: 136037 - DNA, 16 bp, H. sapiens
tccagtcctggctctg

SEQ ID NO: 136038 - DNA, 16 bp, H. sapiens
tccagtcctttttttt

SEQ ID NO: 136039 - DNA, 17 bp, H. sapiens
tccagtctatcattcat

SEQ ID NO: 136040 - DNA, 16 bp, H. sapiens
tccagtctgaatgaca

SEQ ID NO: 136041 - DNA, 16 bp, H. sapiens
tccagtctgagcaaca

SEQ ID NO: 136042 - DNA, 16 bp, H. sapiens
tccagtctgggtgaga

SEQ ID NO: 136043 - DNA, 16 bp, H. sapiens
tccagtgaccagcccc

SEQ ID NO: 136044 - DNA, 16 bp, H. sapiens
tccagtgacctgggaa

SEQ ID NO: 136045 - DNA, 16 bp, H. sapiens
tccagtgaggaggaat

SEQ ID NO: 136046 - DNA, 16 bp, H. sapiens
tccagtgatgtgacct

SEQ ID NO: 136047 - DNA, 16 bp, H. sapiens
tccagtgccatccatg

SEQ ID NO: 136048 - DNA, 16 bp, H. sapiens
tccagtgctctttcca

SEQ ID NO: 136049 - DNA, 16 bp, H. sapiens
tccagtggctggtacc

SEQ ID NO: 136050 - DNA, 16 bp, H. sapiens
tccagtgggtctttgc

SEQ ID NO: 136051 - DNA, 16 bp, H. sapiens
tccagtgtcagctttc

SEQ ID NO: 136052 - DNA, 16 bp, H. sapiens
tccagtgttttgggag

SEQ ID NO: 136053 - DNA, 16 bp, H. sapiens
tccagtgttttttgtt

SEQ ID NO: 136054 - DNA, 16 bp, H. sapiens
tccagttcacagaaaa

SEQ ID NO: 136055 - DNA, 16 bp, H. sapiens
tccagttcattccatt

SEQ ID NO: 136056 - DNA, 16 bp, H. sapiens
tccagttccaaagcca

SEQ ID NO: 136057 - DNA, 16 bp, H. sapiens
tccagttccatccatg

SEQ ID NO: 136058 - DNA, 16 bp, H. sapiens
tccagttcccaaaaag

SEQ ID NO: 136059 - DNA, 16 bp, H. sapiens
tccagttcccaagaag

SEQ ID NO: 136060 - DNA, 16 bp, H. sapiens
tccagttccttcaaag

SEQ ID NO: 136061 - DNA, 16 bp, H. sapiens
tccagttctcccagca

SEQ ID NO: 136062 - DNA, 16 bp, H. sapiens
tccagttctgctctga

SEQ ID NO: 136063 - DNA, 16 bp, H. sapiens
tccagttctggaggct

SEQ ID NO: 136064 - DNA, 16 bp, H. sapiens
tccagttgctccagca

SEQ ID NO: 136065 - DNA, 16 bp, H. sapiens
tccagtttcaattttc

SEQ ID NO: 136066 - DNA, 16 bp, H. sapiens
tccagtttcactcttc

SEQ ID NO: 136067 - DNA, 16 bp, H. sapiens
tccagtttcattattc

SEQ ID NO: 136068 - DNA, 16 bp, H. sapiens
tccagtttccaatacc

SEQ ID NO: 136069 - DNA, 16 bp, H. sapiens
tccagtttctccaaat

SEQ ID NO: 136070 - DNA, 16 bp, H. sapiens
tccagtttctccagca

SEQ ID NO: 136071 - DNA, 16 bp, H. sapiens
tccagtttgggtgaca

SEQ ID NO: 136072 - DNA, 16 bp, H. sapiens
tccagttttgtgccct

SEQ ID NO: 136073 - DNA, 16 bp, H. sapiens
tccagttttgttattt

SEQ ID NO: 136074 - DNA, 16 bp, H. sapiens
tccagtttttggacag

SEQ ID NO: 136075 - DNA, 16 bp, H. sapiens
tccagttttttaaaaa

SEQ ID NO: 136076 - DNA, 16 bp, H. sapiens
tccataaaaggaaaaa

SEQ ID NO: 136077 - DNA, 16 bp, H. sapiens
tccataaaaggcccaa

SEQ ID NO: 136078 - DNA, 16 bp, H. sapiens
tccataataaaatgtt

SEQ ID NO: 136079 - DNA, 16 bp, H. sapiens
tccatacagcagccag

SEQ ID NO: 136080 - DNA, 16 bp, H. sapiens
tccatagatgcagaaa

SEQ ID NO: 136081 - DNA, 16 bp, H. sapiens
tccataggttgctttt

SEQ ID NO: 136082 - DNA, 16 bp, H. sapiens
tccatataaccaaaaa

SEQ ID NO: 136083 - DNA, 16 bp, H. sapiens
tccatatctttgccat

SEQ ID NO: 136084 - DNA, 16 bp, H. sapiens
tccatatgaattttgg

SEQ ID NO: 136085 - DNA, 16 bp, H. sapiens
tccatatgttttcctt

SEQ ID NO: 136086 - DNA, 16 bp, H. sapiens
tccatatttttgcagt

SEQ ID NO: 136087 - DNA, 16 bp, H. sapiens
tccatcaaagaaaatg

SEQ ID NO: 136088 - DNA, 16 bp, H. sapiens
tccatcaacagaaaaa

SEQ ID NO: 136089 - DNA, 16 bp, H. sapiens
tccatcaacagataaa

SEQ ID NO: 136090 - DNA, 16 bp, H. sapiens
tccatcaagggatgaa

SEQ ID NO: 136091 - DNA, 16 bp, H. sapiens
tccatcaagtggaaga

SEQ ID NO: 136092 - DNA, 16 bp, H. sapiens
tccatcaagttcaaga

SEQ ID NO: 136093 - DNA, 16 bp, H. sapiens
tccatcacccaggctg

SEQ ID NO: 136094 - DNA, 16 bp, H. sapiens
tccatcaccctaaaaa

SEQ ID NO: 136095 - DNA, 16 bp, H. sapiens
tccatcaccttgaaca

SEQ ID NO: 136096 - DNA, 16 bp, H. sapiens
tccatcagagaccacc

SEQ ID NO: 136097 - DNA, 16 bp, H. sapiens
tccatcagcctcagcc

SEQ ID NO: 136098 - DNA, 16 bp, H. sapiens
tccatcaggaaaaaaa

SEQ ID NO: 136099 - DNA, 16 bp, H. sapiens
tccatcagtggacaaa

SEQ ID NO: 136100 - DNA, 16 bp, H. sapiens
tccatcagtggataaa

SEQ ID NO: 136101 - DNA, 16 bp, H. sapiens
tccatcagttgatgga

SEQ ID NO: 136102 - DNA, 16 bp, H. sapiens
tccatcatccacccac

SEQ ID NO: 136103 - DNA, 16 bp, H. sapiens
tccatcattctcagca

SEQ ID NO: 136104 - DNA, 16 bp, H. sapiens
tccatccacctgtcca

SEQ ID NO: 136105 - DNA, 16 bp, H. sapiens
tccatccacttatcca

SEQ ID NO: 136106 - DNA, 16 bp, H. sapiens
tccatccatcacccat

SEQ ID NO: 136107 - DNA, 16 bp, H. sapiens
tccatccatccatcca

SEQ ID NO: 136108 - DNA, 16 bp, H. sapiens
tccatccatccttcca

SEQ ID NO: 136109 - DNA, 16 bp, H. sapiens
tccatccatcctttca

SEQ ID NO: 136110 - DNA, 16 bp, H. sapiens
tccatccatctaccca

SEQ ID NO: 136111 - DNA, 16 bp, H. sapiens
tccatccatggaaaaa

SEQ ID NO: 136112 - DNA, 16 bp, H. sapiens
tccatccattcctcct

SEQ ID NO: 136113 - DNA, 16 bp, H. sapiens
tccatccctgtccctg

SEQ ID NO: 136114 - DNA, 16 bp, H. sapiens
tccatcctccatccat

SEQ ID NO: 136115 - DNA, 16 bp, H. sapiens
tccatcctggatgaca

SEQ ID NO: 136116 - DNA, 16 bp, H. sapiens
tccatcctggctaaca

SEQ ID NO: 136117 - DNA, 16 bp, H. sapiens
tccatcctgggcagca

SEQ ID NO: 136118 - DNA, 16 bp, H. sapiens
tccatcctgggctaca

SEQ ID NO: 136119 - DNA, 16 bp, H. sapiens
tccatcctgggtaaca

SEQ ID NO: 136120 - DNA, 16 bp, H. sapiens
tccatccttccatcca

SEQ ID NO: 136121 - DNA, 16 bp, H. sapiens
tccatcgatggacact

SEQ ID NO: 136122 - DNA, 16 bp, H. sapiens
tccatctacccaccca

SEQ ID NO: 136123 - DNA, 16 bp, H. sapiens
tccatctacctgtcca

SEQ ID NO: 136124 - DNA, 48 bp, H. sapiens
tccatctactgagatagggaaaaaccgccttagggctggaggtgggac

SEQ ID NO: 136125 - DNA, 16 bp, H. sapiens
tccatctagaaactca

SEQ ID NO: 136126 - DNA, 16 bp, H. sapiens
tccatctattcatccc

SEQ ID NO: 136127 - DNA, 16 bp, H. sapiens
tccatctcaaaaaaaa

SEQ ID NO: 136128 - DNA, 16 bp, H. sapiens
tccatctcaaaagaaa

SEQ ID NO: 136129 - DNA, 16 bp, H. sapiens
tccatctcaaagaaac

SEQ ID NO: 136130 - DNA, 16 bp, H. sapiens
tccatctcaaatacat

SEQ ID NO: 136131 - DNA, 16 bp, H. sapiens
tccatctcagaaaaac

SEQ ID NO: 136132 - DNA, 16 bp, H. sapiens
tccatctcatgtgcaa

SEQ ID NO: 136133 - DNA, 16 bp, H. sapiens
tccatctccaagaaaa

SEQ ID NO: 136134 - DNA, 16 bp, H. sapiens
tccatctccagaaatt

SEQ ID NO: 136135 - DNA, 16 bp, H. sapiens
tccatctccagaactt

SEQ ID NO: 136136 - DNA, 16 bp, H. sapiens
tccatctccatctctt

SEQ ID NO: 136137 - DNA, 16 bp, H. sapiens
tccatctcccggattc

SEQ ID NO: 136138 - DNA, 16 bp, H. sapiens
tccatctccctgggac

SEQ ID NO: 136139 - DNA, 16 bp, H. sapiens
tccatctcctgacttt

SEQ ID NO: 136140 - DNA, 16 bp, H. sapiens
tccatctctacaaaaa

SEQ ID NO: 136141 - DNA, 16 bp, H. sapiens
tccatctctgcctccc

SEQ ID NO: 136142 - DNA, 16 bp, H. sapiens
tccatctcttgacctc

SEQ ID NO: 136143 - DNA, 16 bp, H. sapiens
tccatctctttgtttt

SEQ ID NO: 136144 - DNA, 16 bp, H. sapiens
tccatctgcaaagcca

SEQ ID NO: 136145 - DNA, 16 bp, H. sapiens
tccatctgtccgtcca

SEQ ID NO: 136146 - DNA, 16 bp, H. sapiens
tccatctgtgtccctg

SEQ ID NO: 136147 - DNA, 16 bp, H. sapiens
tccatcttcaaggcca

SEQ ID NO: 136148 - DNA, 16 bp, H. sapiens
tccatcttcagagcca

SEQ ID NO: 136149 - DNA, 16 bp, H. sapiens
tccatcttcatccatg

SEQ ID NO: 136150 - DNA, 16 bp, H. sapiens
tccatcttctcctgcc

SEQ ID NO: 136151 - DNA, 16 bp, H. sapiens
tccatcttctcttgcc

SEQ ID NO: 136152 - DNA, 16 bp, H. sapiens
tccatcttgagtaaat

SEQ ID NO: 136153 - DNA, 16 bp, H. sapiens
tccatcttgttttatg

SEQ ID NO: 136154 - DNA, 16 bp, H. sapiens
tccatctttgtggttt

SEQ ID NO: 136155 - DNA, 16 bp, H. sapiens
tccatgaaacaggaag

SEQ ID NO: 136156 - DNA, 16 bp, H. sapiens
tccatgaaagcagcca

SEQ ID NO: 136157 - DNA, 16 bp, H. sapiens
tccatgaaggcagaaa

SEQ ID NO: 136158 - DNA, 16 bp, H. sapiens
tccatgaaggctctgc

SEQ ID NO: 136159 - DNA, 16 bp, H. sapiens
tccatgacccatggct

SEQ ID NO: 136160 - DNA, 16 bp, H. sapiens
tccatgaccttgggca

SEQ ID NO: 136161 - DNA, 16 bp, H. sapiens
tccatgagaacagaga

SEQ ID NO: 136162 - DNA, 16 bp, H. sapiens
tccatgagagcaggga

SEQ ID NO: 136163 - DNA, 16 bp, H. sapiens
tccatgagcatggatt

SEQ ID NO: 136164 - DNA, 16 bp, H. sapiens
tccatgagcatggcat

SEQ ID NO: 136165 - DNA, 16 bp, H. sapiens
tccatgatgccccctg

SEQ ID NO: 136166 - DNA, 16 bp, H. sapiens
tccatgccaggccctg

SEQ ID NO: 136167 - DNA, 16 bp, H. sapiens
tccatgccctgacctc

SEQ ID NO: 136168 - DNA, 16 bp, H. sapiens
tccatgctgggtgaca

SEQ ID NO: 136169 - DNA, 16 bp, H. sapiens
tccatggactgcagaa

SEQ ID NO: 136170 - DNA, 16 bp, H. sapiens
tccatggagcatgcag

SEQ ID NO: 136171 - DNA, 16 bp, H. sapiens
tccatggagctggtgg

SEQ ID NO: 136172 - DNA, 16 bp, H. sapiens
tccatggattcaacca

SEQ ID NO: 136173 - DNA, 16 bp, H. sapiens
tccatggattttgata

SEQ ID NO: 136174 - DNA, 16 bp, H. sapiens
tccatggcaactgaaa

SEQ ID NO: 136175 - DNA, 16 bp, H. sapiens
tccatggcagcaggca

SEQ ID NO: 136176 - DNA, 16 bp, H. sapiens
tccatggctcccagca

SEQ ID NO: 136177 - DNA, 16 bp, H. sapiens
tccatgtacctctggt

SEQ ID NO: 136178 - DNA, 16 bp, H. sapiens
tccatgtacctgcaaa

SEQ ID NO: 136179 - DNA, 16 bp, H. sapiens
tccatgtcagaaaaaa

SEQ ID NO: 136180 - DNA, 16 bp, H. sapiens
tccatgtccatggatt

SEQ ID NO: 136181 - DNA, 16 bp, H. sapiens
tccatgtccctgcaga

SEQ ID NO: 136182 - DNA, 16 bp, H. sapiens
tccatgtctttgcaaa

SEQ ID NO: 136183 - DNA, 16 bp, H. sapiens
tccatgtgtttgtatc

SEQ ID NO: 136184 - DNA, 16 bp, H. sapiens
tccatgttgctgcaaa

SEQ ID NO: 136185 - DNA, 16 bp, H. sapiens
tccatgttgctgccaa

SEQ ID NO: 136186 - DNA, 16 bp, H. sapiens
tccatgttggtcagat

SEQ ID NO: 136187 - DNA, 16 bp, H. sapiens
tccatgtttagtgctt

SEQ ID NO: 136188 - DNA, 16 bp, H. sapiens
tccattaaacctcttt

SEQ ID NO: 136189 - DNA, 16 bp, H. sapiens
tccattatattccatt

SEQ ID NO: 136190 - DNA, 16 bp, H. sapiens
tccattcaatgatgat

SEQ ID NO: 136191 - DNA, 16 bp, H. sapiens
tccattcaatttcatt

SEQ ID NO: 136192 - DNA, 16 bp, H. sapiens
tccattcacaattgct

SEQ ID NO: 136193 - DNA, 16 bp, H. sapiens
tccattcatgttaaaa

SEQ ID NO: 136194 - DNA, 16 bp, H. sapiens
tccattcattcattga

SEQ ID NO: 136195 - DNA, 16 bp, H. sapiens
tccattcatttactca

SEQ ID NO: 136196 - DNA, 16 bp, H. sapiens
tccattcatttattct

SEQ ID NO: 136197 - DNA, 16 bp, H. sapiens
tccattcccaccagca

SEQ ID NO: 136198 - DNA, 16 bp, H. sapiens
tccattcctgagttac

SEQ ID NO: 136199 - DNA, 16 bp, H. sapiens
tccattcctgctgcta

SEQ ID NO: 136200 - DNA, 16 bp, H. sapiens
tccattctattgcatt

SEQ ID NO: 136201 - DNA, 16 bp, H. sapiens
tccattctcaagctgc

SEQ ID NO: 136202 - DNA, 16 bp, H. sapiens
tccattctccctgtct

SEQ ID NO: 136203 - DNA, 16 bp, H. sapiens
tccattctctccatca

SEQ ID NO: 136204 - DNA, 16 bp, H. sapiens
tccattctgcagctca

SEQ ID NO: 136205 - DNA, 16 bp, H. sapiens
tccattctgctgttga

SEQ ID NO: 136206 - DNA, 16 bp, H. sapiens
tccattgaactggaag

SEQ ID NO: 136207 - DNA, 16 bp, H. sapiens
tccattgaattttttt

SEQ ID NO: 136208 - DNA, 16 bp, H. sapiens
tccattgatctgtgtg

SEQ ID NO: 136209 - DNA, 16 bp, H. sapiens
tccattgatggacatg

SEQ ID NO: 136210 - DNA, 16 bp, H. sapiens
tccattggctggaaca

SEQ ID NO: 136211 - DNA, 16 bp, H. sapiens
tccattggcttgaaat

SEQ ID NO: 136212 - DNA, 16 bp, H. sapiens
tccattgtttataagc

SEQ ID NO: 136213 - DNA, 16 bp, H. sapiens
tccattgttttgcctt

SEQ ID NO: 136214 - DNA, 16 bp, H. sapiens
tccatttacatttatt

SEQ ID NO: 136215 - DNA, 16 bp, H. sapiens
tccatttatataatgt

SEQ ID NO: 136216 - DNA, 16 bp, H. sapiens
tccatttatccatcca

SEQ ID NO: 136217 - DNA, 16 bp, H. sapiens
tccatttatgtgaaat

SEQ ID NO: 136218 - DNA, 16 bp, H. sapiens
tccatttcaaaaaaaa

SEQ ID NO: 136219 - DNA, 16 bp, H. sapiens
tccatttcacagatga

SEQ ID NO: 136220 - DNA, 16 bp, H. sapiens
tccatttcattctatt

SEQ ID NO: 136221 - DNA, 16 bp, H. sapiens
tccatttccatccatg

SEQ ID NO: 136222 - DNA, 16 bp, H. sapiens
tccatttccatttatt

SEQ ID NO: 136223 - DNA, 16 bp, H. sapiens
tccatttctctgcctt

SEQ ID NO: 136224 - DNA, 16 bp, H. sapiens
tccatttcttcatctc

SEQ ID NO: 136225 - DNA, 16 bp, H. sapiens
tccatttctttaaaat

SEQ ID NO: 136226 - DNA, 16 bp, H. sapiens
tccatttctttcatca

SEQ ID NO: 136227 - DNA, 16 bp, H. sapiens
tccatttctttgtatc

SEQ ID NO: 136228 - DNA, 16 bp, H. sapiens
tccatttgaaatattt

SEQ ID NO: 136229 - DNA, 16 bp, H. sapiens
tccatttgaatccatt

SEQ ID NO: 136230 - DNA, 16 bp, H. sapiens
tccatttgacagatga

SEQ ID NO: 136231 - DNA, 16 bp, H. sapiens
tccatttgatctatag

SEQ ID NO: 136232 - DNA, 16 bp, H. sapiens
tccatttgatgccatt

SEQ ID NO: 136233 - DNA, 16 bp, H. sapiens
tccatttgcatgaaat

SEQ ID NO: 136234 - DNA, 16 bp, H. sapiens
tccatttgccataatg

SEQ ID NO: 136235 - DNA, 16 bp, H. sapiens
tccatttgtaaaatga

SEQ ID NO: 136236 - DNA, 16 bp, H. sapiens
tccatttgtccactga

SEQ ID NO: 136237 - DNA, 16 bp, H. sapiens
tccatttgtccatcca

SEQ ID NO: 136238 - DNA, 16 bp, H. sapiens
tccatttgtctatttt

SEQ ID NO: 136239 - DNA, 16 bp, H. sapiens
tccatttgtctgtatc

SEQ ID NO: 136240 - DNA, 16 bp, H. sapiens
tccatttgtctgtgtg

SEQ ID NO: 136241 - DNA, 16 bp, H. sapiens
tccatttgtctgttga

SEQ ID NO: 136242 - DNA, 16 bp, H. sapiens
tccatttgttcatgtc

SEQ ID NO: 136243 - DNA, 16 bp, H. sapiens
tccatttgtttgtatt

SEQ ID NO: 136244 - DNA, 16 bp, H. sapiens
tccatttgtttgtgtg

SEQ ID NO: 136245 - DNA, 16 bp, H. sapiens
tccattttacagaaga

SEQ ID NO: 136246 - DNA, 16 bp, H. sapiens
tccattttagagatga

SEQ ID NO: 136247 - DNA, 16 bp, H. sapiens
tccattttattgcctt

SEQ ID NO: 136248 - DNA, 16 bp, H. sapiens
tccattttcacacttc

SEQ ID NO: 136249 - DNA, 16 bp, H. sapiens
tccattttcatgctgt

SEQ ID NO: 136250 - DNA, 16 bp, H. sapiens
tccattttcttatcta

SEQ ID NO: 136251 - DNA, 16 bp, H. sapiens
tccattttcttatctg

SEQ ID NO: 136252 - DNA, 16 bp, H. sapiens
tccattttcttcctca

SEQ ID NO: 136253 - DNA, 16 bp, H. sapiens
tccattttcttttctg

SEQ ID NO: 136254 - DNA, 16 bp, H. sapiens
tccattttgttgatct

SEQ ID NO: 136255 - DNA, 16 bp, H. sapiens
tccattttgttgtatt

SEQ ID NO: 136256 - DNA, 16 bp, H. sapiens
tccatttttagttttc

SEQ ID NO: 136257 - DNA, 16 bp, H. sapiens
tccatttttgccttgg

SEQ ID NO: 136258 - DNA, 16 bp, H. sapiens
tccatttttttcctgt

SEQ ID NO: 136259 - DNA, 16 bp, H. sapiens
tcccaaaacaaagaaa

SEQ ID NO: 136260 - DNA, 16 bp, H. sapiens
tcccaaaacgttggga

SEQ ID NO: 136261 - DNA, 16 bp, H. sapiens
tcccaaaagacacaat

SEQ ID NO: 136262 - DNA, 18 bp, H. sapiens
tcccaaaatactgggatt

SEQ ID NO: 136263 - DNA, 18 bp, H. sapiens
tcccaaaatgcggggatt

SEQ ID NO: 136264 - DNA, 17 bp, H. sapiens
tcccaaaatgctgggag

SEQ ID NO: 136265 - DNA, 19 bp, H. sapiens
tcccaaaatgctgggatta

SEQ ID NO: 136266 - DNA, 18 bp, H. sapiens
tcccaaaatgttgggatt

SEQ ID NO: 136267 - DNA, 16 bp, H. sapiens
tcccaaacctcaatcc

SEQ ID NO: 136268 - DNA, 16 bp, H. sapiens
tcccaaactcctggac

SEQ ID NO: 136269 - DNA, 16 bp, H. sapiens
tcccaaactcctggcc

SEQ ID NO: 136270 - DNA, 16 bp, H. sapiens
tcccaaactgaaattc

SEQ ID NO: 136271 - DNA, 19 bp, H. sapiens
tcccaaactgctgggatta

SEQ ID NO: 136272 - DNA, 16 bp, H. sapiens
tcccaaagaaataaaa

SEQ ID NO: 136273 - DNA, 19 bp, H. sapiens
tcccaaagcgctgggatta

SEQ ID NO: 136274 - DNA, 16 bp, H. sapiens
tcccaaaggcctggga

SEQ ID NO: 136275 - DNA, 16 bp, H. sapiens
tcccaaagggaaaaaa

SEQ ID NO: 136276 - DNA, 17 bp, H. sapiens
tcccaaagggctgagat

SEQ ID NO: 136277 - DNA, 19 bp, H. sapiens
tcccaaagggctgggatta

SEQ ID NO: 136278 - DNA, 16 bp, H. sapiens
tcccaaagggctgggg

SEQ ID NO: 136279 - DNA, 19 bp, H. sapiens
tcccaaagtactgggatta

SEQ ID NO: 136280 - DNA, 17 bp, H. sapiens
tcccaaagtagtgggat

SEQ ID NO: 136281 - DNA, 19 bp, H. sapiens
tcccaaagtcctgggatta

SEQ ID NO: 136282 - DNA, 19 bp, H. sapiens
tcccaaagtgatgggatta

SEQ ID NO: 136283 - DNA, 19 bp, H. sapiens
tcccaaagtgctaagatta

SEQ ID NO: 136284 - DNA, 16 bp, H. sapiens
tcccaaagtgctagat

SEQ ID NO: 136285 - DNA, 19 bp, H. sapiens
tcccaaagtgctaggatta

SEQ ID NO: 136286 - DNA, 19 bp, H. sapiens
tcccaaagtgctgagatta

SEQ ID NO: 136287 - DNA, 16 bp, H. sapiens
tcccaaagtgctgagg

SEQ ID NO: 136288 - DNA, 19 bp, H. sapiens
tcccaaagtgctggcatta

SEQ ID NO: 136289 - DNA, 17 bp, H. sapiens
tcccaaagtgctgggaa

SEQ ID NO: 136290 - DNA, 17 bp, H. sapiens
tcccaaagtgctgggac

SEQ ID NO: 136291 - DNA, 17 bp, H. sapiens
tcccaaagtgctgggag

SEQ ID NO: 136292 - DNA, 18 bp, H. sapiens
tcccaaagtgctgggatc

SEQ ID NO: 136293 - DNA, 18 bp, H. sapiens
tcccaaagtgctgggatg

SEQ ID NO: 136294 - DNA, 19 bp, H. sapiens
tcccaaagtgctgggatta

SEQ ID NO: 136295 - DNA, 19 bp, H. sapiens
tcccaaagtgctgggattc

SEQ ID NO: 136296 - DNA, 19 bp, H. sapiens
tcccaaagtgctgggattg

SEQ ID NO: 136297 - DNA, 19 bp, H. sapiens
tcccaaagtgctgggattt

SEQ ID NO: 136298 - DNA, 16 bp, H. sapiens
tcccaaagtgctgggc

SEQ ID NO: 136299 - DNA, 16 bp, H. sapiens
tcccaaagtgctgggg

SEQ ID NO: 136300 - DNA, 16 bp, H. sapiens
tcccaaagtgctgggt

SEQ ID NO: 136301 - DNA, 16 bp, H. sapiens
tcccaaagtgcttgca

SEQ ID NO: 136302 - DNA, 19 bp, H. sapiens
tcccaaagtgcttggatta

SEQ ID NO: 136303 - DNA, 16 bp, H. sapiens
tcccaaagtgttagta

SEQ ID NO: 136304 - DNA, 17 bp, H. sapiens
tcccaaagtgttgagat

SEQ ID NO: 136305 - DNA, 18 bp, H. sapiens
tcccaaagtgttggaatt

SEQ ID NO: 136306 - DNA, 19 bp, H. sapiens
tcccaaagtgttgggatta

SEQ ID NO: 136307 - DNA, 16 bp, H. sapiens
tcccaaagtgttgggg

SEQ ID NO: 136308 - DNA, 19 bp, H. sapiens
tcccaaagttctgggatta

SEQ ID NO: 136309 - DNA, 16 bp, H. sapiens
tcccaaatactcggga

SEQ ID NO: 136310 - DNA, 16 bp, H. sapiens
tcccaaatccaaaatg

SEQ ID NO: 136311 - DNA, 16 bp, H. sapiens
tcccaaatcttatgtc

SEQ ID NO: 136312 - DNA, 16 bp, H. sapiens
tcccaaatgtcctttt

SEQ ID NO: 136313 - DNA, 19 bp, H. sapiens
tcccaaattgctgggatta

SEQ ID NO: 136314 - DNA, 16 bp, H. sapiens
tcccaaatttgaaaat

SEQ ID NO: 136315 - DNA, 16 bp, H. sapiens
tcccaaatttggcaaa

SEQ ID NO: 136316 - DNA, 16 bp, H. sapiens
tcccaacaaattcctc

SEQ ID NO: 136317 - DNA, 16 bp, H. sapiens
tcccaacacaaagaaa

SEQ ID NO: 136318 - DNA, 16 bp, H. sapiens
tcccaacagcagttgg

SEQ ID NO: 136319 - DNA, 16 bp, H. sapiens
tcccaacaggccctgg

SEQ ID NO: 136320 - DNA, 16 bp, H. sapiens
tcccaacatggtgaaa

SEQ ID NO: 136321 - DNA, 16 bp, H. sapiens
tcccaacctcagcact

SEQ ID NO: 136322 - DNA, 19 bp, H. sapiens
tcccaacgtgctgggatta

SEQ ID NO: 136323 - DNA, 16 bp, H. sapiens
tcccaactagctggga

SEQ ID NO: 136324 - DNA, 16 bp, H. sapiens
tcccaactatttggga

SEQ ID NO: 136325 - DNA, 16 bp, H. sapiens
tcccaactcagccccc

SEQ ID NO: 136326 - DNA, 16 bp, H. sapiens
tcccaactctgaagag

SEQ ID NO: 136327 - DNA, 16 bp, H. sapiens
tcccaactctgccact

SEQ ID NO: 136328 - DNA, 30 bp, H. sapiens
tcccaagactaaaccaggaagaagctgaat

SEQ ID NO: 136329 - DNA, 16 bp, H. sapiens
tcccaagagattatgt

SEQ ID NO: 136330 - DNA, 16 bp, H. sapiens
tcccaagagtccccca

SEQ ID NO: 136331 - DNA, 16 bp, H. sapiens
tcccaagatctgcagg

SEQ ID NO: 136332 - DNA, 16 bp, H. sapiens
tcccaagcccctaccc

SEQ ID NO: 136333 - DNA, 16 bp, H. sapiens
tcccaaggatgaagcc

SEQ ID NO: 136334 - DNA, 18 bp, H. sapiens
tcccaaggtgctaggatt

SEQ ID NO: 136335 - DNA, 16 bp, H. sapiens
tcccaaggtgctgaga

SEQ ID NO: 136336 - DNA, 16 bp, H. sapiens
tcccaaggtgctggca

SEQ ID NO: 136337 - DNA, 19 bp, H. sapiens
tcccaaggtgctgggatta

SEQ ID NO: 136338 - DNA, 16 bp, H. sapiens
tcccaaggttctggga

SEQ ID NO: 136339 - DNA, 17 bp, H. sapiens
tcccaagtaactgggac

SEQ ID NO: 136340 - DNA, 17 bp, H. sapiens
tcccaagtactcgggag

SEQ ID NO: 136341 - DNA, 16 bp, H. sapiens
tcccaagtagccggga

SEQ ID NO: 136342 - DNA, 16 bp, H. sapiens
tcccaagtagcgggga

SEQ ID NO: 136343 - DNA, 16 bp, H. sapiens
tcccaagtagctagga

SEQ ID NO: 136344 - DNA, 17 bp, H. sapiens
tcccaagtagctaggac

SEQ ID NO: 136345 - DNA, 19 bp, H. sapiens
tcccaagtagctgagatta

SEQ ID NO: 136346 - DNA, 16 bp, H. sapiens
tcccaagtagctgggt

SEQ ID NO: 136347 - DNA, 16 bp, H. sapiens
tcccaagtagttggga

SEQ ID NO: 136348 - DNA, 16 bp, H. sapiens
tcccaagtgatgctga

SEQ ID NO: 136349 - DNA, 16 bp, H. sapiens
tcccaagtgttgtggg

SEQ ID NO: 136350 - DNA, 16 bp, H. sapiens
tcccaagttcaagcag

SEQ ID NO: 136351 - DNA, 20 bp, H. sapiens
tcccaagttcaagtgattct

SEQ ID NO: 136352 - DNA, 18 bp, H. sapiens
tcccaagttcaggcgatt

SEQ ID NO: 136353 - DNA, 19 bp, H. sapiens
tcccaatgtgctgggatta

SEQ ID NO: 136354 - DNA, 16 bp, H. sapiens
tcccaatgttggagga

SEQ ID NO: 136355 - DNA, 16 bp, H. sapiens
tcccaatgttggaggt

SEQ ID NO: 136356 - DNA, 16 bp, H. sapiens
tcccaattatcctgat

SEQ ID NO: 136357 - DNA, 16 bp, H. sapiens
tcccacacctcagcct

SEQ ID NO: 136358 - DNA, 16 bp, H. sapiens
tcccacagattctggt

SEQ ID NO: 136359 - DNA, 16 bp, H. sapiens
tcccacagctctggag

SEQ ID NO: 136360 - DNA, 16 bp, H. sapiens
tcccacaggctgaggg

SEQ ID NO: 136361 - DNA, 16 bp, H. sapiens
tcccacagggctggga

SEQ ID NO: 136362 - DNA, 16 bp, H. sapiens
tcccacagggtgctcc

SEQ ID NO: 136363 - DNA, 19 bp, H. sapiens
tcccacagtgctgggatta

SEQ ID NO: 136364 - DNA, 16 bp, H. sapiens
tcccacagttaccatt

SEQ ID NO: 136365 - DNA, 16 bp, H. sapiens
tcccacatcagcctcc

SEQ ID NO: 136366 - DNA, 16 bp, H. sapiens
tcccacatccaggaag

SEQ ID NO: 136367 - DNA, 16 bp, H. sapiens
tcccacatccagggca

SEQ ID NO: 136368 - DNA, 16 bp, H. sapiens
tcccacatcctgggca

SEQ ID NO: 136369 - DNA, 16 bp, H. sapiens
tcccacatgcttagtg

SEQ ID NO: 136370 - DNA, 16 bp, H. sapiens
tcccacattccttaca

SEQ ID NO: 136371 - DNA, 16 bp, H. sapiens
tcccaccaaagaaaag

SEQ ID NO: 136372 - DNA, 16 bp, H. sapiens
tcccaccaacagtata

SEQ ID NO: 136373 - DNA, 16 bp, H. sapiens
tcccaccaacagtgta

SEQ ID NO: 136374 - DNA, 16 bp, H. sapiens
tcccaccacagcctcc

SEQ ID NO: 136375 - DNA, 16 bp, H. sapiens
tcccaccacatgtggg

SEQ ID NO: 136376 - DNA, 16 bp, H. sapiens
tcccaccaccctgacc

SEQ ID NO: 136377 - DNA, 16 bp, H. sapiens
tcccaccacgcccagc

SEQ ID NO: 136378 - DNA, 16 bp, H. sapiens
tcccaccactgcctcc

SEQ ID NO: 136379 - DNA, 16 bp, H. sapiens
tcccaccagagaggag

SEQ ID NO: 136380 - DNA, 16 bp, H. sapiens
tcccaccagcctgact

SEQ ID NO: 136381 - DNA, 16 bp, H. sapiens
tcccaccagctccatg

SEQ ID NO: 136382 - DNA, 16 bp, H. sapiens
tcccaccaggcccaac

SEQ ID NO: 136383 - DNA, 16 bp, H. sapiens
tcccaccaggccccca

SEQ ID NO: 136384 - DNA, 16 bp, H. sapiens
tcccaccaggcccctc

SEQ ID NO: 136385 - DNA, 16 bp, H. sapiens
tcccaccaggccctgc

SEQ ID NO: 136386 - DNA, 16 bp, H. sapiens
tcccaccaggtccttc

SEQ ID NO: 136387 - DNA, 16 bp, H. sapiens
tcccaccatggctgat

SEQ ID NO: 136388 - DNA, 16 bp, H. sapiens
tcccaccatgtaagac

SEQ ID NO: 136389 - DNA, 16 bp, H. sapiens
tcccaccccagactcc

SEQ ID NO: 136390 - DNA, 16 bp, H. sapiens
tcccaccccagcatcc

SEQ ID NO: 136391 - DNA, 16 bp, H. sapiens
tcccaccccagcctca

SEQ ID NO: 136392 - DNA, 16 bp, H. sapiens
tcccacccccatggag

SEQ ID NO: 136393 - DNA, 16 bp, H. sapiens
tcccaccctagtcttt

SEQ ID NO: 136394 - DNA, 16 bp, H. sapiens
tcccaccctcatgacc

SEQ ID NO: 136395 - DNA, 16 bp, H. sapiens
tcccaccctgtcaccc

SEQ ID NO: 136396 - DNA, 16 bp, H. sapiens
tcccaccctgtcctcc

SEQ ID NO: 136397 - DNA, 16 bp, H. sapiens
tcccacctaagcctct

SEQ ID NO: 136398 - DNA, 16 bp, H. sapiens
tcccacctcagcccca

SEQ ID NO: 136399 - DNA, 16 bp, H. sapiens
tcccacctcagcctca

SEQ ID NO: 136400 - DNA, 16 bp, H. sapiens
tcccacctcagccttc

SEQ ID NO: 136401 - DNA, 16 bp, H. sapiens
tcccacctcagctcct

SEQ ID NO: 136402 - DNA, 18 bp, H. sapiens
tcccacctcagcttccca

SEQ ID NO: 136403 - DNA, 16 bp, H. sapiens
tcccacctcaggctcc

SEQ ID NO: 136404 - DNA, 16 bp, H. sapiens
tcccacctccagcctc

SEQ ID NO: 136405 - DNA, 16 bp, H. sapiens
tcccacctccctcctg

SEQ ID NO: 136406 - DNA, 16 bp, H. sapiens
tcccacctccgtctcc

SEQ ID NO: 136407 - DNA, 16 bp, H. sapiens
tcccacctcgtcctcc

SEQ ID NO: 136408 - DNA, 16 bp, H. sapiens
tcccacctctgccacc

SEQ ID NO: 136409 - DNA, 16 bp, H. sapiens
tcccacctggcctccc

SEQ ID NO: 136410 - DNA, 16 bp, H. sapiens
tcccacctgggcctcc

SEQ ID NO: 136411 - DNA, 16 bp, H. sapiens
tcccacctgtcccctc

SEQ ID NO: 136412 - DNA, 16 bp, H. sapiens
tcccacctgttcctgg

SEQ ID NO: 136413 - DNA, 16 bp, H. sapiens
tcccacctttgcctcc

SEQ ID NO: 136414 - DNA, 16 bp, H. sapiens
tcccactactgggtaa

SEQ ID NO: 136415 - DNA, 16 bp, H. sapiens
tcccactactgggtat

SEQ ID NO: 136416 - DNA, 16 bp, H. sapiens
tcccactattattttg

SEQ ID NO: 136417 - DNA, 16 bp, H. sapiens
tcccactctctgcagt

SEQ ID NO: 136418 - DNA, 16 bp, H. sapiens
tcccactctgtcacct

SEQ ID NO: 136419 - DNA, 16 bp, H. sapiens
tcccactctgttgctc

SEQ ID NO: 136420 - DNA, 16 bp, H. sapiens
tcccactgccaccacc

SEQ ID NO: 136421 - DNA, 16 bp, H. sapiens
tcccactgcttcctct

SEQ ID NO: 136422 - DNA, 16 bp, H. sapiens
tcccactgggcccctc

SEQ ID NO: 136423 - DNA, 16 bp, H. sapiens
tcccactgggtccctc

SEQ ID NO: 136424 - DNA, 16 bp, H. sapiens
tcccactgtggtttta

SEQ ID NO: 136425 - DNA, 16 bp, H. sapiens
tcccacttaaagaagc

SEQ ID NO: 136426 - DNA, 16 bp, H. sapiens
tcccacttatgtgtga

SEQ ID NO: 136427 - DNA, 16 bp, H. sapiens
tcccacttcacagatg

SEQ ID NO: 136428 - DNA, 16 bp, H. sapiens
tcccacttcagcctct

SEQ ID NO: 136429 - DNA, 16 bp, H. sapiens
tcccacttccctgaca

SEQ ID NO: 136430 - DNA, 16 bp, H. sapiens
tcccagaaaatgaaag

SEQ ID NO: 136431 - DNA, 16 bp, H. sapiens
tcccagaaagagaaga

SEQ ID NO: 136432 - DNA, 17 bp, H. sapiens
tcccagaaagcctgaca

SEQ ID NO: 136433 - DNA, 16 bp, H. sapiens
tcccagaaataaatcc

SEQ ID NO: 136434 - DNA, 16 bp, H. sapiens
tcccagaacaaagctc

SEQ ID NO: 136435 - DNA, 16 bp, H. sapiens
tcccagaacactggga

SEQ ID NO: 136436 - DNA, 16 bp, H. sapiens
tcccagaacattggga

SEQ ID NO: 136437 - DNA, 16 bp, H. sapiens
tcccagaactttaaga

SEQ ID NO: 136438 - DNA, 16 bp, H. sapiens
tcccagaactttcaga

SEQ ID NO: 136439 - DNA, 16 bp, H. sapiens
tcccagaactttgaaa

SEQ ID NO: 136440 - DNA, 16 bp, H. sapiens
tcccagaagcccagcc

SEQ ID NO: 136441 - DNA, 16 bp, H. sapiens
tcccagaagcccccag

SEQ ID NO: 136442 - DNA, 16 bp, H. sapiens
tcccagaaggaaaaga

SEQ ID NO: 136443 - DNA, 16 bp, H. sapiens
tcccagaaggaaggaa

SEQ ID NO: 136444 - DNA, 16 bp, H. sapiens
tcccagaaggcagagg

SEQ ID NO: 136445 - DNA, 16 bp, H. sapiens
tcccagaaggggcagc

SEQ ID NO: 136446 - DNA, 16 bp, H. sapiens
tcccagacaaatgaaa

SEQ ID NO: 136447 - DNA, 16 bp, H. sapiens
tcccagacacacaccc

SEQ ID NO: 136448 - DNA, 16 bp, H. sapiens
tcccagacaccagccc

SEQ ID NO: 136449 - DNA, 16 bp, H. sapiens
tcccagacactggcgt

SEQ ID NO: 136450 - DNA, 16 bp, H. sapiens
tcccagacactgtgct

SEQ ID NO: 136451 - DNA, 16 bp, H. sapiens
tcccagacctgctgaa

SEQ ID NO: 136452 - DNA, 16 bp, H. sapiens
tcccagacggggcggc

SEQ ID NO: 136453 - DNA, 16 bp, H. sapiens
tcccagacttcttgga

SEQ ID NO: 136454 - DNA, 16 bp, H. sapiens
tcccagagagctctct

SEQ ID NO: 136455 - DNA, 16 bp, H. sapiens
tcccagagatgaagct

SEQ ID NO: 136456 - DNA, 16 bp, H. sapiens
tcccagagatgctggt

SEQ ID NO: 136457 - DNA, 16 bp, H. sapiens
tcccagagattctgat

SEQ ID NO: 136458 - DNA, 16 bp, H. sapiens
tcccagaggcagaggt

SEQ ID NO: 136459 - DNA, 16 bp, H. sapiens
tcccagagtgctggca

SEQ ID NO: 136460 - DNA, 19 bp, H. sapiens
tcccagagtgctgggatta

SEQ ID NO: 136461 - DNA, 16 bp, H. sapiens
tcccagagtgctgggt

SEQ ID NO: 136462 - DNA, 16 bp, H. sapiens
tcccagagtgctgtga

SEQ ID NO: 136463 - DNA, 16 bp, H. sapiens
tcccagagttctgaga

SEQ ID NO: 136464 - DNA, 16 bp, H. sapiens
tcccagagttctggga

SEQ ID NO: 136465 - DNA, 16 bp, H. sapiens
tcccagatcttaaagt

SEQ ID NO: 136466 - DNA, 16 bp, H. sapiens
tcccagatgcaagtga

SEQ ID NO: 136467 - DNA, 16 bp, H. sapiens
tcccagatgctcagga

SEQ ID NO: 136468 - DNA, 16 bp, H. sapiens
tcccagattcaaatga

SEQ ID NO: 136469 - DNA, 17 bp, H. sapiens
tcccagattcaagtgat

SEQ ID NO: 136470 - DNA, 16 bp, H. sapiens
tcccagcaaagaaaag

SEQ ID NO: 136471 - DNA, 16 bp, H. sapiens
tcccagcaaagaaaat

SEQ ID NO: 136472 - DNA, 16 bp, H. sapiens
tcccagcaaattggga

SEQ ID NO: 136473 - DNA, 16 bp, H. sapiens
tcccagcaacccagga

SEQ ID NO: 136474 - DNA, 16 bp, H. sapiens
tcccagcaactcaggg

SEQ ID NO: 136475 - DNA, 16 bp, H. sapiens
tcccagcacagtggga

SEQ ID NO: 136476 - DNA, 16 bp, H. sapiens
tcccagcacagtgttc

SEQ ID NO: 136477 - DNA, 16 bp, H. sapiens
tcccagcacctagcac

SEQ ID NO: 136478 - DNA, 16 bp, H. sapiens
tcccagcactcgggag

SEQ ID NO: 136479 - DNA, 16 bp, H. sapiens
tcccagcacttcggga

SEQ ID NO: 136480 - DNA, 16 bp, H. sapiens
tcccagcactttagaa

SEQ ID NO: 136481 - DNA, 16 bp, H. sapiens
tcccagcactttgata

SEQ ID NO: 136482 - DNA, 16 bp, H. sapiens
tcccagcactttgtgg

SEQ ID NO: 136483 - DNA, 16 bp, H. sapiens
tcccagcacttttgag

SEQ ID NO: 136484 - DNA, 16 bp, H. sapiens
tcccagcagccccagc

SEQ ID NO: 136485 - DNA, 16 bp, H. sapiens
tcccagcagccctggg

SEQ ID NO: 136486 - DNA, 16 bp, H. sapiens
tcccagcagcctctgc

SEQ ID NO: 136487 - DNA, 16 bp, H. sapiens
tcccagcaggcagctg

SEQ ID NO: 136488 - DNA, 16 bp, H. sapiens
tcccagcagtccccca

SEQ ID NO: 136489 - DNA, 16 bp, H. sapiens
tcccagcattttgtga

SEQ ID NO: 136490 - DNA, 16 bp, H. sapiens
tcccagccaccagaac

SEQ ID NO: 136491 - DNA, 16 bp, H. sapiens
tcccagccactcagga

SEQ ID NO: 136492 - DNA, 16 bp, H. sapiens
tcccagccactctagc

SEQ ID NO: 136493 - DNA, 16 bp, H. sapiens
tcccagccagggcctc

SEQ ID NO: 136494 - DNA, 16 bp, H. sapiens
tcccagcccagcccag

SEQ ID NO: 136495 - DNA, 16 bp, H. sapiens
tcccagcccagcctct

SEQ ID NO: 136496 - DNA, 16 bp, H. sapiens
tcccagcccagtgctc

SEQ ID NO: 136497 - DNA, 16 bp, H. sapiens
tcccagccccagcatc

SEQ ID NO: 136498 - DNA, 16 bp, H. sapiens
tcccagcccctcagga

SEQ ID NO: 136499 - DNA, 16 bp, H. sapiens
tcccagcccctccagc

SEQ ID NO: 136500 - DNA, 16 bp, H. sapiens
tcccagcccctggaaa

SEQ ID NO: 136501 - DNA, 16 bp, H. sapiens
tcccagcccctgggga

SEQ ID NO: 136502 - DNA, 16 bp, H. sapiens
tcccagccctgcctcc

SEQ ID NO: 136503 - DNA, 16 bp, H. sapiens
tcccagcccttcagga

SEQ ID NO: 136504 - DNA, 16 bp, H. sapiens
tcccagcctcaagtga

SEQ ID NO: 136505 - DNA, 16 bp, H. sapiens
tcccagcctcagcccc

SEQ ID NO: 136506 - DNA, 16 bp, H. sapiens
tcccagcctccaaaac

SEQ ID NO: 136507 - DNA, 16 bp, H. sapiens
tcccagcctcccagcc

SEQ ID NO: 136508 - DNA, 20 bp, H. sapiens
tcccagcctctctttgcttt

SEQ ID NO: 136509 - DNA, 16 bp, H. sapiens
tcccagcctggcctcc

SEQ ID NO: 136510 - DNA, 16 bp, H. sapiens
tcccagccttccttgc

SEQ ID NO: 136511 - DNA, 17 bp, H. sapiens
tcccagcgctttgggaa

SEQ ID NO: 136512 - DNA, 16 bp, H. sapiens
tcccagctaaccagga

SEQ ID NO: 136513 - DNA, 16 bp, H. sapiens
tcccagctaccagaga

SEQ ID NO: 136514 - DNA, 16 bp, H. sapiens
tcccagctacccagaa

SEQ ID NO: 136515 - DNA, 30 bp, H. sapiens
tcccagctactcaggaggctgaagcaggag

SEQ ID NO: 136516 - DNA, 16 bp, H. sapiens
tcccagctactcatga

SEQ ID NO: 136517 - DNA, 16 bp, H. sapiens
tcccagctactcggga

SEQ ID NO: 136518 - DNA, 16 bp, H. sapiens
tcccagctacttgtaa

SEQ ID NO: 136519 - DNA, 16 bp, H. sapiens
tcccagctatgcagaa

SEQ ID NO: 136520 - DNA, 16 bp, H. sapiens
tcccagctattaggga

SEQ ID NO: 136521 - DNA, 17 bp, H. sapiens
tcccagctattcaggaa

SEQ ID NO: 136522 - DNA, 16 bp, H. sapiens
tcccagctcactgaaa

SEQ ID NO: 136523 - DNA, 16 bp, H. sapiens
tcccagctcagcttcc

SEQ ID NO: 136524 - DNA, 16 bp, H. sapiens
tcccagctccacctct

SEQ ID NO: 136525 - DNA, 16 bp, H. sapiens
tcccagctccagagct

SEQ ID NO: 136526 - DNA, 16 bp, H. sapiens
tcccagctccctggga

SEQ ID NO: 136527 - DNA, 16 bp, H. sapiens
tcccagctcctctctg

SEQ ID NO: 136528 - DNA, 16 bp, H. sapiens
tcccagctccttgaga

SEQ ID NO: 136529 - DNA, 16 bp, H. sapiens
tcccagctctcccact

SEQ ID NO: 136530 - DNA, 16 bp, H. sapiens
tcccagctctgcccct

SEQ ID NO: 136531 - DNA, 16 bp, H. sapiens
tcccagctctgcctcc

SEQ ID NO: 136532 - DNA, 16 bp, H. sapiens
tcccagctctgcctct

SEQ ID NO: 136533 - DNA, 16 bp, H. sapiens
tcccagctctgctatt

SEQ ID NO: 136534 - DNA, 16 bp, H. sapiens
tcccagctctgcttct

SEQ ID NO: 136535 - DNA, 16 bp, H. sapiens
tcccagctcttcggga

SEQ ID NO: 136536 - DNA, 16 bp, H. sapiens
tcccagctgagcccag

SEQ ID NO: 136537 - DNA, 16 bp, H. sapiens
tcccagctgatcccag

SEQ ID NO: 136538 - DNA, 16 bp, H. sapiens
tcccagctgccccagc

SEQ ID NO: 136539 - DNA, 16 bp, H. sapiens
tcccagctgcctgcct

SEQ ID NO: 136540 - DNA, 16 bp, H. sapiens
tcccagctgctagaga

SEQ ID NO: 136541 - DNA, 16 bp, H. sapiens
tcccagctgctccagc

SEQ ID NO: 136542 - DNA, 16 bp, H. sapiens
tcccagctgcttagga

SEQ ID NO: 136543 - DNA, 16 bp, H. sapiens
tcccagctggcttctt

SEQ ID NO: 136544 - DNA, 16 bp, H. sapiens
tcccagctgggaggct

SEQ ID NO: 136545 - DNA, 16 bp, H. sapiens
tcccagctgggcctcc

SEQ ID NO: 136546 - DNA, 16 bp, H. sapiens
tcccagctggttggga

SEQ ID NO: 136547 - DNA, 16 bp, H. sapiens
tcccagctgtgaaaga

SEQ ID NO: 136548 - DNA, 16 bp, H. sapiens
tcccagctgtggtggc

SEQ ID NO: 136549 - DNA, 16 bp, H. sapiens
tcccagctgtgtgact

SEQ ID NO: 136550 - DNA, 16 bp, H. sapiens
tcccagcttccagaac

SEQ ID NO: 136551 - DNA, 16 bp, H. sapiens
tcccagcttcctctct

SEQ ID NO: 136552 - DNA, 16 bp, H. sapiens
tcccagcttctccgga

SEQ ID NO: 136553 - DNA, 16 bp, H. sapiens
tcccaggaaaaaaaaa

SEQ ID NO: 136554 - DNA, 16 bp, H. sapiens
tcccaggaaaaaaact

SEQ ID NO: 136555 - DNA, 16 bp, H. sapiens
tcccaggaaagaaaag

SEQ ID NO: 136556 - DNA, 16 bp, H. sapiens
tcccaggaataaaacc

SEQ ID NO: 136557 - DNA, 16 bp, H. sapiens
tcccaggaccagcagc

SEQ ID NO: 136558 - DNA, 16 bp, H. sapiens
tcccaggactttggga

SEQ ID NO: 136559 - DNA, 16 bp, H. sapiens
tcccaggactttgtga

SEQ ID NO: 136560 - DNA, 16 bp, H. sapiens
tcccaggaggctgagg

SEQ ID NO: 136561 - DNA, 16 bp, H. sapiens
tcccaggattccttgg

SEQ ID NO: 136562 - DNA, 16 bp, H. sapiens
tcccaggcacagctgc

SEQ ID NO: 136563 - DNA, 16 bp, H. sapiens
tcccaggccccagccc

SEQ ID NO: 136564 - DNA, 16 bp, H. sapiens
tcccaggcccccaaga

SEQ ID NO: 136565 - DNA, 16 bp, H. sapiens
tcccaggcctattagg

SEQ ID NO: 136566 - DNA, 16 bp, H. sapiens
tcccaggctacatctt

SEQ ID NO: 136567 - DNA, 16 bp, H. sapiens
tcccaggctcaagcta

SEQ ID NO: 136568 - DNA, 16 bp, H. sapiens
tcccaggctgaagcca

SEQ ID NO: 136569 - DNA, 16 bp, H. sapiens
tcccaggctgcagtgc

SEQ ID NO: 136570 - DNA, 16 bp, H. sapiens
tcccaggctgggtgtg

SEQ ID NO: 136571 - DNA, 16 bp, H. sapiens
tcccaggctggtcctg

SEQ ID NO: 136572 - DNA, 16 bp, H. sapiens
tcccagggatgaaact

SEQ ID NO: 136573 - DNA, 16 bp, H. sapiens
tcccagggatgagcag

SEQ ID NO: 136574 - DNA, 16 bp, H. sapiens
tcccagggatgcagcc

SEQ ID NO: 136575 - DNA, 16 bp, H. sapiens
tcccagggcccagccc

SEQ ID NO: 136576 - DNA, 16 bp, H. sapiens
tcccagggccccagcc

SEQ ID NO: 136577 - DNA, 16 bp, H. sapiens
tcccagggtctccagc

SEQ ID NO: 136578 - DNA, 16 bp, H. sapiens
tcccaggtacccagga

SEQ ID NO: 136579 - DNA, 17 bp, H. sapiens
tcccaggtactcaggag

SEQ ID NO: 136580 - DNA, 16 bp, H. sapiens
tcccaggtacttggga

SEQ ID NO: 136581 - DNA, 16 bp, H. sapiens
tcccaggtcactggag

SEQ ID NO: 136582 - DNA, 16 bp, H. sapiens
tcccaggtgatgctgt

SEQ ID NO: 136583 - DNA, 16 bp, H. sapiens
tcccaggtgctgggat

SEQ ID NO: 136584 - DNA, 16 bp, H. sapiens
tcccaggtggacttca

SEQ ID NO: 136585 - DNA, 16 bp, H. sapiens
tcccaggtggctggga

SEQ ID NO: 136586 - DNA, 18 bp, H. sapiens
tcccaggttaaagcgatt

SEQ ID NO: 136587 - DNA, 17 bp, H. sapiens
tcccaggttcaaatgat

SEQ ID NO: 136588 - DNA, 16 bp, H. sapiens
tcccaggttcaaggat

SEQ ID NO: 136589 - DNA, 18 bp, H. sapiens
tcccaggttgaagtgatt

SEQ ID NO: 136590 - DNA, 16 bp, H. sapiens
tcccagtccctggaaa

SEQ ID NO: 136591 - DNA, 16 bp, H. sapiens
tcccagtgaagaaaag

SEQ ID NO: 136592 - DNA, 16 bp, H. sapiens
tcccagtgagatcaac

SEQ ID NO: 136593 - DNA, 16 bp, H. sapiens
tcccagtgccatttgt

SEQ ID NO: 136594 - DNA, 16 bp, H. sapiens
tcccagtgcccagcac

SEQ ID NO: 136595 - DNA, 16 bp, H. sapiens
tcccagtgctttagga

SEQ ID NO: 136596 - DNA, 19 bp, H. sapiens
tcccagttcaagcgattct

SEQ ID NO: 136597 - DNA, 18 bp, H. sapiens
tcccagttcaagtgattc

SEQ ID NO: 136598 - DNA, 16 bp, H. sapiens
tcccagttcctctttg

SEQ ID NO: 136599 - DNA, 16 bp, H. sapiens
tcccagttctaaggct

SEQ ID NO: 136600 - DNA, 16 bp, H. sapiens
tcccagttctggaggc

SEQ ID NO: 136601 - DNA, 16 bp, H. sapiens
tcccagttttgccact

SEQ ID NO: 136602 - DNA, 16 bp, H. sapiens
tcccatagtgctgaga

SEQ ID NO: 136603 - DNA, 16 bp, H. sapiens
tcccatagtgctggga

SEQ ID NO: 136604 - DNA, 19 bp, H. sapiens
tcccatagtgctgggatta

SEQ ID NO: 136605 - DNA, 16 bp, H. sapiens
tcccatatattttaaa

SEQ ID NO: 136606 - DNA, 16 bp, H. sapiens
tcccatcaaaggccca

SEQ ID NO: 136607 - DNA, 16 bp, H. sapiens
tcccatcacagcctcc

SEQ ID NO: 136608 - DNA, 16 bp, H. sapiens
tcccatcagcaatgaa

SEQ ID NO: 136609 - DNA, 16 bp, H. sapiens
tcccatcagcccctgc

SEQ ID NO: 136610 - DNA, 16 bp, H. sapiens
tcccatcatggcctga

SEQ ID NO: 136611 - DNA, 16 bp, H. sapiens
tcccatcattattgtg

SEQ ID NO: 136612 - DNA, 16 bp, H. sapiens
tcccatccaggacacc

SEQ ID NO: 136613 - DNA, 16 bp, H. sapiens
tcccatcccacatgct

SEQ ID NO: 136614 - DNA, 16 bp, H. sapiens
tcccatcccagcctct

SEQ ID NO: 136615 - DNA, 16 bp, H. sapiens
tcccatcctggcctcc

SEQ ID NO: 136616 - DNA, 16 bp, H. sapiens
tcccatctcaaaaaaa

SEQ ID NO: 136617 - DNA, 16 bp, H. sapiens
tcccatctctgccact

SEQ ID NO: 136618 - DNA, 16 bp, H. sapiens
tcccatctgccatgat

SEQ ID NO: 136619 - DNA, 16 bp, H. sapiens
tcccatgataacagca

SEQ ID NO: 136620 - DNA, 16 bp, H. sapiens
tcccatgcaacccaaa

SEQ ID NO: 136621 - DNA, 16 bp, H. sapiens
tcccatgctgctctca

SEQ ID NO: 136622 - DNA, 16 bp, H. sapiens
tcccatgctgttcttg

SEQ ID NO: 136623 - DNA, 16 bp, H. sapiens
tcccatggagcccagc

SEQ ID NO: 136624 - DNA, 16 bp, H. sapiens
tcccatgtacctggga

SEQ ID NO: 136625 - DNA, 16 bp, H. sapiens
tcccatgtagctggga

SEQ ID NO: 136626 - DNA, 16 bp, H. sapiens
tcccatgtttgttaca

SEQ ID NO: 136627 - DNA, 16 bp, H. sapiens
tcccattaaaaactgg

SEQ ID NO: 136628 - DNA, 16 bp, H. sapiens
tcccattaaaaagtgg

SEQ ID NO: 136629 - DNA, 16 bp, H. sapiens
tcccattcacaattgc

SEQ ID NO: 136630 - DNA, 21 bp, H. sapiens
tcccattcacaattgctacta

SEQ ID NO: 136631 - DNA, 16 bp, H. sapiens
tcccattcacagttgc

SEQ ID NO: 136632 - DNA, 16 bp, H. sapiens
tcccattcataattgc

SEQ ID NO: 136633 - DNA, 16 bp, H. sapiens
tcccattctattcagt

SEQ ID NO: 136634 - DNA, 16 bp, H. sapiens
tcccattctcttctgg

SEQ ID NO: 136635 - DNA, 16 bp, H. sapiens
tcccattctgttggtt

SEQ ID NO: 136636 - DNA, 16 bp, H. sapiens
tcccattgtatttaaa

SEQ ID NO: 136637 - DNA, 16 bp, H. sapiens
tcccattgtgtgtgtg

SEQ ID NO: 136638 - DNA, 16 bp, H. sapiens
tcccatttacaaatga

SEQ ID NO: 136639 - DNA, 16 bp, H. sapiens
tcccatttatagatga

SEQ ID NO: 136640 - DNA, 16 bp, H. sapiens
tcccatttcagcctcc

SEQ ID NO: 136641 - DNA, 16 bp, H. sapiens
tcccatttcttaaaaa

SEQ ID NO: 136642 - DNA, 16 bp, H. sapiens
tcccatttggaatggg

SEQ ID NO: 136643 - DNA, 16 bp, H. sapiens
tcccattttacagatg

SEQ ID NO: 136644 - DNA, 19 bp, H. sapiens
tcccattttacagatgagg

SEQ ID NO: 136645 - DNA, 16 bp, H. sapiens
tcccattttctagatg

SEQ ID NO: 136646 - DNA, 16 bp, H. sapiens
tcccattttgcagatg

SEQ ID NO: 136647 - DNA, 16 bp, H. sapiens
tcccattttgtttcta

SEQ ID NO: 136648 - DNA, 16 bp, H. sapiens
tcccattttgtttctt

SEQ ID NO: 136649 - DNA, 16 bp, H. sapiens
tcccatttttactaaa

SEQ ID NO: 136650 - DNA, 16 bp, H. sapiens
tcccatttttttctaa

SEQ ID NO: 136651 - DNA, 18 bp, H. sapiens
tccccaaaaactattgaa

SEQ ID NO: 136652 - DNA, 16 bp, H. sapiens
tccccaaacccagcaa

SEQ ID NO: 136653 - DNA, 16 bp, H. sapiens
tccccaaagcactggg

SEQ ID NO: 136654 - DNA, 16 bp, H. sapiens
tccccaaagccagcca

SEQ ID NO: 136655 - DNA, 16 bp, H. sapiens
tccccaaatacagtca

SEQ ID NO: 136656 - DNA, 16 bp, H. sapiens
tccccaaatccatcct

SEQ ID NO: 136657 - DNA, 16 bp, H. sapiens
tccccaaatttgatga

SEQ ID NO: 136658 - DNA, 16 bp, H. sapiens
tccccaacacagcaca

SEQ ID NO: 136659 - DNA, 16 bp, H. sapiens
tccccaacacttgtta

SEQ ID NO: 136660 - DNA, 16 bp, H. sapiens
tccccaaccccaggca

SEQ ID NO: 136661 - DNA, 16 bp, H. sapiens
tccccaacccccaggc

SEQ ID NO: 136662 - DNA, 16 bp, H. sapiens
tccccaaccttttttg

SEQ ID NO: 136663 - DNA, 16 bp, H. sapiens
tccccaactgctggga

SEQ ID NO: 136664 - DNA, 16 bp, H. sapiens
tccccaagaccaccct

SEQ ID NO: 136665 - DNA, 16 bp, H. sapiens
tccccaagcctcagtt

SEQ ID NO: 136666 - DNA, 18 bp, H. sapiens
tccccaagtttgcatttt

SEQ ID NO: 136667 - DNA, 16 bp, H. sapiens
tccccaatgctggagg

SEQ ID NO: 136668 - DNA, 16 bp, H. sapiens
tccccacaacaaagaa

SEQ ID NO: 136669 - DNA, 16 bp, H. sapiens
tccccacccaaatctt

SEQ ID NO: 136670 - DNA, 16 bp, H. sapiens
tccccacccaactcag

SEQ ID NO: 136671 - DNA, 16 bp, H. sapiens
tccccaccccagggcc

SEQ ID NO: 136672 - DNA, 16 bp, H. sapiens
tccccacccttgagaa

SEQ ID NO: 136673 - DNA, 16 bp, H. sapiens
tccccacctgtcaagg

SEQ ID NO: 136674 - DNA, 16 bp, H. sapiens
tccccactcagtctat

SEQ ID NO: 136675 - DNA, 16 bp, H. sapiens
tccccactcccagctc

SEQ ID NO: 136676 - DNA, 16 bp, H. sapiens
tccccactccctgcca

SEQ ID NO: 136677 - DNA, 16 bp, H. sapiens
tccccactgctcccag

SEQ ID NO: 136678 - DNA, 16 bp, H. sapiens
tccccacttcccaagc

SEQ ID NO: 136679 - DNA, 16 bp, H. sapiens
tccccacttggccttt

SEQ ID NO: 136680 - DNA, 16 bp, H. sapiens
tccccagaaaataggt

SEQ ID NO: 136681 - DNA, 16 bp, H. sapiens
tccccagaaaatggga

SEQ ID NO: 136682 - DNA, 16 bp, H. sapiens
tccccagaagcagaaa

SEQ ID NO: 136683 - DNA, 16 bp, H. sapiens
tccccagaccagcagc

SEQ ID NO: 136684 - DNA, 16 bp, H. sapiens
tccccagagcccagca

SEQ ID NO: 136685 - DNA, 16 bp, H. sapiens
tccccagaggctggtg

SEQ ID NO: 136686 - DNA, 16 bp, H. sapiens
tccccagaggggctgg

SEQ ID NO: 136687 - DNA, 16 bp, H. sapiens
tccccagcaaaacttc

SEQ ID NO: 136688 - DNA, 16 bp, H. sapiens
tccccagcaaatgcaa

SEQ ID NO: 136689 - DNA, 16 bp, H. sapiens
tccccagcaccagccc

SEQ ID NO: 136690 - DNA, 16 bp, H. sapiens
tccccagcaccagcct

SEQ ID NO: 136691 - DNA, 17 bp, H. sapiens
tccccagccatgctgaa

SEQ ID NO: 136692 - DNA, 16 bp, H. sapiens
tccccagccccacctg

SEQ ID NO: 136693 - DNA, 16 bp, H. sapiens
tccccagccccagcct

SEQ ID NO: 136694 - DNA, 16 bp, H. sapiens
tccccagcccctgcca

SEQ ID NO: 136695 - DNA, 16 bp, H. sapiens
tccccagcccctggca

SEQ ID NO: 136696 - DNA, 16 bp, H. sapiens
tccccagccctgcaga

SEQ ID NO: 136697 - DNA, 16 bp, H. sapiens
tccccagccctgccct

SEQ ID NO: 136698 - DNA, 16 bp, H. sapiens
tccccagccctggaaa

SEQ ID NO: 136699 - DNA, 16 bp, H. sapiens
tccccagccctgtgga

SEQ ID NO: 136700 - DNA, 16 bp, H. sapiens
tccccagcccttggca

SEQ ID NO: 136701 - DNA, 16 bp, H. sapiens
tccccagcctcaggca

SEQ ID NO: 136702 - DNA, 16 bp, H. sapiens
tccccagcctcccagg

SEQ ID NO: 136703 - DNA, 16 bp, H. sapiens
tccccagcctcctgag

SEQ ID NO: 136704 - DNA, 16 bp, H. sapiens
tccccagcctctgcct

SEQ ID NO: 136705 - DNA, 16 bp, H. sapiens
tccccagcctgcctgc

SEQ ID NO: 136706 - DNA, 17 bp, H. sapiens
tccccagctactcggga

SEQ ID NO: 136707 - DNA, 16 bp, H. sapiens
tccccagctccttcct

SEQ ID NO: 136708 - DNA, 16 bp, H. sapiens
tccccagctgctctga

SEQ ID NO: 136709 - DNA, 16 bp, H. sapiens
tccccaggagctggga

SEQ ID NO: 136710 - DNA, 16 bp, H. sapiens
tccccaggatggagtg

SEQ ID NO: 136711 - DNA, 16 bp, H. sapiens
tccccaggcaagaaga

SEQ ID NO: 136712 - DNA, 16 bp, H. sapiens
tccccaggcaagaagg

SEQ ID NO: 136713 - DNA, 16 bp, H. sapiens
tccccaggccagcagc

SEQ ID NO: 136714 - DNA, 16 bp, H. sapiens
tccccaggcccagctc

SEQ ID NO: 136715 - DNA, 16 bp, H. sapiens
tccccaggctcaggtg

SEQ ID NO: 136716 - DNA, 16 bp, H. sapiens
tccccaggctgaagtg

SEQ ID NO: 136717 - DNA, 16 bp, H. sapiens
tccccagggcctttgc

SEQ ID NO: 136718 - DNA, 16 bp, H. sapiens
tccccaggtgattcac

SEQ ID NO: 136719 - DNA, 16 bp, H. sapiens
tccccagtagctgtga

SEQ ID NO: 136720 - DNA, 25 bp, H. sapiens
tccccagtatggatccccactggga

SEQ ID NO: 136721 - DNA, 16 bp, H. sapiens
tccccagtccccagcc

SEQ ID NO: 136722 - DNA, 16 bp, H. sapiens
tccccagtgagggtgt

SEQ ID NO: 136723 - DNA, 16 bp, H. sapiens
tccccagtgccagctg

SEQ ID NO: 136724 - DNA, 16 bp, H. sapiens
tccccagtgcctagaa

SEQ ID NO: 136725 - DNA, 16 bp, H. sapiens
tccccagtgcttagca

SEQ ID NO: 136726 - DNA, 16 bp, H. sapiens
tccccagttgagcctt

SEQ ID NO: 136727 - DNA, 18 bp, H. sapiens
tccccatatttccttctt

SEQ ID NO: 136728 - DNA, 16 bp, H. sapiens
tccccatcaaaatccc

SEQ ID NO: 136729 - DNA, 16 bp, H. sapiens
tccccatcccccacag

SEQ ID NO: 136730 - DNA, 16 bp, H. sapiens
tccccatcccccagca

SEQ ID NO: 136731 - DNA, 16 bp, H. sapiens
tccccatctcatcaca

SEQ ID NO: 136732 - DNA, 16 bp, H. sapiens
tccccatctctgtccc

SEQ ID NO: 136733 - DNA, 16 bp, H. sapiens
tccccatgctgttctt

SEQ ID NO: 136734 - DNA, 16 bp, H. sapiens
tccccatggggcaggg

SEQ ID NO: 136735 - DNA, 16 bp, H. sapiens
tccccatgtgtcctgg

SEQ ID NO: 136736 - DNA, 17 bp, H. sapiens
tccccattacaacctct

SEQ ID NO: 136737 - DNA, 16 bp, H. sapiens
tccccattgcttttct

SEQ ID NO: 136738 - DNA, 16 bp, H. sapiens
tccccattggctggag

SEQ ID NO: 136739 - DNA, 16 bp, H. sapiens
tccccattggttgttt

SEQ ID NO: 136740 - DNA, 16 bp, H. sapiens
tccccattttacagat

SEQ ID NO: 136741 - DNA, 16 bp, H. sapiens
tccccattttacattt

SEQ ID NO: 136742 - DNA, 16 bp, H. sapiens
tccccattttaccaat

SEQ ID NO: 136743 - DNA, 16 bp, H. sapiens
tccccatttttcaaat

SEQ ID NO: 136744 - DNA, 16 bp, H. sapiens
tcccccaaagttcatg

SEQ ID NO: 136745 - DNA, 16 bp, H. sapiens
tcccccaacactgggg

SEQ ID NO: 136746 - DNA, 16 bp, H. sapiens
tcccccaaccttggcc

SEQ ID NO: 136747 - DNA, 16 bp, H. sapiens
tcccccaagctggagt

SEQ ID NO: 136748 - DNA, 16 bp, H. sapiens
tcccccacaaaggaca

SEQ ID NO: 136749 - DNA, 16 bp, H. sapiens
tcccccagcccctgca

SEQ ID NO: 136750 - DNA, 16 bp, H. sapiens
tcccccagcccctggc

SEQ ID NO: 136751 - DNA, 16 bp, H. sapiens
tcccccagcccctggg

SEQ ID NO: 136752 - DNA, 16 bp, H. sapiens
tcccccagccctggcc

SEQ ID NO: 136753 - DNA, 16 bp, H. sapiens
tcccccagcctcagcc

SEQ ID NO: 136754 - DNA, 16 bp, H. sapiens
tcccccagcctcggcc

SEQ ID NO: 136755 - DNA, 16 bp, H. sapiens
tcccccagcctgcacc

SEQ ID NO: 136756 - DNA, 16 bp, H. sapiens
tcccccagctcccagc

SEQ ID NO: 136757 - DNA, 16 bp, H. sapiens
tcccccagctcctggc

SEQ ID NO: 136758 - DNA, 16 bp, H. sapiens
tcccccagctgctggg

SEQ ID NO: 136759 - DNA, 16 bp, H. sapiens
tcccccaggccccagg

SEQ ID NO: 136760 - DNA, 16 bp, H. sapiens
tcccccaggccctggg

SEQ ID NO: 136761 - DNA, 16 bp, H. sapiens
tcccccaggctgcagt

SEQ ID NO: 136762 - DNA, 16 bp, H. sapiens
tcccccaggctggagg

SEQ ID NO: 136763 - DNA, 16 bp, H. sapiens
tcccccagtccctggc

SEQ ID NO: 136764 - DNA, 16 bp, H. sapiens
tcccccagtttattac

SEQ ID NO: 136765 - DNA, 16 bp, H. sapiens
tcccccatctgctgag

SEQ ID NO: 136766 - DNA, 16 bp, H. sapiens
tcccccatgcttttct

SEQ ID NO: 136767 - DNA, 16 bp, H. sapiens
tcccccattattattg

SEQ ID NO: 136768 - DNA, 16 bp, H. sapiens
tccccccagcacagca

SEQ ID NO: 136769 - DNA, 16 bp, H. sapiens
tccccctcctgcccag

SEQ ID NO: 136770 - DNA, 16 bp, H. sapiens
tccccctgcagagagc

SEQ ID NO: 136771 - DNA, 16 bp, H. sapiens
tccccctgccaggctg

SEQ ID NO: 136772 - DNA, 16 bp, H. sapiens
tccccctgctgtgtgc

SEQ ID NO: 136773 - DNA, 16 bp, H. sapiens
tcccccttctttgatt

SEQ ID NO: 136774 - DNA, 16 bp, H. sapiens
tccccctttaaaaaaa

SEQ ID NO: 136775 - DNA, 16 bp, H. sapiens
tcccccttttcctgtg

SEQ ID NO: 136776 - DNA, 16 bp, H. sapiens
tccccggctccttcag

SEQ ID NO: 136777 - DNA, 16 bp, H. sapiens
tccccggctggagtgc

SEQ ID NO: 136778 - DNA, 16 bp, H. sapiens
tccccgggcccagctc

SEQ ID NO: 136779 - DNA, 16 bp, H. sapiens
tccccgggtcccctta

SEQ ID NO: 136780 - DNA, 16 bp, H. sapiens
tccccgggtctccagc

SEQ ID NO: 136781 - DNA, 16 bp, H. sapiens
tcccctacctgctcct

SEQ ID NO: 136782 - DNA, 16 bp, H. sapiens
tcccctacctgtgtcc

SEQ ID NO: 136783 - DNA, 16 bp, H. sapiens
tcccctagagcctcca

SEQ ID NO: 136784 - DNA, 16 bp, H. sapiens
tcccctagcccctgac

SEQ ID NO: 136785 - DNA, 16 bp, H. sapiens
tcccctcacctctgcc

SEQ ID NO: 136786 - DNA, 16 bp, H. sapiens
tcccctcaccttctgc

SEQ ID NO: 136787 - DNA, 16 bp, H. sapiens
tcccctcactgcaagc

SEQ ID NO: 136788 - DNA, 16 bp, H. sapiens
tcccctcagcccctgg

SEQ ID NO: 136789 - DNA, 16 bp, H. sapiens
tcccctcagcctctgg

SEQ ID NO: 136790 - DNA, 16 bp, H. sapiens
tcccctccctgtgacc

SEQ ID NO: 136791 - DNA, 16 bp, H. sapiens
tcccctccctgtgtct

SEQ ID NO: 136792 - DNA, 16 bp, H. sapiens
tcccctcctccccaga

SEQ ID NO: 136793 - DNA, 16 bp, H. sapiens
tcccctctctgaacct

SEQ ID NO: 136794 - DNA, 16 bp, H. sapiens
tcccctctctgctgag

SEQ ID NO: 136795 - DNA, 16 bp, H. sapiens
tcccctctgcctggaa

SEQ ID NO: 136796 - DNA, 16 bp, H. sapiens
tcccctctggaggaca

SEQ ID NO: 136797 - DNA, 16 bp, H. sapiens
tcccctctgtctgcct

SEQ ID NO: 136798 - DNA, 16 bp, H. sapiens
tcccctcttcccccag

SEQ ID NO: 136799 - DNA, 16 bp, H. sapiens
tcccctgaacctggga

SEQ ID NO: 136800 - DNA, 16 bp, H. sapiens
tcccctgaagcattta

SEQ ID NO: 136801 - DNA, 16 bp, H. sapiens
tcccctgacaggcccc

SEQ ID NO: 136802 - DNA, 16 bp, H. sapiens
tcccctgacctcgtga

SEQ ID NO: 136803 - DNA, 16 bp, H. sapiens
tcccctgagcccagga

SEQ ID NO: 136804 - DNA, 16 bp, H. sapiens
tcccctgagctccagg

SEQ ID NO: 136805 - DNA, 16 bp, H. sapiens
tcccctgcacatgctt

SEQ ID NO: 136806 - DNA, 16 bp, H. sapiens
tcccctgccctgtgtg

SEQ ID NO: 136807 - DNA, 16 bp, H. sapiens
tcccctgcctcctggc

SEQ ID NO: 136808 - DNA, 16 bp, H. sapiens
tcccctgccttggcct

SEQ ID NO: 136809 - DNA, 16 bp, H. sapiens
tcccctgctgcagctg

SEQ ID NO: 136810 - DNA, 16 bp, H. sapiens
tcccctgctggcactt

SEQ ID NO: 136811 - DNA, 16 bp, H. sapiens
tcccctgctggctctg

SEQ ID NO: 136812 - DNA, 16 bp, H. sapiens
tcccctgggaacttgt

SEQ ID NO: 136813 - DNA, 16 bp, H. sapiens
tcccctgggcccagct

SEQ ID NO: 136814 - DNA, 16 bp, H. sapiens
tcccctgggctcaagt

SEQ ID NO: 136815 - DNA, 16 bp, H. sapiens
tcccctggggcagtgg

SEQ ID NO: 136816 - DNA, 16 bp, H. sapiens
tcccctgtattttctt

SEQ ID NO: 136817 - DNA, 16 bp, H. sapiens
tcccctgtctcagcct

SEQ ID NO: 136818 - DNA, 16 bp, H. sapiens
tcccctgtgccctgca

SEQ ID NO: 136819 - DNA, 16 bp, H. sapiens
tccccttcagcctcct

SEQ ID NO: 136820 - DNA, 16 bp, H. sapiens
tccccttcctgccacc

SEQ ID NO: 136821 - DNA, 16 bp, H. sapiens
tccccttctccccagc

SEQ ID NO: 136822 - DNA, 16 bp, H. sapiens
tccccttcttgtgtcc

SEQ ID NO: 136823 - DNA, 16 bp, H. sapiens
tccccttgctcatcag

SEQ ID NO: 136824 - DNA, 16 bp, H. sapiens
tccccttggccttctg

SEQ ID NO: 136825 - DNA, 16 bp, H. sapiens
tccccttgtcccccat

SEQ ID NO: 136826 - DNA, 16 bp, H. sapiens
tcccctttccactagg

SEQ ID NO: 136827 - DNA, 16 bp, H. sapiens
tcccctttccagctct

SEQ ID NO: 136828 - DNA, 16 bp, H. sapiens
tcccctttcccctagg

SEQ ID NO: 136829 - DNA, 16 bp, H. sapiens
tcccctttctgggcct

SEQ ID NO: 136830 - DNA, 16 bp, H. sapiens
tcccctttgaccttct

SEQ ID NO: 136831 - DNA, 16 bp, H. sapiens
tcccctttgctttctg

SEQ ID NO: 136832 - DNA, 19 bp, H. sapiens
tcccgaagtgctgagatta

SEQ ID NO: 136833 - DNA, 19 bp, H. sapiens
tcccgaagtgctgggatta

SEQ ID NO: 136834 - DNA, 18 bp, H. sapiens
tcccgaatagctgggatt

SEQ ID NO: 136835 - DNA, 16 bp, H. sapiens
tcccgagccctgcccg

SEQ ID NO: 136836 - DNA, 16 bp, H. sapiens
tcccgagctcaggtga

SEQ ID NO: 136837 - DNA, 20 bp, H. sapiens
tcccgagtagctggaattat

SEQ ID NO: 136838 - DNA, 16 bp, H. sapiens
tcccgagtagctgggc

SEQ ID NO: 136839 - DNA, 16 bp, H. sapiens
tcccgattagctggga

SEQ ID NO: 136840 - DNA, 16 bp, H. sapiens
tcccgcctcagccacc

SEQ ID NO: 136841 - DNA, 16 bp, H. sapiens
tcccgcctgggcaaca

SEQ ID NO: 136842 - DNA, 16 bp, H. sapiens
tcccgcctgggcctcc

SEQ ID NO: 136843 - DNA, 16 bp, H. sapiens
tcccgccttggcctcc

SEQ ID NO: 136844 - DNA, 16 bp, H. sapiens
tcccgccttggtctcc

SEQ ID NO: 136845 - DNA, 16 bp, H. sapiens
tcccgcttcagcttcc

SEQ ID NO: 136846 - DNA, 16 bp, H. sapiens
tcccggaaggggcggc

SEQ ID NO: 136847 - DNA, 16 bp, H. sapiens
tcccggccgggcgcag

SEQ ID NO: 136848 - DNA, 16 bp, H. sapiens
tcccggctacctggga

SEQ ID NO: 136849 - DNA, 16 bp, H. sapiens
tcccggctactcggga

SEQ ID NO: 136850 - DNA, 16 bp, H. sapiens
tcccggctcagcctcc

SEQ ID NO: 136851 - DNA, 16 bp, H. sapiens
tcccggctctgccact

SEQ ID NO: 136852 - DNA, 17 bp, H. sapiens
tcccgggctcaagtgat

SEQ ID NO: 136853 - DNA, 16 bp, H. sapiens
tcccgggctgtgggca

SEQ ID NO: 136854 - DNA, 18 bp, H. sapiens
tcccgggttcaggcaatt

SEQ ID NO: 136855 - DNA, 20 bp, H. sapiens
tcccgggttcaggcgattct

SEQ ID NO: 136856 - DNA, 17 bp, H. sapiens
tcccggttcaagcgatt

SEQ ID NO: 136857 - DNA, 16 bp, H. sapiens
tcccgtctcagcctcc

SEQ ID NO: 136858 - DNA, 16 bp, H. sapiens
tcccgtctctacaaaa

SEQ ID NO: 136859 - DNA, 17 bp, H. sapiens
tcccgtgttcaagcgat

SEQ ID NO: 136860 - DNA, 16 bp, H. sapiens
tccctaaaacagcagt

SEQ ID NO: 136861 - DNA, 16 bp, H. sapiens
tccctaaatgctggga

SEQ ID NO: 136862 - DNA, 16 bp, H. sapiens
tccctaacatcacaat

SEQ ID NO: 136863 - DNA, 16 bp, H. sapiens
tccctaagtgtcagcc

SEQ ID NO: 136864 - DNA, 16 bp, H. sapiens
tccctaatcagaaaat

SEQ ID NO: 136865 - DNA, 16 bp, H. sapiens
tccctagaagcagatg

SEQ ID NO: 136866 - DNA, 16 bp, H. sapiens
tccctaggcaaccact

SEQ ID NO: 136867 - DNA, 16 bp, H. sapiens
tccctaggggaagggg

SEQ ID NO: 136868 - DNA, 16 bp, H. sapiens
tccctatgaattttaa

SEQ ID NO: 136869 - DNA, 16 bp, H. sapiens
tccctatgatttcatc

SEQ ID NO: 136870 - DNA, 19 bp, H. sapiens
tccctatgtaataaatggt

SEQ ID NO: 136871 - DNA, 16 bp, H. sapiens
tccctatgttgtccag

SEQ ID NO: 136872 - DNA, 16 bp, H. sapiens
tccctattgcaatagt

SEQ ID NO: 136873 - DNA, 16 bp, H. sapiens
tccctatttgcagatg

SEQ ID NO: 136874 - DNA, 16 bp, H. sapiens
tccctcaaggagctca

SEQ ID NO: 136875 - DNA, 16 bp, H. sapiens
tccctcacacaacaca

SEQ ID NO: 136876 - DNA, 16 bp, H. sapiens
tccctcactgggtcct

SEQ ID NO: 136877 - DNA, 16 bp, H. sapiens
tccctcagacccaggc

SEQ ID NO: 136878 - DNA, 16 bp, H. sapiens
tccctcagcccctggc

SEQ ID NO: 136879 - DNA, 16 bp, H. sapiens
tccctcagcctctgga

SEQ ID NO: 136880 - DNA, 16 bp, H. sapiens
tccctcaggaggctga

SEQ ID NO: 136881 - DNA, 16 bp, H. sapiens
tccctcagtctcccaa

SEQ ID NO: 136882 - DNA, 16 bp, H. sapiens
tccctcatctgtaaaa

SEQ ID NO: 136883 - DNA, 16 bp, H. sapiens
tccctccaccttggcc

SEQ ID NO: 136884 - DNA, 41 bp, H. sapiens
tccctccactattgtcctatgaccctgccaaatccccctct

SEQ ID NO: 136885 - DNA, 16 bp, H. sapiens
tccctccagcctgggc

SEQ ID NO: 136886 - DNA, 16 bp, H. sapiens
tccctccagctttgtt

SEQ ID NO: 136887 - DNA, 16 bp, H. sapiens
tccctccattcattca

SEQ ID NO: 136888 - DNA, 16 bp, H. sapiens
tccctcccaggacaca

SEQ ID NO: 136889 - DNA, 16 bp, H. sapiens
tccctcccatgacgtg

SEQ ID NO: 136890 - DNA, 16 bp, H. sapiens
tccctccccaaagtgc

SEQ ID NO: 136891 - DNA, 16 bp, H. sapiens
tccctccccagcccag

SEQ ID NO: 136892 - DNA, 16 bp, H. sapiens
tccctccccagcttcc

SEQ ID NO: 136893 - DNA, 16 bp, H. sapiens
tccctccctgccagcc

SEQ ID NO: 136894 - DNA, 16 bp, H. sapiens
tccctcctcagccacc

SEQ ID NO: 136895 - DNA, 16 bp, H. sapiens
tccctcctcagcttct

SEQ ID NO: 136896 - DNA, 16 bp, H. sapiens
tccctcctcccagcct

SEQ ID NO: 136897 - DNA, 16 bp, H. sapiens
tccctcctcctgggag

SEQ ID NO: 136898 - DNA, 16 bp, H. sapiens
tccctcctctccagcc

SEQ ID NO: 136899 - DNA, 16 bp, H. sapiens
tccctcctctccccag

SEQ ID NO: 136900 - DNA, 16 bp, H. sapiens
tccctcctgcacctgg

SEQ ID NO: 136901 - DNA, 16 bp, H. sapiens
tccctcctgccaccct

SEQ ID NO: 136902 - DNA, 16 bp, H. sapiens
tccctcctgccccagg

SEQ ID NO: 136903 - DNA, 16 bp, H. sapiens
tccctcctgcccccag

SEQ ID NO: 136904 - DNA, 16 bp, H. sapiens
tccctcctgcccctgg

SEQ ID NO: 136905 - DNA, 16 bp, H. sapiens
tccctcctgctctggc

SEQ ID NO: 136906 - DNA, 16 bp, H. sapiens
tccctcctggctgcct

SEQ ID NO: 136907 - DNA, 16 bp, H. sapiens
tccctccttcccccag

SEQ ID NO: 136908 - DNA, 16 bp, H. sapiens
tccctccttttcaatt

SEQ ID NO: 136909 - DNA, 16 bp, H. sapiens
tccctctacctggaac

SEQ ID NO: 136910 - DNA, 16 bp, H. sapiens
tccctctagacactgc

SEQ ID NO: 136911 - DNA, 16 bp, H. sapiens
tccctctatccatcca

SEQ ID NO: 136912 - DNA, 16 bp, H. sapiens
tccctctccccagctc

SEQ ID NO: 136913 - DNA, 16 bp, H. sapiens
tccctctcctgccacc

SEQ ID NO: 136914 - DNA, 16 bp, H. sapiens
tccctctcctgctctg

SEQ ID NO: 136915 - DNA, 16 bp, H. sapiens
tccctctctctcccag

SEQ ID NO: 136916 - DNA, 16 bp, H. sapiens
tccctctctctctgtg

SEQ ID NO: 136917 - DNA, 16 bp, H. sapiens
tccctctctgagcctc

SEQ ID NO: 136918 - DNA, 16 bp, H. sapiens
tccctctctgggcctc

SEQ ID NO: 136919 - DNA, 16 bp, H. sapiens
tccctctctgtcaccc

SEQ ID NO: 136920 - DNA, 16 bp, H. sapiens
tccctctctgtctctg

SEQ ID NO: 136921 - DNA, 16 bp, H. sapiens
tccctctgatgcccag

SEQ ID NO: 136922 - DNA, 16 bp, H. sapiens
tccctctgcccagtcc

SEQ ID NO: 136923 - DNA, 16 bp, H. sapiens
tccctctgccccagcc

SEQ ID NO: 136924 - DNA, 16 bp, H. sapiens
tccctctgccccatcc

SEQ ID NO: 136925 - DNA, 16 bp, H. sapiens
tccctctgcctgcaat

SEQ ID NO: 136926 - DNA, 16 bp, H. sapiens
tccctctgctgtgtgc

SEQ ID NO: 136927 - DNA, 16 bp, H. sapiens
tccctctggtcctggg

SEQ ID NO: 136928 - DNA, 16 bp, H. sapiens
tccctctgtccactct

SEQ ID NO: 136929 - DNA, 16 bp, H. sapiens
tccctctgtccctctg

SEQ ID NO: 136930 - DNA, 16 bp, H. sapiens
tccctctgtgtgtctg

SEQ ID NO: 136931 - DNA, 19 bp, H. sapiens
tccctctgttgcccaggct

SEQ ID NO: 136932 - DNA, 16 bp, H. sapiens
tccctcttcccagccc

SEQ ID NO: 136933 - DNA, 16 bp, H. sapiens
tccctcttctcacagc

SEQ ID NO: 136934 - DNA, 16 bp, H. sapiens
tccctcttggccaagg

SEQ ID NO: 136935 - DNA, 16 bp, H. sapiens
tccctgaaagagatgg

SEQ ID NO: 136936 - DNA, 16 bp, H. sapiens
tccctgaaatgtctga

SEQ ID NO: 136937 - DNA, 16 bp, H. sapiens
tccctgaagcctcccc

SEQ ID NO: 136938 - DNA, 16 bp, H. sapiens
tccctgaagggaagga

SEQ ID NO: 136939 - DNA, 16 bp, H. sapiens
tccctgaatttggaaa

SEQ ID NO: 136940 - DNA, 16 bp, H. sapiens
tccctgacatccgtgg

SEQ ID NO: 136941 - DNA, 16 bp, H. sapiens
tccctgacccctgccc

SEQ ID NO: 136942 - DNA, 16 bp, H. sapiens
tccctgacctcaagtg

SEQ ID NO: 136943 - DNA, 16 bp, H. sapiens
tccctgagacagagca

SEQ ID NO: 136944 - DNA, 16 bp, H. sapiens
tccctgagacagagct

SEQ ID NO: 136945 - DNA, 16 bp, H. sapiens
tccctgagactcagtt

SEQ ID NO: 136946 - DNA, 16 bp, H. sapiens
tccctgagccacactg

SEQ ID NO: 136947 - DNA, 16 bp, H. sapiens
tccctgaggaagaaga

SEQ ID NO: 136948 - DNA, 16 bp, H. sapiens
tccctgaggacaggga

SEQ ID NO: 136949 - DNA, 16 bp, H. sapiens
tccctgaggccctcac

SEQ ID NO: 136950 - DNA, 16 bp, H. sapiens
tccctgaggcctcccc

SEQ ID NO: 136951 - DNA, 16 bp, H. sapiens
tccctgaggcctctcc

SEQ ID NO: 136952 - DNA, 16 bp, H. sapiens
tccctgaggccttccc

SEQ ID NO: 136953 - DNA, 16 bp, H. sapiens
tccctgaggctctgtt

SEQ ID NO: 136954 - DNA, 16 bp, H. sapiens
tccctgaggcttcccc

SEQ ID NO: 136955 - DNA, 16 bp, H. sapiens
tccctgagggtggggc

SEQ ID NO: 136956 - DNA, 16 bp, H. sapiens
tccctgatccctgacc

SEQ ID NO: 136957 - DNA, 16 bp, H. sapiens
tccctgatgaacatgg

SEQ ID NO: 136958 - DNA, 16 bp, H. sapiens
tccctgatgccaaaaa

SEQ ID NO: 136959 - DNA, 16 bp, H. sapiens
tccctgatggactggg

SEQ ID NO: 136960 - DNA, 16 bp, H. sapiens
tccctgcaaaggaaat

SEQ ID NO: 136961 - DNA, 16 bp, H. sapiens
tccctgcactttggaa

SEQ ID NO: 136962 - DNA, 16 bp, H. sapiens
tccctgcagccctccc

SEQ ID NO: 136963 - DNA, 16 bp, H. sapiens
tccctgcagccttgcc

SEQ ID NO: 136964 - DNA, 16 bp, H. sapiens
tccctgcagggcaggg

SEQ ID NO: 136965 - DNA, 16 bp, H. sapiens
tccctgcagggctggg

SEQ ID NO: 136966 - DNA, 16 bp, H. sapiens
tccctgcagtttggga

SEQ ID NO: 136967 - DNA, 16 bp, H. sapiens
tccctgcatgaccatt

SEQ ID NO: 136968 - DNA, 16 bp, H. sapiens
tccctgccagctcaag

SEQ ID NO: 136969 - DNA, 16 bp, H. sapiens
tccctgccccacttcc

SEQ ID NO: 136970 - DNA, 16 bp, H. sapiens
tccctgccccattccc

SEQ ID NO: 136971 - DNA, 16 bp, H. sapiens
tccctgcccccacaca

SEQ ID NO: 136972 - DNA, 16 bp, H. sapiens
tccctgcccccactgc

SEQ ID NO: 136973 - DNA, 16 bp, H. sapiens
tccctgcccctgctgc

SEQ ID NO: 136974 - DNA, 16 bp, H. sapiens
tccctgccctagagat

SEQ ID NO: 136975 - DNA, 16 bp, H. sapiens
tccctgccctcagggg

SEQ ID NO: 136976 - DNA, 16 bp, H. sapiens
tccctgccctcatgga

SEQ ID NO: 136977 - DNA, 16 bp, H. sapiens
tccctgccctggagga

SEQ ID NO: 136978 - DNA, 16 bp, H. sapiens
tccctgccctggccct

SEQ ID NO: 136979 - DNA, 16 bp, H. sapiens
tccctgccctgtgccc

SEQ ID NO: 136980 - DNA, 16 bp, H. sapiens
tccctgcccttaagga

SEQ ID NO: 136981 - DNA, 16 bp, H. sapiens
tccctgcccttgagaa

SEQ ID NO: 136982 - DNA, 16 bp, H. sapiens
tccctgcctccagacc

SEQ ID NO: 136983 - DNA, 16 bp, H. sapiens
tccctgcctccagccc

SEQ ID NO: 136984 - DNA, 16 bp, H. sapiens
tccctgcctcgggctc

SEQ ID NO: 136985 - DNA, 16 bp, H. sapiens
tccctgcctctgcctg

SEQ ID NO: 136986 - DNA, 16 bp, H. sapiens
tccctgcctgccagct

SEQ ID NO: 136987 - DNA, 16 bp, H. sapiens
tccctgccttcaaaga

SEQ ID NO: 136988 - DNA, 16 bp, H. sapiens
tccctgccttctgtcc

SEQ ID NO: 136989 - DNA, 16 bp, H. sapiens
tccctgcctttaagga

SEQ ID NO: 136990 - DNA, 16 bp, H. sapiens
tccctgcggccttctg

SEQ ID NO: 136991 - DNA, 16 bp, H. sapiens
tccctgctactgtgtc

SEQ ID NO: 136992 - DNA, 16 bp, H. sapiens
tccctgctccatctca

SEQ ID NO: 136993 - DNA, 16 bp, H. sapiens
tccctgctcccaccct

SEQ ID NO: 136994 - DNA, 16 bp, H. sapiens
tccctgctcccagcac

SEQ ID NO: 136995 - DNA, 16 bp, H. sapiens
tccctgctcccagccc

SEQ ID NO: 136996 - DNA, 16 bp, H. sapiens
tccctgctgagcctgg

SEQ ID NO: 136997 - DNA, 16 bp, H. sapiens
tccctgcttccattct

SEQ ID NO: 136998 - DNA, 16 bp, H. sapiens
tccctgctttcaattt

SEQ ID NO: 136999 - DNA, 16 bp, H. sapiens
tccctgctttgagttg

SEQ ID NO: 137000 - DNA, 16 bp, H. sapiens
tccctggaagctgtga

SEQ ID NO: 137001 - DNA, 16 bp, H. sapiens
tccctggaatctgtga

SEQ ID NO: 137002 - DNA, 16 bp, H. sapiens
tccctggaatgaaacc

SEQ ID NO: 137003 - DNA, 16 bp, H. sapiens
tccctggagattctga

SEQ ID NO: 137004 - DNA, 16 bp, H. sapiens
tccctggagcctggga

SEQ ID NO: 137005 - DNA, 16 bp, H. sapiens
tccctggaggaggagg

SEQ ID NO: 137006 - DNA, 16 bp, H. sapiens
tccctggaggaggtga

SEQ ID NO: 137007 - DNA, 16 bp, H. sapiens
tccctggattaccagg

SEQ ID NO: 137008 - DNA, 16 bp, H. sapiens
tccctggcagccacca

SEQ ID NO: 137009 - DNA, 16 bp, H. sapiens
tccctggcccctccca

SEQ ID NO: 137010 - DNA, 16 bp, H. sapiens
tccctggccctgccct

SEQ ID NO: 137011 - DNA, 16 bp, H. sapiens
tccctggcctccacct

SEQ ID NO: 137012 - DNA, 16 bp, H. sapiens
tccctggccttgctgg

SEQ ID NO: 137013 - DNA, 16 bp, H. sapiens
tccctggctagggctc

SEQ ID NO: 137014 - DNA, 16 bp, H. sapiens
tccctggctcccactc

SEQ ID NO: 137015 - DNA, 16 bp, H. sapiens
tccctggcttatttca

SEQ ID NO: 137016 - DNA, 16 bp, H. sapiens
tccctgggattcaagg

SEQ ID NO: 137017 - DNA, 21 bp, H. sapiens
tccctgggcaatggaatgtct

SEQ ID NO: 137018 - DNA, 16 bp, H. sapiens
tccctgggcctcagtc

SEQ ID NO: 137019 - DNA, 16 bp, H. sapiens
tccctgggcctcagtt

SEQ ID NO: 137020 - DNA, 16 bp, H. sapiens
tccctgggcctcattt

SEQ ID NO: 137021 - DNA, 16 bp, H. sapiens
tccctgggcctgagcc

SEQ ID NO: 137022 - DNA, 16 bp, H. sapiens
tccctgggcctggccc

SEQ ID NO: 137023 - DNA, 16 bp, H. sapiens
tccctgggctcaagca

SEQ ID NO: 137024 - DNA, 16 bp, H. sapiens
tccctgggctcaagtg

SEQ ID NO: 137025 - DNA, 16 bp, H. sapiens
tccctggggcaggacc

SEQ ID NO: 137026 - DNA, 16 bp, H. sapiens
tccctgggtcagaagc

SEQ ID NO: 137027 - DNA, 16 bp, H. sapiens
tccctgggtctccagc

SEQ ID NO: 137028 - DNA, 16 bp, H. sapiens
tccctggtctctaccc

SEQ ID NO: 137029 - DNA, 16 bp, H. sapiens
tccctggtgacctgtg

SEQ ID NO: 137030 - DNA, 16 bp, H. sapiens
tccctggtgccaaaaa

SEQ ID NO: 137031 - DNA, 20 bp, H. sapiens
tccctggttcaagcgattct

SEQ ID NO: 137032 - DNA, 16 bp, H. sapiens
tccctggttctgaggc

SEQ ID NO: 137033 - DNA, 16 bp, H. sapiens
tccctgtaatcccagc

SEQ ID NO: 137034 - DNA, 16 bp, H. sapiens
tccctgtcacttctct

SEQ ID NO: 137035 - DNA, 16 bp, H. sapiens
tccctgtcccacacag

SEQ ID NO: 137036 - DNA, 16 bp, H. sapiens
tccctgtctctggtgc

SEQ ID NO: 137037 - DNA, 16 bp, H. sapiens
tccctgtctctttcag

SEQ ID NO: 137038 - DNA, 16 bp, H. sapiens
tccctgtctgacagct

SEQ ID NO: 137039 - DNA, 26 bp, H. sapiens
tccctgtctgacagctttgaagagag

SEQ ID NO: 137040 - DNA, 16 bp, H. sapiens
tccctgtctgtaaaat

SEQ ID NO: 137041 - DNA, 16 bp, H. sapiens
tccctgtcttgttcca

SEQ ID NO: 137042 - DNA, 16 bp, H. sapiens
tccctgtgtccatgga

SEQ ID NO: 137043 - DNA, 16 bp, H. sapiens
tccctgtgtccatgta

SEQ ID NO: 137044 - DNA, 16 bp, H. sapiens
tccctgtgtctcagtt

SEQ ID NO: 137045 - DNA, 16 bp, H. sapiens
tccctgtgtcttcatg

SEQ ID NO: 137046 - DNA, 16 bp, H. sapiens
tccctgtgttctattt

SEQ ID NO: 137047 - DNA, 16 bp, H. sapiens
tccctgttccctgaga

SEQ ID NO: 137048 - DNA, 16 bp, H. sapiens
tccctgtttgcagacg

SEQ ID NO: 137049 - DNA, 16 bp, H. sapiens
tccctgttttcctgct

SEQ ID NO: 137050 - DNA, 16 bp, H. sapiens
tcccttaagcctggga

SEQ ID NO: 137051 - DNA, 16 bp, H. sapiens
tcccttatctgacccc

SEQ ID NO: 137052 - DNA, 16 bp, H. sapiens
tcccttatgaatatag

SEQ ID NO: 137053 - DNA, 16 bp, H. sapiens
tcccttcacagatttt

SEQ ID NO: 137054 - DNA, 16 bp, H. sapiens
tcccttcattataaaa

SEQ ID NO: 137055 - DNA, 16 bp, H. sapiens
tcccttccccattgct

SEQ ID NO: 137056 - DNA, 16 bp, H. sapiens
tcccttcccccacagc

SEQ ID NO: 137057 - DNA, 16 bp, H. sapiens
tcccttccctagccaa

SEQ ID NO: 137058 - DNA, 16 bp, H. sapiens
tcccttccttgtgtcc

SEQ ID NO: 137059 - DNA, 16 bp, H. sapiens
tcccttctccagcccc

SEQ ID NO: 137060 - DNA, 16 bp, H. sapiens
tcccttctccccagcc

SEQ ID NO: 137061 - DNA, 16 bp, H. sapiens
tcccttctctttgcca

SEQ ID NO: 137062 - DNA, 16 bp, H. sapiens
tcccttctttaaaaaa

SEQ ID NO: 137063 - DNA, 16 bp, H. sapiens
tcccttgaaccctgga

SEQ ID NO: 137064 - DNA, 16 bp, H. sapiens
tcccttgagccaggga

SEQ ID NO: 137065 - DNA, 16 bp, H. sapiens
tcccttgaggttagga

SEQ ID NO: 137066 - DNA, 17 bp, H. sapiens
tcccttgattctcttga

SEQ ID NO: 137067 - DNA, 16 bp, H. sapiens
tcccttgcctattttt

SEQ ID NO: 137068 - DNA, 16 bp, H. sapiens
tcccttgcctcttcca

SEQ ID NO: 137069 - DNA, 22 bp, H. sapiens
tcccttgtaagttggattccta

SEQ ID NO: 137070 - DNA, 16 bp, H. sapiens
tcccttgtctcagatg

SEQ ID NO: 137071 - DNA, 16 bp, H. sapiens
tccctttaccaatatg

SEQ ID NO: 137072 - DNA, 16 bp, H. sapiens
tccctttcacctatga

SEQ ID NO: 137073 - DNA, 16 bp, H. sapiens
tccctttccaagcctg

SEQ ID NO: 137074 - DNA, 16 bp, H. sapiens
tccctttccaagtcaa

SEQ ID NO: 137075 - DNA, 16 bp, H. sapiens
tccctttccatggcaa

SEQ ID NO: 137076 - DNA, 16 bp, H. sapiens
tccctttccccagccc

SEQ ID NO: 137077 - DNA, 16 bp, H. sapiens
tccctttccgagtcaa

SEQ ID NO: 137078 - DNA, 16 bp, H. sapiens
tccctttcctctgcag

SEQ ID NO: 137079 - DNA, 16 bp, H. sapiens
tccctttgaaagctgg

SEQ ID NO: 137080 - DNA, 16 bp, H. sapiens
tccctttgtgtgtgtg

SEQ ID NO: 137081 - DNA, 16 bp, H. sapiens
tccctttgttttcagt

SEQ ID NO: 137082 - DNA, 16 bp, H. sapiens
tcccttttaacaaaaa

SEQ ID NO: 137083 - DNA, 16 bp, H. sapiens
tcccttttataaaatg

SEQ ID NO: 137084 - DNA, 16 bp, H. sapiens
tcccttttgcttttca

SEQ ID NO: 137085 - DNA, 16 bp, H. sapiens
tcccttttggagttta

SEQ ID NO: 137086 - DNA, 16 bp, H. sapiens
tccctttttctccaca

SEQ ID NO: 137087 - DNA, 16 bp, H. sapiens
tccctttttttgtcta

SEQ ID NO: 137088 - DNA, 16 bp, H. sapiens
tccgaaatccagcagg

SEQ ID NO: 137089 - DNA, 16 bp, H. sapiens
tccgactcctgggctc

SEQ ID NO: 137090 - DNA, 18 bp, H. sapiens
tccgaggcgggcggatca

SEQ ID NO: 137091 - DNA, 16 bp, H. sapiens
tccgaggctgcagtga

SEQ ID NO: 137092 - DNA, 16 bp, H. sapiens
tccgccaccacgccca

SEQ ID NO: 137093 - DNA, 16 bp, H. sapiens
tccgcccaccgcagcc

SEQ ID NO: 137094 - DNA, 16 bp, H. sapiens
tccgcccacctctgcc

SEQ ID NO: 137095 - DNA, 16 bp, H. sapiens
tccgcccagctcggcc

SEQ ID NO: 137096 - DNA, 16 bp, H. sapiens
tccgcctcagcttccc

SEQ ID NO: 137097 - DNA, 17 bp, H. sapiens
tccgcctcccaggctca

SEQ ID NO: 137098 - DNA, 17 bp, H. sapiens
tccgcctccgggattca

SEQ ID NO: 137099 - DNA, 16 bp, H. sapiens
tccgcctgcctcaccc

SEQ ID NO: 137100 - DNA, 16 bp, H. sapiens
tccgcctgcctcagac

SEQ ID NO: 137101 - DNA, 16 bp, H. sapiens
tccgcctgcctcgacc

SEQ ID NO: 137102 - DNA, 16 bp, H. sapiens
tccgcctgccttggct

SEQ ID NO: 137103 - DNA, 16 bp, H. sapiens
tccgcctgggcctccc

SEQ ID NO: 137104 - DNA, 16 bp, H. sapiens
tccgccttcctcggcc

SEQ ID NO: 137105 - DNA, 16 bp, H. sapiens
tccgcgcagcccagcc

SEQ ID NO: 137106 - DNA, 16 bp, H. sapiens
tccgctccctgtgtcc

SEQ ID NO: 137107 - DNA, 16 bp, H. sapiens
tccggccaggcatggt

SEQ ID NO: 137108 - DNA, 16 bp, H. sapiens
tccggccgcctcagcc

SEQ ID NO: 137109 - DNA, 16 bp, H. sapiens
tccggctcatttttgt

SEQ ID NO: 137110 - DNA, 16 bp, H. sapiens
tccgggacggggcggc

SEQ ID NO: 137111 - DNA, 16 bp, H. sapiens
tccgggaggccgaggc

SEQ ID NO: 137112 - DNA, 16 bp, H. sapiens
tccgggaggcggagat

SEQ ID NO: 137113 - DNA, 16 bp, H. sapiens
tccgggaggcggagct

SEQ ID NO: 137114 - DNA, 16 bp, H. sapiens
tccgggaggtggaggc

SEQ ID NO: 137115 - DNA, 16 bp, H. sapiens
tccggggtccagggtc

SEQ ID NO: 137116 - DNA, 17 bp, H. sapiens
tccgggttcaagccatt

SEQ ID NO: 137117 - DNA, 19 bp, H. sapiens
tccgggttcaagcgattct

SEQ ID NO: 137118 - DNA, 16 bp, H. sapiens
tccggtgatctgcctg

SEQ ID NO: 137119 - DNA, 16 bp, H. sapiens
tccgtccatccatcca

SEQ ID NO: 137120 - DNA, 16 bp, H. sapiens
tccgtctgtctgtctg

SEQ ID NO: 137121 - DNA, 16 bp, H. sapiens
tccgtcttaagaaaaa

SEQ ID NO: 137122 - DNA, 16 bp, H. sapiens
tccgtgaggccaagaa

SEQ ID NO: 137123 - DNA, 16 bp, H. sapiens
tccgtgatggtctacg

SEQ ID NO: 137124 - DNA, 16 bp, H. sapiens
tccgtgcagtggctgc

SEQ ID NO: 137125 - DNA, 16 bp, H. sapiens
tccgtggaaaaattgt

SEQ ID NO: 137126 - DNA, 16 bp, H. sapiens
tccgtggcccaggctg

SEQ ID NO: 137127 - DNA, 16 bp, H. sapiens
tccgtgtggctgggga

SEQ ID NO: 137128 - DNA, 16 bp, H. sapiens
tccgtgtgtgcatgtg

SEQ ID NO: 137129 - DNA, 16 bp, H. sapiens
tcctaaaagaaaacat

SEQ ID NO: 137130 - DNA, 16 bp, H. sapiens
tcctaaaatgtgtatg

SEQ ID NO: 137131 - DNA, 16 bp, H. sapiens
tcctaaagcactggga

SEQ ID NO: 137132 - DNA, 16 bp, H. sapiens
tcctaaagtcctggga

SEQ ID NO: 137133 - DNA, 19 bp, H. sapiens
tcctaaagtgctggaatta

SEQ ID NO: 137134 - DNA, 16 bp, H. sapiens
tcctaacaccatttat

SEQ ID NO: 137135 - DNA, 16 bp, H. sapiens
tcctaacatggtgaaa

SEQ ID NO: 137136 - DNA, 16 bp, H. sapiens
tcctaagcacaaagaa

SEQ ID NO: 137137 - DNA, 16 bp, H. sapiens
tcctaagcagctgaga

SEQ ID NO: 137138 - DNA, 16 bp, H. sapiens
tcctaagtagttggga

SEQ ID NO: 137139 - DNA, 18 bp, H. sapiens
tcctaataagcctgggag

SEQ ID NO: 137140 - DNA, 16 bp, H. sapiens
tcctaataagttcctc

SEQ ID NO: 137141 - DNA, 16 bp, H. sapiens
tcctaatctccttttc

SEQ ID NO: 137142 - DNA, 16 bp, H. sapiens
tcctaatgctctccct

SEQ ID NO: 137143 - DNA, 18 bp, H. sapiens
tcctaattaaataccctt

SEQ ID NO: 137144 - DNA, 16 bp, H. sapiens
tcctaattacctccca

SEQ ID NO: 137145 - DNA, 16 bp, H. sapiens
tcctacaaccaagaaa

SEQ ID NO: 137146 - DNA, 16 bp, H. sapiens
tcctaccacagcctcc

SEQ ID NO: 137147 - DNA, 16 bp, H. sapiens
tcctaccccagggcct

SEQ ID NO: 137148 - DNA, 16 bp, H. sapiens
tcctacctcaacctct

SEQ ID NO: 137149 - DNA, 17 bp, H. sapiens
tcctacctcagcctcct

SEQ ID NO: 137150 - DNA, 16 bp, H. sapiens
tcctacctcggcttcc

SEQ ID NO: 137151 - DNA, 16 bp, H. sapiens
tcctacctctcagcct

SEQ ID NO: 137152 - DNA, 16 bp, H. sapiens
tcctacgtcagcctcc

SEQ ID NO: 137153 - DNA, 22 bp, H. sapiens
tcctactacattcctttttgct

SEQ ID NO: 137154 - DNA, 16 bp, H. sapiens
tcctactccctcagcc

SEQ ID NO: 137155 - DNA, 16 bp, H. sapiens
tcctactctgtcaccc

SEQ ID NO: 137156 - DNA, 16 bp, H. sapiens
tcctactgctgggtat

SEQ ID NO: 137157 - DNA, 16 bp, H. sapiens
tcctacttcagcctcc

SEQ ID NO: 137158 - DNA, 16 bp, H. sapiens
tcctacttctccacag

SEQ ID NO: 137159 - DNA, 16 bp, H. sapiens
tcctagaagaaaagct

SEQ ID NO: 137160 - DNA, 16 bp, H. sapiens
tcctagatatataccc

SEQ ID NO: 137161 - DNA, 16 bp, H. sapiens
tcctagcacagtgcct

SEQ ID NO: 137162 - DNA, 16 bp, H. sapiens
tcctagccagagaaat

SEQ ID NO: 137163 - DNA, 16 bp, H. sapiens
tcctagctactttgga

SEQ ID NO: 137164 - DNA, 16 bp, H. sapiens
tcctagctcaagcaat

SEQ ID NO: 137165 - DNA, 16 bp, H. sapiens
tcctagctgctgggga

SEQ ID NO: 137166 - DNA, 16 bp, H. sapiens
tcctaggcagacaggg

SEQ ID NO: 137167 - DNA, 16 bp, H. sapiens
tcctaggctcaactga

SEQ ID NO: 137168 - DNA, 16 bp, H. sapiens
tcctaggctcaagtta

SEQ ID NO: 137169 - DNA, 16 bp, H. sapiens
tcctagggctgccatg

SEQ ID NO: 137170 - DNA, 16 bp, H. sapiens
tcctaggtattatatt

SEQ ID NO: 137171 - DNA, 16 bp, H. sapiens
tcctaggtcctcccaa

SEQ ID NO: 137172 - DNA, 17 bp, H. sapiens
tcctaggttcaagcgat

SEQ ID NO: 137173 - DNA, 16 bp, H. sapiens
tcctaggttttatgac

SEQ ID NO: 137174 - DNA, 16 bp, H. sapiens
tcctagtgggtgtgaa

SEQ ID NO: 137175 - DNA, 16 bp, H. sapiens
tcctagttcactgcag

SEQ ID NO: 137176 - DNA, 16 bp, H. sapiens
tcctataactcaacaa

SEQ ID NO: 137177 - DNA, 16 bp, H. sapiens
tcctataattcccatg

SEQ ID NO: 137178 - DNA, 16 bp, H. sapiens
tcctatatgccaataa

SEQ ID NO: 137179 - DNA, 16 bp, H. sapiens
tcctatcagatcaggg

SEQ ID NO: 137180 - DNA, 16 bp, H. sapiens
tcctatcttagcctcc

SEQ ID NO: 137181 - DNA, 16 bp, H. sapiens
tcctatgaaaatctaa

SEQ ID NO: 137182 - DNA, 16 bp, H. sapiens
tcctatgttgaaatct

SEQ ID NO: 137183 - DNA, 16 bp, H. sapiens
tcctatgttgggtgca

SEQ ID NO: 137184 - DNA, 16 bp, H. sapiens
tcctattataaagata

SEQ ID NO: 137185 - DNA, 16 bp, H. sapiens
tcctattcaacatagt

SEQ ID NO: 137186 - DNA, 17 bp, H. sapiens
tcctattcaacatagta

SEQ ID NO: 137187 - DNA, 16 bp, H. sapiens
tcctattcatccttca

SEQ ID NO: 137188 - DNA, 16 bp, H. sapiens
tcctattcatgagcat

SEQ ID NO: 137189 - DNA, 16 bp, H. sapiens
tcctattctgtaagtt

SEQ ID NO: 137190 - DNA, 16 bp, H. sapiens
tcctattggccaaagc

SEQ ID NO: 137191 - DNA, 16 bp, H. sapiens
tcctatttcagcctcc

SEQ ID NO: 137192 - DNA, 16 bp, H. sapiens
tcctatttgtctattt

SEQ ID NO: 137193 - DNA, 16 bp, H. sapiens
tcctattttgattaat

SEQ ID NO: 137194 - DNA, 16 bp, H. sapiens
tcctcaaaaatctaaa

SEQ ID NO: 137195 - DNA, 16 bp, H. sapiens
tcctcaaaagcaaatg

SEQ ID NO: 137196 - DNA, 16 bp, H. sapiens
tcctcaaacagaagga

SEQ ID NO: 137197 - DNA, 16 bp, H. sapiens
tcctcaaatttatatg

SEQ ID NO: 137198 - DNA, 16 bp, H. sapiens
tcctcaacaaaatgtt

SEQ ID NO: 137199 - DNA, 16 bp, H. sapiens
tcctcaacttatgatg

SEQ ID NO: 137200 - DNA, 16 bp, H. sapiens
tcctcaagaaaatact

SEQ ID NO: 137201 - DNA, 16 bp, H. sapiens
tcctcaagaaattaaa

SEQ ID NO: 137202 - DNA, 16 bp, H. sapiens
tcctcaagaagttaaa

SEQ ID NO: 137203 - DNA, 16 bp, H. sapiens
tcctcaaggagcttac

SEQ ID NO: 137204 - DNA, 16 bp, H. sapiens
tcctcaaggatttaga

SEQ ID NO: 137205 - DNA, 16 bp, H. sapiens
tcctcaagggcagaga

SEQ ID NO: 137206 - DNA, 16 bp, H. sapiens
tcctcaagtcagcctc

SEQ ID NO: 137207 - DNA, 16 bp, H. sapiens
tcctcaagtcggcctc

SEQ ID NO: 137208 - DNA, 16 bp, H. sapiens
tcctcaagtgcagcca

SEQ ID NO: 137209 - DNA, 16 bp, H. sapiens
tcctcacaaaaaccct

SEQ ID NO: 137210 - DNA, 16 bp, H. sapiens
tcctcacaaaggattc

SEQ ID NO: 137211 - DNA, 16 bp, H. sapiens
tcctcacaacaaccct

SEQ ID NO: 137212 - DNA, 16 bp, H. sapiens
tcctcacaacagtcct

SEQ ID NO: 137213 - DNA, 16 bp, H. sapiens
tcctcacaacatggtg

SEQ ID NO: 137214 - DNA, 16 bp, H. sapiens
tcctcacaataaccct

SEQ ID NO: 137215 - DNA, 16 bp, H. sapiens
tcctcacaataacctt

SEQ ID NO: 137216 - DNA, 16 bp, H. sapiens
tcctcacagcaacccc

SEQ ID NO: 137217 - DNA, 16 bp, H. sapiens
tcctcacagcaaccct

SEQ ID NO: 137218 - DNA, 16 bp, H. sapiens
tcctcacagtaatcct

SEQ ID NO: 137219 - DNA, 17 bp, H. sapiens
tcctcacatcccagatg

SEQ ID NO: 137220 - DNA, 16 bp, H. sapiens
tcctcacatctcagac

SEQ ID NO: 137221 - DNA, 16 bp, H. sapiens
tcctcacatttgaaaa

SEQ ID NO: 137222 - DNA, 16 bp, H. sapiens
tcctcaccaacaatgg

SEQ ID NO: 137223 - DNA, 16 bp, H. sapiens
tcctcaccaacactta

SEQ ID NO: 137224 - DNA, 16 bp, H. sapiens
tcctcaccacaaccct

SEQ ID NO: 137225 - DNA, 16 bp, H. sapiens
tcctcaccaccaccat

SEQ ID NO: 137226 - DNA, 16 bp, H. sapiens
tcctcaccagaaccca

SEQ ID NO: 137227 - DNA, 17 bp, H. sapiens
tcctcacccaaatctca

SEQ ID NO: 137228 - DNA, 16 bp, H. sapiens
tcctcaccctcctgag

SEQ ID NO: 137229 - DNA, 16 bp, H. sapiens
tcctcacctcagatga

SEQ ID NO: 137230 - DNA, 16 bp, H. sapiens
tcctcacctccatctg

SEQ ID NO: 137231 - DNA, 16 bp, H. sapiens
tcctcacgtggtagaa

SEQ ID NO: 137232 - DNA, 17 bp, H. sapiens
tcctcactgctacactc

SEQ ID NO: 137233 - DNA, 16 bp, H. sapiens
tcctcactgggcagga

SEQ ID NO: 137234 - DNA, 16 bp, H. sapiens
tcctcactgggtgggg

SEQ ID NO: 137235 - DNA, 16 bp, H. sapiens
tcctcacttataaaat

SEQ ID NO: 137236 - DNA, 17 bp, H. sapiens
tcctcacttggggctga

SEQ ID NO: 137237 - DNA, 16 bp, H. sapiens
tcctcagaaaatgaga

SEQ ID NO: 137238 - DNA, 16 bp, H. sapiens
tcctcagaaagctaaa

SEQ ID NO: 137239 - DNA, 16 bp, H. sapiens
tcctcagaaatatttt

SEQ ID NO: 137240 - DNA, 16 bp, H. sapiens
tcctcagaagaaacca

SEQ ID NO: 137241 - DNA, 17 bp, H. sapiens
tcctcagaagaaagaat

SEQ ID NO: 137242 - DNA, 16 bp, H. sapiens
tcctcagaagcatgtg

SEQ ID NO: 137243 - DNA, 16 bp, H. sapiens
tcctcagacaaaggtg

SEQ ID NO: 137244 - DNA, 16 bp, H. sapiens
tcctcagagaagccct

SEQ ID NO: 137245 - DNA, 16 bp, H. sapiens
tcctcagcacctctgc

SEQ ID NO: 137246 - DNA, 16 bp, H. sapiens
tcctcagccacctgag

SEQ ID NO: 137247 - DNA, 16 bp, H. sapiens
tcctcagcctcagcat

SEQ ID NO: 137248 - DNA, 16 bp, H. sapiens
tcctcagcctcctcct

SEQ ID NO: 137249 - DNA, 17 bp, H. sapiens
tcctcagccttctgagt

SEQ ID NO: 137250 - DNA, 16 bp, H. sapiens
tcctcagcctttcttt

SEQ ID NO: 137251 - DNA, 16 bp, H. sapiens
tcctcagcttcccaag

SEQ ID NO: 137252 - DNA, 16 bp, H. sapiens
tcctcagcttggtcaa

SEQ ID NO: 137253 - DNA, 16 bp, H. sapiens
tcctcaggacccaccc

SEQ ID NO: 137254 - DNA, 16 bp, H. sapiens
tcctcaggctggtctc

SEQ ID NO: 137255 - DNA, 16 bp, H. sapiens
tcctcagggacctaga

SEQ ID NO: 137256 - DNA, 16 bp, H. sapiens
tcctcagggagcccca

SEQ ID NO: 137257 - DNA, 16 bp, H. sapiens
tcctcagggatccaga

SEQ ID NO: 137258 - DNA, 16 bp, H. sapiens
tcctcagtcttttctt

SEQ ID NO: 137259 - DNA, 16 bp, H. sapiens
tcctcagtgtctgttg

SEQ ID NO: 137260 - DNA, 16 bp, H. sapiens
tcctcagtgttggagg

SEQ ID NO: 137261 - DNA, 16 bp, H. sapiens
tcctcatacataaaat

SEQ ID NO: 137262 - DNA, 16 bp, H. sapiens
tcctcatatagatttt

SEQ ID NO: 137263 - DNA, 16 bp, H. sapiens
tcctcatcaaaatact

SEQ ID NO: 137264 - DNA, 16 bp, H. sapiens
tcctcatcagcaatgg

SEQ ID NO: 137265 - DNA, 16 bp, H. sapiens
tcctcatcatcatcac

SEQ ID NO: 137266 - DNA, 16 bp, H. sapiens
tcctcatcctcatcat

SEQ ID NO: 137267 - DNA, 16 bp, H. sapiens
tcctcatcctcatcct

SEQ ID NO: 137268 - DNA, 16 bp, H. sapiens
tcctcatcctcctgag

SEQ ID NO: 137269 - DNA, 16 bp, H. sapiens
tcctcatctagaaaat

SEQ ID NO: 137270 - DNA, 16 bp, H. sapiens
tcctcatctataaaat

SEQ ID NO: 137271 - DNA, 16 bp, H. sapiens
tcctcatctataaatg

SEQ ID NO: 137272 - DNA, 16 bp, H. sapiens
tcctcatctcaggtga

SEQ ID NO: 137273 - DNA, 16 bp, H. sapiens
tcctcatctcagtaaa

SEQ ID NO: 137274 - DNA, 16 bp, H. sapiens
tcctcatctccatctc

SEQ ID NO: 137275 - DNA, 16 bp, H. sapiens
tcctcatctccatctg

SEQ ID NO: 137276 - DNA, 16 bp, H. sapiens
tcctcatctgcaaagc

SEQ ID NO: 137277 - DNA, 16 bp, H. sapiens
tcctcatctgtaaaac

SEQ ID NO: 137278 - DNA, 16 bp, H. sapiens
tcctcatctgtaaatt

SEQ ID NO: 137279 - DNA, 16 bp, H. sapiens
tcctcatctgtaggat

SEQ ID NO: 137280 - DNA, 16 bp, H. sapiens
tcctcatcttcatgga

SEQ ID NO: 137281 - DNA, 16 bp, H. sapiens
tcctcatcttcctgtc

SEQ ID NO: 137282 - DNA, 16 bp, H. sapiens
tcctcatgacctaatc

SEQ ID NO: 137283 - DNA, 16 bp, H. sapiens
tcctcatgataatgag

SEQ ID NO: 137284 - DNA, 16 bp, H. sapiens
tcctcatgctgttctt

SEQ ID NO: 137285 - DNA, 16 bp, H. sapiens
tcctcatttattatta

SEQ ID NO: 137286 - DNA, 16 bp, H. sapiens
tcctcatttcacagat

SEQ ID NO: 137287 - DNA, 16 bp, H. sapiens
tcctcatttgccttcc

SEQ ID NO: 137288 - DNA, 16 bp, H. sapiens
tcctcattttaaagat

SEQ ID NO: 137289 - DNA, 16 bp, H. sapiens
tcctcattttatagat

SEQ ID NO: 137290 - DNA, 16 bp, H. sapiens
tcctccacagggcagg

SEQ ID NO: 137291 - DNA, 16 bp, H. sapiens
tcctccaccatcacca

SEQ ID NO: 137292 - DNA, 16 bp, H. sapiens
tcctccacctctgcct

SEQ ID NO: 137293 - DNA, 16 bp, H. sapiens
tcctccacgggggcct

SEQ ID NO: 137294 - DNA, 17 bp, H. sapiens
tcctccagaaagctcct

SEQ ID NO: 137295 - DNA, 16 bp, H. sapiens
tcctccagaccctgga

SEQ ID NO: 137296 - DNA, 16 bp, H. sapiens
tcctccagcccccaga

SEQ ID NO: 137297 - DNA, 16 bp, H. sapiens
tcctccagcctcaacc

SEQ ID NO: 137298 - DNA, 16 bp, H. sapiens
tcctccagcctcggcc

SEQ ID NO: 137299 - DNA, 16 bp, H. sapiens
tcctccagcctgggcg

SEQ ID NO: 137300 - DNA, 16 bp, H. sapiens
tcctccagcttcagcc

SEQ ID NO: 137301 - DNA, 16 bp, H. sapiens
tcctccagcttctggt

SEQ ID NO: 137302 - DNA, 16 bp, H. sapiens
tcctccaggaagtctt

SEQ ID NO: 137303 - DNA, 16 bp, H. sapiens
tcctccaggacctcct

SEQ ID NO: 137304 - DNA, 16 bp, H. sapiens
tcctccaggcagcctt

SEQ ID NO: 137305 - DNA, 16 bp, H. sapiens
tcctccagggcaggaa

SEQ ID NO: 137306 - DNA, 16 bp, H. sapiens
tcctccagggttcaag

SEQ ID NO: 137307 - DNA, 16 bp, H. sapiens
tcctccatcattaatg

SEQ ID NO: 137308 - DNA, 30 bp, H. sapiens
tcctccatcattaatgcctctttaataaaa

SEQ ID NO: 137309 - DNA, 16 bp, H. sapiens
tcctccatcttcaaat

SEQ ID NO: 137310 - DNA, 16 bp, H. sapiens
tcctccatttgtttgt

SEQ ID NO: 137311 - DNA, 16 bp, H. sapiens
tcctccatttttaaaa

SEQ ID NO: 137312 - DNA, 16 bp, H. sapiens
tcctcccaacttggcc

SEQ ID NO: 137313 - DNA, 16 bp, H. sapiens
tcctcccacagcctcc

SEQ ID NO: 137314 - DNA, 16 bp, H. sapiens
tcctcccacatcccaa

SEQ ID NO: 137315 - DNA, 16 bp, H. sapiens
tcctcccaccccagac

SEQ ID NO: 137316 - DNA, 16 bp, H. sapiens
tcctcccaccccagca

SEQ ID NO: 137317 - DNA, 16 bp, H. sapiens
tcctcccaccccagct

SEQ ID NO: 137318 - DNA, 16 bp, H. sapiens
tcctcccaccctggcc

SEQ ID NO: 137319 - DNA, 16 bp, H. sapiens
tcctcccacctaagcc

SEQ ID NO: 137320 - DNA, 16 bp, H. sapiens
tcctcccacctccctg

SEQ ID NO: 137321 - DNA, 16 bp, H. sapiens
tcctcccacctgtctc

SEQ ID NO: 137322 - DNA, 16 bp, H. sapiens
tcctcccagcactttg

SEQ ID NO: 137323 - DNA, 16 bp, H. sapiens
tcctcccagcagccct

SEQ ID NO: 137324 - DNA, 16 bp, H. sapiens
tcctcccagctcagca

SEQ ID NO: 137325 - DNA, 16 bp, H. sapiens
tcctcccagctcagcc

SEQ ID NO: 137326 - DNA, 16 bp, H. sapiens
tcctcccagctgcttt

SEQ ID NO: 137327 - DNA, 16 bp, H. sapiens
tcctcccaggccctgg

SEQ ID NO: 137328 - DNA, 16 bp, H. sapiens
tcctcccaggttcaag

SEQ ID NO: 137329 - DNA, 16 bp, H. sapiens
tcctcccagtgggcag

SEQ ID NO: 137330 - DNA, 16 bp, H. sapiens
tcctcccatccatcca

SEQ ID NO: 137331 - DNA, 16 bp, H. sapiens
tcctcccatcctggcc

SEQ ID NO: 137332 - DNA, 16 bp, H. sapiens
tcctcccatctcagct

SEQ ID NO: 137333 - DNA, 16 bp, H. sapiens
tcctcccatctctgcc

SEQ ID NO: 137334 - DNA, 16 bp, H. sapiens
tcctccccaaacctgg

SEQ ID NO: 137335 - DNA, 16 bp, H. sapiens
tcctccccaaccccag

SEQ ID NO: 137336 - DNA, 16 bp, H. sapiens
tcctccccactccctg

SEQ ID NO: 137337 - DNA, 16 bp, H. sapiens
tcctccccagaaaatg

SEQ ID NO: 137338 - DNA, 16 bp, H. sapiens
tcctccccatcagcct

SEQ ID NO: 137339 - DNA, 16 bp, H. sapiens
tcctccccatccccag

SEQ ID NO: 137340 - DNA, 16 bp, H. sapiens
tcctccccatccctgc

SEQ ID NO: 137341 - DNA, 16 bp, H. sapiens
tcctcccccagccctg

SEQ ID NO: 137342 - DNA, 16 bp, H. sapiens
tcctccccctcagcct

SEQ ID NO: 137343 - DNA, 16 bp, H. sapiens
tcctcccctccagagg

SEQ ID NO: 137344 - DNA, 16 bp, H. sapiens
tcctcccctctgaggt

SEQ ID NO: 137345 - DNA, 16 bp, H. sapiens
tcctcccggacggggc

SEQ ID NO: 137346 - DNA, 16 bp, H. sapiens
tcctcccgggttcaag

SEQ ID NO: 137347 - DNA, 21 bp, H. sapiens
tcctcccgggttcaagcgatt

SEQ ID NO: 137348 - DNA, 16 bp, H. sapiens
tcctccctaactcact

SEQ ID NO: 137349 - DNA, 16 bp, H. sapiens
tcctccctcactcatt

SEQ ID NO: 137350 - DNA, 16 bp, H. sapiens
tcctccctcagactca

SEQ ID NO: 137351 - DNA, 16 bp, H. sapiens
tcctccctcagccttc

SEQ ID NO: 137352 - DNA, 16 bp, H. sapiens
tcctccctcctgagcc

SEQ ID NO: 137353 - DNA, 16 bp, H. sapiens
tcctccctccttagcc

SEQ ID NO: 137354 - DNA, 16 bp, H. sapiens
tcctccctgcagccct

SEQ ID NO: 137355 - DNA, 16 bp, H. sapiens
tcctccctgcccacct

SEQ ID NO: 137356 - DNA, 16 bp, H. sapiens
tcctccctgccccagc

SEQ ID NO: 137357 - DNA, 16 bp, H. sapiens
tcctcccttggccacc

SEQ ID NO: 137358 - DNA, 16 bp, H. sapiens
tcctccgacctcagcc

SEQ ID NO: 137359 - DNA, 16 bp, H. sapiens
tcctccgggaagcctt

SEQ ID NO: 137360 - DNA, 16 bp, H. sapiens
tcctcctaaacctcca

SEQ ID NO: 137361 - DNA, 16 bp, H. sapiens
tcctcctactccagcc

SEQ ID NO: 137362 - DNA, 16 bp, H. sapiens
tcctcctacttcagct

SEQ ID NO: 137363 - DNA, 16 bp, H. sapiens
tcctcctcagaggaca

SEQ ID NO: 137364 - DNA, 16 bp, H. sapiens
tcctcctcagcctact

SEQ ID NO: 137365 - DNA, 16 bp, H. sapiens
tcctcctcagcctcca

SEQ ID NO: 137366 - DNA, 16 bp, H. sapiens
tcctcctcagcctccc

SEQ ID NO: 137367 - DNA, 16 bp, H. sapiens
tcctcctccaacaagg

SEQ ID NO: 137368 - DNA, 16 bp, H. sapiens
tcctcctccaagaagc

SEQ ID NO: 137369 - DNA, 16 bp, H. sapiens
tcctcctcccactgct

SEQ ID NO: 137370 - DNA, 16 bp, H. sapiens
tcctcctccccactgc

SEQ ID NO: 137371 - DNA, 16 bp, H. sapiens
tcctcctccctggttc

SEQ ID NO: 137372 - DNA, 16 bp, H. sapiens
tcctcctcctgctgct

SEQ ID NO: 137373 - DNA, 16 bp, H. sapiens
tcctcctccttcagcc

SEQ ID NO: 137374 - DNA, 16 bp, H. sapiens
tcctcctctcttggcc

SEQ ID NO: 137375 - DNA, 16 bp, H. sapiens
tcctcctctgtgaaac

SEQ ID NO: 137376 - DNA, 16 bp, H. sapiens
tcctcctgccacagcc

SEQ ID NO: 137377 - DNA, 16 bp, H. sapiens
tcctcctgccccagcc

SEQ ID NO: 137378 - DNA, 16 bp, H. sapiens
tcctcctgccctcagc

SEQ ID NO: 137379 - DNA, 16 bp, H. sapiens
tcctcctgccctccag

SEQ ID NO: 137380 - DNA, 16 bp, H. sapiens
tcctcctgcctcagca

SEQ ID NO: 137381 - DNA, 21 bp, H. sapiens
tcctcctgcctcagcctcccc

SEQ ID NO: 137382 - DNA, 16 bp, H. sapiens
tcctcctgcctcggcc

SEQ ID NO: 137383 - DNA, 16 bp, H. sapiens
tcctcctgcctctgtt

SEQ ID NO: 137384 - DNA, 16 bp, H. sapiens
tcctcctgcctgagcc

SEQ ID NO: 137385 - DNA, 16 bp, H. sapiens
tcctcctgcctggcct

SEQ ID NO: 137386 - DNA, 16 bp, H. sapiens
tcctcctgccttgcct

SEQ ID NO: 137387 - DNA, 16 bp, H. sapiens
tcctcctgccttggct

SEQ ID NO: 137388 - DNA, 16 bp, H. sapiens
tcctcctgctccagct

SEQ ID NO: 137389 - DNA, 16 bp, H. sapiens
tcctcctgctcccacc

SEQ ID NO: 137390 - DNA, 16 bp, H. sapiens
tcctcctgctccggcc

SEQ ID NO: 137391 - DNA, 18 bp, H. sapiens
tcctcctgctctttgctc

SEQ ID NO: 137392 - DNA, 16 bp, H. sapiens
tcctcctgctgcagcc

SEQ ID NO: 137393 - DNA, 16 bp, H. sapiens
tcctcctgctgcagct

SEQ ID NO: 137394 - DNA, 16 bp, H. sapiens
tcctcctgctgctgct

SEQ ID NO: 137395 - DNA, 16 bp, H. sapiens
tcctcctgcttcagcc

SEQ ID NO: 137396 - DNA, 16 bp, H. sapiens
tcctcctgcttctgct

SEQ ID NO: 137397 - DNA, 16 bp, H. sapiens
tcctcctgcttgggcc

SEQ ID NO: 137398 - DNA, 21 bp, H. sapiens
tcctcctgggttcaagcgatt

SEQ ID NO: 137399 - DNA, 16 bp, H. sapiens
tcctcctgtcttggcc

SEQ ID NO: 137400 - DNA, 16 bp, H. sapiens
tcctcctgtgtagctg

SEQ ID NO: 137401 - DNA, 17 bp, H. sapiens
tcctccttatacctctg

SEQ ID NO: 137402 - DNA, 16 bp, H. sapiens
tcctccttcagcctcc

SEQ ID NO: 137403 - DNA, 16 bp, H. sapiens
tcctccttcctcagct

SEQ ID NO: 137404 - DNA, 16 bp, H. sapiens
tcctccttctcctcag

SEQ ID NO: 137405 - DNA, 16 bp, H. sapiens
tcctccttgatttttt

SEQ ID NO: 137406 - DNA, 16 bp, H. sapiens
tcctccttgtcttcca

SEQ ID NO: 137407 - DNA, 16 bp, H. sapiens
tcctcctttctcagcc

SEQ ID NO: 137408 - DNA, 16 bp, H. sapiens
tcctccttttttaaaa

SEQ ID NO: 137409 - DNA, 16 bp, H. sapiens
tcctcgacctcccaaa

SEQ ID NO: 137410 - DNA, 16 bp, H. sapiens
tcctctaaaatctagg

SEQ ID NO: 137411 - DNA, 30 bp, H. sapiens
tcctctacctacatgtgtctacctgctaat

SEQ ID NO: 137412 - DNA, 16 bp, H. sapiens
tcctctagttctttta

SEQ ID NO: 137413 - DNA, 16 bp, H. sapiens
tcctctcaaagtgctg

SEQ ID NO: 137414 - DNA, 16 bp, H. sapiens
tcctctcacctgagcc

SEQ ID NO: 137415 - DNA, 16 bp, H. sapiens
tcctctcactgcaagc

SEQ ID NO: 137416 - DNA, 16 bp, H. sapiens
tcctctcagctcagcc

SEQ ID NO: 137417 - DNA, 16 bp, H. sapiens
tcctctcatctcagcc

SEQ ID NO: 137418 - DNA, 16 bp, H. sapiens
tcctctccacaggcag

SEQ ID NO: 137419 - DNA, 16 bp, H. sapiens
tcctctccagcacctg

SEQ ID NO: 137420 - DNA, 16 bp, H. sapiens
tcctctccagcccctg

SEQ ID NO: 137421 - DNA, 16 bp, H. sapiens
tcctctccagtacctg

SEQ ID NO: 137422 - DNA, 16 bp, H. sapiens
tcctctcccaagtatt

SEQ ID NO: 137423 - DNA, 16 bp, H. sapiens
tcctctcccacctcag

SEQ ID NO: 137424 - DNA, 16 bp, H. sapiens
tcctctcccagtggag

SEQ ID NO: 137425 - DNA, 16 bp, H. sapiens
tcctctccccactgcc

SEQ ID NO: 137426 - DNA, 16 bp, H. sapiens
tcctctccccagcctc

SEQ ID NO: 137427 - DNA, 16 bp, H. sapiens
tcctctccctcccagg

SEQ ID NO: 137428 - DNA, 16 bp, H. sapiens
tcctctccctctttgg

SEQ ID NO: 137429 - DNA, 16 bp, H. sapiens
tcctctcctgcctggg

SEQ ID NO: 137430 - DNA, 16 bp, H. sapiens
tcctctctccctctgg

SEQ ID NO: 137431 - DNA, 16 bp, H. sapiens
tcctctctcctcagtc

SEQ ID NO: 137432 - DNA, 16 bp, H. sapiens
tcctctctcttcagcc

SEQ ID NO: 137433 - DNA, 16 bp, H. sapiens
tcctctctgccagcag

SEQ ID NO: 137434 - DNA, 16 bp, H. sapiens
tcctctctgctctgcc

SEQ ID NO: 137435 - DNA, 16 bp, H. sapiens
tcctctctgctggctg

SEQ ID NO: 137436 - DNA, 16 bp, H. sapiens
tcctctctggacaggg

SEQ ID NO: 137437 - DNA, 16 bp, H. sapiens
tcctctctggctgccc

SEQ ID NO: 137438 - DNA, 16 bp, H. sapiens
tcctctctgggcagga

SEQ ID NO: 137439 - DNA, 16 bp, H. sapiens
tcctctctgttgaccc

SEQ ID NO: 137440 - DNA, 16 bp, H. sapiens
tcctctcttccagcta

SEQ ID NO: 137441 - DNA, 16 bp, H. sapiens
tcctctgaaaaatggg

SEQ ID NO: 137442 - DNA, 16 bp, H. sapiens
tcctctgaaatctaca

SEQ ID NO: 137443 - DNA, 16 bp, H. sapiens
tcctctgactgtattt

SEQ ID NO: 137444 - DNA, 16 bp, H. sapiens
tcctctgacttcagcc

SEQ ID NO: 137445 - DNA, 16 bp, H. sapiens
tcctctgagctaaaga

SEQ ID NO: 137446 - DNA, 16 bp, H. sapiens
tcctctgaggaggcaa

SEQ ID NO: 137447 - DNA, 16 bp, H. sapiens
tcctctgcccggccgc

SEQ ID NO: 137448 - DNA, 16 bp, H. sapiens
tcctctgcctccctgg

SEQ ID NO: 137449 - DNA, 16 bp, H. sapiens
tcctctgcctcctctg

SEQ ID NO: 137450 - DNA, 16 bp, H. sapiens
tcctctgcctcctgag

SEQ ID NO: 137451 - DNA, 16 bp, H. sapiens
tcctctgcctctgcct

SEQ ID NO: 137452 - DNA, 16 bp, H. sapiens
tcctctgcctgggatg

SEQ ID NO: 137453 - DNA, 16 bp, H. sapiens
tcctctgccttggcct

SEQ ID NO: 137454 - DNA, 16 bp, H. sapiens
tcctctgctctccctg

SEQ ID NO: 137455 - DNA, 16 bp, H. sapiens
tcctctgctcttctgc

SEQ ID NO: 137456 - DNA, 16 bp, H. sapiens
tcctctggcctcagct

SEQ ID NO: 137457 - DNA, 16 bp, H. sapiens
tcctctggcctcggcc

SEQ ID NO: 137458 - DNA, 16 bp, H. sapiens
tcctctgggaagtctt

SEQ ID NO: 137459 - DNA, 16 bp, H. sapiens
tcctctgtaaaacagg

SEQ ID NO: 137460 - DNA, 16 bp, H. sapiens
tcctctgtaaaatggg

SEQ ID NO: 137461 - DNA, 16 bp, H. sapiens
tcctctgtaaagtggg

SEQ ID NO: 137462 - DNA, 16 bp, H. sapiens
tcctctgtcatccagg

SEQ ID NO: 137463 - DNA, 16 bp, H. sapiens
tcctctgtctctgcct

SEQ ID NO: 137464 - DNA, 16 bp, H. sapiens
tcctctgtgctccatc

SEQ ID NO: 137465 - DNA, 16 bp, H. sapiens
tcctctgtgctctgct

SEQ ID NO: 137466 - DNA, 16 bp, H. sapiens
tcctctgtgtgtgtgt

SEQ ID NO: 137467 - DNA, 16 bp, H. sapiens
tcctctgttgtccagg

SEQ ID NO: 137468 - DNA, 16 bp, H. sapiens
tcctctgttttctgaa

SEQ ID NO: 137469 - DNA, 16 bp, H. sapiens
tcctcttcaacacagt

SEQ ID NO: 137470 - DNA, 16 bp, H. sapiens
tcctcttcagcacctg

SEQ ID NO: 137471 - DNA, 16 bp, H. sapiens
tcctcttcagcctccc

SEQ ID NO: 137472 - DNA, 16 bp, H. sapiens
tcctcttcagtaaaat

SEQ ID NO: 137473 - DNA, 16 bp, H. sapiens
tcctcttccaggaagc

SEQ ID NO: 137474 - DNA, 16 bp, H. sapiens
tcctcttcccaggttc

SEQ ID NO: 137475 - DNA, 16 bp, H. sapiens
tcctcttccccagccc

SEQ ID NO: 137476 - DNA, 16 bp, H. sapiens
tcctcttcctcagcct

SEQ ID NO: 137477 - DNA, 16 bp, H. sapiens
tcctcttcctccccag

SEQ ID NO: 137478 - DNA, 16 bp, H. sapiens
tcctcttcctcctcag

SEQ ID NO: 137479 - DNA, 16 bp, H. sapiens
tcctcttcctttaaaa

SEQ ID NO: 137480 - DNA, 16 bp, H. sapiens
tcctcttctacaaaat

SEQ ID NO: 137481 - DNA, 16 bp, H. sapiens
tcctcttctgaaaaat

SEQ ID NO: 137482 - DNA, 16 bp, H. sapiens
tcctcttctgcaggtc

SEQ ID NO: 137483 - DNA, 16 bp, H. sapiens
tcctcttctgtaaagt

SEQ ID NO: 137484 - DNA, 16 bp, H. sapiens
tcctcttgagttttta

SEQ ID NO: 137485 - DNA, 16 bp, H. sapiens
tcctcttgccccccac

SEQ ID NO: 137486 - DNA, 16 bp, H. sapiens
tcctcttgcctcaacc

SEQ ID NO: 137487 - DNA, 17 bp, H. sapiens
tcctcttgccttggcct

SEQ ID NO: 137488 - DNA, 16 bp, H. sapiens
tcctcttgctcctgct

SEQ ID NO: 137489 - DNA, 16 bp, H. sapiens
tcctcttgcttcagcc

SEQ ID NO: 137490 - DNA, 16 bp, H. sapiens
tcctcttggctatgac

SEQ ID NO: 137491 - DNA, 16 bp, H. sapiens
tcctcttggctcagcc

SEQ ID NO: 137492 - DNA, 16 bp, H. sapiens
tcctcttgggttcaag

SEQ ID NO: 137493 - DNA, 16 bp, H. sapiens
tcctctttcttttgta

SEQ ID NO: 137494 - DNA, 16 bp, H. sapiens
tcctctttgaagcaat

SEQ ID NO: 137495 - DNA, 16 bp, H. sapiens
tcctctttgccttcca

SEQ ID NO: 137496 - DNA, 16 bp, H. sapiens
tcctctttgtacctct

SEQ ID NO: 137497 - DNA, 16 bp, H. sapiens
tcctctttgtcatttt

SEQ ID NO: 137498 - DNA, 16 bp, H. sapiens
tcctcttttccatctg

SEQ ID NO: 137499 - DNA, 16 bp, H. sapiens
tcctcttttgtgaaat

SEQ ID NO: 137500 - DNA, 16 bp, H. sapiens
tcctgaaaaagaagaa

SEQ ID NO: 137501 - DNA, 16 bp, H. sapiens
tcctgaaagatatttt

SEQ ID NO: 137502 - DNA, 16 bp, H. sapiens
tcctgaaagcagcaag

SEQ ID NO: 137503 - DNA, 16 bp, H. sapiens
tcctgaaaggaagagt

SEQ ID NO: 137504 - DNA, 16 bp, H. sapiens
tcctgaaaggtattgc

SEQ ID NO: 137505 - DNA, 16 bp, H. sapiens
tcctgaacaaaaagaa

SEQ ID NO: 137506 - DNA, 16 bp, H. sapiens
tcctgaacagctggga

SEQ ID NO: 137507 - DNA, 16 bp, H. sapiens
tcctgaacttttcttt

SEQ ID NO: 137508 - DNA, 16 bp, H. sapiens
tcctgaagaaacagag

SEQ ID NO: 137509 - DNA, 16 bp, H. sapiens
tcctgaagaccttcct

SEQ ID NO: 137510 - DNA, 16 bp, H. sapiens
tcctgaagaccttctt

SEQ ID NO: 137511 - DNA, 16 bp, H. sapiens
tcctgaaggaagccct

SEQ ID NO: 137512 - DNA, 16 bp, H. sapiens
tcctgaagtggtggga

SEQ ID NO: 137513 - DNA, 16 bp, H. sapiens
tcctgaagtgttgaga

SEQ ID NO: 137514 - DNA, 16 bp, H. sapiens
tcctgaataactactg

SEQ ID NO: 137515 - DNA, 17 bp, H. sapiens
tcctgaatacagcacac

SEQ ID NO: 137516 - DNA, 16 bp, H. sapiens
tcctgaatagctagga

SEQ ID NO: 137517 - DNA, 16 bp, H. sapiens
tcctgaatagctgggg

SEQ ID NO: 137518 - DNA, 16 bp, H. sapiens
tcctgaatatgaatgt

SEQ ID NO: 137519 - DNA, 16 bp, H. sapiens
tcctgaatgttttctt

SEQ ID NO: 137520 - DNA, 16 bp, H. sapiens
tcctgaattttctttt

SEQ ID NO: 137521 - DNA, 16 bp, H. sapiens
tcctgaatttttaatg

SEQ ID NO: 137522 - DNA, 16 bp, H. sapiens
tcctgacacacagaaa

SEQ ID NO: 137523 - DNA, 16 bp, H. sapiens
tcctgacaggccctgg

SEQ ID NO: 137524 - DNA, 17 bp, H. sapiens
tcctgacattttaatga

SEQ ID NO: 137525 - DNA, 16 bp, H. sapiens
tcctgaccaccaagga

SEQ ID NO: 137526 - DNA, 16 bp, H. sapiens
tcctgacccacagaaa

SEQ ID NO: 137527 - DNA, 16 bp, H. sapiens
tcctgacccaggtgat

SEQ ID NO: 137528 - DNA, 16 bp, H. sapiens
tcctgaccctcagaaa

SEQ ID NO: 137529 - DNA, 16 bp, H. sapiens
tcctgaccctctccct

SEQ ID NO: 137530 - DNA, 16 bp, H. sapiens
tcctgacctcaaggga

SEQ ID NO: 137531 - DNA, 16 bp, H. sapiens
tcctgacctcaagtca

SEQ ID NO: 137532 - DNA, 38 bp, H. sapiens
tcctgacctcaggtgatccgcctgccttggcctcccaa

SEQ ID NO: 137533 - DNA, 18 bp, H. sapiens
tcctgacctcaggttatc

SEQ ID NO: 137534 - DNA, 17 bp, H. sapiens
tcctgaccttaagtgat

SEQ ID NO: 137535 - DNA, 16 bp, H. sapiens
tcctgaccttgcgatc

SEQ ID NO: 137536 - DNA, 16 bp, H. sapiens
tcctgaccttggatga

SEQ ID NO: 137537 - DNA, 16 bp, H. sapiens
tcctgactcccaggcc

SEQ ID NO: 137538 - DNA, 16 bp, H. sapiens
tcctgactgtcagaag

SEQ ID NO: 137539 - DNA, 16 bp, H. sapiens
tcctgacttcaggcga

SEQ ID NO: 137540 - DNA, 16 bp, H. sapiens
tcctgagaacatgtgc

SEQ ID NO: 137541 - DNA, 16 bp, H. sapiens
tcctgagaccttgctg

SEQ ID NO: 137542 - DNA, 16 bp, H. sapiens
tcctgagactgagtct

SEQ ID NO: 137543 - DNA, 16 bp, H. sapiens
tcctgagacttttctg

SEQ ID NO: 137544 - DNA, 16 bp, H. sapiens
tcctgagagagaagga

SEQ ID NO: 137545 - DNA, 16 bp, H. sapiens
tcctgagatttatttt

SEQ ID NO: 137546 - DNA, 16 bp, H. sapiens
tcctgagcccagcaag

SEQ ID NO: 137547 - DNA, 16 bp, H. sapiens
tcctgagcccaggtga

SEQ ID NO: 137548 - DNA, 16 bp, H. sapiens
tcctgagcctgctgct

SEQ ID NO: 137549 - DNA, 16 bp, H. sapiens
tcctgagctcaagaaa

SEQ ID NO: 137550 - DNA, 16 bp, H. sapiens
tcctgagctcaagtgg

SEQ ID NO: 137551 - DNA, 16 bp, H. sapiens
tcctgagctccagcga

SEQ ID NO: 137552 - DNA, 16 bp, H. sapiens
tcctgagcttaagcga

SEQ ID NO: 137553 - DNA, 16 bp, H. sapiens
tcctgaggaagaaaag

SEQ ID NO: 137554 - DNA, 16 bp, H. sapiens
tcctgaggcctcctag

SEQ ID NO: 137555 - DNA, 16 bp, H. sapiens
tcctgaggcctcctga

SEQ ID NO: 137556 - DNA, 16 bp, H. sapiens
tcctgaggctgtgcag

SEQ ID NO: 137557 - DNA, 16 bp, H. sapiens
tcctgagggctccacc

SEQ ID NO: 137558 - DNA, 16 bp, H. sapiens
tcctgaggtcacacag

SEQ ID NO: 137559 - DNA, 16 bp, H. sapiens
tcctgagtaactggaa

SEQ ID NO: 137560 - DNA, 16 bp, H. sapiens
tcctgagtacctggaa

SEQ ID NO: 137561 - DNA, 16 bp, H. sapiens
tcctgagtacctggga

SEQ ID NO: 137562 - DNA, 16 bp, H. sapiens
tcctgagtagctaggt

SEQ ID NO: 137563 - DNA, 16 bp, H. sapiens
tcctgagtagctgaca

SEQ ID NO: 137564 - DNA, 16 bp, H. sapiens
tcctgagtagctgaga

SEQ ID NO: 137565 - DNA, 17 bp, H. sapiens
tcctgagtagctggcac

SEQ ID NO: 137566 - DNA, 17 bp, H. sapiens
tcctgagtagctgggag

SEQ ID NO: 137567 - DNA, 16 bp, H. sapiens
tcctgagtagctgggc

SEQ ID NO: 137568 - DNA, 16 bp, H. sapiens
tcctgagtagctggtg

SEQ ID NO: 137569 - DNA, 16 bp, H. sapiens
tcctgagtctgtgtca

SEQ ID NO: 137570 - DNA, 16 bp, H. sapiens
tcctgagtgcctggga

SEQ ID NO: 137571 - DNA, 17 bp, H. sapiens
tcctgagttcaagtgat

SEQ ID NO: 137572 - DNA, 16 bp, H. sapiens
tcctgagttcaggtga

SEQ ID NO: 137573 - DNA, 16 bp, H. sapiens
tcctgagttctgattt

SEQ ID NO: 137574 - DNA, 16 bp, H. sapiens
tcctgagttcttgtcc

SEQ ID NO: 137575 - DNA, 16 bp, H. sapiens
tcctgagtttcttcac

SEQ ID NO: 137576 - DNA, 16 bp, H. sapiens
tcctgataccaaaagc

SEQ ID NO: 137577 - DNA, 16 bp, H. sapiens
tcctgataccatcacc

SEQ ID NO: 137578 - DNA, 16 bp, H. sapiens
tcctgatccacctgcc

SEQ ID NO: 137579 - DNA, 16 bp, H. sapiens
tcctgatcctctcctt

SEQ ID NO: 137580 - DNA, 16 bp, H. sapiens
tcctgatcttagaaga

SEQ ID NO: 137581 - DNA, 16 bp, H. sapiens
tcctgatgcaagtcct

SEQ ID NO: 137582 - DNA, 16 bp, H. sapiens
tcctgatgctctccct

SEQ ID NO: 137583 - DNA, 16 bp, H. sapiens
tcctgatgtcatgatc

SEQ ID NO: 137584 - DNA, 16 bp, H. sapiens
tcctgattctcctgcc

SEQ ID NO: 137585 - DNA, 16 bp, H. sapiens
tcctgattctctccct

SEQ ID NO: 137586 - DNA, 16 bp, H. sapiens
tcctgatttaaaaaaa

SEQ ID NO: 137587 - DNA, 16 bp, H. sapiens
tcctgatttctcagaa

SEQ ID NO: 137588 - DNA, 16 bp, H. sapiens
tcctgattttcctcct

SEQ ID NO: 137589 - DNA, 16 bp, H. sapiens
tcctgattttcctttt

SEQ ID NO: 137590 - DNA, 16 bp, H. sapiens
tcctgcaaaggacagg

SEQ ID NO: 137591 - DNA, 16 bp, H. sapiens
tcctgcaactcaacaa

SEQ ID NO: 137592 - DNA, 16 bp, H. sapiens
tcctgcaagctccact

SEQ ID NO: 137593 - DNA, 19 bp, H. sapiens
tcctgcacagccctagatc

SEQ ID NO: 137594 - DNA, 16 bp, H. sapiens
tcctgcacctggaggt

SEQ ID NO: 137595 - DNA, 16 bp, H. sapiens
tcctgcagagagagag

SEQ ID NO: 137596 - DNA, 16 bp, H. sapiens
tcctgcagagagaggg

SEQ ID NO: 137597 - DNA, 16 bp, H. sapiens
tcctgcagataacatc

SEQ ID NO: 137598 - DNA, 16 bp, H. sapiens
tcctgcagcctcaacc

SEQ ID NO: 137599 - DNA, 16 bp, H. sapiens
tcctgcagctgcaggc

SEQ ID NO: 137600 - DNA, 16 bp, H. sapiens
tcctgcaggagcagtc

SEQ ID NO: 137601 - DNA, 16 bp, H. sapiens
tcctgcatcaacctcc

SEQ ID NO: 137602 - DNA, 16 bp, H. sapiens
tcctgcatttttattt

SEQ ID NO: 137603 - DNA, 16 bp, H. sapiens
tcctgccaacaccttg

SEQ ID NO: 137604 - DNA, 16 bp, H. sapiens
tcctgccacagcctcc

SEQ ID NO: 137605 - DNA, 16 bp, H. sapiens
tcctgccacagcttcc

SEQ ID NO: 137606 - DNA, 16 bp, H. sapiens
tcctgccacatcctcc

SEQ ID NO: 137607 - DNA, 16 bp, H. sapiens
tcctgccaccacgccc

SEQ ID NO: 137608 - DNA, 16 bp, H. sapiens
tcctgccaccctgcct

SEQ ID NO: 137609 - DNA, 16 bp, H. sapiens
tcctgccacctcctcc

SEQ ID NO: 137610 - DNA, 16 bp, H. sapiens
tcctgccactgccctc

SEQ ID NO: 137611 - DNA, 16 bp, H. sapiens
tcctgccagcaaagat

SEQ ID NO: 137612 - DNA, 16 bp, H. sapiens
tcctgccaggaggtgg

SEQ ID NO: 137613 - DNA, 16 bp, H. sapiens
tcctgccatggcctcc

SEQ ID NO: 137614 - DNA, 16 bp, H. sapiens
tcctgccattctcctg

SEQ ID NO: 137615 - DNA, 16 bp, H. sapiens
tcctgcccagcccacc

SEQ ID NO: 137616 - DNA, 16 bp, H. sapiens
tcctgcccagcctcct

SEQ ID NO: 137617 - DNA, 16 bp, H. sapiens
tcctgcccaggctggt

SEQ ID NO: 137618 - DNA, 16 bp, H. sapiens
tcctgcccatgctgcc

SEQ ID NO: 137619 - DNA, 16 bp, H. sapiens
tcctgccccagccacc

SEQ ID NO: 137620 - DNA, 16 bp, H. sapiens
tcctgccccagcccag

SEQ ID NO: 137621 - DNA, 16 bp, H. sapiens
tcctgccccagcccct

SEQ ID NO: 137622 - DNA, 16 bp, H. sapiens
tcctgccccagcctca

SEQ ID NO: 137623 - DNA, 16 bp, H. sapiens
tcctgccccagcctcc

SEQ ID NO: 137624 - DNA, 16 bp, H. sapiens
tcctgccccagcctct

SEQ ID NO: 137625 - DNA, 16 bp, H. sapiens
tcctgccccaggcctg

SEQ ID NO: 137626 - DNA, 16 bp, H. sapiens
tcctgccccaggctcc

SEQ ID NO: 137627 - DNA, 16 bp, H. sapiens
tcctgcccccactgtc

SEQ ID NO: 137628 - DNA, 16 bp, H. sapiens
tcctgcccctgccctg

SEQ ID NO: 137629 - DNA, 16 bp, H. sapiens
tcctgccctcagcctc

SEQ ID NO: 137630 - DNA, 16 bp, H. sapiens
tcctgccctcctggag

SEQ ID NO: 137631 - DNA, 16 bp, H. sapiens
tcctgccctcctgtct

SEQ ID NO: 137632 - DNA, 16 bp, H. sapiens
tcctgccctcgaacat

SEQ ID NO: 137633 - DNA, 16 bp, H. sapiens
tcctgccctctaacat

SEQ ID NO: 137634 - DNA, 16 bp, H. sapiens
tcctgccctgcagcct

SEQ ID NO: 137635 - DNA, 16 bp, H. sapiens
tcctgccctgccaact

SEQ ID NO: 137636 - DNA, 16 bp, H. sapiens
tcctgccctgccccca

SEQ ID NO: 137637 - DNA, 16 bp, H. sapiens
tcctgcccttccagat

SEQ ID NO: 137638 - DNA, 16 bp, H. sapiens
tcctgcccttctgcct

SEQ ID NO: 137639 - DNA, 16 bp, H. sapiens
tcctgccgcagcctcc

SEQ ID NO: 137640 - DNA, 16 bp, H. sapiens
tcctgccgcctcagcc

SEQ ID NO: 137641 - DNA, 16 bp, H. sapiens
tcctgccgccttgggc

SEQ ID NO: 137642 - DNA, 16 bp, H. sapiens
tcctgcctaagcttcc

SEQ ID NO: 137643 - DNA, 16 bp, H. sapiens
tcctgcctcaacctgc

SEQ ID NO: 137644 - DNA, 16 bp, H. sapiens
tcctgcctcaagtgat

SEQ ID NO: 137645 - DNA, 17 bp, H. sapiens
tcctgcctcaccctcct

SEQ ID NO: 137646 - DNA, 16 bp, H. sapiens
tcctgcctcaccttcc

SEQ ID NO: 137647 - DNA, 16 bp, H. sapiens
tcctgcctcagactct

SEQ ID NO: 137648 - DNA, 16 bp, H. sapiens
tcctgcctcagagcct

SEQ ID NO: 137649 - DNA, 16 bp, H. sapiens
tcctgcctcagccagg

SEQ ID NO: 137650 - DNA, 22 bp, H. sapiens
tcctgcctcagcctcccaaata

SEQ ID NO: 137651 - DNA, 19 bp, H. sapiens
tcctgcctcagcctcccac

SEQ ID NO: 137652 - DNA, 16 bp, H. sapiens
tcctgcctcagctccc

SEQ ID NO: 137653 - DNA, 16 bp, H. sapiens
tcctgcctcagctgcc

SEQ ID NO: 137654 - DNA, 16 bp, H. sapiens
tcctgcctcagcttac

SEQ ID NO: 137655 - DNA, 16 bp, H. sapiens
tcctgcctcagcttct

SEQ ID NO: 137656 - DNA, 16 bp, H. sapiens
tcctgcctcaggcttc

SEQ ID NO: 137657 - DNA, 16 bp, H. sapiens
tcctgcctcagtctgc

SEQ ID NO: 137658 - DNA, 16 bp, H. sapiens
tcctgcctcagtgcct

SEQ ID NO: 137659 - DNA, 16 bp, H. sapiens
tcctgcctcattctcc

SEQ ID NO: 137660 - DNA, 16 bp, H. sapiens
tcctgcctccacctcc

SEQ ID NO: 137661 - DNA, 16 bp, H. sapiens
tcctgcctccacctct

SEQ ID NO: 137662 - DNA, 16 bp, H. sapiens
tcctgcctcctcccag

SEQ ID NO: 137663 - DNA, 16 bp, H. sapiens
tcctgcctcctcccca

SEQ ID NO: 137664 - DNA, 16 bp, H. sapiens
tcctgcctcggcctcc

SEQ ID NO: 137665 - DNA, 16 bp, H. sapiens
tcctgcctcggcctct

SEQ ID NO: 137666 - DNA, 16 bp, H. sapiens
tcctgcctcggcttcc

SEQ ID NO: 137667 - DNA, 16 bp, H. sapiens
tcctgcctctcccagc

SEQ ID NO: 137668 - DNA, 16 bp, H. sapiens
tcctgcctctgagcct

SEQ ID NO: 137669 - DNA, 16 bp, H. sapiens
tcctgcctctgccaca

SEQ ID NO: 137670 - DNA, 16 bp, H. sapiens
tcctgcctctgccttt

SEQ ID NO: 137671 - DNA, 16 bp, H. sapiens
tcctgcctctgcttct

SEQ ID NO: 137672 - DNA, 16 bp, H. sapiens
tcctgcctctgggcct

SEQ ID NO: 137673 - DNA, 16 bp, H. sapiens
tcctgcctctgtgcct

SEQ ID NO: 137674 - DNA, 16 bp, H. sapiens
tcctgcctgagcctct

SEQ ID NO: 137675 - DNA, 16 bp, H. sapiens
tcctgcctgcccctgg

SEQ ID NO: 137676 - DNA, 16 bp, H. sapiens
tcctgcctgccttggc

SEQ ID NO: 137677 - DNA, 16 bp, H. sapiens
tcctgcctgctcctgg

SEQ ID NO: 137678 - DNA, 16 bp, H. sapiens
tcctgcctgctggctc

SEQ ID NO: 137679 - DNA, 16 bp, H. sapiens
tcctgcctggcccctg

SEQ ID NO: 137680 - DNA, 16 bp, H. sapiens
tcctgcctggcgacag

SEQ ID NO: 137681 - DNA, 16 bp, H. sapiens
tcctgcctgggcctcc

SEQ ID NO: 137682 - DNA, 16 bp, H. sapiens
tcctgcctgggggaca

SEQ ID NO: 137683 - DNA, 16 bp, H. sapiens
tcctgcctgggtcctg

SEQ ID NO: 137684 - DNA, 16 bp, H. sapiens
tcctgcctgggtggca

SEQ ID NO: 137685 - DNA, 16 bp, H. sapiens
tcctgcctgtctcctg

SEQ ID NO: 137686 - DNA, 17 bp, H. sapiens
tcctgccttagcctcct

SEQ ID NO: 137687 - DNA, 16 bp, H. sapiens
tcctgccttaggctcc

SEQ ID NO: 137688 - DNA, 16 bp, H. sapiens
tcctgccttcctgcct

SEQ ID NO: 137689 - DNA, 21 bp, H. sapiens
tcctgccttggcctcccaaag

SEQ ID NO: 137690 - DNA, 22 bp, H. sapiens
tcctgccttggcctcccaaagt

SEQ ID NO: 137691 - DNA, 16 bp, H. sapiens
tcctgccttttaaaaa

SEQ ID NO: 137692 - DNA, 16 bp, H. sapiens
tcctgcgagaagtagc

SEQ ID NO: 137693 - DNA, 16 bp, H. sapiens
tcctgcgcccactgtc

SEQ ID NO: 137694 - DNA, 16 bp, H. sapiens
tcctgcgtcagcctcc

SEQ ID NO: 137695 - DNA, 16 bp, H. sapiens
tcctgctaatttttgt

SEQ ID NO: 137696 - DNA, 16 bp, H. sapiens
tcctgctcagcctcct

SEQ ID NO: 137697 - DNA, 16 bp, H. sapiens
tcctgctctatggtct

SEQ ID NO: 137698 - DNA, 16 bp, H. sapiens
tcctgctctgccttct

SEQ ID NO: 137699 - DNA, 16 bp, H. sapiens
tcctgctctggctgtg

SEQ ID NO: 137700 - DNA, 16 bp, H. sapiens
tcctgctctgtcccct

SEQ ID NO: 137701 - DNA, 16 bp, H. sapiens
tcctgctctgtcctgc

SEQ ID NO: 137702 - DNA, 16 bp, H. sapiens
tcctgctgccactgcc

SEQ ID NO: 137703 - DNA, 16 bp, H. sapiens
tcctgctgcctctgcc

SEQ ID NO: 137704 - DNA, 16 bp, H. sapiens
tcctgctgcctgcagc

SEQ ID NO: 137705 - DNA, 16 bp, H. sapiens
tcctgctgctataaca

SEQ ID NO: 137706 - DNA, 16 bp, H. sapiens
tcctgctgctcactgc

SEQ ID NO: 137707 - DNA, 16 bp, H. sapiens
tcctgctgctgcccag

SEQ ID NO: 137708 - DNA, 16 bp, H. sapiens
tcctgctgctgctcac

SEQ ID NO: 137709 - DNA, 16 bp, H. sapiens
tcctgctgctgcttct

SEQ ID NO: 137710 - DNA, 16 bp, H. sapiens
tcctgctgcttcctct

SEQ ID NO: 137711 - DNA, 16 bp, H. sapiens
tcctgctggattttgg

SEQ ID NO: 137712 - DNA, 16 bp, H. sapiens
tcctgctggcatcagg

SEQ ID NO: 137713 - DNA, 16 bp, H. sapiens
tcctgctgtgcagccc

SEQ ID NO: 137714 - DNA, 16 bp, H. sapiens
tcctgctgtgctctca

SEQ ID NO: 137715 - DNA, 16 bp, H. sapiens
tcctgctgtgtgacct

SEQ ID NO: 137716 - DNA, 16 bp, H. sapiens
tcctgctgtgtgcagc

SEQ ID NO: 137717 - DNA, 16 bp, H. sapiens
tcctgctgtgtgccag

SEQ ID NO: 137718 - DNA, 16 bp, H. sapiens
tcctgcttaaaaccct

SEQ ID NO: 137719 - DNA, 16 bp, H. sapiens
tcctgcttcaacctcc

SEQ ID NO: 137720 - DNA, 16 bp, H. sapiens
tcctgcttcaccttcc

SEQ ID NO: 137721 - DNA, 16 bp, H. sapiens
tcctgcttcagcttcc

SEQ ID NO: 137722 - DNA, 16 bp, H. sapiens
tcctgcttcaggctcc

SEQ ID NO: 137723 - DNA, 16 bp, H. sapiens
tcctgcttcctctgcc

SEQ ID NO: 137724 - DNA, 16 bp, H. sapiens
tcctgcttccttcact

SEQ ID NO: 137725 - DNA, 16 bp, H. sapiens
tcctgcttctgccatg

SEQ ID NO: 137726 - DNA, 16 bp, H. sapiens
tcctgcttctgctgct

SEQ ID NO: 137727 - DNA, 16 bp, H. sapiens
tcctgcttggtgttct

SEQ ID NO: 137728 - DNA, 16 bp, H. sapiens
tcctgcttgtccctgg

SEQ ID NO: 137729 - DNA, 16 bp, H. sapiens
tcctgctttcatttct

SEQ ID NO: 137730 - DNA, 16 bp, H. sapiens
tcctgctttcctgcct

SEQ ID NO: 137731 - DNA, 16 bp, H. sapiens
tcctgctttggcctcc

SEQ ID NO: 137732 - DNA, 16 bp, H. sapiens
tcctggaaccaatccc

SEQ ID NO: 137733 - DNA, 16 bp, H. sapiens
tcctggaactaatccc

SEQ ID NO: 137734 - DNA, 16 bp, H. sapiens
tcctggaactgaaaaa

SEQ ID NO: 137735 - DNA, 27 bp, H. sapiens
tcctggacacatacactctcccaagac

SEQ ID NO: 137736 - DNA, 16 bp, H. sapiens
tcctggacatgtacac

SEQ ID NO: 137737 - DNA, 16 bp, H. sapiens
tcctggacattttgaa

SEQ ID NO: 137738 - DNA, 16 bp, H. sapiens
tcctggactctagcaa

SEQ ID NO: 137739 - DNA, 16 bp, H. sapiens
tcctggacttcttttt

SEQ ID NO: 137740 - DNA, 16 bp, H. sapiens
tcctggacttttttgg

SEQ ID NO: 137741 - DNA, 16 bp, H. sapiens
tcctggagaaacagaa

SEQ ID NO: 137742 - DNA, 16 bp, H. sapiens
tcctggagaaacagag

SEQ ID NO: 137743 - DNA, 16 bp, H. sapiens
tcctggagaaacagat

SEQ ID NO: 137744 - DNA, 16 bp, H. sapiens
tcctggagaatgtttt

SEQ ID NO: 137745 - DNA, 16 bp, H. sapiens
tcctggagaggatgtg

SEQ ID NO: 137746 - DNA, 16 bp, H. sapiens
tcctggagagtttccc

SEQ ID NO: 137747 - DNA, 16 bp, H. sapiens
tcctggagattctggt

SEQ ID NO: 137748 - DNA, 16 bp, H. sapiens
tcctggagcccaggag

SEQ ID NO: 137749 - DNA, 16 bp, H. sapiens
tcctggagctgtgagc

SEQ ID NO: 137750 - DNA, 16 bp, H. sapiens
tcctggaggaagtggc

SEQ ID NO: 137751 - DNA, 16 bp, H. sapiens
tcctggaggaggtgat

SEQ ID NO: 137752 - DNA, 16 bp, H. sapiens
tcctggaggaggtggc

SEQ ID NO: 137753 - DNA, 16 bp, H. sapiens
tcctggaggaggtggg

SEQ ID NO: 137754 - DNA, 16 bp, H. sapiens
tcctggaggctgagaa

SEQ ID NO: 137755 - DNA, 16 bp, H. sapiens
tcctggaggctggaag

SEQ ID NO: 137756 - DNA, 16 bp, H. sapiens
tcctggagggtggcat

SEQ ID NO: 137757 - DNA, 16 bp, H. sapiens
tcctggaggtaaaact

SEQ ID NO: 137758 - DNA, 16 bp, H. sapiens
tcctggagtcccagct

SEQ ID NO: 137759 - DNA, 16 bp, H. sapiens
tcctggatctgccact

SEQ ID NO: 137760 - DNA, 16 bp, H. sapiens
tcctggatgacatttc

SEQ ID NO: 137761 - DNA, 16 bp, H. sapiens
tcctggatgcttcctg

SEQ ID NO: 137762 - DNA, 16 bp, H. sapiens
tcctggatgggatcct

SEQ ID NO: 137763 - DNA, 16 bp, H. sapiens
tcctggattccagtga

SEQ ID NO: 137764 - DNA, 16 bp, H. sapiens
tcctggcaccttggga

SEQ ID NO: 137765 - DNA, 16 bp, H. sapiens
tcctggcactctggga

SEQ ID NO: 137766 - DNA, 16 bp, H. sapiens
tcctggcactgtggga

SEQ ID NO: 137767 - DNA, 16 bp, H. sapiens
tcctggcaggaggcca

SEQ ID NO: 137768 - DNA, 16 bp, H. sapiens
tcctggccaacgtggc

SEQ ID NO: 137769 - DNA, 19 bp, H. sapiens
tcctggccaacgtggtgaa

SEQ ID NO: 137770 - DNA, 16 bp, H. sapiens
tcctggccacaagcaa

SEQ ID NO: 137771 - DNA, 16 bp, H. sapiens
tcctggccagaacttg

SEQ ID NO: 137772 - DNA, 16 bp, H. sapiens
tcctggccaggcacag

SEQ ID NO: 137773 - DNA, 16 bp, H. sapiens
tcctggccaggcgcag

SEQ ID NO: 137774 - DNA, 16 bp, H. sapiens
tcctggcccccagccc

SEQ ID NO: 137775 - DNA, 16 bp, H. sapiens
tcctggccctgccact

SEQ ID NO: 137776 - DNA, 16 bp, H. sapiens
tcctggccctgcccct

SEQ ID NO: 137777 - DNA, 16 bp, H. sapiens
tcctggccctgtcctc

SEQ ID NO: 137778 - DNA, 16 bp, H. sapiens
tcctggcctcaaagaa

SEQ ID NO: 137779 - DNA, 16 bp, H. sapiens
tcctggcctcaagcaa

SEQ ID NO: 137780 - DNA, 16 bp, H. sapiens
tcctggcctcaagcga

SEQ ID NO: 137781 - DNA, 16 bp, H. sapiens
tcctggcctccagcca

SEQ ID NO: 137782 - DNA, 16 bp, H. sapiens
tcctggcctcccaaag

SEQ ID NO: 137783 - DNA, 16 bp, H. sapiens
tcctggcctcctgtga

SEQ ID NO: 137784 - DNA, 16 bp, H. sapiens
tcctggcctgtaaaat

SEQ ID NO: 137785 - DNA, 16 bp, H. sapiens
tcctggctaaaacagt

SEQ ID NO: 137786 - DNA, 16 bp, H. sapiens
tcctggctcaaaaatc

SEQ ID NO: 137787 - DNA, 16 bp, H. sapiens
tcctggctcaagtgat

SEQ ID NO: 137788 - DNA, 16 bp, H. sapiens
tcctggctcagcctcc

SEQ ID NO: 137789 - DNA, 23 bp, H. sapiens
tcctggctcatcctggctcaaaa

SEQ ID NO: 137790 - DNA, 16 bp, H. sapiens
tcctggctccaccact

SEQ ID NO: 137791 - DNA, 16 bp, H. sapiens
tcctggctctgccact

SEQ ID NO: 137792 - DNA, 16 bp, H. sapiens
tcctggctctgccatt

SEQ ID NO: 137793 - DNA, 16 bp, H. sapiens
tcctggctctgcctct

SEQ ID NO: 137794 - DNA, 16 bp, H. sapiens
tcctggctctgctact

SEQ ID NO: 137795 - DNA, 16 bp, H. sapiens
tcctggctctgctgct

SEQ ID NO: 137796 - DNA, 16 bp, H. sapiens
tcctggctgacagcca

SEQ ID NO: 137797 - DNA, 16 bp, H. sapiens
tcctggctgctcagga

SEQ ID NO: 137798 - DNA, 16 bp, H. sapiens
tcctggctggaggcca

SEQ ID NO: 137799 - DNA, 16 bp, H. sapiens
tcctggctgggctcag

SEQ ID NO: 137800 - DNA, 16 bp, H. sapiens
tcctggctgtgccact

SEQ ID NO: 137801 - DNA, 16 bp, H. sapiens
tcctggctgtgtgacc

SEQ ID NO: 137802 - DNA, 16 bp, H. sapiens
tcctggctgttttcat

SEQ ID NO: 137803 - DNA, 16 bp, H. sapiens
tcctggcttatttcac

SEQ ID NO: 137804 - DNA, 16 bp, H. sapiens
tcctggcttctctctc

SEQ ID NO: 137805 - DNA, 16 bp, H. sapiens
tcctgggaaaactgga

SEQ ID NO: 137806 - DNA, 16 bp, H. sapiens
tcctgggaataacatc

SEQ ID NO: 137807 - DNA, 16 bp, H. sapiens
tcctgggactttgctg

SEQ ID NO: 137808 - DNA, 16 bp, H. sapiens
tcctgggagataacct

SEQ ID NO: 137809 - DNA, 16 bp, H. sapiens
tcctgggagccaagag

SEQ ID NO: 137810 - DNA, 16 bp, H. sapiens
tcctgggaggctgagg

SEQ ID NO: 137811 - DNA, 16 bp, H. sapiens
tcctgggataaatctc

SEQ ID NO: 137812 - DNA, 17 bp, H. sapiens
tcctgggatcaagcaat

SEQ ID NO: 137813 - DNA, 16 bp, H. sapiens
tcctgggatccagtga

SEQ ID NO: 137814 - DNA, 16 bp, H. sapiens
tcctgggattacaggc

SEQ ID NO: 137815 - DNA, 22 bp, H. sapiens
tcctgggcaacagagtgagacc

SEQ ID NO: 137816 - DNA, 16 bp, H. sapiens
tcctgggcacaagcca

SEQ ID NO: 137817 - DNA, 16 bp, H. sapiens
tcctgggcacagctgc

SEQ ID NO: 137818 - DNA, 16 bp, H. sapiens
tcctgggcactgcagg

SEQ ID NO: 137819 - DNA, 16 bp, H. sapiens
tcctgggcatggttgg

SEQ ID NO: 137820 - DNA, 16 bp, H. sapiens
tcctgggcatttatcc

SEQ ID NO: 137821 - DNA, 16 bp, H. sapiens
tcctgggccaaatgca

SEQ ID NO: 137822 - DNA, 16 bp, H. sapiens
tcctgggcccaagtgg

SEQ ID NO: 137823 - DNA, 16 bp, H. sapiens
tcctgggcctcagcct

SEQ ID NO: 137824 - DNA, 16 bp, H. sapiens
tcctgggcctccagct

SEQ ID NO: 137825 - DNA, 17 bp, H. sapiens
tcctgggctcaagcgac

SEQ ID NO: 137826 - DNA, 16 bp, H. sapiens
tcctgggctcacacaa

SEQ ID NO: 137827 - DNA, 16 bp, H. sapiens
tcctgggctcaggaga

SEQ ID NO: 137828 - DNA, 16 bp, H. sapiens
tcctgggctcaggtaa

SEQ ID NO: 137829 - DNA, 16 bp, H. sapiens
tcctgggctccagcag

SEQ ID NO: 137830 - DNA, 16 bp, H. sapiens
tcctgggctccaggga

SEQ ID NO: 137831 - DNA, 16 bp, H. sapiens
tcctgggctcctcctg

SEQ ID NO: 137832 - DNA, 16 bp, H. sapiens
tcctgggctggcctgg

SEQ ID NO: 137833 - DNA, 16 bp, H. sapiens
tcctgggcttcagtga

SEQ ID NO: 137834 - DNA, 16 bp, H. sapiens
tcctgggcttgggtga

SEQ ID NO: 137835 - DNA, 16 bp, H. sapiens
tcctggggctcaggtg

SEQ ID NO: 137836 - DNA, 16 bp, H. sapiens
tcctgggggctccagg

SEQ ID NO: 137837 - DNA, 16 bp, H. sapiens
tcctggggttccatga

SEQ ID NO: 137838 - DNA, 16 bp, H. sapiens
tcctgggtagctgtga

SEQ ID NO: 137839 - DNA, 16 bp, H. sapiens
tcctgggtcctgcagg

SEQ ID NO: 137840 - DNA, 16 bp, H. sapiens
tcctgggtctccagtt

SEQ ID NO: 137841 - DNA, 16 bp, H. sapiens
tcctgggtgacaaagt

SEQ ID NO: 137842 - DNA, 16 bp, H. sapiens
tcctgggtgatgctga

SEQ ID NO: 137843 - DNA, 16 bp, H. sapiens
tcctgggttcaagaca

SEQ ID NO: 137844 - DNA, 17 bp, H. sapiens
tcctgggttcaagcgag

SEQ ID NO: 137845 - DNA, 16 bp, H. sapiens
tcctgggttccaatga

SEQ ID NO: 137846 - DNA, 17 bp, H. sapiens
tcctgggttccagtgat

SEQ ID NO: 137847 - DNA, 16 bp, H. sapiens
tcctgggtttgagtga

SEQ ID NO: 137848 - DNA, 16 bp, H. sapiens
tcctggtcacacacag

SEQ ID NO: 137849 - DNA, 16 bp, H. sapiens
tcctggtgctatcccc

SEQ ID NO: 137850 - DNA, 16 bp, H. sapiens
tcctggtgctctccct

SEQ ID NO: 137851 - DNA, 16 bp, H. sapiens
tcctggttcaagcagt

SEQ ID NO: 137852 - DNA, 16 bp, H. sapiens
tcctggttcaagtgat

SEQ ID NO: 137853 - DNA, 16 bp, H. sapiens
tcctggttcagcctcc

SEQ ID NO: 137854 - DNA, 16 bp, H. sapiens
tcctggttcatagaca

SEQ ID NO: 137855 - DNA, 16 bp, H. sapiens
tcctggttctaccact

SEQ ID NO: 137856 - DNA, 16 bp, H. sapiens
tcctggttgtgatatt

SEQ ID NO: 137857 - DNA, 17 bp, H. sapiens
tcctggtttcaagtgat

SEQ ID NO: 137858 - DNA, 16 bp, H. sapiens
tcctgtaacttttttt

SEQ ID NO: 137859 - DNA, 16 bp, H. sapiens
tcctgtactatgttga

SEQ ID NO: 137860 - DNA, 16 bp, H. sapiens
tcctgtagtccaagct

SEQ ID NO: 137861 - DNA, 16 bp, H. sapiens
tcctgtatactttaaa

SEQ ID NO: 137862 - DNA, 16 bp, H. sapiens
tcctgtcactcaggta

SEQ ID NO: 137863 - DNA, 16 bp, H. sapiens
tcctgtcagatcagct

SEQ ID NO: 137864 - DNA, 16 bp, H. sapiens
tcctgtcagcctccca

SEQ ID NO: 137865 - DNA, 16 bp, H. sapiens
tcctgtcccagacaac

SEQ ID NO: 137866 - DNA, 16 bp, H. sapiens
tcctgtcccagggcca

SEQ ID NO: 137867 - DNA, 16 bp, H. sapiens
tcctgtccccagcccc

SEQ ID NO: 137868 - DNA, 16 bp, H. sapiens
tcctgtccctccccca

SEQ ID NO: 137869 - DNA, 16 bp, H. sapiens
tcctgtcctcttctga

SEQ ID NO: 137870 - DNA, 16 bp, H. sapiens
tcctgtctcagccttc

SEQ ID NO: 137871 - DNA, 16 bp, H. sapiens
tcctgtctcagtctcc

SEQ ID NO: 137872 - DNA, 16 bp, H. sapiens
tcctgtctccttgctg

SEQ ID NO: 137873 - DNA, 16 bp, H. sapiens
tcctgtctcctttgcc

SEQ ID NO: 137874 - DNA, 19 bp, H. sapiens
tcctgtctctacaaaaaat

SEQ ID NO: 137875 - DNA, 18 bp, H. sapiens
tcctgtctctacaaaaat

SEQ ID NO: 137876 - DNA, 16 bp, H. sapiens
tcctgtctctctgtct

SEQ ID NO: 137877 - DNA, 16 bp, H. sapiens
tcctgtcttagcctcc

SEQ ID NO: 137878 - DNA, 16 bp, H. sapiens
tcctgtcttgaaaaaa

SEQ ID NO: 137879 - DNA, 16 bp, H. sapiens
tcctgtgaatctataa

SEQ ID NO: 137880 - DNA, 16 bp, H. sapiens
tcctgtgattatgatg

SEQ ID NO: 137881 - DNA, 16 bp, H. sapiens
tcctgtgcactgcagg

SEQ ID NO: 137882 - DNA, 16 bp, H. sapiens
tcctgtgcagaagctc

SEQ ID NO: 137883 - DNA, 16 bp, H. sapiens
tcctgtgccaattctt

SEQ ID NO: 137884 - DNA, 16 bp, H. sapiens
tcctgtgcctggctca

SEQ ID NO: 137885 - DNA, 16 bp, H. sapiens
tcctgtgctggatgct

SEQ ID NO: 137886 - DNA, 16 bp, H. sapiens
tcctgtggccccaccc

SEQ ID NO: 137887 - DNA, 16 bp, H. sapiens
tcctgtggcccccacc

SEQ ID NO: 137888 - DNA, 16 bp, H. sapiens
tcctgtggtcccagct

SEQ ID NO: 137889 - DNA, 16 bp, H. sapiens
tcctgtgttcacgcca

SEQ ID NO: 137890 - DNA, 16 bp, H. sapiens
tcctgtgtttgctgag

SEQ ID NO: 137891 - DNA, 16 bp, H. sapiens
tcctgtgtttgtaatt

SEQ ID NO: 137892 - DNA, 16 bp, H. sapiens
tcctgttaatattgat

SEQ ID NO: 137893 - DNA, 16 bp, H. sapiens
tcctgttaccaaaacc

SEQ ID NO: 137894 - DNA, 16 bp, H. sapiens
tcctgttcaagttaaa

SEQ ID NO: 137895 - DNA, 16 bp, H. sapiens
tcctgttccaaaaggg

SEQ ID NO: 137896 - DNA, 16 bp, H. sapiens
tcctgttcctcctcac

SEQ ID NO: 137897 - DNA, 16 bp, H. sapiens
tcctgttggtttgagc

SEQ ID NO: 137898 - DNA, 16 bp, H. sapiens
tcctgtttctaaaaaa

SEQ ID NO: 137899 - DNA, 16 bp, H. sapiens
tcctgtttgcttttgg

SEQ ID NO: 137900 - DNA, 16 bp, H. sapiens
tcctgttttatggctg

SEQ ID NO: 137901 - DNA, 16 bp, H. sapiens
tcctgttttcctaatt

SEQ ID NO: 137902 - DNA, 16 bp, H. sapiens
tcctgttttctctgtg

SEQ ID NO: 137903 - DNA, 16 bp, H. sapiens
tccttaaaaaacacaa

SEQ ID NO: 137904 - DNA, 16 bp, H. sapiens
tccttaaaggaaaaaa

SEQ ID NO: 137905 - DNA, 16 bp, H. sapiens
tccttaaatatatata

SEQ ID NO: 137906 - DNA, 16 bp, H. sapiens
tccttaaatatgtttt

SEQ ID NO: 137907 - DNA, 16 bp, H. sapiens
tccttaaattgggctt

SEQ ID NO: 137908 - DNA, 16 bp, H. sapiens
tccttaaattttgtgc

SEQ ID NO: 137909 - DNA, 16 bp, H. sapiens
tccttaacaatttttt

SEQ ID NO: 137910 - DNA, 16 bp, H. sapiens
tccttaacttatgaag

SEQ ID NO: 137911 - DNA, 16 bp, H. sapiens
tccttaagctgataaa

SEQ ID NO: 137912 - DNA, 16 bp, H. sapiens
tccttaagggcaggga

SEQ ID NO: 137913 - DNA, 16 bp, H. sapiens
tccttaataaaatact

SEQ ID NO: 137914 - DNA, 16 bp, H. sapiens
tccttacatggccttt

SEQ ID NO: 137915 - DNA, 16 bp, H. sapiens
tccttagaaatttctt

SEQ ID NO: 137916 - DNA, 16 bp, H. sapiens
tccttataaaagggac

SEQ ID NO: 137917 - DNA, 16 bp, H. sapiens
tccttatctataaaaa

SEQ ID NO: 137918 - DNA, 16 bp, H. sapiens
tccttatctataaaag

SEQ ID NO: 137919 - DNA, 17 bp, H. sapiens
tccttatctccatctga

SEQ ID NO: 137920 - DNA, 16 bp, H. sapiens
tccttatctgcaaaat

SEQ ID NO: 137921 - DNA, 16 bp, H. sapiens
tccttatctgcaaagt

SEQ ID NO: 137922 - DNA, 17 bp, H. sapiens
tccttatgagaatctaa

SEQ ID NO: 137923 - DNA, 16 bp, H. sapiens
tccttattaactttct

SEQ ID NO: 137924 - DNA, 16 bp, H. sapiens
tccttattcattcctg

SEQ ID NO: 137925 - DNA, 16 bp, H. sapiens
tccttatttttaaagg

SEQ ID NO: 137926 - DNA, 16 bp, H. sapiens
tccttcaagcactcca

SEQ ID NO: 137927 - DNA, 17 bp, H. sapiens
tccttcacatcacttgt

SEQ ID NO: 137928 - DNA, 16 bp, H. sapiens
tccttcacattccttg

SEQ ID NO: 137929 - DNA, 16 bp, H. sapiens
tccttcacccattttt

SEQ ID NO: 137930 - DNA, 16 bp, H. sapiens
tccttcacctcctgcc

SEQ ID NO: 137931 - DNA, 16 bp, H. sapiens
tccttcaccttttgcc

SEQ ID NO: 137932 - DNA, 16 bp, H. sapiens
tccttcacttcccttg

SEQ ID NO: 137933 - DNA, 16 bp, H. sapiens
tccttcagaaaatatt

SEQ ID NO: 137934 - DNA, 16 bp, H. sapiens
tccttcagaaatgaaa

SEQ ID NO: 137935 - DNA, 16 bp, H. sapiens
tccttcagaagctctt

SEQ ID NO: 137936 - DNA, 16 bp, H. sapiens
tccttcagaatggagc

SEQ ID NO: 137937 - DNA, 16 bp, H. sapiens
tccttcagatctcagt

SEQ ID NO: 137938 - DNA, 16 bp, H. sapiens
tccttcagctgtggtg

SEQ ID NO: 137939 - DNA, 16 bp, H. sapiens
tccttcaggaagcctt

SEQ ID NO: 137940 - DNA, 16 bp, H. sapiens
tccttcaggagcactt

SEQ ID NO: 137941 - DNA, 16 bp, H. sapiens
tccttcaggagctctt

SEQ ID NO: 137942 - DNA, 16 bp, H. sapiens
tccttcaggctggagt

SEQ ID NO: 137943 - DNA, 16 bp, H. sapiens
tccttcaggtctcagc

SEQ ID NO: 137944 - DNA, 16 bp, H. sapiens
tccttcatatcccttg

SEQ ID NO: 137945 - DNA, 16 bp, H. sapiens
tccttcatcagtgttt

SEQ ID NO: 137946 - DNA, 16 bp, H. sapiens
tccttcatccagataa

SEQ ID NO: 137947 - DNA, 16 bp, H. sapiens
tccttcatcttcctgt

SEQ ID NO: 137948 - DNA, 16 bp, H. sapiens
tccttcatgaacattg

SEQ ID NO: 137949 - DNA, 16 bp, H. sapiens
tccttcattcattcac

SEQ ID NO: 137950 - DNA, 16 bp, H. sapiens
tccttcattctgctga

SEQ ID NO: 137951 - DNA, 16 bp, H. sapiens
tccttcattctgttga

SEQ ID NO: 137952 - DNA, 16 bp, H. sapiens
tccttcattttataga

SEQ ID NO: 137953 - DNA, 16 bp, H. sapiens
tccttcattttgttaa

SEQ ID NO: 137954 - DNA, 16 bp, H. sapiens
tccttccaaagtgctg

SEQ ID NO: 137955 - DNA, 16 bp, H. sapiens
tccttccacctctgcc

SEQ ID NO: 137956 - DNA, 16 bp, H. sapiens
tccttccaccttggcc

SEQ ID NO: 137957 - DNA, 16 bp, H. sapiens
tccttccagagcctca

SEQ ID NO: 137958 - DNA, 16 bp, H. sapiens
tccttccagaggctct

SEQ ID NO: 137959 - DNA, 16 bp, H. sapiens
tccttccagcccctgg

SEQ ID NO: 137960 - DNA, 16 bp, H. sapiens
tccttccagtcttttt

SEQ ID NO: 137961 - DNA, 16 bp, H. sapiens
tccttccatccatcct

SEQ ID NO: 137962 - DNA, 16 bp, H. sapiens
tccttcccaatttgga

SEQ ID NO: 137963 - DNA, 16 bp, H. sapiens
tccttcccagcctcta

SEQ ID NO: 137964 - DNA, 16 bp, H. sapiens
tccttcccagcttctc

SEQ ID NO: 137965 - DNA, 16 bp, H. sapiens
tccttcccccagcctc

SEQ ID NO: 137966 - DNA, 16 bp, H. sapiens
tccttcccctgcccca

SEQ ID NO: 137967 - DNA, 16 bp, H. sapiens
tccttcccctttttga

SEQ ID NO: 137968 - DNA, 16 bp, H. sapiens
tccttcccttcaggat

SEQ ID NO: 137969 - DNA, 16 bp, H. sapiens
tccttcccttttaagg

SEQ ID NO: 137970 - DNA, 16 bp, H. sapiens
tccttcctatccatga

SEQ ID NO: 137971 - DNA, 16 bp, H. sapiens
tccttcctcaagcagg

SEQ ID NO: 137972 - DNA, 16 bp, H. sapiens
tccttcctcagactcc

SEQ ID NO: 137973 - DNA, 16 bp, H. sapiens
tccttcctccagcccc

SEQ ID NO: 137974 - DNA, 16 bp, H. sapiens
tccttcctgattctgt

SEQ ID NO: 137975 - DNA, 16 bp, H. sapiens
tccttcctgccacctc

SEQ ID NO: 137976 - DNA, 16 bp, H. sapiens
tccttcctggcttcct

SEQ ID NO: 137977 - DNA, 16 bp, H. sapiens
tccttcctgtgtccat

SEQ ID NO: 137978 - DNA, 16 bp, H. sapiens
tccttccttcaggagc

SEQ ID NO: 137979 - DNA, 16 bp, H. sapiens
tccttccttcattcat

SEQ ID NO: 137980 - DNA, 16 bp, H. sapiens
tccttccttctgggag

SEQ ID NO: 137981 - DNA, 17 bp, H. sapiens
tccttctacaacttggt

SEQ ID NO: 137982 - DNA, 16 bp, H. sapiens
tccttctactaacttt

SEQ ID NO: 137983 - DNA, 16 bp, H. sapiens
tccttctacttgcttt

SEQ ID NO: 137984 - DNA, 16 bp, H. sapiens
tccttctagaacacag

SEQ ID NO: 137985 - DNA, 16 bp, H. sapiens
tccttctcaaagaaaa

SEQ ID NO: 137986 - DNA, 16 bp, H. sapiens
tccttctcaggaaaaa

SEQ ID NO: 137987 - DNA, 16 bp, H. sapiens
tccttctcatccttca

SEQ ID NO: 137988 - DNA, 16 bp, H. sapiens
tccttctcatgcttca

SEQ ID NO: 137989 - DNA, 16 bp, H. sapiens
tccttctccagccatg

SEQ ID NO: 137990 - DNA, 16 bp, H. sapiens
tccttctctccagctg

SEQ ID NO: 137991 - DNA, 16 bp, H. sapiens
tccttctctgtctctg

SEQ ID NO: 137992 - DNA, 16 bp, H. sapiens
tccttctgacagtcag

SEQ ID NO: 137993 - DNA, 16 bp, H. sapiens
tccttctgcctctgtc

SEQ ID NO: 137994 - DNA, 16 bp, H. sapiens
tccttctgctattgat

SEQ ID NO: 137995 - DNA, 16 bp, H. sapiens
tccttctgggaagagc

SEQ ID NO: 137996 - DNA, 16 bp, H. sapiens
tccttcttcacatggt

SEQ ID NO: 137997 - DNA, 16 bp, H. sapiens
tccttcttcagcctcc

SEQ ID NO: 137998 - DNA, 16 bp, H. sapiens
tccttcttctggctca

SEQ ID NO: 137999 - DNA, 16 bp, H. sapiens
tccttcttgctcaggg

SEQ ID NO: 138000 - DNA, 16 bp, H. sapiens
tccttcttgggaaagc

SEQ ID NO: 138001 - DNA, 16 bp, H. sapiens
tccttctttggagcag

SEQ ID NO: 138002 - DNA, 16 bp, H. sapiens
tccttctttggtggct

SEQ ID NO: 138003 - DNA, 16 bp, H. sapiens
tccttgaaaagagcaa

SEQ ID NO: 138004 - DNA, 16 bp, H. sapiens
tccttgaaaaggtcct

SEQ ID NO: 138005 - DNA, 17 bp, H. sapiens
tccttgaaaaggtcctt

SEQ ID NO: 138006 - DNA, 16 bp, H. sapiens
tccttgactttcatga

SEQ ID NO: 138007 - DNA, 16 bp, H. sapiens
tccttgagaggctgag

SEQ ID NO: 138008 - DNA, 16 bp, H. sapiens
tccttgagggcaagga

SEQ ID NO: 138009 - DNA, 16 bp, H. sapiens
tccttgataattttct

SEQ ID NO: 138010 - DNA, 16 bp, H. sapiens
tccttgatcagccttt

SEQ ID NO: 138011 - DNA, 16 bp, H. sapiens
tccttgcaaattgatg

SEQ ID NO: 138012 - DNA, 16 bp, H. sapiens
tccttgcatattctgg

SEQ ID NO: 138013 - DNA, 16 bp, H. sapiens
tccttgcattttggga

SEQ ID NO: 138014 - DNA, 16 bp, H. sapiens
tccttgccaatgccta

SEQ ID NO: 138015 - DNA, 16 bp, H. sapiens
tccttgcccactgcct

SEQ ID NO: 138016 - DNA, 16 bp, H. sapiens
tccttgcctcaagcaa

SEQ ID NO: 138017 - DNA, 16 bp, H. sapiens
tccttgcctcagtttc

SEQ ID NO: 138018 - DNA, 16 bp, H. sapiens
tccttgcctcttcctg

SEQ ID NO: 138019 - DNA, 16 bp, H. sapiens
tccttgcctggggact

SEQ ID NO: 138020 - DNA, 16 bp, H. sapiens
tccttgcctttccagc

SEQ ID NO: 138021 - DNA, 16 bp, H. sapiens
tccttgctgattttct

SEQ ID NO: 138022 - DNA, 16 bp, H. sapiens
tccttgctgttcctca

SEQ ID NO: 138023 - DNA, 16 bp, H. sapiens
tccttgcttctcagct

SEQ ID NO: 138024 - DNA, 16 bp, H. sapiens
tccttggaattttcta

SEQ ID NO: 138025 - DNA, 16 bp, H. sapiens
tccttggagaaacagc

SEQ ID NO: 138026 - DNA, 16 bp, H. sapiens
tccttggcattctttg

SEQ ID NO: 138027 - DNA, 16 bp, H. sapiens
tccttggcctcccaaa

SEQ ID NO: 138028 - DNA, 16 bp, H. sapiens
tccttggctcaaacaa

SEQ ID NO: 138029 - DNA, 16 bp, H. sapiens
tccttggcttgcagag

SEQ ID NO: 138030 - DNA, 16 bp, H. sapiens
tccttggcttggagat

SEQ ID NO: 138031 - DNA, 16 bp, H. sapiens
tccttggcttgtggct

SEQ ID NO: 138032 - DNA, 16 bp, H. sapiens
tccttgggaaaaacag

SEQ ID NO: 138033 - DNA, 16 bp, H. sapiens
tccttggtcaggtcac

SEQ ID NO: 138034 - DNA, 16 bp, H. sapiens
tccttgtagaatctgg

SEQ ID NO: 138035 - DNA, 16 bp, H. sapiens
tccttgtcctccagag

SEQ ID NO: 138036 - DNA, 16 bp, H. sapiens
tccttgtctctaaaat

SEQ ID NO: 138037 - DNA, 16 bp, H. sapiens
tccttgtcttgctcca

SEQ ID NO: 138038 - DNA, 16 bp, H. sapiens
tccttgtctttttcca

SEQ ID NO: 138039 - DNA, 16 bp, H. sapiens
tccttgtgagaatcta

SEQ ID NO: 138040 - DNA, 16 bp, H. sapiens
tccttgtgatctgccc

SEQ ID NO: 138041 - DNA, 16 bp, H. sapiens
tccttgtgcactgttg

SEQ ID NO: 138042 - DNA, 16 bp, H. sapiens
tccttgtggagcaggg

SEQ ID NO: 138043 - DNA, 16 bp, H. sapiens
tccttgttaattttgt

SEQ ID NO: 138044 - DNA, 16 bp, H. sapiens
tccttgttggaagcaa

SEQ ID NO: 138045 - DNA, 16 bp, H. sapiens
tcctttaatcctcaca

SEQ ID NO: 138046 - DNA, 16 bp, H. sapiens
tcctttacagaaaagg

SEQ ID NO: 138047 - DNA, 22 bp, H. sapiens
tcctttacattgtctatgatgc

SEQ ID NO: 138048 - DNA, 16 bp, H. sapiens
tcctttactcaataaa

SEQ ID NO: 138049 - DNA, 16 bp, H. sapiens
tcctttacttcccttg

SEQ ID NO: 138050 - DNA, 16 bp, H. sapiens
tcctttaggttttcta

SEQ ID NO: 138051 - DNA, 16 bp, H. sapiens
tcctttagtcccagct

SEQ ID NO: 138052 - DNA, 16 bp, H. sapiens
tcctttatagtgatgc

SEQ ID NO: 138053 - DNA, 16 bp, H. sapiens
tcctttatatttctgt

SEQ ID NO: 138054 - DNA, 16 bp, H. sapiens
tcctttatgtatctct

SEQ ID NO: 138055 - DNA, 16 bp, H. sapiens
tcctttatttcattca

SEQ ID NO: 138056 - DNA, 16 bp, H. sapiens
tcctttatttttgaag

SEQ ID NO: 138057 - DNA, 16 bp, H. sapiens
tcctttcaaaaagcca

SEQ ID NO: 138058 - DNA, 16 bp, H. sapiens
tcctttcatttcaact

SEQ ID NO: 138059 - DNA, 16 bp, H. sapiens
tcctttccagaaggct

SEQ ID NO: 138060 - DNA, 16 bp, H. sapiens
tcctttccatatttat

SEQ ID NO: 138061 - DNA, 17 bp, H. sapiens
tcctttccccattgctc

SEQ ID NO: 138062 - DNA, 16 bp, H. sapiens
tcctttccttcctggg

SEQ ID NO: 138063 - DNA, 16 bp, H. sapiens
tcctttccttctgcca

SEQ ID NO: 138064 - DNA, 16 bp, H. sapiens
tcctttcctttaaaaa

SEQ ID NO: 138065 - DNA, 16 bp, H. sapiens
tcctttctaaggctga

SEQ ID NO: 138066 - DNA, 16 bp, H. sapiens
tcctttctcagcctcc

SEQ ID NO: 138067 - DNA, 16 bp, H. sapiens
tcctttctcagctgaa

SEQ ID NO: 138068 - DNA, 16 bp, H. sapiens
tcctttctccacatcc

SEQ ID NO: 138069 - DNA, 16 bp, H. sapiens
tcctttctctgagcac

SEQ ID NO: 138070 - DNA, 16 bp, H. sapiens
tcctttctcttgcctg

SEQ ID NO: 138071 - DNA, 16 bp, H. sapiens
tcctttctgatttctt

SEQ ID NO: 138072 - DNA, 16 bp, H. sapiens
tcctttctgcttgtta

SEQ ID NO: 138073 - DNA, 16 bp, H. sapiens
tcctttcttcttctga

SEQ ID NO: 138074 - DNA, 16 bp, H. sapiens
tcctttctttaagaat

SEQ ID NO: 138075 - DNA, 16 bp, H. sapiens
tcctttcttttggatg

SEQ ID NO: 138076 - DNA, 16 bp, H. sapiens
tcctttcttttgggaa

SEQ ID NO: 138077 - DNA, 16 bp, H. sapiens
tcctttcttttgggtg

SEQ ID NO: 138078 - DNA, 16 bp, H. sapiens
tcctttgaaataaaaa

SEQ ID NO: 138079 - DNA, 16 bp, H. sapiens
tcctttgaaggagaag

SEQ ID NO: 138080 - DNA, 16 bp, H. sapiens
tcctttgaatttctat

SEQ ID NO: 138081 - DNA, 16 bp, H. sapiens
tcctttgagaaatctc

SEQ ID NO: 138082 - DNA, 16 bp, H. sapiens
tcctttgagcccagaa

SEQ ID NO: 138083 - DNA, 16 bp, H. sapiens
tcctttgaggccagga

SEQ ID NO: 138084 - DNA, 16 bp, H. sapiens
tcctttgatgtgcaga

SEQ ID NO: 138085 - DNA, 17 bp, H. sapiens
tcctttgcacccttcat

SEQ ID NO: 138086 - DNA, 16 bp, H. sapiens
tcctttgcagggatgt

SEQ ID NO: 138087 - DNA, 16 bp, H. sapiens
tcctttgcatatatac

SEQ ID NO: 138088 - DNA, 16 bp, H. sapiens
tcctttgcatttcttt

SEQ ID NO: 138089 - DNA, 16 bp, H. sapiens
tcctttgcccaatttt

SEQ ID NO: 138090 - DNA, 16 bp, H. sapiens
tcctttgcctattttt

SEQ ID NO: 138091 - DNA, 16 bp, H. sapiens
tcctttgcctcccaaa

SEQ ID NO: 138092 - DNA, 16 bp, H. sapiens
tcctttgccttccacc

SEQ ID NO: 138093 - DNA, 16 bp, H. sapiens
tcctttgccttccgcc

SEQ ID NO: 138094 - DNA, 16 bp, H. sapiens
tcctttgctgggcaga

SEQ ID NO: 138095 - DNA, 16 bp, H. sapiens
tcctttggaatggtgt

SEQ ID NO: 138096 - DNA, 16 bp, H. sapiens
tcctttggagaagaag

SEQ ID NO: 138097 - DNA, 16 bp, H. sapiens
tcctttggagaagagg

SEQ ID NO: 138098 - DNA, 16 bp, H. sapiens
tcctttggagaaggag

SEQ ID NO: 138099 - DNA, 16 bp, H. sapiens
tcctttgggaggctga

SEQ ID NO: 138100 - DNA, 16 bp, H. sapiens
tcctttgggtatacac

SEQ ID NO: 138101 - DNA, 18 bp, H. sapiens
tcctttgggtatataccc

SEQ ID NO: 138102 - DNA, 16 bp, H. sapiens
tcctttgggtgtatgc

SEQ ID NO: 138103 - DNA, 16 bp, H. sapiens
tcctttggttatatac

SEQ ID NO: 138104 - DNA, 16 bp, H. sapiens
tcctttgtaacagtgt

SEQ ID NO: 138105 - DNA, 16 bp, H. sapiens
tcctttgtcttccact

SEQ ID NO: 138106 - DNA, 16 bp, H. sapiens
tcctttgtctttccat

SEQ ID NO: 138107 - DNA, 16 bp, H. sapiens
tcctttgttaaattta

SEQ ID NO: 138108 - DNA, 16 bp, H. sapiens
tccttttaaaataata

SEQ ID NO: 138109 - DNA, 16 bp, H. sapiens
tccttttaaaggttgt

SEQ ID NO: 138110 - DNA, 16 bp, H. sapiens
tccttttaaatctctt

SEQ ID NO: 138111 - DNA, 16 bp, H. sapiens
tccttttacagatgag

SEQ ID NO: 138112 - DNA, 16 bp, H. sapiens
tccttttattttcaac

SEQ ID NO: 138113 - DNA, 16 bp, H. sapiens
tccttttcacatttca

SEQ ID NO: 138114 - DNA, 16 bp, H. sapiens
tccttttcattcagca

SEQ ID NO: 138115 - DNA, 16 bp, H. sapiens
tccttttctagtttct

SEQ ID NO: 138116 - DNA, 16 bp, H. sapiens
tccttttcttccccaa

SEQ ID NO: 138117 - DNA, 16 bp, H. sapiens
tccttttctttcagat

SEQ ID NO: 138118 - DNA, 16 bp, H. sapiens
tccttttgaaaataaa

SEQ ID NO: 138119 - DNA, 16 bp, H. sapiens
tccttttgatagagca

SEQ ID NO: 138120 - DNA, 16 bp, H. sapiens
tccttttgctttttaa

SEQ ID NO: 138121 - DNA, 16 bp, H. sapiens
tcctttttaaaaaaaa

SEQ ID NO: 138122 - DNA, 16 bp, H. sapiens
tcctttttaaaaaaca

SEQ ID NO: 138123 - DNA, 16 bp, H. sapiens
tcctttttaaaaatta

SEQ ID NO: 138124 - DNA, 16 bp, H. sapiens
tcctttttaaaataat

SEQ ID NO: 138125 - DNA, 16 bp, H. sapiens
tcctttttattgatga

SEQ ID NO: 138126 - DNA, 16 bp, H. sapiens
tcctttttcacttctg

SEQ ID NO: 138127 - DNA, 16 bp, H. sapiens
tcctttttcattcctg

SEQ ID NO: 138128 - DNA, 16 bp, H. sapiens
tcctttttctctgcat

SEQ ID NO: 138129 - DNA, 16 bp, H. sapiens
tccttttttaaaaaga

SEQ ID NO: 138130 - DNA, 16 bp, H. sapiens
tcctttttttaagaga

SEQ ID NO: 138131 - DNA, 16 bp, H. sapiens
tcctttttttcctaaa

SEQ ID NO: 138132 - DNA, 16 bp, H. sapiens
tcctttttttctgaga

SEQ ID NO: 138133 - DNA, 16 bp, H. sapiens
tcgaaatcctgacctc

SEQ ID NO: 138134 - DNA, 16 bp, H. sapiens
tcgaactcctcatctc

SEQ ID NO: 138135 - DNA, 16 bp, H. sapiens
tcgaactgacctcaag

SEQ ID NO: 138136 - DNA, 16 bp, H. sapiens
tcgaactgctgggctc

SEQ ID NO: 138137 - DNA, 16 bp, H. sapiens
tcgaacttcctccttt

SEQ ID NO: 138138 - DNA, 16 bp, H. sapiens
tcgaaggccttttctg

SEQ ID NO: 138139 - DNA, 16 bp, H. sapiens
tcgaagtgctgggatt

SEQ ID NO: 138140 - DNA, 16 bp, H. sapiens
tcgaccacccaggctc

SEQ ID NO: 138141 - DNA, 16 bp, H. sapiens
tcgacctccagggctc

SEQ ID NO: 138142 - DNA, 16 bp, H. sapiens
tcgacctcctgacctc

SEQ ID NO: 138143 - DNA, 16 bp, H. sapiens
tcgacctcctgggccc

SEQ ID NO: 138144 - DNA, 16 bp, H. sapiens
tcgactggaggaccac

SEQ ID NO: 138145 - DNA, 16 bp, H. sapiens
tcgagaaacacccaca

SEQ ID NO: 138146 - DNA, 16 bp, H. sapiens
tcgagaacagcctggc

SEQ ID NO: 138147 - DNA, 16 bp, H. sapiens
tcgagaacatcctggc

SEQ ID NO: 138148 - DNA, 16 bp, H. sapiens
tcgagaccaccctggc

SEQ ID NO: 138149 - DNA, 16 bp, H. sapiens
tcgagaccagcccagg

SEQ ID NO: 138150 - DNA, 16 bp, H. sapiens
tcgagaccatccgggc

SEQ ID NO: 138151 - DNA, 16 bp, H. sapiens
tcgagaccatcctgac

SEQ ID NO: 138152 - DNA, 17 bp, H. sapiens
tcgagaccatcctgccc

SEQ ID NO: 138153 - DNA, 16 bp, H. sapiens
tcgagaccattctggc

SEQ ID NO: 138154 - DNA, 16 bp, H. sapiens
tcgagacccgcctggc

SEQ ID NO: 138155 - DNA, 17 bp, H. sapiens
tcgagatcgcaccactg

SEQ ID NO: 138156 - DNA, 16 bp, H. sapiens
tcgagcctgggcgaca

SEQ ID NO: 138157 - DNA, 17 bp, H. sapiens
tcgaggcaggtggatcg

SEQ ID NO: 138158 - DNA, 16 bp, H. sapiens
tcgaggctgccatgag

SEQ ID NO: 138159 - DNA, 16 bp, H. sapiens
tcgaggcttcagtgaa

SEQ ID NO: 138160 - DNA, 17 bp, H. sapiens
tcgaggtgggaggatcg

SEQ ID NO: 138161 - DNA, 16 bp, H. sapiens
tcgatctcctcacctc

SEQ ID NO: 138162 - DNA, 16 bp, H. sapiens
tcgcaagggcaaaaaa

SEQ ID NO: 138163 - DNA, 16 bp, H. sapiens
tcgcactttgggaggc

SEQ ID NO: 138164 - DNA, 16 bp, H. sapiens
tcgcatgcacagttca

SEQ ID NO: 138165 - DNA, 16 bp, H. sapiens
tcgccaaaatgtgtcc

SEQ ID NO: 138166 - DNA, 16 bp, H. sapiens
tcgccacaccgtcttc

SEQ ID NO: 138167 - DNA, 16 bp, H. sapiens
tcgccagcctcggcct

SEQ ID NO: 138168 - DNA, 16 bp, H. sapiens
tcgccaggctggggtg

SEQ ID NO: 138169 - DNA, 16 bp, H. sapiens
tcgccatgttgctcag

SEQ ID NO: 138170 - DNA, 16 bp, H. sapiens
tcgccatgtttcccag

SEQ ID NO: 138171 - DNA, 16 bp, H. sapiens
tcgcccactttctgat

SEQ ID NO: 138172 - DNA, 16 bp, H. sapiens
tcgcccagactggaat

SEQ ID NO: 138173 - DNA, 17 bp, H. sapiens
tcgcccaggctagagta

SEQ ID NO: 138174 - DNA, 16 bp, H. sapiens
tcgcccaggctgagtg

SEQ ID NO: 138175 - DNA, 16 bp, H. sapiens
tcgcccaggctggtct

SEQ ID NO: 138176 - DNA, 16 bp, H. sapiens
tcgcccaggctggtgt

SEQ ID NO: 138177 - DNA, 16 bp, H. sapiens
tcgcccagggtggagt

SEQ ID NO: 138178 - DNA, 16 bp, H. sapiens
tcgcccgcctcagcct

SEQ ID NO: 138179 - DNA, 16 bp, H. sapiens
tcgcctctgcctccca

SEQ ID NO: 138180 - DNA, 16 bp, H. sapiens
tcgcctgcctctgcct

SEQ ID NO: 138181 - DNA, 16 bp, H. sapiens
tcgcctgggctggagt

SEQ ID NO: 138182 - DNA, 16 bp, H. sapiens
tcgccttcccaaagtg

SEQ ID NO: 138183 - DNA, 16 bp, H. sapiens
tcgccttctgccatga

SEQ ID NO: 138184 - DNA, 16 bp, H. sapiens
tcgcggggggtgcctc

SEQ ID NO: 138185 - DNA, 18 bp, H. sapiens
tcgcggtggctcacgcct

SEQ ID NO: 138186 - DNA, 16 bp, H. sapiens
tcgctaacgaggacgc

SEQ ID NO: 138187 - DNA, 17 bp, H. sapiens
tcgctatgttgcccaga

SEQ ID NO: 138188 - DNA, 40 bp, H. sapiens
tcgctcaactacatggaaactgaacaacctgctcctgaat

SEQ ID NO: 138189 - DNA, 16 bp, H. sapiens
tcgctcaggctggagt

SEQ ID NO: 138190 - DNA, 19 bp, H. sapiens
tcgctctgtcacccaggct

SEQ ID NO: 138191 - DNA, 17 bp, H. sapiens
tcgctcttttgcccagg

SEQ ID NO: 138192 - DNA, 16 bp, H. sapiens
tcgctgaaacccagga

SEQ ID NO: 138193 - DNA, 16 bp, H. sapiens
tcgctggagcctggga

SEQ ID NO: 138194 - DNA, 16 bp, H. sapiens
tcgctttgctgcccag

SEQ ID NO: 138195 - DNA, 16 bp, H. sapiens
tcggaattagtttagc

SEQ ID NO: 138196 - DNA, 16 bp, H. sapiens
tcggaggttgcagtga

SEQ ID NO: 138197 - DNA, 16 bp, H. sapiens
tcggccaggctggtct

SEQ ID NO: 138198 - DNA, 22 bp, H. sapiens
tcggcctcccaaagtgctgggt

SEQ ID NO: 138199 - DNA, 17 bp, H. sapiens
tcggcctcccaaagtgg

SEQ ID NO: 138200 - DNA, 17 bp, H. sapiens
tcggcctcccagagtgt

SEQ ID NO: 138201 - DNA, 16 bp, H. sapiens
tcggcctcctagagtg

SEQ ID NO: 138202 - DNA, 16 bp, H. sapiens
tcggcctcctgaaatg

SEQ ID NO: 138203 - DNA, 16 bp, H. sapiens
tcggctaatttttttt

SEQ ID NO: 138204 - DNA, 16 bp, H. sapiens
tcggctcactgagacc

SEQ ID NO: 138205 - DNA, 20 bp, H. sapiens
tcggctcactgcaacccccg

SEQ ID NO: 138206 - DNA, 17 bp, H. sapiens
tcggctgggcacggtgg

SEQ ID NO: 138207 - DNA, 16 bp, H. sapiens
tcggctgtgaatcctt

SEQ ID NO: 138208 - DNA, 16 bp, H. sapiens
tcgggaagcagaggca

SEQ ID NO: 138209 - DNA, 17 bp, H. sapiens
tcgggaggccaaggcac

SEQ ID NO: 138210 - DNA, 16 bp, H. sapiens
tcgggaggccgaggca

SEQ ID NO: 138211 - DNA, 16 bp, H. sapiens
tcgggaggctgaggcc

SEQ ID NO: 138212 - DNA, 16 bp, H. sapiens
tcgggaggctgtggtg

SEQ ID NO: 138213 - DNA, 16 bp, H. sapiens
tcgggaggcttaggtg

SEQ ID NO: 138214 - DNA, 16 bp, H. sapiens
tcgggaggtggaggca

SEQ ID NO: 138215 - DNA, 16 bp, H. sapiens
tcgggagtctgaggca

SEQ ID NO: 138216 - DNA, 16 bp, H. sapiens
tcgggcatggcgggct

SEQ ID NO: 138217 - DNA, 16 bp, H. sapiens
tcgggcgtggtggcag

SEQ ID NO: 138218 - DNA, 16 bp, H. sapiens
tcggggctgaggcagg

SEQ ID NO: 138219 - DNA, 16 bp, H. sapiens
tcgggtggctgaggta

SEQ ID NO: 138220 - DNA, 16 bp, H. sapiens
tcggtcaggctggtct

SEQ ID NO: 138221 - DNA, 17 bp, H. sapiens
tcggttgaacctgggag

SEQ ID NO: 138222 - DNA, 16 bp, H. sapiens
tcgtccaggctggagt

SEQ ID NO: 138223 - DNA, 16 bp, H. sapiens
tcgtctcaaactcctg

SEQ ID NO: 138224 - DNA, 16 bp, H. sapiens
tcgtctcgaactcctg

SEQ ID NO: 138225 - DNA, 16 bp, H. sapiens
tcgtctctaaaaaaat

SEQ ID NO: 138226 - DNA, 16 bp, H. sapiens
tcgtctttgttttaaa

SEQ ID NO: 138227 - DNA, 16 bp, H. sapiens
tcgtgaggctgaggca

SEQ ID NO: 138228 - DNA, 16 bp, H. sapiens
tcgtgatccgcccagc

SEQ ID NO: 138229 - DNA, 16 bp, H. sapiens
tcgtgcaggctggagt

SEQ ID NO: 138230 - DNA, 16 bp, H. sapiens
tcgtgccttcccaaca

SEQ ID NO: 138231 - DNA, 16 bp, H. sapiens
tcgtgcttcagcctcc

SEQ ID NO: 138232 - DNA, 17 bp, H. sapiens
tcgtggccgggcagagg

SEQ ID NO: 138233 - DNA, 17 bp, H. sapiens
tcgtggctcacgcctgt

SEQ ID NO: 138234 - DNA, 16 bp, H. sapiens
tcgtggtctcactggc

SEQ ID NO: 138235 - DNA, 16 bp, H. sapiens
tcgtgtctactaaaaa

SEQ ID NO: 138236 - DNA, 16 bp, H. sapiens
tcgttcaactcccact

SEQ ID NO: 138237 - DNA, 16 bp, H. sapiens
tcgtttaatcctcaca

SEQ ID NO: 138238 - DNA, 16 bp, H. sapiens
tctaaaaaatgtacat

SEQ ID NO: 138239 - DNA, 16 bp, H. sapiens
tctaaaaatcaaagca

SEQ ID NO: 138240 - DNA, 16 bp, H. sapiens
tctaaaacaccgaaag

SEQ ID NO: 138241 - DNA, 16 bp, H. sapiens
tctaaaacagcaaaag

SEQ ID NO: 138242 - DNA, 16 bp, H. sapiens
tctaaaactattttta

SEQ ID NO: 138243 - DNA, 16 bp, H. sapiens
tctaaaactttttcat

SEQ ID NO: 138244 - DNA, 16 bp, H. sapiens
tctaaaagaaaatatg

SEQ ID NO: 138245 - DNA, 16 bp, H. sapiens
tctaaaagaatttaaa

SEQ ID NO: 138246 - DNA, 16 bp, H. sapiens
tctaaaagccagagtg

SEQ ID NO: 138247 - DNA, 16 bp, H. sapiens
tctaaaagggagaaat

SEQ ID NO: 138248 - DNA, 16 bp, H. sapiens
tctaaaatatttacta

SEQ ID NO: 138249 - DNA, 16 bp, H. sapiens
tctaaaatattttgca

SEQ ID NO: 138250 - DNA, 16 bp, H. sapiens
tctaaaatatttttgt

SEQ ID NO: 138251 - DNA, 16 bp, H. sapiens
tctaaaatgcattttt

SEQ ID NO: 138252 - DNA, 16 bp, H. sapiens
tctaaaattaaagttt

SEQ ID NO: 138253 - DNA, 16 bp, H. sapiens
tctaaaattctcttct

SEQ ID NO: 138254 - DNA, 16 bp, H. sapiens
tctaaaattgaccaca

SEQ ID NO: 138255 - DNA, 16 bp, H. sapiens
tctaaacagagaaaag

SEQ ID NO: 138256 - DNA, 16 bp, H. sapiens
tctaaacatagaaaaa

SEQ ID NO: 138257 - DNA, 16 bp, H. sapiens
tctaaacatggaaaag

SEQ ID NO: 138258 - DNA, 16 bp, H. sapiens
tctaaactgttctcca

SEQ ID NO: 138259 - DNA, 16 bp, H. sapiens
tctaaagaaaagaggt

SEQ ID NO: 138260 - DNA, 16 bp, H. sapiens
tctaaaggagaaaaaa

SEQ ID NO: 138261 - DNA, 16 bp, H. sapiens
tctaaagttttctttt

SEQ ID NO: 138262 - DNA, 16 bp, H. sapiens
tctaaataccattccc

SEQ ID NO: 138263 - DNA, 16 bp, H. sapiens
tctaaatatatatgta

SEQ ID NO: 138264 - DNA, 16 bp, H. sapiens
tctaaatcagtggttc

SEQ ID NO: 138265 - DNA, 16 bp, H. sapiens
tctaaatctcttcata

SEQ ID NO: 138266 - DNA, 16 bp, H. sapiens
tctaaattaactgaga

SEQ ID NO: 138267 - DNA, 16 bp, H. sapiens
tctaaattaccttggg

SEQ ID NO: 138268 - DNA, 16 bp, H. sapiens
tctaaattcatatgtt

SEQ ID NO: 138269 - DNA, 16 bp, H. sapiens
tctaaatttgatgaaa

SEQ ID NO: 138270 - DNA, 16 bp, H. sapiens
tctaaattttctaaat

SEQ ID NO: 138271 - DNA, 16 bp, H. sapiens
tctaacacaaaaccta

SEQ ID NO: 138272 - DNA, 16 bp, H. sapiens
tctaacaccactggct

SEQ ID NO: 138273 - DNA, 16 bp, H. sapiens
tctaacagaaagcagc

SEQ ID NO: 138274 - DNA, 16 bp, H. sapiens
tctaacctacagaact

SEQ ID NO: 138275 - DNA, 16 bp, H. sapiens
tctaacttctttcact

SEQ ID NO: 138276 - DNA, 16 bp, H. sapiens
tctaactttttttcaa

SEQ ID NO: 138277 - DNA, 16 bp, H. sapiens
tctaagaaaagggaag

SEQ ID NO: 138278 - DNA, 16 bp, H. sapiens
tctaagaaatgcaaat

SEQ ID NO: 138279 - DNA, 16 bp, H. sapiens
tctaagaacaaagacc

SEQ ID NO: 138280 - DNA, 16 bp, H. sapiens
tctaagaagaggaaga

SEQ ID NO: 138281 - DNA, 16 bp, H. sapiens
tctaagaagctcccag

SEQ ID NO: 138282 - DNA, 16 bp, H. sapiens
tctaagaagtaactaa

SEQ ID NO: 138283 - DNA, 16 bp, H. sapiens
tctaagatctcaaact

SEQ ID NO: 138284 - DNA, 16 bp, H. sapiens
tctaagatctggaaaa

SEQ ID NO: 138285 - DNA, 16 bp, H. sapiens
tctaagatgaaaaata

SEQ ID NO: 138286 - DNA, 16 bp, H. sapiens
tctaagcactttactt

SEQ ID NO: 138287 - DNA, 18 bp, H. sapiens
tctaagcagcaaagcatt

SEQ ID NO: 138288 - DNA, 16 bp, H. sapiens
tctaagcctccatttc

SEQ ID NO: 138289 - DNA, 17 bp, H. sapiens
tctaaggtcacacctca

SEQ ID NO: 138290 - DNA, 16 bp, H. sapiens
tctaagtaaagaaaaa

SEQ ID NO: 138291 - DNA, 16 bp, H. sapiens
tctaagttttcatttt

SEQ ID NO: 138292 - DNA, 16 bp, H. sapiens
tctaataaaaagacaa

SEQ ID NO: 138293 - DNA, 16 bp, H. sapiens
tctaataatttttggt

SEQ ID NO: 138294 - DNA, 16 bp, H. sapiens
tctaatactgtcagtg

SEQ ID NO: 138295 - DNA, 16 bp, H. sapiens
tctaatagtttatttg

SEQ ID NO: 138296 - DNA, 16 bp, H. sapiens
tctaatagttttttaa

SEQ ID NO: 138297 - DNA, 16 bp, H. sapiens
tctaatatccagcacc

SEQ ID NO: 138298 - DNA, 16 bp, H. sapiens
tctaatattgacagtg

SEQ ID NO: 138299 - DNA, 16 bp, H. sapiens
tctaatcagctgctag

SEQ ID NO: 138300 - DNA, 16 bp, H. sapiens
tctaatcccagctact

SEQ ID NO: 138301 - DNA, 16 bp, H. sapiens
tctaatgaccagtaat

SEQ ID NO: 138302 - DNA, 16 bp, H. sapiens
tctaatgaccagtgat

SEQ ID NO: 138303 - DNA, 16 bp, H. sapiens
tctaatgactaataat

SEQ ID NO: 138304 - DNA, 22 bp, H. sapiens
tctaatgacttctctgctagca

SEQ ID NO: 138305 - DNA, 16 bp, H. sapiens
tctaatgagataatca

SEQ ID NO: 138306 - DNA, 16 bp, H. sapiens
tctaatgatgagtgat

SEQ ID NO: 138307 - DNA, 16 bp, H. sapiens
tctaatgcagctgctg

SEQ ID NO: 138308 - DNA, 16 bp, H. sapiens
tctaatgtattttgtt

SEQ ID NO: 138309 - DNA, 16 bp, H. sapiens
tctaattcattttatg

SEQ ID NO: 138310 - DNA, 16 bp, H. sapiens
tctaattcctggcctc

SEQ ID NO: 138311 - DNA, 16 bp, H. sapiens
tctaattctctttgta

SEQ ID NO: 138312 - DNA, 16 bp, H. sapiens
tctaatttcaaaatat

SEQ ID NO: 138313 - DNA, 16 bp, H. sapiens
tctaatttcagacaaa

SEQ ID NO: 138314 - DNA, 16 bp, H. sapiens
tctaatttgattgtgc

SEQ ID NO: 138315 - DNA, 16 bp, H. sapiens
tctaattttgaaagaa

SEQ ID NO: 138316 - DNA, 16 bp, H. sapiens
tctaatttttatgtga

SEQ ID NO: 138317 - DNA, 16 bp, H. sapiens
tctacaaaaaaatgtt

SEQ ID NO: 138318 - DNA, 16 bp, H. sapiens
tctacaaaaaatagta

SEQ ID NO: 138319 - DNA, 16 bp, H. sapiens
tctacaaaaaatctaa

SEQ ID NO: 138320 - DNA, 16 bp, H. sapiens
tctacaaaaacagaaa

SEQ ID NO: 138321 - DNA, 16 bp, H. sapiens
tctacaaaaactgttt

SEQ ID NO: 138322 - DNA, 16 bp, H. sapiens
tctacaaaaacttttt

SEQ ID NO: 138323 - DNA, 16 bp, H. sapiens
tctacaaaaagacttt

SEQ ID NO: 138324 - DNA, 16 bp, H. sapiens
tctacaaaaagagatt

SEQ ID NO: 138325 - DNA, 16 bp, H. sapiens
tctacaaaaaggaaaa

SEQ ID NO: 138326 - DNA, 16 bp, H. sapiens
tctacaaaaagttttt

SEQ ID NO: 138327 - DNA, 16 bp, H. sapiens
tctacaaaaataaaga

SEQ ID NO: 138328 - DNA, 16 bp, H. sapiens
tctacaaaaataagaa

SEQ ID NO: 138329 - DNA, 16 bp, H. sapiens
tctacaaaacattaaa

SEQ ID NO: 138330 - DNA, 16 bp, H. sapiens
tctacaaaagaataca

SEQ ID NO: 138331 - DNA, 16 bp, H. sapiens
tctacaaaataattga

SEQ ID NO: 138332 - DNA, 16 bp, H. sapiens
tctacaaaatattttt

SEQ ID NO: 138333 - DNA, 16 bp, H. sapiens
tctacaaagaacctaa

SEQ ID NO: 138334 - DNA, 16 bp, H. sapiens
tctacaaagaataaaa

SEQ ID NO: 138335 - DNA, 16 bp, H. sapiens
tctacaaataatttta

SEQ ID NO: 138336 - DNA, 16 bp, H. sapiens
tctacaacaaacccac

SEQ ID NO: 138337 - DNA, 16 bp, H. sapiens
tctacaacaacagtgt

SEQ ID NO: 138338 - DNA, 16 bp, H. sapiens
tctacaagaaaaagaa

SEQ ID NO: 138339 - DNA, 16 bp, H. sapiens
tctacaagagtttcct

SEQ ID NO: 138340 - DNA, 16 bp, H. sapiens
tctacaagccaaggaa

SEQ ID NO: 138341 - DNA, 16 bp, H. sapiens
tctacaagctggagaa

SEQ ID NO: 138342 - DNA, 16 bp, H. sapiens
tctacaaggaaaatta

SEQ ID NO: 138343 - DNA, 16 bp, H. sapiens
tctacaaggaacacaa

SEQ ID NO: 138344 - DNA, 16 bp, H. sapiens
tctacaaggaacttca

SEQ ID NO: 138345 - DNA, 16 bp, H. sapiens
tctacaataaacatgt

SEQ ID NO: 138346 - DNA, 16 bp, H. sapiens
tctacaatgaatatgt

SEQ ID NO: 138347 - DNA, 16 bp, H. sapiens
tctacaatgagaatta

SEQ ID NO: 138348 - DNA, 16 bp, H. sapiens
tctacaattacctcaa

SEQ ID NO: 138349 - DNA, 16 bp, H. sapiens
tctacacaaaaacttg

SEQ ID NO: 138350 - DNA, 16 bp, H. sapiens
tctacacagacacagt

SEQ ID NO: 138351 - DNA, 16 bp, H. sapiens
tctacactgctggtga

SEQ ID NO: 138352 - DNA, 16 bp, H. sapiens
tctacacttgatctta

SEQ ID NO: 138353 - DNA, 16 bp, H. sapiens
tctacagaaaaaaaat

SEQ ID NO: 138354 - DNA, 16 bp, H. sapiens
tctacagaaaatacaa

SEQ ID NO: 138355 - DNA, 17 bp, H. sapiens
tctacagaactctccaa

SEQ ID NO: 138356 - DNA, 16 bp, H. sapiens
tctacagagacagaaa

SEQ ID NO: 138357 - DNA, 16 bp, H. sapiens
tctacagatgaagaaa

SEQ ID NO: 138358 - DNA, 16 bp, H. sapiens
tctacagcaggggcaa

SEQ ID NO: 138359 - DNA, 16 bp, H. sapiens
tctacagccataccac

SEQ ID NO: 138360 - DNA, 16 bp, H. sapiens
tctacagcctgagaaa

SEQ ID NO: 138361 - DNA, 16 bp, H. sapiens
tctacatatttatata

SEQ ID NO: 138362 - DNA, 16 bp, H. sapiens
tctacatcttgtccca

SEQ ID NO: 138363 - DNA, 16 bp, H. sapiens
tctacatggttgtcaa

SEQ ID NO: 138364 - DNA, 16 bp, H. sapiens
tctacattacatattt

SEQ ID NO: 138365 - DNA, 16 bp, H. sapiens
tctacattttcaccaa

SEQ ID NO: 138366 - DNA, 16 bp, H. sapiens
tctaccaaaaatgaaa

SEQ ID NO: 138367 - DNA, 16 bp, H. sapiens
tctaccaaaagtaaaa

SEQ ID NO: 138368 - DNA, 16 bp, H. sapiens
tctaccaactgaccaa

SEQ ID NO: 138369 - DNA, 16 bp, H. sapiens
tctaccactgtggtat

SEQ ID NO: 138370 - DNA, 16 bp, H. sapiens
tctaccacttattagc

SEQ ID NO: 138371 - DNA, 18 bp, H. sapiens
tctaccagaaaatgaaag

SEQ ID NO: 138372 - DNA, 16 bp, H. sapiens
tctaccagcaccttga

SEQ ID NO: 138373 - DNA, 21 bp, H. sapiens
tctaccagtcctgctgtccct

SEQ ID NO: 138374 - DNA, 16 bp, H. sapiens
tctacccaccttggcc

SEQ ID NO: 138375 - DNA, 16 bp, H. sapiens
tctacccatctggcaa

SEQ ID NO: 138376 - DNA, 16 bp, H. sapiens
tctacccctggcccct

SEQ ID NO: 138377 - DNA, 16 bp, H. sapiens
tctacctatttatcta

SEQ ID NO: 138378 - DNA, 16 bp, H. sapiens
tctacctcataggatt

SEQ ID NO: 138379 - DNA, 16 bp, H. sapiens
tctacctccagggctc

SEQ ID NO: 138380 - DNA, 16 bp, H. sapiens
tctacctcctaaatat

SEQ ID NO: 138381 - DNA, 16 bp, H. sapiens
tctacctgacttcaaa

SEQ ID NO: 138382 - DNA, 16 bp, H. sapiens
tctacctgcctcagcc

SEQ ID NO: 138383 - DNA, 16 bp, H. sapiens
tctacctggaatgttc

SEQ ID NO: 138384 - DNA, 16 bp, H. sapiens
tctacctggtctctcc

SEQ ID NO: 138385 - DNA, 16 bp, H. sapiens
tctacctttggtcttc

SEQ ID NO: 138386 - DNA, 17 bp, H. sapiens
tctacgtctgattggta

SEQ ID NO: 138387 - DNA, 18 bp, H. sapiens
tctactaaaaaagtacaa

SEQ ID NO: 138388 - DNA, 17 bp, H. sapiens
tctactaaaaatacaat

SEQ ID NO: 138389 - DNA, 17 bp, H. sapiens
tctactaaaaatacaca

SEQ ID NO: 138390 - DNA, 18 bp, H. sapiens
tctactaaaaatacgaaa

SEQ ID NO: 138391 - DNA, 16 bp, H. sapiens
tctactaaaaatcaaa

SEQ ID NO: 138392 - DNA, 16 bp, H. sapiens
tctactaaaaatccaa

SEQ ID NO: 138393 - DNA, 18 bp, H. sapiens
tctactaaaaatgcaaaa

SEQ ID NO: 138394 - DNA, 16 bp, H. sapiens
tctactaaaacaaaac

SEQ ID NO: 138395 - DNA, 16 bp, H. sapiens
tctactaaaagataca

SEQ ID NO: 138396 - DNA, 18 bp, H. sapiens
tctactaaaagtacaaaa

SEQ ID NO: 138397 - DNA, 18 bp, H. sapiens
tctactaaaagtgcaaaa

SEQ ID NO: 138398 - DNA, 18 bp, H. sapiens
tctactaaagatacaaaa

SEQ ID NO: 138399 - DNA, 16 bp, H. sapiens
tctactaaagtacaaa

SEQ ID NO: 138400 - DNA, 16 bp, H. sapiens
tctactacaaataaaa

SEQ ID NO: 138401 - DNA, 18 bp, H. sapiens
tctactagaaatacaaaa

SEQ ID NO: 138402 - DNA, 16 bp, H. sapiens
tctactcattcttcaa

SEQ ID NO: 138403 - DNA, 16 bp, H. sapiens
tctactccagcctggg

SEQ ID NO: 138404 - DNA, 16 bp, H. sapiens
tctactccctccctgg

SEQ ID NO: 138405 - DNA, 16 bp, H. sapiens
tctactccctgcttct

SEQ ID NO: 138406 - DNA, 16 bp, H. sapiens
tctactctgtgcttct

SEQ ID NO: 138407 - DNA, 18 bp, H. sapiens
tctactgaaaacacaaaa

SEQ ID NO: 138408 - DNA, 16 bp, H. sapiens
tctactgaaaatgaaa

SEQ ID NO: 138409 - DNA, 16 bp, H. sapiens
tctactgctgtcagtg

SEQ ID NO: 138410 - DNA, 16 bp, H. sapiens
tctactgtaggtaaaa

SEQ ID NO: 138411 - DNA, 16 bp, H. sapiens
tctactgtatgccagg

SEQ ID NO: 138412 - DNA, 16 bp, H. sapiens
tctacttaaaaaacaa

SEQ ID NO: 138413 - DNA, 16 bp, H. sapiens
tctacttcctgggctc

SEQ ID NO: 138414 - DNA, 16 bp, H. sapiens
tctacttcctgtttct

SEQ ID NO: 138415 - DNA, 16 bp, H. sapiens
tctacttctatgaatt

SEQ ID NO: 138416 - DNA, 16 bp, H. sapiens
tctacttctatgagtt

SEQ ID NO: 138417 - DNA, 16 bp, H. sapiens
tctacttctggtgagg

SEQ ID NO: 138418 - DNA, 16 bp, H. sapiens
tctacttgactggatt

SEQ ID NO: 138419 - DNA, 16 bp, H. sapiens
tctacttggaacatca

SEQ ID NO: 138420 - DNA, 16 bp, H. sapiens
tctactttctgtctct

SEQ ID NO: 138421 - DNA, 16 bp, H. sapiens
tctactttgtgtctct

SEQ ID NO: 138422 - DNA, 17 bp, H. sapiens
tctacttttagttcttt

SEQ ID NO: 138423 - DNA, 16 bp, H. sapiens
tctacttttgtatatg

SEQ ID NO: 138424 - DNA, 16 bp, H. sapiens
tctactttttaaaaaa

SEQ ID NO: 138425 - DNA, 16 bp, H. sapiens
tctactttttaaaatc

SEQ ID NO: 138426 - DNA, 16 bp, H. sapiens
tctagaaaaaattaaa

SEQ ID NO: 138427 - DNA, 16 bp, H. sapiens
tctagaaaaccccaca

SEQ ID NO: 138428 - DNA, 16 bp, H. sapiens
tctagaaaatattttc

SEQ ID NO: 138429 - DNA, 16 bp, H. sapiens
tctagaaataaaacca

SEQ ID NO: 138430 - DNA, 16 bp, H. sapiens
tctagaaatttattca

SEQ ID NO: 138431 - DNA, 16 bp, H. sapiens
tctagaactcttgacc

SEQ ID NO: 138432 - DNA, 16 bp, H. sapiens
tctagaagaaaaccta

SEQ ID NO: 138433 - DNA, 16 bp, H. sapiens
tctagaagaaaatcta

SEQ ID NO: 138434 - DNA, 16 bp, H. sapiens
tctagaagatggaaaa

SEQ ID NO: 138435 - DNA, 16 bp, H. sapiens
tctagaagcagaaata

SEQ ID NO: 138436 - DNA, 16 bp, H. sapiens
tctagaagttctgttt

SEQ ID NO: 138437 - DNA, 16 bp, H. sapiens
tctagaatcagaaata

SEQ ID NO: 138438 - DNA, 16 bp, H. sapiens
tctagaatttattttt

SEQ ID NO: 138439 - DNA, 16 bp, H. sapiens
tctagaatttccactt

SEQ ID NO: 138440 - DNA, 16 bp, H. sapiens
tctagactgggcaaca

SEQ ID NO: 138441 - DNA, 16 bp, H. sapiens
tctagagcctccagag

SEQ ID NO: 138442 - DNA, 16 bp, H. sapiens
tctagaggctgggaag

SEQ ID NO: 138443 - DNA, 16 bp, H. sapiens
tctagcaaactaatat

SEQ ID NO: 138444 - DNA, 16 bp, H. sapiens
tctagcaaagcaggcc

SEQ ID NO: 138445 - DNA, 16 bp, H. sapiens
tctagcagtgggattg

SEQ ID NO: 138446 - DNA, 16 bp, H. sapiens
tctagcatttcctttt

SEQ ID NO: 138447 - DNA, 16 bp, H. sapiens
tctagcctggaggaca

SEQ ID NO: 138448 - DNA, 16 bp, H. sapiens
tctagcctggatgaca

SEQ ID NO: 138449 - DNA, 16 bp, H. sapiens
tctagcctgggtgaca

SEQ ID NO: 138450 - DNA, 24 bp, H. sapiens
tctagcctgggtgacagagtgaga

SEQ ID NO: 138451 - DNA, 20 bp, H. sapiens
tctagctaatctagtgggga

SEQ ID NO: 138452 - DNA, 16 bp, H. sapiens
tctagctcaaggttta

SEQ ID NO: 138453 - DNA, 20 bp, H. sapiens
tctagctcaaggtttgtaaa

SEQ ID NO: 138454 - DNA, 20 bp, H. sapiens
tctagctcagggattgtaaa

SEQ ID NO: 138455 - DNA, 16 bp, H. sapiens
tctaggaaagaaaaaa

SEQ ID NO: 138456 - DNA, 16 bp, H. sapiens
tctaggaagtgaggag

SEQ ID NO: 138457 - DNA, 16 bp, H. sapiens
tctaggaagttccaaa

SEQ ID NO: 138458 - DNA, 16 bp, H. sapiens
tctaggaatttatcca

SEQ ID NO: 138459 - DNA, 16 bp, H. sapiens
tctaggaatttttttt

SEQ ID NO: 138460 - DNA, 16 bp, H. sapiens
tctaggcactggggat

SEQ ID NO: 138461 - DNA, 16 bp, H. sapiens
tctaggccagcctggc

SEQ ID NO: 138462 - DNA, 16 bp, H. sapiens
tctaggccgggcacag

SEQ ID NO: 138463 - DNA, 16 bp, H. sapiens
tctaggctgggcttgg

SEQ ID NO: 138464 - DNA, 16 bp, H. sapiens
tctagggcagtggttc

SEQ ID NO: 138465 - DNA, 16 bp, H. sapiens
tctaggtgagtcagtg

SEQ ID NO: 138466 - DNA, 16 bp, H. sapiens
tctaggttttctgttt

SEQ ID NO: 138467 - DNA, 16 bp, H. sapiens
tctagtcagcaaatgg

SEQ ID NO: 138468 - DNA, 16 bp, H. sapiens
tctagtcagccatctt

SEQ ID NO: 138469 - DNA, 16 bp, H. sapiens
tctagtcccagctact

SEQ ID NO: 138470 - DNA, 16 bp, H. sapiens
tctagtcctggactct

SEQ ID NO: 138471 - DNA, 16 bp, H. sapiens
tctagtctagtctagt

SEQ ID NO: 138472 - DNA, 16 bp, H. sapiens
tctagtctattattga

SEQ ID NO: 138473 - DNA, 39 bp, H. sapiens
tctagtctctgataaaacagactttaaaccaacaaagat

SEQ ID NO: 138474 - DNA, 16 bp, H. sapiens
tctagtcttgtctgca

SEQ ID NO: 138475 - DNA, 16 bp, H. sapiens
tctagtgaggaagaca

SEQ ID NO: 138476 - DNA, 16 bp, H. sapiens
tctagtgagggagaca

SEQ ID NO: 138477 - DNA, 16 bp, H. sapiens
tctagtggaggagaca

SEQ ID NO: 138478 - DNA, 18 bp, H. sapiens
tctagtggggacttggag

SEQ ID NO: 138479 - DNA, 16 bp, H. sapiens
tctagtgttgatgaaa

SEQ ID NO: 138480 - DNA, 16 bp, H. sapiens
tctagttcatgtgcat

SEQ ID NO: 138481 - DNA, 17 bp, H. sapiens
tctagttccagctactt

SEQ ID NO: 138482 - DNA, 16 bp, H. sapiens
tctagttcttttcatt

SEQ ID NO: 138483 - DNA, 16 bp, H. sapiens
tctagtttcatttcat

SEQ ID NO: 138484 - DNA, 16 bp, H. sapiens
tctagtttctgtctct

SEQ ID NO: 138485 - DNA, 16 bp, H. sapiens
tctagttttatgtgaa

SEQ ID NO: 138486 - DNA, 16 bp, H. sapiens
tctagttttctagttt

SEQ ID NO: 138487 - DNA, 16 bp, H. sapiens
tctagttttgcctttt

SEQ ID NO: 138488 - DNA, 16 bp, H. sapiens
tctagtttttatcttg

SEQ ID NO: 138489 - DNA, 16 bp, H. sapiens
tctataaaatagagat

SEQ ID NO: 138490 - DNA, 16 bp, H. sapiens
tctataaaatgaagaa

SEQ ID NO: 138491 - DNA, 16 bp, H. sapiens
tctataaaatggagac

SEQ ID NO: 138492 - DNA, 16 bp, H. sapiens
tctataaaatggatat

SEQ ID NO: 138493 - DNA, 16 bp, H. sapiens
tctataaaatgggaat

SEQ ID NO: 138494 - DNA, 16 bp, H. sapiens
tctataaacagctgct

SEQ ID NO: 138495 - DNA, 16 bp, H. sapiens
tctataaagccagtat

SEQ ID NO: 138496 - DNA, 16 bp, H. sapiens
tctataaatacatatt

SEQ ID NO: 138497 - DNA, 16 bp, H. sapiens
tctataaatatataca

SEQ ID NO: 138498 - DNA, 16 bp, H. sapiens
tctataaatatgtatt

SEQ ID NO: 138499 - DNA, 16 bp, H. sapiens
tctataaatatttgtt

SEQ ID NO: 138500 - DNA, 16 bp, H. sapiens
tctataaatttgttct

SEQ ID NO: 138501 - DNA, 16 bp, H. sapiens
tctataaggaaattaa

SEQ ID NO: 138502 - DNA, 16 bp, H. sapiens
tctataatttccattt

SEQ ID NO: 138503 - DNA, 16 bp, H. sapiens
tctataattttgcctt

SEQ ID NO: 138504 - DNA, 16 bp, H. sapiens
tctatacatttaaaaa

SEQ ID NO: 138505 - DNA, 16 bp, H. sapiens
tctatagagatagaaa

SEQ ID NO: 138506 - DNA, 16 bp, H. sapiens
tctatataatggaata

SEQ ID NO: 138507 - DNA, 16 bp, H. sapiens
tctatatatgtatata

SEQ ID NO: 138508 - DNA, 16 bp, H. sapiens
tctatatatgtattat

SEQ ID NO: 138509 - DNA, 16 bp, H. sapiens
tctatatatgtgtttt

SEQ ID NO: 138510 - DNA, 16 bp, H. sapiens
tctatatctctatcta

SEQ ID NO: 138511 - DNA, 16 bp, H. sapiens
tctatatgtaatatat

SEQ ID NO: 138512 - DNA, 16 bp, H. sapiens
tctatatgtatatcta

SEQ ID NO: 138513 - DNA, 16 bp, H. sapiens
tctatatgtatgtgtg

SEQ ID NO: 138514 - DNA, 16 bp, H. sapiens
tctatattttggaata

SEQ ID NO: 138515 - DNA, 16 bp, H. sapiens
tctatcaaaagaatgg

SEQ ID NO: 138516 - DNA, 16 bp, H. sapiens
tctatcaacaggtgaa

SEQ ID NO: 138517 - DNA, 16 bp, H. sapiens
tctatcaccatagatt

SEQ ID NO: 138518 - DNA, 16 bp, H. sapiens
tctatcagcagatgaa

SEQ ID NO: 138519 - DNA, 16 bp, H. sapiens
tctatcagcagcatga

SEQ ID NO: 138520 - DNA, 17 bp, H. sapiens
tctatccaccttggcct

SEQ ID NO: 138521 - DNA, 16 bp, H. sapiens
tctatccatttattca

SEQ ID NO: 138522 - DNA, 16 bp, H. sapiens
tctatcctggagaatg

SEQ ID NO: 138523 - DNA, 16 bp, H. sapiens
tctatcctgggcaaca

SEQ ID NO: 138524 - DNA, 16 bp, H. sapiens
tctatcctgtttcatt

SEQ ID NO: 138525 - DNA, 16 bp, H. sapiens
tctatctacctatcta

SEQ ID NO: 138526 - DNA, 16 bp, H. sapiens
tctatctatatatcat

SEQ ID NO: 138527 - DNA, 17 bp, H. sapiens
tctatctatctatctaa

SEQ ID NO: 138528 - DNA, 18 bp, H. sapiens
tctatctatctatctatc

SEQ ID NO: 138529 - DNA, 18 bp, H. sapiens
tctatctatctatctatg

SEQ ID NO: 138530 - DNA, 16 bp, H. sapiens
tctatctatttatcta

SEQ ID NO: 138531 - DNA, 16 bp, H. sapiens
tctatctcatctatct

SEQ ID NO: 138532 - DNA, 16 bp, H. sapiens
tctatctgtgtgtgtg

SEQ ID NO: 138533 - DNA, 16 bp, H. sapiens
tctatcttcaaaatat

SEQ ID NO: 138534 - DNA, 16 bp, H. sapiens
tctatcttggctcact

SEQ ID NO: 138535 - DNA, 16 bp, H. sapiens
tctatctttgcttttg

SEQ ID NO: 138536 - DNA, 16 bp, H. sapiens
tctatcttttggcttt

SEQ ID NO: 138537 - DNA, 16 bp, H. sapiens
tctatgaaaataaaaa

SEQ ID NO: 138538 - DNA, 16 bp, H. sapiens
tctatgaaagaaaaaa

SEQ ID NO: 138539 - DNA, 16 bp, H. sapiens
tctatgaagacagaaa

SEQ ID NO: 138540 - DNA, 16 bp, H. sapiens
tctatgaatttgatta

SEQ ID NO: 138541 - DNA, 16 bp, H. sapiens
tctatgaatttggcta

SEQ ID NO: 138542 - DNA, 16 bp, H. sapiens
tctatgactcattggc

SEQ ID NO: 138543 - DNA, 16 bp, H. sapiens
tctatgatttatttca

SEQ ID NO: 138544 - DNA, 16 bp, H. sapiens
tctatgatttctttca

SEQ ID NO: 138545 - DNA, 16 bp, H. sapiens
tctatgcagcctcagg

SEQ ID NO: 138546 - DNA, 16 bp, H. sapiens
tctatggccaattgat

SEQ ID NO: 138547 - DNA, 16 bp, H. sapiens
tctatggctgctgtaa

SEQ ID NO: 138548 - DNA, 16 bp, H. sapiens
tctatgggtcaggaat

SEQ ID NO: 138549 - DNA, 16 bp, H. sapiens
tctatgggttgtctct

SEQ ID NO: 138550 - DNA, 16 bp, H. sapiens
tctatgtatattctat

SEQ ID NO: 138551 - DNA, 16 bp, H. sapiens
tctatgtattttgtta

SEQ ID NO: 138552 - DNA, 16 bp, H. sapiens
tctatgtctgtcttta

SEQ ID NO: 138553 - DNA, 16 bp, H. sapiens
tctatgtgtctgtttt

SEQ ID NO: 138554 - DNA, 16 bp, H. sapiens
tctatgtgtgtgtctg

SEQ ID NO: 138555 - DNA, 16 bp, H. sapiens
tctatgtgttcatgtg

SEQ ID NO: 138556 - DNA, 16 bp, H. sapiens
tctatgtttaaatttt

SEQ ID NO: 138557 - DNA, 16 bp, H. sapiens
tctatgtttaagtttt

SEQ ID NO: 138558 - DNA, 16 bp, H. sapiens
tctattaaaaacaaac

SEQ ID NO: 138559 - DNA, 16 bp, H. sapiens
tctattaaaaatacag

SEQ ID NO: 138560 - DNA, 17 bp, H. sapiens
tctattaagaatacaaa

SEQ ID NO: 138561 - DNA, 16 bp, H. sapiens
tctattaagccagaca

SEQ ID NO: 138562 - DNA, 18 bp, H. sapiens
tctattaggttggtgcaa

SEQ ID NO: 138563 - DNA, 17 bp, H. sapiens
tctattataaagataca

SEQ ID NO: 138564 - DNA, 16 bp, H. sapiens
tctattcaaagttatc

SEQ ID NO: 138565 - DNA, 16 bp, H. sapiens
tctattcagatatttt

SEQ ID NO: 138566 - DNA, 16 bp, H. sapiens
tctattcatccaccca

SEQ ID NO: 138567 - DNA, 16 bp, H. sapiens
tctattccattctcca

SEQ ID NO: 138568 - DNA, 16 bp, H. sapiens
tctattctctctgaaa

SEQ ID NO: 138569 - DNA, 16 bp, H. sapiens
tctattctctctgaag

SEQ ID NO: 138570 - DNA, 16 bp, H. sapiens
tctattctgaacattt

SEQ ID NO: 138571 - DNA, 16 bp, H. sapiens
tctattctggatatta

SEQ ID NO: 138572 - DNA, 16 bp, H. sapiens
tctattctggatattt

SEQ ID NO: 138573 - DNA, 16 bp, H. sapiens
tctattctgttggtct

SEQ ID NO: 138574 - DNA, 16 bp, H. sapiens
tctattgaattgcctt

SEQ ID NO: 138575 - DNA, 28 bp, H. sapiens
tctattgagataatcatgtggtttttgt

SEQ ID NO: 138576 - DNA, 16 bp, H. sapiens
tctattgagatagtca

SEQ ID NO: 138577 - DNA, 16 bp, H. sapiens
tctattgagcacctac

SEQ ID NO: 138578 - DNA, 16 bp, H. sapiens
tctattgccaggctgg

SEQ ID NO: 138579 - DNA, 16 bp, H. sapiens
tctattgccctggctg

SEQ ID NO: 138580 - DNA, 16 bp, H. sapiens
tctattgctttttctc

SEQ ID NO: 138581 - DNA, 16 bp, H. sapiens
tctattgtaaatggga

SEQ ID NO: 138582 - DNA, 16 bp, H. sapiens
tctattgttgtcatct

SEQ ID NO: 138583 - DNA, 16 bp, H. sapiens
tctatttaaagaaaaa

SEQ ID NO: 138584 - DNA, 16 bp, H. sapiens
tctatttacataaaat

SEQ ID NO: 138585 - DNA, 16 bp, H. sapiens
tctatttatctctatc

SEQ ID NO: 138586 - DNA, 16 bp, H. sapiens
tctatttcctaaatat

SEQ ID NO: 138587 - DNA, 16 bp, H. sapiens
tctatttcctcttctg

SEQ ID NO: 138588 - DNA, 16 bp, H. sapiens
tctatttctatgagat

SEQ ID NO: 138589 - DNA, 16 bp, H. sapiens
tctatttctcccttca

SEQ ID NO: 138590 - DNA, 16 bp, H. sapiens
tctatttctgggcttt

SEQ ID NO: 138591 - DNA, 16 bp, H. sapiens
tctatttctgtctctg

SEQ ID NO: 138592 - DNA, 16 bp, H. sapiens
tctatttcttcttgat

SEQ ID NO: 138593 - DNA, 16 bp, H. sapiens
tctatttcttcttgta

SEQ ID NO: 138594 - DNA, 16 bp, H. sapiens
tctatttcttgacttt

SEQ ID NO: 138595 - DNA, 16 bp, H. sapiens
tctatttgattccatt

SEQ ID NO: 138596 - DNA, 16 bp, H. sapiens
tctatttgctaatatt

SEQ ID NO: 138597 - DNA, 16 bp, H. sapiens
tctatttggaatttat

SEQ ID NO: 138598 - DNA, 16 bp, H. sapiens
tctatttggccatctt

SEQ ID NO: 138599 - DNA, 16 bp, H. sapiens
tctatttgtctgtctt

SEQ ID NO: 138600 - DNA, 16 bp, H. sapiens
tctatttgtctgttct

SEQ ID NO: 138601 - DNA, 16 bp, H. sapiens
tctattttaaagataa

SEQ ID NO: 138602 - DNA, 16 bp, H. sapiens
tctattttacagaaga

SEQ ID NO: 138603 - DNA, 16 bp, H. sapiens
tctattttctcagtga

SEQ ID NO: 138604 - DNA, 16 bp, H. sapiens
tctattttctctgata

SEQ ID NO: 138605 - DNA, 16 bp, H. sapiens
tctattttgaaataaa

SEQ ID NO: 138606 - DNA, 16 bp, H. sapiens
tctattttgtctgata

SEQ ID NO: 138607 - DNA, 16 bp, H. sapiens
tctattttgttccatt

SEQ ID NO: 138608 - DNA, 16 bp, H. sapiens
tctatttttactagag

SEQ ID NO: 138609 - DNA, 16 bp, H. sapiens
tctatttttctactca

SEQ ID NO: 138610 - DNA, 16 bp, H. sapiens
tctatttttgtaaaaa

SEQ ID NO: 138611 - DNA, 16 bp, H. sapiens
tctatttttgtatcag

SEQ ID NO: 138612 - DNA, 16 bp, H. sapiens
tctatttttgtgtgtg

SEQ ID NO: 138613 - DNA, 16 bp, H. sapiens
tctcaaaaaaaaagta

SEQ ID NO: 138614 - DNA, 16 bp, H. sapiens
tctcaaaaaaaagaag

SEQ ID NO: 138615 - DNA, 16 bp, H. sapiens
tctcaaaaaaaattgt

SEQ ID NO: 138616 - DNA, 16 bp, H. sapiens
tctcaaaaaaagaaga

SEQ ID NO: 138617 - DNA, 16 bp, H. sapiens
tctcaaaaaagaaaga

SEQ ID NO: 138618 - DNA, 16 bp, H. sapiens
tctcaaaaaagaaata

SEQ ID NO: 138619 - DNA, 16 bp, H. sapiens
tctcaaaaaatgaaat

SEQ ID NO: 138620 - DNA, 16 bp, H. sapiens
tctcaaaaaatgtata

SEQ ID NO: 138621 - DNA, 16 bp, H. sapiens
tctcaaaaacagaaca

SEQ ID NO: 138622 - DNA, 16 bp, H. sapiens
tctcaaaaacataatg

SEQ ID NO: 138623 - DNA, 16 bp, H. sapiens
tctcaaaaacatatat

SEQ ID NO: 138624 - DNA, 16 bp, H. sapiens
tctcaaaaacatgatg

SEQ ID NO: 138625 - DNA, 16 bp, H. sapiens
tctcaaaaagagaaaa

SEQ ID NO: 138626 - DNA, 16 bp, H. sapiens
tctcaaaacaaacgaa

SEQ ID NO: 138627 - DNA, 16 bp, H. sapiens
tctcaaaacacatttt

SEQ ID NO: 138628 - DNA, 16 bp, H. sapiens
tctcaaaacgaaacaa

SEQ ID NO: 138629 - DNA, 16 bp, H. sapiens
tctcaaaagaaaataa

SEQ ID NO: 138630 - DNA, 16 bp, H. sapiens
tctcaaaagagaaaaa

SEQ ID NO: 138631 - DNA, 16 bp, H. sapiens
tctcaaaagtcaaaga

SEQ ID NO: 138632 - DNA, 16 bp, H. sapiens
tctcaaaagttttttt

SEQ ID NO: 138633 - DNA, 16 bp, H. sapiens
tctcaaaatatattat

SEQ ID NO: 138634 - DNA, 16 bp, H. sapiens
tctcaaaatcaaaaca

SEQ ID NO: 138635 - DNA, 16 bp, H. sapiens
tctcaaacaccaaaag

SEQ ID NO: 138636 - DNA, 16 bp, H. sapiens
tctcaaacattaatgt

SEQ ID NO: 138637 - DNA, 16 bp, H. sapiens
tctcaaacctgctgtg

SEQ ID NO: 138638 - DNA, 23 bp, H. sapiens
tctcaaactcctgacctcaggta

SEQ ID NO: 138639 - DNA, 19 bp, H. sapiens
tctcaaactcctgacctcg

SEQ ID NO: 138640 - DNA, 16 bp, H. sapiens
tctcaaactcctgact

SEQ ID NO: 138641 - DNA, 16 bp, H. sapiens
tctcaaactccttggc

SEQ ID NO: 138642 - DNA, 16 bp, H. sapiens
tctcaaactgctggac

SEQ ID NO: 138643 - DNA, 16 bp, H. sapiens
tctcaaactgtctttt

SEQ ID NO: 138644 - DNA, 16 bp, H. sapiens
tctcaaagaaaaaaag

SEQ ID NO: 138645 - DNA, 16 bp, H. sapiens
tctcaaagaaaaaaga

SEQ ID NO: 138646 - DNA, 16 bp, H. sapiens
tctcaaagaaaagaaa

SEQ ID NO: 138647 - DNA, 16 bp, H. sapiens
tctcaaagaaaggaaa

SEQ ID NO: 138648 - DNA, 16 bp, H. sapiens
tctcaaagaaattaaa

SEQ ID NO: 138649 - DNA, 16 bp, H. sapiens
tctcaaagaacttcaa

SEQ ID NO: 138650 - DNA, 16 bp, H. sapiens
tctcaaagaagaaaaa

SEQ ID NO: 138651 - DNA, 16 bp, H. sapiens
tctcaaagaagaagaa

SEQ ID NO: 138652 - DNA, 16 bp, H. sapiens
tctcaaagaagacatt

SEQ ID NO: 138653 - DNA, 16 bp, H. sapiens
tctcaaagaagtttct

SEQ ID NO: 138654 - DNA, 16 bp, H. sapiens
tctcaaagcaaacaaa

SEQ ID NO: 138655 - DNA, 16 bp, H. sapiens
tctcaaaggaaaaaaa

SEQ ID NO: 138656 - DNA, 16 bp, H. sapiens
tctcaaaggacttaaa

SEQ ID NO: 138657 - DNA, 16 bp, H. sapiens
tctcaaagggacagag

SEQ ID NO: 138658 - DNA, 17 bp, H. sapiens
tctcaaagtgctaggat

SEQ ID NO: 138659 - DNA, 16 bp, H. sapiens
tctcaaataactaaaa

SEQ ID NO: 138660 - DNA, 16 bp, H. sapiens
tctcaaatatatatgt

SEQ ID NO: 138661 - DNA, 16 bp, H. sapiens
tctcaaatcctgacct

SEQ ID NO: 138662 - DNA, 16 bp, H. sapiens
tctcaaatgaagaaaa

SEQ ID NO: 138663 - DNA, 16 bp, H. sapiens
tctcaaatgacagaat

SEQ ID NO: 138664 - DNA, 16 bp, H. sapiens
tctcaaatgtcttcag

SEQ ID NO: 138665 - DNA, 16 bp, H. sapiens
tctcaaattccttcag

SEQ ID NO: 138666 - DNA, 16 bp, H. sapiens
tctcaaatttatatct

SEQ ID NO: 138667 - DNA, 16 bp, H. sapiens
tctcaacaaaaaaaag

SEQ ID NO: 138668 - DNA, 16 bp, H. sapiens
tctcaacaaaaaattt

SEQ ID NO: 138669 - DNA, 16 bp, H. sapiens
tctcaacaaaatagta

SEQ ID NO: 138670 - DNA, 16 bp, H. sapiens
tctcaacacagcagcc

SEQ ID NO: 138671 - DNA, 16 bp, H. sapiens
tctcaacctcaacact

SEQ ID NO: 138672 - DNA, 16 bp, H. sapiens
tctcaacctcccaagt

SEQ ID NO: 138673 - DNA, 16 bp, H. sapiens
tctcaaccttggctgc

SEQ ID NO: 138674 - DNA, 17 bp, H. sapiens
tctcaactgcaagaggc

SEQ ID NO: 138675 - DNA, 16 bp, H. sapiens
tctcaactgggggcaa

SEQ ID NO: 138676 - DNA, 16 bp, H. sapiens
tctcaagaaaagaaaa

SEQ ID NO: 138677 - DNA, 16 bp, H. sapiens
tctcaagaaagaaaaa

SEQ ID NO: 138678 - DNA, 16 bp, H. sapiens
tctcaagaaatatttg

SEQ ID NO: 138679 - DNA, 16 bp, H. sapiens
tctcaagagaagatat

SEQ ID NO: 138680 - DNA, 16 bp, H. sapiens
tctcaagatttttttt

SEQ ID NO: 138681 - DNA, 18 bp, H. sapiens
tctcaagcacctaagaac

SEQ ID NO: 138682 - DNA, 16 bp, H. sapiens
tctcaagcatttatcc

SEQ ID NO: 138683 - DNA, 16 bp, H. sapiens
tctcaagctcctgggt

SEQ ID NO: 138684 - DNA, 16 bp, H. sapiens
tctcaaggacctggga

SEQ ID NO: 138685 - DNA, 16 bp, H. sapiens
tctcaaggagtttaca

SEQ ID NO: 138686 - DNA, 16 bp, H. sapiens
tctcaaggtgctggga

SEQ ID NO: 138687 - DNA, 16 bp, H. sapiens
tctcaagtaaaataaa

SEQ ID NO: 138688 - DNA, 16 bp, H. sapiens
tctcaagtagctggta

SEQ ID NO: 138689 - DNA, 16 bp, H. sapiens
tctcaagttcaaagtt

SEQ ID NO: 138690 - DNA, 16 bp, H. sapiens
tctcaagttcaaggag

SEQ ID NO: 138691 - DNA, 16 bp, H. sapiens
tctcaagtttttaaaa

SEQ ID NO: 138692 - DNA, 16 bp, H. sapiens
tctcaataaaagaaaa

SEQ ID NO: 138693 - DNA, 16 bp, H. sapiens
tctcaataaatggtgc

SEQ ID NO: 138694 - DNA, 16 bp, H. sapiens
tctcaatagatgaaga

SEQ ID NO: 138695 - DNA, 16 bp, H. sapiens
tctcaatccagacccc

SEQ ID NO: 138696 - DNA, 19 bp, H. sapiens
tctcaatctcctgacctca

SEQ ID NO: 138697 - DNA, 16 bp, H. sapiens
tctcaatcttttggaa

SEQ ID NO: 138698 - DNA, 16 bp, H. sapiens
tctcaatttaaaaaga

SEQ ID NO: 138699 - DNA, 16 bp, H. sapiens
tctcaatttctttatc

SEQ ID NO: 138700 - DNA, 16 bp, H. sapiens
tctcacaaattttgat

SEQ ID NO: 138701 - DNA, 16 bp, H. sapiens
tctcacaagatctgat

SEQ ID NO: 138702 - DNA, 16 bp, H. sapiens
tctcacaatatctgat

SEQ ID NO: 138703 - DNA, 16 bp, H. sapiens
tctcacaatgttgcct

SEQ ID NO: 138704 - DNA, 16 bp, H. sapiens
tctcacacacacacac

SEQ ID NO: 138705 - DNA, 16 bp, H. sapiens
tctcacacacacacag

SEQ ID NO: 138706 - DNA, 17 bp, H. sapiens
tctcacacaggggagac

SEQ ID NO: 138707 - DNA, 16 bp, H. sapiens
tctcacaccacaacaa

SEQ ID NO: 138708 - DNA, 16 bp, H. sapiens
tctcacaccatcccac

SEQ ID NO: 138709 - DNA, 16 bp, H. sapiens
tctcacacctgtaatt

SEQ ID NO: 138710 - DNA, 16 bp, H. sapiens
tctcacagcagccctg

SEQ ID NO: 138711 - DNA, 16 bp, H. sapiens
tctcacagctccatta

SEQ ID NO: 138712 - DNA, 16 bp, H. sapiens
tctcacaggctggagt

SEQ ID NO: 138713 - DNA, 16 bp, H. sapiens
tctcacagttctgagg

SEQ ID NO: 138714 - DNA, 16 bp, H. sapiens
tctcacagttcttgga

SEQ ID NO: 138715 - DNA, 16 bp, H. sapiens
tctcacagtttctgtg

SEQ ID NO: 138716 - DNA, 16 bp, H. sapiens
tctcacatccaggtca

SEQ ID NO: 138717 - DNA, 16 bp, H. sapiens
tctcacatctccacta

SEQ ID NO: 138718 - DNA, 16 bp, H. sapiens
tctcacatggcggcag

SEQ ID NO: 138719 - DNA, 16 bp, H. sapiens
tctcacattttcctat

SEQ ID NO: 138720 - DNA, 16 bp, H. sapiens
tctcaccaaagaagat

SEQ ID NO: 138721 - DNA, 16 bp, H. sapiens
tctcaccactcctgtt

SEQ ID NO: 138722 - DNA, 16 bp, H. sapiens
tctcaccactgcaccc

SEQ ID NO: 138723 - DNA, 16 bp, H. sapiens
tctcaccacttctttt

SEQ ID NO: 138724 - DNA, 16 bp, H. sapiens
tctcaccaggctggag

SEQ ID NO: 138725 - DNA, 16 bp, H. sapiens
tctcaccatataaaaa

SEQ ID NO: 138726 - DNA, 16 bp, H. sapiens
tctcaccatttctatt

SEQ ID NO: 138727 - DNA, 16 bp, H. sapiens
tctcaccattttgccc

SEQ ID NO: 138728 - DNA, 16 bp, H. sapiens
tctcacccagcctgga

SEQ ID NO: 138729 - DNA, 16 bp, H. sapiens
tctcaccccagggcct

SEQ ID NO: 138730 - DNA, 16 bp, H. sapiens
tctcaccctgtccccc

SEQ ID NO: 138731 - DNA, 16 bp, H. sapiens
tctcacctcagccccc

SEQ ID NO: 138732 - DNA, 16 bp, H. sapiens
tctcacctcagtctcc

SEQ ID NO: 138733 - DNA, 16 bp, H. sapiens
tctcacctctgcctcc

SEQ ID NO: 138734 - DNA, 16 bp, H. sapiens
tctcacctctgtctcc

SEQ ID NO: 138735 - DNA, 16 bp, H. sapiens
tctcacctggattcct

SEQ ID NO: 138736 - DNA, 16 bp, H. sapiens
tctcacctttaattgt

SEQ ID NO: 138737 - DNA, 16 bp, H. sapiens
tctcacgagatctggt

SEQ ID NO: 138738 - DNA, 17 bp, H. sapiens
tctcacgtctccctaaa

SEQ ID NO: 138739 - DNA, 16 bp, H. sapiens
tctcactatgtggccc

SEQ ID NO: 138740 - DNA, 16 bp, H. sapiens
tctcactatgttacct

SEQ ID NO: 138741 - DNA, 16 bp, H. sapiens
tctcactatgttgttg

SEQ ID NO: 138742 - DNA, 16 bp, H. sapiens
tctcactcagtcaccc

SEQ ID NO: 138743 - DNA, 16 bp, H. sapiens
tctcactctctcactc

SEQ ID NO: 138744 - DNA, 16 bp, H. sapiens
tctcactctctctgtc

SEQ ID NO: 138745 - DNA, 16 bp, H. sapiens
tctcactctcttgctc

SEQ ID NO: 138746 - DNA, 16 bp, H. sapiens
tctcactctcttgtcc

SEQ ID NO: 138747 - DNA, 16 bp, H. sapiens
tctcactctgccttat

SEQ ID NO: 138748 - DNA, 16 bp, H. sapiens
tctcactctgctgccc

SEQ ID NO: 138749 - DNA, 16 bp, H. sapiens
tctcactctgtcacca

SEQ ID NO: 138750 - DNA, 16 bp, H. sapiens
tctcactctgtgagtt

SEQ ID NO: 138751 - DNA, 16 bp, H. sapiens
tctcactctgtgcccc

SEQ ID NO: 138752 - DNA, 16 bp, H. sapiens
tctcactctgtgtgtg

SEQ ID NO: 138753 - DNA, 16 bp, H. sapiens
tctcactgcaacctcc

SEQ ID NO: 138754 - DNA, 16 bp, H. sapiens
tctcactgcaacctct

SEQ ID NO: 138755 - DNA, 16 bp, H. sapiens
tctcactgcaagctct

SEQ ID NO: 138756 - DNA, 16 bp, H. sapiens
tctcactgggtccctc

SEQ ID NO: 138757 - DNA, 16 bp, H. sapiens
tctcactgtctcaccc

SEQ ID NO: 138758 - DNA, 16 bp, H. sapiens
tctcactgtgtttttg

SEQ ID NO: 138759 - DNA, 16 bp, H. sapiens
tctcacttaaaaaaaa

SEQ ID NO: 138760 - DNA, 16 bp, H. sapiens
tctcacttaaaagtga

SEQ ID NO: 138761 - DNA, 16 bp, H. sapiens
tctcacttaatcctca

SEQ ID NO: 138762 - DNA, 16 bp, H. sapiens
tctcacttcacttttc

SEQ ID NO: 138763 - DNA, 16 bp, H. sapiens
tctcacttgatcctca

SEQ ID NO: 138764 - DNA, 16 bp, H. sapiens
tctcactttgggccac

SEQ ID NO: 138765 - DNA, 16 bp, H. sapiens
tctcactttgttgacc

SEQ ID NO: 138766 - DNA, 16 bp, H. sapiens
tctcacttttaagtga

SEQ ID NO: 138767 - DNA, 16 bp, H. sapiens
tctcagaaaaaggaaa

SEQ ID NO: 138768 - DNA, 16 bp, H. sapiens
tctcagaaaatatatt

SEQ ID NO: 138769 - DNA, 16 bp, H. sapiens
tctcagaaacttctct

SEQ ID NO: 138770 - DNA, 16 bp, H. sapiens
tctcagaaagaaaaga

SEQ ID NO: 138771 - DNA, 16 bp, H. sapiens
tctcagaaagagaaga

SEQ ID NO: 138772 - DNA, 16 bp, H. sapiens
tctcagaaagttttct

SEQ ID NO: 138773 - DNA, 16 bp, H. sapiens
tctcagaaattaccac

SEQ ID NO: 138774 - DNA, 16 bp, H. sapiens
tctcagaacaaaacaa

SEQ ID NO: 138775 - DNA, 16 bp, H. sapiens
tctcagaactgtggtg

SEQ ID NO: 138776 - DNA, 16 bp, H. sapiens
tctcagaagaaactct

SEQ ID NO: 138777 - DNA, 16 bp, H. sapiens
tctcagaaggaaagaa

SEQ ID NO: 138778 - DNA, 16 bp, H. sapiens
tctcagaatgcttttg

SEQ ID NO: 138779 - DNA, 16 bp, H. sapiens
tctcagaattggaaaa

SEQ ID NO: 138780 - DNA, 16 bp, H. sapiens
tctcagacagaaatga

SEQ ID NO: 138781 - DNA, 16 bp, H. sapiens
tctcagactcctgggt

SEQ ID NO: 138782 - DNA, 16 bp, H. sapiens
tctcagagacttcttt

SEQ ID NO: 138783 - DNA, 16 bp, H. sapiens
tctcagagagaatgct

SEQ ID NO: 138784 - DNA, 16 bp, H. sapiens
tctcagagggaaaaaa

SEQ ID NO: 138785 - DNA, 16 bp, H. sapiens
tctcagagttgaacct

SEQ ID NO: 138786 - DNA, 16 bp, H. sapiens
tctcagagtttctgtg

SEQ ID NO: 138787 - DNA, 16 bp, H. sapiens
tctcagatattttgtt

SEQ ID NO: 138788 - DNA, 16 bp, H. sapiens
tctcagatctccagct

SEQ ID NO: 138789 - DNA, 16 bp, H. sapiens
tctcagatgaagatga

SEQ ID NO: 138790 - DNA, 16 bp, H. sapiens
tctcagatgagactgt

SEQ ID NO: 138791 - DNA, 16 bp, H. sapiens
tctcagatgagacttt

SEQ ID NO: 138792 - DNA, 16 bp, H. sapiens
tctcagatggagatga

SEQ ID NO: 138793 - DNA, 16 bp, H. sapiens
tctcagatttctttga

SEQ ID NO: 138794 - DNA, 16 bp, H. sapiens
tctcagcaacttggga

SEQ ID NO: 138795 - DNA, 16 bp, H. sapiens
tctcagcaataaaaag

SEQ ID NO: 138796 - DNA, 16 bp, H. sapiens
tctcagcaatttggga

SEQ ID NO: 138797 - DNA, 16 bp, H. sapiens
tctcagcacactgcag

SEQ ID NO: 138798 - DNA, 16 bp, H. sapiens
tctcagcagaaacact

SEQ ID NO: 138799 - DNA, 16 bp, H. sapiens
tctcagcagaaacctt

SEQ ID NO: 138800 - DNA, 16 bp, H. sapiens
tctcagcagaagccag

SEQ ID NO: 138801 - DNA, 16 bp, H. sapiens
tctcagcagagaggag

SEQ ID NO: 138802 - DNA, 16 bp, H. sapiens
tctcagcagagcagcc

SEQ ID NO: 138803 - DNA, 16 bp, H. sapiens
tctcagcagatgcaga

SEQ ID NO: 138804 - DNA, 16 bp, H. sapiens
tctcagcagcatttga

SEQ ID NO: 138805 - DNA, 16 bp, H. sapiens
tctcagcatttgtttt

SEQ ID NO: 138806 - DNA, 16 bp, H. sapiens
tctcagccaggctggt

SEQ ID NO: 138807 - DNA, 16 bp, H. sapiens
tctcagcccaaaaact

SEQ ID NO: 138808 - DNA, 29 bp, H. sapiens
tctcagcccaaaacctccttaagctgata

SEQ ID NO: 138809 - DNA, 29 bp, H. sapiens
tctcagcccaaaatctccttaagctcata

SEQ ID NO: 138810 - DNA, 29 bp, H. sapiens
tctcagcccaaaatctccttaagctgata

SEQ ID NO: 138811 - DNA, 29 bp, H. sapiens
tctcagcccaaaatctctttaagctgata

SEQ ID NO: 138812 - DNA, 16 bp, H. sapiens
tctcagcccaaactct

SEQ ID NO: 138813 - DNA, 29 bp, H. sapiens
tctcagcccaaagtctccttaagctgata

SEQ ID NO: 138814 - DNA, 16 bp, H. sapiens
tctcagcccacaatct

SEQ ID NO: 138815 - DNA, 16 bp, H. sapiens
tctcagcccactgact

SEQ ID NO: 138816 - DNA, 16 bp, H. sapiens
tctcagcccactgcag

SEQ ID NO: 138817 - DNA, 16 bp, H. sapiens
tctcagcccagttcag

SEQ ID NO: 138818 - DNA, 16 bp, H. sapiens
tctcagccctgctcac

SEQ ID NO: 138819 - DNA, 16 bp, H. sapiens
tctcagcctacatctt

SEQ ID NO: 138820 - DNA, 16 bp, H. sapiens
tctcagcctcaatttc

SEQ ID NO: 138821 - DNA, 16 bp, H. sapiens
tctcagcctcatttta

SEQ ID NO: 138822 - DNA, 16 bp, H. sapiens
tctcagcctccagctt

SEQ ID NO: 138823 - DNA, 21 bp, H. sapiens
tctcagcctcccaaagtgcta

SEQ ID NO: 138824 - DNA, 18 bp, H. sapiens
tctcagcctcccaagtaa

SEQ ID NO: 138825 - DNA, 16 bp, H. sapiens
tctcagcctcccacag

SEQ ID NO: 138826 - DNA, 16 bp, H. sapiens
tctcagcctcccaggt

SEQ ID NO: 138827 - DNA, 16 bp, H. sapiens
tctcagcctcctgagc

SEQ ID NO: 138828 - DNA, 16 bp, H. sapiens
tctcagcctctcaaaa

SEQ ID NO: 138829 - DNA, 16 bp, H. sapiens
tctcagcctctggagt

SEQ ID NO: 138830 - DNA, 17 bp, H. sapiens
tctcagcctcttgagta

SEQ ID NO: 138831 - DNA, 16 bp, H. sapiens
tctcagcctggttcag

SEQ ID NO: 138832 - DNA, 16 bp, H. sapiens
tctcagccttatttta

SEQ ID NO: 138833 - DNA, 16 bp, H. sapiens
tctcagccttcaaaga

SEQ ID NO: 138834 - DNA, 16 bp, H. sapiens
tctcagccttcatctt

SEQ ID NO: 138835 - DNA, 16 bp, H. sapiens
tctcagctatttggaa

SEQ ID NO: 138836 - DNA, 16 bp, H. sapiens
tctcagctcacagcag

SEQ ID NO: 138837 - DNA, 16 bp, H. sapiens
tctcagctcaccacag

SEQ ID NO: 138838 - DNA, 16 bp, H. sapiens
tctcagctcaccgcca

SEQ ID NO: 138839 - DNA, 16 bp, H. sapiens
tctcagctcagtgcag

SEQ ID NO: 138840 - DNA, 21 bp, H. sapiens
tctcagctcattgcaacctcc

SEQ ID NO: 138841 - DNA, 16 bp, H. sapiens
tctcagctccatctcc

SEQ ID NO: 138842 - DNA, 16 bp, H. sapiens
tctcagctccctgcaa

SEQ ID NO: 138843 - DNA, 16 bp, H. sapiens
tctcagctctgcctcc

SEQ ID NO: 138844 - DNA, 16 bp, H. sapiens
tctcagctctgctttc

SEQ ID NO: 138845 - DNA, 16 bp, H. sapiens
tctcagctctggaggc

SEQ ID NO: 138846 - DNA, 16 bp, H. sapiens
tctcagctgaaaccct

SEQ ID NO: 138847 - DNA, 16 bp, H. sapiens
tctcagctgactgtaa

SEQ ID NO: 138848 - DNA, 25 bp, H. sapiens
tctcagcttacctccatatcctagc

SEQ ID NO: 138849 - DNA, 16 bp, H. sapiens
tctcagcttatgaaga

SEQ ID NO: 138850 - DNA, 16 bp, H. sapiens
tctcagcttcatttta

SEQ ID NO: 138851 - DNA, 16 bp, H. sapiens
tctcagcttcccaagt

SEQ ID NO: 138852 - DNA, 16 bp, H. sapiens
tctcagctttccaaag

SEQ ID NO: 138853 - DNA, 16 bp, H. sapiens
tctcaggaaaacaaaa

SEQ ID NO: 138854 - DNA, 16 bp, H. sapiens
tctcaggaaggtggaa

SEQ ID NO: 138855 - DNA, 16 bp, H. sapiens
tctcaggacccccaaa

SEQ ID NO: 138856 - DNA, 16 bp, H. sapiens
tctcaggagctgggtg

SEQ ID NO: 138857 - DNA, 16 bp, H. sapiens
tctcaggaggagggag

SEQ ID NO: 138858 - DNA, 16 bp, H. sapiens
tctcaggagttcgaga

SEQ ID NO: 138859 - DNA, 16 bp, H. sapiens
tctcaggatagaaaat

SEQ ID NO: 138860 - DNA, 16 bp, H. sapiens
tctcaggccaggcaca

SEQ ID NO: 138861 - DNA, 16 bp, H. sapiens
tctcaggccccacccc

SEQ ID NO: 138862 - DNA, 16 bp, H. sapiens
tctcaggccgggcacg

SEQ ID NO: 138863 - DNA, 16 bp, H. sapiens
tctcaggcctttggcc

SEQ ID NO: 138864 - DNA, 16 bp, H. sapiens
tctcaggctacaaaat

SEQ ID NO: 138865 - DNA, 16 bp, H. sapiens
tctcaggctgcagtta

SEQ ID NO: 138866 - DNA, 16 bp, H. sapiens
tctcaggcttccagcc

SEQ ID NO: 138867 - DNA, 16 bp, H. sapiens
tctcagggaataggga

SEQ ID NO: 138868 - DNA, 16 bp, H. sapiens
tctcagggatggcaga

SEQ ID NO: 138869 - DNA, 16 bp, H. sapiens
tctcagggcctttgca

SEQ ID NO: 138870 - DNA, 16 bp, H. sapiens
tctcaggggtagcaga

SEQ ID NO: 138871 - DNA, 16 bp, H. sapiens
tctcaggggtggcaga

SEQ ID NO: 138872 - DNA, 16 bp, H. sapiens
tctcaggtattttctt

SEQ ID NO: 138873 - DNA, 17 bp, H. sapiens
tctcaggtgatctgccc

SEQ ID NO: 138874 - DNA, 21 bp, H. sapiens
tctcaggtgatctgcctgcct

SEQ ID NO: 138875 - DNA, 21 bp, H. sapiens
tctcagtaaactatcgcaagg

SEQ ID NO: 138876 - DNA, 16 bp, H. sapiens
tctcagtagacacaga

SEQ ID NO: 138877 - DNA, 16 bp, H. sapiens
tctcagtcacaatttt

SEQ ID NO: 138878 - DNA, 16 bp, H. sapiens
tctcagtcactttgca

SEQ ID NO: 138879 - DNA, 16 bp, H. sapiens
tctcagtcccccaagt

SEQ ID NO: 138880 - DNA, 16 bp, H. sapiens
tctcagtccctgcctc

SEQ ID NO: 138881 - DNA, 16 bp, H. sapiens
tctcagtctcagtttc

SEQ ID NO: 138882 - DNA, 17 bp, H. sapiens
tctcagtctcctgacct

SEQ ID NO: 138883 - DNA, 16 bp, H. sapiens
tctcagtgctttgaga

SEQ ID NO: 138884 - DNA, 16 bp, H. sapiens
tctcagtggacagagc

SEQ ID NO: 138885 - DNA, 16 bp, H. sapiens
tctcagttaatcttca

SEQ ID NO: 138886 - DNA, 16 bp, H. sapiens
tctcagttctgttcca

SEQ ID NO: 138887 - DNA, 16 bp, H. sapiens
tctcagttgagacttt

SEQ ID NO: 138888 - DNA, 16 bp, H. sapiens
tctcagtttcccaaag

SEQ ID NO: 138889 - DNA, 16 bp, H. sapiens
tctcagtttctcatct

SEQ ID NO: 138890 - DNA, 16 bp, H. sapiens
tctcagtttctttctc

SEQ ID NO: 138891 - DNA, 16 bp, H. sapiens
tctcagttttctcatc

SEQ ID NO: 138892 - DNA, 16 bp, H. sapiens
tctcagttttcttttc

SEQ ID NO: 138893 - DNA, 16 bp, H. sapiens
tctcagtttttccatc

SEQ ID NO: 138894 - DNA, 16 bp, H. sapiens
tctcataaagcttctt

SEQ ID NO: 138895 - DNA, 16 bp, H. sapiens
tctcataaggagcaca

SEQ ID NO: 138896 - DNA, 16 bp, H. sapiens
tctcataatatttcaa

SEQ ID NO: 138897 - DNA, 16 bp, H. sapiens
tctcatactgaaatgt

SEQ ID NO: 138898 - DNA, 16 bp, H. sapiens
tctcataggcagaagg

SEQ ID NO: 138899 - DNA, 16 bp, H. sapiens
tctcatattgttttat

SEQ ID NO: 138900 - DNA, 16 bp, H. sapiens
tctcatatttgcttct

SEQ ID NO: 138901 - DNA, 21 bp, H. sapiens
tctcatcagatgggttttatt

SEQ ID NO: 138902 - DNA, 16 bp, H. sapiens
tctcatcaggtgggac

SEQ ID NO: 138903 - DNA, 16 bp, H. sapiens
tctcatccatatctga

SEQ ID NO: 138904 - DNA, 16 bp, H. sapiens
tctcatcccagcctcc

SEQ ID NO: 138905 - DNA, 16 bp, H. sapiens
tctcatcccatgaggc

SEQ ID NO: 138906 - DNA, 16 bp, H. sapiens
tctcatctataaaatg

SEQ ID NO: 138907 - DNA, 16 bp, H. sapiens
tctcatctcagcctcc

SEQ ID NO: 138908 - DNA, 16 bp, H. sapiens
tctcatctgcaaaatg

SEQ ID NO: 138909 - DNA, 17 bp, H. sapiens
tctcatctgtaaaatgg

SEQ ID NO: 138910 - DNA, 16 bp, H. sapiens
tctcatcttcaatttt

SEQ ID NO: 138911 - DNA, 16 bp, H. sapiens
tctcatcttccagcag

SEQ ID NO: 138912 - DNA, 17 bp, H. sapiens
tctcatcttgaattgta

SEQ ID NO: 138913 - DNA, 16 bp, H. sapiens
tctcatcttgaatttt

SEQ ID NO: 138914 - DNA, 16 bp, H. sapiens
tctcatgaaatttatt

SEQ ID NO: 138915 - DNA, 16 bp, H. sapiens
tctcatgaatgacttt

SEQ ID NO: 138916 - DNA, 16 bp, H. sapiens
tctcatgacctcatct

SEQ ID NO: 138917 - DNA, 17 bp, H. sapiens
tctcatgagagctcact

SEQ ID NO: 138918 - DNA, 17 bp, H. sapiens
tctcatgagagctgatg

SEQ ID NO: 138919 - DNA, 16 bp, H. sapiens
tctcatgcctcagctg

SEQ ID NO: 138920 - DNA, 16 bp, H. sapiens
tctcatgcctcaggct

SEQ ID NO: 138921 - DNA, 16 bp, H. sapiens
tctcatgcctccacct

SEQ ID NO: 138922 - DNA, 16 bp, H. sapiens
tctcatggaagtagag

SEQ ID NO: 138923 - DNA, 16 bp, H. sapiens
tctcatggagttaaac

SEQ ID NO: 138924 - DNA, 16 bp, H. sapiens
tctcatggtttaaaag

SEQ ID NO: 138925 - DNA, 16 bp, H. sapiens
tctcatggttttaatt

SEQ ID NO: 138926 - DNA, 16 bp, H. sapiens
tctcatgtaatgtatt

SEQ ID NO: 138927 - DNA, 16 bp, H. sapiens
tctcatgtctcagcct

SEQ ID NO: 138928 - DNA, 16 bp, H. sapiens
tctcatgttaaaatgt

SEQ ID NO: 138929 - DNA, 16 bp, H. sapiens
tctcatgttaaaattt

SEQ ID NO: 138930 - DNA, 16 bp, H. sapiens
tctcatgttgaaatgg

SEQ ID NO: 138931 - DNA, 16 bp, H. sapiens
tctcatgttttcttct

SEQ ID NO: 138932 - DNA, 16 bp, H. sapiens
tctcattagaactcac

SEQ ID NO: 138933 - DNA, 16 bp, H. sapiens
tctcattattcacagt

SEQ ID NO: 138934 - DNA, 16 bp, H. sapiens
tctcattattcagctc

SEQ ID NO: 138935 - DNA, 16 bp, H. sapiens
tctcattctattttgt

SEQ ID NO: 138936 - DNA, 16 bp, H. sapiens
tctcattctcattctc

SEQ ID NO: 138937 - DNA, 16 bp, H. sapiens
tctcattctctcttgc

SEQ ID NO: 138938 - DNA, 16 bp, H. sapiens
tctcattctgtggatt

SEQ ID NO: 138939 - DNA, 16 bp, H. sapiens
tctcattcttttgccc

SEQ ID NO: 138940 - DNA, 16 bp, H. sapiens
tctcattcttttgtat

SEQ ID NO: 138941 - DNA, 16 bp, H. sapiens
tctcattgctctggct

SEQ ID NO: 138942 - DNA, 16 bp, H. sapiens
tctcattgtagtttca

SEQ ID NO: 138943 - DNA, 16 bp, H. sapiens
tctcattgtgttgtcc

SEQ ID NO: 138944 - DNA, 33 bp, H. sapiens
tctcattgttcaattcccacctatgagtgagaa

SEQ ID NO: 138945 - DNA, 16 bp, H. sapiens
tctcattgttttactt

SEQ ID NO: 138946 - DNA, 16 bp, H. sapiens
tctcattgttttcaaa

SEQ ID NO: 138947 - DNA, 16 bp, H. sapiens
tctcatttaagcctca

SEQ ID NO: 138948 - DNA, 16 bp, H. sapiens
tctcatttaatattca

SEQ ID NO: 138949 - DNA, 16 bp, H. sapiens
tctcatttaattctga

SEQ ID NO: 138950 - DNA, 16 bp, H. sapiens
tctcatttactcctca

SEQ ID NO: 138951 - DNA, 16 bp, H. sapiens
tctcatttataaaact

SEQ ID NO: 138952 - DNA, 16 bp, H. sapiens
tctcatttataaatgg

SEQ ID NO: 138953 - DNA, 16 bp, H. sapiens
tctcatttattcctca

SEQ ID NO: 138954 - DNA, 16 bp, H. sapiens
tctcatttccttttgt

SEQ ID NO: 138955 - DNA, 16 bp, H. sapiens
tctcatttctaaaata

SEQ ID NO: 138956 - DNA, 16 bp, H. sapiens
tctcattttaaagatg

SEQ ID NO: 138957 - DNA, 16 bp, H. sapiens
tctcattttacagctg

SEQ ID NO: 138958 - DNA, 16 bp, H. sapiens
tctcattttccccatt

SEQ ID NO: 138959 - DNA, 16 bp, H. sapiens
tctcattttcctcatc

SEQ ID NO: 138960 - DNA, 16 bp, H. sapiens
tctcattttccttttg

SEQ ID NO: 138961 - DNA, 16 bp, H. sapiens
tctcattttgtagctc

SEQ ID NO: 138962 - DNA, 16 bp, H. sapiens
tctcattttgtttcta

SEQ ID NO: 138963 - DNA, 16 bp, H. sapiens
tctcatttttaattgt

SEQ ID NO: 138964 - DNA, 16 bp, H. sapiens
tctccaaaaaagaaag

SEQ ID NO: 138965 - DNA, 16 bp, H. sapiens
tctccaaaactctttt

SEQ ID NO: 138966 - DNA, 16 bp, H. sapiens
tctccaaaagtgctgg

SEQ ID NO: 138967 - DNA, 16 bp, H. sapiens
tctccaaaataaaaca

SEQ ID NO: 138968 - DNA, 16 bp, H. sapiens
tctccaaaattcatgt

SEQ ID NO: 138969 - DNA, 16 bp, H. sapiens
tctccaaacaacaaca

SEQ ID NO: 138970 - DNA, 16 bp, H. sapiens
tctccaaacaccatca

SEQ ID NO: 138971 - DNA, 16 bp, H. sapiens
tctccaaactcatcaa

SEQ ID NO: 138972 - DNA, 16 bp, H. sapiens
tctccaaagtggttgt

SEQ ID NO: 138973 - DNA, 16 bp, H. sapiens
tctccaaatacattca

SEQ ID NO: 138974 - DNA, 16 bp, H. sapiens
tctccaaatcctctcc

SEQ ID NO: 138975 - DNA, 16 bp, H. sapiens
tctccaacacctgggc

SEQ ID NO: 138976 - DNA, 16 bp, H. sapiens
tctccaactactggcc

SEQ ID NO: 138977 - DNA, 16 bp, H. sapiens
tctccaactttatttt

SEQ ID NO: 138978 - DNA, 16 bp, H. sapiens
tctccaagaccccacc

SEQ ID NO: 138979 - DNA, 16 bp, H. sapiens
tctccaaggacctggg

SEQ ID NO: 138980 - DNA, 16 bp, H. sapiens
tctccaaggagccctg

SEQ ID NO: 138981 - DNA, 16 bp, H. sapiens
tctccaaggctgaaat

SEQ ID NO: 138982 - DNA, 16 bp, H. sapiens
tctccaagtccccatc

SEQ ID NO: 138983 - DNA, 16 bp, H. sapiens
tctccaagttggccag

SEQ ID NO: 138984 - DNA, 16 bp, H. sapiens
tctccaattaaaagat

SEQ ID NO: 138985 - DNA, 16 bp, H. sapiens
tctccacaaaaaggaa

SEQ ID NO: 138986 - DNA, 16 bp, H. sapiens
tctccacagaaacaga

SEQ ID NO: 138987 - DNA, 16 bp, H. sapiens
tctccacagttttcca

SEQ ID NO: 138988 - DNA, 16 bp, H. sapiens
tctccacatcttcctt

SEQ ID NO: 138989 - DNA, 16 bp, H. sapiens
tctccacatgctgctc

SEQ ID NO: 138990 - DNA, 16 bp, H. sapiens
tctccacattgcccag

SEQ ID NO: 138991 - DNA, 16 bp, H. sapiens
tctccaccatgacaat

SEQ ID NO: 138992 - DNA, 16 bp, H. sapiens
tctccacccttcagag

SEQ ID NO: 138993 - DNA, 16 bp, H. sapiens
tctccacctcccatgt

SEQ ID NO: 138994 - DNA, 16 bp, H. sapiens
tctccacctcctgacc

SEQ ID NO: 138995 - DNA, 16 bp, H. sapiens
tctccacctttcagag

SEQ ID NO: 138996 - DNA, 16 bp, H. sapiens
tctccactaaaaatat

SEQ ID NO: 138997 - DNA, 20 bp, H. sapiens
tctccactaaaagtacaaaa

SEQ ID NO: 138998 - DNA, 16 bp, H. sapiens
tctccacttccaagat

SEQ ID NO: 138999 - DNA, 16 bp, H. sapiens
tctccactttacagat

SEQ ID NO: 139000 - DNA, 16 bp, H. sapiens
tctccagaactcattc

SEQ ID NO: 139001 - DNA, 16 bp, H. sapiens
tctccagaactgagag

SEQ ID NO: 139002 - DNA, 16 bp, H. sapiens
tctccagaactgtgag

SEQ ID NO: 139003 - DNA, 16 bp, H. sapiens
tctccagaacttattc

SEQ ID NO: 139004 - DNA, 16 bp, H. sapiens
tctccagaagagcttc

SEQ ID NO: 139005 - DNA, 16 bp, H. sapiens
tctccagaagcagatg

SEQ ID NO: 139006 - DNA, 16 bp, H. sapiens
tctccagaattgtgag

SEQ ID NO: 139007 - DNA, 16 bp, H. sapiens
tctccagacactgcca

SEQ ID NO: 139008 - DNA, 16 bp, H. sapiens
tctccagacattgcca

SEQ ID NO: 139009 - DNA, 16 bp, H. sapiens
tctccagaccccagaa

SEQ ID NO: 139010 - DNA, 16 bp, H. sapiens
tctccagactttgcca

SEQ ID NO: 139011 - DNA, 16 bp, H. sapiens
tctccagatattgcca

SEQ ID NO: 139012 - DNA, 16 bp, H. sapiens
tctccagatcctctcc

SEQ ID NO: 139013 - DNA, 16 bp, H. sapiens
tctccagcaaactcca

SEQ ID NO: 139014 - DNA, 16 bp, H. sapiens
tctccagcatctgtgg

SEQ ID NO: 139015 - DNA, 16 bp, H. sapiens
tctccagccagcagcc

SEQ ID NO: 139016 - DNA, 16 bp, H. sapiens
tctccagccatgtgga

SEQ ID NO: 139017 - DNA, 16 bp, H. sapiens
tctccagccccatctc

SEQ ID NO: 139018 - DNA, 16 bp, H. sapiens
tctccagcctcacctc

SEQ ID NO: 139019 - DNA, 16 bp, H. sapiens
tctccagcctcagcct

SEQ ID NO: 139020 - DNA, 16 bp, H. sapiens
tctccagcctcatctt

SEQ ID NO: 139021 - DNA, 16 bp, H. sapiens
tctccagcctccagaa

SEQ ID NO: 139022 - DNA, 16 bp, H. sapiens
tctccagcctcctccc

SEQ ID NO: 139023 - DNA, 16 bp, H. sapiens
tctccagcctctgcct

SEQ ID NO: 139024 - DNA, 16 bp, H. sapiens
tctccagctccatcca

SEQ ID NO: 139025 - DNA, 16 bp, H. sapiens
tctccagctcctggcc

SEQ ID NO: 139026 - DNA, 16 bp, H. sapiens
tctccagctcctgggc

SEQ ID NO: 139027 - DNA, 16 bp, H. sapiens
tctccagctgcagctc

SEQ ID NO: 139028 - DNA, 16 bp, H. sapiens
tctccagctgccttta

SEQ ID NO: 139029 - DNA, 18 bp, H. sapiens
tctccagctgcgtactgg

SEQ ID NO: 139030 - DNA, 16 bp, H. sapiens
tctccagcttacagat

SEQ ID NO: 139031 - DNA, 16 bp, H. sapiens
tctccagcttgctgac

SEQ ID NO: 139032 - DNA, 16 bp, H. sapiens
tctccaggacagatca

SEQ ID NO: 139033 - DNA, 16 bp, H. sapiens
tctccaggcccagctc

SEQ ID NO: 139034 - DNA, 16 bp, H. sapiens
tctccaggctcaggtg

SEQ ID NO: 139035 - DNA, 16 bp, H. sapiens
tctccaggctgaagtg

SEQ ID NO: 139036 - DNA, 16 bp, H. sapiens
tctccagggaaacaga

SEQ ID NO: 139037 - DNA, 16 bp, H. sapiens
tctccaggtgattctg

SEQ ID NO: 139038 - DNA, 16 bp, H. sapiens
tctccaggttggccac

SEQ ID NO: 139039 - DNA, 16 bp, H. sapiens
tctccagtaaaaggaa

SEQ ID NO: 139040 - DNA, 16 bp, H. sapiens
tctccagtagctggga

SEQ ID NO: 139041 - DNA, 16 bp, H. sapiens
tctccagtcactggtg

SEQ ID NO: 139042 - DNA, 16 bp, H. sapiens
tctccagtttcatttc

SEQ ID NO: 139043 - DNA, 16 bp, H. sapiens
tctccagttttttgtt

SEQ ID NO: 139044 - DNA, 16 bp, H. sapiens
tctccatactgtcttc

SEQ ID NO: 139045 - DNA, 16 bp, H. sapiens
tctccatatatatata

SEQ ID NO: 139046 - DNA, 16 bp, H. sapiens
tctccatatcagcaat

SEQ ID NO: 139047 - DNA, 16 bp, H. sapiens
tctccatatcctctct

SEQ ID NO: 139048 - DNA, 16 bp, H. sapiens
tctccatcacagctct

SEQ ID NO: 139049 - DNA, 16 bp, H. sapiens
tctccatcacccaggc

SEQ ID NO: 139050 - DNA, 16 bp, H. sapiens
tctccatcatcatcac

SEQ ID NO: 139051 - DNA, 16 bp, H. sapiens
tctccatccctttact

SEQ ID NO: 139052 - DNA, 16 bp, H. sapiens
tctccatctcaagatc

SEQ ID NO: 139053 - DNA, 16 bp, H. sapiens
tctccatctctatctc

SEQ ID NO: 139054 - DNA, 16 bp, H. sapiens
tctccatctctctcca

SEQ ID NO: 139055 - DNA, 16 bp, H. sapiens
tctccatctctgtctc

SEQ ID NO: 139056 - DNA, 16 bp, H. sapiens
tctccatctttgtggt

SEQ ID NO: 139057 - DNA, 16 bp, H. sapiens
tctccatgaattcaat

SEQ ID NO: 139058 - DNA, 16 bp, H. sapiens
tctccatgatggtcag

SEQ ID NO: 139059 - DNA, 16 bp, H. sapiens
tctccatgttggcctg

SEQ ID NO: 139060 - DNA, 16 bp, H. sapiens
tctccatttctataat

SEQ ID NO: 139061 - DNA, 16 bp, H. sapiens
tctccattttatagat

SEQ ID NO: 139062 - DNA, 16 bp, H. sapiens
tctccattttcatctc

SEQ ID NO: 139063 - DNA, 16 bp, H. sapiens
tctccatttttaacaa

SEQ ID NO: 139064 - DNA, 16 bp, H. sapiens
tctcccaactcagcct

SEQ ID NO: 139065 - DNA, 16 bp, H. sapiens
tctcccaaggagctgg

SEQ ID NO: 139066 - DNA, 16 bp, H. sapiens
tctcccaagtagccag

SEQ ID NO: 139067 - DNA, 16 bp, H. sapiens
tctcccaagttcaagc

SEQ ID NO: 139068 - DNA, 16 bp, H. sapiens
tctcccaatcaggagg

SEQ ID NO: 139069 - DNA, 16 bp, H. sapiens
tctcccaccaggtccc

SEQ ID NO: 139070 - DNA, 16 bp, H. sapiens
tctcccaccaggttcc

SEQ ID NO: 139071 - DNA, 16 bp, H. sapiens
tctcccaccagttccc

SEQ ID NO: 139072 - DNA, 16 bp, H. sapiens
tctcccaccccagcct

SEQ ID NO: 139073 - DNA, 16 bp, H. sapiens
tctcccacctcagcct

SEQ ID NO: 139074 - DNA, 16 bp, H. sapiens
tctcccacctcggcct

SEQ ID NO: 139075 - DNA, 16 bp, H. sapiens
tctcccactaggtccc

SEQ ID NO: 139076 - DNA, 16 bp, H. sapiens
tctcccactcagcctc

SEQ ID NO: 139077 - DNA, 16 bp, H. sapiens
tctcccactgttgccc

SEQ ID NO: 139078 - DNA, 16 bp, H. sapiens
tctcccagaattccca

SEQ ID NO: 139079 - DNA, 16 bp, H. sapiens
tctcccagagctgcag

SEQ ID NO: 139080 - DNA, 16 bp, H. sapiens
tctcccagaggggact

SEQ ID NO: 139081 - DNA, 16 bp, H. sapiens
tctcccagcacccagc

SEQ ID NO: 139082 - DNA, 16 bp, H. sapiens
tctcccagcaggcagc

SEQ ID NO: 139083 - DNA, 16 bp, H. sapiens
tctcccagcccagcct

SEQ ID NO: 139084 - DNA, 16 bp, H. sapiens
tctcccagcctcagtt

SEQ ID NO: 139085 - DNA, 16 bp, H. sapiens
tctcccagcctcctcc

SEQ ID NO: 139086 - DNA, 16 bp, H. sapiens
tctcccaggaaagaaa

SEQ ID NO: 139087 - DNA, 16 bp, H. sapiens
tctcccaggcgggagt

SEQ ID NO: 139088 - DNA, 16 bp, H. sapiens
tctcccaggctccagt

SEQ ID NO: 139089 - DNA, 16 bp, H. sapiens
tctcccaggctggagg

SEQ ID NO: 139090 - DNA, 16 bp, H. sapiens
tctcccaggttcaagc

SEQ ID NO: 139091 - DNA, 19 bp, H. sapiens
tctcccaggttcaagtgat

SEQ ID NO: 139092 - DNA, 16 bp, H. sapiens
tctcccatcccagaag

SEQ ID NO: 139093 - DNA, 16 bp, H. sapiens
tctcccatgttcaagc

SEQ ID NO: 139094 - DNA, 16 bp, H. sapiens
tctccccacaaagaaa

SEQ ID NO: 139095 - DNA, 16 bp, H. sapiens
tctccccacctcagcc

SEQ ID NO: 139096 - DNA, 16 bp, H. sapiens
tctccccacctggata

SEQ ID NO: 139097 - DNA, 16 bp, H. sapiens
tctccccactcccagt

SEQ ID NO: 139098 - DNA, 16 bp, H. sapiens
tctccccagagcctcc

SEQ ID NO: 139099 - DNA, 16 bp, H. sapiens
tctccccagctcccag

SEQ ID NO: 139100 - DNA, 16 bp, H. sapiens
tctccccatcaggagg

SEQ ID NO: 139101 - DNA, 16 bp, H. sapiens
tctccccatccctgtc

SEQ ID NO: 139102 - DNA, 16 bp, H. sapiens
tctcccccagagcctc

SEQ ID NO: 139103 - DNA, 16 bp, H. sapiens
tctcccccaggctgga

SEQ ID NO: 139104 - DNA, 16 bp, H. sapiens
tctcccccatgctgtt

SEQ ID NO: 139105 - DNA, 16 bp, H. sapiens
tctccccgcctcagcc

SEQ ID NO: 139106 - DNA, 16 bp, H. sapiens
tctcccctgaactcca

SEQ ID NO: 139107 - DNA, 16 bp, H. sapiens
tctcccctttccacag

SEQ ID NO: 139108 - DNA, 16 bp, H. sapiens
tctcccgagcagctgg

SEQ ID NO: 139109 - DNA, 17 bp, H. sapiens
tctcccgcctcagtctc

SEQ ID NO: 139110 - DNA, 16 bp, H. sapiens
tctcccggattcaagc

SEQ ID NO: 139111 - DNA, 16 bp, H. sapiens
tctcccgggttcaagc

SEQ ID NO: 139112 - DNA, 17 bp, H. sapiens
tctcccgggttcacgcc

SEQ ID NO: 139113 - DNA, 16 bp, H. sapiens
tctcccgggttccagc

SEQ ID NO: 139114 - DNA, 16 bp, H. sapiens
tctccctaaatgtata

SEQ ID NO: 139115 - DNA, 16 bp, H. sapiens
tctccctatgctgccc

SEQ ID NO: 139116 - DNA, 16 bp, H. sapiens
tctccctcaacatgtg

SEQ ID NO: 139117 - DNA, 16 bp, H. sapiens
tctccctcccaggctc

SEQ ID NO: 139118 - DNA, 16 bp, H. sapiens
tctccctcctcccagc

SEQ ID NO: 139119 - DNA, 16 bp, H. sapiens
tctccctcctgcagcc

SEQ ID NO: 139120 - DNA, 16 bp, H. sapiens
tctccctcctgggttt

SEQ ID NO: 139121 - DNA, 16 bp, H. sapiens
tctccctctagcacca

SEQ ID NO: 139122 - DNA, 16 bp, H. sapiens
tctccctctccctgtg

SEQ ID NO: 139123 - DNA, 16 bp, H. sapiens
tctccctctctgacct

SEQ ID NO: 139124 - DNA, 16 bp, H. sapiens
tctccctctctgcacc

SEQ ID NO: 139125 - DNA, 16 bp, H. sapiens
tctccctctgttgctc

SEQ ID NO: 139126 - DNA, 16 bp, H. sapiens
tctccctgaagaggtc

SEQ ID NO: 139127 - DNA, 16 bp, H. sapiens
tctccctgactgacta

SEQ ID NO: 139128 - DNA, 16 bp, H. sapiens
tctccctgccccagcc

SEQ ID NO: 139129 - DNA, 16 bp, H. sapiens
tctccctgctcccagc

SEQ ID NO: 139130 - DNA, 16 bp, H. sapiens
tctccctgctcctggc

SEQ ID NO: 139131 - DNA, 16 bp, H. sapiens
tctccctgctttggct

SEQ ID NO: 139132 - DNA, 16 bp, H. sapiens
tctccctggccctgcc

SEQ ID NO: 139133 - DNA, 16 bp, H. sapiens
tctccctgggaaagag

SEQ ID NO: 139134 - DNA, 16 bp, H. sapiens
tctccctgggtccctc

SEQ ID NO: 139135 - DNA, 16 bp, H. sapiens
tctccctgtctgtccc

SEQ ID NO: 139136 - DNA, 24 bp, H. sapiens
tctccctgtgatgctgtgcttcag

SEQ ID NO: 139137 - DNA, 16 bp, H. sapiens
tctccctgtgtctctg

SEQ ID NO: 139138 - DNA, 16 bp, H. sapiens
tctcccttcagcctcc

SEQ ID NO: 139139 - DNA, 16 bp, H. sapiens
tctcccttccccaagc

SEQ ID NO: 139140 - DNA, 16 bp, H. sapiens
tctcccttctggctcc

SEQ ID NO: 139141 - DNA, 16 bp, H. sapiens
tctccctttccccagg

SEQ ID NO: 139142 - DNA, 16 bp, H. sapiens
tctcccttttaaaatt

SEQ ID NO: 139143 - DNA, 16 bp, H. sapiens
tctccgggcccagctc

SEQ ID NO: 139144 - DNA, 16 bp, H. sapiens
tctccgtctctgtctc

SEQ ID NO: 139145 - DNA, 16 bp, H. sapiens
tctcctaaaaatacag

SEQ ID NO: 139146 - DNA, 16 bp, H. sapiens
tctcctaaaaatataa

SEQ ID NO: 139147 - DNA, 16 bp, H. sapiens
tctcctaagacagagt

SEQ ID NO: 139148 - DNA, 16 bp, H. sapiens
tctcctaatattatcc

SEQ ID NO: 139149 - DNA, 16 bp, H. sapiens
tctcctaatgttttcc

SEQ ID NO: 139150 - DNA, 16 bp, H. sapiens
tctcctaccgcagcct

SEQ ID NO: 139151 - DNA, 16 bp, H. sapiens
tctcctacttgcacat

SEQ ID NO: 139152 - DNA, 16 bp, H. sapiens
tctcctatcaccccca

SEQ ID NO: 139153 - DNA, 16 bp, H. sapiens
tctcctatctcagaat

SEQ ID NO: 139154 - DNA, 16 bp, H. sapiens
tctcctatgatagcaa

SEQ ID NO: 139155 - DNA, 16 bp, H. sapiens
tctcctatgggagcaa

SEQ ID NO: 139156 - DNA, 16 bp, H. sapiens
tctcctatgttcaggt

SEQ ID NO: 139157 - DNA, 16 bp, H. sapiens
tctcctattcaacata

SEQ ID NO: 139158 - DNA, 16 bp, H. sapiens
tctcctattctgtaag

SEQ ID NO: 139159 - DNA, 16 bp, H. sapiens
tctcctcaaacaggaa

SEQ ID NO: 139160 - DNA, 16 bp, H. sapiens
tctcctcaagcattta

SEQ ID NO: 139161 - DNA, 17 bp, H. sapiens
tctcctcaagcatttat

SEQ ID NO: 139162 - DNA, 16 bp, H. sapiens
tctcctcagcctcctg

SEQ ID NO: 139163 - DNA, 16 bp, H. sapiens
tctcctcaggagccac

SEQ ID NO: 139164 - DNA, 16 bp, H. sapiens
tctcctcatctgtgca

SEQ ID NO: 139165 - DNA, 16 bp, H. sapiens
tctcctcatttttaaa

SEQ ID NO: 139166 - DNA, 16 bp, H. sapiens
tctcctccaaaggact

SEQ ID NO: 139167 - DNA, 16 bp, H. sapiens
tctcctcccccagcct

SEQ ID NO: 139168 - DNA, 16 bp, H. sapiens
tctcctccccttgaat

SEQ ID NO: 139169 - DNA, 16 bp, H. sapiens
tctcctccctcaaacc

SEQ ID NO: 139170 - DNA, 16 bp, H. sapiens
tctcctccctgctctg

SEQ ID NO: 139171 - DNA, 16 bp, H. sapiens
tctcctcctccagctc

SEQ ID NO: 139172 - DNA, 16 bp, H. sapiens
tctcctcctctgtgaa

SEQ ID NO: 139173 - DNA, 16 bp, H. sapiens
tctcctcctcttataa

SEQ ID NO: 139174 - DNA, 16 bp, H. sapiens
tctcctctccccagcc

SEQ ID NO: 139175 - DNA, 16 bp, H. sapiens
tctcctctcctgcctg

SEQ ID NO: 139176 - DNA, 16 bp, H. sapiens
tctcctctccttctag

SEQ ID NO: 139177 - DNA, 16 bp, H. sapiens
tctcctctctgagcct

SEQ ID NO: 139178 - DNA, 16 bp, H. sapiens
tctcctctctgcctgc

SEQ ID NO: 139179 - DNA, 16 bp, H. sapiens
tctcctctctgggcct

SEQ ID NO: 139180 - DNA, 16 bp, H. sapiens
tctcctctctggtact

SEQ ID NO: 139181 - DNA, 16 bp, H. sapiens
tctcctctgactctga

SEQ ID NO: 139182 - DNA, 16 bp, H. sapiens
tctcctctgtctccca

SEQ ID NO: 139183 - DNA, 16 bp, H. sapiens
tctcctcttcctcagg

SEQ ID NO: 139184 - DNA, 16 bp, H. sapiens
tctcctctttgtgtcc

SEQ ID NO: 139185 - DNA, 16 bp, H. sapiens
tctcctgaaaatgctt

SEQ ID NO: 139186 - DNA, 16 bp, H. sapiens
tctcctgaatggttta

SEQ ID NO: 139187 - DNA, 19 bp, H. sapiens
tctcctgacctcaggtgat

SEQ ID NO: 139188 - DNA, 16 bp, H. sapiens
tctcctgacctgaggg

SEQ ID NO: 139189 - DNA, 16 bp, H. sapiens
tctcctgaccttgtca

SEQ ID NO: 139190 - DNA, 16 bp, H. sapiens
tctcctgagctacaga

SEQ ID NO: 139191 - DNA, 16 bp, H. sapiens
tctcctgaggcctccc

SEQ ID NO: 139192 - DNA, 16 bp, H. sapiens
tctcctgagtagctgg

SEQ ID NO: 139193 - DNA, 16 bp, H. sapiens
tctcctgatatctgca

SEQ ID NO: 139194 - DNA, 16 bp, H. sapiens
tctcctgatctcctga

SEQ ID NO: 139195 - DNA, 16 bp, H. sapiens
tctcctgcacagctgg

SEQ ID NO: 139196 - DNA, 16 bp, H. sapiens
tctcctgcagcacccc

SEQ ID NO: 139197 - DNA, 16 bp, H. sapiens
tctcctgcagcctccc

SEQ ID NO: 139198 - DNA, 16 bp, H. sapiens
tctcctgcagcttcct

SEQ ID NO: 139199 - DNA, 16 bp, H. sapiens
tctcctgccccactca

SEQ ID NO: 139200 - DNA, 16 bp, H. sapiens
tctcctgccccaggct

SEQ ID NO: 139201 - DNA, 16 bp, H. sapiens
tctcctgccccatcct

SEQ ID NO: 139202 - DNA, 16 bp, H. sapiens
tctcctgccctcagcc

SEQ ID NO: 139203 - DNA, 16 bp, H. sapiens
tctcctgcctcaccat

SEQ ID NO: 139204 - DNA, 16 bp, H. sapiens
tctcctgcctcactcc

SEQ ID NO: 139205 - DNA, 16 bp, H. sapiens
tctcctgcctcagctg

SEQ ID NO: 139206 - DNA, 16 bp, H. sapiens
tctcctgcctcaggca

SEQ ID NO: 139207 - DNA, 16 bp, H. sapiens
tctcctgcctccaccc

SEQ ID NO: 139208 - DNA, 16 bp, H. sapiens
tctcctgcctcctctg

SEQ ID NO: 139209 - DNA, 16 bp, H. sapiens
tctcctgcctctcctg

SEQ ID NO: 139210 - DNA, 16 bp, H. sapiens
tctcctgcctctgtct

SEQ ID NO: 139211 - DNA, 16 bp, H. sapiens
tctcctgccttggcct

SEQ ID NO: 139212 - DNA, 16 bp, H. sapiens
tctcctgccttgtcct

SEQ ID NO: 139213 - DNA, 16 bp, H. sapiens
tctcctgcttcagctc

SEQ ID NO: 139214 - DNA, 16 bp, H. sapiens
tctcctggaaaaaaaa

SEQ ID NO: 139215 - DNA, 16 bp, H. sapiens
tctcctggagcctcca

SEQ ID NO: 139216 - DNA, 16 bp, H. sapiens
tctcctggcctcatga

SEQ ID NO: 139217 - DNA, 16 bp, H. sapiens
tctcctgggctcaggc

SEQ ID NO: 139218 - DNA, 16 bp, H. sapiens
tctcctgggctgaagt

SEQ ID NO: 139219 - DNA, 16 bp, H. sapiens
tctcctggggctgtgt

SEQ ID NO: 139220 - DNA, 16 bp, H. sapiens
tctcctgggttcaagc

SEQ ID NO: 139221 - DNA, 20 bp, H. sapiens
tctcctgggttcaagtgatt

SEQ ID NO: 139222 - DNA, 20 bp, H. sapiens
tctcctgggttcacgccatt

SEQ ID NO: 139223 - DNA, 16 bp, H. sapiens
tctcctgggttcatgc

SEQ ID NO: 139224 - DNA, 16 bp, H. sapiens
tctcctggtctgcaga

SEQ ID NO: 139225 - DNA, 16 bp, H. sapiens
tctcctggttcagcct

SEQ ID NO: 139226 - DNA, 16 bp, H. sapiens
tctcctgtatgaggta

SEQ ID NO: 139227 - DNA, 16 bp, H. sapiens
tctcctgtcctcatga

SEQ ID NO: 139228 - DNA, 16 bp, H. sapiens
tctcctgtctcatcct

SEQ ID NO: 139229 - DNA, 16 bp, H. sapiens
tctcctgtctccttac

SEQ ID NO: 139230 - DNA, 16 bp, H. sapiens
tctcctgtcttggcct

SEQ ID NO: 139231 - DNA, 16 bp, H. sapiens
tctcctgtgggcattt

SEQ ID NO: 139232 - DNA, 16 bp, H. sapiens
tctcctgttggttctg

SEQ ID NO: 139233 - DNA, 16 bp, H. sapiens
tctccttcaccttctg

SEQ ID NO: 139234 - DNA, 16 bp, H. sapiens
tctccttcaccttttg

SEQ ID NO: 139235 - DNA, 16 bp, H. sapiens
tctccttcatgtttaa

SEQ ID NO: 139236 - DNA, 16 bp, H. sapiens
tctccttccctggatg

SEQ ID NO: 139237 - DNA, 16 bp, H. sapiens
tctccttcctcagcat

SEQ ID NO: 139238 - DNA, 16 bp, H. sapiens
tctccttcctcagccc

SEQ ID NO: 139239 - DNA, 16 bp, H. sapiens
tctccttcctgcctgc

SEQ ID NO: 139240 - DNA, 16 bp, H. sapiens
tctccttcctgctgcc

SEQ ID NO: 139241 - DNA, 16 bp, H. sapiens
tctccttcctgtcacc

SEQ ID NO: 139242 - DNA, 16 bp, H. sapiens
tctccttcgccttctg

SEQ ID NO: 139243 - DNA, 16 bp, H. sapiens
tctccttctctgccat

SEQ ID NO: 139244 - DNA, 16 bp, H. sapiens
tctccttctggaactc

SEQ ID NO: 139245 - DNA, 16 bp, H. sapiens
tctccttctgtctctg

SEQ ID NO: 139246 - DNA, 16 bp, H. sapiens
tctccttgacttgtag

SEQ ID NO: 139247 - DNA, 16 bp, H. sapiens
tctcctttaaaaatgt

SEQ ID NO: 139248 - DNA, 16 bp, H. sapiens
tctcctttagcaacac

SEQ ID NO: 139249 - DNA, 16 bp, H. sapiens
tctcctttataaatta

SEQ ID NO: 139250 - DNA, 16 bp, H. sapiens
tctcctttatttctga

SEQ ID NO: 139251 - DNA, 16 bp, H. sapiens
tctcctttccttctgg

SEQ ID NO: 139252 - DNA, 16 bp, H. sapiens
tctcctttgactccag

SEQ ID NO: 139253 - DNA, 16 bp, H. sapiens
tctcctttgccttcca

SEQ ID NO: 139254 - DNA, 16 bp, H. sapiens
tctcctttggataaat

SEQ ID NO: 139255 - DNA, 16 bp, H. sapiens
tctcctttggctccat

SEQ ID NO: 139256 - DNA, 16 bp, H. sapiens
tctccttttgagaagt

SEQ ID NO: 139257 - DNA, 16 bp, H. sapiens
tctcgaaaaaaataaa

SEQ ID NO: 139258 - DNA, 17 bp, H. sapiens
tctcgaactcccgacct

SEQ ID NO: 139259 - DNA, 20 bp, H. sapiens
tctcgaactcctaacctcaa

SEQ ID NO: 139260 - DNA, 16 bp, H. sapiens
tctcgaactcctgaac

SEQ ID NO: 139261 - DNA, 20 bp, H. sapiens
tctcgaactcctgacctcat

SEQ ID NO: 139262 - DNA, 16 bp, H. sapiens
tctcgaactcctggac

SEQ ID NO: 139263 - DNA, 17 bp, H. sapiens
tctcgaactcctggcct

SEQ ID NO: 139264 - DNA, 17 bp, H. sapiens
tctcgaactcttgacct

SEQ ID NO: 139265 - DNA, 16 bp, H. sapiens
tctcgaatcctgacct

SEQ ID NO: 139266 - DNA, 16 bp, H. sapiens
tctcgaccataagaga

SEQ ID NO: 139267 - DNA, 16 bp, H. sapiens
tctcgagcagctggga

SEQ ID NO: 139268 - DNA, 18 bp, H. sapiens
tctcgatctcttgacctc

SEQ ID NO: 139269 - DNA, 16 bp, H. sapiens
tctcgccctgtcacca

SEQ ID NO: 139270 - DNA, 16 bp, H. sapiens
tctcgctatgttgacc

SEQ ID NO: 139271 - DNA, 16 bp, H. sapiens
tctcgctcgctcgctc

SEQ ID NO: 139272 - DNA, 16 bp, H. sapiens
tctcgctctcactctc

SEQ ID NO: 139273 - DNA, 16 bp, H. sapiens
tctcgctctcgctctc

SEQ ID NO: 139274 - DNA, 16 bp, H. sapiens
tctcgctctgttgctc

SEQ ID NO: 139275 - DNA, 16 bp, H. sapiens
tctcggactcccgacc

SEQ ID NO: 139276 - DNA, 19 bp, H. sapiens
tctcggctcactgcaaccc

SEQ ID NO: 139277 - DNA, 20 bp, H. sapiens
tctcggctcactgcaacctt

SEQ ID NO: 139278 - DNA, 16 bp, H. sapiens
tctcggctcactgcac

SEQ ID NO: 139279 - DNA, 16 bp, H. sapiens
tctcggctcatcacaa

SEQ ID NO: 139280 - DNA, 16 bp, H. sapiens
tctcggctgggcatgg

SEQ ID NO: 139281 - DNA, 16 bp, H. sapiens
tctcggctgggtgtgg

SEQ ID NO: 139282 - DNA, 16 bp, H. sapiens
tctcggctttcctggt

SEQ ID NO: 139283 - DNA, 16 bp, H. sapiens
tctcgtctgccaccat

SEQ ID NO: 139284 - DNA, 17 bp, H. sapiens
tctcgtgcctcagcatc

SEQ ID NO: 139285 - DNA, 16 bp, H. sapiens
tctcgttctgtggccc

SEQ ID NO: 139286 - DNA, 16 bp, H. sapiens
tctctaaaaaaagaaa

SEQ ID NO: 139287 - DNA, 16 bp, H. sapiens
tctctaaaaaagaaga

SEQ ID NO: 139288 - DNA, 16 bp, H. sapiens
tctctaaaaaatacaa

SEQ ID NO: 139289 - DNA, 16 bp, H. sapiens
tctctaaaaacaaaca

SEQ ID NO: 139290 - DNA, 16 bp, H. sapiens
tctctaaaaacataaa

SEQ ID NO: 139291 - DNA, 16 bp, H. sapiens
tctctaaaaataaatg

SEQ ID NO: 139292 - DNA, 16 bp, H. sapiens
tctctaaaaataattt

SEQ ID NO: 139293 - DNA, 16 bp, H. sapiens
tctctaaaaatttact

SEQ ID NO: 139294 - DNA, 16 bp, H. sapiens
tctctaaaagaataga

SEQ ID NO: 139295 - DNA, 16 bp, H. sapiens
tctctaaaatagtaat

SEQ ID NO: 139296 - DNA, 16 bp, H. sapiens
tctctaaacaaataaa

SEQ ID NO: 139297 - DNA, 16 bp, H. sapiens
tctctaaacaactaga

SEQ ID NO: 139298 - DNA, 16 bp, H. sapiens
tctctaaagaaaatga

SEQ ID NO: 139299 - DNA, 16 bp, H. sapiens
tctctaaataaataca

SEQ ID NO: 139300 - DNA, 16 bp, H. sapiens
tctctaaatatatata

SEQ ID NO: 139301 - DNA, 16 bp, H. sapiens
tctctaacaacccctg

SEQ ID NO: 139302 - DNA, 16 bp, H. sapiens
tctctaacttatttta

SEQ ID NO: 139303 - DNA, 16 bp, H. sapiens
tctctaagaaaatttt

SEQ ID NO: 139304 - DNA, 16 bp, H. sapiens
tctctaagtaaacttg

SEQ ID NO: 139305 - DNA, 16 bp, H. sapiens
tctctaataaaaatat

SEQ ID NO: 139306 - DNA, 16 bp, H. sapiens
tctctaataaaataca

SEQ ID NO: 139307 - DNA, 16 bp, H. sapiens
tctctaatgaccaatg

SEQ ID NO: 139308 - DNA, 16 bp, H. sapiens
tctctaattccatcca

SEQ ID NO: 139309 - DNA, 16 bp, H. sapiens
tctctacaaaaaaata

SEQ ID NO: 139310 - DNA, 16 bp, H. sapiens
tctctacaaaaacata

SEQ ID NO: 139311 - DNA, 16 bp, H. sapiens
tctctacaaaaagatt

SEQ ID NO: 139312 - DNA, 16 bp, H. sapiens
tctctacaaaaaggaa

SEQ ID NO: 139313 - DNA, 16 bp, H. sapiens
tctctacaaaaattat

SEQ ID NO: 139314 - DNA, 16 bp, H. sapiens
tctctacaaaacaatt

SEQ ID NO: 139315 - DNA, 16 bp, H. sapiens
tctctacaaaacactt

SEQ ID NO: 139316 - DNA, 16 bp, H. sapiens
tctctacaaaacatat

SEQ ID NO: 139317 - DNA, 16 bp, H. sapiens
tctctacaaaagagaa

SEQ ID NO: 139318 - DNA, 16 bp, H. sapiens
tctctacaaagaaaac

SEQ ID NO: 139319 - DNA, 16 bp, H. sapiens
tctctacaataaaaac

SEQ ID NO: 139320 - DNA, 16 bp, H. sapiens
tctctacaataaattt

SEQ ID NO: 139321 - DNA, 16 bp, H. sapiens
tctctacaatgagaac

SEQ ID NO: 139322 - DNA, 16 bp, H. sapiens
tctctacagaaaatgt

SEQ ID NO: 139323 - DNA, 16 bp, H. sapiens
tctctaccaaaaatat

SEQ ID NO: 139324 - DNA, 16 bp, H. sapiens
tctctaccaaaataaa

SEQ ID NO: 139325 - DNA, 16 bp, H. sapiens
tctctaccccaaaaca

SEQ ID NO: 139326 - DNA, 16 bp, H. sapiens
tctctacctcccaggt

SEQ ID NO: 139327 - DNA, 16 bp, H. sapiens
tctctacctctgtctc

SEQ ID NO: 139328 - DNA, 16 bp, H. sapiens
tctctacctgccctgg

SEQ ID NO: 139329 - DNA, 16 bp, H. sapiens
tctctacgaaaaaaaa

SEQ ID NO: 139330 - DNA, 16 bp, H. sapiens
tctctactaaaaaaaa

SEQ ID NO: 139331 - DNA, 16 bp, H. sapiens
tctctactaaaaaaac

SEQ ID NO: 139332 - DNA, 16 bp, H. sapiens
tctctactaaaaaaca

SEQ ID NO: 139333 - DNA, 17 bp, H. sapiens
tctctactaaaaaatat

SEQ ID NO: 139334 - DNA, 16 bp, H. sapiens
tctctactaaaaacac

SEQ ID NO: 139335 - DNA, 16 bp, H. sapiens
tctctactaaaaacag

SEQ ID NO: 139336 - DNA, 16 bp, H. sapiens
tctctactaaaaacat

SEQ ID NO: 139337 - DNA, 19 bp, H. sapiens
tctctactaaaaacgcaaa

SEQ ID NO: 139338 - DNA, 16 bp, H. sapiens
tctctactaaaaataa

SEQ ID NO: 139339 - DNA, 19 bp, H. sapiens
tctctactaaaaatacaac

SEQ ID NO: 139340 - DNA, 19 bp, H. sapiens
tctctactaaaaatacaag

SEQ ID NO: 139341 - DNA, 18 bp, H. sapiens
tctctactaaaaatacag

SEQ ID NO: 139342 - DNA, 20 bp, H. sapiens
tctctactaaaaatacagaa

SEQ ID NO: 139343 - DNA, 17 bp, H. sapiens
tctctactaaaaatact

SEQ ID NO: 139344 - DNA, 16 bp, H. sapiens
tctctactaaaaatat

SEQ ID NO: 139345 - DNA, 17 bp, H. sapiens
tctctactaaaactaca

SEQ ID NO: 139346 - DNA, 16 bp, H. sapiens
tctctactaaaagtat

SEQ ID NO: 139347 - DNA, 17 bp, H. sapiens
tctctactaaaatacaa

SEQ ID NO: 139348 - DNA, 16 bp, H. sapiens
tctctactaaaatata

SEQ ID NO: 139349 - DNA, 16 bp, H. sapiens
tctctactaaagataa

SEQ ID NO: 139350 - DNA, 16 bp, H. sapiens
tctctactaacaatac

SEQ ID NO: 139351 - DNA, 19 bp, H. sapiens
tctctactaacaatacaaa

SEQ ID NO: 139352 - DNA, 20 bp, H. sapiens
tctctactaagaatacaaaa

SEQ ID NO: 139353 - DNA, 16 bp, H. sapiens
tctctactaataaaaa

SEQ ID NO: 139354 - DNA, 17 bp, H. sapiens
tctctactagaaataca

SEQ ID NO: 139355 - DNA, 17 bp, H. sapiens
tctctactataaataca

SEQ ID NO: 139356 - DNA, 16 bp, H. sapiens
tctctactctgtttca

SEQ ID NO: 139357 - DNA, 16 bp, H. sapiens
tctctactgaaaaaac

SEQ ID NO: 139358 - DNA, 20 bp, H. sapiens
tctctactgaaaatacaaaa

SEQ ID NO: 139359 - DNA, 16 bp, H. sapiens
tctctactgaaaatat

SEQ ID NO: 139360 - DNA, 16 bp, H. sapiens
tctctacttcatttat

SEQ ID NO: 139361 - DNA, 16 bp, H. sapiens
tctctagaattttttc

SEQ ID NO: 139362 - DNA, 16 bp, H. sapiens
tctctagacctcagtt

SEQ ID NO: 139363 - DNA, 16 bp, H. sapiens
tctctagtaaaaaata

SEQ ID NO: 139364 - DNA, 16 bp, H. sapiens
tctctataaaaaattt

SEQ ID NO: 139365 - DNA, 16 bp, H. sapiens
tctctataaaaatatt

SEQ ID NO: 139366 - DNA, 16 bp, H. sapiens
tctctataaggagaac

SEQ ID NO: 139367 - DNA, 16 bp, H. sapiens
tctctatcccacacac

SEQ ID NO: 139368 - DNA, 16 bp, H. sapiens
tctctatctcccaggc

SEQ ID NO: 139369 - DNA, 16 bp, H. sapiens
tctctatcttcatgag

SEQ ID NO: 139370 - DNA, 16 bp, H. sapiens
tctctatcttctgacc

SEQ ID NO: 139371 - DNA, 16 bp, H. sapiens
tctctatgaatttgat

SEQ ID NO: 139372 - DNA, 16 bp, H. sapiens
tctctatggatttgac

SEQ ID NO: 139373 - DNA, 16 bp, H. sapiens
tctctatggcctggct

SEQ ID NO: 139374 - DNA, 16 bp, H. sapiens
tctctatgttgctcag

SEQ ID NO: 139375 - DNA, 16 bp, H. sapiens
tctctattaaaaataa

SEQ ID NO: 139376 - DNA, 16 bp, H. sapiens
tctctattaaaatgca

SEQ ID NO: 139377 - DNA, 16 bp, H. sapiens
tctctattcaataaat

SEQ ID NO: 139378 - DNA, 16 bp, H. sapiens
tctctattctattcta

SEQ ID NO: 139379 - DNA, 16 bp, H. sapiens
tctctatttcttttag

SEQ ID NO: 139380 - DNA, 16 bp, H. sapiens
tctctattttaatgtt

SEQ ID NO: 139381 - DNA, 16 bp, H. sapiens
tctctatttttaaaaa

SEQ ID NO: 139382 - DNA, 16 bp, H. sapiens
tctctcaaaaaataaa

SEQ ID NO: 139383 - DNA, 16 bp, H. sapiens
tctctcaaaagaaagg

SEQ ID NO: 139384 - DNA, 16 bp, H. sapiens
tctctcaaaaggaaag

SEQ ID NO: 139385 - DNA, 16 bp, H. sapiens
tctctcaaaataaaaa

SEQ ID NO: 139386 - DNA, 16 bp, H. sapiens
tctctcaagccatttt

SEQ ID NO: 139387 - DNA, 16 bp, H. sapiens
tctctcacacacacaa

SEQ ID NO: 139388 - DNA, 16 bp, H. sapiens
tctctcaccaaggctg

SEQ ID NO: 139389 - DNA, 16 bp, H. sapiens
tctctcaccagtccta

SEQ ID NO: 139390 - DNA, 16 bp, H. sapiens
tctctcactctgcctt

SEQ ID NO: 139391 - DNA, 16 bp, H. sapiens
tctctcactctgtctc

SEQ ID NO: 139392 - DNA, 16 bp, H. sapiens
tctctcagaccacagt

SEQ ID NO: 139393 - DNA, 25 bp, H. sapiens
tctctcagaccacagtgcaaccaaa

SEQ ID NO: 139394 - DNA, 25 bp, H. sapiens
tctctcagaccacagtgcaatcaaa

SEQ ID NO: 139395 - DNA, 16 bp, H. sapiens
tctctcagcacttgct

SEQ ID NO: 139396 - DNA, 16 bp, H. sapiens
tctctcagcatttcct

SEQ ID NO: 139397 - DNA, 16 bp, H. sapiens
tctctcagcctttgct

SEQ ID NO: 139398 - DNA, 16 bp, H. sapiens
tctctcaggaatgcca

SEQ ID NO: 139399 - DNA, 16 bp, H. sapiens
tctctcatcatttgct

SEQ ID NO: 139400 - DNA, 16 bp, H. sapiens
tctctcatctgtaaaa

SEQ ID NO: 139401 - DNA, 16 bp, H. sapiens
tctctcatggttctgg

SEQ ID NO: 139402 - DNA, 16 bp, H. sapiens
tctctcattttgtttc

SEQ ID NO: 139403 - DNA, 16 bp, H. sapiens
tctctccaaaaaaata

SEQ ID NO: 139404 - DNA, 16 bp, H. sapiens
tctctccagaaaatgg

SEQ ID NO: 139405 - DNA, 16 bp, H. sapiens
tctctccagcatctgt

SEQ ID NO: 139406 - DNA, 16 bp, H. sapiens
tctctccagcccctgg

SEQ ID NO: 139407 - DNA, 16 bp, H. sapiens
tctctccagctctctc

SEQ ID NO: 139408 - DNA, 16 bp, H. sapiens
tctctccatccaccca

SEQ ID NO: 139409 - DNA, 16 bp, H. sapiens
tctctccatctcaagg

SEQ ID NO: 139410 - DNA, 16 bp, H. sapiens
tctctccatttatata

SEQ ID NO: 139411 - DNA, 16 bp, H. sapiens
tctctccatttattta

SEQ ID NO: 139412 - DNA, 16 bp, H. sapiens
tctctcccactagaat

SEQ ID NO: 139413 - DNA, 16 bp, H. sapiens
tctctcccaggttttg

SEQ ID NO: 139414 - DNA, 16 bp, H. sapiens
tctctcccattagaat

SEQ ID NO: 139415 - DNA, 16 bp, H. sapiens
tctctcccattctgta

SEQ ID NO: 139416 - DNA, 16 bp, H. sapiens
tctctcccattctgtg

SEQ ID NO: 139417 - DNA, 16 bp, H. sapiens
tctctccccagcctcc

SEQ ID NO: 139418 - DNA, 16 bp, H. sapiens
tctctccccagcctct

SEQ ID NO: 139419 - DNA, 16 bp, H. sapiens
tctctcccctgcccca

SEQ ID NO: 139420 - DNA, 16 bp, H. sapiens
tctctccctcccccag

SEQ ID NO: 139421 - DNA, 16 bp, H. sapiens
tctctccctgggatgg

SEQ ID NO: 139422 - DNA, 16 bp, H. sapiens
tctctccctgtcctca

SEQ ID NO: 139423 - DNA, 16 bp, H. sapiens
tctctccctttagaat

SEQ ID NO: 139424 - DNA, 16 bp, H. sapiens
tctctccgtctctgtc

SEQ ID NO: 139425 - DNA, 16 bp, H. sapiens
tctctcctagagcctt

SEQ ID NO: 139426 - DNA, 16 bp, H. sapiens
tctctcctgatttctt

SEQ ID NO: 139427 - DNA, 16 bp, H. sapiens
tctctcctgctctgcc

SEQ ID NO: 139428 - DNA, 16 bp, H. sapiens
tctctcctgctgcttt

SEQ ID NO: 139429 - DNA, 16 bp, H. sapiens
tctctcctggcttctg

SEQ ID NO: 139430 - DNA, 16 bp, H. sapiens
tctctcctgggtctcc

SEQ ID NO: 139431 - DNA, 16 bp, H. sapiens
tctctccttcctctga

SEQ ID NO: 139432 - DNA, 16 bp, H. sapiens
tctctccttctgccat

SEQ ID NO: 139433 - DNA, 16 bp, H. sapiens
tctctcgaacctggga

SEQ ID NO: 139434 - DNA, 16 bp, H. sapiens
tctctcgggttcaagc

SEQ ID NO: 139435 - DNA, 16 bp, H. sapiens
tctctctagttgcctt

SEQ ID NO: 139436 - DNA, 16 bp, H. sapiens
tctctctatatttata

SEQ ID NO: 139437 - DNA, 16 bp, H. sapiens
tctctctatgttgccc

SEQ ID NO: 139438 - DNA, 16 bp, H. sapiens
tctctctcactcactc

SEQ ID NO: 139439 - DNA, 16 bp, H. sapiens
tctctctcagaccaca

SEQ ID NO: 139440 - DNA, 16 bp, H. sapiens
tctctctcagcctccc

SEQ ID NO: 139441 - DNA, 16 bp, H. sapiens
tctctctcagcctctc

SEQ ID NO: 139442 - DNA, 16 bp, H. sapiens
tctctctcctgctgct

SEQ ID NO: 139443 - DNA, 16 bp, H. sapiens
tctctctctacatata

SEQ ID NO: 139444 - DNA, 16 bp, H. sapiens
tctctctctatatata

SEQ ID NO: 139445 - DNA, 16 bp, H. sapiens
tctctctctatgtctc

SEQ ID NO: 139446 - DNA, 16 bp, H. sapiens
tctctctctcagcctc

SEQ ID NO: 139447 - DNA, 16 bp, H. sapiens
tctctctctcatatat

SEQ ID NO: 139448 - DNA, 16 bp, H. sapiens
tctctctctcctggag

SEQ ID NO: 139449 - DNA, 16 bp, H. sapiens
tctctctctctcagaa

SEQ ID NO: 139450 - DNA, 16 bp, H. sapiens
tctctctctctcagta

SEQ ID NO: 139451 - DNA, 16 bp, H. sapiens
tctctctctctcatat

SEQ ID NO: 139452 - DNA, 16 bp, H. sapiens
tctctctctctcccag

SEQ ID NO: 139453 - DNA, 16 bp, H. sapiens
tctctctctctctaac

SEQ ID NO: 139454 - DNA, 16 bp, H. sapiens
tctctctctctgactt

SEQ ID NO: 139455 - DNA, 16 bp, H. sapiens
tctctctctctgtcac

SEQ ID NO: 139456 - DNA, 16 bp, H. sapiens
tctctctctctgtctg

SEQ ID NO: 139457 - DNA, 16 bp, H. sapiens
tctctctctctttaaa

SEQ ID NO: 139458 - DNA, 16 bp, H. sapiens
tctctctctctttcaa

SEQ ID NO: 139459 - DNA, 16 bp, H. sapiens
tctctctctgactctg

SEQ ID NO: 139460 - DNA, 16 bp, H. sapiens
tctctctctgcatccc

SEQ ID NO: 139461 - DNA, 16 bp, H. sapiens
tctctctctgcctctg

SEQ ID NO: 139462 - DNA, 16 bp, H. sapiens
tctctctctgtctcgc

SEQ ID NO: 139463 - DNA, 16 bp, H. sapiens
tctctctctgtgcccc

SEQ ID NO: 139464 - DNA, 16 bp, H. sapiens
tctctctcttgcctga

SEQ ID NO: 139465 - DNA, 16 bp, H. sapiens
tctctctctttctatg

SEQ ID NO: 139466 - DNA, 16 bp, H. sapiens
tctctctctttctgac

SEQ ID NO: 139467 - DNA, 16 bp, H. sapiens
tctctctctttctgca

SEQ ID NO: 139468 - DNA, 16 bp, H. sapiens
tctctctctttgccta

SEQ ID NO: 139469 - DNA, 16 bp, H. sapiens
tctctctcttttaaaa

SEQ ID NO: 139470 - DNA, 16 bp, H. sapiens
tctctctgaagaaacc

SEQ ID NO: 139471 - DNA, 16 bp, H. sapiens
tctctctgactttctc

SEQ ID NO: 139472 - DNA, 16 bp, H. sapiens
tctctctgagactcag

SEQ ID NO: 139473 - DNA, 16 bp, H. sapiens
tctctctgatccacct

SEQ ID NO: 139474 - DNA, 16 bp, H. sapiens
tctctctgatgtccag

SEQ ID NO: 139475 - DNA, 16 bp, H. sapiens
tctctctgccagctga

SEQ ID NO: 139476 - DNA, 16 bp, H. sapiens
tctctctgcctcagtt

SEQ ID NO: 139477 - DNA, 16 bp, H. sapiens
tctctctgcctccagc

SEQ ID NO: 139478 - DNA, 16 bp, H. sapiens
tctctctgcctctgcc

SEQ ID NO: 139479 - DNA, 16 bp, H. sapiens
tctctctgcctgaaat

SEQ ID NO: 139480 - DNA, 16 bp, H. sapiens
tctctctgcttatatt

SEQ ID NO: 139481 - DNA, 16 bp, H. sapiens
tctctctggctctctg

SEQ ID NO: 139482 - DNA, 16 bp, H. sapiens
tctctctggctgccct

SEQ ID NO: 139483 - DNA, 16 bp, H. sapiens
tctctctggctgctct

SEQ ID NO: 139484 - DNA, 16 bp, H. sapiens
tctctctgtctccctg

SEQ ID NO: 139485 - DNA, 16 bp, H. sapiens
tctctctgtctctcat

SEQ ID NO: 139486 - DNA, 16 bp, H. sapiens
tctctctgtgcctcag

SEQ ID NO: 139487 - DNA, 16 bp, H. sapiens
tctctctgtgtcctcc

SEQ ID NO: 139488 - DNA, 16 bp, H. sapiens
tctctctgtgtctccc

SEQ ID NO: 139489 - DNA, 16 bp, H. sapiens
tctctctgtgtctcta

SEQ ID NO: 139490 - DNA, 16 bp, H. sapiens
tctctctgtgtctgtg

SEQ ID NO: 139491 - DNA, 16 bp, H. sapiens
tctctcttgccaccat

SEQ ID NO: 139492 - DNA, 16 bp, H. sapiens
tctctcttgctcccca

SEQ ID NO: 139493 - DNA, 16 bp, H. sapiens
tctctctttacacaca

SEQ ID NO: 139494 - DNA, 16 bp, H. sapiens
tctctctttttaaaaa

SEQ ID NO: 139495 - DNA, 16 bp, H. sapiens
tctctgaaaaaaaaaa

SEQ ID NO: 139496 - DNA, 16 bp, H. sapiens
tctctgaaaaaaagaa

SEQ ID NO: 139497 - DNA, 16 bp, H. sapiens
tctctgaaaaaacaaa

SEQ ID NO: 139498 - DNA, 16 bp, H. sapiens
tctctgaaaaggaatt

SEQ ID NO: 139499 - DNA, 16 bp, H. sapiens
tctctgaaaattattt

SEQ ID NO: 139500 - DNA, 16 bp, H. sapiens
tctctgaaactgcttt

SEQ ID NO: 139501 - DNA, 16 bp, H. sapiens
tctctgaaacttcttt

SEQ ID NO: 139502 - DNA, 16 bp, H. sapiens
tctctgaaataaaaaa

SEQ ID NO: 139503 - DNA, 20 bp, H. sapiens
tctctgaacataaattgtga

SEQ ID NO: 139504 - DNA, 16 bp, H. sapiens
tctctgaacctcaatt

SEQ ID NO: 139505 - DNA, 16 bp, H. sapiens
tctctgaactattttt

SEQ ID NO: 139506 - DNA, 16 bp, H. sapiens
tctctgaacttcagct

SEQ ID NO: 139507 - DNA, 16 bp, H. sapiens
tctctgaacttcattt

SEQ ID NO: 139508 - DNA, 16 bp, H. sapiens
tctctgaagaagacat

SEQ ID NO: 139509 - DNA, 16 bp, H. sapiens
tctctgaagatgattt

SEQ ID NO: 139510 - DNA, 16 bp, H. sapiens
tctctgaagtttcttt

SEQ ID NO: 139511 - DNA, 16 bp, H. sapiens
tctctgaatattcctt

SEQ ID NO: 139512 - DNA, 16 bp, H. sapiens
tctctgaattttattt

SEQ ID NO: 139513 - DNA, 16 bp, H. sapiens
tctctgacacacacac

SEQ ID NO: 139514 - DNA, 16 bp, H. sapiens
tctctgacccaggagt

SEQ ID NO: 139515 - DNA, 16 bp, H. sapiens
tctctgactgcagctc

SEQ ID NO: 139516 - DNA, 16 bp, H. sapiens
tctctgacttttcttt

SEQ ID NO: 139517 - DNA, 16 bp, H. sapiens
tctctgagaacttgtt

SEQ ID NO: 139518 - DNA, 16 bp, H. sapiens
tctctgagcctcagtg

SEQ ID NO: 139519 - DNA, 16 bp, H. sapiens
tctctgagcctcagtt

SEQ ID NO: 139520 - DNA, 16 bp, H. sapiens
tctctgagcctctgct

SEQ ID NO: 139521 - DNA, 16 bp, H. sapiens
tctctgagccttagtt

SEQ ID NO: 139522 - DNA, 16 bp, H. sapiens
tctctgagccttattt

SEQ ID NO: 139523 - DNA, 16 bp, H. sapiens
tctctgagccttgctt

SEQ ID NO: 139524 - DNA, 16 bp, H. sapiens
tctctgagccttggtt

SEQ ID NO: 139525 - DNA, 16 bp, H. sapiens
tctctgagcctttatt

SEQ ID NO: 139526 - DNA, 16 bp, H. sapiens
tctctgagctctgggc

SEQ ID NO: 139527 - DNA, 16 bp, H. sapiens
tctctgagcttcactt

SEQ ID NO: 139528 - DNA, 16 bp, H. sapiens
tctctgagcttcctgg

SEQ ID NO: 139529 - DNA, 16 bp, H. sapiens
tctctgagcttgagga

SEQ ID NO: 139530 - DNA, 16 bp, H. sapiens
tctctgaggaagtgat

SEQ ID NO: 139531 - DNA, 16 bp, H. sapiens
tctctgaggttttttt

SEQ ID NO: 139532 - DNA, 16 bp, H. sapiens
tctctgagtctgtttc

SEQ ID NO: 139533 - DNA, 16 bp, H. sapiens
tctctgagttttagtt

SEQ ID NO: 139534 - DNA, 16 bp, H. sapiens
tctctgatatcctttt

SEQ ID NO: 139535 - DNA, 16 bp, H. sapiens
tctctgatgaacattg

SEQ ID NO: 139536 - DNA, 16 bp, H. sapiens
tctctgatggccagtg

SEQ ID NO: 139537 - DNA, 16 bp, H. sapiens
tctctgatttcattga

SEQ ID NO: 139538 - DNA, 16 bp, H. sapiens
tctctgatttcttcaa

SEQ ID NO: 139539 - DNA, 16 bp, H. sapiens
tctctgcacctgagat

SEQ ID NO: 139540 - DNA, 16 bp, H. sapiens
tctctgcagaaacact

SEQ ID NO: 139541 - DNA, 16 bp, H. sapiens
tctctgcagaccagca

SEQ ID NO: 139542 - DNA, 16 bp, H. sapiens
tctctgcagagtccca

SEQ ID NO: 139543 - DNA, 16 bp, H. sapiens
tctctgcagcctctcc

SEQ ID NO: 139544 - DNA, 16 bp, H. sapiens
tctctgcaggtctctg

SEQ ID NO: 139545 - DNA, 16 bp, H. sapiens
tctctgcatccctggt

SEQ ID NO: 139546 - DNA, 16 bp, H. sapiens
tctctgcatctcctgg

SEQ ID NO: 139547 - DNA, 16 bp, H. sapiens
tctctgcatgtgagat

SEQ ID NO: 139548 - DNA, 16 bp, H. sapiens
tctctgccaggttttg

SEQ ID NO: 139549 - DNA, 16 bp, H. sapiens
tctctgcccagctgcc

SEQ ID NO: 139550 - DNA, 16 bp, H. sapiens
tctctgccctcaaaga

SEQ ID NO: 139551 - DNA, 16 bp, H. sapiens
tctctgccctcataga

SEQ ID NO: 139552 - DNA, 16 bp, H. sapiens
tctctgccctgtgtcc

SEQ ID NO: 139553 - DNA, 16 bp, H. sapiens
tctctgcctcagccac

SEQ ID NO: 139554 - DNA, 16 bp, H. sapiens
tctctgcctcagcctt

SEQ ID NO: 139555 - DNA, 16 bp, H. sapiens
tctctgcctccagcct

SEQ ID NO: 139556 - DNA, 16 bp, H. sapiens
tctctgcctcccaaag

SEQ ID NO: 139557 - DNA, 16 bp, H. sapiens
tctctgcctcccagac

SEQ ID NO: 139558 - DNA, 16 bp, H. sapiens
tctctgcctcctgcct

SEQ ID NO: 139559 - DNA, 16 bp, H. sapiens
tctctgcctcctggct

SEQ ID NO: 139560 - DNA, 16 bp, H. sapiens
tctctgcctctgcctc

SEQ ID NO: 139561 - DNA, 17 bp, H. sapiens
tctctgcctggctgccc

SEQ ID NO: 139562 - DNA, 16 bp, H. sapiens
tctctgcctggttttg

SEQ ID NO: 139563 - DNA, 16 bp, H. sapiens
tctctgcctgtctttc

SEQ ID NO: 139564 - DNA, 16 bp, H. sapiens
tctctgccttaatttc

SEQ ID NO: 139565 - DNA, 16 bp, H. sapiens
tctctgccttcaagaa

SEQ ID NO: 139566 - DNA, 16 bp, H. sapiens
tctctgccttcaagga

SEQ ID NO: 139567 - DNA, 16 bp, H. sapiens
tctctgccttcattgt

SEQ ID NO: 139568 - DNA, 16 bp, H. sapiens
tctctgccttccaggc

SEQ ID NO: 139569 - DNA, 16 bp, H. sapiens
tctctgcctttctggg

SEQ ID NO: 139570 - DNA, 16 bp, H. sapiens
tctctgccttttgatt

SEQ ID NO: 139571 - DNA, 16 bp, H. sapiens
tctctgctcactacag

SEQ ID NO: 139572 - DNA, 16 bp, H. sapiens
tctctgctcacttcaa

SEQ ID NO: 139573 - DNA, 16 bp, H. sapiens
tctctgctcagggtct

SEQ ID NO: 139574 - DNA, 16 bp, H. sapiens
tctctgctgagagctg

SEQ ID NO: 139575 - DNA, 16 bp, H. sapiens
tctctgctgatagctg

SEQ ID NO: 139576 - DNA, 16 bp, H. sapiens
tctctgctgctggaaa

SEQ ID NO: 139577 - DNA, 16 bp, H. sapiens
tctctgctgtctcttc

SEQ ID NO: 139578 - DNA, 16 bp, H. sapiens
tctctgcttcatagat

SEQ ID NO: 139579 - DNA, 16 bp, H. sapiens
tctctgcttcctgggc

SEQ ID NO: 139580 - DNA, 16 bp, H. sapiens
tctctgcttctgagat

SEQ ID NO: 139581 - DNA, 16 bp, H. sapiens
tctctgcttgcctgtt

SEQ ID NO: 139582 - DNA, 16 bp, H. sapiens
tctctgctttcctggg

SEQ ID NO: 139583 - DNA, 16 bp, H. sapiens
tctctggaacccagga

SEQ ID NO: 139584 - DNA, 16 bp, H. sapiens
tctctggaagttttgt

SEQ ID NO: 139585 - DNA, 16 bp, H. sapiens
tctctggagcaatgtc

SEQ ID NO: 139586 - DNA, 16 bp, H. sapiens
tctctggagggacaga

SEQ ID NO: 139587 - DNA, 16 bp, H. sapiens
tctctggattcagcag

SEQ ID NO: 139588 - DNA, 16 bp, H. sapiens
tctctggcaacaccct

SEQ ID NO: 139589 - DNA, 16 bp, H. sapiens
tctctggcccctcaag

SEQ ID NO: 139590 - DNA, 16 bp, H. sapiens
tctctggcgggcagag

SEQ ID NO: 139591 - DNA, 16 bp, H. sapiens
tctctggctggcaggg

SEQ ID NO: 139592 - DNA, 16 bp, H. sapiens
tctctggcttcctctc

SEQ ID NO: 139593 - DNA, 16 bp, H. sapiens
tctctgggaaacattt

SEQ ID NO: 139594 - DNA, 16 bp, H. sapiens
tctctgggaaaggcag

SEQ ID NO: 139595 - DNA, 16 bp, H. sapiens
tctctgggacacagtt

SEQ ID NO: 139596 - DNA, 16 bp, H. sapiens
tctctgggcactgggg

SEQ ID NO: 139597 - DNA, 16 bp, H. sapiens
tctctgggcctcactt

SEQ ID NO: 139598 - DNA, 16 bp, H. sapiens
tctctgggcctcagtg

SEQ ID NO: 139599 - DNA, 16 bp, H. sapiens
tctctgggcttcactt

SEQ ID NO: 139600 - DNA, 16 bp, H. sapiens
tctctgggcttcagtt

SEQ ID NO: 139601 - DNA, 16 bp, H. sapiens
tctctgggctttggtt

SEQ ID NO: 139602 - DNA, 16 bp, H. sapiens
tctctggggcctcttt

SEQ ID NO: 139603 - DNA, 16 bp, H. sapiens
tctctgggtctcaatt

SEQ ID NO: 139604 - DNA, 16 bp, H. sapiens
tctctgggtctcagct

SEQ ID NO: 139605 - DNA, 16 bp, H. sapiens
tctctgggtctctgtt

SEQ ID NO: 139606 - DNA, 27 bp, H. sapiens
tctctggtatctcagtcaggtcaatga

SEQ ID NO: 139607 - DNA, 16 bp, H. sapiens
tctctggtgcctcctt

SEQ ID NO: 139608 - DNA, 16 bp, H. sapiens
tctctggtgcttttct

SEQ ID NO: 139609 - DNA, 16 bp, H. sapiens
tctctggtgggcagag

SEQ ID NO: 139610 - DNA, 17 bp, H. sapiens
tctctgtcacccaggct

SEQ ID NO: 139611 - DNA, 16 bp, H. sapiens
tctctgtcactgaggc

SEQ ID NO: 139612 - DNA, 16 bp, H. sapiens
tctctgtcactgtctc

SEQ ID NO: 139613 - DNA, 16 bp, H. sapiens
tctctgtccctggttc

SEQ ID NO: 139614 - DNA, 16 bp, H. sapiens
tctctgtcctcatgga

SEQ ID NO: 139615 - DNA, 16 bp, H. sapiens
tctctgtcctgttcca

SEQ ID NO: 139616 - DNA, 16 bp, H. sapiens
tctctgtcgccaggct

SEQ ID NO: 139617 - DNA, 17 bp, H. sapiens
tctctgtcgcccaggct

SEQ ID NO: 139618 - DNA, 16 bp, H. sapiens
tctctgtcgcccaggt

SEQ ID NO: 139619 - DNA, 16 bp, H. sapiens
tctctgtctcactgtc

SEQ ID NO: 139620 - DNA, 16 bp, H. sapiens
tctctgtctccaaaaa

SEQ ID NO: 139621 - DNA, 16 bp, H. sapiens
tctctgtctccatctc

SEQ ID NO: 139622 - DNA, 16 bp, H. sapiens
tctctgtctcctgggc

SEQ ID NO: 139623 - DNA, 16 bp, H. sapiens
tctctgtctctctctg

SEQ ID NO: 139624 - DNA, 16 bp, H. sapiens
tctctgtctgcctctc

SEQ ID NO: 139625 - DNA, 16 bp, H. sapiens
tctctgtctgtccctc

SEQ ID NO: 139626 - DNA, 16 bp, H. sapiens
tctctgtcttcatgag

SEQ ID NO: 139627 - DNA, 16 bp, H. sapiens
tctctgtctttaaaaa

SEQ ID NO: 139628 - DNA, 16 bp, H. sapiens
tctctgtctttatttc

SEQ ID NO: 139629 - DNA, 16 bp, H. sapiens
tctctgtgcatcagtt

SEQ ID NO: 139630 - DNA, 16 bp, H. sapiens
tctctgtgccacatgg

SEQ ID NO: 139631 - DNA, 16 bp, H. sapiens
tctctgtgcctgtctc

SEQ ID NO: 139632 - DNA, 16 bp, H. sapiens
tctctgtgctgtgtgc

SEQ ID NO: 139633 - DNA, 16 bp, H. sapiens
tctctgtgcttcaatt

SEQ ID NO: 139634 - DNA, 16 bp, H. sapiens
tctctgtggccaccac

SEQ ID NO: 139635 - DNA, 16 bp, H. sapiens
tctctgtggccctggg

SEQ ID NO: 139636 - DNA, 16 bp, H. sapiens
tctctgtgtatctgtg

SEQ ID NO: 139637 - DNA, 16 bp, H. sapiens
tctctgtgtccaagtt

SEQ ID NO: 139638 - DNA, 16 bp, H. sapiens
tctctgtgtctctcct

SEQ ID NO: 139639 - DNA, 16 bp, H. sapiens
tctctgtgtctctctc

SEQ ID NO: 139640 - DNA, 16 bp, H. sapiens
tctctgtgtctgtgtg

SEQ ID NO: 139641 - DNA, 16 bp, H. sapiens
tctctgtgtgtgtctg

SEQ ID NO: 139642 - DNA, 16 bp, H. sapiens
tctctgtgtgtgtctt

SEQ ID NO: 139643 - DNA, 16 bp, H. sapiens
tctctgtgttacccag

SEQ ID NO: 139644 - DNA, 16 bp, H. sapiens
tctctgtgttgcccag

SEQ ID NO: 139645 - DNA, 16 bp, H. sapiens
tctctgttcatatcct

SEQ ID NO: 139646 - DNA, 16 bp, H. sapiens
tctctgttcttcagtt

SEQ ID NO: 139647 - DNA, 16 bp, H. sapiens
tctctgttgaattcca

SEQ ID NO: 139648 - DNA, 16 bp, H. sapiens
tctctgttgcattttt

SEQ ID NO: 139649 - DNA, 17 bp, H. sapiens
tctctgttgcccaagct

SEQ ID NO: 139650 - DNA, 16 bp, H. sapiens
tctctgtttatctgtt

SEQ ID NO: 139651 - DNA, 16 bp, H. sapiens
tctctgtttcccaggc

SEQ ID NO: 139652 - DNA, 16 bp, H. sapiens
tctctgtttgcaaatg

SEQ ID NO: 139653 - DNA, 16 bp, H. sapiens
tctctgtttgcagata

SEQ ID NO: 139654 - DNA, 16 bp, H. sapiens
tctctgttttttaaaa

SEQ ID NO: 139655 - DNA, 16 bp, H. sapiens
tctcttaaaaacaaaa

SEQ ID NO: 139656 - DNA, 16 bp, H. sapiens
tctcttcaaactgtgt

SEQ ID NO: 139657 - DNA, 16 bp, H. sapiens
tctcttcaaatatttt

SEQ ID NO: 139658 - DNA, 16 bp, H. sapiens
tctcttcaactggaat

SEQ ID NO: 139659 - DNA, 16 bp, H. sapiens
tctcttcaataaatgc

SEQ ID NO: 139660 - DNA, 16 bp, H. sapiens
tctcttcactctgatg

SEQ ID NO: 139661 - DNA, 16 bp, H. sapiens
tctcttcactgtgttg

SEQ ID NO: 139662 - DNA, 16 bp, H. sapiens
tctcttcagaaaatgg

SEQ ID NO: 139663 - DNA, 16 bp, H. sapiens
tctcttcagatctttt

SEQ ID NO: 139664 - DNA, 16 bp, H. sapiens
tctcttcataaatctt

SEQ ID NO: 139665 - DNA, 16 bp, H. sapiens
tctcttcatatccttc

SEQ ID NO: 139666 - DNA, 16 bp, H. sapiens
tctcttccacactgcc

SEQ ID NO: 139667 - DNA, 16 bp, H. sapiens
tctcttccaggctttg

SEQ ID NO: 139668 - DNA, 16 bp, H. sapiens
tctcttccagttggat

SEQ ID NO: 139669 - DNA, 16 bp, H. sapiens
tctcttccagtttctg

SEQ ID NO: 139670 - DNA, 16 bp, H. sapiens
tctcttcccagctcca

SEQ ID NO: 139671 - DNA, 16 bp, H. sapiens
tctcttcccagctctg

SEQ ID NO: 139672 - DNA, 16 bp, H. sapiens
tctcttcctctgtcag

SEQ ID NO: 139673 - DNA, 16 bp, H. sapiens
tctcttcctggtaatc

SEQ ID NO: 139674 - DNA, 16 bp, H. sapiens
tctcttcctgtgactt

SEQ ID NO: 139675 - DNA, 16 bp, H. sapiens
tctcttcctgtttgga

SEQ ID NO: 139676 - DNA, 16 bp, H. sapiens
tctcttcctttttgaa

SEQ ID NO: 139677 - DNA, 16 bp, H. sapiens
tctcttctctccacat

SEQ ID NO: 139678 - DNA, 16 bp, H. sapiens
tctcttctctgctgag

SEQ ID NO: 139679 - DNA, 16 bp, H. sapiens
tctcttctgctgcctt

SEQ ID NO: 139680 - DNA, 16 bp, H. sapiens
tctcttctggcttcat

SEQ ID NO: 139681 - DNA, 16 bp, H. sapiens
tctcttctgtaaaatg

SEQ ID NO: 139682 - DNA, 16 bp, H. sapiens
tctcttcttcctcagc

SEQ ID NO: 139683 - DNA, 16 bp, H. sapiens
tctcttctttctcaga

SEQ ID NO: 139684 - DNA, 16 bp, H. sapiens
tctcttctttctcagg

SEQ ID NO: 139685 - DNA, 16 bp, H. sapiens
tctcttgaaatatttt

SEQ ID NO: 139686 - DNA, 16 bp, H. sapiens
tctcttgaattatttt

SEQ ID NO: 139687 - DNA, 18 bp, H. sapiens
tctcttgacctcgtgatt

SEQ ID NO: 139688 - DNA, 16 bp, H. sapiens
tctcttgagcccagag

SEQ ID NO: 139689 - DNA, 16 bp, H. sapiens
tctcttgaggccaaga

SEQ ID NO: 139690 - DNA, 16 bp, H. sapiens
tctcttgccaccacca

SEQ ID NO: 139691 - DNA, 16 bp, H. sapiens
tctcttgcctgccact

SEQ ID NO: 139692 - DNA, 16 bp, H. sapiens
tctcttgcctgcctcc

SEQ ID NO: 139693 - DNA, 16 bp, H. sapiens
tctcttgcctgctgcc

SEQ ID NO: 139694 - DNA, 16 bp, H. sapiens
tctcttgctattttca

SEQ ID NO: 139695 - DNA, 16 bp, H. sapiens
tctcttgctgccctgt

SEQ ID NO: 139696 - DNA, 16 bp, H. sapiens
tctcttgctgccgcca

SEQ ID NO: 139697 - DNA, 16 bp, H. sapiens
tctcttgcttctgctc

SEQ ID NO: 139698 - DNA, 56 bp, H. sapiens
tctcttggcagaaaccctacaagccagaagagagtgggggccaatattcaacattc

SEQ ID NO: 139699 - DNA, 16 bp, H. sapiens
tctcttgtaaggcagg

SEQ ID NO: 139700 - DNA, 16 bp, H. sapiens
tctcttgtgatttctt

SEQ ID NO: 139701 - DNA, 16 bp, H. sapiens
tctcttgtggttttga

SEQ ID NO: 139702 - DNA, 16 bp, H. sapiens
tctcttgttggcattt

SEQ ID NO: 139703 - DNA, 16 bp, H. sapiens
tctcttgtttaaaaaa

SEQ ID NO: 139704 - DNA, 16 bp, H. sapiens
tctcttgtttaaattc

SEQ ID NO: 139705 - DNA, 16 bp, H. sapiens
tctctttaaataaaaa

SEQ ID NO: 139706 - DNA, 16 bp, H. sapiens
tctctttaccattatg

SEQ ID NO: 139707 - DNA, 16 bp, H. sapiens
tctctttagaaaaaaa

SEQ ID NO: 139708 - DNA, 16 bp, H. sapiens
tctctttataacagga

SEQ ID NO: 139709 - DNA, 16 bp, H. sapiens
tctctttataataaaa

SEQ ID NO: 139710 - DNA, 16 bp, H. sapiens
tctctttatttaaaaa

SEQ ID NO: 139711 - DNA, 16 bp, H. sapiens
tctctttcctcagctt

SEQ ID NO: 139712 - DNA, 16 bp, H. sapiens
tctctttcctgctgcc

SEQ ID NO: 139713 - DNA, 16 bp, H. sapiens
tctctttctcacacac

SEQ ID NO: 139714 - DNA, 16 bp, H. sapiens
tctctttctgtgcctg

SEQ ID NO: 139715 - DNA, 16 bp, H. sapiens
tctctttcttttcaaa

SEQ ID NO: 139716 - DNA, 16 bp, H. sapiens
tctctttcttttgaaa

SEQ ID NO: 139717 - DNA, 16 bp, H. sapiens
tctctttgaagaggaa

SEQ ID NO: 139718 - DNA, 16 bp, H. sapiens
tctctttgacttcttc

SEQ ID NO: 139719 - DNA, 16 bp, H. sapiens
tctctttgccagctgc

SEQ ID NO: 139720 - DNA, 16 bp, H. sapiens
tctctttgccattttt

SEQ ID NO: 139721 - DNA, 16 bp, H. sapiens
tctctttgcccttcca

SEQ ID NO: 139722 - DNA, 16 bp, H. sapiens
tctctttgcctactgc

SEQ ID NO: 139723 - DNA, 16 bp, H. sapiens
tctctttgctaaagca

SEQ ID NO: 139724 - DNA, 16 bp, H. sapiens
tctctttggaaaaaaa

SEQ ID NO: 139725 - DNA, 16 bp, H. sapiens
tctctttgtagcattt

SEQ ID NO: 139726 - DNA, 16 bp, H. sapiens
tctctttgtatgtctc

SEQ ID NO: 139727 - DNA, 16 bp, H. sapiens
tctctttgttaaaaca

SEQ ID NO: 139728 - DNA, 16 bp, H. sapiens
tctctttgttcccagg

SEQ ID NO: 139729 - DNA, 16 bp, H. sapiens
tctctttgttctcatt

SEQ ID NO: 139730 - DNA, 16 bp, H. sapiens
tctcttttaaaaaaag

SEQ ID NO: 139731 - DNA, 16 bp, H. sapiens
tctcttttaaaaaagt

SEQ ID NO: 139732 - DNA, 16 bp, H. sapiens
tctcttttaaaaatta

SEQ ID NO: 139733 - DNA, 16 bp, H. sapiens
tctcttttcatctttg

SEQ ID NO: 139734 - DNA, 16 bp, H. sapiens
tctcttttctttgaga

SEQ ID NO: 139735 - DNA, 16 bp, H. sapiens
tctctttttaaaagaa

SEQ ID NO: 139736 - DNA, 16 bp, H. sapiens
tctctttttaaaatgt

SEQ ID NO: 139737 - DNA, 16 bp, H. sapiens
tctgaaaaaaattaaa

SEQ ID NO: 139738 - DNA, 16 bp, H. sapiens
tctgaaaaaaattatt

SEQ ID NO: 139739 - DNA, 16 bp, H. sapiens
tctgaaaaaagaaatc

SEQ ID NO: 139740 - DNA, 16 bp, H. sapiens
tctgaaaaacagaaag

SEQ ID NO: 139741 - DNA, 16 bp, H. sapiens
tctgaaaaacattttt

SEQ ID NO: 139742 - DNA, 16 bp, H. sapiens
tctgaaaaagaaagaa

SEQ ID NO: 139743 - DNA, 16 bp, H. sapiens
tctgaaaaagaaatta

SEQ ID NO: 139744 - DNA, 16 bp, H. sapiens
tctgaaaaagaaattg

SEQ ID NO: 139745 - DNA, 16 bp, H. sapiens
tctgaaaaagaaattt

SEQ ID NO: 139746 - DNA, 16 bp, H. sapiens
tctgaaaaataaaata

SEQ ID NO: 139747 - DNA, 16 bp, H. sapiens
tctgaaaaataaatgt

SEQ ID NO: 139748 - DNA, 16 bp, H. sapiens
tctgaaaaatactttt

SEQ ID NO: 139749 - DNA, 16 bp, H. sapiens
tctgaaaaatatcttg

SEQ ID NO: 139750 - DNA, 16 bp, H. sapiens
tctgaaaaatgaaatt

SEQ ID NO: 139751 - DNA, 16 bp, H. sapiens
tctgaaaaatgagaat

SEQ ID NO: 139752 - DNA, 16 bp, H. sapiens
tctgaaaaattctgaa

SEQ ID NO: 139753 - DNA, 16 bp, H. sapiens
tctgaaaaattttttt

SEQ ID NO: 139754 - DNA, 16 bp, H. sapiens
tctgaaaacaaataaa

SEQ ID NO: 139755 - DNA, 16 bp, H. sapiens
tctgaaaacatttttt

SEQ ID NO: 139756 - DNA, 16 bp, H. sapiens
tctgaaaagaaaatta

SEQ ID NO: 139757 - DNA, 16 bp, H. sapiens
tctgaaaagaagatat

SEQ ID NO: 139758 - DNA, 16 bp, H. sapiens
tctgaaaagtcctgca

SEQ ID NO: 139759 - DNA, 16 bp, H. sapiens
tctgaaaagttaaata

SEQ ID NO: 139760 - DNA, 16 bp, H. sapiens
tctgaaaataaagaca

SEQ ID NO: 139761 - DNA, 16 bp, H. sapiens
tctgaaaataataata

SEQ ID NO: 139762 - DNA, 16 bp, H. sapiens
tctgaaaatactgaaa

SEQ ID NO: 139763 - DNA, 16 bp, H. sapiens
tctgaaaatatcttta

SEQ ID NO: 139764 - DNA, 16 bp, H. sapiens
tctgaaaatattttaa

SEQ ID NO: 139765 - DNA, 16 bp, H. sapiens
tctgaaaatgaaatta

SEQ ID NO: 139766 - DNA, 16 bp, H. sapiens
tctgaaaatgacttta

SEQ ID NO: 139767 - DNA, 16 bp, H. sapiens
tctgaaaatgagaaaa

SEQ ID NO: 139768 - DNA, 16 bp, H. sapiens
tctgaaaatgagaaat

SEQ ID NO: 139769 - DNA, 16 bp, H. sapiens
tctgaaaatgtcttta

SEQ ID NO: 139770 - DNA, 16 bp, H. sapiens
tctgaaaatgtctttg

SEQ ID NO: 139771 - DNA, 16 bp, H. sapiens
tctgaaaatgttttta

SEQ ID NO: 139772 - DNA, 16 bp, H. sapiens
tctgaaaattttcaga

SEQ ID NO: 139773 - DNA, 16 bp, H. sapiens
tctgaaaatttttttt

SEQ ID NO: 139774 - DNA, 16 bp, H. sapiens
tctgaaacctcatcag

SEQ ID NO: 139775 - DNA, 18 bp, H. sapiens
tctgaaacctgggtgaat

SEQ ID NO: 139776 - DNA, 16 bp, H. sapiens
tctgaaactcctgacc

SEQ ID NO: 139777 - DNA, 16 bp, H. sapiens
tctgaaagaaaaataa

SEQ ID NO: 139778 - DNA, 16 bp, H. sapiens
tctgaaagaaaattat

SEQ ID NO: 139779 - DNA, 16 bp, H. sapiens
tctgaaagaagagaaa

SEQ ID NO: 139780 - DNA, 16 bp, H. sapiens
tctgaaagacagtttg

SEQ ID NO: 139781 - DNA, 16 bp, H. sapiens
tctgaaagagcaaaaa

SEQ ID NO: 139782 - DNA, 16 bp, H. sapiens
tctgaaagctgggaag

SEQ ID NO: 139783 - DNA, 16 bp, H. sapiens
tctgaaatcaacaccc

SEQ ID NO: 139784 - DNA, 16 bp, H. sapiens
tctgaaatccaaaatc

SEQ ID NO: 139785 - DNA, 16 bp, H. sapiens
tctgaaatccagcaag

SEQ ID NO: 139786 - DNA, 16 bp, H. sapiens
tctgaaatccagcggg

SEQ ID NO: 139787 - DNA, 16 bp, H. sapiens
tctgaaatctgcaggg

SEQ ID NO: 139788 - DNA, 17 bp, H. sapiens
tctgaaatgatctcctt

SEQ ID NO: 139789 - DNA, 16 bp, H. sapiens
tctgaaatgctccagt

SEQ ID NO: 139790 - DNA, 17 bp, H. sapiens
tctgaaatgcttgggat

SEQ ID NO: 139791 - DNA, 16 bp, H. sapiens
tctgaaattatttcct

SEQ ID NO: 139792 - DNA, 16 bp, H. sapiens
tctgaaattcaagttt

SEQ ID NO: 139793 - DNA, 16 bp, H. sapiens
tctgaaattctccaaa

SEQ ID NO: 139794 - DNA, 16 bp, H. sapiens
tctgaaattctgtttt

SEQ ID NO: 139795 - DNA, 16 bp, H. sapiens
tctgaaattgaattag

SEQ ID NO: 139796 - DNA, 20 bp, H. sapiens
tctgaaattgaggcaataat

SEQ ID NO: 139797 - DNA, 20 bp, H. sapiens
tctgaaattgaggcagtaat

SEQ ID NO: 139798 - DNA, 16 bp, H. sapiens
tctgaaatttacattt

SEQ ID NO: 139799 - DNA, 16 bp, H. sapiens
tctgaaatttttaaaa

SEQ ID NO: 139800 - DNA, 16 bp, H. sapiens
tctgaaatttttcaaa

SEQ ID NO: 139801 - DNA, 16 bp, H. sapiens
tctgaacctcagtttc

SEQ ID NO: 139802 - DNA, 16 bp, H. sapiens
tctgaacctctgtttc

SEQ ID NO: 139803 - DNA, 16 bp, H. sapiens
tctgaacttgaagaca

SEQ ID NO: 139804 - DNA, 16 bp, H. sapiens
tctgaagaaaacaaaa

SEQ ID NO: 139805 - DNA, 16 bp, H. sapiens
tctgaagaaagcagca

SEQ ID NO: 139806 - DNA, 16 bp, H. sapiens
tctgaagaacaaagag

SEQ ID NO: 139807 - DNA, 16 bp, H. sapiens
tctgaagaagaggaaa

SEQ ID NO: 139808 - DNA, 16 bp, H. sapiens
tctgaagaattttttt

SEQ ID NO: 139809 - DNA, 16 bp, H. sapiens
tctgaagacatttcta

SEQ ID NO: 139810 - DNA, 16 bp, H. sapiens
tctgaagacatttttg

SEQ ID NO: 139811 - DNA, 16 bp, H. sapiens
tctgaagacctgggat

SEQ ID NO: 139812 - DNA, 16 bp, H. sapiens
tctgaagactgggaag

SEQ ID NO: 139813 - DNA, 16 bp, H. sapiens
tctgaagatctgctca

SEQ ID NO: 139814 - DNA, 16 bp, H. sapiens
tctgaagatgattttg

SEQ ID NO: 139815 - DNA, 16 bp, H. sapiens
tctgaagatgtgactg

SEQ ID NO: 139816 - DNA, 16 bp, H. sapiens
tctgaagatgtttcct

SEQ ID NO: 139817 - DNA, 16 bp, H. sapiens
tctgaagccatagcct

SEQ ID NO: 139818 - DNA, 16 bp, H. sapiens
tctgaagccatggccc

SEQ ID NO: 139819 - DNA, 16 bp, H. sapiens
tctgaagcccataaaa

SEQ ID NO: 139820 - DNA, 16 bp, H. sapiens
tctgaagcctctgctg

SEQ ID NO: 139821 - DNA, 16 bp, H. sapiens
tctgaagctgaaaaat

SEQ ID NO: 139822 - DNA, 16 bp, H. sapiens
tctgaagctttgaagc

SEQ ID NO: 139823 - DNA, 16 bp, H. sapiens
tctgaaggaacaaact

SEQ ID NO: 139824 - DNA, 16 bp, H. sapiens
tctgaaggataatttt

SEQ ID NO: 139825 - DNA, 16 bp, H. sapiens
tctgaaggctctaggg

SEQ ID NO: 139826 - DNA, 16 bp, H. sapiens
tctgaaggctgaaagt

SEQ ID NO: 139827 - DNA, 16 bp, H. sapiens
tctgaaggctgtgaga

SEQ ID NO: 139828 - DNA, 31 bp, H. sapiens
tctgaaggctgtgagacccctgatttcccac

SEQ ID NO: 139829 - DNA, 16 bp, H. sapiens
tctgaagtattttatt

SEQ ID NO: 139830 - DNA, 16 bp, H. sapiens
tctgaagtgttttttt

SEQ ID NO: 139831 - DNA, 16 bp, H. sapiens
tctgaagttttctttt

SEQ ID NO: 139832 - DNA, 16 bp, H. sapiens
tctgaagtttttattt

SEQ ID NO: 139833 - DNA, 16 bp, H. sapiens
tctgaataggaaacat

SEQ ID NO: 139834 - DNA, 16 bp, H. sapiens
tctgaatatatatttc

SEQ ID NO: 139835 - DNA, 16 bp, H. sapiens
tctgaatatattaaaa

SEQ ID NO: 139836 - DNA, 16 bp, H. sapiens
tctgaatctgtttcct

SEQ ID NO: 139837 - DNA, 16 bp, H. sapiens
tctgaatgcctggaga

SEQ ID NO: 139838 - DNA, 16 bp, H. sapiens
tctgaatgtgtccccc

SEQ ID NO: 139839 - DNA, 16 bp, H. sapiens
tctgaatgtgtctgtg

SEQ ID NO: 139840 - DNA, 16 bp, H. sapiens
tctgaatgtttgtgtc

SEQ ID NO: 139841 - DNA, 16 bp, H. sapiens
tctgaattattttctt

SEQ ID NO: 139842 - DNA, 16 bp, H. sapiens
tctgaattcctttttt

SEQ ID NO: 139843 - DNA, 16 bp, H. sapiens
tctgaatttatttaaa

SEQ ID NO: 139844 - DNA, 16 bp, H. sapiens
tctgaatttctaacaa

SEQ ID NO: 139845 - DNA, 16 bp, H. sapiens
tctgaatttcttcttt

SEQ ID NO: 139846 - DNA, 16 bp, H. sapiens
tctgaatttcttgaat

SEQ ID NO: 139847 - DNA, 16 bp, H. sapiens
tctgaattttgctgat

SEQ ID NO: 139848 - DNA, 16 bp, H. sapiens
tctgaattttggagaa

SEQ ID NO: 139849 - DNA, 16 bp, H. sapiens
tctgaatttttcttct

SEQ ID NO: 139850 - DNA, 16 bp, H. sapiens
tctgaattttttaaaa

SEQ ID NO: 139851 - DNA, 16 bp, H. sapiens
tctgacaaaacagact

SEQ ID NO: 139852 - DNA, 17 bp, H. sapiens
tctgacaaagatctaat

SEQ ID NO: 139853 - DNA, 16 bp, H. sapiens
tctgacaactttcaca

SEQ ID NO: 139854 - DNA, 16 bp, H. sapiens
tctgacaagggattaa

SEQ ID NO: 139855 - DNA, 16 bp, H. sapiens
tctgacagagctgaat

SEQ ID NO: 139856 - DNA, 16 bp, H. sapiens
tctgacagatgaggaa

SEQ ID NO: 139857 - DNA, 16 bp, H. sapiens
tctgacatacagagaa

SEQ ID NO: 139858 - DNA, 17 bp, H. sapiens
tctgacatgtcctggag

SEQ ID NO: 139859 - DNA, 16 bp, H. sapiens
tctgacattccctgga

SEQ ID NO: 139860 - DNA, 16 bp, H. sapiens
tctgacatttcccctg

SEQ ID NO: 139861 - DNA, 16 bp, H. sapiens
tctgacatttttttct

SEQ ID NO: 139862 - DNA, 16 bp, H. sapiens
tctgaccacttctcac

SEQ ID NO: 139863 - DNA, 16 bp, H. sapiens
tctgacctacagaact

SEQ ID NO: 139864 - DNA, 16 bp, H. sapiens
tctgacctcaagtgat

SEQ ID NO: 139865 - DNA, 18 bp, H. sapiens
tctgacctcaggtgatcc

SEQ ID NO: 139866 - DNA, 22 bp, H. sapiens
tctgacctcaggtgatccaccc

SEQ ID NO: 139867 - DNA, 16 bp, H. sapiens
tctgacctcagtttcc

SEQ ID NO: 139868 - DNA, 16 bp, H. sapiens
tctgacctcatgatcc

SEQ ID NO: 139869 - DNA, 16 bp, H. sapiens
tctgacctcatttcct

SEQ ID NO: 139870 - DNA, 20 bp, H. sapiens
tctgacctcgtgatctgccc

SEQ ID NO: 139871 - DNA, 16 bp, H. sapiens
tctgaccttgtgatcc

SEQ ID NO: 139872 - DNA, 16 bp, H. sapiens
tctgacctttctctct

SEQ ID NO: 139873 - DNA, 16 bp, H. sapiens
tctgactccagagctt

SEQ ID NO: 139874 - DNA, 16 bp, H. sapiens
tctgactccattccca

SEQ ID NO: 139875 - DNA, 16 bp, H. sapiens
tctgactctgtcaccc

SEQ ID NO: 139876 - DNA, 16 bp, H. sapiens
tctgactctgtctccc

SEQ ID NO: 139877 - DNA, 16 bp, H. sapiens
tctgactggcttcttt

SEQ ID NO: 139878 - DNA, 16 bp, H. sapiens
tctgacttcatttttc

SEQ ID NO: 139879 - DNA, 16 bp, H. sapiens
tctgacttcttttatt

SEQ ID NO: 139880 - DNA, 16 bp, H. sapiens
tctgactttctcttct

SEQ ID NO: 139881 - DNA, 16 bp, H. sapiens
tctgactttgtcaccc

SEQ ID NO: 139882 - DNA, 16 bp, H. sapiens
tctgactttgttgccc

SEQ ID NO: 139883 - DNA, 16 bp, H. sapiens
tctgacttttaaaaat

SEQ ID NO: 139884 - DNA, 16 bp, H. sapiens
tctgagaaagccatca

SEQ ID NO: 139885 - DNA, 16 bp, H. sapiens
tctgagaaataaatgt

SEQ ID NO: 139886 - DNA, 16 bp, H. sapiens
tctgagaacatcagag

SEQ ID NO: 139887 - DNA, 20 bp, H. sapiens
tctgagaagtatgctcagca

SEQ ID NO: 139888 - DNA, 16 bp, H. sapiens
tctgagaagtgaggag

SEQ ID NO: 139889 - DNA, 16 bp, H. sapiens
tctgagaatagacaga

SEQ ID NO: 139890 - DNA, 16 bp, H. sapiens
tctgagacaggtctca

SEQ ID NO: 139891 - DNA, 16 bp, H. sapiens
tctgagacagtgtctt

SEQ ID NO: 139892 - DNA, 16 bp, H. sapiens
tctgagacggagtctc

SEQ ID NO: 139893 - DNA, 16 bp, H. sapiens
tctgagactcagtttt

SEQ ID NO: 139894 - DNA, 16 bp, H. sapiens
tctgagactctgtctc

SEQ ID NO: 139895 - DNA, 16 bp, H. sapiens
tctgagagaaaaaaaa

SEQ ID NO: 139896 - DNA, 16 bp, H. sapiens
tctgagagaatacttg

SEQ ID NO: 139897 - DNA, 16 bp, H. sapiens
tctgagagagagtttg

SEQ ID NO: 139898 - DNA, 16 bp, H. sapiens
tctgagatactggggg

SEQ ID NO: 139899 - DNA, 16 bp, H. sapiens
tctgagatcaggatgc

SEQ ID NO: 139900 - DNA, 16 bp, H. sapiens
tctgagatggaatctc

SEQ ID NO: 139901 - DNA, 16 bp, H. sapiens
tctgagatggagatga

SEQ ID NO: 139902 - DNA, 27 bp, H. sapiens
tctgagatgtggggagcgcctctgccc

SEQ ID NO: 139903 - DNA, 16 bp, H. sapiens
tctgagattctttcct

SEQ ID NO: 139904 - DNA, 16 bp, H. sapiens
tctgagattttaccct

SEQ ID NO: 139905 - DNA, 16 bp, H. sapiens
tctgagcaggaggcag

SEQ ID NO: 139906 - DNA, 16 bp, H. sapiens
tctgagccaggatgag

SEQ ID NO: 139907 - DNA, 16 bp, H. sapiens
tctgagccaggtgagg

SEQ ID NO: 139908 - DNA, 16 bp, H. sapiens
tctgagcccagctcag

SEQ ID NO: 139909 - DNA, 16 bp, H. sapiens
tctgagcccagggagg

SEQ ID NO: 139910 - DNA, 16 bp, H. sapiens
tctgagcctcaatttc

SEQ ID NO: 139911 - DNA, 16 bp, H. sapiens
tctgagcctcaggctc

SEQ ID NO: 139912 - DNA, 16 bp, H. sapiens
tctgagcctcagttta

SEQ ID NO: 139913 - DNA, 17 bp, H. sapiens
tctgagcctcagttttc

SEQ ID NO: 139914 - DNA, 16 bp, H. sapiens
tctgagcctcccaaag

SEQ ID NO: 139915 - DNA, 16 bp, H. sapiens
tctgagcctcccgagt

SEQ ID NO: 139916 - DNA, 16 bp, H. sapiens
tctgagcctgtttctt

SEQ ID NO: 139917 - DNA, 16 bp, H. sapiens
tctgagccttagtttc

SEQ ID NO: 139918 - DNA, 16 bp, H. sapiens
tctgagcctttgtttc

SEQ ID NO: 139919 - DNA, 16 bp, H. sapiens
tctgagctcaagcaat

SEQ ID NO: 139920 - DNA, 16 bp, H. sapiens
tctgagctcagacaca

SEQ ID NO: 139921 - DNA, 16 bp, H. sapiens
tctgaggaagaagaga

SEQ ID NO: 139922 - DNA, 16 bp, H. sapiens
tctgaggaggtgacat

SEQ ID NO: 139923 - DNA, 16 bp, H. sapiens
tctgaggccagcctgg

SEQ ID NO: 139924 - DNA, 16 bp, H. sapiens
tctgaggcccaggctg

SEQ ID NO: 139925 - DNA, 16 bp, H. sapiens
tctgaggccctcacca

SEQ ID NO: 139926 - DNA, 16 bp, H. sapiens
tctgaggctcagagag

SEQ ID NO: 139927 - DNA, 16 bp, H. sapiens
tctgagggctgtgagg

SEQ ID NO: 139928 - DNA, 16 bp, H. sapiens
tctgaggtcaggaatt

SEQ ID NO: 139929 - DNA, 16 bp, H. sapiens
tctgaggtcctgggga

SEQ ID NO: 139930 - DNA, 16 bp, H. sapiens
tctgaggtcctttcca

SEQ ID NO: 139931 - DNA, 16 bp, H. sapiens
tctgaggtggaacagc

SEQ ID NO: 139932 - DNA, 16 bp, H. sapiens
tctgagtagctaggac

SEQ ID NO: 139933 - DNA, 17 bp, H. sapiens
tctgagtctattgagat

SEQ ID NO: 139934 - DNA, 16 bp, H. sapiens
tctgagtctgttttct

SEQ ID NO: 139935 - DNA, 16 bp, H. sapiens
tctgagtcttggtttc

SEQ ID NO: 139936 - DNA, 16 bp, H. sapiens
tctgagtgtggtggtg

SEQ ID NO: 139937 - DNA, 16 bp, H. sapiens
tctgagtgtgtttgtg

SEQ ID NO: 139938 - DNA, 16 bp, H. sapiens
tctgagttcaaatctt

SEQ ID NO: 139939 - DNA, 16 bp, H. sapiens
tctgagttcctttctc

SEQ ID NO: 139940 - DNA, 16 bp, H. sapiens
tctgagtttctttcct

SEQ ID NO: 139941 - DNA, 16 bp, H. sapiens
tctgagtttgaatcct

SEQ ID NO: 139942 - DNA, 16 bp, H. sapiens
tctgagtttgactttt

SEQ ID NO: 139943 - DNA, 16 bp, H. sapiens
tctgagttttagtttc

SEQ ID NO: 139944 - DNA, 16 bp, H. sapiens
tctgataaacagactt

SEQ ID NO: 139945 - DNA, 16 bp, H. sapiens
tctgataaagggctaa

SEQ ID NO: 139946 - DNA, 16 bp, H. sapiens
tctgataaatattgat

SEQ ID NO: 139947 - DNA, 16 bp, H. sapiens
tctgatacccaggctg

SEQ ID NO: 139948 - DNA, 16 bp, H. sapiens
tctgatagagaaaaag

SEQ ID NO: 139949 - DNA, 16 bp, H. sapiens
tctgatagttttataa

SEQ ID NO: 139950 - DNA, 16 bp, H. sapiens
tctgatattttctatt

SEQ ID NO: 139951 - DNA, 16 bp, H. sapiens
tctgatcatcctcact

SEQ ID NO: 139952 - DNA, 16 bp, H. sapiens
tctgatctcaggtgat

SEQ ID NO: 139953 - DNA, 16 bp, H. sapiens
tctgatctcctgacct

SEQ ID NO: 139954 - DNA, 16 bp, H. sapiens
tctgatcttaggggaa

SEQ ID NO: 139955 - DNA, 16 bp, H. sapiens
tctgatctttatttct

SEQ ID NO: 139956 - DNA, 16 bp, H. sapiens
tctgatgaaaatttat

SEQ ID NO: 139957 - DNA, 16 bp, H. sapiens
tctgatgaaacttttt

SEQ ID NO: 139958 - DNA, 16 bp, H. sapiens
tctgatgactttataa

SEQ ID NO: 139959 - DNA, 16 bp, H. sapiens
tctgatgagaatttgt

SEQ ID NO: 139960 - DNA, 16 bp, H. sapiens
tctgatgagatggaga

SEQ ID NO: 139961 - DNA, 16 bp, H. sapiens
tctgatgatttcataa

SEQ ID NO: 139962 - DNA, 16 bp, H. sapiens
tctgatgctgctgctg

SEQ ID NO: 139963 - DNA, 16 bp, H. sapiens
tctgatggaggagaca

SEQ ID NO: 139964 - DNA, 16 bp, H. sapiens
tctgatggctttgtaa

SEQ ID NO: 139965 - DNA, 16 bp, H. sapiens
tctgatggttctaaaa

SEQ ID NO: 139966 - DNA, 16 bp, H. sapiens
tctgatggtttataag

SEQ ID NO: 139967 - DNA, 16 bp, H. sapiens
tctgatgtgctgctgg

SEQ ID NO: 139968 - DNA, 17 bp, H. sapiens
tctgatgtggtttagta

SEQ ID NO: 139969 - DNA, 16 bp, H. sapiens
tctgatgttctcagaa

SEQ ID NO: 139970 - DNA, 16 bp, H. sapiens
tctgatgtttcctgac

SEQ ID NO: 139971 - DNA, 16 bp, H. sapiens
tctgattccaaagcct

SEQ ID NO: 139972 - DNA, 16 bp, H. sapiens
tctgattctgattctg

SEQ ID NO: 139973 - DNA, 16 bp, H. sapiens
tctgattgccagtgat

SEQ ID NO: 139974 - DNA, 16 bp, H. sapiens
tctgattggcccagct

SEQ ID NO: 139975 - DNA, 16 bp, H. sapiens
tctgattggttgcttt

SEQ ID NO: 139976 - DNA, 16 bp, H. sapiens
tctgattgtttccttt

SEQ ID NO: 139977 - DNA, 16 bp, H. sapiens
tctgatttaattctca

SEQ ID NO: 139978 - DNA, 16 bp, H. sapiens
tctgatttctttcact

SEQ ID NO: 139979 - DNA, 16 bp, H. sapiens
tctgattttaaaaagt

SEQ ID NO: 139980 - DNA, 16 bp, H. sapiens
tctgatttttaaaaat

SEQ ID NO: 139981 - DNA, 16 bp, H. sapiens
tctgatttttaaaatt

SEQ ID NO: 139982 - DNA, 16 bp, H. sapiens
tctgatttttaaattt

SEQ ID NO: 139983 - DNA, 16 bp, H. sapiens
tctgatttttcaaatt

SEQ ID NO: 139984 - DNA, 16 bp, H. sapiens
tctgatttttcactca

SEQ ID NO: 139985 - DNA, 16 bp, H. sapiens
tctgatttttctcatt

SEQ ID NO: 139986 - DNA, 16 bp, H. sapiens
tctgatttttggaatt

SEQ ID NO: 139987 - DNA, 16 bp, H. sapiens
tctgcaaaactgaact

SEQ ID NO: 139988 - DNA, 16 bp, H. sapiens
tctgcaaaatgaggaa

SEQ ID NO: 139989 - DNA, 16 bp, H. sapiens
tctgcaaaatggagat

SEQ ID NO: 139990 - DNA, 16 bp, H. sapiens
tctgcaaaatgggaaa

SEQ ID NO: 139991 - DNA, 16 bp, H. sapiens
tctgcaaaatgggggt

SEQ ID NO: 139992 - DNA, 38 bp, H. sapiens
tctgcaaacagggacaatttgacttcctcttttcctaa

SEQ ID NO: 139993 - DNA, 16 bp, H. sapiens
tctgcaaacatttatt

SEQ ID NO: 139994 - DNA, 16 bp, H. sapiens
tctgcaaaccagaaag

SEQ ID NO: 139995 - DNA, 16 bp, H. sapiens
tctgcaaacggagaca

SEQ ID NO: 139996 - DNA, 16 bp, H. sapiens
tctgcaaacttaaatg

SEQ ID NO: 139997 - DNA, 16 bp, H. sapiens
tctgcaaagaaaaaaa

SEQ ID NO: 139998 - DNA, 16 bp, H. sapiens
tctgcaaagagtcctg

SEQ ID NO: 139999 - DNA, 16 bp, H. sapiens
tctgcaaagggatatt

SEQ ID NO: 140000 - DNA, 16 bp, H. sapiens
tctgcaaagggccaga

SEQ ID NO: 140001 - DNA, 16 bp, H. sapiens
tctgcaaagtggagat

SEQ ID NO: 140002 - DNA, 16 bp, H. sapiens
tctgcaaataataatt

SEQ ID NO: 140003 - DNA, 16 bp, H. sapiens
tctgcaaatctaaaac

SEQ ID NO: 140004 - DNA, 16 bp, H. sapiens
tctgcaaatgaggaaa

SEQ ID NO: 140005 - DNA, 16 bp, H. sapiens
tctgcaaatgttttct

SEQ ID NO: 140006 - DNA, 16 bp, H. sapiens
tctgcaacaggtccag

SEQ ID NO: 140007 - DNA, 16 bp, H. sapiens
tctgcaacctcatcag

SEQ ID NO: 140008 - DNA, 16 bp, H. sapiens
tctgcaacctccacct

SEQ ID NO: 140009 - DNA, 17 bp, H. sapiens
tctgcaacctccgcctc

SEQ ID NO: 140010 - DNA, 16 bp, H. sapiens
tctgcaagaatggcca

SEQ ID NO: 140011 - DNA, 16 bp, H. sapiens
tctgcaagccaagcag

SEQ ID NO: 140012 - DNA, 16 bp, H. sapiens
tctgcaagctgagaag

SEQ ID NO: 140013 - DNA, 16 bp, H. sapiens
tctgcaagctgaggag

SEQ ID NO: 140014 - DNA, 16 bp, H. sapiens
tctgcaagcttgagga

SEQ ID NO: 140015 - DNA, 16 bp, H. sapiens
tctgcacagcagaaga

SEQ ID NO: 140016 - DNA, 16 bp, H. sapiens
tctgcacatgtattct

SEQ ID NO: 140017 - DNA, 16 bp, H. sapiens
tctgcactcccatttt

SEQ ID NO: 140018 - DNA, 17 bp, H. sapiens
tctgcactgtgtctgtc

SEQ ID NO: 140019 - DNA, 16 bp, H. sapiens
tctgcagaaactctac

SEQ ID NO: 140020 - DNA, 16 bp, H. sapiens
tctgcagacagcaggt

SEQ ID NO: 140021 - DNA, 41 bp, H. sapiens
tctgcagacttaaatgtccctgtctgacagctttgaagaga

SEQ ID NO: 140022 - DNA, 16 bp, H. sapiens
tctgcagagactgtgg

SEQ ID NO: 140023 - DNA, 16 bp, H. sapiens
tctgcagaggcctcag

SEQ ID NO: 140024 - DNA, 16 bp, H. sapiens
tctgcagaggttactg

SEQ ID NO: 140025 - DNA, 16 bp, H. sapiens
tctgcagatggcaaag

SEQ ID NO: 140026 - DNA, 16 bp, H. sapiens
tctgcagattcaacca

SEQ ID NO: 140027 - DNA, 16 bp, H. sapiens
tctgcagcaacatgga

SEQ ID NO: 140028 - DNA, 21 bp, H. sapiens
tctgcagcactgtgacatgtt

SEQ ID NO: 140029 - DNA, 16 bp, H. sapiens
tctgcagcagagaggg

SEQ ID NO: 140030 - DNA, 16 bp, H. sapiens
tctgcagcagttgggt

SEQ ID NO: 140031 - DNA, 16 bp, H. sapiens
tctgcagcatctgctg

SEQ ID NO: 140032 - DNA, 16 bp, H. sapiens
tctgcagccacagctg

SEQ ID NO: 140033 - DNA, 16 bp, H. sapiens
tctgcagccagcttca

SEQ ID NO: 140034 - DNA, 16 bp, H. sapiens
tctgcagccagcttgg

SEQ ID NO: 140035 - DNA, 16 bp, H. sapiens
tctgcagcccaagctg

SEQ ID NO: 140036 - DNA, 16 bp, H. sapiens
tctgcagcctcctctg

SEQ ID NO: 140037 - DNA, 16 bp, H. sapiens
tctgcagcctctgcta

SEQ ID NO: 140038 - DNA, 18 bp, H. sapiens
tctgcagccttgacctcc

SEQ ID NO: 140039 - DNA, 16 bp, H. sapiens
tctgcagctcccagag

SEQ ID NO: 140040 - DNA, 16 bp, H. sapiens
tctgcagctcccagcg

SEQ ID NO: 140041 - DNA, 16 bp, H. sapiens
tctgcagctgcagttg

SEQ ID NO: 140042 - DNA, 20 bp, H. sapiens
tctgcagcttcactcctgaa

SEQ ID NO: 140043 - DNA, 16 bp, H. sapiens
tctgcagcttcctccc

SEQ ID NO: 140044 - DNA, 16 bp, H. sapiens
tctgcagcttccttac

SEQ ID NO: 140045 - DNA, 16 bp, H. sapiens
tctgcaggaggtcctg

SEQ ID NO: 140046 - DNA, 16 bp, H. sapiens
tctgcaggatgtacag

SEQ ID NO: 140047 - DNA, 16 bp, H. sapiens
tctgcaggcaggtcgt

SEQ ID NO: 140048 - DNA, 16 bp, H. sapiens
tctgcaggctgagaag

SEQ ID NO: 140049 - DNA, 16 bp, H. sapiens
tctgcaggctgggaag

SEQ ID NO: 140050 - DNA, 16 bp, H. sapiens
tctgcagggctgggga

SEQ ID NO: 140051 - DNA, 16 bp, H. sapiens
tctgcaggtcagaagt

SEQ ID NO: 140052 - DNA, 16 bp, H. sapiens
tctgcaggtctctgaa

SEQ ID NO: 140053 - DNA, 16 bp, H. sapiens
tctgcaggtggatatt

SEQ ID NO: 140054 - DNA, 16 bp, H. sapiens
tctgcagtgagccatg

SEQ ID NO: 140055 - DNA, 20 bp, H. sapiens
tctgcagtgagctatgatca

SEQ ID NO: 140056 - DNA, 16 bp, H. sapiens
tctgcagtggctggta

SEQ ID NO: 140057 - DNA, 16 bp, H. sapiens
tctgcagttcctggtg

SEQ ID NO: 140058 - DNA, 16 bp, H. sapiens
tctgcagttgctgggt

SEQ ID NO: 140059 - DNA, 16 bp, H. sapiens
tctgcagttgttgaat

SEQ ID NO: 140060 - DNA, 16 bp, H. sapiens
tctgcagtttcttcct

SEQ ID NO: 140061 - DNA, 16 bp, H. sapiens
tctgcagttttctttt

SEQ ID NO: 140062 - DNA, 16 bp, H. sapiens
tctgcagttttgtttt

SEQ ID NO: 140063 - DNA, 16 bp, H. sapiens
tctgcataataaccag

SEQ ID NO: 140064 - DNA, 16 bp, H. sapiens
tctgcatatatatata

SEQ ID NO: 140065 - DNA, 16 bp, H. sapiens
tctgcatcctgctggt

SEQ ID NO: 140066 - DNA, 16 bp, H. sapiens
tctgcatctactgaaa

SEQ ID NO: 140067 - DNA, 16 bp, H. sapiens
tctgcatctgcagatt

SEQ ID NO: 140068 - DNA, 16 bp, H. sapiens
tctgcatctgtggatt

SEQ ID NO: 140069 - DNA, 16 bp, H. sapiens
tctgcatctgttgata

SEQ ID NO: 140070 - DNA, 16 bp, H. sapiens
tctgcatcttaacaag

SEQ ID NO: 140071 - DNA, 16 bp, H. sapiens
tctgcatgctccccct

SEQ ID NO: 140072 - DNA, 16 bp, H. sapiens
tctgcatgtaactttt

SEQ ID NO: 140073 - DNA, 16 bp, H. sapiens
tctgcatgtgactagc

SEQ ID NO: 140074 - DNA, 16 bp, H. sapiens
tctgcatgtggacatc

SEQ ID NO: 140075 - DNA, 16 bp, H. sapiens
tctgcattgaaaattc

SEQ ID NO: 140076 - DNA, 16 bp, H. sapiens
tctgcattgctcatgc

SEQ ID NO: 140077 - DNA, 16 bp, H. sapiens
tctgcatttaaaaaaa

SEQ ID NO: 140078 - DNA, 16 bp, H. sapiens
tctgcatttattgaaa

SEQ ID NO: 140079 - DNA, 16 bp, H. sapiens
tctgcatttattgaga

SEQ ID NO: 140080 - DNA, 16 bp, H. sapiens
tctgcatttatttatt

SEQ ID NO: 140081 - DNA, 16 bp, H. sapiens
tctgcatttctaacag

SEQ ID NO: 140082 - DNA, 16 bp, H. sapiens
tctgcatttctgacaa

SEQ ID NO: 140083 - DNA, 16 bp, H. sapiens
tctgcattttataaat

SEQ ID NO: 140084 - DNA, 16 bp, H. sapiens
tctgcatttttaaaag

SEQ ID NO: 140085 - DNA, 16 bp, H. sapiens
tctgccaagagatcca

SEQ ID NO: 140086 - DNA, 17 bp, H. sapiens
tctgccaagcaaatgga

SEQ ID NO: 140087 - DNA, 16 bp, H. sapiens
tctgccacagctgctg

SEQ ID NO: 140088 - DNA, 16 bp, H. sapiens
tctgccacctccactg

SEQ ID NO: 140089 - DNA, 16 bp, H. sapiens
tctgccactatgcctg

SEQ ID NO: 140090 - DNA, 16 bp, H. sapiens
tctgccacttaatagc

SEQ ID NO: 140091 - DNA, 16 bp, H. sapiens
tctgccacttacaagc

SEQ ID NO: 140092 - DNA, 16 bp, H. sapiens
tctgccacttattagc

SEQ ID NO: 140093 - DNA, 16 bp, H. sapiens
tctgccagattttggt

SEQ ID NO: 140094 - DNA, 18 bp, H. sapiens
tctgccagcctcggcctc

SEQ ID NO: 140095 - DNA, 16 bp, H. sapiens
tctgccagctttgggg

SEQ ID NO: 140096 - DNA, 16 bp, H. sapiens
tctgccagttgctaag

SEQ ID NO: 140097 - DNA, 16 bp, H. sapiens
tctgccatcccaccca

SEQ ID NO: 140098 - DNA, 16 bp, H. sapiens
tctgccatccctgaga

SEQ ID NO: 140099 - DNA, 16 bp, H. sapiens
tctgccatgggatgac

SEQ ID NO: 140100 - DNA, 16 bp, H. sapiens
tctgccattctgtggg

SEQ ID NO: 140101 - DNA, 16 bp, H. sapiens
tctgccatttattagc

SEQ ID NO: 140102 - DNA, 16 bp, H. sapiens
tctgccattttgtttt

SEQ ID NO: 140103 - DNA, 17 bp, H. sapiens
tctgcccaaaggctcct

SEQ ID NO: 140104 - DNA, 16 bp, H. sapiens
tctgcccacaccttga

SEQ ID NO: 140105 - DNA, 16 bp, H. sapiens
tctgcccaccacagcc

SEQ ID NO: 140106 - DNA, 16 bp, H. sapiens
tctgcccaccctggcc

SEQ ID NO: 140107 - DNA, 16 bp, H. sapiens
tctgcccacctccgcc

SEQ ID NO: 140108 - DNA, 16 bp, H. sapiens
tctgcccacctcgggc

SEQ ID NO: 140109 - DNA, 16 bp, H. sapiens
tctgcccaccttgact

SEQ ID NO: 140110 - DNA, 16 bp, H. sapiens
tctgcccagagaggag

SEQ ID NO: 140111 - DNA, 16 bp, H. sapiens
tctgcccagctcagcc

SEQ ID NO: 140112 - DNA, 16 bp, H. sapiens
tctgcccagctgccct

SEQ ID NO: 140113 - DNA, 16 bp, H. sapiens
tctgcccaggaacctg

SEQ ID NO: 140114 - DNA, 16 bp, H. sapiens
tctgcccaggagcctg

SEQ ID NO: 140115 - DNA, 16 bp, H. sapiens
tctgcccaggtcacag

SEQ ID NO: 140116 - DNA, 16 bp, H. sapiens
tctgcccatgtcctgc

SEQ ID NO: 140117 - DNA, 16 bp, H. sapiens
tctgcccattcagtat

SEQ ID NO: 140118 - DNA, 16 bp, H. sapiens
tctgccccagcccctc

SEQ ID NO: 140119 - DNA, 16 bp, H. sapiens
tctgccccagcctcca

SEQ ID NO: 140120 - DNA, 16 bp, H. sapiens
tctgcccccagggttc

SEQ ID NO: 140121 - DNA, 16 bp, H. sapiens
tctgcccctgacccct

SEQ ID NO: 140122 - DNA, 16 bp, H. sapiens
tctgcccctggtccct

SEQ ID NO: 140123 - DNA, 17 bp, H. sapiens
tctgcccgcctcagccc

SEQ ID NO: 140124 - DNA, 16 bp, H. sapiens
tctgcccgcctcgggc

SEQ ID NO: 140125 - DNA, 16 bp, H. sapiens
tctgccctccagaact

SEQ ID NO: 140126 - DNA, 16 bp, H. sapiens
tctgccctccctggcc

SEQ ID NO: 140127 - DNA, 16 bp, H. sapiens
tctgccctcctcagct

SEQ ID NO: 140128 - DNA, 16 bp, H. sapiens
tctgccctcctgggcc

SEQ ID NO: 140129 - DNA, 16 bp, H. sapiens
tctgccctctgccctg

SEQ ID NO: 140130 - DNA, 16 bp, H. sapiens
tctgccctcttggagc

SEQ ID NO: 140131 - DNA, 16 bp, H. sapiens
tctgccctgccctgcc

SEQ ID NO: 140132 - DNA, 16 bp, H. sapiens
tctgccctggcctccc

SEQ ID NO: 140133 - DNA, 16 bp, H. sapiens
tctgccctggtcccct

SEQ ID NO: 140134 - DNA, 16 bp, H. sapiens
tctgcctcaacctccc

SEQ ID NO: 140135 - DNA, 16 bp, H. sapiens
tctgcctcagccacct

SEQ ID NO: 140136 - DNA, 16 bp, H. sapiens
tctgcctcagcctcac

SEQ ID NO: 140137 - DNA, 16 bp, H. sapiens
tctgcctcaggacctt

SEQ ID NO: 140138 - DNA, 16 bp, H. sapiens
tctgcctcaggctcct

SEQ ID NO: 140139 - DNA, 16 bp, H. sapiens
tctgcctcagggcctt

SEQ ID NO: 140140 - DNA, 16 bp, H. sapiens
tctgcctcagtctcct

SEQ ID NO: 140141 - DNA, 16 bp, H. sapiens
tctgcctccacctccc

SEQ ID NO: 140142 - DNA, 16 bp, H. sapiens
tctgcctccagactgc

SEQ ID NO: 140143 - DNA, 16 bp, H. sapiens
tctgcctccatctccc

SEQ ID NO: 140144 - DNA, 16 bp, H. sapiens
tctgcctcccaagttc

SEQ ID NO: 140145 - DNA, 16 bp, H. sapiens
tctgcctcccaagttg

SEQ ID NO: 140146 - DNA, 16 bp, H. sapiens
tctgcctcccaggcag

SEQ ID NO: 140147 - DNA, 17 bp, H. sapiens
tctgcctcccagggtca

SEQ ID NO: 140148 - DNA, 16 bp, H. sapiens
tctgcctcccaggtct

SEQ ID NO: 140149 - DNA, 17 bp, H. sapiens
tctgcctcccaggttcg

SEQ ID NO: 140150 - DNA, 16 bp, H. sapiens
tctgcctccccagctc

SEQ ID NO: 140151 - DNA, 17 bp, H. sapiens
tctgcctcccgggctca

SEQ ID NO: 140152 - DNA, 18 bp, H. sapiens
tctgcctcccgggttcga

SEQ ID NO: 140153 - DNA, 16 bp, H. sapiens
tctgcctcccttggcc

SEQ ID NO: 140154 - DNA, 17 bp, H. sapiens
tctgcctcctaggttca

SEQ ID NO: 140155 - DNA, 16 bp, H. sapiens
tctgcctcctccccac

SEQ ID NO: 140156 - DNA, 16 bp, H. sapiens
tctgcctcctgaccaa

SEQ ID NO: 140157 - DNA, 16 bp, H. sapiens
tctgcctcctgctgct

SEQ ID NO: 140158 - DNA, 16 bp, H. sapiens
tctgcctcctggcctc

SEQ ID NO: 140159 - DNA, 16 bp, H. sapiens
tctgcctcctggcttc

SEQ ID NO: 140160 - DNA, 16 bp, H. sapiens
tctgcctcctgtgttc

SEQ ID NO: 140161 - DNA, 16 bp, H. sapiens
tctgcctctcccactg

SEQ ID NO: 140162 - DNA, 16 bp, H. sapiens
tctgcctctctctgcc

SEQ ID NO: 140163 - DNA, 16 bp, H. sapiens
tctgcctctgccacct

SEQ ID NO: 140164 - DNA, 16 bp, H. sapiens
tctgcctctgccatcc

SEQ ID NO: 140165 - DNA, 16 bp, H. sapiens
tctgcctctgggctca

SEQ ID NO: 140166 - DNA, 16 bp, H. sapiens
tctgcctctggggttc

SEQ ID NO: 140167 - DNA, 16 bp, H. sapiens
tctgcctctgtctcca

SEQ ID NO: 140168 - DNA, 16 bp, H. sapiens
tctgcctctgtggctc

SEQ ID NO: 140169 - DNA, 16 bp, H. sapiens
tctgcctgcagaccct

SEQ ID NO: 140170 - DNA, 17 bp, H. sapiens
tctgcctgccaggttca

SEQ ID NO: 140171 - DNA, 16 bp, H. sapiens
tctgcctgccccagcc

SEQ ID NO: 140172 - DNA, 16 bp, H. sapiens
tctgcctgcccctgcc

SEQ ID NO: 140173 - DNA, 16 bp, H. sapiens
tctgcctgcctcaacc

SEQ ID NO: 140174 - DNA, 16 bp, H. sapiens
tctgcctgcctcacct

SEQ ID NO: 140175 - DNA, 16 bp, H. sapiens
tctgcctgcctcagct

SEQ ID NO: 140176 - DNA, 16 bp, H. sapiens
tctgcctgcctccacc

SEQ ID NO: 140177 - DNA, 16 bp, H. sapiens
tctgcctgcctcggct

SEQ ID NO: 140178 - DNA, 16 bp, H. sapiens
tctgcctgcctctgcc

SEQ ID NO: 140179 - DNA, 16 bp, H. sapiens
tctgcctgcctgggcc

SEQ ID NO: 140180 - DNA, 16 bp, H. sapiens
tctgcctgccttagtc

SEQ ID NO: 140181 - DNA, 16 bp, H. sapiens
tctgcctgccttattt

SEQ ID NO: 140182 - DNA, 16 bp, H. sapiens
tctgcctgccttggct

SEQ ID NO: 140183 - DNA, 16 bp, H. sapiens
tctgcctgcctttgcc

SEQ ID NO: 140184 - DNA, 16 bp, H. sapiens
tctgcctgctttatat

SEQ ID NO: 140185 - DNA, 16 bp, H. sapiens
tctgcctggagtgctc

SEQ ID NO: 140186 - DNA, 16 bp, H. sapiens
tctgcctgggatgctc

SEQ ID NO: 140187 - DNA, 16 bp, H. sapiens
tctgcctgggcctcag

SEQ ID NO: 140188 - DNA, 16 bp, H. sapiens
tctgcctggtcctggg

SEQ ID NO: 140189 - DNA, 16 bp, H. sapiens
tctgcctggtgccctg

SEQ ID NO: 140190 - DNA, 16 bp, H. sapiens
tctgcctgttacccaa

SEQ ID NO: 140191 - DNA, 16 bp, H. sapiens
tctgcctgtttcccag

SEQ ID NO: 140192 - DNA, 16 bp, H. sapiens
tctgccttaaaaaaaa

SEQ ID NO: 140193 - DNA, 16 bp, H. sapiens
tctgccttactcactc

SEQ ID NO: 140194 - DNA, 16 bp, H. sapiens
tctgccttccaccatg

SEQ ID NO: 140195 - DNA, 16 bp, H. sapiens
tctgccttccaggctc

SEQ ID NO: 140196 - DNA, 16 bp, H. sapiens
tctgccttcctggagc

SEQ ID NO: 140197 - DNA, 16 bp, H. sapiens
tctgccttcctggttc

SEQ ID NO: 140198 - DNA, 16 bp, H. sapiens
tctgccttgattgtga

SEQ ID NO: 140199 - DNA, 16 bp, H. sapiens
tctgccttgcatttgg

SEQ ID NO: 140200 - DNA, 16 bp, H. sapiens
tctgccttgctcactc

SEQ ID NO: 140201 - DNA, 16 bp, H. sapiens
tctgccttggcctcac

SEQ ID NO: 140202 - DNA, 16 bp, H. sapiens
tctgccttgggctccc

SEQ ID NO: 140203 - DNA, 16 bp, H. sapiens
tctgccttggtttccc

SEQ ID NO: 140204 - DNA, 16 bp, H. sapiens
tctgcctttctcagcc

SEQ ID NO: 140205 - DNA, 16 bp, H. sapiens
tctgcctttctgtctc

SEQ ID NO: 140206 - DNA, 16 bp, H. sapiens
tctgcctttgcatcct

SEQ ID NO: 140207 - DNA, 16 bp, H. sapiens
tctgcctttgcctccc

SEQ ID NO: 140208 - DNA, 16 bp, H. sapiens
tctgcgaacagggaca

SEQ ID NO: 140209 - DNA, 16 bp, H. sapiens
tctgcggaggcctcag

SEQ ID NO: 140210 - DNA, 16 bp, H. sapiens
tctgcggcttttccag

SEQ ID NO: 140211 - DNA, 16 bp, H. sapiens
tctgcgtgggttttct

SEQ ID NO: 140212 - DNA, 16 bp, H. sapiens
tctgcgtgtgtctgtg

SEQ ID NO: 140213 - DNA, 18 bp, H. sapiens
tctgctaaaaatacaaaa

SEQ ID NO: 140214 - DNA, 16 bp, H. sapiens
tctgctacttaccagc

SEQ ID NO: 140215 - DNA, 16 bp, H. sapiens
tctgctagttttgggt

SEQ ID NO: 140216 - DNA, 16 bp, H. sapiens
tctgctatcttcaaga

SEQ ID NO: 140217 - DNA, 16 bp, H. sapiens
tctgctatgtgaggac

SEQ ID NO: 140218 - DNA, 16 bp, H. sapiens
tctgctcaaagccctc

SEQ ID NO: 140219 - DNA, 17 bp, H. sapiens
tctgctcaataaagcct

SEQ ID NO: 140220 - DNA, 16 bp, H. sapiens
tctgctcaatttttct

SEQ ID NO: 140221 - DNA, 16 bp, H. sapiens
tctgctcacctcggcc

SEQ ID NO: 140222 - DNA, 16 bp, H. sapiens
tctgctcactgagata

SEQ ID NO: 140223 - DNA, 17 bp, H. sapiens
tctgctcactgcaacct

SEQ ID NO: 140224 - DNA, 16 bp, H. sapiens
tctgctcacttcaacc

SEQ ID NO: 140225 - DNA, 16 bp, H. sapiens
tctgctcagcaccttc

SEQ ID NO: 140226 - DNA, 16 bp, H. sapiens
tctgctcagcctctgg

SEQ ID NO: 140227 - DNA, 16 bp, H. sapiens
tctgctcagctcctgg

SEQ ID NO: 140228 - DNA, 16 bp, H. sapiens
tctgctcagcttccag

SEQ ID NO: 140229 - DNA, 16 bp, H. sapiens
tctgctcagcttctgg

SEQ ID NO: 140230 - DNA, 16 bp, H. sapiens
tctgctcagcttttgg

SEQ ID NO: 140231 - DNA, 16 bp, H. sapiens
tctgctcagtttctgg

SEQ ID NO: 140232 - DNA, 16 bp, H. sapiens
tctgctcagtttttct

SEQ ID NO: 140233 - DNA, 16 bp, H. sapiens
tctgctcatttttaaa

SEQ ID NO: 140234 - DNA, 16 bp, H. sapiens
tctgctccagccactc

SEQ ID NO: 140235 - DNA, 16 bp, H. sapiens
tctgctccagtcccta

SEQ ID NO: 140236 - DNA, 16 bp, H. sapiens
tctgctcccatgaccc

SEQ ID NO: 140237 - DNA, 16 bp, H. sapiens
tctgctccctctgcct

SEQ ID NO: 140238 - DNA, 16 bp, H. sapiens
tctgctccctggctcc

SEQ ID NO: 140239 - DNA, 16 bp, H. sapiens
tctgctccctgggttc

SEQ ID NO: 140240 - DNA, 16 bp, H. sapiens
tctgctccctgtgtcc

SEQ ID NO: 140241 - DNA, 16 bp, H. sapiens
tctgctcctcctgctt

SEQ ID NO: 140242 - DNA, 16 bp, H. sapiens
tctgctcctctgccag

SEQ ID NO: 140243 - DNA, 16 bp, H. sapiens
tctgctcctgctgcct

SEQ ID NO: 140244 - DNA, 16 bp, H. sapiens
tctgctctcaaaccct

SEQ ID NO: 140245 - DNA, 16 bp, H. sapiens
tctgctctgatctttg

SEQ ID NO: 140246 - DNA, 16 bp, H. sapiens
tctgctctgatctttt

SEQ ID NO: 140247 - DNA, 16 bp, H. sapiens
tctgctctgatttcag

SEQ ID NO: 140248 - DNA, 16 bp, H. sapiens
tctgctctgcttccct

SEQ ID NO: 140249 - DNA, 16 bp, H. sapiens
tctgctgactcagcct

SEQ ID NO: 140250 - DNA, 16 bp, H. sapiens
tctgctgactgttctt

SEQ ID NO: 140251 - DNA, 16 bp, H. sapiens
tctgctgagaagtcca

SEQ ID NO: 140252 - DNA, 17 bp, H. sapiens
tctgctgagctagacca

SEQ ID NO: 140253 - DNA, 16 bp, H. sapiens
tctgctgagggtggag

SEQ ID NO: 140254 - DNA, 16 bp, H. sapiens
tctgctgcacagaaga

SEQ ID NO: 140255 - DNA, 16 bp, H. sapiens
tctgctgcagagagct

SEQ ID NO: 140256 - DNA, 16 bp, H. sapiens
tctgctgcaggagtgg

SEQ ID NO: 140257 - DNA, 17 bp, H. sapiens
tctgctgcaggtctgct

SEQ ID NO: 140258 - DNA, 16 bp, H. sapiens
tctgctgcagtttgct

SEQ ID NO: 140259 - DNA, 16 bp, H. sapiens
tctgctgccaaggctg

SEQ ID NO: 140260 - DNA, 16 bp, H. sapiens
tctgctgcccaggcca

SEQ ID NO: 140261 - DNA, 16 bp, H. sapiens
tctgctgcccatgctg

SEQ ID NO: 140262 - DNA, 16 bp, H. sapiens
tctgctgccccagcct

SEQ ID NO: 140263 - DNA, 16 bp, H. sapiens
tctgctgccccaggct

SEQ ID NO: 140264 - DNA, 16 bp, H. sapiens
tctgctgcccgggctg

SEQ ID NO: 140265 - DNA, 16 bp, H. sapiens
tctgctgcctccaagt

SEQ ID NO: 140266 - DNA, 16 bp, H. sapiens
tctgctgcctcttggt

SEQ ID NO: 140267 - DNA, 16 bp, H. sapiens
tctgctgccttgtgaa

SEQ ID NO: 140268 - DNA, 16 bp, H. sapiens
tctgctgccttttgtt

SEQ ID NO: 140269 - DNA, 16 bp, H. sapiens
tctgctgctgcaggct

SEQ ID NO: 140270 - DNA, 16 bp, H. sapiens
tctgctgctgtaacag

SEQ ID NO: 140271 - DNA, 16 bp, H. sapiens
tctgctggcctctccc

SEQ ID NO: 140272 - DNA, 16 bp, H. sapiens
tctgctggcctctcct

SEQ ID NO: 140273 - DNA, 17 bp, H. sapiens
tctgctgggattacagg

SEQ ID NO: 140274 - DNA, 16 bp, H. sapiens
tctgctgggtttctcc

SEQ ID NO: 140275 - DNA, 16 bp, H. sapiens
tctgctggtctgcaga

SEQ ID NO: 140276 - DNA, 16 bp, H. sapiens
tctgctgtcaccttga

SEQ ID NO: 140277 - DNA, 17 bp, H. sapiens
tctgctgtctcagcctc

SEQ ID NO: 140278 - DNA, 16 bp, H. sapiens
tctgctgtctctcctt

SEQ ID NO: 140279 - DNA, 16 bp, H. sapiens
tctgctgtggtctgaa

SEQ ID NO: 140280 - DNA, 16 bp, H. sapiens
tctgctgtgtgacctt

SEQ ID NO: 140281 - DNA, 16 bp, H. sapiens
tctgctgttaatactt

SEQ ID NO: 140282 - DNA, 16 bp, H. sapiens
tctgctgttaatctgt

SEQ ID NO: 140283 - DNA, 16 bp, H. sapiens
tctgctgttgctgtct

SEQ ID NO: 140284 - DNA, 16 bp, H. sapiens
tctgcttaaaaaaaaa

SEQ ID NO: 140285 - DNA, 16 bp, H. sapiens
tctgcttatttattta

SEQ ID NO: 140286 - DNA, 16 bp, H. sapiens
tctgcttcagcttcct

SEQ ID NO: 140287 - DNA, 16 bp, H. sapiens
tctgcttcatccctgg

SEQ ID NO: 140288 - DNA, 16 bp, H. sapiens
tctgcttccaagttca

SEQ ID NO: 140289 - DNA, 16 bp, H. sapiens
tctgcttccctggctc

SEQ ID NO: 140290 - DNA, 16 bp, H. sapiens
tctgcttcctgctgcc

SEQ ID NO: 140291 - DNA, 16 bp, H. sapiens
tctgcttcctgctgct

SEQ ID NO: 140292 - DNA, 16 bp, H. sapiens
tctgcttctaagagtt

SEQ ID NO: 140293 - DNA, 16 bp, H. sapiens
tctgcttctcagagga

SEQ ID NO: 140294 - DNA, 16 bp, H. sapiens
tctgcttctctgtctc

SEQ ID NO: 140295 - DNA, 16 bp, H. sapiens
tctgcttctgcattca

SEQ ID NO: 140296 - DNA, 16 bp, H. sapiens
tctgcttctgcctccc

SEQ ID NO: 140297 - DNA, 16 bp, H. sapiens
tctgcttctgggaaga

SEQ ID NO: 140298 - DNA, 16 bp, H. sapiens
tctgcttctgggagga

SEQ ID NO: 140299 - DNA, 16 bp, H. sapiens
tctgcttctggggaaa

SEQ ID NO: 140300 - DNA, 16 bp, H. sapiens
tctgcttctggggagg

SEQ ID NO: 140301 - DNA, 16 bp, H. sapiens
tctgcttctgtgagtt

SEQ ID NO: 140302 - DNA, 16 bp, H. sapiens
tctgcttcttcatctg

SEQ ID NO: 140303 - DNA, 16 bp, H. sapiens
tctgcttcttggagga

SEQ ID NO: 140304 - DNA, 16 bp, H. sapiens
tctgcttgatcaattc

SEQ ID NO: 140305 - DNA, 16 bp, H. sapiens
tctgcttgcagaaatg

SEQ ID NO: 140306 - DNA, 17 bp, H. sapiens
tctgcttgcctcggcct

SEQ ID NO: 140307 - DNA, 16 bp, H. sapiens
tctgcttgctttaggt

SEQ ID NO: 140308 - DNA, 16 bp, H. sapiens
tctgcttgctttctca

SEQ ID NO: 140309 - DNA, 16 bp, H. sapiens
tctgcttggccaccca

SEQ ID NO: 140310 - DNA, 16 bp, H. sapiens
tctgcttggtgaagag

SEQ ID NO: 140311 - DNA, 16 bp, H. sapiens
tctgcttgtggatatt

SEQ ID NO: 140312 - DNA, 16 bp, H. sapiens
tctgctttatattcta

SEQ ID NO: 140313 - DNA, 16 bp, H. sapiens
tctgctttccaggctg

SEQ ID NO: 140314 - DNA, 16 bp, H. sapiens
tctgctttcctcagcc

SEQ ID NO: 140315 - DNA, 16 bp, H. sapiens
tctgctttcctgaaat

SEQ ID NO: 140316 - DNA, 16 bp, H. sapiens
tctgctttctgcctct

SEQ ID NO: 140317 - DNA, 16 bp, H. sapiens
tctgctttcttcctgc

SEQ ID NO: 140318 - DNA, 16 bp, H. sapiens
tctgcttttaattcct

SEQ ID NO: 140319 - DNA, 16 bp, H. sapiens
tctgcttttagctctt

SEQ ID NO: 140320 - DNA, 16 bp, H. sapiens
tctgcttttagttctt

SEQ ID NO: 140321 - DNA, 16 bp, H. sapiens
tctgcttttcctcagg

SEQ ID NO: 140322 - DNA, 16 bp, H. sapiens
tctgcttttctcaaag

SEQ ID NO: 140323 - DNA, 16 bp, H. sapiens
tctgcttttctggggg

SEQ ID NO: 140324 - DNA, 16 bp, H. sapiens
tctggaaaaaaatgtt

SEQ ID NO: 140325 - DNA, 16 bp, H. sapiens
tctggaaaaaataatt

SEQ ID NO: 140326 - DNA, 16 bp, H. sapiens
tctggaaaagagaaaa

SEQ ID NO: 140327 - DNA, 16 bp, H. sapiens
tctggaaaagattgta

SEQ ID NO: 140328 - DNA, 16 bp, H. sapiens
tctggaaaaggaaaaa

SEQ ID NO: 140329 - DNA, 16 bp, H. sapiens
tctggaaaagggaaaa

SEQ ID NO: 140330 - DNA, 16 bp, H. sapiens
tctggaaaatacttta

SEQ ID NO: 140331 - DNA, 16 bp, H. sapiens
tctggaaaatgtagtt

SEQ ID NO: 140332 - DNA, 16 bp, H. sapiens
tctggaaaattatttt

SEQ ID NO: 140333 - DNA, 16 bp, H. sapiens
tctggaaacagagaca

SEQ ID NO: 140334 - DNA, 16 bp, H. sapiens
tctggaaacagggaca

SEQ ID NO: 140335 - DNA, 16 bp, H. sapiens
tctggaaactttggtg

SEQ ID NO: 140336 - DNA, 16 bp, H. sapiens
tctggaaagaaaaaaa

SEQ ID NO: 140337 - DNA, 16 bp, H. sapiens
tctggaaagaattcac

SEQ ID NO: 140338 - DNA, 16 bp, H. sapiens
tctggaaaggaaggaa

SEQ ID NO: 140339 - DNA, 19 bp, H. sapiens
tctggaaagtgaggagcgc

SEQ ID NO: 140340 - DNA, 16 bp, H. sapiens
tctggaaattttcttt

SEQ ID NO: 140341 - DNA, 16 bp, H. sapiens
tctggaaccaaaccca

SEQ ID NO: 140342 - DNA, 16 bp, H. sapiens
tctggaactcctcacc

SEQ ID NO: 140343 - DNA, 17 bp, H. sapiens
tctggaactcctgaccc

SEQ ID NO: 140344 - DNA, 16 bp, H. sapiens
tctggaactcctgtcc

SEQ ID NO: 140345 - DNA, 16 bp, H. sapiens
tctggaactcttgacc

SEQ ID NO: 140346 - DNA, 16 bp, H. sapiens
tctggaagaaaaagat

SEQ ID NO: 140347 - DNA, 16 bp, H. sapiens
tctggaagaaaacata

SEQ ID NO: 140348 - DNA, 16 bp, H. sapiens
tctggaagaaaaccta

SEQ ID NO: 140349 - DNA, 16 bp, H. sapiens
tctggaagaaatggat

SEQ ID NO: 140350 - DNA, 16 bp, H. sapiens
tctggaagacagtggc

SEQ ID NO: 140351 - DNA, 16 bp, H. sapiens
tctggaagccattatc

SEQ ID NO: 140352 - DNA, 16 bp, H. sapiens
tctggaagcccagact

SEQ ID NO: 140353 - DNA, 16 bp, H. sapiens
tctggaagctgaaaaa

SEQ ID NO: 140354 - DNA, 16 bp, H. sapiens
tctggaagctgagaag

SEQ ID NO: 140355 - DNA, 16 bp, H. sapiens
tctggaagctggaaaa

SEQ ID NO: 140356 - DNA, 16 bp, H. sapiens
tctggaagttttgtct

SEQ ID NO: 140357 - DNA, 16 bp, H. sapiens
tctggaataatgtggg

SEQ ID NO: 140358 - DNA, 16 bp, H. sapiens
tctggaatcccatgtg

SEQ ID NO: 140359 - DNA, 16 bp, H. sapiens
tctggaatcctatgta

SEQ ID NO: 140360 - DNA, 16 bp, H. sapiens
tctggaatgcagtggc

SEQ ID NO: 140361 - DNA, 16 bp, H. sapiens
tctggaattgattttt

SEQ ID NO: 140362 - DNA, 16 bp, H. sapiens
tctggaatttccattt

SEQ ID NO: 140363 - DNA, 16 bp, H. sapiens
tctggaatttttttct

SEQ ID NO: 140364 - DNA, 16 bp, H. sapiens
tctggacaacagagtg

SEQ ID NO: 140365 - DNA, 16 bp, H. sapiens
tctggacataaaacct

SEQ ID NO: 140366 - DNA, 16 bp, H. sapiens
tctggacatccaggca

SEQ ID NO: 140367 - DNA, 16 bp, H. sapiens
tctggaccaaaccagt

SEQ ID NO: 140368 - DNA, 16 bp, H. sapiens
tctggaccctcccagc

SEQ ID NO: 140369 - DNA, 16 bp, H. sapiens
tctggacctttacaga

SEQ ID NO: 140370 - DNA, 16 bp, H. sapiens
tctggactcctgggtc

SEQ ID NO: 140371 - DNA, 16 bp, H. sapiens
tctggagacatttttg

SEQ ID NO: 140372 - DNA, 16 bp, H. sapiens
tctggagactggaaat

SEQ ID NO: 140373 - DNA, 16 bp, H. sapiens
tctggagaggatgtgg

SEQ ID NO: 140374 - DNA, 16 bp, H. sapiens
tctggagatgaaaaat

SEQ ID NO: 140375 - DNA, 16 bp, H. sapiens
tctggagatggtggtg

SEQ ID NO: 140376 - DNA, 16 bp, H. sapiens
tctggagcaaaaattc

SEQ ID NO: 140377 - DNA, 16 bp, H. sapiens
tctggagcagcagcct

SEQ ID NO: 140378 - DNA, 16 bp, H. sapiens
tctggagcagctgctg

SEQ ID NO: 140379 - DNA, 16 bp, H. sapiens
tctggagccacactgc

SEQ ID NO: 140380 - DNA, 16 bp, H. sapiens
tctggagccagacagc

SEQ ID NO: 140381 - DNA, 16 bp, H. sapiens
tctggagcccaggctg

SEQ ID NO: 140382 - DNA, 16 bp, H. sapiens
tctggagctcagaaga

SEQ ID NO: 140383 - DNA, 16 bp, H. sapiens
tctggagctggatggt

SEQ ID NO: 140384 - DNA, 16 bp, H. sapiens
tctggaggaaaagaaa

SEQ ID NO: 140385 - DNA, 16 bp, H. sapiens
tctggaggacgaggag

SEQ ID NO: 140386 - DNA, 16 bp, H. sapiens
tctggaggcagaattc

SEQ ID NO: 140387 - DNA, 16 bp, H. sapiens
tctggaggcagaggtg

SEQ ID NO: 140388 - DNA, 16 bp, H. sapiens
tctggaggcatcacat

SEQ ID NO: 140389 - DNA, 16 bp, H. sapiens
tctggaggccagaagt

SEQ ID NO: 140390 - DNA, 16 bp, H. sapiens
tctggaggcctggact

SEQ ID NO: 140391 - DNA, 16 bp, H. sapiens
tctggaggctccaagg

SEQ ID NO: 140392 - DNA, 16 bp, H. sapiens
tctggaggctctcagg

SEQ ID NO: 140393 - DNA, 16 bp, H. sapiens
tctggaggctctgagg

SEQ ID NO: 140394 - DNA, 16 bp, H. sapiens
tctggaggctctggga

SEQ ID NO: 140395 - DNA, 16 bp, H. sapiens
tctggaggctgcctgc

SEQ ID NO: 140396 - DNA, 16 bp, H. sapiens
tctggaggctgggaag

SEQ ID NO: 140397 - DNA, 16 bp, H. sapiens
tctggaggctgtggtg

SEQ ID NO: 140398 - DNA, 16 bp, H. sapiens
tctggaggtgatggga

SEQ ID NO: 140399 - DNA, 16 bp, H. sapiens
tctggagtcagaaaga

SEQ ID NO: 140400 - DNA, 16 bp, H. sapiens
tctggagtctgtccct

SEQ ID NO: 140401 - DNA, 16 bp, H. sapiens
tctggagtgcagtggc

SEQ ID NO: 140402 - DNA, 18 bp, H. sapiens
tctggagtgcagtggcac

SEQ ID NO: 140403 - DNA, 23 bp, H. sapiens
tctggagtgcagtggtgtgatct

SEQ ID NO: 140404 - DNA, 16 bp, H. sapiens
tctggagtggggcctg

SEQ ID NO: 140405 - DNA, 16 bp, H. sapiens
tctggagttcaagacc

SEQ ID NO: 140406 - DNA, 17 bp, H. sapiens
tctggagttgttcgttc

SEQ ID NO: 140407 - DNA, 19 bp, H. sapiens
tctggagttgttcgttcct

SEQ ID NO: 140408 - DNA, 16 bp, H. sapiens
tctggagttttttcct

SEQ ID NO: 140409 - DNA, 16 bp, H. sapiens
tctggatagaagatca

SEQ ID NO: 140410 - DNA, 16 bp, H. sapiens
tctggatatgaaattc

SEQ ID NO: 140411 - DNA, 16 bp, H. sapiens
tctggatctgccctgg

SEQ ID NO: 140412 - DNA, 16 bp, H. sapiens
tctggatggcaatgaa

SEQ ID NO: 140413 - DNA, 16 bp, H. sapiens
tctggatgtggtggtg

SEQ ID NO: 140414 - DNA, 16 bp, H. sapiens
tctggattctctattt

SEQ ID NO: 140415 - DNA, 16 bp, H. sapiens
tctggattctggattc

SEQ ID NO: 140416 - DNA, 16 bp, H. sapiens
tctggatttgtctgat

SEQ ID NO: 140417 - DNA, 16 bp, H. sapiens
tctggattttaaaaaa

SEQ ID NO: 140418 - DNA, 16 bp, H. sapiens
tctggattttggattt

SEQ ID NO: 140419 - DNA, 16 bp, H. sapiens
tctggcaagatggctg

SEQ ID NO: 140420 - DNA, 16 bp, H. sapiens
tctggcaagccttgcc

SEQ ID NO: 140421 - DNA, 16 bp, H. sapiens
tctggcagccccagcc

SEQ ID NO: 140422 - DNA, 16 bp, H. sapiens
tctggcatctggagga

SEQ ID NO: 140423 - DNA, 16 bp, H. sapiens
tctggccaacatagtg

SEQ ID NO: 140424 - DNA, 17 bp, H. sapiens
tctggccaacatagtga

SEQ ID NO: 140425 - DNA, 16 bp, H. sapiens
tctggccaacatggca

SEQ ID NO: 140426 - DNA, 16 bp, H. sapiens
tctggccaacatggtg

SEQ ID NO: 140427 - DNA, 16 bp, H. sapiens
tctggccaatgagatg

SEQ ID NO: 140428 - DNA, 16 bp, H. sapiens
tctggccacagtggcc

SEQ ID NO: 140429 - DNA, 16 bp, H. sapiens
tctggccagcatggtg

SEQ ID NO: 140430 - DNA, 23 bp, H. sapiens
tctggccaggcgcggtggctcac

SEQ ID NO: 140431 - DNA, 16 bp, H. sapiens
tctggcccaaggcagg

SEQ ID NO: 140432 - DNA, 16 bp, H. sapiens
tctggcccagagcagg

SEQ ID NO: 140433 - DNA, 16 bp, H. sapiens
tctggcccagggcagg

SEQ ID NO: 140434 - DNA, 16 bp, H. sapiens
tctggcccagggtggg

SEQ ID NO: 140435 - DNA, 16 bp, H. sapiens
tctggccctggccctg

SEQ ID NO: 140436 - DNA, 16 bp, H. sapiens
tctggcctcaggtgat

SEQ ID NO: 140437 - DNA, 16 bp, H. sapiens
tctggcctgagtgaca

SEQ ID NO: 140438 - DNA, 16 bp, H. sapiens
tctggcctggtgacag

SEQ ID NO: 140439 - DNA, 16 bp, H. sapiens
tctggccttggcctcc

SEQ ID NO: 140440 - DNA, 16 bp, H. sapiens
tctggcctttgggcag

SEQ ID NO: 140441 - DNA, 16 bp, H. sapiens
tctggctaattttctt

SEQ ID NO: 140442 - DNA, 16 bp, H. sapiens
tctggctaatttttgt

SEQ ID NO: 140443 - DNA, 16 bp, H. sapiens
tctggctacttcctgc

SEQ ID NO: 140444 - DNA, 16 bp, H. sapiens
tctggctctgccactt

SEQ ID NO: 140445 - DNA, 16 bp, H. sapiens
tctggctctggctctg

SEQ ID NO: 140446 - DNA, 24 bp, H. sapiens
tctggctctgtcgcccaggctgga

SEQ ID NO: 140447 - DNA, 16 bp, H. sapiens
tctggctctgtgacct

SEQ ID NO: 140448 - DNA, 16 bp, H. sapiens
tctggctctgtgtctc

SEQ ID NO: 140449 - DNA, 16 bp, H. sapiens
tctggctgcagaaatt

SEQ ID NO: 140450 - DNA, 16 bp, H. sapiens
tctggctgcccttaat

SEQ ID NO: 140451 - DNA, 16 bp, H. sapiens
tctggctgcccttcac

SEQ ID NO: 140452 - DNA, 16 bp, H. sapiens
tctggctgcctgagag

SEQ ID NO: 140453 - DNA, 16 bp, H. sapiens
tctggctgccttggcc

SEQ ID NO: 140454 - DNA, 16 bp, H. sapiens
tctggctgctgtgctg

SEQ ID NO: 140455 - DNA, 16 bp, H. sapiens
tctggctggatgcagt

SEQ ID NO: 140456 - DNA, 17 bp, H. sapiens
tctggctgggtgcagtg

SEQ ID NO: 140457 - DNA, 16 bp, H. sapiens
tctggctgtttaaaag

SEQ ID NO: 140458 - DNA, 16 bp, H. sapiens
tctggcttcaaagcct

SEQ ID NO: 140459 - DNA, 16 bp, H. sapiens
tctggcttcagccccc

SEQ ID NO: 140460 - DNA, 16 bp, H. sapiens
tctggcttctggccag

SEQ ID NO: 140461 - DNA, 16 bp, H. sapiens
tctggcttgaaaattc

SEQ ID NO: 140462 - DNA, 16 bp, H. sapiens
tctggctttatttatt

SEQ ID NO: 140463 - DNA, 16 bp, H. sapiens
tctggctttcattttt

SEQ ID NO: 140464 - DNA, 16 bp, H. sapiens
tctggcttttaatttt

SEQ ID NO: 140465 - DNA, 16 bp, H. sapiens
tctggcttttcttgaa

SEQ ID NO: 140466 - DNA, 16 bp, H. sapiens
tctggctttttgaatt

SEQ ID NO: 140467 - DNA, 16 bp, H. sapiens
tctgggaaacatggtg

SEQ ID NO: 140468 - DNA, 16 bp, H. sapiens
tctgggaaagaaaaag

SEQ ID NO: 140469 - DNA, 16 bp, H. sapiens
tctgggaaagaaaata

SEQ ID NO: 140470 - DNA, 16 bp, H. sapiens
tctgggaaatgtagtt

SEQ ID NO: 140471 - DNA, 16 bp, H. sapiens
tctgggaagaaagtca

SEQ ID NO: 140472 - DNA, 16 bp, H. sapiens
tctgggaagggagagg

SEQ ID NO: 140473 - DNA, 16 bp, H. sapiens
tctgggaagtaactaa

SEQ ID NO: 140474 - DNA, 22 bp, H. sapiens
tctgggacacatttaaagcagc

SEQ ID NO: 140475 - DNA, 16 bp, H. sapiens
tctgggaccagcagtc

SEQ ID NO: 140476 - DNA, 16 bp, H. sapiens
tctgggactacaggca

SEQ ID NO: 140477 - DNA, 16 bp, H. sapiens
tctgggagaaaagtgg

SEQ ID NO: 140478 - DNA, 16 bp, H. sapiens
tctgggagaagagcat

SEQ ID NO: 140479 - DNA, 16 bp, H. sapiens
tctgggagataaaatt

SEQ ID NO: 140480 - DNA, 16 bp, H. sapiens
tctgggagcagggcat

SEQ ID NO: 140481 - DNA, 16 bp, H. sapiens
tctgggagctgggaag

SEQ ID NO: 140482 - DNA, 16 bp, H. sapiens
tctgggaggaggaggt

SEQ ID NO: 140483 - DNA, 16 bp, H. sapiens
tctgggaggcagagtt

SEQ ID NO: 140484 - DNA, 16 bp, H. sapiens
tctgggaggccaagac

SEQ ID NO: 140485 - DNA, 16 bp, H. sapiens
tctgggaggccaaggc

SEQ ID NO: 140486 - DNA, 16 bp, H. sapiens
tctgggagggcgaggc

SEQ ID NO: 140487 - DNA, 16 bp, H. sapiens
tctgggagggggaggt

SEQ ID NO: 140488 - DNA, 16 bp, H. sapiens
tctgggaggtgaggag

SEQ ID NO: 140489 - DNA, 16 bp, H. sapiens
tctgggaggtggaggt

SEQ ID NO: 140490 - DNA, 24 bp, H. sapiens
tctgggaggtgtacccaacagctc

SEQ ID NO: 140491 - DNA, 17 bp, H. sapiens
tctgggaggtgtgccca

SEQ ID NO: 140492 - DNA, 16 bp, H. sapiens
tctgggatgccaaggc

SEQ ID NO: 140493 - DNA, 16 bp, H. sapiens
tctgggatgtgaagag

SEQ ID NO: 140494 - DNA, 16 bp, H. sapiens
tctgggatgtgaggag

SEQ ID NO: 140495 - DNA, 16 bp, H. sapiens
tctgggattacaggcg

SEQ ID NO: 140496 - DNA, 16 bp, H. sapiens
tctgggcatccaggca

SEQ ID NO: 140497 - DNA, 16 bp, H. sapiens
tctgggccaggcctgg

SEQ ID NO: 140498 - DNA, 16 bp, H. sapiens
tctgggcctcaggctc

SEQ ID NO: 140499 - DNA, 16 bp, H. sapiens
tctgggcctcatttcc

SEQ ID NO: 140500 - DNA, 16 bp, H. sapiens
tctgggcctgcccatg

SEQ ID NO: 140501 - DNA, 16 bp, H. sapiens
tctgggcctggctttg

SEQ ID NO: 140502 - DNA, 16 bp, H. sapiens
tctgggcctgtggtgg

SEQ ID NO: 140503 - DNA, 16 bp, H. sapiens
tctgggctacagagcg

SEQ ID NO: 140504 - DNA, 17 bp, H. sapiens
tctgggctcaagcaatc

SEQ ID NO: 140505 - DNA, 18 bp, H. sapiens
tctgggctcaagcaattc

SEQ ID NO: 140506 - DNA, 16 bp, H. sapiens
tctgggctcactgcca

SEQ ID NO: 140507 - DNA, 16 bp, H. sapiens
tctgggctcaggtgat

SEQ ID NO: 140508 - DNA, 16 bp, H. sapiens
tctgggctcattgcaa

SEQ ID NO: 140509 - DNA, 16 bp, H. sapiens
tctgggctcccacagc

SEQ ID NO: 140510 - DNA, 16 bp, H. sapiens
tctgggctccctgaag

SEQ ID NO: 140511 - DNA, 16 bp, H. sapiens
tctgggctccctgcaa

SEQ ID NO: 140512 - DNA, 16 bp, H. sapiens
tctgggctcgagtgat

SEQ ID NO: 140513 - DNA, 16 bp, H. sapiens
tctgggctctggagga

SEQ ID NO: 140514 - DNA, 16 bp, H. sapiens
tctgggctctgggctc

SEQ ID NO: 140515 - DNA, 16 bp, H. sapiens
tctgggctgcagtgag

SEQ ID NO: 140516 - DNA, 17 bp, H. sapiens
tctgggctggccaaggc

SEQ ID NO: 140517 - DNA, 16 bp, H. sapiens
tctgggctgggcacag

SEQ ID NO: 140518 - DNA, 16 bp, H. sapiens
tctgggctgggcttgg

SEQ ID NO: 140519 - DNA, 16 bp, H. sapiens
tctgggcttggtggtg

SEQ ID NO: 140520 - DNA, 16 bp, H. sapiens
tctggggaagaatctg

SEQ ID NO: 140521 - DNA, 16 bp, H. sapiens
tctggggagacctcag

SEQ ID NO: 140522 - DNA, 16 bp, H. sapiens
tctggggagactgagg

SEQ ID NO: 140523 - DNA, 16 bp, H. sapiens
tctggggaggagagag

SEQ ID NO: 140524 - DNA, 16 bp, H. sapiens
tctggggaggagccag

SEQ ID NO: 140525 - DNA, 16 bp, H. sapiens
tctggggaggcctcag

SEQ ID NO: 140526 - DNA, 16 bp, H. sapiens
tctggggaggccttgg

SEQ ID NO: 140527 - DNA, 16 bp, H. sapiens
tctggggagggtgtat

SEQ ID NO: 140528 - DNA, 16 bp, H. sapiens
tctggggcctcagctg

SEQ ID NO: 140529 - DNA, 16 bp, H. sapiens
tctggggcctctgttc

SEQ ID NO: 140530 - DNA, 16 bp, H. sapiens
tctggggccttgctga

SEQ ID NO: 140531 - DNA, 16 bp, H. sapiens
tctgggggaaaaaaaa

SEQ ID NO: 140532 - DNA, 16 bp, H. sapiens
tctgggggctgggaag

SEQ ID NO: 140533 - DNA, 16 bp, H. sapiens
tctgggggggaaaaaa

SEQ ID NO: 140534 - DNA, 16 bp, H. sapiens
tctggggtaatgaaaa

SEQ ID NO: 140535 - DNA, 16 bp, H. sapiens
tctggggtctggaaga

SEQ ID NO: 140536 - DNA, 16 bp, H. sapiens
tctggggtctggggga

SEQ ID NO: 140537 - DNA, 16 bp, H. sapiens
tctggggtgatggaaa

SEQ ID NO: 140538 - DNA, 16 bp, H. sapiens
tctggggtgggaccca

SEQ ID NO: 140539 - DNA, 16 bp, H. sapiens
tctggggtgtctggag

SEQ ID NO: 140540 - DNA, 16 bp, H. sapiens
tctgggtaggcaccat

SEQ ID NO: 140541 - DNA, 16 bp, H. sapiens
tctgggtcagacctga

SEQ ID NO: 140542 - DNA, 16 bp, H. sapiens
tctgggtgagtcagta

SEQ ID NO: 140543 - DNA, 16 bp, H. sapiens
tctgggtgctcctgtt

SEQ ID NO: 140544 - DNA, 16 bp, H. sapiens
tctgggtggccagggg

SEQ ID NO: 140545 - DNA, 16 bp, H. sapiens
tctgggtggggccagc

SEQ ID NO: 140546 - DNA, 16 bp, H. sapiens
tctgggtgggtggagg

SEQ ID NO: 140547 - DNA, 16 bp, H. sapiens
tctgggtgtatatcca

SEQ ID NO: 140548 - DNA, 16 bp, H. sapiens
tctgggtgtgtctgta

SEQ ID NO: 140549 - DNA, 16 bp, H. sapiens
tctgggttcaagccat

SEQ ID NO: 140550 - DNA, 21 bp, H. sapiens
tctgggttcaagcgattctcc

SEQ ID NO: 140551 - DNA, 16 bp, H. sapiens
tctgggttcaagtcct

SEQ ID NO: 140552 - DNA, 16 bp, H. sapiens
tctgggttcaagtgat

SEQ ID NO: 140553 - DNA, 16 bp, H. sapiens
tctgggttcactgcag

SEQ ID NO: 140554 - DNA, 16 bp, H. sapiens
tctgggttctctattc

SEQ ID NO: 140555 - DNA, 16 bp, H. sapiens
tctgggtttgaatcct

SEQ ID NO: 140556 - DNA, 16 bp, H. sapiens
tctgggttttatttat

SEQ ID NO: 140557 - DNA, 16 bp, H. sapiens
tctggtaaaatagttt

SEQ ID NO: 140558 - DNA, 16 bp, H. sapiens
tctggtaacatcttcc

SEQ ID NO: 140559 - DNA, 16 bp, H. sapiens
tctggtagagacagag

SEQ ID NO: 140560 - DNA, 16 bp, H. sapiens
tctggtatacatgtgc

SEQ ID NO: 140561 - DNA, 16 bp, H. sapiens
tctggtatatatttta

SEQ ID NO: 140562 - DNA, 16 bp, H. sapiens
tctggtattcctttat

SEQ ID NO: 140563 - DNA, 16 bp, H. sapiens
tctggtatttcccctg

SEQ ID NO: 140564 - DNA, 16 bp, H. sapiens
tctggtcacaaaaata

SEQ ID NO: 140565 - DNA, 16 bp, H. sapiens
tctggtcccagaacca

SEQ ID NO: 140566 - DNA, 16 bp, H. sapiens
tctggtcctgagcttt

SEQ ID NO: 140567 - DNA, 16 bp, H. sapiens
tctggtcctggacttc

SEQ ID NO: 140568 - DNA, 17 bp, H. sapiens
tctggtcttgaactcct

SEQ ID NO: 140569 - DNA, 16 bp, H. sapiens
tctggtgaaaaaggaa

SEQ ID NO: 140570 - DNA, 16 bp, H. sapiens
tctggtgaaaatattc

SEQ ID NO: 140571 - DNA, 16 bp, H. sapiens
tctggtgagggtcttc

SEQ ID NO: 140572 - DNA, 16 bp, H. sapiens
tctggtggaaaaggaa

SEQ ID NO: 140573 - DNA, 16 bp, H. sapiens
tctggtggaagaaatc

SEQ ID NO: 140574 - DNA, 16 bp, H. sapiens
tctggtggctgccagc

SEQ ID NO: 140575 - DNA, 16 bp, H. sapiens
tctggtgggaggtgat

SEQ ID NO: 140576 - DNA, 16 bp, H. sapiens
tctggtgggagtgacc

SEQ ID NO: 140577 - DNA, 23 bp, H. sapiens
tctggtggggccttggagaacct

SEQ ID NO: 140578 - DNA, 16 bp, H. sapiens
tctggtgtgtctgtga

SEQ ID NO: 140579 - DNA, 16 bp, H. sapiens
tctggttaaaaaaaaa

SEQ ID NO: 140580 - DNA, 16 bp, H. sapiens
tctggttcacatgcct

SEQ ID NO: 140581 - DNA, 16 bp, H. sapiens
tctggttctctctctc

SEQ ID NO: 140582 - DNA, 16 bp, H. sapiens
tctggttctgatgctt

SEQ ID NO: 140583 - DNA, 16 bp, H. sapiens
tctggttgcttttaag

SEQ ID NO: 140584 - DNA, 16 bp, H. sapiens
tctggttgtgtctgtg

SEQ ID NO: 140585 - DNA, 16 bp, H. sapiens
tctggttgttttatgg

SEQ ID NO: 140586 - DNA, 16 bp, H. sapiens
tctggtttctatgacc

SEQ ID NO: 140587 - DNA, 16 bp, H. sapiens
tctggtttctttcact

SEQ ID NO: 140588 - DNA, 16 bp, H. sapiens
tctggttttgttatta

SEQ ID NO: 140589 - DNA, 16 bp, H. sapiens
tctggtttttcagcct

SEQ ID NO: 140590 - DNA, 16 bp, H. sapiens
tctgtaaaaacaaaca

SEQ ID NO: 140591 - DNA, 16 bp, H. sapiens
tctgtaaaaatgcttt

SEQ ID NO: 140592 - DNA, 18 bp, H. sapiens
tctgtaaaacagaccaat

SEQ ID NO: 140593 - DNA, 16 bp, H. sapiens
tctgtaaaataaataa

SEQ ID NO: 140594 - DNA, 16 bp, H. sapiens
tctgtaaaatacagat

SEQ ID NO: 140595 - DNA, 16 bp, H. sapiens
tctgtaaaatattttt

SEQ ID NO: 140596 - DNA, 16 bp, H. sapiens
tctgtaaaatcaggat

SEQ ID NO: 140597 - DNA, 16 bp, H. sapiens
tctgtaaaatgaagag

SEQ ID NO: 140598 - DNA, 16 bp, H. sapiens
tctgtaaaatgaggaa

SEQ ID NO: 140599 - DNA, 16 bp, H. sapiens
tctgtaaaatggaaaa

SEQ ID NO: 140600 - DNA, 16 bp, H. sapiens
tctgtaaaatggaaat

SEQ ID NO: 140601 - DNA, 16 bp, H. sapiens
tctgtaaaatggaatg

SEQ ID NO: 140602 - DNA, 16 bp, H. sapiens
tctgtaaaatggaggt

SEQ ID NO: 140603 - DNA, 16 bp, H. sapiens
tctgtaaaatgggact

SEQ ID NO: 140604 - DNA, 16 bp, H. sapiens
tctgtaaaatggggtg

SEQ ID NO: 140605 - DNA, 16 bp, H. sapiens
tctgtaaagaatctct

SEQ ID NO: 140606 - DNA, 16 bp, H. sapiens
tctgtaaagacagaaa

SEQ ID NO: 140607 - DNA, 16 bp, H. sapiens
tctgtaaagggacaga

SEQ ID NO: 140608 - DNA, 16 bp, H. sapiens
tctgtaaagtatttga

SEQ ID NO: 140609 - DNA, 16 bp, H. sapiens
tctgtaaagtggggat

SEQ ID NO: 140610 - DNA, 16 bp, H. sapiens
tctgtaaataaagaca

SEQ ID NO: 140611 - DNA, 16 bp, H. sapiens
tctgtaaatatttcag

SEQ ID NO: 140612 - DNA, 16 bp, H. sapiens
tctgtaaatatttcca

SEQ ID NO: 140613 - DNA, 16 bp, H. sapiens
tctgtaaatatttgtt

SEQ ID NO: 140614 - DNA, 16 bp, H. sapiens
tctgtaaatttaaaac

SEQ ID NO: 140615 - DNA, 16 bp, H. sapiens
tctgtaacctcagcac

SEQ ID NO: 140616 - DNA, 16 bp, H. sapiens
tctgtaacctcccact

SEQ ID NO: 140617 - DNA, 16 bp, H. sapiens
tctgtaacttgctttt

SEQ ID NO: 140618 - DNA, 16 bp, H. sapiens
tctgtaactttctttt

SEQ ID NO: 140619 - DNA, 16 bp, H. sapiens
tctgtaataataataa

SEQ ID NO: 140620 - DNA, 16 bp, H. sapiens
tctgtaatcccagcaa

SEQ ID NO: 140621 - DNA, 16 bp, H. sapiens
tctgtaatcccagcca

SEQ ID NO: 140622 - DNA, 16 bp, H. sapiens
tctgtaatcccggcac

SEQ ID NO: 140623 - DNA, 16 bp, H. sapiens
tctgtaattattttat

SEQ ID NO: 140624 - DNA, 16 bp, H. sapiens
tctgtaattttctgtt

SEQ ID NO: 140625 - DNA, 16 bp, H. sapiens
tctgtaatttttttaa

SEQ ID NO: 140626 - DNA, 16 bp, H. sapiens
tctgtacaaaaattaa

SEQ ID NO: 140627 - DNA, 16 bp, H. sapiens
tctgtacagcaaaaga

SEQ ID NO: 140628 - DNA, 16 bp, H. sapiens
tctgtacaggaagcat

SEQ ID NO: 140629 - DNA, 16 bp, H. sapiens
tctgtaccaagcagac

SEQ ID NO: 140630 - DNA, 16 bp, H. sapiens
tctgtacccaggctgg

SEQ ID NO: 140631 - DNA, 19 bp, H. sapiens
tctgtactaaaaacacaaa

SEQ ID NO: 140632 - DNA, 16 bp, H. sapiens
tctgtactaaaataca

SEQ ID NO: 140633 - DNA, 16 bp, H. sapiens
tctgtactgaaaatac

SEQ ID NO: 140634 - DNA, 16 bp, H. sapiens
tctgtacttttcattt

SEQ ID NO: 140635 - DNA, 16 bp, H. sapiens
tctgtactttttaaaa

SEQ ID NO: 140636 - DNA, 16 bp, H. sapiens
tctgtagaatggggat

SEQ ID NO: 140637 - DNA, 16 bp, H. sapiens
tctgtagacatttttg

SEQ ID NO: 140638 - DNA, 16 bp, H. sapiens
tctgtagagacagtgt

SEQ ID NO: 140639 - DNA, 16 bp, H. sapiens
tctgtagatgtctact

SEQ ID NO: 140640 - DNA, 16 bp, H. sapiens
tctgtagcagcaactg

SEQ ID NO: 140641 - DNA, 16 bp, H. sapiens
tctgtagcccaggctg

SEQ ID NO: 140642 - DNA, 16 bp, H. sapiens
tctgtagcccatgctg

SEQ ID NO: 140643 - DNA, 16 bp, H. sapiens
tctgtagcttttccag

SEQ ID NO: 140644 - DNA, 16 bp, H. sapiens
tctgtaggaagttcca

SEQ ID NO: 140645 - DNA, 16 bp, H. sapiens
tctgtaggtcagaagt

SEQ ID NO: 140646 - DNA, 20 bp, H. sapiens
tctgtagtcccagctgctcg

SEQ ID NO: 140647 - DNA, 16 bp, H. sapiens
tctgtagttttcttgt

SEQ ID NO: 140648 - DNA, 16 bp, H. sapiens
tctgtataatttttat

SEQ ID NO: 140649 - DNA, 16 bp, H. sapiens
tctgtatatttttaaa

SEQ ID NO: 140650 - DNA, 16 bp, H. sapiens
tctgtatctacaaaaa

SEQ ID NO: 140651 - DNA, 16 bp, H. sapiens
tctgtatctctgtttt

SEQ ID NO: 140652 - DNA, 16 bp, H. sapiens
tctgtatctggctaat

SEQ ID NO: 140653 - DNA, 16 bp, H. sapiens
tctgtatctgtggatt

SEQ ID NO: 140654 - DNA, 16 bp, H. sapiens
tctgtatcttctttgg

SEQ ID NO: 140655 - DNA, 16 bp, H. sapiens
tctgtatgcagaagaa

SEQ ID NO: 140656 - DNA, 16 bp, H. sapiens
tctgtatgtatctgtt

SEQ ID NO: 140657 - DNA, 16 bp, H. sapiens
tctgtatgttgcctgt

SEQ ID NO: 140658 - DNA, 16 bp, H. sapiens
tctgtattaggccatt

SEQ ID NO: 140659 - DNA, 16 bp, H. sapiens
tctgtattagtccgtt

SEQ ID NO: 140660 - DNA, 16 bp, H. sapiens
tctgtattatttgaat

SEQ ID NO: 140661 - DNA, 16 bp, H. sapiens
tctgtattcattttat

SEQ ID NO: 140662 - DNA, 16 bp, H. sapiens
tctgtatttcctgcat

SEQ ID NO: 140663 - DNA, 16 bp, H. sapiens
tctgtatttctgtgtg

SEQ ID NO: 140664 - DNA, 16 bp, H. sapiens
tctgtattttctgtaa

SEQ ID NO: 140665 - DNA, 16 bp, H. sapiens
tctgtatttttaaaaa

SEQ ID NO: 140666 - DNA, 16 bp, H. sapiens
tctgtatttttaaatt

SEQ ID NO: 140667 - DNA, 16 bp, H. sapiens
tctgtatttttctaaa

SEQ ID NO: 140668 - DNA, 16 bp, H. sapiens
tctgtattttttaaaa

SEQ ID NO: 140669 - DNA, 16 bp, H. sapiens
tctgtattttttaaat

SEQ ID NO: 140670 - DNA, 16 bp, H. sapiens
tctgtatttttttaaa

SEQ ID NO: 140671 - DNA, 16 bp, H. sapiens
tctgtcaaaaatcaat

SEQ ID NO: 140672 - DNA, 16 bp, H. sapiens
tctgtcaaacaaacaa

SEQ ID NO: 140673 - DNA, 16 bp, H. sapiens
tctgtcaaccagactg

SEQ ID NO: 140674 - DNA, 16 bp, H. sapiens
tctgtcaagttcaaag

SEQ ID NO: 140675 - DNA, 16 bp, H. sapiens
tctgtcaccaccagcc

SEQ ID NO: 140676 - DNA, 16 bp, H. sapiens
tctgtcaccagtctgg

SEQ ID NO: 140677 - DNA, 16 bp, H. sapiens
tctgtcacccaagctg

SEQ ID NO: 140678 - DNA, 16 bp, H. sapiens
tctgtcacccagctgg

SEQ ID NO: 140679 - DNA, 21 bp, H. sapiens
tctgtcacccaggctggagtt

SEQ ID NO: 140680 - DNA, 16 bp, H. sapiens
tctgtcaccccagcta

SEQ ID NO: 140681 - DNA, 16 bp, H. sapiens
tctgtcaccccagctg

SEQ ID NO: 140682 - DNA, 16 bp, H. sapiens
tctgtcaccctagctg

SEQ ID NO: 140683 - DNA, 16 bp, H. sapiens
tctgtcaccctgactg

SEQ ID NO: 140684 - DNA, 16 bp, H. sapiens
tctgtcacctaggctg

SEQ ID NO: 140685 - DNA, 16 bp, H. sapiens
tctgtcacctgggctg

SEQ ID NO: 140686 - DNA, 16 bp, H. sapiens
tctgtcactcaataaa

SEQ ID NO: 140687 - DNA, 16 bp, H. sapiens
tctgtcactctggctg

SEQ ID NO: 140688 - DNA, 16 bp, H. sapiens
tctgtcactgaccaaa

SEQ ID NO: 140689 - DNA, 16 bp, H. sapiens
tctgtcactgaggctg

SEQ ID NO: 140690 - DNA, 16 bp, H. sapiens
tctgtcactgatgggc

SEQ ID NO: 140691 - DNA, 16 bp, H. sapiens
tctgtcagccagactg

SEQ ID NO: 140692 - DNA, 17 bp, H. sapiens
tctgtcaggcctctgag

SEQ ID NO: 140693 - DNA, 16 bp, H. sapiens
tctgtcataaaaaaaa

SEQ ID NO: 140694 - DNA, 16 bp, H. sapiens
tctgtcatccaagctg

SEQ ID NO: 140695 - DNA, 16 bp, H. sapiens
tctgtcatccatccat

SEQ ID NO: 140696 - DNA, 16 bp, H. sapiens
tctgtcattgatggac

SEQ ID NO: 140697 - DNA, 16 bp, H. sapiens
tctgtcatttcagtca

SEQ ID NO: 140698 - DNA, 16 bp, H. sapiens
tctgtcattttcattt

SEQ ID NO: 140699 - DNA, 16 bp, H. sapiens
tctgtcatttttttaa

SEQ ID NO: 140700 - DNA, 16 bp, H. sapiens
tctgtccacccaccca

SEQ ID NO: 140701 - DNA, 16 bp, H. sapiens
tctgtccatccatcca

SEQ ID NO: 140702 - DNA, 16 bp, H. sapiens
tctgtccatttttgtt

SEQ ID NO: 140703 - DNA, 16 bp, H. sapiens
tctgtcccattgatct

SEQ ID NO: 140704 - DNA, 16 bp, H. sapiens
tctgtccccatctctc

SEQ ID NO: 140705 - DNA, 16 bp, H. sapiens
tctgtccccccaggct

SEQ ID NO: 140706 - DNA, 16 bp, H. sapiens
tctgtccctccacccc

SEQ ID NO: 140707 - DNA, 16 bp, H. sapiens
tctgtccctcccacac

SEQ ID NO: 140708 - DNA, 16 bp, H. sapiens
tctgtccctctgtctc

SEQ ID NO: 140709 - DNA, 16 bp, H. sapiens
tctgtccctgtctccc

SEQ ID NO: 140710 - DNA, 16 bp, H. sapiens
tctgtcccttaggctg

SEQ ID NO: 140711 - DNA, 16 bp, H. sapiens
tctgtcctccagagcc

SEQ ID NO: 140712 - DNA, 16 bp, H. sapiens
tctgtcctcctcagcc

SEQ ID NO: 140713 - DNA, 16 bp, H. sapiens
tctgtcgcccaggcta

SEQ ID NO: 140714 - DNA, 16 bp, H. sapiens
tctgtctaaaagaaaa

SEQ ID NO: 140715 - DNA, 16 bp, H. sapiens
tctgtctactttttat

SEQ ID NO: 140716 - DNA, 16 bp, H. sapiens
tctgtctatcatctat

SEQ ID NO: 140717 - DNA, 16 bp, H. sapiens
tctgtctcaaaaaata

SEQ ID NO: 140718 - DNA, 16 bp, H. sapiens
tctgtctcaaagaaaa

SEQ ID NO: 140719 - DNA, 16 bp, H. sapiens
tctgtctcaacaaaat

SEQ ID NO: 140720 - DNA, 16 bp, H. sapiens
tctgtctcacaaaaag

SEQ ID NO: 140721 - DNA, 16 bp, H. sapiens
tctgtctcacaaacaa

SEQ ID NO: 140722 - DNA, 16 bp, H. sapiens
tctgtctcactggcat

SEQ ID NO: 140723 - DNA, 16 bp, H. sapiens
tctgtctcagaaaaaa

SEQ ID NO: 140724 - DNA, 16 bp, H. sapiens
tctgtctcagcctccc

SEQ ID NO: 140725 - DNA, 16 bp, H. sapiens
tctgtctcagtctccc

SEQ ID NO: 140726 - DNA, 16 bp, H. sapiens
tctgtctcattgacct

SEQ ID NO: 140727 - DNA, 16 bp, H. sapiens
tctgtctccaaaaaag

SEQ ID NO: 140728 - DNA, 16 bp, H. sapiens
tctgtctcccagcctg

SEQ ID NO: 140729 - DNA, 16 bp, H. sapiens
tctgtctccccacctc

SEQ ID NO: 140730 - DNA, 16 bp, H. sapiens
tctgtctccccggctg

SEQ ID NO: 140731 - DNA, 16 bp, H. sapiens
tctgtctccctctcca

SEQ ID NO: 140732 - DNA, 16 bp, H. sapiens
tctgtctcctccaaat

SEQ ID NO: 140733 - DNA, 16 bp, H. sapiens
tctgtctcctctgctg

SEQ ID NO: 140734 - DNA, 16 bp, H. sapiens
tctgtctcctgctcat

SEQ ID NO: 140735 - DNA, 16 bp, H. sapiens
tctgtctcctgctgcc

SEQ ID NO: 140736 - DNA, 16 bp, H. sapiens
tctgtctcctgggctg

SEQ ID NO: 140737 - DNA, 16 bp, H. sapiens
tctgtctcctgggtcc

SEQ ID NO: 140738 - DNA, 16 bp, H. sapiens
tctgtctcctgtctct

SEQ ID NO: 140739 - DNA, 16 bp, H. sapiens
tctgtctctaaaatat

SEQ ID NO: 140740 - DNA, 16 bp, H. sapiens
tctgtctctaaataaa

SEQ ID NO: 140741 - DNA, 18 bp, H. sapiens
tctgtctctacaaaaaat

SEQ ID NO: 140742 - DNA, 16 bp, H. sapiens
tctgtctctacaaaat

SEQ ID NO: 140743 - DNA, 16 bp, H. sapiens
tctgtctctcccacta

SEQ ID NO: 140744 - DNA, 16 bp, H. sapiens
tctgtctctcccactg

SEQ ID NO: 140745 - DNA, 16 bp, H. sapiens
tctgtctctctcctgc

SEQ ID NO: 140746 - DNA, 16 bp, H. sapiens
tctgtctctctcgctc

SEQ ID NO: 140747 - DNA, 16 bp, H. sapiens
tctgtctctctctctg

SEQ ID NO: 140748 - DNA, 16 bp, H. sapiens
tctgtctctctctgtc

SEQ ID NO: 140749 - DNA, 16 bp, H. sapiens
tctgtctctctctgtg

SEQ ID NO: 140750 - DNA, 16 bp, H. sapiens
tctgtctctgcctccc

SEQ ID NO: 140751 - DNA, 16 bp, H. sapiens
tctgtctctgcctctg

SEQ ID NO: 140752 - DNA, 16 bp, H. sapiens
tctgtctctggtaatt

SEQ ID NO: 140753 - DNA, 16 bp, H. sapiens
tctgtctctgtactgt

SEQ ID NO: 140754 - DNA, 16 bp, H. sapiens
tctgtctctgtcatca

SEQ ID NO: 140755 - DNA, 16 bp, H. sapiens
tctgtctctgtccctg

SEQ ID NO: 140756 - DNA, 16 bp, H. sapiens
tctgtctctgtctcta

SEQ ID NO: 140757 - DNA, 16 bp, H. sapiens
tctgtctctgtctctc

SEQ ID NO: 140758 - DNA, 16 bp, H. sapiens
tctgtctctgtcttca

SEQ ID NO: 140759 - DNA, 16 bp, H. sapiens
tctgtctctgtcttcc

SEQ ID NO: 140760 - DNA, 16 bp, H. sapiens
tctgtctctgtctttg

SEQ ID NO: 140761 - DNA, 16 bp, H. sapiens
tctgtctctgtgtctc

SEQ ID NO: 140762 - DNA, 16 bp, H. sapiens
tctgtctgaaaagaaa

SEQ ID NO: 140763 - DNA, 16 bp, H. sapiens
tctgtctgaatgatct

SEQ ID NO: 140764 - DNA, 16 bp, H. sapiens
tctgtctgactccaaa

SEQ ID NO: 140765 - DNA, 16 bp, H. sapiens
tctgtctgactccaag

SEQ ID NO: 140766 - DNA, 16 bp, H. sapiens
tctgtctgactctgaa

SEQ ID NO: 140767 - DNA, 16 bp, H. sapiens
tctgtctgatcctggg

SEQ ID NO: 140768 - DNA, 16 bp, H. sapiens
tctgtctgcctcagcc

SEQ ID NO: 140769 - DNA, 16 bp, H. sapiens
tctgtctggtcctgag

SEQ ID NO: 140770 - DNA, 16 bp, H. sapiens
tctgtctgtccatcca

SEQ ID NO: 140771 - DNA, 16 bp, H. sapiens
tctgtctgtctatcta

SEQ ID NO: 140772 - DNA, 16 bp, H. sapiens
tctgtctgtctctctc

SEQ ID NO: 140773 - DNA, 16 bp, H. sapiens
tctgtctgtctgtctg

SEQ ID NO: 140774 - DNA, 16 bp, H. sapiens
tctgtctgtctgtctt

SEQ ID NO: 140775 - DNA, 16 bp, H. sapiens
tctgtctgtgtgtctg

SEQ ID NO: 140776 - DNA, 16 bp, H. sapiens
tctgtcttacaagaaa

SEQ ID NO: 140777 - DNA, 16 bp, H. sapiens
tctgtcttagtctatt

SEQ ID NO: 140778 - DNA, 16 bp, H. sapiens
tctgtcttcatcttca

SEQ ID NO: 140779 - DNA, 16 bp, H. sapiens
tctgtcttcattttgt

SEQ ID NO: 140780 - DNA, 16 bp, H. sapiens
tctgtcttccagttca

SEQ ID NO: 140781 - DNA, 16 bp, H. sapiens
tctgtcttccatgtct

SEQ ID NO: 140782 - DNA, 16 bp, H. sapiens
tctgtcttcctctgtg

SEQ ID NO: 140783 - DNA, 16 bp, H. sapiens
tctgtcttgctggtgt

SEQ ID NO: 140784 - DNA, 16 bp, H. sapiens
tctgtcttggaaaaaa

SEQ ID NO: 140785 - DNA, 16 bp, H. sapiens
tctgtcttgttcactg

SEQ ID NO: 140786 - DNA, 16 bp, H. sapiens
tctgtcttgtttgctg

SEQ ID NO: 140787 - DNA, 16 bp, H. sapiens
tctgtcttttaattgg

SEQ ID NO: 140788 - DNA, 16 bp, H. sapiens
tctgtcttttccattt

SEQ ID NO: 140789 - DNA, 16 bp, H. sapiens
tctgtgaaaaatataa

SEQ ID NO: 140790 - DNA, 16 bp, H. sapiens
tctgtgaaaatccccg

SEQ ID NO: 140791 - DNA, 16 bp, H. sapiens
tctgtgaaaggaaaat

SEQ ID NO: 140792 - DNA, 16 bp, H. sapiens
tctgtgaaatatattt

SEQ ID NO: 140793 - DNA, 16 bp, H. sapiens
tctgtgaacaatgtca

SEQ ID NO: 140794 - DNA, 16 bp, H. sapiens
tctgtgaagaaattca

SEQ ID NO: 140795 - DNA, 16 bp, H. sapiens
tctgtgaagaatgtaa

SEQ ID NO: 140796 - DNA, 16 bp, H. sapiens
tctgtgaagccagcat

SEQ ID NO: 140797 - DNA, 16 bp, H. sapiens
tctgtgaagccttgca

SEQ ID NO: 140798 - DNA, 16 bp, H. sapiens
tctgtgaaggaatatt

SEQ ID NO: 140799 - DNA, 16 bp, H. sapiens
tctgtgaaggatgtca

SEQ ID NO: 140800 - DNA, 16 bp, H. sapiens
tctgtgaaggcatatt

SEQ ID NO: 140801 - DNA, 16 bp, H. sapiens
tctgtgaaggtgtttc

SEQ ID NO: 140802 - DNA, 16 bp, H. sapiens
tctgtgaagtggggat

SEQ ID NO: 140803 - DNA, 16 bp, H. sapiens
tctgtgaattaaaaaa

SEQ ID NO: 140804 - DNA, 16 bp, H. sapiens
tctgtgaattcaacca

SEQ ID NO: 140805 - DNA, 16 bp, H. sapiens
tctgtgaattcttttg

SEQ ID NO: 140806 - DNA, 16 bp, H. sapiens
tctgtgaattgcctgt

SEQ ID NO: 140807 - DNA, 16 bp, H. sapiens
tctgtgaattttgaca

SEQ ID NO: 140808 - DNA, 16 bp, H. sapiens
tctgtgacagcttctt

SEQ ID NO: 140809 - DNA, 16 bp, H. sapiens
tctgtgaccagcagac

SEQ ID NO: 140810 - DNA, 16 bp, H. sapiens
tctgtgacctcaggca

SEQ ID NO: 140811 - DNA, 16 bp, H. sapiens
tctgtgaccttgcccc

SEQ ID NO: 140812 - DNA, 16 bp, H. sapiens
tctgtgaccttgggca

SEQ ID NO: 140813 - DNA, 16 bp, H. sapiens
tctgtgactcagtttc

SEQ ID NO: 140814 - DNA, 16 bp, H. sapiens
tctgtgactgctcctg

SEQ ID NO: 140815 - DNA, 16 bp, H. sapiens
tctgtgactttgggaa

SEQ ID NO: 140816 - DNA, 16 bp, H. sapiens
tctgtgacttttaaaa

SEQ ID NO: 140817 - DNA, 16 bp, H. sapiens
tctgtgagaagaatgc

SEQ ID NO: 140818 - DNA, 16 bp, H. sapiens
tctgtgagccactcta

SEQ ID NO: 140819 - DNA, 16 bp, H. sapiens
tctgtgagcctcagtt

SEQ ID NO: 140820 - DNA, 16 bp, H. sapiens
tctgtgaggacaggga

SEQ ID NO: 140821 - DNA, 16 bp, H. sapiens
tctgtgaggctgtggc

SEQ ID NO: 140822 - DNA, 16 bp, H. sapiens
tctgtgagggcaggga

SEQ ID NO: 140823 - DNA, 16 bp, H. sapiens
tctgtgagggctccac

SEQ ID NO: 140824 - DNA, 16 bp, H. sapiens
tctgtgatattcctgc

SEQ ID NO: 140825 - DNA, 16 bp, H. sapiens
tctgtgatttatttca

SEQ ID NO: 140826 - DNA, 16 bp, H. sapiens
tctgtgatttctttta

SEQ ID NO: 140827 - DNA, 17 bp, H. sapiens
tctgtgcaaataaacta

SEQ ID NO: 140828 - DNA, 16 bp, H. sapiens
tctgtgcagagaaatg

SEQ ID NO: 140829 - DNA, 16 bp, H. sapiens
tctgtgcagcaaacaa

SEQ ID NO: 140830 - DNA, 16 bp, H. sapiens
tctgtgcagtcaaacc

SEQ ID NO: 140831 - DNA, 16 bp, H. sapiens
tctgtgcagtgggcag

SEQ ID NO: 140832 - DNA, 16 bp, H. sapiens
tctgtgcatgcctgag

SEQ ID NO: 140833 - DNA, 16 bp, H. sapiens
tctgtgcattttgttt

SEQ ID NO: 140834 - DNA, 16 bp, H. sapiens
tctgtgccagacactg

SEQ ID NO: 140835 - DNA, 16 bp, H. sapiens
tctgtgccaggccctg

SEQ ID NO: 140836 - DNA, 16 bp, H. sapiens
tctgtgcccaggctgg

SEQ ID NO: 140837 - DNA, 16 bp, H. sapiens
tctgtgcccttgctgg

SEQ ID NO: 140838 - DNA, 16 bp, H. sapiens
tctgtgcctcagtgtc

SEQ ID NO: 140839 - DNA, 16 bp, H. sapiens
tctgtgcctcagttta

SEQ ID NO: 140840 - DNA, 17 bp, H. sapiens
tctgtgcctcagtttct

SEQ ID NO: 140841 - DNA, 16 bp, H. sapiens
tctgtgcctcagtttt

SEQ ID NO: 140842 - DNA, 16 bp, H. sapiens
tctgtgcctctctcct

SEQ ID NO: 140843 - DNA, 16 bp, H. sapiens
tctgtgcctgacttat

SEQ ID NO: 140844 - DNA, 16 bp, H. sapiens
tctgtgcctggcttct

SEQ ID NO: 140845 - DNA, 16 bp, H. sapiens
tctgtgccttcatttc

SEQ ID NO: 140846 - DNA, 16 bp, H. sapiens
tctgtgcctttgcaca

SEQ ID NO: 140847 - DNA, 16 bp, H. sapiens
tctgtgctctgcctgt

SEQ ID NO: 140848 - DNA, 21 bp, H. sapiens
tctgtgctgaggtggattagt

SEQ ID NO: 140849 - DNA, 16 bp, H. sapiens
tctgtgctgtgggccc

SEQ ID NO: 140850 - DNA, 16 bp, H. sapiens
tctgtgcttcagtttt

SEQ ID NO: 140851 - DNA, 16 bp, H. sapiens
tctgtggaaagtgtaa

SEQ ID NO: 140852 - DNA, 16 bp, H. sapiens
tctgtggaaatttgaa

SEQ ID NO: 140853 - DNA, 16 bp, H. sapiens
tctgtggacatgtttt

SEQ ID NO: 140854 - DNA, 16 bp, H. sapiens
tctgtggagtcagtgg

SEQ ID NO: 140855 - DNA, 16 bp, H. sapiens
tctgtggatggcaaag

SEQ ID NO: 140856 - DNA, 16 bp, H. sapiens
tctgtggatgtgggag

SEQ ID NO: 140857 - DNA, 16 bp, H. sapiens
tctgtggattcaacca

SEQ ID NO: 140858 - DNA, 16 bp, H. sapiens
tctgtggcattttttt

SEQ ID NO: 140859 - DNA, 16 bp, H. sapiens
tctgtggcccatgctg

SEQ ID NO: 140860 - DNA, 16 bp, H. sapiens
tctgtggccctggcca

SEQ ID NO: 140861 - DNA, 16 bp, H. sapiens
tctgtggcctgggggt

SEQ ID NO: 140862 - DNA, 16 bp, H. sapiens
tctgtggctgcttttg

SEQ ID NO: 140863 - DNA, 16 bp, H. sapiens
tctgtggctgtgggca

SEQ ID NO: 140864 - DNA, 16 bp, H. sapiens
tctgtggcttgtctct

SEQ ID NO: 140865 - DNA, 16 bp, H. sapiens
tctgtgggccccactt

SEQ ID NO: 140866 - DNA, 16 bp, H. sapiens
tctgtgggggtgggat

SEQ ID NO: 140867 - DNA, 16 bp, H. sapiens
tctgtggtattcttcc

SEQ ID NO: 140868 - DNA, 16 bp, H. sapiens
tctgtggtattcttgc

SEQ ID NO: 140869 - DNA, 16 bp, H. sapiens
tctgtggtctgtgcct

SEQ ID NO: 140870 - DNA, 16 bp, H. sapiens
tctgtggttcctggca

SEQ ID NO: 140871 - DNA, 16 bp, H. sapiens
tctgtggtttatcttt

SEQ ID NO: 140872 - DNA, 16 bp, H. sapiens
tctgtggtttcacttt

SEQ ID NO: 140873 - DNA, 16 bp, H. sapiens
tctgtggtttcctgac

SEQ ID NO: 140874 - DNA, 16 bp, H. sapiens
tctgtgtaagtcataa

SEQ ID NO: 140875 - DNA, 16 bp, H. sapiens
tctgtgtagcttttat

SEQ ID NO: 140876 - DNA, 16 bp, H. sapiens
tctgtgtataattttt

SEQ ID NO: 140877 - DNA, 16 bp, H. sapiens
tctgtgtatattttat

SEQ ID NO: 140878 - DNA, 16 bp, H. sapiens
tctgtgtatttatata

SEQ ID NO: 140879 - DNA, 16 bp, H. sapiens
tctgtgtcaaaaaata

SEQ ID NO: 140880 - DNA, 16 bp, H. sapiens
tctgtgtcacaaataa

SEQ ID NO: 140881 - DNA, 16 bp, H. sapiens
tctgtgtcatattttg

SEQ ID NO: 140882 - DNA, 16 bp, H. sapiens
tctgtgtccatgtgat

SEQ ID NO: 140883 - DNA, 16 bp, H. sapiens
tctgtgtcccagccac

SEQ ID NO: 140884 - DNA, 16 bp, H. sapiens
tctgtgtccccaccta

SEQ ID NO: 140885 - DNA, 16 bp, H. sapiens
tctgtgtcctaaattt

SEQ ID NO: 140886 - DNA, 16 bp, H. sapiens
tctgtgtcctaatctc

SEQ ID NO: 140887 - DNA, 16 bp, H. sapiens
tctgtgtctaaatttc

SEQ ID NO: 140888 - DNA, 16 bp, H. sapiens
tctgtgtctctatttc

SEQ ID NO: 140889 - DNA, 16 bp, H. sapiens
tctgtgtctctggaga

SEQ ID NO: 140890 - DNA, 16 bp, H. sapiens
tctgtgtctgtctcct

SEQ ID NO: 140891 - DNA, 16 bp, H. sapiens
tctgtgtctgtctctg

SEQ ID NO: 140892 - DNA, 16 bp, H. sapiens
tctgtgtctgtgtctg

SEQ ID NO: 140893 - DNA, 16 bp, H. sapiens
tctgtgtctgtgtctt

SEQ ID NO: 140894 - DNA, 16 bp, H. sapiens
tctgtgtcttctcctc

SEQ ID NO: 140895 - DNA, 16 bp, H. sapiens
tctgtgtctttgtgtc

SEQ ID NO: 140896 - DNA, 16 bp, H. sapiens
tctgtgtgacctgatt

SEQ ID NO: 140897 - DNA, 16 bp, H. sapiens
tctgtgtgagtgtgtg

SEQ ID NO: 140898 - DNA, 16 bp, H. sapiens
tctgtgtgcccaccca

SEQ ID NO: 140899 - DNA, 16 bp, H. sapiens
tctgtgtgcctgtgtc

SEQ ID NO: 140900 - DNA, 16 bp, H. sapiens
tctgtgtgcgtgtgca

SEQ ID NO: 140901 - DNA, 16 bp, H. sapiens
tctgtgtgtatctgtg

SEQ ID NO: 140902 - DNA, 16 bp, H. sapiens
tctgtgtgtctatgtg

SEQ ID NO: 140903 - DNA, 16 bp, H. sapiens
tctgtgtgtctctgtg

SEQ ID NO: 140904 - DNA, 16 bp, H. sapiens
tctgtgtgtgcatgca

SEQ ID NO: 140905 - DNA, 16 bp, H. sapiens
tctgtgtgtgcctctg

SEQ ID NO: 140906 - DNA, 17 bp, H. sapiens
tctgtgtgtgcctgtgt

SEQ ID NO: 140907 - DNA, 16 bp, H. sapiens
tctgtgtgtgtatatg

SEQ ID NO: 140908 - DNA, 16 bp, H. sapiens
tctgtgtgtgtatctg

SEQ ID NO: 140909 - DNA, 16 bp, H. sapiens
tctgtgtgtgtcttta

SEQ ID NO: 140910 - DNA, 16 bp, H. sapiens
tctgtgttcatgaggg

SEQ ID NO: 140911 - DNA, 16 bp, H. sapiens
tctgtgttgttgcaaa

SEQ ID NO: 140912 - DNA, 16 bp, H. sapiens
tctgtgtttattcaaa

SEQ ID NO: 140913 - DNA, 16 bp, H. sapiens
tctgtgtttcctgaat

SEQ ID NO: 140914 - DNA, 16 bp, H. sapiens
tctgtgttttaacaag

SEQ ID NO: 140915 - DNA, 16 bp, H. sapiens
tctgtgttttaataag

SEQ ID NO: 140916 - DNA, 16 bp, H. sapiens
tctgtgttttcattta

SEQ ID NO: 140917 - DNA, 16 bp, H. sapiens
tctgttaaaatgcaga

SEQ ID NO: 140918 - DNA, 16 bp, H. sapiens
tctgttaaatggagat

SEQ ID NO: 140919 - DNA, 16 bp, H. sapiens
tctgttaaatttcttt

SEQ ID NO: 140920 - DNA, 16 bp, H. sapiens
tctgttactcaggctg

SEQ ID NO: 140921 - DNA, 16 bp, H. sapiens
tctgttacttaggctg

SEQ ID NO: 140922 - DNA, 16 bp, H. sapiens
tctgttaggtccattt

SEQ ID NO: 140923 - DNA, 16 bp, H. sapiens
tctgttataatttctg

SEQ ID NO: 140924 - DNA, 16 bp, H. sapiens
tctgttattgttgtat

SEQ ID NO: 140925 - DNA, 16 bp, H. sapiens
tctgttatttaaaaaa

SEQ ID NO: 140926 - DNA, 16 bp, H. sapiens
tctgttatttaagatg

SEQ ID NO: 140927 - DNA, 16 bp, H. sapiens
tctgttatttcagcca

SEQ ID NO: 140928 - DNA, 16 bp, H. sapiens
tctgttcaaatatttt

SEQ ID NO: 140929 - DNA, 16 bp, H. sapiens
tctgttcaagtatttt

SEQ ID NO: 140930 - DNA, 16 bp, H. sapiens
tctgttcagtcagttg

SEQ ID NO: 140931 - DNA, 16 bp, H. sapiens
tctgttcatctccttt

SEQ ID NO: 140932 - DNA, 16 bp, H. sapiens
tctgttcatctgttga

SEQ ID NO: 140933 - DNA, 16 bp, H. sapiens
tctgttcatgtctttt

SEQ ID NO: 140934 - DNA, 16 bp, H. sapiens
tctgttcatgtttttg

SEQ ID NO: 140935 - DNA, 16 bp, H. sapiens
tctgttccaggcttct

SEQ ID NO: 140936 - DNA, 16 bp, H. sapiens
tctgttccattgttct

SEQ ID NO: 140937 - DNA, 16 bp, H. sapiens
tctgttccctgcctct

SEQ ID NO: 140938 - DNA, 16 bp, H. sapiens
tctgttcccttcttta

SEQ ID NO: 140939 - DNA, 16 bp, H. sapiens
tctgttcctatccttc

SEQ ID NO: 140940 - DNA, 16 bp, H. sapiens
tctgttcctatgttaa

SEQ ID NO: 140941 - DNA, 16 bp, H. sapiens
tctgttcctggcctct

SEQ ID NO: 140942 - DNA, 16 bp, H. sapiens
tctgttccttcctctg

SEQ ID NO: 140943 - DNA, 16 bp, H. sapiens
tctgttctcaagctgc

SEQ ID NO: 140944 - DNA, 17 bp, H. sapiens
tctgttctcacactgct

SEQ ID NO: 140945 - DNA, 16 bp, H. sapiens
tctgttctcaggctgc

SEQ ID NO: 140946 - DNA, 16 bp, H. sapiens
tctgttctgagccacc

SEQ ID NO: 140947 - DNA, 16 bp, H. sapiens
tctgttctgttccact

SEQ ID NO: 140948 - DNA, 16 bp, H. sapiens
tctgttctgttggtct

SEQ ID NO: 140949 - DNA, 16 bp, H. sapiens
tctgttcttaacaagg

SEQ ID NO: 140950 - DNA, 16 bp, H. sapiens
tctgttcttcagattg

SEQ ID NO: 140951 - DNA, 16 bp, H. sapiens
tctgttcttcatttct

SEQ ID NO: 140952 - DNA, 16 bp, H. sapiens
tctgttcttgccttca

SEQ ID NO: 140953 - DNA, 16 bp, H. sapiens
tctgttctttataaat

SEQ ID NO: 140954 - DNA, 16 bp, H. sapiens
tctgttgaatgaacaa

SEQ ID NO: 140955 - DNA, 16 bp, H. sapiens
tctgttgattttttaa

SEQ ID NO: 140956 - DNA, 16 bp, H. sapiens
tctgttgcaaaaaaaa

SEQ ID NO: 140957 - DNA, 16 bp, H. sapiens
tctgttgcatgttttt

SEQ ID NO: 140958 - DNA, 16 bp, H. sapiens
tctgttgccagcctgg

SEQ ID NO: 140959 - DNA, 19 bp, H. sapiens
tctgttgccaggctggagt

SEQ ID NO: 140960 - DNA, 16 bp, H. sapiens
tctgttgcccaagatg

SEQ ID NO: 140961 - DNA, 16 bp, H. sapiens
tctgttgcccacactg

SEQ ID NO: 140962 - DNA, 16 bp, H. sapiens
tctgttgcccagaatg

SEQ ID NO: 140963 - DNA, 18 bp, H. sapiens
tctgttgcccaggctgaa

SEQ ID NO: 140964 - DNA, 16 bp, H. sapiens
tctgttgcctcagctg

SEQ ID NO: 140965 - DNA, 16 bp, H. sapiens
tctgttgctcagattg

SEQ ID NO: 140966 - DNA, 16 bp, H. sapiens
tctgttggagtttgct

SEQ ID NO: 140967 - DNA, 16 bp, H. sapiens
tctgttggcaggctgg

SEQ ID NO: 140968 - DNA, 16 bp, H. sapiens
tctgttggtagtttgt

SEQ ID NO: 140969 - DNA, 16 bp, H. sapiens
tctgttggtgggagtg

SEQ ID NO: 140970 - DNA, 16 bp, H. sapiens
tctgttgtacattgca

SEQ ID NO: 140971 - DNA, 16 bp, H. sapiens
tctgttgtccacgctg

SEQ ID NO: 140972 - DNA, 16 bp, H. sapiens
tctgttgtccgggctg

SEQ ID NO: 140973 - DNA, 16 bp, H. sapiens
tctgttgtttaagcca

SEQ ID NO: 140974 - DNA, 16 bp, H. sapiens
tctgtttaaaaaaaaa

SEQ ID NO: 140975 - DNA, 16 bp, H. sapiens
tctgtttaaaaacaaa

SEQ ID NO: 140976 - DNA, 16 bp, H. sapiens
tctgtttacttgtctg

SEQ ID NO: 140977 - DNA, 16 bp, H. sapiens
tctgtttatgtgatga

SEQ ID NO: 140978 - DNA, 16 bp, H. sapiens
tctgtttattcattta

SEQ ID NO: 140979 - DNA, 16 bp, H. sapiens
tctgtttatttgatga

SEQ ID NO: 140980 - DNA, 16 bp, H. sapiens
tctgtttcaaaagaaa

SEQ ID NO: 140981 - DNA, 16 bp, H. sapiens
tctgtttcaaaataat

SEQ ID NO: 140982 - DNA, 16 bp, H. sapiens
tctgtttcacaacaat

SEQ ID NO: 140983 - DNA, 16 bp, H. sapiens
tctgtttccatagaaa

SEQ ID NO: 140984 - DNA, 16 bp, H. sapiens
tctgtttcccagggaa

SEQ ID NO: 140985 - DNA, 16 bp, H. sapiens
tctgtttcctcagctg

SEQ ID NO: 140986 - DNA, 16 bp, H. sapiens
tctgtttcctctgctg

SEQ ID NO: 140987 - DNA, 16 bp, H. sapiens
tctgtttcctgggctg

SEQ ID NO: 140988 - DNA, 16 bp, H. sapiens
tctgtttccttgccct

SEQ ID NO: 140989 - DNA, 16 bp, H. sapiens
tctgtttctaaataaa

SEQ ID NO: 140990 - DNA, 16 bp, H. sapiens
tctgtttctctagaaa

SEQ ID NO: 140991 - DNA, 16 bp, H. sapiens
tctgtttctctgcaga

SEQ ID NO: 140992 - DNA, 16 bp, H. sapiens
tctgtttctgagttct

SEQ ID NO: 140993 - DNA, 16 bp, H. sapiens
tctgtttctggacttt

SEQ ID NO: 140994 - DNA, 16 bp, H. sapiens
tctgtttctgtcattt

SEQ ID NO: 140995 - DNA, 16 bp, H. sapiens
tctgtttctgtcttca

SEQ ID NO: 140996 - DNA, 16 bp, H. sapiens
tctgtttctgtgtctg

SEQ ID NO: 140997 - DNA, 16 bp, H. sapiens
tctgtttcttcacctg

SEQ ID NO: 140998 - DNA, 16 bp, H. sapiens
tctgtttgattcttct

SEQ ID NO: 140999 - DNA, 18 bp, H. sapiens
tctgtttgcagatgacat

SEQ ID NO: 141000 - DNA, 16 bp, H. sapiens
tctgtttgccagtatt

SEQ ID NO: 141001 - DNA, 16 bp, H. sapiens
tctgtttgtgtgatga

SEQ ID NO: 141002 - DNA, 16 bp, H. sapiens
tctgttttaaaaaaaa

SEQ ID NO: 141003 - DNA, 16 bp, H. sapiens
tctgttttaaaaacct

SEQ ID NO: 141004 - DNA, 16 bp, H. sapiens
tctgttttaaaagaaa

SEQ ID NO: 141005 - DNA, 16 bp, H. sapiens
tctgttttatcagaga

SEQ ID NO: 141006 - DNA, 16 bp, H. sapiens
tctgttttcaattctt

SEQ ID NO: 141007 - DNA, 16 bp, H. sapiens
tctgttttcactctat

SEQ ID NO: 141008 - DNA, 16 bp, H. sapiens
tctgttttcagctctt

SEQ ID NO: 141009 - DNA, 16 bp, H. sapiens
tctgttttcagtttca

SEQ ID NO: 141010 - DNA, 16 bp, H. sapiens
tctgttttcattcatt

SEQ ID NO: 141011 - DNA, 16 bp, H. sapiens
tctgttttctttctaa

SEQ ID NO: 141012 - DNA, 16 bp, H. sapiens
tctgttttgcaagatg

SEQ ID NO: 141013 - DNA, 16 bp, H. sapiens
tctgttttggaaccag

SEQ ID NO: 141014 - DNA, 16 bp, H. sapiens
tctgttttgggctggg

SEQ ID NO: 141015 - DNA, 16 bp, H. sapiens
tctgttttgttcatct

SEQ ID NO: 141016 - DNA, 16 bp, H. sapiens
tctgttttgttccatt

SEQ ID NO: 141017 - DNA, 16 bp, H. sapiens
tctgttttgttttgca

SEQ ID NO: 141018 - DNA, 16 bp, H. sapiens
tctgtttttattctaa

SEQ ID NO: 141019 - DNA, 16 bp, H. sapiens
tctgtttttccatctg

SEQ ID NO: 141020 - DNA, 16 bp, H. sapiens
tctgtttttcctttca

SEQ ID NO: 141021 - DNA, 16 bp, H. sapiens
tctgtttttctcttca

SEQ ID NO: 141022 - DNA, 16 bp, H. sapiens
tctgtttttcttaaaa

SEQ ID NO: 141023 - DNA, 16 bp, H. sapiens
tctgtttttgcaccag

SEQ ID NO: 141024 - DNA, 16 bp, H. sapiens
tctgtttttgtaccag

SEQ ID NO: 141025 - DNA, 16 bp, H. sapiens
tctgttttttataaat

SEQ ID NO: 141026 - DNA, 16 bp, H. sapiens
tctgttttttccctat

SEQ ID NO: 141027 - DNA, 16 bp, H. sapiens
tcttaaaaagaacaaa

SEQ ID NO: 141028 - DNA, 16 bp, H. sapiens
tcttaaaaattaaagt

SEQ ID NO: 141029 - DNA, 16 bp, H. sapiens
tcttaaaaattgaaat

SEQ ID NO: 141030 - DNA, 16 bp, H. sapiens
tcttaaaagaaaacat

SEQ ID NO: 141031 - DNA, 16 bp, H. sapiens
tcttaaaagaaaatct

SEQ ID NO: 141032 - DNA, 16 bp, H. sapiens
tcttaaaagagaaaaa

SEQ ID NO: 141033 - DNA, 16 bp, H. sapiens
tcttaaaagttatttt

SEQ ID NO: 141034 - DNA, 16 bp, H. sapiens
tcttaaaatatgtttt

SEQ ID NO: 141035 - DNA, 16 bp, H. sapiens
tcttaaaatgaattat

SEQ ID NO: 141036 - DNA, 16 bp, H. sapiens
tcttaaaatgacaaaa

SEQ ID NO: 141037 - DNA, 16 bp, H. sapiens
tcttaaaatgatattt

SEQ ID NO: 141038 - DNA, 16 bp, H. sapiens
tcttaaaatgattttt

SEQ ID NO: 141039 - DNA, 16 bp, H. sapiens
tcttaaaatgcatttt

SEQ ID NO: 141040 - DNA, 16 bp, H. sapiens
tcttaaaatgtgaaaa

SEQ ID NO: 141041 - DNA, 16 bp, H. sapiens
tcttaaaatgtgacaa

SEQ ID NO: 141042 - DNA, 16 bp, H. sapiens
tcttaaaatgttattt

SEQ ID NO: 141043 - DNA, 16 bp, H. sapiens
tcttaaacaaaaagaa

SEQ ID NO: 141044 - DNA, 16 bp, H. sapiens
tcttaaacatttcttt

SEQ ID NO: 141045 - DNA, 16 bp, H. sapiens
tcttaaagaattagaa

SEQ ID NO: 141046 - DNA, 16 bp, H. sapiens
tcttaaagagcatgct

SEQ ID NO: 141047 - DNA, 18 bp, H. sapiens
tcttaaagatggtgtgtc

SEQ ID NO: 141048 - DNA, 16 bp, H. sapiens
tcttaaagctctaaaa

SEQ ID NO: 141049 - DNA, 16 bp, H. sapiens
tcttaaaggatatttt

SEQ ID NO: 141050 - DNA, 16 bp, H. sapiens
tcttaaatgttatttt

SEQ ID NO: 141051 - DNA, 16 bp, H. sapiens
tcttaaatgttctcac

SEQ ID NO: 141052 - DNA, 16 bp, H. sapiens
tcttaaatgttttatt

SEQ ID NO: 141053 - DNA, 16 bp, H. sapiens
tcttaaatttctgcaa

SEQ ID NO: 141054 - DNA, 16 bp, H. sapiens
tcttaaatttgtattt

SEQ ID NO: 141055 - DNA, 16 bp, H. sapiens
tcttaacaaatgttta

SEQ ID NO: 141056 - DNA, 16 bp, H. sapiens
tcttaacaaattattt

SEQ ID NO: 141057 - DNA, 16 bp, H. sapiens
tcttaacaagcatgct

SEQ ID NO: 141058 - DNA, 16 bp, H. sapiens
tcttaacagggttcaa

SEQ ID NO: 141059 - DNA, 16 bp, H. sapiens
tcttaacattgtcttt

SEQ ID NO: 141060 - DNA, 16 bp, H. sapiens
tcttaaccattttaaa

SEQ ID NO: 141061 - DNA, 16 bp, H. sapiens
tcttaactaattacat

SEQ ID NO: 141062 - DNA, 16 bp, H. sapiens
tcttaactattgtgaa

SEQ ID NO: 141063 - DNA, 16 bp, H. sapiens
tcttaactcctgggct

SEQ ID NO: 141064 - DNA, 16 bp, H. sapiens
tcttaacttccagttc

SEQ ID NO: 141065 - DNA, 16 bp, H. sapiens
tcttaactttaaaaaa

SEQ ID NO: 141066 - DNA, 16 bp, H. sapiens
tcttaagaaattattt

SEQ ID NO: 141067 - DNA, 16 bp, H. sapiens
tcttaaggccttcaac

SEQ ID NO: 141068 - DNA, 16 bp, H. sapiens
tcttaagtgtacagtt

SEQ ID NO: 141069 - DNA, 16 bp, H. sapiens
tcttaagttttaaatt

SEQ ID NO: 141070 - DNA, 16 bp, H. sapiens
tcttaataaaattaca

SEQ ID NO: 141071 - DNA, 16 bp, H. sapiens
tcttaatattttctgt

SEQ ID NO: 141072 - DNA, 16 bp, H. sapiens
tcttaatggaaataaa

SEQ ID NO: 141073 - DNA, 16 bp, H. sapiens
tcttaattggaaatga

SEQ ID NO: 141074 - DNA, 16 bp, H. sapiens
tcttaattttagaaat

SEQ ID NO: 141075 - DNA, 16 bp, H. sapiens
tcttaattttctaaaa

SEQ ID NO: 141076 - DNA, 16 bp, H. sapiens
tcttaatttttaaaga

SEQ ID NO: 141077 - DNA, 16 bp, H. sapiens
tcttacagattttata

SEQ ID NO: 141078 - DNA, 16 bp, H. sapiens
tcttacagttctggag

SEQ ID NO: 141079 - DNA, 16 bp, H. sapiens
tcttacagttctggtg

SEQ ID NO: 141080 - DNA, 16 bp, H. sapiens
tcttacataatcacaa

SEQ ID NO: 141081 - DNA, 16 bp, H. sapiens
tcttacatatattgat

SEQ ID NO: 141082 - DNA, 16 bp, H. sapiens
tcttacatgccctgga

SEQ ID NO: 141083 - DNA, 16 bp, H. sapiens
tcttacatggcggcag

SEQ ID NO: 141084 - DNA, 16 bp, H. sapiens
tcttacatggtggcag

SEQ ID NO: 141085 - DNA, 16 bp, H. sapiens
tcttacatttatatct

SEQ ID NO: 141086 - DNA, 16 bp, H. sapiens
tcttacatttattgag

SEQ ID NO: 141087 - DNA, 16 bp, H. sapiens
tcttacctggcagcag

SEQ ID NO: 141088 - DNA, 16 bp, H. sapiens
tcttactaaagaaaaa

SEQ ID NO: 141089 - DNA, 17 bp, H. sapiens
tcttactatattgccca

SEQ ID NO: 141090 - DNA, 16 bp, H. sapiens
tcttactatttgaata

SEQ ID NO: 141091 - DNA, 16 bp, H. sapiens
tcttactgcttctgaa

SEQ ID NO: 141092 - DNA, 16 bp, H. sapiens
tcttactgtgttgtcc

SEQ ID NO: 141093 - DNA, 16 bp, H. sapiens
tcttactttcccaaaa

SEQ ID NO: 141094 - DNA, 16 bp, H. sapiens
tcttagaaaaatataa

SEQ ID NO: 141095 - DNA, 16 bp, H. sapiens
tcttagaaaagataaa

SEQ ID NO: 141096 - DNA, 16 bp, H. sapiens
tcttagaaacagaaaa

SEQ ID NO: 141097 - DNA, 16 bp, H. sapiens
tcttagaaacatacaa

SEQ ID NO: 141098 - DNA, 16 bp, H. sapiens
tcttagaaagaaacat

SEQ ID NO: 141099 - DNA, 16 bp, H. sapiens
tcttagaaagcttctt

SEQ ID NO: 141100 - DNA, 16 bp, H. sapiens
tcttagaagaaaacag

SEQ ID NO: 141101 - DNA, 16 bp, H. sapiens
tcttagaagaaaacct

SEQ ID NO: 141102 - DNA, 16 bp, H. sapiens
tcttagaagaaaatgt

SEQ ID NO: 141103 - DNA, 16 bp, H. sapiens
tcttagaagaagacat

SEQ ID NO: 141104 - DNA, 16 bp, H. sapiens
tcttagatcactgcaa

SEQ ID NO: 141105 - DNA, 16 bp, H. sapiens
tcttagatttaggtct

SEQ ID NO: 141106 - DNA, 16 bp, H. sapiens
tcttagatttgatgaa

SEQ ID NO: 141107 - DNA, 16 bp, H. sapiens
tcttagcactttgaga

SEQ ID NO: 141108 - DNA, 16 bp, H. sapiens
tcttagcccaaaatct

SEQ ID NO: 141109 - DNA, 16 bp, H. sapiens
tcttagcctcagtttc

SEQ ID NO: 141110 - DNA, 16 bp, H. sapiens
tcttagcttccttgct

SEQ ID NO: 141111 - DNA, 16 bp, H. sapiens
tcttaggaggaaaaaa

SEQ ID NO: 141112 - DNA, 16 bp, H. sapiens
tcttaggattgttttt

SEQ ID NO: 141113 - DNA, 16 bp, H. sapiens
tcttaggcagctctgc

SEQ ID NO: 141114 - DNA, 16 bp, H. sapiens
tcttaggggaaaaaaa

SEQ ID NO: 141115 - DNA, 16 bp, H. sapiens
tcttaggtatttcttc

SEQ ID NO: 141116 - DNA, 16 bp, H. sapiens
tcttaggtcaggagtt

SEQ ID NO: 141117 - DNA, 16 bp, H. sapiens
tcttagtccattttct

SEQ ID NO: 141118 - DNA, 16 bp, H. sapiens
tcttagtggtacataa

SEQ ID NO: 141119 - DNA, 16 bp, H. sapiens
tcttagttctattcag

SEQ ID NO: 141120 - DNA, 16 bp, H. sapiens
tcttagtttccttgca

SEQ ID NO: 141121 - DNA, 16 bp, H. sapiens
tcttagtttctgtttc

SEQ ID NO: 141122 - DNA, 16 bp, H. sapiens
tcttagtttttaaaaa

SEQ ID NO: 141123 - DNA, 16 bp, H. sapiens
tcttagtttttaacaa

SEQ ID NO: 141124 - DNA, 16 bp, H. sapiens
tcttataagaaaacat

SEQ ID NO: 141125 - DNA, 16 bp, H. sapiens
tcttataatcttttac

SEQ ID NO: 141126 - DNA, 16 bp, H. sapiens
tcttatacctcagcct

SEQ ID NO: 141127 - DNA, 16 bp, H. sapiens
tcttatagtttgaggt

SEQ ID NO: 141128 - DNA, 16 bp, H. sapiens
tcttatataaaatctc

SEQ ID NO: 141129 - DNA, 16 bp, H. sapiens
tcttatattttctctg

SEQ ID NO: 141130 - DNA, 16 bp, H. sapiens
tcttatccaaaatgct

SEQ ID NO: 141131 - DNA, 16 bp, H. sapiens
tcttatgaaaataaat

SEQ ID NO: 141132 - DNA, 17 bp, H. sapiens
tcttatgccagttttca

SEQ ID NO: 141133 - DNA, 16 bp, H. sapiens
tcttattcataaaata

SEQ ID NO: 141134 - DNA, 16 bp, H. sapiens
tcttattcatctctgt

SEQ ID NO: 141135 - DNA, 16 bp, H. sapiens
tcttattcatctttgt

SEQ ID NO: 141136 - DNA, 16 bp, H. sapiens
tcttattgtattgtct

SEQ ID NO: 141137 - DNA, 16 bp, H. sapiens
tcttattgttcagttc

SEQ ID NO: 141138 - DNA, 16 bp, H. sapiens
tcttatttaaaaaaac

SEQ ID NO: 141139 - DNA, 16 bp, H. sapiens
tcttatttaaagaaaa

SEQ ID NO: 141140 - DNA, 16 bp, H. sapiens
tcttatttaaatgttt

SEQ ID NO: 141141 - DNA, 16 bp, H. sapiens
tcttatttcacttaac

SEQ ID NO: 141142 - DNA, 16 bp, H. sapiens
tcttatttcatcttca

SEQ ID NO: 141143 - DNA, 16 bp, H. sapiens
tcttatttcatttctg

SEQ ID NO: 141144 - DNA, 16 bp, H. sapiens
tcttatttctgaattc

SEQ ID NO: 141145 - DNA, 16 bp, H. sapiens
tcttatttggagaaat

SEQ ID NO: 141146 - DNA, 16 bp, H. sapiens
tcttattttaaaatac

SEQ ID NO: 141147 - DNA, 16 bp, H. sapiens
tcttattttaaagaaa

SEQ ID NO: 141148 - DNA, 16 bp, H. sapiens
tcttattttaaagata

SEQ ID NO: 141149 - DNA, 16 bp, H. sapiens
tcttattttaaatgta

SEQ ID NO: 141150 - DNA, 16 bp, H. sapiens
tcttattttgaaaagt

SEQ ID NO: 141151 - DNA, 16 bp, H. sapiens
tcttattttgagaaat

SEQ ID NO: 141152 - DNA, 16 bp, H. sapiens
tcttattttgtttaaa

SEQ ID NO: 141153 - DNA, 16 bp, H. sapiens
tcttatttttaagaaa

SEQ ID NO: 141154 - DNA, 16 bp, H. sapiens
tcttatttttaatgta

SEQ ID NO: 141155 - DNA, 16 bp, H. sapiens
tcttattttttcctga

SEQ ID NO: 141156 - DNA, 16 bp, H. sapiens
tcttcaaaaatgaaga

SEQ ID NO: 141157 - DNA, 16 bp, H. sapiens
tcttcaaaaatgtcaa

SEQ ID NO: 141158 - DNA, 16 bp, H. sapiens
tcttcaaaataaaaca

SEQ ID NO: 141159 - DNA, 16 bp, H. sapiens
tcttcaaaattttaat

SEQ ID NO: 141160 - DNA, 16 bp, H. sapiens
tcttcaaacattttac

SEQ ID NO: 141161 - DNA, 16 bp, H. sapiens
tcttcaaacatttttt

SEQ ID NO: 141162 - DNA, 16 bp, H. sapiens
tcttcaaagaaaaaaa

SEQ ID NO: 141163 - DNA, 16 bp, H. sapiens
tcttcaaagccagcag

SEQ ID NO: 141164 - DNA, 16 bp, H. sapiens
tcttcaaagtcagcag

SEQ ID NO: 141165 - DNA, 16 bp, H. sapiens
tcttcaaatattcttt

SEQ ID NO: 141166 - DNA, 16 bp, H. sapiens
tcttcaaatattgttt

SEQ ID NO: 141167 - DNA, 16 bp, H. sapiens
tcttcaaatcaactca

SEQ ID NO: 141168 - DNA, 20 bp, H. sapiens
tcttcaaatggagccccaga

SEQ ID NO: 141169 - DNA, 16 bp, H. sapiens
tcttcaaattcatatg

SEQ ID NO: 141170 - DNA, 16 bp, H. sapiens
tcttcaacaaagaaga

SEQ ID NO: 141171 - DNA, 16 bp, H. sapiens
tcttcaacaaagttga

SEQ ID NO: 141172 - DNA, 16 bp, H. sapiens
tcttcaacaaatacat

SEQ ID NO: 141173 - DNA, 16 bp, H. sapiens
tcttcaacatcatctt

SEQ ID NO: 141174 - DNA, 16 bp, H. sapiens
tcttcaagaagagcaa

SEQ ID NO: 141175 - DNA, 16 bp, H. sapiens
tcttcaagatcctgct

SEQ ID NO: 141176 - DNA, 16 bp, H. sapiens
tcttcaagctcacaaa

SEQ ID NO: 141177 - DNA, 16 bp, H. sapiens
tcttcaaggagaacaa

SEQ ID NO: 141178 - DNA, 21 bp, H. sapiens
tcttcaaggagaactacaaat

SEQ ID NO: 141179 - DNA, 16 bp, H. sapiens
tcttcaaggagcacta

SEQ ID NO: 141180 - DNA, 16 bp, H. sapiens
tcttcaaggatgcagg

SEQ ID NO: 141181 - DNA, 16 bp, H. sapiens
tcttcaagttcacaga

SEQ ID NO: 141182 - DNA, 16 bp, H. sapiens
tcttcaagttcactaa

SEQ ID NO: 141183 - DNA, 16 bp, H. sapiens
tcttcaataaatgata

SEQ ID NO: 141184 - DNA, 16 bp, H. sapiens
tcttcaataaatgctg

SEQ ID NO: 141185 - DNA, 16 bp, H. sapiens
tcttcaatacactgat

SEQ ID NO: 141186 - DNA, 16 bp, H. sapiens
tcttcaatagttttac

SEQ ID NO: 141187 - DNA, 16 bp, H. sapiens
tcttcaattaaaagac

SEQ ID NO: 141188 - DNA, 16 bp, H. sapiens
tcttcaatttctttca

SEQ ID NO: 141189 - DNA, 16 bp, H. sapiens
tcttcaattttctgaa

SEQ ID NO: 141190 - DNA, 16 bp, H. sapiens
tcttcacaagatggca

SEQ ID NO: 141191 - DNA, 16 bp, H. sapiens
tcttcacagatttgga

SEQ ID NO: 141192 - DNA, 16 bp, H. sapiens
tcttcacagcaaccct

SEQ ID NO: 141193 - DNA, 16 bp, H. sapiens
tcttcacaggatggca

SEQ ID NO: 141194 - DNA, 16 bp, H. sapiens
tcttcacatagttctc

SEQ ID NO: 141195 - DNA, 16 bp, H. sapiens
tcttcacatgatggaa

SEQ ID NO: 141196 - DNA, 16 bp, H. sapiens
tcttcacatggtcatc

SEQ ID NO: 141197 - DNA, 16 bp, H. sapiens
tcttcacattaaaact

SEQ ID NO: 141198 - DNA, 16 bp, H. sapiens
tcttcacattgagcag

SEQ ID NO: 141199 - DNA, 16 bp, H. sapiens
tcttcacattgtcttt

SEQ ID NO: 141200 - DNA, 16 bp, H. sapiens
tcttcaccacaaccct

SEQ ID NO: 141201 - DNA, 16 bp, H. sapiens
tcttcaccaccaccac

SEQ ID NO: 141202 - DNA, 16 bp, H. sapiens
tcttcaccatcatcat

SEQ ID NO: 141203 - DNA, 16 bp, H. sapiens
tcttcacctgaaaaat

SEQ ID NO: 141204 - DNA, 16 bp, H. sapiens
tcttcaccttccgcca

SEQ ID NO: 141205 - DNA, 16 bp, H. sapiens
tcttcactgctgaatt

SEQ ID NO: 141206 - DNA, 16 bp, H. sapiens
tcttcactttttaata

SEQ ID NO: 141207 - DNA, 16 bp, H. sapiens
tcttcagaaaaacaaa

SEQ ID NO: 141208 - DNA, 16 bp, H. sapiens
tcttcagaatacagcc

SEQ ID NO: 141209 - DNA, 16 bp, H. sapiens
tcttcagaatattttt

SEQ ID NO: 141210 - DNA, 16 bp, H. sapiens
tcttcagaattatttt

SEQ ID NO: 141211 - DNA, 16 bp, H. sapiens
tcttcagaattgtcag

SEQ ID NO: 141212 - DNA, 16 bp, H. sapiens
tcttcagaatttggaa

SEQ ID NO: 141213 - DNA, 16 bp, H. sapiens
tcttcagactccactt

SEQ ID NO: 141214 - DNA, 16 bp, H. sapiens
tcttcagagaaaaaca

SEQ ID NO: 141215 - DNA, 16 bp, H. sapiens
tcttcagagaaaaaga

SEQ ID NO: 141216 - DNA, 16 bp, H. sapiens
tcttcagagaaacaga

SEQ ID NO: 141217 - DNA, 16 bp, H. sapiens
tcttcagagaagaact

SEQ ID NO: 141218 - DNA, 16 bp, H. sapiens
tcttcagagagaagga

SEQ ID NO: 141219 - DNA, 16 bp, H. sapiens
tcttcagagcctgcag

SEQ ID NO: 141220 - DNA, 16 bp, H. sapiens
tcttcagagctgtgag

SEQ ID NO: 141221 - DNA, 16 bp, H. sapiens
tcttcagataaattct

SEQ ID NO: 141222 - DNA, 16 bp, H. sapiens
tcttcagatacaaact

SEQ ID NO: 141223 - DNA, 16 bp, H. sapiens
tcttcagccatgtgga

SEQ ID NO: 141224 - DNA, 16 bp, H. sapiens
tcttcagcccaggagt

SEQ ID NO: 141225 - DNA, 16 bp, H. sapiens
tcttcagcctctgctg

SEQ ID NO: 141226 - DNA, 16 bp, H. sapiens
tcttcagctccacctg

SEQ ID NO: 141227 - DNA, 16 bp, H. sapiens
tcttcagctctcagca

SEQ ID NO: 141228 - DNA, 16 bp, H. sapiens
tcttcagcttcctcaa

SEQ ID NO: 141229 - DNA, 16 bp, H. sapiens
tcttcagctttgggac

SEQ ID NO: 141230 - DNA, 16 bp, H. sapiens
tcttcaggttttctat

SEQ ID NO: 141231 - DNA, 16 bp, H. sapiens
tcttcagtctccttta

SEQ ID NO: 141232 - DNA, 16 bp, H. sapiens
tcttcagtgaaataga

SEQ ID NO: 141233 - DNA, 16 bp, H. sapiens
tcttcagtgtctattg

SEQ ID NO: 141234 - DNA, 16 bp, H. sapiens
tcttcagtttcttcat

SEQ ID NO: 141235 - DNA, 16 bp, H. sapiens
tcttcagttttctcat

SEQ ID NO: 141236 - DNA, 16 bp, H. sapiens
tcttcagttttctgga

SEQ ID NO: 141237 - DNA, 16 bp, H. sapiens
tcttcataataaaatt

SEQ ID NO: 141238 - DNA, 16 bp, H. sapiens
tcttcatatattttgg

SEQ ID NO: 141239 - DNA, 16 bp, H. sapiens
tcttcatatggtggca

SEQ ID NO: 141240 - DNA, 16 bp, H. sapiens
tcttcatcagcacttg

SEQ ID NO: 141241 - DNA, 16 bp, H. sapiens
tcttcatcctcatctt

SEQ ID NO: 141242 - DNA, 16 bp, H. sapiens
tcttcatcctcattgt

SEQ ID NO: 141243 - DNA, 16 bp, H. sapiens
tcttcatccttatcct

SEQ ID NO: 141244 - DNA, 16 bp, H. sapiens
tcttcatctcagtaaa

SEQ ID NO: 141245 - DNA, 16 bp, H. sapiens
tcttcatcttcttcac

SEQ ID NO: 141246 - DNA, 16 bp, H. sapiens
tcttcatcttgtaaaa

SEQ ID NO: 141247 - DNA, 16 bp, H. sapiens
tcttcatgaaatattt

SEQ ID NO: 141248 - DNA, 19 bp, H. sapiens
tcttcatgctaaaaactct

SEQ ID NO: 141249 - DNA, 16 bp, H. sapiens
tcttcatgctgctgat

SEQ ID NO: 141250 - DNA, 16 bp, H. sapiens
tcttcatggagcttac

SEQ ID NO: 141251 - DNA, 16 bp, H. sapiens
tcttcatggctgggga

SEQ ID NO: 141252 - DNA, 16 bp, H. sapiens
tcttcatgtgtttgtt

SEQ ID NO: 141253 - DNA, 16 bp, H. sapiens
tcttcatgttttcatt

SEQ ID NO: 141254 - DNA, 16 bp, H. sapiens
tcttcattaataaaat

SEQ ID NO: 141255 - DNA, 16 bp, H. sapiens
tcttcatttctaaatt

SEQ ID NO: 141256 - DNA, 16 bp, H. sapiens
tcttcatttctctggg

SEQ ID NO: 141257 - DNA, 16 bp, H. sapiens
tcttcatttctgaaat

SEQ ID NO: 141258 - DNA, 16 bp, H. sapiens
tcttcattttacatat

SEQ ID NO: 141259 - DNA, 16 bp, H. sapiens
tcttcattttataaaa

SEQ ID NO: 141260 - DNA, 16 bp, H. sapiens
tcttcattttatagat

SEQ ID NO: 141261 - DNA, 16 bp, H. sapiens
tcttcattttattgat

SEQ ID NO: 141262 - DNA, 16 bp, H. sapiens
tcttcattttgctgat

SEQ ID NO: 141263 - DNA, 16 bp, H. sapiens
tcttcatttttaaaga

SEQ ID NO: 141264 - DNA, 16 bp, H. sapiens
tcttccaaaaattaaa

SEQ ID NO: 141265 - DNA, 16 bp, H. sapiens
tcttccaaaactgaaa

SEQ ID NO: 141266 - DNA, 16 bp, H. sapiens
tcttccaaaaggaaaa

SEQ ID NO: 141267 - DNA, 16 bp, H. sapiens
tcttccaaaggaatgc

SEQ ID NO: 141268 - DNA, 16 bp, H. sapiens
tcttccaaagtagctg

SEQ ID NO: 141269 - DNA, 16 bp, H. sapiens
tcttccaacttttctg

SEQ ID NO: 141270 - DNA, 16 bp, H. sapiens
tcttccaatacatgaa

SEQ ID NO: 141271 - DNA, 16 bp, H. sapiens
tcttccacaatgactg

SEQ ID NO: 141272 - DNA, 16 bp, H. sapiens
tcttccacatctatca

SEQ ID NO: 141273 - DNA, 16 bp, H. sapiens
tcttccacctcagcct

SEQ ID NO: 141274 - DNA, 16 bp, H. sapiens
tcttccacctctgcca

SEQ ID NO: 141275 - DNA, 16 bp, H. sapiens
tcttccacctctgcct

SEQ ID NO: 141276 - DNA, 16 bp, H. sapiens
tcttccactgtggccc

SEQ ID NO: 141277 - DNA, 16 bp, H. sapiens
tcttccacttccacat

SEQ ID NO: 141278 - DNA, 16 bp, H. sapiens
tcttccacttgtttgt

SEQ ID NO: 141279 - DNA, 16 bp, H. sapiens
tcttccagaaaagaaa

SEQ ID NO: 141280 - DNA, 16 bp, H. sapiens
tcttccagaaaataaa

SEQ ID NO: 141281 - DNA, 16 bp, H. sapiens
tcttccagaaagaaaa

SEQ ID NO: 141282 - DNA, 16 bp, H. sapiens
tcttccagacaatgaa

SEQ ID NO: 141283 - DNA, 16 bp, H. sapiens
tcttccagacagaaaa

SEQ ID NO: 141284 - DNA, 16 bp, H. sapiens
tcttccagcaggctag

SEQ ID NO: 141285 - DNA, 16 bp, H. sapiens
tcttccagcctccaga

SEQ ID NO: 141286 - DNA, 16 bp, H. sapiens
tcttccaggctttggt

SEQ ID NO: 141287 - DNA, 16 bp, H. sapiens
tcttccagggttttta

SEQ ID NO: 141288 - DNA, 16 bp, H. sapiens
tcttccaggttttcca

SEQ ID NO: 141289 - DNA, 16 bp, H. sapiens
tcttccagttctggag

SEQ ID NO: 141290 - DNA, 16 bp, H. sapiens
tcttccagttgctcag

SEQ ID NO: 141291 - DNA, 16 bp, H. sapiens
tcttccatcttaaaaa

SEQ ID NO: 141292 - DNA, 16 bp, H. sapiens
tcttccatgaaacagg

SEQ ID NO: 141293 - DNA, 16 bp, H. sapiens
tcttccattagaatgc

SEQ ID NO: 141294 - DNA, 16 bp, H. sapiens
tcttccattctgtcag

SEQ ID NO: 141295 - DNA, 16 bp, H. sapiens
tcttccatttggctgt

SEQ ID NO: 141296 - DNA, 16 bp, H. sapiens
tcttcccaaagtgctg

SEQ ID NO: 141297 - DNA, 16 bp, H. sapiens
tcttcccaccctggcc

SEQ ID NO: 141298 - DNA, 17 bp, H. sapiens
tcttcccacctcggcct

SEQ ID NO: 141299 - DNA, 16 bp, H. sapiens
tcttcccacctcggct

SEQ ID NO: 141300 - DNA, 16 bp, H. sapiens
tcttcccaccttggcc

SEQ ID NO: 141301 - DNA, 16 bp, H. sapiens
tcttcccactgcttct

SEQ ID NO: 141302 - DNA, 16 bp, H. sapiens
tcttcccagatgctgg

SEQ ID NO: 141303 - DNA, 16 bp, H. sapiens
tcttcccagctcagcc

SEQ ID NO: 141304 - DNA, 16 bp, H. sapiens
tcttcccagtcttgga

SEQ ID NO: 141305 - DNA, 16 bp, H. sapiens
tcttcccatccatgaa

SEQ ID NO: 141306 - DNA, 16 bp, H. sapiens
tcttcccatcttggcc

SEQ ID NO: 141307 - DNA, 16 bp, H. sapiens
tcttccccacctgccc

SEQ ID NO: 141308 - DNA, 16 bp, H. sapiens
tcttccccaggctgga

SEQ ID NO: 141309 - DNA, 16 bp, H. sapiens
tcttccccatctcagt

SEQ ID NO: 141310 - DNA, 16 bp, H. sapiens
tcttccccctcagcct

SEQ ID NO: 141311 - DNA, 16 bp, H. sapiens
tcttccctcagcttcc

SEQ ID NO: 141312 - DNA, 16 bp, H. sapiens
tcttccctcctcagct

SEQ ID NO: 141313 - DNA, 16 bp, H. sapiens
tcttccctctggaact

SEQ ID NO: 141314 - DNA, 16 bp, H. sapiens
tcttccctgggaagct

SEQ ID NO: 141315 - DNA, 16 bp, H. sapiens
tcttccctgggctctg

SEQ ID NO: 141316 - DNA, 16 bp, H. sapiens
tcttccctgtgctgtt

SEQ ID NO: 141317 - DNA, 16 bp, H. sapiens
tcttccctttctacat

SEQ ID NO: 141318 - DNA, 16 bp, H. sapiens
tcttccctttggaatt

SEQ ID NO: 141319 - DNA, 16 bp, H. sapiens
tcttccgtctcagcct

SEQ ID NO: 141320 - DNA, 16 bp, H. sapiens
tcttcctaaacaagta

SEQ ID NO: 141321 - DNA, 16 bp, H. sapiens
tcttcctaagtatttt

SEQ ID NO: 141322 - DNA, 16 bp, H. sapiens
tcttcctactgcccat

SEQ ID NO: 141323 - DNA, 16 bp, H. sapiens
tcttcctagtctcagg

SEQ ID NO: 141324 - DNA, 16 bp, H. sapiens
tcttcctatccaagaa

SEQ ID NO: 141325 - DNA, 16 bp, H. sapiens
tcttcctatccaggag

SEQ ID NO: 141326 - DNA, 16 bp, H. sapiens
tcttcctatctcagcc

SEQ ID NO: 141327 - DNA, 16 bp, H. sapiens
tcttcctatctgaata

SEQ ID NO: 141328 - DNA, 16 bp, H. sapiens
tcttcctatttgaata

SEQ ID NO: 141329 - DNA, 16 bp, H. sapiens
tcttcctccaaccctt

SEQ ID NO: 141330 - DNA, 16 bp, H. sapiens
tcttcctccagatatt

SEQ ID NO: 141331 - DNA, 16 bp, H. sapiens
tcttcctcctcagtct

SEQ ID NO: 141332 - DNA, 16 bp, H. sapiens
tcttcctcctctgcca

SEQ ID NO: 141333 - DNA, 16 bp, H. sapiens
tcttcctcctgcccca

SEQ ID NO: 141334 - DNA, 16 bp, H. sapiens
tcttcctcctgccctg

SEQ ID NO: 141335 - DNA, 16 bp, H. sapiens
tcttcctcctgtgctg

SEQ ID NO: 141336 - DNA, 16 bp, H. sapiens
tcttcctcctgttcca

SEQ ID NO: 141337 - DNA, 16 bp, H. sapiens
tcttcctctccaacct

SEQ ID NO: 141338 - DNA, 16 bp, H. sapiens
tcttcctctccttggg

SEQ ID NO: 141339 - DNA, 16 bp, H. sapiens
tcttcctctggaagct

SEQ ID NO: 141340 - DNA, 16 bp, H. sapiens
tcttcctctttcctgg

SEQ ID NO: 141341 - DNA, 16 bp, H. sapiens
tcttcctgagacagag

SEQ ID NO: 141342 - DNA, 16 bp, H. sapiens
tcttcctgcctcagtc

SEQ ID NO: 141343 - DNA, 16 bp, H. sapiens
tcttcctgcctgagcc

SEQ ID NO: 141344 - DNA, 16 bp, H. sapiens
tcttcctgcctggaat

SEQ ID NO: 141345 - DNA, 16 bp, H. sapiens
tcttcctgccttagtc

SEQ ID NO: 141346 - DNA, 16 bp, H. sapiens
tcttcctgcctttgcc

SEQ ID NO: 141347 - DNA, 16 bp, H. sapiens
tcttcctgctgctgct

SEQ ID NO: 141348 - DNA, 16 bp, H. sapiens
tcttcctgcttccacc

SEQ ID NO: 141349 - DNA, 16 bp, H. sapiens
tcttcctgcttctgct

SEQ ID NO: 141350 - DNA, 16 bp, H. sapiens
tcttcctggaagcaga

SEQ ID NO: 141351 - DNA, 16 bp, H. sapiens
tcttcctggcctgcag

SEQ ID NO: 141352 - DNA, 16 bp, H. sapiens
tcttcctgggcctctg

SEQ ID NO: 141353 - DNA, 16 bp, H. sapiens
tcttcctgggtctcaa

SEQ ID NO: 141354 - DNA, 16 bp, H. sapiens
tcttcctggttcaatc

SEQ ID NO: 141355 - DNA, 16 bp, H. sapiens
tcttccttcatgacag

SEQ ID NO: 141356 - DNA, 16 bp, H. sapiens
tcttccttctgcctga

SEQ ID NO: 141357 - DNA, 16 bp, H. sapiens
tcttccttgaagaaat

SEQ ID NO: 141358 - DNA, 16 bp, H. sapiens
tcttcctttagcttgg

SEQ ID NO: 141359 - DNA, 16 bp, H. sapiens
tcttcctttcagtgaa

SEQ ID NO: 141360 - DNA, 16 bp, H. sapiens
tcttccttttaaaaaa

SEQ ID NO: 141361 - DNA, 16 bp, H. sapiens
tcttccttttcaccca

SEQ ID NO: 141362 - DNA, 16 bp, H. sapiens
tcttccttttggcagg

SEQ ID NO: 141363 - DNA, 16 bp, H. sapiens
tcttcctttttaataa

SEQ ID NO: 141364 - DNA, 16 bp, H. sapiens
tcttcctttttgaaaa

SEQ ID NO: 141365 - DNA, 16 bp, H. sapiens
tcttcgatttctttca

SEQ ID NO: 141366 - DNA, 16 bp, H. sapiens
tcttcggagctgttgg

SEQ ID NO: 141367 - DNA, 16 bp, H. sapiens
tcttctaaaagtttta

SEQ ID NO: 141368 - DNA, 16 bp, H. sapiens
tcttctaaagaagaaa

SEQ ID NO: 141369 - DNA, 16 bp, H. sapiens
tcttctaaatatacaa

SEQ ID NO: 141370 - DNA, 16 bp, H. sapiens
tcttctaagaatttta

SEQ ID NO: 141371 - DNA, 16 bp, H. sapiens
tcttctaagagtttta

SEQ ID NO: 141372 - DNA, 16 bp, H. sapiens
tcttctagaagttgta

SEQ ID NO: 141373 - DNA, 16 bp, H. sapiens
tcttctagaattttat

SEQ ID NO: 141374 - DNA, 16 bp, H. sapiens
tcttctaggttttcta

SEQ ID NO: 141375 - DNA, 16 bp, H. sapiens
tcttctatctgtgaaa

SEQ ID NO: 141376 - DNA, 16 bp, H. sapiens
tcttctattttctgaa

SEQ ID NO: 141377 - DNA, 16 bp, H. sapiens
tcttctcaaggagtgt

SEQ ID NO: 141378 - DNA, 16 bp, H. sapiens
tcttctcaaggccgct

SEQ ID NO: 141379 - DNA, 17 bp, H. sapiens
tcttctcaattttgctg

SEQ ID NO: 141380 - DNA, 16 bp, H. sapiens
tcttctcagaccacag

SEQ ID NO: 141381 - DNA, 16 bp, H. sapiens
tcttctcagcaacaca

SEQ ID NO: 141382 - DNA, 16 bp, H. sapiens
tcttctcatttttctg

SEQ ID NO: 141383 - DNA, 16 bp, H. sapiens
tcttctccaaaggatc

SEQ ID NO: 141384 - DNA, 16 bp, H. sapiens
tcttctccagcacctg

SEQ ID NO: 141385 - DNA, 16 bp, H. sapiens
tcttctccatctcagt

SEQ ID NO: 141386 - DNA, 16 bp, H. sapiens
tcttctccatctgaga

SEQ ID NO: 141387 - DNA, 16 bp, H. sapiens
tcttctccatcttcac

SEQ ID NO: 141388 - DNA, 16 bp, H. sapiens
tcttctccccagcccc

SEQ ID NO: 141389 - DNA, 16 bp, H. sapiens
tcttctcccctgattc

SEQ ID NO: 141390 - DNA, 16 bp, H. sapiens
tcttctccctgctgcc

SEQ ID NO: 141391 - DNA, 16 bp, H. sapiens
tcttctccctgtgtct

SEQ ID NO: 141392 - DNA, 16 bp, H. sapiens
tcttctcctctaaatg

SEQ ID NO: 141393 - DNA, 16 bp, H. sapiens
tcttctcctgcccttg

SEQ ID NO: 141394 - DNA, 16 bp, H. sapiens
tcttctccttctggga

SEQ ID NO: 141395 - DNA, 16 bp, H. sapiens
tcttctccttgctgct

SEQ ID NO: 141396 - DNA, 16 bp, H. sapiens
tcttctctgagaaatg

SEQ ID NO: 141397 - DNA, 16 bp, H. sapiens
tcttctctgagctcca

SEQ ID NO: 141398 - DNA, 16 bp, H. sapiens
tcttctctgtatgtca

SEQ ID NO: 141399 - DNA, 16 bp, H. sapiens
tcttctctgtcttcat

SEQ ID NO: 141400 - DNA, 16 bp, H. sapiens
tcttctgaaagagatt

SEQ ID NO: 141401 - DNA, 16 bp, H. sapiens
tcttctgacctcctga

SEQ ID NO: 141402 - DNA, 16 bp, H. sapiens
tcttctgagcagcagc

SEQ ID NO: 141403 - DNA, 16 bp, H. sapiens
tcttctgagccctcca

SEQ ID NO: 141404 - DNA, 16 bp, H. sapiens
tcttctgagctgcagt

SEQ ID NO: 141405 - DNA, 16 bp, H. sapiens
tcttctgaggcctctt

SEQ ID NO: 141406 - DNA, 16 bp, H. sapiens
tcttctgatagtgaat

SEQ ID NO: 141407 - DNA, 16 bp, H. sapiens
tcttctgatttcttct

SEQ ID NO: 141408 - DNA, 16 bp, H. sapiens
tcttctgattttaaaa

SEQ ID NO: 141409 - DNA, 16 bp, H. sapiens
tcttctgcagcttcct

SEQ ID NO: 141410 - DNA, 16 bp, H. sapiens
tcttctgcatattgct

SEQ ID NO: 141411 - DNA, 16 bp, H. sapiens
tcttctgccactgcca

SEQ ID NO: 141412 - DNA, 16 bp, H. sapiens
tcttctgccagttcaa

SEQ ID NO: 141413 - DNA, 16 bp, H. sapiens
tcttctgccatgagta

SEQ ID NO: 141414 - DNA, 16 bp, H. sapiens
tcttctgcctcaccct

SEQ ID NO: 141415 - DNA, 16 bp, H. sapiens
tcttctgcctcagcca

SEQ ID NO: 141416 - DNA, 16 bp, H. sapiens
tcttctgcctcagctc

SEQ ID NO: 141417 - DNA, 16 bp, H. sapiens
tcttctgcctctgcct

SEQ ID NO: 141418 - DNA, 16 bp, H. sapiens
tcttctgcctgccttt

SEQ ID NO: 141419 - DNA, 16 bp, H. sapiens
tcttctgcctgggctc

SEQ ID NO: 141420 - DNA, 16 bp, H. sapiens
tcttctgcctgtctgt

SEQ ID NO: 141421 - DNA, 16 bp, H. sapiens
tcttctgcgtcgctca

SEQ ID NO: 141422 - DNA, 16 bp, H. sapiens
tcttctgctaggtttg

SEQ ID NO: 141423 - DNA, 16 bp, H. sapiens
tcttctgctccatgtg

SEQ ID NO: 141424 - DNA, 16 bp, H. sapiens
tcttctgcttcatcta

SEQ ID NO: 141425 - DNA, 16 bp, H. sapiens
tcttctggaatacctt

SEQ ID NO: 141426 - DNA, 16 bp, H. sapiens
tcttctggaattttta

SEQ ID NO: 141427 - DNA, 16 bp, H. sapiens
tcttctggagcctcag

SEQ ID NO: 141428 - DNA, 17 bp, H. sapiens
tcttctggatctagcca

SEQ ID NO: 141429 - DNA, 16 bp, H. sapiens
tcttctggcttccctg

SEQ ID NO: 141430 - DNA, 16 bp, H. sapiens
tcttctggggaggcct

SEQ ID NO: 141431 - DNA, 16 bp, H. sapiens
tcttctgtccattttt

SEQ ID NO: 141432 - DNA, 16 bp, H. sapiens
tcttctgtgcctcagt

SEQ ID NO: 141433 - DNA, 16 bp, H. sapiens
tcttctgtgttttcta

SEQ ID NO: 141434 - DNA, 16 bp, H. sapiens
tcttctgttcctgggt

SEQ ID NO: 141435 - DNA, 16 bp, H. sapiens
tcttctgttgatggac

SEQ ID NO: 141436 - DNA, 16 bp, H. sapiens
tcttctgtttgaaatg

SEQ ID NO: 141437 - DNA, 16 bp, H. sapiens
tcttctgttttccatt

SEQ ID NO: 141438 - DNA, 16 bp, H. sapiens
tcttcttaaaatgttt

SEQ ID NO: 141439 - DNA, 16 bp, H. sapiens
tcttcttataaagaca

SEQ ID NO: 141440 - DNA, 16 bp, H. sapiens
tcttcttattgatttc

SEQ ID NO: 141441 - DNA, 16 bp, H. sapiens
tcttcttcaaattctt

SEQ ID NO: 141442 - DNA, 16 bp, H. sapiens
tcttcttcagcttcct

SEQ ID NO: 141443 - DNA, 16 bp, H. sapiens
tcttcttcagtaaaat

SEQ ID NO: 141444 - DNA, 16 bp, H. sapiens
tcttcttcagtgaaat

SEQ ID NO: 141445 - DNA, 16 bp, H. sapiens
tcttcttcatttctga

SEQ ID NO: 141446 - DNA, 16 bp, H. sapiens
tcttcttccagtgtgg

SEQ ID NO: 141447 - DNA, 16 bp, H. sapiens
tcttcttcctctgtgg

SEQ ID NO: 141448 - DNA, 16 bp, H. sapiens
tcttcttccttaggaa

SEQ ID NO: 141449 - DNA, 16 bp, H. sapiens
tcttcttctgagccct

SEQ ID NO: 141450 - DNA, 16 bp, H. sapiens
tcttcttctgctgctg

SEQ ID NO: 141451 - DNA, 16 bp, H. sapiens
tcttcttgcccaagct

SEQ ID NO: 141452 - DNA, 16 bp, H. sapiens
tcttcttgcctaattg

SEQ ID NO: 141453 - DNA, 16 bp, H. sapiens
tcttcttgcctcagcc

SEQ ID NO: 141454 - DNA, 16 bp, H. sapiens
tcttcttgctcaggct

SEQ ID NO: 141455 - DNA, 16 bp, H. sapiens
tcttcttgctcattaa

SEQ ID NO: 141456 - DNA, 16 bp, H. sapiens
tcttcttgctggtggg

SEQ ID NO: 141457 - DNA, 16 bp, H. sapiens
tcttcttggtattgat

SEQ ID NO: 141458 - DNA, 16 bp, H. sapiens
tcttcttgtaaattta

SEQ ID NO: 141459 - DNA, 16 bp, H. sapiens
tcttcttgtccaggct

SEQ ID NO: 141460 - DNA, 16 bp, H. sapiens
tcttcttgtgagccct

SEQ ID NO: 141461 - DNA, 16 bp, H. sapiens
tcttcttgtggagtat

SEQ ID NO: 141462 - DNA, 16 bp, H. sapiens
tcttcttgttaaattg

SEQ ID NO: 141463 - DNA, 16 bp, H. sapiens
tcttctttaaaaaaaa

SEQ ID NO: 141464 - DNA, 16 bp, H. sapiens
tcttctttaccaattt

SEQ ID NO: 141465 - DNA, 16 bp, H. sapiens
tcttctttagaagaag

SEQ ID NO: 141466 - DNA, 16 bp, H. sapiens
tcttctttcacttgaa

SEQ ID NO: 141467 - DNA, 16 bp, H. sapiens
tcttctttcagtttct

SEQ ID NO: 141468 - DNA, 16 bp, H. sapiens
tcttctttctcagcct

SEQ ID NO: 141469 - DNA, 16 bp, H. sapiens
tcttctttctctaaat

SEQ ID NO: 141470 - DNA, 16 bp, H. sapiens
tcttctttgacccatg

SEQ ID NO: 141471 - DNA, 16 bp, H. sapiens
tcttctttgagttaaa

SEQ ID NO: 141472 - DNA, 16 bp, H. sapiens
tcttctttgcctttgg

SEQ ID NO: 141473 - DNA, 16 bp, H. sapiens
tcttctttgtgtccat

SEQ ID NO: 141474 - DNA, 16 bp, H. sapiens
tcttcttttaaaaaaa

SEQ ID NO: 141475 - DNA, 16 bp, H. sapiens
tcttcttttcctgact

SEQ ID NO: 141476 - DNA, 16 bp, H. sapiens
tcttcttttggaaaat

SEQ ID NO: 141477 - DNA, 16 bp, H. sapiens
tcttcttttgggaaat

SEQ ID NO: 141478 - DNA, 16 bp, H. sapiens
tcttcttttgtaaagt

SEQ ID NO: 141479 - DNA, 16 bp, H. sapiens
tcttcttttgtgaagt

SEQ ID NO: 141480 - DNA, 16 bp, H. sapiens
tcttgaaaaaataaat

SEQ ID NO: 141481 - DNA, 16 bp, H. sapiens
tcttgaaaaagaagaa

SEQ ID NO: 141482 - DNA, 16 bp, H. sapiens
tcttgaaaataaatgt

SEQ ID NO: 141483 - DNA, 16 bp, H. sapiens
tcttgaaaatgaagaa

SEQ ID NO: 141484 - DNA, 16 bp, H. sapiens
tcttgaaagaaaatat

SEQ ID NO: 141485 - DNA, 16 bp, H. sapiens
tcttgaaagaaattaa

SEQ ID NO: 141486 - DNA, 16 bp, H. sapiens
tcttgaaagacatttt

SEQ ID NO: 141487 - DNA, 16 bp, H. sapiens
tcttgaaagatatttt

SEQ ID NO: 141488 - DNA, 16 bp, H. sapiens
tcttgaaatatataat

SEQ ID NO: 141489 - DNA, 16 bp, H. sapiens
tcttgaaatattttct

SEQ ID NO: 141490 - DNA, 16 bp, H. sapiens
tcttgaaatcctgact

SEQ ID NO: 141491 - DNA, 16 bp, H. sapiens
tcttgaaattcttttt

SEQ ID NO: 141492 - DNA, 16 bp, H. sapiens
tcttgaaatttgtttt

SEQ ID NO: 141493 - DNA, 16 bp, H. sapiens
tcttgaacaaagaatt

SEQ ID NO: 141494 - DNA, 16 bp, H. sapiens
tcttgaacctaggagg

SEQ ID NO: 141495 - DNA, 16 bp, H. sapiens
tcttgaacctgggaga

SEQ ID NO: 141496 - DNA, 16 bp, H. sapiens
tcttgaactcctcctg

SEQ ID NO: 141497 - DNA, 17 bp, H. sapiens
tcttgaactcctggact

SEQ ID NO: 141498 - DNA, 16 bp, H. sapiens
tcttgaacttctaacc

SEQ ID NO: 141499 - DNA, 16 bp, H. sapiens
tcttgaagaagaaaaa

SEQ ID NO: 141500 - DNA, 16 bp, H. sapiens
tcttgaagtaaataaa

SEQ ID NO: 141501 - DNA, 16 bp, H. sapiens
tcttgaagtcctgacc

SEQ ID NO: 141502 - DNA, 16 bp, H. sapiens
tcttgaatgctttact

SEQ ID NO: 141503 - DNA, 16 bp, H. sapiens
tcttgaattcctatgt

SEQ ID NO: 141504 - DNA, 16 bp, H. sapiens
tcttgaattcctgggc

SEQ ID NO: 141505 - DNA, 16 bp, H. sapiens
tcttgaattctttgct

SEQ ID NO: 141506 - DNA, 16 bp, H. sapiens
tcttgaattgtaactc

SEQ ID NO: 141507 - DNA, 16 bp, H. sapiens
tcttgaatttctccaa

SEQ ID NO: 141508 - DNA, 16 bp, H. sapiens
tcttgaatttctttca

SEQ ID NO: 141509 - DNA, 16 bp, H. sapiens
tcttgaatttgaatat

SEQ ID NO: 141510 - DNA, 16 bp, H. sapiens
tcttgacattttaaaa

SEQ ID NO: 141511 - DNA, 16 bp, H. sapiens
tcttgacctcccaggc

SEQ ID NO: 141512 - DNA, 16 bp, H. sapiens
tcttgactactgtagc

SEQ ID NO: 141513 - DNA, 16 bp, H. sapiens
tcttgactcactgcaa

SEQ ID NO: 141514 - DNA, 16 bp, H. sapiens
tcttgagaaagaagaa

SEQ ID NO: 141515 - DNA, 16 bp, H. sapiens
tcttgagacagggtct

SEQ ID NO: 141516 - DNA, 16 bp, H. sapiens
tcttgagactgagtct

SEQ ID NO: 141517 - DNA, 16 bp, H. sapiens
tcttgagatttctttt

SEQ ID NO: 141518 - DNA, 16 bp, H. sapiens
tcttgagccacttgct

SEQ ID NO: 141519 - DNA, 16 bp, H. sapiens
tcttgagcccaggaga

SEQ ID NO: 141520 - DNA, 16 bp, H. sapiens
tcttgagcctgctggc

SEQ ID NO: 141521 - DNA, 16 bp, H. sapiens
tcttgagctcaggagt

SEQ ID NO: 141522 - DNA, 16 bp, H. sapiens
tcttgagtaactggga

SEQ ID NO: 141523 - DNA, 16 bp, H. sapiens
tcttgagtagttggga

SEQ ID NO: 141524 - DNA, 16 bp, H. sapiens
tcttgagtatctggga

SEQ ID NO: 141525 - DNA, 16 bp, H. sapiens
tcttgagttcattttt

SEQ ID NO: 141526 - DNA, 16 bp, H. sapiens
tcttgatatttaaaaa

SEQ ID NO: 141527 - DNA, 16 bp, H. sapiens
tcttgatcccacttgt

SEQ ID NO: 141528 - DNA, 16 bp, H. sapiens
tcttgatcctctccct

SEQ ID NO: 141529 - DNA, 17 bp, H. sapiens
tcttgatctcctgacct

SEQ ID NO: 141530 - DNA, 16 bp, H. sapiens
tcttgatctgctgacc

SEQ ID NO: 141531 - DNA, 16 bp, H. sapiens
tcttgattatataaaa

SEQ ID NO: 141532 - DNA, 16 bp, H. sapiens
tcttgattcagtcttg

SEQ ID NO: 141533 - DNA, 16 bp, H. sapiens
tcttgatttcttttca

SEQ ID NO: 141534 - DNA, 16 bp, H. sapiens
tcttgattttggtgat

SEQ ID NO: 141535 - DNA, 16 bp, H. sapiens
tcttgatttttaaaaa

SEQ ID NO: 141536 - DNA, 16 bp, H. sapiens
tcttgatttttgcctt

SEQ ID NO: 141537 - DNA, 16 bp, H. sapiens
tcttgcaaaaatgaaa

SEQ ID NO: 141538 - DNA, 16 bp, H. sapiens
tcttgcaaaactgaaa

SEQ ID NO: 141539 - DNA, 16 bp, H. sapiens
tcttgcactgtcaccc

SEQ ID NO: 141540 - DNA, 16 bp, H. sapiens
tcttgcatttttagta

SEQ ID NO: 141541 - DNA, 16 bp, H. sapiens
tcttgccaaaaatatt

SEQ ID NO: 141542 - DNA, 16 bp, H. sapiens
tcttgcccaaattcct

SEQ ID NO: 141543 - DNA, 16 bp, H. sapiens
tcttgcccaaggcctg

SEQ ID NO: 141544 - DNA, 16 bp, H. sapiens
tcttgcccagactgga

SEQ ID NO: 141545 - DNA, 16 bp, H. sapiens
tcttgccctgcctcca

SEQ ID NO: 141546 - DNA, 16 bp, H. sapiens
tcttgccctgtcgcca

SEQ ID NO: 141547 - DNA, 16 bp, H. sapiens
tcttgcctagaactgg

SEQ ID NO: 141548 - DNA, 16 bp, H. sapiens
tcttgcctcagtgttg

SEQ ID NO: 141549 - DNA, 16 bp, H. sapiens
tcttgcctcccagggg

SEQ ID NO: 141550 - DNA, 16 bp, H. sapiens
tcttgcctctctagct

SEQ ID NO: 141551 - DNA, 16 bp, H. sapiens
tcttgcctggactact

SEQ ID NO: 141552 - DNA, 16 bp, H. sapiens
tcttgcctgggctgga

SEQ ID NO: 141553 - DNA, 16 bp, H. sapiens
tcttgcctggggtcca

SEQ ID NO: 141554 - DNA, 16 bp, H. sapiens
tcttgccttagcctcc

SEQ ID NO: 141555 - DNA, 16 bp, H. sapiens
tcttgccttcttttga

SEQ ID NO: 141556 - DNA, 16 bp, H. sapiens
tcttgcctttcatttt

SEQ ID NO: 141557 - DNA, 18 bp, H. sapiens
tcttgcgctgttgcccag

SEQ ID NO: 141558 - DNA, 16 bp, H. sapiens
tcttgctaaaactgga

SEQ ID NO: 141559 - DNA, 16 bp, H. sapiens
tcttgctaatggccta

SEQ ID NO: 141560 - DNA, 16 bp, H. sapiens
tcttgctacattgcct

SEQ ID NO: 141561 - DNA, 16 bp, H. sapiens
tcttgctatattgccc

SEQ ID NO: 141562 - DNA, 16 bp, H. sapiens
tcttgctattgaattg

SEQ ID NO: 141563 - DNA, 16 bp, H. sapiens
tcttgctcccactctc

SEQ ID NO: 141564 - DNA, 16 bp, H. sapiens
tcttgctcctgctttc

SEQ ID NO: 141565 - DNA, 16 bp, H. sapiens
tcttgctcctgttctc

SEQ ID NO: 141566 - DNA, 16 bp, H. sapiens
tcttgctcctgttgcc

SEQ ID NO: 141567 - DNA, 19 bp, H. sapiens
tcttgctctgacgcccagg

SEQ ID NO: 141568 - DNA, 18 bp, H. sapiens
tcttgctctgtcatccag

SEQ ID NO: 141569 - DNA, 16 bp, H. sapiens
tcttgctctgtcttcc

SEQ ID NO: 141570 - DNA, 18 bp, H. sapiens
tcttgctctgttgcccag

SEQ ID NO: 141571 - DNA, 16 bp, H. sapiens
tcttgctgatttattt

SEQ ID NO: 141572 - DNA, 16 bp, H. sapiens
tcttgctgcactttat

SEQ ID NO: 141573 - DNA, 16 bp, H. sapiens
tcttgctgctgccatg

SEQ ID NO: 141574 - DNA, 16 bp, H. sapiens
tcttgctgctgctcag

SEQ ID NO: 141575 - DNA, 16 bp, H. sapiens
tcttgctgctgctgct

SEQ ID NO: 141576 - DNA, 16 bp, H. sapiens
tcttgctgctgcttct

SEQ ID NO: 141577 - DNA, 16 bp, H. sapiens
tcttgctgctttcagt

SEQ ID NO: 141578 - DNA, 16 bp, H. sapiens
tcttgctgggttgggg

SEQ ID NO: 141579 - DNA, 16 bp, H. sapiens
tcttgctgtatcctca

SEQ ID NO: 141580 - DNA, 16 bp, H. sapiens
tcttgctgtgttacct

SEQ ID NO: 141581 - DNA, 16 bp, H. sapiens
tcttgctgtgttttca

SEQ ID NO: 141582 - DNA, 16 bp, H. sapiens
tcttgcttaactgaaa

SEQ ID NO: 141583 - DNA, 16 bp, H. sapiens
tcttgcttatttcact

SEQ ID NO: 141584 - DNA, 16 bp, H. sapiens
tcttgcttctctagct

SEQ ID NO: 141585 - DNA, 16 bp, H. sapiens
tcttgcttctttcatt

SEQ ID NO: 141586 - DNA, 16 bp, H. sapiens
tcttgcttgctgccat

SEQ ID NO: 141587 - DNA, 16 bp, H. sapiens
tcttgctttttaaaaa

SEQ ID NO: 141588 - DNA, 16 bp, H. sapiens
tcttggaaaaacaaaa

SEQ ID NO: 141589 - DNA, 16 bp, H. sapiens
tcttggaaaatatttt

SEQ ID NO: 141590 - DNA, 16 bp, H. sapiens
tcttggaaactttgtc

SEQ ID NO: 141591 - DNA, 16 bp, H. sapiens
tcttggaacatatccc

SEQ ID NO: 141592 - DNA, 16 bp, H. sapiens
tcttggaacatattcc

SEQ ID NO: 141593 - DNA, 16 bp, H. sapiens
tcttggacttccagac

SEQ ID NO: 141594 - DNA, 16 bp, H. sapiens
tcttggagaaagaaaa

SEQ ID NO: 141595 - DNA, 16 bp, H. sapiens
tcttggagaaattcaa

SEQ ID NO: 141596 - DNA, 16 bp, H. sapiens
tcttggaggaaattaa

SEQ ID NO: 141597 - DNA, 16 bp, H. sapiens
tcttggaggctgtgtt

SEQ ID NO: 141598 - DNA, 16 bp, H. sapiens
tcttggaggttttgct

SEQ ID NO: 141599 - DNA, 16 bp, H. sapiens
tcttggagtcatcctt

SEQ ID NO: 141600 - DNA, 16 bp, H. sapiens
tcttggagttgctttt

SEQ ID NO: 141601 - DNA, 16 bp, H. sapiens
tcttggatatttcttc

SEQ ID NO: 141602 - DNA, 16 bp, H. sapiens
tcttggatcatccctg

SEQ ID NO: 141603 - DNA, 16 bp, H. sapiens
tcttggcagaaggtga

SEQ ID NO: 141604 - DNA, 16 bp, H. sapiens
tcttggcatctgcttc

SEQ ID NO: 141605 - DNA, 16 bp, H. sapiens
tcttggccaacatgat

SEQ ID NO: 141606 - DNA, 16 bp, H. sapiens
tcttggccaaggggat

SEQ ID NO: 141607 - DNA, 16 bp, H. sapiens
tcttggccacatgtat

SEQ ID NO: 141608 - DNA, 16 bp, H. sapiens
tcttggccaggctgat

SEQ ID NO: 141609 - DNA, 16 bp, H. sapiens
tcttggcccaaaagct

SEQ ID NO: 141610 - DNA, 16 bp, H. sapiens
tcttggccctgccact

SEQ ID NO: 141611 - DNA, 16 bp, H. sapiens
tcttggcctcagtttt

SEQ ID NO: 141612 - DNA, 16 bp, H. sapiens
tcttggcctcccaaac

SEQ ID NO: 141613 - DNA, 17 bp, H. sapiens
tcttggcctcccaaagc

SEQ ID NO: 141614 - DNA, 16 bp, H. sapiens
tcttggcctcccatag

SEQ ID NO: 141615 - DNA, 16 bp, H. sapiens
tcttggcctctctgag

SEQ ID NO: 141616 - DNA, 16 bp, H. sapiens
tcttggctcactgcag

SEQ ID NO: 141617 - DNA, 16 bp, H. sapiens
tcttggctcactgtat

SEQ ID NO: 141618 - DNA, 16 bp, H. sapiens
tcttggctctctgcaa

SEQ ID NO: 141619 - DNA, 16 bp, H. sapiens
tcttggctgttgtgaa

SEQ ID NO: 141620 - DNA, 16 bp, H. sapiens
tcttggcttgcctgtt

SEQ ID NO: 141621 - DNA, 16 bp, H. sapiens
tcttggcttttgtgaa

SEQ ID NO: 141622 - DNA, 16 bp, H. sapiens
tcttgggaattaacat

SEQ ID NO: 141623 - DNA, 16 bp, H. sapiens
tcttgggagagtatat

SEQ ID NO: 141624 - DNA, 16 bp, H. sapiens
tcttgggaggttgtat

SEQ ID NO: 141625 - DNA, 16 bp, H. sapiens
tcttgggatttcatcc

SEQ ID NO: 141626 - DNA, 16 bp, H. sapiens
tcttgggcaggctggt

SEQ ID NO: 141627 - DNA, 16 bp, H. sapiens
tcttgggcatttcttt

SEQ ID NO: 141628 - DNA, 16 bp, H. sapiens
tcttgggggaaaaaaa

SEQ ID NO: 141629 - DNA, 16 bp, H. sapiens
tcttgggggaagaaaa

SEQ ID NO: 141630 - DNA, 16 bp, H. sapiens
tcttggggggaaaaaa

SEQ ID NO: 141631 - DNA, 16 bp, H. sapiens
tcttggggtttttata

SEQ ID NO: 141632 - DNA, 16 bp, H. sapiens
tcttgggtatgtacct

SEQ ID NO: 141633 - DNA, 16 bp, H. sapiens
tcttggtctccctgac

SEQ ID NO: 141634 - DNA, 16 bp, H. sapiens
tcttggtgcctcagtt

SEQ ID NO: 141635 - DNA, 16 bp, H. sapiens
tcttggttctgccact

SEQ ID NO: 141636 - DNA, 16 bp, H. sapiens
tcttgtaaatgtgttt

SEQ ID NO: 141637 - DNA, 16 bp, H. sapiens
tcttgtaaattcattt

SEQ ID NO: 141638 - DNA, 16 bp, H. sapiens
tcttgtaaatttcttt

SEQ ID NO: 141639 - DNA, 16 bp, H. sapiens
tcttgtacatttattt

SEQ ID NO: 141640 - DNA, 16 bp, H. sapiens
tcttgtagaatttttt

SEQ ID NO: 141641 - DNA, 16 bp, H. sapiens
tcttgtagagacagag

SEQ ID NO: 141642 - DNA, 16 bp, H. sapiens
tcttgtaggatggaaa

SEQ ID NO: 141643 - DNA, 16 bp, H. sapiens
tcttgtatcctgtgac

SEQ ID NO: 141644 - DNA, 16 bp, H. sapiens
tcttgtatttttaaaa

SEQ ID NO: 141645 - DNA, 16 bp, H. sapiens
tcttgtcacacaacca

SEQ ID NO: 141646 - DNA, 16 bp, H. sapiens
tcttgtcctttgtagg

SEQ ID NO: 141647 - DNA, 16 bp, H. sapiens
tcttgtctaactgaaa

SEQ ID NO: 141648 - DNA, 16 bp, H. sapiens
tcttgtctcagcctcc

SEQ ID NO: 141649 - DNA, 16 bp, H. sapiens
tcttgtctcagtctcc

SEQ ID NO: 141650 - DNA, 16 bp, H. sapiens
tcttgtcttctgctgg

SEQ ID NO: 141651 - DNA, 16 bp, H. sapiens
tcttgtgaaagttatg

SEQ ID NO: 141652 - DNA, 16 bp, H. sapiens
tcttgtgaagtatttt

SEQ ID NO: 141653 - DNA, 16 bp, H. sapiens
tcttgtgatttttaaa

SEQ ID NO: 141654 - DNA, 16 bp, H. sapiens
tcttgtgcccaggctg

SEQ ID NO: 141655 - DNA, 16 bp, H. sapiens
tcttgtgctgcttttc

SEQ ID NO: 141656 - DNA, 16 bp, H. sapiens
tcttgtggaagtgaaa

SEQ ID NO: 141657 - DNA, 16 bp, H. sapiens
tcttgtgggaactaat

SEQ ID NO: 141658 - DNA, 17 bp, H. sapiens
tcttgtgggcattcagt

SEQ ID NO: 141659 - DNA, 16 bp, H. sapiens
tcttgtgttgctgtaa

SEQ ID NO: 141660 - DNA, 16 bp, H. sapiens
tcttgttaaaatgtag

SEQ ID NO: 141661 - DNA, 16 bp, H. sapiens
tcttgttacttattat

SEQ ID NO: 141662 - DNA, 16 bp, H. sapiens
tcttgttcactgctgt

SEQ ID NO: 141663 - DNA, 16 bp, H. sapiens
tcttgttccaattctc

SEQ ID NO: 141664 - DNA, 16 bp, H. sapiens
tcttgttccatttctt

SEQ ID NO: 141665 - DNA, 16 bp, H. sapiens
tcttgttccccaggct

SEQ ID NO: 141666 - DNA, 16 bp, H. sapiens
tcttgttgcccagcct

SEQ ID NO: 141667 - DNA, 22 bp, H. sapiens
tcttgttgcccaggctggagta

SEQ ID NO: 141668 - DNA, 16 bp, H. sapiens
tcttgtttaaaaaaat

SEQ ID NO: 141669 - DNA, 16 bp, H. sapiens
tcttgtttaattgatc

SEQ ID NO: 141670 - DNA, 16 bp, H. sapiens
tcttgtttcagctctt

SEQ ID NO: 141671 - DNA, 16 bp, H. sapiens
tcttgtttcttctgag

SEQ ID NO: 141672 - DNA, 16 bp, H. sapiens
tcttgtttctttgcat

SEQ ID NO: 141673 - DNA, 16 bp, H. sapiens
tcttgtttgcttccaa

SEQ ID NO: 141674 - DNA, 16 bp, H. sapiens
tcttgttttgcttgat

SEQ ID NO: 141675 - DNA, 16 bp, H. sapiens
tcttgtttttattaaa

SEQ ID NO: 141676 - DNA, 16 bp, H. sapiens
tcttgtttttcctgga

SEQ ID NO: 141677 - DNA, 16 bp, H. sapiens
tctttaaaaaaaaatg

SEQ ID NO: 141678 - DNA, 16 bp, H. sapiens
tctttaaaaacattat

SEQ ID NO: 141679 - DNA, 16 bp, H. sapiens
tctttaaaaagtcaaa

SEQ ID NO: 141680 - DNA, 16 bp, H. sapiens
tctttaaaaagtgatt

SEQ ID NO: 141681 - DNA, 16 bp, H. sapiens
tctttaaaaagtttct

SEQ ID NO: 141682 - DNA, 16 bp, H. sapiens
tctttaaaaataactt

SEQ ID NO: 141683 - DNA, 16 bp, H. sapiens
tctttaaaaatgtgaa

SEQ ID NO: 141684 - DNA, 16 bp, H. sapiens
tctttaaaactggatt

SEQ ID NO: 141685 - DNA, 16 bp, H. sapiens
tctttaaaagaaaatt

SEQ ID NO: 141686 - DNA, 16 bp, H. sapiens
tctttaaaagcagaga

SEQ ID NO: 141687 - DNA, 16 bp, H. sapiens
tctttaaaataagaaa

SEQ ID NO: 141688 - DNA, 16 bp, H. sapiens
tctttaaaatgaagat

SEQ ID NO: 141689 - DNA, 16 bp, H. sapiens
tctttaaaatgtataa

SEQ ID NO: 141690 - DNA, 16 bp, H. sapiens
tctttaaaatgtcatt

SEQ ID NO: 141691 - DNA, 16 bp, H. sapiens
tctttaaacattcttt

SEQ ID NO: 141692 - DNA, 16 bp, H. sapiens
tctttaaagagaaatt

SEQ ID NO: 141693 - DNA, 16 bp, H. sapiens
tctttaaagagaagaa

SEQ ID NO: 141694 - DNA, 16 bp, H. sapiens
tctttaaagcaaaatt

SEQ ID NO: 141695 - DNA, 16 bp, H. sapiens
tctttaaaggaaaaca

SEQ ID NO: 141696 - DNA, 16 bp, H. sapiens
tctttaaaggagaaaa

SEQ ID NO: 141697 - DNA, 16 bp, H. sapiens
tctttaaatacagtca

SEQ ID NO: 141698 - DNA, 16 bp, H. sapiens
tctttaaatatgcttt

SEQ ID NO: 141699 - DNA, 16 bp, H. sapiens
tctttaactttttaag

SEQ ID NO: 141700 - DNA, 16 bp, H. sapiens
tctttaagaaaaacaa

SEQ ID NO: 141701 - DNA, 16 bp, H. sapiens
tctttaagaaaaataa

SEQ ID NO: 141702 - DNA, 16 bp, H. sapiens
tctttaagaaaatatt

SEQ ID NO: 141703 - DNA, 16 bp, H. sapiens
tctttaagaaagagaa

SEQ ID NO: 141704 - DNA, 16 bp, H. sapiens
tctttaagaaataaaa

SEQ ID NO: 141705 - DNA, 16 bp, H. sapiens
tctttaagaaatgaaa

SEQ ID NO: 141706 - DNA, 16 bp, H. sapiens
tctttaagctgataag

SEQ ID NO: 141707 - DNA, 16 bp, H. sapiens
tctttaaggaaaaaaa

SEQ ID NO: 141708 - DNA, 17 bp, H. sapiens
tctttaatccatcttga

SEQ ID NO: 141709 - DNA, 16 bp, H. sapiens
tctttaatgcattttg

SEQ ID NO: 141710 - DNA, 16 bp, H. sapiens
tctttaatttctgtca

SEQ ID NO: 141711 - DNA, 16 bp, H. sapiens
tctttacaaaaaaaca

SEQ ID NO: 141712 - DNA, 16 bp, H. sapiens
tctttacagaaaatgt

SEQ ID NO: 141713 - DNA, 16 bp, H. sapiens
tctttacctctctgag

SEQ ID NO: 141714 - DNA, 16 bp, H. sapiens
tctttactaaaaatac

SEQ ID NO: 141715 - DNA, 16 bp, H. sapiens
tctttactcaaaatac

SEQ ID NO: 141716 - DNA, 16 bp, H. sapiens
tctttactcattcatc

SEQ ID NO: 141717 - DNA, 16 bp, H. sapiens
tctttactgatatttt

SEQ ID NO: 141718 - DNA, 16 bp, H. sapiens
tctttagatttttcta

SEQ ID NO: 141719 - DNA, 16 bp, H. sapiens
tctttaggaaaaaaaa

SEQ ID NO: 141720 - DNA, 16 bp, H. sapiens
tctttagtctggtggc

SEQ ID NO: 141721 - DNA, 16 bp, H. sapiens
tctttagtttaattaa

SEQ ID NO: 141722 - DNA, 16 bp, H. sapiens
tctttagttttttcca

SEQ ID NO: 141723 - DNA, 16 bp, H. sapiens
tctttataaaatgaag

SEQ ID NO: 141724 - DNA, 16 bp, H. sapiens
tctttatagatgaaat

SEQ ID NO: 141725 - DNA, 16 bp, H. sapiens
tctttatatattctgg

SEQ ID NO: 141726 - DNA, 16 bp, H. sapiens
tctttatattttctga

SEQ ID NO: 141727 - DNA, 16 bp, H. sapiens
tctttatcagcatcat

SEQ ID NO: 141728 - DNA, 16 bp, H. sapiens
tctttatcattctgaa

SEQ ID NO: 141729 - DNA, 16 bp, H. sapiens
tctttatccagcccac

SEQ ID NO: 141730 - DNA, 16 bp, H. sapiens
tctttatccttgattt

SEQ ID NO: 141731 - DNA, 16 bp, H. sapiens
tctttatctctgtctt

SEQ ID NO: 141732 - DNA, 16 bp, H. sapiens
tctttatctttctgtg

SEQ ID NO: 141733 - DNA, 16 bp, H. sapiens
tctttatctttgacct

SEQ ID NO: 141734 - DNA, 16 bp, H. sapiens
tctttatgaccttgga

SEQ ID NO: 141735 - DNA, 16 bp, H. sapiens
tctttatgtccataag

SEQ ID NO: 141736 - DNA, 16 bp, H. sapiens
tctttatgtgaaaaat

SEQ ID NO: 141737 - DNA, 16 bp, H. sapiens
tctttatgtgtgtgtg

SEQ ID NO: 141738 - DNA, 16 bp, H. sapiens
tctttatgtttaaaat

SEQ ID NO: 141739 - DNA, 16 bp, H. sapiens
tctttattccattttg

SEQ ID NO: 141740 - DNA, 16 bp, H. sapiens
tctttattcctgcctt

SEQ ID NO: 141741 - DNA, 16 bp, H. sapiens
tctttatttcattaag

SEQ ID NO: 141742 - DNA, 16 bp, H. sapiens
tctttatttgtaaaat

SEQ ID NO: 141743 - DNA, 16 bp, H. sapiens
tctttattttgaatat

SEQ ID NO: 141744 - DNA, 16 bp, H. sapiens
tctttatttttgaagg

SEQ ID NO: 141745 - DNA, 16 bp, H. sapiens
tctttattttttgaaa

SEQ ID NO: 141746 - DNA, 16 bp, H. sapiens
tctttcaaaacaactt

SEQ ID NO: 141747 - DNA, 16 bp, H. sapiens
tctttcaaaatgaaaa

SEQ ID NO: 141748 - DNA, 16 bp, H. sapiens
tctttcaaaattgaaa

SEQ ID NO: 141749 - DNA, 16 bp, H. sapiens
tctttcaaacaaaaat

SEQ ID NO: 141750 - DNA, 16 bp, H. sapiens
tctttcaaagagcaga

SEQ ID NO: 141751 - DNA, 16 bp, H. sapiens
tctttcaacaaatggt

SEQ ID NO: 141752 - DNA, 16 bp, H. sapiens
tctttcaactcctttg

SEQ ID NO: 141753 - DNA, 16 bp, H. sapiens
tctttcaccaggctgg

SEQ ID NO: 141754 - DNA, 16 bp, H. sapiens
tctttcaccattaaat

SEQ ID NO: 141755 - DNA, 16 bp, H. sapiens
tctttcacccactttt

SEQ ID NO: 141756 - DNA, 16 bp, H. sapiens
tctttcacctcctggg

SEQ ID NO: 141757 - DNA, 16 bp, H. sapiens
tctttcagaaaataaa

SEQ ID NO: 141758 - DNA, 16 bp, H. sapiens
tctttcagaattttta

SEQ ID NO: 141759 - DNA, 16 bp, H. sapiens
tctttcagagatgctc

SEQ ID NO: 141760 - DNA, 16 bp, H. sapiens
tctttcagcagaaact

SEQ ID NO: 141761 - DNA, 16 bp, H. sapiens
tctttcagcagaggca

SEQ ID NO: 141762 - DNA, 16 bp, H. sapiens
tctttcagcagtttgg

SEQ ID NO: 141763 - DNA, 16 bp, H. sapiens
tctttcagtactttga

SEQ ID NO: 141764 - DNA, 16 bp, H. sapiens
tctttcagtgctttga

SEQ ID NO: 141765 - DNA, 16 bp, H. sapiens
tctttcatcactttgt

SEQ ID NO: 141766 - DNA, 16 bp, H. sapiens
tctttcatcagaattt

SEQ ID NO: 141767 - DNA, 16 bp, H. sapiens
tctttcatgacactga

SEQ ID NO: 141768 - DNA, 16 bp, H. sapiens
tctttcatgatggtga

SEQ ID NO: 141769 - DNA, 16 bp, H. sapiens
tctttcatgctttctc

SEQ ID NO: 141770 - DNA, 16 bp, H. sapiens
tctttcattaaaaaaa

SEQ ID NO: 141771 - DNA, 16 bp, H. sapiens
tctttcattctttctg

SEQ ID NO: 141772 - DNA, 16 bp, H. sapiens
tctttcattgctttgt

SEQ ID NO: 141773 - DNA, 16 bp, H. sapiens
tctttcattgtggttg

SEQ ID NO: 141774 - DNA, 16 bp, H. sapiens
tctttccaaattattt

SEQ ID NO: 141775 - DNA, 16 bp, H. sapiens
tctttccaattctgtg

SEQ ID NO: 141776 - DNA, 16 bp, H. sapiens
tctttccaccatgtga

SEQ ID NO: 141777 - DNA, 16 bp, H. sapiens
tctttccacctcagct

SEQ ID NO: 141778 - DNA, 16 bp, H. sapiens
tctttccactgtacca

SEQ ID NO: 141779 - DNA, 16 bp, H. sapiens
tctttccagaaaaaaa

SEQ ID NO: 141780 - DNA, 16 bp, H. sapiens
tctttccagtcttcct

SEQ ID NO: 141781 - DNA, 16 bp, H. sapiens
tctttccatctttaaa

SEQ ID NO: 141782 - DNA, 16 bp, H. sapiens
tctttccattatacca

SEQ ID NO: 141783 - DNA, 16 bp, H. sapiens
tctttccattccttga

SEQ ID NO: 141784 - DNA, 16 bp, H. sapiens
tctttccatttttgtg

SEQ ID NO: 141785 - DNA, 16 bp, H. sapiens
tctttcccatctcagt

SEQ ID NO: 141786 - DNA, 16 bp, H. sapiens
tctttcccccactgaa

SEQ ID NO: 141787 - DNA, 16 bp, H. sapiens
tctttcccttctgcca

SEQ ID NO: 141788 - DNA, 16 bp, H. sapiens
tctttcctccaaggag

SEQ ID NO: 141789 - DNA, 16 bp, H. sapiens
tctttcctctataaat

SEQ ID NO: 141790 - DNA, 16 bp, H. sapiens
tctttcctctgtgtgt

SEQ ID NO: 141791 - DNA, 16 bp, H. sapiens
tctttccttgactttc

SEQ ID NO: 141792 - DNA, 16 bp, H. sapiens
tctttcctttttcaaa

SEQ ID NO: 141793 - DNA, 16 bp, H. sapiens
tctttctaaaatgtat

SEQ ID NO: 141794 - DNA, 16 bp, H. sapiens
tctttctaactgtatt

SEQ ID NO: 141795 - DNA, 17 bp, H. sapiens
tctttctacacagacat

SEQ ID NO: 141796 - DNA, 16 bp, H. sapiens
tctttctacatagaca

SEQ ID NO: 141797 - DNA, 16 bp, H. sapiens
tctttctacttctctg

SEQ ID NO: 141798 - DNA, 16 bp, H. sapiens
tctttctagatttttg

SEQ ID NO: 141799 - DNA, 16 bp, H. sapiens
tctttctccatcttca

SEQ ID NO: 141800 - DNA, 16 bp, H. sapiens
tctttctcccatgctg

SEQ ID NO: 141801 - DNA, 16 bp, H. sapiens
tctttctcccttgctg

SEQ ID NO: 141802 - DNA, 16 bp, H. sapiens
tctttctcctgccacc

SEQ ID NO: 141803 - DNA, 16 bp, H. sapiens
tctttctctagctttt

SEQ ID NO: 141804 - DNA, 16 bp, H. sapiens
tctttctctatggatt

SEQ ID NO: 141805 - DNA, 16 bp, H. sapiens
tctttctctctgactc

SEQ ID NO: 141806 - DNA, 16 bp, H. sapiens
tctttctctctgactt

SEQ ID NO: 141807 - DNA, 16 bp, H. sapiens
tctttctctgcagcct

SEQ ID NO: 141808 - DNA, 16 bp, H. sapiens
tctttctctgcctggc

SEQ ID NO: 141809 - DNA, 16 bp, H. sapiens
tctttctctggcctcc

SEQ ID NO: 141810 - DNA, 16 bp, H. sapiens
tctttctctgtctcac

SEQ ID NO: 141811 - DNA, 16 bp, H. sapiens
tctttctcttccctga

SEQ ID NO: 141812 - DNA, 16 bp, H. sapiens
tctttctgaaactatt

SEQ ID NO: 141813 - DNA, 16 bp, H. sapiens
tctttctgaaataaaa

SEQ ID NO: 141814 - DNA, 16 bp, H. sapiens
tctttctgagaaactg

SEQ ID NO: 141815 - DNA, 16 bp, H. sapiens
tctttctgatgctctc

SEQ ID NO: 141816 - DNA, 16 bp, H. sapiens
tctttctgcctgctgc

SEQ ID NO: 141817 - DNA, 16 bp, H. sapiens
tctttctgctctgcca

SEQ ID NO: 141818 - DNA, 16 bp, H. sapiens
tctttctggaagcttt

SEQ ID NO: 141819 - DNA, 16 bp, H. sapiens
tctttctgggctctct

SEQ ID NO: 141820 - DNA, 16 bp, H. sapiens
tctttctgtagagatg

SEQ ID NO: 141821 - DNA, 16 bp, H. sapiens
tctttctgtccatgtg

SEQ ID NO: 141822 - DNA, 16 bp, H. sapiens
tctttctgtctctgcc

SEQ ID NO: 141823 - DNA, 16 bp, H. sapiens
tctttctgtgcatggc

SEQ ID NO: 141824 - DNA, 16 bp, H. sapiens
tctttctgttactgat

SEQ ID NO: 141825 - DNA, 16 bp, H. sapiens
tctttctgtttctcag

SEQ ID NO: 141826 - DNA, 16 bp, H. sapiens
tctttctgttttgaga

SEQ ID NO: 141827 - DNA, 16 bp, H. sapiens
tctttcttcagctgtg

SEQ ID NO: 141828 - DNA, 16 bp, H. sapiens
tctttcttctgaagag

SEQ ID NO: 141829 - DNA, 16 bp, H. sapiens
tctttcttgcctgctg

SEQ ID NO: 141830 - DNA, 16 bp, H. sapiens
tctttctttaaagaaa

SEQ ID NO: 141831 - DNA, 16 bp, H. sapiens
tctttctttactgcaa

SEQ ID NO: 141832 - DNA, 16 bp, H. sapiens
tctttctttcattgat

SEQ ID NO: 141833 - DNA, 16 bp, H. sapiens
tctttctttcatttga

SEQ ID NO: 141834 - DNA, 16 bp, H. sapiens
tctttctttctgaaat

SEQ ID NO: 141835 - DNA, 16 bp, H. sapiens
tctttcttttgtaaat

SEQ ID NO: 141836 - DNA, 16 bp, H. sapiens
tctttgaaaaacctga

SEQ ID NO: 141837 - DNA, 16 bp, H. sapiens
tctttgaaaaataatt

SEQ ID NO: 141838 - DNA, 16 bp, H. sapiens
tctttgaaaaatatct

SEQ ID NO: 141839 - DNA, 16 bp, H. sapiens
tctttgaaaaatgaaa

SEQ ID NO: 141840 - DNA, 16 bp, H. sapiens
tctttgaaaacatcaa

SEQ ID NO: 141841 - DNA, 16 bp, H. sapiens
tctttgaaaagacaaa

SEQ ID NO: 141842 - DNA, 16 bp, H. sapiens
tctttgaaaagaccaa

SEQ ID NO: 141843 - DNA, 16 bp, H. sapiens
tctttgaaaataaaat

SEQ ID NO: 141844 - DNA, 16 bp, H. sapiens
tctttgaaaataaaga

SEQ ID NO: 141845 - DNA, 16 bp, H. sapiens
tctttgaaaatattta

SEQ ID NO: 141846 - DNA, 16 bp, H. sapiens
tctttgaaaccagtga

SEQ ID NO: 141847 - DNA, 16 bp, H. sapiens
tctttgaaactgatga

SEQ ID NO: 141848 - DNA, 16 bp, H. sapiens
tctttgaaatggggat

SEQ ID NO: 141849 - DNA, 16 bp, H. sapiens
tctttgaagaaaacat

SEQ ID NO: 141850 - DNA, 16 bp, H. sapiens
tctttgaagaaaattt

SEQ ID NO: 141851 - DNA, 16 bp, H. sapiens
tctttgaagaaatgct

SEQ ID NO: 141852 - DNA, 16 bp, H. sapiens
tctttgaagatgaaaa

SEQ ID NO: 141853 - DNA, 16 bp, H. sapiens
tctttgaataattttt

SEQ ID NO: 141854 - DNA, 16 bp, H. sapiens
tctttgaatgtttggt

SEQ ID NO: 141855 - DNA, 16 bp, H. sapiens
tctttgacaaagaaaa

SEQ ID NO: 141856 - DNA, 16 bp, H. sapiens
tctttgacaaagtaaa

SEQ ID NO: 141857 - DNA, 16 bp, H. sapiens
tctttgacaaggccaa

SEQ ID NO: 141858 - DNA, 16 bp, H. sapiens
tctttgacttttctct

SEQ ID NO: 141859 - DNA, 16 bp, H. sapiens
tctttgagaagatcaa

SEQ ID NO: 141860 - DNA, 16 bp, H. sapiens
tctttgagatactgat

SEQ ID NO: 141861 - DNA, 16 bp, H. sapiens
tctttgagcacttcct

SEQ ID NO: 141862 - DNA, 16 bp, H. sapiens
tctttgagcatcatgt

SEQ ID NO: 141863 - DNA, 16 bp, H. sapiens
tctttgagcttcagtt

SEQ ID NO: 141864 - DNA, 16 bp, H. sapiens
tctttgagggcaagga

SEQ ID NO: 141865 - DNA, 16 bp, H. sapiens
tctttgagggcaggga

SEQ ID NO: 141866 - DNA, 16 bp, H. sapiens
tctttgagtttatctt

SEQ ID NO: 141867 - DNA, 16 bp, H. sapiens
tctttgataaaacaga

SEQ ID NO: 141868 - DNA, 16 bp, H. sapiens
tctttgatccactttg

SEQ ID NO: 141869 - DNA, 16 bp, H. sapiens
tctttgatggtggtga

SEQ ID NO: 141870 - DNA, 16 bp, H. sapiens
tctttgatgtactgat

SEQ ID NO: 141871 - DNA, 16 bp, H. sapiens
tctttgatgttgctga

SEQ ID NO: 141872 - DNA, 16 bp, H. sapiens
tctttgattaaaaaaa

SEQ ID NO: 141873 - DNA, 16 bp, H. sapiens
tctttgattttctgca

SEQ ID NO: 141874 - DNA, 16 bp, H. sapiens
tctttgatttttaaaa

SEQ ID NO: 141875 - DNA, 16 bp, H. sapiens
tctttgcaataaatcc

SEQ ID NO: 141876 - DNA, 16 bp, H. sapiens
tctttgcaatttttct

SEQ ID NO: 141877 - DNA, 16 bp, H. sapiens
tctttgcagatgtagt

SEQ ID NO: 141878 - DNA, 16 bp, H. sapiens
tctttgcagattctgg

SEQ ID NO: 141879 - DNA, 16 bp, H. sapiens
tctttgccaaagcata

SEQ ID NO: 141880 - DNA, 16 bp, H. sapiens
tctttgccatttgtat

SEQ ID NO: 141881 - DNA, 16 bp, H. sapiens
tctttgcctaatccaa

SEQ ID NO: 141882 - DNA, 16 bp, H. sapiens
tctttgcctgctgtca

SEQ ID NO: 141883 - DNA, 16 bp, H. sapiens
tctttgctaattttct

SEQ ID NO: 141884 - DNA, 16 bp, H. sapiens
tctttgctattgtgag

SEQ ID NO: 141885 - DNA, 16 bp, H. sapiens
tctttgctattttgaa

SEQ ID NO: 141886 - DNA, 16 bp, H. sapiens
tctttgctcattcctg

SEQ ID NO: 141887 - DNA, 16 bp, H. sapiens
tctttgctctgcagaa

SEQ ID NO: 141888 - DNA, 16 bp, H. sapiens
tctttgctgctgccat

SEQ ID NO: 141889 - DNA, 16 bp, H. sapiens
tctttgctgttcttca

SEQ ID NO: 141890 - DNA, 16 bp, H. sapiens
tctttgctgttgtgaa

SEQ ID NO: 141891 - DNA, 16 bp, H. sapiens
tctttgcttccaagat

SEQ ID NO: 141892 - DNA, 16 bp, H. sapiens
tctttgctttttaaat

SEQ ID NO: 141893 - DNA, 16 bp, H. sapiens
tctttggaaaagaaaa

SEQ ID NO: 141894 - DNA, 16 bp, H. sapiens
tctttggaagaagaaa

SEQ ID NO: 141895 - DNA, 16 bp, H. sapiens
tctttggagaaatgct

SEQ ID NO: 141896 - DNA, 16 bp, H. sapiens
tctttggagaaatgtc

SEQ ID NO: 141897 - DNA, 17 bp, H. sapiens
tctttggagaattgtct

SEQ ID NO: 141898 - DNA, 16 bp, H. sapiens
tctttggagatggagt

SEQ ID NO: 141899 - DNA, 16 bp, H. sapiens
tctttggagtaatgtc

SEQ ID NO: 141900 - DNA, 16 bp, H. sapiens
tctttggatcttcatt

SEQ ID NO: 141901 - DNA, 16 bp, H. sapiens
tctttggattctgcag

SEQ ID NO: 141902 - DNA, 16 bp, H. sapiens
tctttggctataaaca

SEQ ID NO: 141903 - DNA, 16 bp, H. sapiens
tctttggcttcccaaa

SEQ ID NO: 141904 - DNA, 16 bp, H. sapiens
tctttggcttgtagat

SEQ ID NO: 141905 - DNA, 16 bp, H. sapiens
tctttggcttttccag

SEQ ID NO: 141906 - DNA, 16 bp, H. sapiens
tctttgggaggtgatg

SEQ ID NO: 141907 - DNA, 16 bp, H. sapiens
tctttgggatcagtgg

SEQ ID NO: 141908 - DNA, 16 bp, H. sapiens
tctttgggcttcagtt

SEQ ID NO: 141909 - DNA, 16 bp, H. sapiens
tctttggggtcctcaa

SEQ ID NO: 141910 - DNA, 16 bp, H. sapiens
tctttgggtcttcatt

SEQ ID NO: 141911 - DNA, 16 bp, H. sapiens
tctttgtaaaaatatt

SEQ ID NO: 141912 - DNA, 16 bp, H. sapiens
tctttgtaactttttg

SEQ ID NO: 141913 - DNA, 16 bp, H. sapiens
tctttgtagcaatttt

SEQ ID NO: 141914 - DNA, 16 bp, H. sapiens
tctttgtaggttctgg

SEQ ID NO: 141915 - DNA, 16 bp, H. sapiens
tctttgtatttcagtt

SEQ ID NO: 141916 - DNA, 16 bp, H. sapiens
tctttgtcaccacgtg

SEQ ID NO: 141917 - DNA, 16 bp, H. sapiens
tctttgtcataaatca

SEQ ID NO: 141918 - DNA, 16 bp, H. sapiens
tctttgtccttggtca

SEQ ID NO: 141919 - DNA, 16 bp, H. sapiens
tctttgtcttttaact

SEQ ID NO: 141920 - DNA, 16 bp, H. sapiens
tctttgtgaatgaata

SEQ ID NO: 141921 - DNA, 16 bp, H. sapiens
tctttgtgacattctc

SEQ ID NO: 141922 - DNA, 16 bp, H. sapiens
tctttgtgattttcta

SEQ ID NO: 141923 - DNA, 16 bp, H. sapiens
tctttgtggattttct

SEQ ID NO: 141924 - DNA, 16 bp, H. sapiens
tctttgtggtgatgaa

SEQ ID NO: 141925 - DNA, 16 bp, H. sapiens
tctttgtggtgatgga

SEQ ID NO: 141926 - DNA, 16 bp, H. sapiens
tctttgtgtctctgtg

SEQ ID NO: 141927 - DNA, 16 bp, H. sapiens
tctttgttctccattt

SEQ ID NO: 141928 - DNA, 16 bp, H. sapiens
tctttgttctccttgg

SEQ ID NO: 141929 - DNA, 16 bp, H. sapiens
tctttgttggatgcat

SEQ ID NO: 141930 - DNA, 16 bp, H. sapiens
tctttgttggtataaa

SEQ ID NO: 141931 - DNA, 16 bp, H. sapiens
tctttgttttaaaaat

SEQ ID NO: 141932 - DNA, 16 bp, H. sapiens
tctttgtttttaaaat

SEQ ID NO: 141933 - DNA, 16 bp, H. sapiens
tcttttaaaaaaatct

SEQ ID NO: 141934 - DNA, 16 bp, H. sapiens
tcttttaaaaaatgaa

SEQ ID NO: 141935 - DNA, 16 bp, H. sapiens
tcttttaaaaaatgtt

SEQ ID NO: 141936 - DNA, 16 bp, H. sapiens
tcttttaaaaagttaa

SEQ ID NO: 141937 - DNA, 16 bp, H. sapiens
tcttttaaaaatagtt

SEQ ID NO: 141938 - DNA, 16 bp, H. sapiens
tcttttaaaaatgctg

SEQ ID NO: 141939 - DNA, 16 bp, H. sapiens
tcttttaaaaattcat

SEQ ID NO: 141940 - DNA, 16 bp, H. sapiens
tcttttaaaatcttaa

SEQ ID NO: 141941 - DNA, 16 bp, H. sapiens
tcttttaaagaaaaaa

SEQ ID NO: 141942 - DNA, 16 bp, H. sapiens
tcttttaaagaaataa

SEQ ID NO: 141943 - DNA, 16 bp, H. sapiens
tcttttaaagactttt

SEQ ID NO: 141944 - DNA, 16 bp, H. sapiens
tcttttaaataaatga

SEQ ID NO: 141945 - DNA, 16 bp, H. sapiens
tcttttaaatcagata

SEQ ID NO: 141946 - DNA, 16 bp, H. sapiens
tcttttaacagtctgg

SEQ ID NO: 141947 - DNA, 16 bp, H. sapiens
tcttttaagaaaacat

SEQ ID NO: 141948 - DNA, 16 bp, H. sapiens
tcttttaagaaaagaa

SEQ ID NO: 141949 - DNA, 16 bp, H. sapiens
tcttttaagagtttta

SEQ ID NO: 141950 - DNA, 16 bp, H. sapiens
tcttttaatatgcaaa

SEQ ID NO: 141951 - DNA, 16 bp, H. sapiens
tcttttaatcctcata

SEQ ID NO: 141952 - DNA, 16 bp, H. sapiens
tcttttaatctataac

SEQ ID NO: 141953 - DNA, 16 bp, H. sapiens
tcttttaatggaaact

SEQ ID NO: 141954 - DNA, 16 bp, H. sapiens
tcttttaattgcagaa

SEQ ID NO: 141955 - DNA, 16 bp, H. sapiens
tcttttacatttgatg

SEQ ID NO: 141956 - DNA, 16 bp, H. sapiens
tcttttacttttcaaa

SEQ ID NO: 141957 - DNA, 16 bp, H. sapiens
tcttttagaaaaaaaa

SEQ ID NO: 141958 - DNA, 16 bp, H. sapiens
tcttttagatatatac

SEQ ID NO: 141959 - DNA, 16 bp, H. sapiens
tcttttataaatgttt

SEQ ID NO: 141960 - DNA, 16 bp, H. sapiens
tcttttataaattgcc

SEQ ID NO: 141961 - DNA, 16 bp, H. sapiens
tcttttataataaact

SEQ ID NO: 141962 - DNA, 16 bp, H. sapiens
tcttttatagagatgg

SEQ ID NO: 141963 - DNA, 16 bp, H. sapiens
tcttttatccctcact

SEQ ID NO: 141964 - DNA, 16 bp, H. sapiens
tcttttattaaagaaa

SEQ ID NO: 141965 - DNA, 16 bp, H. sapiens
tcttttattatgaaga

SEQ ID NO: 141966 - DNA, 16 bp, H. sapiens
tcttttatttcactaa

SEQ ID NO: 141967 - DNA, 16 bp, H. sapiens
tcttttatttctgaaa

SEQ ID NO: 141968 - DNA, 16 bp, H. sapiens
tcttttcaaaaaaaca

SEQ ID NO: 141969 - DNA, 16 bp, H. sapiens
tcttttcaaaaaatca

SEQ ID NO: 141970 - DNA, 16 bp, H. sapiens
tcttttcaaaaagcaa

SEQ ID NO: 141971 - DNA, 16 bp, H. sapiens
tcttttcaaaaatgtt

SEQ ID NO: 141972 - DNA, 16 bp, H. sapiens
tcttttcaaaatacaa

SEQ ID NO: 141973 - DNA, 16 bp, H. sapiens
tcttttcaaagagaaa

SEQ ID NO: 141974 - DNA, 16 bp, H. sapiens
tcttttcaaagctgtc

SEQ ID NO: 141975 - DNA, 16 bp, H. sapiens
tcttttcaagattttt

SEQ ID NO: 141976 - DNA, 16 bp, H. sapiens
tcttttcaataaatga

SEQ ID NO: 141977 - DNA, 16 bp, H. sapiens
tcttttcacatactcc

SEQ ID NO: 141978 - DNA, 17 bp, H. sapiens
tcttttcagaagtgtct

SEQ ID NO: 141979 - DNA, 16 bp, H. sapiens
tcttttcagacttttt

SEQ ID NO: 141980 - DNA, 16 bp, H. sapiens
tcttttcagttctatc

SEQ ID NO: 141981 - DNA, 16 bp, H. sapiens
tcttttcatatagtcc

SEQ ID NO: 141982 - DNA, 16 bp, H. sapiens
tcttttcatctgaaaa

SEQ ID NO: 141983 - DNA, 16 bp, H. sapiens
tcttttcatctgcaaa

SEQ ID NO: 141984 - DNA, 16 bp, H. sapiens
tcttttcatttcaaat

SEQ ID NO: 141985 - DNA, 16 bp, H. sapiens
tcttttccaaccacaa

SEQ ID NO: 141986 - DNA, 16 bp, H. sapiens
tcttttccactggtct

SEQ ID NO: 141987 - DNA, 16 bp, H. sapiens
tcttttccccagtata

SEQ ID NO: 141988 - DNA, 16 bp, H. sapiens
tcttttcctctgggtg

SEQ ID NO: 141989 - DNA, 16 bp, H. sapiens
tcttttcctggcttgc

SEQ ID NO: 141990 - DNA, 16 bp, H. sapiens
tcttttcctgtaaaat

SEQ ID NO: 141991 - DNA, 16 bp, H. sapiens
tcttttcctgtgctta

SEQ ID NO: 141992 - DNA, 16 bp, H. sapiens
tcttttcctttataaa

SEQ ID NO: 141993 - DNA, 16 bp, H. sapiens
tcttttcctttgggaa

SEQ ID NO: 141994 - DNA, 16 bp, H. sapiens
tcttttccttttaaaa

SEQ ID NO: 141995 - DNA, 16 bp, H. sapiens
tcttttctacctcatg

SEQ ID NO: 141996 - DNA, 16 bp, H. sapiens
tcttttctcttgctac

SEQ ID NO: 141997 - DNA, 16 bp, H. sapiens
tcttttctgccatgtg

SEQ ID NO: 141998 - DNA, 16 bp, H. sapiens
tcttttctggaggctc

SEQ ID NO: 141999 - DNA, 16 bp, H. sapiens
tcttttctgtgcagaa

SEQ ID NO: 142000 - DNA, 16 bp, H. sapiens
tcttttctgttttaaa

SEQ ID NO: 142001 - DNA, 16 bp, H. sapiens
tcttttcttctgctac

SEQ ID NO: 142002 - DNA, 16 bp, H. sapiens
tcttttcttctgttaa

SEQ ID NO: 142003 - DNA, 16 bp, H. sapiens
tcttttctttcaaaag

SEQ ID NO: 142004 - DNA, 16 bp, H. sapiens
tcttttctttctgatc

SEQ ID NO: 142005 - DNA, 16 bp, H. sapiens
tcttttctttgaaata

SEQ ID NO: 142006 - DNA, 16 bp, H. sapiens
tcttttctttgtcatc

SEQ ID NO: 142007 - DNA, 16 bp, H. sapiens
tcttttcttttgaaag

SEQ ID NO: 142008 - DNA, 16 bp, H. sapiens
tcttttcttttgctag

SEQ ID NO: 142009 - DNA, 16 bp, H. sapiens
tcttttgaaaaaaaaa

SEQ ID NO: 142010 - DNA, 16 bp, H. sapiens
tcttttgaaaaataaa

SEQ ID NO: 142011 - DNA, 16 bp, H. sapiens
tcttttgaaaatttaa

SEQ ID NO: 142012 - DNA, 16 bp, H. sapiens
tcttttgaaacggagt

SEQ ID NO: 142013 - DNA, 16 bp, H. sapiens
tcttttgaaagtgtct

SEQ ID NO: 142014 - DNA, 16 bp, H. sapiens
tcttttgaaatttaaa

SEQ ID NO: 142015 - DNA, 16 bp, H. sapiens
tcttttgaactttgtt

SEQ ID NO: 142016 - DNA, 16 bp, H. sapiens
tcttttgaagacagca

SEQ ID NO: 142017 - DNA, 16 bp, H. sapiens
tcttttgaagagcaaa

SEQ ID NO: 142018 - DNA, 16 bp, H. sapiens
tcttttgacccagcaa

SEQ ID NO: 142019 - DNA, 16 bp, H. sapiens
tcttttgagaaatctc

SEQ ID NO: 142020 - DNA, 16 bp, H. sapiens
tcttttgagatatttt

SEQ ID NO: 142021 - DNA, 16 bp, H. sapiens
tcttttgagatggaat

SEQ ID NO: 142022 - DNA, 16 bp, H. sapiens
tcttttgaggaatgtc

SEQ ID NO: 142023 - DNA, 16 bp, H. sapiens
tcttttgagtttctga

SEQ ID NO: 142024 - DNA, 16 bp, H. sapiens
tcttttgatgaacaaa

SEQ ID NO: 142025 - DNA, 16 bp, H. sapiens
tcttttgattaatgtt

SEQ ID NO: 142026 - DNA, 16 bp, H. sapiens
tcttttgatttggggt

SEQ ID NO: 142027 - DNA, 16 bp, H. sapiens
tcttttgcccatattt

SEQ ID NO: 142028 - DNA, 16 bp, H. sapiens
tcttttgcccattttt

SEQ ID NO: 142029 - DNA, 16 bp, H. sapiens
tcttttgcctttttaa

SEQ ID NO: 142030 - DNA, 16 bp, H. sapiens
tcttttgctatttcta

SEQ ID NO: 142031 - DNA, 16 bp, H. sapiens
tcttttgctcaacatt

SEQ ID NO: 142032 - DNA, 16 bp, H. sapiens
tcttttgctgtgcaca

SEQ ID NO: 142033 - DNA, 16 bp, H. sapiens
tcttttggaaaaaaaa

SEQ ID NO: 142034 - DNA, 16 bp, H. sapiens
tcttttggaaaatcaa

SEQ ID NO: 142035 - DNA, 16 bp, H. sapiens
tcttttggataaacat

SEQ ID NO: 142036 - DNA, 16 bp, H. sapiens
tcttttggctgcatag

SEQ ID NO: 142037 - DNA, 16 bp, H. sapiens
tcttttggggttccat

SEQ ID NO: 142038 - DNA, 16 bp, H. sapiens
tcttttgtaaagacag

SEQ ID NO: 142039 - DNA, 16 bp, H. sapiens
tcttttgtaaattgtt

SEQ ID NO: 142040 - DNA, 16 bp, H. sapiens
tcttttgtaattaaaa

SEQ ID NO: 142041 - DNA, 16 bp, H. sapiens
tcttttgtactctttc

SEQ ID NO: 142042 - DNA, 16 bp, H. sapiens
tcttttgtatttccat

SEQ ID NO: 142043 - DNA, 16 bp, H. sapiens
tcttttgtctgatggt

SEQ ID NO: 142044 - DNA, 16 bp, H. sapiens
tcttttgtcttaggat

SEQ ID NO: 142045 - DNA, 16 bp, H. sapiens
tcttttgtgattggct

SEQ ID NO: 142046 - DNA, 16 bp, H. sapiens
tcttttgttaaatgta

SEQ ID NO: 142047 - DNA, 16 bp, H. sapiens
tcttttgttagattta

SEQ ID NO: 142048 - DNA, 16 bp, H. sapiens
tcttttgttttaaatg

SEQ ID NO: 142049 - DNA, 16 bp, H. sapiens
tcttttgtttttgaaa

SEQ ID NO: 142050 - DNA, 16 bp, H. sapiens
tctttttaaaaaatgt

SEQ ID NO: 142051 - DNA, 16 bp, H. sapiens
tctttttaaaaaattg

SEQ ID NO: 142052 - DNA, 16 bp, H. sapiens
tctttttaaaaacaaa

SEQ ID NO: 142053 - DNA, 16 bp, H. sapiens
tctttttaaaaatcag

SEQ ID NO: 142054 - DNA, 16 bp, H. sapiens
tctttttaaaaattga

SEQ ID NO: 142055 - DNA, 16 bp, H. sapiens
tctttttaaaagattt

SEQ ID NO: 142056 - DNA, 16 bp, H. sapiens
tctttttaaaatgtct

SEQ ID NO: 142057 - DNA, 16 bp, H. sapiens
tctttttaaagaatca

SEQ ID NO: 142058 - DNA, 16 bp, H. sapiens
tctttttaaagtgttt

SEQ ID NO: 142059 - DNA, 16 bp, H. sapiens
tctttttaaattatgt

SEQ ID NO: 142060 - DNA, 16 bp, H. sapiens
tctttttaatgctgaa

SEQ ID NO: 142061 - DNA, 16 bp, H. sapiens
tctttttacaaaaaaa

SEQ ID NO: 142062 - DNA, 16 bp, H. sapiens
tctttttataaatgta

SEQ ID NO: 142063 - DNA, 16 bp, H. sapiens
tctttttataaggaaa

SEQ ID NO: 142064 - DNA, 16 bp, H. sapiens
tctttttatatacctg

SEQ ID NO: 142065 - DNA, 16 bp, H. sapiens
tctttttatggctgag

SEQ ID NO: 142066 - DNA, 16 bp, H. sapiens
tctttttattgccaaa

SEQ ID NO: 142067 - DNA, 16 bp, H. sapiens
tctttttcaaagtttt

SEQ ID NO: 142068 - DNA, 16 bp, H. sapiens
tctttttcacattgtt

SEQ ID NO: 142069 - DNA, 16 bp, H. sapiens
tctttttcagaatttt

SEQ ID NO: 142070 - DNA, 16 bp, H. sapiens
tctttttcagacaaat

SEQ ID NO: 142071 - DNA, 16 bp, H. sapiens
tctttttcagattgtc

SEQ ID NO: 142072 - DNA, 16 bp, H. sapiens
tctttttcagtttcct

SEQ ID NO: 142073 - DNA, 16 bp, H. sapiens
tctttttctagtgatt

SEQ ID NO: 142074 - DNA, 16 bp, H. sapiens
tctttttctatttgaa

SEQ ID NO: 142075 - DNA, 16 bp, H. sapiens
tctttttctctaaaat

SEQ ID NO: 142076 - DNA, 16 bp, H. sapiens
tctttttctctggata

SEQ ID NO: 142077 - DNA, 16 bp, H. sapiens
tctttttctgagccct

SEQ ID NO: 142078 - DNA, 16 bp, H. sapiens
tctttttctgttaaaa

SEQ ID NO: 142079 - DNA, 16 bp, H. sapiens
tctttttcttgaaaca

SEQ ID NO: 142080 - DNA, 16 bp, H. sapiens
tctttttctttccagt

SEQ ID NO: 142081 - DNA, 16 bp, H. sapiens
tctttttgaaaatata

SEQ ID NO: 142082 - DNA, 16 bp, H. sapiens
tctttttgataacagc

SEQ ID NO: 142083 - DNA, 16 bp, H. sapiens
tctttttgataatatc

SEQ ID NO: 142084 - DNA, 16 bp, H. sapiens
tctttttgctggtgga

SEQ ID NO: 142085 - DNA, 16 bp, H. sapiens
tctttttgctttaaaa

SEQ ID NO: 142086 - DNA, 16 bp, H. sapiens
tctttttggaaaaaaa

SEQ ID NO: 142087 - DNA, 16 bp, H. sapiens
tctttttggagttgat

SEQ ID NO: 142088 - DNA, 16 bp, H. sapiens
tctttttggttagtaa

SEQ ID NO: 142089 - DNA, 16 bp, H. sapiens
tctttttgtaaaaaaa

SEQ ID NO: 142090 - DNA, 16 bp, H. sapiens
tctttttgttcaagat

SEQ ID NO: 142091 - DNA, 16 bp, H. sapiens
tcttttttaaaaaaac

SEQ ID NO: 142092 - DNA, 16 bp, H. sapiens
tcttttttaaaaatgt

SEQ ID NO: 142093 - DNA, 16 bp, H. sapiens
tcttttttaaaagaga

SEQ ID NO: 142094 - DNA, 16 bp, H. sapiens
tcttttttaatgtagg

SEQ ID NO: 142095 - DNA, 16 bp, H. sapiens
tcttttttcaaagttt

SEQ ID NO: 142096 - DNA, 16 bp, H. sapiens
tcttttttccccccaa

SEQ ID NO: 142097 - DNA, 16 bp, H. sapiens
tcttttttccccctaa

SEQ ID NO: 142098 - DNA, 16 bp, H. sapiens
tcttttttctccaaac

SEQ ID NO: 142099 - DNA, 16 bp, H. sapiens
tcttttttgcctgctg

SEQ ID NO: 142100 - DNA, 16 bp, H. sapiens
tcttttttgggtccat

SEQ ID NO: 142101 - DNA, 16 bp, H. sapiens
tcttttttggtcccat

SEQ ID NO: 142102 - DNA, 16 bp, H. sapiens
tcttttttgttccata

SEQ ID NO: 142103 - DNA, 16 bp, H. sapiens
tctttttttaaaagat

SEQ ID NO: 142104 - DNA, 16 bp, H. sapiens
tctttttttaaaagtc

SEQ ID NO: 142105 - DNA, 16 bp, H. sapiens
tctttttttaatgtag

SEQ ID NO: 142106 - DNA, 16 bp, H. sapiens
tcttttttttaaagac

SEQ ID NO: 142107 - DNA, 16 bp, H. sapiens
tcttttttttaatgaa

SEQ ID NO: 142108 - DNA, 16 bp, H. sapiens
tcttttttttcagatg

SEQ ID NO: 142109 - DNA, 16 bp, H. sapiens
tcttttttttgagacg

SEQ ID NO: 142110 - DNA, 16 bp, H. sapiens
tgaaaaaaaaaatccc

SEQ ID NO: 142111 - DNA, 16 bp, H. sapiens
tgaaaaaaaatccatg

SEQ ID NO: 142112 - DNA, 16 bp, H. sapiens
tgaaaaaaaatgtttt

SEQ ID NO: 142113 - DNA, 16 bp, H. sapiens
tgaaaaaaagcttaac

SEQ ID NO: 142114 - DNA, 16 bp, H. sapiens
tgaaaaaaagttcatt

SEQ ID NO: 142115 - DNA, 16 bp, H. sapiens
tgaaaaaaatcaatca

SEQ ID NO: 142116 - DNA, 16 bp, H. sapiens
tgaaaaaaatgcacat

SEQ ID NO: 142117 - DNA, 16 bp, H. sapiens
tgaaaaaactatgcat

SEQ ID NO: 142118 - DNA, 16 bp, H. sapiens
tgaaaaaataaaatct

SEQ ID NO: 142119 - DNA, 16 bp, H. sapiens
tgaaaaaataatctgt

SEQ ID NO: 142120 - DNA, 16 bp, H. sapiens
tgaaaaaataatggcc

SEQ ID NO: 142121 - DNA, 16 bp, H. sapiens
tgaaaaaatgctcaaa

SEQ ID NO: 142122 - DNA, 16 bp, H. sapiens
tgaaaaaatgctcaat

SEQ ID NO: 142123 - DNA, 16 bp, H. sapiens
tgaaaaaatgcttatc

SEQ ID NO: 142124 - DNA, 16 bp, H. sapiens
tgaaaaaattaacttt

SEQ ID NO: 142125 - DNA, 16 bp, H. sapiens
tgaaaaaattatcaaa

SEQ ID NO: 142126 - DNA, 16 bp, H. sapiens
tgaaaaaattcaacat

SEQ ID NO: 142127 - DNA, 16 bp, H. sapiens
tgaaaaacaaaaccca

SEQ ID NO: 142128 - DNA, 16 bp, H. sapiens
tgaaaaacaaatggaa

SEQ ID NO: 142129 - DNA, 16 bp, H. sapiens
tgaaaaacaacatatt

SEQ ID NO: 142130 - DNA, 16 bp, H. sapiens
tgaaaaacaactcaag

SEQ ID NO: 142131 - DNA, 16 bp, H. sapiens
tgaaaaacaacttcag

SEQ ID NO: 142132 - DNA, 16 bp, H. sapiens
tgaaaaacacaatttt

SEQ ID NO: 142133 - DNA, 16 bp, H. sapiens
tgaaaaacagaaattt

SEQ ID NO: 142134 - DNA, 16 bp, H. sapiens
tgaaaaacataatttt

SEQ ID NO: 142135 - DNA, 16 bp, H. sapiens
tgaaaaacatatttga

SEQ ID NO: 142136 - DNA, 16 bp, H. sapiens
tgaaaaacatgaaaat

SEQ ID NO: 142137 - DNA, 16 bp, H. sapiens
tgaaaaacattatttt

SEQ ID NO: 142138 - DNA, 16 bp, H. sapiens
tgaaaaaccagctcct

SEQ ID NO: 142139 - DNA, 16 bp, H. sapiens
tgaaaaaccatacaaa

SEQ ID NO: 142140 - DNA, 16 bp, H. sapiens
tgaaaaaccctccaaa

SEQ ID NO: 142141 - DNA, 16 bp, H. sapiens
tgaaaaacctagaaga

SEQ ID NO: 142142 - DNA, 16 bp, H. sapiens
tgaaaaactagccagg

SEQ ID NO: 142143 - DNA, 16 bp, H. sapiens
tgaaaaactgaaaatc

SEQ ID NO: 142144 - DNA, 16 bp, H. sapiens
tgaaaaactgcttggc

SEQ ID NO: 142145 - DNA, 16 bp, H. sapiens
tgaaaaactgtttggc

SEQ ID NO: 142146 - DNA, 16 bp, H. sapiens
tgaaaaagaaaatctg

SEQ ID NO: 142147 - DNA, 16 bp, H. sapiens
tgaaaaagaaaatgca

SEQ ID NO: 142148 - DNA, 16 bp, H. sapiens
tgaaaaagaaactgaa

SEQ ID NO: 142149 - DNA, 16 bp, H. sapiens
tgaaaaagaaattgag

SEQ ID NO: 142150 - DNA, 16 bp, H. sapiens
tgaaaaagaatgaagc

SEQ ID NO: 142151 - DNA, 16 bp, H. sapiens
tgaaaaagacagaaat

SEQ ID NO: 142152 - DNA, 16 bp, H. sapiens
tgaaaaagacttgaaa

SEQ ID NO: 142153 - DNA, 16 bp, H. sapiens
tgaaaaagatcaacaa

SEQ ID NO: 142154 - DNA, 16 bp, H. sapiens
tgaaaaagctattaaa

SEQ ID NO: 142155 - DNA, 16 bp, H. sapiens
tgaaaaaggaaacacc

SEQ ID NO: 142156 - DNA, 16 bp, H. sapiens
tgaaaaaggaaatacc

SEQ ID NO: 142157 - DNA, 16 bp, H. sapiens
tgaaaaaggaaatctc

SEQ ID NO: 142158 - DNA, 16 bp, H. sapiens
tgaaaaaggcagaaaa

SEQ ID NO: 142159 - DNA, 16 bp, H. sapiens
tgaaaaaggggacatt

SEQ ID NO: 142160 - DNA, 16 bp, H. sapiens
tgaaaaaggtgtcctt

SEQ ID NO: 142161 - DNA, 16 bp, H. sapiens
tgaaaaagtattcaaa

SEQ ID NO: 142162 - DNA, 16 bp, H. sapiens
tgaaaaagtatttgat

SEQ ID NO: 142163 - DNA, 16 bp, H. sapiens
tgaaaaagtgaatatc

SEQ ID NO: 142164 - DNA, 16 bp, H. sapiens
tgaaaaagtgctcaac

SEQ ID NO: 142165 - DNA, 16 bp, H. sapiens
tgaaaaagttaaacat

SEQ ID NO: 142166 - DNA, 16 bp, H. sapiens
tgaaaaagttgatgat

SEQ ID NO: 142167 - DNA, 16 bp, H. sapiens
tgaaaaagttgatttt

SEQ ID NO: 142168 - DNA, 16 bp, H. sapiens
tgaaaaagttttattt

SEQ ID NO: 142169 - DNA, 16 bp, H. sapiens
tgaaaaataaatcaag

SEQ ID NO: 142170 - DNA, 16 bp, H. sapiens
tgaaaaataaatgctt

SEQ ID NO: 142171 - DNA, 16 bp, H. sapiens
tgaaaaataaatgtct

SEQ ID NO: 142172 - DNA, 16 bp, H. sapiens
tgaaaaataaatttca

SEQ ID NO: 142173 - DNA, 16 bp, H. sapiens
tgaaaaataacaaagt

SEQ ID NO: 142174 - DNA, 16 bp, H. sapiens
tgaaaaatacactgga

SEQ ID NO: 142175 - DNA, 16 bp, H. sapiens
tgaaaaatacatgaaa

SEQ ID NO: 142176 - DNA, 16 bp, H. sapiens
tgaaaaatacatgaga

SEQ ID NO: 142177 - DNA, 16 bp, H. sapiens
tgaaaaatacattatt

SEQ ID NO: 142178 - DNA, 16 bp, H. sapiens
tgaaaaatataggcca

SEQ ID NO: 142179 - DNA, 16 bp, H. sapiens
tgaaaaatatcatttt

SEQ ID NO: 142180 - DNA, 16 bp, H. sapiens
tgaaaaatatctcaag

SEQ ID NO: 142181 - DNA, 16 bp, H. sapiens
tgaaaaatatcttgaa

SEQ ID NO: 142182 - DNA, 16 bp, H. sapiens
tgaaaaatattccatt

SEQ ID NO: 142183 - DNA, 16 bp, H. sapiens
tgaaaaatatttctaa

SEQ ID NO: 142184 - DNA, 16 bp, H. sapiens
tgaaaaatcaaaaatt

SEQ ID NO: 142185 - DNA, 16 bp, H. sapiens
tgaaaaatctgctgtt

SEQ ID NO: 142186 - DNA, 16 bp, H. sapiens
tgaaaaatgaagcaaa

SEQ ID NO: 142187 - DNA, 16 bp, H. sapiens
tgaaaaatgatatttt

SEQ ID NO: 142188 - DNA, 16 bp, H. sapiens
tgaaaaatgatgagtt

SEQ ID NO: 142189 - DNA, 16 bp, H. sapiens
tgaaaaatgggaagat

SEQ ID NO: 142190 - DNA, 16 bp, H. sapiens
tgaaaaatgtgaagaa

SEQ ID NO: 142191 - DNA, 16 bp, H. sapiens
tgaaaaatgtttaata

SEQ ID NO: 142192 - DNA, 16 bp, H. sapiens
tgaaaaattaaaactt

SEQ ID NO: 142193 - DNA, 16 bp, H. sapiens
tgaaaaattaattgta

SEQ ID NO: 142194 - DNA, 16 bp, H. sapiens
tgaaaaattacttatt

SEQ ID NO: 142195 - DNA, 16 bp, H. sapiens
tgaaaaattactttta

SEQ ID NO: 142196 - DNA, 16 bp, H. sapiens
tgaaaaattcacaaat

SEQ ID NO: 142197 - DNA, 16 bp, H. sapiens
tgaaaaattcctattg

SEQ ID NO: 142198 - DNA, 16 bp, H. sapiens
tgaaaaattggaaaca

SEQ ID NO: 142199 - DNA, 16 bp, H. sapiens
tgaaaaatttcaaatg

SEQ ID NO: 142200 - DNA, 16 bp, H. sapiens
tgaaaaatttgagtca

SEQ ID NO: 142201 - DNA, 16 bp, H. sapiens
tgaaaaattttaagca

SEQ ID NO: 142202 - DNA, 16 bp, H. sapiens
tgaaaaattttgaaat

SEQ ID NO: 142203 - DNA, 16 bp, H. sapiens
tgaaaacaaaaatatg

SEQ ID NO: 142204 - DNA, 16 bp, H. sapiens
tgaaaacaaaacatat

SEQ ID NO: 142205 - DNA, 16 bp, H. sapiens
tgaaaacaaaatcaag

SEQ ID NO: 142206 - DNA, 16 bp, H. sapiens
tgaaaacaaaatcaca

SEQ ID NO: 142207 - DNA, 16 bp, H. sapiens
tgaaaacaaacacaca

SEQ ID NO: 142208 - DNA, 16 bp, H. sapiens
tgaaaacaaatatttt

SEQ ID NO: 142209 - DNA, 16 bp, H. sapiens
tgaaaacaaattattt

SEQ ID NO: 142210 - DNA, 16 bp, H. sapiens
tgaaaacaacctaaat

SEQ ID NO: 142211 - DNA, 16 bp, H. sapiens
tgaaaacaagcaaaca

SEQ ID NO: 142212 - DNA, 16 bp, H. sapiens
tgaaaacaagttaaaa

SEQ ID NO: 142213 - DNA, 16 bp, H. sapiens
tgaaaacaatattaat

SEQ ID NO: 142214 - DNA, 16 bp, H. sapiens
tgaaaacaattgaaaa

SEQ ID NO: 142215 - DNA, 16 bp, H. sapiens
tgaaaacaattttttt

SEQ ID NO: 142216 - DNA, 16 bp, H. sapiens
tgaaaacacatcccat

SEQ ID NO: 142217 - DNA, 16 bp, H. sapiens
tgaaaacaccaaaaat

SEQ ID NO: 142218 - DNA, 16 bp, H. sapiens
tgaaaacactgtattt

SEQ ID NO: 142219 - DNA, 16 bp, H. sapiens
tgaaaacactgttttt

SEQ ID NO: 142220 - DNA, 16 bp, H. sapiens
tgaaaacactttaaaa

SEQ ID NO: 142221 - DNA, 16 bp, H. sapiens
tgaaaacactttgaaa

SEQ ID NO: 142222 - DNA, 16 bp, H. sapiens
tgaaaacagaaaatgt

SEQ ID NO: 142223 - DNA, 16 bp, H. sapiens
tgaaaacagaaatatc

SEQ ID NO: 142224 - DNA, 16 bp, H. sapiens
tgaaaacagagacaat

SEQ ID NO: 142225 - DNA, 16 bp, H. sapiens
tgaaaacagcacagga

SEQ ID NO: 142226 - DNA, 16 bp, H. sapiens
tgaaaacaggaactca

SEQ ID NO: 142227 - DNA, 16 bp, H. sapiens
tgaaaacaggacatgt

SEQ ID NO: 142228 - DNA, 16 bp, H. sapiens
tgaaaacaggagtgcc

SEQ ID NO: 142229 - DNA, 16 bp, H. sapiens
tgaaaacataaaatgt

SEQ ID NO: 142230 - DNA, 16 bp, H. sapiens
tgaaaacataaatgaa

SEQ ID NO: 142231 - DNA, 16 bp, H. sapiens
tgaaaacatattttct

SEQ ID NO: 142232 - DNA, 16 bp, H. sapiens
tgaaaacatcatgcta

SEQ ID NO: 142233 - DNA, 16 bp, H. sapiens
tgaaaacatccagaaa

SEQ ID NO: 142234 - DNA, 16 bp, H. sapiens
tgaaaacatctcaatt

SEQ ID NO: 142235 - DNA, 16 bp, H. sapiens
tgaaaacatgaaaaat

SEQ ID NO: 142236 - DNA, 16 bp, H. sapiens
tgaaaacatgccaagt

SEQ ID NO: 142237 - DNA, 16 bp, H. sapiens
tgaaaacatgtctaca

SEQ ID NO: 142238 - DNA, 16 bp, H. sapiens
tgaaaacattaaaaag

SEQ ID NO: 142239 - DNA, 16 bp, H. sapiens
tgaaaacattaaagaa

SEQ ID NO: 142240 - DNA, 16 bp, H. sapiens
tgaaaacattacaaat

SEQ ID NO: 142241 - DNA, 16 bp, H. sapiens
tgaaaacatttgaaaa

SEQ ID NO: 142242 - DNA, 16 bp, H. sapiens
tgaaaacatttttaaa

SEQ ID NO: 142243 - DNA, 16 bp, H. sapiens
tgaaaaccaaaagtga

SEQ ID NO: 142244 - DNA, 16 bp, H. sapiens
tgaaaaccaaatcaag

SEQ ID NO: 142245 - DNA, 16 bp, H. sapiens
tgaaaaccaatacaaa

SEQ ID NO: 142246 - DNA, 16 bp, H. sapiens
tgaaaaccagaaaaca

SEQ ID NO: 142247 - DNA, 16 bp, H. sapiens
tgaaaacccatctcta

SEQ ID NO: 142248 - DNA, 16 bp, H. sapiens
tgaaaaccctcaaaaa

SEQ ID NO: 142249 - DNA, 16 bp, H. sapiens
tgaaaacctagaggaa

SEQ ID NO: 142250 - DNA, 16 bp, H. sapiens
tgaaaaccttttggaa

SEQ ID NO: 142251 - DNA, 16 bp, H. sapiens
tgaaaactaaaatgaa

SEQ ID NO: 142252 - DNA, 16 bp, H. sapiens
tgaaaactacaaagca

SEQ ID NO: 142253 - DNA, 16 bp, H. sapiens
tgaaaactacctattg

SEQ ID NO: 142254 - DNA, 16 bp, H. sapiens
tgaaaactataaaaac

SEQ ID NO: 142255 - DNA, 16 bp, H. sapiens
tgaaaactataaaaca

SEQ ID NO: 142256 - DNA, 16 bp, H. sapiens
tgaaaactatacaaca

SEQ ID NO: 142257 - DNA, 16 bp, H. sapiens
tgaaaactgaaggaaa

SEQ ID NO: 142258 - DNA, 16 bp, H. sapiens
tgaaaactggatattt

SEQ ID NO: 142259 - DNA, 16 bp, H. sapiens
tgaaaactggtaaata

SEQ ID NO: 142260 - DNA, 16 bp, H. sapiens
tgaaaacttaaaacaa

SEQ ID NO: 142261 - DNA, 16 bp, H. sapiens
tgaaaacttcccaagt

SEQ ID NO: 142262 - DNA, 16 bp, H. sapiens
tgaaaacttgccaaga

SEQ ID NO: 142263 - DNA, 16 bp, H. sapiens
tgaaaactttccaaat

SEQ ID NO: 142264 - DNA, 16 bp, H. sapiens
tgaaaactttttgaaa

SEQ ID NO: 142265 - DNA, 16 bp, H. sapiens
tgaaaacttttttttt

SEQ ID NO: 142266 - DNA, 16 bp, H. sapiens
tgaaaagaaaatttct

SEQ ID NO: 142267 - DNA, 16 bp, H. sapiens
tgaaaagaaatgaagt

SEQ ID NO: 142268 - DNA, 16 bp, H. sapiens
tgaaaagaagctgagt

SEQ ID NO: 142269 - DNA, 16 bp, H. sapiens
tgaaaagaaggtaata

SEQ ID NO: 142270 - DNA, 16 bp, H. sapiens
tgaaaagaatgtatat

SEQ ID NO: 142271 - DNA, 16 bp, H. sapiens
tgaaaagacaaataat

SEQ ID NO: 142272 - DNA, 16 bp, H. sapiens
tgaaaagacaagcaac

SEQ ID NO: 142273 - DNA, 16 bp, H. sapiens
tgaaaagacatggaga

SEQ ID NO: 142274 - DNA, 16 bp, H. sapiens
tgaaaagactgccctt

SEQ ID NO: 142275 - DNA, 16 bp, H. sapiens
tgaaaagacttttctt

SEQ ID NO: 142276 - DNA, 16 bp, H. sapiens
tgaaaagagatagttt

SEQ ID NO: 142277 - DNA, 16 bp, H. sapiens
tgaaaagagcagtggt

SEQ ID NO: 142278 - DNA, 16 bp, H. sapiens
tgaaaagagttctgga

SEQ ID NO: 142279 - DNA, 16 bp, H. sapiens
tgaaaagataaaactg

SEQ ID NO: 142280 - DNA, 16 bp, H. sapiens
tgaaaagataagcaaa

SEQ ID NO: 142281 - DNA, 16 bp, H. sapiens
tgaaaagatcaagaaa

SEQ ID NO: 142282 - DNA, 16 bp, H. sapiens
tgaaaagatgaatgaa

SEQ ID NO: 142283 - DNA, 16 bp, H. sapiens
tgaaaagattttattt

SEQ ID NO: 142284 - DNA, 16 bp, H. sapiens
tgaaaagattttttaa

SEQ ID NO: 142285 - DNA, 16 bp, H. sapiens
tgaaaagcaagaaatt

SEQ ID NO: 142286 - DNA, 16 bp, H. sapiens
tgaaaagcagaaagaa

SEQ ID NO: 142287 - DNA, 16 bp, H. sapiens
tgaaaagctttttaaa

SEQ ID NO: 142288 - DNA, 16 bp, H. sapiens
tgaaaaggaaaatttt

SEQ ID NO: 142289 - DNA, 16 bp, H. sapiens
tgaaaaggaaagaaca

SEQ ID NO: 142290 - DNA, 16 bp, H. sapiens
tgaaaaggaaattaag

SEQ ID NO: 142291 - DNA, 16 bp, H. sapiens
tgaaaaggaacaaagt

SEQ ID NO: 142292 - DNA, 16 bp, H. sapiens
tgaaaaggaacaaatt

SEQ ID NO: 142293 - DNA, 16 bp, H. sapiens
tgaaaaggaagaacaa

SEQ ID NO: 142294 - DNA, 16 bp, H. sapiens
tgaaaaggaagtttta

SEQ ID NO: 142295 - DNA, 16 bp, H. sapiens
tgaaaaggaatatttt

SEQ ID NO: 142296 - DNA, 16 bp, H. sapiens
tgaaaaggacaaccag

SEQ ID NO: 142297 - DNA, 16 bp, H. sapiens
tgaaaaggacatgaaa

SEQ ID NO: 142298 - DNA, 16 bp, H. sapiens
tgaaaaggcaacctaa

SEQ ID NO: 142299 - DNA, 16 bp, H. sapiens
tgaaaaggcaatctac

SEQ ID NO: 142300 - DNA, 16 bp, H. sapiens
tgaaaagggaacaatt

SEQ ID NO: 142301 - DNA, 16 bp, H. sapiens
tgaaaaggttttattt

SEQ ID NO: 142302 - DNA, 16 bp, H. sapiens
tgaaaagtattatttt

SEQ ID NO: 142303 - DNA, 16 bp, H. sapiens
tgaaaagtcaaaagaa

SEQ ID NO: 142304 - DNA, 16 bp, H. sapiens
tgaaaagtcagccctc

SEQ ID NO: 142305 - DNA, 16 bp, H. sapiens
tgaaaagttatatttt

SEQ ID NO: 142306 - DNA, 16 bp, H. sapiens
tgaaaagttcatttat

SEQ ID NO: 142307 - DNA, 16 bp, H. sapiens
tgaaaagttttaagca

SEQ ID NO: 142308 - DNA, 16 bp, H. sapiens
tgaaaagttttgtttt

SEQ ID NO: 142309 - DNA, 16 bp, H. sapiens
tgaaaataaaaatgca

SEQ ID NO: 142310 - DNA, 16 bp, H. sapiens
tgaaaataaaagcttt

SEQ ID NO: 142311 - DNA, 16 bp, H. sapiens
tgaaaataaaagtcaa

SEQ ID NO: 142312 - DNA, 16 bp, H. sapiens
tgaaaataaaatctga

SEQ ID NO: 142313 - DNA, 16 bp, H. sapiens
tgaaaataaagcagaa

SEQ ID NO: 142314 - DNA, 16 bp, H. sapiens
tgaaaataaatatttc

SEQ ID NO: 142315 - DNA, 16 bp, H. sapiens
tgaaaataaatgttta

SEQ ID NO: 142316 - DNA, 16 bp, H. sapiens
tgaaaataaatttgta

SEQ ID NO: 142317 - DNA, 16 bp, H. sapiens
tgaaaataatatacat

SEQ ID NO: 142318 - DNA, 16 bp, H. sapiens
tgaaaataatctgaaa

SEQ ID NO: 142319 - DNA, 16 bp, H. sapiens
tgaaaataatgatttt

SEQ ID NO: 142320 - DNA, 16 bp, H. sapiens
tgaaaataattttcct

SEQ ID NO: 142321 - DNA, 16 bp, H. sapiens
tgaaaatacaaaatta

SEQ ID NO: 142322 - DNA, 16 bp, H. sapiens
tgaaaatacaaattta

SEQ ID NO: 142323 - DNA, 16 bp, H. sapiens
tgaaaatacacatttt

SEQ ID NO: 142324 - DNA, 16 bp, H. sapiens
tgaaaatacagaaaca

SEQ ID NO: 142325 - DNA, 16 bp, H. sapiens
tgaaaatactaaaaac

SEQ ID NO: 142326 - DNA, 16 bp, H. sapiens
tgaaaatactgaaaaa

SEQ ID NO: 142327 - DNA, 16 bp, H. sapiens
tgaaaatataacattt

SEQ ID NO: 142328 - DNA, 16 bp, H. sapiens
tgaaaatatacagaaa

SEQ ID NO: 142329 - DNA, 16 bp, H. sapiens
tgaaaatatatcaaaa

SEQ ID NO: 142330 - DNA, 16 bp, H. sapiens
tgaaaatatattttca

SEQ ID NO: 142331 - DNA, 16 bp, H. sapiens
tgaaaatatccagaaa

SEQ ID NO: 142332 - DNA, 16 bp, H. sapiens
tgaaaatatctgtttt

SEQ ID NO: 142333 - DNA, 16 bp, H. sapiens
tgaaaatatcttaaaa

SEQ ID NO: 142334 - DNA, 16 bp, H. sapiens
tgaaaatatggaagca

SEQ ID NO: 142335 - DNA, 16 bp, H. sapiens
tgaaaatatgttcaac

SEQ ID NO: 142336 - DNA, 16 bp, H. sapiens
tgaaaatatgttttca

SEQ ID NO: 142337 - DNA, 16 bp, H. sapiens
tgaaaatattaaattg

SEQ ID NO: 142338 - DNA, 16 bp, H. sapiens
tgaaaatattcaagaa

SEQ ID NO: 142339 - DNA, 16 bp, H. sapiens
tgaaaatattccaaaa

SEQ ID NO: 142340 - DNA, 16 bp, H. sapiens
tgaaaatattctagaa

SEQ ID NO: 142341 - DNA, 16 bp, H. sapiens
tgaaaatattctcttt

SEQ ID NO: 142342 - DNA, 16 bp, H. sapiens
tgaaaatattctgttt

SEQ ID NO: 142343 - DNA, 16 bp, H. sapiens
tgaaaatattgtttta

SEQ ID NO: 142344 - DNA, 16 bp, H. sapiens
tgaaaatatttacaat

SEQ ID NO: 142345 - DNA, 16 bp, H. sapiens
tgaaaatatttccttt

SEQ ID NO: 142346 - DNA, 16 bp, H. sapiens
tgaaaatattttggaa

SEQ ID NO: 142347 - DNA, 16 bp, H. sapiens
tgaaaatatttttgaa

SEQ ID NO: 142348 - DNA, 16 bp, H. sapiens
tgaaaatcaaatttca

SEQ ID NO: 142349 - DNA, 16 bp, H. sapiens
tgaaaatcaaggagaa

SEQ ID NO: 142350 - DNA, 16 bp, H. sapiens
tgaaaatcacaagcat

SEQ ID NO: 142351 - DNA, 16 bp, H. sapiens
tgaaaatcagatggtt

SEQ ID NO: 142352 - DNA, 16 bp, H. sapiens
tgaaaatcatttttta

SEQ ID NO: 142353 - DNA, 16 bp, H. sapiens
tgaaaatccagatttt

SEQ ID NO: 142354 - DNA, 17 bp, H. sapiens
tgaaaatccccacataa

SEQ ID NO: 142355 - DNA, 16 bp, H. sapiens
tgaaaatcctcaacaa

SEQ ID NO: 142356 - DNA, 16 bp, H. sapiens
tgaaaatctaaaaata

SEQ ID NO: 142357 - DNA, 16 bp, H. sapiens
tgaaaatctattttta

SEQ ID NO: 142358 - DNA, 16 bp, H. sapiens
tgaaaatcttttcatg

SEQ ID NO: 142359 - DNA, 16 bp, H. sapiens
tgaaaatgaaaaacag

SEQ ID NO: 142360 - DNA, 16 bp, H. sapiens
tgaaaatgaaaacaca

SEQ ID NO: 142361 - DNA, 16 bp, H. sapiens
tgaaaatgaaaataca

SEQ ID NO: 142362 - DNA, 16 bp, H. sapiens
tgaaaatgaaaccaaa

SEQ ID NO: 142363 - DNA, 16 bp, H. sapiens
tgaaaatgaaagaaca

SEQ ID NO: 142364 - DNA, 16 bp, H. sapiens
tgaaaatgaaagattt

SEQ ID NO: 142365 - DNA, 16 bp, H. sapiens
tgaaaatgaaatggaa

SEQ ID NO: 142366 - DNA, 16 bp, H. sapiens
tgaaaatgaacaaagt

SEQ ID NO: 142367 - DNA, 16 bp, H. sapiens
tgaaaatgaacagaat

SEQ ID NO: 142368 - DNA, 16 bp, H. sapiens
tgaaaatgaactaata

SEQ ID NO: 142369 - DNA, 16 bp, H. sapiens
tgaaaatgaatgaatg

SEQ ID NO: 142370 - DNA, 16 bp, H. sapiens
tgaaaatgaatgaatt

SEQ ID NO: 142371 - DNA, 16 bp, H. sapiens
tgaaaatgaatttttt

SEQ ID NO: 142372 - DNA, 16 bp, H. sapiens
tgaaaatgaccatgct

SEQ ID NO: 142373 - DNA, 16 bp, H. sapiens
tgaaaatgactatact

SEQ ID NO: 142374 - DNA, 16 bp, H. sapiens
tgaaaatgactatttt

SEQ ID NO: 142375 - DNA, 16 bp, H. sapiens
tgaaaatgagaaaaca

SEQ ID NO: 142376 - DNA, 16 bp, H. sapiens
tgaaaatgaggaactt

SEQ ID NO: 142377 - DNA, 16 bp, H. sapiens
tgaaaatgataaattt

SEQ ID NO: 142378 - DNA, 16 bp, H. sapiens
tgaaaatgataatttt

SEQ ID NO: 142379 - DNA, 16 bp, H. sapiens
tgaaaatgatatttat

SEQ ID NO: 142380 - DNA, 16 bp, H. sapiens
tgaaaatgattttgaa

SEQ ID NO: 142381 - DNA, 16 bp, H. sapiens
tgaaaatgatttttca

SEQ ID NO: 142382 - DNA, 16 bp, H. sapiens
tgaaaatgcagagaaa

SEQ ID NO: 142383 - DNA, 16 bp, H. sapiens
tgaaaatgcagttttt

SEQ ID NO: 142384 - DNA, 16 bp, H. sapiens
tgaaaatgctcagtta

SEQ ID NO: 142385 - DNA, 16 bp, H. sapiens
tgaaaatgctttatga

SEQ ID NO: 142386 - DNA, 16 bp, H. sapiens
tgaaaatgctttgaaa

SEQ ID NO: 142387 - DNA, 16 bp, H. sapiens
tgaaaatggaaatatt

SEQ ID NO: 142388 - DNA, 16 bp, H. sapiens
tgaaaatggacatact

SEQ ID NO: 142389 - DNA, 16 bp, H. sapiens
tgaaaatggactaata

SEQ ID NO: 142390 - DNA, 16 bp, H. sapiens
tgaaaatggactcata

SEQ ID NO: 142391 - DNA, 16 bp, H. sapiens
tgaaaatggcagaatt

SEQ ID NO: 142392 - DNA, 16 bp, H. sapiens
tgaaaatggcatttta

SEQ ID NO: 142393 - DNA, 16 bp, H. sapiens
tgaaaatggccatcct

SEQ ID NO: 142394 - DNA, 16 bp, H. sapiens
tgaaaatggctatact

SEQ ID NO: 142395 - DNA, 16 bp, H. sapiens
tgaaaatggtatttca

SEQ ID NO: 142396 - DNA, 16 bp, H. sapiens
tgaaaatggtcatact

SEQ ID NO: 142397 - DNA, 16 bp, H. sapiens
tgaaaatgtatgcaaa

SEQ ID NO: 142398 - DNA, 16 bp, H. sapiens
tgaaaatgtatttctt

SEQ ID NO: 142399 - DNA, 16 bp, H. sapiens
tgaaaatgtcccaaat

SEQ ID NO: 142400 - DNA, 16 bp, H. sapiens
tgaaaatgtgaagaaa

SEQ ID NO: 142401 - DNA, 16 bp, H. sapiens
tgaaaatgtgaatgaa

SEQ ID NO: 142402 - DNA, 16 bp, H. sapiens
tgaaaatgtgactgaa

SEQ ID NO: 142403 - DNA, 16 bp, H. sapiens
tgaaaatgtgatagaa

SEQ ID NO: 142404 - DNA, 16 bp, H. sapiens
tgaaaatgtgcatttt

SEQ ID NO: 142405 - DNA, 16 bp, H. sapiens
tgaaaatgtggaagca

SEQ ID NO: 142406 - DNA, 16 bp, H. sapiens
tgaaaatgttaaatat

SEQ ID NO: 142407 - DNA, 16 bp, H. sapiens
tgaaaatgttaagaaa

SEQ ID NO: 142408 - DNA, 16 bp, H. sapiens
tgaaaatgttattaaa

SEQ ID NO: 142409 - DNA, 16 bp, H. sapiens
tgaaaatgttcagaaa

SEQ ID NO: 142410 - DNA, 16 bp, H. sapiens
tgaaaatgttctcaaa

SEQ ID NO: 142411 - DNA, 16 bp, H. sapiens
tgaaaatgttctggag

SEQ ID NO: 142412 - DNA, 16 bp, H. sapiens
tgaaaatgtttccatt

SEQ ID NO: 142413 - DNA, 16 bp, H. sapiens
tgaaaatgttttaatt

SEQ ID NO: 142414 - DNA, 16 bp, H. sapiens
tgaaaatgttttacat

SEQ ID NO: 142415 - DNA, 16 bp, H. sapiens
tgaaaatgttttagaa

SEQ ID NO: 142416 - DNA, 16 bp, H. sapiens
tgaaaatgttttcaaa

SEQ ID NO: 142417 - DNA, 16 bp, H. sapiens
tgaaaatgttttggaa

SEQ ID NO: 142418 - DNA, 16 bp, H. sapiens
tgaaaatgtttttaaa

SEQ ID NO: 142419 - DNA, 16 bp, H. sapiens
tgaaaattaaatggaa

SEQ ID NO: 142420 - DNA, 16 bp, H. sapiens
tgaaaattaaattctt

SEQ ID NO: 142421 - DNA, 16 bp, H. sapiens
tgaaaattaagatttt

SEQ ID NO: 142422 - DNA, 16 bp, H. sapiens
tgaaaattacaaaatg

SEQ ID NO: 142423 - DNA, 16 bp, H. sapiens
tgaaaattatttcctt

SEQ ID NO: 142424 - DNA, 16 bp, H. sapiens
tgaaaattatttgact

SEQ ID NO: 142425 - DNA, 16 bp, H. sapiens
tgaaaattcagagaaa

SEQ ID NO: 142426 - DNA, 16 bp, H. sapiens
tgaaaattcatgtaca

SEQ ID NO: 142427 - DNA, 16 bp, H. sapiens
tgaaaattccaaaatc

SEQ ID NO: 142428 - DNA, 16 bp, H. sapiens
tgaaaattcctcaaaa

SEQ ID NO: 142429 - DNA, 16 bp, H. sapiens
tgaaaattctaagaaa

SEQ ID NO: 142430 - DNA, 16 bp, H. sapiens
tgaaaattggactgtt

SEQ ID NO: 142431 - DNA, 16 bp, H. sapiens
tgaaaattgtgtattt

SEQ ID NO: 142432 - DNA, 16 bp, H. sapiens
tgaaaattgttttgtt

SEQ ID NO: 142433 - DNA, 16 bp, H. sapiens
tgaaaatttcagaaaa

SEQ ID NO: 142434 - DNA, 16 bp, H. sapiens
tgaaaatttccccaaa

SEQ ID NO: 142435 - DNA, 16 bp, H. sapiens
tgaaaatttcttttta

SEQ ID NO: 142436 - DNA, 16 bp, H. sapiens
tgaaaatttgaaatat

SEQ ID NO: 142437 - DNA, 16 bp, H. sapiens
tgaaaatttggaaaat

SEQ ID NO: 142438 - DNA, 16 bp, H. sapiens
tgaaaattttaaacaa

SEQ ID NO: 142439 - DNA, 16 bp, H. sapiens
tgaaaattttcaaaca

SEQ ID NO: 142440 - DNA, 16 bp, H. sapiens
tgaaaattttcagaaa

SEQ ID NO: 142441 - DNA, 16 bp, H. sapiens
tgaaaattttctttta

SEQ ID NO: 142442 - DNA, 16 bp, H. sapiens
tgaaaatttttacatt

SEQ ID NO: 142443 - DNA, 16 bp, H. sapiens
tgaaacaaaatgaaac

SEQ ID NO: 142444 - DNA, 16 bp, H. sapiens
tgaaacaaaattgaaa

SEQ ID NO: 142445 - DNA, 16 bp, H. sapiens
tgaaacaaatgaaaat

SEQ ID NO: 142446 - DNA, 16 bp, H. sapiens
tgaaacaaatgaaagt

SEQ ID NO: 142447 - DNA, 16 bp, H. sapiens
tgaaacaaatgaacat

SEQ ID NO: 142448 - DNA, 16 bp, H. sapiens
tgaaacaaatgaagat

SEQ ID NO: 142449 - DNA, 16 bp, H. sapiens
tgaaacaaatgaattt

SEQ ID NO: 142450 - DNA, 16 bp, H. sapiens
tgaaacaagaaggcag

SEQ ID NO: 142451 - DNA, 16 bp, H. sapiens
tgaaacaagcaaacaa

SEQ ID NO: 142452 - DNA, 16 bp, H. sapiens
tgaaacacagagagaa

SEQ ID NO: 142453 - DNA, 16 bp, H. sapiens
tgaaacactagttcag

SEQ ID NO: 142454 - DNA, 16 bp, H. sapiens
tgaaacactcttttgt

SEQ ID NO: 142455 - DNA, 16 bp, H. sapiens
tgaaacactttcttcc

SEQ ID NO: 142456 - DNA, 16 bp, H. sapiens
tgaaacagaaaataat

SEQ ID NO: 142457 - DNA, 16 bp, H. sapiens
tgaaacagaaacagaa

SEQ ID NO: 142458 - DNA, 16 bp, H. sapiens
tgaaacagaagagaaa

SEQ ID NO: 142459 - DNA, 16 bp, H. sapiens
tgaaacagaagagaga

SEQ ID NO: 142460 - DNA, 16 bp, H. sapiens
tgaaacagaatataaa

SEQ ID NO: 142461 - DNA, 16 bp, H. sapiens
tgaaacagaatgaaat

SEQ ID NO: 142462 - DNA, 16 bp, H. sapiens
tgaaacagagaagaaa

SEQ ID NO: 142463 - DNA, 16 bp, H. sapiens
tgaaacagaggctaga

SEQ ID NO: 142464 - DNA, 16 bp, H. sapiens
tgaaacagatttttaa

SEQ ID NO: 142465 - DNA, 16 bp, H. sapiens
tgaaacagcctcaggc

SEQ ID NO: 142466 - DNA, 16 bp, H. sapiens
tgaaacaggaaatttt

SEQ ID NO: 142467 - DNA, 16 bp, H. sapiens
tgaaacatctctacaa

SEQ ID NO: 142468 - DNA, 16 bp, H. sapiens
tgaaacatgaaagaaa

SEQ ID NO: 142469 - DNA, 16 bp, H. sapiens
tgaaacatgtaaaata

SEQ ID NO: 142470 - DNA, 16 bp, H. sapiens
tgaaacattcattttt

SEQ ID NO: 142471 - DNA, 16 bp, H. sapiens
tgaaacatttcttcaa

SEQ ID NO: 142472 - DNA, 16 bp, H. sapiens
tgaaacatttttattt

SEQ ID NO: 142473 - DNA, 16 bp, H. sapiens
tgaaacattttttttt

SEQ ID NO: 142474 - DNA, 16 bp, H. sapiens
tgaaaccacagacagt

SEQ ID NO: 142475 - DNA, 16 bp, H. sapiens
tgaaaccagaaaaaga

SEQ ID NO: 142476 - DNA, 16 bp, H. sapiens
tgaaaccagaaggtgg

SEQ ID NO: 142477 - DNA, 16 bp, H. sapiens
tgaaaccagcagcaca

SEQ ID NO: 142478 - DNA, 16 bp, H. sapiens
tgaaaccagcctgggt

SEQ ID NO: 142479 - DNA, 16 bp, H. sapiens
tgaaaccaggcagtct

SEQ ID NO: 142480 - DNA, 16 bp, H. sapiens
tgaaaccaggtctcta

SEQ ID NO: 142481 - DNA, 16 bp, H. sapiens
tgaaaccataaaaatt

SEQ ID NO: 142482 - DNA, 16 bp, H. sapiens
tgaaaccattccaaaa

SEQ ID NO: 142483 - DNA, 16 bp, H. sapiens
tgaaaccccatcccta

SEQ ID NO: 142484 - DNA, 16 bp, H. sapiens
tgaaaccccatctctt

SEQ ID NO: 142485 - DNA, 20 bp, H. sapiens
tgaaaccccgtctctactaa

SEQ ID NO: 142486 - DNA, 22 bp, H. sapiens
tgaaaccccttctctactaaaa

SEQ ID NO: 142487 - DNA, 16 bp, H. sapiens
tgaaacccggtctcta

SEQ ID NO: 142488 - DNA, 16 bp, H. sapiens
tgaaaccctgtcccta

SEQ ID NO: 142489 - DNA, 16 bp, H. sapiens
tgaaacctaatcacca

SEQ ID NO: 142490 - DNA, 16 bp, H. sapiens
tgaaacctaatctcta

SEQ ID NO: 142491 - DNA, 16 bp, H. sapiens
tgaaacctcatctctc

SEQ ID NO: 142492 - DNA, 16 bp, H. sapiens
tgaaacctcatctctt

SEQ ID NO: 142493 - DNA, 16 bp, H. sapiens
tgaaacctccaactcc

SEQ ID NO: 142494 - DNA, 16 bp, H. sapiens
tgaaacctccatctcc

SEQ ID NO: 142495 - DNA, 16 bp, H. sapiens
tgaaacctcgtcttta

SEQ ID NO: 142496 - DNA, 16 bp, H. sapiens
tgaaacctctgcttcc

SEQ ID NO: 142497 - DNA, 16 bp, H. sapiens
tgaaaccttgtctcta

SEQ ID NO: 142498 - DNA, 16 bp, H. sapiens
tgaaactaaagcaaat

SEQ ID NO: 142499 - DNA, 16 bp, H. sapiens
tgaaactaatgagaaa

SEQ ID NO: 142500 - DNA, 16 bp, H. sapiens
tgaaactaattttaaa

SEQ ID NO: 142501 - DNA, 16 bp, H. sapiens
tgaaactattccagaa

SEQ ID NO: 142502 - DNA, 16 bp, H. sapiens
tgaaactatttcaaat

SEQ ID NO: 142503 - DNA, 16 bp, H. sapiens
tgaaactcagtctcta

SEQ ID NO: 142504 - DNA, 16 bp, H. sapiens
tgaaactcagttttct

SEQ ID NO: 142505 - DNA, 16 bp, H. sapiens
tgaaactccaccttca

SEQ ID NO: 142506 - DNA, 16 bp, H. sapiens
tgaaactccatctctc

SEQ ID NO: 142507 - DNA, 18 bp, H. sapiens
tgaaactccgtctcaaaa

SEQ ID NO: 142508 - DNA, 16 bp, H. sapiens
tgaaactctgtctcta

SEQ ID NO: 142509 - DNA, 16 bp, H. sapiens
tgaaactgaaacaaca

SEQ ID NO: 142510 - DNA, 16 bp, H. sapiens
tgaaactgaggctcag

SEQ ID NO: 142511 - DNA, 16 bp, H. sapiens
tgaaactgatttcaga

SEQ ID NO: 142512 - DNA, 16 bp, H. sapiens
tgaaactgcacccctt

SEQ ID NO: 142513 - DNA, 16 bp, H. sapiens
tgaaactgcagacctt

SEQ ID NO: 142514 - DNA, 16 bp, H. sapiens
tgaaactgctccacct

SEQ ID NO: 142515 - DNA, 16 bp, H. sapiens
tgaaactggaaccctt

SEQ ID NO: 142516 - DNA, 16 bp, H. sapiens
tgaaactggacacctt

SEQ ID NO: 142517 - DNA, 16 bp, H. sapiens
tgaaactggaggatat

SEQ ID NO: 142518 - DNA, 16 bp, H. sapiens
tgaaactgtctaaaaa

SEQ ID NO: 142519 - DNA, 16 bp, H. sapiens
tgaaactgtctcaaaa

SEQ ID NO: 142520 - DNA, 16 bp, H. sapiens
tgaaactgtgtaattt

SEQ ID NO: 142521 - DNA, 16 bp, H. sapiens
tgaaacttatatttgt

SEQ ID NO: 142522 - DNA, 16 bp, H. sapiens
tgaaacttccttttga

SEQ ID NO: 142523 - DNA, 16 bp, H. sapiens
tgaaacttctagaaga

SEQ ID NO: 142524 - DNA, 16 bp, H. sapiens
tgaaacttctgatatt

SEQ ID NO: 142525 - DNA, 16 bp, H. sapiens
tgaaagaaaacaaagt

SEQ ID NO: 142526 - DNA, 16 bp, H. sapiens
tgaaagaaaaggatat

SEQ ID NO: 142527 - DNA, 16 bp, H. sapiens
tgaaagaaaagtattt

SEQ ID NO: 142528 - DNA, 16 bp, H. sapiens
tgaaagaaaataacat

SEQ ID NO: 142529 - DNA, 16 bp, H. sapiens
tgaaagaaaatcattt

SEQ ID NO: 142530 - DNA, 16 bp, H. sapiens
tgaaagaaaatgtgtt

SEQ ID NO: 142531 - DNA, 16 bp, H. sapiens
tgaaagaaaccacaga

SEQ ID NO: 142532 - DNA, 16 bp, H. sapiens
tgaaagaaaggtttaa

SEQ ID NO: 142533 - DNA, 16 bp, H. sapiens
tgaaagaaatacattt

SEQ ID NO: 142534 - DNA, 16 bp, H. sapiens
tgaaagaaatcaaaga

SEQ ID NO: 142535 - DNA, 16 bp, H. sapiens
tgaaagaaatcacagg

SEQ ID NO: 142536 - DNA, 16 bp, H. sapiens
tgaaagaaatcatttt

SEQ ID NO: 142537 - DNA, 16 bp, H. sapiens
tgaaagaaatgtttaa

SEQ ID NO: 142538 - DNA, 16 bp, H. sapiens
tgaaagaaattaaaca

SEQ ID NO: 142539 - DNA, 16 bp, H. sapiens
tgaaagaaattagaga

SEQ ID NO: 142540 - DNA, 16 bp, H. sapiens
tgaaagaacaaatgaa

SEQ ID NO: 142541 - DNA, 16 bp, H. sapiens
tgaaagaacagacaaa

SEQ ID NO: 142542 - DNA, 16 bp, H. sapiens
tgaaagaacattttct

SEQ ID NO: 142543 - DNA, 16 bp, H. sapiens
tgaaagaagaaatgtt

SEQ ID NO: 142544 - DNA, 16 bp, H. sapiens
tgaaagaagcaagaca

SEQ ID NO: 142545 - DNA, 16 bp, H. sapiens
tgaaagaagccagtgt

SEQ ID NO: 142546 - DNA, 16 bp, H. sapiens
tgaaagaatacatttt

SEQ ID NO: 142547 - DNA, 16 bp, H. sapiens
tgaaagaatcacttga

SEQ ID NO: 142548 - DNA, 16 bp, H. sapiens
tgaaagaattaatgaa

SEQ ID NO: 142549 - DNA, 16 bp, H. sapiens
tgaaagaatttgaaga

SEQ ID NO: 142550 - DNA, 16 bp, H. sapiens
tgaaagacaaagacag

SEQ ID NO: 142551 - DNA, 16 bp, H. sapiens
tgaaagacaagaaaga

SEQ ID NO: 142552 - DNA, 16 bp, H. sapiens
tgaaagacagaaaaca

SEQ ID NO: 142553 - DNA, 16 bp, H. sapiens
tgaaagacagtgtggc

SEQ ID NO: 142554 - DNA, 16 bp, H. sapiens
tgaaagacatacattt

SEQ ID NO: 142555 - DNA, 16 bp, H. sapiens
tgaaagacctttacaa

SEQ ID NO: 142556 - DNA, 16 bp, H. sapiens
tgaaagactgaatatt

SEQ ID NO: 142557 - DNA, 16 bp, H. sapiens
tgaaagactgaggcag

SEQ ID NO: 142558 - DNA, 16 bp, H. sapiens
tgaaagagaaaatgca

SEQ ID NO: 142559 - DNA, 16 bp, H. sapiens
tgaaagagaaagacag

SEQ ID NO: 142560 - DNA, 16 bp, H. sapiens
tgaaagagaaatacat

SEQ ID NO: 142561 - DNA, 16 bp, H. sapiens
tgaaagagaaattaag

SEQ ID NO: 142562 - DNA, 16 bp, H. sapiens
tgaaagagaagaaatt

SEQ ID NO: 142563 - DNA, 16 bp, H. sapiens
tgaaagagagaaaaca

SEQ ID NO: 142564 - DNA, 16 bp, H. sapiens
tgaaagagatggggag

SEQ ID NO: 142565 - DNA, 16 bp, H. sapiens
tgaaagagattttaaa

SEQ ID NO: 142566 - DNA, 16 bp, H. sapiens
tgaaagagatttttaa

SEQ ID NO: 142567 - DNA, 16 bp, H. sapiens
tgaaagagctccaaat

SEQ ID NO: 142568 - DNA, 16 bp, H. sapiens
tgaaagagctgtaaca

SEQ ID NO: 142569 - DNA, 16 bp, H. sapiens
tgaaagaggaaacatt

SEQ ID NO: 142570 - DNA, 16 bp, H. sapiens
tgaaagagtgaatgaa

SEQ ID NO: 142571 - DNA, 16 bp, H. sapiens
tgaaagagtttgtgaa

SEQ ID NO: 142572 - DNA, 16 bp, H. sapiens
tgaaagatattttcat

SEQ ID NO: 142573 - DNA, 16 bp, H. sapiens
tgaaagatctctacaa

SEQ ID NO: 142574 - DNA, 16 bp, H. sapiens
tgaaagatgtcacttt

SEQ ID NO: 142575 - DNA, 16 bp, H. sapiens
tgaaagatgtctacaa

SEQ ID NO: 142576 - DNA, 16 bp, H. sapiens
tgaaagatttctctat

SEQ ID NO: 142577 - DNA, 16 bp, H. sapiens
tgaaagatttttcaaa

SEQ ID NO: 142578 - DNA, 16 bp, H. sapiens
tgaaagcaacaagaaa

SEQ ID NO: 142579 - DNA, 16 bp, H. sapiens
tgaaagcaaccaggag

SEQ ID NO: 142580 - DNA, 16 bp, H. sapiens
tgaaagcagccagaaa

SEQ ID NO: 142581 - DNA, 16 bp, H. sapiens
tgaaagcagccagaag

SEQ ID NO: 142582 - DNA, 16 bp, H. sapiens
tgaaagcagccaggaa

SEQ ID NO: 142583 - DNA, 16 bp, H. sapiens
tgaaagcagccaggag

SEQ ID NO: 142584 - DNA, 16 bp, H. sapiens
tgaaagcagccatggg

SEQ ID NO: 142585 - DNA, 16 bp, H. sapiens
tgaaagcagctgagag

SEQ ID NO: 142586 - DNA, 16 bp, H. sapiens
tgaaagcaggagcaag

SEQ ID NO: 142587 - DNA, 16 bp, H. sapiens
tgaaagcattcccttt

SEQ ID NO: 142588 - DNA, 16 bp, H. sapiens
tgaaagcatttaaaat

SEQ ID NO: 142589 - DNA, 16 bp, H. sapiens
tgaaagcattttctct

SEQ ID NO: 142590 - DNA, 16 bp, H. sapiens
tgaaagccaaaataaa

SEQ ID NO: 142591 - DNA, 16 bp, H. sapiens
tgaaagccatcatcct

SEQ ID NO: 142592 - DNA, 16 bp, H. sapiens
tgaaagcccagacttc

SEQ ID NO: 142593 - DNA, 16 bp, H. sapiens
tgaaagccttttctct

SEQ ID NO: 142594 - DNA, 16 bp, H. sapiens
tgaaagctctgctttt

SEQ ID NO: 142595 - DNA, 16 bp, H. sapiens
tgaaagctgagagagg

SEQ ID NO: 142596 - DNA, 16 bp, H. sapiens
tgaaagcttaaggaga

SEQ ID NO: 142597 - DNA, 16 bp, H. sapiens
tgaaaggaaattaaat

SEQ ID NO: 142598 - DNA, 16 bp, H. sapiens
tgaaaggaagagtcaa

SEQ ID NO: 142599 - DNA, 16 bp, H. sapiens
tgaaaggaagataaat

SEQ ID NO: 142600 - DNA, 16 bp, H. sapiens
tgaaaggaatcttttt

SEQ ID NO: 142601 - DNA, 16 bp, H. sapiens
tgaaaggaattgaaga

SEQ ID NO: 142602 - DNA, 16 bp, H. sapiens
tgaaaggagccaggag

SEQ ID NO: 142603 - DNA, 16 bp, H. sapiens
tgaaaggatgggaaaa

SEQ ID NO: 142604 - DNA, 16 bp, H. sapiens
tgaaaggatgttgaat

SEQ ID NO: 142605 - DNA, 16 bp, H. sapiens
tgaaaggcaaggagga

SEQ ID NO: 142606 - DNA, 16 bp, H. sapiens
tgaaaggtggaggttg

SEQ ID NO: 142607 - DNA, 16 bp, H. sapiens
tgaaaggttttaagca

SEQ ID NO: 142608 - DNA, 16 bp, H. sapiens
tgaaagtaagcctctt

SEQ ID NO: 142609 - DNA, 16 bp, H. sapiens
tgaaagtaagtttatt

SEQ ID NO: 142610 - DNA, 16 bp, H. sapiens
tgaaagtacagagatt

SEQ ID NO: 142611 - DNA, 17 bp, H. sapiens
tgaaagtactaaaagtc

SEQ ID NO: 142612 - DNA, 16 bp, H. sapiens
tgaaagtcagtgtggc

SEQ ID NO: 142613 - DNA, 16 bp, H. sapiens
tgaaagtcattttttt

SEQ ID NO: 142614 - DNA, 16 bp, H. sapiens
tgaaagtctgaaatcc

SEQ ID NO: 142615 - DNA, 16 bp, H. sapiens
tgaaagtgaaaaacaa

SEQ ID NO: 142616 - DNA, 16 bp, H. sapiens
tgaaagtgaaaaacag

SEQ ID NO: 142617 - DNA, 16 bp, H. sapiens
tgaaagtgaagaaaat

SEQ ID NO: 142618 - DNA, 16 bp, H. sapiens
tgaaagtgatgaggag

SEQ ID NO: 142619 - DNA, 16 bp, H. sapiens
tgaaagtgcctgctcc

SEQ ID NO: 142620 - DNA, 16 bp, H. sapiens
tgaaagtgctgagatt

SEQ ID NO: 142621 - DNA, 16 bp, H. sapiens
tgaaagtgctttgcaa

SEQ ID NO: 142622 - DNA, 16 bp, H. sapiens
tgaaagtggacatctt

SEQ ID NO: 142623 - DNA, 16 bp, H. sapiens
tgaaagtggacccctt

SEQ ID NO: 142624 - DNA, 16 bp, H. sapiens
tgaaagtggctacact

SEQ ID NO: 142625 - DNA, 16 bp, H. sapiens
tgaaagtgggaatcct

SEQ ID NO: 142626 - DNA, 16 bp, H. sapiens
tgaaagtgttgggatt

SEQ ID NO: 142627 - DNA, 16 bp, H. sapiens
tgaaagtttcttttga

SEQ ID NO: 142628 - DNA, 16 bp, H. sapiens
tgaaagtttctttttt

SEQ ID NO: 142629 - DNA, 16 bp, H. sapiens
tgaaagtttgtcttca

SEQ ID NO: 142630 - DNA, 16 bp, H. sapiens
tgaaagttttaaaaat

SEQ ID NO: 142631 - DNA, 16 bp, H. sapiens
tgaaagttttgaaaaa

SEQ ID NO: 142632 - DNA, 16 bp, H. sapiens
tgaaataaaaactgaa

SEQ ID NO: 142633 - DNA, 16 bp, H. sapiens
tgaaataaaaattttg

SEQ ID NO: 142634 - DNA, 16 bp, H. sapiens
tgaaataaaacagaat

SEQ ID NO: 142635 - DNA, 16 bp, H. sapiens
tgaaataaaactaaat

SEQ ID NO: 142636 - DNA, 16 bp, H. sapiens
tgaaataaaatatttg

SEQ ID NO: 142637 - DNA, 16 bp, H. sapiens
tgaaataaaatgtgag

SEQ ID NO: 142638 - DNA, 16 bp, H. sapiens
tgaaataaaattcatt

SEQ ID NO: 142639 - DNA, 16 bp, H. sapiens
tgaaataaaccaaaca

SEQ ID NO: 142640 - DNA, 16 bp, H. sapiens
tgaaataaactgaaga

SEQ ID NO: 142641 - DNA, 16 bp, H. sapiens
tgaaataaatatcaaa

SEQ ID NO: 142642 - DNA, 16 bp, H. sapiens
tgaaataaatattcat

SEQ ID NO: 142643 - DNA, 16 bp, H. sapiens
tgaaataaatatttca

SEQ ID NO: 142644 - DNA, 16 bp, H. sapiens
tgaaataaatgaatga

SEQ ID NO: 142645 - DNA, 16 bp, H. sapiens
tgaaataaatggaaat

SEQ ID NO: 142646 - DNA, 16 bp, H. sapiens
tgaaataaatgttctt

SEQ ID NO: 142647 - DNA, 16 bp, H. sapiens
tgaaataactgaaaaa

SEQ ID NO: 142648 - DNA, 16 bp, H. sapiens
tgaaataagacaagaa

SEQ ID NO: 142649 - DNA, 16 bp, H. sapiens
tgaaataagacaggaa

SEQ ID NO: 142650 - DNA, 16 bp, H. sapiens
tgaaataagacagtca

SEQ ID NO: 142651 - DNA, 16 bp, H. sapiens
tgaaataaggcacaga

SEQ ID NO: 142652 - DNA, 16 bp, H. sapiens
tgaaataagtattatt

SEQ ID NO: 142653 - DNA, 16 bp, H. sapiens
tgaaataatctttaca

SEQ ID NO: 142654 - DNA, 16 bp, H. sapiens
tgaaataatgaatgtg

SEQ ID NO: 142655 - DNA, 16 bp, H. sapiens
tgaaataatttttgtg

SEQ ID NO: 142656 - DNA, 16 bp, H. sapiens
tgaaatacaaaaatta

SEQ ID NO: 142657 - DNA, 16 bp, H. sapiens
tgaaatacaatttttt

SEQ ID NO: 142658 - DNA, 16 bp, H. sapiens
tgaaatacagcaaaag

SEQ ID NO: 142659 - DNA, 16 bp, H. sapiens
tgaaatacctaagaat

SEQ ID NO: 142660 - DNA, 16 bp, H. sapiens
tgaaatacctagaaat

SEQ ID NO: 142661 - DNA, 16 bp, H. sapiens
tgaaatactgaaagct

SEQ ID NO: 142662 - DNA, 16 bp, H. sapiens
tgaaatactgaaatat

SEQ ID NO: 142663 - DNA, 16 bp, H. sapiens
tgaaatactgcaagaa

SEQ ID NO: 142664 - DNA, 16 bp, H. sapiens
tgaaatacttaaaaaa

SEQ ID NO: 142665 - DNA, 16 bp, H. sapiens
tgaaatactttcttct

SEQ ID NO: 142666 - DNA, 16 bp, H. sapiens
tgaaatagaaaatctg

SEQ ID NO: 142667 - DNA, 16 bp, H. sapiens
tgaaatagaaagcaga

SEQ ID NO: 142668 - DNA, 16 bp, H. sapiens
tgaaataggtattatt

SEQ ID NO: 142669 - DNA, 16 bp, H. sapiens
tgaaatataaaataca

SEQ ID NO: 142670 - DNA, 16 bp, H. sapiens
tgaaatatcattttta

SEQ ID NO: 142671 - DNA, 16 bp, H. sapiens
tgaaatatctaaaata

SEQ ID NO: 142672 - DNA, 16 bp, H. sapiens
tgaaatatctctacaa

SEQ ID NO: 142673 - DNA, 16 bp, H. sapiens
tgaaatatgaaaagga

SEQ ID NO: 142674 - DNA, 16 bp, H. sapiens
tgaaatatgcaataaa

SEQ ID NO: 142675 - DNA, 16 bp, H. sapiens
tgaaatatgcatttta

SEQ ID NO: 142676 - DNA, 16 bp, H. sapiens
tgaaatatggaaagaa

SEQ ID NO: 142677 - DNA, 16 bp, H. sapiens
tgaaatatgtttttgt

SEQ ID NO: 142678 - DNA, 16 bp, H. sapiens
tgaaatattatttcac

SEQ ID NO: 142679 - DNA, 16 bp, H. sapiens
tgaaatatttaaagtg

SEQ ID NO: 142680 - DNA, 16 bp, H. sapiens
tgaaatatttagaagt

SEQ ID NO: 142681 - DNA, 16 bp, H. sapiens
tgaaatatttcaatat

SEQ ID NO: 142682 - DNA, 16 bp, H. sapiens
tgaaatatttcagaca

SEQ ID NO: 142683 - DNA, 16 bp, H. sapiens
tgaaatatttcataaa

SEQ ID NO: 142684 - DNA, 16 bp, H. sapiens
tgaaatatttctactt

SEQ ID NO: 142685 - DNA, 16 bp, H. sapiens
tgaaatatttgaatat

SEQ ID NO: 142686 - DNA, 16 bp, H. sapiens
tgaaatatttgcatat

SEQ ID NO: 142687 - DNA, 16 bp, H. sapiens
tgaaatatttgttgaa

SEQ ID NO: 142688 - DNA, 16 bp, H. sapiens
tgaaatattttaagtg

SEQ ID NO: 142689 - DNA, 16 bp, H. sapiens
tgaaatattttattca

SEQ ID NO: 142690 - DNA, 16 bp, H. sapiens
tgaaatattttcttga

SEQ ID NO: 142691 - DNA, 16 bp, H. sapiens
tgaaatattttgagat

SEQ ID NO: 142692 - DNA, 16 bp, H. sapiens
tgaaatatttttttct

SEQ ID NO: 142693 - DNA, 16 bp, H. sapiens
tgaaatcaaagacagg

SEQ ID NO: 142694 - DNA, 16 bp, H. sapiens
tgaaatcagtatctca

SEQ ID NO: 142695 - DNA, 16 bp, H. sapiens
tgaaatcatacaacat

SEQ ID NO: 142696 - DNA, 16 bp, H. sapiens
tgaaatcatacagtat

SEQ ID NO: 142697 - DNA, 16 bp, H. sapiens
tgaaatcatgtagtat

SEQ ID NO: 142698 - DNA, 16 bp, H. sapiens
tgaaatcattttgaaa

SEQ ID NO: 142699 - DNA, 16 bp, H. sapiens
tgaaatccaaaatgct

SEQ ID NO: 142700 - DNA, 16 bp, H. sapiens
tgaaatccaggctgaa

SEQ ID NO: 142701 - DNA, 16 bp, H. sapiens
tgaaatccaggtggag

SEQ ID NO: 142702 - DNA, 16 bp, H. sapiens
tgaaatcccaactact

SEQ ID NO: 142703 - DNA, 17 bp, H. sapiens
tgaaatcccagctactc

SEQ ID NO: 142704 - DNA, 16 bp, H. sapiens
tgaaatcctaacctct

SEQ ID NO: 142705 - DNA, 16 bp, H. sapiens
tgaaatctactttatc

SEQ ID NO: 142706 - DNA, 16 bp, H. sapiens
tgaaatctatttttaa

SEQ ID NO: 142707 - DNA, 16 bp, H. sapiens
tgaaatctgggcagag

SEQ ID NO: 142708 - DNA, 16 bp, H. sapiens
tgaaatctgggctttt

SEQ ID NO: 142709 - DNA, 16 bp, H. sapiens
tgaaatcttgaacccc

SEQ ID NO: 142710 - DNA, 16 bp, H. sapiens
tgaaatctttctagct

SEQ ID NO: 142711 - DNA, 16 bp, H. sapiens
tgaaatgaaaatattt

SEQ ID NO: 142712 - DNA, 16 bp, H. sapiens
tgaaatgaaaatggaa

SEQ ID NO: 142713 - DNA, 16 bp, H. sapiens
tgaaatgaaacatttt

SEQ ID NO: 142714 - DNA, 16 bp, H. sapiens
tgaaatgaaagaatat

SEQ ID NO: 142715 - DNA, 16 bp, H. sapiens
tgaaatgaaagaggac

SEQ ID NO: 142716 - DNA, 16 bp, H. sapiens
tgaaatgaagcaagaa

SEQ ID NO: 142717 - DNA, 16 bp, H. sapiens
tgaaatgaagctagaa

SEQ ID NO: 142718 - DNA, 16 bp, H. sapiens
tgaaatgaatgaaaag

SEQ ID NO: 142719 - DNA, 16 bp, H. sapiens
tgaaatgaatgcacat

SEQ ID NO: 142720 - DNA, 16 bp, H. sapiens
tgaaatgaatgtattt

SEQ ID NO: 142721 - DNA, 16 bp, H. sapiens
tgaaatgaatttgcat

SEQ ID NO: 142722 - DNA, 16 bp, H. sapiens
tgaaatgaattttaaa

SEQ ID NO: 142723 - DNA, 16 bp, H. sapiens
tgaaatgaattttaat

SEQ ID NO: 142724 - DNA, 16 bp, H. sapiens
tgaaatgacagataaa

SEQ ID NO: 142725 - DNA, 16 bp, H. sapiens
tgaaatgagccaagat

SEQ ID NO: 142726 - DNA, 16 bp, H. sapiens
tgaaatgagttaacac

SEQ ID NO: 142727 - DNA, 16 bp, H. sapiens
tgaaatgataaaatgt

SEQ ID NO: 142728 - DNA, 16 bp, H. sapiens
tgaaatgatgaaagga

SEQ ID NO: 142729 - DNA, 16 bp, H. sapiens
tgaaatgattactgca

SEQ ID NO: 142730 - DNA, 16 bp, H. sapiens
tgaaatgattgccaca

SEQ ID NO: 142731 - DNA, 16 bp, H. sapiens
tgaaatgatttttctt

SEQ ID NO: 142732 - DNA, 16 bp, H. sapiens
tgaaatgctgtctcaa

SEQ ID NO: 142733 - DNA, 16 bp, H. sapiens
tgaaatggaaaaattt

SEQ ID NO: 142734 - DNA, 16 bp, H. sapiens
tgaaatggaaacattt

SEQ ID NO: 142735 - DNA, 16 bp, H. sapiens
tgaaatggaaatgaaa

SEQ ID NO: 142736 - DNA, 16 bp, H. sapiens
tgaaatggaagaaaat

SEQ ID NO: 142737 - DNA, 16 bp, H. sapiens
tgaaatggaatcttgc

SEQ ID NO: 142738 - DNA, 16 bp, H. sapiens
tgaaatgggagaaaat

SEQ ID NO: 142739 - DNA, 16 bp, H. sapiens
tgaaatgggagaattg

SEQ ID NO: 142740 - DNA, 16 bp, H. sapiens
tgaaatggggataata

SEQ ID NO: 142741 - DNA, 16 bp, H. sapiens
tgaaatggtgcagcca

SEQ ID NO: 142742 - DNA, 16 bp, H. sapiens
tgaaatggtttttaaa

SEQ ID NO: 142743 - DNA, 16 bp, H. sapiens
tgaaatgtacaataaa

SEQ ID NO: 142744 - DNA, 16 bp, H. sapiens
tgaaatgtattaattt

SEQ ID NO: 142745 - DNA, 16 bp, H. sapiens
tgaaatgtatttaaaa

SEQ ID NO: 142746 - DNA, 16 bp, H. sapiens
tgaaatgtatttcttt

SEQ ID NO: 142747 - DNA, 16 bp, H. sapiens
tgaaatgtccagaaca

SEQ ID NO: 142748 - DNA, 16 bp, H. sapiens
tgaaatgtctttaaaa

SEQ ID NO: 142749 - DNA, 16 bp, H. sapiens
tgaaatgtgaaaaatg

SEQ ID NO: 142750 - DNA, 16 bp, H. sapiens
tgaaatgtgaaataaa

SEQ ID NO: 142751 - DNA, 16 bp, H. sapiens
tgaaatgtgaatttca

SEQ ID NO: 142752 - DNA, 16 bp, H. sapiens
tgaaatgtgaccccca

SEQ ID NO: 142753 - DNA, 16 bp, H. sapiens
tgaaatgtgatctcca

SEQ ID NO: 142754 - DNA, 16 bp, H. sapiens
tgaaatgtggctagtc

SEQ ID NO: 142755 - DNA, 16 bp, H. sapiens
tgaaatgttaatctcc

SEQ ID NO: 142756 - DNA, 16 bp, H. sapiens
tgaaatgttacaaatt

SEQ ID NO: 142757 - DNA, 16 bp, H. sapiens
tgaaatgttcccagca

SEQ ID NO: 142758 - DNA, 16 bp, H. sapiens
tgaaatgttgaaatgt

SEQ ID NO: 142759 - DNA, 16 bp, H. sapiens
tgaaatgtttaaaaat

SEQ ID NO: 142760 - DNA, 16 bp, H. sapiens
tgaaatgtttcaaaat

SEQ ID NO: 142761 - DNA, 16 bp, H. sapiens
tgaaatgtttgggacc

SEQ ID NO: 142762 - DNA, 16 bp, H. sapiens
tgaaatgttttaatta

SEQ ID NO: 142763 - DNA, 16 bp, H. sapiens
tgaaatgttttgtaaa

SEQ ID NO: 142764 - DNA, 16 bp, H. sapiens
tgaaatgttttttaaa

SEQ ID NO: 142765 - DNA, 16 bp, H. sapiens
tgaaattaaaaaatac

SEQ ID NO: 142766 - DNA, 16 bp, H. sapiens
tgaaattaaaattgct

SEQ ID NO: 142767 - DNA, 16 bp, H. sapiens
tgaaattaaataattc

SEQ ID NO: 142768 - DNA, 16 bp, H. sapiens
tgaaattaaatgaaca

SEQ ID NO: 142769 - DNA, 16 bp, H. sapiens
tgaaattaaggaagaa

SEQ ID NO: 142770 - DNA, 16 bp, H. sapiens
tgaaattaatattcca

SEQ ID NO: 142771 - DNA, 16 bp, H. sapiens
tgaaattaattttgat

SEQ ID NO: 142772 - DNA, 16 bp, H. sapiens
tgaaattaattttgta

SEQ ID NO: 142773 - DNA, 16 bp, H. sapiens
tgaaattacaagtgtg

SEQ ID NO: 142774 - DNA, 16 bp, H. sapiens
tgaaattactgagtca

SEQ ID NO: 142775 - DNA, 16 bp, H. sapiens
tgaaattagttttcct

SEQ ID NO: 142776 - DNA, 16 bp, H. sapiens
tgaaattataccaagt

SEQ ID NO: 142777 - DNA, 16 bp, H. sapiens
tgaaattatatgcaaa

SEQ ID NO: 142778 - DNA, 16 bp, H. sapiens
tgaaattatatggttt

SEQ ID NO: 142779 - DNA, 16 bp, H. sapiens
tgaaattatctttttt

SEQ ID NO: 142780 - DNA, 16 bp, H. sapiens
tgaaattattccaatc

SEQ ID NO: 142781 - DNA, 16 bp, H. sapiens
tgaaattattttcagt

SEQ ID NO: 142782 - DNA, 16 bp, H. sapiens
tgaaattcaaacttaa

SEQ ID NO: 142783 - DNA, 16 bp, H. sapiens
tgaaattcaaatgtca

SEQ ID NO: 142784 - DNA, 16 bp, H. sapiens
tgaaattcaattttaa

SEQ ID NO: 142785 - DNA, 16 bp, H. sapiens
tgaaattcagatttca

SEQ ID NO: 142786 - DNA, 16 bp, H. sapiens
tgaaattcaggctgag

SEQ ID NO: 142787 - DNA, 16 bp, H. sapiens
tgaaattcatgttgaa

SEQ ID NO: 142788 - DNA, 16 bp, H. sapiens
tgaaattcttaataaa

SEQ ID NO: 142789 - DNA, 16 bp, H. sapiens
tgaaattcttcaaaat

SEQ ID NO: 142790 - DNA, 16 bp, H. sapiens
tgaaattctttaattt

SEQ ID NO: 142791 - DNA, 16 bp, H. sapiens
tgaaattgaaaacaaa

SEQ ID NO: 142792 - DNA, 16 bp, H. sapiens
tgaaattgaaacaaag

SEQ ID NO: 142793 - DNA, 16 bp, H. sapiens
tgaaattgaaattgaa

SEQ ID NO: 142794 - DNA, 16 bp, H. sapiens
tgaaattgaagcagta

SEQ ID NO: 142795 - DNA, 16 bp, H. sapiens
tgaaattgaattagta

SEQ ID NO: 142796 - DNA, 16 bp, H. sapiens
tgaaattgaggaagta

SEQ ID NO: 142797 - DNA, 26 bp, H. sapiens
tgaaattgaggcaataattaatagcc

SEQ ID NO: 142798 - DNA, 16 bp, H. sapiens
tgaaattgagggagta

SEQ ID NO: 142799 - DNA, 16 bp, H. sapiens
tgaaattgccaatatt

SEQ ID NO: 142800 - DNA, 16 bp, H. sapiens
tgaaattgctggatca

SEQ ID NO: 142801 - DNA, 16 bp, H. sapiens
tgaaattgtaccactg

SEQ ID NO: 142802 - DNA, 16 bp, H. sapiens
tgaaattgtatctcat

SEQ ID NO: 142803 - DNA, 16 bp, H. sapiens
tgaaattgtgccattg

SEQ ID NO: 142804 - DNA, 16 bp, H. sapiens
tgaaattgttccaaaa

SEQ ID NO: 142805 - DNA, 16 bp, H. sapiens
tgaaattgttgcatta

SEQ ID NO: 142806 - DNA, 16 bp, H. sapiens
tgaaattgtttaaaaa

SEQ ID NO: 142807 - DNA, 16 bp, H. sapiens
tgaaatttaggcagag

SEQ ID NO: 142808 - DNA, 16 bp, H. sapiens
tgaaatttatttctta

SEQ ID NO: 142809 - DNA, 16 bp, H. sapiens
tgaaatttattttggt

SEQ ID NO: 142810 - DNA, 16 bp, H. sapiens
tgaaatttcaatttta

SEQ ID NO: 142811 - DNA, 16 bp, H. sapiens
tgaaatttcttttctt

SEQ ID NO: 142812 - DNA, 16 bp, H. sapiens
tgaaatttgaaagtaa

SEQ ID NO: 142813 - DNA, 20 bp, H. sapiens
tgaaatttggtgccgtgact

SEQ ID NO: 142814 - DNA, 16 bp, H. sapiens
tgaaatttgttaaaat

SEQ ID NO: 142815 - DNA, 16 bp, H. sapiens
tgaaattttaattgaa

SEQ ID NO: 142816 - DNA, 16 bp, H. sapiens
tgaaattttaggaaaa

SEQ ID NO: 142817 - DNA, 16 bp, H. sapiens
tgaaattttatctttt

SEQ ID NO: 142818 - DNA, 16 bp, H. sapiens
tgaaattttattttcc

SEQ ID NO: 142819 - DNA, 16 bp, H. sapiens
tgaaattttcagcctt

SEQ ID NO: 142820 - DNA, 16 bp, H. sapiens
tgaaattttcattttt

SEQ ID NO: 142821 - DNA, 16 bp, H. sapiens
tgaaattttccaaagt

SEQ ID NO: 142822 - DNA, 16 bp, H. sapiens
tgaaattttctctttt

SEQ ID NO: 142823 - DNA, 16 bp, H. sapiens
tgaaattttgttcttt

SEQ ID NO: 142824 - DNA, 16 bp, H. sapiens
tgaaatttttatcaaa

SEQ ID NO: 142825 - DNA, 16 bp, H. sapiens
tgaaatttttcttctt

SEQ ID NO: 142826 - DNA, 16 bp, H. sapiens
tgaaatttttgaaaat

SEQ ID NO: 142827 - DNA, 16 bp, H. sapiens
tgaaatttttgaaatt

SEQ ID NO: 142828 - DNA, 16 bp, H. sapiens
tgaacaaaactgaaaa

SEQ ID NO: 142829 - DNA, 16 bp, H. sapiens
tgaacaaaaggaacaa

SEQ ID NO: 142830 - DNA, 16 bp, H. sapiens
tgaacaaaatcaaaga

SEQ ID NO: 142831 - DNA, 16 bp, H. sapiens
tgaacaaagcctctga

SEQ ID NO: 142832 - DNA, 16 bp, H. sapiens
tgaacaaagtgaaaaa

SEQ ID NO: 142833 - DNA, 16 bp, H. sapiens
tgaacaaataagcaaa

SEQ ID NO: 142834 - DNA, 16 bp, H. sapiens
tgaacaaatacatgaa

SEQ ID NO: 142835 - DNA, 16 bp, H. sapiens
tgaacaaatgaacaca

SEQ ID NO: 142836 - DNA, 16 bp, H. sapiens
tgaacaaatgagtgaa

SEQ ID NO: 142837 - DNA, 16 bp, H. sapiens
tgaacaaatgcatgaa

SEQ ID NO: 142838 - DNA, 16 bp, H. sapiens
tgaacaaatgtctctg

SEQ ID NO: 142839 - DNA, 16 bp, H. sapiens
tgaacaaattaatgaa

SEQ ID NO: 142840 - DNA, 16 bp, H. sapiens
tgaacaacagaaatgt

SEQ ID NO: 142841 - DNA, 16 bp, H. sapiens
tgaacaacagtcttca

SEQ ID NO: 142842 - DNA, 16 bp, H. sapiens
tgaacaacatggtgaa

SEQ ID NO: 142843 - DNA, 16 bp, H. sapiens
tgaacaacctgctgct

SEQ ID NO: 142844 - DNA, 16 bp, H. sapiens
tgaacaaccttctcct

SEQ ID NO: 142845 - DNA, 16 bp, H. sapiens
tgaacaactggaattt

SEQ ID NO: 142846 - DNA, 16 bp, H. sapiens
tgaacaagacagacaa

SEQ ID NO: 142847 - DNA, 17 bp, H. sapiens
tgaacaagactccgtct

SEQ ID NO: 142848 - DNA, 16 bp, H. sapiens
tgaacaagtgaataaa

SEQ ID NO: 142849 - DNA, 16 bp, H. sapiens
tgaacaagtttacagt

SEQ ID NO: 142850 - DNA, 16 bp, H. sapiens
tgaacaatctaaaaat

SEQ ID NO: 142851 - DNA, 16 bp, H. sapiens
tgaacaatgagaacac

SEQ ID NO: 142852 - DNA, 17 bp, H. sapiens
tgaacaatgagaacaca

SEQ ID NO: 142853 - DNA, 16 bp, H. sapiens
tgaacaattagaacac

SEQ ID NO: 142854 - DNA, 16 bp, H. sapiens
tgaacaattcagtggc

SEQ ID NO: 142855 - DNA, 16 bp, H. sapiens
tgaacaatttaaaaaa

SEQ ID NO: 142856 - DNA, 16 bp, H. sapiens
tgaacaatttaagaaa

SEQ ID NO: 142857 - DNA, 16 bp, H. sapiens
tgaacacaaaatatct

SEQ ID NO: 142858 - DNA, 16 bp, H. sapiens
tgaacacacacacact

SEQ ID NO: 142859 - DNA, 16 bp, H. sapiens
tgaacacacccatgta

SEQ ID NO: 142860 - DNA, 16 bp, H. sapiens
tgaacacacgaatgat

SEQ ID NO: 142861 - DNA, 16 bp, H. sapiens
tgaacactggactcca

SEQ ID NO: 142862 - DNA, 16 bp, H. sapiens
tgaacacttactatgc

SEQ ID NO: 142863 - DNA, 16 bp, H. sapiens
tgaacagaaagtacag

SEQ ID NO: 142864 - DNA, 16 bp, H. sapiens
tgaacagaaatttctc

SEQ ID NO: 142865 - DNA, 16 bp, H. sapiens
tgaacagaatgtgtat

SEQ ID NO: 142866 - DNA, 16 bp, H. sapiens
tgaacagagatttacc

SEQ ID NO: 142867 - DNA, 16 bp, H. sapiens
tgaacagataaataaa

SEQ ID NO: 142868 - DNA, 16 bp, H. sapiens
tgaacagcaaaggaaa

SEQ ID NO: 142869 - DNA, 18 bp, H. sapiens
tgaacaggaggagaggct

SEQ ID NO: 142870 - DNA, 17 bp, H. sapiens
tgaacaggcaacttaca

SEQ ID NO: 142871 - DNA, 16 bp, H. sapiens
tgaacagggtgagaag

SEQ ID NO: 142872 - DNA, 16 bp, H. sapiens
tgaacagtgttttcca

SEQ ID NO: 142873 - DNA, 16 bp, H. sapiens
tgaacagttctgtctc

SEQ ID NO: 142874 - DNA, 16 bp, H. sapiens
tgaacataaattatga

SEQ ID NO: 142875 - DNA, 16 bp, H. sapiens
tgaacatacaaaaatt

SEQ ID NO: 142876 - DNA, 16 bp, H. sapiens
tgaacatacaaatgca

SEQ ID NO: 142877 - DNA, 16 bp, H. sapiens
tgaacatacatgtgta

SEQ ID NO: 142878 - DNA, 20 bp, H. sapiens
tgaacatagacccttatcag

SEQ ID NO: 142879 - DNA, 16 bp, H. sapiens
tgaacatagctcactg

SEQ ID NO: 142880 - DNA, 16 bp, H. sapiens
tgaacatatatatgaa

SEQ ID NO: 142881 - DNA, 16 bp, H. sapiens
tgaacatatccatcat

SEQ ID NO: 142882 - DNA, 16 bp, H. sapiens
tgaacatatttataat

SEQ ID NO: 142883 - DNA, 16 bp, H. sapiens
tgaacatatttccttt

SEQ ID NO: 142884 - DNA, 16 bp, H. sapiens
tgaacatattttaaaa

SEQ ID NO: 142885 - DNA, 16 bp, H. sapiens
tgaacatatttttaaa

SEQ ID NO: 142886 - DNA, 16 bp, H. sapiens
tgaacatatttttgtt

SEQ ID NO: 142887 - DNA, 16 bp, H. sapiens
tgaacatcaaaataaa

SEQ ID NO: 142888 - DNA, 16 bp, H. sapiens
tgaacatcataatgac

SEQ ID NO: 142889 - DNA, 16 bp, H. sapiens
tgaacatctatgcaaa

SEQ ID NO: 142890 - DNA, 16 bp, H. sapiens
tgaacatgcctagtcc

SEQ ID NO: 142891 - DNA, 16 bp, H. sapiens
tgaacatggacacaaa

SEQ ID NO: 142892 - DNA, 16 bp, H. sapiens
tgaacatgtgtgcaca

SEQ ID NO: 142893 - DNA, 16 bp, H. sapiens
tgaacattcatgtaca

SEQ ID NO: 142894 - DNA, 16 bp, H. sapiens
tgaacattcatgtgta

SEQ ID NO: 142895 - DNA, 16 bp, H. sapiens
tgaacattcttaaaga

SEQ ID NO: 142896 - DNA, 16 bp, H. sapiens
tgaacatttaaacatg

SEQ ID NO: 142897 - DNA, 16 bp, H. sapiens
tgaacatttatgtaca

SEQ ID NO: 142898 - DNA, 16 bp, H. sapiens
tgaacatttcagttct

SEQ ID NO: 142899 - DNA, 16 bp, H. sapiens
tgaacatttctcaaaa

SEQ ID NO: 142900 - DNA, 16 bp, H. sapiens
tgaacatttgaagaaa

SEQ ID NO: 142901 - DNA, 16 bp, H. sapiens
tgaacatttgtgaaca

SEQ ID NO: 142902 - DNA, 16 bp, H. sapiens
tgaacattttttccta

SEQ ID NO: 142903 - DNA, 16 bp, H. sapiens
tgaacatttttttcat

SEQ ID NO: 142904 - DNA, 16 bp, H. sapiens
tgaaccaagaagaaat

SEQ ID NO: 142905 - DNA, 16 bp, H. sapiens
tgaaccaagtggacct

SEQ ID NO: 142906 - DNA, 16 bp, H. sapiens
tgaaccaatcacctcc

SEQ ID NO: 142907 - DNA, 17 bp, H. sapiens
tgaaccactgcacccag

SEQ ID NO: 142908 - DNA, 16 bp, H. sapiens
tgaaccactgtgcctg

SEQ ID NO: 142909 - DNA, 16 bp, H. sapiens
tgaaccaggaagtggg

SEQ ID NO: 142910 - DNA, 16 bp, H. sapiens
tgaaccagggagacag

SEQ ID NO: 142911 - DNA, 16 bp, H. sapiens
tgaaccatatgaaact

SEQ ID NO: 142912 - DNA, 16 bp, H. sapiens
tgaaccatctttgtat

SEQ ID NO: 142913 - DNA, 16 bp, H. sapiens
tgaaccattcttgcat

SEQ ID NO: 142914 - DNA, 16 bp, H. sapiens
tgaaccatttgaaaat

SEQ ID NO: 142915 - DNA, 16 bp, H. sapiens
tgaaccatttgaaatt

SEQ ID NO: 142916 - DNA, 17 bp, H. sapiens
tgaacccaagaggtgga

SEQ ID NO: 142917 - DNA, 16 bp, H. sapiens
tgaacccaagaggttg

SEQ ID NO: 142918 - DNA, 16 bp, H. sapiens
tgaacccaccgggagg

SEQ ID NO: 142919 - DNA, 16 bp, H. sapiens
tgaacccagaaggtga

SEQ ID NO: 142920 - DNA, 17 bp, H. sapiens
tgaacccagaaggtgga

SEQ ID NO: 142921 - DNA, 16 bp, H. sapiens
tgaacccagcaggcgg

SEQ ID NO: 142922 - DNA, 17 bp, H. sapiens
tgaacccaggagacgga

SEQ ID NO: 142923 - DNA, 17 bp, H. sapiens
tgaacccaggagatgga

SEQ ID NO: 142924 - DNA, 18 bp, H. sapiens
tgaacccaggaggcggag

SEQ ID NO: 142925 - DNA, 16 bp, H. sapiens
tgaacccaggagtttg

SEQ ID NO: 142926 - DNA, 16 bp, H. sapiens
tgaacccaggatttca

SEQ ID NO: 142927 - DNA, 16 bp, H. sapiens
tgaacccagggagtct

SEQ ID NO: 142928 - DNA, 16 bp, H. sapiens
tgaaccccaaatatct

SEQ ID NO: 142929 - DNA, 16 bp, H. sapiens
tgaaccccagaggcag

SEQ ID NO: 142930 - DNA, 17 bp, H. sapiens
tgaaccccagaggcaga

SEQ ID NO: 142931 - DNA, 16 bp, H. sapiens
tgaaccccagcctggg

SEQ ID NO: 142932 - DNA, 16 bp, H. sapiens
tgaaccccagctctgc

SEQ ID NO: 142933 - DNA, 16 bp, H. sapiens
tgaacccctgacctct

SEQ ID NO: 142934 - DNA, 16 bp, H. sapiens
tgaacccgcgaggcag

SEQ ID NO: 142935 - DNA, 20 bp, H. sapiens
tgaacccgcgaggcggagct

SEQ ID NO: 142936 - DNA, 18 bp, H. sapiens
tgaacccggaaggcggag

SEQ ID NO: 142937 - DNA, 22 bp, H. sapiens
tgaacccgggaggcagagcttg

SEQ ID NO: 142938 - DNA, 27 bp, H. sapiens
tgaacccgggaggtggagcttgcagtg

SEQ ID NO: 142939 - DNA, 17 bp, H. sapiens
tgaacccgggatgcaga

SEQ ID NO: 142940 - DNA, 16 bp, H. sapiens
tgaacccgggcggcag

SEQ ID NO: 142941 - DNA, 16 bp, H. sapiens
tgaaccctaatgtaaa

SEQ ID NO: 142942 - DNA, 16 bp, H. sapiens
tgaaccctgaaaacat

SEQ ID NO: 142943 - DNA, 16 bp, H. sapiens
tgaaccctgcaaagcc

SEQ ID NO: 142944 - DNA, 16 bp, H. sapiens
tgaaccgggaggtgga

SEQ ID NO: 142945 - DNA, 16 bp, H. sapiens
tgaacctaaaataaaa

SEQ ID NO: 142946 - DNA, 16 bp, H. sapiens
tgaacctacatggaca

SEQ ID NO: 142947 - DNA, 16 bp, H. sapiens
tgaacctacattgaca

SEQ ID NO: 142948 - DNA, 16 bp, H. sapiens
tgaacctcagcttcct

SEQ ID NO: 142949 - DNA, 16 bp, H. sapiens
tgaacctcggaggcag

SEQ ID NO: 142950 - DNA, 16 bp, H. sapiens
tgaacctgagaggtga

SEQ ID NO: 142951 - DNA, 16 bp, H. sapiens
tgaacctggaaagcag

SEQ ID NO: 142952 - DNA, 16 bp, H. sapiens
tgaacctggaagaaat

SEQ ID NO: 142953 - DNA, 16 bp, H. sapiens
tgaacctggaaggagg

SEQ ID NO: 142954 - DNA, 18 bp, H. sapiens
tgaacctggaaggcggag

SEQ ID NO: 142955 - DNA, 16 bp, H. sapiens
tgaacctggacccctt

SEQ ID NO: 142956 - DNA, 16 bp, H. sapiens
tgaacctggagaacat

SEQ ID NO: 142957 - DNA, 21 bp, H. sapiens
tgaacctgggagatggaggtt

SEQ ID NO: 142958 - DNA, 16 bp, H. sapiens
tgaacctgggcaacat

SEQ ID NO: 142959 - DNA, 16 bp, H. sapiens
tgaacctgggcagtgg

SEQ ID NO: 142960 - DNA, 16 bp, H. sapiens
tgaacctgggcggcgg

SEQ ID NO: 142961 - DNA, 16 bp, H. sapiens
tgaacctggggggcag

SEQ ID NO: 142962 - DNA, 16 bp, H. sapiens
tgaacctgtgaaatca

SEQ ID NO: 142963 - DNA, 16 bp, H. sapiens
tgaacctttaaaacat

SEQ ID NO: 142964 - DNA, 16 bp, H. sapiens
tgaacgaatgaatgaa

SEQ ID NO: 142965 - DNA, 18 bp, H. sapiens
tgaacgcgggaggtggag

SEQ ID NO: 142966 - DNA, 16 bp, H. sapiens
tgaacgctgtgctggg

SEQ ID NO: 142967 - DNA, 16 bp, H. sapiens
tgaactaactcagaaa

SEQ ID NO: 142968 - DNA, 16 bp, H. sapiens
tgaactaactttggga

SEQ ID NO: 142969 - DNA, 16 bp, H. sapiens
tgaactaatagagcaa

SEQ ID NO: 142970 - DNA, 16 bp, H. sapiens
tgaactaatttatact

SEQ ID NO: 142971 - DNA, 16 bp, H. sapiens
tgaactaattttcatt

SEQ ID NO: 142972 - DNA, 16 bp, H. sapiens
tgaactaccacaccca

SEQ ID NO: 142973 - DNA, 16 bp, H. sapiens
tgaactactttacagt

SEQ ID NO: 142974 - DNA, 16 bp, H. sapiens
tgaactagtgtgattt

SEQ ID NO: 142975 - DNA, 16 bp, H. sapiens
tgaactatgattgcac

SEQ ID NO: 142976 - DNA, 16 bp, H. sapiens
tgaactattttacatt

SEQ ID NO: 142977 - DNA, 16 bp, H. sapiens
tgaactcaaacaaatg

SEQ ID NO: 142978 - DNA, 16 bp, H. sapiens
tgaactcaatctccag

SEQ ID NO: 142979 - DNA, 16 bp, H. sapiens
tgaactcacagtttca

SEQ ID NO: 142980 - DNA, 16 bp, H. sapiens
tgaactcagccctgga

SEQ ID NO: 142981 - DNA, 20 bp, H. sapiens
tgaactcagctctacaccaa

SEQ ID NO: 142982 - DNA, 16 bp, H. sapiens
tgaactcaggaggtgg

SEQ ID NO: 142983 - DNA, 16 bp, H. sapiens
tgaactcaggagttcg

SEQ ID NO: 142984 - DNA, 16 bp, H. sapiens
tgaactcaggagttgg

SEQ ID NO: 142985 - DNA, 16 bp, H. sapiens
tgaactcatcatattt

SEQ ID NO: 142986 - DNA, 16 bp, H. sapiens
tgaactcatcctttta

SEQ ID NO: 142987 - DNA, 16 bp, H. sapiens
tgaactccagacctca

SEQ ID NO: 142988 - DNA, 16 bp, H. sapiens
tgaactccatcctccc

SEQ ID NO: 142989 - DNA, 16 bp, H. sapiens
tgaactcccatgttca

SEQ ID NO: 142990 - DNA, 16 bp, H. sapiens
tgaactcccattccca

SEQ ID NO: 142991 - DNA, 16 bp, H. sapiens
tgaactcctgaccctg

SEQ ID NO: 142992 - DNA, 17 bp, H. sapiens
tgaactcctgacctcac

SEQ ID NO: 142993 - DNA, 18 bp, H. sapiens
tgaactcctgacctcaga

SEQ ID NO: 142994 - DNA, 16 bp, H. sapiens
tgaactcctgacctct

SEQ ID NO: 142995 - DNA, 17 bp, H. sapiens
tgaactcctgaccttgg

SEQ ID NO: 142996 - DNA, 16 bp, H. sapiens
tgaactcctgagcgca

SEQ ID NO: 142997 - DNA, 16 bp, H. sapiens
tgaactcctgatccca

SEQ ID NO: 142998 - DNA, 16 bp, H. sapiens
tgaactcctggattca

SEQ ID NO: 142999 - DNA, 17 bp, H. sapiens
tgaactcctggcctcat

SEQ ID NO: 143000 - DNA, 16 bp, H. sapiens
tgaactcgtgacctca

SEQ ID NO: 143001 - DNA, 16 bp, H. sapiens
tgaactcttgacctta

SEQ ID NO: 143002 - DNA, 16 bp, H. sapiens
tgaactcttgggttca

SEQ ID NO: 143003 - DNA, 16 bp, H. sapiens
tgaactgaaggaaatc

SEQ ID NO: 143004 - DNA, 16 bp, H. sapiens
tgaactgaatgaaaat

SEQ ID NO: 143005 - DNA, 16 bp, H. sapiens
tgaactgaatgaaatg

SEQ ID NO: 143006 - DNA, 16 bp, H. sapiens
tgaactgcgcatgtga

SEQ ID NO: 143007 - DNA, 16 bp, H. sapiens
tgaactgggagatgga

SEQ ID NO: 143008 - DNA, 16 bp, H. sapiens
tgaactgtgattgtgc

SEQ ID NO: 143009 - DNA, 16 bp, H. sapiens
tgaacttcagtttctt

SEQ ID NO: 143010 - DNA, 16 bp, H. sapiens
tgaacttccattcaca

SEQ ID NO: 143011 - DNA, 16 bp, H. sapiens
tgaacttcctggcagc

SEQ ID NO: 143012 - DNA, 16 bp, H. sapiens
tgaacttcctggtggc

SEQ ID NO: 143013 - DNA, 16 bp, H. sapiens
tgaacttctgagatat

SEQ ID NO: 143014 - DNA, 16 bp, H. sapiens
tgaacttctggcctca

SEQ ID NO: 143015 - DNA, 16 bp, H. sapiens
tgaacttcttgaatct

SEQ ID NO: 143016 - DNA, 16 bp, H. sapiens
tgaacttctttctttt

SEQ ID NO: 143017 - DNA, 16 bp, H. sapiens
tgaacttctttgtctc

SEQ ID NO: 143018 - DNA, 16 bp, H. sapiens
tgaacttgaagataag

SEQ ID NO: 143019 - DNA, 16 bp, H. sapiens
tgaacttggacttcca

SEQ ID NO: 143020 - DNA, 16 bp, H. sapiens
tgaacttgggagatgg

SEQ ID NO: 143021 - DNA, 16 bp, H. sapiens
tgaacttgggaggggg

SEQ ID NO: 143022 - DNA, 16 bp, H. sapiens
tgaacttgtgttttgt

SEQ ID NO: 143023 - DNA, 16 bp, H. sapiens
tgaactttgagaacat

SEQ ID NO: 143024 - DNA, 16 bp, H. sapiens
tgaactttggggactt

SEQ ID NO: 143025 - DNA, 16 bp, H. sapiens
tgaactttgggttcat

SEQ ID NO: 143026 - DNA, 17 bp, H. sapiens
tgaactttgtaacaatt

SEQ ID NO: 143027 - DNA, 16 bp, H. sapiens
tgaagaaaaacttaaa

SEQ ID NO: 143028 - DNA, 16 bp, H. sapiens
tgaagaaaaagaggtt

SEQ ID NO: 143029 - DNA, 16 bp, H. sapiens
tgaagaaaaataaagc

SEQ ID NO: 143030 - DNA, 16 bp, H. sapiens
tgaagaaaaattattt

SEQ ID NO: 143031 - DNA, 16 bp, H. sapiens
tgaagaaaacaaattt

SEQ ID NO: 143032 - DNA, 16 bp, H. sapiens
tgaagaaaacacaaat

SEQ ID NO: 143033 - DNA, 16 bp, H. sapiens
tgaagaaaacagaaat

SEQ ID NO: 143034 - DNA, 16 bp, H. sapiens
tgaagaaaacaggttt

SEQ ID NO: 143035 - DNA, 16 bp, H. sapiens
tgaagaaaagaaattt

SEQ ID NO: 143036 - DNA, 16 bp, H. sapiens
tgaagaaaagagaaca

SEQ ID NO: 143037 - DNA, 16 bp, H. sapiens
tgaagaaaagatagtc

SEQ ID NO: 143038 - DNA, 16 bp, H. sapiens
tgaagaaaagcagaaa

SEQ ID NO: 143039 - DNA, 16 bp, H. sapiens
tgaagaaaagctgaaa

SEQ ID NO: 143040 - DNA, 16 bp, H. sapiens
tgaagaaaaggcattt

SEQ ID NO: 143041 - DNA, 16 bp, H. sapiens
tgaagaaaagttgaaa

SEQ ID NO: 143042 - DNA, 16 bp, H. sapiens
tgaagaaaataaagca

SEQ ID NO: 143043 - DNA, 16 bp, H. sapiens
tgaagaaaatacattt

SEQ ID NO: 143044 - DNA, 16 bp, H. sapiens
tgaagaaaatatggca

SEQ ID NO: 143045 - DNA, 16 bp, H. sapiens
tgaagaaaatattatt

SEQ ID NO: 143046 - DNA, 16 bp, H. sapiens
tgaagaaaatattcaa

SEQ ID NO: 143047 - DNA, 16 bp, H. sapiens
tgaagaaaatcagaaa

SEQ ID NO: 143048 - DNA, 16 bp, H. sapiens
tgaagaaaatcatttt

SEQ ID NO: 143049 - DNA, 16 bp, H. sapiens
tgaagaaaatgaaaca

SEQ ID NO: 143050 - DNA, 16 bp, H. sapiens
tgaagaaaatgaaatt

SEQ ID NO: 143051 - DNA, 16 bp, H. sapiens
tgaagaaaatgaagct

SEQ ID NO: 143052 - DNA, 16 bp, H. sapiens
tgaagaaaatgaggca

SEQ ID NO: 143053 - DNA, 16 bp, H. sapiens
tgaagaaaatgtaaat

SEQ ID NO: 143054 - DNA, 16 bp, H. sapiens
tgaagaaaattttatt

SEQ ID NO: 143055 - DNA, 16 bp, H. sapiens
tgaagaaacaaaggct

SEQ ID NO: 143056 - DNA, 16 bp, H. sapiens
tgaagaaacagaagaa

SEQ ID NO: 143057 - DNA, 16 bp, H. sapiens
tgaagaaacagaagca

SEQ ID NO: 143058 - DNA, 16 bp, H. sapiens
tgaagaaacagaagga

SEQ ID NO: 143059 - DNA, 16 bp, H. sapiens
tgaagaaacaggccca

SEQ ID NO: 143060 - DNA, 16 bp, H. sapiens
tgaagaaacatatctc

SEQ ID NO: 143061 - DNA, 16 bp, H. sapiens
tgaagaaaccaccaaa

SEQ ID NO: 143062 - DNA, 16 bp, H. sapiens
tgaagaaactaaggca

SEQ ID NO: 143063 - DNA, 16 bp, H. sapiens
tgaagaaactgaaact

SEQ ID NO: 143064 - DNA, 16 bp, H. sapiens
tgaagaaactgaagcc

SEQ ID NO: 143065 - DNA, 16 bp, H. sapiens
tgaagaaactgaagct

SEQ ID NO: 143066 - DNA, 16 bp, H. sapiens
tgaagaaactgaagta

SEQ ID NO: 143067 - DNA, 16 bp, H. sapiens
tgaagaaactgaagtt

SEQ ID NO: 143068 - DNA, 16 bp, H. sapiens
tgaagaaactgaatca

SEQ ID NO: 143069 - DNA, 16 bp, H. sapiens
tgaagaaactgagaaa

SEQ ID NO: 143070 - DNA, 16 bp, H. sapiens
tgaagaaactgaggca

SEQ ID NO: 143071 - DNA, 16 bp, H. sapiens
tgaagaaactgaggtt

SEQ ID NO: 143072 - DNA, 16 bp, H. sapiens
tgaagaaactgcacca

SEQ ID NO: 143073 - DNA, 16 bp, H. sapiens
tgaagaaactggaact

SEQ ID NO: 143074 - DNA, 16 bp, H. sapiens
tgaagaaactttaaaa

SEQ ID NO: 143075 - DNA, 16 bp, H. sapiens
tgaagaaagaaaatgt

SEQ ID NO: 143076 - DNA, 16 bp, H. sapiens
tgaagaaagaaattga

SEQ ID NO: 143077 - DNA, 16 bp, H. sapiens
tgaagaaagaaatttt

SEQ ID NO: 143078 - DNA, 16 bp, H. sapiens
tgaagaaagcagaagc

SEQ ID NO: 143079 - DNA, 16 bp, H. sapiens
tgaagaaagttattgg

SEQ ID NO: 143080 - DNA, 16 bp, H. sapiens
tgaagaaataaaactt

SEQ ID NO: 143081 - DNA, 16 bp, H. sapiens
tgaagaaataaagaac

SEQ ID NO: 143082 - DNA, 16 bp, H. sapiens
tgaagaaataatctgt

SEQ ID NO: 143083 - DNA, 16 bp, H. sapiens
tgaagaaataccagag

SEQ ID NO: 143084 - DNA, 16 bp, H. sapiens
tgaagaaatacttgag

SEQ ID NO: 143085 - DNA, 16 bp, H. sapiens
tgaagaaatagaagat

SEQ ID NO: 143086 - DNA, 16 bp, H. sapiens
tgaagaaatatctgag

SEQ ID NO: 143087 - DNA, 16 bp, H. sapiens
tgaagaaatatttgta

SEQ ID NO: 143088 - DNA, 16 bp, H. sapiens
tgaagaaatcaaggct

SEQ ID NO: 143089 - DNA, 16 bp, H. sapiens
tgaagaaatcagaaaa

SEQ ID NO: 143090 - DNA, 16 bp, H. sapiens
tgaagaaatgaatgaa

SEQ ID NO: 143091 - DNA, 16 bp, H. sapiens
tgaagaaatggaagct

SEQ ID NO: 143092 - DNA, 16 bp, H. sapiens
tgaagaaatggaggca

SEQ ID NO: 143093 - DNA, 16 bp, H. sapiens
tgaagaaatgtctgat

SEQ ID NO: 143094 - DNA, 16 bp, H. sapiens
tgaagaaattaagaca

SEQ ID NO: 143095 - DNA, 16 bp, H. sapiens
tgaagaaattaagatg

SEQ ID NO: 143096 - DNA, 16 bp, H. sapiens
tgaagaaattgaaaat

SEQ ID NO: 143097 - DNA, 16 bp, H. sapiens
tgaagaaattgaagca

SEQ ID NO: 143098 - DNA, 16 bp, H. sapiens
tgaagaaattgagaag

SEQ ID NO: 143099 - DNA, 16 bp, H. sapiens
tgaagaaattgcatca

SEQ ID NO: 143100 - DNA, 16 bp, H. sapiens
tgaagaacaaagaaca

SEQ ID NO: 143101 - DNA, 16 bp, H. sapiens
tgaagaacaacaacaa

SEQ ID NO: 143102 - DNA, 16 bp, H. sapiens
tgaagaacagagaaaa

SEQ ID NO: 143103 - DNA, 25 bp, H. sapiens
tgaagaacctcttcaaggagaacta

SEQ ID NO: 143104 - DNA, 16 bp, H. sapiens
tgaagaactcctttta

SEQ ID NO: 143105 - DNA, 16 bp, H. sapiens
tgaagaactctcttta

SEQ ID NO: 143106 - DNA, 16 bp, H. sapiens
tgaagaactgaaagaa

SEQ ID NO: 143107 - DNA, 16 bp, H. sapiens
tgaagaactgaatttt

SEQ ID NO: 143108 - DNA, 16 bp, H. sapiens
tgaagaactgcctgag

SEQ ID NO: 143109 - DNA, 16 bp, H. sapiens
tgaagaacttgcagtc

SEQ ID NO: 143110 - DNA, 16 bp, H. sapiens
tgaagaagaaaagttg

SEQ ID NO: 143111 - DNA, 16 bp, H. sapiens
tgaagaagaaacagaa

SEQ ID NO: 143112 - DNA, 16 bp, H. sapiens
tgaagaagaaactgag

SEQ ID NO: 143113 - DNA, 16 bp, H. sapiens
tgaagaagaaatcaag

SEQ ID NO: 143114 - DNA, 16 bp, H. sapiens
tgaagaagaaattctg

SEQ ID NO: 143115 - DNA, 16 bp, H. sapiens
tgaagaagaacatgtt

SEQ ID NO: 143116 - DNA, 16 bp, H. sapiens
tgaagaagaagaacaa

SEQ ID NO: 143117 - DNA, 16 bp, H. sapiens
tgaagaagaagcaaaa

SEQ ID NO: 143118 - DNA, 16 bp, H. sapiens
tgaagaagacaaaaat

SEQ ID NO: 143119 - DNA, 16 bp, H. sapiens
tgaagaagacaaagaa

SEQ ID NO: 143120 - DNA, 16 bp, H. sapiens
tgaagaagacacaaac

SEQ ID NO: 143121 - DNA, 16 bp, H. sapiens
tgaagaagacaccaaa

SEQ ID NO: 143122 - DNA, 16 bp, H. sapiens
tgaagaagatgaagat

SEQ ID NO: 143123 - DNA, 16 bp, H. sapiens
tgaagaagatgacaag

SEQ ID NO: 143124 - DNA, 16 bp, H. sapiens
tgaagaagcagaaaaa

SEQ ID NO: 143125 - DNA, 16 bp, H. sapiens
tgaagaagcaggaaaa

SEQ ID NO: 143126 - DNA, 16 bp, H. sapiens
tgaagaagctgcagaa

SEQ ID NO: 143127 - DNA, 16 bp, H. sapiens
tgaagaagctttttag

SEQ ID NO: 143128 - DNA, 16 bp, H. sapiens
tgaagaaggaaaacaa

SEQ ID NO: 143129 - DNA, 16 bp, H. sapiens
tgaagaaggacatatt

SEQ ID NO: 143130 - DNA, 16 bp, H. sapiens
tgaagaaggacctgtt

SEQ ID NO: 143131 - DNA, 17 bp, H. sapiens
tgaagaaggacgtgttt

SEQ ID NO: 143132 - DNA, 16 bp, H. sapiens
tgaagaaggagaatca

SEQ ID NO: 143133 - DNA, 16 bp, H. sapiens
tgaagaagttacagaa

SEQ ID NO: 143134 - DNA, 16 bp, H. sapiens
tgaagaataaatgaga

SEQ ID NO: 143135 - DNA, 16 bp, H. sapiens
tgaagaatatttttct

SEQ ID NO: 143136 - DNA, 16 bp, H. sapiens
tgaagaatctgaaagt

SEQ ID NO: 143137 - DNA, 16 bp, H. sapiens
tgaagaatgacattga

SEQ ID NO: 143138 - DNA, 16 bp, H. sapiens
tgaagaatgagaagga

SEQ ID NO: 143139 - DNA, 16 bp, H. sapiens
tgaagaatgatggtgg

SEQ ID NO: 143140 - DNA, 25 bp, H. sapiens
tgaagaatgcagaagcctcaggagc

SEQ ID NO: 143141 - DNA, 16 bp, H. sapiens
tgaagaatgcattaga

SEQ ID NO: 143142 - DNA, 16 bp, H. sapiens
tgaagaatgctgctat

SEQ ID NO: 143143 - DNA, 16 bp, H. sapiens
tgaagaatgggagaaa

SEQ ID NO: 143144 - DNA, 16 bp, H. sapiens
tgaagaatgtatcaga

SEQ ID NO: 143145 - DNA, 16 bp, H. sapiens
tgaagaatgtcagtgg

SEQ ID NO: 143146 - DNA, 16 bp, H. sapiens
tgaagaatgtgaaaaa

SEQ ID NO: 143147 - DNA, 16 bp, H. sapiens
tgaagaattcaataaa

SEQ ID NO: 143148 - DNA, 16 bp, H. sapiens
tgaagaattctaccaa

SEQ ID NO: 143149 - DNA, 16 bp, H. sapiens
tgaagaattgcttgaa

SEQ ID NO: 143150 - DNA, 16 bp, H. sapiens
tgaagaatttccttta

SEQ ID NO: 143151 - DNA, 16 bp, H. sapiens
tgaagaatttctttta

SEQ ID NO: 143152 - DNA, 16 bp, H. sapiens
tgaagaatttggagtc

SEQ ID NO: 143153 - DNA, 16 bp, H. sapiens
tgaagaatttttcttt

SEQ ID NO: 143154 - DNA, 16 bp, H. sapiens
tgaagacaaaattaaa

SEQ ID NO: 143155 - DNA, 16 bp, H. sapiens
tgaagacaataaggat

SEQ ID NO: 143156 - DNA, 16 bp, H. sapiens
tgaagacacagaaaaa

SEQ ID NO: 143157 - DNA, 16 bp, H. sapiens
tgaagacacagaaaga

SEQ ID NO: 143158 - DNA, 16 bp, H. sapiens
tgaagacacagagaca

SEQ ID NO: 143159 - DNA, 16 bp, H. sapiens
tgaagacactgaggca

SEQ ID NO: 143160 - DNA, 16 bp, H. sapiens
tgaagacagaatattt

SEQ ID NO: 143161 - DNA, 16 bp, H. sapiens
tgaagacagagacaca

SEQ ID NO: 143162 - DNA, 16 bp, H. sapiens
tgaagacaggctactt

SEQ ID NO: 143163 - DNA, 16 bp, H. sapiens
tgaagacaggttattt

SEQ ID NO: 143164 - DNA, 16 bp, H. sapiens
tgaagacagtaaaaag

SEQ ID NO: 143165 - DNA, 16 bp, H. sapiens
tgaagacatggagaaa

SEQ ID NO: 143166 - DNA, 16 bp, H. sapiens
tgaagacatttttaaa

SEQ ID NO: 143167 - DNA, 16 bp, H. sapiens
tgaagacccaaagatg

SEQ ID NO: 143168 - DNA, 16 bp, H. sapiens
tgaagacccaggagag

SEQ ID NO: 143169 - DNA, 16 bp, H. sapiens
tgaagaccttccagtg

SEQ ID NO: 143170 - DNA, 16 bp, H. sapiens
tgaagacggaggcaga

SEQ ID NO: 143171 - DNA, 16 bp, H. sapiens
tgaagactccaccaaa

SEQ ID NO: 143172 - DNA, 16 bp, H. sapiens
tgaagactggtctttt

SEQ ID NO: 143173 - DNA, 16 bp, H. sapiens
tgaagactgtgggaaa

SEQ ID NO: 143174 - DNA, 16 bp, H. sapiens
tgaagacttactgtat

SEQ ID NO: 143175 - DNA, 16 bp, H. sapiens
tgaagacttctttgga

SEQ ID NO: 143176 - DNA, 16 bp, H. sapiens
tgaagagaaaaatcaa

SEQ ID NO: 143177 - DNA, 16 bp, H. sapiens
tgaagagaaaatattt

SEQ ID NO: 143178 - DNA, 16 bp, H. sapiens
tgaagagaaacataaa

SEQ ID NO: 143179 - DNA, 16 bp, H. sapiens
tgaagagaacaagaaa

SEQ ID NO: 143180 - DNA, 16 bp, H. sapiens
tgaagagacaaccaaa

SEQ ID NO: 143181 - DNA, 16 bp, H. sapiens
tgaagagacagcctac

SEQ ID NO: 143182 - DNA, 16 bp, H. sapiens
tgaagagaccactaaa

SEQ ID NO: 143183 - DNA, 16 bp, H. sapiens
tgaagagaccatcaaa

SEQ ID NO: 143184 - DNA, 16 bp, H. sapiens
tgaagagactattctt

SEQ ID NO: 143185 - DNA, 16 bp, H. sapiens
tgaagagactgaggct

SEQ ID NO: 143186 - DNA, 16 bp, H. sapiens
tgaagagactgtcctt

SEQ ID NO: 143187 - DNA, 16 bp, H. sapiens
tgaagagataattatt

SEQ ID NO: 143188 - DNA, 16 bp, H. sapiens
tgaagagatatttggt

SEQ ID NO: 143189 - DNA, 16 bp, H. sapiens
tgaagagatatttgta

SEQ ID NO: 143190 - DNA, 16 bp, H. sapiens
tgaagagatgccttcc

SEQ ID NO: 143191 - DNA, 16 bp, H. sapiens
tgaagagctctgtgat

SEQ ID NO: 143192 - DNA, 16 bp, H. sapiens
tgaagagcttggagtc

SEQ ID NO: 143193 - DNA, 16 bp, H. sapiens
tgaagagctttaaaaa

SEQ ID NO: 143194 - DNA, 16 bp, H. sapiens
tgaagaggaacttttt

SEQ ID NO: 143195 - DNA, 16 bp, H. sapiens
tgaagaggaaggaggc

SEQ ID NO: 143196 - DNA, 16 bp, H. sapiens
tgaagaggaggaaatt

SEQ ID NO: 143197 - DNA, 16 bp, H. sapiens
tgaagaggccactggc

SEQ ID NO: 143198 - DNA, 16 bp, H. sapiens
tgaagaggtccttgac

SEQ ID NO: 143199 - DNA, 16 bp, H. sapiens
tgaagagtactggcca

SEQ ID NO: 143200 - DNA, 16 bp, H. sapiens
tgaagagtatttcatt

SEQ ID NO: 143201 - DNA, 16 bp, H. sapiens
tgaagagttgagagaa

SEQ ID NO: 143202 - DNA, 16 bp, H. sapiens
tgaagataaatctttt

SEQ ID NO: 143203 - DNA, 16 bp, H. sapiens
tgaagataatatttta

SEQ ID NO: 143204 - DNA, 16 bp, H. sapiens
tgaagataattcattt

SEQ ID NO: 143205 - DNA, 16 bp, H. sapiens
tgaagatacagagatg

SEQ ID NO: 143206 - DNA, 16 bp, H. sapiens
tgaagatatattcttt

SEQ ID NO: 143207 - DNA, 16 bp, H. sapiens
tgaagatattaccttt

SEQ ID NO: 143208 - DNA, 16 bp, H. sapiens
tgaagatatttattct

SEQ ID NO: 143209 - DNA, 16 bp, H. sapiens
tgaagatatttgcttt

SEQ ID NO: 143210 - DNA, 16 bp, H. sapiens
tgaagatatttttaaa

SEQ ID NO: 143211 - DNA, 16 bp, H. sapiens
tgaagatcaaatgaga

SEQ ID NO: 143212 - DNA, 16 bp, H. sapiens
tgaagatcagatggtc

SEQ ID NO: 143213 - DNA, 16 bp, H. sapiens
tgaagatcattgagat

SEQ ID NO: 143214 - DNA, 16 bp, H. sapiens
tgaagatccagtttca

SEQ ID NO: 143215 - DNA, 16 bp, H. sapiens
tgaagatctaaataaa

SEQ ID NO: 143216 - DNA, 16 bp, H. sapiens
tgaagatgaaggcaga

SEQ ID NO: 143217 - DNA, 16 bp, H. sapiens
tgaagatgagaaactt

SEQ ID NO: 143218 - DNA, 16 bp, H. sapiens
tgaagatgaggaaatt

SEQ ID NO: 143219 - DNA, 16 bp, H. sapiens
tgaagatgataatgat

SEQ ID NO: 143220 - DNA, 16 bp, H. sapiens
tgaagatgatgaagat

SEQ ID NO: 143221 - DNA, 16 bp, H. sapiens
tgaagatgatgagaat

SEQ ID NO: 143222 - DNA, 16 bp, H. sapiens
tgaagatgatgaggat

SEQ ID NO: 143223 - DNA, 16 bp, H. sapiens
tgaagatgatgatgaa

SEQ ID NO: 143224 - DNA, 16 bp, H. sapiens
tgaagatgatgatggt

SEQ ID NO: 143225 - DNA, 16 bp, H. sapiens
tgaagatgctgtgaac

SEQ ID NO: 143226 - DNA, 16 bp, H. sapiens
tgaagatgcttttgga

SEQ ID NO: 143227 - DNA, 16 bp, H. sapiens
tgaagatggaaaccat

SEQ ID NO: 143228 - DNA, 16 bp, H. sapiens
tgaagatggagaaaga

SEQ ID NO: 143229 - DNA, 16 bp, H. sapiens
tgaagatggagaaagg

SEQ ID NO: 143230 - DNA, 16 bp, H. sapiens
tgaagatggagacaga

SEQ ID NO: 143231 - DNA, 16 bp, H. sapiens
tgaagatggaggaaaa

SEQ ID NO: 143232 - DNA, 16 bp, H. sapiens
tgaagatggaggcaga

SEQ ID NO: 143233 - DNA, 16 bp, H. sapiens
tgaagatggggagaaa

SEQ ID NO: 143234 - DNA, 16 bp, H. sapiens
tgaagatgtgaatgaa

SEQ ID NO: 143235 - DNA, 16 bp, H. sapiens
tgaagatgtggaaaaa

SEQ ID NO: 143236 - DNA, 16 bp, H. sapiens
tgaagatgtggagcaa

SEQ ID NO: 143237 - DNA, 16 bp, H. sapiens
tgaagatgttctttga

SEQ ID NO: 143238 - DNA, 16 bp, H. sapiens
tgaagattaaagaaga

SEQ ID NO: 143239 - DNA, 16 bp, H. sapiens
tgaagattaaatagaa

SEQ ID NO: 143240 - DNA, 16 bp, H. sapiens
tgaagattaaatggga

SEQ ID NO: 143241 - DNA, 16 bp, H. sapiens
tgaagattacatgaga

SEQ ID NO: 143242 - DNA, 16 bp, H. sapiens
tgaagattgaggatgg

SEQ ID NO: 143243 - DNA, 16 bp, H. sapiens
tgaagattgttttatg

SEQ ID NO: 143244 - DNA, 16 bp, H. sapiens
tgaagatttctcccct

SEQ ID NO: 143245 - DNA, 16 bp, H. sapiens
tgaagattttaaaaat

SEQ ID NO: 143246 - DNA, 16 bp, H. sapiens
tgaagattttttaaaa

SEQ ID NO: 143247 - DNA, 16 bp, H. sapiens
tgaagcaaaataaaat

SEQ ID NO: 143248 - DNA, 16 bp, H. sapiens
tgaagcaaaatataat

SEQ ID NO: 143249 - DNA, 16 bp, H. sapiens
tgaagcaaacaaacaa

SEQ ID NO: 143250 - DNA, 16 bp, H. sapiens
tgaagcaaaggtgact

SEQ ID NO: 143251 - DNA, 16 bp, H. sapiens
tgaagcaactgaagaa

SEQ ID NO: 143252 - DNA, 16 bp, H. sapiens
tgaagcaagagaatct

SEQ ID NO: 143253 - DNA, 16 bp, H. sapiens
tgaagcacaccaacat

SEQ ID NO: 143254 - DNA, 16 bp, H. sapiens
tgaagcacagagaggt

SEQ ID NO: 143255 - DNA, 16 bp, H. sapiens
tgaagcagaaaatgaa

SEQ ID NO: 143256 - DNA, 16 bp, H. sapiens
tgaagcagaaataaaa

SEQ ID NO: 143257 - DNA, 16 bp, H. sapiens
tgaagcagaaggaaaa

SEQ ID NO: 143258 - DNA, 16 bp, H. sapiens
tgaagcagacagatca

SEQ ID NO: 143259 - DNA, 16 bp, H. sapiens
tgaagcagagaattgc

SEQ ID NO: 143260 - DNA, 16 bp, H. sapiens
tgaagcaggaaaatca

SEQ ID NO: 143261 - DNA, 16 bp, H. sapiens
tgaagcaggaaaatgg

SEQ ID NO: 143262 - DNA, 16 bp, H. sapiens
tgaagcaggaagaaat

SEQ ID NO: 143263 - DNA, 16 bp, H. sapiens
tgaagcaggagcatca

SEQ ID NO: 143264 - DNA, 16 bp, H. sapiens
tgaagcaggaggatct

SEQ ID NO: 143265 - DNA, 16 bp, H. sapiens
tgaagcagggaggcag

SEQ ID NO: 143266 - DNA, 16 bp, H. sapiens
tgaagcagggtggggc

SEQ ID NO: 143267 - DNA, 16 bp, H. sapiens
tgaagcagtgttgaat

SEQ ID NO: 143268 - DNA, 20 bp, H. sapiens
tgaagcatacacaagtatca

SEQ ID NO: 143269 - DNA, 16 bp, H. sapiens
tgaagccaacttggtc

SEQ ID NO: 143270 - DNA, 16 bp, H. sapiens
tgaagccacggaccct

SEQ ID NO: 143271 - DNA, 16 bp, H. sapiens
tgaagccagaagccat

SEQ ID NO: 143272 - DNA, 16 bp, H. sapiens
tgaagccagaaggcag

SEQ ID NO: 143273 - DNA, 16 bp, H. sapiens
tgaagccagacaactt

SEQ ID NO: 143274 - DNA, 17 bp, H. sapiens
tgaagccagcaagacca

SEQ ID NO: 143275 - DNA, 16 bp, H. sapiens
tgaagccagcatagca

SEQ ID NO: 143276 - DNA, 16 bp, H. sapiens
tgaagccagcattatc

SEQ ID NO: 143277 - DNA, 16 bp, H. sapiens
tgaagccaggacttca

SEQ ID NO: 143278 - DNA, 16 bp, H. sapiens
tgaagccaggagttcg

SEQ ID NO: 143279 - DNA, 16 bp, H. sapiens
tgaagccaggctgcct

SEQ ID NO: 143280 - DNA, 16 bp, H. sapiens
tgaagccatcaagtcc

SEQ ID NO: 143281 - DNA, 16 bp, H. sapiens
tgaagccatctggttc

SEQ ID NO: 143282 - DNA, 16 bp, H. sapiens
tgaagccatggcccaa

SEQ ID NO: 143283 - DNA, 16 bp, H. sapiens
tgaagcccagagaggt

SEQ ID NO: 143284 - DNA, 16 bp, H. sapiens
tgaagccctaaccccc

SEQ ID NO: 143285 - DNA, 16 bp, H. sapiens
tgaagcctccagcttt

SEQ ID NO: 143286 - DNA, 16 bp, H. sapiens
tgaagcctccataaaa

SEQ ID NO: 143287 - DNA, 16 bp, H. sapiens
tgaagcctccccagca

SEQ ID NO: 143288 - DNA, 16 bp, H. sapiens
tgaagcctctccagcc

SEQ ID NO: 143289 - DNA, 16 bp, H. sapiens
tgaagccttcttccct

SEQ ID NO: 143290 - DNA, 16 bp, H. sapiens
tgaagctagcacagca

SEQ ID NO: 143291 - DNA, 16 bp, H. sapiens
tgaagctatatatata

SEQ ID NO: 143292 - DNA, 16 bp, H. sapiens
tgaagctcagaaaggt

SEQ ID NO: 143293 - DNA, 16 bp, H. sapiens
tgaagctcagagaagg

SEQ ID NO: 143294 - DNA, 16 bp, H. sapiens
tgaagctcagagaagt

SEQ ID NO: 143295 - DNA, 16 bp, H. sapiens
tgaagctcagtttggc

SEQ ID NO: 143296 - DNA, 16 bp, H. sapiens
tgaagctccaaaatga

SEQ ID NO: 143297 - DNA, 16 bp, H. sapiens
tgaagctgcagacctt

SEQ ID NO: 143298 - DNA, 16 bp, H. sapiens
tgaagctgcagacgtt

SEQ ID NO: 143299 - DNA, 16 bp, H. sapiens
tgaagctgcagacttt

SEQ ID NO: 143300 - DNA, 16 bp, H. sapiens
tgaagctgcagtgacc

SEQ ID NO: 143301 - DNA, 16 bp, H. sapiens
tgaagctggaaacatc

SEQ ID NO: 143302 - DNA, 16 bp, H. sapiens
tgaagctggaaaccac

SEQ ID NO: 143303 - DNA, 16 bp, H. sapiens
tgaagctggaagccat

SEQ ID NO: 143304 - DNA, 17 bp, H. sapiens
tgaagctggaagccatc

SEQ ID NO: 143305 - DNA, 16 bp, H. sapiens
tgaagctggaaggcag

SEQ ID NO: 143306 - DNA, 16 bp, H. sapiens
tgaagctggagaattg

SEQ ID NO: 143307 - DNA, 16 bp, H. sapiens
tgaagctggaggcaga

SEQ ID NO: 143308 - DNA, 16 bp, H. sapiens
tgaagctggaggccat

SEQ ID NO: 143309 - DNA, 16 bp, H. sapiens
tgaagctgtcctcctg

SEQ ID NO: 143310 - DNA, 19 bp, H. sapiens
tgaagctgtttcctttact

SEQ ID NO: 143311 - DNA, 16 bp, H. sapiens
tgaagcttagtttgac

SEQ ID NO: 143312 - DNA, 16 bp, H. sapiens
tgaagcttcactcact

SEQ ID NO: 143313 - DNA, 16 bp, H. sapiens
tgaagctttgcggcag

SEQ ID NO: 143314 - DNA, 16 bp, H. sapiens
tgaaggaaaaaaatgt

SEQ ID NO: 143315 - DNA, 16 bp, H. sapiens
tgaaggaaaaaatgat

SEQ ID NO: 143316 - DNA, 16 bp, H. sapiens
tgaaggaaaagaccct

SEQ ID NO: 143317 - DNA, 16 bp, H. sapiens
tgaaggaaaatgatac

SEQ ID NO: 143318 - DNA, 16 bp, H. sapiens
tgaaggaaagaagcca

SEQ ID NO: 143319 - DNA, 16 bp, H. sapiens
tgaaggaaagaagttt

SEQ ID NO: 143320 - DNA, 16 bp, H. sapiens
tgaaggaaagagattt

SEQ ID NO: 143321 - DNA, 16 bp, H. sapiens
tgaaggaaagctgtgt

SEQ ID NO: 143322 - DNA, 16 bp, H. sapiens
tgaaggaaataaacaa

SEQ ID NO: 143323 - DNA, 16 bp, H. sapiens
tgaaggaaatcaaaat

SEQ ID NO: 143324 - DNA, 16 bp, H. sapiens
tgaaggaaatcataga

SEQ ID NO: 143325 - DNA, 16 bp, H. sapiens
tgaaggaacaaatgaa

SEQ ID NO: 143326 - DNA, 17 bp, H. sapiens
tgaaggaactcttcaag

SEQ ID NO: 143327 - DNA, 16 bp, H. sapiens
tgaaggaagcactgaa

SEQ ID NO: 143328 - DNA, 16 bp, H. sapiens
tgaaggaagcagtaaa

SEQ ID NO: 143329 - DNA, 16 bp, H. sapiens
tgaaggaagttaaaag

SEQ ID NO: 143330 - DNA, 16 bp, H. sapiens
tgaaggaatgaacaaa

SEQ ID NO: 143331 - DNA, 16 bp, H. sapiens
tgaaggaatgagtgaa

SEQ ID NO: 143332 - DNA, 16 bp, H. sapiens
tgaaggacaaaaatca

SEQ ID NO: 143333 - DNA, 16 bp, H. sapiens
tgaaggacaaaatcca

SEQ ID NO: 143334 - DNA, 16 bp, H. sapiens
tgaaggacaaacactc

SEQ ID NO: 143335 - DNA, 16 bp, H. sapiens
tgaaggacattctaca

SEQ ID NO: 143336 - DNA, 37 bp, H. sapiens
tgaaggacctcttcaaggagaactacaaaccactgct

SEQ ID NO: 143337 - DNA, 39 bp, H. sapiens
tgaaggacctcttcaaggagaactacaaaccactgctca

SEQ ID NO: 143338 - DNA, 16 bp, H. sapiens
tgaaggacctcttcag

SEQ ID NO: 143339 - DNA, 17 bp, H. sapiens
tgaaggacctctttgag

SEQ ID NO: 143340 - DNA, 16 bp, H. sapiens
tgaaggagaaatcaaa

SEQ ID NO: 143341 - DNA, 16 bp, H. sapiens
tgaaggagaacaaagt

SEQ ID NO: 143342 - DNA, 16 bp, H. sapiens
tgaaggagaagaacaa

SEQ ID NO: 143343 - DNA, 16 bp, H. sapiens
tgaaggagaagaggca

SEQ ID NO: 143344 - DNA, 16 bp, H. sapiens
tgaaggagaagcaagt

SEQ ID NO: 143345 - DNA, 16 bp, H. sapiens
tgaaggagaagcaggc

SEQ ID NO: 143346 - DNA, 16 bp, H. sapiens
tgaaggagatacagac

SEQ ID NO: 143347 - DNA, 16 bp, H. sapiens
tgaaggagctgggaag

SEQ ID NO: 143348 - DNA, 16 bp, H. sapiens
tgaaggaggagaatgg

SEQ ID NO: 143349 - DNA, 16 bp, H. sapiens
tgaaggaggggtctgt

SEQ ID NO: 143350 - DNA, 16 bp, H. sapiens
tgaaggaggtgaagga

SEQ ID NO: 143351 - DNA, 16 bp, H. sapiens
tgaaggaggtgagaga

SEQ ID NO: 143352 - DNA, 16 bp, H. sapiens
tgaaggatatgaacaa

SEQ ID NO: 143353 - DNA, 16 bp, H. sapiens
tgaaggatattttcaa

SEQ ID NO: 143354 - DNA, 16 bp, H. sapiens
tgaaggatgaagagga

SEQ ID NO: 143355 - DNA, 16 bp, H. sapiens
tgaaggatgagaagaa

SEQ ID NO: 143356 - DNA, 16 bp, H. sapiens
tgaaggatgagtagga

SEQ ID NO: 143357 - DNA, 16 bp, H. sapiens
tgaaggattcacatgc

SEQ ID NO: 143358 - DNA, 16 bp, H. sapiens
tgaaggatttttttct

SEQ ID NO: 143359 - DNA, 16 bp, H. sapiens
tgaaggcaactgagaa

SEQ ID NO: 143360 - DNA, 16 bp, H. sapiens
tgaaggcaaggttaat

SEQ ID NO: 143361 - DNA, 16 bp, H. sapiens
tgaaggcacaaaactc

SEQ ID NO: 143362 - DNA, 16 bp, H. sapiens
tgaaggcacaaataaa

SEQ ID NO: 143363 - DNA, 16 bp, H. sapiens
tgaaggcagaattaaa

SEQ ID NO: 143364 - DNA, 16 bp, H. sapiens
tgaaggcagccaggag

SEQ ID NO: 143365 - DNA, 16 bp, H. sapiens
tgaaggcatttcagaa

SEQ ID NO: 143366 - DNA, 21 bp, H. sapiens
tgaaggccaactaatcttaaa

SEQ ID NO: 143367 - DNA, 16 bp, H. sapiens
tgaaggccaggctgag

SEQ ID NO: 143368 - DNA, 16 bp, H. sapiens
tgaaggccctcttcaa

SEQ ID NO: 143369 - DNA, 16 bp, H. sapiens
tgaaggcctgctttct

SEQ ID NO: 143370 - DNA, 16 bp, H. sapiens
tgaaggctcctgggcc

SEQ ID NO: 143371 - DNA, 16 bp, H. sapiens
tgaaggctggggtggc

SEQ ID NO: 143372 - DNA, 16 bp, H. sapiens
tgaaggcttcttctct

SEQ ID NO: 143373 - DNA, 16 bp, H. sapiens
tgaaggctttcccaca

SEQ ID NO: 143374 - DNA, 16 bp, H. sapiens
tgaagggaaaaatata

SEQ ID NO: 143375 - DNA, 16 bp, H. sapiens
tgaagggaaaaatgtt

SEQ ID NO: 143376 - DNA, 16 bp, H. sapiens
tgaagggaaatcctcc

SEQ ID NO: 143377 - DNA, 16 bp, H. sapiens
tgaagggagagaccca

SEQ ID NO: 143378 - DNA, 16 bp, H. sapiens
tgaagggagagataga

SEQ ID NO: 143379 - DNA, 16 bp, H. sapiens
tgaagggaggcagtga

SEQ ID NO: 143380 - DNA, 16 bp, H. sapiens
tgaagggatgcagtga

SEQ ID NO: 143381 - DNA, 16 bp, H. sapiens
tgaagggcagccagag

SEQ ID NO: 143382 - DNA, 16 bp, H. sapiens
tgaaggggaaactgag

SEQ ID NO: 143383 - DNA, 16 bp, H. sapiens
tgaaggggaagcagac

SEQ ID NO: 143384 - DNA, 16 bp, H. sapiens
tgaaggggatggcatt

SEQ ID NO: 143385 - DNA, 16 bp, H. sapiens
tgaaggggcaaaaact

SEQ ID NO: 143386 - DNA, 17 bp, H. sapiens
tgaaggtctgcagcttc

SEQ ID NO: 143387 - DNA, 16 bp, H. sapiens
tgaaggtcttctctgt

SEQ ID NO: 143388 - DNA, 16 bp, H. sapiens
tgaaggtgaaggggaa

SEQ ID NO: 143389 - DNA, 16 bp, H. sapiens
tgaaggtgctggcagg

SEQ ID NO: 143390 - DNA, 16 bp, H. sapiens
tgaaggtggaaataaa

SEQ ID NO: 143391 - DNA, 16 bp, H. sapiens
tgaaggtggagccctc

SEQ ID NO: 143392 - DNA, 16 bp, H. sapiens
tgaaggtggaggcaga

SEQ ID NO: 143393 - DNA, 16 bp, H. sapiens
tgaaggtggggcctag

SEQ ID NO: 143394 - DNA, 16 bp, H. sapiens
tgaaggtgtttctgga

SEQ ID NO: 143395 - DNA, 16 bp, H. sapiens
tgaaggttaagttgat

SEQ ID NO: 143396 - DNA, 16 bp, H. sapiens
tgaaggttcagatgat

SEQ ID NO: 143397 - DNA, 16 bp, H. sapiens
tgaaggtttcatggct

SEQ ID NO: 143398 - DNA, 16 bp, H. sapiens
tgaaggtttcttttgg

SEQ ID NO: 143399 - DNA, 16 bp, H. sapiens
tgaaggtttgtggcaa

SEQ ID NO: 143400 - DNA, 16 bp, H. sapiens
tgaaggtttttttaaa

SEQ ID NO: 143401 - DNA, 16 bp, H. sapiens
tgaagtaaaataattt

SEQ ID NO: 143402 - DNA, 16 bp, H. sapiens
tgaagtaactctggaa

SEQ ID NO: 143403 - DNA, 16 bp, H. sapiens
tgaagtaactgaagaa

SEQ ID NO: 143404 - DNA, 16 bp, H. sapiens
tgaagtaatttttaaa

SEQ ID NO: 143405 - DNA, 16 bp, H. sapiens
tgaagtactgatacat

SEQ ID NO: 143406 - DNA, 16 bp, H. sapiens
tgaagtatctaaaata

SEQ ID NO: 143407 - DNA, 16 bp, H. sapiens
tgaagtattttaaagt

SEQ ID NO: 143408 - DNA, 16 bp, H. sapiens
tgaagtcacaattaca

SEQ ID NO: 143409 - DNA, 16 bp, H. sapiens
tgaagtcaggagatcg

SEQ ID NO: 143410 - DNA, 16 bp, H. sapiens
tgaagtcaggagttag

SEQ ID NO: 143411 - DNA, 16 bp, H. sapiens
tgaagtcaggagtttg

SEQ ID NO: 143412 - DNA, 16 bp, H. sapiens
tgaagtcaggtgtttg

SEQ ID NO: 143413 - DNA, 16 bp, H. sapiens
tgaagtcataataaaa

SEQ ID NO: 143414 - DNA, 16 bp, H. sapiens
tgaagtccacctggag

SEQ ID NO: 143415 - DNA, 16 bp, H. sapiens
tgaagtcccagctact

SEQ ID NO: 143416 - DNA, 16 bp, H. sapiens
tgaagtcctgagctca

SEQ ID NO: 143417 - DNA, 16 bp, H. sapiens
tgaagtctccataaaa

SEQ ID NO: 143418 - DNA, 16 bp, H. sapiens
tgaagtctccccagcc

SEQ ID NO: 143419 - DNA, 16 bp, H. sapiens
tgaagtctcgctctgt

SEQ ID NO: 143420 - DNA, 16 bp, H. sapiens
tgaagtctgagatttt

SEQ ID NO: 143421 - DNA, 16 bp, H. sapiens
tgaagtctgggctttt

SEQ ID NO: 143422 - DNA, 16 bp, H. sapiens
tgaagtcttaaccccc

SEQ ID NO: 143423 - DNA, 16 bp, H. sapiens
tgaagtcttcatctga

SEQ ID NO: 143424 - DNA, 16 bp, H. sapiens
tgaagtctttgaccat

SEQ ID NO: 143425 - DNA, 16 bp, H. sapiens
tgaagtcttttcccat

SEQ ID NO: 143426 - DNA, 16 bp, H. sapiens
tgaagtgaagtggcat

SEQ ID NO: 143427 - DNA, 16 bp, H. sapiens
tgaagtgacttgttca

SEQ ID NO: 143428 - DNA, 16 bp, H. sapiens
tgaagtgagagaatca

SEQ ID NO: 143429 - DNA, 16 bp, H. sapiens
tgaagtgagctgagat

SEQ ID NO: 143430 - DNA, 16 bp, H. sapiens
tgaagtgatttgccca

SEQ ID NO: 143431 - DNA, 16 bp, H. sapiens
tgaagtgattttcctg

SEQ ID NO: 143432 - DNA, 16 bp, H. sapiens
tgaagtgctgggatta

SEQ ID NO: 143433 - DNA, 16 bp, H. sapiens
tgaagtgggaagattg

SEQ ID NO: 143434 - DNA, 16 bp, H. sapiens
tgaagtgggagaatcg

SEQ ID NO: 143435 - DNA, 16 bp, H. sapiens
tgaagtgggagaatgg

SEQ ID NO: 143436 - DNA, 16 bp, H. sapiens
tgaagtgggcttcatc

SEQ ID NO: 143437 - DNA, 16 bp, H. sapiens
tgaagtgtagtggcat

SEQ ID NO: 143438 - DNA, 16 bp, H. sapiens
tgaagtgttgggatta

SEQ ID NO: 143439 - DNA, 16 bp, H. sapiens
tgaagttaaaaacaaa

SEQ ID NO: 143440 - DNA, 16 bp, H. sapiens
tgaagttaattttaat

SEQ ID NO: 143441 - DNA, 16 bp, H. sapiens
tgaagttatttcattt

SEQ ID NO: 143442 - DNA, 16 bp, H. sapiens
tgaagttcaaatttca

SEQ ID NO: 143443 - DNA, 16 bp, H. sapiens
tgaagttctctgaaat

SEQ ID NO: 143444 - DNA, 16 bp, H. sapiens
tgaagttggaggatca

SEQ ID NO: 143445 - DNA, 16 bp, H. sapiens
tgaagtttcaccatgt

SEQ ID NO: 143446 - DNA, 16 bp, H. sapiens
tgaagtttccctgaaa

SEQ ID NO: 143447 - DNA, 16 bp, H. sapiens
tgaagtttctgattat

SEQ ID NO: 143448 - DNA, 16 bp, H. sapiens
tgaagtttcttatcag

SEQ ID NO: 143449 - DNA, 16 bp, H. sapiens
tgaagtttctttttgg

SEQ ID NO: 143450 - DNA, 16 bp, H. sapiens
tgaagtttgaatatga

SEQ ID NO: 143451 - DNA, 16 bp, H. sapiens
tgaagtttgctggagg

SEQ ID NO: 143452 - DNA, 16 bp, H. sapiens
tgaagtttggcagtta

SEQ ID NO: 143453 - DNA, 16 bp, H. sapiens
tgaagttttaaaaata

SEQ ID NO: 143454 - DNA, 16 bp, H. sapiens
tgaagttttaaaaatg

SEQ ID NO: 143455 - DNA, 16 bp, H. sapiens
tgaagttttaaaaatt

SEQ ID NO: 143456 - DNA, 16 bp, H. sapiens
tgaagttttaaaattt

SEQ ID NO: 143457 - DNA, 16 bp, H. sapiens
tgaagttttctttatt

SEQ ID NO: 143458 - DNA, 16 bp, H. sapiens
tgaagttttgctcttt

SEQ ID NO: 143459 - DNA, 16 bp, H. sapiens
tgaagttttgctgggg

SEQ ID NO: 143460 - DNA, 16 bp, H. sapiens
tgaagttttgggcacg

SEQ ID NO: 143461 - DNA, 16 bp, H. sapiens
tgaataaaagttattt

SEQ ID NO: 143462 - DNA, 16 bp, H. sapiens
tgaataaaatctgttt

SEQ ID NO: 143463 - DNA, 16 bp, H. sapiens
tgaataaaatgagaat

SEQ ID NO: 143464 - DNA, 16 bp, H. sapiens
tgaataaaatgtttaa

SEQ ID NO: 143465 - DNA, 16 bp, H. sapiens
tgaataaagaatgaat

SEQ ID NO: 143466 - DNA, 16 bp, H. sapiens
tgaataaagcttctgt

SEQ ID NO: 143467 - DNA, 16 bp, H. sapiens
tgaataaagttatttt

SEQ ID NO: 143468 - DNA, 16 bp, H. sapiens
tgaataaataaatgag

SEQ ID NO: 143469 - DNA, 16 bp, H. sapiens
tgaataaataaatgtt

SEQ ID NO: 143470 - DNA, 16 bp, H. sapiens
tgaataaatagatgaa

SEQ ID NO: 143471 - DNA, 16 bp, H. sapiens
tgaataaatgaacaaa

SEQ ID NO: 143472 - DNA, 16 bp, H. sapiens
tgaataaatgaaccaa

SEQ ID NO: 143473 - DNA, 16 bp, H. sapiens
tgaataaatgattgaa

SEQ ID NO: 143474 - DNA, 16 bp, H. sapiens
tgaataaatgcttctc

SEQ ID NO: 143475 - DNA, 16 bp, H. sapiens
tgaataaatggatgaa

SEQ ID NO: 143476 - DNA, 16 bp, H. sapiens
tgaataaattcttgga

SEQ ID NO: 143477 - DNA, 16 bp, H. sapiens
tgaataaatttgaatt

SEQ ID NO: 143478 - DNA, 29 bp, H. sapiens
tgaataaattttgcttctaagagaagtta

SEQ ID NO: 143479 - DNA, 16 bp, H. sapiens
tgaataagaaatattt

SEQ ID NO: 143480 - DNA, 16 bp, H. sapiens
tgaataagcaaatgaa

SEQ ID NO: 143481 - DNA, 16 bp, H. sapiens
tgaataagcatggctg

SEQ ID NO: 143482 - DNA, 16 bp, H. sapiens
tgaataaggaaattga

SEQ ID NO: 143483 - DNA, 16 bp, H. sapiens
tgaataagtcttatga

SEQ ID NO: 143484 - DNA, 16 bp, H. sapiens
tgaataagtgaaagaa

SEQ ID NO: 143485 - DNA, 16 bp, H. sapiens
tgaataataataaaac

SEQ ID NO: 143486 - DNA, 16 bp, H. sapiens
tgaataatacttcatt

SEQ ID NO: 143487 - DNA, 16 bp, H. sapiens
tgaataatactttatt

SEQ ID NO: 143488 - DNA, 16 bp, H. sapiens
tgaataatattccctt

SEQ ID NO: 143489 - DNA, 16 bp, H. sapiens
tgaataatatttgatt

SEQ ID NO: 143490 - DNA, 16 bp, H. sapiens
tgaataatcatgtaag

SEQ ID NO: 143491 - DNA, 16 bp, H. sapiens
tgaataatgctatgaa

SEQ ID NO: 143492 - DNA, 16 bp, H. sapiens
tgaataatttcatttt

SEQ ID NO: 143493 - DNA, 16 bp, H. sapiens
tgaatacaatgtggaa

SEQ ID NO: 143494 - DNA, 16 bp, H. sapiens
tgaatacagaaaaata

SEQ ID NO: 143495 - DNA, 16 bp, H. sapiens
tgaatacagcacacca

SEQ ID NO: 143496 - DNA, 16 bp, H. sapiens
tgaatacataaataca

SEQ ID NO: 143497 - DNA, 16 bp, H. sapiens
tgaatacatgaatgaa

SEQ ID NO: 143498 - DNA, 16 bp, H. sapiens
tgaatacatggaaatt

SEQ ID NO: 143499 - DNA, 16 bp, H. sapiens
tgaatacatttatatt

SEQ ID NO: 143500 - DNA, 16 bp, H. sapiens
tgaatactatactgaa

SEQ ID NO: 143501 - DNA, 16 bp, H. sapiens
tgaatactttgcaaat

SEQ ID NO: 143502 - DNA, 16 bp, H. sapiens
tgaatagaaatagtga

SEQ ID NO: 143503 - DNA, 16 bp, H. sapiens
tgaatagaagatcaaa

SEQ ID NO: 143504 - DNA, 16 bp, H. sapiens
tgaatagaagtggtaa

SEQ ID NO: 143505 - DNA, 16 bp, H. sapiens
tgaatagacatttctc

SEQ ID NO: 143506 - DNA, 16 bp, H. sapiens
tgaatagattaatcca

SEQ ID NO: 143507 - DNA, 16 bp, H. sapiens
tgaatagcagtgatga

SEQ ID NO: 143508 - DNA, 16 bp, H. sapiens
tgaatagctggaatta

SEQ ID NO: 143509 - DNA, 16 bp, H. sapiens
tgaatagtaaatatgt

SEQ ID NO: 143510 - DNA, 16 bp, H. sapiens
tgaatagtcttccatt

SEQ ID NO: 143511 - DNA, 16 bp, H. sapiens
tgaatagtgctgtgat

SEQ ID NO: 143512 - DNA, 16 bp, H. sapiens
tgaatagtttgaaaat

SEQ ID NO: 143513 - DNA, 16 bp, H. sapiens
tgaatataaatggatt

SEQ ID NO: 143514 - DNA, 16 bp, H. sapiens
tgaatatactattcta

SEQ ID NO: 143515 - DNA, 16 bp, H. sapiens
tgaatatacttgttaa

SEQ ID NO: 143516 - DNA, 16 bp, H. sapiens
tgaatatatgaaagaa

SEQ ID NO: 143517 - DNA, 16 bp, H. sapiens
tgaatatatgaatatt

SEQ ID NO: 143518 - DNA, 16 bp, H. sapiens
tgaatatatgtaaata

SEQ ID NO: 143519 - DNA, 16 bp, H. sapiens
tgaatatatgtgtgtg

SEQ ID NO: 143520 - DNA, 16 bp, H. sapiens
tgaatatatttaacac

SEQ ID NO: 143521 - DNA, 16 bp, H. sapiens
tgaatatattttctgt

SEQ ID NO: 143522 - DNA, 16 bp, H. sapiens
tgaatatattttgcat

SEQ ID NO: 143523 - DNA, 16 bp, H. sapiens
tgaatatcagatggtt

SEQ ID NO: 143524 - DNA, 16 bp, H. sapiens
tgaatatcatgaaaat

SEQ ID NO: 143525 - DNA, 16 bp, H. sapiens
tgaatatctacatgca

SEQ ID NO: 143526 - DNA, 16 bp, H. sapiens
tgaatatctcatgtaa

SEQ ID NO: 143527 - DNA, 16 bp, H. sapiens
tgaatatgctttattt

SEQ ID NO: 143528 - DNA, 16 bp, H. sapiens
tgaatatgtcattcca

SEQ ID NO: 143529 - DNA, 16 bp, H. sapiens
tgaatatgttttaaaa

SEQ ID NO: 143530 - DNA, 16 bp, H. sapiens
tgaatattaaaccttt

SEQ ID NO: 143531 - DNA, 16 bp, H. sapiens
tgaatattaatatctt

SEQ ID NO: 143532 - DNA, 16 bp, H. sapiens
tgaatattaatccttt

SEQ ID NO: 143533 - DNA, 16 bp, H. sapiens
tgaatattcatataca

SEQ ID NO: 143534 - DNA, 16 bp, H. sapiens
tgaatatttaatgaat

SEQ ID NO: 143535 - DNA, 16 bp, H. sapiens
tgaatatttactgaat

SEQ ID NO: 143536 - DNA, 16 bp, H. sapiens
tgaatatttattaagc

SEQ ID NO: 143537 - DNA, 16 bp, H. sapiens
tgaatatttattgaat

SEQ ID NO: 143538 - DNA, 16 bp, H. sapiens
tgaatatttcaaaata

SEQ ID NO: 143539 - DNA, 16 bp, H. sapiens
tgaatatttgtgtttc

SEQ ID NO: 143540 - DNA, 16 bp, H. sapiens
tgaatattttaagcac

SEQ ID NO: 143541 - DNA, 16 bp, H. sapiens
tgaatattttcaaatg

SEQ ID NO: 143542 - DNA, 16 bp, H. sapiens
tgaatattttgaatat

SEQ ID NO: 143543 - DNA, 16 bp, H. sapiens
tgaatatttttagaaa

SEQ ID NO: 143544 - DNA, 16 bp, H. sapiens
tgaatatttttcttct

SEQ ID NO: 143545 - DNA, 16 bp, H. sapiens
tgaatattttttctat

SEQ ID NO: 143546 - DNA, 16 bp, H. sapiens
tgaatcaaaaactctg

SEQ ID NO: 143547 - DNA, 16 bp, H. sapiens
tgaatcaccaacacca

SEQ ID NO: 143548 - DNA, 16 bp, H. sapiens
tgaatcaccacaccca

SEQ ID NO: 143549 - DNA, 16 bp, H. sapiens
tgaatcatccttttgt

SEQ ID NO: 143550 - DNA, 16 bp, H. sapiens
tgaatcatgaggatgg

SEQ ID NO: 143551 - DNA, 16 bp, H. sapiens
tgaatcatggaagcag

SEQ ID NO: 143552 - DNA, 16 bp, H. sapiens
tgaatcatgggggcca

SEQ ID NO: 143553 - DNA, 16 bp, H. sapiens
tgaatcatggggtgga

SEQ ID NO: 143554 - DNA, 16 bp, H. sapiens
tgaatcatttccagaa

SEQ ID NO: 143555 - DNA, 16 bp, H. sapiens
tgaatccagaagctgg

SEQ ID NO: 143556 - DNA, 16 bp, H. sapiens
tgaatccttacaacaa

SEQ ID NO: 143557 - DNA, 16 bp, H. sapiens
tgaatcctttccagaa

SEQ ID NO: 143558 - DNA, 16 bp, H. sapiens
tgaatctaaaagaaaa

SEQ ID NO: 143559 - DNA, 16 bp, H. sapiens
tgaatctaaaataaaa

SEQ ID NO: 143560 - DNA, 16 bp, H. sapiens
tgaatctaaaatacaa

SEQ ID NO: 143561 - DNA, 16 bp, H. sapiens
tgaatctaaaatataa

SEQ ID NO: 143562 - DNA, 16 bp, H. sapiens
tgaatctcaaataaaa

SEQ ID NO: 143563 - DNA, 16 bp, H. sapiens
tgaatctgaaactctg

SEQ ID NO: 143564 - DNA, 16 bp, H. sapiens
tgaatctgcaaaggga

SEQ ID NO: 143565 - DNA, 16 bp, H. sapiens
tgaatctgctgtgatt

SEQ ID NO: 143566 - DNA, 16 bp, H. sapiens
tgaatctgggaagcgg

SEQ ID NO: 143567 - DNA, 16 bp, H. sapiens
tgaatctgggagttgg

SEQ ID NO: 143568 - DNA, 16 bp, H. sapiens
tgaatctgggtgctgc

SEQ ID NO: 143569 - DNA, 16 bp, H. sapiens
tgaatctgggtgggct

SEQ ID NO: 143570 - DNA, 16 bp, H. sapiens
tgaatctgtaattatt

SEQ ID NO: 143571 - DNA, 16 bp, H. sapiens
tgaatctgtggatgtg

SEQ ID NO: 143572 - DNA, 16 bp, H. sapiens
tgaatcttttaaaaaa

SEQ ID NO: 143573 - DNA, 16 bp, H. sapiens
tgaatgaaaaaaatgt

SEQ ID NO: 143574 - DNA, 16 bp, H. sapiens
tgaatgaaaaagacaa

SEQ ID NO: 143575 - DNA, 16 bp, H. sapiens
tgaatgaaaaatattt

SEQ ID NO: 143576 - DNA, 16 bp, H. sapiens
tgaatgaaaagaaaca

SEQ ID NO: 143577 - DNA, 16 bp, H. sapiens
tgaatgaaaatggaaa

SEQ ID NO: 143578 - DNA, 16 bp, H. sapiens
tgaatgaaagaagcaa

SEQ ID NO: 143579 - DNA, 16 bp, H. sapiens
tgaatgaaagaagcca

SEQ ID NO: 143580 - DNA, 16 bp, H. sapiens
tgaatgaaagaatgaa

SEQ ID NO: 143581 - DNA, 16 bp, H. sapiens
tgaatgaaagtgaaaa

SEQ ID NO: 143582 - DNA, 16 bp, H. sapiens
tgaatgaaataaagga

SEQ ID NO: 143583 - DNA, 16 bp, H. sapiens
tgaatgaaatatttta

SEQ ID NO: 143584 - DNA, 21 bp, H. sapiens
tgaatgaaatgaagcaagaag

SEQ ID NO: 143585 - DNA, 16 bp, H. sapiens
tgaatgaaatgaatga

SEQ ID NO: 143586 - DNA, 16 bp, H. sapiens
tgaatgaacaaaagct

SEQ ID NO: 143587 - DNA, 16 bp, H. sapiens
tgaatgaacaaatgaa

SEQ ID NO: 143588 - DNA, 16 bp, H. sapiens
tgaatgaactattgat

SEQ ID NO: 143589 - DNA, 16 bp, H. sapiens
tgaatgaagaaaatga

SEQ ID NO: 143590 - DNA, 16 bp, H. sapiens
tgaatgaagaaatgaa

SEQ ID NO: 143591 - DNA, 16 bp, H. sapiens
tgaatgaagaagaaat

SEQ ID NO: 143592 - DNA, 16 bp, H. sapiens
tgaatgaataaaagga

SEQ ID NO: 143593 - DNA, 16 bp, H. sapiens
tgaatgaataaatgaa

SEQ ID NO: 143594 - DNA, 16 bp, H. sapiens
tgaatgaataagtaca

SEQ ID NO: 143595 - DNA, 16 bp, H. sapiens
tgaatgaatattttta

SEQ ID NO: 143596 - DNA, 16 bp, H. sapiens
tgaatgaatcaacaaa

SEQ ID NO: 143597 - DNA, 16 bp, H. sapiens
tgaatgaatgaaagaa

SEQ ID NO: 143598 - DNA, 16 bp, H. sapiens
tgaatgaatgaactct

SEQ ID NO: 143599 - DNA, 16 bp, H. sapiens
tgaatgaatgaagaat

SEQ ID NO: 143600 - DNA, 16 bp, H. sapiens
tgaatgaatgaagaca

SEQ ID NO: 143601 - DNA, 16 bp, H. sapiens
tgaatgaatgaaggag

SEQ ID NO: 143602 - DNA, 16 bp, H. sapiens
tgaatgaatgaataaa

SEQ ID NO: 143603 - DNA, 16 bp, H. sapiens
tgaatgaatgaataca

SEQ ID NO: 143604 - DNA, 16 bp, H. sapiens
tgaatgaatgaatgaa

SEQ ID NO: 143605 - DNA, 16 bp, H. sapiens
tgaatgaatgaatgca

SEQ ID NO: 143606 - DNA, 16 bp, H. sapiens
tgaatgaatgaatgga

SEQ ID NO: 143607 - DNA, 16 bp, H. sapiens
tgaatgaatgagcaca

SEQ ID NO: 143608 - DNA, 16 bp, H. sapiens
tgaatgaatgagtgaa

SEQ ID NO: 143609 - DNA, 16 bp, H. sapiens
tgaatgaatgcagaaa

SEQ ID NO: 143610 - DNA, 16 bp, H. sapiens
tgaatgaatgcatgga

SEQ ID NO: 143611 - DNA, 16 bp, H. sapiens
tgaatgaattaaaaag

SEQ ID NO: 143612 - DNA, 16 bp, H. sapiens
tgaatgaattttaaaa

SEQ ID NO: 143613 - DNA, 16 bp, H. sapiens
tgaatgaatttttgaa

SEQ ID NO: 143614 - DNA, 16 bp, H. sapiens
tgaatgactgcatgga

SEQ ID NO: 143615 - DNA, 16 bp, H. sapiens
tgaatgagaaaatgca

SEQ ID NO: 143616 - DNA, 16 bp, H. sapiens
tgaatgagagtttctg

SEQ ID NO: 143617 - DNA, 16 bp, H. sapiens
tgaatgagatcatgtc

SEQ ID NO: 143618 - DNA, 16 bp, H. sapiens
tgaatgaggaaatgaa

SEQ ID NO: 143619 - DNA, 16 bp, H. sapiens
tgaatgaggcccaccc

SEQ ID NO: 143620 - DNA, 16 bp, H. sapiens
tgaatgagtaaataaa

SEQ ID NO: 143621 - DNA, 16 bp, H. sapiens
tgaatgagtaaatgaa

SEQ ID NO: 143622 - DNA, 16 bp, H. sapiens
tgaatgatatatatat

SEQ ID NO: 143623 - DNA, 16 bp, H. sapiens
tgaatgatcttttaaa

SEQ ID NO: 143624 - DNA, 16 bp, H. sapiens
tgaatgatgaatggat

SEQ ID NO: 143625 - DNA, 16 bp, H. sapiens
tgaatgcaaagaaaaa

SEQ ID NO: 143626 - DNA, 16 bp, H. sapiens
tgaatgcaaagaaaag

SEQ ID NO: 143627 - DNA, 16 bp, H. sapiens
tgaatgcaaaggaaaa

SEQ ID NO: 143628 - DNA, 16 bp, H. sapiens
tgaatgcaaagggaaa

SEQ ID NO: 143629 - DNA, 16 bp, H. sapiens
tgaatgcagaagcaaa

SEQ ID NO: 143630 - DNA, 16 bp, H. sapiens
tgaatgcagcacactg

SEQ ID NO: 143631 - DNA, 16 bp, H. sapiens
tgaatgcagctggagg

SEQ ID NO: 143632 - DNA, 16 bp, H. sapiens
tgaatgcaggaggcgg

SEQ ID NO: 143633 - DNA, 16 bp, H. sapiens
tgaatgcataaataaa

SEQ ID NO: 143634 - DNA, 16 bp, H. sapiens
tgaatgcatgaatgag

SEQ ID NO: 143635 - DNA, 16 bp, H. sapiens
tgaatgcatttaaaat

SEQ ID NO: 143636 - DNA, 16 bp, H. sapiens
tgaatgcattttattt

SEQ ID NO: 143637 - DNA, 16 bp, H. sapiens
tgaatgccaggctgag

SEQ ID NO: 143638 - DNA, 16 bp, H. sapiens
tgaatgccatttattt

SEQ ID NO: 143639 - DNA, 16 bp, H. sapiens
tgaatgctcaaataaa

SEQ ID NO: 143640 - DNA, 16 bp, H. sapiens
tgaatggaaaagcaaa

SEQ ID NO: 143641 - DNA, 16 bp, H. sapiens
tgaatggaaaattact

SEQ ID NO: 143642 - DNA, 16 bp, H. sapiens
tgaatggaatcataca

SEQ ID NO: 143643 - DNA, 16 bp, H. sapiens
tgaatggaatgaatga

SEQ ID NO: 143644 - DNA, 16 bp, H. sapiens
tgaatggaattatttt

SEQ ID NO: 143645 - DNA, 16 bp, H. sapiens
tgaatggacccctctt

SEQ ID NO: 143646 - DNA, 16 bp, H. sapiens
tgaatggagaaataaa

SEQ ID NO: 143647 - DNA, 16 bp, H. sapiens
tgaatggagaatgagt

SEQ ID NO: 143648 - DNA, 16 bp, H. sapiens
tgaatggaggaatgaa

SEQ ID NO: 143649 - DNA, 16 bp, H. sapiens
tgaatggataaacaaa

SEQ ID NO: 143650 - DNA, 16 bp, H. sapiens
tgaatggataagcaaa

SEQ ID NO: 143651 - DNA, 16 bp, H. sapiens
tgaatggataataaaa

SEQ ID NO: 143652 - DNA, 16 bp, H. sapiens
tgaatggatgaagaaa

SEQ ID NO: 143653 - DNA, 16 bp, H. sapiens
tgaatggatggatgaa

SEQ ID NO: 143654 - DNA, 16 bp, H. sapiens
tgaatggattaaaaaa

SEQ ID NO: 143655 - DNA, 16 bp, H. sapiens
tgaatggattaaaaat

SEQ ID NO: 143656 - DNA, 16 bp, H. sapiens
tgaatggcttagtacc

SEQ ID NO: 143657 - DNA, 16 bp, H. sapiens
tgaatgggaaaaagct

SEQ ID NO: 143658 - DNA, 16 bp, H. sapiens
tgaatgggcaaaactg

SEQ ID NO: 143659 - DNA, 16 bp, H. sapiens
tgaatgggcaagaact

SEQ ID NO: 143660 - DNA, 16 bp, H. sapiens
tgaatgggcagaaact

SEQ ID NO: 143661 - DNA, 16 bp, H. sapiens
tgaatgggtaaacaaa

SEQ ID NO: 143662 - DNA, 16 bp, H. sapiens
tgaatggtgaaaaact

SEQ ID NO: 143663 - DNA, 16 bp, H. sapiens
tgaatggtggccccca

SEQ ID NO: 143664 - DNA, 16 bp, H. sapiens
tgaatggttaaaaaaa

SEQ ID NO: 143665 - DNA, 16 bp, H. sapiens
tgaatgtactttgtaa

SEQ ID NO: 143666 - DNA, 16 bp, H. sapiens
tgaatgtaggcaacaa

SEQ ID NO: 143667 - DNA, 16 bp, H. sapiens
tgaatgtattttgcat

SEQ ID NO: 143668 - DNA, 16 bp, H. sapiens
tgaatgtgcaaaagct

SEQ ID NO: 143669 - DNA, 16 bp, H. sapiens
tgaatgtgcttgctct

SEQ ID NO: 143670 - DNA, 16 bp, H. sapiens
tgaatgtggatatcca

SEQ ID NO: 143671 - DNA, 16 bp, H. sapiens
tgaatgtgtattgttt

SEQ ID NO: 143672 - DNA, 16 bp, H. sapiens
tgaatgtgtcccagaa

SEQ ID NO: 143673 - DNA, 16 bp, H. sapiens
tgaatgtgtgtgtgta

SEQ ID NO: 143674 - DNA, 16 bp, H. sapiens
tgaatgtgtgtgtgtg

SEQ ID NO: 143675 - DNA, 16 bp, H. sapiens
tgaatgtgtttcctct

SEQ ID NO: 143676 - DNA, 16 bp, H. sapiens
tgaatgtgtttgctct

SEQ ID NO: 143677 - DNA, 16 bp, H. sapiens
tgaatgtgtttgcttt

SEQ ID NO: 143678 - DNA, 16 bp, H. sapiens
tgaatgttattttcat

SEQ ID NO: 143679 - DNA, 16 bp, H. sapiens
tgaatgttctcaccac

SEQ ID NO: 143680 - DNA, 16 bp, H. sapiens
tgaatgttggtgtccc

SEQ ID NO: 143681 - DNA, 16 bp, H. sapiens
tgaatgtttacagctg

SEQ ID NO: 143682 - DNA, 16 bp, H. sapiens
tgaatgtttacatttt

SEQ ID NO: 143683 - DNA, 16 bp, H. sapiens
tgaatgtttgtgtgcc

SEQ ID NO: 143684 - DNA, 16 bp, H. sapiens
tgaatgtttgtgtgtg

SEQ ID NO: 143685 - DNA, 16 bp, H. sapiens
tgaatgtttgttttcc

SEQ ID NO: 143686 - DNA, 16 bp, H. sapiens
tgaatgttttcttctt

SEQ ID NO: 143687 - DNA, 16 bp, H. sapiens
tgaatgttttcttttg

SEQ ID NO: 143688 - DNA, 16 bp, H. sapiens
tgaatgtttttctctt

SEQ ID NO: 143689 - DNA, 16 bp, H. sapiens
tgaattaaacattttt

SEQ ID NO: 143690 - DNA, 16 bp, H. sapiens
tgaattacacacttta

SEQ ID NO: 143691 - DNA, 16 bp, H. sapiens
tgaattacatgaaatt

SEQ ID NO: 143692 - DNA, 16 bp, H. sapiens
tgaattacatttaaaa

SEQ ID NO: 143693 - DNA, 16 bp, H. sapiens
tgaattacatttttat

SEQ ID NO: 143694 - DNA, 16 bp, H. sapiens
tgaattacttttaaaa

SEQ ID NO: 143695 - DNA, 16 bp, H. sapiens
tgaattagaatctgca

SEQ ID NO: 143696 - DNA, 16 bp, H. sapiens
tgaattagtaataaat

SEQ ID NO: 143697 - DNA, 16 bp, H. sapiens
tgaattagttttaaaa

SEQ ID NO: 143698 - DNA, 16 bp, H. sapiens
tgaattatgggggtgg

SEQ ID NO: 143699 - DNA, 16 bp, H. sapiens
tgaattatttcctcaa

SEQ ID NO: 143700 - DNA, 16 bp, H. sapiens
tgaattatttgaaatt

SEQ ID NO: 143701 - DNA, 16 bp, H. sapiens
tgaattattttcttct

SEQ ID NO: 143702 - DNA, 16 bp, H. sapiens
tgaattatttttctca

SEQ ID NO: 143703 - DNA, 16 bp, H. sapiens
tgaattatttttctcc

SEQ ID NO: 143704 - DNA, 16 bp, H. sapiens
tgaattatttttctga

SEQ ID NO: 143705 - DNA, 16 bp, H. sapiens
tgaattcaataaaatt

SEQ ID NO: 143706 - DNA, 16 bp, H. sapiens
tgaattcacagatgtg

SEQ ID NO: 143707 - DNA, 16 bp, H. sapiens
tgaattcagtttgcca

SEQ ID NO: 143708 - DNA, 16 bp, H. sapiens
tgaattcatgggctca

SEQ ID NO: 143709 - DNA, 16 bp, H. sapiens
tgaattcattaaaaaa

SEQ ID NO: 143710 - DNA, 16 bp, H. sapiens
tgaattccaaaaggaa

SEQ ID NO: 143711 - DNA, 16 bp, H. sapiens
tgaattccagcctggg

SEQ ID NO: 143712 - DNA, 17 bp, H. sapiens
tgaattcctgacctcaa

SEQ ID NO: 143713 - DNA, 16 bp, H. sapiens
tgaattcctgacctcc

SEQ ID NO: 143714 - DNA, 16 bp, H. sapiens
tgaattccttcttgtg

SEQ ID NO: 143715 - DNA, 16 bp, H. sapiens
tgaattctcactctgt

SEQ ID NO: 143716 - DNA, 16 bp, H. sapiens
tgaattctgaaatttt

SEQ ID NO: 143717 - DNA, 16 bp, H. sapiens
tgaattctgccaacaa

SEQ ID NO: 143718 - DNA, 16 bp, H. sapiens
tgaattctggtgaggg

SEQ ID NO: 143719 - DNA, 16 bp, H. sapiens
tgaattctttcttcca

SEQ ID NO: 143720 - DNA, 16 bp, H. sapiens
tgaattctttttctgg

SEQ ID NO: 143721 - DNA, 16 bp, H. sapiens
tgaattgaagacttaa

SEQ ID NO: 143722 - DNA, 16 bp, H. sapiens
tgaattgaatgaaatt

SEQ ID NO: 143723 - DNA, 16 bp, H. sapiens
tgaattgagatgtgct

SEQ ID NO: 143724 - DNA, 16 bp, H. sapiens
tgaattgctgcaatct

SEQ ID NO: 143725 - DNA, 16 bp, H. sapiens
tgaattggaaaactca

SEQ ID NO: 143726 - DNA, 16 bp, H. sapiens
tgaattggaaatatca

SEQ ID NO: 143727 - DNA, 16 bp, H. sapiens
tgaattggcaaaagct

SEQ ID NO: 143728 - DNA, 16 bp, H. sapiens
tgaattggttttgtct

SEQ ID NO: 143729 - DNA, 16 bp, H. sapiens
tgaattgtaattccca

SEQ ID NO: 143730 - DNA, 16 bp, H. sapiens
tgaattgtagtcccca

SEQ ID NO: 143731 - DNA, 16 bp, H. sapiens
tgaattgtgtccccct

SEQ ID NO: 143732 - DNA, 16 bp, H. sapiens
tgaatttaaacaaaaa

SEQ ID NO: 143733 - DNA, 16 bp, H. sapiens
tgaatttaaagtgaga

SEQ ID NO: 143734 - DNA, 16 bp, H. sapiens
tgaatttaaatatttg

SEQ ID NO: 143735 - DNA, 16 bp, H. sapiens
tgaatttaccttgaat

SEQ ID NO: 143736 - DNA, 16 bp, H. sapiens
tgaatttatcagtttt

SEQ ID NO: 143737 - DNA, 16 bp, H. sapiens
tgaatttatcatattt

SEQ ID NO: 143738 - DNA, 16 bp, H. sapiens
tgaatttattttcaaa

SEQ ID NO: 143739 - DNA, 16 bp, H. sapiens
tgaatttattttctta

SEQ ID NO: 143740 - DNA, 16 bp, H. sapiens
tgaatttcaaataaaa

SEQ ID NO: 143741 - DNA, 16 bp, H. sapiens
tgaatttcaaataaat

SEQ ID NO: 143742 - DNA, 16 bp, H. sapiens
tgaatttcagtttctt

SEQ ID NO: 143743 - DNA, 16 bp, H. sapiens
tgaatttcatttagtt

SEQ ID NO: 143744 - DNA, 16 bp, H. sapiens
tgaatttcattttctt

SEQ ID NO: 143745 - DNA, 16 bp, H. sapiens
tgaatttccacatgtt

SEQ ID NO: 143746 - DNA, 16 bp, H. sapiens
tgaatttccatgtatt

SEQ ID NO: 143747 - DNA, 16 bp, H. sapiens
tgaatttcctttattt

SEQ ID NO: 143748 - DNA, 16 bp, H. sapiens
tgaatttccttttctt

SEQ ID NO: 143749 - DNA, 16 bp, H. sapiens
tgaatttctcattttt

SEQ ID NO: 143750 - DNA, 16 bp, H. sapiens
tgaatttctctgatga

SEQ ID NO: 143751 - DNA, 16 bp, H. sapiens
tgaatttcttagtttt

SEQ ID NO: 143752 - DNA, 16 bp, H. sapiens
tgaatttcttctttct

SEQ ID NO: 143753 - DNA, 16 bp, H. sapiens
tgaatttgaaaagaat

SEQ ID NO: 143754 - DNA, 16 bp, H. sapiens
tgaatttgaatttcag

SEQ ID NO: 143755 - DNA, 16 bp, H. sapiens
tgaatttgactgtgta

SEQ ID NO: 143756 - DNA, 16 bp, H. sapiens
tgaatttgatttgctg

SEQ ID NO: 143757 - DNA, 16 bp, H. sapiens
tgaatttggaaaaaaa

SEQ ID NO: 143758 - DNA, 16 bp, H. sapiens
tgaatttggaaataaa

SEQ ID NO: 143759 - DNA, 16 bp, H. sapiens
tgaatttggaagtatt

SEQ ID NO: 143760 - DNA, 16 bp, H. sapiens
tgaatttgggattttt

SEQ ID NO: 143761 - DNA, 16 bp, H. sapiens
tgaatttgtatttaaa

SEQ ID NO: 143762 - DNA, 16 bp, H. sapiens
tgaatttgttttctgt

SEQ ID NO: 143763 - DNA, 16 bp, H. sapiens
tgaattttaaatgaaa

SEQ ID NO: 143764 - DNA, 16 bp, H. sapiens
tgaattttaacaaata

SEQ ID NO: 143765 - DNA, 16 bp, H. sapiens
tgaattttaagagttt

SEQ ID NO: 143766 - DNA, 16 bp, H. sapiens
tgaattttacattatt

SEQ ID NO: 143767 - DNA, 16 bp, H. sapiens
tgaattttacattttt

SEQ ID NO: 143768 - DNA, 16 bp, H. sapiens
tgaattttagaattgc

SEQ ID NO: 143769 - DNA, 16 bp, H. sapiens
tgaattttataaaatg

SEQ ID NO: 143770 - DNA, 16 bp, H. sapiens
tgaattttatcaaaat

SEQ ID NO: 143771 - DNA, 16 bp, H. sapiens
tgaattttatcaaaca

SEQ ID NO: 143772 - DNA, 16 bp, H. sapiens
tgaattttatgaaatt

SEQ ID NO: 143773 - DNA, 16 bp, H. sapiens
tgaattttattgaaag

SEQ ID NO: 143774 - DNA, 16 bp, H. sapiens
tgaattttatttcaat

SEQ ID NO: 143775 - DNA, 16 bp, H. sapiens
tgaattttatttctat

SEQ ID NO: 143776 - DNA, 16 bp, H. sapiens
tgaattttcagaattt

SEQ ID NO: 143777 - DNA, 16 bp, H. sapiens
tgaattttctaatttt

SEQ ID NO: 143778 - DNA, 16 bp, H. sapiens
tgaattttctatttat

SEQ ID NO: 143779 - DNA, 16 bp, H. sapiens
tgaattttctgaattt

SEQ ID NO: 143780 - DNA, 16 bp, H. sapiens
tgaattttctggaaaa

SEQ ID NO: 143781 - DNA, 16 bp, H. sapiens
tgaattttctttctgt

SEQ ID NO: 143782 - DNA, 16 bp, H. sapiens
tgaattttgaaaacat

SEQ ID NO: 143783 - DNA, 16 bp, H. sapiens
tgaattttgaatttca

SEQ ID NO: 143784 - DNA, 16 bp, H. sapiens
tgaattttgacaaatg

SEQ ID NO: 143785 - DNA, 16 bp, H. sapiens
tgaattttgacagttt

SEQ ID NO: 143786 - DNA, 16 bp, H. sapiens
tgaattttgagggaac

SEQ ID NO: 143787 - DNA, 16 bp, H. sapiens
tgaattttgcatttta

SEQ ID NO: 143788 - DNA, 16 bp, H. sapiens
tgaattttgctcttgt

SEQ ID NO: 143789 - DNA, 16 bp, H. sapiens
tgaattttggagagga

SEQ ID NO: 143790 - DNA, 16 bp, H. sapiens
tgaattttggaggcaa

SEQ ID NO: 143791 - DNA, 16 bp, H. sapiens
tgaattttgtcaaaca

SEQ ID NO: 143792 - DNA, 16 bp, H. sapiens
tgaattttgttgaatg

SEQ ID NO: 143793 - DNA, 16 bp, H. sapiens
tgaatttttaaaatgt

SEQ ID NO: 143794 - DNA, 16 bp, H. sapiens
tgaatttttaaagact

SEQ ID NO: 143795 - DNA, 16 bp, H. sapiens
tgaatttttatttcca

SEQ ID NO: 143796 - DNA, 16 bp, H. sapiens
tgaatttttctatttc

SEQ ID NO: 143797 - DNA, 16 bp, H. sapiens
tgaattttttcttaaa

SEQ ID NO: 143798 - DNA, 16 bp, H. sapiens
tgaattttttcttctg

SEQ ID NO: 143799 - DNA, 16 bp, H. sapiens
tgacaaaaacaatcaa

SEQ ID NO: 143800 - DNA, 16 bp, H. sapiens
tgacaaaaatgccaag

SEQ ID NO: 143801 - DNA, 16 bp, H. sapiens
tgacaaaaccccattt

SEQ ID NO: 143802 - DNA, 16 bp, H. sapiens
tgacaaaaccctatct

SEQ ID NO: 143803 - DNA, 16 bp, H. sapiens
tgacaaaatatatttt

SEQ ID NO: 143804 - DNA, 16 bp, H. sapiens
tgacaaaatgtctcag

SEQ ID NO: 143805 - DNA, 16 bp, H. sapiens
tgacaaaattatctgt

SEQ ID NO: 143806 - DNA, 16 bp, H. sapiens
tgacaaactgctttgt

SEQ ID NO: 143807 - DNA, 16 bp, H. sapiens
tgacaaactgggaaaa

SEQ ID NO: 143808 - DNA, 16 bp, H. sapiens
tgacaaagaatttaaa

SEQ ID NO: 143809 - DNA, 16 bp, H. sapiens
tgacaaagacaaagaa

SEQ ID NO: 143810 - DNA, 16 bp, H. sapiens
tgacaaagacttcaaa

SEQ ID NO: 143811 - DNA, 16 bp, H. sapiens
tgacaaagatgcaaag

SEQ ID NO: 143812 - DNA, 16 bp, H. sapiens
tgacaaagatgtcaag

SEQ ID NO: 143813 - DNA, 16 bp, H. sapiens
tgacaaagattttaaa

SEQ ID NO: 143814 - DNA, 16 bp, H. sapiens
tgacaaagcaggactc

SEQ ID NO: 143815 - DNA, 16 bp, H. sapiens
tgacaaagtgagaccc

SEQ ID NO: 143816 - DNA, 16 bp, H. sapiens
tgacaaagttaccaag

SEQ ID NO: 143817 - DNA, 16 bp, H. sapiens
tgacaaataaatgttt

SEQ ID NO: 143818 - DNA, 16 bp, H. sapiens
tgacaaatgatgttga

SEQ ID NO: 143819 - DNA, 16 bp, H. sapiens
tgacaaatgcacaagc

SEQ ID NO: 143820 - DNA, 16 bp, H. sapiens
tgacaaatggtgctgt

SEQ ID NO: 143821 - DNA, 16 bp, H. sapiens
tgacaaatgtttcttc

SEQ ID NO: 143822 - DNA, 16 bp, H. sapiens
tgacaaatttttttaa

SEQ ID NO: 143823 - DNA, 16 bp, H. sapiens
tgacaacatggatgga

SEQ ID NO: 143824 - DNA, 16 bp, H. sapiens
tgacaacatttttttt

SEQ ID NO: 143825 - DNA, 16 bp, H. sapiens
tgacaaccacaaatgt

SEQ ID NO: 143826 - DNA, 16 bp, H. sapiens
tgacaaccacagatgt

SEQ ID NO: 143827 - DNA, 16 bp, H. sapiens
tgacaaccactaatct

SEQ ID NO: 143828 - DNA, 16 bp, H. sapiens
tgacaaccagaaatgt

SEQ ID NO: 143829 - DNA, 16 bp, H. sapiens
tgacaagaaaaaaatg

SEQ ID NO: 143830 - DNA, 16 bp, H. sapiens
tgacaaggctgtggag

SEQ ID NO: 143831 - DNA, 16 bp, H. sapiens
tgacaagggcaccaag

SEQ ID NO: 143832 - DNA, 16 bp, H. sapiens
tgacaagggtgtcaag

SEQ ID NO: 143833 - DNA, 16 bp, H. sapiens
tgacaatggtgatgat

SEQ ID NO: 143834 - DNA, 16 bp, H. sapiens
tgacaatggtgccaag

SEQ ID NO: 143835 - DNA, 16 bp, H. sapiens
tgacaatgtgacagaa

SEQ ID NO: 143836 - DNA, 16 bp, H. sapiens
tgacaatgtggtagaa

SEQ ID NO: 143837 - DNA, 16 bp, H. sapiens
tgacaattatgaataa

SEQ ID NO: 143838 - DNA, 16 bp, H. sapiens
tgacaattgaagggtg

SEQ ID NO: 143839 - DNA, 16 bp, H. sapiens
tgacaattgaatgaaa

SEQ ID NO: 143840 - DNA, 16 bp, H. sapiens
tgacacacacatgcac

SEQ ID NO: 143841 - DNA, 16 bp, H. sapiens
tgacacagagacattt

SEQ ID NO: 143842 - DNA, 17 bp, H. sapiens
tgacacagagctcctaa

SEQ ID NO: 143843 - DNA, 16 bp, H. sapiens
tgacacagcctcagaa

SEQ ID NO: 143844 - DNA, 16 bp, H. sapiens
tgacacagcctcagga

SEQ ID NO: 143845 - DNA, 16 bp, H. sapiens
tgacacaggagccttc

SEQ ID NO: 143846 - DNA, 16 bp, H. sapiens
tgacacataaaagtaa

SEQ ID NO: 143847 - DNA, 16 bp, H. sapiens
tgacacataaaattaa

SEQ ID NO: 143848 - DNA, 16 bp, H. sapiens
tgacacataaagttaa

SEQ ID NO: 143849 - DNA, 16 bp, H. sapiens
tgacacatgaaaatta

SEQ ID NO: 143850 - DNA, 16 bp, H. sapiens
tgacacattttattat

SEQ ID NO: 143851 - DNA, 16 bp, H. sapiens
tgacaccaaatgctgg

SEQ ID NO: 143852 - DNA, 16 bp, H. sapiens
tgacaccacgcccggc

SEQ ID NO: 143853 - DNA, 16 bp, H. sapiens
tgacaccactgaaata

SEQ ID NO: 143854 - DNA, 16 bp, H. sapiens
tgacaccagcctgggc

SEQ ID NO: 143855 - DNA, 16 bp, H. sapiens
tgacaccatcctggcc

SEQ ID NO: 143856 - DNA, 16 bp, H. sapiens
tgacaccatcttggct

SEQ ID NO: 143857 - DNA, 16 bp, H. sapiens
tgacacccccaccttc

SEQ ID NO: 143858 - DNA, 16 bp, H. sapiens
tgacaccttgactgca

SEQ ID NO: 143859 - DNA, 18 bp, H. sapiens
tgacactccatctcaaaa

SEQ ID NO: 143860 - DNA, 16 bp, H. sapiens
tgacactgacattttt

SEQ ID NO: 143861 - DNA, 16 bp, H. sapiens
tgacactgaggaggac

SEQ ID NO: 143862 - DNA, 16 bp, H. sapiens
tgacactgtctacctg

SEQ ID NO: 143863 - DNA, 16 bp, H. sapiens
tgacacttaaaattaa

SEQ ID NO: 143864 - DNA, 16 bp, H. sapiens
tgacactttgtctcaa

SEQ ID NO: 143865 - DNA, 16 bp, H. sapiens
tgacagaaagagaccc

SEQ ID NO: 143866 - DNA, 16 bp, H. sapiens
tgacagaaatcaaaga

SEQ ID NO: 143867 - DNA, 16 bp, H. sapiens
tgacagaaatgaagaa

SEQ ID NO: 143868 - DNA, 16 bp, H. sapiens
tgacagaactgaaggg

SEQ ID NO: 143869 - DNA, 16 bp, H. sapiens
tgacagaagaaaaaga

SEQ ID NO: 143870 - DNA, 21 bp, H. sapiens
tgacagaagtaggcttcagaa

SEQ ID NO: 143871 - DNA, 16 bp, H. sapiens
tgacagaagtgggctt

SEQ ID NO: 143872 - DNA, 16 bp, H. sapiens
tgacagaattaaagga

SEQ ID NO: 143873 - DNA, 16 bp, H. sapiens
tgacagactctgtctc

SEQ ID NO: 143874 - DNA, 16 bp, H. sapiens
tgacagactggattaa

SEQ ID NO: 143875 - DNA, 16 bp, H. sapiens
tgacagagaaagagag

SEQ ID NO: 143876 - DNA, 16 bp, H. sapiens
tgacagagaccccatc

SEQ ID NO: 143877 - DNA, 16 bp, H. sapiens
tgacagagagaggctc

SEQ ID NO: 143878 - DNA, 16 bp, H. sapiens
tgacagagcaaaactc

SEQ ID NO: 143879 - DNA, 16 bp, H. sapiens
tgacagagcaacaccc

SEQ ID NO: 143880 - DNA, 16 bp, H. sapiens
tgacagagcaagacct

SEQ ID NO: 143881 - DNA, 16 bp, H. sapiens
tgacagagcaagactg

SEQ ID NO: 143882 - DNA, 16 bp, H. sapiens
tgacagagcaagactt

SEQ ID NO: 143883 - DNA, 16 bp, H. sapiens
tgacagagcaagagct

SEQ ID NO: 143884 - DNA, 16 bp, H. sapiens
tgacagagcaagatct

SEQ ID NO: 143885 - DNA, 16 bp, H. sapiens
tgacagagcaggagca

SEQ ID NO: 143886 - DNA, 16 bp, H. sapiens
tgacagagccagacct

SEQ ID NO: 143887 - DNA, 16 bp, H. sapiens
tgacagagcgagaatc

SEQ ID NO: 143888 - DNA, 17 bp, H. sapiens
tgacagagcgagacccc

SEQ ID NO: 143889 - DNA, 17 bp, H. sapiens
tgacagagcgagactca

SEQ ID NO: 143890 - DNA, 16 bp, H. sapiens
tgacagagcgagactt

SEQ ID NO: 143891 - DNA, 16 bp, H. sapiens
tgacagagctgggatt

SEQ ID NO: 143892 - DNA, 16 bp, H. sapiens
tgacagaggaagactc

SEQ ID NO: 143893 - DNA, 16 bp, H. sapiens
tgacagagtaagactc

SEQ ID NO: 143894 - DNA, 16 bp, H. sapiens
tgacagagtcagactc

SEQ ID NO: 143895 - DNA, 17 bp, H. sapiens
tgacagagtctccctct

SEQ ID NO: 143896 - DNA, 16 bp, H. sapiens
tgacagagtgagacac

SEQ ID NO: 143897 - DNA, 16 bp, H. sapiens
tgacagagtgagacag

SEQ ID NO: 143898 - DNA, 16 bp, H. sapiens
tgacagagtgagaccc

SEQ ID NO: 143899 - DNA, 16 bp, H. sapiens
tgacagagtgagacct

SEQ ID NO: 143900 - DNA, 16 bp, H. sapiens
tgacagagtgagagac

SEQ ID NO: 143901 - DNA, 16 bp, H. sapiens
tgacagagtgataccc

SEQ ID NO: 143902 - DNA, 16 bp, H. sapiens
tgacagagtgggactc

SEQ ID NO: 143903 - DNA, 16 bp, H. sapiens
tgacagattaaaaaaa

SEQ ID NO: 143904 - DNA, 16 bp, H. sapiens
tgacagcagcctgggc

SEQ ID NO: 143905 - DNA, 16 bp, H. sapiens
tgacagcctccagctg

SEQ ID NO: 143906 - DNA, 16 bp, H. sapiens
tgacagctctgaagag

SEQ ID NO: 143907 - DNA, 16 bp, H. sapiens
tgacagctctgacagc

SEQ ID NO: 143908 - DNA, 16 bp, H. sapiens
tgacagctttgaggag

SEQ ID NO: 143909 - DNA, 16 bp, H. sapiens
tgacaggatttccttc

SEQ ID NO: 143910 - DNA, 16 bp, H. sapiens
tgacaggatttctttc

SEQ ID NO: 143911 - DNA, 16 bp, H. sapiens
tgacagggagaaagga

SEQ ID NO: 143912 - DNA, 16 bp, H. sapiens
tgacaggggtgtggct

SEQ ID NO: 143913 - DNA, 17 bp, H. sapiens
tgacagggtttcaccgt

SEQ ID NO: 143914 - DNA, 16 bp, H. sapiens
tgacagtaaaagaaat

SEQ ID NO: 143915 - DNA, 16 bp, H. sapiens
tgacagtatttttttt

SEQ ID NO: 143916 - DNA, 16 bp, H. sapiens
tgacagtctcactctg

SEQ ID NO: 143917 - DNA, 16 bp, H. sapiens
tgacagtgacctctgg

SEQ ID NO: 143918 - DNA, 16 bp, H. sapiens
tgacagtgagactgtc

SEQ ID NO: 143919 - DNA, 16 bp, H. sapiens
tgacagtgagtgagtc

SEQ ID NO: 143920 - DNA, 16 bp, H. sapiens
tgacagtgtgagaccc

SEQ ID NO: 143921 - DNA, 16 bp, H. sapiens
tgacagttctgaagag

SEQ ID NO: 143922 - DNA, 16 bp, H. sapiens
tgacagttctgcaggc

SEQ ID NO: 143923 - DNA, 16 bp, H. sapiens
tgacagttcttcaaaa

SEQ ID NO: 143924 - DNA, 16 bp, H. sapiens
tgacagttgttttctt

SEQ ID NO: 143925 - DNA, 16 bp, H. sapiens
tgacagtttcttttgc

SEQ ID NO: 143926 - DNA, 16 bp, H. sapiens
tgacagtttcttttgt

SEQ ID NO: 143927 - DNA, 16 bp, H. sapiens
tgacagtttttagcat

SEQ ID NO: 143928 - DNA, 16 bp, H. sapiens
tgacagtttttttctt

SEQ ID NO: 143929 - DNA, 16 bp, H. sapiens
tgacataaataaatgg

SEQ ID NO: 143930 - DNA, 16 bp, H. sapiens
tgacataaatatattt

SEQ ID NO: 143931 - DNA, 16 bp, H. sapiens
tgacataacaaaatac

SEQ ID NO: 143932 - DNA, 16 bp, H. sapiens
tgacataagtttacct

SEQ ID NO: 143933 - DNA, 16 bp, H. sapiens
tgacataatcctgtat

SEQ ID NO: 143934 - DNA, 16 bp, H. sapiens
tgacataatttcattt

SEQ ID NO: 143935 - DNA, 16 bp, H. sapiens
tgacatatttttgaaa

SEQ ID NO: 143936 - DNA, 16 bp, H. sapiens
tgacatcactgcactc

SEQ ID NO: 143937 - DNA, 16 bp, H. sapiens
tgacatcctggaaaag

SEQ ID NO: 143938 - DNA, 16 bp, H. sapiens
tgacatcttggggcct

SEQ ID NO: 143939 - DNA, 16 bp, H. sapiens
tgacatctttaaaata

SEQ ID NO: 143940 - DNA, 16 bp, H. sapiens
tgacatctttactata

SEQ ID NO: 143941 - DNA, 16 bp, H. sapiens
tgacatctttgttgaa

SEQ ID NO: 143942 - DNA, 16 bp, H. sapiens
tgacatctttttaaaa

SEQ ID NO: 143943 - DNA, 16 bp, H. sapiens
tgacatgaaagaaaaa

SEQ ID NO: 143944 - DNA, 16 bp, H. sapiens
tgacatgaggcagatt

SEQ ID NO: 143945 - DNA, 16 bp, H. sapiens
tgacatgatcagattt

SEQ ID NO: 143946 - DNA, 16 bp, H. sapiens
tgacatgcaatttacc

SEQ ID NO: 143947 - DNA, 16 bp, H. sapiens
tgacatgccctggaga

SEQ ID NO: 143948 - DNA, 16 bp, H. sapiens
tgacatgcctgctccc

SEQ ID NO: 143949 - DNA, 16 bp, H. sapiens
tgacatggagttttgc

SEQ ID NO: 143950 - DNA, 16 bp, H. sapiens
tgacatggatgaaatt

SEQ ID NO: 143951 - DNA, 16 bp, H. sapiens
tgacatggtcagattt

SEQ ID NO: 143952 - DNA, 16 bp, H. sapiens
tgacattattcacaat

SEQ ID NO: 143953 - DNA, 16 bp, H. sapiens
tgacattctaaggtca

SEQ ID NO: 143954 - DNA, 16 bp, H. sapiens
tgacattctgaaaaag

SEQ ID NO: 143955 - DNA, 16 bp, H. sapiens
tgacattcttcttctg

SEQ ID NO: 143956 - DNA, 16 bp, H. sapiens
tgacattcttgttact

SEQ ID NO: 143957 - DNA, 16 bp, H. sapiens
tgacattgatataatc

SEQ ID NO: 143958 - DNA, 16 bp, H. sapiens
tgacattgatgatcct

SEQ ID NO: 143959 - DNA, 16 bp, H. sapiens
tgacattgtgatccac

SEQ ID NO: 143960 - DNA, 16 bp, H. sapiens
tgacatttaagcaaag

SEQ ID NO: 143961 - DNA, 16 bp, H. sapiens
tgacatttactccagt

SEQ ID NO: 143962 - DNA, 16 bp, H. sapiens
tgacatttactttttt

SEQ ID NO: 143963 - DNA, 16 bp, H. sapiens
tgacatttataaatat

SEQ ID NO: 143964 - DNA, 16 bp, H. sapiens
tgacatttattttatt

SEQ ID NO: 143965 - DNA, 16 bp, H. sapiens
tgacatttcaacatga

SEQ ID NO: 143966 - DNA, 16 bp, H. sapiens
tgacatttcccctgct

SEQ ID NO: 143967 - DNA, 16 bp, H. sapiens
tgacatttctttttct

SEQ ID NO: 143968 - DNA, 16 bp, H. sapiens
tgacatttgagctggg

SEQ ID NO: 143969 - DNA, 16 bp, H. sapiens
tgacattttaacagta

SEQ ID NO: 143970 - DNA, 16 bp, H. sapiens
tgacattttaataaaa

SEQ ID NO: 143971 - DNA, 16 bp, H. sapiens
tgacattttaatagta

SEQ ID NO: 143972 - DNA, 16 bp, H. sapiens
tgacattttagataca

SEQ ID NO: 143973 - DNA, 16 bp, H. sapiens
tgacattttctatttt

SEQ ID NO: 143974 - DNA, 16 bp, H. sapiens
tgacattttgcttttt

SEQ ID NO: 143975 - DNA, 16 bp, H. sapiens
tgacattttggactgg

SEQ ID NO: 143976 - DNA, 16 bp, H. sapiens
tgacatttttcaaaaa

SEQ ID NO: 143977 - DNA, 16 bp, H. sapiens
tgaccaaaaatgtctc

SEQ ID NO: 143978 - DNA, 16 bp, H. sapiens
tgaccaaaatactgat

SEQ ID NO: 143979 - DNA, 16 bp, H. sapiens
tgaccaaaatccagaa

SEQ ID NO: 143980 - DNA, 16 bp, H. sapiens
tgaccaaaatgctgat

SEQ ID NO: 143981 - DNA, 16 bp, H. sapiens
tgaccaaaatgtcatt

SEQ ID NO: 143982 - DNA, 16 bp, H. sapiens
tgaccaaaatgtcttt

SEQ ID NO: 143983 - DNA, 16 bp, H. sapiens
tgaccaaatatctggg

SEQ ID NO: 143984 - DNA, 19 bp, H. sapiens
tgaccaacatggtgaaact

SEQ ID NO: 143985 - DNA, 16 bp, H. sapiens
tgaccaactcagcatt

SEQ ID NO: 143986 - DNA, 16 bp, H. sapiens
tgaccaagaagaaaaa

SEQ ID NO: 143987 - DNA, 21 bp, H. sapiens
tgaccaatatggtgaaaccct

SEQ ID NO: 143988 - DNA, 16 bp, H. sapiens
tgaccaatgtgatgaa

SEQ ID NO: 143989 - DNA, 16 bp, H. sapiens
tgaccacacagttgga

SEQ ID NO: 143990 - DNA, 24 bp, H. sapiens
tgaccacacagttggaagtaaagc

SEQ ID NO: 143991 - DNA, 16 bp, H. sapiens
tgaccacagaggcaga

SEQ ID NO: 143992 - DNA, 16 bp, H. sapiens
tgaccacagtgcaatc

SEQ ID NO: 143993 - DNA, 37 bp, H. sapiens
tgaccacatagttggaagtaaagcactcctcagcaaa

SEQ ID NO: 143994 - DNA, 16 bp, H. sapiens
tgaccagcctggccaa

SEQ ID NO: 143995 - DNA, 16 bp, H. sapiens
tgaccagcctgggcaa

SEQ ID NO: 143996 - DNA, 16 bp, H. sapiens
tgaccagcctggtctc

SEQ ID NO: 143997 - DNA, 16 bp, H. sapiens
tgaccagctaattttt

SEQ ID NO: 143998 - DNA, 16 bp, H. sapiens
tgaccaggcacggtgg

SEQ ID NO: 143999 - DNA, 16 bp, H. sapiens
tgaccagtgatgacga

SEQ ID NO: 144000 - DNA, 16 bp, H. sapiens
tgaccagtgatgatga

SEQ ID NO: 144001 - DNA, 16 bp, H. sapiens
tgaccatatttggaaa

SEQ ID NO: 144002 - DNA, 16 bp, H. sapiens
tgaccatcaaaaatgt

SEQ ID NO: 144003 - DNA, 16 bp, H. sapiens
tgaccatcaccaccat

SEQ ID NO: 144004 - DNA, 17 bp, H. sapiens
tgaccatcatggagaaa

SEQ ID NO: 144005 - DNA, 16 bp, H. sapiens
tgaccatccccaaggc

SEQ ID NO: 144006 - DNA, 16 bp, H. sapiens
tgaccatcctggccaa

SEQ ID NO: 144007 - DNA, 16 bp, H. sapiens
tgaccatttttatttt

SEQ ID NO: 144008 - DNA, 16 bp, H. sapiens
tgacccaccgcacctg

SEQ ID NO: 144009 - DNA, 16 bp, H. sapiens
tgacccactagcaaaa

SEQ ID NO: 144010 - DNA, 16 bp, H. sapiens
tgacccactggttatt

SEQ ID NO: 144011 - DNA, 16 bp, H. sapiens
tgacccagacacctcc

SEQ ID NO: 144012 - DNA, 16 bp, H. sapiens
tgacccagacatccca

SEQ ID NO: 144013 - DNA, 16 bp, H. sapiens
tgacccagatgttgga

SEQ ID NO: 144014 - DNA, 16 bp, H. sapiens
tgacccagcaattcca

SEQ ID NO: 144015 - DNA, 16 bp, H. sapiens
tgacccagcaccattt

SEQ ID NO: 144016 - DNA, 16 bp, H. sapiens
tgacccagccacccca

SEQ ID NO: 144017 - DNA, 16 bp, H. sapiens
tgacccagcctcagaa

SEQ ID NO: 144018 - DNA, 16 bp, H. sapiens
tgacccattctgtgga

SEQ ID NO: 144019 - DNA, 16 bp, H. sapiens
tgaccccacagaaata

SEQ ID NO: 144020 - DNA, 16 bp, H. sapiens
tgaccccagaagttca

SEQ ID NO: 144021 - DNA, 16 bp, H. sapiens
tgaccccagagcagcc

SEQ ID NO: 144022 - DNA, 16 bp, H. sapiens
tgaccccaggagttcg

SEQ ID NO: 144023 - DNA, 16 bp, H. sapiens
tgacccctgtgcctcc

SEQ ID NO: 144024 - DNA, 16 bp, H. sapiens
tgaccccttcatggga

SEQ ID NO: 144025 - DNA, 16 bp, H. sapiens
tgacccctttcagcca

SEQ ID NO: 144026 - DNA, 16 bp, H. sapiens
tgaccctccctaaact

SEQ ID NO: 144027 - DNA, 16 bp, H. sapiens
tgaccctccctccact

SEQ ID NO: 144028 - DNA, 16 bp, H. sapiens
tgaccctcctgcctca

SEQ ID NO: 144029 - DNA, 22 bp, H. sapiens
tgaccctgccaaatccccctct

SEQ ID NO: 144030 - DNA, 16 bp, H. sapiens
tgaccctgggcaagcc

SEQ ID NO: 144031 - DNA, 16 bp, H. sapiens
tgaccctgtgatccgc

SEQ ID NO: 144032 - DNA, 17 bp, H. sapiens
tgaccctgtgatccgcc

SEQ ID NO: 144033 - DNA, 16 bp, H. sapiens
tgaccgatgagaagga

SEQ ID NO: 144034 - DNA, 16 bp, H. sapiens
tgaccgggcacggtgg

SEQ ID NO: 144035 - DNA, 16 bp, H. sapiens
tgaccggttgatgggt

SEQ ID NO: 144036 - DNA, 16 bp, H. sapiens
tgacctaacaggattc

SEQ ID NO: 144037 - DNA, 16 bp, H. sapiens
tgacctaatagacatc

SEQ ID NO: 144038 - DNA, 16 bp, H. sapiens
tgacctaatttacact

SEQ ID NO: 144039 - DNA, 17 bp, H. sapiens
tgacctagtgatctgcc

SEQ ID NO: 144040 - DNA, 16 bp, H. sapiens
tgacctcaagtgttct

SEQ ID NO: 144041 - DNA, 20 bp, H. sapiens
tgacctcagatgatctgccc

SEQ ID NO: 144042 - DNA, 16 bp, H. sapiens
tgacctcagcctccca

SEQ ID NO: 144043 - DNA, 16 bp, H. sapiens
tgacctcagctcactg

SEQ ID NO: 144044 - DNA, 16 bp, H. sapiens
tgacctcatcatctgc

SEQ ID NO: 144045 - DNA, 16 bp, H. sapiens
tgacctcatcttaact

SEQ ID NO: 144046 - DNA, 16 bp, H. sapiens
tgacctcatgacccgc

SEQ ID NO: 144047 - DNA, 24 bp, H. sapiens
tgacctcatgatctgcctgcctcg

SEQ ID NO: 144048 - DNA, 16 bp, H. sapiens
tgacctcatggaactt

SEQ ID NO: 144049 - DNA, 16 bp, H. sapiens
tgacctcatggagctg

SEQ ID NO: 144050 - DNA, 16 bp, H. sapiens
tgacctccagagctgt

SEQ ID NO: 144051 - DNA, 16 bp, H. sapiens
tgacctccagtgatcc

SEQ ID NO: 144052 - DNA, 16 bp, H. sapiens
tgacctcccaggccca

SEQ ID NO: 144053 - DNA, 16 bp, H. sapiens
tgacctcccaggctcc

SEQ ID NO: 144054 - DNA, 16 bp, H. sapiens
tgacctcccagtctca

SEQ ID NO: 144055 - DNA, 16 bp, H. sapiens
tgacctccccacctcc

SEQ ID NO: 144056 - DNA, 16 bp, H. sapiens
tgacctcccgacctca

SEQ ID NO: 144057 - DNA, 16 bp, H. sapiens
tgacctcccgggctca

SEQ ID NO: 144058 - DNA, 16 bp, H. sapiens
tgacctcctgggctca

SEQ ID NO: 144059 - DNA, 23 bp, H. sapiens
tgacctcgtgatccacctgcctt

SEQ ID NO: 144060 - DNA, 19 bp, H. sapiens
tgacctcgtgatccgccca

SEQ ID NO: 144061 - DNA, 18 bp, H. sapiens
tgacctcgtgatccgccg

SEQ ID NO: 144062 - DNA, 17 bp, H. sapiens
tgacctcgtgatccgcg

SEQ ID NO: 144063 - DNA, 17 bp, H. sapiens
tgacctcgtgatctgcc

SEQ ID NO: 144064 - DNA, 18 bp, H. sapiens
tgacctcgtgatttgccc

SEQ ID NO: 144065 - DNA, 16 bp, H. sapiens
tgacctctagctccat

SEQ ID NO: 144066 - DNA, 16 bp, H. sapiens
tgacctctctgtgcct

SEQ ID NO: 144067 - DNA, 24 bp, H. sapiens
tgacctcttcaaggagaactacaa

SEQ ID NO: 144068 - DNA, 17 bp, H. sapiens
tgacctcttgatccacc

SEQ ID NO: 144069 - DNA, 16 bp, H. sapiens
tgacctgacagagctg

SEQ ID NO: 144070 - DNA, 16 bp, H. sapiens
tgacctgccaggctca

SEQ ID NO: 144071 - DNA, 16 bp, H. sapiens
tgacctgcccacctca

SEQ ID NO: 144072 - DNA, 17 bp, H. sapiens
tgacctgccccttctct

SEQ ID NO: 144073 - DNA, 16 bp, H. sapiens
tgacctgcctgtggaa

SEQ ID NO: 144074 - DNA, 16 bp, H. sapiens
tgacctgccttgggga

SEQ ID NO: 144075 - DNA, 16 bp, H. sapiens
tgacctggaagcaccc

SEQ ID NO: 144076 - DNA, 16 bp, H. sapiens
tgacctggaagccccc

SEQ ID NO: 144077 - DNA, 16 bp, H. sapiens
tgacctggaagcctcc

SEQ ID NO: 144078 - DNA, 16 bp, H. sapiens
tgacctggaagctccc

SEQ ID NO: 144079 - DNA, 16 bp, H. sapiens
tgacctggaagtcccc

SEQ ID NO: 144080 - DNA, 16 bp, H. sapiens
tgacctggctggtctc

SEQ ID NO: 144081 - DNA, 16 bp, H. sapiens
tgacctggtggagctg

SEQ ID NO: 144082 - DNA, 16 bp, H. sapiens
tgacctgtatcttgtg

SEQ ID NO: 144083 - DNA, 16 bp, H. sapiens
tgacctgtgatcacac

SEQ ID NO: 144084 - DNA, 16 bp, H. sapiens
tgacctgtgcttctga

SEQ ID NO: 144085 - DNA, 16 bp, H. sapiens
tgaccttaaacaagtc

SEQ ID NO: 144086 - DNA, 16 bp, H. sapiens
tgaccttagacaagtc

SEQ ID NO: 144087 - DNA, 16 bp, H. sapiens
tgaccttaggtgattc

SEQ ID NO: 144088 - DNA, 16 bp, H. sapiens
tgaccttatagaaata

SEQ ID NO: 144089 - DNA, 16 bp, H. sapiens
tgaccttatttggaaa

SEQ ID NO: 144090 - DNA, 16 bp, H. sapiens
tgaccttcagaactgt

SEQ ID NO: 144091 - DNA, 16 bp, H. sapiens
tgaccttccctccact

SEQ ID NO: 144092 - DNA, 16 bp, H. sapiens
tgaccttcctgcttct

SEQ ID NO: 144093 - DNA, 16 bp, H. sapiens
tgaccttctccccacc

SEQ ID NO: 144094 - DNA, 25 bp, H. sapiens
tgaccttctccttattatcaccctg

SEQ ID NO: 144095 - DNA, 16 bp, H. sapiens
tgaccttctgatccac

SEQ ID NO: 144096 - DNA, 16 bp, H. sapiens
tgaccttctgctggga

SEQ ID NO: 144097 - DNA, 16 bp, H. sapiens
tgaccttgaacaagta

SEQ ID NO: 144098 - DNA, 16 bp, H. sapiens
tgaccttgagaaagtt

SEQ ID NO: 144099 - DNA, 16 bp, H. sapiens
tgaccttgagcaggtt

SEQ ID NO: 144100 - DNA, 16 bp, H. sapiens
tgaccttgatagtttt

SEQ ID NO: 144101 - DNA, 16 bp, H. sapiens
tgaccttggacaaatt

SEQ ID NO: 144102 - DNA, 16 bp, H. sapiens
tgaccttggacaagtc

SEQ ID NO: 144103 - DNA, 16 bp, H. sapiens
tgaccttggacagtct

SEQ ID NO: 144104 - DNA, 16 bp, H. sapiens
tgaccttggcaagtca

SEQ ID NO: 144105 - DNA, 16 bp, H. sapiens
tgaccttggccaagtc

SEQ ID NO: 144106 - DNA, 16 bp, H. sapiens
tgaccttgggcaaatt

SEQ ID NO: 144107 - DNA, 16 bp, H. sapiens
tgaccttgggcaagct

SEQ ID NO: 144108 - DNA, 16 bp, H. sapiens
tgaccttgggcaaggc

SEQ ID NO: 144109 - DNA, 16 bp, H. sapiens
tgaccttgggcaagtg

SEQ ID NO: 144110 - DNA, 16 bp, H. sapiens
tgaccttgggcaggtt

SEQ ID NO: 144111 - DNA, 16 bp, H. sapiens
tgaccttgggtaagtc

SEQ ID NO: 144112 - DNA, 16 bp, H. sapiens
tgaccttgtttggaaa

SEQ ID NO: 144113 - DNA, 16 bp, H. sapiens
tgacctttcaggcaga

SEQ ID NO: 144114 - DNA, 16 bp, H. sapiens
tgacctttccatcaat

SEQ ID NO: 144115 - DNA, 16 bp, H. sapiens
tgacgatgatgatgac

SEQ ID NO: 144116 - DNA, 16 bp, H. sapiens
tgacgatgatgatgat

SEQ ID NO: 144117 - DNA, 16 bp, H. sapiens
tgacgcagaagacggg

SEQ ID NO: 144118 - DNA, 17 bp, H. sapiens
tgacggagtctcgctct

SEQ ID NO: 144119 - DNA, 16 bp, H. sapiens
tgacggctcacgcctg

SEQ ID NO: 144120 - DNA, 16 bp, H. sapiens
tgacggctcatgcctg

SEQ ID NO: 144121 - DNA, 16 bp, H. sapiens
tgactaaaacaagcaa

SEQ ID NO: 144122 - DNA, 16 bp, H. sapiens
tgactaatatccagaa

SEQ ID NO: 144123 - DNA, 16 bp, H. sapiens
tgactaatttttaatt

SEQ ID NO: 144124 - DNA, 16 bp, H. sapiens
tgactactttagatac

SEQ ID NO: 144125 - DNA, 16 bp, H. sapiens
tgactagagttaacaa

SEQ ID NO: 144126 - DNA, 16 bp, H. sapiens
tgactatagttaacaa

SEQ ID NO: 144127 - DNA, 16 bp, H. sapiens
tgactatatatgtgtg

SEQ ID NO: 144128 - DNA, 16 bp, H. sapiens
tgactatatttttaaa

SEQ ID NO: 144129 - DNA, 16 bp, H. sapiens
tgactatggtgatggt

SEQ ID NO: 144130 - DNA, 16 bp, H. sapiens
tgactattatttcaca

SEQ ID NO: 144131 - DNA, 16 bp, H. sapiens
tgactcaaaaataaaa

SEQ ID NO: 144132 - DNA, 16 bp, H. sapiens
tgactcaaatattaat

SEQ ID NO: 144133 - DNA, 20 bp, H. sapiens
tgactcacactctttaccct

SEQ ID NO: 144134 - DNA, 16 bp, H. sapiens
tgactcactacagcct

SEQ ID NO: 144135 - DNA, 16 bp, H. sapiens
tgactcactgcagcct

SEQ ID NO: 144136 - DNA, 16 bp, H. sapiens
tgactcagcagaggca

SEQ ID NO: 144137 - DNA, 16 bp, H. sapiens
tgactcatccctgtaa

SEQ ID NO: 144138 - DNA, 16 bp, H. sapiens
tgactcatgtaaatgc

SEQ ID NO: 144139 - DNA, 16 bp, H. sapiens
tgactcattttattgc

SEQ ID NO: 144140 - DNA, 16 bp, H. sapiens
tgactccctggttcaa

SEQ ID NO: 144141 - DNA, 16 bp, H. sapiens
tgactcggcctcccaa

SEQ ID NO: 144142 - DNA, 16 bp, H. sapiens
tgactctcctacctca

SEQ ID NO: 144143 - DNA, 16 bp, H. sapiens
tgactctcctctcctg

SEQ ID NO: 144144 - DNA, 23 bp, H. sapiens
tgactctctttttggactcagcc

SEQ ID NO: 144145 - DNA, 16 bp, H. sapiens
tgactctgaagagagc

SEQ ID NO: 144146 - DNA, 16 bp, H. sapiens
tgactctgaccagtgc

SEQ ID NO: 144147 - DNA, 16 bp, H. sapiens
tgactctggaaaacaa

SEQ ID NO: 144148 - DNA, 16 bp, H. sapiens
tgactctggcataaca

SEQ ID NO: 144149 - DNA, 16 bp, H. sapiens
tgactcttgttatgtt

SEQ ID NO: 144150 - DNA, 16 bp, H. sapiens
tgactgaactcccaca

SEQ ID NO: 144151 - DNA, 16 bp, H. sapiens
tgactgaataaagaaa

SEQ ID NO: 144152 - DNA, 16 bp, H. sapiens
tgactgacctgcccac

SEQ ID NO: 144153 - DNA, 16 bp, H. sapiens
tgactgagtgaatgaa

SEQ ID NO: 144154 - DNA, 16 bp, H. sapiens
tgactgatggctggca

SEQ ID NO: 144155 - DNA, 16 bp, H. sapiens
tgactgcaaaactgcc

SEQ ID NO: 144156 - DNA, 16 bp, H. sapiens
tgactgcacattagaa

SEQ ID NO: 144157 - DNA, 16 bp, H. sapiens
tgactgcaccactgca

SEQ ID NO: 144158 - DNA, 16 bp, H. sapiens
tgactgcagaactgcc

SEQ ID NO: 144159 - DNA, 16 bp, H. sapiens
tgactgcagctcagaa

SEQ ID NO: 144160 - DNA, 16 bp, H. sapiens
tgactgccccactgga

SEQ ID NO: 144161 - DNA, 16 bp, H. sapiens
tgactgcctgcagggt

SEQ ID NO: 144162 - DNA, 16 bp, H. sapiens
tgactggatcacaggg

SEQ ID NO: 144163 - DNA, 16 bp, H. sapiens
tgactggatgaggccc

SEQ ID NO: 144164 - DNA, 16 bp, H. sapiens
tgactgggagctgtgg

SEQ ID NO: 144165 - DNA, 17 bp, H. sapiens
tgactggggaagtgata

SEQ ID NO: 144166 - DNA, 16 bp, H. sapiens
tgactgggtgagaccc

SEQ ID NO: 144167 - DNA, 16 bp, H. sapiens
tgactgggtttcacca

SEQ ID NO: 144168 - DNA, 16 bp, H. sapiens
tgactggttttggtgg

SEQ ID NO: 144169 - DNA, 16 bp, H. sapiens
tgactgtaactaccct

SEQ ID NO: 144170 - DNA, 16 bp, H. sapiens
tgactgtactaaaaat

SEQ ID NO: 144171 - DNA, 16 bp, H. sapiens
tgactgtactagttta

SEQ ID NO: 144172 - DNA, 16 bp, H. sapiens
tgactgtagtcaccct

SEQ ID NO: 144173 - DNA, 16 bp, H. sapiens
tgactgtgagaaggaa

SEQ ID NO: 144174 - DNA, 16 bp, H. sapiens
tgactgtgccactgca

SEQ ID NO: 144175 - DNA, 16 bp, H. sapiens
tgactgtgcctgtgaa

SEQ ID NO: 144176 - DNA, 16 bp, H. sapiens
tgactgtggtgatgga

SEQ ID NO: 144177 - DNA, 16 bp, H. sapiens
tgactgtggtgatggc

SEQ ID NO: 144178 - DNA, 16 bp, H. sapiens
tgactgtggtggtgga

SEQ ID NO: 144179 - DNA, 16 bp, H. sapiens
tgactgtgtgtctgtg

SEQ ID NO: 144180 - DNA, 16 bp, H. sapiens
tgactgtgtttggaga

SEQ ID NO: 144181 - DNA, 16 bp, H. sapiens
tgacttacagtatttt

SEQ ID NO: 144182 - DNA, 16 bp, H. sapiens
tgacttagaatgtctt

SEQ ID NO: 144183 - DNA, 16 bp, H. sapiens
tgacttatttcactta

SEQ ID NO: 144184 - DNA, 16 bp, H. sapiens
tgacttattttccttt

SEQ ID NO: 144185 - DNA, 16 bp, H. sapiens
tgacttcaagggatcc

SEQ ID NO: 144186 - DNA, 16 bp, H. sapiens
tgacttcagatgatcc

SEQ ID NO: 144187 - DNA, 16 bp, H. sapiens
tgacttcagggacaaa

SEQ ID NO: 144188 - DNA, 16 bp, H. sapiens
tgacttcattcttttt

SEQ ID NO: 144189 - DNA, 16 bp, H. sapiens
tgacttcatttatatg

SEQ ID NO: 144190 - DNA, 16 bp, H. sapiens
tgacttccagctccat

SEQ ID NO: 144191 - DNA, 16 bp, H. sapiens
tgacttcccacaacag

SEQ ID NO: 144192 - DNA, 16 bp, H. sapiens
tgacttcctcctttcc

SEQ ID NO: 144193 - DNA, 17 bp, H. sapiens
tgacttcgtgatccgcc

SEQ ID NO: 144194 - DNA, 16 bp, H. sapiens
tgacttctcagcctcc

SEQ ID NO: 144195 - DNA, 16 bp, H. sapiens
tgacttctctgggcct

SEQ ID NO: 144196 - DNA, 16 bp, H. sapiens
tgacttctttcagcag

SEQ ID NO: 144197 - DNA, 16 bp, H. sapiens
tgacttctttgcagaa

SEQ ID NO: 144198 - DNA, 16 bp, H. sapiens
tgacttctttttctct

SEQ ID NO: 144199 - DNA, 16 bp, H. sapiens
tgacttcttttttaaa

SEQ ID NO: 144200 - DNA, 16 bp, H. sapiens
tgacttgatagctcat

SEQ ID NO: 144201 - DNA, 16 bp, H. sapiens
tgacttgatcattaca

SEQ ID NO: 144202 - DNA, 19 bp, H. sapiens
tgacttgccaccaagggaa

SEQ ID NO: 144203 - DNA, 16 bp, H. sapiens
tgacttgcccacagtc

SEQ ID NO: 144204 - DNA, 16 bp, H. sapiens
tgacttgcctaaggcc

SEQ ID NO: 144205 - DNA, 16 bp, H. sapiens
tgacttgcctgaagtc

SEQ ID NO: 144206 - DNA, 16 bp, H. sapiens
tgacttgctgattttt

SEQ ID NO: 144207 - DNA, 16 bp, H. sapiens
tgacttgctttgacca

SEQ ID NO: 144208 - DNA, 16 bp, H. sapiens
tgacttgctttggcca

SEQ ID NO: 144209 - DNA, 16 bp, H. sapiens
tgacttggagttttat

SEQ ID NO: 144210 - DNA, 19 bp, H. sapiens
tgacttgggtgctgttaaa

SEQ ID NO: 144211 - DNA, 16 bp, H. sapiens
tgacttggtgctgtcc

SEQ ID NO: 144212 - DNA, 16 bp, H. sapiens
tgacttgtttttaaaa

SEQ ID NO: 144213 - DNA, 16 bp, H. sapiens
tgactttaaaaatatt

SEQ ID NO: 144214 - DNA, 16 bp, H. sapiens
tgactttaaaataaaa

SEQ ID NO: 144215 - DNA, 16 bp, H. sapiens
tgactttatttttaaa

SEQ ID NO: 144216 - DNA, 16 bp, H. sapiens
tgactttcaacaaagg

SEQ ID NO: 144217 - DNA, 16 bp, H. sapiens
tgactttcccagggtc

SEQ ID NO: 144218 - DNA, 16 bp, H. sapiens
tgactttctggaaggc

SEQ ID NO: 144219 - DNA, 16 bp, H. sapiens
tgactttctgtctgga

SEQ ID NO: 144220 - DNA, 19 bp, H. sapiens
tgactttcttcacagaatt

SEQ ID NO: 144221 - DNA, 27 bp, H. sapiens
tgactttcttcacagaattggaaaaac

SEQ ID NO: 144222 - DNA, 16 bp, H. sapiens
tgactttcttcataga

SEQ ID NO: 144223 - DNA, 16 bp, H. sapiens
tgactttcttcttctt

SEQ ID NO: 144224 - DNA, 16 bp, H. sapiens
tgactttctttgtctt

SEQ ID NO: 144225 - DNA, 16 bp, H. sapiens
tgactttctttgtttc

SEQ ID NO: 144226 - DNA, 16 bp, H. sapiens
tgactttctttttaaa

SEQ ID NO: 144227 - DNA, 16 bp, H. sapiens
tgactttgagcaagtt

SEQ ID NO: 144228 - DNA, 16 bp, H. sapiens
tgactttggaaaagtt

SEQ ID NO: 144229 - DNA, 16 bp, H. sapiens
tgactttggacaagtc

SEQ ID NO: 144230 - DNA, 16 bp, H. sapiens
tgactttggacttccc

SEQ ID NO: 144231 - DNA, 16 bp, H. sapiens
tgactttgtttctgag

SEQ ID NO: 144232 - DNA, 16 bp, H. sapiens
tgactttgtttggaaa

SEQ ID NO: 144233 - DNA, 16 bp, H. sapiens
tgactttgttttttaa

SEQ ID NO: 144234 - DNA, 16 bp, H. sapiens
tgacttttaaatgatt

SEQ ID NO: 144235 - DNA, 16 bp, H. sapiens
tgacttttatttaaaa

SEQ ID NO: 144236 - DNA, 16 bp, H. sapiens
tgacttttattttaga

SEQ ID NO: 144237 - DNA, 16 bp, H. sapiens
tgacttttcattttga

SEQ ID NO: 144238 - DNA, 16 bp, H. sapiens
tgacttttctatttct

SEQ ID NO: 144239 - DNA, 16 bp, H. sapiens
tgacttttcttttaaa

SEQ ID NO: 144240 - DNA, 16 bp, H. sapiens
tgacttttgcttggaa

SEQ ID NO: 144241 - DNA, 16 bp, H. sapiens
tgactttttaaaaatt

SEQ ID NO: 144242 - DNA, 16 bp, H. sapiens
tgactttttaataaaa

SEQ ID NO: 144243 - DNA, 16 bp, H. sapiens
tgactttttaattata

SEQ ID NO: 144244 - DNA, 16 bp, H. sapiens
tgactttttataatag

SEQ ID NO: 144245 - DNA, 16 bp, H. sapiens
tgactttttgaaaaaa

SEQ ID NO: 144246 - DNA, 16 bp, H. sapiens
tgacttttttcaaaaa

SEQ ID NO: 144247 - DNA, 16 bp, H. sapiens
tgactttttttaaaaa

SEQ ID NO: 144248 - DNA, 16 bp, H. sapiens
tgactttttttcctct

SEQ ID NO: 144249 - DNA, 16 bp, H. sapiens
tgactttttttgtgtg

SEQ ID NO: 144250 - DNA, 16 bp, H. sapiens
tgactttttttttaaa

SEQ ID NO: 144251 - DNA, 16 bp, H. sapiens
tgactttttttttcca

SEQ ID NO: 144252 - DNA, 16 bp, H. sapiens
tgagaaaaaatatttt

SEQ ID NO: 144253 - DNA, 16 bp, H. sapiens
tgagaaaaacaacaga

SEQ ID NO: 144254 - DNA, 16 bp, H. sapiens
tgagaaaaacagaaga

SEQ ID NO: 144255 - DNA, 16 bp, H. sapiens
tgagaaaaagaatgtg

SEQ ID NO: 144256 - DNA, 16 bp, H. sapiens
tgagaaaaatgtctcc

SEQ ID NO: 144257 - DNA, 16 bp, H. sapiens
tgagaaaaatgtttta

SEQ ID NO: 144258 - DNA, 16 bp, H. sapiens
tgagaaaacagaaact

SEQ ID NO: 144259 - DNA, 16 bp, H. sapiens
tgagaaaacagagact

SEQ ID NO: 144260 - DNA, 16 bp, H. sapiens
tgagaaaaccacagaa

SEQ ID NO: 144261 - DNA, 16 bp, H. sapiens
tgagaaaactaagaca

SEQ ID NO: 144262 - DNA, 16 bp, H. sapiens
tgagaaaactgaaaca

SEQ ID NO: 144263 - DNA, 16 bp, H. sapiens
tgagaaaactgaagtt

SEQ ID NO: 144264 - DNA, 16 bp, H. sapiens
tgagaaaactgaatat

SEQ ID NO: 144265 - DNA, 16 bp, H. sapiens
tgagaaaactgaggaa

SEQ ID NO: 144266 - DNA, 16 bp, H. sapiens
tgagaaaactgaggca

SEQ ID NO: 144267 - DNA, 16 bp, H. sapiens
tgagaaaactgcagaa

SEQ ID NO: 144268 - DNA, 16 bp, H. sapiens
tgagaaaacttttgcc

SEQ ID NO: 144269 - DNA, 16 bp, H. sapiens
tgagaaaagaaaggct

SEQ ID NO: 144270 - DNA, 16 bp, H. sapiens
tgagaaaagaaagtgg

SEQ ID NO: 144271 - DNA, 16 bp, H. sapiens
tgagaaaagaaatttt

SEQ ID NO: 144272 - DNA, 16 bp, H. sapiens
tgagaaaagcagagaa

SEQ ID NO: 144273 - DNA, 16 bp, H. sapiens
tgagaaaatagcagaa

SEQ ID NO: 144274 - DNA, 16 bp, H. sapiens
tgagaaaatataattt

SEQ ID NO: 144275 - DNA, 16 bp, H. sapiens
tgagaaaatatttcca

SEQ ID NO: 144276 - DNA, 16 bp, H. sapiens
tgagaaaatatttgca

SEQ ID NO: 144277 - DNA, 16 bp, H. sapiens
tgagaaaatgaaaaca

SEQ ID NO: 144278 - DNA, 16 bp, H. sapiens
tgagaaaatgaatttt

SEQ ID NO: 144279 - DNA, 16 bp, H. sapiens
tgagaaaatgtggtgt

SEQ ID NO: 144280 - DNA, 16 bp, H. sapiens
tgagaaaattatggca

SEQ ID NO: 144281 - DNA, 16 bp, H. sapiens
tgagaaaattcaacaa

SEQ ID NO: 144282 - DNA, 16 bp, H. sapiens
tgagaaaattctttgt

SEQ ID NO: 144283 - DNA, 16 bp, H. sapiens
tgagaaaattgaggct

SEQ ID NO: 144284 - DNA, 16 bp, H. sapiens
tgagaaacaaatgttt

SEQ ID NO: 144285 - DNA, 16 bp, H. sapiens
tgagaaacatctttgt

SEQ ID NO: 144286 - DNA, 16 bp, H. sapiens
tgagaaaccctggcct

SEQ ID NO: 144287 - DNA, 16 bp, H. sapiens
tgagaaacctccatat

SEQ ID NO: 144288 - DNA, 16 bp, H. sapiens
tgagaaactaaatttt

SEQ ID NO: 144289 - DNA, 16 bp, H. sapiens
tgagaaactagaaaaa

SEQ ID NO: 144290 - DNA, 16 bp, H. sapiens
tgagaaactgaatatt

SEQ ID NO: 144291 - DNA, 16 bp, H. sapiens
tgagaaactgaatttt

SEQ ID NO: 144292 - DNA, 16 bp, H. sapiens
tgagaaacttgtttgt

SEQ ID NO: 144293 - DNA, 16 bp, H. sapiens
tgagaaagaaattttt

SEQ ID NO: 144294 - DNA, 17 bp, H. sapiens
tgagaaagatccaccta

SEQ ID NO: 144295 - DNA, 16 bp, H. sapiens
tgagaaagatgagatt

SEQ ID NO: 144296 - DNA, 16 bp, H. sapiens
tgagaaagcaggaaag

SEQ ID NO: 144297 - DNA, 16 bp, H. sapiens
tgagaaaggagacatt

SEQ ID NO: 144298 - DNA, 16 bp, H. sapiens
tgagaaagtgacattt

SEQ ID NO: 144299 - DNA, 16 bp, H. sapiens
tgagaaataaagggac

SEQ ID NO: 144300 - DNA, 16 bp, H. sapiens
tgagaaataaatttca

SEQ ID NO: 144301 - DNA, 16 bp, H. sapiens
tgagaaataactttct

SEQ ID NO: 144302 - DNA, 16 bp, H. sapiens
tgagaaataattttct

SEQ ID NO: 144303 - DNA, 16 bp, H. sapiens
tgagaaatcactcact

SEQ ID NO: 144304 - DNA, 16 bp, H. sapiens
tgagaaatcagatggt

SEQ ID NO: 144305 - DNA, 16 bp, H. sapiens
tgagaaatgaatgttt

SEQ ID NO: 144306 - DNA, 16 bp, H. sapiens
tgagaaatgctaaagg

SEQ ID NO: 144307 - DNA, 16 bp, H. sapiens
tgagaaatggaacaag

SEQ ID NO: 144308 - DNA, 16 bp, H. sapiens
tgagaaatgtctcttc

SEQ ID NO: 144309 - DNA, 16 bp, H. sapiens
tgagaaatgtttattt

SEQ ID NO: 144310 - DNA, 16 bp, H. sapiens
tgagaaattcaagcca

SEQ ID NO: 144311 - DNA, 16 bp, H. sapiens
tgagaaattgctttgt

SEQ ID NO: 144312 - DNA, 16 bp, H. sapiens
tgagaaatttacaaaa

SEQ ID NO: 144313 - DNA, 16 bp, H. sapiens
tgagaaatttaccaag

SEQ ID NO: 144314 - DNA, 16 bp, H. sapiens
tgagaaatttagaaaa

SEQ ID NO: 144315 - DNA, 16 bp, H. sapiens
tgagaacaaagagaca

SEQ ID NO: 144316 - DNA, 16 bp, H. sapiens
tgagaacaagcagtat

SEQ ID NO: 144317 - DNA, 16 bp, H. sapiens
tgagaacaatgacaca

SEQ ID NO: 144318 - DNA, 16 bp, H. sapiens
tgagaacacatggact

SEQ ID NO: 144319 - DNA, 16 bp, H. sapiens
tgagaacacatgggca

SEQ ID NO: 144320 - DNA, 16 bp, H. sapiens
tgagaacagaagcatt

SEQ ID NO: 144321 - DNA, 16 bp, H. sapiens
tgagaacagcagcatg

SEQ ID NO: 144322 - DNA, 16 bp, H. sapiens
tgagaacagcctgagc

SEQ ID NO: 144323 - DNA, 16 bp, H. sapiens
tgagaacagcctggga

SEQ ID NO: 144324 - DNA, 16 bp, H. sapiens
tgagaacatgccgtgt

SEQ ID NO: 144325 - DNA, 16 bp, H. sapiens
tgagaacatgctgtgt

SEQ ID NO: 144326 - DNA, 16 bp, H. sapiens
tgagaacatgtgccca

SEQ ID NO: 144327 - DNA, 16 bp, H. sapiens
tgagaacattaaaaaa

SEQ ID NO: 144328 - DNA, 16 bp, H. sapiens
tgagaaccactgattt

SEQ ID NO: 144329 - DNA, 16 bp, H. sapiens
tgagaaccactgctct

SEQ ID NO: 144330 - DNA, 16 bp, H. sapiens
tgagaaccactggact

SEQ ID NO: 144331 - DNA, 16 bp, H. sapiens
tgagaaccactggtct

SEQ ID NO: 144332 - DNA, 16 bp, H. sapiens
tgagaaccagaacaag

SEQ ID NO: 144333 - DNA, 16 bp, H. sapiens
tgagaaccaggagctc

SEQ ID NO: 144334 - DNA, 16 bp, H. sapiens
tgagaaccttcttgct

SEQ ID NO: 144335 - DNA, 16 bp, H. sapiens
tgagaacttcctcact

SEQ ID NO: 144336 - DNA, 16 bp, H. sapiens
tgagaacttctattcc

SEQ ID NO: 144337 - DNA, 16 bp, H. sapiens
tgagaacttctgttcc

SEQ ID NO: 144338 - DNA, 16 bp, H. sapiens
tgagaagaaaccagaa

SEQ ID NO: 144339 - DNA, 16 bp, H. sapiens
tgagaagaaattcaag

SEQ ID NO: 144340 - DNA, 16 bp, H. sapiens
tgagaagagcatgggg

SEQ ID NO: 144341 - DNA, 16 bp, H. sapiens
tgagaagaggaccact

SEQ ID NO: 144342 - DNA, 18 bp, H. sapiens
tgagaagagggccactgt

SEQ ID NO: 144343 - DNA, 16 bp, H. sapiens
tgagaagcaactcctc

SEQ ID NO: 144344 - DNA, 16 bp, H. sapiens
tgagaagcaggcagcc

SEQ ID NO: 144345 - DNA, 16 bp, H. sapiens
tgagaagctgaagcag

SEQ ID NO: 144346 - DNA, 16 bp, H. sapiens
tgagaaggaaccagtg

SEQ ID NO: 144347 - DNA, 16 bp, H. sapiens
tgagaaggagccagct

SEQ ID NO: 144348 - DNA, 16 bp, H. sapiens
tgagaaggcaccatct

SEQ ID NO: 144349 - DNA, 16 bp, H. sapiens
tgagaaggccaccatg

SEQ ID NO: 144350 - DNA, 16 bp, H. sapiens
tgagaaggcctcagga

SEQ ID NO: 144351 - DNA, 16 bp, H. sapiens
tgagaaggctgaggca

SEQ ID NO: 144352 - DNA, 16 bp, H. sapiens
tgagaaggtaaacaaa

SEQ ID NO: 144353 - DNA, 16 bp, H. sapiens
tgagaagtccaaggtc

SEQ ID NO: 144354 - DNA, 17 bp, H. sapiens
tgagaagtgaggagtcc

SEQ ID NO: 144355 - DNA, 16 bp, H. sapiens
tgagaagttgcttctt

SEQ ID NO: 144356 - DNA, 16 bp, H. sapiens
tgagaagtttagagaa

SEQ ID NO: 144357 - DNA, 16 bp, H. sapiens
tgagaagtttgttttt

SEQ ID NO: 144358 - DNA, 16 bp, H. sapiens
tgagaagttttatttt

SEQ ID NO: 144359 - DNA, 16 bp, H. sapiens
tgagaataaatttctg

SEQ ID NO: 144360 - DNA, 16 bp, H. sapiens
tgagaatagcatgggg

SEQ ID NO: 144361 - DNA, 16 bp, H. sapiens
tgagaatagtgctgca

SEQ ID NO: 144362 - DNA, 16 bp, H. sapiens
tgagaatatatatatg

SEQ ID NO: 144363 - DNA, 16 bp, H. sapiens
tgagaatattttaaaa

SEQ ID NO: 144364 - DNA, 16 bp, H. sapiens
tgagaatattttaaat

SEQ ID NO: 144365 - DNA, 16 bp, H. sapiens
tgagaatcactgcttt

SEQ ID NO: 144366 - DNA, 17 bp, H. sapiens
tgagaatcacttgaatc

SEQ ID NO: 144367 - DNA, 16 bp, H. sapiens
tgagaatctaatgaaa

SEQ ID NO: 144368 - DNA, 16 bp, H. sapiens
tgagaatctaatgcct

SEQ ID NO: 144369 - DNA, 16 bp, H. sapiens
tgagaatctcttgaac

SEQ ID NO: 144370 - DNA, 16 bp, H. sapiens
tgagaatctgatgaaa

SEQ ID NO: 144371 - DNA, 16 bp, H. sapiens
tgagaatctgtctcca

SEQ ID NO: 144372 - DNA, 16 bp, H. sapiens
tgagaatgatgacttc

SEQ ID NO: 144373 - DNA, 16 bp, H. sapiens
tgagaatgatggtttt

SEQ ID NO: 144374 - DNA, 16 bp, H. sapiens
tgagaatgcaaaggca

SEQ ID NO: 144375 - DNA, 16 bp, H. sapiens
tgagaatgcttctgtt

SEQ ID NO: 144376 - DNA, 16 bp, H. sapiens
tgagaatggacatcct

SEQ ID NO: 144377 - DNA, 16 bp, H. sapiens
tgagaattaaaaaaca

SEQ ID NO: 144378 - DNA, 16 bp, H. sapiens
tgagaattaaaatttt

SEQ ID NO: 144379 - DNA, 16 bp, H. sapiens
tgagaattaaatgaaa

SEQ ID NO: 144380 - DNA, 16 bp, H. sapiens
tgagaattagaaaaca

SEQ ID NO: 144381 - DNA, 16 bp, H. sapiens
tgagaattatgaaaat

SEQ ID NO: 144382 - DNA, 16 bp, H. sapiens
tgagaattttcaaaaa

SEQ ID NO: 144383 - DNA, 16 bp, H. sapiens
tgagaatttttacatt

SEQ ID NO: 144384 - DNA, 16 bp, H. sapiens
tgagaatttttgcatt

SEQ ID NO: 144385 - DNA, 16 bp, H. sapiens
tgagaattttttaaaa

SEQ ID NO: 144386 - DNA, 16 bp, H. sapiens
tgagacaaaatttcca

SEQ ID NO: 144387 - DNA, 16 bp, H. sapiens
tgagacaaattaaaat

SEQ ID NO: 144388 - DNA, 16 bp, H. sapiens
tgagacaagtctcaat

SEQ ID NO: 144389 - DNA, 16 bp, H. sapiens
tgagacaatggggaaa

SEQ ID NO: 144390 - DNA, 16 bp, H. sapiens
tgagacaatttgagca

SEQ ID NO: 144391 - DNA, 16 bp, H. sapiens
tgagacacaacagtat

SEQ ID NO: 144392 - DNA, 16 bp, H. sapiens
tgagacacagtgcctg

SEQ ID NO: 144393 - DNA, 16 bp, H. sapiens
tgagacaccacacctg

SEQ ID NO: 144394 - DNA, 16 bp, H. sapiens
tgagacaccagctgga

SEQ ID NO: 144395 - DNA, 16 bp, H. sapiens
tgagacaccagctggg

SEQ ID NO: 144396 - DNA, 16 bp, H. sapiens
tgagacaccatctcca

SEQ ID NO: 144397 - DNA, 16 bp, H. sapiens
tgagacagaaaatgaa

SEQ ID NO: 144398 - DNA, 16 bp, H. sapiens
tgagacagaatctcaa

SEQ ID NO: 144399 - DNA, 16 bp, H. sapiens
tgagacagaatctgtc

SEQ ID NO: 144400 - DNA, 16 bp, H. sapiens
tgagacagaatcttcc

SEQ ID NO: 144401 - DNA, 16 bp, H. sapiens
tgagacagagtcctgc

SEQ ID NO: 144402 - DNA, 16 bp, H. sapiens
tgagacagagttgcac

SEQ ID NO: 144403 - DNA, 16 bp, H. sapiens
tgagacagcatctcac

SEQ ID NO: 144404 - DNA, 16 bp, H. sapiens
tgagacaggaaggcta

SEQ ID NO: 144405 - DNA, 16 bp, H. sapiens
tgagacaggaccttgc

SEQ ID NO: 144406 - DNA, 16 bp, H. sapiens
tgagacaggagaactg

SEQ ID NO: 144407 - DNA, 16 bp, H. sapiens
tgagacaggagaatcc

SEQ ID NO: 144408 - DNA, 19 bp, H. sapiens
tgagacaggagaatcgctt

SEQ ID NO: 144409 - DNA, 16 bp, H. sapiens
tgagacaggatctcac

SEQ ID NO: 144410 - DNA, 16 bp, H. sapiens
tgagacagggtcgtgc

SEQ ID NO: 144411 - DNA, 16 bp, H. sapiens
tgagacagggtctcaa

SEQ ID NO: 144412 - DNA, 16 bp, H. sapiens
tgagacagtgaaaaag

SEQ ID NO: 144413 - DNA, 16 bp, H. sapiens
tgagacattttgcaga

SEQ ID NO: 144414 - DNA, 16 bp, H. sapiens
tgagaccaaactgcaa

SEQ ID NO: 144415 - DNA, 16 bp, H. sapiens
tgagaccagccaggca

SEQ ID NO: 144416 - DNA, 18 bp, H. sapiens
tgagaccagccgggccaa

SEQ ID NO: 144417 - DNA, 16 bp, H. sapiens
tgagaccagcctaacc

SEQ ID NO: 144418 - DNA, 16 bp, H. sapiens
tgagaccagcctcagc

SEQ ID NO: 144419 - DNA, 16 bp, H. sapiens
tgagaccagcctgagc

SEQ ID NO: 144420 - DNA, 16 bp, H. sapiens
tgagaccagcctggaa

SEQ ID NO: 144421 - DNA, 16 bp, H. sapiens
tgagaccagcctggag

SEQ ID NO: 144422 - DNA, 16 bp, H. sapiens
tgagaccagctcagtc

SEQ ID NO: 144423 - DNA, 16 bp, H. sapiens
tgagaccagctgggcc

SEQ ID NO: 144424 - DNA, 16 bp, H. sapiens
tgagaccaggctgggc

SEQ ID NO: 144425 - DNA, 16 bp, H. sapiens
tgagaccatccaggct

SEQ ID NO: 144426 - DNA, 16 bp, H. sapiens
tgagaccatctctaca

SEQ ID NO: 144427 - DNA, 18 bp, H. sapiens
tgagaccatcttggccaa

SEQ ID NO: 144428 - DNA, 16 bp, H. sapiens
tgagaccatgaaccca

SEQ ID NO: 144429 - DNA, 16 bp, H. sapiens
tgagaccccatctcca

SEQ ID NO: 144430 - DNA, 16 bp, H. sapiens
tgagacccccccccca

SEQ ID NO: 144431 - DNA, 16 bp, H. sapiens
tgagaccctgtcccta

SEQ ID NO: 144432 - DNA, 20 bp, H. sapiens
tgagaccctgtctcaaaaga

SEQ ID NO: 144433 - DNA, 16 bp, H. sapiens
tgagaccctgtctctt

SEQ ID NO: 144434 - DNA, 16 bp, H. sapiens
tgagaccctgtcttga

SEQ ID NO: 144435 - DNA, 16 bp, H. sapiens
tgagaccctgtttcaa

SEQ ID NO: 144436 - DNA, 16 bp, H. sapiens
tgagaccctttctcta

SEQ ID NO: 144437 - DNA, 16 bp, H. sapiens
tgagaccgagtctctc

SEQ ID NO: 144438 - DNA, 16 bp, H. sapiens
tgagaccggcctgggc

SEQ ID NO: 144439 - DNA, 16 bp, H. sapiens
tgagacctactgctca

SEQ ID NO: 144440 - DNA, 16 bp, H. sapiens
tgagacctagtctcta

SEQ ID NO: 144441 - DNA, 16 bp, H. sapiens
tgagacctcatctctg

SEQ ID NO: 144442 - DNA, 16 bp, H. sapiens
tgagacctgcctggcc

SEQ ID NO: 144443 - DNA, 16 bp, H. sapiens
tgagacctgtctcaga

SEQ ID NO: 144444 - DNA, 16 bp, H. sapiens
tgagaccttcctggcc

SEQ ID NO: 144445 - DNA, 16 bp, H. sapiens
tgagaccttgtctcca

SEQ ID NO: 144446 - DNA, 16 bp, H. sapiens
tgagaccttgtttcaa

SEQ ID NO: 144447 - DNA, 16 bp, H. sapiens
tgagacgctgtctcaa

SEQ ID NO: 144448 - DNA, 21 bp, H. sapiens
tgagacggagtcttgctctgc

SEQ ID NO: 144449 - DNA, 16 bp, H. sapiens
tgagactacaggtgtg

SEQ ID NO: 144450 - DNA, 16 bp, H. sapiens
tgagactatgtaaaaa

SEQ ID NO: 144451 - DNA, 16 bp, H. sapiens
tgagactccatctcca

SEQ ID NO: 144452 - DNA, 16 bp, H. sapiens
tgagactccatctcta

SEQ ID NO: 144453 - DNA, 16 bp, H. sapiens
tgagactctaatgcca

SEQ ID NO: 144454 - DNA, 16 bp, H. sapiens
tgagactctgtctgga

SEQ ID NO: 144455 - DNA, 16 bp, H. sapiens
tgagactgagcaattt

SEQ ID NO: 144456 - DNA, 16 bp, H. sapiens
tgagactgctgggtca

SEQ ID NO: 144457 - DNA, 16 bp, H. sapiens
tgagactggatgagat

SEQ ID NO: 144458 - DNA, 16 bp, H. sapiens
tgagactgggagtttg

SEQ ID NO: 144459 - DNA, 16 bp, H. sapiens
tgagactgtcttaaaa

SEQ ID NO: 144460 - DNA, 16 bp, H. sapiens
tgagacttactgctca

SEQ ID NO: 144461 - DNA, 16 bp, H. sapiens
tgagacttattcacta

SEQ ID NO: 144462 - DNA, 16 bp, H. sapiens
tgagactttctctttg

SEQ ID NO: 144463 - DNA, 16 bp, H. sapiens
tgagagaaaagaaaca

SEQ ID NO: 144464 - DNA, 16 bp, H. sapiens
tgagagaaaatacttg

SEQ ID NO: 144465 - DNA, 16 bp, H. sapiens
tgagagaaataaatat

SEQ ID NO: 144466 - DNA, 16 bp, H. sapiens
tgagagaactgaggca

SEQ ID NO: 144467 - DNA, 20 bp, H. sapiens
tgagagaagaaggcttcaga

SEQ ID NO: 144468 - DNA, 20 bp, H. sapiens
tgagagaagaaggcttcagg

SEQ ID NO: 144469 - DNA, 16 bp, H. sapiens
tgagagaaggcttcag

SEQ ID NO: 144470 - DNA, 16 bp, H. sapiens
tgagagaatactataa

SEQ ID NO: 144471 - DNA, 16 bp, H. sapiens
tgagagaatttatcac

SEQ ID NO: 144472 - DNA, 16 bp, H. sapiens
tgagagacagacatgc

SEQ ID NO: 144473 - DNA, 16 bp, H. sapiens
tgagagagaaaattaa

SEQ ID NO: 144474 - DNA, 16 bp, H. sapiens
tgagagagaaataaac

SEQ ID NO: 144475 - DNA, 16 bp, H. sapiens
tgagagagaatatttg

SEQ ID NO: 144476 - DNA, 16 bp, H. sapiens
tgagagagacagacag

SEQ ID NO: 144477 - DNA, 16 bp, H. sapiens
tgagagagagagagac

SEQ ID NO: 144478 - DNA, 16 bp, H. sapiens
tgagagaggacacaaa

SEQ ID NO: 144479 - DNA, 16 bp, H. sapiens
tgagagaggccagtgt

SEQ ID NO: 144480 - DNA, 16 bp, H. sapiens
tgagagatagaggagg

SEQ ID NO: 144481 - DNA, 16 bp, H. sapiens
tgagagatattgatct

SEQ ID NO: 144482 - DNA, 17 bp, H. sapiens
tgagagatgaggatcca

SEQ ID NO: 144483 - DNA, 16 bp, H. sapiens
tgagagcaaagacaca

SEQ ID NO: 144484 - DNA, 16 bp, H. sapiens
tgagagcagcatgggg

SEQ ID NO: 144485 - DNA, 16 bp, H. sapiens
tgagagcatgtggtgt

SEQ ID NO: 144486 - DNA, 16 bp, H. sapiens
tgagagccaagcaaag

SEQ ID NO: 144487 - DNA, 16 bp, H. sapiens
tgagagccaccatgcc

SEQ ID NO: 144488 - DNA, 16 bp, H. sapiens
tgagagccagcccctc

SEQ ID NO: 144489 - DNA, 16 bp, H. sapiens
tgagagccaggtttct

SEQ ID NO: 144490 - DNA, 16 bp, H. sapiens
tgagagcccagaaata

SEQ ID NO: 144491 - DNA, 16 bp, H. sapiens
tgagagccccacccct

SEQ ID NO: 144492 - DNA, 16 bp, H. sapiens
tgagagccctgagctt

SEQ ID NO: 144493 - DNA, 16 bp, H. sapiens
tgagagcctcagtttc

SEQ ID NO: 144494 - DNA, 16 bp, H. sapiens
tgagagccttgaagat

SEQ ID NO: 144495 - DNA, 16 bp, H. sapiens
tgagagctaaacattg

SEQ ID NO: 144496 - DNA, 16 bp, H. sapiens
tgagagctctcttcct

SEQ ID NO: 144497 - DNA, 16 bp, H. sapiens
tgagagctctgccctc

SEQ ID NO: 144498 - DNA, 16 bp, H. sapiens
tgagagctgatggttt

SEQ ID NO: 144499 - DNA, 16 bp, H. sapiens
tgagagctggacactt

SEQ ID NO: 144500 - DNA, 16 bp, H. sapiens
tgagagctgggtgagg

SEQ ID NO: 144501 - DNA, 16 bp, H. sapiens
tgagagctggttgttt

SEQ ID NO: 144502 - DNA, 16 bp, H. sapiens
tgagagctgtgggctg

SEQ ID NO: 144503 - DNA, 16 bp, H. sapiens
tgagagctttccttct

SEQ ID NO: 144504 - DNA, 16 bp, H. sapiens
tgagaggatcatttga

SEQ ID NO: 144505 - DNA, 24 bp, H. sapiens
tgagaggatgtggagaaataggaa

SEQ ID NO: 144506 - DNA, 16 bp, H. sapiens
tgagaggatgtgtgtg

SEQ ID NO: 144507 - DNA, 16 bp, H. sapiens
tgagaggcagagattg

SEQ ID NO: 144508 - DNA, 16 bp, H. sapiens
tgagaggcagagctgg

SEQ ID NO: 144509 - DNA, 16 bp, H. sapiens
tgagaggcagagggtg

SEQ ID NO: 144510 - DNA, 16 bp, H. sapiens
tgagaggcccaggtgg

SEQ ID NO: 144511 - DNA, 16 bp, H. sapiens
tgagaggctgaagggg

SEQ ID NO: 144512 - DNA, 18 bp, H. sapiens
tgagaggctgaggtgggc

SEQ ID NO: 144513 - DNA, 16 bp, H. sapiens
tgagaggctgtggcag

SEQ ID NO: 144514 - DNA, 19 bp, H. sapiens
tgagaggtgaagccagctg

SEQ ID NO: 144515 - DNA, 16 bp, H. sapiens
tgagaggtgtgtgtgt

SEQ ID NO: 144516 - DNA, 16 bp, H. sapiens
tgagagtacaggtgca

SEQ ID NO: 144517 - DNA, 16 bp, H. sapiens
tgagagtgaaatcaag

SEQ ID NO: 144518 - DNA, 16 bp, H. sapiens
tgagagtgaataagtc

SEQ ID NO: 144519 - DNA, 16 bp, H. sapiens
tgagagtgtgaccaaa

SEQ ID NO: 144520 - DNA, 16 bp, H. sapiens
tgagagtgtgtgtgtg

SEQ ID NO: 144521 - DNA, 16 bp, H. sapiens
tgagagttctttatat

SEQ ID NO: 144522 - DNA, 16 bp, H. sapiens
tgagagttcttttttt

SEQ ID NO: 144523 - DNA, 16 bp, H. sapiens
tgagagtttgattatt

SEQ ID NO: 144524 - DNA, 16 bp, H. sapiens
tgagataagggtccaa

SEQ ID NO: 144525 - DNA, 16 bp, H. sapiens
tgagataccatctcac

SEQ ID NO: 144526 - DNA, 16 bp, H. sapiens
tgagataccatctcat

SEQ ID NO: 144527 - DNA, 16 bp, H. sapiens
tgagataccatgtcac

SEQ ID NO: 144528 - DNA, 16 bp, H. sapiens
tgagataccctctcac

SEQ ID NO: 144529 - DNA, 16 bp, H. sapiens
tgagatagatagatag

SEQ ID NO: 144530 - DNA, 16 bp, H. sapiens
tgagatagcaccacta

SEQ ID NO: 144531 - DNA, 16 bp, H. sapiens
tgagatatgcctttca

SEQ ID NO: 144532 - DNA, 16 bp, H. sapiens
tgagatatgtgtgtgt

SEQ ID NO: 144533 - DNA, 16 bp, H. sapiens
tgagatattttggtat

SEQ ID NO: 144534 - DNA, 16 bp, H. sapiens
tgagatatttttaaaa

SEQ ID NO: 144535 - DNA, 16 bp, H. sapiens
tgagatcagaaagcat

SEQ ID NO: 144536 - DNA, 16 bp, H. sapiens
tgagatcagactggcc

SEQ ID NO: 144537 - DNA, 16 bp, H. sapiens
tgagatcaggagctca

SEQ ID NO: 144538 - DNA, 16 bp, H. sapiens
tgagatcaggctgggc

SEQ ID NO: 144539 - DNA, 16 bp, H. sapiens
tgagatcaggtgttca

SEQ ID NO: 144540 - DNA, 16 bp, H. sapiens
tgagatcatcccactg

SEQ ID NO: 144541 - DNA, 16 bp, H. sapiens
tgagatcatgagtttg

SEQ ID NO: 144542 - DNA, 16 bp, H. sapiens
tgagatcatgtcatct

SEQ ID NO: 144543 - DNA, 16 bp, H. sapiens
tgagatcatgtcattg

SEQ ID NO: 144544 - DNA, 16 bp, H. sapiens
tgagatcattcttttt

SEQ ID NO: 144545 - DNA, 16 bp, H. sapiens
tgagatccagcctggg

SEQ ID NO: 144546 - DNA, 16 bp, H. sapiens
tgagatcctgcctcta

SEQ ID NO: 144547 - DNA, 16 bp, H. sapiens
tgagatcctggtgcac

SEQ ID NO: 144548 - DNA, 16 bp, H. sapiens
tgagatcctgtctcca

SEQ ID NO: 144549 - DNA, 16 bp, H. sapiens
tgagatcctgtcttta

SEQ ID NO: 144550 - DNA, 16 bp, H. sapiens
tgagatcggcctgggc

SEQ ID NO: 144551 - DNA, 16 bp, H. sapiens
tgagatctgggtgagg

SEQ ID NO: 144552 - DNA, 16 bp, H. sapiens
tgagatctgggtggag

SEQ ID NO: 144553 - DNA, 16 bp, H. sapiens
tgagatctggtagttt

SEQ ID NO: 144554 - DNA, 16 bp, H. sapiens
tgagatcttgttgttt

SEQ ID NO: 144555 - DNA, 16 bp, H. sapiens
tgagatgaaagcacat

SEQ ID NO: 144556 - DNA, 16 bp, H. sapiens
tgagatgagcagatca

SEQ ID NO: 144557 - DNA, 16 bp, H. sapiens
tgagatgagcttgggg

SEQ ID NO: 144558 - DNA, 16 bp, H. sapiens
tgagatgaggaagact

SEQ ID NO: 144559 - DNA, 16 bp, H. sapiens
tgagatgatatctcat

SEQ ID NO: 144560 - DNA, 16 bp, H. sapiens
tgagatgatgaaaata

SEQ ID NO: 144561 - DNA, 16 bp, H. sapiens
tgagatgcatctcctg

SEQ ID NO: 144562 - DNA, 16 bp, H. sapiens
tgagatggaaaaaaat

SEQ ID NO: 144563 - DNA, 16 bp, H. sapiens
tgagatggaattttgt

SEQ ID NO: 144564 - DNA, 16 bp, H. sapiens
tgagatggacaaattg

SEQ ID NO: 144565 - DNA, 16 bp, H. sapiens
tgagatggagcctcgc

SEQ ID NO: 144566 - DNA, 16 bp, H. sapiens
tgagatggagccttgc

SEQ ID NO: 144567 - DNA, 16 bp, H. sapiens
tgagatggagtccagc

SEQ ID NO: 144568 - DNA, 16 bp, H. sapiens
tgagatggagtctcat

SEQ ID NO: 144569 - DNA, 16 bp, H. sapiens
tgagatggagtctcct

SEQ ID NO: 144570 - DNA, 17 bp, H. sapiens
tgagatggagtctcgca

SEQ ID NO: 144571 - DNA, 16 bp, H. sapiens
tgagatggagtctcgt

SEQ ID NO: 144572 - DNA, 16 bp, H. sapiens
tgagatggagtctgtt

SEQ ID NO: 144573 - DNA, 16 bp, H. sapiens
tgagatggagtttcgc

SEQ ID NO: 144574 - DNA, 17 bp, H. sapiens
tgagatggatgaactga

SEQ ID NO: 144575 - DNA, 16 bp, H. sapiens
tgagatgggagaaaaa

SEQ ID NO: 144576 - DNA, 16 bp, H. sapiens
tgagatgggaggattt

SEQ ID NO: 144577 - DNA, 16 bp, H. sapiens
tgagatgggatttcac

SEQ ID NO: 144578 - DNA, 16 bp, H. sapiens
tgagatggggagattt

SEQ ID NO: 144579 - DNA, 16 bp, H. sapiens
tgagatggggtttcac

SEQ ID NO: 144580 - DNA, 20 bp, H. sapiens
tgagatggtatctcattgtg

SEQ ID NO: 144581 - DNA, 16 bp, H. sapiens
tgagatggtgacactg

SEQ ID NO: 144582 - DNA, 16 bp, H. sapiens
tgagatggtgtctctc

SEQ ID NO: 144583 - DNA, 16 bp, H. sapiens
tgagatgtggggagag

SEQ ID NO: 144584 - DNA, 16 bp, H. sapiens
tgagatgttatctcat

SEQ ID NO: 144585 - DNA, 17 bp, H. sapiens
tgagattacaggcgtgg

SEQ ID NO: 144586 - DNA, 16 bp, H. sapiens
tgagattatccagtct

SEQ ID NO: 144587 - DNA, 16 bp, H. sapiens
tgagattatttcaaaa

SEQ ID NO: 144588 - DNA, 16 bp, H. sapiens
tgagattcaagagaaa

SEQ ID NO: 144589 - DNA, 16 bp, H. sapiens
tgagattcatctgtgt

SEQ ID NO: 144590 - DNA, 16 bp, H. sapiens
tgagattcattcatgt

SEQ ID NO: 144591 - DNA, 16 bp, H. sapiens
tgagattccttatgaa

SEQ ID NO: 144592 - DNA, 16 bp, H. sapiens
tgagattctgccactg

SEQ ID NO: 144593 - DNA, 16 bp, H. sapiens
tgagattctgtctcta

SEQ ID NO: 144594 - DNA, 16 bp, H. sapiens
tgagattgagtctcac

SEQ ID NO: 144595 - DNA, 16 bp, H. sapiens
tgagattgcaccgctg

SEQ ID NO: 144596 - DNA, 16 bp, H. sapiens
tgagattgcagatgtg

SEQ ID NO: 144597 - DNA, 16 bp, H. sapiens
tgagattgctgagtca

SEQ ID NO: 144598 - DNA, 16 bp, H. sapiens
tgagattgtgttgaat

SEQ ID NO: 144599 - DNA, 16 bp, H. sapiens
tgagatttcagtgggg

SEQ ID NO: 144600 - DNA, 16 bp, H. sapiens
tgagatttgctttaaa

SEQ ID NO: 144601 - DNA, 16 bp, H. sapiens
tgagatttgggaacct

SEQ ID NO: 144602 - DNA, 16 bp, H. sapiens
tgagatttgggaggaa

SEQ ID NO: 144603 - DNA, 16 bp, H. sapiens
tgagatttgtccatgt

SEQ ID NO: 144604 - DNA, 16 bp, H. sapiens
tgagatttgtgtgggg

SEQ ID NO: 144605 - DNA, 16 bp, H. sapiens
tgagattttaaaaatt

SEQ ID NO: 144606 - DNA, 16 bp, H. sapiens
tgagattttagtgcac

SEQ ID NO: 144607 - DNA, 16 bp, H. sapiens
tgagattttggtgcac

SEQ ID NO: 144608 - DNA, 16 bp, H. sapiens
tgagattttggtgcat

SEQ ID NO: 144609 - DNA, 17 bp, H. sapiens
tgagcaaaactccatct

SEQ ID NO: 144610 - DNA, 16 bp, H. sapiens
tgagcaaaataaatta

SEQ ID NO: 144611 - DNA, 16 bp, H. sapiens
tgagcaaacagcaaac

SEQ ID NO: 144612 - DNA, 16 bp, H. sapiens
tgagcaaagacagcca

SEQ ID NO: 144613 - DNA, 16 bp, H. sapiens
tgagcaaagatctgaa

SEQ ID NO: 144614 - DNA, 16 bp, H. sapiens
tgagcaaagatttcat

SEQ ID NO: 144615 - DNA, 16 bp, H. sapiens
tgagcaaaggaatctg

SEQ ID NO: 144616 - DNA, 16 bp, H. sapiens
tgagcaaattccttaa

SEQ ID NO: 144617 - DNA, 16 bp, H. sapiens
tgagcaacagagtgag

SEQ ID NO: 144618 - DNA, 17 bp, H. sapiens
tgagcaacatggagaaa

SEQ ID NO: 144619 - DNA, 16 bp, H. sapiens
tgagcaactggaagga

SEQ ID NO: 144620 - DNA, 16 bp, H. sapiens
tgagcaactgtgcctg

SEQ ID NO: 144621 - DNA, 16 bp, H. sapiens
tgagcaagaaataaac

SEQ ID NO: 144622 - DNA, 16 bp, H. sapiens
tgagcaagactccgtc

SEQ ID NO: 144623 - DNA, 16 bp, H. sapiens
tgagcaaggtggctca

SEQ ID NO: 144624 - DNA, 16 bp, H. sapiens
tgagcaagtcatttca

SEQ ID NO: 144625 - DNA, 16 bp, H. sapiens
tgagcaagttatttaa

SEQ ID NO: 144626 - DNA, 16 bp, H. sapiens
tgagcaagttgcttaa

SEQ ID NO: 144627 - DNA, 16 bp, H. sapiens
tgagcacagggcctgg

SEQ ID NO: 144628 - DNA, 16 bp, H. sapiens
tgagcacatactgtgt

SEQ ID NO: 144629 - DNA, 16 bp, H. sapiens
tgagcacatgttgttg

SEQ ID NO: 144630 - DNA, 16 bp, H. sapiens
tgagcaccactgcact

SEQ ID NO: 144631 - DNA, 16 bp, H. sapiens
tgagcacccactatgt

SEQ ID NO: 144632 - DNA, 16 bp, H. sapiens
tgagcacctactatat

SEQ ID NO: 144633 - DNA, 16 bp, H. sapiens
tgagcacctactatgt

SEQ ID NO: 144634 - DNA, 16 bp, H. sapiens
tgagcacctactgtgt

SEQ ID NO: 144635 - DNA, 16 bp, H. sapiens
tgagcacctcctctgt

SEQ ID NO: 144636 - DNA, 16 bp, H. sapiens
tgagcacctgctatgt

SEQ ID NO: 144637 - DNA, 16 bp, H. sapiens
tgagcacctgctgtgt

SEQ ID NO: 144638 - DNA, 16 bp, H. sapiens
tgagcaccttttcata

SEQ ID NO: 144639 - DNA, 16 bp, H. sapiens
tgagcacttaccatgt

SEQ ID NO: 144640 - DNA, 16 bp, H. sapiens
tgagcacttattatgt

SEQ ID NO: 144641 - DNA, 16 bp, H. sapiens
tgagcacttgaaatgt

SEQ ID NO: 144642 - DNA, 16 bp, H. sapiens
tgagcactttttcata

SEQ ID NO: 144643 - DNA, 16 bp, H. sapiens
tgagcagaacgtgcag

SEQ ID NO: 144644 - DNA, 16 bp, H. sapiens
tgagcagagatggagc

SEQ ID NO: 144645 - DNA, 16 bp, H. sapiens
tgagcagagctgagcc

SEQ ID NO: 144646 - DNA, 16 bp, H. sapiens
tgagcagaggaagaag

SEQ ID NO: 144647 - DNA, 16 bp, H. sapiens
tgagcagaggagggac

SEQ ID NO: 144648 - DNA, 16 bp, H. sapiens
tgagcagaggcctgaa

SEQ ID NO: 144649 - DNA, 16 bp, H. sapiens
tgagcagcaaaataaa

SEQ ID NO: 144650 - DNA, 16 bp, H. sapiens
tgagcagcgtccctgg

SEQ ID NO: 144651 - DNA, 16 bp, H. sapiens
tgagcagggtaagggt

SEQ ID NO: 144652 - DNA, 16 bp, H. sapiens
tgagcaggtgcaggag

SEQ ID NO: 144653 - DNA, 16 bp, H. sapiens
tgagcatctacagatt

SEQ ID NO: 144654 - DNA, 16 bp, H. sapiens
tgagcatctcctatgt

SEQ ID NO: 144655 - DNA, 16 bp, H. sapiens
tgagcatctttccatg

SEQ ID NO: 144656 - DNA, 16 bp, H. sapiens
tgagcatcttttcaga

SEQ ID NO: 144657 - DNA, 16 bp, H. sapiens
tgagcatgagatgtct

SEQ ID NO: 144658 - DNA, 16 bp, H. sapiens
tgagcatgcacacaac

SEQ ID NO: 144659 - DNA, 16 bp, H. sapiens
tgagcatgccactgca

SEQ ID NO: 144660 - DNA, 16 bp, H. sapiens
tgagcatgtgtgtgag

SEQ ID NO: 144661 - DNA, 16 bp, H. sapiens
tgagcattaccgcctg

SEQ ID NO: 144662 - DNA, 16 bp, H. sapiens
tgagcattcatgtaca

SEQ ID NO: 144663 - DNA, 16 bp, H. sapiens
tgagcatttcctttga

SEQ ID NO: 144664 - DNA, 16 bp, H. sapiens
tgagcatttgaaatat

SEQ ID NO: 144665 - DNA, 17 bp, H. sapiens
tgagcattttttcatgt

SEQ ID NO: 144666 - DNA, 16 bp, H. sapiens
tgagcattttttcctg

SEQ ID NO: 144667 - DNA, 16 bp, H. sapiens
tgagccaaaagagctt

SEQ ID NO: 144668 - DNA, 16 bp, H. sapiens
tgagccaaagaaacct

SEQ ID NO: 144669 - DNA, 16 bp, H. sapiens
tgagccaagatcactg

SEQ ID NO: 144670 - DNA, 18 bp, H. sapiens
tgagccaagatcatgcca

SEQ ID NO: 144671 - DNA, 16 bp, H. sapiens
tgagccaagatgatgc

SEQ ID NO: 144672 - DNA, 19 bp, H. sapiens
tgagccaagatggtgccac

SEQ ID NO: 144673 - DNA, 16 bp, H. sapiens
tgagccaagattgcac

SEQ ID NO: 144674 - DNA, 16 bp, H. sapiens
tgagccaagattgggc

SEQ ID NO: 144675 - DNA, 19 bp, H. sapiens
tgagccaagattgtgccat

SEQ ID NO: 144676 - DNA, 16 bp, H. sapiens
tgagccaagcttgtgc

SEQ ID NO: 144677 - DNA, 17 bp, H. sapiens
tgagccaagttcgtgcc

SEQ ID NO: 144678 - DNA, 16 bp, H. sapiens
tgagccaattaaatgt

SEQ ID NO: 144679 - DNA, 16 bp, H. sapiens
tgagccacacacccag

SEQ ID NO: 144680 - DNA, 16 bp, H. sapiens
tgagccacagagccca

SEQ ID NO: 144681 - DNA, 16 bp, H. sapiens
tgagccacagtacctg

SEQ ID NO: 144682 - DNA, 16 bp, H. sapiens
tgagccacagtgccca

SEQ ID NO: 144683 - DNA, 16 bp, H. sapiens
tgagccaccaagcctg

SEQ ID NO: 144684 - DNA, 16 bp, H. sapiens
tgagccaccaagctgg

SEQ ID NO: 144685 - DNA, 16 bp, H. sapiens
tgagccaccacaccca

SEQ ID NO: 144686 - DNA, 16 bp, H. sapiens
tgagccaccacaccgg

SEQ ID NO: 144687 - DNA, 17 bp, H. sapiens
tgagccaccacacctga

SEQ ID NO: 144688 - DNA, 16 bp, H. sapiens
tgagccaccacagcca

SEQ ID NO: 144689 - DNA, 16 bp, H. sapiens
tgagccaccaccctgg

SEQ ID NO: 144690 - DNA, 16 bp, H. sapiens
tgagccaccacccttg

SEQ ID NO: 144691 - DNA, 16 bp, H. sapiens
tgagccaccacgcatg

SEQ ID NO: 144692 - DNA, 16 bp, H. sapiens
tgagccaccacgccct

SEQ ID NO: 144693 - DNA, 17 bp, H. sapiens
tgagccaccacgcctgt

SEQ ID NO: 144694 - DNA, 16 bp, H. sapiens
tgagccaccacgctgg

SEQ ID NO: 144695 - DNA, 16 bp, H. sapiens
tgagccaccatgccgg

SEQ ID NO: 144696 - DNA, 16 bp, H. sapiens
tgagccaccatgcctg

SEQ ID NO: 144697 - DNA, 16 bp, H. sapiens
tgagccacccagcctg

SEQ ID NO: 144698 - DNA, 16 bp, H. sapiens
tgagccaccgcaccgg

SEQ ID NO: 144699 - DNA, 16 bp, H. sapiens
tgagccaccgcacctg

SEQ ID NO: 144700 - DNA, 21 bp, H. sapiens
tgagccaccgcacctggccct

SEQ ID NO: 144701 - DNA, 20 bp, H. sapiens
tgagccaccgcacctggccg

SEQ ID NO: 144702 - DNA, 16 bp, H. sapiens
tgagccaccgcgcagg

SEQ ID NO: 144703 - DNA, 17 bp, H. sapiens
tgagccaccgcgcccag

SEQ ID NO: 144704 - DNA, 22 bp, H. sapiens
tgagccaccgcgcctggccaca

SEQ ID NO: 144705 - DNA, 16 bp, H. sapiens
tgagccaccgcgtctg

SEQ ID NO: 144706 - DNA, 16 bp, H. sapiens
tgagccaccgtgactg

SEQ ID NO: 144707 - DNA, 19 bp, H. sapiens
tgagccaccgtgcccagct

SEQ ID NO: 144708 - DNA, 20 bp, H. sapiens
tgagccaccgtgcctggcct

SEQ ID NO: 144709 - DNA, 21 bp, H. sapiens
tgagccaccgtgcctggctgg

SEQ ID NO: 144710 - DNA, 16 bp, H. sapiens
tgagccaccgtgtcct

SEQ ID NO: 144711 - DNA, 16 bp, H. sapiens
tgagccacctcacttg

SEQ ID NO: 144712 - DNA, 17 bp, H. sapiens
tgagccacctcgtctgg

SEQ ID NO: 144713 - DNA, 16 bp, H. sapiens
tgagccacgacaccca

SEQ ID NO: 144714 - DNA, 16 bp, H. sapiens
tgagccacgcgcctgg

SEQ ID NO: 144715 - DNA, 16 bp, H. sapiens
tgagccacggcacctg

SEQ ID NO: 144716 - DNA, 16 bp, H. sapiens
tgagccactatgcctg

SEQ ID NO: 144717 - DNA, 16 bp, H. sapiens
tgagccactcactgca

SEQ ID NO: 144718 - DNA, 16 bp, H. sapiens
tgagccactgagccct

SEQ ID NO: 144719 - DNA, 17 bp, H. sapiens
tgagccactgcacccaa

SEQ ID NO: 144720 - DNA, 16 bp, H. sapiens
tgagccactgcacctg

SEQ ID NO: 144721 - DNA, 16 bp, H. sapiens
tgagccactgcatccc

SEQ ID NO: 144722 - DNA, 16 bp, H. sapiens
tgagccactgcatctg

SEQ ID NO: 144723 - DNA, 16 bp, H. sapiens
tgagccactgcccccg

SEQ ID NO: 144724 - DNA, 16 bp, H. sapiens
tgagccactgcgccca

SEQ ID NO: 144725 - DNA, 17 bp, H. sapiens
tgagccactgcgcccaa

SEQ ID NO: 144726 - DNA, 17 bp, H. sapiens
tgagccactgcgcccag

SEQ ID NO: 144727 - DNA, 20 bp, H. sapiens
tgagccactgcgcccagcca

SEQ ID NO: 144728 - DNA, 22 bp, H. sapiens
tgagccactgcgcccggcctgc

SEQ ID NO: 144729 - DNA, 17 bp, H. sapiens
tgagccactgcgcctga

SEQ ID NO: 144730 - DNA, 19 bp, H. sapiens
tgagccactgcgcctggcc

SEQ ID NO: 144731 - DNA, 20 bp, H. sapiens
tgagccactgcgcctggcca

SEQ ID NO: 144732 - DNA, 21 bp, H. sapiens
tgagccactgcgcctggccga

SEQ ID NO: 144733 - DNA, 16 bp, H. sapiens
tgagccactgcggccg

SEQ ID NO: 144734 - DNA, 16 bp, H. sapiens
tgagccactgctccca

SEQ ID NO: 144735 - DNA, 16 bp, H. sapiens
tgagccactgggcctg

SEQ ID NO: 144736 - DNA, 16 bp, H. sapiens
tgagccactgtacctg

SEQ ID NO: 144737 - DNA, 16 bp, H. sapiens
tgagccactgtatcca

SEQ ID NO: 144738 - DNA, 16 bp, H. sapiens
tgagccactgtccccg

SEQ ID NO: 144739 - DNA, 16 bp, H. sapiens
tgagccactgtgccca

SEQ ID NO: 144740 - DNA, 18 bp, H. sapiens
tgagccactgtgcccagg

SEQ ID NO: 144741 - DNA, 16 bp, H. sapiens
tgagccactgtggccg

SEQ ID NO: 144742 - DNA, 16 bp, H. sapiens
tgagccactgttccca

SEQ ID NO: 144743 - DNA, 16 bp, H. sapiens
tgagccagacaaaggc

SEQ ID NO: 144744 - DNA, 16 bp, H. sapiens
tgagccagatgctgag

SEQ ID NO: 144745 - DNA, 16 bp, H. sapiens
tgagccagcagcagca

SEQ ID NO: 144746 - DNA, 16 bp, H. sapiens
tgagccagcatgccca

SEQ ID NO: 144747 - DNA, 16 bp, H. sapiens
tgagccagctccagca

SEQ ID NO: 144748 - DNA, 16 bp, H. sapiens
tgagccaggaagaaat

SEQ ID NO: 144749 - DNA, 16 bp, H. sapiens
tgagccaggagtttga

SEQ ID NO: 144750 - DNA, 16 bp, H. sapiens
tgagccaggcactgtg

SEQ ID NO: 144751 - DNA, 16 bp, H. sapiens
tgagccaggccctgtg

SEQ ID NO: 144752 - DNA, 16 bp, H. sapiens
tgagccaggctctgtg

SEQ ID NO: 144753 - DNA, 16 bp, H. sapiens
tgagccagggaggcgg

SEQ ID NO: 144754 - DNA, 16 bp, H. sapiens
tgagccaggtgtagtg

SEQ ID NO: 144755 - DNA, 16 bp, H. sapiens
tgagccaggtgtggtg

SEQ ID NO: 144756 - DNA, 16 bp, H. sapiens
tgagccatcacgcctg

SEQ ID NO: 144757 - DNA, 16 bp, H. sapiens
tgagccatcctgccca

SEQ ID NO: 144758 - DNA, 16 bp, H. sapiens
tgagccatcgcgcccg

SEQ ID NO: 144759 - DNA, 16 bp, H. sapiens
tgagccatcgcgcctg

SEQ ID NO: 144760 - DNA, 16 bp, H. sapiens
tgagccatgctaccag

SEQ ID NO: 144761 - DNA, 16 bp, H. sapiens
tgagccatggcacctg

SEQ ID NO: 144762 - DNA, 16 bp, H. sapiens
tgagcccaagagtctg

SEQ ID NO: 144763 - DNA, 16 bp, H. sapiens
tgagcccaagggtttg

SEQ ID NO: 144764 - DNA, 18 bp, H. sapiens
tgagcccagatcacgcca

SEQ ID NO: 144765 - DNA, 16 bp, H. sapiens
tgagcccagcaggtca

SEQ ID NO: 144766 - DNA, 16 bp, H. sapiens
tgagcccagcaggtcg

SEQ ID NO: 144767 - DNA, 16 bp, H. sapiens
tgagcccagccaagat

SEQ ID NO: 144768 - DNA, 16 bp, H. sapiens
tgagcccagccaggag

SEQ ID NO: 144769 - DNA, 16 bp, H. sapiens
tgagcccaggaagcgg

SEQ ID NO: 144770 - DNA, 16 bp, H. sapiens
tgagcccaggagcttg

SEQ ID NO: 144771 - DNA, 16 bp, H. sapiens
tgagcccaggaggaca

SEQ ID NO: 144772 - DNA, 17 bp, H. sapiens
tgagcccaggagttcaa

SEQ ID NO: 144773 - DNA, 16 bp, H. sapiens
tgagcccaggttgagg

SEQ ID NO: 144774 - DNA, 16 bp, H. sapiens
tgagcccagtttgaga

SEQ ID NO: 144775 - DNA, 16 bp, H. sapiens
tgagccccacctcctg

SEQ ID NO: 144776 - DNA, 16 bp, H. sapiens
tgagccccagctctgc

SEQ ID NO: 144777 - DNA, 16 bp, H. sapiens
tgagccccagttttct

SEQ ID NO: 144778 - DNA, 16 bp, H. sapiens
tgagccccatgcccag

SEQ ID NO: 144779 - DNA, 16 bp, H. sapiens
tgagcccccatgcctg

SEQ ID NO: 144780 - DNA, 17 bp, H. sapiens
tgagccccggaggcaga

SEQ ID NO: 144781 - DNA, 16 bp, H. sapiens
tgagccccggaggtgg

SEQ ID NO: 144782 - DNA, 16 bp, H. sapiens
tgagcccctgcctcac

SEQ ID NO: 144783 - DNA, 16 bp, H. sapiens
tgagcccctgcgcctg

SEQ ID NO: 144784 - DNA, 16 bp, H. sapiens
tgagccctcaccctgg

SEQ ID NO: 144785 - DNA, 16 bp, H. sapiens
tgagccctcagcctgt

SEQ ID NO: 144786 - DNA, 16 bp, H. sapiens
tgagccgagactgagc

SEQ ID NO: 144787 - DNA, 16 bp, H. sapiens
tgagccgagatcacca

SEQ ID NO: 144788 - DNA, 19 bp, H. sapiens
tgagccgagatcatgccac

SEQ ID NO: 144789 - DNA, 25 bp, H. sapiens
tgagccgagattgcaccattgcact

SEQ ID NO: 144790 - DNA, 16 bp, H. sapiens
tgagccgagattgccc

SEQ ID NO: 144791 - DNA, 16 bp, H. sapiens
tgagccgaggttgtgc

SEQ ID NO: 144792 - DNA, 16 bp, H. sapiens
tgagccgccatgcctg

SEQ ID NO: 144793 - DNA, 16 bp, H. sapiens
tgagccgcccgcctcg

SEQ ID NO: 144794 - DNA, 18 bp, H. sapiens
tgagccgccgtgcccagc

SEQ ID NO: 144795 - DNA, 16 bp, H. sapiens
tgagccgctgcacctg

SEQ ID NO: 144796 - DNA, 18 bp, H. sapiens
tgagcctagatcacgcca

SEQ ID NO: 144797 - DNA, 17 bp, H. sapiens
tgagcctaggagttcaa

SEQ ID NO: 144798 - DNA, 16 bp, H. sapiens
tgagcctatggatgtc

SEQ ID NO: 144799 - DNA, 16 bp, H. sapiens
tgagcctatgtatgtc

SEQ ID NO: 144800 - DNA, 16 bp, H. sapiens
tgagcctatgtgtgtt

SEQ ID NO: 144801 - DNA, 18 bp, H. sapiens
tgagcctcagtttcctca

SEQ ID NO: 144802 - DNA, 16 bp, H. sapiens
tgagcctccagaactg

SEQ ID NO: 144803 - DNA, 16 bp, H. sapiens
tgagcctccatctcct

SEQ ID NO: 144804 - DNA, 16 bp, H. sapiens
tgagcctccatgcctg

SEQ ID NO: 144805 - DNA, 16 bp, H. sapiens
tgagcctccatttctt

SEQ ID NO: 144806 - DNA, 16 bp, H. sapiens
tgagcctctgtttctt

SEQ ID NO: 144807 - DNA, 16 bp, H. sapiens
tgagcctgaggaggtc

SEQ ID NO: 144808 - DNA, 16 bp, H. sapiens
tgagcctgggaagcag

SEQ ID NO: 144809 - DNA, 16 bp, H. sapiens
tgagcctgggaagcgg

SEQ ID NO: 144810 - DNA, 16 bp, H. sapiens
tgagcctgggagatga

SEQ ID NO: 144811 - DNA, 16 bp, H. sapiens
tgagcctgggaggagg

SEQ ID NO: 144812 - DNA, 16 bp, H. sapiens
tgagcctgggaggcca

SEQ ID NO: 144813 - DNA, 16 bp, H. sapiens
tgagcctgggaggcgg

SEQ ID NO: 144814 - DNA, 16 bp, H. sapiens
tgagcctgggagggtg

SEQ ID NO: 144815 - DNA, 21 bp, H. sapiens
tgagcctgggaggtcgaggct

SEQ ID NO: 144816 - DNA, 16 bp, H. sapiens
tgagcctgggcagtca

SEQ ID NO: 144817 - DNA, 16 bp, H. sapiens
tgagcctggggaggtc

SEQ ID NO: 144818 - DNA, 16 bp, H. sapiens
tgagcctgtgaggttg

SEQ ID NO: 144819 - DNA, 16 bp, H. sapiens
tgagcctgtgagtgca

SEQ ID NO: 144820 - DNA, 16 bp, H. sapiens
tgagcctgtgtgtgtc

SEQ ID NO: 144821 - DNA, 16 bp, H. sapiens
tgagcctgttgatgcc

SEQ ID NO: 144822 - DNA, 16 bp, H. sapiens
tgagccttgaagacat

SEQ ID NO: 144823 - DNA, 16 bp, H. sapiens
tgagcctttgctgaag

SEQ ID NO: 144824 - DNA, 16 bp, H. sapiens
tgagcgacacagaaga

SEQ ID NO: 144825 - DNA, 16 bp, H. sapiens
tgagcgacgcagaaga

SEQ ID NO: 144826 - DNA, 18 bp, H. sapiens
tgagcggagatggtgcca

SEQ ID NO: 144827 - DNA, 16 bp, H. sapiens
tgagctaaagaaaaaa

SEQ ID NO: 144828 - DNA, 16 bp, H. sapiens
tgagctacaagagaac

SEQ ID NO: 144829 - DNA, 16 bp, H. sapiens
tgagctaccacgccta

SEQ ID NO: 144830 - DNA, 16 bp, H. sapiens
tgagctaccatgtcca

SEQ ID NO: 144831 - DNA, 16 bp, H. sapiens
tgagctaccgcgcctg

SEQ ID NO: 144832 - DNA, 16 bp, H. sapiens
tgagctactgagcctg

SEQ ID NO: 144833 - DNA, 16 bp, H. sapiens
tgagctactgcgcccg

SEQ ID NO: 144834 - DNA, 16 bp, H. sapiens
tgagctactgtgccca

SEQ ID NO: 144835 - DNA, 16 bp, H. sapiens
tgagctactgtgcctg

SEQ ID NO: 144836 - DNA, 16 bp, H. sapiens
tgagctatcacaccca

SEQ ID NO: 144837 - DNA, 16 bp, H. sapiens
tgagctatcacctcac

SEQ ID NO: 144838 - DNA, 16 bp, H. sapiens
tgagctatgataacac

SEQ ID NO: 144839 - DNA, 16 bp, H. sapiens
tgagctatgataatgc

SEQ ID NO: 144840 - DNA, 16 bp, H. sapiens
tgagctatgatggcac

SEQ ID NO: 144841 - DNA, 16 bp, H. sapiens
tgagctcaagagttcg

SEQ ID NO: 144842 - DNA, 16 bp, H. sapiens
tgagctcaagagttgg

SEQ ID NO: 144843 - DNA, 16 bp, H. sapiens
tgagctcaagggattc

SEQ ID NO: 144844 - DNA, 16 bp, H. sapiens
tgagctcaagtggtcc

SEQ ID NO: 144845 - DNA, 16 bp, H. sapiens
tgagctcacaccactg

SEQ ID NO: 144846 - DNA, 16 bp, H. sapiens
tgagctcagctcactg

SEQ ID NO: 144847 - DNA, 16 bp, H. sapiens
tgagctcaggagatgg

SEQ ID NO: 144848 - DNA, 16 bp, H. sapiens
tgagctcaggagtgag

SEQ ID NO: 144849 - DNA, 16 bp, H. sapiens
tgagctcaggagttcg

SEQ ID NO: 144850 - DNA, 17 bp, H. sapiens
tgagctcaggagtttga

SEQ ID NO: 144851 - DNA, 18 bp, H. sapiens
tgagctcaggagtttgaa

SEQ ID NO: 144852 - DNA, 16 bp, H. sapiens
tgagctcatgatccac

SEQ ID NO: 144853 - DNA, 16 bp, H. sapiens
tgagctccaccttctc

SEQ ID NO: 144854 - DNA, 16 bp, H. sapiens
tgagctccctgctcag

SEQ ID NO: 144855 - DNA, 16 bp, H. sapiens
tgagctcctgaccttg

SEQ ID NO: 144856 - DNA, 16 bp, H. sapiens
tgagctcctggactca

SEQ ID NO: 144857 - DNA, 16 bp, H. sapiens
tgagctctcaaatgtc

SEQ ID NO: 144858 - DNA, 16 bp, H. sapiens
tgagctctgctgtccc

SEQ ID NO: 144859 - DNA, 16 bp, H. sapiens
tgagctgaaattgtac

SEQ ID NO: 144860 - DNA, 16 bp, H. sapiens
tgagctgaagcagggc

SEQ ID NO: 144861 - DNA, 16 bp, H. sapiens
tgagctgaagcagggt

SEQ ID NO: 144862 - DNA, 16 bp, H. sapiens
tgagctgaagccacag

SEQ ID NO: 144863 - DNA, 16 bp, H. sapiens
tgagctgaagtgatcc

SEQ ID NO: 144864 - DNA, 16 bp, H. sapiens
tgagctgagacttgaa

SEQ ID NO: 144865 - DNA, 16 bp, H. sapiens
tgagctgagatggaac

SEQ ID NO: 144866 - DNA, 16 bp, H. sapiens
tgagctgagatggttc

SEQ ID NO: 144867 - DNA, 16 bp, H. sapiens
tgagctgaggagtttg

SEQ ID NO: 144868 - DNA, 16 bp, H. sapiens
tgagctgaggctggag

SEQ ID NO: 144869 - DNA, 17 bp, H. sapiens
tgagctgaggtcatgcc

SEQ ID NO: 144870 - DNA, 18 bp, H. sapiens
tgagctgagttcgtgcca

SEQ ID NO: 144871 - DNA, 16 bp, H. sapiens
tgagctgatggagctg

SEQ ID NO: 144872 - DNA, 16 bp, H. sapiens
tgagctgcagctggag

SEQ ID NO: 144873 - DNA, 16 bp, H. sapiens
tgagctgcattcccag

SEQ ID NO: 144874 - DNA, 16 bp, H. sapiens
tgagctgcccaaggcc

SEQ ID NO: 144875 - DNA, 16 bp, H. sapiens
tgagctgcccaccttg

SEQ ID NO: 144876 - DNA, 16 bp, H. sapiens
tgagctgcctgcctca

SEQ ID NO: 144877 - DNA, 16 bp, H. sapiens
tgagctgcctggagct

SEQ ID NO: 144878 - DNA, 16 bp, H. sapiens
tgagctgctgagatgg

SEQ ID NO: 144879 - DNA, 16 bp, H. sapiens
tgagctggcagaagaa

SEQ ID NO: 144880 - DNA, 16 bp, H. sapiens
tgagctgggaaaggca

SEQ ID NO: 144881 - DNA, 16 bp, H. sapiens
tgagctgggctgggct

SEQ ID NO: 144882 - DNA, 16 bp, H. sapiens
tgagctgggctttgaa

SEQ ID NO: 144883 - DNA, 16 bp, H. sapiens
tgagctggggaggtgg

SEQ ID NO: 144884 - DNA, 16 bp, H. sapiens
tgagctggttattttg

SEQ ID NO: 144885 - DNA, 17 bp, H. sapiens
tgagctggttttttgaa

SEQ ID NO: 144886 - DNA, 16 bp, H. sapiens
tgagctgtacctgggc

SEQ ID NO: 144887 - DNA, 16 bp, H. sapiens
tgagctgtgattgcat

SEQ ID NO: 144888 - DNA, 16 bp, H. sapiens
tgagcttaaaaaaaaa

SEQ ID NO: 144889 - DNA, 16 bp, H. sapiens
tgagcttaagaatttt

SEQ ID NO: 144890 - DNA, 16 bp, H. sapiens
tgagcttcagtttcct

SEQ ID NO: 144891 - DNA, 16 bp, H. sapiens
tgagcttctgggctca

SEQ ID NO: 144892 - DNA, 16 bp, H. sapiens
tgagcttctgtttcct

SEQ ID NO: 144893 - DNA, 16 bp, H. sapiens
tgagcttgaaggcagg

SEQ ID NO: 144894 - DNA, 16 bp, H. sapiens
tgagcttggaagcaga

SEQ ID NO: 144895 - DNA, 22 bp, H. sapiens
tgagctttcttcttggacacct

SEQ ID NO: 144896 - DNA, 16 bp, H. sapiens
tgagctttgggagcct

SEQ ID NO: 144897 - DNA, 16 bp, H. sapiens
tgagcttttaaaattt

SEQ ID NO: 144898 - DNA, 16 bp, H. sapiens
tgagcttttaaatgtt

SEQ ID NO: 144899 - DNA, 16 bp, H. sapiens
tgagcttttccaatgg

SEQ ID NO: 144900 - DNA, 16 bp, H. sapiens
tgagcttttctttgct

SEQ ID NO: 144901 - DNA, 16 bp, H. sapiens
tgagctttttttcata

SEQ ID NO: 144902 - DNA, 17 bp, H. sapiens
tgagctttttttcatgt

SEQ ID NO: 144903 - DNA, 16 bp, H. sapiens
tgaggaaaaacaaaga

SEQ ID NO: 144904 - DNA, 16 bp, H. sapiens
tgaggaaaaagaacaa

SEQ ID NO: 144905 - DNA, 16 bp, H. sapiens
tgaggaaaactataaa

SEQ ID NO: 144906 - DNA, 16 bp, H. sapiens
tgaggaaaatgttttg

SEQ ID NO: 144907 - DNA, 16 bp, H. sapiens
tgaggaaacagacaaa

SEQ ID NO: 144908 - DNA, 16 bp, H. sapiens
tgaggaaacagagact

SEQ ID NO: 144909 - DNA, 16 bp, H. sapiens
tgaggaaacagaggct

SEQ ID NO: 144910 - DNA, 16 bp, H. sapiens
tgaggaaaccaaggca

SEQ ID NO: 144911 - DNA, 16 bp, H. sapiens
tgaggaaaccagggct

SEQ ID NO: 144912 - DNA, 16 bp, H. sapiens
tgaggaaaccgaggca

SEQ ID NO: 144913 - DNA, 16 bp, H. sapiens
tgaggaaactccaaac

SEQ ID NO: 144914 - DNA, 16 bp, H. sapiens
tgaggaaactgaaaca

SEQ ID NO: 144915 - DNA, 16 bp, H. sapiens
tgaggaaactgaagaa

SEQ ID NO: 144916 - DNA, 16 bp, H. sapiens
tgaggaaactgaagcc

SEQ ID NO: 144917 - DNA, 16 bp, H. sapiens
tgaggaaactgagagg

SEQ ID NO: 144918 - DNA, 16 bp, H. sapiens
tgaggaaactgaggaa

SEQ ID NO: 144919 - DNA, 16 bp, H. sapiens
tgaggaaactgaggac

SEQ ID NO: 144920 - DNA, 16 bp, H. sapiens
tgaggaaactgtggct

SEQ ID NO: 144921 - DNA, 16 bp, H. sapiens
tgaggaaagaaaacaa

SEQ ID NO: 144922 - DNA, 16 bp, H. sapiens
tgaggaaagaaattga

SEQ ID NO: 144923 - DNA, 16 bp, H. sapiens
tgaggaaagtgaggca

SEQ ID NO: 144924 - DNA, 16 bp, H. sapiens
tgaggaaatcacagac

SEQ ID NO: 144925 - DNA, 16 bp, H. sapiens
tgaggaaatgaatttt

SEQ ID NO: 144926 - DNA, 16 bp, H. sapiens
tgaggaaatgacattt

SEQ ID NO: 144927 - DNA, 16 bp, H. sapiens
tgaggaaatgatggga

SEQ ID NO: 144928 - DNA, 16 bp, H. sapiens
tgaggaaatgcaaaga

SEQ ID NO: 144929 - DNA, 16 bp, H. sapiens
tgaggaaatggagaaa

SEQ ID NO: 144930 - DNA, 16 bp, H. sapiens
tgaggaaattgaagcc

SEQ ID NO: 144931 - DNA, 16 bp, H. sapiens
tgaggaacagaaggaa

SEQ ID NO: 144932 - DNA, 16 bp, H. sapiens
tgaggaagaagacaat

SEQ ID NO: 144933 - DNA, 16 bp, H. sapiens
tgaggaagaagcagaa

SEQ ID NO: 144934 - DNA, 16 bp, H. sapiens
tgaggaagaccatgaa

SEQ ID NO: 144935 - DNA, 16 bp, H. sapiens
tgaggaagagagaaat

SEQ ID NO: 144936 - DNA, 16 bp, H. sapiens
tgaggaagccacagaa

SEQ ID NO: 144937 - DNA, 16 bp, H. sapiens
tgaggaagctgaagct

SEQ ID NO: 144938 - DNA, 16 bp, H. sapiens
tgaggaagctgaggtt

SEQ ID NO: 144939 - DNA, 16 bp, H. sapiens
tgaggaagctgcagaa

SEQ ID NO: 144940 - DNA, 16 bp, H. sapiens
tgaggaagctgtagaa

SEQ ID NO: 144941 - DNA, 16 bp, H. sapiens
tgaggaaggggtccag

SEQ ID NO: 144942 - DNA, 16 bp, H. sapiens
tgaggaagtgacactt

SEQ ID NO: 144943 - DNA, 16 bp, H. sapiens
tgaggaagtggagaaa

SEQ ID NO: 144944 - DNA, 16 bp, H. sapiens
tgaggaataaaagact

SEQ ID NO: 144945 - DNA, 16 bp, H. sapiens
tgaggaatcgccacac

SEQ ID NO: 144946 - DNA, 16 bp, H. sapiens
tgaggaatctaaaata

SEQ ID NO: 144947 - DNA, 17 bp, H. sapiens
tgaggaatgtgttgcct

SEQ ID NO: 144948 - DNA, 16 bp, H. sapiens
tgaggaatttgaggct

SEQ ID NO: 144949 - DNA, 16 bp, H. sapiens
tgaggacaaacctctg

SEQ ID NO: 144950 - DNA, 16 bp, H. sapiens
tgaggacacagacaca

SEQ ID NO: 144951 - DNA, 16 bp, H. sapiens
tgaggacacagagaaa

SEQ ID NO: 144952 - DNA, 16 bp, H. sapiens
tgaggacacagagaag

SEQ ID NO: 144953 - DNA, 16 bp, H. sapiens
tgaggacacagagcca

SEQ ID NO: 144954 - DNA, 16 bp, H. sapiens
tgaggacacagtgttt

SEQ ID NO: 144955 - DNA, 16 bp, H. sapiens
tgaggacactgagttt

SEQ ID NO: 144956 - DNA, 16 bp, H. sapiens
tgaggacagcaccaaa

SEQ ID NO: 144957 - DNA, 16 bp, H. sapiens
tgaggacagcaccaag

SEQ ID NO: 144958 - DNA, 16 bp, H. sapiens
tgaggacagcatcaag

SEQ ID NO: 144959 - DNA, 16 bp, H. sapiens
tgaggacagcctggcc

SEQ ID NO: 144960 - DNA, 16 bp, H. sapiens
tgaggacaggagtttg

SEQ ID NO: 144961 - DNA, 16 bp, H. sapiens
tgaggacagggacttt

SEQ ID NO: 144962 - DNA, 16 bp, H. sapiens
tgaggacattgaggct

SEQ ID NO: 144963 - DNA, 16 bp, H. sapiens
tgaggacgtggagaaa

SEQ ID NO: 144964 - DNA, 16 bp, H. sapiens
tgaggactctgaaaag

SEQ ID NO: 144965 - DNA, 16 bp, H. sapiens
tgaggactctgtgtgg

SEQ ID NO: 144966 - DNA, 16 bp, H. sapiens
tgaggactgagccctg

SEQ ID NO: 144967 - DNA, 16 bp, H. sapiens
tgaggactggagagag

SEQ ID NO: 144968 - DNA, 16 bp, H. sapiens
tgaggagaaatccaag

SEQ ID NO: 144969 - DNA, 16 bp, H. sapiens
tgaggagaatgtatat

SEQ ID NO: 144970 - DNA, 16 bp, H. sapiens
tgaggagactgaggtt

SEQ ID NO: 144971 - DNA, 16 bp, H. sapiens
tgaggagatcacagtg

SEQ ID NO: 144972 - DNA, 16 bp, H. sapiens
tgaggagatgacattt

SEQ ID NO: 144973 - DNA, 16 bp, H. sapiens
tgaggagatggatatg

SEQ ID NO: 144974 - DNA, 16 bp, H. sapiens
tgaggagatgggagat

SEQ ID NO: 144975 - DNA, 16 bp, H. sapiens
tgaggagcaagaagag

SEQ ID NO: 144976 - DNA, 16 bp, H. sapiens
tgaggagctctgtgcc

SEQ ID NO: 144977 - DNA, 16 bp, H. sapiens
tgaggagctgccagac

SEQ ID NO: 144978 - DNA, 16 bp, H. sapiens
tgaggaggaaggactc

SEQ ID NO: 144979 - DNA, 16 bp, H. sapiens
tgaggaggaggaactc

SEQ ID NO: 144980 - DNA, 16 bp, H. sapiens
tgaggaggagggactc

SEQ ID NO: 144981 - DNA, 16 bp, H. sapiens
tgaggaggatgaagac

SEQ ID NO: 144982 - DNA, 16 bp, H. sapiens
tgaggaggcaagaatc

SEQ ID NO: 144983 - DNA, 16 bp, H. sapiens
tgaggaggcagcctgt

SEQ ID NO: 144984 - DNA, 17 bp, H. sapiens
tgaggaggcctcacaat

SEQ ID NO: 144985 - DNA, 16 bp, H. sapiens
tgaggaggctgcagaa

SEQ ID NO: 144986 - DNA, 16 bp, H. sapiens
tgaggagggagaactg

SEQ ID NO: 144987 - DNA, 16 bp, H. sapiens
tgaggagggcaccaag

SEQ ID NO: 144988 - DNA, 16 bp, H. sapiens
tgaggagtaaatgaga

SEQ ID NO: 144989 - DNA, 17 bp, H. sapiens
tgaggagtgcgggtgca

SEQ ID NO: 144990 - DNA, 16 bp, H. sapiens
tgaggagtgtgggcac

SEQ ID NO: 144991 - DNA, 16 bp, H. sapiens
tgaggagttcaaaacc

SEQ ID NO: 144992 - DNA, 16 bp, H. sapiens
tgaggagtttgagatc

SEQ ID NO: 144993 - DNA, 16 bp, H. sapiens
tgaggatacagtgaga

SEQ ID NO: 144994 - DNA, 16 bp, H. sapiens
tgaggatcaaatgaaa

SEQ ID NO: 144995 - DNA, 16 bp, H. sapiens
tgaggatcagagagga

SEQ ID NO: 144996 - DNA, 16 bp, H. sapiens
tgaggatgaaatgaaa

SEQ ID NO: 144997 - DNA, 16 bp, H. sapiens
tgaggatgaaatgaga

SEQ ID NO: 144998 - DNA, 16 bp, H. sapiens
tgaggatgatgatgat

SEQ ID NO: 144999 - DNA, 16 bp, H. sapiens
tgaggatgatgatttc

SEQ ID NO: 145000 - DNA, 16 bp, H. sapiens
tgaggatgatggcttc

SEQ ID NO: 145001 - DNA, 16 bp, H. sapiens
tgaggatgcaaagaca

SEQ ID NO: 145002 - DNA, 16 bp, H. sapiens
tgaggatgcagagaga

SEQ ID NO: 145003 - DNA, 16 bp, H. sapiens
tgaggatggagagaag

SEQ ID NO: 145004 - DNA, 16 bp, H. sapiens
tgaggatgtagagaaa

SEQ ID NO: 145005 - DNA, 16 bp, H. sapiens
tgaggatgtgaggaaa

SEQ ID NO: 145006 - DNA, 16 bp, H. sapiens
tgaggatgtggacaaa

SEQ ID NO: 145007 - DNA, 16 bp, H. sapiens
tgaggatgtggagaaa

SEQ ID NO: 145008 - DNA, 16 bp, H. sapiens
tgaggatgtggagcag

SEQ ID NO: 145009 - DNA, 16 bp, H. sapiens
tgaggatgttgccaaa

SEQ ID NO: 145010 - DNA, 16 bp, H. sapiens
tgaggattaaaataaa

SEQ ID NO: 145011 - DNA, 16 bp, H. sapiens
tgaggatttttgcagc

SEQ ID NO: 145012 - DNA, 16 bp, H. sapiens
tgaggattttttttct

SEQ ID NO: 145013 - DNA, 16 bp, H. sapiens
tgaggcaaaaggattg

SEQ ID NO: 145014 - DNA, 16 bp, H. sapiens
tgaggcaagagaaaca

SEQ ID NO: 145015 - DNA, 16 bp, H. sapiens
tgaggcagaagacttg

SEQ ID NO: 145016 - DNA, 16 bp, H. sapiens
tgaggcagaaggatgg

SEQ ID NO: 145017 - DNA, 16 bp, H. sapiens
tgaggcagagaattgt

SEQ ID NO: 145018 - DNA, 16 bp, H. sapiens
tgaggcagcagcctgg

SEQ ID NO: 145019 - DNA, 16 bp, H. sapiens
tgaggcagcaggaggg

SEQ ID NO: 145020 - DNA, 16 bp, H. sapiens
tgaggcagcttctaag

SEQ ID NO: 145021 - DNA, 16 bp, H. sapiens
tgaggcaggaacatca

SEQ ID NO: 145022 - DNA, 16 bp, H. sapiens
tgaggcaggagcactg

SEQ ID NO: 145023 - DNA, 16 bp, H. sapiens
tgaggcaggagcccag

SEQ ID NO: 145024 - DNA, 16 bp, H. sapiens
tgaggcaggaggaaca

SEQ ID NO: 145025 - DNA, 16 bp, H. sapiens
tgaggcaggaggacca

SEQ ID NO: 145026 - DNA, 16 bp, H. sapiens
tgaggcaggaggacct

SEQ ID NO: 145027 - DNA, 16 bp, H. sapiens
tgaggcaggagggctg

SEQ ID NO: 145028 - DNA, 16 bp, H. sapiens
tgaggcaggcagaagg

SEQ ID NO: 145029 - DNA, 18 bp, H. sapiens
tgaggcaggcggatcact

SEQ ID NO: 145030 - DNA, 16 bp, H. sapiens
tgaggcagggagaatg

SEQ ID NO: 145031 - DNA, 16 bp, H. sapiens
tgaggcaggtagattg

SEQ ID NO: 145032 - DNA, 16 bp, H. sapiens
tgaggcatccccagcc

SEQ ID NO: 145033 - DNA, 16 bp, H. sapiens
tgaggcatgaggatcc

SEQ ID NO: 145034 - DNA, 16 bp, H. sapiens
tgaggcatgcaaagaa

SEQ ID NO: 145035 - DNA, 16 bp, H. sapiens
tgaggccacacagcta

SEQ ID NO: 145036 - DNA, 16 bp, H. sapiens
tgaggccaccctggcc

SEQ ID NO: 145037 - DNA, 16 bp, H. sapiens
tgaggccagcagtggc

SEQ ID NO: 145038 - DNA, 16 bp, H. sapiens
tgaggccagcatcaac

SEQ ID NO: 145039 - DNA, 16 bp, H. sapiens
tgaggccagcctggga

SEQ ID NO: 145040 - DNA, 16 bp, H. sapiens
tgaggccaggaattgg

SEQ ID NO: 145041 - DNA, 16 bp, H. sapiens
tgaggccaggagctcc

SEQ ID NO: 145042 - DNA, 16 bp, H. sapiens
tgaggccagtggtgaa

SEQ ID NO: 145043 - DNA, 16 bp, H. sapiens
tgaggccatgagggtg

SEQ ID NO: 145044 - DNA, 16 bp, H. sapiens
tgaggcccacaaggaa

SEQ ID NO: 145045 - DNA, 16 bp, H. sapiens
tgaggcccagagagat

SEQ ID NO: 145046 - DNA, 16 bp, H. sapiens
tgaggcccagagagcc

SEQ ID NO: 145047 - DNA, 16 bp, H. sapiens
tgaggcccagagaggc

SEQ ID NO: 145048 - DNA, 16 bp, H. sapiens
tgaggcccagagaggt

SEQ ID NO: 145049 - DNA, 16 bp, H. sapiens
tgaggcccagagttca

SEQ ID NO: 145050 - DNA, 16 bp, H. sapiens
tgaggcccagcaagaa

SEQ ID NO: 145051 - DNA, 16 bp, H. sapiens
tgaggcccagggagag

SEQ ID NO: 145052 - DNA, 16 bp, H. sapiens
tgaggcccagggaggt

SEQ ID NO: 145053 - DNA, 16 bp, H. sapiens
tgaggccccaccctca

SEQ ID NO: 145054 - DNA, 16 bp, H. sapiens
tgaggccccccagcca

SEQ ID NO: 145055 - DNA, 16 bp, H. sapiens
tgaggccctcaccaga

SEQ ID NO: 145056 - DNA, 16 bp, H. sapiens
tgaggccctgggcctg

SEQ ID NO: 145057 - DNA, 16 bp, H. sapiens
tgaggccgggcacagt

SEQ ID NO: 145058 - DNA, 16 bp, H. sapiens
tgaggccgggcatggt

SEQ ID NO: 145059 - DNA, 16 bp, H. sapiens
tgaggcctaaggtgaa

SEQ ID NO: 145060 - DNA, 16 bp, H. sapiens
tgaggcctatgctgaa

SEQ ID NO: 145061 - DNA, 16 bp, H. sapiens
tgaggcctcagggagc

SEQ ID NO: 145062 - DNA, 16 bp, H. sapiens
tgaggcctccacagcc

SEQ ID NO: 145063 - DNA, 16 bp, H. sapiens
tgaggcctcccagaag

SEQ ID NO: 145064 - DNA, 16 bp, H. sapiens
tgaggcctcccagtca

SEQ ID NO: 145065 - DNA, 16 bp, H. sapiens
tgaggcctccccagcc

SEQ ID NO: 145066 - DNA, 16 bp, H. sapiens
tgaggcctcccccgcc

SEQ ID NO: 145067 - DNA, 16 bp, H. sapiens
tgaggcctccctagcc

SEQ ID NO: 145068 - DNA, 16 bp, H. sapiens
tgaggcctcctcagtc

SEQ ID NO: 145069 - DNA, 16 bp, H. sapiens
tgaggcctctcaagcc

SEQ ID NO: 145070 - DNA, 16 bp, H. sapiens
tgaggcctctcttctg

SEQ ID NO: 145071 - DNA, 16 bp, H. sapiens
tgaggcctgagaatcg

SEQ ID NO: 145072 - DNA, 16 bp, H. sapiens
tgaggcctgggcaggg

SEQ ID NO: 145073 - DNA, 16 bp, H. sapiens
tgaggcctgtggctgc

SEQ ID NO: 145074 - DNA, 16 bp, H. sapiens
tgaggcctgtggtgga

SEQ ID NO: 145075 - DNA, 16 bp, H. sapiens
tgaggccttcaactga

SEQ ID NO: 145076 - DNA, 16 bp, H. sapiens
tgaggccttctcagcc

SEQ ID NO: 145077 - DNA, 16 bp, H. sapiens
tgaggcctttctcctt

SEQ ID NO: 145078 - DNA, 16 bp, H. sapiens
tgaggcctttgttgga

SEQ ID NO: 145079 - DNA, 16 bp, H. sapiens
tgaggcgggaagggga

SEQ ID NO: 145080 - DNA, 16 bp, H. sapiens
tgaggcgggaggatcg

SEQ ID NO: 145081 - DNA, 16 bp, H. sapiens
tgaggcgggcagctca

SEQ ID NO: 145082 - DNA, 16 bp, H. sapiens
tgaggcgggcggatcg

SEQ ID NO: 145083 - DNA, 16 bp, H. sapiens
tgaggctaggagttcg

SEQ ID NO: 145084 - DNA, 16 bp, H. sapiens
tgaggctcagaaaagg

SEQ ID NO: 145085 - DNA, 16 bp, H. sapiens
tgaggctcagagaact

SEQ ID NO: 145086 - DNA, 16 bp, H. sapiens
tgaggctcagagaagt

SEQ ID NO: 145087 - DNA, 16 bp, H. sapiens
tgaggctcagagactg

SEQ ID NO: 145088 - DNA, 16 bp, H. sapiens
tgaggctcagagagct

SEQ ID NO: 145089 - DNA, 16 bp, H. sapiens
tgaggctcagagaggc

SEQ ID NO: 145090 - DNA, 16 bp, H. sapiens
tgaggctcagagaggg

SEQ ID NO: 145091 - DNA, 16 bp, H. sapiens
tgaggctcagagatgc

SEQ ID NO: 145092 - DNA, 16 bp, H. sapiens
tgaggctcagggaagt

SEQ ID NO: 145093 - DNA, 16 bp, H. sapiens
tgaggctcagggagag

SEQ ID NO: 145094 - DNA, 16 bp, H. sapiens
tgaggctccacctcag

SEQ ID NO: 145095 - DNA, 16 bp, H. sapiens
tgaggctccagaggaa

SEQ ID NO: 145096 - DNA, 16 bp, H. sapiens
tgaggctccccagcca

SEQ ID NO: 145097 - DNA, 16 bp, H. sapiens
tgaggctgagcccagg

SEQ ID NO: 145098 - DNA, 16 bp, H. sapiens
tgaggctgaggaggtg

SEQ ID NO: 145099 - DNA, 18 bp, H. sapiens
tgaggctgaggcaggaga

SEQ ID NO: 145100 - DNA, 16 bp, H. sapiens
tgaggctgaggcaggt

SEQ ID NO: 145101 - DNA, 16 bp, H. sapiens
tgaggctgcaaagagc

SEQ ID NO: 145102 - DNA, 16 bp, H. sapiens
tgaggctgcaagtgag

SEQ ID NO: 145103 - DNA, 16 bp, H. sapiens
tgaggctgcaatgagc

SEQ ID NO: 145104 - DNA, 16 bp, H. sapiens
tgaggctgcactgagc

SEQ ID NO: 145105 - DNA, 16 bp, H. sapiens
tgaggctgcagtgaac

SEQ ID NO: 145106 - DNA, 17 bp, H. sapiens
tgaggctgcagtgagct

SEQ ID NO: 145107 - DNA, 16 bp, H. sapiens
tgaggctgcagtgagt

SEQ ID NO: 145108 - DNA, 16 bp, H. sapiens
tgaggctgctgaccct

SEQ ID NO: 145109 - DNA, 16 bp, H. sapiens
tgaggctgctggcagg

SEQ ID NO: 145110 - DNA, 16 bp, H. sapiens
tgaggctgctgtgagc

SEQ ID NO: 145111 - DNA, 16 bp, H. sapiens
tgaggctggattttct

SEQ ID NO: 145112 - DNA, 16 bp, H. sapiens
tgaggctgggcatggt

SEQ ID NO: 145113 - DNA, 20 bp, H. sapiens
tgaggctgggcgcagtggct

SEQ ID NO: 145114 - DNA, 16 bp, H. sapiens
tgaggctggggctggg

SEQ ID NO: 145115 - DNA, 16 bp, H. sapiens
tgaggctgtgagggag

SEQ ID NO: 145116 - DNA, 16 bp, H. sapiens
tgaggctgtggaggaa

SEQ ID NO: 145117 - DNA, 16 bp, H. sapiens
tgaggctgtgtgtgtg

SEQ ID NO: 145118 - DNA, 16 bp, H. sapiens
tgaggctgtttctgga

SEQ ID NO: 145119 - DNA, 16 bp, H. sapiens
tgaggcttagagaaga

SEQ ID NO: 145120 - DNA, 16 bp, H. sapiens
tgaggcttccccagcc

SEQ ID NO: 145121 - DNA, 16 bp, H. sapiens
tgaggcttctccagcc

SEQ ID NO: 145122 - DNA, 16 bp, H. sapiens
tgaggcttggagaagt

SEQ ID NO: 145123 - DNA, 16 bp, H. sapiens
tgaggcttggggaggt

SEQ ID NO: 145124 - DNA, 16 bp, H. sapiens
tgaggctttggagaaa

SEQ ID NO: 145125 - DNA, 16 bp, H. sapiens
tgagggaaagtttaga

SEQ ID NO: 145126 - DNA, 16 bp, H. sapiens
tgagggaactaaatgg

SEQ ID NO: 145127 - DNA, 16 bp, H. sapiens
tgagggaagaacattc

SEQ ID NO: 145128 - DNA, 16 bp, H. sapiens
tgagggaatttgccac

SEQ ID NO: 145129 - DNA, 16 bp, H. sapiens
tgagggacaaacattc

SEQ ID NO: 145130 - DNA, 16 bp, H. sapiens
tgagggactgagcctg

SEQ ID NO: 145131 - DNA, 18 bp, H. sapiens
tgagggactgtgccatga

SEQ ID NO: 145132 - DNA, 16 bp, H. sapiens
tgagggaggagaatcg

SEQ ID NO: 145133 - DNA, 16 bp, H. sapiens
tgagggaggagctggg

SEQ ID NO: 145134 - DNA, 16 bp, H. sapiens
tgagggagggagagca

SEQ ID NO: 145135 - DNA, 16 bp, H. sapiens
tgagggaggtggaggc

SEQ ID NO: 145136 - DNA, 16 bp, H. sapiens
tgagggatctgcctcc

SEQ ID NO: 145137 - DNA, 16 bp, H. sapiens
tgagggcagaggagga

SEQ ID NO: 145138 - DNA, 16 bp, H. sapiens
tgagggcagcacctgc

SEQ ID NO: 145139 - DNA, 16 bp, H. sapiens
tgagggcaggacctgg

SEQ ID NO: 145140 - DNA, 16 bp, H. sapiens
tgagggcaggagaagg

SEQ ID NO: 145141 - DNA, 16 bp, H. sapiens
tgagggcagggccctc

SEQ ID NO: 145142 - DNA, 16 bp, H. sapiens
tgagggcagggcctgg

SEQ ID NO: 145143 - DNA, 16 bp, H. sapiens
tgagggcaggggctgt

SEQ ID NO: 145144 - DNA, 16 bp, H. sapiens
tgagggcagtgctgag

SEQ ID NO: 145145 - DNA, 16 bp, H. sapiens
tgagggcagtggggag

SEQ ID NO: 145146 - DNA, 16 bp, H. sapiens
tgagggccctcttgct

SEQ ID NO: 145147 - DNA, 16 bp, H. sapiens
tgagggcctcagggag

SEQ ID NO: 145148 - DNA, 16 bp, H. sapiens
tgagggctcagtcccc

SEQ ID NO: 145149 - DNA, 16 bp, H. sapiens
tgagggctccagcctc

SEQ ID NO: 145150 - DNA, 16 bp, H. sapiens
tgagggctccccagcc

SEQ ID NO: 145151 - DNA, 16 bp, H. sapiens
tgagggctctcttctt

SEQ ID NO: 145152 - DNA, 16 bp, H. sapiens
tgagggctgctcctgg

SEQ ID NO: 145153 - DNA, 16 bp, H. sapiens
tgagggctggagaggg

SEQ ID NO: 145154 - DNA, 16 bp, H. sapiens
tgagggcttcagtatt

SEQ ID NO: 145155 - DNA, 16 bp, H. sapiens
tgagggctttcttcct

SEQ ID NO: 145156 - DNA, 16 bp, H. sapiens
tgaggggaaaaaaaca

SEQ ID NO: 145157 - DNA, 16 bp, H. sapiens
tgaggggcactgtgga

SEQ ID NO: 145158 - DNA, 16 bp, H. sapiens
tgaggggcccctctgc

SEQ ID NO: 145159 - DNA, 17 bp, H. sapiens
tgaggggcgcctctgcc

SEQ ID NO: 145160 - DNA, 16 bp, H. sapiens
tgaggggcttagcacc

SEQ ID NO: 145161 - DNA, 16 bp, H. sapiens
tgagggggctgagcat

SEQ ID NO: 145162 - DNA, 16 bp, H. sapiens
tgaggggtgggggaca

SEQ ID NO: 145163 - DNA, 16 bp, H. sapiens
tgagggtctgcagctt

SEQ ID NO: 145164 - DNA, 16 bp, H. sapiens
tgagggtctgtggctt

SEQ ID NO: 145165 - DNA, 18 bp, H. sapiens
tgagggtgcccagggcaa

SEQ ID NO: 145166 - DNA, 16 bp, H. sapiens
tgagggtgctgggggt

SEQ ID NO: 145167 - DNA, 16 bp, H. sapiens
tgagggtggagccctc

SEQ ID NO: 145168 - DNA, 16 bp, H. sapiens
tgagggtgggccctaa

SEQ ID NO: 145169 - DNA, 16 bp, H. sapiens
tgagggtgggcctggg

SEQ ID NO: 145170 - DNA, 16 bp, H. sapiens
tgagggtggtggctca

SEQ ID NO: 145171 - DNA, 16 bp, H. sapiens
tgagggtgtagagaaa

SEQ ID NO: 145172 - DNA, 16 bp, H. sapiens
tgagggtgtttccaaa

SEQ ID NO: 145173 - DNA, 16 bp, H. sapiens
tgagggtgtttctgga

SEQ ID NO: 145174 - DNA, 16 bp, H. sapiens
tgagggttctgatttc

SEQ ID NO: 145175 - DNA, 17 bp, H. sapiens
tgagggttctgcaggag

SEQ ID NO: 145176 - DNA, 16 bp, H. sapiens
tgagggttctgcccct

SEQ ID NO: 145177 - DNA, 16 bp, H. sapiens
tgagggttttttttaa

SEQ ID NO: 145178 - DNA, 16 bp, H. sapiens
tgaggtagaagaatca

SEQ ID NO: 145179 - DNA, 16 bp, H. sapiens
tgaggtaggcggatca

SEQ ID NO: 145180 - DNA, 16 bp, H. sapiens
tgaggtaggttttatt

SEQ ID NO: 145181 - DNA, 16 bp, H. sapiens
tgaggtataattaaca

SEQ ID NO: 145182 - DNA, 16 bp, H. sapiens
tgaggtatgcctgtat

SEQ ID NO: 145183 - DNA, 16 bp, H. sapiens
tgaggtcacacagcag

SEQ ID NO: 145184 - DNA, 16 bp, H. sapiens
tgaggtcacccaggtg

SEQ ID NO: 145185 - DNA, 16 bp, H. sapiens
tgaggtcagaagttca

SEQ ID NO: 145186 - DNA, 16 bp, H. sapiens
tgaggtcagaagttcg

SEQ ID NO: 145187 - DNA, 16 bp, H. sapiens
tgaggtcagcctgggc

SEQ ID NO: 145188 - DNA, 16 bp, H. sapiens
tgaggtcaggaaatcg

SEQ ID NO: 145189 - DNA, 16 bp, H. sapiens
tgaggtcaggagagca

SEQ ID NO: 145190 - DNA, 16 bp, H. sapiens
tgaggtcaggagctag

SEQ ID NO: 145191 - DNA, 16 bp, H. sapiens
tgaggtcaggagctca

SEQ ID NO: 145192 - DNA, 19 bp, H. sapiens
tgaggtcaggagttcgaga

SEQ ID NO: 145193 - DNA, 16 bp, H. sapiens
tgaggtcaggggctca

SEQ ID NO: 145194 - DNA, 16 bp, H. sapiens
tgaggtcctgtctcaa

SEQ ID NO: 145195 - DNA, 16 bp, H. sapiens
tgaggtgacatctcat

SEQ ID NO: 145196 - DNA, 16 bp, H. sapiens
tgaggtgagaggatga

SEQ ID NO: 145197 - DNA, 16 bp, H. sapiens
tgaggtgataaatatg

SEQ ID NO: 145198 - DNA, 16 bp, H. sapiens
tgaggtgatggtgatg

SEQ ID NO: 145199 - DNA, 16 bp, H. sapiens
tgaggtgctgctggat

SEQ ID NO: 145200 - DNA, 16 bp, H. sapiens
tgaggtgcttgctgaa

SEQ ID NO: 145201 - DNA, 16 bp, H. sapiens
tgaggtggagattgca

SEQ ID NO: 145202 - DNA, 17 bp, H. sapiens
tgaggtggctcacgcct

SEQ ID NO: 145203 - DNA, 16 bp, H. sapiens
tgaggtgggaaaactg

SEQ ID NO: 145204 - DNA, 16 bp, H. sapiens
tgaggtgggaacatca

SEQ ID NO: 145205 - DNA, 16 bp, H. sapiens
tgaggtgggaagatca

SEQ ID NO: 145206 - DNA, 16 bp, H. sapiens
tgaggtgggaagattg

SEQ ID NO: 145207 - DNA, 16 bp, H. sapiens
tgaggtgggaggactg

SEQ ID NO: 145208 - DNA, 16 bp, H. sapiens
tgaggtgggaggatcg

SEQ ID NO: 145209 - DNA, 24 bp, H. sapiens
tgaggtgggaggatcgcttgagcc

SEQ ID NO: 145210 - DNA, 16 bp, H. sapiens
tgaggtgggaggctgg

SEQ ID NO: 145211 - DNA, 16 bp, H. sapiens
tgaggtgggagggctg

SEQ ID NO: 145212 - DNA, 16 bp, H. sapiens
tgaggtgggagtactg

SEQ ID NO: 145213 - DNA, 16 bp, H. sapiens
tgaggtgggcagatcg

SEQ ID NO: 145214 - DNA, 16 bp, H. sapiens
tgaggtgggcggatcc

SEQ ID NO: 145215 - DNA, 16 bp, H. sapiens
tgaggtgggtctcctg

SEQ ID NO: 145216 - DNA, 21 bp, H. sapiens
tgaggtgggtggatcacctaa

SEQ ID NO: 145217 - DNA, 22 bp, H. sapiens
tgaggtgggtggatcacctgaa

SEQ ID NO: 145218 - DNA, 16 bp, H. sapiens
tgaggttacagaaaga

SEQ ID NO: 145219 - DNA, 16 bp, H. sapiens
tgaggttcagagagat

SEQ ID NO: 145220 - DNA, 16 bp, H. sapiens
tgaggttcatccatgt

SEQ ID NO: 145221 - DNA, 16 bp, H. sapiens
tgaggttctgttcatt

SEQ ID NO: 145222 - DNA, 16 bp, H. sapiens
tgaggttgagagtttg

SEQ ID NO: 145223 - DNA, 16 bp, H. sapiens
tgaggttgaggtggga

SEQ ID NO: 145224 - DNA, 16 bp, H. sapiens
tgaggttgcaaagaaa

SEQ ID NO: 145225 - DNA, 16 bp, H. sapiens
tgaggttgggagatca

SEQ ID NO: 145226 - DNA, 16 bp, H. sapiens
tgaggttgtggaggaa

SEQ ID NO: 145227 - DNA, 16 bp, H. sapiens
tgaggtttcagagaaa

SEQ ID NO: 145228 - DNA, 16 bp, H. sapiens
tgaggtttcccagaga

SEQ ID NO: 145229 - DNA, 16 bp, H. sapiens
tgaggtttgaggtaca

SEQ ID NO: 145230 - DNA, 16 bp, H. sapiens
tgaggtttgggaacct

SEQ ID NO: 145231 - DNA, 16 bp, H. sapiens
tgagtaaagaaaatgt

SEQ ID NO: 145232 - DNA, 16 bp, H. sapiens
tgagtaaatatttgtt

SEQ ID NO: 145233 - DNA, 16 bp, H. sapiens
tgagtaaatgaataaa

SEQ ID NO: 145234 - DNA, 16 bp, H. sapiens
tgagtaaatgaatgaa

SEQ ID NO: 145235 - DNA, 16 bp, H. sapiens
tgagtaaattaaattt

SEQ ID NO: 145236 - DNA, 16 bp, H. sapiens
tgagtaagttctcatg

SEQ ID NO: 145237 - DNA, 16 bp, H. sapiens
tgagtaagttctggag

SEQ ID NO: 145238 - DNA, 16 bp, H. sapiens
tgagtaattttggatt

SEQ ID NO: 145239 - DNA, 16 bp, H. sapiens
tgagtacctattatgt

SEQ ID NO: 145240 - DNA, 16 bp, H. sapiens
tgagtagacatttctc

SEQ ID NO: 145241 - DNA, 16 bp, H. sapiens
tgagtagcagggactg

SEQ ID NO: 145242 - DNA, 16 bp, H. sapiens
tgagtagcatgataaa

SEQ ID NO: 145243 - DNA, 16 bp, H. sapiens
tgagtagctgcgacta

SEQ ID NO: 145244 - DNA, 16 bp, H. sapiens
tgagtagctggcatta

SEQ ID NO: 145245 - DNA, 16 bp, H. sapiens
tgagtagttgtgatag

SEQ ID NO: 145246 - DNA, 16 bp, H. sapiens
tgagtataacagcttt

SEQ ID NO: 145247 - DNA, 16 bp, H. sapiens
tgagtatctactgtgt

SEQ ID NO: 145248 - DNA, 16 bp, H. sapiens
tgagtatgggatgtgt

SEQ ID NO: 145249 - DNA, 16 bp, H. sapiens
tgagtatgtcttctgt

SEQ ID NO: 145250 - DNA, 16 bp, H. sapiens
tgagtatgttcattgc

SEQ ID NO: 145251 - DNA, 16 bp, H. sapiens
tgagtatttttgcatc

SEQ ID NO: 145252 - DNA, 16 bp, H. sapiens
tgagtcaactaaatct

SEQ ID NO: 145253 - DNA, 16 bp, H. sapiens
tgagtcaagatctcac

SEQ ID NO: 145254 - DNA, 16 bp, H. sapiens
tgagtcaattaaactt

SEQ ID NO: 145255 - DNA, 16 bp, H. sapiens
tgagtcaattaagcct

SEQ ID NO: 145256 - DNA, 16 bp, H. sapiens
tgagtcaggaattcag

SEQ ID NO: 145257 - DNA, 16 bp, H. sapiens
tgagtcattttttaat

SEQ ID NO: 145258 - DNA, 21 bp, H. sapiens
tgagtccaaaaagagagtcag

SEQ ID NO: 145259 - DNA, 16 bp, H. sapiens
tgagtccaggaggtgg

SEQ ID NO: 145260 - DNA, 17 bp, H. sapiens
tgagtccaggagttcga

SEQ ID NO: 145261 - DNA, 16 bp, H. sapiens
tgagtccattgaacct

SEQ ID NO: 145262 - DNA, 16 bp, H. sapiens
tgagtcccagtgctgg

SEQ ID NO: 145263 - DNA, 16 bp, H. sapiens
tgagtcctaatttgat

SEQ ID NO: 145264 - DNA, 16 bp, H. sapiens
tgagtcctggctctgc

SEQ ID NO: 145265 - DNA, 17 bp, H. sapiens
tgagtccttgtggacaa

SEQ ID NO: 145266 - DNA, 18 bp, H. sapiens
tgagtcgagatcgcacca

SEQ ID NO: 145267 - DNA, 16 bp, H. sapiens
tgagtctcaaaaaaaa

SEQ ID NO: 145268 - DNA, 16 bp, H. sapiens
tgagtctcatgaaatc

SEQ ID NO: 145269 - DNA, 16 bp, H. sapiens
tgagtctcatgcctca

SEQ ID NO: 145270 - DNA, 16 bp, H. sapiens
tgagtctccagcctgc

SEQ ID NO: 145271 - DNA, 16 bp, H. sapiens
tgagtctcgctctgtc

SEQ ID NO: 145272 - DNA, 16 bp, H. sapiens
tgagtctcgctctgtt

SEQ ID NO: 145273 - DNA, 16 bp, H. sapiens
tgagtctctctctgtt

SEQ ID NO: 145274 - DNA, 16 bp, H. sapiens
tgagtctctgtctcaa

SEQ ID NO: 145275 - DNA, 16 bp, H. sapiens
tgagtctgaaatggaa

SEQ ID NO: 145276 - DNA, 16 bp, H. sapiens
tgagtctgcagtgagc

SEQ ID NO: 145277 - DNA, 16 bp, H. sapiens
tgagtctgctgttgaa

SEQ ID NO: 145278 - DNA, 16 bp, H. sapiens
tgagtctggctctgtc

SEQ ID NO: 145279 - DNA, 16 bp, H. sapiens
tgagtcttcctattca

SEQ ID NO: 145280 - DNA, 16 bp, H. sapiens
tgagtctttgctgaag

SEQ ID NO: 145281 - DNA, 16 bp, H. sapiens
tgagtctttttaaaaa

SEQ ID NO: 145282 - DNA, 16 bp, H. sapiens
tgagtgaaaagataac

SEQ ID NO: 145283 - DNA, 17 bp, H. sapiens
tgagtgaaactctgtct

SEQ ID NO: 145284 - DNA, 16 bp, H. sapiens
tgagtgaaagaagcca

SEQ ID NO: 145285 - DNA, 16 bp, H. sapiens
tgagtgaagaaatgaa

SEQ ID NO: 145286 - DNA, 16 bp, H. sapiens
tgagtgaatgtgaagg

SEQ ID NO: 145287 - DNA, 16 bp, H. sapiens
tgagtgaattaatgaa

SEQ ID NO: 145288 - DNA, 16 bp, H. sapiens
tgagtgaatttcttag

SEQ ID NO: 145289 - DNA, 16 bp, H. sapiens
tgagtgaccaatggcc

SEQ ID NO: 145290 - DNA, 16 bp, H. sapiens
tgagtgaccacggccc

SEQ ID NO: 145291 - DNA, 16 bp, H. sapiens
tgagtgacggagtgag

SEQ ID NO: 145292 - DNA, 16 bp, H. sapiens
tgagtgagaaataaac

SEQ ID NO: 145293 - DNA, 16 bp, H. sapiens
tgagtgagaacatggc

SEQ ID NO: 145294 - DNA, 16 bp, H. sapiens
tgagtgagcaagtgaa

SEQ ID NO: 145295 - DNA, 16 bp, H. sapiens
tgagtgagctgggaag

SEQ ID NO: 145296 - DNA, 16 bp, H. sapiens
tgagtgaggacatgca

SEQ ID NO: 145297 - DNA, 16 bp, H. sapiens
tgagtgagtgagtgaa

SEQ ID NO: 145298 - DNA, 16 bp, H. sapiens
tgagtgagtgtgtgtg

SEQ ID NO: 145299 - DNA, 16 bp, H. sapiens
tgagtgagtttcctaa

SEQ ID NO: 145300 - DNA, 16 bp, H. sapiens
tgagtgatcctcccac

SEQ ID NO: 145301 - DNA, 16 bp, H. sapiens
tgagtgcagcctgcca

SEQ ID NO: 145302 - DNA, 16 bp, H. sapiens
tgagtgcctactatgt

SEQ ID NO: 145303 - DNA, 16 bp, H. sapiens
tgagtgcctactgtgt

SEQ ID NO: 145304 - DNA, 16 bp, H. sapiens
tgagtgcgtgtgtgtg

SEQ ID NO: 145305 - DNA, 16 bp, H. sapiens
tgagtgctccagtgtt

SEQ ID NO: 145306 - DNA, 16 bp, H. sapiens
tgagtgctgtggctca

SEQ ID NO: 145307 - DNA, 16 bp, H. sapiens
tgagtgcttaataaat

SEQ ID NO: 145308 - DNA, 16 bp, H. sapiens
tgagtgcttacaatgt

SEQ ID NO: 145309 - DNA, 16 bp, H. sapiens
tgagtgcttattaaat

SEQ ID NO: 145310 - DNA, 16 bp, H. sapiens
tgagtgcttgaaatgt

SEQ ID NO: 145311 - DNA, 17 bp, H. sapiens
tgagtggagatcgcgcc

SEQ ID NO: 145312 - DNA, 16 bp, H. sapiens
tgagtggaggagtgag

SEQ ID NO: 145313 - DNA, 16 bp, H. sapiens
tgagtggatagagaaa

SEQ ID NO: 145314 - DNA, 16 bp, H. sapiens
tgagtggatggatgga

SEQ ID NO: 145315 - DNA, 16 bp, H. sapiens
tgagtggcagagtgag

SEQ ID NO: 145316 - DNA, 16 bp, H. sapiens
tgagtggctgggacta

SEQ ID NO: 145317 - DNA, 16 bp, H. sapiens
tgagtggcttaaataa

SEQ ID NO: 145318 - DNA, 16 bp, H. sapiens
tgagtggggacacagc

SEQ ID NO: 145319 - DNA, 16 bp, H. sapiens
tgagtgtctgtgtctt

SEQ ID NO: 145320 - DNA, 16 bp, H. sapiens
tgagtgtgcgtgtgtg

SEQ ID NO: 145321 - DNA, 16 bp, H. sapiens
tgagtgtgggtgtgta

SEQ ID NO: 145322 - DNA, 16 bp, H. sapiens
tgagtgtggtggttca

SEQ ID NO: 145323 - DNA, 16 bp, H. sapiens
tgagtgtgtatgtgtg

SEQ ID NO: 145324 - DNA, 16 bp, H. sapiens
tgagtgtgtctgtgag

SEQ ID NO: 145325 - DNA, 16 bp, H. sapiens
tgagtgtgtgagtgtg

SEQ ID NO: 145326 - DNA, 16 bp, H. sapiens
tgagtgtgtgtgagtg

SEQ ID NO: 145327 - DNA, 16 bp, H. sapiens
tgagtgtgtgtgcctg

SEQ ID NO: 145328 - DNA, 16 bp, H. sapiens
tgagtgtgtttgctct

SEQ ID NO: 145329 - DNA, 16 bp, H. sapiens
tgagtgtgtttgtgag

SEQ ID NO: 145330 - DNA, 20 bp, H. sapiens
tgagtgttacagttcttaaa

SEQ ID NO: 145331 - DNA, 16 bp, H. sapiens
tgagtgttcagctcct

SEQ ID NO: 145332 - DNA, 16 bp, H. sapiens
tgagtgtttactatgt

SEQ ID NO: 145333 - DNA, 16 bp, H. sapiens
tgagtgtttccttcta

SEQ ID NO: 145334 - DNA, 16 bp, H. sapiens
tgagttaacttttgtg

SEQ ID NO: 145335 - DNA, 16 bp, H. sapiens
tgagttaatacataaa

SEQ ID NO: 145336 - DNA, 16 bp, H. sapiens
tgagttaatatttaat

SEQ ID NO: 145337 - DNA, 16 bp, H. sapiens
tgagttaatgcagaaa

SEQ ID NO: 145338 - DNA, 17 bp, H. sapiens
tgagttaatgctgaaat

SEQ ID NO: 145339 - DNA, 16 bp, H. sapiens
tgagttaatttatgta

SEQ ID NO: 145340 - DNA, 16 bp, H. sapiens
tgagttactttactta

SEQ ID NO: 145341 - DNA, 16 bp, H. sapiens
tgagttaggtattatt

SEQ ID NO: 145342 - DNA, 16 bp, H. sapiens
tgagttatgtttcttc

SEQ ID NO: 145343 - DNA, 16 bp, H. sapiens
tgagttatttcaaaag

SEQ ID NO: 145344 - DNA, 16 bp, H. sapiens
tgagttattttaaaat

SEQ ID NO: 145345 - DNA, 16 bp, H. sapiens
tgagttcaagttctga

SEQ ID NO: 145346 - DNA, 16 bp, H. sapiens
tgagttcaattgtttt

SEQ ID NO: 145347 - DNA, 16 bp, H. sapiens
tgagttcacaagagat

SEQ ID NO: 145348 - DNA, 16 bp, H. sapiens
tgagttcatctccttt

SEQ ID NO: 145349 - DNA, 16 bp, H. sapiens
tgagttcatgtccctt

SEQ ID NO: 145350 - DNA, 16 bp, H. sapiens
tgagttcattgtaaat

SEQ ID NO: 145351 - DNA, 16 bp, H. sapiens
tgagttccagtctgag

SEQ ID NO: 145352 - DNA, 16 bp, H. sapiens
tgagttccttgtaggt

SEQ ID NO: 145353 - DNA, 16 bp, H. sapiens
tgagttcctttccttt

SEQ ID NO: 145354 - DNA, 16 bp, H. sapiens
tgagttctagccaatg

SEQ ID NO: 145355 - DNA, 16 bp, H. sapiens
tgagttctatgagcca

SEQ ID NO: 145356 - DNA, 16 bp, H. sapiens
tgagttctccattctg

SEQ ID NO: 145357 - DNA, 16 bp, H. sapiens
tgagttctgcctcctg

SEQ ID NO: 145358 - DNA, 16 bp, H. sapiens
tgagttctgtgagcta

SEQ ID NO: 145359 - DNA, 16 bp, H. sapiens
tgagttctgtgagtca

SEQ ID NO: 145360 - DNA, 16 bp, H. sapiens
tgagttctgtgagtcc

SEQ ID NO: 145361 - DNA, 16 bp, H. sapiens
tgagttctttgagaaa

SEQ ID NO: 145362 - DNA, 16 bp, H. sapiens
tgagttctttgtggat

SEQ ID NO: 145363 - DNA, 16 bp, H. sapiens
tgagttgaaaataaaa

SEQ ID NO: 145364 - DNA, 16 bp, H. sapiens
tgagttgagactttgg

SEQ ID NO: 145365 - DNA, 18 bp, H. sapiens
tgagttgagatcgtgcca

SEQ ID NO: 145366 - DNA, 16 bp, H. sapiens
tgagttgcaagctgaa

SEQ ID NO: 145367 - DNA, 16 bp, H. sapiens
tgagttgggaggatgg

SEQ ID NO: 145368 - DNA, 16 bp, H. sapiens
tgagttgtcttttcac

SEQ ID NO: 145369 - DNA, 16 bp, H. sapiens
tgagttgttttcagtt

SEQ ID NO: 145370 - DNA, 16 bp, H. sapiens
tgagtttcctaatcct

SEQ ID NO: 145371 - DNA, 16 bp, H. sapiens
tgagtttctagatgga

SEQ ID NO: 145372 - DNA, 16 bp, H. sapiens
tgagtttcttaaccct

SEQ ID NO: 145373 - DNA, 16 bp, H. sapiens
tgagtttcttgtaaat

SEQ ID NO: 145374 - DNA, 16 bp, H. sapiens
tgagtttctttctttc

SEQ ID NO: 145375 - DNA, 16 bp, H. sapiens
tgagtttgaatcccag

SEQ ID NO: 145376 - DNA, 16 bp, H. sapiens
tgagtttgacttcttt

SEQ ID NO: 145377 - DNA, 16 bp, H. sapiens
tgagtttgagatgcct

SEQ ID NO: 145378 - DNA, 16 bp, H. sapiens
tgagtttgcagagaaa

SEQ ID NO: 145379 - DNA, 16 bp, H. sapiens
tgagtttgggagtttg

SEQ ID NO: 145380 - DNA, 16 bp, H. sapiens
tgagtttgtctgatgt

SEQ ID NO: 145381 - DNA, 16 bp, H. sapiens
tgagtttgttaatcct

SEQ ID NO: 145382 - DNA, 16 bp, H. sapiens
tgagtttgttataaaa

SEQ ID NO: 145383 - DNA, 16 bp, H. sapiens
tgagttttctcatgct

SEQ ID NO: 145384 - DNA, 16 bp, H. sapiens
tgagttttgaaggatg

SEQ ID NO: 145385 - DNA, 16 bp, H. sapiens
tgagtttttaaaagat

SEQ ID NO: 145386 - DNA, 16 bp, H. sapiens
tgataaaaacactaaa

SEQ ID NO: 145387 - DNA, 16 bp, H. sapiens
tgataaaaacacttaa

SEQ ID NO: 145388 - DNA, 16 bp, H. sapiens
tgataaaaactagaaa

SEQ ID NO: 145389 - DNA, 16 bp, H. sapiens
tgataaaaactgtaaa

SEQ ID NO: 145390 - DNA, 16 bp, H. sapiens
tgataaaaattcaaaa

SEQ ID NO: 145391 - DNA, 16 bp, H. sapiens
tgataaaacaaacttt

SEQ ID NO: 145392 - DNA, 16 bp, H. sapiens
tgataaaacagcatgt

SEQ ID NO: 145393 - DNA, 16 bp, H. sapiens
tgataaaactgacttt

SEQ ID NO: 145394 - DNA, 16 bp, H. sapiens
tgataaaacttgaatg

SEQ ID NO: 145395 - DNA, 16 bp, H. sapiens
tgataaaagctagaaa

SEQ ID NO: 145396 - DNA, 16 bp, H. sapiens
tgataaaatacatata

SEQ ID NO: 145397 - DNA, 16 bp, H. sapiens
tgataaaatagacttt

SEQ ID NO: 145398 - DNA, 16 bp, H. sapiens
tgataaaattcaacag

SEQ ID NO: 145399 - DNA, 16 bp, H. sapiens
tgataaaatttaagct

SEQ ID NO: 145400 - DNA, 16 bp, H. sapiens
tgataaacaacttcaa

SEQ ID NO: 145401 - DNA, 16 bp, H. sapiens
tgataaacatatgcat

SEQ ID NO: 145402 - DNA, 16 bp, H. sapiens
tgataaactggatttc

SEQ ID NO: 145403 - DNA, 16 bp, H. sapiens
tgataaagcagaagaa

SEQ ID NO: 145404 - DNA, 16 bp, H. sapiens
tgataaagcagtagca

SEQ ID NO: 145405 - DNA, 16 bp, H. sapiens
tgataaagctgaaaaa

SEQ ID NO: 145406 - DNA, 16 bp, H. sapiens
tgataaaggtgacatt

SEQ ID NO: 145407 - DNA, 16 bp, H. sapiens
tgataaaggtgccaag

SEQ ID NO: 145408 - DNA, 16 bp, H. sapiens
tgataaataaggactt

SEQ ID NO: 145409 - DNA, 16 bp, H. sapiens
tgataaatatatatga

SEQ ID NO: 145410 - DNA, 16 bp, H. sapiens
tgataaatatttgaaa

SEQ ID NO: 145411 - DNA, 16 bp, H. sapiens
tgataaatcacattta

SEQ ID NO: 145412 - DNA, 16 bp, H. sapiens
tgataaatgaaaaatg

SEQ ID NO: 145413 - DNA, 16 bp, H. sapiens
tgataaatgaattcag

SEQ ID NO: 145414 - DNA, 16 bp, H. sapiens
tgataaatgatgttga

SEQ ID NO: 145415 - DNA, 16 bp, H. sapiens
tgataaatgctataaa

SEQ ID NO: 145416 - DNA, 16 bp, H. sapiens
tgataaatgttcaagg

SEQ ID NO: 145417 - DNA, 16 bp, H. sapiens
tgataaatttcaatca

SEQ ID NO: 145418 - DNA, 16 bp, H. sapiens
tgataaatttctgaat

SEQ ID NO: 145419 - DNA, 16 bp, H. sapiens
tgataaatttgtgttg

SEQ ID NO: 145420 - DNA, 18 bp, H. sapiens
tgataacgcccaaagccc

SEQ ID NO: 145421 - DNA, 16 bp, H. sapiens
tgataagaaacttcag

SEQ ID NO: 145422 - DNA, 16 bp, H. sapiens
tgataagaatttttca

SEQ ID NO: 145423 - DNA, 16 bp, H. sapiens
tgataagcaagttcag

SEQ ID NO: 145424 - DNA, 16 bp, H. sapiens
tgataagtattttaaa

SEQ ID NO: 145425 - DNA, 16 bp, H. sapiens
tgataagtgatattga

SEQ ID NO: 145426 - DNA, 16 bp, H. sapiens
tgataataaaaagcag

SEQ ID NO: 145427 - DNA, 16 bp, H. sapiens
tgataataatgatgat

SEQ ID NO: 145428 - DNA, 16 bp, H. sapiens
tgataatataaacagt

SEQ ID NO: 145429 - DNA, 16 bp, H. sapiens
tgataatattttgaat

SEQ ID NO: 145430 - DNA, 16 bp, H. sapiens
tgataatgacaataaa

SEQ ID NO: 145431 - DNA, 16 bp, H. sapiens
tgataatggtattgtg

SEQ ID NO: 145432 - DNA, 16 bp, H. sapiens
tgataatgtgattttt

SEQ ID NO: 145433 - DNA, 16 bp, H. sapiens
tgataattgtgttaac

SEQ ID NO: 145434 - DNA, 16 bp, H. sapiens
tgataattttccagaa

SEQ ID NO: 145435 - DNA, 16 bp, H. sapiens
tgataatttttttcaa

SEQ ID NO: 145436 - DNA, 16 bp, H. sapiens
tgatacaaagttaaaa

SEQ ID NO: 145437 - DNA, 16 bp, H. sapiens
tgatacaatgtaaatg

SEQ ID NO: 145438 - DNA, 16 bp, H. sapiens
tgatacaggtattctg

SEQ ID NO: 145439 - DNA, 17 bp, H. sapiens
tgatacagtttggctgt

SEQ ID NO: 145440 - DNA, 16 bp, H. sapiens
tgatacataaaattaa

SEQ ID NO: 145441 - DNA, 16 bp, H. sapiens
tgatacatattttttt

SEQ ID NO: 145442 - DNA, 16 bp, H. sapiens
tgatacatgcaacaac

SEQ ID NO: 145443 - DNA, 16 bp, H. sapiens
tgatacatgcatataa

SEQ ID NO: 145444 - DNA, 16 bp, H. sapiens
tgatacattaaaaaaa

SEQ ID NO: 145445 - DNA, 16 bp, H. sapiens
tgatacattattttaa

SEQ ID NO: 145446 - DNA, 16 bp, H. sapiens
tgatacattgtatttt

SEQ ID NO: 145447 - DNA, 16 bp, H. sapiens
tgatacattttgagtt

SEQ ID NO: 145448 - DNA, 16 bp, H. sapiens
tgataccaaaacctga

SEQ ID NO: 145449 - DNA, 17 bp, H. sapiens
tgataccaaggcaaaca

SEQ ID NO: 145450 - DNA, 16 bp, H. sapiens
tgatacccaggcaaat

SEQ ID NO: 145451 - DNA, 16 bp, H. sapiens
tgataccctgtctcaa

SEQ ID NO: 145452 - DNA, 16 bp, H. sapiens
tgatacctaatacaat

SEQ ID NO: 145453 - DNA, 16 bp, H. sapiens
tgatacctccaggtac

SEQ ID NO: 145454 - DNA, 16 bp, H. sapiens
tgatacctccaggtat

SEQ ID NO: 145455 - DNA, 16 bp, H. sapiens
tgatactggcatctgc

SEQ ID NO: 145456 - DNA, 16 bp, H. sapiens
tgatacttttattatt

SEQ ID NO: 145457 - DNA, 16 bp, H. sapiens
tgatactttttttgag

SEQ ID NO: 145458 - DNA, 16 bp, H. sapiens
tgatagagaaaaaggt

SEQ ID NO: 145459 - DNA, 16 bp, H. sapiens
tgatagagcaaaactc

SEQ ID NO: 145460 - DNA, 16 bp, H. sapiens
tgatagagcaagacct

SEQ ID NO: 145461 - DNA, 16 bp, H. sapiens
tgatagagtctcactc

SEQ ID NO: 145462 - DNA, 16 bp, H. sapiens
tgatagagtgagattc

SEQ ID NO: 145463 - DNA, 16 bp, H. sapiens
tgatagggaaactctt

SEQ ID NO: 145464 - DNA, 16 bp, H. sapiens
tgatagggtttggctg

SEQ ID NO: 145465 - DNA, 16 bp, H. sapiens
tgataggtgtgtagtg

SEQ ID NO: 145466 - DNA, 16 bp, H. sapiens
tgatagtatttggaga

SEQ ID NO: 145467 - DNA, 17 bp, H. sapiens
tgatagtgaatgagtct

SEQ ID NO: 145468 - DNA, 16 bp, H. sapiens
tgatagtgatgatgat

SEQ ID NO: 145469 - DNA, 17 bp, H. sapiens
tgatagtttcttttgct

SEQ ID NO: 145470 - DNA, 16 bp, H. sapiens
tgatagttttttaaaa

SEQ ID NO: 145471 - DNA, 16 bp, H. sapiens
tgatataaatatagct

SEQ ID NO: 145472 - DNA, 16 bp, H. sapiens
tgatataattcagctg

SEQ ID NO: 145473 - DNA, 16 bp, H. sapiens
tgatataggagttaag

SEQ ID NO: 145474 - DNA, 16 bp, H. sapiens
tgatatataatcatat

SEQ ID NO: 145475 - DNA, 16 bp, H. sapiens
tgatatatacatgcaa

SEQ ID NO: 145476 - DNA, 16 bp, H. sapiens
tgatatatatgatata

SEQ ID NO: 145477 - DNA, 16 bp, H. sapiens
tgatatatcctgaaac

SEQ ID NO: 145478 - DNA, 16 bp, H. sapiens
tgatatcattttcctt

SEQ ID NO: 145479 - DNA, 16 bp, H. sapiens
tgatatctgatcaaat

SEQ ID NO: 145480 - DNA, 16 bp, H. sapiens
tgatatgattgtatac

SEQ ID NO: 145481 - DNA, 16 bp, H. sapiens
tgatatgatttgattt

SEQ ID NO: 145482 - DNA, 16 bp, H. sapiens
tgatatgcctattaat

SEQ ID NO: 145483 - DNA, 16 bp, H. sapiens
tgatatgcctgccttg

SEQ ID NO: 145484 - DNA, 16 bp, H. sapiens
tgatatgctaagaaag

SEQ ID NO: 145485 - DNA, 16 bp, H. sapiens
tgatatggacaatgaa

SEQ ID NO: 145486 - DNA, 16 bp, H. sapiens
tgatatggttaagctt

SEQ ID NO: 145487 - DNA, 16 bp, H. sapiens
tgatatggtttggctg

SEQ ID NO: 145488 - DNA, 17 bp, H. sapiens
tgatatggtttggctgt

SEQ ID NO: 145489 - DNA, 16 bp, H. sapiens
tgatatggtttttaat

SEQ ID NO: 145490 - DNA, 16 bp, H. sapiens
tgatatgtgtggattt

SEQ ID NO: 145491 - DNA, 16 bp, H. sapiens
tgatattaatgaatgt

SEQ ID NO: 145492 - DNA, 16 bp, H. sapiens
tgatattaatgatcct

SEQ ID NO: 145493 - DNA, 16 bp, H. sapiens
tgatattcactttatt

SEQ ID NO: 145494 - DNA, 16 bp, H. sapiens
tgatattcatgaacat

SEQ ID NO: 145495 - DNA, 17 bp, H. sapiens
tgatattccccttcctg

SEQ ID NO: 145496 - DNA, 16 bp, H. sapiens
tgatattgatgctgct

SEQ ID NO: 145497 - DNA, 16 bp, H. sapiens
tgatatttataaaaca

SEQ ID NO: 145498 - DNA, 16 bp, H. sapiens
tgatatttatagaaca

SEQ ID NO: 145499 - DNA, 16 bp, H. sapiens
tgatatttcaatatat

SEQ ID NO: 145500 - DNA, 16 bp, H. sapiens
tgatatttctttgttg

SEQ ID NO: 145501 - DNA, 16 bp, H. sapiens
tgatatttgcattttc

SEQ ID NO: 145502 - DNA, 16 bp, H. sapiens
tgatatttggagggga

SEQ ID NO: 145503 - DNA, 16 bp, H. sapiens
tgatatttggttttcc

SEQ ID NO: 145504 - DNA, 16 bp, H. sapiens
tgatattttcagtttt

SEQ ID NO: 145505 - DNA, 16 bp, H. sapiens
tgatattttctcttct

SEQ ID NO: 145506 - DNA, 16 bp, H. sapiens
tgatattttgaagggt

SEQ ID NO: 145507 - DNA, 16 bp, H. sapiens
tgatattttgttatgg

SEQ ID NO: 145508 - DNA, 16 bp, H. sapiens
tgatatttttagtaga

SEQ ID NO: 145509 - DNA, 16 bp, H. sapiens
tgatatttttatgaaa

SEQ ID NO: 145510 - DNA, 16 bp, H. sapiens
tgatcaaaatattttt

SEQ ID NO: 145511 - DNA, 16 bp, H. sapiens
tgatcaaaatgctgat

SEQ ID NO: 145512 - DNA, 16 bp, H. sapiens
tgatcaaattggctac

SEQ ID NO: 145513 - DNA, 16 bp, H. sapiens
tgatcaagtgggcttt

SEQ ID NO: 145514 - DNA, 16 bp, H. sapiens
tgatcaataaaataaa

SEQ ID NO: 145515 - DNA, 16 bp, H. sapiens
tgatcacaccactgcg

SEQ ID NO: 145516 - DNA, 16 bp, H. sapiens
tgatcacaccattgca

SEQ ID NO: 145517 - DNA, 16 bp, H. sapiens
tgatcacactgctgca

SEQ ID NO: 145518 - DNA, 16 bp, H. sapiens
tgatcacgctgctgca

SEQ ID NO: 145519 - DNA, 16 bp, H. sapiens
tgatcacttgagccca

SEQ ID NO: 145520 - DNA, 16 bp, H. sapiens
tgatcagcctggccaa

SEQ ID NO: 145521 - DNA, 16 bp, H. sapiens
tgatcaggctggtttt

SEQ ID NO: 145522 - DNA, 16 bp, H. sapiens
tgatcagtgatgttga

SEQ ID NO: 145523 - DNA, 16 bp, H. sapiens
tgatcatacagttttt

SEQ ID NO: 145524 - DNA, 16 bp, H. sapiens
tgatcatagctcactc

SEQ ID NO: 145525 - DNA, 16 bp, H. sapiens
tgatcatatatataga

SEQ ID NO: 145526 - DNA, 16 bp, H. sapiens
tgatcatcatcatcat

SEQ ID NO: 145527 - DNA, 16 bp, H. sapiens
tgatcatcccactgca

SEQ ID NO: 145528 - DNA, 16 bp, H. sapiens
tgatcatgccactgca

SEQ ID NO: 145529 - DNA, 16 bp, H. sapiens
tgatcatgctgggagc

SEQ ID NO: 145530 - DNA, 16 bp, H. sapiens
tgatcatggtgaatta

SEQ ID NO: 145531 - DNA, 16 bp, H. sapiens
tgatcatggtggatga

SEQ ID NO: 145532 - DNA, 16 bp, H. sapiens
tgatcattgttgaagc

SEQ ID NO: 145533 - DNA, 16 bp, H. sapiens
tgatcattttaatgtg

SEQ ID NO: 145534 - DNA, 16 bp, H. sapiens
tgatcattttcctttt

SEQ ID NO: 145535 - DNA, 16 bp, H. sapiens
tgatccacatgcctca

SEQ ID NO: 145536 - DNA, 17 bp, H. sapiens
tgatccaccacctcggc

SEQ ID NO: 145537 - DNA, 17 bp, H. sapiens
tgatccacccacctcgt

SEQ ID NO: 145538 - DNA, 16 bp, H. sapiens
tgatccacccatctcc

SEQ ID NO: 145539 - DNA, 17 bp, H. sapiens
tgatccacccgctttgg

SEQ ID NO: 145540 - DNA, 16 bp, H. sapiens
tgatccacctacctcg

SEQ ID NO: 145541 - DNA, 16 bp, H. sapiens
tgatccacctgccccg

SEQ ID NO: 145542 - DNA, 22 bp, H. sapiens
tgatccacctgcctcagcctcc

SEQ ID NO: 145543 - DNA, 16 bp, H. sapiens
tgatccaccttccttg

SEQ ID NO: 145544 - DNA, 16 bp, H. sapiens
tgatccagagctgagt

SEQ ID NO: 145545 - DNA, 16 bp, H. sapiens
tgatccagcaattaca

SEQ ID NO: 145546 - DNA, 16 bp, H. sapiens
tgatccagcagcagga

SEQ ID NO: 145547 - DNA, 16 bp, H. sapiens
tgatccagtttcttca

SEQ ID NO: 145548 - DNA, 16 bp, H. sapiens
tgatccatgtgctgaa

SEQ ID NO: 145549 - DNA, 16 bp, H. sapiens
tgatccattccaacca

SEQ ID NO: 145550 - DNA, 16 bp, H. sapiens
tgatccattttaattt

SEQ ID NO: 145551 - DNA, 16 bp, H. sapiens
tgatcccaaagtgctg

SEQ ID NO: 145552 - DNA, 16 bp, H. sapiens
tgatcccagaactttg

SEQ ID NO: 145553 - DNA, 16 bp, H. sapiens
tgatcccagcactgtg

SEQ ID NO: 145554 - DNA, 16 bp, H. sapiens
tgatcccaggaggtgg

SEQ ID NO: 145555 - DNA, 16 bp, H. sapiens
tgatccctgccctcaa

SEQ ID NO: 145556 - DNA, 16 bp, H. sapiens
tgatccgcccaccttg

SEQ ID NO: 145557 - DNA, 16 bp, H. sapiens
tgatccgcctgcctct

SEQ ID NO: 145558 - DNA, 16 bp, H. sapiens
tgatcctcagcttgca

SEQ ID NO: 145559 - DNA, 16 bp, H. sapiens
tgatcctccaacttca

SEQ ID NO: 145560 - DNA, 16 bp, H. sapiens
tgatcctccacggggg

SEQ ID NO: 145561 - DNA, 16 bp, H. sapiens
tgatcctccagcctca

SEQ ID NO: 145562 - DNA, 16 bp, H. sapiens
tgatcctcccgccttg

SEQ ID NO: 145563 - DNA, 16 bp, H. sapiens
tgatcctcccttcttg

SEQ ID NO: 145564 - DNA, 16 bp, H. sapiens
tgatcctcctgcttgg

SEQ ID NO: 145565 - DNA, 16 bp, H. sapiens
tgatcctctccatcct

SEQ ID NO: 145566 - DNA, 16 bp, H. sapiens
tgatcctctccctgct

SEQ ID NO: 145567 - DNA, 16 bp, H. sapiens
tgatcctctgcctcct

SEQ ID NO: 145568 - DNA, 16 bp, H. sapiens
tgatcctgccattatg

SEQ ID NO: 145569 - DNA, 16 bp, H. sapiens
tgatcctgtcattctg

SEQ ID NO: 145570 - DNA, 16 bp, H. sapiens
tgatccttccatctca

SEQ ID NO: 145571 - DNA, 16 bp, H. sapiens
tgatccttccatcttg

SEQ ID NO: 145572 - DNA, 16 bp, H. sapiens
tgatcctttcaggtct

SEQ ID NO: 145573 - DNA, 16 bp, H. sapiens
tgatcctttgtattgt

SEQ ID NO: 145574 - DNA, 16 bp, H. sapiens
tgatccttttgcctca

SEQ ID NO: 145575 - DNA, 19 bp, H. sapiens
tgatcgagaccatcctggc

SEQ ID NO: 145576 - DNA, 16 bp, H. sapiens
tgatcgccattctagc

SEQ ID NO: 145577 - DNA, 17 bp, H. sapiens
tgatcggcctgcctcgg

SEQ ID NO: 145578 - DNA, 16 bp, H. sapiens
tgatctacatatttaa

SEQ ID NO: 145579 - DNA, 16 bp, H. sapiens
tgatctaccctcctca

SEQ ID NO: 145580 - DNA, 16 bp, H. sapiens
tgatctacttgcctca

SEQ ID NO: 145581 - DNA, 16 bp, H. sapiens
tgatctcacctcactg

SEQ ID NO: 145582 - DNA, 16 bp, H. sapiens
tgatctcactgatatg

SEQ ID NO: 145583 - DNA, 17 bp, H. sapiens
tgatctcagctcactgt

SEQ ID NO: 145584 - DNA, 16 bp, H. sapiens
tgatctcaggtaatcc

SEQ ID NO: 145585 - DNA, 16 bp, H. sapiens
tgatctcaggttatcc

SEQ ID NO: 145586 - DNA, 16 bp, H. sapiens
tgatctcattcctttt

SEQ ID NO: 145587 - DNA, 16 bp, H. sapiens
tgatctcattctattt

SEQ ID NO: 145588 - DNA, 16 bp, H. sapiens
tgatctcattcttttt

SEQ ID NO: 145589 - DNA, 16 bp, H. sapiens
tgatctcatttcatct

SEQ ID NO: 145590 - DNA, 16 bp, H. sapiens
tgatctcattttattt

SEQ ID NO: 145591 - DNA, 16 bp, H. sapiens
tgatctcctgacctta

SEQ ID NO: 145592 - DNA, 16 bp, H. sapiens
tgatctcgaactactg

SEQ ID NO: 145593 - DNA, 16 bp, H. sapiens
tgatctcgaactccta

SEQ ID NO: 145594 - DNA, 16 bp, H. sapiens
tgatctcgcttttcct

SEQ ID NO: 145595 - DNA, 22 bp, H. sapiens
tgatctcggctcactgcaagct

SEQ ID NO: 145596 - DNA, 19 bp, H. sapiens
tgatctcggctcactgcag

SEQ ID NO: 145597 - DNA, 17 bp, H. sapiens
tgatctctgtgacccac

SEQ ID NO: 145598 - DNA, 16 bp, H. sapiens
tgatctcttgaccttg

SEQ ID NO: 145599 - DNA, 16 bp, H. sapiens
tgatctgaatagacat

SEQ ID NO: 145600 - DNA, 16 bp, H. sapiens
tgatctgccagccttg

SEQ ID NO: 145601 - DNA, 16 bp, H. sapiens
tgatctgccgaccttg

SEQ ID NO: 145602 - DNA, 16 bp, H. sapiens
tgatctgccgcctcag

SEQ ID NO: 145603 - DNA, 16 bp, H. sapiens
tgatctgcctgcccca

SEQ ID NO: 145604 - DNA, 16 bp, H. sapiens
tgatctgcctgcctcc

SEQ ID NO: 145605 - DNA, 16 bp, H. sapiens
tgatctgcctgccttg

SEQ ID NO: 145606 - DNA, 16 bp, H. sapiens
tgatctgcctgccttt

SEQ ID NO: 145607 - DNA, 16 bp, H. sapiens
tgatctgctgtctgca

SEQ ID NO: 145608 - DNA, 16 bp, H. sapiens
tgatctgctttttgtc

SEQ ID NO: 145609 - DNA, 16 bp, H. sapiens
tgatctggcccctgcc

SEQ ID NO: 145610 - DNA, 16 bp, H. sapiens
tgatctggggcaagtt

SEQ ID NO: 145611 - DNA, 16 bp, H. sapiens
tgatctgggtggggcc

SEQ ID NO: 145612 - DNA, 16 bp, H. sapiens
tgatctggtttggctg

SEQ ID NO: 145613 - DNA, 16 bp, H. sapiens
tgatctgtccacctca

SEQ ID NO: 145614 - DNA, 16 bp, H. sapiens
tgatctgtccacttca

SEQ ID NO: 145615 - DNA, 16 bp, H. sapiens
tgatctgtggtcagtg

SEQ ID NO: 145616 - DNA, 16 bp, H. sapiens
tgatctgtgtgtctgt

SEQ ID NO: 145617 - DNA, 16 bp, H. sapiens
tgatctgttgcctaaa

SEQ ID NO: 145618 - DNA, 16 bp, H. sapiens
tgatctgtttgtctgt

SEQ ID NO: 145619 - DNA, 16 bp, H. sapiens
tgatcttaaaattcat

SEQ ID NO: 145620 - DNA, 16 bp, H. sapiens
tgatcttatatttgaa

SEQ ID NO: 145621 - DNA, 16 bp, H. sapiens
tgatcttatttttaaa

SEQ ID NO: 145622 - DNA, 16 bp, H. sapiens
tgatcttcagcaaagc

SEQ ID NO: 145623 - DNA, 17 bp, H. sapiens
tgatcttcagtctctga

SEQ ID NO: 145624 - DNA, 16 bp, H. sapiens
tgatcttcatttattt

SEQ ID NO: 145625 - DNA, 16 bp, H. sapiens
tgatcttccagcctca

SEQ ID NO: 145626 - DNA, 16 bp, H. sapiens
tgatcttcccacttca

SEQ ID NO: 145627 - DNA, 19 bp, H. sapiens
tgatcttcgacaaacctga

SEQ ID NO: 145628 - DNA, 16 bp, H. sapiens
tgatcttctatccaga

SEQ ID NO: 145629 - DNA, 16 bp, H. sapiens
tgatcttctccctctt

SEQ ID NO: 145630 - DNA, 17 bp, H. sapiens
tgatcttgaactcctgg

SEQ ID NO: 145631 - DNA, 16 bp, H. sapiens
tgatcttgagcaagtt

SEQ ID NO: 145632 - DNA, 16 bp, H. sapiens
tgatcttgcctcactg

SEQ ID NO: 145633 - DNA, 18 bp, H. sapiens
tgatcttggctaactgca

SEQ ID NO: 145634 - DNA, 16 bp, H. sapiens
tgatcttggctcaccg

SEQ ID NO: 145635 - DNA, 22 bp, H. sapiens
tgatcttggctcactgcaaccc

SEQ ID NO: 145636 - DNA, 16 bp, H. sapiens
tgatcttggctcattg

SEQ ID NO: 145637 - DNA, 16 bp, H. sapiens
tgatcttgggcaaatt

SEQ ID NO: 145638 - DNA, 16 bp, H. sapiens
tgatctttcttttccc

SEQ ID NO: 145639 - DNA, 16 bp, H. sapiens
tgatctttgataagaa

SEQ ID NO: 145640 - DNA, 16 bp, H. sapiens
tgatcttttcaagaaa

SEQ ID NO: 145641 - DNA, 16 bp, H. sapiens
tgatcttttgcatttc

SEQ ID NO: 145642 - DNA, 16 bp, H. sapiens
tgatcttttggaggag

SEQ ID NO: 145643 - DNA, 16 bp, H. sapiens
tgatctttttaatgtc

SEQ ID NO: 145644 - DNA, 16 bp, H. sapiens
tgatgaaaaactgaat

SEQ ID NO: 145645 - DNA, 16 bp, H. sapiens
tgatgaaaaagttctg

SEQ ID NO: 145646 - DNA, 16 bp, H. sapiens
tgatgaaaagaatgtg

SEQ ID NO: 145647 - DNA, 16 bp, H. sapiens
tgatgaaaataatttt

SEQ ID NO: 145648 - DNA, 16 bp, H. sapiens
tgatgaaaatattctg

SEQ ID NO: 145649 - DNA, 16 bp, H. sapiens
tgatgaaaatgttcca

SEQ ID NO: 145650 - DNA, 16 bp, H. sapiens
tgatgaaaccctgtat

SEQ ID NO: 145651 - DNA, 16 bp, H. sapiens
tgatgaaactgaagca

SEQ ID NO: 145652 - DNA, 16 bp, H. sapiens
tgatgaaagacataaa

SEQ ID NO: 145653 - DNA, 16 bp, H. sapiens
tgatgaaagcctgtct

SEQ ID NO: 145654 - DNA, 16 bp, H. sapiens
tgatgaaagtggctct

SEQ ID NO: 145655 - DNA, 16 bp, H. sapiens
tgatgaaataaattgt

SEQ ID NO: 145656 - DNA, 17 bp, H. sapiens
tgatgaaataatctgta

SEQ ID NO: 145657 - DNA, 16 bp, H. sapiens
tgatgaaataatttgt

SEQ ID NO: 145658 - DNA, 16 bp, H. sapiens
tgatgaaatcatttgt

SEQ ID NO: 145659 - DNA, 16 bp, H. sapiens
tgatgaaatccagttt

SEQ ID NO: 145660 - DNA, 16 bp, H. sapiens
tgatgaaatgaaatga

SEQ ID NO: 145661 - DNA, 16 bp, H. sapiens
tgatgaaatggaaaaa

SEQ ID NO: 145662 - DNA, 16 bp, H. sapiens
tgatgaaattatctgt

SEQ ID NO: 145663 - DNA, 16 bp, H. sapiens
tgatgaaattcaaaat

SEQ ID NO: 145664 - DNA, 16 bp, H. sapiens
tgatgaaattcaacat

SEQ ID NO: 145665 - DNA, 16 bp, H. sapiens
tgatgaaattcctcag

SEQ ID NO: 145666 - DNA, 17 bp, H. sapiens
tgatgaacactgatgca

SEQ ID NO: 145667 - DNA, 16 bp, H. sapiens
tgatgaacatagatgc

SEQ ID NO: 145668 - DNA, 27 bp, H. sapiens
tgatgaacatcgatgcaaaaatcctca

SEQ ID NO: 145669 - DNA, 16 bp, H. sapiens
tgatgaacatctttgt

SEQ ID NO: 145670 - DNA, 16 bp, H. sapiens
tgatgaacatggagaa

SEQ ID NO: 145671 - DNA, 17 bp, H. sapiens
tgatgaacattgatgca

SEQ ID NO: 145672 - DNA, 16 bp, H. sapiens
tgatgaacattgatgt

SEQ ID NO: 145673 - DNA, 16 bp, H. sapiens
tgatgaacattttggt

SEQ ID NO: 145674 - DNA, 16 bp, H. sapiens
tgatgaacattttttc

SEQ ID NO: 145675 - DNA, 16 bp, H. sapiens
tgatgaaccttttttg

SEQ ID NO: 145676 - DNA, 16 bp, H. sapiens
tgatgaagaaaatgtt

SEQ ID NO: 145677 - DNA, 16 bp, H. sapiens
tgatgaagaaattgaa

SEQ ID NO: 145678 - DNA, 16 bp, H. sapiens
tgatgaagacttcaaa

SEQ ID NO: 145679 - DNA, 16 bp, H. sapiens
tgatgaagatgaagac

SEQ ID NO: 145680 - DNA, 16 bp, H. sapiens
tgatgaagatgacaaa

SEQ ID NO: 145681 - DNA, 16 bp, H. sapiens
tgatgaagatgatggt

SEQ ID NO: 145682 - DNA, 16 bp, H. sapiens
tgatgaagatggtgat

SEQ ID NO: 145683 - DNA, 17 bp, H. sapiens
tgatgaagcagaagaaa

SEQ ID NO: 145684 - DNA, 16 bp, H. sapiens
tgatgaagcagtaaaa

SEQ ID NO: 145685 - DNA, 16 bp, H. sapiens
tgatgaagtttaattt

SEQ ID NO: 145686 - DNA, 16 bp, H. sapiens
tgatgaatatgctaat

SEQ ID NO: 145687 - DNA, 16 bp, H. sapiens
tgatgaatatgttaat

SEQ ID NO: 145688 - DNA, 16 bp, H. sapiens
tgatgaatatgttcat

SEQ ID NO: 145689 - DNA, 16 bp, H. sapiens
tgatgaatatttgagt

SEQ ID NO: 145690 - DNA, 16 bp, H. sapiens
tgatgaatcatgttta

SEQ ID NO: 145691 - DNA, 16 bp, H. sapiens
tgatgaatgaaaagaa

SEQ ID NO: 145692 - DNA, 16 bp, H. sapiens
tgatgaatgaatgcat

SEQ ID NO: 145693 - DNA, 16 bp, H. sapiens
tgatgacaatggcagt

SEQ ID NO: 145694 - DNA, 16 bp, H. sapiens
tgatgacaatggtgat

SEQ ID NO: 145695 - DNA, 16 bp, H. sapiens
tgatgacagcaccaag

SEQ ID NO: 145696 - DNA, 16 bp, H. sapiens
tgatgacagttatttc

SEQ ID NO: 145697 - DNA, 16 bp, H. sapiens
tgatgacatgaaatga

SEQ ID NO: 145698 - DNA, 16 bp, H. sapiens
tgatgacattttcttt

SEQ ID NO: 145699 - DNA, 16 bp, H. sapiens
tgatgacatttttatt

SEQ ID NO: 145700 - DNA, 16 bp, H. sapiens
tgatgacgatgatgac

SEQ ID NO: 145701 - DNA, 16 bp, H. sapiens
tgatgactaaatgcaa

SEQ ID NO: 145702 - DNA, 16 bp, H. sapiens
tgatgagaaagtgaaa

SEQ ID NO: 145703 - DNA, 16 bp, H. sapiens
tgatgagaaggagaaa

SEQ ID NO: 145704 - DNA, 16 bp, H. sapiens
tgatgagaatggcatt

SEQ ID NO: 145705 - DNA, 16 bp, H. sapiens
tgatgagaatgtaaat

SEQ ID NO: 145706 - DNA, 16 bp, H. sapiens
tgatgagcatttggat

SEQ ID NO: 145707 - DNA, 16 bp, H. sapiens
tgatgaggaaactgag

SEQ ID NO: 145708 - DNA, 16 bp, H. sapiens
tgatgaggaaattaag

SEQ ID NO: 145709 - DNA, 16 bp, H. sapiens
tgatgaggaagctgag

SEQ ID NO: 145710 - DNA, 16 bp, H. sapiens
tgatgaggatggcatt

SEQ ID NO: 145711 - DNA, 16 bp, H. sapiens
tgatgaggatgtagag

SEQ ID NO: 145712 - DNA, 16 bp, H. sapiens
tgatgaggatgtggaa

SEQ ID NO: 145713 - DNA, 16 bp, H. sapiens
tgatgaggattttttc

SEQ ID NO: 145714 - DNA, 16 bp, H. sapiens
tgatgagggtgtggag

SEQ ID NO: 145715 - DNA, 16 bp, H. sapiens
tgatgagttaatggat

SEQ ID NO: 145716 - DNA, 16 bp, H. sapiens
tgatgataaaatttaa

SEQ ID NO: 145717 - DNA, 16 bp, H. sapiens
tgatgataataataac

SEQ ID NO: 145718 - DNA, 16 bp, H. sapiens
tgatgatagccatcct

SEQ ID NO: 145719 - DNA, 16 bp, H. sapiens
tgatgatagtgatgat

SEQ ID NO: 145720 - DNA, 16 bp, H. sapiens
tgatgatagtttcctt

SEQ ID NO: 145721 - DNA, 16 bp, H. sapiens
tgatgatattgatgat

SEQ ID NO: 145722 - DNA, 16 bp, H. sapiens
tgatgatcttgaccct

SEQ ID NO: 145723 - DNA, 16 bp, H. sapiens
tgatgatgaagaagat

SEQ ID NO: 145724 - DNA, 16 bp, H. sapiens
tgatgatgaagatggt

SEQ ID NO: 145725 - DNA, 16 bp, H. sapiens
tgatgatgacaatgac

SEQ ID NO: 145726 - DNA, 16 bp, H. sapiens
tgatgatgacagtgat

SEQ ID NO: 145727 - DNA, 16 bp, H. sapiens
tgatgatgagaatttt

SEQ ID NO: 145728 - DNA, 16 bp, H. sapiens
tgatgatgaggttttt

SEQ ID NO: 145729 - DNA, 16 bp, H. sapiens
tgatgatgagtatttt

SEQ ID NO: 145730 - DNA, 16 bp, H. sapiens
tgatgatgataaaata

SEQ ID NO: 145731 - DNA, 16 bp, H. sapiens
tgatgatgataaagat

SEQ ID NO: 145732 - DNA, 16 bp, H. sapiens
tgatgatgatgaaaat

SEQ ID NO: 145733 - DNA, 16 bp, H. sapiens
tgatgatgatgacaaa

SEQ ID NO: 145734 - DNA, 16 bp, H. sapiens
tgatgatgatgacagc

SEQ ID NO: 145735 - DNA, 16 bp, H. sapiens
tgatgatgatgaggat

SEQ ID NO: 145736 - DNA, 16 bp, H. sapiens
tgatgatgatgataaa

SEQ ID NO: 145737 - DNA, 16 bp, H. sapiens
tgatgatgatgatgat

SEQ ID NO: 145738 - DNA, 16 bp, H. sapiens
tgatgatgatgatggg

SEQ ID NO: 145739 - DNA, 16 bp, H. sapiens
tgatgatgatgatggt

SEQ ID NO: 145740 - DNA, 16 bp, H. sapiens
tgatgatgatgattct

SEQ ID NO: 145741 - DNA, 16 bp, H. sapiens
tgatgatgatgatttg

SEQ ID NO: 145742 - DNA, 16 bp, H. sapiens
tgatgatgatgctgat

SEQ ID NO: 145743 - DNA, 16 bp, H. sapiens
tgatgatgatggcaat

SEQ ID NO: 145744 - DNA, 16 bp, H. sapiens
tgatgatgatggtggt

SEQ ID NO: 145745 - DNA, 16 bp, H. sapiens
tgatgatgatgttgtt

SEQ ID NO: 145746 - DNA, 16 bp, H. sapiens
tgatgatgattattat

SEQ ID NO: 145747 - DNA, 16 bp, H. sapiens
tgatgatgattgcatt

SEQ ID NO: 145748 - DNA, 16 bp, H. sapiens
tgatgatggacactta

SEQ ID NO: 145749 - DNA, 16 bp, H. sapiens
tgatgatggtgttgat

SEQ ID NO: 145750 - DNA, 16 bp, H. sapiens
tgatgatggtgttggt

SEQ ID NO: 145751 - DNA, 16 bp, H. sapiens
tgatgatgtcattgct

SEQ ID NO: 145752 - DNA, 16 bp, H. sapiens
tgatgatgtcctttga

SEQ ID NO: 145753 - DNA, 16 bp, H. sapiens
tgatgattcagatgat

SEQ ID NO: 145754 - DNA, 16 bp, H. sapiens
tgatgattgattgatt

SEQ ID NO: 145755 - DNA, 16 bp, H. sapiens
tgatgattgtgctttt

SEQ ID NO: 145756 - DNA, 16 bp, H. sapiens
tgatgattttataaat

SEQ ID NO: 145757 - DNA, 16 bp, H. sapiens
tgatgattttataagg

SEQ ID NO: 145758 - DNA, 16 bp, H. sapiens
tgatgattttttaaaa

SEQ ID NO: 145759 - DNA, 16 bp, H. sapiens
tgatgatttttttcat

SEQ ID NO: 145760 - DNA, 16 bp, H. sapiens
tgatgcaaaatcctca

SEQ ID NO: 145761 - DNA, 16 bp, H. sapiens
tgatgcaagaagtggg

SEQ ID NO: 145762 - DNA, 16 bp, H. sapiens
tgatgcaagaccagca

SEQ ID NO: 145763 - DNA, 16 bp, H. sapiens
tgatgcaagaggtagg

SEQ ID NO: 145764 - DNA, 16 bp, H. sapiens
tgatgcaatcttggct

SEQ ID NO: 145765 - DNA, 16 bp, H. sapiens
tgatgcaatgtgagaa

SEQ ID NO: 145766 - DNA, 16 bp, H. sapiens
tgatgcacagagaggt

SEQ ID NO: 145767 - DNA, 16 bp, H. sapiens
tgatgcagaagatggg

SEQ ID NO: 145768 - DNA, 16 bp, H. sapiens
tgatgcaggaggatca

SEQ ID NO: 145769 - DNA, 16 bp, H. sapiens
tgatgcaggcatttat

SEQ ID NO: 145770 - DNA, 16 bp, H. sapiens
tgatgcccacgctgga

SEQ ID NO: 145771 - DNA, 16 bp, H. sapiens
tgatgcctccagctgt

SEQ ID NO: 145772 - DNA, 24 bp, H. sapiens
tgatgcctccagctttgttctttt

SEQ ID NO: 145773 - DNA, 16 bp, H. sapiens
tgatgcctcctgcttt

SEQ ID NO: 145774 - DNA, 16 bp, H. sapiens
tgatgcctgggtccca

SEQ ID NO: 145775 - DNA, 19 bp, H. sapiens
tgatgcgcctgccttggcc

SEQ ID NO: 145776 - DNA, 16 bp, H. sapiens
tgatgctcagactcat

SEQ ID NO: 145777 - DNA, 16 bp, H. sapiens
tgatgctcctgctctg

SEQ ID NO: 145778 - DNA, 16 bp, H. sapiens
tgatgctcctgcttca

SEQ ID NO: 145779 - DNA, 16 bp, H. sapiens
tgatgctgacactgct

SEQ ID NO: 145780 - DNA, 16 bp, H. sapiens
tgatgctgaccttgtg

SEQ ID NO: 145781 - DNA, 16 bp, H. sapiens
tgatgctgagcttttt

SEQ ID NO: 145782 - DNA, 16 bp, H. sapiens
tgatgctgataaagac

SEQ ID NO: 145783 - DNA, 16 bp, H. sapiens
tgatgctgatgatgct

SEQ ID NO: 145784 - DNA, 16 bp, H. sapiens
tgatgctgatgctatt

SEQ ID NO: 145785 - DNA, 16 bp, H. sapiens
tgatgctgatgctgtt

SEQ ID NO: 145786 - DNA, 16 bp, H. sapiens
tgatgctgatggtggt

SEQ ID NO: 145787 - DNA, 16 bp, H. sapiens
tgatgctgctgatcca

SEQ ID NO: 145788 - DNA, 16 bp, H. sapiens
tgatgctgctgctgat

SEQ ID NO: 145789 - DNA, 16 bp, H. sapiens
tgatgctgctgctgct

SEQ ID NO: 145790 - DNA, 16 bp, H. sapiens
tgatgctgctgcttct

SEQ ID NO: 145791 - DNA, 16 bp, H. sapiens
tgatgctgctggtttg

SEQ ID NO: 145792 - DNA, 16 bp, H. sapiens
tgatgctggcctcaaa

SEQ ID NO: 145793 - DNA, 16 bp, H. sapiens
tgatgctggcctcaca

SEQ ID NO: 145794 - DNA, 16 bp, H. sapiens
tgatgctgtccctccc

SEQ ID NO: 145795 - DNA, 16 bp, H. sapiens
tgatgcttgctctgtc

SEQ ID NO: 145796 - DNA, 16 bp, H. sapiens
tgatgctttctgactg

SEQ ID NO: 145797 - DNA, 16 bp, H. sapiens
tgatgctttctgtttt

SEQ ID NO: 145798 - DNA, 16 bp, H. sapiens
tgatggaaaaggaaat

SEQ ID NO: 145799 - DNA, 16 bp, H. sapiens
tgatggaaataaaaat

SEQ ID NO: 145800 - DNA, 16 bp, H. sapiens
tgatggaaatgctcta

SEQ ID NO: 145801 - DNA, 16 bp, H. sapiens
tgatggaaatgtccta

SEQ ID NO: 145802 - DNA, 16 bp, H. sapiens
tgatggaaatgttcta

SEQ ID NO: 145803 - DNA, 16 bp, H. sapiens
tgatggaaatgtttat

SEQ ID NO: 145804 - DNA, 16 bp, H. sapiens
tgatggaacatatctt

SEQ ID NO: 145805 - DNA, 16 bp, H. sapiens
tgatggaagaaattga

SEQ ID NO: 145806 - DNA, 20 bp, H. sapiens
tgatggaagacgaaatgaat

SEQ ID NO: 145807 - DNA, 16 bp, H. sapiens
tgatggaagtataaca

SEQ ID NO: 145808 - DNA, 16 bp, H. sapiens
tgatggaagttcattt

SEQ ID NO: 145809 - DNA, 16 bp, H. sapiens
tgatggaattacaggt

SEQ ID NO: 145810 - DNA, 16 bp, H. sapiens
tgatggacacctgggt

SEQ ID NO: 145811 - DNA, 16 bp, H. sapiens
tgatggacagtgatgg

SEQ ID NO: 145812 - DNA, 16 bp, H. sapiens
tgatggacatctgggt

SEQ ID NO: 145813 - DNA, 16 bp, H. sapiens
tgatggacatttgagt

SEQ ID NO: 145814 - DNA, 16 bp, H. sapiens
tgatggacatttgggt

SEQ ID NO: 145815 - DNA, 16 bp, H. sapiens
tgatggacatttgttt

SEQ ID NO: 145816 - DNA, 16 bp, H. sapiens
tgatggagaaataaaa

SEQ ID NO: 145817 - DNA, 16 bp, H. sapiens
tgatggagagagaaag

SEQ ID NO: 145818 - DNA, 16 bp, H. sapiens
tgatggagatggagat

SEQ ID NO: 145819 - DNA, 16 bp, H. sapiens
tgatggaggtgaaaac

SEQ ID NO: 145820 - DNA, 16 bp, H. sapiens
tgatggaggtgatggt

SEQ ID NO: 145821 - DNA, 16 bp, H. sapiens
tgatggagtgagactc

SEQ ID NO: 145822 - DNA, 16 bp, H. sapiens
tgatggagtttcttca

SEQ ID NO: 145823 - DNA, 16 bp, H. sapiens
tgatggatattccaat

SEQ ID NO: 145824 - DNA, 16 bp, H. sapiens
tgatggatatttaagt

SEQ ID NO: 145825 - DNA, 16 bp, H. sapiens
tgatggatatttagat

SEQ ID NO: 145826 - DNA, 16 bp, H. sapiens
tgatggatctggacaa

SEQ ID NO: 145827 - DNA, 16 bp, H. sapiens
tgatggatctgggcaa

SEQ ID NO: 145828 - DNA, 16 bp, H. sapiens
tgatggattgcattta

SEQ ID NO: 145829 - DNA, 16 bp, H. sapiens
tgatggcacctgcctg

SEQ ID NO: 145830 - DNA, 16 bp, H. sapiens
tgatggcagcagcagc

SEQ ID NO: 145831 - DNA, 16 bp, H. sapiens
tgatggcagcagccac

SEQ ID NO: 145832 - DNA, 16 bp, H. sapiens
tgatggcagcagctgc

SEQ ID NO: 145833 - DNA, 16 bp, H. sapiens
tgatggcaggagcctg

SEQ ID NO: 145834 - DNA, 16 bp, H. sapiens
tgatggcaggcatctg

SEQ ID NO: 145835 - DNA, 16 bp, H. sapiens
tgatggcagtggctgc

SEQ ID NO: 145836 - DNA, 16 bp, H. sapiens
tgatggcgcgcgcctg

SEQ ID NO: 145837 - DNA, 16 bp, H. sapiens
tgatggctcacacctg

SEQ ID NO: 145838 - DNA, 16 bp, H. sapiens
tgatggctcacccctg

SEQ ID NO: 145839 - DNA, 16 bp, H. sapiens
tgatggctctgaagag

SEQ ID NO: 145840 - DNA, 16 bp, H. sapiens
tgatggctgcagaaca

SEQ ID NO: 145841 - DNA, 16 bp, H. sapiens
tgatggctggagctct

SEQ ID NO: 145842 - DNA, 16 bp, H. sapiens
tgatggcttctatttt

SEQ ID NO: 145843 - DNA, 16 bp, H. sapiens
tgatggcttggaaaaa

SEQ ID NO: 145844 - DNA, 16 bp, H. sapiens
tgatggctttaaaaat

SEQ ID NO: 145845 - DNA, 16 bp, H. sapiens
tgatgggagacagtga

SEQ ID NO: 145846 - DNA, 16 bp, H. sapiens
tgatgggaggcagtga

SEQ ID NO: 145847 - DNA, 16 bp, H. sapiens
tgatgggattacaggt

SEQ ID NO: 145848 - DNA, 16 bp, H. sapiens
tgatgggcagccaggc

SEQ ID NO: 145849 - DNA, 16 bp, H. sapiens
tgatgggccccagtgt

SEQ ID NO: 145850 - DNA, 16 bp, H. sapiens
tgatgggcctttgggt

SEQ ID NO: 145851 - DNA, 16 bp, H. sapiens
tgatgggcttgttttt

SEQ ID NO: 145852 - DNA, 32 bp, H. sapiens
tgatggggaaaaatggccacctgagggaagta

SEQ ID NO: 145853 - DNA, 16 bp, H. sapiens
tgatggggacagtgtc

SEQ ID NO: 145854 - DNA, 16 bp, H. sapiens
tgatggggacatggag

SEQ ID NO: 145855 - DNA, 16 bp, H. sapiens
tgatgggggaaaaaaa

SEQ ID NO: 145856 - DNA, 16 bp, H. sapiens
tgatggggttgttttc

SEQ ID NO: 145857 - DNA, 16 bp, H. sapiens
tgatgggtacagcaaa

SEQ ID NO: 145858 - DNA, 16 bp, H. sapiens
tgatgggtgcaggaaa

SEQ ID NO: 145859 - DNA, 16 bp, H. sapiens
tgatgggttgacaggt

SEQ ID NO: 145860 - DNA, 16 bp, H. sapiens
tgatgggtttatcagg

SEQ ID NO: 145861 - DNA, 16 bp, H. sapiens
tgatggtagttggtat

SEQ ID NO: 145862 - DNA, 16 bp, H. sapiens
tgatggtatttggaga

SEQ ID NO: 145863 - DNA, 16 bp, H. sapiens
tgatggtgaaggtggt

SEQ ID NO: 145864 - DNA, 16 bp, H. sapiens
tgatggtgatgatgaa

SEQ ID NO: 145865 - DNA, 16 bp, H. sapiens
tgatggtgatgatgac

SEQ ID NO: 145866 - DNA, 16 bp, H. sapiens
tgatggtgcaggcctg

SEQ ID NO: 145867 - DNA, 16 bp, H. sapiens
tgatggtgccattgca

SEQ ID NO: 145868 - DNA, 16 bp, H. sapiens
tgatggtggcggtggt

SEQ ID NO: 145869 - DNA, 17 bp, H. sapiens
tgatggtggtattctga

SEQ ID NO: 145870 - DNA, 16 bp, H. sapiens
tgatggtggtgatgat

SEQ ID NO: 145871 - DNA, 16 bp, H. sapiens
tgatggtggtgatgct

SEQ ID NO: 145872 - DNA, 16 bp, H. sapiens
tgatggtggtgatggt

SEQ ID NO: 145873 - DNA, 16 bp, H. sapiens
tgatggtggtggtagt

SEQ ID NO: 145874 - DNA, 16 bp, H. sapiens
tgatggtgtgtacctg

SEQ ID NO: 145875 - DNA, 16 bp, H. sapiens
tgatggtgttgatgat

SEQ ID NO: 145876 - DNA, 16 bp, H. sapiens
tgatggtgtttggagg

SEQ ID NO: 145877 - DNA, 16 bp, H. sapiens
tgatggttaatttcag

SEQ ID NO: 145878 - DNA, 16 bp, H. sapiens
tgatggttaattttag

SEQ ID NO: 145879 - DNA, 16 bp, H. sapiens
tgatggttaattttat

SEQ ID NO: 145880 - DNA, 16 bp, H. sapiens
tgatggttatgatgat

SEQ ID NO: 145881 - DNA, 16 bp, H. sapiens
tgatggtttaaaaatg

SEQ ID NO: 145882 - DNA, 17 bp, H. sapiens
tgatggttttataaaga

SEQ ID NO: 145883 - DNA, 16 bp, H. sapiens
tgatggttttataagc

SEQ ID NO: 145884 - DNA, 16 bp, H. sapiens
tgatggttttatgagg

SEQ ID NO: 145885 - DNA, 16 bp, H. sapiens
tgatgtacagaaaatg

SEQ ID NO: 145886 - DNA, 16 bp, H. sapiens
tgatgtacattctcag

SEQ ID NO: 145887 - DNA, 18 bp, H. sapiens
tgatgtacctgaaagtga

SEQ ID NO: 145888 - DNA, 16 bp, H. sapiens
tgatgtatttctccat

SEQ ID NO: 145889 - DNA, 16 bp, H. sapiens
tgatgtcaagagttca

SEQ ID NO: 145890 - DNA, 16 bp, H. sapiens
tgatgtcaggagtttg

SEQ ID NO: 145891 - DNA, 21 bp, H. sapiens
tgatgtccactataacacagg

SEQ ID NO: 145892 - DNA, 16 bp, H. sapiens
tgatgtctgggatttg

SEQ ID NO: 145893 - DNA, 16 bp, H. sapiens
tgatgtctttggtttt

SEQ ID NO: 145894 - DNA, 16 bp, H. sapiens
tgatgtgaacagcttt

SEQ ID NO: 145895 - DNA, 16 bp, H. sapiens
tgatgtgatctgattt

SEQ ID NO: 145896 - DNA, 16 bp, H. sapiens
tgatgtgatgaattac

SEQ ID NO: 145897 - DNA, 16 bp, H. sapiens
tgatgtgatggtggtg

SEQ ID NO: 145898 - DNA, 16 bp, H. sapiens
tgatgtgattgttatg

SEQ ID NO: 145899 - DNA, 16 bp, H. sapiens
tgatgtgcatttctct

SEQ ID NO: 145900 - DNA, 16 bp, H. sapiens
tgatgtgctcctggat

SEQ ID NO: 145901 - DNA, 16 bp, H. sapiens
tgatgtgcttcccttt

SEQ ID NO: 145902 - DNA, 16 bp, H. sapiens
tgatgtgggaggatgg

SEQ ID NO: 145903 - DNA, 16 bp, H. sapiens
tgatgtggtgctggat

SEQ ID NO: 145904 - DNA, 16 bp, H. sapiens
tgatgtgtcacattta

SEQ ID NO: 145905 - DNA, 16 bp, H. sapiens
tgatgtgtctgctccc

SEQ ID NO: 145906 - DNA, 16 bp, H. sapiens
tgatgttaacattgtt

SEQ ID NO: 145907 - DNA, 16 bp, H. sapiens
tgatgttaaccaatca

SEQ ID NO: 145908 - DNA, 16 bp, H. sapiens
tgatgttaactgtagg

SEQ ID NO: 145909 - DNA, 16 bp, H. sapiens
tgatgttaactttgat

SEQ ID NO: 145910 - DNA, 16 bp, H. sapiens
tgatgttaagcatttt

SEQ ID NO: 145911 - DNA, 16 bp, H. sapiens
tgatgttaagcttttt

SEQ ID NO: 145912 - DNA, 16 bp, H. sapiens
tgatgttaattttgat

SEQ ID NO: 145913 - DNA, 16 bp, H. sapiens
tgatgttcagcttttt

SEQ ID NO: 145914 - DNA, 16 bp, H. sapiens
tgatgttcctcttcct

SEQ ID NO: 145915 - DNA, 16 bp, H. sapiens
tgatgttcctgaggaa

SEQ ID NO: 145916 - DNA, 16 bp, H. sapiens
tgatgttgactttgat

SEQ ID NO: 145917 - DNA, 16 bp, H. sapiens
tgatgttgagcttctt

SEQ ID NO: 145918 - DNA, 16 bp, H. sapiens
tgatgttgagctttct

SEQ ID NO: 145919 - DNA, 16 bp, H. sapiens
tgatgttgagtatttt

SEQ ID NO: 145920 - DNA, 16 bp, H. sapiens
tgatgttgatcatttt

SEQ ID NO: 145921 - DNA, 16 bp, H. sapiens
tgatgttgatgatgat

SEQ ID NO: 145922 - DNA, 16 bp, H. sapiens
tgatgttgatggtgat

SEQ ID NO: 145923 - DNA, 16 bp, H. sapiens
tgatgttgcatgcctg

SEQ ID NO: 145924 - DNA, 16 bp, H. sapiens
tgatgttgctgctgct

SEQ ID NO: 145925 - DNA, 16 bp, H. sapiens
tgatgttgctggtctg

SEQ ID NO: 145926 - DNA, 16 bp, H. sapiens
tgatgttgggttagca

SEQ ID NO: 145927 - DNA, 16 bp, H. sapiens
tgatgttggtaatttg

SEQ ID NO: 145928 - DNA, 16 bp, H. sapiens
tgatgtttaacacagg

SEQ ID NO: 145929 - DNA, 16 bp, H. sapiens
tgatgtttacatttca

SEQ ID NO: 145930 - DNA, 16 bp, H. sapiens
tgatgtttatggtttc

SEQ ID NO: 145931 - DNA, 16 bp, H. sapiens
tgatgtttattatttc

SEQ ID NO: 145932 - DNA, 16 bp, H. sapiens
tgatgtttcaatacat

SEQ ID NO: 145933 - DNA, 16 bp, H. sapiens
tgatgtttgtattcaa

SEQ ID NO: 145934 - DNA, 16 bp, H. sapiens
tgatgttttaaaatgt

SEQ ID NO: 145935 - DNA, 16 bp, H. sapiens
tgatgttttgatacat

SEQ ID NO: 145936 - DNA, 16 bp, H. sapiens
tgatgttttgatagat

SEQ ID NO: 145937 - DNA, 16 bp, H. sapiens
tgattaaaaacaaaat

SEQ ID NO: 145938 - DNA, 16 bp, H. sapiens
tgattaaaacaaaaca

SEQ ID NO: 145939 - DNA, 16 bp, H. sapiens
tgattaaacttagtga

SEQ ID NO: 145940 - DNA, 16 bp, H. sapiens
tgattacagaggctga

SEQ ID NO: 145941 - DNA, 16 bp, H. sapiens
tgattacatgttgaaa

SEQ ID NO: 145942 - DNA, 16 bp, H. sapiens
tgattactacaatcaa

SEQ ID NO: 145943 - DNA, 16 bp, H. sapiens
tgattagtgatgatga

SEQ ID NO: 145944 - DNA, 16 bp, H. sapiens
tgattagtgatgtctg

SEQ ID NO: 145945 - DNA, 16 bp, H. sapiens
tgattatcagagaaat

SEQ ID NO: 145946 - DNA, 16 bp, H. sapiens
tgattatctttttgtg

SEQ ID NO: 145947 - DNA, 16 bp, H. sapiens
tgattatgatgtgcct

SEQ ID NO: 145948 - DNA, 16 bp, H. sapiens
tgattatgattatgat

SEQ ID NO: 145949 - DNA, 16 bp, H. sapiens
tgattatggtcattct

SEQ ID NO: 145950 - DNA, 16 bp, H. sapiens
tgattattacacattg

SEQ ID NO: 145951 - DNA, 16 bp, H. sapiens
tgattattagagaaat

SEQ ID NO: 145952 - DNA, 16 bp, H. sapiens
tgattattgtggcttt

SEQ ID NO: 145953 - DNA, 16 bp, H. sapiens
tgattatttcacaatt

SEQ ID NO: 145954 - DNA, 16 bp, H. sapiens
tgattatttcttttgc

SEQ ID NO: 145955 - DNA, 16 bp, H. sapiens
tgattatttgaaaaga

SEQ ID NO: 145956 - DNA, 16 bp, H. sapiens
tgattattttaagaaa

SEQ ID NO: 145957 - DNA, 16 bp, H. sapiens
tgattattttcttcat

SEQ ID NO: 145958 - DNA, 16 bp, H. sapiens
tgattattttgagaaa

SEQ ID NO: 145959 - DNA, 16 bp, H. sapiens
tgattatttttctcct

SEQ ID NO: 145960 - DNA, 16 bp, H. sapiens
tgattcaatcttggga

SEQ ID NO: 145961 - DNA, 16 bp, H. sapiens
tgattcacagttcagc

SEQ ID NO: 145962 - DNA, 16 bp, H. sapiens
tgattcacatcccagg

SEQ ID NO: 145963 - DNA, 16 bp, H. sapiens
tgattcagaaccattt

SEQ ID NO: 145964 - DNA, 16 bp, H. sapiens
tgattcagaatatgaa

SEQ ID NO: 145965 - DNA, 16 bp, H. sapiens
tgattcagcaatccta

SEQ ID NO: 145966 - DNA, 16 bp, H. sapiens
tgattcagcaatctca

SEQ ID NO: 145967 - DNA, 16 bp, H. sapiens
tgattcagcagcttgg

SEQ ID NO: 145968 - DNA, 16 bp, H. sapiens
tgattcagtttcagaa

SEQ ID NO: 145969 - DNA, 16 bp, H. sapiens
tgattcagtttcttca

SEQ ID NO: 145970 - DNA, 16 bp, H. sapiens
tgattcatgtcccagg

SEQ ID NO: 145971 - DNA, 16 bp, H. sapiens
tgattcatttgcatat

SEQ ID NO: 145972 - DNA, 16 bp, H. sapiens
tgattccaaagcctgg

SEQ ID NO: 145973 - DNA, 16 bp, H. sapiens
tgattccagagcctgt

SEQ ID NO: 145974 - DNA, 16 bp, H. sapiens
tgattccaggagctgg

SEQ ID NO: 145975 - DNA, 16 bp, H. sapiens
tgattccattccattc

SEQ ID NO: 145976 - DNA, 16 bp, H. sapiens
tgattccatttttgtt

SEQ ID NO: 145977 - DNA, 16 bp, H. sapiens
tgattcctctgcctca

SEQ ID NO: 145978 - DNA, 16 bp, H. sapiens
tgattcctgtcagagg

SEQ ID NO: 145979 - DNA, 16 bp, H. sapiens
tgattccttacttttt

SEQ ID NO: 145980 - DNA, 16 bp, H. sapiens
tgattctaatgcctca

SEQ ID NO: 145981 - DNA, 16 bp, H. sapiens
tgattctatttttaaa

SEQ ID NO: 145982 - DNA, 16 bp, H. sapiens
tgattctcaaatttta

SEQ ID NO: 145983 - DNA, 16 bp, H. sapiens
tgattctcagtttggt

SEQ ID NO: 145984 - DNA, 17 bp, H. sapiens
tgattctcccgcctcag

SEQ ID NO: 145985 - DNA, 16 bp, H. sapiens
tgattctcctgattca

SEQ ID NO: 145986 - DNA, 16 bp, H. sapiens
tgattctcctgccgca

SEQ ID NO: 145987 - DNA, 18 bp, H. sapiens
tgattctgatgcacacta

SEQ ID NO: 145988 - DNA, 16 bp, H. sapiens
tgattctgattctgat

SEQ ID NO: 145989 - DNA, 16 bp, H. sapiens
tgattctgggaaaact

SEQ ID NO: 145990 - DNA, 16 bp, H. sapiens
tgattctgttttgatc

SEQ ID NO: 145991 - DNA, 16 bp, H. sapiens
tgattcttctctctct

SEQ ID NO: 145992 - DNA, 16 bp, H. sapiens
tgattcttctctttct

SEQ ID NO: 145993 - DNA, 16 bp, H. sapiens
tgattcttctgcctcc

SEQ ID NO: 145994 - DNA, 16 bp, H. sapiens
tgattcttctgcttca

SEQ ID NO: 145995 - DNA, 16 bp, H. sapiens
tgattcttcttattca

SEQ ID NO: 145996 - DNA, 16 bp, H. sapiens
tgattcttctttctct

SEQ ID NO: 145997 - DNA, 16 bp, H. sapiens
tgattcttgcacctca

SEQ ID NO: 145998 - DNA, 16 bp, H. sapiens
tgattctttcaatcca

SEQ ID NO: 145999 - DNA, 16 bp, H. sapiens
tgattcttttcttctg

SEQ ID NO: 146000 - DNA, 16 bp, H. sapiens
tgattgagcagtttga

SEQ ID NO: 146001 - DNA, 16 bp, H. sapiens
tgattgagcccaggag

SEQ ID NO: 146002 - DNA, 16 bp, H. sapiens
tgattgatgatgttga

SEQ ID NO: 146003 - DNA, 16 bp, H. sapiens
tgattgatgcagaaga

SEQ ID NO: 146004 - DNA, 16 bp, H. sapiens
tgattgattgaatcat

SEQ ID NO: 146005 - DNA, 16 bp, H. sapiens
tgattgattgatagat

SEQ ID NO: 146006 - DNA, 16 bp, H. sapiens
tgattgcaccactgca

SEQ ID NO: 146007 - DNA, 17 bp, H. sapiens
tgattgcaccactgcat

SEQ ID NO: 146008 - DNA, 16 bp, H. sapiens
tgattgcactattgca

SEQ ID NO: 146009 - DNA, 16 bp, H. sapiens
tgattgcatccaggca

SEQ ID NO: 146010 - DNA, 16 bp, H. sapiens
tgattgcattttcttt

SEQ ID NO: 146011 - DNA, 17 bp, H. sapiens
tgattgcctcctttgga

SEQ ID NO: 146012 - DNA, 16 bp, H. sapiens
tgattgctttaaaaat

SEQ ID NO: 146013 - DNA, 16 bp, H. sapiens
tgattggactttattt

SEQ ID NO: 146014 - DNA, 16 bp, H. sapiens
tgattggaggctgttg

SEQ ID NO: 146015 - DNA, 17 bp, H. sapiens
tgattggagtacctgaa

SEQ ID NO: 146016 - DNA, 16 bp, H. sapiens
tgattggatcatgggg

SEQ ID NO: 146017 - DNA, 16 bp, H. sapiens
tgattgggaaggaatg

SEQ ID NO: 146018 - DNA, 16 bp, H. sapiens
tgattgggcagtttgg

SEQ ID NO: 146019 - DNA, 16 bp, H. sapiens
tgattggggaagtgat

SEQ ID NO: 146020 - DNA, 17 bp, H. sapiens
tgattggtagagcccag

SEQ ID NO: 146021 - DNA, 16 bp, H. sapiens
tgattggtatgagatg

SEQ ID NO: 146022 - DNA, 16 bp, H. sapiens
tgattggtccagggat

SEQ ID NO: 146023 - DNA, 22 bp, H. sapiens
tgattggtgtacctgaaagtga

SEQ ID NO: 146024 - DNA, 16 bp, H. sapiens
tgattggttgatgaaa

SEQ ID NO: 146025 - DNA, 16 bp, H. sapiens
tgattgtaacaaatgt

SEQ ID NO: 146026 - DNA, 16 bp, H. sapiens
tgattgtaccactgta

SEQ ID NO: 146027 - DNA, 16 bp, H. sapiens
tgattgtacttatttg

SEQ ID NO: 146028 - DNA, 16 bp, H. sapiens
tgattgtagatttcct

SEQ ID NO: 146029 - DNA, 16 bp, H. sapiens
tgattgtgaggcctcc

SEQ ID NO: 146030 - DNA, 16 bp, H. sapiens
tgattgtgaggcttct

SEQ ID NO: 146031 - DNA, 16 bp, H. sapiens
tgattgtgatggtggt

SEQ ID NO: 146032 - DNA, 16 bp, H. sapiens
tgattgtgccacttca

SEQ ID NO: 146033 - DNA, 16 bp, H. sapiens
tgattgttagagaaat

SEQ ID NO: 146034 - DNA, 16 bp, H. sapiens
tgattgttttaaacaa

SEQ ID NO: 146035 - DNA, 16 bp, H. sapiens
tgatttaaaaaatcaa

SEQ ID NO: 146036 - DNA, 16 bp, H. sapiens
tgatttaaaaactttt

SEQ ID NO: 146037 - DNA, 16 bp, H. sapiens
tgatttaaaacatttt

SEQ ID NO: 146038 - DNA, 16 bp, H. sapiens
tgatttaaaatatctt

SEQ ID NO: 146039 - DNA, 16 bp, H. sapiens
tgatttaaagaaaact

SEQ ID NO: 146040 - DNA, 16 bp, H. sapiens
tgatttaaagtatact

SEQ ID NO: 146041 - DNA, 16 bp, H. sapiens
tgatttaatactgcat

SEQ ID NO: 146042 - DNA, 16 bp, H. sapiens
tgatttaatttcagaa

SEQ ID NO: 146043 - DNA, 16 bp, H. sapiens
tgatttacaaatattt

SEQ ID NO: 146044 - DNA, 16 bp, H. sapiens
tgatttacatttttct

SEQ ID NO: 146045 - DNA, 16 bp, H. sapiens
tgatttagataatgag

SEQ ID NO: 146046 - DNA, 16 bp, H. sapiens
tgatttaggagtcatg

SEQ ID NO: 146047 - DNA, 16 bp, H. sapiens
tgatttatattcattt

SEQ ID NO: 146048 - DNA, 16 bp, H. sapiens
tgatttatgacaaaga

SEQ ID NO: 146049 - DNA, 16 bp, H. sapiens
tgatttatgccttaat

SEQ ID NO: 146050 - DNA, 16 bp, H. sapiens
tgatttatgtctttgc

SEQ ID NO: 146051 - DNA, 16 bp, H. sapiens
tgatttattctttaac

SEQ ID NO: 146052 - DNA, 16 bp, H. sapiens
tgatttcaaactatgc

SEQ ID NO: 146053 - DNA, 16 bp, H. sapiens
tgatttcaagagcaga

SEQ ID NO: 146054 - DNA, 16 bp, H. sapiens
tgatttcaattatttt

SEQ ID NO: 146055 - DNA, 16 bp, H. sapiens
tgatttcacaggctca

SEQ ID NO: 146056 - DNA, 16 bp, H. sapiens
tgatttcaccattctt

SEQ ID NO: 146057 - DNA, 16 bp, H. sapiens
tgatttcactggtgaa

SEQ ID NO: 146058 - DNA, 16 bp, H. sapiens
tgatttcagatttcta

SEQ ID NO: 146059 - DNA, 16 bp, H. sapiens
tgatttcagctcattg

SEQ ID NO: 146060 - DNA, 16 bp, H. sapiens
tgatttcatatcctga

SEQ ID NO: 146061 - DNA, 16 bp, H. sapiens
tgatttcatatgaaat

SEQ ID NO: 146062 - DNA, 16 bp, H. sapiens
tgatttcatcatgaaa

SEQ ID NO: 146063 - DNA, 16 bp, H. sapiens
tgatttcatcattgtg

SEQ ID NO: 146064 - DNA, 16 bp, H. sapiens
tgatttcatctctgcc

SEQ ID NO: 146065 - DNA, 16 bp, H. sapiens
tgatttcatctgtaaa

SEQ ID NO: 146066 - DNA, 16 bp, H. sapiens
tgatttcattctgttt

SEQ ID NO: 146067 - DNA, 16 bp, H. sapiens
tgatttcattgatttt

SEQ ID NO: 146068 - DNA, 16 bp, H. sapiens
tgatttcattttttaa

SEQ ID NO: 146069 - DNA, 16 bp, H. sapiens
tgatttccatatgttg

SEQ ID NO: 146070 - DNA, 16 bp, H. sapiens
tgatttccatcttaat

SEQ ID NO: 146071 - DNA, 16 bp, H. sapiens
tgatttccattcttct

SEQ ID NO: 146072 - DNA, 16 bp, H. sapiens
tgatttccattctttt

SEQ ID NO: 146073 - DNA, 16 bp, H. sapiens
tgatttccatttttat

SEQ ID NO: 146074 - DNA, 16 bp, H. sapiens
tgatttcccttctttt

SEQ ID NO: 146075 - DNA, 16 bp, H. sapiens
tgatttcctcatctat

SEQ ID NO: 146076 - DNA, 16 bp, H. sapiens
tgatttcctgtttctg

SEQ ID NO: 146077 - DNA, 16 bp, H. sapiens
tgatttctaatttaat

SEQ ID NO: 146078 - DNA, 16 bp, H. sapiens
tgatttctactttaat

SEQ ID NO: 146079 - DNA, 16 bp, H. sapiens
tgatttctacttttat

SEQ ID NO: 146080 - DNA, 16 bp, H. sapiens
tgatttctagctttat

SEQ ID NO: 146081 - DNA, 16 bp, H. sapiens
tgatttctattccttt

SEQ ID NO: 146082 - DNA, 16 bp, H. sapiens
tgatttctctgagcag

SEQ ID NO: 146083 - DNA, 16 bp, H. sapiens
tgatttctgagatttt

SEQ ID NO: 146084 - DNA, 17 bp, H. sapiens
tgatttctgcatttcca

SEQ ID NO: 146085 - DNA, 16 bp, H. sapiens
tgatttctgctctgat

SEQ ID NO: 146086 - DNA, 16 bp, H. sapiens
tgatttctgctctttt

SEQ ID NO: 146087 - DNA, 16 bp, H. sapiens
tgatttctgtatgttg

SEQ ID NO: 146088 - DNA, 16 bp, H. sapiens
tgatttctgtgtgttg

SEQ ID NO: 146089 - DNA, 16 bp, H. sapiens
tgatttctgttccttt

SEQ ID NO: 146090 - DNA, 16 bp, H. sapiens
tgatttctgttctttc

SEQ ID NO: 146091 - DNA, 16 bp, H. sapiens
tgatttcttaaaaatt

SEQ ID NO: 146092 - DNA, 16 bp, H. sapiens
tgatttcttcagaatt

SEQ ID NO: 146093 - DNA, 16 bp, H. sapiens
tgatttcttcagctat

SEQ ID NO: 146094 - DNA, 16 bp, H. sapiens
tgatttcttcctttcc

SEQ ID NO: 146095 - DNA, 16 bp, H. sapiens
tgatttcttctttgac

SEQ ID NO: 146096 - DNA, 16 bp, H. sapiens
tgatttcttgaatatg

SEQ ID NO: 146097 - DNA, 16 bp, H. sapiens
tgatttcttgatttga

SEQ ID NO: 146098 - DNA, 16 bp, H. sapiens
tgatttctttaaaaaa

SEQ ID NO: 146099 - DNA, 16 bp, H. sapiens
tgatttctttaatcag

SEQ ID NO: 146100 - DNA, 16 bp, H. sapiens
tgatttctttcaacag

SEQ ID NO: 146101 - DNA, 16 bp, H. sapiens
tgatttctttcattag

SEQ ID NO: 146102 - DNA, 16 bp, H. sapiens
tgatttctttgtatta

SEQ ID NO: 146103 - DNA, 16 bp, H. sapiens
tgatttgaaaacaaaa

SEQ ID NO: 146104 - DNA, 16 bp, H. sapiens
tgatttgaatgagaaa

SEQ ID NO: 146105 - DNA, 16 bp, H. sapiens
tgatttgatctttaca

SEQ ID NO: 146106 - DNA, 16 bp, H. sapiens
tgatttgcaaacattt

SEQ ID NO: 146107 - DNA, 16 bp, H. sapiens
tgatttgcattttaaa

SEQ ID NO: 146108 - DNA, 16 bp, H. sapiens
tgatttgctttattgt

SEQ ID NO: 146109 - DNA, 16 bp, H. sapiens
tgatttgcttttctct

SEQ ID NO: 146110 - DNA, 16 bp, H. sapiens
tgatttggaaaataaa

SEQ ID NO: 146111 - DNA, 17 bp, H. sapiens
tgatttgggggctgctt

SEQ ID NO: 146112 - DNA, 16 bp, H. sapiens
tgatttgtaaatgttt

SEQ ID NO: 146113 - DNA, 16 bp, H. sapiens
tgatttgtaagatttt

SEQ ID NO: 146114 - DNA, 16 bp, H. sapiens
tgatttgtcttttcat

SEQ ID NO: 146115 - DNA, 16 bp, H. sapiens
tgatttgtttgaattc

SEQ ID NO: 146116 - DNA, 16 bp, H. sapiens
tgattttaaaagcaat

SEQ ID NO: 146117 - DNA, 16 bp, H. sapiens
tgattttaaagttcat

SEQ ID NO: 146118 - DNA, 16 bp, H. sapiens
tgattttaaattttct

SEQ ID NO: 146119 - DNA, 16 bp, H. sapiens
tgattttaatctgtat

SEQ ID NO: 146120 - DNA, 16 bp, H. sapiens
tgattttaatgtaaat

SEQ ID NO: 146121 - DNA, 16 bp, H. sapiens
tgattttaattacttt

SEQ ID NO: 146122 - DNA, 16 bp, H. sapiens
tgattttaatttgctt

SEQ ID NO: 146123 - DNA, 16 bp, H. sapiens
tgattttacattttat

SEQ ID NO: 146124 - DNA, 16 bp, H. sapiens
tgattttacttttaaa

SEQ ID NO: 146125 - DNA, 16 bp, H. sapiens
tgattttagaagaaaa

SEQ ID NO: 146126 - DNA, 16 bp, H. sapiens
tgattttagatctttc

SEQ ID NO: 146127 - DNA, 16 bp, H. sapiens
tgattttagggggaaa

SEQ ID NO: 146128 - DNA, 16 bp, H. sapiens
tgattttagtccagtg

SEQ ID NO: 146129 - DNA, 16 bp, H. sapiens
tgattttatacatttt

SEQ ID NO: 146130 - DNA, 16 bp, H. sapiens
tgattttatacttaga

SEQ ID NO: 146131 - DNA, 16 bp, H. sapiens
tgattttatatgtaaa

SEQ ID NO: 146132 - DNA, 16 bp, H. sapiens
tgattttatcatgaaa

SEQ ID NO: 146133 - DNA, 16 bp, H. sapiens
tgattttatttgaaaa

SEQ ID NO: 146134 - DNA, 16 bp, H. sapiens
tgattttatttttcca

SEQ ID NO: 146135 - DNA, 16 bp, H. sapiens
tgattttcaaagggaa

SEQ ID NO: 146136 - DNA, 16 bp, H. sapiens
tgattttcaattttat

SEQ ID NO: 146137 - DNA, 16 bp, H. sapiens
tgattttcatcaacaa

SEQ ID NO: 146138 - DNA, 16 bp, H. sapiens
tgattttcatttgaaa

SEQ ID NO: 146139 - DNA, 16 bp, H. sapiens
tgattttctgtctagt

SEQ ID NO: 146140 - DNA, 16 bp, H. sapiens
tgattttcttcacaga

SEQ ID NO: 146141 - DNA, 16 bp, H. sapiens
tgattttctttttaag

SEQ ID NO: 146142 - DNA, 16 bp, H. sapiens
tgattttgaaaacaaa

SEQ ID NO: 146143 - DNA, 16 bp, H. sapiens
tgattttgaccaaaat

SEQ ID NO: 146144 - DNA, 16 bp, H. sapiens
tgattttgagcacttt

SEQ ID NO: 146145 - DNA, 16 bp, H. sapiens
tgattttgatgagctg

SEQ ID NO: 146146 - DNA, 16 bp, H. sapiens
tgattttgcaattgtg

SEQ ID NO: 146147 - DNA, 16 bp, H. sapiens
tgattttgcccagctg

SEQ ID NO: 146148 - DNA, 16 bp, H. sapiens
tgattttggacttgca

SEQ ID NO: 146149 - DNA, 16 bp, H. sapiens
tgattttggctgtggg

SEQ ID NO: 146150 - DNA, 32 bp, H. sapiens
tgattttgtatcctgagactttgctgaagttg

SEQ ID NO: 146151 - DNA, 16 bp, H. sapiens
tgattttgtggcaagg

SEQ ID NO: 146152 - DNA, 16 bp, H. sapiens
tgattttgttaaaaat

SEQ ID NO: 146153 - DNA, 16 bp, H. sapiens
tgattttgttgaagat

SEQ ID NO: 146154 - DNA, 16 bp, H. sapiens
tgatttttaaaaaatc

SEQ ID NO: 146155 - DNA, 16 bp, H. sapiens
tgatttttaaaactta

SEQ ID NO: 146156 - DNA, 16 bp, H. sapiens
tgatttttaaaagtta

SEQ ID NO: 146157 - DNA, 16 bp, H. sapiens
tgatttttaaaatctt

SEQ ID NO: 146158 - DNA, 16 bp, H. sapiens
tgatttttaaactttt

SEQ ID NO: 146159 - DNA, 16 bp, H. sapiens
tgatttttacatattt

SEQ ID NO: 146160 - DNA, 16 bp, H. sapiens
tgatttttacttttaa

SEQ ID NO: 146161 - DNA, 16 bp, H. sapiens
tgatttttagaaaaaa

SEQ ID NO: 146162 - DNA, 16 bp, H. sapiens
tgatttttataccaaa

SEQ ID NO: 146163 - DNA, 16 bp, H. sapiens
tgatttttatccttca

SEQ ID NO: 146164 - DNA, 16 bp, H. sapiens
tgatttttattttcaa

SEQ ID NO: 146165 - DNA, 16 bp, H. sapiens
tgatttttcaaagaat

SEQ ID NO: 146166 - DNA, 16 bp, H. sapiens
tgatttttcaagagaa

SEQ ID NO: 146167 - DNA, 16 bp, H. sapiens
tgatttttcaattaaa

SEQ ID NO: 146168 - DNA, 16 bp, H. sapiens
tgatttttcctcttta

SEQ ID NO: 146169 - DNA, 16 bp, H. sapiens
tgatttttctcaattt

SEQ ID NO: 146170 - DNA, 16 bp, H. sapiens
tgatttttctctttca

SEQ ID NO: 146171 - DNA, 16 bp, H. sapiens
tgatttttcttcttca

SEQ ID NO: 146172 - DNA, 16 bp, H. sapiens
tgatttttgaaaaaat

SEQ ID NO: 146173 - DNA, 16 bp, H. sapiens
tgatttttgaaaaata

SEQ ID NO: 146174 - DNA, 16 bp, H. sapiens
tgatttttgaaaatgt

SEQ ID NO: 146175 - DNA, 16 bp, H. sapiens
tgatttttgacaatgg

SEQ ID NO: 146176 - DNA, 16 bp, H. sapiens
tgatttttgacagttt

SEQ ID NO: 146177 - DNA, 16 bp, H. sapiens
tgatttttgtacagtg

SEQ ID NO: 146178 - DNA, 16 bp, H. sapiens
tgatttttgtacatgg

SEQ ID NO: 146179 - DNA, 16 bp, H. sapiens
tgatttttgtcattgg

SEQ ID NO: 146180 - DNA, 16 bp, H. sapiens
tgatttttgtctttgg

SEQ ID NO: 146181 - DNA, 17 bp, H. sapiens
tgatttttgtgtaaggt

SEQ ID NO: 146182 - DNA, 16 bp, H. sapiens
tgattttttaaaaaag

SEQ ID NO: 146183 - DNA, 16 bp, H. sapiens
tgattttttaaaaact

SEQ ID NO: 146184 - DNA, 16 bp, H. sapiens
tgattttttaaaaatg

SEQ ID NO: 146185 - DNA, 16 bp, H. sapiens
tgattttttgtacatt

SEQ ID NO: 146186 - DNA, 16 bp, H. sapiens
tgatttttttaaacca

SEQ ID NO: 146187 - DNA, 16 bp, H. sapiens
tgatttttttccatgt

SEQ ID NO: 146188 - DNA, 16 bp, H. sapiens
tgatttttttcccctt

SEQ ID NO: 146189 - DNA, 16 bp, H. sapiens
tgatttttttccttga

SEQ ID NO: 146190 - DNA, 16 bp, H. sapiens
tgatttttttctacct

SEQ ID NO: 146191 - DNA, 16 bp, H. sapiens
tgatttttttctccca

SEQ ID NO: 146192 - DNA, 16 bp, H. sapiens
tgatttttttctccta

SEQ ID NO: 146193 - DNA, 16 bp, H. sapiens
tgattttttttcaaat

SEQ ID NO: 146194 - DNA, 16 bp, H. sapiens
tgattttttttcccct

SEQ ID NO: 146195 - DNA, 16 bp, H. sapiens
tgcaaaaaaatggaat

SEQ ID NO: 146196 - DNA, 16 bp, H. sapiens
tgcaaaaaattttcat

SEQ ID NO: 146197 - DNA, 16 bp, H. sapiens
tgcaaaaacaattttt

SEQ ID NO: 146198 - DNA, 16 bp, H. sapiens
tgcaaaaaccattctt

SEQ ID NO: 146199 - DNA, 16 bp, H. sapiens
tgcaaaaactacaaaa

SEQ ID NO: 146200 - DNA, 16 bp, H. sapiens
tgcaaaaatatggaac

SEQ ID NO: 146201 - DNA, 16 bp, H. sapiens
tgcaaaaatattttgt

SEQ ID NO: 146202 - DNA, 16 bp, H. sapiens
tgcaaaaatcaataaa

SEQ ID NO: 146203 - DNA, 16 bp, H. sapiens
tgcaaaaatcatcaat

SEQ ID NO: 146204 - DNA, 16 bp, H. sapiens
tgcaaaaatggttcaa

SEQ ID NO: 146205 - DNA, 16 bp, H. sapiens
tgcaaaaattactagc

SEQ ID NO: 146206 - DNA, 16 bp, H. sapiens
tgcaaaaattttcccc

SEQ ID NO: 146207 - DNA, 16 bp, H. sapiens
tgcaaaacaaaactac

SEQ ID NO: 146208 - DNA, 16 bp, H. sapiens
tgcaaaacaaaatgaa

SEQ ID NO: 146209 - DNA, 16 bp, H. sapiens
tgcaaaagaaactacc

SEQ ID NO: 146210 - DNA, 16 bp, H. sapiens
tgcaaaagaaatagca

SEQ ID NO: 146211 - DNA, 16 bp, H. sapiens
tgcaaaagaaattctg

SEQ ID NO: 146212 - DNA, 16 bp, H. sapiens
tgcaaaagaagtgaaa

SEQ ID NO: 146213 - DNA, 16 bp, H. sapiens
tgcaaaagagcaccag

SEQ ID NO: 146214 - DNA, 16 bp, H. sapiens
tgcaaaaggtgggttc

SEQ ID NO: 146215 - DNA, 16 bp, H. sapiens
tgcaaaagtgttccct

SEQ ID NO: 146216 - DNA, 16 bp, H. sapiens
tgcaaaataaccagct

SEQ ID NO: 146217 - DNA, 16 bp, H. sapiens
tgcaaaatacacatta

SEQ ID NO: 146218 - DNA, 16 bp, H. sapiens
tgcaaaatagcaaaga

SEQ ID NO: 146219 - DNA, 16 bp, H. sapiens
tgcaaaatgaagaaaa

SEQ ID NO: 146220 - DNA, 16 bp, H. sapiens
tgcaaaatgaggatga

SEQ ID NO: 146221 - DNA, 16 bp, H. sapiens
tgcaaaatgggaacaa

SEQ ID NO: 146222 - DNA, 16 bp, H. sapiens
tgcaaaatttaaaaag

SEQ ID NO: 146223 - DNA, 16 bp, H. sapiens
tgcaaacaaaaatgta

SEQ ID NO: 146224 - DNA, 17 bp, H. sapiens
tgcaaacaaggacaatt

SEQ ID NO: 146225 - DNA, 16 bp, H. sapiens
tgcaaacactgttttt

SEQ ID NO: 146226 - DNA, 16 bp, H. sapiens
tgcaaacagcagttag

SEQ ID NO: 146227 - DNA, 16 bp, H. sapiens
tgcaaacagtgctgca

SEQ ID NO: 146228 - DNA, 17 bp, H. sapiens
tgcaaaccccaagcctt

SEQ ID NO: 146229 - DNA, 16 bp, H. sapiens
tgcaaacctgcctccc

SEQ ID NO: 146230 - DNA, 16 bp, H. sapiens
tgcaaactctgcctcc

SEQ ID NO: 146231 - DNA, 16 bp, H. sapiens
tgcaaactgttggtgg

SEQ ID NO: 146232 - DNA, 16 bp, H. sapiens
tgcaaagaaaaatgaa

SEQ ID NO: 146233 - DNA, 16 bp, H. sapiens
tgcaaagaaaagggaa

SEQ ID NO: 146234 - DNA, 16 bp, H. sapiens
tgcaaagaaataggaa

SEQ ID NO: 146235 - DNA, 16 bp, H. sapiens
tgcaaagaagaaataa

SEQ ID NO: 146236 - DNA, 16 bp, H. sapiens
tgcaaagacacacaca

SEQ ID NO: 146237 - DNA, 16 bp, H. sapiens
tgcaaagacacacaga

SEQ ID NO: 146238 - DNA, 16 bp, H. sapiens
tgcaaagaccctgagg

SEQ ID NO: 146239 - DNA, 16 bp, H. sapiens
tgcaaagatatggaat

SEQ ID NO: 146240 - DNA, 16 bp, H. sapiens
tgcaaagatggtttca

SEQ ID NO: 146241 - DNA, 16 bp, H. sapiens
tgcaaagccacaggga

SEQ ID NO: 146242 - DNA, 16 bp, H. sapiens
tgcaaagcctgaaata

SEQ ID NO: 146243 - DNA, 16 bp, H. sapiens
tgcaaagctgtccttt

SEQ ID NO: 146244 - DNA, 16 bp, H. sapiens
tgcaaagcttaaaata

SEQ ID NO: 146245 - DNA, 16 bp, H. sapiens
tgcaaaggaaaaatta

SEQ ID NO: 146246 - DNA, 16 bp, H. sapiens
tgcaaaggcagaagaa

SEQ ID NO: 146247 - DNA, 16 bp, H. sapiens
tgcaaaggccctgaga

SEQ ID NO: 146248 - DNA, 16 bp, H. sapiens
tgcaaaggccctgagg

SEQ ID NO: 146249 - DNA, 16 bp, H. sapiens
tgcaaaggccctgggg

SEQ ID NO: 146250 - DNA, 16 bp, H. sapiens
tgcaaaggccctgtgg

SEQ ID NO: 146251 - DNA, 16 bp, H. sapiens
tgcaaagtattgatct

SEQ ID NO: 146252 - DNA, 16 bp, H. sapiens
tgcaaagtcccttctg

SEQ ID NO: 146253 - DNA, 16 bp, H. sapiens
tgcaaagtgactctga

SEQ ID NO: 146254 - DNA, 16 bp, H. sapiens
tgcaaagtttgggatc

SEQ ID NO: 146255 - DNA, 16 bp, H. sapiens
tgcaaataaacattta

SEQ ID NO: 146256 - DNA, 16 bp, H. sapiens
tgcaaataacagaaaa

SEQ ID NO: 146257 - DNA, 16 bp, H. sapiens
tgcaaataagaataat

SEQ ID NO: 146258 - DNA, 16 bp, H. sapiens
tgcaaatatatgtata

SEQ ID NO: 146259 - DNA, 16 bp, H. sapiens
tgcaaatatcttcttt

SEQ ID NO: 146260 - DNA, 16 bp, H. sapiens
tgcaaatatgtatata

SEQ ID NO: 146261 - DNA, 16 bp, H. sapiens
tgcaaatattctcttc

SEQ ID NO: 146262 - DNA, 16 bp, H. sapiens
tgcaaatattttcacc

SEQ ID NO: 146263 - DNA, 16 bp, H. sapiens
tgcaaatattttctgc

SEQ ID NO: 146264 - DNA, 16 bp, H. sapiens
tgcaaatatttttcct

SEQ ID NO: 146265 - DNA, 16 bp, H. sapiens
tgcaaatattttttaa

SEQ ID NO: 146266 - DNA, 16 bp, H. sapiens
tgcaaatctcccccac

SEQ ID NO: 146267 - DNA, 16 bp, H. sapiens
tgcaaatgaaaaccaa

SEQ ID NO: 146268 - DNA, 16 bp, H. sapiens
tgcaaatgaaaaccat

SEQ ID NO: 146269 - DNA, 16 bp, H. sapiens
tgcaaatgacataatc

SEQ ID NO: 146270 - DNA, 16 bp, H. sapiens
tgcaaatgacctgctt

SEQ ID NO: 146271 - DNA, 16 bp, H. sapiens
tgcaaatggcctaaat

SEQ ID NO: 146272 - DNA, 16 bp, H. sapiens
tgcaaattaaaactaa

SEQ ID NO: 146273 - DNA, 16 bp, H. sapiens
tgcaaattaaaatgag

SEQ ID NO: 146274 - DNA, 16 bp, H. sapiens
tgcaaattcagaaaat

SEQ ID NO: 146275 - DNA, 16 bp, H. sapiens
tgcaaattgatatttg

SEQ ID NO: 146276 - DNA, 16 bp, H. sapiens
tgcaaattgattttgt

SEQ ID NO: 146277 - DNA, 16 bp, H. sapiens
tgcaaattttctaaaa

SEQ ID NO: 146278 - DNA, 16 bp, H. sapiens
tgcaaattttgctgct

SEQ ID NO: 146279 - DNA, 16 bp, H. sapiens
tgcaaattttttaaac

SEQ ID NO: 146280 - DNA, 16 bp, H. sapiens
tgcaacaaacacaaaa

SEQ ID NO: 146281 - DNA, 16 bp, H. sapiens
tgcaacaaatatggga

SEQ ID NO: 146282 - DNA, 16 bp, H. sapiens
tgcaacaagagcaaaa

SEQ ID NO: 146283 - DNA, 16 bp, H. sapiens
tgcaacaccacacctg

SEQ ID NO: 146284 - DNA, 16 bp, H. sapiens
tgcaacagacctgcag

SEQ ID NO: 146285 - DNA, 16 bp, H. sapiens
tgcaacattttacatt

SEQ ID NO: 146286 - DNA, 16 bp, H. sapiens
tgcaaccaaaacaaaa

SEQ ID NO: 146287 - DNA, 16 bp, H. sapiens
tgcaaccaaacaccac

SEQ ID NO: 146288 - DNA, 16 bp, H. sapiens
tgcaaccaccacttcc

SEQ ID NO: 146289 - DNA, 16 bp, H. sapiens
tgcaaccatcacctcc

SEQ ID NO: 146290 - DNA, 16 bp, H. sapiens
tgcaacccctgcttta

SEQ ID NO: 146291 - DNA, 16 bp, H. sapiens
tgcaacccttgctgac

SEQ ID NO: 146292 - DNA, 16 bp, H. sapiens
tgcaacctagatccct

SEQ ID NO: 146293 - DNA, 16 bp, H. sapiens
tgcaacctcagcctcc

SEQ ID NO: 146294 - DNA, 16 bp, H. sapiens
tgcaacctccgctgcc

SEQ ID NO: 146295 - DNA, 16 bp, H. sapiens
tgcaacctgggtgaca

SEQ ID NO: 146296 - DNA, 16 bp, H. sapiens
tgcaaccttccaagtg

SEQ ID NO: 146297 - DNA, 16 bp, H. sapiens
tgcaaccttgaactcc

SEQ ID NO: 146298 - DNA, 16 bp, H. sapiens
tgcaactaatctttaa

SEQ ID NO: 146299 - DNA, 16 bp, H. sapiens
tgcaactccagcctgg

SEQ ID NO: 146300 - DNA, 16 bp, H. sapiens
tgcaactcctgcctcc

SEQ ID NO: 146301 - DNA, 16 bp, H. sapiens
tgcaactgatttttat

SEQ ID NO: 146302 - DNA, 16 bp, H. sapiens
tgcaactgtagtccca

SEQ ID NO: 146303 - DNA, 16 bp, H. sapiens
tgcaacttactttcaa

SEQ ID NO: 146304 - DNA, 16 bp, H. sapiens
tgcaacttccacttcc

SEQ ID NO: 146305 - DNA, 16 bp, H. sapiens
tgcaacttctctgtaa

SEQ ID NO: 146306 - DNA, 16 bp, H. sapiens
tgcaacttctgccacc

SEQ ID NO: 146307 - DNA, 16 bp, H. sapiens
tgcaactttactaaat

SEQ ID NO: 146308 - DNA, 16 bp, H. sapiens
tgcaacttttctataa

SEQ ID NO: 146309 - DNA, 16 bp, H. sapiens
tgcaagaaactgaaga

SEQ ID NO: 146310 - DNA, 16 bp, H. sapiens
tgcaagaaactgcctt

SEQ ID NO: 146311 - DNA, 16 bp, H. sapiens
tgcaagaacaaaaaac

SEQ ID NO: 146312 - DNA, 16 bp, H. sapiens
tgcaagaactcctgaa

SEQ ID NO: 146313 - DNA, 16 bp, H. sapiens
tgcaagaagaaaaata

SEQ ID NO: 146314 - DNA, 16 bp, H. sapiens
tgcaagaaggaattca

SEQ ID NO: 146315 - DNA, 16 bp, H. sapiens
tgcaagaatggcctaa

SEQ ID NO: 146316 - DNA, 16 bp, H. sapiens
tgcaagaccctgtctc

SEQ ID NO: 146317 - DNA, 16 bp, H. sapiens
tgcaagactttttttt

SEQ ID NO: 146318 - DNA, 16 bp, H. sapiens
tgcaagagaaaaaccc

SEQ ID NO: 146319 - DNA, 16 bp, H. sapiens
tgcaagagaaaggaga

SEQ ID NO: 146320 - DNA, 16 bp, H. sapiens
tgcaagagtagtgatg

SEQ ID NO: 146321 - DNA, 17 bp, H. sapiens
tgcaagataaggccatg

SEQ ID NO: 146322 - DNA, 16 bp, H. sapiens
tgcaagatctgcctcc

SEQ ID NO: 146323 - DNA, 16 bp, H. sapiens
tgcaagatgaaaaaat

SEQ ID NO: 146324 - DNA, 16 bp, H. sapiens
tgcaagcaagaagaca

SEQ ID NO: 146325 - DNA, 16 bp, H. sapiens
tgcaagccaggaagaa

SEQ ID NO: 146326 - DNA, 16 bp, H. sapiens
tgcaagctccaccttc

SEQ ID NO: 146327 - DNA, 16 bp, H. sapiens
tgcaaggaaatgaatt

SEQ ID NO: 146328 - DNA, 16 bp, H. sapiens
tgcaaggaagggatcc

SEQ ID NO: 146329 - DNA, 16 bp, H. sapiens
tgcaaggatagttcaa

SEQ ID NO: 146330 - DNA, 16 bp, H. sapiens
tgcaaggcagcagtga

SEQ ID NO: 146331 - DNA, 16 bp, H. sapiens
tgcaaggctgcttcaa

SEQ ID NO: 146332 - DNA, 16 bp, H. sapiens
tgcaagggccctgggg

SEQ ID NO: 146333 - DNA, 16 bp, H. sapiens
tgcaaggttggttcag

SEQ ID NO: 146334 - DNA, 16 bp, H. sapiens
tgcaaggttgtggttt

SEQ ID NO: 146335 - DNA, 16 bp, H. sapiens
tgcaagtatcttttta

SEQ ID NO: 146336 - DNA, 16 bp, H. sapiens
tgcaagtcctttatca

SEQ ID NO: 146337 - DNA, 16 bp, H. sapiens
tgcaagtctgaaacct

SEQ ID NO: 146338 - DNA, 16 bp, H. sapiens
tgcaagtgagaagaca

SEQ ID NO: 146339 - DNA, 16 bp, H. sapiens
tgcaataaaaaaagat

SEQ ID NO: 146340 - DNA, 16 bp, H. sapiens
tgcaataaaaaatgat

SEQ ID NO: 146341 - DNA, 16 bp, H. sapiens
tgcaataaaaatgata

SEQ ID NO: 146342 - DNA, 16 bp, H. sapiens
tgcaataaaacaagaa

SEQ ID NO: 146343 - DNA, 16 bp, H. sapiens
tgcaataaaacaagat

SEQ ID NO: 146344 - DNA, 16 bp, H. sapiens
tgcaataaatatttgt

SEQ ID NO: 146345 - DNA, 16 bp, H. sapiens
tgcaataaatgtggga

SEQ ID NO: 146346 - DNA, 16 bp, H. sapiens
tgcaataatcacatca

SEQ ID NO: 146347 - DNA, 16 bp, H. sapiens
tgcaatatatccatat

SEQ ID NO: 146348 - DNA, 16 bp, H. sapiens
tgcaatatttattttt

SEQ ID NO: 146349 - DNA, 16 bp, H. sapiens
tgcaatatttgggaca

SEQ ID NO: 146350 - DNA, 16 bp, H. sapiens
tgcaatattttaaaaa

SEQ ID NO: 146351 - DNA, 16 bp, H. sapiens
tgcaatattttccttt

SEQ ID NO: 146352 - DNA, 16 bp, H. sapiens
tgcaatatttttaaat

SEQ ID NO: 146353 - DNA, 16 bp, H. sapiens
tgcaatcacagcccac

SEQ ID NO: 146354 - DNA, 16 bp, H. sapiens
tgcaatcatgggtcac

SEQ ID NO: 146355 - DNA, 16 bp, H. sapiens
tgcaatccaagctact

SEQ ID NO: 146356 - DNA, 16 bp, H. sapiens
tgcaatccagcctggg

SEQ ID NO: 146357 - DNA, 16 bp, H. sapiens
tgcaatcccaacactt

SEQ ID NO: 146358 - DNA, 16 bp, H. sapiens
tgcaatcccagctact

SEQ ID NO: 146359 - DNA, 16 bp, H. sapiens
tgcaatcccagttact

SEQ ID NO: 146360 - DNA, 16 bp, H. sapiens
tgcaatcctagcctct

SEQ ID NO: 146361 - DNA, 16 bp, H. sapiens
tgcaatctatccatct

SEQ ID NO: 146362 - DNA, 16 bp, H. sapiens
tgcaatgaaaaagaaa

SEQ ID NO: 146363 - DNA, 16 bp, H. sapiens
tgcaatgaaaacaaaa

SEQ ID NO: 146364 - DNA, 16 bp, H. sapiens
tgcaatgaaaatattt

SEQ ID NO: 146365 - DNA, 16 bp, H. sapiens
tgcaatgaacatggga

SEQ ID NO: 146366 - DNA, 16 bp, H. sapiens
tgcaatgaacatttgc

SEQ ID NO: 146367 - DNA, 17 bp, H. sapiens
tgcaatgaacatttgca

SEQ ID NO: 146368 - DNA, 16 bp, H. sapiens
tgcaatgaactgagat

SEQ ID NO: 146369 - DNA, 16 bp, H. sapiens
tgcaatgaatatggga

SEQ ID NO: 146370 - DNA, 16 bp, H. sapiens
tgcaatgagctatgat

SEQ ID NO: 146371 - DNA, 16 bp, H. sapiens
tgcaatgagctgagat

SEQ ID NO: 146372 - DNA, 16 bp, H. sapiens
tgcaatgagctgtgat

SEQ ID NO: 146373 - DNA, 16 bp, H. sapiens
tgcaatggaatgcaat

SEQ ID NO: 146374 - DNA, 16 bp, H. sapiens
tgcaatggagaaaaat

SEQ ID NO: 146375 - DNA, 17 bp, H. sapiens
tgcaatggcaccatctt

SEQ ID NO: 146376 - DNA, 16 bp, H. sapiens
tgcaatggcacgacct

SEQ ID NO: 146377 - DNA, 16 bp, H. sapiens
tgcaatggcatggtct

SEQ ID NO: 146378 - DNA, 16 bp, H. sapiens
tgcaatggccccatct

SEQ ID NO: 146379 - DNA, 16 bp, H. sapiens
tgcaatggcctttgtg

SEQ ID NO: 146380 - DNA, 16 bp, H. sapiens
tgcaatggcgcagtct

SEQ ID NO: 146381 - DNA, 16 bp, H. sapiens
tgcaatggtgtgacct

SEQ ID NO: 146382 - DNA, 16 bp, H. sapiens
tgcaatggtgtggtct

SEQ ID NO: 146383 - DNA, 16 bp, H. sapiens
tgcaattaaaaataat

SEQ ID NO: 146384 - DNA, 16 bp, H. sapiens
tgcaattaaaagaact

SEQ ID NO: 146385 - DNA, 16 bp, H. sapiens
tgcaattatttaaaaa

SEQ ID NO: 146386 - DNA, 16 bp, H. sapiens
tgcaattcctatcaaa

SEQ ID NO: 146387 - DNA, 16 bp, H. sapiens
tgcaattctttcttcc

SEQ ID NO: 146388 - DNA, 16 bp, H. sapiens
tgcaatttgacatgag

SEQ ID NO: 146389 - DNA, 16 bp, H. sapiens
tgcacaaaaatctcac

SEQ ID NO: 146390 - DNA, 16 bp, H. sapiens
tgcacaaaatatatgt

SEQ ID NO: 146391 - DNA, 16 bp, H. sapiens
tgcacaaacttttttt

SEQ ID NO: 146392 - DNA, 16 bp, H. sapiens
tgcacaaagatgttca

SEQ ID NO: 146393 - DNA, 16 bp, H. sapiens
tgcacaacaaaagaaa

SEQ ID NO: 146394 - DNA, 16 bp, H. sapiens
tgcacaacaatgtgaa

SEQ ID NO: 146395 - DNA, 16 bp, H. sapiens
tgcacaacatgcagtt

SEQ ID NO: 146396 - DNA, 16 bp, H. sapiens
tgcacaacatggtgaa

SEQ ID NO: 146397 - DNA, 16 bp, H. sapiens
tgcacaactctgtgaa

SEQ ID NO: 146398 - DNA, 17 bp, H. sapiens
tgcacacacacacacgc

SEQ ID NO: 146399 - DNA, 16 bp, H. sapiens
tgcacacacacacatg

SEQ ID NO: 146400 - DNA, 16 bp, H. sapiens
tgcacacacacacgtg

SEQ ID NO: 146401 - DNA, 16 bp, H. sapiens
tgcacacacacaggga

SEQ ID NO: 146402 - DNA, 16 bp, H. sapiens
tgcacacacacataca

SEQ ID NO: 146403 - DNA, 16 bp, H. sapiens
tgcacacacacccata

SEQ ID NO: 146404 - DNA, 16 bp, H. sapiens
tgcacacacactcaca

SEQ ID NO: 146405 - DNA, 16 bp, H. sapiens
tgcacacacagacaca

SEQ ID NO: 146406 - DNA, 16 bp, H. sapiens
tgcacacacatacata

SEQ ID NO: 146407 - DNA, 16 bp, H. sapiens
tgcacacacatgcata

SEQ ID NO: 146408 - DNA, 16 bp, H. sapiens
tgcacacacatgtgca

SEQ ID NO: 146409 - DNA, 16 bp, H. sapiens
tgcacacaccacacac

SEQ ID NO: 146410 - DNA, 16 bp, H. sapiens
tgcacacacgcacaca

SEQ ID NO: 146411 - DNA, 16 bp, H. sapiens
tgcacacacgcacacg

SEQ ID NO: 146412 - DNA, 16 bp, H. sapiens
tgcacacactcacaca

SEQ ID NO: 146413 - DNA, 16 bp, H. sapiens
tgcacacactggctcc

SEQ ID NO: 146414 - DNA, 16 bp, H. sapiens
tgcacacagaaaatct

SEQ ID NO: 146415 - DNA, 16 bp, H. sapiens
tgcacacagacacaca

SEQ ID NO: 146416 - DNA, 16 bp, H. sapiens
tgcacacagcatggag

SEQ ID NO: 146417 - DNA, 16 bp, H. sapiens
tgcacacagcctcttt

SEQ ID NO: 146418 - DNA, 16 bp, H. sapiens
tgcacacatacataca

SEQ ID NO: 146419 - DNA, 20 bp, H. sapiens
tgcacacatgcatgcacaca

SEQ ID NO: 146420 - DNA, 16 bp, H. sapiens
tgcacacatgcgcaca

SEQ ID NO: 146421 - DNA, 16 bp, H. sapiens
tgcacacatgtacaca

SEQ ID NO: 146422 - DNA, 16 bp, H. sapiens
tgcacaccaccatgct

SEQ ID NO: 146423 - DNA, 16 bp, H. sapiens
tgcacaccactgtgcc

SEQ ID NO: 146424 - DNA, 16 bp, H. sapiens
tgcacaccagcctggg

SEQ ID NO: 146425 - DNA, 16 bp, H. sapiens
tgcacacctatggtcc

SEQ ID NO: 146426 - DNA, 16 bp, H. sapiens
tgcacacctccacacc

SEQ ID NO: 146427 - DNA, 16 bp, H. sapiens
tgcacacctggctggg

SEQ ID NO: 146428 - DNA, 16 bp, H. sapiens
tgcacacgcacacaca

SEQ ID NO: 146429 - DNA, 16 bp, H. sapiens
tgcacacgcatgttta

SEQ ID NO: 146430 - DNA, 16 bp, H. sapiens
tgcacactcatgcaca

SEQ ID NO: 146431 - DNA, 16 bp, H. sapiens
tgcacagaaaaataaa

SEQ ID NO: 146432 - DNA, 16 bp, H. sapiens
tgcacagaaactagaa

SEQ ID NO: 146433 - DNA, 16 bp, H. sapiens
tgcacagaacagcccc

SEQ ID NO: 146434 - DNA, 16 bp, H. sapiens
tgcacagaagcattct

SEQ ID NO: 146435 - DNA, 17 bp, H. sapiens
tgcacagaagtcaagaa

SEQ ID NO: 146436 - DNA, 16 bp, H. sapiens
tgcacagagcagcaag

SEQ ID NO: 146437 - DNA, 16 bp, H. sapiens
tgcacagatcaaccca

SEQ ID NO: 146438 - DNA, 16 bp, H. sapiens
tgcacagcaaaggaaa

SEQ ID NO: 146439 - DNA, 16 bp, H. sapiens
tgcacagccaaggaaa

SEQ ID NO: 146440 - DNA, 16 bp, H. sapiens
tgcacagcctccccca

SEQ ID NO: 146441 - DNA, 16 bp, H. sapiens
tgcacaggacagcccc

SEQ ID NO: 146442 - DNA, 16 bp, H. sapiens
tgcacaggctggagtt

SEQ ID NO: 146443 - DNA, 16 bp, H. sapiens
tgcacagggcccaggg

SEQ ID NO: 146444 - DNA, 16 bp, H. sapiens
tgcacagtggctcaca

SEQ ID NO: 146445 - DNA, 16 bp, H. sapiens
tgcacagtggtctgag

SEQ ID NO: 146446 - DNA, 16 bp, H. sapiens
tgcacagttcataata

SEQ ID NO: 146447 - DNA, 16 bp, H. sapiens
tgcacataaactaaaa

SEQ ID NO: 146448 - DNA, 16 bp, H. sapiens
tgcacatatacacata

SEQ ID NO: 146449 - DNA, 16 bp, H. sapiens
tgcacatatgcatata

SEQ ID NO: 146450 - DNA, 16 bp, H. sapiens
tgcacatatttaaaat

SEQ ID NO: 146451 - DNA, 16 bp, H. sapiens
tgcacatatttaatgt

SEQ ID NO: 146452 - DNA, 16 bp, H. sapiens
tgcacatcatgcacat

SEQ ID NO: 146453 - DNA, 16 bp, H. sapiens
tgcacatcctccacat

SEQ ID NO: 146454 - DNA, 16 bp, H. sapiens
tgcacatcctcccata

SEQ ID NO: 146455 - DNA, 16 bp, H. sapiens
tgcacatccttcacat

SEQ ID NO: 146456 - DNA, 16 bp, H. sapiens
tgcacatctgtagtcc

SEQ ID NO: 146457 - DNA, 16 bp, H. sapiens
tgcacatgagattggt

SEQ ID NO: 146458 - DNA, 16 bp, H. sapiens
tgcacatgcacacacc

SEQ ID NO: 146459 - DNA, 16 bp, H. sapiens
tgcacatggggtctcc

SEQ ID NO: 146460 - DNA, 16 bp, H. sapiens
tgcacatgtacacctg

SEQ ID NO: 146461 - DNA, 18 bp, H. sapiens
tgcacatgtaccccagaa

SEQ ID NO: 146462 - DNA, 16 bp, H. sapiens
tgcacatgtgcacata

SEQ ID NO: 146463 - DNA, 16 bp, H. sapiens
tgcacatgtgtgtgtc

SEQ ID NO: 146464 - DNA, 16 bp, H. sapiens
tgcacatgtgtgtgtg

SEQ ID NO: 146465 - DNA, 16 bp, H. sapiens
tgcacatgtgtgtgtt

SEQ ID NO: 146466 - DNA, 16 bp, H. sapiens
tgcacatgtgtgttca

SEQ ID NO: 146467 - DNA, 16 bp, H. sapiens
tgcacatgttcattgc

SEQ ID NO: 146468 - DNA, 16 bp, H. sapiens
tgcacattcccagctg

SEQ ID NO: 146469 - DNA, 16 bp, H. sapiens
tgcaccaaaataaact

SEQ ID NO: 146470 - DNA, 16 bp, H. sapiens
tgcaccaaactaataa

SEQ ID NO: 146471 - DNA, 16 bp, H. sapiens
tgcaccacaatgccca

SEQ ID NO: 146472 - DNA, 16 bp, H. sapiens
tgcaccaccacaccaa

SEQ ID NO: 146473 - DNA, 16 bp, H. sapiens
tgcaccaccactccca

SEQ ID NO: 146474 - DNA, 16 bp, H. sapiens
tgcaccaccatacctg

SEQ ID NO: 146475 - DNA, 17 bp, H. sapiens
tgcaccaccatgctgtt

SEQ ID NO: 146476 - DNA, 16 bp, H. sapiens
tgcaccactatacctg

SEQ ID NO: 146477 - DNA, 16 bp, H. sapiens
tgcaccactatgccag

SEQ ID NO: 146478 - DNA, 16 bp, H. sapiens
tgcaccactgcactct

SEQ ID NO: 146479 - DNA, 16 bp, H. sapiens
tgcaccagcacgccca

SEQ ID NO: 146480 - DNA, 17 bp, H. sapiens
tgcaccatgttggtgtg

SEQ ID NO: 146481 - DNA, 16 bp, H. sapiens
tgcaccattttccatt

SEQ ID NO: 146482 - DNA, 16 bp, H. sapiens
tgcacccacagccacc

SEQ ID NO: 146483 - DNA, 16 bp, H. sapiens
tgcacccagagaaaag

SEQ ID NO: 146484 - DNA, 16 bp, H. sapiens
tgcacccagaggacca

SEQ ID NO: 146485 - DNA, 16 bp, H. sapiens
tgcacccagcctccaa

SEQ ID NO: 146486 - DNA, 16 bp, H. sapiens
tgcacccagcctgaag

SEQ ID NO: 146487 - DNA, 16 bp, H. sapiens
tgcaccccagcccagg

SEQ ID NO: 146488 - DNA, 16 bp, H. sapiens
tgcaccccagcctgag

SEQ ID NO: 146489 - DNA, 16 bp, H. sapiens
tgcaccccagcctggg

SEQ ID NO: 146490 - DNA, 16 bp, H. sapiens
tgcaccccagccttgg

SEQ ID NO: 146491 - DNA, 16 bp, H. sapiens
tgcacccccacaccca

SEQ ID NO: 146492 - DNA, 16 bp, H. sapiens
tgcacccccagcctgg

SEQ ID NO: 146493 - DNA, 16 bp, H. sapiens
tgcaccctgagcctgg

SEQ ID NO: 146494 - DNA, 16 bp, H. sapiens
tgcaccctgtgcctgg

SEQ ID NO: 146495 - DNA, 16 bp, H. sapiens
tgcaccgttttacatt

SEQ ID NO: 146496 - DNA, 16 bp, H. sapiens
tgcacctcacactgga

SEQ ID NO: 146497 - DNA, 16 bp, H. sapiens
tgcacctcagcctccc

SEQ ID NO: 146498 - DNA, 16 bp, H. sapiens
tgcacctcagcctggg

SEQ ID NO: 146499 - DNA, 16 bp, H. sapiens
tgcacctcagtttcct

SEQ ID NO: 146500 - DNA, 16 bp, H. sapiens
tgcacctgacaaaggt

SEQ ID NO: 146501 - DNA, 16 bp, H. sapiens
tgcacctggaaaaacc

SEQ ID NO: 146502 - DNA, 16 bp, H. sapiens
tgcacctggccaagag

SEQ ID NO: 146503 - DNA, 16 bp, H. sapiens
tgcacctggccagatc

SEQ ID NO: 146504 - DNA, 16 bp, H. sapiens
tgcacctggccaggaa

SEQ ID NO: 146505 - DNA, 16 bp, H. sapiens
tgcacctggcccctcc

SEQ ID NO: 146506 - DNA, 16 bp, H. sapiens
tgcacctggcctgcct

SEQ ID NO: 146507 - DNA, 16 bp, H. sapiens
tgcacctggcttggag

SEQ ID NO: 146508 - DNA, 18 bp, H. sapiens
tgcacctgtaatcccagt

SEQ ID NO: 146509 - DNA, 16 bp, H. sapiens
tgcacctgtagtccca

SEQ ID NO: 146510 - DNA, 16 bp, H. sapiens
tgcacctgtgaatagc

SEQ ID NO: 146511 - DNA, 16 bp, H. sapiens
tgcacctgtggtccca

SEQ ID NO: 146512 - DNA, 16 bp, H. sapiens
tgcacctttggtccca

SEQ ID NO: 146513 - DNA, 16 bp, H. sapiens
tgcacgagctgaagca

SEQ ID NO: 146514 - DNA, 16 bp, H. sapiens
tgcacgcacgtgtgtg

SEQ ID NO: 146515 - DNA, 16 bp, H. sapiens
tgcacgccaccacgcc

SEQ ID NO: 146516 - DNA, 16 bp, H. sapiens
tgcacggtctccctct

SEQ ID NO: 146517 - DNA, 19 bp, H. sapiens
tgcacggtggctcacgcct

SEQ ID NO: 146518 - DNA, 16 bp, H. sapiens
tgcacgtgtgtgtgta

SEQ ID NO: 146519 - DNA, 16 bp, H. sapiens
tgcacgttgtacacat

SEQ ID NO: 146520 - DNA, 16 bp, H. sapiens
tgcactaatttacatt

SEQ ID NO: 146521 - DNA, 16 bp, H. sapiens
tgcactacagcccagg

SEQ ID NO: 146522 - DNA, 16 bp, H. sapiens
tgcactacagcctggg

SEQ ID NO: 146523 - DNA, 16 bp, H. sapiens
tgcactatgatcacac

SEQ ID NO: 146524 - DNA, 16 bp, H. sapiens
tgcactatgattgtgc

SEQ ID NO: 146525 - DNA, 16 bp, H. sapiens
tgcactattcacaata

SEQ ID NO: 146526 - DNA, 16 bp, H. sapiens
tgcactcaaacctggg

SEQ ID NO: 146527 - DNA, 16 bp, H. sapiens
tgcactcaagcctggg

SEQ ID NO: 146528 - DNA, 16 bp, H. sapiens
tgcactcacacataca

SEQ ID NO: 146529 - DNA, 16 bp, H. sapiens
tgcactcacacatgca

SEQ ID NO: 146530 - DNA, 16 bp, H. sapiens
tgcactcatcacaaag

SEQ ID NO: 146531 - DNA, 16 bp, H. sapiens
tgcactccaacctagg

SEQ ID NO: 146532 - DNA, 16 bp, H. sapiens
tgcactccaacctgga

SEQ ID NO: 146533 - DNA, 16 bp, H. sapiens
tgcactccaacctggg

SEQ ID NO: 146534 - DNA, 16 bp, H. sapiens
tgcactccaccctggg

SEQ ID NO: 146535 - DNA, 16 bp, H. sapiens
tgcactccagacaggg

SEQ ID NO: 146536 - DNA, 16 bp, H. sapiens
tgcactccagactggg

SEQ ID NO: 146537 - DNA, 16 bp, H. sapiens
tgcactccagagcctg

SEQ ID NO: 146538 - DNA, 16 bp, H. sapiens
tgcactccagcatggg

SEQ ID NO: 146539 - DNA, 16 bp, H. sapiens
tgcactccagcccagg

SEQ ID NO: 146540 - DNA, 17 bp, H. sapiens
tgcactccagcccagga

SEQ ID NO: 146541 - DNA, 16 bp, H. sapiens
tgcactccagcctaag

SEQ ID NO: 146542 - DNA, 16 bp, H. sapiens
tgcactccagcctagg

SEQ ID NO: 146543 - DNA, 16 bp, H. sapiens
tgcactccagcctgaa

SEQ ID NO: 146544 - DNA, 16 bp, H. sapiens
tgcactccagcctgag

SEQ ID NO: 146545 - DNA, 16 bp, H. sapiens
tgcactccagcctgat

SEQ ID NO: 146546 - DNA, 16 bp, H. sapiens
tgcactccagcctgca

SEQ ID NO: 146547 - DNA, 16 bp, H. sapiens
tgcactccagcctgga

SEQ ID NO: 146548 - DNA, 16 bp, H. sapiens
tgcactccagcctggc

SEQ ID NO: 146549 - DNA, 16 bp, H. sapiens
tgcactccagcctggg

SEQ ID NO: 146550 - DNA, 16 bp, H. sapiens
tgcactccagcctggt

SEQ ID NO: 146551 - DNA, 16 bp, H. sapiens
tgcactccagcctgtg

SEQ ID NO: 146552 - DNA, 16 bp, H. sapiens
tgcactccagccttga

SEQ ID NO: 146553 - DNA, 16 bp, H. sapiens
tgcactccagccttgg

SEQ ID NO: 146554 - DNA, 16 bp, H. sapiens
tgcactccagcgtggg

SEQ ID NO: 146555 - DNA, 16 bp, H. sapiens
tgcactccagctccag

SEQ ID NO: 146556 - DNA, 16 bp, H. sapiens
tgcactccagcttggg

SEQ ID NO: 146557 - DNA, 16 bp, H. sapiens
tgcactccaggctggg

SEQ ID NO: 146558 - DNA, 16 bp, H. sapiens
tgcactccagtccggg

SEQ ID NO: 146559 - DNA, 16 bp, H. sapiens
tgcactccagtctggg

SEQ ID NO: 146560 - DNA, 16 bp, H. sapiens
tgcactccagtctggt

SEQ ID NO: 146561 - DNA, 16 bp, H. sapiens
tgcactccatcctgag

SEQ ID NO: 146562 - DNA, 16 bp, H. sapiens
tgcactccatcctgga

SEQ ID NO: 146563 - DNA, 16 bp, H. sapiens
tgcactcccagcactt

SEQ ID NO: 146564 - DNA, 16 bp, H. sapiens
tgcactcccagctact

SEQ ID NO: 146565 - DNA, 16 bp, H. sapiens
tgcactcccatgttca

SEQ ID NO: 146566 - DNA, 16 bp, H. sapiens
tgcactcccgcctggg

SEQ ID NO: 146567 - DNA, 16 bp, H. sapiens
tgcactccggcctggg

SEQ ID NO: 146568 - DNA, 16 bp, H. sapiens
tgcactcctgcctggg

SEQ ID NO: 146569 - DNA, 16 bp, H. sapiens
tgcactcctggctggg

SEQ ID NO: 146570 - DNA, 16 bp, H. sapiens
tgcactcctgtctggg

SEQ ID NO: 146571 - DNA, 16 bp, H. sapiens
tgcactcgagcctggg

SEQ ID NO: 146572 - DNA, 16 bp, H. sapiens
tgcactcgggcctggg

SEQ ID NO: 146573 - DNA, 16 bp, H. sapiens
tgcactctaacctggg

SEQ ID NO: 146574 - DNA, 16 bp, H. sapiens
tgcactctagcctggc

SEQ ID NO: 146575 - DNA, 16 bp, H. sapiens
tgcactctagcctggg

SEQ ID NO: 146576 - DNA, 16 bp, H. sapiens
tgcactctagtctggg

SEQ ID NO: 146577 - DNA, 16 bp, H. sapiens
tgcactctatcctggg

SEQ ID NO: 146578 - DNA, 16 bp, H. sapiens
tgcactctggcccaga

SEQ ID NO: 146579 - DNA, 16 bp, H. sapiens
tgcactgagaacagca

SEQ ID NO: 146580 - DNA, 16 bp, H. sapiens
tgcactgagctgagac

SEQ ID NO: 146581 - DNA, 17 bp, H. sapiens
tgcactgagctgagatc

SEQ ID NO: 146582 - DNA, 18 bp, H. sapiens
tgcactgagctgagattg

SEQ ID NO: 146583 - DNA, 16 bp, H. sapiens
tgcactgatttttttt

SEQ ID NO: 146584 - DNA, 16 bp, H. sapiens
tgcactgcaaaagaaa

SEQ ID NO: 146585 - DNA, 16 bp, H. sapiens
tgcactgcaagcagct

SEQ ID NO: 146586 - DNA, 16 bp, H. sapiens
tgcactgcagcctggg

SEQ ID NO: 146587 - DNA, 16 bp, H. sapiens
tgcactggaatggaag

SEQ ID NO: 146588 - DNA, 16 bp, H. sapiens
tgcactggctgttcct

SEQ ID NO: 146589 - DNA, 16 bp, H. sapiens
tgcactgtgctgggag

SEQ ID NO: 146590 - DNA, 16 bp, H. sapiens
tgcactgtggtgtgag

SEQ ID NO: 146591 - DNA, 16 bp, H. sapiens
tgcactgttcctcatg

SEQ ID NO: 146592 - DNA, 16 bp, H. sapiens
tgcacttaaaaaaaaa

SEQ ID NO: 146593 - DNA, 16 bp, H. sapiens
tgcacttaaaaataat

SEQ ID NO: 146594 - DNA, 16 bp, H. sapiens
tgcacttaacactgga

SEQ ID NO: 146595 - DNA, 16 bp, H. sapiens
tgcacttaacattttt

SEQ ID NO: 146596 - DNA, 16 bp, H. sapiens
tgcacttatttattta

SEQ ID NO: 146597 - DNA, 16 bp, H. sapiens
tgcacttcaccctggg

SEQ ID NO: 146598 - DNA, 16 bp, H. sapiens
tgcacttcagcctgag

SEQ ID NO: 146599 - DNA, 16 bp, H. sapiens
tgcacttcagcctgga

SEQ ID NO: 146600 - DNA, 16 bp, H. sapiens
tgcacttcagcctggg

SEQ ID NO: 146601 - DNA, 16 bp, H. sapiens
tgcacttctctctcct

SEQ ID NO: 146602 - DNA, 16 bp, H. sapiens
tgcacttgctgttttc

SEQ ID NO: 146603 - DNA, 16 bp, H. sapiens
tgcactttagcctgga

SEQ ID NO: 146604 - DNA, 16 bp, H. sapiens
tgcactttagcctggg

SEQ ID NO: 146605 - DNA, 16 bp, H. sapiens
tgcactttatttattt

SEQ ID NO: 146606 - DNA, 16 bp, H. sapiens
tgcactttatttctgt

SEQ ID NO: 146607 - DNA, 16 bp, H. sapiens
tgcactttattttatt

SEQ ID NO: 146608 - DNA, 16 bp, H. sapiens
tgcactttgggaagct

SEQ ID NO: 146609 - DNA, 16 bp, H. sapiens
tgcactttggggccat

SEQ ID NO: 146610 - DNA, 16 bp, H. sapiens
tgcacttttcccaagg

SEQ ID NO: 146611 - DNA, 16 bp, H. sapiens
tgcactttttaaaaaa

SEQ ID NO: 146612 - DNA, 16 bp, H. sapiens
tgcagaaaaaaagcat

SEQ ID NO: 146613 - DNA, 16 bp, H. sapiens
tgcagaaaaaaatttg

SEQ ID NO: 146614 - DNA, 16 bp, H. sapiens
tgcagaaaaaagggaa

SEQ ID NO: 146615 - DNA, 16 bp, H. sapiens
tgcagaaaagcaaaga

SEQ ID NO: 146616 - DNA, 16 bp, H. sapiens
tgcagaaaaggctttg

SEQ ID NO: 146617 - DNA, 16 bp, H. sapiens
tgcagaaaataaaata

SEQ ID NO: 146618 - DNA, 16 bp, H. sapiens
tgcagaaaataatttt

SEQ ID NO: 146619 - DNA, 16 bp, H. sapiens
tgcagaaaatcaaaga

SEQ ID NO: 146620 - DNA, 16 bp, H. sapiens
tgcagaaaattataaa

SEQ ID NO: 146621 - DNA, 16 bp, H. sapiens
tgcagaaacagaaaaa

SEQ ID NO: 146622 - DNA, 16 bp, H. sapiens
tgcagaaacttggatg

SEQ ID NO: 146623 - DNA, 16 bp, H. sapiens
tgcagaaagaaatcat

SEQ ID NO: 146624 - DNA, 16 bp, H. sapiens
tgcagaaagtataaaa

SEQ ID NO: 146625 - DNA, 16 bp, H. sapiens
tgcagaaatgtctatt

SEQ ID NO: 146626 - DNA, 16 bp, H. sapiens
tgcagaaatttatttt

SEQ ID NO: 146627 - DNA, 16 bp, H. sapiens
tgcagaaattttgttt

SEQ ID NO: 146628 - DNA, 16 bp, H. sapiens
tgcagaacagcaaaaa

SEQ ID NO: 146629 - DNA, 16 bp, H. sapiens
tgcagaacagcaaaga

SEQ ID NO: 146630 - DNA, 17 bp, H. sapiens
tgcagaacgtgcagatt

SEQ ID NO: 146631 - DNA, 16 bp, H. sapiens
tgcagaacgtgcaggt

SEQ ID NO: 146632 - DNA, 16 bp, H. sapiens
tgcagaactgattgct

SEQ ID NO: 146633 - DNA, 16 bp, H. sapiens
tgcagaactgcgagtc

SEQ ID NO: 146634 - DNA, 16 bp, H. sapiens
tgcagaactgggagcc

SEQ ID NO: 146635 - DNA, 16 bp, H. sapiens
tgcagaactttgaact

SEQ ID NO: 146636 - DNA, 16 bp, H. sapiens
tgcagaagaaaatttt

SEQ ID NO: 146637 - DNA, 16 bp, H. sapiens
tgcagaagaaatgaaa

SEQ ID NO: 146638 - DNA, 16 bp, H. sapiens
tgcagaagaaggcatc

SEQ ID NO: 146639 - DNA, 16 bp, H. sapiens
tgcagaagcaaaaagc

SEQ ID NO: 146640 - DNA, 16 bp, H. sapiens
tgcagaagctgcagca

SEQ ID NO: 146641 - DNA, 16 bp, H. sapiens
tgcagaagctgtttag

SEQ ID NO: 146642 - DNA, 16 bp, H. sapiens
tgcagaagcttttaaa

SEQ ID NO: 146643 - DNA, 16 bp, H. sapiens
tgcagaatatgaaagg

SEQ ID NO: 146644 - DNA, 17 bp, H. sapiens
tgcagaatgtgcagatt

SEQ ID NO: 146645 - DNA, 16 bp, H. sapiens
tgcagaattttttttt

SEQ ID NO: 146646 - DNA, 16 bp, H. sapiens
tgcagacactgctgct

SEQ ID NO: 146647 - DNA, 16 bp, H. sapiens
tgcagacaggagctgt

SEQ ID NO: 146648 - DNA, 16 bp, H. sapiens
tgcagaccctgaccca

SEQ ID NO: 146649 - DNA, 16 bp, H. sapiens
tgcagaccctgcactt

SEQ ID NO: 146650 - DNA, 16 bp, H. sapiens
tgcagaccttcccagt

SEQ ID NO: 146651 - DNA, 16 bp, H. sapiens
tgcagaccttgcactt

SEQ ID NO: 146652 - DNA, 16 bp, H. sapiens
tgcagactgctgactt

SEQ ID NO: 146653 - DNA, 16 bp, H. sapiens
tgcagacttcacaggc

SEQ ID NO: 146654 - DNA, 16 bp, H. sapiens
tgcagagaaaaagaga

SEQ ID NO: 146655 - DNA, 16 bp, H. sapiens
tgcagagacaaggtct

SEQ ID NO: 146656 - DNA, 16 bp, H. sapiens
tgcagagacatggatg

SEQ ID NO: 146657 - DNA, 16 bp, H. sapiens
tgcagagagaaagaga

SEQ ID NO: 146658 - DNA, 16 bp, H. sapiens
tgcagagagccatgat

SEQ ID NO: 146659 - DNA, 16 bp, H. sapiens
tgcagagattttgttt

SEQ ID NO: 146660 - DNA, 16 bp, H. sapiens
tgcagagcaaccactt

SEQ ID NO: 146661 - DNA, 16 bp, H. sapiens
tgcagagcagcaaaga

SEQ ID NO: 146662 - DNA, 16 bp, H. sapiens
tgcagagccacagggc

SEQ ID NO: 146663 - DNA, 16 bp, H. sapiens
tgcagagcccagaggg

SEQ ID NO: 146664 - DNA, 16 bp, H. sapiens
tgcagagccttctcct

SEQ ID NO: 146665 - DNA, 16 bp, H. sapiens
tgcagagctgctactg

SEQ ID NO: 146666 - DNA, 16 bp, H. sapiens
tgcagagctgtgttca

SEQ ID NO: 146667 - DNA, 16 bp, H. sapiens
tgcagaggaatgaaat

SEQ ID NO: 146668 - DNA, 25 bp, H. sapiens
tgcagaggacaccagcgagcttcca

SEQ ID NO: 146669 - DNA, 16 bp, H. sapiens
tgcagaggctcaggcc

SEQ ID NO: 146670 - DNA, 16 bp, H. sapiens
tgcagaggtcaccacc

SEQ ID NO: 146671 - DNA, 16 bp, H. sapiens
tgcagaggtgcaatca

SEQ ID NO: 146672 - DNA, 16 bp, H. sapiens
tgcagagtgcctggga

SEQ ID NO: 146673 - DNA, 16 bp, H. sapiens
tgcagatacagctgca

SEQ ID NO: 146674 - DNA, 16 bp, H. sapiens
tgcagatactgtgttt

SEQ ID NO: 146675 - DNA, 16 bp, H. sapiens
tgcagatattttctct

SEQ ID NO: 146676 - DNA, 16 bp, H. sapiens
tgcagatgaaaaaact

SEQ ID NO: 146677 - DNA, 16 bp, H. sapiens
tgcagatgaagaaaat

SEQ ID NO: 146678 - DNA, 16 bp, H. sapiens
tgcagatgaagccttc

SEQ ID NO: 146679 - DNA, 16 bp, H. sapiens
tgcagatgagaaaaca

SEQ ID NO: 146680 - DNA, 16 bp, H. sapiens
tgcagatgagaaaagt

SEQ ID NO: 146681 - DNA, 16 bp, H. sapiens
tgcagatgagaaaatg

SEQ ID NO: 146682 - DNA, 16 bp, H. sapiens
tgcagatgatgaaact

SEQ ID NO: 146683 - DNA, 16 bp, H. sapiens
tgcagatgctgctggt

SEQ ID NO: 146684 - DNA, 16 bp, H. sapiens
tgcagatggcagagct

SEQ ID NO: 146685 - DNA, 16 bp, H. sapiens
tgcagatggccacctt

SEQ ID NO: 146686 - DNA, 16 bp, H. sapiens
tgcagatggccacttt

SEQ ID NO: 146687 - DNA, 16 bp, H. sapiens
tgcagatgtagttagt

SEQ ID NO: 146688 - DNA, 16 bp, H. sapiens
tgcagatgtcattaag

SEQ ID NO: 146689 - DNA, 16 bp, H. sapiens
tgcagattatatgatt

SEQ ID NO: 146690 - DNA, 16 bp, H. sapiens
tgcagattcctgggcc

SEQ ID NO: 146691 - DNA, 16 bp, H. sapiens
tgcagattctcaggcc

SEQ ID NO: 146692 - DNA, 16 bp, H. sapiens
tgcagattctgactca

SEQ ID NO: 146693 - DNA, 16 bp, H. sapiens
tgcagattttttaaaa

SEQ ID NO: 146694 - DNA, 16 bp, H. sapiens
tgcagcaaaaacaaaa

SEQ ID NO: 146695 - DNA, 16 bp, H. sapiens
tgcagcaaaataaact

SEQ ID NO: 146696 - DNA, 16 bp, H. sapiens
tgcagcaaaattctgc

SEQ ID NO: 146697 - DNA, 16 bp, H. sapiens
tgcagcaaaccagcat

SEQ ID NO: 146698 - DNA, 16 bp, H. sapiens
tgcagcaaatcaccat

SEQ ID NO: 146699 - DNA, 16 bp, H. sapiens
tgcagcaacatggatg

SEQ ID NO: 146700 - DNA, 16 bp, H. sapiens
tgcagcaacctcagtt

SEQ ID NO: 146701 - DNA, 16 bp, H. sapiens
tgcagcaacgtggatg

SEQ ID NO: 146702 - DNA, 16 bp, H. sapiens
tgcagcacaacagcat

SEQ ID NO: 146703 - DNA, 16 bp, H. sapiens
tgcagcacacctgctc

SEQ ID NO: 146704 - DNA, 16 bp, H. sapiens
tgcagcaccacacctg

SEQ ID NO: 146705 - DNA, 16 bp, H. sapiens
tgcagcaccccaacat

SEQ ID NO: 146706 - DNA, 16 bp, H. sapiens
tgcagcactgtttgta

SEQ ID NO: 146707 - DNA, 16 bp, H. sapiens
tgcagcactttgggag

SEQ ID NO: 146708 - DNA, 16 bp, H. sapiens
tgcagcagagaaagag

SEQ ID NO: 146709 - DNA, 16 bp, H. sapiens
tgcagcagaggcagcc

SEQ ID NO: 146710 - DNA, 16 bp, H. sapiens
tgcagcagcacccagg

SEQ ID NO: 146711 - DNA, 16 bp, H. sapiens
tgcagcagcagaaaca

SEQ ID NO: 146712 - DNA, 16 bp, H. sapiens
tgcagcagccagcatg

SEQ ID NO: 146713 - DNA, 16 bp, H. sapiens
tgcagcagctcacgcc

SEQ ID NO: 146714 - DNA, 16 bp, H. sapiens
tgcagcagctgctcca

SEQ ID NO: 146715 - DNA, 16 bp, H. sapiens
tgcagcagctgctgcc

SEQ ID NO: 146716 - DNA, 16 bp, H. sapiens
tgcagcagctgctgct

SEQ ID NO: 146717 - DNA, 16 bp, H. sapiens
tgcagcagtccctgca

SEQ ID NO: 146718 - DNA, 16 bp, H. sapiens
tgcagcatgtgtcaga

SEQ ID NO: 146719 - DNA, 16 bp, H. sapiens
tgcagcattattcaca

SEQ ID NO: 146720 - DNA, 16 bp, H. sapiens
tgcagcattatttgca

SEQ ID NO: 146721 - DNA, 16 bp, H. sapiens
tgcagccaacaaacat

SEQ ID NO: 146722 - DNA, 16 bp, H. sapiens
tgcagccaacaaatat

SEQ ID NO: 146723 - DNA, 16 bp, H. sapiens
tgcagccaatacagga

SEQ ID NO: 146724 - DNA, 16 bp, H. sapiens
tgcagccaccaccacc

SEQ ID NO: 146725 - DNA, 16 bp, H. sapiens
tgcagccagcaaacat

SEQ ID NO: 146726 - DNA, 16 bp, H. sapiens
tgcagccagccaagat

SEQ ID NO: 146727 - DNA, 16 bp, H. sapiens
tgcagccaggctgggg

SEQ ID NO: 146728 - DNA, 16 bp, H. sapiens
tgcagccatataaaag

SEQ ID NO: 146729 - DNA, 16 bp, H. sapiens
tgcagccatgaactcc

SEQ ID NO: 146730 - DNA, 16 bp, H. sapiens
tgcagccatgagcaga

SEQ ID NO: 146731 - DNA, 16 bp, H. sapiens
tgcagccattaaaaag

SEQ ID NO: 146732 - DNA, 16 bp, H. sapiens
tgcagccattaaaatg

SEQ ID NO: 146733 - DNA, 16 bp, H. sapiens
tgcagcccacagagga

SEQ ID NO: 146734 - DNA, 16 bp, H. sapiens
tgcagcccactgagca

SEQ ID NO: 146735 - DNA, 16 bp, H. sapiens
tgcagcccagcctggg

SEQ ID NO: 146736 - DNA, 16 bp, H. sapiens
tgcagcccagtgggtc

SEQ ID NO: 146737 - DNA, 16 bp, H. sapiens
tgcagcccatggaggg

SEQ ID NO: 146738 - DNA, 16 bp, H. sapiens
tgcagccccaaactcc

SEQ ID NO: 146739 - DNA, 16 bp, H. sapiens
tgcagcccctttgttt

SEQ ID NO: 146740 - DNA, 18 bp, H. sapiens
tgcagcccgagagtttgg

SEQ ID NO: 146741 - DNA, 17 bp, H. sapiens
tgcagcccggttcctaa

SEQ ID NO: 146742 - DNA, 16 bp, H. sapiens
tgcagccctgctgaca

SEQ ID NO: 146743 - DNA, 16 bp, H. sapiens
tgcagccctgttcaca

SEQ ID NO: 146744 - DNA, 16 bp, H. sapiens
tgcagccgccgccgcc

SEQ ID NO: 146745 - DNA, 16 bp, H. sapiens
tgcagcctatggtgga

SEQ ID NO: 146746 - DNA, 17 bp, H. sapiens
tgcagcctcaacctccc

SEQ ID NO: 146747 - DNA, 16 bp, H. sapiens
tgcagcctcaactccc

SEQ ID NO: 146748 - DNA, 16 bp, H. sapiens
tgcagcctcaacttca

SEQ ID NO: 146749 - DNA, 16 bp, H. sapiens
tgcagcctcagcccct

SEQ ID NO: 146750 - DNA, 16 bp, H. sapiens
tgcagcctcagccttc

SEQ ID NO: 146751 - DNA, 16 bp, H. sapiens
tgcagcctcagcttcc

SEQ ID NO: 146752 - DNA, 16 bp, H. sapiens
tgcagcctcagtctct

SEQ ID NO: 146753 - DNA, 16 bp, H. sapiens
tgcagcctcatgagag

SEQ ID NO: 146754 - DNA, 16 bp, H. sapiens
tgcagcctccagctcc

SEQ ID NO: 146755 - DNA, 16 bp, H. sapiens
tgcagcctccatcttc

SEQ ID NO: 146756 - DNA, 16 bp, H. sapiens
tgcagcctccctgcct

SEQ ID NO: 146757 - DNA, 16 bp, H. sapiens
tgcagcctccgactcc

SEQ ID NO: 146758 - DNA, 16 bp, H. sapiens
tgcagcctcgaccacc

SEQ ID NO: 146759 - DNA, 17 bp, H. sapiens
tgcagcctcgacctccc

SEQ ID NO: 146760 - DNA, 17 bp, H. sapiens
tgcagcctcgacttcct

SEQ ID NO: 146761 - DNA, 16 bp, H. sapiens
tgcagcctctgcctcg

SEQ ID NO: 146762 - DNA, 16 bp, H. sapiens
tgcagcctctgtcccc

SEQ ID NO: 146763 - DNA, 16 bp, H. sapiens
tgcagcctgagcctcc

SEQ ID NO: 146764 - DNA, 16 bp, H. sapiens
tgcagcctgctgggcc

SEQ ID NO: 146765 - DNA, 16 bp, H. sapiens
tgcagcctggaactct

SEQ ID NO: 146766 - DNA, 16 bp, H. sapiens
tgcagcctggaagaca

SEQ ID NO: 146767 - DNA, 16 bp, H. sapiens
tgcagcctgggtgaca

SEQ ID NO: 146768 - DNA, 16 bp, H. sapiens
tgcagcctgtacagga

SEQ ID NO: 146769 - DNA, 16 bp, H. sapiens
tgcagcctgtgcctcc

SEQ ID NO: 146770 - DNA, 16 bp, H. sapiens
tgcagccttgaactcc

SEQ ID NO: 146771 - DNA, 16 bp, H. sapiens
tgcagccttgacctct

SEQ ID NO: 146772 - DNA, 17 bp, H. sapiens
tgcagcgagccgagatt

SEQ ID NO: 146773 - DNA, 16 bp, H. sapiens
tgcagcgagccgtgat

SEQ ID NO: 146774 - DNA, 16 bp, H. sapiens
tgcagcggctgctgcc

SEQ ID NO: 146775 - DNA, 16 bp, H. sapiens
tgcagcggggaggagc

SEQ ID NO: 146776 - DNA, 16 bp, H. sapiens
tgcagcggtgcaatca

SEQ ID NO: 146777 - DNA, 16 bp, H. sapiens
tgcagctagaggccat

SEQ ID NO: 146778 - DNA, 17 bp, H. sapiens
tgcagctatgccagcag

SEQ ID NO: 146779 - DNA, 16 bp, H. sapiens
tgcagctattggatga

SEQ ID NO: 146780 - DNA, 16 bp, H. sapiens
tgcagctattgtaaat

SEQ ID NO: 146781 - DNA, 16 bp, H. sapiens
tgcagctatttgattt

SEQ ID NO: 146782 - DNA, 16 bp, H. sapiens
tgcagctattttaaaa

SEQ ID NO: 146783 - DNA, 16 bp, H. sapiens
tgcagctcaccaacat

SEQ ID NO: 146784 - DNA, 16 bp, H. sapiens
tgcagctcagaagaaa

SEQ ID NO: 146785 - DNA, 17 bp, H. sapiens
tgcagctcccactcaga

SEQ ID NO: 146786 - DNA, 16 bp, H. sapiens
tgcagctcttccaggc

SEQ ID NO: 146787 - DNA, 16 bp, H. sapiens
tgcagctgaaggccat

SEQ ID NO: 146788 - DNA, 16 bp, H. sapiens
tgcagctgaaggtcct

SEQ ID NO: 146789 - DNA, 16 bp, H. sapiens
tgcagctgagagacct

SEQ ID NO: 146790 - DNA, 16 bp, H. sapiens
tgcagctgcaagccaa

SEQ ID NO: 146791 - DNA, 16 bp, H. sapiens
tgcagctgcaaggtca

SEQ ID NO: 146792 - DNA, 16 bp, H. sapiens
tgcagctgcagaaaga

SEQ ID NO: 146793 - DNA, 16 bp, H. sapiens
tgcagctgcagccgcc

SEQ ID NO: 146794 - DNA, 16 bp, H. sapiens
tgcagctgcagcctcc

SEQ ID NO: 146795 - DNA, 16 bp, H. sapiens
tgcagctgcagctgcc

SEQ ID NO: 146796 - DNA, 16 bp, H. sapiens
tgcagctgcagctgct

SEQ ID NO: 146797 - DNA, 16 bp, H. sapiens
tgcagctgcagtggta

SEQ ID NO: 146798 - DNA, 16 bp, H. sapiens
tgcagctgctgctgct

SEQ ID NO: 146799 - DNA, 16 bp, H. sapiens
tgcagctgctgctgga

SEQ ID NO: 146800 - DNA, 16 bp, H. sapiens
tgcagctgctgctggg

SEQ ID NO: 146801 - DNA, 16 bp, H. sapiens
tgcagctgctgtacca

SEQ ID NO: 146802 - DNA, 16 bp, H. sapiens
tgcagctgctgtggga

SEQ ID NO: 146803 - DNA, 16 bp, H. sapiens
tgcagctggagacccg

SEQ ID NO: 146804 - DNA, 16 bp, H. sapiens
tgcagctggagacctg

SEQ ID NO: 146805 - DNA, 16 bp, H. sapiens
tgcagctggaggccac

SEQ ID NO: 146806 - DNA, 16 bp, H. sapiens
tgcagctggaggccat

SEQ ID NO: 146807 - DNA, 16 bp, H. sapiens
tgcagctggaggctat

SEQ ID NO: 146808 - DNA, 16 bp, H. sapiens
tgcagctggaggctgc

SEQ ID NO: 146809 - DNA, 16 bp, H. sapiens
tgcagctggaggtcat

SEQ ID NO: 146810 - DNA, 16 bp, H. sapiens
tgcagctgggtctcca

SEQ ID NO: 146811 - DNA, 16 bp, H. sapiens
tgcagctggtggagtc

SEQ ID NO: 146812 - DNA, 16 bp, H. sapiens
tgcagctgtacaaaaa

SEQ ID NO: 146813 - DNA, 16 bp, H. sapiens
tgcagctgtgacctcc

SEQ ID NO: 146814 - DNA, 16 bp, H. sapiens
tgcagctgtgagaaga

SEQ ID NO: 146815 - DNA, 16 bp, H. sapiens
tgcagctgtgtgtgtg

SEQ ID NO: 146816 - DNA, 16 bp, H. sapiens
tgcagcttcttcacct

SEQ ID NO: 146817 - DNA, 16 bp, H. sapiens
tgcagctttgacctcc

SEQ ID NO: 146818 - DNA, 16 bp, H. sapiens
tgcagctttgacttcc

SEQ ID NO: 146819 - DNA, 16 bp, H. sapiens
tgcagctttgttacat

SEQ ID NO: 146820 - DNA, 16 bp, H. sapiens
tgcagctttgtttaca

SEQ ID NO: 146821 - DNA, 16 bp, H. sapiens
tgcaggaacaatggca

SEQ ID NO: 146822 - DNA, 16 bp, H. sapiens
tgcaggaagcatggtg

SEQ ID NO: 146823 - DNA, 16 bp, H. sapiens
tgcaggaagctgagat

SEQ ID NO: 146824 - DNA, 16 bp, H. sapiens
tgcaggaagtcaggga

SEQ ID NO: 146825 - DNA, 16 bp, H. sapiens
tgcaggaatggtttaa

SEQ ID NO: 146826 - DNA, 16 bp, H. sapiens
tgcaggacatgcaggt

SEQ ID NO: 146827 - DNA, 16 bp, H. sapiens
tgcaggaccatttcaa

SEQ ID NO: 146828 - DNA, 16 bp, H. sapiens
tgcaggacttctcaga

SEQ ID NO: 146829 - DNA, 16 bp, H. sapiens
tgcaggagagtgcctg

SEQ ID NO: 146830 - DNA, 16 bp, H. sapiens
tgcaggagcagagccc

SEQ ID NO: 146831 - DNA, 16 bp, H. sapiens
tgcaggaggagctgag

SEQ ID NO: 146832 - DNA, 16 bp, H. sapiens
tgcaggaggcttctgc

SEQ ID NO: 146833 - DNA, 16 bp, H. sapiens
tgcaggaggtggaggt

SEQ ID NO: 146834 - DNA, 16 bp, H. sapiens
tgcaggaggtgtacac

SEQ ID NO: 146835 - DNA, 16 bp, H. sapiens
tgcaggatataaggtt

SEQ ID NO: 146836 - DNA, 19 bp, H. sapiens
tgcaggatccactgggtga

SEQ ID NO: 146837 - DNA, 16 bp, H. sapiens
tgcaggatgtgccttg

SEQ ID NO: 146838 - DNA, 16 bp, H. sapiens
tgcaggcatgagccag

SEQ ID NO: 146839 - DNA, 16 bp, H. sapiens
tgcaggccacatgtgg

SEQ ID NO: 146840 - DNA, 16 bp, H. sapiens
tgcaggccaccatgcc

SEQ ID NO: 146841 - DNA, 17 bp, H. sapiens
tgcaggccagccctcca

SEQ ID NO: 146842 - DNA, 16 bp, H. sapiens
tgcaggccaggagaga

SEQ ID NO: 146843 - DNA, 16 bp, H. sapiens
tgcaggccaggcatgg

SEQ ID NO: 146844 - DNA, 16 bp, H. sapiens
tgcaggccagtgccaa

SEQ ID NO: 146845 - DNA, 16 bp, H. sapiens
tgcaggccttgggtga

SEQ ID NO: 146846 - DNA, 17 bp, H. sapiens
tgcaggcgcgcaccgcc

SEQ ID NO: 146847 - DNA, 16 bp, H. sapiens
tgcaggcgtgagctac

SEQ ID NO: 146848 - DNA, 16 bp, H. sapiens
tgcaggctcagaagtg

SEQ ID NO: 146849 - DNA, 16 bp, H. sapiens
tgcaggctccgccccc

SEQ ID NO: 146850 - DNA, 16 bp, H. sapiens
tgcaggctgaggcagg

SEQ ID NO: 146851 - DNA, 16 bp, H. sapiens
tgcaggctgaggtggg

SEQ ID NO: 146852 - DNA, 16 bp, H. sapiens
tgcaggctgggtgtgg

SEQ ID NO: 146853 - DNA, 16 bp, H. sapiens
tgcaggctttacagga

SEQ ID NO: 146854 - DNA, 16 bp, H. sapiens
tgcaggcttttgtgtg

SEQ ID NO: 146855 - DNA, 16 bp, H. sapiens
tgcagggaaactcccg

SEQ ID NO: 146856 - DNA, 16 bp, H. sapiens
tgcagggacagagccc

SEQ ID NO: 146857 - DNA, 19 bp, H. sapiens
tgcagggacgcctctctga

SEQ ID NO: 146858 - DNA, 16 bp, H. sapiens
tgcagggagctgagat

SEQ ID NO: 146859 - DNA, 16 bp, H. sapiens
tgcagggaggcagagg

SEQ ID NO: 146860 - DNA, 16 bp, H. sapiens
tgcagggagggcagag

SEQ ID NO: 146861 - DNA, 16 bp, H. sapiens
tgcagggaggggcagg

SEQ ID NO: 146862 - DNA, 16 bp, H. sapiens
tgcagggaggtgtggg

SEQ ID NO: 146863 - DNA, 16 bp, H. sapiens
tgcagggattacaggt

SEQ ID NO: 146864 - DNA, 16 bp, H. sapiens
tgcagggccaaggcag

SEQ ID NO: 146865 - DNA, 16 bp, H. sapiens
tgcaggggaggctggg

SEQ ID NO: 146866 - DNA, 16 bp, H. sapiens
tgcaggggcagaggag

SEQ ID NO: 146867 - DNA, 16 bp, H. sapiens
tgcaggggctgctggg

SEQ ID NO: 146868 - DNA, 16 bp, H. sapiens
tgcaggggtgaagccc

SEQ ID NO: 146869 - DNA, 16 bp, H. sapiens
tgcagggtcaggcaaa

SEQ ID NO: 146870 - DNA, 16 bp, H. sapiens
tgcagggtcatatggt

SEQ ID NO: 146871 - DNA, 16 bp, H. sapiens
tgcagggtgcagcctc

SEQ ID NO: 146872 - DNA, 16 bp, H. sapiens
tgcagggtgcagggtg

SEQ ID NO: 146873 - DNA, 16 bp, H. sapiens
tgcagggttttttttt

SEQ ID NO: 146874 - DNA, 16 bp, H. sapiens
tgcaggtgacccaggt

SEQ ID NO: 146875 - DNA, 16 bp, H. sapiens
tgcaggtgatctgcct

SEQ ID NO: 146876 - DNA, 16 bp, H. sapiens
tgcaggtgctcaccac

SEQ ID NO: 146877 - DNA, 16 bp, H. sapiens
tgcaggtggagctgaa

SEQ ID NO: 146878 - DNA, 16 bp, H. sapiens
tgcaggtggaggccat

SEQ ID NO: 146879 - DNA, 16 bp, H. sapiens
tgcaggtggcaggggc

SEQ ID NO: 146880 - DNA, 16 bp, H. sapiens
tgcaggtggccacctt

SEQ ID NO: 146881 - DNA, 16 bp, H. sapiens
tgcaggtttggttcca

SEQ ID NO: 146882 - DNA, 16 bp, H. sapiens
tgcaggtttgttacat

SEQ ID NO: 146883 - DNA, 16 bp, H. sapiens
tgcagtaaaaacaaag

SEQ ID NO: 146884 - DNA, 16 bp, H. sapiens
tgcagtaaagaagcca

SEQ ID NO: 146885 - DNA, 16 bp, H. sapiens
tgcagtaaagacaggt

SEQ ID NO: 146886 - DNA, 16 bp, H. sapiens
tgcagtaaaggagctg

SEQ ID NO: 146887 - DNA, 16 bp, H. sapiens
tgcagtaacgtgatct

SEQ ID NO: 146888 - DNA, 16 bp, H. sapiens
tgcagtaagcagagat

SEQ ID NO: 146889 - DNA, 16 bp, H. sapiens
tgcagtaagccaagaa

SEQ ID NO: 146890 - DNA, 17 bp, H. sapiens
tgcagtaagccatgatc

SEQ ID NO: 146891 - DNA, 16 bp, H. sapiens
tgcagtaagcccagat

SEQ ID NO: 146892 - DNA, 17 bp, H. sapiens
tgcagtaagccgagatt

SEQ ID NO: 146893 - DNA, 16 bp, H. sapiens
tgcagtaagctatgat

SEQ ID NO: 146894 - DNA, 16 bp, H. sapiens
tgcagtaagctgagat

SEQ ID NO: 146895 - DNA, 16 bp, H. sapiens
tgcagtatttgttttt

SEQ ID NO: 146896 - DNA, 16 bp, H. sapiens
tgcagtattttaaaaa

SEQ ID NO: 146897 - DNA, 16 bp, H. sapiens
tgcagtcacagctact

SEQ ID NO: 146898 - DNA, 16 bp, H. sapiens
tgcagtcaccttccca

SEQ ID NO: 146899 - DNA, 16 bp, H. sapiens
tgcagtcagaattctt

SEQ ID NO: 146900 - DNA, 16 bp, H. sapiens
tgcagtcagccaagat

SEQ ID NO: 146901 - DNA, 17 bp, H. sapiens
tgcagtcagccgagatc

SEQ ID NO: 146902 - DNA, 16 bp, H. sapiens
tgcagtcagctcctct

SEQ ID NO: 146903 - DNA, 16 bp, H. sapiens
tgcagtccagccaggg

SEQ ID NO: 146904 - DNA, 16 bp, H. sapiens
tgcagtccagcctgag

SEQ ID NO: 146905 - DNA, 16 bp, H. sapiens
tgcagtccagcctggg

SEQ ID NO: 146906 - DNA, 16 bp, H. sapiens
tgcagtcccagcaact

SEQ ID NO: 146907 - DNA, 16 bp, H. sapiens
tgcagtcccagctacc

SEQ ID NO: 146908 - DNA, 16 bp, H. sapiens
tgcagtcccagctact

SEQ ID NO: 146909 - DNA, 16 bp, H. sapiens
tgcagtcccagctatg

SEQ ID NO: 146910 - DNA, 16 bp, H. sapiens
tgcagtcctagctact

SEQ ID NO: 146911 - DNA, 16 bp, H. sapiens
tgcagtccttgtggcc

SEQ ID NO: 146912 - DNA, 16 bp, H. sapiens
tgcagtctcagctcat

SEQ ID NO: 146913 - DNA, 16 bp, H. sapiens
tgcagtgaacatggga

SEQ ID NO: 146914 - DNA, 16 bp, H. sapiens
tgcagtgaaccaacat

SEQ ID NO: 146915 - DNA, 18 bp, H. sapiens
tgcagtgaaccgagatcg

SEQ ID NO: 146916 - DNA, 16 bp, H. sapiens
tgcagtgaactatgat

SEQ ID NO: 146917 - DNA, 16 bp, H. sapiens
tgcagtgaactgagac

SEQ ID NO: 146918 - DNA, 16 bp, H. sapiens
tgcagtgaactgagag

SEQ ID NO: 146919 - DNA, 16 bp, H. sapiens
tgcagtgaactgagat

SEQ ID NO: 146920 - DNA, 16 bp, H. sapiens
tgcagtgaactgtgat

SEQ ID NO: 146921 - DNA, 16 bp, H. sapiens
tgcagtgacactgaaa

SEQ ID NO: 146922 - DNA, 16 bp, H. sapiens
tgcagtgacctgtgat

SEQ ID NO: 146923 - DNA, 17 bp, H. sapiens
tgcagtgagacgagatc

SEQ ID NO: 146924 - DNA, 16 bp, H. sapiens
tgcagtgagcagagac

SEQ ID NO: 146925 - DNA, 16 bp, H. sapiens
tgcagtgagcagagat

SEQ ID NO: 146926 - DNA, 16 bp, H. sapiens
tgcagtgagcagtaat

SEQ ID NO: 146927 - DNA, 18 bp, H. sapiens
tgcagtgagccaagatcc

SEQ ID NO: 146928 - DNA, 18 bp, H. sapiens
tgcagtgagccaagatta

SEQ ID NO: 146929 - DNA, 16 bp, H. sapiens
tgcagtgagccgagac

SEQ ID NO: 146930 - DNA, 23 bp, H. sapiens
tgcagtgagccgagatagcacca

SEQ ID NO: 146931 - DNA, 26 bp, H. sapiens
tgcagtgagccgagatcgcgccactg

SEQ ID NO: 146932 - DNA, 19 bp, H. sapiens
tgcagtgagccgagattgc

SEQ ID NO: 146933 - DNA, 16 bp, H. sapiens
tgcagtgagcctagat

SEQ ID NO: 146934 - DNA, 18 bp, H. sapiens
tgcagtgagcctagatcg

SEQ ID NO: 146935 - DNA, 16 bp, H. sapiens
tgcagtgagcgaagat

SEQ ID NO: 146936 - DNA, 16 bp, H. sapiens
tgcagtgagcggacat

SEQ ID NO: 146937 - DNA, 16 bp, H. sapiens
tgcagtgagcggagat

SEQ ID NO: 146938 - DNA, 16 bp, H. sapiens
tgcagtgagctaggat

SEQ ID NO: 146939 - DNA, 16 bp, H. sapiens
tgcagtgagctatgac

SEQ ID NO: 146940 - DNA, 17 bp, H. sapiens
tgcagtgagctatgagc

SEQ ID NO: 146941 - DNA, 17 bp, H. sapiens
tgcagtgagctatgatg

SEQ ID NO: 146942 - DNA, 18 bp, H. sapiens
tgcagtgagctatgatta

SEQ ID NO: 146943 - DNA, 16 bp, H. sapiens
tgcagtgagctcagat

SEQ ID NO: 146944 - DNA, 16 bp, H. sapiens
tgcagtgagctctgat

SEQ ID NO: 146945 - DNA, 16 bp, H. sapiens
tgcagtgagctgaaat

SEQ ID NO: 146946 - DNA, 16 bp, H. sapiens
tgcagtgagctgagac

SEQ ID NO: 146947 - DNA, 16 bp, H. sapiens
tgcagtgagctgagag

SEQ ID NO: 146948 - DNA, 16 bp, H. sapiens
tgcagtgagctgagat

SEQ ID NO: 146949 - DNA, 17 bp, H. sapiens
tgcagtgagctgagctc

SEQ ID NO: 146950 - DNA, 16 bp, H. sapiens
tgcagtgagctgaggt

SEQ ID NO: 146951 - DNA, 16 bp, H. sapiens
tgcagtgagctgggat

SEQ ID NO: 146952 - DNA, 16 bp, H. sapiens
tgcagtgaggaggagg

SEQ ID NO: 146953 - DNA, 17 bp, H. sapiens
tgcagtgaggcgagatc

SEQ ID NO: 146954 - DNA, 18 bp, H. sapiens
tgcagtgagtcgagatcg

SEQ ID NO: 146955 - DNA, 17 bp, H. sapiens
tgcagtgagttatgatc

SEQ ID NO: 146956 - DNA, 19 bp, H. sapiens
tgcagtgagttgagattgc

SEQ ID NO: 146957 - DNA, 16 bp, H. sapiens
tgcagtgatctgagat

SEQ ID NO: 146958 - DNA, 16 bp, H. sapiens
tgcagtgatggaaatg

SEQ ID NO: 146959 - DNA, 16 bp, H. sapiens
tgcagtgatgtgatca

SEQ ID NO: 146960 - DNA, 16 bp, H. sapiens
tgcagtgattgtggga

SEQ ID NO: 146961 - DNA, 16 bp, H. sapiens
tgcagtgcacagcctg

SEQ ID NO: 146962 - DNA, 16 bp, H. sapiens
tgcagtgcctggcaca

SEQ ID NO: 146963 - DNA, 16 bp, H. sapiens
tgcagtggagaaatct

SEQ ID NO: 146964 - DNA, 16 bp, H. sapiens
tgcagtggagtggagt

SEQ ID NO: 146965 - DNA, 16 bp, H. sapiens
tgcagtggcacactca

SEQ ID NO: 146966 - DNA, 16 bp, H. sapiens
tgcagtggcaccatcc

SEQ ID NO: 146967 - DNA, 16 bp, H. sapiens
tgcagtggcactatct

SEQ ID NO: 146968 - DNA, 16 bp, H. sapiens
tgcagtggcctcagtg

SEQ ID NO: 146969 - DNA, 16 bp, H. sapiens
tgcagtggcgcgatca

SEQ ID NO: 146970 - DNA, 16 bp, H. sapiens
tgcagtggcgtgattc

SEQ ID NO: 146971 - DNA, 17 bp, H. sapiens
tgcagtggctcacacct

SEQ ID NO: 146972 - DNA, 16 bp, H. sapiens
tgcagtggctcaccct

SEQ ID NO: 146973 - DNA, 17 bp, H. sapiens
tgcagtggctcatacct

SEQ ID NO: 146974 - DNA, 16 bp, H. sapiens
tgcagtggctcatgct

SEQ ID NO: 146975 - DNA, 16 bp, H. sapiens
tgcagtggctcattct

SEQ ID NO: 146976 - DNA, 16 bp, H. sapiens
tgcagtggctgccgct

SEQ ID NO: 146977 - DNA, 16 bp, H. sapiens
tgcagtggctgctgct

SEQ ID NO: 146978 - DNA, 16 bp, H. sapiens
tgcagtggctggtgcc

SEQ ID NO: 146979 - DNA, 16 bp, H. sapiens
tgcagtgggaggattg

SEQ ID NO: 146980 - DNA, 18 bp, H. sapiens
tgcagtgggccaagatca

SEQ ID NO: 146981 - DNA, 16 bp, H. sapiens
tgcagtgggctgagat

SEQ ID NO: 146982 - DNA, 17 bp, H. sapiens
tgcagtgggctgtgatt

SEQ ID NO: 146983 - DNA, 16 bp, H. sapiens
tgcagtggggcagtca

SEQ ID NO: 146984 - DNA, 16 bp, H. sapiens
tgcagtggtacaatga

SEQ ID NO: 146985 - DNA, 16 bp, H. sapiens
tgcagtggtgacatct

SEQ ID NO: 146986 - DNA, 17 bp, H. sapiens
tgcagtggtgcaatctg

SEQ ID NO: 146987 - DNA, 17 bp, H. sapiens
tgcagtggtgcaatctt

SEQ ID NO: 146988 - DNA, 16 bp, H. sapiens
tgcagtggtgcagtat

SEQ ID NO: 146989 - DNA, 16 bp, H. sapiens
tgcagtggtgcagtca

SEQ ID NO: 146990 - DNA, 16 bp, H. sapiens
tgcagtggtgcgattt

SEQ ID NO: 146991 - DNA, 16 bp, H. sapiens
tgcagtggtgggacct

SEQ ID NO: 146992 - DNA, 16 bp, H. sapiens
tgcagtggtggttcaa

SEQ ID NO: 146993 - DNA, 21 bp, H. sapiens
tgcagtggtgtgatctcagct

SEQ ID NO: 146994 - DNA, 16 bp, H. sapiens
tgcagtggttcacacc

SEQ ID NO: 146995 - DNA, 16 bp, H. sapiens
tgcagtggtttgatct

SEQ ID NO: 146996 - DNA, 16 bp, H. sapiens
tgcagtgtgctttttc

SEQ ID NO: 146997 - DNA, 16 bp, H. sapiens
tgcagtgtggatggca

SEQ ID NO: 146998 - DNA, 16 bp, H. sapiens
tgcagtgttatttctg

SEQ ID NO: 146999 - DNA, 16 bp, H. sapiens
tgcagtgttctggaat

SEQ ID NO: 147000 - DNA, 16 bp, H. sapiens
tgcagtgtttctcaaa

SEQ ID NO: 147001 - DNA, 16 bp, H. sapiens
tgcagtgtttggttgt

SEQ ID NO: 147002 - DNA, 16 bp, H. sapiens
tgcagttagctatgat

SEQ ID NO: 147003 - DNA, 16 bp, H. sapiens
tgcagttagctgagac

SEQ ID NO: 147004 - DNA, 16 bp, H. sapiens
tgcagttagctgagat

SEQ ID NO: 147005 - DNA, 16 bp, H. sapiens
tgcagttattttaaaa

SEQ ID NO: 147006 - DNA, 16 bp, H. sapiens
tgcagttcaaaaacaa

SEQ ID NO: 147007 - DNA, 16 bp, H. sapiens
tgcagttcaaacccat

SEQ ID NO: 147008 - DNA, 16 bp, H. sapiens
tgcagttcaagtctga

SEQ ID NO: 147009 - DNA, 16 bp, H. sapiens
tgcagttcacaatagg

SEQ ID NO: 147010 - DNA, 16 bp, H. sapiens
tgcagttcacagtagg

SEQ ID NO: 147011 - DNA, 16 bp, H. sapiens
tgcagttccctgatga

SEQ ID NO: 147012 - DNA, 16 bp, H. sapiens
tgcagttcctcccact

SEQ ID NO: 147013 - DNA, 16 bp, H. sapiens
tgcagttctcatgata

SEQ ID NO: 147014 - DNA, 16 bp, H. sapiens
tgcagttctgcaggct

SEQ ID NO: 147015 - DNA, 19 bp, H. sapiens
tgcagttgagataagagga

SEQ ID NO: 147016 - DNA, 16 bp, H. sapiens
tgcagttgctgggtca

SEQ ID NO: 147017 - DNA, 16 bp, H. sapiens
tgcagttgctggtacc

SEQ ID NO: 147018 - DNA, 16 bp, H. sapiens
tgcagttggaattctt

SEQ ID NO: 147019 - DNA, 17 bp, H. sapiens
tgcagtttcactcctga

SEQ ID NO: 147020 - DNA, 16 bp, H. sapiens
tgcagtttccttttct

SEQ ID NO: 147021 - DNA, 16 bp, H. sapiens
tgcagtttctagggcc

SEQ ID NO: 147022 - DNA, 16 bp, H. sapiens
tgcagtttctgcctcc

SEQ ID NO: 147023 - DNA, 16 bp, H. sapiens
tgcagtttcttcaaaa

SEQ ID NO: 147024 - DNA, 16 bp, H. sapiens
tgcagtttcttcacag

SEQ ID NO: 147025 - DNA, 16 bp, H. sapiens
tgcagtttcttcccag

SEQ ID NO: 147026 - DNA, 16 bp, H. sapiens
tgcagtttgaaaaaca

SEQ ID NO: 147027 - DNA, 16 bp, H. sapiens
tgcagtttgaggtgca

SEQ ID NO: 147028 - DNA, 16 bp, H. sapiens
tgcagttttaaaatat

SEQ ID NO: 147029 - DNA, 16 bp, H. sapiens
tgcagttttctctttt

SEQ ID NO: 147030 - DNA, 16 bp, H. sapiens
tgcagttttgattttc

SEQ ID NO: 147031 - DNA, 16 bp, H. sapiens
tgcagttttgttacat

SEQ ID NO: 147032 - DNA, 16 bp, H. sapiens
tgcagttttgttttct

SEQ ID NO: 147033 - DNA, 16 bp, H. sapiens
tgcagtttttgtttgt

SEQ ID NO: 147034 - DNA, 16 bp, H. sapiens
tgcataaattcttttt

SEQ ID NO: 147035 - DNA, 16 bp, H. sapiens
tgcataacaaaccatc

SEQ ID NO: 147036 - DNA, 16 bp, H. sapiens
tgcataactgaaactt

SEQ ID NO: 147037 - DNA, 16 bp, H. sapiens
tgcatacaatgtgtag

SEQ ID NO: 147038 - DNA, 16 bp, H. sapiens
tgcatacacacacaca

SEQ ID NO: 147039 - DNA, 16 bp, H. sapiens
tgcatacatatatatt

SEQ ID NO: 147040 - DNA, 16 bp, H. sapiens
tgcatacatatgcaca

SEQ ID NO: 147041 - DNA, 16 bp, H. sapiens
tgcatacatatgtatg

SEQ ID NO: 147042 - DNA, 16 bp, H. sapiens
tgcatacatatttaca

SEQ ID NO: 147043 - DNA, 16 bp, H. sapiens
tgcatacatcacaaag

SEQ ID NO: 147044 - DNA, 16 bp, H. sapiens
tgcatacatgcatgta

SEQ ID NO: 147045 - DNA, 16 bp, H. sapiens
tgcatacattgtggaa

SEQ ID NO: 147046 - DNA, 16 bp, H. sapiens
tgcatacttaaaaatg

SEQ ID NO: 147047 - DNA, 16 bp, H. sapiens
tgcatataaaatgctt

SEQ ID NO: 147048 - DNA, 16 bp, H. sapiens
tgcatataatttttta

SEQ ID NO: 147049 - DNA, 16 bp, H. sapiens
tgcatatactacattt

SEQ ID NO: 147050 - DNA, 16 bp, H. sapiens
tgcatatatactacat

SEQ ID NO: 147051 - DNA, 16 bp, H. sapiens
tgcatatatatacaca

SEQ ID NO: 147052 - DNA, 16 bp, H. sapiens
tgcatatatatatata

SEQ ID NO: 147053 - DNA, 16 bp, H. sapiens
tgcatatatatgtatg

SEQ ID NO: 147054 - DNA, 16 bp, H. sapiens
tgcatatatctctttg

SEQ ID NO: 147055 - DNA, 16 bp, H. sapiens
tgcatatatgtatata

SEQ ID NO: 147056 - DNA, 16 bp, H. sapiens
tgcatatatgtgtgtg

SEQ ID NO: 147057 - DNA, 16 bp, H. sapiens
tgcatatattttctct

SEQ ID NO: 147058 - DNA, 16 bp, H. sapiens
tgcatatcaaaatcac

SEQ ID NO: 147059 - DNA, 16 bp, H. sapiens
tgcatatcattaacta

SEQ ID NO: 147060 - DNA, 16 bp, H. sapiens
tgcatatgcatataca

SEQ ID NO: 147061 - DNA, 19 bp, H. sapiens
tgcatatggctagccagtt

SEQ ID NO: 147062 - DNA, 16 bp, H. sapiens
tgcatatgtacataca

SEQ ID NO: 147063 - DNA, 16 bp, H. sapiens
tgcatatgtaccccct

SEQ ID NO: 147064 - DNA, 16 bp, H. sapiens
tgcatatgtatatgca

SEQ ID NO: 147065 - DNA, 16 bp, H. sapiens
tgcatatgtatgtgtg

SEQ ID NO: 147066 - DNA, 16 bp, H. sapiens
tgcatatgtgtgtaca

SEQ ID NO: 147067 - DNA, 16 bp, H. sapiens
tgcatatgtgtgtgag

SEQ ID NO: 147068 - DNA, 16 bp, H. sapiens
tgcatatgtgtttgtg

SEQ ID NO: 147069 - DNA, 16 bp, H. sapiens
tgcatattaagaataa

SEQ ID NO: 147070 - DNA, 16 bp, H. sapiens
tgcatattctggacat

SEQ ID NO: 147071 - DNA, 16 bp, H. sapiens
tgcatatttaaaattt

SEQ ID NO: 147072 - DNA, 16 bp, H. sapiens
tgcatatttaatgtat

SEQ ID NO: 147073 - DNA, 16 bp, H. sapiens
tgcatatttatatatg

SEQ ID NO: 147074 - DNA, 16 bp, H. sapiens
tgcatattttattata

SEQ ID NO: 147075 - DNA, 16 bp, H. sapiens
tgcatcacatagttct

SEQ ID NO: 147076 - DNA, 16 bp, H. sapiens
tgcatcacatcaggag

SEQ ID NO: 147077 - DNA, 16 bp, H. sapiens
tgcatcacttaatgac

SEQ ID NO: 147078 - DNA, 16 bp, H. sapiens
tgcatcagaatcacct

SEQ ID NO: 147079 - DNA, 16 bp, H. sapiens
tgcatcagaattgcct

SEQ ID NO: 147080 - DNA, 16 bp, H. sapiens
tgcatcagagagagaa

SEQ ID NO: 147081 - DNA, 16 bp, H. sapiens
tgcatcagtctcctga

SEQ ID NO: 147082 - DNA, 16 bp, H. sapiens
tgcatccaacaaagaa

SEQ ID NO: 147083 - DNA, 16 bp, H. sapiens
tgcatccataaaaaat

SEQ ID NO: 147084 - DNA, 16 bp, H. sapiens
tgcatcccagaaataa

SEQ ID NO: 147085 - DNA, 16 bp, H. sapiens
tgcatcccagggacaa

SEQ ID NO: 147086 - DNA, 16 bp, H. sapiens
tgcatccccagtgcct

SEQ ID NO: 147087 - DNA, 16 bp, H. sapiens
tgcatcccttccttac

SEQ ID NO: 147088 - DNA, 16 bp, H. sapiens
tgcatcctccacctct

SEQ ID NO: 147089 - DNA, 16 bp, H. sapiens
tgcatccttcattcca

SEQ ID NO: 147090 - DNA, 16 bp, H. sapiens
tgcatctatctctgtg

SEQ ID NO: 147091 - DNA, 16 bp, H. sapiens
tgcatctcctttgctg

SEQ ID NO: 147092 - DNA, 16 bp, H. sapiens
tgcatctcttccatct

SEQ ID NO: 147093 - DNA, 16 bp, H. sapiens
tgcatctgaaaaaaaa

SEQ ID NO: 147094 - DNA, 16 bp, H. sapiens
tgcatctgtagtccca

SEQ ID NO: 147095 - DNA, 16 bp, H. sapiens
tgcatctgttgaaatg

SEQ ID NO: 147096 - DNA, 16 bp, H. sapiens
tgcatgaaaatatttt

SEQ ID NO: 147097 - DNA, 16 bp, H. sapiens
tgcatgaaacaaagtt

SEQ ID NO: 147098 - DNA, 16 bp, H. sapiens
tgcatgaggtccaaga

SEQ ID NO: 147099 - DNA, 16 bp, H. sapiens
tgcatgatatatcttt

SEQ ID NO: 147100 - DNA, 16 bp, H. sapiens
tgcatgcacaaacaca

SEQ ID NO: 147101 - DNA, 16 bp, H. sapiens
tgcatgcacacacaca

SEQ ID NO: 147102 - DNA, 16 bp, H. sapiens
tgcatgcacacatgtg

SEQ ID NO: 147103 - DNA, 16 bp, H. sapiens
tgcatgcacagccttg

SEQ ID NO: 147104 - DNA, 16 bp, H. sapiens
tgcatgcacgtgcatg

SEQ ID NO: 147105 - DNA, 16 bp, H. sapiens
tgcatgcaggtgtctt

SEQ ID NO: 147106 - DNA, 16 bp, H. sapiens
tgcatgcagtcttttg

SEQ ID NO: 147107 - DNA, 16 bp, H. sapiens
tgcatgcatgcgtgtg

SEQ ID NO: 147108 - DNA, 16 bp, H. sapiens
tgcatgcatgggtgtg

SEQ ID NO: 147109 - DNA, 16 bp, H. sapiens
tgcatgcatgtatgta

SEQ ID NO: 147110 - DNA, 16 bp, H. sapiens
tgcatgcccaaaactt

SEQ ID NO: 147111 - DNA, 16 bp, H. sapiens
tgcatgcctggcacaa

SEQ ID NO: 147112 - DNA, 16 bp, H. sapiens
tgcatgcgtgtgcgtg

SEQ ID NO: 147113 - DNA, 16 bp, H. sapiens
tgcatgctattccatt

SEQ ID NO: 147114 - DNA, 16 bp, H. sapiens
tgcatgcttcctgccc

SEQ ID NO: 147115 - DNA, 16 bp, H. sapiens
tgcatggatgtgtgtg

SEQ ID NO: 147116 - DNA, 16 bp, H. sapiens
tgcatggatttttaaa

SEQ ID NO: 147117 - DNA, 16 bp, H. sapiens
tgcatgtaaatatata

SEQ ID NO: 147118 - DNA, 16 bp, H. sapiens
tgcatgtaacatacaa

SEQ ID NO: 147119 - DNA, 16 bp, H. sapiens
tgcatgtatatgcaca

SEQ ID NO: 147120 - DNA, 16 bp, H. sapiens
tgcatgtatctttata

SEQ ID NO: 147121 - DNA, 16 bp, H. sapiens
tgcatgtatgtgtatt

SEQ ID NO: 147122 - DNA, 16 bp, H. sapiens
tgcatgtatttgtgtg

SEQ ID NO: 147123 - DNA, 16 bp, H. sapiens
tgcatgtatttttata

SEQ ID NO: 147124 - DNA, 16 bp, H. sapiens
tgcatgtctgaaaatg

SEQ ID NO: 147125 - DNA, 16 bp, H. sapiens
tgcatgtgattttttt

SEQ ID NO: 147126 - DNA, 16 bp, H. sapiens
tgcatgtgcacatgtg

SEQ ID NO: 147127 - DNA, 16 bp, H. sapiens
tgcatgtgcatgtgtg

SEQ ID NO: 147128 - DNA, 16 bp, H. sapiens
tgcatgtggatgtgtg

SEQ ID NO: 147129 - DNA, 16 bp, H. sapiens
tgcatgtgtatatatg

SEQ ID NO: 147130 - DNA, 16 bp, H. sapiens
tgcatgtgtctctgtg

SEQ ID NO: 147131 - DNA, 16 bp, H. sapiens
tgcatgtgtcttcatg

SEQ ID NO: 147132 - DNA, 16 bp, H. sapiens
tgcatgtgtctttatg

SEQ ID NO: 147133 - DNA, 16 bp, H. sapiens
tgcatgtgtctttttc

SEQ ID NO: 147134 - DNA, 16 bp, H. sapiens
tgcatgtgtgaatgtg

SEQ ID NO: 147135 - DNA, 16 bp, H. sapiens
tgcatgtgtgcatggg

SEQ ID NO: 147136 - DNA, 16 bp, H. sapiens
tgcatgtgtgtacata

SEQ ID NO: 147137 - DNA, 16 bp, H. sapiens
tgcatgtgtgtatact

SEQ ID NO: 147138 - DNA, 16 bp, H. sapiens
tgcatgtgtgtatgtt

SEQ ID NO: 147139 - DNA, 16 bp, H. sapiens
tgcatgtgtgtgcgcg

SEQ ID NO: 147140 - DNA, 16 bp, H. sapiens
tgcatgtgtgtgtggg

SEQ ID NO: 147141 - DNA, 16 bp, H. sapiens
tgcatgtgtgttcatg

SEQ ID NO: 147142 - DNA, 16 bp, H. sapiens
tgcatgtgtgtttatg

SEQ ID NO: 147143 - DNA, 16 bp, H. sapiens
tgcatgtgtgtttgta

SEQ ID NO: 147144 - DNA, 16 bp, H. sapiens
tgcatgttctcactca

SEQ ID NO: 147145 - DNA, 16 bp, H. sapiens
tgcatgttgattttgt

SEQ ID NO: 147146 - DNA, 16 bp, H. sapiens
tgcatgtttatatata

SEQ ID NO: 147147 - DNA, 16 bp, H. sapiens
tgcatgtttattttta

SEQ ID NO: 147148 - DNA, 16 bp, H. sapiens
tgcattaaaaaaagaa

SEQ ID NO: 147149 - DNA, 16 bp, H. sapiens
tgcattaaaaacctgt

SEQ ID NO: 147150 - DNA, 16 bp, H. sapiens
tgcattaaaataaaca

SEQ ID NO: 147151 - DNA, 16 bp, H. sapiens
tgcattaaagatttaa

SEQ ID NO: 147152 - DNA, 16 bp, H. sapiens
tgcattaatttaaaaa

SEQ ID NO: 147153 - DNA, 16 bp, H. sapiens
tgcattacttttgtaa

SEQ ID NO: 147154 - DNA, 16 bp, H. sapiens
tgcattactttttaaa

SEQ ID NO: 147155 - DNA, 16 bp, H. sapiens
tgcattagccacattt

SEQ ID NO: 147156 - DNA, 16 bp, H. sapiens
tgcattataattttat

SEQ ID NO: 147157 - DNA, 16 bp, H. sapiens
tgcattatagaccaaa

SEQ ID NO: 147158 - DNA, 16 bp, H. sapiens
tgcattatttatttat

SEQ ID NO: 147159 - DNA, 16 bp, H. sapiens
tgcattatttcatttt

SEQ ID NO: 147160 - DNA, 16 bp, H. sapiens
tgcattatttctttct

SEQ ID NO: 147161 - DNA, 16 bp, H. sapiens
tgcattattttatttg

SEQ ID NO: 147162 - DNA, 16 bp, H. sapiens
tgcattatttttctat

SEQ ID NO: 147163 - DNA, 16 bp, H. sapiens
tgcattcaacaggaaa

SEQ ID NO: 147164 - DNA, 16 bp, H. sapiens
tgcattcattcactca

SEQ ID NO: 147165 - DNA, 16 bp, H. sapiens
tgcattcattcagcaa

SEQ ID NO: 147166 - DNA, 16 bp, H. sapiens
tgcattcattttattt

SEQ ID NO: 147167 - DNA, 16 bp, H. sapiens
tgcattccagcctagg

SEQ ID NO: 147168 - DNA, 16 bp, H. sapiens
tgcattccagcctgag

SEQ ID NO: 147169 - DNA, 16 bp, H. sapiens
tgcattccagcctggc

SEQ ID NO: 147170 - DNA, 16 bp, H. sapiens
tgcattccagcctggg

SEQ ID NO: 147171 - DNA, 16 bp, H. sapiens
tgcattccagccttgg

SEQ ID NO: 147172 - DNA, 16 bp, H. sapiens
tgcattccattccagt

SEQ ID NO: 147173 - DNA, 16 bp, H. sapiens
tgcattcctaacaagc

SEQ ID NO: 147174 - DNA, 16 bp, H. sapiens
tgcattctctttctca

SEQ ID NO: 147175 - DNA, 16 bp, H. sapiens
tgcattctggcaactg

SEQ ID NO: 147176 - DNA, 16 bp, H. sapiens
tgcattcttttcccag

SEQ ID NO: 147177 - DNA, 16 bp, H. sapiens
tgcattgagctgagat

SEQ ID NO: 147178 - DNA, 16 bp, H. sapiens
tgcattgatgttcatc

SEQ ID NO: 147179 - DNA, 16 bp, H. sapiens
tgcattgatgtttatc

SEQ ID NO: 147180 - DNA, 16 bp, H. sapiens
tgcattgctggtggga

SEQ ID NO: 147181 - DNA, 16 bp, H. sapiens
tgcattggcctcccaa

SEQ ID NO: 147182 - DNA, 16 bp, H. sapiens
tgcattgtaggatgct

SEQ ID NO: 147183 - DNA, 16 bp, H. sapiens
tgcattgtaggatgtt

SEQ ID NO: 147184 - DNA, 16 bp, H. sapiens
tgcattgtgaagttct

SEQ ID NO: 147185 - DNA, 16 bp, H. sapiens
tgcattgttggtggga

SEQ ID NO: 147186 - DNA, 16 bp, H. sapiens
tgcattgttttttaaa

SEQ ID NO: 147187 - DNA, 16 bp, H. sapiens
tgcatttaaaaacaaa

SEQ ID NO: 147188 - DNA, 16 bp, H. sapiens
tgcatttaaaaacatt

SEQ ID NO: 147189 - DNA, 16 bp, H. sapiens
tgcatttaaaaattat

SEQ ID NO: 147190 - DNA, 16 bp, H. sapiens
tgcatttaaataaaaa

SEQ ID NO: 147191 - DNA, 16 bp, H. sapiens
tgcatttaaatattta

SEQ ID NO: 147192 - DNA, 16 bp, H. sapiens
tgcatttaaattaaat

SEQ ID NO: 147193 - DNA, 16 bp, H. sapiens
tgcatttaagtttcct

SEQ ID NO: 147194 - DNA, 16 bp, H. sapiens
tgcatttaatacacct

SEQ ID NO: 147195 - DNA, 16 bp, H. sapiens
tgcatttacaacttgg

SEQ ID NO: 147196 - DNA, 16 bp, H. sapiens
tgcatttagaaaattc

SEQ ID NO: 147197 - DNA, 16 bp, H. sapiens
tgcatttataattttg

SEQ ID NO: 147198 - DNA, 16 bp, H. sapiens
tgcatttatatatgta

SEQ ID NO: 147199 - DNA, 16 bp, H. sapiens
tgcatttattgagatg

SEQ ID NO: 147200 - DNA, 16 bp, H. sapiens
tgcatttattttaaat

SEQ ID NO: 147201 - DNA, 16 bp, H. sapiens
tgcatttattttataa

SEQ ID NO: 147202 - DNA, 16 bp, H. sapiens
tgcatttattttatta

SEQ ID NO: 147203 - DNA, 16 bp, H. sapiens
tgcatttatttttata

SEQ ID NO: 147204 - DNA, 16 bp, H. sapiens
tgcatttcagtttctt

SEQ ID NO: 147205 - DNA, 16 bp, H. sapiens
tgcatttccatttgtt

SEQ ID NO: 147206 - DNA, 16 bp, H. sapiens
tgcatttccctgatgg

SEQ ID NO: 147207 - DNA, 16 bp, H. sapiens
tgcatttcctgaattt

SEQ ID NO: 147208 - DNA, 16 bp, H. sapiens
tgcatttctaacaagc

SEQ ID NO: 147209 - DNA, 16 bp, H. sapiens
tgcatttctaacaagt

SEQ ID NO: 147210 - DNA, 16 bp, H. sapiens
tgcatttctaaccagc

SEQ ID NO: 147211 - DNA, 16 bp, H. sapiens
tgcatttctaccaagt

SEQ ID NO: 147212 - DNA, 16 bp, H. sapiens
tgcatttctctaacaa

SEQ ID NO: 147213 - DNA, 16 bp, H. sapiens
tgcatttctctgggat

SEQ ID NO: 147214 - DNA, 16 bp, H. sapiens
tgcatttctctggggt

SEQ ID NO: 147215 - DNA, 16 bp, H. sapiens
tgcatttcttaaataa

SEQ ID NO: 147216 - DNA, 16 bp, H. sapiens
tgcatttcttttataa

SEQ ID NO: 147217 - DNA, 16 bp, H. sapiens
tgcatttctttttaaa

SEQ ID NO: 147218 - DNA, 16 bp, H. sapiens
tgcatttgaaaatgag

SEQ ID NO: 147219 - DNA, 16 bp, H. sapiens
tgcatttgacaaaggt

SEQ ID NO: 147220 - DNA, 16 bp, H. sapiens
tgcatttgctggggag

SEQ ID NO: 147221 - DNA, 16 bp, H. sapiens
tgcatttggaatattt

SEQ ID NO: 147222 - DNA, 16 bp, H. sapiens
tgcatttggttgttat

SEQ ID NO: 147223 - DNA, 16 bp, H. sapiens
tgcatttgtgaaagat

SEQ ID NO: 147224 - DNA, 16 bp, H. sapiens
tgcatttgttgaacca

SEQ ID NO: 147225 - DNA, 16 bp, H. sapiens
tgcattttaaaagctt

SEQ ID NO: 147226 - DNA, 16 bp, H. sapiens
tgcattttaaagcatt

SEQ ID NO: 147227 - DNA, 16 bp, H. sapiens
tgcattttaacaagac

SEQ ID NO: 147228 - DNA, 16 bp, H. sapiens
tgcattttaattttaa

SEQ ID NO: 147229 - DNA, 16 bp, H. sapiens
tgcattttcaaaaatt

SEQ ID NO: 147230 - DNA, 16 bp, H. sapiens
tgcattttcaaaatat

SEQ ID NO: 147231 - DNA, 16 bp, H. sapiens
tgcattttcaatatga

SEQ ID NO: 147232 - DNA, 16 bp, H. sapiens
tgcattttcatgtttt

SEQ ID NO: 147233 - DNA, 16 bp, H. sapiens
tgcattttcattttaa

SEQ ID NO: 147234 - DNA, 16 bp, H. sapiens
tgcattttctcattta

SEQ ID NO: 147235 - DNA, 16 bp, H. sapiens
tgcattttctgatgat

SEQ ID NO: 147236 - DNA, 16 bp, H. sapiens
tgcatttttaaaagat

SEQ ID NO: 147237 - DNA, 16 bp, H. sapiens
tgcatttttaaaaggt

SEQ ID NO: 147238 - DNA, 16 bp, H. sapiens
tgcatttttaaatgtg

SEQ ID NO: 147239 - DNA, 16 bp, H. sapiens
tgcatttttaataagc

SEQ ID NO: 147240 - DNA, 16 bp, H. sapiens
tgcatttttacatttg

SEQ ID NO: 147241 - DNA, 17 bp, H. sapiens
tgcatttttagtagaga

SEQ ID NO: 147242 - DNA, 16 bp, H. sapiens
tgcatttttctaatgg

SEQ ID NO: 147243 - DNA, 16 bp, H. sapiens
tgcatttttcttatta

SEQ ID NO: 147244 - DNA, 16 bp, H. sapiens
tgcatttttgacttat

SEQ ID NO: 147245 - DNA, 16 bp, H. sapiens
tgcattttttacaaat

SEQ ID NO: 147246 - DNA, 16 bp, H. sapiens
tgcatttttttaaaaa

SEQ ID NO: 147247 - DNA, 16 bp, H. sapiens
tgccaaaaagaaagaa

SEQ ID NO: 147248 - DNA, 16 bp, H. sapiens
tgccaaaaaggttggg

SEQ ID NO: 147249 - DNA, 16 bp, H. sapiens
tgccaaaaatacaaaa

SEQ ID NO: 147250 - DNA, 16 bp, H. sapiens
tgccaaaaatatttta

SEQ ID NO: 147251 - DNA, 16 bp, H. sapiens
tgccaaaaccattcaa

SEQ ID NO: 147252 - DNA, 16 bp, H. sapiens
tgccaaaaccccatct

SEQ ID NO: 147253 - DNA, 16 bp, H. sapiens
tgccaaaacttggaag

SEQ ID NO: 147254 - DNA, 16 bp, H. sapiens
tgccaaaagaaatcta

SEQ ID NO: 147255 - DNA, 16 bp, H. sapiens
tgccaaaagagattaa

SEQ ID NO: 147256 - DNA, 16 bp, H. sapiens
tgccaaaatataaaga

SEQ ID NO: 147257 - DNA, 16 bp, H. sapiens
tgccaaacaaccacag

SEQ ID NO: 147258 - DNA, 16 bp, H. sapiens
tgccaaacccattctt

SEQ ID NO: 147259 - DNA, 16 bp, H. sapiens
tgccaaagaagaaaac

SEQ ID NO: 147260 - DNA, 16 bp, H. sapiens
tgccaaagagaagctg

SEQ ID NO: 147261 - DNA, 16 bp, H. sapiens
tgccaaaggagatgaa

SEQ ID NO: 147262 - DNA, 16 bp, H. sapiens
tgccaaaggtaattta

SEQ ID NO: 147263 - DNA, 16 bp, H. sapiens
tgccaaagtcacacag

SEQ ID NO: 147264 - DNA, 16 bp, H. sapiens
tgccaaagttgagaaa

SEQ ID NO: 147265 - DNA, 16 bp, H. sapiens
tgccaaatcaagaatg

SEQ ID NO: 147266 - DNA, 16 bp, H. sapiens
tgccaaatctactctg

SEQ ID NO: 147267 - DNA, 16 bp, H. sapiens
tgccaaatggtaaaga

SEQ ID NO: 147268 - DNA, 16 bp, H. sapiens
tgccaaatggttttcc

SEQ ID NO: 147269 - DNA, 16 bp, H. sapiens
tgccaaatgttccctg

SEQ ID NO: 147270 - DNA, 16 bp, H. sapiens
tgccaaattgcaaaga

SEQ ID NO: 147271 - DNA, 16 bp, H. sapiens
tgccaaatttgggaaa

SEQ ID NO: 147272 - DNA, 16 bp, H. sapiens
tgccaacaaattgaat

SEQ ID NO: 147273 - DNA, 16 bp, H. sapiens
tgccaacacagcagtc

SEQ ID NO: 147274 - DNA, 16 bp, H. sapiens
tgccaacaccttgatt

SEQ ID NO: 147275 - DNA, 16 bp, H. sapiens
tgccaacagcatgctg

SEQ ID NO: 147276 - DNA, 16 bp, H. sapiens
tgccaacatcctgctt

SEQ ID NO: 147277 - DNA, 19 bp, H. sapiens
tgccaacatggtgaaactc

SEQ ID NO: 147278 - DNA, 16 bp, H. sapiens
tgccaacatttaaaaa

SEQ ID NO: 147279 - DNA, 16 bp, H. sapiens
tgccaaccagagctct

SEQ ID NO: 147280 - DNA, 16 bp, H. sapiens
tgccaactcaagtgtc

SEQ ID NO: 147281 - DNA, 16 bp, H. sapiens
tgccaagaccattcag

SEQ ID NO: 147282 - DNA, 16 bp, H. sapiens
tgccaagattgagaaa

SEQ ID NO: 147283 - DNA, 16 bp, H. sapiens
tgccaagcactgtgcc

SEQ ID NO: 147284 - DNA, 16 bp, H. sapiens
tgccaagcactgtgct

SEQ ID NO: 147285 - DNA, 16 bp, H. sapiens
tgccaagccctgtgct

SEQ ID NO: 147286 - DNA, 16 bp, H. sapiens
tgccaagccctgttct

SEQ ID NO: 147287 - DNA, 16 bp, H. sapiens
tgccaaggccctgggg

SEQ ID NO: 147288 - DNA, 16 bp, H. sapiens
tgccaaggccgaggag

SEQ ID NO: 147289 - DNA, 16 bp, H. sapiens
tgccaagggcaagcca

SEQ ID NO: 147290 - DNA, 16 bp, H. sapiens
tgccaagggctggagg

SEQ ID NO: 147291 - DNA, 16 bp, H. sapiens
tgccaagtgaaggggg

SEQ ID NO: 147292 - DNA, 16 bp, H. sapiens
tgccaatagacttgct

SEQ ID NO: 147293 - DNA, 16 bp, H. sapiens
tgccaatatcacactg

SEQ ID NO: 147294 - DNA, 16 bp, H. sapiens
tgccaatcagaaaatt

SEQ ID NO: 147295 - DNA, 17 bp, H. sapiens
tgccaatgcactccagc

SEQ ID NO: 147296 - DNA, 16 bp, H. sapiens
tgccaatttttgtttt

SEQ ID NO: 147297 - DNA, 16 bp, H. sapiens
tgccacaaaagcaaaa

SEQ ID NO: 147298 - DNA, 16 bp, H. sapiens
tgccacaaagttctct

SEQ ID NO: 147299 - DNA, 16 bp, H. sapiens
tgccacaacgcccggc

SEQ ID NO: 147300 - DNA, 16 bp, H. sapiens
tgccacacacccagct

SEQ ID NO: 147301 - DNA, 16 bp, H. sapiens
tgccacacacctttaa

SEQ ID NO: 147302 - DNA, 16 bp, H. sapiens
tgccacacactgttct

SEQ ID NO: 147303 - DNA, 16 bp, H. sapiens
tgccacactgcactcc

SEQ ID NO: 147304 - DNA, 16 bp, H. sapiens
tgccacactgtcttcc

SEQ ID NO: 147305 - DNA, 16 bp, H. sapiens
tgccacagaaatacaa

SEQ ID NO: 147306 - DNA, 16 bp, H. sapiens
tgccacagcactgcag

SEQ ID NO: 147307 - DNA, 16 bp, H. sapiens
tgccacagcattccag

SEQ ID NO: 147308 - DNA, 16 bp, H. sapiens
tgccacagccactcca

SEQ ID NO: 147309 - DNA, 16 bp, H. sapiens
tgccacagcctcccag

SEQ ID NO: 147310 - DNA, 16 bp, H. sapiens
tgccacagccttctga

SEQ ID NO: 147311 - DNA, 16 bp, H. sapiens
tgccacagtaaacata

SEQ ID NO: 147312 - DNA, 16 bp, H. sapiens
tgccacattgtcttcc

SEQ ID NO: 147313 - DNA, 16 bp, H. sapiens
tgccacatttacttta

SEQ ID NO: 147314 - DNA, 16 bp, H. sapiens
tgccacattttctcta

SEQ ID NO: 147315 - DNA, 16 bp, H. sapiens
tgccacattttcttat

SEQ ID NO: 147316 - DNA, 16 bp, H. sapiens
tgccaccaagcccagc

SEQ ID NO: 147317 - DNA, 16 bp, H. sapiens
tgccaccacacccagt

SEQ ID NO: 147318 - DNA, 16 bp, H. sapiens
tgccaccacacctgcc

SEQ ID NO: 147319 - DNA, 17 bp, H. sapiens
tgccaccacacttggct

SEQ ID NO: 147320 - DNA, 16 bp, H. sapiens
tgccaccacatctagc

SEQ ID NO: 147321 - DNA, 16 bp, H. sapiens
tgccaccacatctggc

SEQ ID NO: 147322 - DNA, 16 bp, H. sapiens
tgccaccacccccagc

SEQ ID NO: 147323 - DNA, 16 bp, H. sapiens
tgccaccacccccggc

SEQ ID NO: 147324 - DNA, 16 bp, H. sapiens
tgccaccacctccagc

SEQ ID NO: 147325 - DNA, 16 bp, H. sapiens
tgccaccacgcccacc

SEQ ID NO: 147326 - DNA, 19 bp, H. sapiens
tgccaccacgcccggctaa

SEQ ID NO: 147327 - DNA, 16 bp, H. sapiens
tgccaccacgctcgac

SEQ ID NO: 147328 - DNA, 16 bp, H. sapiens
tgccaccacgcttggc

SEQ ID NO: 147329 - DNA, 16 bp, H. sapiens
tgccaccacggccagc

SEQ ID NO: 147330 - DNA, 16 bp, H. sapiens
tgccaccacgtccagc

SEQ ID NO: 147331 - DNA, 16 bp, H. sapiens
tgccaccactcccagc

SEQ ID NO: 147332 - DNA, 16 bp, H. sapiens
tgccaccaggactggc

SEQ ID NO: 147333 - DNA, 16 bp, H. sapiens
tgccaccaggcctggc

SEQ ID NO: 147334 - DNA, 17 bp, H. sapiens
tgccaccaggcctggct

SEQ ID NO: 147335 - DNA, 16 bp, H. sapiens
tgccaccaggcctggt

SEQ ID NO: 147336 - DNA, 17 bp, H. sapiens
tgccaccatacccagct

SEQ ID NO: 147337 - DNA, 16 bp, H. sapiens
tgccaccatcaccact

SEQ ID NO: 147338 - DNA, 17 bp, H. sapiens
tgccaccatgcctggct

SEQ ID NO: 147339 - DNA, 16 bp, H. sapiens
tgccaccatgctctgc

SEQ ID NO: 147340 - DNA, 16 bp, H. sapiens
tgccaccatggccagc

SEQ ID NO: 147341 - DNA, 16 bp, H. sapiens
tgccaccatgtaaaaa

SEQ ID NO: 147342 - DNA, 16 bp, H. sapiens
tgccaccattttggaa

SEQ ID NO: 147343 - DNA, 16 bp, H. sapiens
tgccaccccacccagc

SEQ ID NO: 147344 - DNA, 16 bp, H. sapiens
tgccaccccgcccggc

SEQ ID NO: 147345 - DNA, 16 bp, H. sapiens
tgccacccctcctcca

SEQ ID NO: 147346 - DNA, 16 bp, H. sapiens
tgccacccctgccctg

SEQ ID NO: 147347 - DNA, 16 bp, H. sapiens
tgccacccttccccca

SEQ ID NO: 147348 - DNA, 16 bp, H. sapiens
tgccaccgcgcccggc

SEQ ID NO: 147349 - DNA, 23 bp, H. sapiens
tgccaccgtgcccggctaatttt

SEQ ID NO: 147350 - DNA, 16 bp, H. sapiens
tgccacctcagccttc

SEQ ID NO: 147351 - DNA, 16 bp, H. sapiens
tgccacctccaccacc

SEQ ID NO: 147352 - DNA, 16 bp, H. sapiens
tgccacctccaccttc

SEQ ID NO: 147353 - DNA, 17 bp, H. sapiens
tgccacctgggttcaag

SEQ ID NO: 147354 - DNA, 16 bp, H. sapiens
tgccaccttcctctgt

SEQ ID NO: 147355 - DNA, 16 bp, H. sapiens
tgccaccttgtgaaga

SEQ ID NO: 147356 - DNA, 17 bp, H. sapiens
tgccactacacctggct

SEQ ID NO: 147357 - DNA, 16 bp, H. sapiens
tgccactacacttcag

SEQ ID NO: 147358 - DNA, 16 bp, H. sapiens
tgccactaccatgctg

SEQ ID NO: 147359 - DNA, 21 bp, H. sapiens
tgccactacgcccggctaatt

SEQ ID NO: 147360 - DNA, 16 bp, H. sapiens
tgccactatgccaggc

SEQ ID NO: 147361 - DNA, 16 bp, H. sapiens
tgccactcccagctaa

SEQ ID NO: 147362 - DNA, 16 bp, H. sapiens
tgccactcctctgctc

SEQ ID NO: 147363 - DNA, 16 bp, H. sapiens
tgccactgaactgcac

SEQ ID NO: 147364 - DNA, 16 bp, H. sapiens
tgccactgaattgtat

SEQ ID NO: 147365 - DNA, 18 bp, H. sapiens
tgccactgcaccccagca

SEQ ID NO: 147366 - DNA, 16 bp, H. sapiens
tgccactgcaccctgc

SEQ ID NO: 147367 - DNA, 16 bp, H. sapiens
tgccactgcaccctgg

SEQ ID NO: 147368 - DNA, 16 bp, H. sapiens
tgccactgcacgccag

SEQ ID NO: 147369 - DNA, 16 bp, H. sapiens
tgccactgcactcccg

SEQ ID NO: 147370 - DNA, 16 bp, H. sapiens
tgccactgcacttcag

SEQ ID NO: 147371 - DNA, 16 bp, H. sapiens
tgccactgcgcccagc

SEQ ID NO: 147372 - DNA, 16 bp, H. sapiens
tgccactgctgctggc

SEQ ID NO: 147373 - DNA, 16 bp, H. sapiens
tgccactgctggcttg

SEQ ID NO: 147374 - DNA, 16 bp, H. sapiens
tgccactggactccag

SEQ ID NO: 147375 - DNA, 16 bp, H. sapiens
tgccactggcatctag

SEQ ID NO: 147376 - DNA, 16 bp, H. sapiens
tgccactgtattccag

SEQ ID NO: 147377 - DNA, 16 bp, H. sapiens
tgccactgtctcctgg

SEQ ID NO: 147378 - DNA, 16 bp, H. sapiens
tgccactgtgcccagc

SEQ ID NO: 147379 - DNA, 16 bp, H. sapiens
tgccactgtgctccag

SEQ ID NO: 147380 - DNA, 16 bp, H. sapiens
tgccacttaactccag

SEQ ID NO: 147381 - DNA, 16 bp, H. sapiens
tgccacttcctagctg

SEQ ID NO: 147382 - DNA, 16 bp, H. sapiens
tgccagaaaaaaagaa

SEQ ID NO: 147383 - DNA, 16 bp, H. sapiens
tgccagaaatctgacc

SEQ ID NO: 147384 - DNA, 16 bp, H. sapiens
tgccagaaggaagaaa

SEQ ID NO: 147385 - DNA, 16 bp, H. sapiens
tgccagaaggaagaat

SEQ ID NO: 147386 - DNA, 16 bp, H. sapiens
tgccagaagtttttcc

SEQ ID NO: 147387 - DNA, 16 bp, H. sapiens
tgccagaattcttgtg

SEQ ID NO: 147388 - DNA, 16 bp, H. sapiens
tgccagacactgagct

SEQ ID NO: 147389 - DNA, 16 bp, H. sapiens
tgccagaccctgtgct

SEQ ID NO: 147390 - DNA, 16 bp, H. sapiens
tgccagaggaaacagc

SEQ ID NO: 147391 - DNA, 16 bp, H. sapiens
tgccagaggagattga

SEQ ID NO: 147392 - DNA, 16 bp, H. sapiens
tgccagaggctgaggg

SEQ ID NO: 147393 - DNA, 16 bp, H. sapiens
tgccagatactattct

SEQ ID NO: 147394 - DNA, 16 bp, H. sapiens
tgccagatactgtgct

SEQ ID NO: 147395 - DNA, 16 bp, H. sapiens
tgccagcaaaggaaca

SEQ ID NO: 147396 - DNA, 16 bp, H. sapiens
tgccagcaccatgcct

SEQ ID NO: 147397 - DNA, 16 bp, H. sapiens
tgccagcacctggagc

SEQ ID NO: 147398 - DNA, 16 bp, H. sapiens
tgccagcagcagcagc

SEQ ID NO: 147399 - DNA, 16 bp, H. sapiens
tgccagcagccaccag

SEQ ID NO: 147400 - DNA, 16 bp, H. sapiens
tgccagcagctgtgcc

SEQ ID NO: 147401 - DNA, 16 bp, H. sapiens
tgccagcatacatttt

SEQ ID NO: 147402 - DNA, 16 bp, H. sapiens
tgccagcatctgctgt

SEQ ID NO: 147403 - DNA, 16 bp, H. sapiens
tgccagcctccagcca

SEQ ID NO: 147404 - DNA, 16 bp, H. sapiens
tgccagcctctttgct

SEQ ID NO: 147405 - DNA, 16 bp, H. sapiens
tgccagcctgagcaac

SEQ ID NO: 147406 - DNA, 16 bp, H. sapiens
tgccagcctgggcgac

SEQ ID NO: 147407 - DNA, 16 bp, H. sapiens
tgccagctactcggaa

SEQ ID NO: 147408 - DNA, 16 bp, H. sapiens
tgccagctcatgtcat

SEQ ID NO: 147409 - DNA, 16 bp, H. sapiens
tgccagctccgcttcc

SEQ ID NO: 147410 - DNA, 16 bp, H. sapiens
tgccagctcctctttg

SEQ ID NO: 147411 - DNA, 16 bp, H. sapiens
tgccagctgcagtggg

SEQ ID NO: 147412 - DNA, 16 bp, H. sapiens
tgccaggaactggggg

SEQ ID NO: 147413 - DNA, 16 bp, H. sapiens
tgccaggactggatcc

SEQ ID NO: 147414 - DNA, 16 bp, H. sapiens
tgccaggagcagggag

SEQ ID NO: 147415 - DNA, 16 bp, H. sapiens
tgccaggagccagggg

SEQ ID NO: 147416 - DNA, 16 bp, H. sapiens
tgccaggagctgaggg

SEQ ID NO: 147417 - DNA, 16 bp, H. sapiens
tgccaggagctggagg

SEQ ID NO: 147418 - DNA, 16 bp, H. sapiens
tgccaggagctggggg

SEQ ID NO: 147419 - DNA, 16 bp, H. sapiens
tgccaggaggaggagg

SEQ ID NO: 147420 - DNA, 16 bp, H. sapiens
tgccaggcaccgtgct

SEQ ID NO: 147421 - DNA, 16 bp, H. sapiens
tgccaggcactatcct

SEQ ID NO: 147422 - DNA, 16 bp, H. sapiens
tgccaggcactgagct

SEQ ID NO: 147423 - DNA, 16 bp, H. sapiens
tgccaggcactgccct

SEQ ID NO: 147424 - DNA, 16 bp, H. sapiens
tgccaggcactgtgct

SEQ ID NO: 147425 - DNA, 16 bp, H. sapiens
tgccaggcactgtggc

SEQ ID NO: 147426 - DNA, 16 bp, H. sapiens
tgccaggcactgtgtt

SEQ ID NO: 147427 - DNA, 16 bp, H. sapiens
tgccaggcactgttca

SEQ ID NO: 147428 - DNA, 16 bp, H. sapiens
tgccaggcactttaca

SEQ ID NO: 147429 - DNA, 16 bp, H. sapiens
tgccaggcagggtggc

SEQ ID NO: 147430 - DNA, 16 bp, H. sapiens
tgccaggcattgagct

SEQ ID NO: 147431 - DNA, 16 bp, H. sapiens
tgccaggcatttttct

SEQ ID NO: 147432 - DNA, 16 bp, H. sapiens
tgccaggcccagtgct

SEQ ID NO: 147433 - DNA, 16 bp, H. sapiens
tgccaggccccacctc

SEQ ID NO: 147434 - DNA, 16 bp, H. sapiens
tgccaggccctgcccc

SEQ ID NO: 147435 - DNA, 16 bp, H. sapiens
tgccaggcctgggact

SEQ ID NO: 147436 - DNA, 16 bp, H. sapiens
tgccaggctctgtgca

SEQ ID NO: 147437 - DNA, 16 bp, H. sapiens
tgccaggctgcagtgc

SEQ ID NO: 147438 - DNA, 17 bp, H. sapiens
tgccaggctggagtgca

SEQ ID NO: 147439 - DNA, 16 bp, H. sapiens
tgccaggctggcctca

SEQ ID NO: 147440 - DNA, 16 bp, H. sapiens
tgccaggctggtcctg

SEQ ID NO: 147441 - DNA, 16 bp, H. sapiens
tgccagggagaagcaa

SEQ ID NO: 147442 - DNA, 16 bp, H. sapiens
tgccagggcctgggga

SEQ ID NO: 147443 - DNA, 16 bp, H. sapiens
tgccaggggctgagga

SEQ ID NO: 147444 - DNA, 16 bp, H. sapiens
tgccaggggctggagg

SEQ ID NO: 147445 - DNA, 16 bp, H. sapiens
tgccaggggctggggg

SEQ ID NO: 147446 - DNA, 16 bp, H. sapiens
tgccaggggctgggtg

SEQ ID NO: 147447 - DNA, 16 bp, H. sapiens
tgccaggggctgtggg

SEQ ID NO: 147448 - DNA, 16 bp, H. sapiens
tgccaggttctgtgct

SEQ ID NO: 147449 - DNA, 16 bp, H. sapiens
tgccaggtttcaaagg

SEQ ID NO: 147450 - DNA, 16 bp, H. sapiens
tgccagtaccatgctg

SEQ ID NO: 147451 - DNA, 16 bp, H. sapiens
tgccagtagcaccccc

SEQ ID NO: 147452 - DNA, 16 bp, H. sapiens
tgccagtctcttctgg

SEQ ID NO: 147453 - DNA, 16 bp, H. sapiens
tgccagtgatgatgag

SEQ ID NO: 147454 - DNA, 16 bp, H. sapiens
tgccagtgccctccag

SEQ ID NO: 147455 - DNA, 16 bp, H. sapiens
tgccagtgtggctgga

SEQ ID NO: 147456 - DNA, 16 bp, H. sapiens
tgccagttctgagcct

SEQ ID NO: 147457 - DNA, 16 bp, H. sapiens
tgccagttgtataaaa

SEQ ID NO: 147458 - DNA, 16 bp, H. sapiens
tgccagtttctttgct

SEQ ID NO: 147459 - DNA, 16 bp, H. sapiens
tgccataagaaaatac

SEQ ID NO: 147460 - DNA, 16 bp, H. sapiens
tgccatatttggtttt

SEQ ID NO: 147461 - DNA, 16 bp, H. sapiens
tgccatattttattga

SEQ ID NO: 147462 - DNA, 16 bp, H. sapiens
tgccatattttctttt

SEQ ID NO: 147463 - DNA, 16 bp, H. sapiens
tgccatcactcctggc

SEQ ID NO: 147464 - DNA, 16 bp, H. sapiens
tgccatcactttggga

SEQ ID NO: 147465 - DNA, 16 bp, H. sapiens
tgccatcatcaccatc

SEQ ID NO: 147466 - DNA, 17 bp, H. sapiens
tgccatcatgcctggct

SEQ ID NO: 147467 - DNA, 16 bp, H. sapiens
tgccatccagcctggg

SEQ ID NO: 147468 - DNA, 16 bp, H. sapiens
tgccatccccactgga

SEQ ID NO: 147469 - DNA, 16 bp, H. sapiens
tgccatccccagcaag

SEQ ID NO: 147470 - DNA, 16 bp, H. sapiens
tgccatccccatccag

SEQ ID NO: 147471 - DNA, 16 bp, H. sapiens
tgccatcctcctgcct

SEQ ID NO: 147472 - DNA, 16 bp, H. sapiens
tgccatctctgcctcc

SEQ ID NO: 147473 - DNA, 16 bp, H. sapiens
tgccatctctgtggtt

SEQ ID NO: 147474 - DNA, 16 bp, H. sapiens
tgccatctgcttttcc

SEQ ID NO: 147475 - DNA, 16 bp, H. sapiens
tgccatctgtccccat

SEQ ID NO: 147476 - DNA, 16 bp, H. sapiens
tgccatctttgaagca

SEQ ID NO: 147477 - DNA, 16 bp, H. sapiens
tgccatgaatgtgagg

SEQ ID NO: 147478 - DNA, 16 bp, H. sapiens
tgccatgaccaagtgg

SEQ ID NO: 147479 - DNA, 16 bp, H. sapiens
tgccatgatcacagct

SEQ ID NO: 147480 - DNA, 16 bp, H. sapiens
tgccatgatcatagct

SEQ ID NO: 147481 - DNA, 16 bp, H. sapiens
tgccatgctgcccagg

SEQ ID NO: 147482 - DNA, 16 bp, H. sapiens
tgccatggcaatgtca

SEQ ID NO: 147483 - DNA, 16 bp, H. sapiens
tgccatggcatttata

SEQ ID NO: 147484 - DNA, 18 bp, H. sapiens
tgccatggtggtttgctg

SEQ ID NO: 147485 - DNA, 16 bp, H. sapiens
tgccatggtgtctgtc

SEQ ID NO: 147486 - DNA, 16 bp, H. sapiens
tgccatgtgaagaagt

SEQ ID NO: 147487 - DNA, 16 bp, H. sapiens
tgccatgtttattgca

SEQ ID NO: 147488 - DNA, 16 bp, H. sapiens
tgccattaatttgttc

SEQ ID NO: 147489 - DNA, 16 bp, H. sapiens
tgccattattttgttg

SEQ ID NO: 147490 - DNA, 16 bp, H. sapiens
tgccattatttttatt

SEQ ID NO: 147491 - DNA, 16 bp, H. sapiens
tgccattctcactggt

SEQ ID NO: 147492 - DNA, 16 bp, H. sapiens
tgccattgcacaccag

SEQ ID NO: 147493 - DNA, 16 bp, H. sapiens
tgccattgcaccccag

SEQ ID NO: 147494 - DNA, 16 bp, H. sapiens
tgccattgcactccag

SEQ ID NO: 147495 - DNA, 16 bp, H. sapiens
tgccattgcattccag

SEQ ID NO: 147496 - DNA, 16 bp, H. sapiens
tgccattgccaaggct

SEQ ID NO: 147497 - DNA, 16 bp, H. sapiens
tgccattgctttcaat

SEQ ID NO: 147498 - DNA, 17 bp, H. sapiens
tgccattgtactccagc

SEQ ID NO: 147499 - DNA, 16 bp, H. sapiens
tgccatttaaaaatat

SEQ ID NO: 147500 - DNA, 16 bp, H. sapiens
tgccatttgacccagc

SEQ ID NO: 147501 - DNA, 16 bp, H. sapiens
tgccatttgcagcaac

SEQ ID NO: 147502 - DNA, 16 bp, H. sapiens
tgccatttgccacaac

SEQ ID NO: 147503 - DNA, 16 bp, H. sapiens
tgccattttatatcag

SEQ ID NO: 147504 - DNA, 16 bp, H. sapiens
tgccattttattttta

SEQ ID NO: 147505 - DNA, 16 bp, H. sapiens
tgccatttttcaaagg

SEQ ID NO: 147506 - DNA, 16 bp, H. sapiens
tgcccaaaatgctgat

SEQ ID NO: 147507 - DNA, 16 bp, H. sapiens
tgcccaaagcaattta

SEQ ID NO: 147508 - DNA, 17 bp, H. sapiens
tgcccaaagtaatttac

SEQ ID NO: 147509 - DNA, 16 bp, H. sapiens
tgcccaaagtgctagg

SEQ ID NO: 147510 - DNA, 16 bp, H. sapiens
tgcccaaatccatcag

SEQ ID NO: 147511 - DNA, 16 bp, H. sapiens
tgcccaaatctcatgt

SEQ ID NO: 147512 - DNA, 16 bp, H. sapiens
tgcccaagctggagag

SEQ ID NO: 147513 - DNA, 16 bp, H. sapiens
tgcccaaggcaggact

SEQ ID NO: 147514 - DNA, 16 bp, H. sapiens
tgcccaaggccacagg

SEQ ID NO: 147515 - DNA, 16 bp, H. sapiens
tgcccaaggcccactg

SEQ ID NO: 147516 - DNA, 16 bp, H. sapiens
tgcccaaggcctgctg

SEQ ID NO: 147517 - DNA, 16 bp, H. sapiens
tgcccaaggtgattgg

SEQ ID NO: 147518 - DNA, 16 bp, H. sapiens
tgcccaataaatgttt

SEQ ID NO: 147519 - DNA, 16 bp, H. sapiens
tgcccacaaccatgcc

SEQ ID NO: 147520 - DNA, 16 bp, H. sapiens
tgcccacaagaaaaag

SEQ ID NO: 147521 - DNA, 16 bp, H. sapiens
tgcccacacacacaca

SEQ ID NO: 147522 - DNA, 16 bp, H. sapiens
tgcccacacctatgtc

SEQ ID NO: 147523 - DNA, 16 bp, H. sapiens
tgcccacactggcctc

SEQ ID NO: 147524 - DNA, 16 bp, H. sapiens
tgcccacagcccagga

SEQ ID NO: 147525 - DNA, 16 bp, H. sapiens
tgcccaccaatgacag

SEQ ID NO: 147526 - DNA, 16 bp, H. sapiens
tgcccaccacacccag

SEQ ID NO: 147527 - DNA, 22 bp, H. sapiens
tgcccaccaccacgcctggcta

SEQ ID NO: 147528 - DNA, 16 bp, H. sapiens
tgcccaccaccaggcc

SEQ ID NO: 147529 - DNA, 16 bp, H. sapiens
tgcccaccaccatgca

SEQ ID NO: 147530 - DNA, 18 bp, H. sapiens
tgcccaccaccatgccca

SEQ ID NO: 147531 - DNA, 21 bp, H. sapiens
tgcccaccaccatgcctggct

SEQ ID NO: 147532 - DNA, 16 bp, H. sapiens
tgcccaccacctcacc

SEQ ID NO: 147533 - DNA, 16 bp, H. sapiens
tgcccaccacctcgcc

SEQ ID NO: 147534 - DNA, 16 bp, H. sapiens
tgcccaccacggcctc

SEQ ID NO: 147535 - DNA, 16 bp, H. sapiens
tgcccaccatcacacc

SEQ ID NO: 147536 - DNA, 16 bp, H. sapiens
tgcccacccacactga

SEQ ID NO: 147537 - DNA, 16 bp, H. sapiens
tgcccacccacccatc

SEQ ID NO: 147538 - DNA, 16 bp, H. sapiens
tgcccaccctgctgca

SEQ ID NO: 147539 - DNA, 16 bp, H. sapiens
tgcccaccctggctcc

SEQ ID NO: 147540 - DNA, 16 bp, H. sapiens
tgcccacctcagctcc

SEQ ID NO: 147541 - DNA, 16 bp, H. sapiens
tgcccacctccacctc

SEQ ID NO: 147542 - DNA, 16 bp, H. sapiens
tgcccacctcctccct

SEQ ID NO: 147543 - DNA, 16 bp, H. sapiens
tgcccacctgagccac

SEQ ID NO: 147544 - DNA, 16 bp, H. sapiens
tgcccacctgcccacc

SEQ ID NO: 147545 - DNA, 16 bp, H. sapiens
tgcccacctgcctgcc

SEQ ID NO: 147546 - DNA, 16 bp, H. sapiens
tgcccacgctgaaggt

SEQ ID NO: 147547 - DNA, 16 bp, H. sapiens
tgcccacttcagcttc

SEQ ID NO: 147548 - DNA, 16 bp, H. sapiens
tgcccagaaggcagca

SEQ ID NO: 147549 - DNA, 16 bp, H. sapiens
tgcccagacagggcca

SEQ ID NO: 147550 - DNA, 16 bp, H. sapiens
tgcccagactggcctt

SEQ ID NO: 147551 - DNA, 16 bp, H. sapiens
tgcccagagagagaaa

SEQ ID NO: 147552 - DNA, 16 bp, H. sapiens
tgcccagagctcagag

SEQ ID NO: 147553 - DNA, 16 bp, H. sapiens
tgcccagagtaattta

SEQ ID NO: 147554 - DNA, 16 bp, H. sapiens
tgcccagagtagcagc

SEQ ID NO: 147555 - DNA, 16 bp, H. sapiens
tgcccagatagctggt

SEQ ID NO: 147556 - DNA, 16 bp, H. sapiens
tgcccagatcttggtt

SEQ ID NO: 147557 - DNA, 18 bp, H. sapiens
tgcccagatttcatattg

SEQ ID NO: 147558 - DNA, 16 bp, H. sapiens
tgcccagcacacagta

SEQ ID NO: 147559 - DNA, 16 bp, H. sapiens
tgcccagcacagagcc

SEQ ID NO: 147560 - DNA, 16 bp, H. sapiens
tgcccagcactgtgct

SEQ ID NO: 147561 - DNA, 16 bp, H. sapiens
tgcccagccagaatat

SEQ ID NO: 147562 - DNA, 16 bp, H. sapiens
tgcccagcccagccct

SEQ ID NO: 147563 - DNA, 16 bp, H. sapiens
tgcccagcccagcctc

SEQ ID NO: 147564 - DNA, 16 bp, H. sapiens
tgcccagcccctggca

SEQ ID NO: 147565 - DNA, 16 bp, H. sapiens
tgcccagccctgattt

SEQ ID NO: 147566 - DNA, 16 bp, H. sapiens
tgcccagccctgcccc

SEQ ID NO: 147567 - DNA, 16 bp, H. sapiens
tgcccagccctggcct

SEQ ID NO: 147568 - DNA, 16 bp, H. sapiens
tgcccagccgcccagt

SEQ ID NO: 147569 - DNA, 16 bp, H. sapiens
tgcccagcctccagaa

SEQ ID NO: 147570 - DNA, 16 bp, H. sapiens
tgcccagcctctttca

SEQ ID NO: 147571 - DNA, 16 bp, H. sapiens
tgcccagcctctttct

SEQ ID NO: 147572 - DNA, 16 bp, H. sapiens
tgcccagcctggaatc

SEQ ID NO: 147573 - DNA, 16 bp, H. sapiens
tgcccagcctggcctg

SEQ ID NO: 147574 - DNA, 16 bp, H. sapiens
tgcccagcctgtcttt

SEQ ID NO: 147575 - DNA, 16 bp, H. sapiens
tgcccagcctttcttt

SEQ ID NO: 147576 - DNA, 16 bp, H. sapiens
tgcccagctaatattt

SEQ ID NO: 147577 - DNA, 17 bp, H. sapiens
tgcccagctaatttttt

SEQ ID NO: 147578 - DNA, 16 bp, H. sapiens
tgcccagctctgtgct

SEQ ID NO: 147579 - DNA, 16 bp, H. sapiens
tgcccaggaagttgct

SEQ ID NO: 147580 - DNA, 16 bp, H. sapiens
tgcccaggaggctgag

SEQ ID NO: 147581 - DNA, 16 bp, H. sapiens
tgcccaggatggcctc

SEQ ID NO: 147582 - DNA, 16 bp, H. sapiens
tgcccaggccagtctc

SEQ ID NO: 147583 - DNA, 16 bp, H. sapiens
tgcccaggcctgtctc

SEQ ID NO: 147584 - DNA, 16 bp, H. sapiens
tgcccaggcgggtctt

SEQ ID NO: 147585 - DNA, 16 bp, H. sapiens
tgcccaggctagaggg

SEQ ID NO: 147586 - DNA, 16 bp, H. sapiens
tgcccaggctgaactc

SEQ ID NO: 147587 - DNA, 16 bp, H. sapiens
tgcccaggctgacctt

SEQ ID NO: 147588 - DNA, 16 bp, H. sapiens
tgcccaggctgaggtg

SEQ ID NO: 147589 - DNA, 16 bp, H. sapiens
tgcccaggctgatctg

SEQ ID NO: 147590 - DNA, 16 bp, H. sapiens
tgcccaggctgccctc

SEQ ID NO: 147591 - DNA, 16 bp, H. sapiens
tgcccaggctgctctg

SEQ ID NO: 147592 - DNA, 16 bp, H. sapiens
tgcccaggctggacag

SEQ ID NO: 147593 - DNA, 16 bp, H. sapiens
tgcccaggctggagca

SEQ ID NO: 147594 - DNA, 16 bp, H. sapiens
tgcccaggctggaggt

SEQ ID NO: 147595 - DNA, 16 bp, H. sapiens
tgcccaggctggcaca

SEQ ID NO: 147596 - DNA, 16 bp, H. sapiens
tgcccaggctggcatc

SEQ ID NO: 147597 - DNA, 16 bp, H. sapiens
tgcccaggctggcctc

SEQ ID NO: 147598 - DNA, 16 bp, H. sapiens
tgcccaggctgggctt

SEQ ID NO: 147599 - DNA, 16 bp, H. sapiens
tgcccaggctgggttt

SEQ ID NO: 147600 - DNA, 16 bp, H. sapiens
tgcccaggctggtcag

SEQ ID NO: 147601 - DNA, 16 bp, H. sapiens
tgcccaggctggtcgc

SEQ ID NO: 147602 - DNA, 16 bp, H. sapiens
tgcccaggctggtttc

SEQ ID NO: 147603 - DNA, 16 bp, H. sapiens
tgcccagggatgggca

SEQ ID NO: 147604 - DNA, 16 bp, H. sapiens
tgcccagggccagcag

SEQ ID NO: 147605 - DNA, 16 bp, H. sapiens
tgcccagggtgcagtg

SEQ ID NO: 147606 - DNA, 16 bp, H. sapiens
tgcccagggtgggtgg

SEQ ID NO: 147607 - DNA, 16 bp, H. sapiens
tgcccaggtatttttt

SEQ ID NO: 147608 - DNA, 16 bp, H. sapiens
tgcccaggttggcctc

SEQ ID NO: 147609 - DNA, 16 bp, H. sapiens
tgcccaggttgttctt

SEQ ID NO: 147610 - DNA, 16 bp, H. sapiens
tgcccagtgaaggggg

SEQ ID NO: 147611 - DNA, 16 bp, H. sapiens
tgcccagtgaggagga

SEQ ID NO: 147612 - DNA, 16 bp, H. sapiens
tgcccagtgcccagca

SEQ ID NO: 147613 - DNA, 16 bp, H. sapiens
tgcccagttcattttt

SEQ ID NO: 147614 - DNA, 16 bp, H. sapiens
tgcccagttccaaagt

SEQ ID NO: 147615 - DNA, 16 bp, H. sapiens
tgcccagttgtttggt

SEQ ID NO: 147616 - DNA, 16 bp, H. sapiens
tgcccatactgcccaa

SEQ ID NO: 147617 - DNA, 16 bp, H. sapiens
tgcccatcaatggtgg

SEQ ID NO: 147618 - DNA, 16 bp, H. sapiens
tgcccatcagtgacag

SEQ ID NO: 147619 - DNA, 16 bp, H. sapiens
tgcccatcccagcagt

SEQ ID NO: 147620 - DNA, 16 bp, H. sapiens
tgcccatctcagcctc

SEQ ID NO: 147621 - DNA, 16 bp, H. sapiens
tgcccatctcagcttc

SEQ ID NO: 147622 - DNA, 16 bp, H. sapiens
tgcccatctctgcctc

SEQ ID NO: 147623 - DNA, 16 bp, H. sapiens
tgcccatctgtaaaat

SEQ ID NO: 147624 - DNA, 16 bp, H. sapiens
tgcccatctgtgtgct

SEQ ID NO: 147625 - DNA, 16 bp, H. sapiens
tgcccatgcatatgtc

SEQ ID NO: 147626 - DNA, 16 bp, H. sapiens
tgcccatgcctatgcc

SEQ ID NO: 147627 - DNA, 16 bp, H. sapiens
tgcccatgctgaaggt

SEQ ID NO: 147628 - DNA, 16 bp, H. sapiens
tgcccatgctggcctt

SEQ ID NO: 147629 - DNA, 16 bp, H. sapiens
tgcccatgctggtctg

SEQ ID NO: 147630 - DNA, 16 bp, H. sapiens
tgcccatgctggtttc

SEQ ID NO: 147631 - DNA, 16 bp, H. sapiens
tgcccatggagcctca

SEQ ID NO: 147632 - DNA, 16 bp, H. sapiens
tgcccattatttcttt

SEQ ID NO: 147633 - DNA, 16 bp, H. sapiens
tgcccatttaaaaatt

SEQ ID NO: 147634 - DNA, 16 bp, H. sapiens
tgcccattttctaatc

SEQ ID NO: 147635 - DNA, 16 bp, H. sapiens
tgcccattttgcagat

SEQ ID NO: 147636 - DNA, 16 bp, H. sapiens
tgccccaaccactttg

SEQ ID NO: 147637 - DNA, 16 bp, H. sapiens
tgccccaagtcaggaa

SEQ ID NO: 147638 - DNA, 16 bp, H. sapiens
tgccccacccacccag

SEQ ID NO: 147639 - DNA, 16 bp, H. sapiens
tgccccacccaggact

SEQ ID NO: 147640 - DNA, 16 bp, H. sapiens
tgccccaccccatcct

SEQ ID NO: 147641 - DNA, 16 bp, H. sapiens
tgccccaccccatctc

SEQ ID NO: 147642 - DNA, 16 bp, H. sapiens
tgccccactcatgcct

SEQ ID NO: 147643 - DNA, 16 bp, H. sapiens
tgccccactgcactct

SEQ ID NO: 147644 - DNA, 16 bp, H. sapiens
tgccccagacctggaa

SEQ ID NO: 147645 - DNA, 16 bp, H. sapiens
tgccccagccagcagt

SEQ ID NO: 147646 - DNA, 16 bp, H. sapiens
tgccccagcccccagc

SEQ ID NO: 147647 - DNA, 16 bp, H. sapiens
tgccccagcccctggc

SEQ ID NO: 147648 - DNA, 16 bp, H. sapiens
tgccccagccctgcct

SEQ ID NO: 147649 - DNA, 16 bp, H. sapiens
tgccccagcctcccaa

SEQ ID NO: 147650 - DNA, 16 bp, H. sapiens
tgccccagctcctgca

SEQ ID NO: 147651 - DNA, 16 bp, H. sapiens
tgccccaggcaccctc

SEQ ID NO: 147652 - DNA, 16 bp, H. sapiens
tgccccaggcttccct

SEQ ID NO: 147653 - DNA, 16 bp, H. sapiens
tgccccatgcccagct

SEQ ID NO: 147654 - DNA, 16 bp, H. sapiens
tgccccattctccatg

SEQ ID NO: 147655 - DNA, 16 bp, H. sapiens
tgccccattttacaga

SEQ ID NO: 147656 - DNA, 16 bp, H. sapiens
tgcccccacacccggc

SEQ ID NO: 147657 - DNA, 16 bp, H. sapiens
tgcccccacacctggc

SEQ ID NO: 147658 - DNA, 16 bp, H. sapiens
tgcccccacctcagcc

SEQ ID NO: 147659 - DNA, 16 bp, H. sapiens
tgcccccagcccctgc

SEQ ID NO: 147660 - DNA, 16 bp, H. sapiens
tgcccccatgatttaa

SEQ ID NO: 147661 - DNA, 16 bp, H. sapiens
tgccccccaagccaca

SEQ ID NO: 147662 - DNA, 16 bp, H. sapiens
tgccccccagcctggg

SEQ ID NO: 147663 - DNA, 16 bp, H. sapiens
tgccccccaggctgga

SEQ ID NO: 147664 - DNA, 16 bp, H. sapiens
tgccccccccaaaaaa

SEQ ID NO: 147665 - DNA, 16 bp, H. sapiens
tgccccctgacccctt

SEQ ID NO: 147666 - DNA, 16 bp, H. sapiens
tgcccctaatcctgct

SEQ ID NO: 147667 - DNA, 16 bp, H. sapiens
tgcccctcaccattcc

SEQ ID NO: 147668 - DNA, 16 bp, H. sapiens
tgcccctcacctccca

SEQ ID NO: 147669 - DNA, 16 bp, H. sapiens
tgcccctccctcagcc

SEQ ID NO: 147670 - DNA, 16 bp, H. sapiens
tgcccctcctccagcc

SEQ ID NO: 147671 - DNA, 16 bp, H. sapiens
tgcccctccttcacct

SEQ ID NO: 147672 - DNA, 16 bp, H. sapiens
tgcccctctgagacaa

SEQ ID NO: 147673 - DNA, 16 bp, H. sapiens
tgcccctgaagacctt

SEQ ID NO: 147674 - DNA, 16 bp, H. sapiens
tgcccctgacccctcc

SEQ ID NO: 147675 - DNA, 16 bp, H. sapiens
tgcccctgcacttcag

SEQ ID NO: 147676 - DNA, 16 bp, H. sapiens
tgcccctgccccagga

SEQ ID NO: 147677 - DNA, 16 bp, H. sapiens
tgcccctgccctaggg

SEQ ID NO: 147678 - DNA, 16 bp, H. sapiens
tgcccctgcctctgcc

SEQ ID NO: 147679 - DNA, 16 bp, H. sapiens
tgcccctgccttggcc

SEQ ID NO: 147680 - DNA, 16 bp, H. sapiens
tgcccctgctctgccc

SEQ ID NO: 147681 - DNA, 16 bp, H. sapiens
tgcccctgctgatctg

SEQ ID NO: 147682 - DNA, 16 bp, H. sapiens
tgcccctgctggaggg

SEQ ID NO: 147683 - DNA, 16 bp, H. sapiens
tgcccctggaaggtca

SEQ ID NO: 147684 - DNA, 16 bp, H. sapiens
tgcccctggctcctcc

SEQ ID NO: 147685 - DNA, 22 bp, H. sapiens
tgcccctgggaactgaatgtct

SEQ ID NO: 147686 - DNA, 16 bp, H. sapiens
tgcccctgtcctagag

SEQ ID NO: 147687 - DNA, 16 bp, H. sapiens
tgccccttttcagcag

SEQ ID NO: 147688 - DNA, 16 bp, H. sapiens
tgcccgactgattttt

SEQ ID NO: 147689 - DNA, 25 bp, H. sapiens
tgcccgccaccatgcctggctaatt

SEQ ID NO: 147690 - DNA, 21 bp, H. sapiens
tgcccgccttgacctcccaaa

SEQ ID NO: 147691 - DNA, 16 bp, H. sapiens
tgcccgctaccacgcc

SEQ ID NO: 147692 - DNA, 16 bp, H. sapiens
tgcccggccaaaaaat

SEQ ID NO: 147693 - DNA, 16 bp, H. sapiens
tgcccggcctctttct

SEQ ID NO: 147694 - DNA, 16 bp, H. sapiens
tgcccggcctcttttt

SEQ ID NO: 147695 - DNA, 16 bp, H. sapiens
tgcccggctaatgttt

SEQ ID NO: 147696 - DNA, 18 bp, H. sapiens
tgcccggctaattttgtt

SEQ ID NO: 147697 - DNA, 16 bp, H. sapiens
tgcccggctagttttt

SEQ ID NO: 147698 - DNA, 16 bp, H. sapiens
tgcccggggccagcag

SEQ ID NO: 147699 - DNA, 17 bp, H. sapiens
tgcccgttcctatgtcc

SEQ ID NO: 147700 - DNA, 16 bp, H. sapiens
tgccctaaaagacctc

SEQ ID NO: 147701 - DNA, 16 bp, H. sapiens
tgccctcaaagagctc

SEQ ID NO: 147702 - DNA, 16 bp, H. sapiens
tgccctcaatgagctc

SEQ ID NO: 147703 - DNA, 16 bp, H. sapiens
tgccctcagcaaacct

SEQ ID NO: 147704 - DNA, 16 bp, H. sapiens
tgccctcaggataaag

SEQ ID NO: 147705 - DNA, 16 bp, H. sapiens
tgccctcaggcttgct

SEQ ID NO: 147706 - DNA, 16 bp, H. sapiens
tgccctcatgaagttt

SEQ ID NO: 147707 - DNA, 16 bp, H. sapiens
tgccctcatgaatggg

SEQ ID NO: 147708 - DNA, 16 bp, H. sapiens
tgccctccaccctggg

SEQ ID NO: 147709 - DNA, 16 bp, H. sapiens
tgccctccagaaaagc

SEQ ID NO: 147710 - DNA, 16 bp, H. sapiens
tgccctccagactggg

SEQ ID NO: 147711 - DNA, 16 bp, H. sapiens
tgccctccagcccagg

SEQ ID NO: 147712 - DNA, 16 bp, H. sapiens
tgccctccagcctcag

SEQ ID NO: 147713 - DNA, 16 bp, H. sapiens
tgccctccagcctgga

SEQ ID NO: 147714 - DNA, 16 bp, H. sapiens
tgccctccagcctggg

SEQ ID NO: 147715 - DNA, 16 bp, H. sapiens
tgccctccaggagctt

SEQ ID NO: 147716 - DNA, 16 bp, H. sapiens
tgccctccagtctggg

SEQ ID NO: 147717 - DNA, 16 bp, H. sapiens
tgccctccatgggctg

SEQ ID NO: 147718 - DNA, 16 bp, H. sapiens
tgccctcccaaatatc

SEQ ID NO: 147719 - DNA, 16 bp, H. sapiens
tgccctccctcaccac

SEQ ID NO: 147720 - DNA, 16 bp, H. sapiens
tgccctccctgggcac

SEQ ID NO: 147721 - DNA, 16 bp, H. sapiens
tgccctcctctaccca

SEQ ID NO: 147722 - DNA, 16 bp, H. sapiens
tgccctcctgggcctc

SEQ ID NO: 147723 - DNA, 16 bp, H. sapiens
tgccctcgaacattgg

SEQ ID NO: 147724 - DNA, 16 bp, H. sapiens
tgccctctctgggcct

SEQ ID NO: 147725 - DNA, 16 bp, H. sapiens
tgccctctggtggcca

SEQ ID NO: 147726 - DNA, 16 bp, H. sapiens
tgccctctgtgcaccc

SEQ ID NO: 147727 - DNA, 16 bp, H. sapiens
tgccctgagccctgga

SEQ ID NO: 147728 - DNA, 16 bp, H. sapiens
tgccctgcacagcctc

SEQ ID NO: 147729 - DNA, 16 bp, H. sapiens
tgccctgcagcctggg

SEQ ID NO: 147730 - DNA, 16 bp, H. sapiens
tgccctgcagggaggc

SEQ ID NO: 147731 - DNA, 16 bp, H. sapiens
tgccctgccactgctg

SEQ ID NO: 147732 - DNA, 16 bp, H. sapiens
tgccctgcccacagag

SEQ ID NO: 147733 - DNA, 16 bp, H. sapiens
tgccctgcccagaaag

SEQ ID NO: 147734 - DNA, 16 bp, H. sapiens
tgccctgcccagccca

SEQ ID NO: 147735 - DNA, 16 bp, H. sapiens
tgccctgcccccagag

SEQ ID NO: 147736 - DNA, 18 bp, H. sapiens
tgccctgcctccagaggt

SEQ ID NO: 147737 - DNA, 16 bp, H. sapiens
tgccctgcctgcctct

SEQ ID NO: 147738 - DNA, 16 bp, H. sapiens
tgccctgctaagtttt

SEQ ID NO: 147739 - DNA, 16 bp, H. sapiens
tgccctgctgcagctg

SEQ ID NO: 147740 - DNA, 16 bp, H. sapiens
tgccctgctgcccagg

SEQ ID NO: 147741 - DNA, 16 bp, H. sapiens
tgccctgctgctcaaa

SEQ ID NO: 147742 - DNA, 16 bp, H. sapiens
tgccctgctgctgctg

SEQ ID NO: 147743 - DNA, 16 bp, H. sapiens
tgccctgctgggtttt

SEQ ID NO: 147744 - DNA, 16 bp, H. sapiens
tgccctggcctcccac

SEQ ID NO: 147745 - DNA, 16 bp, H. sapiens
tgccctggcctcctgc

SEQ ID NO: 147746 - DNA, 16 bp, H. sapiens
tgccctggctctggcc

SEQ ID NO: 147747 - DNA, 16 bp, H. sapiens
tgccctggctgaagtg

SEQ ID NO: 147748 - DNA, 16 bp, H. sapiens
tgccctggctggtctt

SEQ ID NO: 147749 - DNA, 16 bp, H. sapiens
tgccctggctggtgtc

SEQ ID NO: 147750 - DNA, 16 bp, H. sapiens
tgccctgggcaccctc

SEQ ID NO: 147751 - DNA, 16 bp, H. sapiens
tgccctggtccttcca

SEQ ID NO: 147752 - DNA, 16 bp, H. sapiens
tgccctgtagccacca

SEQ ID NO: 147753 - DNA, 16 bp, H. sapiens
tgccctgtcaccaggc

SEQ ID NO: 147754 - DNA, 16 bp, H. sapiens
tgccctgtgacctcag

SEQ ID NO: 147755 - DNA, 16 bp, H. sapiens
tgccctgtgccctgtg

SEQ ID NO: 147756 - DNA, 16 bp, H. sapiens
tgccctgtggaacatc

SEQ ID NO: 147757 - DNA, 17 bp, H. sapiens
tgccctgtggagcatcc

SEQ ID NO: 147758 - DNA, 16 bp, H. sapiens
tgcccttaacattatt

SEQ ID NO: 147759 - DNA, 16 bp, H. sapiens
tgcccttcccccagcc

SEQ ID NO: 147760 - DNA, 16 bp, H. sapiens
tgcccttctcctgcct

SEQ ID NO: 147761 - DNA, 16 bp, H. sapiens
tgcccttctttgtcat

SEQ ID NO: 147762 - DNA, 16 bp, H. sapiens
tgcccttgaattcttt

SEQ ID NO: 147763 - DNA, 16 bp, H. sapiens
tgcccttggacatcag

SEQ ID NO: 147764 - DNA, 16 bp, H. sapiens
tgcccttggacattgg

SEQ ID NO: 147765 - DNA, 16 bp, H. sapiens
tgccctttgcaggaac

SEQ ID NO: 147766 - DNA, 16 bp, H. sapiens
tgccctttgccttctg

SEQ ID NO: 147767 - DNA, 16 bp, H. sapiens
tgccgacctcagcctc

SEQ ID NO: 147768 - DNA, 18 bp, H. sapiens
tgccgagtgcctgcgatt

SEQ ID NO: 147769 - DNA, 16 bp, H. sapiens
tgccgcaataaacata

SEQ ID NO: 147770 - DNA, 16 bp, H. sapiens
tgccgccacgcccagc

SEQ ID NO: 147771 - DNA, 16 bp, H. sapiens
tgccgccatgcccagc

SEQ ID NO: 147772 - DNA, 16 bp, H. sapiens
tgccgcccaggctgga

SEQ ID NO: 147773 - DNA, 16 bp, H. sapiens
tgccgccgcggctttt

SEQ ID NO: 147774 - DNA, 16 bp, H. sapiens
tgccgcctccacctcc

SEQ ID NO: 147775 - DNA, 16 bp, H. sapiens
tgccggcagctgtgcc

SEQ ID NO: 147776 - DNA, 16 bp, H. sapiens
tgccgggcagaggcgc

SEQ ID NO: 147777 - DNA, 19 bp, H. sapiens
tgccgggcgtggtggcaca

SEQ ID NO: 147778 - DNA, 16 bp, H. sapiens
tgccggggctggagtg

SEQ ID NO: 147779 - DNA, 16 bp, H. sapiens
tgccgggtgtggtggc

SEQ ID NO: 147780 - DNA, 16 bp, H. sapiens
tgccgtcccagctact

SEQ ID NO: 147781 - DNA, 18 bp, H. sapiens
tgccgtgagccgagatca

SEQ ID NO: 147782 - DNA, 17 bp, H. sapiens
tgccgtgagccgagatt

SEQ ID NO: 147783 - DNA, 16 bp, H. sapiens
tgccgtgagctgagat

SEQ ID NO: 147784 - DNA, 16 bp, H. sapiens
tgccgttgtactccag

SEQ ID NO: 147785 - DNA, 17 bp, H. sapiens
tgcctaaaagcaggaca

SEQ ID NO: 147786 - DNA, 16 bp, H. sapiens
tgcctaattcttcctg

SEQ ID NO: 147787 - DNA, 16 bp, H. sapiens
tgcctaatttttgtat

SEQ ID NO: 147788 - DNA, 16 bp, H. sapiens
tgcctacaatcccagc

SEQ ID NO: 147789 - DNA, 16 bp, H. sapiens
tgcctacagtattcag

SEQ ID NO: 147790 - DNA, 16 bp, H. sapiens
tgcctacatcaaaaat

SEQ ID NO: 147791 - DNA, 16 bp, H. sapiens
tgcctactatatgcca

SEQ ID NO: 147792 - DNA, 16 bp, H. sapiens
tgcctactgtgtgcca

SEQ ID NO: 147793 - DNA, 16 bp, H. sapiens
tgcctagcatagtgcc

SEQ ID NO: 147794 - DNA, 17 bp, H. sapiens
tgcctagcttttttttt

SEQ ID NO: 147795 - DNA, 16 bp, H. sapiens
tgcctaggctggactt

SEQ ID NO: 147796 - DNA, 16 bp, H. sapiens
tgcctagtacatagta

SEQ ID NO: 147797 - DNA, 16 bp, H. sapiens
tgcctagtcccaggta

SEQ ID NO: 147798 - DNA, 16 bp, H. sapiens
tgcctagtggagcttt

SEQ ID NO: 147799 - DNA, 16 bp, H. sapiens
tgcctataataccagc

SEQ ID NO: 147800 - DNA, 16 bp, H. sapiens
tgcctataatccgagc

SEQ ID NO: 147801 - DNA, 16 bp, H. sapiens
tgcctatgatcccagc

SEQ ID NO: 147802 - DNA, 16 bp, H. sapiens
tgcctatggagtagcc

SEQ ID NO: 147803 - DNA, 17 bp, H. sapiens
tgcctatttttatacca

SEQ ID NO: 147804 - DNA, 16 bp, H. sapiens
tgcctcaaaaacaaaa

SEQ ID NO: 147805 - DNA, 16 bp, H. sapiens
tgcctcaaaaagaaaa

SEQ ID NO: 147806 - DNA, 20 bp, H. sapiens
tgcctcacactggcctctct

SEQ ID NO: 147807 - DNA, 16 bp, H. sapiens
tgcctcaccagggaag

SEQ ID NO: 147808 - DNA, 16 bp, H. sapiens
tgcctcactctcctga

SEQ ID NO: 147809 - DNA, 16 bp, H. sapiens
tgcctcagaaaaaaaa

SEQ ID NO: 147810 - DNA, 16 bp, H. sapiens
tgcctcagcaccctga

SEQ ID NO: 147811 - DNA, 16 bp, H. sapiens
tgcctcagccacccca

SEQ ID NO: 147812 - DNA, 16 bp, H. sapiens
tgcctcagccccaccc

SEQ ID NO: 147813 - DNA, 16 bp, H. sapiens
tgcctcagccccatga

SEQ ID NO: 147814 - DNA, 16 bp, H. sapiens
tgcctcagcccccaag

SEQ ID NO: 147815 - DNA, 16 bp, H. sapiens
tgcctcagccccccaa

SEQ ID NO: 147816 - DNA, 16 bp, H. sapiens
tgcctcagccccccag

SEQ ID NO: 147817 - DNA, 16 bp, H. sapiens
tgcctcagccctccca

SEQ ID NO: 147818 - DNA, 16 bp, H. sapiens
tgcctcagccgcccaa

SEQ ID NO: 147819 - DNA, 16 bp, H. sapiens
tgcctcagcctccaca

SEQ ID NO: 147820 - DNA, 16 bp, H. sapiens
tgcctcagcctccagc

SEQ ID NO: 147821 - DNA, 16 bp, H. sapiens
tgcctcagcctccatg

SEQ ID NO: 147822 - DNA, 17 bp, H. sapiens
tgcctcagcctcccaac

SEQ ID NO: 147823 - DNA, 16 bp, H. sapiens
tgcctcagcctcccca

SEQ ID NO: 147824 - DNA, 16 bp, H. sapiens
tgcctcagcctccgaa

SEQ ID NO: 147825 - DNA, 16 bp, H. sapiens
tgcctcagcctcctag

SEQ ID NO: 147826 - DNA, 16 bp, H. sapiens
tgcctcagcctctggg

SEQ ID NO: 147827 - DNA, 16 bp, H. sapiens
tgcctcagcctcttaa

SEQ ID NO: 147828 - DNA, 16 bp, H. sapiens
tgcctcagcctcttca

SEQ ID NO: 147829 - DNA, 16 bp, H. sapiens
tgcctcagccttcaaa

SEQ ID NO: 147830 - DNA, 22 bp, H. sapiens
tgcctcagccttccaaagtgtt

SEQ ID NO: 147831 - DNA, 16 bp, H. sapiens
tgcctcagctcctgag

SEQ ID NO: 147832 - DNA, 16 bp, H. sapiens
tgcctcagctgcctga

SEQ ID NO: 147833 - DNA, 16 bp, H. sapiens
tgcctcagcttccaaa

SEQ ID NO: 147834 - DNA, 16 bp, H. sapiens
tgcctcagcttcccga

SEQ ID NO: 147835 - DNA, 16 bp, H. sapiens
tgcctcagcttcccta

SEQ ID NO: 147836 - DNA, 16 bp, H. sapiens
tgcctcagcttcctga

SEQ ID NO: 147837 - DNA, 16 bp, H. sapiens
tgcctcaggctcccag

SEQ ID NO: 147838 - DNA, 16 bp, H. sapiens
tgcctcaggctctgct

SEQ ID NO: 147839 - DNA, 16 bp, H. sapiens
tgcctcagggccttgg

SEQ ID NO: 147840 - DNA, 16 bp, H. sapiens
tgcctcagggcctttg

SEQ ID NO: 147841 - DNA, 16 bp, H. sapiens
tgcctcagtttattca

SEQ ID NO: 147842 - DNA, 16 bp, H. sapiens
tgcctcagtttcccca

SEQ ID NO: 147843 - DNA, 17 bp, H. sapiens
tgcctcagtttccccac

SEQ ID NO: 147844 - DNA, 16 bp, H. sapiens
tgcctcagtttccccc

SEQ ID NO: 147845 - DNA, 16 bp, H. sapiens
tgcctcagtttcccct

SEQ ID NO: 147846 - DNA, 16 bp, H. sapiens
tgcctcagtttcccta

SEQ ID NO: 147847 - DNA, 16 bp, H. sapiens
tgcctcagtttccctt

SEQ ID NO: 147848 - DNA, 16 bp, H. sapiens
tgcctcagtttcctca

SEQ ID NO: 147849 - DNA, 16 bp, H. sapiens
tgcctcagtttctccc

SEQ ID NO: 147850 - DNA, 16 bp, H. sapiens
tgcctcagttttccca

SEQ ID NO: 147851 - DNA, 16 bp, H. sapiens
tgcctcatcctcctaa

SEQ ID NO: 147852 - DNA, 16 bp, H. sapiens
tgcctcatctgtaaag

SEQ ID NO: 147853 - DNA, 16 bp, H. sapiens
tgcctcatgtctgtaa

SEQ ID NO: 147854 - DNA, 16 bp, H. sapiens
tgcctccacacctggc

SEQ ID NO: 147855 - DNA, 16 bp, H. sapiens
tgcctccagatttgtt

SEQ ID NO: 147856 - DNA, 16 bp, H. sapiens
tgcctccagctctgtt

SEQ ID NO: 147857 - DNA, 16 bp, H. sapiens
tgcctccagcttttct

SEQ ID NO: 147858 - DNA, 16 bp, H. sapiens
tgcctccatctctccc

SEQ ID NO: 147859 - DNA, 16 bp, H. sapiens
tgcctccatgatccaa

SEQ ID NO: 147860 - DNA, 16 bp, H. sapiens
tgcctccatttcagag

SEQ ID NO: 147861 - DNA, 16 bp, H. sapiens
tgcctccatttcctta

SEQ ID NO: 147862 - DNA, 16 bp, H. sapiens
tgcctccatttgcctt

SEQ ID NO: 147863 - DNA, 16 bp, H. sapiens
tgcctcccaaagagct

SEQ ID NO: 147864 - DNA, 16 bp, H. sapiens
tgcctcccaaagttct

SEQ ID NO: 147865 - DNA, 16 bp, H. sapiens
tgcctcccaagcagct

SEQ ID NO: 147866 - DNA, 16 bp, H. sapiens
tgcctcccactgccat

SEQ ID NO: 147867 - DNA, 16 bp, H. sapiens
tgcctcccagggatga

SEQ ID NO: 147868 - DNA, 16 bp, H. sapiens
tgcctcccattctatt

SEQ ID NO: 147869 - DNA, 16 bp, H. sapiens
tgcctccccagctcaa

SEQ ID NO: 147870 - DNA, 16 bp, H. sapiens
tgcctcccctgctgca

SEQ ID NO: 147871 - DNA, 16 bp, H. sapiens
tgcctcccgggttcgc

SEQ ID NO: 147872 - DNA, 16 bp, H. sapiens
tgcctccctccccagc

SEQ ID NO: 147873 - DNA, 16 bp, H. sapiens
tgcctcctccacctcc

SEQ ID NO: 147874 - DNA, 16 bp, H. sapiens
tgcctcctctcctcca

SEQ ID NO: 147875 - DNA, 16 bp, H. sapiens
tgcctcctgaagtgct

SEQ ID NO: 147876 - DNA, 16 bp, H. sapiens
tgcctcctgagaagct

SEQ ID NO: 147877 - DNA, 16 bp, H. sapiens
tgcctcctgagcagct

SEQ ID NO: 147878 - DNA, 16 bp, H. sapiens
tgcctcctgggctcag

SEQ ID NO: 147879 - DNA, 16 bp, H. sapiens
tgcctcctggttcaag

SEQ ID NO: 147880 - DNA, 16 bp, H. sapiens
tgcctcctgtgctcaa

SEQ ID NO: 147881 - DNA, 16 bp, H. sapiens
tgcctccttacatatt

SEQ ID NO: 147882 - DNA, 16 bp, H. sapiens
tgcctccttgcagttt

SEQ ID NO: 147883 - DNA, 16 bp, H. sapiens
tgcctcctttggaaaa

SEQ ID NO: 147884 - DNA, 16 bp, H. sapiens
tgcctcgccctgcttc

SEQ ID NO: 147885 - DNA, 17 bp, H. sapiens
tgcctcggcctcccaac

SEQ ID NO: 147886 - DNA, 16 bp, H. sapiens
tgcctcggcctcccca

SEQ ID NO: 147887 - DNA, 16 bp, H. sapiens
tgcctcggcctcctga

SEQ ID NO: 147888 - DNA, 16 bp, H. sapiens
tgcctcgtggtcagaa

SEQ ID NO: 147889 - DNA, 16 bp, H. sapiens
tgcctctaaaataaat

SEQ ID NO: 147890 - DNA, 16 bp, H. sapiens
tgcctctacactccag

SEQ ID NO: 147891 - DNA, 16 bp, H. sapiens
tgcctctcaaagtgct

SEQ ID NO: 147892 - DNA, 16 bp, H. sapiens
tgcctctccccctcca

SEQ ID NO: 147893 - DNA, 16 bp, H. sapiens
tgcctctgcccagccg

SEQ ID NO: 147894 - DNA, 16 bp, H. sapiens
tgcctctgcctcccga

SEQ ID NO: 147895 - DNA, 16 bp, H. sapiens
tgcctctgcctctcga

SEQ ID NO: 147896 - DNA, 16 bp, H. sapiens
tgcctctgcctctctg

SEQ ID NO: 147897 - DNA, 16 bp, H. sapiens
tgcctctgccttccaa

SEQ ID NO: 147898 - DNA, 16 bp, H. sapiens
tgcctctgccttctga

SEQ ID NO: 147899 - DNA, 16 bp, H. sapiens
tgcctctgctgtgaga

SEQ ID NO: 147900 - DNA, 16 bp, H. sapiens
tgcctctgcttcccag

SEQ ID NO: 147901 - DNA, 16 bp, H. sapiens
tgcctctggccaccct

SEQ ID NO: 147902 - DNA, 16 bp, H. sapiens
tgcctctggctttatt

SEQ ID NO: 147903 - DNA, 16 bp, H. sapiens
tgcctctgggcctgtg

SEQ ID NO: 147904 - DNA, 16 bp, H. sapiens
tgcctctggggagggg

SEQ ID NO: 147905 - DNA, 16 bp, H. sapiens
tgcctctggtcccagc

SEQ ID NO: 147906 - DNA, 16 bp, H. sapiens
tgcctctgtctccttc

SEQ ID NO: 147907 - DNA, 16 bp, H. sapiens
tgcctctgtgtctttg

SEQ ID NO: 147908 - DNA, 16 bp, H. sapiens
tgcctctgtgtgtgtg

SEQ ID NO: 147909 - DNA, 16 bp, H. sapiens
tgcctcttccagctcc

SEQ ID NO: 147910 - DNA, 16 bp, H. sapiens
tgcctcttccaggaag

SEQ ID NO: 147911 - DNA, 16 bp, H. sapiens
tgcctcttccatgtga

SEQ ID NO: 147912 - DNA, 16 bp, H. sapiens
tgcctcttcctccagg

SEQ ID NO: 147913 - DNA, 16 bp, H. sapiens
tgcctcttcctggctt

SEQ ID NO: 147914 - DNA, 16 bp, H. sapiens
tgcctcttctccttca

SEQ ID NO: 147915 - DNA, 16 bp, H. sapiens
tgcctcttcttctcca

SEQ ID NO: 147916 - DNA, 16 bp, H. sapiens
tgcctctttaggccag

SEQ ID NO: 147917 - DNA, 16 bp, H. sapiens
tgcctcttttcctcca

SEQ ID NO: 147918 - DNA, 16 bp, H. sapiens
tgcctgaaatcccagc

SEQ ID NO: 147919 - DNA, 16 bp, H. sapiens
tgcctgaacccaagag

SEQ ID NO: 147920 - DNA, 16 bp, H. sapiens
tgcctgaacccaggaa

SEQ ID NO: 147921 - DNA, 16 bp, H. sapiens
tgcctgaagccaggag

SEQ ID NO: 147922 - DNA, 16 bp, H. sapiens
tgcctgacacacagca

SEQ ID NO: 147923 - DNA, 16 bp, H. sapiens
tgcctgacaccatgcc

SEQ ID NO: 147924 - DNA, 16 bp, H. sapiens
tgcctgacctcaggtg

SEQ ID NO: 147925 - DNA, 16 bp, H. sapiens
tgcctgacttcaaact

SEQ ID NO: 147926 - DNA, 16 bp, H. sapiens
tgcctgagaccaggag

SEQ ID NO: 147927 - DNA, 16 bp, H. sapiens
tgcctgagatcacaca

SEQ ID NO: 147928 - DNA, 16 bp, H. sapiens
tgcctgagccccaccc

SEQ ID NO: 147929 - DNA, 16 bp, H. sapiens
tgcctgagctcaggaa

SEQ ID NO: 147930 - DNA, 16 bp, H. sapiens
tgcctgagctctacct

SEQ ID NO: 147931 - DNA, 16 bp, H. sapiens
tgcctgaggctgcttt

SEQ ID NO: 147932 - DNA, 16 bp, H. sapiens
tgcctgaggtcacaca

SEQ ID NO: 147933 - DNA, 16 bp, H. sapiens
tgcctgagtcccagct

SEQ ID NO: 147934 - DNA, 16 bp, H. sapiens
tgcctgagtggctgct

SEQ ID NO: 147935 - DNA, 16 bp, H. sapiens
tgcctgataagagtgt

SEQ ID NO: 147936 - DNA, 16 bp, H. sapiens
tgcctgattgacctgg

SEQ ID NO: 147937 - DNA, 16 bp, H. sapiens
tgcctgattgcccttg

SEQ ID NO: 147938 - DNA, 16 bp, H. sapiens
tgcctgattgccttgg

SEQ ID NO: 147939 - DNA, 16 bp, H. sapiens
tgcctgattgctgtgg

SEQ ID NO: 147940 - DNA, 16 bp, H. sapiens
tgcctgcaataccagc

SEQ ID NO: 147941 - DNA, 16 bp, H. sapiens
tgcctgcaatcccaga

SEQ ID NO: 147942 - DNA, 16 bp, H. sapiens
tgcctgcactcctcag

SEQ ID NO: 147943 - DNA, 16 bp, H. sapiens
tgcctgcagacccagc

SEQ ID NO: 147944 - DNA, 16 bp, H. sapiens
tgcctgcagagaggag

SEQ ID NO: 147945 - DNA, 16 bp, H. sapiens
tgcctgcagcccagga

SEQ ID NO: 147946 - DNA, 16 bp, H. sapiens
tgcctgcagggtcagg

SEQ ID NO: 147947 - DNA, 16 bp, H. sapiens
tgcctgccaacacgcc

SEQ ID NO: 147948 - DNA, 16 bp, H. sapiens
tgcctgccaccacgtc

SEQ ID NO: 147949 - DNA, 16 bp, H. sapiens
tgcctgccaccatgct

SEQ ID NO: 147950 - DNA, 16 bp, H. sapiens
tgcctgccactgtgcc

SEQ ID NO: 147951 - DNA, 16 bp, H. sapiens
tgcctgccaggctggg

SEQ ID NO: 147952 - DNA, 16 bp, H. sapiens
tgcctgcccacattgg

SEQ ID NO: 147953 - DNA, 16 bp, H. sapiens
tgcctgccccagcctc

SEQ ID NO: 147954 - DNA, 16 bp, H. sapiens
tgcctgcccctccctg

SEQ ID NO: 147955 - DNA, 16 bp, H. sapiens
tgcctgccctgccctg

SEQ ID NO: 147956 - DNA, 16 bp, H. sapiens
tgcctgcctcactctc

SEQ ID NO: 147957 - DNA, 17 bp, H. sapiens
tgcctgcctcagcttcc

SEQ ID NO: 147958 - DNA, 16 bp, H. sapiens
tgcctgcctcatcctc

SEQ ID NO: 147959 - DNA, 16 bp, H. sapiens
tgcctgcctccctgtg

SEQ ID NO: 147960 - DNA, 16 bp, H. sapiens
tgcctgcctcggtctc

SEQ ID NO: 147961 - DNA, 16 bp, H. sapiens
tgcctgcctctccagc

SEQ ID NO: 147962 - DNA, 16 bp, H. sapiens
tgcctgcctctgcctg

SEQ ID NO: 147963 - DNA, 16 bp, H. sapiens
tgcctgcctctgtctc

SEQ ID NO: 147964 - DNA, 16 bp, H. sapiens
tgcctgcctgcccgcc

SEQ ID NO: 147965 - DNA, 16 bp, H. sapiens
tgcctgcctgcctccc

SEQ ID NO: 147966 - DNA, 18 bp, H. sapiens
tgcctgcctgcctgcctg

SEQ ID NO: 147967 - DNA, 16 bp, H. sapiens
tgcctgcctgcctgtg

SEQ ID NO: 147968 - DNA, 16 bp, H. sapiens
tgcctgcctgccttcc

SEQ ID NO: 147969 - DNA, 16 bp, H. sapiens
tgcctgcctgtaatcc

SEQ ID NO: 147970 - DNA, 16 bp, H. sapiens
tgcctgcctgtagtcc

SEQ ID NO: 147971 - DNA, 16 bp, H. sapiens
tgcctgccttatttca

SEQ ID NO: 147972 - DNA, 16 bp, H. sapiens
tgcctgccttccttcc

SEQ ID NO: 147973 - DNA, 16 bp, H. sapiens
tgcctgccttcctttc

SEQ ID NO: 147974 - DNA, 16 bp, H. sapiens
tgcctgccttgccctc

SEQ ID NO: 147975 - DNA, 16 bp, H. sapiens
tgcctgccttggcctg

SEQ ID NO: 147976 - DNA, 16 bp, H. sapiens
tgcctgccttggcctt

SEQ ID NO: 147977 - DNA, 16 bp, H. sapiens
tgcctgccttggcttt

SEQ ID NO: 147978 - DNA, 16 bp, H. sapiens
tgcctgccttggtcat

SEQ ID NO: 147979 - DNA, 16 bp, H. sapiens
tgcctgctccctcttc

SEQ ID NO: 147980 - DNA, 16 bp, H. sapiens
tgcctgctccttatga

SEQ ID NO: 147981 - DNA, 16 bp, H. sapiens
tgcctgctgcagcctc

SEQ ID NO: 147982 - DNA, 16 bp, H. sapiens
tgcctgctgccaccca

SEQ ID NO: 147983 - DNA, 16 bp, H. sapiens
tgcctgctgccatcca

SEQ ID NO: 147984 - DNA, 16 bp, H. sapiens
tgcctgctgccatccg

SEQ ID NO: 147985 - DNA, 16 bp, H. sapiens
tgcctgctgccatgtt

SEQ ID NO: 147986 - DNA, 16 bp, H. sapiens
tgcctgctgcctaaga

SEQ ID NO: 147987 - DNA, 16 bp, H. sapiens
tgcctgctgccttcca

SEQ ID NO: 147988 - DNA, 16 bp, H. sapiens
tgcctgctgctcacct

SEQ ID NO: 147989 - DNA, 16 bp, H. sapiens
tgcctgctggctctga

SEQ ID NO: 147990 - DNA, 16 bp, H. sapiens
tgcctgctggctctgg

SEQ ID NO: 147991 - DNA, 16 bp, H. sapiens
tgcctgcttccccttc

SEQ ID NO: 147992 - DNA, 16 bp, H. sapiens
tgcctgcttcctggag

SEQ ID NO: 147993 - DNA, 16 bp, H. sapiens
tgcctgcttctcctgc

SEQ ID NO: 147994 - DNA, 16 bp, H. sapiens
tgcctgcttgggtctc

SEQ ID NO: 147995 - DNA, 16 bp, H. sapiens
tgcctgctttatttca

SEQ ID NO: 147996 - DNA, 16 bp, H. sapiens
tgcctgcttttgtaaa

SEQ ID NO: 147997 - DNA, 16 bp, H. sapiens
tgcctggaaataaact

SEQ ID NO: 147998 - DNA, 16 bp, H. sapiens
tgcctggaaatagact

SEQ ID NO: 147999 - DNA, 16 bp, H. sapiens
tgcctggaacaccagc

SEQ ID NO: 148000 - DNA, 16 bp, H. sapiens
tgcctggaatcccagc

SEQ ID NO: 148001 - DNA, 16 bp, H. sapiens
tgcctggaatcccagg

SEQ ID NO: 148002 - DNA, 16 bp, H. sapiens
tgcctggaatcctagc

SEQ ID NO: 148003 - DNA, 16 bp, H. sapiens
tgcctggaattttttt

SEQ ID NO: 148004 - DNA, 16 bp, H. sapiens
tgcctggacatgcagg

SEQ ID NO: 148005 - DNA, 16 bp, H. sapiens
tgcctggagctgaggc

SEQ ID NO: 148006 - DNA, 16 bp, H. sapiens
tgcctggagctgccca

SEQ ID NO: 148007 - DNA, 16 bp, H. sapiens
tgcctggagctgctgc

SEQ ID NO: 148008 - DNA, 16 bp, H. sapiens
tgcctggagctgggag

SEQ ID NO: 148009 - DNA, 16 bp, H. sapiens
tgcctggatacccagg

SEQ ID NO: 148010 - DNA, 16 bp, H. sapiens
tgcctggatttccagg

SEQ ID NO: 148011 - DNA, 16 bp, H. sapiens
tgcctggcacaaagtg

SEQ ID NO: 148012 - DNA, 16 bp, H. sapiens
tgcctggcacacagca

SEQ ID NO: 148013 - DNA, 16 bp, H. sapiens
tgcctggcacacagta

SEQ ID NO: 148014 - DNA, 16 bp, H. sapiens
tgcctggcacagagtg

SEQ ID NO: 148015 - DNA, 16 bp, H. sapiens
tgcctggcacagtgct

SEQ ID NO: 148016 - DNA, 16 bp, H. sapiens
tgcctggcacatagga

SEQ ID NO: 148017 - DNA, 16 bp, H. sapiens
tgcctggcacatagta

SEQ ID NO: 148018 - DNA, 16 bp, H. sapiens
tgcctggcacatggca

SEQ ID NO: 148019 - DNA, 16 bp, H. sapiens
tgcctggcacctagta

SEQ ID NO: 148020 - DNA, 16 bp, H. sapiens
tgcctggcactgtgcc

SEQ ID NO: 148021 - DNA, 16 bp, H. sapiens
tgcctggcatatacta

SEQ ID NO: 148022 - DNA, 16 bp, H. sapiens
tgcctggcatatagta

SEQ ID NO: 148023 - DNA, 16 bp, H. sapiens
tgcctggccaacattt

SEQ ID NO: 148024 - DNA, 16 bp, H. sapiens
tgcctggccagaaatc

SEQ ID NO: 148025 - DNA, 16 bp, H. sapiens
tgcctggcccagaatt

SEQ ID NO: 148026 - DNA, 16 bp, H. sapiens
tgcctggcccagatgt

SEQ ID NO: 148027 - DNA, 16 bp, H. sapiens
tgcctggcccagattt

SEQ ID NO: 148028 - DNA, 16 bp, H. sapiens
tgcctggcccagcctg

SEQ ID NO: 148029 - DNA, 16 bp, H. sapiens
tgcctggcccaggact

SEQ ID NO: 148030 - DNA, 16 bp, H. sapiens
tgcctggcccattctt

SEQ ID NO: 148031 - DNA, 16 bp, H. sapiens
tgcctggccctgcctc

SEQ ID NO: 148032 - DNA, 16 bp, H. sapiens
tgcctggccctgcttc

SEQ ID NO: 148033 - DNA, 16 bp, H. sapiens
tgcctggccgattttt

SEQ ID NO: 148034 - DNA, 16 bp, H. sapiens
tgcctggccgccccgt

SEQ ID NO: 148035 - DNA, 16 bp, H. sapiens
tgcctggccgctgcgg

SEQ ID NO: 148036 - DNA, 16 bp, H. sapiens
tgcctggcctattcct

SEQ ID NO: 148037 - DNA, 16 bp, H. sapiens
tgcctggcctctctct

SEQ ID NO: 148038 - DNA, 16 bp, H. sapiens
tgcctggcctcttttg

SEQ ID NO: 148039 - DNA, 16 bp, H. sapiens
tgcctggcctgaaaat

SEQ ID NO: 148040 - DNA, 16 bp, H. sapiens
tgcctggcctggaact

SEQ ID NO: 148041 - DNA, 16 bp, H. sapiens
tgcctggcctggaatt

SEQ ID NO: 148042 - DNA, 16 bp, H. sapiens
tgcctggcctggctcc

SEQ ID NO: 148043 - DNA, 16 bp, H. sapiens
tgcctggcctgggact

SEQ ID NO: 148044 - DNA, 16 bp, H. sapiens
tgcctggcctgtgtct

SEQ ID NO: 148045 - DNA, 16 bp, H. sapiens
tgcctggcctgtttca

SEQ ID NO: 148046 - DNA, 16 bp, H. sapiens
tgcctggccttatttt

SEQ ID NO: 148047 - DNA, 16 bp, H. sapiens
tgcctggctaacatgg

SEQ ID NO: 148048 - DNA, 16 bp, H. sapiens
tgcctggctaagtttt

SEQ ID NO: 148049 - DNA, 16 bp, H. sapiens
tgcctggctaattttt

SEQ ID NO: 148050 - DNA, 18 bp, H. sapiens
tgcctggctaattttttg

SEQ ID NO: 148051 - DNA, 16 bp, H. sapiens
tgcctggctcagcagg

SEQ ID NO: 148052 - DNA, 16 bp, H. sapiens
tgcctggctcagcggg

SEQ ID NO: 148053 - DNA, 16 bp, H. sapiens
tgcctggctcatagta

SEQ ID NO: 148054 - DNA, 16 bp, H. sapiens
tgcctggctgagtttt

SEQ ID NO: 148055 - DNA, 16 bp, H. sapiens
tgcctggctgattctt

SEQ ID NO: 148056 - DNA, 16 bp, H. sapiens
tgcctggctgattttc

SEQ ID NO: 148057 - DNA, 16 bp, H. sapiens
tgcctggctgcctggc

SEQ ID NO: 148058 - DNA, 16 bp, H. sapiens
tgcctggctgctttca

SEQ ID NO: 148059 - DNA, 16 bp, H. sapiens
tgcctggcttattttc

SEQ ID NO: 148060 - DNA, 16 bp, H. sapiens
tgcctggcttgtttca

SEQ ID NO: 148061 - DNA, 16 bp, H. sapiens
tgcctgggaatccagg

SEQ ID NO: 148062 - DNA, 16 bp, H. sapiens
tgcctgggactgaggg

SEQ ID NO: 148063 - DNA, 16 bp, H. sapiens
tgcctgggaggcagag

SEQ ID NO: 148064 - DNA, 16 bp, H. sapiens
tgcctgggccccaccc

SEQ ID NO: 148065 - DNA, 16 bp, H. sapiens
tgcctgggctggtctc

SEQ ID NO: 148066 - DNA, 16 bp, H. sapiens
tgcctggggaccagac

SEQ ID NO: 148067 - DNA, 16 bp, H. sapiens
tgcctggggccagcag

SEQ ID NO: 148068 - DNA, 16 bp, H. sapiens
tgcctggggccggcag

SEQ ID NO: 148069 - DNA, 16 bp, H. sapiens
tgcctggggctgggag

SEQ ID NO: 148070 - DNA, 16 bp, H. sapiens
tgcctggggtcaccca

SEQ ID NO: 148071 - DNA, 16 bp, H. sapiens
tgcctggggttgccca

SEQ ID NO: 148072 - DNA, 16 bp, H. sapiens
tgcctggggtttatat

SEQ ID NO: 148073 - DNA, 16 bp, H. sapiens
tgcctgggtaccagca

SEQ ID NO: 148074 - DNA, 16 bp, H. sapiens
tgcctgggtcccaccc

SEQ ID NO: 148075 - DNA, 16 bp, H. sapiens
tgcctgggtgtggagc

SEQ ID NO: 148076 - DNA, 16 bp, H. sapiens
tgcctgggtttaaatc

SEQ ID NO: 148077 - DNA, 16 bp, H. sapiens
tgcctgggtttgaatc

SEQ ID NO: 148078 - DNA, 16 bp, H. sapiens
tgcctgggtttgaatt

SEQ ID NO: 148079 - DNA, 16 bp, H. sapiens
tgcctggtatatagca

SEQ ID NO: 148080 - DNA, 16 bp, H. sapiens
tgcctggtccagctgc

SEQ ID NO: 148081 - DNA, 16 bp, H. sapiens
tgcctggtgccaaaaa

SEQ ID NO: 148082 - DNA, 16 bp, H. sapiens
tgcctgtaaacccagc

SEQ ID NO: 148083 - DNA, 16 bp, H. sapiens
tgcctgtaacctcagc

SEQ ID NO: 148084 - DNA, 16 bp, H. sapiens
tgcctgtaatcacagc

SEQ ID NO: 148085 - DNA, 16 bp, H. sapiens
tgcctgtaatcccaac

SEQ ID NO: 148086 - DNA, 16 bp, H. sapiens
tgcctgtaatcccaga

SEQ ID NO: 148087 - DNA, 16 bp, H. sapiens
tgcctgtaatcccagg

SEQ ID NO: 148088 - DNA, 24 bp, H. sapiens
tgcctgtaatcccagtactttgga

SEQ ID NO: 148089 - DNA, 16 bp, H. sapiens
tgcctgtaatcccatc

SEQ ID NO: 148090 - DNA, 16 bp, H. sapiens
tgcctgtaatcttagc

SEQ ID NO: 148091 - DNA, 16 bp, H. sapiens
tgcctgtaccaaaata

SEQ ID NO: 148092 - DNA, 16 bp, H. sapiens
tgcctgtaccaccatt

SEQ ID NO: 148093 - DNA, 16 bp, H. sapiens
tgcctgtactcccagc

SEQ ID NO: 148094 - DNA, 16 bp, H. sapiens
tgcctgtagccccagt

SEQ ID NO: 148095 - DNA, 16 bp, H. sapiens
tgcctgtagtcccact

SEQ ID NO: 148096 - DNA, 16 bp, H. sapiens
tgcctgtatcctcatt

SEQ ID NO: 148097 - DNA, 16 bp, H. sapiens
tgcctgtatgtcttct

SEQ ID NO: 148098 - DNA, 16 bp, H. sapiens
tgcctgtattcctagc

SEQ ID NO: 148099 - DNA, 16 bp, H. sapiens
tgcctgtctgcctgcc

SEQ ID NO: 148100 - DNA, 16 bp, H. sapiens
tgcctgtctgtctgtc

SEQ ID NO: 148101 - DNA, 16 bp, H. sapiens
tgcctgtcttcaccta

SEQ ID NO: 148102 - DNA, 16 bp, H. sapiens
tgcctgtcttccttcc

SEQ ID NO: 148103 - DNA, 16 bp, H. sapiens
tgcctgtgaatagtca

SEQ ID NO: 148104 - DNA, 16 bp, H. sapiens
tgcctgtgatcccagc

SEQ ID NO: 148105 - DNA, 16 bp, H. sapiens
tgcctgtgatcccagt

SEQ ID NO: 148106 - DNA, 16 bp, H. sapiens
tgcctgtgcccccatt

SEQ ID NO: 148107 - DNA, 16 bp, H. sapiens
tgcctgtgcctgtgtg

SEQ ID NO: 148108 - DNA, 16 bp, H. sapiens
tgcctgtgctcccagc

SEQ ID NO: 148109 - DNA, 16 bp, H. sapiens
tgcctgtgcttttggg

SEQ ID NO: 148110 - DNA, 16 bp, H. sapiens
tgcctgtgcttttgtt

SEQ ID NO: 148111 - DNA, 16 bp, H. sapiens
tgcctgtggaaaggag

SEQ ID NO: 148112 - DNA, 16 bp, H. sapiens
tgcctgtggccccagc

SEQ ID NO: 148113 - DNA, 16 bp, H. sapiens
tgcctgtggtcttagc

SEQ ID NO: 148114 - DNA, 16 bp, H. sapiens
tgcctgtgtactttgt

SEQ ID NO: 148115 - DNA, 16 bp, H. sapiens
tgcctgtgtatgtgtg

SEQ ID NO: 148116 - DNA, 16 bp, H. sapiens
tgcctgtgtcctcacc

SEQ ID NO: 148117 - DNA, 18 bp, H. sapiens
tgcctgtgtcctgaatgg

SEQ ID NO: 148118 - DNA, 16 bp, H. sapiens
tgcctgtgtctctgtg

SEQ ID NO: 148119 - DNA, 16 bp, H. sapiens
tgcctgtgtgcctgtg

SEQ ID NO: 148120 - DNA, 16 bp, H. sapiens
tgcctgtgtgtgcctg

SEQ ID NO: 148121 - DNA, 16 bp, H. sapiens
tgcctgtgtgtgtgca

SEQ ID NO: 148122 - DNA, 16 bp, H. sapiens
tgcctgtgtgtgtgcg

SEQ ID NO: 148123 - DNA, 16 bp, H. sapiens
tgcctgtgttcccagc

SEQ ID NO: 148124 - DNA, 16 bp, H. sapiens
tgcctgtgtttgtgtg

SEQ ID NO: 148125 - DNA, 16 bp, H. sapiens
tgcctgttatctcagc

SEQ ID NO: 148126 - DNA, 16 bp, H. sapiens
tgcctgttcctccctc

SEQ ID NO: 148127 - DNA, 16 bp, H. sapiens
tgcctgttctccagat

SEQ ID NO: 148128 - DNA, 16 bp, H. sapiens
tgcctgtttccccttc

SEQ ID NO: 148129 - DNA, 16 bp, H. sapiens
tgcctgtttgccattt

SEQ ID NO: 148130 - DNA, 17 bp, H. sapiens
tgcctgtttgctatttg

SEQ ID NO: 148131 - DNA, 16 bp, H. sapiens
tgcctgtttgctctgg

SEQ ID NO: 148132 - DNA, 16 bp, H. sapiens
tgcctgttttcaaggg

SEQ ID NO: 148133 - DNA, 16 bp, H. sapiens
tgccttaaaagaaaaa

SEQ ID NO: 148134 - DNA, 16 bp, H. sapiens
tgccttagcttcccca

SEQ ID NO: 148135 - DNA, 16 bp, H. sapiens
tgccttattgccctgg

SEQ ID NO: 148136 - DNA, 16 bp, H. sapiens
tgccttatttttcttc

SEQ ID NO: 148137 - DNA, 16 bp, H. sapiens
tgccttcaaggagttt

SEQ ID NO: 148138 - DNA, 16 bp, H. sapiens
tgccttcatcaagaag

SEQ ID NO: 148139 - DNA, 16 bp, H. sapiens
tgccttcatctttgtt

SEQ ID NO: 148140 - DNA, 16 bp, H. sapiens
tgccttcatggagctt

SEQ ID NO: 148141 - DNA, 16 bp, H. sapiens
tgccttcatttaaaaa

SEQ ID NO: 148142 - DNA, 16 bp, H. sapiens
tgccttccagcctgga

SEQ ID NO: 148143 - DNA, 16 bp, H. sapiens
tgccttccagcctggg

SEQ ID NO: 148144 - DNA, 16 bp, H. sapiens
tgccttcctcagcctc

SEQ ID NO: 148145 - DNA, 16 bp, H. sapiens
tgccttcctgctgtgt

SEQ ID NO: 148146 - DNA, 16 bp, H. sapiens
tgccttcctggaggtc

SEQ ID NO: 148147 - DNA, 16 bp, H. sapiens
tgccttctcagttatt

SEQ ID NO: 148148 - DNA, 16 bp, H. sapiens
tgccttctccagaatg

SEQ ID NO: 148149 - DNA, 16 bp, H. sapiens
tgccttctcctgctat

SEQ ID NO: 148150 - DNA, 16 bp, H. sapiens
tgccttctctctctgc

SEQ ID NO: 148151 - DNA, 16 bp, H. sapiens
tgccttctctgagcct

SEQ ID NO: 148152 - DNA, 16 bp, H. sapiens
tgccttctctggtttt

SEQ ID NO: 148153 - DNA, 16 bp, H. sapiens
tgccttctgccatgag

SEQ ID NO: 148154 - DNA, 16 bp, H. sapiens
tgccttctgccatgga

SEQ ID NO: 148155 - DNA, 16 bp, H. sapiens
tgccttctggcctcca

SEQ ID NO: 148156 - DNA, 16 bp, H. sapiens
tgccttcttcactaag

SEQ ID NO: 148157 - DNA, 16 bp, H. sapiens
tgccttcttctagaat

SEQ ID NO: 148158 - DNA, 16 bp, H. sapiens
tgccttgaaaatggac

SEQ ID NO: 148159 - DNA, 17 bp, H. sapiens
tgccttgacctcccaaa

SEQ ID NO: 148160 - DNA, 16 bp, H. sapiens
tgccttgatcttgaac

SEQ ID NO: 148161 - DNA, 16 bp, H. sapiens
tgccttgctctgtcac

SEQ ID NO: 148162 - DNA, 16 bp, H. sapiens
tgccttgctggatttc

SEQ ID NO: 148163 - DNA, 16 bp, H. sapiens
tgccttgcttatttca

SEQ ID NO: 148164 - DNA, 16 bp, H. sapiens
tgccttggccacccaa

SEQ ID NO: 148165 - DNA, 16 bp, H. sapiens
tgccttggcccctttt

SEQ ID NO: 148166 - DNA, 20 bp, H. sapiens
tgccttggcctcccaaagta

SEQ ID NO: 148167 - DNA, 18 bp, H. sapiens
tgccttggcctcccaaat

SEQ ID NO: 148168 - DNA, 16 bp, H. sapiens
tgccttggcctcccga

SEQ ID NO: 148169 - DNA, 16 bp, H. sapiens
tgccttggccttccag

SEQ ID NO: 148170 - DNA, 16 bp, H. sapiens
tgccttggctgccagg

SEQ ID NO: 148171 - DNA, 16 bp, H. sapiens
tgccttggggcaggtg

SEQ ID NO: 148172 - DNA, 16 bp, H. sapiens
tgccttggtctctcct

SEQ ID NO: 148173 - DNA, 16 bp, H. sapiens
tgccttggtggtcttg

SEQ ID NO: 148174 - DNA, 16 bp, H. sapiens
tgccttgtaacttttt

SEQ ID NO: 148175 - DNA, 17 bp, H. sapiens
tgccttgttccagttct

SEQ ID NO: 148176 - DNA, 16 bp, H. sapiens
tgcctttaagattttt

SEQ ID NO: 148177 - DNA, 16 bp, H. sapiens
tgcctttactaaaaat

SEQ ID NO: 148178 - DNA, 16 bp, H. sapiens
tgcctttattttctct

SEQ ID NO: 148179 - DNA, 16 bp, H. sapiens
tgcctttcatcttcca

SEQ ID NO: 148180 - DNA, 16 bp, H. sapiens
tgcctttcattttgtt

SEQ ID NO: 148181 - DNA, 16 bp, H. sapiens
tgcctttccatttgtt

SEQ ID NO: 148182 - DNA, 18 bp, H. sapiens
tgcctttcccagcccact

SEQ ID NO: 148183 - DNA, 16 bp, H. sapiens
tgcctttcccagcttc

SEQ ID NO: 148184 - DNA, 16 bp, H. sapiens
tgcctttccctggtgc

SEQ ID NO: 148185 - DNA, 16 bp, H. sapiens
tgcctttgaggcattt

SEQ ID NO: 148186 - DNA, 16 bp, H. sapiens
tgcctttgatgttgta

SEQ ID NO: 148187 - DNA, 16 bp, H. sapiens
tgcctttgcaaagatt

SEQ ID NO: 148188 - DNA, 16 bp, H. sapiens
tgcctttgcactccag

SEQ ID NO: 148189 - DNA, 16 bp, H. sapiens
tgcctttgcatcctta

SEQ ID NO: 148190 - DNA, 16 bp, H. sapiens
tgcctttgcctgagtt

SEQ ID NO: 148191 - DNA, 16 bp, H. sapiens
tgcctttggactcaga

SEQ ID NO: 148192 - DNA, 16 bp, H. sapiens
tgcctttgtttcctca

SEQ ID NO: 148193 - DNA, 16 bp, H. sapiens
tgccttttaaaaattt

SEQ ID NO: 148194 - DNA, 16 bp, H. sapiens
tgccttttaaaatatt

SEQ ID NO: 148195 - DNA, 16 bp, H. sapiens
tgccttttaaaatttt

SEQ ID NO: 148196 - DNA, 16 bp, H. sapiens
tgccttttaaagtttt

SEQ ID NO: 148197 - DNA, 16 bp, H. sapiens
tgccttttacccagtt

SEQ ID NO: 148198 - DNA, 16 bp, H. sapiens
tgccttttaccttctg

SEQ ID NO: 148199 - DNA, 16 bp, H. sapiens
tgccttttcactgtgt

SEQ ID NO: 148200 - DNA, 16 bp, H. sapiens
tgccttttcattttaa

SEQ ID NO: 148201 - DNA, 16 bp, H. sapiens
tgccttttcattttgt

SEQ ID NO: 148202 - DNA, 16 bp, H. sapiens
tgccttttccaaaatg

SEQ ID NO: 148203 - DNA, 16 bp, H. sapiens
tgccttttgcctcctg

SEQ ID NO: 148204 - DNA, 16 bp, H. sapiens
tgcctttttaaaataa

SEQ ID NO: 148205 - DNA, 16 bp, H. sapiens
tgcctttttactttct

SEQ ID NO: 148206 - DNA, 16 bp, H. sapiens
tgcctttttattattg

SEQ ID NO: 148207 - DNA, 16 bp, H. sapiens
tgcctttttcttttaa

SEQ ID NO: 148208 - DNA, 16 bp, H. sapiens
tgcgagaccagcctgg

SEQ ID NO: 148209 - DNA, 16 bp, H. sapiens
tgcgagactccatctc

SEQ ID NO: 148210 - DNA, 16 bp, H. sapiens
tgcgaggccgaggcag

SEQ ID NO: 148211 - DNA, 16 bp, H. sapiens
tgcgatcctggctcac

SEQ ID NO: 148212 - DNA, 17 bp, H. sapiens
tgcgatctcagctcacc

SEQ ID NO: 148213 - DNA, 20 bp, H. sapiens
tgcgatctcgactcactgca

SEQ ID NO: 148214 - DNA, 16 bp, H. sapiens
tgcgattacaggtgca

SEQ ID NO: 148215 - DNA, 16 bp, H. sapiens
tgcgcacacacacaca

SEQ ID NO: 148216 - DNA, 16 bp, H. sapiens
tgcgcaccactgtgcc

SEQ ID NO: 148217 - DNA, 16 bp, H. sapiens
tgcgcaggctggagtg

SEQ ID NO: 148218 - DNA, 16 bp, H. sapiens
tgcgcagttcacaata

SEQ ID NO: 148219 - DNA, 16 bp, H. sapiens
tgcgcatggtggctca

SEQ ID NO: 148220 - DNA, 16 bp, H. sapiens
tgcgccaccacccctg

SEQ ID NO: 148221 - DNA, 18 bp, H. sapiens
tgcgccaccacgcccagg

SEQ ID NO: 148222 - DNA, 17 bp, H. sapiens
tgcgccaccatgcctgg

SEQ ID NO: 148223 - DNA, 16 bp, H. sapiens
tgcgccactatgcctg

SEQ ID NO: 148224 - DNA, 16 bp, H. sapiens
tgcgccactgccctct

SEQ ID NO: 148225 - DNA, 16 bp, H. sapiens
tgcgccattgcactct

SEQ ID NO: 148226 - DNA, 16 bp, H. sapiens
tgcgcccacagctgcc

SEQ ID NO: 148227 - DNA, 16 bp, H. sapiens
tgcgcccagcccagag

SEQ ID NO: 148228 - DNA, 16 bp, H. sapiens
tgcgcccaggctggag

SEQ ID NO: 148229 - DNA, 16 bp, H. sapiens
tgcgccccctgctggc

SEQ ID NO: 148230 - DNA, 18 bp, H. sapiens
tgcgcccgcactcctcag

SEQ ID NO: 148231 - DNA, 16 bp, H. sapiens
tgcgcctggccaagag

SEQ ID NO: 148232 - DNA, 16 bp, H. sapiens
tgcgcctggctaattt

SEQ ID NO: 148233 - DNA, 16 bp, H. sapiens
tgcgcgcacacacaca

SEQ ID NO: 148234 - DNA, 16 bp, H. sapiens
tgcgcgcagtggctca

SEQ ID NO: 148235 - DNA, 16 bp, H. sapiens
tgcgcgcgtgtgtgtg

SEQ ID NO: 148236 - DNA, 16 bp, H. sapiens
tgcgctccagcctgag

SEQ ID NO: 148237 - DNA, 16 bp, H. sapiens
tgcgctccagcctggg

SEQ ID NO: 148238 - DNA, 16 bp, H. sapiens
tgcgctccagcgtggg

SEQ ID NO: 148239 - DNA, 16 bp, H. sapiens
tgcgctccaggctggg

SEQ ID NO: 148240 - DNA, 16 bp, H. sapiens
tgcgctctagcctggg

SEQ ID NO: 148241 - DNA, 16 bp, H. sapiens
tgcgctgagccgagat

SEQ ID NO: 148242 - DNA, 16 bp, H. sapiens
tgcgcttcagcctggg

SEQ ID NO: 148243 - DNA, 16 bp, H. sapiens
tgcggcaggagaatgg

SEQ ID NO: 148244 - DNA, 16 bp, H. sapiens
tgcggcagtacagcct

SEQ ID NO: 148245 - DNA, 16 bp, H. sapiens
tgcggcccaggatggc

SEQ ID NO: 148246 - DNA, 16 bp, H. sapiens
tgcggtcaggagttcg

SEQ ID NO: 148247 - DNA, 17 bp, H. sapiens
tgcggtcccagctactc

SEQ ID NO: 148248 - DNA, 16 bp, H. sapiens
tgcggtcctggctctt

SEQ ID NO: 148249 - DNA, 19 bp, H. sapiens
tgcggtgagccgagattgc

SEQ ID NO: 148250 - DNA, 16 bp, H. sapiens
tgcggtgagctgagat

SEQ ID NO: 148251 - DNA, 17 bp, H. sapiens
tgcggtggctcacgcct

SEQ ID NO: 148252 - DNA, 16 bp, H. sapiens
tgcggtggtgcaatca

SEQ ID NO: 148253 - DNA, 17 bp, H. sapiens
tgcggtggtgtgatctt

SEQ ID NO: 148254 - DNA, 16 bp, H. sapiens
tgcgtgagtgtgtgtg

SEQ ID NO: 148255 - DNA, 16 bp, H. sapiens
tgcgtgcagcagctgc

SEQ ID NO: 148256 - DNA, 16 bp, H. sapiens
tgcgtgccaccacacc

SEQ ID NO: 148257 - DNA, 16 bp, H. sapiens
tgcgtgccatcacacc

SEQ ID NO: 148258 - DNA, 16 bp, H. sapiens
tgcgtgcctgtgtgtg

SEQ ID NO: 148259 - DNA, 16 bp, H. sapiens
tgcgtgtatgtgtata

SEQ ID NO: 148260 - DNA, 16 bp, H. sapiens
tgcgtgtgagtgtgtg

SEQ ID NO: 148261 - DNA, 16 bp, H. sapiens
tgcgtgtgcgtgtgcg

SEQ ID NO: 148262 - DNA, 16 bp, H. sapiens
tgcgtgtgcgtgtgtg

SEQ ID NO: 148263 - DNA, 16 bp, H. sapiens
tgcgtgtgtgcatgtg

SEQ ID NO: 148264 - DNA, 16 bp, H. sapiens
tgcgtgtgtgcctgtg

SEQ ID NO: 148265 - DNA, 16 bp, H. sapiens
tgcgtgtgtgtctgtg

SEQ ID NO: 148266 - DNA, 16 bp, H. sapiens
tgcgtgtgtgtgagtg

SEQ ID NO: 148267 - DNA, 16 bp, H. sapiens
tgcgtgtgtgtgtgtc

SEQ ID NO: 148268 - DNA, 16 bp, H. sapiens
tgcgtttccctaatga

SEQ ID NO: 148269 - DNA, 16 bp, H. sapiens
tgctaaaaatactaaa

SEQ ID NO: 148270 - DNA, 16 bp, H. sapiens
tgctaaaaatataaaa

SEQ ID NO: 148271 - DNA, 16 bp, H. sapiens
tgctaaaaatgagctt

SEQ ID NO: 148272 - DNA, 16 bp, H. sapiens
tgctaaaacctctcaa

SEQ ID NO: 148273 - DNA, 16 bp, H. sapiens
tgctaaaagaaaacat

SEQ ID NO: 148274 - DNA, 16 bp, H. sapiens
tgctaaaaggggccaa

SEQ ID NO: 148275 - DNA, 16 bp, H. sapiens
tgctaaacattttaca

SEQ ID NO: 148276 - DNA, 16 bp, H. sapiens
tgctaaaccattcacg

SEQ ID NO: 148277 - DNA, 16 bp, H. sapiens
tgctaaagaaaaataa

SEQ ID NO: 148278 - DNA, 16 bp, H. sapiens
tgctaaaggcaggcca

SEQ ID NO: 148279 - DNA, 16 bp, H. sapiens
tgctaaatattttatt

SEQ ID NO: 148280 - DNA, 16 bp, H. sapiens
tgctaaatcaaaagaa

SEQ ID NO: 148281 - DNA, 17 bp, H. sapiens
tgctaacatggtgaaac

SEQ ID NO: 148282 - DNA, 16 bp, H. sapiens
tgctaactggttattt

SEQ ID NO: 148283 - DNA, 17 bp, H. sapiens
tgctaacttttgtattt

SEQ ID NO: 148284 - DNA, 16 bp, H. sapiens
tgctaagaaaatgaaa

SEQ ID NO: 148285 - DNA, 16 bp, H. sapiens
tgctaagaggaaagtt

SEQ ID NO: 148286 - DNA, 16 bp, H. sapiens
tgctaagcaaaataaa

SEQ ID NO: 148287 - DNA, 16 bp, H. sapiens
tgctaaggagtttgga

SEQ ID NO: 148288 - DNA, 16 bp, H. sapiens
tgctaagtgaaataaa

SEQ ID NO: 148289 - DNA, 16 bp, H. sapiens
tgctaagtggaaaaaa

SEQ ID NO: 148290 - DNA, 16 bp, H. sapiens
tgctaagttttggagt

SEQ ID NO: 148291 - DNA, 16 bp, H. sapiens
tgctaataaagacata

SEQ ID NO: 148292 - DNA, 16 bp, H. sapiens
tgctaataataataat

SEQ ID NO: 148293 - DNA, 16 bp, H. sapiens
tgctaatattttattg

SEQ ID NO: 148294 - DNA, 16 bp, H. sapiens
tgctaatattttattt

SEQ ID NO: 148295 - DNA, 16 bp, H. sapiens
tgctaatattttgtaa

SEQ ID NO: 148296 - DNA, 16 bp, H. sapiens
tgctaatattttgtta

SEQ ID NO: 148297 - DNA, 16 bp, H. sapiens
tgctaatgaagtttca

SEQ ID NO: 148298 - DNA, 16 bp, H. sapiens
tgctaatgagcagtga

SEQ ID NO: 148299 - DNA, 16 bp, H. sapiens
tgctaatttttttgtg

SEQ ID NO: 148300 - DNA, 16 bp, H. sapiens
tgctacaaaaagagtg

SEQ ID NO: 148301 - DNA, 21 bp, H. sapiens
tgctacaaactaatgattaat

SEQ ID NO: 148302 - DNA, 16 bp, H. sapiens
tgctacaaagagaatt

SEQ ID NO: 148303 - DNA, 16 bp, H. sapiens
tgctacaaatcagggc

SEQ ID NO: 148304 - DNA, 16 bp, H. sapiens
tgctacaacagcagag

SEQ ID NO: 148305 - DNA, 17 bp, H. sapiens
tgctacaagtgccagaa

SEQ ID NO: 148306 - DNA, 16 bp, H. sapiens
tgctacactcccacca

SEQ ID NO: 148307 - DNA, 16 bp, H. sapiens
tgctacagagaaatat

SEQ ID NO: 148308 - DNA, 16 bp, H. sapiens
tgctacagagggcccc

SEQ ID NO: 148309 - DNA, 16 bp, H. sapiens
tgctacattggccagg

SEQ ID NO: 148310 - DNA, 17 bp, H. sapiens
tgctaccaaaacagaga

SEQ ID NO: 148311 - DNA, 16 bp, H. sapiens
tgctaccacgcctggc

SEQ ID NO: 148312 - DNA, 16 bp, H. sapiens
tgctaccactcctggc

SEQ ID NO: 148313 - DNA, 16 bp, H. sapiens
tgctaccagctcctct

SEQ ID NO: 148314 - DNA, 16 bp, H. sapiens
tgctaccgtgcctggc

SEQ ID NO: 148315 - DNA, 16 bp, H. sapiens
tgctactcgagaggct

SEQ ID NO: 148316 - DNA, 16 bp, H. sapiens
tgctactgccctccag

SEQ ID NO: 148317 - DNA, 16 bp, H. sapiens
tgctactgctgcctgg

SEQ ID NO: 148318 - DNA, 16 bp, H. sapiens
tgctactggcatccag

SEQ ID NO: 148319 - DNA, 16 bp, H. sapiens
tgctactggcatctag

SEQ ID NO: 148320 - DNA, 16 bp, H. sapiens
tgctagaaacatttga

SEQ ID NO: 148321 - DNA, 16 bp, H. sapiens
tgctagaacagctcac

SEQ ID NO: 148322 - DNA, 16 bp, H. sapiens
tgctagacactgtgct

SEQ ID NO: 148323 - DNA, 17 bp, H. sapiens
tgctagagaggatgtgg

SEQ ID NO: 148324 - DNA, 16 bp, H. sapiens
tgctagcaagactaat

SEQ ID NO: 148325 - DNA, 16 bp, H. sapiens
tgctagcaagatggaa

SEQ ID NO: 148326 - DNA, 34 bp, H. sapiens
tgctagcacagcagtctgagatcaaactgcaagg

SEQ ID NO: 148327 - DNA, 16 bp, H. sapiens
tgctagcagctgaagg

SEQ ID NO: 148328 - DNA, 16 bp, H. sapiens
tgctagcctcagcctc

SEQ ID NO: 148329 - DNA, 16 bp, H. sapiens
tgctagcttccaactt

SEQ ID NO: 148330 - DNA, 16 bp, H. sapiens
tgctagcttccagctt

SEQ ID NO: 148331 - DNA, 16 bp, H. sapiens
tgctaggagataaatt

SEQ ID NO: 148332 - DNA, 16 bp, H. sapiens
tgctaggattacagac

SEQ ID NO: 148333 - DNA, 16 bp, H. sapiens
tgctaggcactgtgct

SEQ ID NO: 148334 - DNA, 16 bp, H. sapiens
tgctaggtgctgggga

SEQ ID NO: 148335 - DNA, 16 bp, H. sapiens
tgctagtatacagaaa

SEQ ID NO: 148336 - DNA, 16 bp, H. sapiens
tgctagtattttggtg

SEQ ID NO: 148337 - DNA, 16 bp, H. sapiens
tgctagttttgctgtc

SEQ ID NO: 148338 - DNA, 16 bp, H. sapiens
tgctataaaatttcct

SEQ ID NO: 148339 - DNA, 16 bp, H. sapiens
tgctataaacttcctt

SEQ ID NO: 148340 - DNA, 16 bp, H. sapiens
tgctataaagaaatat

SEQ ID NO: 148341 - DNA, 16 bp, H. sapiens
tgctataaagaacatt

SEQ ID NO: 148342 - DNA, 16 bp, H. sapiens
tgctataaagatacta

SEQ ID NO: 148343 - DNA, 16 bp, H. sapiens
tgctataacagaatac

SEQ ID NO: 148344 - DNA, 16 bp, H. sapiens
tgctataataaaaata

SEQ ID NO: 148345 - DNA, 16 bp, H. sapiens
tgctataataaataaa

SEQ ID NO: 148346 - DNA, 16 bp, H. sapiens
tgctataattttttta

SEQ ID NO: 148347 - DNA, 16 bp, H. sapiens
tgctatataaatggaa

SEQ ID NO: 148348 - DNA, 16 bp, H. sapiens
tgctatatatatattt

SEQ ID NO: 148349 - DNA, 16 bp, H. sapiens
tgctatattttaattt

SEQ ID NO: 148350 - DNA, 16 bp, H. sapiens
tgctatcaaatattag

SEQ ID NO: 148351 - DNA, 23 bp, H. sapiens
tgctatccccaaactgccactct

SEQ ID NO: 148352 - DNA, 16 bp, H. sapiens
tgctatccctctccca

SEQ ID NO: 148353 - DNA, 16 bp, H. sapiens
tgctatctcagttcac

SEQ ID NO: 148354 - DNA, 16 bp, H. sapiens
tgctatgaaaagaaaa

SEQ ID NO: 148355 - DNA, 16 bp, H. sapiens
tgctatgcaagctgct

SEQ ID NO: 148356 - DNA, 16 bp, H. sapiens
tgctatggctcacgcc

SEQ ID NO: 148357 - DNA, 16 bp, H. sapiens
tgctatggtttgaatg

SEQ ID NO: 148358 - DNA, 16 bp, H. sapiens
tgctatgtgcccaggc

SEQ ID NO: 148359 - DNA, 16 bp, H. sapiens
tgctatgttgccctgg

SEQ ID NO: 148360 - DNA, 16 bp, H. sapiens
tgctattaaaaaatac

SEQ ID NO: 148361 - DNA, 16 bp, H. sapiens
tgctattacaaaatac

SEQ ID NO: 148362 - DNA, 16 bp, H. sapiens
tgctattattgctatt

SEQ ID NO: 148363 - DNA, 16 bp, H. sapiens
tgctattattttcatt

SEQ ID NO: 148364 - DNA, 16 bp, H. sapiens
tgctattctcatgata

SEQ ID NO: 148365 - DNA, 16 bp, H. sapiens
tgctattgcctgtctt

SEQ ID NO: 148366 - DNA, 16 bp, H. sapiens
tgctattgcttttggt

SEQ ID NO: 148367 - DNA, 16 bp, H. sapiens
tgctatttcaaacaat

SEQ ID NO: 148368 - DNA, 16 bp, H. sapiens
tgctatttctttgtgg

SEQ ID NO: 148369 - DNA, 16 bp, H. sapiens
tgctattttatattat

SEQ ID NO: 148370 - DNA, 16 bp, H. sapiens
tgctatttttatttaa

SEQ ID NO: 148371 - DNA, 16 bp, H. sapiens
tgctatttttccaaca

SEQ ID NO: 148372 - DNA, 16 bp, H. sapiens
tgctcaaattgtccca

SEQ ID NO: 148373 - DNA, 16 bp, H. sapiens
tgctcaagcctgggag

SEQ ID NO: 148374 - DNA, 16 bp, H. sapiens
tgctcaaggtcacgca

SEQ ID NO: 148375 - DNA, 16 bp, H. sapiens
tgctcaagtgcatcca

SEQ ID NO: 148376 - DNA, 16 bp, H. sapiens
tgctcaataaatatct

SEQ ID NO: 148377 - DNA, 16 bp, H. sapiens
tgctcaataaatgtaa

SEQ ID NO: 148378 - DNA, 16 bp, H. sapiens
tgctcaataaattttg

SEQ ID NO: 148379 - DNA, 16 bp, H. sapiens
tgctcaataagtattt

SEQ ID NO: 148380 - DNA, 18 bp, H. sapiens
tgctcacacaaagcctgt

SEQ ID NO: 148381 - DNA, 16 bp, H. sapiens
tgctcacagcaacctc

SEQ ID NO: 148382 - DNA, 16 bp, H. sapiens
tgctcacagtgggcca

SEQ ID NO: 148383 - DNA, 16 bp, H. sapiens
tgctcacatcccattg

SEQ ID NO: 148384 - DNA, 16 bp, H. sapiens
tgctcacattactgcc

SEQ ID NO: 148385 - DNA, 16 bp, H. sapiens
tgctcaccagctgcct

SEQ ID NO: 148386 - DNA, 16 bp, H. sapiens
tgctcaccatcactaa

SEQ ID NO: 148387 - DNA, 16 bp, H. sapiens
tgctcacccactgctc

SEQ ID NO: 148388 - DNA, 16 bp, H. sapiens
tgctcaccgcaacctc

SEQ ID NO: 148389 - DNA, 16 bp, H. sapiens
tgctcactgcaacctc

SEQ ID NO: 148390 - DNA, 16 bp, H. sapiens
tgctcactgctagtgc

SEQ ID NO: 148391 - DNA, 16 bp, H. sapiens
tgctcactgctcactg

SEQ ID NO: 148392 - DNA, 16 bp, H. sapiens
tgctcacttcctgggt

SEQ ID NO: 148393 - DNA, 16 bp, H. sapiens
tgctcactttgtgttt

SEQ ID NO: 148394 - DNA, 16 bp, H. sapiens
tgctcagagaggagga

SEQ ID NO: 148395 - DNA, 16 bp, H. sapiens
tgctcagagaggccaa

SEQ ID NO: 148396 - DNA, 16 bp, H. sapiens
tgctcagcaaaagaaa

SEQ ID NO: 148397 - DNA, 16 bp, H. sapiens
tgctcagcaccttcct

SEQ ID NO: 148398 - DNA, 16 bp, H. sapiens
tgctcaggaaatattt

SEQ ID NO: 148399 - DNA, 16 bp, H. sapiens
tgctcaggctgctctt

SEQ ID NO: 148400 - DNA, 16 bp, H. sapiens
tgctcaggctgggagc

SEQ ID NO: 148401 - DNA, 16 bp, H. sapiens
tgctcaggctgggctc

SEQ ID NO: 148402 - DNA, 16 bp, H. sapiens
tgctcagggtcacaga

SEQ ID NO: 148403 - DNA, 16 bp, H. sapiens
tgctcagtaaataatt

SEQ ID NO: 148404 - DNA, 16 bp, H. sapiens
tgctcagtaaatattt

SEQ ID NO: 148405 - DNA, 16 bp, H. sapiens
tgctcagtcagttcct

SEQ ID NO: 148406 - DNA, 16 bp, H. sapiens
tgctcatatatatata

SEQ ID NO: 148407 - DNA, 16 bp, H. sapiens
tgctcatcaccactgg

SEQ ID NO: 148408 - DNA, 16 bp, H. sapiens
tgctcatccattcatc

SEQ ID NO: 148409 - DNA, 16 bp, H. sapiens
tgctcatctgattttt

SEQ ID NO: 148410 - DNA, 16 bp, H. sapiens
tgctcatgctgccatt

SEQ ID NO: 148411 - DNA, 16 bp, H. sapiens
tgctcatgctgctggt

SEQ ID NO: 148412 - DNA, 16 bp, H. sapiens
tgctcattacccagtt

SEQ ID NO: 148413 - DNA, 16 bp, H. sapiens
tgctcattcattcatt

SEQ ID NO: 148414 - DNA, 16 bp, H. sapiens
tgctcattgctactgg

SEQ ID NO: 148415 - DNA, 16 bp, H. sapiens
tgctcattttgcagat

SEQ ID NO: 148416 - DNA, 16 bp, H. sapiens
tgctcattttttaatg

SEQ ID NO: 148417 - DNA, 16 bp, H. sapiens
tgctccaaggcgccca

SEQ ID NO: 148418 - DNA, 16 bp, H. sapiens
tgctccaatgtcacct

SEQ ID NO: 148419 - DNA, 16 bp, H. sapiens
tgctccacagcctgct

SEQ ID NO: 148420 - DNA, 16 bp, H. sapiens
tgctccacggcaccca

SEQ ID NO: 148421 - DNA, 16 bp, H. sapiens
tgctccactgaccagc

SEQ ID NO: 148422 - DNA, 16 bp, H. sapiens
tgctccagagctcccc

SEQ ID NO: 148423 - DNA, 16 bp, H. sapiens
tgctccagccacagtg

SEQ ID NO: 148424 - DNA, 16 bp, H. sapiens
tgctccagccacatgg

SEQ ID NO: 148425 - DNA, 16 bp, H. sapiens
tgctccagcctgggtg

SEQ ID NO: 148426 - DNA, 16 bp, H. sapiens
tgctccagctccagct

SEQ ID NO: 148427 - DNA, 16 bp, H. sapiens
tgctccagctgtggct

SEQ ID NO: 148428 - DNA, 16 bp, H. sapiens
tgctccaggctgggca

SEQ ID NO: 148429 - DNA, 16 bp, H. sapiens
tgctccatcctgactc

SEQ ID NO: 148430 - DNA, 16 bp, H. sapiens
tgctccatggcccagg

SEQ ID NO: 148431 - DNA, 16 bp, H. sapiens
tgctcccaaatctgaa

SEQ ID NO: 148432 - DNA, 16 bp, H. sapiens
tgctcccaccccagcc

SEQ ID NO: 148433 - DNA, 16 bp, H. sapiens
tgctcccactctcacc

SEQ ID NO: 148434 - DNA, 16 bp, H. sapiens
tgctcccatctcagcc

SEQ ID NO: 148435 - DNA, 16 bp, H. sapiens
tgctcccatgagaatc

SEQ ID NO: 148436 - DNA, 16 bp, H. sapiens
tgctccccaccctgtg

SEQ ID NO: 148437 - DNA, 16 bp, H. sapiens
tgctccccacctccca

SEQ ID NO: 148438 - DNA, 16 bp, H. sapiens
tgctcccctctttgtg

SEQ ID NO: 148439 - DNA, 22 bp, H. sapiens
tgctccctcaagcacctgatct

SEQ ID NO: 148440 - DNA, 16 bp, H. sapiens
tgctccctctgctgcc

SEQ ID NO: 148441 - DNA, 16 bp, H. sapiens
tgctccctgcccttga

SEQ ID NO: 148442 - DNA, 16 bp, H. sapiens
tgctcctaaactcctc

SEQ ID NO: 148443 - DNA, 16 bp, H. sapiens
tgctcctaggctacag

SEQ ID NO: 148444 - DNA, 17 bp, H. sapiens
tgctcctataattgagg

SEQ ID NO: 148445 - DNA, 16 bp, H. sapiens
tgctcctcccacctca

SEQ ID NO: 148446 - DNA, 16 bp, H. sapiens
tgctcctcctctgcct

SEQ ID NO: 148447 - DNA, 16 bp, H. sapiens
tgctcctcctgccttg

SEQ ID NO: 148448 - DNA, 16 bp, H. sapiens
tgctcctccttcatct

SEQ ID NO: 148449 - DNA, 16 bp, H. sapiens
tgctcctccttgtctt

SEQ ID NO: 148450 - DNA, 16 bp, H. sapiens
tgctcctcggcttgca

SEQ ID NO: 148451 - DNA, 16 bp, H. sapiens
tgctcctctggccacc

SEQ ID NO: 148452 - DNA, 16 bp, H. sapiens
tgctcctctttgcctt

SEQ ID NO: 148453 - DNA, 16 bp, H. sapiens
tgctcctgatccagtg

SEQ ID NO: 148454 - DNA, 16 bp, H. sapiens
tgctcctgctcctgcc

SEQ ID NO: 148455 - DNA, 16 bp, H. sapiens
tgctcctgctcctgct

SEQ ID NO: 148456 - DNA, 16 bp, H. sapiens
tgctcctgctctggcc

SEQ ID NO: 148457 - DNA, 16 bp, H. sapiens
tgctcctgctcttgct

SEQ ID NO: 148458 - DNA, 16 bp, H. sapiens
tgctcctgctttggcc

SEQ ID NO: 148459 - DNA, 16 bp, H. sapiens
tgctcctggcatctgg

SEQ ID NO: 148460 - DNA, 16 bp, H. sapiens
tgctcctgtcacccag

SEQ ID NO: 148461 - DNA, 16 bp, H. sapiens
tgctccttaattttct

SEQ ID NO: 148462 - DNA, 16 bp, H. sapiens
tgctccttcagcattt

SEQ ID NO: 148463 - DNA, 16 bp, H. sapiens
tgctccttctgcctca

SEQ ID NO: 148464 - DNA, 16 bp, H. sapiens
tgctccttctgcctgg

SEQ ID NO: 148465 - DNA, 16 bp, H. sapiens
tgctccttgtggagca

SEQ ID NO: 148466 - DNA, 16 bp, H. sapiens
tgctcgggctggtctc

SEQ ID NO: 148467 - DNA, 16 bp, H. sapiens
tgctctaaaaagtaaa

SEQ ID NO: 148468 - DNA, 16 bp, H. sapiens
tgctctaggcattcct

SEQ ID NO: 148469 - DNA, 16 bp, H. sapiens
tgctctatcccccagg

SEQ ID NO: 148470 - DNA, 16 bp, H. sapiens
tgctctcaaaccctgt

SEQ ID NO: 148471 - DNA, 16 bp, H. sapiens
tgctctcaccattgct

SEQ ID NO: 148472 - DNA, 16 bp, H. sapiens
tgctctcacttgtaag

SEQ ID NO: 148473 - DNA, 16 bp, H. sapiens
tgctctccagcctgga

SEQ ID NO: 148474 - DNA, 16 bp, H. sapiens
tgctctccagcctggg

SEQ ID NO: 148475 - DNA, 16 bp, H. sapiens
tgctctcccctcccca

SEQ ID NO: 148476 - DNA, 16 bp, H. sapiens
tgctctccctcccatt

SEQ ID NO: 148477 - DNA, 16 bp, H. sapiens
tgctctccctgctgat

SEQ ID NO: 148478 - DNA, 16 bp, H. sapiens
tgctctcctctcccca

SEQ ID NO: 148479 - DNA, 16 bp, H. sapiens
tgctctcctgcctggg

SEQ ID NO: 148480 - DNA, 16 bp, H. sapiens
tgctctcgagctcctg

SEQ ID NO: 148481 - DNA, 16 bp, H. sapiens
tgctctctctcctgcc

SEQ ID NO: 148482 - DNA, 16 bp, H. sapiens
tgctctctctgcctgg

SEQ ID NO: 148483 - DNA, 16 bp, H. sapiens
tgctctctctgtctct

SEQ ID NO: 148484 - DNA, 50 bp, H. sapiens
tgctctctgaaacatgtgctgtgtccactcagggttaaatggattaaggg

SEQ ID NO: 148485 - DNA, 16 bp, H. sapiens
tgctctctgctcactg

SEQ ID NO: 148486 - DNA, 16 bp, H. sapiens
tgctctctgcttccaa

SEQ ID NO: 148487 - DNA, 16 bp, H. sapiens
tgctctgaaatctgct

SEQ ID NO: 148488 - DNA, 16 bp, H. sapiens
tgctctgaaatgtccc

SEQ ID NO: 148489 - DNA, 16 bp, H. sapiens
tgctctgaatcagcat

SEQ ID NO: 148490 - DNA, 16 bp, H. sapiens
tgctctgcacctggct

SEQ ID NO: 148491 - DNA, 16 bp, H. sapiens
tgctctgcacttctcc

SEQ ID NO: 148492 - DNA, 16 bp, H. sapiens
tgctctgcagcctggg

SEQ ID NO: 148493 - DNA, 16 bp, H. sapiens
tgctctgccacttggg

SEQ ID NO: 148494 - DNA, 16 bp, H. sapiens
tgctctgcccacctca

SEQ ID NO: 148495 - DNA, 16 bp, H. sapiens
tgctctgccgacgcct

SEQ ID NO: 148496 - DNA, 16 bp, H. sapiens
tgctctgcctgtggag

SEQ ID NO: 148497 - DNA, 16 bp, H. sapiens
tgctctgctgttgctg

SEQ ID NO: 148498 - DNA, 16 bp, H. sapiens
tgctctgcttcctctt

SEQ ID NO: 148499 - DNA, 16 bp, H. sapiens
tgctctggaatcctat

SEQ ID NO: 148500 - DNA, 16 bp, H. sapiens
tgctctggtggaggtg

SEQ ID NO: 148501 - DNA, 16 bp, H. sapiens
tgctctggtttctctc

SEQ ID NO: 148502 - DNA, 16 bp, H. sapiens
tgctctgtcaggctgg

SEQ ID NO: 148503 - DNA, 16 bp, H. sapiens
tgctctgtcccccaag

SEQ ID NO: 148504 - DNA, 16 bp, H. sapiens
tgctctgtcctccagg

SEQ ID NO: 148505 - DNA, 16 bp, H. sapiens
tgctctgtctctcctg

SEQ ID NO: 148506 - DNA, 16 bp, H. sapiens
tgctctgtgaccctgg

SEQ ID NO: 148507 - DNA, 16 bp, H. sapiens
tgctctgtgatgtgtg

SEQ ID NO: 148508 - DNA, 16 bp, H. sapiens
tgctctgtgcagccta

SEQ ID NO: 148509 - DNA, 16 bp, H. sapiens
tgctctgtggcctagg

SEQ ID NO: 148510 - DNA, 16 bp, H. sapiens
tgctctgtgtctggct

SEQ ID NO: 148511 - DNA, 16 bp, H. sapiens
tgctctgttactcagg

SEQ ID NO: 148512 - DNA, 16 bp, H. sapiens
tgctctgttgcccacg

SEQ ID NO: 148513 - DNA, 16 bp, H. sapiens
tgctctgtttccctta

SEQ ID NO: 148514 - DNA, 16 bp, H. sapiens
tgctcttaaaaaaaaa

SEQ ID NO: 148515 - DNA, 16 bp, H. sapiens
tgctcttaaaagcatt

SEQ ID NO: 148516 - DNA, 16 bp, H. sapiens
tgctcttcccacctca

SEQ ID NO: 148517 - DNA, 16 bp, H. sapiens
tgctcttccctctgct

SEQ ID NO: 148518 - DNA, 16 bp, H. sapiens
tgctcttggtgtttta

SEQ ID NO: 148519 - DNA, 16 bp, H. sapiens
tgctcttgtggagctt

SEQ ID NO: 148520 - DNA, 16 bp, H. sapiens
tgctcttgttttccag

SEQ ID NO: 148521 - DNA, 16 bp, H. sapiens
tgctctttataaaacc

SEQ ID NO: 148522 - DNA, 16 bp, H. sapiens
tgctctttcattctct

SEQ ID NO: 148523 - DNA, 16 bp, H. sapiens
tgctcttttcaaaaaa

SEQ ID NO: 148524 - DNA, 16 bp, H. sapiens
tgctctttttgaaatt

SEQ ID NO: 148525 - DNA, 16 bp, H. sapiens
tgctctttttttaaaa

SEQ ID NO: 148526 - DNA, 16 bp, H. sapiens
tgctgaaaaaatattt

SEQ ID NO: 148527 - DNA, 27 bp, H. sapiens
tgctgaaaaaggaggactctgtatatt

SEQ ID NO: 148528 - DNA, 16 bp, H. sapiens
tgctgaaaaatctgct

SEQ ID NO: 148529 - DNA, 16 bp, H. sapiens
tgctgaaaaatgctaa

SEQ ID NO: 148530 - DNA, 16 bp, H. sapiens
tgctgaaaactctcaa

SEQ ID NO: 148531 - DNA, 16 bp, H. sapiens
tgctgaaaatattttt

SEQ ID NO: 148532 - DNA, 16 bp, H. sapiens
tgctgaaagaaaaaaa

SEQ ID NO: 148533 - DNA, 16 bp, H. sapiens
tgctgaaagaaaagaa

SEQ ID NO: 148534 - DNA, 16 bp, H. sapiens
tgctgaaaggaaaaaa

SEQ ID NO: 148535 - DNA, 16 bp, H. sapiens
tgctgaaatgagttga

SEQ ID NO: 148536 - DNA, 16 bp, H. sapiens
tgctgaacccccttgg

SEQ ID NO: 148537 - DNA, 16 bp, H. sapiens
tgctgaagaaaaaaaa

SEQ ID NO: 148538 - DNA, 16 bp, H. sapiens
tgctgaagaaaatgta

SEQ ID NO: 148539 - DNA, 16 bp, H. sapiens
tgctgaaggaaaagaa

SEQ ID NO: 148540 - DNA, 16 bp, H. sapiens
tgctgaaggaatttgt

SEQ ID NO: 148541 - DNA, 16 bp, H. sapiens
tgctgaaggagaaaaa

SEQ ID NO: 148542 - DNA, 16 bp, H. sapiens
tgctgaaggcaggcca

SEQ ID NO: 148543 - DNA, 16 bp, H. sapiens
tgctgaaggggaaaaa

SEQ ID NO: 148544 - DNA, 16 bp, H. sapiens
tgctgaagtttcttat

SEQ ID NO: 148545 - DNA, 16 bp, H. sapiens
tgctgaataacagtgg

SEQ ID NO: 148546 - DNA, 16 bp, H. sapiens
tgctgaataatattcc

SEQ ID NO: 148547 - DNA, 16 bp, H. sapiens
tgctgaatgggcaaaa

SEQ ID NO: 148548 - DNA, 16 bp, H. sapiens
tgctgaattcatttat

SEQ ID NO: 148549 - DNA, 16 bp, H. sapiens
tgctgacaaagacata

SEQ ID NO: 148550 - DNA, 16 bp, H. sapiens
tgctgacagaattcac

SEQ ID NO: 148551 - DNA, 16 bp, H. sapiens
tgctgacatcaaggca

SEQ ID NO: 148552 - DNA, 16 bp, H. sapiens
tgctgaccaggctgga

SEQ ID NO: 148553 - DNA, 16 bp, H. sapiens
tgctgacctcgtgatc

SEQ ID NO: 148554 - DNA, 16 bp, H. sapiens
tgctgacctctgacct

SEQ ID NO: 148555 - DNA, 16 bp, H. sapiens
tgctgacctcttatct

SEQ ID NO: 148556 - DNA, 17 bp, H. sapiens
tgctgaccttctcccca

SEQ ID NO: 148557 - DNA, 16 bp, H. sapiens
tgctgactcatgcctg

SEQ ID NO: 148558 - DNA, 16 bp, H. sapiens
tgctgactctcttttc

SEQ ID NO: 148559 - DNA, 16 bp, H. sapiens
tgctgactctgaagag

SEQ ID NO: 148560 - DNA, 20 bp, H. sapiens
tgctgagaaaaagaattcag

SEQ ID NO: 148561 - DNA, 16 bp, H. sapiens
tgctgagaaaaggaat

SEQ ID NO: 148562 - DNA, 16 bp, H. sapiens
tgctgagaaatccttt

SEQ ID NO: 148563 - DNA, 16 bp, H. sapiens
tgctgagaataatggc

SEQ ID NO: 148564 - DNA, 16 bp, H. sapiens
tgctgagatcgcgcca

SEQ ID NO: 148565 - DNA, 16 bp, H. sapiens
tgctgagatgacaggc

SEQ ID NO: 148566 - DNA, 16 bp, H. sapiens
tgctgagatgggaaag

SEQ ID NO: 148567 - DNA, 16 bp, H. sapiens
tgctgagattccaggc

SEQ ID NO: 148568 - DNA, 16 bp, H. sapiens
tgctgagattgatggt

SEQ ID NO: 148569 - DNA, 16 bp, H. sapiens
tgctgagattgcaggc

SEQ ID NO: 148570 - DNA, 16 bp, H. sapiens
tgctgagcaaaaagaa

SEQ ID NO: 148571 - DNA, 16 bp, H. sapiens
tgctgagcaagaccac

SEQ ID NO: 148572 - DNA, 16 bp, H. sapiens
tgctgagcagctggga

SEQ ID NO: 148573 - DNA, 16 bp, H. sapiens
tgctgagcattttttt

SEQ ID NO: 148574 - DNA, 16 bp, H. sapiens
tgctgagccacctgga

SEQ ID NO: 148575 - DNA, 16 bp, H. sapiens
tgctgagcccaggagt

SEQ ID NO: 148576 - DNA, 16 bp, H. sapiens
tgctgagcctgatggg

SEQ ID NO: 148577 - DNA, 16 bp, H. sapiens
tgctgagcgccggtcc

SEQ ID NO: 148578 - DNA, 16 bp, H. sapiens
tgctgagctctttgcc

SEQ ID NO: 148579 - DNA, 16 bp, H. sapiens
tgctgagctgcctgga

SEQ ID NO: 148580 - DNA, 16 bp, H. sapiens
tgctgagcttcttgga

SEQ ID NO: 148581 - DNA, 16 bp, H. sapiens
tgctgagcttgatggg

SEQ ID NO: 148582 - DNA, 16 bp, H. sapiens
tgctgaggaaattaaa

SEQ ID NO: 148583 - DNA, 16 bp, H. sapiens
tgctgaggagaaaaat

SEQ ID NO: 148584 - DNA, 16 bp, H. sapiens
tgctgaggaggaggag

SEQ ID NO: 148585 - DNA, 16 bp, H. sapiens
tgctgaggatgacggc

SEQ ID NO: 148586 - DNA, 16 bp, H. sapiens
tgctgaggatgatgac

SEQ ID NO: 148587 - DNA, 19 bp, H. sapiens
tgctgaggcaggagaatca

SEQ ID NO: 148588 - DNA, 16 bp, H. sapiens
tgctgaggcccagaga

SEQ ID NO: 148589 - DNA, 16 bp, H. sapiens
tgctgaggcctgggag

SEQ ID NO: 148590 - DNA, 16 bp, H. sapiens
tgctgaggctgcagtg

SEQ ID NO: 148591 - DNA, 16 bp, H. sapiens
tgctgaggctgctgtg

SEQ ID NO: 148592 - DNA, 16 bp, H. sapiens
tgctgaggcttgagtg

SEQ ID NO: 148593 - DNA, 16 bp, H. sapiens
tgctgaggtgggagga

SEQ ID NO: 148594 - DNA, 16 bp, H. sapiens
tgctgaggttgaaaaa

SEQ ID NO: 148595 - DNA, 16 bp, H. sapiens
tgctgaggttgagaaa

SEQ ID NO: 148596 - DNA, 16 bp, H. sapiens
tgctgaggttgtggag

SEQ ID NO: 148597 - DNA, 16 bp, H. sapiens
tgctgaggtttgggat

SEQ ID NO: 148598 - DNA, 16 bp, H. sapiens
tgctgaggtttggggt

SEQ ID NO: 148599 - DNA, 16 bp, H. sapiens
tgctgagtcaaagggt

SEQ ID NO: 148600 - DNA, 16 bp, H. sapiens
tgctgagtctcacctg

SEQ ID NO: 148601 - DNA, 16 bp, H. sapiens
tgctgagtgaaagaaa

SEQ ID NO: 148602 - DNA, 16 bp, H. sapiens
tgctgagtgaaggaag

SEQ ID NO: 148603 - DNA, 16 bp, H. sapiens
tgctgagtgcctggga

SEQ ID NO: 148604 - DNA, 16 bp, H. sapiens
tgctgataaaacagac

SEQ ID NO: 148605 - DNA, 16 bp, H. sapiens
tgctgataaagacata

SEQ ID NO: 148606 - DNA, 16 bp, H. sapiens
tgctgataaagacgta

SEQ ID NO: 148607 - DNA, 16 bp, H. sapiens
tgctgataatgatggt

SEQ ID NO: 148608 - DNA, 16 bp, H. sapiens
tgctgatacggagaaa

SEQ ID NO: 148609 - DNA, 16 bp, H. sapiens
tgctgatagaaatgta

SEQ ID NO: 148610 - DNA, 16 bp, H. sapiens
tgctgatagacactta

SEQ ID NO: 148611 - DNA, 16 bp, H. sapiens
tgctgatagacttgct

SEQ ID NO: 148612 - DNA, 16 bp, H. sapiens
tgctgatattttattt

SEQ ID NO: 148613 - DNA, 16 bp, H. sapiens
tgctgatccctgctct

SEQ ID NO: 148614 - DNA, 16 bp, H. sapiens
tgctgatcctttgttt

SEQ ID NO: 148615 - DNA, 16 bp, H. sapiens
tgctgatcttttaaaa

SEQ ID NO: 148616 - DNA, 16 bp, H. sapiens
tgctgatgaaaaaaat

SEQ ID NO: 148617 - DNA, 16 bp, H. sapiens
tgctgatgaacatttg

SEQ ID NO: 148618 - DNA, 16 bp, H. sapiens
tgctgatgaggctgca

SEQ ID NO: 148619 - DNA, 16 bp, H. sapiens
tgctgatgatggtggt

SEQ ID NO: 148620 - DNA, 16 bp, H. sapiens
tgctgatggaaatgta

SEQ ID NO: 148621 - DNA, 16 bp, H. sapiens
tgctgatggattcagt

SEQ ID NO: 148622 - DNA, 16 bp, H. sapiens
tgctgatgggagtata

SEQ ID NO: 148623 - DNA, 16 bp, H. sapiens
tgctgatggtgctggt

SEQ ID NO: 148624 - DNA, 16 bp, H. sapiens
tgctgatgtgaaatgt

SEQ ID NO: 148625 - DNA, 16 bp, H. sapiens
tgctgatgttgatgct

SEQ ID NO: 148626 - DNA, 16 bp, H. sapiens
tgctgattatttattt

SEQ ID NO: 148627 - DNA, 16 bp, H. sapiens
tgctgattcaaaagaa

SEQ ID NO: 148628 - DNA, 16 bp, H. sapiens
tgctgattggctgggg

SEQ ID NO: 148629 - DNA, 16 bp, H. sapiens
tgctgattggtgcctt

SEQ ID NO: 148630 - DNA, 16 bp, H. sapiens
tgctgcaaaaaacatg

SEQ ID NO: 148631 - DNA, 16 bp, H. sapiens
tgctgcaaaagacata

SEQ ID NO: 148632 - DNA, 16 bp, H. sapiens
tgctgcaaagaacata

SEQ ID NO: 148633 - DNA, 16 bp, H. sapiens
tgctgcaaaggatata

SEQ ID NO: 148634 - DNA, 17 bp, H. sapiens
tgctgcaataaacatac

SEQ ID NO: 148635 - DNA, 16 bp, H. sapiens
tgctgcaatacacatg

SEQ ID NO: 148636 - DNA, 16 bp, H. sapiens
tgctgcaatgaacatg

SEQ ID NO: 148637 - DNA, 16 bp, H. sapiens
tgctgcaatgaataca

SEQ ID NO: 148638 - DNA, 16 bp, H. sapiens
tgctgcacaggctggt

SEQ ID NO: 148639 - DNA, 16 bp, H. sapiens
tgctgcacccattaat

SEQ ID NO: 148640 - DNA, 16 bp, H. sapiens
tgctgcactgtgggag

SEQ ID NO: 148641 - DNA, 27 bp, H. sapiens
tgctgcagagattttgtttatggccag

SEQ ID NO: 148642 - DNA, 16 bp, H. sapiens
tgctgcagaggatgtg

SEQ ID NO: 148643 - DNA, 16 bp, H. sapiens
tgctgcagaggcagag

SEQ ID NO: 148644 - DNA, 18 bp, H. sapiens
tgctgcagataactagcc

SEQ ID NO: 148645 - DNA, 16 bp, H. sapiens
tgctgcagccactttg

SEQ ID NO: 148646 - DNA, 16 bp, H. sapiens
tgctgcagccagcatg

SEQ ID NO: 148647 - DNA, 16 bp, H. sapiens
tgctgcagcctcctga

SEQ ID NO: 148648 - DNA, 16 bp, H. sapiens
tgctgcagctccagcc

SEQ ID NO: 148649 - DNA, 16 bp, H. sapiens
tgctgcagctccagct

SEQ ID NO: 148650 - DNA, 16 bp, H. sapiens
tgctgcagctgaggag

SEQ ID NO: 148651 - DNA, 16 bp, H. sapiens
tgctgcagctgctgtg

SEQ ID NO: 148652 - DNA, 16 bp, H. sapiens
tgctgcagcttctgca

SEQ ID NO: 148653 - DNA, 16 bp, H. sapiens
tgctgcagcttcttca

SEQ ID NO: 148654 - DNA, 16 bp, H. sapiens
tgctgcaggacttctc

SEQ ID NO: 148655 - DNA, 16 bp, H. sapiens
tgctgcaggagtggag

SEQ ID NO: 148656 - DNA, 16 bp, H. sapiens
tgctgcaggagtgggg

SEQ ID NO: 148657 - DNA, 16 bp, H. sapiens
tgctgcagggatggag

SEQ ID NO: 148658 - DNA, 16 bp, H. sapiens
tgctgcaggggcaggg

SEQ ID NO: 148659 - DNA, 16 bp, H. sapiens
tgctgcaggggtggag

SEQ ID NO: 148660 - DNA, 16 bp, H. sapiens
tgctgcatcatcccac

SEQ ID NO: 148661 - DNA, 16 bp, H. sapiens
tgctgcatgggcatgg

SEQ ID NO: 148662 - DNA, 16 bp, H. sapiens
tgctgcatttccttac

SEQ ID NO: 148663 - DNA, 16 bp, H. sapiens
tgctgccaaaggagat

SEQ ID NO: 148664 - DNA, 16 bp, H. sapiens
tgctgccaaggccctc

SEQ ID NO: 148665 - DNA, 16 bp, H. sapiens
tgctgccacctgctgg

SEQ ID NO: 148666 - DNA, 16 bp, H. sapiens
tgctgccactgcccag

SEQ ID NO: 148667 - DNA, 16 bp, H. sapiens
tgctgccactgctgct

SEQ ID NO: 148668 - DNA, 16 bp, H. sapiens
tgctgccagctgagga

SEQ ID NO: 148669 - DNA, 16 bp, H. sapiens
tgctgccatctgctgg

SEQ ID NO: 148670 - DNA, 16 bp, H. sapiens
tgctgccatgtgaaga

SEQ ID NO: 148671 - DNA, 16 bp, H. sapiens
tgctgccatgttaaga

SEQ ID NO: 148672 - DNA, 16 bp, H. sapiens
tgctgcccaagctgga

SEQ ID NO: 148673 - DNA, 16 bp, H. sapiens
tgctgcccagcctgga

SEQ ID NO: 148674 - DNA, 16 bp, H. sapiens
tgctgcccaggatgga

SEQ ID NO: 148675 - DNA, 16 bp, H. sapiens
tgctgcccaggctggc

SEQ ID NO: 148676 - DNA, 16 bp, H. sapiens
tgctgcccaggtctgg

SEQ ID NO: 148677 - DNA, 16 bp, H. sapiens
tgctgccccctgctgg

SEQ ID NO: 148678 - DNA, 16 bp, H. sapiens
tgctgccccctggtgg

SEQ ID NO: 148679 - DNA, 16 bp, H. sapiens
tgctgcccctgcccct

SEQ ID NO: 148680 - DNA, 16 bp, H. sapiens
tgctgccctcactgcc

SEQ ID NO: 148681 - DNA, 16 bp, H. sapiens
tgctgccctctcctgg

SEQ ID NO: 148682 - DNA, 16 bp, H. sapiens
tgctgccctctggtgg

SEQ ID NO: 148683 - DNA, 16 bp, H. sapiens
tgctgcccttcttccc

SEQ ID NO: 148684 - DNA, 16 bp, H. sapiens
tgctgccgctgctgct

SEQ ID NO: 148685 - DNA, 16 bp, H. sapiens
tgctgcctcagcttcc

SEQ ID NO: 148686 - DNA, 16 bp, H. sapiens
tgctgcctcctctgtg

SEQ ID NO: 148687 - DNA, 16 bp, H. sapiens
tgctgcctcctgggtt

SEQ ID NO: 148688 - DNA, 16 bp, H. sapiens
tgctgcctcttggtca

SEQ ID NO: 148689 - DNA, 16 bp, H. sapiens
tgctgcctgcaagctg

SEQ ID NO: 148690 - DNA, 16 bp, H. sapiens
tgctgcctgcctgcct

SEQ ID NO: 148691 - DNA, 16 bp, H. sapiens
tgctgcctggcacata

SEQ ID NO: 148692 - DNA, 16 bp, H. sapiens
tgctgcctgggctgga

SEQ ID NO: 148693 - DNA, 16 bp, H. sapiens
tgctgccttcaagaga

SEQ ID NO: 148694 - DNA, 56 bp, H. sapiens
tgctgccttcaagcatctgtttaacaaagcacatcttgcaccgcccttaatccatt

SEQ ID NO: 148695 - DNA, 16 bp, H. sapiens
tgctgccttcaggaga

SEQ ID NO: 148696 - DNA, 16 bp, H. sapiens
tgctgcgattacaggg

SEQ ID NO: 148697 - DNA, 16 bp, H. sapiens
tgctgcgattataggc

SEQ ID NO: 148698 - DNA, 16 bp, H. sapiens
tgctgctaaacatcct

SEQ ID NO: 148699 - DNA, 16 bp, H. sapiens
tgctgctataaagaaa

SEQ ID NO: 148700 - DNA, 16 bp, H. sapiens
tgctgctatgaaaatg

SEQ ID NO: 148701 - DNA, 16 bp, H. sapiens
tgctgctatgaacttt

SEQ ID NO: 148702 - DNA, 16 bp, H. sapiens
tgctgctatgaatatg

SEQ ID NO: 148703 - DNA, 16 bp, H. sapiens
tgctgctatgaatgtg

SEQ ID NO: 148704 - DNA, 16 bp, H. sapiens
tgctgctattttaaaa

SEQ ID NO: 148705 - DNA, 16 bp, H. sapiens
tgctgctcaaggaaat

SEQ ID NO: 148706 - DNA, 16 bp, H. sapiens
tgctgctctgtgcctg

SEQ ID NO: 148707 - DNA, 16 bp, H. sapiens
tgctgctgatgaagac

SEQ ID NO: 148708 - DNA, 16 bp, H. sapiens
tgctgctgatgctgct

SEQ ID NO: 148709 - DNA, 16 bp, H. sapiens
tgctgctgcagctggt

SEQ ID NO: 148710 - DNA, 16 bp, H. sapiens
tgctgctgcaggcttc

SEQ ID NO: 148711 - DNA, 16 bp, H. sapiens
tgctgctgccactgcc

SEQ ID NO: 148712 - DNA, 16 bp, H. sapiens
tgctgctgccactgct

SEQ ID NO: 148713 - DNA, 16 bp, H. sapiens
tgctgctgccatgtga

SEQ ID NO: 148714 - DNA, 16 bp, H. sapiens
tgctgctgcccctgcc

SEQ ID NO: 148715 - DNA, 16 bp, H. sapiens
tgctgctgccctggcc

SEQ ID NO: 148716 - DNA, 16 bp, H. sapiens
tgctgctgcctcagcc

SEQ ID NO: 148717 - DNA, 16 bp, H. sapiens
tgctgctgcctcctcc

SEQ ID NO: 148718 - DNA, 16 bp, H. sapiens
tgctgctgcctctgcc

SEQ ID NO: 148719 - DNA, 16 bp, H. sapiens
tgctgctgcctgatgg

SEQ ID NO: 148720 - DNA, 16 bp, H. sapiens
tgctgctgcctttttt

SEQ ID NO: 148721 - DNA, 16 bp, H. sapiens
tgctgctgctactact

SEQ ID NO: 148722 - DNA, 16 bp, H. sapiens
tgctgctgctactgct

SEQ ID NO: 148723 - DNA, 16 bp, H. sapiens
tgctgctgctattgct

SEQ ID NO: 148724 - DNA, 16 bp, H. sapiens
tgctgctgctcactct

SEQ ID NO: 148725 - DNA, 16 bp, H. sapiens
tgctgctgctcagtct

SEQ ID NO: 148726 - DNA, 16 bp, H. sapiens
tgctgctgctcatctg

SEQ ID NO: 148727 - DNA, 16 bp, H. sapiens
tgctgctgctcctcct

SEQ ID NO: 148728 - DNA, 16 bp, H. sapiens
tgctgctgctcctctg

SEQ ID NO: 148729 - DNA, 17 bp, H. sapiens
tgctgctgctcctgctg

SEQ ID NO: 148730 - DNA, 16 bp, H. sapiens
tgctgctgctctgcct

SEQ ID NO: 148731 - DNA, 16 bp, H. sapiens
tgctgctgctgccact

SEQ ID NO: 148732 - DNA, 16 bp, H. sapiens
tgctgctgctgccatt

SEQ ID NO: 148733 - DNA, 16 bp, H. sapiens
tgctgctgctgccgct

SEQ ID NO: 148734 - DNA, 16 bp, H. sapiens
tgctgctgctgcctcc

SEQ ID NO: 148735 - DNA, 16 bp, H. sapiens
tgctgctgctgcctgg

SEQ ID NO: 148736 - DNA, 16 bp, H. sapiens
tgctgctgctgctaca

SEQ ID NO: 148737 - DNA, 16 bp, H. sapiens
tgctgctgctgctccc

SEQ ID NO: 148738 - DNA, 16 bp, H. sapiens
tgctgctgctgctcct

SEQ ID NO: 148739 - DNA, 16 bp, H. sapiens
tgctgctgctgctgca

SEQ ID NO: 148740 - DNA, 16 bp, H. sapiens
tgctgctgctgctgct

SEQ ID NO: 148741 - DNA, 16 bp, H. sapiens
tgctgctgctgctgta

SEQ ID NO: 148742 - DNA, 16 bp, H. sapiens
tgctgctgctgctgtt

SEQ ID NO: 148743 - DNA, 18 bp, H. sapiens
tgctgctgctgctgttgc

SEQ ID NO: 148744 - DNA, 16 bp, H. sapiens
tgctgctgctggctca

SEQ ID NO: 148745 - DNA, 16 bp, H. sapiens
tgctgctgctggctct

SEQ ID NO: 148746 - DNA, 16 bp, H. sapiens
tgctgctgctggctgg

SEQ ID NO: 148747 - DNA, 16 bp, H. sapiens
tgctgctgctggtctg

SEQ ID NO: 148748 - DNA, 16 bp, H. sapiens
tgctgctgctggtggt

SEQ ID NO: 148749 - DNA, 16 bp, H. sapiens
tgctgctgctgtgtgt

SEQ ID NO: 148750 - DNA, 16 bp, H. sapiens
tgctgctgctgttatt

SEQ ID NO: 148751 - DNA, 16 bp, H. sapiens
tgctgctgcttctagt

SEQ ID NO: 148752 - DNA, 16 bp, H. sapiens
tgctgctgcttctgct

SEQ ID NO: 148753 - DNA, 16 bp, H. sapiens
tgctgctggactcggt

SEQ ID NO: 148754 - DNA, 16 bp, H. sapiens
tgctgctggattcagt

SEQ ID NO: 148755 - DNA, 16 bp, H. sapiens
tgctgctggcccaggg

SEQ ID NO: 148756 - DNA, 16 bp, H. sapiens
tgctgctggcctgggg

SEQ ID NO: 148757 - DNA, 16 bp, H. sapiens
tgctgctggcttctga

SEQ ID NO: 148758 - DNA, 16 bp, H. sapiens
tgctgctggtccaggg

SEQ ID NO: 148759 - DNA, 16 bp, H. sapiens
tgctgctggtctggaa

SEQ ID NO: 148760 - DNA, 16 bp, H. sapiens
tgctgctggtctggga

SEQ ID NO: 148761 - DNA, 16 bp, H. sapiens
tgctgctggtgctgct

SEQ ID NO: 148762 - DNA, 16 bp, H. sapiens
tgctgctgtaacaaat

SEQ ID NO: 148763 - DNA, 16 bp, H. sapiens
tgctgctgtaacagaa

SEQ ID NO: 148764 - DNA, 16 bp, H. sapiens
tgctgctgtaagaaat

SEQ ID NO: 148765 - DNA, 16 bp, H. sapiens
tgctgctgtacactgc

SEQ ID NO: 148766 - DNA, 16 bp, H. sapiens
tgctgctgtgaacact

SEQ ID NO: 148767 - DNA, 16 bp, H. sapiens
tgctgctgtgaacatg

SEQ ID NO: 148768 - DNA, 16 bp, H. sapiens
tgctgctgtggctgct

SEQ ID NO: 148769 - DNA, 16 bp, H. sapiens
tgctgctgtgtgtgtg

SEQ ID NO: 148770 - DNA, 16 bp, H. sapiens
tgctgctgttattatt

SEQ ID NO: 148771 - DNA, 16 bp, H. sapiens
tgctgctgttgagaaa

SEQ ID NO: 148772 - DNA, 16 bp, H. sapiens
tgctgctgttgctgct

SEQ ID NO: 148773 - DNA, 16 bp, H. sapiens
tgctgctgttgctgtt

SEQ ID NO: 148774 - DNA, 16 bp, H. sapiens
tgctgctgttggatga

SEQ ID NO: 148775 - DNA, 16 bp, H. sapiens
tgctgcttacaagaaa

SEQ ID NO: 148776 - DNA, 16 bp, H. sapiens
tgctgcttagaaatgt

SEQ ID NO: 148777 - DNA, 16 bp, H. sapiens
tgctgcttctcttctc

SEQ ID NO: 148778 - DNA, 16 bp, H. sapiens
tgctgcttctgctttt

SEQ ID NO: 148779 - DNA, 16 bp, H. sapiens
tgctgcttgctgtgct

SEQ ID NO: 148780 - DNA, 16 bp, H. sapiens
tgctgctttcaaaatt

SEQ ID NO: 148781 - DNA, 16 bp, H. sapiens
tgctgctttgtctctg

SEQ ID NO: 148782 - DNA, 16 bp, H. sapiens
tgctgcttttaaaaca

SEQ ID NO: 148783 - DNA, 16 bp, H. sapiens
tgctggaaaaactgaa

SEQ ID NO: 148784 - DNA, 16 bp, H. sapiens
tgctggaaacccaggg

SEQ ID NO: 148785 - DNA, 16 bp, H. sapiens
tgctggaaaggatgtg

SEQ ID NO: 148786 - DNA, 16 bp, H. sapiens
tgctggaaatgcagaa

SEQ ID NO: 148787 - DNA, 16 bp, H. sapiens
tgctggaacaattgga

SEQ ID NO: 148788 - DNA, 16 bp, H. sapiens
tgctggaacccaggag

SEQ ID NO: 148789 - DNA, 16 bp, H. sapiens
tgctggaattacaggt

SEQ ID NO: 148790 - DNA, 16 bp, H. sapiens
tgctggaattagaggt

SEQ ID NO: 148791 - DNA, 16 bp, H. sapiens
tgctggaattatagat

SEQ ID NO: 148792 - DNA, 16 bp, H. sapiens
tgctggactcagtttg

SEQ ID NO: 148793 - DNA, 16 bp, H. sapiens
tgctggactgcagtgg

SEQ ID NO: 148794 - DNA, 16 bp, H. sapiens
tgctggagaaactgga

SEQ ID NO: 148795 - DNA, 16 bp, H. sapiens
tgctggagacacactg

SEQ ID NO: 148796 - DNA, 16 bp, H. sapiens
tgctggagagaatgtg

SEQ ID NO: 148797 - DNA, 16 bp, H. sapiens
tgctggagaggaaccc

SEQ ID NO: 148798 - DNA, 19 bp, H. sapiens
tgctggagaggatatggag

SEQ ID NO: 148799 - DNA, 16 bp, H. sapiens
tgctggagcagctcac

SEQ ID NO: 148800 - DNA, 16 bp, H. sapiens
tgctggagcccaggag

SEQ ID NO: 148801 - DNA, 16 bp, H. sapiens
tgctggagcctgggaa

SEQ ID NO: 148802 - DNA, 16 bp, H. sapiens
tgctggaggatgagag

SEQ ID NO: 148803 - DNA, 16 bp, H. sapiens
tgctggaggcagggag

SEQ ID NO: 148804 - DNA, 16 bp, H. sapiens
tgctggaggggatgtg

SEQ ID NO: 148805 - DNA, 16 bp, H. sapiens
tgctggaggggctgag

SEQ ID NO: 148806 - DNA, 16 bp, H. sapiens
tgctggaggtcctctc

SEQ ID NO: 148807 - DNA, 16 bp, H. sapiens
tgctggaggtggggcc

SEQ ID NO: 148808 - DNA, 16 bp, H. sapiens
tgctggagtgcaatgg

SEQ ID NO: 148809 - DNA, 16 bp, H. sapiens
tgctggagtgcagtga

SEQ ID NO: 148810 - DNA, 16 bp, H. sapiens
tgctggagtgcagtgg

SEQ ID NO: 148811 - DNA, 16 bp, H. sapiens
tgctggagtgtagtgg

SEQ ID NO: 148812 - DNA, 16 bp, H. sapiens
tgctggatcaaatgtt

SEQ ID NO: 148813 - DNA, 16 bp, H. sapiens
tgctggatcacatggt

SEQ ID NO: 148814 - DNA, 16 bp, H. sapiens
tgctggatccttcctg

SEQ ID NO: 148815 - DNA, 16 bp, H. sapiens
tgctggatgcctcctg

SEQ ID NO: 148816 - DNA, 16 bp, H. sapiens
tgctggattctgagtg

SEQ ID NO: 148817 - DNA, 16 bp, H. sapiens
tgctggatttggtgtg

SEQ ID NO: 148818 - DNA, 16 bp, H. sapiens
tgctggattttgttgt

SEQ ID NO: 148819 - DNA, 16 bp, H. sapiens
tgctggcaaaaaaaaa

SEQ ID NO: 148820 - DNA, 16 bp, H. sapiens
tgctggcaaggagctg

SEQ ID NO: 148821 - DNA, 16 bp, H. sapiens
tgctggcaatccttgg

SEQ ID NO: 148822 - DNA, 16 bp, H. sapiens
tgctggcacaaggctt

SEQ ID NO: 148823 - DNA, 16 bp, H. sapiens
tgctggcagagagaat

SEQ ID NO: 148824 - DNA, 16 bp, H. sapiens
tgctggcagcaagaat

SEQ ID NO: 148825 - DNA, 16 bp, H. sapiens
tgctggcagccctcac

SEQ ID NO: 148826 - DNA, 22 bp, H. sapiens
tgctggcagtcctcacagccct

SEQ ID NO: 148827 - DNA, 16 bp, H. sapiens
tgctggcatctggcaa

SEQ ID NO: 148828 - DNA, 16 bp, H. sapiens
tgctggcatgagccac

SEQ ID NO: 148829 - DNA, 16 bp, H. sapiens
tgctggccaggcatgg

SEQ ID NO: 148830 - DNA, 16 bp, H. sapiens
tgctggccaggcttgt

SEQ ID NO: 148831 - DNA, 16 bp, H. sapiens
tgctggccatgctggt

SEQ ID NO: 148832 - DNA, 16 bp, H. sapiens
tgctggcccagctgag

SEQ ID NO: 148833 - DNA, 16 bp, H. sapiens
tgctggcccaggtgct

SEQ ID NO: 148834 - DNA, 16 bp, H. sapiens
tgctggccccgggcaa

SEQ ID NO: 148835 - DNA, 16 bp, H. sapiens
tgctggccgggcacag

SEQ ID NO: 148836 - DNA, 16 bp, H. sapiens
tgctggcctcaaagaa

SEQ ID NO: 148837 - DNA, 16 bp, H. sapiens
tgctggcctctcccag

SEQ ID NO: 148838 - DNA, 16 bp, H. sapiens
tgctggccttgtagaa

SEQ ID NO: 148839 - DNA, 16 bp, H. sapiens
tgctggcgggcgcctg

SEQ ID NO: 148840 - DNA, 16 bp, H. sapiens
tgctggctcaggcctg

SEQ ID NO: 148841 - DNA, 16 bp, H. sapiens
tgctggctcatgcctg

SEQ ID NO: 148842 - DNA, 16 bp, H. sapiens
tgctggctccttgctt

SEQ ID NO: 148843 - DNA, 16 bp, H. sapiens
tgctggctctgaggaa

SEQ ID NO: 148844 - DNA, 16 bp, H. sapiens
tgctggctctggcagc

SEQ ID NO: 148845 - DNA, 16 bp, H. sapiens
tgctggctcttttttg

SEQ ID NO: 148846 - DNA, 16 bp, H. sapiens
tgctggctgcaggcat

SEQ ID NO: 148847 - DNA, 16 bp, H. sapiens
tgctggctgccagctg

SEQ ID NO: 148848 - DNA, 16 bp, H. sapiens
tgctggctgctgcagc

SEQ ID NO: 148849 - DNA, 16 bp, H. sapiens
tgctggctgctggctg

SEQ ID NO: 148850 - DNA, 16 bp, H. sapiens
tgctggctgggcgcag

SEQ ID NO: 148851 - DNA, 16 bp, H. sapiens
tgctggctgggcgcgg

SEQ ID NO: 148852 - DNA, 16 bp, H. sapiens
tgctggctgtcagctg

SEQ ID NO: 148853 - DNA, 16 bp, H. sapiens
tgctggctgtgaccaa

SEQ ID NO: 148854 - DNA, 16 bp, H. sapiens
tgctggctgttggctg

SEQ ID NO: 148855 - DNA, 16 bp, H. sapiens
tgctggcttcaggtct

SEQ ID NO: 148856 - DNA, 16 bp, H. sapiens
tgctggcttccccttc

SEQ ID NO: 148857 - DNA, 16 bp, H. sapiens
tgctggcttgggcagc

SEQ ID NO: 148858 - DNA, 16 bp, H. sapiens
tgctgggaaaactgcc

SEQ ID NO: 148859 - DNA, 16 bp, H. sapiens
tgctgggaaaagcaga

SEQ ID NO: 148860 - DNA, 16 bp, H. sapiens
tgctgggaaaatggga

SEQ ID NO: 148861 - DNA, 22 bp, H. sapiens
tgctgggacaccccacggcagt

SEQ ID NO: 148862 - DNA, 16 bp, H. sapiens
tgctgggactacaggt

SEQ ID NO: 148863 - DNA, 16 bp, H. sapiens
tgctgggactataggc

SEQ ID NO: 148864 - DNA, 16 bp, H. sapiens
tgctgggactgatggg

SEQ ID NO: 148865 - DNA, 16 bp, H. sapiens
tgctgggagaactgga

SEQ ID NO: 148866 - DNA, 16 bp, H. sapiens
tgctgggagagctggc

SEQ ID NO: 148867 - DNA, 16 bp, H. sapiens
tgctgggagcagtggc

SEQ ID NO: 148868 - DNA, 16 bp, H. sapiens
tgctgggagccaccat

SEQ ID NO: 148869 - DNA, 16 bp, H. sapiens
tgctgggagctacaga

SEQ ID NO: 148870 - DNA, 16 bp, H. sapiens
tgctgggaggcaggag

SEQ ID NO: 148871 - DNA, 16 bp, H. sapiens
tgctgggaggcagggc

SEQ ID NO: 148872 - DNA, 16 bp, H. sapiens
tgctgggaggtgattg

SEQ ID NO: 148873 - DNA, 16 bp, H. sapiens
tgctgggagttgtagt

SEQ ID NO: 148874 - DNA, 16 bp, H. sapiens
tgctgggataactgga

SEQ ID NO: 148875 - DNA, 16 bp, H. sapiens
tgctgggataactggc

SEQ ID NO: 148876 - DNA, 16 bp, H. sapiens
tgctgggattacacac

SEQ ID NO: 148877 - DNA, 16 bp, H. sapiens
tgctgggattacagca

SEQ ID NO: 148878 - DNA, 18 bp, H. sapiens
tgctgggattacaggcaa

SEQ ID NO: 148879 - DNA, 18 bp, H. sapiens
tgctgggattacaggcgc

SEQ ID NO: 148880 - DNA, 16 bp, H. sapiens
tgctgggattactgga

SEQ ID NO: 148881 - DNA, 16 bp, H. sapiens
tgctgggattatgggg

SEQ ID NO: 148882 - DNA, 16 bp, H. sapiens
tgctgggattccaggt

SEQ ID NO: 148883 - DNA, 16 bp, H. sapiens
tgctgggattgcaggg

SEQ ID NO: 148884 - DNA, 16 bp, H. sapiens
tgctgggattggaggc

SEQ ID NO: 148885 - DNA, 16 bp, H. sapiens
tgctgggattgtaggc

SEQ ID NO: 148886 - DNA, 16 bp, H. sapiens
tgctgggcacctgtag

SEQ ID NO: 148887 - DNA, 16 bp, H. sapiens
tgctgggcactgggaa

SEQ ID NO: 148888 - DNA, 16 bp, H. sapiens
tgctgggcagaagctt

SEQ ID NO: 148889 - DNA, 16 bp, H. sapiens
tgctgggcagatgtcc

SEQ ID NO: 148890 - DNA, 16 bp, H. sapiens
tgctgggcagtggcag

SEQ ID NO: 148891 - DNA, 16 bp, H. sapiens
tgctgggccccagccc

SEQ ID NO: 148892 - DNA, 18 bp, H. sapiens
tgctgggcgcggtggctc

SEQ ID NO: 148893 - DNA, 16 bp, H. sapiens
tgctgggctcagagcc

SEQ ID NO: 148894 - DNA, 16 bp, H. sapiens
tgctgggctccctggg

SEQ ID NO: 148895 - DNA, 16 bp, H. sapiens
tgctgggctctgtggg

SEQ ID NO: 148896 - DNA, 16 bp, H. sapiens
tgctgggctgcctctg

SEQ ID NO: 148897 - DNA, 16 bp, H. sapiens
tgctgggcttggtggt

SEQ ID NO: 148898 - DNA, 16 bp, H. sapiens
tgctggggacacagca

SEQ ID NO: 148899 - DNA, 16 bp, H. sapiens
tgctggggacacagtg

SEQ ID NO: 148900 - DNA, 16 bp, H. sapiens
tgctggggctggagtg

SEQ ID NO: 148901 - DNA, 16 bp, H. sapiens
tgctggggctggggct

SEQ ID NO: 148902 - DNA, 16 bp, H. sapiens
tgctgggggtccactc

SEQ ID NO: 148903 - DNA, 16 bp, H. sapiens
tgctggggttacagtc

SEQ ID NO: 148904 - DNA, 16 bp, H. sapiens
tgctgggtgacagagc

SEQ ID NO: 148905 - DNA, 16 bp, H. sapiens
tgctgggtgactttgg

SEQ ID NO: 148906 - DNA, 16 bp, H. sapiens
tgctgggtgctggaga

SEQ ID NO: 148907 - DNA, 16 bp, H. sapiens
tgctgggtgctgggga

SEQ ID NO: 148908 - DNA, 16 bp, H. sapiens
tgctgggttacaggcg

SEQ ID NO: 148909 - DNA, 16 bp, H. sapiens
tgctgggttctcagtg

SEQ ID NO: 148910 - DNA, 16 bp, H. sapiens
tgctggtaatctcagc

SEQ ID NO: 148911 - DNA, 16 bp, H. sapiens
tgctggtattacaggc

SEQ ID NO: 148912 - DNA, 16 bp, H. sapiens
tgctggtccagggacc

SEQ ID NO: 148913 - DNA, 16 bp, H. sapiens
tgctggtctcaaactc

SEQ ID NO: 148914 - DNA, 16 bp, H. sapiens
tgctggtcttgaactc

SEQ ID NO: 148915 - DNA, 16 bp, H. sapiens
tgctggtgaagatgca

SEQ ID NO: 148916 - DNA, 16 bp, H. sapiens
tgctggtgaggctgag

SEQ ID NO: 148917 - DNA, 16 bp, H. sapiens
tgctggtgatggtgat

SEQ ID NO: 148918 - DNA, 18 bp, H. sapiens
tgctggtgcactgcaccc

SEQ ID NO: 148919 - DNA, 16 bp, H. sapiens
tgctggtgctgctggt

SEQ ID NO: 148920 - DNA, 16 bp, H. sapiens
tgctggtggaggatct

SEQ ID NO: 148921 - DNA, 16 bp, H. sapiens
tgctggtggctctacc

SEQ ID NO: 148922 - DNA, 16 bp, H. sapiens
tgctggtgtaaataaa

SEQ ID NO: 148923 - DNA, 16 bp, H. sapiens
tgctggtgtgtggatg

SEQ ID NO: 148924 - DNA, 16 bp, H. sapiens
tgctggttttgaggct

SEQ ID NO: 148925 - DNA, 16 bp, H. sapiens
tgctggttttgcggct

SEQ ID NO: 148926 - DNA, 16 bp, H. sapiens
tgctgtaaagaaatat

SEQ ID NO: 148927 - DNA, 16 bp, H. sapiens
tgctgtaaaggacatg

SEQ ID NO: 148928 - DNA, 16 bp, H. sapiens
tgctgtaataaatctt

SEQ ID NO: 148929 - DNA, 16 bp, H. sapiens
tgctgtacccattaac

SEQ ID NO: 148930 - DNA, 16 bp, H. sapiens
tgctgtagaggatgtg

SEQ ID NO: 148931 - DNA, 16 bp, H. sapiens
tgctgtatcaaaagaa

SEQ ID NO: 148932 - DNA, 16 bp, H. sapiens
tgctgtattagtcagg

SEQ ID NO: 148933 - DNA, 16 bp, H. sapiens
tgctgtattttcattt

SEQ ID NO: 148934 - DNA, 16 bp, H. sapiens
tgctgtatttttactg

SEQ ID NO: 148935 - DNA, 16 bp, H. sapiens
tgctgtatttttcagc

SEQ ID NO: 148936 - DNA, 16 bp, H. sapiens
tgctgtcactgcagaa

SEQ ID NO: 148937 - DNA, 16 bp, H. sapiens
tgctgtcaggtgcatc

SEQ ID NO: 148938 - DNA, 16 bp, H. sapiens
tgctgtcagtgtttaa

SEQ ID NO: 148939 - DNA, 16 bp, H. sapiens
tgctgtccaatagaaa

SEQ ID NO: 148940 - DNA, 16 bp, H. sapiens
tgctgtccagcctggg

SEQ ID NO: 148941 - DNA, 16 bp, H. sapiens
tgctgtccaggagcca

SEQ ID NO: 148942 - DNA, 16 bp, H. sapiens
tgctgtccaggctgga

SEQ ID NO: 148943 - DNA, 16 bp, H. sapiens
tgctgtccaggctggt

SEQ ID NO: 148944 - DNA, 17 bp, H. sapiens
tgctgtcccgtctgccc

SEQ ID NO: 148945 - DNA, 16 bp, H. sapiens
tgctgtcctccatccc

SEQ ID NO: 148946 - DNA, 16 bp, H. sapiens
tgctgtcctgcagcct

SEQ ID NO: 148947 - DNA, 16 bp, H. sapiens
tgctgtccttgtggta

SEQ ID NO: 148948 - DNA, 17 bp, H. sapiens
tgctgtctatctcattt

SEQ ID NO: 148949 - DNA, 16 bp, H. sapiens
tgctgtctcatcctta

SEQ ID NO: 148950 - DNA, 16 bp, H. sapiens
tgctgtctgggagcca

SEQ ID NO: 148951 - DNA, 16 bp, H. sapiens
tgctgtctgtcatgtg

SEQ ID NO: 148952 - DNA, 16 bp, H. sapiens
tgctgtcttctgtacc

SEQ ID NO: 148953 - DNA, 16 bp, H. sapiens
tgctgtctttgaagat

SEQ ID NO: 148954 - DNA, 16 bp, H. sapiens
tgctgtgaaggtattt

SEQ ID NO: 148955 - DNA, 16 bp, H. sapiens
tgctgtgactcatgcc

SEQ ID NO: 148956 - DNA, 16 bp, H. sapiens
tgctgtgagatggtat

SEQ ID NO: 148957 - DNA, 16 bp, H. sapiens
tgctgtgagccaagat

SEQ ID NO: 148958 - DNA, 17 bp, H. sapiens
tgctgtgagccgagatt

SEQ ID NO: 148959 - DNA, 16 bp, H. sapiens
tgctgtgataaaaata

SEQ ID NO: 148960 - DNA, 16 bp, H. sapiens
tgctgtgatcttggct

SEQ ID NO: 148961 - DNA, 16 bp, H. sapiens
tgctgtgattataggc

SEQ ID NO: 148962 - DNA, 16 bp, H. sapiens
tgctgtgcaaaagttt

SEQ ID NO: 148963 - DNA, 16 bp, H. sapiens
tgctgtgcagaagatt

SEQ ID NO: 148964 - DNA, 16 bp, H. sapiens
tgctgtgcagaaggtc

SEQ ID NO: 148965 - DNA, 16 bp, H. sapiens
tgctgtgcagaaggtt

SEQ ID NO: 148966 - DNA, 16 bp, H. sapiens
tgctgtgcagaagttt

SEQ ID NO: 148967 - DNA, 18 bp, H. sapiens
tgctgtgctagcaatcag

SEQ ID NO: 148968 - DNA, 16 bp, H. sapiens
tgctgtgctccagcct

SEQ ID NO: 148969 - DNA, 16 bp, H. sapiens
tgctgtgctgcccatt

SEQ ID NO: 148970 - DNA, 16 bp, H. sapiens
tgctgtgctgggaggt

SEQ ID NO: 148971 - DNA, 16 bp, H. sapiens
tgctgtgctgtgctgt

SEQ ID NO: 148972 - DNA, 16 bp, H. sapiens
tgctgtggctcacgcc

SEQ ID NO: 148973 - DNA, 16 bp, H. sapiens
tgctgtggctgagctg

SEQ ID NO: 148974 - DNA, 16 bp, H. sapiens
tgctgtggctgatctg

SEQ ID NO: 148975 - DNA, 16 bp, H. sapiens
tgctgtggctgctgtg

SEQ ID NO: 148976 - DNA, 16 bp, H. sapiens
tgctgtggggttggag

SEQ ID NO: 148977 - DNA, 16 bp, H. sapiens
tgctgtggtctgagtg

SEQ ID NO: 148978 - DNA, 16 bp, H. sapiens
tgctgtggtgccatct

SEQ ID NO: 148979 - DNA, 16 bp, H. sapiens
tgctgtggtgggctcc

SEQ ID NO: 148980 - DNA, 16 bp, H. sapiens
tgctgtggttcatgcc

SEQ ID NO: 148981 - DNA, 16 bp, H. sapiens
tgctgtggtttctccc

SEQ ID NO: 148982 - DNA, 16 bp, H. sapiens
tgctgtggtttgaata

SEQ ID NO: 148983 - DNA, 16 bp, H. sapiens
tgctgtggtttgaatg

SEQ ID NO: 148984 - DNA, 16 bp, H. sapiens
tgctgtgtcacacagg

SEQ ID NO: 148985 - DNA, 16 bp, H. sapiens
tgctgtgtccactcag

SEQ ID NO: 148986 - DNA, 16 bp, H. sapiens
tgctgtgtgaccttag

SEQ ID NO: 148987 - DNA, 17 bp, H. sapiens
tgctgtgtgaccttgga

SEQ ID NO: 148988 - DNA, 16 bp, H. sapiens
tgctgtgtgcagccta

SEQ ID NO: 148989 - DNA, 16 bp, H. sapiens
tgctgtgtgtctgtgt

SEQ ID NO: 148990 - DNA, 16 bp, H. sapiens
tgctgtgtgtgtctgt

SEQ ID NO: 148991 - DNA, 16 bp, H. sapiens
tgctgtgtgtgtgctg

SEQ ID NO: 148992 - DNA, 16 bp, H. sapiens
tgctgtgtgtgtgtgc

SEQ ID NO: 148993 - DNA, 16 bp, H. sapiens
tgctgtgttctggaaa

SEQ ID NO: 148994 - DNA, 16 bp, H. sapiens
tgctgtgttttgatta

SEQ ID NO: 148995 - DNA, 16 bp, H. sapiens
tgctgtgtttttcaac

SEQ ID NO: 148996 - DNA, 16 bp, H. sapiens
tgctgttaaagacatt

SEQ ID NO: 148997 - DNA, 16 bp, H. sapiens
tgctgttaatctgatg

SEQ ID NO: 148998 - DNA, 16 bp, H. sapiens
tgctgttattattatt

SEQ ID NO: 148999 - DNA, 16 bp, H. sapiens
tgctgttatttcttta

SEQ ID NO: 149000 - DNA, 16 bp, H. sapiens
tgctgttcaccaatga

SEQ ID NO: 149001 - DNA, 16 bp, H. sapiens
tgctgttcccactgcc

SEQ ID NO: 149002 - DNA, 16 bp, H. sapiens
tgctgttccctctgcc

SEQ ID NO: 149003 - DNA, 16 bp, H. sapiens
tgctgttccctttgct

SEQ ID NO: 149004 - DNA, 16 bp, H. sapiens
tgctgttcctgctgcc

SEQ ID NO: 149005 - DNA, 16 bp, H. sapiens
tgctgttccttgaaca

SEQ ID NO: 149006 - DNA, 16 bp, H. sapiens
tgctgttctagtgata

SEQ ID NO: 149007 - DNA, 16 bp, H. sapiens
tgctgttctcaggata

SEQ ID NO: 149008 - DNA, 16 bp, H. sapiens
tgctgttctcatgaca

SEQ ID NO: 149009 - DNA, 16 bp, H. sapiens
tgctgttctcatggta

SEQ ID NO: 149010 - DNA, 16 bp, H. sapiens
tgctgttctcctgata

SEQ ID NO: 149011 - DNA, 16 bp, H. sapiens
tgctgttctcgtgata

SEQ ID NO: 149012 - DNA, 16 bp, H. sapiens
tgctgttcttcaaaca

SEQ ID NO: 149013 - DNA, 16 bp, H. sapiens
tgctgttcttgtgata

SEQ ID NO: 149014 - DNA, 16 bp, H. sapiens
tgctgttgaattctgt

SEQ ID NO: 149015 - DNA, 16 bp, H. sapiens
tgctgttgagatgttt

SEQ ID NO: 149016 - DNA, 16 bp, H. sapiens
tgctgttgctgctgcc

SEQ ID NO: 149017 - DNA, 16 bp, H. sapiens
tgctgttgctgctgct

SEQ ID NO: 149018 - DNA, 16 bp, H. sapiens
tgctgttgctgctggt

SEQ ID NO: 149019 - DNA, 16 bp, H. sapiens
tgctgttgctgctgtt

SEQ ID NO: 149020 - DNA, 16 bp, H. sapiens
tgctgttggatttgat

SEQ ID NO: 149021 - DNA, 16 bp, H. sapiens
tgctgttgggaatgta

SEQ ID NO: 149022 - DNA, 16 bp, H. sapiens
tgctgttggtgagaat

SEQ ID NO: 149023 - DNA, 16 bp, H. sapiens
tgctgttgtagtgtga

SEQ ID NO: 149024 - DNA, 16 bp, H. sapiens
tgctgttgttgttact

SEQ ID NO: 149025 - DNA, 16 bp, H. sapiens
tgctgttgttttaaag

SEQ ID NO: 149026 - DNA, 16 bp, H. sapiens
tgctgtttagaaattt

SEQ ID NO: 149027 - DNA, 16 bp, H. sapiens
tgctgtttcacagcct

SEQ ID NO: 149028 - DNA, 16 bp, H. sapiens
tgctgtttcccaggct

SEQ ID NO: 149029 - DNA, 16 bp, H. sapiens
tgctgtttcctctgtc

SEQ ID NO: 149030 - DNA, 16 bp, H. sapiens
tgctgtttgggtgact

SEQ ID NO: 149031 - DNA, 16 bp, H. sapiens
tgctgtttggttactg

SEQ ID NO: 149032 - DNA, 16 bp, H. sapiens
tgctgtttgttgcctg

SEQ ID NO: 149033 - DNA, 16 bp, H. sapiens
tgctgttttatttgga

SEQ ID NO: 149034 - DNA, 16 bp, H. sapiens
tgctgttttctctgct

SEQ ID NO: 149035 - DNA, 16 bp, H. sapiens
tgctgttttgattaat

SEQ ID NO: 149036 - DNA, 47 bp, H. sapiens
tgctgttttggttactgtagccttgtagtatagtttgaagtcaggta

SEQ ID NO: 149037 - DNA, 16 bp, H. sapiens
tgctgtttttagaatt

SEQ ID NO: 149038 - DNA, 16 bp, H. sapiens
tgctgttttttaaaat

SEQ ID NO: 149039 - DNA, 16 bp, H. sapiens
tgcttaaaaatgcaga

SEQ ID NO: 149040 - DNA, 16 bp, H. sapiens
tgcttaaaacccttca

SEQ ID NO: 149041 - DNA, 16 bp, H. sapiens
tgcttaaaatacttca

SEQ ID NO: 149042 - DNA, 16 bp, H. sapiens
tgcttaaaatccttca

SEQ ID NO: 149043 - DNA, 16 bp, H. sapiens
tgcttaaaatgttgct

SEQ ID NO: 149044 - DNA, 16 bp, H. sapiens
tgcttaaaattcttca

SEQ ID NO: 149045 - DNA, 16 bp, H. sapiens
tgcttaagatcacaca

SEQ ID NO: 149046 - DNA, 16 bp, H. sapiens
tgcttaagccactgtt

SEQ ID NO: 149047 - DNA, 16 bp, H. sapiens
tgcttaataaacattt

SEQ ID NO: 149048 - DNA, 16 bp, H. sapiens
tgcttaataaatactt

SEQ ID NO: 149049 - DNA, 16 bp, H. sapiens
tgcttaataaatatct

SEQ ID NO: 149050 - DNA, 16 bp, H. sapiens
tgcttaataaatgtta

SEQ ID NO: 149051 - DNA, 16 bp, H. sapiens
tgcttaataaatgttg

SEQ ID NO: 149052 - DNA, 16 bp, H. sapiens
tgcttaatggtgtccc

SEQ ID NO: 149053 - DNA, 16 bp, H. sapiens
tgcttaattctgtgtt

SEQ ID NO: 149054 - DNA, 16 bp, H. sapiens
tgcttaattttcatgt

SEQ ID NO: 149055 - DNA, 16 bp, H. sapiens
tgcttactgcagcctt

SEQ ID NO: 149056 - DNA, 16 bp, H. sapiens
tgcttagaaaattctt

SEQ ID NO: 149057 - DNA, 16 bp, H. sapiens
tgcttagaaatttctt

SEQ ID NO: 149058 - DNA, 16 bp, H. sapiens
tgcttagtaaatactt

SEQ ID NO: 149059 - DNA, 16 bp, H. sapiens
tgcttagtgaaagaag

SEQ ID NO: 149060 - DNA, 16 bp, H. sapiens
tgcttataatcccagc

SEQ ID NO: 149061 - DNA, 16 bp, H. sapiens
tgcttatatgtcttct

SEQ ID NO: 149062 - DNA, 16 bp, H. sapiens
tgcttatcaagttgct

SEQ ID NO: 149063 - DNA, 16 bp, H. sapiens
tgcttatctttttaaa

SEQ ID NO: 149064 - DNA, 16 bp, H. sapiens
tgcttattggctattt

SEQ ID NO: 149065 - DNA, 16 bp, H. sapiens
tgcttatttaaatatt

SEQ ID NO: 149066 - DNA, 16 bp, H. sapiens
tgcttatttctgtgaa

SEQ ID NO: 149067 - DNA, 16 bp, H. sapiens
tgcttattttacagat

SEQ ID NO: 149068 - DNA, 16 bp, H. sapiens
tgcttatttttaaaat

SEQ ID NO: 149069 - DNA, 16 bp, H. sapiens
tgcttatttttgtcaa

SEQ ID NO: 149070 - DNA, 16 bp, H. sapiens
tgcttatttttttcca

SEQ ID NO: 149071 - DNA, 16 bp, H. sapiens
tgcttcaaaaaaaaaa

SEQ ID NO: 149072 - DNA, 16 bp, H. sapiens
tgcttcaacttcccaa

SEQ ID NO: 149073 - DNA, 16 bp, H. sapiens
tgcttcaagtgccaga

SEQ ID NO: 149074 - DNA, 16 bp, H. sapiens
tgcttcacatccttgc

SEQ ID NO: 149075 - DNA, 16 bp, H. sapiens
tgcttcaccttctgcc

SEQ ID NO: 149076 - DNA, 16 bp, H. sapiens
tgcttcactgtcttct

SEQ ID NO: 149077 - DNA, 17 bp, H. sapiens
tgcttcagcacaagtgt

SEQ ID NO: 149078 - DNA, 17 bp, H. sapiens
tgcttcagcctcccgag

SEQ ID NO: 149079 - DNA, 16 bp, H. sapiens
tgcttcagcctcctca

SEQ ID NO: 149080 - DNA, 16 bp, H. sapiens
tgcttcagcttcctca

SEQ ID NO: 149081 - DNA, 16 bp, H. sapiens
tgcttcaggggcagag

SEQ ID NO: 149082 - DNA, 16 bp, H. sapiens
tgcttcagtgaacata

SEQ ID NO: 149083 - DNA, 16 bp, H. sapiens
tgcttcagtttcctga

SEQ ID NO: 149084 - DNA, 16 bp, H. sapiens
tgcttcagtttcttta

SEQ ID NO: 149085 - DNA, 16 bp, H. sapiens
tgcttcatgaaaaaaa

SEQ ID NO: 149086 - DNA, 16 bp, H. sapiens
tgcttcattcaggagc

SEQ ID NO: 149087 - DNA, 16 bp, H. sapiens
tgcttccagctgcttc

SEQ ID NO: 149088 - DNA, 16 bp, H. sapiens
tgcttccatattttgg

SEQ ID NO: 149089 - DNA, 16 bp, H. sapiens
tgcttccatcttttgc

SEQ ID NO: 149090 - DNA, 16 bp, H. sapiens
tgcttccattgtcaca

SEQ ID NO: 149091 - DNA, 16 bp, H. sapiens
tgcttcccatgtaact

SEQ ID NO: 149092 - DNA, 16 bp, H. sapiens
tgcttccccttcaccc

SEQ ID NO: 149093 - DNA, 16 bp, H. sapiens
tgcttccccttctacc

SEQ ID NO: 149094 - DNA, 16 bp, H. sapiens
tgcttccccttctgcc

SEQ ID NO: 149095 - DNA, 16 bp, H. sapiens
tgcttccccttttgcc

SEQ ID NO: 149096 - DNA, 16 bp, H. sapiens
tgcttcctctcattct

SEQ ID NO: 149097 - DNA, 16 bp, H. sapiens
tgcttcctctctcacc

SEQ ID NO: 149098 - DNA, 16 bp, H. sapiens
tgcttcctcttccacc

SEQ ID NO: 149099 - DNA, 16 bp, H. sapiens
tgcttcctcttcctgc

SEQ ID NO: 149100 - DNA, 16 bp, H. sapiens
tgcttcctgccctcca

SEQ ID NO: 149101 - DNA, 16 bp, H. sapiens
tgcttcctgccctctg

SEQ ID NO: 149102 - DNA, 16 bp, H. sapiens
tgcttcctgggaggtg

SEQ ID NO: 149103 - DNA, 16 bp, H. sapiens
tgcttcctggtttgca

SEQ ID NO: 149104 - DNA, 16 bp, H. sapiens
tgcttcctgtaaagcc

SEQ ID NO: 149105 - DNA, 16 bp, H. sapiens
tgcttcctgtcctcaa

SEQ ID NO: 149106 - DNA, 16 bp, H. sapiens
tgcttccttagcttcc

SEQ ID NO: 149107 - DNA, 16 bp, H. sapiens
tgcttccttgcttcct

SEQ ID NO: 149108 - DNA, 16 bp, H. sapiens
tgcttctaaccaacag

SEQ ID NO: 149109 - DNA, 16 bp, H. sapiens
tgcttctcatggatga

SEQ ID NO: 149110 - DNA, 16 bp, H. sapiens
tgcttctccatttctt

SEQ ID NO: 149111 - DNA, 16 bp, H. sapiens
tgcttctccttctgcc

SEQ ID NO: 149112 - DNA, 16 bp, H. sapiens
tgcttctctccaccca

SEQ ID NO: 149113 - DNA, 16 bp, H. sapiens
tgcttctcttttaatt

SEQ ID NO: 149114 - DNA, 16 bp, H. sapiens
tgcttctgatcacaga

SEQ ID NO: 149115 - DNA, 16 bp, H. sapiens
tgcttctgctgctgct

SEQ ID NO: 149116 - DNA, 16 bp, H. sapiens
tgcttctgggtggggc

SEQ ID NO: 149117 - DNA, 16 bp, H. sapiens
tgcttctgtctggttt

SEQ ID NO: 149118 - DNA, 16 bp, H. sapiens
tgcttctgtgtatttt

SEQ ID NO: 149119 - DNA, 16 bp, H. sapiens
tgcttctgtttatatg

SEQ ID NO: 149120 - DNA, 16 bp, H. sapiens
tgcttcttaattcagt

SEQ ID NO: 149121 - DNA, 16 bp, H. sapiens
tgcttcttctacatct

SEQ ID NO: 149122 - DNA, 16 bp, H. sapiens
tgcttctttttccatt

SEQ ID NO: 149123 - DNA, 16 bp, H. sapiens
tgcttgaaccaaggag

SEQ ID NO: 149124 - DNA, 16 bp, H. sapiens
tgcttgaaccaggacc

SEQ ID NO: 149125 - DNA, 16 bp, H. sapiens
tgcttgaaccaggaga

SEQ ID NO: 149126 - DNA, 16 bp, H. sapiens
tgcttgaacccagagg

SEQ ID NO: 149127 - DNA, 16 bp, H. sapiens
tgcttgaacccaggag

SEQ ID NO: 149128 - DNA, 16 bp, H. sapiens
tgcttgaacccgggag

SEQ ID NO: 149129 - DNA, 16 bp, H. sapiens
tgcttgaacccgggga

SEQ ID NO: 149130 - DNA, 16 bp, H. sapiens
tgcttgaacccggggg

SEQ ID NO: 149131 - DNA, 16 bp, H. sapiens
tgcttgaactcagaag

SEQ ID NO: 149132 - DNA, 16 bp, H. sapiens
tgcttgaactcatgag

SEQ ID NO: 149133 - DNA, 16 bp, H. sapiens
tgcttgaacttgagag

SEQ ID NO: 149134 - DNA, 16 bp, H. sapiens
tgcttgaagccaggag

SEQ ID NO: 149135 - DNA, 16 bp, H. sapiens
tgcttgaccaagccac

SEQ ID NO: 149136 - DNA, 16 bp, H. sapiens
tgcttgagaccgggag

SEQ ID NO: 149137 - DNA, 16 bp, H. sapiens
tgcttgagccaaggaa

SEQ ID NO: 149138 - DNA, 16 bp, H. sapiens
tgcttgagccaggagg

SEQ ID NO: 149139 - DNA, 16 bp, H. sapiens
tgcttgagcccaggac

SEQ ID NO: 149140 - DNA, 16 bp, H. sapiens
tgcttgagcccatgag

SEQ ID NO: 149141 - DNA, 16 bp, H. sapiens
tgcttgagcccggcag

SEQ ID NO: 149142 - DNA, 16 bp, H. sapiens
tgcttgagccctgaag

SEQ ID NO: 149143 - DNA, 16 bp, H. sapiens
tgcttgagccctggag

SEQ ID NO: 149144 - DNA, 16 bp, H. sapiens
tgcttgagcctaggtg

SEQ ID NO: 149145 - DNA, 16 bp, H. sapiens
tgcttgagcctgagag

SEQ ID NO: 149146 - DNA, 16 bp, H. sapiens
tgcttgagctgggagg

SEQ ID NO: 149147 - DNA, 16 bp, H. sapiens
tgcttgagcttgggag

SEQ ID NO: 149148 - DNA, 16 bp, H. sapiens
tgcttgaggagagaag

SEQ ID NO: 149149 - DNA, 16 bp, H. sapiens
tgcttgaggccaagaa

SEQ ID NO: 149150 - DNA, 16 bp, H. sapiens
tgcttgaggccaagag

SEQ ID NO: 149151 - DNA, 16 bp, H. sapiens
tgcttgaggtattttg

SEQ ID NO: 149152 - DNA, 16 bp, H. sapiens
tgcttgagtccagaaa

SEQ ID NO: 149153 - DNA, 16 bp, H. sapiens
tgcttgagtgatgggt

SEQ ID NO: 149154 - DNA, 16 bp, H. sapiens
tgcttgataaatatta

SEQ ID NO: 149155 - DNA, 16 bp, H. sapiens
tgcttgataaatattc

SEQ ID NO: 149156 - DNA, 16 bp, H. sapiens
tgcttgattttccaaa

SEQ ID NO: 149157 - DNA, 16 bp, H. sapiens
tgcttgcagatgatat

SEQ ID NO: 149158 - DNA, 16 bp, H. sapiens
tgcttgcagccaggag

SEQ ID NO: 149159 - DNA, 16 bp, H. sapiens
tgcttgcagtgcagcc

SEQ ID NO: 149160 - DNA, 16 bp, H. sapiens
tgcttgcctcagcctc

SEQ ID NO: 149161 - DNA, 16 bp, H. sapiens
tgcttgctctgtctct

SEQ ID NO: 149162 - DNA, 16 bp, H. sapiens
tgcttgctgtgtgcca

SEQ ID NO: 149163 - DNA, 16 bp, H. sapiens
tgcttgcttgcttgct

SEQ ID NO: 149164 - DNA, 16 bp, H. sapiens
tgcttgcttgctttcc

SEQ ID NO: 149165 - DNA, 16 bp, H. sapiens
tgcttgctttctcagc

SEQ ID NO: 149166 - DNA, 16 bp, H. sapiens
tgcttggcacacagca

SEQ ID NO: 149167 - DNA, 16 bp, H. sapiens
tgcttggctcagagcc

SEQ ID NO: 149168 - DNA, 16 bp, H. sapiens
tgcttggcttctgagg

SEQ ID NO: 149169 - DNA, 16 bp, H. sapiens
tgcttggtgttctctg

SEQ ID NO: 149170 - DNA, 16 bp, H. sapiens
tgcttggttaattttt

SEQ ID NO: 149171 - DNA, 16 bp, H. sapiens
tgcttggtttaatgct

SEQ ID NO: 149172 - DNA, 16 bp, H. sapiens
tgcttggtttatttca

SEQ ID NO: 149173 - DNA, 16 bp, H. sapiens
tgcttgtaatccagca

SEQ ID NO: 149174 - DNA, 16 bp, H. sapiens
tgcttgtaattccagc

SEQ ID NO: 149175 - DNA, 16 bp, H. sapiens
tgcttgtagtcccacc

SEQ ID NO: 149176 - DNA, 16 bp, H. sapiens
tgcttgtagttctcaa

SEQ ID NO: 149177 - DNA, 16 bp, H. sapiens
tgcttgtattttaaaa

SEQ ID NO: 149178 - DNA, 16 bp, H. sapiens
tgcttgtctgaaaata

SEQ ID NO: 149179 - DNA, 16 bp, H. sapiens
tgcttgtgaggagctg

SEQ ID NO: 149180 - DNA, 16 bp, H. sapiens
tgcttgtgcccaggag

SEQ ID NO: 149181 - DNA, 21 bp, H. sapiens
tgcttgtgtttcaccaggaga

SEQ ID NO: 149182 - DNA, 16 bp, H. sapiens
tgcttgtgtttctcca

SEQ ID NO: 149183 - DNA, 16 bp, H. sapiens
tgcttgtgtttttgca

SEQ ID NO: 149184 - DNA, 16 bp, H. sapiens
tgcttgttgaatgaat

SEQ ID NO: 149185 - DNA, 16 bp, H. sapiens
tgcttgttgagttgtt

SEQ ID NO: 149186 - DNA, 16 bp, H. sapiens
tgcttgttttttgtca

SEQ ID NO: 149187 - DNA, 16 bp, H. sapiens
tgctttaaaaaacaaa

SEQ ID NO: 149188 - DNA, 16 bp, H. sapiens
tgctttaaaaaataaa

SEQ ID NO: 149189 - DNA, 16 bp, H. sapiens
tgctttaaaaagatta

SEQ ID NO: 149190 - DNA, 16 bp, H. sapiens
tgctttaaaaatcttt

SEQ ID NO: 149191 - DNA, 16 bp, H. sapiens
tgctttaaaaatttta

SEQ ID NO: 149192 - DNA, 16 bp, H. sapiens
tgctttaaagaaaata

SEQ ID NO: 149193 - DNA, 16 bp, H. sapiens
tgctttaattttcatt

SEQ ID NO: 149194 - DNA, 16 bp, H. sapiens
tgctttacaaaaagtt

SEQ ID NO: 149195 - DNA, 16 bp, H. sapiens
tgctttacatgcatta

SEQ ID NO: 149196 - DNA, 16 bp, H. sapiens
tgctttacatgtgtta

SEQ ID NO: 149197 - DNA, 16 bp, H. sapiens
tgctttactcagtcta

SEQ ID NO: 149198 - DNA, 16 bp, H. sapiens
tgctttagctattcag

SEQ ID NO: 149199 - DNA, 16 bp, H. sapiens
tgctttagctgcattc

SEQ ID NO: 149200 - DNA, 16 bp, H. sapiens
tgctttatatatttga

SEQ ID NO: 149201 - DNA, 16 bp, H. sapiens
tgctttatgtatatta

SEQ ID NO: 149202 - DNA, 16 bp, H. sapiens
tgctttattctttcct

SEQ ID NO: 149203 - DNA, 16 bp, H. sapiens
tgctttattgctaaaa

SEQ ID NO: 149204 - DNA, 16 bp, H. sapiens
tgctttattttctcca

SEQ ID NO: 149205 - DNA, 16 bp, H. sapiens
tgctttcaaggagctc

SEQ ID NO: 149206 - DNA, 16 bp, H. sapiens
tgctttcaatattttt

SEQ ID NO: 149207 - DNA, 16 bp, H. sapiens
tgctttcagaattttt

SEQ ID NO: 149208 - DNA, 16 bp, H. sapiens
tgctttcagcttttcc

SEQ ID NO: 149209 - DNA, 16 bp, H. sapiens
tgctttcagtgtttta

SEQ ID NO: 149210 - DNA, 16 bp, H. sapiens
tgctttcagttttgtt

SEQ ID NO: 149211 - DNA, 16 bp, H. sapiens
tgctttcagtttttcc

SEQ ID NO: 149212 - DNA, 16 bp, H. sapiens
tgctttcattgcttca

SEQ ID NO: 149213 - DNA, 16 bp, H. sapiens
tgctttccacaggggc

SEQ ID NO: 149214 - DNA, 16 bp, H. sapiens
tgctttccagagagca

SEQ ID NO: 149215 - DNA, 16 bp, H. sapiens
tgctttccagcctggg

SEQ ID NO: 149216 - DNA, 16 bp, H. sapiens
tgctttccccatttct

SEQ ID NO: 149217 - DNA, 16 bp, H. sapiens
tgctttcctgcttaga

SEQ ID NO: 149218 - DNA, 16 bp, H. sapiens
tgctttccttctggga

SEQ ID NO: 149219 - DNA, 16 bp, H. sapiens
tgctttccttttaaaa

SEQ ID NO: 149220 - DNA, 16 bp, H. sapiens
tgctttctctctcctg

SEQ ID NO: 149221 - DNA, 16 bp, H. sapiens
tgctttctctcttgcc

SEQ ID NO: 149222 - DNA, 16 bp, H. sapiens
tgctttctcttgaatg

SEQ ID NO: 149223 - DNA, 16 bp, H. sapiens
tgctttctgccatgac

SEQ ID NO: 149224 - DNA, 16 bp, H. sapiens
tgctttctgccatgat

SEQ ID NO: 149225 - DNA, 16 bp, H. sapiens
tgctttctgccatgtg

SEQ ID NO: 149226 - DNA, 16 bp, H. sapiens
tgctttctgcctctgt

SEQ ID NO: 149227 - DNA, 16 bp, H. sapiens
tgctttctgtctctac

SEQ ID NO: 149228 - DNA, 16 bp, H. sapiens
tgctttcttaatttct

SEQ ID NO: 149229 - DNA, 16 bp, H. sapiens
tgctttcttaatttta

SEQ ID NO: 149230 - DNA, 16 bp, H. sapiens
tgctttctttcctcca

SEQ ID NO: 149231 - DNA, 16 bp, H. sapiens
tgctttgaaaatattt

SEQ ID NO: 149232 - DNA, 16 bp, H. sapiens
tgctttgaaatatttg

SEQ ID NO: 149233 - DNA, 16 bp, H. sapiens
tgctttgaggaattga

SEQ ID NO: 149234 - DNA, 16 bp, H. sapiens
tgctttgattgtgttt

SEQ ID NO: 149235 - DNA, 16 bp, H. sapiens
tgctttgcacatagta

SEQ ID NO: 149236 - DNA, 16 bp, H. sapiens
tgctttgcatgtatta

SEQ ID NO: 149237 - DNA, 16 bp, H. sapiens
tgctttgccttctgcc

SEQ ID NO: 149238 - DNA, 16 bp, H. sapiens
tgctttgctgggggga

SEQ ID NO: 149239 - DNA, 16 bp, H. sapiens
tgctttgctttttaaa

SEQ ID NO: 149240 - DNA, 16 bp, H. sapiens
tgctttggccaatgga

SEQ ID NO: 149241 - DNA, 16 bp, H. sapiens
tgctttggctgcctgt

SEQ ID NO: 149242 - DNA, 16 bp, H. sapiens
tgctttgggaagctga

SEQ ID NO: 149243 - DNA, 16 bp, H. sapiens
tgctttgggaagtatg

SEQ ID NO: 149244 - DNA, 16 bp, H. sapiens
tgctttgggaggccaa

SEQ ID NO: 149245 - DNA, 16 bp, H. sapiens
tgctttgggcagtatt

SEQ ID NO: 149246 - DNA, 16 bp, H. sapiens
tgctttggggagtatg

SEQ ID NO: 149247 - DNA, 16 bp, H. sapiens
tgctttggtaagaagc

SEQ ID NO: 149248 - DNA, 16 bp, H. sapiens
tgctttgtaacttttt

SEQ ID NO: 149249 - DNA, 16 bp, H. sapiens
tgctttgtatattttg

SEQ ID NO: 149250 - DNA, 16 bp, H. sapiens
tgctttgtcacccaag

SEQ ID NO: 149251 - DNA, 16 bp, H. sapiens
tgctttgtctctgctg

SEQ ID NO: 149252 - DNA, 16 bp, H. sapiens
tgctttgtctcttcag

SEQ ID NO: 149253 - DNA, 16 bp, H. sapiens
tgctttgtgatgggtg

SEQ ID NO: 149254 - DNA, 16 bp, H. sapiens
tgctttgtgcattttg

SEQ ID NO: 149255 - DNA, 16 bp, H. sapiens
tgctttgtgcctcagt

SEQ ID NO: 149256 - DNA, 16 bp, H. sapiens
tgctttgtggttatca

SEQ ID NO: 149257 - DNA, 16 bp, H. sapiens
tgctttgttccccagg

SEQ ID NO: 149258 - DNA, 16 bp, H. sapiens
tgctttgtttcattaa

SEQ ID NO: 149259 - DNA, 16 bp, H. sapiens
tgcttttaaaaaaaaa

SEQ ID NO: 149260 - DNA, 16 bp, H. sapiens
tgcttttaaaaagaga

SEQ ID NO: 149261 - DNA, 16 bp, H. sapiens
tgcttttaaaaagatt

SEQ ID NO: 149262 - DNA, 16 bp, H. sapiens
tgcttttaaaattctt

SEQ ID NO: 149263 - DNA, 16 bp, H. sapiens
tgcttttaaaatttct

SEQ ID NO: 149264 - DNA, 16 bp, H. sapiens
tgcttttaatggcaaa

SEQ ID NO: 149265 - DNA, 16 bp, H. sapiens
tgcttttaattttaaa

SEQ ID NO: 149266 - DNA, 16 bp, H. sapiens
tgcttttatattttaa

SEQ ID NO: 149267 - DNA, 16 bp, H. sapiens
tgcttttatcactttg

SEQ ID NO: 149268 - DNA, 16 bp, H. sapiens
tgcttttatgagtttg

SEQ ID NO: 149269 - DNA, 16 bp, H. sapiens
tgcttttatggtagca

SEQ ID NO: 149270 - DNA, 16 bp, H. sapiens
tgcttttattgatttg

SEQ ID NO: 149271 - DNA, 16 bp, H. sapiens
tgcttttattgcaatt

SEQ ID NO: 149272 - DNA, 16 bp, H. sapiens
tgcttttattgcccag

SEQ ID NO: 149273 - DNA, 16 bp, H. sapiens
tgcttttatttcctta

SEQ ID NO: 149274 - DNA, 16 bp, H. sapiens
tgcttttattttgaaa

SEQ ID NO: 149275 - DNA, 16 bp, H. sapiens
tgcttttcataatttt

SEQ ID NO: 149276 - DNA, 16 bp, H. sapiens
tgcttttcattcattt

SEQ ID NO: 149277 - DNA, 16 bp, H. sapiens
tgcttttcatttccat

SEQ ID NO: 149278 - DNA, 16 bp, H. sapiens
tgcttttcattttaag

SEQ ID NO: 149279 - DNA, 16 bp, H. sapiens
tgcttttccagttctt

SEQ ID NO: 149280 - DNA, 16 bp, H. sapiens
tgcttttcctgtatct

SEQ ID NO: 149281 - DNA, 16 bp, H. sapiens
tgcttttccttctgcc

SEQ ID NO: 149282 - DNA, 16 bp, H. sapiens
tgcttttctatacaat

SEQ ID NO: 149283 - DNA, 16 bp, H. sapiens
tgcttttctcttgctg

SEQ ID NO: 149284 - DNA, 16 bp, H. sapiens
tgcttttctgaatttt

SEQ ID NO: 149285 - DNA, 16 bp, H. sapiens
tgcttttcttcattct

SEQ ID NO: 149286 - DNA, 16 bp, H. sapiens
tgcttttctttataat

SEQ ID NO: 149287 - DNA, 16 bp, H. sapiens
tgcttttgagattttc

SEQ ID NO: 149288 - DNA, 16 bp, H. sapiens
tgcttttgatattaat

SEQ ID NO: 149289 - DNA, 16 bp, H. sapiens
tgcttttgatgtgcat

SEQ ID NO: 149290 - DNA, 16 bp, H. sapiens
tgcttttgatttgcat

SEQ ID NO: 149291 - DNA, 16 bp, H. sapiens
tgcttttgcaccattg

SEQ ID NO: 149292 - DNA, 16 bp, H. sapiens
tgcttttgcacctttg

SEQ ID NO: 149293 - DNA, 16 bp, H. sapiens
tgcttttgctttgact

SEQ ID NO: 149294 - DNA, 16 bp, H. sapiens
tgcttttgcttttaca

SEQ ID NO: 149295 - DNA, 16 bp, H. sapiens
tgcttttggcagtatg

SEQ ID NO: 149296 - DNA, 16 bp, H. sapiens
tgcttttggtgatttt

SEQ ID NO: 149297 - DNA, 16 bp, H. sapiens
tgcttttggtgtcttc

SEQ ID NO: 149298 - DNA, 16 bp, H. sapiens
tgcttttgttgcttca

SEQ ID NO: 149299 - DNA, 16 bp, H. sapiens
tgctttttaaaaaaca

SEQ ID NO: 149300 - DNA, 16 bp, H. sapiens
tgctttttaaaaaata

SEQ ID NO: 149301 - DNA, 16 bp, H. sapiens
tgctttttaaaaaatt

SEQ ID NO: 149302 - DNA, 16 bp, H. sapiens
tgctttttaaaaatat

SEQ ID NO: 149303 - DNA, 16 bp, H. sapiens
tgctttttaaaaatca

SEQ ID NO: 149304 - DNA, 16 bp, H. sapiens
tgctttttaaaataaa

SEQ ID NO: 149305 - DNA, 16 bp, H. sapiens
tgctttttaaaattta

SEQ ID NO: 149306 - DNA, 16 bp, H. sapiens
tgctttttaaaatttt

SEQ ID NO: 149307 - DNA, 16 bp, H. sapiens
tgctttttaaataaaa

SEQ ID NO: 149308 - DNA, 16 bp, H. sapiens
tgctttttaaatattt

SEQ ID NO: 149309 - DNA, 16 bp, H. sapiens
tgctttttattaaaag

SEQ ID NO: 149310 - DNA, 16 bp, H. sapiens
tgctttttcacatttg

SEQ ID NO: 149311 - DNA, 16 bp, H. sapiens
tgctttttcctctgcc

SEQ ID NO: 149312 - DNA, 16 bp, H. sapiens
tgctttttctataaaa

SEQ ID NO: 149313 - DNA, 16 bp, H. sapiens
tgctttttctgtatcc

SEQ ID NO: 149314 - DNA, 16 bp, H. sapiens
tgctttttgcaaccaa

SEQ ID NO: 149315 - DNA, 16 bp, H. sapiens
tgctttttgttttgga

SEQ ID NO: 149316 - DNA, 16 bp, H. sapiens
tgcttttttaaaaaaa

SEQ ID NO: 149317 - DNA, 16 bp, H. sapiens
tgcttttttcttgcta

SEQ ID NO: 149318 - DNA, 17 bp, H. sapiens
tgcttttttcttgtaaa

SEQ ID NO: 149319 - DNA, 16 bp, H. sapiens
tgcttttttgaaagga

SEQ ID NO: 149320 - DNA, 16 bp, H. sapiens
tgcttttttgacttag

SEQ ID NO: 149321 - DNA, 16 bp, H. sapiens
tggaaaaaaaattcca

SEQ ID NO: 149322 - DNA, 16 bp, H. sapiens
tggaaaaaaacaagga

SEQ ID NO: 149323 - DNA, 16 bp, H. sapiens
tggaaaaaaatcaaca

SEQ ID NO: 149324 - DNA, 16 bp, H. sapiens
tggaaaaaaatgtgaa

SEQ ID NO: 149325 - DNA, 16 bp, H. sapiens
tggaaaaaaattacaa

SEQ ID NO: 149326 - DNA, 16 bp, H. sapiens
tggaaaaaaattctaa

SEQ ID NO: 149327 - DNA, 37 bp, H. sapiens
tggaaaaaactactttcaagttcatatggaaccaaaa

SEQ ID NO: 149328 - DNA, 16 bp, H. sapiens
tggaaaaaatatgtat

SEQ ID NO: 149329 - DNA, 16 bp, H. sapiens
tggaaaaaatgctcaa

SEQ ID NO: 149330 - DNA, 16 bp, H. sapiens
tggaaaaacaggacac

SEQ ID NO: 149331 - DNA, 16 bp, H. sapiens
tggaaaaacataaaga

SEQ ID NO: 149332 - DNA, 16 bp, H. sapiens
tggaaaaacattctgt

SEQ ID NO: 149333 - DNA, 16 bp, H. sapiens
tggaaaaacctttcta

SEQ ID NO: 149334 - DNA, 16 bp, H. sapiens
tggaaaaactgtattt

SEQ ID NO: 149335 - DNA, 16 bp, H. sapiens
tggaaaaactgttttg

SEQ ID NO: 149336 - DNA, 16 bp, H. sapiens
tggaaaaactgttttt

SEQ ID NO: 149337 - DNA, 16 bp, H. sapiens
tggaaaaagaaaaact

SEQ ID NO: 149338 - DNA, 16 bp, H. sapiens
tggaaaaagaagaatt

SEQ ID NO: 149339 - DNA, 16 bp, H. sapiens
tggaaaaagagggaat

SEQ ID NO: 149340 - DNA, 16 bp, H. sapiens
tggaaaaagcaaaata

SEQ ID NO: 149341 - DNA, 16 bp, H. sapiens
tggaaaaaggaaatat

SEQ ID NO: 149342 - DNA, 16 bp, H. sapiens
tggaaaaagtatttta

SEQ ID NO: 149343 - DNA, 16 bp, H. sapiens
tggaaaaataaagcag

SEQ ID NO: 149344 - DNA, 16 bp, H. sapiens
tggaaaaatattcaag

SEQ ID NO: 149345 - DNA, 16 bp, H. sapiens
tggaaaaatattttct

SEQ ID NO: 149346 - DNA, 16 bp, H. sapiens
tggaaaaatcaatatt

SEQ ID NO: 149347 - DNA, 16 bp, H. sapiens
tggaaaaatcctcaac

SEQ ID NO: 149348 - DNA, 16 bp, H. sapiens
tggaaaaatccttcta

SEQ ID NO: 149349 - DNA, 16 bp, H. sapiens
tggaaaaatctaaaga

SEQ ID NO: 149350 - DNA, 16 bp, H. sapiens
tggaaaaatgaaatat

SEQ ID NO: 149351 - DNA, 16 bp, H. sapiens
tggaaaaatgaggtgg

SEQ ID NO: 149352 - DNA, 16 bp, H. sapiens
tggaaaaattgtctcc

SEQ ID NO: 149353 - DNA, 16 bp, H. sapiens
tggaaaaattgtcttc

SEQ ID NO: 149354 - DNA, 16 bp, H. sapiens
tggaaaaatttgaata

SEQ ID NO: 149355 - DNA, 16 bp, H. sapiens
tggaaaaatttttaaa

SEQ ID NO: 149356 - DNA, 16 bp, H. sapiens
tggaaaacaaaacatt

SEQ ID NO: 149357 - DNA, 16 bp, H. sapiens
tggaaaacaaatgaaa

SEQ ID NO: 149358 - DNA, 16 bp, H. sapiens
tggaaaacaacatgga

SEQ ID NO: 149359 - DNA, 16 bp, H. sapiens
tggaaaacaatgaaaa

SEQ ID NO: 149360 - DNA, 16 bp, H. sapiens
tggaaaacaatttttc

SEQ ID NO: 149361 - DNA, 16 bp, H. sapiens
tggaaaacaatttttt

SEQ ID NO: 149362 - DNA, 16 bp, H. sapiens
tggaaaacacatttca

SEQ ID NO: 149363 - DNA, 17 bp, H. sapiens
tggaaaacactcttcag

SEQ ID NO: 149364 - DNA, 16 bp, H. sapiens
tggaaaacagaagaaa

SEQ ID NO: 149365 - DNA, 16 bp, H. sapiens
tggaaaacagaatgga

SEQ ID NO: 149366 - DNA, 16 bp, H. sapiens
tggaaaacagaatggt

SEQ ID NO: 149367 - DNA, 16 bp, H. sapiens
tggaaaacagtaggaa

SEQ ID NO: 149368 - DNA, 16 bp, H. sapiens
tggaaaacagtatggc

SEQ ID NO: 149369 - DNA, 16 bp, H. sapiens
tggaaaacagtatttt

SEQ ID NO: 149370 - DNA, 16 bp, H. sapiens
tggaaaacagtttaat

SEQ ID NO: 149371 - DNA, 16 bp, H. sapiens
tggaaaacagtttggc

SEQ ID NO: 149372 - DNA, 16 bp, H. sapiens
tggaaaacatagaaga

SEQ ID NO: 149373 - DNA, 19 bp, H. sapiens
tggaaaacatcattctcag

SEQ ID NO: 149374 - DNA, 16 bp, H. sapiens
tggaaaacatggaaaa

SEQ ID NO: 149375 - DNA, 16 bp, H. sapiens
tggaaaacattaaaaa

SEQ ID NO: 149376 - DNA, 16 bp, H. sapiens
tggaaaacattttaaa

SEQ ID NO: 149377 - DNA, 16 bp, H. sapiens
tggaaaacattttgaa

SEQ ID NO: 149378 - DNA, 16 bp, H. sapiens
tggaaaaccaaatatt

SEQ ID NO: 149379 - DNA, 16 bp, H. sapiens
tggaaaacctaaaaga

SEQ ID NO: 149380 - DNA, 16 bp, H. sapiens
tggaaaacctggaaga

SEQ ID NO: 149381 - DNA, 16 bp, H. sapiens
tggaaaactatttggc

SEQ ID NO: 149382 - DNA, 16 bp, H. sapiens
tggaaaactggtgaca

SEQ ID NO: 149383 - DNA, 16 bp, H. sapiens
tggaaaagaaaacaga

SEQ ID NO: 149384 - DNA, 16 bp, H. sapiens
tggaaaagaaaatgtg

SEQ ID NO: 149385 - DNA, 16 bp, H. sapiens
tggaaaagaaagaaca

SEQ ID NO: 149386 - DNA, 16 bp, H. sapiens
tggaaaagaaatatct

SEQ ID NO: 149387 - DNA, 16 bp, H. sapiens
tggaaaagaacagagg

SEQ ID NO: 149388 - DNA, 16 bp, H. sapiens
tggaaaagacagaaaa

SEQ ID NO: 149389 - DNA, 17 bp, H. sapiens
tggaaaagaggaagtca

SEQ ID NO: 149390 - DNA, 16 bp, H. sapiens
tggaaaagagtgtgga

SEQ ID NO: 149391 - DNA, 16 bp, H. sapiens
tggaaaagcaaaacaa

SEQ ID NO: 149392 - DNA, 16 bp, H. sapiens
tggaaaagcaaaatgt

SEQ ID NO: 149393 - DNA, 16 bp, H. sapiens
tggaaaagcaagaaaa

SEQ ID NO: 149394 - DNA, 16 bp, H. sapiens
tggaaaagcctcagac

SEQ ID NO: 149395 - DNA, 16 bp, H. sapiens
tggaaaagcctgggtg

SEQ ID NO: 149396 - DNA, 16 bp, H. sapiens
tggaaaagctgcaggt

SEQ ID NO: 149397 - DNA, 16 bp, H. sapiens
tggaaaagctttttga

SEQ ID NO: 149398 - DNA, 16 bp, H. sapiens
tggaaaaggaaaaatt

SEQ ID NO: 149399 - DNA, 16 bp, H. sapiens
tggaaaaggaaatata

SEQ ID NO: 149400 - DNA, 16 bp, H. sapiens
tggaaaaggcaaagaa

SEQ ID NO: 149401 - DNA, 16 bp, H. sapiens
tggaaaaggcaaagga

SEQ ID NO: 149402 - DNA, 16 bp, H. sapiens
tggaaaaggcaagaaa

SEQ ID NO: 149403 - DNA, 16 bp, H. sapiens
tggaaaagggaaaact

SEQ ID NO: 149404 - DNA, 16 bp, H. sapiens
tggaaaagggaggagt

SEQ ID NO: 149405 - DNA, 16 bp, H. sapiens
tggaaaagtaaaatat

SEQ ID NO: 149406 - DNA, 16 bp, H. sapiens
tggaaaagtgttccta

SEQ ID NO: 149407 - DNA, 16 bp, H. sapiens
tggaaaagttatttaa

SEQ ID NO: 149408 - DNA, 16 bp, H. sapiens
tggaaaagtttgaaat

SEQ ID NO: 149409 - DNA, 16 bp, H. sapiens
tggaaaataatatttt

SEQ ID NO: 149410 - DNA, 16 bp, H. sapiens
tggaaaataatttgat

SEQ ID NO: 149411 - DNA, 16 bp, H. sapiens
tggaaaatacagaaaa

SEQ ID NO: 149412 - DNA, 16 bp, H. sapiens
tggaaaatacagaaga

SEQ ID NO: 149413 - DNA, 16 bp, H. sapiens
tggaaaatactgaaaa

SEQ ID NO: 149414 - DNA, 16 bp, H. sapiens
tggaaaatagtttgaa

SEQ ID NO: 149415 - DNA, 16 bp, H. sapiens
tggaaaatatatttca

SEQ ID NO: 149416 - DNA, 16 bp, H. sapiens
tggaaaatatctcaaa

SEQ ID NO: 149417 - DNA, 16 bp, H. sapiens
tggaaaatatcttaaa

SEQ ID NO: 149418 - DNA, 16 bp, H. sapiens
tggaaaatattagaaa

SEQ ID NO: 149419 - DNA, 16 bp, H. sapiens
tggaaaatattttaaa

SEQ ID NO: 149420 - DNA, 16 bp, H. sapiens
tggaaaatcacttgaa

SEQ ID NO: 149421 - DNA, 16 bp, H. sapiens
tggaaaatccagaaga

SEQ ID NO: 149422 - DNA, 16 bp, H. sapiens
tggaaaatcccaaaat

SEQ ID NO: 149423 - DNA, 16 bp, H. sapiens
tggaaaatcccagaaa

SEQ ID NO: 149424 - DNA, 16 bp, H. sapiens
tggaaaatcgagtcac

SEQ ID NO: 149425 - DNA, 16 bp, H. sapiens
tggaaaatcgggacac

SEQ ID NO: 149426 - DNA, 16 bp, H. sapiens
tggaaaatctcagcaa

SEQ ID NO: 149427 - DNA, 16 bp, H. sapiens
tggaaaatgaaaatta

SEQ ID NO: 149428 - DNA, 16 bp, H. sapiens
tggaaaatgatgaaaa

SEQ ID NO: 149429 - DNA, 16 bp, H. sapiens
tggaaaatgcaaaact

SEQ ID NO: 149430 - DNA, 16 bp, H. sapiens
tggaaaatgcaaagaa

SEQ ID NO: 149431 - DNA, 16 bp, H. sapiens
tggaaaatgcagagaa

SEQ ID NO: 149432 - DNA, 16 bp, H. sapiens
tggaaaatgcattttt

SEQ ID NO: 149433 - DNA, 16 bp, H. sapiens
tggaaaatggaaaatg

SEQ ID NO: 149434 - DNA, 16 bp, H. sapiens
tggaaaatggaagaga

SEQ ID NO: 149435 - DNA, 16 bp, H. sapiens
tggaaaatggggtatt

SEQ ID NO: 149436 - DNA, 16 bp, H. sapiens
tggaaaattaattatt

SEQ ID NO: 149437 - DNA, 16 bp, H. sapiens
tggaaaattatttaac

SEQ ID NO: 149438 - DNA, 16 bp, H. sapiens
tggaaaattatttcaa

SEQ ID NO: 149439 - DNA, 16 bp, H. sapiens
tggaaaattcaaaaat

SEQ ID NO: 149440 - DNA, 16 bp, H. sapiens
tggaaaatttgcagca

SEQ ID NO: 149441 - DNA, 16 bp, H. sapiens
tggaaaatttgcagtc

SEQ ID NO: 149442 - DNA, 16 bp, H. sapiens
tggaaaattttgaaaa

SEQ ID NO: 149443 - DNA, 16 bp, H. sapiens
tggaaacaaatggaaa

SEQ ID NO: 149444 - DNA, 16 bp, H. sapiens
tggaaacaacccatat

SEQ ID NO: 149445 - DNA, 16 bp, H. sapiens
tggaaacaatccaagt

SEQ ID NO: 149446 - DNA, 16 bp, H. sapiens
tggaaacaatcttttt

SEQ ID NO: 149447 - DNA, 16 bp, H. sapiens
tggaaacacaacatgc

SEQ ID NO: 149448 - DNA, 16 bp, H. sapiens
tggaaacacacacaca

SEQ ID NO: 149449 - DNA, 16 bp, H. sapiens
tggaaacacatcaaaa

SEQ ID NO: 149450 - DNA, 16 bp, H. sapiens
tggaaacactcttctt

SEQ ID NO: 149451 - DNA, 16 bp, H. sapiens
tggaaacactgatttt

SEQ ID NO: 149452 - DNA, 16 bp, H. sapiens
tggaaacacttttttt

SEQ ID NO: 149453 - DNA, 16 bp, H. sapiens
tggaaacagaaaatca

SEQ ID NO: 149454 - DNA, 16 bp, H. sapiens
tggaaacagaagaaaa

SEQ ID NO: 149455 - DNA, 16 bp, H. sapiens
tggaaacagtgttttt

SEQ ID NO: 149456 - DNA, 16 bp, H. sapiens
tggaaacatggatgga

SEQ ID NO: 149457 - DNA, 16 bp, H. sapiens
tggaaacattattttt

SEQ ID NO: 149458 - DNA, 16 bp, H. sapiens
tggaaacattccaaat

SEQ ID NO: 149459 - DNA, 34 bp, H. sapiens
tggaaacattccctttgaaaactggcacaagaca

SEQ ID NO: 149460 - DNA, 16 bp, H. sapiens
tggaaacattcttctt

SEQ ID NO: 149461 - DNA, 16 bp, H. sapiens
tggaaacattttcttt

SEQ ID NO: 149462 - DNA, 16 bp, H. sapiens
tggaaacatttttatt

SEQ ID NO: 149463 - DNA, 16 bp, H. sapiens
tggaaaccaaaaacaa

SEQ ID NO: 149464 - DNA, 16 bp, H. sapiens
tggaaaccaacattct

SEQ ID NO: 149465 - DNA, 16 bp, H. sapiens
tggaaaccactgatct

SEQ ID NO: 149466 - DNA, 16 bp, H. sapiens
tggaaaccactggagt

SEQ ID NO: 149467 - DNA, 16 bp, H. sapiens
tggaaaccagcattct

SEQ ID NO: 149468 - DNA, 16 bp, H. sapiens
tggaaaccatacaaat

SEQ ID NO: 149469 - DNA, 16 bp, H. sapiens
tggaaaccatcattct

SEQ ID NO: 149470 - DNA, 33 bp, H. sapiens
tggaaaccatcattctcagcaaactatcgcaag

SEQ ID NO: 149471 - DNA, 26 bp, H. sapiens
tggaaaccatcattctcagtaaacta

SEQ ID NO: 149472 - DNA, 16 bp, H. sapiens
tggaaacccacctctt

SEQ ID NO: 149473 - DNA, 16 bp, H. sapiens
tggaaacctctgtggc

SEQ ID NO: 149474 - DNA, 16 bp, H. sapiens
tggaaactacccaaat

SEQ ID NO: 149475 - DNA, 16 bp, H. sapiens
tggaaactcagaaatg

SEQ ID NO: 149476 - DNA, 16 bp, H. sapiens
tggaaactgaaaaaga

SEQ ID NO: 149477 - DNA, 16 bp, H. sapiens
tggaaactgaacaaac

SEQ ID NO: 149478 - DNA, 16 bp, H. sapiens
tggaaactgaggcaga

SEQ ID NO: 149479 - DNA, 16 bp, H. sapiens
tggaaactggaagaaa

SEQ ID NO: 149480 - DNA, 16 bp, H. sapiens
tggaaactggacattt

SEQ ID NO: 149481 - DNA, 16 bp, H. sapiens
tggaaacttaattccc

SEQ ID NO: 149482 - DNA, 16 bp, H. sapiens
tggaaacttcctgagg

SEQ ID NO: 149483 - DNA, 16 bp, H. sapiens
tggaaactttgttgaa

SEQ ID NO: 149484 - DNA, 16 bp, H. sapiens
tggaaacttttttttt

SEQ ID NO: 149485 - DNA, 16 bp, H. sapiens
tggaaagaaaaaggca

SEQ ID NO: 149486 - DNA, 16 bp, H. sapiens
tggaaagaaacaaccg

SEQ ID NO: 149487 - DNA, 16 bp, H. sapiens
tggaaagaaacagaaa

SEQ ID NO: 149488 - DNA, 16 bp, H. sapiens
tggaaagaaatatttt

SEQ ID NO: 149489 - DNA, 16 bp, H. sapiens
tggaaagaaatgaaat

SEQ ID NO: 149490 - DNA, 16 bp, H. sapiens
tggaaagaacctaaat

SEQ ID NO: 149491 - DNA, 16 bp, H. sapiens
tggaaagaaggaagtc

SEQ ID NO: 149492 - DNA, 16 bp, H. sapiens
tggaaagaagtttgga

SEQ ID NO: 149493 - DNA, 16 bp, H. sapiens
tggaaagacaaaaaga

SEQ ID NO: 149494 - DNA, 16 bp, H. sapiens
tggaaagagcactgga

SEQ ID NO: 149495 - DNA, 16 bp, H. sapiens
tggaaagagcctgggt

SEQ ID NO: 149496 - DNA, 16 bp, H. sapiens
tggaaagatacaaaaa

SEQ ID NO: 149497 - DNA, 16 bp, H. sapiens
tggaaagatatttcat

SEQ ID NO: 149498 - DNA, 16 bp, H. sapiens
tggaaagatgatgaat

SEQ ID NO: 149499 - DNA, 16 bp, H. sapiens
tggaaagattatcctg

SEQ ID NO: 149500 - DNA, 16 bp, H. sapiens
tggaaagcaaaaaaga

SEQ ID NO: 149501 - DNA, 16 bp, H. sapiens
tggaaagcaaaataaa

SEQ ID NO: 149502 - DNA, 16 bp, H. sapiens
tggaaagcagaaaaaa

SEQ ID NO: 149503 - DNA, 16 bp, H. sapiens
tggaaagcagagaaaa

SEQ ID NO: 149504 - DNA, 16 bp, H. sapiens
tggaaagccactgaag

SEQ ID NO: 149505 - DNA, 16 bp, H. sapiens
tggaaaggaaagatga

SEQ ID NO: 149506 - DNA, 16 bp, H. sapiens
tggaaaggaagaattc

SEQ ID NO: 149507 - DNA, 16 bp, H. sapiens
tggaaaggaatgcaat

SEQ ID NO: 149508 - DNA, 16 bp, H. sapiens
tggaaaggaggaagtc

SEQ ID NO: 149509 - DNA, 16 bp, H. sapiens
tggaaaggaggctgaa

SEQ ID NO: 149510 - DNA, 16 bp, H. sapiens
tggaaagtcactggaa

SEQ ID NO: 149511 - DNA, 16 bp, H. sapiens
tggaaagtctcagcaa

SEQ ID NO: 149512 - DNA, 16 bp, H. sapiens
tggaaagtgtctgttc

SEQ ID NO: 149513 - DNA, 17 bp, H. sapiens
tggaaagtgttgccaca

SEQ ID NO: 149514 - DNA, 16 bp, H. sapiens
tggaaataaaatttct

SEQ ID NO: 149515 - DNA, 16 bp, H. sapiens
tggaaataaacttggt

SEQ ID NO: 149516 - DNA, 16 bp, H. sapiens
tggaaataatttaaat

SEQ ID NO: 149517 - DNA, 16 bp, H. sapiens
tggaaataatttcaaa

SEQ ID NO: 149518 - DNA, 16 bp, H. sapiens
tggaaatacaaaaaat

SEQ ID NO: 149519 - DNA, 16 bp, H. sapiens
tggaaatacaaaatgg

SEQ ID NO: 149520 - DNA, 16 bp, H. sapiens
tggaaatacaggtgtg

SEQ ID NO: 149521 - DNA, 16 bp, H. sapiens
tggaaatactgttttt

SEQ ID NO: 149522 - DNA, 16 bp, H. sapiens
tggaaatagagtcttt

SEQ ID NO: 149523 - DNA, 16 bp, H. sapiens
tggaaatatatatata

SEQ ID NO: 149524 - DNA, 16 bp, H. sapiens
tggaaatatttaaaat

SEQ ID NO: 149525 - DNA, 16 bp, H. sapiens
tggaaatatttcctcc

SEQ ID NO: 149526 - DNA, 16 bp, H. sapiens
tggaaatattttctgt

SEQ ID NO: 149527 - DNA, 16 bp, H. sapiens
tggaaatattttgaaa

SEQ ID NO: 149528 - DNA, 16 bp, H. sapiens
tggaaatcataataaa

SEQ ID NO: 149529 - DNA, 27 bp, H. sapiens
tggaaatcatcattctcagtaaactat

SEQ ID NO: 149530 - DNA, 28 bp, H. sapiens
tggaaatcatcattctcagtaaattatc

SEQ ID NO: 149531 - DNA, 16 bp, H. sapiens
tggaaatcattattct

SEQ ID NO: 149532 - DNA, 16 bp, H. sapiens
tggaaatcattttttt

SEQ ID NO: 149533 - DNA, 16 bp, H. sapiens
tggaaatctacatttt

SEQ ID NO: 149534 - DNA, 16 bp, H. sapiens
tggaaatctatcctca

SEQ ID NO: 149535 - DNA, 16 bp, H. sapiens
tggaaatctggatttt

SEQ ID NO: 149536 - DNA, 16 bp, H. sapiens
tggaaatgaaaataat

SEQ ID NO: 149537 - DNA, 16 bp, H. sapiens
tggaaatgaaagacat

SEQ ID NO: 149538 - DNA, 16 bp, H. sapiens
tggaaatgaaattaaa

SEQ ID NO: 149539 - DNA, 16 bp, H. sapiens
tggaaatgacccaaat

SEQ ID NO: 149540 - DNA, 16 bp, H. sapiens
tggaaatgataaaatt

SEQ ID NO: 149541 - DNA, 16 bp, H. sapiens
tggaaatgcaaaggac

SEQ ID NO: 149542 - DNA, 17 bp, H. sapiens
tggaaatgcagaaatca

SEQ ID NO: 149543 - DNA, 16 bp, H. sapiens
tggaaatgctcttttt

SEQ ID NO: 149544 - DNA, 16 bp, H. sapiens
tggaaatgctgttttt

SEQ ID NO: 149545 - DNA, 16 bp, H. sapiens
tggaaatggaaattca

SEQ ID NO: 149546 - DNA, 16 bp, H. sapiens
tggaaatggaggccat

SEQ ID NO: 149547 - DNA, 16 bp, H. sapiens
tggaaatggaggtcat

SEQ ID NO: 149548 - DNA, 16 bp, H. sapiens
tggaaatggatagtgg

SEQ ID NO: 149549 - DNA, 16 bp, H. sapiens
tggaaatggcttcttt

SEQ ID NO: 149550 - DNA, 16 bp, H. sapiens
tggaaatgggatttct

SEQ ID NO: 149551 - DNA, 16 bp, H. sapiens
tggaaatgtaaaatta

SEQ ID NO: 149552 - DNA, 16 bp, H. sapiens
tggaaatgtaaacttt

SEQ ID NO: 149553 - DNA, 16 bp, H. sapiens
tggaaatgtgattgga

SEQ ID NO: 149554 - DNA, 16 bp, H. sapiens
tggaaatgttctaaag

SEQ ID NO: 149555 - DNA, 16 bp, H. sapiens
tggaaatgttctgttt

SEQ ID NO: 149556 - DNA, 16 bp, H. sapiens
tggaaattaaagaaca

SEQ ID NO: 149557 - DNA, 16 bp, H. sapiens
tggaaattaaatgaaa

SEQ ID NO: 149558 - DNA, 16 bp, H. sapiens
tggaaattaagaaaca

SEQ ID NO: 149559 - DNA, 16 bp, H. sapiens
tggaaattaatggaat

SEQ ID NO: 149560 - DNA, 16 bp, H. sapiens
tggaaattattattat

SEQ ID NO: 149561 - DNA, 16 bp, H. sapiens
tggaaattattttcct

SEQ ID NO: 149562 - DNA, 16 bp, H. sapiens
tggaaattcaagatga

SEQ ID NO: 149563 - DNA, 22 bp, H. sapiens
tggaaattctggccagggcaat

SEQ ID NO: 149564 - DNA, 16 bp, H. sapiens
tggaaattgaacaact

SEQ ID NO: 149565 - DNA, 16 bp, H. sapiens
tggaaatttaaaattt

SEQ ID NO: 149566 - DNA, 16 bp, H. sapiens
tggaaatttccagaaa

SEQ ID NO: 149567 - DNA, 16 bp, H. sapiens
tggaaattttaaaatt

SEQ ID NO: 149568 - DNA, 16 bp, H. sapiens
tggaaattttaaattt

SEQ ID NO: 149569 - DNA, 16 bp, H. sapiens
tggaaattttcagaaa

SEQ ID NO: 149570 - DNA, 16 bp, H. sapiens
tggaacaaaagagaga

SEQ ID NO: 149571 - DNA, 16 bp, H. sapiens
tggaacaagaaaaaga

SEQ ID NO: 149572 - DNA, 16 bp, H. sapiens
tggaacaagaaaagaa

SEQ ID NO: 149573 - DNA, 16 bp, H. sapiens
tggaacaagatgagga

SEQ ID NO: 149574 - DNA, 16 bp, H. sapiens
tggaacaagggaagac

SEQ ID NO: 149575 - DNA, 20 bp, H. sapiens
tggaacacaacagagccctc

SEQ ID NO: 149576 - DNA, 16 bp, H. sapiens
tggaacacagccatgt

SEQ ID NO: 149577 - DNA, 19 bp, H. sapiens
tggaacaccaagctctgtg

SEQ ID NO: 149578 - DNA, 16 bp, H. sapiens
tggaacacccagatat

SEQ ID NO: 149579 - DNA, 16 bp, H. sapiens
tggaacagaaagagaa

SEQ ID NO: 149580 - DNA, 16 bp, H. sapiens
tggaacagaaagagga

SEQ ID NO: 149581 - DNA, 16 bp, H. sapiens
tggaacagaaatagaa

SEQ ID NO: 149582 - DNA, 16 bp, H. sapiens
tggaacagaatacaga

SEQ ID NO: 149583 - DNA, 16 bp, H. sapiens
tggaacagaatagaaa

SEQ ID NO: 149584 - DNA, 16 bp, H. sapiens
tggaacagaatagaga

SEQ ID NO: 149585 - DNA, 16 bp, H. sapiens
tggaacagaatgaaga

SEQ ID NO: 149586 - DNA, 16 bp, H. sapiens
tggaacagagaaagga

SEQ ID NO: 149587 - DNA, 16 bp, H. sapiens
tggaacagattctctc

SEQ ID NO: 149588 - DNA, 16 bp, H. sapiens
tggaacagattctttc

SEQ ID NO: 149589 - DNA, 16 bp, H. sapiens
tggaacagcagcatca

SEQ ID NO: 149590 - DNA, 16 bp, H. sapiens
tggaacagttcctcag

SEQ ID NO: 149591 - DNA, 16 bp, H. sapiens
tggaacagttttatcc

SEQ ID NO: 149592 - DNA, 16 bp, H. sapiens
tggaacatagccacat

SEQ ID NO: 149593 - DNA, 16 bp, H. sapiens
tggaacatgacaagga

SEQ ID NO: 149594 - DNA, 16 bp, H. sapiens
tggaacattctccaga

SEQ ID NO: 149595 - DNA, 16 bp, H. sapiens
tggaacattctctagg

SEQ ID NO: 149596 - DNA, 16 bp, H. sapiens
tggaacatttacaaaa

SEQ ID NO: 149597 - DNA, 25 bp, H. sapiens
tggaaccaaaaaagagcctgcatcg

SEQ ID NO: 149598 - DNA, 16 bp, H. sapiens
tggaaccaaaaagagc

SEQ ID NO: 149599 - DNA, 16 bp, H. sapiens
tggaaccaaaaaggag

SEQ ID NO: 149600 - DNA, 26 bp, H. sapiens
tggaaccaacccaaatgtccaacaac

SEQ ID NO: 149601 - DNA, 16 bp, H. sapiens
tggaaccaacccaatt

SEQ ID NO: 149602 - DNA, 16 bp, H. sapiens
tggaaccaatttggaa

SEQ ID NO: 149603 - DNA, 16 bp, H. sapiens
tggaaccagcccaaat

SEQ ID NO: 149604 - DNA, 16 bp, H. sapiens
tggaaccagcctggcc

SEQ ID NO: 149605 - DNA, 16 bp, H. sapiens
tggaaccccaggaatt

SEQ ID NO: 149606 - DNA, 16 bp, H. sapiens
tggaaccccatctcta

SEQ ID NO: 149607 - DNA, 16 bp, H. sapiens
tggaacccttgtacac

SEQ ID NO: 149608 - DNA, 16 bp, H. sapiens
tggaaccgaaaaagag

SEQ ID NO: 149609 - DNA, 16 bp, H. sapiens
tggaacctcgctctgt

SEQ ID NO: 149610 - DNA, 16 bp, H. sapiens
tggaactacagatgca

SEQ ID NO: 149611 - DNA, 16 bp, H. sapiens
tggaactcctaggctc

SEQ ID NO: 149612 - DNA, 16 bp, H. sapiens
tggaactgagtaatgg

SEQ ID NO: 149613 - DNA, 16 bp, H. sapiens
tggaactgctgggtca

SEQ ID NO: 149614 - DNA, 16 bp, H. sapiens
tggaactggaaatcat

SEQ ID NO: 149615 - DNA, 16 bp, H. sapiens
tggaactgggtagcag

SEQ ID NO: 149616 - DNA, 16 bp, H. sapiens
tggaactgtgagaaga

SEQ ID NO: 149617 - DNA, 16 bp, H. sapiens
tggaactgtgagtgaa

SEQ ID NO: 149618 - DNA, 16 bp, H. sapiens
tggaactgttctgtat

SEQ ID NO: 149619 - DNA, 16 bp, H. sapiens
tggaacttcctggaga

SEQ ID NO: 149620 - DNA, 16 bp, H. sapiens
tggaacttgaacccag

SEQ ID NO: 149621 - DNA, 16 bp, H. sapiens
tggaacttgcccactc

SEQ ID NO: 149622 - DNA, 16 bp, H. sapiens
tggaactttaaaaaat

SEQ ID NO: 149623 - DNA, 16 bp, H. sapiens
tggaactttgtggaat

SEQ ID NO: 149624 - DNA, 16 bp, H. sapiens
tggaagaaaaagaggt

SEQ ID NO: 149625 - DNA, 16 bp, H. sapiens
tggaagaaaacacaga

SEQ ID NO: 149626 - DNA, 16 bp, H. sapiens
tggaagaaaacataga

SEQ ID NO: 149627 - DNA, 16 bp, H. sapiens
tggaagaaaataaagt

SEQ ID NO: 149628 - DNA, 16 bp, H. sapiens
tggaagaaaataattg

SEQ ID NO: 149629 - DNA, 16 bp, H. sapiens
tggaagaaaatgtttt

SEQ ID NO: 149630 - DNA, 16 bp, H. sapiens
tggaagaaacagaaaa

SEQ ID NO: 149631 - DNA, 16 bp, H. sapiens
tggaagaaacttctaa

SEQ ID NO: 149632 - DNA, 16 bp, H. sapiens
tggaagaaagaattca

SEQ ID NO: 149633 - DNA, 16 bp, H. sapiens
tggaagaaagagtatc

SEQ ID NO: 149634 - DNA, 17 bp, H. sapiens
tggaagaaagggtatcg

SEQ ID NO: 149635 - DNA, 17 bp, H. sapiens
tggaagaaagggtgtca

SEQ ID NO: 149636 - DNA, 16 bp, H. sapiens
tggaagaaagtgtatc

SEQ ID NO: 149637 - DNA, 16 bp, H. sapiens
tggaagaaatcataga

SEQ ID NO: 149638 - DNA, 16 bp, H. sapiens
tggaagaagaaaaatt

SEQ ID NO: 149639 - DNA, 16 bp, H. sapiens
tggaagaagatatttt

SEQ ID NO: 149640 - DNA, 16 bp, H. sapiens
tggaagaagatgacat

SEQ ID NO: 149641 - DNA, 16 bp, H. sapiens
tggaagaagatgccat

SEQ ID NO: 149642 - DNA, 16 bp, H. sapiens
tggaagaagcaaggaa

SEQ ID NO: 149643 - DNA, 16 bp, H. sapiens
tggaagaagcatgact

SEQ ID NO: 149644 - DNA, 16 bp, H. sapiens
tggaagaagctggaag

SEQ ID NO: 149645 - DNA, 16 bp, H. sapiens
tggaagaagtgactgt

SEQ ID NO: 149646 - DNA, 16 bp, H. sapiens
tggaagaattacttga

SEQ ID NO: 149647 - DNA, 16 bp, H. sapiens
tggaagaattcatatt

SEQ ID NO: 149648 - DNA, 16 bp, H. sapiens
tggaagaatttgagaa

SEQ ID NO: 149649 - DNA, 16 bp, H. sapiens
tggaagaatttgtgaa

SEQ ID NO: 149650 - DNA, 16 bp, H. sapiens
tggaagacaacatagg

SEQ ID NO: 149651 - DNA, 16 bp, H. sapiens
tggaagacagcatggc

SEQ ID NO: 149652 - DNA, 16 bp, H. sapiens
tggaagacagtgtgat

SEQ ID NO: 149653 - DNA, 16 bp, H. sapiens
tggaagacagtgttgc

SEQ ID NO: 149654 - DNA, 16 bp, H. sapiens
tggaagacagtttttc

SEQ ID NO: 149655 - DNA, 16 bp, H. sapiens
tggaagacatttctaa

SEQ ID NO: 149656 - DNA, 16 bp, H. sapiens
tggaagaccgaggtgg

SEQ ID NO: 149657 - DNA, 16 bp, H. sapiens
tggaagactcaatatt

SEQ ID NO: 149658 - DNA, 16 bp, H. sapiens
tggaagactcagaaga

SEQ ID NO: 149659 - DNA, 16 bp, H. sapiens
tggaagagacccaagt

SEQ ID NO: 149660 - DNA, 16 bp, H. sapiens
tggaagagattgtgta

SEQ ID NO: 149661 - DNA, 16 bp, H. sapiens
tggaagaggaaatgaa

SEQ ID NO: 149662 - DNA, 16 bp, H. sapiens
tggaagaggaagcaaa

SEQ ID NO: 149663 - DNA, 16 bp, H. sapiens
tggaagaggcaaagaa

SEQ ID NO: 149664 - DNA, 16 bp, H. sapiens
tggaagaggcaggaaa

SEQ ID NO: 149665 - DNA, 16 bp, H. sapiens
tggaagaggccctgga

SEQ ID NO: 149666 - DNA, 16 bp, H. sapiens
tggaagagtttaagaa

SEQ ID NO: 149667 - DNA, 16 bp, H. sapiens
tggaagagtttgagga

SEQ ID NO: 149668 - DNA, 16 bp, H. sapiens
tggaagagtttgtgaa

SEQ ID NO: 149669 - DNA, 16 bp, H. sapiens
tggaagagtttgtgta

SEQ ID NO: 149670 - DNA, 16 bp, H. sapiens
tggaagatatatatat

SEQ ID NO: 149671 - DNA, 16 bp, H. sapiens
tggaagatctggccag

SEQ ID NO: 149672 - DNA, 16 bp, H. sapiens
tggaagatgaaaggaa

SEQ ID NO: 149673 - DNA, 16 bp, H. sapiens
tggaagatgaaatgaa

SEQ ID NO: 149674 - DNA, 16 bp, H. sapiens
tggaagatgaaatgag

SEQ ID NO: 149675 - DNA, 16 bp, H. sapiens
tggaagatggaggctg

SEQ ID NO: 149676 - DNA, 16 bp, H. sapiens
tggaagatggtgtggc

SEQ ID NO: 149677 - DNA, 16 bp, H. sapiens
tggaagcaacataagt

SEQ ID NO: 149678 - DNA, 16 bp, H. sapiens
tggaagcaattttgga

SEQ ID NO: 149679 - DNA, 16 bp, H. sapiens
tggaagcagaaagcag

SEQ ID NO: 149680 - DNA, 16 bp, H. sapiens
tggaagcagagagaag

SEQ ID NO: 149681 - DNA, 16 bp, H. sapiens
tggaagcagccaagat

SEQ ID NO: 149682 - DNA, 16 bp, H. sapiens
tggaagcagcctgagg

SEQ ID NO: 149683 - DNA, 16 bp, H. sapiens
tggaagcagctggagg

SEQ ID NO: 149684 - DNA, 16 bp, H. sapiens
tggaagcagtggctca

SEQ ID NO: 149685 - DNA, 20 bp, H. sapiens
tggaagcattccgtttgaaa

SEQ ID NO: 149686 - DNA, 16 bp, H. sapiens
tggaagcatttctctt

SEQ ID NO: 149687 - DNA, 16 bp, H. sapiens
tggaagcatttctttt

SEQ ID NO: 149688 - DNA, 16 bp, H. sapiens
tggaagcattttgccc

SEQ ID NO: 149689 - DNA, 16 bp, H. sapiens
tggaagccagaaggaa

SEQ ID NO: 149690 - DNA, 16 bp, H. sapiens
tggaagccattatcct

SEQ ID NO: 149691 - DNA, 16 bp, H. sapiens
tggaagccccaagtct

SEQ ID NO: 149692 - DNA, 22 bp, H. sapiens
tggaagccttccctttgaaaac

SEQ ID NO: 149693 - DNA, 16 bp, H. sapiens
tggaagctaaaaaatt

SEQ ID NO: 149694 - DNA, 16 bp, H. sapiens
tggaagctacagtgag

SEQ ID NO: 149695 - DNA, 16 bp, H. sapiens
tggaagctctgcctcc

SEQ ID NO: 149696 - DNA, 16 bp, H. sapiens
tggaagctgagcagat

SEQ ID NO: 149697 - DNA, 16 bp, H. sapiens
tggaagcttcatctca

SEQ ID NO: 149698 - DNA, 16 bp, H. sapiens
tggaagcttcctccca

SEQ ID NO: 149699 - DNA, 16 bp, H. sapiens
tggaagcttcctgaag

SEQ ID NO: 149700 - DNA, 16 bp, H. sapiens
tggaagcttggagatg

SEQ ID NO: 149701 - DNA, 16 bp, H. sapiens
tggaagcttgtgcctg

SEQ ID NO: 149702 - DNA, 16 bp, H. sapiens
tggaagctttattctt

SEQ ID NO: 149703 - DNA, 16 bp, H. sapiens
tggaaggaaaacacaa

SEQ ID NO: 149704 - DNA, 16 bp, H. sapiens
tggaaggaaaagcagg

SEQ ID NO: 149705 - DNA, 16 bp, H. sapiens
tggaaggaccacttga

SEQ ID NO: 149706 - DNA, 16 bp, H. sapiens
tggaaggatcagttga

SEQ ID NO: 149707 - DNA, 16 bp, H. sapiens
tggaaggcaaagagga

SEQ ID NO: 149708 - DNA, 16 bp, H. sapiens
tggaaggcagaagtga

SEQ ID NO: 149709 - DNA, 16 bp, H. sapiens
tggaaggcagagaatg

SEQ ID NO: 149710 - DNA, 16 bp, H. sapiens
tggaaggcagaggcag

SEQ ID NO: 149711 - DNA, 16 bp, H. sapiens
tggaaggcagaggctg

SEQ ID NO: 149712 - DNA, 16 bp, H. sapiens
tggaaggcagagggtg

SEQ ID NO: 149713 - DNA, 16 bp, H. sapiens
tggaaggcagcaggca

SEQ ID NO: 149714 - DNA, 16 bp, H. sapiens
tggaaggccaagatgg

SEQ ID NO: 149715 - DNA, 16 bp, H. sapiens
tggaaggcccaggtgg

SEQ ID NO: 149716 - DNA, 16 bp, H. sapiens
tggaaggccgaggtgg

SEQ ID NO: 149717 - DNA, 16 bp, H. sapiens
tggaaggctgaggcat

SEQ ID NO: 149718 - DNA, 16 bp, H. sapiens
tggaaggctgatgtgg

SEQ ID NO: 149719 - DNA, 16 bp, H. sapiens
tggaagggaaatgtgg

SEQ ID NO: 149720 - DNA, 16 bp, H. sapiens
tggaagggagctgagc

SEQ ID NO: 149721 - DNA, 16 bp, H. sapiens
tggaagggcaaaaagg

SEQ ID NO: 149722 - DNA, 16 bp, H. sapiens
tggaaggggaagcaga

SEQ ID NO: 149723 - DNA, 16 bp, H. sapiens
tggaaggggaagtaaa

SEQ ID NO: 149724 - DNA, 16 bp, H. sapiens
tggaaggggccagggg

SEQ ID NO: 149725 - DNA, 16 bp, H. sapiens
tggaaggtgaaaggga

SEQ ID NO: 149726 - DNA, 16 bp, H. sapiens
tggaaggttttaagca

SEQ ID NO: 149727 - DNA, 16 bp, H. sapiens
tggaaggtttttgatt

SEQ ID NO: 149728 - DNA, 16 bp, H. sapiens
tggaagtcaaggctgc

SEQ ID NO: 149729 - DNA, 16 bp, H. sapiens
tggaagtcatcattct

SEQ ID NO: 149730 - DNA, 16 bp, H. sapiens
tggaagtccaagatca

SEQ ID NO: 149731 - DNA, 16 bp, H. sapiens
tggaagtcttggccag

SEQ ID NO: 149732 - DNA, 16 bp, H. sapiens
tggaagtgactttgaa

SEQ ID NO: 149733 - DNA, 16 bp, H. sapiens
tggaagtgcctgctcc

SEQ ID NO: 149734 - DNA, 16 bp, H. sapiens
tggaagtggagcctga

SEQ ID NO: 149735 - DNA, 16 bp, H. sapiens
tggaagtggctttgga

SEQ ID NO: 149736 - DNA, 16 bp, H. sapiens
tggaagttcgagacca

SEQ ID NO: 149737 - DNA, 16 bp, H. sapiens
tggaagttctgaccag

SEQ ID NO: 149738 - DNA, 16 bp, H. sapiens
tggaagttttgtccca

SEQ ID NO: 149739 - DNA, 16 bp, H. sapiens
tggaataaaaatggaa

SEQ ID NO: 149740 - DNA, 16 bp, H. sapiens
tggaataaaatccaaa

SEQ ID NO: 149741 - DNA, 16 bp, H. sapiens
tggaataaaatggaag

SEQ ID NO: 149742 - DNA, 16 bp, H. sapiens
tggaataaaattgaga

SEQ ID NO: 149743 - DNA, 16 bp, H. sapiens
tggaataattttaaat

SEQ ID NO: 149744 - DNA, 16 bp, H. sapiens
tggaataccatgatgg

SEQ ID NO: 149745 - DNA, 17 bp, H. sapiens
tggaatacgatgcagcc

SEQ ID NO: 149746 - DNA, 16 bp, H. sapiens
tggaatactgtgtagc

SEQ ID NO: 149747 - DNA, 16 bp, H. sapiens
tggaatacttcctgaa

SEQ ID NO: 149748 - DNA, 16 bp, H. sapiens
tggaatacttctgatt

SEQ ID NO: 149749 - DNA, 16 bp, H. sapiens
tggaatagaatggaac

SEQ ID NO: 149750 - DNA, 16 bp, H. sapiens
tggaatagttctgtat

SEQ ID NO: 149751 - DNA, 16 bp, H. sapiens
tggaatatacattctt

SEQ ID NO: 149752 - DNA, 16 bp, H. sapiens
tggaatatccatcacc

SEQ ID NO: 149753 - DNA, 16 bp, H. sapiens
tggaatattatatagc

SEQ ID NO: 149754 - DNA, 16 bp, H. sapiens
tggaatattattcagt

SEQ ID NO: 149755 - DNA, 16 bp, H. sapiens
tggaatattatttggt

SEQ ID NO: 149756 - DNA, 16 bp, H. sapiens
tggaatatttaaaatt

SEQ ID NO: 149757 - DNA, 16 bp, H. sapiens
tggaatatttctggct

SEQ ID NO: 149758 - DNA, 16 bp, H. sapiens
tggaatatttgcattg

SEQ ID NO: 149759 - DNA, 16 bp, H. sapiens
tggaatatttgtcttt

SEQ ID NO: 149760 - DNA, 16 bp, H. sapiens
tggaatattttaaagt

SEQ ID NO: 149761 - DNA, 16 bp, H. sapiens
tggaatattttcagaa

SEQ ID NO: 149762 - DNA, 16 bp, H. sapiens
tggaatcaaacaatat

SEQ ID NO: 149763 - DNA, 16 bp, H. sapiens
tggaatcaacccaaat

SEQ ID NO: 149764 - DNA, 16 bp, H. sapiens
tggaatcaacctaaat

SEQ ID NO: 149765 - DNA, 16 bp, H. sapiens
tggaatcaacctcttc

SEQ ID NO: 149766 - DNA, 16 bp, H. sapiens
tggaatcaatctaaat

SEQ ID NO: 149767 - DNA, 16 bp, H. sapiens
tggaatcaatgtaaat

SEQ ID NO: 149768 - DNA, 16 bp, H. sapiens
tggaatcaatgtcagc

SEQ ID NO: 149769 - DNA, 16 bp, H. sapiens
tggaatcagcttcttc

SEQ ID NO: 149770 - DNA, 16 bp, H. sapiens
tggaatcataaagtat

SEQ ID NO: 149771 - DNA, 16 bp, H. sapiens
tggaatcatacaatat

SEQ ID NO: 149772 - DNA, 16 bp, H. sapiens
tggaatcatacagtat

SEQ ID NO: 149773 - DNA, 16 bp, H. sapiens
tggaatcatatagtat

SEQ ID NO: 149774 - DNA, 16 bp, H. sapiens
tggaatcatcctaaat

SEQ ID NO: 149775 - DNA, 16 bp, H. sapiens
tggaatcccatgtgag

SEQ ID NO: 149776 - DNA, 16 bp, H. sapiens
tggaatccccagtgtt

SEQ ID NO: 149777 - DNA, 16 bp, H. sapiens
tggaatcctagtctct

SEQ ID NO: 149778 - DNA, 16 bp, H. sapiens
tggaatcctatgtgaa

SEQ ID NO: 149779 - DNA, 16 bp, H. sapiens
tggaatctacaaaaaa

SEQ ID NO: 149780 - DNA, 16 bp, H. sapiens
tggaatctcactttgt

SEQ ID NO: 149781 - DNA, 16 bp, H. sapiens
tggaatctcagctcac

SEQ ID NO: 149782 - DNA, 16 bp, H. sapiens
tggaatctcagtctgt

SEQ ID NO: 149783 - DNA, 16 bp, H. sapiens
tggaatctctctctct

SEQ ID NO: 149784 - DNA, 16 bp, H. sapiens
tggaatctctgggaca

SEQ ID NO: 149785 - DNA, 16 bp, H. sapiens
tggaatctgtgaaggg

SEQ ID NO: 149786 - DNA, 16 bp, H. sapiens
tggaatgaacctaaat

SEQ ID NO: 149787 - DNA, 16 bp, H. sapiens
tggaatgaatgaatga

SEQ ID NO: 149788 - DNA, 16 bp, H. sapiens
tggaatgaatgcattt

SEQ ID NO: 149789 - DNA, 16 bp, H. sapiens
tggaatgaatgtattt

SEQ ID NO: 149790 - DNA, 16 bp, H. sapiens
tggaatgagagaaaat

SEQ ID NO: 149791 - DNA, 16 bp, H. sapiens
tggaatgatcaaatca

SEQ ID NO: 149792 - DNA, 16 bp, H. sapiens
tggaatgatcacagct

SEQ ID NO: 149793 - DNA, 16 bp, H. sapiens
tggaatgattgaatca

SEQ ID NO: 149794 - DNA, 16 bp, H. sapiens
tggaatgcaatgatgt

SEQ ID NO: 149795 - DNA, 16 bp, H. sapiens
tggaatgcaggggcat

SEQ ID NO: 149796 - DNA, 16 bp, H. sapiens
tggaatgctaagcatg

SEQ ID NO: 149797 - DNA, 16 bp, H. sapiens
tggaatggaaaaaata

SEQ ID NO: 149798 - DNA, 16 bp, H. sapiens
tggaatggaataaaat

SEQ ID NO: 149799 - DNA, 16 bp, H. sapiens
tggaatggaataaaga

SEQ ID NO: 149800 - DNA, 16 bp, H. sapiens
tggaatggaatggtga

SEQ ID NO: 149801 - DNA, 16 bp, H. sapiens
tggaatggaatgtact

SEQ ID NO: 149802 - DNA, 16 bp, H. sapiens
tggaatggtgtgtttt

SEQ ID NO: 149803 - DNA, 16 bp, H. sapiens
tggaatggttttccat

SEQ ID NO: 149804 - DNA, 16 bp, H. sapiens
tggaatgtcatgggat

SEQ ID NO: 149805 - DNA, 16 bp, H. sapiens
tggaatgttctcccat

SEQ ID NO: 149806 - DNA, 16 bp, H. sapiens
tggaattaaatgagaa

SEQ ID NO: 149807 - DNA, 16 bp, H. sapiens
tggaattacagatgca

SEQ ID NO: 149808 - DNA, 16 bp, H. sapiens
tggaattacaggaatg

SEQ ID NO: 149809 - DNA, 16 bp, H. sapiens
tggaattacaggagtg

SEQ ID NO: 149810 - DNA, 16 bp, H. sapiens
tggaattacaggcacg

SEQ ID NO: 149811 - DNA, 16 bp, H. sapiens
tggaattacaggtgca

SEQ ID NO: 149812 - DNA, 16 bp, H. sapiens
tggaattacagtcatg

SEQ ID NO: 149813 - DNA, 16 bp, H. sapiens
tggaattataaaatat

SEQ ID NO: 149814 - DNA, 16 bp, H. sapiens
tggaattatatcaaac

SEQ ID NO: 149815 - DNA, 16 bp, H. sapiens
tggaattcagctgtga

SEQ ID NO: 149816 - DNA, 16 bp, H. sapiens
tggaattcagtgtggc

SEQ ID NO: 149817 - DNA, 16 bp, H. sapiens
tggaattctacacagc

SEQ ID NO: 149818 - DNA, 16 bp, H. sapiens
tggaattctattttat

SEQ ID NO: 149819 - DNA, 16 bp, H. sapiens
tggaattcttctgcaa

SEQ ID NO: 149820 - DNA, 16 bp, H. sapiens
tggaattgaaaaactc

SEQ ID NO: 149821 - DNA, 16 bp, H. sapiens
tggaattgaatggatt

SEQ ID NO: 149822 - DNA, 16 bp, H. sapiens
tggaattgatttttat

SEQ ID NO: 149823 - DNA, 16 bp, H. sapiens
tggaattgctggattg

SEQ ID NO: 149824 - DNA, 16 bp, H. sapiens
tggaattggaacttac

SEQ ID NO: 149825 - DNA, 16 bp, H. sapiens
tggaattggaacttat

SEQ ID NO: 149826 - DNA, 17 bp, H. sapiens
tggaattggagaccatt

SEQ ID NO: 149827 - DNA, 16 bp, H. sapiens
tggaattgtaagtcca

SEQ ID NO: 149828 - DNA, 16 bp, H. sapiens
tggaattgtacagtat

SEQ ID NO: 149829 - DNA, 16 bp, H. sapiens
tggaattgttctgtat

SEQ ID NO: 149830 - DNA, 16 bp, H. sapiens
tggaattgttgaatca

SEQ ID NO: 149831 - DNA, 16 bp, H. sapiens
tggaattgttttcttt

SEQ ID NO: 149832 - DNA, 16 bp, H. sapiens
tggaatttaaaaatat

SEQ ID NO: 149833 - DNA, 16 bp, H. sapiens
tggaatttaaaattaa

SEQ ID NO: 149834 - DNA, 16 bp, H. sapiens
tggaatttatttaaaa

SEQ ID NO: 149835 - DNA, 16 bp, H. sapiens
tggaatttctgagtca

SEQ ID NO: 149836 - DNA, 16 bp, H. sapiens
tggaatttctgggtca

SEQ ID NO: 149837 - DNA, 16 bp, H. sapiens
tggaatttgaacccag

SEQ ID NO: 149838 - DNA, 16 bp, H. sapiens
tggaatttgctggagg

SEQ ID NO: 149839 - DNA, 16 bp, H. sapiens
tggaattttaaatttc

SEQ ID NO: 149840 - DNA, 16 bp, H. sapiens
tggaattttattttct

SEQ ID NO: 149841 - DNA, 16 bp, H. sapiens
tggaattttccacttg

SEQ ID NO: 149842 - DNA, 16 bp, H. sapiens
tggaattttcctttta

SEQ ID NO: 149843 - DNA, 16 bp, H. sapiens
tggaattttgccatgt

SEQ ID NO: 149844 - DNA, 16 bp, H. sapiens
tggaattttgctcttt

SEQ ID NO: 149845 - DNA, 16 bp, H. sapiens
tggaatttttaaaaat

SEQ ID NO: 149846 - DNA, 16 bp, H. sapiens
tggacaaaccttgaaa

SEQ ID NO: 149847 - DNA, 16 bp, H. sapiens
tggacaaagaacatga

SEQ ID NO: 149848 - DNA, 16 bp, H. sapiens
tggacaaagtggtgaa

SEQ ID NO: 149849 - DNA, 16 bp, H. sapiens
tggacaaatgggatta

SEQ ID NO: 149850 - DNA, 16 bp, H. sapiens
tggacaaattcctagg

SEQ ID NO: 149851 - DNA, 16 bp, H. sapiens
tggacaaattcctgga

SEQ ID NO: 149852 - DNA, 17 bp, H. sapiens
tggacaacacagtaaga

SEQ ID NO: 149853 - DNA, 16 bp, H. sapiens
tggacaacacagtgaa

SEQ ID NO: 149854 - DNA, 16 bp, H. sapiens
tggacaacagagtggg

SEQ ID NO: 149855 - DNA, 16 bp, H. sapiens
tggacaacatggtgag

SEQ ID NO: 149856 - DNA, 16 bp, H. sapiens
tggacaacattgtgag

SEQ ID NO: 149857 - DNA, 16 bp, H. sapiens
tggacaactggagggt

SEQ ID NO: 149858 - DNA, 16 bp, H. sapiens
tggacaagagcttggg

SEQ ID NO: 149859 - DNA, 17 bp, H. sapiens
tggacaatacttttacc

SEQ ID NO: 149860 - DNA, 16 bp, H. sapiens
tggacacacacataca

SEQ ID NO: 149861 - DNA, 16 bp, H. sapiens
tggacacacagaggga

SEQ ID NO: 149862 - DNA, 16 bp, H. sapiens
tggacacagacatgca

SEQ ID NO: 149863 - DNA, 16 bp, H. sapiens
tggacacagagacaga

SEQ ID NO: 149864 - DNA, 17 bp, H. sapiens
tggacacagagagggga

SEQ ID NO: 149865 - DNA, 18 bp, H. sapiens
tggacacaggaaggggaa

SEQ ID NO: 149866 - DNA, 16 bp, H. sapiens
tggacacaggaatggg

SEQ ID NO: 149867 - DNA, 16 bp, H. sapiens
tggacacaggttgggg

SEQ ID NO: 149868 - DNA, 17 bp, H. sapiens
tggacacagtggctcac

SEQ ID NO: 149869 - DNA, 16 bp, H. sapiens
tggacacatacaccca

SEQ ID NO: 149870 - DNA, 16 bp, H. sapiens
tggacacataggttgc

SEQ ID NO: 149871 - DNA, 16 bp, H. sapiens
tggacaccagcctggg

SEQ ID NO: 149872 - DNA, 16 bp, H. sapiens
tggacaccataactca

SEQ ID NO: 149873 - DNA, 16 bp, H. sapiens
tggacaccttttattt

SEQ ID NO: 149874 - DNA, 16 bp, H. sapiens
tggacacgccaccttt

SEQ ID NO: 149875 - DNA, 16 bp, H. sapiens
tggacactcacttttc

SEQ ID NO: 149876 - DNA, 16 bp, H. sapiens
tggacactgattcaga

SEQ ID NO: 149877 - DNA, 16 bp, H. sapiens
tggacactgttgttga

SEQ ID NO: 149878 - DNA, 16 bp, H. sapiens
tggacacttcatataa

SEQ ID NO: 149879 - DNA, 16 bp, H. sapiens
tggacagcatttctag

SEQ ID NO: 149880 - DNA, 16 bp, H. sapiens
tggacagcttggtccc

SEQ ID NO: 149881 - DNA, 16 bp, H. sapiens
tggacaggctgctctc

SEQ ID NO: 149882 - DNA, 16 bp, H. sapiens
tggacaggctggtctg

SEQ ID NO: 149883 - DNA, 16 bp, H. sapiens
tggacagggacacaga

SEQ ID NO: 149884 - DNA, 16 bp, H. sapiens
tggacagggcatctct

SEQ ID NO: 149885 - DNA, 16 bp, H. sapiens
tggacagtgatgatga

SEQ ID NO: 149886 - DNA, 16 bp, H. sapiens
tggacagttttttttt

SEQ ID NO: 149887 - DNA, 16 bp, H. sapiens
tggacataaagatggc

SEQ ID NO: 149888 - DNA, 16 bp, H. sapiens
tggacataaattttca

SEQ ID NO: 149889 - DNA, 16 bp, H. sapiens
tggacataggaagggg

SEQ ID NO: 149890 - DNA, 16 bp, H. sapiens
tggacatcactgaata

SEQ ID NO: 149891 - DNA, 16 bp, H. sapiens
tggacatctttgggag

SEQ ID NO: 149892 - DNA, 16 bp, H. sapiens
tggacatggatgaggg

SEQ ID NO: 149893 - DNA, 16 bp, H. sapiens
tggacatggtggccca

SEQ ID NO: 149894 - DNA, 16 bp, H. sapiens
tggacatgttttcagt

SEQ ID NO: 149895 - DNA, 17 bp, H. sapiens
tggacattaaagtaaaa

SEQ ID NO: 149896 - DNA, 16 bp, H. sapiens
tggacatttcatatga

SEQ ID NO: 149897 - DNA, 16 bp, H. sapiens
tggaccaaaccaatgt

SEQ ID NO: 149898 - DNA, 16 bp, H. sapiens
tggaccaagtggacct

SEQ ID NO: 149899 - DNA, 16 bp, H. sapiens
tggaccacatatacaa

SEQ ID NO: 149900 - DNA, 16 bp, H. sapiens
tggaccagcagcatca

SEQ ID NO: 149901 - DNA, 16 bp, H. sapiens
tggaccaggcactgtg

SEQ ID NO: 149902 - DNA, 16 bp, H. sapiens
tggaccagtcagcttc

SEQ ID NO: 149903 - DNA, 16 bp, H. sapiens
tggaccatgggggcag

SEQ ID NO: 149904 - DNA, 16 bp, H. sapiens
tggaccatttcttcag

SEQ ID NO: 149905 - DNA, 16 bp, H. sapiens
tggacccaaagactga

SEQ ID NO: 149906 - DNA, 16 bp, H. sapiens
tggacccaggaagggg

SEQ ID NO: 149907 - DNA, 16 bp, H. sapiens
tggacccaggaggtgg

SEQ ID NO: 149908 - DNA, 16 bp, H. sapiens
tggaccccctgcagca

SEQ ID NO: 149909 - DNA, 16 bp, H. sapiens
tggacccctcatgaat

SEQ ID NO: 149910 - DNA, 16 bp, H. sapiens
tggacccctcctctca

SEQ ID NO: 149911 - DNA, 16 bp, H. sapiens
tggacctccagcctcc

SEQ ID NO: 149912 - DNA, 17 bp, H. sapiens
tggacctgcacagttca

SEQ ID NO: 149913 - DNA, 16 bp, H. sapiens
tggacctggaggacat

SEQ ID NO: 149914 - DNA, 16 bp, H. sapiens
tggacgcccctccccc

SEQ ID NO: 149915 - DNA, 16 bp, H. sapiens
tggacgctgtggctca

SEQ ID NO: 149916 - DNA, 16 bp, H. sapiens
tggacggggcggctgg

SEQ ID NO: 149917 - DNA, 16 bp, H. sapiens
tggacgtgcagtcagg

SEQ ID NO: 149918 - DNA, 16 bp, H. sapiens
tggactaaacactcca

SEQ ID NO: 149919 - DNA, 16 bp, H. sapiens
tggactcaagcaattc

SEQ ID NO: 149920 - DNA, 16 bp, H. sapiens
tggactcaagtgatcc

SEQ ID NO: 149921 - DNA, 16 bp, H. sapiens
tggactccagaactgt

SEQ ID NO: 149922 - DNA, 16 bp, H. sapiens
tggactccagcccggg

SEQ ID NO: 149923 - DNA, 16 bp, H. sapiens
tggactccagcctggg

SEQ ID NO: 149924 - DNA, 16 bp, H. sapiens
tggactcccattcaca

SEQ ID NO: 149925 - DNA, 16 bp, H. sapiens
tggactccccagcctc

SEQ ID NO: 149926 - DNA, 16 bp, H. sapiens
tggactcgagcaatcc

SEQ ID NO: 149927 - DNA, 16 bp, H. sapiens
tggactctccagcctc

SEQ ID NO: 149928 - DNA, 16 bp, H. sapiens
tggactctctcccctg

SEQ ID NO: 149929 - DNA, 16 bp, H. sapiens
tggactctgggactta

SEQ ID NO: 149930 - DNA, 16 bp, H. sapiens
tggactcttggactta

SEQ ID NO: 149931 - DNA, 16 bp, H. sapiens
tggactgaatgtttat

SEQ ID NO: 149932 - DNA, 16 bp, H. sapiens
tggactgagggagacc

SEQ ID NO: 149933 - DNA, 16 bp, H. sapiens
tggactgcacccactg

SEQ ID NO: 149934 - DNA, 16 bp, H. sapiens
tggactgcagtgacat

SEQ ID NO: 149935 - DNA, 16 bp, H. sapiens
tggactggaaaaaaaa

SEQ ID NO: 149936 - DNA, 16 bp, H. sapiens
tggactgggaaccaca

SEQ ID NO: 149937 - DNA, 16 bp, H. sapiens
tggactgggagaagca

SEQ ID NO: 149938 - DNA, 16 bp, H. sapiens
tggacttaattttttt

SEQ ID NO: 149939 - DNA, 16 bp, H. sapiens
tggacttacagttcca

SEQ ID NO: 149940 - DNA, 16 bp, H. sapiens
tggacttagacttttg

SEQ ID NO: 149941 - DNA, 16 bp, H. sapiens
tggacttcattaaaat

SEQ ID NO: 149942 - DNA, 16 bp, H. sapiens
tggacttcccagcccc

SEQ ID NO: 149943 - DNA, 16 bp, H. sapiens
tggacttcctcaaaat

SEQ ID NO: 149944 - DNA, 16 bp, H. sapiens
tggacttgaacccagg

SEQ ID NO: 149945 - DNA, 16 bp, H. sapiens
tggacttgaacttctg

SEQ ID NO: 149946 - DNA, 16 bp, H. sapiens
tggacttgccagcccc

SEQ ID NO: 149947 - DNA, 16 bp, H. sapiens
tggactttaaattctg

SEQ ID NO: 149948 - DNA, 16 bp, H. sapiens
tggactttagttaata

SEQ ID NO: 149949 - DNA, 16 bp, H. sapiens
tggactttcttttctt

SEQ ID NO: 149950 - DNA, 16 bp, H. sapiens
tggactttgaagtcag

SEQ ID NO: 149951 - DNA, 16 bp, H. sapiens
tggactttggagtcag

SEQ ID NO: 149952 - DNA, 16 bp, H. sapiens
tggactttgggaactc

SEQ ID NO: 149953 - DNA, 16 bp, H. sapiens
tggactttgggcactg

SEQ ID NO: 149954 - DNA, 16 bp, H. sapiens
tggacttttcttcttt

SEQ ID NO: 149955 - DNA, 16 bp, H. sapiens
tggagaaaaacaaagc

SEQ ID NO: 149956 - DNA, 16 bp, H. sapiens
tggagaaaaagacatt

SEQ ID NO: 149957 - DNA, 16 bp, H. sapiens
tggagaaaaaggaaca

SEQ ID NO: 149958 - DNA, 16 bp, H. sapiens
tggagaaaaattaaat

SEQ ID NO: 149959 - DNA, 16 bp, H. sapiens
tggagaaaaattttaa

SEQ ID NO: 149960 - DNA, 16 bp, H. sapiens
tggagaaaagcaaaga

SEQ ID NO: 149961 - DNA, 16 bp, H. sapiens
tggagaaaaggaaact

SEQ ID NO: 149962 - DNA, 16 bp, H. sapiens
tggagaaaaggagaca

SEQ ID NO: 149963 - DNA, 16 bp, H. sapiens
tggagaaaagggaacc

SEQ ID NO: 149964 - DNA, 16 bp, H. sapiens
tggagaaaataaaatt

SEQ ID NO: 149965 - DNA, 16 bp, H. sapiens
tggagaaaataaagca

SEQ ID NO: 149966 - DNA, 16 bp, H. sapiens
tggagaaaatattatt

SEQ ID NO: 149967 - DNA, 16 bp, H. sapiens
tggagaaaatgaaaca

SEQ ID NO: 149968 - DNA, 16 bp, H. sapiens
tggagaaaatggaatt

SEQ ID NO: 149969 - DNA, 16 bp, H. sapiens
tggagaaaatggagaa

SEQ ID NO: 149970 - DNA, 16 bp, H. sapiens
tggagaaaattttaaa

SEQ ID NO: 149971 - DNA, 16 bp, H. sapiens
tggagaaacacaagca

SEQ ID NO: 149972 - DNA, 16 bp, H. sapiens
tggagaaacacacaca

SEQ ID NO: 149973 - DNA, 16 bp, H. sapiens
tggagaaacagagaca

SEQ ID NO: 149974 - DNA, 17 bp, H. sapiens
tggagaaaccccacctc

SEQ ID NO: 149975 - DNA, 16 bp, H. sapiens
tggagaaaccccattt

SEQ ID NO: 149976 - DNA, 16 bp, H. sapiens
tggagaaaccctgtct

SEQ ID NO: 149977 - DNA, 16 bp, H. sapiens
tggagaaactagaact

SEQ ID NO: 149978 - DNA, 16 bp, H. sapiens
tggagaaactgaggcc

SEQ ID NO: 149979 - DNA, 16 bp, H. sapiens
tggagaaactggaaac

SEQ ID NO: 149980 - DNA, 16 bp, H. sapiens
tggagaaactggatca

SEQ ID NO: 149981 - DNA, 16 bp, H. sapiens
tggagaaacttgattt

SEQ ID NO: 149982 - DNA, 16 bp, H. sapiens
tggagaaagagacaga

SEQ ID NO: 149983 - DNA, 16 bp, H. sapiens
tggagaaagagagata

SEQ ID NO: 149984 - DNA, 16 bp, H. sapiens
tggagaaaggacagcc

SEQ ID NO: 149985 - DNA, 16 bp, H. sapiens
tggagaaaggagaacc

SEQ ID NO: 149986 - DNA, 16 bp, H. sapiens
tggagaaaggattccc

SEQ ID NO: 149987 - DNA, 16 bp, H. sapiens
tggagaaaggggaatg

SEQ ID NO: 149988 - DNA, 16 bp, H. sapiens
tggagaaagtcctttt

SEQ ID NO: 149989 - DNA, 16 bp, H. sapiens
tggagaaagtttgaat

SEQ ID NO: 149990 - DNA, 16 bp, H. sapiens
tggagaaataggaacc

SEQ ID NO: 149991 - DNA, 16 bp, H. sapiens
tggagaaatatgaaca

SEQ ID NO: 149992 - DNA, 16 bp, H. sapiens
tggagaaattaaaacc

SEQ ID NO: 149993 - DNA, 16 bp, H. sapiens
tggagaaattgaaacc

SEQ ID NO: 149994 - DNA, 16 bp, H. sapiens
tggagaaattgaaatc

SEQ ID NO: 149995 - DNA, 16 bp, H. sapiens
tggagaaattggaaaa

SEQ ID NO: 149996 - DNA, 16 bp, H. sapiens
tggagaacagagtgag

SEQ ID NO: 149997 - DNA, 16 bp, H. sapiens
tggagaacagattggt

SEQ ID NO: 149998 - DNA, 16 bp, H. sapiens
tggagaacagcctggc

SEQ ID NO: 149999 - DNA, 16 bp, H. sapiens
tggagaacagtggtgt

SEQ ID NO: 150000 - DNA, 16 bp, H. sapiens
tggagaacattatgct

SEQ ID NO: 150001 - DNA, 16 bp, H. sapiens
tggagaaccaggaaaa

SEQ ID NO: 150002 - DNA, 16 bp, H. sapiens
tggagaacctcttcta

SEQ ID NO: 150003 - DNA, 17 bp, H. sapiens
tggagaacctttatgtc

SEQ ID NO: 150004 - DNA, 16 bp, H. sapiens
tggagaactgtttgga

SEQ ID NO: 150005 - DNA, 16 bp, H. sapiens
tggagaagaagaaatt

SEQ ID NO: 150006 - DNA, 16 bp, H. sapiens
tggagaagaaggaaac

SEQ ID NO: 150007 - DNA, 16 bp, H. sapiens
tggagaagagacaaat

SEQ ID NO: 150008 - DNA, 16 bp, H. sapiens
tggagaagagagtgaa

SEQ ID NO: 150009 - DNA, 16 bp, H. sapiens
tggagaagatgtggag

SEQ ID NO: 150010 - DNA, 16 bp, H. sapiens
tggagaagcctggcag

SEQ ID NO: 150011 - DNA, 16 bp, H. sapiens
tggagaagctgaggca

SEQ ID NO: 150012 - DNA, 16 bp, H. sapiens
tggagaaggggtttca

SEQ ID NO: 150013 - DNA, 16 bp, H. sapiens
tggagaagttaaataa

SEQ ID NO: 150014 - DNA, 16 bp, H. sapiens
tggagaatatatttta

SEQ ID NO: 150015 - DNA, 16 bp, H. sapiens
tggagaatatttcatg

SEQ ID NO: 150016 - DNA, 16 bp, H. sapiens
tggagaatccagaaat

SEQ ID NO: 150017 - DNA, 16 bp, H. sapiens
tggagaatgagattga

SEQ ID NO: 150018 - DNA, 16 bp, H. sapiens
tggagaatggactgga

SEQ ID NO: 150019 - DNA, 16 bp, H. sapiens
tggagaatggtattta

SEQ ID NO: 150020 - DNA, 16 bp, H. sapiens
tggagaattctcaaag

SEQ ID NO: 150021 - DNA, 16 bp, H. sapiens
tggagaattgcttggt

SEQ ID NO: 150022 - DNA, 16 bp, H. sapiens
tggagaatttaattca

SEQ ID NO: 150023 - DNA, 16 bp, H. sapiens
tggagaattttaccaa

SEQ ID NO: 150024 - DNA, 16 bp, H. sapiens
tggagaattttttaaa

SEQ ID NO: 150025 - DNA, 16 bp, H. sapiens
tggagacacagaacca

SEQ ID NO: 150026 - DNA, 16 bp, H. sapiens
tggagacacagggaga

SEQ ID NO: 150027 - DNA, 16 bp, H. sapiens
tggagacacagtctca

SEQ ID NO: 150028 - DNA, 16 bp, H. sapiens
tggagacagagaaaga

SEQ ID NO: 150029 - DNA, 16 bp, H. sapiens
tggagacagagaatag

SEQ ID NO: 150030 - DNA, 16 bp, H. sapiens
tggagacagaggcaga

SEQ ID NO: 150031 - DNA, 16 bp, H. sapiens
tggagacagaggctca

SEQ ID NO: 150032 - DNA, 16 bp, H. sapiens
tggagacagagtctcg

SEQ ID NO: 150033 - DNA, 16 bp, H. sapiens
tggagacagagtgaga

SEQ ID NO: 150034 - DNA, 16 bp, H. sapiens
tggagacagggccttg

SEQ ID NO: 150035 - DNA, 16 bp, H. sapiens
tggagacagggtcttg

SEQ ID NO: 150036 - DNA, 19 bp, H. sapiens
tggagacagggtttcaccg

SEQ ID NO: 150037 - DNA, 16 bp, H. sapiens
tggagacagtgaaaag

SEQ ID NO: 150038 - DNA, 16 bp, H. sapiens
tggagacagtgtcaga

SEQ ID NO: 150039 - DNA, 16 bp, H. sapiens
tggagacatcagtatg

SEQ ID NO: 150040 - DNA, 16 bp, H. sapiens
tggagacattttcagt

SEQ ID NO: 150041 - DNA, 16 bp, H. sapiens
tggagaccaaagtttt

SEQ ID NO: 150042 - DNA, 16 bp, H. sapiens
tggagaccaacctggc

SEQ ID NO: 150043 - DNA, 16 bp, H. sapiens
tggagaccaaggtttt

SEQ ID NO: 150044 - DNA, 16 bp, H. sapiens
tggagaccagcatggc

SEQ ID NO: 150045 - DNA, 16 bp, H. sapiens
tggagaccagcctgag

SEQ ID NO: 150046 - DNA, 16 bp, H. sapiens
tggagaccagcctgga

SEQ ID NO: 150047 - DNA, 16 bp, H. sapiens
tggagaccagcgtggc

SEQ ID NO: 150048 - DNA, 16 bp, H. sapiens
tggagaccaggagttc

SEQ ID NO: 150049 - DNA, 16 bp, H. sapiens
tggagaccaggctggg

SEQ ID NO: 150050 - DNA, 16 bp, H. sapiens
tggagaccatcctgga

SEQ ID NO: 150051 - DNA, 17 bp, H. sapiens
tggagaccatcctggca

SEQ ID NO: 150052 - DNA, 16 bp, H. sapiens
tggagaccatcctggg

SEQ ID NO: 150053 - DNA, 16 bp, H. sapiens
tggagaccatcctggt

SEQ ID NO: 150054 - DNA, 16 bp, H. sapiens
tggagacccagaaaag

SEQ ID NO: 150055 - DNA, 16 bp, H. sapiens
tggagacccaggagag

SEQ ID NO: 150056 - DNA, 16 bp, H. sapiens
tggagacggagtctca

SEQ ID NO: 150057 - DNA, 16 bp, H. sapiens
tggagacggagtctgg

SEQ ID NO: 150058 - DNA, 21 bp, H. sapiens
tggagacggggtttcaccata

SEQ ID NO: 150059 - DNA, 18 bp, H. sapiens
tggagacggggtttcact

SEQ ID NO: 150060 - DNA, 16 bp, H. sapiens
tggagactcagaagag

SEQ ID NO: 150061 - DNA, 16 bp, H. sapiens
tggagactcagaaggg

SEQ ID NO: 150062 - DNA, 16 bp, H. sapiens
tggagactctgtgtgg

SEQ ID NO: 150063 - DNA, 16 bp, H. sapiens
tggagactgacaagga

SEQ ID NO: 150064 - DNA, 16 bp, H. sapiens
tggagactgagtcttg

SEQ ID NO: 150065 - DNA, 16 bp, H. sapiens
tggagactgcaatgag

SEQ ID NO: 150066 - DNA, 16 bp, H. sapiens
tggagactgggaaatc

SEQ ID NO: 150067 - DNA, 16 bp, H. sapiens
tggagactgtggcaaa

SEQ ID NO: 150068 - DNA, 16 bp, H. sapiens
tggagacttaacattt

SEQ ID NO: 150069 - DNA, 16 bp, H. sapiens
tggagagaaaccagag

SEQ ID NO: 150070 - DNA, 16 bp, H. sapiens
tggagagaaagggaat

SEQ ID NO: 150071 - DNA, 16 bp, H. sapiens
tggagagaagaaggca

SEQ ID NO: 150072 - DNA, 16 bp, H. sapiens
tggagagacagagtct

SEQ ID NO: 150073 - DNA, 16 bp, H. sapiens
tggagagacagggtct

SEQ ID NO: 150074 - DNA, 16 bp, H. sapiens
tggagagagaaaaatt

SEQ ID NO: 150075 - DNA, 16 bp, H. sapiens
tggagagagacagaaa

SEQ ID NO: 150076 - DNA, 16 bp, H. sapiens
tggagagagagacaga

SEQ ID NO: 150077 - DNA, 16 bp, H. sapiens
tggagagagagcaaga

SEQ ID NO: 150078 - DNA, 16 bp, H. sapiens
tggagagagaggaagc

SEQ ID NO: 150079 - DNA, 16 bp, H. sapiens
tggagagaggcgggag

SEQ ID NO: 150080 - DNA, 16 bp, H. sapiens
tggagagagtaaaaag

SEQ ID NO: 150081 - DNA, 16 bp, H. sapiens
tggagagatggagaga

SEQ ID NO: 150082 - DNA, 16 bp, H. sapiens
tggagagcagcctggc

SEQ ID NO: 150083 - DNA, 16 bp, H. sapiens
tggagagcagcctggg

SEQ ID NO: 150084 - DNA, 16 bp, H. sapiens
tggagagcagtggcgt

SEQ ID NO: 150085 - DNA, 16 bp, H. sapiens
tggagagcagtggtgt

SEQ ID NO: 150086 - DNA, 16 bp, H. sapiens
tggagagcctggagtt

SEQ ID NO: 150087 - DNA, 16 bp, H. sapiens
tggagaggagcttcat

SEQ ID NO: 150088 - DNA, 16 bp, H. sapiens
tggagaggagttgcaa

SEQ ID NO: 150089 - DNA, 16 bp, H. sapiens
tggagaggcctcagga

SEQ ID NO: 150090 - DNA, 16 bp, H. sapiens
tggagaggctgcagag

SEQ ID NO: 150091 - DNA, 16 bp, H. sapiens
tggagaggtccacatg

SEQ ID NO: 150092 - DNA, 16 bp, H. sapiens
tggagaggtgggcagg

SEQ ID NO: 150093 - DNA, 16 bp, H. sapiens
tggagagttctgtaca

SEQ ID NO: 150094 - DNA, 16 bp, H. sapiens
tggagatagaaatttg

SEQ ID NO: 150095 - DNA, 16 bp, H. sapiens
tggagatagggtctta

SEQ ID NO: 150096 - DNA, 16 bp, H. sapiens
tggagatatatatata

SEQ ID NO: 150097 - DNA, 16 bp, H. sapiens
tggagatatatatgta

SEQ ID NO: 150098 - DNA, 16 bp, H. sapiens
tggagatatttccttt

SEQ ID NO: 150099 - DNA, 17 bp, H. sapiens
tggagatctgagaacgg

SEQ ID NO: 150100 - DNA, 16 bp, H. sapiens
tggagatgaagagaaa

SEQ ID NO: 150101 - DNA, 16 bp, H. sapiens
tggagatgagaaactt

SEQ ID NO: 150102 - DNA, 16 bp, H. sapiens
tggagatgagatttca

SEQ ID NO: 150103 - DNA, 16 bp, H. sapiens
tggagatgcccctgac

SEQ ID NO: 150104 - DNA, 16 bp, H. sapiens
tggagatggaagccat

SEQ ID NO: 150105 - DNA, 16 bp, H. sapiens
tggagatggagatgga

SEQ ID NO: 150106 - DNA, 16 bp, H. sapiens
tggagatggagatggt

SEQ ID NO: 150107 - DNA, 16 bp, H. sapiens
tggagatgtaaatttg

SEQ ID NO: 150108 - DNA, 16 bp, H. sapiens
tggagatgtacaaaga

SEQ ID NO: 150109 - DNA, 16 bp, H. sapiens
tggagatgtacaagga

SEQ ID NO: 150110 - DNA, 16 bp, H. sapiens
tggagattccttaaag

SEQ ID NO: 150111 - DNA, 16 bp, H. sapiens
tggagattgagttcaa

SEQ ID NO: 150112 - DNA, 18 bp, H. sapiens
tggagattgcagtgagct

SEQ ID NO: 150113 - DNA, 16 bp, H. sapiens
tggagatttctaaaag

SEQ ID NO: 150114 - DNA, 16 bp, H. sapiens
tggagcaaaggtcaca

SEQ ID NO: 150115 - DNA, 16 bp, H. sapiens
tggagcaataggaaca

SEQ ID NO: 150116 - DNA, 18 bp, H. sapiens
tggagcaatctcggctca

SEQ ID NO: 150117 - DNA, 16 bp, H. sapiens
tggagcagaagaaata

SEQ ID NO: 150118 - DNA, 16 bp, H. sapiens
tggagcagagctgagt

SEQ ID NO: 150119 - DNA, 16 bp, H. sapiens
tggagcagaggcctga

SEQ ID NO: 150120 - DNA, 16 bp, H. sapiens
tggagcagcactttta

SEQ ID NO: 150121 - DNA, 20 bp, H. sapiens
tggagcagccccctttgaag

SEQ ID NO: 150122 - DNA, 16 bp, H. sapiens
tggagcagctggaaca

SEQ ID NO: 150123 - DNA, 16 bp, H. sapiens
tggagcagggcctggg

SEQ ID NO: 150124 - DNA, 16 bp, H. sapiens
tggagcaggggcctgg

SEQ ID NO: 150125 - DNA, 16 bp, H. sapiens
tggagcaggtgattgg

SEQ ID NO: 150126 - DNA, 16 bp, H. sapiens
tggagcagtgcctggc

SEQ ID NO: 150127 - DNA, 16 bp, H. sapiens
tggagcatttagccca

SEQ ID NO: 150128 - DNA, 17 bp, H. sapiens
tggagccaacccaaatg

SEQ ID NO: 150129 - DNA, 16 bp, H. sapiens
tggagccaccacacag

SEQ ID NO: 150130 - DNA, 16 bp, H. sapiens
tggagccagcaggagc

SEQ ID NO: 150131 - DNA, 16 bp, H. sapiens
tggagccaggagttca

SEQ ID NO: 150132 - DNA, 16 bp, H. sapiens
tggagccagtggactt

SEQ ID NO: 150133 - DNA, 16 bp, H. sapiens
tggagcccaccacagc

SEQ ID NO: 150134 - DNA, 16 bp, H. sapiens
tggagcccagcctggg

SEQ ID NO: 150135 - DNA, 16 bp, H. sapiens
tggagcccaggagtct

SEQ ID NO: 150136 - DNA, 16 bp, H. sapiens
tggagccccaacacag

SEQ ID NO: 150137 - DNA, 16 bp, H. sapiens
tggagcccgggaggca

SEQ ID NO: 150138 - DNA, 16 bp, H. sapiens
tggagcctcattctgt

SEQ ID NO: 150139 - DNA, 16 bp, H. sapiens
tggagcctccctctgt

SEQ ID NO: 150140 - DNA, 16 bp, H. sapiens
tggagcctgaagatgg

SEQ ID NO: 150141 - DNA, 16 bp, H. sapiens
tggagcctggctctgt

SEQ ID NO: 150142 - DNA, 16 bp, H. sapiens
tggagcctgggaggtg

SEQ ID NO: 150143 - DNA, 16 bp, H. sapiens
tggagcctggggtttg

SEQ ID NO: 150144 - DNA, 16 bp, H. sapiens
tggagcctggtggaag

SEQ ID NO: 150145 - DNA, 16 bp, H. sapiens
tggagcctttgggaag

SEQ ID NO: 150146 - DNA, 16 bp, H. sapiens
tggagccttttttttt

SEQ ID NO: 150147 - DNA, 16 bp, H. sapiens
tggagcgctttgagga

SEQ ID NO: 150148 - DNA, 16 bp, H. sapiens
tggagcggctgggaca

SEQ ID NO: 150149 - DNA, 16 bp, H. sapiens
tggagctcaggtggta

SEQ ID NO: 150150 - DNA, 16 bp, H. sapiens
tggagctcccagagga

SEQ ID NO: 150151 - DNA, 16 bp, H. sapiens
tggagctctttgagga

SEQ ID NO: 150152 - DNA, 16 bp, H. sapiens
tggagctgaaaaacaa

SEQ ID NO: 150153 - DNA, 16 bp, H. sapiens
tggagctgaagaagct

SEQ ID NO: 150154 - DNA, 16 bp, H. sapiens
tggagctgaggcagtg

SEQ ID NO: 150155 - DNA, 16 bp, H. sapiens
tggagctgcccaagac

SEQ ID NO: 150156 - DNA, 16 bp, H. sapiens
tggagctgcttgccag

SEQ ID NO: 150157 - DNA, 16 bp, H. sapiens
tggagctggaaaccat

SEQ ID NO: 150158 - DNA, 16 bp, H. sapiens
tggagctggaagccat

SEQ ID NO: 150159 - DNA, 16 bp, H. sapiens
tggagctggaatttga

SEQ ID NO: 150160 - DNA, 16 bp, H. sapiens
tggagctggagcagcc

SEQ ID NO: 150161 - DNA, 16 bp, H. sapiens
tggagctggagcagct

SEQ ID NO: 150162 - DNA, 16 bp, H. sapiens
tggagctggagcctgg

SEQ ID NO: 150163 - DNA, 16 bp, H. sapiens
tggagctggagctggg

SEQ ID NO: 150164 - DNA, 16 bp, H. sapiens
tggagctggaggccag

SEQ ID NO: 150165 - DNA, 16 bp, H. sapiens
tggagctggaggccat

SEQ ID NO: 150166 - DNA, 16 bp, H. sapiens
tggagctggagggcat

SEQ ID NO: 150167 - DNA, 16 bp, H. sapiens
tggagctggaggtcat

SEQ ID NO: 150168 - DNA, 16 bp, H. sapiens
tggagctggagtgcag

SEQ ID NO: 150169 - DNA, 16 bp, H. sapiens
tggagctgggaaaact

SEQ ID NO: 150170 - DNA, 16 bp, H. sapiens
tggagctggggcctgg

SEQ ID NO: 150171 - DNA, 16 bp, H. sapiens
tggagctgtaagtcca

SEQ ID NO: 150172 - DNA, 16 bp, H. sapiens
tggagctgtgcctgtg

SEQ ID NO: 150173 - DNA, 16 bp, H. sapiens
tggagctgtgggtggg

SEQ ID NO: 150174 - DNA, 16 bp, H. sapiens
tggagcttccagaagg

SEQ ID NO: 150175 - DNA, 21 bp, H. sapiens
tggagcttgcagtgagcagag

SEQ ID NO: 150176 - DNA, 16 bp, H. sapiens
tggaggaaacttcagt

SEQ ID NO: 150177 - DNA, 16 bp, H. sapiens
tggaggaaagaagaca

SEQ ID NO: 150178 - DNA, 16 bp, H. sapiens
tggaggaactacagag

SEQ ID NO: 150179 - DNA, 16 bp, H. sapiens
tggaggaagaggccac

SEQ ID NO: 150180 - DNA, 16 bp, H. sapiens
tggaggaagatctgcc

SEQ ID NO: 150181 - DNA, 16 bp, H. sapiens
tggaggaaggaatgct

SEQ ID NO: 150182 - DNA, 16 bp, H. sapiens
tggaggaaggagcagg

SEQ ID NO: 150183 - DNA, 16 bp, H. sapiens
tggaggacaagagtga

SEQ ID NO: 150184 - DNA, 16 bp, H. sapiens
tggaggacacccagct

SEQ ID NO: 150185 - DNA, 16 bp, H. sapiens
tggaggacagagggag

SEQ ID NO: 150186 - DNA, 16 bp, H. sapiens
tggaggacagtgtggc

SEQ ID NO: 150187 - DNA, 16 bp, H. sapiens
tggaggacgaggaggg

SEQ ID NO: 150188 - DNA, 16 bp, H. sapiens
tggaggactggaagat

SEQ ID NO: 150189 - DNA, 16 bp, H. sapiens
tggaggagaagcagca

SEQ ID NO: 150190 - DNA, 16 bp, H. sapiens
tggaggagaaggggca

SEQ ID NO: 150191 - DNA, 16 bp, H. sapiens
tggaggagaggcctgg

SEQ ID NO: 150192 - DNA, 16 bp, H. sapiens
tggaggaggagaagcg

SEQ ID NO: 150193 - DNA, 16 bp, H. sapiens
tggaggaggagagacg

SEQ ID NO: 150194 - DNA, 16 bp, H. sapiens
tggaggaggagaggcg

SEQ ID NO: 150195 - DNA, 16 bp, H. sapiens
tggaggaggagcagga

SEQ ID NO: 150196 - DNA, 16 bp, H. sapiens
tggaggaggagcctgg

SEQ ID NO: 150197 - DNA, 16 bp, H. sapiens
tggaggaggaggcagg

SEQ ID NO: 150198 - DNA, 16 bp, H. sapiens
tggaggaggaggcatt

SEQ ID NO: 150199 - DNA, 16 bp, H. sapiens
tggaggaggaggttgc

SEQ ID NO: 150200 - DNA, 16 bp, H. sapiens
tggaggaggctgggga

SEQ ID NO: 150201 - DNA, 16 bp, H. sapiens
tggaggaggctgtgca

SEQ ID NO: 150202 - DNA, 16 bp, H. sapiens
tggaggaggggcctga

SEQ ID NO: 150203 - DNA, 16 bp, H. sapiens
tggaggatgagaagtc

SEQ ID NO: 150204 - DNA, 16 bp, H. sapiens
tggaggatgagatgga

SEQ ID NO: 150205 - DNA, 16 bp, H. sapiens
tggaggatgcagtgaa

SEQ ID NO: 150206 - DNA, 16 bp, H. sapiens
tggaggatggcttgag

SEQ ID NO: 150207 - DNA, 17 bp, H. sapiens
tggaggatggtggccct

SEQ ID NO: 150208 - DNA, 16 bp, H. sapiens
tggaggatgtgcaggt

SEQ ID NO: 150209 - DNA, 16 bp, H. sapiens
tggaggcaagaccctc

SEQ ID NO: 150210 - DNA, 16 bp, H. sapiens
tggaggcagaagctct

SEQ ID NO: 150211 - DNA, 16 bp, H. sapiens
tggaggcagagaacct

SEQ ID NO: 150212 - DNA, 16 bp, H. sapiens
tggaggcagagcttgc

SEQ ID NO: 150213 - DNA, 16 bp, H. sapiens
tggaggcagaggtggc

SEQ ID NO: 150214 - DNA, 16 bp, H. sapiens
tggaggcagagtttgc

SEQ ID NO: 150215 - DNA, 16 bp, H. sapiens
tggaggcagcagggga

SEQ ID NO: 150216 - DNA, 16 bp, H. sapiens
tggaggcagcagtgag

SEQ ID NO: 150217 - DNA, 16 bp, H. sapiens
tggaggcaggagctgg

SEQ ID NO: 150218 - DNA, 16 bp, H. sapiens
tggaggcaggagggag

SEQ ID NO: 150219 - DNA, 16 bp, H. sapiens
tggaggcagggaacat

SEQ ID NO: 150220 - DNA, 25 bp, H. sapiens
tggaggcagggcgagatcacaggac

SEQ ID NO: 150221 - DNA, 16 bp, H. sapiens
tggaggcatcacatta

SEQ ID NO: 150222 - DNA, 16 bp, H. sapiens
tggaggcatcagacta

SEQ ID NO: 150223 - DNA, 16 bp, H. sapiens
tggaggcattttcccc

SEQ ID NO: 150224 - DNA, 16 bp, H. sapiens
tggaggccagaaggaa

SEQ ID NO: 150225 - DNA, 16 bp, H. sapiens
tggaggccagagtctg

SEQ ID NO: 150226 - DNA, 16 bp, H. sapiens
tggaggccaggaatgc

SEQ ID NO: 150227 - DNA, 16 bp, H. sapiens
tggaggccaggtgcag

SEQ ID NO: 150228 - DNA, 16 bp, H. sapiens
tggaggccaggtgcgg

SEQ ID NO: 150229 - DNA, 16 bp, H. sapiens
tggaggccatcctggc

SEQ ID NO: 150230 - DNA, 16 bp, H. sapiens
tggaggccattgtctt

SEQ ID NO: 150231 - DNA, 16 bp, H. sapiens
tggaggcccaggcagg

SEQ ID NO: 150232 - DNA, 16 bp, H. sapiens
tggaggccgaggcagg

SEQ ID NO: 150233 - DNA, 16 bp, H. sapiens
tggaggccgaggtggg

SEQ ID NO: 150234 - DNA, 16 bp, H. sapiens
tggaggccgggcgcag

SEQ ID NO: 150235 - DNA, 16 bp, H. sapiens
tggaggcctggggagg

SEQ ID NO: 150236 - DNA, 16 bp, H. sapiens
tggaggctacaagatt

SEQ ID NO: 150237 - DNA, 16 bp, H. sapiens
tggaggctattatctt

SEQ ID NO: 150238 - DNA, 16 bp, H. sapiens
tggaggctcacacctg

SEQ ID NO: 150239 - DNA, 16 bp, H. sapiens
tggaggctcatgcctg

SEQ ID NO: 150240 - DNA, 16 bp, H. sapiens
tggaggctcccaagcc

SEQ ID NO: 150241 - DNA, 16 bp, H. sapiens
tggaggctctgaagga

SEQ ID NO: 150242 - DNA, 16 bp, H. sapiens
tggaggctctgaggga

SEQ ID NO: 150243 - DNA, 16 bp, H. sapiens
tggaggctctggggag

SEQ ID NO: 150244 - DNA, 16 bp, H. sapiens
tggaggctgaaagtct

SEQ ID NO: 150245 - DNA, 16 bp, H. sapiens
tggaggctgagctggg

SEQ ID NO: 150246 - DNA, 16 bp, H. sapiens
tggaggctgaggcatg

SEQ ID NO: 150247 - DNA, 16 bp, H. sapiens
tggaggctgaggtgag

SEQ ID NO: 150248 - DNA, 16 bp, H. sapiens
tggaggctgaggtggg

SEQ ID NO: 150249 - DNA, 16 bp, H. sapiens
tggaggctgcagagag

SEQ ID NO: 150250 - DNA, 16 bp, H. sapiens
tggaggctgccaaggc

SEQ ID NO: 150251 - DNA, 16 bp, H. sapiens
tggaggctggaagtct

SEQ ID NO: 150252 - DNA, 16 bp, H. sapiens
tggaggctggagggag

SEQ ID NO: 150253 - DNA, 16 bp, H. sapiens
tggaggctgggaagtg

SEQ ID NO: 150254 - DNA, 16 bp, H. sapiens
tggaggctgggcatgg

SEQ ID NO: 150255 - DNA, 16 bp, H. sapiens
tggaggctgggcgtgg

SEQ ID NO: 150256 - DNA, 16 bp, H. sapiens
tggaggctggggctgc

SEQ ID NO: 150257 - DNA, 16 bp, H. sapiens
tggaggctgtgaaggc

SEQ ID NO: 150258 - DNA, 16 bp, H. sapiens
tggaggctgtgaagtc

SEQ ID NO: 150259 - DNA, 16 bp, H. sapiens
tggaggctgtggcagg

SEQ ID NO: 150260 - DNA, 16 bp, H. sapiens
tggaggcttcagggga

SEQ ID NO: 150261 - DNA, 16 bp, H. sapiens
tggaggcttctattca

SEQ ID NO: 150262 - DNA, 16 bp, H. sapiens
tggaggcttggaagtc

SEQ ID NO: 150263 - DNA, 16 bp, H. sapiens
tggaggctttagagaa

SEQ ID NO: 150264 - DNA, 16 bp, H. sapiens
tggaggctttgttcat

SEQ ID NO: 150265 - DNA, 16 bp, H. sapiens
tggaggctttgttctt

SEQ ID NO: 150266 - DNA, 16 bp, H. sapiens
tggagggacctggtgg

SEQ ID NO: 150267 - DNA, 16 bp, H. sapiens
tggagggagaggcaca

SEQ ID NO: 150268 - DNA, 16 bp, H. sapiens
tggagggagggagagc

SEQ ID NO: 150269 - DNA, 16 bp, H. sapiens
tggagggcaaaaggca

SEQ ID NO: 150270 - DNA, 16 bp, H. sapiens
tggagggcaggaagca

SEQ ID NO: 150271 - DNA, 16 bp, H. sapiens
tggagggcaggaggag

SEQ ID NO: 150272 - DNA, 16 bp, H. sapiens
tggagggcagtgacgc

SEQ ID NO: 150273 - DNA, 16 bp, H. sapiens
tggagggctcagaaga

SEQ ID NO: 150274 - DNA, 16 bp, H. sapiens
tggagggctgcaggtc

SEQ ID NO: 150275 - DNA, 16 bp, H. sapiens
tggaggggactgtggg

SEQ ID NO: 150276 - DNA, 16 bp, H. sapiens
tggaggggctgctgtg

SEQ ID NO: 150277 - DNA, 16 bp, H. sapiens
tggagggtcaggccac

SEQ ID NO: 150278 - DNA, 16 bp, H. sapiens
tggagggtggaagttt

SEQ ID NO: 150279 - DNA, 16 bp, H. sapiens
tggagggtggtggccc

SEQ ID NO: 150280 - DNA, 16 bp, H. sapiens
tggaggtagggcctgg

SEQ ID NO: 150281 - DNA, 16 bp, H. sapiens
tggaggtctggggagt

SEQ ID NO: 150282 - DNA, 16 bp, H. sapiens
tggaggtgatggtggc

SEQ ID NO: 150283 - DNA, 16 bp, H. sapiens
tggaggtgctctctgg

SEQ ID NO: 150284 - DNA, 16 bp, H. sapiens
tggaggtggaagatag

SEQ ID NO: 150285 - DNA, 16 bp, H. sapiens
tggaggtggagccttt

SEQ ID NO: 150286 - DNA, 16 bp, H. sapiens
tggaggtggcagtgaa

SEQ ID NO: 150287 - DNA, 16 bp, H. sapiens
tggaggtggcagtggg

SEQ ID NO: 150288 - DNA, 16 bp, H. sapiens
tggaggtggggcatgg

SEQ ID NO: 150289 - DNA, 16 bp, H. sapiens
tggaggtggggcctgg

SEQ ID NO: 150290 - DNA, 16 bp, H. sapiens
tggaggtggggccttt

SEQ ID NO: 150291 - DNA, 16 bp, H. sapiens
tggaggtggggctgag

SEQ ID NO: 150292 - DNA, 16 bp, H. sapiens
tggaggtgggggttgc

SEQ ID NO: 150293 - DNA, 16 bp, H. sapiens
tggaggttcctggagg

SEQ ID NO: 150294 - DNA, 16 bp, H. sapiens
tggaggttgcagtggc

SEQ ID NO: 150295 - DNA, 16 bp, H. sapiens
tggaggttgggaagag

SEQ ID NO: 150296 - DNA, 16 bp, H. sapiens
tggagtaatgaaaatg

SEQ ID NO: 150297 - DNA, 17 bp, H. sapiens
tggagtacaatggcaca

SEQ ID NO: 150298 - DNA, 16 bp, H. sapiens
tggagtacagtagcat

SEQ ID NO: 150299 - DNA, 17 bp, H. sapiens
tggagtagccattcttt

SEQ ID NO: 150300 - DNA, 16 bp, H. sapiens
tggagtagctgggatt

SEQ ID NO: 150301 - DNA, 16 bp, H. sapiens
tggagtagggtgggcc

SEQ ID NO: 150302 - DNA, 16 bp, H. sapiens
tggagtatcttactgg

SEQ ID NO: 150303 - DNA, 16 bp, H. sapiens
tggagtattattcagc

SEQ ID NO: 150304 - DNA, 16 bp, H. sapiens
tggagtcaaaggagat

SEQ ID NO: 150305 - DNA, 16 bp, H. sapiens
tggagtcaaaggggat

SEQ ID NO: 150306 - DNA, 16 bp, H. sapiens
tggagtcacagttcca

SEQ ID NO: 150307 - DNA, 16 bp, H. sapiens
tggagtccagtggcat

SEQ ID NO: 150308 - DNA, 16 bp, H. sapiens
tggagtcccagaagga

SEQ ID NO: 150309 - DNA, 16 bp, H. sapiens
tggagtcccagctact

SEQ ID NO: 150310 - DNA, 16 bp, H. sapiens
tggagtcccagctctg

SEQ ID NO: 150311 - DNA, 16 bp, H. sapiens
tggagtcctgctctgt

SEQ ID NO: 150312 - DNA, 16 bp, H. sapiens
tggagtctcactgtct

SEQ ID NO: 150313 - DNA, 16 bp, H. sapiens
tggagtctctctctct

SEQ ID NO: 150314 - DNA, 16 bp, H. sapiens
tggagtctctctcttg

SEQ ID NO: 150315 - DNA, 16 bp, H. sapiens
tggagtctctgttgcc

SEQ ID NO: 150316 - DNA, 16 bp, H. sapiens
tggagtctgcagtgag

SEQ ID NO: 150317 - DNA, 16 bp, H. sapiens
tggagtctggagtgca

SEQ ID NO: 150318 - DNA, 16 bp, H. sapiens
tggagtctggctctct

SEQ ID NO: 150319 - DNA, 16 bp, H. sapiens
tggagtctggtgaggg

SEQ ID NO: 150320 - DNA, 16 bp, H. sapiens
tggagtctgtctctgt

SEQ ID NO: 150321 - DNA, 16 bp, H. sapiens
tggagtcttgctctat

SEQ ID NO: 150322 - DNA, 16 bp, H. sapiens
tggagtcttgcttttg

SEQ ID NO: 150323 - DNA, 16 bp, H. sapiens
tggagtgaaatattta

SEQ ID NO: 150324 - DNA, 16 bp, H. sapiens
tggagtgagctgagat

SEQ ID NO: 150325 - DNA, 16 bp, H. sapiens
tggagtgagtgcctgg

SEQ ID NO: 150326 - DNA, 16 bp, H. sapiens
tggagtgagtggagtg

SEQ ID NO: 150327 - DNA, 17 bp, H. sapiens
tggagtgcaatggcaca

SEQ ID NO: 150328 - DNA, 16 bp, H. sapiens
tggagtgcaatggcct

SEQ ID NO: 150329 - DNA, 16 bp, H. sapiens
tggagtgcaattgtgt

SEQ ID NO: 150330 - DNA, 16 bp, H. sapiens
tggagtgcagagacac

SEQ ID NO: 150331 - DNA, 16 bp, H. sapiens
tggagtgcagatatct

SEQ ID NO: 150332 - DNA, 16 bp, H. sapiens
tggagtgcagcagtgt

SEQ ID NO: 150333 - DNA, 16 bp, H. sapiens
tggagtgcagtagcgc

SEQ ID NO: 150334 - DNA, 16 bp, H. sapiens
tggagtgcagtcatgc

SEQ ID NO: 150335 - DNA, 16 bp, H. sapiens
tggagtgcagtgacaa

SEQ ID NO: 150336 - DNA, 16 bp, H. sapiens
tggagtgcagtgacga

SEQ ID NO: 150337 - DNA, 17 bp, H. sapiens
tggagtgcagtggagca

SEQ ID NO: 150338 - DNA, 19 bp, H. sapiens
tggagtgcagtggcgagat

SEQ ID NO: 150339 - DNA, 16 bp, H. sapiens
tggagtgcagtgggac

SEQ ID NO: 150340 - DNA, 16 bp, H. sapiens
tggagtgcagtgggtg

SEQ ID NO: 150341 - DNA, 16 bp, H. sapiens
tggagtgcagtggtac

SEQ ID NO: 150342 - DNA, 16 bp, H. sapiens
tggagtgcagtggtgg

SEQ ID NO: 150343 - DNA, 16 bp, H. sapiens
tggagtgcagtgttga

SEQ ID NO: 150344 - DNA, 16 bp, H. sapiens
tggagtgcatggcgtg

SEQ ID NO: 150345 - DNA, 16 bp, H. sapiens
tggagtgccatggcac

SEQ ID NO: 150346 - DNA, 21 bp, H. sapiens
tggagtgcggtggcgcgatct

SEQ ID NO: 150347 - DNA, 16 bp, H. sapiens
tggagtgcggtggtgt

SEQ ID NO: 150348 - DNA, 16 bp, H. sapiens
tggagtggacttccag

SEQ ID NO: 150349 - DNA, 17 bp, H. sapiens
tggagtggagtggcaca

SEQ ID NO: 150350 - DNA, 16 bp, H. sapiens
tggagtggctgtggca

SEQ ID NO: 150351 - DNA, 17 bp, H. sapiens
tggagtgtggtggcacg

SEQ ID NO: 150352 - DNA, 16 bp, H. sapiens
tggagttactcttctc

SEQ ID NO: 150353 - DNA, 16 bp, H. sapiens
tggagttcagtggcac

SEQ ID NO: 150354 - DNA, 17 bp, H. sapiens
tggagttcagtggtgca

SEQ ID NO: 150355 - DNA, 16 bp, H. sapiens
tggagttcagtggtgg

SEQ ID NO: 150356 - DNA, 16 bp, H. sapiens
tggagttcattcaaat

SEQ ID NO: 150357 - DNA, 17 bp, H. sapiens
tggagttcctgcaggga

SEQ ID NO: 150358 - DNA, 16 bp, H. sapiens
tggagttgaaaaatgc

SEQ ID NO: 150359 - DNA, 16 bp, H. sapiens
tggagttgaaaaattc

SEQ ID NO: 150360 - DNA, 16 bp, H. sapiens
tggagttgctgaaatt

SEQ ID NO: 150361 - DNA, 16 bp, H. sapiens
tggagttggagccccc

SEQ ID NO: 150362 - DNA, 18 bp, H. sapiens
tggagtttcactcttgtt

SEQ ID NO: 150363 - DNA, 16 bp, H. sapiens
tggagtttcactcttt

SEQ ID NO: 150364 - DNA, 16 bp, H. sapiens
tggagtttgatggcct

SEQ ID NO: 150365 - DNA, 16 bp, H. sapiens
tggagtttgcagtaag

SEQ ID NO: 150366 - DNA, 16 bp, H. sapiens
tggagtttgctgaagg

SEQ ID NO: 150367 - DNA, 16 bp, H. sapiens
tggagtttgctgttga

SEQ ID NO: 150368 - DNA, 16 bp, H. sapiens
tggagttttaaatttt

SEQ ID NO: 150369 - DNA, 16 bp, H. sapiens
tggagttttctagata

SEQ ID NO: 150370 - DNA, 16 bp, H. sapiens
tggagttttgctctgt

SEQ ID NO: 150371 - DNA, 16 bp, H. sapiens
tggagttttgttcttt

SEQ ID NO: 150372 - DNA, 16 bp, H. sapiens
tggagtttttaactct

SEQ ID NO: 150373 - DNA, 16 bp, H. sapiens
tggataaacaaaatat

SEQ ID NO: 150374 - DNA, 16 bp, H. sapiens
tggataaactgaggca

SEQ ID NO: 150375 - DNA, 16 bp, H. sapiens
tggataaagaaaatat

SEQ ID NO: 150376 - DNA, 16 bp, H. sapiens
tggataaagaaaatgc

SEQ ID NO: 150377 - DNA, 16 bp, H. sapiens
tggataaagaaaatgt

SEQ ID NO: 150378 - DNA, 16 bp, H. sapiens
tggataaagaaaattt

SEQ ID NO: 150379 - DNA, 16 bp, H. sapiens
tggataaagaaactct

SEQ ID NO: 150380 - DNA, 16 bp, H. sapiens
tggataaagaaagcat

SEQ ID NO: 150381 - DNA, 16 bp, H. sapiens
tggataaagaatatgt

SEQ ID NO: 150382 - DNA, 41 bp, H. sapiens
tggataaagagtcaagacccatcagtgtgctgtattcagga

SEQ ID NO: 150383 - DNA, 16 bp, H. sapiens
tggataaataaactat

SEQ ID NO: 150384 - DNA, 16 bp, H. sapiens
tggataaataaattat

SEQ ID NO: 150385 - DNA, 16 bp, H. sapiens
tggataaatggataaa

SEQ ID NO: 150386 - DNA, 16 bp, H. sapiens
tggataaattccttaa

SEQ ID NO: 150387 - DNA, 16 bp, H. sapiens
tggataagcaaaatgc

SEQ ID NO: 150388 - DNA, 16 bp, H. sapiens
tggataagcttttaga

SEQ ID NO: 150389 - DNA, 16 bp, H. sapiens
tggataaggagggact

SEQ ID NO: 150390 - DNA, 17 bp, H. sapiens
tggataaggagtcaaga

SEQ ID NO: 150391 - DNA, 16 bp, H. sapiens
tggataaggtggagga

SEQ ID NO: 150392 - DNA, 16 bp, H. sapiens
tggataattctttgtt

SEQ ID NO: 150393 - DNA, 16 bp, H. sapiens
tggataatttcctgga

SEQ ID NO: 150394 - DNA, 16 bp, H. sapiens
tggatacacaaaatgt

SEQ ID NO: 150395 - DNA, 16 bp, H. sapiens
tggatacagaaaatgt

SEQ ID NO: 150396 - DNA, 16 bp, H. sapiens
tggatacagagtcaag

SEQ ID NO: 150397 - DNA, 16 bp, H. sapiens
tggatagatagacaga

SEQ ID NO: 150398 - DNA, 16 bp, H. sapiens
tggatagattccaaaa

SEQ ID NO: 150399 - DNA, 16 bp, H. sapiens
tggatagtgatgatgg

SEQ ID NO: 150400 - DNA, 16 bp, H. sapiens
tggatataagccattt

SEQ ID NO: 150401 - DNA, 16 bp, H. sapiens
tggatataccataatt

SEQ ID NO: 150402 - DNA, 16 bp, H. sapiens
tggatatatacacaaa

SEQ ID NO: 150403 - DNA, 16 bp, H. sapiens
tggatatattttcttt

SEQ ID NO: 150404 - DNA, 16 bp, H. sapiens
tggatatattttgaaa

SEQ ID NO: 150405 - DNA, 16 bp, H. sapiens
tggatatcatggaaat

SEQ ID NO: 150406 - DNA, 16 bp, H. sapiens
tggatatccatattca

SEQ ID NO: 150407 - DNA, 16 bp, H. sapiens
tggatatggatatata

SEQ ID NO: 150408 - DNA, 16 bp, H. sapiens
tggatatgtgtatata

SEQ ID NO: 150409 - DNA, 16 bp, H. sapiens
tggatattagaccttt

SEQ ID NO: 150410 - DNA, 16 bp, H. sapiens
tggatattagagcttt

SEQ ID NO: 150411 - DNA, 16 bp, H. sapiens
tggatatttaaaaaca

SEQ ID NO: 150412 - DNA, 16 bp, H. sapiens
tggatatttaaaacaa

SEQ ID NO: 150413 - DNA, 16 bp, H. sapiens
tggatatttagttttc

SEQ ID NO: 150414 - DNA, 16 bp, H. sapiens
tggatatttcaaaata

SEQ ID NO: 150415 - DNA, 16 bp, H. sapiens
tggatatttgatattt

SEQ ID NO: 150416 - DNA, 16 bp, H. sapiens
tggatatttttccatt

SEQ ID NO: 150417 - DNA, 16 bp, H. sapiens
tggatcaaaaaagaaa

SEQ ID NO: 150418 - DNA, 16 bp, H. sapiens
tggatcaaatggtatt

SEQ ID NO: 150419 - DNA, 16 bp, H. sapiens
tggatcaactgaggtc

SEQ ID NO: 150420 - DNA, 16 bp, H. sapiens
tggatcaagggggcag

SEQ ID NO: 150421 - DNA, 16 bp, H. sapiens
tggatcacacctgtaa

SEQ ID NO: 150422 - DNA, 16 bp, H. sapiens
tggatcacagacttaa

SEQ ID NO: 150423 - DNA, 23 bp, H. sapiens
tggatcacctgaggtcagcagtt

SEQ ID NO: 150424 - DNA, 16 bp, H. sapiens
tggatcacgggggcag

SEQ ID NO: 150425 - DNA, 16 bp, H. sapiens
tggatcactgctgcag

SEQ ID NO: 150426 - DNA, 23 bp, H. sapiens
tggatcacttgaggtcaggagct

SEQ ID NO: 150427 - DNA, 17 bp, H. sapiens
tggatcagctgacacca

SEQ ID NO: 150428 - DNA, 16 bp, H. sapiens
tggatcatagatttaa

SEQ ID NO: 150429 - DNA, 16 bp, H. sapiens
tggatcccaaggtggc

SEQ ID NO: 150430 - DNA, 16 bp, H. sapiens
tggatcctggatcctg

SEQ ID NO: 150431 - DNA, 16 bp, H. sapiens
tggatccttcatgaat

SEQ ID NO: 150432 - DNA, 16 bp, H. sapiens
tggatccttccccagt

SEQ ID NO: 150433 - DNA, 16 bp, H. sapiens
tggatccttgaggaat

SEQ ID NO: 150434 - DNA, 20 bp, H. sapiens
tggatcgggggacctccctt

SEQ ID NO: 150435 - DNA, 16 bp, H. sapiens
tggatcgtgggggtgg

SEQ ID NO: 150436 - DNA, 16 bp, H. sapiens
tggatctaccattctc

SEQ ID NO: 150437 - DNA, 16 bp, H. sapiens
tggatctaccattctg

SEQ ID NO: 150438 - DNA, 38 bp, H. sapiens
tggatctcacaaagtacattctcaagggtggggagaat

SEQ ID NO: 150439 - DNA, 16 bp, H. sapiens
tggatctcagtttctt

SEQ ID NO: 150440 - DNA, 16 bp, H. sapiens
tggatctggaggccat

SEQ ID NO: 150441 - DNA, 16 bp, H. sapiens
tggatcttctgtcttt

SEQ ID NO: 150442 - DNA, 16 bp, H. sapiens
tggatcttggagaatg

SEQ ID NO: 150443 - DNA, 16 bp, H. sapiens
tggatcttgtttttct

SEQ ID NO: 150444 - DNA, 16 bp, H. sapiens
tggatgaaaaatattt

SEQ ID NO: 150445 - DNA, 17 bp, H. sapiens
tggatgaaactggaaat

SEQ ID NO: 150446 - DNA, 16 bp, H. sapiens
tggatgaaacttgaaa

SEQ ID NO: 150447 - DNA, 16 bp, H. sapiens
tggatgaaattagaaa

SEQ ID NO: 150448 - DNA, 16 bp, H. sapiens
tggatgaaattgaaaa

SEQ ID NO: 150449 - DNA, 16 bp, H. sapiens
tggatgaaattggaga

SEQ ID NO: 150450 - DNA, 16 bp, H. sapiens
tggatgaaattgggaa

SEQ ID NO: 150451 - DNA, 16 bp, H. sapiens
tggatgaacaaataaa

SEQ ID NO: 150452 - DNA, 16 bp, H. sapiens
tggatgaacagataaa

SEQ ID NO: 150453 - DNA, 16 bp, H. sapiens
tggatgaacagatgga

SEQ ID NO: 150454 - DNA, 16 bp, H. sapiens
tggatgaaccctgaag

SEQ ID NO: 150455 - DNA, 16 bp, H. sapiens
tggatgaacttgaaaa

SEQ ID NO: 150456 - DNA, 16 bp, H. sapiens
tggatgaagctgaaaa

SEQ ID NO: 150457 - DNA, 16 bp, H. sapiens
tggatgaagctggata

SEQ ID NO: 150458 - DNA, 16 bp, H. sapiens
tggatgaaggtggaaa

SEQ ID NO: 150459 - DNA, 16 bp, H. sapiens
tggatgaataaataaa

SEQ ID NO: 150460 - DNA, 16 bp, H. sapiens
tggatgaatcacaaaa

SEQ ID NO: 150461 - DNA, 16 bp, H. sapiens
tggatgaatctgaaaa

SEQ ID NO: 150462 - DNA, 16 bp, H. sapiens
tggatgaatcttgaaa

SEQ ID NO: 150463 - DNA, 16 bp, H. sapiens
tggatgaatggaagga

SEQ ID NO: 150464 - DNA, 16 bp, H. sapiens
tggatgaatggatgga

SEQ ID NO: 150465 - DNA, 16 bp, H. sapiens
tggatgaatggatttt

SEQ ID NO: 150466 - DNA, 16 bp, H. sapiens
tggatgaattaatgaa

SEQ ID NO: 150467 - DNA, 16 bp, H. sapiens
tggatgaattgtatgg

SEQ ID NO: 150468 - DNA, 16 bp, H. sapiens
tggatgaatttcaaaa

SEQ ID NO: 150469 - DNA, 16 bp, H. sapiens
tggatgacaagagtga

SEQ ID NO: 150470 - DNA, 16 bp, H. sapiens
tggatgacactggaaa

SEQ ID NO: 150471 - DNA, 16 bp, H. sapiens
tggatgacagaaggag

SEQ ID NO: 150472 - DNA, 16 bp, H. sapiens
tggatgacttggaggg

SEQ ID NO: 150473 - DNA, 16 bp, H. sapiens
tggatgactttgagaa

SEQ ID NO: 150474 - DNA, 16 bp, H. sapiens
tggatgactttgagga

SEQ ID NO: 150475 - DNA, 16 bp, H. sapiens
tggatgacttttattt

SEQ ID NO: 150476 - DNA, 16 bp, H. sapiens
tggatgagcaaaatgt

SEQ ID NO: 150477 - DNA, 16 bp, H. sapiens
tggatgatcagttaaa

SEQ ID NO: 150478 - DNA, 16 bp, H. sapiens
tggatgatgatgatga

SEQ ID NO: 150479 - DNA, 16 bp, H. sapiens
tggatgatggatggat

SEQ ID NO: 150480 - DNA, 16 bp, H. sapiens
tggatgattttgaggg

SEQ ID NO: 150481 - DNA, 16 bp, H. sapiens
tggatgcacacacaca

SEQ ID NO: 150482 - DNA, 16 bp, H. sapiens
tggatgcacagcagga

SEQ ID NO: 150483 - DNA, 16 bp, H. sapiens
tggatgcagcaaacca

SEQ ID NO: 150484 - DNA, 16 bp, H. sapiens
tggatgcagctagagg

SEQ ID NO: 150485 - DNA, 16 bp, H. sapiens
tggatgcagctggaga

SEQ ID NO: 150486 - DNA, 16 bp, H. sapiens
tggatgcattttattt

SEQ ID NO: 150487 - DNA, 16 bp, H. sapiens
tggatgctgctaaaca

SEQ ID NO: 150488 - DNA, 16 bp, H. sapiens
tggatgctgctggagg

SEQ ID NO: 150489 - DNA, 16 bp, H. sapiens
tggatgctgctgtgga

SEQ ID NO: 150490 - DNA, 16 bp, H. sapiens
tggatggaaggaagga

SEQ ID NO: 150491 - DNA, 16 bp, H. sapiens
tggatggacagacaga

SEQ ID NO: 150492 - DNA, 16 bp, H. sapiens
tggatggacagaggga

SEQ ID NO: 150493 - DNA, 16 bp, H. sapiens
tggatggacagatgga

SEQ ID NO: 150494 - DNA, 16 bp, H. sapiens
tggatggacctggaag

SEQ ID NO: 150495 - DNA, 16 bp, H. sapiens
tggatggagatggagg

SEQ ID NO: 150496 - DNA, 16 bp, H. sapiens
tggatggagcaggagg

SEQ ID NO: 150497 - DNA, 16 bp, H. sapiens
tggatggagctagaag

SEQ ID NO: 150498 - DNA, 16 bp, H. sapiens
tggatggagctgaagg

SEQ ID NO: 150499 - DNA, 16 bp, H. sapiens
tggatggagctggagg

SEQ ID NO: 150500 - DNA, 16 bp, H. sapiens
tggatggagttggagg

SEQ ID NO: 150501 - DNA, 16 bp, H. sapiens
tggatggatagatgga

SEQ ID NO: 150502 - DNA, 16 bp, H. sapiens
tggatggatcatctga

SEQ ID NO: 150503 - DNA, 16 bp, H. sapiens
tggatggatgaataca

SEQ ID NO: 150504 - DNA, 16 bp, H. sapiens
tggatggatgaatgga

SEQ ID NO: 150505 - DNA, 16 bp, H. sapiens
tggatggatgatgatg

SEQ ID NO: 150506 - DNA, 17 bp, H. sapiens
tggatggatgcatgcat

SEQ ID NO: 150507 - DNA, 16 bp, H. sapiens
tggatggatgcatggg

SEQ ID NO: 150508 - DNA, 16 bp, H. sapiens
tggatggatggactga

SEQ ID NO: 150509 - DNA, 16 bp, H. sapiens
tggatggatggataaa

SEQ ID NO: 150510 - DNA, 16 bp, H. sapiens
tggatggatggatgga

SEQ ID NO: 150511 - DNA, 16 bp, H. sapiens
tggatggatgggggat

SEQ ID NO: 150512 - DNA, 16 bp, H. sapiens
tggatggattacttga

SEQ ID NO: 150513 - DNA, 16 bp, H. sapiens
tggatggccctcaggg

SEQ ID NO: 150514 - DNA, 16 bp, H. sapiens
tggatgggagcagctt

SEQ ID NO: 150515 - DNA, 16 bp, H. sapiens
tggatgggattctgga

SEQ ID NO: 150516 - DNA, 16 bp, H. sapiens
tggatgggcaccatct

SEQ ID NO: 150517 - DNA, 16 bp, H. sapiens
tggatggggacacagc

SEQ ID NO: 150518 - DNA, 16 bp, H. sapiens
tggatggggagctgga

SEQ ID NO: 150519 - DNA, 16 bp, H. sapiens
tggatggggtttctgt

SEQ ID NO: 150520 - DNA, 16 bp, H. sapiens
tggatgggtggacaga

SEQ ID NO: 150521 - DNA, 16 bp, H. sapiens
tggatgggtggatgga

SEQ ID NO: 150522 - DNA, 18 bp, H. sapiens
tggatggtggcaggcaaa

SEQ ID NO: 150523 - DNA, 16 bp, H. sapiens
tggatgtaccacagtt

SEQ ID NO: 150524 - DNA, 16 bp, H. sapiens
tggatgtatctcaaaa

SEQ ID NO: 150525 - DNA, 16 bp, H. sapiens
tggatgtatttaccca

SEQ ID NO: 150526 - DNA, 16 bp, H. sapiens
tggatgtccaggcaga

SEQ ID NO: 150527 - DNA, 16 bp, H. sapiens
tggatgtcccttctgt

SEQ ID NO: 150528 - DNA, 16 bp, H. sapiens
tggatgtcctttctgt

SEQ ID NO: 150529 - DNA, 16 bp, H. sapiens
tggatgtctgtcccct

SEQ ID NO: 150530 - DNA, 16 bp, H. sapiens
tggatgtctgtgtgtg

SEQ ID NO: 150531 - DNA, 16 bp, H. sapiens
tggatgtggtaaaaag

SEQ ID NO: 150532 - DNA, 16 bp, H. sapiens
tggatgtggtgaaagg

SEQ ID NO: 150533 - DNA, 16 bp, H. sapiens
tggatgtggtggaaag

SEQ ID NO: 150534 - DNA, 16 bp, H. sapiens
tggatgtggtggcaca

SEQ ID NO: 150535 - DNA, 16 bp, H. sapiens
tggatgtggtggcact

SEQ ID NO: 150536 - DNA, 16 bp, H. sapiens
tggatgtggtggcgca

SEQ ID NO: 150537 - DNA, 16 bp, H. sapiens
tggatgtgttcggagt

SEQ ID NO: 150538 - DNA, 16 bp, H. sapiens
tggatgttagaccttt

SEQ ID NO: 150539 - DNA, 16 bp, H. sapiens
tggattaaaacaaaaa

SEQ ID NO: 150540 - DNA, 16 bp, H. sapiens
tggattaaaacaacac

SEQ ID NO: 150541 - DNA, 16 bp, H. sapiens
tggattaatgggttat

SEQ ID NO: 150542 - DNA, 16 bp, H. sapiens
tggattacagatgtga

SEQ ID NO: 150543 - DNA, 16 bp, H. sapiens
tggattacaggcgccc

SEQ ID NO: 150544 - DNA, 20 bp, H. sapiens
tggattacatttattgattt

SEQ ID NO: 150545 - DNA, 16 bp, H. sapiens
tggattaccaggtaga

SEQ ID NO: 150546 - DNA, 16 bp, H. sapiens
tggattacctttttga

SEQ ID NO: 150547 - DNA, 16 bp, H. sapiens
tggattagggtgggcc

SEQ ID NO: 150548 - DNA, 16 bp, H. sapiens
tggattatttcatttt

SEQ ID NO: 150549 - DNA, 16 bp, H. sapiens
tggattcaaatggaat

SEQ ID NO: 150550 - DNA, 16 bp, H. sapiens
tggattcaaccaacct

SEQ ID NO: 150551 - DNA, 16 bp, H. sapiens
tggattcaagccattc

SEQ ID NO: 150552 - DNA, 16 bp, H. sapiens
tggattcattcatttt

SEQ ID NO: 150553 - DNA, 16 bp, H. sapiens
tggattccttggattg

SEQ ID NO: 150554 - DNA, 16 bp, H. sapiens
tggattcgaactcctg

SEQ ID NO: 150555 - DNA, 17 bp, H. sapiens
tggattcgagtggaatg

SEQ ID NO: 150556 - DNA, 16 bp, H. sapiens
tggattctcaattcta

SEQ ID NO: 150557 - DNA, 16 bp, H. sapiens
tggattctccttcaat

SEQ ID NO: 150558 - DNA, 16 bp, H. sapiens
tggattcttccccaga

SEQ ID NO: 150559 - DNA, 16 bp, H. sapiens
tggattcttgctctgt

SEQ ID NO: 150560 - DNA, 16 bp, H. sapiens
tggattctttgatttt

SEQ ID NO: 150561 - DNA, 16 bp, H. sapiens
tggattgagaacctgt

SEQ ID NO: 150562 - DNA, 16 bp, H. sapiens
tggattgagaacttgt

SEQ ID NO: 150563 - DNA, 16 bp, H. sapiens
tggattgatgggtgga

SEQ ID NO: 150564 - DNA, 16 bp, H. sapiens
tggattgcagtggtgt

SEQ ID NO: 150565 - DNA, 17 bp, H. sapiens
tggattgcttgaggtca

SEQ ID NO: 150566 - DNA, 16 bp, H. sapiens
tggattggaaaggaat

SEQ ID NO: 150567 - DNA, 16 bp, H. sapiens
tggattgtgaagattt

SEQ ID NO: 150568 - DNA, 16 bp, H. sapiens
tggattgttcttgttt

SEQ ID NO: 150569 - DNA, 16 bp, H. sapiens
tggattgttttcagtt

SEQ ID NO: 150570 - DNA, 16 bp, H. sapiens
tggatttagtggccct

SEQ ID NO: 150571 - DNA, 16 bp, H. sapiens
tggatttcaagacaaa

SEQ ID NO: 150572 - DNA, 16 bp, H. sapiens
tggatttcaagcacaa

SEQ ID NO: 150573 - DNA, 16 bp, H. sapiens
tggatttcagtttcct

SEQ ID NO: 150574 - DNA, 16 bp, H. sapiens
tggatttcccccttgc

SEQ ID NO: 150575 - DNA, 16 bp, H. sapiens
tggatttcctttcttt

SEQ ID NO: 150576 - DNA, 16 bp, H. sapiens
tggatttcttcatggt

SEQ ID NO: 150577 - DNA, 16 bp, H. sapiens
tggatttctttttaaa

SEQ ID NO: 150578 - DNA, 16 bp, H. sapiens
tggatttctttttcag

SEQ ID NO: 150579 - DNA, 16 bp, H. sapiens
tggatttgaagaatca

SEQ ID NO: 150580 - DNA, 17 bp, H. sapiens
tggatttgcaggtcagg

SEQ ID NO: 150581 - DNA, 16 bp, H. sapiens
tggatttggcctgtgg

SEQ ID NO: 150582 - DNA, 16 bp, H. sapiens
tggatttggcttgcca

SEQ ID NO: 150583 - DNA, 16 bp, H. sapiens
tggatttggcttgcta

SEQ ID NO: 150584 - DNA, 16 bp, H. sapiens
tggatttggtcttttc

SEQ ID NO: 150585 - DNA, 16 bp, H. sapiens
tggatttgtctatttc

SEQ ID NO: 150586 - DNA, 16 bp, H. sapiens
tggatttgtctgattg

SEQ ID NO: 150587 - DNA, 16 bp, H. sapiens
tggatttgtgttccca

SEQ ID NO: 150588 - DNA, 16 bp, H. sapiens
tggatttgtttctgtg

SEQ ID NO: 150589 - DNA, 16 bp, H. sapiens
tggattttaaaatagt

SEQ ID NO: 150590 - DNA, 16 bp, H. sapiens
tggattttattctgtg

SEQ ID NO: 150591 - DNA, 16 bp, H. sapiens
tggattttattttaag

SEQ ID NO: 150592 - DNA, 16 bp, H. sapiens
tggattttcaaatatt

SEQ ID NO: 150593 - DNA, 16 bp, H. sapiens
tggattttggacttac

SEQ ID NO: 150594 - DNA, 16 bp, H. sapiens
tggattttggacttgc

SEQ ID NO: 150595 - DNA, 16 bp, H. sapiens
tggattttggaggcaa

SEQ ID NO: 150596 - DNA, 16 bp, H. sapiens
tggattttgtctaatg

SEQ ID NO: 150597 - DNA, 16 bp, H. sapiens
tggatttttattcatt

SEQ ID NO: 150598 - DNA, 16 bp, H. sapiens
tggatttttgaaaaaa

SEQ ID NO: 150599 - DNA, 16 bp, H. sapiens
tggatttttttttaac

SEQ ID NO: 150600 - DNA, 16 bp, H. sapiens
tggcaaaaaatttgag

SEQ ID NO: 150601 - DNA, 16 bp, H. sapiens
tggcaaaaatgtggaa

SEQ ID NO: 150602 - DNA, 16 bp, H. sapiens
tggcaaaacactgtct

SEQ ID NO: 150603 - DNA, 16 bp, H. sapiens
tggcaaaaccccagct

SEQ ID NO: 150604 - DNA, 16 bp, H. sapiens
tggcaaaaccctgtct

SEQ ID NO: 150605 - DNA, 16 bp, H. sapiens
tggcaaaacctcattt

SEQ ID NO: 150606 - DNA, 16 bp, H. sapiens
tggcaaaagagcgaga

SEQ ID NO: 150607 - DNA, 16 bp, H. sapiens
tggcaaaaggaacttt

SEQ ID NO: 150608 - DNA, 16 bp, H. sapiens
tggcaaaatcatggct

SEQ ID NO: 150609 - DNA, 16 bp, H. sapiens
tggcaaaatggacttt

SEQ ID NO: 150610 - DNA, 16 bp, H. sapiens
tggcaaacatggagaa

SEQ ID NO: 150611 - DNA, 16 bp, H. sapiens
tggcaaaccacatgta

SEQ ID NO: 150612 - DNA, 16 bp, H. sapiens
tggcaaactgggcact

SEQ ID NO: 150613 - DNA, 16 bp, H. sapiens
tggcaaagagactggt

SEQ ID NO: 150614 - DNA, 16 bp, H. sapiens
tggcaaagagctcagc

SEQ ID NO: 150615 - DNA, 16 bp, H. sapiens
tggcaaagatgcagag

SEQ ID NO: 150616 - DNA, 16 bp, H. sapiens
tggcaaagcaagaccc

SEQ ID NO: 150617 - DNA, 16 bp, H. sapiens
tggcaaaggagaaatg

SEQ ID NO: 150618 - DNA, 16 bp, H. sapiens
tggcaaaggagattaa

SEQ ID NO: 150619 - DNA, 16 bp, H. sapiens
tggcaaaggatatgaa

SEQ ID NO: 150620 - DNA, 16 bp, H. sapiens
tggcaaagtggataaa

SEQ ID NO: 150621 - DNA, 16 bp, H. sapiens
tggcaaatggatgtca

SEQ ID NO: 150622 - DNA, 16 bp, H. sapiens
tggcaaattttatttt

SEQ ID NO: 150623 - DNA, 16 bp, H. sapiens
tggcaacaaaaccaaa

SEQ ID NO: 150624 - DNA, 17 bp, H. sapiens
tggcaacaaaagccaga

SEQ ID NO: 150625 - DNA, 16 bp, H. sapiens
tggcaacaaaagtgac

SEQ ID NO: 150626 - DNA, 16 bp, H. sapiens
tggcaacaccatcaca

SEQ ID NO: 150627 - DNA, 18 bp, H. sapiens
tggcaacagagcgagacc

SEQ ID NO: 150628 - DNA, 16 bp, H. sapiens
tggcaacatcttggct

SEQ ID NO: 150629 - DNA, 16 bp, H. sapiens
tggcaacatggatgag

SEQ ID NO: 150630 - DNA, 16 bp, H. sapiens
tggcaaccaccattct

SEQ ID NO: 150631 - DNA, 16 bp, H. sapiens
tggcaaccactaatct

SEQ ID NO: 150632 - DNA, 16 bp, H. sapiens
tggcaaccactgatct

SEQ ID NO: 150633 - DNA, 16 bp, H. sapiens
tggcaactctggaaat

SEQ ID NO: 150634 - DNA, 16 bp, H. sapiens
tggcaactgctgatct

SEQ ID NO: 150635 - DNA, 16 bp, H. sapiens
tggcaagaccctgttt

SEQ ID NO: 150636 - DNA, 16 bp, H. sapiens
tggcaagactgtggag

SEQ ID NO: 150637 - DNA, 16 bp, H. sapiens
tggcaagagaaaatga

SEQ ID NO: 150638 - DNA, 16 bp, H. sapiens
tggcaagatcttgact

SEQ ID NO: 150639 - DNA, 16 bp, H. sapiens
tggcaagctgaggcag

SEQ ID NO: 150640 - DNA, 16 bp, H. sapiens
tggcaaggtctggaga

SEQ ID NO: 150641 - DNA, 16 bp, H. sapiens
tggcaataaaaaggaa

SEQ ID NO: 150642 - DNA, 20 bp, H. sapiens
tggcaatctcggctcactgc

SEQ ID NO: 150643 - DNA, 16 bp, H. sapiens
tggcaatgactttttg

SEQ ID NO: 150644 - DNA, 16 bp, H. sapiens
tggcaatgagatgtgg

SEQ ID NO: 150645 - DNA, 16 bp, H. sapiens
tggcaatgatttcttt

SEQ ID NO: 150646 - DNA, 16 bp, H. sapiens
tggcaatggtgatgat

SEQ ID NO: 150647 - DNA, 16 bp, H. sapiens
tggcaatgtccagaag

SEQ ID NO: 150648 - DNA, 16 bp, H. sapiens
tggcaatgtgggttct

SEQ ID NO: 150649 - DNA, 17 bp, H. sapiens
tggcaattcctcaaaga

SEQ ID NO: 150650 - DNA, 16 bp, H. sapiens
tggcaatttattaaaa

SEQ ID NO: 150651 - DNA, 16 bp, H. sapiens
tggcaatttctcaaag

SEQ ID NO: 150652 - DNA, 16 bp, H. sapiens
tggcaattttaaaatt

SEQ ID NO: 150653 - DNA, 16 bp, H. sapiens
tggcacaaaataaatg

SEQ ID NO: 150654 - DNA, 16 bp, H. sapiens
tggcacaaacaaatgg

SEQ ID NO: 150655 - DNA, 16 bp, H. sapiens
tggcacaaacatggct

SEQ ID NO: 150656 - DNA, 16 bp, H. sapiens
tggcacaactgctggc

SEQ ID NO: 150657 - DNA, 16 bp, H. sapiens
tggcacaagaactatg

SEQ ID NO: 150658 - DNA, 16 bp, H. sapiens
tggcacaagtttacct

SEQ ID NO: 150659 - DNA, 16 bp, H. sapiens
tggcacaatcagagct

SEQ ID NO: 150660 - DNA, 25 bp, H. sapiens
tggcacaatctcggctcactgcaat

SEQ ID NO: 150661 - DNA, 19 bp, H. sapiens
tggcacaatctcggctcat

SEQ ID NO: 150662 - DNA, 17 bp, H. sapiens
tggcacaatcttggctt

SEQ ID NO: 150663 - DNA, 16 bp, H. sapiens
tggcacaatgaaaaat

SEQ ID NO: 150664 - DNA, 17 bp, H. sapiens
tggcacacacctgtagt

SEQ ID NO: 150665 - DNA, 16 bp, H. sapiens
tggcacacgcctgcaa

SEQ ID NO: 150666 - DNA, 16 bp, H. sapiens
tggcacacgcctgtat

SEQ ID NO: 150667 - DNA, 16 bp, H. sapiens
tggcacactggtgggc

SEQ ID NO: 150668 - DNA, 16 bp, H. sapiens
tggcacagagagagaa

SEQ ID NO: 150669 - DNA, 16 bp, H. sapiens
tggcacagagcagatg

SEQ ID NO: 150670 - DNA, 16 bp, H. sapiens
tggcacagagtaggca

SEQ ID NO: 150671 - DNA, 16 bp, H. sapiens
tggcacagggaacagg

SEQ ID NO: 150672 - DNA, 18 bp, H. sapiens
tggcacagtctcagctca

SEQ ID NO: 150673 - DNA, 16 bp, H. sapiens
tggcacataataaaca

SEQ ID NO: 150674 - DNA, 16 bp, H. sapiens
tggcacatagaaagtg

SEQ ID NO: 150675 - DNA, 17 bp, H. sapiens
tggcacatagacaccat

SEQ ID NO: 150676 - DNA, 16 bp, H. sapiens
tggcacatctcagctc

SEQ ID NO: 150677 - DNA, 18 bp, H. sapiens
tggcacatgcctgtaatt

SEQ ID NO: 150678 - DNA, 16 bp, H. sapiens
tggcacatttgttaca

SEQ ID NO: 150679 - DNA, 16 bp, H. sapiens
tggcaccactgcactg

SEQ ID NO: 150680 - DNA, 16 bp, H. sapiens
tggcaccactgctctc

SEQ ID NO: 150681 - DNA, 16 bp, H. sapiens
tggcaccagggaaagg

SEQ ID NO: 150682 - DNA, 16 bp, H. sapiens
tggcaccagggaacaa

SEQ ID NO: 150683 - DNA, 16 bp, H. sapiens
tggcaccagggactgg

SEQ ID NO: 150684 - DNA, 16 bp, H. sapiens
tggcaccatcctggct

SEQ ID NO: 150685 - DNA, 16 bp, H. sapiens
tggcaccatcttggtt

SEQ ID NO: 150686 - DNA, 16 bp, H. sapiens
tggcacccactctggc

SEQ ID NO: 150687 - DNA, 16 bp, H. sapiens
tggcaccctcaggagc

SEQ ID NO: 150688 - DNA, 16 bp, H. sapiens
tggcacctcccctccc

SEQ ID NO: 150689 - DNA, 16 bp, H. sapiens
tggcacctccctccct

SEQ ID NO: 150690 - DNA, 16 bp, H. sapiens
tggcacctccttcctc

SEQ ID NO: 150691 - DNA, 16 bp, H. sapiens
tggcacctggagctgc

SEQ ID NO: 150692 - DNA, 16 bp, H. sapiens
tggcaccttgatcttg

SEQ ID NO: 150693 - DNA, 18 bp, H. sapiens
tggcacgatctcaactca

SEQ ID NO: 150694 - DNA, 17 bp, H. sapiens
tggcacgatctcagctg

SEQ ID NO: 150695 - DNA, 17 bp, H. sapiens
tggcacgatctcggctt

SEQ ID NO: 150696 - DNA, 19 bp, H. sapiens
tggcacgatctctgctcac

SEQ ID NO: 150697 - DNA, 18 bp, H. sapiens
tggcacgatcttagctca

SEQ ID NO: 150698 - DNA, 20 bp, H. sapiens
tggcacgatcttggctcacc

SEQ ID NO: 150699 - DNA, 27 bp, H. sapiens
tggcacgatcttggctcactgcaagct

SEQ ID NO: 150700 - DNA, 16 bp, H. sapiens
tggcacggtctctgct

SEQ ID NO: 150701 - DNA, 18 bp, H. sapiens
tggcacgtgcctatagtc

SEQ ID NO: 150702 - DNA, 16 bp, H. sapiens
tggcacgtgcctgtag

SEQ ID NO: 150703 - DNA, 16 bp, H. sapiens
tggcactacaagatgc

SEQ ID NO: 150704 - DNA, 16 bp, H. sapiens
tggcactgctgcactc

SEQ ID NO: 150705 - DNA, 16 bp, H. sapiens
tggcactggctgtgac

SEQ ID NO: 150706 - DNA, 16 bp, H. sapiens
tggcactgttgcccag

SEQ ID NO: 150707 - DNA, 16 bp, H. sapiens
tggcacttattctaaa

SEQ ID NO: 150708 - DNA, 16 bp, H. sapiens
tggcacttgccctggg

SEQ ID NO: 150709 - DNA, 16 bp, H. sapiens
tggcacttttgttgaa

SEQ ID NO: 150710 - DNA, 16 bp, H. sapiens
tggcagaaaagcagaa

SEQ ID NO: 150711 - DNA, 16 bp, H. sapiens
tggcagaaaaggaaat

SEQ ID NO: 150712 - DNA, 16 bp, H. sapiens
tggcagaaaataaaat

SEQ ID NO: 150713 - DNA, 16 bp, H. sapiens
tggcagaaaataataa

SEQ ID NO: 150714 - DNA, 16 bp, H. sapiens
tggcagaaactctgca

SEQ ID NO: 150715 - DNA, 16 bp, H. sapiens
tggcagaaagtgaagc

SEQ ID NO: 150716 - DNA, 16 bp, H. sapiens
tggcagaactggaatt

SEQ ID NO: 150717 - DNA, 16 bp, H. sapiens
tggcagaactgggatt

SEQ ID NO: 150718 - DNA, 16 bp, H. sapiens
tggcagaagaaacttc

SEQ ID NO: 150719 - DNA, 16 bp, H. sapiens
tggcagaagaacagaa

SEQ ID NO: 150720 - DNA, 16 bp, H. sapiens
tggcagaagaattgct

SEQ ID NO: 150721 - DNA, 16 bp, H. sapiens
tggcagaagacaagga

SEQ ID NO: 150722 - DNA, 16 bp, H. sapiens
tggcagaagacatttc

SEQ ID NO: 150723 - DNA, 16 bp, H. sapiens
tggcagaagatgaaag

SEQ ID NO: 150724 - DNA, 16 bp, H. sapiens
tggcagaagattttaa

SEQ ID NO: 150725 - DNA, 16 bp, H. sapiens
tggcagaagcattgtg

SEQ ID NO: 150726 - DNA, 16 bp, H. sapiens
tggcagaaggagaagg

SEQ ID NO: 150727 - DNA, 16 bp, H. sapiens
tggcagaaggcaaagt

SEQ ID NO: 150728 - DNA, 16 bp, H. sapiens
tggcagaaggcagaga

SEQ ID NO: 150729 - DNA, 16 bp, H. sapiens
tggcagaaggcatcac

SEQ ID NO: 150730 - DNA, 16 bp, H. sapiens
tggcagaagggacaaa

SEQ ID NO: 150731 - DNA, 16 bp, H. sapiens
tggcagaaggggtgaa

SEQ ID NO: 150732 - DNA, 16 bp, H. sapiens
tggcagaaggtgatgg

SEQ ID NO: 150733 - DNA, 16 bp, H. sapiens
tggcagaaggtggaag

SEQ ID NO: 150734 - DNA, 16 bp, H. sapiens
tggcagaagtaggctt

SEQ ID NO: 150735 - DNA, 16 bp, H. sapiens
tggcagaatccagttc

SEQ ID NO: 150736 - DNA, 16 bp, H. sapiens
tggcagaattcaattc

SEQ ID NO: 150737 - DNA, 16 bp, H. sapiens
tggcagaattcagctg

SEQ ID NO: 150738 - DNA, 16 bp, H. sapiens
tggcagacaagaaaga

SEQ ID NO: 150739 - DNA, 16 bp, H. sapiens
tggcagagaaagaaaa

SEQ ID NO: 150740 - DNA, 16 bp, H. sapiens
tggcagagaaggagaa

SEQ ID NO: 150741 - DNA, 16 bp, H. sapiens
tggcagagacacaaca

SEQ ID NO: 150742 - DNA, 16 bp, H. sapiens
tggcagagacacagca

SEQ ID NO: 150743 - DNA, 16 bp, H. sapiens
tggcagagagaaagag

SEQ ID NO: 150744 - DNA, 16 bp, H. sapiens
tggcagagaggctttc

SEQ ID NO: 150745 - DNA, 16 bp, H. sapiens
tggcagagcaacacaa

SEQ ID NO: 150746 - DNA, 16 bp, H. sapiens
tggcagagccagaccc

SEQ ID NO: 150747 - DNA, 16 bp, H. sapiens
tggcagagccaggacc

SEQ ID NO: 150748 - DNA, 16 bp, H. sapiens
tggcagagccaggctg

SEQ ID NO: 150749 - DNA, 16 bp, H. sapiens
tggcagagccatgatt

SEQ ID NO: 150750 - DNA, 16 bp, H. sapiens
tggcagagctgaaatt

SEQ ID NO: 150751 - DNA, 16 bp, H. sapiens
tggcagaggcagggaa

SEQ ID NO: 150752 - DNA, 16 bp, H. sapiens
tggcagaggtggaaga

SEQ ID NO: 150753 - DNA, 16 bp, H. sapiens
tggcagagtgagactc

SEQ ID NO: 150754 - DNA, 16 bp, H. sapiens
tggcagagttggaatt

SEQ ID NO: 150755 - DNA, 16 bp, H. sapiens
tggcagatgacatgat

SEQ ID NO: 150756 - DNA, 16 bp, H. sapiens
tggcagatgcacctga

SEQ ID NO: 150757 - DNA, 16 bp, H. sapiens
tggcagcaactgccct

SEQ ID NO: 150758 - DNA, 16 bp, H. sapiens
tggcagcagcagcagc

SEQ ID NO: 150759 - DNA, 16 bp, H. sapiens
tggcagcagcagggag

SEQ ID NO: 150760 - DNA, 16 bp, H. sapiens
tggcagcagctgcagc

SEQ ID NO: 150761 - DNA, 16 bp, H. sapiens
tggcagcaggagacag

SEQ ID NO: 150762 - DNA, 16 bp, H. sapiens
tggcagcaggcacctg

SEQ ID NO: 150763 - DNA, 16 bp, H. sapiens
tggcagcaggcgagag

SEQ ID NO: 150764 - DNA, 16 bp, H. sapiens
tggcagcaggggagag

SEQ ID NO: 150765 - DNA, 16 bp, H. sapiens
tggcagcagtgactct

SEQ ID NO: 150766 - DNA, 16 bp, H. sapiens
tggcagcagtgggctg

SEQ ID NO: 150767 - DNA, 16 bp, H. sapiens
tggcagcagtggtggt

SEQ ID NO: 150768 - DNA, 16 bp, H. sapiens
tggcagcagtgtggag

SEQ ID NO: 150769 - DNA, 16 bp, H. sapiens
tggcagcatcagcatc

SEQ ID NO: 150770 - DNA, 16 bp, H. sapiens
tggcagcatgagaaca

SEQ ID NO: 150771 - DNA, 16 bp, H. sapiens
tggcagccaaaagatt

SEQ ID NO: 150772 - DNA, 16 bp, H. sapiens
tggcagccacaggcct

SEQ ID NO: 150773 - DNA, 16 bp, H. sapiens
tggcagccacttccag

SEQ ID NO: 150774 - DNA, 16 bp, H. sapiens
tggcagccaggctggg

SEQ ID NO: 150775 - DNA, 16 bp, H. sapiens
tggcagccagggagag

SEQ ID NO: 150776 - DNA, 16 bp, H. sapiens
tggcagccatttcaaa

SEQ ID NO: 150777 - DNA, 16 bp, H. sapiens
tggcagcccacccctc

SEQ ID NO: 150778 - DNA, 16 bp, H. sapiens
tggcagcccagaggga

SEQ ID NO: 150779 - DNA, 16 bp, H. sapiens
tggcagccccagaaaa

SEQ ID NO: 150780 - DNA, 16 bp, H. sapiens
tggcagcccctcccat

SEQ ID NO: 150781 - DNA, 16 bp, H. sapiens
tggcagcctcagcccc

SEQ ID NO: 150782 - DNA, 16 bp, H. sapiens
tggcagcctctagaag

SEQ ID NO: 150783 - DNA, 16 bp, H. sapiens
tggcagctcacacctg

SEQ ID NO: 150784 - DNA, 16 bp, H. sapiens
tggcagctccatcttc

SEQ ID NO: 150785 - DNA, 16 bp, H. sapiens
tggcagctgcccctcc

SEQ ID NO: 150786 - DNA, 16 bp, H. sapiens
tggcagctggcaccag

SEQ ID NO: 150787 - DNA, 16 bp, H. sapiens
tggcagctggcttcct

SEQ ID NO: 150788 - DNA, 16 bp, H. sapiens
tggcagcttccaggtg

SEQ ID NO: 150789 - DNA, 16 bp, H. sapiens
tggcagcttgatgggg

SEQ ID NO: 150790 - DNA, 16 bp, H. sapiens
tggcaggaaggagagg

SEQ ID NO: 150791 - DNA, 16 bp, H. sapiens
tggcaggaccagggct

SEQ ID NO: 150792 - DNA, 18 bp, H. sapiens
tggcaggactgagagtgg

SEQ ID NO: 150793 - DNA, 16 bp, H. sapiens
tggcaggagagaaaat

SEQ ID NO: 150794 - DNA, 16 bp, H. sapiens
tggcaggagagaaaga

SEQ ID NO: 150795 - DNA, 16 bp, H. sapiens
tggcaggagagaggga

SEQ ID NO: 150796 - DNA, 16 bp, H. sapiens
tggcaggagcaggagc

SEQ ID NO: 150797 - DNA, 16 bp, H. sapiens
tggcaggaggcaaaga

SEQ ID NO: 150798 - DNA, 16 bp, H. sapiens
tggcaggaggcaagag

SEQ ID NO: 150799 - DNA, 16 bp, H. sapiens
tggcaggagggagaga

SEQ ID NO: 150800 - DNA, 19 bp, H. sapiens
tggcaggatctcggctcac

SEQ ID NO: 150801 - DNA, 17 bp, H. sapiens
tggcaggcacctataat

SEQ ID NO: 150802 - DNA, 16 bp, H. sapiens
tggcaggcagaattct

SEQ ID NO: 150803 - DNA, 16 bp, H. sapiens
tggcaggcagaggttg

SEQ ID NO: 150804 - DNA, 16 bp, H. sapiens
tggcaggcagctgtgc

SEQ ID NO: 150805 - DNA, 16 bp, H. sapiens
tggcaggcagggtggg

SEQ ID NO: 150806 - DNA, 16 bp, H. sapiens
tggcaggcatctgtaa

SEQ ID NO: 150807 - DNA, 16 bp, H. sapiens
tggcaggccaaggtgg

SEQ ID NO: 150808 - DNA, 16 bp, H. sapiens
tggcaggctgaggcag

SEQ ID NO: 150809 - DNA, 16 bp, H. sapiens
tggcagggagtgggga

SEQ ID NO: 150810 - DNA, 16 bp, H. sapiens
tggcagggcacagtgg

SEQ ID NO: 150811 - DNA, 16 bp, H. sapiens
tggcagggcagccagg

SEQ ID NO: 150812 - DNA, 16 bp, H. sapiens
tggcagggccaggact

SEQ ID NO: 150813 - DNA, 16 bp, H. sapiens
tggcagggcctagctg

SEQ ID NO: 150814 - DNA, 16 bp, H. sapiens
tggcagggctgggact

SEQ ID NO: 150815 - DNA, 16 bp, H. sapiens
tggcaggggccagggg

SEQ ID NO: 150816 - DNA, 16 bp, H. sapiens
tggcaggggctgggca

SEQ ID NO: 150817 - DNA, 16 bp, H. sapiens
tggcagggtctcactc

SEQ ID NO: 150818 - DNA, 16 bp, H. sapiens
tggcagggttggtttc

SEQ ID NO: 150819 - DNA, 16 bp, H. sapiens
tggcaggtgcccctcc

SEQ ID NO: 150820 - DNA, 16 bp, H. sapiens
tggcaggtgcctgttg

SEQ ID NO: 150821 - DNA, 16 bp, H. sapiens
tggcaggtgtgggatc

SEQ ID NO: 150822 - DNA, 16 bp, H. sapiens
tggcagtaggcaaaga

SEQ ID NO: 150823 - DNA, 16 bp, H. sapiens
tggcagtctgtgtctt

SEQ ID NO: 150824 - DNA, 16 bp, H. sapiens
tggcagtgatgatggt

SEQ ID NO: 150825 - DNA, 16 bp, H. sapiens
tggcagtggcagcagc

SEQ ID NO: 150826 - DNA, 16 bp, H. sapiens
tggcagtggcagtggc

SEQ ID NO: 150827 - DNA, 16 bp, H. sapiens
tggcagtggcgtgatc

SEQ ID NO: 150828 - DNA, 16 bp, H. sapiens
tggcagtgggaatgga

SEQ ID NO: 150829 - DNA, 16 bp, H. sapiens
tggcagtgggctggac

SEQ ID NO: 150830 - DNA, 16 bp, H. sapiens
tggcagtggtggcagc

SEQ ID NO: 150831 - DNA, 16 bp, H. sapiens
tggcagtgtgggctct

SEQ ID NO: 150832 - DNA, 16 bp, H. sapiens
tggcagttactcaaaa

SEQ ID NO: 150833 - DNA, 16 bp, H. sapiens
tggcagttggtgctgg

SEQ ID NO: 150834 - DNA, 16 bp, H. sapiens
tggcagttttattttt

SEQ ID NO: 150835 - DNA, 16 bp, H. sapiens
tggcataaacccggga

SEQ ID NO: 150836 - DNA, 16 bp, H. sapiens
tggcataacattacaa

SEQ ID NO: 150837 - DNA, 16 bp, H. sapiens
tggcataatcacggct

SEQ ID NO: 150838 - DNA, 16 bp, H. sapiens
tggcataatgtttttg

SEQ ID NO: 150839 - DNA, 16 bp, H. sapiens
tggcatacagtaagtg

SEQ ID NO: 150840 - DNA, 16 bp, H. sapiens
tggcatatataaatgc

SEQ ID NO: 150841 - DNA, 16 bp, H. sapiens
tggcatcagagggaga

SEQ ID NO: 150842 - DNA, 16 bp, H. sapiens
tggcatcatctctgct

SEQ ID NO: 150843 - DNA, 16 bp, H. sapiens
tggcatccctggcctc

SEQ ID NO: 150844 - DNA, 16 bp, H. sapiens
tggcatctccaggtgt

SEQ ID NO: 150845 - DNA, 16 bp, H. sapiens
tggcatctctggacct

SEQ ID NO: 150846 - DNA, 16 bp, H. sapiens
tggcatctgggaactt

SEQ ID NO: 150847 - DNA, 16 bp, H. sapiens
tggcatgaacctggag

SEQ ID NO: 150848 - DNA, 16 bp, H. sapiens
tggcatgaatccagga

SEQ ID NO: 150849 - DNA, 16 bp, H. sapiens
tggcatgagatgatat

SEQ ID NO: 150850 - DNA, 16 bp, H. sapiens
tggcatgatcataggt

SEQ ID NO: 150851 - DNA, 16 bp, H. sapiens
tggcatgatctcaact

SEQ ID NO: 150852 - DNA, 16 bp, H. sapiens
tggcatgatctcagcc

SEQ ID NO: 150853 - DNA, 16 bp, H. sapiens
tggcatgatctcaggt

SEQ ID NO: 150854 - DNA, 18 bp, H. sapiens
tggcatgatctcgactca

SEQ ID NO: 150855 - DNA, 22 bp, H. sapiens
tggcatgatctcggctcactgt

SEQ ID NO: 150856 - DNA, 17 bp, H. sapiens
tggcatgatctcggctt

SEQ ID NO: 150857 - DNA, 18 bp, H. sapiens
tggcatgatctcggttca

SEQ ID NO: 150858 - DNA, 16 bp, H. sapiens
tggcatgatctgactt

SEQ ID NO: 150859 - DNA, 18 bp, H. sapiens
tggcatgatctgggctca

SEQ ID NO: 150860 - DNA, 20 bp, H. sapiens
tggcatgatcttggctcacc

SEQ ID NO: 150861 - DNA, 16 bp, H. sapiens
tggcatgcatctgtgg

SEQ ID NO: 150862 - DNA, 16 bp, H. sapiens
tggcatgcgccaccat

SEQ ID NO: 150863 - DNA, 16 bp, H. sapiens
tggcatgcttccaggg

SEQ ID NO: 150864 - DNA, 16 bp, H. sapiens
tggcatggctggggag

SEQ ID NO: 150865 - DNA, 16 bp, H. sapiens
tggcatgggcctgtgg

SEQ ID NO: 150866 - DNA, 16 bp, H. sapiens
tggcattaaaaaaaaa

SEQ ID NO: 150867 - DNA, 16 bp, H. sapiens
tggcattgaatcttta

SEQ ID NO: 150868 - DNA, 16 bp, H. sapiens
tggcatttagtgggta

SEQ ID NO: 150869 - DNA, 16 bp, H. sapiens
tggcatttctttcttt

SEQ ID NO: 150870 - DNA, 16 bp, H. sapiens
tggcatttgtaaactg

SEQ ID NO: 150871 - DNA, 16 bp, H. sapiens
tggcattttaaaaaat

SEQ ID NO: 150872 - DNA, 16 bp, H. sapiens
tggcattttctttttc

SEQ ID NO: 150873 - DNA, 16 bp, H. sapiens
tggccaaaaccaaggg

SEQ ID NO: 150874 - DNA, 16 bp, H. sapiens
tggccaaaagaaaggg

SEQ ID NO: 150875 - DNA, 16 bp, H. sapiens
tggccaaaatggagaa

SEQ ID NO: 150876 - DNA, 16 bp, H. sapiens
tggccaaacatggtga

SEQ ID NO: 150877 - DNA, 16 bp, H. sapiens
tggccaaagcaggagg

SEQ ID NO: 150878 - DNA, 16 bp, H. sapiens
tggccaaagtggtgaa

SEQ ID NO: 150879 - DNA, 16 bp, H. sapiens
tggccaaattggtgaa

SEQ ID NO: 150880 - DNA, 16 bp, H. sapiens
tggccaacaaacatat

SEQ ID NO: 150881 - DNA, 17 bp, H. sapiens
tggccaacactgtgaaa

SEQ ID NO: 150882 - DNA, 16 bp, H. sapiens
tggccaacagggagaa

SEQ ID NO: 150883 - DNA, 17 bp, H. sapiens
tggccaacatcatgaaa

SEQ ID NO: 150884 - DNA, 16 bp, H. sapiens
tggccaacatgaggaa

SEQ ID NO: 150885 - DNA, 19 bp, H. sapiens
tggccaacatggtgaaaca

SEQ ID NO: 150886 - DNA, 22 bp, H. sapiens
tggccaacatggtgaaaccccg

SEQ ID NO: 150887 - DNA, 16 bp, H. sapiens
tggccaacctggagaa

SEQ ID NO: 150888 - DNA, 17 bp, H. sapiens
tggccaacctggcaaaa

SEQ ID NO: 150889 - DNA, 16 bp, H. sapiens
tggccaacctggtgaa

SEQ ID NO: 150890 - DNA, 16 bp, H. sapiens
tggccaacgaggtgaa

SEQ ID NO: 150891 - DNA, 16 bp, H. sapiens
tggccaacgtggagaa

SEQ ID NO: 150892 - DNA, 17 bp, H. sapiens
tggccaacgtggcgaaa

SEQ ID NO: 150893 - DNA, 16 bp, H. sapiens
tggccaacttggcaaa

SEQ ID NO: 150894 - DNA, 16 bp, H. sapiens
tggccaagaaggtgaa

SEQ ID NO: 150895 - DNA, 16 bp, H. sapiens
tggccaagaagtatat

SEQ ID NO: 150896 - DNA, 16 bp, H. sapiens
tggccaagaatttttt

SEQ ID NO: 150897 - DNA, 16 bp, H. sapiens
tggccaagagcatgct

SEQ ID NO: 150898 - DNA, 16 bp, H. sapiens
tggccaagaggacccc

SEQ ID NO: 150899 - DNA, 16 bp, H. sapiens
tggccaagatggcaaa

SEQ ID NO: 150900 - DNA, 16 bp, H. sapiens
tggccaagatggccaa

SEQ ID NO: 150901 - DNA, 16 bp, H. sapiens
tggccaagattttttt

SEQ ID NO: 150902 - DNA, 16 bp, H. sapiens
tggccaagctgatctt

SEQ ID NO: 150903 - DNA, 16 bp, H. sapiens
tggccaagctggtcta

SEQ ID NO: 150904 - DNA, 16 bp, H. sapiens
tggccaagctggtgtc

SEQ ID NO: 150905 - DNA, 16 bp, H. sapiens
tggccaaggacttcat

SEQ ID NO: 150906 - DNA, 16 bp, H. sapiens
tggccaaggagaagca

SEQ ID NO: 150907 - DNA, 16 bp, H. sapiens
tggccaaggagacccc

SEQ ID NO: 150908 - DNA, 16 bp, H. sapiens
tggccaaggctggagt

SEQ ID NO: 150909 - DNA, 16 bp, H. sapiens
tggccaaggggacccc

SEQ ID NO: 150910 - DNA, 16 bp, H. sapiens
tggccaaggggatccc

SEQ ID NO: 150911 - DNA, 16 bp, H. sapiens
tggccaaggtcacata

SEQ ID NO: 150912 - DNA, 16 bp, H. sapiens
tggccaaggtgggcgg

SEQ ID NO: 150913 - DNA, 17 bp, H. sapiens
tggccaaggtggtgaaa

SEQ ID NO: 150914 - DNA, 16 bp, H. sapiens
tggccaatgatgtaat

SEQ ID NO: 150915 - DNA, 16 bp, H. sapiens
tggccaatgggaaacc

SEQ ID NO: 150916 - DNA, 16 bp, H. sapiens
tggccaatggtttaat

SEQ ID NO: 150917 - DNA, 16 bp, H. sapiens
tggccacaatggtgaa

SEQ ID NO: 150918 - DNA, 16 bp, H. sapiens
tggccacactggtctt

SEQ ID NO: 150919 - DNA, 16 bp, H. sapiens
tggccacagggagagg

SEQ ID NO: 150920 - DNA, 16 bp, H. sapiens
tggccacagggagggg

SEQ ID NO: 150921 - DNA, 16 bp, H. sapiens
tggccacattgcccaa

SEQ ID NO: 150922 - DNA, 16 bp, H. sapiens
tggccacattttggta

SEQ ID NO: 150923 - DNA, 16 bp, H. sapiens
tggccaccaccaccac

SEQ ID NO: 150924 - DNA, 16 bp, H. sapiens
tggccaccaccactgg

SEQ ID NO: 150925 - DNA, 16 bp, H. sapiens
tggccaccaccattct

SEQ ID NO: 150926 - DNA, 16 bp, H. sapiens
tggccaccaggtggca

SEQ ID NO: 150927 - DNA, 17 bp, H. sapiens
tggccaccatggtgaaa

SEQ ID NO: 150928 - DNA, 16 bp, H. sapiens
tggccacccatcagga

SEQ ID NO: 150929 - DNA, 16 bp, H. sapiens
tggccaccgtggtgaa

SEQ ID NO: 150930 - DNA, 16 bp, H. sapiens
tggccacggaggaggg

SEQ ID NO: 150931 - DNA, 16 bp, H. sapiens
tggccactggtgatca

SEQ ID NO: 150932 - DNA, 16 bp, H. sapiens
tggccactgtgaataa

SEQ ID NO: 150933 - DNA, 16 bp, H. sapiens
tggccagaaaaaaaaa

SEQ ID NO: 150934 - DNA, 16 bp, H. sapiens
tggccagaacttccca

SEQ ID NO: 150935 - DNA, 16 bp, H. sapiens
tggccagaactttcaa

SEQ ID NO: 150936 - DNA, 16 bp, H. sapiens
tggccagaataaaagc

SEQ ID NO: 150937 - DNA, 16 bp, H. sapiens
tggccagactgcttct

SEQ ID NO: 150938 - DNA, 16 bp, H. sapiens
tggccagagaaggagg

SEQ ID NO: 150939 - DNA, 16 bp, H. sapiens
tggccagagatgctgg

SEQ ID NO: 150940 - DNA, 16 bp, H. sapiens
tggccagagcaggagc

SEQ ID NO: 150941 - DNA, 16 bp, H. sapiens
tggccagagcaggagg

SEQ ID NO: 150942 - DNA, 16 bp, H. sapiens
tggccagaggagcagg

SEQ ID NO: 150943 - DNA, 16 bp, H. sapiens
tggccagatgtgtgat

SEQ ID NO: 150944 - DNA, 16 bp, H. sapiens
tggccagcaaggtgaa

SEQ ID NO: 150945 - DNA, 16 bp, H. sapiens
tggccagcagcccaca

SEQ ID NO: 150946 - DNA, 16 bp, H. sapiens
tggccagcatggcgaa

SEQ ID NO: 150947 - DNA, 16 bp, H. sapiens
tggccagccaggctgg

SEQ ID NO: 150948 - DNA, 16 bp, H. sapiens
tggccagcctgcaggc

SEQ ID NO: 150949 - DNA, 16 bp, H. sapiens
tggccagcctggtgaa

SEQ ID NO: 150950 - DNA, 17 bp, H. sapiens
tggccagctggtctcga

SEQ ID NO: 150951 - DNA, 16 bp, H. sapiens
tggccaggacttctag

SEQ ID NO: 150952 - DNA, 16 bp, H. sapiens
tggccaggcacggtga

SEQ ID NO: 150953 - DNA, 16 bp, H. sapiens
tggccaggcatagtgg

SEQ ID NO: 150954 - DNA, 16 bp, H. sapiens
tggccaggccagcctc

SEQ ID NO: 150955 - DNA, 16 bp, H. sapiens
tggccaggccagtctc

SEQ ID NO: 150956 - DNA, 16 bp, H. sapiens
tggccaggcctggtgg

SEQ ID NO: 150957 - DNA, 18 bp, H. sapiens
tggccaggcgcggtgact

SEQ ID NO: 150958 - DNA, 16 bp, H. sapiens
tggccaggctgctcct

SEQ ID NO: 150959 - DNA, 16 bp, H. sapiens
tggccaggctggactt

SEQ ID NO: 150960 - DNA, 16 bp, H. sapiens
tggccaggctggagtg

SEQ ID NO: 150961 - DNA, 16 bp, H. sapiens
tggccaggctggggcc

SEQ ID NO: 150962 - DNA, 16 bp, H. sapiens
tggccagggaggcctc

SEQ ID NO: 150963 - DNA, 16 bp, H. sapiens
tggccagggcaaacag

SEQ ID NO: 150964 - DNA, 16 bp, H. sapiens
tggccagggcactcag

SEQ ID NO: 150965 - DNA, 16 bp, H. sapiens
tggccagggctggtct

SEQ ID NO: 150966 - DNA, 16 bp, H. sapiens
tggccaggtgacattt

SEQ ID NO: 150967 - DNA, 16 bp, H. sapiens
tggccaggtgaggtgg

SEQ ID NO: 150968 - DNA, 16 bp, H. sapiens
tggccaggtgtagtgg

SEQ ID NO: 150969 - DNA, 16 bp, H. sapiens
tggccagtactcttca

SEQ ID NO: 150970 - DNA, 16 bp, H. sapiens
tggccagtctgatctt

SEQ ID NO: 150971 - DNA, 16 bp, H. sapiens
tggccagtgaggatga

SEQ ID NO: 150972 - DNA, 16 bp, H. sapiens
tggccagtgatgagga

SEQ ID NO: 150973 - DNA, 16 bp, H. sapiens
tggccataaagaaatt

SEQ ID NO: 150974 - DNA, 16 bp, H. sapiens
tggccataaagcaagt

SEQ ID NO: 150975 - DNA, 16 bp, H. sapiens
tggccatagaattctc

SEQ ID NO: 150976 - DNA, 16 bp, H. sapiens
tggccatcagagatat

SEQ ID NO: 150977 - DNA, 16 bp, H. sapiens
tggccatcatgaacat

SEQ ID NO: 150978 - DNA, 16 bp, H. sapiens
tggccatcatggtgaa

SEQ ID NO: 150979 - DNA, 16 bp, H. sapiens
tggccatctgcaaacc

SEQ ID NO: 150980 - DNA, 16 bp, H. sapiens
tggccatctgcaaccc

SEQ ID NO: 150981 - DNA, 16 bp, H. sapiens
tggccatctgcaagct

SEQ ID NO: 150982 - DNA, 16 bp, H. sapiens
tggccatcttcttcct

SEQ ID NO: 150983 - DNA, 16 bp, H. sapiens
tggccatcttcttgct

SEQ ID NO: 150984 - DNA, 16 bp, H. sapiens
tggccatcttggctct

SEQ ID NO: 150985 - DNA, 16 bp, H. sapiens
tggccatgatggtgaa

SEQ ID NO: 150986 - DNA, 16 bp, H. sapiens
tggccatgctggtctt

SEQ ID NO: 150987 - DNA, 16 bp, H. sapiens
tggccatgggacaaag

SEQ ID NO: 150988 - DNA, 16 bp, H. sapiens
tggccatgggcaggcc

SEQ ID NO: 150989 - DNA, 16 bp, H. sapiens
tggccatggtggcaga

SEQ ID NO: 150990 - DNA, 16 bp, H. sapiens
tggccatggtggcagg

SEQ ID NO: 150991 - DNA, 16 bp, H. sapiens
tggccatgtccccacc

SEQ ID NO: 150992 - DNA, 16 bp, H. sapiens
tggccatgtgactgag

SEQ ID NO: 150993 - DNA, 16 bp, H. sapiens
tggccattagagaaat

SEQ ID NO: 150994 - DNA, 16 bp, H. sapiens
tggccattatggtgaa

SEQ ID NO: 150995 - DNA, 16 bp, H. sapiens
tggccattcttgtggg

SEQ ID NO: 150996 - DNA, 16 bp, H. sapiens
tggccattgatgatga

SEQ ID NO: 150997 - DNA, 16 bp, H. sapiens
tggccatttctccttc

SEQ ID NO: 150998 - DNA, 16 bp, H. sapiens
tggccattttcaagat

SEQ ID NO: 150999 - DNA, 16 bp, H. sapiens
tggccattttcataat

SEQ ID NO: 151000 - DNA, 16 bp, H. sapiens
tggccattttcatatt

SEQ ID NO: 151001 - DNA, 16 bp, H. sapiens
tggccattttcatgtt

SEQ ID NO: 151002 - DNA, 16 bp, H. sapiens
tggccattttcattat

SEQ ID NO: 151003 - DNA, 16 bp, H. sapiens
tggccatttttatttt

SEQ ID NO: 151004 - DNA, 16 bp, H. sapiens
tggccattttttttgt

SEQ ID NO: 151005 - DNA, 16 bp, H. sapiens
tggcccaagccattca

SEQ ID NO: 151006 - DNA, 16 bp, H. sapiens
tggcccaaggaagcca

SEQ ID NO: 151007 - DNA, 16 bp, H. sapiens
tggcccaagtggcaga

SEQ ID NO: 151008 - DNA, 16 bp, H. sapiens
tggcccaccacaacct

SEQ ID NO: 151009 - DNA, 16 bp, H. sapiens
tggcccacccaggagc

SEQ ID NO: 151010 - DNA, 16 bp, H. sapiens
tggcccacctcagcct

SEQ ID NO: 151011 - DNA, 16 bp, H. sapiens
tggcccagccatccca

SEQ ID NO: 151012 - DNA, 16 bp, H. sapiens
tggcccagccccagcc

SEQ ID NO: 151013 - DNA, 16 bp, H. sapiens
tggcccaggcccaggc

SEQ ID NO: 151014 - DNA, 16 bp, H. sapiens
tggcccaggctgaagt

SEQ ID NO: 151015 - DNA, 16 bp, H. sapiens
tggcccaggctggcct

SEQ ID NO: 151016 - DNA, 16 bp, H. sapiens
tggcccagggcaggtc

SEQ ID NO: 151017 - DNA, 16 bp, H. sapiens
tggcccaggggctggg

SEQ ID NO: 151018 - DNA, 16 bp, H. sapiens
tggcccagtcttggct

SEQ ID NO: 151019 - DNA, 25 bp, H. sapiens
tggcccatccccaatgagccgctgg

SEQ ID NO: 151020 - DNA, 16 bp, H. sapiens
tggcccatgcccagga

SEQ ID NO: 151021 - DNA, 16 bp, H. sapiens
tggcccatgggctgtg

SEQ ID NO: 151022 - DNA, 23 bp, H. sapiens
tggccccacccacatcctgctga

SEQ ID NO: 151023 - DNA, 16 bp, H. sapiens
tggccccacctggacc

SEQ ID NO: 151024 - DNA, 16 bp, H. sapiens
tggccccaggccccag

SEQ ID NO: 151025 - DNA, 16 bp, H. sapiens
tggcccccagctgcat

SEQ ID NO: 151026 - DNA, 16 bp, H. sapiens
tggccccccaaaatgc

SEQ ID NO: 151027 - DNA, 16 bp, H. sapiens
tggccccctctctctt

SEQ ID NO: 151028 - DNA, 16 bp, H. sapiens
tggcccctgctgctgt

SEQ ID NO: 151029 - DNA, 16 bp, H. sapiens
tggcccctttcagcca

SEQ ID NO: 151030 - DNA, 26 bp, H. sapiens
tggcccgttctcaatgagctgttggg

SEQ ID NO: 151031 - DNA, 16 bp, H. sapiens
tggccctgccatggcc

SEQ ID NO: 151032 - DNA, 16 bp, H. sapiens
tggccctgcctctgcc

SEQ ID NO: 151033 - DNA, 16 bp, H. sapiens
tggccctgctctgcct

SEQ ID NO: 151034 - DNA, 16 bp, H. sapiens
tggccctggccaggaa

SEQ ID NO: 151035 - DNA, 16 bp, H. sapiens
tggccctggccctgaa

SEQ ID NO: 151036 - DNA, 16 bp, H. sapiens
tggccctggcctggaa

SEQ ID NO: 151037 - DNA, 16 bp, H. sapiens
tggccctggcttctgg

SEQ ID NO: 151038 - DNA, 16 bp, H. sapiens
tggccctgggtgggag

SEQ ID NO: 151039 - DNA, 16 bp, H. sapiens
tggcccttgacagaaa

SEQ ID NO: 151040 - DNA, 16 bp, H. sapiens
tggccctttccagaaa

SEQ ID NO: 151041 - DNA, 16 bp, H. sapiens
tggccctttcctccat

SEQ ID NO: 151042 - DNA, 16 bp, H. sapiens
tggccctttgcagaaa

SEQ ID NO: 151043 - DNA, 17 bp, H. sapiens
tggccgagcatggtggc

SEQ ID NO: 151044 - DNA, 16 bp, H. sapiens
tggccgaggcgggcgg

SEQ ID NO: 151045 - DNA, 16 bp, H. sapiens
tggccgaggtgggcag

SEQ ID NO: 151046 - DNA, 16 bp, H. sapiens
tggccgatatggtgaa

SEQ ID NO: 151047 - DNA, 16 bp, H. sapiens
tggccgcctgtagtcc

SEQ ID NO: 151048 - DNA, 16 bp, H. sapiens
tggccgggatggtctt

SEQ ID NO: 151049 - DNA, 16 bp, H. sapiens
tggccgggcgcagcgg

SEQ ID NO: 151050 - DNA, 16 bp, H. sapiens
tggccgggcgtgatgg

SEQ ID NO: 151051 - DNA, 16 bp, H. sapiens
tggccgggctgagggg

SEQ ID NO: 151052 - DNA, 16 bp, H. sapiens
tggccgtggtggcagg

SEQ ID NO: 151053 - DNA, 16 bp, H. sapiens
tggcctaaaattttct

SEQ ID NO: 151054 - DNA, 16 bp, H. sapiens
tggcctaatttcaata

SEQ ID NO: 151055 - DNA, 16 bp, H. sapiens
tggcctacaaggccct

SEQ ID NO: 151056 - DNA, 16 bp, H. sapiens
tggcctagccttccag

SEQ ID NO: 151057 - DNA, 16 bp, H. sapiens
tggcctataatcccag

SEQ ID NO: 151058 - DNA, 16 bp, H. sapiens
tggcctatcttggctt

SEQ ID NO: 151059 - DNA, 16 bp, H. sapiens
tggcctattgtgggac

SEQ ID NO: 151060 - DNA, 16 bp, H. sapiens
tggcctcaaactcatg

SEQ ID NO: 151061 - DNA, 16 bp, H. sapiens
tggcctcaaactcctg

SEQ ID NO: 151062 - DNA, 16 bp, H. sapiens
tggcctcaagcaattt

SEQ ID NO: 151063 - DNA, 17 bp, H. sapiens
tggcctcaagcgatcca

SEQ ID NO: 151064 - DNA, 16 bp, H. sapiens
tggcctcagactccca

SEQ ID NO: 151065 - DNA, 16 bp, H. sapiens
tggcctcagcctccag

SEQ ID NO: 151066 - DNA, 16 bp, H. sapiens
tggcctcagcctccca

SEQ ID NO: 151067 - DNA, 16 bp, H. sapiens
tggcctcaggaaggaa

SEQ ID NO: 151068 - DNA, 16 bp, H. sapiens
tggcctcagtttcccc

SEQ ID NO: 151069 - DNA, 16 bp, H. sapiens
tggcctcataccttgt

SEQ ID NO: 151070 - DNA, 16 bp, H. sapiens
tggcctccacccactg

SEQ ID NO: 151071 - DNA, 16 bp, H. sapiens
tggcctccagccagga

SEQ ID NO: 151072 - DNA, 16 bp, H. sapiens
tggcctccagctacat

SEQ ID NO: 151073 - DNA, 16 bp, H. sapiens
tggcctccagctccag

SEQ ID NO: 151074 - DNA, 16 bp, H. sapiens
tggcctccagctccct

SEQ ID NO: 151075 - DNA, 16 bp, H. sapiens
tggcctccatttccat

SEQ ID NO: 151076 - DNA, 16 bp, H. sapiens
tggcctcccaaagaac

SEQ ID NO: 151077 - DNA, 16 bp, H. sapiens
tggcctcccaaagcca

SEQ ID NO: 151078 - DNA, 16 bp, H. sapiens
tggcctcccaagatgc

SEQ ID NO: 151079 - DNA, 16 bp, H. sapiens
tggcctcccagactgc

SEQ ID NO: 151080 - DNA, 16 bp, H. sapiens
tggcctcccagtgctg

SEQ ID NO: 151081 - DNA, 16 bp, H. sapiens
tggcctccccaggtgc

SEQ ID NO: 151082 - DNA, 16 bp, H. sapiens
tggcctcccctgaggc

SEQ ID NO: 151083 - DNA, 16 bp, H. sapiens
tggcctcctgagcagc

SEQ ID NO: 151084 - DNA, 18 bp, H. sapiens
tggcctcctgagggaagt

SEQ ID NO: 151085 - DNA, 17 bp, H. sapiens
tggcctcctgagtagct

SEQ ID NO: 151086 - DNA, 16 bp, H. sapiens
tggcctcctgggctca

SEQ ID NO: 151087 - DNA, 16 bp, H. sapiens
tggcctccttgctgtc

SEQ ID NO: 151088 - DNA, 16 bp, H. sapiens
tggcctcgaattcctg

SEQ ID NO: 151089 - DNA, 16 bp, H. sapiens
tggcctctacccagta

SEQ ID NO: 151090 - DNA, 16 bp, H. sapiens
tggcctctcccaaatc

SEQ ID NO: 151091 - DNA, 16 bp, H. sapiens
tggcctctccctgctc

SEQ ID NO: 151092 - DNA, 16 bp, H. sapiens
tggcctctcctctgtg

SEQ ID NO: 151093 - DNA, 16 bp, H. sapiens
tggcctctgaaagtgt

SEQ ID NO: 151094 - DNA, 16 bp, H. sapiens
tggcctctgcccacct

SEQ ID NO: 151095 - DNA, 16 bp, H. sapiens
tggcctctggctccat

SEQ ID NO: 151096 - DNA, 16 bp, H. sapiens
tggcctcttttcattt

SEQ ID NO: 151097 - DNA, 16 bp, H. sapiens
tggcctgaagcctgaa

SEQ ID NO: 151098 - DNA, 16 bp, H. sapiens
tggcctgatcatggct

SEQ ID NO: 151099 - DNA, 17 bp, H. sapiens
tggcctgatctcggctc

SEQ ID NO: 151100 - DNA, 16 bp, H. sapiens
tggcctgcaggagcca

SEQ ID NO: 151101 - DNA, 16 bp, H. sapiens
tggcctgcaggctgca

SEQ ID NO: 151102 - DNA, 16 bp, H. sapiens
tggcctgccctgcccc

SEQ ID NO: 151103 - DNA, 16 bp, H. sapiens
tggcctggacaacaga

SEQ ID NO: 151104 - DNA, 16 bp, H. sapiens
tggcctggagcctggg

SEQ ID NO: 151105 - DNA, 16 bp, H. sapiens
tggcctggatctcctg

SEQ ID NO: 151106 - DNA, 16 bp, H. sapiens
tggcctggatgtggtt

SEQ ID NO: 151107 - DNA, 16 bp, H. sapiens
tggcctggccaagatg

SEQ ID NO: 151108 - DNA, 16 bp, H. sapiens
tggcctggccctggcc

SEQ ID NO: 151109 - DNA, 16 bp, H. sapiens
tggcctggcctcccag

SEQ ID NO: 151110 - DNA, 16 bp, H. sapiens
tggcctggcctggccc

SEQ ID NO: 151111 - DNA, 16 bp, H. sapiens
tggcctggcctgggct

SEQ ID NO: 151112 - DNA, 16 bp, H. sapiens
tggcctggcgcagtgg

SEQ ID NO: 151113 - DNA, 16 bp, H. sapiens
tggcctggctctggcc

SEQ ID NO: 151114 - DNA, 16 bp, H. sapiens
tggcctggctggtttc

SEQ ID NO: 151115 - DNA, 16 bp, H. sapiens
tggcctgggctcagag

SEQ ID NO: 151116 - DNA, 16 bp, H. sapiens
tggcctgggctctggg

SEQ ID NO: 151117 - DNA, 16 bp, H. sapiens
tggcctggggaagctg

SEQ ID NO: 151118 - DNA, 17 bp, H. sapiens
tggcctgggtgacagag

SEQ ID NO: 151119 - DNA, 16 bp, H. sapiens
tggcctgggtggcaga

SEQ ID NO: 151120 - DNA, 16 bp, H. sapiens
tggcctggtgctgggg

SEQ ID NO: 151121 - DNA, 16 bp, H. sapiens
tggcctggtggctcat

SEQ ID NO: 151122 - DNA, 16 bp, H. sapiens
tggcctgtactcttca

SEQ ID NO: 151123 - DNA, 16 bp, H. sapiens
tggcctgtgcccagga

SEQ ID NO: 151124 - DNA, 16 bp, H. sapiens
tggcctgtggttttct

SEQ ID NO: 151125 - DNA, 16 bp, H. sapiens
tggcctgttaggagcc

SEQ ID NO: 151126 - DNA, 27 bp, H. sapiens
tggccttaatgctccaagcccattggt

SEQ ID NO: 151127 - DNA, 16 bp, H. sapiens
tggccttctctgtgtc

SEQ ID NO: 151128 - DNA, 16 bp, H. sapiens
tggccttgctgagctg

SEQ ID NO: 151129 - DNA, 16 bp, H. sapiens
tggccttgctgaggaa

SEQ ID NO: 151130 - DNA, 16 bp, H. sapiens
tggccttggccttggc

SEQ ID NO: 151131 - DNA, 16 bp, H. sapiens
tggccttgtctctttt

SEQ ID NO: 151132 - DNA, 16 bp, H. sapiens
tggcctttattatttt

SEQ ID NO: 151133 - DNA, 16 bp, H. sapiens
tggcctttcaaaatgc

SEQ ID NO: 151134 - DNA, 16 bp, H. sapiens
tggcctttcaaagtgt

SEQ ID NO: 151135 - DNA, 16 bp, H. sapiens
tggcctttccttggtg

SEQ ID NO: 151136 - DNA, 16 bp, H. sapiens
tggcctttgcacttgc

SEQ ID NO: 151137 - DNA, 16 bp, H. sapiens
tggcctttgtccctgg

SEQ ID NO: 151138 - DNA, 16 bp, H. sapiens
tggcctttgtgtctgg

SEQ ID NO: 151139 - DNA, 16 bp, H. sapiens
tggcctttgttgccat

SEQ ID NO: 151140 - DNA, 16 bp, H. sapiens
tggccttttacagaaa

SEQ ID NO: 151141 - DNA, 16 bp, H. sapiens
tggccttttatgtctg

SEQ ID NO: 151142 - DNA, 16 bp, H. sapiens
tggccttttcccagtg

SEQ ID NO: 151143 - DNA, 17 bp, H. sapiens
tggcgaaacaccatctc

SEQ ID NO: 151144 - DNA, 16 bp, H. sapiens
tggcgaaaccccatct

SEQ ID NO: 151145 - DNA, 16 bp, H. sapiens
tggcgaaaccccctct

SEQ ID NO: 151146 - DNA, 16 bp, H. sapiens
tggcgaaaccctgtgt

SEQ ID NO: 151147 - DNA, 17 bp, H. sapiens
tggcgaacacggtgaaa

SEQ ID NO: 151148 - DNA, 16 bp, H. sapiens
tggcgaggctgcagag

SEQ ID NO: 151149 - DNA, 16 bp, H. sapiens
tggcgagggctccacc

SEQ ID NO: 151150 - DNA, 16 bp, H. sapiens
tggcgagggtgtggag

SEQ ID NO: 151151 - DNA, 16 bp, H. sapiens
tggcgcaatctcagcc

SEQ ID NO: 151152 - DNA, 19 bp, H. sapiens
tggcgcaatctcgactcac

SEQ ID NO: 151153 - DNA, 16 bp, H. sapiens
tggcgcaatctcgcct

SEQ ID NO: 151154 - DNA, 16 bp, H. sapiens
tggcgcagtctcggct

SEQ ID NO: 151155 - DNA, 18 bp, H. sapiens
tggcgcagtcttggctca

SEQ ID NO: 151156 - DNA, 19 bp, H. sapiens
tggcgccatctcggctcac

SEQ ID NO: 151157 - DNA, 16 bp, H. sapiens
tggcgccccctggagg

SEQ ID NO: 151158 - DNA, 16 bp, H. sapiens
tggcgcgatcatggct

SEQ ID NO: 151159 - DNA, 17 bp, H. sapiens
tggcgcgatcgcagctc

SEQ ID NO: 151160 - DNA, 16 bp, H. sapiens
tggcgcgatctcgcct

SEQ ID NO: 151161 - DNA, 16 bp, H. sapiens
tggcgcgatctcggca

SEQ ID NO: 151162 - DNA, 19 bp, H. sapiens
tggcgcgatctcggctcag

SEQ ID NO: 151163 - DNA, 18 bp, H. sapiens
tggcgcgatctcggctct

SEQ ID NO: 151164 - DNA, 16 bp, H. sapiens
tggcgcgatcttggcc

SEQ ID NO: 151165 - DNA, 20 bp, H. sapiens
tggcgcgatcttggctcacc

SEQ ID NO: 151166 - DNA, 18 bp, H. sapiens
tggcgcgcgcctgtagtc

SEQ ID NO: 151167 - DNA, 19 bp, H. sapiens
tggcgcggtctcggctcac

SEQ ID NO: 151168 - DNA, 16 bp, H. sapiens
tggcggcagcaaggag

SEQ ID NO: 151169 - DNA, 16 bp, H. sapiens
tggcggccaggaagag

SEQ ID NO: 151170 - DNA, 16 bp, H. sapiens
tggcggccgggcagag

SEQ ID NO: 151171 - DNA, 16 bp, H. sapiens
tggcggcgtgtgcctg

SEQ ID NO: 151172 - DNA, 16 bp, H. sapiens
tggcggctcacgcctg

SEQ ID NO: 151173 - DNA, 16 bp, H. sapiens
tggcggctcatgcctg

SEQ ID NO: 151174 - DNA, 16 bp, H. sapiens
tggcggctgggcagag

SEQ ID NO: 151175 - DNA, 19 bp, H. sapiens
tggcgggatctcggctcac

SEQ ID NO: 151176 - DNA, 16 bp, H. sapiens
tggcgggcagagtggg

SEQ ID NO: 151177 - DNA, 16 bp, H. sapiens
tggcgggcgcctgcag

SEQ ID NO: 151178 - DNA, 26 bp, H. sapiens
tggcgggcgcctgtagtcccagctac

SEQ ID NO: 151179 - DNA, 16 bp, H. sapiens
tggcgggcgggcagag

SEQ ID NO: 151180 - DNA, 17 bp, H. sapiens
tggcgtgaacccagaag

SEQ ID NO: 151181 - DNA, 17 bp, H. sapiens
tggcgtgatctcagctt

SEQ ID NO: 151182 - DNA, 18 bp, H. sapiens
tggcgtgatctcagttca

SEQ ID NO: 151183 - DNA, 16 bp, H. sapiens
tggcgtgatctccgct

SEQ ID NO: 151184 - DNA, 23 bp, H. sapiens
tggcgtgatctcggctcaccaca

SEQ ID NO: 151185 - DNA, 25 bp, H. sapiens
tggcgtgatctcggctcactgcaaa

SEQ ID NO: 151186 - DNA, 19 bp, H. sapiens
tggcgtgatctcggctcat

SEQ ID NO: 151187 - DNA, 18 bp, H. sapiens
tggcgtgatttcggctca

SEQ ID NO: 151188 - DNA, 17 bp, H. sapiens
tggctaaaaggggccaa

SEQ ID NO: 151189 - DNA, 16 bp, H. sapiens
tggctaaaaggtgcca

SEQ ID NO: 151190 - DNA, 16 bp, H. sapiens
tggctaaaatgggcca

SEQ ID NO: 151191 - DNA, 16 bp, H. sapiens
tggctaaatttgtatt

SEQ ID NO: 151192 - DNA, 18 bp, H. sapiens
tggctaacgcctgtaatc

SEQ ID NO: 151193 - DNA, 19 bp, H. sapiens
tggctaacttttgtatttt

SEQ ID NO: 151194 - DNA, 16 bp, H. sapiens
tggctaactttttttt

SEQ ID NO: 151195 - DNA, 16 bp, H. sapiens
tggctaagtttttatt

SEQ ID NO: 151196 - DNA, 16 bp, H. sapiens
tggctaatatttttat

SEQ ID NO: 151197 - DNA, 16 bp, H. sapiens
tggctaatgatgttga

SEQ ID NO: 151198 - DNA, 17 bp, H. sapiens
tggctaatgcctgtaat

SEQ ID NO: 151199 - DNA, 16 bp, H. sapiens
tggctaatttattatt

SEQ ID NO: 151200 - DNA, 16 bp, H. sapiens
tggctaatttcttatt

SEQ ID NO: 151201 - DNA, 16 bp, H. sapiens
tggctaattttacttt

SEQ ID NO: 151202 - DNA, 16 bp, H. sapiens
tggctaattttctttt

SEQ ID NO: 151203 - DNA, 16 bp, H. sapiens
tggctaattttttaat

SEQ ID NO: 151204 - DNA, 17 bp, H. sapiens
tggctaatttttttaat

SEQ ID NO: 151205 - DNA, 16 bp, H. sapiens
tggctacagccactgc

SEQ ID NO: 151206 - DNA, 16 bp, H. sapiens
tggctactataaataa

SEQ ID NO: 151207 - DNA, 16 bp, H. sapiens
tggctactctgggtct

SEQ ID NO: 151208 - DNA, 16 bp, H. sapiens
tggctactgcaacctc

SEQ ID NO: 151209 - DNA, 16 bp, H. sapiens
tggctactgtattgga

SEQ ID NO: 151210 - DNA, 17 bp, H. sapiens
tggctacttgggaggct

SEQ ID NO: 151211 - DNA, 16 bp, H. sapiens
tggctagaaaaaaaaa

SEQ ID NO: 151212 - DNA, 16 bp, H. sapiens
tggctagaataaaaaa

SEQ ID NO: 151213 - DNA, 16 bp, H. sapiens
tggctagagtacagtg

SEQ ID NO: 151214 - DNA, 18 bp, H. sapiens
tggctagcaacttagaac

SEQ ID NO: 151215 - DNA, 16 bp, H. sapiens
tggctaggaaagggaa

SEQ ID NO: 151216 - DNA, 16 bp, H. sapiens
tggctataaaattatt

SEQ ID NO: 151217 - DNA, 16 bp, H. sapiens
tggctataattaaaag

SEQ ID NO: 151218 - DNA, 16 bp, H. sapiens
tggctatgcagactct

SEQ ID NO: 151219 - DNA, 16 bp, H. sapiens
tggctattcacaggca

SEQ ID NO: 151220 - DNA, 16 bp, H. sapiens
tggctattctgtgtct

SEQ ID NO: 151221 - DNA, 16 bp, H. sapiens
tggctattcttgcagg

SEQ ID NO: 151222 - DNA, 16 bp, H. sapiens
tggctattttatttat

SEQ ID NO: 151223 - DNA, 16 bp, H. sapiens
tggctatttttttaat

SEQ ID NO: 151224 - DNA, 16 bp, H. sapiens
tggctcaaagaaaaat

SEQ ID NO: 151225 - DNA, 16 bp, H. sapiens
tggctcaacatatgaa

SEQ ID NO: 151226 - DNA, 16 bp, H. sapiens
tggctcaagcctggaa

SEQ ID NO: 151227 - DNA, 16 bp, H. sapiens
tggctcaagggatcct

SEQ ID NO: 151228 - DNA, 17 bp, H. sapiens
tggctcacaactgtaat

SEQ ID NO: 151229 - DNA, 17 bp, H. sapiens
tggctcacacctgtaaa

SEQ ID NO: 151230 - DNA, 23 bp, H. sapiens
tggctcacacctgtaatcccaga

SEQ ID NO: 151231 - DNA, 16 bp, H. sapiens
tggctcacacctgtga

SEQ ID NO: 151232 - DNA, 22 bp, H. sapiens
tggctcacacttgtaatcccaa

SEQ ID NO: 151233 - DNA, 16 bp, H. sapiens
tggctcacagcaaact

SEQ ID NO: 151234 - DNA, 16 bp, H. sapiens
tggctcacagtcctgc

SEQ ID NO: 151235 - DNA, 16 bp, H. sapiens
tggctcacccttggca

SEQ ID NO: 151236 - DNA, 17 bp, H. sapiens
tggctcacgactgtaat

SEQ ID NO: 151237 - DNA, 17 bp, H. sapiens
tggctcacgcccataat

SEQ ID NO: 151238 - DNA, 16 bp, H. sapiens
tggctcacgcctataa

SEQ ID NO: 151239 - DNA, 17 bp, H. sapiens
tggctcacgcctgtaaa

SEQ ID NO: 151240 - DNA, 16 bp, H. sapiens
tggctcactacagcct

SEQ ID NO: 151241 - DNA, 16 bp, H. sapiens
tggctcactcctctaa

SEQ ID NO: 151242 - DNA, 16 bp, H. sapiens
tggctcactgaagctt

SEQ ID NO: 151243 - DNA, 18 bp, H. sapiens
tggctcactgcaccctcc

SEQ ID NO: 151244 - DNA, 16 bp, H. sapiens
tggctcactgcagcca

SEQ ID NO: 151245 - DNA, 16 bp, H. sapiens
tggctcactgcagccc

SEQ ID NO: 151246 - DNA, 16 bp, H. sapiens
tggctcactgcagctt

SEQ ID NO: 151247 - DNA, 16 bp, H. sapiens
tggctcactgtagcct

SEQ ID NO: 151248 - DNA, 16 bp, H. sapiens
tggctcactgtgacct

SEQ ID NO: 151249 - DNA, 16 bp, H. sapiens
tggctcagccacttac

SEQ ID NO: 151250 - DNA, 16 bp, H. sapiens
tggctcagcctctctg

SEQ ID NO: 151251 - DNA, 16 bp, H. sapiens
tggctcagcctgtaat

SEQ ID NO: 151252 - DNA, 16 bp, H. sapiens
tggctcaggaggctgc

SEQ ID NO: 151253 - DNA, 16 bp, H. sapiens
tggctcaggtgattct

SEQ ID NO: 151254 - DNA, 16 bp, H. sapiens
tggctcaggtggccag

SEQ ID NO: 151255 - DNA, 16 bp, H. sapiens
tggctcagtgtcccca

SEQ ID NO: 151256 - DNA, 16 bp, H. sapiens
tggctcatagtaggtg

SEQ ID NO: 151257 - DNA, 16 bp, H. sapiens
tggctcatattatatt

SEQ ID NO: 151258 - DNA, 16 bp, H. sapiens
tggctcatgcagcctc

SEQ ID NO: 151259 - DNA, 16 bp, H. sapiens
tggctcatgcatataa

SEQ ID NO: 151260 - DNA, 17 bp, H. sapiens
tggctcatgccagtaat

SEQ ID NO: 151261 - DNA, 16 bp, H. sapiens
tggctcatgcctataa

SEQ ID NO: 151262 - DNA, 18 bp, H. sapiens
tggctcatgcctgtaatg

SEQ ID NO: 151263 - DNA, 16 bp, H. sapiens
tggctcatgcctgtgg

SEQ ID NO: 151264 - DNA, 16 bp, H. sapiens
tggctcatggctcatg

SEQ ID NO: 151265 - DNA, 16 bp, H. sapiens
tggctcatgtctgaaa

SEQ ID NO: 151266 - DNA, 16 bp, H. sapiens
tggctcattgcagcct

SEQ ID NO: 151267 - DNA, 16 bp, H. sapiens
tggctcattttgtttt

SEQ ID NO: 151268 - DNA, 16 bp, H. sapiens
tggctccaaaagagac

SEQ ID NO: 151269 - DNA, 16 bp, H. sapiens
tggctccaaagcccac

SEQ ID NO: 151270 - DNA, 16 bp, H. sapiens
tggctccaccccagtg

SEQ ID NO: 151271 - DNA, 16 bp, H. sapiens
tggctccacctggacc

SEQ ID NO: 151272 - DNA, 16 bp, H. sapiens
tggctccagagcccac

SEQ ID NO: 151273 - DNA, 16 bp, H. sapiens
tggctccagagcccat

SEQ ID NO: 151274 - DNA, 16 bp, H. sapiens
tggctccagagtctgt

SEQ ID NO: 151275 - DNA, 16 bp, H. sapiens
tggctccaggaccccc

SEQ ID NO: 151276 - DNA, 16 bp, H. sapiens
tggctccatctctgct

SEQ ID NO: 151277 - DNA, 17 bp, H. sapiens
tggctcccacctgtaat

SEQ ID NO: 151278 - DNA, 16 bp, H. sapiens
tggctccccaaagtgc

SEQ ID NO: 151279 - DNA, 16 bp, H. sapiens
tggctccccagtgcct

SEQ ID NO: 151280 - DNA, 16 bp, H. sapiens
tggctccccattgcct

SEQ ID NO: 151281 - DNA, 16 bp, H. sapiens
tggctcccccagcccc

SEQ ID NO: 151282 - DNA, 16 bp, H. sapiens
tggctcccgcagcctg

SEQ ID NO: 151283 - DNA, 16 bp, H. sapiens
tggctccctgccacct

SEQ ID NO: 151284 - DNA, 16 bp, H. sapiens
tggctccctgtgttct

SEQ ID NO: 151285 - DNA, 16 bp, H. sapiens
tggctcctgcacctgc

SEQ ID NO: 151286 - DNA, 16 bp, H. sapiens
tggctcctgcaggcca

SEQ ID NO: 151287 - DNA, 16 bp, H. sapiens
tggctcctggacagca

SEQ ID NO: 151288 - DNA, 16 bp, H. sapiens
tggctccttccttcct

SEQ ID NO: 151289 - DNA, 16 bp, H. sapiens
tggctccttgcagcct

SEQ ID NO: 151290 - DNA, 16 bp, H. sapiens
tggctcctttttactt

SEQ ID NO: 151291 - DNA, 16 bp, H. sapiens
tggctcgttgcagcct

SEQ ID NO: 151292 - DNA, 16 bp, H. sapiens
tggctctcaaacttta

SEQ ID NO: 151293 - DNA, 16 bp, H. sapiens
tggctctcattatttt

SEQ ID NO: 151294 - DNA, 16 bp, H. sapiens
tggctctctgtttctc

SEQ ID NO: 151295 - DNA, 16 bp, H. sapiens
tggctctctttctctc

SEQ ID NO: 151296 - DNA, 16 bp, H. sapiens
tggctctgagggtcct

SEQ ID NO: 151297 - DNA, 16 bp, H. sapiens
tggctctgccactgac

SEQ ID NO: 151298 - DNA, 18 bp, H. sapiens
tggctctggaatgtgtct

SEQ ID NO: 151299 - DNA, 16 bp, H. sapiens
tggctctggaggctgg

SEQ ID NO: 151300 - DNA, 16 bp, H. sapiens
tggctctggccctgcc

SEQ ID NO: 151301 - DNA, 16 bp, H. sapiens
tggctctggccctggc

SEQ ID NO: 151302 - DNA, 16 bp, H. sapiens
tggctctggctctggc

SEQ ID NO: 151303 - DNA, 16 bp, H. sapiens
tggctctgtaacccag

SEQ ID NO: 151304 - DNA, 16 bp, H. sapiens
tggctctgtcccccag

SEQ ID NO: 151305 - DNA, 16 bp, H. sapiens
tggctctgtctcccca

SEQ ID NO: 151306 - DNA, 16 bp, H. sapiens
tggctctgtctctctg

SEQ ID NO: 151307 - DNA, 16 bp, H. sapiens
tggctctgtggccttg

SEQ ID NO: 151308 - DNA, 16 bp, H. sapiens
tggctctgtgtcccac

SEQ ID NO: 151309 - DNA, 16 bp, H. sapiens
tggctctgtgtctcca

SEQ ID NO: 151310 - DNA, 16 bp, H. sapiens
tggctctgtttcccca

SEQ ID NO: 151311 - DNA, 16 bp, H. sapiens
tggctcttactatttt

SEQ ID NO: 151312 - DNA, 16 bp, H. sapiens
tggctcttcctgggtc

SEQ ID NO: 151313 - DNA, 16 bp, H. sapiens
tggctcttggttctgc

SEQ ID NO: 151314 - DNA, 17 bp, H. sapiens
tggctctttcactggca

SEQ ID NO: 151315 - DNA, 16 bp, H. sapiens
tggctctttgcagcct

SEQ ID NO: 151316 - DNA, 16 bp, H. sapiens
tggctgaaagatgcac

SEQ ID NO: 151317 - DNA, 16 bp, H. sapiens
tggctgaaaggagcca

SEQ ID NO: 151318 - DNA, 16 bp, H. sapiens
tggctgaaaggggcca

SEQ ID NO: 151319 - DNA, 16 bp, H. sapiens
tggctgaaataacaga

SEQ ID NO: 151320 - DNA, 16 bp, H. sapiens
tggctgaaatgacaga

SEQ ID NO: 151321 - DNA, 16 bp, H. sapiens
tggctgaacctgggag

SEQ ID NO: 151322 - DNA, 16 bp, H. sapiens
tggctgaagctcagct

SEQ ID NO: 151323 - DNA, 16 bp, H. sapiens
tggctgaaggtgaagg

SEQ ID NO: 151324 - DNA, 16 bp, H. sapiens
tggctgaatccacaga

SEQ ID NO: 151325 - DNA, 16 bp, H. sapiens
tggctgaatccacctt

SEQ ID NO: 151326 - DNA, 16 bp, H. sapiens
tggctgacaccttgat

SEQ ID NO: 151327 - DNA, 16 bp, H. sapiens
tggctgacagagccag

SEQ ID NO: 151328 - DNA, 16 bp, H. sapiens
tggctgacatctgtaa

SEQ ID NO: 151329 - DNA, 16 bp, H. sapiens
tggctgactgcaatct

SEQ ID NO: 151330 - DNA, 16 bp, H. sapiens
tggctgactttttttt

SEQ ID NO: 151331 - DNA, 16 bp, H. sapiens
tggctgagctgatatc

SEQ ID NO: 151332 - DNA, 16 bp, H. sapiens
tggctgaggagacctc

SEQ ID NO: 151333 - DNA, 16 bp, H. sapiens
tggctgaggaggcctc

SEQ ID NO: 151334 - DNA, 16 bp, H. sapiens
tggctgaggctgcagt

SEQ ID NO: 151335 - DNA, 16 bp, H. sapiens
tggctgaggtggaagg

SEQ ID NO: 151336 - DNA, 16 bp, H. sapiens
tggctgatgaaataat

SEQ ID NO: 151337 - DNA, 16 bp, H. sapiens
tggctgatgatgttga

SEQ ID NO: 151338 - DNA, 16 bp, H. sapiens
tggctgcacctgctgt

SEQ ID NO: 151339 - DNA, 16 bp, H. sapiens
tggctgcagcccaggc

SEQ ID NO: 151340 - DNA, 16 bp, H. sapiens
tggctgcagccccagc

SEQ ID NO: 151341 - DNA, 16 bp, H. sapiens
tggctgcagctggagg

SEQ ID NO: 151342 - DNA, 16 bp, H. sapiens
tggctgcaggaggagc

SEQ ID NO: 151343 - DNA, 16 bp, H. sapiens
tggctgcaggcaggtg

SEQ ID NO: 151344 - DNA, 16 bp, H. sapiens
tggctgccaggaagct

SEQ ID NO: 151345 - DNA, 16 bp, H. sapiens
tggctgccaggagctg

SEQ ID NO: 151346 - DNA, 16 bp, H. sapiens
tggctgccatactgga

SEQ ID NO: 151347 - DNA, 16 bp, H. sapiens
tggctgcccagtctgg

SEQ ID NO: 151348 - DNA, 16 bp, H. sapiens
tggctgccccagctgg

SEQ ID NO: 151349 - DNA, 16 bp, H. sapiens
tggctgccctgctgga

SEQ ID NO: 151350 - DNA, 16 bp, H. sapiens
tggctgccctgctggg

SEQ ID NO: 151351 - DNA, 16 bp, H. sapiens
tggctgcctcctgcca

SEQ ID NO: 151352 - DNA, 16 bp, H. sapiens
tggctgcctcctgctg

SEQ ID NO: 151353 - DNA, 16 bp, H. sapiens
tggctgcctcctgtca

SEQ ID NO: 151354 - DNA, 16 bp, H. sapiens
tggctgcctccttctc

SEQ ID NO: 151355 - DNA, 16 bp, H. sapiens
tggctgcctctgctgc

SEQ ID NO: 151356 - DNA, 16 bp, H. sapiens
tggctgcctggctggc

SEQ ID NO: 151357 - DNA, 16 bp, H. sapiens
tggctgcctgtatgtc

SEQ ID NO: 151358 - DNA, 16 bp, H. sapiens
tggctgcctgtgggct

SEQ ID NO: 151359 - DNA, 16 bp, H. sapiens
tggctgctccgagtgc

SEQ ID NO: 151360 - DNA, 16 bp, H. sapiens
tggctgctgccatcac

SEQ ID NO: 151361 - DNA, 16 bp, H. sapiens
tggctgctgccgccct

SEQ ID NO: 151362 - DNA, 16 bp, H. sapiens
tggctgctgctgctgc

SEQ ID NO: 151363 - DNA, 16 bp, H. sapiens
tggctgctggcattcc

SEQ ID NO: 151364 - DNA, 16 bp, H. sapiens
tggctgctggcttcca

SEQ ID NO: 151365 - DNA, 16 bp, H. sapiens
tggctgctgtgacaaa

SEQ ID NO: 151366 - DNA, 16 bp, H. sapiens
tggctgctgtgttgag

SEQ ID NO: 151367 - DNA, 16 bp, H. sapiens
tggctgcttccaagtt

SEQ ID NO: 151368 - DNA, 16 bp, H. sapiens
tggctgctttcttgct

SEQ ID NO: 151369 - DNA, 16 bp, H. sapiens
tggctggaatggctgg

SEQ ID NO: 151370 - DNA, 16 bp, H. sapiens
tggctggacacagcct

SEQ ID NO: 151371 - DNA, 16 bp, H. sapiens
tggctggagaaaaaca

SEQ ID NO: 151372 - DNA, 16 bp, H. sapiens
tggctggagaaagagg

SEQ ID NO: 151373 - DNA, 16 bp, H. sapiens
tggctggagcacagtg

SEQ ID NO: 151374 - DNA, 16 bp, H. sapiens
tggctggagcagaggg

SEQ ID NO: 151375 - DNA, 16 bp, H. sapiens
tggctggagctgcagc

SEQ ID NO: 151376 - DNA, 16 bp, H. sapiens
tggctggagctgctgg

SEQ ID NO: 151377 - DNA, 16 bp, H. sapiens
tggctggagctggaga

SEQ ID NO: 151378 - DNA, 16 bp, H. sapiens
tggctggagctggagt

SEQ ID NO: 151379 - DNA, 16 bp, H. sapiens
tggctggagctgtggc

SEQ ID NO: 151380 - DNA, 16 bp, H. sapiens
tggctggaggaggagg

SEQ ID NO: 151381 - DNA, 16 bp, H. sapiens
tggctggaggccagga

SEQ ID NO: 151382 - DNA, 16 bp, H. sapiens
tggctggaggcccagg

SEQ ID NO: 151383 - DNA, 16 bp, H. sapiens
tggctggaggccctgg

SEQ ID NO: 151384 - DNA, 16 bp, H. sapiens
tggctggaggcctcag

SEQ ID NO: 151385 - DNA, 16 bp, H. sapiens
tggctggagtgcagtg

SEQ ID NO: 151386 - DNA, 16 bp, H. sapiens
tggctggagtgtggtg

SEQ ID NO: 151387 - DNA, 18 bp, H. sapiens
tggctggatgtgaaattc

SEQ ID NO: 151388 - DNA, 16 bp, H. sapiens
tggctggcacatagta

SEQ ID NO: 151389 - DNA, 16 bp, H. sapiens
tggctggcagaggcag

SEQ ID NO: 151390 - DNA, 16 bp, H. sapiens
tggctggcagccccta

SEQ ID NO: 151391 - DNA, 16 bp, H. sapiens
tggctggccagttatc

SEQ ID NO: 151392 - DNA, 16 bp, H. sapiens
tggctggccatcagaa

SEQ ID NO: 151393 - DNA, 16 bp, H. sapiens
tggctggctccttctt

SEQ ID NO: 151394 - DNA, 16 bp, H. sapiens
tggctggctgcctggc

SEQ ID NO: 151395 - DNA, 16 bp, H. sapiens
tggctggctgggtggc

SEQ ID NO: 151396 - DNA, 16 bp, H. sapiens
tggctgggaacagtgg

SEQ ID NO: 151397 - DNA, 16 bp, H. sapiens
tggctgggaagcaggg

SEQ ID NO: 151398 - DNA, 16 bp, H. sapiens
tggctgggaccacaga

SEQ ID NO: 151399 - DNA, 16 bp, H. sapiens
tggctgggactatagg

SEQ ID NO: 151400 - DNA, 16 bp, H. sapiens
tggctgggagcagcct

SEQ ID NO: 151401 - DNA, 16 bp, H. sapiens
tggctgggagcggtgg

SEQ ID NO: 151402 - DNA, 16 bp, H. sapiens
tggctgggagctcagc

SEQ ID NO: 151403 - DNA, 16 bp, H. sapiens
tggctgggagctgtgg

SEQ ID NO: 151404 - DNA, 16 bp, H. sapiens
tggctgggcagggtgg

SEQ ID NO: 151405 - DNA, 16 bp, H. sapiens
tggctgggcatgatgg

SEQ ID NO: 151406 - DNA, 16 bp, H. sapiens
tggctgggccacagtg

SEQ ID NO: 151407 - DNA, 16 bp, H. sapiens
tggctgggctcagctg

SEQ ID NO: 151408 - DNA, 16 bp, H. sapiens
tggctgggctgatctc

SEQ ID NO: 151409 - DNA, 16 bp, H. sapiens
tggctggggaaagaga

SEQ ID NO: 151410 - DNA, 16 bp, H. sapiens
tggctggggacacaga

SEQ ID NO: 151411 - DNA, 16 bp, H. sapiens
tggctggggacacagc

SEQ ID NO: 151412 - DNA, 16 bp, H. sapiens
tggctggggaggcccc

SEQ ID NO: 151413 - DNA, 16 bp, H. sapiens
tggctggggaggcttc

SEQ ID NO: 151414 - DNA, 16 bp, H. sapiens
tggctggggcagcctg

SEQ ID NO: 151415 - DNA, 16 bp, H. sapiens
tggctggggcaggagg

SEQ ID NO: 151416 - DNA, 16 bp, H. sapiens
tggctgggggaggcct

SEQ ID NO: 151417 - DNA, 16 bp, H. sapiens
tggctgggggcagtgg

SEQ ID NO: 151418 - DNA, 16 bp, H. sapiens
tggctgggggtggatg

SEQ ID NO: 151419 - DNA, 16 bp, H. sapiens
tggctggttggtggag

SEQ ID NO: 151420 - DNA, 16 bp, H. sapiens
tggctggtttgatctt

SEQ ID NO: 151421 - DNA, 16 bp, H. sapiens
tggctgtaaacacaga

SEQ ID NO: 151422 - DNA, 16 bp, H. sapiens
tggctgtaggtatgtg

SEQ ID NO: 151423 - DNA, 16 bp, H. sapiens
tggctgtaggtgtgca

SEQ ID NO: 151424 - DNA, 16 bp, H. sapiens
tggctgtcagcttgga

SEQ ID NO: 151425 - DNA, 16 bp, H. sapiens
tggctgtctgcaaacc

SEQ ID NO: 151426 - DNA, 16 bp, H. sapiens
tggctgtctgcaacct

SEQ ID NO: 151427 - DNA, 16 bp, H. sapiens
tggctgtctgcaagcc

SEQ ID NO: 151428 - DNA, 16 bp, H. sapiens
tggctgtctgtctgtt

SEQ ID NO: 151429 - DNA, 16 bp, H. sapiens
tggctgtcttcttgtg

SEQ ID NO: 151430 - DNA, 16 bp, H. sapiens
tggctgtcttggctgg

SEQ ID NO: 151431 - DNA, 16 bp, H. sapiens
tggctgtgaatccatc

SEQ ID NO: 151432 - DNA, 16 bp, H. sapiens
tggctgtgaatttgtc

SEQ ID NO: 151433 - DNA, 16 bp, H. sapiens
tggctgtgcaggctct

SEQ ID NO: 151434 - DNA, 16 bp, H. sapiens
tggctgtgccccaccc

SEQ ID NO: 151435 - DNA, 16 bp, H. sapiens
tggctgtgctccacta

SEQ ID NO: 151436 - DNA, 16 bp, H. sapiens
tggctgtgctggagtc

SEQ ID NO: 151437 - DNA, 17 bp, H. sapiens
tggctgtgggtgtgtca

SEQ ID NO: 151438 - DNA, 16 bp, H. sapiens
tggctgtgtcacccag

SEQ ID NO: 151439 - DNA, 16 bp, H. sapiens
tggctgtgtccacacc

SEQ ID NO: 151440 - DNA, 16 bp, H. sapiens
tggctgtgtctctgcc

SEQ ID NO: 151441 - DNA, 16 bp, H. sapiens
tggctgtgtctgcacc

SEQ ID NO: 151442 - DNA, 16 bp, H. sapiens
tggctgtgtgcccacc

SEQ ID NO: 151443 - DNA, 16 bp, H. sapiens
tggctgtgtggccttg

SEQ ID NO: 151444 - DNA, 16 bp, H. sapiens
tggctgttatgaataa

SEQ ID NO: 151445 - DNA, 16 bp, H. sapiens
tggctgttggcaggag

SEQ ID NO: 151446 - DNA, 16 bp, H. sapiens
tggctgttggccagag

SEQ ID NO: 151447 - DNA, 16 bp, H. sapiens
tggctgttgtgaatag

SEQ ID NO: 151448 - DNA, 16 bp, H. sapiens
tggctgtttcctctgc

SEQ ID NO: 151449 - DNA, 16 bp, H. sapiens
tggctgtttgtatgtc

SEQ ID NO: 151450 - DNA, 16 bp, H. sapiens
tggctgtttttaagat

SEQ ID NO: 151451 - DNA, 16 bp, H. sapiens
tggcttaaaacaacac

SEQ ID NO: 151452 - DNA, 16 bp, H. sapiens
tggcttaaaacaacag

SEQ ID NO: 151453 - DNA, 16 bp, H. sapiens
tggcttaaaacaatat

SEQ ID NO: 151454 - DNA, 16 bp, H. sapiens
tggcttaaacaataaa

SEQ ID NO: 151455 - DNA, 16 bp, H. sapiens
tggcttaagcaacaaa

SEQ ID NO: 151456 - DNA, 16 bp, H. sapiens
tggcttaagcaacaga

SEQ ID NO: 151457 - DNA, 16 bp, H. sapiens
tggcttaagtgttaac

SEQ ID NO: 151458 - DNA, 16 bp, H. sapiens
tggcttacacctgtag

SEQ ID NO: 151459 - DNA, 17 bp, H. sapiens
tggcttacgcctgtaat

SEQ ID NO: 151460 - DNA, 16 bp, H. sapiens
tggcttacgcctgtta

SEQ ID NO: 151461 - DNA, 16 bp, H. sapiens
tggcttactgcagcct

SEQ ID NO: 151462 - DNA, 16 bp, H. sapiens
tggcttagaacaacag

SEQ ID NO: 151463 - DNA, 16 bp, H. sapiens
tggcttataaacaaca

SEQ ID NO: 151464 - DNA, 17 bp, H. sapiens
tggcttatgcctgtaat

SEQ ID NO: 151465 - DNA, 16 bp, H. sapiens
tggcttatggcaatga

SEQ ID NO: 151466 - DNA, 16 bp, H. sapiens
tggcttatttatttat

SEQ ID NO: 151467 - DNA, 16 bp, H. sapiens
tggcttatttcactga

SEQ ID NO: 151468 - DNA, 16 bp, H. sapiens
tggcttatttcactta

SEQ ID NO: 151469 - DNA, 16 bp, H. sapiens
tggcttattttagtta

SEQ ID NO: 151470 - DNA, 16 bp, H. sapiens
tggcttattttgctta

SEQ ID NO: 151471 - DNA, 16 bp, H. sapiens
tggcttatttttaaaa

SEQ ID NO: 151472 - DNA, 16 bp, H. sapiens
tggcttcactgtctcc

SEQ ID NO: 151473 - DNA, 16 bp, H. sapiens
tggcttcagaagtgaa

SEQ ID NO: 151474 - DNA, 16 bp, H. sapiens
tggcttcagaggatgc

SEQ ID NO: 151475 - DNA, 16 bp, H. sapiens
tggcttcagcctggga

SEQ ID NO: 151476 - DNA, 16 bp, H. sapiens
tggcttcaggtaccag

SEQ ID NO: 151477 - DNA, 16 bp, H. sapiens
tggcttcatagaatga

SEQ ID NO: 151478 - DNA, 16 bp, H. sapiens
tggcttcatccttggg

SEQ ID NO: 151479 - DNA, 16 bp, H. sapiens
tggcttcattgatttt

SEQ ID NO: 151480 - DNA, 16 bp, H. sapiens
tggcttccaccttcat

SEQ ID NO: 151481 - DNA, 16 bp, H. sapiens
tggcttccagcttcaa

SEQ ID NO: 151482 - DNA, 16 bp, H. sapiens
tggcttccatgtggtg

SEQ ID NO: 151483 - DNA, 16 bp, H. sapiens
tggcttcccagtgcat

SEQ ID NO: 151484 - DNA, 16 bp, H. sapiens
tggcttcccccaaccc

SEQ ID NO: 151485 - DNA, 16 bp, H. sapiens
tggcttccctgggcca

SEQ ID NO: 151486 - DNA, 16 bp, H. sapiens
tggcttccctgggcct

SEQ ID NO: 151487 - DNA, 16 bp, H. sapiens
tggcttcctgcaacct

SEQ ID NO: 151488 - DNA, 16 bp, H. sapiens
tggcttccttgcccct

SEQ ID NO: 151489 - DNA, 16 bp, H. sapiens
tggcttctctctctct

SEQ ID NO: 151490 - DNA, 16 bp, H. sapiens
tggcttctctgcttct

SEQ ID NO: 151491 - DNA, 16 bp, H. sapiens
tggcttctctgggcca

SEQ ID NO: 151492 - DNA, 16 bp, H. sapiens
tggcttctctggttct

SEQ ID NO: 151493 - DNA, 16 bp, H. sapiens
tggcttctctttggca

SEQ ID NO: 151494 - DNA, 16 bp, H. sapiens
tggcttctggagaggc

SEQ ID NO: 151495 - DNA, 16 bp, H. sapiens
tggcttctgtgtccct

SEQ ID NO: 151496 - DNA, 16 bp, H. sapiens
tggcttcttcagctcc

SEQ ID NO: 151497 - DNA, 16 bp, H. sapiens
tggcttcttcaggcaa

SEQ ID NO: 151498 - DNA, 16 bp, H. sapiens
tggcttcttcctgctg

SEQ ID NO: 151499 - DNA, 16 bp, H. sapiens
tggcttctttcaaaat

SEQ ID NO: 151500 - DNA, 16 bp, H. sapiens
tggcttctttcacgta

SEQ ID NO: 151501 - DNA, 16 bp, H. sapiens
tggcttctttcactta

SEQ ID NO: 151502 - DNA, 16 bp, H. sapiens
tggcttctttccctca

SEQ ID NO: 151503 - DNA, 16 bp, H. sapiens
tggcttcttttcattt

SEQ ID NO: 151504 - DNA, 16 bp, H. sapiens
tggcttgaaaatattt

SEQ ID NO: 151505 - DNA, 16 bp, H. sapiens
tggcttgaaggtgggg

SEQ ID NO: 151506 - DNA, 16 bp, H. sapiens
tggcttgcagacagct

SEQ ID NO: 151507 - DNA, 16 bp, H. sapiens
tggcttgccacccaca

SEQ ID NO: 151508 - DNA, 16 bp, H. sapiens
tggcttggctggtttg

SEQ ID NO: 151509 - DNA, 16 bp, H. sapiens
tggcttgggaggctgc

SEQ ID NO: 151510 - DNA, 16 bp, H. sapiens
tggcttggtgccctcc

SEQ ID NO: 151511 - DNA, 16 bp, H. sapiens
tggcttgtggctcctt

SEQ ID NO: 151512 - DNA, 16 bp, H. sapiens
tggcttgtttctcatt

SEQ ID NO: 151513 - DNA, 16 bp, H. sapiens
tggctttaaaaaaaaa

SEQ ID NO: 151514 - DNA, 16 bp, H. sapiens
tggctttaagttgaag

SEQ ID NO: 151515 - DNA, 16 bp, H. sapiens
tggctttaccacctgc

SEQ ID NO: 151516 - DNA, 16 bp, H. sapiens
tggctttatctctggg

SEQ ID NO: 151517 - DNA, 16 bp, H. sapiens
tggctttattttgggg

SEQ ID NO: 151518 - DNA, 16 bp, H. sapiens
tggctttcattgccat

SEQ ID NO: 151519 - DNA, 16 bp, H. sapiens
tggctttccaggccct

SEQ ID NO: 151520 - DNA, 16 bp, H. sapiens
tggctttcctggttct

SEQ ID NO: 151521 - DNA, 16 bp, H. sapiens
tggctttctgaaataa

SEQ ID NO: 151522 - DNA, 16 bp, H. sapiens
tggctttctgattttt

SEQ ID NO: 151523 - DNA, 16 bp, H. sapiens
tggctttgcagatgga

SEQ ID NO: 151524 - DNA, 16 bp, H. sapiens
tggctttgctgagctg

SEQ ID NO: 151525 - DNA, 16 bp, H. sapiens
tggctttggaattggg

SEQ ID NO: 151526 - DNA, 16 bp, H. sapiens
tggctttgtaagaaga

SEQ ID NO: 151527 - DNA, 16 bp, H. sapiens
tggctttgtgggccag

SEQ ID NO: 151528 - DNA, 16 bp, H. sapiens
tggctttgtgttccca

SEQ ID NO: 151529 - DNA, 16 bp, H. sapiens
tggctttgttcatttt

SEQ ID NO: 151530 - DNA, 16 bp, H. sapiens
tggctttgtttaccta

SEQ ID NO: 151531 - DNA, 16 bp, H. sapiens
tggcttttaaaggaat

SEQ ID NO: 151532 - DNA, 16 bp, H. sapiens
tggcttttattacatt

SEQ ID NO: 151533 - DNA, 16 bp, H. sapiens
tggcttttattatgtt

SEQ ID NO: 151534 - DNA, 16 bp, H. sapiens
tggcttttattccttt

SEQ ID NO: 151535 - DNA, 16 bp, H. sapiens
tggcttttattgtatt

SEQ ID NO: 151536 - DNA, 16 bp, H. sapiens
tggcttttccaggagc

SEQ ID NO: 151537 - DNA, 16 bp, H. sapiens
tggcttttctgggcag

SEQ ID NO: 151538 - DNA, 16 bp, H. sapiens
tggcttttgagcactt

SEQ ID NO: 151539 - DNA, 16 bp, H. sapiens
tggcttttgcctgtaa

SEQ ID NO: 151540 - DNA, 16 bp, H. sapiens
tggcttttgtatatta

SEQ ID NO: 151541 - DNA, 16 bp, H. sapiens
tggcttttgtgattga

SEQ ID NO: 151542 - DNA, 16 bp, H. sapiens
tggcttttgtggccat

SEQ ID NO: 151543 - DNA, 16 bp, H. sapiens
tggcttttgtttccat

SEQ ID NO: 151544 - DNA, 16 bp, H. sapiens
tggctttttagatttt

SEQ ID NO: 151545 - DNA, 16 bp, H. sapiens
tggctttttcttccac

SEQ ID NO: 151546 - DNA, 16 bp, H. sapiens
tggctttttgaaaaca

SEQ ID NO: 151547 - DNA, 16 bp, H. sapiens
tggcttttttaaaaaa

SEQ ID NO: 151548 - DNA, 16 bp, H. sapiens
tgggaaaaaaaaaatc

SEQ ID NO: 151549 - DNA, 16 bp, H. sapiens
tgggaaaaaaactgaa

SEQ ID NO: 151550 - DNA, 16 bp, H. sapiens
tgggaaaaaaatgcaa

SEQ ID NO: 151551 - DNA, 16 bp, H. sapiens
tgggaaaaaacaaaca

SEQ ID NO: 151552 - DNA, 16 bp, H. sapiens
tgggaaaaaatgtttg

SEQ ID NO: 151553 - DNA, 16 bp, H. sapiens
tgggaaaaacagaaaa

SEQ ID NO: 151554 - DNA, 16 bp, H. sapiens
tgggaaaaagctggaa

SEQ ID NO: 151555 - DNA, 16 bp, H. sapiens
tgggaaaaataaaatg

SEQ ID NO: 151556 - DNA, 16 bp, H. sapiens
tgggaaaaataatttt

SEQ ID NO: 151557 - DNA, 16 bp, H. sapiens
tgggaaaaattaaata

SEQ ID NO: 151558 - DNA, 16 bp, H. sapiens
tgggaaaaattatttg

SEQ ID NO: 151559 - DNA, 16 bp, H. sapiens
tgggaaaaccactgct

SEQ ID NO: 151560 - DNA, 16 bp, H. sapiens
tgggaaaactgaagct

SEQ ID NO: 151561 - DNA, 16 bp, H. sapiens
tgggaaaactgaggca

SEQ ID NO: 151562 - DNA, 18 bp, H. sapiens
tgggaaaactggctagct

SEQ ID NO: 151563 - DNA, 16 bp, H. sapiens
tgggaaaaggatatga

SEQ ID NO: 151564 - DNA, 16 bp, H. sapiens
tgggaaaaggattccc

SEQ ID NO: 151565 - DNA, 16 bp, H. sapiens
tgggaaaatagaaaat

SEQ ID NO: 151566 - DNA, 16 bp, H. sapiens
tgggaaaatgcctgca

SEQ ID NO: 151567 - DNA, 16 bp, H. sapiens
tgggaaacaaagaaaa

SEQ ID NO: 151568 - DNA, 16 bp, H. sapiens
tgggaaacacagcaag

SEQ ID NO: 151569 - DNA, 16 bp, H. sapiens
tgggaaacatggaaaa

SEQ ID NO: 151570 - DNA, 16 bp, H. sapiens
tgggaaaccaaaaatt

SEQ ID NO: 151571 - DNA, 16 bp, H. sapiens
tgggaaaccaaaatat

SEQ ID NO: 151572 - DNA, 16 bp, H. sapiens
tgggaaaccatgcttc

SEQ ID NO: 151573 - DNA, 16 bp, H. sapiens
tgggaaagaatatttg

SEQ ID NO: 151574 - DNA, 16 bp, H. sapiens
tgggaaagaatttatg

SEQ ID NO: 151575 - DNA, 16 bp, H. sapiens
tgggaaagacccaccc

SEQ ID NO: 151576 - DNA, 16 bp, H. sapiens
tgggaaagacccacct

SEQ ID NO: 151577 - DNA, 16 bp, H. sapiens
tgggaaagactttatc

SEQ ID NO: 151578 - DNA, 16 bp, H. sapiens
tgggaaagattttatt

SEQ ID NO: 151579 - DNA, 16 bp, H. sapiens
tgggaaagctttccag

SEQ ID NO: 151580 - DNA, 16 bp, H. sapiens
tgggaaaggcaggaac

SEQ ID NO: 151581 - DNA, 16 bp, H. sapiens
tgggaaagggctgtta

SEQ ID NO: 151582 - DNA, 16 bp, H. sapiens
tgggaaagggctttct

SEQ ID NO: 151583 - DNA, 16 bp, H. sapiens
tgggaaaggggccagc

SEQ ID NO: 151584 - DNA, 16 bp, H. sapiens
tgggaaagtatttctc

SEQ ID NO: 151585 - DNA, 16 bp, H. sapiens
tgggaaagttacttaa

SEQ ID NO: 151586 - DNA, 16 bp, H. sapiens
tgggaaagttatttaa

SEQ ID NO: 151587 - DNA, 16 bp, H. sapiens
tgggaaagtttggaac

SEQ ID NO: 151588 - DNA, 16 bp, H. sapiens
tgggaaagtttttatt

SEQ ID NO: 151589 - DNA, 16 bp, H. sapiens
tgggaaatggagtaaa

SEQ ID NO: 151590 - DNA, 16 bp, H. sapiens
tgggaaattatgaata

SEQ ID NO: 151591 - DNA, 16 bp, H. sapiens
tgggaacacaggtgca

SEQ ID NO: 151592 - DNA, 16 bp, H. sapiens
tgggaacaggcattcc

SEQ ID NO: 151593 - DNA, 16 bp, H. sapiens
tgggaacattccaaat

SEQ ID NO: 151594 - DNA, 16 bp, H. sapiens
tgggaacccacctctt

SEQ ID NO: 151595 - DNA, 16 bp, H. sapiens
tgggaacgtaaaatgg

SEQ ID NO: 151596 - DNA, 16 bp, H. sapiens
tgggaactcattgagg

SEQ ID NO: 151597 - DNA, 16 bp, H. sapiens
tgggaactctctgtac

SEQ ID NO: 151598 - DNA, 16 bp, H. sapiens
tgggaactggaataaa

SEQ ID NO: 151599 - DNA, 16 bp, H. sapiens
tgggaactggagtgca

SEQ ID NO: 151600 - DNA, 16 bp, H. sapiens
tgggaagaagaagaca

SEQ ID NO: 151601 - DNA, 16 bp, H. sapiens
tgggaagaatcaatat

SEQ ID NO: 151602 - DNA, 16 bp, H. sapiens
tgggaagaccctgatg

SEQ ID NO: 151603 - DNA, 16 bp, H. sapiens
tgggaagactgaggca

SEQ ID NO: 151604 - DNA, 16 bp, H. sapiens
tgggaagaggggaggc

SEQ ID NO: 151605 - DNA, 16 bp, H. sapiens
tgggaagataaaggca

SEQ ID NO: 151606 - DNA, 16 bp, H. sapiens
tgggaagatcactaga

SEQ ID NO: 151607 - DNA, 16 bp, H. sapiens
tgggaagatcacttgg

SEQ ID NO: 151608 - DNA, 16 bp, H. sapiens
tgggaagatcatctga

SEQ ID NO: 151609 - DNA, 16 bp, H. sapiens
tgggaagatgaagaag

SEQ ID NO: 151610 - DNA, 16 bp, H. sapiens
tgggaagatggcagag

SEQ ID NO: 151611 - DNA, 16 bp, H. sapiens
tgggaagatggtttga

SEQ ID NO: 151612 - DNA, 16 bp, H. sapiens
tgggaagatttttttt

SEQ ID NO: 151613 - DNA, 16 bp, H. sapiens
tgggaagcacaagagg

SEQ ID NO: 151614 - DNA, 16 bp, H. sapiens
tgggaagcagaggcgg

SEQ ID NO: 151615 - DNA, 16 bp, H. sapiens
tgggaagcagaggctg

SEQ ID NO: 151616 - DNA, 16 bp, H. sapiens
tgggaagcaggacatg

SEQ ID NO: 151617 - DNA, 16 bp, H. sapiens
tgggaagcaggtttgc

SEQ ID NO: 151618 - DNA, 16 bp, H. sapiens
tgggaagccaaagcag

SEQ ID NO: 151619 - DNA, 18 bp, H. sapiens
tgggaagccaaggcaggc

SEQ ID NO: 151620 - DNA, 16 bp, H. sapiens
tgggaagccaaggtga

SEQ ID NO: 151621 - DNA, 16 bp, H. sapiens
tgggaagctgaagcgg

SEQ ID NO: 151622 - DNA, 16 bp, H. sapiens
tgggaagctgacacag

SEQ ID NO: 151623 - DNA, 16 bp, H. sapiens
tgggaagctgagaggg

SEQ ID NO: 151624 - DNA, 16 bp, H. sapiens
tgggaagctgaggctg

SEQ ID NO: 151625 - DNA, 16 bp, H. sapiens
tgggaaggaagaagta

SEQ ID NO: 151626 - DNA, 16 bp, H. sapiens
tgggaaggagtttgga

SEQ ID NO: 151627 - DNA, 16 bp, H. sapiens
tgggaaggcttcacaa

SEQ ID NO: 151628 - DNA, 20 bp, H. sapiens
tgggaagggaaagacctgac

SEQ ID NO: 151629 - DNA, 16 bp, H. sapiens
tgggaagggcaagggg

SEQ ID NO: 151630 - DNA, 16 bp, H. sapiens
tgggaagggctccctg

SEQ ID NO: 151631 - DNA, 16 bp, H. sapiens
tgggaaggtaaaatgg

SEQ ID NO: 151632 - DNA, 16 bp, H. sapiens
tgggaaggtctttatt

SEQ ID NO: 151633 - DNA, 16 bp, H. sapiens
tgggaaggtgactgca

SEQ ID NO: 151634 - DNA, 16 bp, H. sapiens
tgggaaggtgtatgtg

SEQ ID NO: 151635 - DNA, 24 bp, H. sapiens
tgggaagtaaagctctcctcagca

SEQ ID NO: 151636 - DNA, 16 bp, H. sapiens
tgggaagtgattggat

SEQ ID NO: 151637 - DNA, 16 bp, H. sapiens
tgggaagttttcattt

SEQ ID NO: 151638 - DNA, 16 bp, H. sapiens
tgggaataataatatt

SEQ ID NO: 151639 - DNA, 16 bp, H. sapiens
tgggaataataatggt

SEQ ID NO: 151640 - DNA, 16 bp, H. sapiens
tgggaataatattatc

SEQ ID NO: 151641 - DNA, 16 bp, H. sapiens
tgggaatacaggggtg

SEQ ID NO: 151642 - DNA, 16 bp, H. sapiens
tgggaatatttcaagt

SEQ ID NO: 151643 - DNA, 16 bp, H. sapiens
tgggaatggaattgct

SEQ ID NO: 151644 - DNA, 16 bp, H. sapiens
tgggaatgtaaattag

SEQ ID NO: 151645 - DNA, 16 bp, H. sapiens
tgggaatgtctgtcct

SEQ ID NO: 151646 - DNA, 16 bp, H. sapiens
tgggaattcaaaatga

SEQ ID NO: 151647 - DNA, 16 bp, H. sapiens
tgggaattctgggaaa

SEQ ID NO: 151648 - DNA, 16 bp, H. sapiens
tgggaattgaaaaatg

SEQ ID NO: 151649 - DNA, 19 bp, H. sapiens
tgggaattgaacaatgaga

SEQ ID NO: 151650 - DNA, 16 bp, H. sapiens
tgggaattggagtaaa

SEQ ID NO: 151651 - DNA, 16 bp, H. sapiens
tgggaatttgttagaa

SEQ ID NO: 151652 - DNA, 16 bp, H. sapiens
tgggacaaatacctaa

SEQ ID NO: 151653 - DNA, 16 bp, H. sapiens
tgggacaactggaagt

SEQ ID NO: 151654 - DNA, 16 bp, H. sapiens
tgggacagagcatctg

SEQ ID NO: 151655 - DNA, 16 bp, H. sapiens
tgggacagagcccctg

SEQ ID NO: 151656 - DNA, 16 bp, H. sapiens
tgggacagagtcttac

SEQ ID NO: 151657 - DNA, 16 bp, H. sapiens
tgggacagattctccc

SEQ ID NO: 151658 - DNA, 16 bp, H. sapiens
tgggacatatttcaaa

SEQ ID NO: 151659 - DNA, 16 bp, H. sapiens
tgggaccaatttgacc

SEQ ID NO: 151660 - DNA, 16 bp, H. sapiens
tgggaccacaggagtg

SEQ ID NO: 151661 - DNA, 16 bp, H. sapiens
tgggaccacaggggcc

SEQ ID NO: 151662 - DNA, 16 bp, H. sapiens
tgggaccacaggtaca

SEQ ID NO: 151663 - DNA, 17 bp, H. sapiens
tgggaccacaggtgtga

SEQ ID NO: 151664 - DNA, 17 bp, H. sapiens
tgggaccacaggtgtgc

SEQ ID NO: 151665 - DNA, 16 bp, H. sapiens
tgggaccagaagtatt

SEQ ID NO: 151666 - DNA, 16 bp, H. sapiens
tgggaccagatagtac

SEQ ID NO: 151667 - DNA, 16 bp, H. sapiens
tgggaccataggtgca

SEQ ID NO: 151668 - DNA, 16 bp, H. sapiens
tgggacccaggaatct

SEQ ID NO: 151669 - DNA, 16 bp, H. sapiens
tgggacccaggcatca

SEQ ID NO: 151670 - DNA, 16 bp, H. sapiens
tgggacccccatctct

SEQ ID NO: 151671 - DNA, 16 bp, H. sapiens
tgggacctgcagcctg

SEQ ID NO: 151672 - DNA, 16 bp, H. sapiens
tgggacctgcgggcag

SEQ ID NO: 151673 - DNA, 16 bp, H. sapiens
tgggactacagcatgc

SEQ ID NO: 151674 - DNA, 17 bp, H. sapiens
tgggactacaggcacat

SEQ ID NO: 151675 - DNA, 16 bp, H. sapiens
tgggactacaggggct

SEQ ID NO: 151676 - DNA, 19 bp, H. sapiens
tgggactacaggtgcccac

SEQ ID NO: 151677 - DNA, 16 bp, H. sapiens
tgggactacgggcaca

SEQ ID NO: 151678 - DNA, 16 bp, H. sapiens
tgggactagaaaaaaa

SEQ ID NO: 151679 - DNA, 17 bp, H. sapiens
tgggactataggtgtgc

SEQ ID NO: 151680 - DNA, 16 bp, H. sapiens
tgggactatgggcgcc

SEQ ID NO: 151681 - DNA, 16 bp, H. sapiens
tgggactccaggcatg

SEQ ID NO: 151682 - DNA, 16 bp, H. sapiens
tgggactggctggaca

SEQ ID NO: 151683 - DNA, 16 bp, H. sapiens
tgggactggcttattt

SEQ ID NO: 151684 - DNA, 16 bp, H. sapiens
tgggacttctggcctc

SEQ ID NO: 151685 - DNA, 16 bp, H. sapiens
tgggacttgctgctaa

SEQ ID NO: 151686 - DNA, 16 bp, H. sapiens
tgggactttgccttgt

SEQ ID NO: 151687 - DNA, 16 bp, H. sapiens
tgggagaaaaaaattt

SEQ ID NO: 151688 - DNA, 16 bp, H. sapiens
tgggagaaaaatgtag

SEQ ID NO: 151689 - DNA, 16 bp, H. sapiens
tgggagaaaatatttt

SEQ ID NO: 151690 - DNA, 16 bp, H. sapiens
tgggagaaacctccca

SEQ ID NO: 151691 - DNA, 16 bp, H. sapiens
tgggagaaactttttg

SEQ ID NO: 151692 - DNA, 16 bp, H. sapiens
tgggagaagcagaccc

SEQ ID NO: 151693 - DNA, 16 bp, H. sapiens
tgggagaagctgaggc

SEQ ID NO: 151694 - DNA, 16 bp, H. sapiens
tgggagaatcacttga

SEQ ID NO: 151695 - DNA, 16 bp, H. sapiens
tgggagaattgctcga

SEQ ID NO: 151696 - DNA, 16 bp, H. sapiens
tgggagacaagagcaa

SEQ ID NO: 151697 - DNA, 16 bp, H. sapiens
tgggagacagagctgg

SEQ ID NO: 151698 - DNA, 16 bp, H. sapiens
tgggagacagaggaag

SEQ ID NO: 151699 - DNA, 16 bp, H. sapiens
tgggagacagaggagg

SEQ ID NO: 151700 - DNA, 16 bp, H. sapiens
tgggagacagaggtgg

SEQ ID NO: 151701 - DNA, 16 bp, H. sapiens
tgggagacagtggcag

SEQ ID NO: 151702 - DNA, 16 bp, H. sapiens
tgggagacattaacac

SEQ ID NO: 151703 - DNA, 16 bp, H. sapiens
tgggagaccaagacag

SEQ ID NO: 151704 - DNA, 16 bp, H. sapiens
tgggagaccaaggtgg

SEQ ID NO: 151705 - DNA, 16 bp, H. sapiens
tgggagactcacttga

SEQ ID NO: 151706 - DNA, 16 bp, H. sapiens
tgggagactccatctc

SEQ ID NO: 151707 - DNA, 16 bp, H. sapiens
tgggagactttaacat

SEQ ID NO: 151708 - DNA, 16 bp, H. sapiens
tgggagactttgctct

SEQ ID NO: 151709 - DNA, 16 bp, H. sapiens
tgggagagaagctgag

SEQ ID NO: 151710 - DNA, 16 bp, H. sapiens
tgggagagaatatttg

SEQ ID NO: 151711 - DNA, 16 bp, H. sapiens
tgggagagattggcca

SEQ ID NO: 151712 - DNA, 16 bp, H. sapiens
tgggagaggagcaggg

SEQ ID NO: 151713 - DNA, 16 bp, H. sapiens
tgggagaggagggtct

SEQ ID NO: 151714 - DNA, 16 bp, H. sapiens
tgggagaggccagcag

SEQ ID NO: 151715 - DNA, 16 bp, H. sapiens
tgggagaggctgccat

SEQ ID NO: 151716 - DNA, 16 bp, H. sapiens
tgggagaggctgggag

SEQ ID NO: 151717 - DNA, 16 bp, H. sapiens
tgggagagggagagca

SEQ ID NO: 151718 - DNA, 16 bp, H. sapiens
tgggagagtgaggcag

SEQ ID NO: 151719 - DNA, 16 bp, H. sapiens
tgggagagttccctga

SEQ ID NO: 151720 - DNA, 16 bp, H. sapiens
tgggagatgaggctgg

SEQ ID NO: 151721 - DNA, 16 bp, H. sapiens
tgggagatgtctccca

SEQ ID NO: 151722 - DNA, 16 bp, H. sapiens
tgggagcagaggcagg

SEQ ID NO: 151723 - DNA, 16 bp, H. sapiens
tgggagcagatccctc

SEQ ID NO: 151724 - DNA, 16 bp, H. sapiens
tgggagcatcacttga

SEQ ID NO: 151725 - DNA, 17 bp, H. sapiens
tgggagcattccctttg

SEQ ID NO: 151726 - DNA, 16 bp, H. sapiens
tgggagcatttacacc

SEQ ID NO: 151727 - DNA, 16 bp, H. sapiens
tgggagccaaacattg

SEQ ID NO: 151728 - DNA, 16 bp, H. sapiens
tgggagccaagatggc

SEQ ID NO: 151729 - DNA, 16 bp, H. sapiens
tgggagcccagaggag

SEQ ID NO: 151730 - DNA, 16 bp, H. sapiens
tgggagcccaggagtt

SEQ ID NO: 151731 - DNA, 16 bp, H. sapiens
tgggagcccattgaga

SEQ ID NO: 151732 - DNA, 16 bp, H. sapiens
tgggagccctgagttt

SEQ ID NO: 151733 - DNA, 16 bp, H. sapiens
tgggagcctggggtgg

SEQ ID NO: 151734 - DNA, 17 bp, H. sapiens
tgggagctacagttcaa

SEQ ID NO: 151735 - DNA, 16 bp, H. sapiens
tgggagctaccattca

SEQ ID NO: 151736 - DNA, 16 bp, H. sapiens
tgggagctcaatgagg

SEQ ID NO: 151737 - DNA, 16 bp, H. sapiens
tgggagctccctgggt

SEQ ID NO: 151738 - DNA, 16 bp, H. sapiens
tgggagctctatggcc

SEQ ID NO: 151739 - DNA, 16 bp, H. sapiens
tgggagctctgagctt

SEQ ID NO: 151740 - DNA, 16 bp, H. sapiens
tgggagctctgtgccc

SEQ ID NO: 151741 - DNA, 16 bp, H. sapiens
tgggagctgaacaagg

SEQ ID NO: 151742 - DNA, 16 bp, H. sapiens
tgggagctgagctgag

SEQ ID NO: 151743 - DNA, 16 bp, H. sapiens
tgggagctggagctgg

SEQ ID NO: 151744 - DNA, 17 bp, H. sapiens
tgggagctgtagaccag

SEQ ID NO: 151745 - DNA, 16 bp, H. sapiens
tgggagcttgaggcag

SEQ ID NO: 151746 - DNA, 16 bp, H. sapiens
tgggagctttgttctt

SEQ ID NO: 151747 - DNA, 16 bp, H. sapiens
tgggagctttttagaa

SEQ ID NO: 151748 - DNA, 16 bp, H. sapiens
tgggaggaaactggag

SEQ ID NO: 151749 - DNA, 16 bp, H. sapiens
tgggaggaaattcaaa

SEQ ID NO: 151750 - DNA, 16 bp, H. sapiens
tgggaggaagaggcag

SEQ ID NO: 151751 - DNA, 16 bp, H. sapiens
tgggaggaagctggag

SEQ ID NO: 151752 - DNA, 16 bp, H. sapiens
tgggaggacagggtgg

SEQ ID NO: 151753 - DNA, 16 bp, H. sapiens
tgggaggactcaggaa

SEQ ID NO: 151754 - DNA, 16 bp, H. sapiens
tgggaggagagcttga

SEQ ID NO: 151755 - DNA, 16 bp, H. sapiens
tgggaggagagggcag

SEQ ID NO: 151756 - DNA, 16 bp, H. sapiens
tgggaggaggagtttg

SEQ ID NO: 151757 - DNA, 16 bp, H. sapiens
tgggaggaggcaggag

SEQ ID NO: 151758 - DNA, 16 bp, H. sapiens
tgggaggaggctgagg

SEQ ID NO: 151759 - DNA, 16 bp, H. sapiens
tgggaggagggcaagg

SEQ ID NO: 151760 - DNA, 16 bp, H. sapiens
tgggaggataatttga

SEQ ID NO: 151761 - DNA, 16 bp, H. sapiens
tgggaggatcacatga

SEQ ID NO: 151762 - DNA, 16 bp, H. sapiens
tgggaggatcacttga

SEQ ID NO: 151763 - DNA, 16 bp, H. sapiens
tgggaggatcacttgg

SEQ ID NO: 151764 - DNA, 16 bp, H. sapiens
tgggaggatcagttga

SEQ ID NO: 151765 - DNA, 16 bp, H. sapiens
tgggaggattaaatga

SEQ ID NO: 151766 - DNA, 16 bp, H. sapiens
tgggaggattgcctga

SEQ ID NO: 151767 - DNA, 16 bp, H. sapiens
tgggaggattgcttgg

SEQ ID NO: 151768 - DNA, 16 bp, H. sapiens
tgggaggcagaagctg

SEQ ID NO: 151769 - DNA, 16 bp, H. sapiens
tgggaggcagagatgg

SEQ ID NO: 151770 - DNA, 16 bp, H. sapiens
tgggaggcagagcctg

SEQ ID NO: 151771 - DNA, 16 bp, H. sapiens
tgggaggcagagctgg

SEQ ID NO: 151772 - DNA, 16 bp, H. sapiens
tgggaggcagaggtgc

SEQ ID NO: 151773 - DNA, 18 bp, H. sapiens
tgggaggccaagacaggc

SEQ ID NO: 151774 - DNA, 16 bp, H. sapiens
tgggaggccaaggaga

SEQ ID NO: 151775 - DNA, 16 bp, H. sapiens
tgggaggccaaggagg

SEQ ID NO: 151776 - DNA, 16 bp, H. sapiens
tgggaggccaaggcgg

SEQ ID NO: 151777 - DNA, 16 bp, H. sapiens
tgggaggccaaggtcg

SEQ ID NO: 151778 - DNA, 16 bp, H. sapiens
tgggaggccaggatgg

SEQ ID NO: 151779 - DNA, 16 bp, H. sapiens
tgggaggccaggctgg

SEQ ID NO: 151780 - DNA, 16 bp, H. sapiens
tgggaggccagggtag

SEQ ID NO: 151781 - DNA, 16 bp, H. sapiens
tgggaggccaggtggg

SEQ ID NO: 151782 - DNA, 16 bp, H. sapiens
tgggaggccatggagg

SEQ ID NO: 151783 - DNA, 16 bp, H. sapiens
tgggaggccatggtgg

SEQ ID NO: 151784 - DNA, 18 bp, H. sapiens
tgggaggcccaggcaggt

SEQ ID NO: 151785 - DNA, 16 bp, H. sapiens
tgggaggcccaggtga

SEQ ID NO: 151786 - DNA, 17 bp, H. sapiens
tgggaggccgacgcagg

SEQ ID NO: 151787 - DNA, 16 bp, H. sapiens
tgggaggccgaggagg

SEQ ID NO: 151788 - DNA, 16 bp, H. sapiens
tgggaggccgagtcgg

SEQ ID NO: 151789 - DNA, 16 bp, H. sapiens
tgggaggccgcggcgg

SEQ ID NO: 151790 - DNA, 16 bp, H. sapiens
tgggaggccgtggtgg

SEQ ID NO: 151791 - DNA, 16 bp, H. sapiens
tgggaggcctaggcag

SEQ ID NO: 151792 - DNA, 16 bp, H. sapiens
tgggaggcctcaggaa

SEQ ID NO: 151793 - DNA, 16 bp, H. sapiens
tgggaggcgactggat

SEQ ID NO: 151794 - DNA, 16 bp, H. sapiens
tgggaggcggaggccg

SEQ ID NO: 151795 - DNA, 16 bp, H. sapiens
tgggaggcggaggttg

SEQ ID NO: 151796 - DNA, 16 bp, H. sapiens
tgggaggcggtggttg

SEQ ID NO: 151797 - DNA, 16 bp, H. sapiens
tgggaggctaaagtgg

SEQ ID NO: 151798 - DNA, 16 bp, H. sapiens
tgggaggctaaggtag

SEQ ID NO: 151799 - DNA, 16 bp, H. sapiens
tgggaggctgaaaagg

SEQ ID NO: 151800 - DNA, 16 bp, H. sapiens
tgggaggctgacaggg

SEQ ID NO: 151801 - DNA, 16 bp, H. sapiens
tgggaggctgagaagg

SEQ ID NO: 151802 - DNA, 16 bp, H. sapiens
tgggaggctgagcaga

SEQ ID NO: 151803 - DNA, 16 bp, H. sapiens
tgggaggctgagcagg

SEQ ID NO: 151804 - DNA, 16 bp, H. sapiens
tgggaggctgagccgg

SEQ ID NO: 151805 - DNA, 16 bp, H. sapiens
tgggaggctgaggtga

SEQ ID NO: 151806 - DNA, 16 bp, H. sapiens
tgggaggctgcagagg

SEQ ID NO: 151807 - DNA, 16 bp, H. sapiens
tgggaggctgcagctg

SEQ ID NO: 151808 - DNA, 16 bp, H. sapiens
tgggaggctgcggtgg

SEQ ID NO: 151809 - DNA, 16 bp, H. sapiens
tgggaggctggtgcag

SEQ ID NO: 151810 - DNA, 16 bp, H. sapiens
tgggaggctgtggagg

SEQ ID NO: 151811 - DNA, 16 bp, H. sapiens
tgggaggctgtggctg

SEQ ID NO: 151812 - DNA, 16 bp, H. sapiens
tgggagggacccagga

SEQ ID NO: 151813 - DNA, 16 bp, H. sapiens
tgggagggcaaagcag

SEQ ID NO: 151814 - DNA, 16 bp, H. sapiens
tgggagggccaggcag

SEQ ID NO: 151815 - DNA, 16 bp, H. sapiens
tgggagggctgaggca

SEQ ID NO: 151816 - DNA, 16 bp, H. sapiens
tgggaggggacaaata

SEQ ID NO: 151817 - DNA, 16 bp, H. sapiens
tgggaggggacaggga

SEQ ID NO: 151818 - DNA, 16 bp, H. sapiens
tgggaggggcagtccc

SEQ ID NO: 151819 - DNA, 16 bp, H. sapiens
tgggaggggccaggag

SEQ ID NO: 151820 - DNA, 16 bp, H. sapiens
tgggaggggctgctgg

SEQ ID NO: 151821 - DNA, 16 bp, H. sapiens
tgggagggggacaagg

SEQ ID NO: 151822 - DNA, 16 bp, H. sapiens
tgggaggggtcaggga

SEQ ID NO: 151823 - DNA, 16 bp, H. sapiens
tgggagggtgagacag

SEQ ID NO: 151824 - DNA, 16 bp, H. sapiens
tgggaggtaattgaat

SEQ ID NO: 151825 - DNA, 16 bp, H. sapiens
tgggaggtccctcact

SEQ ID NO: 151826 - DNA, 16 bp, H. sapiens
tgggaggtgactgaat

SEQ ID NO: 151827 - DNA, 16 bp, H. sapiens
tgggaggtgaggagca

SEQ ID NO: 151828 - DNA, 16 bp, H. sapiens
tgggaggtgatgaggt

SEQ ID NO: 151829 - DNA, 16 bp, H. sapiens
tgggaggtgattgaat

SEQ ID NO: 151830 - DNA, 16 bp, H. sapiens
tgggaggtgctacaca

SEQ ID NO: 151831 - DNA, 16 bp, H. sapiens
tgggaggtggaagcag

SEQ ID NO: 151832 - DNA, 16 bp, H. sapiens
tgggaggtggaggccg

SEQ ID NO: 151833 - DNA, 16 bp, H. sapiens
tgggaggtggagttgc

SEQ ID NO: 151834 - DNA, 16 bp, H. sapiens
tgggaggtggcagagg

SEQ ID NO: 151835 - DNA, 16 bp, H. sapiens
tgggaggtggggcctc

SEQ ID NO: 151836 - DNA, 16 bp, H. sapiens
tgggaggtggggcctg

SEQ ID NO: 151837 - DNA, 16 bp, H. sapiens
tgggaggtgtcttcca

SEQ ID NO: 151838 - DNA, 16 bp, H. sapiens
tgggaggttgaagcag

SEQ ID NO: 151839 - DNA, 16 bp, H. sapiens
tgggaggttgtatgtg

SEQ ID NO: 151840 - DNA, 16 bp, H. sapiens
tgggagtacaggtgca

SEQ ID NO: 151841 - DNA, 16 bp, H. sapiens
tgggagtcatccttga

SEQ ID NO: 151842 - DNA, 16 bp, H. sapiens
tgggagtccaaggtgg

SEQ ID NO: 151843 - DNA, 16 bp, H. sapiens
tgggagtctaagtctc

SEQ ID NO: 151844 - DNA, 16 bp, H. sapiens
tgggagtctcactgtg

SEQ ID NO: 151845 - DNA, 16 bp, H. sapiens
tgggagtgagaccagc

SEQ ID NO: 151846 - DNA, 16 bp, H. sapiens
tgggagtgatgggaga

SEQ ID NO: 151847 - DNA, 16 bp, H. sapiens
tgggagtgcagacatt

SEQ ID NO: 151848 - DNA, 16 bp, H. sapiens
tgggagttattgttta

SEQ ID NO: 151849 - DNA, 16 bp, H. sapiens
tgggagttcaagacca

SEQ ID NO: 151850 - DNA, 16 bp, H. sapiens
tgggagttcagtcagg

SEQ ID NO: 151851 - DNA, 16 bp, H. sapiens
tgggagttcgagacca

SEQ ID NO: 151852 - DNA, 16 bp, H. sapiens
tgggagttctagggcc

SEQ ID NO: 151853 - DNA, 16 bp, H. sapiens
tgggagttctcacttt

SEQ ID NO: 151854 - DNA, 16 bp, H. sapiens
tgggagtttgaggtta

SEQ ID NO: 151855 - DNA, 16 bp, H. sapiens
tgggagttttatctat

SEQ ID NO: 151856 - DNA, 16 bp, H. sapiens
tgggataaaatttttg

SEQ ID NO: 151857 - DNA, 16 bp, H. sapiens
tgggataaatgatttt

SEQ ID NO: 151858 - DNA, 16 bp, H. sapiens
tgggataatgaaaatg

SEQ ID NO: 151859 - DNA, 16 bp, H. sapiens
tgggatacagcaaaag

SEQ ID NO: 151860 - DNA, 16 bp, H. sapiens
tgggatacagtgaaag

SEQ ID NO: 151861 - DNA, 16 bp, H. sapiens
tgggatacctgtgcag

SEQ ID NO: 151862 - DNA, 16 bp, H. sapiens
tgggatagtttactga

SEQ ID NO: 151863 - DNA, 16 bp, H. sapiens
tgggatattggcattg

SEQ ID NO: 151864 - DNA, 16 bp, H. sapiens
tgggatcaaattaaac

SEQ ID NO: 151865 - DNA, 16 bp, H. sapiens
tgggatcactggatca

SEQ ID NO: 151866 - DNA, 16 bp, H. sapiens
tgggatcaggatgatg

SEQ ID NO: 151867 - DNA, 16 bp, H. sapiens
tgggatctcattgtgg

SEQ ID NO: 151868 - DNA, 17 bp, H. sapiens
tgggatgacaggcacac

SEQ ID NO: 151869 - DNA, 19 bp, H. sapiens
tgggatgagaaagacctga

SEQ ID NO: 151870 - DNA, 16 bp, H. sapiens
tgggatgatgatgatg

SEQ ID NO: 151871 - DNA, 16 bp, H. sapiens
tgggatgatggaaaag

SEQ ID NO: 151872 - DNA, 16 bp, H. sapiens
tgggatgcaaggatga

SEQ ID NO: 151873 - DNA, 16 bp, H. sapiens
tgggatgcaaggttgt

SEQ ID NO: 151874 - DNA, 16 bp, H. sapiens
tgggatgccctttatt

SEQ ID NO: 151875 - DNA, 16 bp, H. sapiens
tgggatgctgaggtga

SEQ ID NO: 151876 - DNA, 16 bp, H. sapiens
tgggatggcccttcag

SEQ ID NO: 151877 - DNA, 16 bp, H. sapiens
tgggatggggcccagg

SEQ ID NO: 151878 - DNA, 16 bp, H. sapiens
tgggatggtcagggaa

SEQ ID NO: 151879 - DNA, 16 bp, H. sapiens
tgggatggtgccactg

SEQ ID NO: 151880 - DNA, 16 bp, H. sapiens
tgggattaaaggcctg

SEQ ID NO: 151881 - DNA, 16 bp, H. sapiens
tgggattacagacatg

SEQ ID NO: 151882 - DNA, 16 bp, H. sapiens
tgggattacagccata

SEQ ID NO: 151883 - DNA, 17 bp, H. sapiens
tgggattacaggcatca

SEQ ID NO: 151884 - DNA, 22 bp, H. sapiens
tgggattacaggcatgaaccac

SEQ ID NO: 151885 - DNA, 25 bp, H. sapiens
tgggattacaggtgcccaccaccac

SEQ ID NO: 151886 - DNA, 16 bp, H. sapiens
tgggattacaggtgta

SEQ ID NO: 151887 - DNA, 17 bp, H. sapiens
tgggattacaggtgtgc

SEQ ID NO: 151888 - DNA, 17 bp, H. sapiens
tgggattacaggtgtgt

SEQ ID NO: 151889 - DNA, 16 bp, H. sapiens
tgggattaccaggcat

SEQ ID NO: 151890 - DNA, 16 bp, H. sapiens
tgggattactgagtca

SEQ ID NO: 151891 - DNA, 16 bp, H. sapiens
tgggattataggtgtg

SEQ ID NO: 151892 - DNA, 16 bp, H. sapiens
tgggattatgagtgtg

SEQ ID NO: 151893 - DNA, 16 bp, H. sapiens
tgggattcaaacccag

SEQ ID NO: 151894 - DNA, 16 bp, H. sapiens
tgggattcagcaaaag

SEQ ID NO: 151895 - DNA, 16 bp, H. sapiens
tgggattcagtctgtg

SEQ ID NO: 151896 - DNA, 16 bp, H. sapiens
tgggattgcagatgtg

SEQ ID NO: 151897 - DNA, 16 bp, H. sapiens
tgggattgcaggcata

SEQ ID NO: 151898 - DNA, 16 bp, H. sapiens
tgggattgcaggtgca

SEQ ID NO: 151899 - DNA, 16 bp, H. sapiens
tgggattgctgagtca

SEQ ID NO: 151900 - DNA, 16 bp, H. sapiens
tgggattgtgccactg

SEQ ID NO: 151901 - DNA, 16 bp, H. sapiens
tgggatttcaccatat

SEQ ID NO: 151902 - DNA, 16 bp, H. sapiens
tgggatttgaacccca

SEQ ID NO: 151903 - DNA, 16 bp, H. sapiens
tgggattttgatagtg

SEQ ID NO: 151904 - DNA, 16 bp, H. sapiens
tgggcaaaaaaagtga

SEQ ID NO: 151905 - DNA, 16 bp, H. sapiens
tgggcaaaaaatatga

SEQ ID NO: 151906 - DNA, 16 bp, H. sapiens
tgggcaaaaagtgaga

SEQ ID NO: 151907 - DNA, 16 bp, H. sapiens
tgggcaaaagggtgag

SEQ ID NO: 151908 - DNA, 16 bp, H. sapiens
tgggcaaaatggcaag

SEQ ID NO: 151909 - DNA, 16 bp, H. sapiens
tgggcaaagatttctt

SEQ ID NO: 151910 - DNA, 16 bp, H. sapiens
tgggcaaaggaaatga

SEQ ID NO: 151911 - DNA, 16 bp, H. sapiens
tgggcaaaggacagga

SEQ ID NO: 151912 - DNA, 16 bp, H. sapiens
tgggcaaaggacatca

SEQ ID NO: 151913 - DNA, 16 bp, H. sapiens
tgggcaaaggagatga

SEQ ID NO: 151914 - DNA, 16 bp, H. sapiens
tgggcaaattgcttga

SEQ ID NO: 151915 - DNA, 16 bp, H. sapiens
tgggcaacaaagctag

SEQ ID NO: 151916 - DNA, 16 bp, H. sapiens
tgggcaacaaagtaag

SEQ ID NO: 151917 - DNA, 16 bp, H. sapiens
tgggcaacaacagagt

SEQ ID NO: 151918 - DNA, 16 bp, H. sapiens
tgggcaacaagaacaa

SEQ ID NO: 151919 - DNA, 16 bp, H. sapiens
tgggcaacaagaagga

SEQ ID NO: 151920 - DNA, 16 bp, H. sapiens
tgggcaacaagaccga

SEQ ID NO: 151921 - DNA, 16 bp, H. sapiens
tgggcaacaagagcga

SEQ ID NO: 151922 - DNA, 16 bp, H. sapiens
tgggcaacaagagtga

SEQ ID NO: 151923 - DNA, 18 bp, H. sapiens
tgggcaacaagagtgaaa

SEQ ID NO: 151924 - DNA, 16 bp, H. sapiens
tgggcaacaagattga

SEQ ID NO: 151925 - DNA, 16 bp, H. sapiens
tgggcaacaagtgcga

SEQ ID NO: 151926 - DNA, 16 bp, H. sapiens
tgggcaacaagtgtga

SEQ ID NO: 151927 - DNA, 17 bp, H. sapiens
tgggcaacacagcaaga

SEQ ID NO: 151928 - DNA, 17 bp, H. sapiens
tgggcaacacagtgaga

SEQ ID NO: 151929 - DNA, 16 bp, H. sapiens
tgggcaacagagagac

SEQ ID NO: 151930 - DNA, 17 bp, H. sapiens
tgggcaacagagtgaga

SEQ ID NO: 151931 - DNA, 16 bp, H. sapiens
tgggcaacagcaagac

SEQ ID NO: 151932 - DNA, 16 bp, H. sapiens
tgggcaacagcgcgag

SEQ ID NO: 151933 - DNA, 16 bp, H. sapiens
tgggcaacataaccag

SEQ ID NO: 151934 - DNA, 16 bp, H. sapiens
tgggcaacatagggtg

SEQ ID NO: 151935 - DNA, 17 bp, H. sapiens
tgggcaacatagtgaga

SEQ ID NO: 151936 - DNA, 17 bp, H. sapiens
tgggcaacatggcaaaa

SEQ ID NO: 151937 - DNA, 16 bp, H. sapiens
tgggcaacattgcaag

SEQ ID NO: 151938 - DNA, 16 bp, H. sapiens
tgggcaaccccaggca

SEQ ID NO: 151939 - DNA, 18 bp, H. sapiens
tgggcaacgagagcaaaa

SEQ ID NO: 151940 - DNA, 16 bp, H. sapiens
tgggcaacgtagcaag

SEQ ID NO: 151941 - DNA, 16 bp, H. sapiens
tgggcaactggagtga

SEQ ID NO: 151942 - DNA, 16 bp, H. sapiens
tgggcaagagtgagat

SEQ ID NO: 151943 - DNA, 17 bp, H. sapiens
tgggcaaggaattcatg

SEQ ID NO: 151944 - DNA, 16 bp, H. sapiens
tgggcaaggacttcac

SEQ ID NO: 151945 - DNA, 16 bp, H. sapiens
tgggcaagtcagttaa

SEQ ID NO: 151946 - DNA, 16 bp, H. sapiens
tgggcaagttatttaa

SEQ ID NO: 151947 - DNA, 16 bp, H. sapiens
tgggcaagttctttaa

SEQ ID NO: 151948 - DNA, 16 bp, H. sapiens
tgggcaagttgctcaa

SEQ ID NO: 151949 - DNA, 16 bp, H. sapiens
tgggcaagttgcttaa

SEQ ID NO: 151950 - DNA, 16 bp, H. sapiens
tgggcaataaaagtga

SEQ ID NO: 151951 - DNA, 16 bp, H. sapiens
tgggcaataagagtga

SEQ ID NO: 151952 - DNA, 17 bp, H. sapiens
tgggcaatatagtgaga

SEQ ID NO: 151953 - DNA, 16 bp, H. sapiens
tgggcaatcagcagcc

SEQ ID NO: 151954 - DNA, 16 bp, H. sapiens
tgggcaatgtctggag

SEQ ID NO: 151955 - DNA, 16 bp, H. sapiens
tgggcaatgtggcgaa

SEQ ID NO: 151956 - DNA, 16 bp, H. sapiens
tgggcaattcccagaa

SEQ ID NO: 151957 - DNA, 16 bp, H. sapiens
tgggcaatttgcaaaa

SEQ ID NO: 151958 - DNA, 16 bp, H. sapiens
tgggcacaagatggct

SEQ ID NO: 151959 - DNA, 17 bp, H. sapiens
tgggcacaatgtgcagg

SEQ ID NO: 151960 - DNA, 16 bp, H. sapiens
tgggcacagcagctca

SEQ ID NO: 151961 - DNA, 17 bp, H. sapiens
tgggcacagtggcacac

SEQ ID NO: 151962 - DNA, 16 bp, H. sapiens
tgggcacagtggcatg

SEQ ID NO: 151963 - DNA, 16 bp, H. sapiens
tgggcacagtggcgca

SEQ ID NO: 151964 - DNA, 16 bp, H. sapiens
tgggcacagtggctgt

SEQ ID NO: 151965 - DNA, 16 bp, H. sapiens
tgggcacagtggcttg

SEQ ID NO: 151966 - DNA, 16 bp, H. sapiens
tgggcaccatggccca

SEQ ID NO: 151967 - DNA, 16 bp, H. sapiens
tgggcacccgccacca

SEQ ID NO: 151968 - DNA, 16 bp, H. sapiens
tgggcacgttggctca

SEQ ID NO: 151969 - DNA, 16 bp, H. sapiens
tgggcactgcagggtg

SEQ ID NO: 151970 - DNA, 16 bp, H. sapiens
tgggcagaacttccaa

SEQ ID NO: 151971 - DNA, 16 bp, H. sapiens
tgggcagaagagggtg

SEQ ID NO: 151972 - DNA, 16 bp, H. sapiens
tgggcagagactgtgg

SEQ ID NO: 151973 - DNA, 16 bp, H. sapiens
tgggcagaggaagagg

SEQ ID NO: 151974 - DNA, 16 bp, H. sapiens
tgggcagaggccagag

SEQ ID NO: 151975 - DNA, 19 bp, H. sapiens
tgggcagaggggctcctca

SEQ ID NO: 151976 - DNA, 16 bp, H. sapiens
tgggcagatacccagt

SEQ ID NO: 151977 - DNA, 16 bp, H. sapiens
tgggcagatcaactga

SEQ ID NO: 151978 - DNA, 18 bp, H. sapiens
tgggcagatcacttgaga

SEQ ID NO: 151979 - DNA, 16 bp, H. sapiens
tgggcagatcatgaag

SEQ ID NO: 151980 - DNA, 16 bp, H. sapiens
tgggcagatcatttga

SEQ ID NO: 151981 - DNA, 16 bp, H. sapiens
tgggcagcaagagcga

SEQ ID NO: 151982 - DNA, 16 bp, H. sapiens
tgggcagcacagtgaa

SEQ ID NO: 151983 - DNA, 16 bp, H. sapiens
tgggcagcatggagaa

SEQ ID NO: 151984 - DNA, 16 bp, H. sapiens
tgggcagccagcagcc

SEQ ID NO: 151985 - DNA, 16 bp, H. sapiens
tgggcagccgggcaga

SEQ ID NO: 151986 - DNA, 16 bp, H. sapiens
tgggcagctccacccc

SEQ ID NO: 151987 - DNA, 16 bp, H. sapiens
tgggcagctctgcccc

SEQ ID NO: 151988 - DNA, 16 bp, H. sapiens
tgggcagctctggccc

SEQ ID NO: 151989 - DNA, 16 bp, H. sapiens
tgggcagctgcatctg

SEQ ID NO: 151990 - DNA, 16 bp, H. sapiens
tgggcaggacctgtga

SEQ ID NO: 151991 - DNA, 16 bp, H. sapiens
tgggcaggagagaagg

SEQ ID NO: 151992 - DNA, 16 bp, H. sapiens
tgggcaggagtgggga

SEQ ID NO: 151993 - DNA, 16 bp, H. sapiens
tgggcaggctcacctg

SEQ ID NO: 151994 - DNA, 16 bp, H. sapiens
tgggcaggctgtgggg

SEQ ID NO: 151995 - DNA, 16 bp, H. sapiens
tgggcagggcagggct

SEQ ID NO: 151996 - DNA, 16 bp, H. sapiens
tgggcagggccctaga

SEQ ID NO: 151997 - DNA, 16 bp, H. sapiens
tgggcagggcttgctg

SEQ ID NO: 151998 - DNA, 16 bp, H. sapiens
tgggcaggtgcagagg

SEQ ID NO: 151999 - DNA, 16 bp, H. sapiens
tgggcaggtggagagg

SEQ ID NO: 152000 - DNA, 16 bp, H. sapiens
tgggcaggtgtgtgtg

SEQ ID NO: 152001 - DNA, 20 bp, H. sapiens
tgggcagtgaggggcttagc

SEQ ID NO: 152002 - DNA, 16 bp, H. sapiens
tgggcagtggctcaca

SEQ ID NO: 152003 - DNA, 16 bp, H. sapiens
tgggcagtgggcaagg

SEQ ID NO: 152004 - DNA, 16 bp, H. sapiens
tgggcatagtggcatg

SEQ ID NO: 152005 - DNA, 16 bp, H. sapiens
tgggcatcacagcaag

SEQ ID NO: 152006 - DNA, 17 bp, H. sapiens
tgggcatcacagcaaga

SEQ ID NO: 152007 - DNA, 18 bp, H. sapiens
tgggcatcagtagactgg

SEQ ID NO: 152008 - DNA, 16 bp, H. sapiens
tgggcatcatggccat

SEQ ID NO: 152009 - DNA, 16 bp, H. sapiens
tgggcatcctcgtctt

SEQ ID NO: 152010 - DNA, 16 bp, H. sapiens
tgggcatccttgtctc

SEQ ID NO: 152011 - DNA, 16 bp, H. sapiens
tgggcatctgtgtgtg

SEQ ID NO: 152012 - DNA, 16 bp, H. sapiens
tgggcatgctggctca

SEQ ID NO: 152013 - DNA, 16 bp, H. sapiens
tgggcatgggcttggt

SEQ ID NO: 152014 - DNA, 16 bp, H. sapiens
tgggcatggtgatggg

SEQ ID NO: 152015 - DNA, 16 bp, H. sapiens
tgggcatggtggctgg

SEQ ID NO: 152016 - DNA, 16 bp, H. sapiens
tgggcatggtggtgca

SEQ ID NO: 152017 - DNA, 16 bp, H. sapiens
tgggcatggtggtgcc

SEQ ID NO: 152018 - DNA, 16 bp, H. sapiens
tgggcatggtggtgct

SEQ ID NO: 152019 - DNA, 16 bp, H. sapiens
tgggcatggtggtgga

SEQ ID NO: 152020 - DNA, 16 bp, H. sapiens
tgggcatggtggtgta

SEQ ID NO: 152021 - DNA, 16 bp, H. sapiens
tgggcatgttggcatg

SEQ ID NO: 152022 - DNA, 16 bp, H. sapiens
tgggcatttgggtggg

SEQ ID NO: 152023 - DNA, 17 bp, H. sapiens
tgggcatttgggttggt

SEQ ID NO: 152024 - DNA, 16 bp, H. sapiens
tgggcatttgggtttg

SEQ ID NO: 152025 - DNA, 16 bp, H. sapiens
tgggcatttggtgcta

SEQ ID NO: 152026 - DNA, 16 bp, H. sapiens
tgggccaaatccagcc

SEQ ID NO: 152027 - DNA, 16 bp, H. sapiens
tgggccaaatttggcc

SEQ ID NO: 152028 - DNA, 16 bp, H. sapiens
tgggccaagcactgtg

SEQ ID NO: 152029 - DNA, 16 bp, H. sapiens
tgggccaagcccaggg

SEQ ID NO: 152030 - DNA, 16 bp, H. sapiens
tgggccaagtgggcag

SEQ ID NO: 152031 - DNA, 16 bp, H. sapiens
tgggccacaatggaag

SEQ ID NO: 152032 - DNA, 16 bp, H. sapiens
tgggccacacagcagg

SEQ ID NO: 152033 - DNA, 16 bp, H. sapiens
tgggccacagggaggc

SEQ ID NO: 152034 - DNA, 16 bp, H. sapiens
tgggccacaggggagc

SEQ ID NO: 152035 - DNA, 16 bp, H. sapiens
tgggccacatgtggcc

SEQ ID NO: 152036 - DNA, 16 bp, H. sapiens
tgggccactgcacctg

SEQ ID NO: 152037 - DNA, 16 bp, H. sapiens
tgggccactgcactca

SEQ ID NO: 152038 - DNA, 16 bp, H. sapiens
tgggccagactggtct

SEQ ID NO: 152039 - DNA, 16 bp, H. sapiens
tgggccagatttggcc

SEQ ID NO: 152040 - DNA, 16 bp, H. sapiens
tgggccagcactgctg

SEQ ID NO: 152041 - DNA, 16 bp, H. sapiens
tgggccagcagcagca

SEQ ID NO: 152042 - DNA, 16 bp, H. sapiens
tgggccagcagctgca

SEQ ID NO: 152043 - DNA, 16 bp, H. sapiens
tgggccagcaggctgg

SEQ ID NO: 152044 - DNA, 16 bp, H. sapiens
tgggccaggcagggtg

SEQ ID NO: 152045 - DNA, 16 bp, H. sapiens
tgggccaggcatgatg

SEQ ID NO: 152046 - DNA, 16 bp, H. sapiens
tgggccaggcccaggc

SEQ ID NO: 152047 - DNA, 16 bp, H. sapiens
tgggccaggcccaggg

SEQ ID NO: 152048 - DNA, 16 bp, H. sapiens
tgggccaggctagtct

SEQ ID NO: 152049 - DNA, 16 bp, H. sapiens
tgggccaggctcaggg

SEQ ID NO: 152050 - DNA, 16 bp, H. sapiens
tgggccaggctctgtg

SEQ ID NO: 152051 - DNA, 16 bp, H. sapiens
tgggccaggctggtct

SEQ ID NO: 152052 - DNA, 16 bp, H. sapiens
tgggccaggtccaggg

SEQ ID NO: 152053 - DNA, 17 bp, H. sapiens
tgggccagtgcctgacc

SEQ ID NO: 152054 - DNA, 16 bp, H. sapiens
tgggccatggtgccca

SEQ ID NO: 152055 - DNA, 16 bp, H. sapiens
tgggcccaggagctgg

SEQ ID NO: 152056 - DNA, 16 bp, H. sapiens
tgggcccaggaggtgg

SEQ ID NO: 152057 - DNA, 16 bp, H. sapiens
tgggcccaggagttcg

SEQ ID NO: 152058 - DNA, 16 bp, H. sapiens
tgggcccagggtcccc

SEQ ID NO: 152059 - DNA, 16 bp, H. sapiens
tgggccccaccccaga

SEQ ID NO: 152060 - DNA, 16 bp, H. sapiens
tgggccccacctcaga

SEQ ID NO: 152061 - DNA, 16 bp, H. sapiens
tgggccccacctccca

SEQ ID NO: 152062 - DNA, 16 bp, H. sapiens
tgggccctcagtggat

SEQ ID NO: 152063 - DNA, 16 bp, H. sapiens
tgggccctgctctcag

SEQ ID NO: 152064 - DNA, 16 bp, H. sapiens
tgggccctgggccctg

SEQ ID NO: 152065 - DNA, 16 bp, H. sapiens
tgggccctgggctctg

SEQ ID NO: 152066 - DNA, 16 bp, H. sapiens
tgggccctggtgggag

SEQ ID NO: 152067 - DNA, 16 bp, H. sapiens
tgggccgggcctggtg

SEQ ID NO: 152068 - DNA, 16 bp, H. sapiens
tgggcctcaatttccc

SEQ ID NO: 152069 - DNA, 16 bp, H. sapiens
tgggcctcacaaagtg

SEQ ID NO: 152070 - DNA, 16 bp, H. sapiens
tgggcctcaccccaga

SEQ ID NO: 152071 - DNA, 16 bp, H. sapiens
tgggcctcagcttccc

SEQ ID NO: 152072 - DNA, 16 bp, H. sapiens
tgggcctcagcttcct

SEQ ID NO: 152073 - DNA, 16 bp, H. sapiens
tgggcctcagtgtccc

SEQ ID NO: 152074 - DNA, 16 bp, H. sapiens
tgggcctcagtgtcct

SEQ ID NO: 152075 - DNA, 16 bp, H. sapiens
tgggcctcagtttcct

SEQ ID NO: 152076 - DNA, 16 bp, H. sapiens
tgggcctcagtttctc

SEQ ID NO: 152077 - DNA, 16 bp, H. sapiens
tgggcctccaggcctg

SEQ ID NO: 152078 - DNA, 16 bp, H. sapiens
tgggcctccctttgtg

SEQ ID NO: 152079 - DNA, 16 bp, H. sapiens
tgggcctgaagaggcc

SEQ ID NO: 152080 - DNA, 16 bp, H. sapiens
tgggcctgcaggtgtg

SEQ ID NO: 152081 - DNA, 16 bp, H. sapiens
tgggcctgcctctccc

SEQ ID NO: 152082 - DNA, 16 bp, H. sapiens
tgggcctgcctttccc

SEQ ID NO: 152083 - DNA, 16 bp, H. sapiens
tgggcctgggaggtgg

SEQ ID NO: 152084 - DNA, 16 bp, H. sapiens
tgggcctggggcctgg

SEQ ID NO: 152085 - DNA, 16 bp, H. sapiens
tgggcctgggggacca

SEQ ID NO: 152086 - DNA, 16 bp, H. sapiens
tgggcctggtgcagtg

SEQ ID NO: 152087 - DNA, 16 bp, H. sapiens
tgggcctggtggtaca

SEQ ID NO: 152088 - DNA, 17 bp, H. sapiens
tgggcctgtaatcccag

SEQ ID NO: 152089 - DNA, 16 bp, H. sapiens
tgggcctgtggtccca

SEQ ID NO: 152090 - DNA, 16 bp, H. sapiens
tgggccttgaaggatg

SEQ ID NO: 152091 - DNA, 17 bp, H. sapiens
tgggcgacacagccaga

SEQ ID NO: 152092 - DNA, 16 bp, H. sapiens
tgggcgacagaggcag

SEQ ID NO: 152093 - DNA, 16 bp, H. sapiens
tgggcgacagcgtgag

SEQ ID NO: 152094 - DNA, 16 bp, H. sapiens
tgggcgacatggcaaa

SEQ ID NO: 152095 - DNA, 16 bp, H. sapiens
tgggcgaggtgactca

SEQ ID NO: 152096 - DNA, 16 bp, H. sapiens
tgggcgccatggctca

SEQ ID NO: 152097 - DNA, 16 bp, H. sapiens
tgggcgcggtagctca

SEQ ID NO: 152098 - DNA, 16 bp, H. sapiens
tgggcggagtggctca

SEQ ID NO: 152099 - DNA, 18 bp, H. sapiens
tgggcggatcacgaggtc

SEQ ID NO: 152100 - DNA, 16 bp, H. sapiens
tgggcgtaggaccctc

SEQ ID NO: 152101 - DNA, 18 bp, H. sapiens
tgggcgtagtggctcaca

SEQ ID NO: 152102 - DNA, 16 bp, H. sapiens
tgggcgtgatggctca

SEQ ID NO: 152103 - DNA, 16 bp, H. sapiens
tgggcgtggcggcaca

SEQ ID NO: 152104 - DNA, 21 bp, H. sapiens
tgggcgtggtggcaggtgcct

SEQ ID NO: 152105 - DNA, 16 bp, H. sapiens
tgggcgtggtggccca

SEQ ID NO: 152106 - DNA, 17 bp, H. sapiens
tgggctaaatgctccca

SEQ ID NO: 152107 - DNA, 17 bp, H. sapiens
tgggctacagagtgaga

SEQ ID NO: 152108 - DNA, 16 bp, H. sapiens
tgggctaggcccaggg

SEQ ID NO: 152109 - DNA, 16 bp, H. sapiens
tgggctcaaactcctg

SEQ ID NO: 152110 - DNA, 16 bp, H. sapiens
tgggctcaagagttcc

SEQ ID NO: 152111 - DNA, 16 bp, H. sapiens
tgggctcaagcgatcc

SEQ ID NO: 152112 - DNA, 16 bp, H. sapiens
tgggctcaagctttcc

SEQ ID NO: 152113 - DNA, 16 bp, H. sapiens
tgggctcagaaatgtc

SEQ ID NO: 152114 - DNA, 16 bp, H. sapiens
tgggctcagaggcctg

SEQ ID NO: 152115 - DNA, 16 bp, H. sapiens
tgggctcagatgatct

SEQ ID NO: 152116 - DNA, 16 bp, H. sapiens
tgggctcagctgcagc

SEQ ID NO: 152117 - DNA, 16 bp, H. sapiens
tgggctcaggtgactc

SEQ ID NO: 152118 - DNA, 18 bp, H. sapiens
tgggctcaggtgatcctc

SEQ ID NO: 152119 - DNA, 16 bp, H. sapiens
tgggctcagtgactca

SEQ ID NO: 152120 - DNA, 16 bp, H. sapiens
tgggctccaacaatcc

SEQ ID NO: 152121 - DNA, 16 bp, H. sapiens
tgggctccagcaattc

SEQ ID NO: 152122 - DNA, 16 bp, H. sapiens
tgggctcctctcccac

SEQ ID NO: 152123 - DNA, 16 bp, H. sapiens
tgggctcctgagtcag

SEQ ID NO: 152124 - DNA, 16 bp, H. sapiens
tgggctcctgtgcggc

SEQ ID NO: 152125 - DNA, 16 bp, H. sapiens
tgggctctccaaggcc

SEQ ID NO: 152126 - DNA, 16 bp, H. sapiens
tgggctctgccctcat

SEQ ID NO: 152127 - DNA, 16 bp, H. sapiens
tgggctctggacccag

SEQ ID NO: 152128 - DNA, 16 bp, H. sapiens
tgggctctggagccag

SEQ ID NO: 152129 - DNA, 16 bp, H. sapiens
tgggctctgggctggt

SEQ ID NO: 152130 - DNA, 16 bp, H. sapiens
tgggctctggggccag

SEQ ID NO: 152131 - DNA, 16 bp, H. sapiens
tgggctctgttggggt

SEQ ID NO: 152132 - DNA, 16 bp, H. sapiens
tgggctgaaatgatcc

SEQ ID NO: 152133 - DNA, 16 bp, H. sapiens
tgggctgagatggctg

SEQ ID NO: 152134 - DNA, 16 bp, H. sapiens
tgggctgagatggtgg

SEQ ID NO: 152135 - DNA, 16 bp, H. sapiens
tgggctgagctgggct

SEQ ID NO: 152136 - DNA, 16 bp, H. sapiens
tgggctgaggacatga

SEQ ID NO: 152137 - DNA, 16 bp, H. sapiens
tgggctgattccatgt

SEQ ID NO: 152138 - DNA, 16 bp, H. sapiens
tgggctgcacaggagc

SEQ ID NO: 152139 - DNA, 18 bp, H. sapiens
tgggctgcacccactgtc

SEQ ID NO: 152140 - DNA, 16 bp, H. sapiens
tgggctgcactcactg

SEQ ID NO: 152141 - DNA, 16 bp, H. sapiens
tgggctgcaggtcctg

SEQ ID NO: 152142 - DNA, 16 bp, H. sapiens
tgggctgcaggtggag

SEQ ID NO: 152143 - DNA, 16 bp, H. sapiens
tgggctgcatccccag

SEQ ID NO: 152144 - DNA, 16 bp, H. sapiens
tgggctgcatgcagcc

SEQ ID NO: 152145 - DNA, 16 bp, H. sapiens
tgggctgcatgggagc

SEQ ID NO: 152146 - DNA, 16 bp, H. sapiens
tgggctgcattcccag

SEQ ID NO: 152147 - DNA, 16 bp, H. sapiens
tgggctgctggagtgc

SEQ ID NO: 152148 - DNA, 16 bp, H. sapiens
tgggctgctggccaga

SEQ ID NO: 152149 - DNA, 16 bp, H. sapiens
tgggctggaacctgac

SEQ ID NO: 152150 - DNA, 16 bp, H. sapiens
tgggctggagttcagt

SEQ ID NO: 152151 - DNA, 16 bp, H. sapiens
tgggctggcccccgtg

SEQ ID NO: 152152 - DNA, 16 bp, H. sapiens
tgggctggctcagccc

SEQ ID NO: 152153 - DNA, 16 bp, H. sapiens
tgggctggctgaggcc

SEQ ID NO: 152154 - DNA, 16 bp, H. sapiens
tgggctgggagggcag

SEQ ID NO: 152155 - DNA, 16 bp, H. sapiens
tgggctgggatgggat

SEQ ID NO: 152156 - DNA, 16 bp, H. sapiens
tgggctgggcacagtg

SEQ ID NO: 152157 - DNA, 16 bp, H. sapiens
tgggctgggccaggcc

SEQ ID NO: 152158 - DNA, 16 bp, H. sapiens
tgggctgggcccaggg

SEQ ID NO: 152159 - DNA, 16 bp, H. sapiens
tgggctgggctgggcc

SEQ ID NO: 152160 - DNA, 16 bp, H. sapiens
tgggctgggcttggct

SEQ ID NO: 152161 - DNA, 16 bp, H. sapiens
tgggctgggtccaggg

SEQ ID NO: 152162 - DNA, 16 bp, H. sapiens
tgggctgggtgccgtg

SEQ ID NO: 152163 - DNA, 16 bp, H. sapiens
tgggctgggtttttta

SEQ ID NO: 152164 - DNA, 16 bp, H. sapiens
tgggctggtctccaac

SEQ ID NO: 152165 - DNA, 16 bp, H. sapiens
tgggctgtgcccagca

SEQ ID NO: 152166 - DNA, 16 bp, H. sapiens
tgggcttaagtgatcc

SEQ ID NO: 152167 - DNA, 16 bp, H. sapiens
tgggcttcatccatgg

SEQ ID NO: 152168 - DNA, 16 bp, H. sapiens
tgggcttccagcctcc

SEQ ID NO: 152169 - DNA, 16 bp, H. sapiens
tgggcttccccaaagc

SEQ ID NO: 152170 - DNA, 16 bp, H. sapiens
tgggcttctagtgtac

SEQ ID NO: 152171 - DNA, 16 bp, H. sapiens
tgggcttctcacagca

SEQ ID NO: 152172 - DNA, 16 bp, H. sapiens
tgggcttctgggtctg

SEQ ID NO: 152173 - DNA, 16 bp, H. sapiens
tgggcttgcctttgtg

SEQ ID NO: 152174 - DNA, 16 bp, H. sapiens
tgggcttgctgggtca

SEQ ID NO: 152175 - DNA, 16 bp, H. sapiens
tgggcttggagccccc

SEQ ID NO: 152176 - DNA, 16 bp, H. sapiens
tgggcttggcgggccc

SEQ ID NO: 152177 - DNA, 16 bp, H. sapiens
tgggctttggagatga

SEQ ID NO: 152178 - DNA, 16 bp, H. sapiens
tgggctttggagtcag

SEQ ID NO: 152179 - DNA, 16 bp, H. sapiens
tgggcttttagtgcta

SEQ ID NO: 152180 - DNA, 16 bp, H. sapiens
tggggaaaaaaaatca

SEQ ID NO: 152181 - DNA, 16 bp, H. sapiens
tggggaaaaacagaat

SEQ ID NO: 152182 - DNA, 16 bp, H. sapiens
tggggaaaaacagagc

SEQ ID NO: 152183 - DNA, 16 bp, H. sapiens
tggggaaaaataaaat

SEQ ID NO: 152184 - DNA, 16 bp, H. sapiens
tggggaaaaatatttg

SEQ ID NO: 152185 - DNA, 16 bp, H. sapiens
tggggaaaagacttcc

SEQ ID NO: 152186 - DNA, 16 bp, H. sapiens
tggggaaaagattctc

SEQ ID NO: 152187 - DNA, 16 bp, H. sapiens
tggggaaaagggaaat

SEQ ID NO: 152188 - DNA, 16 bp, H. sapiens
tggggaaaccaaggca

SEQ ID NO: 152189 - DNA, 16 bp, H. sapiens
tggggaaaccaaggcc

SEQ ID NO: 152190 - DNA, 16 bp, H. sapiens
tggggaaaccgaggca

SEQ ID NO: 152191 - DNA, 16 bp, H. sapiens
tggggaaaccgaggcc

SEQ ID NO: 152192 - DNA, 16 bp, H. sapiens
tggggaaactaaggca

SEQ ID NO: 152193 - DNA, 16 bp, H. sapiens
tggggaaactgaggcc

SEQ ID NO: 152194 - DNA, 16 bp, H. sapiens
tggggaaactgaggct

SEQ ID NO: 152195 - DNA, 16 bp, H. sapiens
tggggaaactgagtcc

SEQ ID NO: 152196 - DNA, 16 bp, H. sapiens
tggggaaagaattcct

SEQ ID NO: 152197 - DNA, 16 bp, H. sapiens
tggggaaaggaatccc

SEQ ID NO: 152198 - DNA, 16 bp, H. sapiens
tggggaaaggacagtt

SEQ ID NO: 152199 - DNA, 16 bp, H. sapiens
tggggaaaggatctcc

SEQ ID NO: 152200 - DNA, 16 bp, H. sapiens
tggggaaatcctgtct

SEQ ID NO: 152201 - DNA, 16 bp, H. sapiens
tggggaaatgttgaaa

SEQ ID NO: 152202 - DNA, 16 bp, H. sapiens
tggggaacagagagag

SEQ ID NO: 152203 - DNA, 16 bp, H. sapiens
tggggaacctgaaggt

SEQ ID NO: 152204 - DNA, 16 bp, H. sapiens
tggggaagaaaaacaa

SEQ ID NO: 152205 - DNA, 16 bp, H. sapiens
tggggaagaaacaaag

SEQ ID NO: 152206 - DNA, 16 bp, H. sapiens
tggggaagaaacagag

SEQ ID NO: 152207 - DNA, 16 bp, H. sapiens
tggggaagaatctgct

SEQ ID NO: 152208 - DNA, 16 bp, H. sapiens
tggggaagacagacaa

SEQ ID NO: 152209 - DNA, 16 bp, H. sapiens
tggggaagaggggcag

SEQ ID NO: 152210 - DNA, 16 bp, H. sapiens
tggggaagctgaagca

SEQ ID NO: 152211 - DNA, 16 bp, H. sapiens
tggggaagcttcagga

SEQ ID NO: 152212 - DNA, 16 bp, H. sapiens
tggggaaggaacaaag

SEQ ID NO: 152213 - DNA, 16 bp, H. sapiens
tggggaagggcaggaa

SEQ ID NO: 152214 - DNA, 16 bp, H. sapiens
tggggaaggggcctgg

SEQ ID NO: 152215 - DNA, 16 bp, H. sapiens
tggggaaggggctgtg

SEQ ID NO: 152216 - DNA, 16 bp, H. sapiens
tggggaaggggtggct

SEQ ID NO: 152217 - DNA, 16 bp, H. sapiens
tggggaagtcaaaagt

SEQ ID NO: 152218 - DNA, 16 bp, H. sapiens
tggggaagtgagacag

SEQ ID NO: 152219 - DNA, 30 bp, H. sapiens
tggggaagtgataagtgtccatgaaatctt

SEQ ID NO: 152220 - DNA, 16 bp, H. sapiens
tggggaagttgtcctg

SEQ ID NO: 152221 - DNA, 17 bp, H. sapiens
tggggaagttttcagat

SEQ ID NO: 152222 - DNA, 16 bp, H. sapiens
tggggaatttctcctg

SEQ ID NO: 152223 - DNA, 16 bp, H. sapiens
tggggaatttggaaat

SEQ ID NO: 152224 - DNA, 16 bp, H. sapiens
tggggacacacatcca

SEQ ID NO: 152225 - DNA, 16 bp, H. sapiens
tggggacacagagcaa

SEQ ID NO: 152226 - DNA, 16 bp, H. sapiens
tggggacacagagcca

SEQ ID NO: 152227 - DNA, 16 bp, H. sapiens
tggggacacagaggca

SEQ ID NO: 152228 - DNA, 16 bp, H. sapiens
tggggacacagaggtg

SEQ ID NO: 152229 - DNA, 16 bp, H. sapiens
tggggacacagcagtg

SEQ ID NO: 152230 - DNA, 16 bp, H. sapiens
tggggacacagccaag

SEQ ID NO: 152231 - DNA, 16 bp, H. sapiens
tggggacacagtggtg

SEQ ID NO: 152232 - DNA, 17 bp, H. sapiens
tggggacagatcaagaa

SEQ ID NO: 152233 - DNA, 16 bp, H. sapiens
tggggacagatccctc

SEQ ID NO: 152234 - DNA, 16 bp, H. sapiens
tggggacagggcaggg

SEQ ID NO: 152235 - DNA, 16 bp, H. sapiens
tggggacagggctggg

SEQ ID NO: 152236 - DNA, 16 bp, H. sapiens
tggggacataaagcct

SEQ ID NO: 152237 - DNA, 16 bp, H. sapiens
tggggacatggagaac

SEQ ID NO: 152238 - DNA, 16 bp, H. sapiens
tggggacatgtgggag

SEQ ID NO: 152239 - DNA, 16 bp, H. sapiens
tggggaccacaggcat

SEQ ID NO: 152240 - DNA, 16 bp, H. sapiens
tggggaccactgccct

SEQ ID NO: 152241 - DNA, 17 bp, H. sapiens
tggggaccactgctcta

SEQ ID NO: 152242 - DNA, 16 bp, H. sapiens
tggggacccctgctct

SEQ ID NO: 152243 - DNA, 16 bp, H. sapiens
tggggacccctgcttt

SEQ ID NO: 152244 - DNA, 16 bp, H. sapiens
tggggacccctggctt

SEQ ID NO: 152245 - DNA, 16 bp, H. sapiens
tggggaccctgggcct

SEQ ID NO: 152246 - DNA, 16 bp, H. sapiens
tggggacctgggggag

SEQ ID NO: 152247 - DNA, 20 bp, H. sapiens
tggggacgtggagaaccttt

SEQ ID NO: 152248 - DNA, 16 bp, H. sapiens
tggggactacaggtgc

SEQ ID NO: 152249 - DNA, 16 bp, H. sapiens
tggggactctgtgggg

SEQ ID NO: 152250 - DNA, 16 bp, H. sapiens
tggggactctgtgtgg

SEQ ID NO: 152251 - DNA, 16 bp, H. sapiens
tggggactgctgctct

SEQ ID NO: 152252 - DNA, 16 bp, H. sapiens
tggggactgttgttgg

SEQ ID NO: 152253 - DNA, 17 bp, H. sapiens
tggggacttggggggaa

SEQ ID NO: 152254 - DNA, 16 bp, H. sapiens
tggggactttgggagg

SEQ ID NO: 152255 - DNA, 16 bp, H. sapiens
tggggagaaaacagag

SEQ ID NO: 152256 - DNA, 16 bp, H. sapiens
tggggagaaaccagaa

SEQ ID NO: 152257 - DNA, 16 bp, H. sapiens
tggggagaaaccaggg

SEQ ID NO: 152258 - DNA, 16 bp, H. sapiens
tggggagaaagtcaag

SEQ ID NO: 152259 - DNA, 16 bp, H. sapiens
tggggagaaatcagag

SEQ ID NO: 152260 - DNA, 16 bp, H. sapiens
tggggagaatggaact

SEQ ID NO: 152261 - DNA, 16 bp, H. sapiens
tggggagacagaggtt

SEQ ID NO: 152262 - DNA, 16 bp, H. sapiens
tggggagacaggcagg

SEQ ID NO: 152263 - DNA, 16 bp, H. sapiens
tggggagagacagaga

SEQ ID NO: 152264 - DNA, 16 bp, H. sapiens
tggggagagagggcat

SEQ ID NO: 152265 - DNA, 16 bp, H. sapiens
tggggagaggagcagg

SEQ ID NO: 152266 - DNA, 16 bp, H. sapiens
tggggagaggcagagg

SEQ ID NO: 152267 - DNA, 16 bp, H. sapiens
tggggagaggccaggc

SEQ ID NO: 152268 - DNA, 16 bp, H. sapiens
tggggagaggctgggc

SEQ ID NO: 152269 - DNA, 16 bp, H. sapiens
tggggagatgatcctg

SEQ ID NO: 152270 - DNA, 16 bp, H. sapiens
tggggagcaggaggcc

SEQ ID NO: 152271 - DNA, 16 bp, H. sapiens
tggggagccacagaag

SEQ ID NO: 152272 - DNA, 16 bp, H. sapiens
tggggagcctcagaaa

SEQ ID NO: 152273 - DNA, 16 bp, H. sapiens
tggggagctctggagc

SEQ ID NO: 152274 - DNA, 16 bp, H. sapiens
tggggagctgggctgg

SEQ ID NO: 152275 - DNA, 16 bp, H. sapiens
tggggagctttttaaa

SEQ ID NO: 152276 - DNA, 16 bp, H. sapiens
tggggaggccccagga

SEQ ID NO: 152277 - DNA, 16 bp, H. sapiens
tggggaggcctgaggg

SEQ ID NO: 152278 - DNA, 16 bp, H. sapiens
tggggaggctgagaca

SEQ ID NO: 152279 - DNA, 16 bp, H. sapiens
tggggaggctgaggcc

SEQ ID NO: 152280 - DNA, 16 bp, H. sapiens
tggggaggctgcagca

SEQ ID NO: 152281 - DNA, 16 bp, H. sapiens
tggggaggctgcagtg

SEQ ID NO: 152282 - DNA, 16 bp, H. sapiens
tggggaggggaacatc

SEQ ID NO: 152283 - DNA, 16 bp, H. sapiens
tggggaggggcagcag

SEQ ID NO: 152284 - DNA, 16 bp, H. sapiens
tggggagggggcttcc

SEQ ID NO: 152285 - DNA, 16 bp, H. sapiens
tggggagggtgaggca

SEQ ID NO: 152286 - DNA, 16 bp, H. sapiens
tggggagttttaaaaa

SEQ ID NO: 152287 - DNA, 16 bp, H. sapiens
tggggagtttttaaaa

SEQ ID NO: 152288 - DNA, 16 bp, H. sapiens
tggggataataataat

SEQ ID NO: 152289 - DNA, 16 bp, H. sapiens
tggggatacagagcca

SEQ ID NO: 152290 - DNA, 16 bp, H. sapiens
tggggatattcagttt

SEQ ID NO: 152291 - DNA, 16 bp, H. sapiens
tggggatccaatttca

SEQ ID NO: 152292 - DNA, 16 bp, H. sapiens
tggggatgcagcagtg

SEQ ID NO: 152293 - DNA, 16 bp, H. sapiens
tggggatgggacccaa

SEQ ID NO: 152294 - DNA, 16 bp, H. sapiens
tggggatggggcccag

SEQ ID NO: 152295 - DNA, 16 bp, H. sapiens
tggggatgtggagaaa

SEQ ID NO: 152296 - DNA, 16 bp, H. sapiens
tggggatgtggagaac

SEQ ID NO: 152297 - DNA, 16 bp, H. sapiens
tggggattaaatgaga

SEQ ID NO: 152298 - DNA, 16 bp, H. sapiens
tggggattacagtttg

SEQ ID NO: 152299 - DNA, 16 bp, H. sapiens
tggggattaccattca

SEQ ID NO: 152300 - DNA, 16 bp, H. sapiens
tggggattagaatgtg

SEQ ID NO: 152301 - DNA, 16 bp, H. sapiens
tggggattagatttca

SEQ ID NO: 152302 - DNA, 16 bp, H. sapiens
tggggattcctcaggg

SEQ ID NO: 152303 - DNA, 16 bp, H. sapiens
tggggatttctcccca

SEQ ID NO: 152304 - DNA, 16 bp, H. sapiens
tggggcaacacagtga

SEQ ID NO: 152305 - DNA, 16 bp, H. sapiens
tggggcaaggtctgag

SEQ ID NO: 152306 - DNA, 16 bp, H. sapiens
tggggcagccctgctc

SEQ ID NO: 152307 - DNA, 16 bp, H. sapiens
tggggcagcggggcag

SEQ ID NO: 152308 - DNA, 16 bp, H. sapiens
tggggcaggaggactg

SEQ ID NO: 152309 - DNA, 16 bp, H. sapiens
tggggcaggaggagag

SEQ ID NO: 152310 - DNA, 16 bp, H. sapiens
tggggcaggcctggtg

SEQ ID NO: 152311 - DNA, 16 bp, H. sapiens
tggggcagggcaggaa

SEQ ID NO: 152312 - DNA, 16 bp, H. sapiens
tggggcagggcctgag

SEQ ID NO: 152313 - DNA, 16 bp, H. sapiens
tggggcagggcctggg

SEQ ID NO: 152314 - DNA, 16 bp, H. sapiens
tggggcagggcttggg

SEQ ID NO: 152315 - DNA, 16 bp, H. sapiens
tggggcaggggagccc

SEQ ID NO: 152316 - DNA, 16 bp, H. sapiens
tggggcagttggagga

SEQ ID NO: 152317 - DNA, 16 bp, H. sapiens
tggggccaagcccagg

SEQ ID NO: 152318 - DNA, 16 bp, H. sapiens
tggggccagagcccag

SEQ ID NO: 152319 - DNA, 16 bp, H. sapiens
tggggccaggagtttg

SEQ ID NO: 152320 - DNA, 17 bp, H. sapiens
tggggccaggcacagtg

SEQ ID NO: 152321 - DNA, 16 bp, H. sapiens
tggggccaggtgcggt

SEQ ID NO: 152322 - DNA, 16 bp, H. sapiens
tggggccaggtgggag

SEQ ID NO: 152323 - DNA, 16 bp, H. sapiens
tggggccctggctgag

SEQ ID NO: 152324 - DNA, 16 bp, H. sapiens
tggggcctaatgagag

SEQ ID NO: 152325 - DNA, 16 bp, H. sapiens
tggggcctcagtttcc

SEQ ID NO: 152326 - DNA, 16 bp, H. sapiens
tggggcctccagccac

SEQ ID NO: 152327 - DNA, 16 bp, H. sapiens
tggggcctccccagcc

SEQ ID NO: 152328 - DNA, 16 bp, H. sapiens
tggggcctcctcagcc

SEQ ID NO: 152329 - DNA, 16 bp, H. sapiens
tggggcctctgttctg

SEQ ID NO: 152330 - DNA, 16 bp, H. sapiens
tggggcctgaggctgg

SEQ ID NO: 152331 - DNA, 16 bp, H. sapiens
tggggcctgaggttct

SEQ ID NO: 152332 - DNA, 16 bp, H. sapiens
tggggcctgatgggaa

SEQ ID NO: 152333 - DNA, 17 bp, H. sapiens
tggggcctggactcctg

SEQ ID NO: 152334 - DNA, 16 bp, H. sapiens
tggggcctggcgggag

SEQ ID NO: 152335 - DNA, 16 bp, H. sapiens
tggggcctggtgggag

SEQ ID NO: 152336 - DNA, 16 bp, H. sapiens
tggggcctgtcagagg

SEQ ID NO: 152337 - DNA, 16 bp, H. sapiens
tggggcctgtgggagg

SEQ ID NO: 152338 - DNA, 16 bp, H. sapiens
tggggccttgctctgt

SEQ ID NO: 152339 - DNA, 16 bp, H. sapiens
tggggcctttgccagg

SEQ ID NO: 152340 - DNA, 16 bp, H. sapiens
tggggcctttggaaga

SEQ ID NO: 152341 - DNA, 16 bp, H. sapiens
tggggcctttgggaag

SEQ ID NO: 152342 - DNA, 16 bp, H. sapiens
tggggcctttgggagg

SEQ ID NO: 152343 - DNA, 16 bp, H. sapiens
tggggcgatctctgct

SEQ ID NO: 152344 - DNA, 16 bp, H. sapiens
tggggcgtggtggctc

SEQ ID NO: 152345 - DNA, 16 bp, H. sapiens
tggggctcactgcaac

SEQ ID NO: 152346 - DNA, 16 bp, H. sapiens
tggggctcagcctggg

SEQ ID NO: 152347 - DNA, 16 bp, H. sapiens
tggggctcaggtgtgt

SEQ ID NO: 152348 - DNA, 16 bp, H. sapiens
tggggctccctgagga

SEQ ID NO: 152349 - DNA, 16 bp, H. sapiens
tggggctcctggacct

SEQ ID NO: 152350 - DNA, 16 bp, H. sapiens
tggggctctctctttg

SEQ ID NO: 152351 - DNA, 16 bp, H. sapiens
tggggctctgacccca

SEQ ID NO: 152352 - DNA, 16 bp, H. sapiens
tggggctgagacagtg

SEQ ID NO: 152353 - DNA, 16 bp, H. sapiens
tggggctgaggcaggt

SEQ ID NO: 152354 - DNA, 16 bp, H. sapiens
tggggctgcaggtgga

SEQ ID NO: 152355 - DNA, 16 bp, H. sapiens
tggggctgctgggagg

SEQ ID NO: 152356 - DNA, 16 bp, H. sapiens
tggggctggaggatcc

SEQ ID NO: 152357 - DNA, 16 bp, H. sapiens
tggggctggaggccat

SEQ ID NO: 152358 - DNA, 16 bp, H. sapiens
tggggctggcccagga

SEQ ID NO: 152359 - DNA, 16 bp, H. sapiens
tggggctggccctggg

SEQ ID NO: 152360 - DNA, 16 bp, H. sapiens
tggggctgggactctg

SEQ ID NO: 152361 - DNA, 16 bp, H. sapiens
tggggctgggagcagt

SEQ ID NO: 152362 - DNA, 16 bp, H. sapiens
tggggctgggcactgt

SEQ ID NO: 152363 - DNA, 16 bp, H. sapiens
tggggctgggccctgg

SEQ ID NO: 152364 - DNA, 16 bp, H. sapiens
tggggctgggctggag

SEQ ID NO: 152365 - DNA, 16 bp, H. sapiens
tggggctggggcagag

SEQ ID NO: 152366 - DNA, 16 bp, H. sapiens
tggggctggggcagga

SEQ ID NO: 152367 - DNA, 16 bp, H. sapiens
tggggctggggctgag

SEQ ID NO: 152368 - DNA, 16 bp, H. sapiens
tggggctggggctgct

SEQ ID NO: 152369 - DNA, 16 bp, H. sapiens
tggggctgggggccag

SEQ ID NO: 152370 - DNA, 16 bp, H. sapiens
tggggctgtcctgggc

SEQ ID NO: 152371 - DNA, 16 bp, H. sapiens
tggggcttcaggagct

SEQ ID NO: 152372 - DNA, 16 bp, H. sapiens
tggggcttttgggagg

SEQ ID NO: 152373 - DNA, 16 bp, H. sapiens
tgggggaaaaaaaagt

SEQ ID NO: 152374 - DNA, 16 bp, H. sapiens
tgggggaaaaaaaatc

SEQ ID NO: 152375 - DNA, 16 bp, H. sapiens
tgggggaaaaaaacag

SEQ ID NO: 152376 - DNA, 16 bp, H. sapiens
tgggggaaaccacccc

SEQ ID NO: 152377 - DNA, 16 bp, H. sapiens
tgggggaaatttgcat

SEQ ID NO: 152378 - DNA, 16 bp, H. sapiens
tgggggaagccagtga

SEQ ID NO: 152379 - DNA, 16 bp, H. sapiens
tgggggaaggagagct

SEQ ID NO: 152380 - DNA, 16 bp, H. sapiens
tgggggaaggcaggag

SEQ ID NO: 152381 - DNA, 16 bp, H. sapiens
tgggggaagggcacag

SEQ ID NO: 152382 - DNA, 16 bp, H. sapiens
tgggggacagagagag

SEQ ID NO: 152383 - DNA, 16 bp, H. sapiens
tgggggacagagccag

SEQ ID NO: 152384 - DNA, 16 bp, H. sapiens
tgggggacagaggcag

SEQ ID NO: 152385 - DNA, 16 bp, H. sapiens
tgggggacagggcaag

SEQ ID NO: 152386 - DNA, 16 bp, H. sapiens
tgggggacccagtgca

SEQ ID NO: 152387 - DNA, 16 bp, H. sapiens
tgggggacccggcgca

SEQ ID NO: 152388 - DNA, 16 bp, H. sapiens
tgggggacttagcacc

SEQ ID NO: 152389 - DNA, 16 bp, H. sapiens
tgggggacttcaatat

SEQ ID NO: 152390 - DNA, 16 bp, H. sapiens
tgggggagaaaacaca

SEQ ID NO: 152391 - DNA, 16 bp, H. sapiens
tgggggagacagacaa

SEQ ID NO: 152392 - DNA, 16 bp, H. sapiens
tgggggagccagaagg

SEQ ID NO: 152393 - DNA, 16 bp, H. sapiens
tgggggagcttttgag

SEQ ID NO: 152394 - DNA, 16 bp, H. sapiens
tgggggaggcctcagg

SEQ ID NO: 152395 - DNA, 16 bp, H. sapiens
tgggggaggctgtgca

SEQ ID NO: 152396 - DNA, 16 bp, H. sapiens
tgggggagggaaagca

SEQ ID NO: 152397 - DNA, 16 bp, H. sapiens
tgggggagggacagga

SEQ ID NO: 152398 - DNA, 16 bp, H. sapiens
tgggggagttctcctg

SEQ ID NO: 152399 - DNA, 16 bp, H. sapiens
tgggggatggatggat

SEQ ID NO: 152400 - DNA, 16 bp, H. sapiens
tgggggattggttcca

SEQ ID NO: 152401 - DNA, 16 bp, H. sapiens
tgggggcagggagaag

SEQ ID NO: 152402 - DNA, 16 bp, H. sapiens
tgggggcagggagcag

SEQ ID NO: 152403 - DNA, 16 bp, H. sapiens
tgggggcagggcattg

SEQ ID NO: 152404 - DNA, 16 bp, H. sapiens
tgggggcaggtccctc

SEQ ID NO: 152405 - DNA, 16 bp, H. sapiens
tgggggcagtgggcag

SEQ ID NO: 152406 - DNA, 16 bp, H. sapiens
tgggggcatggcaggc

SEQ ID NO: 152407 - DNA, 16 bp, H. sapiens
tgggggcatggtggga

SEQ ID NO: 152408 - DNA, 16 bp, H. sapiens
tgggggcatgtctctt

SEQ ID NO: 152409 - DNA, 16 bp, H. sapiens
tgggggccacaggacc

SEQ ID NO: 152410 - DNA, 16 bp, H. sapiens
tgggggccatttcccc

SEQ ID NO: 152411 - DNA, 16 bp, H. sapiens
tgggggccgggcatgg

SEQ ID NO: 152412 - DNA, 16 bp, H. sapiens
tgggggcctgggaagg

SEQ ID NO: 152413 - DNA, 16 bp, H. sapiens
tgggggcgctgcagga

SEQ ID NO: 152414 - DNA, 16 bp, H. sapiens
tgggggctatccctga

SEQ ID NO: 152415 - DNA, 16 bp, H. sapiens
tgggggctcacacctg

SEQ ID NO: 152416 - DNA, 16 bp, H. sapiens
tgggggctcatgcctg

SEQ ID NO: 152417 - DNA, 16 bp, H. sapiens
tgggggctccacccca

SEQ ID NO: 152418 - DNA, 16 bp, H. sapiens
tgggggctcccctgcc

SEQ ID NO: 152419 - DNA, 16 bp, H. sapiens
tgggggctgccctggg

SEQ ID NO: 152420 - DNA, 16 bp, H. sapiens
tgggggctgtcctggg

SEQ ID NO: 152421 - DNA, 16 bp, H. sapiens
tgggggctgtctgtga

SEQ ID NO: 152422 - DNA, 16 bp, H. sapiens
tgggggctgttctgtg

SEQ ID NO: 152423 - DNA, 16 bp, H. sapiens
tggggggaaaccttgg

SEQ ID NO: 152424 - DNA, 16 bp, H. sapiens
tggggggacacaaaca

SEQ ID NO: 152425 - DNA, 16 bp, H. sapiens
tggggggacagtggtg

SEQ ID NO: 152426 - DNA, 16 bp, H. sapiens
tggggggcagccccca

SEQ ID NO: 152427 - DNA, 16 bp, H. sapiens
tggggggtgtctccca

SEQ ID NO: 152428 - DNA, 16 bp, H. sapiens
tggggggttgaggcag

SEQ ID NO: 152429 - DNA, 16 bp, H. sapiens
tgggggtacaggtggt

SEQ ID NO: 152430 - DNA, 16 bp, H. sapiens
tgggggtcctggaacc

SEQ ID NO: 152431 - DNA, 16 bp, H. sapiens
tgggggtctcagaaat

SEQ ID NO: 152432 - DNA, 16 bp, H. sapiens
tgggggtgaggcccag

SEQ ID NO: 152433 - DNA, 16 bp, H. sapiens
tgggggtgctactggc

SEQ ID NO: 152434 - DNA, 16 bp, H. sapiens
tgggggtggatttcct

SEQ ID NO: 152435 - DNA, 16 bp, H. sapiens
tgggggtggccatgtt

SEQ ID NO: 152436 - DNA, 16 bp, H. sapiens
tgggggtggggctcag

SEQ ID NO: 152437 - DNA, 16 bp, H. sapiens
tgggggtgggggacac

SEQ ID NO: 152438 - DNA, 16 bp, H. sapiens
tgggggttgaggcagg

SEQ ID NO: 152439 - DNA, 16 bp, H. sapiens
tgggggttggggaccc

SEQ ID NO: 152440 - DNA, 16 bp, H. sapiens
tgggggtttcaccata

SEQ ID NO: 152441 - DNA, 16 bp, H. sapiens
tgggggtttcaccatg

SEQ ID NO: 152442 - DNA, 16 bp, H. sapiens
tgggggtttcactatg

SEQ ID NO: 152443 - DNA, 16 bp, H. sapiens
tggggtacacgtgcag

SEQ ID NO: 152444 - DNA, 16 bp, H. sapiens
tggggtacctgtgcag

SEQ ID NO: 152445 - DNA, 16 bp, H. sapiens
tggggtcagagtcccc

SEQ ID NO: 152446 - DNA, 16 bp, H. sapiens
tggggtcagataaggg

SEQ ID NO: 152447 - DNA, 16 bp, H. sapiens
tggggtcaggagttcg

SEQ ID NO: 152448 - DNA, 16 bp, H. sapiens
tggggtcaggggtcag

SEQ ID NO: 152449 - DNA, 16 bp, H. sapiens
tggggtccggccactg

SEQ ID NO: 152450 - DNA, 16 bp, H. sapiens
tggggtctcactatgt

SEQ ID NO: 152451 - DNA, 16 bp, H. sapiens
tggggtctcactgtca

SEQ ID NO: 152452 - DNA, 16 bp, H. sapiens
tggggtctccccatgt

SEQ ID NO: 152453 - DNA, 16 bp, H. sapiens
tggggtctcgctctgt

SEQ ID NO: 152454 - DNA, 16 bp, H. sapiens
tggggtctggctgtgt

SEQ ID NO: 152455 - DNA, 16 bp, H. sapiens
tggggtcttgctctgt

SEQ ID NO: 152456 - DNA, 16 bp, H. sapiens
tggggtctttaggttt

SEQ ID NO: 152457 - DNA, 16 bp, H. sapiens
tggggtgactgtggca

SEQ ID NO: 152458 - DNA, 17 bp, H. sapiens
tggggtggagagttctg

SEQ ID NO: 152459 - DNA, 16 bp, H. sapiens
tggggtgggcctgaga

SEQ ID NO: 152460 - DNA, 16 bp, H. sapiens
tggggtgggcctggag

SEQ ID NO: 152461 - DNA, 16 bp, H. sapiens
tggggtgggctccagg

SEQ ID NO: 152462 - DNA, 16 bp, H. sapiens
tggggtggggcctgag

SEQ ID NO: 152463 - DNA, 16 bp, H. sapiens
tggggtggtaaagtct

SEQ ID NO: 152464 - DNA, 16 bp, H. sapiens
tggggttcagagagct

SEQ ID NO: 152465 - DNA, 16 bp, H. sapiens
tggggttccaatgcag

SEQ ID NO: 152466 - DNA, 16 bp, H. sapiens
tggggttgctgggtca

SEQ ID NO: 152467 - DNA, 17 bp, H. sapiens
tggggttgggactgagg

SEQ ID NO: 152468 - DNA, 16 bp, H. sapiens
tggggtttcaccatac

SEQ ID NO: 152469 - DNA, 17 bp, H. sapiens
tggggtttcaccatgtc

SEQ ID NO: 152470 - DNA, 19 bp, H. sapiens
tggggtttcaccatgttga

SEQ ID NO: 152471 - DNA, 19 bp, H. sapiens
tggggtttcaccattttgg

SEQ ID NO: 152472 - DNA, 22 bp, H. sapiens
tggggtttcactatgttgccca

SEQ ID NO: 152473 - DNA, 17 bp, H. sapiens
tggggtttcactgtgtt

SEQ ID NO: 152474 - DNA, 16 bp, H. sapiens
tggggtttcctcatgt

SEQ ID NO: 152475 - DNA, 16 bp, H. sapiens
tggggtttcgccatgc

SEQ ID NO: 152476 - DNA, 16 bp, H. sapiens
tggggtttctccacgt

SEQ ID NO: 152477 - DNA, 17 bp, H. sapiens
tggggtttctccttgtt

SEQ ID NO: 152478 - DNA, 16 bp, H. sapiens
tggggtttgggaacct

SEQ ID NO: 152479 - DNA, 16 bp, H. sapiens
tggggttttctagata

SEQ ID NO: 152480 - DNA, 16 bp, H. sapiens
tggggttttctatata

SEQ ID NO: 152481 - DNA, 16 bp, H. sapiens
tggggttttgcatgtt

SEQ ID NO: 152482 - DNA, 16 bp, H. sapiens
tggggttttgccaggg

SEQ ID NO: 152483 - DNA, 16 bp, H. sapiens
tggggttttgccctgt

SEQ ID NO: 152484 - DNA, 16 bp, H. sapiens
tgggtaaaggaaatgt

SEQ ID NO: 152485 - DNA, 17 bp, H. sapiens
tgggtaaataacaaaat

SEQ ID NO: 152486 - DNA, 16 bp, H. sapiens
tgggtaaatataccca

SEQ ID NO: 152487 - DNA, 16 bp, H. sapiens
tgggtaaatcagtggc

SEQ ID NO: 152488 - DNA, 16 bp, H. sapiens
tgggtaaatctctgtt

SEQ ID NO: 152489 - DNA, 16 bp, H. sapiens
tgggtaaattatttaa

SEQ ID NO: 152490 - DNA, 16 bp, H. sapiens
tgggtaagttatttaa

SEQ ID NO: 152491 - DNA, 17 bp, H. sapiens
tgggtaagttgaaattg

SEQ ID NO: 152492 - DNA, 16 bp, H. sapiens
tgggtaatttataaca

SEQ ID NO: 152493 - DNA, 16 bp, H. sapiens
tgggtaatttatacaa

SEQ ID NO: 152494 - DNA, 16 bp, H. sapiens
tgggtacaaaaataaa

SEQ ID NO: 152495 - DNA, 16 bp, H. sapiens
tgggtacagcccacag

SEQ ID NO: 152496 - DNA, 16 bp, H. sapiens
tgggtacttaataaat

SEQ ID NO: 152497 - DNA, 16 bp, H. sapiens
tgggtagaggccagga

SEQ ID NO: 152498 - DNA, 16 bp, H. sapiens
tgggtagctgaggcag

SEQ ID NO: 152499 - DNA, 16 bp, H. sapiens
tgggtagggtcttttg

SEQ ID NO: 152500 - DNA, 16 bp, H. sapiens
tgggtagtgagtgtgt

SEQ ID NO: 152501 - DNA, 17 bp, H. sapiens
tgggtatatactcagta

SEQ ID NO: 152502 - DNA, 16 bp, H. sapiens
tgggtatatagtcaaa

SEQ ID NO: 152503 - DNA, 16 bp, H. sapiens
tgggtatccttgtctt

SEQ ID NO: 152504 - DNA, 16 bp, H. sapiens
tgggtatgtgcccagt

SEQ ID NO: 152505 - DNA, 16 bp, H. sapiens
tgggtattataaataa

SEQ ID NO: 152506 - DNA, 17 bp, H. sapiens
tgggtattttattctct

SEQ ID NO: 152507 - DNA, 16 bp, H. sapiens
tgggtcaaactctgtt

SEQ ID NO: 152508 - DNA, 16 bp, H. sapiens
tgggtcaaagaggaag

SEQ ID NO: 152509 - DNA, 16 bp, H. sapiens
tgggtcaaggaagaaa

SEQ ID NO: 152510 - DNA, 16 bp, H. sapiens
tgggtcacatgcccac

SEQ ID NO: 152511 - DNA, 16 bp, H. sapiens
tgggtcacatgtccac

SEQ ID NO: 152512 - DNA, 18 bp, H. sapiens
tgggtcacgtgtccactg

SEQ ID NO: 152513 - DNA, 16 bp, H. sapiens
tgggtcacttgataaa

SEQ ID NO: 152514 - DNA, 16 bp, H. sapiens
tgggtcaggaatttgg

SEQ ID NO: 152515 - DNA, 16 bp, H. sapiens
tgggtcaggctggtct

SEQ ID NO: 152516 - DNA, 16 bp, H. sapiens
tgggtcatgggggtgg

SEQ ID NO: 152517 - DNA, 16 bp, H. sapiens
tgggtcccagctctgc

SEQ ID NO: 152518 - DNA, 16 bp, H. sapiens
tgggtccctcccacag

SEQ ID NO: 152519 - DNA, 16 bp, H. sapiens
tgggtccctgaccccc

SEQ ID NO: 152520 - DNA, 16 bp, H. sapiens
tgggtcctaaatccaa

SEQ ID NO: 152521 - DNA, 16 bp, H. sapiens
tgggtcctggagatgg

SEQ ID NO: 152522 - DNA, 16 bp, H. sapiens
tgggtctacaggcacg

SEQ ID NO: 152523 - DNA, 16 bp, H. sapiens
tgggtctccaaaaagg

SEQ ID NO: 152524 - DNA, 16 bp, H. sapiens
tgggtctccagtttgc

SEQ ID NO: 152525 - DNA, 16 bp, H. sapiens
tgggtctctgaccccc

SEQ ID NO: 152526 - DNA, 16 bp, H. sapiens
tgggtctctgtgtgtg

SEQ ID NO: 152527 - DNA, 16 bp, H. sapiens
tgggtctcttgcattt

SEQ ID NO: 152528 - DNA, 18 bp, H. sapiens
tgggtctgatcaccccaa

SEQ ID NO: 152529 - DNA, 16 bp, H. sapiens
tgggtctggaggtgtc

SEQ ID NO: 152530 - DNA, 16 bp, H. sapiens
tgggtctgtgagggtg

SEQ ID NO: 152531 - DNA, 16 bp, H. sapiens
tgggtcttcattttct

SEQ ID NO: 152532 - DNA, 16 bp, H. sapiens
tgggtctttattctga

SEQ ID NO: 152533 - DNA, 16 bp, H. sapiens
tgggtgaaaaaataat

SEQ ID NO: 152534 - DNA, 16 bp, H. sapiens
tgggtgaaaaagtgag

SEQ ID NO: 152535 - DNA, 17 bp, H. sapiens
tgggtgaaagagtgaaa

SEQ ID NO: 152536 - DNA, 16 bp, H. sapiens
tgggtgaaatgttcta

SEQ ID NO: 152537 - DNA, 16 bp, H. sapiens
tgggtgaaccttgaag

SEQ ID NO: 152538 - DNA, 16 bp, H. sapiens
tgggtgacaagggtga

SEQ ID NO: 152539 - DNA, 24 bp, H. sapiens
tgggtgacagaatgagactctgtc

SEQ ID NO: 152540 - DNA, 16 bp, H. sapiens
tgggtgacagagaaag

SEQ ID NO: 152541 - DNA, 16 bp, H. sapiens
tgggtgacagagacct

SEQ ID NO: 152542 - DNA, 16 bp, H. sapiens
tgggtgacagagagaa

SEQ ID NO: 152543 - DNA, 16 bp, H. sapiens
tgggtgacagaggaga

SEQ ID NO: 152544 - DNA, 16 bp, H. sapiens
tgggtgacagggtgag

SEQ ID NO: 152545 - DNA, 16 bp, H. sapiens
tgggtgacagtgacac

SEQ ID NO: 152546 - DNA, 16 bp, H. sapiens
tgggtgacagtgggag

SEQ ID NO: 152547 - DNA, 16 bp, H. sapiens
tgggtgagaacatgtg

SEQ ID NO: 152548 - DNA, 16 bp, H. sapiens
tgggtgagaagagcaa

SEQ ID NO: 152549 - DNA, 16 bp, H. sapiens
tgggtgagacagtgag

SEQ ID NO: 152550 - DNA, 16 bp, H. sapiens
tgggtgagagtgtgag

SEQ ID NO: 152551 - DNA, 16 bp, H. sapiens
tgggtgagggataaaa

SEQ ID NO: 152552 - DNA, 16 bp, H. sapiens
tgggtgagtggatgaa

SEQ ID NO: 152553 - DNA, 16 bp, H. sapiens
tgggtgagttacttaa

SEQ ID NO: 152554 - DNA, 16 bp, H. sapiens
tgggtgatgaaaatgt

SEQ ID NO: 152555 - DNA, 16 bp, H. sapiens
tgggtgatgaaataat

SEQ ID NO: 152556 - DNA, 16 bp, H. sapiens
tgggtgcaagtgattc

SEQ ID NO: 152557 - DNA, 16 bp, H. sapiens
tgggtgcagctggagg

SEQ ID NO: 152558 - DNA, 16 bp, H. sapiens
tgggtgcagtgactca

SEQ ID NO: 152559 - DNA, 16 bp, H. sapiens
tgggtgcagtggatca

SEQ ID NO: 152560 - DNA, 16 bp, H. sapiens
tgggtgcagttcatgg

SEQ ID NO: 152561 - DNA, 16 bp, H. sapiens
tgggtgcatgtgtgtg

SEQ ID NO: 152562 - DNA, 17 bp, H. sapiens
tgggtgccagagtgaga

SEQ ID NO: 152563 - DNA, 16 bp, H. sapiens
tgggtgccagctcagc

SEQ ID NO: 152564 - DNA, 16 bp, H. sapiens
tgggtgccaggccctg

SEQ ID NO: 152565 - DNA, 16 bp, H. sapiens
tgggtgcccaggcaga

SEQ ID NO: 152566 - DNA, 16 bp, H. sapiens
tgggtgccccagcctg

SEQ ID NO: 152567 - DNA, 17 bp, H. sapiens
tgggtgcgcgcaccatg

SEQ ID NO: 152568 - DNA, 16 bp, H. sapiens
tgggtgcggaggctca

SEQ ID NO: 152569 - DNA, 17 bp, H. sapiens
tgggtgctatcaatgcc

SEQ ID NO: 152570 - DNA, 16 bp, H. sapiens
tgggtgctggatattt

SEQ ID NO: 152571 - DNA, 16 bp, H. sapiens
tgggtgctgggccctg

SEQ ID NO: 152572 - DNA, 16 bp, H. sapiens
tgggtgcttaataaat

SEQ ID NO: 152573 - DNA, 16 bp, H. sapiens
tgggtgcttctgtgtt

SEQ ID NO: 152574 - DNA, 16 bp, H. sapiens
tgggtggaggccaggg

SEQ ID NO: 152575 - DNA, 16 bp, H. sapiens
tgggtggagtggggac

SEQ ID NO: 152576 - DNA, 16 bp, H. sapiens
tgggtggataaagaaa

SEQ ID NO: 152577 - DNA, 16 bp, H. sapiens
tgggtggatcacctga

SEQ ID NO: 152578 - DNA, 16 bp, H. sapiens
tgggtggatcatttga

SEQ ID NO: 152579 - DNA, 16 bp, H. sapiens
tgggtggattacctga

SEQ ID NO: 152580 - DNA, 16 bp, H. sapiens
tgggtggcacatgcct

SEQ ID NO: 152581 - DNA, 16 bp, H. sapiens
tgggtggcaccagctg

SEQ ID NO: 152582 - DNA, 16 bp, H. sapiens
tgggtggcagagcaaa

SEQ ID NO: 152583 - DNA, 17 bp, H. sapiens
tgggtggcagagcaaga

SEQ ID NO: 152584 - DNA, 16 bp, H. sapiens
tgggtggcagagctag

SEQ ID NO: 152585 - DNA, 16 bp, H. sapiens
tgggtggcagaggctg

SEQ ID NO: 152586 - DNA, 16 bp, H. sapiens
tgggtggcatggggag

SEQ ID NO: 152587 - DNA, 16 bp, H. sapiens
tgggtggccattattc

SEQ ID NO: 152588 - DNA, 16 bp, H. sapiens
tgggtggctgaggaag

SEQ ID NO: 152589 - DNA, 16 bp, H. sapiens
tgggtgggacacagag

SEQ ID NO: 152590 - DNA, 16 bp, H. sapiens
tgggtgggaggattgc

SEQ ID NO: 152591 - DNA, 16 bp, H. sapiens
tgggtgggaggctcag

SEQ ID NO: 152592 - DNA, 16 bp, H. sapiens
tgggtgggatgtggcc

SEQ ID NO: 152593 - DNA, 16 bp, H. sapiens
tgggtgggcacagtgg

SEQ ID NO: 152594 - DNA, 16 bp, H. sapiens
tgggtgggcctgtcct

SEQ ID NO: 152595 - DNA, 16 bp, H. sapiens
tgggtggggacacacc

SEQ ID NO: 152596 - DNA, 16 bp, H. sapiens
tgggtggggacccaga

SEQ ID NO: 152597 - DNA, 16 bp, H. sapiens
tgggtggggactcaga

SEQ ID NO: 152598 - DNA, 16 bp, H. sapiens
tgggtgggggcacagc

SEQ ID NO: 152599 - DNA, 16 bp, H. sapiens
tgggtggtcagggaag

SEQ ID NO: 152600 - DNA, 16 bp, H. sapiens
tgggtggtggaggctg

SEQ ID NO: 152601 - DNA, 16 bp, H. sapiens
tgggtgtcaccagtgg

SEQ ID NO: 152602 - DNA, 16 bp, H. sapiens
tgggtgtcatggcaca

SEQ ID NO: 152603 - DNA, 16 bp, H. sapiens
tgggtgtgagccactg

SEQ ID NO: 152604 - DNA, 16 bp, H. sapiens
tgggtgtgggggctca

SEQ ID NO: 152605 - DNA, 16 bp, H. sapiens
tgggtgtggtgattca

SEQ ID NO: 152606 - DNA, 24 bp, H. sapiens
tgggtgtggtggcacgtgcctgta

SEQ ID NO: 152607 - DNA, 18 bp, H. sapiens
tgggtgtggtggcatgca

SEQ ID NO: 152608 - DNA, 16 bp, H. sapiens
tgggtgtggtggctta

SEQ ID NO: 152609 - DNA, 16 bp, H. sapiens
tgggtgtgtccccacc

SEQ ID NO: 152610 - DNA, 16 bp, H. sapiens
tgggtgtgtgtgcaca

SEQ ID NO: 152611 - DNA, 16 bp, H. sapiens
tgggttaaataaaatg

SEQ ID NO: 152612 - DNA, 16 bp, H. sapiens
tgggttatttattttc

SEQ ID NO: 152613 - DNA, 16 bp, H. sapiens
tgggttatttctcttt

SEQ ID NO: 152614 - DNA, 16 bp, H. sapiens
tgggttcaagaaattc

SEQ ID NO: 152615 - DNA, 17 bp, H. sapiens
tgggttcaagagatcct

SEQ ID NO: 152616 - DNA, 16 bp, H. sapiens
tgggttcaaggaatcc

SEQ ID NO: 152617 - DNA, 16 bp, H. sapiens
tgggttcagttccaga

SEQ ID NO: 152618 - DNA, 16 bp, H. sapiens
tgggttcccttctggc

SEQ ID NO: 152619 - DNA, 16 bp, H. sapiens
tgggttcgtggtctcc

SEQ ID NO: 152620 - DNA, 16 bp, H. sapiens
tgggttcttggtctgg

SEQ ID NO: 152621 - DNA, 16 bp, H. sapiens
tgggttgaattgtgtc

SEQ ID NO: 152622 - DNA, 16 bp, H. sapiens
tgggttgatggatgga

SEQ ID NO: 152623 - DNA, 16 bp, H. sapiens
tgggttgcttctgcct

SEQ ID NO: 152624 - DNA, 16 bp, H. sapiens
tgggttgtcttttcac

SEQ ID NO: 152625 - DNA, 16 bp, H. sapiens
tgggttgtttctatat

SEQ ID NO: 152626 - DNA, 16 bp, H. sapiens
tgggtttatttctgaa

SEQ ID NO: 152627 - DNA, 16 bp, H. sapiens
tgggtttcatcccagg

SEQ ID NO: 152628 - DNA, 16 bp, H. sapiens
tgggtttcctcatctg

SEQ ID NO: 152629 - DNA, 16 bp, H. sapiens
tgggtttgaatctcag

SEQ ID NO: 152630 - DNA, 16 bp, H. sapiens
tgggtttgagtcctga

SEQ ID NO: 152631 - DNA, 16 bp, H. sapiens
tgggtttggacaaatg

SEQ ID NO: 152632 - DNA, 16 bp, H. sapiens
tgggtttggccaatgg

SEQ ID NO: 152633 - DNA, 16 bp, H. sapiens
tgggtttgtcatagat

SEQ ID NO: 152634 - DNA, 16 bp, H. sapiens
tgggtttgtcattaat

SEQ ID NO: 152635 - DNA, 18 bp, H. sapiens
tgggtttgtggtctcgct

SEQ ID NO: 152636 - DNA, 16 bp, H. sapiens
tgggttttaaaaaatt

SEQ ID NO: 152637 - DNA, 16 bp, H. sapiens
tgggttttgacaaatg

SEQ ID NO: 152638 - DNA, 16 bp, H. sapiens
tgggttttggaggcag

SEQ ID NO: 152639 - DNA, 16 bp, H. sapiens
tgggttttgtccttca

SEQ ID NO: 152640 - DNA, 16 bp, H. sapiens
tgggtttttcacagat

SEQ ID NO: 152641 - DNA, 16 bp, H. sapiens
tgggtttttctaaata

SEQ ID NO: 152642 - DNA, 16 bp, H. sapiens
tgggtttttgcactgt

SEQ ID NO: 152643 - DNA, 16 bp, H. sapiens
tggtaaaaagattata

SEQ ID NO: 152644 - DNA, 16 bp, H. sapiens
tggtaaaacattactt

SEQ ID NO: 152645 - DNA, 16 bp, H. sapiens
tggtaaaacattattt

SEQ ID NO: 152646 - DNA, 16 bp, H. sapiens
tggtaaaaggcctcag

SEQ ID NO: 152647 - DNA, 23 bp, H. sapiens
tggtaaaagtcatcgccattctc

SEQ ID NO: 152648 - DNA, 16 bp, H. sapiens
tggtaaaagtgggcat

SEQ ID NO: 152649 - DNA, 16 bp, H. sapiens
tggtaaaatacatata

SEQ ID NO: 152650 - DNA, 16 bp, H. sapiens
tggtaaaatatacata

SEQ ID NO: 152651 - DNA, 16 bp, H. sapiens
tggtaaagaagctggc

SEQ ID NO: 152652 - DNA, 16 bp, H. sapiens
tggtaaagatggtaaa

SEQ ID NO: 152653 - DNA, 16 bp, H. sapiens
tggtaaagggatcatt

SEQ ID NO: 152654 - DNA, 16 bp, H. sapiens
tggtaaagtattattt

SEQ ID NO: 152655 - DNA, 16 bp, H. sapiens
tggtaaagtctgggct

SEQ ID NO: 152656 - DNA, 16 bp, H. sapiens
tggtaaatatttgttt

SEQ ID NO: 152657 - DNA, 16 bp, H. sapiens
tggtaaatgtgtttcc

SEQ ID NO: 152658 - DNA, 16 bp, H. sapiens
tggtaaatgtttaaca

SEQ ID NO: 152659 - DNA, 16 bp, H. sapiens
tggtaaatgtttcttt

SEQ ID NO: 152660 - DNA, 16 bp, H. sapiens
tggtaaccactgttct

SEQ ID NO: 152661 - DNA, 16 bp, H. sapiens
tggtaaccattcttct

SEQ ID NO: 152662 - DNA, 16 bp, H. sapiens
tggtaactcatgcctg

SEQ ID NO: 152663 - DNA, 16 bp, H. sapiens
tggtaacttctgggtt

SEQ ID NO: 152664 - DNA, 16 bp, H. sapiens
tggtaacttttacctt

SEQ ID NO: 152665 - DNA, 16 bp, H. sapiens
tggtaagaacacttaa

SEQ ID NO: 152666 - DNA, 16 bp, H. sapiens
tggtaagaacatttaa

SEQ ID NO: 152667 - DNA, 16 bp, H. sapiens
tggtaaggttgcagag

SEQ ID NO: 152668 - DNA, 16 bp, H. sapiens
tggtaataaaatattt

SEQ ID NO: 152669 - DNA, 16 bp, H. sapiens
tggtaataataatagt

SEQ ID NO: 152670 - DNA, 16 bp, H. sapiens
tggtaatatgacaaaa

SEQ ID NO: 152671 - DNA, 16 bp, H. sapiens
tggtaatgatggtggt

SEQ ID NO: 152672 - DNA, 16 bp, H. sapiens
tggtaatggtggtggt

SEQ ID NO: 152673 - DNA, 17 bp, H. sapiens
tggtaatttataaagga

SEQ ID NO: 152674 - DNA, 16 bp, H. sapiens
tggtaatttattacag

SEQ ID NO: 152675 - DNA, 16 bp, H. sapiens
tggtacaagctcctct

SEQ ID NO: 152676 - DNA, 16 bp, H. sapiens
tggtacagcctgcaga

SEQ ID NO: 152677 - DNA, 16 bp, H. sapiens
tggtacagcctgttgc

SEQ ID NO: 152678 - DNA, 16 bp, H. sapiens
tggtacatctgttaca

SEQ ID NO: 152679 - DNA, 16 bp, H. sapiens
tggtacatgtgatatt

SEQ ID NO: 152680 - DNA, 16 bp, H. sapiens
tggtacatttgttaca

SEQ ID NO: 152681 - DNA, 16 bp, H. sapiens
tggtacattttatgtg

SEQ ID NO: 152682 - DNA, 16 bp, H. sapiens
tggtaccagccactga

SEQ ID NO: 152683 - DNA, 16 bp, H. sapiens
tggtaccagtaccatt

SEQ ID NO: 152684 - DNA, 16 bp, H. sapiens
tggtaccagtagcatg

SEQ ID NO: 152685 - DNA, 17 bp, H. sapiens
tggtaccagtttctcct

SEQ ID NO: 152686 - DNA, 16 bp, H. sapiens
tggtaccatcacagct

SEQ ID NO: 152687 - DNA, 16 bp, H. sapiens
tggtacctgggttctg

SEQ ID NO: 152688 - DNA, 16 bp, H. sapiens
tggtacctggtatgca

SEQ ID NO: 152689 - DNA, 16 bp, H. sapiens
tggtacctggtatgta

SEQ ID NO: 152690 - DNA, 21 bp, H. sapiens
tggtactcgtaccaaaacaga

SEQ ID NO: 152691 - DNA, 16 bp, H. sapiens
tggtactgccataaaa

SEQ ID NO: 152692 - DNA, 16 bp, H. sapiens
tggtactggaaaaact

SEQ ID NO: 152693 - DNA, 16 bp, H. sapiens
tggtactggcataagg

SEQ ID NO: 152694 - DNA, 16 bp, H. sapiens
tggtactggctgttcc

SEQ ID NO: 152695 - DNA, 21 bp, H. sapiens
tggtactggtaccaaaacaca

SEQ ID NO: 152696 - DNA, 21 bp, H. sapiens
tggtactggtaccaaaacaga

SEQ ID NO: 152697 - DNA, 16 bp, H. sapiens
tggtactgtcataaaa

SEQ ID NO: 152698 - DNA, 16 bp, H. sapiens
tggtacttgcctgtag

SEQ ID NO: 152699 - DNA, 16 bp, H. sapiens
tggtagaaatatgaat

SEQ ID NO: 152700 - DNA, 16 bp, H. sapiens
tggtagaaatgcagaa

SEQ ID NO: 152701 - DNA, 16 bp, H. sapiens
tggtagaaggggcaaa

SEQ ID NO: 152702 - DNA, 16 bp, H. sapiens
tggtagaattcagcaa

SEQ ID NO: 152703 - DNA, 16 bp, H. sapiens
tggtagagaaggggtt

SEQ ID NO: 152704 - DNA, 16 bp, H. sapiens
tggtagagctgagatt

SEQ ID NO: 152705 - DNA, 16 bp, H. sapiens
tggtagagctgggact

SEQ ID NO: 152706 - DNA, 16 bp, H. sapiens
tggtagataagctttt

SEQ ID NO: 152707 - DNA, 16 bp, H. sapiens
tggtagatctactgac

SEQ ID NO: 152708 - DNA, 16 bp, H. sapiens
tggtagcagcagcagc

SEQ ID NO: 152709 - DNA, 17 bp, H. sapiens
tggtagcagttcctcct

SEQ ID NO: 152710 - DNA, 16 bp, H. sapiens
tggtagccaaagacaa

SEQ ID NO: 152711 - DNA, 16 bp, H. sapiens
tggtagccccatgcag

SEQ ID NO: 152712 - DNA, 16 bp, H. sapiens
tggtagctcacacctg

SEQ ID NO: 152713 - DNA, 16 bp, H. sapiens
tggtagctcacgcctg

SEQ ID NO: 152714 - DNA, 16 bp, H. sapiens
tggtagctcatacctg

SEQ ID NO: 152715 - DNA, 16 bp, H. sapiens
tggtagctcatgcctg

SEQ ID NO: 152716 - DNA, 16 bp, H. sapiens
tggtagctccacccca

SEQ ID NO: 152717 - DNA, 16 bp, H. sapiens
tggtagcttgaaatca

SEQ ID NO: 152718 - DNA, 16 bp, H. sapiens
tggtaggcagaataat

SEQ ID NO: 152719 - DNA, 16 bp, H. sapiens
tggtaggcagaggcag

SEQ ID NO: 152720 - DNA, 16 bp, H. sapiens
tggtagtgatggttgt

SEQ ID NO: 152721 - DNA, 16 bp, H. sapiens
tggtagttgctgaagg

SEQ ID NO: 152722 - DNA, 16 bp, H. sapiens
tggtagtttggtagga

SEQ ID NO: 152723 - DNA, 16 bp, H. sapiens
tggtataatgatttat

SEQ ID NO: 152724 - DNA, 16 bp, H. sapiens
tggtatataattcttt

SEQ ID NO: 152725 - DNA, 16 bp, H. sapiens
tggtatatattttaaa

SEQ ID NO: 152726 - DNA, 16 bp, H. sapiens
tggtatcacagtgctt

SEQ ID NO: 152727 - DNA, 16 bp, H. sapiens
tggtatcagttcttct

SEQ ID NO: 152728 - DNA, 16 bp, H. sapiens
tggtatccatggggaa

SEQ ID NO: 152729 - DNA, 16 bp, H. sapiens
tggtatctcactctgt

SEQ ID NO: 152730 - DNA, 16 bp, H. sapiens
tggtatctcttcctct

SEQ ID NO: 152731 - DNA, 16 bp, H. sapiens
tggtatgattttgatt

SEQ ID NO: 152732 - DNA, 16 bp, H. sapiens
tggtatgcacctgtgg

SEQ ID NO: 152733 - DNA, 16 bp, H. sapiens
tggtatggtggcacat

SEQ ID NO: 152734 - DNA, 16 bp, H. sapiens
tggtatgtgaattcta

SEQ ID NO: 152735 - DNA, 16 bp, H. sapiens
tggtattaaaatttca

SEQ ID NO: 152736 - DNA, 16 bp, H. sapiens
tggtattgagtgtctg

SEQ ID NO: 152737 - DNA, 16 bp, H. sapiens
tggtatttctagtttt

SEQ ID NO: 152738 - DNA, 16 bp, H. sapiens
tggtatttctctacct

SEQ ID NO: 152739 - DNA, 16 bp, H. sapiens
tggtatttctgggtct

SEQ ID NO: 152740 - DNA, 16 bp, H. sapiens
tggtatttggagatga

SEQ ID NO: 152741 - DNA, 16 bp, H. sapiens
tggtatttggttacat

SEQ ID NO: 152742 - DNA, 16 bp, H. sapiens
tggtatttgtcttcct

SEQ ID NO: 152743 - DNA, 16 bp, H. sapiens
tggtattttcttatgg

SEQ ID NO: 152744 - DNA, 16 bp, H. sapiens
tggtattttgatatgg

SEQ ID NO: 152745 - DNA, 16 bp, H. sapiens
tggtattttgttatga

SEQ ID NO: 152746 - DNA, 16 bp, H. sapiens
tggtatttttagttct

SEQ ID NO: 152747 - DNA, 16 bp, H. sapiens
tggtcaaaatccagaa

SEQ ID NO: 152748 - DNA, 16 bp, H. sapiens
tggtcaaagcagtcac

SEQ ID NO: 152749 - DNA, 18 bp, H. sapiens
tggtcaaatggtatttct

SEQ ID NO: 152750 - DNA, 16 bp, H. sapiens
tggtcaacagaaaggg

SEQ ID NO: 152751 - DNA, 16 bp, H. sapiens
tggtcaacaggcagca

SEQ ID NO: 152752 - DNA, 16 bp, H. sapiens
tggtcaacatgggaaa

SEQ ID NO: 152753 - DNA, 16 bp, H. sapiens
tggtcaatgaagaaat

SEQ ID NO: 152754 - DNA, 16 bp, H. sapiens
tggtcaatgagaaaga

SEQ ID NO: 152755 - DNA, 16 bp, H. sapiens
tggtcaattttggaaa

SEQ ID NO: 152756 - DNA, 16 bp, H. sapiens
tggtcaattttggctt

SEQ ID NO: 152757 - DNA, 16 bp, H. sapiens
tggtcaccagaggctg

SEQ ID NO: 152758 - DNA, 16 bp, H. sapiens
tggtcaccccacccta

SEQ ID NO: 152759 - DNA, 20 bp, H. sapiens
tggtcacccccatgctgaac

SEQ ID NO: 152760 - DNA, 17 bp, H. sapiens
tggtcacgctcctagtc

SEQ ID NO: 152761 - DNA, 16 bp, H. sapiens
tggtcactgcaacctc

SEQ ID NO: 152762 - DNA, 16 bp, H. sapiens
tggtcactgcagctgt

SEQ ID NO: 152763 - DNA, 16 bp, H. sapiens
tggtcagacaccattt

SEQ ID NO: 152764 - DNA, 16 bp, H. sapiens
tggtcagacattaaaa

SEQ ID NO: 152765 - DNA, 16 bp, H. sapiens
tggtcagagaagatgc

SEQ ID NO: 152766 - DNA, 16 bp, H. sapiens
tggtcagcatggtgaa

SEQ ID NO: 152767 - DNA, 16 bp, H. sapiens
tggtcagctgtgcctg

SEQ ID NO: 152768 - DNA, 16 bp, H. sapiens
tggtcagggaagacct

SEQ ID NO: 152769 - DNA, 16 bp, H. sapiens
tggtcagggacccact

SEQ ID NO: 152770 - DNA, 16 bp, H. sapiens
tggtcagggagatgga

SEQ ID NO: 152771 - DNA, 16 bp, H. sapiens
tggtcatcagagaaac

SEQ ID NO: 152772 - DNA, 16 bp, H. sapiens
tggtcatcagagaaat

SEQ ID NO: 152773 - DNA, 16 bp, H. sapiens
tggtcatggtggtgtg

SEQ ID NO: 152774 - DNA, 18 bp, H. sapiens
tggtcattgaggacaagt

SEQ ID NO: 152775 - DNA, 16 bp, H. sapiens
tggtcatttggaaaat

SEQ ID NO: 152776 - DNA, 16 bp, H. sapiens
tggtcattttcacagt

SEQ ID NO: 152777 - DNA, 16 bp, H. sapiens
tggtcattttctcaat

SEQ ID NO: 152778 - DNA, 16 bp, H. sapiens
tggtccaacacaaatt

SEQ ID NO: 152779 - DNA, 16 bp, H. sapiens
tggtccaagacaattc

SEQ ID NO: 152780 - DNA, 16 bp, H. sapiens
tggtccacccacctcg

SEQ ID NO: 152781 - DNA, 17 bp, H. sapiens
tggtccacctgctcctg

SEQ ID NO: 152782 - DNA, 16 bp, H. sapiens
tggtccagccacagcc

SEQ ID NO: 152783 - DNA, 17 bp, H. sapiens
tggtccagctgcagcct

SEQ ID NO: 152784 - DNA, 16 bp, H. sapiens
tggtcccagctacttg

SEQ ID NO: 152785 - DNA, 16 bp, H. sapiens
tggtcccagctatttg

SEQ ID NO: 152786 - DNA, 16 bp, H. sapiens
tggtcccaggaccaca

SEQ ID NO: 152787 - DNA, 16 bp, H. sapiens
tggtcccccaaagtgc

SEQ ID NO: 152788 - DNA, 17 bp, H. sapiens
tggtcccccgggcccag

SEQ ID NO: 152789 - DNA, 16 bp, H. sapiens
tggtccccttcctgtg

SEQ ID NO: 152790 - DNA, 16 bp, H. sapiens
tggtccctgccctcat

SEQ ID NO: 152791 - DNA, 16 bp, H. sapiens
tggtccctggaccctg

SEQ ID NO: 152792 - DNA, 16 bp, H. sapiens
tggtccctggcagctg

SEQ ID NO: 152793 - DNA, 16 bp, H. sapiens
tggtcctcacctgctc

SEQ ID NO: 152794 - DNA, 16 bp, H. sapiens
tggtcctgaacttttt

SEQ ID NO: 152795 - DNA, 16 bp, H. sapiens
tggtcctggacctttt

SEQ ID NO: 152796 - DNA, 18 bp, H. sapiens
tggtcctggactttattt

SEQ ID NO: 152797 - DNA, 16 bp, H. sapiens
tggtcctgggattttt

SEQ ID NO: 152798 - DNA, 16 bp, H. sapiens
tggtcgctcacgcctg

SEQ ID NO: 152799 - DNA, 16 bp, H. sapiens
tggtcgtgcatgcctg

SEQ ID NO: 152800 - DNA, 16 bp, H. sapiens
tggtctatcctagaga

SEQ ID NO: 152801 - DNA, 16 bp, H. sapiens
tggtctcaaaatccta

SEQ ID NO: 152802 - DNA, 16 bp, H. sapiens
tggtctcaaacacctg

SEQ ID NO: 152803 - DNA, 16 bp, H. sapiens
tggtctcaaactccta

SEQ ID NO: 152804 - DNA, 16 bp, H. sapiens
tggtctcaaactcttg

SEQ ID NO: 152805 - DNA, 17 bp, H. sapiens
tggtctcaaacttctgg

SEQ ID NO: 152806 - DNA, 16 bp, H. sapiens
tggtctcaaattcatg

SEQ ID NO: 152807 - DNA, 17 bp, H. sapiens
tggtctcaagctcctgg

SEQ ID NO: 152808 - DNA, 18 bp, H. sapiens
tggtctcaatctcctgat

SEQ ID NO: 152809 - DNA, 16 bp, H. sapiens
tggtctcaatttcctg

SEQ ID NO: 152810 - DNA, 16 bp, H. sapiens
tggtctcactcctgac

SEQ ID NO: 152811 - DNA, 16 bp, H. sapiens
tggtctcactgtgttg

SEQ ID NO: 152812 - DNA, 16 bp, H. sapiens
tggtctcagactccca

SEQ ID NO: 152813 - DNA, 16 bp, H. sapiens
tggtctcagactcctg

SEQ ID NO: 152814 - DNA, 16 bp, H. sapiens
tggtctcagcccaaaa

SEQ ID NO: 152815 - DNA, 16 bp, H. sapiens
tggtctcataagatta

SEQ ID NO: 152816 - DNA, 16 bp, H. sapiens
tggtctcatgatagtg

SEQ ID NO: 152817 - DNA, 16 bp, H. sapiens
tggtctcattctcctg

SEQ ID NO: 152818 - DNA, 17 bp, H. sapiens
tggtctcgaacccctga

SEQ ID NO: 152819 - DNA, 16 bp, H. sapiens
tggtctcgaactccag

SEQ ID NO: 152820 - DNA, 17 bp, H. sapiens
tggtctcgaactcttgg

SEQ ID NO: 152821 - DNA, 17 bp, H. sapiens
tggtctcgaattcctga

SEQ ID NO: 152822 - DNA, 20 bp, H. sapiens
tggtctcgatctcctgactt

SEQ ID NO: 152823 - DNA, 20 bp, H. sapiens
tggtctcgatctcttgacct

SEQ ID NO: 152824 - DNA, 17 bp, H. sapiens
tggtctcgctgacttca

SEQ ID NO: 152825 - DNA, 16 bp, H. sapiens
tggtctcgctgggagc

SEQ ID NO: 152826 - DNA, 16 bp, H. sapiens
tggtctctctgcttct

SEQ ID NO: 152827 - DNA, 16 bp, H. sapiens
tggtctctctggcttc

SEQ ID NO: 152828 - DNA, 16 bp, H. sapiens
tggtctctggtctctc

SEQ ID NO: 152829 - DNA, 16 bp, H. sapiens
tggtctcttcaataaa

SEQ ID NO: 152830 - DNA, 17 bp, H. sapiens
tggtctcttcacacaga

SEQ ID NO: 152831 - DNA, 16 bp, H. sapiens
tggtctgaaattcctg

SEQ ID NO: 152832 - DNA, 16 bp, H. sapiens
tggtctgagctccctg

SEQ ID NO: 152833 - DNA, 16 bp, H. sapiens
tggtctgcagctccca

SEQ ID NO: 152834 - DNA, 16 bp, H. sapiens
tggtctggaacacctg

SEQ ID NO: 152835 - DNA, 16 bp, H. sapiens
tggtctgggcccaggg

SEQ ID NO: 152836 - DNA, 16 bp, H. sapiens
tggtctgtgcttcttc

SEQ ID NO: 152837 - DNA, 16 bp, H. sapiens
tggtctgtgtacttaa

SEQ ID NO: 152838 - DNA, 16 bp, H. sapiens
tggtctgtgtgtctgt

SEQ ID NO: 152839 - DNA, 16 bp, H. sapiens
tggtctgtttagattt

SEQ ID NO: 152840 - DNA, 16 bp, H. sapiens
tggtctgttttgacag

SEQ ID NO: 152841 - DNA, 18 bp, H. sapiens
tggtctgttttgacaggg

SEQ ID NO: 152842 - DNA, 16 bp, H. sapiens
tggtcttaaactcctg

SEQ ID NO: 152843 - DNA, 16 bp, H. sapiens
tggtcttaaactcttg

SEQ ID NO: 152844 - DNA, 16 bp, H. sapiens
tggtcttatttctgag

SEQ ID NO: 152845 - DNA, 16 bp, H. sapiens
tggtcttgaacagctg

SEQ ID NO: 152846 - DNA, 16 bp, H. sapiens
tggtcttgaacccctg

SEQ ID NO: 152847 - DNA, 16 bp, H. sapiens
tggtcttgaacgcctg

SEQ ID NO: 152848 - DNA, 16 bp, H. sapiens
tggtcttgaactcctc

SEQ ID NO: 152849 - DNA, 18 bp, H. sapiens
tggtcttgaactcctgat

SEQ ID NO: 152850 - DNA, 16 bp, H. sapiens
tggtcttgaactcctt

SEQ ID NO: 152851 - DNA, 16 bp, H. sapiens
tggtcttgaattccta

SEQ ID NO: 152852 - DNA, 16 bp, H. sapiens
tggtcttgacctccca

SEQ ID NO: 152853 - DNA, 16 bp, H. sapiens
tggtcttgagctgctg

SEQ ID NO: 152854 - DNA, 16 bp, H. sapiens
tggtcttgctctctca

SEQ ID NO: 152855 - DNA, 16 bp, H. sapiens
tggtcttgctctgttg

SEQ ID NO: 152856 - DNA, 16 bp, H. sapiens
tggtcttgctgtgtca

SEQ ID NO: 152857 - DNA, 16 bp, H. sapiens
tggtcttggcctccca

SEQ ID NO: 152858 - DNA, 16 bp, H. sapiens
tggtctttgaggctgc

SEQ ID NO: 152859 - DNA, 16 bp, H. sapiens
tggtctttgataatgg

SEQ ID NO: 152860 - DNA, 16 bp, H. sapiens
tggtgaaaaaggagat

SEQ ID NO: 152861 - DNA, 16 bp, H. sapiens
tggtgaaaaatcaaat

SEQ ID NO: 152862 - DNA, 16 bp, H. sapiens
tggtgaaaaatgaaat

SEQ ID NO: 152863 - DNA, 16 bp, H. sapiens
tggtgaaaacccttct

SEQ ID NO: 152864 - DNA, 16 bp, H. sapiens
tggtgaaaagggaaat

SEQ ID NO: 152865 - DNA, 16 bp, H. sapiens
tggtgaaaaggggaca

SEQ ID NO: 152866 - DNA, 16 bp, H. sapiens
tggtgaaaatgcaaaa

SEQ ID NO: 152867 - DNA, 16 bp, H. sapiens
tggtgaaaatgtctcc

SEQ ID NO: 152868 - DNA, 16 bp, H. sapiens
tggtgaaacaccctct

SEQ ID NO: 152869 - DNA, 16 bp, H. sapiens
tggtgaaaccacgtct

SEQ ID NO: 152870 - DNA, 16 bp, H. sapiens
tggtgaaacccaacct

SEQ ID NO: 152871 - DNA, 16 bp, H. sapiens
tggtgaaaccccatcc

SEQ ID NO: 152872 - DNA, 18 bp, H. sapiens
tggtgaaaccccatctct

SEQ ID NO: 152873 - DNA, 26 bp, H. sapiens
tggtgaaaccccatctctactaaaac

SEQ ID NO: 152874 - DNA, 25 bp, H. sapiens
tggtgaaaccccgcctctactaaaa

SEQ ID NO: 152875 - DNA, 26 bp, H. sapiens
tggtgaaaccccgtctctactaaaag

SEQ ID NO: 152876 - DNA, 16 bp, H. sapiens
tggtgaaaccctgtcg

SEQ ID NO: 152877 - DNA, 19 bp, H. sapiens
tggtgaaaccctgtctaca

SEQ ID NO: 152878 - DNA, 19 bp, H. sapiens
tggtgaaaccctgtctcta

SEQ ID NO: 152879 - DNA, 16 bp, H. sapiens
tggtgaaacctcacct

SEQ ID NO: 152880 - DNA, 16 bp, H. sapiens
tggtgaaacctcattt

SEQ ID NO: 152881 - DNA, 16 bp, H. sapiens
tggtgaaacctctgtc

SEQ ID NO: 152882 - DNA, 16 bp, H. sapiens
tggtgaaactctttct

SEQ ID NO: 152883 - DNA, 16 bp, H. sapiens
tggtgaaactttgtct

SEQ ID NO: 152884 - DNA, 16 bp, H. sapiens
tggtgaaagaggaaat

SEQ ID NO: 152885 - DNA, 16 bp, H. sapiens
tggtgaaagaggacat

SEQ ID NO: 152886 - DNA, 16 bp, H. sapiens
tggtgaaagcaggagc

SEQ ID NO: 152887 - DNA, 16 bp, H. sapiens
tggtgaaagccagtct

SEQ ID NO: 152888 - DNA, 16 bp, H. sapiens
tggtgaaaggcaagga

SEQ ID NO: 152889 - DNA, 16 bp, H. sapiens
tggtgaaagtggacat

SEQ ID NO: 152890 - DNA, 16 bp, H. sapiens
tggtgaaataaattat

SEQ ID NO: 152891 - DNA, 16 bp, H. sapiens
tggtgaaatcacatct

SEQ ID NO: 152892 - DNA, 16 bp, H. sapiens
tggtgaaatcattgat

SEQ ID NO: 152893 - DNA, 16 bp, H. sapiens
tggtgaaatcctgcct

SEQ ID NO: 152894 - DNA, 16 bp, H. sapiens
tggtgaacaaaacaga

SEQ ID NO: 152895 - DNA, 16 bp, H. sapiens
tggtgaacagcaaatg

SEQ ID NO: 152896 - DNA, 16 bp, H. sapiens
tggtgaacagtgctgc

SEQ ID NO: 152897 - DNA, 16 bp, H. sapiens
tggtgaagatgtgggg

SEQ ID NO: 152898 - DNA, 16 bp, H. sapiens
tggtgaagccccacct

SEQ ID NO: 152899 - DNA, 16 bp, H. sapiens
tggtgaagtgtctgtt

SEQ ID NO: 152900 - DNA, 16 bp, H. sapiens
tggtgaataattcttt

SEQ ID NO: 152901 - DNA, 16 bp, H. sapiens
tggtgaatatgtacca

SEQ ID NO: 152902 - DNA, 16 bp, H. sapiens
tggtgaatatgtgcca

SEQ ID NO: 152903 - DNA, 16 bp, H. sapiens
tggtgaatgaatggat

SEQ ID NO: 152904 - DNA, 16 bp, H. sapiens
tggtgaatgtggagaa

SEQ ID NO: 152905 - DNA, 16 bp, H. sapiens
tggtgaattacattta

SEQ ID NO: 152906 - DNA, 16 bp, H. sapiens
tggtgacaaaatctgt

SEQ ID NO: 152907 - DNA, 16 bp, H. sapiens
tggtgacaaagtgaga

SEQ ID NO: 152908 - DNA, 16 bp, H. sapiens
tggtgacaacatctct

SEQ ID NO: 152909 - DNA, 16 bp, H. sapiens
tggtgacagaatgaga

SEQ ID NO: 152910 - DNA, 19 bp, H. sapiens
tggtgacagagcgagactg

SEQ ID NO: 152911 - DNA, 16 bp, H. sapiens
tggtgacagtgggcat

SEQ ID NO: 152912 - DNA, 16 bp, H. sapiens
tggtgaccagcctggc

SEQ ID NO: 152913 - DNA, 16 bp, H. sapiens
tggtgaccagggctga

SEQ ID NO: 152914 - DNA, 16 bp, H. sapiens
tggtgaccatggcctt

SEQ ID NO: 152915 - DNA, 16 bp, H. sapiens
tggtgactcacacctg

SEQ ID NO: 152916 - DNA, 16 bp, H. sapiens
tggtgactcacgcctg

SEQ ID NO: 152917 - DNA, 16 bp, H. sapiens
tggtgactcatgcctg

SEQ ID NO: 152918 - DNA, 16 bp, H. sapiens
tggtgactgtggatgg

SEQ ID NO: 152919 - DNA, 16 bp, H. sapiens
tggtgacttatgcctg

SEQ ID NO: 152920 - DNA, 16 bp, H. sapiens
tggtgagagaagaagc

SEQ ID NO: 152921 - DNA, 16 bp, H. sapiens
tggtgagagagagaaa

SEQ ID NO: 152922 - DNA, 17 bp, H. sapiens
tggtgagagaggtcatc

SEQ ID NO: 152923 - DNA, 16 bp, H. sapiens
tggtgagagtgggcca

SEQ ID NO: 152924 - DNA, 16 bp, H. sapiens
tggtgagatctgtgcc

SEQ ID NO: 152925 - DNA, 16 bp, H. sapiens
tggtgagcatgtggag

SEQ ID NO: 152926 - DNA, 16 bp, H. sapiens
tggtgagccgaaatca

SEQ ID NO: 152927 - DNA, 16 bp, H. sapiens
tggtgaggatggagag

SEQ ID NO: 152928 - DNA, 16 bp, H. sapiens
tggtgaggctgcagag

SEQ ID NO: 152929 - DNA, 16 bp, H. sapiens
tggtgagggactcagg

SEQ ID NO: 152930 - DNA, 16 bp, H. sapiens
tggtgagggccctctt

SEQ ID NO: 152931 - DNA, 16 bp, H. sapiens
tggtgagggccttctt

SEQ ID NO: 152932 - DNA, 16 bp, H. sapiens
tggtgagggctctttt

SEQ ID NO: 152933 - DNA, 17 bp, H. sapiens
tggtgaggtcatgtttt

SEQ ID NO: 152934 - DNA, 16 bp, H. sapiens
tggtgaggtctggttt

SEQ ID NO: 152935 - DNA, 16 bp, H. sapiens
tggtgaggtgtgctca

SEQ ID NO: 152936 - DNA, 16 bp, H. sapiens
tggtgaggttttggag

SEQ ID NO: 152937 - DNA, 16 bp, H. sapiens
tggtgagttatataat

SEQ ID NO: 152938 - DNA, 16 bp, H. sapiens
tggtgataatttgtta

SEQ ID NO: 152939 - DNA, 16 bp, H. sapiens
tggtgatagtggtggt

SEQ ID NO: 152940 - DNA, 17 bp, H. sapiens
tggtgatccacctgcct

SEQ ID NO: 152941 - DNA, 17 bp, H. sapiens
tggtgatctgcccacct

SEQ ID NO: 152942 - DNA, 16 bp, H. sapiens
tggtgatgactcttaa

SEQ ID NO: 152943 - DNA, 16 bp, H. sapiens
tggtgatgactgcaca

SEQ ID NO: 152944 - DNA, 16 bp, H. sapiens
tggtgatgagaagaat

SEQ ID NO: 152945 - DNA, 16 bp, H. sapiens
tggtgatgagtgagtt

SEQ ID NO: 152946 - DNA, 16 bp, H. sapiens
tggtgatgatgatgac

SEQ ID NO: 152947 - DNA, 16 bp, H. sapiens
tggtgatgatgctgat

SEQ ID NO: 152948 - DNA, 16 bp, H. sapiens
tggtgatgatggtgaa

SEQ ID NO: 152949 - DNA, 16 bp, H. sapiens
tggtgatgattgcaca

SEQ ID NO: 152950 - DNA, 16 bp, H. sapiens
tggtgatgcccaggca

SEQ ID NO: 152951 - DNA, 16 bp, H. sapiens
tggtgatggcagtggt

SEQ ID NO: 152952 - DNA, 16 bp, H. sapiens
tggtgatggggctgga

SEQ ID NO: 152953 - DNA, 16 bp, H. sapiens
tggtgatggtgacaat

SEQ ID NO: 152954 - DNA, 16 bp, H. sapiens
tggtgatggtggagga

SEQ ID NO: 152955 - DNA, 16 bp, H. sapiens
tggtgatggtgttgat

SEQ ID NO: 152956 - DNA, 16 bp, H. sapiens
tggtgatggttataca

SEQ ID NO: 152957 - DNA, 16 bp, H. sapiens
tggtgatggttgcaca

SEQ ID NO: 152958 - DNA, 16 bp, H. sapiens
tggtgatgtgtgcatt

SEQ ID NO: 152959 - DNA, 16 bp, H. sapiens
tggtgatgttgaacat

SEQ ID NO: 152960 - DNA, 16 bp, H. sapiens
tggtgatgttggtgat

SEQ ID NO: 152961 - DNA, 16 bp, H. sapiens
tggtgattgcaccact

SEQ ID NO: 152962 - DNA, 16 bp, H. sapiens
tggtgattgctgaagg

SEQ ID NO: 152963 - DNA, 16 bp, H. sapiens
tggtgatttctgatat

SEQ ID NO: 152964 - DNA, 16 bp, H. sapiens
tggtgattttaagttg

SEQ ID NO: 152965 - DNA, 16 bp, H. sapiens
tggtgattttctattt

SEQ ID NO: 152966 - DNA, 16 bp, H. sapiens
tggtgcaaaagtaact

SEQ ID NO: 152967 - DNA, 16 bp, H. sapiens
tggtgcaaaattaatt

SEQ ID NO: 152968 - DNA, 16 bp, H. sapiens
tggtgcaaccccgtct

SEQ ID NO: 152969 - DNA, 16 bp, H. sapiens
tggtgcaatcatagcc

SEQ ID NO: 152970 - DNA, 18 bp, H. sapiens
tggtgcaatcttggctcg

SEQ ID NO: 152971 - DNA, 16 bp, H. sapiens
tggtgcacatgcctgt

SEQ ID NO: 152972 - DNA, 16 bp, H. sapiens
tggtgcagcacaccaa

SEQ ID NO: 152973 - DNA, 16 bp, H. sapiens
tggtgcaggagcatct

SEQ ID NO: 152974 - DNA, 16 bp, H. sapiens
tggtgcaggcctgcag

SEQ ID NO: 152975 - DNA, 16 bp, H. sapiens
tggtgcaggcctgtgg

SEQ ID NO: 152976 - DNA, 16 bp, H. sapiens
tggtgcagtctaggct

SEQ ID NO: 152977 - DNA, 16 bp, H. sapiens
tggtgcatgcctttgg

SEQ ID NO: 152978 - DNA, 16 bp, H. sapiens
tggtgccaacaatgca

SEQ ID NO: 152979 - DNA, 16 bp, H. sapiens
tggtgccagttcctcc

SEQ ID NO: 152980 - DNA, 16 bp, H. sapiens
tggtgccatcatagct

SEQ ID NO: 152981 - DNA, 19 bp, H. sapiens
tggtgccatctcggctcac

SEQ ID NO: 152982 - DNA, 16 bp, H. sapiens
tggtgccattgcactt

SEQ ID NO: 152983 - DNA, 16 bp, H. sapiens
tggtgcccaggcagct

SEQ ID NO: 152984 - DNA, 16 bp, H. sapiens
tggtgcccaggctgtt

SEQ ID NO: 152985 - DNA, 16 bp, H. sapiens
tggtgccctgcgtccc

SEQ ID NO: 152986 - DNA, 20 bp, H. sapiens
tggtgcctcacacctgtaat

SEQ ID NO: 152987 - DNA, 16 bp, H. sapiens
tggtgcctcagtttct

SEQ ID NO: 152988 - DNA, 18 bp, H. sapiens
tggtgcctcatgcctgta

SEQ ID NO: 152989 - DNA, 16 bp, H. sapiens
tggtgcctgcctatag

SEQ ID NO: 152990 - DNA, 16 bp, H. sapiens
tggtgcctggtgggag

SEQ ID NO: 152991 - DNA, 16 bp, H. sapiens
tggtgcgatcacagct

SEQ ID NO: 152992 - DNA, 19 bp, H. sapiens
tggtgcgatctcggttcac

SEQ ID NO: 152993 - DNA, 18 bp, H. sapiens
tggtgcgatcttggctct

SEQ ID NO: 152994 - DNA, 18 bp, H. sapiens
tggtgcgatcttggttca

SEQ ID NO: 152995 - DNA, 18 bp, H. sapiens
tggtgctatcttggctca

SEQ ID NO: 152996 - DNA, 16 bp, H. sapiens
tggtgctcatgcctgt

SEQ ID NO: 152997 - DNA, 16 bp, H. sapiens
tggtgctgctgcactc

SEQ ID NO: 152998 - DNA, 16 bp, H. sapiens
tggtgctggaaaaact

SEQ ID NO: 152999 - DNA, 16 bp, H. sapiens
tggtgctggaacaatt

SEQ ID NO: 153000 - DNA, 16 bp, H. sapiens
tggtgctggagcaatt

SEQ ID NO: 153001 - DNA, 16 bp, H. sapiens
tggtgctggctgcaac

SEQ ID NO: 153002 - DNA, 16 bp, H. sapiens
tggtgctggctgttgg

SEQ ID NO: 153003 - DNA, 16 bp, H. sapiens
tggtgctgggaaaaca

SEQ ID NO: 153004 - DNA, 16 bp, H. sapiens
tggtgctgggaaaatg

SEQ ID NO: 153005 - DNA, 16 bp, H. sapiens
tggtgctgggacagct

SEQ ID NO: 153006 - DNA, 16 bp, H. sapiens
tggtgctgggcgcctg

SEQ ID NO: 153007 - DNA, 16 bp, H. sapiens
tggtgctggggaaact

SEQ ID NO: 153008 - DNA, 16 bp, H. sapiens
tggtgctggtcacccc

SEQ ID NO: 153009 - DNA, 16 bp, H. sapiens
tggtgctgtcctcgtg

SEQ ID NO: 153010 - DNA, 16 bp, H. sapiens
tggtgctgtctttgtg

SEQ ID NO: 153011 - DNA, 16 bp, H. sapiens
tggtgcttacattcta

SEQ ID NO: 153012 - DNA, 16 bp, H. sapiens
tggtgcttggcacaca

SEQ ID NO: 153013 - DNA, 16 bp, H. sapiens
tggtggaaaaggaaat

SEQ ID NO: 153014 - DNA, 16 bp, H. sapiens
tggtggaaagcaaaag

SEQ ID NO: 153015 - DNA, 16 bp, H. sapiens
tggtggaaagcaaagg

SEQ ID NO: 153016 - DNA, 16 bp, H. sapiens
tggtggaaagtggaag

SEQ ID NO: 153017 - DNA, 16 bp, H. sapiens
tggtggaaatgcaaaa

SEQ ID NO: 153018 - DNA, 16 bp, H. sapiens
tggtggaaatgtaaaa

SEQ ID NO: 153019 - DNA, 16 bp, H. sapiens
tggtggaactaattta

SEQ ID NO: 153020 - DNA, 16 bp, H. sapiens
tggtggaagaaggatt

SEQ ID NO: 153021 - DNA, 16 bp, H. sapiens
tggtggaagacaagga

SEQ ID NO: 153022 - DNA, 16 bp, H. sapiens
tggtggaaggaaaaat

SEQ ID NO: 153023 - DNA, 16 bp, H. sapiens
tggtggaaggaaagga

SEQ ID NO: 153024 - DNA, 16 bp, H. sapiens
tggtggaaggagaaag

SEQ ID NO: 153025 - DNA, 16 bp, H. sapiens
tggtggaaggagaagc

SEQ ID NO: 153026 - DNA, 16 bp, H. sapiens
tggtggaaggcaaagt

SEQ ID NO: 153027 - DNA, 16 bp, H. sapiens
tggtggaaggcaagag

SEQ ID NO: 153028 - DNA, 16 bp, H. sapiens
tggtggaaggtgaaag

SEQ ID NO: 153029 - DNA, 16 bp, H. sapiens
tggtggaaggtgatgg

SEQ ID NO: 153030 - DNA, 16 bp, H. sapiens
tggtggaaggtgattg

SEQ ID NO: 153031 - DNA, 16 bp, H. sapiens
tggtggaaggtggaag

SEQ ID NO: 153032 - DNA, 16 bp, H. sapiens
tggtggaagtataaat

SEQ ID NO: 153033 - DNA, 16 bp, H. sapiens
tggtggaagtgatgct

SEQ ID NO: 153034 - DNA, 16 bp, H. sapiens
tggtggagaaggactc

SEQ ID NO: 153035 - DNA, 16 bp, H. sapiens
tggtggagacggggtt

SEQ ID NO: 153036 - DNA, 16 bp, H. sapiens
tggtggagatgggatt

SEQ ID NO: 153037 - DNA, 16 bp, H. sapiens
tggtggagctgaaaaa

SEQ ID NO: 153038 - DNA, 16 bp, H. sapiens
tggtggaggatgagga

SEQ ID NO: 153039 - DNA, 16 bp, H. sapiens
tggtggaggtggctgg

SEQ ID NO: 153040 - DNA, 16 bp, H. sapiens
tggtggagtctttaga

SEQ ID NO: 153041 - DNA, 16 bp, H. sapiens
tggtggataacctttt

SEQ ID NO: 153042 - DNA, 16 bp, H. sapiens
tggtggataaggcatt

SEQ ID NO: 153043 - DNA, 16 bp, H. sapiens
tggtggatacactttt

SEQ ID NO: 153044 - DNA, 16 bp, H. sapiens
tggtggatcacttgag

SEQ ID NO: 153045 - DNA, 16 bp, H. sapiens
tggtggatcagctttt

SEQ ID NO: 153046 - DNA, 16 bp, H. sapiens
tggtggcacatgccag

SEQ ID NO: 153047 - DNA, 16 bp, H. sapiens
tggtggcacatgcttg

SEQ ID NO: 153048 - DNA, 16 bp, H. sapiens
tggtggcaccactgca

SEQ ID NO: 153049 - DNA, 16 bp, H. sapiens
tggtggcaccagcctg

SEQ ID NO: 153050 - DNA, 17 bp, H. sapiens
tggtggcacgcgcctat

SEQ ID NO: 153051 - DNA, 16 bp, H. sapiens
tggtggcagaattcaa

SEQ ID NO: 153052 - DNA, 16 bp, H. sapiens
tggtggcagacaagaa

SEQ ID NO: 153053 - DNA, 16 bp, H. sapiens
tggtggcagacacctg

SEQ ID NO: 153054 - DNA, 16 bp, H. sapiens
tggtggcagagatgga

SEQ ID NO: 153055 - DNA, 16 bp, H. sapiens
tggtggcagagccagg

SEQ ID NO: 153056 - DNA, 16 bp, H. sapiens
tggtggcagaggtggg

SEQ ID NO: 153057 - DNA, 16 bp, H. sapiens
tggtggcagagtgaga

SEQ ID NO: 153058 - DNA, 16 bp, H. sapiens
tggtggcagatacctg

SEQ ID NO: 153059 - DNA, 16 bp, H. sapiens
tggtggcagcaagaga

SEQ ID NO: 153060 - DNA, 16 bp, H. sapiens
tggtggcagcagcagg

SEQ ID NO: 153061 - DNA, 16 bp, H. sapiens
tggtggcaggcaaaga

SEQ ID NO: 153062 - DNA, 16 bp, H. sapiens
tggtggcaggcgccca

SEQ ID NO: 153063 - DNA, 17 bp, H. sapiens
tggtggcaggttgatta

SEQ ID NO: 153064 - DNA, 16 bp, H. sapiens
tggtggcagtagcagt

SEQ ID NO: 153065 - DNA, 16 bp, H. sapiens
tggtggcagtggtggc

SEQ ID NO: 153066 - DNA, 16 bp, H. sapiens
tggtggcatctgcttc

SEQ ID NO: 153067 - DNA, 16 bp, H. sapiens
tggtggcatgagcctg

SEQ ID NO: 153068 - DNA, 16 bp, H. sapiens
tggtggcatgcatgtg

SEQ ID NO: 153069 - DNA, 16 bp, H. sapiens
tggtggcatgtgcctg

SEQ ID NO: 153070 - DNA, 16 bp, H. sapiens
tggtggccacagggtg

SEQ ID NO: 153071 - DNA, 16 bp, H. sapiens
tggtggccacagtggt

SEQ ID NO: 153072 - DNA, 16 bp, H. sapiens
tggtggcccacgccta

SEQ ID NO: 153073 - DNA, 16 bp, H. sapiens
tggtggcccacgcctg

SEQ ID NO: 153074 - DNA, 16 bp, H. sapiens
tggtggcctgtgtctg

SEQ ID NO: 153075 - DNA, 17 bp, H. sapiens
tggtggcgcacacctgc

SEQ ID NO: 153076 - DNA, 16 bp, H. sapiens
tggtggcgctcacctg

SEQ ID NO: 153077 - DNA, 16 bp, H. sapiens
tggtggcgggtgccca

SEQ ID NO: 153078 - DNA, 16 bp, H. sapiens
tggtggcggtcgcctg

SEQ ID NO: 153079 - DNA, 16 bp, H. sapiens
tggtggcggtgcctgt

SEQ ID NO: 153080 - DNA, 16 bp, H. sapiens
tggtggcgtgtccctg

SEQ ID NO: 153081 - DNA, 16 bp, H. sapiens
tggtggctaacgcctg

SEQ ID NO: 153082 - DNA, 16 bp, H. sapiens
tggtggctcaagcctg

SEQ ID NO: 153083 - DNA, 16 bp, H. sapiens
tggtggctcaagtctg

SEQ ID NO: 153084 - DNA, 16 bp, H. sapiens
tggtggctcacacctg

SEQ ID NO: 153085 - DNA, 16 bp, H. sapiens
tggtggctcacgccca

SEQ ID NO: 153086 - DNA, 16 bp, H. sapiens
tggtggctcacgcctg

SEQ ID NO: 153087 - DNA, 28 bp, H. sapiens
tggtggctcacgcctgtaatcccagcat

SEQ ID NO: 153088 - DNA, 17 bp, H. sapiens
tggtggctcacggctgt

SEQ ID NO: 153089 - DNA, 16 bp, H. sapiens
tggtggctcacttctg

SEQ ID NO: 153090 - DNA, 16 bp, H. sapiens
tggtggctcaggcctg

SEQ ID NO: 153091 - DNA, 16 bp, H. sapiens
tggtggctcatccctg

SEQ ID NO: 153092 - DNA, 16 bp, H. sapiens
tggtggctcatgccag

SEQ ID NO: 153093 - DNA, 16 bp, H. sapiens
tggtggctcatgcctg

SEQ ID NO: 153094 - DNA, 18 bp, H. sapiens
tggtggctcatgcctgtg

SEQ ID NO: 153095 - DNA, 16 bp, H. sapiens
tggtggctcatgtctg

SEQ ID NO: 153096 - DNA, 16 bp, H. sapiens
tggtggctcccacctg

SEQ ID NO: 153097 - DNA, 16 bp, H. sapiens
tggtggctccctcctg

SEQ ID NO: 153098 - DNA, 16 bp, H. sapiens
tggtggctcctgcctg

SEQ ID NO: 153099 - DNA, 16 bp, H. sapiens
tggtggctctcgcctg

SEQ ID NO: 153100 - DNA, 17 bp, H. sapiens
tggtggctgacacctgt

SEQ ID NO: 153101 - DNA, 16 bp, H. sapiens
tggtggctgacgcctg

SEQ ID NO: 153102 - DNA, 16 bp, H. sapiens
tggtggctgaggcctg

SEQ ID NO: 153103 - DNA, 16 bp, H. sapiens
tggtggctgatgcctg

SEQ ID NO: 153104 - DNA, 16 bp, H. sapiens
tggtggctggcaagat

SEQ ID NO: 153105 - DNA, 16 bp, H. sapiens
tggtggctggctcctg

SEQ ID NO: 153106 - DNA, 16 bp, H. sapiens
tggtggctggtggcct

SEQ ID NO: 153107 - DNA, 16 bp, H. sapiens
tggtggcttacacctg

SEQ ID NO: 153108 - DNA, 16 bp, H. sapiens
tggtggcttacagctg

SEQ ID NO: 153109 - DNA, 16 bp, H. sapiens
tggtggcttaggcctg

SEQ ID NO: 153110 - DNA, 16 bp, H. sapiens
tggtggcttatgcctg

SEQ ID NO: 153111 - DNA, 16 bp, H. sapiens
tggtggcttgcacctg

SEQ ID NO: 153112 - DNA, 16 bp, H. sapiens
tggtggctttggtggc

SEQ ID NO: 153113 - DNA, 16 bp, H. sapiens
tggtgggaaagaaaaa

SEQ ID NO: 153114 - DNA, 16 bp, H. sapiens
tggtgggaatgtgaaa

SEQ ID NO: 153115 - DNA, 16 bp, H. sapiens
tggtgggagcaggaga

SEQ ID NO: 153116 - DNA, 16 bp, H. sapiens
tggtgggaggcctcag

SEQ ID NO: 153117 - DNA, 16 bp, H. sapiens
tggtgggaggtggctg

SEQ ID NO: 153118 - DNA, 17 bp, H. sapiens
tggtgggagtgtaaatt

SEQ ID NO: 153119 - DNA, 16 bp, H. sapiens
tggtgggcagggggct

SEQ ID NO: 153120 - DNA, 16 bp, H. sapiens
tggtgggccccgcact

SEQ ID NO: 153121 - DNA, 16 bp, H. sapiens
tggtgggccctgcact

SEQ ID NO: 153122 - DNA, 16 bp, H. sapiens
tggtgggctgggcagg

SEQ ID NO: 153123 - DNA, 16 bp, H. sapiens
tggtggggaatgttga

SEQ ID NO: 153124 - DNA, 16 bp, H. sapiens
tggtggggacttggaa

SEQ ID NO: 153125 - DNA, 19 bp, H. sapiens
tggtggggagataagaacc

SEQ ID NO: 153126 - DNA, 16 bp, H. sapiens
tggtggggctgaggca

SEQ ID NO: 153127 - DNA, 16 bp, H. sapiens
tggtgggggctgtcct

SEQ ID NO: 153128 - DNA, 16 bp, H. sapiens
tggtgggtcacacctg

SEQ ID NO: 153129 - DNA, 16 bp, H. sapiens
tggtgggtccaggtgg

SEQ ID NO: 153130 - DNA, 16 bp, H. sapiens
tggtgggtggggccct

SEQ ID NO: 153131 - DNA, 16 bp, H. sapiens
tggtgggtgtgtaaat

SEQ ID NO: 153132 - DNA, 16 bp, H. sapiens
tggtggtaatgtaaaa

SEQ ID NO: 153133 - DNA, 16 bp, H. sapiens
tggtggtacatgccag

SEQ ID NO: 153134 - DNA, 16 bp, H. sapiens
tggtggtcttttggat

SEQ ID NO: 153135 - DNA, 16 bp, H. sapiens
tggtggtgacagtggt

SEQ ID NO: 153136 - DNA, 16 bp, H. sapiens
tggtggtgagggcctg

SEQ ID NO: 153137 - DNA, 16 bp, H. sapiens
tggtggtgatgaagat

SEQ ID NO: 153138 - DNA, 16 bp, H. sapiens
tggtggtgatgatgac

SEQ ID NO: 153139 - DNA, 16 bp, H. sapiens
tggtggtgatgctgat

SEQ ID NO: 153140 - DNA, 16 bp, H. sapiens
tggtggtgatggctgt

SEQ ID NO: 153141 - DNA, 16 bp, H. sapiens
tggtggtgatggtgat

SEQ ID NO: 153142 - DNA, 16 bp, H. sapiens
tggtggtgcagcctgt

SEQ ID NO: 153143 - DNA, 16 bp, H. sapiens
tggtggtgcatgcctc

SEQ ID NO: 153144 - DNA, 16 bp, H. sapiens
tggtggtgcccacctg

SEQ ID NO: 153145 - DNA, 16 bp, H. sapiens
tggtggtgctcatctg

SEQ ID NO: 153146 - DNA, 16 bp, H. sapiens
tggtggtggacgcctg

SEQ ID NO: 153147 - DNA, 16 bp, H. sapiens
tggtggtggactcctg

SEQ ID NO: 153148 - DNA, 16 bp, H. sapiens
tggtggtggagatgga

SEQ ID NO: 153149 - DNA, 16 bp, H. sapiens
tggtggtggaggccaa

SEQ ID NO: 153150 - DNA, 16 bp, H. sapiens
tggtggtggcaagaca

SEQ ID NO: 153151 - DNA, 16 bp, H. sapiens
tggtggtggcagcagc

SEQ ID NO: 153152 - DNA, 16 bp, H. sapiens
tggtggtggcagtggg

SEQ ID NO: 153153 - DNA, 16 bp, H. sapiens
tggtggtggccacaag

SEQ ID NO: 153154 - DNA, 16 bp, H. sapiens
tggtggtggctatggg

SEQ ID NO: 153155 - DNA, 16 bp, H. sapiens
tggtggtgggaatgta

SEQ ID NO: 153156 - DNA, 16 bp, H. sapiens
tggtggtgggaggcag

SEQ ID NO: 153157 - DNA, 16 bp, H. sapiens
tggtggtgggcactgt

SEQ ID NO: 153158 - DNA, 16 bp, H. sapiens
tggtggtgggcccctg

SEQ ID NO: 153159 - DNA, 16 bp, H. sapiens
tggtggtgggtgcagg

SEQ ID NO: 153160 - DNA, 16 bp, H. sapiens
tggtggtgggtgccag

SEQ ID NO: 153161 - DNA, 16 bp, H. sapiens
tggtggtgggtgccca

SEQ ID NO: 153162 - DNA, 16 bp, H. sapiens
tggtggtggtagtagt

SEQ ID NO: 153163 - DNA, 16 bp, H. sapiens
tggtggtggtgatgat

SEQ ID NO: 153164 - DNA, 16 bp, H. sapiens
tggtggtggtgcctgt

SEQ ID NO: 153165 - DNA, 16 bp, H. sapiens
tggtggtggtggcaat

SEQ ID NO: 153166 - DNA, 16 bp, H. sapiens
tggtggtggtggcagc

SEQ ID NO: 153167 - DNA, 16 bp, H. sapiens
tggtggtggtggtgca

SEQ ID NO: 153168 - DNA, 16 bp, H. sapiens
tggtggtgtgaacctg

SEQ ID NO: 153169 - DNA, 17 bp, H. sapiens
tggtggtgtgcacctgt

SEQ ID NO: 153170 - DNA, 16 bp, H. sapiens
tggtggttcacgcctg

SEQ ID NO: 153171 - DNA, 16 bp, H. sapiens
tggtggttcatccctg

SEQ ID NO: 153172 - DNA, 18 bp, H. sapiens
tggtggttcatgcctata

SEQ ID NO: 153173 - DNA, 16 bp, H. sapiens
tggtggttcatgcctg

SEQ ID NO: 153174 - DNA, 16 bp, H. sapiens
tggtggttcattcctg

SEQ ID NO: 153175 - DNA, 16 bp, H. sapiens
tggtggttcctcaaaa

SEQ ID NO: 153176 - DNA, 16 bp, H. sapiens
tggtggttctattttt

SEQ ID NO: 153177 - DNA, 16 bp, H. sapiens
tggtggttgccagcaa

SEQ ID NO: 153178 - DNA, 16 bp, H. sapiens
tggtggttgctgaagg

SEQ ID NO: 153179 - DNA, 16 bp, H. sapiens
tggtggtttatgcctg

SEQ ID NO: 153180 - DNA, 16 bp, H. sapiens
tggtggtttgctgcac

SEQ ID NO: 153181 - DNA, 16 bp, H. sapiens
tggtgtaaataaacct

SEQ ID NO: 153182 - DNA, 16 bp, H. sapiens
tggtgtacagtggcat

SEQ ID NO: 153183 - DNA, 18 bp, H. sapiens
tggtgtacctgaaagtca

SEQ ID NO: 153184 - DNA, 16 bp, H. sapiens
tggtgtagccaccttc

SEQ ID NO: 153185 - DNA, 17 bp, H. sapiens
tggtgtataggaatgct

SEQ ID NO: 153186 - DNA, 16 bp, H. sapiens
tggtgtatatgtatca

SEQ ID NO: 153187 - DNA, 16 bp, H. sapiens
tggtgtatctgtgcca

SEQ ID NO: 153188 - DNA, 16 bp, H. sapiens
tggtgtcagagaaggc

SEQ ID NO: 153189 - DNA, 16 bp, H. sapiens
tggtgtcagaggaggc

SEQ ID NO: 153190 - DNA, 16 bp, H. sapiens
tggtgtcatcttggct

SEQ ID NO: 153191 - DNA, 16 bp, H. sapiens
tggtgtccactgcttg

SEQ ID NO: 153192 - DNA, 16 bp, H. sapiens
tggtgtccaggaagaa

SEQ ID NO: 153193 - DNA, 16 bp, H. sapiens
tggtgtccaggcatgt

SEQ ID NO: 153194 - DNA, 16 bp, H. sapiens
tggtgtcctcataaga

SEQ ID NO: 153195 - DNA, 16 bp, H. sapiens
tggtgtctcacacctg

SEQ ID NO: 153196 - DNA, 16 bp, H. sapiens
tggtgtctcttcttct

SEQ ID NO: 153197 - DNA, 16 bp, H. sapiens
tggtgtctgctgaggg

SEQ ID NO: 153198 - DNA, 16 bp, H. sapiens
tggtgtctggcgaggg

SEQ ID NO: 153199 - DNA, 16 bp, H. sapiens
tggtgtctgggaactt

SEQ ID NO: 153200 - DNA, 16 bp, H. sapiens
tggtgtcttatgcctg

SEQ ID NO: 153201 - DNA, 16 bp, H. sapiens
tggtgtctttgtcata

SEQ ID NO: 153202 - DNA, 16 bp, H. sapiens
tggtgtgaatgtgtgt

SEQ ID NO: 153203 - DNA, 16 bp, H. sapiens
tggtgtgagcctggga

SEQ ID NO: 153204 - DNA, 16 bp, H. sapiens
tggtgtgataatagct

SEQ ID NO: 153205 - DNA, 16 bp, H. sapiens
tggtgtgatcatggct

SEQ ID NO: 153206 - DNA, 16 bp, H. sapiens
tggtgtgatctcagca

SEQ ID NO: 153207 - DNA, 17 bp, H. sapiens
tggtgtgatcttgcctc

SEQ ID NO: 153208 - DNA, 16 bp, H. sapiens
tggtgtgccatttgct

SEQ ID NO: 153209 - DNA, 17 bp, H. sapiens
tggtgtgcctgaaagtg

SEQ ID NO: 153210 - DNA, 16 bp, H. sapiens
tggtgtgcgcctgcag

SEQ ID NO: 153211 - DNA, 22 bp, H. sapiens
tggtgtgctgcacccattaact

SEQ ID NO: 153212 - DNA, 16 bp, H. sapiens
tggtgtgctgcacctg

SEQ ID NO: 153213 - DNA, 16 bp, H. sapiens
tggtgtgctgcgccca

SEQ ID NO: 153214 - DNA, 16 bp, H. sapiens
tggtgtggacccaaag

SEQ ID NO: 153215 - DNA, 16 bp, H. sapiens
tggtgtggtcatggct

SEQ ID NO: 153216 - DNA, 16 bp, H. sapiens
tggtgtggtgctgaaa

SEQ ID NO: 153217 - DNA, 16 bp, H. sapiens
tggtgtgtccagagtt

SEQ ID NO: 153218 - DNA, 16 bp, H. sapiens
tggtgtgtccggaatt

SEQ ID NO: 153219 - DNA, 16 bp, H. sapiens
tggtgtgttcctgtgg

SEQ ID NO: 153220 - DNA, 16 bp, H. sapiens
tggtgtgtttacaatc

SEQ ID NO: 153221 - DNA, 16 bp, H. sapiens
tggtgttatccccttt

SEQ ID NO: 153222 - DNA, 16 bp, H. sapiens
tggtgttcttcctgtg

SEQ ID NO: 153223 - DNA, 16 bp, H. sapiens
tggtgttgagaagaat

SEQ ID NO: 153224 - DNA, 16 bp, H. sapiens
tggtgttgagcctaca

SEQ ID NO: 153225 - DNA, 16 bp, H. sapiens
tggtgttgggacaact

SEQ ID NO: 153226 - DNA, 16 bp, H. sapiens
tggtgttgtcagtatt

SEQ ID NO: 153227 - DNA, 16 bp, H. sapiens
tggtgttgtgtacctg

SEQ ID NO: 153228 - DNA, 16 bp, H. sapiens
tggtgtttctcaaact

SEQ ID NO: 153229 - DNA, 16 bp, H. sapiens
tggtgtttgctggagg

SEQ ID NO: 153230 - DNA, 16 bp, H. sapiens
tggtgtttggctggag

SEQ ID NO: 153231 - DNA, 16 bp, H. sapiens
tggttaaaaaaatcaa

SEQ ID NO: 153232 - DNA, 16 bp, H. sapiens
tggttaaataaattat

SEQ ID NO: 153233 - DNA, 16 bp, H. sapiens
tggttaaatttatttg

SEQ ID NO: 153234 - DNA, 16 bp, H. sapiens
tggttaacagatacaa

SEQ ID NO: 153235 - DNA, 16 bp, H. sapiens
tggttaaggtggtatc

SEQ ID NO: 153236 - DNA, 16 bp, H. sapiens
tggttaatctttcctg

SEQ ID NO: 153237 - DNA, 16 bp, H. sapiens
tggttaattttatgtg

SEQ ID NO: 153238 - DNA, 16 bp, H. sapiens
tggttacatggatgaa

SEQ ID NO: 153239 - DNA, 16 bp, H. sapiens
tggttaccagaggctg

SEQ ID NO: 153240 - DNA, 16 bp, H. sapiens
tggttaccagaggttg

SEQ ID NO: 153241 - DNA, 16 bp, H. sapiens
tggttaccatggggat

SEQ ID NO: 153242 - DNA, 16 bp, H. sapiens
tggttactgtggcttt

SEQ ID NO: 153243 - DNA, 17 bp, H. sapiens
tggttagctgtattcct

SEQ ID NO: 153244 - DNA, 16 bp, H. sapiens
tggttatctattgtta

SEQ ID NO: 153245 - DNA, 16 bp, H. sapiens
tggttattcagggtct

SEQ ID NO: 153246 - DNA, 16 bp, H. sapiens
tggttattgtagcttt

SEQ ID NO: 153247 - DNA, 16 bp, H. sapiens
tggttatttaaaagtg

SEQ ID NO: 153248 - DNA, 16 bp, H. sapiens
tggttattttgcacat

SEQ ID NO: 153249 - DNA, 16 bp, H. sapiens
tggttattttgccagt

SEQ ID NO: 153250 - DNA, 16 bp, H. sapiens
tggttcaaagaagaaa

SEQ ID NO: 153251 - DNA, 20 bp, H. sapiens
tggttcaagcaattcccctg

SEQ ID NO: 153252 - DNA, 16 bp, H. sapiens
tggttcaagcgattct

SEQ ID NO: 153253 - DNA, 16 bp, H. sapiens
tggttcaagtgattct

SEQ ID NO: 153254 - DNA, 16 bp, H. sapiens
tggttcactgcaaccc

SEQ ID NO: 153255 - DNA, 16 bp, H. sapiens
tggttcagtctggaaa

SEQ ID NO: 153256 - DNA, 17 bp, H. sapiens
tggttcatacctgtaat

SEQ ID NO: 153257 - DNA, 16 bp, H. sapiens
tggttcatgcctgtga

SEQ ID NO: 153258 - DNA, 16 bp, H. sapiens
tggttcattattgaat

SEQ ID NO: 153259 - DNA, 16 bp, H. sapiens
tggttcattccacaca

SEQ ID NO: 153260 - DNA, 16 bp, H. sapiens
tggttccagctactcg

SEQ ID NO: 153261 - DNA, 16 bp, H. sapiens
tggttccagctatttg

SEQ ID NO: 153262 - DNA, 16 bp, H. sapiens
tggttccagcttttgc

SEQ ID NO: 153263 - DNA, 16 bp, H. sapiens
tggttccaggaccttc

SEQ ID NO: 153264 - DNA, 16 bp, H. sapiens
tggttccagtgattct

SEQ ID NO: 153265 - DNA, 16 bp, H. sapiens
tggttccataagatta

SEQ ID NO: 153266 - DNA, 16 bp, H. sapiens
tggttccatatgaact

SEQ ID NO: 153267 - DNA, 16 bp, H. sapiens
tggttccattccttct

SEQ ID NO: 153268 - DNA, 16 bp, H. sapiens
tggttccattctctct

SEQ ID NO: 153269 - DNA, 16 bp, H. sapiens
tggttccctgcagcct

SEQ ID NO: 153270 - DNA, 16 bp, H. sapiens
tggttcccttttctcc

SEQ ID NO: 153271 - DNA, 16 bp, H. sapiens
tggttcctgacacaga

SEQ ID NO: 153272 - DNA, 16 bp, H. sapiens
tggttcctgccctcag

SEQ ID NO: 153273 - DNA, 16 bp, H. sapiens
tggttcctttctcccc

SEQ ID NO: 153274 - DNA, 16 bp, H. sapiens
tggttctattctccct

SEQ ID NO: 153275 - DNA, 16 bp, H. sapiens
tggttctcaaacatta

SEQ ID NO: 153276 - DNA, 16 bp, H. sapiens
tggttctcaaacctta

SEQ ID NO: 153277 - DNA, 16 bp, H. sapiens
tggttctcaaacttaa

SEQ ID NO: 153278 - DNA, 16 bp, H. sapiens
tggttctcagaccttc

SEQ ID NO: 153279 - DNA, 16 bp, H. sapiens
tggttctcagctgggg

SEQ ID NO: 153280 - DNA, 16 bp, H. sapiens
tggttctcagcttgaa

SEQ ID NO: 153281 - DNA, 16 bp, H. sapiens
tggttctcaggctttt

SEQ ID NO: 153282 - DNA, 16 bp, H. sapiens
tggttctccagttctt

SEQ ID NO: 153283 - DNA, 16 bp, H. sapiens
tggttctccattcctg

SEQ ID NO: 153284 - DNA, 16 bp, H. sapiens
tggttctgaatcaagg

SEQ ID NO: 153285 - DNA, 16 bp, H. sapiens
tggttctgatttgtat

SEQ ID NO: 153286 - DNA, 16 bp, H. sapiens
tggttctgcaggatgt

SEQ ID NO: 153287 - DNA, 16 bp, H. sapiens
tggttctgctttttgc

SEQ ID NO: 153288 - DNA, 16 bp, H. sapiens
tggttctggaggctgg

SEQ ID NO: 153289 - DNA, 16 bp, H. sapiens
tggttctggatccttg

SEQ ID NO: 153290 - DNA, 16 bp, H. sapiens
tggttctgtccctctg

SEQ ID NO: 153291 - DNA, 16 bp, H. sapiens
tggttgaaaacttccc

SEQ ID NO: 153292 - DNA, 16 bp, H. sapiens
tggttgaatgaataaa

SEQ ID NO: 153293 - DNA, 16 bp, H. sapiens
tggttgagaaccactg

SEQ ID NO: 153294 - DNA, 16 bp, H. sapiens
tggttgagaatcactg

SEQ ID NO: 153295 - DNA, 16 bp, H. sapiens
tggttgaggtgatgga

SEQ ID NO: 153296 - DNA, 16 bp, H. sapiens
tggttgcagctggagg

SEQ ID NO: 153297 - DNA, 16 bp, H. sapiens
tggttgcagtgagcca

SEQ ID NO: 153298 - DNA, 16 bp, H. sapiens
tggttgccagtgaagg

SEQ ID NO: 153299 - DNA, 16 bp, H. sapiens
tggttgcgccactgca

SEQ ID NO: 153300 - DNA, 16 bp, H. sapiens
tggttgctcacgcctg

SEQ ID NO: 153301 - DNA, 16 bp, H. sapiens
tggttgctttccacaa

SEQ ID NO: 153302 - DNA, 16 bp, H. sapiens
tggttggaaattattt

SEQ ID NO: 153303 - DNA, 16 bp, H. sapiens
tggttggaatttcttt

SEQ ID NO: 153304 - DNA, 16 bp, H. sapiens
tggttggactgtaaac

SEQ ID NO: 153305 - DNA, 16 bp, H. sapiens
tggttggagaagggag

SEQ ID NO: 153306 - DNA, 16 bp, H. sapiens
tggttggagatgttat

SEQ ID NO: 153307 - DNA, 16 bp, H. sapiens
tggttggagcaggagg

SEQ ID NO: 153308 - DNA, 16 bp, H. sapiens
tggttggttcccctgg

SEQ ID NO: 153309 - DNA, 16 bp, H. sapiens
tggttggttgtatttc

SEQ ID NO: 153310 - DNA, 16 bp, H. sapiens
tggttgtcacaactag

SEQ ID NO: 153311 - DNA, 16 bp, H. sapiens
tggttgtcacaactga

SEQ ID NO: 153312 - DNA, 16 bp, H. sapiens
tggttgtcacagctgg

SEQ ID NO: 153313 - DNA, 17 bp, H. sapiens
tggttgtcctcactgct

SEQ ID NO: 153314 - DNA, 16 bp, H. sapiens
tggttgtttaaaaagt

SEQ ID NO: 153315 - DNA, 17 bp, H. sapiens
tggttgtttaaaagagt

SEQ ID NO: 153316 - DNA, 16 bp, H. sapiens
tggtttaaaaagaaaa

SEQ ID NO: 153317 - DNA, 16 bp, H. sapiens
tggtttaaacaacaga

SEQ ID NO: 153318 - DNA, 17 bp, H. sapiens
tggtttaacatacgcaa

SEQ ID NO: 153319 - DNA, 16 bp, H. sapiens
tggtttagtcttgtga

SEQ ID NO: 153320 - DNA, 16 bp, H. sapiens
tggtttataaagaaaa

SEQ ID NO: 153321 - DNA, 16 bp, H. sapiens
tggtttatagttttct

SEQ ID NO: 153322 - DNA, 16 bp, H. sapiens
tggtttatcttggtga

SEQ ID NO: 153323 - DNA, 16 bp, H. sapiens
tggtttatgcagaaat

SEQ ID NO: 153324 - DNA, 16 bp, H. sapiens
tggtttattataaaag

SEQ ID NO: 153325 - DNA, 16 bp, H. sapiens
tggtttatttcactta

SEQ ID NO: 153326 - DNA, 16 bp, H. sapiens
tggtttattttgctgt

SEQ ID NO: 153327 - DNA, 16 bp, H. sapiens
tggtttcaaataactt

SEQ ID NO: 153328 - DNA, 16 bp, H. sapiens
tggtttcaaatcccag

SEQ ID NO: 153329 - DNA, 17 bp, H. sapiens
tggtttcaagcttcatc

SEQ ID NO: 153330 - DNA, 16 bp, H. sapiens
tggtttcaagtgatcc

SEQ ID NO: 153331 - DNA, 16 bp, H. sapiens
tggtttcaccatgttg

SEQ ID NO: 153332 - DNA, 16 bp, H. sapiens
tggtttcatataaatt

SEQ ID NO: 153333 - DNA, 16 bp, H. sapiens
tggtttcatatttttg

SEQ ID NO: 153334 - DNA, 16 bp, H. sapiens
tggtttcatgggctgg

SEQ ID NO: 153335 - DNA, 16 bp, H. sapiens
tggtttcatttttctg

SEQ ID NO: 153336 - DNA, 16 bp, H. sapiens
tggtttcctgggctgg

SEQ ID NO: 153337 - DNA, 16 bp, H. sapiens
tggtttcctggggctg

SEQ ID NO: 153338 - DNA, 16 bp, H. sapiens
tggtttccttataaga

SEQ ID NO: 153339 - DNA, 16 bp, H. sapiens
tggtttcgaactccta

SEQ ID NO: 153340 - DNA, 16 bp, H. sapiens
tggtttctatctcctg

SEQ ID NO: 153341 - DNA, 16 bp, H. sapiens
tggtttctgtttgcat

SEQ ID NO: 153342 - DNA, 16 bp, H. sapiens
tggtttcttagatatg

SEQ ID NO: 153343 - DNA, 16 bp, H. sapiens
tggtttcttgagatga

SEQ ID NO: 153344 - DNA, 16 bp, H. sapiens
tggtttcttttactta

SEQ ID NO: 153345 - DNA, 16 bp, H. sapiens
tggtttgaatatgtcc

SEQ ID NO: 153346 - DNA, 16 bp, H. sapiens
tggtttgaatatgtgt

SEQ ID NO: 153347 - DNA, 16 bp, H. sapiens
tggtttgactctgtcc

SEQ ID NO: 153348 - DNA, 16 bp, H. sapiens
tggtttgagcccagaa

SEQ ID NO: 153349 - DNA, 16 bp, H. sapiens
tggtttgcaatattga

SEQ ID NO: 153350 - DNA, 16 bp, H. sapiens
tggtttgcagacagct

SEQ ID NO: 153351 - DNA, 16 bp, H. sapiens
tggtttgcatttgaaa

SEQ ID NO: 153352 - DNA, 16 bp, H. sapiens
tggtttgcattttcct

SEQ ID NO: 153353 - DNA, 16 bp, H. sapiens
tggtttgccaggggtt

SEQ ID NO: 153354 - DNA, 16 bp, H. sapiens
tggtttgctgcatcta

SEQ ID NO: 153355 - DNA, 16 bp, H. sapiens
tggtttggaattgaaa

SEQ ID NO: 153356 - DNA, 16 bp, H. sapiens
tggtttggaattggaa

SEQ ID NO: 153357 - DNA, 16 bp, H. sapiens
tggtttggatatggtt

SEQ ID NO: 153358 - DNA, 16 bp, H. sapiens
tggtttggctatgttc

SEQ ID NO: 153359 - DNA, 16 bp, H. sapiens
tggtttggctgtttcc

SEQ ID NO: 153360 - DNA, 16 bp, H. sapiens
tggtttggttactgta

SEQ ID NO: 153361 - DNA, 16 bp, H. sapiens
tggtttggttgtgtcc

SEQ ID NO: 153362 - DNA, 16 bp, H. sapiens
tggtttggtttagaaa

SEQ ID NO: 153363 - DNA, 16 bp, H. sapiens
tggtttgtaaatattt

SEQ ID NO: 153364 - DNA, 16 bp, H. sapiens
tggtttgtagttttct

SEQ ID NO: 153365 - DNA, 16 bp, H. sapiens
tggttttaaaatacat

SEQ ID NO: 153366 - DNA, 16 bp, H. sapiens
tggttttaaaatatgt

SEQ ID NO: 153367 - DNA, 16 bp, H. sapiens
tggttttaaaatggga

SEQ ID NO: 153368 - DNA, 16 bp, H. sapiens
tggttttaatgtgcat

SEQ ID NO: 153369 - DNA, 16 bp, H. sapiens
tggttttactatttta

SEQ ID NO: 153370 - DNA, 16 bp, H. sapiens
tggttttataaaaagg

SEQ ID NO: 153371 - DNA, 16 bp, H. sapiens
tggttttataatcagc

SEQ ID NO: 153372 - DNA, 16 bp, H. sapiens
tggttttatgtccttg

SEQ ID NO: 153373 - DNA, 16 bp, H. sapiens
tggttttcatttgctt

SEQ ID NO: 153374 - DNA, 16 bp, H. sapiens
tggttttcattttaat

SEQ ID NO: 153375 - DNA, 16 bp, H. sapiens
tggttttcctatgcag

SEQ ID NO: 153376 - DNA, 16 bp, H. sapiens
tggttttcctcctacc

SEQ ID NO: 153377 - DNA, 16 bp, H. sapiens
tggttttctaaggggc

SEQ ID NO: 153378 - DNA, 16 bp, H. sapiens
tggttttctcatctat

SEQ ID NO: 153379 - DNA, 16 bp, H. sapiens
tggttttctcccaggc

SEQ ID NO: 153380 - DNA, 16 bp, H. sapiens
tggttttctgtccctg

SEQ ID NO: 153381 - DNA, 16 bp, H. sapiens
tggttttctgtttcta

SEQ ID NO: 153382 - DNA, 16 bp, H. sapiens
tggttttgtctttcag

SEQ ID NO: 153383 - DNA, 16 bp, H. sapiens
tggttttgtggctcag

SEQ ID NO: 153384 - DNA, 16 bp, H. sapiens
tggttttgtgggccag

SEQ ID NO: 153385 - DNA, 16 bp, H. sapiens
tggttttgttgccatt

SEQ ID NO: 153386 - DNA, 16 bp, H. sapiens
tggtttttaattaaaa

SEQ ID NO: 153387 - DNA, 16 bp, H. sapiens
tggtttttaattctgt

SEQ ID NO: 153388 - DNA, 16 bp, H. sapiens
tggtttttagtacatt

SEQ ID NO: 153389 - DNA, 17 bp, H. sapiens
tggtttttagtatagtc

SEQ ID NO: 153390 - DNA, 16 bp, H. sapiens
tggtttttatccaaaa

SEQ ID NO: 153391 - DNA, 16 bp, H. sapiens
tggtttttatcctggg

SEQ ID NO: 153392 - DNA, 16 bp, H. sapiens
tggtttttctgcatct

SEQ ID NO: 153393 - DNA, 16 bp, H. sapiens
tggtttttctttaaaa

SEQ ID NO: 153394 - DNA, 16 bp, H. sapiens
tggttttttgaccttg

SEQ ID NO: 153395 - DNA, 16 bp, H. sapiens
tggtttttttaaaaaa

SEQ ID NO: 153396 - DNA, 16 bp, H. sapiens
tggtttttttccccca

SEQ ID NO: 153397 - DNA, 16 bp, H. sapiens
tgtaaaaaaatcaatt

SEQ ID NO: 153398 - DNA, 16 bp, H. sapiens
tgtaaaaaatgatgtt

SEQ ID NO: 153399 - DNA, 16 bp, H. sapiens
tgtaaaaatcaaaata

SEQ ID NO: 153400 - DNA, 16 bp, H. sapiens
tgtaaaaatgttttgt

SEQ ID NO: 153401 - DNA, 16 bp, H. sapiens
tgtaaaaattaatctt

SEQ ID NO: 153402 - DNA, 16 bp, H. sapiens
tgtaaaacaaaagcaa

SEQ ID NO: 153403 - DNA, 16 bp, H. sapiens
tgtaaaacacagaaaa

SEQ ID NO: 153404 - DNA, 16 bp, H. sapiens
tgtaaaacacttagaa

SEQ ID NO: 153405 - DNA, 16 bp, H. sapiens
tgtaaaacagggataa

SEQ ID NO: 153406 - DNA, 16 bp, H. sapiens
tgtaaaacatgccttt

SEQ ID NO: 153407 - DNA, 16 bp, H. sapiens
tgtaaaacattgatga

SEQ ID NO: 153408 - DNA, 16 bp, H. sapiens
tgtaaaacatttagaa

SEQ ID NO: 153409 - DNA, 16 bp, H. sapiens
tgtaaaacatttgaag

SEQ ID NO: 153410 - DNA, 16 bp, H. sapiens
tgtaaaaccatcagat

SEQ ID NO: 153411 - DNA, 16 bp, H. sapiens
tgtaaaactgatgaaa

SEQ ID NO: 153412 - DNA, 16 bp, H. sapiens
tgtaaaacttaaaact

SEQ ID NO: 153413 - DNA, 16 bp, H. sapiens
tgtaaaactttttttt

SEQ ID NO: 153414 - DNA, 16 bp, H. sapiens
tgtaaaagaactgaaa

SEQ ID NO: 153415 - DNA, 16 bp, H. sapiens
tgtaaaagaagtcaaa

SEQ ID NO: 153416 - DNA, 16 bp, H. sapiens
tgtaaaagatcagatg

SEQ ID NO: 153417 - DNA, 16 bp, H. sapiens
tgtaaaagccaaaact

SEQ ID NO: 153418 - DNA, 16 bp, H. sapiens
tgtaaaagtgttcctg

SEQ ID NO: 153419 - DNA, 16 bp, H. sapiens
tgtaaaataaaagttg

SEQ ID NO: 153420 - DNA, 16 bp, H. sapiens
tgtaaaataaaagttt

SEQ ID NO: 153421 - DNA, 16 bp, H. sapiens
tgtaaaataagatatt

SEQ ID NO: 153422 - DNA, 16 bp, H. sapiens
tgtaaaataattacat

SEQ ID NO: 153423 - DNA, 16 bp, H. sapiens
tgtaaaatagagataa

SEQ ID NO: 153424 - DNA, 16 bp, H. sapiens
tgtaaaatataaaact

SEQ ID NO: 153425 - DNA, 16 bp, H. sapiens
tgtaaaatataacaaa

SEQ ID NO: 153426 - DNA, 16 bp, H. sapiens
tgtaaaatatatacaa

SEQ ID NO: 153427 - DNA, 16 bp, H. sapiens
tgtaaaatatgtaaat

SEQ ID NO: 153428 - DNA, 16 bp, H. sapiens
tgtaaaatattaaatg

SEQ ID NO: 153429 - DNA, 16 bp, H. sapiens
tgtaaaatattcaaaa

SEQ ID NO: 153430 - DNA, 16 bp, H. sapiens
tgtaaaatatttcaaa

SEQ ID NO: 153431 - DNA, 16 bp, H. sapiens
tgtaaaatattttaca

SEQ ID NO: 153432 - DNA, 16 bp, H. sapiens
tgtaaaatcaaagcaa

SEQ ID NO: 153433 - DNA, 16 bp, H. sapiens
tgtaaaatgagaataa

SEQ ID NO: 153434 - DNA, 16 bp, H. sapiens
tgtaaaatgaggataa

SEQ ID NO: 153435 - DNA, 16 bp, H. sapiens
tgtaaaatgagggaaa

SEQ ID NO: 153436 - DNA, 16 bp, H. sapiens
tgtaaaatgaggttaa

SEQ ID NO: 153437 - DNA, 16 bp, H. sapiens
tgtaaaatgagtataa

SEQ ID NO: 153438 - DNA, 16 bp, H. sapiens
tgtaaaatgcaaaact

SEQ ID NO: 153439 - DNA, 16 bp, H. sapiens
tgtaaaatggaccaat

SEQ ID NO: 153440 - DNA, 16 bp, H. sapiens
tgtaaaatgggaaaaa

SEQ ID NO: 153441 - DNA, 16 bp, H. sapiens
tgtaaaatgggacaat

SEQ ID NO: 153442 - DNA, 16 bp, H. sapiens
tgtaaaatgtgaataa

SEQ ID NO: 153443 - DNA, 16 bp, H. sapiens
tgtaaaatgtggaaaa

SEQ ID NO: 153444 - DNA, 16 bp, H. sapiens
tgtaaaattaccttca

SEQ ID NO: 153445 - DNA, 16 bp, H. sapiens
tgtaaaattataactg

SEQ ID NO: 153446 - DNA, 16 bp, H. sapiens
tgtaaaattatttcat

SEQ ID NO: 153447 - DNA, 16 bp, H. sapiens
tgtaaaattggaaaaa

SEQ ID NO: 153448 - DNA, 16 bp, H. sapiens
tgtaaaatttattctt

SEQ ID NO: 153449 - DNA, 16 bp, H. sapiens
tgtaaacaaaatttta

SEQ ID NO: 153450 - DNA, 16 bp, H. sapiens
tgtaaacaagggtgta

SEQ ID NO: 153451 - DNA, 16 bp, H. sapiens
tgtaaacagtgctgta

SEQ ID NO: 153452 - DNA, 16 bp, H. sapiens
tgtaaacattgttgaa

SEQ ID NO: 153453 - DNA, 16 bp, H. sapiens
tgtaaacattttgtta

SEQ ID NO: 153454 - DNA, 16 bp, H. sapiens
tgtaaaccaaaaagta

SEQ ID NO: 153455 - DNA, 16 bp, H. sapiens
tgtaaaccagccagaa

SEQ ID NO: 153456 - DNA, 22 bp, H. sapiens
tgtaaactagttcaaccattgg

SEQ ID NO: 153457 - DNA, 32 bp, H. sapiens
tgtaaactagttcaacccttgtggaagtcagt

SEQ ID NO: 153458 - DNA, 16 bp, H. sapiens
tgtaaacttaaaaatg

SEQ ID NO: 153459 - DNA, 16 bp, H. sapiens
tgtaaagaaataggac

SEQ ID NO: 153460 - DNA, 16 bp, H. sapiens
tgtaaagaactgcctg

SEQ ID NO: 153461 - DNA, 16 bp, H. sapiens
tgtaaagaatgtcatt

SEQ ID NO: 153462 - DNA, 16 bp, H. sapiens
tgtaaagagcttagaa

SEQ ID NO: 153463 - DNA, 16 bp, H. sapiens
tgtaaagatacacata

SEQ ID NO: 153464 - DNA, 16 bp, H. sapiens
tgtaaagcactcagaa

SEQ ID NO: 153465 - DNA, 16 bp, H. sapiens
tgtaaagctttttttt

SEQ ID NO: 153466 - DNA, 16 bp, H. sapiens
tgtaaaggaatgcctg

SEQ ID NO: 153467 - DNA, 16 bp, H. sapiens
tgtaaagggccagata

SEQ ID NO: 153468 - DNA, 16 bp, H. sapiens
tgtaaagtaaaattta

SEQ ID NO: 153469 - DNA, 16 bp, H. sapiens
tgtaaagtatttagaa

SEQ ID NO: 153470 - DNA, 16 bp, H. sapiens
tgtaaagtgctcagca

SEQ ID NO: 153471 - DNA, 16 bp, H. sapiens
tgtaaagtgcttagca

SEQ ID NO: 153472 - DNA, 19 bp, H. sapiens
tgtaaagtggaccaatcag

SEQ ID NO: 153473 - DNA, 16 bp, H. sapiens
tgtaaagtggagatga

SEQ ID NO: 153474 - DNA, 16 bp, H. sapiens
tgtaaagtgttttatt

SEQ ID NO: 153475 - DNA, 16 bp, H. sapiens
tgtaaagttactattt

SEQ ID NO: 153476 - DNA, 16 bp, H. sapiens
tgtaaataacttttaa

SEQ ID NO: 153477 - DNA, 16 bp, H. sapiens
tgtaaataatgttgca

SEQ ID NO: 153478 - DNA, 16 bp, H. sapiens
tgtaaatacaaagttg

SEQ ID NO: 153479 - DNA, 16 bp, H. sapiens
tgtaaatacatttaaa

SEQ ID NO: 153480 - DNA, 16 bp, H. sapiens
tgtaaatactgttttt

SEQ ID NO: 153481 - DNA, 16 bp, H. sapiens
tgtaaatatactaaaa

SEQ ID NO: 153482 - DNA, 16 bp, H. sapiens
tgtaaatatatgtgca

SEQ ID NO: 153483 - DNA, 16 bp, H. sapiens
tgtaaatatctgttag

SEQ ID NO: 153484 - DNA, 16 bp, H. sapiens
tgtaaatatgcatata

SEQ ID NO: 153485 - DNA, 16 bp, H. sapiens
tgtaaatatgtacaat

SEQ ID NO: 153486 - DNA, 16 bp, H. sapiens
tgtaaatatgtatgta

SEQ ID NO: 153487 - DNA, 16 bp, H. sapiens
tgtaaatatgtattta

SEQ ID NO: 153488 - DNA, 16 bp, H. sapiens
tgtaaatatttcaata

SEQ ID NO: 153489 - DNA, 16 bp, H. sapiens
tgtaaatatttcttat

SEQ ID NO: 153490 - DNA, 16 bp, H. sapiens
tgtaaatattttacat

SEQ ID NO: 153491 - DNA, 16 bp, H. sapiens
tgtaaatattttctgc

SEQ ID NO: 153492 - DNA, 16 bp, H. sapiens
tgtaaatattttgaaa

SEQ ID NO: 153493 - DNA, 16 bp, H. sapiens
tgtaaatatttttccc

SEQ ID NO: 153494 - DNA, 16 bp, H. sapiens
tgtaaatcaaaactac

SEQ ID NO: 153495 - DNA, 16 bp, H. sapiens
tgtaaatcactttgga

SEQ ID NO: 153496 - DNA, 16 bp, H. sapiens
tgtaaatcattctact

SEQ ID NO: 153497 - DNA, 16 bp, H. sapiens
tgtaaatcatttttat

SEQ ID NO: 153498 - DNA, 16 bp, H. sapiens
tgtaaatgacatttta

SEQ ID NO: 153499 - DNA, 16 bp, H. sapiens
tgtaaatgagattgag

SEQ ID NO: 153500 - DNA, 16 bp, H. sapiens
tgtaaatgcaccaatt

SEQ ID NO: 153501 - DNA, 16 bp, H. sapiens
tgtaaatgccatgtaa

SEQ ID NO: 153502 - DNA, 16 bp, H. sapiens
tgtaaatgggattaat

SEQ ID NO: 153503 - DNA, 16 bp, H. sapiens
tgtaaatggtatttta

SEQ ID NO: 153504 - DNA, 16 bp, H. sapiens
tgtaaatgtatatgta

SEQ ID NO: 153505 - DNA, 16 bp, H. sapiens
tgtaaatgttataaat

SEQ ID NO: 153506 - DNA, 16 bp, H. sapiens
tgtaaatgttttaaat

SEQ ID NO: 153507 - DNA, 16 bp, H. sapiens
tgtaaattagctcaac

SEQ ID NO: 153508 - DNA, 16 bp, H. sapiens
tgtaaattagttcaac

SEQ ID NO: 153509 - DNA, 16 bp, H. sapiens
tgtaaattatatttca

SEQ ID NO: 153510 - DNA, 16 bp, H. sapiens
tgtaaattctgaatat

SEQ ID NO: 153511 - DNA, 16 bp, H. sapiens
tgtaaattggtacagt

SEQ ID NO: 153512 - DNA, 16 bp, H. sapiens
tgtaaatttgtacaac

SEQ ID NO: 153513 - DNA, 16 bp, H. sapiens
tgtaaatttgtttaaa

SEQ ID NO: 153514 - DNA, 16 bp, H. sapiens
tgtaaattttacctca

SEQ ID NO: 153515 - DNA, 16 bp, H. sapiens
tgtaaattttacttta

SEQ ID NO: 153516 - DNA, 16 bp, H. sapiens
tgtaaattttagaatc

SEQ ID NO: 153517 - DNA, 16 bp, H. sapiens
tgtaaattttctgtaa

SEQ ID NO: 153518 - DNA, 16 bp, H. sapiens
tgtaaatttttgcttt

SEQ ID NO: 153519 - DNA, 16 bp, H. sapiens
tgtaacaaaatactat

SEQ ID NO: 153520 - DNA, 16 bp, H. sapiens
tgtaacaaaatattta

SEQ ID NO: 153521 - DNA, 16 bp, H. sapiens
tgtaacacaatggtaa

SEQ ID NO: 153522 - DNA, 16 bp, H. sapiens
tgtaacactgcctctt

SEQ ID NO: 153523 - DNA, 16 bp, H. sapiens
tgtaacagaaatgaaa

SEQ ID NO: 153524 - DNA, 16 bp, H. sapiens
tgtaacagtacttgaa

SEQ ID NO: 153525 - DNA, 16 bp, H. sapiens
tgtaacattattcaca

SEQ ID NO: 153526 - DNA, 16 bp, H. sapiens
tgtaacattttgtttt

SEQ ID NO: 153527 - DNA, 16 bp, H. sapiens
tgtaaccaaaacagca

SEQ ID NO: 153528 - DNA, 16 bp, H. sapiens
tgtaaccccaactact

SEQ ID NO: 153529 - DNA, 16 bp, H. sapiens
tgtaaccccagcattt

SEQ ID NO: 153530 - DNA, 16 bp, H. sapiens
tgtaactggattgttt

SEQ ID NO: 153531 - DNA, 16 bp, H. sapiens
tgtaactttttattta

SEQ ID NO: 153532 - DNA, 16 bp, H. sapiens
tgtaagaaatgcaaaa

SEQ ID NO: 153533 - DNA, 16 bp, H. sapiens
tgtaagaagtacattg

SEQ ID NO: 153534 - DNA, 16 bp, H. sapiens
tgtaagaagtgccttt

SEQ ID NO: 153535 - DNA, 16 bp, H. sapiens
tgtaagaagtgtcttt

SEQ ID NO: 153536 - DNA, 16 bp, H. sapiens
tgtaagaatatagtat

SEQ ID NO: 153537 - DNA, 16 bp, H. sapiens
tgtaagacaataaatt

SEQ ID NO: 153538 - DNA, 16 bp, H. sapiens
tgtaagagaataaatg

SEQ ID NO: 153539 - DNA, 16 bp, H. sapiens
tgtaagagacagaaga

SEQ ID NO: 153540 - DNA, 16 bp, H. sapiens
tgtaagatgcctgctc

SEQ ID NO: 153541 - DNA, 16 bp, H. sapiens
tgtaagatggtgcagc

SEQ ID NO: 153542 - DNA, 16 bp, H. sapiens
tgtaagcagaaactca

SEQ ID NO: 153543 - DNA, 16 bp, H. sapiens
tgtaagccactgcact

SEQ ID NO: 153544 - DNA, 16 bp, H. sapiens
tgtaagccaggctggt

SEQ ID NO: 153545 - DNA, 16 bp, H. sapiens
tgtaagctccttgagg

SEQ ID NO: 153546 - DNA, 16 bp, H. sapiens
tgtaagctctgcctcc

SEQ ID NO: 153547 - DNA, 16 bp, H. sapiens
tgtaagcttccctgtg

SEQ ID NO: 153548 - DNA, 16 bp, H. sapiens
tgtaagctttctgagg

SEQ ID NO: 153549 - DNA, 16 bp, H. sapiens
tgtaaggaaagtaaaa

SEQ ID NO: 153550 - DNA, 16 bp, H. sapiens
tgtaaggattacatga

SEQ ID NO: 153551 - DNA, 16 bp, H. sapiens
tgtaagtatgctctat

SEQ ID NO: 153552 - DNA, 16 bp, H. sapiens
tgtaagtattcaataa

SEQ ID NO: 153553 - DNA, 16 bp, H. sapiens
tgtaagtggaataata

SEQ ID NO: 153554 - DNA, 16 bp, H. sapiens
tgtaagttccatgaga

SEQ ID NO: 153555 - DNA, 16 bp, H. sapiens
tgtaagttggattgct

SEQ ID NO: 153556 - DNA, 16 bp, H. sapiens
tgtaagtttatataat

SEQ ID NO: 153557 - DNA, 16 bp, H. sapiens
tgtaagtttggtagaa

SEQ ID NO: 153558 - DNA, 16 bp, H. sapiens
tgtaataaatgtttat

SEQ ID NO: 153559 - DNA, 16 bp, H. sapiens
tgtaataatcacatca

SEQ ID NO: 153560 - DNA, 16 bp, H. sapiens
tgtaataccaatactt

SEQ ID NO: 153561 - DNA, 16 bp, H. sapiens
tgtaatagcactttgg

SEQ ID NO: 153562 - DNA, 16 bp, H. sapiens
tgtaatagcccaaaac

SEQ ID NO: 153563 - DNA, 16 bp, H. sapiens
tgtaatataatttgaa

SEQ ID NO: 153564 - DNA, 16 bp, H. sapiens
tgtaatatacatgtat

SEQ ID NO: 153565 - DNA, 16 bp, H. sapiens
tgtaatatatatgtat

SEQ ID NO: 153566 - DNA, 16 bp, H. sapiens
tgtaatatatttcttt

SEQ ID NO: 153567 - DNA, 16 bp, H. sapiens
tgtaatatgtatatta

SEQ ID NO: 153568 - DNA, 16 bp, H. sapiens
tgtaatatttgcatta

SEQ ID NO: 153569 - DNA, 16 bp, H. sapiens
tgtaatattttcaata

SEQ ID NO: 153570 - DNA, 16 bp, H. sapiens
tgtaatatttttccat

SEQ ID NO: 153571 - DNA, 16 bp, H. sapiens
tgtaatatttttgaaa

SEQ ID NO: 153572 - DNA, 16 bp, H. sapiens
tgtaatcaacataaaa

SEQ ID NO: 153573 - DNA, 16 bp, H. sapiens
tgtaatcacaagtatt

SEQ ID NO: 153574 - DNA, 16 bp, H. sapiens
tgtaatccaagcagtt

SEQ ID NO: 153575 - DNA, 16 bp, H. sapiens
tgtaatccaagctact

SEQ ID NO: 153576 - DNA, 16 bp, H. sapiens
tgtaatcccaacactg

SEQ ID NO: 153577 - DNA, 18 bp, H. sapiens
tgtaatcccaacactttc

SEQ ID NO: 153578 - DNA, 16 bp, H. sapiens
tgtaatcccaacatct

SEQ ID NO: 153579 - DNA, 16 bp, H. sapiens
tgtaatcccagaacta

SEQ ID NO: 153580 - DNA, 17 bp, H. sapiens
tgtaatcccagcacttg

SEQ ID NO: 153581 - DNA, 16 bp, H. sapiens
tgtaatcccagctaca

SEQ ID NO: 153582 - DNA, 16 bp, H. sapiens
tgtaatcccagctacg

SEQ ID NO: 153583 - DNA, 16 bp, H. sapiens
tgtaatcccagctcct

SEQ ID NO: 153584 - DNA, 16 bp, H. sapiens
tgtaatccccaatgtt

SEQ ID NO: 153585 - DNA, 16 bp, H. sapiens
tgtaatccctgctact

SEQ ID NO: 153586 - DNA, 16 bp, H. sapiens
tgtaatcctagcacta

SEQ ID NO: 153587 - DNA, 17 bp, H. sapiens
tgtaatcctagcacttc

SEQ ID NO: 153588 - DNA, 17 bp, H. sapiens
tgtaatcctagcacttg

SEQ ID NO: 153589 - DNA, 16 bp, H. sapiens
tgtaatcctagctact

SEQ ID NO: 153590 - DNA, 17 bp, H. sapiens
tgtaatcctagtacttt

SEQ ID NO: 153591 - DNA, 16 bp, H. sapiens
tgtaatcctggctact

SEQ ID NO: 153592 - DNA, 16 bp, H. sapiens
tgtaatcgcagctact

SEQ ID NO: 153593 - DNA, 16 bp, H. sapiens
tgtaatctcagctgct

SEQ ID NO: 153594 - DNA, 16 bp, H. sapiens
tgtaatctcagcttct

SEQ ID NO: 153595 - DNA, 17 bp, H. sapiens
tgtaatctcagtacttt

SEQ ID NO: 153596 - DNA, 16 bp, H. sapiens
tgtaatctcagttact

SEQ ID NO: 153597 - DNA, 16 bp, H. sapiens
tgtaatctgaattata

SEQ ID NO: 153598 - DNA, 16 bp, H. sapiens
tgtaatctgctttttt

SEQ ID NO: 153599 - DNA, 16 bp, H. sapiens
tgtaatgagaacattt

SEQ ID NO: 153600 - DNA, 16 bp, H. sapiens
tgtaatgagctagaaa

SEQ ID NO: 153601 - DNA, 17 bp, H. sapiens
tgtaatgagtgtggcaa

SEQ ID NO: 153602 - DNA, 16 bp, H. sapiens
tgtaatgccagctact

SEQ ID NO: 153603 - DNA, 16 bp, H. sapiens
tgtaatgtaatgtaaa

SEQ ID NO: 153604 - DNA, 16 bp, H. sapiens
tgtaatgtttatataa

SEQ ID NO: 153605 - DNA, 16 bp, H. sapiens
tgtaattaaaaacaaa

SEQ ID NO: 153606 - DNA, 16 bp, H. sapiens
tgtaattatttcatta

SEQ ID NO: 153607 - DNA, 16 bp, H. sapiens
tgtaattattttcctt

SEQ ID NO: 153608 - DNA, 16 bp, H. sapiens
tgtaattccaaaactt

SEQ ID NO: 153609 - DNA, 16 bp, H. sapiens
tgtaattcccagtgtt

SEQ ID NO: 153610 - DNA, 16 bp, H. sapiens
tgtaattctaccactt

SEQ ID NO: 153611 - DNA, 16 bp, H. sapiens
tgtaattctgtgggat

SEQ ID NO: 153612 - DNA, 16 bp, H. sapiens
tgtaatttaaaaaaca

SEQ ID NO: 153613 - DNA, 16 bp, H. sapiens
tgtaatttcaaatttt

SEQ ID NO: 153614 - DNA, 16 bp, H. sapiens
tgtaatttgaaaataa

SEQ ID NO: 153615 - DNA, 16 bp, H. sapiens
tgtaatttgttttctg

SEQ ID NO: 153616 - DNA, 16 bp, H. sapiens
tgtaattttgcctttt

SEQ ID NO: 153617 - DNA, 16 bp, H. sapiens
tgtaattttgtatgta

SEQ ID NO: 153618 - DNA, 16 bp, H. sapiens
tgtaatttttacttta

SEQ ID NO: 153619 - DNA, 16 bp, H. sapiens
tgtaatttttttcagt

SEQ ID NO: 153620 - DNA, 16 bp, H. sapiens
tgtaatttttttccca

SEQ ID NO: 153621 - DNA, 16 bp, H. sapiens
tgtacaaaaaacacaa

SEQ ID NO: 153622 - DNA, 16 bp, H. sapiens
tgtacaaaaaatacaa

SEQ ID NO: 153623 - DNA, 16 bp, H. sapiens
tgtacaaaaaattaaa

SEQ ID NO: 153624 - DNA, 16 bp, H. sapiens
tgtacaaacatctctt

SEQ ID NO: 153625 - DNA, 16 bp, H. sapiens
tgtacaaattagaaaa

SEQ ID NO: 153626 - DNA, 20 bp, H. sapiens
tgtacaaattgattgtaaaa

SEQ ID NO: 153627 - DNA, 16 bp, H. sapiens
tgtacaaatttttttt

SEQ ID NO: 153628 - DNA, 16 bp, H. sapiens
tgtacaacaatgtgaa

SEQ ID NO: 153629 - DNA, 16 bp, H. sapiens
tgtacaaccaccacca

SEQ ID NO: 153630 - DNA, 16 bp, H. sapiens
tgtacaagatgagcct

SEQ ID NO: 153631 - DNA, 16 bp, H. sapiens
tgtacaatatggtgac

SEQ ID NO: 153632 - DNA, 16 bp, H. sapiens
tgtacaattcagtgtt

SEQ ID NO: 153633 - DNA, 16 bp, H. sapiens
tgtacaattttaaaat

SEQ ID NO: 153634 - DNA, 16 bp, H. sapiens
tgtacacacatacaca

SEQ ID NO: 153635 - DNA, 16 bp, H. sapiens
tgtacacatacacaaa

SEQ ID NO: 153636 - DNA, 16 bp, H. sapiens
tgtacacatatacaca

SEQ ID NO: 153637 - DNA, 16 bp, H. sapiens
tgtacacattttcttt

SEQ ID NO: 153638 - DNA, 16 bp, H. sapiens
tgtacaccacaaatat

SEQ ID NO: 153639 - DNA, 16 bp, H. sapiens
tgtacactgaaaactg

SEQ ID NO: 153640 - DNA, 16 bp, H. sapiens
tgtacactgttcaggt

SEQ ID NO: 153641 - DNA, 16 bp, H. sapiens
tgtacacttacaaatg

SEQ ID NO: 153642 - DNA, 16 bp, H. sapiens
tgtacagaaaaagaaa

SEQ ID NO: 153643 - DNA, 16 bp, H. sapiens
tgtacagaaacctaaa

SEQ ID NO: 153644 - DNA, 16 bp, H. sapiens
tgtacagaaataaaaa

SEQ ID NO: 153645 - DNA, 16 bp, H. sapiens
tgtacagaagtcaaga

SEQ ID NO: 153646 - DNA, 16 bp, H. sapiens
tgtacagactttttct

SEQ ID NO: 153647 - DNA, 16 bp, H. sapiens
tgtacagattatttaa

SEQ ID NO: 153648 - DNA, 16 bp, H. sapiens
tgtacagatttttcac

SEQ ID NO: 153649 - DNA, 16 bp, H. sapiens
tgtacagcaaagaaaa

SEQ ID NO: 153650 - DNA, 16 bp, H. sapiens
tgtacagcatgatgac

SEQ ID NO: 153651 - DNA, 16 bp, H. sapiens
tgtacagcatgtgact

SEQ ID NO: 153652 - DNA, 16 bp, H. sapiens
tgtacagcctgcaaaa

SEQ ID NO: 153653 - DNA, 16 bp, H. sapiens
tgtacagcctgcagaa

SEQ ID NO: 153654 - DNA, 16 bp, H. sapiens
tgtacagcctgcagga

SEQ ID NO: 153655 - DNA, 16 bp, H. sapiens
tgtacagggcacttac

SEQ ID NO: 153656 - DNA, 16 bp, H. sapiens
tgtacaggtttctgtg

SEQ ID NO: 153657 - DNA, 16 bp, H. sapiens
tgtacaggtttgttat

SEQ ID NO: 153658 - DNA, 16 bp, H. sapiens
tgtacagttcagtaat

SEQ ID NO: 153659 - DNA, 16 bp, H. sapiens
tgtacagttcagtgat

SEQ ID NO: 153660 - DNA, 16 bp, H. sapiens
tgtacagttcagtggc

SEQ ID NO: 153661 - DNA, 16 bp, H. sapiens
tgtacataaaaataat

SEQ ID NO: 153662 - DNA, 16 bp, H. sapiens
tgtacataaatgttca

SEQ ID NO: 153663 - DNA, 16 bp, H. sapiens
tgtacataattgcatg

SEQ ID NO: 153664 - DNA, 16 bp, H. sapiens
tgtacatacaatggaa

SEQ ID NO: 153665 - DNA, 16 bp, H. sapiens
tgtacatacacatgca

SEQ ID NO: 153666 - DNA, 16 bp, H. sapiens
tgtacatactacttta

SEQ ID NO: 153667 - DNA, 16 bp, H. sapiens
tgtacatatacatgtg

SEQ ID NO: 153668 - DNA, 16 bp, H. sapiens
tgtacatatataaata

SEQ ID NO: 153669 - DNA, 16 bp, H. sapiens
tgtacatatatatggg

SEQ ID NO: 153670 - DNA, 16 bp, H. sapiens
tgtacatatatattca

SEQ ID NO: 153671 - DNA, 16 bp, H. sapiens
tgtacatatattatgt

SEQ ID NO: 153672 - DNA, 16 bp, H. sapiens
tgtacatatgtataaa

SEQ ID NO: 153673 - DNA, 16 bp, H. sapiens
tgtacatatgtattta

SEQ ID NO: 153674 - DNA, 16 bp, H. sapiens
tgtacatatgtgtgtg

SEQ ID NO: 153675 - DNA, 16 bp, H. sapiens
tgtacatattttgggg

SEQ ID NO: 153676 - DNA, 16 bp, H. sapiens
tgtacatgaagcatgg

SEQ ID NO: 153677 - DNA, 16 bp, H. sapiens
tgtacatgtaccacat

SEQ ID NO: 153678 - DNA, 16 bp, H. sapiens
tgtacatgtatgtgtg

SEQ ID NO: 153679 - DNA, 16 bp, H. sapiens
tgtacatgttttgtta

SEQ ID NO: 153680 - DNA, 16 bp, H. sapiens
tgtacattattcaggt

SEQ ID NO: 153681 - DNA, 16 bp, H. sapiens
tgtacattctaaaata

SEQ ID NO: 153682 - DNA, 16 bp, H. sapiens
tgtacattgtggaatg

SEQ ID NO: 153683 - DNA, 16 bp, H. sapiens
tgtacattgttttctt

SEQ ID NO: 153684 - DNA, 16 bp, H. sapiens
tgtacatttaaaaaaa

SEQ ID NO: 153685 - DNA, 16 bp, H. sapiens
tgtacatttaaaatat

SEQ ID NO: 153686 - DNA, 16 bp, H. sapiens
tgtacatttatttatt

SEQ ID NO: 153687 - DNA, 16 bp, H. sapiens
tgtacatttatttttg

SEQ ID NO: 153688 - DNA, 16 bp, H. sapiens
tgtacatttgaaaatg

SEQ ID NO: 153689 - DNA, 16 bp, H. sapiens
tgtacatttgttcagt

SEQ ID NO: 153690 - DNA, 16 bp, H. sapiens
tgtacattttacatgt

SEQ ID NO: 153691 - DNA, 16 bp, H. sapiens
tgtacattttacattt

SEQ ID NO: 153692 - DNA, 16 bp, H. sapiens
tgtacattttcatatt

SEQ ID NO: 153693 - DNA, 16 bp, H. sapiens
tgtacatttttataca

SEQ ID NO: 153694 - DNA, 16 bp, H. sapiens
tgtaccaaaacagaga

SEQ ID NO: 153695 - DNA, 16 bp, H. sapiens
tgtaccaatttacatt

SEQ ID NO: 153696 - DNA, 16 bp, H. sapiens
tgtaccacagtttctt

SEQ ID NO: 153697 - DNA, 16 bp, H. sapiens
tgtaccacatttcttt

SEQ ID NO: 153698 - DNA, 16 bp, H. sapiens
tgtaccaggcactgtt

SEQ ID NO: 153699 - DNA, 16 bp, H. sapiens
tgtaccagtgccatgc

SEQ ID NO: 153700 - DNA, 16 bp, H. sapiens
tgtaccatgcacctgg

SEQ ID NO: 153701 - DNA, 16 bp, H. sapiens
tgtaccattttatgtt

SEQ ID NO: 153702 - DNA, 16 bp, H. sapiens
tgtaccccaacctggg

SEQ ID NO: 153703 - DNA, 16 bp, H. sapiens
tgtaccccataaatat

SEQ ID NO: 153704 - DNA, 16 bp, H. sapiens
tgtaccctaaaaccta

SEQ ID NO: 153705 - DNA, 16 bp, H. sapiens
tgtacccttcacccag

SEQ ID NO: 153706 - DNA, 16 bp, H. sapiens
tgtaccctttgaccat

SEQ ID NO: 153707 - DNA, 16 bp, H. sapiens
tgtacctcattcttcc

SEQ ID NO: 153708 - DNA, 16 bp, H. sapiens
tgtacctggaaaaatg

SEQ ID NO: 153709 - DNA, 16 bp, H. sapiens
tgtacctggtcaccca

SEQ ID NO: 153710 - DNA, 16 bp, H. sapiens
tgtaccttggcctctt

SEQ ID NO: 153711 - DNA, 16 bp, H. sapiens
tgtacgtgaatgttta

SEQ ID NO: 153712 - DNA, 16 bp, H. sapiens
tgtactaaaaatacag

SEQ ID NO: 153713 - DNA, 31 bp, H. sapiens
tgtactaagaaaaattcttctgccttgagat

SEQ ID NO: 153714 - DNA, 16 bp, H. sapiens
tgtactattttatatt

SEQ ID NO: 153715 - DNA, 16 bp, H. sapiens
tgtactcaataaatag

SEQ ID NO: 153716 - DNA, 16 bp, H. sapiens
tgtactcagcctgggc

SEQ ID NO: 153717 - DNA, 17 bp, H. sapiens
tgtactcaggaggctga

SEQ ID NO: 153718 - DNA, 16 bp, H. sapiens
tgtactccagccaggg

SEQ ID NO: 153719 - DNA, 16 bp, H. sapiens
tgtactccagcctgag

SEQ ID NO: 153720 - DNA, 16 bp, H. sapiens
tgtactccagcctggc

SEQ ID NO: 153721 - DNA, 16 bp, H. sapiens
tgtactccagcctggg

SEQ ID NO: 153722 - DNA, 16 bp, H. sapiens
tgtactccagcctggt

SEQ ID NO: 153723 - DNA, 16 bp, H. sapiens
tgtactccagtctggg

SEQ ID NO: 153724 - DNA, 16 bp, H. sapiens
tgtactctagcctggg

SEQ ID NO: 153725 - DNA, 16 bp, H. sapiens
tgtactctttatttct

SEQ ID NO: 153726 - DNA, 16 bp, H. sapiens
tgtactggcttcaggt

SEQ ID NO: 153727 - DNA, 16 bp, H. sapiens
tgtactggtttttcct

SEQ ID NO: 153728 - DNA, 16 bp, H. sapiens
tgtactgtgagaggat

SEQ ID NO: 153729 - DNA, 16 bp, H. sapiens
tgtactgttgaatttg

SEQ ID NO: 153730 - DNA, 16 bp, H. sapiens
tgtactgttttacatt

SEQ ID NO: 153731 - DNA, 16 bp, H. sapiens
tgtacttaaaataaaa

SEQ ID NO: 153732 - DNA, 16 bp, H. sapiens
tgtacttaatgccaat

SEQ ID NO: 153733 - DNA, 16 bp, H. sapiens
tgtacttcaacctggg

SEQ ID NO: 153734 - DNA, 16 bp, H. sapiens
tgtacttgaaaagaat

SEQ ID NO: 153735 - DNA, 16 bp, H. sapiens
tgtacttgaaaataat

SEQ ID NO: 153736 - DNA, 16 bp, H. sapiens
tgtactttaaaaattt

SEQ ID NO: 153737 - DNA, 16 bp, H. sapiens
tgtactttatataaat

SEQ ID NO: 153738 - DNA, 16 bp, H. sapiens
tgtactttctgctcag

SEQ ID NO: 153739 - DNA, 17 bp, H. sapiens
tgtactttgtagggaca

SEQ ID NO: 153740 - DNA, 17 bp, H. sapiens
tgtacttttagtagaga

SEQ ID NO: 153741 - DNA, 16 bp, H. sapiens
tgtactttttctatgt

SEQ ID NO: 153742 - DNA, 16 bp, H. sapiens
tgtagaaaacaaaaca

SEQ ID NO: 153743 - DNA, 16 bp, H. sapiens
tgtagaaaatatattt

SEQ ID NO: 153744 - DNA, 16 bp, H. sapiens
tgtagaaaattctaaa

SEQ ID NO: 153745 - DNA, 16 bp, H. sapiens
tgtagaaaatttggaa

SEQ ID NO: 153746 - DNA, 16 bp, H. sapiens
tgtagaaactgcaaaa

SEQ ID NO: 153747 - DNA, 16 bp, H. sapiens
tgtagaaagcagtgtg

SEQ ID NO: 153748 - DNA, 16 bp, H. sapiens
tgtagaaatgaagtct

SEQ ID NO: 153749 - DNA, 16 bp, H. sapiens
tgtagaaattatttta

SEQ ID NO: 153750 - DNA, 16 bp, H. sapiens
tgtagaagtggctttg

SEQ ID NO: 153751 - DNA, 16 bp, H. sapiens
tgtagaataatttgaa

SEQ ID NO: 153752 - DNA, 16 bp, H. sapiens
tgtagaatctgcaaac

SEQ ID NO: 153753 - DNA, 16 bp, H. sapiens
tgtagaatctttgaag

SEQ ID NO: 153754 - DNA, 16 bp, H. sapiens
tgtagaatgattaaat

SEQ ID NO: 153755 - DNA, 16 bp, H. sapiens
tgtagaatggggataa

SEQ ID NO: 153756 - DNA, 16 bp, H. sapiens
tgtagaattattaatt

SEQ ID NO: 153757 - DNA, 16 bp, H. sapiens
tgtagaattttccact

SEQ ID NO: 153758 - DNA, 16 bp, H. sapiens
tgtagacatggggtct

SEQ ID NO: 153759 - DNA, 16 bp, H. sapiens
tgtagacatgttttca

SEQ ID NO: 153760 - DNA, 16 bp, H. sapiens
tgtagacccagctact

SEQ ID NO: 153761 - DNA, 16 bp, H. sapiens
tgtagactccacctct

SEQ ID NO: 153762 - DNA, 16 bp, H. sapiens
tgtagactgctttggg

SEQ ID NO: 153763 - DNA, 16 bp, H. sapiens
tgtagacttttcagat

SEQ ID NO: 153764 - DNA, 16 bp, H. sapiens
tgtagagaaattagaa

SEQ ID NO: 153765 - DNA, 16 bp, H. sapiens
tgtagagaaattgaaa

SEQ ID NO: 153766 - DNA, 16 bp, H. sapiens
tgtagagaagaggtct

SEQ ID NO: 153767 - DNA, 16 bp, H. sapiens
tgtagagacagggtcc

SEQ ID NO: 153768 - DNA, 16 bp, H. sapiens
tgtagagacggagtct

SEQ ID NO: 153769 - DNA, 16 bp, H. sapiens
tgtagagatggagcct

SEQ ID NO: 153770 - DNA, 16 bp, H. sapiens
tgtagagatggagtct

SEQ ID NO: 153771 - DNA, 18 bp, H. sapiens
tgtagagatggggtctca

SEQ ID NO: 153772 - DNA, 20 bp, H. sapiens
tgtagagatggggtttctcc

SEQ ID NO: 153773 - DNA, 16 bp, H. sapiens
tgtagagatgtttata

SEQ ID NO: 153774 - DNA, 16 bp, H. sapiens
tgtagagggaaatata

SEQ ID NO: 153775 - DNA, 16 bp, H. sapiens
tgtagatattgacaaa

SEQ ID NO: 153776 - DNA, 16 bp, H. sapiens
tgtagatgtgtgatgt

SEQ ID NO: 153777 - DNA, 16 bp, H. sapiens
tgtagattcctctggt

SEQ ID NO: 153778 - DNA, 16 bp, H. sapiens
tgtagattctgattca

SEQ ID NO: 153779 - DNA, 16 bp, H. sapiens
tgtagatttcatttat

SEQ ID NO: 153780 - DNA, 16 bp, H. sapiens
tgtagattttgtcttt

SEQ ID NO: 153781 - DNA, 16 bp, H. sapiens
tgtagcacttcccact

SEQ ID NO: 153782 - DNA, 16 bp, H. sapiens
tgtagcagcagcagca

SEQ ID NO: 153783 - DNA, 16 bp, H. sapiens
tgtagcatctgcaaag

SEQ ID NO: 153784 - DNA, 16 bp, H. sapiens
tgtagcatttgtgaat

SEQ ID NO: 153785 - DNA, 16 bp, H. sapiens
tgtagcattttatttt

SEQ ID NO: 153786 - DNA, 16 bp, H. sapiens
tgtagccagggttgag

SEQ ID NO: 153787 - DNA, 16 bp, H. sapiens
tgtagccccagctact

SEQ ID NO: 153788 - DNA, 16 bp, H. sapiens
tgtagcctccgcctcc

SEQ ID NO: 153789 - DNA, 16 bp, H. sapiens
tgtagcctctggaaaa

SEQ ID NO: 153790 - DNA, 16 bp, H. sapiens
tgtagccttttcagat

SEQ ID NO: 153791 - DNA, 17 bp, H. sapiens
tgtagctgggactacag

SEQ ID NO: 153792 - DNA, 16 bp, H. sapiens
tgtagctgggattaca

SEQ ID NO: 153793 - DNA, 19 bp, H. sapiens
tgtagctgggattacaggc

SEQ ID NO: 153794 - DNA, 16 bp, H. sapiens
tgtagcttggctttca

SEQ ID NO: 153795 - DNA, 16 bp, H. sapiens
tgtagctttagagtaa

SEQ ID NO: 153796 - DNA, 16 bp, H. sapiens
tgtagctttatggtaa

SEQ ID NO: 153797 - DNA, 16 bp, H. sapiens
tgtagcttttatgtga

SEQ ID NO: 153798 - DNA, 16 bp, H. sapiens
tgtaggagttctttat

SEQ ID NO: 153799 - DNA, 16 bp, H. sapiens
tgtaggcatagttaaa

SEQ ID NO: 153800 - DNA, 16 bp, H. sapiens
tgtaggctgggcgtgg

SEQ ID NO: 153801 - DNA, 16 bp, H. sapiens
tgtagggacagagtct

SEQ ID NO: 153802 - DNA, 16 bp, H. sapiens
tgtagggacagggtct

SEQ ID NO: 153803 - DNA, 16 bp, H. sapiens
tgtagggttgccagat

SEQ ID NO: 153804 - DNA, 16 bp, H. sapiens
tgtagggtttctgttg

SEQ ID NO: 153805 - DNA, 16 bp, H. sapiens
tgtaggtgagaaactt

SEQ ID NO: 153806 - DNA, 16 bp, H. sapiens
tgtaggtgtgtgtata

SEQ ID NO: 153807 - DNA, 16 bp, H. sapiens
tgtaggttgctttttc

SEQ ID NO: 153808 - DNA, 16 bp, H. sapiens
tgtaggtttgttacat

SEQ ID NO: 153809 - DNA, 23 bp, H. sapiens
tgtagtagagacggggtttcact

SEQ ID NO: 153810 - DNA, 16 bp, H. sapiens
tgtagtatattttgaa

SEQ ID NO: 153811 - DNA, 16 bp, H. sapiens
tgtagtatgaaagcag

SEQ ID NO: 153812 - DNA, 16 bp, H. sapiens
tgtagtattttcattt

SEQ ID NO: 153813 - DNA, 16 bp, H. sapiens
tgtagtcacagctact

SEQ ID NO: 153814 - DNA, 16 bp, H. sapiens
tgtagtcccaaatact

SEQ ID NO: 153815 - DNA, 16 bp, H. sapiens
tgtagtcccaactact

SEQ ID NO: 153816 - DNA, 16 bp, H. sapiens
tgtagtcccagatact

SEQ ID NO: 153817 - DNA, 16 bp, H. sapiens
tgtagtcccagctacc

SEQ ID NO: 153818 - DNA, 16 bp, H. sapiens
tgtagtcccagctacg

SEQ ID NO: 153819 - DNA, 16 bp, H. sapiens
tgtagtccccactact

SEQ ID NO: 153820 - DNA, 16 bp, H. sapiens
tgtagtcccggctact

SEQ ID NO: 153821 - DNA, 16 bp, H. sapiens
tgtagtccctgctact

SEQ ID NO: 153822 - DNA, 16 bp, H. sapiens
tgtagtcctagcaact

SEQ ID NO: 153823 - DNA, 16 bp, H. sapiens
tgtagtcctagctact

SEQ ID NO: 153824 - DNA, 16 bp, H. sapiens
tgtagtcctagcttct

SEQ ID NO: 153825 - DNA, 16 bp, H. sapiens
tgtagtcctggctact

SEQ ID NO: 153826 - DNA, 16 bp, H. sapiens
tgtagtctcagctacc

SEQ ID NO: 153827 - DNA, 16 bp, H. sapiens
tgtagtctcagctact

SEQ ID NO: 153828 - DNA, 16 bp, H. sapiens
tgtagtcttagctact

SEQ ID NO: 153829 - DNA, 17 bp, H. sapiens
tgtagtcttttatccct

SEQ ID NO: 153830 - DNA, 16 bp, H. sapiens
tgtagtgagcagagat

SEQ ID NO: 153831 - DNA, 18 bp, H. sapiens
tgtagtgagccgagatca

SEQ ID NO: 153832 - DNA, 16 bp, H. sapiens
tgtagtgagctatgat

SEQ ID NO: 153833 - DNA, 16 bp, H. sapiens
tgtagtgagctgagat

SEQ ID NO: 153834 - DNA, 16 bp, H. sapiens
tgtagtgcaatggcat

SEQ ID NO: 153835 - DNA, 16 bp, H. sapiens
tgtagtgcactatgat

SEQ ID NO: 153836 - DNA, 16 bp, H. sapiens
tgtagtgcagtggcac

SEQ ID NO: 153837 - DNA, 16 bp, H. sapiens
tgtagtgcagtggcgc

SEQ ID NO: 153838 - DNA, 16 bp, H. sapiens
tgtagtgccagctact

SEQ ID NO: 153839 - DNA, 16 bp, H. sapiens
tgtagtgcccttcttt

SEQ ID NO: 153840 - DNA, 16 bp, H. sapiens
tgtagtgctagctact

SEQ ID NO: 153841 - DNA, 16 bp, H. sapiens
tgtagtggcatgatca

SEQ ID NO: 153842 - DNA, 17 bp, H. sapiens
tgtagtggctcacacct

SEQ ID NO: 153843 - DNA, 16 bp, H. sapiens
tgtagtgtgaaagcag

SEQ ID NO: 153844 - DNA, 16 bp, H. sapiens
tgtagtgtttgccaat

SEQ ID NO: 153845 - DNA, 16 bp, H. sapiens
tgtagttccagctact

SEQ ID NO: 153846 - DNA, 16 bp, H. sapiens
tgtagttccagctcct

SEQ ID NO: 153847 - DNA, 16 bp, H. sapiens
tgtagttctagctact

SEQ ID NO: 153848 - DNA, 16 bp, H. sapiens
tgtagtttgaatatga

SEQ ID NO: 153849 - DNA, 16 bp, H. sapiens
tgtagttttcaacata

SEQ ID NO: 153850 - DNA, 16 bp, H. sapiens
tgtagttttccttata

SEQ ID NO: 153851 - DNA, 16 bp, H. sapiens
tgtagttttctgtgta

SEQ ID NO: 153852 - DNA, 16 bp, H. sapiens
tgtagttttgcctttt

SEQ ID NO: 153853 - DNA, 16 bp, H. sapiens
tgtataaaaatgtatt

SEQ ID NO: 153854 - DNA, 16 bp, H. sapiens
tgtataaaacaccaaa

SEQ ID NO: 153855 - DNA, 16 bp, H. sapiens
tgtataaaagtcaagt

SEQ ID NO: 153856 - DNA, 16 bp, H. sapiens
tgtataaaatgtataa

SEQ ID NO: 153857 - DNA, 16 bp, H. sapiens
tgtataaaattatctt

SEQ ID NO: 153858 - DNA, 16 bp, H. sapiens
tgtataaacatacata

SEQ ID NO: 153859 - DNA, 16 bp, H. sapiens
tgtataaactggccat

SEQ ID NO: 153860 - DNA, 16 bp, H. sapiens
tgtataaataaaacaa

SEQ ID NO: 153861 - DNA, 16 bp, H. sapiens
tgtataaatacatatt

SEQ ID NO: 153862 - DNA, 16 bp, H. sapiens
tgtataaatggaatca

SEQ ID NO: 153863 - DNA, 16 bp, H. sapiens
tgtataaatgtatgta

SEQ ID NO: 153864 - DNA, 16 bp, H. sapiens
tgtataaattactttg

SEQ ID NO: 153865 - DNA, 16 bp, H. sapiens
tgtataagcattccat

SEQ ID NO: 153866 - DNA, 17 bp, H. sapiens
tgtataaggtgtaaaga

SEQ ID NO: 153867 - DNA, 16 bp, H. sapiens
tgtataaggtgtatat

SEQ ID NO: 153868 - DNA, 16 bp, H. sapiens
tgtataataaagaatt

SEQ ID NO: 153869 - DNA, 16 bp, H. sapiens
tgtataataaatacat

SEQ ID NO: 153870 - DNA, 16 bp, H. sapiens
tgtataatacattatt

SEQ ID NO: 153871 - DNA, 16 bp, H. sapiens
tgtataatattccatg

SEQ ID NO: 153872 - DNA, 16 bp, H. sapiens
tgtataattccaacta

SEQ ID NO: 153873 - DNA, 16 bp, H. sapiens
tgtataattccattta

SEQ ID NO: 153874 - DNA, 16 bp, H. sapiens
tgtatacaaatattta

SEQ ID NO: 153875 - DNA, 16 bp, H. sapiens
tgtatacaatttttat

SEQ ID NO: 153876 - DNA, 16 bp, H. sapiens
tgtatacacagtggaa

SEQ ID NO: 153877 - DNA, 16 bp, H. sapiens
tgtatacacatacata

SEQ ID NO: 153878 - DNA, 16 bp, H. sapiens
tgtatacacatatatt

SEQ ID NO: 153879 - DNA, 16 bp, H. sapiens
tgtatacacatatgta

SEQ ID NO: 153880 - DNA, 16 bp, H. sapiens
tgtatacacatttatt

SEQ ID NO: 153881 - DNA, 16 bp, H. sapiens
tgtatacacgtataca

SEQ ID NO: 153882 - DNA, 16 bp, H. sapiens
tgtatacactacattt

SEQ ID NO: 153883 - DNA, 16 bp, H. sapiens
tgtatacataatatat

SEQ ID NO: 153884 - DNA, 16 bp, H. sapiens
tgtatacatacacatt

SEQ ID NO: 153885 - DNA, 16 bp, H. sapiens
tgtatacatatataca

SEQ ID NO: 153886 - DNA, 16 bp, H. sapiens
tgtatacatatatttg

SEQ ID NO: 153887 - DNA, 16 bp, H. sapiens
tgtatacatatgtaca

SEQ ID NO: 153888 - DNA, 16 bp, H. sapiens
tgtatacatatgtgta

SEQ ID NO: 153889 - DNA, 16 bp, H. sapiens
tgtatacatgtattat

SEQ ID NO: 153890 - DNA, 16 bp, H. sapiens
tgtatacatgtctaga

SEQ ID NO: 153891 - DNA, 16 bp, H. sapiens
tgtatacatgtgcaca

SEQ ID NO: 153892 - DNA, 16 bp, H. sapiens
tgtatacatgtgtgca

SEQ ID NO: 153893 - DNA, 16 bp, H. sapiens
tgtatacattcatata

SEQ ID NO: 153894 - DNA, 16 bp, H. sapiens
tgtatacattgatttt

SEQ ID NO: 153895 - DNA, 16 bp, H. sapiens
tgtatacatttcaaaa

SEQ ID NO: 153896 - DNA, 16 bp, H. sapiens
tgtatacatttgtaac

SEQ ID NO: 153897 - DNA, 16 bp, H. sapiens
tgtatacatttgttaa

SEQ ID NO: 153898 - DNA, 16 bp, H. sapiens
tgtatacattttaaaa

SEQ ID NO: 153899 - DNA, 16 bp, H. sapiens
tgtataccttaaatat

SEQ ID NO: 153900 - DNA, 16 bp, H. sapiens
tgtatacttaaaaata

SEQ ID NO: 153901 - DNA, 16 bp, H. sapiens
tgtatacttaagattt

SEQ ID NO: 153902 - DNA, 16 bp, H. sapiens
tgtatacttttttaaa

SEQ ID NO: 153903 - DNA, 16 bp, H. sapiens
tgtatagaaaagctac

SEQ ID NO: 153904 - DNA, 16 bp, H. sapiens
tgtatagacatttctc

SEQ ID NO: 153905 - DNA, 16 bp, H. sapiens
tgtatagtatcttgca

SEQ ID NO: 153906 - DNA, 16 bp, H. sapiens
tgtatagtatttcatg

SEQ ID NO: 153907 - DNA, 16 bp, H. sapiens
tgtatagtttgcaaat

SEQ ID NO: 153908 - DNA, 16 bp, H. sapiens
tgtatagttttagctc

SEQ ID NO: 153909 - DNA, 16 bp, H. sapiens
tgtatagttttataaa

SEQ ID NO: 153910 - DNA, 16 bp, H. sapiens
tgtatataaacatatc

SEQ ID NO: 153911 - DNA, 16 bp, H. sapiens
tgtatataaatatgtg

SEQ ID NO: 153912 - DNA, 16 bp, H. sapiens
tgtatataaatatgtt

SEQ ID NO: 153913 - DNA, 16 bp, H. sapiens
tgtatatacacacaca

SEQ ID NO: 153914 - DNA, 16 bp, H. sapiens
tgtatatacacataga

SEQ ID NO: 153915 - DNA, 16 bp, H. sapiens
tgtatatacacatatc

SEQ ID NO: 153916 - DNA, 16 bp, H. sapiens
tgtatatacatatata

SEQ ID NO: 153917 - DNA, 16 bp, H. sapiens
tgtatatacatattat

SEQ ID NO: 153918 - DNA, 16 bp, H. sapiens
tgtatatacatgtaca

SEQ ID NO: 153919 - DNA, 16 bp, H. sapiens
tgtatatacatgtata

SEQ ID NO: 153920 - DNA, 16 bp, H. sapiens
tgtatatacattattt

SEQ ID NO: 153921 - DNA, 16 bp, H. sapiens
tgtatataccacattt

SEQ ID NO: 153922 - DNA, 16 bp, H. sapiens
tgtatatacttatggg

SEQ ID NO: 153923 - DNA, 16 bp, H. sapiens
tgtatatacttgtata

SEQ ID NO: 153924 - DNA, 16 bp, H. sapiens
tgtatatagacatata

SEQ ID NO: 153925 - DNA, 16 bp, H. sapiens
tgtatatagatgtata

SEQ ID NO: 153926 - DNA, 16 bp, H. sapiens
tgtatataggtgtgtg

SEQ ID NO: 153927 - DNA, 16 bp, H. sapiens
tgtatatataaacaca

SEQ ID NO: 153928 - DNA, 16 bp, H. sapiens
tgtatatataaatatg

SEQ ID NO: 153929 - DNA, 16 bp, H. sapiens
tgtatatatacaatat

SEQ ID NO: 153930 - DNA, 16 bp, H. sapiens
tgtatatatacacata

SEQ ID NO: 153931 - DNA, 16 bp, H. sapiens
tgtatatatatccata

SEQ ID NO: 153932 - DNA, 16 bp, H. sapiens
tgtatatatatgtata

SEQ ID NO: 153933 - DNA, 16 bp, H. sapiens
tgtatatatatgtgaa

SEQ ID NO: 153934 - DNA, 16 bp, H. sapiens
tgtatatatattgcat

SEQ ID NO: 153935 - DNA, 16 bp, H. sapiens
tgtatatatcccatat

SEQ ID NO: 153936 - DNA, 16 bp, H. sapiens
tgtatatatctgtata

SEQ ID NO: 153937 - DNA, 16 bp, H. sapiens
tgtatatatcttatat

SEQ ID NO: 153938 - DNA, 16 bp, H. sapiens
tgtatatatgagtgta

SEQ ID NO: 153939 - DNA, 16 bp, H. sapiens
tgtatatatgcacata

SEQ ID NO: 153940 - DNA, 16 bp, H. sapiens
tgtatatatgcatata

SEQ ID NO: 153941 - DNA, 16 bp, H. sapiens
tgtatatatgccatat

SEQ ID NO: 153942 - DNA, 16 bp, H. sapiens
tgtatatatgtaaaat

SEQ ID NO: 153943 - DNA, 16 bp, H. sapiens
tgtatatatgtaaata

SEQ ID NO: 153944 - DNA, 16 bp, H. sapiens
tgtatatatgtaacaa

SEQ ID NO: 153945 - DNA, 16 bp, H. sapiens
tgtatatatgtacaca

SEQ ID NO: 153946 - DNA, 16 bp, H. sapiens
tgtatatatgtacata

SEQ ID NO: 153947 - DNA, 16 bp, H. sapiens
tgtatatatgtataaa

SEQ ID NO: 153948 - DNA, 16 bp, H. sapiens
tgtatatatgtgtgca

SEQ ID NO: 153949 - DNA, 18 bp, H. sapiens
tgtatatatgtgtgtata

SEQ ID NO: 153950 - DNA, 16 bp, H. sapiens
tgtatatatgttcata

SEQ ID NO: 153951 - DNA, 16 bp, H. sapiens
tgtatatattgcatat

SEQ ID NO: 153952 - DNA, 16 bp, H. sapiens
tgtatatattgtataa

SEQ ID NO: 153953 - DNA, 16 bp, H. sapiens
tgtatatatttttgca

SEQ ID NO: 153954 - DNA, 16 bp, H. sapiens
tgtatatcatgactta

SEQ ID NO: 153955 - DNA, 16 bp, H. sapiens
tgtatatctcctttgg

SEQ ID NO: 153956 - DNA, 16 bp, H. sapiens
tgtatatctgtatata

SEQ ID NO: 153957 - DNA, 16 bp, H. sapiens
tgtatatcttctttgg

SEQ ID NO: 153958 - DNA, 16 bp, H. sapiens
tgtatatcttgttttg

SEQ ID NO: 153959 - DNA, 16 bp, H. sapiens
tgtatatctttggaga

SEQ ID NO: 153960 - DNA, 16 bp, H. sapiens
tgtatatgatgaaagg

SEQ ID NO: 153961 - DNA, 16 bp, H. sapiens
tgtatatggtgtgtgt

SEQ ID NO: 153962 - DNA, 16 bp, H. sapiens
tgtatatgtaaatata

SEQ ID NO: 153963 - DNA, 16 bp, H. sapiens
tgtatatgtaatatat

SEQ ID NO: 153964 - DNA, 16 bp, H. sapiens
tgtatatgtaatgtat

SEQ ID NO: 153965 - DNA, 16 bp, H. sapiens
tgtatatgtatacata

SEQ ID NO: 153966 - DNA, 16 bp, H. sapiens
tgtatatgtatgtata

SEQ ID NO: 153967 - DNA, 16 bp, H. sapiens
tgtatatgtatgtgca

SEQ ID NO: 153968 - DNA, 16 bp, H. sapiens
tgtatatgtatgtgtg

SEQ ID NO: 153969 - DNA, 16 bp, H. sapiens
tgtatatgtggtgtgt

SEQ ID NO: 153970 - DNA, 16 bp, H. sapiens
tgtatatgtgtaaata

SEQ ID NO: 153971 - DNA, 16 bp, H. sapiens
tgtatatgtgtacaca

SEQ ID NO: 153972 - DNA, 16 bp, H. sapiens
tgtatatgtgtatata

SEQ ID NO: 153973 - DNA, 16 bp, H. sapiens
tgtatatgtgtatgtg

SEQ ID NO: 153974 - DNA, 16 bp, H. sapiens
tgtatatgtgtatgtt

SEQ ID NO: 153975 - DNA, 16 bp, H. sapiens
tgtatatgtgtggtgt

SEQ ID NO: 153976 - DNA, 16 bp, H. sapiens
tgtatatgtgtgtata

SEQ ID NO: 153977 - DNA, 16 bp, H. sapiens
tgtatatgtgtgttta

SEQ ID NO: 153978 - DNA, 16 bp, H. sapiens
tgtatatgtgtttata

SEQ ID NO: 153979 - DNA, 16 bp, H. sapiens
tgtatatgtttacata

SEQ ID NO: 153980 - DNA, 16 bp, H. sapiens
tgtatatgtttatggg

SEQ ID NO: 153981 - DNA, 16 bp, H. sapiens
tgtatatgtttatgta

SEQ ID NO: 153982 - DNA, 16 bp, H. sapiens
tgtatatgtttgaaat

SEQ ID NO: 153983 - DNA, 16 bp, H. sapiens
tgtatattaaaccatc

SEQ ID NO: 153984 - DNA, 16 bp, H. sapiens
tgtatattacatatat

SEQ ID NO: 153985 - DNA, 16 bp, H. sapiens
tgtatattctatgggt

SEQ ID NO: 153986 - DNA, 16 bp, H. sapiens
tgtatattctgtatat

SEQ ID NO: 153987 - DNA, 16 bp, H. sapiens
tgtatattgtgttgat

SEQ ID NO: 153988 - DNA, 16 bp, H. sapiens
tgtatatttatgggat

SEQ ID NO: 153989 - DNA, 16 bp, H. sapiens
tgtatatttattcata

SEQ ID NO: 153990 - DNA, 16 bp, H. sapiens
tgtatatttctatatt

SEQ ID NO: 153991 - DNA, 16 bp, H. sapiens
tgtatatttcttttaa

SEQ ID NO: 153992 - DNA, 16 bp, H. sapiens
tgtatatttgaaaatg

SEQ ID NO: 153993 - DNA, 16 bp, H. sapiens
tgtatattttaaaaga

SEQ ID NO: 153994 - DNA, 16 bp, H. sapiens
tgtatattttaagtgg

SEQ ID NO: 153995 - DNA, 16 bp, H. sapiens
tgtatattttacattt

SEQ ID NO: 153996 - DNA, 16 bp, H. sapiens
tgtatattttatatca

SEQ ID NO: 153997 - DNA, 16 bp, H. sapiens
tgtatattttcaaaaa

SEQ ID NO: 153998 - DNA, 16 bp, H. sapiens
tgtatattttcaggaa

SEQ ID NO: 153999 - DNA, 16 bp, H. sapiens
tgtatattttccattt

SEQ ID NO: 154000 - DNA, 16 bp, H. sapiens
tgtatattttgcagtt

SEQ ID NO: 154001 - DNA, 16 bp, H. sapiens
tgtatattttgtagaa

SEQ ID NO: 154002 - DNA, 16 bp, H. sapiens
tgtatatttttcaaaa

SEQ ID NO: 154003 - DNA, 16 bp, H. sapiens
tgtatattttttgaga

SEQ ID NO: 154004 - DNA, 16 bp, H. sapiens
tgtatcaaaagcctta

SEQ ID NO: 154005 - DNA, 16 bp, H. sapiens
tgtatcaaaataaata

SEQ ID NO: 154006 - DNA, 16 bp, H. sapiens
tgtatcaatagttcat

SEQ ID NO: 154007 - DNA, 16 bp, H. sapiens
tgtatcaatttacatt

SEQ ID NO: 154008 - DNA, 16 bp, H. sapiens
tgtatcacatttattt

SEQ ID NO: 154009 - DNA, 16 bp, H. sapiens
tgtatcagtatttcat

SEQ ID NO: 154010 - DNA, 16 bp, H. sapiens
tgtatcataatttatt

SEQ ID NO: 154011 - DNA, 16 bp, H. sapiens
tgtatcatgtttttga

SEQ ID NO: 154012 - DNA, 16 bp, H. sapiens
tgtatcattcattcat

SEQ ID NO: 154013 - DNA, 16 bp, H. sapiens
tgtatcattttaattt

SEQ ID NO: 154014 - DNA, 16 bp, H. sapiens
tgtatccaaagaaaat

SEQ ID NO: 154015 - DNA, 16 bp, H. sapiens
tgtatccagtgaaaat

SEQ ID NO: 154016 - DNA, 16 bp, H. sapiens
tgtatcccagaggtct

SEQ ID NO: 154017 - DNA, 16 bp, H. sapiens
tgtatccccaaaatat

SEQ ID NO: 154018 - DNA, 16 bp, H. sapiens
tgtatccccagagcct

SEQ ID NO: 154019 - DNA, 16 bp, H. sapiens
tgtatccccagtgcct

SEQ ID NO: 154020 - DNA, 16 bp, H. sapiens
tgtatccccagtgctt

SEQ ID NO: 154021 - DNA, 16 bp, H. sapiens
tgtatcctgcaaattt

SEQ ID NO: 154022 - DNA, 16 bp, H. sapiens
tgtatccttcagtcca

SEQ ID NO: 154023 - DNA, 16 bp, H. sapiens
tgtatcctttaaaata

SEQ ID NO: 154024 - DNA, 16 bp, H. sapiens
tgtatctaaaaaataa

SEQ ID NO: 154025 - DNA, 16 bp, H. sapiens
tgtatctaaaataaaa

SEQ ID NO: 154026 - DNA, 16 bp, H. sapiens
tgtatctagaaaaccc

SEQ ID NO: 154027 - DNA, 16 bp, H. sapiens
tgtatctataaaaata

SEQ ID NO: 154028 - DNA, 16 bp, H. sapiens
tgtatctatatgtata

SEQ ID NO: 154029 - DNA, 16 bp, H. sapiens
tgtatctatgtatcta

SEQ ID NO: 154030 - DNA, 16 bp, H. sapiens
tgtatctattaaataa

SEQ ID NO: 154031 - DNA, 16 bp, H. sapiens
tgtatctcaataaagc

SEQ ID NO: 154032 - DNA, 16 bp, H. sapiens
tgtatctctgatgcct

SEQ ID NO: 154033 - DNA, 16 bp, H. sapiens
tgtatctgtgtctgtg

SEQ ID NO: 154034 - DNA, 16 bp, H. sapiens
tgtatctgtgtgtgca

SEQ ID NO: 154035 - DNA, 16 bp, H. sapiens
tgtatctgtttttgta

SEQ ID NO: 154036 - DNA, 16 bp, H. sapiens
tgtatcttgaaatttt

SEQ ID NO: 154037 - DNA, 16 bp, H. sapiens
tgtatcttggaagcaa

SEQ ID NO: 154038 - DNA, 16 bp, H. sapiens
tgtatctttaaaaaaa

SEQ ID NO: 154039 - DNA, 16 bp, H. sapiens
tgtatctttactagag

SEQ ID NO: 154040 - DNA, 16 bp, H. sapiens
tgtatctttgttttca

SEQ ID NO: 154041 - DNA, 16 bp, H. sapiens
tgtatctttttaaaaa

SEQ ID NO: 154042 - DNA, 16 bp, H. sapiens
tgtatgaagaaataaa

SEQ ID NO: 154043 - DNA, 16 bp, H. sapiens
tgtatgaatatgtgtg

SEQ ID NO: 154044 - DNA, 16 bp, H. sapiens
tgtatgagagagagaa

SEQ ID NO: 154045 - DNA, 16 bp, H. sapiens
tgtatgagtatgtgtg

SEQ ID NO: 154046 - DNA, 16 bp, H. sapiens
tgtatgagtgtgtgca

SEQ ID NO: 154047 - DNA, 16 bp, H. sapiens
tgtatgatcatctcaa

SEQ ID NO: 154048 - DNA, 16 bp, H. sapiens
tgtatgattccactta

SEQ ID NO: 154049 - DNA, 16 bp, H. sapiens
tgtatgatttttatac

SEQ ID NO: 154050 - DNA, 16 bp, H. sapiens
tgtatgcacacacaca

SEQ ID NO: 154051 - DNA, 16 bp, H. sapiens
tgtatgcacacatcac

SEQ ID NO: 154052 - DNA, 16 bp, H. sapiens
tgtatgcatccaggaa

SEQ ID NO: 154053 - DNA, 16 bp, H. sapiens
tgtatgcattttaaaa

SEQ ID NO: 154054 - DNA, 16 bp, H. sapiens
tgtatgcctttgcata

SEQ ID NO: 154055 - DNA, 16 bp, H. sapiens
tgtatgcgtgtgtgtg

SEQ ID NO: 154056 - DNA, 16 bp, H. sapiens
tgtatgctaatgagat

SEQ ID NO: 154057 - DNA, 16 bp, H. sapiens
tgtatggatgtgtgtg

SEQ ID NO: 154058 - DNA, 16 bp, H. sapiens
tgtatggattatttca

SEQ ID NO: 154059 - DNA, 16 bp, H. sapiens
tgtatggcctgaagtg

SEQ ID NO: 154060 - DNA, 16 bp, H. sapiens
tgtatggcctgcagtg

SEQ ID NO: 154061 - DNA, 16 bp, H. sapiens
tgtatggcttatttca

SEQ ID NO: 154062 - DNA, 16 bp, H. sapiens
tgtatggtttgcagat

SEQ ID NO: 154063 - DNA, 16 bp, H. sapiens
tgtatgtaaaatgttt

SEQ ID NO: 154064 - DNA, 16 bp, H. sapiens
tgtatgtaaatataaa

SEQ ID NO: 154065 - DNA, 16 bp, H. sapiens
tgtatgtaagaaaacc

SEQ ID NO: 154066 - DNA, 16 bp, H. sapiens
tgtatgtacatataca

SEQ ID NO: 154067 - DNA, 16 bp, H. sapiens
tgtatgtacatatata

SEQ ID NO: 154068 - DNA, 16 bp, H. sapiens
tgtatgtatacataca

SEQ ID NO: 154069 - DNA, 16 bp, H. sapiens
tgtatgtatacatata

SEQ ID NO: 154070 - DNA, 16 bp, H. sapiens
tgtatgtatagatata

SEQ ID NO: 154071 - DNA, 16 bp, H. sapiens
tgtatgtatatataca

SEQ ID NO: 154072 - DNA, 16 bp, H. sapiens
tgtatgtatatatgtt

SEQ ID NO: 154073 - DNA, 16 bp, H. sapiens
tgtatgtatatattca

SEQ ID NO: 154074 - DNA, 16 bp, H. sapiens
tgtatgtatctatctg

SEQ ID NO: 154075 - DNA, 16 bp, H. sapiens
tgtatgtatctatgta

SEQ ID NO: 154076 - DNA, 16 bp, H. sapiens
tgtatgtatgatgtat

SEQ ID NO: 154077 - DNA, 16 bp, H. sapiens
tgtatgtatgcacaca

SEQ ID NO: 154078 - DNA, 16 bp, H. sapiens
tgtatgtatgcatata

SEQ ID NO: 154079 - DNA, 16 bp, H. sapiens
tgtatgtatgcatgtt

SEQ ID NO: 154080 - DNA, 16 bp, H. sapiens
tgtatgtatgtaaatg

SEQ ID NO: 154081 - DNA, 16 bp, H. sapiens
tgtatgtatgtacata

SEQ ID NO: 154082 - DNA, 16 bp, H. sapiens
tgtatgtatgtagaga

SEQ ID NO: 154083 - DNA, 16 bp, H. sapiens
tgtatgtatgtatacg

SEQ ID NO: 154084 - DNA, 16 bp, H. sapiens
tgtatgtatgtatata

SEQ ID NO: 154085 - DNA, 16 bp, H. sapiens
tgtatgtatgtatatc

SEQ ID NO: 154086 - DNA, 16 bp, H. sapiens
tgtatgtatgtatgtg

SEQ ID NO: 154087 - DNA, 16 bp, H. sapiens
tgtatgtatgtgcata

SEQ ID NO: 154088 - DNA, 16 bp, H. sapiens
tgtatgtatgtttaaa

SEQ ID NO: 154089 - DNA, 16 bp, H. sapiens
tgtatgtatttaaaat

SEQ ID NO: 154090 - DNA, 16 bp, H. sapiens
tgtatgtatttcaaaa

SEQ ID NO: 154091 - DNA, 16 bp, H. sapiens
tgtatgtatttgtgta

SEQ ID NO: 154092 - DNA, 16 bp, H. sapiens
tgtatgtattttacca

SEQ ID NO: 154093 - DNA, 16 bp, H. sapiens
tgtatgtctatatgtg

SEQ ID NO: 154094 - DNA, 16 bp, H. sapiens
tgtatgtctgtgtctg

SEQ ID NO: 154095 - DNA, 16 bp, H. sapiens
tgtatgtctgtgtgtg

SEQ ID NO: 154096 - DNA, 16 bp, H. sapiens
tgtatgtcttcttttg

SEQ ID NO: 154097 - DNA, 16 bp, H. sapiens
tgtatgtcttttgaga

SEQ ID NO: 154098 - DNA, 16 bp, H. sapiens
tgtatgtgaatattca

SEQ ID NO: 154099 - DNA, 16 bp, H. sapiens
tgtatgtgaatgttta

SEQ ID NO: 154100 - DNA, 16 bp, H. sapiens
tgtatgtgattgtgtg

SEQ ID NO: 154101 - DNA, 16 bp, H. sapiens
tgtatgtgcacatata

SEQ ID NO: 154102 - DNA, 16 bp, H. sapiens
tgtatgtgcacatgtg

SEQ ID NO: 154103 - DNA, 16 bp, H. sapiens
tgtatgtgcatgcatg

SEQ ID NO: 154104 - DNA, 16 bp, H. sapiens
tgtatgtgccacattt

SEQ ID NO: 154105 - DNA, 16 bp, H. sapiens
tgtatgtgcgtgtgtg

SEQ ID NO: 154106 - DNA, 16 bp, H. sapiens
tgtatgtgcttgtgtg

SEQ ID NO: 154107 - DNA, 16 bp, H. sapiens
tgtatgtggtatgtgt

SEQ ID NO: 154108 - DNA, 16 bp, H. sapiens
tgtatgtgtatacata

SEQ ID NO: 154109 - DNA, 16 bp, H. sapiens
tgtatgtgtatatata

SEQ ID NO: 154110 - DNA, 16 bp, H. sapiens
tgtatgtgtatctata

SEQ ID NO: 154111 - DNA, 16 bp, H. sapiens
tgtatgtgtatctatg

SEQ ID NO: 154112 - DNA, 16 bp, H. sapiens
tgtatgtgtatgcaca

SEQ ID NO: 154113 - DNA, 16 bp, H. sapiens
tgtatgtgtatgcata

SEQ ID NO: 154114 - DNA, 16 bp, H. sapiens
tgtatgtgtatttata

SEQ ID NO: 154115 - DNA, 16 bp, H. sapiens
tgtatgtgtccaggaa

SEQ ID NO: 154116 - DNA, 16 bp, H. sapiens
tgtatgtgtctgtgtg

SEQ ID NO: 154117 - DNA, 16 bp, H. sapiens
tgtatgtgtgaatata

SEQ ID NO: 154118 - DNA, 16 bp, H. sapiens
tgtatgtgtgaatgtg

SEQ ID NO: 154119 - DNA, 16 bp, H. sapiens
tgtatgtgtgagtata

SEQ ID NO: 154120 - DNA, 16 bp, H. sapiens
tgtatgtgtgctgtgt

SEQ ID NO: 154121 - DNA, 16 bp, H. sapiens
tgtatgtgtgtacatg

SEQ ID NO: 154122 - DNA, 16 bp, H. sapiens
tgtatgtgtgtctttg

SEQ ID NO: 154123 - DNA, 16 bp, H. sapiens
tgtatgtgtgtgcaca

SEQ ID NO: 154124 - DNA, 16 bp, H. sapiens
tgtatgtgtgtttaat

SEQ ID NO: 154125 - DNA, 16 bp, H. sapiens
tgtatgttactttaaa

SEQ ID NO: 154126 - DNA, 16 bp, H. sapiens
tgtatgtttaactttt

SEQ ID NO: 154127 - DNA, 16 bp, H. sapiens
tgtatgtttacatata

SEQ ID NO: 154128 - DNA, 16 bp, H. sapiens
tgtatgtttccaggaa

SEQ ID NO: 154129 - DNA, 16 bp, H. sapiens
tgtatgtttctagaaa

SEQ ID NO: 154130 - DNA, 16 bp, H. sapiens
tgtatgtttgtatata

SEQ ID NO: 154131 - DNA, 16 bp, H. sapiens
tgtatgttttcagaaa

SEQ ID NO: 154132 - DNA, 16 bp, H. sapiens
tgtatgttttctatgt

SEQ ID NO: 154133 - DNA, 16 bp, H. sapiens
tgtattaatccatttt

SEQ ID NO: 154134 - DNA, 16 bp, H. sapiens
tgtattaattttctat

SEQ ID NO: 154135 - DNA, 16 bp, H. sapiens
tgtattacaaatattt

SEQ ID NO: 154136 - DNA, 16 bp, H. sapiens
tgtattacatactgta

SEQ ID NO: 154137 - DNA, 16 bp, H. sapiens
tgtattacttttacaa

SEQ ID NO: 154138 - DNA, 16 bp, H. sapiens
tgtattacttttgtaa

SEQ ID NO: 154139 - DNA, 16 bp, H. sapiens
tgtattactttttaaa

SEQ ID NO: 154140 - DNA, 16 bp, H. sapiens
tgtattagatattata

SEQ ID NO: 154141 - DNA, 16 bp, H. sapiens
tgtattaggccgttct

SEQ ID NO: 154142 - DNA, 16 bp, H. sapiens
tgtattagtagagatg

SEQ ID NO: 154143 - DNA, 16 bp, H. sapiens
tgtattagtcaaggtt

SEQ ID NO: 154144 - DNA, 16 bp, H. sapiens
tgtattagtccattct

SEQ ID NO: 154145 - DNA, 16 bp, H. sapiens
tgtattagtttcctag

SEQ ID NO: 154146 - DNA, 16 bp, H. sapiens
tgtattatagtaactt

SEQ ID NO: 154147 - DNA, 16 bp, H. sapiens
tgtattatataacata

SEQ ID NO: 154148 - DNA, 16 bp, H. sapiens
tgtattatatatgtac

SEQ ID NO: 154149 - DNA, 16 bp, H. sapiens
tgtattatattttcat

SEQ ID NO: 154150 - DNA, 16 bp, H. sapiens
tgtattatgtgtatat

SEQ ID NO: 154151 - DNA, 17 bp, H. sapiens
tgtattattagtagaga

SEQ ID NO: 154152 - DNA, 16 bp, H. sapiens
tgtattatttcactta

SEQ ID NO: 154153 - DNA, 16 bp, H. sapiens
tgtattatttcttaca

SEQ ID NO: 154154 - DNA, 16 bp, H. sapiens
tgtattcaggaaacct

SEQ ID NO: 154155 - DNA, 16 bp, H. sapiens
tgtattcatatatgta

SEQ ID NO: 154156 - DNA, 16 bp, H. sapiens
tgtattcattcagcaa

SEQ ID NO: 154157 - DNA, 16 bp, H. sapiens
tgtattcatttattca

SEQ ID NO: 154158 - DNA, 16 bp, H. sapiens
tgtattcatttgttct

SEQ ID NO: 154159 - DNA, 16 bp, H. sapiens
tgtattcatttttaaa

SEQ ID NO: 154160 - DNA, 16 bp, H. sapiens
tgtattccagcctggg

SEQ ID NO: 154161 - DNA, 16 bp, H. sapiens
tgtattcccagctact

SEQ ID NO: 154162 - DNA, 16 bp, H. sapiens
tgtattcctaggtatt

SEQ ID NO: 154163 - DNA, 16 bp, H. sapiens
tgtattcctattttat

SEQ ID NO: 154164 - DNA, 16 bp, H. sapiens
tgtattccttaaataa

SEQ ID NO: 154165 - DNA, 16 bp, H. sapiens
tgtattctacagtatt

SEQ ID NO: 154166 - DNA, 16 bp, H. sapiens
tgtattctgaaacttt

SEQ ID NO: 154167 - DNA, 16 bp, H. sapiens
tgtattcttgaaaact

SEQ ID NO: 154168 - DNA, 16 bp, H. sapiens
tgtattcttttgaaat

SEQ ID NO: 154169 - DNA, 16 bp, H. sapiens
tgtattgattggttga

SEQ ID NO: 154170 - DNA, 16 bp, H. sapiens
tgtattggttattcta

SEQ ID NO: 154171 - DNA, 16 bp, H. sapiens
tgtattgtttagagaa

SEQ ID NO: 154172 - DNA, 16 bp, H. sapiens
tgtattgtttgtaaca

SEQ ID NO: 154173 - DNA, 16 bp, H. sapiens
tgtattgttttaagcc

SEQ ID NO: 154174 - DNA, 16 bp, H. sapiens
tgtatttaaaaataca

SEQ ID NO: 154175 - DNA, 16 bp, H. sapiens
tgtatttaaagcattt

SEQ ID NO: 154176 - DNA, 16 bp, H. sapiens
tgtatttaaatgtata

SEQ ID NO: 154177 - DNA, 16 bp, H. sapiens
tgtatttaaatttcat

SEQ ID NO: 154178 - DNA, 16 bp, H. sapiens
tgtatttaactttata

SEQ ID NO: 154179 - DNA, 16 bp, H. sapiens
tgtatttaataaatgg

SEQ ID NO: 154180 - DNA, 16 bp, H. sapiens
tgtatttacacaaacc

SEQ ID NO: 154181 - DNA, 16 bp, H. sapiens
tgtatttacagccatt

SEQ ID NO: 154182 - DNA, 16 bp, H. sapiens
tgtatttactgtattt

SEQ ID NO: 154183 - DNA, 16 bp, H. sapiens
tgtatttaggaagtaa

SEQ ID NO: 154184 - DNA, 16 bp, H. sapiens
tgtatttatatacatg

SEQ ID NO: 154185 - DNA, 16 bp, H. sapiens
tgtatttatatttcat

SEQ ID NO: 154186 - DNA, 16 bp, H. sapiens
tgtatttatcagcagt

SEQ ID NO: 154187 - DNA, 16 bp, H. sapiens
tgtatttattacattt

SEQ ID NO: 154188 - DNA, 16 bp, H. sapiens
tgtatttattcattta

SEQ ID NO: 154189 - DNA, 16 bp, H. sapiens
tgtatttatttacctt

SEQ ID NO: 154190 - DNA, 16 bp, H. sapiens
tgtatttattttcaaa

SEQ ID NO: 154191 - DNA, 16 bp, H. sapiens
tgtatttcaaaatttt

SEQ ID NO: 154192 - DNA, 16 bp, H. sapiens
tgtatttcaaggattt

SEQ ID NO: 154193 - DNA, 16 bp, H. sapiens
tgtatttcagtatttt

SEQ ID NO: 154194 - DNA, 16 bp, H. sapiens
tgtatttcctgaaatt

SEQ ID NO: 154195 - DNA, 16 bp, H. sapiens
tgtatttcctgtattt

SEQ ID NO: 154196 - DNA, 16 bp, H. sapiens
tgtatttccttccagt

SEQ ID NO: 154197 - DNA, 16 bp, H. sapiens
tgtatttccttttctg

SEQ ID NO: 154198 - DNA, 16 bp, H. sapiens
tgtatttctaaatatt

SEQ ID NO: 154199 - DNA, 16 bp, H. sapiens
tgtatttctaacaagt

SEQ ID NO: 154200 - DNA, 16 bp, H. sapiens
tgtatttctataaata

SEQ ID NO: 154201 - DNA, 16 bp, H. sapiens
tgtatttctattttca

SEQ ID NO: 154202 - DNA, 16 bp, H. sapiens
tgtatttctccttgaa

SEQ ID NO: 154203 - DNA, 16 bp, H. sapiens
tgtatttctcttctta

SEQ ID NO: 154204 - DNA, 16 bp, H. sapiens
tgtatttcttctttgg

SEQ ID NO: 154205 - DNA, 16 bp, H. sapiens
tgtatttctttataaa

SEQ ID NO: 154206 - DNA, 16 bp, H. sapiens
tgtatttctttgtaga

SEQ ID NO: 154207 - DNA, 16 bp, H. sapiens
tgtatttcttttataa

SEQ ID NO: 154208 - DNA, 16 bp, H. sapiens
tgtatttcttttgtaa

SEQ ID NO: 154209 - DNA, 16 bp, H. sapiens
tgtatttgaataaaat

SEQ ID NO: 154210 - DNA, 16 bp, H. sapiens
tgtatttgaatttatg

SEQ ID NO: 154211 - DNA, 16 bp, H. sapiens
tgtatttgattcttct

SEQ ID NO: 154212 - DNA, 16 bp, H. sapiens
tgtatttgcatgtgtg

SEQ ID NO: 154213 - DNA, 16 bp, H. sapiens
tgtatttggaatattt

SEQ ID NO: 154214 - DNA, 16 bp, H. sapiens
tgtatttggatgtcta

SEQ ID NO: 154215 - DNA, 16 bp, H. sapiens
tgtatttggttttctg

SEQ ID NO: 154216 - DNA, 16 bp, H. sapiens
tgtatttgtacagttt

SEQ ID NO: 154217 - DNA, 16 bp, H. sapiens
tgtatttgtttcctat

SEQ ID NO: 154218 - DNA, 16 bp, H. sapiens
tgtattttaaaacata

SEQ ID NO: 154219 - DNA, 16 bp, H. sapiens
tgtattttaagtaaag

SEQ ID NO: 154220 - DNA, 16 bp, H. sapiens
tgtattttaataaaga

SEQ ID NO: 154221 - DNA, 16 bp, H. sapiens
tgtattttacatatat

SEQ ID NO: 154222 - DNA, 16 bp, H. sapiens
tgtattttaccacaat

SEQ ID NO: 154223 - DNA, 16 bp, H. sapiens
tgtattttagattcag

SEQ ID NO: 154224 - DNA, 16 bp, H. sapiens
tgtattttagtaaaga

SEQ ID NO: 154225 - DNA, 16 bp, H. sapiens
tgtattttagtagaga

SEQ ID NO: 154226 - DNA, 16 bp, H. sapiens
tgtattttatacttga

SEQ ID NO: 154227 - DNA, 16 bp, H. sapiens
tgtattttatctggca

SEQ ID NO: 154228 - DNA, 16 bp, H. sapiens
tgtattttattctgtg

SEQ ID NO: 154229 - DNA, 16 bp, H. sapiens
tgtattttcactttta

SEQ ID NO: 154230 - DNA, 16 bp, H. sapiens
tgtattttcagcagag

SEQ ID NO: 154231 - DNA, 16 bp, H. sapiens
tgtattttcagtatag

SEQ ID NO: 154232 - DNA, 16 bp, H. sapiens
tgtattttctcatagt

SEQ ID NO: 154233 - DNA, 16 bp, H. sapiens
tgtattttctctgtaa

SEQ ID NO: 154234 - DNA, 16 bp, H. sapiens
tgtattttcttacagt

SEQ ID NO: 154235 - DNA, 16 bp, H. sapiens
tgtattttcttattga

SEQ ID NO: 154236 - DNA, 16 bp, H. sapiens
tgtattttcttctaat

SEQ ID NO: 154237 - DNA, 16 bp, H. sapiens
tgtattttcttgaagt

SEQ ID NO: 154238 - DNA, 16 bp, H. sapiens
tgtattttgaaaaaca

SEQ ID NO: 154239 - DNA, 16 bp, H. sapiens
tgtattttgatagaga

SEQ ID NO: 154240 - DNA, 16 bp, H. sapiens
tgtattttgatgggaa

SEQ ID NO: 154241 - DNA, 16 bp, H. sapiens
tgtattttgtaaatgt

SEQ ID NO: 154242 - DNA, 16 bp, H. sapiens
tgtatttttaaaacac

SEQ ID NO: 154243 - DNA, 16 bp, H. sapiens
tgtatttttaaaatct

SEQ ID NO: 154244 - DNA, 16 bp, H. sapiens
tgtatttttaaagatg

SEQ ID NO: 154245 - DNA, 16 bp, H. sapiens
tgtatttttaaagcat

SEQ ID NO: 154246 - DNA, 17 bp, H. sapiens
tgtatttttaatagagt

SEQ ID NO: 154247 - DNA, 16 bp, H. sapiens
tgtatttttaataggg

SEQ ID NO: 154248 - DNA, 16 bp, H. sapiens
tgtatttttaatggaa

SEQ ID NO: 154249 - DNA, 16 bp, H. sapiens
tgtatttttacaaata

SEQ ID NO: 154250 - DNA, 17 bp, H. sapiens
tgtatttttactagaga

SEQ ID NO: 154251 - DNA, 18 bp, H. sapiens
tgtatttttactagagac

SEQ ID NO: 154252 - DNA, 16 bp, H. sapiens
tgtatttttactatac

SEQ ID NO: 154253 - DNA, 16 bp, H. sapiens
tgtatttttagtaaga

SEQ ID NO: 154254 - DNA, 17 bp, H. sapiens
tgtatttttagtacaga

SEQ ID NO: 154255 - DNA, 17 bp, H. sapiens
tgtatttttagtagagc

SEQ ID NO: 154256 - DNA, 17 bp, H. sapiens
tgtatttttagtagagg

SEQ ID NO: 154257 - DNA, 17 bp, H. sapiens
tgtatttttagtataga

SEQ ID NO: 154258 - DNA, 16 bp, H. sapiens
tgtatttttagttcag

SEQ ID NO: 154259 - DNA, 16 bp, H. sapiens
tgtatttttatagaga

SEQ ID NO: 154260 - DNA, 16 bp, H. sapiens
tgtatttttattggag

SEQ ID NO: 154261 - DNA, 16 bp, H. sapiens
tgtatttttcaaatgt

SEQ ID NO: 154262 - DNA, 16 bp, H. sapiens
tgtatttttcagaata

SEQ ID NO: 154263 - DNA, 16 bp, H. sapiens
tgtatttttcagtaaa

SEQ ID NO: 154264 - DNA, 16 bp, H. sapiens
tgtatttttcagttat

SEQ ID NO: 154265 - DNA, 16 bp, H. sapiens
tgtatttttggtagaa

SEQ ID NO: 154266 - DNA, 16 bp, H. sapiens
tgtatttttggtagac

SEQ ID NO: 154267 - DNA, 17 bp, H. sapiens
tgtatttttggtagaga

SEQ ID NO: 154268 - DNA, 17 bp, H. sapiens
tgtatttttggtggaga

SEQ ID NO: 154269 - DNA, 16 bp, H. sapiens
tgtatttttgtacaga

SEQ ID NO: 154270 - DNA, 16 bp, H. sapiens
tgtatttttgtagtga

SEQ ID NO: 154271 - DNA, 16 bp, H. sapiens
tgtattttttatctca

SEQ ID NO: 154272 - DNA, 16 bp, H. sapiens
tgtattttttctagta

SEQ ID NO: 154273 - DNA, 16 bp, H. sapiens
tgtattttttgtaaag

SEQ ID NO: 154274 - DNA, 16 bp, H. sapiens
tgtattttttgtgaag

SEQ ID NO: 154275 - DNA, 16 bp, H. sapiens
tgtatttttttcaaat

SEQ ID NO: 154276 - DNA, 16 bp, H. sapiens
tgtcaaaaaaagaaag

SEQ ID NO: 154277 - DNA, 16 bp, H. sapiens
tgtcaaaaagaaataa

SEQ ID NO: 154278 - DNA, 16 bp, H. sapiens
tgtcaaaaataaattg

SEQ ID NO: 154279 - DNA, 16 bp, H. sapiens
tgtcaaaacatatcaa

SEQ ID NO: 154280 - DNA, 16 bp, H. sapiens
tgtcaaaagaaagaaa

SEQ ID NO: 154281 - DNA, 16 bp, H. sapiens
tgtcaaaatccataga

SEQ ID NO: 154282 - DNA, 16 bp, H. sapiens
tgtcaaaatgaaaaaa

SEQ ID NO: 154283 - DNA, 16 bp, H. sapiens
tgtcaaaattatttct

SEQ ID NO: 154284 - DNA, 16 bp, H. sapiens
tgtcaaaattcattga

SEQ ID NO: 154285 - DNA, 16 bp, H. sapiens
tgtcaaacactgtgct

SEQ ID NO: 154286 - DNA, 16 bp, H. sapiens
tgtcaaaggtcagatg

SEQ ID NO: 154287 - DNA, 16 bp, H. sapiens
tgtcaaagtcatgaaa

SEQ ID NO: 154288 - DNA, 16 bp, H. sapiens
tgtcaaataaatatat

SEQ ID NO: 154289 - DNA, 16 bp, H. sapiens
tgtcaaatcctagaaa

SEQ ID NO: 154290 - DNA, 16 bp, H. sapiens
tgtcaaccaagaatac

SEQ ID NO: 154291 - DNA, 16 bp, H. sapiens
tgtcaaccaggctaga

SEQ ID NO: 154292 - DNA, 16 bp, H. sapiens
tgtcaacccgggaggc

SEQ ID NO: 154293 - DNA, 18 bp, H. sapiens
tgtcaactttggcttttg

SEQ ID NO: 154294 - DNA, 16 bp, H. sapiens
tgtcaagaagagtatt

SEQ ID NO: 154295 - DNA, 16 bp, H. sapiens
tgtcaagatttttttt

SEQ ID NO: 154296 - DNA, 16 bp, H. sapiens
tgtcaaggctgcagtg

SEQ ID NO: 154297 - DNA, 16 bp, H. sapiens
tgtcaagttttggtat

SEQ ID NO: 154298 - DNA, 16 bp, H. sapiens
tgtcaataaaatattt

SEQ ID NO: 154299 - DNA, 16 bp, H. sapiens
tgtcaatcatacctca

SEQ ID NO: 154300 - DNA, 16 bp, H. sapiens
tgtcaatgtttgcttt

SEQ ID NO: 154301 - DNA, 16 bp, H. sapiens
tgtcaattaaaaagaa

SEQ ID NO: 154302 - DNA, 16 bp, H. sapiens
tgtcaattaaaaataa

SEQ ID NO: 154303 - DNA, 16 bp, H. sapiens
tgtcaattaaaagtaa

SEQ ID NO: 154304 - DNA, 16 bp, H. sapiens
tgtcaattctccctaa

SEQ ID NO: 154305 - DNA, 16 bp, H. sapiens
tgtcaattgcattttt

SEQ ID NO: 154306 - DNA, 16 bp, H. sapiens
tgtcaatttaaaaatt

SEQ ID NO: 154307 - DNA, 16 bp, H. sapiens
tgtcaatttttccttt

SEQ ID NO: 154308 - DNA, 16 bp, H. sapiens
tgtcaatttttgattt

SEQ ID NO: 154309 - DNA, 16 bp, H. sapiens
tgtcaatttttgcctt

SEQ ID NO: 154310 - DNA, 16 bp, H. sapiens
tgtcacaaaaacaaaa

SEQ ID NO: 154311 - DNA, 16 bp, H. sapiens
tgtcacaagaacagaa

SEQ ID NO: 154312 - DNA, 16 bp, H. sapiens
tgtcacaagaacagca

SEQ ID NO: 154313 - DNA, 16 bp, H. sapiens
tgtcacaagacatcct

SEQ ID NO: 154314 - DNA, 16 bp, H. sapiens
tgtcacaatcacagct

SEQ ID NO: 154315 - DNA, 16 bp, H. sapiens
tgtcacagaaaaaaaa

SEQ ID NO: 154316 - DNA, 16 bp, H. sapiens
tgtcacagagattctg

SEQ ID NO: 154317 - DNA, 16 bp, H. sapiens
tgtcacagctcataaa

SEQ ID NO: 154318 - DNA, 16 bp, H. sapiens
tgtcacagctgaggaa

SEQ ID NO: 154319 - DNA, 16 bp, H. sapiens
tgtcacatagcaagag

SEQ ID NO: 154320 - DNA, 16 bp, H. sapiens
tgtcacattttggcaa

SEQ ID NO: 154321 - DNA, 16 bp, H. sapiens
tgtcacattttgttta

SEQ ID NO: 154322 - DNA, 16 bp, H. sapiens
tgtcaccaaagctgga

SEQ ID NO: 154323 - DNA, 16 bp, H. sapiens
tgtcaccacatccagc

SEQ ID NO: 154324 - DNA, 16 bp, H. sapiens
tgtcaccaccagccct

SEQ ID NO: 154325 - DNA, 16 bp, H. sapiens
tgtcaccacccaaatc

SEQ ID NO: 154326 - DNA, 16 bp, H. sapiens
tgtcaccacccaggct

SEQ ID NO: 154327 - DNA, 16 bp, H. sapiens
tgtcaccagggctgga

SEQ ID NO: 154328 - DNA, 16 bp, H. sapiens
tgtcaccagtggaggc

SEQ ID NO: 154329 - DNA, 16 bp, H. sapiens
tgtcaccatcatcacc

SEQ ID NO: 154330 - DNA, 16 bp, H. sapiens
tgtcacccaagcagga

SEQ ID NO: 154331 - DNA, 16 bp, H. sapiens
tgtcacccaagctgga

SEQ ID NO: 154332 - DNA, 16 bp, H. sapiens
tgtcacccagctggag

SEQ ID NO: 154333 - DNA, 16 bp, H. sapiens
tgtcacccaggatgga

SEQ ID NO: 154334 - DNA, 16 bp, H. sapiens
tgtcacccaggctgaa

SEQ ID NO: 154335 - DNA, 16 bp, H. sapiens
tgtcacccaggctgtg

SEQ ID NO: 154336 - DNA, 16 bp, H. sapiens
tgtcacccaggcttga

SEQ ID NO: 154337 - DNA, 16 bp, H. sapiens
tgtcacccaggtggtg

SEQ ID NO: 154338 - DNA, 16 bp, H. sapiens
tgtcaccccagagtca

SEQ ID NO: 154339 - DNA, 16 bp, H. sapiens
tgtcaccccagttaaa

SEQ ID NO: 154340 - DNA, 16 bp, H. sapiens
tgtcaccctgcctgga

SEQ ID NO: 154341 - DNA, 16 bp, H. sapiens
tgtcaccctgtcaccc

SEQ ID NO: 154342 - DNA, 16 bp, H. sapiens
tgtcacctaagctgga

SEQ ID NO: 154343 - DNA, 16 bp, H. sapiens
tgtcacctaccaaaat

SEQ ID NO: 154344 - DNA, 16 bp, H. sapiens
tgtcacctaggctgaa

SEQ ID NO: 154345 - DNA, 16 bp, H. sapiens
tgtcacctccccagag

SEQ ID NO: 154346 - DNA, 16 bp, H. sapiens
tgtcacctggccagag

SEQ ID NO: 154347 - DNA, 16 bp, H. sapiens
tgtcactcagcctgga

SEQ ID NO: 154348 - DNA, 16 bp, H. sapiens
tgtcactccaccccca

SEQ ID NO: 154349 - DNA, 16 bp, H. sapiens
tgtcactgcactccag

SEQ ID NO: 154350 - DNA, 16 bp, H. sapiens
tgtcactgtgctccag

SEQ ID NO: 154351 - DNA, 16 bp, H. sapiens
tgtcactgtgtctgtg

SEQ ID NO: 154352 - DNA, 16 bp, H. sapiens
tgtcagaaaaatagaa

SEQ ID NO: 154353 - DNA, 16 bp, H. sapiens
tgtcagaaagaaagaa

SEQ ID NO: 154354 - DNA, 16 bp, H. sapiens
tgtcagaaagagaaaa

SEQ ID NO: 154355 - DNA, 16 bp, H. sapiens
tgtcagagatggcttt

SEQ ID NO: 154356 - DNA, 16 bp, H. sapiens
tgtcagaggacccaaa

SEQ ID NO: 154357 - DNA, 16 bp, H. sapiens
tgtcagataaaacaga

SEQ ID NO: 154358 - DNA, 16 bp, H. sapiens
tgtcagatggagagat

SEQ ID NO: 154359 - DNA, 16 bp, H. sapiens
tgtcagatggagatga

SEQ ID NO: 154360 - DNA, 16 bp, H. sapiens
tgtcagatttttaaaa

SEQ ID NO: 154361 - DNA, 16 bp, H. sapiens
tgtcagcagagctgtg

SEQ ID NO: 154362 - DNA, 16 bp, H. sapiens
tgtcagcagcagtggc

SEQ ID NO: 154363 - DNA, 16 bp, H. sapiens
tgtcagcatttccatt

SEQ ID NO: 154364 - DNA, 16 bp, H. sapiens
tgtcagcatttgatgt

SEQ ID NO: 154365 - DNA, 18 bp, H. sapiens
tgtcagccaggatggtct

SEQ ID NO: 154366 - DNA, 16 bp, H. sapiens
tgtcagctcactgcaa

SEQ ID NO: 154367 - DNA, 16 bp, H. sapiens
tgtcaggaaacaacag

SEQ ID NO: 154368 - DNA, 16 bp, H. sapiens
tgtcaggaaagacaat

SEQ ID NO: 154369 - DNA, 16 bp, H. sapiens
tgtcaggacttcctga

SEQ ID NO: 154370 - DNA, 16 bp, H. sapiens
tgtcaggagctgactg

SEQ ID NO: 154371 - DNA, 16 bp, H. sapiens
tgtcaggattaaatga

SEQ ID NO: 154372 - DNA, 16 bp, H. sapiens
tgtcaggcactgggct

SEQ ID NO: 154373 - DNA, 16 bp, H. sapiens
tgtcaggcactgtcct

SEQ ID NO: 154374 - DNA, 16 bp, H. sapiens
tgtcaggcagtgttct

SEQ ID NO: 154375 - DNA, 22 bp, H. sapiens
tgtcaggcctctgagcccaagc

SEQ ID NO: 154376 - DNA, 16 bp, H. sapiens
tgtcaggctctgtgct

SEQ ID NO: 154377 - DNA, 16 bp, H. sapiens
tgtcaggggaaaaaaa

SEQ ID NO: 154378 - DNA, 16 bp, H. sapiens
tgtcaggtatttcttt

SEQ ID NO: 154379 - DNA, 16 bp, H. sapiens
tgtcaggttttgtttt

SEQ ID NO: 154380 - DNA, 16 bp, H. sapiens
tgtcagtgattgaaga

SEQ ID NO: 154381 - DNA, 16 bp, H. sapiens
tgtcagtgtaaacaag

SEQ ID NO: 154382 - DNA, 16 bp, H. sapiens
tgtcagtgtctcccat

SEQ ID NO: 154383 - DNA, 16 bp, H. sapiens
tgtcagttaaaaataa

SEQ ID NO: 154384 - DNA, 16 bp, H. sapiens
tgtcagtttctcaaaa

SEQ ID NO: 154385 - DNA, 16 bp, H. sapiens
tgtcagtttgttttct

SEQ ID NO: 154386 - DNA, 16 bp, H. sapiens
tgtcataaaatatttt

SEQ ID NO: 154387 - DNA, 17 bp, H. sapiens
tgtcataaacaaggtta

SEQ ID NO: 154388 - DNA, 16 bp, H. sapiens
tgtcataaataaataa

SEQ ID NO: 154389 - DNA, 16 bp, H. sapiens
tgtcataacaaaatac

SEQ ID NO: 154390 - DNA, 17 bp, H. sapiens
tgtcataatcttattca

SEQ ID NO: 154391 - DNA, 16 bp, H. sapiens
tgtcataattaatgaa

SEQ ID NO: 154392 - DNA, 16 bp, H. sapiens
tgtcatagtttaattg

SEQ ID NO: 154393 - DNA, 16 bp, H. sapiens
tgtcatataaacagaa

SEQ ID NO: 154394 - DNA, 16 bp, H. sapiens
tgtcatatctaaaaaa

SEQ ID NO: 154395 - DNA, 16 bp, H. sapiens
tgtcatattattttta

SEQ ID NO: 154396 - DNA, 16 bp, H. sapiens
tgtcatattcatcttt

SEQ ID NO: 154397 - DNA, 16 bp, H. sapiens
tgtcatcaaggctgga

SEQ ID NO: 154398 - DNA, 16 bp, H. sapiens
tgtcatcaggaaaatg

SEQ ID NO: 154399 - DNA, 16 bp, H. sapiens
tgtcatcatcatcacc

SEQ ID NO: 154400 - DNA, 16 bp, H. sapiens
tgtcatcatcatcatc

SEQ ID NO: 154401 - DNA, 16 bp, H. sapiens
tgtcatcatcattatc

SEQ ID NO: 154402 - DNA, 16 bp, H. sapiens
tgtcatcatcattgtc

SEQ ID NO: 154403 - DNA, 16 bp, H. sapiens
tgtcatccacagacaa

SEQ ID NO: 154404 - DNA, 16 bp, H. sapiens
tgtcatccagactgga

SEQ ID NO: 154405 - DNA, 16 bp, H. sapiens
tgtcatccaggctaga

SEQ ID NO: 154406 - DNA, 16 bp, H. sapiens
tgtcatccaggctttg

SEQ ID NO: 154407 - DNA, 16 bp, H. sapiens
tgtcatcccagctact

SEQ ID NO: 154408 - DNA, 16 bp, H. sapiens
tgtcatcccagctgct

SEQ ID NO: 154409 - DNA, 16 bp, H. sapiens
tgtcatcctctacccc

SEQ ID NO: 154410 - DNA, 16 bp, H. sapiens
tgtcatctatgacttc

SEQ ID NO: 154411 - DNA, 16 bp, H. sapiens
tgtcatctgcaaataa

SEQ ID NO: 154412 - DNA, 16 bp, H. sapiens
tgtcatctgcaaatga

SEQ ID NO: 154413 - DNA, 16 bp, H. sapiens
tgtcatctgcacacag

SEQ ID NO: 154414 - DNA, 16 bp, H. sapiens
tgtcatctgggagcta

SEQ ID NO: 154415 - DNA, 16 bp, H. sapiens
tgtcatctgtaaaatg

SEQ ID NO: 154416 - DNA, 16 bp, H. sapiens
tgtcatctgtaaagtg

SEQ ID NO: 154417 - DNA, 16 bp, H. sapiens
tgtcatcttatgtaaa

SEQ ID NO: 154418 - DNA, 16 bp, H. sapiens
tgtcatcttcatttta

SEQ ID NO: 154419 - DNA, 16 bp, H. sapiens
tgtcatgaactgggtg

SEQ ID NO: 154420 - DNA, 16 bp, H. sapiens
tgtcatggagctggtg

SEQ ID NO: 154421 - DNA, 16 bp, H. sapiens
tgtcatggcaatgtca

SEQ ID NO: 154422 - DNA, 16 bp, H. sapiens
tgtcatgggggtttgt

SEQ ID NO: 154423 - DNA, 16 bp, H. sapiens
tgtcatggggtcgggg

SEQ ID NO: 154424 - DNA, 16 bp, H. sapiens
tgtcatggtgctggta

SEQ ID NO: 154425 - DNA, 16 bp, H. sapiens
tgtcatggtgctggtg

SEQ ID NO: 154426 - DNA, 16 bp, H. sapiens
tgtcatggttcctgcc

SEQ ID NO: 154427 - DNA, 16 bp, H. sapiens
tgtcatgttttcattt

SEQ ID NO: 154428 - DNA, 16 bp, H. sapiens
tgtcatgttttcttgc

SEQ ID NO: 154429 - DNA, 16 bp, H. sapiens
tgtcattaattttgaa

SEQ ID NO: 154430 - DNA, 16 bp, H. sapiens
tgtcattattccctaa

SEQ ID NO: 154431 - DNA, 16 bp, H. sapiens
tgtcattccagctact

SEQ ID NO: 154432 - DNA, 25 bp, H. sapiens
tgtcattgataacatcttatcagga

SEQ ID NO: 154433 - DNA, 16 bp, H. sapiens
tgtcattgtcattgtt

SEQ ID NO: 154434 - DNA, 16 bp, H. sapiens
tgtcattgtctggttt

SEQ ID NO: 154435 - DNA, 16 bp, H. sapiens
tgtcattgtgctgtta

SEQ ID NO: 154436 - DNA, 16 bp, H. sapiens
tgtcattgtggtcctc

SEQ ID NO: 154437 - DNA, 16 bp, H. sapiens
tgtcatttcatttatt

SEQ ID NO: 154438 - DNA, 16 bp, H. sapiens
tgtcatttctatttta

SEQ ID NO: 154439 - DNA, 16 bp, H. sapiens
tgtcatttctgatttc

SEQ ID NO: 154440 - DNA, 16 bp, H. sapiens
tgtcattttgattata

SEQ ID NO: 154441 - DNA, 16 bp, H. sapiens
tgtcatttttctctgg

SEQ ID NO: 154442 - DNA, 16 bp, H. sapiens
tgtccaaacaacttga

SEQ ID NO: 154443 - DNA, 16 bp, H. sapiens
tgtccaaagtcacaca

SEQ ID NO: 154444 - DNA, 16 bp, H. sapiens
tgtccaaagtcacatg

SEQ ID NO: 154445 - DNA, 16 bp, H. sapiens
tgtccaacaagtccca

SEQ ID NO: 154446 - DNA, 16 bp, H. sapiens
tgtccaactaattttt

SEQ ID NO: 154447 - DNA, 16 bp, H. sapiens
tgtccaagaaatcatt

SEQ ID NO: 154448 - DNA, 16 bp, H. sapiens
tgtccaagaatttatc

SEQ ID NO: 154449 - DNA, 16 bp, H. sapiens
tgtccaagatcacaga

SEQ ID NO: 154450 - DNA, 16 bp, H. sapiens
tgtccaagccccacct

SEQ ID NO: 154451 - DNA, 16 bp, H. sapiens
tgtccaaggtcacatg

SEQ ID NO: 154452 - DNA, 16 bp, H. sapiens
tgtccacaaggaaatt

SEQ ID NO: 154453 - DNA, 16 bp, H. sapiens
tgtccacacaaaagcc

SEQ ID NO: 154454 - DNA, 16 bp, H. sapiens
tgtccacacaaaggtt

SEQ ID NO: 154455 - DNA, 16 bp, H. sapiens
tgtccacatcctgcag

SEQ ID NO: 154456 - DNA, 16 bp, H. sapiens
tgtccaccttctgtga

SEQ ID NO: 154457 - DNA, 16 bp, H. sapiens
tgtccaccttggcctc

SEQ ID NO: 154458 - DNA, 16 bp, H. sapiens
tgtccactccagaccc

SEQ ID NO: 154459 - DNA, 16 bp, H. sapiens
tgtccagaagggtttt

SEQ ID NO: 154460 - DNA, 16 bp, H. sapiens
tgtccagaatctacaa

SEQ ID NO: 154461 - DNA, 16 bp, H. sapiens
tgtccagaatggtatt

SEQ ID NO: 154462 - DNA, 16 bp, H. sapiens
tgtccagactggtctt

SEQ ID NO: 154463 - DNA, 16 bp, H. sapiens
tgtccagcactcccca

SEQ ID NO: 154464 - DNA, 16 bp, H. sapiens
tgtccagcatccaaga

SEQ ID NO: 154465 - DNA, 16 bp, H. sapiens
tgtccagcctccctgg

SEQ ID NO: 154466 - DNA, 16 bp, H. sapiens
tgtccagcctgccacc

SEQ ID NO: 154467 - DNA, 16 bp, H. sapiens
tgtccagcctggtctc

SEQ ID NO: 154468 - DNA, 16 bp, H. sapiens
tgtccagctaattttt

SEQ ID NO: 154469 - DNA, 16 bp, H. sapiens
tgtccaggaccagaca

SEQ ID NO: 154470 - DNA, 16 bp, H. sapiens
tgtccaggctgctctc

SEQ ID NO: 154471 - DNA, 16 bp, H. sapiens
tgtccaggctggactc

SEQ ID NO: 154472 - DNA, 16 bp, H. sapiens
tgtccaggctggagta

SEQ ID NO: 154473 - DNA, 16 bp, H. sapiens
tgtccaggctggtctg

SEQ ID NO: 154474 - DNA, 16 bp, H. sapiens
tgtccaggctgtagtg

SEQ ID NO: 154475 - DNA, 16 bp, H. sapiens
tgtccagtgatgatga

SEQ ID NO: 154476 - DNA, 16 bp, H. sapiens
tgtccagtgtttcctg

SEQ ID NO: 154477 - DNA, 16 bp, H. sapiens
tgtccagttttcaaca

SEQ ID NO: 154478 - DNA, 16 bp, H. sapiens
tgtccagttttcccag

SEQ ID NO: 154479 - DNA, 16 bp, H. sapiens
tgtccagttttgttct

SEQ ID NO: 154480 - DNA, 16 bp, H. sapiens
tgtccatctgtctgtc

SEQ ID NO: 154481 - DNA, 16 bp, H. sapiens
tgtccatgtctatgtc

SEQ ID NO: 154482 - DNA, 16 bp, H. sapiens
tgtccatgtgtataca

SEQ ID NO: 154483 - DNA, 16 bp, H. sapiens
tgtccattacccagtt

SEQ ID NO: 154484 - DNA, 16 bp, H. sapiens
tgtccattctgcaaat

SEQ ID NO: 154485 - DNA, 16 bp, H. sapiens
tgtccattttttaaaa

SEQ ID NO: 154486 - DNA, 16 bp, H. sapiens
tgtccattttttaatc

SEQ ID NO: 154487 - DNA, 16 bp, H. sapiens
tgtcccaaagtgctgg

SEQ ID NO: 154488 - DNA, 16 bp, H. sapiens
tgtcccacattttcct

SEQ ID NO: 154489 - DNA, 16 bp, H. sapiens
tgtcccagaggcagca

SEQ ID NO: 154490 - DNA, 16 bp, H. sapiens
tgtcccagccctgcaa

SEQ ID NO: 154491 - DNA, 16 bp, H. sapiens
tgtcccagctcaaata

SEQ ID NO: 154492 - DNA, 16 bp, H. sapiens
tgtcccagctccagga

SEQ ID NO: 154493 - DNA, 16 bp, H. sapiens
tgtcccagctgctcag

SEQ ID NO: 154494 - DNA, 16 bp, H. sapiens
tgtcccaggcactgtg

SEQ ID NO: 154495 - DNA, 16 bp, H. sapiens
tgtcccagggagagat

SEQ ID NO: 154496 - DNA, 16 bp, H. sapiens
tgtcccatctgtgcag

SEQ ID NO: 154497 - DNA, 19 bp, H. sapiens
tgtccccaaccaaatctca

SEQ ID NO: 154498 - DNA, 16 bp, H. sapiens
tgtccccaccaccacc

SEQ ID NO: 154499 - DNA, 16 bp, H. sapiens
tgtccccacccaaact

SEQ ID NO: 154500 - DNA, 16 bp, H. sapiens
tgtccccacccacatc

SEQ ID NO: 154501 - DNA, 16 bp, H. sapiens
tgtccccagacattgc

SEQ ID NO: 154502 - DNA, 16 bp, H. sapiens
tgtccccagagcccag

SEQ ID NO: 154503 - DNA, 16 bp, H. sapiens
tgtccccagcacccag

SEQ ID NO: 154504 - DNA, 16 bp, H. sapiens
tgtccccaggaccctg

SEQ ID NO: 154505 - DNA, 16 bp, H. sapiens
tgtccccaggctgcag

SEQ ID NO: 154506 - DNA, 16 bp, H. sapiens
tgtccccagttcctgg

SEQ ID NO: 154507 - DNA, 16 bp, H. sapiens
tgtccccagttgagaa

SEQ ID NO: 154508 - DNA, 17 bp, H. sapiens
tgtccccatccaaatct

SEQ ID NO: 154509 - DNA, 16 bp, H. sapiens
tgtcccccacccccaa

SEQ ID NO: 154510 - DNA, 16 bp, H. sapiens
tgtcccccacccccag

SEQ ID NO: 154511 - DNA, 16 bp, H. sapiens
tgtcccccaccccctg

SEQ ID NO: 154512 - DNA, 16 bp, H. sapiens
tgtcccccagcctgga

SEQ ID NO: 154513 - DNA, 16 bp, H. sapiens
tgtcccccaggggaca

SEQ ID NO: 154514 - DNA, 16 bp, H. sapiens
tgtccccctggctgga

SEQ ID NO: 154515 - DNA, 17 bp, H. sapiens
tgtcccctacttgagga

SEQ ID NO: 154516 - DNA, 16 bp, H. sapiens
tgtcccctaggctgga

SEQ ID NO: 154517 - DNA, 16 bp, H. sapiens
tgtcccctccaaatct

SEQ ID NO: 154518 - DNA, 16 bp, H. sapiens
tgtcccctctgaaact

SEQ ID NO: 154519 - DNA, 16 bp, H. sapiens
tgtcccctgccacagc

SEQ ID NO: 154520 - DNA, 16 bp, H. sapiens
tgtccctcatttcctg

SEQ ID NO: 154521 - DNA, 16 bp, H. sapiens
tgtccctgaagccttg

SEQ ID NO: 154522 - DNA, 16 bp, H. sapiens
tgtccctgcaaaattc

SEQ ID NO: 154523 - DNA, 17 bp, H. sapiens
tgtccctgcaaagggca

SEQ ID NO: 154524 - DNA, 17 bp, H. sapiens
tgtccctgcccaaatct

SEQ ID NO: 154525 - DNA, 16 bp, H. sapiens
tgtccctgtggctttg

SEQ ID NO: 154526 - DNA, 17 bp, H. sapiens
tgtccctgtttgcagaa

SEQ ID NO: 154527 - DNA, 16 bp, H. sapiens
tgtccctgtttgctga

SEQ ID NO: 154528 - DNA, 16 bp, H. sapiens
tgtcccttggtggaga

SEQ ID NO: 154529 - DNA, 16 bp, H. sapiens
tgtccggagtttcttc

SEQ ID NO: 154530 - DNA, 16 bp, H. sapiens
tgtcctaatgttctcc

SEQ ID NO: 154531 - DNA, 16 bp, H. sapiens
tgtcctacaagaaatg

SEQ ID NO: 154532 - DNA, 16 bp, H. sapiens
tgtcctagctacttgg

SEQ ID NO: 154533 - DNA, 16 bp, H. sapiens
tgtcctaggttttctt

SEQ ID NO: 154534 - DNA, 16 bp, H. sapiens
tgtcctcaaagttcat

SEQ ID NO: 154535 - DNA, 16 bp, H. sapiens
tgtcctcaaggaactt

SEQ ID NO: 154536 - DNA, 16 bp, H. sapiens
tgtcctcaaggagctt

SEQ ID NO: 154537 - DNA, 16 bp, H. sapiens
tgtcctcacagggcag

SEQ ID NO: 154538 - DNA, 16 bp, H. sapiens
tgtcctcaggacctcc

SEQ ID NO: 154539 - DNA, 16 bp, H. sapiens
tgtcctcatctcctct

SEQ ID NO: 154540 - DNA, 16 bp, H. sapiens
tgtcctccagaaccca

SEQ ID NO: 154541 - DNA, 16 bp, H. sapiens
tgtcctccaggttcaa

SEQ ID NO: 154542 - DNA, 16 bp, H. sapiens
tgtcctccaggttcac

SEQ ID NO: 154543 - DNA, 16 bp, H. sapiens
tgtcctccaggtttat

SEQ ID NO: 154544 - DNA, 16 bp, H. sapiens
tgtcctccagttttat

SEQ ID NO: 154545 - DNA, 16 bp, H. sapiens
tgtcctcccttccctg

SEQ ID NO: 154546 - DNA, 16 bp, H. sapiens
tgtcctcctcagcctc

SEQ ID NO: 154547 - DNA, 16 bp, H. sapiens
tgtcctctctggtttc

SEQ ID NO: 154548 - DNA, 16 bp, H. sapiens
tgtcctgattttaaaa

SEQ ID NO: 154549 - DNA, 16 bp, H. sapiens
tgtcctgcacccactg

SEQ ID NO: 154550 - DNA, 16 bp, H. sapiens
tgtcctgcctcagctt

SEQ ID NO: 154551 - DNA, 16 bp, H. sapiens
tgtcctgctggatttt

SEQ ID NO: 154552 - DNA, 16 bp, H. sapiens
tgtcctggctggtctc

SEQ ID NO: 154553 - DNA, 16 bp, H. sapiens
tgtcctgtcctgtcct

SEQ ID NO: 154554 - DNA, 16 bp, H. sapiens
tgtcctgtgaccctgc

SEQ ID NO: 154555 - DNA, 16 bp, H. sapiens
tgtccttaaggcacag

SEQ ID NO: 154556 - DNA, 16 bp, H. sapiens
tgtccttaaggttcat

SEQ ID NO: 154557 - DNA, 16 bp, H. sapiens
tgtccttacaggtgaa

SEQ ID NO: 154558 - DNA, 16 bp, H. sapiens
tgtccttatatttaaa

SEQ ID NO: 154559 - DNA, 16 bp, H. sapiens
tgtccttcagggatgt

SEQ ID NO: 154560 - DNA, 16 bp, H. sapiens
tgtccttcattctttt

SEQ ID NO: 154561 - DNA, 16 bp, H. sapiens
tgtccttccaagtggg

SEQ ID NO: 154562 - DNA, 16 bp, H. sapiens
tgtccttcccagcctc

SEQ ID NO: 154563 - DNA, 16 bp, H. sapiens
tgtccttcccttcagg

SEQ ID NO: 154564 - DNA, 16 bp, H. sapiens
tgtccttcctcagcct

SEQ ID NO: 154565 - DNA, 16 bp, H. sapiens
tgtccttgatgaagca

SEQ ID NO: 154566 - DNA, 16 bp, H. sapiens
tgtccttgcagggaca

SEQ ID NO: 154567 - DNA, 16 bp, H. sapiens
tgtccttgtaagaaga

SEQ ID NO: 154568 - DNA, 16 bp, H. sapiens
tgtccttgttctcatt

SEQ ID NO: 154569 - DNA, 16 bp, H. sapiens
tgtcctttataataaa

SEQ ID NO: 154570 - DNA, 16 bp, H. sapiens
tgtcctttccccactt

SEQ ID NO: 154571 - DNA, 16 bp, H. sapiens
tgtcctttcccccact

SEQ ID NO: 154572 - DNA, 16 bp, H. sapiens
tgtcctttcctggttt

SEQ ID NO: 154573 - DNA, 16 bp, H. sapiens
tgtcctttctccagtg

SEQ ID NO: 154574 - DNA, 16 bp, H. sapiens
tgtcctttctgtgaat

SEQ ID NO: 154575 - DNA, 16 bp, H. sapiens
tgtcctttgcagcagc

SEQ ID NO: 154576 - DNA, 16 bp, H. sapiens
tgtcctttgcagtgac

SEQ ID NO: 154577 - DNA, 16 bp, H. sapiens
tgtcctttgcccacct

SEQ ID NO: 154578 - DNA, 16 bp, H. sapiens
tgtcctttggctgcat

SEQ ID NO: 154579 - DNA, 16 bp, H. sapiens
tgtccttttgataata

SEQ ID NO: 154580 - DNA, 16 bp, H. sapiens
tgtccttttgtgtctg

SEQ ID NO: 154581 - DNA, 19 bp, H. sapiens
tgtcgagtttgtattgggg

SEQ ID NO: 154582 - DNA, 17 bp, H. sapiens
tgtcgccaggctagagt

SEQ ID NO: 154583 - DNA, 16 bp, H. sapiens
tgtcgcccagactggt

SEQ ID NO: 154584 - DNA, 16 bp, H. sapiens
tgtcgcccagctggag

SEQ ID NO: 154585 - DNA, 18 bp, H. sapiens
tgtcgcccaggatggagt

SEQ ID NO: 154586 - DNA, 16 bp, H. sapiens
tgtcgcccaggcggga

SEQ ID NO: 154587 - DNA, 16 bp, H. sapiens
tgtcgcccaggctaca

SEQ ID NO: 154588 - DNA, 18 bp, H. sapiens
tgtcgcccaggctggaac

SEQ ID NO: 154589 - DNA, 16 bp, H. sapiens
tgtcgcccaggctggc

SEQ ID NO: 154590 - DNA, 16 bp, H. sapiens
tgtcgcccaggctggt

SEQ ID NO: 154591 - DNA, 16 bp, H. sapiens
tgtcgcccaggttgga

SEQ ID NO: 154592 - DNA, 16 bp, H. sapiens
tgtcgcctaggctggt

SEQ ID NO: 154593 - DNA, 16 bp, H. sapiens
tgtcggctgggcgtgg

SEQ ID NO: 154594 - DNA, 16 bp, H. sapiens
tgtcgtccaggctggt

SEQ ID NO: 154595 - DNA, 16 bp, H. sapiens
tgtcgtcccagctact

SEQ ID NO: 154596 - DNA, 16 bp, H. sapiens
tgtcgtgggagggacc

SEQ ID NO: 154597 - DNA, 16 bp, H. sapiens
tgtctaaaaaaatata

SEQ ID NO: 154598 - DNA, 16 bp, H. sapiens
tgtctaaaaaatatat

SEQ ID NO: 154599 - DNA, 16 bp, H. sapiens
tgtctaaacatagaaa

SEQ ID NO: 154600 - DNA, 16 bp, H. sapiens
tgtctaactgaaattt

SEQ ID NO: 154601 - DNA, 16 bp, H. sapiens
tgtctaagaaatcttt

SEQ ID NO: 154602 - DNA, 16 bp, H. sapiens
tgtctaaggtcacaca

SEQ ID NO: 154603 - DNA, 16 bp, H. sapiens
tgtctacactgaaaat

SEQ ID NO: 154604 - DNA, 16 bp, H. sapiens
tgtctacccagaggaa

SEQ ID NO: 154605 - DNA, 16 bp, H. sapiens
tgtctactaattctat

SEQ ID NO: 154606 - DNA, 16 bp, H. sapiens
tgtctacttttgagaa

SEQ ID NO: 154607 - DNA, 16 bp, H. sapiens
tgtctacttttgcttt

SEQ ID NO: 154608 - DNA, 16 bp, H. sapiens
tgtctactttttatat

SEQ ID NO: 154609 - DNA, 16 bp, H. sapiens
tgtctataaatatata

SEQ ID NO: 154610 - DNA, 16 bp, H. sapiens
tgtctataatttcttt

SEQ ID NO: 154611 - DNA, 16 bp, H. sapiens
tgtctatagttaacaa

SEQ ID NO: 154612 - DNA, 16 bp, H. sapiens
tgtctatcaatggatg

SEQ ID NO: 154613 - DNA, 16 bp, H. sapiens
tgtctatgaatttgac

SEQ ID NO: 154614 - DNA, 16 bp, H. sapiens
tgtctatggagcagcc

SEQ ID NO: 154615 - DNA, 16 bp, H. sapiens
tgtctatgtatgtatg

SEQ ID NO: 154616 - DNA, 17 bp, H. sapiens
tgtctattcatgttctt

SEQ ID NO: 154617 - DNA, 16 bp, H. sapiens
tgtctattcctgtcct

SEQ ID NO: 154618 - DNA, 16 bp, H. sapiens
tgtctattctgctgtt

SEQ ID NO: 154619 - DNA, 16 bp, H. sapiens
tgtctatttatgtcct

SEQ ID NO: 154620 - DNA, 16 bp, H. sapiens
tgtctatttttttaaa

SEQ ID NO: 154621 - DNA, 16 bp, H. sapiens
tgtctcaaaaaaaatg

SEQ ID NO: 154622 - DNA, 16 bp, H. sapiens
tgtctcaaaaaaacag

SEQ ID NO: 154623 - DNA, 16 bp, H. sapiens
tgtctcaaaaagaaga

SEQ ID NO: 154624 - DNA, 16 bp, H. sapiens
tgtctcaaaaagagaa

SEQ ID NO: 154625 - DNA, 16 bp, H. sapiens
tgtctcaaaaagtaat

SEQ ID NO: 154626 - DNA, 16 bp, H. sapiens
tgtctcaaaaataaaa

SEQ ID NO: 154627 - DNA, 16 bp, H. sapiens
tgtctcaaaacaaaaa

SEQ ID NO: 154628 - DNA, 16 bp, H. sapiens
tgtctcaaaacaaagc

SEQ ID NO: 154629 - DNA, 16 bp, H. sapiens
tgtctcaaaagaaaaa

SEQ ID NO: 154630 - DNA, 16 bp, H. sapiens
tgtctcaaaagaagaa

SEQ ID NO: 154631 - DNA, 16 bp, H. sapiens
tgtctcaaagaaaata

SEQ ID NO: 154632 - DNA, 16 bp, H. sapiens
tgtctcaaagaataaa

SEQ ID NO: 154633 - DNA, 16 bp, H. sapiens
tgtctcaaagcaaaac

SEQ ID NO: 154634 - DNA, 17 bp, H. sapiens
tgtctcaaataaataaa

SEQ ID NO: 154635 - DNA, 16 bp, H. sapiens
tgtctcaaatgaataa

SEQ ID NO: 154636 - DNA, 16 bp, H. sapiens
tgtctcaacaaaaaca

SEQ ID NO: 154637 - DNA, 16 bp, H. sapiens
tgtctcaacaaaacaa

SEQ ID NO: 154638 - DNA, 16 bp, H. sapiens
tgtctcaagaaacaaa

SEQ ID NO: 154639 - DNA, 16 bp, H. sapiens
tgtctcaagaagaaaa

SEQ ID NO: 154640 - DNA, 16 bp, H. sapiens
tgtctcaatctgtcta

SEQ ID NO: 154641 - DNA, 16 bp, H. sapiens
tgtctcacctcccacc

SEQ ID NO: 154642 - DNA, 16 bp, H. sapiens
tgtctcactgtggttt

SEQ ID NO: 154643 - DNA, 16 bp, H. sapiens
tgtctcacttaatcct

SEQ ID NO: 154644 - DNA, 16 bp, H. sapiens
tgtctcagacaaacaa

SEQ ID NO: 154645 - DNA, 16 bp, H. sapiens
tgtctcagagagaaaa

SEQ ID NO: 154646 - DNA, 16 bp, H. sapiens
tgtctcagatgggact

SEQ ID NO: 154647 - DNA, 16 bp, H. sapiens
tgtctcagccaaaaat

SEQ ID NO: 154648 - DNA, 20 bp, H. sapiens
tgtctcaggatacaaaatca

SEQ ID NO: 154649 - DNA, 17 bp, H. sapiens
tgtctcatgcctgtaat

SEQ ID NO: 154650 - DNA, 16 bp, H. sapiens
tgtctcattgatctaa

SEQ ID NO: 154651 - DNA, 16 bp, H. sapiens
tgtctcattttaatgt

SEQ ID NO: 154652 - DNA, 16 bp, H. sapiens
tgtctcattttggttt

SEQ ID NO: 154653 - DNA, 16 bp, H. sapiens
tgtctccaaaaaaaag

SEQ ID NO: 154654 - DNA, 16 bp, H. sapiens
tgtctccaaaaacaaa

SEQ ID NO: 154655 - DNA, 16 bp, H. sapiens
tgtctccaaagaagat

SEQ ID NO: 154656 - DNA, 16 bp, H. sapiens
tgtctccaaatacagt

SEQ ID NO: 154657 - DNA, 16 bp, H. sapiens
tgtctccactaaaaac

SEQ ID NO: 154658 - DNA, 16 bp, H. sapiens
tgtctccaggctgaag

SEQ ID NO: 154659 - DNA, 16 bp, H. sapiens
tgtctccatcctgaag

SEQ ID NO: 154660 - DNA, 16 bp, H. sapiens
tgtctccattttgcag

SEQ ID NO: 154661 - DNA, 16 bp, H. sapiens
tgtctcccaggctaga

SEQ ID NO: 154662 - DNA, 16 bp, H. sapiens
tgtctcccaggctgag

SEQ ID NO: 154663 - DNA, 16 bp, H. sapiens
tgtctcccagtttcaa

SEQ ID NO: 154664 - DNA, 16 bp, H. sapiens
tgtctcccattctgtg

SEQ ID NO: 154665 - DNA, 16 bp, H. sapiens
tgtctccctcactaga

SEQ ID NO: 154666 - DNA, 16 bp, H. sapiens
tgtctcctctccatcc

SEQ ID NO: 154667 - DNA, 16 bp, H. sapiens
tgtctcctctttcatt

SEQ ID NO: 154668 - DNA, 16 bp, H. sapiens
tgtctcctggcttcag

SEQ ID NO: 154669 - DNA, 16 bp, H. sapiens
tgtctccttcagttcc

SEQ ID NO: 154670 - DNA, 16 bp, H. sapiens
tgtctccttccttctg

SEQ ID NO: 154671 - DNA, 16 bp, H. sapiens
tgtctcctttttcatt

SEQ ID NO: 154672 - DNA, 16 bp, H. sapiens
tgtctctaaaaaaaaa

SEQ ID NO: 154673 - DNA, 16 bp, H. sapiens
tgtctctacaaaaact

SEQ ID NO: 154674 - DNA, 16 bp, H. sapiens
tgtctctacaaaaatt

SEQ ID NO: 154675 - DNA, 16 bp, H. sapiens
tgtctctaccaaaagt

SEQ ID NO: 154676 - DNA, 16 bp, H. sapiens
tgtctctactaaaaag

SEQ ID NO: 154677 - DNA, 19 bp, H. sapiens
tgtctctactaaaaatacc

SEQ ID NO: 154678 - DNA, 16 bp, H. sapiens
tgtctctactaaaaca

SEQ ID NO: 154679 - DNA, 16 bp, H. sapiens
tgtctctatagatttg

SEQ ID NO: 154680 - DNA, 16 bp, H. sapiens
tgtctctcaaaggctg

SEQ ID NO: 154681 - DNA, 16 bp, H. sapiens
tgtctctcacaccaca

SEQ ID NO: 154682 - DNA, 16 bp, H. sapiens
tgtctctcaggctgga

SEQ ID NO: 154683 - DNA, 16 bp, H. sapiens
tgtctctccttctctg

SEQ ID NO: 154684 - DNA, 16 bp, H. sapiens
tgtctctctctctgcc

SEQ ID NO: 154685 - DNA, 16 bp, H. sapiens
tgtctctctctgcctg

SEQ ID NO: 154686 - DNA, 16 bp, H. sapiens
tgtctctctgtcctct

SEQ ID NO: 154687 - DNA, 17 bp, H. sapiens
tgtctctctgtttgtct

SEQ ID NO: 154688 - DNA, 16 bp, H. sapiens
tgtctctgaaaacaaa

SEQ ID NO: 154689 - DNA, 16 bp, H. sapiens
tgtctctgaaaataaa

SEQ ID NO: 154690 - DNA, 16 bp, H. sapiens
tgtctctgcaaaaaat

SEQ ID NO: 154691 - DNA, 16 bp, H. sapiens
tgtctctgcctccttc

SEQ ID NO: 154692 - DNA, 16 bp, H. sapiens
tgtctctgcttgcaga

SEQ ID NO: 154693 - DNA, 16 bp, H. sapiens
tgtctctggctgccct

SEQ ID NO: 154694 - DNA, 16 bp, H. sapiens
tgtctctggctgtcct

SEQ ID NO: 154695 - DNA, 16 bp, H. sapiens
tgtctctggcttcttt

SEQ ID NO: 154696 - DNA, 16 bp, H. sapiens
tgtctctgtctctcac

SEQ ID NO: 154697 - DNA, 16 bp, H. sapiens
tgtctctgtctctccc

SEQ ID NO: 154698 - DNA, 16 bp, H. sapiens
tgtctctgtctctctc

SEQ ID NO: 154699 - DNA, 16 bp, H. sapiens
tgtctcttaaatctct

SEQ ID NO: 154700 - DNA, 16 bp, H. sapiens
tgtctcttaagaaaaa

SEQ ID NO: 154701 - DNA, 16 bp, H. sapiens
tgtctcttcattctgt

SEQ ID NO: 154702 - DNA, 16 bp, H. sapiens
tgtctcttcccagttt

SEQ ID NO: 154703 - DNA, 16 bp, H. sapiens
tgtctcttctccattt

SEQ ID NO: 154704 - DNA, 16 bp, H. sapiens
tgtctctttgatctgt

SEQ ID NO: 154705 - DNA, 16 bp, H. sapiens
tgtctcttttgaactt

SEQ ID NO: 154706 - DNA, 16 bp, H. sapiens
tgtctgaaaaaaaaaa

SEQ ID NO: 154707 - DNA, 16 bp, H. sapiens
tgtctgaaaaaaacaa

SEQ ID NO: 154708 - DNA, 16 bp, H. sapiens
tgtctgaaaaaataaa

SEQ ID NO: 154709 - DNA, 16 bp, H. sapiens
tgtctgaaaacaaaaa

SEQ ID NO: 154710 - DNA, 16 bp, H. sapiens
tgtctgaaaacatctt

SEQ ID NO: 154711 - DNA, 16 bp, H. sapiens
tgtctgaaaaggattt

SEQ ID NO: 154712 - DNA, 16 bp, H. sapiens
tgtctgaaaataaata

SEQ ID NO: 154713 - DNA, 16 bp, H. sapiens
tgtctgaaaatatttt

SEQ ID NO: 154714 - DNA, 16 bp, H. sapiens
tgtctgaaaggtcaca

SEQ ID NO: 154715 - DNA, 16 bp, H. sapiens
tgtctgaaatcccagc

SEQ ID NO: 154716 - DNA, 16 bp, H. sapiens
tgtctgaagaaaaaaa

SEQ ID NO: 154717 - DNA, 16 bp, H. sapiens
tgtctgacccccactt

SEQ ID NO: 154718 - DNA, 16 bp, H. sapiens
tgtctgacttcaaagc

SEQ ID NO: 154719 - DNA, 16 bp, H. sapiens
tgtctgacttctttca

SEQ ID NO: 154720 - DNA, 16 bp, H. sapiens
tgtctgagaaaatctt

SEQ ID NO: 154721 - DNA, 16 bp, H. sapiens
tgtctgagaaataaag

SEQ ID NO: 154722 - DNA, 16 bp, H. sapiens
tgtctgagatggagtc

SEQ ID NO: 154723 - DNA, 16 bp, H. sapiens
tgtctgatatttttct

SEQ ID NO: 154724 - DNA, 16 bp, H. sapiens
tgtctgcaaactggag

SEQ ID NO: 154725 - DNA, 16 bp, H. sapiens
tgtctgcagggttggt

SEQ ID NO: 154726 - DNA, 16 bp, H. sapiens
tgtctgcatgcatgtg

SEQ ID NO: 154727 - DNA, 16 bp, H. sapiens
tgtctgcccaaatggc

SEQ ID NO: 154728 - DNA, 16 bp, H. sapiens
tgtctgcccaggctgg

SEQ ID NO: 154729 - DNA, 16 bp, H. sapiens
tgtctgccctgctggg

SEQ ID NO: 154730 - DNA, 16 bp, H. sapiens
tgtctgcctcagcctc

SEQ ID NO: 154731 - DNA, 16 bp, H. sapiens
tgtctgcctcctgctg

SEQ ID NO: 154732 - DNA, 16 bp, H. sapiens
tgtctgcctccttctt

SEQ ID NO: 154733 - DNA, 16 bp, H. sapiens
tgtctgctggtgtctg

SEQ ID NO: 154734 - DNA, 16 bp, H. sapiens
tgtctgcttactctgt

SEQ ID NO: 154735 - DNA, 16 bp, H. sapiens
tgtctgcttttgagaa

SEQ ID NO: 154736 - DNA, 16 bp, H. sapiens
tgtctggaaacatttt

SEQ ID NO: 154737 - DNA, 16 bp, H. sapiens
tgtctggaagagtttt

SEQ ID NO: 154738 - DNA, 16 bp, H. sapiens
tgtctggaatcccagc

SEQ ID NO: 154739 - DNA, 16 bp, H. sapiens
tgtctggagacatttt

SEQ ID NO: 154740 - DNA, 28 bp, H. sapiens
tgtctggcactccctagtgagatgaacc

SEQ ID NO: 154741 - DNA, 16 bp, H. sapiens
tgtctggctcctttca

SEQ ID NO: 154742 - DNA, 16 bp, H. sapiens
tgtctggcttcttttg

SEQ ID NO: 154743 - DNA, 16 bp, H. sapiens
tgtctggtgaggacct

SEQ ID NO: 154744 - DNA, 16 bp, H. sapiens
tgtctggtgagggccc

SEQ ID NO: 154745 - DNA, 16 bp, H. sapiens
tgtctgtaaaaataaa

SEQ ID NO: 154746 - DNA, 16 bp, H. sapiens
tgtctgtaagctggag

SEQ ID NO: 154747 - DNA, 16 bp, H. sapiens
tgtctgtaatcctagc

SEQ ID NO: 154748 - DNA, 16 bp, H. sapiens
tgtctgtaccattttg

SEQ ID NO: 154749 - DNA, 16 bp, H. sapiens
tgtctgtactaaaaat

SEQ ID NO: 154750 - DNA, 16 bp, H. sapiens
tgtctgtatatttgtg

SEQ ID NO: 154751 - DNA, 16 bp, H. sapiens
tgtctgtatttaaaaa

SEQ ID NO: 154752 - DNA, 16 bp, H. sapiens
tgtctgtatttggaga

SEQ ID NO: 154753 - DNA, 16 bp, H. sapiens
tgtctgtcacagcttc

SEQ ID NO: 154754 - DNA, 16 bp, H. sapiens
tgtctgtcagcccctg

SEQ ID NO: 154755 - DNA, 16 bp, H. sapiens
tgtctgtcgacccctg

SEQ ID NO: 154756 - DNA, 16 bp, H. sapiens
tgtctgtctccctccc

SEQ ID NO: 154757 - DNA, 16 bp, H. sapiens
tgtctgtctctctctg

SEQ ID NO: 154758 - DNA, 16 bp, H. sapiens
tgtctgtctctctgtc

SEQ ID NO: 154759 - DNA, 16 bp, H. sapiens
tgtctgtctctgtcac

SEQ ID NO: 154760 - DNA, 16 bp, H. sapiens
tgtctgtctctgtctc

SEQ ID NO: 154761 - DNA, 16 bp, H. sapiens
tgtctgtctctgtgtc

SEQ ID NO: 154762 - DNA, 16 bp, H. sapiens
tgtctgtctctgtttc

SEQ ID NO: 154763 - DNA, 16 bp, H. sapiens
tgtctgtctgtccgtc

SEQ ID NO: 154764 - DNA, 16 bp, H. sapiens
tgtctgtctgtctctg

SEQ ID NO: 154765 - DNA, 16 bp, H. sapiens
tgtctgtctgtctgct

SEQ ID NO: 154766 - DNA, 16 bp, H. sapiens
tgtctgtctgtctgtc

SEQ ID NO: 154767 - DNA, 17 bp, H. sapiens
tgtctgtctgtctgtct

SEQ ID NO: 154768 - DNA, 16 bp, H. sapiens
tgtctgtctgtgtctg

SEQ ID NO: 154769 - DNA, 19 bp, H. sapiens
tgtctgtcttatgcagttg

SEQ ID NO: 154770 - DNA, 16 bp, H. sapiens
tgtctgtcttgttcac

SEQ ID NO: 154771 - DNA, 16 bp, H. sapiens
tgtctgtgaaagtcat

SEQ ID NO: 154772 - DNA, 16 bp, H. sapiens
tgtctgtgaagagaga

SEQ ID NO: 154773 - DNA, 16 bp, H. sapiens
tgtctgtgaaggtgtt

SEQ ID NO: 154774 - DNA, 16 bp, H. sapiens
tgtctgtgaataaaga

SEQ ID NO: 154775 - DNA, 16 bp, H. sapiens
tgtctgtgagaatgtt

SEQ ID NO: 154776 - DNA, 16 bp, H. sapiens
tgtctgtgagggcatt

SEQ ID NO: 154777 - DNA, 16 bp, H. sapiens
tgtctgtgagggtgtt

SEQ ID NO: 154778 - DNA, 16 bp, H. sapiens
tgtctgtgcatgtgta

SEQ ID NO: 154779 - DNA, 16 bp, H. sapiens
tgtctgtgcatttgaa

SEQ ID NO: 154780 - DNA, 16 bp, H. sapiens
tgtctgtgccaggttt

SEQ ID NO: 154781 - DNA, 16 bp, H. sapiens
tgtctgtgccctgtcc

SEQ ID NO: 154782 - DNA, 16 bp, H. sapiens
tgtctgtggctgcctt

SEQ ID NO: 154783 - DNA, 16 bp, H. sapiens
tgtctgtgtatgcatg

SEQ ID NO: 154784 - DNA, 16 bp, H. sapiens
tgtctgtgtatgtata

SEQ ID NO: 154785 - DNA, 16 bp, H. sapiens
tgtctgtgtcacattt

SEQ ID NO: 154786 - DNA, 16 bp, H. sapiens
tgtctgtgtccaaatt

SEQ ID NO: 154787 - DNA, 16 bp, H. sapiens
tgtctgtgtccaggaa

SEQ ID NO: 154788 - DNA, 16 bp, H. sapiens
tgtctgtgtccccatc

SEQ ID NO: 154789 - DNA, 16 bp, H. sapiens
tgtctgtgtctgtctg

SEQ ID NO: 154790 - DNA, 16 bp, H. sapiens
tgtctgtgtgtactca

SEQ ID NO: 154791 - DNA, 16 bp, H. sapiens
tgtctgtgtgtctgca

SEQ ID NO: 154792 - DNA, 16 bp, H. sapiens
tgtctgtgtgtctgtg

SEQ ID NO: 154793 - DNA, 16 bp, H. sapiens
tgtctgtgtgtgtctg

SEQ ID NO: 154794 - DNA, 16 bp, H. sapiens
tgtctgtgtgtgtgcc

SEQ ID NO: 154795 - DNA, 16 bp, H. sapiens
tgtctgtgtgtgtgta

SEQ ID NO: 154796 - DNA, 16 bp, H. sapiens
tgtctgttattggagt

SEQ ID NO: 154797 - DNA, 16 bp, H. sapiens
tgtctgttcaggtttt

SEQ ID NO: 154798 - DNA, 16 bp, H. sapiens
tgtctgttcatgtgtt

SEQ ID NO: 154799 - DNA, 16 bp, H. sapiens
tgtctgttccttcctc

SEQ ID NO: 154800 - DNA, 16 bp, H. sapiens
tgtctgttctcagatc

SEQ ID NO: 154801 - DNA, 16 bp, H. sapiens
tgtctgttgttccctt

SEQ ID NO: 154802 - DNA, 16 bp, H. sapiens
tgtctgtttcattcac

SEQ ID NO: 154803 - DNA, 16 bp, H. sapiens
tgtctgttttggtacc

SEQ ID NO: 154804 - DNA, 16 bp, H. sapiens
tgtctgtttttgtaac

SEQ ID NO: 154805 - DNA, 16 bp, H. sapiens
tgtctgtttttttaaa

SEQ ID NO: 154806 - DNA, 16 bp, H. sapiens
tgtcttaaaaacaaaa

SEQ ID NO: 154807 - DNA, 16 bp, H. sapiens
tgtcttaaaaataaat

SEQ ID NO: 154808 - DNA, 16 bp, H. sapiens
tgtcttaaaaatgttt

SEQ ID NO: 154809 - DNA, 16 bp, H. sapiens
tgtcttaaacaaacaa

SEQ ID NO: 154810 - DNA, 16 bp, H. sapiens
tgtcttaaggaaaaaa

SEQ ID NO: 154811 - DNA, 16 bp, H. sapiens
tgtcttaagttttcat

SEQ ID NO: 154812 - DNA, 16 bp, H. sapiens
tgtcttaatttctccc

SEQ ID NO: 154813 - DNA, 16 bp, H. sapiens
tgtcttacagagaaaa

SEQ ID NO: 154814 - DNA, 16 bp, H. sapiens
tgtcttacatattttt

SEQ ID NO: 154815 - DNA, 16 bp, H. sapiens
tgtcttactcatcttt

SEQ ID NO: 154816 - DNA, 16 bp, H. sapiens
tgtcttagcctgtttt

SEQ ID NO: 154817 - DNA, 16 bp, H. sapiens
tgtcttagtcatgaag

SEQ ID NO: 154818 - DNA, 16 bp, H. sapiens
tgtcttagtttgggtt

SEQ ID NO: 154819 - DNA, 16 bp, H. sapiens
tgtcttattgatctgt

SEQ ID NO: 154820 - DNA, 16 bp, H. sapiens
tgtcttatttaagaaa

SEQ ID NO: 154821 - DNA, 16 bp, H. sapiens
tgtcttcaaaatatat

SEQ ID NO: 154822 - DNA, 16 bp, H. sapiens
tgtcttcaaataaaaa

SEQ ID NO: 154823 - DNA, 16 bp, H. sapiens
tgtcttcaaatatttt

SEQ ID NO: 154824 - DNA, 16 bp, H. sapiens
tgtcttcaaggagctc

SEQ ID NO: 154825 - DNA, 16 bp, H. sapiens
tgtcttcacgtggtct

SEQ ID NO: 154826 - DNA, 16 bp, H. sapiens
tgtcttcaggttcact

SEQ ID NO: 154827 - DNA, 16 bp, H. sapiens
tgtcttcatgttgagt

SEQ ID NO: 154828 - DNA, 16 bp, H. sapiens
tgtcttcatttcttct

SEQ ID NO: 154829 - DNA, 16 bp, H. sapiens
tgtcttcattttcatt

SEQ ID NO: 154830 - DNA, 16 bp, H. sapiens
tgtcttcattttcctt

SEQ ID NO: 154831 - DNA, 16 bp, H. sapiens
tgtcttcattttttaa

SEQ ID NO: 154832 - DNA, 16 bp, H. sapiens
tgtcttccacaatgtt

SEQ ID NO: 154833 - DNA, 16 bp, H. sapiens
tgtcttccactcctgg

SEQ ID NO: 154834 - DNA, 16 bp, H. sapiens
tgtcttccagactgga

SEQ ID NO: 154835 - DNA, 16 bp, H. sapiens
tgtcttccattctttt

SEQ ID NO: 154836 - DNA, 16 bp, H. sapiens
tgtcttcctaggtatt

SEQ ID NO: 154837 - DNA, 16 bp, H. sapiens
tgtcttcctcactaga

SEQ ID NO: 154838 - DNA, 16 bp, H. sapiens
tgtcttcctttacctc

SEQ ID NO: 154839 - DNA, 16 bp, H. sapiens
tgtcttcctttgaaaa

SEQ ID NO: 154840 - DNA, 16 bp, H. sapiens
tgtcttctcttattct

SEQ ID NO: 154841 - DNA, 16 bp, H. sapiens
tgtcttctgcacagac

SEQ ID NO: 154842 - DNA, 16 bp, H. sapiens
tgtcttctgccagcat

SEQ ID NO: 154843 - DNA, 16 bp, H. sapiens
tgtcttctggcctcca

SEQ ID NO: 154844 - DNA, 16 bp, H. sapiens
tgtcttctgtgtcact

SEQ ID NO: 154845 - DNA, 16 bp, H. sapiens
tgtcttctttcaagaa

SEQ ID NO: 154846 - DNA, 16 bp, H. sapiens
tgtcttctttcctcca

SEQ ID NO: 154847 - DNA, 16 bp, H. sapiens
tgtcttctttgaagaa

SEQ ID NO: 154848 - DNA, 16 bp, H. sapiens
tgtcttctttgtagca

SEQ ID NO: 154849 - DNA, 16 bp, H. sapiens
tgtcttcttttcaaaa

SEQ ID NO: 154850 - DNA, 16 bp, H. sapiens
tgtcttcttttgaaaa

SEQ ID NO: 154851 - DNA, 16 bp, H. sapiens
tgtcttcttttgagga

SEQ ID NO: 154852 - DNA, 16 bp, H. sapiens
tgtcttgaagaaaaaa

SEQ ID NO: 154853 - DNA, 16 bp, H. sapiens
tgtcttgaagacagca

SEQ ID NO: 154854 - DNA, 16 bp, H. sapiens
tgtcttgaattttcct

SEQ ID NO: 154855 - DNA, 16 bp, H. sapiens
tgtcttgctgtgcctg

SEQ ID NO: 154856 - DNA, 16 bp, H. sapiens
tgtcttgcttctttca

SEQ ID NO: 154857 - DNA, 16 bp, H. sapiens
tgtcttggctgtatgg

SEQ ID NO: 154858 - DNA, 16 bp, H. sapiens
tgtcttggtctcccaa

SEQ ID NO: 154859 - DNA, 16 bp, H. sapiens
tgtcttggttactgta

SEQ ID NO: 154860 - DNA, 16 bp, H. sapiens
tgtcttgtctgctgcc

SEQ ID NO: 154861 - DNA, 16 bp, H. sapiens
tgtcttgtgacagttt

SEQ ID NO: 154862 - DNA, 17 bp, H. sapiens
tgtcttgtgccagcttt

SEQ ID NO: 154863 - DNA, 19 bp, H. sapiens
tgtcttgtgccagttttca

SEQ ID NO: 154864 - DNA, 16 bp, H. sapiens
tgtcttgttctccact

SEQ ID NO: 154865 - DNA, 16 bp, H. sapiens
tgtcttgttctgtcac

SEQ ID NO: 154866 - DNA, 16 bp, H. sapiens
tgtcttgttttaagaa

SEQ ID NO: 154867 - DNA, 16 bp, H. sapiens
tgtctttaaaaaaaat

SEQ ID NO: 154868 - DNA, 16 bp, H. sapiens
tgtctttaaaaaaaca

SEQ ID NO: 154869 - DNA, 16 bp, H. sapiens
tgtctttaaaaattaa

SEQ ID NO: 154870 - DNA, 16 bp, H. sapiens
tgtctttaaaatattt

SEQ ID NO: 154871 - DNA, 16 bp, H. sapiens
tgtctttaaagaaaaa

SEQ ID NO: 154872 - DNA, 16 bp, H. sapiens
tgtctttaaatatatt

SEQ ID NO: 154873 - DNA, 16 bp, H. sapiens
tgtctttaagattttt

SEQ ID NO: 154874 - DNA, 16 bp, H. sapiens
tgtctttaatccatct

SEQ ID NO: 154875 - DNA, 16 bp, H. sapiens
tgtctttaattcattt

SEQ ID NO: 154876 - DNA, 16 bp, H. sapiens
tgtctttacaggtaaa

SEQ ID NO: 154877 - DNA, 16 bp, H. sapiens
tgtctttatatgtgaa

SEQ ID NO: 154878 - DNA, 16 bp, H. sapiens
tgtctttatatttgaa

SEQ ID NO: 154879 - DNA, 16 bp, H. sapiens
tgtctttatcagcact

SEQ ID NO: 154880 - DNA, 16 bp, H. sapiens
tgtctttatggtagaa

SEQ ID NO: 154881 - DNA, 16 bp, H. sapiens
tgtctttatttaaaat

SEQ ID NO: 154882 - DNA, 16 bp, H. sapiens
tgtctttatttataaa

SEQ ID NO: 154883 - DNA, 16 bp, H. sapiens
tgtctttatttgaaaa

SEQ ID NO: 154884 - DNA, 16 bp, H. sapiens
tgtctttcaaaataaa

SEQ ID NO: 154885 - DNA, 16 bp, H. sapiens
tgtctttcaaagtggc

SEQ ID NO: 154886 - DNA, 16 bp, H. sapiens
tgtctttcaccaaatt

SEQ ID NO: 154887 - DNA, 16 bp, H. sapiens
tgtctttcatttccaa

SEQ ID NO: 154888 - DNA, 16 bp, H. sapiens
tgtctttctattattg

SEQ ID NO: 154889 - DNA, 16 bp, H. sapiens
tgtctttctccaaaga

SEQ ID NO: 154890 - DNA, 16 bp, H. sapiens
tgtctttctgtgctgg

SEQ ID NO: 154891 - DNA, 16 bp, H. sapiens
tgtctttctgtgtctg

SEQ ID NO: 154892 - DNA, 16 bp, H. sapiens
tgtctttcttttgtaa

SEQ ID NO: 154893 - DNA, 16 bp, H. sapiens
tgtctttgaaatattt

SEQ ID NO: 154894 - DNA, 16 bp, H. sapiens
tgtctttgaatttaaa

SEQ ID NO: 154895 - DNA, 16 bp, H. sapiens
tgtctttgatgatggt

SEQ ID NO: 154896 - DNA, 16 bp, H. sapiens
tgtctttgattctgtt

SEQ ID NO: 154897 - DNA, 16 bp, H. sapiens
tgtctttgctattata

SEQ ID NO: 154898 - DNA, 16 bp, H. sapiens
tgtctttggatattgc

SEQ ID NO: 154899 - DNA, 16 bp, H. sapiens
tgtctttggctttcaa

SEQ ID NO: 154900 - DNA, 16 bp, H. sapiens
tgtctttgtggtttta

SEQ ID NO: 154901 - DNA, 16 bp, H. sapiens
tgtctttgtgtcccca

SEQ ID NO: 154902 - DNA, 16 bp, H. sapiens
tgtctttgtttcaaag

SEQ ID NO: 154903 - DNA, 16 bp, H. sapiens
tgtcttttaaaatgta

SEQ ID NO: 154904 - DNA, 16 bp, H. sapiens
tgtcttttaactttta

SEQ ID NO: 154905 - DNA, 16 bp, H. sapiens
tgtcttttaattggga

SEQ ID NO: 154906 - DNA, 16 bp, H. sapiens
tgtcttttatgaccta

SEQ ID NO: 154907 - DNA, 16 bp, H. sapiens
tgtcttttatttggag

SEQ ID NO: 154908 - DNA, 16 bp, H. sapiens
tgtcttttcatccttt

SEQ ID NO: 154909 - DNA, 16 bp, H. sapiens
tgtcttttgaagcaca

SEQ ID NO: 154910 - DNA, 16 bp, H. sapiens
tgtcttttgcccactt

SEQ ID NO: 154911 - DNA, 16 bp, H. sapiens
tgtcttttgctagctt

SEQ ID NO: 154912 - DNA, 16 bp, H. sapiens
tgtcttttggtggaca

SEQ ID NO: 154913 - DNA, 16 bp, H. sapiens
tgtcttttgtaaattg

SEQ ID NO: 154914 - DNA, 16 bp, H. sapiens
tgtcttttgtccactt

SEQ ID NO: 154915 - DNA, 16 bp, H. sapiens
tgtctttttaaaaaaa

SEQ ID NO: 154916 - DNA, 16 bp, H. sapiens
tgtctttttaatattc

SEQ ID NO: 154917 - DNA, 16 bp, H. sapiens
tgtctttttagtagaa

SEQ ID NO: 154918 - DNA, 17 bp, H. sapiens
tgtctttttagtagaga

SEQ ID NO: 154919 - DNA, 16 bp, H. sapiens
tgtctttttagtggag

SEQ ID NO: 154920 - DNA, 16 bp, H. sapiens
tgtctttttattactg

SEQ ID NO: 154921 - DNA, 16 bp, H. sapiens
tgtctttttccattct

SEQ ID NO: 154922 - DNA, 16 bp, H. sapiens
tgtcttttttccccca

SEQ ID NO: 154923 - DNA, 16 bp, H. sapiens
tgtctttttttaactg

SEQ ID NO: 154924 - DNA, 16 bp, H. sapiens
tgtgaaaaacatggca

SEQ ID NO: 154925 - DNA, 16 bp, H. sapiens
tgtgaaaaatgacttt

SEQ ID NO: 154926 - DNA, 16 bp, H. sapiens
tgtgaaaaatgagaaa

SEQ ID NO: 154927 - DNA, 16 bp, H. sapiens
tgtgaaaaatgctgca

SEQ ID NO: 154928 - DNA, 16 bp, H. sapiens
tgtgaaaaatgtcatt

SEQ ID NO: 154929 - DNA, 16 bp, H. sapiens
tgtgaaaaatgtggca

SEQ ID NO: 154930 - DNA, 16 bp, H. sapiens
tgtgaaaacagaataa

SEQ ID NO: 154931 - DNA, 16 bp, H. sapiens
tgtgaaaacagactga

SEQ ID NO: 154932 - DNA, 16 bp, H. sapiens
tgtgaaaactaaatga

SEQ ID NO: 154933 - DNA, 16 bp, H. sapiens
tgtgaaaagaccaaac

SEQ ID NO: 154934 - DNA, 16 bp, H. sapiens
tgtgaaaataagtttt

SEQ ID NO: 154935 - DNA, 16 bp, H. sapiens
tgtgaaaataatttta

SEQ ID NO: 154936 - DNA, 16 bp, H. sapiens
tgtgaaaatattttta

SEQ ID NO: 154937 - DNA, 16 bp, H. sapiens
tgtgaaaatgaaaatg

SEQ ID NO: 154938 - DNA, 16 bp, H. sapiens
tgtgaaaatgaacaaa

SEQ ID NO: 154939 - DNA, 16 bp, H. sapiens
tgtgaaaatgaactaa

SEQ ID NO: 154940 - DNA, 16 bp, H. sapiens
tgtgaaaatggctata

SEQ ID NO: 154941 - DNA, 16 bp, H. sapiens
tgtgaaaatgtgtgtg

SEQ ID NO: 154942 - DNA, 16 bp, H. sapiens
tgtgaaaatgttttgt

SEQ ID NO: 154943 - DNA, 16 bp, H. sapiens
tgtgaaaattatataa

SEQ ID NO: 154944 - DNA, 16 bp, H. sapiens
tgtgaaacaataaatt

SEQ ID NO: 154945 - DNA, 16 bp, H. sapiens
tgtgaaacagctttgt

SEQ ID NO: 154946 - DNA, 16 bp, H. sapiens
tgtgaaacaggaataa

SEQ ID NO: 154947 - DNA, 16 bp, H. sapiens
tgtgaaactgctttct

SEQ ID NO: 154948 - DNA, 16 bp, H. sapiens
tgtgaaagcagccaga

SEQ ID NO: 154949 - DNA, 16 bp, H. sapiens
tgtgaaagcagctgag

SEQ ID NO: 154950 - DNA, 16 bp, H. sapiens
tgtgaaagcagctgca

SEQ ID NO: 154951 - DNA, 16 bp, H. sapiens
tgtgaaagcatgtgat

SEQ ID NO: 154952 - DNA, 16 bp, H. sapiens
tgtgaaagggagttca

SEQ ID NO: 154953 - DNA, 16 bp, H. sapiens
tgtgaaataaagataa

SEQ ID NO: 154954 - DNA, 16 bp, H. sapiens
tgtgaaatatttttaa

SEQ ID NO: 154955 - DNA, 16 bp, H. sapiens
tgtgaaatgaaaataa

SEQ ID NO: 154956 - DNA, 16 bp, H. sapiens
tgtgaaatgcctgttc

SEQ ID NO: 154957 - DNA, 16 bp, H. sapiens
tgtgaaatgtctgttc

SEQ ID NO: 154958 - DNA, 16 bp, H. sapiens
tgtgaaattaaataat

SEQ ID NO: 154959 - DNA, 16 bp, H. sapiens
tgtgaacaaagacagt

SEQ ID NO: 154960 - DNA, 16 bp, H. sapiens
tgtgaacatatatttt

SEQ ID NO: 154961 - DNA, 16 bp, H. sapiens
tgtgaacatatgcttt

SEQ ID NO: 154962 - DNA, 16 bp, H. sapiens
tgtgaacattgtggaa

SEQ ID NO: 154963 - DNA, 16 bp, H. sapiens
tgtgaacccagaaaat

SEQ ID NO: 154964 - DNA, 16 bp, H. sapiens
tgtgaacccaggaggt

SEQ ID NO: 154965 - DNA, 16 bp, H. sapiens
tgtgaacctaaaactg

SEQ ID NO: 154966 - DNA, 16 bp, H. sapiens
tgtgaacttgggcaag

SEQ ID NO: 154967 - DNA, 16 bp, H. sapiens
tgtgaagaaaatcatt

SEQ ID NO: 154968 - DNA, 16 bp, H. sapiens
tgtgaagaaagtgatt

SEQ ID NO: 154969 - DNA, 16 bp, H. sapiens
tgtgaagaaataggaa

SEQ ID NO: 154970 - DNA, 16 bp, H. sapiens
tgtgaagaaatcagaa

SEQ ID NO: 154971 - DNA, 16 bp, H. sapiens
tgtgaagaaattggaa

SEQ ID NO: 154972 - DNA, 16 bp, H. sapiens
tgtgaagaacatcatt

SEQ ID NO: 154973 - DNA, 16 bp, H. sapiens
tgtgaagaaggtacct

SEQ ID NO: 154974 - DNA, 16 bp, H. sapiens
tgtgaagaaggtcctt

SEQ ID NO: 154975 - DNA, 16 bp, H. sapiens
tgtgaagaaggtgtct

SEQ ID NO: 154976 - DNA, 16 bp, H. sapiens
tgtgaagaaggtgttt

SEQ ID NO: 154977 - DNA, 17 bp, H. sapiens
tgtgaagaatgcagaag

SEQ ID NO: 154978 - DNA, 16 bp, H. sapiens
tgtgaagaatgttatt

SEQ ID NO: 154979 - DNA, 16 bp, H. sapiens
tgtgaagacacagaag

SEQ ID NO: 154980 - DNA, 16 bp, H. sapiens
tgtgaagacacagcaa

SEQ ID NO: 154981 - DNA, 16 bp, H. sapiens
tgtgaagacacaggga

SEQ ID NO: 154982 - DNA, 16 bp, H. sapiens
tgtgaagacaggcaga

SEQ ID NO: 154983 - DNA, 18 bp, H. sapiens
tgtgaagactgtgggaaa

SEQ ID NO: 154984 - DNA, 16 bp, H. sapiens
tgtgaagagagagaga

SEQ ID NO: 154985 - DNA, 16 bp, H. sapiens
tgtgaagaggtgcctt

SEQ ID NO: 154986 - DNA, 16 bp, H. sapiens
tgtgaagaggtgcttt

SEQ ID NO: 154987 - DNA, 16 bp, H. sapiens
tgtgaagattaaaaat

SEQ ID NO: 154988 - DNA, 16 bp, H. sapiens
tgtgaagattaaaaga

SEQ ID NO: 154989 - DNA, 16 bp, H. sapiens
tgtgaagattaaagga

SEQ ID NO: 154990 - DNA, 16 bp, H. sapiens
tgtgaagattaaatga

SEQ ID NO: 154991 - DNA, 16 bp, H. sapiens
tgtgaagatttcattt

SEQ ID NO: 154992 - DNA, 16 bp, H. sapiens
tgtgaagcacctcttc

SEQ ID NO: 154993 - DNA, 16 bp, H. sapiens
tgtgaaggagaaactg

SEQ ID NO: 154994 - DNA, 16 bp, H. sapiens
tgtgaaggtgtttctg

SEQ ID NO: 154995 - DNA, 16 bp, H. sapiens
tgtgaagtttttcttt

SEQ ID NO: 154996 - DNA, 16 bp, H. sapiens
tgtgaataaagctgca

SEQ ID NO: 154997 - DNA, 16 bp, H. sapiens
tgtgaataaatataat

SEQ ID NO: 154998 - DNA, 16 bp, H. sapiens
tgtgaataaatatttt

SEQ ID NO: 154999 - DNA, 16 bp, H. sapiens
tgtgaataaatctttt

SEQ ID NO: 155000 - DNA, 16 bp, H. sapiens
tgtgaataacgctgct

SEQ ID NO: 155001 - DNA, 16 bp, H. sapiens
tgtgaatagcaaaatg

SEQ ID NO: 155002 - DNA, 16 bp, H. sapiens
tgtgaatagtgtttca

SEQ ID NO: 155003 - DNA, 16 bp, H. sapiens
tgtgaatatactagaa

SEQ ID NO: 155004 - DNA, 16 bp, H. sapiens
tgtgaatatatattat

SEQ ID NO: 155005 - DNA, 16 bp, H. sapiens
tgtgaatatattaaaa

SEQ ID NO: 155006 - DNA, 16 bp, H. sapiens
tgtgaatatatttgta

SEQ ID NO: 155007 - DNA, 16 bp, H. sapiens
tgtgaatattcttttt

SEQ ID NO: 155008 - DNA, 16 bp, H. sapiens
tgtgaatattgccaca

SEQ ID NO: 155009 - DNA, 16 bp, H. sapiens
tgtgaatattttcatt

SEQ ID NO: 155010 - DNA, 16 bp, H. sapiens
tgtgaatatttttctc

SEQ ID NO: 155011 - DNA, 16 bp, H. sapiens
tgtgaatcatcccttt

SEQ ID NO: 155012 - DNA, 16 bp, H. sapiens
tgtgaatctacttaat

SEQ ID NO: 155013 - DNA, 16 bp, H. sapiens
tgtgaatctataatta

SEQ ID NO: 155014 - DNA, 16 bp, H. sapiens
tgtgaatctgtgtgtg

SEQ ID NO: 155015 - DNA, 16 bp, H. sapiens
tgtgaatgagtgtgtg

SEQ ID NO: 155016 - DNA, 16 bp, H. sapiens
tgtgaatgcacacaca

SEQ ID NO: 155017 - DNA, 16 bp, H. sapiens
tgtgaatgctgctgca

SEQ ID NO: 155018 - DNA, 16 bp, H. sapiens
tgtgaatgctgctgct

SEQ ID NO: 155019 - DNA, 16 bp, H. sapiens
tgtgaatggtgctgct

SEQ ID NO: 155020 - DNA, 16 bp, H. sapiens
tgtgaatgtctgtgtg

SEQ ID NO: 155021 - DNA, 16 bp, H. sapiens
tgtgaatgtgacctta

SEQ ID NO: 155022 - DNA, 16 bp, H. sapiens
tgtgaatgtgtgtggg

SEQ ID NO: 155023 - DNA, 16 bp, H. sapiens
tgtgaattatttaaaa

SEQ ID NO: 155024 - DNA, 16 bp, H. sapiens
tgtgaattattttctt

SEQ ID NO: 155025 - DNA, 16 bp, H. sapiens
tgtgaatttcacctca

SEQ ID NO: 155026 - DNA, 16 bp, H. sapiens
tgtgaattttaaaaaa

SEQ ID NO: 155027 - DNA, 16 bp, H. sapiens
tgtgaattttacctca

SEQ ID NO: 155028 - DNA, 16 bp, H. sapiens
tgtgaattttagaata

SEQ ID NO: 155029 - DNA, 16 bp, H. sapiens
tgtgaatttttaaaat

SEQ ID NO: 155030 - DNA, 16 bp, H. sapiens
tgtgaatttttgtgaa

SEQ ID NO: 155031 - DNA, 16 bp, H. sapiens
tgtgacaaccaaaaat

SEQ ID NO: 155032 - DNA, 16 bp, H. sapiens
tgtgacaaccagaaat

SEQ ID NO: 155033 - DNA, 16 bp, H. sapiens
tgtgacaatgagaaga

SEQ ID NO: 155034 - DNA, 16 bp, H. sapiens
tgtgacacaggagcct

SEQ ID NO: 155035 - DNA, 16 bp, H. sapiens
tgtgacagaatgagac

SEQ ID NO: 155036 - DNA, 16 bp, H. sapiens
tgtgacagtatttgga

SEQ ID NO: 155037 - DNA, 16 bp, H. sapiens
tgtgacagtttttcag

SEQ ID NO: 155038 - DNA, 16 bp, H. sapiens
tgtgacatcagaatag

SEQ ID NO: 155039 - DNA, 16 bp, H. sapiens
tgtgacattttacatt

SEQ ID NO: 155040 - DNA, 16 bp, H. sapiens
tgtgaccagcctggac

SEQ ID NO: 155041 - DNA, 16 bp, H. sapiens
tgtgaccatcctggct

SEQ ID NO: 155042 - DNA, 16 bp, H. sapiens
tgtgaccatgtgttct

SEQ ID NO: 155043 - DNA, 16 bp, H. sapiens
tgtgacccaagctgga

SEQ ID NO: 155044 - DNA, 16 bp, H. sapiens
tgtgaccccaggcaag

SEQ ID NO: 155045 - DNA, 16 bp, H. sapiens
tgtgacccccacccag

SEQ ID NO: 155046 - DNA, 16 bp, H. sapiens
tgtgaccctggacaaa

SEQ ID NO: 155047 - DNA, 16 bp, H. sapiens
tgtgaccctggacagg

SEQ ID NO: 155048 - DNA, 16 bp, H. sapiens
tgtgacctaggctgga

SEQ ID NO: 155049 - DNA, 16 bp, H. sapiens
tgtgacctcagacaag

SEQ ID NO: 155050 - DNA, 16 bp, H. sapiens
tgtgacctcaggaaag

SEQ ID NO: 155051 - DNA, 16 bp, H. sapiens
tgtgacctcatttgga

SEQ ID NO: 155052 - DNA, 16 bp, H. sapiens
tgtgacctggagcaag

SEQ ID NO: 155053 - DNA, 16 bp, H. sapiens
tgtgacctggggcagg

SEQ ID NO: 155054 - DNA, 16 bp, H. sapiens
tgtgacctgtgctttt

SEQ ID NO: 155055 - DNA, 16 bp, H. sapiens
tgtgaccttaagcaaa

SEQ ID NO: 155056 - DNA, 16 bp, H. sapiens
tgtgaccttagaatgt

SEQ ID NO: 155057 - DNA, 16 bp, H. sapiens
tgtgaccttgaacaag

SEQ ID NO: 155058 - DNA, 16 bp, H. sapiens
tgtgaccttgaccaag

SEQ ID NO: 155059 - DNA, 16 bp, H. sapiens
tgtgaccttgagtgag

SEQ ID NO: 155060 - DNA, 16 bp, H. sapiens
tgtgaccttggacaaa

SEQ ID NO: 155061 - DNA, 16 bp, H. sapiens
tgtgaccttggacaag

SEQ ID NO: 155062 - DNA, 16 bp, H. sapiens
tgtgaccttgggcaag

SEQ ID NO: 155063 - DNA, 16 bp, H. sapiens
tgtgaccttgggcaga

SEQ ID NO: 155064 - DNA, 16 bp, H. sapiens
tgtgaccttgggcatg

SEQ ID NO: 155065 - DNA, 16 bp, H. sapiens
tgtgaccttgggttaa

SEQ ID NO: 155066 - DNA, 16 bp, H. sapiens
tgtgactcaggctgga

SEQ ID NO: 155067 - DNA, 16 bp, H. sapiens
tgtgactctgggcaag

SEQ ID NO: 155068 - DNA, 16 bp, H. sapiens
tgtgactctgggcagg

SEQ ID NO: 155069 - DNA, 16 bp, H. sapiens
tgtgactgcactccag

SEQ ID NO: 155070 - DNA, 16 bp, H. sapiens
tgtgactggggaactt

SEQ ID NO: 155071 - DNA, 16 bp, H. sapiens
tgtgactgtctttgga

SEQ ID NO: 155072 - DNA, 16 bp, H. sapiens
tgtgacttagaatgct

SEQ ID NO: 155073 - DNA, 16 bp, H. sapiens
tgtgacttctgaagct

SEQ ID NO: 155074 - DNA, 16 bp, H. sapiens
tgtgacttgctcaagg

SEQ ID NO: 155075 - DNA, 16 bp, H. sapiens
tgtgacttgcttcttt

SEQ ID NO: 155076 - DNA, 16 bp, H. sapiens
tgtgacttgctttatt

SEQ ID NO: 155077 - DNA, 16 bp, H. sapiens
tgtgactttaattttt

SEQ ID NO: 155078 - DNA, 16 bp, H. sapiens
tgtgactttgggcaaa

SEQ ID NO: 155079 - DNA, 16 bp, H. sapiens
tgtgactttgggcaag

SEQ ID NO: 155080 - DNA, 16 bp, H. sapiens
tgtgactttgggccag

SEQ ID NO: 155081 - DNA, 16 bp, H. sapiens
tgtgactttttaaaaa

SEQ ID NO: 155082 - DNA, 16 bp, H. sapiens
tgtgagaaaaataaac

SEQ ID NO: 155083 - DNA, 16 bp, H. sapiens
tgtgagaaagagagag

SEQ ID NO: 155084 - DNA, 16 bp, H. sapiens
tgtgagaaaggactaa

SEQ ID NO: 155085 - DNA, 16 bp, H. sapiens
tgtgagaaagtttgga

SEQ ID NO: 155086 - DNA, 16 bp, H. sapiens
tgtgagaaataaagtt

SEQ ID NO: 155087 - DNA, 16 bp, H. sapiens
tgtgagaaatgaattt

SEQ ID NO: 155088 - DNA, 16 bp, H. sapiens
tgtgagaaatttctgt

SEQ ID NO: 155089 - DNA, 16 bp, H. sapiens
tgtgagaacaaactaa

SEQ ID NO: 155090 - DNA, 16 bp, H. sapiens
tgtgagaagagagaaa

SEQ ID NO: 155091 - DNA, 16 bp, H. sapiens
tgtgagaatataaatt

SEQ ID NO: 155092 - DNA, 16 bp, H. sapiens
tgtgagaattaaatga

SEQ ID NO: 155093 - DNA, 16 bp, H. sapiens
tgtgagacagagtctt

SEQ ID NO: 155094 - DNA, 16 bp, H. sapiens
tgtgagaccccatctc

SEQ ID NO: 155095 - DNA, 16 bp, H. sapiens
tgtgagaccctgtctc

SEQ ID NO: 155096 - DNA, 16 bp, H. sapiens
tgtgagactgaggtgg

SEQ ID NO: 155097 - DNA, 16 bp, H. sapiens
tgtgagactgtgtgtg

SEQ ID NO: 155098 - DNA, 16 bp, H. sapiens
tgtgagagaatcaatt

SEQ ID NO: 155099 - DNA, 16 bp, H. sapiens
tgtgagagacagtttg

SEQ ID NO: 155100 - DNA, 16 bp, H. sapiens
tgtgagagagtgtgtg

SEQ ID NO: 155101 - DNA, 16 bp, H. sapiens
tgtgagaggaaactgg

SEQ ID NO: 155102 - DNA, 16 bp, H. sapiens
tgtgagagtccttggt

SEQ ID NO: 155103 - DNA, 16 bp, H. sapiens
tgtgagataatgaata

SEQ ID NO: 155104 - DNA, 16 bp, H. sapiens
tgtgagatggagtctc

SEQ ID NO: 155105 - DNA, 16 bp, H. sapiens
tgtgagatggggtctc

SEQ ID NO: 155106 - DNA, 16 bp, H. sapiens
tgtgagattgtgtgtg

SEQ ID NO: 155107 - DNA, 16 bp, H. sapiens
tgtgagcagtttgagg

SEQ ID NO: 155108 - DNA, 16 bp, H. sapiens
tgtgagcatgcatgtg

SEQ ID NO: 155109 - DNA, 16 bp, H. sapiens
tgtgagcatgtgtgag

SEQ ID NO: 155110 - DNA, 16 bp, H. sapiens
tgtgagcattaaataa

SEQ ID NO: 155111 - DNA, 16 bp, H. sapiens
tgtgagccaaaataaa

SEQ ID NO: 155112 - DNA, 16 bp, H. sapiens
tgtgagccaagattgt

SEQ ID NO: 155113 - DNA, 16 bp, H. sapiens
tgtgagccacaacacc

SEQ ID NO: 155114 - DNA, 16 bp, H. sapiens
tgtgagccacatatgt

SEQ ID NO: 155115 - DNA, 17 bp, H. sapiens
tgtgagccaccacacca

SEQ ID NO: 155116 - DNA, 17 bp, H. sapiens
tgtgagccaccacaccc

SEQ ID NO: 155117 - DNA, 16 bp, H. sapiens
tgtgagccaccacact

SEQ ID NO: 155118 - DNA, 17 bp, H. sapiens
tgtgagccaccacgcca

SEQ ID NO: 155119 - DNA, 18 bp, H. sapiens
tgtgagccaccacgccca

SEQ ID NO: 155120 - DNA, 17 bp, H. sapiens
tgtgagccaccacgcct

SEQ ID NO: 155121 - DNA, 17 bp, H. sapiens
tgtgagccaccgcaccc

SEQ ID NO: 155122 - DNA, 19 bp, H. sapiens
tgtgagccaccgcacccag

SEQ ID NO: 155123 - DNA, 16 bp, H. sapiens
tgtgagccaccgcgcc

SEQ ID NO: 155124 - DNA, 17 bp, H. sapiens
tgtgagccaccgcgccc

SEQ ID NO: 155125 - DNA, 19 bp, H. sapiens
tgtgagccaccgtgcccaa

SEQ ID NO: 155126 - DNA, 23 bp, H. sapiens
tgtgagccaccgtgcccggcctg

SEQ ID NO: 155127 - DNA, 16 bp, H. sapiens
tgtgagccacctgcct

SEQ ID NO: 155128 - DNA, 16 bp, H. sapiens
tgtgagccacggcgcc

SEQ ID NO: 155129 - DNA, 16 bp, H. sapiens
tgtgagccactacacc

SEQ ID NO: 155130 - DNA, 16 bp, H. sapiens
tgtgagccactgcccc

SEQ ID NO: 155131 - DNA, 16 bp, H. sapiens
tgtgagccactgcctg

SEQ ID NO: 155132 - DNA, 18 bp, H. sapiens
tgtgagccactgcgcccg

SEQ ID NO: 155133 - DNA, 22 bp, H. sapiens
tgtgagccactgtgcccagccc

SEQ ID NO: 155134 - DNA, 16 bp, H. sapiens
tgtgagccagcacacc

SEQ ID NO: 155135 - DNA, 18 bp, H. sapiens
tgtgagccaggatggtct

SEQ ID NO: 155136 - DNA, 16 bp, H. sapiens
tgtgagccatcgcacc

SEQ ID NO: 155137 - DNA, 16 bp, H. sapiens
tgtgagcccaggagtt

SEQ ID NO: 155138 - DNA, 16 bp, H. sapiens
tgtgagcccctgccag

SEQ ID NO: 155139 - DNA, 16 bp, H. sapiens
tgtgagctaccacacc

SEQ ID NO: 155140 - DNA, 16 bp, H. sapiens
tgtgagctactcaagc

SEQ ID NO: 155141 - DNA, 16 bp, H. sapiens
tgtgagctcctggagg

SEQ ID NO: 155142 - DNA, 16 bp, H. sapiens
tgtgagctccttgaaa

SEQ ID NO: 155143 - DNA, 16 bp, H. sapiens
tgtgagctccttgagg

SEQ ID NO: 155144 - DNA, 16 bp, H. sapiens
tgtgagctccttgggg

SEQ ID NO: 155145 - DNA, 16 bp, H. sapiens
tgtgagctgttggtgg

SEQ ID NO: 155146 - DNA, 18 bp, H. sapiens
tgtgaggaaagtcattgg

SEQ ID NO: 155147 - DNA, 16 bp, H. sapiens
tgtgaggaaggaatga

SEQ ID NO: 155148 - DNA, 16 bp, H. sapiens
tgtgaggacacagagg

SEQ ID NO: 155149 - DNA, 16 bp, H. sapiens
tgtgaggacacagcag

SEQ ID NO: 155150 - DNA, 16 bp, H. sapiens
tgtgaggacacagcat

SEQ ID NO: 155151 - DNA, 16 bp, H. sapiens
tgtgaggacatggtga

SEQ ID NO: 155152 - DNA, 16 bp, H. sapiens
tgtgaggagtaaatga

SEQ ID NO: 155153 - DNA, 16 bp, H. sapiens
tgtgaggatcaaatga

SEQ ID NO: 155154 - DNA, 16 bp, H. sapiens
tgtgaggatgaaataa

SEQ ID NO: 155155 - DNA, 16 bp, H. sapiens
tgtgaggatgaaatga

SEQ ID NO: 155156 - DNA, 16 bp, H. sapiens
tgtgaggattaaatga

SEQ ID NO: 155157 - DNA, 16 bp, H. sapiens
tgtgaggattaaatgt

SEQ ID NO: 155158 - DNA, 16 bp, H. sapiens
tgtgaggattaaggga

SEQ ID NO: 155159 - DNA, 16 bp, H. sapiens
tgtgaggattaagtga

SEQ ID NO: 155160 - DNA, 16 bp, H. sapiens
tgtgaggattcaatga

SEQ ID NO: 155161 - DNA, 16 bp, H. sapiens
tgtgaggattcagtga

SEQ ID NO: 155162 - DNA, 16 bp, H. sapiens
tgtgaggattgaatga

SEQ ID NO: 155163 - DNA, 16 bp, H. sapiens
tgtgaggcaggaagaa

SEQ ID NO: 155164 - DNA, 16 bp, H. sapiens
tgtgaggccaaggagg

SEQ ID NO: 155165 - DNA, 16 bp, H. sapiens
tgtgaggcctcctcag

SEQ ID NO: 155166 - DNA, 16 bp, H. sapiens
tgtgaggctcaaatga

SEQ ID NO: 155167 - DNA, 19 bp, H. sapiens
tgtgagggacaaacactct

SEQ ID NO: 155168 - DNA, 16 bp, H. sapiens
tgtgagggactgtgcc

SEQ ID NO: 155169 - DNA, 16 bp, H. sapiens
tgtgagggtgtttcca

SEQ ID NO: 155170 - DNA, 16 bp, H. sapiens
tgtgagggttaaatga

SEQ ID NO: 155171 - DNA, 16 bp, H. sapiens
tgtgaggtgatggata

SEQ ID NO: 155172 - DNA, 16 bp, H. sapiens
tgtgaggtgctgtgga

SEQ ID NO: 155173 - DNA, 16 bp, H. sapiens
tgtgagtacctggatg

SEQ ID NO: 155174 - DNA, 16 bp, H. sapiens
tgtgagtcaattaaac

SEQ ID NO: 155175 - DNA, 16 bp, H. sapiens
tgtgagtcctccagct

SEQ ID NO: 155176 - DNA, 16 bp, H. sapiens
tgtgagtgaatgtgtg

SEQ ID NO: 155177 - DNA, 16 bp, H. sapiens
tgtgagtgcatgtgtg

SEQ ID NO: 155178 - DNA, 16 bp, H. sapiens
tgtgagtgtatgtgtg

SEQ ID NO: 155179 - DNA, 16 bp, H. sapiens
tgtgagtgtgagagtg

SEQ ID NO: 155180 - DNA, 16 bp, H. sapiens
tgtgagtgtgagtgtg

SEQ ID NO: 155181 - DNA, 16 bp, H. sapiens
tgtgagtgtgcctgtg

SEQ ID NO: 155182 - DNA, 16 bp, H. sapiens
tgtgagtgtgtgagtg

SEQ ID NO: 155183 - DNA, 16 bp, H. sapiens
tgtgagtgtgtgcaca

SEQ ID NO: 155184 - DNA, 17 bp, H. sapiens
tgtgagtgtgtgtgagt

SEQ ID NO: 155185 - DNA, 16 bp, H. sapiens
tgtgagtgtgtgtgga

SEQ ID NO: 155186 - DNA, 16 bp, H. sapiens
tgtgagtgtgtgtgtc

SEQ ID NO: 155187 - DNA, 16 bp, H. sapiens
tgtgagttttttcaaa

SEQ ID NO: 155188 - DNA, 16 bp, H. sapiens
tgtgataagaacattt

SEQ ID NO: 155189 - DNA, 16 bp, H. sapiens
tgtgataagtgctata

SEQ ID NO: 155190 - DNA, 16 bp, H. sapiens
tgtgataatttattac

SEQ ID NO: 155191 - DNA, 16 bp, H. sapiens
tgtgataatttgtaat

SEQ ID NO: 155192 - DNA, 16 bp, H. sapiens
tgtgatacctttcctc

SEQ ID NO: 155193 - DNA, 16 bp, H. sapiens
tgtgatactgtgaaat

SEQ ID NO: 155194 - DNA, 28 bp, H. sapiens
tgtgatagtttgctgagaatgatggttt

SEQ ID NO: 155195 - DNA, 16 bp, H. sapiens
tgtgatatagtttgga

SEQ ID NO: 155196 - DNA, 16 bp, H. sapiens
tgtgatatgaaaatat

SEQ ID NO: 155197 - DNA, 16 bp, H. sapiens
tgtgatattcctgcca

SEQ ID NO: 155198 - DNA, 16 bp, H. sapiens
tgtgatattgtgaaat

SEQ ID NO: 155199 - DNA, 16 bp, H. sapiens
tgtgatattttgatat

SEQ ID NO: 155200 - DNA, 16 bp, H. sapiens
tgtgatcacggctcac

SEQ ID NO: 155201 - DNA, 16 bp, H. sapiens
tgtgatcagaaaagat

SEQ ID NO: 155202 - DNA, 16 bp, H. sapiens
tgtgatcatttatttt

SEQ ID NO: 155203 - DNA, 20 bp, H. sapiens
tgtgatccgcccaccttggc

SEQ ID NO: 155204 - DNA, 21 bp, H. sapiens
tgtgatccgcctgcctcggcc

SEQ ID NO: 155205 - DNA, 16 bp, H. sapiens
tgtgatcctttgcagg

SEQ ID NO: 155206 - DNA, 24 bp, H. sapiens
tgtgatctcggctcactgcaagct

SEQ ID NO: 155207 - DNA, 22 bp, H. sapiens
tgtgatctcggctcactgcaat

SEQ ID NO: 155208 - DNA, 21 bp, H. sapiens
tgtgatctgcccacctcggcc

SEQ ID NO: 155209 - DNA, 24 bp, H. sapiens
tgtgatctgcctgccttggcctcc

SEQ ID NO: 155210 - DNA, 16 bp, H. sapiens
tgtgatctgtccacct

SEQ ID NO: 155211 - DNA, 16 bp, H. sapiens
tgtgatcttatttctg

SEQ ID NO: 155212 - DNA, 16 bp, H. sapiens
tgtgatcttgaacaag

SEQ ID NO: 155213 - DNA, 16 bp, H. sapiens
tgtgatcttggacaag

SEQ ID NO: 155214 - DNA, 16 bp, H. sapiens
tgtgatcttttgtggc

SEQ ID NO: 155215 - DNA, 16 bp, H. sapiens
tgtgatgaaaacactt

SEQ ID NO: 155216 - DNA, 16 bp, H. sapiens
tgtgatgaaatcttgt

SEQ ID NO: 155217 - DNA, 16 bp, H. sapiens
tgtgatgatgatgatg

SEQ ID NO: 155218 - DNA, 16 bp, H. sapiens
tgtgatgatggaagca

SEQ ID NO: 155219 - DNA, 16 bp, H. sapiens
tgtgatgatggtttca

SEQ ID NO: 155220 - DNA, 16 bp, H. sapiens
tgtgatgcctgctccc

SEQ ID NO: 155221 - DNA, 16 bp, H. sapiens
tgtgatgctgaggctt

SEQ ID NO: 155222 - DNA, 17 bp, H. sapiens
tgtgatggctcatgcct

SEQ ID NO: 155223 - DNA, 16 bp, H. sapiens
tgtgatggtagggtgt

SEQ ID NO: 155224 - DNA, 16 bp, H. sapiens
tgtgatggttaatact

SEQ ID NO: 155225 - DNA, 16 bp, H. sapiens
tgtgatggttaatatt

SEQ ID NO: 155226 - DNA, 16 bp, H. sapiens
tgtgatgtctggagct

SEQ ID NO: 155227 - DNA, 18 bp, H. sapiens
tgtgatgttcccctccct

SEQ ID NO: 155228 - DNA, 16 bp, H. sapiens
tgtgatgtttgtgttc

SEQ ID NO: 155229 - DNA, 16 bp, H. sapiens
tgtgattaagaaaaaa

SEQ ID NO: 155230 - DNA, 16 bp, H. sapiens
tgtgattaaggtcaat

SEQ ID NO: 155231 - DNA, 16 bp, H. sapiens
tgtgattacattaggc

SEQ ID NO: 155232 - DNA, 16 bp, H. sapiens
tgtgattagactgggc

SEQ ID NO: 155233 - DNA, 16 bp, H. sapiens
tgtgattattttctta

SEQ ID NO: 155234 - DNA, 16 bp, H. sapiens
tgtgattcattcattc

SEQ ID NO: 155235 - DNA, 16 bp, H. sapiens
tgtgattccagctact

SEQ ID NO: 155236 - DNA, 16 bp, H. sapiens
tgtgattccatctggt

SEQ ID NO: 155237 - DNA, 16 bp, H. sapiens
tgtgattcctccaact

SEQ ID NO: 155238 - DNA, 16 bp, H. sapiens
tgtgattctgccactg

SEQ ID NO: 155239 - DNA, 17 bp, H. sapiens
tgtgattgcattatgaa

SEQ ID NO: 155240 - DNA, 16 bp, H. sapiens
tgtgattggacaaaaa

SEQ ID NO: 155241 - DNA, 16 bp, H. sapiens
tgtgattggcttgttt

SEQ ID NO: 155242 - DNA, 16 bp, H. sapiens
tgtgattgtatttagg

SEQ ID NO: 155243 - DNA, 16 bp, H. sapiens
tgtgattgtatttgaa

SEQ ID NO: 155244 - DNA, 16 bp, H. sapiens
tgtgatttatcacata

SEQ ID NO: 155245 - DNA, 16 bp, H. sapiens
tgtgatttcattttat

SEQ ID NO: 155246 - DNA, 16 bp, H. sapiens
tgtgatttggggcaaa

SEQ ID NO: 155247 - DNA, 18 bp, H. sapiens
tgtgatttgtttctgccc

SEQ ID NO: 155248 - DNA, 16 bp, H. sapiens
tgtgattttaaaatgt

SEQ ID NO: 155249 - DNA, 16 bp, H. sapiens
tgtgattttaatttgc

SEQ ID NO: 155250 - DNA, 16 bp, H. sapiens
tgtgatttttacacat

SEQ ID NO: 155251 - DNA, 16 bp, H. sapiens
tgtgatttttatgaaa

SEQ ID NO: 155252 - DNA, 16 bp, H. sapiens
tgtgatttttatgcat

SEQ ID NO: 155253 - DNA, 16 bp, H. sapiens
tgtgatttttgccatt

SEQ ID NO: 155254 - DNA, 16 bp, H. sapiens
tgtgattttttaaaaa

SEQ ID NO: 155255 - DNA, 16 bp, H. sapiens
tgtgatttttttcatg

SEQ ID NO: 155256 - DNA, 16 bp, H. sapiens
tgtgatttttttccat

SEQ ID NO: 155257 - DNA, 16 bp, H. sapiens
tgtgcaaaagaaaatg

SEQ ID NO: 155258 - DNA, 16 bp, H. sapiens
tgtgcaaatgagaaaa

SEQ ID NO: 155259 - DNA, 16 bp, H. sapiens
tgtgcaaattagaaaa

SEQ ID NO: 155260 - DNA, 16 bp, H. sapiens
tgtgcaaccatcacca

SEQ ID NO: 155261 - DNA, 16 bp, H. sapiens
tgtgcaaccatcatca

SEQ ID NO: 155262 - DNA, 17 bp, H. sapiens
tgtgcaaccctccaagt

SEQ ID NO: 155263 - DNA, 16 bp, H. sapiens
tgtgcaactcttcctt

SEQ ID NO: 155264 - DNA, 16 bp, H. sapiens
tgtgcaagctgctctg

SEQ ID NO: 155265 - DNA, 16 bp, H. sapiens
tgtgcacacacaaata

SEQ ID NO: 155266 - DNA, 16 bp, H. sapiens
tgtgcacacacatgct

SEQ ID NO: 155267 - DNA, 16 bp, H. sapiens
tgtgcacacacatgtg

SEQ ID NO: 155268 - DNA, 16 bp, H. sapiens
tgtgcacacatatgca

SEQ ID NO: 155269 - DNA, 16 bp, H. sapiens
tgtgcacacatgcaca

SEQ ID NO: 155270 - DNA, 16 bp, H. sapiens
tgtgcacacccagcca

SEQ ID NO: 155271 - DNA, 16 bp, H. sapiens
tgtgcacactgtgcag

SEQ ID NO: 155272 - DNA, 16 bp, H. sapiens
tgtgcacagagaaaag

SEQ ID NO: 155273 - DNA, 16 bp, H. sapiens
tgtgcacagctgcctg

SEQ ID NO: 155274 - DNA, 16 bp, H. sapiens
tgtgcacatgcacaca

SEQ ID NO: 155275 - DNA, 16 bp, H. sapiens
tgtgcacatgcgtgtg

SEQ ID NO: 155276 - DNA, 16 bp, H. sapiens
tgtgcacatgctcatt

SEQ ID NO: 155277 - DNA, 16 bp, H. sapiens
tgtgcacatgtacaca

SEQ ID NO: 155278 - DNA, 17 bp, H. sapiens
tgtgcacatgtacccta

SEQ ID NO: 155279 - DNA, 16 bp, H. sapiens
tgtgcacatgtgtgaa

SEQ ID NO: 155280 - DNA, 16 bp, H. sapiens
tgtgcacatgtgtgtg

SEQ ID NO: 155281 - DNA, 16 bp, H. sapiens
tgtgcaccaccaagct

SEQ ID NO: 155282 - DNA, 16 bp, H. sapiens
tgtgcaccaccacacc

SEQ ID NO: 155283 - DNA, 17 bp, H. sapiens
tgtgcaccaccacacct

SEQ ID NO: 155284 - DNA, 18 bp, H. sapiens
tgtgcaccaccacgccca

SEQ ID NO: 155285 - DNA, 16 bp, H. sapiens
tgtgcaccaccagacc

SEQ ID NO: 155286 - DNA, 16 bp, H. sapiens
tgtgcaccaccatccc

SEQ ID NO: 155287 - DNA, 16 bp, H. sapiens
tgtgcaccactatgcc

SEQ ID NO: 155288 - DNA, 16 bp, H. sapiens
tgtgcaccaggcactg

SEQ ID NO: 155289 - DNA, 16 bp, H. sapiens
tgtgcaccatggaata

SEQ ID NO: 155290 - DNA, 16 bp, H. sapiens
tgtgcacctggaaaag

SEQ ID NO: 155291 - DNA, 16 bp, H. sapiens
tgtgcacgtgtgtgca

SEQ ID NO: 155292 - DNA, 16 bp, H. sapiens
tgtgcacgtgtgtgta

SEQ ID NO: 155293 - DNA, 16 bp, H. sapiens
tgtgcacgtttgtgtg

SEQ ID NO: 155294 - DNA, 16 bp, H. sapiens
tgtgcactgtagaatg

SEQ ID NO: 155295 - DNA, 16 bp, H. sapiens
tgtgcagaaaaatgaa

SEQ ID NO: 155296 - DNA, 16 bp, H. sapiens
tgtgcagatgacatga

SEQ ID NO: 155297 - DNA, 16 bp, H. sapiens
tgtgcagcaaaccaac

SEQ ID NO: 155298 - DNA, 16 bp, H. sapiens
tgtgcagcaaagtttg

SEQ ID NO: 155299 - DNA, 16 bp, H. sapiens
tgtgcagcagcttttt

SEQ ID NO: 155300 - DNA, 16 bp, H. sapiens
tgtgcagccaacagac

SEQ ID NO: 155301 - DNA, 16 bp, H. sapiens
tgtgcagccatcacca

SEQ ID NO: 155302 - DNA, 16 bp, H. sapiens
tgtgcagcctgcagaa

SEQ ID NO: 155303 - DNA, 16 bp, H. sapiens
tgtgcaggatgggcag

SEQ ID NO: 155304 - DNA, 16 bp, H. sapiens
tgtgcaggatgtgcat

SEQ ID NO: 155305 - DNA, 16 bp, H. sapiens
tgtgcaggcagctgtg

SEQ ID NO: 155306 - DNA, 16 bp, H. sapiens
tgtgcagggcagcagg

SEQ ID NO: 155307 - DNA, 16 bp, H. sapiens
tgtgcagggtctttat

SEQ ID NO: 155308 - DNA, 16 bp, H. sapiens
tgtgcaggtttgttac

SEQ ID NO: 155309 - DNA, 16 bp, H. sapiens
tgtgcagtatgtgcag

SEQ ID NO: 155310 - DNA, 16 bp, H. sapiens
tgtgcagtcatcacca

SEQ ID NO: 155311 - DNA, 16 bp, H. sapiens
tgtgcataaagttgtt

SEQ ID NO: 155312 - DNA, 16 bp, H. sapiens
tgtgcatacacacata

SEQ ID NO: 155313 - DNA, 16 bp, H. sapiens
tgtgcatataaacaca

SEQ ID NO: 155314 - DNA, 16 bp, H. sapiens
tgtgcatatacacaca

SEQ ID NO: 155315 - DNA, 16 bp, H. sapiens
tgtgcatatgtacata

SEQ ID NO: 155316 - DNA, 16 bp, H. sapiens
tgtgcatatgtatttt

SEQ ID NO: 155317 - DNA, 16 bp, H. sapiens
tgtgcatatgtctttt

SEQ ID NO: 155318 - DNA, 16 bp, H. sapiens
tgtgcatatgtgcaca

SEQ ID NO: 155319 - DNA, 16 bp, H. sapiens
tgtgcatattcaggga

SEQ ID NO: 155320 - DNA, 16 bp, H. sapiens
tgtgcatatttgttac

SEQ ID NO: 155321 - DNA, 16 bp, H. sapiens
tgtgcatattttgtta

SEQ ID NO: 155322 - DNA, 16 bp, H. sapiens
tgtgcatgagtcttta

SEQ ID NO: 155323 - DNA, 16 bp, H. sapiens
tgtgcatgagtgtgca

SEQ ID NO: 155324 - DNA, 16 bp, H. sapiens
tgtgcatgcatgtgta

SEQ ID NO: 155325 - DNA, 16 bp, H. sapiens
tgtgcatgcgcgtgtg

SEQ ID NO: 155326 - DNA, 16 bp, H. sapiens
tgtgcatgcgtgcgtg

SEQ ID NO: 155327 - DNA, 16 bp, H. sapiens
tgtgcatgcgtgtgca

SEQ ID NO: 155328 - DNA, 16 bp, H. sapiens
tgtgcatggtggtgtg

SEQ ID NO: 155329 - DNA, 16 bp, H. sapiens
tgtgcatggtgtgtgg

SEQ ID NO: 155330 - DNA, 16 bp, H. sapiens
tgtgcatgtacacaca

SEQ ID NO: 155331 - DNA, 16 bp, H. sapiens
tgtgcatgtacatgca

SEQ ID NO: 155332 - DNA, 16 bp, H. sapiens
tgtgcatgtacgtgtg

SEQ ID NO: 155333 - DNA, 16 bp, H. sapiens
tgtgcatgtctgtgaa

SEQ ID NO: 155334 - DNA, 16 bp, H. sapiens
tgtgcatgtgaccaca

SEQ ID NO: 155335 - DNA, 16 bp, H. sapiens
tgtgcatgtgcctgtg

SEQ ID NO: 155336 - DNA, 16 bp, H. sapiens
tgtgcatgtgcctttt

SEQ ID NO: 155337 - DNA, 16 bp, H. sapiens
tgtgcatgtgggtgca

SEQ ID NO: 155338 - DNA, 16 bp, H. sapiens
tgtgcatgtgggtgtg

SEQ ID NO: 155339 - DNA, 16 bp, H. sapiens
tgtgcatgtgtatatg

SEQ ID NO: 155340 - DNA, 16 bp, H. sapiens
tgtgcatgtgtctgtg

SEQ ID NO: 155341 - DNA, 33 bp, H. sapiens
tgtgcatgtgtctttatagcagcatgatttata

SEQ ID NO: 155342 - DNA, 16 bp, H. sapiens
tgtgcatgtgtgagag

SEQ ID NO: 155343 - DNA, 16 bp, H. sapiens
tgtgcatgtgtgagca

SEQ ID NO: 155344 - DNA, 16 bp, H. sapiens
tgtgcatgtgtggggg

SEQ ID NO: 155345 - DNA, 16 bp, H. sapiens
tgtgcatgtgtgtaca

SEQ ID NO: 155346 - DNA, 16 bp, H. sapiens
tgtgcatgtgtgtatt

SEQ ID NO: 155347 - DNA, 16 bp, H. sapiens
tgtgcatgtgtgtgaa

SEQ ID NO: 155348 - DNA, 16 bp, H. sapiens
tgtgcatgtgtgtgcg

SEQ ID NO: 155349 - DNA, 16 bp, H. sapiens
tgtgcatgtgtgtgta

SEQ ID NO: 155350 - DNA, 16 bp, H. sapiens
tgtgcatgtgtttgtg

SEQ ID NO: 155351 - DNA, 16 bp, H. sapiens
tgtgcattcatctcaa

SEQ ID NO: 155352 - DNA, 16 bp, H. sapiens
tgtgcattgctggtag

SEQ ID NO: 155353 - DNA, 16 bp, H. sapiens
tgtgcatttgggttgg

SEQ ID NO: 155354 - DNA, 16 bp, H. sapiens
tgtgcatttttaaatt

SEQ ID NO: 155355 - DNA, 16 bp, H. sapiens
tgtgccaaagaaataa

SEQ ID NO: 155356 - DNA, 16 bp, H. sapiens
tgtgccaaattttctt

SEQ ID NO: 155357 - DNA, 16 bp, H. sapiens
tgtgccaacatgccca

SEQ ID NO: 155358 - DNA, 16 bp, H. sapiens
tgtgccaagcactgta

SEQ ID NO: 155359 - DNA, 16 bp, H. sapiens
tgtgccaagcactgtg

SEQ ID NO: 155360 - DNA, 16 bp, H. sapiens
tgtgccacaatgcctg

SEQ ID NO: 155361 - DNA, 16 bp, H. sapiens
tgtgccacagaggtaa

SEQ ID NO: 155362 - DNA, 17 bp, H. sapiens
tgtgccacattttgtta

SEQ ID NO: 155363 - DNA, 16 bp, H. sapiens
tgtgccaccaagcctg

SEQ ID NO: 155364 - DNA, 16 bp, H. sapiens
tgtgccaccacaccca

SEQ ID NO: 155365 - DNA, 16 bp, H. sapiens
tgtgccaccacgacca

SEQ ID NO: 155366 - DNA, 17 bp, H. sapiens
tgtgccaccacgctcag

SEQ ID NO: 155367 - DNA, 16 bp, H. sapiens
tgtgccaccatacctg

SEQ ID NO: 155368 - DNA, 16 bp, H. sapiens
tgtgccaccatcacca

SEQ ID NO: 155369 - DNA, 16 bp, H. sapiens
tgtgccaccatgcccg

SEQ ID NO: 155370 - DNA, 16 bp, H. sapiens
tgtgccaccgtactcc

SEQ ID NO: 155371 - DNA, 17 bp, H. sapiens
tgtgccactgaactcca

SEQ ID NO: 155372 - DNA, 16 bp, H. sapiens
tgtgccactgccctcc

SEQ ID NO: 155373 - DNA, 16 bp, H. sapiens
tgtgccactgtgccca

SEQ ID NO: 155374 - DNA, 16 bp, H. sapiens
tgtgccactttttctt

SEQ ID NO: 155375 - DNA, 16 bp, H. sapiens
tgtgccagacactgca

SEQ ID NO: 155376 - DNA, 16 bp, H. sapiens
tgtgccagacactgtt

SEQ ID NO: 155377 - DNA, 16 bp, H. sapiens
tgtgccagaccctggg

SEQ ID NO: 155378 - DNA, 16 bp, H. sapiens
tgtgccagatgctgtg

SEQ ID NO: 155379 - DNA, 16 bp, H. sapiens
tgtgccagatgctgtt

SEQ ID NO: 155380 - DNA, 16 bp, H. sapiens
tgtgccagcactgtgc

SEQ ID NO: 155381 - DNA, 16 bp, H. sapiens
tgtgccagcctgggca

SEQ ID NO: 155382 - DNA, 16 bp, H. sapiens
tgtgccaggagctgtg

SEQ ID NO: 155383 - DNA, 16 bp, H. sapiens
tgtgccaggcaatgtt

SEQ ID NO: 155384 - DNA, 16 bp, H. sapiens
tgtgccaggcacaggg

SEQ ID NO: 155385 - DNA, 16 bp, H. sapiens
tgtgccaggcaccaca

SEQ ID NO: 155386 - DNA, 16 bp, H. sapiens
tgtgccaggcaccagg

SEQ ID NO: 155387 - DNA, 16 bp, H. sapiens
tgtgccaggcaccctg

SEQ ID NO: 155388 - DNA, 16 bp, H. sapiens
tgtgccaggcactgag

SEQ ID NO: 155389 - DNA, 16 bp, H. sapiens
tgtgccaggcactgtt

SEQ ID NO: 155390 - DNA, 16 bp, H. sapiens
tgtgccaggcccaggg

SEQ ID NO: 155391 - DNA, 16 bp, H. sapiens
tgtgccaggcctggtg

SEQ ID NO: 155392 - DNA, 16 bp, H. sapiens
tgtgccaggcctgtgc

SEQ ID NO: 155393 - DNA, 16 bp, H. sapiens
tgtgccaggctctctg

SEQ ID NO: 155394 - DNA, 16 bp, H. sapiens
tgtgccaggctctgtg

SEQ ID NO: 155395 - DNA, 16 bp, H. sapiens
tgtgccaggctctgtt

SEQ ID NO: 155396 - DNA, 16 bp, H. sapiens
tgtgccaggtactatg

SEQ ID NO: 155397 - DNA, 16 bp, H. sapiens
tgtgccaggtgctgtg

SEQ ID NO: 155398 - DNA, 16 bp, H. sapiens
tgtgccaggtgtggtg

SEQ ID NO: 155399 - DNA, 16 bp, H. sapiens
tgtgccaggttctggg

SEQ ID NO: 155400 - DNA, 16 bp, H. sapiens
tgtgccagtgcctgga

SEQ ID NO: 155401 - DNA, 16 bp, H. sapiens
tgtgccatggtggttt

SEQ ID NO: 155402 - DNA, 16 bp, H. sapiens
tgtgccatgttgatgt

SEQ ID NO: 155403 - DNA, 16 bp, H. sapiens
tgtgccatttctttct

SEQ ID NO: 155404 - DNA, 16 bp, H. sapiens
tgtgccattttatata

SEQ ID NO: 155405 - DNA, 16 bp, H. sapiens
tgtgccattttgcatt

SEQ ID NO: 155406 - DNA, 16 bp, H. sapiens
tgtgccattttgtatt

SEQ ID NO: 155407 - DNA, 16 bp, H. sapiens
tgtgcccacggtgccc

SEQ ID NO: 155408 - DNA, 16 bp, H. sapiens
tgtgcccagagtagca

SEQ ID NO: 155409 - DNA, 16 bp, H. sapiens
tgtgcccagagtagcc

SEQ ID NO: 155410 - DNA, 16 bp, H. sapiens
tgtgcccagcccactt

SEQ ID NO: 155411 - DNA, 16 bp, H. sapiens
tgtgcccagcccctcc

SEQ ID NO: 155412 - DNA, 16 bp, H. sapiens
tgtgcccagccctgtg

SEQ ID NO: 155413 - DNA, 16 bp, H. sapiens
tgtgcccagcctaaga

SEQ ID NO: 155414 - DNA, 16 bp, H. sapiens
tgtgcccagcctcatc

SEQ ID NO: 155415 - DNA, 16 bp, H. sapiens
tgtgcccagcctcttg

SEQ ID NO: 155416 - DNA, 16 bp, H. sapiens
tgtgcccaggctggag

SEQ ID NO: 155417 - DNA, 16 bp, H. sapiens
tgtgcccatgtgttct

SEQ ID NO: 155418 - DNA, 16 bp, H. sapiens
tgtgccccagcctcct

SEQ ID NO: 155419 - DNA, 16 bp, H. sapiens
tgtgccccaggctgga

SEQ ID NO: 155420 - DNA, 16 bp, H. sapiens
tgtgcccccacacctg

SEQ ID NO: 155421 - DNA, 16 bp, H. sapiens
tgtgcccgcctcagcc

SEQ ID NO: 155422 - DNA, 16 bp, H. sapiens
tgtgccctgagctgcc

SEQ ID NO: 155423 - DNA, 16 bp, H. sapiens
tgtgccctgtccccag

SEQ ID NO: 155424 - DNA, 16 bp, H. sapiens
tgtgccgggcactgtg

SEQ ID NO: 155425 - DNA, 16 bp, H. sapiens
tgtgcctcaatttcct

SEQ ID NO: 155426 - DNA, 16 bp, H. sapiens
tgtgcctcaccctccc

SEQ ID NO: 155427 - DNA, 16 bp, H. sapiens
tgtgcctcagccttcc

SEQ ID NO: 155428 - DNA, 16 bp, H. sapiens
tgtgcctcaggctcct

SEQ ID NO: 155429 - DNA, 16 bp, H. sapiens
tgtgcctcagttacct

SEQ ID NO: 155430 - DNA, 16 bp, H. sapiens
tgtgcctcagttcctc

SEQ ID NO: 155431 - DNA, 16 bp, H. sapiens
tgtgcctcagtttacc

SEQ ID NO: 155432 - DNA, 16 bp, H. sapiens
tgtgcctcataaatat

SEQ ID NO: 155433 - DNA, 16 bp, H. sapiens
tgtgcctctgtctcct

SEQ ID NO: 155434 - DNA, 16 bp, H. sapiens
tgtgcctgaagtccca

SEQ ID NO: 155435 - DNA, 16 bp, H. sapiens
tgtgcctgcagcccca

SEQ ID NO: 155436 - DNA, 16 bp, H. sapiens
tgtgcctgcctcagcc

SEQ ID NO: 155437 - DNA, 16 bp, H. sapiens
tgtgcctgcctgtctg

SEQ ID NO: 155438 - DNA, 16 bp, H. sapiens
tgtgcctgcttcctct

SEQ ID NO: 155439 - DNA, 16 bp, H. sapiens
tgtgcctggaatccca

SEQ ID NO: 155440 - DNA, 16 bp, H. sapiens
tgtgcctggcacacag

SEQ ID NO: 155441 - DNA, 16 bp, H. sapiens
tgtgcctggcactggg

SEQ ID NO: 155442 - DNA, 16 bp, H. sapiens
tgtgcctggccaaatg

SEQ ID NO: 155443 - DNA, 16 bp, H. sapiens
tgtgcctggcccaggt

SEQ ID NO: 155444 - DNA, 16 bp, H. sapiens
tgtgcctggccccaag

SEQ ID NO: 155445 - DNA, 16 bp, H. sapiens
tgtgcctggccctggg

SEQ ID NO: 155446 - DNA, 16 bp, H. sapiens
tgtgcctggcctactt

SEQ ID NO: 155447 - DNA, 16 bp, H. sapiens
tgtgcctggcctggaa

SEQ ID NO: 155448 - DNA, 16 bp, H. sapiens
tgtgcctggcctgggt

SEQ ID NO: 155449 - DNA, 16 bp, H. sapiens
tgtgcctggccttgtt

SEQ ID NO: 155450 - DNA, 16 bp, H. sapiens
tgtgcctggctcagag

SEQ ID NO: 155451 - DNA, 16 bp, H. sapiens
tgtgcctggctctgtg

SEQ ID NO: 155452 - DNA, 16 bp, H. sapiens
tgtgcctggcttattt

SEQ ID NO: 155453 - DNA, 16 bp, H. sapiens
tgtgcctgggaggctg

SEQ ID NO: 155454 - DNA, 16 bp, H. sapiens
tgtgcctgggctgagg

SEQ ID NO: 155455 - DNA, 16 bp, H. sapiens
tgtgcctggtttcctc

SEQ ID NO: 155456 - DNA, 16 bp, H. sapiens
tgtgcctgtaatacca

SEQ ID NO: 155457 - DNA, 16 bp, H. sapiens
tgtgcctgtagcctca

SEQ ID NO: 155458 - DNA, 16 bp, H. sapiens
tgtgcctgtgctccca

SEQ ID NO: 155459 - DNA, 16 bp, H. sapiens
tgtgcctgtggcccca

SEQ ID NO: 155460 - DNA, 16 bp, H. sapiens
tgtgcctgtggtccca

SEQ ID NO: 155461 - DNA, 16 bp, H. sapiens
tgtgcctgtgtgcgtg

SEQ ID NO: 155462 - DNA, 16 bp, H. sapiens
tgtgcctgttttcaag

SEQ ID NO: 155463 - DNA, 16 bp, H. sapiens
tgtgccttggagagga

SEQ ID NO: 155464 - DNA, 16 bp, H. sapiens
tgtgccttggcctccc

SEQ ID NO: 155465 - DNA, 16 bp, H. sapiens
tgtgccttggtttccc

SEQ ID NO: 155466 - DNA, 16 bp, H. sapiens
tgtgccttttaattag

SEQ ID NO: 155467 - DNA, 16 bp, H. sapiens
tgtgcgaccttgggca

SEQ ID NO: 155468 - DNA, 16 bp, H. sapiens
tgtgcgcacgcacaca

SEQ ID NO: 155469 - DNA, 16 bp, H. sapiens
tgtgcgccaccatgca

SEQ ID NO: 155470 - DNA, 16 bp, H. sapiens
tgtgcgccaccgcgcc

SEQ ID NO: 155471 - DNA, 16 bp, H. sapiens
tgtgcgcgcgtgcgcg

SEQ ID NO: 155472 - DNA, 16 bp, H. sapiens
tgtgcgtgagagagag

SEQ ID NO: 155473 - DNA, 16 bp, H. sapiens
tgtgcgtgcatatgtg

SEQ ID NO: 155474 - DNA, 16 bp, H. sapiens
tgtgcgtgtgagtgtg

SEQ ID NO: 155475 - DNA, 16 bp, H. sapiens
tgtgcgtgtgcgcgcg

SEQ ID NO: 155476 - DNA, 16 bp, H. sapiens
tgtgcgtgtgcgcgtg

SEQ ID NO: 155477 - DNA, 16 bp, H. sapiens
tgtgcgtgtgcgtgtg

SEQ ID NO: 155478 - DNA, 16 bp, H. sapiens
tgtgcgtgtgtcttta

SEQ ID NO: 155479 - DNA, 16 bp, H. sapiens
tgtgcgtgtgtgagtg

SEQ ID NO: 155480 - DNA, 16 bp, H. sapiens
tgtgcgtgtgtgcata

SEQ ID NO: 155481 - DNA, 16 bp, H. sapiens
tgtgcgtgtgtgtctg

SEQ ID NO: 155482 - DNA, 16 bp, H. sapiens
tgtgcgtgtgtgtgcc

SEQ ID NO: 155483 - DNA, 16 bp, H. sapiens
tgtgcgtgtgtgtgta

SEQ ID NO: 155484 - DNA, 16 bp, H. sapiens
tgtgctaagcacttta

SEQ ID NO: 155485 - DNA, 16 bp, H. sapiens
tgtgctaagtgaaaaa

SEQ ID NO: 155486 - DNA, 16 bp, H. sapiens
tgtgctacaacagcag

SEQ ID NO: 155487 - DNA, 16 bp, H. sapiens
tgtgctaccacacctg

SEQ ID NO: 155488 - DNA, 16 bp, H. sapiens
tgtgctaggtactgtg

SEQ ID NO: 155489 - DNA, 16 bp, H. sapiens
tgtgctaggtgctgag

SEQ ID NO: 155490 - DNA, 16 bp, H. sapiens
tgtgctatctatagat

SEQ ID NO: 155491 - DNA, 16 bp, H. sapiens
tgtgctatgtgtgtgt

SEQ ID NO: 155492 - DNA, 16 bp, H. sapiens
tgtgctattatttctg

SEQ ID NO: 155493 - DNA, 16 bp, H. sapiens
tgtgctcaaggtggtc

SEQ ID NO: 155494 - DNA, 16 bp, H. sapiens
tgtgctcacagaaaca

SEQ ID NO: 155495 - DNA, 16 bp, H. sapiens
tgtgctcacatttcaa

SEQ ID NO: 155496 - DNA, 16 bp, H. sapiens
tgtgctcatgtgtgtg

SEQ ID NO: 155497 - DNA, 16 bp, H. sapiens
tgtgctccagcctgag

SEQ ID NO: 155498 - DNA, 16 bp, H. sapiens
tgtgctccagcctgga

SEQ ID NO: 155499 - DNA, 16 bp, H. sapiens
tgtgctccagcctggg

SEQ ID NO: 155500 - DNA, 16 bp, H. sapiens
tgtgctcccagctact

SEQ ID NO: 155501 - DNA, 16 bp, H. sapiens
tgtgctccctgaaaca

SEQ ID NO: 155502 - DNA, 16 bp, H. sapiens
tgtgctcctgctgggg

SEQ ID NO: 155503 - DNA, 16 bp, H. sapiens
tgtgctcgtgtgtgtg

SEQ ID NO: 155504 - DNA, 21 bp, H. sapiens
tgtgctctgggctcatgaaga

SEQ ID NO: 155505 - DNA, 16 bp, H. sapiens
tgtgctctgtgtgtgt

SEQ ID NO: 155506 - DNA, 16 bp, H. sapiens
tgtgctgaataaatgc

SEQ ID NO: 155507 - DNA, 16 bp, H. sapiens
tgtgctgcactgtggg

SEQ ID NO: 155508 - DNA, 16 bp, H. sapiens
tgtgctgcagtaacaa

SEQ ID NO: 155509 - DNA, 16 bp, H. sapiens
tgtgctgctgcattca

SEQ ID NO: 155510 - DNA, 16 bp, H. sapiens
tgtgctgctggattct

SEQ ID NO: 155511 - DNA, 16 bp, H. sapiens
tgtgctggacactggg

SEQ ID NO: 155512 - DNA, 16 bp, H. sapiens
tgtgctggacactgtg

SEQ ID NO: 155513 - DNA, 16 bp, H. sapiens
tgtgctggagctggct

SEQ ID NO: 155514 - DNA, 16 bp, H. sapiens
tgtgctgggaggtctg

SEQ ID NO: 155515 - DNA, 16 bp, H. sapiens
tgtgctgggaggtggg

SEQ ID NO: 155516 - DNA, 16 bp, H. sapiens
tgtgctgggattacag

SEQ ID NO: 155517 - DNA, 16 bp, H. sapiens
tgtgctgggcactgag

SEQ ID NO: 155518 - DNA, 16 bp, H. sapiens
tgtgctgggcactggg

SEQ ID NO: 155519 - DNA, 16 bp, H. sapiens
tgtgctgggcatggtg

SEQ ID NO: 155520 - DNA, 16 bp, H. sapiens
tgtgctggggcagggg

SEQ ID NO: 155521 - DNA, 16 bp, H. sapiens
tgtgctgggtgcagtg

SEQ ID NO: 155522 - DNA, 16 bp, H. sapiens
tgtgctgggtgctgag

SEQ ID NO: 155523 - DNA, 16 bp, H. sapiens
tgtgctgggtgctgtg

SEQ ID NO: 155524 - DNA, 16 bp, H. sapiens
tgtgctggtaaatgtt

SEQ ID NO: 155525 - DNA, 16 bp, H. sapiens
tgtgctggtgggtgcc

SEQ ID NO: 155526 - DNA, 18 bp, H. sapiens
tgtgctgtattcaggaga

SEQ ID NO: 155527 - DNA, 16 bp, H. sapiens
tgtgctgtcatctagg

SEQ ID NO: 155528 - DNA, 16 bp, H. sapiens
tgtgctgtccaacatg

SEQ ID NO: 155529 - DNA, 16 bp, H. sapiens
tgtgctgtccagtgtg

SEQ ID NO: 155530 - DNA, 16 bp, H. sapiens
tgtgctgtggggaatt

SEQ ID NO: 155531 - DNA, 16 bp, H. sapiens
tgtgctgtgtgcattc

SEQ ID NO: 155532 - DNA, 16 bp, H. sapiens
tgtgctgtgtgctctg

SEQ ID NO: 155533 - DNA, 16 bp, H. sapiens
tgtgctgttataaaca

SEQ ID NO: 155534 - DNA, 16 bp, H. sapiens
tgtgcttatttattta

SEQ ID NO: 155535 - DNA, 16 bp, H. sapiens
tgtgcttcagtttcct

SEQ ID NO: 155536 - DNA, 16 bp, H. sapiens
tgtgcttcagtttctc

SEQ ID NO: 155537 - DNA, 16 bp, H. sapiens
tgtgcttcttcgagat

SEQ ID NO: 155538 - DNA, 16 bp, H. sapiens
tgtgcttcttggccat

SEQ ID NO: 155539 - DNA, 16 bp, H. sapiens
tgtgcttgcagtccca

SEQ ID NO: 155540 - DNA, 16 bp, H. sapiens
tgtgcttgcttctcct

SEQ ID NO: 155541 - DNA, 16 bp, H. sapiens
tgtgcttggaaaagcc

SEQ ID NO: 155542 - DNA, 16 bp, H. sapiens
tgtgcttggcttattt

SEQ ID NO: 155543 - DNA, 16 bp, H. sapiens
tgtgcttgtgtatgtg

SEQ ID NO: 155544 - DNA, 16 bp, H. sapiens
tgtgctttcctttaag

SEQ ID NO: 155545 - DNA, 16 bp, H. sapiens
tgtgcttttaaaaaat

SEQ ID NO: 155546 - DNA, 16 bp, H. sapiens
tgtgcttttgagttct

SEQ ID NO: 155547 - DNA, 16 bp, H. sapiens
tgtgcttttggggtca

SEQ ID NO: 155548 - DNA, 16 bp, H. sapiens
tgtgctttttaaaaaa

SEQ ID NO: 155549 - DNA, 16 bp, H. sapiens
tgtgctttttttaaaa

SEQ ID NO: 155550 - DNA, 16 bp, H. sapiens
tgtggaaaaactggaa

SEQ ID NO: 155551 - DNA, 16 bp, H. sapiens
tgtggaaaagccacag

SEQ ID NO: 155552 - DNA, 16 bp, H. sapiens
tgtggaaaatgacatt

SEQ ID NO: 155553 - DNA, 16 bp, H. sapiens
tgtggaaactgaggca

SEQ ID NO: 155554 - DNA, 16 bp, H. sapiens
tgtggaaagcactttg

SEQ ID NO: 155555 - DNA, 16 bp, H. sapiens
tgtggaaagcagtttt

SEQ ID NO: 155556 - DNA, 16 bp, H. sapiens
tgtggaaaggagtttg

SEQ ID NO: 155557 - DNA, 16 bp, H. sapiens
tgtggaaataaatgaa

SEQ ID NO: 155558 - DNA, 16 bp, H. sapiens
tgtggaaatatttttt

SEQ ID NO: 155559 - DNA, 16 bp, H. sapiens
tgtggaaatgactttg

SEQ ID NO: 155560 - DNA, 16 bp, H. sapiens
tgtggaaatgagtttg

SEQ ID NO: 155561 - DNA, 16 bp, H. sapiens
tgtggaaatttgtttt

SEQ ID NO: 155562 - DNA, 16 bp, H. sapiens
tgtggaaatttttaaa

SEQ ID NO: 155563 - DNA, 16 bp, H. sapiens
tgtggaactgtgagtt

SEQ ID NO: 155564 - DNA, 16 bp, H. sapiens
tgtggaagacagggtg

SEQ ID NO: 155565 - DNA, 16 bp, H. sapiens
tgtggaagacagtatg

SEQ ID NO: 155566 - DNA, 16 bp, H. sapiens
tgtggaagacagtgta

SEQ ID NO: 155567 - DNA, 16 bp, H. sapiens
tgtggaagagggaggc

SEQ ID NO: 155568 - DNA, 16 bp, H. sapiens
tgtggaagatagtgtg

SEQ ID NO: 155569 - DNA, 16 bp, H. sapiens
tgtggaaggaaaacaa

SEQ ID NO: 155570 - DNA, 16 bp, H. sapiens
tgtggaaggaaaatat

SEQ ID NO: 155571 - DNA, 16 bp, H. sapiens
tgtggaaggaaaatgt

SEQ ID NO: 155572 - DNA, 16 bp, H. sapiens
tgtggaaggcagtttt

SEQ ID NO: 155573 - DNA, 16 bp, H. sapiens
tgtggaaggccaaggc

SEQ ID NO: 155574 - DNA, 16 bp, H. sapiens
tgtggaagggacccag

SEQ ID NO: 155575 - DNA, 16 bp, H. sapiens
tgtggaaggggaagca

SEQ ID NO: 155576 - DNA, 16 bp, H. sapiens
tgtggaaggggaccca

SEQ ID NO: 155577 - DNA, 16 bp, H. sapiens
tgtggaaggggacccc

SEQ ID NO: 155578 - DNA, 16 bp, H. sapiens
tgtggaagtagctttg

SEQ ID NO: 155579 - DNA, 16 bp, H. sapiens
tgtggaagtgactttg

SEQ ID NO: 155580 - DNA, 16 bp, H. sapiens
tgtggaagtggctttg

SEQ ID NO: 155581 - DNA, 16 bp, H. sapiens
tgtggaagtgtgtgtg

SEQ ID NO: 155582 - DNA, 16 bp, H. sapiens
tgtggaagttcctcaa

SEQ ID NO: 155583 - DNA, 16 bp, H. sapiens
tgtggaatacaggaga

SEQ ID NO: 155584 - DNA, 16 bp, H. sapiens
tgtggaatattactca

SEQ ID NO: 155585 - DNA, 16 bp, H. sapiens
tgtggaatccatggat

SEQ ID NO: 155586 - DNA, 16 bp, H. sapiens
tgtggaatgttaaata

SEQ ID NO: 155587 - DNA, 16 bp, H. sapiens
tgtggaatgttgaact

SEQ ID NO: 155588 - DNA, 16 bp, H. sapiens
tgtggaattttccact

SEQ ID NO: 155589 - DNA, 16 bp, H. sapiens
tgtggacactgaggaa

SEQ ID NO: 155590 - DNA, 16 bp, H. sapiens
tgtggacataagtttt

SEQ ID NO: 155591 - DNA, 16 bp, H. sapiens
tgtggacatctttttt

SEQ ID NO: 155592 - DNA, 16 bp, H. sapiens
tgtggaccacactttg

SEQ ID NO: 155593 - DNA, 16 bp, H. sapiens
tgtggagaaaaagaga

SEQ ID NO: 155594 - DNA, 16 bp, H. sapiens
tgtggagaaaagagaa

SEQ ID NO: 155595 - DNA, 16 bp, H. sapiens
tgtggagaaactgaaa

SEQ ID NO: 155596 - DNA, 16 bp, H. sapiens
tgtggagaaactggaa

SEQ ID NO: 155597 - DNA, 16 bp, H. sapiens
tgtggagaaagaggaa

SEQ ID NO: 155598 - DNA, 16 bp, H. sapiens
tgtggagaaatagaaa

SEQ ID NO: 155599 - DNA, 16 bp, H. sapiens
tgtggagaacagggaa

SEQ ID NO: 155600 - DNA, 16 bp, H. sapiens
tgtggagaatagattg

SEQ ID NO: 155601 - DNA, 16 bp, H. sapiens
tgtggagaatggatta

SEQ ID NO: 155602 - DNA, 16 bp, H. sapiens
tgtggagactcacatc

SEQ ID NO: 155603 - DNA, 16 bp, H. sapiens
tgtggagagaagagaa

SEQ ID NO: 155604 - DNA, 16 bp, H. sapiens
tgtggagagaagagag

SEQ ID NO: 155605 - DNA, 16 bp, H. sapiens
tgtggagatgaggtct

SEQ ID NO: 155606 - DNA, 16 bp, H. sapiens
tgtggagatggaagac

SEQ ID NO: 155607 - DNA, 16 bp, H. sapiens
tgtggagatggagttt

SEQ ID NO: 155608 - DNA, 16 bp, H. sapiens
tgtggagattgcagtg

SEQ ID NO: 155609 - DNA, 16 bp, H. sapiens
tgtggagcaaagggaa

SEQ ID NO: 155610 - DNA, 16 bp, H. sapiens
tgtggagcaactggaa

SEQ ID NO: 155611 - DNA, 16 bp, H. sapiens
tgtggagcccagaggg

SEQ ID NO: 155612 - DNA, 16 bp, H. sapiens
tgtggagcctggggtt

SEQ ID NO: 155613 - DNA, 16 bp, H. sapiens
tgtggaggaaagggaa

SEQ ID NO: 155614 - DNA, 16 bp, H. sapiens
tgtggaggaactggaa

SEQ ID NO: 155615 - DNA, 16 bp, H. sapiens
tgtggaggaattggaa

SEQ ID NO: 155616 - DNA, 16 bp, H. sapiens
tgtggaggaatttatc

SEQ ID NO: 155617 - DNA, 16 bp, H. sapiens
tgtggaggaggtgagt

SEQ ID NO: 155618 - DNA, 16 bp, H. sapiens
tgtggaggattttatt

SEQ ID NO: 155619 - DNA, 16 bp, H. sapiens
tgtggaggcagggtct

SEQ ID NO: 155620 - DNA, 16 bp, H. sapiens
tgtggaggctggcaag

SEQ ID NO: 155621 - DNA, 17 bp, H. sapiens
tgtggagggcctgacat

SEQ ID NO: 155622 - DNA, 18 bp, H. sapiens
tgtggaggtaacaagtat

SEQ ID NO: 155623 - DNA, 16 bp, H. sapiens
tgtggaggtgaaagac

SEQ ID NO: 155624 - DNA, 16 bp, H. sapiens
tgtggaggtggaagat

SEQ ID NO: 155625 - DNA, 17 bp, H. sapiens
tgtggaggttgcagtga

SEQ ID NO: 155626 - DNA, 16 bp, H. sapiens
tgtggagtcctgccca

SEQ ID NO: 155627 - DNA, 16 bp, H. sapiens
tgtggataaattggaa

SEQ ID NO: 155628 - DNA, 16 bp, H. sapiens
tgtggataccactcag

SEQ ID NO: 155629 - DNA, 16 bp, H. sapiens
tgtggatatattttaa

SEQ ID NO: 155630 - DNA, 16 bp, H. sapiens
tgtggatatgttttca

SEQ ID NO: 155631 - DNA, 16 bp, H. sapiens
tgtggatgagtgtgtg

SEQ ID NO: 155632 - DNA, 16 bp, H. sapiens
tgtggatggcaaggac

SEQ ID NO: 155633 - DNA, 16 bp, H. sapiens
tgtggatgtcagtgtg

SEQ ID NO: 155634 - DNA, 16 bp, H. sapiens
tgtggatgtgagtgtg

SEQ ID NO: 155635 - DNA, 16 bp, H. sapiens
tgtggatgtggagaaa

SEQ ID NO: 155636 - DNA, 16 bp, H. sapiens
tgtggatgtggatgtg

SEQ ID NO: 155637 - DNA, 16 bp, H. sapiens
tgtggattcaagttac

SEQ ID NO: 155638 - DNA, 16 bp, H. sapiens
tgtggatttgtctcac

SEQ ID NO: 155639 - DNA, 16 bp, H. sapiens
tgtggatttgtttctg

SEQ ID NO: 155640 - DNA, 16 bp, H. sapiens
tgtggattttcaactg

SEQ ID NO: 155641 - DNA, 16 bp, H. sapiens
tgtggcaaagccttca

SEQ ID NO: 155642 - DNA, 16 bp, H. sapiens
tgtggcaattgtgaat

SEQ ID NO: 155643 - DNA, 16 bp, H. sapiens
tgtggcacatatatgc

SEQ ID NO: 155644 - DNA, 16 bp, H. sapiens
tgtggcacatgcctat

SEQ ID NO: 155645 - DNA, 16 bp, H. sapiens
tgtggcactgcctagt

SEQ ID NO: 155646 - DNA, 16 bp, H. sapiens
tgtggcagagactgct

SEQ ID NO: 155647 - DNA, 16 bp, H. sapiens
tgtggcagagctggga

SEQ ID NO: 155648 - DNA, 16 bp, H. sapiens
tgtggcagcataactc

SEQ ID NO: 155649 - DNA, 16 bp, H. sapiens
tgtggcagccatcttg

SEQ ID NO: 155650 - DNA, 16 bp, H. sapiens
tgtggcagtactttct

SEQ ID NO: 155651 - DNA, 16 bp, H. sapiens
tgtggcagtgttggga

SEQ ID NO: 155652 - DNA, 16 bp, H. sapiens
tgtggcagttcctcaa

SEQ ID NO: 155653 - DNA, 16 bp, H. sapiens
tgtggcattatttctg

SEQ ID NO: 155654 - DNA, 16 bp, H. sapiens
tgtggcattctgttat

SEQ ID NO: 155655 - DNA, 16 bp, H. sapiens
tgtggcattgtttctg

SEQ ID NO: 155656 - DNA, 16 bp, H. sapiens
tgtggcatttgtcttt

SEQ ID NO: 155657 - DNA, 16 bp, H. sapiens
tgtggcattttctcta

SEQ ID NO: 155658 - DNA, 16 bp, H. sapiens
tgtggcattttgttac

SEQ ID NO: 155659 - DNA, 16 bp, H. sapiens
tgtggcatttttactt

SEQ ID NO: 155660 - DNA, 16 bp, H. sapiens
tgtggccaatatggtg

SEQ ID NO: 155661 - DNA, 16 bp, H. sapiens
tgtggccacatcactc

SEQ ID NO: 155662 - DNA, 16 bp, H. sapiens
tgtggccaccaccact

SEQ ID NO: 155663 - DNA, 16 bp, H. sapiens
tgtggccagagtgcct

SEQ ID NO: 155664 - DNA, 16 bp, H. sapiens
tgtggccagcctggcc

SEQ ID NO: 155665 - DNA, 16 bp, H. sapiens
tgtggccaggctggag

SEQ ID NO: 155666 - DNA, 16 bp, H. sapiens
tgtggccaggctgggg

SEQ ID NO: 155667 - DNA, 16 bp, H. sapiens
tgtggccatgtgttct

SEQ ID NO: 155668 - DNA, 16 bp, H. sapiens
tgtggcccaaaacaat

SEQ ID NO: 155669 - DNA, 16 bp, H. sapiens
tgtggcccaacacaaa

SEQ ID NO: 155670 - DNA, 16 bp, H. sapiens
tgtggcccacacctgt

SEQ ID NO: 155671 - DNA, 16 bp, H. sapiens
tgtggcccagagaagc

SEQ ID NO: 155672 - DNA, 16 bp, H. sapiens
tgtggcccagccaagt

SEQ ID NO: 155673 - DNA, 16 bp, H. sapiens
tgtggcccaggaaagc

SEQ ID NO: 155674 - DNA, 16 bp, H. sapiens
tgtggcccaggctggg

SEQ ID NO: 155675 - DNA, 16 bp, H. sapiens
tgtggcccaggttgga

SEQ ID NO: 155676 - DNA, 16 bp, H. sapiens
tgtggccctggccctg

SEQ ID NO: 155677 - DNA, 16 bp, H. sapiens
tgtggcctgagagact

SEQ ID NO: 155678 - DNA, 16 bp, H. sapiens
tgtggcctggcatggt

SEQ ID NO: 155679 - DNA, 16 bp, H. sapiens
tgtggcctgtggcctg

SEQ ID NO: 155680 - DNA, 16 bp, H. sapiens
tgtggccttctcctct

SEQ ID NO: 155681 - DNA, 16 bp, H. sapiens
tgtggccttggaaaag

SEQ ID NO: 155682 - DNA, 16 bp, H. sapiens
tgtggccttgggcaag

SEQ ID NO: 155683 - DNA, 16 bp, H. sapiens
tgtggcctttggcaag

SEQ ID NO: 155684 - DNA, 16 bp, H. sapiens
tgtggcctttgggaag

SEQ ID NO: 155685 - DNA, 16 bp, H. sapiens
tgtggccttttcagat

SEQ ID NO: 155686 - DNA, 16 bp, H. sapiens
tgtggcgcgatcttgg

SEQ ID NO: 155687 - DNA, 16 bp, H. sapiens
tgtggctactagaaaa

SEQ ID NO: 155688 - DNA, 16 bp, H. sapiens
tgtggctactgtaaat

SEQ ID NO: 155689 - DNA, 16 bp, H. sapiens
tgtggctagtggctat

SEQ ID NO: 155690 - DNA, 16 bp, H. sapiens
tgtggctagtgtgact

SEQ ID NO: 155691 - DNA, 16 bp, H. sapiens
tgtggctattttaaat

SEQ ID NO: 155692 - DNA, 16 bp, H. sapiens
tgtggctcagcctccc

SEQ ID NO: 155693 - DNA, 16 bp, H. sapiens
tgtggctcaggtgggc

SEQ ID NO: 155694 - DNA, 16 bp, H. sapiens
tgtggctcatccctgt

SEQ ID NO: 155695 - DNA, 18 bp, H. sapiens
tgtggctcatccctgtaa

SEQ ID NO: 155696 - DNA, 16 bp, H. sapiens
tgtggctcccacccag

SEQ ID NO: 155697 - DNA, 16 bp, H. sapiens
tgtggctcccacctgt

SEQ ID NO: 155698 - DNA, 16 bp, H. sapiens
tgtggctctcagctct

SEQ ID NO: 155699 - DNA, 16 bp, H. sapiens
tgtggctctgcaggat

SEQ ID NO: 155700 - DNA, 16 bp, H. sapiens
tgtggctctgcagggc

SEQ ID NO: 155701 - DNA, 16 bp, H. sapiens
tgtggctctgttgccc

SEQ ID NO: 155702 - DNA, 16 bp, H. sapiens
tgtggctgaagcagag

SEQ ID NO: 155703 - DNA, 16 bp, H. sapiens
tgtggctgagctggca

SEQ ID NO: 155704 - DNA, 16 bp, H. sapiens
tgtggctgagctggtg

SEQ ID NO: 155705 - DNA, 16 bp, H. sapiens
tgtggctgcactggag

SEQ ID NO: 155706 - DNA, 16 bp, H. sapiens
tgtggctgctgctgct

SEQ ID NO: 155707 - DNA, 16 bp, H. sapiens
tgtggctgctgctggg

SEQ ID NO: 155708 - DNA, 16 bp, H. sapiens
tgtggctgctttcctg

SEQ ID NO: 155709 - DNA, 16 bp, H. sapiens
tgtggctgcttttgca

SEQ ID NO: 155710 - DNA, 16 bp, H. sapiens
tgtggctggaatggag

SEQ ID NO: 155711 - DNA, 16 bp, H. sapiens
tgtggctggaccagat

SEQ ID NO: 155712 - DNA, 16 bp, H. sapiens
tgtggctggaccaggt

SEQ ID NO: 155713 - DNA, 16 bp, H. sapiens
tgtggctggagaagag

SEQ ID NO: 155714 - DNA, 16 bp, H. sapiens
tgtggctggagcaaag

SEQ ID NO: 155715 - DNA, 16 bp, H. sapiens
tgtggctggagcagaa

SEQ ID NO: 155716 - DNA, 16 bp, H. sapiens
tgtggctggagcaggg

SEQ ID NO: 155717 - DNA, 16 bp, H. sapiens
tgtggctggagcccag

SEQ ID NO: 155718 - DNA, 16 bp, H. sapiens
tgtggctggaggcgag

SEQ ID NO: 155719 - DNA, 16 bp, H. sapiens
tgtggctggggaagcc

SEQ ID NO: 155720 - DNA, 16 bp, H. sapiens
tgtggctggggaggcc

SEQ ID NO: 155721 - DNA, 16 bp, H. sapiens
tgtggctgtcctttct

SEQ ID NO: 155722 - DNA, 16 bp, H. sapiens
tgtggctgtgctggag

SEQ ID NO: 155723 - DNA, 16 bp, H. sapiens
tgtggctgtggatgag

SEQ ID NO: 155724 - DNA, 16 bp, H. sapiens
tgtggctgtgggcaaa

SEQ ID NO: 155725 - DNA, 16 bp, H. sapiens
tgtggcttatcttttc

SEQ ID NO: 155726 - DNA, 16 bp, H. sapiens
tgtggcttgggaggcc

SEQ ID NO: 155727 - DNA, 16 bp, H. sapiens
tgtggcttgggcttcc

SEQ ID NO: 155728 - DNA, 16 bp, H. sapiens
tgtggcttgtcttctc

SEQ ID NO: 155729 - DNA, 16 bp, H. sapiens
tgtggctttgaagggt

SEQ ID NO: 155730 - DNA, 16 bp, H. sapiens
tgtggctttgggcaag

SEQ ID NO: 155731 - DNA, 16 bp, H. sapiens
tgtgggaaacagtttg

SEQ ID NO: 155732 - DNA, 16 bp, H. sapiens
tgtgggaaagccttca

SEQ ID NO: 155733 - DNA, 16 bp, H. sapiens
tgtgggaaaggcctct

SEQ ID NO: 155734 - DNA, 16 bp, H. sapiens
tgtgggaagattttta

SEQ ID NO: 155735 - DNA, 16 bp, H. sapiens
tgtgggaaggttttta

SEQ ID NO: 155736 - DNA, 16 bp, H. sapiens
tgtgggacaataacaa

SEQ ID NO: 155737 - DNA, 16 bp, H. sapiens
tgtgggaccttgtgat

SEQ ID NO: 155738 - DNA, 16 bp, H. sapiens
tgtgggactgagtcct

SEQ ID NO: 155739 - DNA, 16 bp, H. sapiens
tgtgggagagacccgg

SEQ ID NO: 155740 - DNA, 16 bp, H. sapiens
tgtgggagcagcttca

SEQ ID NO: 155741 - DNA, 16 bp, H. sapiens
tgtgggagcagctttt

SEQ ID NO: 155742 - DNA, 16 bp, H. sapiens
tgtgggagctaaaaaa

SEQ ID NO: 155743 - DNA, 16 bp, H. sapiens
tgtgggagctaaaaat

SEQ ID NO: 155744 - DNA, 16 bp, H. sapiens
tgtgggagctttgttc

SEQ ID NO: 155745 - DNA, 16 bp, H. sapiens
tgtgggaggccaagac

SEQ ID NO: 155746 - DNA, 16 bp, H. sapiens
tgtgggagggaactgg

SEQ ID NO: 155747 - DNA, 16 bp, H. sapiens
tgtgggagggaccaag

SEQ ID NO: 155748 - DNA, 16 bp, H. sapiens
tgtgggagggaccggg

SEQ ID NO: 155749 - DNA, 16 bp, H. sapiens
tgtgggagtctcagtc

SEQ ID NO: 155750 - DNA, 16 bp, H. sapiens
tgtgggattgatggtg

SEQ ID NO: 155751 - DNA, 16 bp, H. sapiens
tgtgggcaacatggtg

SEQ ID NO: 155752 - DNA, 16 bp, H. sapiens
tgtgggcacagcttca

SEQ ID NO: 155753 - DNA, 16 bp, H. sapiens
tgtgggcagaaaccag

SEQ ID NO: 155754 - DNA, 16 bp, H. sapiens
tgtgggcagggccatg

SEQ ID NO: 155755 - DNA, 16 bp, H. sapiens
tgtgggcatctttggg

SEQ ID NO: 155756 - DNA, 17 bp, H. sapiens
tgtgggcatttggtgct

SEQ ID NO: 155757 - DNA, 16 bp, H. sapiens
tgtgggccaccgtgcc

SEQ ID NO: 155758 - DNA, 16 bp, H. sapiens
tgtgggccagatttgg

SEQ ID NO: 155759 - DNA, 16 bp, H. sapiens
tgtgggccaggcatgg

SEQ ID NO: 155760 - DNA, 16 bp, H. sapiens
tgtgggccaggccctg

SEQ ID NO: 155761 - DNA, 16 bp, H. sapiens
tgtgggccaggcctgg

SEQ ID NO: 155762 - DNA, 16 bp, H. sapiens
tgtgggccaggctagt

SEQ ID NO: 155763 - DNA, 16 bp, H. sapiens
tgtgggccatagtttg

SEQ ID NO: 155764 - DNA, 16 bp, H. sapiens
tgtgggccccaagatc

SEQ ID NO: 155765 - DNA, 16 bp, H. sapiens
tgtgggcccttttttg

SEQ ID NO: 155766 - DNA, 16 bp, H. sapiens
tgtgggctctgttttg

SEQ ID NO: 155767 - DNA, 16 bp, H. sapiens
tgtgggctctttcttg

SEQ ID NO: 155768 - DNA, 16 bp, H. sapiens
tgtgggctgagcccag

SEQ ID NO: 155769 - DNA, 16 bp, H. sapiens
tgtgggctgcaacaaa

SEQ ID NO: 155770 - DNA, 16 bp, H. sapiens
tgtgggctgggcacag

SEQ ID NO: 155771 - DNA, 16 bp, H. sapiens
tgtgggctgggcatgg

SEQ ID NO: 155772 - DNA, 16 bp, H. sapiens
tgtgggctgggcccag

SEQ ID NO: 155773 - DNA, 16 bp, H. sapiens
tgtgggcttttaaaaa

SEQ ID NO: 155774 - DNA, 16 bp, H. sapiens
tgtggggacacagagc

SEQ ID NO: 155775 - DNA, 16 bp, H. sapiens
tgtggggacatggatg

SEQ ID NO: 155776 - DNA, 16 bp, H. sapiens
tgtggggagagggcag

SEQ ID NO: 155777 - DNA, 16 bp, H. sapiens
tgtggggaggctgagg

SEQ ID NO: 155778 - DNA, 16 bp, H. sapiens
tgtggggagggcacca

SEQ ID NO: 155779 - DNA, 16 bp, H. sapiens
tgtggggaggtggcag

SEQ ID NO: 155780 - DNA, 16 bp, H. sapiens
tgtggggatttctccc

SEQ ID NO: 155781 - DNA, 16 bp, H. sapiens
tgtggggccagagccc

SEQ ID NO: 155782 - DNA, 16 bp, H. sapiens
tgtggggccaggcatg

SEQ ID NO: 155783 - DNA, 16 bp, H. sapiens
tgtggggcctccccag

SEQ ID NO: 155784 - DNA, 16 bp, H. sapiens
tgtggggcctgaggct

SEQ ID NO: 155785 - DNA, 16 bp, H. sapiens
tgtggggctgagggag

SEQ ID NO: 155786 - DNA, 16 bp, H. sapiens
tgtgggggagatttgc

SEQ ID NO: 155787 - DNA, 16 bp, H. sapiens
tgtgggggctccaaac

SEQ ID NO: 155788 - DNA, 16 bp, H. sapiens
tgtgggggctccaccc

SEQ ID NO: 155789 - DNA, 16 bp, H. sapiens
tgtgggggctgccctg

SEQ ID NO: 155790 - DNA, 16 bp, H. sapiens
tgtggggtgggggaca

SEQ ID NO: 155791 - DNA, 16 bp, H. sapiens
tgtggggttggagctc

SEQ ID NO: 155792 - DNA, 16 bp, H. sapiens
tgtggggttgtcatag

SEQ ID NO: 155793 - DNA, 16 bp, H. sapiens
tgtgggtacacagaag

SEQ ID NO: 155794 - DNA, 16 bp, H. sapiens
tgtgggtatatgtgtg

SEQ ID NO: 155795 - DNA, 16 bp, H. sapiens
tgtgggtcaggaatct

SEQ ID NO: 155796 - DNA, 16 bp, H. sapiens
tgtgggtctatttcta

SEQ ID NO: 155797 - DNA, 16 bp, H. sapiens
tgtgggtctctcagcc

SEQ ID NO: 155798 - DNA, 16 bp, H. sapiens
tgtgggtctgtttctg

SEQ ID NO: 155799 - DNA, 16 bp, H. sapiens
tgtgggtgggcctcat

SEQ ID NO: 155800 - DNA, 16 bp, H. sapiens
tgtgggtgggccttgt

SEQ ID NO: 155801 - DNA, 16 bp, H. sapiens
tgtgggtgtcagtcag

SEQ ID NO: 155802 - DNA, 16 bp, H. sapiens
tgtgggtgtgagtgac

SEQ ID NO: 155803 - DNA, 16 bp, H. sapiens
tgtgggtgtgtgaatg

SEQ ID NO: 155804 - DNA, 16 bp, H. sapiens
tgtgggtgttgccaaa

SEQ ID NO: 155805 - DNA, 16 bp, H. sapiens
tgtgggtgtttctcga

SEQ ID NO: 155806 - DNA, 16 bp, H. sapiens
tgtgggttccacatct

SEQ ID NO: 155807 - DNA, 17 bp, H. sapiens
tgtgggttgtctcttca

SEQ ID NO: 155808 - DNA, 16 bp, H. sapiens
tgtgggttgttcccct

SEQ ID NO: 155809 - DNA, 16 bp, H. sapiens
tgtgggtttaaaaaaa

SEQ ID NO: 155810 - DNA, 16 bp, H. sapiens
tgtgggtttgtaataa

SEQ ID NO: 155811 - DNA, 16 bp, H. sapiens
tgtgggtttgtcattt

SEQ ID NO: 155812 - DNA, 16 bp, H. sapiens
tgtgggttttgacaaa

SEQ ID NO: 155813 - DNA, 16 bp, H. sapiens
tgtggtaatgtgttac

SEQ ID NO: 155814 - DNA, 16 bp, H. sapiens
tgtggtaattctattt

SEQ ID NO: 155815 - DNA, 16 bp, H. sapiens
tgtggtacatctatac

SEQ ID NO: 155816 - DNA, 16 bp, H. sapiens
tgtggtagaaaaggaa

SEQ ID NO: 155817 - DNA, 17 bp, H. sapiens
tgtggtagaattcggct

SEQ ID NO: 155818 - DNA, 16 bp, H. sapiens
tgtggtagcaggcacc

SEQ ID NO: 155819 - DNA, 16 bp, H. sapiens
tgtggtagcatgtgcc

SEQ ID NO: 155820 - DNA, 17 bp, H. sapiens
tgtggtagctcatgcct

SEQ ID NO: 155821 - DNA, 16 bp, H. sapiens
tgtggtatttgctttt

SEQ ID NO: 155822 - DNA, 16 bp, H. sapiens
tgtggtcagagaagat

SEQ ID NO: 155823 - DNA, 16 bp, H. sapiens
tgtggtccatcattga

SEQ ID NO: 155824 - DNA, 16 bp, H. sapiens
tgtggtcccagctaca

SEQ ID NO: 155825 - DNA, 16 bp, H. sapiens
tgtggtcccagctacc

SEQ ID NO: 155826 - DNA, 16 bp, H. sapiens
tgtggtcccagctact

SEQ ID NO: 155827 - DNA, 16 bp, H. sapiens
tgtggtcccagctgag

SEQ ID NO: 155828 - DNA, 16 bp, H. sapiens
tgtggtccccacccag

SEQ ID NO: 155829 - DNA, 16 bp, H. sapiens
tgtggtccccagacca

SEQ ID NO: 155830 - DNA, 16 bp, H. sapiens
tgtggtccctgaacca

SEQ ID NO: 155831 - DNA, 16 bp, H. sapiens
tgtggtccctggacca

SEQ ID NO: 155832 - DNA, 16 bp, H. sapiens
tgtggtcctagctact

SEQ ID NO: 155833 - DNA, 16 bp, H. sapiens
tgtggtcctagttact

SEQ ID NO: 155834 - DNA, 16 bp, H. sapiens
tgtggtctcagatact

SEQ ID NO: 155835 - DNA, 16 bp, H. sapiens
tgtggtctgtcttggt

SEQ ID NO: 155836 - DNA, 16 bp, H. sapiens
tgtggtcttggacaag

SEQ ID NO: 155837 - DNA, 16 bp, H. sapiens
tgtggtgacaggcacc

SEQ ID NO: 155838 - DNA, 16 bp, H. sapiens
tgtggtgagttgagat

SEQ ID NO: 155839 - DNA, 16 bp, H. sapiens
tgtggtgatagaaatg

SEQ ID NO: 155840 - DNA, 16 bp, H. sapiens
tgtggtgatcatttca

SEQ ID NO: 155841 - DNA, 16 bp, H. sapiens
tgtggtgatgatttca

SEQ ID NO: 155842 - DNA, 17 bp, H. sapiens
tgtggtgatgcatgcct

SEQ ID NO: 155843 - DNA, 16 bp, H. sapiens
tgtggtgatgctggtg

SEQ ID NO: 155844 - DNA, 16 bp, H. sapiens
tgtggtgcatgtgtgt

SEQ ID NO: 155845 - DNA, 16 bp, H. sapiens
tgtggtgccagctact

SEQ ID NO: 155846 - DNA, 16 bp, H. sapiens
tgtggtgcctcctctg

SEQ ID NO: 155847 - DNA, 16 bp, H. sapiens
tgtggtgctggaaaaa

SEQ ID NO: 155848 - DNA, 16 bp, H. sapiens
tgtggtgctgtgcttc

SEQ ID NO: 155849 - DNA, 16 bp, H. sapiens
tgtggtggagagttct

SEQ ID NO: 155850 - DNA, 16 bp, H. sapiens
tgtggtggagcatgcc

SEQ ID NO: 155851 - DNA, 16 bp, H. sapiens
tgtggtggagggcacc

SEQ ID NO: 155852 - DNA, 16 bp, H. sapiens
tgtggtggagtgcacc

SEQ ID NO: 155853 - DNA, 17 bp, H. sapiens
tgtggtggcacacacct

SEQ ID NO: 155854 - DNA, 16 bp, H. sapiens
tgtggtggcacaggcc

SEQ ID NO: 155855 - DNA, 16 bp, H. sapiens
tgtggtggcacatgct

SEQ ID NO: 155856 - DNA, 20 bp, H. sapiens
tgtggtggcaggcgcctgta

SEQ ID NO: 155857 - DNA, 16 bp, H. sapiens
tgtggtggcaggctcc

SEQ ID NO: 155858 - DNA, 16 bp, H. sapiens
tgtggtggcaggggcc

SEQ ID NO: 155859 - DNA, 16 bp, H. sapiens
tgtggtggcaggtgcc

SEQ ID NO: 155860 - DNA, 16 bp, H. sapiens
tgtggtggcatgtggc

SEQ ID NO: 155861 - DNA, 16 bp, H. sapiens
tgtggtggcctcaggg

SEQ ID NO: 155862 - DNA, 16 bp, H. sapiens
tgtggtggcctgtgcc

SEQ ID NO: 155863 - DNA, 17 bp, H. sapiens
tgtggtggcgtgcacct

SEQ ID NO: 155864 - DNA, 17 bp, H. sapiens
tgtggtggctcacacct

SEQ ID NO: 155865 - DNA, 16 bp, H. sapiens
tgtggtggctcacact

SEQ ID NO: 155866 - DNA, 17 bp, H. sapiens
tgtggtggctcacgcct

SEQ ID NO: 155867 - DNA, 27 bp, H. sapiens
tgtggtggctcatgcctgtaatcccaa

SEQ ID NO: 155868 - DNA, 16 bp, H. sapiens
tgtggtggcttatgct

SEQ ID NO: 155869 - DNA, 16 bp, H. sapiens
tgtggtggcttgtgcc

SEQ ID NO: 155870 - DNA, 18 bp, H. sapiens
tgtggtgggctccaccca

SEQ ID NO: 155871 - DNA, 16 bp, H. sapiens
tgtggtggggcaggca

SEQ ID NO: 155872 - DNA, 16 bp, H. sapiens
tgtggtggtagatgcc

SEQ ID NO: 155873 - DNA, 16 bp, H. sapiens
tgtggtggtgcatatc

SEQ ID NO: 155874 - DNA, 16 bp, H. sapiens
tgtggtggtgcccgcc

SEQ ID NO: 155875 - DNA, 16 bp, H. sapiens
tgtggtggtggacacc

SEQ ID NO: 155876 - DNA, 16 bp, H. sapiens
tgtggtggtggctgcc

SEQ ID NO: 155877 - DNA, 16 bp, H. sapiens
tgtggtggtgggcatc

SEQ ID NO: 155878 - DNA, 16 bp, H. sapiens
tgtggtggtgggcgcc

SEQ ID NO: 155879 - DNA, 16 bp, H. sapiens
tgtggtggtggtttca

SEQ ID NO: 155880 - DNA, 16 bp, H. sapiens
tgtggtgtcatttctg

SEQ ID NO: 155881 - DNA, 16 bp, H. sapiens
tgtggtgtgtacctgt

SEQ ID NO: 155882 - DNA, 16 bp, H. sapiens
tgtggtgtgtgtatat

SEQ ID NO: 155883 - DNA, 16 bp, H. sapiens
tgtggtgttccccttc

SEQ ID NO: 155884 - DNA, 16 bp, H. sapiens
tgtggtgttgagcctg

SEQ ID NO: 155885 - DNA, 16 bp, H. sapiens
tgtggttacaggtgtg

SEQ ID NO: 155886 - DNA, 16 bp, H. sapiens
tgtggttagccgagat

SEQ ID NO: 155887 - DNA, 16 bp, H. sapiens
tgtggttcccagtcca

SEQ ID NO: 155888 - DNA, 16 bp, H. sapiens
tgtggttgcaggtgcc

SEQ ID NO: 155889 - DNA, 16 bp, H. sapiens
tgtggttgtgggcgcc

SEQ ID NO: 155890 - DNA, 16 bp, H. sapiens
tgtggtttcattgctt

SEQ ID NO: 155891 - DNA, 16 bp, H. sapiens
tgtggttttatttctg

SEQ ID NO: 155892 - DNA, 16 bp, H. sapiens
tgtggtttttaaaaaa

SEQ ID NO: 155893 - DNA, 16 bp, H. sapiens
tgtggtttttgccata

SEQ ID NO: 155894 - DNA, 16 bp, H. sapiens
tgtgtaaactactcat

SEQ ID NO: 155895 - DNA, 16 bp, H. sapiens
tgtgtaaactactttt

SEQ ID NO: 155896 - DNA, 16 bp, H. sapiens
tgtgtaaaggtgttca

SEQ ID NO: 155897 - DNA, 16 bp, H. sapiens
tgtgtaaatatgtgtg

SEQ ID NO: 155898 - DNA, 16 bp, H. sapiens
tgtgtaaattatatct

SEQ ID NO: 155899 - DNA, 16 bp, H. sapiens
tgtgtaaatttaaaaa

SEQ ID NO: 155900 - DNA, 16 bp, H. sapiens
tgtgtaagtatactct

SEQ ID NO: 155901 - DNA, 16 bp, H. sapiens
tgtgtaagtctttaat

SEQ ID NO: 155902 - DNA, 16 bp, H. sapiens
tgtgtaagtttgctga

SEQ ID NO: 155903 - DNA, 16 bp, H. sapiens
tgtgtaatctctgatt

SEQ ID NO: 155904 - DNA, 16 bp, H. sapiens
tgtgtaatgataaaat

SEQ ID NO: 155905 - DNA, 16 bp, H. sapiens
tgtgtaatgatcaaat

SEQ ID NO: 155906 - DNA, 16 bp, H. sapiens
tgtgtacaagtgtgtg

SEQ ID NO: 155907 - DNA, 16 bp, H. sapiens
tgtgtacacacacgtg

SEQ ID NO: 155908 - DNA, 16 bp, H. sapiens
tgtgtacacacatgca

SEQ ID NO: 155909 - DNA, 16 bp, H. sapiens
tgtgtacagattattt

SEQ ID NO: 155910 - DNA, 16 bp, H. sapiens
tgtgtacagatttttg

SEQ ID NO: 155911 - DNA, 16 bp, H. sapiens
tgtgtacatatattta

SEQ ID NO: 155912 - DNA, 16 bp, H. sapiens
tgtgtacatatgtgtg

SEQ ID NO: 155913 - DNA, 16 bp, H. sapiens
tgtgtacatgcacaca

SEQ ID NO: 155914 - DNA, 16 bp, H. sapiens
tgtgtacatgtgtgca

SEQ ID NO: 155915 - DNA, 16 bp, H. sapiens
tgtgtacatgtgtttg

SEQ ID NO: 155916 - DNA, 16 bp, H. sapiens
tgtgtactttttaaaa

SEQ ID NO: 155917 - DNA, 16 bp, H. sapiens
tgtgtagaaatggggt

SEQ ID NO: 155918 - DNA, 17 bp, H. sapiens
tgtgtagaagtgttgga

SEQ ID NO: 155919 - DNA, 16 bp, H. sapiens
tgtgtagagacaggat

SEQ ID NO: 155920 - DNA, 16 bp, H. sapiens
tgtgtaggtctgtttc

SEQ ID NO: 155921 - DNA, 16 bp, H. sapiens
tgtgtataaagtatat

SEQ ID NO: 155922 - DNA, 16 bp, H. sapiens
tgtgtataaggtgtat

SEQ ID NO: 155923 - DNA, 16 bp, H. sapiens
tgtgtatacaaataca

SEQ ID NO: 155924 - DNA, 16 bp, H. sapiens
tgtgtatacacgcaca

SEQ ID NO: 155925 - DNA, 16 bp, H. sapiens
tgtgtatacatacata

SEQ ID NO: 155926 - DNA, 16 bp, H. sapiens
tgtgtatacatatata

SEQ ID NO: 155927 - DNA, 16 bp, H. sapiens
tgtgtatacatatgta

SEQ ID NO: 155928 - DNA, 16 bp, H. sapiens
tgtgtatataacatat

SEQ ID NO: 155929 - DNA, 16 bp, H. sapiens
tgtgtatataagtgtg

SEQ ID NO: 155930 - DNA, 16 bp, H. sapiens
tgtgtatatacacacg

SEQ ID NO: 155931 - DNA, 16 bp, H. sapiens
tgtgtatatacataaa

SEQ ID NO: 155932 - DNA, 16 bp, H. sapiens
tgtgtatatacatgca

SEQ ID NO: 155933 - DNA, 16 bp, H. sapiens
tgtgtatatataaata

SEQ ID NO: 155934 - DNA, 16 bp, H. sapiens
tgtgtatatatacatg

SEQ ID NO: 155935 - DNA, 16 bp, H. sapiens
tgtgtatatatagata

SEQ ID NO: 155936 - DNA, 16 bp, H. sapiens
tgtgtatatatataaa

SEQ ID NO: 155937 - DNA, 16 bp, H. sapiens
tgtgtatatatatacg

SEQ ID NO: 155938 - DNA, 16 bp, H. sapiens
tgtgtatatatatagt

SEQ ID NO: 155939 - DNA, 16 bp, H. sapiens
tgtgtatatatgaaaa

SEQ ID NO: 155940 - DNA, 16 bp, H. sapiens
tgtgtatatatgcata

SEQ ID NO: 155941 - DNA, 16 bp, H. sapiens
tgtgtatatatgtata

SEQ ID NO: 155942 - DNA, 16 bp, H. sapiens
tgtgtatatctatcta

SEQ ID NO: 155943 - DNA, 16 bp, H. sapiens
tgtgtatatgaatgtg

SEQ ID NO: 155944 - DNA, 16 bp, H. sapiens
tgtgtatatgggtgtg

SEQ ID NO: 155945 - DNA, 16 bp, H. sapiens
tgtgtatatgtataaa

SEQ ID NO: 155946 - DNA, 16 bp, H. sapiens
tgtgtatatgtgcaca

SEQ ID NO: 155947 - DNA, 16 bp, H. sapiens
tgtgtatatgtttata

SEQ ID NO: 155948 - DNA, 16 bp, H. sapiens
tgtgtatatttataaa

SEQ ID NO: 155949 - DNA, 16 bp, H. sapiens
tgtgtatatttatggg

SEQ ID NO: 155950 - DNA, 16 bp, H. sapiens
tgtgtatcactttcac

SEQ ID NO: 155951 - DNA, 16 bp, H. sapiens
tgtgtatccatgtgtg

SEQ ID NO: 155952 - DNA, 16 bp, H. sapiens
tgtgtatctatacata

SEQ ID NO: 155953 - DNA, 16 bp, H. sapiens
tgtgtatctgtgtatc

SEQ ID NO: 155954 - DNA, 16 bp, H. sapiens
tgtgtatctgtgtctg

SEQ ID NO: 155955 - DNA, 16 bp, H. sapiens
tgtgtatctgtgtgtg

SEQ ID NO: 155956 - DNA, 16 bp, H. sapiens
tgtgtatgaatgtgtg

SEQ ID NO: 155957 - DNA, 16 bp, H. sapiens
tgtgtatgactgtgtg

SEQ ID NO: 155958 - DNA, 16 bp, H. sapiens
tgtgtatgagtgtgtg

SEQ ID NO: 155959 - DNA, 16 bp, H. sapiens
tgtgtatgcatgtgtg

SEQ ID NO: 155960 - DNA, 16 bp, H. sapiens
tgtgtatgcctgtgtg

SEQ ID NO: 155961 - DNA, 16 bp, H. sapiens
tgtgtatgctgtgtgt

SEQ ID NO: 155962 - DNA, 16 bp, H. sapiens
tgtgtatgtaaatata

SEQ ID NO: 155963 - DNA, 16 bp, H. sapiens
tgtgtatgtacatata

SEQ ID NO: 155964 - DNA, 16 bp, H. sapiens
tgtgtatgtataaata

SEQ ID NO: 155965 - DNA, 16 bp, H. sapiens
tgtgtatgtatataaa

SEQ ID NO: 155966 - DNA, 16 bp, H. sapiens
tgtgtatgtatatatc

SEQ ID NO: 155967 - DNA, 16 bp, H. sapiens
tgtgtatgtatatatg

SEQ ID NO: 155968 - DNA, 16 bp, H. sapiens
tgtgtatgtatatgta

SEQ ID NO: 155969 - DNA, 16 bp, H. sapiens
tgtgtatgtatgtgta

SEQ ID NO: 155970 - DNA, 16 bp, H. sapiens
tgtgtatgtctgtgta

SEQ ID NO: 155971 - DNA, 16 bp, H. sapiens
tgtgtatgtctgtgtg

SEQ ID NO: 155972 - DNA, 16 bp, H. sapiens
tgtgtatgtgcacaca

SEQ ID NO: 155973 - DNA, 16 bp, H. sapiens
tgtgtatgtgcatatg

SEQ ID NO: 155974 - DNA, 16 bp, H. sapiens
tgtgtatgtgcatgtg

SEQ ID NO: 155975 - DNA, 16 bp, H. sapiens
tgtgtatgtgcctgtg

SEQ ID NO: 155976 - DNA, 16 bp, H. sapiens
tgtgtatgtgtatctg

SEQ ID NO: 155977 - DNA, 16 bp, H. sapiens
tgtgtatgtgtatgca

SEQ ID NO: 155978 - DNA, 16 bp, H. sapiens
tgtgtatgtgtattta

SEQ ID NO: 155979 - DNA, 16 bp, H. sapiens
tgtgtatgtgtgcata

SEQ ID NO: 155980 - DNA, 16 bp, H. sapiens
tgtgtatgtgtgcatt

SEQ ID NO: 155981 - DNA, 16 bp, H. sapiens
tgtgtatgtgtgcttg

SEQ ID NO: 155982 - DNA, 16 bp, H. sapiens
tgtgtatgtgtgtgta

SEQ ID NO: 155983 - DNA, 16 bp, H. sapiens
tgtgtatgttgagcca

SEQ ID NO: 155984 - DNA, 16 bp, H. sapiens
tgtgtatgtttataaa

SEQ ID NO: 155985 - DNA, 16 bp, H. sapiens
tgtgtatgtttataca

SEQ ID NO: 155986 - DNA, 16 bp, H. sapiens
tgtgtatgtttatgta

SEQ ID NO: 155987 - DNA, 16 bp, H. sapiens
tgtgtatgtttctgtg

SEQ ID NO: 155988 - DNA, 16 bp, H. sapiens
tgtgtatttatataca

SEQ ID NO: 155989 - DNA, 16 bp, H. sapiens
tgtgtatttatttact

SEQ ID NO: 155990 - DNA, 16 bp, H. sapiens
tgtgtatttcaaaata

SEQ ID NO: 155991 - DNA, 16 bp, H. sapiens
tgtgtatttctgaaaa

SEQ ID NO: 155992 - DNA, 16 bp, H. sapiens
tgtgtattttacactt

SEQ ID NO: 155993 - DNA, 16 bp, H. sapiens
tgtgtattttttaaag

SEQ ID NO: 155994 - DNA, 16 bp, H. sapiens
tgtgtcaaagaagaaa

SEQ ID NO: 155995 - DNA, 16 bp, H. sapiens
tgtgtcaagcactgtg

SEQ ID NO: 155996 - DNA, 16 bp, H. sapiens
tgtgtcacatagttct

SEQ ID NO: 155997 - DNA, 16 bp, H. sapiens
tgtgtcaccatgctca

SEQ ID NO: 155998 - DNA, 16 bp, H. sapiens
tgtgtcacccctcccc

SEQ ID NO: 155999 - DNA, 16 bp, H. sapiens
tgtgtcaccttgggca

SEQ ID NO: 156000 - DNA, 16 bp, H. sapiens
tgtgtcactccatccc

SEQ ID NO: 156001 - DNA, 16 bp, H. sapiens
tgtgtcagagagagaa

SEQ ID NO: 156002 - DNA, 16 bp, H. sapiens
tgtgtcaggcactctg

SEQ ID NO: 156003 - DNA, 18 bp, H. sapiens
tgtgtcataatcttattc

SEQ ID NO: 156004 - DNA, 16 bp, H. sapiens
tgtgtcatgggtgttt

SEQ ID NO: 156005 - DNA, 16 bp, H. sapiens
tgtgtcatgttggttt

SEQ ID NO: 156006 - DNA, 16 bp, H. sapiens
tgtgtccagaattggt

SEQ ID NO: 156007 - DNA, 16 bp, H. sapiens
tgtgtccagagttttt

SEQ ID NO: 156008 - DNA, 16 bp, H. sapiens
tgtgtccagggaggga

SEQ ID NO: 156009 - DNA, 16 bp, H. sapiens
tgtgtccatatatact

SEQ ID NO: 156010 - DNA, 16 bp, H. sapiens
tgtgtccatgtgctct

SEQ ID NO: 156011 - DNA, 18 bp, H. sapiens
tgtgtccatgtgttctca

SEQ ID NO: 156012 - DNA, 16 bp, H. sapiens
tgtgtccattgatctc

SEQ ID NO: 156013 - DNA, 16 bp, H. sapiens
tgtgtccccctcaaaa

SEQ ID NO: 156014 - DNA, 16 bp, H. sapiens
tgtgtcctctgcctgg

SEQ ID NO: 156015 - DNA, 16 bp, H. sapiens
tgtgtctacgtgtgtg

SEQ ID NO: 156016 - DNA, 21 bp, H. sapiens
tgtgtctagctcaaggtttgt

SEQ ID NO: 156017 - DNA, 31 bp, H. sapiens
tgtgtctagctcagggtttgtgaatgcacca

SEQ ID NO: 156018 - DNA, 16 bp, H. sapiens
tgtgtctatgaatttg

SEQ ID NO: 156019 - DNA, 16 bp, H. sapiens
tgtgtctatgtgtata

SEQ ID NO: 156020 - DNA, 16 bp, H. sapiens
tgtgtctatttgtttc

SEQ ID NO: 156021 - DNA, 16 bp, H. sapiens
tgtgtctcaaaaataa

SEQ ID NO: 156022 - DNA, 16 bp, H. sapiens
tgtgtctcagaaaatc

SEQ ID NO: 156023 - DNA, 16 bp, H. sapiens
tgtgtctcagtttctc

SEQ ID NO: 156024 - DNA, 16 bp, H. sapiens
tgtgtctccacccaag

SEQ ID NO: 156025 - DNA, 16 bp, H. sapiens
tgtgtctcccaaaatt

SEQ ID NO: 156026 - DNA, 16 bp, H. sapiens
tgtgtctccctaaaat

SEQ ID NO: 156027 - DNA, 16 bp, H. sapiens
tgtgtctctatttcct

SEQ ID NO: 156028 - DNA, 16 bp, H. sapiens
tgtgtctctctcctct

SEQ ID NO: 156029 - DNA, 16 bp, H. sapiens
tgtgtctctctctgtc

SEQ ID NO: 156030 - DNA, 16 bp, H. sapiens
tgtgtctctgtatgtg

SEQ ID NO: 156031 - DNA, 16 bp, H. sapiens
tgtgtctctgtctcct

SEQ ID NO: 156032 - DNA, 16 bp, H. sapiens
tgtgtctctgtctctc

SEQ ID NO: 156033 - DNA, 16 bp, H. sapiens
tgtgtctctgtctctt

SEQ ID NO: 156034 - DNA, 16 bp, H. sapiens
tgtgtctctgtgtgtg

SEQ ID NO: 156035 - DNA, 16 bp, H. sapiens
tgtgtctgaatgtgtg

SEQ ID NO: 156036 - DNA, 16 bp, H. sapiens
tgtgtctgagtgtgtg

SEQ ID NO: 156037 - DNA, 16 bp, H. sapiens
tgtgtctgatttgttt

SEQ ID NO: 156038 - DNA, 16 bp, H. sapiens
tgtgtctgcacccaaa

SEQ ID NO: 156039 - DNA, 16 bp, H. sapiens
tgtgtctgccaggctt

SEQ ID NO: 156040 - DNA, 16 bp, H. sapiens
tgtgtctggcctcttt

SEQ ID NO: 156041 - DNA, 16 bp, H. sapiens
tgtgtctggcttcctt

SEQ ID NO: 156042 - DNA, 16 bp, H. sapiens
tgtgtctgtatatgta

SEQ ID NO: 156043 - DNA, 16 bp, H. sapiens
tgtgtctgtctctgtg

SEQ ID NO: 156044 - DNA, 16 bp, H. sapiens
tgtgtctgtctgtctc

SEQ ID NO: 156045 - DNA, 16 bp, H. sapiens
tgtgtctgtctgtctg

SEQ ID NO: 156046 - DNA, 16 bp, H. sapiens
tgtgtctgtctttctc

SEQ ID NO: 156047 - DNA, 16 bp, H. sapiens
tgtgtctgtgatggtg

SEQ ID NO: 156048 - DNA, 16 bp, H. sapiens
tgtgtctgtgcatgtg

SEQ ID NO: 156049 - DNA, 16 bp, H. sapiens
tgtgtctgtgccaggc

SEQ ID NO: 156050 - DNA, 16 bp, H. sapiens
tgtgtctgtgcctgtg

SEQ ID NO: 156051 - DNA, 16 bp, H. sapiens
tgtgtctgtgtatata

SEQ ID NO: 156052 - DNA, 16 bp, H. sapiens
tgtgtctgtgtccaaa

SEQ ID NO: 156053 - DNA, 16 bp, H. sapiens
tgtgtctgtgtccttg

SEQ ID NO: 156054 - DNA, 16 bp, H. sapiens
tgtgtctgtgtctgtc

SEQ ID NO: 156055 - DNA, 16 bp, H. sapiens
tgtgtctgtgtctgtg

SEQ ID NO: 156056 - DNA, 16 bp, H. sapiens
tgtgtctgtgtgcata

SEQ ID NO: 156057 - DNA, 16 bp, H. sapiens
tgtgtctgtgtgtgcg

SEQ ID NO: 156058 - DNA, 16 bp, H. sapiens
tgtgtctgtgtgtgta

SEQ ID NO: 156059 - DNA, 16 bp, H. sapiens
tgtgtctgtgtgtgtc

SEQ ID NO: 156060 - DNA, 16 bp, H. sapiens
tgtgtctgtgttttat

SEQ ID NO: 156061 - DNA, 16 bp, H. sapiens
tgtgtctgtttctctg

SEQ ID NO: 156062 - DNA, 16 bp, H. sapiens
tgtgtctgtttgcaga

SEQ ID NO: 156063 - DNA, 16 bp, H. sapiens
tgtgtcttattcatct

SEQ ID NO: 156064 - DNA, 16 bp, H. sapiens
tgtgtcttcacatggt

SEQ ID NO: 156065 - DNA, 16 bp, H. sapiens
tgtgtcttcattttta

SEQ ID NO: 156066 - DNA, 16 bp, H. sapiens
tgtgtcttggtgtgga

SEQ ID NO: 156067 - DNA, 20 bp, H. sapiens
tgtgtctttaattcctctag

SEQ ID NO: 156068 - DNA, 16 bp, H. sapiens
tgtgtctttatagaat

SEQ ID NO: 156069 - DNA, 16 bp, H. sapiens
tgtgtctttataggag

SEQ ID NO: 156070 - DNA, 17 bp, H. sapiens
tgtgtctttatcataga

SEQ ID NO: 156071 - DNA, 17 bp, H. sapiens
tgtgtctttgcacgtga

SEQ ID NO: 156072 - DNA, 16 bp, H. sapiens
tgtgtctttgcatatg

SEQ ID NO: 156073 - DNA, 16 bp, H. sapiens
tgtgtcttttggctcc

SEQ ID NO: 156074 - DNA, 16 bp, H. sapiens
tgtgtgaaactgcttt

SEQ ID NO: 156075 - DNA, 16 bp, H. sapiens
tgtgtgaaataataaa

SEQ ID NO: 156076 - DNA, 16 bp, H. sapiens
tgtgtgaacatcacag

SEQ ID NO: 156077 - DNA, 16 bp, H. sapiens
tgtgtgaaggtgtgtg

SEQ ID NO: 156078 - DNA, 16 bp, H. sapiens
tgtgtgaatatgtgtg

SEQ ID NO: 156079 - DNA, 16 bp, H. sapiens
tgtgtgaatgtatgta

SEQ ID NO: 156080 - DNA, 16 bp, H. sapiens
tgtgtgaatgtgtatg

SEQ ID NO: 156081 - DNA, 16 bp, H. sapiens
tgtgtgacattggaca

SEQ ID NO: 156082 - DNA, 16 bp, H. sapiens
tgtgtgacccaagaca

SEQ ID NO: 156083 - DNA, 16 bp, H. sapiens
tgtgtgacccaggctg

SEQ ID NO: 156084 - DNA, 16 bp, H. sapiens
tgtgtgaccctaggca

SEQ ID NO: 156085 - DNA, 16 bp, H. sapiens
tgtgtgaccctggaca

SEQ ID NO: 156086 - DNA, 16 bp, H. sapiens
tgtgtgaccctgggta

SEQ ID NO: 156087 - DNA, 16 bp, H. sapiens
tgtgtgacctgggcaa

SEQ ID NO: 156088 - DNA, 16 bp, H. sapiens
tgtgtgaccttgagaa

SEQ ID NO: 156089 - DNA, 16 bp, H. sapiens
tgtgtgaccttgagca

SEQ ID NO: 156090 - DNA, 16 bp, H. sapiens
tgtgtgaccttgggaa

SEQ ID NO: 156091 - DNA, 16 bp, H. sapiens
tgtgtgaccttgggca

SEQ ID NO: 156092 - DNA, 16 bp, H. sapiens
tgtgtgactggcttat

SEQ ID NO: 156093 - DNA, 16 bp, H. sapiens
tgtgtgactgtgtgtg

SEQ ID NO: 156094 - DNA, 16 bp, H. sapiens
tgtgtgacttcaggca

SEQ ID NO: 156095 - DNA, 16 bp, H. sapiens
tgtgtgacttggggca

SEQ ID NO: 156096 - DNA, 16 bp, H. sapiens
tgtgtgactttgagca

SEQ ID NO: 156097 - DNA, 16 bp, H. sapiens
tgtgtgactttggaaa

SEQ ID NO: 156098 - DNA, 16 bp, H. sapiens
tgtgtgagagagagat

SEQ ID NO: 156099 - DNA, 16 bp, H. sapiens
tgtgtgagagagaggg

SEQ ID NO: 156100 - DNA, 16 bp, H. sapiens
tgtgtgagcagcaagg

SEQ ID NO: 156101 - DNA, 16 bp, H. sapiens
tgtgtgagcgtgtgtg

SEQ ID NO: 156102 - DNA, 16 bp, H. sapiens
tgtgtgaggtgtctgt

SEQ ID NO: 156103 - DNA, 16 bp, H. sapiens
tgtgtgagtgcatgtg

SEQ ID NO: 156104 - DNA, 16 bp, H. sapiens
tgtgtgagtgcgtgtg

SEQ ID NO: 156105 - DNA, 16 bp, H. sapiens
tgtgtgagtgtatgag

SEQ ID NO: 156106 - DNA, 16 bp, H. sapiens
tgtgtgagtgtatgta

SEQ ID NO: 156107 - DNA, 16 bp, H. sapiens
tgtgtgagtgtgtgta

SEQ ID NO: 156108 - DNA, 16 bp, H. sapiens
tgtgtgatcctgggca

SEQ ID NO: 156109 - DNA, 16 bp, H. sapiens
tgtgtgatctgattct

SEQ ID NO: 156110 - DNA, 16 bp, H. sapiens
tgtgtgatcttgggca

SEQ ID NO: 156111 - DNA, 16 bp, H. sapiens
tgtgtgatgtttatat

SEQ ID NO: 156112 - DNA, 16 bp, H. sapiens
tgtgtgatttggggca

SEQ ID NO: 156113 - DNA, 16 bp, H. sapiens
tgtgtgcacacatgca

SEQ ID NO: 156114 - DNA, 18 bp, H. sapiens
tgtgtgcacacgtgtgtg

SEQ ID NO: 156115 - DNA, 16 bp, H. sapiens
tgtgtgcacagacaca

SEQ ID NO: 156116 - DNA, 16 bp, H. sapiens
tgtgtgcacagaggaa

SEQ ID NO: 156117 - DNA, 16 bp, H. sapiens
tgtgtgcacatataca

SEQ ID NO: 156118 - DNA, 16 bp, H. sapiens
tgtgtgcacatatgtg

SEQ ID NO: 156119 - DNA, 16 bp, H. sapiens
tgtgtgcacatgtgtg

SEQ ID NO: 156120 - DNA, 16 bp, H. sapiens
tgtgtgcacccagctt

SEQ ID NO: 156121 - DNA, 16 bp, H. sapiens
tgtgtgcacgcacaca

SEQ ID NO: 156122 - DNA, 16 bp, H. sapiens
tgtgtgcacgcacatg

SEQ ID NO: 156123 - DNA, 16 bp, H. sapiens
tgtgtgcacgtgcatg

SEQ ID NO: 156124 - DNA, 16 bp, H. sapiens
tgtgtgcagaagctct

SEQ ID NO: 156125 - DNA, 16 bp, H. sapiens
tgtgtgcagggctggg

SEQ ID NO: 156126 - DNA, 16 bp, H. sapiens
tgtgtgcaggtatctt

SEQ ID NO: 156127 - DNA, 16 bp, H. sapiens
tgtgtgcaggtgtgtg

SEQ ID NO: 156128 - DNA, 16 bp, H. sapiens
tgtgtgcagtggctca

SEQ ID NO: 156129 - DNA, 16 bp, H. sapiens
tgtgtgcatacatatt

SEQ ID NO: 156130 - DNA, 16 bp, H. sapiens
tgtgtgcatacatctc

SEQ ID NO: 156131 - DNA, 16 bp, H. sapiens
tgtgtgcatctctgtg

SEQ ID NO: 156132 - DNA, 16 bp, H. sapiens
tgtgtgcatctgtgca

SEQ ID NO: 156133 - DNA, 16 bp, H. sapiens
tgtgtgcatgcataca

SEQ ID NO: 156134 - DNA, 16 bp, H. sapiens
tgtgtgcatgtatata

SEQ ID NO: 156135 - DNA, 16 bp, H. sapiens
tgtgtgcatgtgagca

SEQ ID NO: 156136 - DNA, 16 bp, H. sapiens
tgtgtgcatgtgggtg

SEQ ID NO: 156137 - DNA, 16 bp, H. sapiens
tgtgtgcatgtgtata

SEQ ID NO: 156138 - DNA, 16 bp, H. sapiens
tgtgtgcatgtgtgca

SEQ ID NO: 156139 - DNA, 16 bp, H. sapiens
tgtgtgcatgtgtgta

SEQ ID NO: 156140 - DNA, 16 bp, H. sapiens
tgtgtgcatgtgtgtc

SEQ ID NO: 156141 - DNA, 16 bp, H. sapiens
tgtgtgcatgtgtgtg

SEQ ID NO: 156142 - DNA, 16 bp, H. sapiens
tgtgtgcatgtgttgg

SEQ ID NO: 156143 - DNA, 16 bp, H. sapiens
tgtgtgcatttatttt

SEQ ID NO: 156144 - DNA, 16 bp, H. sapiens
tgtgtgcatttgcatg

SEQ ID NO: 156145 - DNA, 16 bp, H. sapiens
tgtgtgccaagccctg

SEQ ID NO: 156146 - DNA, 17 bp, H. sapiens
tgtgtgccaccatgcct

SEQ ID NO: 156147 - DNA, 16 bp, H. sapiens
tgtgtgccaggccctg

SEQ ID NO: 156148 - DNA, 16 bp, H. sapiens
tgtgtgccaggctctg

SEQ ID NO: 156149 - DNA, 16 bp, H. sapiens
tgtgtgccatcatgcc

SEQ ID NO: 156150 - DNA, 16 bp, H. sapiens
tgtgtgcccagccctg

SEQ ID NO: 156151 - DNA, 16 bp, H. sapiens
tgtgtgcccaggctgg

SEQ ID NO: 156152 - DNA, 16 bp, H. sapiens
tgtgtgcccatgtgtg

SEQ ID NO: 156153 - DNA, 16 bp, H. sapiens
tgtgtgccctttttac

SEQ ID NO: 156154 - DNA, 16 bp, H. sapiens
tgtgtgcctgggtgtg

SEQ ID NO: 156155 - DNA, 16 bp, H. sapiens
tgtgtgcctgtgcctg

SEQ ID NO: 156156 - DNA, 16 bp, H. sapiens
tgtgtgcctgtgtgct

SEQ ID NO: 156157 - DNA, 16 bp, H. sapiens
tgtgtgcctgtgtgta

SEQ ID NO: 156158 - DNA, 16 bp, H. sapiens
tgtgtgcctgtgtgtg

SEQ ID NO: 156159 - DNA, 17 bp, H. sapiens
tgtgtgcgtgcacgtgt

SEQ ID NO: 156160 - DNA, 16 bp, H. sapiens
tgtgtgcgtgtatata

SEQ ID NO: 156161 - DNA, 16 bp, H. sapiens
tgtgtgcgtgtgcaca

SEQ ID NO: 156162 - DNA, 16 bp, H. sapiens
tgtgtgcgtgtgtata

SEQ ID NO: 156163 - DNA, 16 bp, H. sapiens
tgtgtgctctgtgtgt

SEQ ID NO: 156164 - DNA, 16 bp, H. sapiens
tgtgtgctgggcacag

SEQ ID NO: 156165 - DNA, 16 bp, H. sapiens
tgtgtgctgggcccag

SEQ ID NO: 156166 - DNA, 16 bp, H. sapiens
tgtgtgctgggctctg

SEQ ID NO: 156167 - DNA, 16 bp, H. sapiens
tgtgtgctgggggagg

SEQ ID NO: 156168 - DNA, 16 bp, H. sapiens
tgtgtgctgtgctgtg

SEQ ID NO: 156169 - DNA, 16 bp, H. sapiens
tgtgtgctgtgtgtgc

SEQ ID NO: 156170 - DNA, 16 bp, H. sapiens
tgtgtggaataccatg

SEQ ID NO: 156171 - DNA, 16 bp, H. sapiens
tgtgtggacatctcat

SEQ ID NO: 156172 - DNA, 16 bp, H. sapiens
tgtgtggagactcaca

SEQ ID NO: 156173 - DNA, 16 bp, H. sapiens
tgtgtggatctgtttc

SEQ ID NO: 156174 - DNA, 16 bp, H. sapiens
tgtgtggcacctccca

SEQ ID NO: 156175 - DNA, 16 bp, H. sapiens
tgtgtggcacctcccc

SEQ ID NO: 156176 - DNA, 16 bp, H. sapiens
tgtgtggccctgtgtg

SEQ ID NO: 156177 - DNA, 16 bp, H. sapiens
tgtgtggccttatttt

SEQ ID NO: 156178 - DNA, 16 bp, H. sapiens
tgtgtggccttggaaa

SEQ ID NO: 156179 - DNA, 16 bp, H. sapiens
tgtgtggccttggcca

SEQ ID NO: 156180 - DNA, 16 bp, H. sapiens
tgtgtggctttggaca

SEQ ID NO: 156181 - DNA, 16 bp, H. sapiens
tgtgtggtgactgtgg

SEQ ID NO: 156182 - DNA, 16 bp, H. sapiens
tgtgtggtggcaggtg

SEQ ID NO: 156183 - DNA, 16 bp, H. sapiens
tgtgtggtgggggcag

SEQ ID NO: 156184 - DNA, 16 bp, H. sapiens
tgtgtggtggtgtgca

SEQ ID NO: 156185 - DNA, 17 bp, H. sapiens
tgtgtggttatctaagt

SEQ ID NO: 156186 - DNA, 16 bp, H. sapiens
tgtgtggttttgaatg

SEQ ID NO: 156187 - DNA, 16 bp, H. sapiens
tgtgtgtaaaatattt

SEQ ID NO: 156188 - DNA, 16 bp, H. sapiens
tgtgtgtaaagcactt

SEQ ID NO: 156189 - DNA, 16 bp, H. sapiens
tgtgtgtaaatatata

SEQ ID NO: 156190 - DNA, 16 bp, H. sapiens
tgtgtgtaaatgtgtg

SEQ ID NO: 156191 - DNA, 16 bp, H. sapiens
tgtgtgtaatgtgtgt

SEQ ID NO: 156192 - DNA, 16 bp, H. sapiens
tgtgtgtacacacaca

SEQ ID NO: 156193 - DNA, 16 bp, H. sapiens
tgtgtgtacacacatg

SEQ ID NO: 156194 - DNA, 16 bp, H. sapiens
tgtgtgtacacatgtg

SEQ ID NO: 156195 - DNA, 16 bp, H. sapiens
tgtgtgtacagtgtgt

SEQ ID NO: 156196 - DNA, 16 bp, H. sapiens
tgtgtgtacatatata

SEQ ID NO: 156197 - DNA, 16 bp, H. sapiens
tgtgtgtacatatgtg

SEQ ID NO: 156198 - DNA, 16 bp, H. sapiens
tgtgtgtacatgtaca

SEQ ID NO: 156199 - DNA, 16 bp, H. sapiens
tgtgtgtacatgtctg

SEQ ID NO: 156200 - DNA, 16 bp, H. sapiens
tgtgtgtacctgtgtg

SEQ ID NO: 156201 - DNA, 16 bp, H. sapiens
tgtgtgtacgcgtgtg

SEQ ID NO: 156202 - DNA, 16 bp, H. sapiens
tgtgtgtaggtgtgag

SEQ ID NO: 156203 - DNA, 16 bp, H. sapiens
tgtgtgtataaaacaa

SEQ ID NO: 156204 - DNA, 16 bp, H. sapiens
tgtgtgtataaaataa

SEQ ID NO: 156205 - DNA, 16 bp, H. sapiens
tgtgtgtataaatgtg

SEQ ID NO: 156206 - DNA, 17 bp, H. sapiens
tgtgtgtatacacacac

SEQ ID NO: 156207 - DNA, 16 bp, H. sapiens
tgtgtgtatacataca

SEQ ID NO: 156208 - DNA, 16 bp, H. sapiens
tgtgtgtatatacata

SEQ ID NO: 156209 - DNA, 16 bp, H. sapiens
tgtgtgtatatataat

SEQ ID NO: 156210 - DNA, 16 bp, H. sapiens
tgtgtgtatatatata

SEQ ID NO: 156211 - DNA, 20 bp, H. sapiens
tgtgtgtatatatatatgta

SEQ ID NO: 156212 - DNA, 16 bp, H. sapiens
tgtgtgtatatatatt

SEQ ID NO: 156213 - DNA, 16 bp, H. sapiens
tgtgtgtatatctgta

SEQ ID NO: 156214 - DNA, 16 bp, H. sapiens
tgtgtgtatatgtaca

SEQ ID NO: 156215 - DNA, 16 bp, H. sapiens
tgtgtgtatatgtatt

SEQ ID NO: 156216 - DNA, 16 bp, H. sapiens
tgtgtgtatatgtgtg

SEQ ID NO: 156217 - DNA, 16 bp, H. sapiens
tgtgtgtatctttata

SEQ ID NO: 156218 - DNA, 16 bp, H. sapiens
tgtgtgtatgagagtg

SEQ ID NO: 156219 - DNA, 16 bp, H. sapiens
tgtgtgtatgatatat

SEQ ID NO: 156220 - DNA, 16 bp, H. sapiens
tgtgtgtatgcacatg

SEQ ID NO: 156221 - DNA, 16 bp, H. sapiens
tgtgtgtatgcatctg

SEQ ID NO: 156222 - DNA, 16 bp, H. sapiens
tgtgtgtatgcattta

SEQ ID NO: 156223 - DNA, 16 bp, H. sapiens
tgtgtgtatgtaatat

SEQ ID NO: 156224 - DNA, 16 bp, H. sapiens
tgtgtgtatgtacata

SEQ ID NO: 156225 - DNA, 16 bp, H. sapiens
tgtgtgtatgtacatt

SEQ ID NO: 156226 - DNA, 16 bp, H. sapiens
tgtgtgtatgtagata

SEQ ID NO: 156227 - DNA, 16 bp, H. sapiens
tgtgtgtatgtataac

SEQ ID NO: 156228 - DNA, 16 bp, H. sapiens
tgtgtgtatgtatata

SEQ ID NO: 156229 - DNA, 16 bp, H. sapiens
tgtgtgtatgtctatg

SEQ ID NO: 156230 - DNA, 16 bp, H. sapiens
tgtgtgtatgtgacag

SEQ ID NO: 156231 - DNA, 16 bp, H. sapiens
tgtgtgtatgtgcatg

SEQ ID NO: 156232 - DNA, 16 bp, H. sapiens
tgtgtgtatgtgtaag

SEQ ID NO: 156233 - DNA, 16 bp, H. sapiens
tgtgtgtatgtgtata

SEQ ID NO: 156234 - DNA, 16 bp, H. sapiens
tgtgtgtatgtgtctt

SEQ ID NO: 156235 - DNA, 16 bp, H. sapiens
tgtgtgtatgtgtgaa

SEQ ID NO: 156236 - DNA, 16 bp, H. sapiens
tgtgtgtatgtgtgta

SEQ ID NO: 156237 - DNA, 16 bp, H. sapiens
tgtgtgtattagtctg

SEQ ID NO: 156238 - DNA, 16 bp, H. sapiens
tgtgtgtattatgtat

SEQ ID NO: 156239 - DNA, 16 bp, H. sapiens
tgtgtgtatttgtata

SEQ ID NO: 156240 - DNA, 16 bp, H. sapiens
tgtgtgtattttaaat

SEQ ID NO: 156241 - DNA, 16 bp, H. sapiens
tgtgtgtattttaagt

SEQ ID NO: 156242 - DNA, 16 bp, H. sapiens
tgtgtgtcaccacgcc

SEQ ID NO: 156243 - DNA, 16 bp, H. sapiens
tgtgtgtccacgtgtg

SEQ ID NO: 156244 - DNA, 16 bp, H. sapiens
tgtgtgtccagctgct

SEQ ID NO: 156245 - DNA, 16 bp, H. sapiens
tgtgtgtccaggaatt

SEQ ID NO: 156246 - DNA, 16 bp, H. sapiens
tgtgtgtccctgtgtg

SEQ ID NO: 156247 - DNA, 16 bp, H. sapiens
tgtgtgtctatgtgta

SEQ ID NO: 156248 - DNA, 16 bp, H. sapiens
tgtgtgtctctatctc

SEQ ID NO: 156249 - DNA, 18 bp, H. sapiens
tgtgtgtctctgcatgtg

SEQ ID NO: 156250 - DNA, 16 bp, H. sapiens
tgtgtgtctgagtgtg

SEQ ID NO: 156251 - DNA, 16 bp, H. sapiens
tgtgtgtctgctttta

SEQ ID NO: 156252 - DNA, 16 bp, H. sapiens
tgtgtgtctggcttat

SEQ ID NO: 156253 - DNA, 16 bp, H. sapiens
tgtgtgtctgtatttt

SEQ ID NO: 156254 - DNA, 16 bp, H. sapiens
tgtgtgtctgtctctg

SEQ ID NO: 156255 - DNA, 16 bp, H. sapiens
tgtgtgtctgtgtcat

SEQ ID NO: 156256 - DNA, 16 bp, H. sapiens
tgtgtgtctgtgtctg

SEQ ID NO: 156257 - DNA, 16 bp, H. sapiens
tgtgtgtctgtgtgtc

SEQ ID NO: 156258 - DNA, 16 bp, H. sapiens
tgtgtgtctgttttta

SEQ ID NO: 156259 - DNA, 16 bp, H. sapiens
tgtgtgtctttgcaca

SEQ ID NO: 156260 - DNA, 16 bp, H. sapiens
tgtgtgtgaatatatt

SEQ ID NO: 156261 - DNA, 16 bp, H. sapiens
tgtgtgtgaatatgtg

SEQ ID NO: 156262 - DNA, 16 bp, H. sapiens
tgtgtgtgaccaggac

SEQ ID NO: 156263 - DNA, 16 bp, H. sapiens
tgtgtgtgagacagag

SEQ ID NO: 156264 - DNA, 16 bp, H. sapiens
tgtgtgtgagcacatg

SEQ ID NO: 156265 - DNA, 16 bp, H. sapiens
tgtgtgtgagggagag

SEQ ID NO: 156266 - DNA, 16 bp, H. sapiens
tgtgtgtgagtgagag

SEQ ID NO: 156267 - DNA, 16 bp, H. sapiens
tgtgtgtgagtgagtg

SEQ ID NO: 156268 - DNA, 16 bp, H. sapiens
tgtgtgtgagtgtgag

SEQ ID NO: 156269 - DNA, 16 bp, H. sapiens
tgtgtgtgcacacaca

SEQ ID NO: 156270 - DNA, 16 bp, H. sapiens
tgtgtgtgcacacgtg

SEQ ID NO: 156271 - DNA, 16 bp, H. sapiens
tgtgtgtgcacatgca

SEQ ID NO: 156272 - DNA, 16 bp, H. sapiens
tgtgtgtgcacatgtg

SEQ ID NO: 156273 - DNA, 16 bp, H. sapiens
tgtgtgtgcacgcgtg

SEQ ID NO: 156274 - DNA, 16 bp, H. sapiens
tgtgtgtgcacgtgca

SEQ ID NO: 156275 - DNA, 16 bp, H. sapiens
tgtgtgtgcacttgta

SEQ ID NO: 156276 - DNA, 16 bp, H. sapiens
tgtgtgtgcatacatg

SEQ ID NO: 156277 - DNA, 16 bp, H. sapiens
tgtgtgtgcatatgag

SEQ ID NO: 156278 - DNA, 16 bp, H. sapiens
tgtgtgtgcatatgca

SEQ ID NO: 156279 - DNA, 16 bp, H. sapiens
tgtgtgtgcatatgtg

SEQ ID NO: 156280 - DNA, 16 bp, H. sapiens
tgtgtgtgcatatttt

SEQ ID NO: 156281 - DNA, 16 bp, H. sapiens
tgtgtgtgcatgagtg

SEQ ID NO: 156282 - DNA, 16 bp, H. sapiens
tgtgtgtgcatgcaca

SEQ ID NO: 156283 - DNA, 16 bp, H. sapiens
tgtgtgtgcatgcctg

SEQ ID NO: 156284 - DNA, 16 bp, H. sapiens
tgtgtgtgcatgtctg

SEQ ID NO: 156285 - DNA, 16 bp, H. sapiens
tgtgtgtgcatgtgtt

SEQ ID NO: 156286 - DNA, 16 bp, H. sapiens
tgtgtgtgcatgttgg

SEQ ID NO: 156287 - DNA, 16 bp, H. sapiens
tgtgtgtgcattttaa

SEQ ID NO: 156288 - DNA, 16 bp, H. sapiens
tgtgtgtgcccgtgtg

SEQ ID NO: 156289 - DNA, 16 bp, H. sapiens
tgtgtgtgcctgtagt

SEQ ID NO: 156290 - DNA, 16 bp, H. sapiens
tgtgtgtgcgcgcgca

SEQ ID NO: 156291 - DNA, 16 bp, H. sapiens
tgtgtgtgcgcgtgtg

SEQ ID NO: 156292 - DNA, 16 bp, H. sapiens
tgtgtgtgcgtgcacg

SEQ ID NO: 156293 - DNA, 17 bp, H. sapiens
tgtgtgtgcgtgcgtgt

SEQ ID NO: 156294 - DNA, 16 bp, H. sapiens
tgtgtgtgcgtgtgta

SEQ ID NO: 156295 - DNA, 16 bp, H. sapiens
tgtgtgtggatatgtg

SEQ ID NO: 156296 - DNA, 16 bp, H. sapiens
tgtgtgtggcatgtgt

SEQ ID NO: 156297 - DNA, 16 bp, H. sapiens
tgtgtgtgggagagag

SEQ ID NO: 156298 - DNA, 16 bp, H. sapiens
tgtgtgtggtgtgcat

SEQ ID NO: 156299 - DNA, 16 bp, H. sapiens
tgtgtgtgtaaatata

SEQ ID NO: 156300 - DNA, 16 bp, H. sapiens
tgtgtgtgtaatctcc

SEQ ID NO: 156301 - DNA, 16 bp, H. sapiens
tgtgtgtgtacatata

SEQ ID NO: 156302 - DNA, 16 bp, H. sapiens
tgtgtgtgtacctgtg

SEQ ID NO: 156303 - DNA, 16 bp, H. sapiens
tgtgtgtgtagacagg

SEQ ID NO: 156304 - DNA, 16 bp, H. sapiens
tgtgtgtgtagcatgt

SEQ ID NO: 156305 - DNA, 16 bp, H. sapiens
tgtgtgtgtagtgaga

SEQ ID NO: 156306 - DNA, 16 bp, H. sapiens
tgtgtgtgtatacata

SEQ ID NO: 156307 - DNA, 16 bp, H. sapiens
tgtgtgtgtatagaga

SEQ ID NO: 156308 - DNA, 16 bp, H. sapiens
tgtgtgtgtatatagt

SEQ ID NO: 156309 - DNA, 16 bp, H. sapiens
tgtgtgtgtatcctat

SEQ ID NO: 156310 - DNA, 16 bp, H. sapiens
tgtgtgtgtatctctg

SEQ ID NO: 156311 - DNA, 16 bp, H. sapiens
tgtgtgtgtatctgaa

SEQ ID NO: 156312 - DNA, 16 bp, H. sapiens
tgtgtgtgtatctgta

SEQ ID NO: 156313 - DNA, 16 bp, H. sapiens
tgtgtgtgtatctgtc

SEQ ID NO: 156314 - DNA, 16 bp, H. sapiens
tgtgtgtgtatcttca

SEQ ID NO: 156315 - DNA, 16 bp, H. sapiens
tgtgtgtgtatgcata

SEQ ID NO: 156316 - DNA, 16 bp, H. sapiens
tgtgtgtgtatgcatg

SEQ ID NO: 156317 - DNA, 16 bp, H. sapiens
tgtgtgtgtatgtatg

SEQ ID NO: 156318 - DNA, 16 bp, H. sapiens
tgtgtgtgtatgtgct

SEQ ID NO: 156319 - DNA, 16 bp, H. sapiens
tgtgtgtgtatgtgta

SEQ ID NO: 156320 - DNA, 16 bp, H. sapiens
tgtgtgtgtatttcaa

SEQ ID NO: 156321 - DNA, 16 bp, H. sapiens
tgtgtgtgtatttctg

SEQ ID NO: 156322 - DNA, 16 bp, H. sapiens
tgtgtgtgtatttgag

SEQ ID NO: 156323 - DNA, 16 bp, H. sapiens
tgtgtgtgtcagagaa

SEQ ID NO: 156324 - DNA, 16 bp, H. sapiens
tgtgtgtgtccaggaa

SEQ ID NO: 156325 - DNA, 16 bp, H. sapiens
tgtgtgtgtccatgtc

SEQ ID NO: 156326 - DNA, 16 bp, H. sapiens
tgtgtgtgtccctgtg

SEQ ID NO: 156327 - DNA, 16 bp, H. sapiens
tgtgtgtgtcctcttc

SEQ ID NO: 156328 - DNA, 16 bp, H. sapiens
tgtgtgtgtctacaca

SEQ ID NO: 156329 - DNA, 16 bp, H. sapiens
tgtgtgtgtctatgag

SEQ ID NO: 156330 - DNA, 16 bp, H. sapiens
tgtgtgtgtctctatc

SEQ ID NO: 156331 - DNA, 16 bp, H. sapiens
tgtgtgtgtctgagtg

SEQ ID NO: 156332 - DNA, 16 bp, H. sapiens
tgtgtgtgtctggctg

SEQ ID NO: 156333 - DNA, 16 bp, H. sapiens
tgtgtgtgtctgtaaa

SEQ ID NO: 156334 - DNA, 16 bp, H. sapiens
tgtgtgtgtctgtata

SEQ ID NO: 156335 - DNA, 16 bp, H. sapiens
tgtgtgtgtctgtgta

SEQ ID NO: 156336 - DNA, 16 bp, H. sapiens
tgtgtgtgtctttaaa

SEQ ID NO: 156337 - DNA, 16 bp, H. sapiens
tgtgtgtgtgaaaaag

SEQ ID NO: 156338 - DNA, 16 bp, H. sapiens
tgtgtgtgtgaaataa

SEQ ID NO: 156339 - DNA, 16 bp, H. sapiens
tgtgtgtgtgaaatgg

SEQ ID NO: 156340 - DNA, 16 bp, H. sapiens
tgtgtgtgtgaagtgt

SEQ ID NO: 156341 - DNA, 16 bp, H. sapiens
tgtgtgtgtgaattat

SEQ ID NO: 156342 - DNA, 16 bp, H. sapiens
tgtgtgtgtgacagtg

SEQ ID NO: 156343 - DNA, 16 bp, H. sapiens
tgtgtgtgtgaccagg

SEQ ID NO: 156344 - DNA, 16 bp, H. sapiens
tgtgtgtgtgagaagg

SEQ ID NO: 156345 - DNA, 16 bp, H. sapiens
tgtgtgtgtgagagga

SEQ ID NO: 156346 - DNA, 16 bp, H. sapiens
tgtgtgtgtgagtgaa

SEQ ID NO: 156347 - DNA, 16 bp, H. sapiens
tgtgtgtgtgagtgag

SEQ ID NO: 156348 - DNA, 16 bp, H. sapiens
tgtgtgtgtgagtgta

SEQ ID NO: 156349 - DNA, 16 bp, H. sapiens
tgtgtgtgtgatctgt

SEQ ID NO: 156350 - DNA, 16 bp, H. sapiens
tgtgtgtgtgatggag

SEQ ID NO: 156351 - DNA, 16 bp, H. sapiens
tgtgtgtgtgcacaca

SEQ ID NO: 156352 - DNA, 16 bp, H. sapiens
tgtgtgtgtgcacata

SEQ ID NO: 156353 - DNA, 16 bp, H. sapiens
tgtgtgtgtgcacatg

SEQ ID NO: 156354 - DNA, 16 bp, H. sapiens
tgtgtgtgtgcagata

SEQ ID NO: 156355 - DNA, 16 bp, H. sapiens
tgtgtgtgtgcatata

SEQ ID NO: 156356 - DNA, 17 bp, H. sapiens
tgtgtgtgtgcatgcac

SEQ ID NO: 156357 - DNA, 16 bp, H. sapiens
tgtgtgtgtgcatgcc

SEQ ID NO: 156358 - DNA, 16 bp, H. sapiens
tgtgtgtgtgcatgcg

SEQ ID NO: 156359 - DNA, 16 bp, H. sapiens
tgtgtgtgtgcatggt

SEQ ID NO: 156360 - DNA, 16 bp, H. sapiens
tgtgtgtgtgcatgta

SEQ ID NO: 156361 - DNA, 16 bp, H. sapiens
tgtgtgtgtgcgcacg

SEQ ID NO: 156362 - DNA, 16 bp, H. sapiens
tgtgtgtgtgcgcatg

SEQ ID NO: 156363 - DNA, 16 bp, H. sapiens
tgtgtgtgtgcgcgtg

SEQ ID NO: 156364 - DNA, 17 bp, H. sapiens
tgtgtgtgtgcgcttgt

SEQ ID NO: 156365 - DNA, 16 bp, H. sapiens
tgtgtgtgtgcgtgca

SEQ ID NO: 156366 - DNA, 16 bp, H. sapiens
tgtgtgtgtgcgtgcg

SEQ ID NO: 156367 - DNA, 16 bp, H. sapiens
tgtgtgtgtgcgtgta

SEQ ID NO: 156368 - DNA, 16 bp, H. sapiens
tgtgtgtgtgctcaca

SEQ ID NO: 156369 - DNA, 16 bp, H. sapiens
tgtgtgtgtggagatg

SEQ ID NO: 156370 - DNA, 16 bp, H. sapiens
tgtgtgtgtggcagga

SEQ ID NO: 156371 - DNA, 16 bp, H. sapiens
tgtgtgtgtgggtgca

SEQ ID NO: 156372 - DNA, 16 bp, H. sapiens
tgtgtgtgtgtaaaca

SEQ ID NO: 156373 - DNA, 16 bp, H. sapiens
tgtgtgtgtgtaatgg

SEQ ID NO: 156374 - DNA, 16 bp, H. sapiens
tgtgtgtgtgtacatg

SEQ ID NO: 156375 - DNA, 16 bp, H. sapiens
tgtgtgtgtgtaggat

SEQ ID NO: 156376 - DNA, 16 bp, H. sapiens
tgtgtgtgtgtatcac

SEQ ID NO: 156377 - DNA, 16 bp, H. sapiens
tgtgtgtgtgtatctg

SEQ ID NO: 156378 - DNA, 16 bp, H. sapiens
tgtgtgtgtgtatgac

SEQ ID NO: 156379 - DNA, 16 bp, H. sapiens
tgtgtgtgtgtatgat

SEQ ID NO: 156380 - DNA, 16 bp, H. sapiens
tgtgtgtgtgtattct

SEQ ID NO: 156381 - DNA, 16 bp, H. sapiens
tgtgtgtgtgtctaat

SEQ ID NO: 156382 - DNA, 16 bp, H. sapiens
tgtgtgtgtgtctcat

SEQ ID NO: 156383 - DNA, 16 bp, H. sapiens
tgtgtgtgtgtctctc

SEQ ID NO: 156384 - DNA, 16 bp, H. sapiens
tgtgtgtgtgtctgtc

SEQ ID NO: 156385 - DNA, 16 bp, H. sapiens
tgtgtgtgtgtcttgc

SEQ ID NO: 156386 - DNA, 16 bp, H. sapiens
tgtgtgtgtgtcttta

SEQ ID NO: 156387 - DNA, 16 bp, H. sapiens
tgtgtgtgtgtgaata

SEQ ID NO: 156388 - DNA, 16 bp, H. sapiens
tgtgtgtgtgtgaatc

SEQ ID NO: 156389 - DNA, 16 bp, H. sapiens
tgtgtgtgtgtgagat

SEQ ID NO: 156390 - DNA, 16 bp, H. sapiens
tgtgtgtgtgtgagta

SEQ ID NO: 156391 - DNA, 16 bp, H. sapiens
tgtgtgtgtgtgcagt

SEQ ID NO: 156392 - DNA, 16 bp, H. sapiens
tgtgtgtgtgtgcata

SEQ ID NO: 156393 - DNA, 16 bp, H. sapiens
tgtgtgtgtgtgccca

SEQ ID NO: 156394 - DNA, 16 bp, H. sapiens
tgtgtgtgtgtgcctg

SEQ ID NO: 156395 - DNA, 16 bp, H. sapiens
tgtgtgtgtgtgctca

SEQ ID NO: 156396 - DNA, 16 bp, H. sapiens
tgtgtgtgtgtggtac

SEQ ID NO: 156397 - DNA, 17 bp, H. sapiens
tgtgtgtgtgtgtaaaa

SEQ ID NO: 156398 - DNA, 17 bp, H. sapiens
tgtgtgtgtgtgtatcc

SEQ ID NO: 156399 - DNA, 17 bp, H. sapiens
tgtgtgtgtgtgtgcac

SEQ ID NO: 156400 - DNA, 16 bp, H. sapiens
tgtgtgtgtgtgttaa

SEQ ID NO: 156401 - DNA, 16 bp, H. sapiens
tgtgtgtgtgtgttca

SEQ ID NO: 156402 - DNA, 16 bp, H. sapiens
tgtgtgtgtgttaagt

SEQ ID NO: 156403 - DNA, 16 bp, H. sapiens
tgtgtgtgtgttgaaa

SEQ ID NO: 156404 - DNA, 16 bp, H. sapiens
tgtgtgtgtgttgcag

SEQ ID NO: 156405 - DNA, 16 bp, H. sapiens
tgtgtgtgtgtttaaa

SEQ ID NO: 156406 - DNA, 16 bp, H. sapiens
tgtgtgtgttgcaggg

SEQ ID NO: 156407 - DNA, 16 bp, H. sapiens
tgtgtgtgtttacaca

SEQ ID NO: 156408 - DNA, 16 bp, H. sapiens
tgtgtgtgtttacagt

SEQ ID NO: 156409 - DNA, 16 bp, H. sapiens
tgtgtgtgtttatgtc

SEQ ID NO: 156410 - DNA, 16 bp, H. sapiens
tgtgtgtgtttctgaa

SEQ ID NO: 156411 - DNA, 16 bp, H. sapiens
tgtgtgtgtttgcata

SEQ ID NO: 156412 - DNA, 16 bp, H. sapiens
tgtgtgtgttttaaaa

SEQ ID NO: 156413 - DNA, 16 bp, H. sapiens
tgtgtgtgttttacta

SEQ ID NO: 156414 - DNA, 16 bp, H. sapiens
tgtgtgtgttttccac

SEQ ID NO: 156415 - DNA, 16 bp, H. sapiens
tgtgtgtgtttttact

SEQ ID NO: 156416 - DNA, 16 bp, H. sapiens
tgtgtgttcactggaa

SEQ ID NO: 156417 - DNA, 16 bp, H. sapiens
tgtgtgttgaatgaat

SEQ ID NO: 156418 - DNA, 16 bp, H. sapiens
tgtgtgttttaataga

SEQ ID NO: 156419 - DNA, 16 bp, H. sapiens
tgtgtgttttataaaa

SEQ ID NO: 156420 - DNA, 16 bp, H. sapiens
tgtgtgttttcaagag

SEQ ID NO: 156421 - DNA, 16 bp, H. sapiens
tgtgtgttttggaaaa

SEQ ID NO: 156422 - DNA, 16 bp, H. sapiens
tgtgtgtttttcccct

SEQ ID NO: 156423 - DNA, 16 bp, H. sapiens
tgtgttaaaaagaaaa

SEQ ID NO: 156424 - DNA, 21 bp, H. sapiens
tgtgttaactcacatgcagta

SEQ ID NO: 156425 - DNA, 16 bp, H. sapiens
tgtgttaatttacatt

SEQ ID NO: 156426 - DNA, 16 bp, H. sapiens
tgtgttacagttgcct

SEQ ID NO: 156427 - DNA, 16 bp, H. sapiens
tgtgttacccaggatg

SEQ ID NO: 156428 - DNA, 16 bp, H. sapiens
tgtgttagggttctct

SEQ ID NO: 156429 - DNA, 16 bp, H. sapiens
tgtgttagtttcctaa

SEQ ID NO: 156430 - DNA, 16 bp, H. sapiens
tgtgttagtttgctaa

SEQ ID NO: 156431 - DNA, 16 bp, H. sapiens
tgtgttagtttgctga

SEQ ID NO: 156432 - DNA, 16 bp, H. sapiens
tgtgttagtttgctta

SEQ ID NO: 156433 - DNA, 16 bp, H. sapiens
tgtgttatccaggctg

SEQ ID NO: 156434 - DNA, 16 bp, H. sapiens
tgtgttattgcccctg

SEQ ID NO: 156435 - DNA, 16 bp, H. sapiens
tgtgttatttcattta

SEQ ID NO: 156436 - DNA, 16 bp, H. sapiens
tgtgttcaaggagaaa

SEQ ID NO: 156437 - DNA, 16 bp, H. sapiens
tgtgttcacatgtgtg

SEQ ID NO: 156438 - DNA, 16 bp, H. sapiens
tgtgttcacatttttt

SEQ ID NO: 156439 - DNA, 16 bp, H. sapiens
tgtgttcagctctctg

SEQ ID NO: 156440 - DNA, 16 bp, H. sapiens
tgtgttcataaattct

SEQ ID NO: 156441 - DNA, 16 bp, H. sapiens
tgtgttcattgcagca

SEQ ID NO: 156442 - DNA, 16 bp, H. sapiens
tgtgttccagacactg

SEQ ID NO: 156443 - DNA, 16 bp, H. sapiens
tgtgttccagatctta

SEQ ID NO: 156444 - DNA, 16 bp, H. sapiens
tgtgttccagccactc

SEQ ID NO: 156445 - DNA, 16 bp, H. sapiens
tgtgttccagtaaaac

SEQ ID NO: 156446 - DNA, 16 bp, H. sapiens
tgtgttcccagtgcct

SEQ ID NO: 156447 - DNA, 16 bp, H. sapiens
tgtgttcccccaaaat

SEQ ID NO: 156448 - DNA, 17 bp, H. sapiens
tgtgttcctgcagcctg

SEQ ID NO: 156449 - DNA, 16 bp, H. sapiens
tgtgttctaataaaat

SEQ ID NO: 156450 - DNA, 16 bp, H. sapiens
tgtgttctcacccaaa

SEQ ID NO: 156451 - DNA, 16 bp, H. sapiens
tgtgttctcattttta

SEQ ID NO: 156452 - DNA, 16 bp, H. sapiens
tgtgttctgagaaatg

SEQ ID NO: 156453 - DNA, 16 bp, H. sapiens
tgtgttctgcaacttt

SEQ ID NO: 156454 - DNA, 16 bp, H. sapiens
tgtgttcttttaaaat

SEQ ID NO: 156455 - DNA, 16 bp, H. sapiens
tgtgttgacatttgca

SEQ ID NO: 156456 - DNA, 16 bp, H. sapiens
tgtgttgagcaagtct

SEQ ID NO: 156457 - DNA, 16 bp, H. sapiens
tgtgttgagggaggaa

SEQ ID NO: 156458 - DNA, 18 bp, H. sapiens
tgtgttgcccaggctggg

SEQ ID NO: 156459 - DNA, 16 bp, H. sapiens
tgtgttgctggtggga

SEQ ID NO: 156460 - DNA, 16 bp, H. sapiens
tgtgttggcctggctg

SEQ ID NO: 156461 - DNA, 16 bp, H. sapiens
tgtgttgggaaaactg

SEQ ID NO: 156462 - DNA, 16 bp, H. sapiens
tgtgttgggggctctg

SEQ ID NO: 156463 - DNA, 16 bp, H. sapiens
tgtgttgtatctttgt

SEQ ID NO: 156464 - DNA, 16 bp, H. sapiens
tgtgttgtttaagcca

SEQ ID NO: 156465 - DNA, 16 bp, H. sapiens
tgtgtttaaaataaaa

SEQ ID NO: 156466 - DNA, 16 bp, H. sapiens
tgtgtttacatttata

SEQ ID NO: 156467 - DNA, 16 bp, H. sapiens
tgtgtttacattttat

SEQ ID NO: 156468 - DNA, 16 bp, H. sapiens
tgtgtttagtagagac

SEQ ID NO: 156469 - DNA, 16 bp, H. sapiens
tgtgtttataaatata

SEQ ID NO: 156470 - DNA, 16 bp, H. sapiens
tgtgtttccatataaa

SEQ ID NO: 156471 - DNA, 16 bp, H. sapiens
tgtgtttccatttcct

SEQ ID NO: 156472 - DNA, 16 bp, H. sapiens
tgtgtttccttaaagt

SEQ ID NO: 156473 - DNA, 16 bp, H. sapiens
tgtgtttctatatact

SEQ ID NO: 156474 - DNA, 16 bp, H. sapiens
tgtgtttgaaaaatat

SEQ ID NO: 156475 - DNA, 16 bp, H. sapiens
tgtgtttgattttaaa

SEQ ID NO: 156476 - DNA, 16 bp, H. sapiens
tgtgtttgcatagttt

SEQ ID NO: 156477 - DNA, 16 bp, H. sapiens
tgtgtttgctcttgct

SEQ ID NO: 156478 - DNA, 16 bp, H. sapiens
tgtgtttggagatagg

SEQ ID NO: 156479 - DNA, 16 bp, H. sapiens
tgtgtttgtatacaca

SEQ ID NO: 156480 - DNA, 16 bp, H. sapiens
tgtgtttgtcataaat

SEQ ID NO: 156481 - DNA, 16 bp, H. sapiens
tgtgtttgtgagagag

SEQ ID NO: 156482 - DNA, 16 bp, H. sapiens
tgtgtttgtgcatatg

SEQ ID NO: 156483 - DNA, 16 bp, H. sapiens
tgtgtttgtgcctgtg

SEQ ID NO: 156484 - DNA, 16 bp, H. sapiens
tgtgtttgtgtgtaga

SEQ ID NO: 156485 - DNA, 16 bp, H. sapiens
tgtgtttgtgtgtatc

SEQ ID NO: 156486 - DNA, 16 bp, H. sapiens
tgtgtttgtgtgttca

SEQ ID NO: 156487 - DNA, 16 bp, H. sapiens
tgtgtttgtgtttcaa

SEQ ID NO: 156488 - DNA, 16 bp, H. sapiens
tgtgtttgtttttaca

SEQ ID NO: 156489 - DNA, 16 bp, H. sapiens
tgtgttttaaatttca

SEQ ID NO: 156490 - DNA, 16 bp, H. sapiens
tgtgttttacaaagat

SEQ ID NO: 156491 - DNA, 16 bp, H. sapiens
tgtgttttagtagaaa

SEQ ID NO: 156492 - DNA, 16 bp, H. sapiens
tgtgttttcagtagaa

SEQ ID NO: 156493 - DNA, 16 bp, H. sapiens
tgtgttttcattttaa

SEQ ID NO: 156494 - DNA, 16 bp, H. sapiens
tgtgttttctctttaa

SEQ ID NO: 156495 - DNA, 16 bp, H. sapiens
tgtgttttctggctgc

SEQ ID NO: 156496 - DNA, 16 bp, H. sapiens
tgtgttttcttccatt

SEQ ID NO: 156497 - DNA, 16 bp, H. sapiens
tgtgttttgaaaatat

SEQ ID NO: 156498 - DNA, 16 bp, H. sapiens
tgtgttttggatataa

SEQ ID NO: 156499 - DNA, 16 bp, H. sapiens
tgtgttttgtagttct

SEQ ID NO: 156500 - DNA, 16 bp, H. sapiens
tgtgtttttaaaaata

SEQ ID NO: 156501 - DNA, 16 bp, H. sapiens
tgtgtttttaaaatca

SEQ ID NO: 156502 - DNA, 16 bp, H. sapiens
tgtgtttttaaagaaa

SEQ ID NO: 156503 - DNA, 16 bp, H. sapiens
tgtgtttttaaattct

SEQ ID NO: 156504 - DNA, 16 bp, H. sapiens
tgtgtttttaatttca

SEQ ID NO: 156505 - DNA, 16 bp, H. sapiens
tgtgtttttatgccaa

SEQ ID NO: 156506 - DNA, 16 bp, H. sapiens
tgtgtttttcacattt

SEQ ID NO: 156507 - DNA, 16 bp, H. sapiens
tgttaaaaacaaacaa

SEQ ID NO: 156508 - DNA, 16 bp, H. sapiens
tgttaaaaacactcaa

SEQ ID NO: 156509 - DNA, 16 bp, H. sapiens
tgttaaaaacattttt

SEQ ID NO: 156510 - DNA, 16 bp, H. sapiens
tgttaaaaagagcctg

SEQ ID NO: 156511 - DNA, 16 bp, H. sapiens
tgttaaaacacaaatt

SEQ ID NO: 156512 - DNA, 16 bp, H. sapiens
tgttaaaactattttt

SEQ ID NO: 156513 - DNA, 16 bp, H. sapiens
tgttaaaagaaaaaca

SEQ ID NO: 156514 - DNA, 16 bp, H. sapiens
tgttaaaagaaaaact

SEQ ID NO: 156515 - DNA, 16 bp, H. sapiens
tgttaaaagaaaacaa

SEQ ID NO: 156516 - DNA, 16 bp, H. sapiens
tgttaaaagaatatat

SEQ ID NO: 156517 - DNA, 16 bp, H. sapiens
tgttaaaagcaaaaat

SEQ ID NO: 156518 - DNA, 16 bp, H. sapiens
tgttaaaagctgtaaa

SEQ ID NO: 156519 - DNA, 16 bp, H. sapiens
tgttaaaaggaaagaa

SEQ ID NO: 156520 - DNA, 16 bp, H. sapiens
tgttaaaataaatgtt

SEQ ID NO: 156521 - DNA, 16 bp, H. sapiens
tgttaaaatacagatt

SEQ ID NO: 156522 - DNA, 16 bp, H. sapiens
tgttaaaatgcagatc

SEQ ID NO: 156523 - DNA, 16 bp, H. sapiens
tgttaaaatgcagatt

SEQ ID NO: 156524 - DNA, 16 bp, H. sapiens
tgttaaaatgttaact

SEQ ID NO: 156525 - DNA, 16 bp, H. sapiens
tgttaaaatgttttaa

SEQ ID NO: 156526 - DNA, 16 bp, H. sapiens
tgttaaaatttgagaa

SEQ ID NO: 156527 - DNA, 16 bp, H. sapiens
tgttaaactctcccac

SEQ ID NO: 156528 - DNA, 16 bp, H. sapiens
tgttaaatatatttct

SEQ ID NO: 156529 - DNA, 16 bp, H. sapiens
tgttaaatattttgaa

SEQ ID NO: 156530 - DNA, 16 bp, H. sapiens
tgttaaatcaaccttg

SEQ ID NO: 156531 - DNA, 16 bp, H. sapiens
tgttaaatgaatgagt

SEQ ID NO: 156532 - DNA, 16 bp, H. sapiens
tgttaaatgttaaatg

SEQ ID NO: 156533 - DNA, 16 bp, H. sapiens
tgttaaatttattcct

SEQ ID NO: 156534 - DNA, 16 bp, H. sapiens
tgttaaatttcatttt

SEQ ID NO: 156535 - DNA, 16 bp, H. sapiens
tgttaaattttgcttt

SEQ ID NO: 156536 - DNA, 16 bp, H. sapiens
tgttaacatttctttt

SEQ ID NO: 156537 - DNA, 18 bp, H. sapiens
tgttaaccaggatggtct

SEQ ID NO: 156538 - DNA, 16 bp, H. sapiens
tgttaaccctagagga

SEQ ID NO: 156539 - DNA, 16 bp, H. sapiens
tgttaaccttgatcac

SEQ ID NO: 156540 - DNA, 16 bp, H. sapiens
tgttaactataatcac

SEQ ID NO: 156541 - DNA, 16 bp, H. sapiens
tgttaactctgatgat

SEQ ID NO: 156542 - DNA, 16 bp, H. sapiens
tgttaactttgtcaaa

SEQ ID NO: 156543 - DNA, 16 bp, H. sapiens
tgttaagaaaatgaaa

SEQ ID NO: 156544 - DNA, 16 bp, H. sapiens
tgttaagaaggaaatt

SEQ ID NO: 156545 - DNA, 16 bp, H. sapiens
tgttaagagggaagtt

SEQ ID NO: 156546 - DNA, 16 bp, H. sapiens
tgttaagcctgtgggt

SEQ ID NO: 156547 - DNA, 16 bp, H. sapiens
tgttaagtatatttac

SEQ ID NO: 156548 - DNA, 16 bp, H. sapiens
tgttaagtgacacatg

SEQ ID NO: 156549 - DNA, 16 bp, H. sapiens
tgttaatatttgtgat

SEQ ID NO: 156550 - DNA, 16 bp, H. sapiens
tgttaatattttatca

SEQ ID NO: 156551 - DNA, 16 bp, H. sapiens
tgttaatctgtaactt

SEQ ID NO: 156552 - DNA, 16 bp, H. sapiens
tgttaatctttaaaaa

SEQ ID NO: 156553 - DNA, 16 bp, H. sapiens
tgttaatggatacaca

SEQ ID NO: 156554 - DNA, 16 bp, H. sapiens
tgttaatgtgatggat

SEQ ID NO: 156555 - DNA, 16 bp, H. sapiens
tgttaatgttgacatt

SEQ ID NO: 156556 - DNA, 16 bp, H. sapiens
tgttaatgttttcaaa

SEQ ID NO: 156557 - DNA, 16 bp, H. sapiens
tgttaattagcttgat

SEQ ID NO: 156558 - DNA, 16 bp, H. sapiens
tgttaatttgctcaag

SEQ ID NO: 156559 - DNA, 16 bp, H. sapiens
tgttacaaaaatgaaa

SEQ ID NO: 156560 - DNA, 16 bp, H. sapiens
tgttacaattcaagat

SEQ ID NO: 156561 - DNA, 16 bp, H. sapiens
tgttacagatgaagaa

SEQ ID NO: 156562 - DNA, 16 bp, H. sapiens
tgttacagatgaggaa

SEQ ID NO: 156563 - DNA, 16 bp, H. sapiens
tgttacagcagcctga

SEQ ID NO: 156564 - DNA, 16 bp, H. sapiens
tgttacagcagctcta

SEQ ID NO: 156565 - DNA, 16 bp, H. sapiens
tgttacagctgatgaa

SEQ ID NO: 156566 - DNA, 18 bp, H. sapiens
tgttacagttcttaaagg

SEQ ID NO: 156567 - DNA, 16 bp, H. sapiens
tgttacagttcttcaa

SEQ ID NO: 156568 - DNA, 16 bp, H. sapiens
tgttacagttctttca

SEQ ID NO: 156569 - DNA, 16 bp, H. sapiens
tgttacatacatttta

SEQ ID NO: 156570 - DNA, 16 bp, H. sapiens
tgttacatatatattt

SEQ ID NO: 156571 - DNA, 16 bp, H. sapiens
tgttacatatgtataa

SEQ ID NO: 156572 - DNA, 16 bp, H. sapiens
tgttacatatgtatat

SEQ ID NO: 156573 - DNA, 16 bp, H. sapiens
tgttacatgaaataag

SEQ ID NO: 156574 - DNA, 16 bp, H. sapiens
tgttacatggatatat

SEQ ID NO: 156575 - DNA, 16 bp, H. sapiens
tgttaccaaaaataaa

SEQ ID NO: 156576 - DNA, 16 bp, H. sapiens
tgttaccaaactgctg

SEQ ID NO: 156577 - DNA, 16 bp, H. sapiens
tgttaccacagcataa

SEQ ID NO: 156578 - DNA, 16 bp, H. sapiens
tgttaccactggggaa

SEQ ID NO: 156579 - DNA, 16 bp, H. sapiens
tgttaccagaaaggag

SEQ ID NO: 156580 - DNA, 16 bp, H. sapiens
tgttacccaggttgga

SEQ ID NO: 156581 - DNA, 16 bp, H. sapiens
tgttaccttttaaaat

SEQ ID NO: 156582 - DNA, 16 bp, H. sapiens
tgttacgtggatatat

SEQ ID NO: 156583 - DNA, 16 bp, H. sapiens
tgttactataaaggaa

SEQ ID NO: 156584 - DNA, 16 bp, H. sapiens
tgttactgtattttat

SEQ ID NO: 156585 - DNA, 16 bp, H. sapiens
tgttacttgcagctga

SEQ ID NO: 156586 - DNA, 16 bp, H. sapiens
tgttacttgttttcta

SEQ ID NO: 156587 - DNA, 16 bp, H. sapiens
tgttacttttgtaatt

SEQ ID NO: 156588 - DNA, 16 bp, H. sapiens
tgttagaaaagcaaat

SEQ ID NO: 156589 - DNA, 16 bp, H. sapiens
tgttagaaaagcagaa

SEQ ID NO: 156590 - DNA, 16 bp, H. sapiens
tgttagaaatggaaat

SEQ ID NO: 156591 - DNA, 16 bp, H. sapiens
tgttagaaggaaaacc

SEQ ID NO: 156592 - DNA, 16 bp, H. sapiens
tgttagactggataaa

SEQ ID NO: 156593 - DNA, 16 bp, H. sapiens
tgttagataattttgc

SEQ ID NO: 156594 - DNA, 16 bp, H. sapiens
tgttagcaaagagact

SEQ ID NO: 156595 - DNA, 16 bp, H. sapiens
tgttagcacacagaac

SEQ ID NO: 156596 - DNA, 16 bp, H. sapiens
tgttagcatatagaaa

SEQ ID NO: 156597 - DNA, 16 bp, H. sapiens
tgttagcatattttat

SEQ ID NO: 156598 - DNA, 16 bp, H. sapiens
tgttagcattttctct

SEQ ID NO: 156599 - DNA, 18 bp, H. sapiens
tgttagccaagatggtct

SEQ ID NO: 156600 - DNA, 18 bp, H. sapiens
tgttagccacgatggtct

SEQ ID NO: 156601 - DNA, 16 bp, H. sapiens
tgttagccagaatggt

SEQ ID NO: 156602 - DNA, 18 bp, H. sapiens
tgttagccagaatggtct

SEQ ID NO: 156603 - DNA, 18 bp, H. sapiens
tgttagccaggaaggtct

SEQ ID NO: 156604 - DNA, 16 bp, H. sapiens
tgttagccaggacagt

SEQ ID NO: 156605 - DNA, 18 bp, H. sapiens
tgttagccaggacggtct

SEQ ID NO: 156606 - DNA, 16 bp, H. sapiens
tgttagccaggatagt

SEQ ID NO: 156607 - DNA, 18 bp, H. sapiens
tgttagccaggatagtct

SEQ ID NO: 156608 - DNA, 18 bp, H. sapiens
tgttagccaggatgatct

SEQ ID NO: 156609 - DNA, 16 bp, H. sapiens
tgttagccaggatgga

SEQ ID NO: 156610 - DNA, 18 bp, H. sapiens
tgttagccaggatggtcc

SEQ ID NO: 156611 - DNA, 18 bp, H. sapiens
tgttagccaggatggtct

SEQ ID NO: 156612 - DNA, 17 bp, H. sapiens
tgttagccaggatggtg

SEQ ID NO: 156613 - DNA, 18 bp, H. sapiens
tgttagccaggatgttct

SEQ ID NO: 156614 - DNA, 18 bp, H. sapiens
tgttagccaggattgtct

SEQ ID NO: 156615 - DNA, 18 bp, H. sapiens
tgttagccagggtggtct

SEQ ID NO: 156616 - DNA, 16 bp, H. sapiens
tgttagcccaggctgg

SEQ ID NO: 156617 - DNA, 18 bp, H. sapiens
tgttagccgggatggtct

SEQ ID NO: 156618 - DNA, 18 bp, H. sapiens
tgttagctaggatggtct

SEQ ID NO: 156619 - DNA, 16 bp, H. sapiens
tgttagctttttaaaa

SEQ ID NO: 156620 - DNA, 16 bp, H. sapiens
tgttaggaaacctgct

SEQ ID NO: 156621 - DNA, 16 bp, H. sapiens
tgttaggaacctggcc

SEQ ID NO: 156622 - DNA, 16 bp, H. sapiens
tgttaggaactgggtc

SEQ ID NO: 156623 - DNA, 16 bp, H. sapiens
tgttaggatggctatt

SEQ ID NO: 156624 - DNA, 16 bp, H. sapiens
tgttaggccacaaaaa

SEQ ID NO: 156625 - DNA, 16 bp, H. sapiens
tgttagggagagacat

SEQ ID NO: 156626 - DNA, 16 bp, H. sapiens
tgttaggtttttaaat

SEQ ID NO: 156627 - DNA, 18 bp, H. sapiens
tgttagtcaggatggtct

SEQ ID NO: 156628 - DNA, 16 bp, H. sapiens
tgttagtctgaggagg

SEQ ID NO: 156629 - DNA, 16 bp, H. sapiens
tgttagtctgttttgt

SEQ ID NO: 156630 - DNA, 16 bp, H. sapiens
tgttagtgctggtcag

SEQ ID NO: 156631 - DNA, 16 bp, H. sapiens
tgttataaaagcaaat

SEQ ID NO: 156632 - DNA, 16 bp, H. sapiens
tgttataaaagccagt

SEQ ID NO: 156633 - DNA, 16 bp, H. sapiens
tgttataaacaatgct

SEQ ID NO: 156634 - DNA, 16 bp, H. sapiens
tgttataaataaagtt

SEQ ID NO: 156635 - DNA, 16 bp, H. sapiens
tgttatactgtattat

SEQ ID NO: 156636 - DNA, 16 bp, H. sapiens
tgttatagatgaggaa

SEQ ID NO: 156637 - DNA, 16 bp, H. sapiens
tgttatagcagcacaa

SEQ ID NO: 156638 - DNA, 16 bp, H. sapiens
tgttatagtgatctgt

SEQ ID NO: 156639 - DNA, 16 bp, H. sapiens
tgttatatagataaat

SEQ ID NO: 156640 - DNA, 16 bp, H. sapiens
tgttatatatggcttt

SEQ ID NO: 156641 - DNA, 16 bp, H. sapiens
tgttatattttacatt

SEQ ID NO: 156642 - DNA, 16 bp, H. sapiens
tgttatcaacttaaaa

SEQ ID NO: 156643 - DNA, 16 bp, H. sapiens
tgttatccaggatggt

SEQ ID NO: 156644 - DNA, 16 bp, H. sapiens
tgttatccaggctgga

SEQ ID NO: 156645 - DNA, 16 bp, H. sapiens
tgttatccaggctggt

SEQ ID NO: 156646 - DNA, 16 bp, H. sapiens
tgttatctctgtttta

SEQ ID NO: 156647 - DNA, 16 bp, H. sapiens
tgttatctcttgtctt

SEQ ID NO: 156648 - DNA, 16 bp, H. sapiens
tgttatctgaaattca

SEQ ID NO: 156649 - DNA, 16 bp, H. sapiens
tgttatgaaatctttg

SEQ ID NO: 156650 - DNA, 16 bp, H. sapiens
tgttatgaggattaaa

SEQ ID NO: 156651 - DNA, 16 bp, H. sapiens
tgttatggaagcccaa

SEQ ID NO: 156652 - DNA, 16 bp, H. sapiens
tgttatggtgatctgt

SEQ ID NO: 156653 - DNA, 16 bp, H. sapiens
tgttatgtaaatagtt

SEQ ID NO: 156654 - DNA, 16 bp, H. sapiens
tgttattaaaaagtta

SEQ ID NO: 156655 - DNA, 16 bp, H. sapiens
tgttattaatgttaaa

SEQ ID NO: 156656 - DNA, 16 bp, H. sapiens
tgttattatcattatt

SEQ ID NO: 156657 - DNA, 16 bp, H. sapiens
tgttattattgtcatt

SEQ ID NO: 156658 - DNA, 16 bp, H. sapiens
tgttattcatttaaaa

SEQ ID NO: 156659 - DNA, 16 bp, H. sapiens
tgttattgatgtataa

SEQ ID NO: 156660 - DNA, 16 bp, H. sapiens
tgttattgcctctgaa

SEQ ID NO: 156661 - DNA, 16 bp, H. sapiens
tgttattgctgttatt

SEQ ID NO: 156662 - DNA, 16 bp, H. sapiens
tgttattggcaccttt

SEQ ID NO: 156663 - DNA, 18 bp, H. sapiens
tgttattggtctattcag

SEQ ID NO: 156664 - DNA, 16 bp, H. sapiens
tgttatttaaacattt

SEQ ID NO: 156665 - DNA, 16 bp, H. sapiens
tgttatttaaatgaaa

SEQ ID NO: 156666 - DNA, 16 bp, H. sapiens
tgttatttatctgaaa

SEQ ID NO: 156667 - DNA, 16 bp, H. sapiens
tgttatttcattaaat

SEQ ID NO: 156668 - DNA, 16 bp, H. sapiens
tgttatttctaataat

SEQ ID NO: 156669 - DNA, 16 bp, H. sapiens
tgttatttcttacaac

SEQ ID NO: 156670 - DNA, 16 bp, H. sapiens
tgttatttgctttctg

SEQ ID NO: 156671 - DNA, 16 bp, H. sapiens
tgttattttagaatgt

SEQ ID NO: 156672 - DNA, 16 bp, H. sapiens
tgttattttgttacag

SEQ ID NO: 156673 - DNA, 16 bp, H. sapiens
tgttatttttaatgtc

SEQ ID NO: 156674 - DNA, 16 bp, H. sapiens
tgttatttttagtgga

SEQ ID NO: 156675 - DNA, 16 bp, H. sapiens
tgttatttttctggat

SEQ ID NO: 156676 - DNA, 16 bp, H. sapiens
tgttcaaatattttgc

SEQ ID NO: 156677 - DNA, 16 bp, H. sapiens
tgttcaacatcactga

SEQ ID NO: 156678 - DNA, 16 bp, H. sapiens
tgttcaacattcttaa

SEQ ID NO: 156679 - DNA, 16 bp, H. sapiens
tgttcaagaaataaaa

SEQ ID NO: 156680 - DNA, 17 bp, H. sapiens
tgttcaagaccaacctg

SEQ ID NO: 156681 - DNA, 16 bp, H. sapiens
tgttcaagagtcaact

SEQ ID NO: 156682 - DNA, 16 bp, H. sapiens
tgttcaagctggtctt

SEQ ID NO: 156683 - DNA, 16 bp, H. sapiens
tgttcaaggagaaaga

SEQ ID NO: 156684 - DNA, 16 bp, H. sapiens
tgttcaagggtaaact

SEQ ID NO: 156685 - DNA, 16 bp, H. sapiens
tgttcaagggtcaact

SEQ ID NO: 156686 - DNA, 16 bp, H. sapiens
tgttcaagtcccactt

SEQ ID NO: 156687 - DNA, 16 bp, H. sapiens
tgttcaagtgcagaaa

SEQ ID NO: 156688 - DNA, 16 bp, H. sapiens
tgttcaatgaaataaa

SEQ ID NO: 156689 - DNA, 26 bp, H. sapiens
tgttcaattcccacctaggagtgaga

SEQ ID NO: 156690 - DNA, 16 bp, H. sapiens
tgttcacaacagcaaa

SEQ ID NO: 156691 - DNA, 16 bp, H. sapiens
tgttcacagcattttc

SEQ ID NO: 156692 - DNA, 16 bp, H. sapiens
tgttcacattgttcag

SEQ ID NO: 156693 - DNA, 16 bp, H. sapiens
tgttcaccaaccagga

SEQ ID NO: 156694 - DNA, 16 bp, H. sapiens
tgttcaccctgatggt

SEQ ID NO: 156695 - DNA, 16 bp, H. sapiens
tgttcactctgatgat

SEQ ID NO: 156696 - DNA, 16 bp, H. sapiens
tgttcactgcaacctc

SEQ ID NO: 156697 - DNA, 16 bp, H. sapiens
tgttcactgcagtgct

SEQ ID NO: 156698 - DNA, 16 bp, H. sapiens
tgttcactggttattt

SEQ ID NO: 156699 - DNA, 16 bp, H. sapiens
tgttcactgtggcatt

SEQ ID NO: 156700 - DNA, 16 bp, H. sapiens
tgttcacttaaaaaaa

SEQ ID NO: 156701 - DNA, 16 bp, H. sapiens
tgttcagagtttcttc

SEQ ID NO: 156702 - DNA, 16 bp, H. sapiens
tgttcagatcttctat

SEQ ID NO: 156703 - DNA, 16 bp, H. sapiens
tgttcagcccccactt

SEQ ID NO: 156704 - DNA, 16 bp, H. sapiens
tgttcaggcctcctcc

SEQ ID NO: 156705 - DNA, 16 bp, H. sapiens
tgttcaggggtcaact

SEQ ID NO: 156706 - DNA, 16 bp, H. sapiens
tgttcaggttttgaat

SEQ ID NO: 156707 - DNA, 16 bp, H. sapiens
tgttcagtgtgctctt

SEQ ID NO: 156708 - DNA, 16 bp, H. sapiens
tgttcagtttctattt

SEQ ID NO: 156709 - DNA, 16 bp, H. sapiens
tgttcataattgccaa

SEQ ID NO: 156710 - DNA, 16 bp, H. sapiens
tgttcatacaaagact

SEQ ID NO: 156711 - DNA, 16 bp, H. sapiens
tgttcataccactgca

SEQ ID NO: 156712 - DNA, 16 bp, H. sapiens
tgttcatagcaatatt

SEQ ID NO: 156713 - DNA, 16 bp, H. sapiens
tgttcatagcaccatt

SEQ ID NO: 156714 - DNA, 16 bp, H. sapiens
tgttcatatcctttgt

SEQ ID NO: 156715 - DNA, 16 bp, H. sapiens
tgttcatattttaaaa

SEQ ID NO: 156716 - DNA, 16 bp, H. sapiens
tgttcatattttctta

SEQ ID NO: 156717 - DNA, 16 bp, H. sapiens
tgttcatcaacaaatg

SEQ ID NO: 156718 - DNA, 16 bp, H. sapiens
tgttcatctcccactt

SEQ ID NO: 156719 - DNA, 16 bp, H. sapiens
tgttcatgaataggaa

SEQ ID NO: 156720 - DNA, 16 bp, H. sapiens
tgttcatgccactaca

SEQ ID NO: 156721 - DNA, 16 bp, H. sapiens
tgttcatgccactgta

SEQ ID NO: 156722 - DNA, 16 bp, H. sapiens
tgttcattcatttctt

SEQ ID NO: 156723 - DNA, 16 bp, H. sapiens
tgttcattcctcccag

SEQ ID NO: 156724 - DNA, 16 bp, H. sapiens
tgttcattccttttca

SEQ ID NO: 156725 - DNA, 16 bp, H. sapiens
tgttcattctccttcc

SEQ ID NO: 156726 - DNA, 16 bp, H. sapiens
tgttcattgaagcatt

SEQ ID NO: 156727 - DNA, 16 bp, H. sapiens
tgttcattgcagcact

SEQ ID NO: 156728 - DNA, 16 bp, H. sapiens
tgttcattgtggcact

SEQ ID NO: 156729 - DNA, 16 bp, H. sapiens
tgttcatttattcaat

SEQ ID NO: 156730 - DNA, 16 bp, H. sapiens
tgttcatttctggaat

SEQ ID NO: 156731 - DNA, 16 bp, H. sapiens
tgttcatttgaagttt

SEQ ID NO: 156732 - DNA, 16 bp, H. sapiens
tgttcattttcaagaa

SEQ ID NO: 156733 - DNA, 16 bp, H. sapiens
tgttcatttttaaaat

SEQ ID NO: 156734 - DNA, 16 bp, H. sapiens
tgttcatttttgagaa

SEQ ID NO: 156735 - DNA, 16 bp, H. sapiens
tgttccaaaattatgt

SEQ ID NO: 156736 - DNA, 21 bp, H. sapiens
tgttccaaaattgaccacata

SEQ ID NO: 156737 - DNA, 16 bp, H. sapiens
tgttccaacctctgtc

SEQ ID NO: 156738 - DNA, 16 bp, H. sapiens
tgttccaagcacttta

SEQ ID NO: 156739 - DNA, 16 bp, H. sapiens
tgttccacatcctcac

SEQ ID NO: 156740 - DNA, 16 bp, H. sapiens
tgttccacttcctgtg

SEQ ID NO: 156741 - DNA, 16 bp, H. sapiens
tgttccagaccagcct

SEQ ID NO: 156742 - DNA, 16 bp, H. sapiens
tgttccagcaccactt

SEQ ID NO: 156743 - DNA, 16 bp, H. sapiens
tgttccagctgctcca

SEQ ID NO: 156744 - DNA, 16 bp, H. sapiens
tgttccagtaaaactt

SEQ ID NO: 156745 - DNA, 16 bp, H. sapiens
tgttccatatttttgc

SEQ ID NO: 156746 - DNA, 16 bp, H. sapiens
tgttccatcaatacct

SEQ ID NO: 156747 - DNA, 16 bp, H. sapiens
tgttccatggagactg

SEQ ID NO: 156748 - DNA, 16 bp, H. sapiens
tgttccattattggaa

SEQ ID NO: 156749 - DNA, 16 bp, H. sapiens
tgttccattttgcatt

SEQ ID NO: 156750 - DNA, 16 bp, H. sapiens
tgttcccacaaaggac

SEQ ID NO: 156751 - DNA, 16 bp, H. sapiens
tgttcccaccttttgg

SEQ ID NO: 156752 - DNA, 16 bp, H. sapiens
tgttcccagccctgtg

SEQ ID NO: 156753 - DNA, 16 bp, H. sapiens
tgttcccatttagggc

SEQ ID NO: 156754 - DNA, 16 bp, H. sapiens
tgttcccattttaaaa

SEQ ID NO: 156755 - DNA, 16 bp, H. sapiens
tgttccccaggctgga

SEQ ID NO: 156756 - DNA, 16 bp, H. sapiens
tgttcccctctctgtg

SEQ ID NO: 156757 - DNA, 16 bp, H. sapiens
tgttcccctttctcca

SEQ ID NO: 156758 - DNA, 16 bp, H. sapiens
tgttccctccaaatct

SEQ ID NO: 156759 - DNA, 16 bp, H. sapiens
tgttccgctccctgtg

SEQ ID NO: 156760 - DNA, 16 bp, H. sapiens
tgttcctacttctcca

SEQ ID NO: 156761 - DNA, 16 bp, H. sapiens
tgttcctagaagtaaa

SEQ ID NO: 156762 - DNA, 16 bp, H. sapiens
tgttcctcaggctgga

SEQ ID NO: 156763 - DNA, 16 bp, H. sapiens
tgttcctccagagctg

SEQ ID NO: 156764 - DNA, 16 bp, H. sapiens
tgttcctccagtcatc

SEQ ID NO: 156765 - DNA, 16 bp, H. sapiens
tgttcctcctggctgc

SEQ ID NO: 156766 - DNA, 16 bp, H. sapiens
tgttcctctgcctgct

SEQ ID NO: 156767 - DNA, 16 bp, H. sapiens
tgttcctctgtcccct

SEQ ID NO: 156768 - DNA, 16 bp, H. sapiens
tgttcctgaagaagaa

SEQ ID NO: 156769 - DNA, 16 bp, H. sapiens
tgttcctgaggaagaa

SEQ ID NO: 156770 - DNA, 16 bp, H. sapiens
tgttcctgctctggcc

SEQ ID NO: 156771 - DNA, 16 bp, H. sapiens
tgttcctgctgcagat

SEQ ID NO: 156772 - DNA, 17 bp, H. sapiens
tgttcctgggtgtgtct

SEQ ID NO: 156773 - DNA, 16 bp, H. sapiens
tgttcctgtattgggt

SEQ ID NO: 156774 - DNA, 16 bp, H. sapiens
tgttcctgtttcttca

SEQ ID NO: 156775 - DNA, 16 bp, H. sapiens
tgttccttcaattcct

SEQ ID NO: 156776 - DNA, 16 bp, H. sapiens
tgttccttctcctatg

SEQ ID NO: 156777 - DNA, 16 bp, H. sapiens
tgttccttgacttgtg

SEQ ID NO: 156778 - DNA, 16 bp, H. sapiens
tgttccttgctatgct

SEQ ID NO: 156779 - DNA, 16 bp, H. sapiens
tgttcctttactcttc

SEQ ID NO: 156780 - DNA, 16 bp, H. sapiens
tgttcctttactttct

SEQ ID NO: 156781 - DNA, 16 bp, H. sapiens
tgttcctttttcacca

SEQ ID NO: 156782 - DNA, 16 bp, H. sapiens
tgttcgagggcaggaa

SEQ ID NO: 156783 - DNA, 16 bp, H. sapiens
tgttcgttgcagcact

SEQ ID NO: 156784 - DNA, 16 bp, H. sapiens
tgttctaaagcctttt

SEQ ID NO: 156785 - DNA, 16 bp, H. sapiens
tgttctaagtgcttta

SEQ ID NO: 156786 - DNA, 16 bp, H. sapiens
tgttctaatccccaga

SEQ ID NO: 156787 - DNA, 16 bp, H. sapiens
tgttctaggcactgaa

SEQ ID NO: 156788 - DNA, 16 bp, H. sapiens
tgttctataaatatct

SEQ ID NO: 156789 - DNA, 16 bp, H. sapiens
tgttctatagttttca

SEQ ID NO: 156790 - DNA, 16 bp, H. sapiens
tgttctatatcttgat

SEQ ID NO: 156791 - DNA, 16 bp, H. sapiens
tgttctattaaaaaaa

SEQ ID NO: 156792 - DNA, 16 bp, H. sapiens
tgttctattttctgaa

SEQ ID NO: 156793 - DNA, 16 bp, H. sapiens
tgttctcaccacaaaa

SEQ ID NO: 156794 - DNA, 17 bp, H. sapiens
tgttctcatgatagtga

SEQ ID NO: 156795 - DNA, 16 bp, H. sapiens
tgttctccaggttcat

SEQ ID NO: 156796 - DNA, 16 bp, H. sapiens
tgttctccatactatt

SEQ ID NO: 156797 - DNA, 16 bp, H. sapiens
tgttctcctgacctcg

SEQ ID NO: 156798 - DNA, 16 bp, H. sapiens
tgttctctcatttaat

SEQ ID NO: 156799 - DNA, 16 bp, H. sapiens
tgttctctggctcctt

SEQ ID NO: 156800 - DNA, 16 bp, H. sapiens
tgttctctgtatttcc

SEQ ID NO: 156801 - DNA, 16 bp, H. sapiens
tgttctctgtgcctag

SEQ ID NO: 156802 - DNA, 16 bp, H. sapiens
tgttctcttcccttat

SEQ ID NO: 156803 - DNA, 16 bp, H. sapiens
tgttctcttgatagtg

SEQ ID NO: 156804 - DNA, 16 bp, H. sapiens
tgttctgagcacattt

SEQ ID NO: 156805 - DNA, 16 bp, H. sapiens
tgttctgcagtctctg

SEQ ID NO: 156806 - DNA, 16 bp, H. sapiens
tgttctgcctggctca

SEQ ID NO: 156807 - DNA, 16 bp, H. sapiens
tgttctggaatcctac

SEQ ID NO: 156808 - DNA, 16 bp, H. sapiens
tgttctggaatcttat

SEQ ID NO: 156809 - DNA, 16 bp, H. sapiens
tgttctggaggtcaca

SEQ ID NO: 156810 - DNA, 16 bp, H. sapiens
tgttctggccagggca

SEQ ID NO: 156811 - DNA, 17 bp, H. sapiens
tgttctggtgatagtga

SEQ ID NO: 156812 - DNA, 16 bp, H. sapiens
tgttctgtaaatacct

SEQ ID NO: 156813 - DNA, 16 bp, H. sapiens
tgttctgtaaatattt

SEQ ID NO: 156814 - DNA, 16 bp, H. sapiens
tgttctgtaaatgtct

SEQ ID NO: 156815 - DNA, 16 bp, H. sapiens
tgttctgtaattttct

SEQ ID NO: 156816 - DNA, 16 bp, H. sapiens
tgttctgtcagctgag

SEQ ID NO: 156817 - DNA, 16 bp, H. sapiens
tgttctgtcatccagg

SEQ ID NO: 156818 - DNA, 16 bp, H. sapiens
tgttctgtcccccagg

SEQ ID NO: 156819 - DNA, 16 bp, H. sapiens
tgttctgttccattca

SEQ ID NO: 156820 - DNA, 16 bp, H. sapiens
tgttctgttccattgt

SEQ ID NO: 156821 - DNA, 16 bp, H. sapiens
tgttctgttgcccatg

SEQ ID NO: 156822 - DNA, 16 bp, H. sapiens
tgttctgtttccatgt

SEQ ID NO: 156823 - DNA, 16 bp, H. sapiens
tgttcttaatttttaa

SEQ ID NO: 156824 - DNA, 16 bp, H. sapiens
tgttcttactgatttt

SEQ ID NO: 156825 - DNA, 16 bp, H. sapiens
tgttcttacttacaag

SEQ ID NO: 156826 - DNA, 16 bp, H. sapiens
tgttcttaggaaatat

SEQ ID NO: 156827 - DNA, 16 bp, H. sapiens
tgttcttataagaaga

SEQ ID NO: 156828 - DNA, 16 bp, H. sapiens
tgttcttattggccat

SEQ ID NO: 156829 - DNA, 16 bp, H. sapiens
tgttcttcattctgtt

SEQ ID NO: 156830 - DNA, 16 bp, H. sapiens
tgttcttccttctcta

SEQ ID NO: 156831 - DNA, 16 bp, H. sapiens
tgttcttcttcaagat

SEQ ID NO: 156832 - DNA, 16 bp, H. sapiens
tgttcttgaacttcat

SEQ ID NO: 156833 - DNA, 16 bp, H. sapiens
tgttcttgaacttctg

SEQ ID NO: 156834 - DNA, 16 bp, H. sapiens
tgttcttgctgtctca

SEQ ID NO: 156835 - DNA, 16 bp, H. sapiens
tgttcttggcacattt

SEQ ID NO: 156836 - DNA, 16 bp, H. sapiens
tgttcttgttctgtaa

SEQ ID NO: 156837 - DNA, 16 bp, H. sapiens
tgttctttataaatta

SEQ ID NO: 156838 - DNA, 16 bp, H. sapiens
tgttctttgaaaaaat

SEQ ID NO: 156839 - DNA, 16 bp, H. sapiens
tgttctttgaaaataa

SEQ ID NO: 156840 - DNA, 16 bp, H. sapiens
tgttctttgaaagaaa

SEQ ID NO: 156841 - DNA, 16 bp, H. sapiens
tgttctttgaaagaat

SEQ ID NO: 156842 - DNA, 16 bp, H. sapiens
tgttctttgaagcaca

SEQ ID NO: 156843 - DNA, 16 bp, H. sapiens
tgttcttttacctttg

SEQ ID NO: 156844 - DNA, 16 bp, H. sapiens
tgttcttttcacatag

SEQ ID NO: 156845 - DNA, 16 bp, H. sapiens
tgttgaaaaaggaaat

SEQ ID NO: 156846 - DNA, 16 bp, H. sapiens
tgttgaaaaagtaaaa

SEQ ID NO: 156847 - DNA, 16 bp, H. sapiens
tgttgaaaagactatt

SEQ ID NO: 156848 - DNA, 16 bp, H. sapiens
tgttgaaaatcaattt

SEQ ID NO: 156849 - DNA, 16 bp, H. sapiens
tgttgaaaatcagttt

SEQ ID NO: 156850 - DNA, 16 bp, H. sapiens
tgttgaaacaaacaaa

SEQ ID NO: 156851 - DNA, 16 bp, H. sapiens
tgttgaaagaaaagaa

SEQ ID NO: 156852 - DNA, 16 bp, H. sapiens
tgttgaaagcaaagaa

SEQ ID NO: 156853 - DNA, 16 bp, H. sapiens
tgttgaaatgtaatcc

SEQ ID NO: 156854 - DNA, 16 bp, H. sapiens
tgttgaaatgtgatcc

SEQ ID NO: 156855 - DNA, 16 bp, H. sapiens
tgttgaaatttaatcc

SEQ ID NO: 156856 - DNA, 16 bp, H. sapiens
tgttgaaatttaattg

SEQ ID NO: 156857 - DNA, 16 bp, H. sapiens
tgttgaacagaagtag

SEQ ID NO: 156858 - DNA, 16 bp, H. sapiens
tgttgaacagaagtgg

SEQ ID NO: 156859 - DNA, 16 bp, H. sapiens
tgttgaacagcttttc

SEQ ID NO: 156860 - DNA, 16 bp, H. sapiens
tgttgaacctttcttt

SEQ ID NO: 156861 - DNA, 16 bp, H. sapiens
tgttgaactttttaaa

SEQ ID NO: 156862 - DNA, 16 bp, H. sapiens
tgttgaagaccagatg

SEQ ID NO: 156863 - DNA, 16 bp, H. sapiens
tgttgaagatcagatg

SEQ ID NO: 156864 - DNA, 16 bp, H. sapiens
tgttgaagatgctata

SEQ ID NO: 156865 - DNA, 16 bp, H. sapiens
tgttgaagatttttgc

SEQ ID NO: 156866 - DNA, 16 bp, H. sapiens
tgttgaagctctcaat

SEQ ID NO: 156867 - DNA, 16 bp, H. sapiens
tgttgaaggcctgaat

SEQ ID NO: 156868 - DNA, 16 bp, H. sapiens
tgttgaagtcctaacc

SEQ ID NO: 156869 - DNA, 16 bp, H. sapiens
tgttgaagtctcccac

SEQ ID NO: 156870 - DNA, 16 bp, H. sapiens
tgttgaagtcttaact

SEQ ID NO: 156871 - DNA, 16 bp, H. sapiens
tgttgaagtcttaatc

SEQ ID NO: 156872 - DNA, 16 bp, H. sapiens
tgttgaagttgtttat

SEQ ID NO: 156873 - DNA, 16 bp, H. sapiens
tgttgaataaaatatt

SEQ ID NO: 156874 - DNA, 16 bp, H. sapiens
tgttgaataaatgagt

SEQ ID NO: 156875 - DNA, 16 bp, H. sapiens
tgttgaataaatgtat

SEQ ID NO: 156876 - DNA, 16 bp, H. sapiens
tgttgaatatcagatg

SEQ ID NO: 156877 - DNA, 16 bp, H. sapiens
tgttgaatcaataaat

SEQ ID NO: 156878 - DNA, 16 bp, H. sapiens
tgttgaatgaataaaa

SEQ ID NO: 156879 - DNA, 16 bp, H. sapiens
tgttgaatgaatgaat

SEQ ID NO: 156880 - DNA, 16 bp, H. sapiens
tgttgaatggttttgg

SEQ ID NO: 156881 - DNA, 16 bp, H. sapiens
tgttgaattaataaat

SEQ ID NO: 156882 - DNA, 16 bp, H. sapiens
tgttgaattccagtgt

SEQ ID NO: 156883 - DNA, 16 bp, H. sapiens
tgttgaattgaacttt

SEQ ID NO: 156884 - DNA, 16 bp, H. sapiens
tgttgaattggggtgg

SEQ ID NO: 156885 - DNA, 16 bp, H. sapiens
tgttgaattgtttaaa

SEQ ID NO: 156886 - DNA, 16 bp, H. sapiens
tgttgaatttcattga

SEQ ID NO: 156887 - DNA, 17 bp, H. sapiens
tgttgaattttattgaa

SEQ ID NO: 156888 - DNA, 16 bp, H. sapiens
tgttgaattttgtcaa

SEQ ID NO: 156889 - DNA, 16 bp, H. sapiens
tgttgacaaaatctct

SEQ ID NO: 156890 - DNA, 16 bp, H. sapiens
tgttgaccaaaacatc

SEQ ID NO: 156891 - DNA, 16 bp, H. sapiens
tgttgaccaagttggt

SEQ ID NO: 156892 - DNA, 16 bp, H. sapiens
tgttgaccacataaat

SEQ ID NO: 156893 - DNA, 16 bp, H. sapiens
tgttgaccagcctggt

SEQ ID NO: 156894 - DNA, 25 bp, H. sapiens
tgttgactataatcaattacaggag

SEQ ID NO: 156895 - DNA, 16 bp, H. sapiens
tgttgactctgatgat

SEQ ID NO: 156896 - DNA, 16 bp, H. sapiens
tgttgactggaagtct

SEQ ID NO: 156897 - DNA, 16 bp, H. sapiens
tgttgactttgtatct

SEQ ID NO: 156898 - DNA, 16 bp, H. sapiens
tgttgagacagggtct

SEQ ID NO: 156899 - DNA, 16 bp, H. sapiens
tgttgagagaatgaaa

SEQ ID NO: 156900 - DNA, 16 bp, H. sapiens
tgttgagcacctactg

SEQ ID NO: 156901 - DNA, 16 bp, H. sapiens
tgttgagcacctgctg

SEQ ID NO: 156902 - DNA, 16 bp, H. sapiens
tgttgagccatctttg

SEQ ID NO: 156903 - DNA, 16 bp, H. sapiens
tgttgagcctcagttt

SEQ ID NO: 156904 - DNA, 16 bp, H. sapiens
tgttgaggaacctcca

SEQ ID NO: 156905 - DNA, 16 bp, H. sapiens
tgttgaggacttttgt

SEQ ID NO: 156906 - DNA, 16 bp, H. sapiens
tgttgagtgaaagaat

SEQ ID NO: 156907 - DNA, 16 bp, H. sapiens
tgttgagttttaaaag

SEQ ID NO: 156908 - DNA, 16 bp, H. sapiens
tgttgataaggatgtg

SEQ ID NO: 156909 - DNA, 16 bp, H. sapiens
tgttgatcttatatcc

SEQ ID NO: 156910 - DNA, 16 bp, H. sapiens
tgttgatgagcattta

SEQ ID NO: 156911 - DNA, 16 bp, H. sapiens
tgttgatgatgatgat

SEQ ID NO: 156912 - DNA, 16 bp, H. sapiens
tgttgatgatttttgc

SEQ ID NO: 156913 - DNA, 16 bp, H. sapiens
tgttgatgctgctggt

SEQ ID NO: 156914 - DNA, 16 bp, H. sapiens
tgttgatgctgctgtt

SEQ ID NO: 156915 - DNA, 16 bp, H. sapiens
tgttgattctcctcag

SEQ ID NO: 156916 - DNA, 16 bp, H. sapiens
tgttgattgctttctt

SEQ ID NO: 156917 - DNA, 16 bp, H. sapiens
tgttgattgtttgctt

SEQ ID NO: 156918 - DNA, 16 bp, H. sapiens
tgttgatttaaagaaa

SEQ ID NO: 156919 - DNA, 16 bp, H. sapiens
tgttgattttatgtct

SEQ ID NO: 156920 - DNA, 16 bp, H. sapiens
tgttgattttcaacct

SEQ ID NO: 156921 - DNA, 16 bp, H. sapiens
tgttgattttgaatcc

SEQ ID NO: 156922 - DNA, 16 bp, H. sapiens
tgttgcaaaaaaaaaa

SEQ ID NO: 156923 - DNA, 16 bp, H. sapiens
tgttgcaagtgacagg

SEQ ID NO: 156924 - DNA, 16 bp, H. sapiens
tgttgcaattgccttt

SEQ ID NO: 156925 - DNA, 16 bp, H. sapiens
tgttgcacagactggt

SEQ ID NO: 156926 - DNA, 16 bp, H. sapiens
tgttgcacagatcatc

SEQ ID NO: 156927 - DNA, 16 bp, H. sapiens
tgttgcacaggctggt

SEQ ID NO: 156928 - DNA, 16 bp, H. sapiens
tgttgcagaagaaaat

SEQ ID NO: 156929 - DNA, 16 bp, H. sapiens
tgttgcagcaaaggac

SEQ ID NO: 156930 - DNA, 16 bp, H. sapiens
tgttgcagttgttttt

SEQ ID NO: 156931 - DNA, 16 bp, H. sapiens
tgttgcatgcctgtgg

SEQ ID NO: 156932 - DNA, 16 bp, H. sapiens
tgttgcatttactttt

SEQ ID NO: 156933 - DNA, 16 bp, H. sapiens
tgttgcatttgttttg

SEQ ID NO: 156934 - DNA, 16 bp, H. sapiens
tgttgccaaagaagat

SEQ ID NO: 156935 - DNA, 16 bp, H. sapiens
tgttgccaagctggag

SEQ ID NO: 156936 - DNA, 16 bp, H. sapiens
tgttgccaaggctgtt

SEQ ID NO: 156937 - DNA, 16 bp, H. sapiens
tgttgccaggggctgg

SEQ ID NO: 156938 - DNA, 16 bp, H. sapiens
tgttgccagtgataaa

SEQ ID NO: 156939 - DNA, 16 bp, H. sapiens
tgttgccattgatttt

SEQ ID NO: 156940 - DNA, 16 bp, H. sapiens
tgttgccattgctttt

SEQ ID NO: 156941 - DNA, 16 bp, H. sapiens
tgttgcccaagcagga

SEQ ID NO: 156942 - DNA, 16 bp, H. sapiens
tgttgcccaagctgga

SEQ ID NO: 156943 - DNA, 16 bp, H. sapiens
tgttgcccaaggtgga

SEQ ID NO: 156944 - DNA, 16 bp, H. sapiens
tgttgcccacgctgat

SEQ ID NO: 156945 - DNA, 16 bp, H. sapiens
tgttgcccacgctgga

SEQ ID NO: 156946 - DNA, 16 bp, H. sapiens
tgttgcccagcctggg

SEQ ID NO: 156947 - DNA, 16 bp, H. sapiens
tgttgcccagctggag

SEQ ID NO: 156948 - DNA, 16 bp, H. sapiens
tgttgcccaggctaga

SEQ ID NO: 156949 - DNA, 16 bp, H. sapiens
tgttgcccaggctagc

SEQ ID NO: 156950 - DNA, 16 bp, H. sapiens
tgttgcccaggctgct

SEQ ID NO: 156951 - DNA, 16 bp, H. sapiens
tgttgcccaggctggc

SEQ ID NO: 156952 - DNA, 17 bp, H. sapiens
tgttgcccaggctgggg

SEQ ID NO: 156953 - DNA, 17 bp, H. sapiens
tgttgcccaggctggta

SEQ ID NO: 156954 - DNA, 17 bp, H. sapiens
tgttgcccaggctggtt

SEQ ID NO: 156955 - DNA, 16 bp, H. sapiens
tgttgcccaggctgtc

SEQ ID NO: 156956 - DNA, 16 bp, H. sapiens
tgttgcccagggctgg

SEQ ID NO: 156957 - DNA, 16 bp, H. sapiens
tgttgcccaggttgga

SEQ ID NO: 156958 - DNA, 16 bp, H. sapiens
tgttgcccagtctagt

SEQ ID NO: 156959 - DNA, 16 bp, H. sapiens
tgttgcccagtctggt

SEQ ID NO: 156960 - DNA, 16 bp, H. sapiens
tgttgcccatgctggt

SEQ ID NO: 156961 - DNA, 16 bp, H. sapiens
tgttgcccatgctttt

SEQ ID NO: 156962 - DNA, 16 bp, H. sapiens
tgttgcctacaaaaaa

SEQ ID NO: 156963 - DNA, 16 bp, H. sapiens
tgttgcctacaagaaa

SEQ ID NO: 156964 - DNA, 18 bp, H. sapiens
tgttgcctaggctggagg

SEQ ID NO: 156965 - DNA, 16 bp, H. sapiens
tgttgcctggctggag

SEQ ID NO: 156966 - DNA, 16 bp, H. sapiens
tgttgcctgggctggg

SEQ ID NO: 156967 - DNA, 16 bp, H. sapiens
tgttgccttgtgaaga

SEQ ID NO: 156968 - DNA, 16 bp, H. sapiens
tgttgcctttctttca

SEQ ID NO: 156969 - DNA, 16 bp, H. sapiens
tgttgctattactatt

SEQ ID NO: 156970 - DNA, 16 bp, H. sapiens
tgttgctatttttaaa

SEQ ID NO: 156971 - DNA, 16 bp, H. sapiens
tgttgctgaaaaaaat

SEQ ID NO: 156972 - DNA, 16 bp, H. sapiens
tgttgctgaatttggt

SEQ ID NO: 156973 - DNA, 16 bp, H. sapiens
tgttgctgcaaacaac

SEQ ID NO: 156974 - DNA, 16 bp, H. sapiens
tgttgctgctgctgtt

SEQ ID NO: 156975 - DNA, 16 bp, H. sapiens
tgttgctgctgctttt

SEQ ID NO: 156976 - DNA, 16 bp, H. sapiens
tgttgcttataataga

SEQ ID NO: 156977 - DNA, 16 bp, H. sapiens
tgttggaaaaataaaa

SEQ ID NO: 156978 - DNA, 16 bp, H. sapiens
tgttggaaaaatgaca

SEQ ID NO: 156979 - DNA, 16 bp, H. sapiens
tgttggaaaggcatga

SEQ ID NO: 156980 - DNA, 16 bp, H. sapiens
tgttggaaatgggaat

SEQ ID NO: 156981 - DNA, 16 bp, H. sapiens
tgttggaaatgtaaat

SEQ ID NO: 156982 - DNA, 16 bp, H. sapiens
tgttggaacacagcca

SEQ ID NO: 156983 - DNA, 16 bp, H. sapiens
tgttggaattacagac

SEQ ID NO: 156984 - DNA, 17 bp, H. sapiens
tgttggacatttgcgtt

SEQ ID NO: 156985 - DNA, 16 bp, H. sapiens
tgttggagatggggct

SEQ ID NO: 156986 - DNA, 16 bp, H. sapiens
tgttggaggaagggcc

SEQ ID NO: 156987 - DNA, 16 bp, H. sapiens
tgttggaggagaggcc

SEQ ID NO: 156988 - DNA, 16 bp, H. sapiens
tgttggagggagtgta

SEQ ID NO: 156989 - DNA, 16 bp, H. sapiens
tgttggaggtggagcc

SEQ ID NO: 156990 - DNA, 16 bp, H. sapiens
tgttggaggtggggcc

SEQ ID NO: 156991 - DNA, 16 bp, H. sapiens
tgttggaggtggggtc

SEQ ID NO: 156992 - DNA, 16 bp, H. sapiens
tgttggatatgtggtt

SEQ ID NO: 156993 - DNA, 16 bp, H. sapiens
tgttggatcttttaga

SEQ ID NO: 156994 - DNA, 16 bp, H. sapiens
tgttggattaccaata

SEQ ID NO: 156995 - DNA, 16 bp, H. sapiens
tgttggcaaggatgtg

SEQ ID NO: 156996 - DNA, 16 bp, H. sapiens
tgttggcagagctgca

SEQ ID NO: 156997 - DNA, 16 bp, H. sapiens
tgttggccaagatgtt

SEQ ID NO: 156998 - DNA, 16 bp, H. sapiens
tgttggccacctgtat

SEQ ID NO: 156999 - DNA, 16 bp, H. sapiens
tgttggccagaatggt

SEQ ID NO: 157000 - DNA, 16 bp, H. sapiens
tgttggccagcctgct

SEQ ID NO: 157001 - DNA, 16 bp, H. sapiens
tgttggccaggaaggt

SEQ ID NO: 157002 - DNA, 17 bp, H. sapiens
tgttggccaggatgatc

SEQ ID NO: 157003 - DNA, 21 bp, H. sapiens
tgttggccaggcacggtggct

SEQ ID NO: 157004 - DNA, 16 bp, H. sapiens
tgttggccaggctctt

SEQ ID NO: 157005 - DNA, 16 bp, H. sapiens
tgttggccaggctgga

SEQ ID NO: 157006 - DNA, 16 bp, H. sapiens
tgttggccaggctggg

SEQ ID NO: 157007 - DNA, 16 bp, H. sapiens
tgttggccatgctgct

SEQ ID NO: 157008 - DNA, 16 bp, H. sapiens
tgttggcctgccttcc

SEQ ID NO: 157009 - DNA, 16 bp, H. sapiens
tgttggctacatgtat

SEQ ID NO: 157010 - DNA, 16 bp, H. sapiens
tgttggctaggatggt

SEQ ID NO: 157011 - DNA, 16 bp, H. sapiens
tgttggctgggcacgg

SEQ ID NO: 157012 - DNA, 16 bp, H. sapiens
tgttgggaaaactgac

SEQ ID NO: 157013 - DNA, 17 bp, H. sapiens
tgttgggaacaggcccc

SEQ ID NO: 157014 - DNA, 16 bp, H. sapiens
tgttgggaacattcaa

SEQ ID NO: 157015 - DNA, 16 bp, H. sapiens
tgttgggaactggaac

SEQ ID NO: 157016 - DNA, 16 bp, H. sapiens
tgttgggagagaagct

SEQ ID NO: 157017 - DNA, 18 bp, H. sapiens
tgttgggagcaggccccc

SEQ ID NO: 157018 - DNA, 16 bp, H. sapiens
tgttgggattacagaa

SEQ ID NO: 157019 - DNA, 16 bp, H. sapiens
tgttgggcaggctggt

SEQ ID NO: 157020 - DNA, 16 bp, H. sapiens
tgttgggccacattca

SEQ ID NO: 157021 - DNA, 16 bp, H. sapiens
tgttggggaaatataa

SEQ ID NO: 157022 - DNA, 16 bp, H. sapiens
tgttggggaagggacc

SEQ ID NO: 157023 - DNA, 16 bp, H. sapiens
tgttggggatgatgaa

SEQ ID NO: 157024 - DNA, 16 bp, H. sapiens
tgttgggtactatgct

SEQ ID NO: 157025 - DNA, 16 bp, H. sapiens
tgttgggtttacaggc

SEQ ID NO: 157026 - DNA, 16 bp, H. sapiens
tgttgggttttggact

SEQ ID NO: 157027 - DNA, 16 bp, H. sapiens
tgttggtaattttaaa

SEQ ID NO: 157028 - DNA, 16 bp, H. sapiens
tgttggtatataagaa

SEQ ID NO: 157029 - DNA, 16 bp, H. sapiens
tgttggtgaagctggt

SEQ ID NO: 157030 - DNA, 16 bp, H. sapiens
tgttggtgaggagctg

SEQ ID NO: 157031 - DNA, 16 bp, H. sapiens
tgttggtgaggctgat

SEQ ID NO: 157032 - DNA, 16 bp, H. sapiens
tgttggtgatgatgtg

SEQ ID NO: 157033 - DNA, 16 bp, H. sapiens
tgttggtggactctct

SEQ ID NO: 157034 - DNA, 16 bp, H. sapiens
tgttggtgggaatata

SEQ ID NO: 157035 - DNA, 16 bp, H. sapiens
tgttggtggtattgta

SEQ ID NO: 157036 - DNA, 16 bp, H. sapiens
tgttggtgtatagcac

SEQ ID NO: 157037 - DNA, 17 bp, H. sapiens
tgttggtgtgctgcacc

SEQ ID NO: 157038 - DNA, 16 bp, H. sapiens
tgttggttccttctga

SEQ ID NO: 157039 - DNA, 16 bp, H. sapiens
tgttgtaagggttaaa

SEQ ID NO: 157040 - DNA, 16 bp, H. sapiens
tgttgtaataaacatg

SEQ ID NO: 157041 - DNA, 16 bp, H. sapiens
tgttgtacaatttaaa

SEQ ID NO: 157042 - DNA, 16 bp, H. sapiens
tgttgtacaggctggt

SEQ ID NO: 157043 - DNA, 16 bp, H. sapiens
tgttgtatgtattata

SEQ ID NO: 157044 - DNA, 16 bp, H. sapiens
tgttgtattttcagta

SEQ ID NO: 157045 - DNA, 16 bp, H. sapiens
tgttgtcacttcaaca

SEQ ID NO: 157046 - DNA, 16 bp, H. sapiens
tgttgtcatctcaaca

SEQ ID NO: 157047 - DNA, 16 bp, H. sapiens
tgttgtcattattgtt

SEQ ID NO: 157048 - DNA, 16 bp, H. sapiens
tgttgtcattgctgtt

SEQ ID NO: 157049 - DNA, 16 bp, H. sapiens
tgttgtcattgttatt

SEQ ID NO: 157050 - DNA, 16 bp, H. sapiens
tgttgtccaggatgga

SEQ ID NO: 157051 - DNA, 16 bp, H. sapiens
tgttgtccaggcagga

SEQ ID NO: 157052 - DNA, 16 bp, H. sapiens
tgttgtccatgctgga

SEQ ID NO: 157053 - DNA, 16 bp, H. sapiens
tgttgtcccagctact

SEQ ID NO: 157054 - DNA, 16 bp, H. sapiens
tgttgtctacaagaga

SEQ ID NO: 157055 - DNA, 16 bp, H. sapiens
tgttgtctgtcttctg

SEQ ID NO: 157056 - DNA, 16 bp, H. sapiens
tgttgtcttttaaaaa

SEQ ID NO: 157057 - DNA, 16 bp, H. sapiens
tgttgtgaagaataaa

SEQ ID NO: 157058 - DNA, 16 bp, H. sapiens
tgttgtgaagattaat

SEQ ID NO: 157059 - DNA, 16 bp, H. sapiens
tgttgtgaaggtattt

SEQ ID NO: 157060 - DNA, 16 bp, H. sapiens
tgttgtgaaggttaaa

SEQ ID NO: 157061 - DNA, 16 bp, H. sapiens
tgttgtgaatattttc

SEQ ID NO: 157062 - DNA, 16 bp, H. sapiens
tgttgtgctatcaaat

SEQ ID NO: 157063 - DNA, 16 bp, H. sapiens
tgttgtggatgtcctt

SEQ ID NO: 157064 - DNA, 16 bp, H. sapiens
tgttgtgggaaggacc

SEQ ID NO: 157065 - DNA, 16 bp, H. sapiens
tgttgtgggaggaacc

SEQ ID NO: 157066 - DNA, 16 bp, H. sapiens
tgttgtgggagggacc

SEQ ID NO: 157067 - DNA, 16 bp, H. sapiens
tgttgtgggaggggcc

SEQ ID NO: 157068 - DNA, 16 bp, H. sapiens
tgttgtggtggagaag

SEQ ID NO: 157069 - DNA, 16 bp, H. sapiens
tgttgtgtctcagaga

SEQ ID NO: 157070 - DNA, 16 bp, H. sapiens
tgttgtgtctcaggaa

SEQ ID NO: 157071 - DNA, 16 bp, H. sapiens
tgttgtgtctgccagg

SEQ ID NO: 157072 - DNA, 16 bp, H. sapiens
tgttgtgtgtattcaa

SEQ ID NO: 157073 - DNA, 16 bp, H. sapiens
tgttgtgtgtgtgata

SEQ ID NO: 157074 - DNA, 16 bp, H. sapiens
tgttgttattattact

SEQ ID NO: 157075 - DNA, 16 bp, H. sapiens
tgttgttcatctctta

SEQ ID NO: 157076 - DNA, 16 bp, H. sapiens
tgttgttggaaaaatg

SEQ ID NO: 157077 - DNA, 16 bp, H. sapiens
tgttgttgttactgtt

SEQ ID NO: 157078 - DNA, 16 bp, H. sapiens
tgttgttgttattgct

SEQ ID NO: 157079 - DNA, 16 bp, H. sapiens
tgttgttgttatttca

SEQ ID NO: 157080 - DNA, 16 bp, H. sapiens
tgttgttgttgtttca

SEQ ID NO: 157081 - DNA, 16 bp, H. sapiens
tgttgttgttttaaag

SEQ ID NO: 157082 - DNA, 16 bp, H. sapiens
tgttgttgttttcagc

SEQ ID NO: 157083 - DNA, 16 bp, H. sapiens
tgttgtttaagccatg

SEQ ID NO: 157084 - DNA, 16 bp, H. sapiens
tgttgtttaatttcca

SEQ ID NO: 157085 - DNA, 16 bp, H. sapiens
tgttgtttacctgaaa

SEQ ID NO: 157086 - DNA, 16 bp, H. sapiens
tgttgtttataaatga

SEQ ID NO: 157087 - DNA, 16 bp, H. sapiens
tgttgtttcatgactt

SEQ ID NO: 157088 - DNA, 16 bp, H. sapiens
tgttgttttaaaaaaa

SEQ ID NO: 157089 - DNA, 16 bp, H. sapiens
tgttgttttaagccac

SEQ ID NO: 157090 - DNA, 16 bp, H. sapiens
tgttgttttatttcca

SEQ ID NO: 157091 - DNA, 16 bp, H. sapiens
tgttgttttcttgtaa

SEQ ID NO: 157092 - DNA, 16 bp, H. sapiens
tgttgtttttcaactt

SEQ ID NO: 157093 - DNA, 16 bp, H. sapiens
tgttgtttttcaataa

SEQ ID NO: 157094 - DNA, 16 bp, H. sapiens
tgttgtttttgagaag

SEQ ID NO: 157095 - DNA, 16 bp, H. sapiens
tgtttaaaaaaaatct

SEQ ID NO: 157096 - DNA, 16 bp, H. sapiens
tgtttaaaaaaacaca

SEQ ID NO: 157097 - DNA, 16 bp, H. sapiens
tgtttaaaaaaataca

SEQ ID NO: 157098 - DNA, 16 bp, H. sapiens
tgtttaaaaaacaaaa

SEQ ID NO: 157099 - DNA, 16 bp, H. sapiens
tgtttaaaaatacaca

SEQ ID NO: 157100 - DNA, 16 bp, H. sapiens
tgtttaaaaatggaaa

SEQ ID NO: 157101 - DNA, 16 bp, H. sapiens
tgtttaaaacccttca

SEQ ID NO: 157102 - DNA, 16 bp, H. sapiens
tgtttaaaatgatatt

SEQ ID NO: 157103 - DNA, 16 bp, H. sapiens
tgtttaaaccacccag

SEQ ID NO: 157104 - DNA, 16 bp, H. sapiens
tgtttaaagaaatatt

SEQ ID NO: 157105 - DNA, 16 bp, H. sapiens
tgtttaaagaagaaaa

SEQ ID NO: 157106 - DNA, 16 bp, H. sapiens
tgtttaaatttcattt

SEQ ID NO: 157107 - DNA, 16 bp, H. sapiens
tgtttaaatttcttgt

SEQ ID NO: 157108 - DNA, 16 bp, H. sapiens
tgtttaacaaatattt

SEQ ID NO: 157109 - DNA, 16 bp, H. sapiens
tgtttaacaaccagct

SEQ ID NO: 157110 - DNA, 16 bp, H. sapiens
tgtttaacaactgact

SEQ ID NO: 157111 - DNA, 16 bp, H. sapiens
tgtttaaggaagctaa

SEQ ID NO: 157112 - DNA, 16 bp, H. sapiens
tgtttaaggaggctga

SEQ ID NO: 157113 - DNA, 16 bp, H. sapiens
tgtttaataaacattt

SEQ ID NO: 157114 - DNA, 16 bp, H. sapiens
tgtttaataaatactt

SEQ ID NO: 157115 - DNA, 16 bp, H. sapiens
tgtttaatcatttgag

SEQ ID NO: 157116 - DNA, 16 bp, H. sapiens
tgtttaatggggacag

SEQ ID NO: 157117 - DNA, 16 bp, H. sapiens
tgtttaatgttttgag

SEQ ID NO: 157118 - DNA, 16 bp, H. sapiens
tgtttaatttacatgt

SEQ ID NO: 157119 - DNA, 16 bp, H. sapiens
tgtttacatagcattt

SEQ ID NO: 157120 - DNA, 16 bp, H. sapiens
tgtttacatgtctgtc

SEQ ID NO: 157121 - DNA, 16 bp, H. sapiens
tgtttacatttaatgt

SEQ ID NO: 157122 - DNA, 16 bp, H. sapiens
tgtttacattttataa

SEQ ID NO: 157123 - DNA, 16 bp, H. sapiens
tgtttacattttctat

SEQ ID NO: 157124 - DNA, 16 bp, H. sapiens
tgtttaccaagaattt

SEQ ID NO: 157125 - DNA, 16 bp, H. sapiens
tgtttaccatttttat

SEQ ID NO: 157126 - DNA, 16 bp, H. sapiens
tgtttactaaataaat

SEQ ID NO: 157127 - DNA, 16 bp, H. sapiens
tgtttactatgtgcca

SEQ ID NO: 157128 - DNA, 16 bp, H. sapiens
tgtttactgagcatct

SEQ ID NO: 157129 - DNA, 16 bp, H. sapiens
tgtttactgaggcact

SEQ ID NO: 157130 - DNA, 16 bp, H. sapiens
tgtttactgcagcact

SEQ ID NO: 157131 - DNA, 16 bp, H. sapiens
tgtttactgcagcagt

SEQ ID NO: 157132 - DNA, 16 bp, H. sapiens
tgtttacttgaaattt

SEQ ID NO: 157133 - DNA, 16 bp, H. sapiens
tgtttactttaaaaat

SEQ ID NO: 157134 - DNA, 16 bp, H. sapiens
tgtttactttgctgat

SEQ ID NO: 157135 - DNA, 16 bp, H. sapiens
tgtttactttttaaaa

SEQ ID NO: 157136 - DNA, 16 bp, H. sapiens
tgtttacttttttaaa

SEQ ID NO: 157137 - DNA, 16 bp, H. sapiens
tgtttagaaacaaaaa

SEQ ID NO: 157138 - DNA, 16 bp, H. sapiens
tgtttagacttgggtc

SEQ ID NO: 157139 - DNA, 16 bp, H. sapiens
tgtttagagatggggt

SEQ ID NO: 157140 - DNA, 16 bp, H. sapiens
tgtttagatacacaaa

SEQ ID NO: 157141 - DNA, 16 bp, H. sapiens
tgtttagcatcttttc

SEQ ID NO: 157142 - DNA, 16 bp, H. sapiens
tgtttagctccaactt

SEQ ID NO: 157143 - DNA, 16 bp, H. sapiens
tgtttagctcccactt

SEQ ID NO: 157144 - DNA, 16 bp, H. sapiens
tgtttagctcctactt

SEQ ID NO: 157145 - DNA, 16 bp, H. sapiens
tgtttagctctcactt

SEQ ID NO: 157146 - DNA, 16 bp, H. sapiens
tgtttaggagaaagta

SEQ ID NO: 157147 - DNA, 16 bp, H. sapiens
tgtttaggtcatgaag

SEQ ID NO: 157148 - DNA, 16 bp, H. sapiens
tgtttagtagaattta

SEQ ID NO: 157149 - DNA, 16 bp, H. sapiens
tgtttagtagagatgg

SEQ ID NO: 157150 - DNA, 16 bp, H. sapiens
tgtttagtgcagccac

SEQ ID NO: 157151 - DNA, 16 bp, H. sapiens
tgtttagtttttaaag

SEQ ID NO: 157152 - DNA, 16 bp, H. sapiens
tgtttagtttttgaaa

SEQ ID NO: 157153 - DNA, 16 bp, H. sapiens
tgtttataaaatactt

SEQ ID NO: 157154 - DNA, 16 bp, H. sapiens
tgtttataataacaaa

SEQ ID NO: 157155 - DNA, 16 bp, H. sapiens
tgtttatacataaata

SEQ ID NO: 157156 - DNA, 16 bp, H. sapiens
tgtttatacattattt

SEQ ID NO: 157157 - DNA, 16 bp, H. sapiens
tgtttatatattcata

SEQ ID NO: 157158 - DNA, 16 bp, H. sapiens
tgtttatatcagcttt

SEQ ID NO: 157159 - DNA, 16 bp, H. sapiens
tgtttatatgcatata

SEQ ID NO: 157160 - DNA, 16 bp, H. sapiens
tgtttatccatgcatc

SEQ ID NO: 157161 - DNA, 16 bp, H. sapiens
tgtttatccatttgtt

SEQ ID NO: 157162 - DNA, 16 bp, H. sapiens
tgtttatctcccactt

SEQ ID NO: 157163 - DNA, 16 bp, H. sapiens
tgtttatctgaaaaag

SEQ ID NO: 157164 - DNA, 16 bp, H. sapiens
tgtttatctgaaattc

SEQ ID NO: 157165 - DNA, 16 bp, H. sapiens
tgtttatctggagaac

SEQ ID NO: 157166 - DNA, 16 bp, H. sapiens
tgtttatctgttcatt

SEQ ID NO: 157167 - DNA, 16 bp, H. sapiens
tgtttatcttgaaaac

SEQ ID NO: 157168 - DNA, 16 bp, H. sapiens
tgtttatggataggaa

SEQ ID NO: 157169 - DNA, 16 bp, H. sapiens
tgtttatggattggaa

SEQ ID NO: 157170 - DNA, 16 bp, H. sapiens
tgtttatggtattctc

SEQ ID NO: 157171 - DNA, 16 bp, H. sapiens
tgtttatggtgatgct

SEQ ID NO: 157172 - DNA, 16 bp, H. sapiens
tgtttatggtttcagg

SEQ ID NO: 157173 - DNA, 16 bp, H. sapiens
tgtttatgtagaaaat

SEQ ID NO: 157174 - DNA, 16 bp, H. sapiens
tgtttatgtatatgta

SEQ ID NO: 157175 - DNA, 16 bp, H. sapiens
tgtttatgtgatggat

SEQ ID NO: 157176 - DNA, 16 bp, H. sapiens
tgtttattaaaattca

SEQ ID NO: 157177 - DNA, 16 bp, H. sapiens
tgtttattagttccag

SEQ ID NO: 157178 - DNA, 16 bp, H. sapiens
tgtttattatcttgat

SEQ ID NO: 157179 - DNA, 16 bp, H. sapiens
tgtttattcagatctt

SEQ ID NO: 157180 - DNA, 16 bp, H. sapiens
tgtttattcagatttt

SEQ ID NO: 157181 - DNA, 16 bp, H. sapiens
tgtttattctaattag

SEQ ID NO: 157182 - DNA, 16 bp, H. sapiens
tgtttattctagttaa

SEQ ID NO: 157183 - DNA, 16 bp, H. sapiens
tgtttattctttaaaa

SEQ ID NO: 157184 - DNA, 16 bp, H. sapiens
tgtttattgaatgaat

SEQ ID NO: 157185 - DNA, 16 bp, H. sapiens
tgtttattgagcacat

SEQ ID NO: 157186 - DNA, 16 bp, H. sapiens
tgtttattgagcacct

SEQ ID NO: 157187 - DNA, 16 bp, H. sapiens
tgtttattgcagcact

SEQ ID NO: 157188 - DNA, 16 bp, H. sapiens
tgtttattgcagcatt

SEQ ID NO: 157189 - DNA, 16 bp, H. sapiens
tgtttattgctgcatt

SEQ ID NO: 157190 - DNA, 16 bp, H. sapiens
tgtttattggacattt

SEQ ID NO: 157191 - DNA, 16 bp, H. sapiens
tgtttattggctgttt

SEQ ID NO: 157192 - DNA, 16 bp, H. sapiens
tgtttattgtagaaaa

SEQ ID NO: 157193 - DNA, 16 bp, H. sapiens
tgtttattgtctgtct

SEQ ID NO: 157194 - DNA, 16 bp, H. sapiens
tgtttatttattcact

SEQ ID NO: 157195 - DNA, 16 bp, H. sapiens
tgtttatttcatttga

SEQ ID NO: 157196 - DNA, 16 bp, H. sapiens
tgtttatttccaaata

SEQ ID NO: 157197 - DNA, 16 bp, H. sapiens
tgtttatttcctctgt

SEQ ID NO: 157198 - DNA, 16 bp, H. sapiens
tgtttattttcaaata

SEQ ID NO: 157199 - DNA, 16 bp, H. sapiens
tgtttattttctcctc

SEQ ID NO: 157200 - DNA, 16 bp, H. sapiens
tgtttatttttcccat

SEQ ID NO: 157201 - DNA, 16 bp, H. sapiens
tgtttcaaaaaaaaaa

SEQ ID NO: 157202 - DNA, 16 bp, H. sapiens
tgtttcaaaaaggaaa

SEQ ID NO: 157203 - DNA, 16 bp, H. sapiens
tgtttcaaaagaagaa

SEQ ID NO: 157204 - DNA, 16 bp, H. sapiens
tgtttcaaaataaaca

SEQ ID NO: 157205 - DNA, 16 bp, H. sapiens
tgtttcaaaatatttt

SEQ ID NO: 157206 - DNA, 16 bp, H. sapiens
tgtttcaaatatttta

SEQ ID NO: 157207 - DNA, 16 bp, H. sapiens
tgtttcaacaaaactt

SEQ ID NO: 157208 - DNA, 16 bp, H. sapiens
tgtttcaacttgaaga

SEQ ID NO: 157209 - DNA, 16 bp, H. sapiens
tgtttcaagaaatttt

SEQ ID NO: 157210 - DNA, 16 bp, H. sapiens
tgtttcaattttagca

SEQ ID NO: 157211 - DNA, 16 bp, H. sapiens
tgtttcacagttctgg

SEQ ID NO: 157212 - DNA, 16 bp, H. sapiens
tgtttcaccaggagat

SEQ ID NO: 157213 - DNA, 16 bp, H. sapiens
tgtttcactcttgttg

SEQ ID NO: 157214 - DNA, 16 bp, H. sapiens
tgtttcagaaaaaaaa

SEQ ID NO: 157215 - DNA, 16 bp, H. sapiens
tgtttcagaaataaaa

SEQ ID NO: 157216 - DNA, 16 bp, H. sapiens
tgtttcagatttaaaa

SEQ ID NO: 157217 - DNA, 16 bp, H. sapiens
tgtttcagatttggga

SEQ ID NO: 157218 - DNA, 16 bp, H. sapiens
tgtttcagttactgta

SEQ ID NO: 157219 - DNA, 16 bp, H. sapiens
tgtttcagtttttgaa

SEQ ID NO: 157220 - DNA, 16 bp, H. sapiens
tgtttcatcttctgtt

SEQ ID NO: 157221 - DNA, 16 bp, H. sapiens
tgtttcatgtgtattt

SEQ ID NO: 157222 - DNA, 16 bp, H. sapiens
tgtttcattaatcttt

SEQ ID NO: 157223 - DNA, 16 bp, H. sapiens
tgtttcatttataaaa

SEQ ID NO: 157224 - DNA, 16 bp, H. sapiens
tgtttcatttatctct

SEQ ID NO: 157225 - DNA, 16 bp, H. sapiens
tgtttcatttctaatt

SEQ ID NO: 157226 - DNA, 16 bp, H. sapiens
tgtttcatttcttagt

SEQ ID NO: 157227 - DNA, 16 bp, H. sapiens
tgtttcatttgccttc

SEQ ID NO: 157228 - DNA, 16 bp, H. sapiens
tgtttcattttaatta

SEQ ID NO: 157229 - DNA, 16 bp, H. sapiens
tgtttcattttcaaaa

SEQ ID NO: 157230 - DNA, 16 bp, H. sapiens
tgtttcatttttaaaa

SEQ ID NO: 157231 - DNA, 16 bp, H. sapiens
tgtttcattttttaaa

SEQ ID NO: 157232 - DNA, 16 bp, H. sapiens
tgtttccaaaataaaa

SEQ ID NO: 157233 - DNA, 16 bp, H. sapiens
tgtttccaaactgcag

SEQ ID NO: 157234 - DNA, 16 bp, H. sapiens
tgtttccaaatacagt

SEQ ID NO: 157235 - DNA, 16 bp, H. sapiens
tgtttccaatttttaa

SEQ ID NO: 157236 - DNA, 16 bp, H. sapiens
tgtttccacatcttgg

SEQ ID NO: 157237 - DNA, 16 bp, H. sapiens
tgtttccaggaattta

SEQ ID NO: 157238 - DNA, 16 bp, H. sapiens
tgtttccatacaaatt

SEQ ID NO: 157239 - DNA, 16 bp, H. sapiens
tgtttccatctttgtg

SEQ ID NO: 157240 - DNA, 16 bp, H. sapiens
tgtttccatggaaaca

SEQ ID NO: 157241 - DNA, 16 bp, H. sapiens
tgtttccattctcccc

SEQ ID NO: 157242 - DNA, 16 bp, H. sapiens
tgtttccatttatttc

SEQ ID NO: 157243 - DNA, 16 bp, H. sapiens
tgtttccattttcctt

SEQ ID NO: 157244 - DNA, 16 bp, H. sapiens
tgtttccatttttaaa

SEQ ID NO: 157245 - DNA, 16 bp, H. sapiens
tgtttcccaaacttca

SEQ ID NO: 157246 - DNA, 16 bp, H. sapiens
tgtttcccacagtggc

SEQ ID NO: 157247 - DNA, 16 bp, H. sapiens
tgtttcccagcctggt

SEQ ID NO: 157248 - DNA, 16 bp, H. sapiens
tgtttcccaggctggc

SEQ ID NO: 157249 - DNA, 16 bp, H. sapiens
tgtttccctccatgtg

SEQ ID NO: 157250 - DNA, 16 bp, H. sapiens
tgtttcccttttcatt

SEQ ID NO: 157251 - DNA, 16 bp, H. sapiens
tgtttcctaaagaaaa

SEQ ID NO: 157252 - DNA, 16 bp, H. sapiens
tgtttcctaaattttt

SEQ ID NO: 157253 - DNA, 16 bp, H. sapiens
tgtttcctcaactgta

SEQ ID NO: 157254 - DNA, 16 bp, H. sapiens
tgtttcctcatctatg

SEQ ID NO: 157255 - DNA, 16 bp, H. sapiens
tgtttcctcatctgta

SEQ ID NO: 157256 - DNA, 16 bp, H. sapiens
tgtttcctccaaatct

SEQ ID NO: 157257 - DNA, 16 bp, H. sapiens
tgtttcctgaaatttt

SEQ ID NO: 157258 - DNA, 16 bp, H. sapiens
tgtttcctgaagtttt

SEQ ID NO: 157259 - DNA, 16 bp, H. sapiens
tgtttcctgaatttga

SEQ ID NO: 157260 - DNA, 16 bp, H. sapiens
tgtttcctgggctgga

SEQ ID NO: 157261 - DNA, 16 bp, H. sapiens
tgtttccttacatttt

SEQ ID NO: 157262 - DNA, 16 bp, H. sapiens
tgtttccttctgggca

SEQ ID NO: 157263 - DNA, 16 bp, H. sapiens
tgtttcctttgctgta

SEQ ID NO: 157264 - DNA, 16 bp, H. sapiens
tgtttcctttgctgtg

SEQ ID NO: 157265 - DNA, 16 bp, H. sapiens
tgtttccttttaaatt

SEQ ID NO: 157266 - DNA, 16 bp, H. sapiens
tgtttccttttataaa

SEQ ID NO: 157267 - DNA, 16 bp, H. sapiens
tgtttccttttcactg

SEQ ID NO: 157268 - DNA, 16 bp, H. sapiens
tgtttctaaattattt

SEQ ID NO: 157269 - DNA, 16 bp, H. sapiens
tgtttctaaattttct

SEQ ID NO: 157270 - DNA, 16 bp, H. sapiens
tgtttctaataaaaat

SEQ ID NO: 157271 - DNA, 16 bp, H. sapiens
tgtttctacaaataat

SEQ ID NO: 157272 - DNA, 16 bp, H. sapiens
tgtttctagaaattta

SEQ ID NO: 157273 - DNA, 16 bp, H. sapiens
tgtttctaggaattta

SEQ ID NO: 157274 - DNA, 16 bp, H. sapiens
tgtttctagtttttga

SEQ ID NO: 157275 - DNA, 16 bp, H. sapiens
tgtttctatgaaaaat

SEQ ID NO: 157276 - DNA, 16 bp, H. sapiens
tgtttctatgtatttg

SEQ ID NO: 157277 - DNA, 16 bp, H. sapiens
tgtttctcaaataaat

SEQ ID NO: 157278 - DNA, 16 bp, H. sapiens
tgtttctcagttattt

SEQ ID NO: 157279 - DNA, 16 bp, H. sapiens
tgtttctcattttaaa

SEQ ID NO: 157280 - DNA, 16 bp, H. sapiens
tgtttctccagttctg

SEQ ID NO: 157281 - DNA, 16 bp, H. sapiens
tgtttctctagagaat

SEQ ID NO: 157282 - DNA, 16 bp, H. sapiens
tgtttctctcaggttt

SEQ ID NO: 157283 - DNA, 18 bp, H. sapiens
tgtttctctccacccaaa

SEQ ID NO: 157284 - DNA, 16 bp, H. sapiens
tgtttctctccatttt

SEQ ID NO: 157285 - DNA, 16 bp, H. sapiens
tgtttctctctctgtg

SEQ ID NO: 157286 - DNA, 16 bp, H. sapiens
tgtttctctggaaaat

SEQ ID NO: 157287 - DNA, 16 bp, H. sapiens
tgtttctctttcactt

SEQ ID NO: 157288 - DNA, 16 bp, H. sapiens
tgtttctctttttaaa

SEQ ID NO: 157289 - DNA, 16 bp, H. sapiens
tgtttctgaaagaaaa

SEQ ID NO: 157290 - DNA, 16 bp, H. sapiens
tgtttctgacttattt

SEQ ID NO: 157291 - DNA, 16 bp, H. sapiens
tgtttctgaggaagaa

SEQ ID NO: 157292 - DNA, 16 bp, H. sapiens
tgtttctgatgagaag

SEQ ID NO: 157293 - DNA, 16 bp, H. sapiens
tgtttctgattttaat

SEQ ID NO: 157294 - DNA, 16 bp, H. sapiens
tgtttctgcagtggct

SEQ ID NO: 157295 - DNA, 16 bp, H. sapiens
tgtttctgctgagaaa

SEQ ID NO: 157296 - DNA, 16 bp, H. sapiens
tgtttctgctgctgtg

SEQ ID NO: 157297 - DNA, 16 bp, H. sapiens
tgtttctgctgttaat

SEQ ID NO: 157298 - DNA, 16 bp, H. sapiens
tgtttctgcttctgtg

SEQ ID NO: 157299 - DNA, 16 bp, H. sapiens
tgtttctggaaaaaaa

SEQ ID NO: 157300 - DNA, 16 bp, H. sapiens
tgtttctggattctct

SEQ ID NO: 157301 - DNA, 17 bp, H. sapiens
tgtttctgggtgtgtct

SEQ ID NO: 157302 - DNA, 16 bp, H. sapiens
tgtttctgggtgttgc

SEQ ID NO: 157303 - DNA, 16 bp, H. sapiens
tgtttctgtagaatct

SEQ ID NO: 157304 - DNA, 16 bp, H. sapiens
tgtttctgtatcttgg

SEQ ID NO: 157305 - DNA, 16 bp, H. sapiens
tgtttctgtctgtctg

SEQ ID NO: 157306 - DNA, 16 bp, H. sapiens
tgtttctgtgttcatt

SEQ ID NO: 157307 - DNA, 16 bp, H. sapiens
tgtttctgtttgaaga

SEQ ID NO: 157308 - DNA, 16 bp, H. sapiens
tgtttctgttttaaat

SEQ ID NO: 157309 - DNA, 16 bp, H. sapiens
tgtttcttaaaaacaa

SEQ ID NO: 157310 - DNA, 16 bp, H. sapiens
tgtttcttattttcag

SEQ ID NO: 157311 - DNA, 16 bp, H. sapiens
tgtttcttcagtttct

SEQ ID NO: 157312 - DNA, 16 bp, H. sapiens
tgtttcttctgcttga

SEQ ID NO: 157313 - DNA, 16 bp, H. sapiens
tgtttcttgaaaatat

SEQ ID NO: 157314 - DNA, 16 bp, H. sapiens
tgtttcttgaatattt

SEQ ID NO: 157315 - DNA, 16 bp, H. sapiens
tgtttcttgcttcctg

SEQ ID NO: 157316 - DNA, 16 bp, H. sapiens
tgtttctttaaaaaaa

SEQ ID NO: 157317 - DNA, 16 bp, H. sapiens
tgtttctttaaaacag

SEQ ID NO: 157318 - DNA, 16 bp, H. sapiens
tgtttctttaaattat

SEQ ID NO: 157319 - DNA, 16 bp, H. sapiens
tgtttctttatctgta

SEQ ID NO: 157320 - DNA, 16 bp, H. sapiens
tgtttctttctcagaa

SEQ ID NO: 157321 - DNA, 16 bp, H. sapiens
tgtttctttcttaaaa

SEQ ID NO: 157322 - DNA, 16 bp, H. sapiens
tgtttctttgagtctt

SEQ ID NO: 157323 - DNA, 16 bp, H. sapiens
tgtttctttgataatt

SEQ ID NO: 157324 - DNA, 16 bp, H. sapiens
tgtttctttgccatat

SEQ ID NO: 157325 - DNA, 16 bp, H. sapiens
tgtttctttgtatgtc

SEQ ID NO: 157326 - DNA, 16 bp, H. sapiens
tgtttcttttaaataa

SEQ ID NO: 157327 - DNA, 16 bp, H. sapiens
tgtttcttttcattca

SEQ ID NO: 157328 - DNA, 16 bp, H. sapiens
tgtttctttttccaaa

SEQ ID NO: 157329 - DNA, 16 bp, H. sapiens
tgtttctttttctcca

SEQ ID NO: 157330 - DNA, 16 bp, H. sapiens
tgtttgaaaacatttt

SEQ ID NO: 157331 - DNA, 16 bp, H. sapiens
tgtttgaaaataaaat

SEQ ID NO: 157332 - DNA, 16 bp, H. sapiens
tgtttgaaaattatat

SEQ ID NO: 157333 - DNA, 16 bp, H. sapiens
tgtttgaaagaattca

SEQ ID NO: 157334 - DNA, 16 bp, H. sapiens
tgtttgaagtgatgga

SEQ ID NO: 157335 - DNA, 16 bp, H. sapiens
tgtttgacttcattgt

SEQ ID NO: 157336 - DNA, 16 bp, H. sapiens
tgtttgagaaaagcag

SEQ ID NO: 157337 - DNA, 16 bp, H. sapiens
tgtttgagatgatgga

SEQ ID NO: 157338 - DNA, 16 bp, H. sapiens
tgtttgagatggagtt

SEQ ID NO: 157339 - DNA, 16 bp, H. sapiens
tgtttgagcctaggag

SEQ ID NO: 157340 - DNA, 16 bp, H. sapiens
tgtttgagctgctata

SEQ ID NO: 157341 - DNA, 16 bp, H. sapiens
tgtttgaggaaaaaaa

SEQ ID NO: 157342 - DNA, 16 bp, H. sapiens
tgtttgaggaactgaa

SEQ ID NO: 157343 - DNA, 16 bp, H. sapiens
tgtttgaggccaggag

SEQ ID NO: 157344 - DNA, 17 bp, H. sapiens
tgtttgagggccttggc

SEQ ID NO: 157345 - DNA, 16 bp, H. sapiens
tgtttgaggtgacaga

SEQ ID NO: 157346 - DNA, 16 bp, H. sapiens
tgtttgagtttttaaa

SEQ ID NO: 157347 - DNA, 16 bp, H. sapiens
tgtttgatgagaggaa

SEQ ID NO: 157348 - DNA, 16 bp, H. sapiens
tgtttgatgggcattt

SEQ ID NO: 157349 - DNA, 16 bp, H. sapiens
tgtttgatttttgaga

SEQ ID NO: 157350 - DNA, 16 bp, H. sapiens
tgtttgcatataatct

SEQ ID NO: 157351 - DNA, 16 bp, H. sapiens
tgtttgcatatgacat

SEQ ID NO: 157352 - DNA, 16 bp, H. sapiens
tgtttgcatgtgtgtg

SEQ ID NO: 157353 - DNA, 16 bp, H. sapiens
tgtttgcatttctgtt

SEQ ID NO: 157354 - DNA, 16 bp, H. sapiens
tgtttgcattttttaa

SEQ ID NO: 157355 - DNA, 16 bp, H. sapiens
tgtttgccaagctggt

SEQ ID NO: 157356 - DNA, 16 bp, H. sapiens
tgtttgccagactggt

SEQ ID NO: 157357 - DNA, 16 bp, H. sapiens
tgtttgccaggctgtt

SEQ ID NO: 157358 - DNA, 16 bp, H. sapiens
tgtttgccaggtttct

SEQ ID NO: 157359 - DNA, 16 bp, H. sapiens
tgtttgcctgtgtgtg

SEQ ID NO: 157360 - DNA, 16 bp, H. sapiens
tgtttgccttatttga

SEQ ID NO: 157361 - DNA, 16 bp, H. sapiens
tgtttgccttttaaat

SEQ ID NO: 157362 - DNA, 16 bp, H. sapiens
tgtttgctccatttta

SEQ ID NO: 157363 - DNA, 16 bp, H. sapiens
tgtttgctgaattgaa

SEQ ID NO: 157364 - DNA, 16 bp, H. sapiens
tgtttgctgagaatga

SEQ ID NO: 157365 - DNA, 16 bp, H. sapiens
tgtttgctgatgatat

SEQ ID NO: 157366 - DNA, 16 bp, H. sapiens
tgtttgctgattattt

SEQ ID NO: 157367 - DNA, 16 bp, H. sapiens
tgtttgctgcacccat

SEQ ID NO: 157368 - DNA, 16 bp, H. sapiens
tgtttgctggctgctt

SEQ ID NO: 157369 - DNA, 16 bp, H. sapiens
tgtttgctttgtggaa

SEQ ID NO: 157370 - DNA, 16 bp, H. sapiens
tgtttgcttttgagga

SEQ ID NO: 157371 - DNA, 16 bp, H. sapiens
tgtttggaacagtttc

SEQ ID NO: 157372 - DNA, 16 bp, H. sapiens
tgtttggccaggctgg

SEQ ID NO: 157373 - DNA, 16 bp, H. sapiens
tgtttggctttccatt

SEQ ID NO: 157374 - DNA, 16 bp, H. sapiens
tgtttgggatgatgaa

SEQ ID NO: 157375 - DNA, 16 bp, H. sapiens
tgtttgggtcctctct

SEQ ID NO: 157376 - DNA, 16 bp, H. sapiens
tgtttggtttcccatt

SEQ ID NO: 157377 - DNA, 16 bp, H. sapiens
tgtttggttttccact

SEQ ID NO: 157378 - DNA, 16 bp, H. sapiens
tgtttgtaaaataaat

SEQ ID NO: 157379 - DNA, 16 bp, H. sapiens
tgtttgtaaaatgaga

SEQ ID NO: 157380 - DNA, 16 bp, H. sapiens
tgtttgtaaagcactt

SEQ ID NO: 157381 - DNA, 16 bp, H. sapiens
tgtttgtaatattctc

SEQ ID NO: 157382 - DNA, 16 bp, H. sapiens
tgtttgtaccatttta

SEQ ID NO: 157383 - DNA, 16 bp, H. sapiens
tgtttgtagtagagac

SEQ ID NO: 157384 - DNA, 16 bp, H. sapiens
tgtttgtagtgatgct

SEQ ID NO: 157385 - DNA, 16 bp, H. sapiens
tgtttgtatttctgtg

SEQ ID NO: 157386 - DNA, 16 bp, H. sapiens
tgtttgtctgagaaaa

SEQ ID NO: 157387 - DNA, 16 bp, H. sapiens
tgtttgtgagatttat

SEQ ID NO: 157388 - DNA, 16 bp, H. sapiens
tgtttgtgcatgtata

SEQ ID NO: 157389 - DNA, 16 bp, H. sapiens
tgtttgtgcctgtcct

SEQ ID NO: 157390 - DNA, 16 bp, H. sapiens
tgtttgtggtactttg

SEQ ID NO: 157391 - DNA, 16 bp, H. sapiens
tgtttgtgtcatctac

SEQ ID NO: 157392 - DNA, 16 bp, H. sapiens
tgtttgtgtcatgtat

SEQ ID NO: 157393 - DNA, 16 bp, H. sapiens
tgtttgtgtcctccca

SEQ ID NO: 157394 - DNA, 16 bp, H. sapiens
tgtttgtgtgcacatg

SEQ ID NO: 157395 - DNA, 16 bp, H. sapiens
tgtttgtgtgcatatg

SEQ ID NO: 157396 - DNA, 16 bp, H. sapiens
tgtttgtgtgtacata

SEQ ID NO: 157397 - DNA, 16 bp, H. sapiens
tgtttgtgtgtgcatt

SEQ ID NO: 157398 - DNA, 16 bp, H. sapiens
tgtttgttacatggat

SEQ ID NO: 157399 - DNA, 16 bp, H. sapiens
tgtttgttataatttc

SEQ ID NO: 157400 - DNA, 16 bp, H. sapiens
tgtttgttcaattgtt

SEQ ID NO: 157401 - DNA, 16 bp, H. sapiens
tgtttgttctagttag

SEQ ID NO: 157402 - DNA, 16 bp, H. sapiens
tgtttgttgaatgaat

SEQ ID NO: 157403 - DNA, 16 bp, H. sapiens
tgtttgttggctattt

SEQ ID NO: 157404 - DNA, 16 bp, H. sapiens
tgtttgttgtttaagc

SEQ ID NO: 157405 - DNA, 16 bp, H. sapiens
tgtttgtttaaaataa

SEQ ID NO: 157406 - DNA, 16 bp, H. sapiens
tgtttgtttcatatat

SEQ ID NO: 157407 - DNA, 16 bp, H. sapiens
tgtttgtttctttaaa

SEQ ID NO: 157408 - DNA, 16 bp, H. sapiens
tgtttgttttaacaaa

SEQ ID NO: 157409 - DNA, 16 bp, H. sapiens
tgtttgttttaagaca

SEQ ID NO: 157410 - DNA, 16 bp, H. sapiens
tgtttgttttattcac

SEQ ID NO: 157411 - DNA, 16 bp, H. sapiens
tgtttgttttcattca

SEQ ID NO: 157412 - DNA, 16 bp, H. sapiens
tgtttgttttcctgta

SEQ ID NO: 157413 - DNA, 17 bp, H. sapiens
tgtttgttttgagacaa

SEQ ID NO: 157414 - DNA, 16 bp, H. sapiens
tgtttgttttgtctga

SEQ ID NO: 157415 - DNA, 16 bp, H. sapiens
tgtttgtttttaaagc

SEQ ID NO: 157416 - DNA, 16 bp, H. sapiens
tgtttgtttttaacaa

SEQ ID NO: 157417 - DNA, 16 bp, H. sapiens
tgtttgtttttcaaga

SEQ ID NO: 157418 - DNA, 16 bp, H. sapiens
tgtttgtttttgaact

SEQ ID NO: 157419 - DNA, 16 bp, H. sapiens
tgtttgtttttgggac

SEQ ID NO: 157420 - DNA, 16 bp, H. sapiens
tgtttgttttttaaac

SEQ ID NO: 157421 - DNA, 16 bp, H. sapiens
tgtttgttttttcaaa

SEQ ID NO: 157422 - DNA, 16 bp, H. sapiens
tgtttgttttttcaga

SEQ ID NO: 157423 - DNA, 16 bp, H. sapiens
tgttttaaaaaaggaa

SEQ ID NO: 157424 - DNA, 16 bp, H. sapiens
tgttttaaaaacaatt

SEQ ID NO: 157425 - DNA, 16 bp, H. sapiens
tgttttaaaaacacat

SEQ ID NO: 157426 - DNA, 16 bp, H. sapiens
tgttttaaaaacattt

SEQ ID NO: 157427 - DNA, 16 bp, H. sapiens
tgttttaaaaagcaaa

SEQ ID NO: 157428 - DNA, 16 bp, H. sapiens
tgttttaaaaatacat

SEQ ID NO: 157429 - DNA, 16 bp, H. sapiens
tgttttaaaaatgatt

SEQ ID NO: 157430 - DNA, 16 bp, H. sapiens
tgttttaaaaatgtaa

SEQ ID NO: 157431 - DNA, 16 bp, H. sapiens
tgttttaaaacaaata

SEQ ID NO: 157432 - DNA, 16 bp, H. sapiens
tgttttaaaactttaa

SEQ ID NO: 157433 - DNA, 16 bp, H. sapiens
tgttttaaaactttca

SEQ ID NO: 157434 - DNA, 16 bp, H. sapiens
tgttttaaaagaatta

SEQ ID NO: 157435 - DNA, 16 bp, H. sapiens
tgttttaaaagtgtgt

SEQ ID NO: 157436 - DNA, 16 bp, H. sapiens
tgttttaaaagtttct

SEQ ID NO: 157437 - DNA, 16 bp, H. sapiens
tgttttaaaattatct

SEQ ID NO: 157438 - DNA, 16 bp, H. sapiens
tgttttaaagtctatt

SEQ ID NO: 157439 - DNA, 16 bp, H. sapiens
tgttttaaagttaaaa

SEQ ID NO: 157440 - DNA, 16 bp, H. sapiens
tgttttaaataaaaac

SEQ ID NO: 157441 - DNA, 16 bp, H. sapiens
tgttttaaataaaaag

SEQ ID NO: 157442 - DNA, 16 bp, H. sapiens
tgttttaaataaagaa

SEQ ID NO: 157443 - DNA, 16 bp, H. sapiens
tgttttaaataagaaa

SEQ ID NO: 157444 - DNA, 16 bp, H. sapiens
tgttttaaattctgtt

SEQ ID NO: 157445 - DNA, 16 bp, H. sapiens
tgttttaactttttaa

SEQ ID NO: 157446 - DNA, 16 bp, H. sapiens
tgttttaagaaataaa

SEQ ID NO: 157447 - DNA, 16 bp, H. sapiens
tgttttaagaaattgc

SEQ ID NO: 157448 - DNA, 16 bp, H. sapiens
tgttttaagaattaaa

SEQ ID NO: 157449 - DNA, 16 bp, H. sapiens
tgttttaagcacttta

SEQ ID NO: 157450 - DNA, 16 bp, H. sapiens
tgttttaagccacaga

SEQ ID NO: 157451 - DNA, 16 bp, H. sapiens
tgttttaagccaccaa

SEQ ID NO: 157452 - DNA, 16 bp, H. sapiens
tgttttaagttctttg

SEQ ID NO: 157453 - DNA, 16 bp, H. sapiens
tgttttaataaaaaga

SEQ ID NO: 157454 - DNA, 16 bp, H. sapiens
tgttttaatacatata

SEQ ID NO: 157455 - DNA, 17 bp, H. sapiens
tgttttaattgtgatgt

SEQ ID NO: 157456 - DNA, 16 bp, H. sapiens
tgttttacaaaataaa

SEQ ID NO: 157457 - DNA, 16 bp, H. sapiens
tgttttacaattaact

SEQ ID NO: 157458 - DNA, 16 bp, H. sapiens
tgttttacagacaagg

SEQ ID NO: 157459 - DNA, 16 bp, H. sapiens
tgttttacagatgaag

SEQ ID NO: 157460 - DNA, 16 bp, H. sapiens
tgttttacagttttca

SEQ ID NO: 157461 - DNA, 16 bp, H. sapiens
tgttttacataatttt

SEQ ID NO: 157462 - DNA, 16 bp, H. sapiens
tgttttacatatttaa

SEQ ID NO: 157463 - DNA, 16 bp, H. sapiens
tgttttactgctttta

SEQ ID NO: 157464 - DNA, 16 bp, H. sapiens
tgttttacttatttaa

SEQ ID NO: 157465 - DNA, 16 bp, H. sapiens
tgttttacttctaatt

SEQ ID NO: 157466 - DNA, 16 bp, H. sapiens
tgttttactttcaatt

SEQ ID NO: 157467 - DNA, 16 bp, H. sapiens
tgttttagaaaaaata

SEQ ID NO: 157468 - DNA, 16 bp, H. sapiens
tgttttagaaaatata

SEQ ID NO: 157469 - DNA, 16 bp, H. sapiens
tgttttagagacagtg

SEQ ID NO: 157470 - DNA, 16 bp, H. sapiens
tgttttagtccatttg

SEQ ID NO: 157471 - DNA, 16 bp, H. sapiens
tgttttataaatgtga

SEQ ID NO: 157472 - DNA, 16 bp, H. sapiens
tgttttataaatgtgg

SEQ ID NO: 157473 - DNA, 16 bp, H. sapiens
tgttttatacatttat

SEQ ID NO: 157474 - DNA, 16 bp, H. sapiens
tgttttatagatgagg

SEQ ID NO: 157475 - DNA, 16 bp, H. sapiens
tgttttatagtgttca

SEQ ID NO: 157476 - DNA, 16 bp, H. sapiens
tgttttatatatgtct

SEQ ID NO: 157477 - DNA, 16 bp, H. sapiens
tgttttatcatctgta

SEQ ID NO: 157478 - DNA, 16 bp, H. sapiens
tgttttatccattatt

SEQ ID NO: 157479 - DNA, 16 bp, H. sapiens
tgttttatctgtaaaa

SEQ ID NO: 157480 - DNA, 16 bp, H. sapiens
tgttttatctttaaaa

SEQ ID NO: 157481 - DNA, 16 bp, H. sapiens
tgttttatgacttgag

SEQ ID NO: 157482 - DNA, 16 bp, H. sapiens
tgttttatgcacaaaa

SEQ ID NO: 157483 - DNA, 16 bp, H. sapiens
tgttttatgcatttgt

SEQ ID NO: 157484 - DNA, 16 bp, H. sapiens
tgttttattcaccact

SEQ ID NO: 157485 - DNA, 16 bp, H. sapiens
tgttttattcaccatt

SEQ ID NO: 157486 - DNA, 16 bp, H. sapiens
tgttttattcactgct

SEQ ID NO: 157487 - DNA, 16 bp, H. sapiens
tgttttattcatctct

SEQ ID NO: 157488 - DNA, 16 bp, H. sapiens
tgttttattgtggtaa

SEQ ID NO: 157489 - DNA, 16 bp, H. sapiens
tgttttatttaaactt

SEQ ID NO: 157490 - DNA, 16 bp, H. sapiens
tgttttattttcaaat

SEQ ID NO: 157491 - DNA, 16 bp, H. sapiens
tgttttcaaaaaatca

SEQ ID NO: 157492 - DNA, 16 bp, H. sapiens
tgttttcaaaaagcca

SEQ ID NO: 157493 - DNA, 16 bp, H. sapiens
tgttttcaaaaaggaa

SEQ ID NO: 157494 - DNA, 16 bp, H. sapiens
tgttttcaaaatgaaa

SEQ ID NO: 157495 - DNA, 16 bp, H. sapiens
tgttttcaaacaataa

SEQ ID NO: 157496 - DNA, 16 bp, H. sapiens
tgttttcaaactgctc

SEQ ID NO: 157497 - DNA, 16 bp, H. sapiens
tgttttcaaagaacat

SEQ ID NO: 157498 - DNA, 16 bp, H. sapiens
tgttttcaaatatgta

SEQ ID NO: 157499 - DNA, 16 bp, H. sapiens
tgttttcaaatttaaa

SEQ ID NO: 157500 - DNA, 16 bp, H. sapiens
tgttttcaacattttt

SEQ ID NO: 157501 - DNA, 16 bp, H. sapiens
tgttttcaagctgctg

SEQ ID NO: 157502 - DNA, 16 bp, H. sapiens
tgttttcaaggttcat

SEQ ID NO: 157503 - DNA, 16 bp, H. sapiens
tgttttcaaggtttat

SEQ ID NO: 157504 - DNA, 16 bp, H. sapiens
tgttttcaagtttctt

SEQ ID NO: 157505 - DNA, 16 bp, H. sapiens
tgttttcaagtttttg

SEQ ID NO: 157506 - DNA, 16 bp, H. sapiens
tgttttcaattctttg

SEQ ID NO: 157507 - DNA, 16 bp, H. sapiens
tgttttcaattttaaa

SEQ ID NO: 157508 - DNA, 16 bp, H. sapiens
tgttttcacaaatgac

SEQ ID NO: 157509 - DNA, 16 bp, H. sapiens
tgttttcacaagccct

SEQ ID NO: 157510 - DNA, 16 bp, H. sapiens
tgttttcagaaaaaaa

SEQ ID NO: 157511 - DNA, 16 bp, H. sapiens
tgttttcagatatttt

SEQ ID NO: 157512 - DNA, 16 bp, H. sapiens
tgttttcagatgatat

SEQ ID NO: 157513 - DNA, 16 bp, H. sapiens
tgttttcagcttttgc

SEQ ID NO: 157514 - DNA, 16 bp, H. sapiens
tgttttcagtgtttct

SEQ ID NO: 157515 - DNA, 16 bp, H. sapiens
tgttttcagttctctt

SEQ ID NO: 157516 - DNA, 16 bp, H. sapiens
tgttttcagttctttg

SEQ ID NO: 157517 - DNA, 16 bp, H. sapiens
tgttttcataattttc

SEQ ID NO: 157518 - DNA, 16 bp, H. sapiens
tgttttcatacatttt

SEQ ID NO: 157519 - DNA, 16 bp, H. sapiens
tgttttcatagttttg

SEQ ID NO: 157520 - DNA, 16 bp, H. sapiens
tgttttcatcatttaa

SEQ ID NO: 157521 - DNA, 16 bp, H. sapiens
tgttttcatctgtaaa

SEQ ID NO: 157522 - DNA, 16 bp, H. sapiens
tgttttcatcttttgg

SEQ ID NO: 157523 - DNA, 16 bp, H. sapiens
tgttttcatgataaaa

SEQ ID NO: 157524 - DNA, 16 bp, H. sapiens
tgttttcatgctgctg

SEQ ID NO: 157525 - DNA, 16 bp, H. sapiens
tgttttcatgctgctt

SEQ ID NO: 157526 - DNA, 16 bp, H. sapiens
tgttttcattatcatt

SEQ ID NO: 157527 - DNA, 16 bp, H. sapiens
tgttttcattgcattt

SEQ ID NO: 157528 - DNA, 16 bp, H. sapiens
tgttttcatttcaaaa

SEQ ID NO: 157529 - DNA, 16 bp, H. sapiens
tgttttcatttgaaaa

SEQ ID NO: 157530 - DNA, 16 bp, H. sapiens
tgttttcattttcact

SEQ ID NO: 157531 - DNA, 16 bp, H. sapiens
tgttttccaaaatgtt

SEQ ID NO: 157532 - DNA, 16 bp, H. sapiens
tgttttccaaagaaaa

SEQ ID NO: 157533 - DNA, 16 bp, H. sapiens
tgttttccaaagtgac

SEQ ID NO: 157534 - DNA, 16 bp, H. sapiens
tgttttccaaagtggt

SEQ ID NO: 157535 - DNA, 16 bp, H. sapiens
tgttttccaagttgct

SEQ ID NO: 157536 - DNA, 16 bp, H. sapiens
tgttttccaccttggt

SEQ ID NO: 157537 - DNA, 16 bp, H. sapiens
tgttttccatagtgat

SEQ ID NO: 157538 - DNA, 16 bp, H. sapiens
tgttttccattggctt

SEQ ID NO: 157539 - DNA, 16 bp, H. sapiens
tgttttccatttgtat

SEQ ID NO: 157540 - DNA, 16 bp, H. sapiens
tgttttccatttttaa

SEQ ID NO: 157541 - DNA, 16 bp, H. sapiens
tgttttcccaagtggc

SEQ ID NO: 157542 - DNA, 16 bp, H. sapiens
tgttttcccacacata

SEQ ID NO: 157543 - DNA, 16 bp, H. sapiens
tgttttcccacttgaa

SEQ ID NO: 157544 - DNA, 16 bp, H. sapiens
tgttttcctaaaatgt

SEQ ID NO: 157545 - DNA, 16 bp, H. sapiens
tgttttcctcatttca

SEQ ID NO: 157546 - DNA, 16 bp, H. sapiens
tgttttccttccaatt

SEQ ID NO: 157547 - DNA, 16 bp, H. sapiens
tgttttccttttaaaa

SEQ ID NO: 157548 - DNA, 16 bp, H. sapiens
tgttttccttttgaaa

SEQ ID NO: 157549 - DNA, 16 bp, H. sapiens
tgttttctaaaataaa

SEQ ID NO: 157550 - DNA, 16 bp, H. sapiens
tgttttctaaatattt

SEQ ID NO: 157551 - DNA, 16 bp, H. sapiens
tgttttctaagctttt

SEQ ID NO: 157552 - DNA, 16 bp, H. sapiens
tgttttctaattcatt

SEQ ID NO: 157553 - DNA, 16 bp, H. sapiens
tgttttctacaatggt

SEQ ID NO: 157554 - DNA, 16 bp, H. sapiens
tgttttctcagcattt

SEQ ID NO: 157555 - DNA, 16 bp, H. sapiens
tgttttctcatttcat

SEQ ID NO: 157556 - DNA, 16 bp, H. sapiens
tgttttctccagaaat

SEQ ID NO: 157557 - DNA, 16 bp, H. sapiens
tgttttctcctcttca

SEQ ID NO: 157558 - DNA, 16 bp, H. sapiens
tgttttctctctgaaa

SEQ ID NO: 157559 - DNA, 16 bp, H. sapiens
tgttttctcttcctta

SEQ ID NO: 157560 - DNA, 16 bp, H. sapiens
tgttttctgaacattt

SEQ ID NO: 157561 - DNA, 16 bp, H. sapiens
tgttttctgactttta

SEQ ID NO: 157562 - DNA, 16 bp, H. sapiens
tgttttctgtcttcat

SEQ ID NO: 157563 - DNA, 16 bp, H. sapiens
tgttttctgtttaaat

SEQ ID NO: 157564 - DNA, 16 bp, H. sapiens
tgttttctgttttaaa

SEQ ID NO: 157565 - DNA, 16 bp, H. sapiens
tgttttcttatttaac

SEQ ID NO: 157566 - DNA, 16 bp, H. sapiens
tgttttcttcatctgt

SEQ ID NO: 157567 - DNA, 16 bp, H. sapiens
tgttttcttctaagtg

SEQ ID NO: 157568 - DNA, 16 bp, H. sapiens
tgttttcttctgggag

SEQ ID NO: 157569 - DNA, 16 bp, H. sapiens
tgttttcttctggtag

SEQ ID NO: 157570 - DNA, 16 bp, H. sapiens
tgttttctttaataaa

SEQ ID NO: 157571 - DNA, 16 bp, H. sapiens
tgttttctttatccat

SEQ ID NO: 157572 - DNA, 16 bp, H. sapiens
tgttttctttcagaaa

SEQ ID NO: 157573 - DNA, 16 bp, H. sapiens
tgttttctttcagatt

SEQ ID NO: 157574 - DNA, 16 bp, H. sapiens
tgttttctttgaaaaa

SEQ ID NO: 157575 - DNA, 16 bp, H. sapiens
tgttttctttgaaaat

SEQ ID NO: 157576 - DNA, 16 bp, H. sapiens
tgttttctttgtaaat

SEQ ID NO: 157577 - DNA, 16 bp, H. sapiens
tgttttctttgttgaa

SEQ ID NO: 157578 - DNA, 16 bp, H. sapiens
tgttttcttttacaaa

SEQ ID NO: 157579 - DNA, 16 bp, H. sapiens
tgttttcttttctaaa

SEQ ID NO: 157580 - DNA, 16 bp, H. sapiens
tgttttcttttgaaac

SEQ ID NO: 157581 - DNA, 16 bp, H. sapiens
tgttttctttttaaaa

SEQ ID NO: 157582 - DNA, 16 bp, H. sapiens
tgttttgaaaaataca

SEQ ID NO: 157583 - DNA, 16 bp, H. sapiens
tgttttgaaaaatatg

SEQ ID NO: 157584 - DNA, 16 bp, H. sapiens
tgttttgaaaaatgaa

SEQ ID NO: 157585 - DNA, 16 bp, H. sapiens
tgttttgaaaaatgta

SEQ ID NO: 157586 - DNA, 16 bp, H. sapiens
tgttttgaaagtttaa

SEQ ID NO: 157587 - DNA, 16 bp, H. sapiens
tgttttgaaataaaat

SEQ ID NO: 157588 - DNA, 16 bp, H. sapiens
tgttttgaaatacgta

SEQ ID NO: 157589 - DNA, 16 bp, H. sapiens
tgttttgaaatctatt

SEQ ID NO: 157590 - DNA, 16 bp, H. sapiens
tgttttgaaatgtaag

SEQ ID NO: 157591 - DNA, 16 bp, H. sapiens
tgttttgaaatgtata

SEQ ID NO: 157592 - DNA, 16 bp, H. sapiens
tgttttgaaatgtgag

SEQ ID NO: 157593 - DNA, 16 bp, H. sapiens
tgttttgagacagaat

SEQ ID NO: 157594 - DNA, 16 bp, H. sapiens
tgttttgagatagagt

SEQ ID NO: 157595 - DNA, 16 bp, H. sapiens
tgttttgagatgcagt

SEQ ID NO: 157596 - DNA, 16 bp, H. sapiens
tgttttgaggattaaa

SEQ ID NO: 157597 - DNA, 16 bp, H. sapiens
tgttttgatacagggt

SEQ ID NO: 157598 - DNA, 16 bp, H. sapiens
tgttttgatacagtca

SEQ ID NO: 157599 - DNA, 16 bp, H. sapiens
tgttttgatatacatt

SEQ ID NO: 157600 - DNA, 16 bp, H. sapiens
tgttttgcaaatattt

SEQ ID NO: 157601 - DNA, 16 bp, H. sapiens
tgttttgcaaatgttt

SEQ ID NO: 157602 - DNA, 16 bp, H. sapiens
tgttttgcagagatgg

SEQ ID NO: 157603 - DNA, 16 bp, H. sapiens
tgttttgcatatttta

SEQ ID NO: 157604 - DNA, 16 bp, H. sapiens
tgttttgccatgttgc

SEQ ID NO: 157605 - DNA, 16 bp, H. sapiens
tgttttgctcattgct

SEQ ID NO: 157606 - DNA, 16 bp, H. sapiens
tgttttgctgtagcaa

SEQ ID NO: 157607 - DNA, 16 bp, H. sapiens
tgttttgctttattgc

SEQ ID NO: 157608 - DNA, 16 bp, H. sapiens
tgttttgcttttgtaa

SEQ ID NO: 157609 - DNA, 16 bp, H. sapiens
tgttttggaaatattt

SEQ ID NO: 157610 - DNA, 16 bp, H. sapiens
tgttttggccaattta

SEQ ID NO: 157611 - DNA, 16 bp, H. sapiens
tgttttgggaaaaaaa

SEQ ID NO: 157612 - DNA, 16 bp, H. sapiens
tgttttgggaaagagc

SEQ ID NO: 157613 - DNA, 19 bp, H. sapiens
tgttttggtaccagtacca

SEQ ID NO: 157614 - DNA, 16 bp, H. sapiens
tgttttggtttctata

SEQ ID NO: 157615 - DNA, 16 bp, H. sapiens
tgttttgtaaacattt

SEQ ID NO: 157616 - DNA, 16 bp, H. sapiens
tgttttgtaaataaag

SEQ ID NO: 157617 - DNA, 16 bp, H. sapiens
tgttttgtaaatgaag

SEQ ID NO: 157618 - DNA, 16 bp, H. sapiens
tgttttgtaattttca

SEQ ID NO: 157619 - DNA, 16 bp, H. sapiens
tgttttgtacttttca

SEQ ID NO: 157620 - DNA, 16 bp, H. sapiens
tgttttgtagattctt

SEQ ID NO: 157621 - DNA, 16 bp, H. sapiens
tgttttgtatatatct

SEQ ID NO: 157622 - DNA, 16 bp, H. sapiens
tgttttgtgaaacttt

SEQ ID NO: 157623 - DNA, 16 bp, H. sapiens
tgttttgtggttccat

SEQ ID NO: 157624 - DNA, 16 bp, H. sapiens
tgttttgttcaccatt

SEQ ID NO: 157625 - DNA, 16 bp, H. sapiens
tgttttgttcattgct

SEQ ID NO: 157626 - DNA, 16 bp, H. sapiens
tgttttgttcttgtaa

SEQ ID NO: 157627 - DNA, 16 bp, H. sapiens
tgttttgttgatctgt

SEQ ID NO: 157628 - DNA, 16 bp, H. sapiens
tgttttgtttaaaaag

SEQ ID NO: 157629 - DNA, 16 bp, H. sapiens
tgttttgtttactgta

SEQ ID NO: 157630 - DNA, 16 bp, H. sapiens
tgttttgtttagaaat

SEQ ID NO: 157631 - DNA, 16 bp, H. sapiens
tgttttgtttcaaaaa

SEQ ID NO: 157632 - DNA, 16 bp, H. sapiens
tgttttgtttgaaaca

SEQ ID NO: 157633 - DNA, 16 bp, H. sapiens
tgttttgttttaaatc

SEQ ID NO: 157634 - DNA, 16 bp, H. sapiens
tgttttgttttataca

SEQ ID NO: 157635 - DNA, 16 bp, H. sapiens
tgtttttaaaaaaaca

SEQ ID NO: 157636 - DNA, 16 bp, H. sapiens
tgtttttaaaaaacat

SEQ ID NO: 157637 - DNA, 16 bp, H. sapiens
tgtttttaaaaagaat

SEQ ID NO: 157638 - DNA, 16 bp, H. sapiens
tgtttttaaaaagtga

SEQ ID NO: 157639 - DNA, 16 bp, H. sapiens
tgtttttaaaaatcat

SEQ ID NO: 157640 - DNA, 16 bp, H. sapiens
tgtttttaaaaatgaa

SEQ ID NO: 157641 - DNA, 16 bp, H. sapiens
tgtttttaaaaatgta

SEQ ID NO: 157642 - DNA, 16 bp, H. sapiens
tgtttttaaaacttaa

SEQ ID NO: 157643 - DNA, 16 bp, H. sapiens
tgtttttaaaagatca

SEQ ID NO: 157644 - DNA, 16 bp, H. sapiens
tgtttttaaaagttga

SEQ ID NO: 157645 - DNA, 16 bp, H. sapiens
tgtttttaaaatacag

SEQ ID NO: 157646 - DNA, 16 bp, H. sapiens
tgtttttaaaatacat

SEQ ID NO: 157647 - DNA, 16 bp, H. sapiens
tgtttttaaaatgtca

SEQ ID NO: 157648 - DNA, 16 bp, H. sapiens
tgtttttaaactttta

SEQ ID NO: 157649 - DNA, 16 bp, H. sapiens
tgtttttaaagttcat

SEQ ID NO: 157650 - DNA, 16 bp, H. sapiens
tgtttttaaataactt

SEQ ID NO: 157651 - DNA, 16 bp, H. sapiens
tgtttttaaatagaga

SEQ ID NO: 157652 - DNA, 16 bp, H. sapiens
tgtttttaaatgaatg

SEQ ID NO: 157653 - DNA, 16 bp, H. sapiens
tgtttttaacaaaaga

SEQ ID NO: 157654 - DNA, 16 bp, H. sapiens
tgtttttaagccaccc

SEQ ID NO: 157655 - DNA, 16 bp, H. sapiens
tgtttttaataaatga

SEQ ID NO: 157656 - DNA, 16 bp, H. sapiens
tgtttttaatggcatc

SEQ ID NO: 157657 - DNA, 16 bp, H. sapiens
tgtttttaattacaaa

SEQ ID NO: 157658 - DNA, 26 bp, H. sapiens
tgtttttacctaaatcaatctggcct

SEQ ID NO: 157659 - DNA, 16 bp, H. sapiens
tgtttttagaaaatat

SEQ ID NO: 157660 - DNA, 16 bp, H. sapiens
tgtttttagaaataaa

SEQ ID NO: 157661 - DNA, 16 bp, H. sapiens
tgtttttagagatggg

SEQ ID NO: 157662 - DNA, 16 bp, H. sapiens
tgtttttagcagagac

SEQ ID NO: 157663 - DNA, 16 bp, H. sapiens
tgtttttataaaacaa

SEQ ID NO: 157664 - DNA, 16 bp, H. sapiens
tgtttttatacaaata

SEQ ID NO: 157665 - DNA, 16 bp, H. sapiens
tgtttttatatagaaa

SEQ ID NO: 157666 - DNA, 16 bp, H. sapiens
tgtttttatcattaaa

SEQ ID NO: 157667 - DNA, 16 bp, H. sapiens
tgtttttatgaagaat

SEQ ID NO: 157668 - DNA, 16 bp, H. sapiens
tgtttttatgccatta

SEQ ID NO: 157669 - DNA, 16 bp, H. sapiens
tgtttttattaaacca

SEQ ID NO: 157670 - DNA, 16 bp, H. sapiens
tgtttttattacaaaa

SEQ ID NO: 157671 - DNA, 16 bp, H. sapiens
tgtttttattagcagt

SEQ ID NO: 157672 - DNA, 16 bp, H. sapiens
tgtttttattttcaaa

SEQ ID NO: 157673 - DNA, 16 bp, H. sapiens
tgtttttcaaaatttc

SEQ ID NO: 157674 - DNA, 16 bp, H. sapiens
tgtttttcaaagtgat

SEQ ID NO: 157675 - DNA, 16 bp, H. sapiens
tgtttttcaaagtgtt

SEQ ID NO: 157676 - DNA, 16 bp, H. sapiens
tgtttttcaaatttct

SEQ ID NO: 157677 - DNA, 16 bp, H. sapiens
tgtttttcaactccat

SEQ ID NO: 157678 - DNA, 16 bp, H. sapiens
tgtttttcacttttca

SEQ ID NO: 157679 - DNA, 16 bp, H. sapiens
tgtttttcagactttt

SEQ ID NO: 157680 - DNA, 16 bp, H. sapiens
tgtttttcagatgagg

SEQ ID NO: 157681 - DNA, 16 bp, H. sapiens
tgtttttcagattctt

SEQ ID NO: 157682 - DNA, 16 bp, H. sapiens
tgtttttcagcttcat

SEQ ID NO: 157683 - DNA, 16 bp, H. sapiens
tgtttttcagttccat

SEQ ID NO: 157684 - DNA, 16 bp, H. sapiens
tgtttttcattttaaa

SEQ ID NO: 157685 - DNA, 16 bp, H. sapiens
tgtttttcctacctct

SEQ ID NO: 157686 - DNA, 16 bp, H. sapiens
tgtttttccttcagca

SEQ ID NO: 157687 - DNA, 16 bp, H. sapiens
tgtttttcctttaaaa

SEQ ID NO: 157688 - DNA, 16 bp, H. sapiens
tgtttttctaaaaaaa

SEQ ID NO: 157689 - DNA, 16 bp, H. sapiens
tgtttttctaaataaa

SEQ ID NO: 157690 - DNA, 16 bp, H. sapiens
tgtttttctagtctct

SEQ ID NO: 157691 - DNA, 16 bp, H. sapiens
tgtttttctagttcct

SEQ ID NO: 157692 - DNA, 16 bp, H. sapiens
tgtttttctatataaa

SEQ ID NO: 157693 - DNA, 16 bp, H. sapiens
tgtttttctccattct

SEQ ID NO: 157694 - DNA, 16 bp, H. sapiens
tgtttttctctttcac

SEQ ID NO: 157695 - DNA, 16 bp, H. sapiens
tgtttttctgaaaaaa

SEQ ID NO: 157696 - DNA, 16 bp, H. sapiens
tgtttttctgaaaaac

SEQ ID NO: 157697 - DNA, 16 bp, H. sapiens
tgtttttctgtacctg

SEQ ID NO: 157698 - DNA, 16 bp, H. sapiens
tgtttttcttcaaaaa

SEQ ID NO: 157699 - DNA, 16 bp, H. sapiens
tgtttttcttcaactt

SEQ ID NO: 157700 - DNA, 16 bp, H. sapiens
tgtttttcttcaataa

SEQ ID NO: 157701 - DNA, 16 bp, H. sapiens
tgtttttcttcataaa

SEQ ID NO: 157702 - DNA, 16 bp, H. sapiens
tgtttttcttccaaat

SEQ ID NO: 157703 - DNA, 16 bp, H. sapiens
tgtttttcttctgtga

SEQ ID NO: 157704 - DNA, 16 bp, H. sapiens
tgtttttcttgaaatt

SEQ ID NO: 157705 - DNA, 16 bp, H. sapiens
tgtttttcttttaaaa

SEQ ID NO: 157706 - DNA, 16 bp, H. sapiens
tgtttttgaaaaataa

SEQ ID NO: 157707 - DNA, 16 bp, H. sapiens
tgtttttgaaaaatta

SEQ ID NO: 157708 - DNA, 16 bp, H. sapiens
tgtttttgaaaatcat

SEQ ID NO: 157709 - DNA, 16 bp, H. sapiens
tgtttttgaagaatct

SEQ ID NO: 157710 - DNA, 16 bp, H. sapiens
tgtttttgaagttcat

SEQ ID NO: 157711 - DNA, 19 bp, H. sapiens
tgtttttgagacagagttt

SEQ ID NO: 157712 - DNA, 16 bp, H. sapiens
tgtttttgagacagtg

SEQ ID NO: 157713 - DNA, 16 bp, H. sapiens
tgtttttgatatggag

SEQ ID NO: 157714 - DNA, 16 bp, H. sapiens
tgtttttgattttaca

SEQ ID NO: 157715 - DNA, 16 bp, H. sapiens
tgtttttgcaaataaa

SEQ ID NO: 157716 - DNA, 16 bp, H. sapiens
tgtttttgcaattgtg

SEQ ID NO: 157717 - DNA, 16 bp, H. sapiens
tgtttttgcttttcaa

SEQ ID NO: 157718 - DNA, 16 bp, H. sapiens
tgtttttggatgaaat

SEQ ID NO: 157719 - DNA, 16 bp, H. sapiens
tgtttttggccaggca

SEQ ID NO: 157720 - DNA, 16 bp, H. sapiens
tgtttttgtagaaaca

SEQ ID NO: 157721 - DNA, 16 bp, H. sapiens
tgtttttgtatcaata

SEQ ID NO: 157722 - DNA, 16 bp, H. sapiens
tgtttttgtcagtttg

SEQ ID NO: 157723 - DNA, 16 bp, H. sapiens
tgtttttgtctttgaa

SEQ ID NO: 157724 - DNA, 16 bp, H. sapiens
tgtttttgtggtagca

SEQ ID NO: 157725 - DNA, 16 bp, H. sapiens
tgtttttgtggtggca

SEQ ID NO: 157726 - DNA, 16 bp, H. sapiens
tgttttttaaaaaagc

SEQ ID NO: 157727 - DNA, 16 bp, H. sapiens
tgttttttaaaaagaa

SEQ ID NO: 157728 - DNA, 16 bp, H. sapiens
tgttttttaaaatctt

SEQ ID NO: 157729 - DNA, 16 bp, H. sapiens
tgttttttaaggtaaa

SEQ ID NO: 157730 - DNA, 16 bp, H. sapiens
tgttttttcagacagg

SEQ ID NO: 157731 - DNA, 16 bp, H. sapiens
tgttttttcttaaaat

SEQ ID NO: 157732 - DNA, 16 bp, H. sapiens
tgttttttgaaaagat

SEQ ID NO: 157733 - DNA, 16 bp, H. sapiens
tgttttttgagaaaaa

SEQ ID NO: 157734 - DNA, 16 bp, H. sapiens
tgttttttgagagagt

SEQ ID NO: 157735 - DNA, 21 bp, H. sapiens
tgttttttgagatggagtttc

SEQ ID NO: 157736 - DNA, 16 bp, H. sapiens
tgttttttggataaaa

SEQ ID NO: 157737 - DNA, 16 bp, H. sapiens
tgttttttggctacat

SEQ ID NO: 157738 - DNA, 16 bp, H. sapiens
tgttttttgtcattgg

SEQ ID NO: 157739 - DNA, 16 bp, H. sapiens
tgtttttttaaaaaca

SEQ ID NO: 157740 - DNA, 16 bp, H. sapiens
tgtttttttaatgaga

SEQ ID NO: 157741 - DNA, 16 bp, H. sapiens
tgtttttttcccctta

SEQ ID NO: 157742 - DNA, 16 bp, H. sapiens
tgtttttttcctgata

SEQ ID NO: 157743 - DNA, 16 bp, H. sapiens
tgtttttttctaaaaa

SEQ ID NO: 157744 - DNA, 16 bp, H. sapiens
tgtttttttctgagat

SEQ ID NO: 157745 - DNA, 16 bp, H. sapiens
tgtttttttctggaga

SEQ ID NO: 157746 - DNA, 16 bp, H. sapiens
tgtttttttgcttagg

SEQ ID NO: 157747 - DNA, 16 bp, H. sapiens
tgttttttttccccca

SEQ ID NO: 157748 - DNA, 16 bp, H. sapiens
tgttttttttctggag

SEQ ID NO: 157749 - DNA, 16 bp, H. sapiens
ttaaaaaaaaatctag

SEQ ID NO: 157750 - DNA, 16 bp, H. sapiens
ttaaaaaaaactttgt

SEQ ID NO: 157751 - DNA, 16 bp, H. sapiens
ttaaaaaaaagtcttt

SEQ ID NO: 157752 - DNA, 16 bp, H. sapiens
ttaaaaaaaatccatg

SEQ ID NO: 157753 - DNA, 16 bp, H. sapiens
ttaaaaaaaatctctt

SEQ ID NO: 157754 - DNA, 16 bp, H. sapiens
ttaaaaaaaatctgta

SEQ ID NO: 157755 - DNA, 16 bp, H. sapiens
ttaaaaaaacaaattg

SEQ ID NO: 157756 - DNA, 16 bp, H. sapiens
ttaaaaaaacaagttt

SEQ ID NO: 157757 - DNA, 16 bp, H. sapiens
ttaaaaaaacagttaa

SEQ ID NO: 157758 - DNA, 16 bp, H. sapiens
ttaaaaaaactgcttt

SEQ ID NO: 157759 - DNA, 16 bp, H. sapiens
ttaaaaaaagacatat

SEQ ID NO: 157760 - DNA, 16 bp, H. sapiens
ttaaaaaaagatacat

SEQ ID NO: 157761 - DNA, 16 bp, H. sapiens
ttaaaaaaagtgtttg

SEQ ID NO: 157762 - DNA, 16 bp, H. sapiens
ttaaaaaaataacagt

SEQ ID NO: 157763 - DNA, 16 bp, H. sapiens
ttaaaaaaatagctgg

SEQ ID NO: 157764 - DNA, 16 bp, H. sapiens
ttaaaaaaatagcttt

SEQ ID NO: 157765 - DNA, 16 bp, H. sapiens
ttaaaaaaatatgtac

SEQ ID NO: 157766 - DNA, 16 bp, H. sapiens
ttaaaaaaatcaagat

SEQ ID NO: 157767 - DNA, 16 bp, H. sapiens
ttaaaaaaatcagatt

SEQ ID NO: 157768 - DNA, 16 bp, H. sapiens
ttaaaaaaatcagtga

SEQ ID NO: 157769 - DNA, 16 bp, H. sapiens
ttaaaaaaatccttct

SEQ ID NO: 157770 - DNA, 16 bp, H. sapiens
ttaaaaaaatctaaag

SEQ ID NO: 157771 - DNA, 16 bp, H. sapiens
ttaaaaaaatctattc

SEQ ID NO: 157772 - DNA, 16 bp, H. sapiens
ttaaaaaaatgaacat

SEQ ID NO: 157773 - DNA, 16 bp, H. sapiens
ttaaaaaaattatgcc

SEQ ID NO: 157774 - DNA, 16 bp, H. sapiens
ttaaaaaaattctctg

SEQ ID NO: 157775 - DNA, 16 bp, H. sapiens
ttaaaaaaattctgct

SEQ ID NO: 157776 - DNA, 16 bp, H. sapiens
ttaaaaaaattgtatc

SEQ ID NO: 157777 - DNA, 16 bp, H. sapiens
ttaaaaaacaagattt

SEQ ID NO: 157778 - DNA, 16 bp, H. sapiens
ttaaaaaacagcttta

SEQ ID NO: 157779 - DNA, 16 bp, H. sapiens
ttaaaaaacagttttg

SEQ ID NO: 157780 - DNA, 16 bp, H. sapiens
ttaaaaaacattgatt

SEQ ID NO: 157781 - DNA, 16 bp, H. sapiens
ttaaaaaacattttca

SEQ ID NO: 157782 - DNA, 16 bp, H. sapiens
ttaaaaaactagagaa

SEQ ID NO: 157783 - DNA, 16 bp, H. sapiens
ttaaaaaactgacaat

SEQ ID NO: 157784 - DNA, 16 bp, H. sapiens
ttaaaaaagaaaatct

SEQ ID NO: 157785 - DNA, 16 bp, H. sapiens
ttaaaaaagaaagcat

SEQ ID NO: 157786 - DNA, 16 bp, H. sapiens
ttaaaaaagaaatctg

SEQ ID NO: 157787 - DNA, 16 bp, H. sapiens
ttaaaaaagcatattt

SEQ ID NO: 157788 - DNA, 16 bp, H. sapiens
ttaaaaaagtaaaatc

SEQ ID NO: 157789 - DNA, 16 bp, H. sapiens
ttaaaaaagttttcta

SEQ ID NO: 157790 - DNA, 16 bp, H. sapiens
ttaaaaaagtttttgt

SEQ ID NO: 157791 - DNA, 16 bp, H. sapiens
ttaaaaaataagcaat

SEQ ID NO: 157792 - DNA, 16 bp, H. sapiens
ttaaaaaataatacag

SEQ ID NO: 157793 - DNA, 16 bp, H. sapiens
ttaaaaaatactttgt

SEQ ID NO: 157794 - DNA, 16 bp, H. sapiens
ttaaaaaatagacatt

SEQ ID NO: 157795 - DNA, 16 bp, H. sapiens
ttaaaaaatagagttt

SEQ ID NO: 157796 - DNA, 16 bp, H. sapiens
ttaaaaaatatgtcaa

SEQ ID NO: 157797 - DNA, 16 bp, H. sapiens
ttaaaaaatatgtgta

SEQ ID NO: 157798 - DNA, 16 bp, H. sapiens
ttaaaaaatcaaattg

SEQ ID NO: 157799 - DNA, 16 bp, H. sapiens
ttaaaaaatcaccttt

SEQ ID NO: 157800 - DNA, 16 bp, H. sapiens
ttaaaaaatcagaata

SEQ ID NO: 157801 - DNA, 16 bp, H. sapiens
ttaaaaaatcagtttg

SEQ ID NO: 157802 - DNA, 16 bp, H. sapiens
ttaaaaaatcattttc

SEQ ID NO: 157803 - DNA, 16 bp, H. sapiens
ttaaaaaatctcttct

SEQ ID NO: 157804 - DNA, 16 bp, H. sapiens
ttaaaaaatcttttga

SEQ ID NO: 157805 - DNA, 16 bp, H. sapiens
ttaaaaaatgaaaact

SEQ ID NO: 157806 - DNA, 16 bp, H. sapiens
ttaaaaaatgactcat

SEQ ID NO: 157807 - DNA, 16 bp, H. sapiens
ttaaaaaatgagtttg

SEQ ID NO: 157808 - DNA, 16 bp, H. sapiens
ttaaaaaatgctttat

SEQ ID NO: 157809 - DNA, 16 bp, H. sapiens
ttaaaaaatgttaact

SEQ ID NO: 157810 - DNA, 16 bp, H. sapiens
ttaaaaaatgttactt

SEQ ID NO: 157811 - DNA, 16 bp, H. sapiens
ttaaaaaatgtttttc

SEQ ID NO: 157812 - DNA, 16 bp, H. sapiens
ttaaaaaattacaaag

SEQ ID NO: 157813 - DNA, 16 bp, H. sapiens
ttaaaaaattacttct

SEQ ID NO: 157814 - DNA, 16 bp, H. sapiens
ttaaaaaattagctgg

SEQ ID NO: 157815 - DNA, 16 bp, H. sapiens
ttaaaaaattatccag

SEQ ID NO: 157816 - DNA, 16 bp, H. sapiens
ttaaaaaattatctga

SEQ ID NO: 157817 - DNA, 16 bp, H. sapiens
ttaaaaaattatttcc

SEQ ID NO: 157818 - DNA, 16 bp, H. sapiens
ttaaaaaattcaaagt

SEQ ID NO: 157819 - DNA, 16 bp, H. sapiens
ttaaaaaattgttaag

SEQ ID NO: 157820 - DNA, 16 bp, H. sapiens
ttaaaaacaaaagatt

SEQ ID NO: 157821 - DNA, 16 bp, H. sapiens
ttaaaaacaaaggtaa

SEQ ID NO: 157822 - DNA, 16 bp, H. sapiens
ttaaaaacaaatcttt

SEQ ID NO: 157823 - DNA, 16 bp, H. sapiens
ttaaaaacaaattttc

SEQ ID NO: 157824 - DNA, 16 bp, H. sapiens
ttaaaaacaacatttt

SEQ ID NO: 157825 - DNA, 16 bp, H. sapiens
ttaaaaacaaggaaat

SEQ ID NO: 157826 - DNA, 16 bp, H. sapiens
ttaaaaacaatttctt

SEQ ID NO: 157827 - DNA, 16 bp, H. sapiens
ttaaaaacacagattt

SEQ ID NO: 157828 - DNA, 16 bp, H. sapiens
ttaaaaacacagtttt

SEQ ID NO: 157829 - DNA, 16 bp, H. sapiens
ttaaaaacacatacac

SEQ ID NO: 157830 - DNA, 16 bp, H. sapiens
ttaaaaacaggagttt

SEQ ID NO: 157831 - DNA, 16 bp, H. sapiens
ttaaaaacatactttt

SEQ ID NO: 157832 - DNA, 16 bp, H. sapiens
ttaaaaacatgaattt

SEQ ID NO: 157833 - DNA, 16 bp, H. sapiens
ttaaaaacatgtttat

SEQ ID NO: 157834 - DNA, 16 bp, H. sapiens
ttaaaaacattcattt

SEQ ID NO: 157835 - DNA, 16 bp, H. sapiens
ttaaaaaccctcaaaa

SEQ ID NO: 157836 - DNA, 16 bp, H. sapiens
ttaaaaacctgcattt

SEQ ID NO: 157837 - DNA, 16 bp, H. sapiens
ttaaaaactaacattt

SEQ ID NO: 157838 - DNA, 16 bp, H. sapiens
ttaaaaactagatttt

SEQ ID NO: 157839 - DNA, 16 bp, H. sapiens
ttaaaaactattttga

SEQ ID NO: 157840 - DNA, 16 bp, H. sapiens
ttaaaaactgaaaaat

SEQ ID NO: 157841 - DNA, 16 bp, H. sapiens
ttaaaaactgaaaatg

SEQ ID NO: 157842 - DNA, 16 bp, H. sapiens
ttaaaaactggtaaat

SEQ ID NO: 157843 - DNA, 16 bp, H. sapiens
ttaaaaacttctgtgc

SEQ ID NO: 157844 - DNA, 16 bp, H. sapiens
ttaaaaacttttttga

SEQ ID NO: 157845 - DNA, 16 bp, H. sapiens
ttaaaaagaaaacatt

SEQ ID NO: 157846 - DNA, 16 bp, H. sapiens
ttaaaaagaaaacttt

SEQ ID NO: 157847 - DNA, 16 bp, H. sapiens
ttaaaaagaaaagtct

SEQ ID NO: 157848 - DNA, 16 bp, H. sapiens
ttaaaaagaaaattct

SEQ ID NO: 157849 - DNA, 16 bp, H. sapiens
ttaaaaagaaattctg

SEQ ID NO: 157850 - DNA, 16 bp, H. sapiens
ttaaaaagaacataat

SEQ ID NO: 157851 - DNA, 16 bp, H. sapiens
ttaaaaagaacattat

SEQ ID NO: 157852 - DNA, 16 bp, H. sapiens
ttaaaaagaacattta

SEQ ID NO: 157853 - DNA, 16 bp, H. sapiens
ttaaaaagacacacac

SEQ ID NO: 157854 - DNA, 16 bp, H. sapiens
ttaaaaagatatttct

SEQ ID NO: 157855 - DNA, 16 bp, H. sapiens
ttaaaaagattattca

SEQ ID NO: 157856 - DNA, 16 bp, H. sapiens
ttaaaaagattatttg

SEQ ID NO: 157857 - DNA, 16 bp, H. sapiens
ttaaaaagcaagagaa

SEQ ID NO: 157858 - DNA, 16 bp, H. sapiens
ttaaaaagcattatta

SEQ ID NO: 157859 - DNA, 16 bp, H. sapiens
ttaaaaagctaaagaa

SEQ ID NO: 157860 - DNA, 16 bp, H. sapiens
ttaaaaagctttagag

SEQ ID NO: 157861 - DNA, 16 bp, H. sapiens
ttaaaaaggaaaatca

SEQ ID NO: 157862 - DNA, 16 bp, H. sapiens
ttaaaaaggaaacaga

SEQ ID NO: 157863 - DNA, 16 bp, H. sapiens
ttaaaaaggaaatgat

SEQ ID NO: 157864 - DNA, 16 bp, H. sapiens
ttaaaaaggaagcaga

SEQ ID NO: 157865 - DNA, 16 bp, H. sapiens
ttaaaaaggaaggcaa

SEQ ID NO: 157866 - DNA, 16 bp, H. sapiens
ttaaaaaggaatttta

SEQ ID NO: 157867 - DNA, 16 bp, H. sapiens
ttaaaaaggctttaga

SEQ ID NO: 157868 - DNA, 16 bp, H. sapiens
ttaaaaaggttatttt

SEQ ID NO: 157869 - DNA, 16 bp, H. sapiens
ttaaaaagtaaaactt

SEQ ID NO: 157870 - DNA, 16 bp, H. sapiens
ttaaaaagtacataaa

SEQ ID NO: 157871 - DNA, 16 bp, H. sapiens
ttaaaaagtactttaa

SEQ ID NO: 157872 - DNA, 16 bp, H. sapiens
ttaaaaagtagaaatg

SEQ ID NO: 157873 - DNA, 16 bp, H. sapiens
ttaaaaagtagaattt

SEQ ID NO: 157874 - DNA, 16 bp, H. sapiens
ttaaaaagtcaaattc

SEQ ID NO: 157875 - DNA, 16 bp, H. sapiens
ttaaaaagtcaaattt

SEQ ID NO: 157876 - DNA, 16 bp, H. sapiens
ttaaaaagtcaacatt

SEQ ID NO: 157877 - DNA, 16 bp, H. sapiens
ttaaaaagtcaattat

SEQ ID NO: 157878 - DNA, 16 bp, H. sapiens
ttaaaaagtcttattt

SEQ ID NO: 157879 - DNA, 16 bp, H. sapiens
ttaaaaagtgaaagtt

SEQ ID NO: 157880 - DNA, 16 bp, H. sapiens
ttaaaaagtgattttt

SEQ ID NO: 157881 - DNA, 16 bp, H. sapiens
ttaaaaagtggtaaat

SEQ ID NO: 157882 - DNA, 16 bp, H. sapiens
ttaaaaagttaggaaa

SEQ ID NO: 157883 - DNA, 16 bp, H. sapiens
ttaaaaagttatttca

SEQ ID NO: 157884 - DNA, 16 bp, H. sapiens
ttaaaaagttcaacat

SEQ ID NO: 157885 - DNA, 16 bp, H. sapiens
ttaaaaagttccaaaa

SEQ ID NO: 157886 - DNA, 16 bp, H. sapiens
ttaaaaagttgatttc

SEQ ID NO: 157887 - DNA, 16 bp, H. sapiens
ttaaaaagttggaaaa

SEQ ID NO: 157888 - DNA, 16 bp, H. sapiens
ttaaaaagtttacaaa

SEQ ID NO: 157889 - DNA, 16 bp, H. sapiens
ttaaaaagttttctgt

SEQ ID NO: 157890 - DNA, 16 bp, H. sapiens
ttaaaaagtttttttc

SEQ ID NO: 157891 - DNA, 16 bp, H. sapiens
ttaaaaataacagttt

SEQ ID NO: 157892 - DNA, 16 bp, H. sapiens
ttaaaaataactagaa

SEQ ID NO: 157893 - DNA, 16 bp, H. sapiens
ttaaaaataactcatt

SEQ ID NO: 157894 - DNA, 16 bp, H. sapiens
ttaaaaataagagttt

SEQ ID NO: 157895 - DNA, 16 bp, H. sapiens
ttaaaaataagcattt

SEQ ID NO: 157896 - DNA, 16 bp, H. sapiens
ttaaaaataattccat

SEQ ID NO: 157897 - DNA, 16 bp, H. sapiens
ttaaaaataattctct

SEQ ID NO: 157898 - DNA, 16 bp, H. sapiens
ttaaaaataattcttg

SEQ ID NO: 157899 - DNA, 16 bp, H. sapiens
ttaaaaataatttcag

SEQ ID NO: 157900 - DNA, 16 bp, H. sapiens
ttaaaaataattttgg

SEQ ID NO: 157901 - DNA, 16 bp, H. sapiens
ttaaaaatacaaatgt

SEQ ID NO: 157902 - DNA, 16 bp, H. sapiens
ttaaaaatacaatttc

SEQ ID NO: 157903 - DNA, 16 bp, H. sapiens
ttaaaaatacacattt

SEQ ID NO: 157904 - DNA, 16 bp, H. sapiens
ttaaaaatacagaaat

SEQ ID NO: 157905 - DNA, 16 bp, H. sapiens
ttaaaaatacagattc

SEQ ID NO: 157906 - DNA, 16 bp, H. sapiens
ttaaaaatacatatct

SEQ ID NO: 157907 - DNA, 16 bp, H. sapiens
ttaaaaatactgaatt

SEQ ID NO: 157908 - DNA, 16 bp, H. sapiens
ttaaaaatacttctat

SEQ ID NO: 157909 - DNA, 16 bp, H. sapiens
ttaaaaatactttgta

SEQ ID NO: 157910 - DNA, 16 bp, H. sapiens
ttaaaaatagactttg

SEQ ID NO: 157911 - DNA, 16 bp, H. sapiens
ttaaaaataggctttt

SEQ ID NO: 157912 - DNA, 16 bp, H. sapiens
ttaaaaatatacctat

SEQ ID NO: 157913 - DNA, 16 bp, H. sapiens
ttaaaaatatagcatt

SEQ ID NO: 157914 - DNA, 16 bp, H. sapiens
ttaaaaatatatttcc

SEQ ID NO: 157915 - DNA, 16 bp, H. sapiens
ttaaaaatatcttcaa

SEQ ID NO: 157916 - DNA, 16 bp, H. sapiens
ttaaaaatatgcagaa

SEQ ID NO: 157917 - DNA, 16 bp, H. sapiens
ttaaaaatatgtatac

SEQ ID NO: 157918 - DNA, 16 bp, H. sapiens
ttaaaaatattcagca

SEQ ID NO: 157919 - DNA, 16 bp, H. sapiens
ttaaaaatattctgta

SEQ ID NO: 157920 - DNA, 16 bp, H. sapiens
ttaaaaatattgcttt

SEQ ID NO: 157921 - DNA, 16 bp, H. sapiens
ttaaaaatattgtaca

SEQ ID NO: 157922 - DNA, 16 bp, H. sapiens
ttaaaaatattttctg

SEQ ID NO: 157923 - DNA, 16 bp, H. sapiens
ttaaaaatcaaactgc

SEQ ID NO: 157924 - DNA, 16 bp, H. sapiens
ttaaaaatcaaaggaa

SEQ ID NO: 157925 - DNA, 16 bp, H. sapiens
ttaaaaatcaagaaat

SEQ ID NO: 157926 - DNA, 16 bp, H. sapiens
ttaaaaatcaagataa

SEQ ID NO: 157927 - DNA, 16 bp, H. sapiens
ttaaaaatcaatgtaa

SEQ ID NO: 157928 - DNA, 16 bp, H. sapiens
ttaaaaatcacagttt

SEQ ID NO: 157929 - DNA, 16 bp, H. sapiens
ttaaaaatcacatttt

SEQ ID NO: 157930 - DNA, 16 bp, H. sapiens
ttaaaaatcagctttt

SEQ ID NO: 157931 - DNA, 16 bp, H. sapiens
ttaaaaatcatgtttt

SEQ ID NO: 157932 - DNA, 16 bp, H. sapiens
ttaaaaatctagaaaa

SEQ ID NO: 157933 - DNA, 16 bp, H. sapiens
ttaaaaatctggtttt

SEQ ID NO: 157934 - DNA, 16 bp, H. sapiens
ttaaaaatctgtaaat

SEQ ID NO: 157935 - DNA, 16 bp, H. sapiens
ttaaaaatctgtaaga

SEQ ID NO: 157936 - DNA, 16 bp, H. sapiens
ttaaaaatcttgtttt

SEQ ID NO: 157937 - DNA, 16 bp, H. sapiens
ttaaaaatcttttcct

SEQ ID NO: 157938 - DNA, 16 bp, H. sapiens
ttaaaaatcttttgaa

SEQ ID NO: 157939 - DNA, 16 bp, H. sapiens
ttaaaaatgaaaacta

SEQ ID NO: 157940 - DNA, 16 bp, H. sapiens
ttaaaaatgaaagcat

SEQ ID NO: 157941 - DNA, 16 bp, H. sapiens
ttaaaaatgaaattgt

SEQ ID NO: 157942 - DNA, 16 bp, H. sapiens
ttaaaaatgaacattt

SEQ ID NO: 157943 - DNA, 16 bp, H. sapiens
ttaaaaatgaagattt

SEQ ID NO: 157944 - DNA, 16 bp, H. sapiens
ttaaaaatgaaggaga

SEQ ID NO: 157945 - DNA, 16 bp, H. sapiens
ttaaaaatgacaataa

SEQ ID NO: 157946 - DNA, 16 bp, H. sapiens
ttaaaaatgacacaaa

SEQ ID NO: 157947 - DNA, 16 bp, H. sapiens
ttaaaaatgagaacac

SEQ ID NO: 157948 - DNA, 16 bp, H. sapiens
ttaaaaatgaggaaac

SEQ ID NO: 157949 - DNA, 16 bp, H. sapiens
ttaaaaatgagtttta

SEQ ID NO: 157950 - DNA, 16 bp, H. sapiens
ttaaaaatgatgtttt

SEQ ID NO: 157951 - DNA, 16 bp, H. sapiens
ttaaaaatgattttgt

SEQ ID NO: 157952 - DNA, 16 bp, H. sapiens
ttaaaaatgcagatta

SEQ ID NO: 157953 - DNA, 16 bp, H. sapiens
ttaaaaatgcatataa

SEQ ID NO: 157954 - DNA, 16 bp, H. sapiens
ttaaaaatgcattaaa

SEQ ID NO: 157955 - DNA, 16 bp, H. sapiens
ttaaaaatgcattctt

SEQ ID NO: 157956 - DNA, 16 bp, H. sapiens
ttaaaaatgcatttaa

SEQ ID NO: 157957 - DNA, 16 bp, H. sapiens
ttaaaaatgcttattt

SEQ ID NO: 157958 - DNA, 16 bp, H. sapiens
ttaaaaatgcttcaaa

SEQ ID NO: 157959 - DNA, 16 bp, H. sapiens
ttaaaaatgctttatt

SEQ ID NO: 157960 - DNA, 16 bp, H. sapiens
ttaaaaatggttagga

SEQ ID NO: 157961 - DNA, 16 bp, H. sapiens
ttaaaaatggttttct

SEQ ID NO: 157962 - DNA, 16 bp, H. sapiens
ttaaaaatgtaaatgt

SEQ ID NO: 157963 - DNA, 16 bp, H. sapiens
ttaaaaatgtatgttg

SEQ ID NO: 157964 - DNA, 16 bp, H. sapiens
ttaaaaatgtattgag

SEQ ID NO: 157965 - DNA, 16 bp, H. sapiens
ttaaaaatgtatttag

SEQ ID NO: 157966 - DNA, 16 bp, H. sapiens
ttaaaaatgtcatata

SEQ ID NO: 157967 - DNA, 16 bp, H. sapiens
ttaaaaatgtctttag

SEQ ID NO: 157968 - DNA, 16 bp, H. sapiens
ttaaaaatgtcttttt

SEQ ID NO: 157969 - DNA, 16 bp, H. sapiens
ttaaaaatgtgaaaca

SEQ ID NO: 157970 - DNA, 16 bp, H. sapiens
ttaaaaatgtgaaatg

SEQ ID NO: 157971 - DNA, 16 bp, H. sapiens
ttaaaaatgtgaattt

SEQ ID NO: 157972 - DNA, 16 bp, H. sapiens
ttaaaaatgttaaaac

SEQ ID NO: 157973 - DNA, 16 bp, H. sapiens
ttaaaaatgttcattt

SEQ ID NO: 157974 - DNA, 16 bp, H. sapiens
ttaaaaatgttctttc

SEQ ID NO: 157975 - DNA, 16 bp, H. sapiens
ttaaaaatgtttaaga

SEQ ID NO: 157976 - DNA, 16 bp, H. sapiens
ttaaaaatgtttcatt

SEQ ID NO: 157977 - DNA, 16 bp, H. sapiens
ttaaaaatgtttctaa

SEQ ID NO: 157978 - DNA, 16 bp, H. sapiens
ttaaaaatgtttctgg

SEQ ID NO: 157979 - DNA, 16 bp, H. sapiens
ttaaaaatgttttaac

SEQ ID NO: 157980 - DNA, 16 bp, H. sapiens
ttaaaaatgtttttct

SEQ ID NO: 157981 - DNA, 16 bp, H. sapiens
ttaaaaattaaatgtg

SEQ ID NO: 157982 - DNA, 16 bp, H. sapiens
ttaaaaattacagttt

SEQ ID NO: 157983 - DNA, 16 bp, H. sapiens
ttaaaaattagaactt

SEQ ID NO: 157984 - DNA, 16 bp, H. sapiens
ttaaaaattagccaaa

SEQ ID NO: 157985 - DNA, 16 bp, H. sapiens
ttaaaaattatagcat

SEQ ID NO: 157986 - DNA, 16 bp, H. sapiens
ttaaaaattatgttct

SEQ ID NO: 157987 - DNA, 16 bp, H. sapiens
ttaaaaattatgttgt

SEQ ID NO: 157988 - DNA, 16 bp, H. sapiens
ttaaaaattcactttt

SEQ ID NO: 157989 - DNA, 16 bp, H. sapiens
ttaaaaattcagtaaa

SEQ ID NO: 157990 - DNA, 16 bp, H. sapiens
ttaaaaattcagtttc

SEQ ID NO: 157991 - DNA, 16 bp, H. sapiens
ttaaaaattccttaaa

SEQ ID NO: 157992 - DNA, 16 bp, H. sapiens
ttaaaaattctctttg

SEQ ID NO: 157993 - DNA, 16 bp, H. sapiens
ttaaaaattggctttg

SEQ ID NO: 157994 - DNA, 16 bp, H. sapiens
ttaaaaattggtgaat

SEQ ID NO: 157995 - DNA, 16 bp, H. sapiens
ttaaaaattgtaaatg

SEQ ID NO: 157996 - DNA, 16 bp, H. sapiens
ttaaaaattgtgttta

SEQ ID NO: 157997 - DNA, 16 bp, H. sapiens
ttaaaaattgttatgt

SEQ ID NO: 157998 - DNA, 16 bp, H. sapiens
ttaaaaatttcaactt

SEQ ID NO: 157999 - DNA, 16 bp, H. sapiens
ttaaaaatttctcaaa

SEQ ID NO: 158000 - DNA, 16 bp, H. sapiens
ttaaaaatttggaaat

SEQ ID NO: 158001 - DNA, 16 bp, H. sapiens
ttaaaaattttccata

SEQ ID NO: 158002 - DNA, 16 bp, H. sapiens
ttaaaaattttctgta

SEQ ID NO: 158003 - DNA, 16 bp, H. sapiens
ttaaaaattttcttga

SEQ ID NO: 158004 - DNA, 16 bp, H. sapiens
ttaaaaattttgctaa

SEQ ID NO: 158005 - DNA, 16 bp, H. sapiens
ttaaaaattttgtgca

SEQ ID NO: 158006 - DNA, 16 bp, H. sapiens
ttaaaacaaatgagaa

SEQ ID NO: 158007 - DNA, 16 bp, H. sapiens
ttaaaacaaatgtatt

SEQ ID NO: 158008 - DNA, 16 bp, H. sapiens
ttaaaacaacagaaat

SEQ ID NO: 158009 - DNA, 16 bp, H. sapiens
ttaaaacaacagagat

SEQ ID NO: 158010 - DNA, 16 bp, H. sapiens
ttaaaacaactttttt

SEQ ID NO: 158011 - DNA, 16 bp, H. sapiens
ttaaaacaagagaaat

SEQ ID NO: 158012 - DNA, 16 bp, H. sapiens
ttaaaacaagcaaaat

SEQ ID NO: 158013 - DNA, 16 bp, H. sapiens
ttaaaacaatgtaaat

SEQ ID NO: 158014 - DNA, 16 bp, H. sapiens
ttaaaacaatgttgaa

SEQ ID NO: 158015 - DNA, 16 bp, H. sapiens
ttaaaacaatgtttta

SEQ ID NO: 158016 - DNA, 16 bp, H. sapiens
ttaaaacaatttttag

SEQ ID NO: 158017 - DNA, 16 bp, H. sapiens
ttaaaacactggaaaa

SEQ ID NO: 158018 - DNA, 16 bp, H. sapiens
ttaaaacagataaatt

SEQ ID NO: 158019 - DNA, 16 bp, H. sapiens
ttaaaacagcacacat

SEQ ID NO: 158020 - DNA, 16 bp, H. sapiens
ttaaaacagctatttt

SEQ ID NO: 158021 - DNA, 16 bp, H. sapiens
ttaaaacagctgtttt

SEQ ID NO: 158022 - DNA, 16 bp, H. sapiens
ttaaaacagtttttaa

SEQ ID NO: 158023 - DNA, 16 bp, H. sapiens
ttaaaacataattttc

SEQ ID NO: 158024 - DNA, 16 bp, H. sapiens
ttaaaacatatttttg

SEQ ID NO: 158025 - DNA, 16 bp, H. sapiens
ttaaaacatcatgaga

SEQ ID NO: 158026 - DNA, 16 bp, H. sapiens
ttaaaacatgaaaata

SEQ ID NO: 158027 - DNA, 16 bp, H. sapiens
ttaaaacatgtaaaaa

SEQ ID NO: 158028 - DNA, 16 bp, H. sapiens
ttaaaacatgtttatt

SEQ ID NO: 158029 - DNA, 16 bp, H. sapiens
ttaaaacattccaaaa

SEQ ID NO: 158030 - DNA, 16 bp, H. sapiens
ttaaaacatttagttt

SEQ ID NO: 158031 - DNA, 16 bp, H. sapiens
ttaaaacatttctaaa

SEQ ID NO: 158032 - DNA, 16 bp, H. sapiens
ttaaaacatttctaat

SEQ ID NO: 158033 - DNA, 16 bp, H. sapiens
ttaaaacatttcttca

SEQ ID NO: 158034 - DNA, 16 bp, H. sapiens
ttaaaacattttactt

SEQ ID NO: 158035 - DNA, 16 bp, H. sapiens
ttaaaacattttcaca

SEQ ID NO: 158036 - DNA, 16 bp, H. sapiens
ttaaaacatttttcat

SEQ ID NO: 158037 - DNA, 16 bp, H. sapiens
ttaaaacatttttccc

SEQ ID NO: 158038 - DNA, 16 bp, H. sapiens
ttaaaaccaaaatgag

SEQ ID NO: 158039 - DNA, 16 bp, H. sapiens
ttaaaacctaaatgac

SEQ ID NO: 158040 - DNA, 16 bp, H. sapiens
ttaaaactcatttatt

SEQ ID NO: 158041 - DNA, 16 bp, H. sapiens
ttaaaactgaagaaaa

SEQ ID NO: 158042 - DNA, 16 bp, H. sapiens
ttaaaactgctatttt

SEQ ID NO: 158043 - DNA, 16 bp, H. sapiens
ttaaaactgtcttttt

SEQ ID NO: 158044 - DNA, 16 bp, H. sapiens
ttaaaactgttatttt

SEQ ID NO: 158045 - DNA, 16 bp, H. sapiens
ttaaaactgtttaaaa

SEQ ID NO: 158046 - DNA, 16 bp, H. sapiens
ttaaaacttccttttg

SEQ ID NO: 158047 - DNA, 16 bp, H. sapiens
ttaaaacttgttttgt

SEQ ID NO: 158048 - DNA, 16 bp, H. sapiens
ttaaaactttctgtgg

SEQ ID NO: 158049 - DNA, 16 bp, H. sapiens
ttaaaacttttgtaga

SEQ ID NO: 158050 - DNA, 16 bp, H. sapiens
ttaaaactttttgtta

SEQ ID NO: 158051 - DNA, 16 bp, H. sapiens
ttaaaagaaaaactct

SEQ ID NO: 158052 - DNA, 16 bp, H. sapiens
ttaaaagaaaaacttt

SEQ ID NO: 158053 - DNA, 16 bp, H. sapiens
ttaaaagaaaacactg

SEQ ID NO: 158054 - DNA, 16 bp, H. sapiens
ttaaaagaaaacctag

SEQ ID NO: 158055 - DNA, 16 bp, H. sapiens
ttaaaagaaaatgttc

SEQ ID NO: 158056 - DNA, 16 bp, H. sapiens
ttaaaagaaacattaa

SEQ ID NO: 158057 - DNA, 16 bp, H. sapiens
ttaaaagaaactttaa

SEQ ID NO: 158058 - DNA, 16 bp, H. sapiens
ttaaaagaaagtttta

SEQ ID NO: 158059 - DNA, 16 bp, H. sapiens
ttaaaagaacattaaa

SEQ ID NO: 158060 - DNA, 16 bp, H. sapiens
ttaaaagaaccaaata

SEQ ID NO: 158061 - DNA, 16 bp, H. sapiens
ttaaaagaagacatgc

SEQ ID NO: 158062 - DNA, 16 bp, H. sapiens
ttaaaagacaaaatga

SEQ ID NO: 158063 - DNA, 16 bp, H. sapiens
ttaaaagacagaaact

SEQ ID NO: 158064 - DNA, 16 bp, H. sapiens
ttaaaagacagatttt

SEQ ID NO: 158065 - DNA, 16 bp, H. sapiens
ttaaaagacattttaa

SEQ ID NO: 158066 - DNA, 16 bp, H. sapiens
ttaaaagacattttct

SEQ ID NO: 158067 - DNA, 16 bp, H. sapiens
ttaaaagactcaatat

SEQ ID NO: 158068 - DNA, 16 bp, H. sapiens
ttaaaagactgctttt

SEQ ID NO: 158069 - DNA, 16 bp, H. sapiens
ttaaaagacttttaaa

SEQ ID NO: 158070 - DNA, 16 bp, H. sapiens
ttaaaagagctagaaa

SEQ ID NO: 158071 - DNA, 16 bp, H. sapiens
ttaaaagatattttgg

SEQ ID NO: 158072 - DNA, 16 bp, H. sapiens
ttaaaagatgcagaat

SEQ ID NO: 158073 - DNA, 16 bp, H. sapiens
ttaaaagatgttttaa

SEQ ID NO: 158074 - DNA, 16 bp, H. sapiens
ttaaaagatttaatgg

SEQ ID NO: 158075 - DNA, 16 bp, H. sapiens
ttaaaagcaaaaagat

SEQ ID NO: 158076 - DNA, 16 bp, H. sapiens
ttaaaagcaacagaaa

SEQ ID NO: 158077 - DNA, 16 bp, H. sapiens
ttaaaagcagaaaaca

SEQ ID NO: 158078 - DNA, 16 bp, H. sapiens
ttaaaagcagaagaaa

SEQ ID NO: 158079 - DNA, 16 bp, H. sapiens
ttaaaagcatcagaaa

SEQ ID NO: 158080 - DNA, 16 bp, H. sapiens
ttaaaagcattttaat

SEQ ID NO: 158081 - DNA, 16 bp, H. sapiens
ttaaaagcttctgctc

SEQ ID NO: 158082 - DNA, 16 bp, H. sapiens
ttaaaagcttttaaaa

SEQ ID NO: 158083 - DNA, 16 bp, H. sapiens
ttaaaagcttttaaat

SEQ ID NO: 158084 - DNA, 16 bp, H. sapiens
ttaaaaggaaaacaat

SEQ ID NO: 158085 - DNA, 16 bp, H. sapiens
ttaaaaggaaaactaa

SEQ ID NO: 158086 - DNA, 16 bp, H. sapiens
ttaaaaggaaagcaga

SEQ ID NO: 158087 - DNA, 16 bp, H. sapiens
ttaaaaggaaatatct

SEQ ID NO: 158088 - DNA, 16 bp, H. sapiens
ttaaaaggaagaaatt

SEQ ID NO: 158089 - DNA, 16 bp, H. sapiens
ttaaaaggattaaagt

SEQ ID NO: 158090 - DNA, 16 bp, H. sapiens
ttaaaaggattcaagt

SEQ ID NO: 158091 - DNA, 16 bp, H. sapiens
ttaaaaggctgaggca

SEQ ID NO: 158092 - DNA, 16 bp, H. sapiens
ttaaaagggaaattaa

SEQ ID NO: 158093 - DNA, 16 bp, H. sapiens
ttaaaaggttaaattt

SEQ ID NO: 158094 - DNA, 16 bp, H. sapiens
ttaaaagtaatttctt

SEQ ID NO: 158095 - DNA, 16 bp, H. sapiens
ttaaaagtagattttt

SEQ ID NO: 158096 - DNA, 16 bp, H. sapiens
ttaaaagtatgttgtt

SEQ ID NO: 158097 - DNA, 16 bp, H. sapiens
ttaaaagtatttaaca

SEQ ID NO: 158098 - DNA, 16 bp, H. sapiens
ttaaaagtgtttttaa

SEQ ID NO: 158099 - DNA, 16 bp, H. sapiens
ttaaaagttaaaaaca

SEQ ID NO: 158100 - DNA, 16 bp, H. sapiens
ttaaaagttcaaaaaa

SEQ ID NO: 158101 - DNA, 16 bp, H. sapiens
ttaaaagttcatttta

SEQ ID NO: 158102 - DNA, 16 bp, H. sapiens
ttaaaagttctttgaa

SEQ ID NO: 158103 - DNA, 16 bp, H. sapiens
ttaaaagtttcaaata

SEQ ID NO: 158104 - DNA, 16 bp, H. sapiens
ttaaaagtttccattt

SEQ ID NO: 158105 - DNA, 16 bp, H. sapiens
ttaaaataaaatgaca

SEQ ID NO: 158106 - DNA, 16 bp, H. sapiens
ttaaaataaacatctt

SEQ ID NO: 158107 - DNA, 16 bp, H. sapiens
ttaaaataaagtcact

SEQ ID NO: 158108 - DNA, 16 bp, H. sapiens
ttaaaataaagtgttt

SEQ ID NO: 158109 - DNA, 16 bp, H. sapiens
ttaaaataaagttgtt

SEQ ID NO: 158110 - DNA, 16 bp, H. sapiens
ttaaaataacttttga

SEQ ID NO: 158111 - DNA, 16 bp, H. sapiens
ttaaaataagaacttt

SEQ ID NO: 158112 - DNA, 16 bp, H. sapiens
ttaaaataatgatgtt

SEQ ID NO: 158113 - DNA, 16 bp, H. sapiens
ttaaaatacaatgttt

SEQ ID NO: 158114 - DNA, 16 bp, H. sapiens
ttaaaatacacacaca

SEQ ID NO: 158115 - DNA, 16 bp, H. sapiens
ttaaaatacagaatta

SEQ ID NO: 158116 - DNA, 16 bp, H. sapiens
ttaaaatacagattgc

SEQ ID NO: 158117 - DNA, 16 bp, H. sapiens
ttaaaatacagtatat

SEQ ID NO: 158118 - DNA, 16 bp, H. sapiens
ttaaaatacatgtaaa

SEQ ID NO: 158119 - DNA, 16 bp, H. sapiens
ttaaaatactgaaaaa

SEQ ID NO: 158120 - DNA, 16 bp, H. sapiens
ttaaaatactgaaaat

SEQ ID NO: 158121 - DNA, 16 bp, H. sapiens
ttaaaatacttgtttt

SEQ ID NO: 158122 - DNA, 16 bp, H. sapiens
ttaaaatagaaacaga

SEQ ID NO: 158123 - DNA, 16 bp, H. sapiens
ttaaaatagcatttca

SEQ ID NO: 158124 - DNA, 16 bp, H. sapiens
ttaaaatagccacaaa

SEQ ID NO: 158125 - DNA, 16 bp, H. sapiens
ttaaaatagcttaaaa

SEQ ID NO: 158126 - DNA, 16 bp, H. sapiens
ttaaaatagctttatt

SEQ ID NO: 158127 - DNA, 16 bp, H. sapiens
ttaaaatatctcttta

SEQ ID NO: 158128 - DNA, 16 bp, H. sapiens
ttaaaatattaatgca

SEQ ID NO: 158129 - DNA, 16 bp, H. sapiens
ttaaaatattcagaaa

SEQ ID NO: 158130 - DNA, 16 bp, H. sapiens
ttaaaatattcagtaa

SEQ ID NO: 158131 - DNA, 16 bp, H. sapiens
ttaaaatatttcaaga

SEQ ID NO: 158132 - DNA, 16 bp, H. sapiens
ttaaaatatttcccat

SEQ ID NO: 158133 - DNA, 16 bp, H. sapiens
ttaaaatatttcttgt

SEQ ID NO: 158134 - DNA, 16 bp, H. sapiens
ttaaaatattttgtag

SEQ ID NO: 158135 - DNA, 16 bp, H. sapiens
ttaaaatcaaaagcaa

SEQ ID NO: 158136 - DNA, 16 bp, H. sapiens
ttaaaatcaaaagcta

SEQ ID NO: 158137 - DNA, 16 bp, H. sapiens
ttaaaatcaagtaaaa

SEQ ID NO: 158138 - DNA, 16 bp, H. sapiens
ttaaaatcacatttta

SEQ ID NO: 158139 - DNA, 16 bp, H. sapiens
ttaaaatcacattttt

SEQ ID NO: 158140 - DNA, 16 bp, H. sapiens
ttaaaatcagaaaaca

SEQ ID NO: 158141 - DNA, 16 bp, H. sapiens
ttaaaatcagaaaatg

SEQ ID NO: 158142 - DNA, 16 bp, H. sapiens
ttaaaatcagattttt

SEQ ID NO: 158143 - DNA, 16 bp, H. sapiens
ttaaaatcagtaaaat

SEQ ID NO: 158144 - DNA, 16 bp, H. sapiens
ttaaaatcagtgtttc

SEQ ID NO: 158145 - DNA, 16 bp, H. sapiens
ttaaaatcatgttttt

SEQ ID NO: 158146 - DNA, 16 bp, H. sapiens
ttaaaatcattttcta

SEQ ID NO: 158147 - DNA, 16 bp, H. sapiens
ttaaaatctattctct

SEQ ID NO: 158148 - DNA, 16 bp, H. sapiens
ttaaaatctattctgt

SEQ ID NO: 158149 - DNA, 16 bp, H. sapiens
ttaaaatcttttctct

SEQ ID NO: 158150 - DNA, 16 bp, H. sapiens
ttaaaatgaaaaatca

SEQ ID NO: 158151 - DNA, 16 bp, H. sapiens
ttaaaatgaaaatctt

SEQ ID NO: 158152 - DNA, 16 bp, H. sapiens
ttaaaatgaaatgcaa

SEQ ID NO: 158153 - DNA, 16 bp, H. sapiens
ttaaaatgaaatgttt

SEQ ID NO: 158154 - DNA, 16 bp, H. sapiens
ttaaaatgaaggtaaa

SEQ ID NO: 158155 - DNA, 16 bp, H. sapiens
ttaaaatgacatttta

SEQ ID NO: 158156 - DNA, 16 bp, H. sapiens
ttaaaatgaccatttc

SEQ ID NO: 158157 - DNA, 16 bp, H. sapiens
ttaaaatgacttttat

SEQ ID NO: 158158 - DNA, 16 bp, H. sapiens
ttaaaatgaggtcatt

SEQ ID NO: 158159 - DNA, 16 bp, H. sapiens
ttaaaatgagttttta

SEQ ID NO: 158160 - DNA, 16 bp, H. sapiens
ttaaaatgcaaaataa

SEQ ID NO: 158161 - DNA, 16 bp, H. sapiens
ttaaaatgcaaatttt

SEQ ID NO: 158162 - DNA, 16 bp, H. sapiens
ttaaaatgcatttcaa

SEQ ID NO: 158163 - DNA, 16 bp, H. sapiens
ttaaaatgcattttat

SEQ ID NO: 158164 - DNA, 16 bp, H. sapiens
ttaaaatgctaaacat

SEQ ID NO: 158165 - DNA, 16 bp, H. sapiens
ttaaaatgctgattct

SEQ ID NO: 158166 - DNA, 16 bp, H. sapiens
ttaaaatgctttcatt

SEQ ID NO: 158167 - DNA, 16 bp, H. sapiens
ttaaaatgcttttaaa

SEQ ID NO: 158168 - DNA, 16 bp, H. sapiens
ttaaaatgctttttat

SEQ ID NO: 158169 - DNA, 16 bp, H. sapiens
ttaaaatggaaatcat

SEQ ID NO: 158170 - DNA, 16 bp, H. sapiens
ttaaaatggacatttt

SEQ ID NO: 158171 - DNA, 16 bp, H. sapiens
ttaaaatggccatact

SEQ ID NO: 158172 - DNA, 16 bp, H. sapiens
ttaaaatggctttctt

SEQ ID NO: 158173 - DNA, 16 bp, H. sapiens
ttaaaatgggaagaaa

SEQ ID NO: 158174 - DNA, 16 bp, H. sapiens
ttaaaatggggataat

SEQ ID NO: 158175 - DNA, 16 bp, H. sapiens
ttaaaatggtattatt

SEQ ID NO: 158176 - DNA, 16 bp, H. sapiens
ttaaaatggtgaattt

SEQ ID NO: 158177 - DNA, 16 bp, H. sapiens
ttaaaatggttaaaat

SEQ ID NO: 158178 - DNA, 16 bp, H. sapiens
ttaaaatggttaattt

SEQ ID NO: 158179 - DNA, 16 bp, H. sapiens
ttaaaatggttttaaa

SEQ ID NO: 158180 - DNA, 16 bp, H. sapiens
ttaaaatgtaattcat

SEQ ID NO: 158181 - DNA, 16 bp, H. sapiens
ttaaaatgtacaataa

SEQ ID NO: 158182 - DNA, 16 bp, H. sapiens
ttaaaatgtacacttt

SEQ ID NO: 158183 - DNA, 16 bp, H. sapiens
ttaaaatgtattcagt

SEQ ID NO: 158184 - DNA, 16 bp, H. sapiens
ttaaaatgtatttaca

SEQ ID NO: 158185 - DNA, 16 bp, H. sapiens
ttaaaatgtatttctt

SEQ ID NO: 158186 - DNA, 16 bp, H. sapiens
ttaaaatgtcacaaaa

SEQ ID NO: 158187 - DNA, 16 bp, H. sapiens
ttaaaatgtcaggaaa

SEQ ID NO: 158188 - DNA, 16 bp, H. sapiens
ttaaaatgtcattatt

SEQ ID NO: 158189 - DNA, 16 bp, H. sapiens
ttaaaatgtcattttt

SEQ ID NO: 158190 - DNA, 16 bp, H. sapiens
ttaaaatgtctttttc

SEQ ID NO: 158191 - DNA, 16 bp, H. sapiens
ttaaaatgtgaaagaa

SEQ ID NO: 158192 - DNA, 16 bp, H. sapiens
ttaaaatgtgaagaaa

SEQ ID NO: 158193 - DNA, 16 bp, H. sapiens
ttaaaatgtgaatata

SEQ ID NO: 158194 - DNA, 16 bp, H. sapiens
ttaaaatgtgcttttt

SEQ ID NO: 158195 - DNA, 16 bp, H. sapiens
ttaaaatgtggtacat

SEQ ID NO: 158196 - DNA, 16 bp, H. sapiens
ttaaaatgtgtaaaat

SEQ ID NO: 158197 - DNA, 16 bp, H. sapiens
ttaaaatgtgtacaaa

SEQ ID NO: 158198 - DNA, 16 bp, H. sapiens
ttaaaatgtgtttctc

SEQ ID NO: 158199 - DNA, 16 bp, H. sapiens
ttaaaatgtgttttga

SEQ ID NO: 158200 - DNA, 16 bp, H. sapiens
ttaaaatgttaacttt

SEQ ID NO: 158201 - DNA, 16 bp, H. sapiens
ttaaaatgttcataaa

SEQ ID NO: 158202 - DNA, 16 bp, H. sapiens
ttaaaatgttgaattt

SEQ ID NO: 158203 - DNA, 16 bp, H. sapiens
ttaaaatgttgtaaaa

SEQ ID NO: 158204 - DNA, 16 bp, H. sapiens
ttaaaatgtttaaatg

SEQ ID NO: 158205 - DNA, 16 bp, H. sapiens
ttaaaatgtttacatt

SEQ ID NO: 158206 - DNA, 16 bp, H. sapiens
ttaaaatgtttatgta

SEQ ID NO: 158207 - DNA, 16 bp, H. sapiens
ttaaaatgtttcataa

SEQ ID NO: 158208 - DNA, 16 bp, H. sapiens
ttaaaatgtttctctt

SEQ ID NO: 158209 - DNA, 16 bp, H. sapiens
ttaaaatgtttcttct

SEQ ID NO: 158210 - DNA, 16 bp, H. sapiens
ttaaaatgttttatga

SEQ ID NO: 158211 - DNA, 16 bp, H. sapiens
ttaaaattaaggattt

SEQ ID NO: 158212 - DNA, 16 bp, H. sapiens
ttaaaattacattttc

SEQ ID NO: 158213 - DNA, 16 bp, H. sapiens
ttaaaattagtctttt

SEQ ID NO: 158214 - DNA, 16 bp, H. sapiens
ttaaaattcaatatga

SEQ ID NO: 158215 - DNA, 16 bp, H. sapiens
ttaaaattcttcagaa

SEQ ID NO: 158216 - DNA, 16 bp, H. sapiens
ttaaaattcttctttg

SEQ ID NO: 158217 - DNA, 16 bp, H. sapiens
ttaaaattctttctct

SEQ ID NO: 158218 - DNA, 16 bp, H. sapiens
ttaaaattgactactt

SEQ ID NO: 158219 - DNA, 16 bp, H. sapiens
ttaaaattgctaaaat

SEQ ID NO: 158220 - DNA, 16 bp, H. sapiens
ttaaaattgctttctt

SEQ ID NO: 158221 - DNA, 16 bp, H. sapiens
ttaaaattgcttttct

SEQ ID NO: 158222 - DNA, 16 bp, H. sapiens
ttaaaattgtactttt

SEQ ID NO: 158223 - DNA, 16 bp, H. sapiens
ttaaaattgtattctt

SEQ ID NO: 158224 - DNA, 16 bp, H. sapiens
ttaaaattgtttccaa

SEQ ID NO: 158225 - DNA, 16 bp, H. sapiens
ttaaaattgttttgaa

SEQ ID NO: 158226 - DNA, 16 bp, H. sapiens
ttaaaatttcaaaatg

SEQ ID NO: 158227 - DNA, 16 bp, H. sapiens
ttaaaatttctgttct

SEQ ID NO: 158228 - DNA, 16 bp, H. sapiens
ttaaaatttctttgtt

SEQ ID NO: 158229 - DNA, 16 bp, H. sapiens
ttaaaatttgatgaaa

SEQ ID NO: 158230 - DNA, 16 bp, H. sapiens
ttaaaatttggtgttc

SEQ ID NO: 158231 - DNA, 16 bp, H. sapiens
ttaaaatttgttgaaa

SEQ ID NO: 158232 - DNA, 16 bp, H. sapiens
ttaaaattttattcca

SEQ ID NO: 158233 - DNA, 16 bp, H. sapiens
ttaaaattttcagtgt

SEQ ID NO: 158234 - DNA, 16 bp, H. sapiens
ttaaaattttggaaaa

SEQ ID NO: 158235 - DNA, 16 bp, H. sapiens
ttaaaatttttctcag

SEQ ID NO: 158236 - DNA, 16 bp, H. sapiens
ttaaacaaaattatga

SEQ ID NO: 158237 - DNA, 16 bp, H. sapiens
ttaaacaaactgtgat

SEQ ID NO: 158238 - DNA, 16 bp, H. sapiens
ttaaacaaatttatga

SEQ ID NO: 158239 - DNA, 16 bp, H. sapiens
ttaaacaaccagattg

SEQ ID NO: 158240 - DNA, 16 bp, H. sapiens
ttaaacaaccagctgt

SEQ ID NO: 158241 - DNA, 16 bp, H. sapiens
ttaaacaactttacaa

SEQ ID NO: 158242 - DNA, 16 bp, H. sapiens
ttaaacaatcagatct

SEQ ID NO: 158243 - DNA, 16 bp, H. sapiens
ttaaacaattcaacaa

SEQ ID NO: 158244 - DNA, 16 bp, H. sapiens
ttaaacaattttcaaa

SEQ ID NO: 158245 - DNA, 16 bp, H. sapiens
ttaaacacatacacac

SEQ ID NO: 158246 - DNA, 16 bp, H. sapiens
ttaaacactttttaaa

SEQ ID NO: 158247 - DNA, 16 bp, H. sapiens
ttaaacagatttttct

SEQ ID NO: 158248 - DNA, 16 bp, H. sapiens
ttaaacataaagaaat

SEQ ID NO: 158249 - DNA, 16 bp, H. sapiens
ttaaacataaatttac

SEQ ID NO: 158250 - DNA, 16 bp, H. sapiens
ttaaacataagaaaat

SEQ ID NO: 158251 - DNA, 16 bp, H. sapiens
ttaaacatagtttaaa

SEQ ID NO: 158252 - DNA, 16 bp, H. sapiens
ttaaacatatatgcac

SEQ ID NO: 158253 - DNA, 16 bp, H. sapiens
ttaaacatgattaaaa

SEQ ID NO: 158254 - DNA, 16 bp, H. sapiens
ttaaacattagaccta

SEQ ID NO: 158255 - DNA, 16 bp, H. sapiens
ttaaacattatttctg

SEQ ID NO: 158256 - DNA, 16 bp, H. sapiens
ttaaacatttaaatgt

SEQ ID NO: 158257 - DNA, 16 bp, H. sapiens
ttaaacatttatttca

SEQ ID NO: 158258 - DNA, 16 bp, H. sapiens
ttaaacatttattttg

SEQ ID NO: 158259 - DNA, 16 bp, H. sapiens
ttaaacatttctaaaa

SEQ ID NO: 158260 - DNA, 16 bp, H. sapiens
ttaaacatttctcttt

SEQ ID NO: 158261 - DNA, 16 bp, H. sapiens
ttaaacatttcttgta

SEQ ID NO: 158262 - DNA, 16 bp, H. sapiens
ttaaacatttctttct

SEQ ID NO: 158263 - DNA, 16 bp, H. sapiens
ttaaacatttcttttc

SEQ ID NO: 158264 - DNA, 16 bp, H. sapiens
ttaaacatttggtaga

SEQ ID NO: 158265 - DNA, 16 bp, H. sapiens
ttaaacattttcaaaa

SEQ ID NO: 158266 - DNA, 16 bp, H. sapiens
ttaaacatttttaagt

SEQ ID NO: 158267 - DNA, 16 bp, H. sapiens
ttaaacccaaagtaaa

SEQ ID NO: 158268 - DNA, 22 bp, H. sapiens
ttaaaccccgtctctactaaaa

SEQ ID NO: 158269 - DNA, 16 bp, H. sapiens
ttaaaccccttttctt

SEQ ID NO: 158270 - DNA, 16 bp, H. sapiens
ttaaacctctttattt

SEQ ID NO: 158271 - DNA, 16 bp, H. sapiens
ttaaacctctttgtct

SEQ ID NO: 158272 - DNA, 16 bp, H. sapiens
ttaaacgttagaccta

SEQ ID NO: 158273 - DNA, 16 bp, H. sapiens
ttaaactaaagagctg

SEQ ID NO: 158274 - DNA, 16 bp, H. sapiens
ttaaactagattctga

SEQ ID NO: 158275 - DNA, 16 bp, H. sapiens
ttaaactcttagaaga

SEQ ID NO: 158276 - DNA, 16 bp, H. sapiens
ttaaactgaaaagctt

SEQ ID NO: 158277 - DNA, 16 bp, H. sapiens
ttaaactgtaaactga

SEQ ID NO: 158278 - DNA, 16 bp, H. sapiens
ttaaactgttttcttt

SEQ ID NO: 158279 - DNA, 16 bp, H. sapiens
ttaaacttacagaaaa

SEQ ID NO: 158280 - DNA, 16 bp, H. sapiens
ttaaacttctaaaatt

SEQ ID NO: 158281 - DNA, 16 bp, H. sapiens
ttaaacttctgtttta

SEQ ID NO: 158282 - DNA, 16 bp, H. sapiens
ttaaacttgtaatttt

SEQ ID NO: 158283 - DNA, 16 bp, H. sapiens
ttaaacttttagaaaa

SEQ ID NO: 158284 - DNA, 16 bp, H. sapiens
ttaaacttttccaaaa

SEQ ID NO: 158285 - DNA, 16 bp, H. sapiens
ttaaacttttcttctg

SEQ ID NO: 158286 - DNA, 16 bp, H. sapiens
ttaaacttttttaaag

SEQ ID NO: 158287 - DNA, 16 bp, H. sapiens
ttaaacttttttttga

SEQ ID NO: 158288 - DNA, 16 bp, H. sapiens
ttaaagaaaaatatct

SEQ ID NO: 158289 - DNA, 16 bp, H. sapiens
ttaaagaaaagatttt

SEQ ID NO: 158290 - DNA, 16 bp, H. sapiens
ttaaagaaaagcaaat

SEQ ID NO: 158291 - DNA, 16 bp, H. sapiens
ttaaagaaaagttgca

SEQ ID NO: 158292 - DNA, 16 bp, H. sapiens
ttaaagaaaagttttt

SEQ ID NO: 158293 - DNA, 16 bp, H. sapiens
ttaaagaaaatggaga

SEQ ID NO: 158294 - DNA, 16 bp, H. sapiens
ttaaagaaacatcagc

SEQ ID NO: 158295 - DNA, 16 bp, H. sapiens
ttaaagaaacattttt

SEQ ID NO: 158296 - DNA, 16 bp, H. sapiens
ttaaagaaactcaatg

SEQ ID NO: 158297 - DNA, 16 bp, H. sapiens
ttaaagaaatgcaaat

SEQ ID NO: 158298 - DNA, 16 bp, H. sapiens
ttaaagaactaaaaat

SEQ ID NO: 158299 - DNA, 16 bp, H. sapiens
ttaaagaactagaagt

SEQ ID NO: 158300 - DNA, 16 bp, H. sapiens
ttaaagaactggagaa

SEQ ID NO: 158301 - DNA, 16 bp, H. sapiens
ttaaagaagaaataac

SEQ ID NO: 158302 - DNA, 16 bp, H. sapiens
ttaaagaagaaatttt

SEQ ID NO: 158303 - DNA, 16 bp, H. sapiens
ttaaagaatattttca

SEQ ID NO: 158304 - DNA, 16 bp, H. sapiens
ttaaagacaaatttat

SEQ ID NO: 158305 - DNA, 16 bp, H. sapiens
ttaaagacactttatt

SEQ ID NO: 158306 - DNA, 16 bp, H. sapiens
ttaaagacagaaagaa

SEQ ID NO: 158307 - DNA, 16 bp, H. sapiens
ttaaagacagggtttc

SEQ ID NO: 158308 - DNA, 16 bp, H. sapiens
ttaaagacatacctga

SEQ ID NO: 158309 - DNA, 16 bp, H. sapiens
ttaaagaccctgtctc

SEQ ID NO: 158310 - DNA, 16 bp, H. sapiens
ttaaagacggagtttc

SEQ ID NO: 158311 - DNA, 16 bp, H. sapiens
ttaaagacttgaatat

SEQ ID NO: 158312 - DNA, 16 bp, H. sapiens
ttaaagagaaaattca

SEQ ID NO: 158313 - DNA, 16 bp, H. sapiens
ttaaagagaagggtag

SEQ ID NO: 158314 - DNA, 16 bp, H. sapiens
ttaaagagaaggtaga

SEQ ID NO: 158315 - DNA, 16 bp, H. sapiens
ttaaagagatttgcaa

SEQ ID NO: 158316 - DNA, 16 bp, H. sapiens
ttaaagagcaggttag

SEQ ID NO: 158317 - DNA, 16 bp, H. sapiens
ttaaagaggaggaaat

SEQ ID NO: 158318 - DNA, 16 bp, H. sapiens
ttaaagaggtacatga

SEQ ID NO: 158319 - DNA, 16 bp, H. sapiens
ttaaagagttaaatat

SEQ ID NO: 158320 - DNA, 16 bp, H. sapiens
ttaaagagtttttggg

SEQ ID NO: 158321 - DNA, 16 bp, H. sapiens
ttaaagataattttga

SEQ ID NO: 158322 - DNA, 16 bp, H. sapiens
ttaaagatataaatgt

SEQ ID NO: 158323 - DNA, 16 bp, H. sapiens
ttaaagatatttttct

SEQ ID NO: 158324 - DNA, 16 bp, H. sapiens
ttaaagatgaaaaaca

SEQ ID NO: 158325 - DNA, 16 bp, H. sapiens
ttaaagatgagaaaag

SEQ ID NO: 158326 - DNA, 16 bp, H. sapiens
ttaaagatgagatttg

SEQ ID NO: 158327 - DNA, 16 bp, H. sapiens
ttaaagatgaggaaat

SEQ ID NO: 158328 - DNA, 16 bp, H. sapiens
ttaaagatggaggaag

SEQ ID NO: 158329 - DNA, 16 bp, H. sapiens
ttaaagatgttgctcc

SEQ ID NO: 158330 - DNA, 16 bp, H. sapiens
ttaaagattttttttc

SEQ ID NO: 158331 - DNA, 16 bp, H. sapiens
ttaaagcaaaaataat

SEQ ID NO: 158332 - DNA, 16 bp, H. sapiens
ttaaagcaacaatgag

SEQ ID NO: 158333 - DNA, 16 bp, H. sapiens
ttaaagcaacacaaat

SEQ ID NO: 158334 - DNA, 16 bp, H. sapiens
ttaaagcaattaaaaa

SEQ ID NO: 158335 - DNA, 16 bp, H. sapiens
ttaaagcagcagtccc

SEQ ID NO: 158336 - DNA, 16 bp, H. sapiens
ttaaagcagccatcat

SEQ ID NO: 158337 - DNA, 16 bp, H. sapiens
ttaaagcagtggcagc

SEQ ID NO: 158338 - DNA, 16 bp, H. sapiens
ttaaagcatattttat

SEQ ID NO: 158339 - DNA, 16 bp, H. sapiens
ttaaagcatttacttt

SEQ ID NO: 158340 - DNA, 16 bp, H. sapiens
ttaaagcatttttaaa

SEQ ID NO: 158341 - DNA, 16 bp, H. sapiens
ttaaagcattttttaa

SEQ ID NO: 158342 - DNA, 16 bp, H. sapiens
ttaaagcatttttttc

SEQ ID NO: 158343 - DNA, 16 bp, H. sapiens
ttaaagctattaaaaa

SEQ ID NO: 158344 - DNA, 16 bp, H. sapiens
ttaaagctcttttctt

SEQ ID NO: 158345 - DNA, 16 bp, H. sapiens
ttaaagctttgttttg

SEQ ID NO: 158346 - DNA, 16 bp, H. sapiens
ttaaagctttttaaaa

SEQ ID NO: 158347 - DNA, 16 bp, H. sapiens
ttaaaggaaaagcttt

SEQ ID NO: 158348 - DNA, 16 bp, H. sapiens
ttaaaggaaaagggag

SEQ ID NO: 158349 - DNA, 16 bp, H. sapiens
ttaaaggaaaatattt

SEQ ID NO: 158350 - DNA, 16 bp, H. sapiens
ttaaaggaaaatttat

SEQ ID NO: 158351 - DNA, 16 bp, H. sapiens
ttaaaggaaacaaaat

SEQ ID NO: 158352 - DNA, 16 bp, H. sapiens
ttaaaggaaatgaaag

SEQ ID NO: 158353 - DNA, 16 bp, H. sapiens
ttaaaggaaattaaag

SEQ ID NO: 158354 - DNA, 16 bp, H. sapiens
ttaaaggaattttaaa

SEQ ID NO: 158355 - DNA, 16 bp, H. sapiens
ttaaaggagctgcaga

SEQ ID NO: 158356 - DNA, 16 bp, H. sapiens
ttaaagggaaatttat

SEQ ID NO: 158357 - DNA, 16 bp, H. sapiens
ttaaagggaagataaa

SEQ ID NO: 158358 - DNA, 16 bp, H. sapiens
ttaaagggagaatgag

SEQ ID NO: 158359 - DNA, 16 bp, H. sapiens
ttaaaggtggcatgga

SEQ ID NO: 158360 - DNA, 16 bp, H. sapiens
ttaaagtaaaaacaat

SEQ ID NO: 158361 - DNA, 16 bp, H. sapiens
ttaaagtaaaactttt

SEQ ID NO: 158362 - DNA, 16 bp, H. sapiens
ttaaagtaacatttaa

SEQ ID NO: 158363 - DNA, 16 bp, H. sapiens
ttaaagtacattttaa

SEQ ID NO: 158364 - DNA, 16 bp, H. sapiens
ttaaagtactaaaaga

SEQ ID NO: 158365 - DNA, 16 bp, H. sapiens
ttaaagtacttttttc

SEQ ID NO: 158366 - DNA, 16 bp, H. sapiens
ttaaagtacttttttt

SEQ ID NO: 158367 - DNA, 16 bp, H. sapiens
ttaaagtagatttttc

SEQ ID NO: 158368 - DNA, 16 bp, H. sapiens
ttaaagtatacaataa

SEQ ID NO: 158369 - DNA, 16 bp, H. sapiens
ttaaagtatacaggag

SEQ ID NO: 158370 - DNA, 16 bp, H. sapiens
ttaaagtatattttct

SEQ ID NO: 158371 - DNA, 16 bp, H. sapiens
ttaaagtattttttcc

SEQ ID NO: 158372 - DNA, 16 bp, H. sapiens
ttaaagtctattttct

SEQ ID NO: 158373 - DNA, 16 bp, H. sapiens
ttaaagtctcagtttc

SEQ ID NO: 158374 - DNA, 16 bp, H. sapiens
ttaaagtctctcttct

SEQ ID NO: 158375 - DNA, 16 bp, H. sapiens
ttaaagtctgaataat

SEQ ID NO: 158376 - DNA, 16 bp, H. sapiens
ttaaagtctgttatca

SEQ ID NO: 158377 - DNA, 16 bp, H. sapiens
ttaaagtctgtttatc

SEQ ID NO: 158378 - DNA, 16 bp, H. sapiens
ttaaagtctgttttta

SEQ ID NO: 158379 - DNA, 16 bp, H. sapiens
ttaaagtgaaagatgt

SEQ ID NO: 158380 - DNA, 16 bp, H. sapiens
ttaaagtgagagacat

SEQ ID NO: 158381 - DNA, 16 bp, H. sapiens
ttaaagtgtaataata

SEQ ID NO: 158382 - DNA, 16 bp, H. sapiens
ttaaagtgtagaattt

SEQ ID NO: 158383 - DNA, 16 bp, H. sapiens
ttaaagtgtgtttctt

SEQ ID NO: 158384 - DNA, 16 bp, H. sapiens
ttaaagttacattttt

SEQ ID NO: 158385 - DNA, 16 bp, H. sapiens
ttaaagttctttttat

SEQ ID NO: 158386 - DNA, 16 bp, H. sapiens
ttaaagtttacttttt

SEQ ID NO: 158387 - DNA, 16 bp, H. sapiens
ttaaagtttatttttc

SEQ ID NO: 158388 - DNA, 16 bp, H. sapiens
ttaaagtttctttctt

SEQ ID NO: 158389 - DNA, 16 bp, H. sapiens
ttaaagttttagtttg

SEQ ID NO: 158390 - DNA, 16 bp, H. sapiens
ttaaagttttttgaaa

SEQ ID NO: 158391 - DNA, 16 bp, H. sapiens
ttaaataaaacaattg

SEQ ID NO: 158392 - DNA, 16 bp, H. sapiens
ttaaataaaccttttt

SEQ ID NO: 158393 - DNA, 16 bp, H. sapiens
ttaaataaacttgctt

SEQ ID NO: 158394 - DNA, 16 bp, H. sapiens
ttaaataaagacaaga

SEQ ID NO: 158395 - DNA, 16 bp, H. sapiens
ttaaataaatgcaaat

SEQ ID NO: 158396 - DNA, 16 bp, H. sapiens
ttaaataaatggtgct

SEQ ID NO: 158397 - DNA, 16 bp, H. sapiens
ttaaataaatggtgtt

SEQ ID NO: 158398 - DNA, 16 bp, H. sapiens
ttaaataaatgtcatt

SEQ ID NO: 158399 - DNA, 16 bp, H. sapiens
ttaaataaattacagt

SEQ ID NO: 158400 - DNA, 16 bp, H. sapiens
ttaaataaattatgca

SEQ ID NO: 158401 - DNA, 16 bp, H. sapiens
ttaaataaattgaatc

SEQ ID NO: 158402 - DNA, 16 bp, H. sapiens
ttaaataaatttgctt

SEQ ID NO: 158403 - DNA, 16 bp, H. sapiens
ttaaataactgaaatt

SEQ ID NO: 158404 - DNA, 16 bp, H. sapiens
ttaaataataaggctt

SEQ ID NO: 158405 - DNA, 16 bp, H. sapiens
ttaaataatgaacaaa

SEQ ID NO: 158406 - DNA, 16 bp, H. sapiens
ttaaatacagaaaata

SEQ ID NO: 158407 - DNA, 16 bp, H. sapiens
ttaaatacattgaaaa

SEQ ID NO: 158408 - DNA, 16 bp, H. sapiens
ttaaatacatttgtat

SEQ ID NO: 158409 - DNA, 16 bp, H. sapiens
ttaaatagactttttt

SEQ ID NO: 158410 - DNA, 16 bp, H. sapiens
ttaaataggaaaatgt

SEQ ID NO: 158411 - DNA, 16 bp, H. sapiens
ttaaatagtttttttc

SEQ ID NO: 158412 - DNA, 16 bp, H. sapiens
ttaaatataaaatggt

SEQ ID NO: 158413 - DNA, 16 bp, H. sapiens
ttaaatataaatggat

SEQ ID NO: 158414 - DNA, 16 bp, H. sapiens
ttaaatataatttcca

SEQ ID NO: 158415 - DNA, 16 bp, H. sapiens
ttaaatatatgcagtt

SEQ ID NO: 158416 - DNA, 16 bp, H. sapiens
ttaaatatatgctttt

SEQ ID NO: 158417 - DNA, 16 bp, H. sapiens
ttaaatatatgtagtt

SEQ ID NO: 158418 - DNA, 16 bp, H. sapiens
ttaaatatattcctag

SEQ ID NO: 158419 - DNA, 16 bp, H. sapiens
ttaaatatcttttcaa

SEQ ID NO: 158420 - DNA, 16 bp, H. sapiens
ttaaatatgaacaaat

SEQ ID NO: 158421 - DNA, 16 bp, H. sapiens
ttaaatatgcaaaata

SEQ ID NO: 158422 - DNA, 16 bp, H. sapiens
ttaaatatgcatattt

SEQ ID NO: 158423 - DNA, 16 bp, H. sapiens
ttaaatatggaaaaca

SEQ ID NO: 158424 - DNA, 16 bp, H. sapiens
ttaaatatgtagatca

SEQ ID NO: 158425 - DNA, 16 bp, H. sapiens
ttaaatatgtgcagtt

SEQ ID NO: 158426 - DNA, 16 bp, H. sapiens
ttaaatatgttttcat

SEQ ID NO: 158427 - DNA, 16 bp, H. sapiens
ttaaatattcaggaat

SEQ ID NO: 158428 - DNA, 16 bp, H. sapiens
ttaaatatttcagtgt

SEQ ID NO: 158429 - DNA, 16 bp, H. sapiens
ttaaatatttgctaaa

SEQ ID NO: 158430 - DNA, 16 bp, H. sapiens
ttaaatatttgctcaa

SEQ ID NO: 158431 - DNA, 16 bp, H. sapiens
ttaaatattttgacta

SEQ ID NO: 158432 - DNA, 16 bp, H. sapiens
ttaaatattttgctaa

SEQ ID NO: 158433 - DNA, 16 bp, H. sapiens
ttaaatcacttgccca

SEQ ID NO: 158434 - DNA, 16 bp, H. sapiens
ttaaatcagaaatgaa

SEQ ID NO: 158435 - DNA, 16 bp, H. sapiens
ttaaatcattaatttg

SEQ ID NO: 158436 - DNA, 16 bp, H. sapiens
ttaaatcatttcagca

SEQ ID NO: 158437 - DNA, 16 bp, H. sapiens
ttaaatccattgtttc

SEQ ID NO: 158438 - DNA, 16 bp, H. sapiens
ttaaatctgtttttaa

SEQ ID NO: 158439 - DNA, 16 bp, H. sapiens
ttaaatctgtttttct

SEQ ID NO: 158440 - DNA, 16 bp, H. sapiens
ttaaatctttctttgg

SEQ ID NO: 158441 - DNA, 16 bp, H. sapiens
ttaaatgaaatcaaat

SEQ ID NO: 158442 - DNA, 16 bp, H. sapiens
ttaaatgaaatctttt

SEQ ID NO: 158443 - DNA, 16 bp, H. sapiens
ttaaatgaaatgtttt

SEQ ID NO: 158444 - DNA, 16 bp, H. sapiens
ttaaatgaacatttta

SEQ ID NO: 158445 - DNA, 16 bp, H. sapiens
ttaaatgaattagtat

SEQ ID NO: 158446 - DNA, 16 bp, H. sapiens
ttaaatgacaagttaa

SEQ ID NO: 158447 - DNA, 19 bp, H. sapiens
ttaaatgacctgatggagc

SEQ ID NO: 158448 - DNA, 16 bp, H. sapiens
ttaaatgagaaaatac

SEQ ID NO: 158449 - DNA, 16 bp, H. sapiens
ttaaatgagattatat

SEQ ID NO: 158450 - DNA, 16 bp, H. sapiens
ttaaatgagttaagac

SEQ ID NO: 158451 - DNA, 16 bp, H. sapiens
ttaaatgattacattt

SEQ ID NO: 158452 - DNA, 16 bp, H. sapiens
ttaaatgatttgctca

SEQ ID NO: 158453 - DNA, 16 bp, H. sapiens
ttaaatgatttttctt

SEQ ID NO: 158454 - DNA, 16 bp, H. sapiens
ttaaatgcaaatataa

SEQ ID NO: 158455 - DNA, 16 bp, H. sapiens
ttaaatgcaaattaaa

SEQ ID NO: 158456 - DNA, 16 bp, H. sapiens
ttaaatgcaatagttt

SEQ ID NO: 158457 - DNA, 16 bp, H. sapiens
ttaaatgcatatttta

SEQ ID NO: 158458 - DNA, 16 bp, H. sapiens
ttaaatgcattttttt

SEQ ID NO: 158459 - DNA, 16 bp, H. sapiens
ttaaatgccttgaggt

SEQ ID NO: 158460 - DNA, 16 bp, H. sapiens
ttaaatgctccaatta

SEQ ID NO: 158461 - DNA, 16 bp, H. sapiens
ttaaatgcttatatta

SEQ ID NO: 158462 - DNA, 16 bp, H. sapiens
ttaaatgcttcatttt

SEQ ID NO: 158463 - DNA, 16 bp, H. sapiens
ttaaatggaaaaagca

SEQ ID NO: 158464 - DNA, 16 bp, H. sapiens
ttaaatggaaaacaaa

SEQ ID NO: 158465 - DNA, 16 bp, H. sapiens
ttaaatggaaaattct

SEQ ID NO: 158466 - DNA, 16 bp, H. sapiens
ttaaatggaatggaat

SEQ ID NO: 158467 - DNA, 16 bp, H. sapiens
ttaaatggatttttaa

SEQ ID NO: 158468 - DNA, 16 bp, H. sapiens
ttaaatggctaaaatg

SEQ ID NO: 158469 - DNA, 16 bp, H. sapiens
ttaaatgggataatgt

SEQ ID NO: 158470 - DNA, 16 bp, H. sapiens
ttaaatgggcaaaata

SEQ ID NO: 158471 - DNA, 16 bp, H. sapiens
ttaaatggtaaatttt

SEQ ID NO: 158472 - DNA, 16 bp, H. sapiens
ttaaatggtttttaaa

SEQ ID NO: 158473 - DNA, 16 bp, H. sapiens
ttaaatgtaaaaacca

SEQ ID NO: 158474 - DNA, 16 bp, H. sapiens
ttaaatgtaaaagtat

SEQ ID NO: 158475 - DNA, 21 bp, H. sapiens
ttaaatgtaaacgggctaaat

SEQ ID NO: 158476 - DNA, 16 bp, H. sapiens
ttaaatgtaaatagat

SEQ ID NO: 158477 - DNA, 16 bp, H. sapiens
ttaaatgtaaatggat

SEQ ID NO: 158478 - DNA, 16 bp, H. sapiens
ttaaatgtaaatggcc

SEQ ID NO: 158479 - DNA, 21 bp, H. sapiens
ttaaatgtaaatgggctaaat

SEQ ID NO: 158480 - DNA, 16 bp, H. sapiens
ttaaatgtacattttg

SEQ ID NO: 158481 - DNA, 16 bp, H. sapiens
ttaaatgtatacatta

SEQ ID NO: 158482 - DNA, 16 bp, H. sapiens
ttaaatgtatcccaga

SEQ ID NO: 158483 - DNA, 16 bp, H. sapiens
ttaaatgtatgcattt

SEQ ID NO: 158484 - DNA, 16 bp, H. sapiens
ttaaatgtcacttttt

SEQ ID NO: 158485 - DNA, 16 bp, H. sapiens
ttaaatgtccagtttt

SEQ ID NO: 158486 - DNA, 16 bp, H. sapiens
ttaaatgtgaaaccca

SEQ ID NO: 158487 - DNA, 16 bp, H. sapiens
ttaaatgtgaatttca

SEQ ID NO: 158488 - DNA, 16 bp, H. sapiens
ttaaatgtgataatgt

SEQ ID NO: 158489 - DNA, 16 bp, H. sapiens
ttaaatgtgtcctaga

SEQ ID NO: 158490 - DNA, 16 bp, H. sapiens
ttaaatgttaatatca

SEQ ID NO: 158491 - DNA, 16 bp, H. sapiens
ttaaatgttgctttaa

SEQ ID NO: 158492 - DNA, 16 bp, H. sapiens
ttaaatgtttcatttt

SEQ ID NO: 158493 - DNA, 16 bp, H. sapiens
ttaaatgtttctttct

SEQ ID NO: 158494 - DNA, 16 bp, H. sapiens
ttaaatgtttctttgt

SEQ ID NO: 158495 - DNA, 16 bp, H. sapiens
ttaaatgtttggaaga

SEQ ID NO: 158496 - DNA, 16 bp, H. sapiens
ttaaattacaaattca

SEQ ID NO: 158497 - DNA, 16 bp, H. sapiens
ttaaattactatttca

SEQ ID NO: 158498 - DNA, 16 bp, H. sapiens
ttaaattatactacaa

SEQ ID NO: 158499 - DNA, 16 bp, H. sapiens
ttaaattatgcatttt

SEQ ID NO: 158500 - DNA, 16 bp, H. sapiens
ttaaattattttcttg

SEQ ID NO: 158501 - DNA, 16 bp, H. sapiens
ttaaattatttttgac

SEQ ID NO: 158502 - DNA, 16 bp, H. sapiens
ttaaattcaaagaaat

SEQ ID NO: 158503 - DNA, 16 bp, H. sapiens
ttaaattcaaatttca

SEQ ID NO: 158504 - DNA, 16 bp, H. sapiens
ttaaattcctttaaat

SEQ ID NO: 158505 - DNA, 16 bp, H. sapiens
ttaaattctctctgtt

SEQ ID NO: 158506 - DNA, 16 bp, H. sapiens
ttaaattctgaaatat

SEQ ID NO: 158507 - DNA, 16 bp, H. sapiens
ttaaattgagacagag

SEQ ID NO: 158508 - DNA, 16 bp, H. sapiens
ttaaattgtttctgtt

SEQ ID NO: 158509 - DNA, 16 bp, H. sapiens
ttaaatttacatttca

SEQ ID NO: 158510 - DNA, 16 bp, H. sapiens
ttaaatttatctctaa

SEQ ID NO: 158511 - DNA, 16 bp, H. sapiens
ttaaatttattcctaa

SEQ ID NO: 158512 - DNA, 16 bp, H. sapiens
ttaaatttattgaggt

SEQ ID NO: 158513 - DNA, 16 bp, H. sapiens
ttaaatttcacctttt

SEQ ID NO: 158514 - DNA, 17 bp, H. sapiens
ttaaatttcatatggaa

SEQ ID NO: 158515 - DNA, 16 bp, H. sapiens
ttaaatttcatcaaat

SEQ ID NO: 158516 - DNA, 16 bp, H. sapiens
ttaaatttctttcaaa

SEQ ID NO: 158517 - DNA, 16 bp, H. sapiens
ttaaatttgaattcca

SEQ ID NO: 158518 - DNA, 16 bp, H. sapiens
ttaaatttgtatttca

SEQ ID NO: 158519 - DNA, 16 bp, H. sapiens
ttaaatttgtggtaat

SEQ ID NO: 158520 - DNA, 16 bp, H. sapiens
ttaaatttgtgtgtgt

SEQ ID NO: 158521 - DNA, 16 bp, H. sapiens
ttaaatttgttttcat

SEQ ID NO: 158522 - DNA, 16 bp, H. sapiens
ttaaattttaatgaag

SEQ ID NO: 158523 - DNA, 16 bp, H. sapiens
ttaaattttctaatag

SEQ ID NO: 158524 - DNA, 16 bp, H. sapiens
ttaaattttctttaag

SEQ ID NO: 158525 - DNA, 16 bp, H. sapiens
ttaaattttgaaaatg

SEQ ID NO: 158526 - DNA, 16 bp, H. sapiens
ttaaattttgataaag

SEQ ID NO: 158527 - DNA, 16 bp, H. sapiens
ttaaatttttctcaaa

SEQ ID NO: 158528 - DNA, 16 bp, H. sapiens
ttaacaaaaattgttt

SEQ ID NO: 158529 - DNA, 16 bp, H. sapiens
ttaacaaaatccaaat

SEQ ID NO: 158530 - DNA, 16 bp, H. sapiens
ttaacaaaatccaaca

SEQ ID NO: 158531 - DNA, 16 bp, H. sapiens
ttaacaaaatgagaaa

SEQ ID NO: 158532 - DNA, 16 bp, H. sapiens
ttaacaaaattgaaat

SEQ ID NO: 158533 - DNA, 16 bp, H. sapiens
ttaacaaactgattct

SEQ ID NO: 158534 - DNA, 16 bp, H. sapiens
ttaacaaagaaacatt

SEQ ID NO: 158535 - DNA, 16 bp, H. sapiens
ttaacaaattttaaag

SEQ ID NO: 158536 - DNA, 16 bp, H. sapiens
ttaacaacaatgtatt

SEQ ID NO: 158537 - DNA, 16 bp, H. sapiens
ttaacaagcaaaaaat

SEQ ID NO: 158538 - DNA, 16 bp, H. sapiens
ttaacaagctcccagg

SEQ ID NO: 158539 - DNA, 16 bp, H. sapiens
ttaacaaggaaagaaa

SEQ ID NO: 158540 - DNA, 16 bp, H. sapiens
ttaacaaggatattta

SEQ ID NO: 158541 - DNA, 16 bp, H. sapiens
ttaacaagggaagtga

SEQ ID NO: 158542 - DNA, 16 bp, H. sapiens
ttaacaagtatttatt

SEQ ID NO: 158543 - DNA, 16 bp, H. sapiens
ttaacaataatctatt

SEQ ID NO: 158544 - DNA, 16 bp, H. sapiens
ttaacaatactgtatt

SEQ ID NO: 158545 - DNA, 16 bp, H. sapiens
ttaacaatattaattc

SEQ ID NO: 158546 - DNA, 16 bp, H. sapiens
ttaacaattctgaaat

SEQ ID NO: 158547 - DNA, 16 bp, H. sapiens
ttaacaattttaaaag

SEQ ID NO: 158548 - DNA, 16 bp, H. sapiens
ttaacacaaatttatt

SEQ ID NO: 158549 - DNA, 16 bp, H. sapiens
ttaacacatccatcat

SEQ ID NO: 158550 - DNA, 16 bp, H. sapiens
ttaacacatttaagaa

SEQ ID NO: 158551 - DNA, 16 bp, H. sapiens
ttaacacattttgtat

SEQ ID NO: 158552 - DNA, 16 bp, H. sapiens
ttaacacattttttaa

SEQ ID NO: 158553 - DNA, 16 bp, H. sapiens
ttaacaccaaataata

SEQ ID NO: 158554 - DNA, 16 bp, H. sapiens
ttaacaccagcctggg

SEQ ID NO: 158555 - DNA, 16 bp, H. sapiens
ttaacacctgtaatcc

SEQ ID NO: 158556 - DNA, 16 bp, H. sapiens
ttaacactacatggaa

SEQ ID NO: 158557 - DNA, 16 bp, H. sapiens
ttaacactgcagaaaa

SEQ ID NO: 158558 - DNA, 16 bp, H. sapiens
ttaacactgtttactg

SEQ ID NO: 158559 - DNA, 16 bp, H. sapiens
ttaacagaaatagaaa

SEQ ID NO: 158560 - DNA, 16 bp, H. sapiens
ttaacagaagaagaaa

SEQ ID NO: 158561 - DNA, 16 bp, H. sapiens
ttaacagaagagaaaa

SEQ ID NO: 158562 - DNA, 16 bp, H. sapiens
ttaacagaaggaaaga

SEQ ID NO: 158563 - DNA, 16 bp, H. sapiens
ttaacagataaagaaa

SEQ ID NO: 158564 - DNA, 16 bp, H. sapiens
ttaacagatatttaaa

SEQ ID NO: 158565 - DNA, 16 bp, H. sapiens
ttaacagatgaagaaa

SEQ ID NO: 158566 - DNA, 16 bp, H. sapiens
ttaacagatgaatgga

SEQ ID NO: 158567 - DNA, 16 bp, H. sapiens
ttaacagatgaggaag

SEQ ID NO: 158568 - DNA, 16 bp, H. sapiens
ttaacagatggggaaa

SEQ ID NO: 158569 - DNA, 17 bp, H. sapiens
ttaacagcaaaccagtc

SEQ ID NO: 158570 - DNA, 16 bp, H. sapiens
ttaacagcagaattga

SEQ ID NO: 158571 - DNA, 16 bp, H. sapiens
ttaacagcttttaaca

SEQ ID NO: 158572 - DNA, 16 bp, H. sapiens
ttaacagtattttaaa

SEQ ID NO: 158573 - DNA, 16 bp, H. sapiens
ttaacataaatgaaaa

SEQ ID NO: 158574 - DNA, 17 bp, H. sapiens
ttaacatatgcaagtca

SEQ ID NO: 158575 - DNA, 16 bp, H. sapiens
ttaacatcaacacaga

SEQ ID NO: 158576 - DNA, 16 bp, H. sapiens
ttaacatcaacagtga

SEQ ID NO: 158577 - DNA, 16 bp, H. sapiens
ttaacatctttattga

SEQ ID NO: 158578 - DNA, 16 bp, H. sapiens
ttaacatgaaggaatg

SEQ ID NO: 158579 - DNA, 16 bp, H. sapiens
ttaacatggtgaaacc

SEQ ID NO: 158580 - DNA, 16 bp, H. sapiens
ttaacatgtggggatt

SEQ ID NO: 158581 - DNA, 16 bp, H. sapiens
ttaacatgtttttatt

SEQ ID NO: 158582 - DNA, 16 bp, H. sapiens
ttaacattaaacattt

SEQ ID NO: 158583 - DNA, 16 bp, H. sapiens
ttaacattaaatgtaa

SEQ ID NO: 158584 - DNA, 16 bp, H. sapiens
ttaacattctcatttt

SEQ ID NO: 158585 - DNA, 16 bp, H. sapiens
ttaacatttaaatgtt

SEQ ID NO: 158586 - DNA, 16 bp, H. sapiens
ttaacatttattaagt

SEQ ID NO: 158587 - DNA, 16 bp, H. sapiens
ttaacatttattttag

SEQ ID NO: 158588 - DNA, 16 bp, H. sapiens
ttaacatttcatttaa

SEQ ID NO: 158589 - DNA, 16 bp, H. sapiens
ttaacatttgttgaat

SEQ ID NO: 158590 - DNA, 16 bp, H. sapiens
ttaacattttcagaaa

SEQ ID NO: 158591 - DNA, 16 bp, H. sapiens
ttaacattttgttaaa

SEQ ID NO: 158592 - DNA, 16 bp, H. sapiens
ttaacatttttagaaa

SEQ ID NO: 158593 - DNA, 16 bp, H. sapiens
ttaacatttttattga

SEQ ID NO: 158594 - DNA, 16 bp, H. sapiens
ttaaccaacagaaatt

SEQ ID NO: 158595 - DNA, 17 bp, H. sapiens
ttaaccaagtggtgact

SEQ ID NO: 158596 - DNA, 16 bp, H. sapiens
ttaaccaatttgccag

SEQ ID NO: 158597 - DNA, 16 bp, H. sapiens
ttaaccagctgtggtg

SEQ ID NO: 158598 - DNA, 16 bp, H. sapiens
ttaaccagtcatggtg

SEQ ID NO: 158599 - DNA, 16 bp, H. sapiens
ttaaccagttgtggtg

SEQ ID NO: 158600 - DNA, 16 bp, H. sapiens
ttaaccataaaatctt

SEQ ID NO: 158601 - DNA, 16 bp, H. sapiens
ttaaccatcacaagtt

SEQ ID NO: 158602 - DNA, 16 bp, H. sapiens
ttaaccatcacactca

SEQ ID NO: 158603 - DNA, 16 bp, H. sapiens
ttaaccattcacccac

SEQ ID NO: 158604 - DNA, 16 bp, H. sapiens
ttaaccatttaaaaat

SEQ ID NO: 158605 - DNA, 16 bp, H. sapiens
ttaaccatttaaaagt

SEQ ID NO: 158606 - DNA, 16 bp, H. sapiens
ttaaccatttgtgaag

SEQ ID NO: 158607 - DNA, 16 bp, H. sapiens
ttaaccatttttaaat

SEQ ID NO: 158608 - DNA, 16 bp, H. sapiens
ttaacccattccagca

SEQ ID NO: 158609 - DNA, 16 bp, H. sapiens
ttaacccatttatgcc

SEQ ID NO: 158610 - DNA, 16 bp, H. sapiens
ttaacccctctgagcc

SEQ ID NO: 158611 - DNA, 16 bp, H. sapiens
ttaaccgtttttaagt

SEQ ID NO: 158612 - DNA, 16 bp, H. sapiens
ttaacctaaatgctat

SEQ ID NO: 158613 - DNA, 16 bp, H. sapiens
ttaacctccctgagcc

SEQ ID NO: 158614 - DNA, 16 bp, H. sapiens
ttaacctctcagtgcc

SEQ ID NO: 158615 - DNA, 16 bp, H. sapiens
ttaacctctctaagcc

SEQ ID NO: 158616 - DNA, 16 bp, H. sapiens
ttaacctctttgagcc

SEQ ID NO: 158617 - DNA, 16 bp, H. sapiens
ttaacctgggaggcag

SEQ ID NO: 158618 - DNA, 16 bp, H. sapiens
ttaacctgtctcttct

SEQ ID NO: 158619 - DNA, 16 bp, H. sapiens
ttaaccttaaatgcaa

SEQ ID NO: 158620 - DNA, 16 bp, H. sapiens
ttaactaaagtccatg

SEQ ID NO: 158621 - DNA, 16 bp, H. sapiens
ttaactaggtgtggtg

SEQ ID NO: 158622 - DNA, 16 bp, H. sapiens
ttaactcaacatggat

SEQ ID NO: 158623 - DNA, 16 bp, H. sapiens
ttaactcattccagca

SEQ ID NO: 158624 - DNA, 16 bp, H. sapiens
ttaactcatttaaatc

SEQ ID NO: 158625 - DNA, 16 bp, H. sapiens
ttaactcattttatcc

SEQ ID NO: 158626 - DNA, 16 bp, H. sapiens
ttaactctatgagatg

SEQ ID NO: 158627 - DNA, 16 bp, H. sapiens
ttaactctgatgatag

SEQ ID NO: 158628 - DNA, 16 bp, H. sapiens
ttaactctgccttttg

SEQ ID NO: 158629 - DNA, 16 bp, H. sapiens
ttaactgaaaatattt

SEQ ID NO: 158630 - DNA, 16 bp, H. sapiens
ttaactgaagaaaaat

SEQ ID NO: 158631 - DNA, 16 bp, H. sapiens
ttaactgcagccttga

SEQ ID NO: 158632 - DNA, 16 bp, H. sapiens
ttaactgcagtcacca

SEQ ID NO: 158633 - DNA, 16 bp, H. sapiens
ttaactgctctataga

SEQ ID NO: 158634 - DNA, 17 bp, H. sapiens
ttaactgtacaaattgt

SEQ ID NO: 158635 - DNA, 16 bp, H. sapiens
ttaactgtttatgtta

SEQ ID NO: 158636 - DNA, 16 bp, H. sapiens
ttaacttattccagca

SEQ ID NO: 158637 - DNA, 16 bp, H. sapiens
ttaacttcaaaaggaa

SEQ ID NO: 158638 - DNA, 16 bp, H. sapiens
ttaacttgaaaaaaat

SEQ ID NO: 158639 - DNA, 16 bp, H. sapiens
ttaactttaaatgtaa

SEQ ID NO: 158640 - DNA, 16 bp, H. sapiens
ttaactttaagttcag

SEQ ID NO: 158641 - DNA, 16 bp, H. sapiens
ttaactttgaaataaa

SEQ ID NO: 158642 - DNA, 16 bp, H. sapiens
ttaactttgtatcctg

SEQ ID NO: 158643 - DNA, 16 bp, H. sapiens
ttaacttttaaaaagt

SEQ ID NO: 158644 - DNA, 16 bp, H. sapiens
ttaacttttattatag

SEQ ID NO: 158645 - DNA, 16 bp, H. sapiens
ttaacttttcccagtt

SEQ ID NO: 158646 - DNA, 16 bp, H. sapiens
ttaacttttgtatatg

SEQ ID NO: 158647 - DNA, 16 bp, H. sapiens
ttaactttttatttgg

SEQ ID NO: 158648 - DNA, 16 bp, H. sapiens
ttaactttttttgtag

SEQ ID NO: 158649 - DNA, 16 bp, H. sapiens
ttaagaaaaaaacttt

SEQ ID NO: 158650 - DNA, 16 bp, H. sapiens
ttaagaaaactgaaat

SEQ ID NO: 158651 - DNA, 16 bp, H. sapiens
ttaagaaaagaagttt

SEQ ID NO: 158652 - DNA, 16 bp, H. sapiens
ttaagaaaatgtgcca

SEQ ID NO: 158653 - DNA, 16 bp, H. sapiens
ttaagaaaatgtggga

SEQ ID NO: 158654 - DNA, 16 bp, H. sapiens
ttaagaaacaatttaa

SEQ ID NO: 158655 - DNA, 16 bp, H. sapiens
ttaagaaaccagaaaa

SEQ ID NO: 158656 - DNA, 16 bp, H. sapiens
ttaagaaactggaaaa

SEQ ID NO: 158657 - DNA, 16 bp, H. sapiens
ttaagaaacttgaaaa

SEQ ID NO: 158658 - DNA, 16 bp, H. sapiens
ttaagaaagaaccaaa

SEQ ID NO: 158659 - DNA, 16 bp, H. sapiens
ttaagaaagtaaagga

SEQ ID NO: 158660 - DNA, 16 bp, H. sapiens
ttaagaaataaaacat

SEQ ID NO: 158661 - DNA, 16 bp, H. sapiens
ttaagaaatacattct

SEQ ID NO: 158662 - DNA, 16 bp, H. sapiens
ttaagaaatagaacat

SEQ ID NO: 158663 - DNA, 16 bp, H. sapiens
ttaagaaatatttgct

SEQ ID NO: 158664 - DNA, 16 bp, H. sapiens
ttaagaaatctccaaa

SEQ ID NO: 158665 - DNA, 16 bp, H. sapiens
ttaagaaatgtaattt

SEQ ID NO: 158666 - DNA, 16 bp, H. sapiens
ttaagaaattcttaaa

SEQ ID NO: 158667 - DNA, 16 bp, H. sapiens
ttaagaaattgctaca

SEQ ID NO: 158668 - DNA, 16 bp, H. sapiens
ttaagaacacttgtga

SEQ ID NO: 158669 - DNA, 16 bp, H. sapiens
ttaagaacttgtttta

SEQ ID NO: 158670 - DNA, 16 bp, H. sapiens
ttaagaagagagagag

SEQ ID NO: 158671 - DNA, 16 bp, H. sapiens
ttaagaagttagaaaa

SEQ ID NO: 158672 - DNA, 16 bp, H. sapiens
ttaagaagtttaaaat

SEQ ID NO: 158673 - DNA, 16 bp, H. sapiens
ttaagaataaaacatt

SEQ ID NO: 158674 - DNA, 16 bp, H. sapiens
ttaagaataaactttt

SEQ ID NO: 158675 - DNA, 16 bp, H. sapiens
ttaagaatattcacaa

SEQ ID NO: 158676 - DNA, 16 bp, H. sapiens
ttaagaatattcttaa

SEQ ID NO: 158677 - DNA, 17 bp, H. sapiens
ttaagaatgcctttaag

SEQ ID NO: 158678 - DNA, 16 bp, H. sapiens
ttaagaatttggggga

SEQ ID NO: 158679 - DNA, 16 bp, H. sapiens
ttaagacaaatgaaaa

SEQ ID NO: 158680 - DNA, 16 bp, H. sapiens
ttaagacactgaaaaa

SEQ ID NO: 158681 - DNA, 16 bp, H. sapiens
ttaagacagttatttt

SEQ ID NO: 158682 - DNA, 16 bp, H. sapiens
ttaagacatttaaaaa

SEQ ID NO: 158683 - DNA, 16 bp, H. sapiens
ttaagacctgaaacca

SEQ ID NO: 158684 - DNA, 16 bp, H. sapiens
ttaagactttaaaaat

SEQ ID NO: 158685 - DNA, 16 bp, H. sapiens
ttaagacttttacatt

SEQ ID NO: 158686 - DNA, 16 bp, H. sapiens
ttaagagaaaaaagca

SEQ ID NO: 158687 - DNA, 16 bp, H. sapiens
ttaagagaaaagactg

SEQ ID NO: 158688 - DNA, 16 bp, H. sapiens
ttaagagacaagatct

SEQ ID NO: 158689 - DNA, 16 bp, H. sapiens
ttaagagacagggtct

SEQ ID NO: 158690 - DNA, 16 bp, H. sapiens
ttaagagaccaggtct

SEQ ID NO: 158691 - DNA, 18 bp, H. sapiens
ttaagagcaatgttttgc

SEQ ID NO: 158692 - DNA, 16 bp, H. sapiens
ttaagagcagcctggg

SEQ ID NO: 158693 - DNA, 16 bp, H. sapiens
ttaagaggtgattggg

SEQ ID NO: 158694 - DNA, 47 bp, H. sapiens
ttaagagtcatcaccactccctaatctcaagtacccagggacacaaa

SEQ ID NO: 158695 - DNA, 16 bp, H. sapiens
ttaagagttatttata

SEQ ID NO: 158696 - DNA, 16 bp, H. sapiens
ttaagagttatttgta

SEQ ID NO: 158697 - DNA, 16 bp, H. sapiens
ttaagataaagattgt

SEQ ID NO: 158698 - DNA, 16 bp, H. sapiens
ttaagataaatttcta

SEQ ID NO: 158699 - DNA, 16 bp, H. sapiens
ttaagatacatatttt

SEQ ID NO: 158700 - DNA, 16 bp, H. sapiens
ttaagatattttacat

SEQ ID NO: 158701 - DNA, 16 bp, H. sapiens
ttaagatcaggaaaaa

SEQ ID NO: 158702 - DNA, 16 bp, H. sapiens
ttaagatcattatttt

SEQ ID NO: 158703 - DNA, 16 bp, H. sapiens
ttaagatctttaaact

SEQ ID NO: 158704 - DNA, 16 bp, H. sapiens
ttaagatgataaattt

SEQ ID NO: 158705 - DNA, 16 bp, H. sapiens
ttaagatggagttgct

SEQ ID NO: 158706 - DNA, 16 bp, H. sapiens
ttaagatgtatcatta

SEQ ID NO: 158707 - DNA, 16 bp, H. sapiens
ttaagatgtttatcaa

SEQ ID NO: 158708 - DNA, 16 bp, H. sapiens
ttaagatgtttattaa

SEQ ID NO: 158709 - DNA, 16 bp, H. sapiens
ttaagattcttttctt

SEQ ID NO: 158710 - DNA, 16 bp, H. sapiens
ttaagatttttacatt

SEQ ID NO: 158711 - DNA, 16 bp, H. sapiens
ttaagcaaatttttaa

SEQ ID NO: 158712 - DNA, 16 bp, H. sapiens
ttaagcaagagaaaga

SEQ ID NO: 158713 - DNA, 18 bp, H. sapiens
ttaagcaattctcctgct

SEQ ID NO: 158714 - DNA, 16 bp, H. sapiens
ttaagcagaggagtga

SEQ ID NO: 158715 - DNA, 16 bp, H. sapiens
ttaagcatatatatat

SEQ ID NO: 158716 - DNA, 16 bp, H. sapiens
ttaagcatattttcat

SEQ ID NO: 158717 - DNA, 16 bp, H. sapiens
ttaagcattttaaaaa

SEQ ID NO: 158718 - DNA, 16 bp, H. sapiens
ttaagcattttttaaa

SEQ ID NO: 158719 - DNA, 16 bp, H. sapiens
ttaagcatttttttaa

SEQ ID NO: 158720 - DNA, 16 bp, H. sapiens
ttaagccaaaagaaca

SEQ ID NO: 158721 - DNA, 16 bp, H. sapiens
ttaagccagtggttct

SEQ ID NO: 158722 - DNA, 16 bp, H. sapiens
ttaagccattaaattt

SEQ ID NO: 158723 - DNA, 19 bp, H. sapiens
ttaagcccagcatgcatta

SEQ ID NO: 158724 - DNA, 16 bp, H. sapiens
ttaagcccaggagttg

SEQ ID NO: 158725 - DNA, 16 bp, H. sapiens
ttaagcccaggggttc

SEQ ID NO: 158726 - DNA, 19 bp, H. sapiens
ttaagccctgcatgcatta

SEQ ID NO: 158727 - DNA, 16 bp, H. sapiens
ttaagcctgaagaact

SEQ ID NO: 158728 - DNA, 16 bp, H. sapiens
ttaagcgatccacctg

SEQ ID NO: 158729 - DNA, 16 bp, H. sapiens
ttaagctaatcaagga

SEQ ID NO: 158730 - DNA, 16 bp, H. sapiens
ttaagctctgaaattc

SEQ ID NO: 158731 - DNA, 18 bp, H. sapiens
ttaagctgctgaccctga

SEQ ID NO: 158732 - DNA, 24 bp, H. sapiens
ttaagctggtaagcaacttcagca

SEQ ID NO: 158733 - DNA, 16 bp, H. sapiens
ttaagctgttcttgca

SEQ ID NO: 158734 - DNA, 16 bp, H. sapiens
ttaagctttgtcagta

SEQ ID NO: 158735 - DNA, 16 bp, H. sapiens
ttaaggaaaatatttt

SEQ ID NO: 158736 - DNA, 16 bp, H. sapiens
ttaaggaaattaaaag

SEQ ID NO: 158737 - DNA, 16 bp, H. sapiens
ttaaggaagaaattaa

SEQ ID NO: 158738 - DNA, 16 bp, H. sapiens
ttaaggaatcaaattt

SEQ ID NO: 158739 - DNA, 16 bp, H. sapiens
ttaaggaatcagagag

SEQ ID NO: 158740 - DNA, 16 bp, H. sapiens
ttaaggacattatgct

SEQ ID NO: 158741 - DNA, 16 bp, H. sapiens
ttaaggacctttgtga

SEQ ID NO: 158742 - DNA, 16 bp, H. sapiens
ttaaggactttgagat

SEQ ID NO: 158743 - DNA, 16 bp, H. sapiens
ttaaggatcttgaaat

SEQ ID NO: 158744 - DNA, 16 bp, H. sapiens
ttaaggatgaggaaac

SEQ ID NO: 158745 - DNA, 16 bp, H. sapiens
ttaaggattttgagat

SEQ ID NO: 158746 - DNA, 16 bp, H. sapiens
ttaaggcacctgccac

SEQ ID NO: 158747 - DNA, 16 bp, H. sapiens
ttaaggcagaaataat

SEQ ID NO: 158748 - DNA, 16 bp, H. sapiens
ttaaggcagaagtcaa

SEQ ID NO: 158749 - DNA, 17 bp, H. sapiens
ttaaggcaggaactggc

SEQ ID NO: 158750 - DNA, 16 bp, H. sapiens
ttaaggcaggaggatc

SEQ ID NO: 158751 - DNA, 16 bp, H. sapiens
ttaaggcagtggttct

SEQ ID NO: 158752 - DNA, 16 bp, H. sapiens
ttaaggcattcttaaa

SEQ ID NO: 158753 - DNA, 16 bp, H. sapiens
ttaaggccaggaattc

SEQ ID NO: 158754 - DNA, 16 bp, H. sapiens
ttaagggcagccacag

SEQ ID NO: 158755 - DNA, 16 bp, H. sapiens
ttaaggggttaatatc

SEQ ID NO: 158756 - DNA, 16 bp, H. sapiens
ttaaggtattttgtta

SEQ ID NO: 158757 - DNA, 16 bp, H. sapiens
ttaaggttttaaaaat

SEQ ID NO: 158758 - DNA, 16 bp, H. sapiens
ttaagtaacctgccca

SEQ ID NO: 158759 - DNA, 16 bp, H. sapiens
ttaagtaacttatcca

SEQ ID NO: 158760 - DNA, 16 bp, H. sapiens
ttaagtaatttcttat

SEQ ID NO: 158761 - DNA, 16 bp, H. sapiens
ttaagtaatttttcaa

SEQ ID NO: 158762 - DNA, 20 bp, H. sapiens
ttaagtacaatgagttctga

SEQ ID NO: 158763 - DNA, 16 bp, H. sapiens
ttaagtacacagacaa

SEQ ID NO: 158764 - DNA, 16 bp, H. sapiens
ttaagtataaaataca

SEQ ID NO: 158765 - DNA, 16 bp, H. sapiens
ttaagtatacaattca

SEQ ID NO: 158766 - DNA, 16 bp, H. sapiens
ttaagtattgatggga

SEQ ID NO: 158767 - DNA, 16 bp, H. sapiens
ttaagtcacttgtcca

SEQ ID NO: 158768 - DNA, 16 bp, H. sapiens
ttaagtctatttaaaa

SEQ ID NO: 158769 - DNA, 16 bp, H. sapiens
ttaagtctttaacttc

SEQ ID NO: 158770 - DNA, 16 bp, H. sapiens
ttaagtgaaaaaagca

SEQ ID NO: 158771 - DNA, 16 bp, H. sapiens
ttaagtgaaaaggtga

SEQ ID NO: 158772 - DNA, 16 bp, H. sapiens
ttaagtgaaaggaaaa

SEQ ID NO: 158773 - DNA, 16 bp, H. sapiens
ttaagtgaaataaacc

SEQ ID NO: 158774 - DNA, 16 bp, H. sapiens
ttaagtgaagatattt

SEQ ID NO: 158775 - DNA, 16 bp, H. sapiens
ttaagtgaagtaactc

SEQ ID NO: 158776 - DNA, 16 bp, H. sapiens
ttaagtgatcttcctg

SEQ ID NO: 158777 - DNA, 16 bp, H. sapiens
ttaagtgatttgcctg

SEQ ID NO: 158778 - DNA, 16 bp, H. sapiens
ttaagtgattttccca

SEQ ID NO: 158779 - DNA, 16 bp, H. sapiens
ttaagtggaagccaat

SEQ ID NO: 158780 - DNA, 16 bp, H. sapiens
ttaagtgtacagtttg

SEQ ID NO: 158781 - DNA, 16 bp, H. sapiens
ttaagttaaaaacaaa

SEQ ID NO: 158782 - DNA, 16 bp, H. sapiens
ttaagttattgatttg

SEQ ID NO: 158783 - DNA, 16 bp, H. sapiens
ttaagttcacagaaaa

SEQ ID NO: 158784 - DNA, 16 bp, H. sapiens
ttaagttcattataga

SEQ ID NO: 158785 - DNA, 16 bp, H. sapiens
ttaagttcattgtaga

SEQ ID NO: 158786 - DNA, 16 bp, H. sapiens
ttaagttcatttgttc

SEQ ID NO: 158787 - DNA, 16 bp, H. sapiens
ttaagttctgggatgc

SEQ ID NO: 158788 - DNA, 16 bp, H. sapiens
ttaagttctttaaaat

SEQ ID NO: 158789 - DNA, 16 bp, H. sapiens
ttaagttgaagccaat

SEQ ID NO: 158790 - DNA, 16 bp, H. sapiens
ttaagttttaaaaaag

SEQ ID NO: 158791 - DNA, 16 bp, H. sapiens
ttaagttttaaaagtt

SEQ ID NO: 158792 - DNA, 16 bp, H. sapiens
ttaagttttcaatttt

SEQ ID NO: 158793 - DNA, 16 bp, H. sapiens
ttaagttttgggggaa

SEQ ID NO: 158794 - DNA, 16 bp, H. sapiens
ttaagttttgtataag

SEQ ID NO: 158795 - DNA, 16 bp, H. sapiens
ttaataaaaacatttc

SEQ ID NO: 158796 - DNA, 16 bp, H. sapiens
ttaataaaaatgggga

SEQ ID NO: 158797 - DNA, 16 bp, H. sapiens
ttaataaaattgacaa

SEQ ID NO: 158798 - DNA, 16 bp, H. sapiens
ttaataaacacatttt

SEQ ID NO: 158799 - DNA, 16 bp, H. sapiens
ttaataaacatgtttt

SEQ ID NO: 158800 - DNA, 16 bp, H. sapiens
ttaataaactgaaaaa

SEQ ID NO: 158801 - DNA, 16 bp, H. sapiens
ttaataaactggcatt

SEQ ID NO: 158802 - DNA, 16 bp, H. sapiens
ttaataaacttacttt

SEQ ID NO: 158803 - DNA, 16 bp, H. sapiens
ttaataaacttgattt

SEQ ID NO: 158804 - DNA, 16 bp, H. sapiens
ttaataaagaaataca

SEQ ID NO: 158805 - DNA, 16 bp, H. sapiens
ttaataaagatgtgtt

SEQ ID NO: 158806 - DNA, 16 bp, H. sapiens
ttaataaagctggaaa

SEQ ID NO: 158807 - DNA, 16 bp, H. sapiens
ttaataaagttgattt

SEQ ID NO: 158808 - DNA, 16 bp, H. sapiens
ttaataaagttgcttt

SEQ ID NO: 158809 - DNA, 16 bp, H. sapiens
ttaataaatacagaaa

SEQ ID NO: 158810 - DNA, 16 bp, H. sapiens
ttaataaatactcatt

SEQ ID NO: 158811 - DNA, 16 bp, H. sapiens
ttaataaatcactgtt

SEQ ID NO: 158812 - DNA, 16 bp, H. sapiens
ttaataaatcacttgc

SEQ ID NO: 158813 - DNA, 16 bp, H. sapiens
ttaataaatgaacaaa

SEQ ID NO: 158814 - DNA, 16 bp, H. sapiens
ttaataaatgaattca

SEQ ID NO: 158815 - DNA, 16 bp, H. sapiens
ttaataaatgctaaaa

SEQ ID NO: 158816 - DNA, 16 bp, H. sapiens
ttaataaatgctgttg

SEQ ID NO: 158817 - DNA, 16 bp, H. sapiens
ttaataaatgcttgtt

SEQ ID NO: 158818 - DNA, 16 bp, H. sapiens
ttaataaatggtgcta

SEQ ID NO: 158819 - DNA, 16 bp, H. sapiens
ttaataaatggttttg

SEQ ID NO: 158820 - DNA, 16 bp, H. sapiens
ttaataaatgtgattt

SEQ ID NO: 158821 - DNA, 16 bp, H. sapiens
ttaataaatgttggtt

SEQ ID NO: 158822 - DNA, 16 bp, H. sapiens
ttaataacaatgcatt

SEQ ID NO: 158823 - DNA, 16 bp, H. sapiens
ttaataacaatgtatt

SEQ ID NO: 158824 - DNA, 16 bp, H. sapiens
ttaataacagtaataa

SEQ ID NO: 158825 - DNA, 16 bp, H. sapiens
ttaataagcaaaatat

SEQ ID NO: 158826 - DNA, 16 bp, H. sapiens
ttaataataaatgctg

SEQ ID NO: 158827 - DNA, 16 bp, H. sapiens
ttaataatcacattaa

SEQ ID NO: 158828 - DNA, 16 bp, H. sapiens
ttaataatgtattgta

SEQ ID NO: 158829 - DNA, 16 bp, H. sapiens
ttaataattcttcata

SEQ ID NO: 158830 - DNA, 16 bp, H. sapiens
ttaataattgtacata

SEQ ID NO: 158831 - DNA, 16 bp, H. sapiens
ttaatacaatgtaaat

SEQ ID NO: 158832 - DNA, 16 bp, H. sapiens
ttaatacataggtgat

SEQ ID NO: 158833 - DNA, 16 bp, H. sapiens
ttaatacatattttgt

SEQ ID NO: 158834 - DNA, 17 bp, H. sapiens
ttaatacctaggtgatg

SEQ ID NO: 158835 - DNA, 16 bp, H. sapiens
ttaatagatatttttc

SEQ ID NO: 158836 - DNA, 16 bp, H. sapiens
ttaatagatgaggaaa

SEQ ID NO: 158837 - DNA, 16 bp, H. sapiens
ttaatagcattttaaa

SEQ ID NO: 158838 - DNA, 16 bp, H. sapiens
ttaatatacacatttt

SEQ ID NO: 158839 - DNA, 16 bp, H. sapiens
ttaatatacctaacct

SEQ ID NO: 158840 - DNA, 16 bp, H. sapiens
ttaatatatttcattg

SEQ ID NO: 158841 - DNA, 16 bp, H. sapiens
ttaatatcattaagat

SEQ ID NO: 158842 - DNA, 16 bp, H. sapiens
ttaatatctatagaaa

SEQ ID NO: 158843 - DNA, 16 bp, H. sapiens
ttaatatgcaaataat

SEQ ID NO: 158844 - DNA, 16 bp, H. sapiens
ttaatatgctaatgtg

SEQ ID NO: 158845 - DNA, 16 bp, H. sapiens
ttaatatggtgaatta

SEQ ID NO: 158846 - DNA, 16 bp, H. sapiens
ttaatatgtgtatata

SEQ ID NO: 158847 - DNA, 16 bp, H. sapiens
ttaatatgttacattt

SEQ ID NO: 158848 - DNA, 16 bp, H. sapiens
ttaatattaaaaagtc

SEQ ID NO: 158849 - DNA, 16 bp, H. sapiens
ttaatattaatattcc

SEQ ID NO: 158850 - DNA, 16 bp, H. sapiens
ttaatattcatttgtt

SEQ ID NO: 158851 - DNA, 16 bp, H. sapiens
ttaatattcatttttg

SEQ ID NO: 158852 - DNA, 16 bp, H. sapiens
ttaatattgctaaaat

SEQ ID NO: 158853 - DNA, 16 bp, H. sapiens
ttaatattgtcaaaat

SEQ ID NO: 158854 - DNA, 16 bp, H. sapiens
ttaatatttaccagtg

SEQ ID NO: 158855 - DNA, 16 bp, H. sapiens
ttaatatttgcatgat

SEQ ID NO: 158856 - DNA, 16 bp, H. sapiens
ttaatattttcaagta

SEQ ID NO: 158857 - DNA, 16 bp, H. sapiens
ttaatattttgaggaa

SEQ ID NO: 158858 - DNA, 16 bp, H. sapiens
ttaatcaaagttttac

SEQ ID NO: 158859 - DNA, 16 bp, H. sapiens
ttaatcacatctgtaa

SEQ ID NO: 158860 - DNA, 16 bp, H. sapiens
ttaatcaccaggacaa

SEQ ID NO: 158861 - DNA, 16 bp, H. sapiens
ttaatcagattatttt

SEQ ID NO: 158862 - DNA, 16 bp, H. sapiens
ttaatcaggcatggtg

SEQ ID NO: 158863 - DNA, 16 bp, H. sapiens
ttaatcataaattctt

SEQ ID NO: 158864 - DNA, 16 bp, H. sapiens
ttaatcatgagaaaat

SEQ ID NO: 158865 - DNA, 16 bp, H. sapiens
ttaatcattttaagtg

SEQ ID NO: 158866 - DNA, 16 bp, H. sapiens
ttaatccatcttgagc

SEQ ID NO: 158867 - DNA, 16 bp, H. sapiens
ttaatcctcaaaacaa

SEQ ID NO: 158868 - DNA, 16 bp, H. sapiens
ttaatcctcacaataa

SEQ ID NO: 158869 - DNA, 16 bp, H. sapiens
ttaatccttaaaacaa

SEQ ID NO: 158870 - DNA, 16 bp, H. sapiens
ttaatctagcatttgt

SEQ ID NO: 158871 - DNA, 16 bp, H. sapiens
ttaatctcactaatga

SEQ ID NO: 158872 - DNA, 16 bp, H. sapiens
ttaatctcattcatga

SEQ ID NO: 158873 - DNA, 16 bp, H. sapiens
ttaatctcctcagaca

SEQ ID NO: 158874 - DNA, 16 bp, H. sapiens
ttaatctctctgagct

SEQ ID NO: 158875 - DNA, 16 bp, H. sapiens
ttaatctggaacagtt

SEQ ID NO: 158876 - DNA, 16 bp, H. sapiens
ttaatctgttttgtgt

SEQ ID NO: 158877 - DNA, 16 bp, H. sapiens
ttaatcttcacagcaa

SEQ ID NO: 158878 - DNA, 16 bp, H. sapiens
ttaatcttgtatccag

SEQ ID NO: 158879 - DNA, 16 bp, H. sapiens
ttaatcttttcaaaat

SEQ ID NO: 158880 - DNA, 16 bp, H. sapiens
ttaatcttttctaaaa

SEQ ID NO: 158881 - DNA, 16 bp, H. sapiens
ttaatctttttgtaga

SEQ ID NO: 158882 - DNA, 16 bp, H. sapiens
ttaatgaaaaaggatt

SEQ ID NO: 158883 - DNA, 16 bp, H. sapiens
ttaatgaaaacattaa

SEQ ID NO: 158884 - DNA, 16 bp, H. sapiens
ttaatgaaaacttttt

SEQ ID NO: 158885 - DNA, 16 bp, H. sapiens
ttaatgaaaagaaatg

SEQ ID NO: 158886 - DNA, 16 bp, H. sapiens
ttaatgaaaatgtatt

SEQ ID NO: 158887 - DNA, 16 bp, H. sapiens
ttaatgaaagaaattg

SEQ ID NO: 158888 - DNA, 16 bp, H. sapiens
ttaatgaaataaaaca

SEQ ID NO: 158889 - DNA, 16 bp, H. sapiens
ttaatgaaataaacaa

SEQ ID NO: 158890 - DNA, 16 bp, H. sapiens
ttaatgaaataagcca

SEQ ID NO: 158891 - DNA, 16 bp, H. sapiens
ttaatgaaatgaaatg

SEQ ID NO: 158892 - DNA, 16 bp, H. sapiens
ttaatgaaatggaaat

SEQ ID NO: 158893 - DNA, 16 bp, H. sapiens
ttaatgaacaaacaaa

SEQ ID NO: 158894 - DNA, 16 bp, H. sapiens
ttaatgaatttcaaaa

SEQ ID NO: 158895 - DNA, 16 bp, H. sapiens
ttaatgacttattttt

SEQ ID NO: 158896 - DNA, 16 bp, H. sapiens
ttaatgacttcatttt

SEQ ID NO: 158897 - DNA, 16 bp, H. sapiens
ttaatgacttttaaaa

SEQ ID NO: 158898 - DNA, 16 bp, H. sapiens
ttaatgagatatttta

SEQ ID NO: 158899 - DNA, 16 bp, H. sapiens
ttaatgagcacctact

SEQ ID NO: 158900 - DNA, 16 bp, H. sapiens
ttaatgaggaaaaaat

SEQ ID NO: 158901 - DNA, 16 bp, H. sapiens
ttaatgaggcagatga

SEQ ID NO: 158902 - DNA, 16 bp, H. sapiens
ttaatgagtttttaaa

SEQ ID NO: 158903 - DNA, 16 bp, H. sapiens
ttaatgatgaaatatt

SEQ ID NO: 158904 - DNA, 16 bp, H. sapiens
ttaatgatgatgataa

SEQ ID NO: 158905 - DNA, 16 bp, H. sapiens
ttaatgatgttgagta

SEQ ID NO: 158906 - DNA, 16 bp, H. sapiens
ttaatgcaattattga

SEQ ID NO: 158907 - DNA, 16 bp, H. sapiens
ttaatgcattttttaa

SEQ ID NO: 158908 - DNA, 16 bp, H. sapiens
ttaatgccaatgaatt

SEQ ID NO: 158909 - DNA, 16 bp, H. sapiens
ttaatgccacaaaact

SEQ ID NO: 158910 - DNA, 16 bp, H. sapiens
ttaatgccaccaaact

SEQ ID NO: 158911 - DNA, 16 bp, H. sapiens
ttaatgcctcaatttc

SEQ ID NO: 158912 - DNA, 16 bp, H. sapiens
ttaatgctgaaatgac

SEQ ID NO: 158913 - DNA, 16 bp, H. sapiens
ttaatggaaataaatg

SEQ ID NO: 158914 - DNA, 16 bp, H. sapiens
ttaatggaatcctttt

SEQ ID NO: 158915 - DNA, 16 bp, H. sapiens
ttaatggagagaaaaa

SEQ ID NO: 158916 - DNA, 16 bp, H. sapiens
ttaatggttatttctt

SEQ ID NO: 158917 - DNA, 16 bp, H. sapiens
ttaatgtaaaatgttt

SEQ ID NO: 158918 - DNA, 16 bp, H. sapiens
ttaatgtaatacacca

SEQ ID NO: 158919 - DNA, 16 bp, H. sapiens
ttaatgtagttaaata

SEQ ID NO: 158920 - DNA, 16 bp, H. sapiens
ttaatgtcatttttat

SEQ ID NO: 158921 - DNA, 16 bp, H. sapiens
ttaatgtctttttaaa

SEQ ID NO: 158922 - DNA, 16 bp, H. sapiens
ttaatgtgattattga

SEQ ID NO: 158923 - DNA, 16 bp, H. sapiens
ttaatgtgattttaaa

SEQ ID NO: 158924 - DNA, 16 bp, H. sapiens
ttaatgtgcatgccca

SEQ ID NO: 158925 - DNA, 16 bp, H. sapiens
ttaatgtgtacaaaaa

SEQ ID NO: 158926 - DNA, 16 bp, H. sapiens
ttaatgttaaaataga

SEQ ID NO: 158927 - DNA, 16 bp, H. sapiens
ttaatgttaacattta

SEQ ID NO: 158928 - DNA, 16 bp, H. sapiens
ttaatgttaactatag

SEQ ID NO: 158929 - DNA, 16 bp, H. sapiens
ttaatgttcatatttt

SEQ ID NO: 158930 - DNA, 16 bp, H. sapiens
ttaatgttcattttct

SEQ ID NO: 158931 - DNA, 16 bp, H. sapiens
ttaatgttgaaatgag

SEQ ID NO: 158932 - DNA, 16 bp, H. sapiens
ttaatgttgatattct

SEQ ID NO: 158933 - DNA, 16 bp, H. sapiens
ttaatgtttaatgact

SEQ ID NO: 158934 - DNA, 16 bp, H. sapiens
ttaatgtttcttaaaa

SEQ ID NO: 158935 - DNA, 16 bp, H. sapiens
ttaatgtttgtgggta

SEQ ID NO: 158936 - DNA, 16 bp, H. sapiens
ttaatgttttcttaat

SEQ ID NO: 158937 - DNA, 16 bp, H. sapiens
ttaatgttttgagaaa

SEQ ID NO: 158938 - DNA, 16 bp, H. sapiens
ttaatgtttttccatt

SEQ ID NO: 158939 - DNA, 16 bp, H. sapiens
ttaattaaaaatggat

SEQ ID NO: 158940 - DNA, 16 bp, H. sapiens
ttaattaaactgaaga

SEQ ID NO: 158941 - DNA, 16 bp, H. sapiens
ttaattaattacatct

SEQ ID NO: 158942 - DNA, 16 bp, H. sapiens
ttaattaattgattga

SEQ ID NO: 158943 - DNA, 16 bp, H. sapiens
ttaattacatctcaat

SEQ ID NO: 158944 - DNA, 16 bp, H. sapiens
ttaattagcttgattt

SEQ ID NO: 158945 - DNA, 16 bp, H. sapiens
ttaattaggaataaat

SEQ ID NO: 158946 - DNA, 16 bp, H. sapiens
ttaattaggccccact

SEQ ID NO: 158947 - DNA, 16 bp, H. sapiens
ttaattatatttgcaa

SEQ ID NO: 158948 - DNA, 16 bp, H. sapiens
ttaattatttcaggaa

SEQ ID NO: 158949 - DNA, 16 bp, H. sapiens
ttaattcaaagacctt

SEQ ID NO: 158950 - DNA, 16 bp, H. sapiens
ttaattcaaatgaaat

SEQ ID NO: 158951 - DNA, 16 bp, H. sapiens
ttaattcaataacttt

SEQ ID NO: 158952 - DNA, 16 bp, H. sapiens
ttaattcagaatttct

SEQ ID NO: 158953 - DNA, 16 bp, H. sapiens
ttaattcagtcattca

SEQ ID NO: 158954 - DNA, 16 bp, H. sapiens
ttaattcatctttaaa

SEQ ID NO: 158955 - DNA, 16 bp, H. sapiens
ttaattcatttgagtt

SEQ ID NO: 158956 - DNA, 16 bp, H. sapiens
ttaattccaaatattt

SEQ ID NO: 158957 - DNA, 16 bp, H. sapiens
ttaattctcacaacca

SEQ ID NO: 158958 - DNA, 16 bp, H. sapiens
ttaattctggaaaatt

SEQ ID NO: 158959 - DNA, 16 bp, H. sapiens
ttaattcttccagttc

SEQ ID NO: 158960 - DNA, 16 bp, H. sapiens
ttaattcttctttgaa

SEQ ID NO: 158961 - DNA, 16 bp, H. sapiens
ttaattctttgaagaa

SEQ ID NO: 158962 - DNA, 16 bp, H. sapiens
ttaattctttttatgg

SEQ ID NO: 158963 - DNA, 17 bp, H. sapiens
ttaattgactcacagtt

SEQ ID NO: 158964 - DNA, 16 bp, H. sapiens
ttaattgagacagggt

SEQ ID NO: 158965 - DNA, 16 bp, H. sapiens
ttaattgagcaaagaa

SEQ ID NO: 158966 - DNA, 16 bp, H. sapiens
ttaattgccatttaaa

SEQ ID NO: 158967 - DNA, 19 bp, H. sapiens
ttaattggctcacagttcc

SEQ ID NO: 158968 - DNA, 17 bp, H. sapiens
ttaattggctcacggtt

SEQ ID NO: 158969 - DNA, 16 bp, H. sapiens
ttaattgggctatttg

SEQ ID NO: 158970 - DNA, 16 bp, H. sapiens
ttaattgggtcatttg

SEQ ID NO: 158971 - DNA, 16 bp, H. sapiens
ttaattgggttgtttc

SEQ ID NO: 158972 - DNA, 16 bp, H. sapiens
ttaattggtttaaaaa

SEQ ID NO: 158973 - DNA, 16 bp, H. sapiens
ttaattgtgcatttaa

SEQ ID NO: 158974 - DNA, 16 bp, H. sapiens
ttaatttaaaaatcca

SEQ ID NO: 158975 - DNA, 16 bp, H. sapiens
ttaatttaaaagacat

SEQ ID NO: 158976 - DNA, 16 bp, H. sapiens
ttaatttaaaagcctt

SEQ ID NO: 158977 - DNA, 16 bp, H. sapiens
ttaatttacaaattag

SEQ ID NO: 158978 - DNA, 16 bp, H. sapiens
ttaatttacattctct

SEQ ID NO: 158979 - DNA, 16 bp, H. sapiens
ttaatttatggcaata

SEQ ID NO: 158980 - DNA, 16 bp, H. sapiens
ttaatttatttgttca

SEQ ID NO: 158981 - DNA, 16 bp, H. sapiens
ttaatttcagaaaaat

SEQ ID NO: 158982 - DNA, 16 bp, H. sapiens
ttaatttcagaacatt

SEQ ID NO: 158983 - DNA, 16 bp, H. sapiens
ttaatttcagacttct

SEQ ID NO: 158984 - DNA, 16 bp, H. sapiens
ttaatttcagccattc

SEQ ID NO: 158985 - DNA, 16 bp, H. sapiens
ttaatttcatgtgtca

SEQ ID NO: 158986 - DNA, 16 bp, H. sapiens
ttaatttcattgttaa

SEQ ID NO: 158987 - DNA, 16 bp, H. sapiens
ttaatttccacatatt

SEQ ID NO: 158988 - DNA, 16 bp, H. sapiens
ttaatttccttcaata

SEQ ID NO: 158989 - DNA, 16 bp, H. sapiens
ttaatttctacaaaaa

SEQ ID NO: 158990 - DNA, 16 bp, H. sapiens
ttaatttctgatatta

SEQ ID NO: 158991 - DNA, 16 bp, H. sapiens
ttaatttctgcattaa

SEQ ID NO: 158992 - DNA, 16 bp, H. sapiens
ttaatttcttccttca

SEQ ID NO: 158993 - DNA, 16 bp, H. sapiens
ttaatttctttaatag

SEQ ID NO: 158994 - DNA, 16 bp, H. sapiens
ttaatttgaaaacctt

SEQ ID NO: 158995 - DNA, 16 bp, H. sapiens
ttaatttgaaaacttt

SEQ ID NO: 158996 - DNA, 16 bp, H. sapiens
ttaatttgagaacttt

SEQ ID NO: 158997 - DNA, 16 bp, H. sapiens
ttaatttgattctcag

SEQ ID NO: 158998 - DNA, 16 bp, H. sapiens
ttaatttgcatatatt

SEQ ID NO: 158999 - DNA, 16 bp, H. sapiens
ttaatttgcttaagat

SEQ ID NO: 159000 - DNA, 16 bp, H. sapiens
ttaatttgcttttccc

SEQ ID NO: 159001 - DNA, 16 bp, H. sapiens
ttaatttggaaatgtc

SEQ ID NO: 159002 - DNA, 16 bp, H. sapiens
ttaatttggctggata

SEQ ID NO: 159003 - DNA, 16 bp, H. sapiens
ttaatttgggaaaaaa

SEQ ID NO: 159004 - DNA, 16 bp, H. sapiens
ttaatttgtaactttg

SEQ ID NO: 159005 - DNA, 16 bp, H. sapiens
ttaatttgtatttgcc

SEQ ID NO: 159006 - DNA, 16 bp, H. sapiens
ttaatttgtttttcag

SEQ ID NO: 159007 - DNA, 16 bp, H. sapiens
ttaattttaaaactca

SEQ ID NO: 159008 - DNA, 16 bp, H. sapiens
ttaattttaaaatgca

SEQ ID NO: 159009 - DNA, 16 bp, H. sapiens
ttaattttaaaggaaa

SEQ ID NO: 159010 - DNA, 16 bp, H. sapiens
ttaattttagatgtca

SEQ ID NO: 159011 - DNA, 16 bp, H. sapiens
ttaattttatcaaaag

SEQ ID NO: 159012 - DNA, 16 bp, H. sapiens
ttaattttatgtttca

SEQ ID NO: 159013 - DNA, 16 bp, H. sapiens
ttaattttattgaagg

SEQ ID NO: 159014 - DNA, 16 bp, H. sapiens
ttaattttcagttgaa

SEQ ID NO: 159015 - DNA, 16 bp, H. sapiens
ttaattttcatgacaa

SEQ ID NO: 159016 - DNA, 16 bp, H. sapiens
ttaattttcattaagt

SEQ ID NO: 159017 - DNA, 16 bp, H. sapiens
ttaattttctaaatgt

SEQ ID NO: 159018 - DNA, 16 bp, H. sapiens
ttaattttctgtttca

SEQ ID NO: 159019 - DNA, 16 bp, H. sapiens
ttaattttcttcaaaa

SEQ ID NO: 159020 - DNA, 16 bp, H. sapiens
ttaattttcttcattg

SEQ ID NO: 159021 - DNA, 16 bp, H. sapiens
ttaattttgaaaaatg

SEQ ID NO: 159022 - DNA, 16 bp, H. sapiens
ttaattttgaagttca

SEQ ID NO: 159023 - DNA, 16 bp, H. sapiens
ttaattttgaatttct

SEQ ID NO: 159024 - DNA, 16 bp, H. sapiens
ttaattttgacaaata

SEQ ID NO: 159025 - DNA, 16 bp, H. sapiens
ttaattttgagaaata

SEQ ID NO: 159026 - DNA, 16 bp, H. sapiens
ttaattttgatgaaga

SEQ ID NO: 159027 - DNA, 16 bp, H. sapiens
ttaattttgatgaagt

SEQ ID NO: 159028 - DNA, 16 bp, H. sapiens
ttaattttgctcattt

SEQ ID NO: 159029 - DNA, 16 bp, H. sapiens
ttaattttggtttcca

SEQ ID NO: 159030 - DNA, 16 bp, H. sapiens
ttaatttttaagagat

SEQ ID NO: 159031 - DNA, 16 bp, H. sapiens
ttaatttttatgcatg

SEQ ID NO: 159032 - DNA, 16 bp, H. sapiens
ttaatttttctcagca

SEQ ID NO: 159033 - DNA, 16 bp, H. sapiens
ttaatttttgaaaact

SEQ ID NO: 159034 - DNA, 16 bp, H. sapiens
ttaatttttgaaaatg

SEQ ID NO: 159035 - DNA, 16 bp, H. sapiens
ttaatttttgaaacat

SEQ ID NO: 159036 - DNA, 16 bp, H. sapiens
ttaatttttgagaaat

SEQ ID NO: 159037 - DNA, 16 bp, H. sapiens
ttaatttttggaggaa

SEQ ID NO: 159038 - DNA, 16 bp, H. sapiens
ttaatttttgtatagg

SEQ ID NO: 159039 - DNA, 16 bp, H. sapiens
ttaattttttaggaaa

SEQ ID NO: 159040 - DNA, 16 bp, H. sapiens
ttaattttttgaagaa

SEQ ID NO: 159041 - DNA, 16 bp, H. sapiens
ttaattttttgagcaa

SEQ ID NO: 159042 - DNA, 16 bp, H. sapiens
ttaatttttttcagca

SEQ ID NO: 159043 - DNA, 16 bp, H. sapiens
ttaatttttttcagtg

SEQ ID NO: 159044 - DNA, 16 bp, H. sapiens
ttaatttttttccaga

SEQ ID NO: 159045 - DNA, 16 bp, H. sapiens
ttacaaaaacagatgg

SEQ ID NO: 159046 - DNA, 16 bp, H. sapiens
ttacaaaaagtatttt

SEQ ID NO: 159047 - DNA, 16 bp, H. sapiens
ttacaaaaatgttctc

SEQ ID NO: 159048 - DNA, 16 bp, H. sapiens
ttacaaaacatttttt

SEQ ID NO: 159049 - DNA, 16 bp, H. sapiens
ttacaaaactgaatgc

SEQ ID NO: 159050 - DNA, 16 bp, H. sapiens
ttacaaaagaaaacag

SEQ ID NO: 159051 - DNA, 16 bp, H. sapiens
ttacaaaagaaagaga

SEQ ID NO: 159052 - DNA, 16 bp, H. sapiens
ttacaaaagttatttt

SEQ ID NO: 159053 - DNA, 16 bp, H. sapiens
ttacaaaatcagaaaa

SEQ ID NO: 159054 - DNA, 16 bp, H. sapiens
ttacaaaatcatgcat

SEQ ID NO: 159055 - DNA, 16 bp, H. sapiens
ttacaaaatgaagaaa

SEQ ID NO: 159056 - DNA, 16 bp, H. sapiens
ttacaaaatgtatttt

SEQ ID NO: 159057 - DNA, 16 bp, H. sapiens
ttacaaacaacagaaa

SEQ ID NO: 159058 - DNA, 16 bp, H. sapiens
ttacaaacagtaaaat

SEQ ID NO: 159059 - DNA, 16 bp, H. sapiens
ttacaaagaaaaattt

SEQ ID NO: 159060 - DNA, 16 bp, H. sapiens
ttacaaagaaaagaga

SEQ ID NO: 159061 - DNA, 16 bp, H. sapiens
ttacaaagaaacttct

SEQ ID NO: 159062 - DNA, 16 bp, H. sapiens
ttacaaagaagaaaac

SEQ ID NO: 159063 - DNA, 16 bp, H. sapiens
ttacaaagaagaaaag

SEQ ID NO: 159064 - DNA, 16 bp, H. sapiens
ttacaaagcaatttca

SEQ ID NO: 159065 - DNA, 16 bp, H. sapiens
ttacaaaggaaaccaa

SEQ ID NO: 159066 - DNA, 16 bp, H. sapiens
ttacaaaggaagaaaa

SEQ ID NO: 159067 - DNA, 16 bp, H. sapiens
ttacaaaggagaaaac

SEQ ID NO: 159068 - DNA, 16 bp, H. sapiens
ttacaaaggtatacat

SEQ ID NO: 159069 - DNA, 16 bp, H. sapiens
ttacaaagtcaggaaa

SEQ ID NO: 159070 - DNA, 16 bp, H. sapiens
ttacaaataaagaaac

SEQ ID NO: 159071 - DNA, 16 bp, H. sapiens
ttacaaatatttttca

SEQ ID NO: 159072 - DNA, 16 bp, H. sapiens
ttacaaatgaaaacag

SEQ ID NO: 159073 - DNA, 16 bp, H. sapiens
ttacaaatgaagaatc

SEQ ID NO: 159074 - DNA, 16 bp, H. sapiens
ttacaaatgagaaaat

SEQ ID NO: 159075 - DNA, 16 bp, H. sapiens
ttacaaatgcaaattt

SEQ ID NO: 159076 - DNA, 16 bp, H. sapiens
ttacaaatggagattt

SEQ ID NO: 159077 - DNA, 16 bp, H. sapiens
ttacaaatgttatttt

SEQ ID NO: 159078 - DNA, 16 bp, H. sapiens
ttacaaatgttcttaa

SEQ ID NO: 159079 - DNA, 16 bp, H. sapiens
ttacaaattgaaggtt

SEQ ID NO: 159080 - DNA, 16 bp, H. sapiens
ttacaacagatttgtg

SEQ ID NO: 159081 - DNA, 16 bp, H. sapiens
ttacaacagccaagat

SEQ ID NO: 159082 - DNA, 16 bp, H. sapiens
ttacaacccctgcctt

SEQ ID NO: 159083 - DNA, 16 bp, H. sapiens
ttacaactgatgaact

SEQ ID NO: 159084 - DNA, 16 bp, H. sapiens
ttacaactgcctacag

SEQ ID NO: 159085 - DNA, 16 bp, H. sapiens
ttacaagaaaaaaacc

SEQ ID NO: 159086 - DNA, 16 bp, H. sapiens
ttacaagaaaacaaac

SEQ ID NO: 159087 - DNA, 16 bp, H. sapiens
ttacaagaaagaaaga

SEQ ID NO: 159088 - DNA, 16 bp, H. sapiens
ttacaagaaaggggtc

SEQ ID NO: 159089 - DNA, 16 bp, H. sapiens
ttacaagaagagaaaa

SEQ ID NO: 159090 - DNA, 16 bp, H. sapiens
ttacaagagaaaagca

SEQ ID NO: 159091 - DNA, 16 bp, H. sapiens
ttacaaggatgtgaag

SEQ ID NO: 159092 - DNA, 16 bp, H. sapiens
ttacaaggcaaagtcc

SEQ ID NO: 159093 - DNA, 16 bp, H. sapiens
ttacaagggaagtgaa

SEQ ID NO: 159094 - DNA, 16 bp, H. sapiens
ttacaagttaaaaaaa

SEQ ID NO: 159095 - DNA, 16 bp, H. sapiens
ttacaatcaaggcaga

SEQ ID NO: 159096 - DNA, 16 bp, H. sapiens
ttacaatcttttaaaa

SEQ ID NO: 159097 - DNA, 16 bp, H. sapiens
ttacaatgatggcaga

SEQ ID NO: 159098 - DNA, 16 bp, H. sapiens
ttacaatggaaaaaaa

SEQ ID NO: 159099 - DNA, 18 bp, H. sapiens
ttacaatggcctctttag

SEQ ID NO: 159100 - DNA, 16 bp, H. sapiens
ttacaattcttcaaag

SEQ ID NO: 159101 - DNA, 16 bp, H. sapiens
ttacaattgtctacag

SEQ ID NO: 159102 - DNA, 16 bp, H. sapiens
ttacaatttgaaatga

SEQ ID NO: 159103 - DNA, 16 bp, H. sapiens
ttacacaaacctagat

SEQ ID NO: 159104 - DNA, 16 bp, H. sapiens
ttacacaaagctagat

SEQ ID NO: 159105 - DNA, 16 bp, H. sapiens
ttacacaacagaaatg

SEQ ID NO: 159106 - DNA, 16 bp, H. sapiens
ttacacaatgtatata

SEQ ID NO: 159107 - DNA, 16 bp, H. sapiens
ttacacacacaccaca

SEQ ID NO: 159108 - DNA, 16 bp, H. sapiens
ttacacagaaatagat

SEQ ID NO: 159109 - DNA, 16 bp, H. sapiens
ttacacagcaaaagct

SEQ ID NO: 159110 - DNA, 16 bp, H. sapiens
ttacacagcaatagct

SEQ ID NO: 159111 - DNA, 16 bp, H. sapiens
ttacacagctagtaag

SEQ ID NO: 159112 - DNA, 16 bp, H. sapiens
ttacacatatgtgaaa

SEQ ID NO: 159113 - DNA, 16 bp, H. sapiens
ttacaccagtggtttt

SEQ ID NO: 159114 - DNA, 16 bp, H. sapiens
ttacaccatacaaaaa

SEQ ID NO: 159115 - DNA, 16 bp, H. sapiens
ttacacctctaatccc

SEQ ID NO: 159116 - DNA, 16 bp, H. sapiens
ttacaccttaaggaac

SEQ ID NO: 159117 - DNA, 16 bp, H. sapiens
ttacactatggaaatt

SEQ ID NO: 159118 - DNA, 16 bp, H. sapiens
ttacactcccacctac

SEQ ID NO: 159119 - DNA, 16 bp, H. sapiens
ttacactgctatgaag

SEQ ID NO: 159120 - DNA, 16 bp, H. sapiens
ttacagaaaaagcttg

SEQ ID NO: 159121 - DNA, 16 bp, H. sapiens
ttacagaaaaatatga

SEQ ID NO: 159122 - DNA, 16 bp, H. sapiens
ttacagaaaaatttaa

SEQ ID NO: 159123 - DNA, 16 bp, H. sapiens
ttacagaaaaatttat

SEQ ID NO: 159124 - DNA, 16 bp, H. sapiens
ttacagaaaaattttg

SEQ ID NO: 159125 - DNA, 16 bp, H. sapiens
ttacagaaaacagaag

SEQ ID NO: 159126 - DNA, 16 bp, H. sapiens
ttacagaaaatataaa

SEQ ID NO: 159127 - DNA, 16 bp, H. sapiens
ttacagaaaatttgca

SEQ ID NO: 159128 - DNA, 16 bp, H. sapiens
ttacagaaagaaaata

SEQ ID NO: 159129 - DNA, 16 bp, H. sapiens
ttacagaaagaaagaa

SEQ ID NO: 159130 - DNA, 16 bp, H. sapiens
ttacagaaagtaaaaa

SEQ ID NO: 159131 - DNA, 16 bp, H. sapiens
ttacagaaatagaaaa

SEQ ID NO: 159132 - DNA, 16 bp, H. sapiens
ttacagaaatgagcca

SEQ ID NO: 159133 - DNA, 16 bp, H. sapiens
ttacagaaatggaaaa

SEQ ID NO: 159134 - DNA, 16 bp, H. sapiens
ttacagaacattctac

SEQ ID NO: 159135 - DNA, 16 bp, H. sapiens
ttacagaagaaataca

SEQ ID NO: 159136 - DNA, 16 bp, H. sapiens
ttacagaagaagaaaa

SEQ ID NO: 159137 - DNA, 16 bp, H. sapiens
ttacagaagaggaaac

SEQ ID NO: 159138 - DNA, 16 bp, H. sapiens
ttacagaatttttaaa

SEQ ID NO: 159139 - DNA, 16 bp, H. sapiens
ttacagacaagaaaac

SEQ ID NO: 159140 - DNA, 16 bp, H. sapiens
ttacagacaaggaaaa

SEQ ID NO: 159141 - DNA, 16 bp, H. sapiens
ttacagacacacccag

SEQ ID NO: 159142 - DNA, 16 bp, H. sapiens
ttacagagaaaaataa

SEQ ID NO: 159143 - DNA, 16 bp, H. sapiens
ttacagagaaatttta

SEQ ID NO: 159144 - DNA, 16 bp, H. sapiens
ttacagagaagcaaat

SEQ ID NO: 159145 - DNA, 18 bp, H. sapiens
ttacagagagctgattgg

SEQ ID NO: 159146 - DNA, 16 bp, H. sapiens
ttacagagtttggttt

SEQ ID NO: 159147 - DNA, 16 bp, H. sapiens
ttacagataaggaaat

SEQ ID NO: 159148 - DNA, 16 bp, H. sapiens
ttacagatcaggaaat

SEQ ID NO: 159149 - DNA, 16 bp, H. sapiens
ttacagatgaagaaat

SEQ ID NO: 159150 - DNA, 16 bp, H. sapiens
ttacagatgaagacac

SEQ ID NO: 159151 - DNA, 16 bp, H. sapiens
ttacagatgaagcaat

SEQ ID NO: 159152 - DNA, 16 bp, H. sapiens
ttacagatgaggaaac

SEQ ID NO: 159153 - DNA, 16 bp, H. sapiens
ttacagatgaggaaag

SEQ ID NO: 159154 - DNA, 16 bp, H. sapiens
ttacagatgaggaaat

SEQ ID NO: 159155 - DNA, 16 bp, H. sapiens
ttacagatgaggacac

SEQ ID NO: 159156 - DNA, 16 bp, H. sapiens
ttacagatggggaaac

SEQ ID NO: 159157 - DNA, 16 bp, H. sapiens
ttacagatgtgagcta

SEQ ID NO: 159158 - DNA, 16 bp, H. sapiens
ttacagattaaaagaa

SEQ ID NO: 159159 - DNA, 16 bp, H. sapiens
ttacagattttatttt

SEQ ID NO: 159160 - DNA, 16 bp, H. sapiens
ttacagcagaggaaac

SEQ ID NO: 159161 - DNA, 16 bp, H. sapiens
ttacagcaggggtccc

SEQ ID NO: 159162 - DNA, 16 bp, H. sapiens
ttacagcattatttat

SEQ ID NO: 159163 - DNA, 16 bp, H. sapiens
ttacagctaaagaagt

SEQ ID NO: 159164 - DNA, 16 bp, H. sapiens
ttacagctgaagaaat

SEQ ID NO: 159165 - DNA, 16 bp, H. sapiens
ttacagcttttatttt

SEQ ID NO: 159166 - DNA, 16 bp, H. sapiens
ttacaggaaaagaaaa

SEQ ID NO: 159167 - DNA, 16 bp, H. sapiens
ttacaggaatcagcca

SEQ ID NO: 159168 - DNA, 16 bp, H. sapiens
ttacaggaattgctaa

SEQ ID NO: 159169 - DNA, 16 bp, H. sapiens
ttacaggagaggaaac

SEQ ID NO: 159170 - DNA, 16 bp, H. sapiens
ttacaggagtgagcaa

SEQ ID NO: 159171 - DNA, 16 bp, H. sapiens
ttacaggagtgcatca

SEQ ID NO: 159172 - DNA, 16 bp, H. sapiens
ttacaggcaccatgcc

SEQ ID NO: 159173 - DNA, 16 bp, H. sapiens
ttacaggcatgagccg

SEQ ID NO: 159174 - DNA, 16 bp, H. sapiens
ttacaggcctcaccca

SEQ ID NO: 159175 - DNA, 16 bp, H. sapiens
ttacaggcgcgtgcca

SEQ ID NO: 159176 - DNA, 16 bp, H. sapiens
ttacaggctcctgcca

SEQ ID NO: 159177 - DNA, 18 bp, H. sapiens
ttacaggcttgagccacg

SEQ ID NO: 159178 - DNA, 16 bp, H. sapiens
ttacaggggtgcgcca

SEQ ID NO: 159179 - DNA, 17 bp, H. sapiens
ttacaggtatgagccat

SEQ ID NO: 159180 - DNA, 16 bp, H. sapiens
ttacaggtgaaagcca

SEQ ID NO: 159181 - DNA, 16 bp, H. sapiens
ttacaggtgagagcca

SEQ ID NO: 159182 - DNA, 16 bp, H. sapiens
ttacaggtgtgagcac

SEQ ID NO: 159183 - DNA, 18 bp, H. sapiens
ttacaggtgtgagccaca

SEQ ID NO: 159184 - DNA, 19 bp, H. sapiens
ttacaggtgtgagccacga

SEQ ID NO: 159185 - DNA, 16 bp, H. sapiens
ttacaggtgtgagccc

SEQ ID NO: 159186 - DNA, 16 bp, H. sapiens
ttacaggtttgggata

SEQ ID NO: 159187 - DNA, 16 bp, H. sapiens
ttacagtaaaatattt

SEQ ID NO: 159188 - DNA, 17 bp, H. sapiens
ttacagtaaccaaaaca

SEQ ID NO: 159189 - DNA, 16 bp, H. sapiens
ttacagtaataataat

SEQ ID NO: 159190 - DNA, 16 bp, H. sapiens
ttacagtaattttttt

SEQ ID NO: 159191 - DNA, 16 bp, H. sapiens
ttacagtctgttttat

SEQ ID NO: 159192 - DNA, 16 bp, H. sapiens
ttacagtgagcagaga

SEQ ID NO: 159193 - DNA, 16 bp, H. sapiens
ttacagtgattttttt

SEQ ID NO: 159194 - DNA, 16 bp, H. sapiens
ttacagtggtgtgaaa

SEQ ID NO: 159195 - DNA, 16 bp, H. sapiens
ttacagtgtaataata

SEQ ID NO: 159196 - DNA, 16 bp, H. sapiens
ttacagttagaaacac

SEQ ID NO: 159197 - DNA, 16 bp, H. sapiens
ttacagttatttcttg

SEQ ID NO: 159198 - DNA, 16 bp, H. sapiens
ttacagttctggaggc

SEQ ID NO: 159199 - DNA, 16 bp, H. sapiens
ttacagttgagaaaac

SEQ ID NO: 159200 - DNA, 16 bp, H. sapiens
ttacagttttctttgt

SEQ ID NO: 159201 - DNA, 16 bp, H. sapiens
ttacagtttttgactt

SEQ ID NO: 159202 - DNA, 16 bp, H. sapiens
ttacataaaatagaaa

SEQ ID NO: 159203 - DNA, 16 bp, H. sapiens
ttacataatgaaaaaa

SEQ ID NO: 159204 - DNA, 16 bp, H. sapiens
ttacatacatacatac

SEQ ID NO: 159205 - DNA, 16 bp, H. sapiens
ttacatacatatatat

SEQ ID NO: 159206 - DNA, 16 bp, H. sapiens
ttacatagataaactt

SEQ ID NO: 159207 - DNA, 16 bp, H. sapiens
ttacatagtttttaaa

SEQ ID NO: 159208 - DNA, 16 bp, H. sapiens
ttacatataacatcct

SEQ ID NO: 159209 - DNA, 16 bp, H. sapiens
ttacatatatgtacat

SEQ ID NO: 159210 - DNA, 16 bp, H. sapiens
ttacatatctgggtgc

SEQ ID NO: 159211 - DNA, 16 bp, H. sapiens
ttacatatgaaaatat

SEQ ID NO: 159212 - DNA, 16 bp, H. sapiens
ttacatattctagata

SEQ ID NO: 159213 - DNA, 16 bp, H. sapiens
ttacatattgaaatat

SEQ ID NO: 159214 - DNA, 16 bp, H. sapiens
ttacatattgattttt

SEQ ID NO: 159215 - DNA, 16 bp, H. sapiens
ttacatattgtatgca

SEQ ID NO: 159216 - DNA, 16 bp, H. sapiens
ttacatatttgtttat

SEQ ID NO: 159217 - DNA, 16 bp, H. sapiens
ttacatcatggaaaat

SEQ ID NO: 159218 - DNA, 16 bp, H. sapiens
ttacatccaggtcatg

SEQ ID NO: 159219 - DNA, 16 bp, H. sapiens
ttacatgaaaaaaatt

SEQ ID NO: 159220 - DNA, 16 bp, H. sapiens
ttacatgcagattttt

SEQ ID NO: 159221 - DNA, 16 bp, H. sapiens
ttacatgcatatattg

SEQ ID NO: 159222 - DNA, 16 bp, H. sapiens
ttacatgccataaaat

SEQ ID NO: 159223 - DNA, 16 bp, H. sapiens
ttacatggcagaaggg

SEQ ID NO: 159224 - DNA, 16 bp, H. sapiens
ttacatggcagcagaa

SEQ ID NO: 159225 - DNA, 16 bp, H. sapiens
ttacatggccagagca

SEQ ID NO: 159226 - DNA, 16 bp, H. sapiens
ttacatggtgaaaccc

SEQ ID NO: 159227 - DNA, 16 bp, H. sapiens
ttacatggtttcctgc

SEQ ID NO: 159228 - DNA, 16 bp, H. sapiens
ttacatgtaaatcttt

SEQ ID NO: 159229 - DNA, 16 bp, H. sapiens
ttacatgtatattaca

SEQ ID NO: 159230 - DNA, 16 bp, H. sapiens
ttacatgtattgattt

SEQ ID NO: 159231 - DNA, 16 bp, H. sapiens
ttacatgtatttttct

SEQ ID NO: 159232 - DNA, 16 bp, H. sapiens
ttacatgttaattttt

SEQ ID NO: 159233 - DNA, 16 bp, H. sapiens
ttacatgttctcattt

SEQ ID NO: 159234 - DNA, 16 bp, H. sapiens
ttacatgttttaaaaa

SEQ ID NO: 159235 - DNA, 16 bp, H. sapiens
ttacatgttttgaaaa

SEQ ID NO: 159236 - DNA, 16 bp, H. sapiens
ttacattaaatacatt

SEQ ID NO: 159237 - DNA, 16 bp, H. sapiens
ttacattaaatgtaaa

SEQ ID NO: 159238 - DNA, 16 bp, H. sapiens
ttacattaaatgttat

SEQ ID NO: 159239 - DNA, 16 bp, H. sapiens
ttacattaagaaaatt

SEQ ID NO: 159240 - DNA, 16 bp, H. sapiens
ttacattaatagattt

SEQ ID NO: 159241 - DNA, 16 bp, H. sapiens
ttacattcccaccacc

SEQ ID NO: 159242 - DNA, 16 bp, H. sapiens
ttacattgaaatttaa

SEQ ID NO: 159243 - DNA, 16 bp, H. sapiens
ttacattgattttgta

SEQ ID NO: 159244 - DNA, 16 bp, H. sapiens
ttacattgtaaaatat

SEQ ID NO: 159245 - DNA, 16 bp, H. sapiens
ttacattgtattaggt

SEQ ID NO: 159246 - DNA, 16 bp, H. sapiens
ttacatttaaaatgta

SEQ ID NO: 159247 - DNA, 16 bp, H. sapiens
ttacatttaaaatgtt

SEQ ID NO: 159248 - DNA, 16 bp, H. sapiens
ttacatttaagtgttt

SEQ ID NO: 159249 - DNA, 16 bp, H. sapiens
ttacatttaccagttt

SEQ ID NO: 159250 - DNA, 16 bp, H. sapiens
ttacatttagatctat

SEQ ID NO: 159251 - DNA, 16 bp, H. sapiens
ttacatttattgatta

SEQ ID NO: 159252 - DNA, 16 bp, H. sapiens
ttacatttcagtcttt

SEQ ID NO: 159253 - DNA, 16 bp, H. sapiens
ttacatttcagttttt

SEQ ID NO: 159254 - DNA, 16 bp, H. sapiens
ttacatttctgaaaat

SEQ ID NO: 159255 - DNA, 16 bp, H. sapiens
ttacatttctggaggt

SEQ ID NO: 159256 - DNA, 16 bp, H. sapiens
ttacatttctttgatt

SEQ ID NO: 159257 - DNA, 16 bp, H. sapiens
ttacatttgcatttaa

SEQ ID NO: 159258 - DNA, 16 bp, H. sapiens
ttacatttgccatttt

SEQ ID NO: 159259 - DNA, 16 bp, H. sapiens
ttacatttggaatttt

SEQ ID NO: 159260 - DNA, 16 bp, H. sapiens
ttacattttaaatgtt

SEQ ID NO: 159261 - DNA, 16 bp, H. sapiens
ttacattttagtcttt

SEQ ID NO: 159262 - DNA, 16 bp, H. sapiens
ttacattttatagaaa

SEQ ID NO: 159263 - DNA, 16 bp, H. sapiens
ttacattttattttgg

SEQ ID NO: 159264 - DNA, 16 bp, H. sapiens
ttacattttcaaaatg

SEQ ID NO: 159265 - DNA, 16 bp, H. sapiens
ttacattttcaggaat

SEQ ID NO: 159266 - DNA, 16 bp, H. sapiens
ttacattttcctgttt

SEQ ID NO: 159267 - DNA, 16 bp, H. sapiens
ttacatttttaaatga

SEQ ID NO: 159268 - DNA, 16 bp, H. sapiens
ttacatttttatctca

SEQ ID NO: 159269 - DNA, 16 bp, H. sapiens
ttacatttttgtgtgt

SEQ ID NO: 159270 - DNA, 16 bp, H. sapiens
ttacattttttaaagt

SEQ ID NO: 159271 - DNA, 16 bp, H. sapiens
ttacattttttacaaa

SEQ ID NO: 159272 - DNA, 16 bp, H. sapiens
ttacatttttttaaag

SEQ ID NO: 159273 - DNA, 16 bp, H. sapiens
ttaccaaagaagacat

SEQ ID NO: 159274 - DNA, 16 bp, H. sapiens
ttaccaaatttggaaa

SEQ ID NO: 159275 - DNA, 16 bp, H. sapiens
ttaccaaattttaaaa

SEQ ID NO: 159276 - DNA, 18 bp, H. sapiens
ttaccaaccaaaaagagt

SEQ ID NO: 159277 - DNA, 16 bp, H. sapiens
ttaccacaaacttagt

SEQ ID NO: 159278 - DNA, 16 bp, H. sapiens
ttaccacaacctgttt

SEQ ID NO: 159279 - DNA, 16 bp, H. sapiens
ttaccaccatgcccag

SEQ ID NO: 159280 - DNA, 16 bp, H. sapiens
ttaccagaaagaccaa

SEQ ID NO: 159281 - DNA, 16 bp, H. sapiens
ttaccagaagcagatg

SEQ ID NO: 159282 - DNA, 16 bp, H. sapiens
ttaccagaattacttt

SEQ ID NO: 159283 - DNA, 16 bp, H. sapiens
ttaccagaggcttgga

SEQ ID NO: 159284 - DNA, 16 bp, H. sapiens
ttaccagagtctggga

SEQ ID NO: 159285 - DNA, 16 bp, H. sapiens
ttaccagcaatggatc

SEQ ID NO: 159286 - DNA, 16 bp, H. sapiens
ttaccagccaatacaa

SEQ ID NO: 159287 - DNA, 16 bp, H. sapiens
ttaccagggaaatgca

SEQ ID NO: 159288 - DNA, 16 bp, H. sapiens
ttaccagtattttatt

SEQ ID NO: 159289 - DNA, 16 bp, H. sapiens
ttaccagtattttttt

SEQ ID NO: 159290 - DNA, 16 bp, H. sapiens
ttaccatctggccctt

SEQ ID NO: 159291 - DNA, 16 bp, H. sapiens
ttaccatgaggcttgt

SEQ ID NO: 159292 - DNA, 16 bp, H. sapiens
ttaccatgtgccaggc

SEQ ID NO: 159293 - DNA, 16 bp, H. sapiens
ttaccattatgtgatg

SEQ ID NO: 159294 - DNA, 16 bp, H. sapiens
ttaccattcatcttta

SEQ ID NO: 159295 - DNA, 16 bp, H. sapiens
ttaccattgaaagtaa

SEQ ID NO: 159296 - DNA, 16 bp, H. sapiens
ttaccattgttcctgg

SEQ ID NO: 159297 - DNA, 16 bp, H. sapiens
ttaccatttcaacatg

SEQ ID NO: 159298 - DNA, 16 bp, H. sapiens
ttaccatttcttgtag

SEQ ID NO: 159299 - DNA, 16 bp, H. sapiens
ttaccattttaaccat

SEQ ID NO: 159300 - DNA, 16 bp, H. sapiens
ttacccaacctcaggt

SEQ ID NO: 159301 - DNA, 16 bp, H. sapiens
ttacccaaggtcacaa

SEQ ID NO: 159302 - DNA, 16 bp, H. sapiens
ttacccaatgcctgta

SEQ ID NO: 159303 - DNA, 16 bp, H. sapiens
ttacccaatttcaggt

SEQ ID NO: 159304 - DNA, 16 bp, H. sapiens
ttacccactttctgaa

SEQ ID NO: 159305 - DNA, 16 bp, H. sapiens
ttacccagacatggtg

SEQ ID NO: 159306 - DNA, 16 bp, H. sapiens
ttacccaggaggctga

SEQ ID NO: 159307 - DNA, 16 bp, H. sapiens
ttacccaggctggtct

SEQ ID NO: 159308 - DNA, 16 bp, H. sapiens
ttacccagttccaaac

SEQ ID NO: 159309 - DNA, 16 bp, H. sapiens
ttacccagttccaaag

SEQ ID NO: 159310 - DNA, 16 bp, H. sapiens
ttacccagttccaaat

SEQ ID NO: 159311 - DNA, 16 bp, H. sapiens
ttacccagtttcaagt

SEQ ID NO: 159312 - DNA, 16 bp, H. sapiens
ttacccatttttaaat

SEQ ID NO: 159313 - DNA, 16 bp, H. sapiens
ttaccccaaaatcttt

SEQ ID NO: 159314 - DNA, 16 bp, H. sapiens
ttaccccatgctgttc

SEQ ID NO: 159315 - DNA, 16 bp, H. sapiens
ttacccgaggtcagga

SEQ ID NO: 159316 - DNA, 16 bp, H. sapiens
ttaccctatgacccag

SEQ ID NO: 159317 - DNA, 18 bp, H. sapiens
ttaccctcatgctgttct

SEQ ID NO: 159318 - DNA, 16 bp, H. sapiens
ttacctagtagtcatt

SEQ ID NO: 159319 - DNA, 16 bp, H. sapiens
ttacctataaaatgag

SEQ ID NO: 159320 - DNA, 16 bp, H. sapiens
ttacctatgaaacaaa

SEQ ID NO: 159321 - DNA, 16 bp, H. sapiens
ttacctattaaaaata

SEQ ID NO: 159322 - DNA, 16 bp, H. sapiens
ttacctattttaaaaa

SEQ ID NO: 159323 - DNA, 16 bp, H. sapiens
ttacctatttttaaaa

SEQ ID NO: 159324 - DNA, 16 bp, H. sapiens
ttacctcaaacattta

SEQ ID NO: 159325 - DNA, 16 bp, H. sapiens
ttacctcaatttcaga

SEQ ID NO: 159326 - DNA, 18 bp, H. sapiens
ttacctcattaatggatc

SEQ ID NO: 159327 - DNA, 16 bp, H. sapiens
ttacctccacctggtc

SEQ ID NO: 159328 - DNA, 16 bp, H. sapiens
ttacctcctcctgggt

SEQ ID NO: 159329 - DNA, 16 bp, H. sapiens
ttacctctctgagcct

SEQ ID NO: 159330 - DNA, 16 bp, H. sapiens
ttacctgaacctggga

SEQ ID NO: 159331 - DNA, 16 bp, H. sapiens
ttacctgatttaaaaa

SEQ ID NO: 159332 - DNA, 16 bp, H. sapiens
ttacctggccccaccc

SEQ ID NO: 159333 - DNA, 16 bp, H. sapiens
ttacctgggaagtgca

SEQ ID NO: 159334 - DNA, 16 bp, H. sapiens
ttacctgggcctggtg

SEQ ID NO: 159335 - DNA, 16 bp, H. sapiens
ttaccttatttgaaca

SEQ ID NO: 159336 - DNA, 16 bp, H. sapiens
ttaccttgtctcagat

SEQ ID NO: 159337 - DNA, 16 bp, H. sapiens
ttacctttgtgtgtgt

SEQ ID NO: 159338 - DNA, 16 bp, H. sapiens
ttaccttttaaaaaat

SEQ ID NO: 159339 - DNA, 17 bp, H. sapiens
ttactaaaagtacaaaa

SEQ ID NO: 159340 - DNA, 16 bp, H. sapiens
ttactaaaatgtaaat

SEQ ID NO: 159341 - DNA, 16 bp, H. sapiens
ttactaaagaaataaa

SEQ ID NO: 159342 - DNA, 16 bp, H. sapiens
ttactaaagtcatgtg

SEQ ID NO: 159343 - DNA, 16 bp, H. sapiens
ttactaaatgaaagaa

SEQ ID NO: 159344 - DNA, 16 bp, H. sapiens
ttactaagaagtcaaa

SEQ ID NO: 159345 - DNA, 16 bp, H. sapiens
ttactaatttttgtat

SEQ ID NO: 159346 - DNA, 16 bp, H. sapiens
ttactactgccatttt

SEQ ID NO: 159347 - DNA, 16 bp, H. sapiens
ttactataactttgta

SEQ ID NO: 159348 - DNA, 16 bp, H. sapiens
ttactatatatataca

SEQ ID NO: 159349 - DNA, 16 bp, H. sapiens
ttactatctgtgtgac

SEQ ID NO: 159350 - DNA, 16 bp, H. sapiens
ttactatgatgtgtct

SEQ ID NO: 159351 - DNA, 16 bp, H. sapiens
ttactatggctttgta

SEQ ID NO: 159352 - DNA, 16 bp, H. sapiens
ttactatgttgcccag

SEQ ID NO: 159353 - DNA, 16 bp, H. sapiens
ttactattattgttgt

SEQ ID NO: 159354 - DNA, 16 bp, H. sapiens
ttactattcattaaat

SEQ ID NO: 159355 - DNA, 16 bp, H. sapiens
ttactatttatatgta

SEQ ID NO: 159356 - DNA, 16 bp, H. sapiens
ttactattttgaaaat

SEQ ID NO: 159357 - DNA, 16 bp, H. sapiens
ttactcaatgcctgta

SEQ ID NO: 159358 - DNA, 16 bp, H. sapiens
ttactcacagttctgc

SEQ ID NO: 159359 - DNA, 16 bp, H. sapiens
ttactcactgtcatga

SEQ ID NO: 159360 - DNA, 16 bp, H. sapiens
ttactcaggctggagt

SEQ ID NO: 159361 - DNA, 16 bp, H. sapiens
ttactcaggctggtct

SEQ ID NO: 159362 - DNA, 16 bp, H. sapiens
ttactcataaattctt

SEQ ID NO: 159363 - DNA, 17 bp, H. sapiens
ttactcatgtaaccaaa

SEQ ID NO: 159364 - DNA, 16 bp, H. sapiens
ttactcatgtgtttgt

SEQ ID NO: 159365 - DNA, 16 bp, H. sapiens
ttactcatttaacaaa

SEQ ID NO: 159366 - DNA, 16 bp, H. sapiens
ttactctgtgacccag

SEQ ID NO: 159367 - DNA, 16 bp, H. sapiens
ttactctgtgccaggc

SEQ ID NO: 159368 - DNA, 16 bp, H. sapiens
ttactctgtttattta

SEQ ID NO: 159369 - DNA, 16 bp, H. sapiens
ttactcttaatatcac

SEQ ID NO: 159370 - DNA, 16 bp, H. sapiens
ttactcttttcacatg

SEQ ID NO: 159371 - DNA, 16 bp, H. sapiens
ttactctttttgccca

SEQ ID NO: 159372 - DNA, 16 bp, H. sapiens
ttactgaaaaaaaatt

SEQ ID NO: 159373 - DNA, 16 bp, H. sapiens
ttactgaaatataatt

SEQ ID NO: 159374 - DNA, 16 bp, H. sapiens
ttactgaaatgccagg

SEQ ID NO: 159375 - DNA, 16 bp, H. sapiens
ttactgaatattttaa

SEQ ID NO: 159376 - DNA, 16 bp, H. sapiens
ttactgacaatgatga

SEQ ID NO: 159377 - DNA, 16 bp, H. sapiens
ttactgagaataatga

SEQ ID NO: 159378 - DNA, 16 bp, H. sapiens
ttactgagaatatttt

SEQ ID NO: 159379 - DNA, 16 bp, H. sapiens
ttactgagatataatt

SEQ ID NO: 159380 - DNA, 16 bp, H. sapiens
ttactgagcacctgct

SEQ ID NO: 159381 - DNA, 16 bp, H. sapiens
ttactgagcacttgaa

SEQ ID NO: 159382 - DNA, 16 bp, H. sapiens
ttactgagcatcttct

SEQ ID NO: 159383 - DNA, 16 bp, H. sapiens
ttactgaggatttttt

SEQ ID NO: 159384 - DNA, 16 bp, H. sapiens
ttactgagtgctcact

SEQ ID NO: 159385 - DNA, 16 bp, H. sapiens
ttactgagtgcttatt

SEQ ID NO: 159386 - DNA, 16 bp, H. sapiens
ttactgatgagaaaat

SEQ ID NO: 159387 - DNA, 16 bp, H. sapiens
ttactgatgaggaaat

SEQ ID NO: 159388 - DNA, 16 bp, H. sapiens
ttactgatttaatttc

SEQ ID NO: 159389 - DNA, 16 bp, H. sapiens
ttactgcaatgctgtg

SEQ ID NO: 159390 - DNA, 16 bp, H. sapiens
ttactgcacactactg

SEQ ID NO: 159391 - DNA, 16 bp, H. sapiens
ttactgcagcactgtt

SEQ ID NO: 159392 - DNA, 16 bp, H. sapiens
ttactgctgatatgga

SEQ ID NO: 159393 - DNA, 16 bp, H. sapiens
ttactggaaaataaaa

SEQ ID NO: 159394 - DNA, 16 bp, H. sapiens
ttactggagttgtaca

SEQ ID NO: 159395 - DNA, 16 bp, H. sapiens
ttactggctgtgtgac

SEQ ID NO: 159396 - DNA, 16 bp, H. sapiens
ttactggcttatttca

SEQ ID NO: 159397 - DNA, 16 bp, H. sapiens
ttactgggattacaga

SEQ ID NO: 159398 - DNA, 17 bp, H. sapiens
ttactggggaaagaatt

SEQ ID NO: 159399 - DNA, 16 bp, H. sapiens
ttactgggtatataac

SEQ ID NO: 159400 - DNA, 16 bp, H. sapiens
ttactgggtatataca

SEQ ID NO: 159401 - DNA, 16 bp, H. sapiens
ttactggtgtatagga

SEQ ID NO: 159402 - DNA, 16 bp, H. sapiens
ttactgtacctttata

SEQ ID NO: 159403 - DNA, 16 bp, H. sapiens
ttactgtactgtactc

SEQ ID NO: 159404 - DNA, 16 bp, H. sapiens
ttactgtagcattttg

SEQ ID NO: 159405 - DNA, 16 bp, H. sapiens
ttactgtagctctgta

SEQ ID NO: 159406 - DNA, 16 bp, H. sapiens
ttactgtattgaatac

SEQ ID NO: 159407 - DNA, 16 bp, H. sapiens
ttactgtattttaatt

SEQ ID NO: 159408 - DNA, 16 bp, H. sapiens
ttactgtgaagagcaa

SEQ ID NO: 159409 - DNA, 16 bp, H. sapiens
ttactgtgccttttct

SEQ ID NO: 159410 - DNA, 16 bp, H. sapiens
ttactgtgctgaatac

SEQ ID NO: 159411 - DNA, 16 bp, H. sapiens
ttactgtgcttaattt

SEQ ID NO: 159412 - DNA, 16 bp, H. sapiens
ttactgttgagtttta

SEQ ID NO: 159413 - DNA, 16 bp, H. sapiens
ttactgtttccatttt

SEQ ID NO: 159414 - DNA, 16 bp, H. sapiens
ttactgtttttaaaaa

SEQ ID NO: 159415 - DNA, 16 bp, H. sapiens
ttacttaaaaaaattg

SEQ ID NO: 159416 - DNA, 16 bp, H. sapiens
ttacttaaaatatctt

SEQ ID NO: 159417 - DNA, 16 bp, H. sapiens
ttacttaacctctctg

SEQ ID NO: 159418 - DNA, 16 bp, H. sapiens
ttacttaaggtcagga

SEQ ID NO: 159419 - DNA, 16 bp, H. sapiens
ttacttatagattctg

SEQ ID NO: 159420 - DNA, 16 bp, H. sapiens
ttacttatgcacattt

SEQ ID NO: 159421 - DNA, 16 bp, H. sapiens
ttacttatttctgcct

SEQ ID NO: 159422 - DNA, 16 bp, H. sapiens
ttacttatttttaagt

SEQ ID NO: 159423 - DNA, 16 bp, H. sapiens
ttacttcagcctcctg

SEQ ID NO: 159424 - DNA, 16 bp, H. sapiens
ttacttcatttaatct

SEQ ID NO: 159425 - DNA, 16 bp, H. sapiens
ttacttcttgccttct

SEQ ID NO: 159426 - DNA, 16 bp, H. sapiens
ttacttgagcccaggg

SEQ ID NO: 159427 - DNA, 19 bp, H. sapiens
ttacttgggaggctgaggt

SEQ ID NO: 159428 - DNA, 16 bp, H. sapiens
ttacttgggatttact

SEQ ID NO: 159429 - DNA, 16 bp, H. sapiens
ttactttaaaaaactt

SEQ ID NO: 159430 - DNA, 16 bp, H. sapiens
ttactttaaaaaatga

SEQ ID NO: 159431 - DNA, 16 bp, H. sapiens
ttactttaaagaaaaa

SEQ ID NO: 159432 - DNA, 16 bp, H. sapiens
ttactttacctctctg

SEQ ID NO: 159433 - DNA, 16 bp, H. sapiens
ttactttagaaaataa

SEQ ID NO: 159434 - DNA, 27 bp, H. sapiens
ttactttctagacaggtccagcaagac

SEQ ID NO: 159435 - DNA, 16 bp, H. sapiens
ttactttctccaaaac

SEQ ID NO: 159436 - DNA, 16 bp, H. sapiens
ttactttctgtctctg

SEQ ID NO: 159437 - DNA, 16 bp, H. sapiens
ttactttgaaaataaa

SEQ ID NO: 159438 - DNA, 16 bp, H. sapiens
ttactttgaatgtaaa

SEQ ID NO: 159439 - DNA, 16 bp, H. sapiens
ttactttgaatttaat

SEQ ID NO: 159440 - DNA, 16 bp, H. sapiens
ttactttgaattttgt

SEQ ID NO: 159441 - DNA, 16 bp, H. sapiens
ttactttgttgcctag

SEQ ID NO: 159442 - DNA, 16 bp, H. sapiens
ttacttttaaaactgg

SEQ ID NO: 159443 - DNA, 16 bp, H. sapiens
ttacttttaaaagtaa

SEQ ID NO: 159444 - DNA, 16 bp, H. sapiens
ttacttttaattgaca

SEQ ID NO: 159445 - DNA, 16 bp, H. sapiens
ttacttttgaagaaaa

SEQ ID NO: 159446 - DNA, 16 bp, H. sapiens
ttacttttggctacca

SEQ ID NO: 159447 - DNA, 16 bp, H. sapiens
ttacttttgtaaaaat

SEQ ID NO: 159448 - DNA, 16 bp, H. sapiens
ttacttttgtaattaa

SEQ ID NO: 159449 - DNA, 16 bp, H. sapiens
ttacttttgttgcaat

SEQ ID NO: 159450 - DNA, 16 bp, H. sapiens
ttactttttaaaaact

SEQ ID NO: 159451 - DNA, 16 bp, H. sapiens
ttactttttaaagatt

SEQ ID NO: 159452 - DNA, 16 bp, H. sapiens
ttactttttaaataga

SEQ ID NO: 159453 - DNA, 16 bp, H. sapiens
ttactttttaaatctc

SEQ ID NO: 159454 - DNA, 16 bp, H. sapiens
ttactttttaagtaaa

SEQ ID NO: 159455 - DNA, 16 bp, H. sapiens
ttactttttaataatg

SEQ ID NO: 159456 - DNA, 16 bp, H. sapiens
ttactttttaatgatt

SEQ ID NO: 159457 - DNA, 16 bp, H. sapiens
ttactttttattatga

SEQ ID NO: 159458 - DNA, 16 bp, H. sapiens
ttactttttgtagaga

SEQ ID NO: 159459 - DNA, 16 bp, H. sapiens
ttactttttgtatatg

SEQ ID NO: 159460 - DNA, 16 bp, H. sapiens
ttacttttttaaaaag

SEQ ID NO: 159461 - DNA, 16 bp, H. sapiens
ttacttttttaattga

SEQ ID NO: 159462 - DNA, 16 bp, H. sapiens
ttactttttttgtaga

SEQ ID NO: 159463 - DNA, 16 bp, H. sapiens
ttacttttttttgaga

SEQ ID NO: 159464 - DNA, 16 bp, H. sapiens
ttagaaaaaaaatact

SEQ ID NO: 159465 - DNA, 16 bp, H. sapiens
ttagaaaaagaaaagc

SEQ ID NO: 159466 - DNA, 16 bp, H. sapiens
ttagaaaaatctcaaa

SEQ ID NO: 159467 - DNA, 16 bp, H. sapiens
ttagaaaaatgcattt

SEQ ID NO: 159468 - DNA, 16 bp, H. sapiens
ttagaaaacaaagtat

SEQ ID NO: 159469 - DNA, 16 bp, H. sapiens
ttagaaaacacagaaa

SEQ ID NO: 159470 - DNA, 16 bp, H. sapiens
ttagaaaacactttga

SEQ ID NO: 159471 - DNA, 16 bp, H. sapiens
ttagaaaacagaaaca

SEQ ID NO: 159472 - DNA, 16 bp, H. sapiens
ttagaaaaccccatca

SEQ ID NO: 159473 - DNA, 16 bp, H. sapiens
ttagaaaacctcattg

SEQ ID NO: 159474 - DNA, 16 bp, H. sapiens
ttagaaaagcaaagaa

SEQ ID NO: 159475 - DNA, 16 bp, H. sapiens
ttagaaaagttttaaa

SEQ ID NO: 159476 - DNA, 16 bp, H. sapiens
ttagaaaataacattt

SEQ ID NO: 159477 - DNA, 16 bp, H. sapiens
ttagaaaataattaca

SEQ ID NO: 159478 - DNA, 16 bp, H. sapiens
ttagaaaatactattt

SEQ ID NO: 159479 - DNA, 16 bp, H. sapiens
ttagaaaatactttaa

SEQ ID NO: 159480 - DNA, 16 bp, H. sapiens
ttagaaaatatattga

SEQ ID NO: 159481 - DNA, 16 bp, H. sapiens
ttagaaaatatttact

SEQ ID NO: 159482 - DNA, 16 bp, H. sapiens
ttagaaaatattttca

SEQ ID NO: 159483 - DNA, 16 bp, H. sapiens
ttagaaaatgaatttt

SEQ ID NO: 159484 - DNA, 16 bp, H. sapiens
ttagaaaatgcaaact

SEQ ID NO: 159485 - DNA, 16 bp, H. sapiens
ttagaaaatgtgttta

SEQ ID NO: 159486 - DNA, 16 bp, H. sapiens
ttagaaaatgtttaaa

SEQ ID NO: 159487 - DNA, 16 bp, H. sapiens
ttagaaaatgtttctt

SEQ ID NO: 159488 - DNA, 16 bp, H. sapiens
ttagaaaattaaacaa

SEQ ID NO: 159489 - DNA, 16 bp, H. sapiens
ttagaaacaaaacagg

SEQ ID NO: 159490 - DNA, 16 bp, H. sapiens
ttagaaacaatttaaa

SEQ ID NO: 159491 - DNA, 16 bp, H. sapiens
ttagaaacactgtttt

SEQ ID NO: 159492 - DNA, 16 bp, H. sapiens
ttagaaacagaaaata

SEQ ID NO: 159493 - DNA, 16 bp, H. sapiens
ttagaaacagaaagta

SEQ ID NO: 159494 - DNA, 16 bp, H. sapiens
ttagaaacagtctttt

SEQ ID NO: 159495 - DNA, 16 bp, H. sapiens
ttagaaaccaagatct

SEQ ID NO: 159496 - DNA, 16 bp, H. sapiens
ttagaaaggaggaaat

SEQ ID NO: 159497 - DNA, 16 bp, H. sapiens
ttagaaagtcaaaaaa

SEQ ID NO: 159498 - DNA, 16 bp, H. sapiens
ttagaaagttgatttt

SEQ ID NO: 159499 - DNA, 16 bp, H. sapiens
ttagaaataagtttaa

SEQ ID NO: 159500 - DNA, 16 bp, H. sapiens
ttagaaatacaaattc

SEQ ID NO: 159501 - DNA, 16 bp, H. sapiens
ttagaaatacagattc

SEQ ID NO: 159502 - DNA, 16 bp, H. sapiens
ttagaaatacagctaa

SEQ ID NO: 159503 - DNA, 16 bp, H. sapiens
ttagaaatatttgaaa

SEQ ID NO: 159504 - DNA, 16 bp, H. sapiens
ttagaaatgaatttaa

SEQ ID NO: 159505 - DNA, 16 bp, H. sapiens
ttagaaatgaattttt

SEQ ID NO: 159506 - DNA, 16 bp, H. sapiens
ttagaaatgcagaatc

SEQ ID NO: 159507 - DNA, 16 bp, H. sapiens
ttagaaatgcagattt

SEQ ID NO: 159508 - DNA, 16 bp, H. sapiens
ttagaaattattagaa

SEQ ID NO: 159509 - DNA, 16 bp, H. sapiens
ttagaaattgtggttt

SEQ ID NO: 159510 - DNA, 16 bp, H. sapiens
ttagaaatttcttcta

SEQ ID NO: 159511 - DNA, 16 bp, H. sapiens
ttagaaatttcttttg

SEQ ID NO: 159512 - DNA, 16 bp, H. sapiens
ttagaacagcttttgc

SEQ ID NO: 159513 - DNA, 16 bp, H. sapiens
ttagaacaggaaagaa

SEQ ID NO: 159514 - DNA, 16 bp, H. sapiens
ttagaacagtgcctgg

SEQ ID NO: 159515 - DNA, 16 bp, H. sapiens
ttagaacattttaatt

SEQ ID NO: 159516 - DNA, 16 bp, H. sapiens
ttagaagaaaacctag

SEQ ID NO: 159517 - DNA, 16 bp, H. sapiens
ttagaagaaaactatt

SEQ ID NO: 159518 - DNA, 16 bp, H. sapiens
ttagaagaaaatgagt

SEQ ID NO: 159519 - DNA, 16 bp, H. sapiens
ttagaagaaacatttg

SEQ ID NO: 159520 - DNA, 16 bp, H. sapiens
ttagaagaaatggaca

SEQ ID NO: 159521 - DNA, 16 bp, H. sapiens
ttagaagaatatttaa

SEQ ID NO: 159522 - DNA, 16 bp, H. sapiens
ttagaagacacagact

SEQ ID NO: 159523 - DNA, 16 bp, H. sapiens
ttagaagaggaagaga

SEQ ID NO: 159524 - DNA, 16 bp, H. sapiens
ttagaagcagccaggt

SEQ ID NO: 159525 - DNA, 16 bp, H. sapiens
ttagaagcagctgtgg

SEQ ID NO: 159526 - DNA, 16 bp, H. sapiens
ttagaagcaggactag

SEQ ID NO: 159527 - DNA, 16 bp, H. sapiens
ttagaaggaaaagtaa

SEQ ID NO: 159528 - DNA, 16 bp, H. sapiens
ttagaaggaatatttt

SEQ ID NO: 159529 - DNA, 16 bp, H. sapiens
ttagaagtaattttaa

SEQ ID NO: 159530 - DNA, 16 bp, H. sapiens
ttagaagtgtgtttaa

SEQ ID NO: 159531 - DNA, 16 bp, H. sapiens
ttagaagtttgatgat

SEQ ID NO: 159532 - DNA, 16 bp, H. sapiens
ttagaataatttcaga

SEQ ID NO: 159533 - DNA, 16 bp, H. sapiens
ttagaataattttttc

SEQ ID NO: 159534 - DNA, 16 bp, H. sapiens
ttagaatattttcata

SEQ ID NO: 159535 - DNA, 16 bp, H. sapiens
ttagaatcaatgaaat

SEQ ID NO: 159536 - DNA, 16 bp, H. sapiens
ttagaatcagtgaaat

SEQ ID NO: 159537 - DNA, 16 bp, H. sapiens
ttagaatgagaaaata

SEQ ID NO: 159538 - DNA, 16 bp, H. sapiens
ttagaatgcagattct

SEQ ID NO: 159539 - DNA, 16 bp, H. sapiens
ttagaatggaatggaa

SEQ ID NO: 159540 - DNA, 21 bp, H. sapiens
ttagaatggtgatcattaaaa

SEQ ID NO: 159541 - DNA, 16 bp, H. sapiens
ttagaatgtaagctcc

SEQ ID NO: 159542 - DNA, 16 bp, H. sapiens
ttagaattagcagaca

SEQ ID NO: 159543 - DNA, 16 bp, H. sapiens
ttagaattatttttct

SEQ ID NO: 159544 - DNA, 16 bp, H. sapiens
ttagaattctttcctt

SEQ ID NO: 159545 - DNA, 16 bp, H. sapiens
ttagaatttcttttta

SEQ ID NO: 159546 - DNA, 16 bp, H. sapiens
ttagaattttttctaa

SEQ ID NO: 159547 - DNA, 16 bp, H. sapiens
ttagacaaattaaatg

SEQ ID NO: 159548 - DNA, 23 bp, H. sapiens
ttagacaagcctttatcaattct

SEQ ID NO: 159549 - DNA, 16 bp, H. sapiens
ttagacaatttttaaa

SEQ ID NO: 159550 - DNA, 17 bp, H. sapiens
ttagacagatcaaggag

SEQ ID NO: 159551 - DNA, 17 bp, H. sapiens
ttagacagtgagtgcag

SEQ ID NO: 159552 - DNA, 16 bp, H. sapiens
ttagactgtaagctcc

SEQ ID NO: 159553 - DNA, 16 bp, H. sapiens
ttagagaaaaatacaa

SEQ ID NO: 159554 - DNA, 16 bp, H. sapiens
ttagagaaaatggaaa

SEQ ID NO: 159555 - DNA, 16 bp, H. sapiens
ttagagaaacagaacc

SEQ ID NO: 159556 - DNA, 16 bp, H. sapiens
ttagagaaataatttt

SEQ ID NO: 159557 - DNA, 16 bp, H. sapiens
ttagagaaatgcaaat

SEQ ID NO: 159558 - DNA, 16 bp, H. sapiens
ttagagaagcttcatt

SEQ ID NO: 159559 - DNA, 16 bp, H. sapiens
ttagagacaaggtctt

SEQ ID NO: 159560 - DNA, 16 bp, H. sapiens
ttagagacagggtttc

SEQ ID NO: 159561 - DNA, 17 bp, H. sapiens
ttagagacagggtttca

SEQ ID NO: 159562 - DNA, 23 bp, H. sapiens
ttagagacctacaaagagactta

SEQ ID NO: 159563 - DNA, 16 bp, H. sapiens
ttagagagagagagag

SEQ ID NO: 159564 - DNA, 16 bp, H. sapiens
ttagagaggttaaata

SEQ ID NO: 159565 - DNA, 16 bp, H. sapiens
ttagagatattaaaat

SEQ ID NO: 159566 - DNA, 16 bp, H. sapiens
ttagagatgaagaaat

SEQ ID NO: 159567 - DNA, 16 bp, H. sapiens
ttagagatggggtttc

SEQ ID NO: 159568 - DNA, 19 bp, H. sapiens
ttagagatggggtttcacc

SEQ ID NO: 159569 - DNA, 19 bp, H. sapiens
ttagagatggggttttgcc

SEQ ID NO: 159570 - DNA, 16 bp, H. sapiens
ttagagattcaatgcc

SEQ ID NO: 159571 - DNA, 16 bp, H. sapiens
ttagagatttcttctg

SEQ ID NO: 159572 - DNA, 16 bp, H. sapiens
ttagagctggaaggaa

SEQ ID NO: 159573 - DNA, 16 bp, H. sapiens
ttagaggaaaaacttt

SEQ ID NO: 159574 - DNA, 16 bp, H. sapiens
ttagagggaaagcatt

SEQ ID NO: 159575 - DNA, 16 bp, H. sapiens
ttagaggtggggcctt

SEQ ID NO: 159576 - DNA, 16 bp, H. sapiens
ttagagtagaaacaaa

SEQ ID NO: 159577 - DNA, 16 bp, H. sapiens
ttagagtcagagtctt

SEQ ID NO: 159578 - DNA, 16 bp, H. sapiens
ttagagtgtgtgtgtg

SEQ ID NO: 159579 - DNA, 16 bp, H. sapiens
ttagagtttttaaaaa

SEQ ID NO: 159580 - DNA, 16 bp, H. sapiens
ttagataacttagata

SEQ ID NO: 159581 - DNA, 16 bp, H. sapiens
ttagatacacaaataa

SEQ ID NO: 159582 - DNA, 16 bp, H. sapiens
ttagatacagagtttg

SEQ ID NO: 159583 - DNA, 16 bp, H. sapiens
ttagatagtgatgatg

SEQ ID NO: 159584 - DNA, 16 bp, H. sapiens
ttagatatacaaatac

SEQ ID NO: 159585 - DNA, 16 bp, H. sapiens
ttagatatccaagtgg

SEQ ID NO: 159586 - DNA, 54 bp, H. sapiens
ttagatatgcatacacataaacatctcaatgctttacaaagcagtattgctgcc

SEQ ID NO: 159587 - DNA, 18 bp, H. sapiens
ttagatatttctcctaat

SEQ ID NO: 159588 - DNA, 16 bp, H. sapiens
ttagatattttctatt

SEQ ID NO: 159589 - DNA, 16 bp, H. sapiens
ttagatattttgaaat

SEQ ID NO: 159590 - DNA, 16 bp, H. sapiens
ttagatatttttcctg

SEQ ID NO: 159591 - DNA, 18 bp, H. sapiens
ttagatgaatggctaact

SEQ ID NO: 159592 - DNA, 16 bp, H. sapiens
ttagattagattagat

SEQ ID NO: 159593 - DNA, 19 bp, H. sapiens
ttagattctcataaggagc

SEQ ID NO: 159594 - DNA, 16 bp, H. sapiens
ttagattgtgcccacc

SEQ ID NO: 159595 - DNA, 16 bp, H. sapiens
ttagatttcataaaat

SEQ ID NO: 159596 - DNA, 16 bp, H. sapiens
ttagattttaaaaatg

SEQ ID NO: 159597 - DNA, 16 bp, H. sapiens
ttagattttaaagaaa

SEQ ID NO: 159598 - DNA, 16 bp, H. sapiens
ttagattttcatttta

SEQ ID NO: 159599 - DNA, 16 bp, H. sapiens
ttagattttgaggaaa

SEQ ID NO: 159600 - DNA, 16 bp, H. sapiens
ttagcaaaatgttttc

SEQ ID NO: 159601 - DNA, 16 bp, H. sapiens
ttagcaaactaatgca

SEQ ID NO: 159602 - DNA, 16 bp, H. sapiens
ttagcaaagaggttgg

SEQ ID NO: 159603 - DNA, 16 bp, H. sapiens
ttagcaaagcagttgc

SEQ ID NO: 159604 - DNA, 23 bp, H. sapiens
ttagcaaagtctcaggatacaaa

SEQ ID NO: 159605 - DNA, 16 bp, H. sapiens
ttagcaaatactgaac

SEQ ID NO: 159606 - DNA, 16 bp, H. sapiens
ttagcaaatatttttt

SEQ ID NO: 159607 - DNA, 16 bp, H. sapiens
ttagcaaattttactt

SEQ ID NO: 159608 - DNA, 16 bp, H. sapiens
ttagcacagtatctgg

SEQ ID NO: 159609 - DNA, 16 bp, H. sapiens
ttagcacagtgcctgg

SEQ ID NO: 159610 - DNA, 16 bp, H. sapiens
ttagcacttcaacata

SEQ ID NO: 159611 - DNA, 16 bp, H. sapiens
ttagcactttttaaaa

SEQ ID NO: 159612 - DNA, 16 bp, H. sapiens
ttagcagaagaaagga

SEQ ID NO: 159613 - DNA, 16 bp, H. sapiens
ttagcagagcttgagc

SEQ ID NO: 159614 - DNA, 16 bp, H. sapiens
ttagcagcttaaaaca

SEQ ID NO: 159615 - DNA, 16 bp, H. sapiens
ttagcagcttaaaata

SEQ ID NO: 159616 - DNA, 16 bp, H. sapiens
ttagcaggaaaaaaaa

SEQ ID NO: 159617 - DNA, 16 bp, H. sapiens
ttagcaggacatggtg

SEQ ID NO: 159618 - DNA, 16 bp, H. sapiens
ttagcaggcataaaaa

SEQ ID NO: 159619 - DNA, 16 bp, H. sapiens
ttagcagggcatgatg

SEQ ID NO: 159620 - DNA, 16 bp, H. sapiens
ttagcagtatccctgg

SEQ ID NO: 159621 - DNA, 16 bp, H. sapiens
ttagcagtgtaagaac

SEQ ID NO: 159622 - DNA, 16 bp, H. sapiens
ttagcataattcttaa

SEQ ID NO: 159623 - DNA, 16 bp, H. sapiens
ttagcatatcaattat

SEQ ID NO: 159624 - DNA, 16 bp, H. sapiens
ttagcatgaaggctgt

SEQ ID NO: 159625 - DNA, 16 bp, H. sapiens
ttagcatgaatgggtg

SEQ ID NO: 159626 - DNA, 16 bp, H. sapiens
ttagcattttacattt

SEQ ID NO: 159627 - DNA, 16 bp, H. sapiens
ttagcattttctttga

SEQ ID NO: 159628 - DNA, 16 bp, H. sapiens
ttagccaagatcatgc

SEQ ID NO: 159629 - DNA, 16 bp, H. sapiens
ttagccaagtatggtg

SEQ ID NO: 159630 - DNA, 16 bp, H. sapiens
ttagccaagtgtgatg

SEQ ID NO: 159631 - DNA, 16 bp, H. sapiens
ttagccagaatggttt

SEQ ID NO: 159632 - DNA, 16 bp, H. sapiens
ttagccagacgtgatg

SEQ ID NO: 159633 - DNA, 16 bp, H. sapiens
ttagccagactggtct

SEQ ID NO: 159634 - DNA, 16 bp, H. sapiens
ttagccagatgtgatg

SEQ ID NO: 159635 - DNA, 16 bp, H. sapiens
ttagccagatgtggtg

SEQ ID NO: 159636 - DNA, 16 bp, H. sapiens
ttagccaggcatagtg

SEQ ID NO: 159637 - DNA, 16 bp, H. sapiens
ttagccaggcatgatg

SEQ ID NO: 159638 - DNA, 16 bp, H. sapiens
ttagccaggcatggag

SEQ ID NO: 159639 - DNA, 16 bp, H. sapiens
ttagccaggcatggcg

SEQ ID NO: 159640 - DNA, 16 bp, H. sapiens
ttagccaggcatggtg

SEQ ID NO: 159641 - DNA, 16 bp, H. sapiens
ttagccaggcattggt

SEQ ID NO: 159642 - DNA, 17 bp, H. sapiens
ttagccaggcgcggtgg

SEQ ID NO: 159643 - DNA, 16 bp, H. sapiens
ttagccaggcgtgatg

SEQ ID NO: 159644 - DNA, 16 bp, H. sapiens
ttagccaggcgtggct

SEQ ID NO: 159645 - DNA, 16 bp, H. sapiens
ttagccaggcgtggtg

SEQ ID NO: 159646 - DNA, 16 bp, H. sapiens
ttagccaggctagtct

SEQ ID NO: 159647 - DNA, 16 bp, H. sapiens
ttagccaggctggtct

SEQ ID NO: 159648 - DNA, 16 bp, H. sapiens
ttagccaggcttagtg

SEQ ID NO: 159649 - DNA, 16 bp, H. sapiens
ttagccaggtgtgctg

SEQ ID NO: 159650 - DNA, 16 bp, H. sapiens
ttagccaggtgtgggg

SEQ ID NO: 159651 - DNA, 16 bp, H. sapiens
ttagccaggtgtggta

SEQ ID NO: 159652 - DNA, 16 bp, H. sapiens
ttagccaggttggtct

SEQ ID NO: 159653 - DNA, 16 bp, H. sapiens
ttagccagttatccca

SEQ ID NO: 159654 - DNA, 16 bp, H. sapiens
ttagccatatgcagaa

SEQ ID NO: 159655 - DNA, 16 bp, H. sapiens
ttagccatgcgtggtg

SEQ ID NO: 159656 - DNA, 16 bp, H. sapiens
ttagccattgtgaata

SEQ ID NO: 159657 - DNA, 16 bp, H. sapiens
ttagcccaggctggag

SEQ ID NO: 159658 - DNA, 16 bp, H. sapiens
ttagcccccatggctg

SEQ ID NO: 159659 - DNA, 16 bp, H. sapiens
ttagccgagcatggtg

SEQ ID NO: 159660 - DNA, 16 bp, H. sapiens
ttagccgagtgtggtg

SEQ ID NO: 159661 - DNA, 16 bp, H. sapiens
ttagccggatgtggtg

SEQ ID NO: 159662 - DNA, 17 bp, H. sapiens
ttagccggcagtggtgg

SEQ ID NO: 159663 - DNA, 16 bp, H. sapiens
ttagccggccatggtg

SEQ ID NO: 159664 - DNA, 16 bp, H. sapiens
ttagccgggcatgatg

SEQ ID NO: 159665 - DNA, 16 bp, H. sapiens
ttagccgggcatgggg

SEQ ID NO: 159666 - DNA, 16 bp, H. sapiens
ttagccgggcatggtc

SEQ ID NO: 159667 - DNA, 17 bp, H. sapiens
ttagccgggcgtagtgg

SEQ ID NO: 159668 - DNA, 16 bp, H. sapiens
ttagccgggcgtggca

SEQ ID NO: 159669 - DNA, 17 bp, H. sapiens
ttagccgggcgtggtag

SEQ ID NO: 159670 - DNA, 17 bp, H. sapiens
ttagccgggcgtggtgg

SEQ ID NO: 159671 - DNA, 17 bp, H. sapiens
ttagccgggtgcagtgg

SEQ ID NO: 159672 - DNA, 19 bp, H. sapiens
ttagccgggtgtggtgtcg

SEQ ID NO: 159673 - DNA, 16 bp, H. sapiens
ttagccggtcatggtg

SEQ ID NO: 159674 - DNA, 16 bp, H. sapiens
ttagcctggacaacat

SEQ ID NO: 159675 - DNA, 16 bp, H. sapiens
ttagcctggccaacat

SEQ ID NO: 159676 - DNA, 16 bp, H. sapiens
ttagcctggcgtggta

SEQ ID NO: 159677 - DNA, 19 bp, H. sapiens
ttagcctgggcgacagagc

SEQ ID NO: 159678 - DNA, 16 bp, H. sapiens
ttagcggggcatggta

SEQ ID NO: 159679 - DNA, 16 bp, H. sapiens
ttagcggggtgtggtg

SEQ ID NO: 159680 - DNA, 16 bp, H. sapiens
ttagctagacataaag

SEQ ID NO: 159681 - DNA, 16 bp, H. sapiens
ttagctagatcttctg

SEQ ID NO: 159682 - DNA, 16 bp, H. sapiens
ttagctattgttatta

SEQ ID NO: 159683 - DNA, 16 bp, H. sapiens
ttagctattttaaaat

SEQ ID NO: 159684 - DNA, 16 bp, H. sapiens
ttagctcagtgtggtg

SEQ ID NO: 159685 - DNA, 16 bp, H. sapiens
ttagctcagttggtta

SEQ ID NO: 159686 - DNA, 16 bp, H. sapiens
ttagctccaatttata

SEQ ID NO: 159687 - DNA, 16 bp, H. sapiens
ttagctcccacctata

SEQ ID NO: 159688 - DNA, 16 bp, H. sapiens
ttagctcccacttaca

SEQ ID NO: 159689 - DNA, 16 bp, H. sapiens
ttagctctaacaatat

SEQ ID NO: 159690 - DNA, 21 bp, H. sapiens
ttagctgagcaagactgtgaa

SEQ ID NO: 159691 - DNA, 16 bp, H. sapiens
ttagctgagcatggtg

SEQ ID NO: 159692 - DNA, 16 bp, H. sapiens
ttagctgagggtggtg

SEQ ID NO: 159693 - DNA, 16 bp, H. sapiens
ttagctgagtgtagtg

SEQ ID NO: 159694 - DNA, 16 bp, H. sapiens
ttagctgctagagaaa

SEQ ID NO: 159695 - DNA, 16 bp, H. sapiens
ttagctgggactacag

SEQ ID NO: 159696 - DNA, 17 bp, H. sapiens
ttagctgggattacagg

SEQ ID NO: 159697 - DNA, 16 bp, H. sapiens
ttagctgggcacagtg

SEQ ID NO: 159698 - DNA, 16 bp, H. sapiens
ttagctgggcatagtg

SEQ ID NO: 159699 - DNA, 16 bp, H. sapiens
ttagctgggcatggta

SEQ ID NO: 159700 - DNA, 16 bp, H. sapiens
ttagctgggcatggtg

SEQ ID NO: 159701 - DNA, 16 bp, H. sapiens
ttagctgggcgtggcg

SEQ ID NO: 159702 - DNA, 16 bp, H. sapiens
ttagctgggcgtggtg

SEQ ID NO: 159703 - DNA, 16 bp, H. sapiens
ttagctgggcttggtg

SEQ ID NO: 159704 - DNA, 16 bp, H. sapiens
ttagctgggggtggta

SEQ ID NO: 159705 - DNA, 16 bp, H. sapiens
ttagctgggtgcagtg

SEQ ID NO: 159706 - DNA, 16 bp, H. sapiens
ttagctgggtgtggtg

SEQ ID NO: 159707 - DNA, 16 bp, H. sapiens
ttagctgggtgtggtt

SEQ ID NO: 159708 - DNA, 16 bp, H. sapiens
ttagctgggtgtgtgg

SEQ ID NO: 159709 - DNA, 16 bp, H. sapiens
ttagctggtcatggtg

SEQ ID NO: 159710 - DNA, 16 bp, H. sapiens
ttagctggtcttggtg

SEQ ID NO: 159711 - DNA, 16 bp, H. sapiens
ttagctgtactcctag

SEQ ID NO: 159712 - DNA, 16 bp, H. sapiens
ttagctgtatgacctt

SEQ ID NO: 159713 - DNA, 16 bp, H. sapiens
ttagctgtgggttttt

SEQ ID NO: 159714 - DNA, 16 bp, H. sapiens
ttagctgttttgaaat

SEQ ID NO: 159715 - DNA, 16 bp, H. sapiens
ttagcttctctgagcc

SEQ ID NO: 159716 - DNA, 16 bp, H. sapiens
ttagcttctctgtgcc

SEQ ID NO: 159717 - DNA, 16 bp, H. sapiens
ttagcttggcctggtg

SEQ ID NO: 159718 - DNA, 16 bp, H. sapiens
ttagcttgtggtgaat

SEQ ID NO: 159719 - DNA, 16 bp, H. sapiens
ttagctttataatttt

SEQ ID NO: 159720 - DNA, 16 bp, H. sapiens
ttagctttgaaacaaa

SEQ ID NO: 159721 - DNA, 16 bp, H. sapiens
ttagcttttgaaaatg

SEQ ID NO: 159722 - DNA, 16 bp, H. sapiens
ttagcttttgaatttg

SEQ ID NO: 159723 - DNA, 16 bp, H. sapiens
ttagctttttgaggaa

SEQ ID NO: 159724 - DNA, 16 bp, H. sapiens
ttaggaaaaaatacat

SEQ ID NO: 159725 - DNA, 16 bp, H. sapiens
ttaggaaaaatatatt

SEQ ID NO: 159726 - DNA, 16 bp, H. sapiens
ttaggaaaactggcta

SEQ ID NO: 159727 - DNA, 38 bp, H. sapiens
ttaggaaaagaggaagtcaaattgtccctgtttgcaga

SEQ ID NO: 159728 - DNA, 16 bp, H. sapiens
ttaggaaaagaggaat

SEQ ID NO: 159729 - DNA, 16 bp, H. sapiens
ttaggaaaatatttca

SEQ ID NO: 159730 - DNA, 16 bp, H. sapiens
ttaggaaaatgaaaat

SEQ ID NO: 159731 - DNA, 16 bp, H. sapiens
ttaggaaacttataat

SEQ ID NO: 159732 - DNA, 16 bp, H. sapiens
ttaggaaatacacact

SEQ ID NO: 159733 - DNA, 33 bp, H. sapiens
ttaggaaatgaggaagtcaaattgtccctgttt

SEQ ID NO: 159734 - DNA, 16 bp, H. sapiens
ttaggaacaaatttaa

SEQ ID NO: 159735 - DNA, 16 bp, H. sapiens
ttaggaacatttcaaa

SEQ ID NO: 159736 - DNA, 16 bp, H. sapiens
ttaggaaccctgtaca

SEQ ID NO: 159737 - DNA, 16 bp, H. sapiens
ttaggaagccctcagt

SEQ ID NO: 159738 - DNA, 16 bp, H. sapiens
ttaggaagtgtttcct

SEQ ID NO: 159739 - DNA, 16 bp, H. sapiens
ttaggaataaaaggaa

SEQ ID NO: 159740 - DNA, 16 bp, H. sapiens
ttaggaataaatctga

SEQ ID NO: 159741 - DNA, 16 bp, H. sapiens
ttaggaataaatgtaa

SEQ ID NO: 159742 - DNA, 16 bp, H. sapiens
ttaggaataaattcaa

SEQ ID NO: 159743 - DNA, 16 bp, H. sapiens
ttaggaatttctccta

SEQ ID NO: 159744 - DNA, 16 bp, H. sapiens
ttaggactaaatttac

SEQ ID NO: 159745 - DNA, 16 bp, H. sapiens
ttaggagaaaagcatt

SEQ ID NO: 159746 - DNA, 17 bp, H. sapiens
ttaggagctctgtgtca

SEQ ID NO: 159747 - DNA, 17 bp, H. sapiens
ttaggaggccgaggcgg

SEQ ID NO: 159748 - DNA, 16 bp, H. sapiens
ttaggaggctgaggag

SEQ ID NO: 159749 - DNA, 16 bp, H. sapiens
ttaggaggttgaggca

SEQ ID NO: 159750 - DNA, 16 bp, H. sapiens
ttaggagtcatgcagc

SEQ ID NO: 159751 - DNA, 16 bp, H. sapiens
ttaggataatgctggc

SEQ ID NO: 159752 - DNA, 16 bp, H. sapiens
ttaggataattagcat

SEQ ID NO: 159753 - DNA, 16 bp, H. sapiens
ttaggatcttttcttt

SEQ ID NO: 159754 - DNA, 16 bp, H. sapiens
ttaggatgcttttggc

SEQ ID NO: 159755 - DNA, 16 bp, H. sapiens
ttaggatggcaatcat

SEQ ID NO: 159756 - DNA, 16 bp, H. sapiens
ttaggattacaagcgt

SEQ ID NO: 159757 - DNA, 16 bp, H. sapiens
ttaggattgccttggc

SEQ ID NO: 159758 - DNA, 16 bp, H. sapiens
ttaggcaaagaaaaaa

SEQ ID NO: 159759 - DNA, 16 bp, H. sapiens
ttaggcaagtcacttt

SEQ ID NO: 159760 - DNA, 18 bp, H. sapiens
ttaggccaggcgcggtgg

SEQ ID NO: 159761 - DNA, 20 bp, H. sapiens
ttaggccaggcgtggtggct

SEQ ID NO: 159762 - DNA, 16 bp, H. sapiens
ttaggccattcttgca

SEQ ID NO: 159763 - DNA, 16 bp, H. sapiens
ttaggcctcacctccc

SEQ ID NO: 159764 - DNA, 16 bp, H. sapiens
ttaggctacactaaat

SEQ ID NO: 159765 - DNA, 16 bp, H. sapiens
ttaggctatttacatt

SEQ ID NO: 159766 - DNA, 20 bp, H. sapiens
ttaggctgggcttggtggct

SEQ ID NO: 159767 - DNA, 16 bp, H. sapiens
ttaggctgggtatggt

SEQ ID NO: 159768 - DNA, 16 bp, H. sapiens
ttaggctgttctcaca

SEQ ID NO: 159769 - DNA, 16 bp, H. sapiens
ttaggctttcttccct

SEQ ID NO: 159770 - DNA, 16 bp, H. sapiens
ttagggaaagaggaag

SEQ ID NO: 159771 - DNA, 16 bp, H. sapiens
ttagggaaatgcaaat

SEQ ID NO: 159772 - DNA, 16 bp, H. sapiens
ttagggaagggtaggt

SEQ ID NO: 159773 - DNA, 16 bp, H. sapiens
ttagggaataatgaca

SEQ ID NO: 159774 - DNA, 16 bp, H. sapiens
ttagggaatgagtact

SEQ ID NO: 159775 - DNA, 16 bp, H. sapiens
ttagggaggccgaggc

SEQ ID NO: 159776 - DNA, 16 bp, H. sapiens
ttagggaggctgaggc

SEQ ID NO: 159777 - DNA, 16 bp, H. sapiens
ttagggaggctgaggt

SEQ ID NO: 159778 - DNA, 16 bp, H. sapiens
ttagggatatttatgg

SEQ ID NO: 159779 - DNA, 16 bp, H. sapiens
ttagggcagcagcagc

SEQ ID NO: 159780 - DNA, 16 bp, H. sapiens
ttagggccattatgaa

SEQ ID NO: 159781 - DNA, 16 bp, H. sapiens
ttagggcccaccctaa

SEQ ID NO: 159782 - DNA, 16 bp, H. sapiens
ttagggcccaccctca

SEQ ID NO: 159783 - DNA, 16 bp, H. sapiens
ttagggtgggctctaa

SEQ ID NO: 159784 - DNA, 16 bp, H. sapiens
ttagggtgtcaattct

SEQ ID NO: 159785 - DNA, 16 bp, H. sapiens
ttagggttctccagag

SEQ ID NO: 159786 - DNA, 16 bp, H. sapiens
ttaggtatcgatggga

SEQ ID NO: 159787 - DNA, 16 bp, H. sapiens
ttaggtattgatggaa

SEQ ID NO: 159788 - DNA, 16 bp, H. sapiens
ttaggtattgatggga

SEQ ID NO: 159789 - DNA, 16 bp, H. sapiens
ttaggtattgatgggc

SEQ ID NO: 159790 - DNA, 18 bp, H. sapiens
ttaggtatttgtcctaat

SEQ ID NO: 159791 - DNA, 16 bp, H. sapiens
ttaggtcatgaggaca

SEQ ID NO: 159792 - DNA, 16 bp, H. sapiens
ttaggtctgcttggtt

SEQ ID NO: 159793 - DNA, 16 bp, H. sapiens
ttaggtctttaaggaa

SEQ ID NO: 159794 - DNA, 16 bp, H. sapiens
ttaggtctttaatcca

SEQ ID NO: 159795 - DNA, 16 bp, H. sapiens
ttaggtctttgtcaga

SEQ ID NO: 159796 - DNA, 16 bp, H. sapiens
ttaggtgatttcatca

SEQ ID NO: 159797 - DNA, 16 bp, H. sapiens
ttaggtgctcaataaa

SEQ ID NO: 159798 - DNA, 16 bp, H. sapiens
ttaggtgggaacacag

SEQ ID NO: 159799 - DNA, 16 bp, H. sapiens
ttaggttgaaccatat

SEQ ID NO: 159800 - DNA, 16 bp, H. sapiens
ttaggttggttccata

SEQ ID NO: 159801 - DNA, 16 bp, H. sapiens
ttaggttgttaatttg

SEQ ID NO: 159802 - DNA, 16 bp, H. sapiens
ttaggttttcttctag

SEQ ID NO: 159803 - DNA, 16 bp, H. sapiens
ttaggttttctttaat

SEQ ID NO: 159804 - DNA, 16 bp, H. sapiens
ttagtaaaagaggaag

SEQ ID NO: 159805 - DNA, 16 bp, H. sapiens
ttagtaaagatggtgt

SEQ ID NO: 159806 - DNA, 36 bp, H. sapiens
ttagtaaatgacactaccattgtgccacagaaagta

SEQ ID NO: 159807 - DNA, 16 bp, H. sapiens
ttagtaaccttaattc

SEQ ID NO: 159808 - DNA, 16 bp, H. sapiens
ttagtacaaatggggt

SEQ ID NO: 159809 - DNA, 16 bp, H. sapiens
ttagtacagacagggg

SEQ ID NO: 159810 - DNA, 18 bp, H. sapiens
ttagtagaaacgaggttt

SEQ ID NO: 159811 - DNA, 18 bp, H. sapiens
ttagtagagatcgggttt

SEQ ID NO: 159812 - DNA, 21 bp, H. sapiens
ttagtagaggcggggtttcat

SEQ ID NO: 159813 - DNA, 16 bp, H. sapiens
ttagtagtggttgtgg

SEQ ID NO: 159814 - DNA, 16 bp, H. sapiens
ttagtagtttttagta

SEQ ID NO: 159815 - DNA, 16 bp, H. sapiens
ttagtatgaaaaaaag

SEQ ID NO: 159816 - DNA, 16 bp, H. sapiens
ttagtattagtattag

SEQ ID NO: 159817 - DNA, 16 bp, H. sapiens
ttagtattttcactaa

SEQ ID NO: 159818 - DNA, 16 bp, H. sapiens
ttagtcaggcatagtg

SEQ ID NO: 159819 - DNA, 16 bp, H. sapiens
ttagtcaggctggtct

SEQ ID NO: 159820 - DNA, 16 bp, H. sapiens
ttagtcagggttccct

SEQ ID NO: 159821 - DNA, 16 bp, H. sapiens
ttagtcattagaaaaa

SEQ ID NO: 159822 - DNA, 16 bp, H. sapiens
ttagtcattcaacaaa

SEQ ID NO: 159823 - DNA, 16 bp, H. sapiens
ttagtcattttaattt

SEQ ID NO: 159824 - DNA, 16 bp, H. sapiens
ttagtccagcagccca

SEQ ID NO: 159825 - DNA, 16 bp, H. sapiens
ttagtccatttacatt

SEQ ID NO: 159826 - DNA, 16 bp, H. sapiens
ttagtctacaggtgta

SEQ ID NO: 159827 - DNA, 16 bp, H. sapiens
ttagtctccttccttt

SEQ ID NO: 159828 - DNA, 16 bp, H. sapiens
ttagtctgatgagctt

SEQ ID NO: 159829 - DNA, 16 bp, H. sapiens
ttagtgaacttgaaaa

SEQ ID NO: 159830 - DNA, 16 bp, H. sapiens
ttagtgaatttaaaaa

SEQ ID NO: 159831 - DNA, 16 bp, H. sapiens
ttagtgaggaaggcat

SEQ ID NO: 159832 - DNA, 16 bp, H. sapiens
ttagtgagtttggggt

SEQ ID NO: 159833 - DNA, 16 bp, H. sapiens
ttagtgatattgagaa

SEQ ID NO: 159834 - DNA, 16 bp, H. sapiens
ttagtgattttaaaat

SEQ ID NO: 159835 - DNA, 16 bp, H. sapiens
ttagtgattttcaaaa

SEQ ID NO: 159836 - DNA, 16 bp, H. sapiens
ttagtgccatgttttt

SEQ ID NO: 159837 - DNA, 16 bp, H. sapiens
ttagtgcccttgtaag

SEQ ID NO: 159838 - DNA, 16 bp, H. sapiens
ttagtgcctcaaacta

SEQ ID NO: 159839 - DNA, 16 bp, H. sapiens
ttagtgcttccttcag

SEQ ID NO: 159840 - DNA, 16 bp, H. sapiens
ttagtgctttttgtgt

SEQ ID NO: 159841 - DNA, 16 bp, H. sapiens
ttagtggagacagcgt

SEQ ID NO: 159842 - DNA, 16 bp, H. sapiens
ttagtggcttaaaaaa

SEQ ID NO: 159843 - DNA, 16 bp, H. sapiens
ttagtggcttcaaaca

SEQ ID NO: 159844 - DNA, 23 bp, H. sapiens
ttagtgggtgcagcgcaccagca

SEQ ID NO: 159845 - DNA, 16 bp, H. sapiens
ttagtggttgcttagg

SEQ ID NO: 159846 - DNA, 16 bp, H. sapiens
ttagtgtggctggata

SEQ ID NO: 159847 - DNA, 16 bp, H. sapiens
ttagtgtttaggctct

SEQ ID NO: 159848 - DNA, 16 bp, H. sapiens
ttagttaatgaaataa

SEQ ID NO: 159849 - DNA, 23 bp, H. sapiens
ttagttactgaacaattagaaaa

SEQ ID NO: 159850 - DNA, 16 bp, H. sapiens
ttagttatctattact

SEQ ID NO: 159851 - DNA, 16 bp, H. sapiens
ttagttatctattgct

SEQ ID NO: 159852 - DNA, 16 bp, H. sapiens
ttagttatttgaaaaa

SEQ ID NO: 159853 - DNA, 16 bp, H. sapiens
ttagttatttttccca

SEQ ID NO: 159854 - DNA, 16 bp, H. sapiens
ttagttcatttgatga

SEQ ID NO: 159855 - DNA, 16 bp, H. sapiens
ttagttccagctactc

SEQ ID NO: 159856 - DNA, 16 bp, H. sapiens
ttagttctctctctct

SEQ ID NO: 159857 - DNA, 16 bp, H. sapiens
ttagttctgtccctct

SEQ ID NO: 159858 - DNA, 16 bp, H. sapiens
ttagttctgtttagaa

SEQ ID NO: 159859 - DNA, 16 bp, H. sapiens
ttagttcttcttcaaa

SEQ ID NO: 159860 - DNA, 16 bp, H. sapiens
ttagttctttaaatat

SEQ ID NO: 159861 - DNA, 16 bp, H. sapiens
ttagttctttcagaaa

SEQ ID NO: 159862 - DNA, 16 bp, H. sapiens
ttagttcttttttaaa

SEQ ID NO: 159863 - DNA, 16 bp, H. sapiens
ttagttgggattacag

SEQ ID NO: 159864 - DNA, 16 bp, H. sapiens
ttagttgggcgttgtg

SEQ ID NO: 159865 - DNA, 16 bp, H. sapiens
ttagttgggtgtgatg

SEQ ID NO: 159866 - DNA, 16 bp, H. sapiens
ttagttgtgatttctg

SEQ ID NO: 159867 - DNA, 16 bp, H. sapiens
ttagttgtgtctctgc

SEQ ID NO: 159868 - DNA, 16 bp, H. sapiens
ttagtttaaaaaacaa

SEQ ID NO: 159869 - DNA, 16 bp, H. sapiens
ttagtttagccattgt

SEQ ID NO: 159870 - DNA, 16 bp, H. sapiens
ttagtttgctgaggat

SEQ ID NO: 159871 - DNA, 16 bp, H. sapiens
ttagtttgtagtttaa

SEQ ID NO: 159872 - DNA, 16 bp, H. sapiens
ttagtttgttaatatg

SEQ ID NO: 159873 - DNA, 16 bp, H. sapiens
ttagttttaataaaac

SEQ ID NO: 159874 - DNA, 16 bp, H. sapiens
ttagttttcaaaaaaa

SEQ ID NO: 159875 - DNA, 16 bp, H. sapiens
ttagttttccttctga

SEQ ID NO: 159876 - DNA, 16 bp, H. sapiens
ttagttttctaggact

SEQ ID NO: 159877 - DNA, 16 bp, H. sapiens
ttagttttctattgct

SEQ ID NO: 159878 - DNA, 16 bp, H. sapiens
ttagttttggggaagg

SEQ ID NO: 159879 - DNA, 16 bp, H. sapiens
ttagttttgtaggaaa

SEQ ID NO: 159880 - DNA, 16 bp, H. sapiens
ttagtttttaaaaaca

SEQ ID NO: 159881 - DNA, 16 bp, H. sapiens
ttagtttttaaagaaa

SEQ ID NO: 159882 - DNA, 16 bp, H. sapiens
ttagtttttattgctg

SEQ ID NO: 159883 - DNA, 16 bp, H. sapiens
ttagtttttcaaatat

SEQ ID NO: 159884 - DNA, 16 bp, H. sapiens
ttagtttttctactta

SEQ ID NO: 159885 - DNA, 16 bp, H. sapiens
ttagttttttcatctg

SEQ ID NO: 159886 - DNA, 16 bp, H. sapiens
ttataaaaacactttt

SEQ ID NO: 159887 - DNA, 16 bp, H. sapiens
ttataaaaaggcaaaa

SEQ ID NO: 159888 - DNA, 16 bp, H. sapiens
ttataaaaatgtgaat

SEQ ID NO: 159889 - DNA, 16 bp, H. sapiens
ttataaaacaaccaga

SEQ ID NO: 159890 - DNA, 16 bp, H. sapiens
ttataaaacaattagt

SEQ ID NO: 159891 - DNA, 16 bp, H. sapiens
ttataaaacatatttc

SEQ ID NO: 159892 - DNA, 16 bp, H. sapiens
ttataaaacatgttta

SEQ ID NO: 159893 - DNA, 16 bp, H. sapiens
ttataaaacatttcat

SEQ ID NO: 159894 - DNA, 16 bp, H. sapiens
ttataaaaccaccttc

SEQ ID NO: 159895 - DNA, 16 bp, H. sapiens
ttataaaacttagttt

SEQ ID NO: 159896 - DNA, 16 bp, H. sapiens
ttataaaagaggtttc

SEQ ID NO: 159897 - DNA, 16 bp, H. sapiens
ttataaaagcattaat

SEQ ID NO: 159898 - DNA, 16 bp, H. sapiens
ttataaaagggaaaat

SEQ ID NO: 159899 - DNA, 16 bp, H. sapiens
ttataaaataaatgca

SEQ ID NO: 159900 - DNA, 16 bp, H. sapiens
ttataaaataagaaca

SEQ ID NO: 159901 - DNA, 16 bp, H. sapiens
ttataaaatgtccttt

SEQ ID NO: 159902 - DNA, 16 bp, H. sapiens
ttataaaatgtgattt

SEQ ID NO: 159903 - DNA, 16 bp, H. sapiens
ttataaaatgtgtaaa

SEQ ID NO: 159904 - DNA, 16 bp, H. sapiens
ttataaaattatcttc

SEQ ID NO: 159905 - DNA, 16 bp, H. sapiens
ttataaaattgaccac

SEQ ID NO: 159906 - DNA, 16 bp, H. sapiens
ttataaacacacacac

SEQ ID NO: 159907 - DNA, 16 bp, H. sapiens
ttataaacagaaccaa

SEQ ID NO: 159908 - DNA, 16 bp, H. sapiens
ttataaacattcatat

SEQ ID NO: 159909 - DNA, 16 bp, H. sapiens
ttataaaccaataaca

SEQ ID NO: 159910 - DNA, 16 bp, H. sapiens
ttataaaccaccttct

SEQ ID NO: 159911 - DNA, 16 bp, H. sapiens
ttataaagaaaagagg

SEQ ID NO: 159912 - DNA, 16 bp, H. sapiens
ttataaagaacttaaa

SEQ ID NO: 159913 - DNA, 16 bp, H. sapiens
ttataaagaatacaaa

SEQ ID NO: 159914 - DNA, 17 bp, H. sapiens
ttataaagacacatgca

SEQ ID NO: 159915 - DNA, 16 bp, H. sapiens
ttataaagacccttgt

SEQ ID NO: 159916 - DNA, 16 bp, H. sapiens
ttataaagcaaaataa

SEQ ID NO: 159917 - DNA, 16 bp, H. sapiens
ttataaagcatttttt

SEQ ID NO: 159918 - DNA, 16 bp, H. sapiens
ttataaaggaaagggg

SEQ ID NO: 159919 - DNA, 16 bp, H. sapiens
ttataaataaagctgt

SEQ ID NO: 159920 - DNA, 16 bp, H. sapiens
ttataaatatgcatat

SEQ ID NO: 159921 - DNA, 16 bp, H. sapiens
ttataaatgaggaaat

SEQ ID NO: 159922 - DNA, 16 bp, H. sapiens
ttataaatggcatttt

SEQ ID NO: 159923 - DNA, 16 bp, H. sapiens
ttataaatgggattac

SEQ ID NO: 159924 - DNA, 16 bp, H. sapiens
ttataaattcaacttt

SEQ ID NO: 159925 - DNA, 16 bp, H. sapiens
ttataacaacagaaat

SEQ ID NO: 159926 - DNA, 16 bp, H. sapiens
ttataacaactattta

SEQ ID NO: 159927 - DNA, 16 bp, H. sapiens
ttataactataaactt

SEQ ID NO: 159928 - DNA, 16 bp, H. sapiens
ttataactgcatagta

SEQ ID NO: 159929 - DNA, 16 bp, H. sapiens
ttataagaaaacaatt

SEQ ID NO: 159930 - DNA, 16 bp, H. sapiens
ttataagaagagaaga

SEQ ID NO: 159931 - DNA, 16 bp, H. sapiens
ttataagaagaggaaa

SEQ ID NO: 159932 - DNA, 16 bp, H. sapiens
ttataagaagaggaga

SEQ ID NO: 159933 - DNA, 16 bp, H. sapiens
ttataagatacatttt

SEQ ID NO: 159934 - DNA, 16 bp, H. sapiens
ttataagccacccaat

SEQ ID NO: 159935 - DNA, 16 bp, H. sapiens
ttataaggacatttgt

SEQ ID NO: 159936 - DNA, 16 bp, H. sapiens
ttataagggaaaaccc

SEQ ID NO: 159937 - DNA, 16 bp, H. sapiens
ttataagtgggtgcta

SEQ ID NO: 159938 - DNA, 16 bp, H. sapiens
ttataagtgtttggca

SEQ ID NO: 159939 - DNA, 16 bp, H. sapiens
ttataataaaatgcaa

SEQ ID NO: 159940 - DNA, 16 bp, H. sapiens
ttataataaacagaaa

SEQ ID NO: 159941 - DNA, 16 bp, H. sapiens
ttataatagcattatt

SEQ ID NO: 159942 - DNA, 16 bp, H. sapiens
ttataatcatttttgt

SEQ ID NO: 159943 - DNA, 16 bp, H. sapiens
ttataatcccaccact

SEQ ID NO: 159944 - DNA, 16 bp, H. sapiens
ttataatcttatgaga

SEQ ID NO: 159945 - DNA, 16 bp, H. sapiens
ttataatgaaaatgta

SEQ ID NO: 159946 - DNA, 16 bp, H. sapiens
ttataatgtgtatata

SEQ ID NO: 159947 - DNA, 16 bp, H. sapiens
ttataattaaaggcca

SEQ ID NO: 159948 - DNA, 16 bp, H. sapiens
ttataattctgtgaaa

SEQ ID NO: 159949 - DNA, 16 bp, H. sapiens
ttataattgcaaaaaa

SEQ ID NO: 159950 - DNA, 18 bp, H. sapiens
ttataatttcctatgcct

SEQ ID NO: 159951 - DNA, 16 bp, H. sapiens
ttataattttacagtt

SEQ ID NO: 159952 - DNA, 16 bp, H. sapiens
ttatacaaacctagat

SEQ ID NO: 159953 - DNA, 16 bp, H. sapiens
ttatacacagattttc

SEQ ID NO: 159954 - DNA, 16 bp, H. sapiens
ttatacactgttggtg

SEQ ID NO: 159955 - DNA, 16 bp, H. sapiens
ttatacagatgtgaaa

SEQ ID NO: 159956 - DNA, 16 bp, H. sapiens
ttatacagattatttc

SEQ ID NO: 159957 - DNA, 16 bp, H. sapiens
ttatacagcaatagat

SEQ ID NO: 159958 - DNA, 16 bp, H. sapiens
ttatacataatgtata

SEQ ID NO: 159959 - DNA, 16 bp, H. sapiens
ttatacatatgtgtat

SEQ ID NO: 159960 - DNA, 16 bp, H. sapiens
ttatacatatttatgg

SEQ ID NO: 159961 - DNA, 16 bp, H. sapiens
ttatacatgttatttt

SEQ ID NO: 159962 - DNA, 16 bp, H. sapiens
ttatacattcatttgt

SEQ ID NO: 159963 - DNA, 16 bp, H. sapiens
ttatacattttacaga

SEQ ID NO: 159964 - DNA, 16 bp, H. sapiens
ttatacattttacata

SEQ ID NO: 159965 - DNA, 16 bp, H. sapiens
ttatacattttagaaa

SEQ ID NO: 159966 - DNA, 16 bp, H. sapiens
ttatactaatttacat

SEQ ID NO: 159967 - DNA, 16 bp, H. sapiens
ttatactacagagctg

SEQ ID NO: 159968 - DNA, 16 bp, H. sapiens
ttatactgtattgttt

SEQ ID NO: 159969 - DNA, 16 bp, H. sapiens
ttatactgtctatgtc

SEQ ID NO: 159970 - DNA, 16 bp, H. sapiens
ttatacttgaagtttt

SEQ ID NO: 159971 - DNA, 16 bp, H. sapiens
ttatactttatacaaa

SEQ ID NO: 159972 - DNA, 16 bp, H. sapiens
ttatactttctgtctc

SEQ ID NO: 159973 - DNA, 16 bp, H. sapiens
ttatacttttggtaga

SEQ ID NO: 159974 - DNA, 16 bp, H. sapiens
ttatagaaaatttgga

SEQ ID NO: 159975 - DNA, 16 bp, H. sapiens
ttatagaactagaaaa

SEQ ID NO: 159976 - DNA, 16 bp, H. sapiens
ttatagaagagaaaat

SEQ ID NO: 159977 - DNA, 16 bp, H. sapiens
ttatagagaaaagaag

SEQ ID NO: 159978 - DNA, 16 bp, H. sapiens
ttatagaggaagaaat

SEQ ID NO: 159979 - DNA, 16 bp, H. sapiens
ttatagagtgtactta

SEQ ID NO: 159980 - DNA, 16 bp, H. sapiens
ttatagataagaaaac

SEQ ID NO: 159981 - DNA, 16 bp, H. sapiens
ttatagatgaggaaat

SEQ ID NO: 159982 - DNA, 16 bp, H. sapiens
ttatagatgtaaattt

SEQ ID NO: 159983 - DNA, 16 bp, H. sapiens
ttatagattaacttcc

SEQ ID NO: 159984 - DNA, 16 bp, H. sapiens
ttatagcaacagaaaa

SEQ ID NO: 159985 - DNA, 16 bp, H. sapiens
ttatagcagcagaaaa

SEQ ID NO: 159986 - DNA, 16 bp, H. sapiens
ttatagcagccagaat

SEQ ID NO: 159987 - DNA, 16 bp, H. sapiens
ttatagcattgtgaaa

SEQ ID NO: 159988 - DNA, 16 bp, H. sapiens
ttatagctcactgcaa

SEQ ID NO: 159989 - DNA, 16 bp, H. sapiens
ttatagctcttaaggc

SEQ ID NO: 159990 - DNA, 16 bp, H. sapiens
ttatagctttcatttt

SEQ ID NO: 159991 - DNA, 16 bp, H. sapiens
ttataggggaaaaaaa

SEQ ID NO: 159992 - DNA, 16 bp, H. sapiens
ttatagtcattatttt

SEQ ID NO: 159993 - DNA, 16 bp, H. sapiens
ttatagtgacagaaag

SEQ ID NO: 159994 - DNA, 16 bp, H. sapiens
ttatagttatgctttg

SEQ ID NO: 159995 - DNA, 16 bp, H. sapiens
ttatagttgaagaaat

SEQ ID NO: 159996 - DNA, 16 bp, H. sapiens
ttatagtttcatgttt

SEQ ID NO: 159997 - DNA, 16 bp, H. sapiens
ttatagttttaggtat

SEQ ID NO: 159998 - DNA, 16 bp, H. sapiens
ttatagttttataacc

SEQ ID NO: 159999 - DNA, 16 bp, H. sapiens
ttatagttttcattgt

SEQ ID NO: 160000 - DNA, 16 bp, H. sapiens
ttatagttttctgtat

SEQ ID NO: 160001 - DNA, 16 bp, H. sapiens
ttatagttttgccttt

SEQ ID NO: 160002 - DNA, 16 bp, H. sapiens
ttatataaaatagtgt

SEQ ID NO: 160003 - DNA, 16 bp, H. sapiens
ttatataaaatttcca

SEQ ID NO: 160004 - DNA, 16 bp, H. sapiens
ttatataagggatttg

SEQ ID NO: 160005 - DNA, 16 bp, H. sapiens
ttatatacaaatatgt

SEQ ID NO: 160006 - DNA, 16 bp, H. sapiens
ttatatacacatacat

SEQ ID NO: 160007 - DNA, 16 bp, H. sapiens
ttatatacatatacaa

SEQ ID NO: 160008 - DNA, 16 bp, H. sapiens
ttatatacatatatac

SEQ ID NO: 160009 - DNA, 16 bp, H. sapiens
ttatatagcaggaaag

SEQ ID NO: 160010 - DNA, 16 bp, H. sapiens
ttatatagcattttca

SEQ ID NO: 160011 - DNA, 16 bp, H. sapiens
ttatatatacaaatgt

SEQ ID NO: 160012 - DNA, 16 bp, H. sapiens
ttatatatagatagat

SEQ ID NO: 160013 - DNA, 16 bp, H. sapiens
ttatatatatgcatat

SEQ ID NO: 160014 - DNA, 16 bp, H. sapiens
ttatatatatgtacat

SEQ ID NO: 160015 - DNA, 16 bp, H. sapiens
ttatatatcctagata

SEQ ID NO: 160016 - DNA, 16 bp, H. sapiens
ttatatatctatgtgt

SEQ ID NO: 160017 - DNA, 16 bp, H. sapiens
ttatatatgaggaaat

SEQ ID NO: 160018 - DNA, 16 bp, H. sapiens
ttatatatgcatacat

SEQ ID NO: 160019 - DNA, 16 bp, H. sapiens
ttatatatgtatacat

SEQ ID NO: 160020 - DNA, 16 bp, H. sapiens
ttatatatgtatatac

SEQ ID NO: 160021 - DNA, 16 bp, H. sapiens
ttatatattctagtta

SEQ ID NO: 160022 - DNA, 16 bp, H. sapiens
ttatatattctggtta

SEQ ID NO: 160023 - DNA, 16 bp, H. sapiens
ttatatatttgaaaga

SEQ ID NO: 160024 - DNA, 16 bp, H. sapiens
ttatatattttccaaa

SEQ ID NO: 160025 - DNA, 16 bp, H. sapiens
ttatatcactctgtat

SEQ ID NO: 160026 - DNA, 16 bp, H. sapiens
ttatatctgaataaag

SEQ ID NO: 160027 - DNA, 16 bp, H. sapiens
ttatatcttgtcttct

SEQ ID NO: 160028 - DNA, 16 bp, H. sapiens
ttatatgaagataaat

SEQ ID NO: 160029 - DNA, 16 bp, H. sapiens
ttatatgaagatattc

SEQ ID NO: 160030 - DNA, 16 bp, H. sapiens
ttatatgaagtttaaa

SEQ ID NO: 160031 - DNA, 16 bp, H. sapiens
ttatatgaatctttgt

SEQ ID NO: 160032 - DNA, 16 bp, H. sapiens
ttatatgaatttcacc

SEQ ID NO: 160033 - DNA, 16 bp, H. sapiens
ttatatgacattctgg

SEQ ID NO: 160034 - DNA, 16 bp, H. sapiens
ttatatgcagatattt

SEQ ID NO: 160035 - DNA, 16 bp, H. sapiens
ttatatgcagattttc

SEQ ID NO: 160036 - DNA, 16 bp, H. sapiens
ttatatgcatgagcca

SEQ ID NO: 160037 - DNA, 16 bp, H. sapiens
ttatatgctatattct

SEQ ID NO: 160038 - DNA, 16 bp, H. sapiens
ttatatgctgttggtg

SEQ ID NO: 160039 - DNA, 16 bp, H. sapiens
ttatatggaaacacaa

SEQ ID NO: 160040 - DNA, 16 bp, H. sapiens
ttatatggatatacta

SEQ ID NO: 160041 - DNA, 16 bp, H. sapiens
ttatatggctgaataa

SEQ ID NO: 160042 - DNA, 16 bp, H. sapiens
ttatatgggtctattt

SEQ ID NO: 160043 - DNA, 16 bp, H. sapiens
ttatatggtctatctt

SEQ ID NO: 160044 - DNA, 16 bp, H. sapiens
ttatatgtaaacatat

SEQ ID NO: 160045 - DNA, 16 bp, H. sapiens
ttatatgtggaatctt

SEQ ID NO: 160046 - DNA, 16 bp, H. sapiens
ttatatgtgtatgtat

SEQ ID NO: 160047 - DNA, 16 bp, H. sapiens
ttatatgttatttgct

SEQ ID NO: 160048 - DNA, 16 bp, H. sapiens
ttatattaaatggaaa

SEQ ID NO: 160049 - DNA, 16 bp, H. sapiens
ttatattaaatgtgaa

SEQ ID NO: 160050 - DNA, 16 bp, H. sapiens
ttatattagttttcta

SEQ ID NO: 160051 - DNA, 16 bp, H. sapiens
ttatattcagaaaaaa

SEQ ID NO: 160052 - DNA, 16 bp, H. sapiens
ttatattcagattttt

SEQ ID NO: 160053 - DNA, 16 bp, H. sapiens
ttatattccttttggt

SEQ ID NO: 160054 - DNA, 16 bp, H. sapiens
ttatattctgaaactt

SEQ ID NO: 160055 - DNA, 16 bp, H. sapiens
ttatattctgaatatt

SEQ ID NO: 160056 - DNA, 16 bp, H. sapiens
ttatattcttttgggt

SEQ ID NO: 160057 - DNA, 16 bp, H. sapiens
ttatattgaggtatgt

SEQ ID NO: 160058 - DNA, 16 bp, H. sapiens
ttatattgtccaggct

SEQ ID NO: 160059 - DNA, 16 bp, H. sapiens
ttatatttcaaaagca

SEQ ID NO: 160060 - DNA, 16 bp, H. sapiens
ttatatttcagaaata

SEQ ID NO: 160061 - DNA, 16 bp, H. sapiens
ttatatttctattgga

SEQ ID NO: 160062 - DNA, 17 bp, H. sapiens
ttatatttgatgaaaaa

SEQ ID NO: 160063 - DNA, 16 bp, H. sapiens
ttatatttggaaaaat

SEQ ID NO: 160064 - DNA, 16 bp, H. sapiens
ttatattttaagttca

SEQ ID NO: 160065 - DNA, 16 bp, H. sapiens
ttatattttattgcat

SEQ ID NO: 160066 - DNA, 16 bp, H. sapiens
ttatattttcagaaat

SEQ ID NO: 160067 - DNA, 16 bp, H. sapiens
ttatattttcagtaaa

SEQ ID NO: 160068 - DNA, 16 bp, H. sapiens
ttatattttccaataa

SEQ ID NO: 160069 - DNA, 16 bp, H. sapiens
ttatattttctaaaac

SEQ ID NO: 160070 - DNA, 16 bp, H. sapiens
ttatattttctaagaa

SEQ ID NO: 160071 - DNA, 16 bp, H. sapiens
ttatattttcttgtaa

SEQ ID NO: 160072 - DNA, 16 bp, H. sapiens
ttatattttgaaagaa

SEQ ID NO: 160073 - DNA, 16 bp, H. sapiens
ttatattttgagtaga

SEQ ID NO: 160074 - DNA, 16 bp, H. sapiens
ttatatttttaaggaa

SEQ ID NO: 160075 - DNA, 16 bp, H. sapiens
ttatatttttccagga

SEQ ID NO: 160076 - DNA, 16 bp, H. sapiens
ttatatttttctagaa

SEQ ID NO: 160077 - DNA, 16 bp, H. sapiens
ttatcaaaatcaggaa

SEQ ID NO: 160078 - DNA, 16 bp, H. sapiens
ttatcaaatctaggag

SEQ ID NO: 160079 - DNA, 16 bp, H. sapiens
ttatcaaatgaataaa

SEQ ID NO: 160080 - DNA, 16 bp, H. sapiens
ttatcaaatgcatttt

SEQ ID NO: 160081 - DNA, 16 bp, H. sapiens
ttatcaacatcatcat

SEQ ID NO: 160082 - DNA, 16 bp, H. sapiens
ttatcaagaaaaaaat

SEQ ID NO: 160083 - DNA, 16 bp, H. sapiens
ttatcaagctttttca

SEQ ID NO: 160084 - DNA, 16 bp, H. sapiens
ttatcaagttgaggaa

SEQ ID NO: 160085 - DNA, 16 bp, H. sapiens
ttatcaataataatgt

SEQ ID NO: 160086 - DNA, 16 bp, H. sapiens
ttatcaatcagtcagc

SEQ ID NO: 160087 - DNA, 16 bp, H. sapiens
ttatcacagcattatt

SEQ ID NO: 160088 - DNA, 16 bp, H. sapiens
ttatcactatctgaaa

SEQ ID NO: 160089 - DNA, 16 bp, H. sapiens
ttatcactcccatttt

SEQ ID NO: 160090 - DNA, 27 bp, H. sapiens
ttatcactggcttgctgtcaataaata

SEQ ID NO: 160091 - DNA, 21 bp, H. sapiens
ttatcacttccccaatcaata

SEQ ID NO: 160092 - DNA, 16 bp, H. sapiens
ttatcagaaaaaaatt

SEQ ID NO: 160093 - DNA, 16 bp, H. sapiens
ttatcagaaactcaaa

SEQ ID NO: 160094 - DNA, 16 bp, H. sapiens
ttatcagatatatttt

SEQ ID NO: 160095 - DNA, 16 bp, H. sapiens
ttatcagcagcaagaa

SEQ ID NO: 160096 - DNA, 16 bp, H. sapiens
ttatcagcagcaggaa

SEQ ID NO: 160097 - DNA, 16 bp, H. sapiens
ttatcagcagcatgta

SEQ ID NO: 160098 - DNA, 16 bp, H. sapiens
ttatcagcatccctgg

SEQ ID NO: 160099 - DNA, 16 bp, H. sapiens
ttatcagcttaaagag

SEQ ID NO: 160100 - DNA, 16 bp, H. sapiens
ttatcagcttaagaag

SEQ ID NO: 160101 - DNA, 16 bp, H. sapiens
ttatcaggaaaaaaga

SEQ ID NO: 160102 - DNA, 16 bp, H. sapiens
ttatcaggagtttttg

SEQ ID NO: 160103 - DNA, 16 bp, H. sapiens
ttatcaggttgagaaa

SEQ ID NO: 160104 - DNA, 16 bp, H. sapiens
ttatcagtctgggtgg

SEQ ID NO: 160105 - DNA, 16 bp, H. sapiens
ttatcagttctaaaag

SEQ ID NO: 160106 - DNA, 16 bp, H. sapiens
ttatcatatgtaaatt

SEQ ID NO: 160107 - DNA, 16 bp, H. sapiens
ttatcatcatcatcat

SEQ ID NO: 160108 - DNA, 16 bp, H. sapiens
ttatcatcatcatcct

SEQ ID NO: 160109 - DNA, 16 bp, H. sapiens
ttatcatccccattta

SEQ ID NO: 160110 - DNA, 16 bp, H. sapiens
ttatcatgggatattc

SEQ ID NO: 160111 - DNA, 16 bp, H. sapiens
ttatcattataaaatg

SEQ ID NO: 160112 - DNA, 16 bp, H. sapiens
ttatcattatatgatg

SEQ ID NO: 160113 - DNA, 16 bp, H. sapiens
ttatcattatgtaatg

SEQ ID NO: 160114 - DNA, 16 bp, H. sapiens
ttatcattcatgtatt

SEQ ID NO: 160115 - DNA, 16 bp, H. sapiens
ttatcattcctgtgtt

SEQ ID NO: 160116 - DNA, 16 bp, H. sapiens
ttatcatttaaagaaa

SEQ ID NO: 160117 - DNA, 16 bp, H. sapiens
ttatcatttcaaaaat

SEQ ID NO: 160118 - DNA, 16 bp, H. sapiens
ttatcatttgatattt

SEQ ID NO: 160119 - DNA, 16 bp, H. sapiens
ttatccaatcatctgt

SEQ ID NO: 160120 - DNA, 16 bp, H. sapiens
ttatccacaggggata

SEQ ID NO: 160121 - DNA, 16 bp, H. sapiens
ttatccacattgtagc

SEQ ID NO: 160122 - DNA, 16 bp, H. sapiens
ttatccactcattggt

SEQ ID NO: 160123 - DNA, 16 bp, H. sapiens
ttatccaggctggtct

SEQ ID NO: 160124 - DNA, 16 bp, H. sapiens
ttatccataaaatggg

SEQ ID NO: 160125 - DNA, 16 bp, H. sapiens
ttatccatttaaaaaa

SEQ ID NO: 160126 - DNA, 16 bp, H. sapiens
ttatccatttaaaaat

SEQ ID NO: 160127 - DNA, 16 bp, H. sapiens
ttatccatttcttcaa

SEQ ID NO: 160128 - DNA, 16 bp, H. sapiens
ttatccatttcttctg

SEQ ID NO: 160129 - DNA, 16 bp, H. sapiens
ttatccatttttctgt

SEQ ID NO: 160130 - DNA, 16 bp, H. sapiens
ttatcccaagaatgca

SEQ ID NO: 160131 - DNA, 16 bp, H. sapiens
ttatcccatttggaat

SEQ ID NO: 160132 - DNA, 16 bp, H. sapiens
ttatccccattttaca

SEQ ID NO: 160133 - DNA, 16 bp, H. sapiens
ttatccccattttaga

SEQ ID NO: 160134 - DNA, 16 bp, H. sapiens
ttatccccatttttca

SEQ ID NO: 160135 - DNA, 16 bp, H. sapiens
ttatccctaaatattt

SEQ ID NO: 160136 - DNA, 16 bp, H. sapiens
ttatccctaggagcaa

SEQ ID NO: 160137 - DNA, 18 bp, H. sapiens
ttatccctgagcctgagt

SEQ ID NO: 160138 - DNA, 16 bp, H. sapiens
ttatccgggcatggtg

SEQ ID NO: 160139 - DNA, 16 bp, H. sapiens
ttatcctaagtgaatt

SEQ ID NO: 160140 - DNA, 16 bp, H. sapiens
ttatcctcactttata

SEQ ID NO: 160141 - DNA, 16 bp, H. sapiens
ttatcctcagcaaact

SEQ ID NO: 160142 - DNA, 16 bp, H. sapiens
ttatcctcattttaca

SEQ ID NO: 160143 - DNA, 18 bp, H. sapiens
ttatcctcctatttgcct

SEQ ID NO: 160144 - DNA, 16 bp, H. sapiens
ttatcctgaattatcc

SEQ ID NO: 160145 - DNA, 16 bp, H. sapiens
ttatcctggaaaaaaa

SEQ ID NO: 160146 - DNA, 16 bp, H. sapiens
ttatcctgggatgttc

SEQ ID NO: 160147 - DNA, 16 bp, H. sapiens
ttatccttatccttat

SEQ ID NO: 160148 - DNA, 16 bp, H. sapiens
ttatccttgacctttg

SEQ ID NO: 160149 - DNA, 16 bp, H. sapiens
ttatccttgggatgca

SEQ ID NO: 160150 - DNA, 16 bp, H. sapiens
ttatccttgttcctct

SEQ ID NO: 160151 - DNA, 16 bp, H. sapiens
ttatcctttaaaatta

SEQ ID NO: 160152 - DNA, 16 bp, H. sapiens
ttatcctttcatctgt

SEQ ID NO: 160153 - DNA, 16 bp, H. sapiens
ttatctaatttaaaac

SEQ ID NO: 160154 - DNA, 16 bp, H. sapiens
ttatctagaaagaaaa

SEQ ID NO: 160155 - DNA, 16 bp, H. sapiens
ttatctataaaatagg

SEQ ID NO: 160156 - DNA, 16 bp, H. sapiens
ttatctatcatctgtc

SEQ ID NO: 160157 - DNA, 16 bp, H. sapiens
ttatctcaaaacaaaa

SEQ ID NO: 160158 - DNA, 16 bp, H. sapiens
ttatctcaaaacaatt

SEQ ID NO: 160159 - DNA, 16 bp, H. sapiens
ttatctcaaattgtaa

SEQ ID NO: 160160 - DNA, 16 bp, H. sapiens
ttatctcaaattttaa

SEQ ID NO: 160161 - DNA, 16 bp, H. sapiens
ttatctcacatactta

SEQ ID NO: 160162 - DNA, 16 bp, H. sapiens
ttatctcatttaagcc

SEQ ID NO: 160163 - DNA, 16 bp, H. sapiens
ttatctcatttaatac

SEQ ID NO: 160164 - DNA, 16 bp, H. sapiens
ttatctccatgagttc

SEQ ID NO: 160165 - DNA, 16 bp, H. sapiens
ttatctccattttgta

SEQ ID NO: 160166 - DNA, 16 bp, H. sapiens
ttatctcccacttata

SEQ ID NO: 160167 - DNA, 16 bp, H. sapiens
ttatctctgctctgat

SEQ ID NO: 160168 - DNA, 16 bp, H. sapiens
ttatctgaaaaatgga

SEQ ID NO: 160169 - DNA, 16 bp, H. sapiens
ttatctgaaatgcttg

SEQ ID NO: 160170 - DNA, 16 bp, H. sapiens
ttatctgaaattcaaa

SEQ ID NO: 160171 - DNA, 16 bp, H. sapiens
ttatctgaaattccaa

SEQ ID NO: 160172 - DNA, 16 bp, H. sapiens
ttatctgaattatttt

SEQ ID NO: 160173 - DNA, 16 bp, H. sapiens
ttatctgattttggta

SEQ ID NO: 160174 - DNA, 16 bp, H. sapiens
ttatctgcaaatattt

SEQ ID NO: 160175 - DNA, 16 bp, H. sapiens
ttatctgctttttaaa

SEQ ID NO: 160176 - DNA, 16 bp, H. sapiens
ttatctggatgtacca

SEQ ID NO: 160177 - DNA, 16 bp, H. sapiens
ttatctgggcatggtg

SEQ ID NO: 160178 - DNA, 16 bp, H. sapiens
ttatctgggcctggtg

SEQ ID NO: 160179 - DNA, 16 bp, H. sapiens
ttatctgggtatggtg

SEQ ID NO: 160180 - DNA, 16 bp, H. sapiens
ttatctgggtgggctc

SEQ ID NO: 160181 - DNA, 16 bp, H. sapiens
ttatctgtaaaatggg

SEQ ID NO: 160182 - DNA, 16 bp, H. sapiens
ttatctgtacaaattg

SEQ ID NO: 160183 - DNA, 16 bp, H. sapiens
ttatctgtattttaaa

SEQ ID NO: 160184 - DNA, 16 bp, H. sapiens
ttatctgtctgtctgt

SEQ ID NO: 160185 - DNA, 16 bp, H. sapiens
ttatctgtgaaaatgc

SEQ ID NO: 160186 - DNA, 16 bp, H. sapiens
ttatctgtgaaatgag

SEQ ID NO: 160187 - DNA, 16 bp, H. sapiens
ttatctgtgaaatggg

SEQ ID NO: 160188 - DNA, 16 bp, H. sapiens
ttatctgtgcttttga

SEQ ID NO: 160189 - DNA, 16 bp, H. sapiens
ttatcttatttggaaa

SEQ ID NO: 160190 - DNA, 16 bp, H. sapiens
ttatcttctttgccat

SEQ ID NO: 160191 - DNA, 16 bp, H. sapiens
ttatcttgtagaattt

SEQ ID NO: 160192 - DNA, 16 bp, H. sapiens
ttatctttcaaaaaca

SEQ ID NO: 160193 - DNA, 16 bp, H. sapiens
ttatctttcagttcaa

SEQ ID NO: 160194 - DNA, 16 bp, H. sapiens
ttatctttctatgcct

SEQ ID NO: 160195 - DNA, 16 bp, H. sapiens
ttatctttgaacttgt

SEQ ID NO: 160196 - DNA, 16 bp, H. sapiens
ttatctttgtatttcc

SEQ ID NO: 160197 - DNA, 16 bp, H. sapiens
ttatctttgttcctct

SEQ ID NO: 160198 - DNA, 16 bp, H. sapiens
ttatcttttaaatatg

SEQ ID NO: 160199 - DNA, 16 bp, H. sapiens
ttatcttttagagaaa

SEQ ID NO: 160200 - DNA, 16 bp, H. sapiens
ttatcttttcaaagga

SEQ ID NO: 160201 - DNA, 16 bp, H. sapiens
ttatcttttccaaaaa

SEQ ID NO: 160202 - DNA, 16 bp, H. sapiens
ttatgaaaaaaagctc

SEQ ID NO: 160203 - DNA, 16 bp, H. sapiens
ttatgaaaaactgtat

SEQ ID NO: 160204 - DNA, 16 bp, H. sapiens
ttatgaaaacaaacaa

SEQ ID NO: 160205 - DNA, 16 bp, H. sapiens
ttatgaaaactacaat

SEQ ID NO: 160206 - DNA, 16 bp, H. sapiens
ttatgaaaactgcaat

SEQ ID NO: 160207 - DNA, 16 bp, H. sapiens
ttatgaaaagtttatg

SEQ ID NO: 160208 - DNA, 16 bp, H. sapiens
ttatgaaaatactttt

SEQ ID NO: 160209 - DNA, 16 bp, H. sapiens
ttatgaaataaaaaca

SEQ ID NO: 160210 - DNA, 16 bp, H. sapiens
ttatgaaatagaattt

SEQ ID NO: 160211 - DNA, 16 bp, H. sapiens
ttatgaaatttgaaaa

SEQ ID NO: 160212 - DNA, 16 bp, H. sapiens
ttatgaaattttagaa

SEQ ID NO: 160213 - DNA, 16 bp, H. sapiens
ttatgaacattcatat

SEQ ID NO: 160214 - DNA, 16 bp, H. sapiens
ttatgaagaaaagaag

SEQ ID NO: 160215 - DNA, 16 bp, H. sapiens
ttatgaagaaacagaa

SEQ ID NO: 160216 - DNA, 16 bp, H. sapiens
ttatgaagctgagttt

SEQ ID NO: 160217 - DNA, 16 bp, H. sapiens
ttatgaagtaaaaaag

SEQ ID NO: 160218 - DNA, 16 bp, H. sapiens
ttatgaataaagctgc

SEQ ID NO: 160219 - DNA, 16 bp, H. sapiens
ttatgaatattcatgt

SEQ ID NO: 160220 - DNA, 16 bp, H. sapiens
ttatgaatattttcat

SEQ ID NO: 160221 - DNA, 16 bp, H. sapiens
ttatgaatggatgttg

SEQ ID NO: 160222 - DNA, 16 bp, H. sapiens
ttatgaattacccagc

SEQ ID NO: 160223 - DNA, 16 bp, H. sapiens
ttatgaattcattttt

SEQ ID NO: 160224 - DNA, 16 bp, H. sapiens
ttatgaatttctgttt

SEQ ID NO: 160225 - DNA, 16 bp, H. sapiens
ttatgacaaaaccaca

SEQ ID NO: 160226 - DNA, 16 bp, H. sapiens
ttatgacaaccaaaaa

SEQ ID NO: 160227 - DNA, 16 bp, H. sapiens
ttatgacattttattt

SEQ ID NO: 160228 - DNA, 16 bp, H. sapiens
ttatgacccagaatgt

SEQ ID NO: 160229 - DNA, 16 bp, H. sapiens
ttatgagaaaaaaaca

SEQ ID NO: 160230 - DNA, 16 bp, H. sapiens
ttatgaggatgaaatg

SEQ ID NO: 160231 - DNA, 16 bp, H. sapiens
ttatgagggcactaat

SEQ ID NO: 160232 - DNA, 16 bp, H. sapiens
ttatgatagcatcaaa

SEQ ID NO: 160233 - DNA, 16 bp, H. sapiens
ttatgatgatccactt

SEQ ID NO: 160234 - DNA, 16 bp, H. sapiens
ttatgattaaaattct

SEQ ID NO: 160235 - DNA, 16 bp, H. sapiens
ttatgattcattttat

SEQ ID NO: 160236 - DNA, 16 bp, H. sapiens
ttatgattttcattct

SEQ ID NO: 160237 - DNA, 16 bp, H. sapiens
ttatgattttcttaat

SEQ ID NO: 160238 - DNA, 16 bp, H. sapiens
ttatgattttgaaata

SEQ ID NO: 160239 - DNA, 16 bp, H. sapiens
ttatgattttgcctgt

SEQ ID NO: 160240 - DNA, 16 bp, H. sapiens
ttatgatttttaaaag

SEQ ID NO: 160241 - DNA, 16 bp, H. sapiens
ttatgatttttcaaaa

SEQ ID NO: 160242 - DNA, 16 bp, H. sapiens
ttatgcagatgtagat

SEQ ID NO: 160243 - DNA, 17 bp, H. sapiens
ttatgcagccaaaaaac

SEQ ID NO: 160244 - DNA, 17 bp, H. sapiens
ttatgcagccaaaagac

SEQ ID NO: 160245 - DNA, 16 bp, H. sapiens
ttatgcagccaaaata

SEQ ID NO: 160246 - DNA, 16 bp, H. sapiens
ttatgccagtactaca

SEQ ID NO: 160247 - DNA, 16 bp, H. sapiens
ttatgccagttagaat

SEQ ID NO: 160248 - DNA, 16 bp, H. sapiens
ttatgccccctccaag

SEQ ID NO: 160249 - DNA, 16 bp, H. sapiens
ttatgcctgtggtaga

SEQ ID NO: 160250 - DNA, 16 bp, H. sapiens
ttatgccttttaaaat

SEQ ID NO: 160251 - DNA, 20 bp, H. sapiens
ttatgctaaaaactctcaat

SEQ ID NO: 160252 - DNA, 16 bp, H. sapiens
ttatgctaaatatact

SEQ ID NO: 160253 - DNA, 16 bp, H. sapiens
ttatgctcttttagtt

SEQ ID NO: 160254 - DNA, 16 bp, H. sapiens
ttatgctgagcaaaag

SEQ ID NO: 160255 - DNA, 16 bp, H. sapiens
ttatgcttgttttata

SEQ ID NO: 160256 - DNA, 16 bp, H. sapiens
ttatggaaaaggcaaa

SEQ ID NO: 160257 - DNA, 16 bp, H. sapiens
ttatggaaacagaaaa

SEQ ID NO: 160258 - DNA, 16 bp, H. sapiens
ttatggaaactacagt

SEQ ID NO: 160259 - DNA, 16 bp, H. sapiens
ttatggaaatatttca

SEQ ID NO: 160260 - DNA, 16 bp, H. sapiens
ttatggagaaaaagaa

SEQ ID NO: 160261 - DNA, 16 bp, H. sapiens
ttatggaggctgagaa

SEQ ID NO: 160262 - DNA, 16 bp, H. sapiens
ttatggaggctggaaa

SEQ ID NO: 160263 - DNA, 16 bp, H. sapiens
ttatggataaagctgc

SEQ ID NO: 160264 - DNA, 16 bp, H. sapiens
ttatggatttcaaaag

SEQ ID NO: 160265 - DNA, 16 bp, H. sapiens
ttatggcagaagatga

SEQ ID NO: 160266 - DNA, 16 bp, H. sapiens
ttatggcagccccagc

SEQ ID NO: 160267 - DNA, 16 bp, H. sapiens
ttatggccaaatagta

SEQ ID NO: 160268 - DNA, 16 bp, H. sapiens
ttatggccaggtgcgg

SEQ ID NO: 160269 - DNA, 28 bp, H. sapiens
ttatggccagttttggggccagtttatg

SEQ ID NO: 160270 - DNA, 16 bp, H. sapiens
ttatggctgaatagta

SEQ ID NO: 160271 - DNA, 16 bp, H. sapiens
ttatggctgagtaata

SEQ ID NO: 160272 - DNA, 16 bp, H. sapiens
ttatggctgcagagta

SEQ ID NO: 160273 - DNA, 16 bp, H. sapiens
ttatggcttaaaaaaa

SEQ ID NO: 160274 - DNA, 16 bp, H. sapiens
ttatggcttccagctc

SEQ ID NO: 160275 - DNA, 16 bp, H. sapiens
ttatgggaagatattt

SEQ ID NO: 160276 - DNA, 16 bp, H. sapiens
ttatgggaccaccgtc

SEQ ID NO: 160277 - DNA, 16 bp, H. sapiens
ttatgggagccacaat

SEQ ID NO: 160278 - DNA, 16 bp, H. sapiens
ttatgggattaaaaaa

SEQ ID NO: 160279 - DNA, 17 bp, H. sapiens
ttatgggtctttcaact

SEQ ID NO: 160280 - DNA, 16 bp, H. sapiens
ttatgggttgaattgt

SEQ ID NO: 160281 - DNA, 16 bp, H. sapiens
ttatgggttttgggga

SEQ ID NO: 160282 - DNA, 16 bp, H. sapiens
ttatggtagtttgtta

SEQ ID NO: 160283 - DNA, 16 bp, H. sapiens
ttatggtggctcacgc

SEQ ID NO: 160284 - DNA, 16 bp, H. sapiens
ttatggtggtgatggt

SEQ ID NO: 160285 - DNA, 16 bp, H. sapiens
ttatgtaaaaggaaaa

SEQ ID NO: 160286 - DNA, 16 bp, H. sapiens
ttatgtaaaatgcaga

SEQ ID NO: 160287 - DNA, 16 bp, H. sapiens
ttatgtaaaattatgt

SEQ ID NO: 160288 - DNA, 16 bp, H. sapiens
ttatgtaagagaatgt

SEQ ID NO: 160289 - DNA, 16 bp, H. sapiens
ttatgtaatcagtgtt

SEQ ID NO: 160290 - DNA, 16 bp, H. sapiens
ttatgtacacagtagt

SEQ ID NO: 160291 - DNA, 16 bp, H. sapiens
ttatgtactgtatata

SEQ ID NO: 160292 - DNA, 16 bp, H. sapiens
ttatgtagctggtcct

SEQ ID NO: 160293 - DNA, 16 bp, H. sapiens
ttatgtataaaacaaa

SEQ ID NO: 160294 - DNA, 16 bp, H. sapiens
ttatgtatacatttat

SEQ ID NO: 160295 - DNA, 16 bp, H. sapiens
ttatgtatactatata

SEQ ID NO: 160296 - DNA, 16 bp, H. sapiens
ttatgtatatatatac

SEQ ID NO: 160297 - DNA, 16 bp, H. sapiens
ttatgtatatgcagat

SEQ ID NO: 160298 - DNA, 16 bp, H. sapiens
ttatgtatattttaca

SEQ ID NO: 160299 - DNA, 16 bp, H. sapiens
ttatgtatggtttgca

SEQ ID NO: 160300 - DNA, 16 bp, H. sapiens
ttatgtatgtaaacat

SEQ ID NO: 160301 - DNA, 16 bp, H. sapiens
ttatgtatgtaaatag

SEQ ID NO: 160302 - DNA, 16 bp, H. sapiens
ttatgtatgtatatac

SEQ ID NO: 160303 - DNA, 16 bp, H. sapiens
ttatgtatgtgtatgt

SEQ ID NO: 160304 - DNA, 16 bp, H. sapiens
ttatgtcaatatttta

SEQ ID NO: 160305 - DNA, 22 bp, H. sapiens
ttatgtccaagctttcttttca

SEQ ID NO: 160306 - DNA, 18 bp, H. sapiens
ttatgtccccttcaagct

SEQ ID NO: 160307 - DNA, 16 bp, H. sapiens
ttatgtcctcttgatg

SEQ ID NO: 160308 - DNA, 16 bp, H. sapiens
ttatgtcctttgctgg

SEQ ID NO: 160309 - DNA, 16 bp, H. sapiens
ttatgtctatgttcat

SEQ ID NO: 160310 - DNA, 16 bp, H. sapiens
ttatgtcttcttggaa

SEQ ID NO: 160311 - DNA, 16 bp, H. sapiens
ttatgtcttggggttg

SEQ ID NO: 160312 - DNA, 16 bp, H. sapiens
ttatgtctttaaaaaa

SEQ ID NO: 160313 - DNA, 16 bp, H. sapiens
ttatgtgaaatattca

SEQ ID NO: 160314 - DNA, 16 bp, H. sapiens
ttatgtgaaattcaaa

SEQ ID NO: 160315 - DNA, 16 bp, H. sapiens
ttatgtgaagatactt

SEQ ID NO: 160316 - DNA, 16 bp, H. sapiens
ttatgtgaagatattt

SEQ ID NO: 160317 - DNA, 16 bp, H. sapiens
ttatgtgaattttgcc

SEQ ID NO: 160318 - DNA, 16 bp, H. sapiens
ttatgtgagcaataaa

SEQ ID NO: 160319 - DNA, 16 bp, H. sapiens
ttatgtgatcagtttt

SEQ ID NO: 160320 - DNA, 16 bp, H. sapiens
ttatgtgatgtattac

SEQ ID NO: 160321 - DNA, 16 bp, H. sapiens
ttatgtgctgggcact

SEQ ID NO: 160322 - DNA, 16 bp, H. sapiens
ttatgtggatctattt

SEQ ID NO: 160323 - DNA, 16 bp, H. sapiens
ttatgtgtatataaat

SEQ ID NO: 160324 - DNA, 16 bp, H. sapiens
ttatgtgtcagacact

SEQ ID NO: 160325 - DNA, 16 bp, H. sapiens
ttatgtgtcagtttga

SEQ ID NO: 160326 - DNA, 16 bp, H. sapiens
ttatgtgtgcttttat

SEQ ID NO: 160327 - DNA, 16 bp, H. sapiens
ttatgtgtggcccaaa

SEQ ID NO: 160328 - DNA, 16 bp, H. sapiens
ttatgtgtgtgcatgt

SEQ ID NO: 160329 - DNA, 16 bp, H. sapiens
ttatgttaaacatttt

SEQ ID NO: 160330 - DNA, 16 bp, H. sapiens
ttatgttaaaccatcc

SEQ ID NO: 160331 - DNA, 16 bp, H. sapiens
ttatgttaaattgttg

SEQ ID NO: 160332 - DNA, 16 bp, H. sapiens
ttatgttaagggaaat

SEQ ID NO: 160333 - DNA, 16 bp, H. sapiens
ttatgttattttcaaa

SEQ ID NO: 160334 - DNA, 16 bp, H. sapiens
ttatgttatttttcaa

SEQ ID NO: 160335 - DNA, 16 bp, H. sapiens
ttatgttcacagcaaa

SEQ ID NO: 160336 - DNA, 16 bp, H. sapiens
ttatgttcataaattt

SEQ ID NO: 160337 - DNA, 16 bp, H. sapiens
ttatgttccaggcatt

SEQ ID NO: 160338 - DNA, 16 bp, H. sapiens
ttatgttctgggatac

SEQ ID NO: 160339 - DNA, 17 bp, H. sapiens
ttatgttgcccaggctg

SEQ ID NO: 160340 - DNA, 16 bp, H. sapiens
ttatgtttaaaaaaca

SEQ ID NO: 160341 - DNA, 16 bp, H. sapiens
ttatgtttaaaagaaa

SEQ ID NO: 160342 - DNA, 16 bp, H. sapiens
ttatgtttatgagatt

SEQ ID NO: 160343 - DNA, 16 bp, H. sapiens
ttatgtttgaatttga

SEQ ID NO: 160344 - DNA, 16 bp, H. sapiens
ttatgtttttaaaaag

SEQ ID NO: 160345 - DNA, 16 bp, H. sapiens
ttatgtttttctaaaa

SEQ ID NO: 160346 - DNA, 16 bp, H. sapiens
ttattaaaaaatcaga

SEQ ID NO: 160347 - DNA, 16 bp, H. sapiens
ttattaaaaacacttt

SEQ ID NO: 160348 - DNA, 16 bp, H. sapiens
ttattaaaaaggcaaa

SEQ ID NO: 160349 - DNA, 16 bp, H. sapiens
ttattaaaaagtttca

SEQ ID NO: 160350 - DNA, 16 bp, H. sapiens
ttattaaaaattcaga

SEQ ID NO: 160351 - DNA, 16 bp, H. sapiens
ttattaaaaggagaaa

SEQ ID NO: 160352 - DNA, 16 bp, H. sapiens
ttattaaaatcatgtt

SEQ ID NO: 160353 - DNA, 16 bp, H. sapiens
ttattaaaatcttcct

SEQ ID NO: 160354 - DNA, 16 bp, H. sapiens
ttattaaaatggaaat

SEQ ID NO: 160355 - DNA, 16 bp, H. sapiens
ttattaaacctctttt

SEQ ID NO: 160356 - DNA, 16 bp, H. sapiens
ttattaaatgaatgaa

SEQ ID NO: 160357 - DNA, 16 bp, H. sapiens
ttattaaatgctttga

SEQ ID NO: 160358 - DNA, 16 bp, H. sapiens
ttattaaatgtcttca

SEQ ID NO: 160359 - DNA, 16 bp, H. sapiens
ttattaaatgttttct

SEQ ID NO: 160360 - DNA, 16 bp, H. sapiens
ttattaaatttttctg

SEQ ID NO: 160361 - DNA, 16 bp, H. sapiens
ttattaacatcttgca

SEQ ID NO: 160362 - DNA, 16 bp, H. sapiens
ttattaacattcctga

SEQ ID NO: 160363 - DNA, 16 bp, H. sapiens
ttattaacattttctc

SEQ ID NO: 160364 - DNA, 16 bp, H. sapiens
ttattaaccatagtca

SEQ ID NO: 160365 - DNA, 16 bp, H. sapiens
ttattaactgaagaaa

SEQ ID NO: 160366 - DNA, 16 bp, H. sapiens
ttattaactgtagtca

SEQ ID NO: 160367 - DNA, 16 bp, H. sapiens
ttattaagaaaaatca

SEQ ID NO: 160368 - DNA, 16 bp, H. sapiens
ttattaaggaagaaaa

SEQ ID NO: 160369 - DNA, 16 bp, H. sapiens
ttattaaggactttaa

SEQ ID NO: 160370 - DNA, 16 bp, H. sapiens
ttattaaggagaattg

SEQ ID NO: 160371 - DNA, 16 bp, H. sapiens
ttattaagtacttact

SEQ ID NO: 160372 - DNA, 16 bp, H. sapiens
ttattaatagagatgg

SEQ ID NO: 160373 - DNA, 16 bp, H. sapiens
ttattacaaaaatgtt

SEQ ID NO: 160374 - DNA, 16 bp, H. sapiens
ttattacaaagaaaat

SEQ ID NO: 160375 - DNA, 16 bp, H. sapiens
ttattacagaaaaaaa

SEQ ID NO: 160376 - DNA, 16 bp, H. sapiens
ttattacaggaaaatt

SEQ ID NO: 160377 - DNA, 16 bp, H. sapiens
ttattacattatatgt

SEQ ID NO: 160378 - DNA, 16 bp, H. sapiens
ttattactattattgt

SEQ ID NO: 160379 - DNA, 16 bp, H. sapiens
ttattactgaaatcag

SEQ ID NO: 160380 - DNA, 16 bp, H. sapiens
ttattactgattcaat

SEQ ID NO: 160381 - DNA, 16 bp, H. sapiens
ttattacttaaatcag

SEQ ID NO: 160382 - DNA, 16 bp, H. sapiens
ttattacttatgcaaa

SEQ ID NO: 160383 - DNA, 16 bp, H. sapiens
ttattactttaaatgt

SEQ ID NO: 160384 - DNA, 16 bp, H. sapiens
ttattagaaacaaaaa

SEQ ID NO: 160385 - DNA, 16 bp, H. sapiens
ttattagcagcataag

SEQ ID NO: 160386 - DNA, 16 bp, H. sapiens
ttattagctctgtgac

SEQ ID NO: 160387 - DNA, 16 bp, H. sapiens
ttattagctgtgtgac

SEQ ID NO: 160388 - DNA, 16 bp, H. sapiens
ttattaggttaaaaaa

SEQ ID NO: 160389 - DNA, 16 bp, H. sapiens
ttattagtagtagtag

SEQ ID NO: 160390 - DNA, 16 bp, H. sapiens
ttattagtcatttgta

SEQ ID NO: 160391 - DNA, 17 bp, H. sapiens
ttattagttccccaaat

SEQ ID NO: 160392 - DNA, 16 bp, H. sapiens
ttattataaaggattt

SEQ ID NO: 160393 - DNA, 17 bp, H. sapiens
ttattatactttaagtt

SEQ ID NO: 160394 - DNA, 16 bp, H. sapiens
ttattatatagctaca

SEQ ID NO: 160395 - DNA, 16 bp, H. sapiens
ttattatatattacag

SEQ ID NO: 160396 - DNA, 16 bp, H. sapiens
ttattatatgtaaagt

SEQ ID NO: 160397 - DNA, 16 bp, H. sapiens
ttattatattgctgtc

SEQ ID NO: 160398 - DNA, 16 bp, H. sapiens
ttattatatttttcag

SEQ ID NO: 160399 - DNA, 16 bp, H. sapiens
ttattatcatccccat

SEQ ID NO: 160400 - DNA, 16 bp, H. sapiens
ttattatgaacatttt

SEQ ID NO: 160401 - DNA, 16 bp, H. sapiens
ttattatgactattat

SEQ ID NO: 160402 - DNA, 16 bp, H. sapiens
ttattatgagaattaa

SEQ ID NO: 160403 - DNA, 16 bp, H. sapiens
ttattatgcaaataat

SEQ ID NO: 160404 - DNA, 16 bp, H. sapiens
ttattatggtaaaata

SEQ ID NO: 160405 - DNA, 16 bp, H. sapiens
ttattatgttaatcaa

SEQ ID NO: 160406 - DNA, 16 bp, H. sapiens
ttattattaaaccaat

SEQ ID NO: 160407 - DNA, 16 bp, H. sapiens
ttattattaaaggaaa

SEQ ID NO: 160408 - DNA, 16 bp, H. sapiens
ttattattaactaaag

SEQ ID NO: 160409 - DNA, 16 bp, H. sapiens
ttattattattagaga

SEQ ID NO: 160410 - DNA, 16 bp, H. sapiens
ttattattattgctat

SEQ ID NO: 160411 - DNA, 16 bp, H. sapiens
ttattattatttcaga

SEQ ID NO: 160412 - DNA, 16 bp, H. sapiens
ttattattatttctgg

SEQ ID NO: 160413 - DNA, 16 bp, H. sapiens
ttattattctttaagt

SEQ ID NO: 160414 - DNA, 16 bp, H. sapiens
ttattattgactatag

SEQ ID NO: 160415 - DNA, 16 bp, H. sapiens
ttattattgactgtag

SEQ ID NO: 160416 - DNA, 17 bp, H. sapiens
ttattattgtactttaa

SEQ ID NO: 160417 - DNA, 16 bp, H. sapiens
ttattattgtcattgt

SEQ ID NO: 160418 - DNA, 16 bp, H. sapiens
ttattatttcagaaat

SEQ ID NO: 160419 - DNA, 16 bp, H. sapiens
ttattattttctgtag

SEQ ID NO: 160420 - DNA, 16 bp, H. sapiens
ttattattttgagaaa

SEQ ID NO: 160421 - DNA, 16 bp, H. sapiens
ttattattttgagaga

SEQ ID NO: 160422 - DNA, 16 bp, H. sapiens
ttattcaaaagaaaaa

SEQ ID NO: 160423 - DNA, 16 bp, H. sapiens
ttattcaagaaatctt

SEQ ID NO: 160424 - DNA, 16 bp, H. sapiens
ttattcaataagtatt

SEQ ID NO: 160425 - DNA, 16 bp, H. sapiens
ttattcactatcatga

SEQ ID NO: 160426 - DNA, 16 bp, H. sapiens
ttattcactcattaat

SEQ ID NO: 160427 - DNA, 16 bp, H. sapiens
ttattcactgtcacaa

SEQ ID NO: 160428 - DNA, 16 bp, H. sapiens
ttattcagaaaacatt

SEQ ID NO: 160429 - DNA, 16 bp, H. sapiens
ttattcagaattttct

SEQ ID NO: 160430 - DNA, 16 bp, H. sapiens
ttattcagatcctttg

SEQ ID NO: 160431 - DNA, 16 bp, H. sapiens
ttattcagttattaaa

SEQ ID NO: 160432 - DNA, 16 bp, H. sapiens
ttattcatctttgtat

SEQ ID NO: 160433 - DNA, 16 bp, H. sapiens
ttattcattatatgga

SEQ ID NO: 160434 - DNA, 16 bp, H. sapiens
ttattcattcaagaaa

SEQ ID NO: 160435 - DNA, 16 bp, H. sapiens
ttattcattcatcaaa

SEQ ID NO: 160436 - DNA, 16 bp, H. sapiens
ttattcattcattcaa

SEQ ID NO: 160437 - DNA, 16 bp, H. sapiens
ttattcattcatttca

SEQ ID NO: 160438 - DNA, 16 bp, H. sapiens
ttattcatttgttcat

SEQ ID NO: 160439 - DNA, 16 bp, H. sapiens
ttattcatttgtttaa

SEQ ID NO: 160440 - DNA, 16 bp, H. sapiens
ttattcattttatgga

SEQ ID NO: 160441 - DNA, 16 bp, H. sapiens
ttattcatttttactg

SEQ ID NO: 160442 - DNA, 16 bp, H. sapiens
ttattccaaaatattt

SEQ ID NO: 160443 - DNA, 16 bp, H. sapiens
ttattccagttttaca

SEQ ID NO: 160444 - DNA, 16 bp, H. sapiens
ttattccagttttcaa

SEQ ID NO: 160445 - DNA, 16 bp, H. sapiens
ttattccatttagttt

SEQ ID NO: 160446 - DNA, 16 bp, H. sapiens
ttattcccaaatattt

SEQ ID NO: 160447 - DNA, 16 bp, H. sapiens
ttattcccatttttaa

SEQ ID NO: 160448 - DNA, 16 bp, H. sapiens
ttattccctaaacaat

SEQ ID NO: 160449 - DNA, 16 bp, H. sapiens
ttattcctaagtattt

SEQ ID NO: 160450 - DNA, 16 bp, H. sapiens
ttattcctagaatgca

SEQ ID NO: 160451 - DNA, 16 bp, H. sapiens
ttattcctaggtttgg

SEQ ID NO: 160452 - DNA, 16 bp, H. sapiens
ttattcctcaaaataa

SEQ ID NO: 160453 - DNA, 16 bp, H. sapiens
ttattccttccatcta

SEQ ID NO: 160454 - DNA, 16 bp, H. sapiens
ttattctaagagaagt

SEQ ID NO: 160455 - DNA, 16 bp, H. sapiens
ttattctacaaggcca

SEQ ID NO: 160456 - DNA, 16 bp, H. sapiens
ttattctattataaag

SEQ ID NO: 160457 - DNA, 16 bp, H. sapiens
ttattctcagcaccac

SEQ ID NO: 160458 - DNA, 16 bp, H. sapiens
ttattctcattttgca

SEQ ID NO: 160459 - DNA, 16 bp, H. sapiens
ttattctctaaataat

SEQ ID NO: 160460 - DNA, 16 bp, H. sapiens
ttattctgagaaactg

SEQ ID NO: 160461 - DNA, 16 bp, H. sapiens
ttattctgattataaa

SEQ ID NO: 160462 - DNA, 16 bp, H. sapiens
ttattctgcatttatt

SEQ ID NO: 160463 - DNA, 16 bp, H. sapiens
ttattctgccattttt

SEQ ID NO: 160464 - DNA, 16 bp, H. sapiens
ttattctgtaagtttt

SEQ ID NO: 160465 - DNA, 16 bp, H. sapiens
ttattctgttaatgta

SEQ ID NO: 160466 - DNA, 16 bp, H. sapiens
ttattctgtttttaaa

SEQ ID NO: 160467 - DNA, 16 bp, H. sapiens
ttattcttaagcattt

SEQ ID NO: 160468 - DNA, 16 bp, H. sapiens
ttattcttccagatga

SEQ ID NO: 160469 - DNA, 16 bp, H. sapiens
ttattcttgaagtcag

SEQ ID NO: 160470 - DNA, 16 bp, H. sapiens
ttattctttaagaaat

SEQ ID NO: 160471 - DNA, 16 bp, H. sapiens
ttattctttcaaaaat

SEQ ID NO: 160472 - DNA, 16 bp, H. sapiens
ttattctttctgtctc

SEQ ID NO: 160473 - DNA, 16 bp, H. sapiens
ttattgaaaaaaattg

SEQ ID NO: 160474 - DNA, 16 bp, H. sapiens
ttattgaaaaacaaca

SEQ ID NO: 160475 - DNA, 16 bp, H. sapiens
ttattgaacacctgct

SEQ ID NO: 160476 - DNA, 16 bp, H. sapiens
ttattgaacacttact

SEQ ID NO: 160477 - DNA, 16 bp, H. sapiens
ttattgaacatctgtt

SEQ ID NO: 160478 - DNA, 16 bp, H. sapiens
ttattgaagaaactgg

SEQ ID NO: 160479 - DNA, 16 bp, H. sapiens
ttattgaagaaagaaa

SEQ ID NO: 160480 - DNA, 16 bp, H. sapiens
ttattgaaggactttt

SEQ ID NO: 160481 - DNA, 16 bp, H. sapiens
ttattgaatatctatt

SEQ ID NO: 160482 - DNA, 16 bp, H. sapiens
ttattgacttctgtgc

SEQ ID NO: 160483 - DNA, 16 bp, H. sapiens
ttattgagaaaaatat

SEQ ID NO: 160484 - DNA, 16 bp, H. sapiens
ttattgagatataatt

SEQ ID NO: 160485 - DNA, 16 bp, H. sapiens
ttattgagatatagtt

SEQ ID NO: 160486 - DNA, 16 bp, H. sapiens
ttattgagcgcttact

SEQ ID NO: 160487 - DNA, 16 bp, H. sapiens
ttattgaggtataatt

SEQ ID NO: 160488 - DNA, 16 bp, H. sapiens
ttattgaggtatgatt

SEQ ID NO: 160489 - DNA, 16 bp, H. sapiens
ttattgagtgcttatt

SEQ ID NO: 160490 - DNA, 16 bp, H. sapiens
ttattgatctattcag

SEQ ID NO: 160491 - DNA, 16 bp, H. sapiens
ttattgatctgtgtat

SEQ ID NO: 160492 - DNA, 16 bp, H. sapiens
ttattgattagagctg

SEQ ID NO: 160493 - DNA, 16 bp, H. sapiens
ttattgattgtttcct

SEQ ID NO: 160494 - DNA, 16 bp, H. sapiens
ttattgatttcaaatt

SEQ ID NO: 160495 - DNA, 16 bp, H. sapiens
ttattgcaagaataca

SEQ ID NO: 160496 - DNA, 16 bp, H. sapiens
ttattgcactccagcc

SEQ ID NO: 160497 - DNA, 16 bp, H. sapiens
ttattgcactggctag

SEQ ID NO: 160498 - DNA, 16 bp, H. sapiens
ttattgccaaataaaa

SEQ ID NO: 160499 - DNA, 16 bp, H. sapiens
ttattgccaaataata

SEQ ID NO: 160500 - DNA, 16 bp, H. sapiens
ttattgccattatttt

SEQ ID NO: 160501 - DNA, 16 bp, H. sapiens
ttattgcctgaatttc

SEQ ID NO: 160502 - DNA, 16 bp, H. sapiens
ttattgcctgtctttt

SEQ ID NO: 160503 - DNA, 16 bp, H. sapiens
ttattgctaaaaaatt

SEQ ID NO: 160504 - DNA, 16 bp, H. sapiens
ttattgctataatctt

SEQ ID NO: 160505 - DNA, 16 bp, H. sapiens
ttattgctgtgtaaca

SEQ ID NO: 160506 - DNA, 16 bp, H. sapiens
ttattgcttgccttct

SEQ ID NO: 160507 - DNA, 16 bp, H. sapiens
ttattgctttttaaaa

SEQ ID NO: 160508 - DNA, 16 bp, H. sapiens
ttattggaaaacagcc

SEQ ID NO: 160509 - DNA, 16 bp, H. sapiens
ttattggaaaatataa

SEQ ID NO: 160510 - DNA, 16 bp, H. sapiens
ttattggaatataatt

SEQ ID NO: 160511 - DNA, 16 bp, H. sapiens
ttattggaattttaaa

SEQ ID NO: 160512 - DNA, 16 bp, H. sapiens
ttattggacatttgta

SEQ ID NO: 160513 - DNA, 16 bp, H. sapiens
ttattggatatgtttg

SEQ ID NO: 160514 - DNA, 16 bp, H. sapiens
ttattgggagactttt

SEQ ID NO: 160515 - DNA, 16 bp, H. sapiens
ttattggtctattcaa

SEQ ID NO: 160516 - DNA, 16 bp, H. sapiens
ttattggtgtgttcag

SEQ ID NO: 160517 - DNA, 16 bp, H. sapiens
ttattgtaaaaatgtt

SEQ ID NO: 160518 - DNA, 16 bp, H. sapiens
ttattgtaaatacaaa

SEQ ID NO: 160519 - DNA, 16 bp, H. sapiens
ttattgtacacatttt

SEQ ID NO: 160520 - DNA, 16 bp, H. sapiens
ttattgtagattctgg

SEQ ID NO: 160521 - DNA, 16 bp, H. sapiens
ttattgtcatcatcat

SEQ ID NO: 160522 - DNA, 16 bp, H. sapiens
ttattgtcatgcattt

SEQ ID NO: 160523 - DNA, 16 bp, H. sapiens
ttattgtccacatttt

SEQ ID NO: 160524 - DNA, 16 bp, H. sapiens
ttattgtctaaaagtt

SEQ ID NO: 160525 - DNA, 16 bp, H. sapiens
ttattgtgaagagcga

SEQ ID NO: 160526 - DNA, 16 bp, H. sapiens
ttattgtgagaattaa

SEQ ID NO: 160527 - DNA, 16 bp, H. sapiens
ttattgtgataaaata

SEQ ID NO: 160528 - DNA, 16 bp, H. sapiens
ttattgtgcatttaaa

SEQ ID NO: 160529 - DNA, 16 bp, H. sapiens
ttattgtgggagtggg

SEQ ID NO: 160530 - DNA, 16 bp, H. sapiens
ttattgtggtggtgat

SEQ ID NO: 160531 - DNA, 16 bp, H. sapiens
ttattgtgttgctgcc

SEQ ID NO: 160532 - DNA, 16 bp, H. sapiens
ttattgttattatact

SEQ ID NO: 160533 - DNA, 16 bp, H. sapiens
ttattgttgctattgt

SEQ ID NO: 160534 - DNA, 16 bp, H. sapiens
ttattgttttaaacca

SEQ ID NO: 160535 - DNA, 16 bp, H. sapiens
ttattgttttaaagaa

SEQ ID NO: 160536 - DNA, 16 bp, H. sapiens
ttattgttttcctgat

SEQ ID NO: 160537 - DNA, 16 bp, H. sapiens
ttattgttttgcatat

SEQ ID NO: 160538 - DNA, 16 bp, H. sapiens
ttattgtttttgagac

SEQ ID NO: 160539 - DNA, 16 bp, H. sapiens
ttatttaaaaatgtgt

SEQ ID NO: 160540 - DNA, 16 bp, H. sapiens
ttatttaaaaggaaat

SEQ ID NO: 160541 - DNA, 16 bp, H. sapiens
ttatttaaaaggcatt

SEQ ID NO: 160542 - DNA, 16 bp, H. sapiens
ttatttaaaagggaag

SEQ ID NO: 160543 - DNA, 16 bp, H. sapiens
ttatttaaaatgtaca

SEQ ID NO: 160544 - DNA, 16 bp, H. sapiens
ttatttaaaattggaa

SEQ ID NO: 160545 - DNA, 16 bp, H. sapiens
ttatttaaacaaaaag

SEQ ID NO: 160546 - DNA, 16 bp, H. sapiens
ttatttaaagagacag

SEQ ID NO: 160547 - DNA, 16 bp, H. sapiens
ttatttaacttagcat

SEQ ID NO: 160548 - DNA, 16 bp, H. sapiens
ttatttaacttcaaaa

SEQ ID NO: 160549 - DNA, 16 bp, H. sapiens
ttatttaagaaaaaca

SEQ ID NO: 160550 - DNA, 16 bp, H. sapiens
ttatttaatctccaca

SEQ ID NO: 160551 - DNA, 16 bp, H. sapiens
ttatttaatcttctca

SEQ ID NO: 160552 - DNA, 16 bp, H. sapiens
ttatttaatctttctg

SEQ ID NO: 160553 - DNA, 16 bp, H. sapiens
ttatttaatgcccttc

SEQ ID NO: 160554 - DNA, 16 bp, H. sapiens
ttatttaattctcaca

SEQ ID NO: 160555 - DNA, 16 bp, H. sapiens
ttatttacatttgctt

SEQ ID NO: 160556 - DNA, 16 bp, H. sapiens
ttatttaccattctga

SEQ ID NO: 160557 - DNA, 16 bp, H. sapiens
ttatttacctgaaatt

SEQ ID NO: 160558 - DNA, 16 bp, H. sapiens
ttatttacttagagat

SEQ ID NO: 160559 - DNA, 16 bp, H. sapiens
ttatttagcaataaaa

SEQ ID NO: 160560 - DNA, 16 bp, H. sapiens
ttatttagcattttta

SEQ ID NO: 160561 - DNA, 16 bp, H. sapiens
ttatttaggaaataat

SEQ ID NO: 160562 - DNA, 16 bp, H. sapiens
ttatttaggtcttatt

SEQ ID NO: 160563 - DNA, 16 bp, H. sapiens
ttatttagtctttaaa

SEQ ID NO: 160564 - DNA, 16 bp, H. sapiens
ttatttataaaaggaa

SEQ ID NO: 160565 - DNA, 16 bp, H. sapiens
ttatttataatagcaa

SEQ ID NO: 160566 - DNA, 16 bp, H. sapiens
ttatttatacattttg

SEQ ID NO: 160567 - DNA, 16 bp, H. sapiens
ttatttatagaaacaa

SEQ ID NO: 160568 - DNA, 16 bp, H. sapiens
ttatttatagaaatga

SEQ ID NO: 160569 - DNA, 16 bp, H. sapiens
ttatttatatatttgc

SEQ ID NO: 160570 - DNA, 22 bp, H. sapiens
ttatttatatcctactgctcaa

SEQ ID NO: 160571 - DNA, 16 bp, H. sapiens
ttatttatcagaaaat

SEQ ID NO: 160572 - DNA, 16 bp, H. sapiens
ttatttatctctgctc

SEQ ID NO: 160573 - DNA, 16 bp, H. sapiens
ttatttatctgataaa

SEQ ID NO: 160574 - DNA, 16 bp, H. sapiens
ttatttatgaaacaga

SEQ ID NO: 160575 - DNA, 16 bp, H. sapiens
ttatttatgacacaga

SEQ ID NO: 160576 - DNA, 16 bp, H. sapiens
ttatttatgcatttgt

SEQ ID NO: 160577 - DNA, 16 bp, H. sapiens
ttatttatgtaaaaca

SEQ ID NO: 160578 - DNA, 16 bp, H. sapiens
ttatttatgtatctat

SEQ ID NO: 160579 - DNA, 16 bp, H. sapiens
ttatttatgtttcata

SEQ ID NO: 160580 - DNA, 16 bp, H. sapiens
ttatttattcatccat

SEQ ID NO: 160581 - DNA, 16 bp, H. sapiens
ttatttattcattcac

SEQ ID NO: 160582 - DNA, 16 bp, H. sapiens
ttatttattccataaa

SEQ ID NO: 160583 - DNA, 16 bp, H. sapiens
ttatttattctgttcc

SEQ ID NO: 160584 - DNA, 16 bp, H. sapiens
ttatttattgcagaac

SEQ ID NO: 160585 - DNA, 16 bp, H. sapiens
ttatttattgctcatt

SEQ ID NO: 160586 - DNA, 16 bp, H. sapiens
ttatttattgtagaaa

SEQ ID NO: 160587 - DNA, 16 bp, H. sapiens
ttatttatttatcgag

SEQ ID NO: 160588 - DNA, 16 bp, H. sapiens
ttatttatttcaagaa

SEQ ID NO: 160589 - DNA, 16 bp, H. sapiens
ttatttatttcacaaa

SEQ ID NO: 160590 - DNA, 16 bp, H. sapiens
ttatttatttctgaaa

SEQ ID NO: 160591 - DNA, 16 bp, H. sapiens
ttatttatttctgaat

SEQ ID NO: 160592 - DNA, 16 bp, H. sapiens
ttatttatttgaatct

SEQ ID NO: 160593 - DNA, 16 bp, H. sapiens
ttatttattttcaaga

SEQ ID NO: 160594 - DNA, 16 bp, H. sapiens
ttatttattttgcctg

SEQ ID NO: 160595 - DNA, 16 bp, H. sapiens
ttatttattttgggac

SEQ ID NO: 160596 - DNA, 16 bp, H. sapiens
ttatttatttttacag

SEQ ID NO: 160597 - DNA, 16 bp, H. sapiens
ttatttcaaaaactgt

SEQ ID NO: 160598 - DNA, 16 bp, H. sapiens
ttatttcaaaacaatt

SEQ ID NO: 160599 - DNA, 16 bp, H. sapiens
ttatttcaaaagttaa

SEQ ID NO: 160600 - DNA, 16 bp, H. sapiens
ttatttcaaagttaaa

SEQ ID NO: 160601 - DNA, 16 bp, H. sapiens
ttatttcaaagtttaa

SEQ ID NO: 160602 - DNA, 16 bp, H. sapiens
ttatttcaaatagttt

SEQ ID NO: 160603 - DNA, 16 bp, H. sapiens
ttatttcaaatatttg

SEQ ID NO: 160604 - DNA, 16 bp, H. sapiens
ttatttcaacatataa

SEQ ID NO: 160605 - DNA, 16 bp, H. sapiens
ttatttcaacattaat

SEQ ID NO: 160606 - DNA, 16 bp, H. sapiens
ttatttcaataaaact

SEQ ID NO: 160607 - DNA, 16 bp, H. sapiens
ttatttcaatagaaaa

SEQ ID NO: 160608 - DNA, 16 bp, H. sapiens
ttatttcaatagcttt

SEQ ID NO: 160609 - DNA, 16 bp, H. sapiens
ttatttcaatctgttt

SEQ ID NO: 160610 - DNA, 16 bp, H. sapiens
ttatttcaatgagaaa

SEQ ID NO: 160611 - DNA, 16 bp, H. sapiens
ttatttcacaaataat

SEQ ID NO: 160612 - DNA, 16 bp, H. sapiens
ttatttcacaatgtat

SEQ ID NO: 160613 - DNA, 16 bp, H. sapiens
ttatttcacataatat

SEQ ID NO: 160614 - DNA, 16 bp, H. sapiens
ttatttcactgaagat

SEQ ID NO: 160615 - DNA, 16 bp, H. sapiens
ttatttcacttaacat

SEQ ID NO: 160616 - DNA, 16 bp, H. sapiens
ttatttcagaaaaaaa

SEQ ID NO: 160617 - DNA, 16 bp, H. sapiens
ttatttcagaaatgca

SEQ ID NO: 160618 - DNA, 16 bp, H. sapiens
ttatttcagaagaaaa

SEQ ID NO: 160619 - DNA, 16 bp, H. sapiens
ttatttcagatggagt

SEQ ID NO: 160620 - DNA, 16 bp, H. sapiens
ttatttcagattttta

SEQ ID NO: 160621 - DNA, 16 bp, H. sapiens
ttatttcaggattttt

SEQ ID NO: 160622 - DNA, 16 bp, H. sapiens
ttatttcagttttaaa

SEQ ID NO: 160623 - DNA, 16 bp, H. sapiens
ttatttcatcattaaa

SEQ ID NO: 160624 - DNA, 16 bp, H. sapiens
ttatttcatctgcaaa

SEQ ID NO: 160625 - DNA, 16 bp, H. sapiens
ttatttcatcttaaaa

SEQ ID NO: 160626 - DNA, 16 bp, H. sapiens
ttatttcatgacccag

SEQ ID NO: 160627 - DNA, 16 bp, H. sapiens
ttatttcatgtctttg

SEQ ID NO: 160628 - DNA, 16 bp, H. sapiens
ttatttcatttagcat

SEQ ID NO: 160629 - DNA, 16 bp, H. sapiens
ttatttcatttggaaa

SEQ ID NO: 160630 - DNA, 16 bp, H. sapiens
ttatttccaaataaaa

SEQ ID NO: 160631 - DNA, 16 bp, H. sapiens
ttatttccagaatttt

SEQ ID NO: 160632 - DNA, 16 bp, H. sapiens
ttatttccattgtatt

SEQ ID NO: 160633 - DNA, 16 bp, H. sapiens
ttatttccattttatg

SEQ ID NO: 160634 - DNA, 16 bp, H. sapiens
ttatttccattttcca

SEQ ID NO: 160635 - DNA, 16 bp, H. sapiens
ttatttcccaaagatt

SEQ ID NO: 160636 - DNA, 16 bp, H. sapiens
ttatttcccttaacat

SEQ ID NO: 160637 - DNA, 16 bp, H. sapiens
ttatttccctttaaaa

SEQ ID NO: 160638 - DNA, 16 bp, H. sapiens
ttatttcctctaaaaa

SEQ ID NO: 160639 - DNA, 16 bp, H. sapiens
ttatttcctgaaatat

SEQ ID NO: 160640 - DNA, 16 bp, H. sapiens
ttatttcctgtcttct

SEQ ID NO: 160641 - DNA, 16 bp, H. sapiens
ttatttccttgagcat

SEQ ID NO: 160642 - DNA, 16 bp, H. sapiens
ttatttcctttaaaaa

SEQ ID NO: 160643 - DNA, 16 bp, H. sapiens
ttatttcctttgctgt

SEQ ID NO: 160644 - DNA, 16 bp, H. sapiens
ttatttcctttggaaa

SEQ ID NO: 160645 - DNA, 16 bp, H. sapiens
ttatttctaaaatgtt

SEQ ID NO: 160646 - DNA, 16 bp, H. sapiens
ttatttctaaacagaa

SEQ ID NO: 160647 - DNA, 16 bp, H. sapiens
ttatttctaagtattt

SEQ ID NO: 160648 - DNA, 16 bp, H. sapiens
ttatttctagatattt

SEQ ID NO: 160649 - DNA, 16 bp, H. sapiens
ttatttctatgaaaat

SEQ ID NO: 160650 - DNA, 16 bp, H. sapiens
ttatttctcaaagatt

SEQ ID NO: 160651 - DNA, 16 bp, H. sapiens
ttatttctcacacttc

SEQ ID NO: 160652 - DNA, 16 bp, H. sapiens
ttatttctcacagttt

SEQ ID NO: 160653 - DNA, 16 bp, H. sapiens
ttatttctcactgttc

SEQ ID NO: 160654 - DNA, 16 bp, H. sapiens
ttatttctccctcact

SEQ ID NO: 160655 - DNA, 16 bp, H. sapiens
ttatttctctgaagaa

SEQ ID NO: 160656 - DNA, 16 bp, H. sapiens
ttatttctcttctgga

SEQ ID NO: 160657 - DNA, 16 bp, H. sapiens
ttatttctgaaaatgt

SEQ ID NO: 160658 - DNA, 16 bp, H. sapiens
ttatttctgaaatttt

SEQ ID NO: 160659 - DNA, 31 bp, H. sapiens
ttatttctgagggctctgttctgttccattg

SEQ ID NO: 160660 - DNA, 16 bp, H. sapiens
ttatttctgccttcat

SEQ ID NO: 160661 - DNA, 16 bp, H. sapiens
ttatttctgcctttgt

SEQ ID NO: 160662 - DNA, 16 bp, H. sapiens
ttatttctgctgttat

SEQ ID NO: 160663 - DNA, 16 bp, H. sapiens
ttatttctggaatgtt

SEQ ID NO: 160664 - DNA, 16 bp, H. sapiens
ttatttctggaatttt

SEQ ID NO: 160665 - DNA, 16 bp, H. sapiens
ttatttctggactctc

SEQ ID NO: 160666 - DNA, 16 bp, H. sapiens
ttatttctggattctc

SEQ ID NO: 160667 - DNA, 16 bp, H. sapiens
ttatttctgggttgtc

SEQ ID NO: 160668 - DNA, 16 bp, H. sapiens
ttatttctgggtttgt

SEQ ID NO: 160669 - DNA, 16 bp, H. sapiens
ttatttctgtaaataa

SEQ ID NO: 160670 - DNA, 16 bp, H. sapiens
ttatttctgtctcttg

SEQ ID NO: 160671 - DNA, 16 bp, H. sapiens
ttatttctgtggtcta

SEQ ID NO: 160672 - DNA, 16 bp, H. sapiens
ttatttctgtgtatgt

SEQ ID NO: 160673 - DNA, 16 bp, H. sapiens
ttatttctgttttcca

SEQ ID NO: 160674 - DNA, 16 bp, H. sapiens
ttatttcttaaagatt

SEQ ID NO: 160675 - DNA, 16 bp, H. sapiens
ttatttcttaaatgtt

SEQ ID NO: 160676 - DNA, 16 bp, H. sapiens
ttatttctttatatag

SEQ ID NO: 160677 - DNA, 16 bp, H. sapiens
ttatttctttctctgg

SEQ ID NO: 160678 - DNA, 16 bp, H. sapiens
ttatttctttgtaaat

SEQ ID NO: 160679 - DNA, 16 bp, H. sapiens
ttatttctttttaaga

SEQ ID NO: 160680 - DNA, 16 bp, H. sapiens
ttatttgaaaactttt

SEQ ID NO: 160681 - DNA, 16 bp, H. sapiens
ttatttgaaaagagaa

SEQ ID NO: 160682 - DNA, 16 bp, H. sapiens
ttatttgaaaagtaaa

SEQ ID NO: 160683 - DNA, 16 bp, H. sapiens
ttatttgaaaagttat

SEQ ID NO: 160684 - DNA, 16 bp, H. sapiens
ttatttgaaaatatag

SEQ ID NO: 160685 - DNA, 16 bp, H. sapiens
ttatttgaaaatcaaa

SEQ ID NO: 160686 - DNA, 16 bp, H. sapiens
ttatttgaaaatggaa

SEQ ID NO: 160687 - DNA, 16 bp, H. sapiens
ttatttgaaaatttga

SEQ ID NO: 160688 - DNA, 16 bp, H. sapiens
ttatttgaaatctttt

SEQ ID NO: 160689 - DNA, 16 bp, H. sapiens
ttatttgaaatgaaaa

SEQ ID NO: 160690 - DNA, 16 bp, H. sapiens
ttatttgaaatgttaa

SEQ ID NO: 160691 - DNA, 16 bp, H. sapiens
ttatttgaacacagtt

SEQ ID NO: 160692 - DNA, 16 bp, H. sapiens
ttatttgaaggaataa

SEQ ID NO: 160693 - DNA, 16 bp, H. sapiens
ttatttgaaggtagac

SEQ ID NO: 160694 - DNA, 16 bp, H. sapiens
ttatttgaagttttct

SEQ ID NO: 160695 - DNA, 16 bp, H. sapiens
ttatttgacaatgctt

SEQ ID NO: 160696 - DNA, 16 bp, H. sapiens
ttatttgacattttag

SEQ ID NO: 160697 - DNA, 16 bp, H. sapiens
ttatttgaccacagaa

SEQ ID NO: 160698 - DNA, 16 bp, H. sapiens
ttatttgaggaaaaaa

SEQ ID NO: 160699 - DNA, 16 bp, H. sapiens
ttatttgcaaaatctg

SEQ ID NO: 160700 - DNA, 16 bp, H. sapiens
ttatttgcagttattt

SEQ ID NO: 160701 - DNA, 16 bp, H. sapiens
ttatttgcatatattg

SEQ ID NO: 160702 - DNA, 16 bp, H. sapiens
ttatttgcatatttgt

SEQ ID NO: 160703 - DNA, 16 bp, H. sapiens
ttatttgcatttaatt

SEQ ID NO: 160704 - DNA, 16 bp, H. sapiens
ttatttgctcatgatt

SEQ ID NO: 160705 - DNA, 16 bp, H. sapiens
ttatttgctttttaaa

SEQ ID NO: 160706 - DNA, 16 bp, H. sapiens
ttatttggaaaaacaa

SEQ ID NO: 160707 - DNA, 16 bp, H. sapiens
ttatttggaaaaatgt

SEQ ID NO: 160708 - DNA, 16 bp, H. sapiens
ttatttggaaaatgtt

SEQ ID NO: 160709 - DNA, 16 bp, H. sapiens
ttatttggaaacagtt

SEQ ID NO: 160710 - DNA, 16 bp, H. sapiens
ttatttggaaagaaga

SEQ ID NO: 160711 - DNA, 16 bp, H. sapiens
ttatttggaaataaga

SEQ ID NO: 160712 - DNA, 16 bp, H. sapiens
ttatttggaaataatt

SEQ ID NO: 160713 - DNA, 16 bp, H. sapiens
ttatttggaattcttt

SEQ ID NO: 160714 - DNA, 16 bp, H. sapiens
ttatttgggaaaaaaa

SEQ ID NO: 160715 - DNA, 16 bp, H. sapiens
ttatttgggaaaaggg

SEQ ID NO: 160716 - DNA, 16 bp, H. sapiens
ttatttggtagagatg

SEQ ID NO: 160717 - DNA, 16 bp, H. sapiens
ttatttgtaaaacaaa

SEQ ID NO: 160718 - DNA, 16 bp, H. sapiens
ttatttgtaaaatgag

SEQ ID NO: 160719 - DNA, 16 bp, H. sapiens
ttatttgtatcttctg

SEQ ID NO: 160720 - DNA, 16 bp, H. sapiens
ttatttgtcaaataaa

SEQ ID NO: 160721 - DNA, 16 bp, H. sapiens
ttatttgtgcaggagg

SEQ ID NO: 160722 - DNA, 16 bp, H. sapiens
ttatttgttcaataaa

SEQ ID NO: 160723 - DNA, 16 bp, H. sapiens
ttatttgttccttaaa

SEQ ID NO: 160724 - DNA, 16 bp, H. sapiens
ttatttgttgcctgaa

SEQ ID NO: 160725 - DNA, 16 bp, H. sapiens
ttatttgtttcaaatt

SEQ ID NO: 160726 - DNA, 16 bp, H. sapiens
ttattttaaaaaacag

SEQ ID NO: 160727 - DNA, 16 bp, H. sapiens
ttattttaaaaaccct

SEQ ID NO: 160728 - DNA, 16 bp, H. sapiens
ttattttaaaaagcag

SEQ ID NO: 160729 - DNA, 16 bp, H. sapiens
ttattttaaaaagtgt

SEQ ID NO: 160730 - DNA, 16 bp, H. sapiens
ttattttaaaactgaa

SEQ ID NO: 160731 - DNA, 16 bp, H. sapiens
ttattttaaaaggata

SEQ ID NO: 160732 - DNA, 16 bp, H. sapiens
ttattttaaaatgcaa

SEQ ID NO: 160733 - DNA, 16 bp, H. sapiens
ttattttaaaatggaa

SEQ ID NO: 160734 - DNA, 16 bp, H. sapiens
ttattttaaacaaaca

SEQ ID NO: 160735 - DNA, 16 bp, H. sapiens
ttattttaaagatgaa

SEQ ID NO: 160736 - DNA, 16 bp, H. sapiens
ttattttaaagcaatt

SEQ ID NO: 160737 - DNA, 16 bp, H. sapiens
ttattttaaagcatat

SEQ ID NO: 160738 - DNA, 16 bp, H. sapiens
ttattttaaaggtaaa

SEQ ID NO: 160739 - DNA, 16 bp, H. sapiens
ttattttaaatgctat

SEQ ID NO: 160740 - DNA, 16 bp, H. sapiens
ttattttaaatgtgct

SEQ ID NO: 160741 - DNA, 16 bp, H. sapiens
ttattttaaatgttca

SEQ ID NO: 160742 - DNA, 16 bp, H. sapiens
ttattttaacctaaaa

SEQ ID NO: 160743 - DNA, 16 bp, H. sapiens
ttattttaagaaattg

SEQ ID NO: 160744 - DNA, 16 bp, H. sapiens
ttattttaagaataca

SEQ ID NO: 160745 - DNA, 16 bp, H. sapiens
ttattttaagctgcta

SEQ ID NO: 160746 - DNA, 16 bp, H. sapiens
ttattttaagtgaaaa

SEQ ID NO: 160747 - DNA, 16 bp, H. sapiens
ttattttaatttgcat

SEQ ID NO: 160748 - DNA, 16 bp, H. sapiens
ttattttacaaatgca

SEQ ID NO: 160749 - DNA, 16 bp, H. sapiens
ttattttacatagcat

SEQ ID NO: 160750 - DNA, 16 bp, H. sapiens
ttattttacatgtgga

SEQ ID NO: 160751 - DNA, 16 bp, H. sapiens
ttattttacattttag

SEQ ID NO: 160752 - DNA, 16 bp, H. sapiens
ttattttaccaaaaag

SEQ ID NO: 160753 - DNA, 16 bp, H. sapiens
ttattttagaaaacaa

SEQ ID NO: 160754 - DNA, 16 bp, H. sapiens
ttattttagaaacaag

SEQ ID NO: 160755 - DNA, 16 bp, H. sapiens
ttattttagagaaaac

SEQ ID NO: 160756 - DNA, 16 bp, H. sapiens
ttattttagattcaag

SEQ ID NO: 160757 - DNA, 16 bp, H. sapiens
ttattttatcacagtt

SEQ ID NO: 160758 - DNA, 16 bp, H. sapiens
ttattttatgaaaact

SEQ ID NO: 160759 - DNA, 16 bp, H. sapiens
ttattttatgaaatga

SEQ ID NO: 160760 - DNA, 16 bp, H. sapiens
ttattttatggaaaaa

SEQ ID NO: 160761 - DNA, 16 bp, H. sapiens
ttattttattgaaaca

SEQ ID NO: 160762 - DNA, 16 bp, H. sapiens
ttattttcaaaatatg

SEQ ID NO: 160763 - DNA, 16 bp, H. sapiens
ttattttcaacaaatg

SEQ ID NO: 160764 - DNA, 16 bp, H. sapiens
ttattttcaataaatg

SEQ ID NO: 160765 - DNA, 16 bp, H. sapiens
ttattttcagttaatt

SEQ ID NO: 160766 - DNA, 16 bp, H. sapiens
ttattttcataaagtt

SEQ ID NO: 160767 - DNA, 16 bp, H. sapiens
ttattttcatattgaa

SEQ ID NO: 160768 - DNA, 16 bp, H. sapiens
ttattttcatgtaaat

SEQ ID NO: 160769 - DNA, 16 bp, H. sapiens
ttattttcatgtatat

SEQ ID NO: 160770 - DNA, 16 bp, H. sapiens
ttattttcattaatga

SEQ ID NO: 160771 - DNA, 16 bp, H. sapiens
ttattttcattcagtt

SEQ ID NO: 160772 - DNA, 16 bp, H. sapiens
ttattttcattgtaat

SEQ ID NO: 160773 - DNA, 16 bp, H. sapiens
ttattttccaaatttc

SEQ ID NO: 160774 - DNA, 16 bp, H. sapiens
ttattttccattaaaa

SEQ ID NO: 160775 - DNA, 16 bp, H. sapiens
ttattttccctgaaaa

SEQ ID NO: 160776 - DNA, 16 bp, H. sapiens
ttattttcctaaaaaa

SEQ ID NO: 160777 - DNA, 16 bp, H. sapiens
ttattttccttaaatg

SEQ ID NO: 160778 - DNA, 16 bp, H. sapiens
ttattttctaaaacaa

SEQ ID NO: 160779 - DNA, 16 bp, H. sapiens
ttattttctaaagttt

SEQ ID NO: 160780 - DNA, 16 bp, H. sapiens
ttattttctcacagtc

SEQ ID NO: 160781 - DNA, 16 bp, H. sapiens
ttattttctcacagtt

SEQ ID NO: 160782 - DNA, 16 bp, H. sapiens
ttattttctctgaaaa

SEQ ID NO: 160783 - DNA, 16 bp, H. sapiens
ttattttctgaaaaat

SEQ ID NO: 160784 - DNA, 16 bp, H. sapiens
ttattttctgaaatgt

SEQ ID NO: 160785 - DNA, 16 bp, H. sapiens
ttattttctgaatttg

SEQ ID NO: 160786 - DNA, 16 bp, H. sapiens
ttattttctgcatttc

SEQ ID NO: 160787 - DNA, 16 bp, H. sapiens
ttattttctgtgaaat

SEQ ID NO: 160788 - DNA, 16 bp, H. sapiens
ttattttcttcctaaa

SEQ ID NO: 160789 - DNA, 16 bp, H. sapiens
ttattttcttctgctg

SEQ ID NO: 160790 - DNA, 16 bp, H. sapiens
ttattttcttgaaatt

SEQ ID NO: 160791 - DNA, 16 bp, H. sapiens
ttattttctttctcag

SEQ ID NO: 160792 - DNA, 16 bp, H. sapiens
ttattttctttgaaag

SEQ ID NO: 160793 - DNA, 16 bp, H. sapiens
ttattttctttgaaat

SEQ ID NO: 160794 - DNA, 16 bp, H. sapiens
ttattttgaaaaacaa

SEQ ID NO: 160795 - DNA, 16 bp, H. sapiens
ttattttgaaaaattc

SEQ ID NO: 160796 - DNA, 16 bp, H. sapiens
ttattttgaaacattt

SEQ ID NO: 160797 - DNA, 16 bp, H. sapiens
ttattttgaagaaaaa

SEQ ID NO: 160798 - DNA, 16 bp, H. sapiens
ttattttgaagaaaat

SEQ ID NO: 160799 - DNA, 16 bp, H. sapiens
ttattttgaagagaaa

SEQ ID NO: 160800 - DNA, 16 bp, H. sapiens
ttattttgaagcaaat

SEQ ID NO: 160801 - DNA, 16 bp, H. sapiens
ttattttgagacaagg

SEQ ID NO: 160802 - DNA, 16 bp, H. sapiens
ttattttgcagatgaa

SEQ ID NO: 160803 - DNA, 16 bp, H. sapiens
ttattttgccaaggtt

SEQ ID NO: 160804 - DNA, 16 bp, H. sapiens
ttattttgccttaatt

SEQ ID NO: 160805 - DNA, 16 bp, H. sapiens
ttattttgctgcattt

SEQ ID NO: 160806 - DNA, 16 bp, H. sapiens
ttattttgcttaatgt

SEQ ID NO: 160807 - DNA, 16 bp, H. sapiens
ttattttgctttgtaa

SEQ ID NO: 160808 - DNA, 16 bp, H. sapiens
ttattttggaaaaaat

SEQ ID NO: 160809 - DNA, 16 bp, H. sapiens
ttattttggaaaaaca

SEQ ID NO: 160810 - DNA, 16 bp, H. sapiens
ttattttggaaagaaa

SEQ ID NO: 160811 - DNA, 16 bp, H. sapiens
ttattttggaaatata

SEQ ID NO: 160812 - DNA, 16 bp, H. sapiens
ttattttggagatgag

SEQ ID NO: 160813 - DNA, 16 bp, H. sapiens
ttattttgggttcagg

SEQ ID NO: 160814 - DNA, 16 bp, H. sapiens
ttattttggtgcaaaa

SEQ ID NO: 160815 - DNA, 16 bp, H. sapiens
ttattttgtaaaaatg

SEQ ID NO: 160816 - DNA, 16 bp, H. sapiens
ttattttgtaaaagaa

SEQ ID NO: 160817 - DNA, 16 bp, H. sapiens
ttattttgtattacat

SEQ ID NO: 160818 - DNA, 16 bp, H. sapiens
ttattttgtcacccaa

SEQ ID NO: 160819 - DNA, 16 bp, H. sapiens
ttattttgtcataaaa

SEQ ID NO: 160820 - DNA, 16 bp, H. sapiens
ttattttgtcatatat

SEQ ID NO: 160821 - DNA, 16 bp, H. sapiens
ttattttgtcatgctt

SEQ ID NO: 160822 - DNA, 16 bp, H. sapiens
ttattttgtgacctaa

SEQ ID NO: 160823 - DNA, 16 bp, H. sapiens
ttattttgttttgcag

SEQ ID NO: 160824 - DNA, 16 bp, H. sapiens
ttatttttaaaagtca

SEQ ID NO: 160825 - DNA, 16 bp, H. sapiens
ttatttttaaagagat

SEQ ID NO: 160826 - DNA, 16 bp, H. sapiens
ttatttttaaaggaaa

SEQ ID NO: 160827 - DNA, 16 bp, H. sapiens
ttatttttaatctgat

SEQ ID NO: 160828 - DNA, 16 bp, H. sapiens
ttatttttaatgcagt

SEQ ID NO: 160829 - DNA, 16 bp, H. sapiens
ttatttttaattactg

SEQ ID NO: 160830 - DNA, 16 bp, H. sapiens
ttatttttacctaaaa

SEQ ID NO: 160831 - DNA, 16 bp, H. sapiens
ttatttttagaaaatg

SEQ ID NO: 160832 - DNA, 16 bp, H. sapiens
ttatttttagaaatga

SEQ ID NO: 160833 - DNA, 16 bp, H. sapiens
ttatttttagtaaaga

SEQ ID NO: 160834 - DNA, 16 bp, H. sapiens
ttatttttagtagaga

SEQ ID NO: 160835 - DNA, 19 bp, H. sapiens
ttatttttagtagagatga

SEQ ID NO: 160836 - DNA, 16 bp, H. sapiens
ttatttttagttctgg

SEQ ID NO: 160837 - DNA, 16 bp, H. sapiens
ttatttttataaagct

SEQ ID NO: 160838 - DNA, 16 bp, H. sapiens
ttatttttataagcaa

SEQ ID NO: 160839 - DNA, 16 bp, H. sapiens
ttatttttatagcaaa

SEQ ID NO: 160840 - DNA, 16 bp, H. sapiens
ttatttttatatacag

SEQ ID NO: 160841 - DNA, 16 bp, H. sapiens
ttatttttatatgcat

SEQ ID NO: 160842 - DNA, 16 bp, H. sapiens
ttatttttatgacaat

SEQ ID NO: 160843 - DNA, 16 bp, H. sapiens
ttatttttatgccatt

SEQ ID NO: 160844 - DNA, 16 bp, H. sapiens
ttatttttatggctga

SEQ ID NO: 160845 - DNA, 16 bp, H. sapiens
ttatttttattaactg

SEQ ID NO: 160846 - DNA, 16 bp, H. sapiens
ttatttttattgacat

SEQ ID NO: 160847 - DNA, 16 bp, H. sapiens
ttatttttcaaaaaga

SEQ ID NO: 160848 - DNA, 16 bp, H. sapiens
ttatttttcaaaaatg

SEQ ID NO: 160849 - DNA, 16 bp, H. sapiens
ttatttttcaaagaaa

SEQ ID NO: 160850 - DNA, 16 bp, H. sapiens
ttatttttcaaagatg

SEQ ID NO: 160851 - DNA, 16 bp, H. sapiens
ttatttttcacaattc

SEQ ID NO: 160852 - DNA, 16 bp, H. sapiens
ttatttttcagatatt

SEQ ID NO: 160853 - DNA, 16 bp, H. sapiens
ttatttttcagatgga

SEQ ID NO: 160854 - DNA, 16 bp, H. sapiens
ttatttttcagattat

SEQ ID NO: 160855 - DNA, 16 bp, H. sapiens
ttatttttcaggtaaa

SEQ ID NO: 160856 - DNA, 16 bp, H. sapiens
ttatttttcatataga

SEQ ID NO: 160857 - DNA, 16 bp, H. sapiens
ttatttttcatgaaaa

SEQ ID NO: 160858 - DNA, 16 bp, H. sapiens
ttatttttcctgatct

SEQ ID NO: 160859 - DNA, 16 bp, H. sapiens
ttatttttccttaagt

SEQ ID NO: 160860 - DNA, 16 bp, H. sapiens
ttatttttctatgtaa

SEQ ID NO: 160861 - DNA, 16 bp, H. sapiens
ttatttttctctgtag

SEQ ID NO: 160862 - DNA, 16 bp, H. sapiens
ttatttttctgtaaaa

SEQ ID NO: 160863 - DNA, 16 bp, H. sapiens
ttatttttctgtaaat

SEQ ID NO: 160864 - DNA, 16 bp, H. sapiens
ttatttttctgtgaat

SEQ ID NO: 160865 - DNA, 16 bp, H. sapiens
ttatttttctttcagc

SEQ ID NO: 160866 - DNA, 16 bp, H. sapiens
ttatttttgaaaatct

SEQ ID NO: 160867 - DNA, 16 bp, H. sapiens
ttatttttgaagctat

SEQ ID NO: 160868 - DNA, 16 bp, H. sapiens
ttatttttgaagtaaa

SEQ ID NO: 160869 - DNA, 16 bp, H. sapiens
ttatttttgagatggg

SEQ ID NO: 160870 - DNA, 16 bp, H. sapiens
ttatttttgagatgta

SEQ ID NO: 160871 - DNA, 16 bp, H. sapiens
ttatttttgagcattt

SEQ ID NO: 160872 - DNA, 16 bp, H. sapiens
ttatttttgatgaaaa

SEQ ID NO: 160873 - DNA, 16 bp, H. sapiens
ttatttttgcatttca

SEQ ID NO: 160874 - DNA, 16 bp, H. sapiens
ttatttttgccaattt

SEQ ID NO: 160875 - DNA, 16 bp, H. sapiens
ttatttttgctactta

SEQ ID NO: 160876 - DNA, 16 bp, H. sapiens
ttatttttgctcaaga

SEQ ID NO: 160877 - DNA, 16 bp, H. sapiens
ttatttttggtagaga

SEQ ID NO: 160878 - DNA, 16 bp, H. sapiens
ttatttttgtacagat

SEQ ID NO: 160879 - DNA, 16 bp, H. sapiens
ttatttttgtagagac

SEQ ID NO: 160880 - DNA, 16 bp, H. sapiens
ttatttttgtgagaca

SEQ ID NO: 160881 - DNA, 16 bp, H. sapiens
ttattttttaaaggaa

SEQ ID NO: 160882 - DNA, 16 bp, H. sapiens
ttattttttaaagtct

SEQ ID NO: 160883 - DNA, 16 bp, H. sapiens
ttattttttaagagaa

SEQ ID NO: 160884 - DNA, 16 bp, H. sapiens
ttattttttaagagac

SEQ ID NO: 160885 - DNA, 16 bp, H. sapiens
ttattttttagtacag

SEQ ID NO: 160886 - DNA, 16 bp, H. sapiens
ttattttttatagagg

SEQ ID NO: 160887 - DNA, 16 bp, H. sapiens
ttattttttcaaggaa

SEQ ID NO: 160888 - DNA, 16 bp, H. sapiens
ttattttttccacata

SEQ ID NO: 160889 - DNA, 16 bp, H. sapiens
ttattttttcctaaca

SEQ ID NO: 160890 - DNA, 16 bp, H. sapiens
ttattttttccttaag

SEQ ID NO: 160891 - DNA, 18 bp, H. sapiens
ttattttttgagacaagg

SEQ ID NO: 160892 - DNA, 19 bp, H. sapiens
ttattttttgtagagatgg

SEQ ID NO: 160893 - DNA, 16 bp, H. sapiens
ttatttttttaagaca

SEQ ID NO: 160894 - DNA, 16 bp, H. sapiens
ttatttttttcatgga

SEQ ID NO: 160895 - DNA, 16 bp, H. sapiens
ttatttttttcccaag

SEQ ID NO: 160896 - DNA, 16 bp, H. sapiens
ttatttttttgagaag

SEQ ID NO: 160897 - DNA, 16 bp, H. sapiens
ttcaaaaaaactgaaa

SEQ ID NO: 160898 - DNA, 16 bp, H. sapiens
ttcaaaaaaagacata

SEQ ID NO: 160899 - DNA, 16 bp, H. sapiens
ttcaaaaaaatcaatg

SEQ ID NO: 160900 - DNA, 16 bp, H. sapiens
ttcaaaaaaattgaaa

SEQ ID NO: 160901 - DNA, 16 bp, H. sapiens
ttcaaaaaacagaaat

SEQ ID NO: 160902 - DNA, 16 bp, H. sapiens
ttcaaaaaaccagaat

SEQ ID NO: 160903 - DNA, 16 bp, H. sapiens
ttcaaaaaagaaatta

SEQ ID NO: 160904 - DNA, 16 bp, H. sapiens
ttcaaaaaataaatga

SEQ ID NO: 160905 - DNA, 16 bp, H. sapiens
ttcaaaaaatgtttat

SEQ ID NO: 160906 - DNA, 16 bp, H. sapiens
ttcaaaaaatgttttt

SEQ ID NO: 160907 - DNA, 16 bp, H. sapiens
ttcaaaaacaggaaaa

SEQ ID NO: 160908 - DNA, 16 bp, H. sapiens
ttcaaaaacattcttt

SEQ ID NO: 160909 - DNA, 16 bp, H. sapiens
ttcaaaaacatttttg

SEQ ID NO: 160910 - DNA, 16 bp, H. sapiens
ttcaaaaactattttt

SEQ ID NO: 160911 - DNA, 16 bp, H. sapiens
ttcaaaaagaggaaaa

SEQ ID NO: 160912 - DNA, 16 bp, H. sapiens
ttcaaaaagtaaataa

SEQ ID NO: 160913 - DNA, 16 bp, H. sapiens
ttcaaaaataaagaag

SEQ ID NO: 160914 - DNA, 16 bp, H. sapiens
ttcaaaaataaggaaa

SEQ ID NO: 160915 - DNA, 16 bp, H. sapiens
ttcaaaaatatattca

SEQ ID NO: 160916 - DNA, 16 bp, H. sapiens
ttcaaaaatatttact

SEQ ID NO: 160917 - DNA, 16 bp, H. sapiens
ttcaaaaatgaaagca

SEQ ID NO: 160918 - DNA, 16 bp, H. sapiens
ttcaaaaatgaaatat

SEQ ID NO: 160919 - DNA, 16 bp, H. sapiens
ttcaaaaatgaagaca

SEQ ID NO: 160920 - DNA, 16 bp, H. sapiens
ttcaaaaatgaatata

SEQ ID NO: 160921 - DNA, 16 bp, H. sapiens
ttcaaaaatgttttat

SEQ ID NO: 160922 - DNA, 16 bp, H. sapiens
ttcaaaaatgttttca

SEQ ID NO: 160923 - DNA, 16 bp, H. sapiens
ttcaaaaattagtttt

SEQ ID NO: 160924 - DNA, 16 bp, H. sapiens
ttcaaaaattatgttt

SEQ ID NO: 160925 - DNA, 16 bp, H. sapiens
ttcaaaacaaggaaaa

SEQ ID NO: 160926 - DNA, 16 bp, H. sapiens
ttcaaaacaatccttt

SEQ ID NO: 160927 - DNA, 16 bp, H. sapiens
ttcaaaacaattttat

SEQ ID NO: 160928 - DNA, 16 bp, H. sapiens
ttcaaaacaccaagaa

SEQ ID NO: 160929 - DNA, 16 bp, H. sapiens
ttcaaaaccaagcaaa

SEQ ID NO: 160930 - DNA, 16 bp, H. sapiens
ttcaaaaccaccctgg

SEQ ID NO: 160931 - DNA, 16 bp, H. sapiens
ttcaaaaccagcaaca

SEQ ID NO: 160932 - DNA, 16 bp, H. sapiens
ttcaaaaccagcaatg

SEQ ID NO: 160933 - DNA, 16 bp, H. sapiens
ttcaaaactgacattt

SEQ ID NO: 160934 - DNA, 16 bp, H. sapiens
ttcaaaacttactaaa

SEQ ID NO: 160935 - DNA, 16 bp, H. sapiens
ttcaaaacttactgca

SEQ ID NO: 160936 - DNA, 16 bp, H. sapiens
ttcaaaacttactgta

SEQ ID NO: 160937 - DNA, 16 bp, H. sapiens
ttcaaaactttctaca

SEQ ID NO: 160938 - DNA, 16 bp, H. sapiens
ttcaaaagaaaacata

SEQ ID NO: 160939 - DNA, 16 bp, H. sapiens
ttcaaaagaaaatatt

SEQ ID NO: 160940 - DNA, 16 bp, H. sapiens
ttcaaaagaattattt

SEQ ID NO: 160941 - DNA, 16 bp, H. sapiens
ttcaaaagatcaatga

SEQ ID NO: 160942 - DNA, 16 bp, H. sapiens
ttcaaaagcaaaatta

SEQ ID NO: 160943 - DNA, 16 bp, H. sapiens
ttcaaaagcaattcaa

SEQ ID NO: 160944 - DNA, 16 bp, H. sapiens
ttcaaaaggaaaagaa

SEQ ID NO: 160945 - DNA, 16 bp, H. sapiens
ttcaaaaggaaggaaa

SEQ ID NO: 160946 - DNA, 16 bp, H. sapiens
ttcaaaaggagaaaaa

SEQ ID NO: 160947 - DNA, 16 bp, H. sapiens
ttcaaaagtcagaaat

SEQ ID NO: 160948 - DNA, 16 bp, H. sapiens
ttcaaaagtgagggag

SEQ ID NO: 160949 - DNA, 17 bp, H. sapiens
ttcaaaagttgaacgaa

SEQ ID NO: 160950 - DNA, 16 bp, H. sapiens
ttcaaaagttttcaaa

SEQ ID NO: 160951 - DNA, 16 bp, H. sapiens
ttcaaaataaaaagta

SEQ ID NO: 160952 - DNA, 16 bp, H. sapiens
ttcaaaataaaaagtt

SEQ ID NO: 160953 - DNA, 16 bp, H. sapiens
ttcaaaataaaaatgt

SEQ ID NO: 160954 - DNA, 16 bp, H. sapiens
ttcaaaataaaagtaa

SEQ ID NO: 160955 - DNA, 16 bp, H. sapiens
ttcaaaataaaagttt

SEQ ID NO: 160956 - DNA, 16 bp, H. sapiens
ttcaaaataactgttt

SEQ ID NO: 160957 - DNA, 16 bp, H. sapiens
ttcaaaataatgtttt

SEQ ID NO: 160958 - DNA, 16 bp, H. sapiens
ttcaaaatactactgc

SEQ ID NO: 160959 - DNA, 16 bp, H. sapiens
ttcaaaatactgatct

SEQ ID NO: 160960 - DNA, 16 bp, H. sapiens
ttcaaaatagaaatta

SEQ ID NO: 160961 - DNA, 16 bp, H. sapiens
ttcaaaatatagttaa

SEQ ID NO: 160962 - DNA, 16 bp, H. sapiens
ttcaaaatatgttttt

SEQ ID NO: 160963 - DNA, 16 bp, H. sapiens
ttcaaaatattatttc

SEQ ID NO: 160964 - DNA, 16 bp, H. sapiens
ttcaaaatattgattt

SEQ ID NO: 160965 - DNA, 16 bp, H. sapiens
ttcaaaatatttccaa

SEQ ID NO: 160966 - DNA, 16 bp, H. sapiens
ttcaaaatatttctta

SEQ ID NO: 160967 - DNA, 16 bp, H. sapiens
ttcaaaatattttcat

SEQ ID NO: 160968 - DNA, 16 bp, H. sapiens
ttcaaaatcaatcatg

SEQ ID NO: 160969 - DNA, 16 bp, H. sapiens
ttcaaaatcattttgg

SEQ ID NO: 160970 - DNA, 16 bp, H. sapiens
ttcaaaatccagcagg

SEQ ID NO: 160971 - DNA, 16 bp, H. sapiens
ttcaaaatctgaaact

SEQ ID NO: 160972 - DNA, 16 bp, H. sapiens
ttcaaaatgaaaatag

SEQ ID NO: 160973 - DNA, 16 bp, H. sapiens
ttcaaaatgaaataat

SEQ ID NO: 160974 - DNA, 16 bp, H. sapiens
ttcaaaatgaaattat

SEQ ID NO: 160975 - DNA, 16 bp, H. sapiens
ttcaaaatgagagaaa

SEQ ID NO: 160976 - DNA, 16 bp, H. sapiens
ttcaaaatgcagattc

SEQ ID NO: 160977 - DNA, 16 bp, H. sapiens
ttcaaaatggaaaaat

SEQ ID NO: 160978 - DNA, 16 bp, H. sapiens
ttcaaaatgtatgttt

SEQ ID NO: 160979 - DNA, 16 bp, H. sapiens
ttcaaaatgtattaat

SEQ ID NO: 160980 - DNA, 16 bp, H. sapiens
ttcaaaatgtgtgtgt

SEQ ID NO: 160981 - DNA, 16 bp, H. sapiens
ttcaaaatgtttattt

SEQ ID NO: 160982 - DNA, 16 bp, H. sapiens
ttcaaaatgttttctt

SEQ ID NO: 160983 - DNA, 16 bp, H. sapiens
ttcaaaattaaagaaa

SEQ ID NO: 160984 - DNA, 16 bp, H. sapiens
ttcaaaattaaagtca

SEQ ID NO: 160985 - DNA, 16 bp, H. sapiens
ttcaaaattaatgaaa

SEQ ID NO: 160986 - DNA, 16 bp, H. sapiens
ttcaaaattacctttt

SEQ ID NO: 160987 - DNA, 30 bp, H. sapiens
ttcaaaattgaccacatagttggaagtaaa

SEQ ID NO: 160988 - DNA, 16 bp, H. sapiens
ttcaaaattgatgaaa

SEQ ID NO: 160989 - DNA, 16 bp, H. sapiens
ttcaaaattgctaaaa

SEQ ID NO: 160990 - DNA, 16 bp, H. sapiens
ttcaaaattgttttaa

SEQ ID NO: 160991 - DNA, 16 bp, H. sapiens
ttcaaaatttaaagaa

SEQ ID NO: 160992 - DNA, 16 bp, H. sapiens
ttcaaaatttcaattt

SEQ ID NO: 160993 - DNA, 16 bp, H. sapiens
ttcaaaatttgaagta

SEQ ID NO: 160994 - DNA, 16 bp, H. sapiens
ttcaaaattttgtaaa

SEQ ID NO: 160995 - DNA, 16 bp, H. sapiens
ttcaaacaattctctg

SEQ ID NO: 160996 - DNA, 16 bp, H. sapiens
ttcaaacacacaaaga

SEQ ID NO: 160997 - DNA, 16 bp, H. sapiens
ttcaaacacagaaaaa

SEQ ID NO: 160998 - DNA, 16 bp, H. sapiens
ttcaaacaggaaaaga

SEQ ID NO: 160999 - DNA, 16 bp, H. sapiens
ttcaaacatacagaaa

SEQ ID NO: 161000 - DNA, 16 bp, H. sapiens
ttcaaaccagagtgac

SEQ ID NO: 161001 - DNA, 16 bp, H. sapiens
ttcaaacccaggcaat

SEQ ID NO: 161002 - DNA, 16 bp, H. sapiens
ttcaaacctgtgttgt

SEQ ID NO: 161003 - DNA, 16 bp, H. sapiens
ttcaaaccttgcaaat

SEQ ID NO: 161004 - DNA, 16 bp, H. sapiens
ttcaaactatactaaa

SEQ ID NO: 161005 - DNA, 28 bp, H. sapiens
ttcaaactatactacaaggctacaggaa

SEQ ID NO: 161006 - DNA, 16 bp, H. sapiens
ttcaaactcctgacct

SEQ ID NO: 161007 - DNA, 16 bp, H. sapiens
ttcaaactggtgtgag

SEQ ID NO: 161008 - DNA, 16 bp, H. sapiens
ttcaaactgttacaaa

SEQ ID NO: 161009 - DNA, 16 bp, H. sapiens
ttcaaacttattttct

SEQ ID NO: 161010 - DNA, 16 bp, H. sapiens
ttcaaagaaaaaatac

SEQ ID NO: 161011 - DNA, 16 bp, H. sapiens
ttcaaagaaaaatgtt

SEQ ID NO: 161012 - DNA, 16 bp, H. sapiens
ttcaaagaaaacagaa

SEQ ID NO: 161013 - DNA, 16 bp, H. sapiens
ttcaaagaacaggctg

SEQ ID NO: 161014 - DNA, 16 bp, H. sapiens
ttcaaagaacatattt

SEQ ID NO: 161015 - DNA, 16 bp, H. sapiens
ttcaaagaacttcttt

SEQ ID NO: 161016 - DNA, 16 bp, H. sapiens
ttcaaagaagaattaa

SEQ ID NO: 161017 - DNA, 16 bp, H. sapiens
ttcaaagaattctcct

SEQ ID NO: 161018 - DNA, 16 bp, H. sapiens
ttcaaagaggaaaaaa

SEQ ID NO: 161019 - DNA, 16 bp, H. sapiens
ttcaaagaggataaaa

SEQ ID NO: 161020 - DNA, 16 bp, H. sapiens
ttcaaagaggttaaat

SEQ ID NO: 161021 - DNA, 16 bp, H. sapiens
ttcaaagatacaaata

SEQ ID NO: 161022 - DNA, 16 bp, H. sapiens
ttcaaagattaaatga

SEQ ID NO: 161023 - DNA, 16 bp, H. sapiens
ttcaaagattattttt

SEQ ID NO: 161024 - DNA, 16 bp, H. sapiens
ttcaaagcaaaaataa

SEQ ID NO: 161025 - DNA, 16 bp, H. sapiens
ttcaaagcaaacaaaa

SEQ ID NO: 161026 - DNA, 16 bp, H. sapiens
ttcaaagcagtgtgtg

SEQ ID NO: 161027 - DNA, 16 bp, H. sapiens
ttcaaagccaaattct

SEQ ID NO: 161028 - DNA, 16 bp, H. sapiens
ttcaaagctttctttt

SEQ ID NO: 161029 - DNA, 16 bp, H. sapiens
ttcaaaggaaaaaaga

SEQ ID NO: 161030 - DNA, 16 bp, H. sapiens
ttcaaaggaaaacaaa

SEQ ID NO: 161031 - DNA, 16 bp, H. sapiens
ttcaaaggaaaaggaa

SEQ ID NO: 161032 - DNA, 16 bp, H. sapiens
ttcaaaggaatatttt

SEQ ID NO: 161033 - DNA, 16 bp, H. sapiens
ttcaaaggacatgaac

SEQ ID NO: 161034 - DNA, 16 bp, H. sapiens
ttcaaaggagaaaaaa

SEQ ID NO: 161035 - DNA, 16 bp, H. sapiens
ttcaaagggaaaaaaa

SEQ ID NO: 161036 - DNA, 16 bp, H. sapiens
ttcaaagtaaaagaaa

SEQ ID NO: 161037 - DNA, 16 bp, H. sapiens
ttcaaagttgcagtga

SEQ ID NO: 161038 - DNA, 16 bp, H. sapiens
ttcaaagtttaaaata

SEQ ID NO: 161039 - DNA, 16 bp, H. sapiens
ttcaaagttttatttt

SEQ ID NO: 161040 - DNA, 16 bp, H. sapiens
ttcaaagtttttaatt

SEQ ID NO: 161041 - DNA, 16 bp, H. sapiens
ttcaaataaaaaatga

SEQ ID NO: 161042 - DNA, 16 bp, H. sapiens
ttcaaataaatatttg

SEQ ID NO: 161043 - DNA, 16 bp, H. sapiens
ttcaaataaggaagag

SEQ ID NO: 161044 - DNA, 16 bp, H. sapiens
ttcaaataatagaaaa

SEQ ID NO: 161045 - DNA, 16 bp, H. sapiens
ttcaaatacatgaaaa

SEQ ID NO: 161046 - DNA, 16 bp, H. sapiens
ttcaaatacttcaaat

SEQ ID NO: 161047 - DNA, 16 bp, H. sapiens
ttcaaatactttttca

SEQ ID NO: 161048 - DNA, 16 bp, H. sapiens
ttcaaataggaaaaaa

SEQ ID NO: 161049 - DNA, 16 bp, H. sapiens
ttcaaatatacaaaga

SEQ ID NO: 161050 - DNA, 16 bp, H. sapiens
ttcaaatatacacaaa

SEQ ID NO: 161051 - DNA, 16 bp, H. sapiens
ttcaaatatttcaaaa

SEQ ID NO: 161052 - DNA, 16 bp, H. sapiens
ttcaaatatttgaaga

SEQ ID NO: 161053 - DNA, 16 bp, H. sapiens
ttcaaatatttggaga

SEQ ID NO: 161054 - DNA, 16 bp, H. sapiens
ttcaaatattttcctt

SEQ ID NO: 161055 - DNA, 16 bp, H. sapiens
ttcaaatccaggaaat

SEQ ID NO: 161056 - DNA, 16 bp, H. sapiens
ttcaaatcccagctct

SEQ ID NO: 161057 - DNA, 16 bp, H. sapiens
ttcaaatcctagctct

SEQ ID NO: 161058 - DNA, 16 bp, H. sapiens
ttcaaatcctgactcc

SEQ ID NO: 161059 - DNA, 16 bp, H. sapiens
ttcaaatcctggctct

SEQ ID NO: 161060 - DNA, 16 bp, H. sapiens
ttcaaatctcttatta

SEQ ID NO: 161061 - DNA, 16 bp, H. sapiens
ttcaaatgaaaagaaa

SEQ ID NO: 161062 - DNA, 16 bp, H. sapiens
ttcaaatgaaaatttt

SEQ ID NO: 161063 - DNA, 16 bp, H. sapiens
ttcaaatgaaaggaag

SEQ ID NO: 161064 - DNA, 16 bp, H. sapiens
ttcaaatgaaataaat

SEQ ID NO: 161065 - DNA, 16 bp, H. sapiens
ttcaaatgaagaaaaa

SEQ ID NO: 161066 - DNA, 16 bp, H. sapiens
ttcaaatgagtaaata

SEQ ID NO: 161067 - DNA, 17 bp, H. sapiens
ttcaaatgcctctgaca

SEQ ID NO: 161068 - DNA, 16 bp, H. sapiens
ttcaaatgtaaatttt

SEQ ID NO: 161069 - DNA, 16 bp, H. sapiens
ttcaaatgttaaaaaa

SEQ ID NO: 161070 - DNA, 16 bp, H. sapiens
ttcaaatgtttcttct

SEQ ID NO: 161071 - DNA, 16 bp, H. sapiens
ttcaaatgtttgtttt

SEQ ID NO: 161072 - DNA, 16 bp, H. sapiens
ttcaaattaaagaaaa

SEQ ID NO: 161073 - DNA, 16 bp, H. sapiens
ttcaaattatatgaca

SEQ ID NO: 161074 - DNA, 16 bp, H. sapiens
ttcaaattcaggaaaa

SEQ ID NO: 161075 - DNA, 16 bp, H. sapiens
ttcaaattccacctct

SEQ ID NO: 161076 - DNA, 16 bp, H. sapiens
ttcaaattctgatttt

SEQ ID NO: 161077 - DNA, 16 bp, H. sapiens
ttcaaattctgcctct

SEQ ID NO: 161078 - DNA, 16 bp, H. sapiens
ttcaaattctggagaa

SEQ ID NO: 161079 - DNA, 16 bp, H. sapiens
ttcaaattctggttct

SEQ ID NO: 161080 - DNA, 16 bp, H. sapiens
ttcaaattcttctttg

SEQ ID NO: 161081 - DNA, 16 bp, H. sapiens
ttcaaattgaagaact

SEQ ID NO: 161082 - DNA, 16 bp, H. sapiens
ttcaaattgttcttga

SEQ ID NO: 161083 - DNA, 16 bp, H. sapiens
ttcaaatttaactgag

SEQ ID NO: 161084 - DNA, 16 bp, H. sapiens
ttcaaatttccctgat

SEQ ID NO: 161085 - DNA, 16 bp, H. sapiens
ttcaaatttgatgaaa

SEQ ID NO: 161086 - DNA, 16 bp, H. sapiens
ttcaaattttagtgtc

SEQ ID NO: 161087 - DNA, 16 bp, H. sapiens
ttcaaattttatcatg

SEQ ID NO: 161088 - DNA, 16 bp, H. sapiens
ttcaaatttttagaaa

SEQ ID NO: 161089 - DNA, 16 bp, H. sapiens
ttcaaatttttttctg

SEQ ID NO: 161090 - DNA, 16 bp, H. sapiens
ttcaacaaaaagagct

SEQ ID NO: 161091 - DNA, 16 bp, H. sapiens
ttcaacaaaaatttac

SEQ ID NO: 161092 - DNA, 17 bp, H. sapiens
ttcaacaaaattcaaca

SEQ ID NO: 161093 - DNA, 16 bp, H. sapiens
ttcaacaaacactgat

SEQ ID NO: 161094 - DNA, 16 bp, H. sapiens
ttcaacaaacggtgct

SEQ ID NO: 161095 - DNA, 16 bp, H. sapiens
ttcaacaaactttttt

SEQ ID NO: 161096 - DNA, 16 bp, H. sapiens
ttcaacaaagaagata

SEQ ID NO: 161097 - DNA, 16 bp, H. sapiens
ttcaacaaagatttat

SEQ ID NO: 161098 - DNA, 16 bp, H. sapiens
ttcaacaaataatgct

SEQ ID NO: 161099 - DNA, 16 bp, H. sapiens
ttcaacaaatagtatt

SEQ ID NO: 161100 - DNA, 16 bp, H. sapiens
ttcaacaaatattgtt

SEQ ID NO: 161101 - DNA, 16 bp, H. sapiens
ttcaacaaatgatgtt

SEQ ID NO: 161102 - DNA, 16 bp, H. sapiens
ttcaacaaatggtgct

SEQ ID NO: 161103 - DNA, 16 bp, H. sapiens
ttcaacaaatgttatt

SEQ ID NO: 161104 - DNA, 16 bp, H. sapiens
ttcaacaaccagctct

SEQ ID NO: 161105 - DNA, 16 bp, H. sapiens
ttcaacaagaaaaata

SEQ ID NO: 161106 - DNA, 16 bp, H. sapiens
ttcaacaagtatttgt

SEQ ID NO: 161107 - DNA, 16 bp, H. sapiens
ttcaacaattatttct

SEQ ID NO: 161108 - DNA, 16 bp, H. sapiens
ttcaacacacacacac

SEQ ID NO: 161109 - DNA, 16 bp, H. sapiens
ttcaacagatacttat

SEQ ID NO: 161110 - DNA, 16 bp, H. sapiens
ttcaacagctttattg

SEQ ID NO: 161111 - DNA, 16 bp, H. sapiens
ttcaacaggtgaatga

SEQ ID NO: 161112 - DNA, 16 bp, H. sapiens
ttcaacagtgttttgt

SEQ ID NO: 161113 - DNA, 16 bp, H. sapiens
ttcaacataaaatttg

SEQ ID NO: 161114 - DNA, 16 bp, H. sapiens
ttcaacatacaaattt

SEQ ID NO: 161115 - DNA, 16 bp, H. sapiens
ttcaacatacacaaat

SEQ ID NO: 161116 - DNA, 16 bp, H. sapiens
ttcaacatatagattt

SEQ ID NO: 161117 - DNA, 16 bp, H. sapiens
ttcaacatatcatttt

SEQ ID NO: 161118 - DNA, 16 bp, H. sapiens
ttcaacatatgaattt

SEQ ID NO: 161119 - DNA, 16 bp, H. sapiens
ttcaacatgaatttta

SEQ ID NO: 161120 - DNA, 16 bp, H. sapiens
ttcaacatgagatttg

SEQ ID NO: 161121 - DNA, 16 bp, H. sapiens
ttcaacatgtaaattt

SEQ ID NO: 161122 - DNA, 16 bp, H. sapiens
ttcaacatgtaaccaa

SEQ ID NO: 161123 - DNA, 16 bp, H. sapiens
ttcaacatgtgaattt

SEQ ID NO: 161124 - DNA, 16 bp, H. sapiens
ttcaacattttaaaaa

SEQ ID NO: 161125 - DNA, 16 bp, H. sapiens
ttcaacattttaaaga

SEQ ID NO: 161126 - DNA, 16 bp, H. sapiens
ttcaaccaacagcaga

SEQ ID NO: 161127 - DNA, 16 bp, H. sapiens
ttcaaccaactgtgga

SEQ ID NO: 161128 - DNA, 16 bp, H. sapiens
ttcaaccacagactga

SEQ ID NO: 161129 - DNA, 16 bp, H. sapiens
ttcaaccactgtggaa

SEQ ID NO: 161130 - DNA, 16 bp, H. sapiens
ttcaaccattttggaa

SEQ ID NO: 161131 - DNA, 16 bp, H. sapiens
ttcaacccagaaatcc

SEQ ID NO: 161132 - DNA, 16 bp, H. sapiens
ttcaaccctcaccctc

SEQ ID NO: 161133 - DNA, 16 bp, H. sapiens
ttcaacctctacctcc

SEQ ID NO: 161134 - DNA, 16 bp, H. sapiens
ttcaacctctctgagc

SEQ ID NO: 161135 - DNA, 16 bp, H. sapiens
ttcaacctcttcctgg

SEQ ID NO: 161136 - DNA, 16 bp, H. sapiens
ttcaacgtatgaattt

SEQ ID NO: 161137 - DNA, 16 bp, H. sapiens
ttcaactatgtggtca

SEQ ID NO: 161138 - DNA, 22 bp, H. sapiens
ttcaactcagctctgcaccaag

SEQ ID NO: 161139 - DNA, 16 bp, H. sapiens
ttcaactcctggcttc

SEQ ID NO: 161140 - DNA, 16 bp, H. sapiens
ttcaactccttcctgg

SEQ ID NO: 161141 - DNA, 16 bp, H. sapiens
ttcaactctatgagtt

SEQ ID NO: 161142 - DNA, 16 bp, H. sapiens
ttcaactgggctctct

SEQ ID NO: 161143 - DNA, 16 bp, H. sapiens
ttcaacttctttgcct

SEQ ID NO: 161144 - DNA, 16 bp, H. sapiens
ttcaacttgataaaga

SEQ ID NO: 161145 - DNA, 16 bp, H. sapiens
ttcaactttggagaat

SEQ ID NO: 161146 - DNA, 16 bp, H. sapiens
ttcaacttttaaaaat

SEQ ID NO: 161147 - DNA, 16 bp, H. sapiens
ttcaacttttatgtta

SEQ ID NO: 161148 - DNA, 16 bp, H. sapiens
ttcaactttttaaaaa

SEQ ID NO: 161149 - DNA, 16 bp, H. sapiens
ttcaactttttattgt

SEQ ID NO: 161150 - DNA, 16 bp, H. sapiens
ttcaagaaaacacaga

SEQ ID NO: 161151 - DNA, 16 bp, H. sapiens
ttcaagaaaagaattt

SEQ ID NO: 161152 - DNA, 16 bp, H. sapiens
ttcaagaaaagtaaaa

SEQ ID NO: 161153 - DNA, 16 bp, H. sapiens
ttcaagaaaatgtctg

SEQ ID NO: 161154 - DNA, 16 bp, H. sapiens
ttcaagaaaatttaaa

SEQ ID NO: 161155 - DNA, 16 bp, H. sapiens
ttcaagaaagaaataa

SEQ ID NO: 161156 - DNA, 16 bp, H. sapiens
ttcaagaaatgcagag

SEQ ID NO: 161157 - DNA, 16 bp, H. sapiens
ttcaagaaatggtgtt

SEQ ID NO: 161158 - DNA, 16 bp, H. sapiens
ttcaagaaatgttttt

SEQ ID NO: 161159 - DNA, 16 bp, H. sapiens
ttcaagaacaacctgg

SEQ ID NO: 161160 - DNA, 16 bp, H. sapiens
ttcaagaacaggaaaa

SEQ ID NO: 161161 - DNA, 16 bp, H. sapiens
ttcaagaacaggcaaa

SEQ ID NO: 161162 - DNA, 16 bp, H. sapiens
ttcaagaacatcctgg

SEQ ID NO: 161163 - DNA, 16 bp, H. sapiens
ttcaagaagaaaaaca

SEQ ID NO: 161164 - DNA, 16 bp, H. sapiens
ttcaagaagaaaaata

SEQ ID NO: 161165 - DNA, 16 bp, H. sapiens
ttcaagaattaaaaaa

SEQ ID NO: 161166 - DNA, 16 bp, H. sapiens
ttcaagacaaaaacca

SEQ ID NO: 161167 - DNA, 16 bp, H. sapiens
ttcaagacaagatttg

SEQ ID NO: 161168 - DNA, 17 bp, H. sapiens
ttcaagacaagcctggg

SEQ ID NO: 161169 - DNA, 16 bp, H. sapiens
ttcaagacagtgacag

SEQ ID NO: 161170 - DNA, 16 bp, H. sapiens
ttcaagaccaccatgg

SEQ ID NO: 161171 - DNA, 16 bp, H. sapiens
ttcaagaccagccagc

SEQ ID NO: 161172 - DNA, 16 bp, H. sapiens
ttcaagaccagcctaa

SEQ ID NO: 161173 - DNA, 16 bp, H. sapiens
ttcaagaccagtgtgg

SEQ ID NO: 161174 - DNA, 16 bp, H. sapiens
ttcaagacccgcctgg

SEQ ID NO: 161175 - DNA, 16 bp, H. sapiens
ttcaagagactcactt

SEQ ID NO: 161176 - DNA, 16 bp, H. sapiens
ttcaagagcaacctgg

SEQ ID NO: 161177 - DNA, 16 bp, H. sapiens
ttcaagagcagcttgg

SEQ ID NO: 161178 - DNA, 16 bp, H. sapiens
ttcaagaggccaaaga

SEQ ID NO: 161179 - DNA, 16 bp, H. sapiens
ttcaagaggtgacaga

SEQ ID NO: 161180 - DNA, 16 bp, H. sapiens
ttcaagaggtgattag

SEQ ID NO: 161181 - DNA, 16 bp, H. sapiens
ttcaagatatattttt

SEQ ID NO: 161182 - DNA, 16 bp, H. sapiens
ttcaagatgagagttg

SEQ ID NO: 161183 - DNA, 16 bp, H. sapiens
ttcaagatgagatttg

SEQ ID NO: 161184 - DNA, 16 bp, H. sapiens
ttcaagatgagcctgg

SEQ ID NO: 161185 - DNA, 16 bp, H. sapiens
ttcaagatggcagcag

SEQ ID NO: 161186 - DNA, 16 bp, H. sapiens
ttcaagattttctttt

SEQ ID NO: 161187 - DNA, 16 bp, H. sapiens
ttcaagcaaatctcct

SEQ ID NO: 161188 - DNA, 16 bp, H. sapiens
ttcaagcaattctgcc

SEQ ID NO: 161189 - DNA, 16 bp, H. sapiens
ttcaagcagaaggaag

SEQ ID NO: 161190 - DNA, 16 bp, H. sapiens
ttcaagcagtcctcct

SEQ ID NO: 161191 - DNA, 16 bp, H. sapiens
ttcaagcatttattct

SEQ ID NO: 161192 - DNA, 18 bp, H. sapiens
ttcaagcgatcctcccac

SEQ ID NO: 161193 - DNA, 16 bp, H. sapiens
ttcaagcgattctgcc

SEQ ID NO: 161194 - DNA, 16 bp, H. sapiens
ttcaagctattttcct

SEQ ID NO: 161195 - DNA, 16 bp, H. sapiens
ttcaagctccacctcc

SEQ ID NO: 161196 - DNA, 16 bp, H. sapiens
ttcaagctctgctaag

SEQ ID NO: 161197 - DNA, 16 bp, H. sapiens
ttcaagctcttctcct

SEQ ID NO: 161198 - DNA, 16 bp, H. sapiens
ttcaagctgaaagaaa

SEQ ID NO: 161199 - DNA, 16 bp, H. sapiens
ttcaagcttctcctgc

SEQ ID NO: 161200 - DNA, 16 bp, H. sapiens
ttcaaggaaaacaact

SEQ ID NO: 161201 - DNA, 16 bp, H. sapiens
ttcaaggaaaacaatt

SEQ ID NO: 161202 - DNA, 16 bp, H. sapiens
ttcaaggaaaagaaaa

SEQ ID NO: 161203 - DNA, 16 bp, H. sapiens
ttcaaggaaaatgaaa

SEQ ID NO: 161204 - DNA, 16 bp, H. sapiens
ttcaaggaattggctt

SEQ ID NO: 161205 - DNA, 16 bp, H. sapiens
ttcaaggatgcagtga

SEQ ID NO: 161206 - DNA, 16 bp, H. sapiens
ttcaaggccagccagg

SEQ ID NO: 161207 - DNA, 16 bp, H. sapiens
ttcaaggccagcccag

SEQ ID NO: 161208 - DNA, 16 bp, H. sapiens
ttcaaggctgtggtga

SEQ ID NO: 161209 - DNA, 16 bp, H. sapiens
ttcaagggaaaaaaaa

SEQ ID NO: 161210 - DNA, 16 bp, H. sapiens
ttcaagggaaaggaag

SEQ ID NO: 161211 - DNA, 16 bp, H. sapiens
ttcaagggaagaggaa

SEQ ID NO: 161212 - DNA, 16 bp, H. sapiens
ttcaaggtggcagtga

SEQ ID NO: 161213 - DNA, 16 bp, H. sapiens
ttcaaggttcctccat

SEQ ID NO: 161214 - DNA, 16 bp, H. sapiens
ttcaaggttcttccat

SEQ ID NO: 161215 - DNA, 16 bp, H. sapiens
ttcaaggttgcagtga

SEQ ID NO: 161216 - DNA, 16 bp, H. sapiens
ttcaagtaaaaatgat

SEQ ID NO: 161217 - DNA, 16 bp, H. sapiens
ttcaagtaaaattaaa

SEQ ID NO: 161218 - DNA, 16 bp, H. sapiens
ttcaagtatttttaaa

SEQ ID NO: 161219 - DNA, 16 bp, H. sapiens
ttcaagtattttttct

SEQ ID NO: 161220 - DNA, 16 bp, H. sapiens
ttcaagtctctgctca

SEQ ID NO: 161221 - DNA, 16 bp, H. sapiens
ttcaagtctctgcttt

SEQ ID NO: 161222 - DNA, 16 bp, H. sapiens
ttcaagtcttattatt

SEQ ID NO: 161223 - DNA, 16 bp, H. sapiens
ttcaagtgaaagaaag

SEQ ID NO: 161224 - DNA, 16 bp, H. sapiens
ttcaagtgatccgccc

SEQ ID NO: 161225 - DNA, 16 bp, H. sapiens
ttcaagtgctggaaat

SEQ ID NO: 161226 - DNA, 16 bp, H. sapiens
ttcaagtgggaaaaca

SEQ ID NO: 161227 - DNA, 16 bp, H. sapiens
ttcaagtgtttcttct

SEQ ID NO: 161228 - DNA, 16 bp, H. sapiens
ttcaagttatctattt

SEQ ID NO: 161229 - DNA, 16 bp, H. sapiens
ttcaagttattcttct

SEQ ID NO: 161230 - DNA, 16 bp, H. sapiens
ttcaagttcacttatt

SEQ ID NO: 161231 - DNA, 16 bp, H. sapiens
ttcaagttcatttatt

SEQ ID NO: 161232 - DNA, 16 bp, H. sapiens
ttcaagttgaaacaaa

SEQ ID NO: 161233 - DNA, 16 bp, H. sapiens
ttcaagtttaaaaaat

SEQ ID NO: 161234 - DNA, 16 bp, H. sapiens
ttcaagtttgatcatg

SEQ ID NO: 161235 - DNA, 16 bp, H. sapiens
ttcaataaaagatttt

SEQ ID NO: 161236 - DNA, 16 bp, H. sapiens
ttcaataaaagttgct

SEQ ID NO: 161237 - DNA, 17 bp, H. sapiens
ttcaataaaattcaaca

SEQ ID NO: 161238 - DNA, 16 bp, H. sapiens
ttcaataaacatatgt

SEQ ID NO: 161239 - DNA, 16 bp, H. sapiens
ttcaataaagtctcag

SEQ ID NO: 161240 - DNA, 16 bp, H. sapiens
ttcaataaagttgatt

SEQ ID NO: 161241 - DNA, 16 bp, H. sapiens
ttcaataaatactgaa

SEQ ID NO: 161242 - DNA, 16 bp, H. sapiens
ttcaataaatacttgt

SEQ ID NO: 161243 - DNA, 16 bp, H. sapiens
ttcaataaatattgat

SEQ ID NO: 161244 - DNA, 16 bp, H. sapiens
ttcaataaatggtgct

SEQ ID NO: 161245 - DNA, 16 bp, H. sapiens
ttcaataaatgtttat

SEQ ID NO: 161246 - DNA, 16 bp, H. sapiens
ttcaataagtggtgct

SEQ ID NO: 161247 - DNA, 16 bp, H. sapiens
ttcaataagtggtgtt

SEQ ID NO: 161248 - DNA, 16 bp, H. sapiens
ttcaataataaataga

SEQ ID NO: 161249 - DNA, 16 bp, H. sapiens
ttcaatacagtattca

SEQ ID NO: 161250 - DNA, 16 bp, H. sapiens
ttcaatactttaaaat

SEQ ID NO: 161251 - DNA, 16 bp, H. sapiens
ttcaataggttttggg

SEQ ID NO: 161252 - DNA, 16 bp, H. sapiens
ttcaatattatattgg

SEQ ID NO: 161253 - DNA, 16 bp, H. sapiens
ttcaatatttcaaaat

SEQ ID NO: 161254 - DNA, 16 bp, H. sapiens
ttcaatattttctgtt

SEQ ID NO: 161255 - DNA, 16 bp, H. sapiens
ttcaatcaataaatat

SEQ ID NO: 161256 - DNA, 16 bp, H. sapiens
ttcaatcatttattca

SEQ ID NO: 161257 - DNA, 16 bp, H. sapiens
ttcaatgaagaaagga

SEQ ID NO: 161258 - DNA, 16 bp, H. sapiens
ttcaatgaagaatgga

SEQ ID NO: 161259 - DNA, 16 bp, H. sapiens
ttcaatgagaagagct

SEQ ID NO: 161260 - DNA, 16 bp, H. sapiens
ttcaatgagctgagat

SEQ ID NO: 161261 - DNA, 16 bp, H. sapiens
ttcaatgccatgccca

SEQ ID NO: 161262 - DNA, 16 bp, H. sapiens
ttcaatgctgcagtga

SEQ ID NO: 161263 - DNA, 16 bp, H. sapiens
ttcaatggaatattat

SEQ ID NO: 161264 - DNA, 16 bp, H. sapiens
ttcaatggcttcccat

SEQ ID NO: 161265 - DNA, 16 bp, H. sapiens
ttcaatggggaaagga

SEQ ID NO: 161266 - DNA, 16 bp, H. sapiens
ttcaatgtaaatggac

SEQ ID NO: 161267 - DNA, 16 bp, H. sapiens
ttcaatgtaatatttt

SEQ ID NO: 161268 - DNA, 16 bp, H. sapiens
ttcaatgtagataaaa

SEQ ID NO: 161269 - DNA, 16 bp, H. sapiens
ttcaatgtatcttttt

SEQ ID NO: 161270 - DNA, 16 bp, H. sapiens
ttcaatgtcatcccca

SEQ ID NO: 161271 - DNA, 16 bp, H. sapiens
ttcaatgtttacattt

SEQ ID NO: 161272 - DNA, 16 bp, H. sapiens
ttcaatgtttctttgt

SEQ ID NO: 161273 - DNA, 16 bp, H. sapiens
ttcaattaaaaggcag

SEQ ID NO: 161274 - DNA, 16 bp, H. sapiens
ttcaattaatgctgaa

SEQ ID NO: 161275 - DNA, 16 bp, H. sapiens
ttcaattatgtggtca

SEQ ID NO: 161276 - DNA, 16 bp, H. sapiens
ttcaattccatcccca

SEQ ID NO: 161277 - DNA, 16 bp, H. sapiens
ttcaattctagaattt

SEQ ID NO: 161278 - DNA, 16 bp, H. sapiens
ttcaattctatcagtt

SEQ ID NO: 161279 - DNA, 16 bp, H. sapiens
ttcaatttcaaaataa

SEQ ID NO: 161280 - DNA, 16 bp, H. sapiens
ttcaatttcattcatc

SEQ ID NO: 161281 - DNA, 16 bp, H. sapiens
ttcaatttgcattttc

SEQ ID NO: 161282 - DNA, 16 bp, H. sapiens
ttcaatttggaaaaaa

SEQ ID NO: 161283 - DNA, 16 bp, H. sapiens
ttcaatttgtaagaaa

SEQ ID NO: 161284 - DNA, 16 bp, H. sapiens
ttcaattttaaaaagt

SEQ ID NO: 161285 - DNA, 16 bp, H. sapiens
ttcaatttttttgaaa

SEQ ID NO: 161286 - DNA, 16 bp, H. sapiens
ttcacaaaaaggaaga

SEQ ID NO: 161287 - DNA, 16 bp, H. sapiens
ttcacaaaagaggaaa

SEQ ID NO: 161288 - DNA, 16 bp, H. sapiens
ttcacaaaatatttat

SEQ ID NO: 161289 - DNA, 16 bp, H. sapiens
ttcacaaaatatttta

SEQ ID NO: 161290 - DNA, 16 bp, H. sapiens
ttcacaaaatattttt

SEQ ID NO: 161291 - DNA, 16 bp, H. sapiens
ttcacaaaatgaaaat

SEQ ID NO: 161292 - DNA, 16 bp, H. sapiens
ttcacaaagcctaaaa

SEQ ID NO: 161293 - DNA, 16 bp, H. sapiens
ttcacaaagtggcagg

SEQ ID NO: 161294 - DNA, 16 bp, H. sapiens
ttcacaaataagaaaa

SEQ ID NO: 161295 - DNA, 16 bp, H. sapiens
ttcacaaatgctacaa

SEQ ID NO: 161296 - DNA, 16 bp, H. sapiens
ttcacaagaacagcat

SEQ ID NO: 161297 - DNA, 16 bp, H. sapiens
ttcacaagaagatcat

SEQ ID NO: 161298 - DNA, 16 bp, H. sapiens
ttcacaaggaggcagg

SEQ ID NO: 161299 - DNA, 16 bp, H. sapiens
ttcacaaggtcaggag

SEQ ID NO: 161300 - DNA, 16 bp, H. sapiens
ttcacaataaatattt

SEQ ID NO: 161301 - DNA, 16 bp, H. sapiens
ttcacaatagcaaaat

SEQ ID NO: 161302 - DNA, 16 bp, H. sapiens
ttcacaatagcaaaga

SEQ ID NO: 161303 - DNA, 18 bp, H. sapiens
ttcacaatagcaaagacc

SEQ ID NO: 161304 - DNA, 27 bp, H. sapiens
ttcacaatagcaaagacttggaaccaa

SEQ ID NO: 161305 - DNA, 16 bp, H. sapiens
ttcacaatattcattc

SEQ ID NO: 161306 - DNA, 16 bp, H. sapiens
ttcacaatattttaaa

SEQ ID NO: 161307 - DNA, 16 bp, H. sapiens
ttcacaatgtacagag

SEQ ID NO: 161308 - DNA, 17 bp, H. sapiens
ttcacaatgttgattct

SEQ ID NO: 161309 - DNA, 16 bp, H. sapiens
ttcacaattgcaaaac

SEQ ID NO: 161310 - DNA, 18 bp, H. sapiens
ttcacaattgccacaaaa

SEQ ID NO: 161311 - DNA, 16 bp, H. sapiens
ttcacaattgctacaa

SEQ ID NO: 161312 - DNA, 16 bp, H. sapiens
ttcacacacatacata

SEQ ID NO: 161313 - DNA, 16 bp, H. sapiens
ttcacacagaaacctg

SEQ ID NO: 161314 - DNA, 16 bp, H. sapiens
ttcacacatatataca

SEQ ID NO: 161315 - DNA, 16 bp, H. sapiens
ttcacaccattgtaaa

SEQ ID NO: 161316 - DNA, 16 bp, H. sapiens
ttcacacctgtagtcc

SEQ ID NO: 161317 - DNA, 16 bp, H. sapiens
ttcacaccttatttca

SEQ ID NO: 161318 - DNA, 16 bp, H. sapiens
ttcacagaaaaactaa

SEQ ID NO: 161319 - DNA, 16 bp, H. sapiens
ttcacagaaaaactgg

SEQ ID NO: 161320 - DNA, 16 bp, H. sapiens
ttcacagaaaataaaa

SEQ ID NO: 161321 - DNA, 16 bp, H. sapiens
ttcacagaaaatgttt

SEQ ID NO: 161322 - DNA, 16 bp, H. sapiens
ttcacagaaacagaaa

SEQ ID NO: 161323 - DNA, 16 bp, H. sapiens
ttcacagaaacttctt

SEQ ID NO: 161324 - DNA, 16 bp, H. sapiens
ttcacagaaatggaat

SEQ ID NO: 161325 - DNA, 17 bp, H. sapiens
ttcacagaactagaaaa

SEQ ID NO: 161326 - DNA, 16 bp, H. sapiens
ttcacagaagaagaaa

SEQ ID NO: 161327 - DNA, 16 bp, H. sapiens
ttcacagaagaggaaa

SEQ ID NO: 161328 - DNA, 22 bp, H. sapiens
ttcacagaagtaggcttcagaa

SEQ ID NO: 161329 - DNA, 16 bp, H. sapiens
ttcacagaattaaaaa

SEQ ID NO: 161330 - DNA, 17 bp, H. sapiens
ttcacagaattagaaaa

SEQ ID NO: 161331 - DNA, 16 bp, H. sapiens
ttcacagacaaggaaa

SEQ ID NO: 161332 - DNA, 16 bp, H. sapiens
ttcacagaggaagaaa

SEQ ID NO: 161333 - DNA, 16 bp, H. sapiens
ttcacagaggaagaga

SEQ ID NO: 161334 - DNA, 16 bp, H. sapiens
ttcacagaggaggaaa

SEQ ID NO: 161335 - DNA, 16 bp, H. sapiens
ttcacagatagcatct

SEQ ID NO: 161336 - DNA, 16 bp, H. sapiens
ttcacagatgaagaaa

SEQ ID NO: 161337 - DNA, 16 bp, H. sapiens
ttcacagatgagaaca

SEQ ID NO: 161338 - DNA, 16 bp, H. sapiens
ttcacagatgaggaaa

SEQ ID NO: 161339 - DNA, 16 bp, H. sapiens
ttcacagatggcttct

SEQ ID NO: 161340 - DNA, 16 bp, H. sapiens
ttcacagattttaaaa

SEQ ID NO: 161341 - DNA, 16 bp, H. sapiens
ttcacagcaaagaaaa

SEQ ID NO: 161342 - DNA, 16 bp, H. sapiens
ttcacagcaaagttga

SEQ ID NO: 161343 - DNA, 16 bp, H. sapiens
ttcacagcatttatca

SEQ ID NO: 161344 - DNA, 16 bp, H. sapiens
ttcacagccaatttct

SEQ ID NO: 161345 - DNA, 16 bp, H. sapiens
ttcacaggctagtgtt

SEQ ID NO: 161346 - DNA, 16 bp, H. sapiens
ttcacagggcagcaag

SEQ ID NO: 161347 - DNA, 16 bp, H. sapiens
ttcacaggtgtgatca

SEQ ID NO: 161348 - DNA, 16 bp, H. sapiens
ttcacaggttccagaa

SEQ ID NO: 161349 - DNA, 16 bp, H. sapiens
ttcacaggttccagga

SEQ ID NO: 161350 - DNA, 16 bp, H. sapiens
ttcacagtaacaaaga

SEQ ID NO: 161351 - DNA, 16 bp, H. sapiens
ttcacagtgcttttct

SEQ ID NO: 161352 - DNA, 16 bp, H. sapiens
ttcacagtgtgaatct

SEQ ID NO: 161353 - DNA, 16 bp, H. sapiens
ttcacatacattttct

SEQ ID NO: 161354 - DNA, 16 bp, H. sapiens
ttcacatatatattca

SEQ ID NO: 161355 - DNA, 16 bp, H. sapiens
ttcacatgagagctgg

SEQ ID NO: 161356 - DNA, 16 bp, H. sapiens
ttcacatggtctttct

SEQ ID NO: 161357 - DNA, 16 bp, H. sapiens
ttcacatgttttcact

SEQ ID NO: 161358 - DNA, 16 bp, H. sapiens
ttcacattcacacaca

SEQ ID NO: 161359 - DNA, 16 bp, H. sapiens
ttcacattgttgtgca

SEQ ID NO: 161360 - DNA, 16 bp, H. sapiens
ttcacatttaaataaa

SEQ ID NO: 161361 - DNA, 16 bp, H. sapiens
ttcacatttctctgat

SEQ ID NO: 161362 - DNA, 16 bp, H. sapiens
ttcacatttcttatct

SEQ ID NO: 161363 - DNA, 16 bp, H. sapiens
ttcacattttttaaaa

SEQ ID NO: 161364 - DNA, 16 bp, H. sapiens
ttcaccaaaaaagata

SEQ ID NO: 161365 - DNA, 16 bp, H. sapiens
ttcaccaaaagtaaaa

SEQ ID NO: 161366 - DNA, 16 bp, H. sapiens
ttcaccaaacttgaaa

SEQ ID NO: 161367 - DNA, 17 bp, H. sapiens
ttcaccacactggccag

SEQ ID NO: 161368 - DNA, 16 bp, H. sapiens
ttcaccacagtggtgg

SEQ ID NO: 161369 - DNA, 16 bp, H. sapiens
ttcaccacatcctcac

SEQ ID NO: 161370 - DNA, 16 bp, H. sapiens
ttcaccaccaccatca

SEQ ID NO: 161371 - DNA, 16 bp, H. sapiens
ttcaccaccagcctgg

SEQ ID NO: 161372 - DNA, 16 bp, H. sapiens
ttcaccaccttggcca

SEQ ID NO: 161373 - DNA, 16 bp, H. sapiens
ttcaccagaagctgag

SEQ ID NO: 161374 - DNA, 16 bp, H. sapiens
ttcaccaggagatcat

SEQ ID NO: 161375 - DNA, 16 bp, H. sapiens
ttcaccaggagtaaat

SEQ ID NO: 161376 - DNA, 16 bp, H. sapiens
ttcaccaggctggtct

SEQ ID NO: 161377 - DNA, 16 bp, H. sapiens
ttcaccagggatattg

SEQ ID NO: 161378 - DNA, 16 bp, H. sapiens
ttcaccagtaaagcca

SEQ ID NO: 161379 - DNA, 16 bp, H. sapiens
ttcaccagtgaagaca

SEQ ID NO: 161380 - DNA, 16 bp, H. sapiens
ttcaccatagcaaaga

SEQ ID NO: 161381 - DNA, 16 bp, H. sapiens
ttcaccataggctttt

SEQ ID NO: 161382 - DNA, 16 bp, H. sapiens
ttcaccatgctggccg

SEQ ID NO: 161383 - DNA, 16 bp, H. sapiens
ttcaccatggtgccca

SEQ ID NO: 161384 - DNA, 17 bp, H. sapiens
ttcaccatgttagctag

SEQ ID NO: 161385 - DNA, 16 bp, H. sapiens
ttcaccattgacctca

SEQ ID NO: 161386 - DNA, 16 bp, H. sapiens
ttcaccattttagcca

SEQ ID NO: 161387 - DNA, 16 bp, H. sapiens
ttcaccattttggcca

SEQ ID NO: 161388 - DNA, 16 bp, H. sapiens
ttcacccactttttgt

SEQ ID NO: 161389 - DNA, 16 bp, H. sapiens
ttcacccaggatggag

SEQ ID NO: 161390 - DNA, 16 bp, H. sapiens
ttcacccagtttcctc

SEQ ID NO: 161391 - DNA, 16 bp, H. sapiens
ttcacccattcattca

SEQ ID NO: 161392 - DNA, 16 bp, H. sapiens
ttcacccatttaaggt

SEQ ID NO: 161393 - DNA, 16 bp, H. sapiens
ttcaccccattctcct

SEQ ID NO: 161394 - DNA, 16 bp, H. sapiens
ttcacccctttctttg

SEQ ID NO: 161395 - DNA, 16 bp, H. sapiens
ttcaccctgctggcca

SEQ ID NO: 161396 - DNA, 16 bp, H. sapiens
ttcaccgtgctggcca

SEQ ID NO: 161397 - DNA, 16 bp, H. sapiens
ttcacctccttggtta

SEQ ID NO: 161398 - DNA, 16 bp, H. sapiens
ttcacctgacctctca

SEQ ID NO: 161399 - DNA, 20 bp, H. sapiens
ttcacctgaggtcaggagtt

SEQ ID NO: 161400 - DNA, 16 bp, H. sapiens
ttcacctgcctcggct

SEQ ID NO: 161401 - DNA, 16 bp, H. sapiens
ttcacctgcttggacc

SEQ ID NO: 161402 - DNA, 16 bp, H. sapiens
ttcacctgtttccttt

SEQ ID NO: 161403 - DNA, 16 bp, H. sapiens
ttcaccttccacaatg

SEQ ID NO: 161404 - DNA, 17 bp, H. sapiens
ttcaccttccaccatga

SEQ ID NO: 161405 - DNA, 16 bp, H. sapiens
ttcaccttctaccatg

SEQ ID NO: 161406 - DNA, 17 bp, H. sapiens
ttcaccttctgccatga

SEQ ID NO: 161407 - DNA, 16 bp, H. sapiens
ttcaccttcttggcca

SEQ ID NO: 161408 - DNA, 16 bp, H. sapiens
ttcaccttgctcaccc

SEQ ID NO: 161409 - DNA, 16 bp, H. sapiens
ttcaccttgtgactgt

SEQ ID NO: 161410 - DNA, 16 bp, H. sapiens
ttcacctttggcctca

SEQ ID NO: 161411 - DNA, 16 bp, H. sapiens
ttcaccttttgccatg

SEQ ID NO: 161412 - DNA, 16 bp, H. sapiens
ttcacctttttaaaaa

SEQ ID NO: 161413 - DNA, 16 bp, H. sapiens
ttcacgaggtcaggag

SEQ ID NO: 161414 - DNA, 16 bp, H. sapiens
ttcactaattttctct

SEQ ID NO: 161415 - DNA, 16 bp, H. sapiens
ttcactatcatgagaa

SEQ ID NO: 161416 - DNA, 16 bp, H. sapiens
ttcactatgtacagag

SEQ ID NO: 161417 - DNA, 16 bp, H. sapiens
ttcactcaccacttcc

SEQ ID NO: 161418 - DNA, 16 bp, H. sapiens
ttcactcactgctcac

SEQ ID NO: 161419 - DNA, 16 bp, H. sapiens
ttcactcatcatttgg

SEQ ID NO: 161420 - DNA, 16 bp, H. sapiens
ttcactcattcagctg

SEQ ID NO: 161421 - DNA, 16 bp, H. sapiens
ttcactccagcctggg

SEQ ID NO: 161422 - DNA, 16 bp, H. sapiens
ttcactcttattgtcc

SEQ ID NO: 161423 - DNA, 16 bp, H. sapiens
ttcactcttgctgccc

SEQ ID NO: 161424 - DNA, 16 bp, H. sapiens
ttcactctttttgccc

SEQ ID NO: 161425 - DNA, 16 bp, H. sapiens
ttcactgaaacctccg

SEQ ID NO: 161426 - DNA, 16 bp, H. sapiens
ttcactgaagaaaaat

SEQ ID NO: 161427 - DNA, 16 bp, H. sapiens
ttcactgaagaggaaa

SEQ ID NO: 161428 - DNA, 16 bp, H. sapiens
ttcactgaagccttga

SEQ ID NO: 161429 - DNA, 16 bp, H. sapiens
ttcactgacttttttt

SEQ ID NO: 161430 - DNA, 16 bp, H. sapiens
ttcactgagcacttac

SEQ ID NO: 161431 - DNA, 16 bp, H. sapiens
ttcactgagtttcttg

SEQ ID NO: 161432 - DNA, 16 bp, H. sapiens
ttcactgatatatccc

SEQ ID NO: 161433 - DNA, 16 bp, H. sapiens
ttcactgatattttct

SEQ ID NO: 161434 - DNA, 16 bp, H. sapiens
ttcactgatgaagaaa

SEQ ID NO: 161435 - DNA, 16 bp, H. sapiens
ttcactgatttctgtt

SEQ ID NO: 161436 - DNA, 16 bp, H. sapiens
ttcactgatttttaaa

SEQ ID NO: 161437 - DNA, 16 bp, H. sapiens
ttcactgcagcctcaa

SEQ ID NO: 161438 - DNA, 16 bp, H. sapiens
ttcactgcagcctcca

SEQ ID NO: 161439 - DNA, 16 bp, H. sapiens
ttcactgcagcctggg

SEQ ID NO: 161440 - DNA, 16 bp, H. sapiens
ttcactgccacctctg

SEQ ID NO: 161441 - DNA, 16 bp, H. sapiens
ttcactgccctgaaaa

SEQ ID NO: 161442 - DNA, 17 bp, H. sapiens
ttcactgggcactcatt

SEQ ID NO: 161443 - DNA, 16 bp, H. sapiens
ttcactggggaaagaa

SEQ ID NO: 161444 - DNA, 16 bp, H. sapiens
ttcactgtaaaaaaaa

SEQ ID NO: 161445 - DNA, 16 bp, H. sapiens
ttcactgtattttctt

SEQ ID NO: 161446 - DNA, 16 bp, H. sapiens
ttcactgtcacccact

SEQ ID NO: 161447 - DNA, 16 bp, H. sapiens
ttcactgtcatcattt

SEQ ID NO: 161448 - DNA, 16 bp, H. sapiens
ttcactgtcatctttt

SEQ ID NO: 161449 - DNA, 16 bp, H. sapiens
ttcactgtctcctgtg

SEQ ID NO: 161450 - DNA, 16 bp, H. sapiens
ttcactgtcttatatg

SEQ ID NO: 161451 - DNA, 16 bp, H. sapiens
ttcactgtgttgccag

SEQ ID NO: 161452 - DNA, 16 bp, H. sapiens
ttcactgtgttgctca

SEQ ID NO: 161453 - DNA, 16 bp, H. sapiens
ttcactgttaaattct

SEQ ID NO: 161454 - DNA, 16 bp, H. sapiens
ttcacttaaatgaaca

SEQ ID NO: 161455 - DNA, 16 bp, H. sapiens
ttcacttagaataata

SEQ ID NO: 161456 - DNA, 16 bp, H. sapiens
ttcacttatatgaaat

SEQ ID NO: 161457 - DNA, 16 bp, H. sapiens
ttcacttatgatgctt

SEQ ID NO: 161458 - DNA, 16 bp, H. sapiens
ttcacttattctttca

SEQ ID NO: 161459 - DNA, 16 bp, H. sapiens
ttcacttatttattca

SEQ ID NO: 161460 - DNA, 16 bp, H. sapiens
ttcacttcccaccatg

SEQ ID NO: 161461 - DNA, 16 bp, H. sapiens
ttcacttcccaggctc

SEQ ID NO: 161462 - DNA, 16 bp, H. sapiens
ttcacttcctctccca

SEQ ID NO: 161463 - DNA, 16 bp, H. sapiens
ttcacttctctggtta

SEQ ID NO: 161464 - DNA, 16 bp, H. sapiens
ttcacttctttttaaa

SEQ ID NO: 161465 - DNA, 16 bp, H. sapiens
ttcacttggctctcat

SEQ ID NO: 161466 - DNA, 16 bp, H. sapiens
ttcacttggttctcat

SEQ ID NO: 161467 - DNA, 16 bp, H. sapiens
ttcactttaaaaataa

SEQ ID NO: 161468 - DNA, 16 bp, H. sapiens
ttcactttaaatataa

SEQ ID NO: 161469 - DNA, 16 bp, H. sapiens
ttcactttacagataa

SEQ ID NO: 161470 - DNA, 16 bp, H. sapiens
ttcactttcatttttg

SEQ ID NO: 161471 - DNA, 16 bp, H. sapiens
ttcactttgatcactt

SEQ ID NO: 161472 - DNA, 16 bp, H. sapiens
ttcactttgcagatga

SEQ ID NO: 161473 - DNA, 16 bp, H. sapiens
ttcactttgtgggtaa

SEQ ID NO: 161474 - DNA, 16 bp, H. sapiens
ttcactttgtgtgtgt

SEQ ID NO: 161475 - DNA, 16 bp, H. sapiens
ttcactttgttgccca

SEQ ID NO: 161476 - DNA, 16 bp, H. sapiens
ttcacttttaccctga

SEQ ID NO: 161477 - DNA, 16 bp, H. sapiens
ttcacttttgttgaaa

SEQ ID NO: 161478 - DNA, 16 bp, H. sapiens
ttcacttttttaaaaa

SEQ ID NO: 161479 - DNA, 16 bp, H. sapiens
ttcagaaaaaaaattt

SEQ ID NO: 161480 - DNA, 16 bp, H. sapiens
ttcagaaaaaaagtga

SEQ ID NO: 161481 - DNA, 16 bp, H. sapiens
ttcagaaaaaaattaa

SEQ ID NO: 161482 - DNA, 16 bp, H. sapiens
ttcagaaaaaatgaaa

SEQ ID NO: 161483 - DNA, 16 bp, H. sapiens
ttcagaaaaagcaaaa

SEQ ID NO: 161484 - DNA, 16 bp, H. sapiens
ttcagaaaaagcaaat

SEQ ID NO: 161485 - DNA, 16 bp, H. sapiens
ttcagaaaaataaaac

SEQ ID NO: 161486 - DNA, 16 bp, H. sapiens
ttcagaaaaatcagat

SEQ ID NO: 161487 - DNA, 16 bp, H. sapiens
ttcagaaaaattaact

SEQ ID NO: 161488 - DNA, 16 bp, H. sapiens
ttcagaaaacaaagaa

SEQ ID NO: 161489 - DNA, 16 bp, H. sapiens
ttcagaaaacagaaga

SEQ ID NO: 161490 - DNA, 16 bp, H. sapiens
ttcagaaaacattttt

SEQ ID NO: 161491 - DNA, 16 bp, H. sapiens
ttcagaaaactgaaac

SEQ ID NO: 161492 - DNA, 16 bp, H. sapiens
ttcagaaaagcatttt

SEQ ID NO: 161493 - DNA, 16 bp, H. sapiens
ttcagaaaaggcaaat

SEQ ID NO: 161494 - DNA, 16 bp, H. sapiens
ttcagaaaagttgaaa

SEQ ID NO: 161495 - DNA, 16 bp, H. sapiens
ttcagaaaagttgcag

SEQ ID NO: 161496 - DNA, 16 bp, H. sapiens
ttcagaaaataaaaga

SEQ ID NO: 161497 - DNA, 16 bp, H. sapiens
ttcagaaaataaatat

SEQ ID NO: 161498 - DNA, 16 bp, H. sapiens
ttcagaaaataaattt

SEQ ID NO: 161499 - DNA, 16 bp, H. sapiens
ttcagaaaatatatat

SEQ ID NO: 161500 - DNA, 16 bp, H. sapiens
ttcagaaaatatttat

SEQ ID NO: 161501 - DNA, 16 bp, H. sapiens
ttcagaaaatattttc

SEQ ID NO: 161502 - DNA, 16 bp, H. sapiens
ttcagaaaatgcattt

SEQ ID NO: 161503 - DNA, 16 bp, H. sapiens
ttcagaaaattttcag

SEQ ID NO: 161504 - DNA, 16 bp, H. sapiens
ttcagaaacaaaacaa

SEQ ID NO: 161505 - DNA, 16 bp, H. sapiens
ttcagaaacagaaaat

SEQ ID NO: 161506 - DNA, 16 bp, H. sapiens
ttcagaaactaaaaat

SEQ ID NO: 161507 - DNA, 16 bp, H. sapiens
ttcagaaaggaaaaga

SEQ ID NO: 161508 - DNA, 16 bp, H. sapiens
ttcagaaagggaaaag

SEQ ID NO: 161509 - DNA, 16 bp, H. sapiens
ttcagaaaggttaagt

SEQ ID NO: 161510 - DNA, 16 bp, H. sapiens
ttcagaaagtattttt

SEQ ID NO: 161511 - DNA, 16 bp, H. sapiens
ttcagaaataaattta

SEQ ID NO: 161512 - DNA, 16 bp, H. sapiens
ttcagaaataatacca

SEQ ID NO: 161513 - DNA, 16 bp, H. sapiens
ttcagaaatataaata

SEQ ID NO: 161514 - DNA, 16 bp, H. sapiens
ttcagaaatgaagaag

SEQ ID NO: 161515 - DNA, 16 bp, H. sapiens
ttcagaaatgtctatt

SEQ ID NO: 161516 - DNA, 16 bp, H. sapiens
ttcagaaattaaggat

SEQ ID NO: 161517 - DNA, 16 bp, H. sapiens
ttcagaaattttttct

SEQ ID NO: 161518 - DNA, 16 bp, H. sapiens
ttcagaacagttttag

SEQ ID NO: 161519 - DNA, 18 bp, H. sapiens
ttcagaacataggcatgg

SEQ ID NO: 161520 - DNA, 16 bp, H. sapiens
ttcagaacttgttact

SEQ ID NO: 161521 - DNA, 16 bp, H. sapiens
ttcagaactttttcat

SEQ ID NO: 161522 - DNA, 16 bp, H. sapiens
ttcagaagaaaataaa

SEQ ID NO: 161523 - DNA, 16 bp, H. sapiens
ttcagaagaaaataac

SEQ ID NO: 161524 - DNA, 16 bp, H. sapiens
ttcagaagaaacaaaa

SEQ ID NO: 161525 - DNA, 16 bp, H. sapiens
ttcagaagaatgtgta

SEQ ID NO: 161526 - DNA, 16 bp, H. sapiens
ttcagaagcagaaaaa

SEQ ID NO: 161527 - DNA, 16 bp, H. sapiens
ttcagaagctttttag

SEQ ID NO: 161528 - DNA, 16 bp, H. sapiens
ttcagaaggaaagaaa

SEQ ID NO: 161529 - DNA, 19 bp, H. sapiens
ttcagaaggtgggtaataa

SEQ ID NO: 161530 - DNA, 16 bp, H. sapiens
ttcagaataaaaataa

SEQ ID NO: 161531 - DNA, 16 bp, H. sapiens
ttcagaataggaaaat

SEQ ID NO: 161532 - DNA, 16 bp, H. sapiens
ttcagaatagtttttt

SEQ ID NO: 161533 - DNA, 16 bp, H. sapiens
ttcagaatatttaaaa

SEQ ID NO: 161534 - DNA, 16 bp, H. sapiens
ttcagaatatttattt

SEQ ID NO: 161535 - DNA, 16 bp, H. sapiens
ttcagaatattttaaa

SEQ ID NO: 161536 - DNA, 16 bp, H. sapiens
ttcagaatgtattttt

SEQ ID NO: 161537 - DNA, 16 bp, H. sapiens
ttcagaattaaatttt

SEQ ID NO: 161538 - DNA, 16 bp, H. sapiens
ttcagaattattttct

SEQ ID NO: 161539 - DNA, 16 bp, H. sapiens
ttcagaattcagaatt

SEQ ID NO: 161540 - DNA, 16 bp, H. sapiens
ttcagaattgcatggg

SEQ ID NO: 161541 - DNA, 16 bp, H. sapiens
ttcagaattgttttat

SEQ ID NO: 161542 - DNA, 16 bp, H. sapiens
ttcagaattgttttgg

SEQ ID NO: 161543 - DNA, 16 bp, H. sapiens
ttcagaatttaaaaat

SEQ ID NO: 161544 - DNA, 16 bp, H. sapiens
ttcagaatttccattt

SEQ ID NO: 161545 - DNA, 16 bp, H. sapiens
ttcagaatttgttatt

SEQ ID NO: 161546 - DNA, 16 bp, H. sapiens
ttcagaatttgttttt

SEQ ID NO: 161547 - DNA, 16 bp, H. sapiens
ttcagaattttaaaat

SEQ ID NO: 161548 - DNA, 16 bp, H. sapiens
ttcagaattttatttt

SEQ ID NO: 161549 - DNA, 16 bp, H. sapiens
ttcagaatttttaaag

SEQ ID NO: 161550 - DNA, 16 bp, H. sapiens
ttcagacaagaaaatg

SEQ ID NO: 161551 - DNA, 16 bp, H. sapiens
ttcagacactgtggaa

SEQ ID NO: 161552 - DNA, 16 bp, H. sapiens
ttcagacagatgattc

SEQ ID NO: 161553 - DNA, 16 bp, H. sapiens
ttcagaccacagtgga

SEQ ID NO: 161554 - DNA, 16 bp, H. sapiens
ttcagactgctgtact

SEQ ID NO: 161555 - DNA, 16 bp, H. sapiens
ttcagactgctgtgct

SEQ ID NO: 161556 - DNA, 16 bp, H. sapiens
ttcagactttattttt

SEQ ID NO: 161557 - DNA, 16 bp, H. sapiens
ttcagactttttaaat

SEQ ID NO: 161558 - DNA, 16 bp, H. sapiens
ttcagactttttaatg

SEQ ID NO: 161559 - DNA, 16 bp, H. sapiens
ttcagagaaaaaaaga

SEQ ID NO: 161560 - DNA, 16 bp, H. sapiens
ttcagagaaacagaaa

SEQ ID NO: 161561 - DNA, 16 bp, H. sapiens
ttcagagaaatggaaa

SEQ ID NO: 161562 - DNA, 16 bp, H. sapiens
ttcagagaaattaaaa

SEQ ID NO: 161563 - DNA, 16 bp, H. sapiens
ttcagagaaccagtct

SEQ ID NO: 161564 - DNA, 16 bp, H. sapiens
ttcagagaactttgtg

SEQ ID NO: 161565 - DNA, 16 bp, H. sapiens
ttcagagaaggaaaaa

SEQ ID NO: 161566 - DNA, 16 bp, H. sapiens
ttcagagaattcaaaa

SEQ ID NO: 161567 - DNA, 16 bp, H. sapiens
ttcagagaattgaaaa

SEQ ID NO: 161568 - DNA, 16 bp, H. sapiens
ttcagagaattgaaga

SEQ ID NO: 161569 - DNA, 16 bp, H. sapiens
ttcagagaattttttt

SEQ ID NO: 161570 - DNA, 16 bp, H. sapiens
ttcagagagaaaaata

SEQ ID NO: 161571 - DNA, 16 bp, H. sapiens
ttcagagagacagaaa

SEQ ID NO: 161572 - DNA, 16 bp, H. sapiens
ttcagagagctctgct

SEQ ID NO: 161573 - DNA, 16 bp, H. sapiens
ttcagagatgccctgc

SEQ ID NO: 161574 - DNA, 16 bp, H. sapiens
ttcagagatgccctgt

SEQ ID NO: 161575 - DNA, 16 bp, H. sapiens
ttcagagattccactt

SEQ ID NO: 161576 - DNA, 16 bp, H. sapiens
ttcagagcacagcagc

SEQ ID NO: 161577 - DNA, 16 bp, H. sapiens
ttcagagctcgaagac

SEQ ID NO: 161578 - DNA, 16 bp, H. sapiens
ttcagagctgtcctgg

SEQ ID NO: 161579 - DNA, 16 bp, H. sapiens
ttcagagcttgaagac

SEQ ID NO: 161580 - DNA, 16 bp, H. sapiens
ttcagaggaaaaaaat

SEQ ID NO: 161581 - DNA, 16 bp, H. sapiens
ttcagaggctgcaagc

SEQ ID NO: 161582 - DNA, 16 bp, H. sapiens
ttcagaggggcttttg

SEQ ID NO: 161583 - DNA, 16 bp, H. sapiens
ttcagagggtgcaagt

SEQ ID NO: 161584 - DNA, 16 bp, H. sapiens
ttcagagggtgcaggc

SEQ ID NO: 161585 - DNA, 16 bp, H. sapiens
ttcagagtcaaggaaa

SEQ ID NO: 161586 - DNA, 16 bp, H. sapiens
ttcagagtttcttttt

SEQ ID NO: 161587 - DNA, 16 bp, H. sapiens
ttcagagtttttattt

SEQ ID NO: 161588 - DNA, 16 bp, H. sapiens
ttcagataaacaaaaa

SEQ ID NO: 161589 - DNA, 16 bp, H. sapiens
ttcagataaacaatga

SEQ ID NO: 161590 - DNA, 16 bp, H. sapiens
ttcagataattttatt

SEQ ID NO: 161591 - DNA, 16 bp, H. sapiens
ttcagataatttttaa

SEQ ID NO: 161592 - DNA, 16 bp, H. sapiens
ttcagatatttgaaaa

SEQ ID NO: 161593 - DNA, 16 bp, H. sapiens
ttcagatattttgttt

SEQ ID NO: 161594 - DNA, 16 bp, H. sapiens
ttcagatcctgaatat

SEQ ID NO: 161595 - DNA, 16 bp, H. sapiens
ttcagatcctttgctc

SEQ ID NO: 161596 - DNA, 17 bp, H. sapiens
ttcagatgcatttggaa

SEQ ID NO: 161597 - DNA, 16 bp, H. sapiens
ttcagatggaaccaaa

SEQ ID NO: 161598 - DNA, 16 bp, H. sapiens
ttcagatggaatggta

SEQ ID NO: 161599 - DNA, 16 bp, H. sapiens
ttcagattcaatgcaa

SEQ ID NO: 161600 - DNA, 16 bp, H. sapiens
ttcagattcaggaaac

SEQ ID NO: 161601 - DNA, 16 bp, H. sapiens
ttcagattctgaatgt

SEQ ID NO: 161602 - DNA, 16 bp, H. sapiens
ttcagattctttcttt

SEQ ID NO: 161603 - DNA, 16 bp, H. sapiens
ttcagattgaagaaat

SEQ ID NO: 161604 - DNA, 16 bp, H. sapiens
ttcagattgccttctt

SEQ ID NO: 161605 - DNA, 16 bp, H. sapiens
ttcagatttaaagaaa

SEQ ID NO: 161606 - DNA, 16 bp, H. sapiens
ttcagatttacagaaa

SEQ ID NO: 161607 - DNA, 16 bp, H. sapiens
ttcagatttccagttt

SEQ ID NO: 161608 - DNA, 16 bp, H. sapiens
ttcagatttctacata

SEQ ID NO: 161609 - DNA, 16 bp, H. sapiens
ttcagatttcttcttt

SEQ ID NO: 161610 - DNA, 16 bp, H. sapiens
ttcagatttgggagca

SEQ ID NO: 161611 - DNA, 16 bp, H. sapiens
ttcagatttgttttct

SEQ ID NO: 161612 - DNA, 16 bp, H. sapiens
ttcagatttgttttgt

SEQ ID NO: 161613 - DNA, 16 bp, H. sapiens
ttcagattttagattt

SEQ ID NO: 161614 - DNA, 16 bp, H. sapiens
ttcagattttcagaaa

SEQ ID NO: 161615 - DNA, 16 bp, H. sapiens
ttcagattttctatgt

SEQ ID NO: 161616 - DNA, 16 bp, H. sapiens
ttcagattttggactt

SEQ ID NO: 161617 - DNA, 16 bp, H. sapiens
ttcagattttgtaata

SEQ ID NO: 161618 - DNA, 16 bp, H. sapiens
ttcagatttttgaata

SEQ ID NO: 161619 - DNA, 16 bp, H. sapiens
ttcagatttttttaaa

SEQ ID NO: 161620 - DNA, 16 bp, H. sapiens
ttcagcaaaaagaaaa

SEQ ID NO: 161621 - DNA, 16 bp, H. sapiens
ttcagcaaaacttcag

SEQ ID NO: 161622 - DNA, 16 bp, H. sapiens
ttcagcaaacatttgc

SEQ ID NO: 161623 - DNA, 16 bp, H. sapiens
ttcagcaaaccaccat

SEQ ID NO: 161624 - DNA, 25 bp, H. sapiens
ttcagcaaagcaagctttctgcttg

SEQ ID NO: 161625 - DNA, 16 bp, H. sapiens
ttcagcaaagtttcag

SEQ ID NO: 161626 - DNA, 16 bp, H. sapiens
ttcagcaaatcataat

SEQ ID NO: 161627 - DNA, 16 bp, H. sapiens
ttcagcaagcacctca

SEQ ID NO: 161628 - DNA, 16 bp, H. sapiens
ttcagcaaggtcacag

SEQ ID NO: 161629 - DNA, 16 bp, H. sapiens
ttcagcaaggttgaaa

SEQ ID NO: 161630 - DNA, 16 bp, H. sapiens
ttcagcaagtgtttat

SEQ ID NO: 161631 - DNA, 16 bp, H. sapiens
ttcagcaccaaggaca

SEQ ID NO: 161632 - DNA, 16 bp, H. sapiens
ttcagcaccacactac

SEQ ID NO: 161633 - DNA, 16 bp, H. sapiens
ttcagcaccagcctgg

SEQ ID NO: 161634 - DNA, 16 bp, H. sapiens
ttcagcactttaaaga

SEQ ID NO: 161635 - DNA, 16 bp, H. sapiens
ttcagcactttgaaaa

SEQ ID NO: 161636 - DNA, 16 bp, H. sapiens
ttcagcagatatttat

SEQ ID NO: 161637 - DNA, 16 bp, H. sapiens
ttcagcagcacaccac

SEQ ID NO: 161638 - DNA, 16 bp, H. sapiens
ttcagcagcagctctc

SEQ ID NO: 161639 - DNA, 16 bp, H. sapiens
ttcagcagccaccacc

SEQ ID NO: 161640 - DNA, 16 bp, H. sapiens
ttcagcagtattttat

SEQ ID NO: 161641 - DNA, 16 bp, H. sapiens
ttcagcagtgaagaca

SEQ ID NO: 161642 - DNA, 16 bp, H. sapiens
ttcagcagtgaagcca

SEQ ID NO: 161643 - DNA, 16 bp, H. sapiens
ttcagcagtgaagctg

SEQ ID NO: 161644 - DNA, 16 bp, H. sapiens
ttcagcagtgtcttgt

SEQ ID NO: 161645 - DNA, 16 bp, H. sapiens
ttcagcagtttcagga

SEQ ID NO: 161646 - DNA, 16 bp, H. sapiens
ttcagcatgttgacca

SEQ ID NO: 161647 - DNA, 16 bp, H. sapiens
ttcagcatgttggtca

SEQ ID NO: 161648 - DNA, 16 bp, H. sapiens
ttcagcattttgaaaa

SEQ ID NO: 161649 - DNA, 16 bp, H. sapiens
ttcagccactgtgaaa

SEQ ID NO: 161650 - DNA, 16 bp, H. sapiens
ttcagccaggcgtggt

SEQ ID NO: 161651 - DNA, 16 bp, H. sapiens
ttcagccaggctggag

SEQ ID NO: 161652 - DNA, 16 bp, H. sapiens
ttcagccatttaaaaa

SEQ ID NO: 161653 - DNA, 16 bp, H. sapiens
ttcagcccagcccagc

SEQ ID NO: 161654 - DNA, 16 bp, H. sapiens
ttcagcccaggaagtc

SEQ ID NO: 161655 - DNA, 16 bp, H. sapiens
ttcagccccctttcca

SEQ ID NO: 161656 - DNA, 16 bp, H. sapiens
ttcagccgggcatggt

SEQ ID NO: 161657 - DNA, 16 bp, H. sapiens
ttcagcctcagactga

SEQ ID NO: 161658 - DNA, 16 bp, H. sapiens
ttcagcctcagttttc

SEQ ID NO: 161659 - DNA, 16 bp, H. sapiens
ttcagcctccaaaact

SEQ ID NO: 161660 - DNA, 17 bp, H. sapiens
ttcagcctcccaaagta

SEQ ID NO: 161661 - DNA, 20 bp, H. sapiens
ttcagcctcccaagtagctg

SEQ ID NO: 161662 - DNA, 16 bp, H. sapiens
ttcagcctcccgagta

SEQ ID NO: 161663 - DNA, 16 bp, H. sapiens
ttcagcctcctgaaca

SEQ ID NO: 161664 - DNA, 16 bp, H. sapiens
ttcagcctcctgagca

SEQ ID NO: 161665 - DNA, 16 bp, H. sapiens
ttcagcctctgagtag

SEQ ID NO: 161666 - DNA, 16 bp, H. sapiens
ttcagcctgagtgaca

SEQ ID NO: 161667 - DNA, 16 bp, H. sapiens
ttcagcctgctgctgc

SEQ ID NO: 161668 - DNA, 16 bp, H. sapiens
ttcagcctgtcttggc

SEQ ID NO: 161669 - DNA, 16 bp, H. sapiens
ttcagccttaaaaata

SEQ ID NO: 161670 - DNA, 16 bp, H. sapiens
ttcagctataaaatgg

SEQ ID NO: 161671 - DNA, 16 bp, H. sapiens
ttcagctattccttta

SEQ ID NO: 161672 - DNA, 16 bp, H. sapiens
ttcagctattttgaaa

SEQ ID NO: 161673 - DNA, 18 bp, H. sapiens
ttcagctcactgcaacct

SEQ ID NO: 161674 - DNA, 20 bp, H. sapiens
ttcagctcactgcaatctcc

SEQ ID NO: 161675 - DNA, 16 bp, H. sapiens
ttcagctccagaattt

SEQ ID NO: 161676 - DNA, 16 bp, H. sapiens
ttcagctccatccaag

SEQ ID NO: 161677 - DNA, 16 bp, H. sapiens
ttcagctccatccatg

SEQ ID NO: 161678 - DNA, 16 bp, H. sapiens
ttcagctcccactttt

SEQ ID NO: 161679 - DNA, 16 bp, H. sapiens
ttcagctctgatttgg

SEQ ID NO: 161680 - DNA, 17 bp, H. sapiens
ttcagctctgcaccaag

SEQ ID NO: 161681 - DNA, 16 bp, H. sapiens
ttcagctctgctctga

SEQ ID NO: 161682 - DNA, 16 bp, H. sapiens
ttcagctgaagttttt

SEQ ID NO: 161683 - DNA, 16 bp, H. sapiens
ttcagctgtgactcca

SEQ ID NO: 161684 - DNA, 16 bp, H. sapiens
ttcagctgtttctttt

SEQ ID NO: 161685 - DNA, 16 bp, H. sapiens
ttcagcttcattataa

SEQ ID NO: 161686 - DNA, 16 bp, H. sapiens
ttcagcttcccaaagt

SEQ ID NO: 161687 - DNA, 16 bp, H. sapiens
ttcagcttctggtggc

SEQ ID NO: 161688 - DNA, 16 bp, H. sapiens
ttcagcttcttcatct

SEQ ID NO: 161689 - DNA, 16 bp, H. sapiens
ttcagcttcttcattt

SEQ ID NO: 161690 - DNA, 16 bp, H. sapiens
ttcagcttgaatgtta

SEQ ID NO: 161691 - DNA, 16 bp, H. sapiens
ttcagcttgcaactca

SEQ ID NO: 161692 - DNA, 16 bp, H. sapiens
ttcagctttaattttt

SEQ ID NO: 161693 - DNA, 16 bp, H. sapiens
ttcagctttactgagg

SEQ ID NO: 161694 - DNA, 16 bp, H. sapiens
ttcagctttagtagat

SEQ ID NO: 161695 - DNA, 16 bp, H. sapiens
ttcagctttctactta

SEQ ID NO: 161696 - DNA, 16 bp, H. sapiens
ttcagctttttacttg

SEQ ID NO: 161697 - DNA, 16 bp, H. sapiens
ttcaggaaaaaaattt

SEQ ID NO: 161698 - DNA, 16 bp, H. sapiens
ttcaggaaaagtaaaa

SEQ ID NO: 161699 - DNA, 16 bp, H. sapiens
ttcaggaaaataaata

SEQ ID NO: 161700 - DNA, 16 bp, H. sapiens
ttcaggaaagcagaaa

SEQ ID NO: 161701 - DNA, 16 bp, H. sapiens
ttcaggaaataaagga

SEQ ID NO: 161702 - DNA, 16 bp, H. sapiens
ttcaggaaataatttt

SEQ ID NO: 161703 - DNA, 18 bp, H. sapiens
ttcaggaaatacacagaa

SEQ ID NO: 161704 - DNA, 16 bp, H. sapiens
ttcaggaaatacagat

SEQ ID NO: 161705 - DNA, 16 bp, H. sapiens
ttcaggaaatgcaaat

SEQ ID NO: 161706 - DNA, 16 bp, H. sapiens
ttcaggaacttttcct

SEQ ID NO: 161707 - DNA, 16 bp, H. sapiens
ttcaggaagaagaaaa

SEQ ID NO: 161708 - DNA, 16 bp, H. sapiens
ttcaggaagtgaaatg

SEQ ID NO: 161709 - DNA, 16 bp, H. sapiens
ttcaggaatttggaaa

SEQ ID NO: 161710 - DNA, 16 bp, H. sapiens
ttcaggacaaaccaga

SEQ ID NO: 161711 - DNA, 16 bp, H. sapiens
ttcaggacacagacat

SEQ ID NO: 161712 - DNA, 16 bp, H. sapiens
ttcaggacttgaactt

SEQ ID NO: 161713 - DNA, 16 bp, H. sapiens
ttcaggactttaaaaa

SEQ ID NO: 161714 - DNA, 16 bp, H. sapiens
ttcaggagaaaaaaaa

SEQ ID NO: 161715 - DNA, 16 bp, H. sapiens
ttcaggagcagcctgg

SEQ ID NO: 161716 - DNA, 16 bp, H. sapiens
ttcaggagcatgctgt

SEQ ID NO: 161717 - DNA, 16 bp, H. sapiens
ttcaggagctcttcta

SEQ ID NO: 161718 - DNA, 16 bp, H. sapiens
ttcaggaggatgtgca

SEQ ID NO: 161719 - DNA, 16 bp, H. sapiens
ttcaggaggctgagat

SEQ ID NO: 161720 - DNA, 16 bp, H. sapiens
ttcaggaggtggaggc

SEQ ID NO: 161721 - DNA, 22 bp, H. sapiens
ttcaggatattatccaggagaa

SEQ ID NO: 161722 - DNA, 16 bp, H. sapiens
ttcaggatcttgagat

SEQ ID NO: 161723 - DNA, 16 bp, H. sapiens
ttcaggatgaaactgt

SEQ ID NO: 161724 - DNA, 16 bp, H. sapiens
ttcaggatgcatttga

SEQ ID NO: 161725 - DNA, 16 bp, H. sapiens
ttcaggatggaggctg

SEQ ID NO: 161726 - DNA, 16 bp, H. sapiens
ttcaggatttctgttt

SEQ ID NO: 161727 - DNA, 16 bp, H. sapiens
ttcaggatttcttgct

SEQ ID NO: 161728 - DNA, 16 bp, H. sapiens
ttcaggattttgattt

SEQ ID NO: 161729 - DNA, 16 bp, H. sapiens
ttcaggcaaaaggaaa

SEQ ID NO: 161730 - DNA, 16 bp, H. sapiens
ttcaggcagaggaaat

SEQ ID NO: 161731 - DNA, 16 bp, H. sapiens
ttcaggcatagctgga

SEQ ID NO: 161732 - DNA, 16 bp, H. sapiens
ttcaggcatgagccac

SEQ ID NO: 161733 - DNA, 16 bp, H. sapiens
ttcaggccctccctgg

SEQ ID NO: 161734 - DNA, 16 bp, H. sapiens
ttcaggccttaaggga

SEQ ID NO: 161735 - DNA, 16 bp, H. sapiens
ttcaggccttattcat

SEQ ID NO: 161736 - DNA, 16 bp, H. sapiens
ttcaggctgcagtgca

SEQ ID NO: 161737 - DNA, 16 bp, H. sapiens
ttcaggctgggcatgg

SEQ ID NO: 161738 - DNA, 16 bp, H. sapiens
ttcagggaaaaaaata

SEQ ID NO: 161739 - DNA, 16 bp, H. sapiens
ttcagggaaaaaaatt

SEQ ID NO: 161740 - DNA, 16 bp, H. sapiens
ttcagggagcttccag

SEQ ID NO: 161741 - DNA, 16 bp, H. sapiens
ttcagggccagggcca

SEQ ID NO: 161742 - DNA, 16 bp, H. sapiens
ttcaggggaaaaaaaa

SEQ ID NO: 161743 - DNA, 16 bp, H. sapiens
ttcaggggcagtaaca

SEQ ID NO: 161744 - DNA, 16 bp, H. sapiens
ttcaggggtacttgtg

SEQ ID NO: 161745 - DNA, 16 bp, H. sapiens
ttcagggtggtatggc

SEQ ID NO: 161746 - DNA, 16 bp, H. sapiens
ttcagggtttgttttt

SEQ ID NO: 161747 - DNA, 16 bp, H. sapiens
ttcaggtatttatttt

SEQ ID NO: 161748 - DNA, 16 bp, H. sapiens
ttcaggtattttctat

SEQ ID NO: 161749 - DNA, 16 bp, H. sapiens
ttcaggtcctgcatac

SEQ ID NO: 161750 - DNA, 16 bp, H. sapiens
ttcaggtctctgctta

SEQ ID NO: 161751 - DNA, 16 bp, H. sapiens
ttcaggtctttgctca

SEQ ID NO: 161752 - DNA, 18 bp, H. sapiens
ttcaggtgatccacccac

SEQ ID NO: 161753 - DNA, 21 bp, H. sapiens
ttcaggtgatccacccgcctc

SEQ ID NO: 161754 - DNA, 20 bp, H. sapiens
ttcaggtgatccacctgcct

SEQ ID NO: 161755 - DNA, 16 bp, H. sapiens
ttcaggtgatccgccc

SEQ ID NO: 161756 - DNA, 16 bp, H. sapiens
ttcaggttatacattt

SEQ ID NO: 161757 - DNA, 16 bp, H. sapiens
ttcaggttggagtgca

SEQ ID NO: 161758 - DNA, 16 bp, H. sapiens
ttcaggtttctctggg

SEQ ID NO: 161759 - DNA, 16 bp, H. sapiens
ttcaggtttctgctca

SEQ ID NO: 161760 - DNA, 16 bp, H. sapiens
ttcaggtttctttctt

SEQ ID NO: 161761 - DNA, 16 bp, H. sapiens
ttcaggttttggattt

SEQ ID NO: 161762 - DNA, 16 bp, H. sapiens
ttcaggtttttaaaaa

SEQ ID NO: 161763 - DNA, 17 bp, H. sapiens
ttcaggtttttgcattt

SEQ ID NO: 161764 - DNA, 16 bp, H. sapiens
ttcagtaaaagaaaaa

SEQ ID NO: 161765 - DNA, 16 bp, H. sapiens
ttcagtaaaataattt

SEQ ID NO: 161766 - DNA, 16 bp, H. sapiens
ttcagtaaatattatt

SEQ ID NO: 161767 - DNA, 16 bp, H. sapiens
ttcagtaaatgtttgc

SEQ ID NO: 161768 - DNA, 16 bp, H. sapiens
ttcagtaacttgccca

SEQ ID NO: 161769 - DNA, 16 bp, H. sapiens
ttcagtaagaatctgt

SEQ ID NO: 161770 - DNA, 16 bp, H. sapiens
ttcagtaagccatgct

SEQ ID NO: 161771 - DNA, 16 bp, H. sapiens
ttcagtaaggtttcag

SEQ ID NO: 161772 - DNA, 16 bp, H. sapiens
ttcagtaataaatatg

SEQ ID NO: 161773 - DNA, 16 bp, H. sapiens
ttcagtacattcacat

SEQ ID NO: 161774 - DNA, 16 bp, H. sapiens
ttcagtagatgcagaa

SEQ ID NO: 161775 - DNA, 16 bp, H. sapiens
ttcagtaggaaaaaaa

SEQ ID NO: 161776 - DNA, 16 bp, H. sapiens
ttcagtatattttatt

SEQ ID NO: 161777 - DNA, 16 bp, H. sapiens
ttcagtatgatatggg

SEQ ID NO: 161778 - DNA, 16 bp, H. sapiens
ttcagtatgatgttga

SEQ ID NO: 161779 - DNA, 16 bp, H. sapiens
ttcagtatgatgttgg

SEQ ID NO: 161780 - DNA, 16 bp, H. sapiens
ttcagtattcactaat

SEQ ID NO: 161781 - DNA, 16 bp, H. sapiens
ttcagtattgtgttgg

SEQ ID NO: 161782 - DNA, 16 bp, H. sapiens
ttcagtatttcagtat

SEQ ID NO: 161783 - DNA, 16 bp, H. sapiens
ttcagtattttagaaa

SEQ ID NO: 161784 - DNA, 16 bp, H. sapiens
ttcagtatttttttaa

SEQ ID NO: 161785 - DNA, 16 bp, H. sapiens
ttcagtcacactagcc

SEQ ID NO: 161786 - DNA, 16 bp, H. sapiens
ttcagtcacctcccac

SEQ ID NO: 161787 - DNA, 16 bp, H. sapiens
ttcagtcactcattca

SEQ ID NO: 161788 - DNA, 16 bp, H. sapiens
ttcagtcattcagcaa

SEQ ID NO: 161789 - DNA, 16 bp, H. sapiens
ttcagtcattcagtca

SEQ ID NO: 161790 - DNA, 16 bp, H. sapiens
ttcagtcattgtggaa

SEQ ID NO: 161791 - DNA, 16 bp, H. sapiens
ttcagtcattttcttt

SEQ ID NO: 161792 - DNA, 16 bp, H. sapiens
ttcagtctctctctct

SEQ ID NO: 161793 - DNA, 16 bp, H. sapiens
ttcagtctctttctct

SEQ ID NO: 161794 - DNA, 16 bp, H. sapiens
ttcagtctgaaagaaa

SEQ ID NO: 161795 - DNA, 16 bp, H. sapiens
ttcagtctttcatcat

SEQ ID NO: 161796 - DNA, 16 bp, H. sapiens
ttcagtctttcatttt

SEQ ID NO: 161797 - DNA, 16 bp, H. sapiens
ttcagtgaactgagat

SEQ ID NO: 161798 - DNA, 16 bp, H. sapiens
ttcagtgaatttttaa

SEQ ID NO: 161799 - DNA, 16 bp, H. sapiens
ttcagtgagctatgat

SEQ ID NO: 161800 - DNA, 16 bp, H. sapiens
ttcagtgagctgagat

SEQ ID NO: 161801 - DNA, 16 bp, H. sapiens
ttcagtgagtcaagat

SEQ ID NO: 161802 - DNA, 16 bp, H. sapiens
ttcagtgagttttgac

SEQ ID NO: 161803 - DNA, 16 bp, H. sapiens
ttcagtggaaacttta

SEQ ID NO: 161804 - DNA, 16 bp, H. sapiens
ttcagtggaggaaaga

SEQ ID NO: 161805 - DNA, 16 bp, H. sapiens
ttcagtggctttccat

SEQ ID NO: 161806 - DNA, 16 bp, H. sapiens
ttcagtggtattaaat

SEQ ID NO: 161807 - DNA, 16 bp, H. sapiens
ttcagtggtgttaagt

SEQ ID NO: 161808 - DNA, 16 bp, H. sapiens
ttcagtgtcttcatct

SEQ ID NO: 161809 - DNA, 16 bp, H. sapiens
ttcagtgtgtatttcc

SEQ ID NO: 161810 - DNA, 16 bp, H. sapiens
ttcagtgtttcaccat

SEQ ID NO: 161811 - DNA, 16 bp, H. sapiens
ttcagtgttttctcat

SEQ ID NO: 161812 - DNA, 16 bp, H. sapiens
ttcagttagaaggaat

SEQ ID NO: 161813 - DNA, 16 bp, H. sapiens
ttcagttagcaagtga

SEQ ID NO: 161814 - DNA, 16 bp, H. sapiens
ttcagttataagatga

SEQ ID NO: 161815 - DNA, 16 bp, H. sapiens
ttcagttattatattt

SEQ ID NO: 161816 - DNA, 16 bp, H. sapiens
ttcagttcaagtccaa

SEQ ID NO: 161817 - DNA, 16 bp, H. sapiens
ttcagttcagttctga

SEQ ID NO: 161818 - DNA, 16 bp, H. sapiens
ttcagttcatctctga

SEQ ID NO: 161819 - DNA, 16 bp, H. sapiens
ttcagttccagaccac

SEQ ID NO: 161820 - DNA, 16 bp, H. sapiens
ttcagttccaggattt

SEQ ID NO: 161821 - DNA, 16 bp, H. sapiens
ttcagttccatatgaa

SEQ ID NO: 161822 - DNA, 16 bp, H. sapiens
ttcagttccgctctga

SEQ ID NO: 161823 - DNA, 16 bp, H. sapiens
ttcagttcctcagtca

SEQ ID NO: 161824 - DNA, 16 bp, H. sapiens
ttcagttctgctctaa

SEQ ID NO: 161825 - DNA, 16 bp, H. sapiens
ttcagttctttcattt

SEQ ID NO: 161826 - DNA, 16 bp, H. sapiens
ttcagttctttgaaaa

SEQ ID NO: 161827 - DNA, 16 bp, H. sapiens
ttcagttgcccctgga

SEQ ID NO: 161828 - DNA, 16 bp, H. sapiens
ttcagttggggaagat

SEQ ID NO: 161829 - DNA, 16 bp, H. sapiens
ttcagttgtgtgtgtg

SEQ ID NO: 161830 - DNA, 16 bp, H. sapiens
ttcagttgttttgcat

SEQ ID NO: 161831 - DNA, 16 bp, H. sapiens
ttcagtttacagaaaa

SEQ ID NO: 161832 - DNA, 16 bp, H. sapiens
ttcagtttcacaagat

SEQ ID NO: 161833 - DNA, 16 bp, H. sapiens
ttcagtttcagaactt

SEQ ID NO: 161834 - DNA, 16 bp, H. sapiens
ttcagtttccatgcag

SEQ ID NO: 161835 - DNA, 16 bp, H. sapiens
ttcagtttccccatct

SEQ ID NO: 161836 - DNA, 16 bp, H. sapiens
ttcagtttcctcatct

SEQ ID NO: 161837 - DNA, 16 bp, H. sapiens
ttcagtttccttattt

SEQ ID NO: 161838 - DNA, 16 bp, H. sapiens
ttcagtttctatttct

SEQ ID NO: 161839 - DNA, 16 bp, H. sapiens
ttcagtttctcagttg

SEQ ID NO: 161840 - DNA, 16 bp, H. sapiens
ttcagtttcttcatct

SEQ ID NO: 161841 - DNA, 16 bp, H. sapiens
ttcagtttcttcctag

SEQ ID NO: 161842 - DNA, 16 bp, H. sapiens
ttcagtttgctatttt

SEQ ID NO: 161843 - DNA, 16 bp, H. sapiens
ttcagtttggggtgat

SEQ ID NO: 161844 - DNA, 16 bp, H. sapiens
ttcagttttacattta

SEQ ID NO: 161845 - DNA, 16 bp, H. sapiens
ttcagttttataaagg

SEQ ID NO: 161846 - DNA, 16 bp, H. sapiens
ttcagttttataattt

SEQ ID NO: 161847 - DNA, 16 bp, H. sapiens
ttcagttttatgcatt

SEQ ID NO: 161848 - DNA, 16 bp, H. sapiens
ttcagttttcactttt

SEQ ID NO: 161849 - DNA, 16 bp, H. sapiens
ttcagttttcagaagt

SEQ ID NO: 161850 - DNA, 16 bp, H. sapiens
ttcagttttcagattt

SEQ ID NO: 161851 - DNA, 16 bp, H. sapiens
ttcagttttcccccat

SEQ ID NO: 161852 - DNA, 16 bp, H. sapiens
ttcagttttctcacct

SEQ ID NO: 161853 - DNA, 16 bp, H. sapiens
ttcagttttctgctta

SEQ ID NO: 161854 - DNA, 16 bp, H. sapiens
ttcagttttcttttcc

SEQ ID NO: 161855 - DNA, 16 bp, H. sapiens
ttcagttttgcaagag

SEQ ID NO: 161856 - DNA, 16 bp, H. sapiens
ttcagtttttaaaaga

SEQ ID NO: 161857 - DNA, 16 bp, H. sapiens
ttcagtttttcaaaaa

SEQ ID NO: 161858 - DNA, 16 bp, H. sapiens
ttcagtttttcaaaat

SEQ ID NO: 161859 - DNA, 16 bp, H. sapiens
ttcagtttttccacat

SEQ ID NO: 161860 - DNA, 16 bp, H. sapiens
ttcagtttttccataa

SEQ ID NO: 161861 - DNA, 16 bp, H. sapiens
ttcagtttttctataa

SEQ ID NO: 161862 - DNA, 16 bp, H. sapiens
ttcagtttttctgtaa

SEQ ID NO: 161863 - DNA, 16 bp, H. sapiens
ttcataaaaaatgtta

SEQ ID NO: 161864 - DNA, 16 bp, H. sapiens
ttcataaaaatgcaaa

SEQ ID NO: 161865 - DNA, 16 bp, H. sapiens
ttcataaaaccatcag

SEQ ID NO: 161866 - DNA, 16 bp, H. sapiens
ttcataaaaggaagag

SEQ ID NO: 161867 - DNA, 16 bp, H. sapiens
ttcataaaatatattc

SEQ ID NO: 161868 - DNA, 16 bp, H. sapiens
ttcataaaatgaattg

SEQ ID NO: 161869 - DNA, 16 bp, H. sapiens
ttcataaaatgttaat

SEQ ID NO: 161870 - DNA, 16 bp, H. sapiens
ttcataaacttttaaa

SEQ ID NO: 161871 - DNA, 16 bp, H. sapiens
ttcataaagttttatt

SEQ ID NO: 161872 - DNA, 16 bp, H. sapiens
ttcataaatatggaat

SEQ ID NO: 161873 - DNA, 16 bp, H. sapiens
ttcataaatgaatttt

SEQ ID NO: 161874 - DNA, 16 bp, H. sapiens
ttcataagttacccag

SEQ ID NO: 161875 - DNA, 16 bp, H. sapiens
ttcataataaaaatct

SEQ ID NO: 161876 - DNA, 16 bp, H. sapiens
ttcataataacaaaga

SEQ ID NO: 161877 - DNA, 16 bp, H. sapiens
ttcataatagttaaaa

SEQ ID NO: 161878 - DNA, 16 bp, H. sapiens
ttcataatattctctg

SEQ ID NO: 161879 - DNA, 16 bp, H. sapiens
ttcataattttaatgt

SEQ ID NO: 161880 - DNA, 16 bp, H. sapiens
ttcatacaatgaaatg

SEQ ID NO: 161881 - DNA, 16 bp, H. sapiens
ttcataccattctcct

SEQ ID NO: 161882 - DNA, 16 bp, H. sapiens
ttcatactggagaaaa

SEQ ID NO: 161883 - DNA, 16 bp, H. sapiens
ttcatagaaataaaaa

SEQ ID NO: 161884 - DNA, 16 bp, H. sapiens
ttcatagaagaggaaa

SEQ ID NO: 161885 - DNA, 16 bp, H. sapiens
ttcatagagatgggat

SEQ ID NO: 161886 - DNA, 16 bp, H. sapiens
ttcatagattggaaga

SEQ ID NO: 161887 - DNA, 16 bp, H. sapiens
ttcatagcacttgtca

SEQ ID NO: 161888 - DNA, 16 bp, H. sapiens
ttcatagcagcactgt

SEQ ID NO: 161889 - DNA, 16 bp, H. sapiens
ttcatagcatttttca

SEQ ID NO: 161890 - DNA, 16 bp, H. sapiens
ttcatagtttatatta

SEQ ID NO: 161891 - DNA, 16 bp, H. sapiens
ttcatagttttccttg

SEQ ID NO: 161892 - DNA, 16 bp, H. sapiens
ttcatataaaaattca

SEQ ID NO: 161893 - DNA, 16 bp, H. sapiens
ttcatataatgactta

SEQ ID NO: 161894 - DNA, 16 bp, H. sapiens
ttcatatacttgtttg

SEQ ID NO: 161895 - DNA, 16 bp, H. sapiens
ttcatatatatgaata

SEQ ID NO: 161896 - DNA, 16 bp, H. sapiens
ttcatatatctatata

SEQ ID NO: 161897 - DNA, 16 bp, H. sapiens
ttcatatatggctttt

SEQ ID NO: 161898 - DNA, 16 bp, H. sapiens
ttcatatcccttgccc

SEQ ID NO: 161899 - DNA, 16 bp, H. sapiens
ttcatatccttcatcc

SEQ ID NO: 161900 - DNA, 16 bp, H. sapiens
ttcatatggaaacaaa

SEQ ID NO: 161901 - DNA, 18 bp, H. sapiens
ttcatatggaaccaaaaa

SEQ ID NO: 161902 - DNA, 20 bp, H. sapiens
ttcatatggaaccaaaaaac

SEQ ID NO: 161903 - DNA, 16 bp, H. sapiens
ttcatatggaatgaaa

SEQ ID NO: 161904 - DNA, 16 bp, H. sapiens
ttcatatgttttttgg

SEQ ID NO: 161905 - DNA, 16 bp, H. sapiens
ttcatattgttgtaca

SEQ ID NO: 161906 - DNA, 16 bp, H. sapiens
ttcatatttatacata

SEQ ID NO: 161907 - DNA, 16 bp, H. sapiens
ttcatatttatgtatt

SEQ ID NO: 161908 - DNA, 16 bp, H. sapiens
ttcatatttcatattc

SEQ ID NO: 161909 - DNA, 16 bp, H. sapiens
ttcatatttgatgaaa

SEQ ID NO: 161910 - DNA, 16 bp, H. sapiens
ttcatatttgcatttt

SEQ ID NO: 161911 - DNA, 16 bp, H. sapiens
ttcatattttacagat

SEQ ID NO: 161912 - DNA, 16 bp, H. sapiens
ttcatattttccatct

SEQ ID NO: 161913 - DNA, 16 bp, H. sapiens
ttcatattttgaaaca

SEQ ID NO: 161914 - DNA, 16 bp, H. sapiens
ttcatatttttagtat

SEQ ID NO: 161915 - DNA, 16 bp, H. sapiens
ttcatcaaactgtaca

SEQ ID NO: 161916 - DNA, 16 bp, H. sapiens
ttcatcaacagaagaa

SEQ ID NO: 161917 - DNA, 16 bp, H. sapiens
ttcatcaagattaaaa

SEQ ID NO: 161918 - DNA, 16 bp, H. sapiens
ttcatcaattataaca

SEQ ID NO: 161919 - DNA, 16 bp, H. sapiens
ttcatcaattgtaata

SEQ ID NO: 161920 - DNA, 16 bp, H. sapiens
ttcatcaattttaaca

SEQ ID NO: 161921 - DNA, 16 bp, H. sapiens
ttcatcacattaacaa

SEQ ID NO: 161922 - DNA, 16 bp, H. sapiens
ttcatcaccccaaaag

SEQ ID NO: 161923 - DNA, 16 bp, H. sapiens
ttcatcacgtagttct

SEQ ID NO: 161924 - DNA, 16 bp, H. sapiens
ttcatcactccaaaaa

SEQ ID NO: 161925 - DNA, 16 bp, H. sapiens
ttcatcagaaatactt

SEQ ID NO: 161926 - DNA, 16 bp, H. sapiens
ttcatcagggatattg

SEQ ID NO: 161927 - DNA, 16 bp, H. sapiens
ttcatcagtgttttat

SEQ ID NO: 161928 - DNA, 16 bp, H. sapiens
ttcatcatcaccatca

SEQ ID NO: 161929 - DNA, 16 bp, H. sapiens
ttcatcatcatcatca

SEQ ID NO: 161930 - DNA, 16 bp, H. sapiens
ttcatcatctttccaa

SEQ ID NO: 161931 - DNA, 16 bp, H. sapiens
ttcatcatgaagaact

SEQ ID NO: 161932 - DNA, 16 bp, H. sapiens
ttcatcatgaccaagt

SEQ ID NO: 161933 - DNA, 16 bp, H. sapiens
ttcatcatggattttt

SEQ ID NO: 161934 - DNA, 16 bp, H. sapiens
ttcatcatgttggcaa

SEQ ID NO: 161935 - DNA, 17 bp, H. sapiens
ttcatcatgttggccaa

SEQ ID NO: 161936 - DNA, 16 bp, H. sapiens
ttcatcattccaaaaa

SEQ ID NO: 161937 - DNA, 16 bp, H. sapiens
ttcatcatttagcatt

SEQ ID NO: 161938 - DNA, 16 bp, H. sapiens
ttcatcattttttatg

SEQ ID NO: 161939 - DNA, 16 bp, H. sapiens
ttcatccacaaggact

SEQ ID NO: 161940 - DNA, 16 bp, H. sapiens
ttcatccagctcctcc

SEQ ID NO: 161941 - DNA, 16 bp, H. sapiens
ttcatccatccattca

SEQ ID NO: 161942 - DNA, 16 bp, H. sapiens
ttcatccatgctgttg

SEQ ID NO: 161943 - DNA, 23 bp, H. sapiens
ttcatccatgtccctacaaagga

SEQ ID NO: 161944 - DNA, 16 bp, H. sapiens
ttcatccatgttgtag

SEQ ID NO: 161945 - DNA, 16 bp, H. sapiens
ttcatccatttgttca

SEQ ID NO: 161946 - DNA, 16 bp, H. sapiens
ttcatcccagaggagc

SEQ ID NO: 161947 - DNA, 16 bp, H. sapiens
ttcatcccagaggggc

SEQ ID NO: 161948 - DNA, 16 bp, H. sapiens
ttcatcccatttcccc

SEQ ID NO: 161949 - DNA, 26 bp, H. sapiens
ttcatccctgggatgcaaggctggct

SEQ ID NO: 161950 - DNA, 29 bp, H. sapiens
ttcatccctgggatgcaaggctggttcac

SEQ ID NO: 161951 - DNA, 29 bp, H. sapiens
ttcatccctgggatgcaaggctggttcga

SEQ ID NO: 161952 - DNA, 16 bp, H. sapiens
ttcatcctcatcatct

SEQ ID NO: 161953 - DNA, 16 bp, H. sapiens
ttcatcctcatcttca

SEQ ID NO: 161954 - DNA, 16 bp, H. sapiens
ttcatcctgggtgaca

SEQ ID NO: 161955 - DNA, 16 bp, H. sapiens
ttcatcctttaaaaag

SEQ ID NO: 161956 - DNA, 16 bp, H. sapiens
ttcatctaaagacata

SEQ ID NO: 161957 - DNA, 16 bp, H. sapiens
ttcatctacatgacaa

SEQ ID NO: 161958 - DNA, 16 bp, H. sapiens
ttcatctatgttgcag

SEQ ID NO: 161959 - DNA, 16 bp, H. sapiens
ttcatctatttatttg

SEQ ID NO: 161960 - DNA, 16 bp, H. sapiens
ttcatctcacagagtt

SEQ ID NO: 161961 - DNA, 16 bp, H. sapiens
ttcatctcagacttct

SEQ ID NO: 161962 - DNA, 16 bp, H. sapiens
ttcatctctacagaaa

SEQ ID NO: 161963 - DNA, 16 bp, H. sapiens
ttcatctctgtgtccc

SEQ ID NO: 161964 - DNA, 16 bp, H. sapiens
ttcatctgcttatttt

SEQ ID NO: 161965 - DNA, 16 bp, H. sapiens
ttcatctgtaaaaagg

SEQ ID NO: 161966 - DNA, 16 bp, H. sapiens
ttcatctgtaaatatt

SEQ ID NO: 161967 - DNA, 16 bp, H. sapiens
ttcatctgtatccttt

SEQ ID NO: 161968 - DNA, 16 bp, H. sapiens
ttcatctgtatctttt

SEQ ID NO: 161969 - DNA, 16 bp, H. sapiens
ttcatctgtcttttgt

SEQ ID NO: 161970 - DNA, 16 bp, H. sapiens
ttcatctgtggatgga

SEQ ID NO: 161971 - DNA, 16 bp, H. sapiens
ttcatctgtgtccctg

SEQ ID NO: 161972 - DNA, 16 bp, H. sapiens
ttcatctgtgttgcag

SEQ ID NO: 161973 - DNA, 16 bp, H. sapiens
ttcatctgttaataga

SEQ ID NO: 161974 - DNA, 16 bp, H. sapiens
ttcatctgttcattca

SEQ ID NO: 161975 - DNA, 16 bp, H. sapiens
ttcatcttcacaacaa

SEQ ID NO: 161976 - DNA, 16 bp, H. sapiens
ttcatcttctgtaaaa

SEQ ID NO: 161977 - DNA, 16 bp, H. sapiens
ttcatcttgaattgta

SEQ ID NO: 161978 - DNA, 16 bp, H. sapiens
ttcatctttctcctgt

SEQ ID NO: 161979 - DNA, 16 bp, H. sapiens
ttcatctttctcttgt

SEQ ID NO: 161980 - DNA, 16 bp, H. sapiens
ttcatctttgcatccc

SEQ ID NO: 161981 - DNA, 16 bp, H. sapiens
ttcatctttgtattct

SEQ ID NO: 161982 - DNA, 16 bp, H. sapiens
ttcatctttgtcttct

SEQ ID NO: 161983 - DNA, 16 bp, H. sapiens
ttcatcttttcagttt

SEQ ID NO: 161984 - DNA, 16 bp, H. sapiens
ttcatgaaaaagaaag

SEQ ID NO: 161985 - DNA, 16 bp, H. sapiens
ttcatgaaagagaaaa

SEQ ID NO: 161986 - DNA, 16 bp, H. sapiens
ttcatgaaagattttt

SEQ ID NO: 161987 - DNA, 16 bp, H. sapiens
ttcatgaaataaataa

SEQ ID NO: 161988 - DNA, 16 bp, H. sapiens
ttcatgaaatatttta

SEQ ID NO: 161989 - DNA, 16 bp, H. sapiens
ttcatgaagatatttt

SEQ ID NO: 161990 - DNA, 16 bp, H. sapiens
ttcatgaatatatatt

SEQ ID NO: 161991 - DNA, 16 bp, H. sapiens
ttcatgaatattttca

SEQ ID NO: 161992 - DNA, 16 bp, H. sapiens
ttcatgaatcattcat

SEQ ID NO: 161993 - DNA, 16 bp, H. sapiens
ttcatgaatgggaaga

SEQ ID NO: 161994 - DNA, 16 bp, H. sapiens
ttcatgaattagaaga

SEQ ID NO: 161995 - DNA, 16 bp, H. sapiens
ttcatgaattattttt

SEQ ID NO: 161996 - DNA, 16 bp, H. sapiens
ttcatgaccaagaacc

SEQ ID NO: 161997 - DNA, 21 bp, H. sapiens
ttcatgactaaaacaccaaaa

SEQ ID NO: 161998 - DNA, 16 bp, H. sapiens
ttcatgataaaacatt

SEQ ID NO: 161999 - DNA, 21 bp, H. sapiens
ttcatgatccacccaccttgg

SEQ ID NO: 162000 - DNA, 16 bp, H. sapiens
ttcatgatgaaatcac

SEQ ID NO: 162001 - DNA, 16 bp, H. sapiens
ttcatgcaaatatttt

SEQ ID NO: 162002 - DNA, 16 bp, H. sapiens
ttcatgcaaatggaaa

SEQ ID NO: 162003 - DNA, 16 bp, H. sapiens
ttcatgcacacacaca

SEQ ID NO: 162004 - DNA, 16 bp, H. sapiens
ttcatgcagagccagc

SEQ ID NO: 162005 - DNA, 16 bp, H. sapiens
ttcatgcattaattca

SEQ ID NO: 162006 - DNA, 16 bp, H. sapiens
ttcatgcattcattca

SEQ ID NO: 162007 - DNA, 16 bp, H. sapiens
ttcatgcatttttaaa

SEQ ID NO: 162008 - DNA, 16 bp, H. sapiens
ttcatgccatttttct

SEQ ID NO: 162009 - DNA, 16 bp, H. sapiens
ttcatgcctcagcctc

SEQ ID NO: 162010 - DNA, 22 bp, H. sapiens
ttcatgcctgtaatcccaacac

SEQ ID NO: 162011 - DNA, 16 bp, H. sapiens
ttcatgccttcccttt

SEQ ID NO: 162012 - DNA, 24 bp, H. sapiens
ttcatgctaaaatctctcaataaa

SEQ ID NO: 162013 - DNA, 16 bp, H. sapiens
ttcatgctgttttcca

SEQ ID NO: 162014 - DNA, 16 bp, H. sapiens
ttcatgcttttaaaaa

SEQ ID NO: 162015 - DNA, 16 bp, H. sapiens
ttcatggaggaggtga

SEQ ID NO: 162016 - DNA, 16 bp, H. sapiens
ttcatggaggggaaga

SEQ ID NO: 162017 - DNA, 16 bp, H. sapiens
ttcatggatcaaaaga

SEQ ID NO: 162018 - DNA, 16 bp, H. sapiens
ttcatggctggggagg

SEQ ID NO: 162019 - DNA, 16 bp, H. sapiens
ttcatgggatacagag

SEQ ID NO: 162020 - DNA, 16 bp, H. sapiens
ttcatggggtacatga

SEQ ID NO: 162021 - DNA, 16 bp, H. sapiens
ttcatgggtcccatgt

SEQ ID NO: 162022 - DNA, 16 bp, H. sapiens
ttcatgggttctgcat

SEQ ID NO: 162023 - DNA, 16 bp, H. sapiens
ttcatgggttggaaga

SEQ ID NO: 162024 - DNA, 16 bp, H. sapiens
ttcatggtccaggaca

SEQ ID NO: 162025 - DNA, 16 bp, H. sapiens
ttcatggtctcactgg

SEQ ID NO: 162026 - DNA, 16 bp, H. sapiens
ttcatggtcttgctga

SEQ ID NO: 162027 - DNA, 16 bp, H. sapiens
ttcatggtttggaaga

SEQ ID NO: 162028 - DNA, 16 bp, H. sapiens
ttcatgtaaatagaat

SEQ ID NO: 162029 - DNA, 16 bp, H. sapiens
ttcatgtaaatggaat

SEQ ID NO: 162030 - DNA, 16 bp, H. sapiens
ttcatgtaacaaaaca

SEQ ID NO: 162031 - DNA, 16 bp, H. sapiens
ttcatgtaacttttat

SEQ ID NO: 162032 - DNA, 16 bp, H. sapiens
ttcatgtaagtggaat

SEQ ID NO: 162033 - DNA, 16 bp, H. sapiens
ttcatgtacaagtttt

SEQ ID NO: 162034 - DNA, 16 bp, H. sapiens
ttcatgtacctgtttg

SEQ ID NO: 162035 - DNA, 16 bp, H. sapiens
ttcatgtatatttatt

SEQ ID NO: 162036 - DNA, 16 bp, H. sapiens
ttcatgtatttatata

SEQ ID NO: 162037 - DNA, 16 bp, H. sapiens
ttcatgtatttcttta

SEQ ID NO: 162038 - DNA, 16 bp, H. sapiens
ttcatgtcatcatttc

SEQ ID NO: 162039 - DNA, 16 bp, H. sapiens
ttcatgtcctctgccc

SEQ ID NO: 162040 - DNA, 17 bp, H. sapiens
ttcatgtcctttgccca

SEQ ID NO: 162041 - DNA, 16 bp, H. sapiens
ttcatgtcctttgtcc

SEQ ID NO: 162042 - DNA, 16 bp, H. sapiens
ttcatgtctctgctca

SEQ ID NO: 162043 - DNA, 16 bp, H. sapiens
ttcatgtcttatattt

SEQ ID NO: 162044 - DNA, 16 bp, H. sapiens
ttcatgtcttccaccc

SEQ ID NO: 162045 - DNA, 16 bp, H. sapiens
ttcatgtcttcttttg

SEQ ID NO: 162046 - DNA, 16 bp, H. sapiens
ttcatgtcttttgctc

SEQ ID NO: 162047 - DNA, 16 bp, H. sapiens
ttcatgtggtgttgag

SEQ ID NO: 162048 - DNA, 16 bp, H. sapiens
ttcatgttaaaaacct

SEQ ID NO: 162049 - DNA, 16 bp, H. sapiens
ttcatgttatctattt

SEQ ID NO: 162050 - DNA, 18 bp, H. sapiens
ttcatgttccatcctgta

SEQ ID NO: 162051 - DNA, 16 bp, H. sapiens
ttcatgttgatatttt

SEQ ID NO: 162052 - DNA, 16 bp, H. sapiens
ttcatgtttataaaat

SEQ ID NO: 162053 - DNA, 16 bp, H. sapiens
ttcatgttttaaaatt

SEQ ID NO: 162054 - DNA, 16 bp, H. sapiens
ttcatgttttcctgga

SEQ ID NO: 162055 - DNA, 16 bp, H. sapiens
ttcattaaaaacaaag

SEQ ID NO: 162056 - DNA, 16 bp, H. sapiens
ttcattaaaaatgaaa

SEQ ID NO: 162057 - DNA, 16 bp, H. sapiens
ttcattaaacaatatt

SEQ ID NO: 162058 - DNA, 16 bp, H. sapiens
ttcattaaagaaaata

SEQ ID NO: 162059 - DNA, 16 bp, H. sapiens
ttcattaaagttaaaa

SEQ ID NO: 162060 - DNA, 16 bp, H. sapiens
ttcattaagaaataaa

SEQ ID NO: 162061 - DNA, 16 bp, H. sapiens
ttcattaagttggact

SEQ ID NO: 162062 - DNA, 16 bp, H. sapiens
ttcattaatgtttatt

SEQ ID NO: 162063 - DNA, 16 bp, H. sapiens
ttcattaatgttttgt

SEQ ID NO: 162064 - DNA, 16 bp, H. sapiens
ttcattaattcaaaaa

SEQ ID NO: 162065 - DNA, 16 bp, H. sapiens
ttcattaattcactca

SEQ ID NO: 162066 - DNA, 16 bp, H. sapiens
ttcattaatttttgaa

SEQ ID NO: 162067 - DNA, 16 bp, H. sapiens
ttcattacacacagcc

SEQ ID NO: 162068 - DNA, 16 bp, H. sapiens
ttcattaccccaaaaa

SEQ ID NO: 162069 - DNA, 16 bp, H. sapiens
ttcattataatttgtt

SEQ ID NO: 162070 - DNA, 16 bp, H. sapiens
ttcattataccattct

SEQ ID NO: 162071 - DNA, 16 bp, H. sapiens
ttcattatataatact

SEQ ID NO: 162072 - DNA, 16 bp, H. sapiens
ttcattatgaaaatat

SEQ ID NO: 162073 - DNA, 16 bp, H. sapiens
ttcattatgaaatatt

SEQ ID NO: 162074 - DNA, 16 bp, H. sapiens
ttcattatgaaatttt

SEQ ID NO: 162075 - DNA, 16 bp, H. sapiens
ttcattattttgattg

SEQ ID NO: 162076 - DNA, 16 bp, H. sapiens
ttcattatttttatag

SEQ ID NO: 162077 - DNA, 16 bp, H. sapiens
ttcattatttttatgg

SEQ ID NO: 162078 - DNA, 16 bp, H. sapiens
ttcattcaacaaacac

SEQ ID NO: 162079 - DNA, 16 bp, H. sapiens
ttcattcaacaaacat

SEQ ID NO: 162080 - DNA, 16 bp, H. sapiens
ttcattcaacaaataa

SEQ ID NO: 162081 - DNA, 16 bp, H. sapiens
ttcattcaacaaatat

SEQ ID NO: 162082 - DNA, 16 bp, H. sapiens
ttcattcaacagatat

SEQ ID NO: 162083 - DNA, 16 bp, H. sapiens
ttcattcaacagtatt

SEQ ID NO: 162084 - DNA, 16 bp, H. sapiens
ttcattcaataaatat

SEQ ID NO: 162085 - DNA, 16 bp, H. sapiens
ttcattcactcactca

SEQ ID NO: 162086 - DNA, 16 bp, H. sapiens
ttcattcactcatttg

SEQ ID NO: 162087 - DNA, 16 bp, H. sapiens
ttcattcacttaacaa

SEQ ID NO: 162088 - DNA, 16 bp, H. sapiens
ttcattcagaaaataa

SEQ ID NO: 162089 - DNA, 16 bp, H. sapiens
ttcattcagcaaatgt

SEQ ID NO: 162090 - DNA, 16 bp, H. sapiens
ttcattcagcaagtat

SEQ ID NO: 162091 - DNA, 16 bp, H. sapiens
ttcattcagtaaatat

SEQ ID NO: 162092 - DNA, 16 bp, H. sapiens
ttcattcagttattca

SEQ ID NO: 162093 - DNA, 16 bp, H. sapiens
ttcattcagttctgct

SEQ ID NO: 162094 - DNA, 16 bp, H. sapiens
ttcattcatcaattta

SEQ ID NO: 162095 - DNA, 16 bp, H. sapiens
ttcattcatccatcag

SEQ ID NO: 162096 - DNA, 16 bp, H. sapiens
ttcattcatccatcca

SEQ ID NO: 162097 - DNA, 16 bp, H. sapiens
ttcattcatcttgagt

SEQ ID NO: 162098 - DNA, 16 bp, H. sapiens
ttcattcatggattca

SEQ ID NO: 162099 - DNA, 16 bp, H. sapiens
ttcattcatgttattg

SEQ ID NO: 162100 - DNA, 16 bp, H. sapiens
ttcattcattcaaaaa

SEQ ID NO: 162101 - DNA, 16 bp, H. sapiens
ttcattcattcaacga

SEQ ID NO: 162102 - DNA, 16 bp, H. sapiens
ttcattcattcaagat

SEQ ID NO: 162103 - DNA, 16 bp, H. sapiens
ttcattcattcaagca

SEQ ID NO: 162104 - DNA, 16 bp, H. sapiens
ttcattcattcactca

SEQ ID NO: 162105 - DNA, 16 bp, H. sapiens
ttcattcattcagcaa

SEQ ID NO: 162106 - DNA, 16 bp, H. sapiens
ttcattcattcatcag

SEQ ID NO: 162107 - DNA, 16 bp, H. sapiens
ttcattcattcattca

SEQ ID NO: 162108 - DNA, 16 bp, H. sapiens
ttcattcattccatct

SEQ ID NO: 162109 - DNA, 16 bp, H. sapiens
ttcattcattcctcca

SEQ ID NO: 162110 - DNA, 16 bp, H. sapiens
ttcattcattctataa

SEQ ID NO: 162111 - DNA, 16 bp, H. sapiens
ttcattcattgaacaa

SEQ ID NO: 162112 - DNA, 16 bp, H. sapiens
ttcattcatttaaaaa

SEQ ID NO: 162113 - DNA, 16 bp, H. sapiens
ttcattcatttagcaa

SEQ ID NO: 162114 - DNA, 16 bp, H. sapiens
ttcattcatttattca

SEQ ID NO: 162115 - DNA, 16 bp, H. sapiens
ttcattcatttcagaa

SEQ ID NO: 162116 - DNA, 16 bp, H. sapiens
ttcattcatttctgtt

SEQ ID NO: 162117 - DNA, 16 bp, H. sapiens
ttcattcatttgttca

SEQ ID NO: 162118 - DNA, 16 bp, H. sapiens
ttcattccattccact

SEQ ID NO: 162119 - DNA, 16 bp, H. sapiens
ttcattccattctatt

SEQ ID NO: 162120 - DNA, 16 bp, H. sapiens
ttcattcctcccagtg

SEQ ID NO: 162121 - DNA, 16 bp, H. sapiens
ttcattcctctccatg

SEQ ID NO: 162122 - DNA, 16 bp, H. sapiens
ttcattccttcaacaa

SEQ ID NO: 162123 - DNA, 16 bp, H. sapiens
ttcattccttcattca

SEQ ID NO: 162124 - DNA, 16 bp, H. sapiens
ttcattcctttgttca

SEQ ID NO: 162125 - DNA, 16 bp, H. sapiens
ttcattccttttattg

SEQ ID NO: 162126 - DNA, 16 bp, H. sapiens
ttcattctacaaatac

SEQ ID NO: 162127 - DNA, 16 bp, H. sapiens
ttcattctctcttgcc

SEQ ID NO: 162128 - DNA, 16 bp, H. sapiens
ttcattctgtttcatt

SEQ ID NO: 162129 - DNA, 16 bp, H. sapiens
ttcattcttctttaaa

SEQ ID NO: 162130 - DNA, 16 bp, H. sapiens
ttcattctttaaaaaa

SEQ ID NO: 162131 - DNA, 16 bp, H. sapiens
ttcattctttataaaa

SEQ ID NO: 162132 - DNA, 16 bp, H. sapiens
ttcattctttcaaaaa

SEQ ID NO: 162133 - DNA, 16 bp, H. sapiens
ttcattctttcaacaa

SEQ ID NO: 162134 - DNA, 16 bp, H. sapiens
ttcattctttcattca

SEQ ID NO: 162135 - DNA, 16 bp, H. sapiens
ttcattgaaaagaaaa

SEQ ID NO: 162136 - DNA, 16 bp, H. sapiens
ttcattgaaattaaaa

SEQ ID NO: 162137 - DNA, 16 bp, H. sapiens
ttcattgaatatttat

SEQ ID NO: 162138 - DNA, 16 bp, H. sapiens
ttcattgagacagagt

SEQ ID NO: 162139 - DNA, 16 bp, H. sapiens
ttcattgatctgtttg

SEQ ID NO: 162140 - DNA, 16 bp, H. sapiens
ttcattgatcttttct

SEQ ID NO: 162141 - DNA, 16 bp, H. sapiens
ttcattgatttctact

SEQ ID NO: 162142 - DNA, 16 bp, H. sapiens
ttcattgattttttca

SEQ ID NO: 162143 - DNA, 16 bp, H. sapiens
ttcattgccatccaga

SEQ ID NO: 162144 - DNA, 17 bp, H. sapiens
ttcattgctcaattaaa

SEQ ID NO: 162145 - DNA, 16 bp, H. sapiens
ttcattgctgaattct

SEQ ID NO: 162146 - DNA, 16 bp, H. sapiens
ttcattggttttctct

SEQ ID NO: 162147 - DNA, 16 bp, H. sapiens
ttcattgtaaaaataa

SEQ ID NO: 162148 - DNA, 16 bp, H. sapiens
ttcattgtagaaaaaa

SEQ ID NO: 162149 - DNA, 16 bp, H. sapiens
ttcattgtatatatgt

SEQ ID NO: 162150 - DNA, 16 bp, H. sapiens
ttcattgtatggatat

SEQ ID NO: 162151 - DNA, 16 bp, H. sapiens
ttcattgtatttcatt

SEQ ID NO: 162152 - DNA, 16 bp, H. sapiens
ttcattgtgctctttg

SEQ ID NO: 162153 - DNA, 16 bp, H. sapiens
ttcattgtggagatct

SEQ ID NO: 162154 - DNA, 16 bp, H. sapiens
ttcattgtggttttaa

SEQ ID NO: 162155 - DNA, 16 bp, H. sapiens
ttcattgtgtatatat

SEQ ID NO: 162156 - DNA, 16 bp, H. sapiens
ttcattgtttcattca

SEQ ID NO: 162157 - DNA, 16 bp, H. sapiens
ttcattgttttaatta

SEQ ID NO: 162158 - DNA, 16 bp, H. sapiens
ttcatttaaaaaagat

SEQ ID NO: 162159 - DNA, 16 bp, H. sapiens
ttcatttaaaaacaat

SEQ ID NO: 162160 - DNA, 16 bp, H. sapiens
ttcatttaaaaatgca

SEQ ID NO: 162161 - DNA, 16 bp, H. sapiens
ttcatttaaaaggaaa

SEQ ID NO: 162162 - DNA, 16 bp, H. sapiens
ttcatttaaaataaca

SEQ ID NO: 162163 - DNA, 16 bp, H. sapiens
ttcatttaaccctcac

SEQ ID NO: 162164 - DNA, 16 bp, H. sapiens
ttcatttaattctcat

SEQ ID NO: 162165 - DNA, 16 bp, H. sapiens
ttcatttacacatttt

SEQ ID NO: 162166 - DNA, 16 bp, H. sapiens
ttcatttacattttca

SEQ ID NO: 162167 - DNA, 16 bp, H. sapiens
ttcatttagcaaatat

SEQ ID NO: 162168 - DNA, 16 bp, H. sapiens
ttcatttataaaacat

SEQ ID NO: 162169 - DNA, 16 bp, H. sapiens
ttcatttatacaaaat

SEQ ID NO: 162170 - DNA, 16 bp, H. sapiens
ttcatttatatgaagt

SEQ ID NO: 162171 - DNA, 16 bp, H. sapiens
ttcatttatccattca

SEQ ID NO: 162172 - DNA, 16 bp, H. sapiens
ttcatttatctattca

SEQ ID NO: 162173 - DNA, 16 bp, H. sapiens
ttcatttatgaatctt

SEQ ID NO: 162174 - DNA, 16 bp, H. sapiens
ttcatttatgtattat

SEQ ID NO: 162175 - DNA, 16 bp, H. sapiens
ttcatttatgtttcag

SEQ ID NO: 162176 - DNA, 16 bp, H. sapiens
ttcatttattcagtca

SEQ ID NO: 162177 - DNA, 16 bp, H. sapiens
ttcatttattcattca

SEQ ID NO: 162178 - DNA, 16 bp, H. sapiens
ttcatttattcattga

SEQ ID NO: 162179 - DNA, 16 bp, H. sapiens
ttcatttattccacaa

SEQ ID NO: 162180 - DNA, 16 bp, H. sapiens
ttcatttattgaggaa

SEQ ID NO: 162181 - DNA, 16 bp, H. sapiens
ttcatttatttactga

SEQ ID NO: 162182 - DNA, 16 bp, H. sapiens
ttcatttatttagttc

SEQ ID NO: 162183 - DNA, 16 bp, H. sapiens
ttcatttatttcaaac

SEQ ID NO: 162184 - DNA, 16 bp, H. sapiens
ttcatttatttggaaa

SEQ ID NO: 162185 - DNA, 16 bp, H. sapiens
ttcatttatttgttca

SEQ ID NO: 162186 - DNA, 16 bp, H. sapiens
ttcatttattttaatg

SEQ ID NO: 162187 - DNA, 16 bp, H. sapiens
ttcatttcagatattg

SEQ ID NO: 162188 - DNA, 16 bp, H. sapiens
ttcatttcagttattt

SEQ ID NO: 162189 - DNA, 16 bp, H. sapiens
ttcatttcattcagca

SEQ ID NO: 162190 - DNA, 16 bp, H. sapiens
ttcatttcatttagtt

SEQ ID NO: 162191 - DNA, 16 bp, H. sapiens
ttcatttcatttcacc

SEQ ID NO: 162192 - DNA, 16 bp, H. sapiens
ttcatttcattttatg

SEQ ID NO: 162193 - DNA, 16 bp, H. sapiens
ttcatttcattttgat

SEQ ID NO: 162194 - DNA, 16 bp, H. sapiens
ttcatttccaaatttt

SEQ ID NO: 162195 - DNA, 16 bp, H. sapiens
ttcatttccattttaa

SEQ ID NO: 162196 - DNA, 16 bp, H. sapiens
ttcatttcctggggct

SEQ ID NO: 162197 - DNA, 16 bp, H. sapiens
ttcatttcctttgaaa

SEQ ID NO: 162198 - DNA, 16 bp, H. sapiens
ttcatttctagaaatt

SEQ ID NO: 162199 - DNA, 16 bp, H. sapiens
ttcatttctcttaaaa

SEQ ID NO: 162200 - DNA, 16 bp, H. sapiens
ttcatttctcttggaa

SEQ ID NO: 162201 - DNA, 16 bp, H. sapiens
ttcatttctgaaattt

SEQ ID NO: 162202 - DNA, 16 bp, H. sapiens
ttcatttctgatattg

SEQ ID NO: 162203 - DNA, 16 bp, H. sapiens
ttcatttcttctgcat

SEQ ID NO: 162204 - DNA, 16 bp, H. sapiens
ttcatttctttcacat

SEQ ID NO: 162205 - DNA, 16 bp, H. sapiens
ttcatttctttgctca

SEQ ID NO: 162206 - DNA, 16 bp, H. sapiens
ttcatttcttttaatg

SEQ ID NO: 162207 - DNA, 16 bp, H. sapiens
ttcatttgaaaaaaaa

SEQ ID NO: 162208 - DNA, 16 bp, H. sapiens
ttcatttgaaaagaaa

SEQ ID NO: 162209 - DNA, 16 bp, H. sapiens
ttcatttgaaattttt

SEQ ID NO: 162210 - DNA, 16 bp, H. sapiens
ttcatttgaataaaaa

SEQ ID NO: 162211 - DNA, 16 bp, H. sapiens
ttcatttgaattttta

SEQ ID NO: 162212 - DNA, 16 bp, H. sapiens
ttcatttgacaagtat

SEQ ID NO: 162213 - DNA, 16 bp, H. sapiens
ttcatttgagatcttt

SEQ ID NO: 162214 - DNA, 16 bp, H. sapiens
ttcatttgatgtattt

SEQ ID NO: 162215 - DNA, 16 bp, H. sapiens
ttcatttgcataaatg

SEQ ID NO: 162216 - DNA, 16 bp, H. sapiens
ttcatttgcatgaaat

SEQ ID NO: 162217 - DNA, 16 bp, H. sapiens
ttcatttgctagggct

SEQ ID NO: 162218 - DNA, 16 bp, H. sapiens
ttcatttggaaaatga

SEQ ID NO: 162219 - DNA, 16 bp, H. sapiens
ttcatttggggaaaaa

SEQ ID NO: 162220 - DNA, 16 bp, H. sapiens
ttcatttgtatttaca

SEQ ID NO: 162221 - DNA, 16 bp, H. sapiens
ttcatttgtattttaa

SEQ ID NO: 162222 - DNA, 16 bp, H. sapiens
ttcatttgtctgttgg

SEQ ID NO: 162223 - DNA, 16 bp, H. sapiens
ttcatttgtgttgtag

SEQ ID NO: 162224 - DNA, 16 bp, H. sapiens
ttcatttgttaattta

SEQ ID NO: 162225 - DNA, 16 bp, H. sapiens
ttcatttgttcatcca

SEQ ID NO: 162226 - DNA, 16 bp, H. sapiens
ttcatttgttcattca

SEQ ID NO: 162227 - DNA, 16 bp, H. sapiens
ttcatttgtttacttg

SEQ ID NO: 162228 - DNA, 16 bp, H. sapiens
ttcatttgtttcaatt

SEQ ID NO: 162229 - DNA, 16 bp, H. sapiens
ttcatttgtttcactt

SEQ ID NO: 162230 - DNA, 16 bp, H. sapiens
ttcattttaaaagaaa

SEQ ID NO: 162231 - DNA, 16 bp, H. sapiens
ttcattttaaaatatg

SEQ ID NO: 162232 - DNA, 16 bp, H. sapiens
ttcattttaaaatgtt

SEQ ID NO: 162233 - DNA, 16 bp, H. sapiens
ttcattttaagaaatt

SEQ ID NO: 162234 - DNA, 16 bp, H. sapiens
ttcattttaatgaaaa

SEQ ID NO: 162235 - DNA, 16 bp, H. sapiens
ttcattttacttgaaa

SEQ ID NO: 162236 - DNA, 16 bp, H. sapiens
ttcattttaggttcag

SEQ ID NO: 162237 - DNA, 16 bp, H. sapiens
ttcattttattctaag

SEQ ID NO: 162238 - DNA, 16 bp, H. sapiens
ttcattttattgcatt

SEQ ID NO: 162239 - DNA, 16 bp, H. sapiens
ttcattttattgtact

SEQ ID NO: 162240 - DNA, 16 bp, H. sapiens
ttcattttcaaaatta

SEQ ID NO: 162241 - DNA, 16 bp, H. sapiens
ttcattttcagtcttt

SEQ ID NO: 162242 - DNA, 16 bp, H. sapiens
ttcattttcatcttca

SEQ ID NO: 162243 - DNA, 16 bp, H. sapiens
ttcattttcattgctg

SEQ ID NO: 162244 - DNA, 16 bp, H. sapiens
ttcattttcatttgtc

SEQ ID NO: 162245 - DNA, 16 bp, H. sapiens
ttcattttccagtttc

SEQ ID NO: 162246 - DNA, 16 bp, H. sapiens
ttcattttcctgtctt

SEQ ID NO: 162247 - DNA, 16 bp, H. sapiens
ttcattttcctttaaa

SEQ ID NO: 162248 - DNA, 16 bp, H. sapiens
ttcattttctacttca

SEQ ID NO: 162249 - DNA, 16 bp, H. sapiens
ttcattttctcattaa

SEQ ID NO: 162250 - DNA, 16 bp, H. sapiens
ttcattttctccaaat

SEQ ID NO: 162251 - DNA, 16 bp, H. sapiens
ttcattttctcttctg

SEQ ID NO: 162252 - DNA, 16 bp, H. sapiens
ttcattttctgagaaa

SEQ ID NO: 162253 - DNA, 16 bp, H. sapiens
ttcattttctgtaatt

SEQ ID NO: 162254 - DNA, 16 bp, H. sapiens
ttcattttctttagat

SEQ ID NO: 162255 - DNA, 16 bp, H. sapiens
ttcattttctttcaaa

SEQ ID NO: 162256 - DNA, 16 bp, H. sapiens
ttcattttctttggaa

SEQ ID NO: 162257 - DNA, 16 bp, H. sapiens
ttcattttctttgggt

SEQ ID NO: 162258 - DNA, 16 bp, H. sapiens
ttcattttgaaaaaga

SEQ ID NO: 162259 - DNA, 16 bp, H. sapiens
ttcattttgaaaatat

SEQ ID NO: 162260 - DNA, 16 bp, H. sapiens
ttcattttgaagaaaa

SEQ ID NO: 162261 - DNA, 16 bp, H. sapiens
ttcattttgatcttgg

SEQ ID NO: 162262 - DNA, 16 bp, H. sapiens
ttcattttgatgctat

SEQ ID NO: 162263 - DNA, 16 bp, H. sapiens
ttcattttggaaaata

SEQ ID NO: 162264 - DNA, 16 bp, H. sapiens
ttcattttggaagaaa

SEQ ID NO: 162265 - DNA, 16 bp, H. sapiens
ttcattttggggtgat

SEQ ID NO: 162266 - DNA, 16 bp, H. sapiens
ttcattttgtaaaaat

SEQ ID NO: 162267 - DNA, 16 bp, H. sapiens
ttcattttgtaaattt

SEQ ID NO: 162268 - DNA, 16 bp, H. sapiens
ttcattttgttgcatt

SEQ ID NO: 162269 - DNA, 16 bp, H. sapiens
ttcatttttaaatgct

SEQ ID NO: 162270 - DNA, 16 bp, H. sapiens
ttcatttttaaatgtt

SEQ ID NO: 162271 - DNA, 16 bp, H. sapiens
ttcatttttaaattgt

SEQ ID NO: 162272 - DNA, 16 bp, H. sapiens
ttcatttttaatgaaa

SEQ ID NO: 162273 - DNA, 16 bp, H. sapiens
ttcatttttaatttag

SEQ ID NO: 162274 - DNA, 16 bp, H. sapiens
ttcatttttacaaata

SEQ ID NO: 162275 - DNA, 16 bp, H. sapiens
ttcatttttagaaagt

SEQ ID NO: 162276 - DNA, 16 bp, H. sapiens
ttcatttttagaattt

SEQ ID NO: 162277 - DNA, 16 bp, H. sapiens
ttcatttttagattgt

SEQ ID NO: 162278 - DNA, 16 bp, H. sapiens
ttcatttttataaagt

SEQ ID NO: 162279 - DNA, 16 bp, H. sapiens
ttcatttttatatatg

SEQ ID NO: 162280 - DNA, 16 bp, H. sapiens
ttcatttttatcaaaa

SEQ ID NO: 162281 - DNA, 16 bp, H. sapiens
ttcatttttcagctcc

SEQ ID NO: 162282 - DNA, 16 bp, H. sapiens
ttcatttttcagtctt

SEQ ID NO: 162283 - DNA, 16 bp, H. sapiens
ttcatttttctaaaaa

SEQ ID NO: 162284 - DNA, 16 bp, H. sapiens
ttcatttttctacata

SEQ ID NO: 162285 - DNA, 16 bp, H. sapiens
ttcatttttctgtgta

SEQ ID NO: 162286 - DNA, 16 bp, H. sapiens
ttcatttttcttgagt

SEQ ID NO: 162287 - DNA, 16 bp, H. sapiens
ttcatttttgaaagat

SEQ ID NO: 162288 - DNA, 16 bp, H. sapiens
ttcatttttgaaaggt

SEQ ID NO: 162289 - DNA, 16 bp, H. sapiens
ttcatttttgagaaaa

SEQ ID NO: 162290 - DNA, 16 bp, H. sapiens
ttcatttttgtaaata

SEQ ID NO: 162291 - DNA, 16 bp, H. sapiens
ttcattttttttaaag

SEQ ID NO: 162292 - DNA, 16 bp, H. sapiens
ttccaaaaaccagagc

SEQ ID NO: 162293 - DNA, 16 bp, H. sapiens
ttccaaaaacttttgg

SEQ ID NO: 162294 - DNA, 16 bp, H. sapiens
ttccaaaaagaaaaga

SEQ ID NO: 162295 - DNA, 16 bp, H. sapiens
ttccaaaaagaaagaa

SEQ ID NO: 162296 - DNA, 16 bp, H. sapiens
ttccaaaacatttcca

SEQ ID NO: 162297 - DNA, 16 bp, H. sapiens
ttccaaaacattttct

SEQ ID NO: 162298 - DNA, 16 bp, H. sapiens
ttccaaaactgaagaa

SEQ ID NO: 162299 - DNA, 16 bp, H. sapiens
ttccaaaaggcagaaa

SEQ ID NO: 162300 - DNA, 16 bp, H. sapiens
ttccaaaagggaaaaa

SEQ ID NO: 162301 - DNA, 16 bp, H. sapiens
ttccaaaagtgctgag

SEQ ID NO: 162302 - DNA, 16 bp, H. sapiens
ttccaaaagttttata

SEQ ID NO: 162303 - DNA, 16 bp, H. sapiens
ttccaaaatactggga

SEQ ID NO: 162304 - DNA, 16 bp, H. sapiens
ttccaaaatatgaaaa

SEQ ID NO: 162305 - DNA, 16 bp, H. sapiens
ttccaaaatcaaatta

SEQ ID NO: 162306 - DNA, 16 bp, H. sapiens
ttccaaaattttgttt

SEQ ID NO: 162307 - DNA, 16 bp, H. sapiens
ttccaaacaacagaaa

SEQ ID NO: 162308 - DNA, 16 bp, H. sapiens
ttccaaacaactgaaa

SEQ ID NO: 162309 - DNA, 16 bp, H. sapiens
ttccaaacagttgaaa

SEQ ID NO: 162310 - DNA, 16 bp, H. sapiens
ttccaaaccatatatt

SEQ ID NO: 162311 - DNA, 16 bp, H. sapiens
ttccaaaccttccctc

SEQ ID NO: 162312 - DNA, 16 bp, H. sapiens
ttccaaactcattcta

SEQ ID NO: 162313 - DNA, 16 bp, H. sapiens
ttccaaactgctggga

SEQ ID NO: 162314 - DNA, 16 bp, H. sapiens
ttccaaactttcagat

SEQ ID NO: 162315 - DNA, 16 bp, H. sapiens
ttccaaacttttcctc

SEQ ID NO: 162316 - DNA, 16 bp, H. sapiens
ttccaaagaaaaagaa

SEQ ID NO: 162317 - DNA, 16 bp, H. sapiens
ttccaaagacagaaaa

SEQ ID NO: 162318 - DNA, 16 bp, H. sapiens
ttccaaagcattttca

SEQ ID NO: 162319 - DNA, 16 bp, H. sapiens
ttccaaaggaaaagaa

SEQ ID NO: 162320 - DNA, 16 bp, H. sapiens
ttccaaaggaacacag

SEQ ID NO: 162321 - DNA, 16 bp, H. sapiens
ttccaaagggaaaaaa

SEQ ID NO: 162322 - DNA, 16 bp, H. sapiens
ttccaaagtcatttcc

SEQ ID NO: 162323 - DNA, 16 bp, H. sapiens
ttccaaagtgccagga

SEQ ID NO: 162324 - DNA, 16 bp, H. sapiens
ttccaaagtggctgca

SEQ ID NO: 162325 - DNA, 16 bp, H. sapiens
ttccaaagtggctgta

SEQ ID NO: 162326 - DNA, 16 bp, H. sapiens
ttccaaagttatggga

SEQ ID NO: 162327 - DNA, 16 bp, H. sapiens
ttccaaataaaatttt

SEQ ID NO: 162328 - DNA, 16 bp, H. sapiens
ttccaaataaattatg

SEQ ID NO: 162329 - DNA, 16 bp, H. sapiens
ttccaaataaatttta

SEQ ID NO: 162330 - DNA, 16 bp, H. sapiens
ttccaaataattttta

SEQ ID NO: 162331 - DNA, 16 bp, H. sapiens
ttccaaataggagaaa

SEQ ID NO: 162332 - DNA, 16 bp, H. sapiens
ttccaaatatacaaaa

SEQ ID NO: 162333 - DNA, 16 bp, H. sapiens
ttccaaatatattatt

SEQ ID NO: 162334 - DNA, 16 bp, H. sapiens
ttccaaatatttatct

SEQ ID NO: 162335 - DNA, 16 bp, H. sapiens
ttccaaatgaagaaaa

SEQ ID NO: 162336 - DNA, 16 bp, H. sapiens
ttccaaatgagaaaaa

SEQ ID NO: 162337 - DNA, 16 bp, H. sapiens
ttccaaattctaaaat

SEQ ID NO: 162338 - DNA, 16 bp, H. sapiens
ttccaaatttaagtca

SEQ ID NO: 162339 - DNA, 16 bp, H. sapiens
ttccaaatttcatttt

SEQ ID NO: 162340 - DNA, 16 bp, H. sapiens
ttccaacactttggaa

SEQ ID NO: 162341 - DNA, 16 bp, H. sapiens
ttccaacacttttgga

SEQ ID NO: 162342 - DNA, 16 bp, H. sapiens
ttccaaccactgggat

SEQ ID NO: 162343 - DNA, 16 bp, H. sapiens
ttccaacctctgccca

SEQ ID NO: 162344 - DNA, 16 bp, H. sapiens
ttccaactatgtggtg

SEQ ID NO: 162345 - DNA, 16 bp, H. sapiens
ttccaactctaaaatt

SEQ ID NO: 162346 - DNA, 16 bp, H. sapiens
ttccaacttctgcctg

SEQ ID NO: 162347 - DNA, 16 bp, H. sapiens
ttccaagaccccagtg

SEQ ID NO: 162348 - DNA, 16 bp, H. sapiens
ttccaagacccccagt

SEQ ID NO: 162349 - DNA, 17 bp, H. sapiens
ttccaagagactttcaa

SEQ ID NO: 162350 - DNA, 16 bp, H. sapiens
ttccaagagttttagg

SEQ ID NO: 162351 - DNA, 16 bp, H. sapiens
ttccaagcagaaggaa

SEQ ID NO: 162352 - DNA, 16 bp, H. sapiens
ttccaagctcattcag

SEQ ID NO: 162353 - DNA, 16 bp, H. sapiens
ttccaagctgtcagac

SEQ ID NO: 162354 - DNA, 16 bp, H. sapiens
ttccaaggctgtttgc

SEQ ID NO: 162355 - DNA, 16 bp, H. sapiens
ttccaagtaactggga

SEQ ID NO: 162356 - DNA, 16 bp, H. sapiens
ttccaagttgtttgct

SEQ ID NO: 162357 - DNA, 16 bp, H. sapiens
ttccaataatggaaca

SEQ ID NO: 162358 - DNA, 18 bp, H. sapiens
ttccaatactatgttgaa

SEQ ID NO: 162359 - DNA, 16 bp, H. sapiens
ttccaatactgtgttg

SEQ ID NO: 162360 - DNA, 16 bp, H. sapiens
ttccaatcaatgaaca

SEQ ID NO: 162361 - DNA, 16 bp, H. sapiens
ttccaatccatgaaca

SEQ ID NO: 162362 - DNA, 16 bp, H. sapiens
ttccaatctgctgaat

SEQ ID NO: 162363 - DNA, 16 bp, H. sapiens
ttccaatgattctcct

SEQ ID NO: 162364 - DNA, 16 bp, H. sapiens
ttccaatgtgcagcca

SEQ ID NO: 162365 - DNA, 16 bp, H. sapiens
ttccaatgtggatgcc

SEQ ID NO: 162366 - DNA, 16 bp, H. sapiens
ttccaatgtggctcag

SEQ ID NO: 162367 - DNA, 16 bp, H. sapiens
ttccaattaccctgat

SEQ ID NO: 162368 - DNA, 16 bp, H. sapiens
ttccaattctgtgaat

SEQ ID NO: 162369 - DNA, 16 bp, H. sapiens
ttccaattttaaaact

SEQ ID NO: 162370 - DNA, 16 bp, H. sapiens
ttccaatttttaaaca

SEQ ID NO: 162371 - DNA, 16 bp, H. sapiens
ttccaattttttaaaa

SEQ ID NO: 162372 - DNA, 16 bp, H. sapiens
ttccacaaaaaataca

SEQ ID NO: 162373 - DNA, 16 bp, H. sapiens
ttccacaaaacactag

SEQ ID NO: 162374 - DNA, 16 bp, H. sapiens
ttccacaaatatttat

SEQ ID NO: 162375 - DNA, 16 bp, H. sapiens
ttccacaagataaaga

SEQ ID NO: 162376 - DNA, 16 bp, H. sapiens
ttccacaaggaatctc

SEQ ID NO: 162377 - DNA, 16 bp, H. sapiens
ttccacaagttacttc

SEQ ID NO: 162378 - DNA, 16 bp, H. sapiens
ttccacaatgcataca

SEQ ID NO: 162379 - DNA, 19 bp, H. sapiens
ttccacaatggttgaacca

SEQ ID NO: 162380 - DNA, 19 bp, H. sapiens
ttccacaatggttgaacta

SEQ ID NO: 162381 - DNA, 16 bp, H. sapiens
ttccacagattttttt

SEQ ID NO: 162382 - DNA, 16 bp, H. sapiens
ttccacagggctggag

SEQ ID NO: 162383 - DNA, 16 bp, H. sapiens
ttccacagtttcacct

SEQ ID NO: 162384 - DNA, 16 bp, H. sapiens
ttccacataaatttta

SEQ ID NO: 162385 - DNA, 16 bp, H. sapiens
ttccacatagagaaaa

SEQ ID NO: 162386 - DNA, 16 bp, H. sapiens
ttccacatatcagtga

SEQ ID NO: 162387 - DNA, 16 bp, H. sapiens
ttccacatcagcctcc

SEQ ID NO: 162388 - DNA, 16 bp, H. sapiens
ttccacatctgcagat

SEQ ID NO: 162389 - DNA, 16 bp, H. sapiens
ttccacatgcaaaaga

SEQ ID NO: 162390 - DNA, 16 bp, H. sapiens
ttccacatgcatttta

SEQ ID NO: 162391 - DNA, 16 bp, H. sapiens
ttccacatggtgttgg

SEQ ID NO: 162392 - DNA, 16 bp, H. sapiens
ttccacattgattttg

SEQ ID NO: 162393 - DNA, 16 bp, H. sapiens
ttccacattttcaggt

SEQ ID NO: 162394 - DNA, 16 bp, H. sapiens
ttccacatttttacaa

SEQ ID NO: 162395 - DNA, 16 bp, H. sapiens
ttccaccataaagaca

SEQ ID NO: 162396 - DNA, 16 bp, H. sapiens
ttccaccatatgagga

SEQ ID NO: 162397 - DNA, 16 bp, H. sapiens
ttccaccatgactgtg

SEQ ID NO: 162398 - DNA, 16 bp, H. sapiens
ttccaccatgtgagga

SEQ ID NO: 162399 - DNA, 16 bp, H. sapiens
ttccacccaaatgtgg

SEQ ID NO: 162400 - DNA, 16 bp, H. sapiens
ttccaccccagcccct

SEQ ID NO: 162401 - DNA, 16 bp, H. sapiens
ttccacccctgacccc

SEQ ID NO: 162402 - DNA, 17 bp, H. sapiens
ttccacccgcctcggcc

SEQ ID NO: 162403 - DNA, 16 bp, H. sapiens
ttccacccgccttggc

SEQ ID NO: 162404 - DNA, 16 bp, H. sapiens
ttccacctcagtcccc

SEQ ID NO: 162405 - DNA, 16 bp, H. sapiens
ttccacctccacacct

SEQ ID NO: 162406 - DNA, 16 bp, H. sapiens
ttccacctcccagatt

SEQ ID NO: 162407 - DNA, 16 bp, H. sapiens
ttccacctctgccacc

SEQ ID NO: 162408 - DNA, 16 bp, H. sapiens
ttccacctctggcccc

SEQ ID NO: 162409 - DNA, 17 bp, H. sapiens
ttccacctgccttggcc

SEQ ID NO: 162410 - DNA, 16 bp, H. sapiens
ttccacctggctgggg

SEQ ID NO: 162411 - DNA, 16 bp, H. sapiens
ttccaccttggcttcc

SEQ ID NO: 162412 - DNA, 16 bp, H. sapiens
ttccaccttttgccta

SEQ ID NO: 162413 - DNA, 16 bp, H. sapiens
ttccacgtggcttggg

SEQ ID NO: 162414 - DNA, 16 bp, H. sapiens
ttccactaattccctt

SEQ ID NO: 162415 - DNA, 16 bp, H. sapiens
ttccactatggtctga

SEQ ID NO: 162416 - DNA, 16 bp, H. sapiens
ttccactcctgccacc

SEQ ID NO: 162417 - DNA, 16 bp, H. sapiens
ttccactctctacttc

SEQ ID NO: 162418 - DNA, 16 bp, H. sapiens
ttccactcttagatat

SEQ ID NO: 162419 - DNA, 16 bp, H. sapiens
ttccactgcaggcacc

SEQ ID NO: 162420 - DNA, 16 bp, H. sapiens
ttccactgtgtgtgtg

SEQ ID NO: 162421 - DNA, 16 bp, H. sapiens
ttccactgttgtctga

SEQ ID NO: 162422 - DNA, 16 bp, H. sapiens
ttccactgtttatttt

SEQ ID NO: 162423 - DNA, 16 bp, H. sapiens
ttccacttaaatgagg

SEQ ID NO: 162424 - DNA, 16 bp, H. sapiens
ttccacttcctgtgtc

SEQ ID NO: 162425 - DNA, 16 bp, H. sapiens
ttccacttctggctat

SEQ ID NO: 162426 - DNA, 16 bp, H. sapiens
ttccacttcttcctgg

SEQ ID NO: 162427 - DNA, 16 bp, H. sapiens
ttccacttgtttattg

SEQ ID NO: 162428 - DNA, 16 bp, H. sapiens
ttccactttttgccca

SEQ ID NO: 162429 - DNA, 16 bp, H. sapiens
ttccagaaaaagaaga

SEQ ID NO: 162430 - DNA, 16 bp, H. sapiens
ttccagaaaacagaaa

SEQ ID NO: 162431 - DNA, 16 bp, H. sapiens
ttccagaaaataaaaa

SEQ ID NO: 162432 - DNA, 16 bp, H. sapiens
ttccagaaaatataaa

SEQ ID NO: 162433 - DNA, 16 bp, H. sapiens
ttccagaaacagagaa

SEQ ID NO: 162434 - DNA, 16 bp, H. sapiens
ttccagaaagaattgg

SEQ ID NO: 162435 - DNA, 16 bp, H. sapiens
ttccagaaagagaaag

SEQ ID NO: 162436 - DNA, 16 bp, H. sapiens
ttccagaaaggattta

SEQ ID NO: 162437 - DNA, 16 bp, H. sapiens
ttccagaaataaaaat

SEQ ID NO: 162438 - DNA, 16 bp, H. sapiens
ttccagaacatttcat

SEQ ID NO: 162439 - DNA, 16 bp, H. sapiens
ttccagaagaaaacag

SEQ ID NO: 162440 - DNA, 16 bp, H. sapiens
ttccagaagaaaacat

SEQ ID NO: 162441 - DNA, 16 bp, H. sapiens
ttccagaagagaaaaa

SEQ ID NO: 162442 - DNA, 16 bp, H. sapiens
ttccagaagagcagag

SEQ ID NO: 162443 - DNA, 16 bp, H. sapiens
ttccagaagattttca

SEQ ID NO: 162444 - DNA, 16 bp, H. sapiens
ttccagaaggagaaga

SEQ ID NO: 162445 - DNA, 16 bp, H. sapiens
ttccagaaggagagaa

SEQ ID NO: 162446 - DNA, 16 bp, H. sapiens
ttccagaatgctggga

SEQ ID NO: 162447 - DNA, 16 bp, H. sapiens
ttccagaatgtaatat

SEQ ID NO: 162448 - DNA, 16 bp, H. sapiens
ttccagaatgtcatgt

SEQ ID NO: 162449 - DNA, 16 bp, H. sapiens
ttccagaattttccat

SEQ ID NO: 162450 - DNA, 17 bp, H. sapiens
ttccagacaccagacca

SEQ ID NO: 162451 - DNA, 16 bp, H. sapiens
ttccagacagaaaatc

SEQ ID NO: 162452 - DNA, 16 bp, H. sapiens
ttccagaccactgcaa

SEQ ID NO: 162453 - DNA, 16 bp, H. sapiens
ttccagaccagcagca

SEQ ID NO: 162454 - DNA, 16 bp, H. sapiens
ttccagaccttgccct

SEQ ID NO: 162455 - DNA, 16 bp, H. sapiens
ttccagacggagtctc

SEQ ID NO: 162456 - DNA, 16 bp, H. sapiens
ttccagactcccagaa

SEQ ID NO: 162457 - DNA, 16 bp, H. sapiens
ttccagagaaagagag

SEQ ID NO: 162458 - DNA, 16 bp, H. sapiens
ttccagagaacagaaa

SEQ ID NO: 162459 - DNA, 16 bp, H. sapiens
ttccagagaagagaaa

SEQ ID NO: 162460 - DNA, 16 bp, H. sapiens
ttccagagagggtcct

SEQ ID NO: 162461 - DNA, 16 bp, H. sapiens
ttccagagattttggt

SEQ ID NO: 162462 - DNA, 16 bp, H. sapiens
ttccagagcttatata

SEQ ID NO: 162463 - DNA, 16 bp, H. sapiens
ttccagaggaagaagc

SEQ ID NO: 162464 - DNA, 16 bp, H. sapiens
ttccagaggagattgg

SEQ ID NO: 162465 - DNA, 16 bp, H. sapiens
ttccagaggctgggaa

SEQ ID NO: 162466 - DNA, 16 bp, H. sapiens
ttccagaggtcacaag

SEQ ID NO: 162467 - DNA, 16 bp, H. sapiens
ttccagagttacttca

SEQ ID NO: 162468 - DNA, 16 bp, H. sapiens
ttccagagtttttttt

SEQ ID NO: 162469 - DNA, 16 bp, H. sapiens
ttccagataaattaaa

SEQ ID NO: 162470 - DNA, 16 bp, H. sapiens
ttccagatgaggaaaa

SEQ ID NO: 162471 - DNA, 16 bp, H. sapiens
ttccagatgcctcctc

SEQ ID NO: 162472 - DNA, 16 bp, H. sapiens
ttccagatttttttct

SEQ ID NO: 162473 - DNA, 16 bp, H. sapiens
ttccagcaaactccaa

SEQ ID NO: 162474 - DNA, 16 bp, H. sapiens
ttccagcaaatctcaa

SEQ ID NO: 162475 - DNA, 16 bp, H. sapiens
ttccagcacttcagga

SEQ ID NO: 162476 - DNA, 16 bp, H. sapiens
ttccagcagagggaac

SEQ ID NO: 162477 - DNA, 16 bp, H. sapiens
ttccagcatttactga

SEQ ID NO: 162478 - DNA, 16 bp, H. sapiens
ttccagccagccacca

SEQ ID NO: 162479 - DNA, 16 bp, H. sapiens
ttccagcccagatact

SEQ ID NO: 162480 - DNA, 16 bp, H. sapiens
ttccagcccatgctga

SEQ ID NO: 162481 - DNA, 16 bp, H. sapiens
ttccagccctgccact

SEQ ID NO: 162482 - DNA, 16 bp, H. sapiens
ttccagcctcagcctt

SEQ ID NO: 162483 - DNA, 16 bp, H. sapiens
ttccagcctccagaac

SEQ ID NO: 162484 - DNA, 16 bp, H. sapiens
ttccagcctccagaag

SEQ ID NO: 162485 - DNA, 16 bp, H. sapiens
ttccagcctccagact

SEQ ID NO: 162486 - DNA, 16 bp, H. sapiens
ttccagcctccaggac

SEQ ID NO: 162487 - DNA, 16 bp, H. sapiens
ttccagcctccctttc

SEQ ID NO: 162488 - DNA, 16 bp, H. sapiens
ttccagcctcctttgc

SEQ ID NO: 162489 - DNA, 16 bp, H. sapiens
ttccagcctgagcaac

SEQ ID NO: 162490 - DNA, 16 bp, H. sapiens
ttccagcctgcagaac

SEQ ID NO: 162491 - DNA, 16 bp, H. sapiens
ttccagcctggacgac

SEQ ID NO: 162492 - DNA, 23 bp, H. sapiens
ttccagcctgggcgacagagcga

SEQ ID NO: 162493 - DNA, 16 bp, H. sapiens
ttccagctccatccct

SEQ ID NO: 162494 - DNA, 16 bp, H. sapiens
ttccagctccccatcc

SEQ ID NO: 162495 - DNA, 16 bp, H. sapiens
ttccagctctgaaatt

SEQ ID NO: 162496 - DNA, 16 bp, H. sapiens
ttccagctctgccact

SEQ ID NO: 162497 - DNA, 16 bp, H. sapiens
ttccagctctgcctcc

SEQ ID NO: 162498 - DNA, 16 bp, H. sapiens
ttccagctctgctgct

SEQ ID NO: 162499 - DNA, 16 bp, H. sapiens
ttccagctgctccagc

SEQ ID NO: 162500 - DNA, 16 bp, H. sapiens
ttccagctgtgcctgc

SEQ ID NO: 162501 - DNA, 23 bp, H. sapiens
ttccagcttcatccatgtccctg

SEQ ID NO: 162502 - DNA, 16 bp, H. sapiens
ttccagcttcatctac

SEQ ID NO: 162503 - DNA, 16 bp, H. sapiens
ttccagcttctagaag

SEQ ID NO: 162504 - DNA, 16 bp, H. sapiens
ttccagcttctagagg

SEQ ID NO: 162505 - DNA, 16 bp, H. sapiens
ttccagctttgtcctt

SEQ ID NO: 162506 - DNA, 16 bp, H. sapiens
ttccagcttttcttct

SEQ ID NO: 162507 - DNA, 16 bp, H. sapiens
ttccaggaagaggaaa

SEQ ID NO: 162508 - DNA, 16 bp, H. sapiens
ttccaggaagagggaa

SEQ ID NO: 162509 - DNA, 16 bp, H. sapiens
ttccaggaatcttcat

SEQ ID NO: 162510 - DNA, 16 bp, H. sapiens
ttccaggaatgcaaag

SEQ ID NO: 162511 - DNA, 16 bp, H. sapiens
ttccaggaattttttt

SEQ ID NO: 162512 - DNA, 16 bp, H. sapiens
ttccaggacctcccac

SEQ ID NO: 162513 - DNA, 16 bp, H. sapiens
ttccaggagacccaaa

SEQ ID NO: 162514 - DNA, 16 bp, H. sapiens
ttccaggagctctggg

SEQ ID NO: 162515 - DNA, 16 bp, H. sapiens
ttccaggaggaagagg

SEQ ID NO: 162516 - DNA, 16 bp, H. sapiens
ttccaggataaaaact

SEQ ID NO: 162517 - DNA, 16 bp, H. sapiens
ttccaggatgcagtga

SEQ ID NO: 162518 - DNA, 16 bp, H. sapiens
ttccaggattctacag

SEQ ID NO: 162519 - DNA, 16 bp, H. sapiens
ttccaggatttgtttt

SEQ ID NO: 162520 - DNA, 16 bp, H. sapiens
ttccaggcaaaaggaa

SEQ ID NO: 162521 - DNA, 16 bp, H. sapiens
ttccaggcaaagggaa

SEQ ID NO: 162522 - DNA, 16 bp, H. sapiens
ttccaggcagagaaaa

SEQ ID NO: 162523 - DNA, 16 bp, H. sapiens
ttccaggcagagggaa

SEQ ID NO: 162524 - DNA, 16 bp, H. sapiens
ttccaggcagtgggtg

SEQ ID NO: 162525 - DNA, 16 bp, H. sapiens
ttccaggccaggtgtg

SEQ ID NO: 162526 - DNA, 16 bp, H. sapiens
ttccaggccctaaaga

SEQ ID NO: 162527 - DNA, 16 bp, H. sapiens
ttccaggccctgttct

SEQ ID NO: 162528 - DNA, 16 bp, H. sapiens
ttccaggccgggcgtg

SEQ ID NO: 162529 - DNA, 16 bp, H. sapiens
ttccaggcctggccca

SEQ ID NO: 162530 - DNA, 16 bp, H. sapiens
ttccaggctctagctc

SEQ ID NO: 162531 - DNA, 16 bp, H. sapiens
ttccaggctgagggaa

SEQ ID NO: 162532 - DNA, 16 bp, H. sapiens
ttccagggattaggat

SEQ ID NO: 162533 - DNA, 16 bp, H. sapiens
ttccagggctggggca

SEQ ID NO: 162534 - DNA, 16 bp, H. sapiens
ttccagggctttatat

SEQ ID NO: 162535 - DNA, 16 bp, H. sapiens
ttccaggggctaatct

SEQ ID NO: 162536 - DNA, 16 bp, H. sapiens
ttccaggggctctggg

SEQ ID NO: 162537 - DNA, 16 bp, H. sapiens
ttccaggtagctggga

SEQ ID NO: 162538 - DNA, 16 bp, H. sapiens
ttccaggtatttgaag

SEQ ID NO: 162539 - DNA, 16 bp, H. sapiens
ttccaggtgattctca

SEQ ID NO: 162540 - DNA, 16 bp, H. sapiens
ttccaggtgctgggga

SEQ ID NO: 162541 - DNA, 16 bp, H. sapiens
ttccaggtggagggaa

SEQ ID NO: 162542 - DNA, 16 bp, H. sapiens
ttccaggtgggcatgg

SEQ ID NO: 162543 - DNA, 16 bp, H. sapiens
ttccaggtgggtgtgg

SEQ ID NO: 162544 - DNA, 16 bp, H. sapiens
ttccagtaaagaaaag

SEQ ID NO: 162545 - DNA, 16 bp, H. sapiens
ttccagtaatggaaca

SEQ ID NO: 162546 - DNA, 16 bp, H. sapiens
ttccagtacctggagg

SEQ ID NO: 162547 - DNA, 16 bp, H. sapiens
ttccagtcctggctct

SEQ ID NO: 162548 - DNA, 16 bp, H. sapiens
ttccagtcttctttat

SEQ ID NO: 162549 - DNA, 16 bp, H. sapiens
ttccagtcttttgcta

SEQ ID NO: 162550 - DNA, 16 bp, H. sapiens
ttccagtggcctggct

SEQ ID NO: 162551 - DNA, 16 bp, H. sapiens
ttccagtgggataaga

SEQ ID NO: 162552 - DNA, 16 bp, H. sapiens
ttccagtgtcatccat

SEQ ID NO: 162553 - DNA, 16 bp, H. sapiens
ttccagtgttctctct

SEQ ID NO: 162554 - DNA, 16 bp, H. sapiens
ttccagttcctgtagc

SEQ ID NO: 162555 - DNA, 16 bp, H. sapiens
ttccagttctcagaag

SEQ ID NO: 162556 - DNA, 16 bp, H. sapiens
ttccagttctcagaga

SEQ ID NO: 162557 - DNA, 16 bp, H. sapiens
ttccagttctcaggga

SEQ ID NO: 162558 - DNA, 16 bp, H. sapiens
ttccagttgattgcat

SEQ ID NO: 162559 - DNA, 16 bp, H. sapiens
ttccagtttaatgaaa

SEQ ID NO: 162560 - DNA, 16 bp, H. sapiens
ttccagtttctctaca

SEQ ID NO: 162561 - DNA, 16 bp, H. sapiens
ttccagtttctctgca

SEQ ID NO: 162562 - DNA, 16 bp, H. sapiens
ttccagtttggggcta

SEQ ID NO: 162563 - DNA, 16 bp, H. sapiens
ttccagtttgtggctt

SEQ ID NO: 162564 - DNA, 16 bp, H. sapiens
ttccagttttattctt

SEQ ID NO: 162565 - DNA, 16 bp, H. sapiens
ttccagttttgttttg

SEQ ID NO: 162566 - DNA, 16 bp, H. sapiens
ttccagtttttcacca

SEQ ID NO: 162567 - DNA, 16 bp, H. sapiens
ttccagtttttctgtt

SEQ ID NO: 162568 - DNA, 16 bp, H. sapiens
ttccagtttttgcctg

SEQ ID NO: 162569 - DNA, 16 bp, H. sapiens
ttccagtttttggcaa

SEQ ID NO: 162570 - DNA, 16 bp, H. sapiens
ttccataaatgtttgt

SEQ ID NO: 162571 - DNA, 16 bp, H. sapiens
ttccatacatatttta

SEQ ID NO: 162572 - DNA, 16 bp, H. sapiens
ttccatagatgtctat

SEQ ID NO: 162573 - DNA, 16 bp, H. sapiens
ttccatataaatttta

SEQ ID NO: 162574 - DNA, 16 bp, H. sapiens
ttccatataactttta

SEQ ID NO: 162575 - DNA, 16 bp, H. sapiens
ttccatatacatttta

SEQ ID NO: 162576 - DNA, 16 bp, H. sapiens
ttccatatgaacttga

SEQ ID NO: 162577 - DNA, 16 bp, H. sapiens
ttccatatgaatttta

SEQ ID NO: 162578 - DNA, 16 bp, H. sapiens
ttccatatggctggga

SEQ ID NO: 162579 - DNA, 16 bp, H. sapiens
ttccatattcatttta

SEQ ID NO: 162580 - DNA, 16 bp, H. sapiens
ttccatatttttaaaa

SEQ ID NO: 162581 - DNA, 16 bp, H. sapiens
ttccatatttttacaa

SEQ ID NO: 162582 - DNA, 16 bp, H. sapiens
ttccatattttttgca

SEQ ID NO: 162583 - DNA, 16 bp, H. sapiens
ttccatcaatacctgg

SEQ ID NO: 162584 - DNA, 16 bp, H. sapiens
ttccatcatgactgta

SEQ ID NO: 162585 - DNA, 16 bp, H. sapiens
ttccatccatgttgcc

SEQ ID NO: 162586 - DNA, 16 bp, H. sapiens
ttccatccctggcccc

SEQ ID NO: 162587 - DNA, 16 bp, H. sapiens
ttccatcccttctgcc

SEQ ID NO: 162588 - DNA, 17 bp, H. sapiens
ttccatctcaaaaaaat

SEQ ID NO: 162589 - DNA, 16 bp, H. sapiens
ttccatctcaaataat

SEQ ID NO: 162590 - DNA, 16 bp, H. sapiens
ttccatctcccaggtt

SEQ ID NO: 162591 - DNA, 16 bp, H. sapiens
ttccatctctgctgct

SEQ ID NO: 162592 - DNA, 16 bp, H. sapiens
ttccatctcttcactt

SEQ ID NO: 162593 - DNA, 16 bp, H. sapiens
ttccatctgcaacttt

SEQ ID NO: 162594 - DNA, 16 bp, H. sapiens
ttccatctgtgttgct

SEQ ID NO: 162595 - DNA, 16 bp, H. sapiens
ttccatcttttggcta

SEQ ID NO: 162596 - DNA, 16 bp, H. sapiens
ttccatgaaaatgaaa

SEQ ID NO: 162597 - DNA, 16 bp, H. sapiens
ttccatgctgtggaag

SEQ ID NO: 162598 - DNA, 16 bp, H. sapiens
ttccatggacattaaa

SEQ ID NO: 162599 - DNA, 16 bp, H. sapiens
ttccatggctccccat

SEQ ID NO: 162600 - DNA, 16 bp, H. sapiens
ttccatgggtttggac

SEQ ID NO: 162601 - DNA, 16 bp, H. sapiens
ttccatggtttcagtt

SEQ ID NO: 162602 - DNA, 16 bp, H. sapiens
ttccatgtaactgtat

SEQ ID NO: 162603 - DNA, 16 bp, H. sapiens
ttccatgtatttttgt

SEQ ID NO: 162604 - DNA, 16 bp, H. sapiens
ttccatgtcaataaat

SEQ ID NO: 162605 - DNA, 16 bp, H. sapiens
ttccatgtcagtacat

SEQ ID NO: 162606 - DNA, 16 bp, H. sapiens
ttccatgtctttgtta

SEQ ID NO: 162607 - DNA, 16 bp, H. sapiens
ttccatgtgaacttta

SEQ ID NO: 162608 - DNA, 16 bp, H. sapiens
ttccatgtgctgttga

SEQ ID NO: 162609 - DNA, 16 bp, H. sapiens
ttccatgtggctgagg

SEQ ID NO: 162610 - DNA, 16 bp, H. sapiens
ttccatgtggtgttaa

SEQ ID NO: 162611 - DNA, 16 bp, H. sapiens
ttccatgtgttttcat

SEQ ID NO: 162612 - DNA, 16 bp, H. sapiens
ttccatgtttttgcaa

SEQ ID NO: 162613 - DNA, 16 bp, H. sapiens
ttccatgtttttgtat

SEQ ID NO: 162614 - DNA, 16 bp, H. sapiens
ttccattatcactgac

SEQ ID NO: 162615 - DNA, 16 bp, H. sapiens
ttccattcaaaatatt

SEQ ID NO: 162616 - DNA, 16 bp, H. sapiens
ttccattcatttccat

SEQ ID NO: 162617 - DNA, 16 bp, H. sapiens
ttccattccattgctt

SEQ ID NO: 162618 - DNA, 16 bp, H. sapiens
ttccattccatttcat

SEQ ID NO: 162619 - DNA, 16 bp, H. sapiens
ttccattcctaggtgt

SEQ ID NO: 162620 - DNA, 16 bp, H. sapiens
ttccattctgtatctt

SEQ ID NO: 162621 - DNA, 16 bp, H. sapiens
ttccattctgtgagat

SEQ ID NO: 162622 - DNA, 16 bp, H. sapiens
ttccattctgttctat

SEQ ID NO: 162623 - DNA, 16 bp, H. sapiens
ttccattgaatatttt

SEQ ID NO: 162624 - DNA, 16 bp, H. sapiens
ttccattgaccttaat

SEQ ID NO: 162625 - DNA, 16 bp, H. sapiens
ttccattgagaagtct

SEQ ID NO: 162626 - DNA, 16 bp, H. sapiens
ttccattgattgattt

SEQ ID NO: 162627 - DNA, 16 bp, H. sapiens
ttccattgatttatgt

SEQ ID NO: 162628 - DNA, 16 bp, H. sapiens
ttccattgtatgaata

SEQ ID NO: 162629 - DNA, 16 bp, H. sapiens
ttccattgtatttata

SEQ ID NO: 162630 - DNA, 16 bp, H. sapiens
ttccattgtgattgga

SEQ ID NO: 162631 - DNA, 16 bp, H. sapiens
ttccattgtgtggata

SEQ ID NO: 162632 - DNA, 16 bp, H. sapiens
ttccattgtgtggatg

SEQ ID NO: 162633 - DNA, 16 bp, H. sapiens
ttccattgttttatat

SEQ ID NO: 162634 - DNA, 16 bp, H. sapiens
ttccatttacaaaata

SEQ ID NO: 162635 - DNA, 16 bp, H. sapiens
ttccatttatatggaa

SEQ ID NO: 162636 - DNA, 16 bp, H. sapiens
ttccatttatgtaaaa

SEQ ID NO: 162637 - DNA, 16 bp, H. sapiens
ttccatttatgtaaag

SEQ ID NO: 162638 - DNA, 16 bp, H. sapiens
ttccatttattttcca

SEQ ID NO: 162639 - DNA, 16 bp, H. sapiens
ttccatttcattttca

SEQ ID NO: 162640 - DNA, 16 bp, H. sapiens
ttccatttctacaaaa

SEQ ID NO: 162641 - DNA, 16 bp, H. sapiens
ttccatttctataaaa

SEQ ID NO: 162642 - DNA, 16 bp, H. sapiens
ttccatttctctggag

SEQ ID NO: 162643 - DNA, 16 bp, H. sapiens
ttccatttctgcaaaa

SEQ ID NO: 162644 - DNA, 16 bp, H. sapiens
ttccatttctgccttt

SEQ ID NO: 162645 - DNA, 16 bp, H. sapiens
ttccatttgaaaatat

SEQ ID NO: 162646 - DNA, 16 bp, H. sapiens
ttccatttgatgatga

SEQ ID NO: 162647 - DNA, 16 bp, H. sapiens
ttccatttgcttcttt

SEQ ID NO: 162648 - DNA, 16 bp, H. sapiens
ttccatttgcttgtgt

SEQ ID NO: 162649 - DNA, 16 bp, H. sapiens
ttccatttgtgtgtgt

SEQ ID NO: 162650 - DNA, 16 bp, H. sapiens
ttccatttgtttatgt

SEQ ID NO: 162651 - DNA, 16 bp, H. sapiens
ttccatttgtttcctt

SEQ ID NO: 162652 - DNA, 16 bp, H. sapiens
ttccatttgtttgtat

SEQ ID NO: 162653 - DNA, 16 bp, H. sapiens
ttccatttgtttgtgt

SEQ ID NO: 162654 - DNA, 16 bp, H. sapiens
ttccatttgttttcaa

SEQ ID NO: 162655 - DNA, 16 bp, H. sapiens
ttccattttaaatttc

SEQ ID NO: 162656 - DNA, 16 bp, H. sapiens
ttccattttcaaaatt

SEQ ID NO: 162657 - DNA, 16 bp, H. sapiens
ttccattttctgtata

SEQ ID NO: 162658 - DNA, 16 bp, H. sapiens
ttccattttgtgtata

SEQ ID NO: 162659 - DNA, 16 bp, H. sapiens
ttccatttttaaaacc

SEQ ID NO: 162660 - DNA, 16 bp, H. sapiens
ttccatttttaaaata

SEQ ID NO: 162661 - DNA, 16 bp, H. sapiens
ttccatttttactaaa

SEQ ID NO: 162662 - DNA, 16 bp, H. sapiens
ttccatttttatgaat

SEQ ID NO: 162663 - DNA, 16 bp, H. sapiens
ttccatttttattcca

SEQ ID NO: 162664 - DNA, 16 bp, H. sapiens
ttccattttttgaaat

SEQ ID NO: 162665 - DNA, 16 bp, H. sapiens
ttcccaaacctagcaa

SEQ ID NO: 162666 - DNA, 16 bp, H. sapiens
ttcccaaagccctggg

SEQ ID NO: 162667 - DNA, 19 bp, H. sapiens
ttcccaaagtgccgggatt

SEQ ID NO: 162668 - DNA, 17 bp, H. sapiens
ttcccaaagtgctgggt

SEQ ID NO: 162669 - DNA, 16 bp, H. sapiens
ttcccaaagttgcaaa

SEQ ID NO: 162670 - DNA, 16 bp, H. sapiens
ttcccaaataaactat

SEQ ID NO: 162671 - DNA, 16 bp, H. sapiens
ttcccaaatccaaaaa

SEQ ID NO: 162672 - DNA, 16 bp, H. sapiens
ttcccaacacaaagat

SEQ ID NO: 162673 - DNA, 16 bp, H. sapiens
ttcccaacactgttta

SEQ ID NO: 162674 - DNA, 16 bp, H. sapiens
ttcccaactcattcta

SEQ ID NO: 162675 - DNA, 16 bp, H. sapiens
ttcccaagcagctgga

SEQ ID NO: 162676 - DNA, 18 bp, H. sapiens
ttcccaagtagctgggac

SEQ ID NO: 162677 - DNA, 16 bp, H. sapiens
ttcccaatctgtatac

SEQ ID NO: 162678 - DNA, 16 bp, H. sapiens
ttcccaatttttaaat

SEQ ID NO: 162679 - DNA, 16 bp, H. sapiens
ttcccacagttctgga

SEQ ID NO: 162680 - DNA, 16 bp, H. sapiens
ttcccacattttcttg

SEQ ID NO: 162681 - DNA, 16 bp, H. sapiens
ttcccaccagcctgat

SEQ ID NO: 162682 - DNA, 16 bp, H. sapiens
ttcccaccctgtgtcc

SEQ ID NO: 162683 - DNA, 16 bp, H. sapiens
ttcccacctcagcccc

SEQ ID NO: 162684 - DNA, 16 bp, H. sapiens
ttcccacctcagcctc

SEQ ID NO: 162685 - DNA, 16 bp, H. sapiens
ttcccacctcagcctt

SEQ ID NO: 162686 - DNA, 16 bp, H. sapiens
ttcccacctcagcttc

SEQ ID NO: 162687 - DNA, 16 bp, H. sapiens
ttcccacctgtaaaat

SEQ ID NO: 162688 - DNA, 16 bp, H. sapiens
ttcccacctgtgaaat

SEQ ID NO: 162689 - DNA, 20 bp, H. sapiens
ttcccacttatgagtgagaa

SEQ ID NO: 162690 - DNA, 16 bp, H. sapiens
ttcccacttcacacct

SEQ ID NO: 162691 - DNA, 16 bp, H. sapiens
ttcccactttcttctg

SEQ ID NO: 162692 - DNA, 16 bp, H. sapiens
ttcccagaagccccca

SEQ ID NO: 162693 - DNA, 16 bp, H. sapiens
ttcccagactcccttg

SEQ ID NO: 162694 - DNA, 16 bp, H. sapiens
ttcccagacttcagaa

SEQ ID NO: 162695 - DNA, 16 bp, H. sapiens
ttcccagagaagcaaa

SEQ ID NO: 162696 - DNA, 16 bp, H. sapiens
ttcccagatgttcttt

SEQ ID NO: 162697 - DNA, 16 bp, H. sapiens
ttcccagcacaaagaa

SEQ ID NO: 162698 - DNA, 17 bp, H. sapiens
ttcccagcactttggga

SEQ ID NO: 162699 - DNA, 16 bp, H. sapiens
ttcccagcattttggg

SEQ ID NO: 162700 - DNA, 16 bp, H. sapiens
ttcccagccagtctct

SEQ ID NO: 162701 - DNA, 16 bp, H. sapiens
ttcccagcctacagaa

SEQ ID NO: 162702 - DNA, 16 bp, H. sapiens
ttcccagcctccagaa

SEQ ID NO: 162703 - DNA, 17 bp, H. sapiens
ttcccagctactctgga

SEQ ID NO: 162704 - DNA, 16 bp, H. sapiens
ttcccagctatggtgg

SEQ ID NO: 162705 - DNA, 16 bp, H. sapiens
ttcccagctcccagaa

SEQ ID NO: 162706 - DNA, 16 bp, H. sapiens
ttcccagctctgtgac

SEQ ID NO: 162707 - DNA, 16 bp, H. sapiens
ttcccagcttcatcca

SEQ ID NO: 162708 - DNA, 16 bp, H. sapiens
ttcccagcttcctccc

SEQ ID NO: 162709 - DNA, 20 bp, H. sapiens
ttcccaggcattgtgaagac

SEQ ID NO: 162710 - DNA, 16 bp, H. sapiens
ttcccaggccctgccc

SEQ ID NO: 162711 - DNA, 16 bp, H. sapiens
ttcccaggctccagtg

SEQ ID NO: 162712 - DNA, 16 bp, H. sapiens
ttcccaggctgggctc

SEQ ID NO: 162713 - DNA, 16 bp, H. sapiens
ttcccaggctggtctg

SEQ ID NO: 162714 - DNA, 16 bp, H. sapiens
ttcccagggcctggca

SEQ ID NO: 162715 - DNA, 16 bp, H. sapiens
ttcccagggtcttggg

SEQ ID NO: 162716 - DNA, 17 bp, H. sapiens
ttcccaggtagctggga

SEQ ID NO: 162717 - DNA, 16 bp, H. sapiens
ttcccaggtgttcttt

SEQ ID NO: 162718 - DNA, 16 bp, H. sapiens
ttcccaggttcaagtg

SEQ ID NO: 162719 - DNA, 16 bp, H. sapiens
ttcccaggttccagcg

SEQ ID NO: 162720 - DNA, 16 bp, H. sapiens
ttcccagtccccagaa

SEQ ID NO: 162721 - DNA, 16 bp, H. sapiens
ttcccagttactcagg

SEQ ID NO: 162722 - DNA, 16 bp, H. sapiens
ttcccagttctaaggc

SEQ ID NO: 162723 - DNA, 16 bp, H. sapiens
ttcccagtttaaaaaa

SEQ ID NO: 162724 - DNA, 16 bp, H. sapiens
ttcccagtttctggta

SEQ ID NO: 162725 - DNA, 16 bp, H. sapiens
ttcccataaagaaaac

SEQ ID NO: 162726 - DNA, 16 bp, H. sapiens
ttcccataatccccac

SEQ ID NO: 162727 - DNA, 16 bp, H. sapiens
ttcccatattttaaaa

SEQ ID NO: 162728 - DNA, 16 bp, H. sapiens
ttcccatctcagcttc

SEQ ID NO: 162729 - DNA, 16 bp, H. sapiens
ttcccatcttacagat

SEQ ID NO: 162730 - DNA, 16 bp, H. sapiens
ttcccatggtcttgag

SEQ ID NO: 162731 - DNA, 16 bp, H. sapiens
ttcccatgttttattt

SEQ ID NO: 162732 - DNA, 16 bp, H. sapiens
ttcccattaaaaaaaa

SEQ ID NO: 162733 - DNA, 16 bp, H. sapiens
ttcccattaatcaaaa

SEQ ID NO: 162734 - DNA, 16 bp, H. sapiens
ttcccatttcaaaagg

SEQ ID NO: 162735 - DNA, 16 bp, H. sapiens
ttcccattttacaaaa

SEQ ID NO: 162736 - DNA, 16 bp, H. sapiens
ttcccattttacagat

SEQ ID NO: 162737 - DNA, 16 bp, H. sapiens
ttccccaaaaacctat

SEQ ID NO: 162738 - DNA, 16 bp, H. sapiens
ttccccaaaactcaac

SEQ ID NO: 162739 - DNA, 16 bp, H. sapiens
ttccccaaagtcttaa

SEQ ID NO: 162740 - DNA, 16 bp, H. sapiens
ttccccaaatatgttt

SEQ ID NO: 162741 - DNA, 19 bp, H. sapiens
ttccccaaattaatacttt

SEQ ID NO: 162742 - DNA, 16 bp, H. sapiens
ttccccaacctagcag

SEQ ID NO: 162743 - DNA, 16 bp, H. sapiens
ttccccacagccttgc

SEQ ID NO: 162744 - DNA, 16 bp, H. sapiens
ttccccacctcagcct

SEQ ID NO: 162745 - DNA, 16 bp, H. sapiens
ttccccagcccctggc

SEQ ID NO: 162746 - DNA, 16 bp, H. sapiens
ttccccagccctgcag

SEQ ID NO: 162747 - DNA, 16 bp, H. sapiens
ttccccagcctagcaa

SEQ ID NO: 162748 - DNA, 16 bp, H. sapiens
ttccccaggaaaattg

SEQ ID NO: 162749 - DNA, 16 bp, H. sapiens
ttccccaggctggagt

SEQ ID NO: 162750 - DNA, 16 bp, H. sapiens
ttccccaggctggtct

SEQ ID NO: 162751 - DNA, 16 bp, H. sapiens
ttccccagtagctgag

SEQ ID NO: 162752 - DNA, 16 bp, H. sapiens
ttccccagtgccagcc

SEQ ID NO: 162753 - DNA, 16 bp, H. sapiens
ttccccataaatttat

SEQ ID NO: 162754 - DNA, 16 bp, H. sapiens
ttccccatccagcttt

SEQ ID NO: 162755 - DNA, 16 bp, H. sapiens
ttccccatccccagta

SEQ ID NO: 162756 - DNA, 16 bp, H. sapiens
ttccccatctgttaaa

SEQ ID NO: 162757 - DNA, 16 bp, H. sapiens
ttccccatctttaaaa

SEQ ID NO: 162758 - DNA, 16 bp, H. sapiens
ttccccatggctgggg

SEQ ID NO: 162759 - DNA, 16 bp, H. sapiens
ttccccatggtcttgg

SEQ ID NO: 162760 - DNA, 16 bp, H. sapiens
ttccccatgtggccct

SEQ ID NO: 162761 - DNA, 16 bp, H. sapiens
ttccccatgtggctct

SEQ ID NO: 162762 - DNA, 16 bp, H. sapiens
ttccccattcagtgtg

SEQ ID NO: 162763 - DNA, 16 bp, H. sapiens
ttccccatttttcaga

SEQ ID NO: 162764 - DNA, 16 bp, H. sapiens
ttcccccaaattattt

SEQ ID NO: 162765 - DNA, 16 bp, H. sapiens
ttcccccaagacagag

SEQ ID NO: 162766 - DNA, 16 bp, H. sapiens
ttcccccagccccagg

SEQ ID NO: 162767 - DNA, 16 bp, H. sapiens
ttcccccaggtgttct

SEQ ID NO: 162768 - DNA, 16 bp, H. sapiens
ttcccccagtccctgg

SEQ ID NO: 162769 - DNA, 17 bp, H. sapiens
ttcccccatactgttct

SEQ ID NO: 162770 - DNA, 16 bp, H. sapiens
ttccccccaacccctg

SEQ ID NO: 162771 - DNA, 16 bp, H. sapiens
ttccccccaaggcaaa

SEQ ID NO: 162772 - DNA, 16 bp, H. sapiens
ttccccccagcccctg

SEQ ID NO: 162773 - DNA, 16 bp, H. sapiens
ttccccctccctgtgt

SEQ ID NO: 162774 - DNA, 16 bp, H. sapiens
ttcccccttcactcag

SEQ ID NO: 162775 - DNA, 16 bp, H. sapiens
ttcccctacctgctcc

SEQ ID NO: 162776 - DNA, 16 bp, H. sapiens
ttcccctacctgtgtc

SEQ ID NO: 162777 - DNA, 16 bp, H. sapiens
ttcccctattattaat

SEQ ID NO: 162778 - DNA, 16 bp, H. sapiens
ttcccctcactgtgtc

SEQ ID NO: 162779 - DNA, 16 bp, H. sapiens
ttcccctccagcccac

SEQ ID NO: 162780 - DNA, 16 bp, H. sapiens
ttcccctcctcccagc

SEQ ID NO: 162781 - DNA, 16 bp, H. sapiens
ttcccctctatttcta

SEQ ID NO: 162782 - DNA, 16 bp, H. sapiens
ttcccctctggcccag

SEQ ID NO: 162783 - DNA, 16 bp, H. sapiens
ttcccctctgtgtcca

SEQ ID NO: 162784 - DNA, 16 bp, H. sapiens
ttcccctctttgtgcc

SEQ ID NO: 162785 - DNA, 16 bp, H. sapiens
ttcccctgaagcaggt

SEQ ID NO: 162786 - DNA, 16 bp, H. sapiens
ttcccctgagtcccca

SEQ ID NO: 162787 - DNA, 16 bp, H. sapiens
ttcccctgccccagcc

SEQ ID NO: 162788 - DNA, 16 bp, H. sapiens
ttcccctgccccattt

SEQ ID NO: 162789 - DNA, 16 bp, H. sapiens
ttcccctgcctcaggc

SEQ ID NO: 162790 - DNA, 16 bp, H. sapiens
ttcccctgcttcagcc

SEQ ID NO: 162791 - DNA, 16 bp, H. sapiens
ttcccctggagcctcc

SEQ ID NO: 162792 - DNA, 16 bp, H. sapiens
ttcccctgtgctctct

SEQ ID NO: 162793 - DNA, 22 bp, H. sapiens
ttccccttcctgtgtccaagtg

SEQ ID NO: 162794 - DNA, 23 bp, H. sapiens
ttccccttcctgtgtccatgtga

SEQ ID NO: 162795 - DNA, 16 bp, H. sapiens
ttccccttctgccatg

SEQ ID NO: 162796 - DNA, 16 bp, H. sapiens
ttcccctttcacttgg

SEQ ID NO: 162797 - DNA, 16 bp, H. sapiens
ttcccctttctgtgtc

SEQ ID NO: 162798 - DNA, 16 bp, H. sapiens
ttcccgggctcaagtg

SEQ ID NO: 162799 - DNA, 16 bp, H. sapiens
ttcccgttttacagat

SEQ ID NO: 162800 - DNA, 16 bp, H. sapiens
ttccctaaacaataca

SEQ ID NO: 162801 - DNA, 16 bp, H. sapiens
ttccctagagcctcca

SEQ ID NO: 162802 - DNA, 16 bp, H. sapiens
ttccctatgaattcat

SEQ ID NO: 162803 - DNA, 16 bp, H. sapiens
ttccctatgttgccca

SEQ ID NO: 162804 - DNA, 16 bp, H. sapiens
ttccctcagcttttgt

SEQ ID NO: 162805 - DNA, 16 bp, H. sapiens
ttccctcagtttttat

SEQ ID NO: 162806 - DNA, 16 bp, H. sapiens
ttccctcatgctgttc

SEQ ID NO: 162807 - DNA, 16 bp, H. sapiens
ttccctcattttacag

SEQ ID NO: 162808 - DNA, 16 bp, H. sapiens
ttccctccacctggaa

SEQ ID NO: 162809 - DNA, 16 bp, H. sapiens
ttccctcccagcctcc

SEQ ID NO: 162810 - DNA, 16 bp, H. sapiens
ttccctccctccagcc

SEQ ID NO: 162811 - DNA, 16 bp, H. sapiens
ttccctccctgtgtcc

SEQ ID NO: 162812 - DNA, 16 bp, H. sapiens
ttccctcctgtgcctg

SEQ ID NO: 162813 - DNA, 16 bp, H. sapiens
ttccctctactcactg

SEQ ID NO: 162814 - DNA, 16 bp, H. sapiens
ttccctctcccagcct

SEQ ID NO: 162815 - DNA, 16 bp, H. sapiens
ttccctctccctggaa

SEQ ID NO: 162816 - DNA, 16 bp, H. sapiens
ttccctctgaagatct

SEQ ID NO: 162817 - DNA, 16 bp, H. sapiens
ttccctctgcactccc

SEQ ID NO: 162818 - DNA, 16 bp, H. sapiens
ttccctctgtacatgt

SEQ ID NO: 162819 - DNA, 16 bp, H. sapiens
ttccctctgtgggtaa

SEQ ID NO: 162820 - DNA, 16 bp, H. sapiens
ttccctcttaggcctc

SEQ ID NO: 162821 - DNA, 16 bp, H. sapiens
ttccctcttcctggaa

SEQ ID NO: 162822 - DNA, 16 bp, H. sapiens
ttccctcttctcccag

SEQ ID NO: 162823 - DNA, 16 bp, H. sapiens
ttccctctttaataaa

SEQ ID NO: 162824 - DNA, 16 bp, H. sapiens
ttccctgaccaccctc

SEQ ID NO: 162825 - DNA, 16 bp, H. sapiens
ttccctgacctcttgc

SEQ ID NO: 162826 - DNA, 16 bp, H. sapiens
ttccctgcattccaga

SEQ ID NO: 162827 - DNA, 16 bp, H. sapiens
ttccctgcattgggtt

SEQ ID NO: 162828 - DNA, 16 bp, H. sapiens
ttccctgccccagccc

SEQ ID NO: 162829 - DNA, 16 bp, H. sapiens
ttccctgcctcagcct

SEQ ID NO: 162830 - DNA, 16 bp, H. sapiens
ttccctgcctccagac

SEQ ID NO: 162831 - DNA, 16 bp, H. sapiens
ttccctgcctctgcct

SEQ ID NO: 162832 - DNA, 16 bp, H. sapiens
ttccctgcttcagcct

SEQ ID NO: 162833 - DNA, 16 bp, H. sapiens
ttccctggaaagcaga

SEQ ID NO: 162834 - DNA, 16 bp, H. sapiens
ttccctggagcctggc

SEQ ID NO: 162835 - DNA, 16 bp, H. sapiens
ttccctggcaccagct

SEQ ID NO: 162836 - DNA, 16 bp, H. sapiens
ttccctggcctcttct

SEQ ID NO: 162837 - DNA, 17 bp, H. sapiens
ttccctgggccacactg

SEQ ID NO: 162838 - DNA, 16 bp, H. sapiens
ttccctgggcctcagt

SEQ ID NO: 162839 - DNA, 16 bp, H. sapiens
ttccctgtctctgtct

SEQ ID NO: 162840 - DNA, 16 bp, H. sapiens
ttccctgtgtcccagc

SEQ ID NO: 162841 - DNA, 16 bp, H. sapiens
ttcccttaaaaaaaaa

SEQ ID NO: 162842 - DNA, 17 bp, H. sapiens
ttcccttcctgtgtcca

SEQ ID NO: 162843 - DNA, 16 bp, H. sapiens
ttcccttctagcccag

SEQ ID NO: 162844 - DNA, 16 bp, H. sapiens
ttcccttctattcctg

SEQ ID NO: 162845 - DNA, 16 bp, H. sapiens
ttcccttctcagcctc

SEQ ID NO: 162846 - DNA, 16 bp, H. sapiens
ttcccttctgtcagat

SEQ ID NO: 162847 - DNA, 16 bp, H. sapiens
ttccctttatatatat

SEQ ID NO: 162848 - DNA, 16 bp, H. sapiens
ttccctttcctggtca

SEQ ID NO: 162849 - DNA, 16 bp, H. sapiens
ttccctttgaaaactt

SEQ ID NO: 162850 - DNA, 16 bp, H. sapiens
ttccctttgaaaattg

SEQ ID NO: 162851 - DNA, 16 bp, H. sapiens
ttccctttgctttcag

SEQ ID NO: 162852 - DNA, 26 bp, H. sapiens
ttccctttgggttccatgttttcctt

SEQ ID NO: 162853 - DNA, 16 bp, H. sapiens
ttccctttggtaggtg

SEQ ID NO: 162854 - DNA, 16 bp, H. sapiens
ttccctttgtgtgtgt

SEQ ID NO: 162855 - DNA, 16 bp, H. sapiens
ttcccttttaaaaatg

SEQ ID NO: 162856 - DNA, 16 bp, H. sapiens
ttcccttttaaaattg

SEQ ID NO: 162857 - DNA, 16 bp, H. sapiens
ttcccttttccatcat

SEQ ID NO: 162858 - DNA, 16 bp, H. sapiens
ttcccttttctaaaat

SEQ ID NO: 162859 - DNA, 16 bp, H. sapiens
ttcccttttctccaca

SEQ ID NO: 162860 - DNA, 16 bp, H. sapiens
ttcccttttctccatg

SEQ ID NO: 162861 - DNA, 16 bp, H. sapiens
ttcccttttctctgta

SEQ ID NO: 162862 - DNA, 16 bp, H. sapiens
ttccctttttccacat

SEQ ID NO: 162863 - DNA, 16 bp, H. sapiens
ttccgccatgattctg

SEQ ID NO: 162864 - DNA, 16 bp, H. sapiens
ttccgcctcagcctcc

SEQ ID NO: 162865 - DNA, 16 bp, H. sapiens
ttccggccgggcgcgg

SEQ ID NO: 162866 - DNA, 16 bp, H. sapiens
ttcctaaaaaggaaaa

SEQ ID NO: 162867 - DNA, 16 bp, H. sapiens
ttcctaaactttctta

SEQ ID NO: 162868 - DNA, 16 bp, H. sapiens
ttcctaaagtgctgag

SEQ ID NO: 162869 - DNA, 16 bp, H. sapiens
ttcctaaatatttaat

SEQ ID NO: 162870 - DNA, 16 bp, H. sapiens
ttcctaacaggccaca

SEQ ID NO: 162871 - DNA, 16 bp, H. sapiens
ttcctaacaggtcatg

SEQ ID NO: 162872 - DNA, 16 bp, H. sapiens
ttcctaacatcagaat

SEQ ID NO: 162873 - DNA, 16 bp, H. sapiens
ttcctaagtttttgtt

SEQ ID NO: 162874 - DNA, 16 bp, H. sapiens
ttcctaatattttgtt

SEQ ID NO: 162875 - DNA, 16 bp, H. sapiens
ttcctaatgattaatg

SEQ ID NO: 162876 - DNA, 16 bp, H. sapiens
ttcctacacattttca

SEQ ID NO: 162877 - DNA, 16 bp, H. sapiens
ttcctactgactggga

SEQ ID NO: 162878 - DNA, 16 bp, H. sapiens
ttcctagaggaggtga

SEQ ID NO: 162879 - DNA, 16 bp, H. sapiens
ttcctagatatttgat

SEQ ID NO: 162880 - DNA, 16 bp, H. sapiens
ttcctagccaaggaaa

SEQ ID NO: 162881 - DNA, 16 bp, H. sapiens
ttcctagcctccaaaa

SEQ ID NO: 162882 - DNA, 17 bp, H. sapiens
ttcctagggggcaagaa

SEQ ID NO: 162883 - DNA, 16 bp, H. sapiens
ttcctaggtattattt

SEQ ID NO: 162884 - DNA, 16 bp, H. sapiens
ttcctaggtgatgctg

SEQ ID NO: 162885 - DNA, 16 bp, H. sapiens
ttcctagtctttgcta

SEQ ID NO: 162886 - DNA, 16 bp, H. sapiens
ttcctatcaaaatctc

SEQ ID NO: 162887 - DNA, 16 bp, H. sapiens
ttcctatccttgagca

SEQ ID NO: 162888 - DNA, 16 bp, H. sapiens
ttcctatgtcctgaat

SEQ ID NO: 162889 - DNA, 16 bp, H. sapiens
ttcctatgttttcttc

SEQ ID NO: 162890 - DNA, 16 bp, H. sapiens
ttcctattaatgataa

SEQ ID NO: 162891 - DNA, 16 bp, H. sapiens
ttcctattgatggaca

SEQ ID NO: 162892 - DNA, 16 bp, H. sapiens
ttcctattgctactgt

SEQ ID NO: 162893 - DNA, 16 bp, H. sapiens
ttcctatttggatgcc

SEQ ID NO: 162894 - DNA, 16 bp, H. sapiens
ttcctattttgattaa

SEQ ID NO: 162895 - DNA, 16 bp, H. sapiens
ttcctcaaacaaaaca

SEQ ID NO: 162896 - DNA, 16 bp, H. sapiens
ttcctcaaagagctaa

SEQ ID NO: 162897 - DNA, 16 bp, H. sapiens
ttcctcaactccatct

SEQ ID NO: 162898 - DNA, 16 bp, H. sapiens
ttcctcaagaagagca

SEQ ID NO: 162899 - DNA, 43 bp, H. sapiens
ttcctcaaggacttaacttgtgcaagctgactcccagcacatc

SEQ ID NO: 162900 - DNA, 16 bp, H. sapiens
ttcctcacagcacagt

SEQ ID NO: 162901 - DNA, 16 bp, H. sapiens
ttcctcacctctcagc

SEQ ID NO: 162902 - DNA, 16 bp, H. sapiens
ttcctcacctgtaata

SEQ ID NO: 162903 - DNA, 16 bp, H. sapiens
ttcctcacctgtgaaa

SEQ ID NO: 162904 - DNA, 16 bp, H. sapiens
ttcctcactgtgtgtt

SEQ ID NO: 162905 - DNA, 16 bp, H. sapiens
ttcctcacttgtgaaa

SEQ ID NO: 162906 - DNA, 16 bp, H. sapiens
ttcctcagcaaggcca

SEQ ID NO: 162907 - DNA, 16 bp, H. sapiens
ttcctcagcagaaacc

SEQ ID NO: 162908 - DNA, 19 bp, H. sapiens
ttcctcagcatccacaggt

SEQ ID NO: 162909 - DNA, 16 bp, H. sapiens
ttcctcagcctccgct

SEQ ID NO: 162910 - DNA, 16 bp, H. sapiens
ttcctcagcctctgct

SEQ ID NO: 162911 - DNA, 16 bp, H. sapiens
ttcctcagctgtgtcc

SEQ ID NO: 162912 - DNA, 16 bp, H. sapiens
ttcctcagcttttctt

SEQ ID NO: 162913 - DNA, 16 bp, H. sapiens
ttcctcaggaacatca

SEQ ID NO: 162914 - DNA, 16 bp, H. sapiens
ttcctcaggattttct

SEQ ID NO: 162915 - DNA, 16 bp, H. sapiens
ttcctcagggaaacct

SEQ ID NO: 162916 - DNA, 16 bp, H. sapiens
ttcctcagggacagtt

SEQ ID NO: 162917 - DNA, 16 bp, H. sapiens
ttcctcagtatccaca

SEQ ID NO: 162918 - DNA, 16 bp, H. sapiens
ttcctcagtgttttat

SEQ ID NO: 162919 - DNA, 16 bp, H. sapiens
ttcctcagttgcacta

SEQ ID NO: 162920 - DNA, 16 bp, H. sapiens
ttcctcagtttcctca

SEQ ID NO: 162921 - DNA, 16 bp, H. sapiens
ttcctcagtttctcca

SEQ ID NO: 162922 - DNA, 16 bp, H. sapiens
ttcctcagtttcttca

SEQ ID NO: 162923 - DNA, 16 bp, H. sapiens
ttcctcatagttgttt

SEQ ID NO: 162924 - DNA, 16 bp, H. sapiens
ttcctcatccatgaaa

SEQ ID NO: 162925 - DNA, 16 bp, H. sapiens
ttcctcatccccagtc

SEQ ID NO: 162926 - DNA, 16 bp, H. sapiens
ttcctcatctccatcc

SEQ ID NO: 162927 - DNA, 16 bp, H. sapiens
ttcctcatctgtaaaa

SEQ ID NO: 162928 - DNA, 16 bp, H. sapiens
ttcctcatcttcatct

SEQ ID NO: 162929 - DNA, 16 bp, H. sapiens
ttcctcatcttcctgt

SEQ ID NO: 162930 - DNA, 16 bp, H. sapiens
ttcctcatcttttaca

SEQ ID NO: 162931 - DNA, 16 bp, H. sapiens
ttcctcatggcttccc

SEQ ID NO: 162932 - DNA, 16 bp, H. sapiens
ttcctcatgtgcaaaa

SEQ ID NO: 162933 - DNA, 16 bp, H. sapiens
ttcctcattgataaaa

SEQ ID NO: 162934 - DNA, 16 bp, H. sapiens
ttcctcattgcttgct

SEQ ID NO: 162935 - DNA, 16 bp, H. sapiens
ttcctcatttccacct

SEQ ID NO: 162936 - DNA, 16 bp, H. sapiens
ttcctcatttgtgaaa

SEQ ID NO: 162937 - DNA, 16 bp, H. sapiens
ttcctccaagaagcct

SEQ ID NO: 162938 - DNA, 16 bp, H. sapiens
ttcctccaccagggag

SEQ ID NO: 162939 - DNA, 16 bp, H. sapiens
ttcctccacctttctg

SEQ ID NO: 162940 - DNA, 16 bp, H. sapiens
ttcctccatgattgtg

SEQ ID NO: 162941 - DNA, 16 bp, H. sapiens
ttcctccatgtctttt

SEQ ID NO: 162942 - DNA, 16 bp, H. sapiens
ttcctccatgttttct

SEQ ID NO: 162943 - DNA, 16 bp, H. sapiens
ttcctcccacattcca

SEQ ID NO: 162944 - DNA, 20 bp, H. sapiens
ttcctcccacctcagcctcc

SEQ ID NO: 162945 - DNA, 16 bp, H. sapiens
ttcctcccagaggggc

SEQ ID NO: 162946 - DNA, 16 bp, H. sapiens
ttcctcccatccagag

SEQ ID NO: 162947 - DNA, 16 bp, H. sapiens
ttcctcccctccagag

SEQ ID NO: 162948 - DNA, 16 bp, H. sapiens
ttcctcccggtgggtt

SEQ ID NO: 162949 - DNA, 16 bp, H. sapiens
ttcctcctcagcactc

SEQ ID NO: 162950 - DNA, 16 bp, H. sapiens
ttcctcctcagcctcc

SEQ ID NO: 162951 - DNA, 16 bp, H. sapiens
ttcctcctcagtctcc

SEQ ID NO: 162952 - DNA, 16 bp, H. sapiens
ttcctcctcccccagc

SEQ ID NO: 162953 - DNA, 16 bp, H. sapiens
ttcctcctcctcatca

SEQ ID NO: 162954 - DNA, 16 bp, H. sapiens
ttcctcctcctccagc

SEQ ID NO: 162955 - DNA, 16 bp, H. sapiens
ttcctcctcctcccag

SEQ ID NO: 162956 - DNA, 16 bp, H. sapiens
ttcctcctcctgctgc

SEQ ID NO: 162957 - DNA, 16 bp, H. sapiens
ttcctcctctataaaa

SEQ ID NO: 162958 - DNA, 16 bp, H. sapiens
ttcctcctctgtaaaa

SEQ ID NO: 162959 - DNA, 16 bp, H. sapiens
ttcctcctgcccttgg

SEQ ID NO: 162960 - DNA, 16 bp, H. sapiens
ttcctcctgctccagc

SEQ ID NO: 162961 - DNA, 16 bp, H. sapiens
ttcctcctgggcctcc

SEQ ID NO: 162962 - DNA, 16 bp, H. sapiens
ttcctcctgtctaact

SEQ ID NO: 162963 - DNA, 16 bp, H. sapiens
ttcctccttctctggc

SEQ ID NO: 162964 - DNA, 16 bp, H. sapiens
ttcctcggcctcccaa

SEQ ID NO: 162965 - DNA, 16 bp, H. sapiens
ttcctctaaacttctc

SEQ ID NO: 162966 - DNA, 16 bp, H. sapiens
ttcctctaacattttt

SEQ ID NO: 162967 - DNA, 16 bp, H. sapiens
ttcctctacctttttg

SEQ ID NO: 162968 - DNA, 16 bp, H. sapiens
ttcctctagaatttgg

SEQ ID NO: 162969 - DNA, 16 bp, H. sapiens
ttcctctagcaccact

SEQ ID NO: 162970 - DNA, 16 bp, H. sapiens
ttcctctagtgaagat

SEQ ID NO: 162971 - DNA, 16 bp, H. sapiens
ttcctctccagctgtg

SEQ ID NO: 162972 - DNA, 16 bp, H. sapiens
ttcctctctgagcctc

SEQ ID NO: 162973 - DNA, 16 bp, H. sapiens
ttcctctgatagatct

SEQ ID NO: 162974 - DNA, 21 bp, H. sapiens
ttcctctgcacaataaaactt

SEQ ID NO: 162975 - DNA, 16 bp, H. sapiens
ttcctctgcacatgct

SEQ ID NO: 162976 - DNA, 16 bp, H. sapiens
ttcctctgccatggct

SEQ ID NO: 162977 - DNA, 16 bp, H. sapiens
ttcctctgcctgaaat

SEQ ID NO: 162978 - DNA, 16 bp, H. sapiens
ttcctctgcctttctg

SEQ ID NO: 162979 - DNA, 16 bp, H. sapiens
ttcctctgctgcctct

SEQ ID NO: 162980 - DNA, 16 bp, H. sapiens
ttcctctgctttttca

SEQ ID NO: 162981 - DNA, 16 bp, H. sapiens
ttcctctggagcctca

SEQ ID NO: 162982 - DNA, 16 bp, H. sapiens
ttcctctgtctggaat

SEQ ID NO: 162983 - DNA, 16 bp, H. sapiens
ttcctctgttgcccag

SEQ ID NO: 162984 - DNA, 16 bp, H. sapiens
ttcctctgttgtcatc

SEQ ID NO: 162985 - DNA, 16 bp, H. sapiens
ttcctcttaggcctct

SEQ ID NO: 162986 - DNA, 16 bp, H. sapiens
ttcctcttcaaaggtt

SEQ ID NO: 162987 - DNA, 16 bp, H. sapiens
ttcctcttcagtaaaa

SEQ ID NO: 162988 - DNA, 16 bp, H. sapiens
ttcctcttcagttttt

SEQ ID NO: 162989 - DNA, 16 bp, H. sapiens
ttcctctttggcctcc

SEQ ID NO: 162990 - DNA, 16 bp, H. sapiens
ttcctcttttactaat

SEQ ID NO: 162991 - DNA, 16 bp, H. sapiens
ttcctcttttccaact

SEQ ID NO: 162992 - DNA, 16 bp, H. sapiens
ttcctcttttccagtt

SEQ ID NO: 162993 - DNA, 16 bp, H. sapiens
ttcctcttttcctgat

SEQ ID NO: 162994 - DNA, 16 bp, H. sapiens
ttcctgaaaagaaaaa

SEQ ID NO: 162995 - DNA, 16 bp, H. sapiens
ttcctgaaaataaaat

SEQ ID NO: 162996 - DNA, 16 bp, H. sapiens
ttcctgaaccaatcac

SEQ ID NO: 162997 - DNA, 16 bp, H. sapiens
ttcctgaaccacaaac

SEQ ID NO: 162998 - DNA, 16 bp, H. sapiens
ttcctgaagaagagaa

SEQ ID NO: 162999 - DNA, 16 bp, H. sapiens
ttcctgaaggacctgc

SEQ ID NO: 163000 - DNA, 16 bp, H. sapiens
ttcctgaaggaggtgg

SEQ ID NO: 163001 - DNA, 16 bp, H. sapiens
ttcctgaaggatctgg

SEQ ID NO: 163002 - DNA, 16 bp, H. sapiens
ttcctgaagtcagtga

SEQ ID NO: 163003 - DNA, 16 bp, H. sapiens
ttcctgaagttgtgat

SEQ ID NO: 163004 - DNA, 16 bp, H. sapiens
ttcctgaatatagcac

SEQ ID NO: 163005 - DNA, 16 bp, H. sapiens
ttcctgaattaaaaaa

SEQ ID NO: 163006 - DNA, 16 bp, H. sapiens
ttcctgaattatttca

SEQ ID NO: 163007 - DNA, 16 bp, H. sapiens
ttcctgacacctggct

SEQ ID NO: 163008 - DNA, 16 bp, H. sapiens
ttcctgacattgccat

SEQ ID NO: 163009 - DNA, 16 bp, H. sapiens
ttcctgacccacagaa

SEQ ID NO: 163010 - DNA, 17 bp, H. sapiens
ttcctgacctcgtgatc

SEQ ID NO: 163011 - DNA, 17 bp, H. sapiens
ttcctgaccttgtgatc

SEQ ID NO: 163012 - DNA, 16 bp, H. sapiens
ttcctgactcacagaa

SEQ ID NO: 163013 - DNA, 16 bp, H. sapiens
ttcctgactcagcctc

SEQ ID NO: 163014 - DNA, 16 bp, H. sapiens
ttcctgactctcagaa

SEQ ID NO: 163015 - DNA, 16 bp, H. sapiens
ttcctgacttttaaaa

SEQ ID NO: 163016 - DNA, 16 bp, H. sapiens
ttcctgagaaggaaaa

SEQ ID NO: 163017 - DNA, 16 bp, H. sapiens
ttcctgagcagctggg

SEQ ID NO: 163018 - DNA, 16 bp, H. sapiens
ttcctgagctcaggtg

SEQ ID NO: 163019 - DNA, 16 bp, H. sapiens
ttcctgaggaagaaaa

SEQ ID NO: 163020 - DNA, 16 bp, H. sapiens
ttcctgaggaagaaga

SEQ ID NO: 163021 - DNA, 16 bp, H. sapiens
ttcctgaggacttccc

SEQ ID NO: 163022 - DNA, 16 bp, H. sapiens
ttcctgaggcctcagc

SEQ ID NO: 163023 - DNA, 16 bp, H. sapiens
ttcctgaggcctcgcc

SEQ ID NO: 163024 - DNA, 16 bp, H. sapiens
ttcctgaggcctctgc

SEQ ID NO: 163025 - DNA, 16 bp, H. sapiens
ttcctgaggctctcac

SEQ ID NO: 163026 - DNA, 17 bp, H. sapiens
ttcctgaggcttcccca

SEQ ID NO: 163027 - DNA, 16 bp, H. sapiens
ttcctgaggcttccct

SEQ ID NO: 163028 - DNA, 16 bp, H. sapiens
ttcctgagggctctgt

SEQ ID NO: 163029 - DNA, 16 bp, H. sapiens
ttcctgaggggtctgg

SEQ ID NO: 163030 - DNA, 16 bp, H. sapiens
ttcctgaggtctcccc

SEQ ID NO: 163031 - DNA, 16 bp, H. sapiens
ttcctgagtcctcacc

SEQ ID NO: 163032 - DNA, 16 bp, H. sapiens
ttcctgagtctcagtt

SEQ ID NO: 163033 - DNA, 16 bp, H. sapiens
ttcctgagtgtgtctg

SEQ ID NO: 163034 - DNA, 18 bp, H. sapiens
ttcctgagttcaagcgat

SEQ ID NO: 163035 - DNA, 16 bp, H. sapiens
ttcctgatccaggaga

SEQ ID NO: 163036 - DNA, 16 bp, H. sapiens
ttcctgatcctctttc

SEQ ID NO: 163037 - DNA, 16 bp, H. sapiens
ttcctgatctcatgat

SEQ ID NO: 163038 - DNA, 16 bp, H. sapiens
ttcctgatgtttgata

SEQ ID NO: 163039 - DNA, 16 bp, H. sapiens
ttcctgattattttta

SEQ ID NO: 163040 - DNA, 16 bp, H. sapiens
ttcctgatttcaaact

SEQ ID NO: 163041 - DNA, 16 bp, H. sapiens
ttcctgatttggctct

SEQ ID NO: 163042 - DNA, 16 bp, H. sapiens
ttcctgatttttaaaa

SEQ ID NO: 163043 - DNA, 16 bp, H. sapiens
ttcctgccacagggcc

SEQ ID NO: 163044 - DNA, 16 bp, H. sapiens
ttcctgccccacccca

SEQ ID NO: 163045 - DNA, 16 bp, H. sapiens
ttcctgccccagccct

SEQ ID NO: 163046 - DNA, 16 bp, H. sapiens
ttcctgccccagcctc

SEQ ID NO: 163047 - DNA, 16 bp, H. sapiens
ttcctgcctaggcctc

SEQ ID NO: 163048 - DNA, 16 bp, H. sapiens
ttcctgcctcagcatc

SEQ ID NO: 163049 - DNA, 16 bp, H. sapiens
ttcctgcctcagcctc

SEQ ID NO: 163050 - DNA, 16 bp, H. sapiens
ttcctgcctcagcctt

SEQ ID NO: 163051 - DNA, 16 bp, H. sapiens
ttcctgcctcagcttc

SEQ ID NO: 163052 - DNA, 16 bp, H. sapiens
ttcctgcctcatcctc

SEQ ID NO: 163053 - DNA, 16 bp, H. sapiens
ttcctgcctcctccag

SEQ ID NO: 163054 - DNA, 16 bp, H. sapiens
ttcctgcctctgtgtc

SEQ ID NO: 163055 - DNA, 16 bp, H. sapiens
ttcctgcctgccggct

SEQ ID NO: 163056 - DNA, 16 bp, H. sapiens
ttcctgcctgccttct

SEQ ID NO: 163057 - DNA, 16 bp, H. sapiens
ttcctgcctgtctccc

SEQ ID NO: 163058 - DNA, 16 bp, H. sapiens
ttcctgccttcaagga

SEQ ID NO: 163059 - DNA, 16 bp, H. sapiens
ttcctgccttcagact

SEQ ID NO: 163060 - DNA, 16 bp, H. sapiens
ttcctgccttggcctc

SEQ ID NO: 163061 - DNA, 16 bp, H. sapiens
ttcctgcggcctcccc

SEQ ID NO: 163062 - DNA, 16 bp, H. sapiens
ttcctgcgttaattca

SEQ ID NO: 163063 - DNA, 16 bp, H. sapiens
ttcctgctgaccttct

SEQ ID NO: 163064 - DNA, 16 bp, H. sapiens
ttcctgctgcctgcag

SEQ ID NO: 163065 - DNA, 16 bp, H. sapiens
ttcctgctgctgtaac

SEQ ID NO: 163066 - DNA, 16 bp, H. sapiens
ttcctgctgcttcctc

SEQ ID NO: 163067 - DNA, 16 bp, H. sapiens
ttcctgcttcagcctc

SEQ ID NO: 163068 - DNA, 16 bp, H. sapiens
ttcctgcttcctcttg

SEQ ID NO: 163069 - DNA, 16 bp, H. sapiens
ttcctgctttagtctt

SEQ ID NO: 163070 - DNA, 16 bp, H. sapiens
ttcctggaaaaacaca

SEQ ID NO: 163071 - DNA, 16 bp, H. sapiens
ttcctggaagaaaaca

SEQ ID NO: 163072 - DNA, 16 bp, H. sapiens
ttcctggaatgcaagg

SEQ ID NO: 163073 - DNA, 16 bp, H. sapiens
ttcctggacacagaca

SEQ ID NO: 163074 - DNA, 16 bp, H. sapiens
ttcctggacacatcca

SEQ ID NO: 163075 - DNA, 16 bp, H. sapiens
ttcctggacacctaca

SEQ ID NO: 163076 - DNA, 16 bp, H. sapiens
ttcctggacctgtgaa

SEQ ID NO: 163077 - DNA, 16 bp, H. sapiens
ttcctggagaaagtga

SEQ ID NO: 163078 - DNA, 16 bp, H. sapiens
ttcctggagcagcttg

SEQ ID NO: 163079 - DNA, 16 bp, H. sapiens
ttcctggaggagatga

SEQ ID NO: 163080 - DNA, 16 bp, H. sapiens
ttcctggaggaggaga

SEQ ID NO: 163081 - DNA, 16 bp, H. sapiens
ttcctggaggaggagg

SEQ ID NO: 163082 - DNA, 16 bp, H. sapiens
ttcctggaggccttcc

SEQ ID NO: 163083 - DNA, 16 bp, H. sapiens
ttcctggaggctttgt

SEQ ID NO: 163084 - DNA, 16 bp, H. sapiens
ttcctggatgccagac

SEQ ID NO: 163085 - DNA, 16 bp, H. sapiens
ttcctggatgtgggac

SEQ ID NO: 163086 - DNA, 16 bp, H. sapiens
ttcctggattcaagtg

SEQ ID NO: 163087 - DNA, 16 bp, H. sapiens
ttcctggattttcttt

SEQ ID NO: 163088 - DNA, 16 bp, H. sapiens
ttcctggcaaagggaa

SEQ ID NO: 163089 - DNA, 16 bp, H. sapiens
ttcctggcacacagct

SEQ ID NO: 163090 - DNA, 16 bp, H. sapiens
ttcctggcacagagct

SEQ ID NO: 163091 - DNA, 16 bp, H. sapiens
ttcctggcagagagaa

SEQ ID NO: 163092 - DNA, 16 bp, H. sapiens
ttcctggccctgttct

SEQ ID NO: 163093 - DNA, 16 bp, H. sapiens
ttcctggcctccaccc

SEQ ID NO: 163094 - DNA, 16 bp, H. sapiens
ttcctggcctcttcca

SEQ ID NO: 163095 - DNA, 21 bp, H. sapiens
ttcctggctaacacggtgaaa

SEQ ID NO: 163096 - DNA, 16 bp, H. sapiens
ttcctggctcagcctc

SEQ ID NO: 163097 - DNA, 16 bp, H. sapiens
ttcctggctcctcagc

SEQ ID NO: 163098 - DNA, 16 bp, H. sapiens
ttcctggctgtggtca

SEQ ID NO: 163099 - DNA, 16 bp, H. sapiens
ttcctgggctcaagca

SEQ ID NO: 163100 - DNA, 19 bp, H. sapiens
ttcctgggctcaagtgatc

SEQ ID NO: 163101 - DNA, 16 bp, H. sapiens
ttcctggggcaggggc

SEQ ID NO: 163102 - DNA, 16 bp, H. sapiens
ttcctggggcctccca

SEQ ID NO: 163103 - DNA, 16 bp, H. sapiens
ttcctggggctgctgt

SEQ ID NO: 163104 - DNA, 16 bp, H. sapiens
ttcctgggggaggtga

SEQ ID NO: 163105 - DNA, 16 bp, H. sapiens
ttcctgggtcaagtgg

SEQ ID NO: 163106 - DNA, 16 bp, H. sapiens
ttcctgggtcttcagc

SEQ ID NO: 163107 - DNA, 16 bp, H. sapiens
ttcctgggtgagggcc

SEQ ID NO: 163108 - DNA, 16 bp, H. sapiens
ttcctgggtggggacc

SEQ ID NO: 163109 - DNA, 16 bp, H. sapiens
ttcctgggttcaagcc

SEQ ID NO: 163110 - DNA, 16 bp, H. sapiens
ttcctgggttcaggtg

SEQ ID NO: 163111 - DNA, 16 bp, H. sapiens
ttcctgggttcatgcc

SEQ ID NO: 163112 - DNA, 16 bp, H. sapiens
ttcctggtgtctccaa

SEQ ID NO: 163113 - DNA, 16 bp, H. sapiens
ttcctggttcaatttt

SEQ ID NO: 163114 - DNA, 16 bp, H. sapiens
ttcctggttcattctt

SEQ ID NO: 163115 - DNA, 16 bp, H. sapiens
ttcctggttccatctt

SEQ ID NO: 163116 - DNA, 16 bp, H. sapiens
ttcctggttctccagc

SEQ ID NO: 163117 - DNA, 16 bp, H. sapiens
ttcctggtttaatcta

SEQ ID NO: 163118 - DNA, 16 bp, H. sapiens
ttcctggtttgcaggt

SEQ ID NO: 163119 - DNA, 16 bp, H. sapiens
ttcctggtttgcagtt

SEQ ID NO: 163120 - DNA, 16 bp, H. sapiens
ttcctgtacaacctgt

SEQ ID NO: 163121 - DNA, 16 bp, H. sapiens
ttcctgtacagtctgc

SEQ ID NO: 163122 - DNA, 16 bp, H. sapiens
ttcctgtacctggagg

SEQ ID NO: 163123 - DNA, 16 bp, H. sapiens
ttcctgtatccatgtg

SEQ ID NO: 163124 - DNA, 16 bp, H. sapiens
ttcctgtcacttttct

SEQ ID NO: 163125 - DNA, 16 bp, H. sapiens
ttcctgtcagaggacc

SEQ ID NO: 163126 - DNA, 16 bp, H. sapiens
ttcctgtcatttattt

SEQ ID NO: 163127 - DNA, 16 bp, H. sapiens
ttcctgtcattttgtt

SEQ ID NO: 163128 - DNA, 16 bp, H. sapiens
ttcctgtccatattct

SEQ ID NO: 163129 - DNA, 16 bp, H. sapiens
ttcctgtcctttgccc

SEQ ID NO: 163130 - DNA, 16 bp, H. sapiens
ttcctgtctcagcctc

SEQ ID NO: 163131 - DNA, 16 bp, H. sapiens
ttcctgtcttcctcta

SEQ ID NO: 163132 - DNA, 16 bp, H. sapiens
ttcctgtgagatctgg

SEQ ID NO: 163133 - DNA, 16 bp, H. sapiens
ttcctgtgattctcct

SEQ ID NO: 163134 - DNA, 16 bp, H. sapiens
ttcctgtgcctcagcc

SEQ ID NO: 163135 - DNA, 16 bp, H. sapiens
ttcctgtgtccatctg

SEQ ID NO: 163136 - DNA, 16 bp, H. sapiens
ttcctgtgtccctttg

SEQ ID NO: 163137 - DNA, 16 bp, H. sapiens
ttcctgtgtgtatgtg

SEQ ID NO: 163138 - DNA, 16 bp, H. sapiens
ttcctgtgttagcttg

SEQ ID NO: 163139 - DNA, 16 bp, H. sapiens
ttcctgtgttagttca

SEQ ID NO: 163140 - DNA, 16 bp, H. sapiens
ttcctgttaacaggcc

SEQ ID NO: 163141 - DNA, 16 bp, H. sapiens
ttcctgttcaataaat

SEQ ID NO: 163142 - DNA, 16 bp, H. sapiens
ttcctgttcactctga

SEQ ID NO: 163143 - DNA, 16 bp, H. sapiens
ttcctgttcattcttg

SEQ ID NO: 163144 - DNA, 16 bp, H. sapiens
ttcctgttctgcagcc

SEQ ID NO: 163145 - DNA, 16 bp, H. sapiens
ttcctgttgctgctgt

SEQ ID NO: 163146 - DNA, 16 bp, H. sapiens
ttcctgtttctctgca

SEQ ID NO: 163147 - DNA, 16 bp, H. sapiens
ttcctgtttcttcaca

SEQ ID NO: 163148 - DNA, 16 bp, H. sapiens
ttcctgttttcagttt

SEQ ID NO: 163149 - DNA, 16 bp, H. sapiens
ttcctgttttcttata

SEQ ID NO: 163150 - DNA, 16 bp, H. sapiens
ttcctgttttttaaaa

SEQ ID NO: 163151 - DNA, 16 bp, H. sapiens
ttccttaaaaaagaaa

SEQ ID NO: 163152 - DNA, 16 bp, H. sapiens
ttccttaaaaactaaa

SEQ ID NO: 163153 - DNA, 16 bp, H. sapiens
ttccttaaaataaata

SEQ ID NO: 163154 - DNA, 16 bp, H. sapiens
ttccttaaaattttct

SEQ ID NO: 163155 - DNA, 28 bp, H. sapiens
ttccttaagctgataagcaacttcagca

SEQ ID NO: 163156 - DNA, 16 bp, H. sapiens
ttccttaatttaaaaa

SEQ ID NO: 163157 - DNA, 16 bp, H. sapiens
ttccttacaggaaaca

SEQ ID NO: 163158 - DNA, 16 bp, H. sapiens
ttccttagaatttggg

SEQ ID NO: 163159 - DNA, 16 bp, H. sapiens
ttccttaggttttctt

SEQ ID NO: 163160 - DNA, 16 bp, H. sapiens
ttccttataagaatct

SEQ ID NO: 163161 - DNA, 16 bp, H. sapiens
ttccttatgattggga

SEQ ID NO: 163162 - DNA, 16 bp, H. sapiens
ttccttatgttagcca

SEQ ID NO: 163163 - DNA, 16 bp, H. sapiens
ttccttattaaaaaaa

SEQ ID NO: 163164 - DNA, 16 bp, H. sapiens
ttccttcaaataattt

SEQ ID NO: 163165 - DNA, 16 bp, H. sapiens
ttccttcaaggaaaat

SEQ ID NO: 163166 - DNA, 16 bp, H. sapiens
ttccttcaatacctag

SEQ ID NO: 163167 - DNA, 16 bp, H. sapiens
ttccttcacagattct

SEQ ID NO: 163168 - DNA, 16 bp, H. sapiens
ttccttcagaattttg

SEQ ID NO: 163169 - DNA, 16 bp, H. sapiens
ttccttcagagggtct

SEQ ID NO: 163170 - DNA, 16 bp, H. sapiens
ttccttcagcacttta

SEQ ID NO: 163171 - DNA, 16 bp, H. sapiens
ttccttcagcctgaag

SEQ ID NO: 163172 - DNA, 16 bp, H. sapiens
ttccttcagggcctgc

SEQ ID NO: 163173 - DNA, 16 bp, H. sapiens
ttccttcaggtgctct

SEQ ID NO: 163174 - DNA, 16 bp, H. sapiens
ttccttcagttctcct

SEQ ID NO: 163175 - DNA, 16 bp, H. sapiens
ttccttcagttctttg

SEQ ID NO: 163176 - DNA, 16 bp, H. sapiens
ttccttcatccattca

SEQ ID NO: 163177 - DNA, 16 bp, H. sapiens
ttccttcatcttctgc

SEQ ID NO: 163178 - DNA, 16 bp, H. sapiens
ttccttcatgttgact

SEQ ID NO: 163179 - DNA, 16 bp, H. sapiens
ttccttcattttcctg

SEQ ID NO: 163180 - DNA, 16 bp, H. sapiens
ttccttccaaaatatt

SEQ ID NO: 163181 - DNA, 16 bp, H. sapiens
ttccttccacatccct

SEQ ID NO: 163182 - DNA, 16 bp, H. sapiens
ttccttccagtctttt

SEQ ID NO: 163183 - DNA, 16 bp, H. sapiens
ttccttccagtgggtt

SEQ ID NO: 163184 - DNA, 16 bp, H. sapiens
ttccttcccttcctga

SEQ ID NO: 163185 - DNA, 16 bp, H. sapiens
ttccttcctaggcctc

SEQ ID NO: 163186 - DNA, 16 bp, H. sapiens
ttccttcctctttaag

SEQ ID NO: 163187 - DNA, 16 bp, H. sapiens
ttccttcctgggcatg

SEQ ID NO: 163188 - DNA, 16 bp, H. sapiens
ttccttcctgttctaa

SEQ ID NO: 163189 - DNA, 16 bp, H. sapiens
ttccttctaactgtat

SEQ ID NO: 163190 - DNA, 16 bp, H. sapiens
ttccttctgaaaatat

SEQ ID NO: 163191 - DNA, 16 bp, H. sapiens
ttccttctgaaactgt

SEQ ID NO: 163192 - DNA, 16 bp, H. sapiens
ttccttctggaggctc

SEQ ID NO: 163193 - DNA, 17 bp, H. sapiens
ttccttctggtgggttc

SEQ ID NO: 163194 - DNA, 16 bp, H. sapiens
ttccttctgtagctca

SEQ ID NO: 163195 - DNA, 16 bp, H. sapiens
ttccttctgtgtctgg

SEQ ID NO: 163196 - DNA, 16 bp, H. sapiens
ttccttctgttttaag

SEQ ID NO: 163197 - DNA, 16 bp, H. sapiens
ttccttcttaaggctg

SEQ ID NO: 163198 - DNA, 16 bp, H. sapiens
ttccttcttcaccata

SEQ ID NO: 163199 - DNA, 16 bp, H. sapiens
ttccttcttcctggaa

SEQ ID NO: 163200 - DNA, 16 bp, H. sapiens
ttccttcttgcatttt

SEQ ID NO: 163201 - DNA, 16 bp, H. sapiens
ttccttctttcagaaa

SEQ ID NO: 163202 - DNA, 16 bp, H. sapiens
ttccttctttctaaag

SEQ ID NO: 163203 - DNA, 16 bp, H. sapiens
ttccttctttcttaaa

SEQ ID NO: 163204 - DNA, 16 bp, H. sapiens
ttccttctttgttaag

SEQ ID NO: 163205 - DNA, 16 bp, H. sapiens
ttccttctttttaaaa

SEQ ID NO: 163206 - DNA, 19 bp, H. sapiens
ttccttgaagacagcttta

SEQ ID NO: 163207 - DNA, 16 bp, H. sapiens
ttccttgacatataca

SEQ ID NO: 163208 - DNA, 16 bp, H. sapiens
ttccttgcctcagcct

SEQ ID NO: 163209 - DNA, 16 bp, H. sapiens
ttccttgctttttcca

SEQ ID NO: 163210 - DNA, 16 bp, H. sapiens
ttccttggaattttct

SEQ ID NO: 163211 - DNA, 16 bp, H. sapiens
ttccttggcttggaga

SEQ ID NO: 163212 - DNA, 16 bp, H. sapiens
ttccttgtaaatttaa

SEQ ID NO: 163213 - DNA, 16 bp, H. sapiens
ttccttgttggaagca

SEQ ID NO: 163214 - DNA, 16 bp, H. sapiens
ttccttgtttttgtca

SEQ ID NO: 163215 - DNA, 16 bp, H. sapiens
ttcctttaaaaaaact

SEQ ID NO: 163216 - DNA, 16 bp, H. sapiens
ttcctttaaaaaataa

SEQ ID NO: 163217 - DNA, 16 bp, H. sapiens
ttcctttaaaaaatag

SEQ ID NO: 163218 - DNA, 16 bp, H. sapiens
ttcctttaaaaataat

SEQ ID NO: 163219 - DNA, 16 bp, H. sapiens
ttcctttaaaaattaa

SEQ ID NO: 163220 - DNA, 16 bp, H. sapiens
ttcctttaaaggaaaa

SEQ ID NO: 163221 - DNA, 16 bp, H. sapiens
ttcctttaaataaata

SEQ ID NO: 163222 - DNA, 16 bp, H. sapiens
ttcctttaagaaaaaa

SEQ ID NO: 163223 - DNA, 16 bp, H. sapiens
ttcctttaagtgaaaa

SEQ ID NO: 163224 - DNA, 16 bp, H. sapiens
ttcctttactaccaca

SEQ ID NO: 163225 - DNA, 16 bp, H. sapiens
ttcctttagcattttt

SEQ ID NO: 163226 - DNA, 16 bp, H. sapiens
ttcctttaggaaaaaa

SEQ ID NO: 163227 - DNA, 16 bp, H. sapiens
ttcctttagttctttg

SEQ ID NO: 163228 - DNA, 16 bp, H. sapiens
ttcctttattctgctg

SEQ ID NO: 163229 - DNA, 16 bp, H. sapiens
ttcctttatttctgct

SEQ ID NO: 163230 - DNA, 16 bp, H. sapiens
ttcctttcagttattt

SEQ ID NO: 163231 - DNA, 16 bp, H. sapiens
ttcctttcagttttct

SEQ ID NO: 163232 - DNA, 16 bp, H. sapiens
ttcctttccaacttgg

SEQ ID NO: 163233 - DNA, 16 bp, H. sapiens
ttcctttccatcctgg

SEQ ID NO: 163234 - DNA, 16 bp, H. sapiens
ttcctttccatttgtt

SEQ ID NO: 163235 - DNA, 16 bp, H. sapiens
ttcctttccccagccc

SEQ ID NO: 163236 - DNA, 16 bp, H. sapiens
ttcctttcctagtcaa

SEQ ID NO: 163237 - DNA, 16 bp, H. sapiens
ttcctttcctctgggt

SEQ ID NO: 163238 - DNA, 16 bp, H. sapiens
ttcctttcctgtcatt

SEQ ID NO: 163239 - DNA, 16 bp, H. sapiens
ttcctttcctttgaat

SEQ ID NO: 163240 - DNA, 16 bp, H. sapiens
ttcctttcctttgggt

SEQ ID NO: 163241 - DNA, 16 bp, H. sapiens
ttcctttctaaggctg

SEQ ID NO: 163242 - DNA, 16 bp, H. sapiens
ttcctttctaatctgt

SEQ ID NO: 163243 - DNA, 16 bp, H. sapiens
ttcctttctctgaact

SEQ ID NO: 163244 - DNA, 16 bp, H. sapiens
ttcctttctgctgcct

SEQ ID NO: 163245 - DNA, 16 bp, H. sapiens
ttcctttctgtggctg

SEQ ID NO: 163246 - DNA, 16 bp, H. sapiens
ttcctttctgtttcta

SEQ ID NO: 163247 - DNA, 16 bp, H. sapiens
ttcctttgaaaaccag

SEQ ID NO: 163248 - DNA, 16 bp, H. sapiens
ttcctttgagaattgt

SEQ ID NO: 163249 - DNA, 16 bp, H. sapiens
ttcctttgagatggag

SEQ ID NO: 163250 - DNA, 16 bp, H. sapiens
ttcctttgcatttgct

SEQ ID NO: 163251 - DNA, 16 bp, H. sapiens
ttcctttgcattttct

SEQ ID NO: 163252 - DNA, 16 bp, H. sapiens
ttcctttgctttttca

SEQ ID NO: 163253 - DNA, 16 bp, H. sapiens
ttcctttggaggaaga

SEQ ID NO: 163254 - DNA, 16 bp, H. sapiens
ttcctttgggtatata

SEQ ID NO: 163255 - DNA, 16 bp, H. sapiens
ttcctttgggtattta

SEQ ID NO: 163256 - DNA, 16 bp, H. sapiens
ttcctttgtcacccag

SEQ ID NO: 163257 - DNA, 16 bp, H. sapiens
ttcctttgttatgcag

SEQ ID NO: 163258 - DNA, 16 bp, H. sapiens
ttccttttaaaataaa

SEQ ID NO: 163259 - DNA, 16 bp, H. sapiens
ttccttttatggaaaa

SEQ ID NO: 163260 - DNA, 16 bp, H. sapiens
ttccttttcagagaac

SEQ ID NO: 163261 - DNA, 16 bp, H. sapiens
ttccttttcattactg

SEQ ID NO: 163262 - DNA, 16 bp, H. sapiens
ttccttttcattcctg

SEQ ID NO: 163263 - DNA, 16 bp, H. sapiens
ttccttttcctgcctg

SEQ ID NO: 163264 - DNA, 16 bp, H. sapiens
ttccttttctaaaatt

SEQ ID NO: 163265 - DNA, 16 bp, H. sapiens
ttccttttctctgcat

SEQ ID NO: 163266 - DNA, 16 bp, H. sapiens
ttccttttctgtataa

SEQ ID NO: 163267 - DNA, 16 bp, H. sapiens
ttccttttctgtgaaa

SEQ ID NO: 163268 - DNA, 16 bp, H. sapiens
ttccttttctttcagt

SEQ ID NO: 163269 - DNA, 16 bp, H. sapiens
ttccttttctttgaga

SEQ ID NO: 163270 - DNA, 16 bp, H. sapiens
ttccttttgaagttaa

SEQ ID NO: 163271 - DNA, 16 bp, H. sapiens
ttccttttgatgatga

SEQ ID NO: 163272 - DNA, 16 bp, H. sapiens
ttccttttgcttggta

SEQ ID NO: 163273 - DNA, 16 bp, H. sapiens
ttccttttggaattga

SEQ ID NO: 163274 - DNA, 16 bp, H. sapiens
ttccttttggagttga

SEQ ID NO: 163275 - DNA, 16 bp, H. sapiens
ttccttttgttattga

SEQ ID NO: 163276 - DNA, 16 bp, H. sapiens
ttccttttgttcctaa

SEQ ID NO: 163277 - DNA, 16 bp, H. sapiens
ttccttttgttcttaa

SEQ ID NO: 163278 - DNA, 16 bp, H. sapiens
ttcctttttaagaaaa

SEQ ID NO: 163279 - DNA, 16 bp, H. sapiens
ttcctttttatggctg

SEQ ID NO: 163280 - DNA, 16 bp, H. sapiens
ttcctttttattgata

SEQ ID NO: 163281 - DNA, 16 bp, H. sapiens
ttcctttttcaagatt

SEQ ID NO: 163282 - DNA, 16 bp, H. sapiens
ttcctttttctataaa

SEQ ID NO: 163283 - DNA, 16 bp, H. sapiens
ttcctttttctccaca

SEQ ID NO: 163284 - DNA, 16 bp, H. sapiens
ttcctttttctgtgaa

SEQ ID NO: 163285 - DNA, 16 bp, H. sapiens
ttcctttttgaaaaaa

SEQ ID NO: 163286 - DNA, 16 bp, H. sapiens
ttcctttttgaacagt

SEQ ID NO: 163287 - DNA, 16 bp, H. sapiens
ttcctttttgttgatg

SEQ ID NO: 163288 - DNA, 16 bp, H. sapiens
ttccttttttaaaaga

SEQ ID NO: 163289 - DNA, 16 bp, H. sapiens
ttccttttttaaaatc

SEQ ID NO: 163290 - DNA, 16 bp, H. sapiens
ttccttttttatggct

SEQ ID NO: 163291 - DNA, 16 bp, H. sapiens
ttccttttttgaaaca

SEQ ID NO: 163292 - DNA, 16 bp, H. sapiens
ttcctttttttccaaa

SEQ ID NO: 163293 - DNA, 16 bp, H. sapiens
ttcgaactcctggcct

SEQ ID NO: 163294 - DNA, 18 bp, H. sapiens
ttcgagaccagactgggc

SEQ ID NO: 163295 - DNA, 16 bp, H. sapiens
ttcgagatcagcctga

SEQ ID NO: 163296 - DNA, 16 bp, H. sapiens
ttcgagatcagcctgg

SEQ ID NO: 163297 - DNA, 16 bp, H. sapiens
ttcgaggccaccctgg

SEQ ID NO: 163298 - DNA, 16 bp, H. sapiens
ttcgaggctgcactga

SEQ ID NO: 163299 - DNA, 16 bp, H. sapiens
ttcgagtccagcctga

SEQ ID NO: 163300 - DNA, 17 bp, H. sapiens
ttcgataaaattcaaca

SEQ ID NO: 163301 - DNA, 16 bp, H. sapiens
ttcgccatgctggcca

SEQ ID NO: 163302 - DNA, 16 bp, H. sapiens
ttcgccatggtggcca

SEQ ID NO: 163303 - DNA, 20 bp, H. sapiens
ttcgccatgttggccaggcc

SEQ ID NO: 163304 - DNA, 21 bp, H. sapiens
ttcgccatgttggccaggctt

SEQ ID NO: 163305 - DNA, 16 bp, H. sapiens
ttcggccaggtgtggt

SEQ ID NO: 163306 - DNA, 16 bp, H. sapiens
ttcgggaccagcctga

SEQ ID NO: 163307 - DNA, 16 bp, H. sapiens
ttcgggaggcagaggt

SEQ ID NO: 163308 - DNA, 16 bp, H. sapiens
ttcggtattgatggga

SEQ ID NO: 163309 - DNA, 17 bp, H. sapiens
ttcggtggctcacgcct

SEQ ID NO: 163310 - DNA, 16 bp, H. sapiens
ttcgtcaggctggtct

SEQ ID NO: 163311 - DNA, 16 bp, H. sapiens
ttcgtctaaatttttt

SEQ ID NO: 163312 - DNA, 16 bp, H. sapiens
ttcgtgcctcagcctc

SEQ ID NO: 163313 - DNA, 16 bp, H. sapiens
ttcgtgtgctgcaccc

SEQ ID NO: 163314 - DNA, 16 bp, H. sapiens
ttcgttctattctgag

SEQ ID NO: 163315 - DNA, 16 bp, H. sapiens
ttcgtttttcaccata

SEQ ID NO: 163316 - DNA, 16 bp, H. sapiens
ttctaaaaaatgaaaa

SEQ ID NO: 163317 - DNA, 16 bp, H. sapiens
ttctaaaaaatgttaa

SEQ ID NO: 163318 - DNA, 16 bp, H. sapiens
ttctaaaaacaaattt

SEQ ID NO: 163319 - DNA, 16 bp, H. sapiens
ttctaaaaagtcaaaa

SEQ ID NO: 163320 - DNA, 16 bp, H. sapiens
ttctaaaaataaaatg

SEQ ID NO: 163321 - DNA, 16 bp, H. sapiens
ttctaaaaatatttct

SEQ ID NO: 163322 - DNA, 16 bp, H. sapiens
ttctaaaaatcagaat

SEQ ID NO: 163323 - DNA, 16 bp, H. sapiens
ttctaaaaatgttttc

SEQ ID NO: 163324 - DNA, 16 bp, H. sapiens
ttctaaaacaggcaaa

SEQ ID NO: 163325 - DNA, 16 bp, H. sapiens
ttctaaaactatattt

SEQ ID NO: 163326 - DNA, 16 bp, H. sapiens
ttctaaaactgaagaa

SEQ ID NO: 163327 - DNA, 16 bp, H. sapiens
ttctaaaacttttaaa

SEQ ID NO: 163328 - DNA, 16 bp, H. sapiens
ttctaaaagaaaaaga

SEQ ID NO: 163329 - DNA, 16 bp, H. sapiens
ttctaaaagctgaaaa

SEQ ID NO: 163330 - DNA, 16 bp, H. sapiens
ttctaaaaggaaaatt

SEQ ID NO: 163331 - DNA, 16 bp, H. sapiens
ttctaaaagtaaaaaa

SEQ ID NO: 163332 - DNA, 16 bp, H. sapiens
ttctaaaagttttata

SEQ ID NO: 163333 - DNA, 16 bp, H. sapiens
ttctaaaataaatgtt

SEQ ID NO: 163334 - DNA, 16 bp, H. sapiens
ttctaaaatccaaaaa

SEQ ID NO: 163335 - DNA, 16 bp, H. sapiens
ttctaaaatctaaaat

SEQ ID NO: 163336 - DNA, 16 bp, H. sapiens
ttctaaaatgaaatat

SEQ ID NO: 163337 - DNA, 16 bp, H. sapiens
ttctaaaatgtacatt

SEQ ID NO: 163338 - DNA, 16 bp, H. sapiens
ttctaaaatgtatata

SEQ ID NO: 163339 - DNA, 16 bp, H. sapiens
ttctaaaatgttttta

SEQ ID NO: 163340 - DNA, 16 bp, H. sapiens
ttctaaaattaatttg

SEQ ID NO: 163341 - DNA, 16 bp, H. sapiens
ttctaaaattatttca

SEQ ID NO: 163342 - DNA, 16 bp, H. sapiens
ttctaaaattcatgtg

SEQ ID NO: 163343 - DNA, 16 bp, H. sapiens
ttctaaaatttatctg

SEQ ID NO: 163344 - DNA, 16 bp, H. sapiens
ttctaaacatttttaa

SEQ ID NO: 163345 - DNA, 16 bp, H. sapiens
ttctaaaccaaaccaa

SEQ ID NO: 163346 - DNA, 16 bp, H. sapiens
ttctaaactgctcaat

SEQ ID NO: 163347 - DNA, 16 bp, H. sapiens
ttctaaagattttttt

SEQ ID NO: 163348 - DNA, 16 bp, H. sapiens
ttctaaagcacccact

SEQ ID NO: 163349 - DNA, 16 bp, H. sapiens
ttctaaaggtagatca

SEQ ID NO: 163350 - DNA, 16 bp, H. sapiens
ttctaaagtaaatatt

SEQ ID NO: 163351 - DNA, 16 bp, H. sapiens
ttctaaagtaattttt

SEQ ID NO: 163352 - DNA, 16 bp, H. sapiens
ttctaaataaaacatt

SEQ ID NO: 163353 - DNA, 16 bp, H. sapiens
ttctaaataaatgtat

SEQ ID NO: 163354 - DNA, 16 bp, H. sapiens
ttctaaataaatgttt

SEQ ID NO: 163355 - DNA, 16 bp, H. sapiens
ttctaaatagaaaatg

SEQ ID NO: 163356 - DNA, 16 bp, H. sapiens
ttctaaatctcatttt

SEQ ID NO: 163357 - DNA, 16 bp, H. sapiens
ttctaaatctgtgaag

SEQ ID NO: 163358 - DNA, 17 bp, H. sapiens
ttctaaatggtgtgaga

SEQ ID NO: 163359 - DNA, 16 bp, H. sapiens
ttctaaatgtttctaa

SEQ ID NO: 163360 - DNA, 16 bp, H. sapiens
ttctaaatgttttaca

SEQ ID NO: 163361 - DNA, 16 bp, H. sapiens
ttctaaattaaaagaa

SEQ ID NO: 163362 - DNA, 16 bp, H. sapiens
ttctaaattatatttg

SEQ ID NO: 163363 - DNA, 16 bp, H. sapiens
ttctaaatttctaaaa

SEQ ID NO: 163364 - DNA, 16 bp, H. sapiens
ttctaaatttcttcct

SEQ ID NO: 163365 - DNA, 16 bp, H. sapiens
ttctaaatttgaattt

SEQ ID NO: 163366 - DNA, 16 bp, H. sapiens
ttctaaatttgataaa

SEQ ID NO: 163367 - DNA, 16 bp, H. sapiens
ttctaaatttgtttta

SEQ ID NO: 163368 - DNA, 16 bp, H. sapiens
ttctaaattttgaaat

SEQ ID NO: 163369 - DNA, 16 bp, H. sapiens
ttctaacagtcaggcc

SEQ ID NO: 163370 - DNA, 16 bp, H. sapiens
ttctaacatgttccca

SEQ ID NO: 163371 - DNA, 16 bp, H. sapiens
ttctaacatttccttt

SEQ ID NO: 163372 - DNA, 16 bp, H. sapiens
ttctaaccagttccca

SEQ ID NO: 163373 - DNA, 16 bp, H. sapiens
ttctaacttttgattt

SEQ ID NO: 163374 - DNA, 16 bp, H. sapiens
ttctaagaattaaatg

SEQ ID NO: 163375 - DNA, 16 bp, H. sapiens
ttctaagatacaatgg

SEQ ID NO: 163376 - DNA, 16 bp, H. sapiens
ttctaagcaaaaagaa

SEQ ID NO: 163377 - DNA, 16 bp, H. sapiens
ttctaagcagcaaaat

SEQ ID NO: 163378 - DNA, 16 bp, H. sapiens
ttctaagcctcagttt

SEQ ID NO: 163379 - DNA, 16 bp, H. sapiens
ttctaaggaagaaaaa

SEQ ID NO: 163380 - DNA, 16 bp, H. sapiens
ttctaaggatgattct

SEQ ID NO: 163381 - DNA, 16 bp, H. sapiens
ttctaagtgatttaca

SEQ ID NO: 163382 - DNA, 16 bp, H. sapiens
ttctaagtgcttcaca

SEQ ID NO: 163383 - DNA, 16 bp, H. sapiens
ttctaagtgtttcaca

SEQ ID NO: 163384 - DNA, 16 bp, H. sapiens
ttctaataattatttg

SEQ ID NO: 163385 - DNA, 16 bp, H. sapiens
ttctaataatttctaa

SEQ ID NO: 163386 - DNA, 16 bp, H. sapiens
ttctaatagtttttca

SEQ ID NO: 163387 - DNA, 17 bp, H. sapiens
ttctaatccctccttag

SEQ ID NO: 163388 - DNA, 16 bp, H. sapiens
ttctaatgatagagat

SEQ ID NO: 163389 - DNA, 16 bp, H. sapiens
ttctaatgtatgcatt

SEQ ID NO: 163390 - DNA, 16 bp, H. sapiens
ttctaattatgtttat

SEQ ID NO: 163391 - DNA, 16 bp, H. sapiens
ttctaattcaatagat

SEQ ID NO: 163392 - DNA, 16 bp, H. sapiens
ttctaattcataaaca

SEQ ID NO: 163393 - DNA, 16 bp, H. sapiens
ttctaattggattatt

SEQ ID NO: 163394 - DNA, 16 bp, H. sapiens
ttctaatttaattaca

SEQ ID NO: 163395 - DNA, 16 bp, H. sapiens
ttctaatttcaaaaat

SEQ ID NO: 163396 - DNA, 16 bp, H. sapiens
ttctaatttcttaaaa

SEQ ID NO: 163397 - DNA, 16 bp, H. sapiens
ttctaattttaaagaa

SEQ ID NO: 163398 - DNA, 16 bp, H. sapiens
ttctaattttgtaatt

SEQ ID NO: 163399 - DNA, 16 bp, H. sapiens
ttctaatttttttcag

SEQ ID NO: 163400 - DNA, 16 bp, H. sapiens
ttctacaaagaaaaca

SEQ ID NO: 163401 - DNA, 16 bp, H. sapiens
ttctacaatagtgatg

SEQ ID NO: 163402 - DNA, 16 bp, H. sapiens
ttctacacatggctag

SEQ ID NO: 163403 - DNA, 16 bp, H. sapiens
ttctacactgtggaag

SEQ ID NO: 163404 - DNA, 16 bp, H. sapiens
ttctacagaaataaaa

SEQ ID NO: 163405 - DNA, 16 bp, H. sapiens
ttctacagaagtaaaa

SEQ ID NO: 163406 - DNA, 16 bp, H. sapiens
ttctacagatgaagaa

SEQ ID NO: 163407 - DNA, 16 bp, H. sapiens
ttctacagcctctgct

SEQ ID NO: 163408 - DNA, 16 bp, H. sapiens
ttctacaggtgaggaa

SEQ ID NO: 163409 - DNA, 16 bp, H. sapiens
ttctacatgtggatat

SEQ ID NO: 163410 - DNA, 16 bp, H. sapiens
ttctacattgattttg

SEQ ID NO: 163411 - DNA, 16 bp, H. sapiens
ttctacatttcaaaat

SEQ ID NO: 163412 - DNA, 16 bp, H. sapiens
ttctacattttaataa

SEQ ID NO: 163413 - DNA, 16 bp, H. sapiens
ttctacatttttgggt

SEQ ID NO: 163414 - DNA, 16 bp, H. sapiens
ttctaccaaaaaataa

SEQ ID NO: 163415 - DNA, 16 bp, H. sapiens
ttctaccacatggcca

SEQ ID NO: 163416 - DNA, 16 bp, H. sapiens
ttctacccaaatcttc

SEQ ID NO: 163417 - DNA, 16 bp, H. sapiens
ttctacctcagcctcc

SEQ ID NO: 163418 - DNA, 16 bp, H. sapiens
ttctaccttggtgaat

SEQ ID NO: 163419 - DNA, 16 bp, H. sapiens
ttctacgataaagaca

SEQ ID NO: 163420 - DNA, 16 bp, H. sapiens
ttctactaaaagtaca

SEQ ID NO: 163421 - DNA, 16 bp, H. sapiens
ttctactataaagatg

SEQ ID NO: 163422 - DNA, 16 bp, H. sapiens
ttctactctctgtgtc

SEQ ID NO: 163423 - DNA, 16 bp, H. sapiens
ttctactctgcttctg

SEQ ID NO: 163424 - DNA, 16 bp, H. sapiens
ttctactgttttaaaa

SEQ ID NO: 163425 - DNA, 16 bp, H. sapiens
ttctacttctttaaaa

SEQ ID NO: 163426 - DNA, 16 bp, H. sapiens
ttctactttctgcttc

SEQ ID NO: 163427 - DNA, 16 bp, H. sapiens
ttctactttgtgtttc

SEQ ID NO: 163428 - DNA, 16 bp, H. sapiens
ttctacttttaaactt

SEQ ID NO: 163429 - DNA, 16 bp, H. sapiens
ttctacttttcctgaa

SEQ ID NO: 163430 - DNA, 16 bp, H. sapiens
ttctacttttctgatg

SEQ ID NO: 163431 - DNA, 16 bp, H. sapiens
ttctacttttctgtat

SEQ ID NO: 163432 - DNA, 16 bp, H. sapiens
ttctagaaaaaagaaa

SEQ ID NO: 163433 - DNA, 16 bp, H. sapiens
ttctagaaaaatatat

SEQ ID NO: 163434 - DNA, 16 bp, H. sapiens
ttctagaaaaggcaga

SEQ ID NO: 163435 - DNA, 16 bp, H. sapiens
ttctagaaataaaatt

SEQ ID NO: 163436 - DNA, 16 bp, H. sapiens
ttctagaaatagaatt

SEQ ID NO: 163437 - DNA, 16 bp, H. sapiens
ttctagaagaaaacat

SEQ ID NO: 163438 - DNA, 16 bp, H. sapiens
ttctagaagaaaatat

SEQ ID NO: 163439 - DNA, 16 bp, H. sapiens
ttctagaagagtggct

SEQ ID NO: 163440 - DNA, 16 bp, H. sapiens
ttctagaatgttatat

SEQ ID NO: 163441 - DNA, 16 bp, H. sapiens
ttctagaattctagaa

SEQ ID NO: 163442 - DNA, 16 bp, H. sapiens
ttctagaattttcttt

SEQ ID NO: 163443 - DNA, 16 bp, H. sapiens
ttctagagaaaaaaaa

SEQ ID NO: 163444 - DNA, 16 bp, H. sapiens
ttctagagaaaaaaat

SEQ ID NO: 163445 - DNA, 16 bp, H. sapiens
ttctagaggccacctg

SEQ ID NO: 163446 - DNA, 16 bp, H. sapiens
ttctagagttgaaaaa

SEQ ID NO: 163447 - DNA, 16 bp, H. sapiens
ttctagatacaagtcc

SEQ ID NO: 163448 - DNA, 16 bp, H. sapiens
ttctagatattctagt

SEQ ID NO: 163449 - DNA, 19 bp, H. sapiens
ttctagatccttgaggaat

SEQ ID NO: 163450 - DNA, 16 bp, H. sapiens
ttctagattgtgaagg

SEQ ID NO: 163451 - DNA, 16 bp, H. sapiens
ttctagatttctcttc

SEQ ID NO: 163452 - DNA, 16 bp, H. sapiens
ttctagcacagtgcct

SEQ ID NO: 163453 - DNA, 16 bp, H. sapiens
ttctagcctggatgac

SEQ ID NO: 163454 - DNA, 16 bp, H. sapiens
ttctagctgagaggct

SEQ ID NO: 163455 - DNA, 18 bp, H. sapiens
ttctaggatttgacattt

SEQ ID NO: 163456 - DNA, 16 bp, H. sapiens
ttctaggcagaggaaa

SEQ ID NO: 163457 - DNA, 16 bp, H. sapiens
ttctaggcctcagttt

SEQ ID NO: 163458 - DNA, 16 bp, H. sapiens
ttctaggcctccaggc

SEQ ID NO: 163459 - DNA, 16 bp, H. sapiens
ttctagggctgttttt

SEQ ID NO: 163460 - DNA, 16 bp, H. sapiens
ttctagggttttttat

SEQ ID NO: 163461 - DNA, 16 bp, H. sapiens
ttctaggtacttggga

SEQ ID NO: 163462 - DNA, 16 bp, H. sapiens
ttctaggtgctggaga

SEQ ID NO: 163463 - DNA, 16 bp, H. sapiens
ttctaggtgctgggga

SEQ ID NO: 163464 - DNA, 16 bp, H. sapiens
ttctaggttcaagtga

SEQ ID NO: 163465 - DNA, 22 bp, H. sapiens
ttctagtagagatggggtttca

SEQ ID NO: 163466 - DNA, 16 bp, H. sapiens
ttctagtattttaata

SEQ ID NO: 163467 - DNA, 16 bp, H. sapiens
ttctagtcagtcatct

SEQ ID NO: 163468 - DNA, 16 bp, H. sapiens
ttctagtgtttttatg

SEQ ID NO: 163469 - DNA, 16 bp, H. sapiens
ttctagttatcttgct

SEQ ID NO: 163470 - DNA, 16 bp, H. sapiens
ttctagttccctgagg

SEQ ID NO: 163471 - DNA, 16 bp, H. sapiens
ttctagttcctctagg

SEQ ID NO: 163472 - DNA, 16 bp, H. sapiens
ttctagttgttttaat

SEQ ID NO: 163473 - DNA, 16 bp, H. sapiens
ttctagtttgttgagt

SEQ ID NO: 163474 - DNA, 16 bp, H. sapiens
ttctagttttaaattt

SEQ ID NO: 163475 - DNA, 16 bp, H. sapiens
ttctataaagtcactg

SEQ ID NO: 163476 - DNA, 16 bp, H. sapiens
ttctataagttttata

SEQ ID NO: 163477 - DNA, 16 bp, H. sapiens
ttctataatgatcagt

SEQ ID NO: 163478 - DNA, 16 bp, H. sapiens
ttctataattagaaaa

SEQ ID NO: 163479 - DNA, 16 bp, H. sapiens
ttctatacatatatat

SEQ ID NO: 163480 - DNA, 16 bp, H. sapiens
ttctatacattagcaa

SEQ ID NO: 163481 - DNA, 16 bp, H. sapiens
ttctatacctggctta

SEQ ID NO: 163482 - DNA, 16 bp, H. sapiens
ttctatagaaataaaa

SEQ ID NO: 163483 - DNA, 16 bp, H. sapiens
ttctatagaagtaaat

SEQ ID NO: 163484 - DNA, 18 bp, H. sapiens
ttctatagattatagatt

SEQ ID NO: 163485 - DNA, 16 bp, H. sapiens
ttctatattcagtgaa

SEQ ID NO: 163486 - DNA, 16 bp, H. sapiens
ttctatcaaatactag

SEQ ID NO: 163487 - DNA, 16 bp, H. sapiens
ttctatcagaaaaaaa

SEQ ID NO: 163488 - DNA, 16 bp, H. sapiens
ttctatcagttgctga

SEQ ID NO: 163489 - DNA, 16 bp, H. sapiens
ttctatctaactgtat

SEQ ID NO: 163490 - DNA, 16 bp, H. sapiens
ttctatctaactgtgt

SEQ ID NO: 163491 - DNA, 16 bp, H. sapiens
ttctatgaaaacagtg

SEQ ID NO: 163492 - DNA, 16 bp, H. sapiens
ttctatgaaatattta

SEQ ID NO: 163493 - DNA, 16 bp, H. sapiens
ttctatgagtttgact

SEQ ID NO: 163494 - DNA, 16 bp, H. sapiens
ttctatgatgatggaa

SEQ ID NO: 163495 - DNA, 16 bp, H. sapiens
ttctatgcctttgcat

SEQ ID NO: 163496 - DNA, 16 bp, H. sapiens
ttctatggctgaataa

SEQ ID NO: 163497 - DNA, 16 bp, H. sapiens
ttctatgggttttgat

SEQ ID NO: 163498 - DNA, 16 bp, H. sapiens
ttctatgtagttgagc

SEQ ID NO: 163499 - DNA, 16 bp, H. sapiens
ttctatgtatttatca

SEQ ID NO: 163500 - DNA, 16 bp, H. sapiens
ttctatgtatttatta

SEQ ID NO: 163501 - DNA, 16 bp, H. sapiens
ttctatgtcttctttg

SEQ ID NO: 163502 - DNA, 16 bp, H. sapiens
ttctattaaaacattt

SEQ ID NO: 163503 - DNA, 16 bp, H. sapiens
ttctattcaacatagt

SEQ ID NO: 163504 - DNA, 16 bp, H. sapiens
ttctattccatcatct

SEQ ID NO: 163505 - DNA, 16 bp, H. sapiens
ttctattctctttgaa

SEQ ID NO: 163506 - DNA, 16 bp, H. sapiens
ttctattctgttcctt

SEQ ID NO: 163507 - DNA, 16 bp, H. sapiens
ttctattgtttaaaaa

SEQ ID NO: 163508 - DNA, 16 bp, H. sapiens
ttctatttaatcttca

SEQ ID NO: 163509 - DNA, 16 bp, H. sapiens
ttctatttacatgaaa

SEQ ID NO: 163510 - DNA, 16 bp, H. sapiens
ttctatttagaaataa

SEQ ID NO: 163511 - DNA, 16 bp, H. sapiens
ttctatttatgtaaca

SEQ ID NO: 163512 - DNA, 16 bp, H. sapiens
ttctatttccaaaatt

SEQ ID NO: 163513 - DNA, 16 bp, H. sapiens
ttctatttctagaaaa

SEQ ID NO: 163514 - DNA, 16 bp, H. sapiens
ttctatttctagaaat

SEQ ID NO: 163515 - DNA, 16 bp, H. sapiens
ttctatttctgagaaa

SEQ ID NO: 163516 - DNA, 16 bp, H. sapiens
ttctatttctgccatt

SEQ ID NO: 163517 - DNA, 16 bp, H. sapiens
ttctatttcttcaaaa

SEQ ID NO: 163518 - DNA, 16 bp, H. sapiens
ttctattttaaagaca

SEQ ID NO: 163519 - DNA, 16 bp, H. sapiens
ttctattttgaaaaaa

SEQ ID NO: 163520 - DNA, 16 bp, H. sapiens
ttctattttgtaaata

SEQ ID NO: 163521 - DNA, 16 bp, H. sapiens
ttctatttttaagaaa

SEQ ID NO: 163522 - DNA, 18 bp, H. sapiens
ttctatttttagtagaga

SEQ ID NO: 163523 - DNA, 16 bp, H. sapiens
ttctatttttagtagc

SEQ ID NO: 163524 - DNA, 16 bp, H. sapiens
ttctatttttgtaaaa

SEQ ID NO: 163525 - DNA, 16 bp, H. sapiens
ttctatttttgtaaag

SEQ ID NO: 163526 - DNA, 16 bp, H. sapiens
ttctcaaaaaaagaca

SEQ ID NO: 163527 - DNA, 16 bp, H. sapiens
ttctcaaaaaactaca

SEQ ID NO: 163528 - DNA, 16 bp, H. sapiens
ttctcaaaaaatatat

SEQ ID NO: 163529 - DNA, 16 bp, H. sapiens
ttctcaaaaacaaaac

SEQ ID NO: 163530 - DNA, 16 bp, H. sapiens
ttctcaaaactcaaca

SEQ ID NO: 163531 - DNA, 16 bp, H. sapiens
ttctcaaaagaataca

SEQ ID NO: 163532 - DNA, 16 bp, H. sapiens
ttctcaaaagcaattg

SEQ ID NO: 163533 - DNA, 16 bp, H. sapiens
ttctcaaaataatcct

SEQ ID NO: 163534 - DNA, 16 bp, H. sapiens
ttctcaaaatacttca

SEQ ID NO: 163535 - DNA, 16 bp, H. sapiens
ttctcaaaattcatat

SEQ ID NO: 163536 - DNA, 16 bp, H. sapiens
ttctcaaactcaactt

SEQ ID NO: 163537 - DNA, 16 bp, H. sapiens
ttctcaaactttagca

SEQ ID NO: 163538 - DNA, 16 bp, H. sapiens
ttctcaaactttagtg

SEQ ID NO: 163539 - DNA, 16 bp, H. sapiens
ttctcaaactttttgg

SEQ ID NO: 163540 - DNA, 16 bp, H. sapiens
ttctcaaagaattaaa

SEQ ID NO: 163541 - DNA, 16 bp, H. sapiens
ttctcaaagagcaata

SEQ ID NO: 163542 - DNA, 16 bp, H. sapiens
ttctcaaagatagacc

SEQ ID NO: 163543 - DNA, 16 bp, H. sapiens
ttctcaaagtgtggta

SEQ ID NO: 163544 - DNA, 16 bp, H. sapiens
ttctcaaagtgtggtc

SEQ ID NO: 163545 - DNA, 16 bp, H. sapiens
ttctcaaagtgtgttc

SEQ ID NO: 163546 - DNA, 16 bp, H. sapiens
ttctcaaattatttct

SEQ ID NO: 163547 - DNA, 16 bp, H. sapiens
ttctcaaatttattga

SEQ ID NO: 163548 - DNA, 16 bp, H. sapiens
ttctcaaccagaggtg

SEQ ID NO: 163549 - DNA, 16 bp, H. sapiens
ttctcaaccctggctg

SEQ ID NO: 163550 - DNA, 16 bp, H. sapiens
ttctcaactactcata

SEQ ID NO: 163551 - DNA, 16 bp, H. sapiens
ttctcaagaaagaaaa

SEQ ID NO: 163552 - DNA, 16 bp, H. sapiens
ttctcaagagaaaaga

SEQ ID NO: 163553 - DNA, 16 bp, H. sapiens
ttctcaagagaagaca

SEQ ID NO: 163554 - DNA, 16 bp, H. sapiens
ttctcaagataaacaa

SEQ ID NO: 163555 - DNA, 16 bp, H. sapiens
ttctcaagattgtttt

SEQ ID NO: 163556 - DNA, 16 bp, H. sapiens
ttctcaaggtcacaca

SEQ ID NO: 163557 - DNA, 16 bp, H. sapiens
ttctcaaggttcatcc

SEQ ID NO: 163558 - DNA, 16 bp, H. sapiens
ttctcaataaacatta

SEQ ID NO: 163559 - DNA, 16 bp, H. sapiens
ttctcaataaatgtta

SEQ ID NO: 163560 - DNA, 16 bp, H. sapiens
ttctcaatagccaaaa

SEQ ID NO: 163561 - DNA, 16 bp, H. sapiens
ttctcaatcaaaagaa

SEQ ID NO: 163562 - DNA, 16 bp, H. sapiens
ttctcaatgaatattt

SEQ ID NO: 163563 - DNA, 16 bp, H. sapiens
ttctcacaaagaaaac

SEQ ID NO: 163564 - DNA, 16 bp, H. sapiens
ttctcacaacaaccct

SEQ ID NO: 163565 - DNA, 16 bp, H. sapiens
ttctcacactgctaat

SEQ ID NO: 163566 - DNA, 17 bp, H. sapiens
ttctcacagctccacta

SEQ ID NO: 163567 - DNA, 16 bp, H. sapiens
ttctcacagtttggga

SEQ ID NO: 163568 - DNA, 16 bp, H. sapiens
ttctcacatggcagaa

SEQ ID NO: 163569 - DNA, 16 bp, H. sapiens
ttctcacattgctgta

SEQ ID NO: 163570 - DNA, 16 bp, H. sapiens
ttctcaccacaaagaa

SEQ ID NO: 163571 - DNA, 16 bp, H. sapiens
ttctcaccatgtgatc

SEQ ID NO: 163572 - DNA, 16 bp, H. sapiens
ttctcaccttagcctc

SEQ ID NO: 163573 - DNA, 16 bp, H. sapiens
ttctcactcataagtg

SEQ ID NO: 163574 - DNA, 16 bp, H. sapiens
ttctcactcataggag

SEQ ID NO: 163575 - DNA, 19 bp, H. sapiens
ttctcactcataggtagga

SEQ ID NO: 163576 - DNA, 30 bp, H. sapiens
ttctcactcataggtgggaattgaacaatg

SEQ ID NO: 163577 - DNA, 33 bp, H. sapiens
ttctcactcataggtgggaattgaacaatgaga

SEQ ID NO: 163578 - DNA, 16 bp, H. sapiens
ttctcactgcatcctc

SEQ ID NO: 163579 - DNA, 16 bp, H. sapiens
ttctcactgtgtcttc

SEQ ID NO: 163580 - DNA, 16 bp, H. sapiens
ttctcacttataagta

SEQ ID NO: 163581 - DNA, 16 bp, H. sapiens
ttctcacttataagtg

SEQ ID NO: 163582 - DNA, 16 bp, H. sapiens
ttctcacttatttgtg

SEQ ID NO: 163583 - DNA, 16 bp, H. sapiens
ttctcactttttaaaa

SEQ ID NO: 163584 - DNA, 16 bp, H. sapiens
ttctcagaaaaaaaaa

SEQ ID NO: 163585 - DNA, 16 bp, H. sapiens
ttctcagaaaacttct

SEQ ID NO: 163586 - DNA, 16 bp, H. sapiens
ttctcagaaagaaaca

SEQ ID NO: 163587 - DNA, 16 bp, H. sapiens
ttctcagaaatgaaaa

SEQ ID NO: 163588 - DNA, 16 bp, H. sapiens
ttctcagaacctttaa

SEQ ID NO: 163589 - DNA, 16 bp, H. sapiens
ttctcagaagaaaaca

SEQ ID NO: 163590 - DNA, 16 bp, H. sapiens
ttctcagaagaagaaa

SEQ ID NO: 163591 - DNA, 16 bp, H. sapiens
ttctcagaagaagaca

SEQ ID NO: 163592 - DNA, 18 bp, H. sapiens
ttctcagaagtcagacct

SEQ ID NO: 163593 - DNA, 16 bp, H. sapiens
ttctcagaatgattct

SEQ ID NO: 163594 - DNA, 16 bp, H. sapiens
ttctcagaatgtattt

SEQ ID NO: 163595 - DNA, 16 bp, H. sapiens
ttctcagaatgtgtct

SEQ ID NO: 163596 - DNA, 16 bp, H. sapiens
ttctcagagaaataaa

SEQ ID NO: 163597 - DNA, 16 bp, H. sapiens
ttctcagagaattaaa

SEQ ID NO: 163598 - DNA, 16 bp, H. sapiens
ttctcagaggaggtgg

SEQ ID NO: 163599 - DNA, 16 bp, H. sapiens
ttctcagatctcaaat

SEQ ID NO: 163600 - DNA, 16 bp, H. sapiens
ttctcagatctctagc

SEQ ID NO: 163601 - DNA, 16 bp, H. sapiens
ttctcagatgtccagc

SEQ ID NO: 163602 - DNA, 16 bp, H. sapiens
ttctcagattcaccaa

SEQ ID NO: 163603 - DNA, 16 bp, H. sapiens
ttctcagattttcttt

SEQ ID NO: 163604 - DNA, 16 bp, H. sapiens
ttctcagcagaaattt

SEQ ID NO: 163605 - DNA, 16 bp, H. sapiens
ttctcagcatttgttt

SEQ ID NO: 163606 - DNA, 16 bp, H. sapiens
ttctcagccctccaaa

SEQ ID NO: 163607 - DNA, 16 bp, H. sapiens
ttctcagcctcagcct

SEQ ID NO: 163608 - DNA, 16 bp, H. sapiens
ttctcagcctccataa

SEQ ID NO: 163609 - DNA, 16 bp, H. sapiens
ttctcagcctcctgag

SEQ ID NO: 163610 - DNA, 16 bp, H. sapiens
ttctcagccttggcac

SEQ ID NO: 163611 - DNA, 19 bp, H. sapiens
ttctcagccttttggctaa

SEQ ID NO: 163612 - DNA, 16 bp, H. sapiens
ttctcagctacttggg

SEQ ID NO: 163613 - DNA, 18 bp, H. sapiens
ttctcagctcactgcaac

SEQ ID NO: 163614 - DNA, 16 bp, H. sapiens
ttctcagctgcaaaat

SEQ ID NO: 163615 - DNA, 16 bp, H. sapiens
ttctcagcttcccaaa

SEQ ID NO: 163616 - DNA, 16 bp, H. sapiens
ttctcagctttatttt

SEQ ID NO: 163617 - DNA, 16 bp, H. sapiens
ttctcaggcccagcca

SEQ ID NO: 163618 - DNA, 16 bp, H. sapiens
ttctcaggcctttggt

SEQ ID NO: 163619 - DNA, 16 bp, H. sapiens
ttctcagtcttcagaa

SEQ ID NO: 163620 - DNA, 16 bp, H. sapiens
ttctcagttttaattt

SEQ ID NO: 163621 - DNA, 16 bp, H. sapiens
ttctcagttttctctt

SEQ ID NO: 163622 - DNA, 16 bp, H. sapiens
ttctcataattttaaa

SEQ ID NO: 163623 - DNA, 16 bp, H. sapiens
ttctcatcatcttcat

SEQ ID NO: 163624 - DNA, 16 bp, H. sapiens
ttctcatcatttggct

SEQ ID NO: 163625 - DNA, 16 bp, H. sapiens
ttctcatccacaaaat

SEQ ID NO: 163626 - DNA, 16 bp, H. sapiens
ttctcatctataaaat

SEQ ID NO: 163627 - DNA, 16 bp, H. sapiens
ttctcatctgtgaaac

SEQ ID NO: 163628 - DNA, 16 bp, H. sapiens
ttctcatcttcatgga

SEQ ID NO: 163629 - DNA, 16 bp, H. sapiens
ttctcatctttcaaat

SEQ ID NO: 163630 - DNA, 16 bp, H. sapiens
ttctcatctttgtgtc

SEQ ID NO: 163631 - DNA, 16 bp, H. sapiens
ttctcatgataatgaa

SEQ ID NO: 163632 - DNA, 16 bp, H. sapiens
ttctcatgcctctgcc

SEQ ID NO: 163633 - DNA, 16 bp, H. sapiens
ttctcatggtcttggg

SEQ ID NO: 163634 - DNA, 16 bp, H. sapiens
ttctcatgtatttctt

SEQ ID NO: 163635 - DNA, 16 bp, H. sapiens
ttctcatgtgttggct

SEQ ID NO: 163636 - DNA, 16 bp, H. sapiens
ttctcattaaaaaata

SEQ ID NO: 163637 - DNA, 16 bp, H. sapiens
ttctcattaaaagaaa

SEQ ID NO: 163638 - DNA, 16 bp, H. sapiens
ttctcattattttcaa

SEQ ID NO: 163639 - DNA, 16 bp, H. sapiens
ttctcattcttgcttt

SEQ ID NO: 163640 - DNA, 16 bp, H. sapiens
ttctcattgattttta

SEQ ID NO: 163641 - DNA, 16 bp, H. sapiens
ttctcattgtaaagat

SEQ ID NO: 163642 - DNA, 16 bp, H. sapiens
ttctcattgtggaggg

SEQ ID NO: 163643 - DNA, 16 bp, H. sapiens
ttctcatttaaatata

SEQ ID NO: 163644 - DNA, 16 bp, H. sapiens
ttctcatttgtttgta

SEQ ID NO: 163645 - DNA, 16 bp, H. sapiens
ttctcattttaaaaac

SEQ ID NO: 163646 - DNA, 16 bp, H. sapiens
ttctcattttaaaaat

SEQ ID NO: 163647 - DNA, 16 bp, H. sapiens
ttctcatttttacaga

SEQ ID NO: 163648 - DNA, 16 bp, H. sapiens
ttctccaaaatatttt

SEQ ID NO: 163649 - DNA, 16 bp, H. sapiens
ttctccaaaattcaga

SEQ ID NO: 163650 - DNA, 16 bp, H. sapiens
ttctccaaacttctct

SEQ ID NO: 163651 - DNA, 16 bp, H. sapiens
ttctccaaagaagaaa

SEQ ID NO: 163652 - DNA, 16 bp, H. sapiens
ttctccaaagaagaca

SEQ ID NO: 163653 - DNA, 16 bp, H. sapiens
ttctccaaagaaggta

SEQ ID NO: 163654 - DNA, 16 bp, H. sapiens
ttctccaactctctgg

SEQ ID NO: 163655 - DNA, 16 bp, H. sapiens
ttctccaactctgtgg

SEQ ID NO: 163656 - DNA, 16 bp, H. sapiens
ttctccaagaagccct

SEQ ID NO: 163657 - DNA, 16 bp, H. sapiens
ttctccaagcccacat

SEQ ID NO: 163658 - DNA, 16 bp, H. sapiens
ttctccaagtccccac

SEQ ID NO: 163659 - DNA, 16 bp, H. sapiens
ttctccaatgttttat

SEQ ID NO: 163660 - DNA, 16 bp, H. sapiens
ttctccacatcctctg

SEQ ID NO: 163661 - DNA, 16 bp, H. sapiens
ttctccacatccttac

SEQ ID NO: 163662 - DNA, 16 bp, H. sapiens
ttctccaccacaacaa

SEQ ID NO: 163663 - DNA, 16 bp, H. sapiens
ttctccagaaaacaga

SEQ ID NO: 163664 - DNA, 16 bp, H. sapiens
ttctccagaaggctgt

SEQ ID NO: 163665 - DNA, 16 bp, H. sapiens
ttctccagagaaagaa

SEQ ID NO: 163666 - DNA, 16 bp, H. sapiens
ttctccagccacatgg

SEQ ID NO: 163667 - DNA, 16 bp, H. sapiens
ttctccagcctcctca

SEQ ID NO: 163668 - DNA, 16 bp, H. sapiens
ttctccagcctcctga

SEQ ID NO: 163669 - DNA, 16 bp, H. sapiens
ttctccaggaagcaga

SEQ ID NO: 163670 - DNA, 16 bp, H. sapiens
ttctccaggagaactt

SEQ ID NO: 163671 - DNA, 16 bp, H. sapiens
ttctccaggctcagcc

SEQ ID NO: 163672 - DNA, 16 bp, H. sapiens
ttctccagggaccctt

SEQ ID NO: 163673 - DNA, 17 bp, H. sapiens
ttctccatactattaga

SEQ ID NO: 163674 - DNA, 16 bp, H. sapiens
ttctccatagtggttg

SEQ ID NO: 163675 - DNA, 16 bp, H. sapiens
ttctccatatatatat

SEQ ID NO: 163676 - DNA, 16 bp, H. sapiens
ttctccatatggatat

SEQ ID NO: 163677 - DNA, 16 bp, H. sapiens
ttctccatattagcaa

SEQ ID NO: 163678 - DNA, 16 bp, H. sapiens
ttctccatattctctc

SEQ ID NO: 163679 - DNA, 16 bp, H. sapiens
ttctccatcatcctga

SEQ ID NO: 163680 - DNA, 16 bp, H. sapiens
ttctccatcctgcttt

SEQ ID NO: 163681 - DNA, 16 bp, H. sapiens
ttctccatctccatct

SEQ ID NO: 163682 - DNA, 16 bp, H. sapiens
ttctccatctccattt

SEQ ID NO: 163683 - DNA, 16 bp, H. sapiens
ttctccatgggtcaag

SEQ ID NO: 163684 - DNA, 16 bp, H. sapiens
ttctccatgttgggca

SEQ ID NO: 163685 - DNA, 16 bp, H. sapiens
ttctccattctccatg

SEQ ID NO: 163686 - DNA, 16 bp, H. sapiens
ttctccattgataaga

SEQ ID NO: 163687 - DNA, 16 bp, H. sapiens
ttctccattgtcttgg

SEQ ID NO: 163688 - DNA, 16 bp, H. sapiens
ttctccatttctttaa

SEQ ID NO: 163689 - DNA, 16 bp, H. sapiens
ttctccattttacaga

SEQ ID NO: 163690 - DNA, 16 bp, H. sapiens
ttctcccaatctgtag

SEQ ID NO: 163691 - DNA, 16 bp, H. sapiens
ttctcccaatctgtgg

SEQ ID NO: 163692 - DNA, 16 bp, H. sapiens
ttctcccacaacatgt

SEQ ID NO: 163693 - DNA, 17 bp, H. sapiens
ttctcccacctcagcct

SEQ ID NO: 163694 - DNA, 16 bp, H. sapiens
ttctcccagaggtaca

SEQ ID NO: 163695 - DNA, 17 bp, H. sapiens
ttctcccagcatgcagc

SEQ ID NO: 163696 - DNA, 16 bp, H. sapiens
ttctcccagtaccatt

SEQ ID NO: 163697 - DNA, 16 bp, H. sapiens
ttctcccatagccaga

SEQ ID NO: 163698 - DNA, 16 bp, H. sapiens
ttctcccattatgtag

SEQ ID NO: 163699 - DNA, 16 bp, H. sapiens
ttctcccatttaaaat

SEQ ID NO: 163700 - DNA, 16 bp, H. sapiens
ttctcccatttgtttg

SEQ ID NO: 163701 - DNA, 16 bp, H. sapiens
ttctcccattttacag

SEQ ID NO: 163702 - DNA, 16 bp, H. sapiens
ttctcccattttgtat

SEQ ID NO: 163703 - DNA, 16 bp, H. sapiens
ttctccccaaactgat

SEQ ID NO: 163704 - DNA, 16 bp, H. sapiens
ttctccccactcttga

SEQ ID NO: 163705 - DNA, 16 bp, H. sapiens
ttctccccagaagcag

SEQ ID NO: 163706 - DNA, 16 bp, H. sapiens
ttctccccagcccctg

SEQ ID NO: 163707 - DNA, 16 bp, H. sapiens
ttctcccctgaagcag

SEQ ID NO: 163708 - DNA, 16 bp, H. sapiens
ttctcccctgaagtga

SEQ ID NO: 163709 - DNA, 16 bp, H. sapiens
ttctcccctgccctta

SEQ ID NO: 163710 - DNA, 16 bp, H. sapiens
ttctcccgttctgtag

SEQ ID NO: 163711 - DNA, 16 bp, H. sapiens
ttctccctaactcatt

SEQ ID NO: 163712 - DNA, 16 bp, H. sapiens
ttctccctcagagcct

SEQ ID NO: 163713 - DNA, 29 bp, H. sapiens
ttctccctctctgatttaaagcagatcaa

SEQ ID NO: 163714 - DNA, 16 bp, H. sapiens
ttctccctctgcctca

SEQ ID NO: 163715 - DNA, 16 bp, H. sapiens
ttctccctgtctcctg

SEQ ID NO: 163716 - DNA, 16 bp, H. sapiens
ttctccctgttgaaaa

SEQ ID NO: 163717 - DNA, 16 bp, H. sapiens
ttctccctgttggcca

SEQ ID NO: 163718 - DNA, 16 bp, H. sapiens
ttctccctttagttct

SEQ ID NO: 163719 - DNA, 16 bp, H. sapiens
ttctcctaactgaaat

SEQ ID NO: 163720 - DNA, 16 bp, H. sapiens
ttctcctacctcagca

SEQ ID NO: 163721 - DNA, 16 bp, H. sapiens
ttctcctatctcagtc

SEQ ID NO: 163722 - DNA, 16 bp, H. sapiens
ttctcctatgttttct

SEQ ID NO: 163723 - DNA, 16 bp, H. sapiens
ttctcctattctgcag

SEQ ID NO: 163724 - DNA, 16 bp, H. sapiens
ttctcctcaaccttgc

SEQ ID NO: 163725 - DNA, 16 bp, H. sapiens
ttctcctcccttagcc

SEQ ID NO: 163726 - DNA, 16 bp, H. sapiens
ttctcctcctcagcct

SEQ ID NO: 163727 - DNA, 16 bp, H. sapiens
ttctcctctgctgagg

SEQ ID NO: 163728 - DNA, 16 bp, H. sapiens
ttctcctgaagcctct

SEQ ID NO: 163729 - DNA, 16 bp, H. sapiens
ttctcctgacccagcc

SEQ ID NO: 163730 - DNA, 16 bp, H. sapiens
ttctcctgactcaggc

SEQ ID NO: 163731 - DNA, 16 bp, H. sapiens
ttctcctgaggcctcc

SEQ ID NO: 163732 - DNA, 16 bp, H. sapiens
ttctcctgagggcagg

SEQ ID NO: 163733 - DNA, 16 bp, H. sapiens
ttctcctgccacaacc

SEQ ID NO: 163734 - DNA, 16 bp, H. sapiens
ttctcctgccccagca

SEQ ID NO: 163735 - DNA, 16 bp, H. sapiens
ttctcctgccccagcc

SEQ ID NO: 163736 - DNA, 16 bp, H. sapiens
ttctcctgcctcaagt

SEQ ID NO: 163737 - DNA, 16 bp, H. sapiens
ttctcctgcctccacc

SEQ ID NO: 163738 - DNA, 16 bp, H. sapiens
ttctcctgcctccatc

SEQ ID NO: 163739 - DNA, 16 bp, H. sapiens
ttctcctgcctctgca

SEQ ID NO: 163740 - DNA, 16 bp, H. sapiens
ttctcctgcctctgct

SEQ ID NO: 163741 - DNA, 16 bp, H. sapiens
ttctcctgcctctgtc

SEQ ID NO: 163742 - DNA, 16 bp, H. sapiens
ttctcctgctcctgcc

SEQ ID NO: 163743 - DNA, 16 bp, H. sapiens
ttctcctgctctgtgg

SEQ ID NO: 163744 - DNA, 16 bp, H. sapiens
ttctcctgcttgagcc

SEQ ID NO: 163745 - DNA, 16 bp, H. sapiens
ttctcctgcttgcact

SEQ ID NO: 163746 - DNA, 16 bp, H. sapiens
ttctcctgtgctagat

SEQ ID NO: 163747 - DNA, 16 bp, H. sapiens
ttctcctgtgctggat

SEQ ID NO: 163748 - DNA, 17 bp, H. sapiens
ttctcctgtgtcagcct

SEQ ID NO: 163749 - DNA, 16 bp, H. sapiens
ttctccttagtccttc

SEQ ID NO: 163750 - DNA, 16 bp, H. sapiens
ttctccttatataaat

SEQ ID NO: 163751 - DNA, 16 bp, H. sapiens
ttctccttcactgatt

SEQ ID NO: 163752 - DNA, 16 bp, H. sapiens
ttctccttcatgtttg

SEQ ID NO: 163753 - DNA, 16 bp, H. sapiens
ttctccttcctcaacc

SEQ ID NO: 163754 - DNA, 16 bp, H. sapiens
ttctccttcctcagtc

SEQ ID NO: 163755 - DNA, 16 bp, H. sapiens
ttctccttcctgctgc

SEQ ID NO: 163756 - DNA, 16 bp, H. sapiens
ttctccttcctgggag

SEQ ID NO: 163757 - DNA, 16 bp, H. sapiens
ttctccttctgttatt

SEQ ID NO: 163758 - DNA, 16 bp, H. sapiens
ttctccttgcatttct

SEQ ID NO: 163759 - DNA, 16 bp, H. sapiens
ttctcctttaaaaata

SEQ ID NO: 163760 - DNA, 16 bp, H. sapiens
ttctcctttaaagaaa

SEQ ID NO: 163761 - DNA, 16 bp, H. sapiens
ttctcctttataaaat

SEQ ID NO: 163762 - DNA, 16 bp, H. sapiens
ttctcctttctcagcc

SEQ ID NO: 163763 - DNA, 16 bp, H. sapiens
ttctcctttctgccac

SEQ ID NO: 163764 - DNA, 16 bp, H. sapiens
ttctcctttgtaaaat

SEQ ID NO: 163765 - DNA, 16 bp, H. sapiens
ttctcgaactcctgag

SEQ ID NO: 163766 - DNA, 16 bp, H. sapiens
ttctctaaaaatgttt

SEQ ID NO: 163767 - DNA, 16 bp, H. sapiens
ttctctaaaactttat

SEQ ID NO: 163768 - DNA, 16 bp, H. sapiens
ttctctaaaagcattt

SEQ ID NO: 163769 - DNA, 16 bp, H. sapiens
ttctctaatcttgtct

SEQ ID NO: 163770 - DNA, 16 bp, H. sapiens
ttctctacctccatga

SEQ ID NO: 163771 - DNA, 16 bp, H. sapiens
ttctctactgttttct

SEQ ID NO: 163772 - DNA, 16 bp, H. sapiens
ttctctacttttgagg

SEQ ID NO: 163773 - DNA, 16 bp, H. sapiens
ttctctagagaaacaa

SEQ ID NO: 163774 - DNA, 16 bp, H. sapiens
ttctctagcttatttt

SEQ ID NO: 163775 - DNA, 16 bp, H. sapiens
ttctctagcttgcttt

SEQ ID NO: 163776 - DNA, 16 bp, H. sapiens
ttctctaggcctttta

SEQ ID NO: 163777 - DNA, 16 bp, H. sapiens
ttctctaggtctttta

SEQ ID NO: 163778 - DNA, 16 bp, H. sapiens
ttctctaggttttcta

SEQ ID NO: 163779 - DNA, 16 bp, H. sapiens
ttctctatctcctgac

SEQ ID NO: 163780 - DNA, 16 bp, H. sapiens
ttctctattagtcttg

SEQ ID NO: 163781 - DNA, 16 bp, H. sapiens
ttctctattgtttgga

SEQ ID NO: 163782 - DNA, 16 bp, H. sapiens
ttctctcaccactctt

SEQ ID NO: 163783 - DNA, 16 bp, H. sapiens
ttctctcatttgtaaa

SEQ ID NO: 163784 - DNA, 16 bp, H. sapiens
ttctctccaactgcca

SEQ ID NO: 163785 - DNA, 16 bp, H. sapiens
ttctctcccagcttct

SEQ ID NO: 163786 - DNA, 16 bp, H. sapiens
ttctctcccatgcctg

SEQ ID NO: 163787 - DNA, 16 bp, H. sapiens
ttctctcccctgccac

SEQ ID NO: 163788 - DNA, 16 bp, H. sapiens
ttctctccctcagcct

SEQ ID NO: 163789 - DNA, 16 bp, H. sapiens
ttctctcctgttgccc

SEQ ID NO: 163790 - DNA, 16 bp, H. sapiens
ttctctctcacacaca

SEQ ID NO: 163791 - DNA, 16 bp, H. sapiens
ttctctctcaccatgt

SEQ ID NO: 163792 - DNA, 16 bp, H. sapiens
ttctctctctccacca

SEQ ID NO: 163793 - DNA, 16 bp, H. sapiens
ttctctctctggctct

SEQ ID NO: 163794 - DNA, 16 bp, H. sapiens
ttctctctcttgccat

SEQ ID NO: 163795 - DNA, 16 bp, H. sapiens
ttctctctgaagaact

SEQ ID NO: 163796 - DNA, 16 bp, H. sapiens
ttctctctgcctcagt

SEQ ID NO: 163797 - DNA, 16 bp, H. sapiens
ttctctctgcctgccc

SEQ ID NO: 163798 - DNA, 16 bp, H. sapiens
ttctctctggttttta

SEQ ID NO: 163799 - DNA, 16 bp, H. sapiens
ttctctcttaacactg

SEQ ID NO: 163800 - DNA, 16 bp, H. sapiens
ttctctcttgcctgct

SEQ ID NO: 163801 - DNA, 16 bp, H. sapiens
ttctctctttcacaca

SEQ ID NO: 163802 - DNA, 16 bp, H. sapiens
ttctctctttcagttt

SEQ ID NO: 163803 - DNA, 16 bp, H. sapiens
ttctctcttttggaat

SEQ ID NO: 163804 - DNA, 16 bp, H. sapiens
ttctctgaatgcttct

SEQ ID NO: 163805 - DNA, 16 bp, H. sapiens
ttctctgaatttattt

SEQ ID NO: 163806 - DNA, 16 bp, H. sapiens
ttctctgagaaagaaa

SEQ ID NO: 163807 - DNA, 16 bp, H. sapiens
ttctctgagcctctat

SEQ ID NO: 163808 - DNA, 16 bp, H. sapiens
ttctctgaggctcagt

SEQ ID NO: 163809 - DNA, 16 bp, H. sapiens
ttctctgagttctgtg

SEQ ID NO: 163810 - DNA, 16 bp, H. sapiens
ttctctgatatttatt

SEQ ID NO: 163811 - DNA, 16 bp, H. sapiens
ttctctgatgattact

SEQ ID NO: 163812 - DNA, 16 bp, H. sapiens
ttctctgatggatcta

SEQ ID NO: 163813 - DNA, 16 bp, H. sapiens
ttctctgatggcctgt

SEQ ID NO: 163814 - DNA, 16 bp, H. sapiens
ttctctgatttttaaa

SEQ ID NO: 163815 - DNA, 16 bp, H. sapiens
ttctctgcagaaccct

SEQ ID NO: 163816 - DNA, 16 bp, H. sapiens
ttctctgcatcctccc

SEQ ID NO: 163817 - DNA, 16 bp, H. sapiens
ttctctgcatcctttc

SEQ ID NO: 163818 - DNA, 16 bp, H. sapiens
ttctctgcatttcttg

SEQ ID NO: 163819 - DNA, 16 bp, H. sapiens
ttctctgcattttctg

SEQ ID NO: 163820 - DNA, 16 bp, H. sapiens
ttctctgcccagcttt

SEQ ID NO: 163821 - DNA, 16 bp, H. sapiens
ttctctgcctcagcct

SEQ ID NO: 163822 - DNA, 16 bp, H. sapiens
ttctctgcctcatcct

SEQ ID NO: 163823 - DNA, 16 bp, H. sapiens
ttctctgcctctttga

SEQ ID NO: 163824 - DNA, 16 bp, H. sapiens
ttctctgctctgctct

SEQ ID NO: 163825 - DNA, 16 bp, H. sapiens
ttctctgcttttaaaa

SEQ ID NO: 163826 - DNA, 16 bp, H. sapiens
ttctctggaggaccct

SEQ ID NO: 163827 - DNA, 16 bp, H. sapiens
ttctctggaggctgag

SEQ ID NO: 163828 - DNA, 16 bp, H. sapiens
ttctctggctgctttc

SEQ ID NO: 163829 - DNA, 16 bp, H. sapiens
ttctctggctgctttt

SEQ ID NO: 163830 - DNA, 16 bp, H. sapiens
ttctctgggcctcagt

SEQ ID NO: 163831 - DNA, 16 bp, H. sapiens
ttctctgggcctctgt

SEQ ID NO: 163832 - DNA, 16 bp, H. sapiens
ttctctggggaaaaaa

SEQ ID NO: 163833 - DNA, 16 bp, H. sapiens
ttctctgggggaaaaa

SEQ ID NO: 163834 - DNA, 16 bp, H. sapiens
ttctctggggtccctt

SEQ ID NO: 163835 - DNA, 16 bp, H. sapiens
ttctctggggtcctct

SEQ ID NO: 163836 - DNA, 16 bp, H. sapiens
ttctctggttggtcct

SEQ ID NO: 163837 - DNA, 16 bp, H. sapiens
ttctctgtaaagtttt

SEQ ID NO: 163838 - DNA, 16 bp, H. sapiens
ttctctgtactatctt

SEQ ID NO: 163839 - DNA, 16 bp, H. sapiens
ttctctgtatctattg

SEQ ID NO: 163840 - DNA, 16 bp, H. sapiens
ttctctgtctcactgt

SEQ ID NO: 163841 - DNA, 16 bp, H. sapiens
ttctctgtctgtaaaa

SEQ ID NO: 163842 - DNA, 16 bp, H. sapiens
ttctctgtcttccctg

SEQ ID NO: 163843 - DNA, 16 bp, H. sapiens
ttctctgtgaaatggg

SEQ ID NO: 163844 - DNA, 16 bp, H. sapiens
ttctctgtgacatcct

SEQ ID NO: 163845 - DNA, 16 bp, H. sapiens
ttctctgtgccaagca

SEQ ID NO: 163846 - DNA, 16 bp, H. sapiens
ttctctgtgccaggca

SEQ ID NO: 163847 - DNA, 16 bp, H. sapiens
ttctctgtgctctgcc

SEQ ID NO: 163848 - DNA, 16 bp, H. sapiens
ttctctgtgtgaacat

SEQ ID NO: 163849 - DNA, 16 bp, H. sapiens
ttctctgtgtgtctct

SEQ ID NO: 163850 - DNA, 16 bp, H. sapiens
ttctctgtgttctgcc

SEQ ID NO: 163851 - DNA, 16 bp, H. sapiens
ttctctgtgtttcctg

SEQ ID NO: 163852 - DNA, 16 bp, H. sapiens
ttctctgtttaataaa

SEQ ID NO: 163853 - DNA, 16 bp, H. sapiens
ttctctgtttctggaa

SEQ ID NO: 163854 - DNA, 16 bp, H. sapiens
ttctcttaaaataatt

SEQ ID NO: 163855 - DNA, 16 bp, H. sapiens
ttctcttaattttgct

SEQ ID NO: 163856 - DNA, 16 bp, H. sapiens
ttctcttagtaatttt

SEQ ID NO: 163857 - DNA, 16 bp, H. sapiens
ttctcttatctctttg

SEQ ID NO: 163858 - DNA, 16 bp, H. sapiens
ttctcttcaaataatc

SEQ ID NO: 163859 - DNA, 16 bp, H. sapiens
ttctcttcagaaacca

SEQ ID NO: 163860 - DNA, 16 bp, H. sapiens
ttctcttccattctgt

SEQ ID NO: 163861 - DNA, 16 bp, H. sapiens
ttctcttcctagcaaa

SEQ ID NO: 163862 - DNA, 16 bp, H. sapiens
ttctcttcctctgggt

SEQ ID NO: 163863 - DNA, 16 bp, H. sapiens
ttctcttctctccaca

SEQ ID NO: 163864 - DNA, 16 bp, H. sapiens
ttctcttctgaaaact

SEQ ID NO: 163865 - DNA, 16 bp, H. sapiens
ttctcttctggcccag

SEQ ID NO: 163866 - DNA, 16 bp, H. sapiens
ttctcttcttcctcag

SEQ ID NO: 163867 - DNA, 16 bp, H. sapiens
ttctcttcttctggaa

SEQ ID NO: 163868 - DNA, 16 bp, H. sapiens
ttctcttcttgcttca

SEQ ID NO: 163869 - DNA, 16 bp, H. sapiens
ttctcttctttaaaat

SEQ ID NO: 163870 - DNA, 16 bp, H. sapiens
ttctcttctttataaa

SEQ ID NO: 163871 - DNA, 16 bp, H. sapiens
ttctcttcttttcaaa

SEQ ID NO: 163872 - DNA, 16 bp, H. sapiens
ttctcttgactgcaaa

SEQ ID NO: 163873 - DNA, 16 bp, H. sapiens
ttctcttgattgagca

SEQ ID NO: 163874 - DNA, 16 bp, H. sapiens
ttctcttgcccaggct

SEQ ID NO: 163875 - DNA, 16 bp, H. sapiens
ttctcttggctcagcc

SEQ ID NO: 163876 - DNA, 16 bp, H. sapiens
ttctcttgggtataaa

SEQ ID NO: 163877 - DNA, 16 bp, H. sapiens
ttctcttgggtatata

SEQ ID NO: 163878 - DNA, 16 bp, H. sapiens
ttctcttgtgtcagcc

SEQ ID NO: 163879 - DNA, 16 bp, H. sapiens
ttctctttaaaaacaa

SEQ ID NO: 163880 - DNA, 16 bp, H. sapiens
ttctctttagttctgt

SEQ ID NO: 163881 - DNA, 16 bp, H. sapiens
ttctctttataaatga

SEQ ID NO: 163882 - DNA, 16 bp, H. sapiens
ttctctttatttcctg

SEQ ID NO: 163883 - DNA, 16 bp, H. sapiens
ttctctttcaaaataa

SEQ ID NO: 163884 - DNA, 16 bp, H. sapiens
ttctctttcaaaattt

SEQ ID NO: 163885 - DNA, 16 bp, H. sapiens
ttctctttcctagtca

SEQ ID NO: 163886 - DNA, 16 bp, H. sapiens
ttctctttgaaaacca

SEQ ID NO: 163887 - DNA, 16 bp, H. sapiens
ttctctttgaaatgta

SEQ ID NO: 163888 - DNA, 16 bp, H. sapiens
ttctctttgccatttt

SEQ ID NO: 163889 - DNA, 16 bp, H. sapiens
ttctctttggaataat

SEQ ID NO: 163890 - DNA, 16 bp, H. sapiens
ttctctttggagaaaa

SEQ ID NO: 163891 - DNA, 16 bp, H. sapiens
ttctctttggtaaata

SEQ ID NO: 163892 - DNA, 16 bp, H. sapiens
ttctctttgttcttca

SEQ ID NO: 163893 - DNA, 16 bp, H. sapiens
ttctcttttaaaaaag

SEQ ID NO: 163894 - DNA, 16 bp, H. sapiens
ttctcttttaaaacaa

SEQ ID NO: 163895 - DNA, 16 bp, H. sapiens
ttctcttttaaatttg

SEQ ID NO: 163896 - DNA, 16 bp, H. sapiens
ttctcttttaacaaaa

SEQ ID NO: 163897 - DNA, 16 bp, H. sapiens
ttctcttttctctaaa

SEQ ID NO: 163898 - DNA, 16 bp, H. sapiens
ttctcttttctctgaa

SEQ ID NO: 163899 - DNA, 16 bp, H. sapiens
ttctcttttctctgca

SEQ ID NO: 163900 - DNA, 16 bp, H. sapiens
ttctcttttctctgta

SEQ ID NO: 163901 - DNA, 16 bp, H. sapiens
ttctcttttgaaaaat

SEQ ID NO: 163902 - DNA, 16 bp, H. sapiens
ttctctttttcaaaaa

SEQ ID NO: 163903 - DNA, 16 bp, H. sapiens
ttctctttttgaaaat

SEQ ID NO: 163904 - DNA, 16 bp, H. sapiens
ttctgaaaaaaatatt

SEQ ID NO: 163905 - DNA, 16 bp, H. sapiens
ttctgaaaaaagaaaa

SEQ ID NO: 163906 - DNA, 16 bp, H. sapiens
ttctgaaaaactgctt

SEQ ID NO: 163907 - DNA, 16 bp, H. sapiens
ttctgaaaaatgtgtc

SEQ ID NO: 163908 - DNA, 16 bp, H. sapiens
ttctgaaaactgaaaa

SEQ ID NO: 163909 - DNA, 16 bp, H. sapiens
ttctgaaaagaaaaaa

SEQ ID NO: 163910 - DNA, 16 bp, H. sapiens
ttctgaaaatgttaaa

SEQ ID NO: 163911 - DNA, 16 bp, H. sapiens
ttctgaaaattaaaga

SEQ ID NO: 163912 - DNA, 16 bp, H. sapiens
ttctgaaaattctgaa

SEQ ID NO: 163913 - DNA, 16 bp, H. sapiens
ttctgaaaatttatat

SEQ ID NO: 163914 - DNA, 16 bp, H. sapiens
ttctgaaacagagtct

SEQ ID NO: 163915 - DNA, 16 bp, H. sapiens
ttctgaaaggaaaaaa

SEQ ID NO: 163916 - DNA, 16 bp, H. sapiens
ttctgaaagttaaaaa

SEQ ID NO: 163917 - DNA, 16 bp, H. sapiens
ttctgaaagttttttt

SEQ ID NO: 163918 - DNA, 16 bp, H. sapiens
ttctgaaataaaacat

SEQ ID NO: 163919 - DNA, 16 bp, H. sapiens
ttctgaaataaaatgt

SEQ ID NO: 163920 - DNA, 16 bp, H. sapiens
ttctgaaataaaatta

SEQ ID NO: 163921 - DNA, 16 bp, H. sapiens
ttctgaaataactttt

SEQ ID NO: 163922 - DNA, 16 bp, H. sapiens
ttctgaaataattttg

SEQ ID NO: 163923 - DNA, 16 bp, H. sapiens
ttctgaaatatttgct

SEQ ID NO: 163924 - DNA, 16 bp, H. sapiens
ttctgaaatattttca

SEQ ID NO: 163925 - DNA, 16 bp, H. sapiens
ttctgaaatcaggaag

SEQ ID NO: 163926 - DNA, 16 bp, H. sapiens
ttctgaaattatttca

SEQ ID NO: 163927 - DNA, 16 bp, H. sapiens
ttctgaaattattttg

SEQ ID NO: 163928 - DNA, 16 bp, H. sapiens
ttctgaaattcaaaaa

SEQ ID NO: 163929 - DNA, 16 bp, H. sapiens
ttctgaaattcttttt

SEQ ID NO: 163930 - DNA, 16 bp, H. sapiens
ttctgaaatttcaaaa

SEQ ID NO: 163931 - DNA, 16 bp, H. sapiens
ttctgaaatttcagaa

SEQ ID NO: 163932 - DNA, 16 bp, H. sapiens
ttctgaaatttttttc

SEQ ID NO: 163933 - DNA, 16 bp, H. sapiens
ttctgaagaaaaaaag

SEQ ID NO: 163934 - DNA, 16 bp, H. sapiens
ttctgaagaaaaagaa

SEQ ID NO: 163935 - DNA, 16 bp, H. sapiens
ttctgaagaaaaatta

SEQ ID NO: 163936 - DNA, 16 bp, H. sapiens
ttctgaagaaaacaaa

SEQ ID NO: 163937 - DNA, 16 bp, H. sapiens
ttctgaagaaaagaaa

SEQ ID NO: 163938 - DNA, 16 bp, H. sapiens
ttctgaagaacagaaa

SEQ ID NO: 163939 - DNA, 16 bp, H. sapiens
ttctgaagccaggaga

SEQ ID NO: 163940 - DNA, 16 bp, H. sapiens
ttctgaagcctctgct

SEQ ID NO: 163941 - DNA, 16 bp, H. sapiens
ttctgaagtctacttt

SEQ ID NO: 163942 - DNA, 16 bp, H. sapiens
ttctgaagtctgggaa

SEQ ID NO: 163943 - DNA, 16 bp, H. sapiens
ttctgaagttttgttt

SEQ ID NO: 163944 - DNA, 16 bp, H. sapiens
ttctgaataaagaaaa

SEQ ID NO: 163945 - DNA, 16 bp, H. sapiens
ttctgaataatttctt

SEQ ID NO: 163946 - DNA, 16 bp, H. sapiens
ttctgaatacagcaca

SEQ ID NO: 163947 - DNA, 16 bp, H. sapiens
ttctgaatatttaata

SEQ ID NO: 163948 - DNA, 16 bp, H. sapiens
ttctgaatcaaggtga

SEQ ID NO: 163949 - DNA, 16 bp, H. sapiens
ttctgaatgcttctaa

SEQ ID NO: 163950 - DNA, 16 bp, H. sapiens
ttctgaatgggcaaaa

SEQ ID NO: 163951 - DNA, 16 bp, H. sapiens
ttctgaatgtttgaaa

SEQ ID NO: 163952 - DNA, 16 bp, H. sapiens
ttctgaattaaaaaaa

SEQ ID NO: 163953 - DNA, 16 bp, H. sapiens
ttctgaattctgaaat

SEQ ID NO: 163954 - DNA, 16 bp, H. sapiens
ttctgaatttgtttat

SEQ ID NO: 163955 - DNA, 16 bp, H. sapiens
ttctgaattttaaaaa

SEQ ID NO: 163956 - DNA, 16 bp, H. sapiens
ttctgacaaaacagat

SEQ ID NO: 163957 - DNA, 25 bp, H. sapiens
ttctgacaaagggctaatatccaga

SEQ ID NO: 163958 - DNA, 16 bp, H. sapiens
ttctgacaccaaatat

SEQ ID NO: 163959 - DNA, 16 bp, H. sapiens
ttctgacccagagaac

SEQ ID NO: 163960 - DNA, 16 bp, H. sapiens
ttctgaccccaggtga

SEQ ID NO: 163961 - DNA, 16 bp, H. sapiens
ttctgactcatccttg

SEQ ID NO: 163962 - DNA, 16 bp, H. sapiens
ttctgactgagctcct

SEQ ID NO: 163963 - DNA, 16 bp, H. sapiens
ttctgactggtataag

SEQ ID NO: 163964 - DNA, 16 bp, H. sapiens
ttctgactttgtgatc

SEQ ID NO: 163965 - DNA, 16 bp, H. sapiens
ttctgactttttctaa

SEQ ID NO: 163966 - DNA, 16 bp, H. sapiens
ttctgagaaaactgga

SEQ ID NO: 163967 - DNA, 16 bp, H. sapiens
ttctgagaaactggat

SEQ ID NO: 163968 - DNA, 16 bp, H. sapiens
ttctgagaaacttcta

SEQ ID NO: 163969 - DNA, 16 bp, H. sapiens
ttctgagaaacttctt

SEQ ID NO: 163970 - DNA, 16 bp, H. sapiens
ttctgagaaaggaaaa

SEQ ID NO: 163971 - DNA, 16 bp, H. sapiens
ttctgagaaatgaaat

SEQ ID NO: 163972 - DNA, 16 bp, H. sapiens
ttctgagaaatgcatc

SEQ ID NO: 163973 - DNA, 16 bp, H. sapiens
ttctgagaaatgtatt

SEQ ID NO: 163974 - DNA, 16 bp, H. sapiens
ttctgagaaatgtcta

SEQ ID NO: 163975 - DNA, 16 bp, H. sapiens
ttctgagaaatgtctg

SEQ ID NO: 163976 - DNA, 16 bp, H. sapiens
ttctgagaaatgtgtc

SEQ ID NO: 163977 - DNA, 16 bp, H. sapiens
ttctgagaaattcatc

SEQ ID NO: 163978 - DNA, 16 bp, H. sapiens
ttctgagaagtcagat

SEQ ID NO: 163979 - DNA, 16 bp, H. sapiens
ttctgagaattaaatg

SEQ ID NO: 163980 - DNA, 16 bp, H. sapiens
ttctgagacacagtct

SEQ ID NO: 163981 - DNA, 16 bp, H. sapiens
ttctgagacagtgtct

SEQ ID NO: 163982 - DNA, 16 bp, H. sapiens
ttctgagagagaaaaa

SEQ ID NO: 163983 - DNA, 16 bp, H. sapiens
ttctgagatggagtct

SEQ ID NO: 163984 - DNA, 16 bp, H. sapiens
ttctgagcaaactatt

SEQ ID NO: 163985 - DNA, 16 bp, H. sapiens
ttctgagcacgtttaa

SEQ ID NO: 163986 - DNA, 16 bp, H. sapiens
ttctgagcactttaca

SEQ ID NO: 163987 - DNA, 16 bp, H. sapiens
ttctgagcagaggagg

SEQ ID NO: 163988 - DNA, 16 bp, H. sapiens
ttctgagcagcaggtc

SEQ ID NO: 163989 - DNA, 16 bp, H. sapiens
ttctgagcagtgtgat

SEQ ID NO: 163990 - DNA, 16 bp, H. sapiens
ttctgagcatttattt

SEQ ID NO: 163991 - DNA, 16 bp, H. sapiens
ttctgagccaggagaa

SEQ ID NO: 163992 - DNA, 16 bp, H. sapiens
ttctgagcccataaaa

SEQ ID NO: 163993 - DNA, 16 bp, H. sapiens
ttctgagccccagttt

SEQ ID NO: 163994 - DNA, 16 bp, H. sapiens
ttctgagcctatgtgt

SEQ ID NO: 163995 - DNA, 16 bp, H. sapiens
ttctgagctcaagtga

SEQ ID NO: 163996 - DNA, 16 bp, H. sapiens
ttctgaggaatccagg

SEQ ID NO: 163997 - DNA, 16 bp, H. sapiens
ttctgaggagacaaga

SEQ ID NO: 163998 - DNA, 16 bp, H. sapiens
ttctgaggaggtgaca

SEQ ID NO: 163999 - DNA, 16 bp, H. sapiens
ttctgaggcactgggg

SEQ ID NO: 164000 - DNA, 16 bp, H. sapiens
ttctgagggaacagga

SEQ ID NO: 164001 - DNA, 16 bp, H. sapiens
ttctgaggtattttat

SEQ ID NO: 164002 - DNA, 16 bp, H. sapiens
ttctgaggtttcagtt

SEQ ID NO: 164003 - DNA, 16 bp, H. sapiens
ttctgagtagtgtgat

SEQ ID NO: 164004 - DNA, 16 bp, H. sapiens
ttctgagtttttgtcc

SEQ ID NO: 164005 - DNA, 16 bp, H. sapiens
ttctgataactttgga

SEQ ID NO: 164006 - DNA, 16 bp, H. sapiens
ttctgatatcctttct

SEQ ID NO: 164007 - DNA, 16 bp, H. sapiens
ttctgatattgataat

SEQ ID NO: 164008 - DNA, 16 bp, H. sapiens
ttctgatcctgaagag

SEQ ID NO: 164009 - DNA, 16 bp, H. sapiens
ttctgatgcacagcca

SEQ ID NO: 164010 - DNA, 16 bp, H. sapiens
ttctgatgcctcagcc

SEQ ID NO: 164011 - DNA, 16 bp, H. sapiens
ttctgatgctttgaca

SEQ ID NO: 164012 - DNA, 20 bp, H. sapiens
ttctgatgttcggatgtgtt

SEQ ID NO: 164013 - DNA, 16 bp, H. sapiens
ttctgatgtttgcatt

SEQ ID NO: 164014 - DNA, 16 bp, H. sapiens
ttctgattatgtttat

SEQ ID NO: 164015 - DNA, 16 bp, H. sapiens
ttctgattattttaat

SEQ ID NO: 164016 - DNA, 16 bp, H. sapiens
ttctgattcagaaagt

SEQ ID NO: 164017 - DNA, 16 bp, H. sapiens
ttctgattcagaagat

SEQ ID NO: 164018 - DNA, 16 bp, H. sapiens
ttctgattcagtaggt

SEQ ID NO: 164019 - DNA, 16 bp, H. sapiens
ttctgattctgtttct

SEQ ID NO: 164020 - DNA, 16 bp, H. sapiens
ttctgattgcatttat

SEQ ID NO: 164021 - DNA, 16 bp, H. sapiens
ttctgattgtgtttgt

SEQ ID NO: 164022 - DNA, 16 bp, H. sapiens
ttctgatttaattgat

SEQ ID NO: 164023 - DNA, 16 bp, H. sapiens
ttctgatttcaaaata

SEQ ID NO: 164024 - DNA, 16 bp, H. sapiens
ttctgatttccttgca

SEQ ID NO: 164025 - DNA, 16 bp, H. sapiens
ttctgattttaaaatt

SEQ ID NO: 164026 - DNA, 16 bp, H. sapiens
ttctgattttgaaaat

SEQ ID NO: 164027 - DNA, 16 bp, H. sapiens
ttctgatttttgcaca

SEQ ID NO: 164028 - DNA, 16 bp, H. sapiens
ttctgcaaagaacatg

SEQ ID NO: 164029 - DNA, 16 bp, H. sapiens
ttctgcaagctccatt

SEQ ID NO: 164030 - DNA, 16 bp, H. sapiens
ttctgcaaggctgggg

SEQ ID NO: 164031 - DNA, 16 bp, H. sapiens
ttctgcaatgatggaa

SEQ ID NO: 164032 - DNA, 16 bp, H. sapiens
ttctgcacagcataag

SEQ ID NO: 164033 - DNA, 16 bp, H. sapiens
ttctgcacatgtatct

SEQ ID NO: 164034 - DNA, 16 bp, H. sapiens
ttctgcaccttgcttt

SEQ ID NO: 164035 - DNA, 16 bp, H. sapiens
ttctgcacggcaaaag

SEQ ID NO: 164036 - DNA, 16 bp, H. sapiens
ttctgcagactgtaca

SEQ ID NO: 164037 - DNA, 16 bp, H. sapiens
ttctgcagccaacttg

SEQ ID NO: 164038 - DNA, 17 bp, H. sapiens
ttctgcagcctctgctg

SEQ ID NO: 164039 - DNA, 16 bp, H. sapiens
ttctgcagctgcaggc

SEQ ID NO: 164040 - DNA, 16 bp, H. sapiens
ttctgcaggctgtgta

SEQ ID NO: 164041 - DNA, 16 bp, H. sapiens
ttctgcagtatttgct

SEQ ID NO: 164042 - DNA, 16 bp, H. sapiens
ttctgcagtgcattgt

SEQ ID NO: 164043 - DNA, 16 bp, H. sapiens
ttctgcagtggacacc

SEQ ID NO: 164044 - DNA, 16 bp, H. sapiens
ttctgcataacaaagg

SEQ ID NO: 164045 - DNA, 16 bp, H. sapiens
ttctgcatagctgggg

SEQ ID NO: 164046 - DNA, 16 bp, H. sapiens
ttctgcatataaatat

SEQ ID NO: 164047 - DNA, 16 bp, H. sapiens
ttctgcatatggctag

SEQ ID NO: 164048 - DNA, 16 bp, H. sapiens
ttctgcatatgtatcc

SEQ ID NO: 164049 - DNA, 16 bp, H. sapiens
ttctgcatcagcctcc

SEQ ID NO: 164050 - DNA, 16 bp, H. sapiens
ttctgcatctgctgag

SEQ ID NO: 164051 - DNA, 16 bp, H. sapiens
ttctgcatctgtagat

SEQ ID NO: 164052 - DNA, 16 bp, H. sapiens
ttctgcatggcaaaat

SEQ ID NO: 164053 - DNA, 16 bp, H. sapiens
ttctgcatgtggatgt

SEQ ID NO: 164054 - DNA, 16 bp, H. sapiens
ttctgcatttaaaata

SEQ ID NO: 164055 - DNA, 16 bp, H. sapiens
ttctgcatttctgaca

SEQ ID NO: 164056 - DNA, 16 bp, H. sapiens
ttctgcatttcttaca

SEQ ID NO: 164057 - DNA, 16 bp, H. sapiens
ttctgccaacagcctg

SEQ ID NO: 164058 - DNA, 16 bp, H. sapiens
ttctgccacctcagcc

SEQ ID NO: 164059 - DNA, 16 bp, H. sapiens
ttctgccatcattgtg

SEQ ID NO: 164060 - DNA, 16 bp, H. sapiens
ttctgccatgaatgtg

SEQ ID NO: 164061 - DNA, 16 bp, H. sapiens
ttctgccatgaggaca

SEQ ID NO: 164062 - DNA, 16 bp, H. sapiens
ttctgccatgagtgtg

SEQ ID NO: 164063 - DNA, 18 bp, H. sapiens
ttctgccatggcttcagc

SEQ ID NO: 164064 - DNA, 16 bp, H. sapiens
ttctgccatgtaagga

SEQ ID NO: 164065 - DNA, 16 bp, H. sapiens
ttctgcccagcaaaag

SEQ ID NO: 164066 - DNA, 16 bp, H. sapiens
ttctgcccattcagta

SEQ ID NO: 164067 - DNA, 16 bp, H. sapiens
ttctgccccagcctcc

SEQ ID NO: 164068 - DNA, 16 bp, H. sapiens
ttctgccccattctct

SEQ ID NO: 164069 - DNA, 16 bp, H. sapiens
ttctgccctgtgttgc

SEQ ID NO: 164070 - DNA, 16 bp, H. sapiens
ttctgcctaccacaaa

SEQ ID NO: 164071 - DNA, 16 bp, H. sapiens
ttctgcctcagactcc

SEQ ID NO: 164072 - DNA, 16 bp, H. sapiens
ttctgcctcagcatcc

SEQ ID NO: 164073 - DNA, 16 bp, H. sapiens
ttctgcctcagccccc

SEQ ID NO: 164074 - DNA, 16 bp, H. sapiens
ttctgcctcagccctc

SEQ ID NO: 164075 - DNA, 16 bp, H. sapiens
ttctgcctcagcctcc

SEQ ID NO: 164076 - DNA, 16 bp, H. sapiens
ttctgcctcagcctct

SEQ ID NO: 164077 - DNA, 16 bp, H. sapiens
ttctgcctcagccttc

SEQ ID NO: 164078 - DNA, 16 bp, H. sapiens
ttctgcctcagctgcc

SEQ ID NO: 164079 - DNA, 16 bp, H. sapiens
ttctgcctcagcttcc

SEQ ID NO: 164080 - DNA, 16 bp, H. sapiens
ttctgcctcaggctcc

SEQ ID NO: 164081 - DNA, 16 bp, H. sapiens
ttctgcctcctgggtt

SEQ ID NO: 164082 - DNA, 16 bp, H. sapiens
ttctgcctcggcctct

SEQ ID NO: 164083 - DNA, 16 bp, H. sapiens
ttctgcctctgtggat

SEQ ID NO: 164084 - DNA, 16 bp, H. sapiens
ttctgcctctgtggct

SEQ ID NO: 164085 - DNA, 16 bp, H. sapiens
ttctgcctgagcctcc

SEQ ID NO: 164086 - DNA, 16 bp, H. sapiens
ttctgcctgggcatct

SEQ ID NO: 164087 - DNA, 16 bp, H. sapiens
ttctgcctgggtgaca

SEQ ID NO: 164088 - DNA, 16 bp, H. sapiens
ttctgccttagcctcc

SEQ ID NO: 164089 - DNA, 16 bp, H. sapiens
ttctgccttcattttg

SEQ ID NO: 164090 - DNA, 16 bp, H. sapiens
ttctgccttccgggtt

SEQ ID NO: 164091 - DNA, 16 bp, H. sapiens
ttctgccttcctgcct

SEQ ID NO: 164092 - DNA, 16 bp, H. sapiens
ttctgccttctgtcat

SEQ ID NO: 164093 - DNA, 16 bp, H. sapiens
ttctgccttgtatcca

SEQ ID NO: 164094 - DNA, 16 bp, H. sapiens
ttctgcctttatttta

SEQ ID NO: 164095 - DNA, 16 bp, H. sapiens
ttctgcctttctggac

SEQ ID NO: 164096 - DNA, 16 bp, H. sapiens
ttctgccttttaaaat

SEQ ID NO: 164097 - DNA, 16 bp, H. sapiens
ttctgctatttaaaaa

SEQ ID NO: 164098 - DNA, 16 bp, H. sapiens
ttctgctcagcaaaat

SEQ ID NO: 164099 - DNA, 16 bp, H. sapiens
ttctgctccatcaggt

SEQ ID NO: 164100 - DNA, 16 bp, H. sapiens
ttctgctcctggcccc

SEQ ID NO: 164101 - DNA, 16 bp, H. sapiens
ttctgctgaaaaatct

SEQ ID NO: 164102 - DNA, 16 bp, H. sapiens
ttctgctgagaagtcc

SEQ ID NO: 164103 - DNA, 16 bp, H. sapiens
ttctgctgccctgtga

SEQ ID NO: 164104 - DNA, 16 bp, H. sapiens
ttctgctgccttttat

SEQ ID NO: 164105 - DNA, 16 bp, H. sapiens
ttctgctgcttctgct

SEQ ID NO: 164106 - DNA, 16 bp, H. sapiens
ttctgctggtcttgcc

SEQ ID NO: 164107 - DNA, 16 bp, H. sapiens
ttctgctgtctctcct

SEQ ID NO: 164108 - DNA, 16 bp, H. sapiens
ttctgctgtgtgagga

SEQ ID NO: 164109 - DNA, 16 bp, H. sapiens
ttctgcttatttttaa

SEQ ID NO: 164110 - DNA, 16 bp, H. sapiens
ttctgcttcagcctcc

SEQ ID NO: 164111 - DNA, 16 bp, H. sapiens
ttctgcttcagcttcc

SEQ ID NO: 164112 - DNA, 16 bp, H. sapiens
ttctgcttcagtaggt

SEQ ID NO: 164113 - DNA, 16 bp, H. sapiens
ttctgcttcagtctcc

SEQ ID NO: 164114 - DNA, 16 bp, H. sapiens
ttctgcttcattttct

SEQ ID NO: 164115 - DNA, 16 bp, H. sapiens
ttctgcttccattttt

SEQ ID NO: 164116 - DNA, 16 bp, H. sapiens
ttctgcttcctcatct

SEQ ID NO: 164117 - DNA, 16 bp, H. sapiens
ttctgcttctgccact

SEQ ID NO: 164118 - DNA, 16 bp, H. sapiens
ttctgcttctgctgct

SEQ ID NO: 164119 - DNA, 16 bp, H. sapiens
ttctgcttctgtgagt

SEQ ID NO: 164120 - DNA, 16 bp, H. sapiens
ttctgcttgaggagag

SEQ ID NO: 164121 - DNA, 16 bp, H. sapiens
ttctgcttggtctagt

SEQ ID NO: 164122 - DNA, 16 bp, H. sapiens
ttctgcttggtgttct

SEQ ID NO: 164123 - DNA, 16 bp, H. sapiens
ttctgctttaaaatat

SEQ ID NO: 164124 - DNA, 16 bp, H. sapiens
ttctgctttaaatgtt

SEQ ID NO: 164125 - DNA, 16 bp, H. sapiens
ttctgctttagcctcc

SEQ ID NO: 164126 - DNA, 16 bp, H. sapiens
ttctgcttttacttct

SEQ ID NO: 164127 - DNA, 16 bp, H. sapiens
ttctgcttttatttca

SEQ ID NO: 164128 - DNA, 16 bp, H. sapiens
ttctgcttttgcattt

SEQ ID NO: 164129 - DNA, 16 bp, H. sapiens
ttctggaaaaaaaaaa

SEQ ID NO: 164130 - DNA, 16 bp, H. sapiens
ttctggaaaaaaataa

SEQ ID NO: 164131 - DNA, 16 bp, H. sapiens
ttctggaaaaagtaaa

SEQ ID NO: 164132 - DNA, 16 bp, H. sapiens
ttctggaaaagaaatt

SEQ ID NO: 164133 - DNA, 16 bp, H. sapiens
ttctggaaaagagaaa

SEQ ID NO: 164134 - DNA, 16 bp, H. sapiens
ttctggaaaaggcaaa

SEQ ID NO: 164135 - DNA, 16 bp, H. sapiens
ttctggaaaaggtaaa

SEQ ID NO: 164136 - DNA, 16 bp, H. sapiens
ttctggaaaataaatg

SEQ ID NO: 164137 - DNA, 16 bp, H. sapiens
ttctggaaaatatttt

SEQ ID NO: 164138 - DNA, 16 bp, H. sapiens
ttctggaaacacacaa

SEQ ID NO: 164139 - DNA, 16 bp, H. sapiens
ttctggaaacatcctc

SEQ ID NO: 164140 - DNA, 16 bp, H. sapiens
ttctggaaaccatggg

SEQ ID NO: 164141 - DNA, 16 bp, H. sapiens
ttctggaaagtctcag

SEQ ID NO: 164142 - DNA, 16 bp, H. sapiens
ttctggaaagttttct

SEQ ID NO: 164143 - DNA, 16 bp, H. sapiens
ttctggaaatgaaaaa

SEQ ID NO: 164144 - DNA, 16 bp, H. sapiens
ttctggaaatgaagga

SEQ ID NO: 164145 - DNA, 16 bp, H. sapiens
ttctggaaatggatag

SEQ ID NO: 164146 - DNA, 16 bp, H. sapiens
ttctggaaattttatt

SEQ ID NO: 164147 - DNA, 16 bp, H. sapiens
ttctggaacaactgga

SEQ ID NO: 164148 - DNA, 16 bp, H. sapiens
ttctggaacagaaaaa

SEQ ID NO: 164149 - DNA, 16 bp, H. sapiens
ttctggaactagatag

SEQ ID NO: 164150 - DNA, 16 bp, H. sapiens
ttctggaactccaatt

SEQ ID NO: 164151 - DNA, 16 bp, H. sapiens
ttctggaagaaaagaa

SEQ ID NO: 164152 - DNA, 16 bp, H. sapiens
ttctggaagacagtgt

SEQ ID NO: 164153 - DNA, 16 bp, H. sapiens
ttctggaagagactgt

SEQ ID NO: 164154 - DNA, 16 bp, H. sapiens
ttctggaagctggaaa

SEQ ID NO: 164155 - DNA, 16 bp, H. sapiens
ttctggaagcttctgg

SEQ ID NO: 164156 - DNA, 16 bp, H. sapiens
ttctggaagtcagaaa

SEQ ID NO: 164157 - DNA, 16 bp, H. sapiens
ttctggaagtgaatgg

SEQ ID NO: 164158 - DNA, 16 bp, H. sapiens
ttctggaagttagaag

SEQ ID NO: 164159 - DNA, 16 bp, H. sapiens
ttctggaatatttgca

SEQ ID NO: 164160 - DNA, 16 bp, H. sapiens
ttctggaatgagggtc

SEQ ID NO: 164161 - DNA, 16 bp, H. sapiens
ttctggaattttatat

SEQ ID NO: 164162 - DNA, 16 bp, H. sapiens
ttctggacagctgaac

SEQ ID NO: 164163 - DNA, 16 bp, H. sapiens
ttctggacattggcct

SEQ ID NO: 164164 - DNA, 16 bp, H. sapiens
ttctggacatttcaca

SEQ ID NO: 164165 - DNA, 16 bp, H. sapiens
ttctggacatttcata

SEQ ID NO: 164166 - DNA, 16 bp, H. sapiens
ttctggacattttata

SEQ ID NO: 164167 - DNA, 16 bp, H. sapiens
ttctggacttttcttt

SEQ ID NO: 164168 - DNA, 16 bp, H. sapiens
ttctggagaaaaataa

SEQ ID NO: 164169 - DNA, 16 bp, H. sapiens
ttctggagacaagaaa

SEQ ID NO: 164170 - DNA, 16 bp, H. sapiens
ttctggagacctaatg

SEQ ID NO: 164171 - DNA, 16 bp, H. sapiens
ttctggagactgagaa

SEQ ID NO: 164172 - DNA, 16 bp, H. sapiens
ttctggagagaaattc

SEQ ID NO: 164173 - DNA, 16 bp, H. sapiens
ttctggagatgggtgg

SEQ ID NO: 164174 - DNA, 16 bp, H. sapiens
ttctggagcctggaag

SEQ ID NO: 164175 - DNA, 16 bp, H. sapiens
ttctggagctaaaaat

SEQ ID NO: 164176 - DNA, 16 bp, H. sapiens
ttctggagctgaagaa

SEQ ID NO: 164177 - DNA, 16 bp, H. sapiens
ttctggaggacagaag

SEQ ID NO: 164178 - DNA, 16 bp, H. sapiens
ttctggaggatgggaa

SEQ ID NO: 164179 - DNA, 16 bp, H. sapiens
ttctggaggctctagg

SEQ ID NO: 164180 - DNA, 16 bp, H. sapiens
ttctggaggctggaca

SEQ ID NO: 164181 - DNA, 16 bp, H. sapiens
ttctggagggcaattt

SEQ ID NO: 164182 - DNA, 16 bp, H. sapiens
ttctggaggtgggaag

SEQ ID NO: 164183 - DNA, 16 bp, H. sapiens
ttctggagtctggaag

SEQ ID NO: 164184 - DNA, 16 bp, H. sapiens
ttctggatatattttt

SEQ ID NO: 164185 - DNA, 16 bp, H. sapiens
ttctggatattagtca

SEQ ID NO: 164186 - DNA, 16 bp, H. sapiens
ttctggatgctagaag

SEQ ID NO: 164187 - DNA, 16 bp, H. sapiens
ttctggatgctggaag

SEQ ID NO: 164188 - DNA, 16 bp, H. sapiens
ttctggattctggatt

SEQ ID NO: 164189 - DNA, 16 bp, H. sapiens
ttctggattttgtcaa

SEQ ID NO: 164190 - DNA, 16 bp, H. sapiens
ttctggcaatatgaca

SEQ ID NO: 164191 - DNA, 16 bp, H. sapiens
ttctggcactggggaa

SEQ ID NO: 164192 - DNA, 16 bp, H. sapiens
ttctggccaatgaaat

SEQ ID NO: 164193 - DNA, 16 bp, H. sapiens
ttctggccaatggaat

SEQ ID NO: 164194 - DNA, 16 bp, H. sapiens
ttctggccacactggc

SEQ ID NO: 164195 - DNA, 16 bp, H. sapiens
ttctggccatgctggc

SEQ ID NO: 164196 - DNA, 16 bp, H. sapiens
ttctggccctggcccc

SEQ ID NO: 164197 - DNA, 16 bp, H. sapiens
ttctggccctgtgtct

SEQ ID NO: 164198 - DNA, 16 bp, H. sapiens
ttctggccgggcgcgg

SEQ ID NO: 164199 - DNA, 16 bp, H. sapiens
ttctggcctcagcctc

SEQ ID NO: 164200 - DNA, 16 bp, H. sapiens
ttctggcctccacaac

SEQ ID NO: 164201 - DNA, 16 bp, H. sapiens
ttctggcctccagaac

SEQ ID NO: 164202 - DNA, 16 bp, H. sapiens
ttctggcctccagacc

SEQ ID NO: 164203 - DNA, 16 bp, H. sapiens
ttctggcctccagcac

SEQ ID NO: 164204 - DNA, 16 bp, H. sapiens
ttctggctattgtaaa

SEQ ID NO: 164205 - DNA, 16 bp, H. sapiens
ttctggctccccatcc

SEQ ID NO: 164206 - DNA, 16 bp, H. sapiens
ttctggctctgccaca

SEQ ID NO: 164207 - DNA, 16 bp, H. sapiens
ttctggctctgtcatt

SEQ ID NO: 164208 - DNA, 16 bp, H. sapiens
ttctggcttttgaaat

SEQ ID NO: 164209 - DNA, 16 bp, H. sapiens
ttctggcttttggaat

SEQ ID NO: 164210 - DNA, 16 bp, H. sapiens
ttctgggaagatggca

SEQ ID NO: 164211 - DNA, 16 bp, H. sapiens
ttctgggatatatgtg

SEQ ID NO: 164212 - DNA, 16 bp, H. sapiens
ttctgggatgggagag

SEQ ID NO: 164213 - DNA, 16 bp, H. sapiens
ttctgggattcagttt

SEQ ID NO: 164214 - DNA, 16 bp, H. sapiens
ttctgggatttaaata

SEQ ID NO: 164215 - DNA, 16 bp, H. sapiens
ttctgggcactgggga

SEQ ID NO: 164216 - DNA, 16 bp, H. sapiens
ttctgggccaggtgca

SEQ ID NO: 164217 - DNA, 16 bp, H. sapiens
ttctgggctcaaggga

SEQ ID NO: 164218 - DNA, 16 bp, H. sapiens
ttctgggctgggtgtg

SEQ ID NO: 164219 - DNA, 16 bp, H. sapiens
ttctgggcttttcctt

SEQ ID NO: 164220 - DNA, 16 bp, H. sapiens
ttctggggaaaaaaaa

SEQ ID NO: 164221 - DNA, 16 bp, H. sapiens
ttctggggaaaaataa

SEQ ID NO: 164222 - DNA, 16 bp, H. sapiens
ttctggggaggaattc

SEQ ID NO: 164223 - DNA, 16 bp, H. sapiens
ttctggggtctctttt

SEQ ID NO: 164224 - DNA, 16 bp, H. sapiens
ttctgggtatttatcc

SEQ ID NO: 164225 - DNA, 16 bp, H. sapiens
ttctgggtcataaaac

SEQ ID NO: 164226 - DNA, 16 bp, H. sapiens
ttctgggtctataaac

SEQ ID NO: 164227 - DNA, 16 bp, H. sapiens
ttctgggtcttttgct

SEQ ID NO: 164228 - DNA, 16 bp, H. sapiens
ttctgggtgggggcca

SEQ ID NO: 164229 - DNA, 16 bp, H. sapiens
ttctgggttctatatt

SEQ ID NO: 164230 - DNA, 17 bp, H. sapiens
ttctggtacaccaatca

SEQ ID NO: 164231 - DNA, 16 bp, H. sapiens
ttctggtcaatagtag

SEQ ID NO: 164232 - DNA, 16 bp, H. sapiens
ttctggtctctctatt

SEQ ID NO: 164233 - DNA, 16 bp, H. sapiens
ttctggtctctctctc

SEQ ID NO: 164234 - DNA, 16 bp, H. sapiens
ttctggtgagggccct

SEQ ID NO: 164235 - DNA, 16 bp, H. sapiens
ttctggtgggagtgac

SEQ ID NO: 164236 - DNA, 16 bp, H. sapiens
ttctggtgttctattg

SEQ ID NO: 164237 - DNA, 16 bp, H. sapiens
ttctggttgttttgca

SEQ ID NO: 164238 - DNA, 16 bp, H. sapiens
ttctggttgtttttaa

SEQ ID NO: 164239 - DNA, 16 bp, H. sapiens
ttctggtttaaaaaaa

SEQ ID NO: 164240 - DNA, 16 bp, H. sapiens
ttctgtaaaaaatgat

SEQ ID NO: 164241 - DNA, 16 bp, H. sapiens
ttctgtaaacattttt

SEQ ID NO: 164242 - DNA, 16 bp, H. sapiens
ttctgtaaacttaaaa

SEQ ID NO: 164243 - DNA, 16 bp, H. sapiens
ttctgtaaaggaccag

SEQ ID NO: 164244 - DNA, 16 bp, H. sapiens
ttctgtaaatatatat

SEQ ID NO: 164245 - DNA, 16 bp, H. sapiens
ttctgtaaatatctgt

SEQ ID NO: 164246 - DNA, 16 bp, H. sapiens
ttctgtaaatatgtat

SEQ ID NO: 164247 - DNA, 16 bp, H. sapiens
ttctgtaagtttgact

SEQ ID NO: 164248 - DNA, 16 bp, H. sapiens
ttctgtaatatttatt

SEQ ID NO: 164249 - DNA, 16 bp, H. sapiens
ttctgtaattctgaaa

SEQ ID NO: 164250 - DNA, 16 bp, H. sapiens
ttctgtacagcctgtg

SEQ ID NO: 164251 - DNA, 16 bp, H. sapiens
ttctgtacatgtatcc

SEQ ID NO: 164252 - DNA, 16 bp, H. sapiens
ttctgtagatgtccat

SEQ ID NO: 164253 - DNA, 16 bp, H. sapiens
ttctgtagattgtttt

SEQ ID NO: 164254 - DNA, 16 bp, H. sapiens
ttctgtaggtggtctg

SEQ ID NO: 164255 - DNA, 17 bp, H. sapiens
ttctgtaggtttcctgt

SEQ ID NO: 164256 - DNA, 16 bp, H. sapiens
ttctgtagtttgaaaa

SEQ ID NO: 164257 - DNA, 16 bp, H. sapiens
ttctgtataaattact

SEQ ID NO: 164258 - DNA, 16 bp, H. sapiens
ttctgtatatttgaaa

SEQ ID NO: 164259 - DNA, 16 bp, H. sapiens
ttctgtatccagtcta

SEQ ID NO: 164260 - DNA, 16 bp, H. sapiens
ttctgtatgaacttta

SEQ ID NO: 164261 - DNA, 16 bp, H. sapiens
ttctgtatgacactgt

SEQ ID NO: 164262 - DNA, 16 bp, H. sapiens
ttctgtatggttctgt

SEQ ID NO: 164263 - DNA, 16 bp, H. sapiens
ttctgtatgtatttta

SEQ ID NO: 164264 - DNA, 16 bp, H. sapiens
ttctgtatgtctgaaa

SEQ ID NO: 164265 - DNA, 16 bp, H. sapiens
ttctgtattatttaaa

SEQ ID NO: 164266 - DNA, 16 bp, H. sapiens
ttctgtattctgtatt

SEQ ID NO: 164267 - DNA, 16 bp, H. sapiens
ttctgtattcttagta

SEQ ID NO: 164268 - DNA, 16 bp, H. sapiens
ttctgtatttagaaaa

SEQ ID NO: 164269 - DNA, 16 bp, H. sapiens
ttctgtcaacttgtca

SEQ ID NO: 164270 - DNA, 17 bp, H. sapiens
ttctgtcacccaggcta

SEQ ID NO: 164271 - DNA, 16 bp, H. sapiens
ttctgtcacccaggtt

SEQ ID NO: 164272 - DNA, 16 bp, H. sapiens
ttctgtcacttctttt

SEQ ID NO: 164273 - DNA, 16 bp, H. sapiens
ttctgtcagttcatca

SEQ ID NO: 164274 - DNA, 16 bp, H. sapiens
ttctgtcagtttttgc

SEQ ID NO: 164275 - DNA, 16 bp, H. sapiens
ttctgtcataaagaca

SEQ ID NO: 164276 - DNA, 16 bp, H. sapiens
ttctgtcatgagttgc

SEQ ID NO: 164277 - DNA, 16 bp, H. sapiens
ttctgtcatgattgta

SEQ ID NO: 164278 - DNA, 16 bp, H. sapiens
ttctgtcattggttct

SEQ ID NO: 164279 - DNA, 16 bp, H. sapiens
ttctgtcatttaaaat

SEQ ID NO: 164280 - DNA, 16 bp, H. sapiens
ttctgtccaaaaaaaa

SEQ ID NO: 164281 - DNA, 16 bp, H. sapiens
ttctgtcccccaggct

SEQ ID NO: 164282 - DNA, 16 bp, H. sapiens
ttctgtctagtgttta

SEQ ID NO: 164283 - DNA, 16 bp, H. sapiens
ttctgtctataaattt

SEQ ID NO: 164284 - DNA, 16 bp, H. sapiens
ttctgtctcagcctcc

SEQ ID NO: 164285 - DNA, 16 bp, H. sapiens
ttctgtctcagcctct

SEQ ID NO: 164286 - DNA, 16 bp, H. sapiens
ttctgtctctgccagg

SEQ ID NO: 164287 - DNA, 16 bp, H. sapiens
ttctgtctctgctgct

SEQ ID NO: 164288 - DNA, 16 bp, H. sapiens
ttctgtctctggattt

SEQ ID NO: 164289 - DNA, 16 bp, H. sapiens
ttctgtctctgtgaat

SEQ ID NO: 164290 - DNA, 16 bp, H. sapiens
ttctgtctctgtgatt

SEQ ID NO: 164291 - DNA, 16 bp, H. sapiens
ttctgtctctgtgtgt

SEQ ID NO: 164292 - DNA, 16 bp, H. sapiens
ttctgtctcttccact

SEQ ID NO: 164293 - DNA, 16 bp, H. sapiens
ttctgtctgattttta

SEQ ID NO: 164294 - DNA, 16 bp, H. sapiens
ttctgtctgcctctct

SEQ ID NO: 164295 - DNA, 16 bp, H. sapiens
ttctgtcttcattttg

SEQ ID NO: 164296 - DNA, 16 bp, H. sapiens
ttctgtcttcctctga

SEQ ID NO: 164297 - DNA, 16 bp, H. sapiens
ttctgtcttgttaatc

SEQ ID NO: 164298 - DNA, 16 bp, H. sapiens
ttctgtctttatgaat

SEQ ID NO: 164299 - DNA, 16 bp, H. sapiens
ttctgtctttcaccat

SEQ ID NO: 164300 - DNA, 16 bp, H. sapiens
ttctgtctttgacttt

SEQ ID NO: 164301 - DNA, 16 bp, H. sapiens
ttctgtgaaaaaagtc

SEQ ID NO: 164302 - DNA, 16 bp, H. sapiens
ttctgtgaaaatgtca

SEQ ID NO: 164303 - DNA, 16 bp, H. sapiens
ttctgtgaaatatttt

SEQ ID NO: 164304 - DNA, 16 bp, H. sapiens
ttctgtgaacatttgt

SEQ ID NO: 164305 - DNA, 16 bp, H. sapiens
ttctgtgaacccacag

SEQ ID NO: 164306 - DNA, 16 bp, H. sapiens
ttctgtgaagaatgta

SEQ ID NO: 164307 - DNA, 16 bp, H. sapiens
ttctgtgaatctaaaa

SEQ ID NO: 164308 - DNA, 16 bp, H. sapiens
ttctgtgaccttgagc

SEQ ID NO: 164309 - DNA, 16 bp, H. sapiens
ttctgtgacttgtctt

SEQ ID NO: 164310 - DNA, 16 bp, H. sapiens
ttctgtgactttattt

SEQ ID NO: 164311 - DNA, 16 bp, H. sapiens
ttctgtgagaagaatg

SEQ ID NO: 164312 - DNA, 16 bp, H. sapiens
ttctgtgagatcagtg

SEQ ID NO: 164313 - DNA, 16 bp, H. sapiens
ttctgtgagtccttct

SEQ ID NO: 164314 - DNA, 16 bp, H. sapiens
ttctgtgatatcagtt

SEQ ID NO: 164315 - DNA, 16 bp, H. sapiens
ttctgtgatattcctg

SEQ ID NO: 164316 - DNA, 16 bp, H. sapiens
ttctgtgccaggcact

SEQ ID NO: 164317 - DNA, 16 bp, H. sapiens
ttctgtgcctaactta

SEQ ID NO: 164318 - DNA, 16 bp, H. sapiens
ttctgtgcctcagtct

SEQ ID NO: 164319 - DNA, 16 bp, H. sapiens
ttctgtgcctcagttt

SEQ ID NO: 164320 - DNA, 16 bp, H. sapiens
ttctgtgcctcatttt

SEQ ID NO: 164321 - DNA, 16 bp, H. sapiens
ttctgtgcctgcctta

SEQ ID NO: 164322 - DNA, 16 bp, H. sapiens
ttctgtgccttggttt

SEQ ID NO: 164323 - DNA, 16 bp, H. sapiens
ttctgtggaaaaagca

SEQ ID NO: 164324 - DNA, 16 bp, H. sapiens
ttctgtggaattggtg

SEQ ID NO: 164325 - DNA, 16 bp, H. sapiens
ttctgtggacaccact

SEQ ID NO: 164326 - DNA, 16 bp, H. sapiens
ttctgtggatcaggaa

SEQ ID NO: 164327 - DNA, 16 bp, H. sapiens
ttctgtggctccaccc

SEQ ID NO: 164328 - DNA, 16 bp, H. sapiens
ttctgtgggatcgttg

SEQ ID NO: 164329 - DNA, 16 bp, H. sapiens
ttctgtgggccaggcc

SEQ ID NO: 164330 - DNA, 16 bp, H. sapiens
ttctgtggggccagtg

SEQ ID NO: 164331 - DNA, 16 bp, H. sapiens
ttctgtggtctggagg

SEQ ID NO: 164332 - DNA, 16 bp, H. sapiens
ttctgtggttgttgga

SEQ ID NO: 164333 - DNA, 16 bp, H. sapiens
ttctgtggtttcagtt

SEQ ID NO: 164334 - DNA, 16 bp, H. sapiens
ttctgtgtagttttta

SEQ ID NO: 164335 - DNA, 16 bp, H. sapiens
ttctgtgtatatgtgt

SEQ ID NO: 164336 - DNA, 16 bp, H. sapiens
ttctgtgtatgtgatg

SEQ ID NO: 164337 - DNA, 16 bp, H. sapiens
ttctgtgtattgattt

SEQ ID NO: 164338 - DNA, 16 bp, H. sapiens
ttctgtgtatttctgt

SEQ ID NO: 164339 - DNA, 16 bp, H. sapiens
ttctgtgtcaaaaaaa

SEQ ID NO: 164340 - DNA, 16 bp, H. sapiens
ttctgtgtctaaattt

SEQ ID NO: 164341 - DNA, 16 bp, H. sapiens
ttctgtgtctgaaagg

SEQ ID NO: 164342 - DNA, 16 bp, H. sapiens
ttctgtgtctgtgaat

SEQ ID NO: 164343 - DNA, 16 bp, H. sapiens
ttctgtgtcttcacat

SEQ ID NO: 164344 - DNA, 16 bp, H. sapiens
ttctgtgtgcccacag

SEQ ID NO: 164345 - DNA, 16 bp, H. sapiens
ttctgtgtgtaaacat

SEQ ID NO: 164346 - DNA, 16 bp, H. sapiens
ttctgtgtgtcaggaa

SEQ ID NO: 164347 - DNA, 16 bp, H. sapiens
ttctgtgtgtgtatct

SEQ ID NO: 164348 - DNA, 16 bp, H. sapiens
ttctgtgtgttttcat

SEQ ID NO: 164349 - DNA, 16 bp, H. sapiens
ttctgtgttaatttgc

SEQ ID NO: 164350 - DNA, 16 bp, H. sapiens
ttctgtgttcatgaat

SEQ ID NO: 164351 - DNA, 16 bp, H. sapiens
ttctgtgttgctcaca

SEQ ID NO: 164352 - DNA, 16 bp, H. sapiens
ttctgttaaaatattt

SEQ ID NO: 164353 - DNA, 16 bp, H. sapiens
ttctgttatagtaaca

SEQ ID NO: 164354 - DNA, 16 bp, H. sapiens
ttctgttatttaagcc

SEQ ID NO: 164355 - DNA, 16 bp, H. sapiens
ttctgttatttcactt

SEQ ID NO: 164356 - DNA, 17 bp, H. sapiens
ttctgttccattggtct

SEQ ID NO: 164357 - DNA, 16 bp, H. sapiens
ttctgttcctgtgtta

SEQ ID NO: 164358 - DNA, 16 bp, H. sapiens
ttctgttctgtggaaa

SEQ ID NO: 164359 - DNA, 16 bp, H. sapiens
ttctgttctgttgatc

SEQ ID NO: 164360 - DNA, 16 bp, H. sapiens
ttctgttcttctgtta

SEQ ID NO: 164361 - DNA, 16 bp, H. sapiens
ttctgttctttaagaa

SEQ ID NO: 164362 - DNA, 16 bp, H. sapiens
ttctgttgaatttcac

SEQ ID NO: 164363 - DNA, 16 bp, H. sapiens
ttctgttgatctatat

SEQ ID NO: 164364 - DNA, 16 bp, H. sapiens
ttctgttgccctggct

SEQ ID NO: 164365 - DNA, 16 bp, H. sapiens
ttctgttgctgctttc

SEQ ID NO: 164366 - DNA, 16 bp, H. sapiens
ttctgttgtatgaata

SEQ ID NO: 164367 - DNA, 16 bp, H. sapiens
ttctgttgttctaagc

SEQ ID NO: 164368 - DNA, 16 bp, H. sapiens
ttctgttgtttgtaag

SEQ ID NO: 164369 - DNA, 16 bp, H. sapiens
ttctgtttaaaaaaaa

SEQ ID NO: 164370 - DNA, 16 bp, H. sapiens
ttctgtttaaaaaaat

SEQ ID NO: 164371 - DNA, 16 bp, H. sapiens
ttctgtttaaataaaa

SEQ ID NO: 164372 - DNA, 16 bp, H. sapiens
ttctgtttataaaagt

SEQ ID NO: 164373 - DNA, 16 bp, H. sapiens
ttctgtttatatctta

SEQ ID NO: 164374 - DNA, 16 bp, H. sapiens
ttctgtttatgtgatg

SEQ ID NO: 164375 - DNA, 16 bp, H. sapiens
ttctgtttattaaaat

SEQ ID NO: 164376 - DNA, 16 bp, H. sapiens
ttctgtttatttaata

SEQ ID NO: 164377 - DNA, 16 bp, H. sapiens
ttctgtttcattggtc

SEQ ID NO: 164378 - DNA, 16 bp, H. sapiens
ttctgtttcattttcc

SEQ ID NO: 164379 - DNA, 16 bp, H. sapiens
ttctgtttccctggag

SEQ ID NO: 164380 - DNA, 16 bp, H. sapiens
ttctgtttcctgaggc

SEQ ID NO: 164381 - DNA, 16 bp, H. sapiens
ttctgtttctcagttt

SEQ ID NO: 164382 - DNA, 16 bp, H. sapiens
ttctgtttctctctga

SEQ ID NO: 164383 - DNA, 16 bp, H. sapiens
ttctgtttctctgaat

SEQ ID NO: 164384 - DNA, 16 bp, H. sapiens
ttctgtttctctgatt

SEQ ID NO: 164385 - DNA, 16 bp, H. sapiens
ttctgtttctctggag

SEQ ID NO: 164386 - DNA, 16 bp, H. sapiens
ttctgtttctgagtga

SEQ ID NO: 164387 - DNA, 16 bp, H. sapiens
ttctgtttctgagttg

SEQ ID NO: 164388 - DNA, 16 bp, H. sapiens
ttctgtttctgcaaaa

SEQ ID NO: 164389 - DNA, 16 bp, H. sapiens
ttctgtttctgcattc

SEQ ID NO: 164390 - DNA, 16 bp, H. sapiens
ttctgtttctgcgtta

SEQ ID NO: 164391 - DNA, 16 bp, H. sapiens
ttctgtttctgtccta

SEQ ID NO: 164392 - DNA, 16 bp, H. sapiens
ttctgtttcttaaaga

SEQ ID NO: 164393 - DNA, 16 bp, H. sapiens
ttctgtttcttcataa

SEQ ID NO: 164394 - DNA, 16 bp, H. sapiens
ttctgtttctttaaaa

SEQ ID NO: 164395 - DNA, 16 bp, H. sapiens
ttctgtttctttctca

SEQ ID NO: 164396 - DNA, 16 bp, H. sapiens
ttctgtttgtgtgatg

SEQ ID NO: 164397 - DNA, 16 bp, H. sapiens
ttctgtttgttttaaa

SEQ ID NO: 164398 - DNA, 16 bp, H. sapiens
ttctgttttaataaaa

SEQ ID NO: 164399 - DNA, 16 bp, H. sapiens
ttctgttttaatgtta

SEQ ID NO: 164400 - DNA, 16 bp, H. sapiens
ttctgttttatcagag

SEQ ID NO: 164401 - DNA, 16 bp, H. sapiens
ttctgttttcaaattt

SEQ ID NO: 164402 - DNA, 16 bp, H. sapiens
ttctgttttcacattt

SEQ ID NO: 164403 - DNA, 16 bp, H. sapiens
ttctgttttccacttt

SEQ ID NO: 164404 - DNA, 16 bp, H. sapiens
ttctgttttcctgaaa

SEQ ID NO: 164405 - DNA, 16 bp, H. sapiens
ttctgttttctggaag

SEQ ID NO: 164406 - DNA, 16 bp, H. sapiens
ttctgttttgcaagat

SEQ ID NO: 164407 - DNA, 16 bp, H. sapiens
ttctgttttggaaaat

SEQ ID NO: 164408 - DNA, 16 bp, H. sapiens
ttctgttttgtaaatt

SEQ ID NO: 164409 - DNA, 16 bp, H. sapiens
ttctgtttttaggtct

SEQ ID NO: 164410 - DNA, 16 bp, H. sapiens
ttctgtttttcaatat

SEQ ID NO: 164411 - DNA, 16 bp, H. sapiens
ttctgtttttcagaat

SEQ ID NO: 164412 - DNA, 16 bp, H. sapiens
ttctgtttttctccat

SEQ ID NO: 164413 - DNA, 16 bp, H. sapiens
ttctgtttttgaaaat

SEQ ID NO: 164414 - DNA, 16 bp, H. sapiens
ttctgtttttgagaca

SEQ ID NO: 164415 - DNA, 16 bp, H. sapiens
ttctgttttttaaaaa

SEQ ID NO: 164416 - DNA, 16 bp, H. sapiens
ttctgttttttataaa

SEQ ID NO: 164417 - DNA, 16 bp, H. sapiens
ttctgttttttctcca

SEQ ID NO: 164418 - DNA, 16 bp, H. sapiens
ttcttaaaaaaaattc

SEQ ID NO: 164419 - DNA, 16 bp, H. sapiens
ttcttaaaaacacaaa

SEQ ID NO: 164420 - DNA, 16 bp, H. sapiens
ttcttaaaaagaaaga

SEQ ID NO: 164421 - DNA, 16 bp, H. sapiens
ttcttaaaaatgcaga

SEQ ID NO: 164422 - DNA, 16 bp, H. sapiens
ttcttaaaacaatttt

SEQ ID NO: 164423 - DNA, 16 bp, H. sapiens
ttcttaaaaggacact

SEQ ID NO: 164424 - DNA, 16 bp, H. sapiens
ttcttaaaatgtattt

SEQ ID NO: 164425 - DNA, 16 bp, H. sapiens
ttcttaaagaaaataa

SEQ ID NO: 164426 - DNA, 16 bp, H. sapiens
ttcttaaagaactgaa

SEQ ID NO: 164427 - DNA, 16 bp, H. sapiens
ttcttaaagagaaaaa

SEQ ID NO: 164428 - DNA, 16 bp, H. sapiens
ttcttaaagattattt

SEQ ID NO: 164429 - DNA, 16 bp, H. sapiens
ttcttaaagcaccaac

SEQ ID NO: 164430 - DNA, 16 bp, H. sapiens
ttcttaaaggtcccac

SEQ ID NO: 164431 - DNA, 16 bp, H. sapiens
ttcttaaagttctgga

SEQ ID NO: 164432 - DNA, 16 bp, H. sapiens
ttcttaaagtttttgt

SEQ ID NO: 164433 - DNA, 16 bp, H. sapiens
ttcttaaataaaagaa

SEQ ID NO: 164434 - DNA, 16 bp, H. sapiens
ttcttaaatattttgt

SEQ ID NO: 164435 - DNA, 16 bp, H. sapiens
ttcttaaatgaaaatg

SEQ ID NO: 164436 - DNA, 16 bp, H. sapiens
ttcttaaatgtatgta

SEQ ID NO: 164437 - DNA, 16 bp, H. sapiens
ttcttaaatgtttata

SEQ ID NO: 164438 - DNA, 16 bp, H. sapiens
ttcttaacttgataaa

SEQ ID NO: 164439 - DNA, 16 bp, H. sapiens
ttcttaaggaaaagaa

SEQ ID NO: 164440 - DNA, 16 bp, H. sapiens
ttcttaagtgagtttt

SEQ ID NO: 164441 - DNA, 16 bp, H. sapiens
ttcttaataaagtttt

SEQ ID NO: 164442 - DNA, 16 bp, H. sapiens
ttcttaataattttga

SEQ ID NO: 164443 - DNA, 16 bp, H. sapiens
ttcttaatctctctgt

SEQ ID NO: 164444 - DNA, 16 bp, H. sapiens
ttcttaatgacatttt

SEQ ID NO: 164445 - DNA, 16 bp, H. sapiens
ttcttaatgataaaaa

SEQ ID NO: 164446 - DNA, 16 bp, H. sapiens
ttcttaatgatatttt

SEQ ID NO: 164447 - DNA, 16 bp, H. sapiens
ttcttaatgtcatcta

SEQ ID NO: 164448 - DNA, 16 bp, H. sapiens
ttcttaattctgagtt

SEQ ID NO: 164449 - DNA, 16 bp, H. sapiens
ttcttaattgccttca

SEQ ID NO: 164450 - DNA, 16 bp, H. sapiens
ttcttacaaaaagaaa

SEQ ID NO: 164451 - DNA, 16 bp, H. sapiens
ttcttacaaaattaaa

SEQ ID NO: 164452 - DNA, 16 bp, H. sapiens
ttcttacaaagaaaaa

SEQ ID NO: 164453 - DNA, 16 bp, H. sapiens
ttcttacaatttaaaa

SEQ ID NO: 164454 - DNA, 18 bp, H. sapiens
ttcttacacaagagctgg

SEQ ID NO: 164455 - DNA, 16 bp, H. sapiens
ttcttacagttctgga

SEQ ID NO: 164456 - DNA, 16 bp, H. sapiens
ttcttacctccaaatg

SEQ ID NO: 164457 - DNA, 16 bp, H. sapiens
ttcttactgatttctt

SEQ ID NO: 164458 - DNA, 16 bp, H. sapiens
ttcttagaaatgcaga

SEQ ID NO: 164459 - DNA, 16 bp, H. sapiens
ttcttagaagtaaaat

SEQ ID NO: 164460 - DNA, 16 bp, H. sapiens
ttcttagactttcctt

SEQ ID NO: 164461 - DNA, 16 bp, H. sapiens
ttcttagagaagaaaa

SEQ ID NO: 164462 - DNA, 16 bp, H. sapiens
ttcttagatatggcac

SEQ ID NO: 164463 - DNA, 16 bp, H. sapiens
ttcttagatttggtca

SEQ ID NO: 164464 - DNA, 16 bp, H. sapiens
ttcttagattttcttc

SEQ ID NO: 164465 - DNA, 16 bp, H. sapiens
ttcttagcattatttt

SEQ ID NO: 164466 - DNA, 16 bp, H. sapiens
ttcttagtattgattt

SEQ ID NO: 164467 - DNA, 16 bp, H. sapiens
ttcttagtgcctcaaa

SEQ ID NO: 164468 - DNA, 16 bp, H. sapiens
ttcttagttaaaaaaa

SEQ ID NO: 164469 - DNA, 16 bp, H. sapiens
ttcttatctgaaaatt

SEQ ID NO: 164470 - DNA, 16 bp, H. sapiens
ttcttatctggaaaat

SEQ ID NO: 164471 - DNA, 16 bp, H. sapiens
ttcttatgaaagtgct

SEQ ID NO: 164472 - DNA, 16 bp, H. sapiens
ttcttatgaagatgct

SEQ ID NO: 164473 - DNA, 16 bp, H. sapiens
ttcttatgaatggttt

SEQ ID NO: 164474 - DNA, 16 bp, H. sapiens
ttcttatgaggacact

SEQ ID NO: 164475 - DNA, 16 bp, H. sapiens
ttcttatgttagtttg

SEQ ID NO: 164476 - DNA, 16 bp, H. sapiens
ttcttatgttgcccag

SEQ ID NO: 164477 - DNA, 16 bp, H. sapiens
ttcttattaagaaaaa

SEQ ID NO: 164478 - DNA, 16 bp, H. sapiens
ttcttattcttgagtt

SEQ ID NO: 164479 - DNA, 16 bp, H. sapiens
ttcttattggtctgtt

SEQ ID NO: 164480 - DNA, 16 bp, H. sapiens
ttcttatttaaatgtt

SEQ ID NO: 164481 - DNA, 16 bp, H. sapiens
ttcttattttagaaaa

SEQ ID NO: 164482 - DNA, 16 bp, H. sapiens
ttcttattttatggca

SEQ ID NO: 164483 - DNA, 16 bp, H. sapiens
ttcttattttcaaatg

SEQ ID NO: 164484 - DNA, 16 bp, H. sapiens
ttcttattttccaaat

SEQ ID NO: 164485 - DNA, 16 bp, H. sapiens
ttcttatttttagaaa

SEQ ID NO: 164486 - DNA, 16 bp, H. sapiens
ttcttattttttgaga

SEQ ID NO: 164487 - DNA, 16 bp, H. sapiens
ttcttcaaaaacagtg

SEQ ID NO: 164488 - DNA, 16 bp, H. sapiens
ttcttcaaaatattaa

SEQ ID NO: 164489 - DNA, 16 bp, H. sapiens
ttcttcaaagaagaaa

SEQ ID NO: 164490 - DNA, 16 bp, H. sapiens
ttcttcaagaaaagaa

SEQ ID NO: 164491 - DNA, 16 bp, H. sapiens
ttcttcaagaaatctc

SEQ ID NO: 164492 - DNA, 26 bp, H. sapiens
ttcttcaaggagaactacaaaccact

SEQ ID NO: 164493 - DNA, 16 bp, H. sapiens
ttcttcaaggttgaaa

SEQ ID NO: 164494 - DNA, 16 bp, H. sapiens
ttcttcaataataaat

SEQ ID NO: 164495 - DNA, 16 bp, H. sapiens
ttcttcaatctgaaag

SEQ ID NO: 164496 - DNA, 16 bp, H. sapiens
ttcttcaatgtatgtt

SEQ ID NO: 164497 - DNA, 16 bp, H. sapiens
ttcttcacaaaattag

SEQ ID NO: 164498 - DNA, 16 bp, H. sapiens
ttcttcacaattttat

SEQ ID NO: 164499 - DNA, 21 bp, H. sapiens
ttcttcacagaactggaaaaa

SEQ ID NO: 164500 - DNA, 16 bp, H. sapiens
ttcttcacataattgg

SEQ ID NO: 164501 - DNA, 16 bp, H. sapiens
ttcttcacttgctttt

SEQ ID NO: 164502 - DNA, 16 bp, H. sapiens
ttcttcagaaaacaaa

SEQ ID NO: 164503 - DNA, 16 bp, H. sapiens
ttcttcagagaaataa

SEQ ID NO: 164504 - DNA, 16 bp, H. sapiens
ttcttcagatggagtc

SEQ ID NO: 164505 - DNA, 16 bp, H. sapiens
ttcttcagcaacttct

SEQ ID NO: 164506 - DNA, 16 bp, H. sapiens
ttcttcagcccatgga

SEQ ID NO: 164507 - DNA, 16 bp, H. sapiens
ttcttcagcctttgga

SEQ ID NO: 164508 - DNA, 16 bp, H. sapiens
ttcttcagccttttct

SEQ ID NO: 164509 - DNA, 16 bp, H. sapiens
ttcttcagcttttctc

SEQ ID NO: 164510 - DNA, 16 bp, H. sapiens
ttcttcaggatattat

SEQ ID NO: 164511 - DNA, 16 bp, H. sapiens
ttcttcaggcagaagg

SEQ ID NO: 164512 - DNA, 16 bp, H. sapiens
ttcttcaggttttctt

SEQ ID NO: 164513 - DNA, 16 bp, H. sapiens
ttcttcagtatttttc

SEQ ID NO: 164514 - DNA, 16 bp, H. sapiens
ttcttcagtcagcttg

SEQ ID NO: 164515 - DNA, 16 bp, H. sapiens
ttcttcagtctttcct

SEQ ID NO: 164516 - DNA, 16 bp, H. sapiens
ttcttcagtggtgatt

SEQ ID NO: 164517 - DNA, 16 bp, H. sapiens
ttcttcagttccagga

SEQ ID NO: 164518 - DNA, 16 bp, H. sapiens
ttcttcagtttcagaa

SEQ ID NO: 164519 - DNA, 16 bp, H. sapiens
ttcttcagtttcttct

SEQ ID NO: 164520 - DNA, 16 bp, H. sapiens
ttcttcataacagtat

SEQ ID NO: 164521 - DNA, 16 bp, H. sapiens
ttcttcatatgcttgt

SEQ ID NO: 164522 - DNA, 16 bp, H. sapiens
ttcttcatcaaaccta

SEQ ID NO: 164523 - DNA, 16 bp, H. sapiens
ttcttcatctataaaa

SEQ ID NO: 164524 - DNA, 16 bp, H. sapiens
ttcttcatctctgttt

SEQ ID NO: 164525 - DNA, 16 bp, H. sapiens
ttcttcatctgaaaaa

SEQ ID NO: 164526 - DNA, 16 bp, H. sapiens
ttcttcatctgaaaag

SEQ ID NO: 164527 - DNA, 16 bp, H. sapiens
ttcttcatctgcaaca

SEQ ID NO: 164528 - DNA, 16 bp, H. sapiens
ttcttcatcttcaaaa

SEQ ID NO: 164529 - DNA, 16 bp, H. sapiens
ttcttcatcttcaaag

SEQ ID NO: 164530 - DNA, 16 bp, H. sapiens
ttcttcatctttaaag

SEQ ID NO: 164531 - DNA, 16 bp, H. sapiens
ttcttcatgatttagt

SEQ ID NO: 164532 - DNA, 16 bp, H. sapiens
ttcttcattaaaaaaa

SEQ ID NO: 164533 - DNA, 16 bp, H. sapiens
ttcttcattcatccat

SEQ ID NO: 164534 - DNA, 16 bp, H. sapiens
ttcttcatttctgttg

SEQ ID NO: 164535 - DNA, 16 bp, H. sapiens
ttcttcatttgattct

SEQ ID NO: 164536 - DNA, 16 bp, H. sapiens
ttcttcattttcaaag

SEQ ID NO: 164537 - DNA, 16 bp, H. sapiens
ttcttcattttcaaga

SEQ ID NO: 164538 - DNA, 16 bp, H. sapiens
ttcttcattttgaaaa

SEQ ID NO: 164539 - DNA, 16 bp, H. sapiens
ttcttccaaaaacaaa

SEQ ID NO: 164540 - DNA, 16 bp, H. sapiens
ttcttccaaacaaatg

SEQ ID NO: 164541 - DNA, 16 bp, H. sapiens
ttcttccaaattttat

SEQ ID NO: 164542 - DNA, 16 bp, H. sapiens
ttcttccaacgtggcc

SEQ ID NO: 164543 - DNA, 16 bp, H. sapiens
ttcttccaccttggcc

SEQ ID NO: 164544 - DNA, 16 bp, H. sapiens
ttcttccacttctgcc

SEQ ID NO: 164545 - DNA, 16 bp, H. sapiens
ttcttccacttggtca

SEQ ID NO: 164546 - DNA, 16 bp, H. sapiens
ttcttccacttttctg

SEQ ID NO: 164547 - DNA, 16 bp, H. sapiens
ttcttccagtctgtgg

SEQ ID NO: 164548 - DNA, 16 bp, H. sapiens
ttcttccagttgatca

SEQ ID NO: 164549 - DNA, 16 bp, H. sapiens
ttcttccagtttccaa

SEQ ID NO: 164550 - DNA, 16 bp, H. sapiens
ttcttccatctttaaa

SEQ ID NO: 164551 - DNA, 16 bp, H. sapiens
ttcttccatgttttct

SEQ ID NO: 164552 - DNA, 16 bp, H. sapiens
ttcttccatttattca

SEQ ID NO: 164553 - DNA, 16 bp, H. sapiens
ttcttccatttctttg

SEQ ID NO: 164554 - DNA, 17 bp, H. sapiens
ttcttcccaatccaaag

SEQ ID NO: 164555 - DNA, 16 bp, H. sapiens
ttcttcccatctttgt

SEQ ID NO: 164556 - DNA, 16 bp, H. sapiens
ttcttccccaagaaag

SEQ ID NO: 164557 - DNA, 16 bp, H. sapiens
ttcttccccaggctgg

SEQ ID NO: 164558 - DNA, 16 bp, H. sapiens
ttcttccccctcagcc

SEQ ID NO: 164559 - DNA, 16 bp, H. sapiens
ttcttcccctaaaaat

SEQ ID NO: 164560 - DNA, 16 bp, H. sapiens
ttcttccctggagcct

SEQ ID NO: 164561 - DNA, 16 bp, H. sapiens
ttcttccctttggaat

SEQ ID NO: 164562 - DNA, 16 bp, H. sapiens
ttcttcctagtttaat

SEQ ID NO: 164563 - DNA, 16 bp, H. sapiens
ttcttcctcatcatct

SEQ ID NO: 164564 - DNA, 16 bp, H. sapiens
ttcttcctcattgtct

SEQ ID NO: 164565 - DNA, 16 bp, H. sapiens
ttcttcctcctcagcc

SEQ ID NO: 164566 - DNA, 16 bp, H. sapiens
ttcttcctcctgggtt

SEQ ID NO: 164567 - DNA, 16 bp, H. sapiens
ttcttcctctgcaaaa

SEQ ID NO: 164568 - DNA, 16 bp, H. sapiens
ttcttcctggcttaga

SEQ ID NO: 164569 - DNA, 16 bp, H. sapiens
ttcttcctgggcctct

SEQ ID NO: 164570 - DNA, 24 bp, H. sapiens
ttcttcctggtttagtcttgggag

SEQ ID NO: 164571 - DNA, 16 bp, H. sapiens
ttcttccttaaaatgt

SEQ ID NO: 164572 - DNA, 16 bp, H. sapiens
ttcttccttcctgatg

SEQ ID NO: 164573 - DNA, 16 bp, H. sapiens
ttcttcctttaaaaat

SEQ ID NO: 164574 - DNA, 16 bp, H. sapiens
ttcttccttttcaata

SEQ ID NO: 164575 - DNA, 16 bp, H. sapiens
ttcttctaaaaattat

SEQ ID NO: 164576 - DNA, 16 bp, H. sapiens
ttcttctaaaagtttt

SEQ ID NO: 164577 - DNA, 16 bp, H. sapiens
ttcttctaaagaaaaa

SEQ ID NO: 164578 - DNA, 16 bp, H. sapiens
ttcttctaagattctt

SEQ ID NO: 164579 - DNA, 16 bp, H. sapiens
ttcttctaagtatttt

SEQ ID NO: 164580 - DNA, 16 bp, H. sapiens
ttcttctacagcttcc

SEQ ID NO: 164581 - DNA, 16 bp, H. sapiens
ttcttctactaatttg

SEQ ID NO: 164582 - DNA, 16 bp, H. sapiens
ttcttctacttgttca

SEQ ID NO: 164583 - DNA, 16 bp, H. sapiens
ttcttctacttgttta

SEQ ID NO: 164584 - DNA, 16 bp, H. sapiens
ttcttctaggattttc

SEQ ID NO: 164585 - DNA, 16 bp, H. sapiens
ttcttctaggttttcc

SEQ ID NO: 164586 - DNA, 16 bp, H. sapiens
ttcttctcaaaatatt

SEQ ID NO: 164587 - DNA, 16 bp, H. sapiens
ttcttctcacagctcc

SEQ ID NO: 164588 - DNA, 16 bp, H. sapiens
ttcttctcagaaccac

SEQ ID NO: 164589 - DNA, 16 bp, H. sapiens
ttcttctcagtctcag

SEQ ID NO: 164590 - DNA, 16 bp, H. sapiens
ttcttctcagtcttgg

SEQ ID NO: 164591 - DNA, 16 bp, H. sapiens
ttcttctctgtgtccc

SEQ ID NO: 164592 - DNA, 16 bp, H. sapiens
ttcttctgacttcttt

SEQ ID NO: 164593 - DNA, 16 bp, H. sapiens
ttcttctgaggaagca

SEQ ID NO: 164594 - DNA, 16 bp, H. sapiens
ttcttctgaggccttt

SEQ ID NO: 164595 - DNA, 16 bp, H. sapiens
ttcttctgatagcttt

SEQ ID NO: 164596 - DNA, 16 bp, H. sapiens
ttcttctgattaaaaa

SEQ ID NO: 164597 - DNA, 16 bp, H. sapiens
ttcttctgccacagcc

SEQ ID NO: 164598 - DNA, 16 bp, H. sapiens
ttcttctgccagctca

SEQ ID NO: 164599 - DNA, 19 bp, H. sapiens
ttcttctgccatggcttca

SEQ ID NO: 164600 - DNA, 16 bp, H. sapiens
ttcttctgcctgaaat

SEQ ID NO: 164601 - DNA, 16 bp, H. sapiens
ttcttctgcctgctct

SEQ ID NO: 164602 - DNA, 16 bp, H. sapiens
ttcttctgctgctgct

SEQ ID NO: 164603 - DNA, 16 bp, H. sapiens
ttcttctgcttgttca

SEQ ID NO: 164604 - DNA, 16 bp, H. sapiens
ttcttctggaagcttt

SEQ ID NO: 164605 - DNA, 16 bp, H. sapiens
ttcttctggaatattt

SEQ ID NO: 164606 - DNA, 16 bp, H. sapiens
ttcttctggatatata

SEQ ID NO: 164607 - DNA, 16 bp, H. sapiens
ttcttctgggtagata

SEQ ID NO: 164608 - DNA, 16 bp, H. sapiens
ttcttctggtagtttt

SEQ ID NO: 164609 - DNA, 16 bp, H. sapiens
ttcttcttaataaaaa

SEQ ID NO: 164610 - DNA, 16 bp, H. sapiens
ttcttcttaatgtatt

SEQ ID NO: 164611 - DNA, 16 bp, H. sapiens
ttcttcttagcaccac

SEQ ID NO: 164612 - DNA, 16 bp, H. sapiens
ttcttcttcagcttct

SEQ ID NO: 164613 - DNA, 16 bp, H. sapiens
ttcttcttcctcagcc

SEQ ID NO: 164614 - DNA, 16 bp, H. sapiens
ttcttcttcctgctgc

SEQ ID NO: 164615 - DNA, 16 bp, H. sapiens
ttcttcttcttgatca

SEQ ID NO: 164616 - DNA, 16 bp, H. sapiens
ttcttcttctttaaaa

SEQ ID NO: 164617 - DNA, 16 bp, H. sapiens
ttcttcttcttttgag

SEQ ID NO: 164618 - DNA, 16 bp, H. sapiens
ttcttcttgaaaaaaa

SEQ ID NO: 164619 - DNA, 16 bp, H. sapiens
ttcttcttgaaatttt

SEQ ID NO: 164620 - DNA, 16 bp, H. sapiens
ttcttcttgcattatt

SEQ ID NO: 164621 - DNA, 16 bp, H. sapiens
ttcttcttgctcagga

SEQ ID NO: 164622 - DNA, 16 bp, H. sapiens
ttcttcttgggaaggc

SEQ ID NO: 164623 - DNA, 16 bp, H. sapiens
ttcttctttagaagaa

SEQ ID NO: 164624 - DNA, 16 bp, H. sapiens
ttcttctttcttaatg

SEQ ID NO: 164625 - DNA, 16 bp, H. sapiens
ttcttctttgacccat

SEQ ID NO: 164626 - DNA, 16 bp, H. sapiens
ttcttctttgatctct

SEQ ID NO: 164627 - DNA, 16 bp, H. sapiens
ttcttcttttctagta

SEQ ID NO: 164628 - DNA, 16 bp, H. sapiens
ttcttcttttttgaaa

SEQ ID NO: 164629 - DNA, 16 bp, H. sapiens
ttcttgaaaaaaaaaa

SEQ ID NO: 164630 - DNA, 16 bp, H. sapiens
ttcttgaaaaatgcaa

SEQ ID NO: 164631 - DNA, 16 bp, H. sapiens
ttcttgaaaatattaa

SEQ ID NO: 164632 - DNA, 16 bp, H. sapiens
ttcttgaaaatatttt

SEQ ID NO: 164633 - DNA, 16 bp, H. sapiens
ttcttgaaaattttaa

SEQ ID NO: 164634 - DNA, 16 bp, H. sapiens
ttcttgaaatactttc

SEQ ID NO: 164635 - DNA, 16 bp, H. sapiens
ttcttgaaatattttt

SEQ ID NO: 164636 - DNA, 16 bp, H. sapiens
ttcttgaaattttctg

SEQ ID NO: 164637 - DNA, 16 bp, H. sapiens
ttcttgaagaggtcct

SEQ ID NO: 164638 - DNA, 16 bp, H. sapiens
ttcttgaagggttttt

SEQ ID NO: 164639 - DNA, 16 bp, H. sapiens
ttcttgaataaaactt

SEQ ID NO: 164640 - DNA, 16 bp, H. sapiens
ttcttgaatattctgt

SEQ ID NO: 164641 - DNA, 16 bp, H. sapiens
ttcttgaatattttga

SEQ ID NO: 164642 - DNA, 16 bp, H. sapiens
ttcttgacacttttgt

SEQ ID NO: 164643 - DNA, 16 bp, H. sapiens
ttcttgacattggtct

SEQ ID NO: 164644 - DNA, 16 bp, H. sapiens
ttcttgacttaataag

SEQ ID NO: 164645 - DNA, 17 bp, H. sapiens
ttcttgacttctgtgca

SEQ ID NO: 164646 - DNA, 16 bp, H. sapiens
ttcttgactttttgat

SEQ ID NO: 164647 - DNA, 16 bp, H. sapiens
ttcttgagcacctact

SEQ ID NO: 164648 - DNA, 16 bp, H. sapiens
ttcttgaggaacctcc

SEQ ID NO: 164649 - DNA, 16 bp, H. sapiens
ttcttgatcttaaaga

SEQ ID NO: 164650 - DNA, 16 bp, H. sapiens
ttcttgatgctctggc

SEQ ID NO: 164651 - DNA, 16 bp, H. sapiens
ttcttgatgctgacct

SEQ ID NO: 164652 - DNA, 16 bp, H. sapiens
ttcttgattttaataa

SEQ ID NO: 164653 - DNA, 16 bp, H. sapiens
ttcttgatttttaaaa

SEQ ID NO: 164654 - DNA, 16 bp, H. sapiens
ttcttgatttttcaga

SEQ ID NO: 164655 - DNA, 16 bp, H. sapiens
ttcttgcacctcagcc

SEQ ID NO: 164656 - DNA, 16 bp, H. sapiens
ttcttgcagttctatc

SEQ ID NO: 164657 - DNA, 16 bp, H. sapiens
ttcttgcattaatttg

SEQ ID NO: 164658 - DNA, 16 bp, H. sapiens
ttcttgcattgctgta

SEQ ID NO: 164659 - DNA, 16 bp, H. sapiens
ttcttgccaaaaatgc

SEQ ID NO: 164660 - DNA, 16 bp, H. sapiens
ttcttgcctcagcctc

SEQ ID NO: 164661 - DNA, 16 bp, H. sapiens
ttcttgccttctgata

SEQ ID NO: 164662 - DNA, 16 bp, H. sapiens
ttcttgcctttccctg

SEQ ID NO: 164663 - DNA, 17 bp, H. sapiens
ttcttgctctgtcaccc

SEQ ID NO: 164664 - DNA, 16 bp, H. sapiens
ttcttgctgaattgac

SEQ ID NO: 164665 - DNA, 16 bp, H. sapiens
ttcttgcttcccaaat

SEQ ID NO: 164666 - DNA, 16 bp, H. sapiens
ttcttgcttgattgct

SEQ ID NO: 164667 - DNA, 16 bp, H. sapiens
ttcttggaaactatga

SEQ ID NO: 164668 - DNA, 16 bp, H. sapiens
ttcttggaaactttgt

SEQ ID NO: 164669 - DNA, 16 bp, H. sapiens
ttcttggaggcattgt

SEQ ID NO: 164670 - DNA, 17 bp, H. sapiens
ttcttggaggttttgtt

SEQ ID NO: 164671 - DNA, 16 bp, H. sapiens
ttcttggatttttaaa

SEQ ID NO: 164672 - DNA, 16 bp, H. sapiens
ttcttggcacctttat

SEQ ID NO: 164673 - DNA, 16 bp, H. sapiens
ttcttggcatcttgaa

SEQ ID NO: 164674 - DNA, 16 bp, H. sapiens
ttcttggccacttgta

SEQ ID NO: 164675 - DNA, 16 bp, H. sapiens
ttcttggccgggcatg

SEQ ID NO: 164676 - DNA, 16 bp, H. sapiens
ttcttggcttttaaaa

SEQ ID NO: 164677 - DNA, 16 bp, H. sapiens
ttcttgggaagacttt

SEQ ID NO: 164678 - DNA, 16 bp, H. sapiens
ttcttgggctgctttt

SEQ ID NO: 164679 - DNA, 16 bp, H. sapiens
ttcttgggggctttgt

SEQ ID NO: 164680 - DNA, 18 bp, H. sapiens
ttcttgggttcaagtgat

SEQ ID NO: 164681 - DNA, 16 bp, H. sapiens
ttcttggtagagatgg

SEQ ID NO: 164682 - DNA, 16 bp, H. sapiens
ttcttggtattaattt

SEQ ID NO: 164683 - DNA, 16 bp, H. sapiens
ttcttggttaagttta

SEQ ID NO: 164684 - DNA, 16 bp, H. sapiens
ttcttgtaaattattt

SEQ ID NO: 164685 - DNA, 16 bp, H. sapiens
ttcttgtaatatcttt

SEQ ID NO: 164686 - DNA, 16 bp, H. sapiens
ttcttgtaggagtaag

SEQ ID NO: 164687 - DNA, 16 bp, H. sapiens
ttcttgtatttgaata

SEQ ID NO: 164688 - DNA, 16 bp, H. sapiens
ttcttgtcataaaatg

SEQ ID NO: 164689 - DNA, 16 bp, H. sapiens
ttcttgtcatagtgag

SEQ ID NO: 164690 - DNA, 16 bp, H. sapiens
ttcttgtcattattct

SEQ ID NO: 164691 - DNA, 16 bp, H. sapiens
ttcttgtctccatttt

SEQ ID NO: 164692 - DNA, 16 bp, H. sapiens
ttcttgtctgattgct

SEQ ID NO: 164693 - DNA, 16 bp, H. sapiens
ttcttgtctttaagaa

SEQ ID NO: 164694 - DNA, 16 bp, H. sapiens
ttcttgtgaaagtgag

SEQ ID NO: 164695 - DNA, 16 bp, H. sapiens
ttcttgtgacagtgag

SEQ ID NO: 164696 - DNA, 16 bp, H. sapiens
ttcttgtgagaaatgt

SEQ ID NO: 164697 - DNA, 16 bp, H. sapiens
ttcttgtgagaagtgt

SEQ ID NO: 164698 - DNA, 16 bp, H. sapiens
ttcttgtgatattgag

SEQ ID NO: 164699 - DNA, 16 bp, H. sapiens
ttcttgtgccagtttt

SEQ ID NO: 164700 - DNA, 18 bp, H. sapiens
ttcttgtgttagtttgct

SEQ ID NO: 164701 - DNA, 17 bp, H. sapiens
ttcttgttgcccaggct

SEQ ID NO: 164702 - DNA, 16 bp, H. sapiens
ttcttgtttctccagt

SEQ ID NO: 164703 - DNA, 16 bp, H. sapiens
ttcttgtttttggaat

SEQ ID NO: 164704 - DNA, 16 bp, H. sapiens
ttctttaaaaagataa

SEQ ID NO: 164705 - DNA, 16 bp, H. sapiens
ttctttaaaaagcatt

SEQ ID NO: 164706 - DNA, 16 bp, H. sapiens
ttctttaaaaaggaaa

SEQ ID NO: 164707 - DNA, 16 bp, H. sapiens
ttctttaaaaatacct

SEQ ID NO: 164708 - DNA, 16 bp, H. sapiens
ttctttaaaaatgaat

SEQ ID NO: 164709 - DNA, 16 bp, H. sapiens
ttctttaaaaattgtt

SEQ ID NO: 164710 - DNA, 16 bp, H. sapiens
ttctttaaaactaaaa

SEQ ID NO: 164711 - DNA, 16 bp, H. sapiens
ttctttaaaagtgtgt

SEQ ID NO: 164712 - DNA, 16 bp, H. sapiens
ttctttaaaataaatc

SEQ ID NO: 164713 - DNA, 16 bp, H. sapiens
ttctttaaaatgcttt

SEQ ID NO: 164714 - DNA, 16 bp, H. sapiens
ttctttaaaatgttga

SEQ ID NO: 164715 - DNA, 16 bp, H. sapiens
ttctttaaaatgtttt

SEQ ID NO: 164716 - DNA, 16 bp, H. sapiens
ttctttaaaattacaa

SEQ ID NO: 164717 - DNA, 16 bp, H. sapiens
ttctttaaaggaaaat

SEQ ID NO: 164718 - DNA, 16 bp, H. sapiens
ttctttaaatatgctt

SEQ ID NO: 164719 - DNA, 16 bp, H. sapiens
ttctttaaatattttg

SEQ ID NO: 164720 - DNA, 16 bp, H. sapiens
ttctttaaatgtctga

SEQ ID NO: 164721 - DNA, 16 bp, H. sapiens
ttctttaaatgttttc

SEQ ID NO: 164722 - DNA, 16 bp, H. sapiens
ttctttaagaatcttg

SEQ ID NO: 164723 - DNA, 16 bp, H. sapiens
ttctttaagcagtgtt

SEQ ID NO: 164724 - DNA, 16 bp, H. sapiens
ttctttaagttggttt

SEQ ID NO: 164725 - DNA, 16 bp, H. sapiens
ttctttacacatctgg

SEQ ID NO: 164726 - DNA, 16 bp, H. sapiens
ttctttacagcagtat

SEQ ID NO: 164727 - DNA, 16 bp, H. sapiens
ttctttacttgtaaaa

SEQ ID NO: 164728 - DNA, 16 bp, H. sapiens
ttctttactttcctaa

SEQ ID NO: 164729 - DNA, 16 bp, H. sapiens
ttctttagaaaaatgt

SEQ ID NO: 164730 - DNA, 16 bp, H. sapiens
ttctttagaaaacaaa

SEQ ID NO: 164731 - DNA, 16 bp, H. sapiens
ttctttagccataaag

SEQ ID NO: 164732 - DNA, 16 bp, H. sapiens
ttctttagctcagagg

SEQ ID NO: 164733 - DNA, 16 bp, H. sapiens
ttctttaggtttttcc

SEQ ID NO: 164734 - DNA, 16 bp, H. sapiens
ttctttagtggtaatt

SEQ ID NO: 164735 - DNA, 16 bp, H. sapiens
ttctttataaaagaat

SEQ ID NO: 164736 - DNA, 16 bp, H. sapiens
ttctttataataaaac

SEQ ID NO: 164737 - DNA, 16 bp, H. sapiens
ttctttatacattcta

SEQ ID NO: 164738 - DNA, 16 bp, H. sapiens
ttctttatagaaatgt

SEQ ID NO: 164739 - DNA, 16 bp, H. sapiens
ttctttatatcttctg

SEQ ID NO: 164740 - DNA, 16 bp, H. sapiens
ttctttatcccaaatc

SEQ ID NO: 164741 - DNA, 16 bp, H. sapiens
ttctttatctatgaaa

SEQ ID NO: 164742 - DNA, 16 bp, H. sapiens
ttctttatctgaaaaa

SEQ ID NO: 164743 - DNA, 16 bp, H. sapiens
ttctttatgaatttta

SEQ ID NO: 164744 - DNA, 16 bp, H. sapiens
ttctttattaattacc

SEQ ID NO: 164745 - DNA, 16 bp, H. sapiens
ttctttattcaactat

SEQ ID NO: 164746 - DNA, 16 bp, H. sapiens
ttctttattcaataaa

SEQ ID NO: 164747 - DNA, 16 bp, H. sapiens
ttctttattctacttg

SEQ ID NO: 164748 - DNA, 16 bp, H. sapiens
ttctttcaaaaaatgt

SEQ ID NO: 164749 - DNA, 16 bp, H. sapiens
ttctttcaaaaacaaa

SEQ ID NO: 164750 - DNA, 16 bp, H. sapiens
ttctttcaaaaatgtt

SEQ ID NO: 164751 - DNA, 16 bp, H. sapiens
ttctttcaaaataaaa

SEQ ID NO: 164752 - DNA, 16 bp, H. sapiens
ttctttcaaagaaaga

SEQ ID NO: 164753 - DNA, 16 bp, H. sapiens
ttctttcaaataatct

SEQ ID NO: 164754 - DNA, 16 bp, H. sapiens
ttctttcaccactttg

SEQ ID NO: 164755 - DNA, 16 bp, H. sapiens
ttctttcactcagcac

SEQ ID NO: 164756 - DNA, 16 bp, H. sapiens
ttctttcacttaaaat

SEQ ID NO: 164757 - DNA, 16 bp, H. sapiens
ttctttcacttagcat

SEQ ID NO: 164758 - DNA, 16 bp, H. sapiens
ttctttcacttattaa

SEQ ID NO: 164759 - DNA, 16 bp, H. sapiens
ttctttcacttattca

SEQ ID NO: 164760 - DNA, 16 bp, H. sapiens
ttctttcagaaaatat

SEQ ID NO: 164761 - DNA, 16 bp, H. sapiens
ttctttcagacttttt

SEQ ID NO: 164762 - DNA, 16 bp, H. sapiens
ttctttcagagacagg

SEQ ID NO: 164763 - DNA, 16 bp, H. sapiens
ttctttcagcacttca

SEQ ID NO: 164764 - DNA, 16 bp, H. sapiens
ttctttcagtaatgtt

SEQ ID NO: 164765 - DNA, 16 bp, H. sapiens
ttctttcagttctttg

SEQ ID NO: 164766 - DNA, 16 bp, H. sapiens
ttctttcagttgtgaa

SEQ ID NO: 164767 - DNA, 16 bp, H. sapiens
ttctttcataataaat

SEQ ID NO: 164768 - DNA, 16 bp, H. sapiens
ttctttcatcagagtt

SEQ ID NO: 164769 - DNA, 16 bp, H. sapiens
ttctttcatgtattca

SEQ ID NO: 164770 - DNA, 16 bp, H. sapiens
ttctttcatgttaaaa

SEQ ID NO: 164771 - DNA, 16 bp, H. sapiens
ttctttcattgctata

SEQ ID NO: 164772 - DNA, 16 bp, H. sapiens
ttctttcatttcaatc

SEQ ID NO: 164773 - DNA, 16 bp, H. sapiens
ttctttccaagttttt

SEQ ID NO: 164774 - DNA, 16 bp, H. sapiens
ttctttccaccctttg

SEQ ID NO: 164775 - DNA, 16 bp, H. sapiens
ttctttcccagcctct

SEQ ID NO: 164776 - DNA, 16 bp, H. sapiens
ttctttcccagtctgt

SEQ ID NO: 164777 - DNA, 16 bp, H. sapiens
ttctttcccattctgt

SEQ ID NO: 164778 - DNA, 16 bp, H. sapiens
ttctttccttctgcta

SEQ ID NO: 164779 - DNA, 16 bp, H. sapiens
ttctttccttggctgt

SEQ ID NO: 164780 - DNA, 16 bp, H. sapiens
ttctttcctttcagca

SEQ ID NO: 164781 - DNA, 16 bp, H. sapiens
ttctttcctttctgaa

SEQ ID NO: 164782 - DNA, 16 bp, H. sapiens
ttctttcctttggaat

SEQ ID NO: 164783 - DNA, 16 bp, H. sapiens
ttctttctaaaaagag

SEQ ID NO: 164784 - DNA, 16 bp, H. sapiens
ttctttctaaaaatat

SEQ ID NO: 164785 - DNA, 16 bp, H. sapiens
ttctttctacatagac

SEQ ID NO: 164786 - DNA, 16 bp, H. sapiens
ttctttctagttttca

SEQ ID NO: 164787 - DNA, 16 bp, H. sapiens
ttctttctcatcacca

SEQ ID NO: 164788 - DNA, 16 bp, H. sapiens
ttctttctcatctctg

SEQ ID NO: 164789 - DNA, 16 bp, H. sapiens
ttctttctcatttggg

SEQ ID NO: 164790 - DNA, 16 bp, H. sapiens
ttctttctccattgaa

SEQ ID NO: 164791 - DNA, 16 bp, H. sapiens
ttctttctccctggaa

SEQ ID NO: 164792 - DNA, 16 bp, H. sapiens
ttctttctctctggaa

SEQ ID NO: 164793 - DNA, 16 bp, H. sapiens
ttctttctctgaaaat

SEQ ID NO: 164794 - DNA, 16 bp, H. sapiens
ttctttctctgtgcag

SEQ ID NO: 164795 - DNA, 16 bp, H. sapiens
ttctttctgcctgcct

SEQ ID NO: 164796 - DNA, 16 bp, H. sapiens
ttctttctgcttagaa

SEQ ID NO: 164797 - DNA, 16 bp, H. sapiens
ttctttctggaactct

SEQ ID NO: 164798 - DNA, 16 bp, H. sapiens
ttctttctggaggttc

SEQ ID NO: 164799 - DNA, 16 bp, H. sapiens
ttctttctggtttagt

SEQ ID NO: 164800 - DNA, 16 bp, H. sapiens
ttctttcttcaaaaga

SEQ ID NO: 164801 - DNA, 16 bp, H. sapiens
ttctttcttcataaaa

SEQ ID NO: 164802 - DNA, 16 bp, H. sapiens
ttctttcttcattgtg

SEQ ID NO: 164803 - DNA, 16 bp, H. sapiens
ttctttcttctacttg

SEQ ID NO: 164804 - DNA, 16 bp, H. sapiens
ttctttcttgaaaata

SEQ ID NO: 164805 - DNA, 16 bp, H. sapiens
ttctttcttgagacag

SEQ ID NO: 164806 - DNA, 16 bp, H. sapiens
ttctttctttagaaaa

SEQ ID NO: 164807 - DNA, 16 bp, H. sapiens
ttctttctttcttaag

SEQ ID NO: 164808 - DNA, 16 bp, H. sapiens
ttctttctttcttgag

SEQ ID NO: 164809 - DNA, 16 bp, H. sapiens
ttctttctttgagaaa

SEQ ID NO: 164810 - DNA, 16 bp, H. sapiens
ttctttcttttcaaga

SEQ ID NO: 164811 - DNA, 16 bp, H. sapiens
ttctttcttttcagaa

SEQ ID NO: 164812 - DNA, 16 bp, H. sapiens
ttctttcttttccatg

SEQ ID NO: 164813 - DNA, 16 bp, H. sapiens
ttctttctttttgaag

SEQ ID NO: 164814 - DNA, 16 bp, H. sapiens
ttctttgaaaacataa

SEQ ID NO: 164815 - DNA, 16 bp, H. sapiens
ttctttgaaaacatca

SEQ ID NO: 164816 - DNA, 16 bp, H. sapiens
ttctttgaaaagacta

SEQ ID NO: 164817 - DNA, 16 bp, H. sapiens
ttctttgaaaagcaaa

SEQ ID NO: 164818 - DNA, 16 bp, H. sapiens
ttctttgaaaataaat

SEQ ID NO: 164819 - DNA, 16 bp, H. sapiens
ttctttgaaaatgaaa

SEQ ID NO: 164820 - DNA, 16 bp, H. sapiens
ttctttgaaaccagta

SEQ ID NO: 164821 - DNA, 16 bp, H. sapiens
ttctttgaagaaatat

SEQ ID NO: 164822 - DNA, 16 bp, H. sapiens
ttctttgaagaatttt

SEQ ID NO: 164823 - DNA, 16 bp, H. sapiens
ttctttgaaggaaaaa

SEQ ID NO: 164824 - DNA, 16 bp, H. sapiens
ttctttgaatatattt

SEQ ID NO: 164825 - DNA, 16 bp, H. sapiens
ttctttgaatatgttt

SEQ ID NO: 164826 - DNA, 16 bp, H. sapiens
ttctttgaatgtttta

SEQ ID NO: 164827 - DNA, 16 bp, H. sapiens
ttctttgaattaaaaa

SEQ ID NO: 164828 - DNA, 16 bp, H. sapiens
ttctttgacatatttt

SEQ ID NO: 164829 - DNA, 16 bp, H. sapiens
ttctttgactcagaaa

SEQ ID NO: 164830 - DNA, 16 bp, H. sapiens
ttctttgacttttcct

SEQ ID NO: 164831 - DNA, 16 bp, H. sapiens
ttctttgagaaaaaaa

SEQ ID NO: 164832 - DNA, 16 bp, H. sapiens
ttctttgagaaatctt

SEQ ID NO: 164833 - DNA, 16 bp, H. sapiens
ttctttgagacacagt

SEQ ID NO: 164834 - DNA, 16 bp, H. sapiens
ttctttgagacagaat

SEQ ID NO: 164835 - DNA, 16 bp, H. sapiens
ttctttgagcagtgtt

SEQ ID NO: 164836 - DNA, 16 bp, H. sapiens
ttctttgaggaaaaaa

SEQ ID NO: 164837 - DNA, 16 bp, H. sapiens
ttctttgaggccagga

SEQ ID NO: 164838 - DNA, 16 bp, H. sapiens
ttctttgatgaagtgt

SEQ ID NO: 164839 - DNA, 16 bp, H. sapiens
ttctttgcagaaatat

SEQ ID NO: 164840 - DNA, 16 bp, H. sapiens
ttctttgcatttctgt

SEQ ID NO: 164841 - DNA, 16 bp, H. sapiens
ttctttgctaaaactg

SEQ ID NO: 164842 - DNA, 16 bp, H. sapiens
ttctttggaaaaatta

SEQ ID NO: 164843 - DNA, 16 bp, H. sapiens
ttctttggaaattatt

SEQ ID NO: 164844 - DNA, 16 bp, H. sapiens
ttctttggaattttat

SEQ ID NO: 164845 - DNA, 16 bp, H. sapiens
ttctttggagaaaggt

SEQ ID NO: 164846 - DNA, 16 bp, H. sapiens
ttctttggagaaccct

SEQ ID NO: 164847 - DNA, 16 bp, H. sapiens
ttctttggaggagaag

SEQ ID NO: 164848 - DNA, 16 bp, H. sapiens
ttctttggattttgga

SEQ ID NO: 164849 - DNA, 16 bp, H. sapiens
ttctttggcaacttct

SEQ ID NO: 164850 - DNA, 16 bp, H. sapiens
ttctttgggattttct

SEQ ID NO: 164851 - DNA, 16 bp, H. sapiens
ttctttggggaaaaaa

SEQ ID NO: 164852 - DNA, 16 bp, H. sapiens
ttctttggggaaaaat

SEQ ID NO: 164853 - DNA, 16 bp, H. sapiens
ttctttgggtaaatat

SEQ ID NO: 164854 - DNA, 16 bp, H. sapiens
ttctttggtctaaaaa

SEQ ID NO: 164855 - DNA, 16 bp, H. sapiens
ttctttggttccatat

SEQ ID NO: 164856 - DNA, 16 bp, H. sapiens
ttctttgtaaaatttt

SEQ ID NO: 164857 - DNA, 16 bp, H. sapiens
ttctttgtaaattgcc

SEQ ID NO: 164858 - DNA, 16 bp, H. sapiens
ttctttgtaattttaa

SEQ ID NO: 164859 - DNA, 16 bp, H. sapiens
ttctttgtagattatg

SEQ ID NO: 164860 - DNA, 16 bp, H. sapiens
ttctttgtcaagattg

SEQ ID NO: 164861 - DNA, 16 bp, H. sapiens
ttctttgtctcttcca

SEQ ID NO: 164862 - DNA, 16 bp, H. sapiens
ttctttgtgaaatttt

SEQ ID NO: 164863 - DNA, 16 bp, H. sapiens
ttctttgtgatttgtg

SEQ ID NO: 164864 - DNA, 16 bp, H. sapiens
ttctttgtggaggagg

SEQ ID NO: 164865 - DNA, 16 bp, H. sapiens
ttctttgtgttcataa

SEQ ID NO: 164866 - DNA, 16 bp, H. sapiens
ttctttgttcattcat

SEQ ID NO: 164867 - DNA, 16 bp, H. sapiens
ttctttgttgactttc

SEQ ID NO: 164868 - DNA, 16 bp, H. sapiens
ttctttgttgatattc

SEQ ID NO: 164869 - DNA, 16 bp, H. sapiens
ttctttgttggattac

SEQ ID NO: 164870 - DNA, 16 bp, H. sapiens
ttctttgttgtgggaa

SEQ ID NO: 164871 - DNA, 16 bp, H. sapiens
ttctttgttttggcca

SEQ ID NO: 164872 - DNA, 16 bp, H. sapiens
ttctttgttttgggaa

SEQ ID NO: 164873 - DNA, 16 bp, H. sapiens
ttcttttaaaaactca

SEQ ID NO: 164874 - DNA, 16 bp, H. sapiens
ttcttttaaaaagaat

SEQ ID NO: 164875 - DNA, 16 bp, H. sapiens
ttcttttaaaaattag

SEQ ID NO: 164876 - DNA, 16 bp, H. sapiens
ttcttttaaaacagaa

SEQ ID NO: 164877 - DNA, 16 bp, H. sapiens
ttcttttaaaatatgt

SEQ ID NO: 164878 - DNA, 16 bp, H. sapiens
ttcttttaaaatgatt

SEQ ID NO: 164879 - DNA, 16 bp, H. sapiens
ttcttttaaattagtt

SEQ ID NO: 164880 - DNA, 16 bp, H. sapiens
ttcttttaagagtttt

SEQ ID NO: 164881 - DNA, 16 bp, H. sapiens
ttcttttacttaacat

SEQ ID NO: 164882 - DNA, 16 bp, H. sapiens
ttcttttagaaattat

SEQ ID NO: 164883 - DNA, 16 bp, H. sapiens
ttcttttataagaaaa

SEQ ID NO: 164884 - DNA, 16 bp, H. sapiens
ttcttttatttccaaa

SEQ ID NO: 164885 - DNA, 16 bp, H. sapiens
ttcttttattttgaga

SEQ ID NO: 164886 - DNA, 16 bp, H. sapiens
ttcttttcaaaagatg

SEQ ID NO: 164887 - DNA, 16 bp, H. sapiens
ttcttttcaaaatgta

SEQ ID NO: 164888 - DNA, 16 bp, H. sapiens
ttcttttcaaaattgt

SEQ ID NO: 164889 - DNA, 16 bp, H. sapiens
ttcttttcaaatgttt

SEQ ID NO: 164890 - DNA, 16 bp, H. sapiens
ttcttttcacaggtgt

SEQ ID NO: 164891 - DNA, 16 bp, H. sapiens
ttcttttcatacagca

SEQ ID NO: 164892 - DNA, 16 bp, H. sapiens
ttcttttcatcctaaa

SEQ ID NO: 164893 - DNA, 16 bp, H. sapiens
ttcttttccaattaat

SEQ ID NO: 164894 - DNA, 16 bp, H. sapiens
ttcttttcctctggat

SEQ ID NO: 164895 - DNA, 16 bp, H. sapiens
ttcttttccttataaa

SEQ ID NO: 164896 - DNA, 16 bp, H. sapiens
ttcttttctaaattgc

SEQ ID NO: 164897 - DNA, 16 bp, H. sapiens
ttcttttctaatgtat

SEQ ID NO: 164898 - DNA, 16 bp, H. sapiens
ttcttttctaccaaat

SEQ ID NO: 164899 - DNA, 16 bp, H. sapiens
ttcttttctcagtctc

SEQ ID NO: 164900 - DNA, 16 bp, H. sapiens
ttcttttctctaaaat

SEQ ID NO: 164901 - DNA, 16 bp, H. sapiens
ttcttttctctctgaa

SEQ ID NO: 164902 - DNA, 16 bp, H. sapiens
ttcttttctcttcaaa

SEQ ID NO: 164903 - DNA, 16 bp, H. sapiens
ttcttttctgaaattt

SEQ ID NO: 164904 - DNA, 16 bp, H. sapiens
ttcttttctgcaaaat

SEQ ID NO: 164905 - DNA, 16 bp, H. sapiens
ttcttttctgctgcat

SEQ ID NO: 164906 - DNA, 16 bp, H. sapiens
ttcttttctggaaaat

SEQ ID NO: 164907 - DNA, 16 bp, H. sapiens
ttcttttctgtaaaat

SEQ ID NO: 164908 - DNA, 16 bp, H. sapiens
ttcttttctgtagctt

SEQ ID NO: 164909 - DNA, 16 bp, H. sapiens
ttcttttctgtcacat

SEQ ID NO: 164910 - DNA, 16 bp, H. sapiens
ttcttttctgttctaa

SEQ ID NO: 164911 - DNA, 16 bp, H. sapiens
ttcttttcttaagaat

SEQ ID NO: 164912 - DNA, 16 bp, H. sapiens
ttcttttctttgagaa

SEQ ID NO: 164913 - DNA, 16 bp, H. sapiens
ttcttttctttgagca

SEQ ID NO: 164914 - DNA, 16 bp, H. sapiens
ttcttttgaaaaatat

SEQ ID NO: 164915 - DNA, 16 bp, H. sapiens
ttcttttgaaaagtgt

SEQ ID NO: 164916 - DNA, 16 bp, H. sapiens
ttcttttgaaaataaa

SEQ ID NO: 164917 - DNA, 16 bp, H. sapiens
ttcttttgaagtctta

SEQ ID NO: 164918 - DNA, 16 bp, H. sapiens
ttcttttgaataaaaa

SEQ ID NO: 164919 - DNA, 16 bp, H. sapiens
ttcttttgaataaaca

SEQ ID NO: 164920 - DNA, 16 bp, H. sapiens
ttcttttgaatcagca

SEQ ID NO: 164921 - DNA, 16 bp, H. sapiens
ttcttttgagaaagag

SEQ ID NO: 164922 - DNA, 16 bp, H. sapiens
ttcttttgagaactgt

SEQ ID NO: 164923 - DNA, 16 bp, H. sapiens
ttcttttgagaattgc

SEQ ID NO: 164924 - DNA, 16 bp, H. sapiens
ttcttttgagtccttg

SEQ ID NO: 164925 - DNA, 16 bp, H. sapiens
ttcttttgattcagca

SEQ ID NO: 164926 - DNA, 16 bp, H. sapiens
ttcttttgcctctgcc

SEQ ID NO: 164927 - DNA, 16 bp, H. sapiens
ttcttttgctgtatag

SEQ ID NO: 164928 - DNA, 16 bp, H. sapiens
ttcttttgcttcagcc

SEQ ID NO: 164929 - DNA, 16 bp, H. sapiens
ttcttttgctttccat

SEQ ID NO: 164930 - DNA, 16 bp, H. sapiens
ttcttttggaaaatca

SEQ ID NO: 164931 - DNA, 16 bp, H. sapiens
ttcttttggaaaatgt

SEQ ID NO: 164932 - DNA, 16 bp, H. sapiens
ttcttttgggaaatgt

SEQ ID NO: 164933 - DNA, 17 bp, H. sapiens
ttcttttgggttaggat

SEQ ID NO: 164934 - DNA, 16 bp, H. sapiens
ttcttttgtaaagtgt

SEQ ID NO: 164935 - DNA, 16 bp, H. sapiens
ttcttttgtcttagga

SEQ ID NO: 164936 - DNA, 16 bp, H. sapiens
ttcttttgtgaaatat

SEQ ID NO: 164937 - DNA, 16 bp, H. sapiens
ttcttttgtgtaaaat

SEQ ID NO: 164938 - DNA, 16 bp, H. sapiens
ttcttttgtttaaaaa

SEQ ID NO: 164939 - DNA, 16 bp, H. sapiens
ttcttttgtttccatg

SEQ ID NO: 164940 - DNA, 16 bp, H. sapiens
ttctttttaaaaagta

SEQ ID NO: 164941 - DNA, 16 bp, H. sapiens
ttctttttaaaaagtt

SEQ ID NO: 164942 - DNA, 16 bp, H. sapiens
ttctttttaaaaatgt

SEQ ID NO: 164943 - DNA, 16 bp, H. sapiens
ttctttttaaaagttg

SEQ ID NO: 164944 - DNA, 16 bp, H. sapiens
ttctttttaaaatcaa

SEQ ID NO: 164945 - DNA, 16 bp, H. sapiens
ttctttttaaagcttt

SEQ ID NO: 164946 - DNA, 16 bp, H. sapiens
ttctttttaaatatga

SEQ ID NO: 164947 - DNA, 16 bp, H. sapiens
ttctttttaacaaata

SEQ ID NO: 164948 - DNA, 16 bp, H. sapiens
ttctttttaagattgt

SEQ ID NO: 164949 - DNA, 16 bp, H. sapiens
ttctttttagtagaga

SEQ ID NO: 164950 - DNA, 16 bp, H. sapiens
ttctttttatgtaaat

SEQ ID NO: 164951 - DNA, 16 bp, H. sapiens
ttctttttcaaaataa

SEQ ID NO: 164952 - DNA, 16 bp, H. sapiens
ttctttttcaaatctg

SEQ ID NO: 164953 - DNA, 16 bp, H. sapiens
ttctttttcatgtaaa

SEQ ID NO: 164954 - DNA, 16 bp, H. sapiens
ttctttttccagaaaa

SEQ ID NO: 164955 - DNA, 16 bp, H. sapiens
ttctttttctctgcag

SEQ ID NO: 164956 - DNA, 16 bp, H. sapiens
ttctttttctgagaca

SEQ ID NO: 164957 - DNA, 16 bp, H. sapiens
ttctttttcttctcag

SEQ ID NO: 164958 - DNA, 16 bp, H. sapiens
ttctttttgaaatgtt

SEQ ID NO: 164959 - DNA, 16 bp, H. sapiens
ttctttttgaaattat

SEQ ID NO: 164960 - DNA, 16 bp, H. sapiens
ttctttttgataaata

SEQ ID NO: 164961 - DNA, 16 bp, H. sapiens
ttctttttgtggagaa

SEQ ID NO: 164962 - DNA, 16 bp, H. sapiens
ttctttttgtggctgc

SEQ ID NO: 164963 - DNA, 16 bp, H. sapiens
ttctttttgttcagga

SEQ ID NO: 164964 - DNA, 16 bp, H. sapiens
ttcttttttaaacaca

SEQ ID NO: 164965 - DNA, 16 bp, H. sapiens
ttcttttttaaataga

SEQ ID NO: 164966 - DNA, 16 bp, H. sapiens
ttcttttttaagacag

SEQ ID NO: 164967 - DNA, 16 bp, H. sapiens
ttcttttttaaggatg

SEQ ID NO: 164968 - DNA, 16 bp, H. sapiens
ttcttttttacagatg

SEQ ID NO: 164969 - DNA, 16 bp, H. sapiens
ttcttttttagtagag

SEQ ID NO: 164970 - DNA, 16 bp, H. sapiens
ttcttttttagtatga

SEQ ID NO: 164971 - DNA, 16 bp, H. sapiens
ttcttttttatggcta

SEQ ID NO: 164972 - DNA, 16 bp, H. sapiens
ttcttttttatgtaaa

SEQ ID NO: 164973 - DNA, 16 bp, H. sapiens
ttcttttttcagggtg

SEQ ID NO: 164974 - DNA, 16 bp, H. sapiens
ttcttttttcctgaga

SEQ ID NO: 164975 - DNA, 16 bp, H. sapiens
ttcttttttcttgaga

SEQ ID NO: 164976 - DNA, 16 bp, H. sapiens
ttcttttttgaaaatt

SEQ ID NO: 164977 - DNA, 16 bp, H. sapiens
ttcttttttgaaagat

SEQ ID NO: 164978 - DNA, 16 bp, H. sapiens
ttcttttttgagatgg

SEQ ID NO: 164979 - DNA, 16 bp, H. sapiens
ttcttttttgatatag

SEQ ID NO: 164980 - DNA, 16 bp, H. sapiens
ttcttttttggaaaat

SEQ ID NO: 164981 - DNA, 16 bp, H. sapiens
ttcttttttgtaaaaa

SEQ ID NO: 164982 - DNA, 16 bp, H. sapiens
ttctttttttaaagaa

SEQ ID NO: 164983 - DNA, 16 bp, H. sapiens
ttctttttttaagata

SEQ ID NO: 164984 - DNA, 16 bp, H. sapiens
ttctttttttccaaac

SEQ ID NO: 164985 - DNA, 16 bp, H. sapiens
ttctttttttgaaatg

SEQ ID NO: 164986 - DNA, 16 bp, H. sapiens
ttctttttttggagac

SEQ ID NO: 164987 - DNA, 16 bp, H. sapiens
ttcttttttttaaaga

SEQ ID NO: 164988 - DNA, 16 bp, H. sapiens
ttcttttttttggaga

SEQ ID NO: 164989 - DNA, 16 bp, H. sapiens
ttgaaaaaaatgaatg

SEQ ID NO: 164990 - DNA, 16 bp, H. sapiens
ttgaaaaaacaaattt

SEQ ID NO: 164991 - DNA, 16 bp, H. sapiens
ttgaaaaaacattttt

SEQ ID NO: 164992 - DNA, 16 bp, H. sapiens
ttgaaaaaaccagctc

SEQ ID NO: 164993 - DNA, 16 bp, H. sapiens
ttgaaaaaatcatttt

SEQ ID NO: 164994 - DNA, 16 bp, H. sapiens
ttgaaaaaattaacaa

SEQ ID NO: 164995 - DNA, 16 bp, H. sapiens
ttgaaaaacaatagac

SEQ ID NO: 164996 - DNA, 16 bp, H. sapiens
ttgaaaaacacacaca

SEQ ID NO: 164997 - DNA, 16 bp, H. sapiens
ttgaaaaacactattt

SEQ ID NO: 164998 - DNA, 16 bp, H. sapiens
ttgaaaaacagcagat

SEQ ID NO: 164999 - DNA, 16 bp, H. sapiens
ttgaaaaactctagcc

SEQ ID NO: 165000 - DNA, 16 bp, H. sapiens
ttgaaaaactgaatat

SEQ ID NO: 165001 - DNA, 16 bp, H. sapiens
ttgaaaaagaaacaag

SEQ ID NO: 165002 - DNA, 16 bp, H. sapiens
ttgaaaaagaaatgta

SEQ ID NO: 165003 - DNA, 16 bp, H. sapiens
ttgaaaaagaacagaa

SEQ ID NO: 165004 - DNA, 16 bp, H. sapiens
ttgaaaaagaagagca

SEQ ID NO: 165005 - DNA, 16 bp, H. sapiens
ttgaaaaagaataaca

SEQ ID NO: 165006 - DNA, 16 bp, H. sapiens
ttgaaaaagcagaaaa

SEQ ID NO: 165007 - DNA, 16 bp, H. sapiens
ttgaaaaaggaaatat

SEQ ID NO: 165008 - DNA, 16 bp, H. sapiens
ttgaaaaatattttct

SEQ ID NO: 165009 - DNA, 16 bp, H. sapiens
ttgaaaaatcattaaa

SEQ ID NO: 165010 - DNA, 16 bp, H. sapiens
ttgaaaaatggagaaa

SEQ ID NO: 165011 - DNA, 16 bp, H. sapiens
ttgaaaaattacctgt

SEQ ID NO: 165012 - DNA, 16 bp, H. sapiens
ttgaaaaatttcaaaa

SEQ ID NO: 165013 - DNA, 16 bp, H. sapiens
ttgaaaacaattttca

SEQ ID NO: 165014 - DNA, 16 bp, H. sapiens
ttgaaaacagagaaaa

SEQ ID NO: 165015 - DNA, 16 bp, H. sapiens
ttgaaaacagcaagag

SEQ ID NO: 165016 - DNA, 16 bp, H. sapiens
ttgaaaacattaaaaa

SEQ ID NO: 165017 - DNA, 16 bp, H. sapiens
ttgaaaacattacact

SEQ ID NO: 165018 - DNA, 16 bp, H. sapiens
ttgaaaacattatttt

SEQ ID NO: 165019 - DNA, 16 bp, H. sapiens
ttgaaaaccactgatc

SEQ ID NO: 165020 - DNA, 16 bp, H. sapiens
ttgaaaaccagcagaa

SEQ ID NO: 165021 - DNA, 16 bp, H. sapiens
ttgaaaaccagcataa

SEQ ID NO: 165022 - DNA, 16 bp, H. sapiens
ttgaaaactatgtcca

SEQ ID NO: 165023 - DNA, 16 bp, H. sapiens
ttgaaaactggcacat

SEQ ID NO: 165024 - DNA, 16 bp, H. sapiens
ttgaaaacttaaatgt

SEQ ID NO: 165025 - DNA, 16 bp, H. sapiens
ttgaaaacttaaattt

SEQ ID NO: 165026 - DNA, 16 bp, H. sapiens
ttgaaaactttggaaa

SEQ ID NO: 165027 - DNA, 16 bp, H. sapiens
ttgaaaagaaattatt

SEQ ID NO: 165028 - DNA, 16 bp, H. sapiens
ttgaaaagacaaaata

SEQ ID NO: 165029 - DNA, 16 bp, H. sapiens
ttgaaaagactattat

SEQ ID NO: 165030 - DNA, 16 bp, H. sapiens
ttgaaaagatcagcaa

SEQ ID NO: 165031 - DNA, 16 bp, H. sapiens
ttgaaaagatcattca

SEQ ID NO: 165032 - DNA, 16 bp, H. sapiens
ttgaaaagattattct

SEQ ID NO: 165033 - DNA, 16 bp, H. sapiens
ttgaaaagcatttaaa

SEQ ID NO: 165034 - DNA, 16 bp, H. sapiens
ttgaaaagccagagaa

SEQ ID NO: 165035 - DNA, 16 bp, H. sapiens
ttgaaaaggaaagttt

SEQ ID NO: 165036 - DNA, 16 bp, H. sapiens
ttgaaaagtaaatatt

SEQ ID NO: 165037 - DNA, 16 bp, H. sapiens
ttgaaaagtaagaaat

SEQ ID NO: 165038 - DNA, 16 bp, H. sapiens
ttgaaaagttcaacaa

SEQ ID NO: 165039 - DNA, 16 bp, H. sapiens
ttgaaaagttgtttta

SEQ ID NO: 165040 - DNA, 16 bp, H. sapiens
ttgaaaataaagtttt

SEQ ID NO: 165041 - DNA, 16 bp, H. sapiens
ttgaaaataatgagaa

SEQ ID NO: 165042 - DNA, 16 bp, H. sapiens
ttgaaaataatgtttt

SEQ ID NO: 165043 - DNA, 16 bp, H. sapiens
ttgaaaataatttcaa

SEQ ID NO: 165044 - DNA, 16 bp, H. sapiens
ttgaaaatacatttaa

SEQ ID NO: 165045 - DNA, 16 bp, H. sapiens
ttgaaaatatacagtc

SEQ ID NO: 165046 - DNA, 16 bp, H. sapiens
ttgaaaatatttcctc

SEQ ID NO: 165047 - DNA, 16 bp, H. sapiens
ttgaaaatattttctt

SEQ ID NO: 165048 - DNA, 16 bp, H. sapiens
ttgaaaatatttttct

SEQ ID NO: 165049 - DNA, 16 bp, H. sapiens
ttgaaaatcaaaacaa

SEQ ID NO: 165050 - DNA, 16 bp, H. sapiens
ttgaaaatcaacttaa

SEQ ID NO: 165051 - DNA, 16 bp, H. sapiens
ttgaaaatcactgctt

SEQ ID NO: 165052 - DNA, 16 bp, H. sapiens
ttgaaaatcagtcaga

SEQ ID NO: 165053 - DNA, 16 bp, H. sapiens
ttgaaaatcttcattt

SEQ ID NO: 165054 - DNA, 16 bp, H. sapiens
ttgaaaatgaaattct

SEQ ID NO: 165055 - DNA, 16 bp, H. sapiens
ttgaaaatgaacagaa

SEQ ID NO: 165056 - DNA, 16 bp, H. sapiens
ttgaaaatgcaataaa

SEQ ID NO: 165057 - DNA, 16 bp, H. sapiens
ttgaaaatggaaaata

SEQ ID NO: 165058 - DNA, 16 bp, H. sapiens
ttgaaaatgtaatttt

SEQ ID NO: 165059 - DNA, 16 bp, H. sapiens
ttgaaaatgtgttgtt

SEQ ID NO: 165060 - DNA, 16 bp, H. sapiens
ttgaaaatgttctctt

SEQ ID NO: 165061 - DNA, 16 bp, H. sapiens
ttgaaaattagaaatt

SEQ ID NO: 165062 - DNA, 16 bp, H. sapiens
ttgaaaattagccagg

SEQ ID NO: 165063 - DNA, 16 bp, H. sapiens
ttgaaaattatttctt

SEQ ID NO: 165064 - DNA, 16 bp, H. sapiens
ttgaaaattcagaaaa

SEQ ID NO: 165065 - DNA, 16 bp, H. sapiens
ttgaaaattccaaaaa

SEQ ID NO: 165066 - DNA, 16 bp, H. sapiens
ttgaaaattgttcaat

SEQ ID NO: 165067 - DNA, 16 bp, H. sapiens
ttgaaaatttacattt

SEQ ID NO: 165068 - DNA, 16 bp, H. sapiens
ttgaaaattttccatt

SEQ ID NO: 165069 - DNA, 16 bp, H. sapiens
ttgaaaatttttttca

SEQ ID NO: 165070 - DNA, 16 bp, H. sapiens
ttgaaacaaacaaaca

SEQ ID NO: 165071 - DNA, 16 bp, H. sapiens
ttgaaacaaagatggt

SEQ ID NO: 165072 - DNA, 16 bp, H. sapiens
ttgaaacaaatgagaa

SEQ ID NO: 165073 - DNA, 16 bp, H. sapiens
ttgaaacaaattaaaa

SEQ ID NO: 165074 - DNA, 16 bp, H. sapiens
ttgaaacacagccaca

SEQ ID NO: 165075 - DNA, 16 bp, H. sapiens
ttgaaacatttaaaaa

SEQ ID NO: 165076 - DNA, 16 bp, H. sapiens
ttgaaacatttgtttt

SEQ ID NO: 165077 - DNA, 16 bp, H. sapiens
ttgaaaccaccattgc

SEQ ID NO: 165078 - DNA, 16 bp, H. sapiens
ttgaaaccagcctgga

SEQ ID NO: 165079 - DNA, 21 bp, H. sapiens
ttgaaaccccgtctctactaa

SEQ ID NO: 165080 - DNA, 16 bp, H. sapiens
ttgaaacctggcacaa

SEQ ID NO: 165081 - DNA, 16 bp, H. sapiens
ttgaaactaaaataaa

SEQ ID NO: 165082 - DNA, 16 bp, H. sapiens
ttgaaactatgtaaat

SEQ ID NO: 165083 - DNA, 16 bp, H. sapiens
ttgaaactattaaaaa

SEQ ID NO: 165084 - DNA, 16 bp, H. sapiens
ttgaaactctgttttt

SEQ ID NO: 165085 - DNA, 16 bp, H. sapiens
ttgaaagaaaatacat

SEQ ID NO: 165086 - DNA, 16 bp, H. sapiens
ttgaaagaaataattt

SEQ ID NO: 165087 - DNA, 16 bp, H. sapiens
ttgaaagaaatatatt

SEQ ID NO: 165088 - DNA, 16 bp, H. sapiens
ttgaaagaactaatag

SEQ ID NO: 165089 - DNA, 16 bp, H. sapiens
ttgaaagaagatgcca

SEQ ID NO: 165090 - DNA, 16 bp, H. sapiens
ttgaaagaataaatga

SEQ ID NO: 165091 - DNA, 16 bp, H. sapiens
ttgaaagacatttttt

SEQ ID NO: 165092 - DNA, 16 bp, H. sapiens
ttgaaagagaaaacat

SEQ ID NO: 165093 - DNA, 16 bp, H. sapiens
ttgaaagagcagtggc

SEQ ID NO: 165094 - DNA, 16 bp, H. sapiens
ttgaaagataattttt

SEQ ID NO: 165095 - DNA, 16 bp, H. sapiens
ttgaaagatattttca

SEQ ID NO: 165096 - DNA, 16 bp, H. sapiens
ttgaaagatttaatat

SEQ ID NO: 165097 - DNA, 16 bp, H. sapiens
ttgaaagcaaaagaaa

SEQ ID NO: 165098 - DNA, 16 bp, H. sapiens
ttgaaagcaaagaaaa

SEQ ID NO: 165099 - DNA, 16 bp, H. sapiens
ttgaaagcaaccaaga

SEQ ID NO: 165100 - DNA, 16 bp, H. sapiens
ttgaaagctttgctgc

SEQ ID NO: 165101 - DNA, 16 bp, H. sapiens
ttgaaaggagaaatag

SEQ ID NO: 165102 - DNA, 16 bp, H. sapiens
ttgaaagtattttaaa

SEQ ID NO: 165103 - DNA, 16 bp, H. sapiens
ttgaaagtctgtttta

SEQ ID NO: 165104 - DNA, 16 bp, H. sapiens
ttgaaagtgaaaagat

SEQ ID NO: 165105 - DNA, 16 bp, H. sapiens
ttgaaagtggacttgg

SEQ ID NO: 165106 - DNA, 16 bp, H. sapiens
ttgaaagtgtttgctc

SEQ ID NO: 165107 - DNA, 16 bp, H. sapiens
ttgaaagttaatattt

SEQ ID NO: 165108 - DNA, 16 bp, H. sapiens
ttgaaagttctggcca

SEQ ID NO: 165109 - DNA, 16 bp, H. sapiens
ttgaaataaaaatact

SEQ ID NO: 165110 - DNA, 16 bp, H. sapiens
ttgaaataaaaatgtt

SEQ ID NO: 165111 - DNA, 16 bp, H. sapiens
ttgaaataaaatgtgt

SEQ ID NO: 165112 - DNA, 16 bp, H. sapiens
ttgaaataaatgtgaa

SEQ ID NO: 165113 - DNA, 16 bp, H. sapiens
ttgaaataaattttga

SEQ ID NO: 165114 - DNA, 16 bp, H. sapiens
ttgaaataacaaaaat

SEQ ID NO: 165115 - DNA, 16 bp, H. sapiens
ttgaaataactgaaaa

SEQ ID NO: 165116 - DNA, 16 bp, H. sapiens
ttgaaataatattttg

SEQ ID NO: 165117 - DNA, 16 bp, H. sapiens
ttgaaataattcaaaa

SEQ ID NO: 165118 - DNA, 16 bp, H. sapiens
ttgaaataatttcaaa

SEQ ID NO: 165119 - DNA, 16 bp, H. sapiens
ttgaaataatttcatt

SEQ ID NO: 165120 - DNA, 16 bp, H. sapiens
ttgaaatacatttttg

SEQ ID NO: 165121 - DNA, 16 bp, H. sapiens
ttgaaatagaaaacaa

SEQ ID NO: 165122 - DNA, 16 bp, H. sapiens
ttgaaatagccctgca

SEQ ID NO: 165123 - DNA, 16 bp, H. sapiens
ttgaaatatgttttcc

SEQ ID NO: 165124 - DNA, 16 bp, H. sapiens
ttgaaatatgttttgt

SEQ ID NO: 165125 - DNA, 16 bp, H. sapiens
ttgaaatatttaagaa

SEQ ID NO: 165126 - DNA, 16 bp, H. sapiens
ttgaaatattttcatt

SEQ ID NO: 165127 - DNA, 16 bp, H. sapiens
ttgaaatattttgaaa

SEQ ID NO: 165128 - DNA, 16 bp, H. sapiens
ttgaaatcaatgagaa

SEQ ID NO: 165129 - DNA, 16 bp, H. sapiens
ttgaaatcctaacttc

SEQ ID NO: 165130 - DNA, 16 bp, H. sapiens
ttgaaatcctggcctc

SEQ ID NO: 165131 - DNA, 16 bp, H. sapiens
ttgaaatgaaaatatt

SEQ ID NO: 165132 - DNA, 16 bp, H. sapiens
ttgaaatgaaatgaaa

SEQ ID NO: 165133 - DNA, 16 bp, H. sapiens
ttgaaatgacaacaaa

SEQ ID NO: 165134 - DNA, 16 bp, H. sapiens
ttgaaatgatcatttt

SEQ ID NO: 165135 - DNA, 16 bp, H. sapiens
ttgaaatggaatctac

SEQ ID NO: 165136 - DNA, 16 bp, H. sapiens
ttgaaatggcaacaaa

SEQ ID NO: 165137 - DNA, 16 bp, H. sapiens
ttgaaatggtcctgca

SEQ ID NO: 165138 - DNA, 16 bp, H. sapiens
ttgaaattaaaaacat

SEQ ID NO: 165139 - DNA, 16 bp, H. sapiens
ttgaaattaaaaactt

SEQ ID NO: 165140 - DNA, 16 bp, H. sapiens
ttgaaattatcagaca

SEQ ID NO: 165141 - DNA, 16 bp, H. sapiens
ttgaaattcttaataa

SEQ ID NO: 165142 - DNA, 16 bp, H. sapiens
ttgaaattcttaatga

SEQ ID NO: 165143 - DNA, 16 bp, H. sapiens
ttgaaattcttatttt

SEQ ID NO: 165144 - DNA, 16 bp, H. sapiens
ttgaaattgtatcaag

SEQ ID NO: 165145 - DNA, 16 bp, H. sapiens
ttgaaatttatattct

SEQ ID NO: 165146 - DNA, 16 bp, H. sapiens
ttgaaatttgtcaaat

SEQ ID NO: 165147 - DNA, 16 bp, H. sapiens
ttgaaattttaaatgt

SEQ ID NO: 165148 - DNA, 16 bp, H. sapiens
ttgaaattttccataa

SEQ ID NO: 165149 - DNA, 16 bp, H. sapiens
ttgaaattttctaaaa

SEQ ID NO: 165150 - DNA, 16 bp, H. sapiens
ttgaaattttgtcttt

SEQ ID NO: 165151 - DNA, 16 bp, H. sapiens
ttgaaatttttaaaga

SEQ ID NO: 165152 - DNA, 16 bp, H. sapiens
ttgaacaaaaatttaa

SEQ ID NO: 165153 - DNA, 16 bp, H. sapiens
ttgaacaaatattttt

SEQ ID NO: 165154 - DNA, 16 bp, H. sapiens
ttgaacaaatgaaaat

SEQ ID NO: 165155 - DNA, 16 bp, H. sapiens
ttgaacaatgacaaca

SEQ ID NO: 165156 - DNA, 16 bp, H. sapiens
ttgaacaatgtgggag

SEQ ID NO: 165157 - DNA, 16 bp, H. sapiens
ttgaacacaaacactg

SEQ ID NO: 165158 - DNA, 16 bp, H. sapiens
ttgaacactttgccac

SEQ ID NO: 165159 - DNA, 16 bp, H. sapiens
ttgaacagatacttca

SEQ ID NO: 165160 - DNA, 16 bp, H. sapiens
ttgaacagatgcttga

SEQ ID NO: 165161 - DNA, 16 bp, H. sapiens
ttgaacagttttgaaa

SEQ ID NO: 165162 - DNA, 16 bp, H. sapiens
ttgaacatctttttat

SEQ ID NO: 165163 - DNA, 16 bp, H. sapiens
ttgaacatcttttttt

SEQ ID NO: 165164 - DNA, 16 bp, H. sapiens
ttgaacatgggaggca

SEQ ID NO: 165165 - DNA, 16 bp, H. sapiens
ttgaacatgtttttat

SEQ ID NO: 165166 - DNA, 16 bp, H. sapiens
ttgaacattttaaatt

SEQ ID NO: 165167 - DNA, 16 bp, H. sapiens
ttgaacattttaattt

SEQ ID NO: 165168 - DNA, 16 bp, H. sapiens
ttgaacattttatcat

SEQ ID NO: 165169 - DNA, 16 bp, H. sapiens
ttgaaccaagaagaaa

SEQ ID NO: 165170 - DNA, 31 bp, H. sapiens
ttgaaccagccttgcatcccagggatgaagc

SEQ ID NO: 165171 - DNA, 16 bp, H. sapiens
ttgaacccagatctgc

SEQ ID NO: 165172 - DNA, 16 bp, H. sapiens
ttgaacccaggagttc

SEQ ID NO: 165173 - DNA, 16 bp, H. sapiens
ttgaacccaggtctcc

SEQ ID NO: 165174 - DNA, 16 bp, H. sapiens
ttgaacccaggtggtc

SEQ ID NO: 165175 - DNA, 16 bp, H. sapiens
ttgaaccccaggaggt

SEQ ID NO: 165176 - DNA, 16 bp, H. sapiens
ttgaacccgggaagca

SEQ ID NO: 165177 - DNA, 22 bp, H. sapiens
ttgaacccgggaggcggagctt

SEQ ID NO: 165178 - DNA, 16 bp, H. sapiens
ttgaacctaggaggtt

SEQ ID NO: 165179 - DNA, 16 bp, H. sapiens
ttgaacctgggagacg

SEQ ID NO: 165180 - DNA, 16 bp, H. sapiens
ttgaacctgggagcag

SEQ ID NO: 165181 - DNA, 16 bp, H. sapiens
ttgaacctgtgaggca

SEQ ID NO: 165182 - DNA, 16 bp, H. sapiens
ttgaactcagctctgt

SEQ ID NO: 165183 - DNA, 22 bp, H. sapiens
ttgaactcagctttgcaccaag

SEQ ID NO: 165184 - DNA, 16 bp, H. sapiens
ttgaactcaggaggca

SEQ ID NO: 165185 - DNA, 16 bp, H. sapiens
ttgaactcagtgctgc

SEQ ID NO: 165186 - DNA, 16 bp, H. sapiens
ttgaactccaagttct

SEQ ID NO: 165187 - DNA, 16 bp, H. sapiens
ttgaactcctaacctc

SEQ ID NO: 165188 - DNA, 16 bp, H. sapiens
ttgaactcctggcctt

SEQ ID NO: 165189 - DNA, 16 bp, H. sapiens
ttgaactcctgggcta

SEQ ID NO: 165190 - DNA, 16 bp, H. sapiens
ttgaactctgagctca

SEQ ID NO: 165191 - DNA, 16 bp, H. sapiens
ttgaactgaaagaaaa

SEQ ID NO: 165192 - DNA, 16 bp, H. sapiens
ttgaacttatttacac

SEQ ID NO: 165193 - DNA, 16 bp, H. sapiens
ttgaacttcccaacct

SEQ ID NO: 165194 - DNA, 16 bp, H. sapiens
ttgaacttctggcctc

SEQ ID NO: 165195 - DNA, 16 bp, H. sapiens
ttgaacttttcagcct

SEQ ID NO: 165196 - DNA, 16 bp, H. sapiens
ttgaactttttaaaaa

SEQ ID NO: 165197 - DNA, 16 bp, H. sapiens
ttgaagaaaaaatgtt

SEQ ID NO: 165198 - DNA, 16 bp, H. sapiens
ttgaagaaaaatatgt

SEQ ID NO: 165199 - DNA, 16 bp, H. sapiens
ttgaagaaaacacaca

SEQ ID NO: 165200 - DNA, 16 bp, H. sapiens
ttgaagaaaatattta

SEQ ID NO: 165201 - DNA, 16 bp, H. sapiens
ttgaagaaaatgaaga

SEQ ID NO: 165202 - DNA, 16 bp, H. sapiens
ttgaagaaacaatggc

SEQ ID NO: 165203 - DNA, 16 bp, H. sapiens
ttgaagaaactgaggc

SEQ ID NO: 165204 - DNA, 16 bp, H. sapiens
ttgaagaaagtaaaat

SEQ ID NO: 165205 - DNA, 16 bp, H. sapiens
ttgaagaaatatttct

SEQ ID NO: 165206 - DNA, 16 bp, H. sapiens
ttgaagaaatcagaga

SEQ ID NO: 165207 - DNA, 16 bp, H. sapiens
ttgaagaaatgaatga

SEQ ID NO: 165208 - DNA, 16 bp, H. sapiens
ttgaagaaatgactga

SEQ ID NO: 165209 - DNA, 16 bp, H. sapiens
ttgaagaaatgcttca

SEQ ID NO: 165210 - DNA, 16 bp, H. sapiens
ttgaagaaatggctga

SEQ ID NO: 165211 - DNA, 16 bp, H. sapiens
ttgaagaaattatttt

SEQ ID NO: 165212 - DNA, 16 bp, H. sapiens
ttgaagaacaaaagtt

SEQ ID NO: 165213 - DNA, 16 bp, H. sapiens
ttgaagaacagaaaaa

SEQ ID NO: 165214 - DNA, 16 bp, H. sapiens
ttgaagaacagaagtt

SEQ ID NO: 165215 - DNA, 16 bp, H. sapiens
ttgaagaacatcttgg

SEQ ID NO: 165216 - DNA, 16 bp, H. sapiens
ttgaagaacttttctg

SEQ ID NO: 165217 - DNA, 16 bp, H. sapiens
ttgaagaagagagaat

SEQ ID NO: 165218 - DNA, 16 bp, H. sapiens
ttgaagaagttcttca

SEQ ID NO: 165219 - DNA, 16 bp, H. sapiens
ttgaagaatctgtgaa

SEQ ID NO: 165220 - DNA, 16 bp, H. sapiens
ttgaagaatgaatggg

SEQ ID NO: 165221 - DNA, 16 bp, H. sapiens
ttgaagaattagaaaa

SEQ ID NO: 165222 - DNA, 16 bp, H. sapiens
ttgaagaatttccttt

SEQ ID NO: 165223 - DNA, 16 bp, H. sapiens
ttgaagacagcagaca

SEQ ID NO: 165224 - DNA, 16 bp, H. sapiens
ttgaagaccagcccgg

SEQ ID NO: 165225 - DNA, 16 bp, H. sapiens
ttgaagaccatcttgc

SEQ ID NO: 165226 - DNA, 16 bp, H. sapiens
ttgaagactatctttc

SEQ ID NO: 165227 - DNA, 16 bp, H. sapiens
ttgaagagactgtttt

SEQ ID NO: 165228 - DNA, 16 bp, H. sapiens
ttgaagagaggagtgg

SEQ ID NO: 165229 - DNA, 16 bp, H. sapiens
ttgaagagagtagtga

SEQ ID NO: 165230 - DNA, 16 bp, H. sapiens
ttgaagagatggggtt

SEQ ID NO: 165231 - DNA, 16 bp, H. sapiens
ttgaagaggaaacttt

SEQ ID NO: 165232 - DNA, 16 bp, H. sapiens
ttgaagaggtccttcc

SEQ ID NO: 165233 - DNA, 16 bp, H. sapiens
ttgaagagtttgagaa

SEQ ID NO: 165234 - DNA, 16 bp, H. sapiens
ttgaagataaaattat

SEQ ID NO: 165235 - DNA, 16 bp, H. sapiens
ttgaagataagaaaat

SEQ ID NO: 165236 - DNA, 16 bp, H. sapiens
ttgaagatatttttct

SEQ ID NO: 165237 - DNA, 16 bp, H. sapiens
ttgaagatgcagtgag

SEQ ID NO: 165238 - DNA, 16 bp, H. sapiens
ttgaagatggagaaag

SEQ ID NO: 165239 - DNA, 16 bp, H. sapiens
ttgaagatggcagagc

SEQ ID NO: 165240 - DNA, 16 bp, H. sapiens
ttgaagatggggcctt

SEQ ID NO: 165241 - DNA, 16 bp, H. sapiens
ttgaagatgtgattaa

SEQ ID NO: 165242 - DNA, 16 bp, H. sapiens
ttgaagatgtttttat

SEQ ID NO: 165243 - DNA, 16 bp, H. sapiens
ttgaagatttggaaaa

SEQ ID NO: 165244 - DNA, 16 bp, H. sapiens
ttgaagcaaaggcagg

SEQ ID NO: 165245 - DNA, 16 bp, H. sapiens
ttgaagcaaatcctag

SEQ ID NO: 165246 - DNA, 16 bp, H. sapiens
ttgaagcaggggcttc

SEQ ID NO: 165247 - DNA, 16 bp, H. sapiens
ttgaagccaggtagtg

SEQ ID NO: 165248 - DNA, 16 bp, H. sapiens
ttgaagccatgagttc

SEQ ID NO: 165249 - DNA, 16 bp, H. sapiens
ttgaagccctaatccc

SEQ ID NO: 165250 - DNA, 16 bp, H. sapiens
ttgaagctgcagtgag

SEQ ID NO: 165251 - DNA, 16 bp, H. sapiens
ttgaagcttctttttg

SEQ ID NO: 165252 - DNA, 16 bp, H. sapiens
ttgaagcttgtgtatg

SEQ ID NO: 165253 - DNA, 16 bp, H. sapiens
ttgaaggaaattgaaa

SEQ ID NO: 165254 - DNA, 16 bp, H. sapiens
ttgaaggaaatttaaa

SEQ ID NO: 165255 - DNA, 16 bp, H. sapiens
ttgaaggaatactcac

SEQ ID NO: 165256 - DNA, 16 bp, H. sapiens
ttgaaggacatttttg

SEQ ID NO: 165257 - DNA, 16 bp, H. sapiens
ttgaaggagaaaaaca

SEQ ID NO: 165258 - DNA, 16 bp, H. sapiens
ttgaaggagcaggagg

SEQ ID NO: 165259 - DNA, 16 bp, H. sapiens
ttgaaggagctgcaga

SEQ ID NO: 165260 - DNA, 16 bp, H. sapiens
ttgaagggtttttctt

SEQ ID NO: 165261 - DNA, 16 bp, H. sapiens
ttgaagggttttttgg

SEQ ID NO: 165262 - DNA, 16 bp, H. sapiens
ttgaaggtataaaacc

SEQ ID NO: 165263 - DNA, 16 bp, H. sapiens
ttgaagtaaaaattat

SEQ ID NO: 165264 - DNA, 16 bp, H. sapiens
ttgaagtcagacagac

SEQ ID NO: 165265 - DNA, 16 bp, H. sapiens
ttgaagtctgggccag

SEQ ID NO: 165266 - DNA, 16 bp, H. sapiens
ttgaagtcttgggctc

SEQ ID NO: 165267 - DNA, 16 bp, H. sapiens
ttgaagtgagcagaga

SEQ ID NO: 165268 - DNA, 16 bp, H. sapiens
ttgaagtgagtttttt

SEQ ID NO: 165269 - DNA, 16 bp, H. sapiens
ttgaagtgtgtgtgtg

SEQ ID NO: 165270 - DNA, 17 bp, H. sapiens
ttgaagttgcttatcag

SEQ ID NO: 165271 - DNA, 16 bp, H. sapiens
ttgaagttgtttatca

SEQ ID NO: 165272 - DNA, 16 bp, H. sapiens
ttgaagtttttcaaaa

SEQ ID NO: 165273 - DNA, 16 bp, H. sapiens
ttgaataaaataggaa

SEQ ID NO: 165274 - DNA, 16 bp, H. sapiens
ttgaataaacaaaatg

SEQ ID NO: 165275 - DNA, 16 bp, H. sapiens
ttgaataaacatttgt

SEQ ID NO: 165276 - DNA, 16 bp, H. sapiens
ttgaataaactttcta

SEQ ID NO: 165277 - DNA, 16 bp, H. sapiens
ttgaataaagaaaatg

SEQ ID NO: 165278 - DNA, 16 bp, H. sapiens
ttgaataaataatggc

SEQ ID NO: 165279 - DNA, 16 bp, H. sapiens
ttgaataaatatatga

SEQ ID NO: 165280 - DNA, 16 bp, H. sapiens
ttgaataaatgtttct

SEQ ID NO: 165281 - DNA, 16 bp, H. sapiens
ttgaataacaccatgg

SEQ ID NO: 165282 - DNA, 16 bp, H. sapiens
ttgaataatatttcat

SEQ ID NO: 165283 - DNA, 16 bp, H. sapiens
ttgaataatcttttgt

SEQ ID NO: 165284 - DNA, 16 bp, H. sapiens
ttgaatacacatttct

SEQ ID NO: 165285 - DNA, 16 bp, H. sapiens
ttgaataggattggta

SEQ ID NO: 165286 - DNA, 16 bp, H. sapiens
ttgaatatatagatca

SEQ ID NO: 165287 - DNA, 16 bp, H. sapiens
ttgaatatgtaaaata

SEQ ID NO: 165288 - DNA, 16 bp, H. sapiens
ttgaatatttctctct

SEQ ID NO: 165289 - DNA, 16 bp, H. sapiens
ttgaatatttgaaata

SEQ ID NO: 165290 - DNA, 16 bp, H. sapiens
ttgaatattttaagat

SEQ ID NO: 165291 - DNA, 16 bp, H. sapiens
ttgaatcaaatacttt

SEQ ID NO: 165292 - DNA, 16 bp, H. sapiens
ttgaatcacctgaggt

SEQ ID NO: 165293 - DNA, 16 bp, H. sapiens
ttgaatcagaaaaaaa

SEQ ID NO: 165294 - DNA, 16 bp, H. sapiens
ttgaatcagaaagaaa

SEQ ID NO: 165295 - DNA, 16 bp, H. sapiens
ttgaatccaggaggta

SEQ ID NO: 165296 - DNA, 16 bp, H. sapiens
ttgaatcctgacctca

SEQ ID NO: 165297 - DNA, 16 bp, H. sapiens
ttgaatctgcagattg

SEQ ID NO: 165298 - DNA, 16 bp, H. sapiens
ttgaatctgggctggc

SEQ ID NO: 165299 - DNA, 16 bp, H. sapiens
ttgaatctttcttttg

SEQ ID NO: 165300 - DNA, 16 bp, H. sapiens
ttgaatcttttaaaat

SEQ ID NO: 165301 - DNA, 16 bp, H. sapiens
ttgaatgaacaaatga

SEQ ID NO: 165302 - DNA, 16 bp, H. sapiens
ttgaatgaatgaatga

SEQ ID NO: 165303 - DNA, 16 bp, H. sapiens
ttgaatgaatgaggag

SEQ ID NO: 165304 - DNA, 16 bp, H. sapiens
ttgaatgaatggatga

SEQ ID NO: 165305 - DNA, 16 bp, H. sapiens
ttgaatgaattaatga

SEQ ID NO: 165306 - DNA, 16 bp, H. sapiens
ttgaatgaattaatta

SEQ ID NO: 165307 - DNA, 16 bp, H. sapiens
ttgaatgattccattt

SEQ ID NO: 165308 - DNA, 16 bp, H. sapiens
ttgaatgcagaagcag

SEQ ID NO: 165309 - DNA, 16 bp, H. sapiens
ttgaatggatgaataa

SEQ ID NO: 165310 - DNA, 16 bp, H. sapiens
ttgaatgtgtttgccc

SEQ ID NO: 165311 - DNA, 16 bp, H. sapiens
ttgaatgttcccaata

SEQ ID NO: 165312 - DNA, 16 bp, H. sapiens
ttgaatgttgaaccag

SEQ ID NO: 165313 - DNA, 16 bp, H. sapiens
ttgaatgtttcttttg

SEQ ID NO: 165314 - DNA, 16 bp, H. sapiens
ttgaattaaaatgttt

SEQ ID NO: 165315 - DNA, 16 bp, H. sapiens
ttgaattaaacatttt

SEQ ID NO: 165316 - DNA, 16 bp, H. sapiens
ttgaattaggaaaaga

SEQ ID NO: 165317 - DNA, 16 bp, H. sapiens
ttgaattatagttccc

SEQ ID NO: 165318 - DNA, 16 bp, H. sapiens
ttgaattatgaagaaa

SEQ ID NO: 165319 - DNA, 16 bp, H. sapiens
ttgaattatttagaaa

SEQ ID NO: 165320 - DNA, 16 bp, H. sapiens
ttgaattatttccaaa

SEQ ID NO: 165321 - DNA, 16 bp, H. sapiens
ttgaattcccacatgt

SEQ ID NO: 165322 - DNA, 16 bp, H. sapiens
ttgaattctctctctg

SEQ ID NO: 165323 - DNA, 16 bp, H. sapiens
ttgaattcttttaaat

SEQ ID NO: 165324 - DNA, 16 bp, H. sapiens
ttgaattgtacacttc

SEQ ID NO: 165325 - DNA, 16 bp, H. sapiens
ttgaattgtattgaat

SEQ ID NO: 165326 - DNA, 16 bp, H. sapiens
ttgaattgtttgagct

SEQ ID NO: 165327 - DNA, 16 bp, H. sapiens
ttgaattgtttgagtt

SEQ ID NO: 165328 - DNA, 16 bp, H. sapiens
ttgaattgttttctta

SEQ ID NO: 165329 - DNA, 16 bp, H. sapiens
ttgaatttaatcagac

SEQ ID NO: 165330 - DNA, 16 bp, H. sapiens
ttgaatttcattttct

SEQ ID NO: 165331 - DNA, 17 bp, H. sapiens
ttgaatttctccccaga

SEQ ID NO: 165332 - DNA, 16 bp, H. sapiens
ttgaatttctgtggga

SEQ ID NO: 165333 - DNA, 16 bp, H. sapiens
ttgaatttgggaggtg

SEQ ID NO: 165334 - DNA, 16 bp, H. sapiens
ttgaatttgttgagac

SEQ ID NO: 165335 - DNA, 16 bp, H. sapiens
ttgaattttaagaatt

SEQ ID NO: 165336 - DNA, 16 bp, H. sapiens
ttgaattttactttaa

SEQ ID NO: 165337 - DNA, 16 bp, H. sapiens
ttgaattttgtaaaat

SEQ ID NO: 165338 - DNA, 16 bp, H. sapiens
ttgaatttttaaaaag

SEQ ID NO: 165339 - DNA, 16 bp, H. sapiens
ttgaatttttttcaga

SEQ ID NO: 165340 - DNA, 16 bp, H. sapiens
ttgacaaaactttagc

SEQ ID NO: 165341 - DNA, 16 bp, H. sapiens
ttgacaaaagcaagca

SEQ ID NO: 165342 - DNA, 16 bp, H. sapiens
ttgacaaaataaactt

SEQ ID NO: 165343 - DNA, 16 bp, H. sapiens
ttgacaaaatccaaca

SEQ ID NO: 165344 - DNA, 16 bp, H. sapiens
ttgacaaacctgagga

SEQ ID NO: 165345 - DNA, 16 bp, H. sapiens
ttgacaaactgacaaa

SEQ ID NO: 165346 - DNA, 16 bp, H. sapiens
ttgacaaagaaaaatg

SEQ ID NO: 165347 - DNA, 16 bp, H. sapiens
ttgacaaagaaataga

SEQ ID NO: 165348 - DNA, 16 bp, H. sapiens
ttgacaaagaataaaa

SEQ ID NO: 165349 - DNA, 16 bp, H. sapiens
ttgacaaaggtgtcaa

SEQ ID NO: 165350 - DNA, 16 bp, H. sapiens
ttgacaaatatttatc

SEQ ID NO: 165351 - DNA, 16 bp, H. sapiens
ttgacaaatcataatt

SEQ ID NO: 165352 - DNA, 16 bp, H. sapiens
ttgacaaatgtatata

SEQ ID NO: 165353 - DNA, 16 bp, H. sapiens
ttgacaaattgctgga

SEQ ID NO: 165354 - DNA, 16 bp, H. sapiens
ttgacaagattcaaca

SEQ ID NO: 165355 - DNA, 16 bp, H. sapiens
ttgacaatattatttt

SEQ ID NO: 165356 - DNA, 16 bp, H. sapiens
ttgacaattataaata

SEQ ID NO: 165357 - DNA, 16 bp, H. sapiens
ttgacacacacacaca

SEQ ID NO: 165358 - DNA, 16 bp, H. sapiens
ttgacacagcacatgt

SEQ ID NO: 165359 - DNA, 16 bp, H. sapiens
ttgacaccacagaaat

SEQ ID NO: 165360 - DNA, 16 bp, H. sapiens
ttgacaccagcctgac

SEQ ID NO: 165361 - DNA, 16 bp, H. sapiens
ttgacacccaggctgg

SEQ ID NO: 165362 - DNA, 16 bp, H. sapiens
ttgacacgtggggatt

SEQ ID NO: 165363 - DNA, 16 bp, H. sapiens
ttgacactattccaca

SEQ ID NO: 165364 - DNA, 16 bp, H. sapiens
ttgacacttgtgtatg

SEQ ID NO: 165365 - DNA, 16 bp, H. sapiens
ttgacacttgttttgt

SEQ ID NO: 165366 - DNA, 16 bp, H. sapiens
ttgacagaagaggaaa

SEQ ID NO: 165367 - DNA, 16 bp, H. sapiens
ttgacagaggaagaga

SEQ ID NO: 165368 - DNA, 16 bp, H. sapiens
ttgacagatgcagcaa

SEQ ID NO: 165369 - DNA, 16 bp, H. sapiens
ttgacagcatttgtta

SEQ ID NO: 165370 - DNA, 16 bp, H. sapiens
ttgacagtattttatt

SEQ ID NO: 165371 - DNA, 16 bp, H. sapiens
ttgacagtattttgtt

SEQ ID NO: 165372 - DNA, 16 bp, H. sapiens
ttgacagtggagtgtt

SEQ ID NO: 165373 - DNA, 16 bp, H. sapiens
ttgacatattttgaga

SEQ ID NO: 165374 - DNA, 16 bp, H. sapiens
ttgacatggtttggct

SEQ ID NO: 165375 - DNA, 16 bp, H. sapiens
ttgacattaaaaaaaa

SEQ ID NO: 165376 - DNA, 16 bp, H. sapiens
ttgacatttaatttta

SEQ ID NO: 165377 - DNA, 16 bp, H. sapiens
ttgacatttcattttt

SEQ ID NO: 165378 - DNA, 16 bp, H. sapiens
ttgacatttgagaaaa

SEQ ID NO: 165379 - DNA, 16 bp, H. sapiens
ttgacatttggggcca

SEQ ID NO: 165380 - DNA, 16 bp, H. sapiens
ttgacattttatttca

SEQ ID NO: 165381 - DNA, 16 bp, H. sapiens
ttgacattttggaaga

SEQ ID NO: 165382 - DNA, 16 bp, H. sapiens
ttgacattttgggctg

SEQ ID NO: 165383 - DNA, 16 bp, H. sapiens
ttgacatttttagatt

SEQ ID NO: 165384 - DNA, 16 bp, H. sapiens
ttgaccaacatggtga

SEQ ID NO: 165385 - DNA, 16 bp, H. sapiens
ttgaccaggctagtct

SEQ ID NO: 165386 - DNA, 16 bp, H. sapiens
ttgaccaggctgctct

SEQ ID NO: 165387 - DNA, 16 bp, H. sapiens
ttgaccaggctggagt

SEQ ID NO: 165388 - DNA, 16 bp, H. sapiens
ttgaccaggctggtcc

SEQ ID NO: 165389 - DNA, 16 bp, H. sapiens
ttgaccaggctggtct

SEQ ID NO: 165390 - DNA, 16 bp, H. sapiens
ttgaccaggttggtct

SEQ ID NO: 165391 - DNA, 16 bp, H. sapiens
ttgaccattttttaat

SEQ ID NO: 165392 - DNA, 16 bp, H. sapiens
ttgacccagagatccc

SEQ ID NO: 165393 - DNA, 16 bp, H. sapiens
ttgacccttgaataat

SEQ ID NO: 165394 - DNA, 16 bp, H. sapiens
ttgacccttgagcaac

SEQ ID NO: 165395 - DNA, 16 bp, H. sapiens
ttgacctaattgacat

SEQ ID NO: 165396 - DNA, 16 bp, H. sapiens
ttgacctcaagtgatc

SEQ ID NO: 165397 - DNA, 17 bp, H. sapiens
ttgacctcccgggctca

SEQ ID NO: 165398 - DNA, 16 bp, H. sapiens
ttgacctcctaaagtg

SEQ ID NO: 165399 - DNA, 16 bp, H. sapiens
ttgacctctctgagcc

SEQ ID NO: 165400 - DNA, 16 bp, H. sapiens
ttgacctctctgggcc

SEQ ID NO: 165401 - DNA, 16 bp, H. sapiens
ttgacctcttgacctc

SEQ ID NO: 165402 - DNA, 16 bp, H. sapiens
ttgacctgggaggtgg

SEQ ID NO: 165403 - DNA, 16 bp, H. sapiens
ttgacctttggaagtt

SEQ ID NO: 165404 - DNA, 16 bp, H. sapiens
ttgactaacctgacaa

SEQ ID NO: 165405 - DNA, 16 bp, H. sapiens
ttgactcaagaagaaa

SEQ ID NO: 165406 - DNA, 16 bp, H. sapiens
ttgactcagaaaaaaa

SEQ ID NO: 165407 - DNA, 16 bp, H. sapiens
ttgactcagcaattcc

SEQ ID NO: 165408 - DNA, 16 bp, H. sapiens
ttgactcattttttaa

SEQ ID NO: 165409 - DNA, 17 bp, H. sapiens
ttgactccaattttgaa

SEQ ID NO: 165410 - DNA, 16 bp, H. sapiens
ttgactccatttcatt

SEQ ID NO: 165411 - DNA, 16 bp, H. sapiens
ttgactgattgactga

SEQ ID NO: 165412 - DNA, 16 bp, H. sapiens
ttgactggaagcctta

SEQ ID NO: 165413 - DNA, 16 bp, H. sapiens
ttgactggattaagaa

SEQ ID NO: 165414 - DNA, 16 bp, H. sapiens
ttgactgtggtgatgg

SEQ ID NO: 165415 - DNA, 16 bp, H. sapiens
ttgactgtgtgtgtgt

SEQ ID NO: 165416 - DNA, 16 bp, H. sapiens
ttgactgttttagatt

SEQ ID NO: 165417 - DNA, 16 bp, H. sapiens
ttgacttaatttttgt

SEQ ID NO: 165418 - DNA, 16 bp, H. sapiens
ttgacttacagttctg

SEQ ID NO: 165419 - DNA, 16 bp, H. sapiens
ttgacttatttattta

SEQ ID NO: 165420 - DNA, 16 bp, H. sapiens
ttgacttatttcactt

SEQ ID NO: 165421 - DNA, 16 bp, H. sapiens
ttgacttatttctttc

SEQ ID NO: 165422 - DNA, 16 bp, H. sapiens
ttgacttatttttaaa

SEQ ID NO: 165423 - DNA, 16 bp, H. sapiens
ttgacttcagttttga

SEQ ID NO: 165424 - DNA, 16 bp, H. sapiens
ttgacttccctggctc

SEQ ID NO: 165425 - DNA, 16 bp, H. sapiens
ttgacttctgtgaacc

SEQ ID NO: 165426 - DNA, 16 bp, H. sapiens
ttgactttaaattttt

SEQ ID NO: 165427 - DNA, 16 bp, H. sapiens
ttgactttagcccagt

SEQ ID NO: 165428 - DNA, 16 bp, H. sapiens
ttgactttctctttct

SEQ ID NO: 165429 - DNA, 16 bp, H. sapiens
ttgactttctgtcttg

SEQ ID NO: 165430 - DNA, 16 bp, H. sapiens
ttgactttgaacttct

SEQ ID NO: 165431 - DNA, 16 bp, H. sapiens
ttgactttggaactgg

SEQ ID NO: 165432 - DNA, 16 bp, H. sapiens
ttgactttgggcaagt

SEQ ID NO: 165433 - DNA, 16 bp, H. sapiens
ttgacttttaaaaaat

SEQ ID NO: 165434 - DNA, 16 bp, H. sapiens
ttgacttttaaataat

SEQ ID NO: 165435 - DNA, 16 bp, H. sapiens
ttgacttttgaatatt

SEQ ID NO: 165436 - DNA, 16 bp, H. sapiens
ttgactttttaaaagt

SEQ ID NO: 165437 - DNA, 16 bp, H. sapiens
ttgactttttaaaatt

SEQ ID NO: 165438 - DNA, 16 bp, H. sapiens
ttgactttttaaataa

SEQ ID NO: 165439 - DNA, 16 bp, H. sapiens
ttgactttttaacaat

SEQ ID NO: 165440 - DNA, 16 bp, H. sapiens
ttgactttttaataat

SEQ ID NO: 165441 - DNA, 16 bp, H. sapiens
ttgactttttataata

SEQ ID NO: 165442 - DNA, 16 bp, H. sapiens
ttgactttttcataat

SEQ ID NO: 165443 - DNA, 16 bp, H. sapiens
ttgactttttgaaaat

SEQ ID NO: 165444 - DNA, 16 bp, H. sapiens
ttgactttttttcccc

SEQ ID NO: 165445 - DNA, 16 bp, H. sapiens
ttgactttttttccct

SEQ ID NO: 165446 - DNA, 16 bp, H. sapiens
ttgagaaaaggagagg

SEQ ID NO: 165447 - DNA, 16 bp, H. sapiens
ttgagaaaagtctgtt

SEQ ID NO: 165448 - DNA, 16 bp, H. sapiens
ttgagaaagaaaaaca

SEQ ID NO: 165449 - DNA, 16 bp, H. sapiens
ttgagaaagagaaaat

SEQ ID NO: 165450 - DNA, 16 bp, H. sapiens
ttgagaaataaagttt

SEQ ID NO: 165451 - DNA, 16 bp, H. sapiens
ttgagaaatatttaaa

SEQ ID NO: 165452 - DNA, 16 bp, H. sapiens
ttgagaaatcaccaaa

SEQ ID NO: 165453 - DNA, 16 bp, H. sapiens
ttgagaaatcttcata

SEQ ID NO: 165454 - DNA, 16 bp, H. sapiens
ttgagaaatttctgtt

SEQ ID NO: 165455 - DNA, 16 bp, H. sapiens
ttgagaacattccaaa

SEQ ID NO: 165456 - DNA, 16 bp, H. sapiens
ttgagaaccactaatc

SEQ ID NO: 165457 - DNA, 16 bp, H. sapiens
ttgagaaccactgttg

SEQ ID NO: 165458 - DNA, 16 bp, H. sapiens
ttgagaagaactgaca

SEQ ID NO: 165459 - DNA, 16 bp, H. sapiens
ttgagaagatgaaaaa

SEQ ID NO: 165460 - DNA, 16 bp, H. sapiens
ttgagaagtctctgtt

SEQ ID NO: 165461 - DNA, 16 bp, H. sapiens
ttgagaagtgttttgt

SEQ ID NO: 165462 - DNA, 16 bp, H. sapiens
ttgagaataattattt

SEQ ID NO: 165463 - DNA, 16 bp, H. sapiens
ttgagaatattttcta

SEQ ID NO: 165464 - DNA, 16 bp, H. sapiens
ttgagaatcactgctc

SEQ ID NO: 165465 - DNA, 16 bp, H. sapiens
ttgagaatgtttttct

SEQ ID NO: 165466 - DNA, 16 bp, H. sapiens
ttgagaatttcttttt

SEQ ID NO: 165467 - DNA, 16 bp, H. sapiens
ttgagacaagagtctt

SEQ ID NO: 165468 - DNA, 16 bp, H. sapiens
ttgagacaatcctggc

SEQ ID NO: 165469 - DNA, 16 bp, H. sapiens
ttgagacagagactct

SEQ ID NO: 165470 - DNA, 16 bp, H. sapiens
ttgagacagagtcact

SEQ ID NO: 165471 - DNA, 16 bp, H. sapiens
ttgagacagggcttca

SEQ ID NO: 165472 - DNA, 16 bp, H. sapiens
ttgagacagggtctct

SEQ ID NO: 165473 - DNA, 16 bp, H. sapiens
ttgagacagggtcttg

SEQ ID NO: 165474 - DNA, 16 bp, H. sapiens
ttgagacagggtttca

SEQ ID NO: 165475 - DNA, 16 bp, H. sapiens
ttgagacagggtttct

SEQ ID NO: 165476 - DNA, 16 bp, H. sapiens
ttgagacaggttctca

SEQ ID NO: 165477 - DNA, 16 bp, H. sapiens
ttgagacaggttctcc

SEQ ID NO: 165478 - DNA, 16 bp, H. sapiens
ttgagaccaacctgac

SEQ ID NO: 165479 - DNA, 17 bp, H. sapiens
ttgagaccagcctgcca

SEQ ID NO: 165480 - DNA, 17 bp, H. sapiens
ttgagaccagcctggca

SEQ ID NO: 165481 - DNA, 16 bp, H. sapiens
ttgagaccagctgggc

SEQ ID NO: 165482 - DNA, 16 bp, H. sapiens
ttgagaccagtctgga

SEQ ID NO: 165483 - DNA, 16 bp, H. sapiens
ttgagacctgcctgga

SEQ ID NO: 165484 - DNA, 22 bp, H. sapiens
ttgagacggagtctcgctcttg

SEQ ID NO: 165485 - DNA, 20 bp, H. sapiens
ttgagacggagtctcgctgt

SEQ ID NO: 165486 - DNA, 16 bp, H. sapiens
ttgagactcagtttcc

SEQ ID NO: 165487 - DNA, 16 bp, H. sapiens
ttgagactgagtctca

SEQ ID NO: 165488 - DNA, 16 bp, H. sapiens
ttgagactgagttttg

SEQ ID NO: 165489 - DNA, 16 bp, H. sapiens
ttgagagaaaatattt

SEQ ID NO: 165490 - DNA, 16 bp, H. sapiens
ttgagagaactgactc

SEQ ID NO: 165491 - DNA, 16 bp, H. sapiens
ttgagagaagcctggg

SEQ ID NO: 165492 - DNA, 16 bp, H. sapiens
ttgagagaaggtctca

SEQ ID NO: 165493 - DNA, 17 bp, H. sapiens
ttgagagcaatcatcga

SEQ ID NO: 165494 - DNA, 16 bp, H. sapiens
ttgagagcctgaggca

SEQ ID NO: 165495 - DNA, 16 bp, H. sapiens
ttgagagttctttata

SEQ ID NO: 165496 - DNA, 16 bp, H. sapiens
ttgagagttttattat

SEQ ID NO: 165497 - DNA, 16 bp, H. sapiens
ttgagatacaattcac

SEQ ID NO: 165498 - DNA, 16 bp, H. sapiens
ttgagatagatgattt

SEQ ID NO: 165499 - DNA, 16 bp, H. sapiens
ttgagatataattaat

SEQ ID NO: 165500 - DNA, 16 bp, H. sapiens
ttgagatcgcaccact

SEQ ID NO: 165501 - DNA, 16 bp, H. sapiens
ttgagatctttctttt

SEQ ID NO: 165502 - DNA, 16 bp, H. sapiens
ttgagatgagatgaga

SEQ ID NO: 165503 - DNA, 16 bp, H. sapiens
ttgagatggagctttg

SEQ ID NO: 165504 - DNA, 16 bp, H. sapiens
ttgagatggagtttcc

SEQ ID NO: 165505 - DNA, 16 bp, H. sapiens
ttgagatggggagatt

SEQ ID NO: 165506 - DNA, 16 bp, H. sapiens
ttgagatgtctgtggt

SEQ ID NO: 165507 - DNA, 16 bp, H. sapiens
ttgagattatgttaaa

SEQ ID NO: 165508 - DNA, 17 bp, H. sapiens
ttgagattgcaccactg

SEQ ID NO: 165509 - DNA, 16 bp, H. sapiens
ttgagattgcattaaa

SEQ ID NO: 165510 - DNA, 16 bp, H. sapiens
ttgagattttctacat

SEQ ID NO: 165511 - DNA, 16 bp, H. sapiens
ttgagatttttaaaaa

SEQ ID NO: 165512 - DNA, 16 bp, H. sapiens
ttgagatttttgaaaa

SEQ ID NO: 165513 - DNA, 16 bp, H. sapiens
ttgagcaataaaataa

SEQ ID NO: 165514 - DNA, 16 bp, H. sapiens
ttgagcaccaacatga

SEQ ID NO: 165515 - DNA, 16 bp, H. sapiens
ttgagcacttgctata

SEQ ID NO: 165516 - DNA, 16 bp, H. sapiens
ttgagcagaaacctga

SEQ ID NO: 165517 - DNA, 16 bp, H. sapiens
ttgagcagaggagaaa

SEQ ID NO: 165518 - DNA, 22 bp, H. sapiens
ttgagcagtaggatataaataa

SEQ ID NO: 165519 - DNA, 16 bp, H. sapiens
ttgagcagttctgaaa

SEQ ID NO: 165520 - DNA, 16 bp, H. sapiens
ttgagcagtttggaaa

SEQ ID NO: 165521 - DNA, 16 bp, H. sapiens
ttgagcagtttgggaa

SEQ ID NO: 165522 - DNA, 16 bp, H. sapiens
ttgagcagtttttaaa

SEQ ID NO: 165523 - DNA, 16 bp, H. sapiens
ttgagcatctgcagat

SEQ ID NO: 165524 - DNA, 16 bp, H. sapiens
ttgagcatcttcagat

SEQ ID NO: 165525 - DNA, 16 bp, H. sapiens
ttgagcatcttttcac

SEQ ID NO: 165526 - DNA, 16 bp, H. sapiens
ttgagcatcttttcag

SEQ ID NO: 165527 - DNA, 16 bp, H. sapiens
ttgagcatcttttcat

SEQ ID NO: 165528 - DNA, 16 bp, H. sapiens
ttgagcatctttttat

SEQ ID NO: 165529 - DNA, 16 bp, H. sapiens
ttgagcattttttata

SEQ ID NO: 165530 - DNA, 16 bp, H. sapiens
ttgagccactgcaccc

SEQ ID NO: 165531 - DNA, 21 bp, H. sapiens
ttgagccactgcacctggcct

SEQ ID NO: 165532 - DNA, 16 bp, H. sapiens
ttgagcccacaagttc

SEQ ID NO: 165533 - DNA, 16 bp, H. sapiens
ttgagcccagaaggtt

SEQ ID NO: 165534 - DNA, 16 bp, H. sapiens
ttgagcccaggaagga

SEQ ID NO: 165535 - DNA, 16 bp, H. sapiens
ttgagcccaggagatt

SEQ ID NO: 165536 - DNA, 16 bp, H. sapiens
ttgagcccaggatgca

SEQ ID NO: 165537 - DNA, 16 bp, H. sapiens
ttgagcccaggggctt

SEQ ID NO: 165538 - DNA, 16 bp, H. sapiens
ttgagccccagagttc

SEQ ID NO: 165539 - DNA, 16 bp, H. sapiens
ttgagcccgggaggcg

SEQ ID NO: 165540 - DNA, 18 bp, H. sapiens
ttgagccgagattgtgcc

SEQ ID NO: 165541 - DNA, 16 bp, H. sapiens
ttgagcctagcagttt

SEQ ID NO: 165542 - DNA, 16 bp, H. sapiens
ttgagcctatgagtgt

SEQ ID NO: 165543 - DNA, 16 bp, H. sapiens
ttgagcctcagtttct

SEQ ID NO: 165544 - DNA, 16 bp, H. sapiens
ttgagcctcggaggtc

SEQ ID NO: 165545 - DNA, 16 bp, H. sapiens
ttgagcctgggaaatg

SEQ ID NO: 165546 - DNA, 16 bp, H. sapiens
ttgagcctgggagatc

SEQ ID NO: 165547 - DNA, 16 bp, H. sapiens
ttgagctatttttcat

SEQ ID NO: 165548 - DNA, 16 bp, H. sapiens
ttgagctcaagcgatc

SEQ ID NO: 165549 - DNA, 16 bp, H. sapiens
ttgagctcaggcgttc

SEQ ID NO: 165550 - DNA, 16 bp, H. sapiens
ttgagctccacctcct

SEQ ID NO: 165551 - DNA, 16 bp, H. sapiens
ttgagctgagatcaca

SEQ ID NO: 165552 - DNA, 16 bp, H. sapiens
ttgagctgggaattca

SEQ ID NO: 165553 - DNA, 16 bp, H. sapiens
ttgagcttctttaaaa

SEQ ID NO: 165554 - DNA, 16 bp, H. sapiens
ttgagcttcttttata

SEQ ID NO: 165555 - DNA, 16 bp, H. sapiens
ttgagctttttctcat

SEQ ID NO: 165556 - DNA, 16 bp, H. sapiens
ttgaggaaactgaggc

SEQ ID NO: 165557 - DNA, 16 bp, H. sapiens
ttgaggaaccaccaaa

SEQ ID NO: 165558 - DNA, 16 bp, H. sapiens
ttgaggaaccttcaaa

SEQ ID NO: 165559 - DNA, 16 bp, H. sapiens
ttgaggaatctccaca

SEQ ID NO: 165560 - DNA, 16 bp, H. sapiens
ttgaggacaaggccat

SEQ ID NO: 165561 - DNA, 16 bp, H. sapiens
ttgaggagactgtcct

SEQ ID NO: 165562 - DNA, 16 bp, H. sapiens
ttgaggagcaaggaga

SEQ ID NO: 165563 - DNA, 18 bp, H. sapiens
ttgaggagcccttcagcc

SEQ ID NO: 165564 - DNA, 16 bp, H. sapiens
ttgaggaggcctcagg

SEQ ID NO: 165565 - DNA, 16 bp, H. sapiens
ttgaggagtctcactc

SEQ ID NO: 165566 - DNA, 16 bp, H. sapiens
ttgaggataggagttc

SEQ ID NO: 165567 - DNA, 16 bp, H. sapiens
ttgaggatatttgcat

SEQ ID NO: 165568 - DNA, 17 bp, H. sapiens
ttgaggcaagagaatcg

SEQ ID NO: 165569 - DNA, 16 bp, H. sapiens
ttgaggcaggaggatc

SEQ ID NO: 165570 - DNA, 16 bp, H. sapiens
ttgaggccaaaggtga

SEQ ID NO: 165571 - DNA, 16 bp, H. sapiens
ttgaggccaagagtta

SEQ ID NO: 165572 - DNA, 16 bp, H. sapiens
ttgaggccagaaattt

SEQ ID NO: 165573 - DNA, 16 bp, H. sapiens
ttgaggccagagtttg

SEQ ID NO: 165574 - DNA, 16 bp, H. sapiens
ttgaggccaggaggtc

SEQ ID NO: 165575 - DNA, 16 bp, H. sapiens
ttgaggccaggcgcag

SEQ ID NO: 165576 - DNA, 16 bp, H. sapiens
ttgaggccaggcgtgg

SEQ ID NO: 165577 - DNA, 17 bp, H. sapiens
ttgaggccaggtgcggt

SEQ ID NO: 165578 - DNA, 16 bp, H. sapiens
ttgaggcctatgggga

SEQ ID NO: 165579 - DNA, 16 bp, H. sapiens
ttgaggcgggaggatc

SEQ ID NO: 165580 - DNA, 16 bp, H. sapiens
ttgaggctacagggag

SEQ ID NO: 165581 - DNA, 16 bp, H. sapiens
ttgaggctgcaatgag

SEQ ID NO: 165582 - DNA, 16 bp, H. sapiens
ttgaggctgcagagag

SEQ ID NO: 165583 - DNA, 16 bp, H. sapiens
ttgaggctgcagtagg

SEQ ID NO: 165584 - DNA, 16 bp, H. sapiens
ttgaggctgcagtgag

SEQ ID NO: 165585 - DNA, 16 bp, H. sapiens
ttgaggctgcagtgat

SEQ ID NO: 165586 - DNA, 16 bp, H. sapiens
ttgaggctgcagtggg

SEQ ID NO: 165587 - DNA, 16 bp, H. sapiens
ttgaggctgctgacct

SEQ ID NO: 165588 - DNA, 16 bp, H. sapiens
ttgaggctggggaagg

SEQ ID NO: 165589 - DNA, 16 bp, H. sapiens
ttgaggcttgttttgt

SEQ ID NO: 165590 - DNA, 16 bp, H. sapiens
ttgagggagggatctg

SEQ ID NO: 165591 - DNA, 16 bp, H. sapiens
ttgaggggatggataa

SEQ ID NO: 165592 - DNA, 16 bp, H. sapiens
ttgagggtttttgtca

SEQ ID NO: 165593 - DNA, 16 bp, H. sapiens
ttgaggtacatttctt

SEQ ID NO: 165594 - DNA, 16 bp, H. sapiens
ttgaggtcagaagttt

SEQ ID NO: 165595 - DNA, 16 bp, H. sapiens
ttgaggtcagcagttc

SEQ ID NO: 165596 - DNA, 16 bp, H. sapiens
ttgaggtcaggatttc

SEQ ID NO: 165597 - DNA, 16 bp, H. sapiens
ttgaggtcgggagttt

SEQ ID NO: 165598 - DNA, 16 bp, H. sapiens
ttgaggtcttagactt

SEQ ID NO: 165599 - DNA, 16 bp, H. sapiens
ttgaggtgaggaattc

SEQ ID NO: 165600 - DNA, 16 bp, H. sapiens
ttgaggtgatggatat

SEQ ID NO: 165601 - DNA, 16 bp, H. sapiens
ttgaggtgctgctgga

SEQ ID NO: 165602 - DNA, 23 bp, H. sapiens
ttgaggtgggaggattgcttgaa

SEQ ID NO: 165603 - DNA, 16 bp, H. sapiens
ttgaggttacagaaag

SEQ ID NO: 165604 - DNA, 16 bp, H. sapiens
ttgaggttatctactg

SEQ ID NO: 165605 - DNA, 17 bp, H. sapiens
ttgaggttgcagtgagt

SEQ ID NO: 165606 - DNA, 16 bp, H. sapiens
ttgaggtttacaacat

SEQ ID NO: 165607 - DNA, 16 bp, H. sapiens
ttgaggttttgtttca

SEQ ID NO: 165608 - DNA, 16 bp, H. sapiens
ttgagtaaagtatact

SEQ ID NO: 165609 - DNA, 16 bp, H. sapiens
ttgagtaattgtgaca

SEQ ID NO: 165610 - DNA, 16 bp, H. sapiens
ttgagtaatttgccca

SEQ ID NO: 165611 - DNA, 16 bp, H. sapiens
ttgagtatcttttcag

SEQ ID NO: 165612 - DNA, 16 bp, H. sapiens
ttgagtatttattacc

SEQ ID NO: 165613 - DNA, 16 bp, H. sapiens
ttgagtccagcctggc

SEQ ID NO: 165614 - DNA, 16 bp, H. sapiens
ttgagtccaggagtgc

SEQ ID NO: 165615 - DNA, 16 bp, H. sapiens
ttgagtctctgccaaa

SEQ ID NO: 165616 - DNA, 20 bp, H. sapiens
ttgagtgcaggagttcaagg

SEQ ID NO: 165617 - DNA, 16 bp, H. sapiens
ttgagtggctgaggca

SEQ ID NO: 165618 - DNA, 16 bp, H. sapiens
ttgagtgtttcatttg

SEQ ID NO: 165619 - DNA, 16 bp, H. sapiens
ttgagttacaaacaat

SEQ ID NO: 165620 - DNA, 16 bp, H. sapiens
ttgagttctttgagaa

SEQ ID NO: 165621 - DNA, 16 bp, H. sapiens
ttgagttgtttgaatt

SEQ ID NO: 165622 - DNA, 16 bp, H. sapiens
ttgagttgtttgagtc

SEQ ID NO: 165623 - DNA, 16 bp, H. sapiens
ttgagtttctgatgag

SEQ ID NO: 165624 - DNA, 16 bp, H. sapiens
ttgagtttctgtctgg

SEQ ID NO: 165625 - DNA, 16 bp, H. sapiens
ttgagtttcttttcat

SEQ ID NO: 165626 - DNA, 16 bp, H. sapiens
ttgagttttaagattt

SEQ ID NO: 165627 - DNA, 16 bp, H. sapiens
ttgataaaaatgcaaa

SEQ ID NO: 165628 - DNA, 16 bp, H. sapiens
ttgataaaatacaaca

SEQ ID NO: 165629 - DNA, 16 bp, H. sapiens
ttgataaaattaaaca

SEQ ID NO: 165630 - DNA, 16 bp, H. sapiens
ttgataaaattcaaca

SEQ ID NO: 165631 - DNA, 16 bp, H. sapiens
ttgataaatatttgct

SEQ ID NO: 165632 - DNA, 16 bp, H. sapiens
ttgataaatatttgtg

SEQ ID NO: 165633 - DNA, 16 bp, H. sapiens
ttgataacatttaaaa

SEQ ID NO: 165634 - DNA, 16 bp, H. sapiens
ttgataaggattgcat

SEQ ID NO: 165635 - DNA, 16 bp, H. sapiens
ttgataatgatgatga

SEQ ID NO: 165636 - DNA, 16 bp, H. sapiens
ttgatacagagtctca

SEQ ID NO: 165637 - DNA, 16 bp, H. sapiens
ttgataccaacctggg

SEQ ID NO: 165638 - DNA, 18 bp, H. sapiens
ttgatagaacagttttga

SEQ ID NO: 165639 - DNA, 16 bp, H. sapiens
ttgatagaatttacca

SEQ ID NO: 165640 - DNA, 16 bp, H. sapiens
ttgatagatttttctt

SEQ ID NO: 165641 - DNA, 17 bp, H. sapiens
ttgatagctggtattgt

SEQ ID NO: 165642 - DNA, 17 bp, H. sapiens
ttgataggtgcagcaaa

SEQ ID NO: 165643 - DNA, 16 bp, H. sapiens
ttgatagtatcctttg

SEQ ID NO: 165644 - DNA, 16 bp, H. sapiens
ttgatatcttaacaat

SEQ ID NO: 165645 - DNA, 16 bp, H. sapiens
ttgatatctttcatca

SEQ ID NO: 165646 - DNA, 16 bp, H. sapiens
ttgatatgctgctgaa

SEQ ID NO: 165647 - DNA, 16 bp, H. sapiens
ttgatattgtgaaaat

SEQ ID NO: 165648 - DNA, 16 bp, H. sapiens
ttgatatttacatttt

SEQ ID NO: 165649 - DNA, 16 bp, H. sapiens
ttgatatttatagaat

SEQ ID NO: 165650 - DNA, 16 bp, H. sapiens
ttgatattttcaattt

SEQ ID NO: 165651 - DNA, 16 bp, H. sapiens
ttgatattttgatctc

SEQ ID NO: 165652 - DNA, 16 bp, H. sapiens
ttgatattttgccaaa

SEQ ID NO: 165653 - DNA, 16 bp, H. sapiens
ttgatatttttgaaga

SEQ ID NO: 165654 - DNA, 16 bp, H. sapiens
ttgatcaacatctccc

SEQ ID NO: 165655 - DNA, 16 bp, H. sapiens
ttgatcaggctggtct

SEQ ID NO: 165656 - DNA, 17 bp, H. sapiens
ttgatcaggctggtctc

SEQ ID NO: 165657 - DNA, 20 bp, H. sapiens
ttgatcaggctggtcttgaa

SEQ ID NO: 165658 - DNA, 16 bp, H. sapiens
ttgatcagttgatgaa

SEQ ID NO: 165659 - DNA, 16 bp, H. sapiens
ttgatcatgatgaatg

SEQ ID NO: 165660 - DNA, 16 bp, H. sapiens
ttgatcattacacatt

SEQ ID NO: 165661 - DNA, 16 bp, H. sapiens
ttgatcatttgtattt

SEQ ID NO: 165662 - DNA, 16 bp, H. sapiens
ttgatcatttttaaaa

SEQ ID NO: 165663 - DNA, 16 bp, H. sapiens
ttgatccgcctgcctt

SEQ ID NO: 165664 - DNA, 16 bp, H. sapiens
ttgatcctgtcattct

SEQ ID NO: 165665 - DNA, 17 bp, H. sapiens
ttgatcctttcagaaaa

SEQ ID NO: 165666 - DNA, 16 bp, H. sapiens
ttgatctcagatttct

SEQ ID NO: 165667 - DNA, 16 bp, H. sapiens
ttgatctcttcacctc

SEQ ID NO: 165668 - DNA, 16 bp, H. sapiens
ttgatctgataaacaa

SEQ ID NO: 165669 - DNA, 16 bp, H. sapiens
ttgatctgttttctgt

SEQ ID NO: 165670 - DNA, 16 bp, H. sapiens
ttgatcttagccaaaa

SEQ ID NO: 165671 - DNA, 16 bp, H. sapiens
ttgatcttctgtctag

SEQ ID NO: 165672 - DNA, 16 bp, H. sapiens
ttgatctttctaatat

SEQ ID NO: 165673 - DNA, 16 bp, H. sapiens
ttgatcttttaaaaaa

SEQ ID NO: 165674 - DNA, 16 bp, H. sapiens
ttgatcttttcaaaga

SEQ ID NO: 165675 - DNA, 16 bp, H. sapiens
ttgatcttttcacaaa

SEQ ID NO: 165676 - DNA, 16 bp, H. sapiens
ttgatctttttatcat

SEQ ID NO: 165677 - DNA, 16 bp, H. sapiens
ttgatctttttgaaaa

SEQ ID NO: 165678 - DNA, 16 bp, H. sapiens
ttgatgaaaataattt

SEQ ID NO: 165679 - DNA, 16 bp, H. sapiens
ttgatgaaatgtatct

SEQ ID NO: 165680 - DNA, 16 bp, H. sapiens
ttgatgaacatttgga

SEQ ID NO: 165681 - DNA, 16 bp, H. sapiens
ttgatgaagaaattga

SEQ ID NO: 165682 - DNA, 16 bp, H. sapiens
ttgatgaatgaataaa

SEQ ID NO: 165683 - DNA, 16 bp, H. sapiens
ttgatgaattttcaca

SEQ ID NO: 165684 - DNA, 16 bp, H. sapiens
ttgatgaattttcata

SEQ ID NO: 165685 - DNA, 16 bp, H. sapiens
ttgatgacattatgct

SEQ ID NO: 165686 - DNA, 16 bp, H. sapiens
ttgatgacctttggat

SEQ ID NO: 165687 - DNA, 16 bp, H. sapiens
ttgatgagaaagaaaa

SEQ ID NO: 165688 - DNA, 16 bp, H. sapiens
ttgatgagagaacctg

SEQ ID NO: 165689 - DNA, 16 bp, H. sapiens
ttgatgagaggaatga

SEQ ID NO: 165690 - DNA, 16 bp, H. sapiens
ttgatgaggaaactga

SEQ ID NO: 165691 - DNA, 16 bp, H. sapiens
ttgatgagtttggaca

SEQ ID NO: 165692 - DNA, 16 bp, H. sapiens
ttgatgatcctgacct

SEQ ID NO: 165693 - DNA, 16 bp, H. sapiens
ttgatgatgatggtga

SEQ ID NO: 165694 - DNA, 16 bp, H. sapiens
ttgatgatggtgatga

SEQ ID NO: 165695 - DNA, 16 bp, H. sapiens
ttgatgcagcagtttg

SEQ ID NO: 165696 - DNA, 16 bp, H. sapiens
ttgatgctgtcctcat

SEQ ID NO: 165697 - DNA, 16 bp, H. sapiens
ttgatgctgttgttgc

SEQ ID NO: 165698 - DNA, 16 bp, H. sapiens
ttgatgctgttgttgt

SEQ ID NO: 165699 - DNA, 16 bp, H. sapiens
ttgatggaaatgtaaa

SEQ ID NO: 165700 - DNA, 16 bp, H. sapiens
ttgatggaagactttt

SEQ ID NO: 165701 - DNA, 16 bp, H. sapiens
ttgatggacatttggg

SEQ ID NO: 165702 - DNA, 16 bp, H. sapiens
ttgatggagtctcact

SEQ ID NO: 165703 - DNA, 16 bp, H. sapiens
ttgatggctactgact

SEQ ID NO: 165704 - DNA, 16 bp, H. sapiens
ttgatgggatatatct

SEQ ID NO: 165705 - DNA, 16 bp, H. sapiens
ttgatgggatgtattt

SEQ ID NO: 165706 - DNA, 16 bp, H. sapiens
ttgatgggcacctagg

SEQ ID NO: 165707 - DNA, 16 bp, H. sapiens
ttgatgggcgcagcaa

SEQ ID NO: 165708 - DNA, 16 bp, H. sapiens
ttgatggtttcttttg

SEQ ID NO: 165709 - DNA, 16 bp, H. sapiens
ttgatgtaggtattta

SEQ ID NO: 165710 - DNA, 16 bp, H. sapiens
ttgatgtctcatgcct

SEQ ID NO: 165711 - DNA, 16 bp, H. sapiens
ttgatgtgatctcatt

SEQ ID NO: 165712 - DNA, 16 bp, H. sapiens
ttgatgtgggtattta

SEQ ID NO: 165713 - DNA, 16 bp, H. sapiens
ttgatgtggtgctctc

SEQ ID NO: 165714 - DNA, 16 bp, H. sapiens
ttgatgttgatggcta

SEQ ID NO: 165715 - DNA, 16 bp, H. sapiens
ttgattaattcattca

SEQ ID NO: 165716 - DNA, 16 bp, H. sapiens
ttgattactgtagctt

SEQ ID NO: 165717 - DNA, 16 bp, H. sapiens
ttgattagcaatgtct

SEQ ID NO: 165718 - DNA, 16 bp, H. sapiens
ttgattattttgagct

SEQ ID NO: 165719 - DNA, 16 bp, H. sapiens
ttgattcaatacagca

SEQ ID NO: 165720 - DNA, 16 bp, H. sapiens
ttgattcattcatcca

SEQ ID NO: 165721 - DNA, 16 bp, H. sapiens
ttgattcattcattca

SEQ ID NO: 165722 - DNA, 16 bp, H. sapiens
ttgattcattttgaat

SEQ ID NO: 165723 - DNA, 16 bp, H. sapiens
ttgattccatacaaca

SEQ ID NO: 165724 - DNA, 16 bp, H. sapiens
ttgattccatgtattt

SEQ ID NO: 165725 - DNA, 16 bp, H. sapiens
ttgattccatttcatt

SEQ ID NO: 165726 - DNA, 16 bp, H. sapiens
ttgattccctgtcttt

SEQ ID NO: 165727 - DNA, 16 bp, H. sapiens
ttgattctatattttg

SEQ ID NO: 165728 - DNA, 16 bp, H. sapiens
ttgattctgtgtcttt

SEQ ID NO: 165729 - DNA, 16 bp, H. sapiens
ttgattctgtttctct

SEQ ID NO: 165730 - DNA, 16 bp, H. sapiens
ttgattcttagcttgg

SEQ ID NO: 165731 - DNA, 16 bp, H. sapiens
ttgattcttctctttc

SEQ ID NO: 165732 - DNA, 16 bp, H. sapiens
ttgattcttctgtctt

SEQ ID NO: 165733 - DNA, 16 bp, H. sapiens
ttgattctttcccttt

SEQ ID NO: 165734 - DNA, 16 bp, H. sapiens
ttgattctttcttctg

SEQ ID NO: 165735 - DNA, 16 bp, H. sapiens
ttgattctttttaatg

SEQ ID NO: 165736 - DNA, 16 bp, H. sapiens
ttgattcttttttaaa

SEQ ID NO: 165737 - DNA, 16 bp, H. sapiens
ttgattgaaagagtta

SEQ ID NO: 165738 - DNA, 16 bp, H. sapiens
ttgattgactgatttt

SEQ ID NO: 165739 - DNA, 16 bp, H. sapiens
ttgattgatgcctcat

SEQ ID NO: 165740 - DNA, 16 bp, H. sapiens
ttgattgatgtctcat

SEQ ID NO: 165741 - DNA, 16 bp, H. sapiens
ttgattgattgattga

SEQ ID NO: 165742 - DNA, 16 bp, H. sapiens
ttgattgattgattgt

SEQ ID NO: 165743 - DNA, 16 bp, H. sapiens
ttgattgctttttgct

SEQ ID NO: 165744 - DNA, 16 bp, H. sapiens
ttgattggaataattt

SEQ ID NO: 165745 - DNA, 16 bp, H. sapiens
ttgattgtggtgatgg

SEQ ID NO: 165746 - DNA, 16 bp, H. sapiens
ttgattgtgtcctttg

SEQ ID NO: 165747 - DNA, 16 bp, H. sapiens
ttgatttacatatttt

SEQ ID NO: 165748 - DNA, 16 bp, H. sapiens
ttgatttattcaacaa

SEQ ID NO: 165749 - DNA, 16 bp, H. sapiens
ttgatttatttcatct

SEQ ID NO: 165750 - DNA, 16 bp, H. sapiens
ttgatttcaggtcttt

SEQ ID NO: 165751 - DNA, 16 bp, H. sapiens
ttgatttctggtgagg

SEQ ID NO: 165752 - DNA, 16 bp, H. sapiens
ttgatttctttaagtt

SEQ ID NO: 165753 - DNA, 16 bp, H. sapiens
ttgatttgattctcag

SEQ ID NO: 165754 - DNA, 16 bp, H. sapiens
ttgatttgattttcag

SEQ ID NO: 165755 - DNA, 16 bp, H. sapiens
ttgatttgcatatatt

SEQ ID NO: 165756 - DNA, 21 bp, H. sapiens
ttgatttggggtggagagttc

SEQ ID NO: 165757 - DNA, 16 bp, H. sapiens
ttgatttggtttggct

SEQ ID NO: 165758 - DNA, 16 bp, H. sapiens
ttgatttgtatttctg

SEQ ID NO: 165759 - DNA, 16 bp, H. sapiens
ttgattttaaaagtca

SEQ ID NO: 165760 - DNA, 16 bp, H. sapiens
ttgattttacatcttt

SEQ ID NO: 165761 - DNA, 16 bp, H. sapiens
ttgattttacttttaa

SEQ ID NO: 165762 - DNA, 16 bp, H. sapiens
ttgattttagatcttt

SEQ ID NO: 165763 - DNA, 16 bp, H. sapiens
ttgattttcaaatgtt

SEQ ID NO: 165764 - DNA, 16 bp, H. sapiens
ttgattttcagcaaac

SEQ ID NO: 165765 - DNA, 16 bp, H. sapiens
ttgattttcagcagtt

SEQ ID NO: 165766 - DNA, 16 bp, H. sapiens
ttgattttcagtttta

SEQ ID NO: 165767 - DNA, 16 bp, H. sapiens
ttgattttctctctgg

SEQ ID NO: 165768 - DNA, 16 bp, H. sapiens
ttgattttctgctcct

SEQ ID NO: 165769 - DNA, 16 bp, H. sapiens
ttgattttgattttca

SEQ ID NO: 165770 - DNA, 16 bp, H. sapiens
ttgattttgtaaaaat

SEQ ID NO: 165771 - DNA, 16 bp, H. sapiens
ttgattttgtctcctg

SEQ ID NO: 165772 - DNA, 16 bp, H. sapiens
ttgatttttgaatact

SEQ ID NO: 165773 - DNA, 16 bp, H. sapiens
ttgattttttcaaaaa

SEQ ID NO: 165774 - DNA, 16 bp, H. sapiens
ttgattttttgaaagg

SEQ ID NO: 165775 - DNA, 16 bp, H. sapiens
ttgatttttttcaaaa

SEQ ID NO: 165776 - DNA, 16 bp, H. sapiens
ttgatttttttgaagg

SEQ ID NO: 165777 - DNA, 16 bp, H. sapiens
ttgattttttttcaaa

SEQ ID NO: 165778 - DNA, 16 bp, H. sapiens
ttgcaaaaacagtgtt

SEQ ID NO: 165779 - DNA, 16 bp, H. sapiens
ttgcaaaaataataca

SEQ ID NO: 165780 - DNA, 16 bp, H. sapiens
ttgcaaaaattctctc

SEQ ID NO: 165781 - DNA, 16 bp, H. sapiens
ttgcaaaacttcttga

SEQ ID NO: 165782 - DNA, 16 bp, H. sapiens
ttgcaaaagaaagagg

SEQ ID NO: 165783 - DNA, 16 bp, H. sapiens
ttgcaaaagaaattct

SEQ ID NO: 165784 - DNA, 16 bp, H. sapiens
ttgcaaaataagtttt

SEQ ID NO: 165785 - DNA, 16 bp, H. sapiens
ttgcaaaatctgtgaa

SEQ ID NO: 165786 - DNA, 16 bp, H. sapiens
ttgcaaaattcctgaa

SEQ ID NO: 165787 - DNA, 16 bp, H. sapiens
ttgcaaactatgcatc

SEQ ID NO: 165788 - DNA, 16 bp, H. sapiens
ttgcaaactggcacaa

SEQ ID NO: 165789 - DNA, 16 bp, H. sapiens
ttgcaaactgtgtatc

SEQ ID NO: 165790 - DNA, 16 bp, H. sapiens
ttgcaaagatttttct

SEQ ID NO: 165791 - DNA, 16 bp, H. sapiens
ttgcaaataagaaaat

SEQ ID NO: 165792 - DNA, 16 bp, H. sapiens
ttgcaaatatttcccc

SEQ ID NO: 165793 - DNA, 16 bp, H. sapiens
ttgcaaatatttcctt

SEQ ID NO: 165794 - DNA, 16 bp, H. sapiens
ttgcaaatatttttct

SEQ ID NO: 165795 - DNA, 16 bp, H. sapiens
ttgcaaatgtgattaa

SEQ ID NO: 165796 - DNA, 16 bp, H. sapiens
ttgcaaatttgttttt

SEQ ID NO: 165797 - DNA, 16 bp, H. sapiens
ttgcaaattttctgta

SEQ ID NO: 165798 - DNA, 16 bp, H. sapiens
ttgcaaattttttatt

SEQ ID NO: 165799 - DNA, 16 bp, H. sapiens
ttgcaaatttttttct

SEQ ID NO: 165800 - DNA, 16 bp, H. sapiens
ttgcaaattttttttc

SEQ ID NO: 165801 - DNA, 16 bp, H. sapiens
ttgcaacaaaacaaaa

SEQ ID NO: 165802 - DNA, 16 bp, H. sapiens
ttgcaacaacatgtat

SEQ ID NO: 165803 - DNA, 16 bp, H. sapiens
ttgcaacacctctcca

SEQ ID NO: 165804 - DNA, 16 bp, H. sapiens
ttgcaacagagactat

SEQ ID NO: 165805 - DNA, 16 bp, H. sapiens
ttgcaacagaggctac

SEQ ID NO: 165806 - DNA, 16 bp, H. sapiens
ttgcaacctcagcctc

SEQ ID NO: 165807 - DNA, 16 bp, H. sapiens
ttgcaacttttaaaaa

SEQ ID NO: 165808 - DNA, 16 bp, H. sapiens
ttgcaacttttctgta

SEQ ID NO: 165809 - DNA, 16 bp, H. sapiens
ttgcaagaaacagaaa

SEQ ID NO: 165810 - DNA, 16 bp, H. sapiens
ttgcaagaagagaaat

SEQ ID NO: 165811 - DNA, 16 bp, H. sapiens
ttgcaagaattttctc

SEQ ID NO: 165812 - DNA, 16 bp, H. sapiens
ttgcaagatctggtca

SEQ ID NO: 165813 - DNA, 16 bp, H. sapiens
ttgcaagcctactctg

SEQ ID NO: 165814 - DNA, 16 bp, H. sapiens
ttgcaagtattttttc

SEQ ID NO: 165815 - DNA, 16 bp, H. sapiens
ttgcaatagccaaaaa

SEQ ID NO: 165816 - DNA, 16 bp, H. sapiens
ttgcaatatttgtttt

SEQ ID NO: 165817 - DNA, 16 bp, H. sapiens
ttgcaatcctactctc

SEQ ID NO: 165818 - DNA, 24 bp, H. sapiens
ttgcaatcctagtctcggataaaa

SEQ ID NO: 165819 - DNA, 39 bp, H. sapiens
ttgcaatcctagtctctgataaaacagactttaaaccaa

SEQ ID NO: 165820 - DNA, 16 bp, H. sapiens
ttgcaatgagctcaga

SEQ ID NO: 165821 - DNA, 16 bp, H. sapiens
ttgcaatggagaaata

SEQ ID NO: 165822 - DNA, 16 bp, H. sapiens
ttgcaattgttttggg

SEQ ID NO: 165823 - DNA, 16 bp, H. sapiens
ttgcaatttcttttgg

SEQ ID NO: 165824 - DNA, 16 bp, H. sapiens
ttgcacaacagtgtga

SEQ ID NO: 165825 - DNA, 16 bp, H. sapiens
ttgcacactttaaaat

SEQ ID NO: 165826 - DNA, 16 bp, H. sapiens
ttgcacatatattttt

SEQ ID NO: 165827 - DNA, 16 bp, H. sapiens
ttgcacatattttgtt

SEQ ID NO: 165828 - DNA, 16 bp, H. sapiens
ttgcacatcttttcat

SEQ ID NO: 165829 - DNA, 16 bp, H. sapiens
ttgcacatcttttgtt

SEQ ID NO: 165830 - DNA, 16 bp, H. sapiens
ttgcacatgctattcc

SEQ ID NO: 165831 - DNA, 16 bp, H. sapiens
ttgcacattcattttg

SEQ ID NO: 165832 - DNA, 16 bp, H. sapiens
ttgcaccactgcactg

SEQ ID NO: 165833 - DNA, 16 bp, H. sapiens
ttgcaccactgcactt

SEQ ID NO: 165834 - DNA, 16 bp, H. sapiens
ttgcaccatatgcctg

SEQ ID NO: 165835 - DNA, 16 bp, H. sapiens
ttgcaccatggcactc

SEQ ID NO: 165836 - DNA, 16 bp, H. sapiens
ttgcaccattttacat

SEQ ID NO: 165837 - DNA, 16 bp, H. sapiens
ttgcactaatttacat

SEQ ID NO: 165838 - DNA, 17 bp, H. sapiens
ttgcactccagcctgcg

SEQ ID NO: 165839 - DNA, 16 bp, H. sapiens
ttgcactgaatctata

SEQ ID NO: 165840 - DNA, 16 bp, H. sapiens
ttgcactgtttttttc

SEQ ID NO: 165841 - DNA, 16 bp, H. sapiens
ttgcactttaaaaaaa

SEQ ID NO: 165842 - DNA, 17 bp, H. sapiens
ttgcagaagaaaataag

SEQ ID NO: 165843 - DNA, 16 bp, H. sapiens
ttgcagaagaggtggg

SEQ ID NO: 165844 - DNA, 16 bp, H. sapiens
ttgcagaatacacatt

SEQ ID NO: 165845 - DNA, 16 bp, H. sapiens
ttgcagacagcagatt

SEQ ID NO: 165846 - DNA, 16 bp, H. sapiens
ttgcagacattcccca

SEQ ID NO: 165847 - DNA, 16 bp, H. sapiens
ttgcagactgacaatg

SEQ ID NO: 165848 - DNA, 16 bp, H. sapiens
ttgcagaggacaccag

SEQ ID NO: 165849 - DNA, 16 bp, H. sapiens
ttgcagatactataaa

SEQ ID NO: 165850 - DNA, 16 bp, H. sapiens
ttgcagatactgtgtt

SEQ ID NO: 165851 - DNA, 16 bp, H. sapiens
ttgcagatattttatt

SEQ ID NO: 165852 - DNA, 16 bp, H. sapiens
ttgcagatattttccc

SEQ ID NO: 165853 - DNA, 16 bp, H. sapiens
ttgcagatgacatgct

SEQ ID NO: 165854 - DNA, 16 bp, H. sapiens
ttgcagatgaggaaaa

SEQ ID NO: 165855 - DNA, 16 bp, H. sapiens
ttgcagatggaatcaa

SEQ ID NO: 165856 - DNA, 16 bp, H. sapiens
ttgcagatgtaattgg

SEQ ID NO: 165857 - DNA, 16 bp, H. sapiens
ttgcagattctgcaaa

SEQ ID NO: 165858 - DNA, 16 bp, H. sapiens
ttgcagattctgcaga

SEQ ID NO: 165859 - DNA, 16 bp, H. sapiens
ttgcagcaagcagaga

SEQ ID NO: 165860 - DNA, 16 bp, H. sapiens
ttgcagcataacaaat

SEQ ID NO: 165861 - DNA, 16 bp, H. sapiens
ttgcagccaggcgtgg

SEQ ID NO: 165862 - DNA, 16 bp, H. sapiens
ttgcagccagggccag

SEQ ID NO: 165863 - DNA, 16 bp, H. sapiens
ttgcagccatgtcaag

SEQ ID NO: 165864 - DNA, 16 bp, H. sapiens
ttgcagctcccactca

SEQ ID NO: 165865 - DNA, 18 bp, H. sapiens
ttgcagctgcacagctag

SEQ ID NO: 165866 - DNA, 16 bp, H. sapiens
ttgcagcttttgccat

SEQ ID NO: 165867 - DNA, 16 bp, H. sapiens
ttgcaggagctgacag

SEQ ID NO: 165868 - DNA, 16 bp, H. sapiens
ttgcaggatttttttt

SEQ ID NO: 165869 - DNA, 17 bp, H. sapiens
ttgcagggactgctgca

SEQ ID NO: 165870 - DNA, 19 bp, H. sapiens
ttgcagggagccgagatcg

SEQ ID NO: 165871 - DNA, 16 bp, H. sapiens
ttgcagggaggattga

SEQ ID NO: 165872 - DNA, 16 bp, H. sapiens
ttgcagggatgcctct

SEQ ID NO: 165873 - DNA, 16 bp, H. sapiens
ttgcagtaggggagag

SEQ ID NO: 165874 - DNA, 16 bp, H. sapiens
ttgcagtcacagctac

SEQ ID NO: 165875 - DNA, 16 bp, H. sapiens
ttgcagtcagctgaga

SEQ ID NO: 165876 - DNA, 16 bp, H. sapiens
ttgcagtcagtggaga

SEQ ID NO: 165877 - DNA, 16 bp, H. sapiens
ttgcagtccttgtgtc

SEQ ID NO: 165878 - DNA, 16 bp, H. sapiens
ttgcagtctctctctc

SEQ ID NO: 165879 - DNA, 19 bp, H. sapiens
ttgcagtgaaccaagatca

SEQ ID NO: 165880 - DNA, 16 bp, H. sapiens
ttgcagtgaatggaga

SEQ ID NO: 165881 - DNA, 16 bp, H. sapiens
ttgcagtgagcagaca

SEQ ID NO: 165882 - DNA, 16 bp, H. sapiens
ttgcagtgagccatga

SEQ ID NO: 165883 - DNA, 16 bp, H. sapiens
ttgcagtgagccatgg

SEQ ID NO: 165884 - DNA, 16 bp, H. sapiens
ttgcagtgagctaata

SEQ ID NO: 165885 - DNA, 16 bp, H. sapiens
ttgcagtgagctgaca

SEQ ID NO: 165886 - DNA, 16 bp, H. sapiens
ttgcagtgagctgata

SEQ ID NO: 165887 - DNA, 16 bp, H. sapiens
ttgcagtgagctgatg

SEQ ID NO: 165888 - DNA, 16 bp, H. sapiens
ttgcagtgagctgtga

SEQ ID NO: 165889 - DNA, 16 bp, H. sapiens
ttgcagtgagttatga

SEQ ID NO: 165890 - DNA, 16 bp, H. sapiens
ttgcagtgagttgtga

SEQ ID NO: 165891 - DNA, 16 bp, H. sapiens
ttgcagtggcacgatc

SEQ ID NO: 165892 - DNA, 16 bp, H. sapiens
ttgcagtgggtcaaga

SEQ ID NO: 165893 - DNA, 16 bp, H. sapiens
ttgcagtgtgctgaga

SEQ ID NO: 165894 - DNA, 16 bp, H. sapiens
ttgcagtgttgcccag

SEQ ID NO: 165895 - DNA, 24 bp, H. sapiens
ttgcagttgagataagaggaaggc

SEQ ID NO: 165896 - DNA, 16 bp, H. sapiens
ttgcagtttagacaca

SEQ ID NO: 165897 - DNA, 16 bp, H. sapiens
ttgcagtttttgcaat

SEQ ID NO: 165898 - DNA, 16 bp, H. sapiens
ttgcagtttttgccac

SEQ ID NO: 165899 - DNA, 16 bp, H. sapiens
ttgcagtttttgtaga

SEQ ID NO: 165900 - DNA, 16 bp, H. sapiens
ttgcataactgaagct

SEQ ID NO: 165901 - DNA, 16 bp, H. sapiens
ttgcatactttaaaat

SEQ ID NO: 165902 - DNA, 16 bp, H. sapiens
ttgcatataatctatg

SEQ ID NO: 165903 - DNA, 16 bp, H. sapiens
ttgcatatatatttat

SEQ ID NO: 165904 - DNA, 16 bp, H. sapiens
ttgcatatattttctt

SEQ ID NO: 165905 - DNA, 16 bp, H. sapiens
ttgcatatttcaaaat

SEQ ID NO: 165906 - DNA, 16 bp, H. sapiens
ttgcatattttattat

SEQ ID NO: 165907 - DNA, 16 bp, H. sapiens
ttgcatcaatattctt

SEQ ID NO: 165908 - DNA, 16 bp, H. sapiens
ttgcatcagtgtgacc

SEQ ID NO: 165909 - DNA, 16 bp, H. sapiens
ttgcatcctggctctg

SEQ ID NO: 165910 - DNA, 16 bp, H. sapiens
ttgcatccttcaatct

SEQ ID NO: 165911 - DNA, 16 bp, H. sapiens
ttgcatctgctgtttt

SEQ ID NO: 165912 - DNA, 16 bp, H. sapiens
ttgcatctggcttttt

SEQ ID NO: 165913 - DNA, 16 bp, H. sapiens
ttgcatgagccaattt

SEQ ID NO: 165914 - DNA, 16 bp, H. sapiens
ttgcatgatgctgaag

SEQ ID NO: 165915 - DNA, 16 bp, H. sapiens
ttgcatgattgccctg

SEQ ID NO: 165916 - DNA, 16 bp, H. sapiens
ttgcatgtttattttg

SEQ ID NO: 165917 - DNA, 16 bp, H. sapiens
ttgcattcaatctgta

SEQ ID NO: 165918 - DNA, 16 bp, H. sapiens
ttgcattccagggata

SEQ ID NO: 165919 - DNA, 16 bp, H. sapiens
ttgcattccattgcat

SEQ ID NO: 165920 - DNA, 16 bp, H. sapiens
ttgcattcccagcaca

SEQ ID NO: 165921 - DNA, 16 bp, H. sapiens
ttgcattcctttgagt

SEQ ID NO: 165922 - DNA, 16 bp, H. sapiens
ttgcattgtggttttt

SEQ ID NO: 165923 - DNA, 16 bp, H. sapiens
ttgcatttataattta

SEQ ID NO: 165924 - DNA, 16 bp, H. sapiens
ttgcatttatatgaaa

SEQ ID NO: 165925 - DNA, 16 bp, H. sapiens
ttgcatttattctaaa

SEQ ID NO: 165926 - DNA, 16 bp, H. sapiens
ttgcatttcaatatga

SEQ ID NO: 165927 - DNA, 16 bp, H. sapiens
ttgcatttccatgatg

SEQ ID NO: 165928 - DNA, 16 bp, H. sapiens
ttgcatttccttgata

SEQ ID NO: 165929 - DNA, 16 bp, H. sapiens
ttgcatttctctgaat

SEQ ID NO: 165930 - DNA, 16 bp, H. sapiens
ttgcatttctttgctt

SEQ ID NO: 165931 - DNA, 16 bp, H. sapiens
ttgcatttcttttatg

SEQ ID NO: 165932 - DNA, 16 bp, H. sapiens
ttgcatttcttttcct

SEQ ID NO: 165933 - DNA, 16 bp, H. sapiens
ttgcatttgaaatttt

SEQ ID NO: 165934 - DNA, 16 bp, H. sapiens
ttgcatttgctgagta

SEQ ID NO: 165935 - DNA, 16 bp, H. sapiens
ttgcattttaaagaga

SEQ ID NO: 165936 - DNA, 16 bp, H. sapiens
ttgcattttccttatg

SEQ ID NO: 165937 - DNA, 16 bp, H. sapiens
ttgcattttctgatga

SEQ ID NO: 165938 - DNA, 16 bp, H. sapiens
ttgcatttttatataa

SEQ ID NO: 165939 - DNA, 16 bp, H. sapiens
ttgcatttttattaaa

SEQ ID NO: 165940 - DNA, 16 bp, H. sapiens
ttgcatttttcaactc

SEQ ID NO: 165941 - DNA, 16 bp, H. sapiens
ttgcatttttcttcat

SEQ ID NO: 165942 - DNA, 16 bp, H. sapiens
ttgcattttttaaaaa

SEQ ID NO: 165943 - DNA, 16 bp, H. sapiens
ttgcatttttttccat

SEQ ID NO: 165944 - DNA, 16 bp, H. sapiens
ttgccaaaacaaaggg

SEQ ID NO: 165945 - DNA, 16 bp, H. sapiens
ttgccaaaacttgtta

SEQ ID NO: 165946 - DNA, 16 bp, H. sapiens
ttgccaaaagaaatta

SEQ ID NO: 165947 - DNA, 16 bp, H. sapiens
ttgccaaaattaaaaa

SEQ ID NO: 165948 - DNA, 16 bp, H. sapiens
ttgccaaaatttggaa

SEQ ID NO: 165949 - DNA, 16 bp, H. sapiens
ttgccaaacagttttc

SEQ ID NO: 165950 - DNA, 16 bp, H. sapiens
ttgccaaatatcccct

SEQ ID NO: 165951 - DNA, 16 bp, H. sapiens
ttgccaaatccaatgg

SEQ ID NO: 165952 - DNA, 16 bp, H. sapiens
ttgccaacaaaaaaaa

SEQ ID NO: 165953 - DNA, 16 bp, H. sapiens
ttgccaacacttggaa

SEQ ID NO: 165954 - DNA, 16 bp, H. sapiens
ttgccaacattttatt

SEQ ID NO: 165955 - DNA, 16 bp, H. sapiens
ttgccaaggatgtgga

SEQ ID NO: 165956 - DNA, 16 bp, H. sapiens
ttgccaaggctgagga

SEQ ID NO: 165957 - DNA, 16 bp, H. sapiens
ttgccaatgaaagtgg

SEQ ID NO: 165958 - DNA, 16 bp, H. sapiens
ttgccacaaaaaataa

SEQ ID NO: 165959 - DNA, 16 bp, H. sapiens
ttgccacaaaacttca

SEQ ID NO: 165960 - DNA, 16 bp, H. sapiens
ttgccacaaaccttca

SEQ ID NO: 165961 - DNA, 16 bp, H. sapiens
ttgccacaaatcttca

SEQ ID NO: 165962 - DNA, 16 bp, H. sapiens
ttgccacagctcttct

SEQ ID NO: 165963 - DNA, 16 bp, H. sapiens
ttgccaccatcttgga

SEQ ID NO: 165964 - DNA, 16 bp, H. sapiens
ttgccactataaagcc

SEQ ID NO: 165965 - DNA, 16 bp, H. sapiens
ttgccactgctggctt

SEQ ID NO: 165966 - DNA, 16 bp, H. sapiens
ttgccactttttaatg

SEQ ID NO: 165967 - DNA, 16 bp, H. sapiens
ttgccagagcagtttt

SEQ ID NO: 165968 - DNA, 16 bp, H. sapiens
ttgccagaggctgggg

SEQ ID NO: 165969 - DNA, 16 bp, H. sapiens
ttgccagcctggtctc

SEQ ID NO: 165970 - DNA, 16 bp, H. sapiens
ttgccaggcacatgtg

SEQ ID NO: 165971 - DNA, 16 bp, H. sapiens
ttgccaggcgtggtgg

SEQ ID NO: 165972 - DNA, 16 bp, H. sapiens
ttgccaggctgctctg

SEQ ID NO: 165973 - DNA, 16 bp, H. sapiens
ttgccaggctggcctt

SEQ ID NO: 165974 - DNA, 16 bp, H. sapiens
ttgccaggctggtctc

SEQ ID NO: 165975 - DNA, 16 bp, H. sapiens
ttgccagggaagaagg

SEQ ID NO: 165976 - DNA, 16 bp, H. sapiens
ttgccagggacctgcc

SEQ ID NO: 165977 - DNA, 16 bp, H. sapiens
ttgccaggttgcccag

SEQ ID NO: 165978 - DNA, 16 bp, H. sapiens
ttgccaggtttgtcaa

SEQ ID NO: 165979 - DNA, 16 bp, H. sapiens
ttgccagtattttatt

SEQ ID NO: 165980 - DNA, 16 bp, H. sapiens
ttgccagtgaaggatt

SEQ ID NO: 165981 - DNA, 16 bp, H. sapiens
ttgccagtttttaagt

SEQ ID NO: 165982 - DNA, 16 bp, H. sapiens
ttgccataacagaata

SEQ ID NO: 165983 - DNA, 19 bp, H. sapiens
ttgccataccttgaaattg

SEQ ID NO: 165984 - DNA, 16 bp, H. sapiens
ttgccatcctagtctc

SEQ ID NO: 165985 - DNA, 16 bp, H. sapiens
ttgccatctgtgtgtc

SEQ ID NO: 165986 - DNA, 16 bp, H. sapiens
ttgccatgagcagaga

SEQ ID NO: 165987 - DNA, 18 bp, H. sapiens
ttgccatggcatttgtaa

SEQ ID NO: 165988 - DNA, 16 bp, H. sapiens
ttgccatggtaacact

SEQ ID NO: 165989 - DNA, 16 bp, H. sapiens
ttgccatgttgcccag

SEQ ID NO: 165990 - DNA, 16 bp, H. sapiens
ttgccattatttttaa

SEQ ID NO: 165991 - DNA, 16 bp, H. sapiens
ttgccattctaattgg

SEQ ID NO: 165992 - DNA, 16 bp, H. sapiens
ttgccatttatttatt

SEQ ID NO: 165993 - DNA, 16 bp, H. sapiens
ttgccatttattttct

SEQ ID NO: 165994 - DNA, 16 bp, H. sapiens
ttgccattttaatttt

SEQ ID NO: 165995 - DNA, 16 bp, H. sapiens
ttgcccaaagtaattt

SEQ ID NO: 165996 - DNA, 16 bp, H. sapiens
ttgcccaaagttgcac

SEQ ID NO: 165997 - DNA, 16 bp, H. sapiens
ttgcccaagctggtct

SEQ ID NO: 165998 - DNA, 16 bp, H. sapiens
ttgcccaagttggagt

SEQ ID NO: 165999 - DNA, 16 bp, H. sapiens
ttgcccacactggtct

SEQ ID NO: 166000 - DNA, 16 bp, H. sapiens
ttgcccacgctggtct

SEQ ID NO: 166001 - DNA, 16 bp, H. sapiens
ttgcccacttttaaat

SEQ ID NO: 166002 - DNA, 16 bp, H. sapiens
ttgcccacttttcaat

SEQ ID NO: 166003 - DNA, 16 bp, H. sapiens
ttgcccagactagagt

SEQ ID NO: 166004 - DNA, 16 bp, H. sapiens
ttgcccagactggtct

SEQ ID NO: 166005 - DNA, 16 bp, H. sapiens
ttgcccagagctggag

SEQ ID NO: 166006 - DNA, 16 bp, H. sapiens
ttgcccagattggagt

SEQ ID NO: 166007 - DNA, 16 bp, H. sapiens
ttgcccagcctgcagt

SEQ ID NO: 166008 - DNA, 16 bp, H. sapiens
ttgcccagcctggact

SEQ ID NO: 166009 - DNA, 16 bp, H. sapiens
ttgcccagcctggagc

SEQ ID NO: 166010 - DNA, 16 bp, H. sapiens
ttgcccagcctggtct

SEQ ID NO: 166011 - DNA, 16 bp, H. sapiens
ttgcccagcttggagt

SEQ ID NO: 166012 - DNA, 16 bp, H. sapiens
ttgcccaggatggggt

SEQ ID NO: 166013 - DNA, 16 bp, H. sapiens
ttgcccaggatggtct

SEQ ID NO: 166014 - DNA, 16 bp, H. sapiens
ttgcccaggccagtct

SEQ ID NO: 166015 - DNA, 16 bp, H. sapiens
ttgcccaggctagtct

SEQ ID NO: 166016 - DNA, 16 bp, H. sapiens
ttgcccaggctgatct

SEQ ID NO: 166017 - DNA, 17 bp, H. sapiens
ttgcccaggctggagtt

SEQ ID NO: 166018 - DNA, 16 bp, H. sapiens
ttgcccaggctggcct

SEQ ID NO: 166019 - DNA, 16 bp, H. sapiens
ttgcccaggctggggc

SEQ ID NO: 166020 - DNA, 16 bp, H. sapiens
ttgcccaggctggtcc

SEQ ID NO: 166021 - DNA, 16 bp, H. sapiens
ttgcccaggctggtcg

SEQ ID NO: 166022 - DNA, 17 bp, H. sapiens
ttgcccaggctggtcgt

SEQ ID NO: 166023 - DNA, 16 bp, H. sapiens
ttgcccaggctggtct

SEQ ID NO: 166024 - DNA, 16 bp, H. sapiens
ttgcccaggctggtgt

SEQ ID NO: 166025 - DNA, 17 bp, H. sapiens
ttgcccaggctggtttg

SEQ ID NO: 166026 - DNA, 16 bp, H. sapiens
ttgcccaggctgtagt

SEQ ID NO: 166027 - DNA, 16 bp, H. sapiens
ttgcccaggctgtggc

SEQ ID NO: 166028 - DNA, 17 bp, H. sapiens
ttgcccaggctgttctc

SEQ ID NO: 166029 - DNA, 16 bp, H. sapiens
ttgcccaggcttggtc

SEQ ID NO: 166030 - DNA, 16 bp, H. sapiens
ttgcccagggccagca

SEQ ID NO: 166031 - DNA, 16 bp, H. sapiens
ttgcccaggtgtggtg

SEQ ID NO: 166032 - DNA, 16 bp, H. sapiens
ttgcccaggttgatct

SEQ ID NO: 166033 - DNA, 16 bp, H. sapiens
ttgcccaggttgctct

SEQ ID NO: 166034 - DNA, 16 bp, H. sapiens
ttgcccaggttggtct

SEQ ID NO: 166035 - DNA, 16 bp, H. sapiens
ttgcccagtctggtct

SEQ ID NO: 166036 - DNA, 16 bp, H. sapiens
ttgcccagttcatgga

SEQ ID NO: 166037 - DNA, 16 bp, H. sapiens
ttgcccataccaatgt

SEQ ID NO: 166038 - DNA, 16 bp, H. sapiens
ttgccccaggaaatca

SEQ ID NO: 166039 - DNA, 16 bp, H. sapiens
ttgccccagtcctgtg

SEQ ID NO: 166040 - DNA, 16 bp, H. sapiens
ttgccccatttgcttt

SEQ ID NO: 166041 - DNA, 16 bp, H. sapiens
ttgcccccaggctgga

SEQ ID NO: 166042 - DNA, 16 bp, H. sapiens
ttgcccgggctgaagt

SEQ ID NO: 166043 - DNA, 16 bp, H. sapiens
ttgcccgggctggcct

SEQ ID NO: 166044 - DNA, 16 bp, H. sapiens
ttgcccgggctggtct

SEQ ID NO: 166045 - DNA, 20 bp, H. sapiens
ttgccctcattctggtaaac

SEQ ID NO: 166046 - DNA, 16 bp, H. sapiens
ttgccctccaccatga

SEQ ID NO: 166047 - DNA, 16 bp, H. sapiens
ttgccctccatgggct

SEQ ID NO: 166048 - DNA, 16 bp, H. sapiens
ttgccctgctgacact

SEQ ID NO: 166049 - DNA, 16 bp, H. sapiens
ttgccctggctggggt

SEQ ID NO: 166050 - DNA, 16 bp, H. sapiens
ttgcccttccaccttc

SEQ ID NO: 166051 - DNA, 17 bp, H. sapiens
ttgccctttgaagcatg

SEQ ID NO: 166052 - DNA, 16 bp, H. sapiens
ttgccgaagaactcaa

SEQ ID NO: 166053 - DNA, 16 bp, H. sapiens
ttgcctaagctggtct

SEQ ID NO: 166054 - DNA, 16 bp, H. sapiens
ttgcctaaggtcacat

SEQ ID NO: 166055 - DNA, 16 bp, H. sapiens
ttgcctaatccaaggt

SEQ ID NO: 166056 - DNA, 16 bp, H. sapiens
ttgcctacattttctt

SEQ ID NO: 166057 - DNA, 16 bp, H. sapiens
ttgcctaggccggtct

SEQ ID NO: 166058 - DNA, 16 bp, H. sapiens
ttgcctaggctggtct

SEQ ID NO: 166059 - DNA, 16 bp, H. sapiens
ttgcctaggttggagt

SEQ ID NO: 166060 - DNA, 16 bp, H. sapiens
ttgcctatttttaaaa

SEQ ID NO: 166061 - DNA, 16 bp, H. sapiens
ttgcctcagaataaat

SEQ ID NO: 166062 - DNA, 16 bp, H. sapiens
ttgcctcagcctccca

SEQ ID NO: 166063 - DNA, 18 bp, H. sapiens
ttgcctcagcctcccaaa

SEQ ID NO: 166064 - DNA, 16 bp, H. sapiens
ttgcctcagcctccta

SEQ ID NO: 166065 - DNA, 16 bp, H. sapiens
ttgcctcagcttcccg

SEQ ID NO: 166066 - DNA, 16 bp, H. sapiens
ttgcctcagggccttt

SEQ ID NO: 166067 - DNA, 16 bp, H. sapiens
ttgcctcagtctccca

SEQ ID NO: 166068 - DNA, 16 bp, H. sapiens
ttgcctcagtttcctc

SEQ ID NO: 166069 - DNA, 16 bp, H. sapiens
ttgcctcatatatttt

SEQ ID NO: 166070 - DNA, 16 bp, H. sapiens
ttgcctccagaactgt

SEQ ID NO: 166071 - DNA, 16 bp, H. sapiens
ttgcctcctcagagga

SEQ ID NO: 166072 - DNA, 16 bp, H. sapiens
ttgcctctaccaaaaa

SEQ ID NO: 166073 - DNA, 16 bp, H. sapiens
ttgcctctcccagctt

SEQ ID NO: 166074 - DNA, 16 bp, H. sapiens
ttgcctctctgtttgt

SEQ ID NO: 166075 - DNA, 16 bp, H. sapiens
ttgcctctgcctggaa

SEQ ID NO: 166076 - DNA, 16 bp, H. sapiens
ttgcctgagagcacag

SEQ ID NO: 166077 - DNA, 16 bp, H. sapiens
ttgcctgaggacagga

SEQ ID NO: 166078 - DNA, 16 bp, H. sapiens
ttgcctgaggccaaga

SEQ ID NO: 166079 - DNA, 16 bp, H. sapiens
ttgcctgccgccatgt

SEQ ID NO: 166080 - DNA, 16 bp, H. sapiens
ttgcctgcctcagcct

SEQ ID NO: 166081 - DNA, 16 bp, H. sapiens
ttgcctgcctctgcct

SEQ ID NO: 166082 - DNA, 16 bp, H. sapiens
ttgcctgcctgcctgc

SEQ ID NO: 166083 - DNA, 16 bp, H. sapiens
ttgcctgctgcctaga

SEQ ID NO: 166084 - DNA, 16 bp, H. sapiens
ttgcctgggcaacata

SEQ ID NO: 166085 - DNA, 16 bp, H. sapiens
ttgcctgggcccagga

SEQ ID NO: 166086 - DNA, 16 bp, H. sapiens
ttgcctggggaccagt

SEQ ID NO: 166087 - DNA, 19 bp, H. sapiens
ttgcctgtaatcccagcat

SEQ ID NO: 166088 - DNA, 16 bp, H. sapiens
ttgcctgtgattttga

SEQ ID NO: 166089 - DNA, 16 bp, H. sapiens
ttgccttcagggagct

SEQ ID NO: 166090 - DNA, 16 bp, H. sapiens
ttgccttccaccttga

SEQ ID NO: 166091 - DNA, 16 bp, H. sapiens
ttgccttcccccatga

SEQ ID NO: 166092 - DNA, 16 bp, H. sapiens
ttgccttccgtcatga

SEQ ID NO: 166093 - DNA, 16 bp, H. sapiens
ttgccttctaccatga

SEQ ID NO: 166094 - DNA, 16 bp, H. sapiens
ttgccttctcctagct

SEQ ID NO: 166095 - DNA, 16 bp, H. sapiens
ttgccttctgccagga

SEQ ID NO: 166096 - DNA, 16 bp, H. sapiens
ttgccttctttaaaaa

SEQ ID NO: 166097 - DNA, 16 bp, H. sapiens
ttgccttgatgttgat

SEQ ID NO: 166098 - DNA, 16 bp, H. sapiens
ttgccttgattttctt

SEQ ID NO: 166099 - DNA, 17 bp, H. sapiens
ttgccttgctgagaatt

SEQ ID NO: 166100 - DNA, 17 bp, H. sapiens
ttgccttgtcgcccagg

SEQ ID NO: 166101 - DNA, 16 bp, H. sapiens
ttgccttgtgatcttt

SEQ ID NO: 166102 - DNA, 16 bp, H. sapiens
ttgcctttaaaaatct

SEQ ID NO: 166103 - DNA, 16 bp, H. sapiens
ttgcctttaaattttt

SEQ ID NO: 166104 - DNA, 16 bp, H. sapiens
ttgcctttaagaaact

SEQ ID NO: 166105 - DNA, 16 bp, H. sapiens
ttgcctttcagtggga

SEQ ID NO: 166106 - DNA, 16 bp, H. sapiens
ttgcctttctgtgcct

SEQ ID NO: 166107 - DNA, 16 bp, H. sapiens
ttgcctttcttctgcc

SEQ ID NO: 166108 - DNA, 16 bp, H. sapiens
ttgcctttgtaggact

SEQ ID NO: 166109 - DNA, 16 bp, H. sapiens
ttgccttttccagctt

SEQ ID NO: 166110 - DNA, 16 bp, H. sapiens
ttgccttttccaggat

SEQ ID NO: 166111 - DNA, 16 bp, H. sapiens
ttgcctttttcactgt

SEQ ID NO: 166112 - DNA, 24 bp, H. sapiens
ttgcggtgagccgagatcgcgcca

SEQ ID NO: 166113 - DNA, 16 bp, H. sapiens
ttgctaaaatatttta

SEQ ID NO: 166114 - DNA, 16 bp, H. sapiens
ttgctaaatctggcag

SEQ ID NO: 166115 - DNA, 16 bp, H. sapiens
ttgctaaatctggtaa

SEQ ID NO: 166116 - DNA, 16 bp, H. sapiens
ttgctaaatgaaagaa

SEQ ID NO: 166117 - DNA, 16 bp, H. sapiens
ttgctaaattttaaaa

SEQ ID NO: 166118 - DNA, 16 bp, H. sapiens
ttgctaacattttatt

SEQ ID NO: 166119 - DNA, 16 bp, H. sapiens
ttgctaagagagcaga

SEQ ID NO: 166120 - DNA, 16 bp, H. sapiens
ttgctaagattttgtt

SEQ ID NO: 166121 - DNA, 16 bp, H. sapiens
ttgctaataaagacat

SEQ ID NO: 166122 - DNA, 16 bp, H. sapiens
ttgctaatattttgat

SEQ ID NO: 166123 - DNA, 16 bp, H. sapiens
ttgctaatgttttatt

SEQ ID NO: 166124 - DNA, 16 bp, H. sapiens
ttgctaattaaaaaaa

SEQ ID NO: 166125 - DNA, 16 bp, H. sapiens
ttgctaattttaaaaa

SEQ ID NO: 166126 - DNA, 16 bp, H. sapiens
ttgctaatttttaaat

SEQ ID NO: 166127 - DNA, 16 bp, H. sapiens
ttgctaattttttcaa

SEQ ID NO: 166128 - DNA, 16 bp, H. sapiens
ttgctacaaaaaataa

SEQ ID NO: 166129 - DNA, 16 bp, H. sapiens
ttgctacaaagaacat

SEQ ID NO: 166130 - DNA, 16 bp, H. sapiens
ttgctacaaatgacag

SEQ ID NO: 166131 - DNA, 16 bp, H. sapiens
ttgctacaagtgccgg

SEQ ID NO: 166132 - DNA, 16 bp, H. sapiens
ttgctaccaagagaat

SEQ ID NO: 166133 - DNA, 16 bp, H. sapiens
ttgctagaaggactca

SEQ ID NO: 166134 - DNA, 16 bp, H. sapiens
ttgctagtctgtgtct

SEQ ID NO: 166135 - DNA, 16 bp, H. sapiens
ttgctataaaggaaca

SEQ ID NO: 166136 - DNA, 16 bp, H. sapiens
ttgctatgcaaaagct

SEQ ID NO: 166137 - DNA, 16 bp, H. sapiens
ttgctatgcagaagtt

SEQ ID NO: 166138 - DNA, 16 bp, H. sapiens
ttgctatgttgccaag

SEQ ID NO: 166139 - DNA, 16 bp, H. sapiens
ttgctattattttaaa

SEQ ID NO: 166140 - DNA, 16 bp, H. sapiens
ttgctattttgcctag

SEQ ID NO: 166141 - DNA, 16 bp, H. sapiens
ttgctcaaatcaatca

SEQ ID NO: 166142 - DNA, 16 bp, H. sapiens
ttgctcaactttaatt

SEQ ID NO: 166143 - DNA, 16 bp, H. sapiens
ttgctcaaggtcatgt

SEQ ID NO: 166144 - DNA, 16 bp, H. sapiens
ttgctcaataaaattc

SEQ ID NO: 166145 - DNA, 16 bp, H. sapiens
ttgctcaataaacatt

SEQ ID NO: 166146 - DNA, 16 bp, H. sapiens
ttgctcaattcaagaa

SEQ ID NO: 166147 - DNA, 16 bp, H. sapiens
ttgctcaccactgtat

SEQ ID NO: 166148 - DNA, 16 bp, H. sapiens
ttgctcaccattttat

SEQ ID NO: 166149 - DNA, 16 bp, H. sapiens
ttgctcacctcctgct

SEQ ID NO: 166150 - DNA, 16 bp, H. sapiens
ttgctcactgcaacct

SEQ ID NO: 166151 - DNA, 16 bp, H. sapiens
ttgctcactgctatat

SEQ ID NO: 166152 - DNA, 16 bp, H. sapiens
ttgctcactgctgtat

SEQ ID NO: 166153 - DNA, 16 bp, H. sapiens
ttgctcacttcaagaa

SEQ ID NO: 166154 - DNA, 16 bp, H. sapiens
ttgctcagaatgatga

SEQ ID NO: 166155 - DNA, 16 bp, H. sapiens
ttgctcagcctggagt

SEQ ID NO: 166156 - DNA, 16 bp, H. sapiens
ttgctcagctctcatt

SEQ ID NO: 166157 - DNA, 16 bp, H. sapiens
ttgctcaggctggtct

SEQ ID NO: 166158 - DNA, 16 bp, H. sapiens
ttgctcagttagttca

SEQ ID NO: 166159 - DNA, 16 bp, H. sapiens
ttgctcatctgtaaga

SEQ ID NO: 166160 - DNA, 16 bp, H. sapiens
ttgctcatgctggagt

SEQ ID NO: 166161 - DNA, 16 bp, H. sapiens
ttgctcatgttgccca

SEQ ID NO: 166162 - DNA, 16 bp, H. sapiens
ttgctcattaacatcc

SEQ ID NO: 166163 - DNA, 16 bp, H. sapiens
ttgctcattgaagcat

SEQ ID NO: 166164 - DNA, 16 bp, H. sapiens
ttgctcatttaaaaaa

SEQ ID NO: 166165 - DNA, 16 bp, H. sapiens
ttgctcatttatttct

SEQ ID NO: 166166 - DNA, 16 bp, H. sapiens
ttgctcatttatttgt

SEQ ID NO: 166167 - DNA, 16 bp, H. sapiens
ttgctccaacccagga

SEQ ID NO: 166168 - DNA, 16 bp, H. sapiens
ttgctccacccatcaa

SEQ ID NO: 166169 - DNA, 16 bp, H. sapiens
ttgctccagttccaaa

SEQ ID NO: 166170 - DNA, 18 bp, H. sapiens
ttgctcctccttcgcctt

SEQ ID NO: 166171 - DNA, 17 bp, H. sapiens
ttgctcctccttgcctt

SEQ ID NO: 166172 - DNA, 16 bp, H. sapiens
ttgctcctgctcctgc

SEQ ID NO: 166173 - DNA, 16 bp, H. sapiens
ttgctcctgctcttgc

SEQ ID NO: 166174 - DNA, 16 bp, H. sapiens
ttgctcctgcttctgc

SEQ ID NO: 166175 - DNA, 16 bp, H. sapiens
ttgctccttagaaatt

SEQ ID NO: 166176 - DNA, 16 bp, H. sapiens
ttgctctgccagctga

SEQ ID NO: 166177 - DNA, 16 bp, H. sapiens
ttgctctgctgcccaa

SEQ ID NO: 166178 - DNA, 16 bp, H. sapiens
ttgctctggatgagtc

SEQ ID NO: 166179 - DNA, 16 bp, H. sapiens
ttgctctgtcacctat

SEQ ID NO: 166180 - DNA, 16 bp, H. sapiens
ttgctctgtcacgcag

SEQ ID NO: 166181 - DNA, 16 bp, H. sapiens
ttgctctgtgactttg

SEQ ID NO: 166182 - DNA, 16 bp, H. sapiens
ttgctctgtggccagg

SEQ ID NO: 166183 - DNA, 18 bp, H. sapiens
ttgctctgttgcccaggg

SEQ ID NO: 166184 - DNA, 16 bp, H. sapiens
ttgctctgttttccag

SEQ ID NO: 166185 - DNA, 16 bp, H. sapiens
ttgctcttctccagga

SEQ ID NO: 166186 - DNA, 16 bp, H. sapiens
ttgctcttttcaccca

SEQ ID NO: 166187 - DNA, 16 bp, H. sapiens
ttgctgaaaatcaact

SEQ ID NO: 166188 - DNA, 16 bp, H. sapiens
ttgctgaaaatgtcaa

SEQ ID NO: 166189 - DNA, 16 bp, H. sapiens
ttgctgaaagcaaagg

SEQ ID NO: 166190 - DNA, 16 bp, H. sapiens
ttgctgaagacaggcc

SEQ ID NO: 166191 - DNA, 16 bp, H. sapiens
ttgctgaaggctggga

SEQ ID NO: 166192 - DNA, 16 bp, H. sapiens
ttgctgaaggttgggt

SEQ ID NO: 166193 - DNA, 16 bp, H. sapiens
ttgctgaagttgttta

SEQ ID NO: 166194 - DNA, 16 bp, H. sapiens
ttgctgaagttgtttg

SEQ ID NO: 166195 - DNA, 16 bp, H. sapiens
ttgctgaatgaataca

SEQ ID NO: 166196 - DNA, 16 bp, H. sapiens
ttgctgaatttttatt

SEQ ID NO: 166197 - DNA, 16 bp, H. sapiens
ttgctgagaaaagaat

SEQ ID NO: 166198 - DNA, 16 bp, H. sapiens
ttgctgagaaaattaa

SEQ ID NO: 166199 - DNA, 16 bp, H. sapiens
ttgctgagaaactcaa

SEQ ID NO: 166200 - DNA, 16 bp, H. sapiens
ttgctgagactttcca

SEQ ID NO: 166201 - DNA, 35 bp, H. sapiens
ttgctgagatgttgttaatttgtagctttgcccca

SEQ ID NO: 166202 - DNA, 16 bp, H. sapiens
ttgctgagcagtattc

SEQ ID NO: 166203 - DNA, 16 bp, H. sapiens
ttgctgagcatggtgg

SEQ ID NO: 166204 - DNA, 16 bp, H. sapiens
ttgctgagcccatgca

SEQ ID NO: 166205 - DNA, 16 bp, H. sapiens
ttgctgaggaaaatgg

SEQ ID NO: 166206 - DNA, 16 bp, H. sapiens
ttgctgaggatgacgg

SEQ ID NO: 166207 - DNA, 16 bp, H. sapiens
ttgctgaggatgatgg

SEQ ID NO: 166208 - DNA, 16 bp, H. sapiens
ttgctgaggatgatgt

SEQ ID NO: 166209 - DNA, 16 bp, H. sapiens
ttgctgagtgaataaa

SEQ ID NO: 166210 - DNA, 16 bp, H. sapiens
ttgctgatgatattat

SEQ ID NO: 166211 - DNA, 16 bp, H. sapiens
ttgctgatgggaatgc

SEQ ID NO: 166212 - DNA, 16 bp, H. sapiens
ttgctgatgggaatgt

SEQ ID NO: 166213 - DNA, 16 bp, H. sapiens
ttgctgcagcttctgc

SEQ ID NO: 166214 - DNA, 16 bp, H. sapiens
ttgctgcaggagcagg

SEQ ID NO: 166215 - DNA, 16 bp, H. sapiens
ttgctgcctgcttctt

SEQ ID NO: 166216 - DNA, 16 bp, H. sapiens
ttgctgctacagattg

SEQ ID NO: 166217 - DNA, 16 bp, H. sapiens
ttgctgctagcacagc

SEQ ID NO: 166218 - DNA, 25 bp, H. sapiens
ttgctgctataaagacacatgcaca

SEQ ID NO: 166219 - DNA, 16 bp, H. sapiens
ttgctgctgcaggctc

SEQ ID NO: 166220 - DNA, 16 bp, H. sapiens
ttgctgctgccatgta

SEQ ID NO: 166221 - DNA, 16 bp, H. sapiens
ttgctgctgccatgtg

SEQ ID NO: 166222 - DNA, 16 bp, H. sapiens
ttgctgctgctgcttc

SEQ ID NO: 166223 - DNA, 16 bp, H. sapiens
ttgctgctgctggctt

SEQ ID NO: 166224 - DNA, 16 bp, H. sapiens
ttgctgctgctgttgc

SEQ ID NO: 166225 - DNA, 16 bp, H. sapiens
ttgctgctgcttctct

SEQ ID NO: 166226 - DNA, 16 bp, H. sapiens
ttgctgctgcttctgc

SEQ ID NO: 166227 - DNA, 16 bp, H. sapiens
ttgctgctgtaataaa

SEQ ID NO: 166228 - DNA, 16 bp, H. sapiens
ttgctgctgttgctgc

SEQ ID NO: 166229 - DNA, 16 bp, H. sapiens
ttgctgctttgaaatt

SEQ ID NO: 166230 - DNA, 16 bp, H. sapiens
ttgctgcttttaagat

SEQ ID NO: 166231 - DNA, 16 bp, H. sapiens
ttgctggaaaggacat

SEQ ID NO: 166232 - DNA, 16 bp, H. sapiens
ttgctggaaccatcag

SEQ ID NO: 166233 - DNA, 16 bp, H. sapiens
ttgctggagaggcatt

SEQ ID NO: 166234 - DNA, 16 bp, H. sapiens
ttgctggagcccagga

SEQ ID NO: 166235 - DNA, 16 bp, H. sapiens
ttgctggatcaagtgg

SEQ ID NO: 166236 - DNA, 16 bp, H. sapiens
ttgctggatcatatga

SEQ ID NO: 166237 - DNA, 16 bp, H. sapiens
ttgctggatcatatgg

SEQ ID NO: 166238 - DNA, 16 bp, H. sapiens
ttgctggatctaatgg

SEQ ID NO: 166239 - DNA, 16 bp, H. sapiens
ttgctggattatgtgg

SEQ ID NO: 166240 - DNA, 16 bp, H. sapiens
ttgctggattctattt

SEQ ID NO: 166241 - DNA, 16 bp, H. sapiens
ttgctggattgaatgg

SEQ ID NO: 166242 - DNA, 16 bp, H. sapiens
ttgctggctctgaaga

SEQ ID NO: 166243 - DNA, 16 bp, H. sapiens
ttgctggctgcataaa

SEQ ID NO: 166244 - DNA, 16 bp, H. sapiens
ttgctggctttgaagg

SEQ ID NO: 166245 - DNA, 16 bp, H. sapiens
ttgctgggactacagg

SEQ ID NO: 166246 - DNA, 16 bp, H. sapiens
ttgctgggagaattaa

SEQ ID NO: 166247 - DNA, 16 bp, H. sapiens
ttgctgggattacagg

SEQ ID NO: 166248 - DNA, 16 bp, H. sapiens
ttgctgggattttaat

SEQ ID NO: 166249 - DNA, 16 bp, H. sapiens
ttgctgggccccaccc

SEQ ID NO: 166250 - DNA, 16 bp, H. sapiens
ttgctgggctctgtgg

SEQ ID NO: 166251 - DNA, 16 bp, H. sapiens
ttgctggggttacagg

SEQ ID NO: 166252 - DNA, 16 bp, H. sapiens
ttgctgggttatatgg

SEQ ID NO: 166253 - DNA, 16 bp, H. sapiens
ttgctggtgtgagcca

SEQ ID NO: 166254 - DNA, 16 bp, H. sapiens
ttgctggttttgaaga

SEQ ID NO: 166255 - DNA, 16 bp, H. sapiens
ttgctgtatcatccca

SEQ ID NO: 166256 - DNA, 16 bp, H. sapiens
ttgctgtatgaccttg

SEQ ID NO: 166257 - DNA, 16 bp, H. sapiens
ttgctgtgaacctaaa

SEQ ID NO: 166258 - DNA, 16 bp, H. sapiens
ttgctgtgaagatgaa

SEQ ID NO: 166259 - DNA, 16 bp, H. sapiens
ttgctgtgagaattaa

SEQ ID NO: 166260 - DNA, 16 bp, H. sapiens
ttgctgtgcagaagct

SEQ ID NO: 166261 - DNA, 16 bp, H. sapiens
ttgctgtggatgtcct

SEQ ID NO: 166262 - DNA, 16 bp, H. sapiens
ttgctgtgtaacaaac

SEQ ID NO: 166263 - DNA, 16 bp, H. sapiens
ttgctgtgtaaccttg

SEQ ID NO: 166264 - DNA, 16 bp, H. sapiens
ttgctgtgtcaaatgg

SEQ ID NO: 166265 - DNA, 16 bp, H. sapiens
ttgctgtgtcccagag

SEQ ID NO: 166266 - DNA, 16 bp, H. sapiens
ttgctgtgtgactttg

SEQ ID NO: 166267 - DNA, 16 bp, H. sapiens
ttgctgtgttgtccag

SEQ ID NO: 166268 - DNA, 16 bp, H. sapiens
ttgctgttaataaata

SEQ ID NO: 166269 - DNA, 16 bp, H. sapiens
ttgctgttgctgctgc

SEQ ID NO: 166270 - DNA, 16 bp, H. sapiens
ttgctgttttgatttg

SEQ ID NO: 166271 - DNA, 16 bp, H. sapiens
ttgctgttttttaaat

SEQ ID NO: 166272 - DNA, 16 bp, H. sapiens
ttgcttaaaataaaat

SEQ ID NO: 166273 - DNA, 16 bp, H. sapiens
ttgcttaaaataatgg

SEQ ID NO: 166274 - DNA, 16 bp, H. sapiens
ttgcttaaacctggaa

SEQ ID NO: 166275 - DNA, 16 bp, H. sapiens
ttgcttaacctctctg

SEQ ID NO: 166276 - DNA, 16 bp, H. sapiens
ttgcttaatccagtct

SEQ ID NO: 166277 - DNA, 16 bp, H. sapiens
ttgcttagaattgctt

SEQ ID NO: 166278 - DNA, 16 bp, H. sapiens
ttgcttaggagtgttt

SEQ ID NO: 166279 - DNA, 16 bp, H. sapiens
ttgcttaggctggtct

SEQ ID NO: 166280 - DNA, 16 bp, H. sapiens
ttgcttaggttgtctt

SEQ ID NO: 166281 - DNA, 16 bp, H. sapiens
ttgcttatctgggagg

SEQ ID NO: 166282 - DNA, 16 bp, H. sapiens
ttgcttatttccttct

SEQ ID NO: 166283 - DNA, 16 bp, H. sapiens
ttgcttcagaaggtgc

SEQ ID NO: 166284 - DNA, 16 bp, H. sapiens
ttgcttcatctgtaaa

SEQ ID NO: 166285 - DNA, 16 bp, H. sapiens
ttgcttcatgcatttt

SEQ ID NO: 166286 - DNA, 16 bp, H. sapiens
ttgcttccaaatattg

SEQ ID NO: 166287 - DNA, 16 bp, H. sapiens
ttgcttccaaatttta

SEQ ID NO: 166288 - DNA, 16 bp, H. sapiens
ttgcttccaagttttg

SEQ ID NO: 166289 - DNA, 16 bp, H. sapiens
ttgcttccaatttttg

SEQ ID NO: 166290 - DNA, 16 bp, H. sapiens
ttgcttccacattttc

SEQ ID NO: 166291 - DNA, 16 bp, H. sapiens
ttgcttccagtttggg

SEQ ID NO: 166292 - DNA, 16 bp, H. sapiens
ttgcttccattttcca

SEQ ID NO: 166293 - DNA, 16 bp, H. sapiens
ttgcttcccttcacct

SEQ ID NO: 166294 - DNA, 16 bp, H. sapiens
ttgcttcctcagaaga

SEQ ID NO: 166295 - DNA, 16 bp, H. sapiens
ttgcttcctgtacagc

SEQ ID NO: 166296 - DNA, 16 bp, H. sapiens
ttgcttctaatatcac

SEQ ID NO: 166297 - DNA, 16 bp, H. sapiens
ttgcttctatattcat

SEQ ID NO: 166298 - DNA, 16 bp, H. sapiens
ttgcttctcatggatg

SEQ ID NO: 166299 - DNA, 16 bp, H. sapiens
ttgcttctctagctct

SEQ ID NO: 166300 - DNA, 16 bp, H. sapiens
ttgcttctctctgtcc

SEQ ID NO: 166301 - DNA, 16 bp, H. sapiens
ttgcttctctgaaaag

SEQ ID NO: 166302 - DNA, 16 bp, H. sapiens
ttgcttctgccatttt

SEQ ID NO: 166303 - DNA, 16 bp, H. sapiens
ttgcttctgcttttgc

SEQ ID NO: 166304 - DNA, 16 bp, H. sapiens
ttgcttctgtttcagt

SEQ ID NO: 166305 - DNA, 16 bp, H. sapiens
ttgcttgaaaccggga

SEQ ID NO: 166306 - DNA, 16 bp, H. sapiens
ttgcttgaacccggag

SEQ ID NO: 166307 - DNA, 16 bp, H. sapiens
ttgcttgagaaaagca

SEQ ID NO: 166308 - DNA, 16 bp, H. sapiens
ttgcttgagaacagga

SEQ ID NO: 166309 - DNA, 16 bp, H. sapiens
ttgcttgagcctggaa

SEQ ID NO: 166310 - DNA, 16 bp, H. sapiens
ttgcttgaggccagag

SEQ ID NO: 166311 - DNA, 16 bp, H. sapiens
ttgcttgattttgtca

SEQ ID NO: 166312 - DNA, 16 bp, H. sapiens
ttgcttgcttgcttgt

SEQ ID NO: 166313 - DNA, 16 bp, H. sapiens
ttgcttgcttttgtca

SEQ ID NO: 166314 - DNA, 16 bp, H. sapiens
ttgcttgtacttttgg

SEQ ID NO: 166315 - DNA, 16 bp, H. sapiens
ttgcttgtgctcagga

SEQ ID NO: 166316 - DNA, 16 bp, H. sapiens
ttgcttgtgcttttga

SEQ ID NO: 166317 - DNA, 16 bp, H. sapiens
ttgctttaaaataatt

SEQ ID NO: 166318 - DNA, 16 bp, H. sapiens
ttgctttaaaatatat

SEQ ID NO: 166319 - DNA, 16 bp, H. sapiens
ttgctttaaaatgttt

SEQ ID NO: 166320 - DNA, 16 bp, H. sapiens
ttgctttaaaattttt

SEQ ID NO: 166321 - DNA, 16 bp, H. sapiens
ttgctttaaagtctgt

SEQ ID NO: 166322 - DNA, 16 bp, H. sapiens
ttgctttaagaaaaaa

SEQ ID NO: 166323 - DNA, 16 bp, H. sapiens
ttgctttaataaaaat

SEQ ID NO: 166324 - DNA, 16 bp, H. sapiens
ttgctttacataatcc

SEQ ID NO: 166325 - DNA, 16 bp, H. sapiens
ttgctttacttccaac

SEQ ID NO: 166326 - DNA, 16 bp, H. sapiens
ttgctttataaattat

SEQ ID NO: 166327 - DNA, 16 bp, H. sapiens
ttgctttataggagtt

SEQ ID NO: 166328 - DNA, 16 bp, H. sapiens
ttgctttattgtgatg

SEQ ID NO: 166329 - DNA, 16 bp, H. sapiens
ttgctttcaaagaaca

SEQ ID NO: 166330 - DNA, 16 bp, H. sapiens
ttgctttcaattcttt

SEQ ID NO: 166331 - DNA, 16 bp, H. sapiens
ttgctttcacatttta

SEQ ID NO: 166332 - DNA, 16 bp, H. sapiens
ttgctttcagtttact

SEQ ID NO: 166333 - DNA, 16 bp, H. sapiens
ttgctttcattttaaa

SEQ ID NO: 166334 - DNA, 16 bp, H. sapiens
ttgctttcattttcat

SEQ ID NO: 166335 - DNA, 16 bp, H. sapiens
ttgctttcattttcct

SEQ ID NO: 166336 - DNA, 16 bp, H. sapiens
ttgctttccactatga

SEQ ID NO: 166337 - DNA, 16 bp, H. sapiens
ttgctttcctagttct

SEQ ID NO: 166338 - DNA, 16 bp, H. sapiens
ttgctttctgatggtt

SEQ ID NO: 166339 - DNA, 16 bp, H. sapiens
ttgctttcttgatttc

SEQ ID NO: 166340 - DNA, 16 bp, H. sapiens
ttgctttgaatatttt

SEQ ID NO: 166341 - DNA, 18 bp, H. sapiens
ttgctttgctgagatgtt

SEQ ID NO: 166342 - DNA, 16 bp, H. sapiens
ttgctttgctttgctg

SEQ ID NO: 166343 - DNA, 16 bp, H. sapiens
ttgctttggatggtat

SEQ ID NO: 166344 - DNA, 16 bp, H. sapiens
ttgctttgggcagtgt

SEQ ID NO: 166345 - DNA, 16 bp, H. sapiens
ttgctttggggaaaaa

SEQ ID NO: 166346 - DNA, 16 bp, H. sapiens
ttgctttggttacctg

SEQ ID NO: 166347 - DNA, 16 bp, H. sapiens
ttgctttgtctatttg

SEQ ID NO: 166348 - DNA, 16 bp, H. sapiens
ttgctttgttacccag

SEQ ID NO: 166349 - DNA, 16 bp, H. sapiens
ttgctttgttttgaga

SEQ ID NO: 166350 - DNA, 16 bp, H. sapiens
ttgctttgtttttaag

SEQ ID NO: 166351 - DNA, 16 bp, H. sapiens
ttgcttttaaaaattt

SEQ ID NO: 166352 - DNA, 16 bp, H. sapiens
ttgcttttaaaatgtg

SEQ ID NO: 166353 - DNA, 16 bp, H. sapiens
ttgcttttaaaatttt

SEQ ID NO: 166354 - DNA, 16 bp, H. sapiens
ttgcttttaaattaaa

SEQ ID NO: 166355 - DNA, 16 bp, H. sapiens
ttgcttttaagaaaat

SEQ ID NO: 166356 - DNA, 16 bp, H. sapiens
ttgcttttaagatttt

SEQ ID NO: 166357 - DNA, 16 bp, H. sapiens
ttgcttttatacattt

SEQ ID NO: 166358 - DNA, 16 bp, H. sapiens
ttgcttttattacatt

SEQ ID NO: 166359 - DNA, 16 bp, H. sapiens
ttgcttttcacattta

SEQ ID NO: 166360 - DNA, 16 bp, H. sapiens
ttgcttttcatggttt

SEQ ID NO: 166361 - DNA, 16 bp, H. sapiens
ttgcttttctatgtct

SEQ ID NO: 166362 - DNA, 16 bp, H. sapiens
ttgcttttctccattc

SEQ ID NO: 166363 - DNA, 16 bp, H. sapiens
ttgcttttctctgatt

SEQ ID NO: 166364 - DNA, 16 bp, H. sapiens
ttgcttttcttaaaaa

SEQ ID NO: 166365 - DNA, 16 bp, H. sapiens
ttgcttttcttgtgat

SEQ ID NO: 166366 - DNA, 16 bp, H. sapiens
ttgcttttgatttgct

SEQ ID NO: 166367 - DNA, 16 bp, H. sapiens
ttgcttttgcaccttt

SEQ ID NO: 166368 - DNA, 16 bp, H. sapiens
ttgcttttggcatctt

SEQ ID NO: 166369 - DNA, 16 bp, H. sapiens
ttgcttttggtttcca

SEQ ID NO: 166370 - DNA, 16 bp, H. sapiens
ttgcttttgtaaataa

SEQ ID NO: 166371 - DNA, 16 bp, H. sapiens
ttgcttttgttgaatt

SEQ ID NO: 166372 - DNA, 16 bp, H. sapiens
ttgctttttaaaaaag

SEQ ID NO: 166373 - DNA, 16 bp, H. sapiens
ttgctttttaaaatgt

SEQ ID NO: 166374 - DNA, 16 bp, H. sapiens
ttgctttttaaaggaa

SEQ ID NO: 166375 - DNA, 16 bp, H. sapiens
ttgctttttaaagtaa

SEQ ID NO: 166376 - DNA, 16 bp, H. sapiens
ttgctttttaaatcag

SEQ ID NO: 166377 - DNA, 16 bp, H. sapiens
ttgctttttaaatgaa

SEQ ID NO: 166378 - DNA, 16 bp, H. sapiens
ttgctttttccagaat

SEQ ID NO: 166379 - DNA, 16 bp, H. sapiens
ttgctttttgtttcca

SEQ ID NO: 166380 - DNA, 16 bp, H. sapiens
ttgcttttttaccatt

SEQ ID NO: 166381 - DNA, 16 bp, H. sapiens
ttgctttttttaaaaa

SEQ ID NO: 166382 - DNA, 16 bp, H. sapiens
ttgctttttttgagac

SEQ ID NO: 166383 - DNA, 16 bp, H. sapiens
ttgctttttttgccca

SEQ ID NO: 166384 - DNA, 16 bp, H. sapiens
ttgctttttttgtcag

SEQ ID NO: 166385 - DNA, 16 bp, H. sapiens
ttggaaaaaaaatact

SEQ ID NO: 166386 - DNA, 16 bp, H. sapiens
ttggaaaaaaatgtat

SEQ ID NO: 166387 - DNA, 16 bp, H. sapiens
ttggaaaaaaatttta

SEQ ID NO: 166388 - DNA, 16 bp, H. sapiens
ttggaaaaaacaactt

SEQ ID NO: 166389 - DNA, 16 bp, H. sapiens
ttggaaaaactacttt

SEQ ID NO: 166390 - DNA, 16 bp, H. sapiens
ttggaaaaactgattt

SEQ ID NO: 166391 - DNA, 16 bp, H. sapiens
ttggaaaaagatgcca

SEQ ID NO: 166392 - DNA, 16 bp, H. sapiens
ttggaaaacaatattt

SEQ ID NO: 166393 - DNA, 16 bp, H. sapiens
ttggaaaacactgcag

SEQ ID NO: 166394 - DNA, 16 bp, H. sapiens
ttggaaaacagaaaaa

SEQ ID NO: 166395 - DNA, 16 bp, H. sapiens
ttggaaaacagtgtgg

SEQ ID NO: 166396 - DNA, 16 bp, H. sapiens
ttggaaaacatatttg

SEQ ID NO: 166397 - DNA, 16 bp, H. sapiens
ttggaaaacattttga

SEQ ID NO: 166398 - DNA, 16 bp, H. sapiens
ttggaaaactgaggca

SEQ ID NO: 166399 - DNA, 16 bp, H. sapiens
ttggaaaacttgcagc

SEQ ID NO: 166400 - DNA, 16 bp, H. sapiens
ttggaaaagaacaaaa

SEQ ID NO: 166401 - DNA, 16 bp, H. sapiens
ttggaaaagaagaaat

SEQ ID NO: 166402 - DNA, 16 bp, H. sapiens
ttggaaaagaatttat

SEQ ID NO: 166403 - DNA, 16 bp, H. sapiens
ttggaaaagagaaagt

SEQ ID NO: 166404 - DNA, 16 bp, H. sapiens
ttggaaaagttttaaa

SEQ ID NO: 166405 - DNA, 16 bp, H. sapiens
ttggaaaataaatatg

SEQ ID NO: 166406 - DNA, 16 bp, H. sapiens
ttggaaaatacaggaa

SEQ ID NO: 166407 - DNA, 16 bp, H. sapiens
ttggaaaatacagtct

SEQ ID NO: 166408 - DNA, 16 bp, H. sapiens
ttggaaaatagtttga

SEQ ID NO: 166409 - DNA, 16 bp, H. sapiens
ttggaaaatcagaaaa

SEQ ID NO: 166410 - DNA, 16 bp, H. sapiens
ttggaaaatgcctttt

SEQ ID NO: 166411 - DNA, 16 bp, H. sapiens
ttggaaaatggaaaaa

SEQ ID NO: 166412 - DNA, 16 bp, H. sapiens
ttggaaaatgtgaaaa

SEQ ID NO: 166413 - DNA, 16 bp, H. sapiens
ttggaaaatgtgcagc

SEQ ID NO: 166414 - DNA, 16 bp, H. sapiens
ttggaaaatttaatat

SEQ ID NO: 166415 - DNA, 16 bp, H. sapiens
ttggaaacactatttt

SEQ ID NO: 166416 - DNA, 16 bp, H. sapiens
ttggaaacatttcaaa

SEQ ID NO: 166417 - DNA, 16 bp, H. sapiens
ttggaaacctccacct

SEQ ID NO: 166418 - DNA, 16 bp, H. sapiens
ttggaaactatgcaaa

SEQ ID NO: 166419 - DNA, 16 bp, H. sapiens
ttggaaagaaaatgaa

SEQ ID NO: 166420 - DNA, 16 bp, H. sapiens
ttggaaagaatgaaaa

SEQ ID NO: 166421 - DNA, 16 bp, H. sapiens
ttggaaagcagtttgg

SEQ ID NO: 166422 - DNA, 16 bp, H. sapiens
ttggaaagcattttca

SEQ ID NO: 166423 - DNA, 16 bp, H. sapiens
ttggaaagctaaggca

SEQ ID NO: 166424 - DNA, 16 bp, H. sapiens
ttggaaaggaaaagag

SEQ ID NO: 166425 - DNA, 16 bp, H. sapiens
ttggaaaggagaaaat

SEQ ID NO: 166426 - DNA, 16 bp, H. sapiens
ttggaaataaatttaa

SEQ ID NO: 166427 - DNA, 16 bp, H. sapiens
ttggaaataaggaaaa

SEQ ID NO: 166428 - DNA, 16 bp, H. sapiens
ttggaaatactttttt

SEQ ID NO: 166429 - DNA, 16 bp, H. sapiens
ttggaaatagggtctt

SEQ ID NO: 166430 - DNA, 16 bp, H. sapiens
ttggaaatattttctc

SEQ ID NO: 166431 - DNA, 16 bp, H. sapiens
ttggaaatatttttaa

SEQ ID NO: 166432 - DNA, 16 bp, H. sapiens
ttggaaatcctagcca

SEQ ID NO: 166433 - DNA, 16 bp, H. sapiens
ttggaaatgaagaaat

SEQ ID NO: 166434 - DNA, 16 bp, H. sapiens
ttggaaatgcaggaat

SEQ ID NO: 166435 - DNA, 16 bp, H. sapiens
ttggaaatggaaaaaa

SEQ ID NO: 166436 - DNA, 16 bp, H. sapiens
ttggaaatggagaaat

SEQ ID NO: 166437 - DNA, 16 bp, H. sapiens
ttggaaatggattctt

SEQ ID NO: 166438 - DNA, 16 bp, H. sapiens
ttggaaatgttctaaa

SEQ ID NO: 166439 - DNA, 16 bp, H. sapiens
ttggaaattatttaaa

SEQ ID NO: 166440 - DNA, 16 bp, H. sapiens
ttggaacacagccaca

SEQ ID NO: 166441 - DNA, 16 bp, H. sapiens
ttggaacagaacagag

SEQ ID NO: 166442 - DNA, 16 bp, H. sapiens
ttggaaccaaaaaaga

SEQ ID NO: 166443 - DNA, 16 bp, H. sapiens
ttggaacccagccacc

SEQ ID NO: 166444 - DNA, 16 bp, H. sapiens
ttggaactcagtgctg

SEQ ID NO: 166445 - DNA, 16 bp, H. sapiens
ttggaactgggtaaca

SEQ ID NO: 166446 - DNA, 16 bp, H. sapiens
ttggaagaaataatat

SEQ ID NO: 166447 - DNA, 16 bp, H. sapiens
ttggaagaaatagaaa

SEQ ID NO: 166448 - DNA, 16 bp, H. sapiens
ttggaagaatttatat

SEQ ID NO: 166449 - DNA, 16 bp, H. sapiens
ttggaagaccaaggca

SEQ ID NO: 166450 - DNA, 18 bp, H. sapiens
ttggaagagcgcagtatt

SEQ ID NO: 166451 - DNA, 16 bp, H. sapiens
ttggaagagtttcaga

SEQ ID NO: 166452 - DNA, 16 bp, H. sapiens
ttggaagagtttggga

SEQ ID NO: 166453 - DNA, 16 bp, H. sapiens
ttggaagcagacagca

SEQ ID NO: 166454 - DNA, 16 bp, H. sapiens
ttggaagccaaggcag

SEQ ID NO: 166455 - DNA, 16 bp, H. sapiens
ttggaagcccattgag

SEQ ID NO: 166456 - DNA, 16 bp, H. sapiens
ttggaaggaaggaaaa

SEQ ID NO: 166457 - DNA, 16 bp, H. sapiens
ttggaagggacaaaca

SEQ ID NO: 166458 - DNA, 16 bp, H. sapiens
ttggaaggtttttgat

SEQ ID NO: 166459 - DNA, 16 bp, H. sapiens
ttggaagtaaaacact

SEQ ID NO: 166460 - DNA, 16 bp, H. sapiens
ttggaagtatttcctt

SEQ ID NO: 166461 - DNA, 16 bp, H. sapiens
ttggaagtattttctt

SEQ ID NO: 166462 - DNA, 16 bp, H. sapiens
ttggaagtcctagcca

SEQ ID NO: 166463 - DNA, 16 bp, H. sapiens
ttggaagtgaagcact

SEQ ID NO: 166464 - DNA, 16 bp, H. sapiens
ttggaagtggcccacc

SEQ ID NO: 166465 - DNA, 17 bp, H. sapiens
ttggaagttctggccac

SEQ ID NO: 166466 - DNA, 19 bp, H. sapiens
ttggaagttctggccagga

SEQ ID NO: 166467 - DNA, 21 bp, H. sapiens
ttggaagttctggccagggaa

SEQ ID NO: 166468 - DNA, 36 bp, H. sapiens
ttggaagttctggccagggcaatcaggcaggagaaa

SEQ ID NO: 166469 - DNA, 23 bp, H. sapiens
ttggaagttctggccagggtaat

SEQ ID NO: 166470 - DNA, 16 bp, H. sapiens
ttggaataataatttt

SEQ ID NO: 166471 - DNA, 16 bp, H. sapiens
ttggaataatttcaga

SEQ ID NO: 166472 - DNA, 18 bp, H. sapiens
ttggaatagtttcagaag

SEQ ID NO: 166473 - DNA, 16 bp, H. sapiens
ttggaatcatacagta

SEQ ID NO: 166474 - DNA, 16 bp, H. sapiens
ttggaatgcaatggcg

SEQ ID NO: 166475 - DNA, 16 bp, H. sapiens
ttggaatggaaacatt

SEQ ID NO: 166476 - DNA, 16 bp, H. sapiens
ttggaatggacatttg

SEQ ID NO: 166477 - DNA, 16 bp, H. sapiens
ttggaatggctaaaat

SEQ ID NO: 166478 - DNA, 16 bp, H. sapiens
ttggaattatcagact

SEQ ID NO: 166479 - DNA, 16 bp, H. sapiens
ttggaattcttctgta

SEQ ID NO: 166480 - DNA, 16 bp, H. sapiens
ttggaatttaaatgat

SEQ ID NO: 166481 - DNA, 16 bp, H. sapiens
ttggaattttagaaaa

SEQ ID NO: 166482 - DNA, 16 bp, H. sapiens
ttggaattttcagact

SEQ ID NO: 166483 - DNA, 16 bp, H. sapiens
ttggaattttgataaa

SEQ ID NO: 166484 - DNA, 16 bp, H. sapiens
ttggacaaaaaggcta

SEQ ID NO: 166485 - DNA, 16 bp, H. sapiens
ttggacaaatttataa

SEQ ID NO: 166486 - DNA, 16 bp, H. sapiens
ttggacaatattgcat

SEQ ID NO: 166487 - DNA, 16 bp, H. sapiens
ttggacacagaaaggg

SEQ ID NO: 166488 - DNA, 16 bp, H. sapiens
ttggacagcacaggtc

SEQ ID NO: 166489 - DNA, 16 bp, H. sapiens
ttggacaggatggtct

SEQ ID NO: 166490 - DNA, 16 bp, H. sapiens
ttggacaggctggtct

SEQ ID NO: 166491 - DNA, 16 bp, H. sapiens
ttggaccaaggaaaat

SEQ ID NO: 166492 - DNA, 16 bp, H. sapiens
ttggaccaggtgtgcc

SEQ ID NO: 166493 - DNA, 16 bp, H. sapiens
ttggaccatgaatttt

SEQ ID NO: 166494 - DNA, 16 bp, H. sapiens
ttggacccaggaggtg

SEQ ID NO: 166495 - DNA, 16 bp, H. sapiens
ttggactcttggacct

SEQ ID NO: 166496 - DNA, 16 bp, H. sapiens
ttggactcttttttgg

SEQ ID NO: 166497 - DNA, 17 bp, H. sapiens
ttggactgtatagaggt

SEQ ID NO: 166498 - DNA, 16 bp, H. sapiens
ttggacttccagcctc

SEQ ID NO: 166499 - DNA, 16 bp, H. sapiens
ttggacttcccaacct

SEQ ID NO: 166500 - DNA, 16 bp, H. sapiens
ttggacttctagactc

SEQ ID NO: 166501 - DNA, 16 bp, H. sapiens
ttggacttgcctttgt

SEQ ID NO: 166502 - DNA, 16 bp, H. sapiens
ttggacttggccatgt

SEQ ID NO: 166503 - DNA, 16 bp, H. sapiens
ttggactttggggact

SEQ ID NO: 166504 - DNA, 16 bp, H. sapiens
ttggacttttgagttg

SEQ ID NO: 166505 - DNA, 16 bp, H. sapiens
ttggagaaaaaagaat

SEQ ID NO: 166506 - DNA, 16 bp, H. sapiens
ttggagaaaaggcata

SEQ ID NO: 166507 - DNA, 16 bp, H. sapiens
ttggagaaaagtctat

SEQ ID NO: 166508 - DNA, 16 bp, H. sapiens
ttggagaaatatttaa

SEQ ID NO: 166509 - DNA, 16 bp, H. sapiens
ttggagaaatgcctat

SEQ ID NO: 166510 - DNA, 16 bp, H. sapiens
ttggagaaatggttga

SEQ ID NO: 166511 - DNA, 16 bp, H. sapiens
ttggagaacattatgc

SEQ ID NO: 166512 - DNA, 16 bp, H. sapiens
ttggagaacctgtgtg

SEQ ID NO: 166513 - DNA, 16 bp, H. sapiens
ttggagaactcacact

SEQ ID NO: 166514 - DNA, 16 bp, H. sapiens
ttggagaagagaataa

SEQ ID NO: 166515 - DNA, 16 bp, H. sapiens
ttggagaagaggcatt

SEQ ID NO: 166516 - DNA, 16 bp, H. sapiens
ttggagaagatgtgga

SEQ ID NO: 166517 - DNA, 16 bp, H. sapiens
ttggagaaggagaggc

SEQ ID NO: 166518 - DNA, 16 bp, H. sapiens
ttggagaatgtttcat

SEQ ID NO: 166519 - DNA, 16 bp, H. sapiens
ttggagacaagcctgg

SEQ ID NO: 166520 - DNA, 16 bp, H. sapiens
ttggagacagggtctt

SEQ ID NO: 166521 - DNA, 16 bp, H. sapiens
ttggagaccagcatgg

SEQ ID NO: 166522 - DNA, 16 bp, H. sapiens
ttggagaccagcctga

SEQ ID NO: 166523 - DNA, 16 bp, H. sapiens
ttggagaccagcctgg

SEQ ID NO: 166524 - DNA, 16 bp, H. sapiens
ttggagaccagctggg

SEQ ID NO: 166525 - DNA, 16 bp, H. sapiens
ttggagacctacaaag

SEQ ID NO: 166526 - DNA, 16 bp, H. sapiens
ttggagacggagtctt

SEQ ID NO: 166527 - DNA, 16 bp, H. sapiens
ttggagagcagcctga

SEQ ID NO: 166528 - DNA, 16 bp, H. sapiens
ttggagatgccaggaa

SEQ ID NO: 166529 - DNA, 16 bp, H. sapiens
ttggagcaaatcaatt

SEQ ID NO: 166530 - DNA, 16 bp, H. sapiens
ttggagcattttggat

SEQ ID NO: 166531 - DNA, 16 bp, H. sapiens
ttggagcctgaggcag

SEQ ID NO: 166532 - DNA, 16 bp, H. sapiens
ttggagctcccacaca

SEQ ID NO: 166533 - DNA, 16 bp, H. sapiens
ttggagctgaagaatt

SEQ ID NO: 166534 - DNA, 16 bp, H. sapiens
ttggagctgtgagaag

SEQ ID NO: 166535 - DNA, 16 bp, H. sapiens
ttggaggaaaaacaaa

SEQ ID NO: 166536 - DNA, 16 bp, H. sapiens
ttggaggaaaaataat

SEQ ID NO: 166537 - DNA, 16 bp, H. sapiens
ttggaggaaacaaaca

SEQ ID NO: 166538 - DNA, 16 bp, H. sapiens
ttggaggaactacaga

SEQ ID NO: 166539 - DNA, 16 bp, H. sapiens
ttggaggacacccagc

SEQ ID NO: 166540 - DNA, 16 bp, H. sapiens
ttggaggagaagaagc

SEQ ID NO: 166541 - DNA, 16 bp, H. sapiens
ttggaggaggaaaaaa

SEQ ID NO: 166542 - DNA, 16 bp, H. sapiens
ttggaggaggagagac

SEQ ID NO: 166543 - DNA, 16 bp, H. sapiens
ttggaggaggggcctg

SEQ ID NO: 166544 - DNA, 16 bp, H. sapiens
ttggaggattacttga

SEQ ID NO: 166545 - DNA, 16 bp, H. sapiens
ttggaggattgtttga

SEQ ID NO: 166546 - DNA, 16 bp, H. sapiens
ttggaggccaaggaag

SEQ ID NO: 166547 - DNA, 16 bp, H. sapiens
ttggaggccaaggagg

SEQ ID NO: 166548 - DNA, 16 bp, H. sapiens
ttggaggccaggagtt

SEQ ID NO: 166549 - DNA, 16 bp, H. sapiens
ttggaggccattatct

SEQ ID NO: 166550 - DNA, 16 bp, H. sapiens
ttggaggctgaggcgg

SEQ ID NO: 166551 - DNA, 16 bp, H. sapiens
ttggaggcttcagtga

SEQ ID NO: 166552 - DNA, 16 bp, H. sapiens
ttggaggctttcttca

SEQ ID NO: 166553 - DNA, 16 bp, H. sapiens
ttggagggaaaaaaat

SEQ ID NO: 166554 - DNA, 16 bp, H. sapiens
ttggaggggacaaaac

SEQ ID NO: 166555 - DNA, 16 bp, H. sapiens
ttggaggggccagggg

SEQ ID NO: 166556 - DNA, 16 bp, H. sapiens
ttggaggtcagaagca

SEQ ID NO: 166557 - DNA, 16 bp, H. sapiens
ttggaggtggggtctg

SEQ ID NO: 166558 - DNA, 16 bp, H. sapiens
ttggaggtggtgggaa

SEQ ID NO: 166559 - DNA, 16 bp, H. sapiens
ttggaggttaggactt

SEQ ID NO: 166560 - DNA, 16 bp, H. sapiens
ttggaggttagggctt

SEQ ID NO: 166561 - DNA, 16 bp, H. sapiens
ttggaggttttgctca

SEQ ID NO: 166562 - DNA, 16 bp, H. sapiens
ttggagtcctcagtgt

SEQ ID NO: 166563 - DNA, 16 bp, H. sapiens
ttggagtcttgctgtg

SEQ ID NO: 166564 - DNA, 16 bp, H. sapiens
ttggagtgatgcagcc

SEQ ID NO: 166565 - DNA, 16 bp, H. sapiens
ttggagtgcaatgaca

SEQ ID NO: 166566 - DNA, 16 bp, H. sapiens
ttggagtgcaatggtg

SEQ ID NO: 166567 - DNA, 16 bp, H. sapiens
ttggagtgcagaggca

SEQ ID NO: 166568 - DNA, 16 bp, H. sapiens
ttggagtgcaggggca

SEQ ID NO: 166569 - DNA, 17 bp, H. sapiens
ttggagtgcagtggcat

SEQ ID NO: 166570 - DNA, 18 bp, H. sapiens
ttggagtgcagtggcgcg

SEQ ID NO: 166571 - DNA, 16 bp, H. sapiens
ttggagtgcagtggtg

SEQ ID NO: 166572 - DNA, 16 bp, H. sapiens
ttggagtttcaccatg

SEQ ID NO: 166573 - DNA, 16 bp, H. sapiens
ttggagttttaaaatt

SEQ ID NO: 166574 - DNA, 16 bp, H. sapiens
ttggataaagaaaaag

SEQ ID NO: 166575 - DNA, 16 bp, H. sapiens
ttggataaagacaatg

SEQ ID NO: 166576 - DNA, 16 bp, H. sapiens
ttggataaatacctag

SEQ ID NO: 166577 - DNA, 16 bp, H. sapiens
ttggataatttttcct

SEQ ID NO: 166578 - DNA, 16 bp, H. sapiens
ttggatacaagacaag

SEQ ID NO: 166579 - DNA, 16 bp, H. sapiens
ttggataccagctcag

SEQ ID NO: 166580 - DNA, 16 bp, H. sapiens
ttggatatattgggtt

SEQ ID NO: 166581 - DNA, 16 bp, H. sapiens
ttggatatgacctcaa

SEQ ID NO: 166582 - DNA, 16 bp, H. sapiens
ttggatatttagctga

SEQ ID NO: 166583 - DNA, 16 bp, H. sapiens
ttggatatttgtcctc

SEQ ID NO: 166584 - DNA, 16 bp, H. sapiens
ttggatattttctatt

SEQ ID NO: 166585 - DNA, 16 bp, H. sapiens
ttggatattttgaata

SEQ ID NO: 166586 - DNA, 16 bp, H. sapiens
ttggatcaagagtcaa

SEQ ID NO: 166587 - DNA, 18 bp, H. sapiens
ttggatcaggctgaattt

SEQ ID NO: 166588 - DNA, 16 bp, H. sapiens
ttggatccattgttgg

SEQ ID NO: 166589 - DNA, 16 bp, H. sapiens
ttggatcctgaaacag

SEQ ID NO: 166590 - DNA, 16 bp, H. sapiens
ttggatctcctctctt

SEQ ID NO: 166591 - DNA, 16 bp, H. sapiens
ttggatctgctgggtc

SEQ ID NO: 166592 - DNA, 17 bp, H. sapiens
ttggatctgtgtccctg

SEQ ID NO: 166593 - DNA, 16 bp, H. sapiens
ttggatctttcctgct

SEQ ID NO: 166594 - DNA, 16 bp, H. sapiens
ttggatgagatgaaca

SEQ ID NO: 166595 - DNA, 16 bp, H. sapiens
ttggattaaaatattt

SEQ ID NO: 166596 - DNA, 16 bp, H. sapiens
ttggattaaagactta

SEQ ID NO: 166597 - DNA, 16 bp, H. sapiens
ttggattatttccact

SEQ ID NO: 166598 - DNA, 16 bp, H. sapiens
ttggattggatcctgg

SEQ ID NO: 166599 - DNA, 16 bp, H. sapiens
ttggattggctttgat

SEQ ID NO: 166600 - DNA, 16 bp, H. sapiens
ttggattgggaagaag

SEQ ID NO: 166601 - DNA, 16 bp, H. sapiens
ttggattggggcccac

SEQ ID NO: 166602 - DNA, 16 bp, H. sapiens
ttggatttcataaaaa

SEQ ID NO: 166603 - DNA, 16 bp, H. sapiens
ttggatttctctaatg

SEQ ID NO: 166604 - DNA, 16 bp, H. sapiens
ttggatttctctgatg

SEQ ID NO: 166605 - DNA, 16 bp, H. sapiens
ttggatttggggccca

SEQ ID NO: 166606 - DNA, 16 bp, H. sapiens
ttggattttacatttt

SEQ ID NO: 166607 - DNA, 16 bp, H. sapiens
ttggattttatcctgt

SEQ ID NO: 166608 - DNA, 16 bp, H. sapiens
ttggattttcaaatta

SEQ ID NO: 166609 - DNA, 16 bp, H. sapiens
ttggattttggtatct

SEQ ID NO: 166610 - DNA, 16 bp, H. sapiens
ttggatttttctagtt

SEQ ID NO: 166611 - DNA, 16 bp, H. sapiens
ttggattttttttcaa

SEQ ID NO: 166612 - DNA, 16 bp, H. sapiens
ttggcaaaataaactt

SEQ ID NO: 166613 - DNA, 16 bp, H. sapiens
ttggcaaaattcaaca

SEQ ID NO: 166614 - DNA, 21 bp, H. sapiens
ttggcaaacccatttagctga

SEQ ID NO: 166615 - DNA, 16 bp, H. sapiens
ttggcaaactgtggcc

SEQ ID NO: 166616 - DNA, 16 bp, H. sapiens
ttggcaaaggacttga

SEQ ID NO: 166617 - DNA, 16 bp, H. sapiens
ttggcaaatattttct

SEQ ID NO: 166618 - DNA, 16 bp, H. sapiens
ttggcaaatgaaaaat

SEQ ID NO: 166619 - DNA, 17 bp, H. sapiens
ttggcaacagagcgaga

SEQ ID NO: 166620 - DNA, 16 bp, H. sapiens
ttggcaacatggcaaa

SEQ ID NO: 166621 - DNA, 16 bp, H. sapiens
ttggcaagaaaaagaa

SEQ ID NO: 166622 - DNA, 16 bp, H. sapiens
ttggcaaggctgcaga

SEQ ID NO: 166623 - DNA, 16 bp, H. sapiens
ttggcaaggctggtct

SEQ ID NO: 166624 - DNA, 16 bp, H. sapiens
ttggcaataaaaagaa

SEQ ID NO: 166625 - DNA, 16 bp, H. sapiens
ttggcaatacttgttg

SEQ ID NO: 166626 - DNA, 16 bp, H. sapiens
ttggcaatattttttt

SEQ ID NO: 166627 - DNA, 16 bp, H. sapiens
ttggcaatgttttctt

SEQ ID NO: 166628 - DNA, 16 bp, H. sapiens
ttggcaattatgaaca

SEQ ID NO: 166629 - DNA, 16 bp, H. sapiens
ttggcaatttttaaat

SEQ ID NO: 166630 - DNA, 16 bp, H. sapiens
ttggcaatttttttat

SEQ ID NO: 166631 - DNA, 16 bp, H. sapiens
ttggcaccagggacag

SEQ ID NO: 166632 - DNA, 16 bp, H. sapiens
ttggcacgtgcctgta

SEQ ID NO: 166633 - DNA, 16 bp, H. sapiens
ttggcacttttgttga

SEQ ID NO: 166634 - DNA, 16 bp, H. sapiens
ttggcagaatctttag

SEQ ID NO: 166635 - DNA, 16 bp, H. sapiens
ttggcagaatttattt

SEQ ID NO: 166636 - DNA, 16 bp, H. sapiens
ttggcagattctacaa

SEQ ID NO: 166637 - DNA, 16 bp, H. sapiens
ttggcaggaaaaaaaa

SEQ ID NO: 166638 - DNA, 16 bp, H. sapiens
ttggcagggcacagtg

SEQ ID NO: 166639 - DNA, 16 bp, H. sapiens
ttggcaggtttgtcaa

SEQ ID NO: 166640 - DNA, 16 bp, H. sapiens
ttggcataagaataga

SEQ ID NO: 166641 - DNA, 16 bp, H. sapiens
ttggcatctatgttca

SEQ ID NO: 166642 - DNA, 16 bp, H. sapiens
ttggcatcttcctcat

SEQ ID NO: 166643 - DNA, 16 bp, H. sapiens
ttggcatgagccactg

SEQ ID NO: 166644 - DNA, 16 bp, H. sapiens
ttggcattccttgact

SEQ ID NO: 166645 - DNA, 16 bp, H. sapiens
ttggcattgaagagtt

SEQ ID NO: 166646 - DNA, 16 bp, H. sapiens
ttggcattttcatcat

SEQ ID NO: 166647 - DNA, 16 bp, H. sapiens
ttggcatttttaaaaa

SEQ ID NO: 166648 - DNA, 16 bp, H. sapiens
ttggcatttttaaaat

SEQ ID NO: 166649 - DNA, 16 bp, H. sapiens
ttggccaaaacaagtc

SEQ ID NO: 166650 - DNA, 16 bp, H. sapiens
ttggccaaatgaatga

SEQ ID NO: 166651 - DNA, 22 bp, H. sapiens
ttggccaacatggtgaaaccct

SEQ ID NO: 166652 - DNA, 16 bp, H. sapiens
ttggccaagctgctct

SEQ ID NO: 166653 - DNA, 16 bp, H. sapiens
ttggccaagctggtct

SEQ ID NO: 166654 - DNA, 16 bp, H. sapiens
ttggccaaggagaccc

SEQ ID NO: 166655 - DNA, 16 bp, H. sapiens
ttggccacagactgaa

SEQ ID NO: 166656 - DNA, 16 bp, H. sapiens
ttggccagaatggtct

SEQ ID NO: 166657 - DNA, 16 bp, H. sapiens
ttggccagactggtct

SEQ ID NO: 166658 - DNA, 16 bp, H. sapiens
ttggccagagtggtct

SEQ ID NO: 166659 - DNA, 16 bp, H. sapiens
ttggccagcctggcct

SEQ ID NO: 166660 - DNA, 16 bp, H. sapiens
ttggccagcctggtct

SEQ ID NO: 166661 - DNA, 16 bp, H. sapiens
ttggccaggatagtct

SEQ ID NO: 166662 - DNA, 16 bp, H. sapiens
ttggccaggatgatct

SEQ ID NO: 166663 - DNA, 16 bp, H. sapiens
ttggccaggatggtct

SEQ ID NO: 166664 - DNA, 16 bp, H. sapiens
ttggccaggattgtct

SEQ ID NO: 166665 - DNA, 16 bp, H. sapiens
ttggccaggcactgtg

SEQ ID NO: 166666 - DNA, 16 bp, H. sapiens
ttggccaggcaggtct

SEQ ID NO: 166667 - DNA, 16 bp, H. sapiens
ttggccaggcatggta

SEQ ID NO: 166668 - DNA, 16 bp, H. sapiens
ttggccaggccggtct

SEQ ID NO: 166669 - DNA, 23 bp, H. sapiens
ttggccaggcgcggtggctcacg

SEQ ID NO: 166670 - DNA, 16 bp, H. sapiens
ttggccaggctactct

SEQ ID NO: 166671 - DNA, 16 bp, H. sapiens
ttggccaggctagtct

SEQ ID NO: 166672 - DNA, 16 bp, H. sapiens
ttggccaggctagttt

SEQ ID NO: 166673 - DNA, 16 bp, H. sapiens
ttggccaggctcgtct

SEQ ID NO: 166674 - DNA, 16 bp, H. sapiens
ttggccaggctgatct

SEQ ID NO: 166675 - DNA, 16 bp, H. sapiens
ttggccaggctgattt

SEQ ID NO: 166676 - DNA, 16 bp, H. sapiens
ttggccaggctgctct

SEQ ID NO: 166677 - DNA, 16 bp, H. sapiens
ttggccaggctggcct

SEQ ID NO: 166678 - DNA, 16 bp, H. sapiens
ttggccaggctggtat

SEQ ID NO: 166679 - DNA, 16 bp, H. sapiens
ttggccaggctggtca

SEQ ID NO: 166680 - DNA, 16 bp, H. sapiens
ttggccaggctggtcc

SEQ ID NO: 166681 - DNA, 16 bp, H. sapiens
ttggccaggctggtcg

SEQ ID NO: 166682 - DNA, 16 bp, H. sapiens
ttggccaggctggtct

SEQ ID NO: 166683 - DNA, 16 bp, H. sapiens
ttggccaggctggtgt

SEQ ID NO: 166684 - DNA, 16 bp, H. sapiens
ttggccaggctggttg

SEQ ID NO: 166685 - DNA, 16 bp, H. sapiens
ttggccaggctggttt

SEQ ID NO: 166686 - DNA, 18 bp, H. sapiens
ttggccaggctggtttca

SEQ ID NO: 166687 - DNA, 16 bp, H. sapiens
ttggccaggctgttct

SEQ ID NO: 166688 - DNA, 16 bp, H. sapiens
ttggccaggcttgtct

SEQ ID NO: 166689 - DNA, 16 bp, H. sapiens
ttggccaggcttttct

SEQ ID NO: 166690 - DNA, 16 bp, H. sapiens
ttggccagggtggtct

SEQ ID NO: 166691 - DNA, 17 bp, H. sapiens
ttggccaggtgcggtgg

SEQ ID NO: 166692 - DNA, 16 bp, H. sapiens
ttggccaggtgtggtg

SEQ ID NO: 166693 - DNA, 16 bp, H. sapiens
ttggccaggttgatct

SEQ ID NO: 166694 - DNA, 16 bp, H. sapiens
ttggccaggttggtct

SEQ ID NO: 166695 - DNA, 16 bp, H. sapiens
ttggccagtctggcct

SEQ ID NO: 166696 - DNA, 16 bp, H. sapiens
ttggccagtctggtct

SEQ ID NO: 166697 - DNA, 16 bp, H. sapiens
ttggccataaaaagaa

SEQ ID NO: 166698 - DNA, 16 bp, H. sapiens
ttggccatgctggtct

SEQ ID NO: 166699 - DNA, 16 bp, H. sapiens
ttggccatttctatgt

SEQ ID NO: 166700 - DNA, 16 bp, H. sapiens
ttggccatttgtgtat

SEQ ID NO: 166701 - DNA, 16 bp, H. sapiens
ttggcccaaagtgctg

SEQ ID NO: 166702 - DNA, 16 bp, H. sapiens
ttggcccacaggctgt

SEQ ID NO: 166703 - DNA, 19 bp, H. sapiens
ttggcccaggaactgctaa

SEQ ID NO: 166704 - DNA, 16 bp, H. sapiens
ttggcccaggagtttg

SEQ ID NO: 166705 - DNA, 16 bp, H. sapiens
ttggccctccagaaag

SEQ ID NO: 166706 - DNA, 16 bp, H. sapiens
ttggccgggatggtct

SEQ ID NO: 166707 - DNA, 16 bp, H. sapiens
ttggccgggcacagtg

SEQ ID NO: 166708 - DNA, 16 bp, H. sapiens
ttggccgggcgcagtg

SEQ ID NO: 166709 - DNA, 16 bp, H. sapiens
ttggccgggctggcct

SEQ ID NO: 166710 - DNA, 16 bp, H. sapiens
ttggccgggctggtct

SEQ ID NO: 166711 - DNA, 16 bp, H. sapiens
ttggccgggctggttt

SEQ ID NO: 166712 - DNA, 16 bp, H. sapiens
ttggcctcacaaagtg

SEQ ID NO: 166713 - DNA, 16 bp, H. sapiens
ttggcctcccaaagta

SEQ ID NO: 166714 - DNA, 16 bp, H. sapiens
ttggcctcccagagtg

SEQ ID NO: 166715 - DNA, 16 bp, H. sapiens
ttggcctcctaaagtg

SEQ ID NO: 166716 - DNA, 16 bp, H. sapiens
ttggcctcctaaagtt

SEQ ID NO: 166717 - DNA, 16 bp, H. sapiens
ttggcctctctagcta

SEQ ID NO: 166718 - DNA, 16 bp, H. sapiens
ttggcctggctgatct

SEQ ID NO: 166719 - DNA, 16 bp, H. sapiens
ttggcctggctggtct

SEQ ID NO: 166720 - DNA, 16 bp, H. sapiens
ttggcctgtgcccagg

SEQ ID NO: 166721 - DNA, 16 bp, H. sapiens
ttggccttccaaactg

SEQ ID NO: 166722 - DNA, 16 bp, H. sapiens
ttggccttccaaagtg

SEQ ID NO: 166723 - DNA, 16 bp, H. sapiens
ttggccttcccaagtg

SEQ ID NO: 166724 - DNA, 16 bp, H. sapiens
ttggccttgtcaaaga

SEQ ID NO: 166725 - DNA, 16 bp, H. sapiens
ttggcctttgatgatg

SEQ ID NO: 166726 - DNA, 16 bp, H. sapiens
ttggccttttggctaa

SEQ ID NO: 166727 - DNA, 17 bp, H. sapiens
ttggcgacagagcaaga

SEQ ID NO: 166728 - DNA, 16 bp, H. sapiens
ttggcgcagagctgag

SEQ ID NO: 166729 - DNA, 16 bp, H. sapiens
ttggcgtgatcttggc

SEQ ID NO: 166730 - DNA, 16 bp, H. sapiens
ttggctaaataaacct

SEQ ID NO: 166731 - DNA, 16 bp, H. sapiens
ttggctaggctggtct

SEQ ID NO: 166732 - DNA, 16 bp, H. sapiens
ttggctattataagta

SEQ ID NO: 166733 - DNA, 16 bp, H. sapiens
ttggctattgtgaata

SEQ ID NO: 166734 - DNA, 18 bp, H. sapiens
ttggctcacacctgtaat

SEQ ID NO: 166735 - DNA, 16 bp, H. sapiens
ttggctcacagttctg

SEQ ID NO: 166736 - DNA, 16 bp, H. sapiens
ttggctcatgcctata

SEQ ID NO: 166737 - DNA, 18 bp, H. sapiens
ttggctcatgcctgtaat

SEQ ID NO: 166738 - DNA, 16 bp, H. sapiens
ttggctcatggctcct

SEQ ID NO: 166739 - DNA, 16 bp, H. sapiens
ttggctcatttttaaa

SEQ ID NO: 166740 - DNA, 16 bp, H. sapiens
ttggctctgtgggctc

SEQ ID NO: 166741 - DNA, 16 bp, H. sapiens
ttggctctgtgttctc

SEQ ID NO: 166742 - DNA, 16 bp, H. sapiens
ttggctgacagttttt

SEQ ID NO: 166743 - DNA, 16 bp, H. sapiens
ttggctgcagaaattt

SEQ ID NO: 166744 - DNA, 16 bp, H. sapiens
ttggctgcagcaccca

SEQ ID NO: 166745 - DNA, 16 bp, H. sapiens
ttggctgcataaatgt

SEQ ID NO: 166746 - DNA, 16 bp, H. sapiens
ttggctgcgtccccac

SEQ ID NO: 166747 - DNA, 16 bp, H. sapiens
ttggctggacatgaaa

SEQ ID NO: 166748 - DNA, 16 bp, H. sapiens
ttggctggagccagac

SEQ ID NO: 166749 - DNA, 16 bp, H. sapiens
ttggctggcatctggg

SEQ ID NO: 166750 - DNA, 16 bp, H. sapiens
ttggctggccatggtg

SEQ ID NO: 166751 - DNA, 16 bp, H. sapiens
ttggctggctggctgg

SEQ ID NO: 166752 - DNA, 16 bp, H. sapiens
ttggctgggcacagtg

SEQ ID NO: 166753 - DNA, 16 bp, H. sapiens
ttggctgggctgctct

SEQ ID NO: 166754 - DNA, 16 bp, H. sapiens
ttggctgggctggtct

SEQ ID NO: 166755 - DNA, 16 bp, H. sapiens
ttggctgggtgaggtg

SEQ ID NO: 166756 - DNA, 16 bp, H. sapiens
ttggctggttgcagtg

SEQ ID NO: 166757 - DNA, 16 bp, H. sapiens
ttggctggttggctgg

SEQ ID NO: 166758 - DNA, 16 bp, H. sapiens
ttggctgtggatctgt

SEQ ID NO: 166759 - DNA, 16 bp, H. sapiens
ttggctgtgggttagt

SEQ ID NO: 166760 - DNA, 16 bp, H. sapiens
ttggctgtgtccccag

SEQ ID NO: 166761 - DNA, 16 bp, H. sapiens
ttggctgtgtccctgc

SEQ ID NO: 166762 - DNA, 16 bp, H. sapiens
ttggctgtgtgcagtg

SEQ ID NO: 166763 - DNA, 16 bp, H. sapiens
ttggctgttaagtatt

SEQ ID NO: 166764 - DNA, 16 bp, H. sapiens
ttggctgttattggtg

SEQ ID NO: 166765 - DNA, 16 bp, H. sapiens
ttggcttccctgagcc

SEQ ID NO: 166766 - DNA, 16 bp, H. sapiens
ttggcttcctgggctg

SEQ ID NO: 166767 - DNA, 16 bp, H. sapiens
ttggcttcctgttcct

SEQ ID NO: 166768 - DNA, 16 bp, H. sapiens
ttggcttctctgggcc

SEQ ID NO: 166769 - DNA, 16 bp, H. sapiens
ttggcttgaaattttc

SEQ ID NO: 166770 - DNA, 16 bp, H. sapiens
ttggcttgtaaatggc

SEQ ID NO: 166771 - DNA, 16 bp, H. sapiens
ttggcttgtagatggc

SEQ ID NO: 166772 - DNA, 16 bp, H. sapiens
ttggctttaaaaaaaa

SEQ ID NO: 166773 - DNA, 16 bp, H. sapiens
ttggctttattttaaa

SEQ ID NO: 166774 - DNA, 16 bp, H. sapiens
ttggcttttattgcca

SEQ ID NO: 166775 - DNA, 16 bp, H. sapiens
ttggcttttgatgcca

SEQ ID NO: 166776 - DNA, 16 bp, H. sapiens
ttggcttttggaaatt

SEQ ID NO: 166777 - DNA, 16 bp, H. sapiens
ttggctttttaaaaat

SEQ ID NO: 166778 - DNA, 16 bp, H. sapiens
ttgggaaaaaaaaatc

SEQ ID NO: 166779 - DNA, 16 bp, H. sapiens
ttgggaaaaaatattt

SEQ ID NO: 166780 - DNA, 16 bp, H. sapiens
ttgggaaaactggcca

SEQ ID NO: 166781 - DNA, 16 bp, H. sapiens
ttgggaaaactggcta

SEQ ID NO: 166782 - DNA, 16 bp, H. sapiens
ttgggaaaagctgagt

SEQ ID NO: 166783 - DNA, 16 bp, H. sapiens
ttgggaaaattttctc

SEQ ID NO: 166784 - DNA, 16 bp, H. sapiens
ttgggaaactgaggca

SEQ ID NO: 166785 - DNA, 16 bp, H. sapiens
ttgggaaactgaggtg

SEQ ID NO: 166786 - DNA, 16 bp, H. sapiens
ttgggaaagaataaaa

SEQ ID NO: 166787 - DNA, 16 bp, H. sapiens
ttgggaaagctggcta

SEQ ID NO: 166788 - DNA, 16 bp, H. sapiens
ttgggaaataatttat

SEQ ID NO: 166789 - DNA, 16 bp, H. sapiens
ttgggaaatttatttt

SEQ ID NO: 166790 - DNA, 16 bp, H. sapiens
ttgggaacaaaaggaa

SEQ ID NO: 166791 - DNA, 16 bp, H. sapiens
ttgggaagagaaggaa

SEQ ID NO: 166792 - DNA, 16 bp, H. sapiens
ttgggaagccaaagca

SEQ ID NO: 166793 - DNA, 16 bp, H. sapiens
ttgggaagccatgatt

SEQ ID NO: 166794 - DNA, 16 bp, H. sapiens
ttgggaagctgaggcg

SEQ ID NO: 166795 - DNA, 16 bp, H. sapiens
ttgggaaggaagaaat

SEQ ID NO: 166796 - DNA, 16 bp, H. sapiens
ttgggaaggcatgact

SEQ ID NO: 166797 - DNA, 16 bp, H. sapiens
ttgggaaggctggtct

SEQ ID NO: 166798 - DNA, 16 bp, H. sapiens
ttgggaagtttgtcaa

SEQ ID NO: 166799 - DNA, 16 bp, H. sapiens
ttgggaataatattat

SEQ ID NO: 166800 - DNA, 16 bp, H. sapiens
ttgggaatatacccag

SEQ ID NO: 166801 - DNA, 16 bp, H. sapiens
ttgggacactgaggtg

SEQ ID NO: 166802 - DNA, 17 bp, H. sapiens
ttgggaccccaaactca

SEQ ID NO: 166803 - DNA, 16 bp, H. sapiens
ttgggacgactcagga

SEQ ID NO: 166804 - DNA, 16 bp, H. sapiens
ttgggagaaacaaagt

SEQ ID NO: 166805 - DNA, 16 bp, H. sapiens
ttgggagactcaggtg

SEQ ID NO: 166806 - DNA, 16 bp, H. sapiens
ttgggagactgagaca

SEQ ID NO: 166807 - DNA, 16 bp, H. sapiens
ttgggagcccgaggag

SEQ ID NO: 166808 - DNA, 16 bp, H. sapiens
ttgggaggatgaagtg

SEQ ID NO: 166809 - DNA, 16 bp, H. sapiens
ttgggaggcacaggca

SEQ ID NO: 166810 - DNA, 16 bp, H. sapiens
ttgggaggcagaggtg

SEQ ID NO: 166811 - DNA, 16 bp, H. sapiens
ttgggaggccaagaaa

SEQ ID NO: 166812 - DNA, 16 bp, H. sapiens
ttgggaggcccagggg

SEQ ID NO: 166813 - DNA, 16 bp, H. sapiens
ttgggaggccgaaggg

SEQ ID NO: 166814 - DNA, 17 bp, H. sapiens
ttgggaggccgaggcac

SEQ ID NO: 166815 - DNA, 16 bp, H. sapiens
ttgggaggccgaggct

SEQ ID NO: 166816 - DNA, 16 bp, H. sapiens
ttgggaggccgaggga

SEQ ID NO: 166817 - DNA, 16 bp, H. sapiens
ttgggaggccgagggg

SEQ ID NO: 166818 - DNA, 16 bp, H. sapiens
ttgggaggcgggtgga

SEQ ID NO: 166819 - DNA, 16 bp, H. sapiens
ttgggaggctaaggcg

SEQ ID NO: 166820 - DNA, 16 bp, H. sapiens
ttgggaggctcagatg

SEQ ID NO: 166821 - DNA, 16 bp, H. sapiens
ttgggaggctgaactg

SEQ ID NO: 166822 - DNA, 16 bp, H. sapiens
ttgggaggctgacgtg

SEQ ID NO: 166823 - DNA, 17 bp, H. sapiens
ttgggaggctgaggaag

SEQ ID NO: 166824 - DNA, 18 bp, H. sapiens
ttgggaggctgaggcagc

SEQ ID NO: 166825 - DNA, 16 bp, H. sapiens
ttgggaggctgaggta

SEQ ID NO: 166826 - DNA, 16 bp, H. sapiens
ttgggaggctggagtg

SEQ ID NO: 166827 - DNA, 16 bp, H. sapiens
ttgggaggctgtggag

SEQ ID NO: 166828 - DNA, 16 bp, H. sapiens
ttgggagggtgagaca

SEQ ID NO: 166829 - DNA, 16 bp, H. sapiens
ttgggaggtcaaggcc

SEQ ID NO: 166830 - DNA, 16 bp, H. sapiens
ttgggaggttgaagtg

SEQ ID NO: 166831 - DNA, 16 bp, H. sapiens
ttgggaggttgaggcc

SEQ ID NO: 166832 - DNA, 16 bp, H. sapiens
ttgggaggttgaggcg

SEQ ID NO: 166833 - DNA, 16 bp, H. sapiens
ttgggagtgcattgag

SEQ ID NO: 166834 - DNA, 16 bp, H. sapiens
ttgggagtttgagacc

SEQ ID NO: 166835 - DNA, 16 bp, H. sapiens
ttgggatgaaactgtt

SEQ ID NO: 166836 - DNA, 16 bp, H. sapiens
ttgggattacaggagt

SEQ ID NO: 166837 - DNA, 18 bp, H. sapiens
ttgggattacaggcaccc

SEQ ID NO: 166838 - DNA, 17 bp, H. sapiens
ttgggattacaggcata

SEQ ID NO: 166839 - DNA, 16 bp, H. sapiens
ttgggattacaggcgc

SEQ ID NO: 166840 - DNA, 20 bp, H. sapiens
ttgggattactggcgtgagc

SEQ ID NO: 166841 - DNA, 16 bp, H. sapiens
ttgggattttgattat

SEQ ID NO: 166842 - DNA, 16 bp, H. sapiens
ttgggcaaaatcatct

SEQ ID NO: 166843 - DNA, 16 bp, H. sapiens
ttgggcaacaaaatga

SEQ ID NO: 166844 - DNA, 16 bp, H. sapiens
ttgggcaacatggtga

SEQ ID NO: 166845 - DNA, 16 bp, H. sapiens
ttgggcaagtgattta

SEQ ID NO: 166846 - DNA, 16 bp, H. sapiens
ttgggcaagttactta

SEQ ID NO: 166847 - DNA, 17 bp, H. sapiens
ttgggcacagtggctca

SEQ ID NO: 166848 - DNA, 16 bp, H. sapiens
ttgggcagcctggtct

SEQ ID NO: 166849 - DNA, 16 bp, H. sapiens
ttgggcagctctgctc

SEQ ID NO: 166850 - DNA, 16 bp, H. sapiens
ttgggcagctgcagct

SEQ ID NO: 166851 - DNA, 16 bp, H. sapiens
ttgggcaggcactgag

SEQ ID NO: 166852 - DNA, 16 bp, H. sapiens
ttgggcaggctagtct

SEQ ID NO: 166853 - DNA, 16 bp, H. sapiens
ttgggcaggctgctct

SEQ ID NO: 166854 - DNA, 16 bp, H. sapiens
ttgggcaggctggtct

SEQ ID NO: 166855 - DNA, 20 bp, H. sapiens
ttgggcagtatggccatttt

SEQ ID NO: 166856 - DNA, 16 bp, H. sapiens
ttgggcatagtggcac

SEQ ID NO: 166857 - DNA, 16 bp, H. sapiens
ttgggcatatatccag

SEQ ID NO: 166858 - DNA, 18 bp, H. sapiens
ttgggcatggtggcacat

SEQ ID NO: 166859 - DNA, 16 bp, H. sapiens
ttgggccaggtgcagt

SEQ ID NO: 166860 - DNA, 16 bp, H. sapiens
ttgggccaggtgtggt

SEQ ID NO: 166861 - DNA, 16 bp, H. sapiens
ttgggcctcagtttcc

SEQ ID NO: 166862 - DNA, 16 bp, H. sapiens
ttgggccttttatgga

SEQ ID NO: 166863 - DNA, 16 bp, H. sapiens
ttgggctcaagcgatc

SEQ ID NO: 166864 - DNA, 16 bp, H. sapiens
ttgggctcccaaagca

SEQ ID NO: 166865 - DNA, 16 bp, H. sapiens
ttgggctgagaggatg

SEQ ID NO: 166866 - DNA, 16 bp, H. sapiens
ttgggctgaggtggga

SEQ ID NO: 166867 - DNA, 16 bp, H. sapiens
ttgggctgggctgggc

SEQ ID NO: 166868 - DNA, 16 bp, H. sapiens
ttgggcttaagtgatc

SEQ ID NO: 166869 - DNA, 16 bp, H. sapiens
ttgggcttcctcatag

SEQ ID NO: 166870 - DNA, 16 bp, H. sapiens
ttgggcttctagcctc

SEQ ID NO: 166871 - DNA, 16 bp, H. sapiens
ttgggctttggagatg

SEQ ID NO: 166872 - DNA, 16 bp, H. sapiens
ttggggaaaaaaataa

SEQ ID NO: 166873 - DNA, 16 bp, H. sapiens
ttggggaaaaaaatac

SEQ ID NO: 166874 - DNA, 16 bp, H. sapiens
ttggggaaaagacaat

SEQ ID NO: 166875 - DNA, 16 bp, H. sapiens
ttggggaaagaacagt

SEQ ID NO: 166876 - DNA, 16 bp, H. sapiens
ttggggaacaagtggt

SEQ ID NO: 166877 - DNA, 16 bp, H. sapiens
ttggggaacaggtggt

SEQ ID NO: 166878 - DNA, 16 bp, H. sapiens
ttggggaagataaaaa

SEQ ID NO: 166879 - DNA, 16 bp, H. sapiens
ttggggaagccaaggc

SEQ ID NO: 166880 - DNA, 16 bp, H. sapiens
ttggggaagtcactta

SEQ ID NO: 166881 - DNA, 16 bp, H. sapiens
ttggggaagttttcat

SEQ ID NO: 166882 - DNA, 16 bp, H. sapiens
ttggggacacagatcc

SEQ ID NO: 166883 - DNA, 16 bp, H. sapiens
ttggggacagagtgag

SEQ ID NO: 166884 - DNA, 16 bp, H. sapiens
ttggggaccactgccc

SEQ ID NO: 166885 - DNA, 16 bp, H. sapiens
ttggggactcagaggg

SEQ ID NO: 166886 - DNA, 16 bp, H. sapiens
ttggggactgctgttt

SEQ ID NO: 166887 - DNA, 16 bp, H. sapiens
ttggggacttggactg

SEQ ID NO: 166888 - DNA, 16 bp, H. sapiens
ttggggagaaaaagga

SEQ ID NO: 166889 - DNA, 16 bp, H. sapiens
ttggggagcaggtggt

SEQ ID NO: 166890 - DNA, 16 bp, H. sapiens
ttggggaggagtccct

SEQ ID NO: 166891 - DNA, 16 bp, H. sapiens
ttggggatattggtct

SEQ ID NO: 166892 - DNA, 17 bp, H. sapiens
ttggggattaacattag

SEQ ID NO: 166893 - DNA, 16 bp, H. sapiens
ttggggattagaattt

SEQ ID NO: 166894 - DNA, 16 bp, H. sapiens
ttggggattataattt

SEQ ID NO: 166895 - DNA, 16 bp, H. sapiens
ttggggattgcatttc

SEQ ID NO: 166896 - DNA, 16 bp, H. sapiens
ttggggcactgcctag

SEQ ID NO: 166897 - DNA, 16 bp, H. sapiens
ttggggccaggcatgg

SEQ ID NO: 166898 - DNA, 16 bp, H. sapiens
ttggggcccaccctaa

SEQ ID NO: 166899 - DNA, 16 bp, H. sapiens
ttggggcggcgtggga

SEQ ID NO: 166900 - DNA, 16 bp, H. sapiens
ttggggctcttcctct

SEQ ID NO: 166901 - DNA, 16 bp, H. sapiens
ttggggcttcagtgag

SEQ ID NO: 166902 - DNA, 16 bp, H. sapiens
ttgggggaaaaaaaac

SEQ ID NO: 166903 - DNA, 16 bp, H. sapiens
ttgggggaaaagaaaa

SEQ ID NO: 166904 - DNA, 16 bp, H. sapiens
ttgggggaacccaccc

SEQ ID NO: 166905 - DNA, 16 bp, H. sapiens
ttgggggagaaaaaaa

SEQ ID NO: 166906 - DNA, 16 bp, H. sapiens
ttgggggcagggagga

SEQ ID NO: 166907 - DNA, 16 bp, H. sapiens
ttgggggcagtggctc

SEQ ID NO: 166908 - DNA, 16 bp, H. sapiens
ttgggggccaggtgtg

SEQ ID NO: 166909 - DNA, 16 bp, H. sapiens
ttgggggctaggggag

SEQ ID NO: 166910 - DNA, 16 bp, H. sapiens
ttgggggctggggaga

SEQ ID NO: 166911 - DNA, 22 bp, H. sapiens
ttggggtgatcagacccaacac

SEQ ID NO: 166912 - DNA, 16 bp, H. sapiens
ttggggtgtcaatttt

SEQ ID NO: 166913 - DNA, 16 bp, H. sapiens
ttggggttagggttag

SEQ ID NO: 166914 - DNA, 16 bp, H. sapiens
ttggggtttctcttct

SEQ ID NO: 166915 - DNA, 16 bp, H. sapiens
ttgggtaagtcattta

SEQ ID NO: 166916 - DNA, 16 bp, H. sapiens
ttgggtaagttctcct

SEQ ID NO: 166917 - DNA, 16 bp, H. sapiens
ttgggtaataaaatgt

SEQ ID NO: 166918 - DNA, 16 bp, H. sapiens
ttgggtatatacccaa

SEQ ID NO: 166919 - DNA, 16 bp, H. sapiens
ttgggtcaggtgcagt

SEQ ID NO: 166920 - DNA, 16 bp, H. sapiens
ttgggtcttgactctt

SEQ ID NO: 166921 - DNA, 20 bp, H. sapiens
ttgggtgacagagtgagacc

SEQ ID NO: 166922 - DNA, 16 bp, H. sapiens
ttgggtgagacccagt

SEQ ID NO: 166923 - DNA, 16 bp, H. sapiens
ttgggtggagatacag

SEQ ID NO: 166924 - DNA, 16 bp, H. sapiens
ttgggtggatcacctg

SEQ ID NO: 166925 - DNA, 16 bp, H. sapiens
ttgggtgggagcacag

SEQ ID NO: 166926 - DNA, 16 bp, H. sapiens
ttgggtggggtcacag

SEQ ID NO: 166927 - DNA, 16 bp, H. sapiens
ttgggtgtgtatatat

SEQ ID NO: 166928 - DNA, 16 bp, H. sapiens
ttgggttagaatatgc

SEQ ID NO: 166929 - DNA, 16 bp, H. sapiens
ttgggttctctattct

SEQ ID NO: 166930 - DNA, 16 bp, H. sapiens
ttgggttgtttccaag

SEQ ID NO: 166931 - DNA, 16 bp, H. sapiens
ttgggtttatcctgtt

SEQ ID NO: 166932 - DNA, 16 bp, H. sapiens
ttgggtttgaattctg

SEQ ID NO: 166933 - DNA, 16 bp, H. sapiens
ttgggttttacatata

SEQ ID NO: 166934 - DNA, 16 bp, H. sapiens
ttgggttttacattga

SEQ ID NO: 166935 - DNA, 16 bp, H. sapiens
ttgggttttttccccc

SEQ ID NO: 166936 - DNA, 16 bp, H. sapiens
ttggtaaaatgcaaat

SEQ ID NO: 166937 - DNA, 16 bp, H. sapiens
ttggtaaatatttgtt

SEQ ID NO: 166938 - DNA, 16 bp, H. sapiens
ttggtaaattttaaat

SEQ ID NO: 166939 - DNA, 16 bp, H. sapiens
ttggtaaatttttaaa

SEQ ID NO: 166940 - DNA, 16 bp, H. sapiens
ttggtaaatttttctt

SEQ ID NO: 166941 - DNA, 16 bp, H. sapiens
ttggtaagactagtct

SEQ ID NO: 166942 - DNA, 16 bp, H. sapiens
ttggtaattcttacaa

SEQ ID NO: 166943 - DNA, 16 bp, H. sapiens
ttggtacagaagacag

SEQ ID NO: 166944 - DNA, 16 bp, H. sapiens
ttggtaccaaaacaga

SEQ ID NO: 166945 - DNA, 16 bp, H. sapiens
ttggtaccaggagtgg

SEQ ID NO: 166946 - DNA, 16 bp, H. sapiens
ttggtaggctcttaat

SEQ ID NO: 166947 - DNA, 16 bp, H. sapiens
ttggtagtttgatagg

SEQ ID NO: 166948 - DNA, 16 bp, H. sapiens
ttggtatattcacaga

SEQ ID NO: 166949 - DNA, 16 bp, H. sapiens
ttggtatttttaaaaa

SEQ ID NO: 166950 - DNA, 16 bp, H. sapiens
ttggtatttttagtaa

SEQ ID NO: 166951 - DNA, 16 bp, H. sapiens
ttggtcagactggtct

SEQ ID NO: 166952 - DNA, 16 bp, H. sapiens
ttggtcagatgcatag

SEQ ID NO: 166953 - DNA, 16 bp, H. sapiens
ttggtcagcctggtct

SEQ ID NO: 166954 - DNA, 16 bp, H. sapiens
ttggtcaggatggtct

SEQ ID NO: 166955 - DNA, 16 bp, H. sapiens
ttggtcaggctagtct

SEQ ID NO: 166956 - DNA, 16 bp, H. sapiens
ttggtcaggctgacct

SEQ ID NO: 166957 - DNA, 16 bp, H. sapiens
ttggtcaggctgatct

SEQ ID NO: 166958 - DNA, 16 bp, H. sapiens
ttggtcaggctgctct

SEQ ID NO: 166959 - DNA, 16 bp, H. sapiens
ttggtcaggctggcct

SEQ ID NO: 166960 - DNA, 16 bp, H. sapiens
ttggtcaggctggtca

SEQ ID NO: 166961 - DNA, 16 bp, H. sapiens
ttggtcaggctggtct

SEQ ID NO: 166962 - DNA, 16 bp, H. sapiens
ttggtcagggtggtgg

SEQ ID NO: 166963 - DNA, 16 bp, H. sapiens
ttggtcaggttggtct

SEQ ID NO: 166964 - DNA, 18 bp, H. sapiens
ttggtcaggttggtctca

SEQ ID NO: 166965 - DNA, 16 bp, H. sapiens
ttggtcagtctggtct

SEQ ID NO: 166966 - DNA, 16 bp, H. sapiens
ttggtcccaggccaag

SEQ ID NO: 166967 - DNA, 16 bp, H. sapiens
ttggtcgggctggtct

SEQ ID NO: 166968 - DNA, 17 bp, H. sapiens
ttggtctatatatctgt

SEQ ID NO: 166969 - DNA, 18 bp, H. sapiens
ttggtctcaaactcctgg

SEQ ID NO: 166970 - DNA, 19 bp, H. sapiens
ttggtctcaaactcctggc

SEQ ID NO: 166971 - DNA, 16 bp, H. sapiens
ttggtctccctgggag

SEQ ID NO: 166972 - DNA, 24 bp, H. sapiens
ttggtctcgaactcctgacctcag

SEQ ID NO: 166973 - DNA, 16 bp, H. sapiens
ttggtctggctggtct

SEQ ID NO: 166974 - DNA, 16 bp, H. sapiens
ttggtctgggcaagga

SEQ ID NO: 166975 - DNA, 16 bp, H. sapiens
ttggtctgggcagtga

SEQ ID NO: 166976 - DNA, 16 bp, H. sapiens
ttggtcttgaactcct

SEQ ID NO: 166977 - DNA, 16 bp, H. sapiens
ttggtctttatttaga

SEQ ID NO: 166978 - DNA, 16 bp, H. sapiens
ttggtgaaagccattc

SEQ ID NO: 166979 - DNA, 16 bp, H. sapiens
ttggtgaagaaaaaaa

SEQ ID NO: 166980 - DNA, 16 bp, H. sapiens
ttggtgacagagccag

SEQ ID NO: 166981 - DNA, 16 bp, H. sapiens
ttggtgactatggcct

SEQ ID NO: 166982 - DNA, 16 bp, H. sapiens
ttggtgagacatttgt

SEQ ID NO: 166983 - DNA, 16 bp, H. sapiens
ttggtgagatgtttct

SEQ ID NO: 166984 - DNA, 16 bp, H. sapiens
ttggtgaggaggtgga

SEQ ID NO: 166985 - DNA, 16 bp, H. sapiens
ttggtgaggatttgga

SEQ ID NO: 166986 - DNA, 16 bp, H. sapiens
ttggtgagggcagatc

SEQ ID NO: 166987 - DNA, 16 bp, H. sapiens
ttggtgatctcatcca

SEQ ID NO: 166988 - DNA, 16 bp, H. sapiens
ttggtgatgaccttga

SEQ ID NO: 166989 - DNA, 17 bp, H. sapiens
ttggtgatgcgggctct

SEQ ID NO: 166990 - DNA, 16 bp, H. sapiens
ttggtgcaaaagcaat

SEQ ID NO: 166991 - DNA, 16 bp, H. sapiens
ttggtgcaaaagtaat

SEQ ID NO: 166992 - DNA, 16 bp, H. sapiens
ttggtgcagagctggg

SEQ ID NO: 166993 - DNA, 16 bp, H. sapiens
ttggtgcagtttcttc

SEQ ID NO: 166994 - DNA, 16 bp, H. sapiens
ttggtgccactgcctt

SEQ ID NO: 166995 - DNA, 16 bp, H. sapiens
ttggtgctcaataaat

SEQ ID NO: 166996 - DNA, 16 bp, H. sapiens
ttggtggaatctttag

SEQ ID NO: 166997 - DNA, 16 bp, H. sapiens
ttggtggatttaccat

SEQ ID NO: 166998 - DNA, 16 bp, H. sapiens
ttggtggcactgtaaa

SEQ ID NO: 166999 - DNA, 16 bp, H. sapiens
ttggtggccaggctgg

SEQ ID NO: 167000 - DNA, 16 bp, H. sapiens
ttggtggctcacacct

SEQ ID NO: 167001 - DNA, 16 bp, H. sapiens
ttggtggctcacgcct

SEQ ID NO: 167002 - DNA, 17 bp, H. sapiens
ttggtggctcatgcctg

SEQ ID NO: 167003 - DNA, 16 bp, H. sapiens
ttggtggctgagcttg

SEQ ID NO: 167004 - DNA, 17 bp, H. sapiens
ttggtggctgagcttgg

SEQ ID NO: 167005 - DNA, 16 bp, H. sapiens
ttggtgggatggtaaa

SEQ ID NO: 167006 - DNA, 16 bp, H. sapiens
ttggtgggctcctgga

SEQ ID NO: 167007 - DNA, 16 bp, H. sapiens
ttggtggggacacaga

SEQ ID NO: 167008 - DNA, 18 bp, H. sapiens
ttggtggtagtggtcccc

SEQ ID NO: 167009 - DNA, 16 bp, H. sapiens
ttggtggtcttttcac

SEQ ID NO: 167010 - DNA, 16 bp, H. sapiens
ttggtggtgatgatgg

SEQ ID NO: 167011 - DNA, 16 bp, H. sapiens
ttggtggtggggagaa

SEQ ID NO: 167012 - DNA, 17 bp, H. sapiens
ttggtggtgtcatattt

SEQ ID NO: 167013 - DNA, 16 bp, H. sapiens
ttggtgtatagaaatg

SEQ ID NO: 167014 - DNA, 16 bp, H. sapiens
ttggtgtcatagctaa

SEQ ID NO: 167015 - DNA, 16 bp, H. sapiens
ttggtgtcatatctag

SEQ ID NO: 167016 - DNA, 16 bp, H. sapiens
ttggtgtcatattcaa

SEQ ID NO: 167017 - DNA, 16 bp, H. sapiens
ttggtgtctggtgagg

SEQ ID NO: 167018 - DNA, 16 bp, H. sapiens
ttggtgtctgtcatta

SEQ ID NO: 167019 - DNA, 16 bp, H. sapiens
ttggtgttttggacat

SEQ ID NO: 167020 - DNA, 16 bp, H. sapiens
ttggttaaaatgaaaa

SEQ ID NO: 167021 - DNA, 16 bp, H. sapiens
ttggttaaatgaatga

SEQ ID NO: 167022 - DNA, 16 bp, H. sapiens
ttggttaaatgtattt

SEQ ID NO: 167023 - DNA, 16 bp, H. sapiens
ttggttaccagtgtgt

SEQ ID NO: 167024 - DNA, 16 bp, H. sapiens
ttggttaggctggtct

SEQ ID NO: 167025 - DNA, 16 bp, H. sapiens
ttggttatattaccaa

SEQ ID NO: 167026 - DNA, 16 bp, H. sapiens
ttggttatcagatcaa

SEQ ID NO: 167027 - DNA, 16 bp, H. sapiens
ttggttattatgaata

SEQ ID NO: 167028 - DNA, 16 bp, H. sapiens
ttggttattctgagtc

SEQ ID NO: 167029 - DNA, 16 bp, H. sapiens
ttggttcaacatttga

SEQ ID NO: 167030 - DNA, 16 bp, H. sapiens
ttggttcatgaagttt

SEQ ID NO: 167031 - DNA, 16 bp, H. sapiens
ttggttcatttcttct

SEQ ID NO: 167032 - DNA, 27 bp, H. sapiens
ttggttccaagtctttgctattgtgaa

SEQ ID NO: 167033 - DNA, 16 bp, H. sapiens
ttggttccacaatttt

SEQ ID NO: 167034 - DNA, 16 bp, H. sapiens
ttggttccctgacctg

SEQ ID NO: 167035 - DNA, 16 bp, H. sapiens
ttggttctttctgagg

SEQ ID NO: 167036 - DNA, 16 bp, H. sapiens
ttggttgaataaatga

SEQ ID NO: 167037 - DNA, 16 bp, H. sapiens
ttggttgaatccatgg

SEQ ID NO: 167038 - DNA, 16 bp, H. sapiens
ttggttgcatggaaaa

SEQ ID NO: 167039 - DNA, 16 bp, H. sapiens
ttggttgccagtgaag

SEQ ID NO: 167040 - DNA, 16 bp, H. sapiens
ttggttgcctgtgcct

SEQ ID NO: 167041 - DNA, 16 bp, H. sapiens
ttggttggaccaggtg

SEQ ID NO: 167042 - DNA, 16 bp, H. sapiens
ttggttgtttgaaaag

SEQ ID NO: 167043 - DNA, 16 bp, H. sapiens
ttggtttaatattcaa

SEQ ID NO: 167044 - DNA, 16 bp, H. sapiens
ttggtttatttcactt

SEQ ID NO: 167045 - DNA, 16 bp, H. sapiens
ttggtttcaaagaaaa

SEQ ID NO: 167046 - DNA, 16 bp, H. sapiens
ttggtttccacatctg

SEQ ID NO: 167047 - DNA, 16 bp, H. sapiens
ttggtttcctttgtaa

SEQ ID NO: 167048 - DNA, 16 bp, H. sapiens
ttggtttctaaatgcc

SEQ ID NO: 167049 - DNA, 16 bp, H. sapiens
ttggtttgacctaaaa

SEQ ID NO: 167050 - DNA, 16 bp, H. sapiens
ttggtttgcatatgtt

SEQ ID NO: 167051 - DNA, 16 bp, H. sapiens
ttggtttgcattttcc

SEQ ID NO: 167052 - DNA, 16 bp, H. sapiens
ttggttttaaaaatta

SEQ ID NO: 167053 - DNA, 16 bp, H. sapiens
ttggttttactaaaaa

SEQ ID NO: 167054 - DNA, 16 bp, H. sapiens
ttggttttatttctgg

SEQ ID NO: 167055 - DNA, 16 bp, H. sapiens
ttggttttccattctt

SEQ ID NO: 167056 - DNA, 16 bp, H. sapiens
ttggttttctactcct

SEQ ID NO: 167057 - DNA, 16 bp, H. sapiens
ttggttttctgctcct

SEQ ID NO: 167058 - DNA, 16 bp, H. sapiens
ttggttttctggaaag

SEQ ID NO: 167059 - DNA, 16 bp, H. sapiens
ttggtttttaaatgtg

SEQ ID NO: 167060 - DNA, 16 bp, H. sapiens
ttggtttttagaaaaa

SEQ ID NO: 167061 - DNA, 16 bp, H. sapiens
ttggtttttatttgca

SEQ ID NO: 167062 - DNA, 16 bp, H. sapiens
ttggttttttgaaaaa

SEQ ID NO: 167063 - DNA, 16 bp, H. sapiens
ttggttttttgaaagg

SEQ ID NO: 167064 - DNA, 16 bp, H. sapiens
ttgtaaaaaacaaaat

SEQ ID NO: 167065 - DNA, 16 bp, H. sapiens
ttgtaaaaagcatgca

SEQ ID NO: 167066 - DNA, 16 bp, H. sapiens
ttgtaaaaatgaagaa

SEQ ID NO: 167067 - DNA, 16 bp, H. sapiens
ttgtaaaaattgacaa

SEQ ID NO: 167068 - DNA, 16 bp, H. sapiens
ttgtaaaagtatttta

SEQ ID NO: 167069 - DNA, 16 bp, H. sapiens
ttgtaaaataaaaaac

SEQ ID NO: 167070 - DNA, 16 bp, H. sapiens
ttgtaaaatattgaaa

SEQ ID NO: 167071 - DNA, 16 bp, H. sapiens
ttgtaaaatgaatgaa

SEQ ID NO: 167072 - DNA, 16 bp, H. sapiens
ttgtaaaatgaatttg

SEQ ID NO: 167073 - DNA, 16 bp, H. sapiens
ttgtaaaatgcttttc

SEQ ID NO: 167074 - DNA, 16 bp, H. sapiens
ttgtaaaatttgcaaa

SEQ ID NO: 167075 - DNA, 19 bp, H. sapiens
ttgtaaacacaccaatcag

SEQ ID NO: 167076 - DNA, 16 bp, H. sapiens
ttgtaaacctcaaata

SEQ ID NO: 167077 - DNA, 16 bp, H. sapiens
ttgtaaagctaatgaa

SEQ ID NO: 167078 - DNA, 16 bp, H. sapiens
ttgtaaagtttcttaa

SEQ ID NO: 167079 - DNA, 16 bp, H. sapiens
ttgtaaataaactttt

SEQ ID NO: 167080 - DNA, 16 bp, H. sapiens
ttgtaaataaagattt

SEQ ID NO: 167081 - DNA, 16 bp, H. sapiens
ttgtaaataaagtttc

SEQ ID NO: 167082 - DNA, 16 bp, H. sapiens
ttgtaaataacatttt

SEQ ID NO: 167083 - DNA, 16 bp, H. sapiens
ttgtaaataattttct

SEQ ID NO: 167084 - DNA, 16 bp, H. sapiens
ttgtaaatacaatttt

SEQ ID NO: 167085 - DNA, 16 bp, H. sapiens
ttgtaaatacagtttt

SEQ ID NO: 167086 - DNA, 16 bp, H. sapiens
ttgtaaatatttcctc

SEQ ID NO: 167087 - DNA, 16 bp, H. sapiens
ttgtaaatggcattgt

SEQ ID NO: 167088 - DNA, 16 bp, H. sapiens
ttgtaaatgtgtttaa

SEQ ID NO: 167089 - DNA, 16 bp, H. sapiens
ttgtaaatttctttga

SEQ ID NO: 167090 - DNA, 16 bp, H. sapiens
ttgtaaatttgttgga

SEQ ID NO: 167091 - DNA, 16 bp, H. sapiens
ttgtaacaaatgtacc

SEQ ID NO: 167092 - DNA, 16 bp, H. sapiens
ttgtaacatattttga

SEQ ID NO: 167093 - DNA, 16 bp, H. sapiens
ttgtaaccatatgatt

SEQ ID NO: 167094 - DNA, 16 bp, H. sapiens
ttgtaaccattttaaa

SEQ ID NO: 167095 - DNA, 16 bp, H. sapiens
ttgtaacttttaaaat

SEQ ID NO: 167096 - DNA, 16 bp, H. sapiens
ttgtaagaagaggaaa

SEQ ID NO: 167097 - DNA, 16 bp, H. sapiens
ttgtaagctttgcata

SEQ ID NO: 167098 - DNA, 16 bp, H. sapiens
ttgtaaggcaggtctg

SEQ ID NO: 167099 - DNA, 16 bp, H. sapiens
ttgtaagtgtaaaata

SEQ ID NO: 167100 - DNA, 17 bp, H. sapiens
ttgtaatatctcctgtt

SEQ ID NO: 167101 - DNA, 16 bp, H. sapiens
ttgtaatattctctga

SEQ ID NO: 167102 - DNA, 16 bp, H. sapiens
ttgtaatcccaaaact

SEQ ID NO: 167103 - DNA, 17 bp, H. sapiens
ttgtaatcccagatact

SEQ ID NO: 167104 - DNA, 17 bp, H. sapiens
ttgtaatcccagcactt

SEQ ID NO: 167105 - DNA, 17 bp, H. sapiens
ttgtaatcccagcagtt

SEQ ID NO: 167106 - DNA, 17 bp, H. sapiens
ttgtaatcccagctact

SEQ ID NO: 167107 - DNA, 16 bp, H. sapiens
ttgtaatcccagctat

SEQ ID NO: 167108 - DNA, 17 bp, H. sapiens
ttgtaatcctagcactt

SEQ ID NO: 167109 - DNA, 16 bp, H. sapiens
ttgtaatctcaacact

SEQ ID NO: 167110 - DNA, 16 bp, H. sapiens
ttgtaatctcagctac

SEQ ID NO: 167111 - DNA, 16 bp, H. sapiens
ttgtaatgcaggcctg

SEQ ID NO: 167112 - DNA, 16 bp, H. sapiens
ttgtaatgtattttga

SEQ ID NO: 167113 - DNA, 17 bp, H. sapiens
ttgtaattccagctact

SEQ ID NO: 167114 - DNA, 16 bp, H. sapiens
ttgtaattctcattat

SEQ ID NO: 167115 - DNA, 16 bp, H. sapiens
ttgtaatttaaaatct

SEQ ID NO: 167116 - DNA, 16 bp, H. sapiens
ttgtaatttgaaaaaa

SEQ ID NO: 167117 - DNA, 16 bp, H. sapiens
ttgtaattttaaaaca

SEQ ID NO: 167118 - DNA, 16 bp, H. sapiens
ttgtaattttaaagaa

SEQ ID NO: 167119 - DNA, 16 bp, H. sapiens
ttgtaattttcctgag

SEQ ID NO: 167120 - DNA, 16 bp, H. sapiens
ttgtacaaatttatgg

SEQ ID NO: 167121 - DNA, 16 bp, H. sapiens
ttgtacaacaagaagg

SEQ ID NO: 167122 - DNA, 16 bp, H. sapiens
ttgtacaacactgtga

SEQ ID NO: 167123 - DNA, 16 bp, H. sapiens
ttgtacagaatatttc

SEQ ID NO: 167124 - DNA, 16 bp, H. sapiens
ttgtacataaatcttt

SEQ ID NO: 167125 - DNA, 16 bp, H. sapiens
ttgtacatatatcttt

SEQ ID NO: 167126 - DNA, 16 bp, H. sapiens
ttgtacatattatttt

SEQ ID NO: 167127 - DNA, 16 bp, H. sapiens
ttgtacatatttatag

SEQ ID NO: 167128 - DNA, 16 bp, H. sapiens
ttgtacatatttgtgg

SEQ ID NO: 167129 - DNA, 16 bp, H. sapiens
ttgtacatattttaaa

SEQ ID NO: 167130 - DNA, 16 bp, H. sapiens
ttgtacattgatttca

SEQ ID NO: 167131 - DNA, 16 bp, H. sapiens
ttgtacattttatttc

SEQ ID NO: 167132 - DNA, 16 bp, H. sapiens
ttgtacatttttaaat

SEQ ID NO: 167133 - DNA, 16 bp, H. sapiens
ttgtacatttttatgg

SEQ ID NO: 167134 - DNA, 16 bp, H. sapiens
ttgtacattttttaaa

SEQ ID NO: 167135 - DNA, 16 bp, H. sapiens
ttgtaccactgcaccc

SEQ ID NO: 167136 - DNA, 16 bp, H. sapiens
ttgtaccactgcacta

SEQ ID NO: 167137 - DNA, 16 bp, H. sapiens
ttgtaccactgcattc

SEQ ID NO: 167138 - DNA, 19 bp, H. sapiens
ttgtacctctggtagaatt

SEQ ID NO: 167139 - DNA, 16 bp, H. sapiens
ttgtactaatttacac

SEQ ID NO: 167140 - DNA, 17 bp, H. sapiens
ttgtactccagcctgga

SEQ ID NO: 167141 - DNA, 16 bp, H. sapiens
ttgtactccatcctgg

SEQ ID NO: 167142 - DNA, 16 bp, H. sapiens
ttgtactggtacaaaa

SEQ ID NO: 167143 - DNA, 16 bp, H. sapiens
ttgtactgtattttta

SEQ ID NO: 167144 - DNA, 16 bp, H. sapiens
ttgtacttttcagctc

SEQ ID NO: 167145 - DNA, 16 bp, H. sapiens
ttgtacttttttgtag

SEQ ID NO: 167146 - DNA, 16 bp, H. sapiens
ttgtagaaaactgata

SEQ ID NO: 167147 - DNA, 16 bp, H. sapiens
ttgtagaaatggaatc

SEQ ID NO: 167148 - DNA, 16 bp, H. sapiens
ttgtagaaatggggct

SEQ ID NO: 167149 - DNA, 16 bp, H. sapiens
ttgtagaaattaacaa

SEQ ID NO: 167150 - DNA, 16 bp, H. sapiens
ttgtagaagaaaataa

SEQ ID NO: 167151 - DNA, 16 bp, H. sapiens
ttgtagaagtagagag

SEQ ID NO: 167152 - DNA, 16 bp, H. sapiens
ttgtagaatattttaa

SEQ ID NO: 167153 - DNA, 16 bp, H. sapiens
ttgtagaatgaatgaa

SEQ ID NO: 167154 - DNA, 16 bp, H. sapiens
ttgtagaatttgcaag

SEQ ID NO: 167155 - DNA, 16 bp, H. sapiens
ttgtagagaaaaagaa

SEQ ID NO: 167156 - DNA, 16 bp, H. sapiens
ttgtagagaaaagaga

SEQ ID NO: 167157 - DNA, 16 bp, H. sapiens
ttgtagagacagtttc

SEQ ID NO: 167158 - DNA, 17 bp, H. sapiens
ttgtagagacggggttt

SEQ ID NO: 167159 - DNA, 16 bp, H. sapiens
ttgtagagaggaggtc

SEQ ID NO: 167160 - DNA, 16 bp, H. sapiens
ttgtagatgaagaaac

SEQ ID NO: 167161 - DNA, 16 bp, H. sapiens
ttgtagatgaggaaat

SEQ ID NO: 167162 - DNA, 16 bp, H. sapiens
ttgtagatgtttgtct

SEQ ID NO: 167163 - DNA, 16 bp, H. sapiens
ttgtagcaattttgaa

SEQ ID NO: 167164 - DNA, 16 bp, H. sapiens
ttgtagcagtgttctg

SEQ ID NO: 167165 - DNA, 16 bp, H. sapiens
ttgtagctaatttgtt

SEQ ID NO: 167166 - DNA, 16 bp, H. sapiens
ttgtagctcccataat

SEQ ID NO: 167167 - DNA, 16 bp, H. sapiens
ttgtaggaatgtaaat

SEQ ID NO: 167168 - DNA, 16 bp, H. sapiens
ttgtaggagttattta

SEQ ID NO: 167169 - DNA, 16 bp, H. sapiens
ttgtagggatgaggtt

SEQ ID NO: 167170 - DNA, 16 bp, H. sapiens
ttgtaggtctctaaga

SEQ ID NO: 167171 - DNA, 17 bp, H. sapiens
ttgtagtcccagctact

SEQ ID NO: 167172 - DNA, 16 bp, H. sapiens
ttgtagtcccagctat

SEQ ID NO: 167173 - DNA, 16 bp, H. sapiens
ttgtagtgcaaaagca

SEQ ID NO: 167174 - DNA, 16 bp, H. sapiens
ttgtagttttacattt

SEQ ID NO: 167175 - DNA, 20 bp, H. sapiens
ttgtagttttagtagagaca

SEQ ID NO: 167176 - DNA, 16 bp, H. sapiens
ttgtagttttagtagg

SEQ ID NO: 167177 - DNA, 16 bp, H. sapiens
ttgtagttttcattat

SEQ ID NO: 167178 - DNA, 16 bp, H. sapiens
ttgtagttttctgcat

SEQ ID NO: 167179 - DNA, 16 bp, H. sapiens
ttgtataaatatacca

SEQ ID NO: 167180 - DNA, 16 bp, H. sapiens
ttgtataaatggaatc

SEQ ID NO: 167181 - DNA, 16 bp, H. sapiens
ttgtataaatgtacca

SEQ ID NO: 167182 - DNA, 16 bp, H. sapiens
ttgtataaatgtgtta

SEQ ID NO: 167183 - DNA, 16 bp, H. sapiens
ttgtataaattttagg

SEQ ID NO: 167184 - DNA, 16 bp, H. sapiens
ttgtataatttctatt

SEQ ID NO: 167185 - DNA, 16 bp, H. sapiens
ttgtatacaaatgttt

SEQ ID NO: 167186 - DNA, 16 bp, H. sapiens
ttgtatactttaaata

SEQ ID NO: 167187 - DNA, 16 bp, H. sapiens
ttgtatagttttcaaa

SEQ ID NO: 167188 - DNA, 16 bp, H. sapiens
ttgtatagttttgaga

SEQ ID NO: 167189 - DNA, 16 bp, H. sapiens
ttgtatatatgtgtgt

SEQ ID NO: 167190 - DNA, 16 bp, H. sapiens
ttgtatattctcactt

SEQ ID NO: 167191 - DNA, 16 bp, H. sapiens
ttgtatattctgtata

SEQ ID NO: 167192 - DNA, 16 bp, H. sapiens
ttgtatatttagaata

SEQ ID NO: 167193 - DNA, 16 bp, H. sapiens
ttgtatatttagagaa

SEQ ID NO: 167194 - DNA, 16 bp, H. sapiens
ttgtatatttaggaaa

SEQ ID NO: 167195 - DNA, 16 bp, H. sapiens
ttgtatatttcaatat

SEQ ID NO: 167196 - DNA, 16 bp, H. sapiens
ttgtatatttccattt

SEQ ID NO: 167197 - DNA, 16 bp, H. sapiens
ttgtatcaaaaagaca

SEQ ID NO: 167198 - DNA, 16 bp, H. sapiens
ttgtatccaataaata

SEQ ID NO: 167199 - DNA, 16 bp, H. sapiens
ttgtatcccagaactt

SEQ ID NO: 167200 - DNA, 16 bp, H. sapiens
ttgtatcctgcaactt

SEQ ID NO: 167201 - DNA, 16 bp, H. sapiens
ttgtatcctgtgacct

SEQ ID NO: 167202 - DNA, 16 bp, H. sapiens
ttgtatctggcttatt

SEQ ID NO: 167203 - DNA, 16 bp, H. sapiens
ttgtatcttcagatga

SEQ ID NO: 167204 - DNA, 16 bp, H. sapiens
ttgtatcttggaagga

SEQ ID NO: 167205 - DNA, 16 bp, H. sapiens
ttgtatctttccagga

SEQ ID NO: 167206 - DNA, 16 bp, H. sapiens
ttgtatgaatgtacca

SEQ ID NO: 167207 - DNA, 16 bp, H. sapiens
ttgtatgaatgtatca

SEQ ID NO: 167208 - DNA, 16 bp, H. sapiens
ttgtatgcttgaaaat

SEQ ID NO: 167209 - DNA, 16 bp, H. sapiens
ttgtatggatatacca

SEQ ID NO: 167210 - DNA, 16 bp, H. sapiens
ttgtatggtttttcac

SEQ ID NO: 167211 - DNA, 16 bp, H. sapiens
ttgtatgtatatgtgt

SEQ ID NO: 167212 - DNA, 16 bp, H. sapiens
ttgtatgtttagaaaa

SEQ ID NO: 167213 - DNA, 16 bp, H. sapiens
ttgtatgttttaaaaa

SEQ ID NO: 167214 - DNA, 16 bp, H. sapiens
ttgtatgttttgtaaa

SEQ ID NO: 167215 - DNA, 16 bp, H. sapiens
ttgtattaaaaataca

SEQ ID NO: 167216 - DNA, 16 bp, H. sapiens
ttgtattatctattaa

SEQ ID NO: 167217 - DNA, 16 bp, H. sapiens
ttgtattcagaatata

SEQ ID NO: 167218 - DNA, 16 bp, H. sapiens
ttgtattcagagttga

SEQ ID NO: 167219 - DNA, 16 bp, H. sapiens
ttgtattcagtattat

SEQ ID NO: 167220 - DNA, 16 bp, H. sapiens
ttgtattcattaacca

SEQ ID NO: 167221 - DNA, 16 bp, H. sapiens
ttgtattcctttgggt

SEQ ID NO: 167222 - DNA, 16 bp, H. sapiens
ttgtattgtgttacct

SEQ ID NO: 167223 - DNA, 17 bp, H. sapiens
ttgtattgttagtagag

SEQ ID NO: 167224 - DNA, 16 bp, H. sapiens
ttgtattgtttaggga

SEQ ID NO: 167225 - DNA, 16 bp, H. sapiens
ttgtatttagtagaga

SEQ ID NO: 167226 - DNA, 16 bp, H. sapiens
ttgtatttcaaataaa

SEQ ID NO: 167227 - DNA, 16 bp, H. sapiens
ttgtatttctataata

SEQ ID NO: 167228 - DNA, 16 bp, H. sapiens
ttgtatttctccttca

SEQ ID NO: 167229 - DNA, 16 bp, H. sapiens
ttgtatttctgtggaa

SEQ ID NO: 167230 - DNA, 16 bp, H. sapiens
ttgtatttggaaaaac

SEQ ID NO: 167231 - DNA, 16 bp, H. sapiens
ttgtattttaaaagat

SEQ ID NO: 167232 - DNA, 16 bp, H. sapiens
ttgtattttactttaa

SEQ ID NO: 167233 - DNA, 16 bp, H. sapiens
ttgtattttagtagat

SEQ ID NO: 167234 - DNA, 16 bp, H. sapiens
ttgtattttcagaaga

SEQ ID NO: 167235 - DNA, 16 bp, H. sapiens
ttgtattttcagtgga

SEQ ID NO: 167236 - DNA, 16 bp, H. sapiens
ttgtattttctctctc

SEQ ID NO: 167237 - DNA, 16 bp, H. sapiens
ttgtattttgaaattc

SEQ ID NO: 167238 - DNA, 16 bp, H. sapiens
ttgtattttgagtgga

SEQ ID NO: 167239 - DNA, 16 bp, H. sapiens
ttgtattttgttgaag

SEQ ID NO: 167240 - DNA, 16 bp, H. sapiens
ttgtatttttaaaaag

SEQ ID NO: 167241 - DNA, 16 bp, H. sapiens
ttgtatttttaaaaga

SEQ ID NO: 167242 - DNA, 17 bp, H. sapiens
ttgtatttttagtagaa

SEQ ID NO: 167243 - DNA, 16 bp, H. sapiens
ttgtatttttagtagc

SEQ ID NO: 167244 - DNA, 19 bp, H. sapiens
ttgtatttttagtagggac

SEQ ID NO: 167245 - DNA, 16 bp, H. sapiens
ttgtatttttagtcaa

SEQ ID NO: 167246 - DNA, 16 bp, H. sapiens
ttgtatttttccaaaa

SEQ ID NO: 167247 - DNA, 16 bp, H. sapiens
ttgtatttttctagta

SEQ ID NO: 167248 - DNA, 16 bp, H. sapiens
ttgtatttttctataa

SEQ ID NO: 167249 - DNA, 17 bp, H. sapiens
ttgtatttttggtagac

SEQ ID NO: 167250 - DNA, 16 bp, H. sapiens
ttgtatttttgtagaa

SEQ ID NO: 167251 - DNA, 16 bp, H. sapiens
ttgtcaaaaatcaaat

SEQ ID NO: 167252 - DNA, 16 bp, H. sapiens
ttgtcaaaaattagtt

SEQ ID NO: 167253 - DNA, 16 bp, H. sapiens
ttgtcaaaactcagca

SEQ ID NO: 167254 - DNA, 16 bp, H. sapiens
ttgtcaaaattttaaa

SEQ ID NO: 167255 - DNA, 16 bp, H. sapiens
ttgtcaaagatcattt

SEQ ID NO: 167256 - DNA, 16 bp, H. sapiens
ttgtcaaatataaaat

SEQ ID NO: 167257 - DNA, 16 bp, H. sapiens
ttgtcaaatctttttt

SEQ ID NO: 167258 - DNA, 16 bp, H. sapiens
ttgtcaacacttatta

SEQ ID NO: 167259 - DNA, 16 bp, H. sapiens
ttgtcaacccagaatt

SEQ ID NO: 167260 - DNA, 16 bp, H. sapiens
ttgtcaagagaatgaa

SEQ ID NO: 167261 - DNA, 16 bp, H. sapiens
ttgtcaagtgaatgaa

SEQ ID NO: 167262 - DNA, 16 bp, H. sapiens
ttgtcaattaaaaaaa

SEQ ID NO: 167263 - DNA, 16 bp, H. sapiens
ttgtcaattaaatatt

SEQ ID NO: 167264 - DNA, 16 bp, H. sapiens
ttgtcaatttctcctt

SEQ ID NO: 167265 - DNA, 16 bp, H. sapiens
ttgtcaccacaaagaa

SEQ ID NO: 167266 - DNA, 16 bp, H. sapiens
ttgtcaccatcatcat

SEQ ID NO: 167267 - DNA, 16 bp, H. sapiens
ttgtcacccaagctgg

SEQ ID NO: 167268 - DNA, 17 bp, H. sapiens
ttgtcacccagactgga

SEQ ID NO: 167269 - DNA, 16 bp, H. sapiens
ttgtcacctctcaata

SEQ ID NO: 167270 - DNA, 17 bp, H. sapiens
ttgtcactggttctgtt

SEQ ID NO: 167271 - DNA, 16 bp, H. sapiens
ttgtcactgtctccca

SEQ ID NO: 167272 - DNA, 16 bp, H. sapiens
ttgtcagaaactagaa

SEQ ID NO: 167273 - DNA, 16 bp, H. sapiens
ttgtcagaaatcaatt

SEQ ID NO: 167274 - DNA, 16 bp, H. sapiens
ttgtcagaaatgcaga

SEQ ID NO: 167275 - DNA, 16 bp, H. sapiens
ttgtcagaatcaaaat

SEQ ID NO: 167276 - DNA, 16 bp, H. sapiens
ttgtcagatacaccaa

SEQ ID NO: 167277 - DNA, 16 bp, H. sapiens
ttgtcagtatttttta

SEQ ID NO: 167278 - DNA, 16 bp, H. sapiens
ttgtcagttttgttca

SEQ ID NO: 167279 - DNA, 16 bp, H. sapiens
ttgtcatactgtattg

SEQ ID NO: 167280 - DNA, 16 bp, H. sapiens
ttgtcatcatttattt

SEQ ID NO: 167281 - DNA, 16 bp, H. sapiens
ttgtcatcttcatcat

SEQ ID NO: 167282 - DNA, 16 bp, H. sapiens
ttgtcatgctttaagg

SEQ ID NO: 167283 - DNA, 16 bp, H. sapiens
ttgtcatgtctcctta

SEQ ID NO: 167284 - DNA, 16 bp, H. sapiens
ttgtcattcttcagtt

SEQ ID NO: 167285 - DNA, 16 bp, H. sapiens
ttgtcattctttttaa

SEQ ID NO: 167286 - DNA, 16 bp, H. sapiens
ttgtcatttaaaaata

SEQ ID NO: 167287 - DNA, 17 bp, H. sapiens
ttgtcatttagcattag

SEQ ID NO: 167288 - DNA, 16 bp, H. sapiens
ttgtcatttatttgtg

SEQ ID NO: 167289 - DNA, 16 bp, H. sapiens
ttgtcatttctcttta

SEQ ID NO: 167290 - DNA, 16 bp, H. sapiens
ttgtcatttctgactg

SEQ ID NO: 167291 - DNA, 16 bp, H. sapiens
ttgtcatttgtatatc

SEQ ID NO: 167292 - DNA, 16 bp, H. sapiens
ttgtcatttgtttcaa

SEQ ID NO: 167293 - DNA, 16 bp, H. sapiens
ttgtcattttataaat

SEQ ID NO: 167294 - DNA, 16 bp, H. sapiens
ttgtcatttttaaaat

SEQ ID NO: 167295 - DNA, 16 bp, H. sapiens
ttgtccaagctggtct

SEQ ID NO: 167296 - DNA, 16 bp, H. sapiens
ttgtccaaggccacat

SEQ ID NO: 167297 - DNA, 16 bp, H. sapiens
ttgtccaatcaaagct

SEQ ID NO: 167298 - DNA, 16 bp, H. sapiens
ttgtccagactggtct

SEQ ID NO: 167299 - DNA, 16 bp, H. sapiens
ttgtccaggccttctt

SEQ ID NO: 167300 - DNA, 16 bp, H. sapiens
ttgtccaggctagtct

SEQ ID NO: 167301 - DNA, 16 bp, H. sapiens
ttgtccaggctggtct

SEQ ID NO: 167302 - DNA, 16 bp, H. sapiens
ttgtccaggttgatct

SEQ ID NO: 167303 - DNA, 16 bp, H. sapiens
ttgtccaggttggtct

SEQ ID NO: 167304 - DNA, 16 bp, H. sapiens
ttgtccaggttggttt

SEQ ID NO: 167305 - DNA, 16 bp, H. sapiens
ttgtccatatcaccat

SEQ ID NO: 167306 - DNA, 18 bp, H. sapiens
ttgtccatattgctatca

SEQ ID NO: 167307 - DNA, 16 bp, H. sapiens
ttgtccatggttcctg

SEQ ID NO: 167308 - DNA, 16 bp, H. sapiens
ttgtccatttttgctt

SEQ ID NO: 167309 - DNA, 16 bp, H. sapiens
ttgtccattttttaaa

SEQ ID NO: 167310 - DNA, 16 bp, H. sapiens
ttgtcccaataatgtc

SEQ ID NO: 167311 - DNA, 16 bp, H. sapiens
ttgtccccaaggctgg

SEQ ID NO: 167312 - DNA, 16 bp, H. sapiens
ttgtccctggctcctg

SEQ ID NO: 167313 - DNA, 16 bp, H. sapiens
ttgtcccttcttaaaa

SEQ ID NO: 167314 - DNA, 17 bp, H. sapiens
ttgtcctcattttacag

SEQ ID NO: 167315 - DNA, 16 bp, H. sapiens
ttgtcctgcctctgcc

SEQ ID NO: 167316 - DNA, 16 bp, H. sapiens
ttgtcctgcctttcta

SEQ ID NO: 167317 - DNA, 16 bp, H. sapiens
ttgtcctgttccagtt

SEQ ID NO: 167318 - DNA, 16 bp, H. sapiens
ttgtccttcattcttt

SEQ ID NO: 167319 - DNA, 16 bp, H. sapiens
ttgtccttcctcagcc

SEQ ID NO: 167320 - DNA, 16 bp, H. sapiens
ttgtccttctgtgctt

SEQ ID NO: 167321 - DNA, 16 bp, H. sapiens
ttgtccttctgtgtct

SEQ ID NO: 167322 - DNA, 16 bp, H. sapiens
ttgtccttttttactg

SEQ ID NO: 167323 - DNA, 16 bp, H. sapiens
ttgtcgcccacgctgg

SEQ ID NO: 167324 - DNA, 16 bp, H. sapiens
ttgtctactttttcca

SEQ ID NO: 167325 - DNA, 16 bp, H. sapiens
ttgtctaggctggtct

SEQ ID NO: 167326 - DNA, 16 bp, H. sapiens
ttgtctaggttttctt

SEQ ID NO: 167327 - DNA, 16 bp, H. sapiens
ttgtctcaaacaaaca

SEQ ID NO: 167328 - DNA, 16 bp, H. sapiens
ttgtctcactctgtca

SEQ ID NO: 167329 - DNA, 16 bp, H. sapiens
ttgtctcagaaaaaaa

SEQ ID NO: 167330 - DNA, 16 bp, H. sapiens
ttgtctcagccccaaa

SEQ ID NO: 167331 - DNA, 16 bp, H. sapiens
ttgtctcagcctaaaa

SEQ ID NO: 167332 - DNA, 16 bp, H. sapiens
ttgtctccaaaaacaa

SEQ ID NO: 167333 - DNA, 16 bp, H. sapiens
ttgtctccaaaataaa

SEQ ID NO: 167334 - DNA, 16 bp, H. sapiens
ttgtctccactttttg

SEQ ID NO: 167335 - DNA, 16 bp, H. sapiens
ttgtctcccaggctga

SEQ ID NO: 167336 - DNA, 16 bp, H. sapiens
ttgtctctaccaaaaa

SEQ ID NO: 167337 - DNA, 16 bp, H. sapiens
ttgtctctataaaata

SEQ ID NO: 167338 - DNA, 16 bp, H. sapiens
ttgtctctggtttcag

SEQ ID NO: 167339 - DNA, 16 bp, H. sapiens
ttgtctcttttgatat

SEQ ID NO: 167340 - DNA, 16 bp, H. sapiens
ttgtctgaaaaatatt

SEQ ID NO: 167341 - DNA, 16 bp, H. sapiens
ttgtctgacaggcatt

SEQ ID NO: 167342 - DNA, 16 bp, H. sapiens
ttgtctgaggtcacat

SEQ ID NO: 167343 - DNA, 16 bp, H. sapiens
ttgtctgagttcattg

SEQ ID NO: 167344 - DNA, 16 bp, H. sapiens
ttgtctgatataagtg

SEQ ID NO: 167345 - DNA, 16 bp, H. sapiens
ttgtctgatatttctt

SEQ ID NO: 167346 - DNA, 16 bp, H. sapiens
ttgtctgctaccatgt

SEQ ID NO: 167347 - DNA, 16 bp, H. sapiens
ttgtctggaaaagact

SEQ ID NO: 167348 - DNA, 16 bp, H. sapiens
ttgtctggtttcacag

SEQ ID NO: 167349 - DNA, 16 bp, H. sapiens
ttgtctgtaaaatggg

SEQ ID NO: 167350 - DNA, 16 bp, H. sapiens
ttgtctgtaatcccag

SEQ ID NO: 167351 - DNA, 16 bp, H. sapiens
ttgtctgtctgtctgt

SEQ ID NO: 167352 - DNA, 16 bp, H. sapiens
ttgtctgtgaatgaca

SEQ ID NO: 167353 - DNA, 16 bp, H. sapiens
ttgtctgtggctgctt

SEQ ID NO: 167354 - DNA, 16 bp, H. sapiens
ttgtctgttcatgtcc

SEQ ID NO: 167355 - DNA, 16 bp, H. sapiens
ttgtctgttggctgca

SEQ ID NO: 167356 - DNA, 16 bp, H. sapiens
ttgtctgtttactctg

SEQ ID NO: 167357 - DNA, 16 bp, H. sapiens
ttgtctgttttgagac

SEQ ID NO: 167358 - DNA, 16 bp, H. sapiens
ttgtcttaaaaagaaa

SEQ ID NO: 167359 - DNA, 16 bp, H. sapiens
ttgtcttaagccacta

SEQ ID NO: 167360 - DNA, 16 bp, H. sapiens
ttgtcttagaaaccag

SEQ ID NO: 167361 - DNA, 16 bp, H. sapiens
ttgtcttagtctattt

SEQ ID NO: 167362 - DNA, 16 bp, H. sapiens
ttgtcttagtttgggt

SEQ ID NO: 167363 - DNA, 16 bp, H. sapiens
ttgtcttcaaactctg

SEQ ID NO: 167364 - DNA, 16 bp, H. sapiens
ttgtcttctagaattt

SEQ ID NO: 167365 - DNA, 16 bp, H. sapiens
ttgtcttgaaatccat

SEQ ID NO: 167366 - DNA, 16 bp, H. sapiens
ttgtcttgaactcctg

SEQ ID NO: 167367 - DNA, 16 bp, H. sapiens
ttgtcttgatctcttg

SEQ ID NO: 167368 - DNA, 16 bp, H. sapiens
ttgtcttgctctgtca

SEQ ID NO: 167369 - DNA, 16 bp, H. sapiens
ttgtctttctgcacct

SEQ ID NO: 167370 - DNA, 16 bp, H. sapiens
ttgtctttctgcatct

SEQ ID NO: 167371 - DNA, 16 bp, H. sapiens
ttgtctttctgtgact

SEQ ID NO: 167372 - DNA, 16 bp, H. sapiens
ttgtctttctgtgcct

SEQ ID NO: 167373 - DNA, 16 bp, H. sapiens
ttgtctttgagctctg

SEQ ID NO: 167374 - DNA, 16 bp, H. sapiens
ttgtctttggctacca

SEQ ID NO: 167375 - DNA, 23 bp, H. sapiens
ttgtctttgtagcatttaactct

SEQ ID NO: 167376 - DNA, 16 bp, H. sapiens
ttgtctttgtctttga

SEQ ID NO: 167377 - DNA, 16 bp, H. sapiens
ttgtcttttaaaatga

SEQ ID NO: 167378 - DNA, 16 bp, H. sapiens
ttgtcttttaaaatgt

SEQ ID NO: 167379 - DNA, 16 bp, H. sapiens
ttgtcttttctagctt

SEQ ID NO: 167380 - DNA, 16 bp, H. sapiens
ttgtcttttgaaaatt

SEQ ID NO: 167381 - DNA, 16 bp, H. sapiens
ttgtcttttgagaagt

SEQ ID NO: 167382 - DNA, 16 bp, H. sapiens
ttgtctttttagcaga

SEQ ID NO: 167383 - DNA, 16 bp, H. sapiens
ttgtctttttccagat

SEQ ID NO: 167384 - DNA, 16 bp, H. sapiens
ttgtcttttttaactg

SEQ ID NO: 167385 - DNA, 16 bp, H. sapiens
ttgtctttttttgaga

SEQ ID NO: 167386 - DNA, 16 bp, H. sapiens
ttgtgaaaaacaaaaa

SEQ ID NO: 167387 - DNA, 16 bp, H. sapiens
ttgtgaaaaatcagtt

SEQ ID NO: 167388 - DNA, 16 bp, H. sapiens
ttgtgaaaaatgaaat

SEQ ID NO: 167389 - DNA, 16 bp, H. sapiens
ttgtgaaaaattttaa

SEQ ID NO: 167390 - DNA, 16 bp, H. sapiens
ttgtgaaaaccaaaaa

SEQ ID NO: 167391 - DNA, 16 bp, H. sapiens
ttgtgaaaagcagttt

SEQ ID NO: 167392 - DNA, 16 bp, H. sapiens
ttgtgaaaataaccat

SEQ ID NO: 167393 - DNA, 16 bp, H. sapiens
ttgtgaaaatagtttt

SEQ ID NO: 167394 - DNA, 16 bp, H. sapiens
ttgtgaaaatcaaatg

SEQ ID NO: 167395 - DNA, 16 bp, H. sapiens
ttgtgaaaatggccat

SEQ ID NO: 167396 - DNA, 16 bp, H. sapiens
ttgtgaaaatgttcat

SEQ ID NO: 167397 - DNA, 16 bp, H. sapiens
ttgtgaaaattcatca

SEQ ID NO: 167398 - DNA, 16 bp, H. sapiens
ttgtgaaatcccatct

SEQ ID NO: 167399 - DNA, 16 bp, H. sapiens
ttgtgaaattcctttt

SEQ ID NO: 167400 - DNA, 16 bp, H. sapiens
ttgtgaacactgctgc

SEQ ID NO: 167401 - DNA, 16 bp, H. sapiens
ttgtgaacagtgctac

SEQ ID NO: 167402 - DNA, 16 bp, H. sapiens
ttgtgaacagtgttgc

SEQ ID NO: 167403 - DNA, 16 bp, H. sapiens
ttgtgaactgcacacg

SEQ ID NO: 167404 - DNA, 16 bp, H. sapiens
ttgtgaagaaggtgac

SEQ ID NO: 167405 - DNA, 16 bp, H. sapiens
ttgtgaagatcaaatg

SEQ ID NO: 167406 - DNA, 16 bp, H. sapiens
ttgtgaagatgaaata

SEQ ID NO: 167407 - DNA, 16 bp, H. sapiens
ttgtgaataatgctgc

SEQ ID NO: 167408 - DNA, 16 bp, H. sapiens
ttgtgaatagagctgc

SEQ ID NO: 167409 - DNA, 16 bp, H. sapiens
ttgtgaatagcacagt

SEQ ID NO: 167410 - DNA, 16 bp, H. sapiens
ttgtgaatattttttc

SEQ ID NO: 167411 - DNA, 16 bp, H. sapiens
ttgtgaatgggagatc

SEQ ID NO: 167412 - DNA, 16 bp, H. sapiens
ttgtgaatggtgctac

SEQ ID NO: 167413 - DNA, 16 bp, H. sapiens
ttgtgaatgtaaagga

SEQ ID NO: 167414 - DNA, 16 bp, H. sapiens
ttgtgaattgtgcatg

SEQ ID NO: 167415 - DNA, 16 bp, H. sapiens
ttgtgacaaccaaaaa

SEQ ID NO: 167416 - DNA, 16 bp, H. sapiens
ttgtgacaatatggat

SEQ ID NO: 167417 - DNA, 16 bp, H. sapiens
ttgtgacaatgaaaaa

SEQ ID NO: 167418 - DNA, 16 bp, H. sapiens
ttgtgacatatttctg

SEQ ID NO: 167419 - DNA, 16 bp, H. sapiens
ttgtgacattctctgt

SEQ ID NO: 167420 - DNA, 16 bp, H. sapiens
ttgtgacattttcctg

SEQ ID NO: 167421 - DNA, 16 bp, H. sapiens
ttgtgaccttgagcaa

SEQ ID NO: 167422 - DNA, 16 bp, H. sapiens
ttgtgacttacacaga

SEQ ID NO: 167423 - DNA, 16 bp, H. sapiens
ttgtgacttgctttgg

SEQ ID NO: 167424 - DNA, 16 bp, H. sapiens
ttgtgagaaaatattt

SEQ ID NO: 167425 - DNA, 16 bp, H. sapiens
ttgtgagacagtgtct

SEQ ID NO: 167426 - DNA, 16 bp, H. sapiens
ttgtgagagttaaatg

SEQ ID NO: 167427 - DNA, 16 bp, H. sapiens
ttgtgagccactgcac

SEQ ID NO: 167428 - DNA, 16 bp, H. sapiens
ttgtgaggagtaaatg

SEQ ID NO: 167429 - DNA, 16 bp, H. sapiens
ttgtgaggatgaaata

SEQ ID NO: 167430 - DNA, 16 bp, H. sapiens
ttgtgaggatgaaatg

SEQ ID NO: 167431 - DNA, 16 bp, H. sapiens
ttgtgaggatttaatg

SEQ ID NO: 167432 - DNA, 16 bp, H. sapiens
ttgtgaggccacccca

SEQ ID NO: 167433 - DNA, 16 bp, H. sapiens
ttgtgagtacatagta

SEQ ID NO: 167434 - DNA, 16 bp, H. sapiens
ttgtgagtttgtcata

SEQ ID NO: 167435 - DNA, 16 bp, H. sapiens
ttgtgataatcatttc

SEQ ID NO: 167436 - DNA, 16 bp, H. sapiens
ttgtgataattaaata

SEQ ID NO: 167437 - DNA, 16 bp, H. sapiens
ttgtgatagtgaatat

SEQ ID NO: 167438 - DNA, 16 bp, H. sapiens
ttgtgatatatatata

SEQ ID NO: 167439 - DNA, 16 bp, H. sapiens
ttgtgatatattcata

SEQ ID NO: 167440 - DNA, 16 bp, H. sapiens
ttgtgatggtgatgat

SEQ ID NO: 167441 - DNA, 16 bp, H. sapiens
ttgtgatggtgctttt

SEQ ID NO: 167442 - DNA, 16 bp, H. sapiens
ttgtgatgtgtggatt

SEQ ID NO: 167443 - DNA, 16 bp, H. sapiens
ttgtgatgtgtgtact

SEQ ID NO: 167444 - DNA, 16 bp, H. sapiens
ttgtgatgttagattg

SEQ ID NO: 167445 - DNA, 16 bp, H. sapiens
ttgtgattgcattgtg

SEQ ID NO: 167446 - DNA, 16 bp, H. sapiens
ttgtgattttggtaca

SEQ ID NO: 167447 - DNA, 16 bp, H. sapiens
ttgtgatttttaacat

SEQ ID NO: 167448 - DNA, 16 bp, H. sapiens
ttgtgatttttgcata

SEQ ID NO: 167449 - DNA, 16 bp, H. sapiens
ttgtgcaaccactacc

SEQ ID NO: 167450 - DNA, 16 bp, H. sapiens
ttgtgcacccatcacc

SEQ ID NO: 167451 - DNA, 16 bp, H. sapiens
ttgtgcagaaactttt

SEQ ID NO: 167452 - DNA, 16 bp, H. sapiens
ttgtgcagcaggcagg

SEQ ID NO: 167453 - DNA, 16 bp, H. sapiens
ttgtgcaggctgtaca

SEQ ID NO: 167454 - DNA, 16 bp, H. sapiens
ttgtgcatcaaaagat

SEQ ID NO: 167455 - DNA, 16 bp, H. sapiens
ttgtgcatcaaagaac

SEQ ID NO: 167456 - DNA, 16 bp, H. sapiens
ttgtgcatgaataatt

SEQ ID NO: 167457 - DNA, 16 bp, H. sapiens
ttgtgccactgcactt

SEQ ID NO: 167458 - DNA, 16 bp, H. sapiens
ttgtgcccaggagttc

SEQ ID NO: 167459 - DNA, 16 bp, H. sapiens
ttgtgccctcttttat

SEQ ID NO: 167460 - DNA, 16 bp, H. sapiens
ttgtgccctgccccca

SEQ ID NO: 167461 - DNA, 16 bp, H. sapiens
ttgtgcctcagccccc

SEQ ID NO: 167462 - DNA, 22 bp, H. sapiens
ttgtgcctcagcctcccgagta

SEQ ID NO: 167463 - DNA, 16 bp, H. sapiens
ttgtgcctcagccttt

SEQ ID NO: 167464 - DNA, 16 bp, H. sapiens
ttgtgcctcagtgtcc

SEQ ID NO: 167465 - DNA, 16 bp, H. sapiens
ttgtgcctcagtttcc

SEQ ID NO: 167466 - DNA, 16 bp, H. sapiens
ttgtgccttggttttc

SEQ ID NO: 167467 - DNA, 16 bp, H. sapiens
ttgtgctattattgtt

SEQ ID NO: 167468 - DNA, 16 bp, H. sapiens
ttgtgctgcccccact

SEQ ID NO: 167469 - DNA, 16 bp, H. sapiens
ttgtgctggtttttaa

SEQ ID NO: 167470 - DNA, 16 bp, H. sapiens
ttgtgctgtgtgcatt

SEQ ID NO: 167471 - DNA, 16 bp, H. sapiens
ttgtgcttccctggtg

SEQ ID NO: 167472 - DNA, 16 bp, H. sapiens
ttgtgctttaaaaaaa

SEQ ID NO: 167473 - DNA, 16 bp, H. sapiens
ttgtgcttttgatttg

SEQ ID NO: 167474 - DNA, 16 bp, H. sapiens
ttgtggaaaatttcaa

SEQ ID NO: 167475 - DNA, 16 bp, H. sapiens
ttgtggaactttaaac

SEQ ID NO: 167476 - DNA, 16 bp, H. sapiens
ttgtggaagaaaattt

SEQ ID NO: 167477 - DNA, 16 bp, H. sapiens
ttgtggaagacagttt

SEQ ID NO: 167478 - DNA, 16 bp, H. sapiens
ttgtggaagggaaaag

SEQ ID NO: 167479 - DNA, 16 bp, H. sapiens
ttgtggaagggacctg

SEQ ID NO: 167480 - DNA, 16 bp, H. sapiens
ttgtggaatagtgtca

SEQ ID NO: 167481 - DNA, 16 bp, H. sapiens
ttgtggaatttgcaag

SEQ ID NO: 167482 - DNA, 16 bp, H. sapiens
ttgtggagaaaaataa

SEQ ID NO: 167483 - DNA, 16 bp, H. sapiens
ttgtggagaacagggt

SEQ ID NO: 167484 - DNA, 16 bp, H. sapiens
ttgtggaggacagtgt

SEQ ID NO: 167485 - DNA, 16 bp, H. sapiens
ttgtggatgacagtgt

SEQ ID NO: 167486 - DNA, 16 bp, H. sapiens
ttgtggcagaaggtga

SEQ ID NO: 167487 - DNA, 16 bp, H. sapiens
ttgtggcatgtgcctg

SEQ ID NO: 167488 - DNA, 16 bp, H. sapiens
ttgtggcattttaaaa

SEQ ID NO: 167489 - DNA, 16 bp, H. sapiens
ttgtggccatctttgg

SEQ ID NO: 167490 - DNA, 16 bp, H. sapiens
ttgtggcctctggctg

SEQ ID NO: 167491 - DNA, 16 bp, H. sapiens
ttgtggctcatgcctg

SEQ ID NO: 167492 - DNA, 16 bp, H. sapiens
ttgtggctttgatttg

SEQ ID NO: 167493 - DNA, 16 bp, H. sapiens
ttgtgggccagctgga

SEQ ID NO: 167494 - DNA, 16 bp, H. sapiens
ttgtggggggaaaaaa

SEQ ID NO: 167495 - DNA, 16 bp, H. sapiens
ttgtggtatattcata

SEQ ID NO: 167496 - DNA, 16 bp, H. sapiens
ttgtggtcccagctac

SEQ ID NO: 167497 - DNA, 16 bp, H. sapiens
ttgtggtctgaaaaga

SEQ ID NO: 167498 - DNA, 16 bp, H. sapiens
ttgtggtcttgctgac

SEQ ID NO: 167499 - DNA, 16 bp, H. sapiens
ttgtggtgaatgctgc

SEQ ID NO: 167500 - DNA, 16 bp, H. sapiens
ttgtggtggcatgtgc

SEQ ID NO: 167501 - DNA, 16 bp, H. sapiens
ttgtggtgttctctct

SEQ ID NO: 167502 - DNA, 16 bp, H. sapiens
ttgtggttcccataat

SEQ ID NO: 167503 - DNA, 16 bp, H. sapiens
ttgtggtttctatttg

SEQ ID NO: 167504 - DNA, 16 bp, H. sapiens
ttgtggtttgagtgcc

SEQ ID NO: 167505 - DNA, 16 bp, H. sapiens
ttgtggttttatctac

SEQ ID NO: 167506 - DNA, 16 bp, H. sapiens
ttgtggttttcattta

SEQ ID NO: 167507 - DNA, 16 bp, H. sapiens
ttgtggtttttaaaaa

SEQ ID NO: 167508 - DNA, 16 bp, H. sapiens
ttgtgtaaccatcact

SEQ ID NO: 167509 - DNA, 16 bp, H. sapiens
ttgtgtacaagttttt

SEQ ID NO: 167510 - DNA, 16 bp, H. sapiens
ttgtgtacatatatat

SEQ ID NO: 167511 - DNA, 16 bp, H. sapiens
ttgtgtactttaaaat

SEQ ID NO: 167512 - DNA, 16 bp, H. sapiens
ttgtgtacttttaaaa

SEQ ID NO: 167513 - DNA, 16 bp, H. sapiens
ttgtgtagatagttgt

SEQ ID NO: 167514 - DNA, 16 bp, H. sapiens
ttgtgtagtatcttgc

SEQ ID NO: 167515 - DNA, 16 bp, H. sapiens
ttgtgtatatacatat

SEQ ID NO: 167516 - DNA, 16 bp, H. sapiens
ttgtgtatatatgtgt

SEQ ID NO: 167517 - DNA, 16 bp, H. sapiens
ttgtgtatatttaaag

SEQ ID NO: 167518 - DNA, 16 bp, H. sapiens
ttgtgtattctccttc

SEQ ID NO: 167519 - DNA, 16 bp, H. sapiens
ttgtgtatttagaaaa

SEQ ID NO: 167520 - DNA, 16 bp, H. sapiens
ttgtgtcagttttcaa

SEQ ID NO: 167521 - DNA, 16 bp, H. sapiens
ttgtgtcatctgattt

SEQ ID NO: 167522 - DNA, 16 bp, H. sapiens
ttgtgtcccagccact

SEQ ID NO: 167523 - DNA, 16 bp, H. sapiens
ttgtgtcccaggctgg

SEQ ID NO: 167524 - DNA, 16 bp, H. sapiens
ttgtgtccccacaaaa

SEQ ID NO: 167525 - DNA, 18 bp, H. sapiens
ttgtgtccccacccaaat

SEQ ID NO: 167526 - DNA, 16 bp, H. sapiens
ttgtgtccccccaaaa

SEQ ID NO: 167527 - DNA, 16 bp, H. sapiens
ttgtgtcctttcttat

SEQ ID NO: 167528 - DNA, 16 bp, H. sapiens
ttgtgtcctttgacca

SEQ ID NO: 167529 - DNA, 16 bp, H. sapiens
ttgtgtccttttcaat

SEQ ID NO: 167530 - DNA, 16 bp, H. sapiens
ttgtgtctctttgatt

SEQ ID NO: 167531 - DNA, 16 bp, H. sapiens
ttgtgtctgttggctg

SEQ ID NO: 167532 - DNA, 16 bp, H. sapiens
ttgtgtctttaatttc

SEQ ID NO: 167533 - DNA, 16 bp, H. sapiens
ttgtgtcttttaagaa

SEQ ID NO: 167534 - DNA, 16 bp, H. sapiens
ttgtgtgaacatcata

SEQ ID NO: 167535 - DNA, 16 bp, H. sapiens
ttgtgtgaatgtatgt

SEQ ID NO: 167536 - DNA, 16 bp, H. sapiens
ttgtgtgaattaaatg

SEQ ID NO: 167537 - DNA, 16 bp, H. sapiens
ttgtgtgacttacttt

SEQ ID NO: 167538 - DNA, 16 bp, H. sapiens
ttgtgtgatctcagct

SEQ ID NO: 167539 - DNA, 16 bp, H. sapiens
ttgtgtgtacatatgt

SEQ ID NO: 167540 - DNA, 16 bp, H. sapiens
ttgtgtgtatatatgt

SEQ ID NO: 167541 - DNA, 16 bp, H. sapiens
ttgtgtgtctgtatgt

SEQ ID NO: 167542 - DNA, 16 bp, H. sapiens
ttgtgtgtgcatgcat

SEQ ID NO: 167543 - DNA, 16 bp, H. sapiens
ttgtgtgtgcatgtgt

SEQ ID NO: 167544 - DNA, 16 bp, H. sapiens
ttgtgtgtgtgcatgt

SEQ ID NO: 167545 - DNA, 16 bp, H. sapiens
ttgtgtgtgtgcctgc

SEQ ID NO: 167546 - DNA, 16 bp, H. sapiens
ttgtgtgtgtgtgcat

SEQ ID NO: 167547 - DNA, 16 bp, H. sapiens
ttgtgtgtgtgtgtaa

SEQ ID NO: 167548 - DNA, 16 bp, H. sapiens
ttgtgttgccataaca

SEQ ID NO: 167549 - DNA, 16 bp, H. sapiens
ttgtgttgcccaggct

SEQ ID NO: 167550 - DNA, 16 bp, H. sapiens
ttgtgttgctataaag

SEQ ID NO: 167551 - DNA, 16 bp, H. sapiens
ttgtgttgggaatatt

SEQ ID NO: 167552 - DNA, 16 bp, H. sapiens
ttgtgttgtacagttc

SEQ ID NO: 167553 - DNA, 16 bp, H. sapiens
ttgtgtttcccccaaa

SEQ ID NO: 167554 - DNA, 16 bp, H. sapiens
ttgtgtttccctaatg

SEQ ID NO: 167555 - DNA, 16 bp, H. sapiens
ttgtgtttctagtaga

SEQ ID NO: 167556 - DNA, 16 bp, H. sapiens
ttgtgtttctgccagg

SEQ ID NO: 167557 - DNA, 16 bp, H. sapiens
ttgtgtttcttttcca

SEQ ID NO: 167558 - DNA, 16 bp, H. sapiens
ttgtgtttgattttca

SEQ ID NO: 167559 - DNA, 16 bp, H. sapiens
ttgtgttttaaaataa

SEQ ID NO: 167560 - DNA, 16 bp, H. sapiens
ttgtgttttaaaatgt

SEQ ID NO: 167561 - DNA, 16 bp, H. sapiens
ttgtgttttatcttaa

SEQ ID NO: 167562 - DNA, 16 bp, H. sapiens
ttgtgttttcattctc

SEQ ID NO: 167563 - DNA, 16 bp, H. sapiens
ttgtgttttctaaatt

SEQ ID NO: 167564 - DNA, 16 bp, H. sapiens
ttgtgtttttaatgga

SEQ ID NO: 167565 - DNA, 16 bp, H. sapiens
ttgtgtttttttccaa

SEQ ID NO: 167566 - DNA, 16 bp, H. sapiens
ttgttaaaaacatgtt

SEQ ID NO: 167567 - DNA, 16 bp, H. sapiens
ttgttaaaaatgcaca

SEQ ID NO: 167568 - DNA, 16 bp, H. sapiens
ttgttaaaaatgcaga

SEQ ID NO: 167569 - DNA, 16 bp, H. sapiens
ttgttaaaaatgtcca

SEQ ID NO: 167570 - DNA, 16 bp, H. sapiens
ttgttaaaacattaaa

SEQ ID NO: 167571 - DNA, 16 bp, H. sapiens
ttgttaaaacttgttt

SEQ ID NO: 167572 - DNA, 16 bp, H. sapiens
ttgttaaaatgcaaat

SEQ ID NO: 167573 - DNA, 16 bp, H. sapiens
ttgttaaaatgcagat

SEQ ID NO: 167574 - DNA, 16 bp, H. sapiens
ttgttaaaattgcttt

SEQ ID NO: 167575 - DNA, 16 bp, H. sapiens
ttgttaaacaaataaa

SEQ ID NO: 167576 - DNA, 16 bp, H. sapiens
ttgttaaacaaatgaa

SEQ ID NO: 167577 - DNA, 16 bp, H. sapiens
ttgttaaaccacagat

SEQ ID NO: 167578 - DNA, 16 bp, H. sapiens
ttgttaaactttttaa

SEQ ID NO: 167579 - DNA, 16 bp, H. sapiens
ttgttaaaggcctttt

SEQ ID NO: 167580 - DNA, 16 bp, H. sapiens
ttgttaaataaatgca

SEQ ID NO: 167581 - DNA, 16 bp, H. sapiens
ttgttaaataatttct

SEQ ID NO: 167582 - DNA, 16 bp, H. sapiens
ttgttaactatagtca

SEQ ID NO: 167583 - DNA, 16 bp, H. sapiens
ttgttaatggacattt

SEQ ID NO: 167584 - DNA, 16 bp, H. sapiens
ttgttaattttctgac

SEQ ID NO: 167585 - DNA, 17 bp, H. sapiens
ttgttaattttctgtct

SEQ ID NO: 167586 - DNA, 16 bp, H. sapiens
ttgttacaatcagtga

SEQ ID NO: 167587 - DNA, 16 bp, H. sapiens
ttgttacactgtattg

SEQ ID NO: 167588 - DNA, 16 bp, H. sapiens
ttgttacagaaaaaaa

SEQ ID NO: 167589 - DNA, 16 bp, H. sapiens
ttgttacagcagcaca

SEQ ID NO: 167590 - DNA, 16 bp, H. sapiens
ttgttacatagttaaa

SEQ ID NO: 167591 - DNA, 16 bp, H. sapiens
ttgttacatatgttta

SEQ ID NO: 167592 - DNA, 16 bp, H. sapiens
ttgttacatggacata

SEQ ID NO: 167593 - DNA, 16 bp, H. sapiens
ttgttacatgggtaaa

SEQ ID NO: 167594 - DNA, 16 bp, H. sapiens
ttgttactgatttcta

SEQ ID NO: 167595 - DNA, 16 bp, H. sapiens
ttgttactgtgaatag

SEQ ID NO: 167596 - DNA, 16 bp, H. sapiens
ttgttagaaaagaaaa

SEQ ID NO: 167597 - DNA, 16 bp, H. sapiens
ttgttagaaatacaga

SEQ ID NO: 167598 - DNA, 16 bp, H. sapiens
ttgttagaaatgtaaa

SEQ ID NO: 167599 - DNA, 16 bp, H. sapiens
ttgttagaaattcaga

SEQ ID NO: 167600 - DNA, 16 bp, H. sapiens
ttgttagaactgataa

SEQ ID NO: 167601 - DNA, 16 bp, H. sapiens
ttgttagtagagatgg

SEQ ID NO: 167602 - DNA, 16 bp, H. sapiens
ttgttataaaaatgag

SEQ ID NO: 167603 - DNA, 16 bp, H. sapiens
ttgttataattgatga

SEQ ID NO: 167604 - DNA, 17 bp, H. sapiens
ttgttataatttctgtt

SEQ ID NO: 167605 - DNA, 16 bp, H. sapiens
ttgttatataggtaaa

SEQ ID NO: 167606 - DNA, 16 bp, H. sapiens
ttgttatccctatttt

SEQ ID NO: 167607 - DNA, 16 bp, H. sapiens
ttgttatctctcttct

SEQ ID NO: 167608 - DNA, 16 bp, H. sapiens
ttgttatctgaaattc

SEQ ID NO: 167609 - DNA, 16 bp, H. sapiens
ttgttatctgtgcttt

SEQ ID NO: 167610 - DNA, 16 bp, H. sapiens
ttgttatgagaatgaa

SEQ ID NO: 167611 - DNA, 16 bp, H. sapiens
ttgttatgcagcaata

SEQ ID NO: 167612 - DNA, 16 bp, H. sapiens
ttgttattaccatttt

SEQ ID NO: 167613 - DNA, 17 bp, H. sapiens
ttgttattctttactcc

SEQ ID NO: 167614 - DNA, 16 bp, H. sapiens
ttgttattgagttgta

SEQ ID NO: 167615 - DNA, 16 bp, H. sapiens
ttgttattttagtaga

SEQ ID NO: 167616 - DNA, 16 bp, H. sapiens
ttgttatttttagaga

SEQ ID NO: 167617 - DNA, 16 bp, H. sapiens
ttgttatttttcaaaa

SEQ ID NO: 167618 - DNA, 16 bp, H. sapiens
ttgttatttttgcaca

SEQ ID NO: 167619 - DNA, 16 bp, H. sapiens
ttgttcaaaaaagaaa

SEQ ID NO: 167620 - DNA, 16 bp, H. sapiens
ttgttcaaaatgccaa

SEQ ID NO: 167621 - DNA, 16 bp, H. sapiens
ttgttcaacctcagct

SEQ ID NO: 167622 - DNA, 16 bp, H. sapiens
ttgttcaactcccact

SEQ ID NO: 167623 - DNA, 17 bp, H. sapiens
ttgttcaagaccagcct

SEQ ID NO: 167624 - DNA, 16 bp, H. sapiens
ttgttcaatgcccacc

SEQ ID NO: 167625 - DNA, 16 bp, H. sapiens
ttgttcacagtattct

SEQ ID NO: 167626 - DNA, 16 bp, H. sapiens
ttgttcaccactatat

SEQ ID NO: 167627 - DNA, 16 bp, H. sapiens
ttgttcactgttgtat

SEQ ID NO: 167628 - DNA, 16 bp, H. sapiens
ttgttcacttatctgc

SEQ ID NO: 167629 - DNA, 16 bp, H. sapiens
ttgttcaggctggagt

SEQ ID NO: 167630 - DNA, 16 bp, H. sapiens
ttgttcaggctggtct

SEQ ID NO: 167631 - DNA, 16 bp, H. sapiens
ttgttcaggctgttct

SEQ ID NO: 167632 - DNA, 16 bp, H. sapiens
ttgttcagtttctatg

SEQ ID NO: 167633 - DNA, 16 bp, H. sapiens
ttgttcagttttcatg

SEQ ID NO: 167634 - DNA, 16 bp, H. sapiens
ttgttcatcattgtat

SEQ ID NO: 167635 - DNA, 16 bp, H. sapiens
ttgttcatctctgtat

SEQ ID NO: 167636 - DNA, 16 bp, H. sapiens
ttgttcattttgaaaa

SEQ ID NO: 167637 - DNA, 16 bp, H. sapiens
ttgttccacatcttca

SEQ ID NO: 167638 - DNA, 16 bp, H. sapiens
ttgttccacctcagct

SEQ ID NO: 167639 - DNA, 16 bp, H. sapiens
ttgttccagatcttaa

SEQ ID NO: 167640 - DNA, 16 bp, H. sapiens
ttgttccagcactgtt

SEQ ID NO: 167641 - DNA, 16 bp, H. sapiens
ttgttccatttgcttt

SEQ ID NO: 167642 - DNA, 16 bp, H. sapiens
ttgttcccagaccaaa

SEQ ID NO: 167643 - DNA, 16 bp, H. sapiens
ttgttcccagtcttag

SEQ ID NO: 167644 - DNA, 16 bp, H. sapiens
ttgttcccttccctgt

SEQ ID NO: 167645 - DNA, 16 bp, H. sapiens
ttgttcccttctttat

SEQ ID NO: 167646 - DNA, 16 bp, H. sapiens
ttgttcccttgctgga

SEQ ID NO: 167647 - DNA, 16 bp, H. sapiens
ttgttccgatctaatt

SEQ ID NO: 167648 - DNA, 16 bp, H. sapiens
ttgttcctgttgccca

SEQ ID NO: 167649 - DNA, 16 bp, H. sapiens
ttgttccttcctctgg

SEQ ID NO: 167650 - DNA, 16 bp, H. sapiens
ttgttcctttccacat

SEQ ID NO: 167651 - DNA, 16 bp, H. sapiens
ttgttctattataaag

SEQ ID NO: 167652 - DNA, 16 bp, H. sapiens
ttgttctattgctggt

SEQ ID NO: 167653 - DNA, 16 bp, H. sapiens
ttgttctcatgacagt

SEQ ID NO: 167654 - DNA, 16 bp, H. sapiens
ttgttctctctgcctg

SEQ ID NO: 167655 - DNA, 16 bp, H. sapiens
ttgttctctgacctgg

SEQ ID NO: 167656 - DNA, 16 bp, H. sapiens
ttgttctctggcccct

SEQ ID NO: 167657 - DNA, 16 bp, H. sapiens
ttgttctgcagcctcc

SEQ ID NO: 167658 - DNA, 16 bp, H. sapiens
ttgttctgtggcccag

SEQ ID NO: 167659 - DNA, 16 bp, H. sapiens
ttgttctgtttcccag

SEQ ID NO: 167660 - DNA, 16 bp, H. sapiens
ttgttcttctctttca

SEQ ID NO: 167661 - DNA, 16 bp, H. sapiens
ttgttcttcttttcaa

SEQ ID NO: 167662 - DNA, 16 bp, H. sapiens
ttgttctttaaatatt

SEQ ID NO: 167663 - DNA, 16 bp, H. sapiens
ttgttctttataaatt

SEQ ID NO: 167664 - DNA, 16 bp, H. sapiens
ttgttctttcagatgt

SEQ ID NO: 167665 - DNA, 16 bp, H. sapiens
ttgttctttcatttcc

SEQ ID NO: 167666 - DNA, 16 bp, H. sapiens
ttgttctttctgatgt

SEQ ID NO: 167667 - DNA, 16 bp, H. sapiens
ttgttcttttcttaaa

SEQ ID NO: 167668 - DNA, 16 bp, H. sapiens
ttgttcttttttaaga

SEQ ID NO: 167669 - DNA, 16 bp, H. sapiens
ttgttgaaaacaaaat

SEQ ID NO: 167670 - DNA, 16 bp, H. sapiens
ttgttgaaaagattgt

SEQ ID NO: 167671 - DNA, 16 bp, H. sapiens
ttgttgaaatttaaaa

SEQ ID NO: 167672 - DNA, 16 bp, H. sapiens
ttgttgaacttcttgg

SEQ ID NO: 167673 - DNA, 16 bp, H. sapiens
ttgttgaataaataaa

SEQ ID NO: 167674 - DNA, 16 bp, H. sapiens
ttgttgaataaattaa

SEQ ID NO: 167675 - DNA, 16 bp, H. sapiens
ttgttgaatgaatgaa

SEQ ID NO: 167676 - DNA, 16 bp, H. sapiens
ttgttgaatgagtgaa

SEQ ID NO: 167677 - DNA, 16 bp, H. sapiens
ttgttgaatggctttg

SEQ ID NO: 167678 - DNA, 16 bp, H. sapiens
ttgttgaatttatgag

SEQ ID NO: 167679 - DNA, 16 bp, H. sapiens
ttgttgaattttttca

SEQ ID NO: 167680 - DNA, 16 bp, H. sapiens
ttgttgatgatatgat

SEQ ID NO: 167681 - DNA, 16 bp, H. sapiens
ttgttgcaaatgacag

SEQ ID NO: 167682 - DNA, 16 bp, H. sapiens
ttgttgcagagctgag

SEQ ID NO: 167683 - DNA, 16 bp, H. sapiens
ttgttgccagcagacc

SEQ ID NO: 167684 - DNA, 17 bp, H. sapiens
ttgttgcccaggctggt

SEQ ID NO: 167685 - DNA, 16 bp, H. sapiens
ttgttgcccagggtgg

SEQ ID NO: 167686 - DNA, 16 bp, H. sapiens
ttgttgcccaggttgg

SEQ ID NO: 167687 - DNA, 16 bp, H. sapiens
ttgttgcctgggctgg

SEQ ID NO: 167688 - DNA, 16 bp, H. sapiens
ttgttgctattataaa

SEQ ID NO: 167689 - DNA, 16 bp, H. sapiens
ttgttgctcaggctgg

SEQ ID NO: 167690 - DNA, 16 bp, H. sapiens
ttgttgctgctgctgc

SEQ ID NO: 167691 - DNA, 16 bp, H. sapiens
ttgttgctttaaaaaa

SEQ ID NO: 167692 - DNA, 16 bp, H. sapiens
ttgttggaaactggag

SEQ ID NO: 167693 - DNA, 16 bp, H. sapiens
ttgttggaaatgtaaa

SEQ ID NO: 167694 - DNA, 16 bp, H. sapiens
ttgttggcagcataaa

SEQ ID NO: 167695 - DNA, 16 bp, H. sapiens
ttgttggcatatattt

SEQ ID NO: 167696 - DNA, 16 bp, H. sapiens
ttgttggccaggctgg

SEQ ID NO: 167697 - DNA, 16 bp, H. sapiens
ttgttggctgcatgta

SEQ ID NO: 167698 - DNA, 16 bp, H. sapiens
ttgttgggaaaactgg

SEQ ID NO: 167699 - DNA, 16 bp, H. sapiens
ttgttgggaactgaag

SEQ ID NO: 167700 - DNA, 18 bp, H. sapiens
ttgttgggaattggagca

SEQ ID NO: 167701 - DNA, 16 bp, H. sapiens
ttgttgggattacagg

SEQ ID NO: 167702 - DNA, 16 bp, H. sapiens
ttgttggtggcattaa

SEQ ID NO: 167703 - DNA, 16 bp, H. sapiens
ttgttgtaaagatcaa

SEQ ID NO: 167704 - DNA, 16 bp, H. sapiens
ttgttgtagagatggg

SEQ ID NO: 167705 - DNA, 16 bp, H. sapiens
ttgttgtcagagaaga

SEQ ID NO: 167706 - DNA, 16 bp, H. sapiens
ttgttgtccaggctgg

SEQ ID NO: 167707 - DNA, 16 bp, H. sapiens
ttgttgtcccctactt

SEQ ID NO: 167708 - DNA, 16 bp, H. sapiens
ttgttgtgaggattaa

SEQ ID NO: 167709 - DNA, 16 bp, H. sapiens
ttgttgtgtctgtgcc

SEQ ID NO: 167710 - DNA, 16 bp, H. sapiens
ttgttgttctgcagcc

SEQ ID NO: 167711 - DNA, 16 bp, H. sapiens
ttgttgttgatgatga

SEQ ID NO: 167712 - DNA, 16 bp, H. sapiens
ttgttgttgctgttat

SEQ ID NO: 167713 - DNA, 16 bp, H. sapiens
ttgttgttgctgttga

SEQ ID NO: 167714 - DNA, 16 bp, H. sapiens
ttgttgttggagatgg

SEQ ID NO: 167715 - DNA, 16 bp, H. sapiens
ttgttgttgttaaata

SEQ ID NO: 167716 - DNA, 16 bp, H. sapiens
ttgttgttgttgaaag

SEQ ID NO: 167717 - DNA, 18 bp, H. sapiens
ttgttgtttcctgacttt

SEQ ID NO: 167718 - DNA, 16 bp, H. sapiens
ttgttgttttaaacca

SEQ ID NO: 167719 - DNA, 16 bp, H. sapiens
ttgttgtttttaaaga

SEQ ID NO: 167720 - DNA, 16 bp, H. sapiens
ttgttgtttttaacaa

SEQ ID NO: 167721 - DNA, 16 bp, H. sapiens
ttgtttaaaaaaagag

SEQ ID NO: 167722 - DNA, 16 bp, H. sapiens
ttgtttaaaaattact

SEQ ID NO: 167723 - DNA, 16 bp, H. sapiens
ttgtttaaaagaaaat

SEQ ID NO: 167724 - DNA, 16 bp, H. sapiens
ttgtttaaataaaatg

SEQ ID NO: 167725 - DNA, 16 bp, H. sapiens
ttgtttaaataaactt

SEQ ID NO: 167726 - DNA, 16 bp, H. sapiens
ttgtttaaattcattt

SEQ ID NO: 167727 - DNA, 16 bp, H. sapiens
ttgtttaagccatcca

SEQ ID NO: 167728 - DNA, 16 bp, H. sapiens
ttgtttaagctaccta

SEQ ID NO: 167729 - DNA, 16 bp, H. sapiens
ttgtttaatttacatg

SEQ ID NO: 167730 - DNA, 16 bp, H. sapiens
ttgtttacaaaatttt

SEQ ID NO: 167731 - DNA, 16 bp, H. sapiens
ttgtttacacacacac

SEQ ID NO: 167732 - DNA, 16 bp, H. sapiens
ttgtttacacattttt

SEQ ID NO: 167733 - DNA, 16 bp, H. sapiens
ttgtttacaccagcat

SEQ ID NO: 167734 - DNA, 16 bp, H. sapiens
ttgtttacattttaaa

SEQ ID NO: 167735 - DNA, 16 bp, H. sapiens
ttgtttacccattcat

SEQ ID NO: 167736 - DNA, 16 bp, H. sapiens
ttgtttactcatttat

SEQ ID NO: 167737 - DNA, 16 bp, H. sapiens
ttgtttagtctttcta

SEQ ID NO: 167738 - DNA, 16 bp, H. sapiens
ttgtttataagccaca

SEQ ID NO: 167739 - DNA, 16 bp, H. sapiens
ttgtttataatagcaa

SEQ ID NO: 167740 - DNA, 16 bp, H. sapiens
ttgtttatagagacag

SEQ ID NO: 167741 - DNA, 16 bp, H. sapiens
ttgtttatattttcaa

SEQ ID NO: 167742 - DNA, 16 bp, H. sapiens
ttgtttatcagttcaa

SEQ ID NO: 167743 - DNA, 16 bp, H. sapiens
ttgtttatccactcac

SEQ ID NO: 167744 - DNA, 16 bp, H. sapiens
ttgtttatcccttcat

SEQ ID NO: 167745 - DNA, 16 bp, H. sapiens
ttgtttatctgaaatt

SEQ ID NO: 167746 - DNA, 16 bp, H. sapiens
ttgtttatcttttgaa

SEQ ID NO: 167747 - DNA, 16 bp, H. sapiens
ttgtttatgagttcta

SEQ ID NO: 167748 - DNA, 16 bp, H. sapiens
ttgtttatggtgtgag

SEQ ID NO: 167749 - DNA, 16 bp, H. sapiens
ttgtttattcattcag

SEQ ID NO: 167750 - DNA, 16 bp, H. sapiens
ttgtttattcattctc

SEQ ID NO: 167751 - DNA, 16 bp, H. sapiens
ttgtttatttctgaaa

SEQ ID NO: 167752 - DNA, 16 bp, H. sapiens
ttgtttcaaaaacaaa

SEQ ID NO: 167753 - DNA, 16 bp, H. sapiens
ttgtttcaaaaatttt

SEQ ID NO: 167754 - DNA, 16 bp, H. sapiens
ttgtttcaaatacttt

SEQ ID NO: 167755 - DNA, 16 bp, H. sapiens
ttgtttcacattttta

SEQ ID NO: 167756 - DNA, 16 bp, H. sapiens
ttgtttcagtttctta

SEQ ID NO: 167757 - DNA, 16 bp, H. sapiens
ttgtttcagttttcaa

SEQ ID NO: 167758 - DNA, 16 bp, H. sapiens
ttgtttcataaataac

SEQ ID NO: 167759 - DNA, 16 bp, H. sapiens
ttgtttcataggtata

SEQ ID NO: 167760 - DNA, 16 bp, H. sapiens
ttgtttcattaatctt

SEQ ID NO: 167761 - DNA, 16 bp, H. sapiens
ttgtttcatttttaag

SEQ ID NO: 167762 - DNA, 16 bp, H. sapiens
ttgtttccaagtgttt

SEQ ID NO: 167763 - DNA, 16 bp, H. sapiens
ttgtttccaatttttc

SEQ ID NO: 167764 - DNA, 16 bp, H. sapiens
ttgtttccagtttcag

SEQ ID NO: 167765 - DNA, 16 bp, H. sapiens
ttgtttccagtttttg

SEQ ID NO: 167766 - DNA, 16 bp, H. sapiens
ttgtttccatcttttg

SEQ ID NO: 167767 - DNA, 16 bp, H. sapiens
ttgtttccatgtttta

SEQ ID NO: 167768 - DNA, 16 bp, H. sapiens
ttgtttccattttaaa

SEQ ID NO: 167769 - DNA, 16 bp, H. sapiens
ttgtttcctcatctgt

SEQ ID NO: 167770 - DNA, 16 bp, H. sapiens
ttgtttctacctttgg

SEQ ID NO: 167771 - DNA, 16 bp, H. sapiens
ttgtttctagtttggg

SEQ ID NO: 167772 - DNA, 16 bp, H. sapiens
ttgtttctccccctgc

SEQ ID NO: 167773 - DNA, 16 bp, H. sapiens
ttgtttctctgaaata

SEQ ID NO: 167774 - DNA, 16 bp, H. sapiens
ttgtttctctggttcc

SEQ ID NO: 167775 - DNA, 16 bp, H. sapiens
ttgtttctgcaattta

SEQ ID NO: 167776 - DNA, 16 bp, H. sapiens
ttgtttctttataaat

SEQ ID NO: 167777 - DNA, 16 bp, H. sapiens
ttgtttctttttgaaa

SEQ ID NO: 167778 - DNA, 16 bp, H. sapiens
ttgtttgaaaagaaaa

SEQ ID NO: 167779 - DNA, 16 bp, H. sapiens
ttgtttgaaatgcaaa

SEQ ID NO: 167780 - DNA, 16 bp, H. sapiens
ttgtttgaacctgaga

SEQ ID NO: 167781 - DNA, 16 bp, H. sapiens
ttgtttgagacagtct

SEQ ID NO: 167782 - DNA, 16 bp, H. sapiens
ttgtttgcagatgaca

SEQ ID NO: 167783 - DNA, 16 bp, H. sapiens
ttgtttgcatggaata

SEQ ID NO: 167784 - DNA, 16 bp, H. sapiens
ttgtttgccccttctg

SEQ ID NO: 167785 - DNA, 16 bp, H. sapiens
ttgtttgctcatttgt

SEQ ID NO: 167786 - DNA, 16 bp, H. sapiens
ttgtttgctttcaact

SEQ ID NO: 167787 - DNA, 16 bp, H. sapiens
ttgtttggaggattaa

SEQ ID NO: 167788 - DNA, 16 bp, H. sapiens
ttgtttggcatataat

SEQ ID NO: 167789 - DNA, 16 bp, H. sapiens
ttgtttgtaaaatgag

SEQ ID NO: 167790 - DNA, 16 bp, H. sapiens
ttgtttgtaactgaaa

SEQ ID NO: 167791 - DNA, 16 bp, H. sapiens
ttgtttgtagattctg

SEQ ID NO: 167792 - DNA, 16 bp, H. sapiens
ttgtttgtttgagaga

SEQ ID NO: 167793 - DNA, 16 bp, H. sapiens
ttgtttgtttgggaaa

SEQ ID NO: 167794 - DNA, 16 bp, H. sapiens
ttgtttgttttaaact

SEQ ID NO: 167795 - DNA, 16 bp, H. sapiens
ttgtttgttttaacca

SEQ ID NO: 167796 - DNA, 16 bp, H. sapiens
ttgtttgttttacaaa

SEQ ID NO: 167797 - DNA, 16 bp, H. sapiens
ttgtttgttttacata

SEQ ID NO: 167798 - DNA, 16 bp, H. sapiens
ttgtttgttttcccaa

SEQ ID NO: 167799 - DNA, 16 bp, H. sapiens
ttgtttgttttcccca

SEQ ID NO: 167800 - DNA, 16 bp, H. sapiens
ttgttttaaaaaaatg

SEQ ID NO: 167801 - DNA, 16 bp, H. sapiens
ttgttttaaaaagaaa

SEQ ID NO: 167802 - DNA, 16 bp, H. sapiens
ttgttttaaaacaaaa

SEQ ID NO: 167803 - DNA, 16 bp, H. sapiens
ttgttttaaaacaata

SEQ ID NO: 167804 - DNA, 16 bp, H. sapiens
ttgttttaaaacatat

SEQ ID NO: 167805 - DNA, 16 bp, H. sapiens
ttgttttaaaagaaaa

SEQ ID NO: 167806 - DNA, 16 bp, H. sapiens
ttgttttaaaagaata

SEQ ID NO: 167807 - DNA, 16 bp, H. sapiens
ttgttttaaactttaa

SEQ ID NO: 167808 - DNA, 16 bp, H. sapiens
ttgttttaaagatgag

SEQ ID NO: 167809 - DNA, 16 bp, H. sapiens
ttgttttaagaaaaaa

SEQ ID NO: 167810 - DNA, 16 bp, H. sapiens
ttgttttaagagacag

SEQ ID NO: 167811 - DNA, 16 bp, H. sapiens
ttgttttaatctgaaa

SEQ ID NO: 167812 - DNA, 16 bp, H. sapiens
ttgttttaattacatt

SEQ ID NO: 167813 - DNA, 16 bp, H. sapiens
ttgttttacaaatttg

SEQ ID NO: 167814 - DNA, 16 bp, H. sapiens
ttgttttacagatggg

SEQ ID NO: 167815 - DNA, 16 bp, H. sapiens
ttgttttacttaaagt

SEQ ID NO: 167816 - DNA, 16 bp, H. sapiens
ttgttttagaaaatta

SEQ ID NO: 167817 - DNA, 16 bp, H. sapiens
ttgttttagccatttt

SEQ ID NO: 167818 - DNA, 16 bp, H. sapiens
ttgttttatacacaca

SEQ ID NO: 167819 - DNA, 16 bp, H. sapiens
ttgttttatgccatta

SEQ ID NO: 167820 - DNA, 16 bp, H. sapiens
ttgttttatgtccaat

SEQ ID NO: 167821 - DNA, 16 bp, H. sapiens
ttgttttattctaaaa

SEQ ID NO: 167822 - DNA, 16 bp, H. sapiens
ttgttttcaaaacaaa

SEQ ID NO: 167823 - DNA, 16 bp, H. sapiens
ttgttttcaaagaact

SEQ ID NO: 167824 - DNA, 16 bp, H. sapiens
ttgttttcaaatttta

SEQ ID NO: 167825 - DNA, 16 bp, H. sapiens
ttgttttcctcatttc

SEQ ID NO: 167826 - DNA, 16 bp, H. sapiens
ttgttttcctgcagct

SEQ ID NO: 167827 - DNA, 16 bp, H. sapiens
ttgttttccttaaatt

SEQ ID NO: 167828 - DNA, 16 bp, H. sapiens
ttgttttctaataaaa

SEQ ID NO: 167829 - DNA, 16 bp, H. sapiens
ttgttttctctgtaat

SEQ ID NO: 167830 - DNA, 16 bp, H. sapiens
ttgttttctcttaaaa

SEQ ID NO: 167831 - DNA, 16 bp, H. sapiens
ttgttttctggaattt

SEQ ID NO: 167832 - DNA, 16 bp, H. sapiens
ttgttttctgtaaata

SEQ ID NO: 167833 - DNA, 16 bp, H. sapiens
ttgttttcttagaata

SEQ ID NO: 167834 - DNA, 16 bp, H. sapiens
ttgttttcttcactta

SEQ ID NO: 167835 - DNA, 16 bp, H. sapiens
ttgttttcttcttcac

SEQ ID NO: 167836 - DNA, 16 bp, H. sapiens
ttgttttctttaaaat

SEQ ID NO: 167837 - DNA, 16 bp, H. sapiens
ttgttttctttataca

SEQ ID NO: 167838 - DNA, 16 bp, H. sapiens
ttgttttctttcaaca

SEQ ID NO: 167839 - DNA, 16 bp, H. sapiens
ttgttttgaaaaaaat

SEQ ID NO: 167840 - DNA, 16 bp, H. sapiens
ttgttttgcatttgct

SEQ ID NO: 167841 - DNA, 16 bp, H. sapiens
ttgttttgccagtatt

SEQ ID NO: 167842 - DNA, 16 bp, H. sapiens
ttgttttgcttttcca

SEQ ID NO: 167843 - DNA, 16 bp, H. sapiens
ttgttttgggacacca

SEQ ID NO: 167844 - DNA, 16 bp, H. sapiens
ttgttttgtaaataaa

SEQ ID NO: 167845 - DNA, 16 bp, H. sapiens
ttgttttgtagagatg

SEQ ID NO: 167846 - DNA, 16 bp, H. sapiens
ttgttttgtcttgaga

SEQ ID NO: 167847 - DNA, 16 bp, H. sapiens
ttgttttgttttagac

SEQ ID NO: 167848 - DNA, 16 bp, H. sapiens
ttgtttttaaaactct

SEQ ID NO: 167849 - DNA, 16 bp, H. sapiens
ttgtttttaaaagata

SEQ ID NO: 167850 - DNA, 16 bp, H. sapiens
ttgtttttaaaagtaa

SEQ ID NO: 167851 - DNA, 16 bp, H. sapiens
ttgtttttaaagaaat

SEQ ID NO: 167852 - DNA, 16 bp, H. sapiens
ttgtttttaaagtaaa

SEQ ID NO: 167853 - DNA, 16 bp, H. sapiens
ttgtttttaaattacc

SEQ ID NO: 167854 - DNA, 16 bp, H. sapiens
ttgtttttaagaaaaa

SEQ ID NO: 167855 - DNA, 16 bp, H. sapiens
ttgtttttaagaaata

SEQ ID NO: 167856 - DNA, 16 bp, H. sapiens
ttgtttttaagacaga

SEQ ID NO: 167857 - DNA, 16 bp, H. sapiens
ttgtttttaagggaaa

SEQ ID NO: 167858 - DNA, 16 bp, H. sapiens
ttgtttttaatagaaa

SEQ ID NO: 167859 - DNA, 16 bp, H. sapiens
ttgtttttaatcttaa

SEQ ID NO: 167860 - DNA, 16 bp, H. sapiens
ttgtttttaatggcaa

SEQ ID NO: 167861 - DNA, 16 bp, H. sapiens
ttgtttttcaaaaaat

SEQ ID NO: 167862 - DNA, 16 bp, H. sapiens
ttgtttttcaaaaata

SEQ ID NO: 167863 - DNA, 16 bp, H. sapiens
ttgtttttcaaataaa

SEQ ID NO: 167864 - DNA, 16 bp, H. sapiens
ttgtttttcaagattg

SEQ ID NO: 167865 - DNA, 16 bp, H. sapiens
ttgtttttcagaaatt

SEQ ID NO: 167866 - DNA, 16 bp, H. sapiens
ttgtttttctcagctt

SEQ ID NO: 167867 - DNA, 17 bp, H. sapiens
ttgtttttctcaggttt

SEQ ID NO: 167868 - DNA, 16 bp, H. sapiens
ttgtttttctgaaaat

SEQ ID NO: 167869 - DNA, 16 bp, H. sapiens
ttgtttttctttccca

SEQ ID NO: 167870 - DNA, 16 bp, H. sapiens
ttgtttttgaaaataa

SEQ ID NO: 167871 - DNA, 16 bp, H. sapiens
ttgtttttgagacaaa

SEQ ID NO: 167872 - DNA, 16 bp, H. sapiens
ttgtttttgtagagat

SEQ ID NO: 167873 - DNA, 16 bp, H. sapiens
ttgttttttaaaaagg

SEQ ID NO: 167874 - DNA, 16 bp, H. sapiens
ttgttttttaaaacaa

SEQ ID NO: 167875 - DNA, 16 bp, H. sapiens
ttgttttttaaacaaa

SEQ ID NO: 167876 - DNA, 16 bp, H. sapiens
ttgttttttaaataca

SEQ ID NO: 167877 - DNA, 16 bp, H. sapiens
ttgttttttaaatcca

SEQ ID NO: 167878 - DNA, 16 bp, H. sapiens
ttgttttttaagacgg

SEQ ID NO: 167879 - DNA, 16 bp, H. sapiens
ttgttttttagtagaa

SEQ ID NO: 167880 - DNA, 16 bp, H. sapiens
ttgttttttgaaagca

SEQ ID NO: 167881 - DNA, 16 bp, H. sapiens
ttgttttttgagacat

SEQ ID NO: 167882 - DNA, 22 bp, H. sapiens
ttgttttttgagacggagtctt

SEQ ID NO: 167883 - DNA, 16 bp, H. sapiens
ttgttttttgagagaa

SEQ ID NO: 167884 - DNA, 16 bp, H. sapiens
ttgtttttttaaagag

SEQ ID NO: 167885 - DNA, 16 bp, H. sapiens
ttgtttttttcaaaat

SEQ ID NO: 167886 - DNA, 16 bp, H. sapiens
ttgtttttttcctaaa

SEQ ID NO: 167887 - DNA, 16 bp, H. sapiens
ttgtttttttctccaa

SEQ ID NO: 167888 - DNA, 16 bp, H. sapiens
tttaaaaaaaatcctt

SEQ ID NO: 167889 - DNA, 16 bp, H. sapiens
tttaaaaaaaatctgg

SEQ ID NO: 167890 - DNA, 16 bp, H. sapiens
tttaaaaaaaattgct

SEQ ID NO: 167891 - DNA, 16 bp, H. sapiens
tttaaaaaaacagctg

SEQ ID NO: 167892 - DNA, 16 bp, H. sapiens
tttaaaaaaacagttt

SEQ ID NO: 167893 - DNA, 16 bp, H. sapiens
tttaaaaaaagcaaat

SEQ ID NO: 167894 - DNA, 16 bp, H. sapiens
tttaaaaaaagcattt

SEQ ID NO: 167895 - DNA, 16 bp, H. sapiens
tttaaaaaaagtattc

SEQ ID NO: 167896 - DNA, 16 bp, H. sapiens
tttaaaaaaatacatg

SEQ ID NO: 167897 - DNA, 16 bp, H. sapiens
tttaaaaaaatctcca

SEQ ID NO: 167898 - DNA, 16 bp, H. sapiens
tttaaaaaaatgcaaa

SEQ ID NO: 167899 - DNA, 16 bp, H. sapiens
tttaaaaaaatgcaca

SEQ ID NO: 167900 - DNA, 16 bp, H. sapiens
tttaaaaaaattccac

SEQ ID NO: 167901 - DNA, 16 bp, H. sapiens
tttaaaaaaattccta

SEQ ID NO: 167902 - DNA, 16 bp, H. sapiens
tttaaaaaaattctga

SEQ ID NO: 167903 - DNA, 16 bp, H. sapiens
tttaaaaaaattggtt

SEQ ID NO: 167904 - DNA, 16 bp, H. sapiens
tttaaaaaaatttcct

SEQ ID NO: 167905 - DNA, 16 bp, H. sapiens
tttaaaaaacaaagac

SEQ ID NO: 167906 - DNA, 16 bp, H. sapiens
tttaaaaaacaaatgt

SEQ ID NO: 167907 - DNA, 16 bp, H. sapiens
tttaaaaaacaacttt

SEQ ID NO: 167908 - DNA, 16 bp, H. sapiens
tttaaaaaacaagttt

SEQ ID NO: 167909 - DNA, 16 bp, H. sapiens
tttaaaaaacagataa

SEQ ID NO: 167910 - DNA, 16 bp, H. sapiens
tttaaaaaaccaactt

SEQ ID NO: 167911 - DNA, 16 bp, H. sapiens
tttaaaaaaccttttt

SEQ ID NO: 167912 - DNA, 16 bp, H. sapiens
tttaaaaaactacatt

SEQ ID NO: 167913 - DNA, 16 bp, H. sapiens
tttaaaaaactgtata

SEQ ID NO: 167914 - DNA, 16 bp, H. sapiens
tttaaaaaactgtcaa

SEQ ID NO: 167915 - DNA, 16 bp, H. sapiens
tttaaaaaactttact

SEQ ID NO: 167916 - DNA, 16 bp, H. sapiens
tttaaaaaagaacatt

SEQ ID NO: 167917 - DNA, 16 bp, H. sapiens
tttaaaaaagaaggag

SEQ ID NO: 167918 - DNA, 16 bp, H. sapiens
tttaaaaaagaatgtt

SEQ ID NO: 167919 - DNA, 16 bp, H. sapiens
tttaaaaaagactgaa

SEQ ID NO: 167920 - DNA, 16 bp, H. sapiens
tttaaaaaagactttc

SEQ ID NO: 167921 - DNA, 16 bp, H. sapiens
tttaaaaaagcaaaat

SEQ ID NO: 167922 - DNA, 16 bp, H. sapiens
tttaaaaaagcaaatc

SEQ ID NO: 167923 - DNA, 16 bp, H. sapiens
tttaaaaaagcaagtt

SEQ ID NO: 167924 - DNA, 16 bp, H. sapiens
tttaaaaaaggaaaca

SEQ ID NO: 167925 - DNA, 16 bp, H. sapiens
tttaaaaaaggcaaaa

SEQ ID NO: 167926 - DNA, 16 bp, H. sapiens
tttaaaaaagtgaatt

SEQ ID NO: 167927 - DNA, 16 bp, H. sapiens
tttaaaaaagtgttta

SEQ ID NO: 167928 - DNA, 16 bp, H. sapiens
tttaaaaaagtgtttt

SEQ ID NO: 167929 - DNA, 16 bp, H. sapiens
tttaaaaaagttaaca

SEQ ID NO: 167930 - DNA, 16 bp, H. sapiens
tttaaaaaagttcatt

SEQ ID NO: 167931 - DNA, 16 bp, H. sapiens
tttaaaaaagtttcta

SEQ ID NO: 167932 - DNA, 16 bp, H. sapiens
tttaaaaaagttttct

SEQ ID NO: 167933 - DNA, 16 bp, H. sapiens
tttaaaaaataacttc

SEQ ID NO: 167934 - DNA, 16 bp, H. sapiens
tttaaaaaataatgtg

SEQ ID NO: 167935 - DNA, 16 bp, H. sapiens
tttaaaaaatacacac

SEQ ID NO: 167936 - DNA, 16 bp, H. sapiens
tttaaaaaatacatgt

SEQ ID NO: 167937 - DNA, 16 bp, H. sapiens
tttaaaaaataccatg

SEQ ID NO: 167938 - DNA, 16 bp, H. sapiens
tttaaaaaataccttc

SEQ ID NO: 167939 - DNA, 16 bp, H. sapiens
tttaaaaaatacttag

SEQ ID NO: 167940 - DNA, 16 bp, H. sapiens
tttaaaaaatacttca

SEQ ID NO: 167941 - DNA, 16 bp, H. sapiens
tttaaaaaatagtact

SEQ ID NO: 167942 - DNA, 16 bp, H. sapiens
tttaaaaaatattctg

SEQ ID NO: 167943 - DNA, 16 bp, H. sapiens
tttaaaaaatcagcca

SEQ ID NO: 167944 - DNA, 16 bp, H. sapiens
tttaaaaaatcatcca

SEQ ID NO: 167945 - DNA, 16 bp, H. sapiens
tttaaaaaatcatgca

SEQ ID NO: 167946 - DNA, 16 bp, H. sapiens
tttaaaaaatccaaag

SEQ ID NO: 167947 - DNA, 16 bp, H. sapiens
tttaaaaaatcccttc

SEQ ID NO: 167948 - DNA, 16 bp, H. sapiens
tttaaaaaatctgtaa

SEQ ID NO: 167949 - DNA, 16 bp, H. sapiens
tttaaaaaatctgtta

SEQ ID NO: 167950 - DNA, 16 bp, H. sapiens
tttaaaaaatgaaatc

SEQ ID NO: 167951 - DNA, 16 bp, H. sapiens
tttaaaaaatgaagag

SEQ ID NO: 167952 - DNA, 16 bp, H. sapiens
tttaaaaaatgacaac

SEQ ID NO: 167953 - DNA, 16 bp, H. sapiens
tttaaaaaatgagctt

SEQ ID NO: 167954 - DNA, 16 bp, H. sapiens
tttaaaaaatgcataa

SEQ ID NO: 167955 - DNA, 16 bp, H. sapiens
tttaaaaaatgctttt

SEQ ID NO: 167956 - DNA, 16 bp, H. sapiens
tttaaaaaatgtacag

SEQ ID NO: 167957 - DNA, 16 bp, H. sapiens
tttaaaaaatgtactc

SEQ ID NO: 167958 - DNA, 16 bp, H. sapiens
tttaaaaaatgtctct

SEQ ID NO: 167959 - DNA, 16 bp, H. sapiens
tttaaaaaatgtcttc

SEQ ID NO: 167960 - DNA, 16 bp, H. sapiens
tttaaaaaatgtcttt

SEQ ID NO: 167961 - DNA, 16 bp, H. sapiens
tttaaaaaatgtgaat

SEQ ID NO: 167962 - DNA, 16 bp, H. sapiens
tttaaaaaattaaggt

SEQ ID NO: 167963 - DNA, 16 bp, H. sapiens
tttaaaaaattacaag

SEQ ID NO: 167964 - DNA, 16 bp, H. sapiens
tttaaaaaattagcca

SEQ ID NO: 167965 - DNA, 16 bp, H. sapiens
tttaaaaaattcacta

SEQ ID NO: 167966 - DNA, 16 bp, H. sapiens
tttaaaaaattcagtt

SEQ ID NO: 167967 - DNA, 16 bp, H. sapiens
tttaaaaaattccatg

SEQ ID NO: 167968 - DNA, 16 bp, H. sapiens
tttaaaaaattccccc

SEQ ID NO: 167969 - DNA, 16 bp, H. sapiens
tttaaaaaattctgaa

SEQ ID NO: 167970 - DNA, 16 bp, H. sapiens
tttaaaaaattctggt

SEQ ID NO: 167971 - DNA, 16 bp, H. sapiens
tttaaaaaattgagct

SEQ ID NO: 167972 - DNA, 16 bp, H. sapiens
tttaaaaaattgatac

SEQ ID NO: 167973 - DNA, 16 bp, H. sapiens
tttaaaaaattggatt

SEQ ID NO: 167974 - DNA, 16 bp, H. sapiens
tttaaaaaattgttct

SEQ ID NO: 167975 - DNA, 16 bp, H. sapiens
tttaaaaaattgttgt

SEQ ID NO: 167976 - DNA, 16 bp, H. sapiens
tttaaaaaatttcctt

SEQ ID NO: 167977 - DNA, 16 bp, H. sapiens
tttaaaaaatttgctt

SEQ ID NO: 167978 - DNA, 16 bp, H. sapiens
tttaaaaacaaaaatg

SEQ ID NO: 167979 - DNA, 16 bp, H. sapiens
tttaaaaacaaagaga

SEQ ID NO: 167980 - DNA, 16 bp, H. sapiens
tttaaaaacaagaaca

SEQ ID NO: 167981 - DNA, 16 bp, H. sapiens
tttaaaaacaagtaaa

SEQ ID NO: 167982 - DNA, 16 bp, H. sapiens
tttaaaaacaagtgaa

SEQ ID NO: 167983 - DNA, 16 bp, H. sapiens
tttaaaaacaattgaa

SEQ ID NO: 167984 - DNA, 16 bp, H. sapiens
tttaaaaacacagcaa

SEQ ID NO: 167985 - DNA, 16 bp, H. sapiens
tttaaaaacagaaaca

SEQ ID NO: 167986 - DNA, 16 bp, H. sapiens
tttaaaaacagaagaa

SEQ ID NO: 167987 - DNA, 16 bp, H. sapiens
tttaaaaacagaagtt

SEQ ID NO: 167988 - DNA, 16 bp, H. sapiens
tttaaaaacaggaaaa

SEQ ID NO: 167989 - DNA, 16 bp, H. sapiens
tttaaaaacagtgttt

SEQ ID NO: 167990 - DNA, 16 bp, H. sapiens
tttaaaaacagttatt

SEQ ID NO: 167991 - DNA, 16 bp, H. sapiens
tttaaaaacatatgaa

SEQ ID NO: 167992 - DNA, 16 bp, H. sapiens
tttaaaaacatctttt

SEQ ID NO: 167993 - DNA, 16 bp, H. sapiens
tttaaaaacatgaatt

SEQ ID NO: 167994 - DNA, 16 bp, H. sapiens
tttaaaaacatgttat

SEQ ID NO: 167995 - DNA, 16 bp, H. sapiens
tttaaaaacatttaca

SEQ ID NO: 167996 - DNA, 16 bp, H. sapiens
tttaaaaacatttctg

SEQ ID NO: 167997 - DNA, 16 bp, H. sapiens
tttaaaaacattttca

SEQ ID NO: 167998 - DNA, 16 bp, H. sapiens
tttaaaaaccattctt

SEQ ID NO: 167999 - DNA, 16 bp, H. sapiens
tttaaaaaccatttaa

SEQ ID NO: 168000 - DNA, 16 bp, H. sapiens
tttaaaaaccattttt

SEQ ID NO: 168001 - DNA, 16 bp, H. sapiens
tttaaaaactcactta

SEQ ID NO: 168002 - DNA, 16 bp, H. sapiens
tttaaaaactcacttt

SEQ ID NO: 168003 - DNA, 16 bp, H. sapiens
tttaaaaactgaataa

SEQ ID NO: 168004 - DNA, 16 bp, H. sapiens
tttaaaaactgattat

SEQ ID NO: 168005 - DNA, 16 bp, H. sapiens
tttaaaaactgcttta

SEQ ID NO: 168006 - DNA, 16 bp, H. sapiens
tttaaaaactgtaatt

SEQ ID NO: 168007 - DNA, 16 bp, H. sapiens
tttaaaaactgtgttt

SEQ ID NO: 168008 - DNA, 16 bp, H. sapiens
tttaaaaacttcttaa

SEQ ID NO: 168009 - DNA, 16 bp, H. sapiens
tttaaaaactttcaaa

SEQ ID NO: 168010 - DNA, 16 bp, H. sapiens
tttaaaaagaaatcta

SEQ ID NO: 168011 - DNA, 16 bp, H. sapiens
tttaaaaagaaatgac

SEQ ID NO: 168012 - DNA, 16 bp, H. sapiens
tttaaaaagaaattca

SEQ ID NO: 168013 - DNA, 16 bp, H. sapiens
tttaaaaagaacagat

SEQ ID NO: 168014 - DNA, 16 bp, H. sapiens
tttaaaaagaatcaca

SEQ ID NO: 168015 - DNA, 16 bp, H. sapiens
tttaaaaagacaattt

SEQ ID NO: 168016 - DNA, 16 bp, H. sapiens
tttaaaaagacacaaa

SEQ ID NO: 168017 - DNA, 16 bp, H. sapiens
tttaaaaagacattaa

SEQ ID NO: 168018 - DNA, 16 bp, H. sapiens
tttaaaaagacatttt

SEQ ID NO: 168019 - DNA, 16 bp, H. sapiens
tttaaaaagactaaaa

SEQ ID NO: 168020 - DNA, 16 bp, H. sapiens
tttaaaaagagaacat

SEQ ID NO: 168021 - DNA, 16 bp, H. sapiens
tttaaaaagaggaaat

SEQ ID NO: 168022 - DNA, 16 bp, H. sapiens
tttaaaaagagtgaaa

SEQ ID NO: 168023 - DNA, 16 bp, H. sapiens
tttaaaaagatgttct

SEQ ID NO: 168024 - DNA, 16 bp, H. sapiens
tttaaaaagatgttta

SEQ ID NO: 168025 - DNA, 16 bp, H. sapiens
tttaaaaagatgtttt

SEQ ID NO: 168026 - DNA, 16 bp, H. sapiens
tttaaaaagcaaaaca

SEQ ID NO: 168027 - DNA, 16 bp, H. sapiens
tttaaaaagcaaatat

SEQ ID NO: 168028 - DNA, 16 bp, H. sapiens
tttaaaaagcaaattt

SEQ ID NO: 168029 - DNA, 16 bp, H. sapiens
tttaaaaagcaagaat

SEQ ID NO: 168030 - DNA, 16 bp, H. sapiens
tttaaaaagcaagatg

SEQ ID NO: 168031 - DNA, 16 bp, H. sapiens
tttaaaaagcaagtta

SEQ ID NO: 168032 - DNA, 16 bp, H. sapiens
tttaaaaagcagaaaa

SEQ ID NO: 168033 - DNA, 16 bp, H. sapiens
tttaaaaagcagattt

SEQ ID NO: 168034 - DNA, 16 bp, H. sapiens
tttaaaaagcaggaaa

SEQ ID NO: 168035 - DNA, 16 bp, H. sapiens
tttaaaaagcagtaat

SEQ ID NO: 168036 - DNA, 16 bp, H. sapiens
tttaaaaagcagttta

SEQ ID NO: 168037 - DNA, 16 bp, H. sapiens
tttaaaaagcagtttg

SEQ ID NO: 168038 - DNA, 16 bp, H. sapiens
tttaaaaagcagtttt

SEQ ID NO: 168039 - DNA, 16 bp, H. sapiens
tttaaaaagcataaat

SEQ ID NO: 168040 - DNA, 16 bp, H. sapiens
tttaaaaagcatataa

SEQ ID NO: 168041 - DNA, 16 bp, H. sapiens
tttaaaaagcattaat

SEQ ID NO: 168042 - DNA, 16 bp, H. sapiens
tttaaaaagccaacat

SEQ ID NO: 168043 - DNA, 16 bp, H. sapiens
tttaaaaagctaatga

SEQ ID NO: 168044 - DNA, 16 bp, H. sapiens
tttaaaaagctgaaaa

SEQ ID NO: 168045 - DNA, 16 bp, H. sapiens
tttaaaaagcttttca

SEQ ID NO: 168046 - DNA, 16 bp, H. sapiens
tttaaaaagcttttct

SEQ ID NO: 168047 - DNA, 16 bp, H. sapiens
tttaaaaaggaaaagg

SEQ ID NO: 168048 - DNA, 16 bp, H. sapiens
tttaaaaaggaaatga

SEQ ID NO: 168049 - DNA, 16 bp, H. sapiens
tttaaaaaggaagaag

SEQ ID NO: 168050 - DNA, 16 bp, H. sapiens
tttaaaaaggaatttg

SEQ ID NO: 168051 - DNA, 16 bp, H. sapiens
tttaaaaaggattttt

SEQ ID NO: 168052 - DNA, 16 bp, H. sapiens
tttaaaaaggcaaatg

SEQ ID NO: 168053 - DNA, 16 bp, H. sapiens
tttaaaaagggaaaac

SEQ ID NO: 168054 - DNA, 16 bp, H. sapiens
tttaaaaagggaaaca

SEQ ID NO: 168055 - DNA, 16 bp, H. sapiens
tttaaaaagggcaaaa

SEQ ID NO: 168056 - DNA, 16 bp, H. sapiens
tttaaaaaggtataat

SEQ ID NO: 168057 - DNA, 16 bp, H. sapiens
tttaaaaaggttattt

SEQ ID NO: 168058 - DNA, 16 bp, H. sapiens
tttaaaaagtaaaaac

SEQ ID NO: 168059 - DNA, 16 bp, H. sapiens
tttaaaaagtaatatg

SEQ ID NO: 168060 - DNA, 16 bp, H. sapiens
tttaaaaagtactttt

SEQ ID NO: 168061 - DNA, 16 bp, H. sapiens
tttaaaaagtattcta

SEQ ID NO: 168062 - DNA, 16 bp, H. sapiens
tttaaaaagtatttac

SEQ ID NO: 168063 - DNA, 16 bp, H. sapiens
tttaaaaagtcaagaa

SEQ ID NO: 168064 - DNA, 16 bp, H. sapiens
tttaaaaagtcaggtt

SEQ ID NO: 168065 - DNA, 16 bp, H. sapiens
tttaaaaagtcataga

SEQ ID NO: 168066 - DNA, 16 bp, H. sapiens
tttaaaaagtcatatt

SEQ ID NO: 168067 - DNA, 16 bp, H. sapiens
tttaaaaagtcatcag

SEQ ID NO: 168068 - DNA, 16 bp, H. sapiens
tttaaaaagtcattaa

SEQ ID NO: 168069 - DNA, 16 bp, H. sapiens
tttaaaaagtcatttg

SEQ ID NO: 168070 - DNA, 16 bp, H. sapiens
tttaaaaagtcatttt

SEQ ID NO: 168071 - DNA, 16 bp, H. sapiens
tttaaaaagtgaaaga

SEQ ID NO: 168072 - DNA, 16 bp, H. sapiens
tttaaaaagtgaaatt

SEQ ID NO: 168073 - DNA, 16 bp, H. sapiens
tttaaaaagtgatttt

SEQ ID NO: 168074 - DNA, 16 bp, H. sapiens
tttaaaaagtgctttg

SEQ ID NO: 168075 - DNA, 16 bp, H. sapiens
tttaaaaagtggcaaa

SEQ ID NO: 168076 - DNA, 16 bp, H. sapiens
tttaaaaagtgtcttt

SEQ ID NO: 168077 - DNA, 16 bp, H. sapiens
tttaaaaagtgttgaa

SEQ ID NO: 168078 - DNA, 16 bp, H. sapiens
tttaaaaagtgtttca

SEQ ID NO: 168079 - DNA, 16 bp, H. sapiens
tttaaaaagttagctg

SEQ ID NO: 168080 - DNA, 16 bp, H. sapiens
tttaaaaagttatcaa

SEQ ID NO: 168081 - DNA, 16 bp, H. sapiens
tttaaaaagtttctca

SEQ ID NO: 168082 - DNA, 16 bp, H. sapiens
tttaaaaataaagcaa

SEQ ID NO: 168083 - DNA, 16 bp, H. sapiens
tttaaaaataacaaag

SEQ ID NO: 168084 - DNA, 16 bp, H. sapiens
tttaaaaataacattg

SEQ ID NO: 168085 - DNA, 16 bp, H. sapiens
tttaaaaataagacaa

SEQ ID NO: 168086 - DNA, 16 bp, H. sapiens
tttaaaaataagatca

SEQ ID NO: 168087 - DNA, 16 bp, H. sapiens
tttaaaaataagcaca

SEQ ID NO: 168088 - DNA, 16 bp, H. sapiens
tttaaaaataagctaa

SEQ ID NO: 168089 - DNA, 16 bp, H. sapiens
tttaaaaataatagac

SEQ ID NO: 168090 - DNA, 16 bp, H. sapiens
tttaaaaataatgagt

SEQ ID NO: 168091 - DNA, 16 bp, H. sapiens
tttaaaaataatgcaa

SEQ ID NO: 168092 - DNA, 16 bp, H. sapiens
tttaaaaataattcct

SEQ ID NO: 168093 - DNA, 16 bp, H. sapiens
tttaaaaatacacaga

SEQ ID NO: 168094 - DNA, 16 bp, H. sapiens
tttaaaaatacagaaa

SEQ ID NO: 168095 - DNA, 16 bp, H. sapiens
tttaaaaatacagtgt

SEQ ID NO: 168096 - DNA, 16 bp, H. sapiens
tttaaaaatacatagt

SEQ ID NO: 168097 - DNA, 16 bp, H. sapiens
tttaaaaatacatcat

SEQ ID NO: 168098 - DNA, 16 bp, H. sapiens
tttaaaaatacatgtt

SEQ ID NO: 168099 - DNA, 16 bp, H. sapiens
tttaaaaatacattag

SEQ ID NO: 168100 - DNA, 16 bp, H. sapiens
tttaaaaataccaatt

SEQ ID NO: 168101 - DNA, 16 bp, H. sapiens
tttaaaaatactgtct

SEQ ID NO: 168102 - DNA, 16 bp, H. sapiens
tttaaaaatacttgat

SEQ ID NO: 168103 - DNA, 16 bp, H. sapiens
tttaaaaatagaatca

SEQ ID NO: 168104 - DNA, 16 bp, H. sapiens
tttaaaaatagccttt

SEQ ID NO: 168105 - DNA, 16 bp, H. sapiens
tttaaaaataggcttt

SEQ ID NO: 168106 - DNA, 16 bp, H. sapiens
tttaaaaatagtcttt

SEQ ID NO: 168107 - DNA, 16 bp, H. sapiens
tttaaaaatatccttt

SEQ ID NO: 168108 - DNA, 16 bp, H. sapiens
tttaaaaatatctaca

SEQ ID NO: 168109 - DNA, 16 bp, H. sapiens
tttaaaaatatgaact

SEQ ID NO: 168110 - DNA, 16 bp, H. sapiens
tttaaaaatatgcaat

SEQ ID NO: 168111 - DNA, 16 bp, H. sapiens
tttaaaaatatgtatg

SEQ ID NO: 168112 - DNA, 16 bp, H. sapiens
tttaaaaatattcaac

SEQ ID NO: 168113 - DNA, 16 bp, H. sapiens
tttaaaaatattgtct

SEQ ID NO: 168114 - DNA, 16 bp, H. sapiens
tttaaaaatcaaaatg

SEQ ID NO: 168115 - DNA, 16 bp, H. sapiens
tttaaaaatcaaagta

SEQ ID NO: 168116 - DNA, 16 bp, H. sapiens
tttaaaaatcaacttt

SEQ ID NO: 168117 - DNA, 16 bp, H. sapiens
tttaaaaatcaagtaa

SEQ ID NO: 168118 - DNA, 16 bp, H. sapiens
tttaaaaatcacattt

SEQ ID NO: 168119 - DNA, 16 bp, H. sapiens
tttaaaaatcactttt

SEQ ID NO: 168120 - DNA, 16 bp, H. sapiens
tttaaaaatcagaaag

SEQ ID NO: 168121 - DNA, 16 bp, H. sapiens
tttaaaaatcagaatg

SEQ ID NO: 168122 - DNA, 16 bp, H. sapiens
tttaaaaatcagatta

SEQ ID NO: 168123 - DNA, 16 bp, H. sapiens
tttaaaaatcagtttg

SEQ ID NO: 168124 - DNA, 16 bp, H. sapiens
tttaaaaatcagtttt

SEQ ID NO: 168125 - DNA, 16 bp, H. sapiens
tttaaaaatcataatc

SEQ ID NO: 168126 - DNA, 16 bp, H. sapiens
tttaaaaatcatattg

SEQ ID NO: 168127 - DNA, 16 bp, H. sapiens
tttaaaaatcatcttt

SEQ ID NO: 168128 - DNA, 16 bp, H. sapiens
tttaaaaatccataat

SEQ ID NO: 168129 - DNA, 16 bp, H. sapiens
tttaaaaatccatatt

SEQ ID NO: 168130 - DNA, 16 bp, H. sapiens
tttaaaaatcctttat

SEQ ID NO: 168131 - DNA, 16 bp, H. sapiens
tttaaaaatctattca

SEQ ID NO: 168132 - DNA, 16 bp, H. sapiens
tttaaaaatctcagat

SEQ ID NO: 168133 - DNA, 16 bp, H. sapiens
tttaaaaatctcttct

SEQ ID NO: 168134 - DNA, 16 bp, H. sapiens
tttaaaaatctgaagt

SEQ ID NO: 168135 - DNA, 16 bp, H. sapiens
tttaaaaatctgcctt

SEQ ID NO: 168136 - DNA, 16 bp, H. sapiens
tttaaaaatctgtatg

SEQ ID NO: 168137 - DNA, 16 bp, H. sapiens
tttaaaaatctgtgat

SEQ ID NO: 168138 - DNA, 16 bp, H. sapiens
tttaaaaatcttaatg

SEQ ID NO: 168139 - DNA, 16 bp, H. sapiens
tttaaaaatcttccca

SEQ ID NO: 168140 - DNA, 16 bp, H. sapiens
tttaaaaatcttctat

SEQ ID NO: 168141 - DNA, 16 bp, H. sapiens
tttaaaaatgaaaact

SEQ ID NO: 168142 - DNA, 16 bp, H. sapiens
tttaaaaatgaaatca

SEQ ID NO: 168143 - DNA, 16 bp, H. sapiens
tttaaaaatgaacaaa

SEQ ID NO: 168144 - DNA, 16 bp, H. sapiens
tttaaaaatgaagatg

SEQ ID NO: 168145 - DNA, 16 bp, H. sapiens
tttaaaaatgaatgta

SEQ ID NO: 168146 - DNA, 16 bp, H. sapiens
tttaaaaatgaattct

SEQ ID NO: 168147 - DNA, 16 bp, H. sapiens
tttaaaaatgacatca

SEQ ID NO: 168148 - DNA, 16 bp, H. sapiens
tttaaaaatgaccaaa

SEQ ID NO: 168149 - DNA, 16 bp, H. sapiens
tttaaaaatgagaaca

SEQ ID NO: 168150 - DNA, 16 bp, H. sapiens
tttaaaaatgagaatg

SEQ ID NO: 168151 - DNA, 16 bp, H. sapiens
tttaaaaatgatatgt

SEQ ID NO: 168152 - DNA, 16 bp, H. sapiens
tttaaaaatgattctt

SEQ ID NO: 168153 - DNA, 16 bp, H. sapiens
tttaaaaatgcaaatt

SEQ ID NO: 168154 - DNA, 16 bp, H. sapiens
tttaaaaatgcaattt

SEQ ID NO: 168155 - DNA, 16 bp, H. sapiens
tttaaaaatgcacaca

SEQ ID NO: 168156 - DNA, 16 bp, H. sapiens
tttaaaaatgcatatg

SEQ ID NO: 168157 - DNA, 16 bp, H. sapiens
tttaaaaatgcatcct

SEQ ID NO: 168158 - DNA, 16 bp, H. sapiens
tttaaaaatgcatgaa

SEQ ID NO: 168159 - DNA, 16 bp, H. sapiens
tttaaaaatgcatgca

SEQ ID NO: 168160 - DNA, 16 bp, H. sapiens
tttaaaaatgcattta

SEQ ID NO: 168161 - DNA, 16 bp, H. sapiens
tttaaaaatgccaaaa

SEQ ID NO: 168162 - DNA, 16 bp, H. sapiens
tttaaaaatgcttaat

SEQ ID NO: 168163 - DNA, 16 bp, H. sapiens
tttaaaaatggaaact

SEQ ID NO: 168164 - DNA, 16 bp, H. sapiens
tttaaaaatgggaaaa

SEQ ID NO: 168165 - DNA, 16 bp, H. sapiens
tttaaaaatggtcaaa

SEQ ID NO: 168166 - DNA, 16 bp, H. sapiens
tttaaaaatgtacaag

SEQ ID NO: 168167 - DNA, 16 bp, H. sapiens
tttaaaaatgtataca

SEQ ID NO: 168168 - DNA, 16 bp, H. sapiens
tttaaaaatgtatact

SEQ ID NO: 168169 - DNA, 16 bp, H. sapiens
tttaaaaatgtcaaga

SEQ ID NO: 168170 - DNA, 16 bp, H. sapiens
tttaaaaatgtcattt

SEQ ID NO: 168171 - DNA, 16 bp, H. sapiens
tttaaaaatgtgaatt

SEQ ID NO: 168172 - DNA, 16 bp, H. sapiens
tttaaaaatgtggaaa

SEQ ID NO: 168173 - DNA, 16 bp, H. sapiens
tttaaaaatgtggttt

SEQ ID NO: 168174 - DNA, 16 bp, H. sapiens
tttaaaaatgtgttta

SEQ ID NO: 168175 - DNA, 16 bp, H. sapiens
tttaaaaatgtttctt

SEQ ID NO: 168176 - DNA, 16 bp, H. sapiens
tttaaaaatgtttttc

SEQ ID NO: 168177 - DNA, 16 bp, H. sapiens
tttaaaaattaactca

SEQ ID NO: 168178 - DNA, 16 bp, H. sapiens
tttaaaaattaagctt

SEQ ID NO: 168179 - DNA, 16 bp, H. sapiens
tttaaaaattactaga

SEQ ID NO: 168180 - DNA, 16 bp, H. sapiens
tttaaaaattactgta

SEQ ID NO: 168181 - DNA, 16 bp, H. sapiens
tttaaaaattactgtt

SEQ ID NO: 168182 - DNA, 16 bp, H. sapiens
tttaaaaattacttgg

SEQ ID NO: 168183 - DNA, 16 bp, H. sapiens
tttaaaaattagcctg

SEQ ID NO: 168184 - DNA, 16 bp, H. sapiens
tttaaaaattaggttt

SEQ ID NO: 168185 - DNA, 16 bp, H. sapiens
tttaaaaattagtaag

SEQ ID NO: 168186 - DNA, 16 bp, H. sapiens
tttaaaaattatacac

SEQ ID NO: 168187 - DNA, 16 bp, H. sapiens
tttaaaaattatccag

SEQ ID NO: 168188 - DNA, 16 bp, H. sapiens
tttaaaaattatcttg

SEQ ID NO: 168189 - DNA, 16 bp, H. sapiens
tttaaaaattcatctt

SEQ ID NO: 168190 - DNA, 16 bp, H. sapiens
tttaaaaattccaaag

SEQ ID NO: 168191 - DNA, 16 bp, H. sapiens
tttaaaaattccaaat

SEQ ID NO: 168192 - DNA, 16 bp, H. sapiens
tttaaaaattcctctt

SEQ ID NO: 168193 - DNA, 16 bp, H. sapiens
tttaaaaattctaaag

SEQ ID NO: 168194 - DNA, 16 bp, H. sapiens
tttaaaaattctcaaa

SEQ ID NO: 168195 - DNA, 16 bp, H. sapiens
tttaaaaattctctct

SEQ ID NO: 168196 - DNA, 16 bp, H. sapiens
tttaaaaattctttcc

SEQ ID NO: 168197 - DNA, 16 bp, H. sapiens
tttaaaaattgaggca

SEQ ID NO: 168198 - DNA, 16 bp, H. sapiens
tttaaaaattgatgaa

SEQ ID NO: 168199 - DNA, 16 bp, H. sapiens
tttaaaaattgatgta

SEQ ID NO: 168200 - DNA, 16 bp, H. sapiens
tttaaaaattggaatt

SEQ ID NO: 168201 - DNA, 16 bp, H. sapiens
tttaaaaattggtaaa

SEQ ID NO: 168202 - DNA, 16 bp, H. sapiens
tttaaaaattgtctct

SEQ ID NO: 168203 - DNA, 16 bp, H. sapiens
tttaaaaattgtgaat

SEQ ID NO: 168204 - DNA, 16 bp, H. sapiens
tttaaaaattgttact

SEQ ID NO: 168205 - DNA, 16 bp, H. sapiens
tttaaaaatttcattg

SEQ ID NO: 168206 - DNA, 16 bp, H. sapiens
tttaaaaatttggaat

SEQ ID NO: 168207 - DNA, 16 bp, H. sapiens
tttaaaaattttctca

SEQ ID NO: 168208 - DNA, 16 bp, H. sapiens
tttaaaaattttgaga

SEQ ID NO: 168209 - DNA, 16 bp, H. sapiens
tttaaaacaaaagcaa

SEQ ID NO: 168210 - DNA, 16 bp, H. sapiens
tttaaaacaaatagaa

SEQ ID NO: 168211 - DNA, 16 bp, H. sapiens
tttaaaacaaatgaaa

SEQ ID NO: 168212 - DNA, 16 bp, H. sapiens
tttaaaacaaattatg

SEQ ID NO: 168213 - DNA, 16 bp, H. sapiens
tttaaaacaaatttct

SEQ ID NO: 168214 - DNA, 16 bp, H. sapiens
tttaaaacaactgttt

SEQ ID NO: 168215 - DNA, 16 bp, H. sapiens
tttaaaacaatttgtt

SEQ ID NO: 168216 - DNA, 16 bp, H. sapiens
tttaaaacacaaatga

SEQ ID NO: 168217 - DNA, 16 bp, H. sapiens
tttaaaacactgattt

SEQ ID NO: 168218 - DNA, 16 bp, H. sapiens
tttaaaacagaaagaa

SEQ ID NO: 168219 - DNA, 16 bp, H. sapiens
tttaaaacagaaatca

SEQ ID NO: 168220 - DNA, 16 bp, H. sapiens
tttaaaacagagtctt

SEQ ID NO: 168221 - DNA, 16 bp, H. sapiens
tttaaaacagatattt

SEQ ID NO: 168222 - DNA, 16 bp, H. sapiens
tttaaaacagcaaaat

SEQ ID NO: 168223 - DNA, 16 bp, H. sapiens
tttaaaacagctttat

SEQ ID NO: 168224 - DNA, 16 bp, H. sapiens
tttaaaacagcttttt

SEQ ID NO: 168225 - DNA, 16 bp, H. sapiens
tttaaaacagttattt

SEQ ID NO: 168226 - DNA, 16 bp, H. sapiens
tttaaaacataaaagt

SEQ ID NO: 168227 - DNA, 16 bp, H. sapiens
tttaaaacataagcaa

SEQ ID NO: 168228 - DNA, 16 bp, H. sapiens
tttaaaacatcaattt

SEQ ID NO: 168229 - DNA, 16 bp, H. sapiens
tttaaaacatcagaaa

SEQ ID NO: 168230 - DNA, 16 bp, H. sapiens
tttaaaacatcattca

SEQ ID NO: 168231 - DNA, 16 bp, H. sapiens
tttaaaacatgcaaat

SEQ ID NO: 168232 - DNA, 16 bp, H. sapiens
tttaaaacatgtaaaa

SEQ ID NO: 168233 - DNA, 16 bp, H. sapiens
tttaaaacatgtaata

SEQ ID NO: 168234 - DNA, 16 bp, H. sapiens
tttaaaacattcttta

SEQ ID NO: 168235 - DNA, 16 bp, H. sapiens
tttaaaacatttccat

SEQ ID NO: 168236 - DNA, 16 bp, H. sapiens
tttaaaacatttctta

SEQ ID NO: 168237 - DNA, 16 bp, H. sapiens
tttaaaaccaaagaaa

SEQ ID NO: 168238 - DNA, 16 bp, H. sapiens
tttaaaaccaaatatt

SEQ ID NO: 168239 - DNA, 16 bp, H. sapiens
tttaaaaccattattt

SEQ ID NO: 168240 - DNA, 16 bp, H. sapiens
tttaaaaccatttaaa

SEQ ID NO: 168241 - DNA, 16 bp, H. sapiens
tttaaaactaaaactt

SEQ ID NO: 168242 - DNA, 16 bp, H. sapiens
tttaaaactaatgaaa

SEQ ID NO: 168243 - DNA, 16 bp, H. sapiens
tttaaaactatttttg

SEQ ID NO: 168244 - DNA, 16 bp, H. sapiens
tttaaaactctggaaa

SEQ ID NO: 168245 - DNA, 16 bp, H. sapiens
tttaaaactcttgaaa

SEQ ID NO: 168246 - DNA, 16 bp, H. sapiens
tttaaaactgtaattt

SEQ ID NO: 168247 - DNA, 16 bp, H. sapiens
tttaaaactgtgtagc

SEQ ID NO: 168248 - DNA, 16 bp, H. sapiens
tttaaaacttagctgg

SEQ ID NO: 168249 - DNA, 16 bp, H. sapiens
tttaaaacttcagttt

SEQ ID NO: 168250 - DNA, 16 bp, H. sapiens
tttaaaacttctaaaa

SEQ ID NO: 168251 - DNA, 16 bp, H. sapiens
tttaaaacttctttaa

SEQ ID NO: 168252 - DNA, 16 bp, H. sapiens
tttaaaactttgaaat

SEQ ID NO: 168253 - DNA, 16 bp, H. sapiens
tttaaaactttgtttt

SEQ ID NO: 168254 - DNA, 16 bp, H. sapiens
tttaaaacttttagtt

SEQ ID NO: 168255 - DNA, 16 bp, H. sapiens
tttaaaacttttccaa

SEQ ID NO: 168256 - DNA, 16 bp, H. sapiens
tttaaaagaaaaatct

SEQ ID NO: 168257 - DNA, 16 bp, H. sapiens
tttaaaagaaaacaca

SEQ ID NO: 168258 - DNA, 16 bp, H. sapiens
tttaaaagaaaacatt

SEQ ID NO: 168259 - DNA, 16 bp, H. sapiens
tttaaaagaaaagcca

SEQ ID NO: 168260 - DNA, 16 bp, H. sapiens
tttaaaagaaaatcta

SEQ ID NO: 168261 - DNA, 16 bp, H. sapiens
tttaaaagaaaatttc

SEQ ID NO: 168262 - DNA, 16 bp, H. sapiens
tttaaaagaaactatt

SEQ ID NO: 168263 - DNA, 16 bp, H. sapiens
tttaaaagaacattta

SEQ ID NO: 168264 - DNA, 16 bp, H. sapiens
tttaaaagaacatttt

SEQ ID NO: 168265 - DNA, 16 bp, H. sapiens
tttaaaagaaccaaaa

SEQ ID NO: 168266 - DNA, 16 bp, H. sapiens
tttaaaagaactaaaa

SEQ ID NO: 168267 - DNA, 16 bp, H. sapiens
tttaaaagaagatttt

SEQ ID NO: 168268 - DNA, 16 bp, H. sapiens
tttaaaagaatgtata

SEQ ID NO: 168269 - DNA, 16 bp, H. sapiens
tttaaaagacaaaaat

SEQ ID NO: 168270 - DNA, 16 bp, H. sapiens
tttaaaagactaataa

SEQ ID NO: 168271 - DNA, 16 bp, H. sapiens
tttaaaagactatttt

SEQ ID NO: 168272 - DNA, 16 bp, H. sapiens
tttaaaagactgaaaa

SEQ ID NO: 168273 - DNA, 16 bp, H. sapiens
tttaaaagacttaaaa

SEQ ID NO: 168274 - DNA, 16 bp, H. sapiens
tttaaaagacttttat

SEQ ID NO: 168275 - DNA, 16 bp, H. sapiens
tttaaaagagaaaatc

SEQ ID NO: 168276 - DNA, 16 bp, H. sapiens
tttaaaagagagagaa

SEQ ID NO: 168277 - DNA, 16 bp, H. sapiens
tttaaaagagattttt

SEQ ID NO: 168278 - DNA, 16 bp, H. sapiens
tttaaaagaggagaaa

SEQ ID NO: 168279 - DNA, 16 bp, H. sapiens
tttaaaagagttttct

SEQ ID NO: 168280 - DNA, 16 bp, H. sapiens
tttaaaagataaaatc

SEQ ID NO: 168281 - DNA, 16 bp, H. sapiens
tttaaaagatatttca

SEQ ID NO: 168282 - DNA, 16 bp, H. sapiens
tttaaaagatattttg

SEQ ID NO: 168283 - DNA, 16 bp, H. sapiens
tttaaaagatcataaa

SEQ ID NO: 168284 - DNA, 16 bp, H. sapiens
tttaaaagatcctttt

SEQ ID NO: 168285 - DNA, 16 bp, H. sapiens
tttaaaagatcttttt

SEQ ID NO: 168286 - DNA, 16 bp, H. sapiens
tttaaaagatgaagaa

SEQ ID NO: 168287 - DNA, 16 bp, H. sapiens
tttaaaagatgctttc

SEQ ID NO: 168288 - DNA, 16 bp, H. sapiens
tttaaaagatgctttt

SEQ ID NO: 168289 - DNA, 16 bp, H. sapiens
tttaaaagatgtttat

SEQ ID NO: 168290 - DNA, 16 bp, H. sapiens
tttaaaagatttattg

SEQ ID NO: 168291 - DNA, 16 bp, H. sapiens
tttaaaagcaaaaatt

SEQ ID NO: 168292 - DNA, 16 bp, H. sapiens
tttaaaagcaaaataa

SEQ ID NO: 168293 - DNA, 16 bp, H. sapiens
tttaaaagcagaaaat

SEQ ID NO: 168294 - DNA, 16 bp, H. sapiens
tttaaaagcagaaaga

SEQ ID NO: 168295 - DNA, 16 bp, H. sapiens
tttaaaagcataattt

SEQ ID NO: 168296 - DNA, 16 bp, H. sapiens
tttaaaagcatttata

SEQ ID NO: 168297 - DNA, 16 bp, H. sapiens
tttaaaagcatttatt

SEQ ID NO: 168298 - DNA, 16 bp, H. sapiens
tttaaaagcatttttt

SEQ ID NO: 168299 - DNA, 16 bp, H. sapiens
tttaaaagctatttta

SEQ ID NO: 168300 - DNA, 16 bp, H. sapiens
tttaaaagctcccagg

SEQ ID NO: 168301 - DNA, 16 bp, H. sapiens
tttaaaagctgaaaat

SEQ ID NO: 168302 - DNA, 16 bp, H. sapiens
tttaaaagcttctgca

SEQ ID NO: 168303 - DNA, 16 bp, H. sapiens
tttaaaagctttagaa

SEQ ID NO: 168304 - DNA, 16 bp, H. sapiens
tttaaaagctttcttt

SEQ ID NO: 168305 - DNA, 16 bp, H. sapiens
tttaaaaggaaatatc

SEQ ID NO: 168306 - DNA, 16 bp, H. sapiens
tttaaaaggaaatgtt

SEQ ID NO: 168307 - DNA, 16 bp, H. sapiens
tttaaaaggaaatttt

SEQ ID NO: 168308 - DNA, 16 bp, H. sapiens
tttaaaaggaagaaat

SEQ ID NO: 168309 - DNA, 16 bp, H. sapiens
tttaaaaggaatattt

SEQ ID NO: 168310 - DNA, 16 bp, H. sapiens
tttaaaaggactaaaa

SEQ ID NO: 168311 - DNA, 16 bp, H. sapiens
tttaaaaggactttat

SEQ ID NO: 168312 - DNA, 16 bp, H. sapiens
tttaaaaggagacatt

SEQ ID NO: 168313 - DNA, 16 bp, H. sapiens
tttaaaaggattttta

SEQ ID NO: 168314 - DNA, 16 bp, H. sapiens
tttaaaaggcacattt

SEQ ID NO: 168315 - DNA, 16 bp, H. sapiens
tttaaaagggaaacag

SEQ ID NO: 168316 - DNA, 16 bp, H. sapiens
tttaaaagggaaagaa

SEQ ID NO: 168317 - DNA, 16 bp, H. sapiens
tttaaaaggggaaaat

SEQ ID NO: 168318 - DNA, 16 bp, H. sapiens
tttaaaaggtaatttt

SEQ ID NO: 168319 - DNA, 16 bp, H. sapiens
tttaaaaggtatttat

SEQ ID NO: 168320 - DNA, 16 bp, H. sapiens
tttaaaaggtgaattt

SEQ ID NO: 168321 - DNA, 16 bp, H. sapiens
tttaaaaggtggtttt

SEQ ID NO: 168322 - DNA, 16 bp, H. sapiens
tttaaaaggttaaata

SEQ ID NO: 168323 - DNA, 16 bp, H. sapiens
tttaaaagtaaacttt

SEQ ID NO: 168324 - DNA, 16 bp, H. sapiens
tttaaaagtaaatgat

SEQ ID NO: 168325 - DNA, 16 bp, H. sapiens
tttaaaagtaaatgca

SEQ ID NO: 168326 - DNA, 16 bp, H. sapiens
tttaaaagtaacaaaa

SEQ ID NO: 168327 - DNA, 16 bp, H. sapiens
tttaaaagtaactaaa

SEQ ID NO: 168328 - DNA, 16 bp, H. sapiens
tttaaaagtaatttct

SEQ ID NO: 168329 - DNA, 16 bp, H. sapiens
tttaaaagtacttatt

SEQ ID NO: 168330 - DNA, 16 bp, H. sapiens
tttaaaagtatattct

SEQ ID NO: 168331 - DNA, 16 bp, H. sapiens
tttaaaagtcattatt

SEQ ID NO: 168332 - DNA, 16 bp, H. sapiens
tttaaaagtctaattt

SEQ ID NO: 168333 - DNA, 16 bp, H. sapiens
tttaaaagtgaacaaa

SEQ ID NO: 168334 - DNA, 16 bp, H. sapiens
tttaaaagtgaatatt

SEQ ID NO: 168335 - DNA, 16 bp, H. sapiens
tttaaaagtgaatttt

SEQ ID NO: 168336 - DNA, 16 bp, H. sapiens
tttaaaagtgtgtggc

SEQ ID NO: 168337 - DNA, 16 bp, H. sapiens
tttaaaagttaaaaac

SEQ ID NO: 168338 - DNA, 16 bp, H. sapiens
tttaaaagttaaacat

SEQ ID NO: 168339 - DNA, 16 bp, H. sapiens
tttaaaagttactttt

SEQ ID NO: 168340 - DNA, 16 bp, H. sapiens
tttaaaagttctattt

SEQ ID NO: 168341 - DNA, 16 bp, H. sapiens
tttaaaagttctttgt

SEQ ID NO: 168342 - DNA, 16 bp, H. sapiens
tttaaaagtttaaaag

SEQ ID NO: 168343 - DNA, 16 bp, H. sapiens
tttaaaagtttggaaa

SEQ ID NO: 168344 - DNA, 16 bp, H. sapiens
tttaaaagttttaaag

SEQ ID NO: 168345 - DNA, 16 bp, H. sapiens
tttaaaagtttttctt

SEQ ID NO: 168346 - DNA, 16 bp, H. sapiens
tttaaaataaaactct

SEQ ID NO: 168347 - DNA, 16 bp, H. sapiens
tttaaaataaagatgt

SEQ ID NO: 168348 - DNA, 16 bp, H. sapiens
tttaaaataaatagtg

SEQ ID NO: 168349 - DNA, 16 bp, H. sapiens
tttaaaataaattcag

SEQ ID NO: 168350 - DNA, 16 bp, H. sapiens
tttaaaataaattcct

SEQ ID NO: 168351 - DNA, 16 bp, H. sapiens
tttaaaataacagaat

SEQ ID NO: 168352 - DNA, 16 bp, H. sapiens
tttaaaataactagaa

SEQ ID NO: 168353 - DNA, 16 bp, H. sapiens
tttaaaataagctatt

SEQ ID NO: 168354 - DNA, 16 bp, H. sapiens
tttaaaataagctttt

SEQ ID NO: 168355 - DNA, 16 bp, H. sapiens
tttaaaataatcagaa

SEQ ID NO: 168356 - DNA, 16 bp, H. sapiens
tttaaaataatgatct

SEQ ID NO: 168357 - DNA, 16 bp, H. sapiens
tttaaaatacaaatag

SEQ ID NO: 168358 - DNA, 16 bp, H. sapiens
tttaaaatacagaaaa

SEQ ID NO: 168359 - DNA, 16 bp, H. sapiens
tttaaaatacattctc

SEQ ID NO: 168360 - DNA, 16 bp, H. sapiens
tttaaaatacctattt

SEQ ID NO: 168361 - DNA, 16 bp, H. sapiens
tttaaaatagataaca

SEQ ID NO: 168362 - DNA, 16 bp, H. sapiens
tttaaaatagccacaa

SEQ ID NO: 168363 - DNA, 16 bp, H. sapiens
tttaaaataggatttt

SEQ ID NO: 168364 - DNA, 16 bp, H. sapiens
tttaaaatagttttct

SEQ ID NO: 168365 - DNA, 16 bp, H. sapiens
tttaaaatatactgaa

SEQ ID NO: 168366 - DNA, 16 bp, H. sapiens
tttaaaatatatgaag

SEQ ID NO: 168367 - DNA, 16 bp, H. sapiens
tttaaaatatatgctt

SEQ ID NO: 168368 - DNA, 16 bp, H. sapiens
tttaaaatatctacat

SEQ ID NO: 168369 - DNA, 16 bp, H. sapiens
tttaaaatatctcttc

SEQ ID NO: 168370 - DNA, 16 bp, H. sapiens
tttaaaatatctgaaa

SEQ ID NO: 168371 - DNA, 16 bp, H. sapiens
tttaaaatatcttcat

SEQ ID NO: 168372 - DNA, 16 bp, H. sapiens
tttaaaatatgaaagt

SEQ ID NO: 168373 - DNA, 16 bp, H. sapiens
tttaaaatatgaagtt

SEQ ID NO: 168374 - DNA, 16 bp, H. sapiens
tttaaaatatgtgcat

SEQ ID NO: 168375 - DNA, 16 bp, H. sapiens
tttaaaatatgtgctt

SEQ ID NO: 168376 - DNA, 16 bp, H. sapiens
tttaaaatattgcata

SEQ ID NO: 168377 - DNA, 16 bp, H. sapiens
tttaaaatatttgtga

SEQ ID NO: 168378 - DNA, 16 bp, H. sapiens
tttaaaatcaaacatt

SEQ ID NO: 168379 - DNA, 16 bp, H. sapiens
tttaaaatcagattgt

SEQ ID NO: 168380 - DNA, 16 bp, H. sapiens
tttaaaatcatacatt

SEQ ID NO: 168381 - DNA, 16 bp, H. sapiens
tttaaaatcatcttta

SEQ ID NO: 168382 - DNA, 16 bp, H. sapiens
tttaaaatccattctt

SEQ ID NO: 168383 - DNA, 16 bp, H. sapiens
tttaaaatccatttta

SEQ ID NO: 168384 - DNA, 16 bp, H. sapiens
tttaaaatcctttttg

SEQ ID NO: 168385 - DNA, 16 bp, H. sapiens
tttaaaatctctttca

SEQ ID NO: 168386 - DNA, 16 bp, H. sapiens
tttaaaatctgctttt

SEQ ID NO: 168387 - DNA, 16 bp, H. sapiens
tttaaaatctggaaat

SEQ ID NO: 168388 - DNA, 16 bp, H. sapiens
tttaaaatctgtaatt

SEQ ID NO: 168389 - DNA, 16 bp, H. sapiens
tttaaaatctgttttt

SEQ ID NO: 168390 - DNA, 16 bp, H. sapiens
tttaaaatcttctctt

SEQ ID NO: 168391 - DNA, 16 bp, H. sapiens
tttaaaatgaaagaca

SEQ ID NO: 168392 - DNA, 16 bp, H. sapiens
tttaaaatgaatacaa

SEQ ID NO: 168393 - DNA, 16 bp, H. sapiens
tttaaaatgaatttct

SEQ ID NO: 168394 - DNA, 16 bp, H. sapiens
tttaaaatgacttttc

SEQ ID NO: 168395 - DNA, 16 bp, H. sapiens
tttaaaatgacttttt

SEQ ID NO: 168396 - DNA, 16 bp, H. sapiens
tttaaaatgatgtaaa

SEQ ID NO: 168397 - DNA, 16 bp, H. sapiens
tttaaaatgatttcat

SEQ ID NO: 168398 - DNA, 16 bp, H. sapiens
tttaaaatgattttct

SEQ ID NO: 168399 - DNA, 16 bp, H. sapiens
tttaaaatgcaacttt

SEQ ID NO: 168400 - DNA, 16 bp, H. sapiens
tttaaaatgcacaaaa

SEQ ID NO: 168401 - DNA, 16 bp, H. sapiens
tttaaaatgcacttaa

SEQ ID NO: 168402 - DNA, 16 bp, H. sapiens
tttaaaatgcataaaa

SEQ ID NO: 168403 - DNA, 16 bp, H. sapiens
tttaaaatgcataatt

SEQ ID NO: 168404 - DNA, 16 bp, H. sapiens
tttaaaatgcattaaa

SEQ ID NO: 168405 - DNA, 16 bp, H. sapiens
tttaaaatgcattttt

SEQ ID NO: 168406 - DNA, 16 bp, H. sapiens
tttaaaatgctaatat

SEQ ID NO: 168407 - DNA, 16 bp, H. sapiens
tttaaaatgcttaaaa

SEQ ID NO: 168408 - DNA, 16 bp, H. sapiens
tttaaaatgcttattt

SEQ ID NO: 168409 - DNA, 16 bp, H. sapiens
tttaaaatggaaacag

SEQ ID NO: 168410 - DNA, 16 bp, H. sapiens
tttaaaatggaaagtt

SEQ ID NO: 168411 - DNA, 16 bp, H. sapiens
tttaaaatggaaatgt

SEQ ID NO: 168412 - DNA, 16 bp, H. sapiens
tttaaaatggaagaaa

SEQ ID NO: 168413 - DNA, 16 bp, H. sapiens
tttaaaatggaatatt

SEQ ID NO: 168414 - DNA, 16 bp, H. sapiens
tttaaaatggactttt

SEQ ID NO: 168415 - DNA, 16 bp, H. sapiens
tttaaaatggattaaa

SEQ ID NO: 168416 - DNA, 16 bp, H. sapiens
tttaaaatggtgaatt

SEQ ID NO: 168417 - DNA, 25 bp, H. sapiens
tttaaaatggttaacagataagcca

SEQ ID NO: 168418 - DNA, 16 bp, H. sapiens
tttaaaatgtaaaagt

SEQ ID NO: 168419 - DNA, 16 bp, H. sapiens
tttaaaatgtaaatgt

SEQ ID NO: 168420 - DNA, 16 bp, H. sapiens
tttaaaatgtaagata

SEQ ID NO: 168421 - DNA, 16 bp, H. sapiens
tttaaaatgtaagatt

SEQ ID NO: 168422 - DNA, 16 bp, H. sapiens
tttaaaatgtaagcat

SEQ ID NO: 168423 - DNA, 16 bp, H. sapiens
tttaaaatgtaagtga

SEQ ID NO: 168424 - DNA, 16 bp, H. sapiens
tttaaaatgtacataa

SEQ ID NO: 168425 - DNA, 16 bp, H. sapiens
tttaaaatgtatcttt

SEQ ID NO: 168426 - DNA, 16 bp, H. sapiens
tttaaaatgtatgtaa

SEQ ID NO: 168427 - DNA, 16 bp, H. sapiens
tttaaaatgtatttac

SEQ ID NO: 168428 - DNA, 16 bp, H. sapiens
tttaaaatgtatttga

SEQ ID NO: 168429 - DNA, 16 bp, H. sapiens
tttaaaatgtcaacat

SEQ ID NO: 168430 - DNA, 16 bp, H. sapiens
tttaaaatgtcagaaa

SEQ ID NO: 168431 - DNA, 16 bp, H. sapiens
tttaaaatgtcatctt

SEQ ID NO: 168432 - DNA, 16 bp, H. sapiens
tttaaaatgtcatttg

SEQ ID NO: 168433 - DNA, 16 bp, H. sapiens
tttaaaatgtgaacat

SEQ ID NO: 168434 - DNA, 16 bp, H. sapiens
tttaaaatgtgaattt

SEQ ID NO: 168435 - DNA, 16 bp, H. sapiens
tttaaaatgtggaatt

SEQ ID NO: 168436 - DNA, 16 bp, H. sapiens
tttaaaatgtgtatat

SEQ ID NO: 168437 - DNA, 16 bp, H. sapiens
tttaaaatgtgttaaa

SEQ ID NO: 168438 - DNA, 16 bp, H. sapiens
tttaaaatgtgtttct

SEQ ID NO: 168439 - DNA, 16 bp, H. sapiens
tttaaaatgtgtttgt

SEQ ID NO: 168440 - DNA, 16 bp, H. sapiens
tttaaaatgttacata

SEQ ID NO: 168441 - DNA, 16 bp, H. sapiens
tttaaaatgttacttt

SEQ ID NO: 168442 - DNA, 16 bp, H. sapiens
tttaaaatgttctttc

SEQ ID NO: 168443 - DNA, 16 bp, H. sapiens
tttaaaatgtttagaa

SEQ ID NO: 168444 - DNA, 16 bp, H. sapiens
tttaaaatgtttatca

SEQ ID NO: 168445 - DNA, 16 bp, H. sapiens
tttaaaatgtttcttg

SEQ ID NO: 168446 - DNA, 16 bp, H. sapiens
tttaaaatgttttctt

SEQ ID NO: 168447 - DNA, 16 bp, H. sapiens
tttaaaatgttttgaa

SEQ ID NO: 168448 - DNA, 16 bp, H. sapiens
tttaaaattaaccttt

SEQ ID NO: 168449 - DNA, 16 bp, H. sapiens
tttaaaattaagcttt

SEQ ID NO: 168450 - DNA, 16 bp, H. sapiens
tttaaaattaaggatt

SEQ ID NO: 168451 - DNA, 16 bp, H. sapiens
tttaaaattacatgtg

SEQ ID NO: 168452 - DNA, 16 bp, H. sapiens
tttaaaattacattct

SEQ ID NO: 168453 - DNA, 16 bp, H. sapiens
tttaaaattactgaat

SEQ ID NO: 168454 - DNA, 16 bp, H. sapiens
tttaaaattagtcttt

SEQ ID NO: 168455 - DNA, 16 bp, H. sapiens
tttaaaattatgtatc

SEQ ID NO: 168456 - DNA, 16 bp, H. sapiens
tttaaaattattgcta

SEQ ID NO: 168457 - DNA, 16 bp, H. sapiens
tttaaaattattggta

SEQ ID NO: 168458 - DNA, 16 bp, H. sapiens
tttaaaattcagtaaa

SEQ ID NO: 168459 - DNA, 16 bp, H. sapiens
tttaaaattcagttca

SEQ ID NO: 168460 - DNA, 16 bp, H. sapiens
tttaaaattcagtttt

SEQ ID NO: 168461 - DNA, 16 bp, H. sapiens
tttaaaattcatgtgg

SEQ ID NO: 168462 - DNA, 16 bp, H. sapiens
tttaaaattccaaata

SEQ ID NO: 168463 - DNA, 16 bp, H. sapiens
tttaaaattccttttc

SEQ ID NO: 168464 - DNA, 16 bp, H. sapiens
tttaaaattctctctt

SEQ ID NO: 168465 - DNA, 16 bp, H. sapiens
tttaaaattctcttct

SEQ ID NO: 168466 - DNA, 16 bp, H. sapiens
tttaaaattcttcctt

SEQ ID NO: 168467 - DNA, 16 bp, H. sapiens
tttaaaattgagaaat

SEQ ID NO: 168468 - DNA, 16 bp, H. sapiens
tttaaaattgcttaaa

SEQ ID NO: 168469 - DNA, 16 bp, H. sapiens
tttaaaattggattgt

SEQ ID NO: 168470 - DNA, 16 bp, H. sapiens
tttaaaattgtcttta

SEQ ID NO: 168471 - DNA, 16 bp, H. sapiens
tttaaaattgttacat

SEQ ID NO: 168472 - DNA, 16 bp, H. sapiens
tttaaaattgttttca

SEQ ID NO: 168473 - DNA, 16 bp, H. sapiens
tttaaaattgttttct

SEQ ID NO: 168474 - DNA, 16 bp, H. sapiens
tttaaaatttaaaacc

SEQ ID NO: 168475 - DNA, 16 bp, H. sapiens
tttaaaatttcacaaa

SEQ ID NO: 168476 - DNA, 16 bp, H. sapiens
tttaaaatttcagttt

SEQ ID NO: 168477 - DNA, 16 bp, H. sapiens
tttaaaatttcttgtg

SEQ ID NO: 168478 - DNA, 16 bp, H. sapiens
tttaaaattttgatga

SEQ ID NO: 168479 - DNA, 16 bp, H. sapiens
tttaaaattttgcttt

SEQ ID NO: 168480 - DNA, 16 bp, H. sapiens
tttaaaatttttctgt

SEQ ID NO: 168481 - DNA, 16 bp, H. sapiens
tttaaaatttttgcca

SEQ ID NO: 168482 - DNA, 16 bp, H. sapiens
tttaaaatttttgtct

SEQ ID NO: 168483 - DNA, 16 bp, H. sapiens
tttaaacaaaagcaaa

SEQ ID NO: 168484 - DNA, 16 bp, H. sapiens
tttaaacaaacaaaga

SEQ ID NO: 168485 - DNA, 16 bp, H. sapiens
tttaaacaaagacagt

SEQ ID NO: 168486 - DNA, 16 bp, H. sapiens
tttaaacaaaggagat

SEQ ID NO: 168487 - DNA, 16 bp, H. sapiens
tttaaacaaattgaag

SEQ ID NO: 168488 - DNA, 16 bp, H. sapiens
tttaaacaaatttgaa

SEQ ID NO: 168489 - DNA, 16 bp, H. sapiens
tttaaacaatatttca

SEQ ID NO: 168490 - DNA, 16 bp, H. sapiens
tttaaacacattattt

SEQ ID NO: 168491 - DNA, 16 bp, H. sapiens
tttaaacagaaacaca

SEQ ID NO: 168492 - DNA, 16 bp, H. sapiens
tttaaacataactttt

SEQ ID NO: 168493 - DNA, 16 bp, H. sapiens
tttaaacatcttaaat

SEQ ID NO: 168494 - DNA, 16 bp, H. sapiens
tttaaacatctttaaa

SEQ ID NO: 168495 - DNA, 16 bp, H. sapiens
tttaaacatgtttaaa

SEQ ID NO: 168496 - DNA, 16 bp, H. sapiens
tttaaacattaaacat

SEQ ID NO: 168497 - DNA, 16 bp, H. sapiens
tttaaacattgaaaaa

SEQ ID NO: 168498 - DNA, 16 bp, H. sapiens
tttaaacattgttttc

SEQ ID NO: 168499 - DNA, 16 bp, H. sapiens
tttaaacattttcata

SEQ ID NO: 168500 - DNA, 16 bp, H. sapiens
tttaaaccaacaaaca

SEQ ID NO: 168501 - DNA, 16 bp, H. sapiens
tttaaaccatttaaaa

SEQ ID NO: 168502 - DNA, 16 bp, H. sapiens
tttaaacccaggaggc

SEQ ID NO: 168503 - DNA, 16 bp, H. sapiens
tttaaacttctttgtt

SEQ ID NO: 168504 - DNA, 16 bp, H. sapiens
tttaaactttagtttt

SEQ ID NO: 168505 - DNA, 16 bp, H. sapiens
tttaaactttctaaat

SEQ ID NO: 168506 - DNA, 16 bp, H. sapiens
tttaaacttttttgct

SEQ ID NO: 168507 - DNA, 16 bp, H. sapiens
tttaaagaaaaactaa

SEQ ID NO: 168508 - DNA, 16 bp, H. sapiens
tttaaagaaaacattt

SEQ ID NO: 168509 - DNA, 16 bp, H. sapiens
tttaaagaaaagtaca

SEQ ID NO: 168510 - DNA, 16 bp, H. sapiens
tttaaagaaaatcata

SEQ ID NO: 168511 - DNA, 16 bp, H. sapiens
tttaaagaaaatcttt

SEQ ID NO: 168512 - DNA, 16 bp, H. sapiens
tttaaagaaaatgaac

SEQ ID NO: 168513 - DNA, 16 bp, H. sapiens
tttaaagaaaatgtta

SEQ ID NO: 168514 - DNA, 16 bp, H. sapiens
tttaaagaaacaataa

SEQ ID NO: 168515 - DNA, 16 bp, H. sapiens
tttaaagaaacagaaa

SEQ ID NO: 168516 - DNA, 16 bp, H. sapiens
tttaaagaaacagcag

SEQ ID NO: 168517 - DNA, 16 bp, H. sapiens
tttaaagaaactacca

SEQ ID NO: 168518 - DNA, 16 bp, H. sapiens
tttaaagaaacttttt

SEQ ID NO: 168519 - DNA, 16 bp, H. sapiens
tttaaagaaagtgttt

SEQ ID NO: 168520 - DNA, 16 bp, H. sapiens
tttaaagaaagtttat

SEQ ID NO: 168521 - DNA, 16 bp, H. sapiens
tttaaagaaatatgtt

SEQ ID NO: 168522 - DNA, 16 bp, H. sapiens
tttaaagaaatgtttt

SEQ ID NO: 168523 - DNA, 16 bp, H. sapiens
tttaaagaaattactt

SEQ ID NO: 168524 - DNA, 16 bp, H. sapiens
tttaaagaacaaattt

SEQ ID NO: 168525 - DNA, 16 bp, H. sapiens
tttaaagaactacctg

SEQ ID NO: 168526 - DNA, 16 bp, H. sapiens
tttaaagaagagaaat

SEQ ID NO: 168527 - DNA, 16 bp, H. sapiens
tttaaagaagaggaaa

SEQ ID NO: 168528 - DNA, 16 bp, H. sapiens
tttaaagaagagtttt

SEQ ID NO: 168529 - DNA, 16 bp, H. sapiens
tttaaagaatatttct

SEQ ID NO: 168530 - DNA, 16 bp, H. sapiens
tttaaagaatgaatta

SEQ ID NO: 168531 - DNA, 16 bp, H. sapiens
tttaaagaattcagaa

SEQ ID NO: 168532 - DNA, 16 bp, H. sapiens
tttaaagacaaaaata

SEQ ID NO: 168533 - DNA, 16 bp, H. sapiens
tttaaagacagattct

SEQ ID NO: 168534 - DNA, 16 bp, H. sapiens
tttaaagacattttat

SEQ ID NO: 168535 - DNA, 16 bp, H. sapiens
tttaaagacatttttt

SEQ ID NO: 168536 - DNA, 16 bp, H. sapiens
tttaaagactgaaaat

SEQ ID NO: 168537 - DNA, 16 bp, H. sapiens
tttaaagagaaaagta

SEQ ID NO: 168538 - DNA, 16 bp, H. sapiens
tttaaagagaaatatt

SEQ ID NO: 168539 - DNA, 16 bp, H. sapiens
tttaaagagatgacaa

SEQ ID NO: 168540 - DNA, 16 bp, H. sapiens
tttaaagagattctgt

SEQ ID NO: 168541 - DNA, 16 bp, H. sapiens
tttaaagagatttaaa

SEQ ID NO: 168542 - DNA, 16 bp, H. sapiens
tttaaagataactttt

SEQ ID NO: 168543 - DNA, 16 bp, H. sapiens
tttaaagataaggaaa

SEQ ID NO: 168544 - DNA, 16 bp, H. sapiens
tttaaagatataaact

SEQ ID NO: 168545 - DNA, 16 bp, H. sapiens
tttaaagatgaacaaa

SEQ ID NO: 168546 - DNA, 16 bp, H. sapiens
tttaaagatgaagaaa

SEQ ID NO: 168547 - DNA, 16 bp, H. sapiens
tttaaagatgaatttt

SEQ ID NO: 168548 - DNA, 16 bp, H. sapiens
tttaaagatgagaaaa

SEQ ID NO: 168549 - DNA, 16 bp, H. sapiens
tttaaagatttaaatg

SEQ ID NO: 168550 - DNA, 16 bp, H. sapiens
tttaaagcaaaaagaa

SEQ ID NO: 168551 - DNA, 16 bp, H. sapiens
tttaaagcaaatccta

SEQ ID NO: 168552 - DNA, 16 bp, H. sapiens
tttaaagcaaatgaaa

SEQ ID NO: 168553 - DNA, 16 bp, H. sapiens
tttaaagcaatatttt

SEQ ID NO: 168554 - DNA, 16 bp, H. sapiens
tttaaagcaatgtgta

SEQ ID NO: 168555 - DNA, 16 bp, H. sapiens
tttaaagcagtttgta

SEQ ID NO: 168556 - DNA, 16 bp, H. sapiens
tttaaagcatatttta

SEQ ID NO: 168557 - DNA, 16 bp, H. sapiens
tttaaagcatttttta

SEQ ID NO: 168558 - DNA, 16 bp, H. sapiens
tttaaagcattttttt

SEQ ID NO: 168559 - DNA, 16 bp, H. sapiens
tttaaagccttttttt

SEQ ID NO: 168560 - DNA, 16 bp, H. sapiens
tttaaaggaaaaaagt

SEQ ID NO: 168561 - DNA, 16 bp, H. sapiens
tttaaaggaaaaaatg

SEQ ID NO: 168562 - DNA, 16 bp, H. sapiens
tttaaaggaaaaacaa

SEQ ID NO: 168563 - DNA, 16 bp, H. sapiens
tttaaaggaaaatgtt

SEQ ID NO: 168564 - DNA, 16 bp, H. sapiens
tttaaaggaaatttat

SEQ ID NO: 168565 - DNA, 16 bp, H. sapiens
tttaaaggaagaaaag

SEQ ID NO: 168566 - DNA, 16 bp, H. sapiens
tttaaaggaagaaaat

SEQ ID NO: 168567 - DNA, 16 bp, H. sapiens
tttaaaggaagagaga

SEQ ID NO: 168568 - DNA, 16 bp, H. sapiens
tttaaaggagaaagag

SEQ ID NO: 168569 - DNA, 16 bp, H. sapiens
tttaaaggatacaatt

SEQ ID NO: 168570 - DNA, 16 bp, H. sapiens
tttaaaggatgaaaaa

SEQ ID NO: 168571 - DNA, 16 bp, H. sapiens
tttaaaggcaaatatt

SEQ ID NO: 168572 - DNA, 16 bp, H. sapiens
tttaaaggccctatct

SEQ ID NO: 168573 - DNA, 16 bp, H. sapiens
tttaaaggctctgtct

SEQ ID NO: 168574 - DNA, 16 bp, H. sapiens
tttaaagggaaaaata

SEQ ID NO: 168575 - DNA, 16 bp, H. sapiens
tttaaaggtgaggaaa

SEQ ID NO: 168576 - DNA, 16 bp, H. sapiens
tttaaaggttaaataa

SEQ ID NO: 168577 - DNA, 16 bp, H. sapiens
tttaaaggtttttaaa

SEQ ID NO: 168578 - DNA, 16 bp, H. sapiens
tttaaagtacacaatt

SEQ ID NO: 168579 - DNA, 16 bp, H. sapiens
tttaaagtagtgtttt

SEQ ID NO: 168580 - DNA, 16 bp, H. sapiens
tttaaagtagtttctt

SEQ ID NO: 168581 - DNA, 16 bp, H. sapiens
tttaaagtagttttct

SEQ ID NO: 168582 - DNA, 16 bp, H. sapiens
tttaaagtattagaaa

SEQ ID NO: 168583 - DNA, 16 bp, H. sapiens
tttaaagtattttcta

SEQ ID NO: 168584 - DNA, 16 bp, H. sapiens
tttaaagtattttctt

SEQ ID NO: 168585 - DNA, 16 bp, H. sapiens
tttaaagtatttttct

SEQ ID NO: 168586 - DNA, 16 bp, H. sapiens
tttaaagtcaagaaaa

SEQ ID NO: 168587 - DNA, 16 bp, H. sapiens
tttaaagtctacaatt

SEQ ID NO: 168588 - DNA, 16 bp, H. sapiens
tttaaagtctgtattt

SEQ ID NO: 168589 - DNA, 16 bp, H. sapiens
tttaaagtggatttct

SEQ ID NO: 168590 - DNA, 16 bp, H. sapiens
tttaaagtgtaaaatt

SEQ ID NO: 168591 - DNA, 16 bp, H. sapiens
tttaaagtgtacaatt

SEQ ID NO: 168592 - DNA, 16 bp, H. sapiens
tttaaagtgtacattt

SEQ ID NO: 168593 - DNA, 16 bp, H. sapiens
tttaaagtgtttttct

SEQ ID NO: 168594 - DNA, 16 bp, H. sapiens
tttaaagttaatttct

SEQ ID NO: 168595 - DNA, 16 bp, H. sapiens
tttaaagttcttttta

SEQ ID NO: 168596 - DNA, 16 bp, H. sapiens
tttaaagtttcaaata

SEQ ID NO: 168597 - DNA, 16 bp, H. sapiens
tttaaagtttctgttt

SEQ ID NO: 168598 - DNA, 16 bp, H. sapiens
tttaaagttttaagaa

SEQ ID NO: 168599 - DNA, 16 bp, H. sapiens
tttaaagtttttgaaa

SEQ ID NO: 168600 - DNA, 16 bp, H. sapiens
tttaaagtttttttca

SEQ ID NO: 168601 - DNA, 16 bp, H. sapiens
tttaaataaaagaaca

SEQ ID NO: 168602 - DNA, 16 bp, H. sapiens
tttaaataaaagaggt

SEQ ID NO: 168603 - DNA, 16 bp, H. sapiens
tttaaataaaatctct

SEQ ID NO: 168604 - DNA, 16 bp, H. sapiens
tttaaataaaatgaca

SEQ ID NO: 168605 - DNA, 16 bp, H. sapiens
tttaaataaaatgtct

SEQ ID NO: 168606 - DNA, 16 bp, H. sapiens
tttaaataaacaaatg

SEQ ID NO: 168607 - DNA, 16 bp, H. sapiens
tttaaataaaggtttt

SEQ ID NO: 168608 - DNA, 16 bp, H. sapiens
tttaaataaatgaaca

SEQ ID NO: 168609 - DNA, 16 bp, H. sapiens
tttaaataaatgagta

SEQ ID NO: 168610 - DNA, 16 bp, H. sapiens
tttaaataagcaaaaa

SEQ ID NO: 168611 - DNA, 16 bp, H. sapiens
tttaaataatgttttc

SEQ ID NO: 168612 - DNA, 16 bp, H. sapiens
tttaaataattgcttt

SEQ ID NO: 168613 - DNA, 16 bp, H. sapiens
tttaaatacagaaaag

SEQ ID NO: 168614 - DNA, 16 bp, H. sapiens
tttaaatacagaattt

SEQ ID NO: 168615 - DNA, 16 bp, H. sapiens
tttaaatacattgaaa

SEQ ID NO: 168616 - DNA, 16 bp, H. sapiens
tttaaataccatctat

SEQ ID NO: 168617 - DNA, 16 bp, H. sapiens
tttaaatactgtatat

SEQ ID NO: 168618 - DNA, 16 bp, H. sapiens
tttaaatagcataaaa

SEQ ID NO: 168619 - DNA, 16 bp, H. sapiens
tttaaatagcattttt

SEQ ID NO: 168620 - DNA, 16 bp, H. sapiens
tttaaatagttgaaaa

SEQ ID NO: 168621 - DNA, 16 bp, H. sapiens
tttaaatataaacaga

SEQ ID NO: 168622 - DNA, 16 bp, H. sapiens
tttaaatatatgcaaa

SEQ ID NO: 168623 - DNA, 16 bp, H. sapiens
tttaaatatatgctat

SEQ ID NO: 168624 - DNA, 16 bp, H. sapiens
tttaaatatcagaaat

SEQ ID NO: 168625 - DNA, 16 bp, H. sapiens
tttaaatatcatcatt

SEQ ID NO: 168626 - DNA, 16 bp, H. sapiens
tttaaatatctggaaa

SEQ ID NO: 168627 - DNA, 16 bp, H. sapiens
tttaaatatgagattt

SEQ ID NO: 168628 - DNA, 16 bp, H. sapiens
tttaaatatgatttct

SEQ ID NO: 168629 - DNA, 16 bp, H. sapiens
tttaaatatgcttttt

SEQ ID NO: 168630 - DNA, 16 bp, H. sapiens
tttaaatatgtttgaa

SEQ ID NO: 168631 - DNA, 16 bp, H. sapiens
tttaaatattgctttt

SEQ ID NO: 168632 - DNA, 16 bp, H. sapiens
tttaaatatttcacat

SEQ ID NO: 168633 - DNA, 16 bp, H. sapiens
tttaaatatttgttct

SEQ ID NO: 168634 - DNA, 16 bp, H. sapiens
tttaaatattttcagt

SEQ ID NO: 168635 - DNA, 16 bp, H. sapiens
tttaaatattttgaga

SEQ ID NO: 168636 - DNA, 16 bp, H. sapiens
tttaaatcagagaaaa

SEQ ID NO: 168637 - DNA, 16 bp, H. sapiens
tttaaatcaggaagaa

SEQ ID NO: 168638 - DNA, 16 bp, H. sapiens
tttaaatcaggaagtg

SEQ ID NO: 168639 - DNA, 16 bp, H. sapiens
tttaaatcagtgaatt

SEQ ID NO: 168640 - DNA, 16 bp, H. sapiens
tttaaatccagaattt

SEQ ID NO: 168641 - DNA, 16 bp, H. sapiens
tttaaatccagtattt

SEQ ID NO: 168642 - DNA, 16 bp, H. sapiens
tttaaatcctttaaaa

SEQ ID NO: 168643 - DNA, 16 bp, H. sapiens
tttaaatctatttttg

SEQ ID NO: 168644 - DNA, 16 bp, H. sapiens
tttaaatctgtaaaat

SEQ ID NO: 168645 - DNA, 16 bp, H. sapiens
tttaaatctgttttgt

SEQ ID NO: 168646 - DNA, 16 bp, H. sapiens
tttaaatcttttatcc

SEQ ID NO: 168647 - DNA, 16 bp, H. sapiens
tttaaatcttttcaaa

SEQ ID NO: 168648 - DNA, 16 bp, H. sapiens
tttaaatcttttgccc

SEQ ID NO: 168649 - DNA, 16 bp, H. sapiens
tttaaatgaagaaatt

SEQ ID NO: 168650 - DNA, 16 bp, H. sapiens
tttaaatgaagaattt

SEQ ID NO: 168651 - DNA, 16 bp, H. sapiens
tttaaatgaagatttt

SEQ ID NO: 168652 - DNA, 16 bp, H. sapiens
tttaaatgacaaataa

SEQ ID NO: 168653 - DNA, 16 bp, H. sapiens
tttaaatgactttatt

SEQ ID NO: 168654 - DNA, 16 bp, H. sapiens
tttaaatgagtaaatt

SEQ ID NO: 168655 - DNA, 16 bp, H. sapiens
tttaaatgcaaaatta

SEQ ID NO: 168656 - DNA, 16 bp, H. sapiens
tttaaatgcttttaaa

SEQ ID NO: 168657 - DNA, 16 bp, H. sapiens
tttaaatggaaacttt

SEQ ID NO: 168658 - DNA, 16 bp, H. sapiens
tttaaatggaacattt

SEQ ID NO: 168659 - DNA, 16 bp, H. sapiens
tttaaatggagtttca

SEQ ID NO: 168660 - DNA, 16 bp, H. sapiens
tttaaatggcaaaaaa

SEQ ID NO: 168661 - DNA, 16 bp, H. sapiens
tttaaatgggtgaact

SEQ ID NO: 168662 - DNA, 16 bp, H. sapiens
tttaaatggtccattt

SEQ ID NO: 168663 - DNA, 16 bp, H. sapiens
tttaaatggttgaaaa

SEQ ID NO: 168664 - DNA, 16 bp, H. sapiens
tttaaatgtaaatgtc

SEQ ID NO: 168665 - DNA, 16 bp, H. sapiens
tttaaatgtaatacat

SEQ ID NO: 168666 - DNA, 16 bp, H. sapiens
tttaaatgtacagaaa

SEQ ID NO: 168667 - DNA, 16 bp, H. sapiens
tttaaatgtacatatt

SEQ ID NO: 168668 - DNA, 16 bp, H. sapiens
tttaaatgtaggcatt

SEQ ID NO: 168669 - DNA, 16 bp, H. sapiens
tttaaatgtcaaattt

SEQ ID NO: 168670 - DNA, 16 bp, H. sapiens
tttaaatgtcacattt

SEQ ID NO: 168671 - DNA, 16 bp, H. sapiens
tttaaatgtcttaaat

SEQ ID NO: 168672 - DNA, 16 bp, H. sapiens
tttaaatgtctttaaa

SEQ ID NO: 168673 - DNA, 16 bp, H. sapiens
tttaaatgtgtatttc

SEQ ID NO: 168674 - DNA, 16 bp, H. sapiens
tttaaatgtgtgtgtg

SEQ ID NO: 168675 - DNA, 16 bp, H. sapiens
tttaaatgtgttaaaa

SEQ ID NO: 168676 - DNA, 16 bp, H. sapiens
tttaaatgtgtttctt

SEQ ID NO: 168677 - DNA, 16 bp, H. sapiens
tttaaatgtgtttttc

SEQ ID NO: 168678 - DNA, 17 bp, H. sapiens
tttaaatgttagaccta

SEQ ID NO: 168679 - DNA, 16 bp, H. sapiens
tttaaatgttcactta

SEQ ID NO: 168680 - DNA, 16 bp, H. sapiens
tttaaatgttctgttt

SEQ ID NO: 168681 - DNA, 16 bp, H. sapiens
tttaaatgttctttca

SEQ ID NO: 168682 - DNA, 16 bp, H. sapiens
tttaaatgttgaaaga

SEQ ID NO: 168683 - DNA, 16 bp, H. sapiens
tttaaatgtttagaat

SEQ ID NO: 168684 - DNA, 16 bp, H. sapiens
tttaaatgtttcaaat

SEQ ID NO: 168685 - DNA, 16 bp, H. sapiens
tttaaatgtttcttat

SEQ ID NO: 168686 - DNA, 16 bp, H. sapiens
tttaaatgtttgcatg

SEQ ID NO: 168687 - DNA, 16 bp, H. sapiens
tttaaattaaatgtgt

SEQ ID NO: 168688 - DNA, 16 bp, H. sapiens
tttaaattacatgaaa

SEQ ID NO: 168689 - DNA, 16 bp, H. sapiens
tttaaattactttttg

SEQ ID NO: 168690 - DNA, 16 bp, H. sapiens
tttaaattagttcagc

SEQ ID NO: 168691 - DNA, 16 bp, H. sapiens
tttaaattatctgctt

SEQ ID NO: 168692 - DNA, 16 bp, H. sapiens
tttaaattatttgtct

SEQ ID NO: 168693 - DNA, 16 bp, H. sapiens
tttaaattcacattta

SEQ ID NO: 168694 - DNA, 16 bp, H. sapiens
tttaaattcagaaaat

SEQ ID NO: 168695 - DNA, 16 bp, H. sapiens
tttaaattcatgacca

SEQ ID NO: 168696 - DNA, 16 bp, H. sapiens
tttaaattcatttcct

SEQ ID NO: 168697 - DNA, 16 bp, H. sapiens
tttaaattctctctct

SEQ ID NO: 168698 - DNA, 16 bp, H. sapiens
tttaaattctctttca

SEQ ID NO: 168699 - DNA, 16 bp, H. sapiens
tttaaattgacttttt

SEQ ID NO: 168700 - DNA, 16 bp, H. sapiens
tttaaattggataatt

SEQ ID NO: 168701 - DNA, 16 bp, H. sapiens
tttaaattgttatatc

SEQ ID NO: 168702 - DNA, 16 bp, H. sapiens
tttaaattgtttcatt

SEQ ID NO: 168703 - DNA, 16 bp, H. sapiens
tttaaattgttttcat

SEQ ID NO: 168704 - DNA, 16 bp, H. sapiens
tttaaattgtttttca

SEQ ID NO: 168705 - DNA, 16 bp, H. sapiens
tttaaatttacctata

SEQ ID NO: 168706 - DNA, 16 bp, H. sapiens
tttaaatttacttttg

SEQ ID NO: 168707 - DNA, 16 bp, H. sapiens
tttaaatttcagcttt

SEQ ID NO: 168708 - DNA, 16 bp, H. sapiens
tttaaatttctgcctt

SEQ ID NO: 168709 - DNA, 16 bp, H. sapiens
tttaaatttggcattt

SEQ ID NO: 168710 - DNA, 16 bp, H. sapiens
tttaaatttgttgagg

SEQ ID NO: 168711 - DNA, 16 bp, H. sapiens
tttaaattttacttgt

SEQ ID NO: 168712 - DNA, 16 bp, H. sapiens
tttaaattttcatgaa

SEQ ID NO: 168713 - DNA, 16 bp, H. sapiens
tttaaattttctaaac

SEQ ID NO: 168714 - DNA, 16 bp, H. sapiens
tttaaattttctgatt

SEQ ID NO: 168715 - DNA, 16 bp, H. sapiens
tttaaattttgccaat

SEQ ID NO: 168716 - DNA, 16 bp, H. sapiens
tttaaattttgctaat

SEQ ID NO: 168717 - DNA, 16 bp, H. sapiens
tttaaattttggaata

SEQ ID NO: 168718 - DNA, 16 bp, H. sapiens
tttaaattttgtgtag

SEQ ID NO: 168719 - DNA, 16 bp, H. sapiens
tttaaattttgtttca

SEQ ID NO: 168720 - DNA, 16 bp, H. sapiens
tttaaatttttctgta

SEQ ID NO: 168721 - DNA, 16 bp, H. sapiens
tttaacaaaacatttt

SEQ ID NO: 168722 - DNA, 16 bp, H. sapiens
tttaacaaaataattg

SEQ ID NO: 168723 - DNA, 16 bp, H. sapiens
tttaacaaagaaagaa

SEQ ID NO: 168724 - DNA, 16 bp, H. sapiens
tttaacaagccctcca

SEQ ID NO: 168725 - DNA, 16 bp, H. sapiens
tttaacaagctcccag

SEQ ID NO: 168726 - DNA, 16 bp, H. sapiens
tttaacaatacatttt

SEQ ID NO: 168727 - DNA, 16 bp, H. sapiens
tttaacacccccaaaa

SEQ ID NO: 168728 - DNA, 16 bp, H. sapiens
tttaacagaaaaagaa

SEQ ID NO: 168729 - DNA, 16 bp, H. sapiens
tttaacagaacccaag

SEQ ID NO: 168730 - DNA, 16 bp, H. sapiens
tttaacagaagagaaa

SEQ ID NO: 168731 - DNA, 16 bp, H. sapiens
tttaacagagagaaaa

SEQ ID NO: 168732 - DNA, 16 bp, H. sapiens
tttaacagagagaatt

SEQ ID NO: 168733 - DNA, 16 bp, H. sapiens
tttaacagtttttctt

SEQ ID NO: 168734 - DNA, 16 bp, H. sapiens
tttaacataactttaa

SEQ ID NO: 168735 - DNA, 16 bp, H. sapiens
tttaacatatacaaat

SEQ ID NO: 168736 - DNA, 16 bp, H. sapiens
tttaacatatttgaaa

SEQ ID NO: 168737 - DNA, 16 bp, H. sapiens
tttaacatgaaagaat

SEQ ID NO: 168738 - DNA, 16 bp, H. sapiens
tttaacatgcatttat

SEQ ID NO: 168739 - DNA, 16 bp, H. sapiens
tttaacatgtaaaaat

SEQ ID NO: 168740 - DNA, 16 bp, H. sapiens
tttaacatgtttttct

SEQ ID NO: 168741 - DNA, 16 bp, H. sapiens
tttaacattgaaaaat

SEQ ID NO: 168742 - DNA, 16 bp, H. sapiens
tttaacatttctgaaa

SEQ ID NO: 168743 - DNA, 16 bp, H. sapiens
tttaacatttgtttta

SEQ ID NO: 168744 - DNA, 16 bp, H. sapiens
tttaacattttcctta

SEQ ID NO: 168745 - DNA, 16 bp, H. sapiens
tttaacattttctgtt

SEQ ID NO: 168746 - DNA, 16 bp, H. sapiens
tttaacattttgtttc

SEQ ID NO: 168747 - DNA, 16 bp, H. sapiens
tttaaccaaaagaaaa

SEQ ID NO: 168748 - DNA, 16 bp, H. sapiens
tttaaccaagaaggta

SEQ ID NO: 168749 - DNA, 16 bp, H. sapiens
tttaacccagaatttc

SEQ ID NO: 168750 - DNA, 31 bp, H. sapiens
tttaacccatgttaatgcctctggtctcaaa

SEQ ID NO: 168751 - DNA, 16 bp, H. sapiens
tttaaccttttttgca

SEQ ID NO: 168752 - DNA, 16 bp, H. sapiens
tttaactagacacaga

SEQ ID NO: 168753 - DNA, 16 bp, H. sapiens
tttaactattgtgaat

SEQ ID NO: 168754 - DNA, 16 bp, H. sapiens
tttaactcaggtgttt

SEQ ID NO: 168755 - DNA, 16 bp, H. sapiens
tttaactgatttttaa

SEQ ID NO: 168756 - DNA, 16 bp, H. sapiens
tttaactggtatatga

SEQ ID NO: 168757 - DNA, 16 bp, H. sapiens
tttaactgtatttttg

SEQ ID NO: 168758 - DNA, 16 bp, H. sapiens
tttaacttaatgtaat

SEQ ID NO: 168759 - DNA, 16 bp, H. sapiens
tttaacttcttcctgg

SEQ ID NO: 168760 - DNA, 16 bp, H. sapiens
tttaacttgaaatttt

SEQ ID NO: 168761 - DNA, 16 bp, H. sapiens
tttaacttgctcttct

SEQ ID NO: 168762 - DNA, 16 bp, H. sapiens
tttaacttgttcctct

SEQ ID NO: 168763 - DNA, 16 bp, H. sapiens
tttaactttcattttg

SEQ ID NO: 168764 - DNA, 16 bp, H. sapiens
tttaactttgcttaaa

SEQ ID NO: 168765 - DNA, 16 bp, H. sapiens
tttaactttgtaagaa

SEQ ID NO: 168766 - DNA, 16 bp, H. sapiens
tttaactttgttttaa

SEQ ID NO: 168767 - DNA, 16 bp, H. sapiens
tttaacttttaaaatg

SEQ ID NO: 168768 - DNA, 16 bp, H. sapiens
tttaacttttaaagaa

SEQ ID NO: 168769 - DNA, 16 bp, H. sapiens
tttaacttttaaagta

SEQ ID NO: 168770 - DNA, 16 bp, H. sapiens
tttaacttttcagaaa

SEQ ID NO: 168771 - DNA, 16 bp, H. sapiens
tttaacttttgcattt

SEQ ID NO: 168772 - DNA, 16 bp, H. sapiens
tttaactttttgaaaa

SEQ ID NO: 168773 - DNA, 16 bp, H. sapiens
tttaactttttgagga

SEQ ID NO: 168774 - DNA, 16 bp, H. sapiens
tttaacttttttgcct

SEQ ID NO: 168775 - DNA, 16 bp, H. sapiens
tttaagaaaaaaatgc

SEQ ID NO: 168776 - DNA, 16 bp, H. sapiens
tttaagaaaaacaact

SEQ ID NO: 168777 - DNA, 16 bp, H. sapiens
tttaagaaaaagtttg

SEQ ID NO: 168778 - DNA, 16 bp, H. sapiens
tttaagaaaaatatac

SEQ ID NO: 168779 - DNA, 16 bp, H. sapiens
tttaagaaaaatgcaa

SEQ ID NO: 168780 - DNA, 16 bp, H. sapiens
tttaagaaaacagaaa

SEQ ID NO: 168781 - DNA, 16 bp, H. sapiens
tttaagaaaacatgaa

SEQ ID NO: 168782 - DNA, 16 bp, H. sapiens
tttaagaaaacattga

SEQ ID NO: 168783 - DNA, 16 bp, H. sapiens
tttaagaaaactcagt

SEQ ID NO: 168784 - DNA, 16 bp, H. sapiens
tttaagaaaagtattt

SEQ ID NO: 168785 - DNA, 16 bp, H. sapiens
tttaagaaaataaaca

SEQ ID NO: 168786 - DNA, 16 bp, H. sapiens
tttaagaaaataacaa

SEQ ID NO: 168787 - DNA, 16 bp, H. sapiens
tttaagaaaataatgg

SEQ ID NO: 168788 - DNA, 16 bp, H. sapiens
tttaagaaaatgcaaa

SEQ ID NO: 168789 - DNA, 26 bp, H. sapiens
tttaagaaaatgtggcacatatacac

SEQ ID NO: 168790 - DNA, 16 bp, H. sapiens
tttaagaaaatttttg

SEQ ID NO: 168791 - DNA, 16 bp, H. sapiens
tttaagaaacaaaaca

SEQ ID NO: 168792 - DNA, 16 bp, H. sapiens
tttaagaaacaaaaga

SEQ ID NO: 168793 - DNA, 16 bp, H. sapiens
tttaagaaacagattt

SEQ ID NO: 168794 - DNA, 16 bp, H. sapiens
tttaagaaactgaaaa

SEQ ID NO: 168795 - DNA, 16 bp, H. sapiens
tttaagaaagtaaaag

SEQ ID NO: 168796 - DNA, 16 bp, H. sapiens
tttaagaaagtgaaat

SEQ ID NO: 168797 - DNA, 16 bp, H. sapiens
tttaagaaataattct

SEQ ID NO: 168798 - DNA, 16 bp, H. sapiens
tttaagaaatacaatt

SEQ ID NO: 168799 - DNA, 16 bp, H. sapiens
tttaagaaatacattg

SEQ ID NO: 168800 - DNA, 16 bp, H. sapiens
tttaagaaatactttt

SEQ ID NO: 168801 - DNA, 16 bp, H. sapiens
tttaagaaatagaaca

SEQ ID NO: 168802 - DNA, 16 bp, H. sapiens
tttaagaaatctattt

SEQ ID NO: 168803 - DNA, 16 bp, H. sapiens
tttaagaaatgaagaa

SEQ ID NO: 168804 - DNA, 16 bp, H. sapiens
tttaagaaatgagaaa

SEQ ID NO: 168805 - DNA, 16 bp, H. sapiens
tttaagaaatgtagaa

SEQ ID NO: 168806 - DNA, 16 bp, H. sapiens
tttaagaacaaaaata

SEQ ID NO: 168807 - DNA, 16 bp, H. sapiens
tttaagaacataaaat

SEQ ID NO: 168808 - DNA, 16 bp, H. sapiens
tttaagaactaaaatg

SEQ ID NO: 168809 - DNA, 20 bp, H. sapiens
tttaagaactgtaacactca

SEQ ID NO: 168810 - DNA, 16 bp, H. sapiens
tttaagaactttccat

SEQ ID NO: 168811 - DNA, 16 bp, H. sapiens
tttaagaagaaaacaa

SEQ ID NO: 168812 - DNA, 16 bp, H. sapiens
tttaagaagaagaaga

SEQ ID NO: 168813 - DNA, 16 bp, H. sapiens
tttaagaagacagaaa

SEQ ID NO: 168814 - DNA, 16 bp, H. sapiens
tttaagaagagagaga

SEQ ID NO: 168815 - DNA, 16 bp, H. sapiens
tttaagaataaacttt

SEQ ID NO: 168816 - DNA, 16 bp, H. sapiens
tttaagaatgctgaat

SEQ ID NO: 168817 - DNA, 16 bp, H. sapiens
tttaagaatttgaaaa

SEQ ID NO: 168818 - DNA, 16 bp, H. sapiens
tttaagaatttttctt

SEQ ID NO: 168819 - DNA, 16 bp, H. sapiens
tttaagacaattataa

SEQ ID NO: 168820 - DNA, 16 bp, H. sapiens
tttaagacactaaatt

SEQ ID NO: 168821 - DNA, 16 bp, H. sapiens
tttaagacagagtcct

SEQ ID NO: 168822 - DNA, 16 bp, H. sapiens
tttaagactttaaaaa

SEQ ID NO: 168823 - DNA, 17 bp, H. sapiens
tttaagagactcctgta

SEQ ID NO: 168824 - DNA, 16 bp, H. sapiens
tttaagagatgagggt

SEQ ID NO: 168825 - DNA, 16 bp, H. sapiens
tttaagaggtggggtc

SEQ ID NO: 168826 - DNA, 16 bp, H. sapiens
tttaagagtttaaaat

SEQ ID NO: 168827 - DNA, 16 bp, H. sapiens
tttaagatcagcctga

SEQ ID NO: 168828 - DNA, 16 bp, H. sapiens
tttaagatggaagaaa

SEQ ID NO: 168829 - DNA, 16 bp, H. sapiens
tttaagatgttaataa

SEQ ID NO: 168830 - DNA, 16 bp, H. sapiens
tttaagatttattttc

SEQ ID NO: 168831 - DNA, 18 bp, H. sapiens
tttaagatttgactgcca

SEQ ID NO: 168832 - DNA, 16 bp, H. sapiens
tttaagcaaagaaatg

SEQ ID NO: 168833 - DNA, 16 bp, H. sapiens
tttaagcaaatgcatt

SEQ ID NO: 168834 - DNA, 16 bp, H. sapiens
tttaagcacttaaaaa

SEQ ID NO: 168835 - DNA, 16 bp, H. sapiens
tttaagcatttaaaaa

SEQ ID NO: 168836 - DNA, 16 bp, H. sapiens
tttaagcatttatttt

SEQ ID NO: 168837 - DNA, 16 bp, H. sapiens
tttaagcatttcttgt

SEQ ID NO: 168838 - DNA, 16 bp, H. sapiens
tttaagcctcagtttt

SEQ ID NO: 168839 - DNA, 16 bp, H. sapiens
tttaagcttttaaaaa

SEQ ID NO: 168840 - DNA, 16 bp, H. sapiens
tttaagctttttaaaa

SEQ ID NO: 168841 - DNA, 16 bp, H. sapiens
tttaaggaaacatttt

SEQ ID NO: 168842 - DNA, 16 bp, H. sapiens
tttaaggaaagaaaac

SEQ ID NO: 168843 - DNA, 16 bp, H. sapiens
tttaaggaaagaaaat

SEQ ID NO: 168844 - DNA, 16 bp, H. sapiens
tttaaggaaagaagcc

SEQ ID NO: 168845 - DNA, 16 bp, H. sapiens
tttaaggaagaaaaca

SEQ ID NO: 168846 - DNA, 17 bp, H. sapiens
tttaaggaatcaaactt

SEQ ID NO: 168847 - DNA, 16 bp, H. sapiens
tttaaggaatggaaag

SEQ ID NO: 168848 - DNA, 16 bp, H. sapiens
tttaaggaatttttaa

SEQ ID NO: 168849 - DNA, 16 bp, H. sapiens
tttaaggatgaagaaa

SEQ ID NO: 168850 - DNA, 16 bp, H. sapiens
tttaaggatttagggt

SEQ ID NO: 168851 - DNA, 16 bp, H. sapiens
tttaagggactcacag

SEQ ID NO: 168852 - DNA, 16 bp, H. sapiens
tttaaggggtacaagt

SEQ ID NO: 168853 - DNA, 16 bp, H. sapiens
tttaaggtaatggata

SEQ ID NO: 168854 - DNA, 16 bp, H. sapiens
tttaaggtcttctctg

SEQ ID NO: 168855 - DNA, 16 bp, H. sapiens
tttaaggtcttttcta

SEQ ID NO: 168856 - DNA, 16 bp, H. sapiens
tttaaggtgatagata

SEQ ID NO: 168857 - DNA, 18 bp, H. sapiens
tttaaggttatctctctt

SEQ ID NO: 168858 - DNA, 16 bp, H. sapiens
tttaaggttttgttga

SEQ ID NO: 168859 - DNA, 16 bp, H. sapiens
tttaagtaaaatgttt

SEQ ID NO: 168860 - DNA, 16 bp, H. sapiens
tttaagtaatttcttt

SEQ ID NO: 168861 - DNA, 16 bp, H. sapiens
tttaagtagagacaag

SEQ ID NO: 168862 - DNA, 16 bp, H. sapiens
tttaagtagagatgag

SEQ ID NO: 168863 - DNA, 16 bp, H. sapiens
tttaagtattgttaac

SEQ ID NO: 168864 - DNA, 16 bp, H. sapiens
tttaagtatttaagta

SEQ ID NO: 168865 - DNA, 16 bp, H. sapiens
tttaagtcagaaactg

SEQ ID NO: 168866 - DNA, 16 bp, H. sapiens
tttaagtcattaaaaa

SEQ ID NO: 168867 - DNA, 16 bp, H. sapiens
tttaagtcattcattt

SEQ ID NO: 168868 - DNA, 16 bp, H. sapiens
tttaagtcattttaaa

SEQ ID NO: 168869 - DNA, 16 bp, H. sapiens
tttaagtcatttttta

SEQ ID NO: 168870 - DNA, 16 bp, H. sapiens
tttaagtccaggagtt

SEQ ID NO: 168871 - DNA, 16 bp, H. sapiens
tttaagtctattgttt

SEQ ID NO: 168872 - DNA, 16 bp, H. sapiens
tttaagtctgatgttt

SEQ ID NO: 168873 - DNA, 16 bp, H. sapiens
tttaagtctgcagatg

SEQ ID NO: 168874 - DNA, 18 bp, H. sapiens
tttaagtctgctgaagct

SEQ ID NO: 168875 - DNA, 16 bp, H. sapiens
tttaagtgaaaaatta

SEQ ID NO: 168876 - DNA, 16 bp, H. sapiens
tttaagtgaacattta

SEQ ID NO: 168877 - DNA, 16 bp, H. sapiens
tttaagtgctttaaaa

SEQ ID NO: 168878 - DNA, 16 bp, H. sapiens
tttaagtggaatattt

SEQ ID NO: 168879 - DNA, 16 bp, H. sapiens
tttaagtggagtgttt

SEQ ID NO: 168880 - DNA, 16 bp, H. sapiens
tttaagtgtacagtta

SEQ ID NO: 168881 - DNA, 18 bp, H. sapiens
tttaagttctgggataca

SEQ ID NO: 168882 - DNA, 19 bp, H. sapiens
tttaagttctggggtacat

SEQ ID NO: 168883 - DNA, 16 bp, H. sapiens
tttaagttctttgcag

SEQ ID NO: 168884 - DNA, 16 bp, H. sapiens
tttaagttgtttgtag

SEQ ID NO: 168885 - DNA, 16 bp, H. sapiens
tttaagtttacagttt

SEQ ID NO: 168886 - DNA, 16 bp, H. sapiens
tttaagtttctcttta

SEQ ID NO: 168887 - DNA, 16 bp, H. sapiens
tttaagttttaatcca

SEQ ID NO: 168888 - DNA, 16 bp, H. sapiens
tttaagttttcctggt

SEQ ID NO: 168889 - DNA, 16 bp, H. sapiens
tttaagtttttaaaag

SEQ ID NO: 168890 - DNA, 16 bp, H. sapiens
tttaagttttttcaaa

SEQ ID NO: 168891 - DNA, 16 bp, H. sapiens
tttaataaaaacagct

SEQ ID NO: 168892 - DNA, 16 bp, H. sapiens
tttaataaaactgaaa

SEQ ID NO: 168893 - DNA, 16 bp, H. sapiens
tttaataaaagctttt

SEQ ID NO: 168894 - DNA, 16 bp, H. sapiens
tttaataaaaggtgtt

SEQ ID NO: 168895 - DNA, 16 bp, H. sapiens
tttaataaaatcagaa

SEQ ID NO: 168896 - DNA, 16 bp, H. sapiens
tttaataaaatcttgt

SEQ ID NO: 168897 - DNA, 16 bp, H. sapiens
tttaataaagaaggaa

SEQ ID NO: 168898 - DNA, 16 bp, H. sapiens
tttaataaatagggaa

SEQ ID NO: 168899 - DNA, 27 bp, H. sapiens
tttaataaatggtgctgggaaaactgg

SEQ ID NO: 168900 - DNA, 16 bp, H. sapiens
tttaataaatgtcaaa

SEQ ID NO: 168901 - DNA, 16 bp, H. sapiens
tttaataaattttcac

SEQ ID NO: 168902 - DNA, 16 bp, H. sapiens
tttaataagaaacaaa

SEQ ID NO: 168903 - DNA, 16 bp, H. sapiens
tttaataagaatagca

SEQ ID NO: 168904 - DNA, 16 bp, H. sapiens
tttaataaggacacca

SEQ ID NO: 168905 - DNA, 16 bp, H. sapiens
tttaataatcagaaaa

SEQ ID NO: 168906 - DNA, 16 bp, H. sapiens
tttaataattgagtaa

SEQ ID NO: 168907 - DNA, 16 bp, H. sapiens
tttaatacagaaaaaa

SEQ ID NO: 168908 - DNA, 16 bp, H. sapiens
tttaatacagatgaaa

SEQ ID NO: 168909 - DNA, 16 bp, H. sapiens
tttaatactatagttt

SEQ ID NO: 168910 - DNA, 16 bp, H. sapiens
tttaatactatcacat

SEQ ID NO: 168911 - DNA, 16 bp, H. sapiens
tttaatagaaaaatgt

SEQ ID NO: 168912 - DNA, 16 bp, H. sapiens
tttaatagaagagaaa

SEQ ID NO: 168913 - DNA, 16 bp, H. sapiens
tttaatagacttacag

SEQ ID NO: 168914 - DNA, 16 bp, H. sapiens
tttaatagagagaggg

SEQ ID NO: 168915 - DNA, 16 bp, H. sapiens
tttaatagagatggga

SEQ ID NO: 168916 - DNA, 16 bp, H. sapiens
tttaatagttttcctt

SEQ ID NO: 168917 - DNA, 16 bp, H. sapiens
tttaatataaagacat

SEQ ID NO: 168918 - DNA, 16 bp, H. sapiens
tttaatatccattcat

SEQ ID NO: 168919 - DNA, 16 bp, H. sapiens
tttaatatgctaatgt

SEQ ID NO: 168920 - DNA, 16 bp, H. sapiens
tttaatatgcttttaa

SEQ ID NO: 168921 - DNA, 16 bp, H. sapiens
tttaatatgtaaatgt

SEQ ID NO: 168922 - DNA, 16 bp, H. sapiens
tttaatattcaaaaca

SEQ ID NO: 168923 - DNA, 16 bp, H. sapiens
tttaatattgatgaag

SEQ ID NO: 168924 - DNA, 16 bp, H. sapiens
tttaatatttgcattt

SEQ ID NO: 168925 - DNA, 16 bp, H. sapiens
tttaatcatgaagaaa

SEQ ID NO: 168926 - DNA, 16 bp, H. sapiens
tttaatcccagcagtt

SEQ ID NO: 168927 - DNA, 16 bp, H. sapiens
tttaatcccagctact

SEQ ID NO: 168928 - DNA, 16 bp, H. sapiens
tttaatcctcataaga

SEQ ID NO: 168929 - DNA, 16 bp, H. sapiens
tttaatccttcttgaa

SEQ ID NO: 168930 - DNA, 16 bp, H. sapiens
tttaatcctttaaaat

SEQ ID NO: 168931 - DNA, 16 bp, H. sapiens
tttaatctgaaaattt

SEQ ID NO: 168932 - DNA, 16 bp, H. sapiens
tttaatctgtatttct

SEQ ID NO: 168933 - DNA, 16 bp, H. sapiens
tttaatctgttttata

SEQ ID NO: 168934 - DNA, 16 bp, H. sapiens
tttaatcttcaaatat

SEQ ID NO: 168935 - DNA, 16 bp, H. sapiens
tttaatcttcacaata

SEQ ID NO: 168936 - DNA, 16 bp, H. sapiens
tttaatcttcccagca

SEQ ID NO: 168937 - DNA, 16 bp, H. sapiens
tttaatctttacagca

SEQ ID NO: 168938 - DNA, 16 bp, H. sapiens
tttaatcttttgagga

SEQ ID NO: 168939 - DNA, 16 bp, H. sapiens
tttaatctttttaaag

SEQ ID NO: 168940 - DNA, 16 bp, H. sapiens
tttaatgaaaactttt

SEQ ID NO: 168941 - DNA, 16 bp, H. sapiens
tttaatgaaaagcaac

SEQ ID NO: 168942 - DNA, 16 bp, H. sapiens
tttaatgaaaagcagc

SEQ ID NO: 168943 - DNA, 16 bp, H. sapiens
tttaatgaaaatgaat

SEQ ID NO: 168944 - DNA, 16 bp, H. sapiens
tttaatgaaatcaaat

SEQ ID NO: 168945 - DNA, 16 bp, H. sapiens
tttaatgaagagaaaa

SEQ ID NO: 168946 - DNA, 16 bp, H. sapiens
tttaatgacaaaataa

SEQ ID NO: 168947 - DNA, 16 bp, H. sapiens
tttaatgactgcccag

SEQ ID NO: 168948 - DNA, 16 bp, H. sapiens
tttaatgagataatgt

SEQ ID NO: 168949 - DNA, 16 bp, H. sapiens
tttaatgatgaagaaa

SEQ ID NO: 168950 - DNA, 16 bp, H. sapiens
tttaatgatgagaaaa

SEQ ID NO: 168951 - DNA, 16 bp, H. sapiens
tttaatgattgacatt

SEQ ID NO: 168952 - DNA, 16 bp, H. sapiens
tttaatgatttccatt

SEQ ID NO: 168953 - DNA, 16 bp, H. sapiens
tttaatgcaatgtttt

SEQ ID NO: 168954 - DNA, 16 bp, H. sapiens
tttaatgcattttaaa

SEQ ID NO: 168955 - DNA, 16 bp, H. sapiens
tttaatgcattttctt

SEQ ID NO: 168956 - DNA, 16 bp, H. sapiens
tttaatgcatttttaa

SEQ ID NO: 168957 - DNA, 16 bp, H. sapiens
tttaatgccttttatt

SEQ ID NO: 168958 - DNA, 16 bp, H. sapiens
tttaatgctataaaat

SEQ ID NO: 168959 - DNA, 16 bp, H. sapiens
tttaatgcttttaaaa

SEQ ID NO: 168960 - DNA, 16 bp, H. sapiens
tttaatggggttatct

SEQ ID NO: 168961 - DNA, 16 bp, H. sapiens
tttaatggggttattt

SEQ ID NO: 168962 - DNA, 16 bp, H. sapiens
tttaatgtacatattt

SEQ ID NO: 168963 - DNA, 16 bp, H. sapiens
tttaatgtctttgtct

SEQ ID NO: 168964 - DNA, 16 bp, H. sapiens
tttaatgtgaagtttt

SEQ ID NO: 168965 - DNA, 16 bp, H. sapiens
tttaatgtgtacaatt

SEQ ID NO: 168966 - DNA, 16 bp, H. sapiens
tttaatgtgttttgaa

SEQ ID NO: 168967 - DNA, 16 bp, H. sapiens
tttaatgtttcatatt

SEQ ID NO: 168968 - DNA, 16 bp, H. sapiens
tttaatgtttgaaaat

SEQ ID NO: 168969 - DNA, 16 bp, H. sapiens
tttaatgttttagaaa

SEQ ID NO: 168970 - DNA, 16 bp, H. sapiens
tttaattaaaatgttg

SEQ ID NO: 168971 - DNA, 16 bp, H. sapiens
tttaattaaagaaaca

SEQ ID NO: 168972 - DNA, 16 bp, H. sapiens
tttaattaaatcccac

SEQ ID NO: 168973 - DNA, 16 bp, H. sapiens
tttaattaaatggaaa

SEQ ID NO: 168974 - DNA, 16 bp, H. sapiens
tttaattaatgctttt

SEQ ID NO: 168975 - DNA, 16 bp, H. sapiens
tttaattacatgcaaa

SEQ ID NO: 168976 - DNA, 16 bp, H. sapiens
tttaattaggtcccat

SEQ ID NO: 168977 - DNA, 16 bp, H. sapiens
tttaattagtcaggca

SEQ ID NO: 168978 - DNA, 16 bp, H. sapiens
tttaattatttgcata

SEQ ID NO: 168979 - DNA, 16 bp, H. sapiens
tttaattcaactaaaa

SEQ ID NO: 168980 - DNA, 16 bp, H. sapiens
tttaattcatcttcag

SEQ ID NO: 168981 - DNA, 16 bp, H. sapiens
tttaattcatgtttct

SEQ ID NO: 168982 - DNA, 16 bp, H. sapiens
tttaattccagctact

SEQ ID NO: 168983 - DNA, 16 bp, H. sapiens
tttaattccattgtgg

SEQ ID NO: 168984 - DNA, 16 bp, H. sapiens
tttaattcctgacctc

SEQ ID NO: 168985 - DNA, 16 bp, H. sapiens
tttaattctcataaca

SEQ ID NO: 168986 - DNA, 16 bp, H. sapiens
tttaattctctcaaca

SEQ ID NO: 168987 - DNA, 16 bp, H. sapiens
tttaattctttgccaa

SEQ ID NO: 168988 - DNA, 16 bp, H. sapiens
tttaattgaagaaaat

SEQ ID NO: 168989 - DNA, 16 bp, H. sapiens
tttaattgacatttat

SEQ ID NO: 168990 - DNA, 16 bp, H. sapiens
tttaattggcaaataa

SEQ ID NO: 168991 - DNA, 16 bp, H. sapiens
tttaattgtgacatta

SEQ ID NO: 168992 - DNA, 16 bp, H. sapiens
tttaattgtggtaaaa

SEQ ID NO: 168993 - DNA, 16 bp, H. sapiens
tttaatttaagttcta

SEQ ID NO: 168994 - DNA, 16 bp, H. sapiens
tttaatttacagaaat

SEQ ID NO: 168995 - DNA, 16 bp, H. sapiens
tttaatttactcacag

SEQ ID NO: 168996 - DNA, 16 bp, H. sapiens
tttaatttatggaaaa

SEQ ID NO: 168997 - DNA, 16 bp, H. sapiens
tttaatttcaaaaact

SEQ ID NO: 168998 - DNA, 16 bp, H. sapiens
tttaatttcaaatgtt

SEQ ID NO: 168999 - DNA, 16 bp, H. sapiens
tttaatttcactgtgg

SEQ ID NO: 169000 - DNA, 16 bp, H. sapiens
tttaatttcagaaatg

SEQ ID NO: 169001 - DNA, 16 bp, H. sapiens
tttaatttcagagttt

SEQ ID NO: 169002 - DNA, 16 bp, H. sapiens
tttaatttcattgatt

SEQ ID NO: 169003 - DNA, 16 bp, H. sapiens
tttaatttcatttcca

SEQ ID NO: 169004 - DNA, 16 bp, H. sapiens
tttaatttccaagtat

SEQ ID NO: 169005 - DNA, 16 bp, H. sapiens
tttaatttccataaat

SEQ ID NO: 169006 - DNA, 16 bp, H. sapiens
tttaatttctctgagc

SEQ ID NO: 169007 - DNA, 16 bp, H. sapiens
tttaatttctgaaaag

SEQ ID NO: 169008 - DNA, 16 bp, H. sapiens
tttaatttctttcagc

SEQ ID NO: 169009 - DNA, 16 bp, H. sapiens
tttaatttgcccttct

SEQ ID NO: 169010 - DNA, 16 bp, H. sapiens
tttaatttggagaaaa

SEQ ID NO: 169011 - DNA, 16 bp, H. sapiens
tttaatttgttgtaga

SEQ ID NO: 169012 - DNA, 16 bp, H. sapiens
tttaattttacataag

SEQ ID NO: 169013 - DNA, 16 bp, H. sapiens
tttaattttagagaaa

SEQ ID NO: 169014 - DNA, 16 bp, H. sapiens
tttaattttagcaatt

SEQ ID NO: 169015 - DNA, 16 bp, H. sapiens
tttaattttagccatt

SEQ ID NO: 169016 - DNA, 16 bp, H. sapiens
tttaattttagccttt

SEQ ID NO: 169017 - DNA, 16 bp, H. sapiens
tttaattttattgaca

SEQ ID NO: 169018 - DNA, 16 bp, H. sapiens
tttaattttcacaaaa

SEQ ID NO: 169019 - DNA, 16 bp, H. sapiens
tttaattttcacaaga

SEQ ID NO: 169020 - DNA, 16 bp, H. sapiens
tttaattttcacagca

SEQ ID NO: 169021 - DNA, 16 bp, H. sapiens
tttaattttcagctcc

SEQ ID NO: 169022 - DNA, 16 bp, H. sapiens
tttaattttccatttg

SEQ ID NO: 169023 - DNA, 16 bp, H. sapiens
tttaattttctaaaga

SEQ ID NO: 169024 - DNA, 16 bp, H. sapiens
tttaattttctatgtg

SEQ ID NO: 169025 - DNA, 16 bp, H. sapiens
tttaattttctcagaa

SEQ ID NO: 169026 - DNA, 16 bp, H. sapiens
tttaattttctgtaaa

SEQ ID NO: 169027 - DNA, 16 bp, H. sapiens
tttaattttgaaaact

SEQ ID NO: 169028 - DNA, 16 bp, H. sapiens
tttaattttgagatgg

SEQ ID NO: 169029 - DNA, 16 bp, H. sapiens
tttaattttgatgaaa

SEQ ID NO: 169030 - DNA, 16 bp, H. sapiens
tttaattttggaaatg

SEQ ID NO: 169031 - DNA, 16 bp, H. sapiens
tttaattttggagaaa

SEQ ID NO: 169032 - DNA, 16 bp, H. sapiens
tttaattttgtttgca

SEQ ID NO: 169033 - DNA, 16 bp, H. sapiens
tttaatttttaaaacc

SEQ ID NO: 169034 - DNA, 16 bp, H. sapiens
tttaatttttcagtca

SEQ ID NO: 169035 - DNA, 16 bp, H. sapiens
tttaatttttctaaag

SEQ ID NO: 169036 - DNA, 16 bp, H. sapiens
tttaatttttctaatg

SEQ ID NO: 169037 - DNA, 16 bp, H. sapiens
tttaatttttgaagaa

SEQ ID NO: 169038 - DNA, 16 bp, H. sapiens
tttaatttttgccaat

SEQ ID NO: 169039 - DNA, 16 bp, H. sapiens
tttaatttttgccatt

SEQ ID NO: 169040 - DNA, 16 bp, H. sapiens
tttaattttttctgga

SEQ ID NO: 169041 - DNA, 16 bp, H. sapiens
tttacaaaaaatgcaa

SEQ ID NO: 169042 - DNA, 16 bp, H. sapiens
tttacaaaaatgttta

SEQ ID NO: 169043 - DNA, 16 bp, H. sapiens
tttacaaaacactttt

SEQ ID NO: 169044 - DNA, 16 bp, H. sapiens
tttacaaaacagaaaa

SEQ ID NO: 169045 - DNA, 16 bp, H. sapiens
tttacaaaagaaggag

SEQ ID NO: 169046 - DNA, 16 bp, H. sapiens
tttacaaaaggagaaa

SEQ ID NO: 169047 - DNA, 16 bp, H. sapiens
tttacaaaataaagaa

SEQ ID NO: 169048 - DNA, 16 bp, H. sapiens
tttacaaaataagtaa

SEQ ID NO: 169049 - DNA, 16 bp, H. sapiens
tttacaaaatggaaaa

SEQ ID NO: 169050 - DNA, 16 bp, H. sapiens
tttacaaaatgtaaaa

SEQ ID NO: 169051 - DNA, 20 bp, H. sapiens
tttacaaaccttgagctaga

SEQ ID NO: 169052 - DNA, 16 bp, H. sapiens
tttacaaactgctgaa

SEQ ID NO: 169053 - DNA, 16 bp, H. sapiens
tttacaaagaaagaaa

SEQ ID NO: 169054 - DNA, 16 bp, H. sapiens
tttacaaagaaagaga

SEQ ID NO: 169055 - DNA, 16 bp, H. sapiens
tttacaaagaaggaaa

SEQ ID NO: 169056 - DNA, 16 bp, H. sapiens
tttacaaagatttttt

SEQ ID NO: 169057 - DNA, 16 bp, H. sapiens
tttacaaagcactttc

SEQ ID NO: 169058 - DNA, 16 bp, H. sapiens
tttacaaagcatattt

SEQ ID NO: 169059 - DNA, 16 bp, H. sapiens
tttacaaagccctttc

SEQ ID NO: 169060 - DNA, 16 bp, H. sapiens
tttacaaaggaggaaa

SEQ ID NO: 169061 - DNA, 16 bp, H. sapiens
tttacaaagtgaacac

SEQ ID NO: 169062 - DNA, 16 bp, H. sapiens
tttacaaagtgctttc

SEQ ID NO: 169063 - DNA, 16 bp, H. sapiens
tttacaaataaagaaa

SEQ ID NO: 169064 - DNA, 16 bp, H. sapiens
tttacaaataagaaaa

SEQ ID NO: 169065 - DNA, 16 bp, H. sapiens
tttacaaataaggaaa

SEQ ID NO: 169066 - DNA, 16 bp, H. sapiens
tttacaaatacatata

SEQ ID NO: 169067 - DNA, 16 bp, H. sapiens
tttacaaatattcatt

SEQ ID NO: 169068 - DNA, 16 bp, H. sapiens
tttacaaatcagaaaa

SEQ ID NO: 169069 - DNA, 16 bp, H. sapiens
tttacaaatgaaaatt

SEQ ID NO: 169070 - DNA, 16 bp, H. sapiens
tttacaaatgaagaga

SEQ ID NO: 169071 - DNA, 16 bp, H. sapiens
tttacaaatgagaaaa

SEQ ID NO: 169072 - DNA, 16 bp, H. sapiens
tttacaaatgagagaa

SEQ ID NO: 169073 - DNA, 16 bp, H. sapiens
tttacaaatgaggaaa

SEQ ID NO: 169074 - DNA, 16 bp, H. sapiens
tttacaaatggagaaa

SEQ ID NO: 169075 - DNA, 16 bp, H. sapiens
tttacaaatgtggaaa

SEQ ID NO: 169076 - DNA, 16 bp, H. sapiens
tttacaaattatccag

SEQ ID NO: 169077 - DNA, 16 bp, H. sapiens
tttacaaattgttttt

SEQ ID NO: 169078 - DNA, 16 bp, H. sapiens
tttacaacaaatattt

SEQ ID NO: 169079 - DNA, 16 bp, H. sapiens
tttacaacctgctctc

SEQ ID NO: 169080 - DNA, 16 bp, H. sapiens
tttacaactgaagaaa

SEQ ID NO: 169081 - DNA, 16 bp, H. sapiens
tttacaacttttaaaa

SEQ ID NO: 169082 - DNA, 16 bp, H. sapiens
tttacaagaaaaaaca

SEQ ID NO: 169083 - DNA, 16 bp, H. sapiens
tttacaagaaaaagac

SEQ ID NO: 169084 - DNA, 16 bp, H. sapiens
tttacaagaaaatgaa

SEQ ID NO: 169085 - DNA, 16 bp, H. sapiens
tttacaagaaactttt

SEQ ID NO: 169086 - DNA, 16 bp, H. sapiens
tttacaagagctcctg

SEQ ID NO: 169087 - DNA, 16 bp, H. sapiens
tttacaagctctttgt

SEQ ID NO: 169088 - DNA, 16 bp, H. sapiens
tttacaaggaaaaaag

SEQ ID NO: 169089 - DNA, 16 bp, H. sapiens
tttacaaggaactcaa

SEQ ID NO: 169090 - DNA, 16 bp, H. sapiens
tttacaagggaggaaa

SEQ ID NO: 169091 - DNA, 30 bp, H. sapiens
tttacaagggttaggacaatcctttgatct

SEQ ID NO: 169092 - DNA, 16 bp, H. sapiens
tttacaagtgaggaaa

SEQ ID NO: 169093 - DNA, 16 bp, H. sapiens
tttacaataatttgta

SEQ ID NO: 169094 - DNA, 20 bp, H. sapiens
tttacaatccctgagctaga

SEQ ID NO: 169095 - DNA, 16 bp, H. sapiens
tttacaatgaagaaat

SEQ ID NO: 169096 - DNA, 16 bp, H. sapiens
tttacaatgagaaaat

SEQ ID NO: 169097 - DNA, 16 bp, H. sapiens
tttacaattaaaatgt

SEQ ID NO: 169098 - DNA, 16 bp, H. sapiens
tttacaattaagaaaa

SEQ ID NO: 169099 - DNA, 16 bp, H. sapiens
tttacaattaaggaaa

SEQ ID NO: 169100 - DNA, 16 bp, H. sapiens
tttacaatttacaaag

SEQ ID NO: 169101 - DNA, 16 bp, H. sapiens
tttacaatttttaatg

SEQ ID NO: 169102 - DNA, 16 bp, H. sapiens
tttacacaaaaagaaa

SEQ ID NO: 169103 - DNA, 16 bp, H. sapiens
tttacacaaatattta

SEQ ID NO: 169104 - DNA, 16 bp, H. sapiens
tttacacaagaagaaa

SEQ ID NO: 169105 - DNA, 16 bp, H. sapiens
tttacacacaaggaaa

SEQ ID NO: 169106 - DNA, 16 bp, H. sapiens
tttacacagaaaaaga

SEQ ID NO: 169107 - DNA, 16 bp, H. sapiens
tttacacatattaact

SEQ ID NO: 169108 - DNA, 16 bp, H. sapiens
tttacacatatttttg

SEQ ID NO: 169109 - DNA, 16 bp, H. sapiens
tttacacatgaggaaa

SEQ ID NO: 169110 - DNA, 16 bp, H. sapiens
tttacaccaaaataaa

SEQ ID NO: 169111 - DNA, 16 bp, H. sapiens
tttacaccatggaaat

SEQ ID NO: 169112 - DNA, 16 bp, H. sapiens
tttacacctatgtttt

SEQ ID NO: 169113 - DNA, 16 bp, H. sapiens
tttacactgccagttt

SEQ ID NO: 169114 - DNA, 16 bp, H. sapiens
tttacactgttgggag

SEQ ID NO: 169115 - DNA, 16 bp, H. sapiens
tttacacttaaaaatt

SEQ ID NO: 169116 - DNA, 16 bp, H. sapiens
tttacactttaaaaaa

SEQ ID NO: 169117 - DNA, 16 bp, H. sapiens
tttacagaaaaagttt

SEQ ID NO: 169118 - DNA, 16 bp, H. sapiens
tttacagaaaacattt

SEQ ID NO: 169119 - DNA, 16 bp, H. sapiens
tttacagaaaaggaaa

SEQ ID NO: 169120 - DNA, 16 bp, H. sapiens
tttacagaaaatgttt

SEQ ID NO: 169121 - DNA, 16 bp, H. sapiens
tttacagaaacatttt

SEQ ID NO: 169122 - DNA, 16 bp, H. sapiens
tttacagaaataaaag

SEQ ID NO: 169123 - DNA, 16 bp, H. sapiens
tttacagaagaaaaag

SEQ ID NO: 169124 - DNA, 16 bp, H. sapiens
tttacagaagaggaaa

SEQ ID NO: 169125 - DNA, 16 bp, H. sapiens
tttacagaatattcca

SEQ ID NO: 169126 - DNA, 16 bp, H. sapiens
tttacagacaaggaaa

SEQ ID NO: 169127 - DNA, 16 bp, H. sapiens
tttacagacagagaaa

SEQ ID NO: 169128 - DNA, 16 bp, H. sapiens
tttacagaggagagaa

SEQ ID NO: 169129 - DNA, 16 bp, H. sapiens
tttacagataaagaaa

SEQ ID NO: 169130 - DNA, 16 bp, H. sapiens
tttacagatcaagaaa

SEQ ID NO: 169131 - DNA, 16 bp, H. sapiens
tttacagatgaaaata

SEQ ID NO: 169132 - DNA, 16 bp, H. sapiens
tttacagatgaagaaa

SEQ ID NO: 169133 - DNA, 16 bp, H. sapiens
tttacagatgaagaac

SEQ ID NO: 169134 - DNA, 16 bp, H. sapiens
tttacagatgacataa

SEQ ID NO: 169135 - DNA, 16 bp, H. sapiens
tttacagatgagaaaa

SEQ ID NO: 169136 - DNA, 16 bp, H. sapiens
tttacagatgagaaca

SEQ ID NO: 169137 - DNA, 16 bp, H. sapiens
tttacagatgaggaaa

SEQ ID NO: 169138 - DNA, 16 bp, H. sapiens
tttacagatgaggaag

SEQ ID NO: 169139 - DNA, 16 bp, H. sapiens
tttacagatgagggaa

SEQ ID NO: 169140 - DNA, 16 bp, H. sapiens
tttacagatgaggtct

SEQ ID NO: 169141 - DNA, 16 bp, H. sapiens
tttacagatgcggaaa

SEQ ID NO: 169142 - DNA, 16 bp, H. sapiens
tttacagatggacaaa

SEQ ID NO: 169143 - DNA, 16 bp, H. sapiens
tttacagatgggcaaa

SEQ ID NO: 169144 - DNA, 16 bp, H. sapiens
tttacagatggggaaa

SEQ ID NO: 169145 - DNA, 16 bp, H. sapiens
tttacagatgttaaaa

SEQ ID NO: 169146 - DNA, 16 bp, H. sapiens
tttacagattcattgc

SEQ ID NO: 169147 - DNA, 16 bp, H. sapiens
tttacagattgagaaa

SEQ ID NO: 169148 - DNA, 16 bp, H. sapiens
tttacagatttgtgtt

SEQ ID NO: 169149 - DNA, 16 bp, H. sapiens
tttacagcaaaattaa

SEQ ID NO: 169150 - DNA, 16 bp, H. sapiens
tttacagctaagaaaa

SEQ ID NO: 169151 - DNA, 16 bp, H. sapiens
tttacagctgaagaaa

SEQ ID NO: 169152 - DNA, 16 bp, H. sapiens
tttacaggaaaaaaaa

SEQ ID NO: 169153 - DNA, 16 bp, H. sapiens
tttacaggagaggaaa

SEQ ID NO: 169154 - DNA, 16 bp, H. sapiens
tttacaggcaaggaaa

SEQ ID NO: 169155 - DNA, 16 bp, H. sapiens
tttacaggggagaaaa

SEQ ID NO: 169156 - DNA, 16 bp, H. sapiens
tttacaggtgaaaaaa

SEQ ID NO: 169157 - DNA, 16 bp, H. sapiens
tttacaggtgagaaaa

SEQ ID NO: 169158 - DNA, 16 bp, H. sapiens
tttacaggtgagatga

SEQ ID NO: 169159 - DNA, 16 bp, H. sapiens
tttacaggtgagcaaa

SEQ ID NO: 169160 - DNA, 16 bp, H. sapiens
tttacaggtgagggaa

SEQ ID NO: 169161 - DNA, 16 bp, H. sapiens
tttacagtaaatattt

SEQ ID NO: 169162 - DNA, 16 bp, H. sapiens
tttacagtgagtttta

SEQ ID NO: 169163 - DNA, 16 bp, H. sapiens
tttacagttaaaaaaa

SEQ ID NO: 169164 - DNA, 16 bp, H. sapiens
tttacagttaagaaaa

SEQ ID NO: 169165 - DNA, 16 bp, H. sapiens
tttacagttaaggaaa

SEQ ID NO: 169166 - DNA, 16 bp, H. sapiens
tttacagttacctttt

SEQ ID NO: 169167 - DNA, 16 bp, H. sapiens
tttacagttctggagg

SEQ ID NO: 169168 - DNA, 16 bp, H. sapiens
tttacagttgaagaaa

SEQ ID NO: 169169 - DNA, 16 bp, H. sapiens
tttacagttgagaaaa

SEQ ID NO: 169170 - DNA, 16 bp, H. sapiens
tttacagtttagaaaa

SEQ ID NO: 169171 - DNA, 16 bp, H. sapiens
tttacagtttccaaat

SEQ ID NO: 169172 - DNA, 16 bp, H. sapiens
tttacagttttcaaaa

SEQ ID NO: 169173 - DNA, 16 bp, H. sapiens
tttacagttttgcatt

SEQ ID NO: 169174 - DNA, 16 bp, H. sapiens
tttacataacagaaaa

SEQ ID NO: 169175 - DNA, 16 bp, H. sapiens
tttacataagaagaaa

SEQ ID NO: 169176 - DNA, 16 bp, H. sapiens
tttacatacacaaata

SEQ ID NO: 169177 - DNA, 16 bp, H. sapiens
tttacatacagtgaaa

SEQ ID NO: 169178 - DNA, 16 bp, H. sapiens
tttacatataaaatgt

SEQ ID NO: 169179 - DNA, 16 bp, H. sapiens
tttacatataaacata

SEQ ID NO: 169180 - DNA, 16 bp, H. sapiens
tttacatataaagaaa

SEQ ID NO: 169181 - DNA, 16 bp, H. sapiens
tttacatatatttgta

SEQ ID NO: 169182 - DNA, 16 bp, H. sapiens
tttacatcagggttca

SEQ ID NO: 169183 - DNA, 16 bp, H. sapiens
tttacatccccaccag

SEQ ID NO: 169184 - DNA, 16 bp, H. sapiens
tttacatcttacattt

SEQ ID NO: 169185 - DNA, 16 bp, H. sapiens
tttacatcttggacat

SEQ ID NO: 169186 - DNA, 16 bp, H. sapiens
tttacatcttttaaaa

SEQ ID NO: 169187 - DNA, 16 bp, H. sapiens
tttacatgaaatttta

SEQ ID NO: 169188 - DNA, 16 bp, H. sapiens
tttacatgcattatct

SEQ ID NO: 169189 - DNA, 16 bp, H. sapiens
tttacatgcattttta

SEQ ID NO: 169190 - DNA, 16 bp, H. sapiens
tttacatggttttgaa

SEQ ID NO: 169191 - DNA, 16 bp, H. sapiens
tttacatgtacatttt

SEQ ID NO: 169192 - DNA, 16 bp, H. sapiens
tttacatgtatatatt

SEQ ID NO: 169193 - DNA, 16 bp, H. sapiens
tttacatgtattatct

SEQ ID NO: 169194 - DNA, 16 bp, H. sapiens
tttacatgtattattt

SEQ ID NO: 169195 - DNA, 16 bp, H. sapiens
tttacatgttgtctat

SEQ ID NO: 169196 - DNA, 16 bp, H. sapiens
tttacatgtttaaatt

SEQ ID NO: 169197 - DNA, 16 bp, H. sapiens
tttacatgttttctgt

SEQ ID NO: 169198 - DNA, 16 bp, H. sapiens
tttacattaaaagata

SEQ ID NO: 169199 - DNA, 16 bp, H. sapiens
tttacattaattgatt

SEQ ID NO: 169200 - DNA, 16 bp, H. sapiens
tttacattcaagttta

SEQ ID NO: 169201 - DNA, 16 bp, H. sapiens
tttacattcccaccag

SEQ ID NO: 169202 - DNA, 16 bp, H. sapiens
tttacattgatgttca

SEQ ID NO: 169203 - DNA, 16 bp, H. sapiens
tttacattgtattaga

SEQ ID NO: 169204 - DNA, 16 bp, H. sapiens
tttacatttaagaaaa

SEQ ID NO: 169205 - DNA, 16 bp, H. sapiens
tttacatttaagtttt

SEQ ID NO: 169206 - DNA, 16 bp, H. sapiens
tttacatttaatatga

SEQ ID NO: 169207 - DNA, 16 bp, H. sapiens
tttacatttaatgtaa

SEQ ID NO: 169208 - DNA, 16 bp, H. sapiens
tttacatttatttaga

SEQ ID NO: 169209 - DNA, 16 bp, H. sapiens
tttacatttcaatttc

SEQ ID NO: 169210 - DNA, 16 bp, H. sapiens
tttacatttccaacaa

SEQ ID NO: 169211 - DNA, 16 bp, H. sapiens
tttacatttccctaat

SEQ ID NO: 169212 - DNA, 16 bp, H. sapiens
tttacatttgaaatgt

SEQ ID NO: 169213 - DNA, 16 bp, H. sapiens
tttacatttgaattaa

SEQ ID NO: 169214 - DNA, 16 bp, H. sapiens
tttacatttgtaattt

SEQ ID NO: 169215 - DNA, 16 bp, H. sapiens
tttacatttgttttaa

SEQ ID NO: 169216 - DNA, 16 bp, H. sapiens
tttacattttaacatc

SEQ ID NO: 169217 - DNA, 16 bp, H. sapiens
tttacattttatcaag

SEQ ID NO: 169218 - DNA, 16 bp, H. sapiens
tttacattttcaaata

SEQ ID NO: 169219 - DNA, 16 bp, H. sapiens
tttacattttcataaa

SEQ ID NO: 169220 - DNA, 16 bp, H. sapiens
tttacattttcttcca

SEQ ID NO: 169221 - DNA, 16 bp, H. sapiens
tttacattttgaaaaa

SEQ ID NO: 169222 - DNA, 16 bp, H. sapiens
tttacattttgaaata

SEQ ID NO: 169223 - DNA, 16 bp, H. sapiens
tttacattttgaagac

SEQ ID NO: 169224 - DNA, 16 bp, H. sapiens
tttacattttgataaa

SEQ ID NO: 169225 - DNA, 16 bp, H. sapiens
tttacattttgatgat

SEQ ID NO: 169226 - DNA, 16 bp, H. sapiens
tttacattttggaaat

SEQ ID NO: 169227 - DNA, 16 bp, H. sapiens
tttacattttggcatg

SEQ ID NO: 169228 - DNA, 16 bp, H. sapiens
tttacatttttaaaca

SEQ ID NO: 169229 - DNA, 16 bp, H. sapiens
tttacatttttaaagg

SEQ ID NO: 169230 - DNA, 16 bp, H. sapiens
tttacatttttaaagt

SEQ ID NO: 169231 - DNA, 16 bp, H. sapiens
tttacatttttaaatg

SEQ ID NO: 169232 - DNA, 16 bp, H. sapiens
tttacatttttctgat

SEQ ID NO: 169233 - DNA, 16 bp, H. sapiens
tttacattttttgtag

SEQ ID NO: 169234 - DNA, 16 bp, H. sapiens
tttaccaaagaagata

SEQ ID NO: 169235 - DNA, 16 bp, H. sapiens
tttaccaaagagaaat

SEQ ID NO: 169236 - DNA, 16 bp, H. sapiens
tttaccaaatgcctgt

SEQ ID NO: 169237 - DNA, 16 bp, H. sapiens
tttaccaagaaaatgg

SEQ ID NO: 169238 - DNA, 16 bp, H. sapiens
tttaccaagcaaacgg

SEQ ID NO: 169239 - DNA, 16 bp, H. sapiens
tttaccaaggaggaaa

SEQ ID NO: 169240 - DNA, 16 bp, H. sapiens
tttaccaaggttttga

SEQ ID NO: 169241 - DNA, 16 bp, H. sapiens
tttaccagtgaggaaa

SEQ ID NO: 169242 - DNA, 16 bp, H. sapiens
tttaccagtgagtttt

SEQ ID NO: 169243 - DNA, 17 bp, H. sapiens
tttaccatgttggctag

SEQ ID NO: 169244 - DNA, 16 bp, H. sapiens
tttaccattatataat

SEQ ID NO: 169245 - DNA, 16 bp, H. sapiens
tttaccattttaaata

SEQ ID NO: 169246 - DNA, 16 bp, H. sapiens
tttacccaaaagaaaa

SEQ ID NO: 169247 - DNA, 16 bp, H. sapiens
tttacccaaagaagtt

SEQ ID NO: 169248 - DNA, 16 bp, H. sapiens
tttacccacgtattta

SEQ ID NO: 169249 - DNA, 16 bp, H. sapiens
tttacccagtattcat

SEQ ID NO: 169250 - DNA, 16 bp, H. sapiens
tttacccatttattca

SEQ ID NO: 169251 - DNA, 16 bp, H. sapiens
tttaccctatgttttc

SEQ ID NO: 169252 - DNA, 16 bp, H. sapiens
tttacctaatgtcttt

SEQ ID NO: 169253 - DNA, 18 bp, H. sapiens
tttacctatagcctggaa

SEQ ID NO: 169254 - DNA, 16 bp, H. sapiens
tttacctcctcttctg

SEQ ID NO: 169255 - DNA, 16 bp, H. sapiens
tttacctctgtgaaat

SEQ ID NO: 169256 - DNA, 16 bp, H. sapiens
tttacctgcctcagcc

SEQ ID NO: 169257 - DNA, 16 bp, H. sapiens
tttacctgttttttaa

SEQ ID NO: 169258 - DNA, 16 bp, H. sapiens
tttaccttcaaaatat

SEQ ID NO: 169259 - DNA, 16 bp, H. sapiens
tttacctttctgtgcc

SEQ ID NO: 169260 - DNA, 16 bp, H. sapiens
tttacggtgagtttta

SEQ ID NO: 169261 - DNA, 16 bp, H. sapiens
tttactaaaaatcatt

SEQ ID NO: 169262 - DNA, 16 bp, H. sapiens
tttactaaaattgttt

SEQ ID NO: 169263 - DNA, 16 bp, H. sapiens
tttactaaagaaattt

SEQ ID NO: 169264 - DNA, 16 bp, H. sapiens
tttactaaatatacaa

SEQ ID NO: 169265 - DNA, 16 bp, H. sapiens
tttactaatgaagaaa

SEQ ID NO: 169266 - DNA, 16 bp, H. sapiens
tttactacaaagctat

SEQ ID NO: 169267 - DNA, 16 bp, H. sapiens
tttactatgtatttat

SEQ ID NO: 169268 - DNA, 16 bp, H. sapiens
tttactattatgtaat

SEQ ID NO: 169269 - DNA, 16 bp, H. sapiens
tttactatttcaaaaa

SEQ ID NO: 169270 - DNA, 16 bp, H. sapiens
tttactatttggccct

SEQ ID NO: 169271 - DNA, 16 bp, H. sapiens
tttactatttggcctt

SEQ ID NO: 169272 - DNA, 16 bp, H. sapiens
tttactcagcctgcca

SEQ ID NO: 169273 - DNA, 16 bp, H. sapiens
tttactcatggcagaa

SEQ ID NO: 169274 - DNA, 16 bp, H. sapiens
tttactcattcagtat

SEQ ID NO: 169275 - DNA, 16 bp, H. sapiens
tttactcattcattca

SEQ ID NO: 169276 - DNA, 16 bp, H. sapiens
tttactcatttactca

SEQ ID NO: 169277 - DNA, 16 bp, H. sapiens
tttactccacatcctt

SEQ ID NO: 169278 - DNA, 16 bp, H. sapiens
tttactccatttacat

SEQ ID NO: 169279 - DNA, 16 bp, H. sapiens
tttactctatggactt

SEQ ID NO: 169280 - DNA, 16 bp, H. sapiens
tttactctgttgatag

SEQ ID NO: 169281 - DNA, 16 bp, H. sapiens
tttactcttttctgta

SEQ ID NO: 169282 - DNA, 16 bp, H. sapiens
tttactgaaaaagaaa

SEQ ID NO: 169283 - DNA, 16 bp, H. sapiens
tttactgaaacatttt

SEQ ID NO: 169284 - DNA, 16 bp, H. sapiens
tttactgaaatatttt

SEQ ID NO: 169285 - DNA, 16 bp, H. sapiens
tttactgaaattttat

SEQ ID NO: 169286 - DNA, 16 bp, H. sapiens
tttactgaacatttta

SEQ ID NO: 169287 - DNA, 16 bp, H. sapiens
tttactgaagttattt

SEQ ID NO: 169288 - DNA, 16 bp, H. sapiens
tttactgaatatattt

SEQ ID NO: 169289 - DNA, 16 bp, H. sapiens
tttactgaatatttga

SEQ ID NO: 169290 - DNA, 16 bp, H. sapiens
tttactgaattaaaaa

SEQ ID NO: 169291 - DNA, 16 bp, H. sapiens
tttactgaatttcttt

SEQ ID NO: 169292 - DNA, 16 bp, H. sapiens
tttactgaatttttat

SEQ ID NO: 169293 - DNA, 16 bp, H. sapiens
tttactgacaatgatg

SEQ ID NO: 169294 - DNA, 16 bp, H. sapiens
tttactgagaggggcc

SEQ ID NO: 169295 - DNA, 16 bp, H. sapiens
tttactgagatgagga

SEQ ID NO: 169296 - DNA, 16 bp, H. sapiens
tttactgaggatgatg

SEQ ID NO: 169297 - DNA, 16 bp, H. sapiens
tttactgaggtacaat

SEQ ID NO: 169298 - DNA, 16 bp, H. sapiens
tttactgaggtatgat

SEQ ID NO: 169299 - DNA, 16 bp, H. sapiens
tttactgataagaaaa

SEQ ID NO: 169300 - DNA, 16 bp, H. sapiens
tttactgatgaggaaa

SEQ ID NO: 169301 - DNA, 28 bp, H. sapiens
tttactgatggttccagcaatggaaaag

SEQ ID NO: 169302 - DNA, 16 bp, H. sapiens
tttactgatttaaaaa

SEQ ID NO: 169303 - DNA, 16 bp, H. sapiens
tttactgattttcaaa

SEQ ID NO: 169304 - DNA, 16 bp, H. sapiens
tttactgctgaattct

SEQ ID NO: 169305 - DNA, 16 bp, H. sapiens
tttactgcttagaaat

SEQ ID NO: 169306 - DNA, 16 bp, H. sapiens
tttactgtaacttttc

SEQ ID NO: 169307 - DNA, 16 bp, H. sapiens
tttactgtatttttaa

SEQ ID NO: 169308 - DNA, 17 bp, H. sapiens
tttactgtcctacctca

SEQ ID NO: 169309 - DNA, 16 bp, H. sapiens
tttactgttgttttaa

SEQ ID NO: 169310 - DNA, 16 bp, H. sapiens
tttactgtttaaaatg

SEQ ID NO: 169311 - DNA, 16 bp, H. sapiens
tttacttaaaaatatg

SEQ ID NO: 169312 - DNA, 16 bp, H. sapiens
tttacttaaaattttg

SEQ ID NO: 169313 - DNA, 16 bp, H. sapiens
tttacttaaagtctat

SEQ ID NO: 169314 - DNA, 16 bp, H. sapiens
tttacttacagatcct

SEQ ID NO: 169315 - DNA, 16 bp, H. sapiens
tttacttcaaaaaata

SEQ ID NO: 169316 - DNA, 16 bp, H. sapiens
tttacttcaaaatatt

SEQ ID NO: 169317 - DNA, 16 bp, H. sapiens
tttacttcatcctctc

SEQ ID NO: 169318 - DNA, 16 bp, H. sapiens
tttacttcttaataaa

SEQ ID NO: 169319 - DNA, 16 bp, H. sapiens
tttacttgaaaaactc

SEQ ID NO: 169320 - DNA, 16 bp, H. sapiens
tttacttgaatcttct

SEQ ID NO: 169321 - DNA, 16 bp, H. sapiens
tttacttgcattgatt

SEQ ID NO: 169322 - DNA, 16 bp, H. sapiens
tttactttatccagtc

SEQ ID NO: 169323 - DNA, 16 bp, H. sapiens
tttactttatgaactt

SEQ ID NO: 169324 - DNA, 16 bp, H. sapiens
tttactttcaaaaata

SEQ ID NO: 169325 - DNA, 16 bp, H. sapiens
tttactttctgtgtct

SEQ ID NO: 169326 - DNA, 16 bp, H. sapiens
tttactttcttagcaa

SEQ ID NO: 169327 - DNA, 16 bp, H. sapiens
tttactttgcccatat

SEQ ID NO: 169328 - DNA, 16 bp, H. sapiens
tttactttggatatat

SEQ ID NO: 169329 - DNA, 16 bp, H. sapiens
tttactttgttaataa

SEQ ID NO: 169330 - DNA, 16 bp, H. sapiens
tttactttgttgatag

SEQ ID NO: 169331 - DNA, 16 bp, H. sapiens
tttactttgtttaaaa

SEQ ID NO: 169332 - DNA, 16 bp, H. sapiens
tttactttgttttaaa

SEQ ID NO: 169333 - DNA, 16 bp, H. sapiens
tttacttttaacctat

SEQ ID NO: 169334 - DNA, 16 bp, H. sapiens
tttacttttaagaaat

SEQ ID NO: 169335 - DNA, 16 bp, H. sapiens
tttacttttcaaaata

SEQ ID NO: 169336 - DNA, 16 bp, H. sapiens
tttactttttaaagca

SEQ ID NO: 169337 - DNA, 16 bp, H. sapiens
tttactttttaaagta

SEQ ID NO: 169338 - DNA, 16 bp, H. sapiens
tttactttttcaaaga

SEQ ID NO: 169339 - DNA, 16 bp, H. sapiens
tttactttttccaaaa

SEQ ID NO: 169340 - DNA, 16 bp, H. sapiens
tttactttttgtaaaa

SEQ ID NO: 169341 - DNA, 16 bp, H. sapiens
tttagaaaaaaattgt

SEQ ID NO: 169342 - DNA, 16 bp, H. sapiens
tttagaaaaaacattt

SEQ ID NO: 169343 - DNA, 16 bp, H. sapiens
tttagaaaaattaact

SEQ ID NO: 169344 - DNA, 16 bp, H. sapiens
tttagaaaacaatttt

SEQ ID NO: 169345 - DNA, 16 bp, H. sapiens
tttagaaaacactttt

SEQ ID NO: 169346 - DNA, 16 bp, H. sapiens
tttagaaaactttaaa

SEQ ID NO: 169347 - DNA, 16 bp, H. sapiens
tttagaaaagaaagga

SEQ ID NO: 169348 - DNA, 16 bp, H. sapiens
tttagaaaagaacata

SEQ ID NO: 169349 - DNA, 16 bp, H. sapiens
tttagaaaaggaaatt

SEQ ID NO: 169350 - DNA, 16 bp, H. sapiens
tttagaaaagtttgag

SEQ ID NO: 169351 - DNA, 16 bp, H. sapiens
tttagaaaataaactt

SEQ ID NO: 169352 - DNA, 16 bp, H. sapiens
tttagaaaataaagag

SEQ ID NO: 169353 - DNA, 16 bp, H. sapiens
tttagaaaataaagtt

SEQ ID NO: 169354 - DNA, 16 bp, H. sapiens
tttagaaaatacattt

SEQ ID NO: 169355 - DNA, 16 bp, H. sapiens
tttagaaaatagttat

SEQ ID NO: 169356 - DNA, 16 bp, H. sapiens
tttagaaaatataatg

SEQ ID NO: 169357 - DNA, 16 bp, H. sapiens
tttagaaaatgttaaa

SEQ ID NO: 169358 - DNA, 16 bp, H. sapiens
tttagaaaattatttg

SEQ ID NO: 169359 - DNA, 16 bp, H. sapiens
tttagaaaattctaaa

SEQ ID NO: 169360 - DNA, 16 bp, H. sapiens
tttagaaaattctttt

SEQ ID NO: 169361 - DNA, 16 bp, H. sapiens
tttagaaaatttgcaa

SEQ ID NO: 169362 - DNA, 16 bp, H. sapiens
tttagaaacaaaaatg

SEQ ID NO: 169363 - DNA, 16 bp, H. sapiens
tttagaaacacaaata

SEQ ID NO: 169364 - DNA, 16 bp, H. sapiens
tttagaaacagtcttt

SEQ ID NO: 169365 - DNA, 16 bp, H. sapiens
tttagaaactgaaaaa

SEQ ID NO: 169366 - DNA, 16 bp, H. sapiens
tttagaaactgtaaaa

SEQ ID NO: 169367 - DNA, 16 bp, H. sapiens
tttagaaagaagagaa

SEQ ID NO: 169368 - DNA, 16 bp, H. sapiens
tttagaaagaaggaaa

SEQ ID NO: 169369 - DNA, 16 bp, H. sapiens
tttagaaagtttcttt

SEQ ID NO: 169370 - DNA, 16 bp, H. sapiens
tttagaaatcatttta

SEQ ID NO: 169371 - DNA, 16 bp, H. sapiens
tttagaaatgaaagaa

SEQ ID NO: 169372 - DNA, 16 bp, H. sapiens
tttagaaatgaaggaa

SEQ ID NO: 169373 - DNA, 16 bp, H. sapiens
tttagaaatggaaaaa

SEQ ID NO: 169374 - DNA, 16 bp, H. sapiens
tttagaaatgtaaatt

SEQ ID NO: 169375 - DNA, 16 bp, H. sapiens
tttagaaatgtgaaaa

SEQ ID NO: 169376 - DNA, 16 bp, H. sapiens
tttagaaattctttct

SEQ ID NO: 169377 - DNA, 16 bp, H. sapiens
tttagaaattcttttt

SEQ ID NO: 169378 - DNA, 16 bp, H. sapiens
tttagaaatttatctt

SEQ ID NO: 169379 - DNA, 16 bp, H. sapiens
tttagaaatttattct

SEQ ID NO: 169380 - DNA, 16 bp, H. sapiens
tttagaacatttttat

SEQ ID NO: 169381 - DNA, 16 bp, H. sapiens
tttagaagaaaaaaca

SEQ ID NO: 169382 - DNA, 16 bp, H. sapiens
tttagaagaaaatatt

SEQ ID NO: 169383 - DNA, 16 bp, H. sapiens
tttagaagattttctt

SEQ ID NO: 169384 - DNA, 16 bp, H. sapiens
tttagaagctgaaaaa

SEQ ID NO: 169385 - DNA, 16 bp, H. sapiens
tttagaagtatgtttt

SEQ ID NO: 169386 - DNA, 16 bp, H. sapiens
tttagaagtgtgttat

SEQ ID NO: 169387 - DNA, 16 bp, H. sapiens
tttagaagtttgatta

SEQ ID NO: 169388 - DNA, 16 bp, H. sapiens
tttagaatacaaaatc

SEQ ID NO: 169389 - DNA, 16 bp, H. sapiens
tttagaatattctaaa

SEQ ID NO: 169390 - DNA, 16 bp, H. sapiens
tttagaatatttcata

SEQ ID NO: 169391 - DNA, 16 bp, H. sapiens
tttagaatcagaaaaa

SEQ ID NO: 169392 - DNA, 16 bp, H. sapiens
tttagaatgcattttt

SEQ ID NO: 169393 - DNA, 16 bp, H. sapiens
tttagaatggctgtat

SEQ ID NO: 169394 - DNA, 16 bp, H. sapiens
tttagaattaaaaaca

SEQ ID NO: 169395 - DNA, 16 bp, H. sapiens
tttagaatttccttta

SEQ ID NO: 169396 - DNA, 16 bp, H. sapiens
tttagaattttctaaa

SEQ ID NO: 169397 - DNA, 16 bp, H. sapiens
tttagaatttttgcat

SEQ ID NO: 169398 - DNA, 16 bp, H. sapiens
tttagacaaagcttaa

SEQ ID NO: 169399 - DNA, 16 bp, H. sapiens
tttagacataattcta

SEQ ID NO: 169400 - DNA, 16 bp, H. sapiens
tttagaccaatattct

SEQ ID NO: 169401 - DNA, 16 bp, H. sapiens
tttagagaaaaacaaa

SEQ ID NO: 169402 - DNA, 16 bp, H. sapiens
tttagagaaaaagctt

SEQ ID NO: 169403 - DNA, 16 bp, H. sapiens
tttagagaaaaattat

SEQ ID NO: 169404 - DNA, 16 bp, H. sapiens
tttagagaaatgtaaa

SEQ ID NO: 169405 - DNA, 16 bp, H. sapiens
tttagagaagaacaaa

SEQ ID NO: 169406 - DNA, 16 bp, H. sapiens
tttagagaagaacata

SEQ ID NO: 169407 - DNA, 16 bp, H. sapiens
tttagagacaaggtct

SEQ ID NO: 169408 - DNA, 16 bp, H. sapiens
tttagagacagggact

SEQ ID NO: 169409 - DNA, 16 bp, H. sapiens
tttagagacagggttt

SEQ ID NO: 169410 - DNA, 16 bp, H. sapiens
tttagagagaaaaata

SEQ ID NO: 169411 - DNA, 16 bp, H. sapiens
tttagagagaagaaaa

SEQ ID NO: 169412 - DNA, 16 bp, H. sapiens
tttagagataaagaaa

SEQ ID NO: 169413 - DNA, 16 bp, H. sapiens
tttagagatagagtct

SEQ ID NO: 169414 - DNA, 16 bp, H. sapiens
tttagagatagagttt

SEQ ID NO: 169415 - DNA, 16 bp, H. sapiens
tttagagataggttct

SEQ ID NO: 169416 - DNA, 16 bp, H. sapiens
tttagagatgaggaaa

SEQ ID NO: 169417 - DNA, 16 bp, H. sapiens
tttagagatgggatct

SEQ ID NO: 169418 - DNA, 16 bp, H. sapiens
tttagagcaggagtaa

SEQ ID NO: 169419 - DNA, 16 bp, H. sapiens
tttagaggaaaatata

SEQ ID NO: 169420 - DNA, 16 bp, H. sapiens
tttagaggcctccaat

SEQ ID NO: 169421 - DNA, 16 bp, H. sapiens
tttagagttgtttaaa

SEQ ID NO: 169422 - DNA, 16 bp, H. sapiens
tttagataaactcaac

SEQ ID NO: 169423 - DNA, 16 bp, H. sapiens
tttagataagtttctc

SEQ ID NO: 169424 - DNA, 16 bp, H. sapiens
tttagatacataaata

SEQ ID NO: 169425 - DNA, 16 bp, H. sapiens
tttagatactttattt

SEQ ID NO: 169426 - DNA, 16 bp, H. sapiens
tttagatatattttct

SEQ ID NO: 169427 - DNA, 16 bp, H. sapiens
tttagatatttcaaaa

SEQ ID NO: 169428 - DNA, 16 bp, H. sapiens
tttagatctattaata

SEQ ID NO: 169429 - DNA, 16 bp, H. sapiens
tttagatcttctttta

SEQ ID NO: 169430 - DNA, 16 bp, H. sapiens
tttagatctttcttct

SEQ ID NO: 169431 - DNA, 16 bp, H. sapiens
tttagatgaaatgaac

SEQ ID NO: 169432 - DNA, 16 bp, H. sapiens
tttagattcagcagtt

SEQ ID NO: 169433 - DNA, 16 bp, H. sapiens
tttagatttcacattt

SEQ ID NO: 169434 - DNA, 16 bp, H. sapiens
tttagatttcttcatg

SEQ ID NO: 169435 - DNA, 16 bp, H. sapiens
tttagattttgaaata

SEQ ID NO: 169436 - DNA, 16 bp, H. sapiens
tttagcaaacatttat

SEQ ID NO: 169437 - DNA, 16 bp, H. sapiens
tttagcaaagagactg

SEQ ID NO: 169438 - DNA, 16 bp, H. sapiens
tttagcaaataaaaac

SEQ ID NO: 169439 - DNA, 16 bp, H. sapiens
tttagcaaatattaaa

SEQ ID NO: 169440 - DNA, 16 bp, H. sapiens
tttagcaacaaagtat

SEQ ID NO: 169441 - DNA, 16 bp, H. sapiens
tttagcaagattgcag

SEQ ID NO: 169442 - DNA, 16 bp, H. sapiens
tttagcaaggagactg

SEQ ID NO: 169443 - DNA, 16 bp, H. sapiens
tttagcaccatctccc

SEQ ID NO: 169444 - DNA, 16 bp, H. sapiens
tttagcactttaaata

SEQ ID NO: 169445 - DNA, 16 bp, H. sapiens
tttagcagaaatagaa

SEQ ID NO: 169446 - DNA, 24 bp, H. sapiens
tttagcagagacggggtttcaccg

SEQ ID NO: 169447 - DNA, 16 bp, H. sapiens
tttagcagagactggt

SEQ ID NO: 169448 - DNA, 16 bp, H. sapiens
tttagcagggacaggg

SEQ ID NO: 169449 - DNA, 16 bp, H. sapiens
tttagcagtttggaaa

SEQ ID NO: 169450 - DNA, 16 bp, H. sapiens
tttagcagttttgaaa

SEQ ID NO: 169451 - DNA, 16 bp, H. sapiens
tttagcatataatcaa

SEQ ID NO: 169452 - DNA, 16 bp, H. sapiens
tttagcatatcatcaa

SEQ ID NO: 169453 - DNA, 16 bp, H. sapiens
tttagcatgaagagtt

SEQ ID NO: 169454 - DNA, 16 bp, H. sapiens
tttagcattaggttta

SEQ ID NO: 169455 - DNA, 16 bp, H. sapiens
tttagcatttattatt

SEQ ID NO: 169456 - DNA, 16 bp, H. sapiens
tttagcatttctttgt

SEQ ID NO: 169457 - DNA, 16 bp, H. sapiens
tttagcattttttata

SEQ ID NO: 169458 - DNA, 16 bp, H. sapiens
tttagcatttttttca

SEQ ID NO: 169459 - DNA, 16 bp, H. sapiens
tttagccataaaaaga

SEQ ID NO: 169460 - DNA, 16 bp, H. sapiens
tttagccatcctggtg

SEQ ID NO: 169461 - DNA, 16 bp, H. sapiens
tttagccattccagtg

SEQ ID NO: 169462 - DNA, 16 bp, H. sapiens
tttagccattttgaaa

SEQ ID NO: 169463 - DNA, 16 bp, H. sapiens
tttagccatttttaaa

SEQ ID NO: 169464 - DNA, 16 bp, H. sapiens
tttagcccactgagac

SEQ ID NO: 169465 - DNA, 16 bp, H. sapiens
tttagcccactttttg

SEQ ID NO: 169466 - DNA, 16 bp, H. sapiens
tttagcctaggtgaca

SEQ ID NO: 169467 - DNA, 16 bp, H. sapiens
tttagcctgttaactt

SEQ ID NO: 169468 - DNA, 16 bp, H. sapiens
tttagctctgagaagt

SEQ ID NO: 169469 - DNA, 16 bp, H. sapiens
tttagctgggcctggt

SEQ ID NO: 169470 - DNA, 16 bp, H. sapiens
tttagctgtgcagaag

SEQ ID NO: 169471 - DNA, 16 bp, H. sapiens
tttagctgtgtctcag

SEQ ID NO: 169472 - DNA, 16 bp, H. sapiens
tttagctgttttcatt

SEQ ID NO: 169473 - DNA, 16 bp, H. sapiens
tttagcttatttttaa

SEQ ID NO: 169474 - DNA, 16 bp, H. sapiens
tttagcttccatatat

SEQ ID NO: 169475 - DNA, 16 bp, H. sapiens
tttagcttctttccag

SEQ ID NO: 169476 - DNA, 16 bp, H. sapiens
tttagcttttacattt

SEQ ID NO: 169477 - DNA, 16 bp, H. sapiens
tttaggaaaatgtttt

SEQ ID NO: 169478 - DNA, 16 bp, H. sapiens
tttaggaaataaatat

SEQ ID NO: 169479 - DNA, 16 bp, H. sapiens
tttaggaaatacattt

SEQ ID NO: 169480 - DNA, 16 bp, H. sapiens
tttaggacaagaattt

SEQ ID NO: 169481 - DNA, 16 bp, H. sapiens
tttaggagaaagtaag

SEQ ID NO: 169482 - DNA, 16 bp, H. sapiens
tttaggagatttattt

SEQ ID NO: 169483 - DNA, 16 bp, H. sapiens
tttaggaggacaagtt

SEQ ID NO: 169484 - DNA, 16 bp, H. sapiens
tttaggaggccgaggt

SEQ ID NO: 169485 - DNA, 16 bp, H. sapiens
tttaggcacagctgac

SEQ ID NO: 169486 - DNA, 16 bp, H. sapiens
tttaggccaggagttc

SEQ ID NO: 169487 - DNA, 16 bp, H. sapiens
tttaggctaaacttaa

SEQ ID NO: 169488 - DNA, 16 bp, H. sapiens
tttaggcttttccaaa

SEQ ID NO: 169489 - DNA, 16 bp, H. sapiens
tttagggaaaagaaaa

SEQ ID NO: 169490 - DNA, 16 bp, H. sapiens
tttagggaacctaata

SEQ ID NO: 169491 - DNA, 16 bp, H. sapiens
tttagggagagacctg

SEQ ID NO: 169492 - DNA, 16 bp, H. sapiens
tttaggggaaaaaaaa

SEQ ID NO: 169493 - DNA, 16 bp, H. sapiens
tttagggggaaaaaaa

SEQ ID NO: 169494 - DNA, 16 bp, H. sapiens
tttagggtttacattt

SEQ ID NO: 169495 - DNA, 16 bp, H. sapiens
tttaggtcctgaatat

SEQ ID NO: 169496 - DNA, 16 bp, H. sapiens
tttaggtgatccaccc

SEQ ID NO: 169497 - DNA, 16 bp, H. sapiens
tttaggttcacagcaa

SEQ ID NO: 169498 - DNA, 16 bp, H. sapiens
tttaggtttgcagaaa

SEQ ID NO: 169499 - DNA, 16 bp, H. sapiens
tttaggtttttaaaaa

SEQ ID NO: 169500 - DNA, 16 bp, H. sapiens
tttagtaaatgttatc

SEQ ID NO: 169501 - DNA, 16 bp, H. sapiens
tttagtaaattgccca

SEQ ID NO: 169502 - DNA, 18 bp, H. sapiens
tttagtaatagactgggc

SEQ ID NO: 169503 - DNA, 16 bp, H. sapiens
tttagtaatagctatt

SEQ ID NO: 169504 - DNA, 17 bp, H. sapiens
tttagtagaaatggagt

SEQ ID NO: 169505 - DNA, 16 bp, H. sapiens
tttagtagaaatgggc

SEQ ID NO: 169506 - DNA, 17 bp, H. sapiens
tttagtagagacaggag

SEQ ID NO: 169507 - DNA, 29 bp, H. sapiens
tttagtagagacagggtttcaccatgtta

SEQ ID NO: 169508 - DNA, 31 bp, H. sapiens
tttagtagagacagggtttcaccatgttggt

SEQ ID NO: 169509 - DNA, 26 bp, H. sapiens
tttagtagagacggggtttcaccacg

SEQ ID NO: 169510 - DNA, 19 bp, H. sapiens
tttagtagagatgcggttt

SEQ ID NO: 169511 - DNA, 25 bp, H. sapiens
tttagtagagatgggttttcaccat

SEQ ID NO: 169512 - DNA, 16 bp, H. sapiens
tttagtagagatggtg

SEQ ID NO: 169513 - DNA, 16 bp, H. sapiens
tttagtagaggtgggc

SEQ ID NO: 169514 - DNA, 18 bp, H. sapiens
tttagtagggacgggttt

SEQ ID NO: 169515 - DNA, 16 bp, H. sapiens
tttagtataagcatgt

SEQ ID NO: 169516 - DNA, 16 bp, H. sapiens
tttagtataattagat

SEQ ID NO: 169517 - DNA, 16 bp, H. sapiens
tttagtatatttgcag

SEQ ID NO: 169518 - DNA, 16 bp, H. sapiens
tttagtcattctagta

SEQ ID NO: 169519 - DNA, 16 bp, H. sapiens
tttagtcatttaaaaa

SEQ ID NO: 169520 - DNA, 16 bp, H. sapiens
tttagtcccagctact

SEQ ID NO: 169521 - DNA, 16 bp, H. sapiens
tttagtgaaggtaatt

SEQ ID NO: 169522 - DNA, 16 bp, H. sapiens
tttagtgcctctttca

SEQ ID NO: 169523 - DNA, 16 bp, H. sapiens
tttagtggagacaagg

SEQ ID NO: 169524 - DNA, 16 bp, H. sapiens
tttagtggagatggga

SEQ ID NO: 169525 - DNA, 16 bp, H. sapiens
tttagtggaggaagta

SEQ ID NO: 169526 - DNA, 16 bp, H. sapiens
tttagtggggacacag

SEQ ID NO: 169527 - DNA, 16 bp, H. sapiens
tttagtggtgagtgtt

SEQ ID NO: 169528 - DNA, 16 bp, H. sapiens
tttagtggttatttct

SEQ ID NO: 169529 - DNA, 16 bp, H. sapiens
tttagtgtttttatca

SEQ ID NO: 169530 - DNA, 16 bp, H. sapiens
tttagttaaaatgtct

SEQ ID NO: 169531 - DNA, 16 bp, H. sapiens
tttagttaacaataat

SEQ ID NO: 169532 - DNA, 26 bp, H. sapiens
tttagttaatctaatatctatagaaa

SEQ ID NO: 169533 - DNA, 16 bp, H. sapiens
tttagttatacatttt

SEQ ID NO: 169534 - DNA, 16 bp, H. sapiens
tttagttcaattagat

SEQ ID NO: 169535 - DNA, 16 bp, H. sapiens
tttagttcttacattt

SEQ ID NO: 169536 - DNA, 16 bp, H. sapiens
tttagttcttatgaag

SEQ ID NO: 169537 - DNA, 16 bp, H. sapiens
tttagttctttgaaaa

SEQ ID NO: 169538 - DNA, 16 bp, H. sapiens
tttagttgaaaaagca

SEQ ID NO: 169539 - DNA, 16 bp, H. sapiens
tttagttgactcacag

SEQ ID NO: 169540 - DNA, 16 bp, H. sapiens
tttagttgtacattta

SEQ ID NO: 169541 - DNA, 16 bp, H. sapiens
tttagtttaaaaatgt

SEQ ID NO: 169542 - DNA, 16 bp, H. sapiens
tttagtttacagttta

SEQ ID NO: 169543 - DNA, 16 bp, H. sapiens
tttagtttctataggg

SEQ ID NO: 169544 - DNA, 18 bp, H. sapiens
tttagtttctcaattcat

SEQ ID NO: 169545 - DNA, 16 bp, H. sapiens
tttagtttgcattttc

SEQ ID NO: 169546 - DNA, 16 bp, H. sapiens
tttagttttactttaa

SEQ ID NO: 169547 - DNA, 17 bp, H. sapiens
tttagttttctgttcct

SEQ ID NO: 169548 - DNA, 16 bp, H. sapiens
tttagttttgccatct

SEQ ID NO: 169549 - DNA, 16 bp, H. sapiens
tttagtttttaattca

SEQ ID NO: 169550 - DNA, 16 bp, H. sapiens
tttagtttttgttgca

SEQ ID NO: 169551 - DNA, 16 bp, H. sapiens
tttagttttttcagaa

SEQ ID NO: 169552 - DNA, 16 bp, H. sapiens
tttataaaaacaaaga

SEQ ID NO: 169553 - DNA, 16 bp, H. sapiens
tttataaaaagatgta

SEQ ID NO: 169554 - DNA, 16 bp, H. sapiens
tttataaaaatgaagt

SEQ ID NO: 169555 - DNA, 16 bp, H. sapiens
tttataaaaatggaag

SEQ ID NO: 169556 - DNA, 16 bp, H. sapiens
tttataaaaatggttt

SEQ ID NO: 169557 - DNA, 16 bp, H. sapiens
tttataaaacaaacac

SEQ ID NO: 169558 - DNA, 16 bp, H. sapiens
tttataaaacaagaaa

SEQ ID NO: 169559 - DNA, 16 bp, H. sapiens
tttataaaacatgttt

SEQ ID NO: 169560 - DNA, 16 bp, H. sapiens
tttataaaaccatttt

SEQ ID NO: 169561 - DNA, 16 bp, H. sapiens
tttataaaagacaaaa

SEQ ID NO: 169562 - DNA, 16 bp, H. sapiens
tttataaaagcaaaat

SEQ ID NO: 169563 - DNA, 16 bp, H. sapiens
tttataaaaggaagag

SEQ ID NO: 169564 - DNA, 16 bp, H. sapiens
tttataaaaggggaaa

SEQ ID NO: 169565 - DNA, 16 bp, H. sapiens
tttataaaaggtaaat

SEQ ID NO: 169566 - DNA, 16 bp, H. sapiens
tttataaaatcaaaga

SEQ ID NO: 169567 - DNA, 16 bp, H. sapiens
tttataaaatgaattc

SEQ ID NO: 169568 - DNA, 16 bp, H. sapiens
tttataaaatgactat

SEQ ID NO: 169569 - DNA, 16 bp, H. sapiens
tttataaaatgagcat

SEQ ID NO: 169570 - DNA, 16 bp, H. sapiens
tttataaaatgcatat

SEQ ID NO: 169571 - DNA, 16 bp, H. sapiens
tttataaaatgctttc

SEQ ID NO: 169572 - DNA, 16 bp, H. sapiens
tttataaaatgggaat

SEQ ID NO: 169573 - DNA, 16 bp, H. sapiens
tttataaacaaattca

SEQ ID NO: 169574 - DNA, 16 bp, H. sapiens
tttataaacacataca

SEQ ID NO: 169575 - DNA, 16 bp, H. sapiens
tttataaacagaaatg

SEQ ID NO: 169576 - DNA, 16 bp, H. sapiens
tttataaacaggaaaa

SEQ ID NO: 169577 - DNA, 16 bp, H. sapiens
tttataaacatgaaaa

SEQ ID NO: 169578 - DNA, 16 bp, H. sapiens
tttataaacatgtata

SEQ ID NO: 169579 - DNA, 16 bp, H. sapiens
tttataaacatgtttt

SEQ ID NO: 169580 - DNA, 16 bp, H. sapiens
tttataaactgaaaaa

SEQ ID NO: 169581 - DNA, 16 bp, H. sapiens
tttataaactgctttt

SEQ ID NO: 169582 - DNA, 16 bp, H. sapiens
tttataaactgtaaag

SEQ ID NO: 169583 - DNA, 16 bp, H. sapiens
tttataaacttgtaaa

SEQ ID NO: 169584 - DNA, 16 bp, H. sapiens
tttataaagaaaagtg

SEQ ID NO: 169585 - DNA, 16 bp, H. sapiens
tttataaagaaacaga

SEQ ID NO: 169586 - DNA, 16 bp, H. sapiens
tttataaagaaaggtt

SEQ ID NO: 169587 - DNA, 16 bp, H. sapiens
tttataaagagaaaga

SEQ ID NO: 169588 - DNA, 16 bp, H. sapiens
tttataaagcaaaaaa

SEQ ID NO: 169589 - DNA, 16 bp, H. sapiens
tttataaagcaataaa

SEQ ID NO: 169590 - DNA, 16 bp, H. sapiens
tttataaagcatttac

SEQ ID NO: 169591 - DNA, 16 bp, H. sapiens
tttataaagccatcag

SEQ ID NO: 169592 - DNA, 16 bp, H. sapiens
tttataaagctcaaaa

SEQ ID NO: 169593 - DNA, 16 bp, H. sapiens
tttataaaggaaaaga

SEQ ID NO: 169594 - DNA, 16 bp, H. sapiens
tttataaaggagagag

SEQ ID NO: 169595 - DNA, 16 bp, H. sapiens
tttataaagtccaatt

SEQ ID NO: 169596 - DNA, 16 bp, H. sapiens
tttataaagttcaaaa

SEQ ID NO: 169597 - DNA, 16 bp, H. sapiens
tttataaagtttatag

SEQ ID NO: 169598 - DNA, 16 bp, H. sapiens
tttataaatcagtttt

SEQ ID NO: 169599 - DNA, 16 bp, H. sapiens
tttataaatgagaaga

SEQ ID NO: 169600 - DNA, 16 bp, H. sapiens
tttataaatgatgaaa

SEQ ID NO: 169601 - DNA, 16 bp, H. sapiens
tttataaatggcagtt

SEQ ID NO: 169602 - DNA, 16 bp, H. sapiens
tttataaatgggcaaa

SEQ ID NO: 169603 - DNA, 16 bp, H. sapiens
tttataaatgtcattt

SEQ ID NO: 169604 - DNA, 16 bp, H. sapiens
tttataaattacccag

SEQ ID NO: 169605 - DNA, 16 bp, H. sapiens
tttataaattcagaaa

SEQ ID NO: 169606 - DNA, 16 bp, H. sapiens
tttataaattcagtgt

SEQ ID NO: 169607 - DNA, 16 bp, H. sapiens
tttataaattgctcag

SEQ ID NO: 169608 - DNA, 16 bp, H. sapiens
tttataacaacacaaa

SEQ ID NO: 169609 - DNA, 16 bp, H. sapiens
tttataacaagcccac

SEQ ID NO: 169610 - DNA, 16 bp, H. sapiens
tttataacttgaaaaa

SEQ ID NO: 169611 - DNA, 16 bp, H. sapiens
tttataagaaaaaaac

SEQ ID NO: 169612 - DNA, 16 bp, H. sapiens
tttataagaaaatgtt

SEQ ID NO: 169613 - DNA, 16 bp, H. sapiens
tttataagaaccaaaa

SEQ ID NO: 169614 - DNA, 16 bp, H. sapiens
tttataagagaaagaa

SEQ ID NO: 169615 - DNA, 16 bp, H. sapiens
tttataagccacccag

SEQ ID NO: 169616 - DNA, 16 bp, H. sapiens
tttataagctttttaa

SEQ ID NO: 169617 - DNA, 16 bp, H. sapiens
tttataaggaaagaag

SEQ ID NO: 169618 - DNA, 16 bp, H. sapiens
tttataagggactttt

SEQ ID NO: 169619 - DNA, 16 bp, H. sapiens
tttataagggcactaa

SEQ ID NO: 169620 - DNA, 16 bp, H. sapiens
tttataagtaaagttt

SEQ ID NO: 169621 - DNA, 16 bp, H. sapiens
tttataataaaactgt

SEQ ID NO: 169622 - DNA, 16 bp, H. sapiens
tttataataaactgtt

SEQ ID NO: 169623 - DNA, 16 bp, H. sapiens
tttataatagctattt

SEQ ID NO: 169624 - DNA, 16 bp, H. sapiens
tttataatagcttttt

SEQ ID NO: 169625 - DNA, 16 bp, H. sapiens
tttataatcaatttgt

SEQ ID NO: 169626 - DNA, 16 bp, H. sapiens
tttataatcagaaaaa

SEQ ID NO: 169627 - DNA, 16 bp, H. sapiens
tttataatcatgaaaa

SEQ ID NO: 169628 - DNA, 16 bp, H. sapiens
tttataatgaaaatga

SEQ ID NO: 169629 - DNA, 16 bp, H. sapiens
tttataatgtatttca

SEQ ID NO: 169630 - DNA, 16 bp, H. sapiens
tttataattcagtctt

SEQ ID NO: 169631 - DNA, 16 bp, H. sapiens
tttataattctgaaaa

SEQ ID NO: 169632 - DNA, 16 bp, H. sapiens
tttataatttcaacat

SEQ ID NO: 169633 - DNA, 16 bp, H. sapiens
tttataattttcagca

SEQ ID NO: 169634 - DNA, 16 bp, H. sapiens
tttataattttctcca

SEQ ID NO: 169635 - DNA, 16 bp, H. sapiens
tttatacaaagatatt

SEQ ID NO: 169636 - DNA, 16 bp, H. sapiens
tttatacaatggaata

SEQ ID NO: 169637 - DNA, 16 bp, H. sapiens
tttatacatatgtaaa

SEQ ID NO: 169638 - DNA, 16 bp, H. sapiens
tttatacatgaagaaa

SEQ ID NO: 169639 - DNA, 16 bp, H. sapiens
tttatacattaagaaa

SEQ ID NO: 169640 - DNA, 16 bp, H. sapiens
tttatacattttgtat

SEQ ID NO: 169641 - DNA, 16 bp, H. sapiens
tttataccattgtggt

SEQ ID NO: 169642 - DNA, 16 bp, H. sapiens
tttatacccaaaagaa

SEQ ID NO: 169643 - DNA, 16 bp, H. sapiens
tttatacttgagaaaa

SEQ ID NO: 169644 - DNA, 16 bp, H. sapiens
tttatactttaaaaga

SEQ ID NO: 169645 - DNA, 16 bp, H. sapiens
tttatactttctgcag

SEQ ID NO: 169646 - DNA, 16 bp, H. sapiens
tttatactttgagtta

SEQ ID NO: 169647 - DNA, 16 bp, H. sapiens
tttatacttttgaaat

SEQ ID NO: 169648 - DNA, 16 bp, H. sapiens
tttatacttttgtatg

SEQ ID NO: 169649 - DNA, 16 bp, H. sapiens
tttatagaaaaacttt

SEQ ID NO: 169650 - DNA, 16 bp, H. sapiens
tttatagaaaatgttt

SEQ ID NO: 169651 - DNA, 16 bp, H. sapiens
tttatagaaatacaaa

SEQ ID NO: 169652 - DNA, 16 bp, H. sapiens
tttatagaaatacaat

SEQ ID NO: 169653 - DNA, 16 bp, H. sapiens
tttatagaagaggaaa

SEQ ID NO: 169654 - DNA, 16 bp, H. sapiens
tttatagagatggagg

SEQ ID NO: 169655 - DNA, 16 bp, H. sapiens
tttatagagtttgact

SEQ ID NO: 169656 - DNA, 16 bp, H. sapiens
tttatagataaggaaa

SEQ ID NO: 169657 - DNA, 16 bp, H. sapiens
tttatagatgcaatgc

SEQ ID NO: 169658 - DNA, 16 bp, H. sapiens
tttatagatggagaaa

SEQ ID NO: 169659 - DNA, 16 bp, H. sapiens
tttatagatggggaaa

SEQ ID NO: 169660 - DNA, 16 bp, H. sapiens
tttatagcaatacaaa

SEQ ID NO: 169661 - DNA, 16 bp, H. sapiens
tttatagcacttaatg

SEQ ID NO: 169662 - DNA, 17 bp, H. sapiens
tttatagcagcacaatt

SEQ ID NO: 169663 - DNA, 16 bp, H. sapiens
tttatagcagcatgtt

SEQ ID NO: 169664 - DNA, 16 bp, H. sapiens
tttatagcatttatca

SEQ ID NO: 169665 - DNA, 16 bp, H. sapiens
tttatagcattttctt

SEQ ID NO: 169666 - DNA, 16 bp, H. sapiens
tttatagcattttgtt

SEQ ID NO: 169667 - DNA, 16 bp, H. sapiens
tttatagctaaagaaa

SEQ ID NO: 169668 - DNA, 16 bp, H. sapiens
tttatagctggggaaa

SEQ ID NO: 169669 - DNA, 16 bp, H. sapiens
tttatagcttttgatt

SEQ ID NO: 169670 - DNA, 16 bp, H. sapiens
tttataggcaagaaaa

SEQ ID NO: 169671 - DNA, 16 bp, H. sapiens
tttatagtaataaaca

SEQ ID NO: 169672 - DNA, 16 bp, H. sapiens
tttatagtagcaaaaa

SEQ ID NO: 169673 - DNA, 17 bp, H. sapiens
tttatagtcctttgggt

SEQ ID NO: 169674 - DNA, 18 bp, H. sapiens
tttatagtgttctctgat

SEQ ID NO: 169675 - DNA, 16 bp, H. sapiens
tttatagttagaaaaa

SEQ ID NO: 169676 - DNA, 16 bp, H. sapiens
tttatagtttacaaag

SEQ ID NO: 169677 - DNA, 16 bp, H. sapiens
tttatagtttatttgc

SEQ ID NO: 169678 - DNA, 16 bp, H. sapiens
tttatagttttaactt

SEQ ID NO: 169679 - DNA, 16 bp, H. sapiens
tttatagtttttggtc

SEQ ID NO: 169680 - DNA, 16 bp, H. sapiens
tttatataaaaatgca

SEQ ID NO: 169681 - DNA, 16 bp, H. sapiens
tttatataaaatgaca

SEQ ID NO: 169682 - DNA, 16 bp, H. sapiens
tttatataaaatgtgt

SEQ ID NO: 169683 - DNA, 16 bp, H. sapiens
tttatataaatacaca

SEQ ID NO: 169684 - DNA, 16 bp, H. sapiens
tttatataaatggatt

SEQ ID NO: 169685 - DNA, 16 bp, H. sapiens
tttatataaattagag

SEQ ID NO: 169686 - DNA, 16 bp, H. sapiens
tttatatacaagaaaa

SEQ ID NO: 169687 - DNA, 16 bp, H. sapiens
tttatatacagaaata

SEQ ID NO: 169688 - DNA, 16 bp, H. sapiens
tttatatacatacata

SEQ ID NO: 169689 - DNA, 16 bp, H. sapiens
tttatatacatgttta

SEQ ID NO: 169690 - DNA, 16 bp, H. sapiens
tttatataccacattt

SEQ ID NO: 169691 - DNA, 16 bp, H. sapiens
tttatatactatgtat

SEQ ID NO: 169692 - DNA, 16 bp, H. sapiens
tttatatagcacttta

SEQ ID NO: 169693 - DNA, 16 bp, H. sapiens
tttatatatacataca

SEQ ID NO: 169694 - DNA, 16 bp, H. sapiens
tttatatatagtgtgt

SEQ ID NO: 169695 - DNA, 17 bp, H. sapiens
tttatatatatgtgtgt

SEQ ID NO: 169696 - DNA, 16 bp, H. sapiens
tttatatatgaagaaa

SEQ ID NO: 169697 - DNA, 16 bp, H. sapiens
tttatatattgtgaaa

SEQ ID NO: 169698 - DNA, 16 bp, H. sapiens
tttatatattttgcct

SEQ ID NO: 169699 - DNA, 16 bp, H. sapiens
tttatatcagataaaa

SEQ ID NO: 169700 - DNA, 16 bp, H. sapiens
tttatatccaaatata

SEQ ID NO: 169701 - DNA, 16 bp, H. sapiens
tttatatcctataaaa

SEQ ID NO: 169702 - DNA, 17 bp, H. sapiens
tttatatcctgagactt

SEQ ID NO: 169703 - DNA, 16 bp, H. sapiens
tttatatctgaaatat

SEQ ID NO: 169704 - DNA, 16 bp, H. sapiens
tttatatgaaaatgca

SEQ ID NO: 169705 - DNA, 16 bp, H. sapiens
tttatatgaaaatgta

SEQ ID NO: 169706 - DNA, 16 bp, H. sapiens
tttatatgaaatcaca

SEQ ID NO: 169707 - DNA, 16 bp, H. sapiens
tttatatgaagataaa

SEQ ID NO: 169708 - DNA, 16 bp, H. sapiens
tttatatgacattctt

SEQ ID NO: 169709 - DNA, 16 bp, H. sapiens
tttatatgcattatct

SEQ ID NO: 169710 - DNA, 17 bp, H. sapiens
tttatatgggtacagga

SEQ ID NO: 169711 - DNA, 16 bp, H. sapiens
tttatatgtgaaatct

SEQ ID NO: 169712 - DNA, 16 bp, H. sapiens
tttatatgtgaatata

SEQ ID NO: 169713 - DNA, 16 bp, H. sapiens
tttatatgtgtgcata

SEQ ID NO: 169714 - DNA, 16 bp, H. sapiens
tttatattaagtcttg

SEQ ID NO: 169715 - DNA, 16 bp, H. sapiens
tttatattacacatat

SEQ ID NO: 169716 - DNA, 16 bp, H. sapiens
tttatattacatatgt

SEQ ID NO: 169717 - DNA, 16 bp, H. sapiens
tttatattactttggg

SEQ ID NO: 169718 - DNA, 16 bp, H. sapiens
tttatattcaaatgtt

SEQ ID NO: 169719 - DNA, 16 bp, H. sapiens
tttatattcatctggg

SEQ ID NO: 169720 - DNA, 16 bp, H. sapiens
tttatattcccaccag

SEQ ID NO: 169721 - DNA, 16 bp, H. sapiens
tttatattcctttgga

SEQ ID NO: 169722 - DNA, 16 bp, H. sapiens
tttatattgaaagaaa

SEQ ID NO: 169723 - DNA, 16 bp, H. sapiens
tttatatttatgtcta

SEQ ID NO: 169724 - DNA, 16 bp, H. sapiens
tttatatttattcatg

SEQ ID NO: 169725 - DNA, 16 bp, H. sapiens
tttatatttatttgca

SEQ ID NO: 169726 - DNA, 16 bp, H. sapiens
tttatatttcagatat

SEQ ID NO: 169727 - DNA, 16 bp, H. sapiens
tttatatttccaaaaa

SEQ ID NO: 169728 - DNA, 16 bp, H. sapiens
tttatatttccagaaa

SEQ ID NO: 169729 - DNA, 16 bp, H. sapiens
tttatatttctaccag

SEQ ID NO: 169730 - DNA, 16 bp, H. sapiens
tttatatttgtttcaa

SEQ ID NO: 169731 - DNA, 16 bp, H. sapiens
tttatattttcatgtg

SEQ ID NO: 169732 - DNA, 16 bp, H. sapiens
tttatcaaaaagaaaa

SEQ ID NO: 169733 - DNA, 16 bp, H. sapiens
tttatcaaaagacttt

SEQ ID NO: 169734 - DNA, 16 bp, H. sapiens
tttatcaaaggtcttt

SEQ ID NO: 169735 - DNA, 16 bp, H. sapiens
tttatcaaatgtttct

SEQ ID NO: 169736 - DNA, 16 bp, H. sapiens
tttatcaaatttgcca

SEQ ID NO: 169737 - DNA, 16 bp, H. sapiens
tttatcaactaagttt

SEQ ID NO: 169738 - DNA, 16 bp, H. sapiens
tttatcaacttcctca

SEQ ID NO: 169739 - DNA, 16 bp, H. sapiens
tttatcaacttttaaa

SEQ ID NO: 169740 - DNA, 16 bp, H. sapiens
tttatcaagagttttt

SEQ ID NO: 169741 - DNA, 16 bp, H. sapiens
tttatcaagattctta

SEQ ID NO: 169742 - DNA, 16 bp, H. sapiens
tttatcaagtctagga

SEQ ID NO: 169743 - DNA, 16 bp, H. sapiens
tttatcaagtttatgt

SEQ ID NO: 169744 - DNA, 16 bp, H. sapiens
tttatcacattttgtt

SEQ ID NO: 169745 - DNA, 16 bp, H. sapiens
tttatcactgaatagt

SEQ ID NO: 169746 - DNA, 16 bp, H. sapiens
tttatcagatatatgc

SEQ ID NO: 169747 - DNA, 16 bp, H. sapiens
tttatcaggttgaaaa

SEQ ID NO: 169748 - DNA, 16 bp, H. sapiens
tttatcagtaatttga

SEQ ID NO: 169749 - DNA, 16 bp, H. sapiens
tttatcagtattttct

SEQ ID NO: 169750 - DNA, 16 bp, H. sapiens
tttatcagtgatattg

SEQ ID NO: 169751 - DNA, 16 bp, H. sapiens
tttatcagtttgagga

SEQ ID NO: 169752 - DNA, 22 bp, H. sapiens
tttatcatgaatgcaggatgtg

SEQ ID NO: 169753 - DNA, 16 bp, H. sapiens
tttatcatgcagatga

SEQ ID NO: 169754 - DNA, 16 bp, H. sapiens
tttatcatgtatttat

SEQ ID NO: 169755 - DNA, 16 bp, H. sapiens
tttatcattatgaaat

SEQ ID NO: 169756 - DNA, 16 bp, H. sapiens
tttatcattctgaaaa

SEQ ID NO: 169757 - DNA, 16 bp, H. sapiens
tttatcattctgaaac

SEQ ID NO: 169758 - DNA, 16 bp, H. sapiens
tttatcattgatgggc

SEQ ID NO: 169759 - DNA, 16 bp, H. sapiens
tttatcatttcaaaaa

SEQ ID NO: 169760 - DNA, 16 bp, H. sapiens
tttatcattttgtaat

SEQ ID NO: 169761 - DNA, 16 bp, H. sapiens
tttatccaaaggaaaa

SEQ ID NO: 169762 - DNA, 16 bp, H. sapiens
tttatccaagagaaaa

SEQ ID NO: 169763 - DNA, 16 bp, H. sapiens
tttatccaagatcaca

SEQ ID NO: 169764 - DNA, 16 bp, H. sapiens
tttatccaatccactg

SEQ ID NO: 169765 - DNA, 16 bp, H. sapiens
tttatccactcattgg

SEQ ID NO: 169766 - DNA, 16 bp, H. sapiens
tttatccactctatca

SEQ ID NO: 169767 - DNA, 16 bp, H. sapiens
tttatccagtcatcag

SEQ ID NO: 169768 - DNA, 16 bp, H. sapiens
tttatccattcaactg

SEQ ID NO: 169769 - DNA, 16 bp, H. sapiens
tttatccattcaccta

SEQ ID NO: 169770 - DNA, 16 bp, H. sapiens
tttatccattcatctg

SEQ ID NO: 169771 - DNA, 16 bp, H. sapiens
tttatccattcattga

SEQ ID NO: 169772 - DNA, 16 bp, H. sapiens
tttatccattcatttg

SEQ ID NO: 169773 - DNA, 16 bp, H. sapiens
tttatccatttatcag

SEQ ID NO: 169774 - DNA, 16 bp, H. sapiens
tttatccatttgttca

SEQ ID NO: 169775 - DNA, 16 bp, H. sapiens
tttatccctcaacccc

SEQ ID NO: 169776 - DNA, 16 bp, H. sapiens
tttatcctaaggaaat

SEQ ID NO: 169777 - DNA, 16 bp, H. sapiens
tttatcctacttggag

SEQ ID NO: 169778 - DNA, 16 bp, H. sapiens
tttatcctttaaaaaa

SEQ ID NO: 169779 - DNA, 16 bp, H. sapiens
tttatctaatctatca

SEQ ID NO: 169780 - DNA, 16 bp, H. sapiens
tttatctaatgttttc

SEQ ID NO: 169781 - DNA, 16 bp, H. sapiens
tttatctccaaataca

SEQ ID NO: 169782 - DNA, 16 bp, H. sapiens
tttatctctgctctga

SEQ ID NO: 169783 - DNA, 16 bp, H. sapiens
tttatctgaagatttt

SEQ ID NO: 169784 - DNA, 16 bp, H. sapiens
tttatctgaattttaa

SEQ ID NO: 169785 - DNA, 16 bp, H. sapiens
tttatctgactccaaa

SEQ ID NO: 169786 - DNA, 16 bp, H. sapiens
tttatctggaatttat

SEQ ID NO: 169787 - DNA, 16 bp, H. sapiens
tttatcttaaaactca

SEQ ID NO: 169788 - DNA, 16 bp, H. sapiens
tttatcttaacctgaa

SEQ ID NO: 169789 - DNA, 16 bp, H. sapiens
tttatcttacaaaaat

SEQ ID NO: 169790 - DNA, 16 bp, H. sapiens
tttatcttacttggag

SEQ ID NO: 169791 - DNA, 16 bp, H. sapiens
tttatcttctcaaaga

SEQ ID NO: 169792 - DNA, 16 bp, H. sapiens
tttatcttgagaacat

SEQ ID NO: 169793 - DNA, 16 bp, H. sapiens
tttatcttggatcatt

SEQ ID NO: 169794 - DNA, 16 bp, H. sapiens
tttatcttgtggaata

SEQ ID NO: 169795 - DNA, 16 bp, H. sapiens
tttatctttaagaaat

SEQ ID NO: 169796 - DNA, 16 bp, H. sapiens
tttatctttcaaaata

SEQ ID NO: 169797 - DNA, 16 bp, H. sapiens
tttatctttcaaaatg

SEQ ID NO: 169798 - DNA, 16 bp, H. sapiens
tttatctttccaaaga

SEQ ID NO: 169799 - DNA, 16 bp, H. sapiens
tttatctttgaaaata

SEQ ID NO: 169800 - DNA, 16 bp, H. sapiens
tttatctttgtattcc

SEQ ID NO: 169801 - DNA, 16 bp, H. sapiens
tttatcttttaaagtt

SEQ ID NO: 169802 - DNA, 16 bp, H. sapiens
tttatcttttcaaaga

SEQ ID NO: 169803 - DNA, 16 bp, H. sapiens
tttatcttttcaagga

SEQ ID NO: 169804 - DNA, 16 bp, H. sapiens
tttatcttttcagaaa

SEQ ID NO: 169805 - DNA, 16 bp, H. sapiens
tttatgaaaaacaaaa

SEQ ID NO: 169806 - DNA, 16 bp, H. sapiens
tttatgaaaaataact

SEQ ID NO: 169807 - DNA, 16 bp, H. sapiens
tttatgaaaaatactt

SEQ ID NO: 169808 - DNA, 16 bp, H. sapiens
tttatgaaaatagttt

SEQ ID NO: 169809 - DNA, 16 bp, H. sapiens
tttatgaaaatatgaa

SEQ ID NO: 169810 - DNA, 16 bp, H. sapiens
tttatgaaaatgttaa

SEQ ID NO: 169811 - DNA, 16 bp, H. sapiens
tttatgaaaatgttta

SEQ ID NO: 169812 - DNA, 16 bp, H. sapiens
tttatgaaaattcatc

SEQ ID NO: 169813 - DNA, 16 bp, H. sapiens
tttatgaaaattcatt

SEQ ID NO: 169814 - DNA, 16 bp, H. sapiens
tttatgaaacagaaaa

SEQ ID NO: 169815 - DNA, 16 bp, H. sapiens
tttatgaaacttttaa

SEQ ID NO: 169816 - DNA, 16 bp, H. sapiens
tttatgaaagataatt

SEQ ID NO: 169817 - DNA, 16 bp, H. sapiens
tttatgaaatactttt

SEQ ID NO: 169818 - DNA, 16 bp, H. sapiens
tttatgaaatgctttt

SEQ ID NO: 169819 - DNA, 16 bp, H. sapiens
tttatgaaatggaaat

SEQ ID NO: 169820 - DNA, 16 bp, H. sapiens
tttatgaactgtaaca

SEQ ID NO: 169821 - DNA, 16 bp, H. sapiens
tttatgaagaaaaaca

SEQ ID NO: 169822 - DNA, 16 bp, H. sapiens
tttatgaagaaaaaga

SEQ ID NO: 169823 - DNA, 16 bp, H. sapiens
tttatgaagaaaatga

SEQ ID NO: 169824 - DNA, 16 bp, H. sapiens
tttatgaagaaagagg

SEQ ID NO: 169825 - DNA, 16 bp, H. sapiens
tttatgaagaaatatt

SEQ ID NO: 169826 - DNA, 16 bp, H. sapiens
tttatgaagaagaaat

SEQ ID NO: 169827 - DNA, 16 bp, H. sapiens
tttatgaagagaaaat

SEQ ID NO: 169828 - DNA, 16 bp, H. sapiens
tttatgaagagaagag

SEQ ID NO: 169829 - DNA, 16 bp, H. sapiens
tttatgaagattaaat

SEQ ID NO: 169830 - DNA, 16 bp, H. sapiens
tttatgaagcattttc

SEQ ID NO: 169831 - DNA, 16 bp, H. sapiens
tttatgaagccagaat

SEQ ID NO: 169832 - DNA, 16 bp, H. sapiens
tttatgaagttttaaa

SEQ ID NO: 169833 - DNA, 16 bp, H. sapiens
tttatgaatctgggca

SEQ ID NO: 169834 - DNA, 16 bp, H. sapiens
tttatgaatctgggta

SEQ ID NO: 169835 - DNA, 16 bp, H. sapiens
tttatgaatgaggaaa

SEQ ID NO: 169836 - DNA, 16 bp, H. sapiens
tttatgaattacccag

SEQ ID NO: 169837 - DNA, 16 bp, H. sapiens
tttatgaattaggcac

SEQ ID NO: 169838 - DNA, 16 bp, H. sapiens
tttatgaattcattca

SEQ ID NO: 169839 - DNA, 21 bp, H. sapiens
tttatgacaaacccacagcca

SEQ ID NO: 169840 - DNA, 16 bp, H. sapiens
tttatgacattaaaaa

SEQ ID NO: 169841 - DNA, 16 bp, H. sapiens
tttatgacctcattta

SEQ ID NO: 169842 - DNA, 16 bp, H. sapiens
tttatgactaaatagt

SEQ ID NO: 169843 - DNA, 16 bp, H. sapiens
tttatgactttttaaa

SEQ ID NO: 169844 - DNA, 16 bp, H. sapiens
tttatgagaaatattt

SEQ ID NO: 169845 - DNA, 16 bp, H. sapiens
tttatgagaattatgc

SEQ ID NO: 169846 - DNA, 16 bp, H. sapiens
tttatgagacagggtc

SEQ ID NO: 169847 - DNA, 16 bp, H. sapiens
tttatgagatggagtc

SEQ ID NO: 169848 - DNA, 16 bp, H. sapiens
tttatgataaaagatg

SEQ ID NO: 169849 - DNA, 16 bp, H. sapiens
tttatgatagaattat

SEQ ID NO: 169850 - DNA, 16 bp, H. sapiens
tttatgatgactgctt

SEQ ID NO: 169851 - DNA, 16 bp, H. sapiens
tttatgatgcagagac

SEQ ID NO: 169852 - DNA, 16 bp, H. sapiens
tttatgattatgaaat

SEQ ID NO: 169853 - DNA, 16 bp, H. sapiens
tttatgattccactta

SEQ ID NO: 169854 - DNA, 16 bp, H. sapiens
tttatgcaaataatca

SEQ ID NO: 169855 - DNA, 16 bp, H. sapiens
tttatgcaaatattct

SEQ ID NO: 169856 - DNA, 16 bp, H. sapiens
tttatgcagtgaatct

SEQ ID NO: 169857 - DNA, 16 bp, H. sapiens
tttatgcatatatgca

SEQ ID NO: 169858 - DNA, 16 bp, H. sapiens
tttatgcatattattt

SEQ ID NO: 169859 - DNA, 16 bp, H. sapiens
tttatgcattcatcca

SEQ ID NO: 169860 - DNA, 16 bp, H. sapiens
tttatgctaaaaaaaa

SEQ ID NO: 169861 - DNA, 16 bp, H. sapiens
tttatgctaagtttga

SEQ ID NO: 169862 - DNA, 16 bp, H. sapiens
tttatgctatctattt

SEQ ID NO: 169863 - DNA, 16 bp, H. sapiens
tttatgctgccaaaaa

SEQ ID NO: 169864 - DNA, 16 bp, H. sapiens
tttatgctgttaatct

SEQ ID NO: 169865 - DNA, 16 bp, H. sapiens
tttatgcttgcaaaaa

SEQ ID NO: 169866 - DNA, 16 bp, H. sapiens
tttatgcttttaaaaa

SEQ ID NO: 169867 - DNA, 16 bp, H. sapiens
tttatgcttttggtgt

SEQ ID NO: 169868 - DNA, 16 bp, H. sapiens
tttatgctttttaaaa

SEQ ID NO: 169869 - DNA, 16 bp, H. sapiens
tttatggaaaaaatat

SEQ ID NO: 169870 - DNA, 16 bp, H. sapiens
tttatggaaaacattt

SEQ ID NO: 169871 - DNA, 16 bp, H. sapiens
tttatggaaaaggaaa

SEQ ID NO: 169872 - DNA, 16 bp, H. sapiens
tttatggaatgctttt

SEQ ID NO: 169873 - DNA, 16 bp, H. sapiens
tttatggactcagaat

SEQ ID NO: 169874 - DNA, 16 bp, H. sapiens
tttatggactgaatgt

SEQ ID NO: 169875 - DNA, 16 bp, H. sapiens
tttatggaggattttt

SEQ ID NO: 169876 - DNA, 16 bp, H. sapiens
tttatggatgagcaaa

SEQ ID NO: 169877 - DNA, 16 bp, H. sapiens
tttatggatgaggaaa

SEQ ID NO: 169878 - DNA, 16 bp, H. sapiens
tttatggattgtgctt

SEQ ID NO: 169879 - DNA, 17 bp, H. sapiens
tttatggctcaaaccaa

SEQ ID NO: 169880 - DNA, 16 bp, H. sapiens
tttatgggcttcagaa

SEQ ID NO: 169881 - DNA, 16 bp, H. sapiens
tttatggggaaaaaaa

SEQ ID NO: 169882 - DNA, 16 bp, H. sapiens
tttatggttacttctt

SEQ ID NO: 169883 - DNA, 16 bp, H. sapiens
tttatggttttctagg

SEQ ID NO: 169884 - DNA, 16 bp, H. sapiens
tttatggttttctata

SEQ ID NO: 169885 - DNA, 16 bp, H. sapiens
tttatgtaaaaatgaa

SEQ ID NO: 169886 - DNA, 16 bp, H. sapiens
tttatgtaaaaatgta

SEQ ID NO: 169887 - DNA, 16 bp, H. sapiens
tttatgtaaaataaac

SEQ ID NO: 169888 - DNA, 16 bp, H. sapiens
tttatgtaaaatgtag

SEQ ID NO: 169889 - DNA, 16 bp, H. sapiens
tttatgtaaacataaa

SEQ ID NO: 169890 - DNA, 16 bp, H. sapiens
tttatgtaaagatatt

SEQ ID NO: 169891 - DNA, 16 bp, H. sapiens
tttatgtaaagtaaaa

SEQ ID NO: 169892 - DNA, 16 bp, H. sapiens
tttatgtaagggactt

SEQ ID NO: 169893 - DNA, 16 bp, H. sapiens
tttatgtacacacaca

SEQ ID NO: 169894 - DNA, 16 bp, H. sapiens
tttatgtacagatttt

SEQ ID NO: 169895 - DNA, 16 bp, H. sapiens
tttatgtacatgtttt

SEQ ID NO: 169896 - DNA, 16 bp, H. sapiens
tttatgtacattattt

SEQ ID NO: 169897 - DNA, 16 bp, H. sapiens
tttatgtactatacaa

SEQ ID NO: 169898 - DNA, 16 bp, H. sapiens
tttatgtatatatgtg

SEQ ID NO: 169899 - DNA, 16 bp, H. sapiens
tttatgtattcacaaa

SEQ ID NO: 169900 - DNA, 16 bp, H. sapiens
tttatgtattcattca

SEQ ID NO: 169901 - DNA, 16 bp, H. sapiens
tttatgtattctttaa

SEQ ID NO: 169902 - DNA, 16 bp, H. sapiens
tttatgtatttaatca

SEQ ID NO: 169903 - DNA, 16 bp, H. sapiens
tttatgtatttattca

SEQ ID NO: 169904 - DNA, 16 bp, H. sapiens
tttatgtccatgagta

SEQ ID NO: 169905 - DNA, 16 bp, H. sapiens
tttatgtccgtgtgta

SEQ ID NO: 169906 - DNA, 16 bp, H. sapiens
tttatgtctaaaacac

SEQ ID NO: 169907 - DNA, 23 bp, H. sapiens
tttatgtctagctaagggattgt

SEQ ID NO: 169908 - DNA, 16 bp, H. sapiens
tttatgtctatgttca

SEQ ID NO: 169909 - DNA, 16 bp, H. sapiens
tttatgtcttaaaaat

SEQ ID NO: 169910 - DNA, 16 bp, H. sapiens
tttatgtctttctcct

SEQ ID NO: 169911 - DNA, 16 bp, H. sapiens
tttatgtctttttaaa

SEQ ID NO: 169912 - DNA, 16 bp, H. sapiens
tttatgtgaaatcttt

SEQ ID NO: 169913 - DNA, 16 bp, H. sapiens
tttatgtgaacatata

SEQ ID NO: 169914 - DNA, 16 bp, H. sapiens
tttatgtgaagaaatt

SEQ ID NO: 169915 - DNA, 16 bp, H. sapiens
tttatgtgaatgtatt

SEQ ID NO: 169916 - DNA, 16 bp, H. sapiens
tttatgtgagagaaaa

SEQ ID NO: 169917 - DNA, 17 bp, H. sapiens
tttatgtgctgctggat

SEQ ID NO: 169918 - DNA, 16 bp, H. sapiens
tttatgtgtaaatata

SEQ ID NO: 169919 - DNA, 16 bp, H. sapiens
tttatgtgtgcatgtg

SEQ ID NO: 169920 - DNA, 20 bp, H. sapiens
tttatgtgtggcccaagaca

SEQ ID NO: 169921 - DNA, 16 bp, H. sapiens
tttatgtgtttattca

SEQ ID NO: 169922 - DNA, 16 bp, H. sapiens
tttatgttaacatgta

SEQ ID NO: 169923 - DNA, 16 bp, H. sapiens
tttatgttcataaatt

SEQ ID NO: 169924 - DNA, 16 bp, H. sapiens
tttatgtttaaaaaca

SEQ ID NO: 169925 - DNA, 16 bp, H. sapiens
tttatgtttacattta

SEQ ID NO: 169926 - DNA, 16 bp, H. sapiens
tttatgtttagataca

SEQ ID NO: 169927 - DNA, 16 bp, H. sapiens
tttatgtttatattca

SEQ ID NO: 169928 - DNA, 16 bp, H. sapiens
tttatgtttcaaatat

SEQ ID NO: 169929 - DNA, 16 bp, H. sapiens
tttatgtttccaggaa

SEQ ID NO: 169930 - DNA, 16 bp, H. sapiens
tttattaaaagcaaaa

SEQ ID NO: 169931 - DNA, 16 bp, H. sapiens
tttattaaaagcattt

SEQ ID NO: 169932 - DNA, 16 bp, H. sapiens
tttattaaaagctttt

SEQ ID NO: 169933 - DNA, 16 bp, H. sapiens
tttattaaagaaaagt

SEQ ID NO: 169934 - DNA, 16 bp, H. sapiens
tttattaaagaaactt

SEQ ID NO: 169935 - DNA, 16 bp, H. sapiens
tttattaaagacaggg

SEQ ID NO: 169936 - DNA, 16 bp, H. sapiens
tttattaaagacattt

SEQ ID NO: 169937 - DNA, 16 bp, H. sapiens
tttattaaagagacta

SEQ ID NO: 169938 - DNA, 16 bp, H. sapiens
tttattaaagagggaa

SEQ ID NO: 169939 - DNA, 16 bp, H. sapiens
tttattaaaggaaatt

SEQ ID NO: 169940 - DNA, 16 bp, H. sapiens
tttattaagattttct

SEQ ID NO: 169941 - DNA, 16 bp, H. sapiens
tttattaagcacttat

SEQ ID NO: 169942 - DNA, 16 bp, H. sapiens
tttattaagcattttc

SEQ ID NO: 169943 - DNA, 16 bp, H. sapiens
tttattaaggaatatt

SEQ ID NO: 169944 - DNA, 16 bp, H. sapiens
tttattaatgaagaaa

SEQ ID NO: 169945 - DNA, 16 bp, H. sapiens
tttattaatgattttc

SEQ ID NO: 169946 - DNA, 16 bp, H. sapiens
tttattaatgttttca

SEQ ID NO: 169947 - DNA, 16 bp, H. sapiens
tttattacagaaattt

SEQ ID NO: 169948 - DNA, 16 bp, H. sapiens
tttattacagtataat

SEQ ID NO: 169949 - DNA, 16 bp, H. sapiens
tttattacatttgaaa

SEQ ID NO: 169950 - DNA, 16 bp, H. sapiens
tttattactaattcaa

SEQ ID NO: 169951 - DNA, 16 bp, H. sapiens
tttattactcacagca

SEQ ID NO: 169952 - DNA, 16 bp, H. sapiens
tttattactgaagaaa

SEQ ID NO: 169953 - DNA, 16 bp, H. sapiens
tttattacttacagat

SEQ ID NO: 169954 - DNA, 16 bp, H. sapiens
tttattagcagcgtga

SEQ ID NO: 169955 - DNA, 16 bp, H. sapiens
tttattagttcccaaa

SEQ ID NO: 169956 - DNA, 16 bp, H. sapiens
tttattatataggtaa

SEQ ID NO: 169957 - DNA, 17 bp, H. sapiens
tttattatccccatttt

SEQ ID NO: 169958 - DNA, 16 bp, H. sapiens
tttattatgaaaacaa

SEQ ID NO: 169959 - DNA, 16 bp, H. sapiens
tttattatgcaggtgg

SEQ ID NO: 169960 - DNA, 16 bp, H. sapiens
tttattatgctttaag

SEQ ID NO: 169961 - DNA, 16 bp, H. sapiens
tttattatggaaaatt

SEQ ID NO: 169962 - DNA, 16 bp, H. sapiens
tttattatggatttca

SEQ ID NO: 169963 - DNA, 17 bp, H. sapiens
tttattattactcaaat

SEQ ID NO: 169964 - DNA, 16 bp, H. sapiens
tttattattcattaag

SEQ ID NO: 169965 - DNA, 16 bp, H. sapiens
tttattattgatacat

SEQ ID NO: 169966 - DNA, 16 bp, H. sapiens
tttattatttgctata

SEQ ID NO: 169967 - DNA, 16 bp, H. sapiens
tttattattttacagt

SEQ ID NO: 169968 - DNA, 16 bp, H. sapiens
tttattattttcaaag

SEQ ID NO: 169969 - DNA, 16 bp, H. sapiens
tttattcaaaagaaac

SEQ ID NO: 169970 - DNA, 16 bp, H. sapiens
tttattcaaaattcaa

SEQ ID NO: 169971 - DNA, 16 bp, H. sapiens
tttattcaaagaaaaa

SEQ ID NO: 169972 - DNA, 16 bp, H. sapiens
tttattcaaatgaaat

SEQ ID NO: 169973 - DNA, 16 bp, H. sapiens
tttattcaacaaaaat

SEQ ID NO: 169974 - DNA, 16 bp, H. sapiens
tttattcaagaaaatt

SEQ ID NO: 169975 - DNA, 16 bp, H. sapiens
tttattcaagaataaa

SEQ ID NO: 169976 - DNA, 16 bp, H. sapiens
tttattcaagactatt

SEQ ID NO: 169977 - DNA, 16 bp, H. sapiens
tttattcaaggtcaca

SEQ ID NO: 169978 - DNA, 16 bp, H. sapiens
tttattcagaattttt

SEQ ID NO: 169979 - DNA, 16 bp, H. sapiens
tttattcagcagcagc

SEQ ID NO: 169980 - DNA, 16 bp, H. sapiens
tttattcagtcatcca

SEQ ID NO: 169981 - DNA, 16 bp, H. sapiens
tttattcatccattca

SEQ ID NO: 169982 - DNA, 16 bp, H. sapiens
tttattcatctgcaaa

SEQ ID NO: 169983 - DNA, 16 bp, H. sapiens
tttattcatgataaaa

SEQ ID NO: 169984 - DNA, 16 bp, H. sapiens
tttattcatgttttca

SEQ ID NO: 169985 - DNA, 16 bp, H. sapiens
tttattcattcatcag

SEQ ID NO: 169986 - DNA, 16 bp, H. sapiens
tttattcattcatcca

SEQ ID NO: 169987 - DNA, 16 bp, H. sapiens
tttattcattcatgca

SEQ ID NO: 169988 - DNA, 16 bp, H. sapiens
tttattcatttgcata

SEQ ID NO: 169989 - DNA, 16 bp, H. sapiens
tttattcatttgtgta

SEQ ID NO: 169990 - DNA, 16 bp, H. sapiens
tttattccattgtatt

SEQ ID NO: 169991 - DNA, 16 bp, H. sapiens
tttattccatttgctt

SEQ ID NO: 169992 - DNA, 16 bp, H. sapiens
tttattcccaaatatt

SEQ ID NO: 169993 - DNA, 16 bp, H. sapiens
tttattcctaaatact

SEQ ID NO: 169994 - DNA, 16 bp, H. sapiens
tttattcctagtttat

SEQ ID NO: 169995 - DNA, 16 bp, H. sapiens
tttattcctatccata

SEQ ID NO: 169996 - DNA, 16 bp, H. sapiens
tttattcctttgcata

SEQ ID NO: 169997 - DNA, 16 bp, H. sapiens
tttattccttttcaaa

SEQ ID NO: 169998 - DNA, 16 bp, H. sapiens
tttattctaagaaaat

SEQ ID NO: 169999 - DNA, 16 bp, H. sapiens
tttattctagaaaata

SEQ ID NO: 170000 - DNA, 16 bp, H. sapiens
tttattctaggttttc

SEQ ID NO: 170001 - DNA, 16 bp, H. sapiens
tttattctcattggtt

SEQ ID NO: 170002 - DNA, 16 bp, H. sapiens
tttattctcccacagt

SEQ ID NO: 170003 - DNA, 16 bp, H. sapiens
tttattctctcatggt

SEQ ID NO: 170004 - DNA, 16 bp, H. sapiens
tttattctgaaatatt

SEQ ID NO: 170005 - DNA, 16 bp, H. sapiens
tttattctgagccaaa

SEQ ID NO: 170006 - DNA, 16 bp, H. sapiens
tttattctgctgttgt

SEQ ID NO: 170007 - DNA, 16 bp, H. sapiens
tttattctgttgctgg

SEQ ID NO: 170008 - DNA, 16 bp, H. sapiens
tttattctgtttaaaa

SEQ ID NO: 170009 - DNA, 16 bp, H. sapiens
tttattctgttttaca

SEQ ID NO: 170010 - DNA, 16 bp, H. sapiens
tttattctttcaccaa

SEQ ID NO: 170011 - DNA, 16 bp, H. sapiens
tttattctttcagaaa

SEQ ID NO: 170012 - DNA, 16 bp, H. sapiens
tttattctttcatatg

SEQ ID NO: 170013 - DNA, 16 bp, H. sapiens
tttattctttcccaaa

SEQ ID NO: 170014 - DNA, 16 bp, H. sapiens
tttattctttgaccca

SEQ ID NO: 170015 - DNA, 16 bp, H. sapiens
tttattctttggaaat

SEQ ID NO: 170016 - DNA, 16 bp, H. sapiens
tttattcttttacagt

SEQ ID NO: 170017 - DNA, 16 bp, H. sapiens
tttattgaaaaacatt

SEQ ID NO: 170018 - DNA, 16 bp, H. sapiens
tttattgaaaaccttt

SEQ ID NO: 170019 - DNA, 16 bp, H. sapiens
tttattgaaaaggaaa

SEQ ID NO: 170020 - DNA, 16 bp, H. sapiens
tttattgaaaataaca

SEQ ID NO: 170021 - DNA, 16 bp, H. sapiens
tttattgaaaatcaat

SEQ ID NO: 170022 - DNA, 16 bp, H. sapiens
tttattgaacacctac

SEQ ID NO: 170023 - DNA, 16 bp, H. sapiens
tttattgaacattttt

SEQ ID NO: 170024 - DNA, 16 bp, H. sapiens
tttattgaagaaatta

SEQ ID NO: 170025 - DNA, 16 bp, H. sapiens
tttattgaagacattt

SEQ ID NO: 170026 - DNA, 16 bp, H. sapiens
tttattgaatatggag

SEQ ID NO: 170027 - DNA, 16 bp, H. sapiens
tttattgaatctattt

SEQ ID NO: 170028 - DNA, 16 bp, H. sapiens
tttattgaatgcttat

SEQ ID NO: 170029 - DNA, 16 bp, H. sapiens
tttattgaattattac

SEQ ID NO: 170030 - DNA, 16 bp, H. sapiens
tttattgacacataat

SEQ ID NO: 170031 - DNA, 16 bp, H. sapiens
tttattgacatggaaa

SEQ ID NO: 170032 - DNA, 16 bp, H. sapiens
tttattgactcattta

SEQ ID NO: 170033 - DNA, 16 bp, H. sapiens
tttattgagacagagt

SEQ ID NO: 170034 - DNA, 16 bp, H. sapiens
tttattgagacggagt

SEQ ID NO: 170035 - DNA, 16 bp, H. sapiens
tttattgagcaaatat

SEQ ID NO: 170036 - DNA, 16 bp, H. sapiens
tttattgagcaactac

SEQ ID NO: 170037 - DNA, 16 bp, H. sapiens
tttattgagcacctac

SEQ ID NO: 170038 - DNA, 16 bp, H. sapiens
tttattgagcacctgc

SEQ ID NO: 170039 - DNA, 16 bp, H. sapiens
tttattgagcacttac

SEQ ID NO: 170040 - DNA, 16 bp, H. sapiens
tttattgagcatccac

SEQ ID NO: 170041 - DNA, 16 bp, H. sapiens
tttattgagcatttac

SEQ ID NO: 170042 - DNA, 16 bp, H. sapiens
tttattgaggaaaaat

SEQ ID NO: 170043 - DNA, 16 bp, H. sapiens
tttattgaggactttt

SEQ ID NO: 170044 - DNA, 16 bp, H. sapiens
tttattgaggtaaaat

SEQ ID NO: 170045 - DNA, 16 bp, H. sapiens
tttattgaggtatgat

SEQ ID NO: 170046 - DNA, 16 bp, H. sapiens
tttattgaggtgtaat

SEQ ID NO: 170047 - DNA, 16 bp, H. sapiens
tttattgagtattttc

SEQ ID NO: 170048 - DNA, 16 bp, H. sapiens
tttattgatgaagaaa

SEQ ID NO: 170049 - DNA, 16 bp, H. sapiens
tttattgatgttgatg

SEQ ID NO: 170050 - DNA, 17 bp, H. sapiens
tttattgatttgcatat

SEQ ID NO: 170051 - DNA, 16 bp, H. sapiens
tttattgatttgtgaa

SEQ ID NO: 170052 - DNA, 16 bp, H. sapiens
tttattgcacttcaca

SEQ ID NO: 170053 - DNA, 16 bp, H. sapiens
tttattgcactttgca

SEQ ID NO: 170054 - DNA, 16 bp, H. sapiens
tttattgcagaattat

SEQ ID NO: 170055 - DNA, 16 bp, H. sapiens
tttattgcagcatcat

SEQ ID NO: 170056 - DNA, 16 bp, H. sapiens
tttattgcagtcttca

SEQ ID NO: 170057 - DNA, 16 bp, H. sapiens
tttattgctattatta

SEQ ID NO: 170058 - DNA, 16 bp, H. sapiens
tttattgctgatgaaa

SEQ ID NO: 170059 - DNA, 16 bp, H. sapiens
tttattgctgctgtaa

SEQ ID NO: 170060 - DNA, 16 bp, H. sapiens
tttattgctttccatt

SEQ ID NO: 170061 - DNA, 16 bp, H. sapiens
tttattggaaaaaata

SEQ ID NO: 170062 - DNA, 16 bp, H. sapiens
tttattggatacaaag

SEQ ID NO: 170063 - DNA, 16 bp, H. sapiens
tttattggcacacagt

SEQ ID NO: 170064 - DNA, 16 bp, H. sapiens
tttattggctatttgt

SEQ ID NO: 170065 - DNA, 16 bp, H. sapiens
tttattgggaaaaaaa

SEQ ID NO: 170066 - DNA, 16 bp, H. sapiens
tttattgggatgtaac

SEQ ID NO: 170067 - DNA, 16 bp, H. sapiens
tttattgtagaaaatt

SEQ ID NO: 170068 - DNA, 16 bp, H. sapiens
tttattgtctatctcc

SEQ ID NO: 170069 - DNA, 16 bp, H. sapiens
tttattgtgatgttag

SEQ ID NO: 170070 - DNA, 16 bp, H. sapiens
tttattgtttctaaat

SEQ ID NO: 170071 - DNA, 16 bp, H. sapiens
tttatttaaagcattt

SEQ ID NO: 170072 - DNA, 16 bp, H. sapiens
tttatttaaatgaagt

SEQ ID NO: 170073 - DNA, 16 bp, H. sapiens
tttatttaagagacag

SEQ ID NO: 170074 - DNA, 16 bp, H. sapiens
tttatttaatagcttt

SEQ ID NO: 170075 - DNA, 16 bp, H. sapiens
tttatttaatgaatga

SEQ ID NO: 170076 - DNA, 16 bp, H. sapiens
tttatttacaaaagta

SEQ ID NO: 170077 - DNA, 16 bp, H. sapiens
tttatttacaaatatg

SEQ ID NO: 170078 - DNA, 16 bp, H. sapiens
tttatttactgaatta

SEQ ID NO: 170079 - DNA, 16 bp, H. sapiens
tttatttacttggtta

SEQ ID NO: 170080 - DNA, 16 bp, H. sapiens
tttatttacttttgga

SEQ ID NO: 170081 - DNA, 16 bp, H. sapiens
tttatttagaaaatgt

SEQ ID NO: 170082 - DNA, 16 bp, H. sapiens
tttatttagaaagaaa

SEQ ID NO: 170083 - DNA, 16 bp, H. sapiens
tttatttagaaatgga

SEQ ID NO: 170084 - DNA, 16 bp, H. sapiens
tttatttagcataatg

SEQ ID NO: 170085 - DNA, 16 bp, H. sapiens
tttatttagcatctac

SEQ ID NO: 170086 - DNA, 16 bp, H. sapiens
tttatttagccattca

SEQ ID NO: 170087 - DNA, 16 bp, H. sapiens
tttatttaggccttct

SEQ ID NO: 170088 - DNA, 16 bp, H. sapiens
tttatttagtagagac

SEQ ID NO: 170089 - DNA, 16 bp, H. sapiens
tttatttagtgttaga

SEQ ID NO: 170090 - DNA, 16 bp, H. sapiens
tttatttataagaaca

SEQ ID NO: 170091 - DNA, 16 bp, H. sapiens
tttatttataagcatt

SEQ ID NO: 170092 - DNA, 16 bp, H. sapiens
tttatttatagaaaca

SEQ ID NO: 170093 - DNA, 16 bp, H. sapiens
tttatttatccagttt

SEQ ID NO: 170094 - DNA, 16 bp, H. sapiens
tttatttatctgagaa

SEQ ID NO: 170095 - DNA, 16 bp, H. sapiens
tttatttatgagacag

SEQ ID NO: 170096 - DNA, 16 bp, H. sapiens
tttatttatgcattta

SEQ ID NO: 170097 - DNA, 16 bp, H. sapiens
tttatttattgaacaa

SEQ ID NO: 170098 - DNA, 16 bp, H. sapiens
tttatttattgagaaa

SEQ ID NO: 170099 - DNA, 16 bp, H. sapiens
tttatttatttgacag

SEQ ID NO: 170100 - DNA, 16 bp, H. sapiens
tttatttatttgctca

SEQ ID NO: 170101 - DNA, 16 bp, H. sapiens
tttatttatttgggtc

SEQ ID NO: 170102 - DNA, 16 bp, H. sapiens
tttatttattttacag

SEQ ID NO: 170103 - DNA, 16 bp, H. sapiens
tttatttcaaaaacaa

SEQ ID NO: 170104 - DNA, 16 bp, H. sapiens
tttatttcaaagaaaa

SEQ ID NO: 170105 - DNA, 16 bp, H. sapiens
tttatttcaaagaact

SEQ ID NO: 170106 - DNA, 16 bp, H. sapiens
tttatttcaaagaatt

SEQ ID NO: 170107 - DNA, 16 bp, H. sapiens
tttatttcaaatatca

SEQ ID NO: 170108 - DNA, 16 bp, H. sapiens
tttatttcaaattgtt

SEQ ID NO: 170109 - DNA, 16 bp, H. sapiens
tttatttcacacagtt

SEQ ID NO: 170110 - DNA, 16 bp, H. sapiens
tttatttcacctggat

SEQ ID NO: 170111 - DNA, 16 bp, H. sapiens
tttatttcagaaatgt

SEQ ID NO: 170112 - DNA, 16 bp, H. sapiens
tttatttcagcagtgt

SEQ ID NO: 170113 - DNA, 16 bp, H. sapiens
tttatttcagcattat

SEQ ID NO: 170114 - DNA, 16 bp, H. sapiens
tttatttcagttaaca

SEQ ID NO: 170115 - DNA, 16 bp, H. sapiens
tttatttcatacagtt

SEQ ID NO: 170116 - DNA, 16 bp, H. sapiens
tttatttcatatgctt

SEQ ID NO: 170117 - DNA, 16 bp, H. sapiens
tttatttcatcctcat

SEQ ID NO: 170118 - DNA, 16 bp, H. sapiens
tttatttcatgcattt

SEQ ID NO: 170119 - DNA, 16 bp, H. sapiens
tttatttccaagtttt

SEQ ID NO: 170120 - DNA, 16 bp, H. sapiens
tttatttccataaaat

SEQ ID NO: 170121 - DNA, 16 bp, H. sapiens
tttatttccatgtatt

SEQ ID NO: 170122 - DNA, 16 bp, H. sapiens
tttatttccattaaga

SEQ ID NO: 170123 - DNA, 16 bp, H. sapiens
tttatttccatttgca

SEQ ID NO: 170124 - DNA, 16 bp, H. sapiens
tttatttccatttgct

SEQ ID NO: 170125 - DNA, 16 bp, H. sapiens
tttatttcctttggaa

SEQ ID NO: 170126 - DNA, 16 bp, H. sapiens
tttatttctaaatgtt

SEQ ID NO: 170127 - DNA, 16 bp, H. sapiens
tttatttctaagctct

SEQ ID NO: 170128 - DNA, 16 bp, H. sapiens
tttatttctaattgag

SEQ ID NO: 170129 - DNA, 16 bp, H. sapiens
tttatttctataagaa

SEQ ID NO: 170130 - DNA, 16 bp, H. sapiens
tttatttctcaaaaaa

SEQ ID NO: 170131 - DNA, 16 bp, H. sapiens
tttatttctcaaagtt

SEQ ID NO: 170132 - DNA, 16 bp, H. sapiens
tttatttctcagaaaa

SEQ ID NO: 170133 - DNA, 16 bp, H. sapiens
tttatttctcagttct

SEQ ID NO: 170134 - DNA, 16 bp, H. sapiens
tttatttctccagaaa

SEQ ID NO: 170135 - DNA, 16 bp, H. sapiens
tttatttctctgtcat

SEQ ID NO: 170136 - DNA, 16 bp, H. sapiens
tttatttctcttgtaa

SEQ ID NO: 170137 - DNA, 16 bp, H. sapiens
tttatttctgaacttt

SEQ ID NO: 170138 - DNA, 16 bp, H. sapiens
tttatttctgaatatt

SEQ ID NO: 170139 - DNA, 16 bp, H. sapiens
tttatttctgcaattt

SEQ ID NO: 170140 - DNA, 16 bp, H. sapiens
tttatttctgcatatg

SEQ ID NO: 170141 - DNA, 16 bp, H. sapiens
tttatttctgccttta

SEQ ID NO: 170142 - DNA, 16 bp, H. sapiens
tttatttctgctctca

SEQ ID NO: 170143 - DNA, 16 bp, H. sapiens
tttatttctggaattt

SEQ ID NO: 170144 - DNA, 16 bp, H. sapiens
tttatttctgtaaaat

SEQ ID NO: 170145 - DNA, 16 bp, H. sapiens
tttatttctgtaactg

SEQ ID NO: 170146 - DNA, 16 bp, H. sapiens
tttatttctgtagaat

SEQ ID NO: 170147 - DNA, 16 bp, H. sapiens
tttatttctgtatctg

SEQ ID NO: 170148 - DNA, 16 bp, H. sapiens
tttatttctgtcagtt

SEQ ID NO: 170149 - DNA, 16 bp, H. sapiens
tttatttcttacagtt

SEQ ID NO: 170150 - DNA, 16 bp, H. sapiens
tttatttcttgaaaaa

SEQ ID NO: 170151 - DNA, 16 bp, H. sapiens
tttatttctttatgaa

SEQ ID NO: 170152 - DNA, 16 bp, H. sapiens
tttatttctttcacaa

SEQ ID NO: 170153 - DNA, 16 bp, H. sapiens
tttatttctttggaga

SEQ ID NO: 170154 - DNA, 16 bp, H. sapiens
tttatttgaaaagaaa

SEQ ID NO: 170155 - DNA, 16 bp, H. sapiens
tttatttgaaaatagt

SEQ ID NO: 170156 - DNA, 16 bp, H. sapiens
tttatttgaaacttct

SEQ ID NO: 170157 - DNA, 16 bp, H. sapiens
tttatttgaaatacaa

SEQ ID NO: 170158 - DNA, 16 bp, H. sapiens
tttatttgaaatcttt

SEQ ID NO: 170159 - DNA, 16 bp, H. sapiens
tttatttgaaattcag

SEQ ID NO: 170160 - DNA, 16 bp, H. sapiens
tttatttgaagaaaaa

SEQ ID NO: 170161 - DNA, 16 bp, H. sapiens
tttatttgaatcttct

SEQ ID NO: 170162 - DNA, 16 bp, H. sapiens
tttatttgagatgaag

SEQ ID NO: 170163 - DNA, 16 bp, H. sapiens
tttatttgagcaaaca

SEQ ID NO: 170164 - DNA, 16 bp, H. sapiens
tttatttgcagctatt

SEQ ID NO: 170165 - DNA, 16 bp, H. sapiens
tttatttgcatagagg

SEQ ID NO: 170166 - DNA, 16 bp, H. sapiens
tttatttgcatgaaaa

SEQ ID NO: 170167 - DNA, 16 bp, H. sapiens
tttatttgcatttcta

SEQ ID NO: 170168 - DNA, 16 bp, H. sapiens
tttatttggaaaaaaa

SEQ ID NO: 170169 - DNA, 16 bp, H. sapiens
tttatttggaaaagaa

SEQ ID NO: 170170 - DNA, 16 bp, H. sapiens
tttatttggagaaata

SEQ ID NO: 170171 - DNA, 16 bp, H. sapiens
tttatttggagagaaa

SEQ ID NO: 170172 - DNA, 16 bp, H. sapiens
tttatttggctcatga

SEQ ID NO: 170173 - DNA, 16 bp, H. sapiens
tttatttgggaagaaa

SEQ ID NO: 170174 - DNA, 16 bp, H. sapiens
tttatttgtatcatct

SEQ ID NO: 170175 - DNA, 16 bp, H. sapiens
tttatttgtcaataaa

SEQ ID NO: 170176 - DNA, 16 bp, H. sapiens
tttatttgtgaaggat

SEQ ID NO: 170177 - DNA, 16 bp, H. sapiens
tttatttgtggaaaaa

SEQ ID NO: 170178 - DNA, 16 bp, H. sapiens
tttatttgttcactta

SEQ ID NO: 170179 - DNA, 16 bp, H. sapiens
tttattttaaaaagca

SEQ ID NO: 170180 - DNA, 16 bp, H. sapiens
tttattttaaaagatg

SEQ ID NO: 170181 - DNA, 16 bp, H. sapiens
tttattttaaagaaag

SEQ ID NO: 170182 - DNA, 16 bp, H. sapiens
tttattttaaaggcaa

SEQ ID NO: 170183 - DNA, 16 bp, H. sapiens
tttattttaaagtcaa

SEQ ID NO: 170184 - DNA, 16 bp, H. sapiens
tttattttaaattctg

SEQ ID NO: 170185 - DNA, 16 bp, H. sapiens
tttattttaacaaatg

SEQ ID NO: 170186 - DNA, 16 bp, H. sapiens
tttattttaaggaact

SEQ ID NO: 170187 - DNA, 16 bp, H. sapiens
tttattttaatgttca

SEQ ID NO: 170188 - DNA, 16 bp, H. sapiens
tttattttaattgaca

SEQ ID NO: 170189 - DNA, 16 bp, H. sapiens
tttattttacaaaaga

SEQ ID NO: 170190 - DNA, 16 bp, H. sapiens
tttattttacactttg

SEQ ID NO: 170191 - DNA, 16 bp, H. sapiens
tttattttacagaaaa

SEQ ID NO: 170192 - DNA, 16 bp, H. sapiens
tttattttacatttag

SEQ ID NO: 170193 - DNA, 16 bp, H. sapiens
tttattttacttgaaa

SEQ ID NO: 170194 - DNA, 16 bp, H. sapiens
tttattttacttgaga

SEQ ID NO: 170195 - DNA, 16 bp, H. sapiens
tttattttagacaaaa

SEQ ID NO: 170196 - DNA, 16 bp, H. sapiens
tttattttaggaaaaa

SEQ ID NO: 170197 - DNA, 16 bp, H. sapiens
tttattttatgagaaa

SEQ ID NO: 170198 - DNA, 16 bp, H. sapiens
tttattttatttaagc

SEQ ID NO: 170199 - DNA, 16 bp, H. sapiens
tttattttcaaaattg

SEQ ID NO: 170200 - DNA, 16 bp, H. sapiens
tttattttcaaagcaa

SEQ ID NO: 170201 - DNA, 16 bp, H. sapiens
tttattttcaagaata

SEQ ID NO: 170202 - DNA, 16 bp, H. sapiens
tttattttcacagatt

SEQ ID NO: 170203 - DNA, 16 bp, H. sapiens
tttattttcacatgtt

SEQ ID NO: 170204 - DNA, 16 bp, H. sapiens
tttattttcagatact

SEQ ID NO: 170205 - DNA, 16 bp, H. sapiens
tttattttcaggattt

SEQ ID NO: 170206 - DNA, 16 bp, H. sapiens
tttattttcagtgctt

SEQ ID NO: 170207 - DNA, 16 bp, H. sapiens
tttattttcagtttca

SEQ ID NO: 170208 - DNA, 16 bp, H. sapiens
tttattttcataaatg

SEQ ID NO: 170209 - DNA, 16 bp, H. sapiens
tttattttcatagatt

SEQ ID NO: 170210 - DNA, 16 bp, H. sapiens
tttattttcattgcaa

SEQ ID NO: 170211 - DNA, 16 bp, H. sapiens
tttattttcatttgaa

SEQ ID NO: 170212 - DNA, 16 bp, H. sapiens
tttattttccatcaaa

SEQ ID NO: 170213 - DNA, 16 bp, H. sapiens
tttattttccatctgt

SEQ ID NO: 170214 - DNA, 16 bp, H. sapiens
tttattttccatgtat

SEQ ID NO: 170215 - DNA, 16 bp, H. sapiens
tttattttcccaaaca

SEQ ID NO: 170216 - DNA, 16 bp, H. sapiens
tttattttcccagaaa

SEQ ID NO: 170217 - DNA, 16 bp, H. sapiens
tttattttcctaatga

SEQ ID NO: 170218 - DNA, 16 bp, H. sapiens
tttattttctaatgca

SEQ ID NO: 170219 - DNA, 16 bp, H. sapiens
tttattttctagaaaa

SEQ ID NO: 170220 - DNA, 16 bp, H. sapiens
tttattttctctagaa

SEQ ID NO: 170221 - DNA, 16 bp, H. sapiens
tttattttctgtgtaa

SEQ ID NO: 170222 - DNA, 16 bp, H. sapiens
tttattttcttaatgg

SEQ ID NO: 170223 - DNA, 16 bp, H. sapiens
tttattttcttcccag

SEQ ID NO: 170224 - DNA, 16 bp, H. sapiens
tttattttcttgaaaa

SEQ ID NO: 170225 - DNA, 16 bp, H. sapiens
tttattttctttagag

SEQ ID NO: 170226 - DNA, 16 bp, H. sapiens
tttattttgaaaaatg

SEQ ID NO: 170227 - DNA, 16 bp, H. sapiens
tttattttgaaaagaa

SEQ ID NO: 170228 - DNA, 16 bp, H. sapiens
tttattttgaaatcag

SEQ ID NO: 170229 - DNA, 16 bp, H. sapiens
tttattttgagatgta

SEQ ID NO: 170230 - DNA, 16 bp, H. sapiens
tttattttgagcctat

SEQ ID NO: 170231 - DNA, 16 bp, H. sapiens
tttattttgagtctgt

SEQ ID NO: 170232 - DNA, 16 bp, H. sapiens
tttattttgatactca

SEQ ID NO: 170233 - DNA, 16 bp, H. sapiens
tttattttgcaaacaa

SEQ ID NO: 170234 - DNA, 16 bp, H. sapiens
tttattttgcaaagaa

SEQ ID NO: 170235 - DNA, 16 bp, H. sapiens
tttattttgcagaaaa

SEQ ID NO: 170236 - DNA, 16 bp, H. sapiens
tttattttgccaaaat

SEQ ID NO: 170237 - DNA, 16 bp, H. sapiens
tttattttgctgaaaa

SEQ ID NO: 170238 - DNA, 16 bp, H. sapiens
tttattttgctgcaca

SEQ ID NO: 170239 - DNA, 16 bp, H. sapiens
tttattttgctgtaca

SEQ ID NO: 170240 - DNA, 16 bp, H. sapiens
tttattttggaaaaaa

SEQ ID NO: 170241 - DNA, 16 bp, H. sapiens
tttattttgggaaagg

SEQ ID NO: 170242 - DNA, 16 bp, H. sapiens
tttattttggtaaatg

SEQ ID NO: 170243 - DNA, 16 bp, H. sapiens
tttattttgtaaaaac

SEQ ID NO: 170244 - DNA, 16 bp, H. sapiens
tttattttgtaatcaa

SEQ ID NO: 170245 - DNA, 16 bp, H. sapiens
tttattttgtgatgga

SEQ ID NO: 170246 - DNA, 16 bp, H. sapiens
tttattttgtgcctat

SEQ ID NO: 170247 - DNA, 16 bp, H. sapiens
tttatttttaaaacca

SEQ ID NO: 170248 - DNA, 16 bp, H. sapiens
tttatttttaaaagga

SEQ ID NO: 170249 - DNA, 16 bp, H. sapiens
tttatttttaaaggca

SEQ ID NO: 170250 - DNA, 16 bp, H. sapiens
tttatttttacaagaa

SEQ ID NO: 170251 - DNA, 16 bp, H. sapiens
tttatttttacagaaa

SEQ ID NO: 170252 - DNA, 16 bp, H. sapiens
tttatttttagcaatt

SEQ ID NO: 170253 - DNA, 16 bp, H. sapiens
tttatttttaggggaa

SEQ ID NO: 170254 - DNA, 16 bp, H. sapiens
tttatttttcaaatga

SEQ ID NO: 170255 - DNA, 16 bp, H. sapiens
tttatttttcacagtc

SEQ ID NO: 170256 - DNA, 16 bp, H. sapiens
tttatttttcagaaat

SEQ ID NO: 170257 - DNA, 16 bp, H. sapiens
tttatttttcagagtt

SEQ ID NO: 170258 - DNA, 16 bp, H. sapiens
tttatttttccaaaac

SEQ ID NO: 170259 - DNA, 16 bp, H. sapiens
tttatttttccagaaa

SEQ ID NO: 170260 - DNA, 16 bp, H. sapiens
tttatttttccagaga

SEQ ID NO: 170261 - DNA, 16 bp, H. sapiens
tttatttttccccaga

SEQ ID NO: 170262 - DNA, 16 bp, H. sapiens
tttatttttcctgaaa

SEQ ID NO: 170263 - DNA, 16 bp, H. sapiens
tttatttttctccaga

SEQ ID NO: 170264 - DNA, 16 bp, H. sapiens
tttatttttctggagt

SEQ ID NO: 170265 - DNA, 16 bp, H. sapiens
tttatttttcttggag

SEQ ID NO: 170266 - DNA, 16 bp, H. sapiens
tttatttttgaaatgg

SEQ ID NO: 170267 - DNA, 16 bp, H. sapiens
tttatttttgagagag

SEQ ID NO: 170268 - DNA, 16 bp, H. sapiens
tttatttttgatagag

SEQ ID NO: 170269 - DNA, 16 bp, H. sapiens
tttatttttgcaaaaa

SEQ ID NO: 170270 - DNA, 16 bp, H. sapiens
tttatttttgcatatg

SEQ ID NO: 170271 - DNA, 16 bp, H. sapiens
tttatttttgctaata

SEQ ID NO: 170272 - DNA, 16 bp, H. sapiens
tttatttttggaagaa

SEQ ID NO: 170273 - DNA, 16 bp, H. sapiens
tttatttttggagatg

SEQ ID NO: 170274 - DNA, 16 bp, H. sapiens
tttatttttgtacaga

SEQ ID NO: 170275 - DNA, 16 bp, H. sapiens
tttattttttaaactg

SEQ ID NO: 170276 - DNA, 16 bp, H. sapiens
tttattttttcaaaga

SEQ ID NO: 170277 - DNA, 16 bp, H. sapiens
tttattttttgaaaac

SEQ ID NO: 170278 - DNA, 16 bp, H. sapiens
tttattttttgagaca

SEQ ID NO: 170279 - DNA, 16 bp, H. sapiens
tttatttttttcagag

SEQ ID NO: 170280 - DNA, 16 bp, H. sapiens
tttatttttttcagca

SEQ ID NO: 170281 - DNA, 16 bp, H. sapiens
tttatttttttccaag

SEQ ID NO: 170282 - DNA, 16 bp, H. sapiens
tttatttttttcccag

SEQ ID NO: 170283 - DNA, 16 bp, H. sapiens
tttcaaaaaaacattt

SEQ ID NO: 170284 - DNA, 16 bp, H. sapiens
tttcaaaaaacatttt

SEQ ID NO: 170285 - DNA, 16 bp, H. sapiens
tttcaaaaaactattt

SEQ ID NO: 170286 - DNA, 16 bp, H. sapiens
tttcaaaaaaggaaaa

SEQ ID NO: 170287 - DNA, 16 bp, H. sapiens
tttcaaaaaatacatt

SEQ ID NO: 170288 - DNA, 16 bp, H. sapiens
tttcaaaaaattaatg

SEQ ID NO: 170289 - DNA, 16 bp, H. sapiens
tttcaaaaactatttt

SEQ ID NO: 170290 - DNA, 16 bp, H. sapiens
tttcaaaaactgaaaa

SEQ ID NO: 170291 - DNA, 16 bp, H. sapiens
tttcaaaaagaaaatt

SEQ ID NO: 170292 - DNA, 16 bp, H. sapiens
tttcaaaaagaaattt

SEQ ID NO: 170293 - DNA, 16 bp, H. sapiens
tttcaaaaagataaat

SEQ ID NO: 170294 - DNA, 16 bp, H. sapiens
tttcaaaaagcatttg

SEQ ID NO: 170295 - DNA, 16 bp, H. sapiens
tttcaaaaagtttaaa

SEQ ID NO: 170296 - DNA, 16 bp, H. sapiens
tttcaaaaataaatgt

SEQ ID NO: 170297 - DNA, 16 bp, H. sapiens
tttcaaaaatatggaa

SEQ ID NO: 170298 - DNA, 16 bp, H. sapiens
tttcaaaaatgagaaa

SEQ ID NO: 170299 - DNA, 16 bp, H. sapiens
tttcaaaaatgcattt

SEQ ID NO: 170300 - DNA, 16 bp, H. sapiens
tttcaaaaatggaaaa

SEQ ID NO: 170301 - DNA, 16 bp, H. sapiens
tttcaaaaatgttaat

SEQ ID NO: 170302 - DNA, 16 bp, H. sapiens
tttcaaaaatgttttg

SEQ ID NO: 170303 - DNA, 16 bp, H. sapiens
tttcaaaaattactag

SEQ ID NO: 170304 - DNA, 16 bp, H. sapiens
tttcaaaaattccaaa

SEQ ID NO: 170305 - DNA, 16 bp, H. sapiens
tttcaaaaatttgttt

SEQ ID NO: 170306 - DNA, 16 bp, H. sapiens
tttcaaaacaaaagca

SEQ ID NO: 170307 - DNA, 16 bp, H. sapiens
tttcaaaacaaatgaa

SEQ ID NO: 170308 - DNA, 16 bp, H. sapiens
tttcaaaacaactttt

SEQ ID NO: 170309 - DNA, 16 bp, H. sapiens
tttcaaaacaagaaaa

SEQ ID NO: 170310 - DNA, 16 bp, H. sapiens
tttcaaaacaatttat

SEQ ID NO: 170311 - DNA, 16 bp, H. sapiens
tttcaaaacacttttt

SEQ ID NO: 170312 - DNA, 16 bp, H. sapiens
tttcaaaacataattt

SEQ ID NO: 170313 - DNA, 16 bp, H. sapiens
tttcaaaacatttctt

SEQ ID NO: 170314 - DNA, 16 bp, H. sapiens
tttcaaaacattttta

SEQ ID NO: 170315 - DNA, 16 bp, H. sapiens
tttcaaaacatttttg

SEQ ID NO: 170316 - DNA, 16 bp, H. sapiens
tttcaaaaccaaaatt

SEQ ID NO: 170317 - DNA, 16 bp, H. sapiens
tttcaaaaccattttt

SEQ ID NO: 170318 - DNA, 16 bp, H. sapiens
tttcaaaactaaattt

SEQ ID NO: 170319 - DNA, 16 bp, H. sapiens
tttcaaaactgcccta

SEQ ID NO: 170320 - DNA, 16 bp, H. sapiens
tttcaaaactgctaaa

SEQ ID NO: 170321 - DNA, 16 bp, H. sapiens
tttcaaaactgctcta

SEQ ID NO: 170322 - DNA, 16 bp, H. sapiens
tttcaaaactggaaaa

SEQ ID NO: 170323 - DNA, 16 bp, H. sapiens
tttcaaaactggcaca

SEQ ID NO: 170324 - DNA, 16 bp, H. sapiens
tttcaaaacttctttt

SEQ ID NO: 170325 - DNA, 16 bp, H. sapiens
tttcaaaagaaaaagt

SEQ ID NO: 170326 - DNA, 16 bp, H. sapiens
tttcaaaagaaaatat

SEQ ID NO: 170327 - DNA, 16 bp, H. sapiens
tttcaaaagaaattta

SEQ ID NO: 170328 - DNA, 16 bp, H. sapiens
tttcaaaagaagactt

SEQ ID NO: 170329 - DNA, 16 bp, H. sapiens
tttcaaaagaagatgt

SEQ ID NO: 170330 - DNA, 16 bp, H. sapiens
tttcaaaagaaggcat

SEQ ID NO: 170331 - DNA, 16 bp, H. sapiens
tttcaaaagacataca

SEQ ID NO: 170332 - DNA, 16 bp, H. sapiens
tttcaaaagagaaaaa

SEQ ID NO: 170333 - DNA, 16 bp, H. sapiens
tttcaaaagatgaaaa

SEQ ID NO: 170334 - DNA, 16 bp, H. sapiens
tttcaaaagcaaaaca

SEQ ID NO: 170335 - DNA, 16 bp, H. sapiens
tttcaaaagcaattta

SEQ ID NO: 170336 - DNA, 16 bp, H. sapiens
tttcaaaagccaaaga

SEQ ID NO: 170337 - DNA, 16 bp, H. sapiens
tttcaaaaggaaagtt

SEQ ID NO: 170338 - DNA, 16 bp, H. sapiens
tttcaaaaggataaaa

SEQ ID NO: 170339 - DNA, 16 bp, H. sapiens
tttcaaaagggagaaa

SEQ ID NO: 170340 - DNA, 16 bp, H. sapiens
tttcaaaaggggaggg

SEQ ID NO: 170341 - DNA, 16 bp, H. sapiens
tttcaaaagttgtttt

SEQ ID NO: 170342 - DNA, 16 bp, H. sapiens
tttcaaaataaataag

SEQ ID NO: 170343 - DNA, 16 bp, H. sapiens
tttcaaaataacaagt

SEQ ID NO: 170344 - DNA, 16 bp, H. sapiens
tttcaaaataagcttt

SEQ ID NO: 170345 - DNA, 16 bp, H. sapiens
tttcaaaataatcttt

SEQ ID NO: 170346 - DNA, 16 bp, H. sapiens
tttcaaaataattttc

SEQ ID NO: 170347 - DNA, 16 bp, H. sapiens
tttcaaaatacatttg

SEQ ID NO: 170348 - DNA, 16 bp, H. sapiens
tttcaaaatatattac

SEQ ID NO: 170349 - DNA, 16 bp, H. sapiens
tttcaaaatatgtttt

SEQ ID NO: 170350 - DNA, 16 bp, H. sapiens
tttcaaaatattaatg

SEQ ID NO: 170351 - DNA, 16 bp, H. sapiens
tttcaaaatattactg

SEQ ID NO: 170352 - DNA, 16 bp, H. sapiens
tttcaaaatatttctg

SEQ ID NO: 170353 - DNA, 16 bp, H. sapiens
tttcaaaatattttca

SEQ ID NO: 170354 - DNA, 16 bp, H. sapiens
tttcaaaatcaagaaa

SEQ ID NO: 170355 - DNA, 16 bp, H. sapiens
tttcaaaatcagttta

SEQ ID NO: 170356 - DNA, 16 bp, H. sapiens
tttcaaaatcagtttt

SEQ ID NO: 170357 - DNA, 16 bp, H. sapiens
tttcaaaatgaaaatt

SEQ ID NO: 170358 - DNA, 16 bp, H. sapiens
tttcaaaatgaatttt

SEQ ID NO: 170359 - DNA, 16 bp, H. sapiens
tttcaaaatgcaatca

SEQ ID NO: 170360 - DNA, 16 bp, H. sapiens
tttcaaaatggaaatt

SEQ ID NO: 170361 - DNA, 16 bp, H. sapiens
tttcaaaatggcattt

SEQ ID NO: 170362 - DNA, 16 bp, H. sapiens
tttcaaaatgggaaaa

SEQ ID NO: 170363 - DNA, 16 bp, H. sapiens
tttcaaaatgtaaaaa

SEQ ID NO: 170364 - DNA, 16 bp, H. sapiens
tttcaaaatgtcatgt

SEQ ID NO: 170365 - DNA, 16 bp, H. sapiens
tttcaaaatgtggctt

SEQ ID NO: 170366 - DNA, 16 bp, H. sapiens
tttcaaaatgttataa

SEQ ID NO: 170367 - DNA, 16 bp, H. sapiens
tttcaaaatgttttca

SEQ ID NO: 170368 - DNA, 16 bp, H. sapiens
tttcaaaatgttttct

SEQ ID NO: 170369 - DNA, 16 bp, H. sapiens
tttcaaaattaaaagt

SEQ ID NO: 170370 - DNA, 16 bp, H. sapiens
tttcaaaattaacttt

SEQ ID NO: 170371 - DNA, 16 bp, H. sapiens
tttcaaaattaatcat

SEQ ID NO: 170372 - DNA, 16 bp, H. sapiens
tttcaaaattaggaaa

SEQ ID NO: 170373 - DNA, 16 bp, H. sapiens
tttcaaaattattttg

SEQ ID NO: 170374 - DNA, 16 bp, H. sapiens
tttcaaaattctcatt

SEQ ID NO: 170375 - DNA, 16 bp, H. sapiens
tttcaaaattgctaat

SEQ ID NO: 170376 - DNA, 16 bp, H. sapiens
tttcaaaatttacaaa

SEQ ID NO: 170377 - DNA, 16 bp, H. sapiens
tttcaaaatttcagaa

SEQ ID NO: 170378 - DNA, 16 bp, H. sapiens
tttcaaaattttcaaa

SEQ ID NO: 170379 - DNA, 16 bp, H. sapiens
tttcaaacaaaacaga

SEQ ID NO: 170380 - DNA, 16 bp, H. sapiens
tttcaaacacacaaaa

SEQ ID NO: 170381 - DNA, 16 bp, H. sapiens
tttcaaacactttttt

SEQ ID NO: 170382 - DNA, 16 bp, H. sapiens
tttcaaacatacaaaa

SEQ ID NO: 170383 - DNA, 16 bp, H. sapiens
tttcaaacatacacaa

SEQ ID NO: 170384 - DNA, 16 bp, H. sapiens
tttcaaacatatataa

SEQ ID NO: 170385 - DNA, 16 bp, H. sapiens
tttcaaacatatttta

SEQ ID NO: 170386 - DNA, 16 bp, H. sapiens
tttcaaacattattat

SEQ ID NO: 170387 - DNA, 16 bp, H. sapiens
tttcaaacatttcaaa

SEQ ID NO: 170388 - DNA, 16 bp, H. sapiens
tttcaaactattcatc

SEQ ID NO: 170389 - DNA, 16 bp, H. sapiens
tttcaaactcacagaa

SEQ ID NO: 170390 - DNA, 16 bp, H. sapiens
tttcaaactcccttct

SEQ ID NO: 170391 - DNA, 16 bp, H. sapiens
tttcaaactgatgtct

SEQ ID NO: 170392 - DNA, 16 bp, H. sapiens
tttcaaactggaaaaa

SEQ ID NO: 170393 - DNA, 16 bp, H. sapiens
tttcaaacttagagaa

SEQ ID NO: 170394 - DNA, 16 bp, H. sapiens
tttcaaactttaaaaa

SEQ ID NO: 170395 - DNA, 16 bp, H. sapiens
tttcaaactttgtttt

SEQ ID NO: 170396 - DNA, 16 bp, H. sapiens
tttcaaacttttccat

SEQ ID NO: 170397 - DNA, 16 bp, H. sapiens
tttcaaactttttgat

SEQ ID NO: 170398 - DNA, 16 bp, H. sapiens
tttcaaagaaaaagga

SEQ ID NO: 170399 - DNA, 16 bp, H. sapiens
tttcaaagaaaaataa

SEQ ID NO: 170400 - DNA, 16 bp, H. sapiens
tttcaaagaaaaatta

SEQ ID NO: 170401 - DNA, 16 bp, H. sapiens
tttcaaagaaaacaga

SEQ ID NO: 170402 - DNA, 16 bp, H. sapiens
tttcaaagaaaagaaa

SEQ ID NO: 170403 - DNA, 16 bp, H. sapiens
tttcaaagaaaataat

SEQ ID NO: 170404 - DNA, 16 bp, H. sapiens
tttcaaagaaagaatt

SEQ ID NO: 170405 - DNA, 16 bp, H. sapiens
tttcaaagaaatcttt

SEQ ID NO: 170406 - DNA, 16 bp, H. sapiens
tttcaaagaaattgaa

SEQ ID NO: 170407 - DNA, 16 bp, H. sapiens
tttcaaagaaatttca

SEQ ID NO: 170408 - DNA, 16 bp, H. sapiens
tttcaaagaacaaaaa

SEQ ID NO: 170409 - DNA, 16 bp, H. sapiens
tttcaaagaactattt

SEQ ID NO: 170410 - DNA, 16 bp, H. sapiens
tttcaaagaacttgtt

SEQ ID NO: 170411 - DNA, 16 bp, H. sapiens
tttcaaagaacttttt

SEQ ID NO: 170412 - DNA, 16 bp, H. sapiens
tttcaaagaatttctt

SEQ ID NO: 170413 - DNA, 16 bp, H. sapiens
tttcaaagataaaatt

SEQ ID NO: 170414 - DNA, 16 bp, H. sapiens
tttcaaagatttcttt

SEQ ID NO: 170415 - DNA, 16 bp, H. sapiens
tttcaaagcccattga

SEQ ID NO: 170416 - DNA, 16 bp, H. sapiens
tttcaaagcctcagtt

SEQ ID NO: 170417 - DNA, 16 bp, H. sapiens
tttcaaagcctttgca

SEQ ID NO: 170418 - DNA, 16 bp, H. sapiens
tttcaaaggaaaaatt

SEQ ID NO: 170419 - DNA, 16 bp, H. sapiens
tttcaaaggaaataaa

SEQ ID NO: 170420 - DNA, 16 bp, H. sapiens
tttcaaagggattgct

SEQ ID NO: 170421 - DNA, 16 bp, H. sapiens
tttcaaaggtagtttg

SEQ ID NO: 170422 - DNA, 16 bp, H. sapiens
tttcaaagtaaaatat

SEQ ID NO: 170423 - DNA, 16 bp, H. sapiens
tttcaaagtaatttca

SEQ ID NO: 170424 - DNA, 16 bp, H. sapiens
tttcaaagtatgtttc

SEQ ID NO: 170425 - DNA, 16 bp, H. sapiens
tttcaaagtgattttt

SEQ ID NO: 170426 - DNA, 16 bp, H. sapiens
tttcaaagttaatttt

SEQ ID NO: 170427 - DNA, 16 bp, H. sapiens
tttcaaagttactttc

SEQ ID NO: 170428 - DNA, 16 bp, H. sapiens
tttcaaagttcagttt

SEQ ID NO: 170429 - DNA, 16 bp, H. sapiens
tttcaaagtttgtttt

SEQ ID NO: 170430 - DNA, 16 bp, H. sapiens
tttcaaagttttcttt

SEQ ID NO: 170431 - DNA, 16 bp, H. sapiens
tttcaaataaaattct

SEQ ID NO: 170432 - DNA, 16 bp, H. sapiens
tttcaaataaatggaa

SEQ ID NO: 170433 - DNA, 16 bp, H. sapiens
tttcaaataagaaagt

SEQ ID NO: 170434 - DNA, 16 bp, H. sapiens
tttcaaataagaaata

SEQ ID NO: 170435 - DNA, 16 bp, H. sapiens
tttcaaataataaaag

SEQ ID NO: 170436 - DNA, 16 bp, H. sapiens
tttcaaataatacatt

SEQ ID NO: 170437 - DNA, 16 bp, H. sapiens
tttcaaataatgactt

SEQ ID NO: 170438 - DNA, 16 bp, H. sapiens
tttcaaatacaaacat

SEQ ID NO: 170439 - DNA, 16 bp, H. sapiens
tttcaaatacattttc

SEQ ID NO: 170440 - DNA, 16 bp, H. sapiens
tttcaaatactttctt

SEQ ID NO: 170441 - DNA, 16 bp, H. sapiens
tttcaaatatacagaa

SEQ ID NO: 170442 - DNA, 16 bp, H. sapiens
tttcaaatatcttctc

SEQ ID NO: 170443 - DNA, 16 bp, H. sapiens
tttcaaatattcagaa

SEQ ID NO: 170444 - DNA, 16 bp, H. sapiens
tttcaaatattctctt

SEQ ID NO: 170445 - DNA, 16 bp, H. sapiens
tttcaaatattttgaa

SEQ ID NO: 170446 - DNA, 16 bp, H. sapiens
tttcaaatatttttga

SEQ ID NO: 170447 - DNA, 16 bp, H. sapiens
tttcaaatattttttg

SEQ ID NO: 170448 - DNA, 16 bp, H. sapiens
tttcaaatctgtaatt

SEQ ID NO: 170449 - DNA, 16 bp, H. sapiens
tttcaaatgaagaaaa

SEQ ID NO: 170450 - DNA, 16 bp, H. sapiens
tttcaaatgaagaaat

SEQ ID NO: 170451 - DNA, 16 bp, H. sapiens
tttcaaatgaataaaa

SEQ ID NO: 170452 - DNA, 16 bp, H. sapiens
tttcaaatgcattttt

SEQ ID NO: 170453 - DNA, 16 bp, H. sapiens
tttcaaatgctttttt

SEQ ID NO: 170454 - DNA, 16 bp, H. sapiens
tttcaaatgtaaaaat

SEQ ID NO: 170455 - DNA, 16 bp, H. sapiens
tttcaaatgtacaaaa

SEQ ID NO: 170456 - DNA, 16 bp, H. sapiens
tttcaaatgttaattt

SEQ ID NO: 170457 - DNA, 16 bp, H. sapiens
tttcaaatgttttcaa

SEQ ID NO: 170458 - DNA, 16 bp, H. sapiens
tttcaaatgtttttct

SEQ ID NO: 170459 - DNA, 16 bp, H. sapiens
tttcaaattcattgat

SEQ ID NO: 170460 - DNA, 16 bp, H. sapiens
tttcaaattggctttt

SEQ ID NO: 170461 - DNA, 16 bp, H. sapiens
tttcaaatttctgttt

SEQ ID NO: 170462 - DNA, 16 bp, H. sapiens
tttcaaatttctttca

SEQ ID NO: 170463 - DNA, 16 bp, H. sapiens
tttcaaatttgaaatt

SEQ ID NO: 170464 - DNA, 16 bp, H. sapiens
tttcaaatttggaaaa

SEQ ID NO: 170465 - DNA, 16 bp, H. sapiens
tttcaaatttgggatg

SEQ ID NO: 170466 - DNA, 16 bp, H. sapiens
tttcaaattttacttg

SEQ ID NO: 170467 - DNA, 16 bp, H. sapiens
tttcaaattttttgaa

SEQ ID NO: 170468 - DNA, 16 bp, H. sapiens
tttcaacaaaagcaaa

SEQ ID NO: 170469 - DNA, 16 bp, H. sapiens
tttcaacaaaattgaa

SEQ ID NO: 170470 - DNA, 16 bp, H. sapiens
tttcaacaatatattt

SEQ ID NO: 170471 - DNA, 16 bp, H. sapiens
tttcaacacaggaatt

SEQ ID NO: 170472 - DNA, 16 bp, H. sapiens
tttcaacactgtgaga

SEQ ID NO: 170473 - DNA, 16 bp, H. sapiens
tttcaacactttaaaa

SEQ ID NO: 170474 - DNA, 16 bp, H. sapiens
tttcaacagcatgtgc

SEQ ID NO: 170475 - DNA, 16 bp, H. sapiens
tttcaacatagaaatt

SEQ ID NO: 170476 - DNA, 16 bp, H. sapiens
tttcaacatatgattt

SEQ ID NO: 170477 - DNA, 16 bp, H. sapiens
tttcaacatgaatatt

SEQ ID NO: 170478 - DNA, 16 bp, H. sapiens
tttcaacatgaatttt

SEQ ID NO: 170479 - DNA, 16 bp, H. sapiens
tttcaacatttgaaaa

SEQ ID NO: 170480 - DNA, 16 bp, H. sapiens
tttcaacattttaata

SEQ ID NO: 170481 - DNA, 16 bp, H. sapiens
tttcaaccaattgcca

SEQ ID NO: 170482 - DNA, 19 bp, H. sapiens
tttcaacccagaatttcat

SEQ ID NO: 170483 - DNA, 16 bp, H. sapiens
tttcaacccagatttt

SEQ ID NO: 170484 - DNA, 16 bp, H. sapiens
tttcaacctctgccca

SEQ ID NO: 170485 - DNA, 16 bp, H. sapiens
tttcaactcattgcat

SEQ ID NO: 170486 - DNA, 16 bp, H. sapiens
tttcaacttgagtttt

SEQ ID NO: 170487 - DNA, 16 bp, H. sapiens
tttcaactttaaaaaa

SEQ ID NO: 170488 - DNA, 16 bp, H. sapiens
tttcaactttttggaa

SEQ ID NO: 170489 - DNA, 16 bp, H. sapiens
tttcaagaaaaatatt

SEQ ID NO: 170490 - DNA, 16 bp, H. sapiens
tttcaagaaaagcaaa

SEQ ID NO: 170491 - DNA, 16 bp, H. sapiens
tttcaagaaaaggaaa

SEQ ID NO: 170492 - DNA, 16 bp, H. sapiens
tttcaagaaatggtgc

SEQ ID NO: 170493 - DNA, 16 bp, H. sapiens
tttcaagaaattttta

SEQ ID NO: 170494 - DNA, 16 bp, H. sapiens
tttcaagaatgtcata

SEQ ID NO: 170495 - DNA, 16 bp, H. sapiens
tttcaagaattatttt

SEQ ID NO: 170496 - DNA, 16 bp, H. sapiens
tttcaagacacagaca

SEQ ID NO: 170497 - DNA, 16 bp, H. sapiens
tttcaagaccagcctg

SEQ ID NO: 170498 - DNA, 16 bp, H. sapiens
tttcaagagaagctgg

SEQ ID NO: 170499 - DNA, 16 bp, H. sapiens
tttcaagataaacaat

SEQ ID NO: 170500 - DNA, 16 bp, H. sapiens
tttcaagataaattaa

SEQ ID NO: 170501 - DNA, 16 bp, H. sapiens
tttcaagattgttttt

SEQ ID NO: 170502 - DNA, 16 bp, H. sapiens
tttcaagcaaaaatta

SEQ ID NO: 170503 - DNA, 16 bp, H. sapiens
tttcaagcacaaaact

SEQ ID NO: 170504 - DNA, 16 bp, H. sapiens
tttcaagctatcaaca

SEQ ID NO: 170505 - DNA, 16 bp, H. sapiens
tttcaaggaaaaaaaa

SEQ ID NO: 170506 - DNA, 16 bp, H. sapiens
tttcaaggaaaaacat

SEQ ID NO: 170507 - DNA, 16 bp, H. sapiens
tttcaaggaatttgaa

SEQ ID NO: 170508 - DNA, 16 bp, H. sapiens
tttcaaggaatttttc

SEQ ID NO: 170509 - DNA, 16 bp, H. sapiens
tttcaaggtttttaag

SEQ ID NO: 170510 - DNA, 16 bp, H. sapiens
tttcaagtaaaatgaa

SEQ ID NO: 170511 - DNA, 16 bp, H. sapiens
tttcaagtcctctttt

SEQ ID NO: 170512 - DNA, 16 bp, H. sapiens
tttcaagtgctcatta

SEQ ID NO: 170513 - DNA, 16 bp, H. sapiens
tttcaagttaaatttt

SEQ ID NO: 170514 - DNA, 16 bp, H. sapiens
tttcaagtttaaaaaa

SEQ ID NO: 170515 - DNA, 16 bp, H. sapiens
tttcaagttttaaaac

SEQ ID NO: 170516 - DNA, 16 bp, H. sapiens
tttcaagttttgacaa

SEQ ID NO: 170517 - DNA, 16 bp, H. sapiens
tttcaataaaagttat

SEQ ID NO: 170518 - DNA, 16 bp, H. sapiens
tttcaataaaatccaa

SEQ ID NO: 170519 - DNA, 16 bp, H. sapiens
tttcaataaaattcaa

SEQ ID NO: 170520 - DNA, 16 bp, H. sapiens
tttcaataaaccagct

SEQ ID NO: 170521 - DNA, 16 bp, H. sapiens
tttcaataaactttct

SEQ ID NO: 170522 - DNA, 16 bp, H. sapiens
tttcaataaagctatt

SEQ ID NO: 170523 - DNA, 16 bp, H. sapiens
tttcaataaattcctt

SEQ ID NO: 170524 - DNA, 16 bp, H. sapiens
tttcaataacatttta

SEQ ID NO: 170525 - DNA, 16 bp, H. sapiens
tttcaataatagccat

SEQ ID NO: 170526 - DNA, 16 bp, H. sapiens
tttcaatagtttttga

SEQ ID NO: 170527 - DNA, 16 bp, H. sapiens
tttcaatataaaaagt

SEQ ID NO: 170528 - DNA, 16 bp, H. sapiens
tttcaatataattgat

SEQ ID NO: 170529 - DNA, 16 bp, H. sapiens
tttcaatatgattttt

SEQ ID NO: 170530 - DNA, 16 bp, H. sapiens
tttcaatattgttttg

SEQ ID NO: 170531 - DNA, 16 bp, H. sapiens
tttcaatatttgaaaa

SEQ ID NO: 170532 - DNA, 16 bp, H. sapiens
tttcaatattttgtta

SEQ ID NO: 170533 - DNA, 16 bp, H. sapiens
tttcaatccctccctt

SEQ ID NO: 170534 - DNA, 16 bp, H. sapiens
tttcaatctcactgct

SEQ ID NO: 170535 - DNA, 16 bp, H. sapiens
tttcaatctcttgacc

SEQ ID NO: 170536 - DNA, 16 bp, H. sapiens
tttcaatctctttgtt

SEQ ID NO: 170537 - DNA, 16 bp, H. sapiens
tttcaatgacattttt

SEQ ID NO: 170538 - DNA, 16 bp, H. sapiens
tttcaatggaaatttt

SEQ ID NO: 170539 - DNA, 16 bp, H. sapiens
tttcaattcatttaaa

SEQ ID NO: 170540 - DNA, 16 bp, H. sapiens
tttcaattctgtcagt

SEQ ID NO: 170541 - DNA, 16 bp, H. sapiens
tttcaattctgtgaag

SEQ ID NO: 170542 - DNA, 16 bp, H. sapiens
tttcaatttaaaaaga

SEQ ID NO: 170543 - DNA, 16 bp, H. sapiens
tttcaatttactttcc

SEQ ID NO: 170544 - DNA, 16 bp, H. sapiens
tttcaatttatgaatt

SEQ ID NO: 170545 - DNA, 16 bp, H. sapiens
tttcaatttcctcatc

SEQ ID NO: 170546 - DNA, 16 bp, H. sapiens
tttcaatttctccata

SEQ ID NO: 170547 - DNA, 16 bp, H. sapiens
tttcaatttggaaaaa

SEQ ID NO: 170548 - DNA, 16 bp, H. sapiens
tttcaattttaagaaa

SEQ ID NO: 170549 - DNA, 16 bp, H. sapiens
tttcaattttcatttg

SEQ ID NO: 170550 - DNA, 16 bp, H. sapiens
tttcaattttctacat

SEQ ID NO: 170551 - DNA, 16 bp, H. sapiens
tttcaattttcttaag

SEQ ID NO: 170552 - DNA, 16 bp, H. sapiens
tttcaatttttgaaat

SEQ ID NO: 170553 - DNA, 16 bp, H. sapiens
tttcacaaaaatgaaa

SEQ ID NO: 170554 - DNA, 16 bp, H. sapiens
tttcacaaagtgaaca

SEQ ID NO: 170555 - DNA, 16 bp, H. sapiens
tttcacaaatcaccac

SEQ ID NO: 170556 - DNA, 16 bp, H. sapiens
tttcacaaatggaaaa

SEQ ID NO: 170557 - DNA, 16 bp, H. sapiens
tttcacaacaacccta

SEQ ID NO: 170558 - DNA, 16 bp, H. sapiens
tttcacaattttaaaa

SEQ ID NO: 170559 - DNA, 16 bp, H. sapiens
tttcacacacaaaaaa

SEQ ID NO: 170560 - DNA, 16 bp, H. sapiens
tttcacaccagcctgg

SEQ ID NO: 170561 - DNA, 16 bp, H. sapiens
tttcacactgaaaatc

SEQ ID NO: 170562 - DNA, 16 bp, H. sapiens
tttcacagaaaaaaaa

SEQ ID NO: 170563 - DNA, 16 bp, H. sapiens
tttcacagaagaagaa

SEQ ID NO: 170564 - DNA, 16 bp, H. sapiens
tttcacagaatcagaa

SEQ ID NO: 170565 - DNA, 16 bp, H. sapiens
tttcacagaattagaa

SEQ ID NO: 170566 - DNA, 16 bp, H. sapiens
tttcacagagaagaaa

SEQ ID NO: 170567 - DNA, 16 bp, H. sapiens
tttcacagaggaggaa

SEQ ID NO: 170568 - DNA, 16 bp, H. sapiens
tttcacagagttaaaa

SEQ ID NO: 170569 - DNA, 16 bp, H. sapiens
tttcacagagttgaac

SEQ ID NO: 170570 - DNA, 16 bp, H. sapiens
tttcacagataaggaa

SEQ ID NO: 170571 - DNA, 16 bp, H. sapiens
tttcacagatggagaa

SEQ ID NO: 170572 - DNA, 16 bp, H. sapiens
tttcacagattttttt

SEQ ID NO: 170573 - DNA, 16 bp, H. sapiens
tttcacagcaaaggaa

SEQ ID NO: 170574 - DNA, 16 bp, H. sapiens
tttcacaggtgaggaa

SEQ ID NO: 170575 - DNA, 16 bp, H. sapiens
tttcacatcaccaaga

SEQ ID NO: 170576 - DNA, 16 bp, H. sapiens
tttcacatcttacatt

SEQ ID NO: 170577 - DNA, 16 bp, H. sapiens
tttcacatgctttttg

SEQ ID NO: 170578 - DNA, 16 bp, H. sapiens
tttcacatggaagagg

SEQ ID NO: 170579 - DNA, 16 bp, H. sapiens
tttcacatttataaat

SEQ ID NO: 170580 - DNA, 16 bp, H. sapiens
tttcacatttgaaaat

SEQ ID NO: 170581 - DNA, 16 bp, H. sapiens
tttcacatttttaaaa

SEQ ID NO: 170582 - DNA, 16 bp, H. sapiens
tttcaccaagatggcc

SEQ ID NO: 170583 - DNA, 16 bp, H. sapiens
tttcaccaataccaca

SEQ ID NO: 170584 - DNA, 16 bp, H. sapiens
tttcaccaccctaaaa

SEQ ID NO: 170585 - DNA, 18 bp, H. sapiens
tttcaccacgttggccac

SEQ ID NO: 170586 - DNA, 16 bp, H. sapiens
tttcaccaggctggcc

SEQ ID NO: 170587 - DNA, 16 bp, H. sapiens
tttcaccagtgtttta

SEQ ID NO: 170588 - DNA, 16 bp, H. sapiens
tttcaccagtttttaa

SEQ ID NO: 170589 - DNA, 21 bp, H. sapiens
tttcaccatgatggccaggct

SEQ ID NO: 170590 - DNA, 16 bp, H. sapiens
tttcaccatgctggtc

SEQ ID NO: 170591 - DNA, 16 bp, H. sapiens
tttcaccatgttaatc

SEQ ID NO: 170592 - DNA, 17 bp, H. sapiens
tttcaccatgttaccca

SEQ ID NO: 170593 - DNA, 19 bp, H. sapiens
tttcaccatgttagccaga

SEQ ID NO: 170594 - DNA, 24 bp, H. sapiens
tttcaccatgttagccaggatagt

SEQ ID NO: 170595 - DNA, 18 bp, H. sapiens
tttcaccatgttgaccaa

SEQ ID NO: 170596 - DNA, 16 bp, H. sapiens
tttcaccatgttgcca

SEQ ID NO: 170597 - DNA, 16 bp, H. sapiens
tttcaccatgttgcct

SEQ ID NO: 170598 - DNA, 16 bp, H. sapiens
tttcaccatgttgctt

SEQ ID NO: 170599 - DNA, 18 bp, H. sapiens
tttcaccatgttggccaa

SEQ ID NO: 170600 - DNA, 18 bp, H. sapiens
tttcaccatgttggccac

SEQ ID NO: 170601 - DNA, 20 bp, H. sapiens
tttcaccatgttggccagca

SEQ ID NO: 170602 - DNA, 21 bp, H. sapiens
tttcaccatgttggccaggac

SEQ ID NO: 170603 - DNA, 23 bp, H. sapiens
tttcaccatgttggccaggatga

SEQ ID NO: 170604 - DNA, 21 bp, H. sapiens
tttcaccatgttggccaggca

SEQ ID NO: 170605 - DNA, 22 bp, H. sapiens
tttcaccatgttggccaggcta

SEQ ID NO: 170606 - DNA, 23 bp, H. sapiens
tttcaccatgttggccaggctgc

SEQ ID NO: 170607 - DNA, 25 bp, H. sapiens
tttcaccatgttggccaggctggtt

SEQ ID NO: 170608 - DNA, 17 bp, H. sapiens
tttcaccatgttggcct

SEQ ID NO: 170609 - DNA, 24 bp, H. sapiens
tttcaccatgttggtcaggctggc

SEQ ID NO: 170610 - DNA, 16 bp, H. sapiens
tttcaccatgtttcct

SEQ ID NO: 170611 - DNA, 16 bp, H. sapiens
tttcaccattcttcca

SEQ ID NO: 170612 - DNA, 16 bp, H. sapiens
tttcaccattgaatat

SEQ ID NO: 170613 - DNA, 16 bp, H. sapiens
tttcaccatttagtat

SEQ ID NO: 170614 - DNA, 17 bp, H. sapiens
tttcaccattttgccca

SEQ ID NO: 170615 - DNA, 24 bp, H. sapiens
tttcaccattttggccaggctggt

SEQ ID NO: 170616 - DNA, 16 bp, H. sapiens
tttcacccagcataat

SEQ ID NO: 170617 - DNA, 16 bp, H. sapiens
tttcaccccctgctcc

SEQ ID NO: 170618 - DNA, 16 bp, H. sapiens
tttcacccctggcccc

SEQ ID NO: 170619 - DNA, 18 bp, H. sapiens
tttcaccctgttagccag

SEQ ID NO: 170620 - DNA, 17 bp, H. sapiens
tttcaccgcattagcca

SEQ ID NO: 170621 - DNA, 16 bp, H. sapiens
tttcaccgtgttgccc

SEQ ID NO: 170622 - DNA, 16 bp, H. sapiens
tttcacctatcagatt

SEQ ID NO: 170623 - DNA, 16 bp, H. sapiens
tttcacctattttaca

SEQ ID NO: 170624 - DNA, 16 bp, H. sapiens
tttcaccttagcattt

SEQ ID NO: 170625 - DNA, 16 bp, H. sapiens
tttcaccttcagccat

SEQ ID NO: 170626 - DNA, 16 bp, H. sapiens
tttcaccttttaaaaa

SEQ ID NO: 170627 - DNA, 16 bp, H. sapiens
tttcactaaaattaaa

SEQ ID NO: 170628 - DNA, 16 bp, H. sapiens
tttcactaattttgct

SEQ ID NO: 170629 - DNA, 17 bp, H. sapiens
tttcactatgttgacca

SEQ ID NO: 170630 - DNA, 16 bp, H. sapiens
tttcactatgttgctc

SEQ ID NO: 170631 - DNA, 16 bp, H. sapiens
tttcactctgtgtccc

SEQ ID NO: 170632 - DNA, 22 bp, H. sapiens
tttcactcttgttgcccaggct

SEQ ID NO: 170633 - DNA, 16 bp, H. sapiens
tttcactgaattttct

SEQ ID NO: 170634 - DNA, 16 bp, H. sapiens
tttcactgatttattt

SEQ ID NO: 170635 - DNA, 16 bp, H. sapiens
tttcactgccctaaaa

SEQ ID NO: 170636 - DNA, 16 bp, H. sapiens
tttcactgccttaaaa

SEQ ID NO: 170637 - DNA, 16 bp, H. sapiens
tttcactgtatataaa

SEQ ID NO: 170638 - DNA, 16 bp, H. sapiens
tttcactgtattttat

SEQ ID NO: 170639 - DNA, 16 bp, H. sapiens
tttcactgtctcagtt

SEQ ID NO: 170640 - DNA, 19 bp, H. sapiens
tttcactgtgttagccagc

SEQ ID NO: 170641 - DNA, 16 bp, H. sapiens
tttcactgttggtggg

SEQ ID NO: 170642 - DNA, 16 bp, H. sapiens
tttcacttaaaattat

SEQ ID NO: 170643 - DNA, 16 bp, H. sapiens
tttcacttaacattgt

SEQ ID NO: 170644 - DNA, 16 bp, H. sapiens
tttcacttaataatat

SEQ ID NO: 170645 - DNA, 16 bp, H. sapiens
tttcacttaataatgt

SEQ ID NO: 170646 - DNA, 16 bp, H. sapiens
tttcacttaatcctca

SEQ ID NO: 170647 - DNA, 16 bp, H. sapiens
tttcacttacataaaa

SEQ ID NO: 170648 - DNA, 16 bp, H. sapiens
tttcacttaggataat

SEQ ID NO: 170649 - DNA, 16 bp, H. sapiens
tttcacttctgatttt

SEQ ID NO: 170650 - DNA, 16 bp, H. sapiens
tttcacttcttcagtt

SEQ ID NO: 170651 - DNA, 16 bp, H. sapiens
tttcacttcttttaaa

SEQ ID NO: 170652 - DNA, 16 bp, H. sapiens
tttcacttgaacactt

SEQ ID NO: 170653 - DNA, 16 bp, H. sapiens
tttcacttggcataat

SEQ ID NO: 170654 - DNA, 16 bp, H. sapiens
tttcactttaaaaaaa

SEQ ID NO: 170655 - DNA, 16 bp, H. sapiens
tttcactttcaaatat

SEQ ID NO: 170656 - DNA, 16 bp, H. sapiens
tttcactttcatttag

SEQ ID NO: 170657 - DNA, 16 bp, H. sapiens
tttcactttccttttg

SEQ ID NO: 170658 - DNA, 16 bp, H. sapiens
tttcacttttaaaatg

SEQ ID NO: 170659 - DNA, 16 bp, H. sapiens
tttcacttttcttaaa

SEQ ID NO: 170660 - DNA, 16 bp, H. sapiens
tttcactttttaaaaa

SEQ ID NO: 170661 - DNA, 16 bp, H. sapiens
tttcactttttgaaaa

SEQ ID NO: 170662 - DNA, 16 bp, H. sapiens
tttcagaaaaaaaaat

SEQ ID NO: 170663 - DNA, 16 bp, H. sapiens
tttcagaaaaaagaaa

SEQ ID NO: 170664 - DNA, 16 bp, H. sapiens
tttcagaaaaacaaat

SEQ ID NO: 170665 - DNA, 16 bp, H. sapiens
tttcagaaaaaggaaa

SEQ ID NO: 170666 - DNA, 16 bp, H. sapiens
tttcagaaaacagaaa

SEQ ID NO: 170667 - DNA, 16 bp, H. sapiens
tttcagaaaaggaaaa

SEQ ID NO: 170668 - DNA, 16 bp, H. sapiens
tttcagaaaagtaaat

SEQ ID NO: 170669 - DNA, 16 bp, H. sapiens
tttcagaaaataaaga

SEQ ID NO: 170670 - DNA, 16 bp, H. sapiens
tttcagaaaatatatg

SEQ ID NO: 170671 - DNA, 16 bp, H. sapiens
tttcagaaaatgaaaa

SEQ ID NO: 170672 - DNA, 16 bp, H. sapiens
tttcagaaaatggaaa

SEQ ID NO: 170673 - DNA, 16 bp, H. sapiens
tttcagaaaatgtatg

SEQ ID NO: 170674 - DNA, 16 bp, H. sapiens
tttcagaaaatgtttt

SEQ ID NO: 170675 - DNA, 16 bp, H. sapiens
tttcagaaacattttt

SEQ ID NO: 170676 - DNA, 16 bp, H. sapiens
tttcagaaactttcca

SEQ ID NO: 170677 - DNA, 16 bp, H. sapiens
tttcagaaagaaatat

SEQ ID NO: 170678 - DNA, 16 bp, H. sapiens
tttcagaaagaaggaa

SEQ ID NO: 170679 - DNA, 16 bp, H. sapiens
tttcagaaagaataaa

SEQ ID NO: 170680 - DNA, 16 bp, H. sapiens
tttcagaaagagaaaa

SEQ ID NO: 170681 - DNA, 16 bp, H. sapiens
tttcagaaataaaaaa

SEQ ID NO: 170682 - DNA, 16 bp, H. sapiens
tttcagaaataaaaag

SEQ ID NO: 170683 - DNA, 16 bp, H. sapiens
tttcagaaatacagaa

SEQ ID NO: 170684 - DNA, 16 bp, H. sapiens
tttcagaaatagaatt

SEQ ID NO: 170685 - DNA, 16 bp, H. sapiens
tttcagaaatataaat

SEQ ID NO: 170686 - DNA, 16 bp, H. sapiens
tttcagaaatatttct

SEQ ID NO: 170687 - DNA, 16 bp, H. sapiens
tttcagaaatgttaaa

SEQ ID NO: 170688 - DNA, 16 bp, H. sapiens
tttcagaaattatttt

SEQ ID NO: 170689 - DNA, 16 bp, H. sapiens
tttcagaaattcaaaa

SEQ ID NO: 170690 - DNA, 16 bp, H. sapiens
tttcagaaattgaaaa

SEQ ID NO: 170691 - DNA, 16 bp, H. sapiens
tttcagaaattttgca

SEQ ID NO: 170692 - DNA, 16 bp, H. sapiens
tttcagaactctcatg

SEQ ID NO: 170693 - DNA, 16 bp, H. sapiens
tttcagaactttttca

SEQ ID NO: 170694 - DNA, 16 bp, H. sapiens
tttcagaagaaaaaat

SEQ ID NO: 170695 - DNA, 16 bp, H. sapiens
tttcagaagaaaataa

SEQ ID NO: 170696 - DNA, 16 bp, H. sapiens
tttcagaagaaatgtt

SEQ ID NO: 170697 - DNA, 16 bp, H. sapiens
tttcagaagagaaaaa

SEQ ID NO: 170698 - DNA, 16 bp, H. sapiens
tttcagaaggagtctc

SEQ ID NO: 170699 - DNA, 17 bp, H. sapiens
tttcagaaggagtggta

SEQ ID NO: 170700 - DNA, 16 bp, H. sapiens
tttcagaataaaaaat

SEQ ID NO: 170701 - DNA, 16 bp, H. sapiens
tttcagaataaaatta

SEQ ID NO: 170702 - DNA, 16 bp, H. sapiens
tttcagaataaatatt

SEQ ID NO: 170703 - DNA, 16 bp, H. sapiens
tttcagaataattatt

SEQ ID NO: 170704 - DNA, 16 bp, H. sapiens
tttcagaatatttcat

SEQ ID NO: 170705 - DNA, 16 bp, H. sapiens
tttcagaatattttca

SEQ ID NO: 170706 - DNA, 16 bp, H. sapiens
tttcagaatcatttta

SEQ ID NO: 170707 - DNA, 16 bp, H. sapiens
tttcagaattaaaaat

SEQ ID NO: 170708 - DNA, 16 bp, H. sapiens
tttcagaattaaatga

SEQ ID NO: 170709 - DNA, 16 bp, H. sapiens
tttcagaattataaaa

SEQ ID NO: 170710 - DNA, 16 bp, H. sapiens
tttcagaatttaaaaa

SEQ ID NO: 170711 - DNA, 16 bp, H. sapiens
tttcagaatttgaaat

SEQ ID NO: 170712 - DNA, 16 bp, H. sapiens
tttcagacaaaataga

SEQ ID NO: 170713 - DNA, 16 bp, H. sapiens
tttcagacaaatgctg

SEQ ID NO: 170714 - DNA, 16 bp, H. sapiens
tttcagacagaaaaaa

SEQ ID NO: 170715 - DNA, 16 bp, H. sapiens
tttcagacatgcatgg

SEQ ID NO: 170716 - DNA, 16 bp, H. sapiens
tttcagacatttattt

SEQ ID NO: 170717 - DNA, 16 bp, H. sapiens
tttcagaccctgcact

SEQ ID NO: 170718 - DNA, 24 bp, H. sapiens
tttcagactatcacatggggagaa

SEQ ID NO: 170719 - DNA, 37 bp, H. sapiens
tttcagactatcacatggggagaaaccttggacaata

SEQ ID NO: 170720 - DNA, 16 bp, H. sapiens
tttcagactcagccca

SEQ ID NO: 170721 - DNA, 16 bp, H. sapiens
tttcagactcctgggc

SEQ ID NO: 170722 - DNA, 16 bp, H. sapiens
tttcagactgacccca

SEQ ID NO: 170723 - DNA, 16 bp, H. sapiens
tttcagactttggaat

SEQ ID NO: 170724 - DNA, 16 bp, H. sapiens
tttcagagaaaaaaaa

SEQ ID NO: 170725 - DNA, 16 bp, H. sapiens
tttcagagaagaaaag

SEQ ID NO: 170726 - DNA, 16 bp, H. sapiens
tttcagagaatagaaa

SEQ ID NO: 170727 - DNA, 16 bp, H. sapiens
tttcagagacaaggtc

SEQ ID NO: 170728 - DNA, 16 bp, H. sapiens
tttcagagagagaatt

SEQ ID NO: 170729 - DNA, 16 bp, H. sapiens
tttcagagagagagag

SEQ ID NO: 170730 - DNA, 16 bp, H. sapiens
tttcagagataaaaat

SEQ ID NO: 170731 - DNA, 16 bp, H. sapiens
tttcagagatgaggaa

SEQ ID NO: 170732 - DNA, 16 bp, H. sapiens
tttcagagatgtcctg

SEQ ID NO: 170733 - DNA, 16 bp, H. sapiens
tttcagagattaaaaa

SEQ ID NO: 170734 - DNA, 16 bp, H. sapiens
tttcagagcagcctgg

SEQ ID NO: 170735 - DNA, 16 bp, H. sapiens
tttcagaggaaagaaa

SEQ ID NO: 170736 - DNA, 16 bp, H. sapiens
tttcagaggaaggatc

SEQ ID NO: 170737 - DNA, 16 bp, H. sapiens
tttcagaggggaaaaa

SEQ ID NO: 170738 - DNA, 16 bp, H. sapiens
tttcagagtcttctta

SEQ ID NO: 170739 - DNA, 16 bp, H. sapiens
tttcagagttcttttt

SEQ ID NO: 170740 - DNA, 16 bp, H. sapiens
tttcagatattctgct

SEQ ID NO: 170741 - DNA, 16 bp, H. sapiens
tttcagatatttattt

SEQ ID NO: 170742 - DNA, 16 bp, H. sapiens
tttcagatattttcta

SEQ ID NO: 170743 - DNA, 16 bp, H. sapiens
tttcagatgaagaaaa

SEQ ID NO: 170744 - DNA, 16 bp, H. sapiens
tttcagatgaggaaaa

SEQ ID NO: 170745 - DNA, 16 bp, H. sapiens
tttcagattaaagaaa

SEQ ID NO: 170746 - DNA, 16 bp, H. sapiens
tttcagatttcacatt

SEQ ID NO: 170747 - DNA, 16 bp, H. sapiens
tttcagatttctcttc

SEQ ID NO: 170748 - DNA, 16 bp, H. sapiens
tttcagatttgatttt

SEQ ID NO: 170749 - DNA, 16 bp, H. sapiens
tttcagattttaaaaa

SEQ ID NO: 170750 - DNA, 16 bp, H. sapiens
tttcagattttctaaa

SEQ ID NO: 170751 - DNA, 16 bp, H. sapiens
tttcagatttttaaaa

SEQ ID NO: 170752 - DNA, 16 bp, H. sapiens
tttcagatttttgaaa

SEQ ID NO: 170753 - DNA, 16 bp, H. sapiens
tttcagattttttgga

SEQ ID NO: 170754 - DNA, 16 bp, H. sapiens
tttcagatttttttca

SEQ ID NO: 170755 - DNA, 16 bp, H. sapiens
tttcagcaaaaaaaaa

SEQ ID NO: 170756 - DNA, 16 bp, H. sapiens
tttcagcaaatggtgt

SEQ ID NO: 170757 - DNA, 16 bp, H. sapiens
tttcagcagcacctca

SEQ ID NO: 170758 - DNA, 16 bp, H. sapiens
tttcagcagcagcagc

SEQ ID NO: 170759 - DNA, 16 bp, H. sapiens
tttcagcagtgttctg

SEQ ID NO: 170760 - DNA, 16 bp, H. sapiens
tttcagcagtgtttca

SEQ ID NO: 170761 - DNA, 16 bp, H. sapiens
tttcagcatttgcttg

SEQ ID NO: 170762 - DNA, 16 bp, H. sapiens
tttcagccaaggctgg

SEQ ID NO: 170763 - DNA, 16 bp, H. sapiens
tttcagccattctgat

SEQ ID NO: 170764 - DNA, 16 bp, H. sapiens
tttcagcccaaaagct

SEQ ID NO: 170765 - DNA, 16 bp, H. sapiens
tttcagccccaccctc

SEQ ID NO: 170766 - DNA, 16 bp, H. sapiens
tttcagccccatcccc

SEQ ID NO: 170767 - DNA, 16 bp, H. sapiens
tttcagcctcagcctc

SEQ ID NO: 170768 - DNA, 16 bp, H. sapiens
tttcagcctcagtttc

SEQ ID NO: 170769 - DNA, 16 bp, H. sapiens
tttcagcctccagaac

SEQ ID NO: 170770 - DNA, 16 bp, H. sapiens
tttcagccttatttta

SEQ ID NO: 170771 - DNA, 16 bp, H. sapiens
tttcagccttccaagt

SEQ ID NO: 170772 - DNA, 19 bp, H. sapiens
tttcagccttctacatatg

SEQ ID NO: 170773 - DNA, 16 bp, H. sapiens
tttcagctaaccaagc

SEQ ID NO: 170774 - DNA, 16 bp, H. sapiens
tttcagctatttcttt

SEQ ID NO: 170775 - DNA, 16 bp, H. sapiens
tttcagctccatcacc

SEQ ID NO: 170776 - DNA, 16 bp, H. sapiens
tttcagctccattggg

SEQ ID NO: 170777 - DNA, 16 bp, H. sapiens
tttcagctctatcaga

SEQ ID NO: 170778 - DNA, 16 bp, H. sapiens
tttcagctggggaaga

SEQ ID NO: 170779 - DNA, 16 bp, H. sapiens
tttcagcttaaaataa

SEQ ID NO: 170780 - DNA, 16 bp, H. sapiens
tttcagcttctagtgg

SEQ ID NO: 170781 - DNA, 16 bp, H. sapiens
tttcagcttctctgct

SEQ ID NO: 170782 - DNA, 16 bp, H. sapiens
tttcagcttctggtgg

SEQ ID NO: 170783 - DNA, 16 bp, H. sapiens
tttcagcttgaagaac

SEQ ID NO: 170784 - DNA, 16 bp, H. sapiens
tttcagctttcttctt

SEQ ID NO: 170785 - DNA, 16 bp, H. sapiens
tttcagctttcttttg

SEQ ID NO: 170786 - DNA, 16 bp, H. sapiens
tttcagcttttaaaaa

SEQ ID NO: 170787 - DNA, 16 bp, H. sapiens
tttcagctttttaaaa

SEQ ID NO: 170788 - DNA, 16 bp, H. sapiens
tttcaggaaaaggaaa

SEQ ID NO: 170789 - DNA, 16 bp, H. sapiens
tttcaggatacaaaat

SEQ ID NO: 170790 - DNA, 16 bp, H. sapiens
tttcaggcaaagggaa

SEQ ID NO: 170791 - DNA, 16 bp, H. sapiens
tttcaggcatccactg

SEQ ID NO: 170792 - DNA, 16 bp, H. sapiens
tttcaggccctgggga

SEQ ID NO: 170793 - DNA, 16 bp, H. sapiens
tttcaggctttaaatt

SEQ ID NO: 170794 - DNA, 16 bp, H. sapiens
tttcaggggaaaaaaa

SEQ ID NO: 170795 - DNA, 16 bp, H. sapiens
tttcaggtatttttat

SEQ ID NO: 170796 - DNA, 16 bp, H. sapiens
tttcaggtgtgtgtgt

SEQ ID NO: 170797 - DNA, 18 bp, H. sapiens
tttcaggttaactttgga

SEQ ID NO: 170798 - DNA, 16 bp, H. sapiens
tttcaggttcacagca

SEQ ID NO: 170799 - DNA, 16 bp, H. sapiens
tttcaggttcatccat

SEQ ID NO: 170800 - DNA, 16 bp, H. sapiens
tttcaggtttctgcat

SEQ ID NO: 170801 - DNA, 16 bp, H. sapiens
tttcaggtttgttgaa

SEQ ID NO: 170802 - DNA, 16 bp, H. sapiens
tttcaggttttatatt

SEQ ID NO: 170803 - DNA, 16 bp, H. sapiens
tttcaggttttctatt

SEQ ID NO: 170804 - DNA, 16 bp, H. sapiens
tttcagtaaaaaggaa

SEQ ID NO: 170805 - DNA, 16 bp, H. sapiens
tttcagtaaaatgttt

SEQ ID NO: 170806 - DNA, 16 bp, H. sapiens
tttcagtaaatctaaa

SEQ ID NO: 170807 - DNA, 16 bp, H. sapiens
tttcagtaacatttta

SEQ ID NO: 170808 - DNA, 16 bp, H. sapiens
tttcagtaataataaa

SEQ ID NO: 170809 - DNA, 16 bp, H. sapiens
tttcagtactgtgttg

SEQ ID NO: 170810 - DNA, 24 bp, H. sapiens
tttcagtagagacagggtttcacc

SEQ ID NO: 170811 - DNA, 26 bp, H. sapiens
tttcagtagagacggggtttcaccgt

SEQ ID NO: 170812 - DNA, 16 bp, H. sapiens
tttcagtatataaaat

SEQ ID NO: 170813 - DNA, 16 bp, H. sapiens
tttcagtatttaaaaa

SEQ ID NO: 170814 - DNA, 16 bp, H. sapiens
tttcagtattttaact

SEQ ID NO: 170815 - DNA, 16 bp, H. sapiens
tttcagtattttccaa

SEQ ID NO: 170816 - DNA, 16 bp, H. sapiens
tttcagtcctgccatt

SEQ ID NO: 170817 - DNA, 16 bp, H. sapiens
tttcagtctcttttct

SEQ ID NO: 170818 - DNA, 16 bp, H. sapiens
tttcagtctcttttta

SEQ ID NO: 170819 - DNA, 16 bp, H. sapiens
tttcagtctttttaaa

SEQ ID NO: 170820 - DNA, 16 bp, H. sapiens
tttcagtgaaaatttt

SEQ ID NO: 170821 - DNA, 16 bp, H. sapiens
tttcagtgctaaaatt

SEQ ID NO: 170822 - DNA, 16 bp, H. sapiens
tttcagtgctttggga

SEQ ID NO: 170823 - DNA, 16 bp, H. sapiens
tttcagtggcttccca

SEQ ID NO: 170824 - DNA, 16 bp, H. sapiens
tttcagtggtctggat

SEQ ID NO: 170825 - DNA, 16 bp, H. sapiens
tttcagtgtgaaaata

SEQ ID NO: 170826 - DNA, 16 bp, H. sapiens
tttcagtgttttaaaa

SEQ ID NO: 170827 - DNA, 16 bp, H. sapiens
tttcagttaaaaataa

SEQ ID NO: 170828 - DNA, 16 bp, H. sapiens
tttcagttagaggtta

SEQ ID NO: 170829 - DNA, 16 bp, H. sapiens
tttcagttatttgaga

SEQ ID NO: 170830 - DNA, 16 bp, H. sapiens
tttcagttatttttaa

SEQ ID NO: 170831 - DNA, 16 bp, H. sapiens
tttcagttcctgcatt

SEQ ID NO: 170832 - DNA, 16 bp, H. sapiens
tttcagttccttgaat

SEQ ID NO: 170833 - DNA, 16 bp, H. sapiens
tttcagttctaaaata

SEQ ID NO: 170834 - DNA, 16 bp, H. sapiens
tttcagttctaaaatt

SEQ ID NO: 170835 - DNA, 16 bp, H. sapiens
tttcagttctatcaga

SEQ ID NO: 170836 - DNA, 16 bp, H. sapiens
tttcagttctgctctg

SEQ ID NO: 170837 - DNA, 16 bp, H. sapiens
tttcagttgttttaag

SEQ ID NO: 170838 - DNA, 16 bp, H. sapiens
tttcagtttccatttt

SEQ ID NO: 170839 - DNA, 17 bp, H. sapiens
tttcagtttctgatgcc

SEQ ID NO: 170840 - DNA, 16 bp, H. sapiens
tttcagtttcttaaat

SEQ ID NO: 170841 - DNA, 16 bp, H. sapiens
tttcagtttcttcatc

SEQ ID NO: 170842 - DNA, 16 bp, H. sapiens
tttcagtttcttctgt

SEQ ID NO: 170843 - DNA, 16 bp, H. sapiens
tttcagtttctttcat

SEQ ID NO: 170844 - DNA, 16 bp, H. sapiens
tttcagtttggaaagt

SEQ ID NO: 170845 - DNA, 16 bp, H. sapiens
tttcagtttggcctgg

SEQ ID NO: 170846 - DNA, 16 bp, H. sapiens
tttcagttttattcca

SEQ ID NO: 170847 - DNA, 16 bp, H. sapiens
tttcagttttcaaagt

SEQ ID NO: 170848 - DNA, 16 bp, H. sapiens
tttcagttttcctttc

SEQ ID NO: 170849 - DNA, 16 bp, H. sapiens
tttcagttttctcatc

SEQ ID NO: 170850 - DNA, 16 bp, H. sapiens
tttcagttttctgtat

SEQ ID NO: 170851 - DNA, 16 bp, H. sapiens
tttcagttttgaaaaa

SEQ ID NO: 170852 - DNA, 16 bp, H. sapiens
tttcagtttttaaaaa

SEQ ID NO: 170853 - DNA, 16 bp, H. sapiens
tttcagtttttaagaa

SEQ ID NO: 170854 - DNA, 16 bp, H. sapiens
tttcagtttttacttc

SEQ ID NO: 170855 - DNA, 16 bp, H. sapiens
tttcagtttttccaca

SEQ ID NO: 170856 - DNA, 16 bp, H. sapiens
tttcagtttttcctca

SEQ ID NO: 170857 - DNA, 16 bp, H. sapiens
tttcagtttttttaaa

SEQ ID NO: 170858 - DNA, 16 bp, H. sapiens
tttcataaaaagtttt

SEQ ID NO: 170859 - DNA, 16 bp, H. sapiens
tttcataaaaatggga

SEQ ID NO: 170860 - DNA, 16 bp, H. sapiens
tttcataaaagtaaaa

SEQ ID NO: 170861 - DNA, 16 bp, H. sapiens
tttcataaaataaagt

SEQ ID NO: 170862 - DNA, 16 bp, H. sapiens
tttcataaaattttca

SEQ ID NO: 170863 - DNA, 16 bp, H. sapiens
tttcataaagcagaaa

SEQ ID NO: 170864 - DNA, 16 bp, H. sapiens
tttcataaataatgta

SEQ ID NO: 170865 - DNA, 16 bp, H. sapiens
tttcataaattttatg

SEQ ID NO: 170866 - DNA, 16 bp, H. sapiens
tttcataaggaaaaaa

SEQ ID NO: 170867 - DNA, 16 bp, H. sapiens
tttcataatttaaaag

SEQ ID NO: 170868 - DNA, 16 bp, H. sapiens
tttcatacatttgtaa

SEQ ID NO: 170869 - DNA, 16 bp, H. sapiens
tttcatacattttcat

SEQ ID NO: 170870 - DNA, 16 bp, H. sapiens
tttcatagaaaatatt

SEQ ID NO: 170871 - DNA, 16 bp, H. sapiens
tttcatagtttaaaaa

SEQ ID NO: 170872 - DNA, 16 bp, H. sapiens
tttcatagtttcagat

SEQ ID NO: 170873 - DNA, 16 bp, H. sapiens
tttcatagtttcattt

SEQ ID NO: 170874 - DNA, 16 bp, H. sapiens
tttcatagttttcatt

SEQ ID NO: 170875 - DNA, 16 bp, H. sapiens
tttcatagtttttaaa

SEQ ID NO: 170876 - DNA, 16 bp, H. sapiens
tttcatataaatagaa

SEQ ID NO: 170877 - DNA, 16 bp, H. sapiens
tttcatatacatctta

SEQ ID NO: 170878 - DNA, 16 bp, H. sapiens
tttcatatattttgcc

SEQ ID NO: 170879 - DNA, 16 bp, H. sapiens
tttcatatctataaaa

SEQ ID NO: 170880 - DNA, 16 bp, H. sapiens
tttcatatgaaattta

SEQ ID NO: 170881 - DNA, 16 bp, H. sapiens
tttcatatgaatggaa

SEQ ID NO: 170882 - DNA, 16 bp, H. sapiens
tttcatatgttcaaaa

SEQ ID NO: 170883 - DNA, 16 bp, H. sapiens
tttcatatgttttcat

SEQ ID NO: 170884 - DNA, 16 bp, H. sapiens
tttcatattaagtctt

SEQ ID NO: 170885 - DNA, 16 bp, H. sapiens
tttcatattgttttaa

SEQ ID NO: 170886 - DNA, 16 bp, H. sapiens
tttcatatttgaaaaa

SEQ ID NO: 170887 - DNA, 16 bp, H. sapiens
tttcatatttgacaat

SEQ ID NO: 170888 - DNA, 16 bp, H. sapiens
tttcatatttttagtg

SEQ ID NO: 170889 - DNA, 16 bp, H. sapiens
tttcatcacatcatat

SEQ ID NO: 170890 - DNA, 16 bp, H. sapiens
tttcatcaccccagaa

SEQ ID NO: 170891 - DNA, 16 bp, H. sapiens
tttcatcacccccaaa

SEQ ID NO: 170892 - DNA, 16 bp, H. sapiens
tttcatcactctaaaa

SEQ ID NO: 170893 - DNA, 16 bp, H. sapiens
tttcatcactgttatt

SEQ ID NO: 170894 - DNA, 16 bp, H. sapiens
tttcatcactttggga

SEQ ID NO: 170895 - DNA, 16 bp, H. sapiens
tttcatcagtgttttg

SEQ ID NO: 170896 - DNA, 16 bp, H. sapiens
tttcatcatcatcatc

SEQ ID NO: 170897 - DNA, 16 bp, H. sapiens
tttcatcatcccaaat

SEQ ID NO: 170898 - DNA, 16 bp, H. sapiens
tttcatcatccccaaa

SEQ ID NO: 170899 - DNA, 16 bp, H. sapiens
tttcatcatctcagaa

SEQ ID NO: 170900 - DNA, 16 bp, H. sapiens
tttcatcatgctgccc

SEQ ID NO: 170901 - DNA, 18 bp, H. sapiens
tttcatcatgttggccag

SEQ ID NO: 170902 - DNA, 16 bp, H. sapiens
tttcatcattcattca

SEQ ID NO: 170903 - DNA, 16 bp, H. sapiens
tttcatcattcccaaa

SEQ ID NO: 170904 - DNA, 16 bp, H. sapiens
tttcatcattcttcca

SEQ ID NO: 170905 - DNA, 16 bp, H. sapiens
tttcatcattgtgtga

SEQ ID NO: 170906 - DNA, 16 bp, H. sapiens
tttcatcatttaaaaa

SEQ ID NO: 170907 - DNA, 16 bp, H. sapiens
tttcatcatttctgtt

SEQ ID NO: 170908 - DNA, 16 bp, H. sapiens
tttcatcatttgaaat

SEQ ID NO: 170909 - DNA, 16 bp, H. sapiens
tttcatcattttaaaa

SEQ ID NO: 170910 - DNA, 16 bp, H. sapiens
tttcatccaagagctg

SEQ ID NO: 170911 - DNA, 16 bp, H. sapiens
tttcatccttgtccct

SEQ ID NO: 170912 - DNA, 16 bp, H. sapiens
tttcatctataaaatg

SEQ ID NO: 170913 - DNA, 16 bp, H. sapiens
tttcatctatgtttat

SEQ ID NO: 170914 - DNA, 16 bp, H. sapiens
tttcatctctagaaat

SEQ ID NO: 170915 - DNA, 16 bp, H. sapiens
tttcatctgtaaaata

SEQ ID NO: 170916 - DNA, 16 bp, H. sapiens
tttcatctgtgtttta

SEQ ID NO: 170917 - DNA, 16 bp, H. sapiens
tttcatcttaaaaata

SEQ ID NO: 170918 - DNA, 16 bp, H. sapiens
tttcatcttcttggtt

SEQ ID NO: 170919 - DNA, 16 bp, H. sapiens
tttcatctttatgtcc

SEQ ID NO: 170920 - DNA, 16 bp, H. sapiens
tttcatctttcaaaat

SEQ ID NO: 170921 - DNA, 16 bp, H. sapiens
tttcatctttctgcat

SEQ ID NO: 170922 - DNA, 16 bp, H. sapiens
tttcatgaaaaaaatt

SEQ ID NO: 170923 - DNA, 16 bp, H. sapiens
tttcatgaaaaaataa

SEQ ID NO: 170924 - DNA, 16 bp, H. sapiens
tttcatgaaacaattt

SEQ ID NO: 170925 - DNA, 16 bp, H. sapiens
tttcatgaaagaaaaa

SEQ ID NO: 170926 - DNA, 16 bp, H. sapiens
tttcatgaaaggaaaa

SEQ ID NO: 170927 - DNA, 16 bp, H. sapiens
tttcatgaaatctttg

SEQ ID NO: 170928 - DNA, 16 bp, H. sapiens
tttcatgaaatttttg

SEQ ID NO: 170929 - DNA, 16 bp, H. sapiens
tttcatgaagaaaaca

SEQ ID NO: 170930 - DNA, 16 bp, H. sapiens
tttcatgacaaaaaca

SEQ ID NO: 170931 - DNA, 16 bp, H. sapiens
tttcatgacaatttaa

SEQ ID NO: 170932 - DNA, 16 bp, H. sapiens
tttcatgacattgaaa

SEQ ID NO: 170933 - DNA, 16 bp, H. sapiens
tttcatgagacttact

SEQ ID NO: 170934 - DNA, 16 bp, H. sapiens
tttcatgatgatttta

SEQ ID NO: 170935 - DNA, 16 bp, H. sapiens
tttcatgcatttattt

SEQ ID NO: 170936 - DNA, 16 bp, H. sapiens
tttcatgctacagtgg

SEQ ID NO: 170937 - DNA, 16 bp, H. sapiens
tttcatgctttttaat

SEQ ID NO: 170938 - DNA, 16 bp, H. sapiens
tttcatggaacaccat

SEQ ID NO: 170939 - DNA, 16 bp, H. sapiens
tttcatgtaaaataaa

SEQ ID NO: 170940 - DNA, 16 bp, H. sapiens
tttcatgtaaaatatt

SEQ ID NO: 170941 - DNA, 16 bp, H. sapiens
tttcatgtaattttat

SEQ ID NO: 170942 - DNA, 16 bp, H. sapiens
tttcatgtataaaatg

SEQ ID NO: 170943 - DNA, 16 bp, H. sapiens
tttcatgtattaaaat

SEQ ID NO: 170944 - DNA, 16 bp, H. sapiens
tttcatgtattaatat

SEQ ID NO: 170945 - DNA, 16 bp, H. sapiens
tttcatgtattttaat

SEQ ID NO: 170946 - DNA, 16 bp, H. sapiens
tttcatgtctctttag

SEQ ID NO: 170947 - DNA, 16 bp, H. sapiens
tttcatgtctgtcttc

SEQ ID NO: 170948 - DNA, 16 bp, H. sapiens
tttcatgtcttctgct

SEQ ID NO: 170949 - DNA, 16 bp, H. sapiens
tttcatgtctttaaat

SEQ ID NO: 170950 - DNA, 26 bp, H. sapiens
tttcatgtgaaatctttagtgttgtg

SEQ ID NO: 170951 - DNA, 16 bp, H. sapiens
tttcatgtgaatttta

SEQ ID NO: 170952 - DNA, 16 bp, H. sapiens
tttcatgtgttttctg

SEQ ID NO: 170953 - DNA, 16 bp, H. sapiens
tttcatgttaaaataa

SEQ ID NO: 170954 - DNA, 16 bp, H. sapiens
tttcatgtttgttgcc

SEQ ID NO: 170955 - DNA, 16 bp, H. sapiens
tttcatgttttaaaaa

SEQ ID NO: 170956 - DNA, 16 bp, H. sapiens
tttcatgtttttgaaa

SEQ ID NO: 170957 - DNA, 16 bp, H. sapiens
tttcatgttttttaaa

SEQ ID NO: 170958 - DNA, 16 bp, H. sapiens
tttcattaaatatgtt

SEQ ID NO: 170959 - DNA, 16 bp, H. sapiens
tttcattaaatttgta

SEQ ID NO: 170960 - DNA, 16 bp, H. sapiens
tttcattataaaacat

SEQ ID NO: 170961 - DNA, 16 bp, H. sapiens
tttcattatatacata

SEQ ID NO: 170962 - DNA, 16 bp, H. sapiens
tttcattattctgcat

SEQ ID NO: 170963 - DNA, 16 bp, H. sapiens
tttcattatttcttgc

SEQ ID NO: 170964 - DNA, 16 bp, H. sapiens
tttcattatttgggta

SEQ ID NO: 170965 - DNA, 16 bp, H. sapiens
tttcattattttccca

SEQ ID NO: 170966 - DNA, 16 bp, H. sapiens
tttcattattttgaaa

SEQ ID NO: 170967 - DNA, 16 bp, H. sapiens
tttcattcaacattgt

SEQ ID NO: 170968 - DNA, 16 bp, H. sapiens
tttcattcacttattc

SEQ ID NO: 170969 - DNA, 16 bp, H. sapiens
tttcattcagcaaata

SEQ ID NO: 170970 - DNA, 16 bp, H. sapiens
tttcattcagcataat

SEQ ID NO: 170971 - DNA, 16 bp, H. sapiens
tttcattcatatgaaa

SEQ ID NO: 170972 - DNA, 16 bp, H. sapiens
tttcattcatcttttg

SEQ ID NO: 170973 - DNA, 16 bp, H. sapiens
tttcattcattttgtg

SEQ ID NO: 170974 - DNA, 16 bp, H. sapiens
tttcattccatttata

SEQ ID NO: 170975 - DNA, 16 bp, H. sapiens
tttcattcccatcaac

SEQ ID NO: 170976 - DNA, 16 bp, H. sapiens
tttcattcctgatttt

SEQ ID NO: 170977 - DNA, 16 bp, H. sapiens
tttcattctataaata

SEQ ID NO: 170978 - DNA, 16 bp, H. sapiens
tttcattctcagcttg

SEQ ID NO: 170979 - DNA, 16 bp, H. sapiens
tttcattcttcaaatt

SEQ ID NO: 170980 - DNA, 16 bp, H. sapiens
tttcattcttgttgcc

SEQ ID NO: 170981 - DNA, 16 bp, H. sapiens
tttcattctttcaaaa

SEQ ID NO: 170982 - DNA, 16 bp, H. sapiens
tttcattgaaataatt

SEQ ID NO: 170983 - DNA, 16 bp, H. sapiens
tttcattgcattccat

SEQ ID NO: 170984 - DNA, 16 bp, H. sapiens
tttcattgcttttggt

SEQ ID NO: 170985 - DNA, 16 bp, H. sapiens
tttcattggacttaca

SEQ ID NO: 170986 - DNA, 16 bp, H. sapiens
tttcattggagaattt

SEQ ID NO: 170987 - DNA, 16 bp, H. sapiens
tttcattggagcattt

SEQ ID NO: 170988 - DNA, 16 bp, H. sapiens
tttcattgtaatattt

SEQ ID NO: 170989 - DNA, 16 bp, H. sapiens
tttcattgtaatttta

SEQ ID NO: 170990 - DNA, 16 bp, H. sapiens
tttcattgtatgtatg

SEQ ID NO: 170991 - DNA, 16 bp, H. sapiens
tttcattgtggcttta

SEQ ID NO: 170992 - DNA, 16 bp, H. sapiens
tttcattgtggtaaaa

SEQ ID NO: 170993 - DNA, 16 bp, H. sapiens
tttcattgtgtatgta

SEQ ID NO: 170994 - DNA, 16 bp, H. sapiens
tttcattgttgtgcaa

SEQ ID NO: 170995 - DNA, 16 bp, H. sapiens
tttcattgtttaaaat

SEQ ID NO: 170996 - DNA, 16 bp, H. sapiens
tttcattgtttataaa

SEQ ID NO: 170997 - DNA, 16 bp, H. sapiens
tttcatttaaaaagtt

SEQ ID NO: 170998 - DNA, 16 bp, H. sapiens
tttcatttaaaatttg

SEQ ID NO: 170999 - DNA, 16 bp, H. sapiens
tttcatttaaagaaaa

SEQ ID NO: 171000 - DNA, 16 bp, H. sapiens
tttcatttaaagtgag

SEQ ID NO: 171001 - DNA, 16 bp, H. sapiens
tttcatttaacccaat

SEQ ID NO: 171002 - DNA, 16 bp, H. sapiens
tttcatttaagataat

SEQ ID NO: 171003 - DNA, 16 bp, H. sapiens
tttcatttaattcaaa

SEQ ID NO: 171004 - DNA, 16 bp, H. sapiens
tttcatttacataaat

SEQ ID NO: 171005 - DNA, 16 bp, H. sapiens
tttcatttacataaca

SEQ ID NO: 171006 - DNA, 16 bp, H. sapiens
tttcatttacatgaaa

SEQ ID NO: 171007 - DNA, 16 bp, H. sapiens
tttcatttagcataat

SEQ ID NO: 171008 - DNA, 16 bp, H. sapiens
tttcatttatatgaaa

SEQ ID NO: 171009 - DNA, 16 bp, H. sapiens
tttcatttatatggaa

SEQ ID NO: 171010 - DNA, 16 bp, H. sapiens
tttcatttatctggaa

SEQ ID NO: 171011 - DNA, 16 bp, H. sapiens
tttcatttattcatgt

SEQ ID NO: 171012 - DNA, 16 bp, H. sapiens
tttcatttattcctca

SEQ ID NO: 171013 - DNA, 16 bp, H. sapiens
tttcatttcaaattca

SEQ ID NO: 171014 - DNA, 16 bp, H. sapiens
tttcatttcaagaaat

SEQ ID NO: 171015 - DNA, 16 bp, H. sapiens
tttcatttcacttcat

SEQ ID NO: 171016 - DNA, 16 bp, H. sapiens
tttcatttcagaaatg

SEQ ID NO: 171017 - DNA, 16 bp, H. sapiens
tttcatttcagatttt

SEQ ID NO: 171018 - DNA, 16 bp, H. sapiens
tttcatttcagttaat

SEQ ID NO: 171019 - DNA, 16 bp, H. sapiens
tttcatttcatcattc

SEQ ID NO: 171020 - DNA, 16 bp, H. sapiens
tttcatttcatttgga

SEQ ID NO: 171021 - DNA, 16 bp, H. sapiens
tttcatttcattttga

SEQ ID NO: 171022 - DNA, 16 bp, H. sapiens
tttcatttccatttca

SEQ ID NO: 171023 - DNA, 16 bp, H. sapiens
tttcatttcctctgga

SEQ ID NO: 171024 - DNA, 16 bp, H. sapiens
tttcatttctagcttt

SEQ ID NO: 171025 - DNA, 16 bp, H. sapiens
tttcatttctatgaaa

SEQ ID NO: 171026 - DNA, 16 bp, H. sapiens
tttcatttctccacat

SEQ ID NO: 171027 - DNA, 16 bp, H. sapiens
tttcatttctcctgag

SEQ ID NO: 171028 - DNA, 16 bp, H. sapiens
tttcatttctggaatt

SEQ ID NO: 171029 - DNA, 16 bp, H. sapiens
tttcatttcttattga

SEQ ID NO: 171030 - DNA, 16 bp, H. sapiens
tttcatttcttgaatt

SEQ ID NO: 171031 - DNA, 16 bp, H. sapiens
tttcatttctttggat

SEQ ID NO: 171032 - DNA, 16 bp, H. sapiens
tttcatttctttggga

SEQ ID NO: 171033 - DNA, 16 bp, H. sapiens
tttcatttgaagtttt

SEQ ID NO: 171034 - DNA, 16 bp, H. sapiens
tttcatttgcattttc

SEQ ID NO: 171035 - DNA, 16 bp, H. sapiens
tttcatttgcattttg

SEQ ID NO: 171036 - DNA, 16 bp, H. sapiens
tttcatttgccaattt

SEQ ID NO: 171037 - DNA, 16 bp, H. sapiens
tttcatttgctaatat

SEQ ID NO: 171038 - DNA, 16 bp, H. sapiens
tttcatttgctttgga

SEQ ID NO: 171039 - DNA, 16 bp, H. sapiens
tttcatttgcttttcc

SEQ ID NO: 171040 - DNA, 16 bp, H. sapiens
tttcatttgtaaattg

SEQ ID NO: 171041 - DNA, 16 bp, H. sapiens
tttcatttgttcaaat

SEQ ID NO: 171042 - DNA, 16 bp, H. sapiens
tttcatttgtttctaa

SEQ ID NO: 171043 - DNA, 16 bp, H. sapiens
tttcattttaaaatgt

SEQ ID NO: 171044 - DNA, 16 bp, H. sapiens
tttcattttaaagaat

SEQ ID NO: 171045 - DNA, 16 bp, H. sapiens
tttcattttaacaaaa

SEQ ID NO: 171046 - DNA, 16 bp, H. sapiens
tttcattttacaggct

SEQ ID NO: 171047 - DNA, 16 bp, H. sapiens
tttcattttataagaa

SEQ ID NO: 171048 - DNA, 16 bp, H. sapiens
tttcattttatagata

SEQ ID NO: 171049 - DNA, 16 bp, H. sapiens
tttcattttatgaatg

SEQ ID NO: 171050 - DNA, 16 bp, H. sapiens
tttcattttatgaatt

SEQ ID NO: 171051 - DNA, 16 bp, H. sapiens
tttcattttcaaaagt

SEQ ID NO: 171052 - DNA, 16 bp, H. sapiens
tttcattttcaataaa

SEQ ID NO: 171053 - DNA, 16 bp, H. sapiens
tttcattttcagaaaa

SEQ ID NO: 171054 - DNA, 16 bp, H. sapiens
tttcattttcatattg

SEQ ID NO: 171055 - DNA, 16 bp, H. sapiens
tttcattttcctaatg

SEQ ID NO: 171056 - DNA, 16 bp, H. sapiens
tttcattttctccaca

SEQ ID NO: 171057 - DNA, 16 bp, H. sapiens
tttcattttctgaaag

SEQ ID NO: 171058 - DNA, 16 bp, H. sapiens
tttcattttcttaatg

SEQ ID NO: 171059 - DNA, 16 bp, H. sapiens
tttcattttgaagaaa

SEQ ID NO: 171060 - DNA, 16 bp, H. sapiens
tttcattttgataatt

SEQ ID NO: 171061 - DNA, 16 bp, H. sapiens
tttcattttgatatat

SEQ ID NO: 171062 - DNA, 16 bp, H. sapiens
tttcattttgcataat

SEQ ID NO: 171063 - DNA, 16 bp, H. sapiens
tttcattttgcattgg

SEQ ID NO: 171064 - DNA, 16 bp, H. sapiens
tttcattttggggtga

SEQ ID NO: 171065 - DNA, 16 bp, H. sapiens
tttcattttgttcaaa

SEQ ID NO: 171066 - DNA, 16 bp, H. sapiens
tttcattttgtttgga

SEQ ID NO: 171067 - DNA, 16 bp, H. sapiens
tttcatttttaaaagt

SEQ ID NO: 171068 - DNA, 16 bp, H. sapiens
tttcatttttaaagga

SEQ ID NO: 171069 - DNA, 16 bp, H. sapiens
tttcatttttagaagt

SEQ ID NO: 171070 - DNA, 16 bp, H. sapiens
tttcatttttagttga

SEQ ID NO: 171071 - DNA, 16 bp, H. sapiens
tttcatttttatggct

SEQ ID NO: 171072 - DNA, 16 bp, H. sapiens
tttcatttttcaatga

SEQ ID NO: 171073 - DNA, 16 bp, H. sapiens
tttcatttttccccca

SEQ ID NO: 171074 - DNA, 16 bp, H. sapiens
tttcatttttctgcat

SEQ ID NO: 171075 - DNA, 16 bp, H. sapiens
tttcatttttgaaaaa

SEQ ID NO: 171076 - DNA, 16 bp, H. sapiens
tttcatttttgaaaat

SEQ ID NO: 171077 - DNA, 16 bp, H. sapiens
tttcatttttgtgggt

SEQ ID NO: 171078 - DNA, 16 bp, H. sapiens
tttcattttttgagga

SEQ ID NO: 171079 - DNA, 16 bp, H. sapiens
tttcatttttttggaa

SEQ ID NO: 171080 - DNA, 16 bp, H. sapiens
tttccaaaaattctta

SEQ ID NO: 171081 - DNA, 16 bp, H. sapiens
tttccaaaacacaaat

SEQ ID NO: 171082 - DNA, 16 bp, H. sapiens
tttccaaaagaaaaaa

SEQ ID NO: 171083 - DNA, 16 bp, H. sapiens
tttccaaaagatattt

SEQ ID NO: 171084 - DNA, 16 bp, H. sapiens
tttccaaaatattttc

SEQ ID NO: 171085 - DNA, 16 bp, H. sapiens
tttccaaaatgactgt

SEQ ID NO: 171086 - DNA, 16 bp, H. sapiens
tttccaaaattaaaat

SEQ ID NO: 171087 - DNA, 16 bp, H. sapiens
tttccaaaattctttt

SEQ ID NO: 171088 - DNA, 16 bp, H. sapiens
tttccaaaatttaaaa

SEQ ID NO: 171089 - DNA, 16 bp, H. sapiens
tttccaaaatttatga

SEQ ID NO: 171090 - DNA, 16 bp, H. sapiens
tttccaaaattttaaa

SEQ ID NO: 171091 - DNA, 16 bp, H. sapiens
tttccaaaatttttaa

SEQ ID NO: 171092 - DNA, 16 bp, H. sapiens
tttccaaaatttttca

SEQ ID NO: 171093 - DNA, 16 bp, H. sapiens
tttccaaacaagcaaa

SEQ ID NO: 171094 - DNA, 16 bp, H. sapiens
tttccaaactgctaaa

SEQ ID NO: 171095 - DNA, 16 bp, H. sapiens
tttccaaactgctctg

SEQ ID NO: 171096 - DNA, 16 bp, H. sapiens
tttccaaactgctgca

SEQ ID NO: 171097 - DNA, 16 bp, H. sapiens
tttccaaactgctgta

SEQ ID NO: 171098 - DNA, 16 bp, H. sapiens
tttccaaactgctttt

SEQ ID NO: 171099 - DNA, 16 bp, H. sapiens
tttccaaagaaaattt

SEQ ID NO: 171100 - DNA, 16 bp, H. sapiens
tttccaaagaagaaat

SEQ ID NO: 171101 - DNA, 16 bp, H. sapiens
tttccaaagagaaaaa

SEQ ID NO: 171102 - DNA, 16 bp, H. sapiens
tttccaaagcattttt

SEQ ID NO: 171103 - DNA, 16 bp, H. sapiens
tttccaaaggagaaaa

SEQ ID NO: 171104 - DNA, 16 bp, H. sapiens
tttccaaagtcacaaa

SEQ ID NO: 171105 - DNA, 16 bp, H. sapiens
tttccaaagtttctct

SEQ ID NO: 171106 - DNA, 16 bp, H. sapiens
tttccaaagtttttct

SEQ ID NO: 171107 - DNA, 16 bp, H. sapiens
tttccaaataaaatgt

SEQ ID NO: 171108 - DNA, 16 bp, H. sapiens
tttccaaataacattt

SEQ ID NO: 171109 - DNA, 16 bp, H. sapiens
tttccaaataaggtca

SEQ ID NO: 171110 - DNA, 16 bp, H. sapiens
tttccaaatattaaaa

SEQ ID NO: 171111 - DNA, 16 bp, H. sapiens
tttccaaatatttgaa

SEQ ID NO: 171112 - DNA, 16 bp, H. sapiens
tttccaaatgtaaaat

SEQ ID NO: 171113 - DNA, 16 bp, H. sapiens
tttccaaattaaaaat

SEQ ID NO: 171114 - DNA, 16 bp, H. sapiens
tttccaaattaaataa

SEQ ID NO: 171115 - DNA, 16 bp, H. sapiens
tttccaaatttggtga

SEQ ID NO: 171116 - DNA, 16 bp, H. sapiens
tttccaaatttgtttt

SEQ ID NO: 171117 - DNA, 16 bp, H. sapiens
tttccaacattttcct

SEQ ID NO: 171118 - DNA, 16 bp, H. sapiens
tttccaagaaaaatat

SEQ ID NO: 171119 - DNA, 16 bp, H. sapiens
tttccaagacaatcct

SEQ ID NO: 171120 - DNA, 16 bp, H. sapiens
tttccaagagaaaaaa

SEQ ID NO: 171121 - DNA, 16 bp, H. sapiens
tttccaagagctcttt

SEQ ID NO: 171122 - DNA, 16 bp, H. sapiens
tttccaagtttatttt

SEQ ID NO: 171123 - DNA, 16 bp, H. sapiens
tttccaataaaaatat

SEQ ID NO: 171124 - DNA, 16 bp, H. sapiens
tttccaatgttgtctt

SEQ ID NO: 171125 - DNA, 16 bp, H. sapiens
tttccacaaaagacat

SEQ ID NO: 171126 - DNA, 16 bp, H. sapiens
tttccacaaagaaaaa

SEQ ID NO: 171127 - DNA, 16 bp, H. sapiens
tttccacaatggaaag

SEQ ID NO: 171128 - DNA, 16 bp, H. sapiens
tttccacagtggatga

SEQ ID NO: 171129 - DNA, 16 bp, H. sapiens
tttccacatctgcaaa

SEQ ID NO: 171130 - DNA, 16 bp, H. sapiens
tttccacatctgtaaa

SEQ ID NO: 171131 - DNA, 16 bp, H. sapiens
tttccacatttgaaaa

SEQ ID NO: 171132 - DNA, 16 bp, H. sapiens
tttccacatttttgtg

SEQ ID NO: 171133 - DNA, 16 bp, H. sapiens
tttccaccacatccac

SEQ ID NO: 171134 - DNA, 16 bp, H. sapiens
tttccaccctttggct

SEQ ID NO: 171135 - DNA, 16 bp, H. sapiens
tttccacctcagcctc

SEQ ID NO: 171136 - DNA, 16 bp, H. sapiens
tttccactaaaaggaa

SEQ ID NO: 171137 - DNA, 16 bp, H. sapiens
tttccactctttggct

SEQ ID NO: 171138 - DNA, 16 bp, H. sapiens
tttccactgaaaaatc

SEQ ID NO: 171139 - DNA, 16 bp, H. sapiens
tttccactggctggct

SEQ ID NO: 171140 - DNA, 16 bp, H. sapiens
tttccagaaaaacaaa

SEQ ID NO: 171141 - DNA, 16 bp, H. sapiens
tttccagaaatggaaa

SEQ ID NO: 171142 - DNA, 16 bp, H. sapiens
tttccagaaatttatc

SEQ ID NO: 171143 - DNA, 16 bp, H. sapiens
tttccagaaatttttt

SEQ ID NO: 171144 - DNA, 16 bp, H. sapiens
tttccagaagaaaaaa

SEQ ID NO: 171145 - DNA, 16 bp, H. sapiens
tttccagaagagattg

SEQ ID NO: 171146 - DNA, 16 bp, H. sapiens
tttccagaaggctttc

SEQ ID NO: 171147 - DNA, 16 bp, H. sapiens
tttccagaattatttt

SEQ ID NO: 171148 - DNA, 16 bp, H. sapiens
tttccagaatttaaaa

SEQ ID NO: 171149 - DNA, 16 bp, H. sapiens
tttccagaatttgaat

SEQ ID NO: 171150 - DNA, 16 bp, H. sapiens
tttccagactgggcag

SEQ ID NO: 171151 - DNA, 16 bp, H. sapiens
tttccagagaaataaa

SEQ ID NO: 171152 - DNA, 16 bp, H. sapiens
tttccagataaggaaa

SEQ ID NO: 171153 - DNA, 16 bp, H. sapiens
tttccagatgagggaa

SEQ ID NO: 171154 - DNA, 16 bp, H. sapiens
tttccagatggggaaa

SEQ ID NO: 171155 - DNA, 16 bp, H. sapiens
tttccagatttctgct

SEQ ID NO: 171156 - DNA, 16 bp, H. sapiens
tttccagcagtcccat

SEQ ID NO: 171157 - DNA, 16 bp, H. sapiens
tttccagcatttttat

SEQ ID NO: 171158 - DNA, 16 bp, H. sapiens
tttccagcccccagaa

SEQ ID NO: 171159 - DNA, 16 bp, H. sapiens
tttccagcctcagcct

SEQ ID NO: 171160 - DNA, 16 bp, H. sapiens
tttccagcctgggcaa

SEQ ID NO: 171161 - DNA, 16 bp, H. sapiens
tttccagctcctagag

SEQ ID NO: 171162 - DNA, 16 bp, H. sapiens
tttccagctgggcaca

SEQ ID NO: 171163 - DNA, 16 bp, H. sapiens
tttccagcttcataca

SEQ ID NO: 171164 - DNA, 16 bp, H. sapiens
tttccagcttgcagat

SEQ ID NO: 171165 - DNA, 16 bp, H. sapiens
tttccagctttgttct

SEQ ID NO: 171166 - DNA, 16 bp, H. sapiens
tttccagcttttcttt

SEQ ID NO: 171167 - DNA, 16 bp, H. sapiens
tttccagcttttgatt

SEQ ID NO: 171168 - DNA, 16 bp, H. sapiens
tttccaggaaataaaa

SEQ ID NO: 171169 - DNA, 16 bp, H. sapiens
tttccaggagcacagt

SEQ ID NO: 171170 - DNA, 16 bp, H. sapiens
tttccaggatggaaag

SEQ ID NO: 171171 - DNA, 16 bp, H. sapiens
tttccaggctcagggt

SEQ ID NO: 171172 - DNA, 16 bp, H. sapiens
tttccaggtattttat

SEQ ID NO: 171173 - DNA, 16 bp, H. sapiens
tttccaggttttgttt

SEQ ID NO: 171174 - DNA, 16 bp, H. sapiens
tttccagtacaatgtt

SEQ ID NO: 171175 - DNA, 16 bp, H. sapiens
tttccagtctgtggct

SEQ ID NO: 171176 - DNA, 16 bp, H. sapiens
tttccagtggttcttt

SEQ ID NO: 171177 - DNA, 16 bp, H. sapiens
tttccagtgtttggct

SEQ ID NO: 171178 - DNA, 16 bp, H. sapiens
tttccagttaaaaaaa

SEQ ID NO: 171179 - DNA, 16 bp, H. sapiens
tttccagttgtatgaa

SEQ ID NO: 171180 - DNA, 16 bp, H. sapiens
tttccagttgttttgt

SEQ ID NO: 171181 - DNA, 16 bp, H. sapiens
tttccagttttattat

SEQ ID NO: 171182 - DNA, 16 bp, H. sapiens
tttccagtttttctgt

SEQ ID NO: 171183 - DNA, 16 bp, H. sapiens
tttccagtttttgact

SEQ ID NO: 171184 - DNA, 16 bp, H. sapiens
tttccataacataaaa

SEQ ID NO: 171185 - DNA, 16 bp, H. sapiens
tttccataataaaatg

SEQ ID NO: 171186 - DNA, 16 bp, H. sapiens
tttccatacatccttt

SEQ ID NO: 171187 - DNA, 16 bp, H. sapiens
tttccatagaggttgt

SEQ ID NO: 171188 - DNA, 16 bp, H. sapiens
tttccatataaaattt

SEQ ID NO: 171189 - DNA, 16 bp, H. sapiens
tttccatatctttgct

SEQ ID NO: 171190 - DNA, 16 bp, H. sapiens
tttccatatgaatttt

SEQ ID NO: 171191 - DNA, 16 bp, H. sapiens
tttccatatgagtttt

SEQ ID NO: 171192 - DNA, 16 bp, H. sapiens
tttccatatggatttt

SEQ ID NO: 171193 - DNA, 16 bp, H. sapiens
tttccatatgttttat

SEQ ID NO: 171194 - DNA, 16 bp, H. sapiens
tttccatatttatgtc

SEQ ID NO: 171195 - DNA, 16 bp, H. sapiens
tttccatatttttctg

SEQ ID NO: 171196 - DNA, 16 bp, H. sapiens
tttccatcccttcatt

SEQ ID NO: 171197 - DNA, 16 bp, H. sapiens
tttccatctcagcctc

SEQ ID NO: 171198 - DNA, 16 bp, H. sapiens
tttccatctcctgacc

SEQ ID NO: 171199 - DNA, 16 bp, H. sapiens
tttccatctgttttct

SEQ ID NO: 171200 - DNA, 16 bp, H. sapiens
tttccatcttcccaaa

SEQ ID NO: 171201 - DNA, 16 bp, H. sapiens
tttccatctttttgct

SEQ ID NO: 171202 - DNA, 16 bp, H. sapiens
tttccatgaaaataat

SEQ ID NO: 171203 - DNA, 16 bp, H. sapiens
tttccatgataattag

SEQ ID NO: 171204 - DNA, 16 bp, H. sapiens
tttccatgctgttctc

SEQ ID NO: 171205 - DNA, 16 bp, H. sapiens
tttccatggtggctga

SEQ ID NO: 171206 - DNA, 16 bp, H. sapiens
tttccatgtaaatttt

SEQ ID NO: 171207 - DNA, 16 bp, H. sapiens
tttccatgtaatattt

SEQ ID NO: 171208 - DNA, 16 bp, H. sapiens
tttccatgtagctgtg

SEQ ID NO: 171209 - DNA, 16 bp, H. sapiens
tttccatgtgaatttt

SEQ ID NO: 171210 - DNA, 16 bp, H. sapiens
tttccatgtgtctttt

SEQ ID NO: 171211 - DNA, 16 bp, H. sapiens
tttccatgtgtttgtg

SEQ ID NO: 171212 - DNA, 16 bp, H. sapiens
tttccatgttgcccag

SEQ ID NO: 171213 - DNA, 16 bp, H. sapiens
tttccatgttttaatt

SEQ ID NO: 171214 - DNA, 16 bp, H. sapiens
tttccattaaaatatt

SEQ ID NO: 171215 - DNA, 17 bp, H. sapiens
tttccattcctgagtta

SEQ ID NO: 171216 - DNA, 16 bp, H. sapiens
tttccattcttgtgtt

SEQ ID NO: 171217 - DNA, 16 bp, H. sapiens
tttccattcttttaaa

SEQ ID NO: 171218 - DNA, 16 bp, H. sapiens
tttccattcttttgaa

SEQ ID NO: 171219 - DNA, 16 bp, H. sapiens
tttccattgttttgca

SEQ ID NO: 171220 - DNA, 16 bp, H. sapiens
tttccatttcaataaa

SEQ ID NO: 171221 - DNA, 16 bp, H. sapiens
tttccatttcagtttt

SEQ ID NO: 171222 - DNA, 16 bp, H. sapiens
tttccatttccttaat

SEQ ID NO: 171223 - DNA, 16 bp, H. sapiens
tttccatttctccaca

SEQ ID NO: 171224 - DNA, 16 bp, H. sapiens
tttccatttctgaatt

SEQ ID NO: 171225 - DNA, 16 bp, H. sapiens
tttccatttctgattt

SEQ ID NO: 171226 - DNA, 16 bp, H. sapiens
tttccatttgtaaaat

SEQ ID NO: 171227 - DNA, 16 bp, H. sapiens
tttccatttgttttaa

SEQ ID NO: 171228 - DNA, 16 bp, H. sapiens
tttccattttacagtt

SEQ ID NO: 171229 - DNA, 16 bp, H. sapiens
tttccattttatagac

SEQ ID NO: 171230 - DNA, 16 bp, H. sapiens
tttccattttcaaaat

SEQ ID NO: 171231 - DNA, 16 bp, H. sapiens
tttccattttcatcca

SEQ ID NO: 171232 - DNA, 16 bp, H. sapiens
tttccattttcattca

SEQ ID NO: 171233 - DNA, 16 bp, H. sapiens
tttccattttcatttg

SEQ ID NO: 171234 - DNA, 16 bp, H. sapiens
tttccattttccaagt

SEQ ID NO: 171235 - DNA, 16 bp, H. sapiens
tttccattttcctgat

SEQ ID NO: 171236 - DNA, 16 bp, H. sapiens
tttccattttctctgt

SEQ ID NO: 171237 - DNA, 16 bp, H. sapiens
tttccattttcttaaa

SEQ ID NO: 171238 - DNA, 16 bp, H. sapiens
tttccatttttaaaaa

SEQ ID NO: 171239 - DNA, 16 bp, H. sapiens
tttccatttttcagaa

SEQ ID NO: 171240 - DNA, 16 bp, H. sapiens
tttcccaaaatgtgtt

SEQ ID NO: 171241 - DNA, 16 bp, H. sapiens
tttcccaaacattcct

SEQ ID NO: 171242 - DNA, 16 bp, H. sapiens
tttcccaaagaagaaa

SEQ ID NO: 171243 - DNA, 16 bp, H. sapiens
tttcccaaagattact

SEQ ID NO: 171244 - DNA, 16 bp, H. sapiens
tttcccaaataaaaca

SEQ ID NO: 171245 - DNA, 16 bp, H. sapiens
tttcccaaatttgaca

SEQ ID NO: 171246 - DNA, 16 bp, H. sapiens
tttcccaaatttttat

SEQ ID NO: 171247 - DNA, 16 bp, H. sapiens
tttcccaactgctgaa

SEQ ID NO: 171248 - DNA, 16 bp, H. sapiens
tttcccaagtagctgg

SEQ ID NO: 171249 - DNA, 16 bp, H. sapiens
tttcccaatgtgtgtt

SEQ ID NO: 171250 - DNA, 16 bp, H. sapiens
tttcccaattctgtga

SEQ ID NO: 171251 - DNA, 16 bp, H. sapiens
tttcccacattttcct

SEQ ID NO: 171252 - DNA, 16 bp, H. sapiens
tttcccaccacctcca

SEQ ID NO: 171253 - DNA, 16 bp, H. sapiens
tttcccagaatccctt

SEQ ID NO: 171254 - DNA, 16 bp, H. sapiens
tttcccagactggagt

SEQ ID NO: 171255 - DNA, 16 bp, H. sapiens
tttcccagactggtct

SEQ ID NO: 171256 - DNA, 16 bp, H. sapiens
tttcccagagaaacaa

SEQ ID NO: 171257 - DNA, 16 bp, H. sapiens
tttcccagatgttctt

SEQ ID NO: 171258 - DNA, 16 bp, H. sapiens
tttcccagcaccagtt

SEQ ID NO: 171259 - DNA, 16 bp, H. sapiens
tttcccagcataattt

SEQ ID NO: 171260 - DNA, 16 bp, H. sapiens
tttcccagcatcactt

SEQ ID NO: 171261 - DNA, 16 bp, H. sapiens
tttcccagcattcctt

SEQ ID NO: 171262 - DNA, 16 bp, H. sapiens
tttcccagcctccaaa

SEQ ID NO: 171263 - DNA, 16 bp, H. sapiens
tttcccagcctttctt

SEQ ID NO: 171264 - DNA, 16 bp, H. sapiens
tttcccagctccatgc

SEQ ID NO: 171265 - DNA, 16 bp, H. sapiens
tttcccagctttattg

SEQ ID NO: 171266 - DNA, 16 bp, H. sapiens
tttcccaggctgatct

SEQ ID NO: 171267 - DNA, 16 bp, H. sapiens
tttcccaggctggtct

SEQ ID NO: 171268 - DNA, 16 bp, H. sapiens
tttcccagggctgttc

SEQ ID NO: 171269 - DNA, 16 bp, H. sapiens
tttcccataaggaata

SEQ ID NO: 171270 - DNA, 28 bp, H. sapiens
tttcccataagggatacttttagttaat

SEQ ID NO: 171271 - DNA, 16 bp, H. sapiens
tttcccatcaaaactc

SEQ ID NO: 171272 - DNA, 16 bp, H. sapiens
tttcccatctgcaaaa

SEQ ID NO: 171273 - DNA, 16 bp, H. sapiens
tttcccatctgtaaaa

SEQ ID NO: 171274 - DNA, 16 bp, H. sapiens
tttcccatgctggagt

SEQ ID NO: 171275 - DNA, 16 bp, H. sapiens
tttcccatgctggatg

SEQ ID NO: 171276 - DNA, 16 bp, H. sapiens
tttcccatgctgttct

SEQ ID NO: 171277 - DNA, 16 bp, H. sapiens
tttcccatggtgttct

SEQ ID NO: 171278 - DNA, 16 bp, H. sapiens
tttcccatgttttctt

SEQ ID NO: 171279 - DNA, 16 bp, H. sapiens
tttcccattgaatttt

SEQ ID NO: 171280 - DNA, 16 bp, H. sapiens
tttcccattgcttatt

SEQ ID NO: 171281 - DNA, 16 bp, H. sapiens
tttcccattttaaaaa

SEQ ID NO: 171282 - DNA, 16 bp, H. sapiens
tttcccattttaaaat

SEQ ID NO: 171283 - DNA, 16 bp, H. sapiens
tttcccattttgtggg

SEQ ID NO: 171284 - DNA, 16 bp, H. sapiens
tttcccatttttaagt

SEQ ID NO: 171285 - DNA, 16 bp, H. sapiens
tttccccaatggtaac

SEQ ID NO: 171286 - DNA, 16 bp, H. sapiens
tttccccaccatcttt

SEQ ID NO: 171287 - DNA, 16 bp, H. sapiens
tttccccatctgaaaa

SEQ ID NO: 171288 - DNA, 16 bp, H. sapiens
tttccccatctgtgac

SEQ ID NO: 171289 - DNA, 16 bp, H. sapiens
tttccccattcagcat

SEQ ID NO: 171290 - DNA, 16 bp, H. sapiens
tttccccattcagtat

SEQ ID NO: 171291 - DNA, 20 bp, H. sapiens
tttccccattgcttgttttt

SEQ ID NO: 171292 - DNA, 16 bp, H. sapiens
tttccccattgtatat

SEQ ID NO: 171293 - DNA, 20 bp, H. sapiens
tttccccatttcttgttttt

SEQ ID NO: 171294 - DNA, 16 bp, H. sapiens
tttccccattttaaaa

SEQ ID NO: 171295 - DNA, 16 bp, H. sapiens
tttcccccatgctttt

SEQ ID NO: 171296 - DNA, 16 bp, H. sapiens
tttcccccattctgtt

SEQ ID NO: 171297 - DNA, 16 bp, H. sapiens
tttccccccaaaattc

SEQ ID NO: 171298 - DNA, 16 bp, H. sapiens
tttccccctctgtaaa

SEQ ID NO: 171299 - DNA, 16 bp, H. sapiens
tttcccccttactgtt

SEQ ID NO: 171300 - DNA, 16 bp, H. sapiens
tttcccctatgtttcc

SEQ ID NO: 171301 - DNA, 16 bp, H. sapiens
tttcccctccaaatct

SEQ ID NO: 171302 - DNA, 16 bp, H. sapiens
tttcccctctctgggc

SEQ ID NO: 171303 - DNA, 16 bp, H. sapiens
tttcccctgaggcctc

SEQ ID NO: 171304 - DNA, 16 bp, H. sapiens
tttcccctgcccccag

SEQ ID NO: 171305 - DNA, 16 bp, H. sapiens
tttcccctgctgttct

SEQ ID NO: 171306 - DNA, 16 bp, H. sapiens
tttccccttccaccat

SEQ ID NO: 171307 - DNA, 16 bp, H. sapiens
tttccccttttattaa

SEQ ID NO: 171308 - DNA, 16 bp, H. sapiens
tttccctaaaatattt

SEQ ID NO: 171309 - DNA, 16 bp, H. sapiens
tttccctacaaaggac

SEQ ID NO: 171310 - DNA, 16 bp, H. sapiens
tttccctcatctgtaa

SEQ ID NO: 171311 - DNA, 16 bp, H. sapiens
tttccctcatgattag

SEQ ID NO: 171312 - DNA, 16 bp, H. sapiens
tttccctcctaggcct

SEQ ID NO: 171313 - DNA, 16 bp, H. sapiens
tttccctgaattctgt

SEQ ID NO: 171314 - DNA, 16 bp, H. sapiens
tttccctgacaattag

SEQ ID NO: 171315 - DNA, 16 bp, H. sapiens
tttccctgatcctctc

SEQ ID NO: 171316 - DNA, 16 bp, H. sapiens
tttccctgatgtttag

SEQ ID NO: 171317 - DNA, 16 bp, H. sapiens
tttccctgggggagtt

SEQ ID NO: 171318 - DNA, 16 bp, H. sapiens
tttccctggtgctggc

SEQ ID NO: 171319 - DNA, 16 bp, H. sapiens
tttcccttcccagcac

SEQ ID NO: 171320 - DNA, 16 bp, H. sapiens
tttcccttctagtttt

SEQ ID NO: 171321 - DNA, 16 bp, H. sapiens
tttcccttgagatttc

SEQ ID NO: 171322 - DNA, 16 bp, H. sapiens
tttcccttgtgggcat

SEQ ID NO: 171323 - DNA, 16 bp, H. sapiens
tttccctttgccttca

SEQ ID NO: 171324 - DNA, 16 bp, H. sapiens
tttcccttttctaaaa

SEQ ID NO: 171325 - DNA, 16 bp, H. sapiens
tttcccttttctgaaa

SEQ ID NO: 171326 - DNA, 16 bp, H. sapiens
tttccctttttaaaaa

SEQ ID NO: 171327 - DNA, 16 bp, H. sapiens
tttcctaaaaatataa

SEQ ID NO: 171328 - DNA, 16 bp, H. sapiens
tttcctaaaagtttta

SEQ ID NO: 171329 - DNA, 16 bp, H. sapiens
tttcctaaagaaataa

SEQ ID NO: 171330 - DNA, 16 bp, H. sapiens
tttcctaaatgtattt

SEQ ID NO: 171331 - DNA, 17 bp, H. sapiens
tttcctaatcaaagaaa

SEQ ID NO: 171332 - DNA, 16 bp, H. sapiens
tttcctaattggtttt

SEQ ID NO: 171333 - DNA, 16 bp, H. sapiens
tttcctaatttgcaaa

SEQ ID NO: 171334 - DNA, 16 bp, H. sapiens
tttcctagaattttgt

SEQ ID NO: 171335 - DNA, 16 bp, H. sapiens
tttcctagctgtgtga

SEQ ID NO: 171336 - DNA, 16 bp, H. sapiens
tttcctaggactgctg

SEQ ID NO: 171337 - DNA, 16 bp, H. sapiens
tttcctaggatttctt

SEQ ID NO: 171338 - DNA, 16 bp, H. sapiens
tttcctaggcagaggt

SEQ ID NO: 171339 - DNA, 16 bp, H. sapiens
tttcctagttctgtga

SEQ ID NO: 171340 - DNA, 16 bp, H. sapiens
tttcctagttgaatac

SEQ ID NO: 171341 - DNA, 16 bp, H. sapiens
tttcctattctgtgaa

SEQ ID NO: 171342 - DNA, 16 bp, H. sapiens
tttcctatttgaaaaa

SEQ ID NO: 171343 - DNA, 16 bp, H. sapiens
tttcctcaaaaaatta

SEQ ID NO: 171344 - DNA, 16 bp, H. sapiens
tttcctcaaaaactta

SEQ ID NO: 171345 - DNA, 16 bp, H. sapiens
tttcctcaaatgcttt

SEQ ID NO: 171346 - DNA, 16 bp, H. sapiens
tttcctcaactggaaa

SEQ ID NO: 171347 - DNA, 16 bp, H. sapiens
tttcctcacctgtaaa

SEQ ID NO: 171348 - DNA, 16 bp, H. sapiens
tttcctcacctgtgaa

SEQ ID NO: 171349 - DNA, 16 bp, H. sapiens
tttcctcagaaaacta

SEQ ID NO: 171350 - DNA, 16 bp, H. sapiens
tttcctcagctgaaaa

SEQ ID NO: 171351 - DNA, 16 bp, H. sapiens
tttcctcatattttaa

SEQ ID NO: 171352 - DNA, 16 bp, H. sapiens
tttcctcatcagtaaa

SEQ ID NO: 171353 - DNA, 16 bp, H. sapiens
tttcctcatccgtaaa

SEQ ID NO: 171354 - DNA, 16 bp, H. sapiens
tttcctcatctaaaaa

SEQ ID NO: 171355 - DNA, 16 bp, H. sapiens
tttcctcatctataaa

SEQ ID NO: 171356 - DNA, 16 bp, H. sapiens
tttcctcatctatcaa

SEQ ID NO: 171357 - DNA, 16 bp, H. sapiens
tttcctcatctatgaa

SEQ ID NO: 171358 - DNA, 16 bp, H. sapiens
tttcctcatctccaaa

SEQ ID NO: 171359 - DNA, 16 bp, H. sapiens
tttcctcatctgtaga

SEQ ID NO: 171360 - DNA, 16 bp, H. sapiens
tttcctcatctgtgag

SEQ ID NO: 171361 - DNA, 16 bp, H. sapiens
tttcctcatcttcatg

SEQ ID NO: 171362 - DNA, 16 bp, H. sapiens
tttcctcatcttcctg

SEQ ID NO: 171363 - DNA, 16 bp, H. sapiens
tttcctcatctttaaa

SEQ ID NO: 171364 - DNA, 16 bp, H. sapiens
tttcctcatgaaatct

SEQ ID NO: 171365 - DNA, 16 bp, H. sapiens
tttcctcatgcccctt

SEQ ID NO: 171366 - DNA, 16 bp, H. sapiens
tttcctcatgtggaaa

SEQ ID NO: 171367 - DNA, 16 bp, H. sapiens
tttcctcattggaaaa

SEQ ID NO: 171368 - DNA, 16 bp, H. sapiens
tttcctcattgtcttg

SEQ ID NO: 171369 - DNA, 16 bp, H. sapiens
tttcctcatttaaaaa

SEQ ID NO: 171370 - DNA, 16 bp, H. sapiens
tttcctcatttataaa

SEQ ID NO: 171371 - DNA, 16 bp, H. sapiens
tttcctcatttttaaa

SEQ ID NO: 171372 - DNA, 16 bp, H. sapiens
tttcctccaaattcct

SEQ ID NO: 171373 - DNA, 16 bp, H. sapiens
tttcctccagcctctg

SEQ ID NO: 171374 - DNA, 16 bp, H. sapiens
tttcctccagttccca

SEQ ID NO: 171375 - DNA, 16 bp, H. sapiens
tttcctccattctgag

SEQ ID NO: 171376 - DNA, 16 bp, H. sapiens
tttcctcccattctgt

SEQ ID NO: 171377 - DNA, 16 bp, H. sapiens
tttcctcctctgcaaa

SEQ ID NO: 171378 - DNA, 16 bp, H. sapiens
tttcctcctctgtgaa

SEQ ID NO: 171379 - DNA, 16 bp, H. sapiens
tttcctcctgggcaca

SEQ ID NO: 171380 - DNA, 16 bp, H. sapiens
tttcctctataaatta

SEQ ID NO: 171381 - DNA, 16 bp, H. sapiens
tttcctctcctgtaaa

SEQ ID NO: 171382 - DNA, 16 bp, H. sapiens
tttcctctgagctgtt

SEQ ID NO: 171383 - DNA, 16 bp, H. sapiens
tttcctctgcaacctc

SEQ ID NO: 171384 - DNA, 16 bp, H. sapiens
tttcctctgcacttcc

SEQ ID NO: 171385 - DNA, 16 bp, H. sapiens
tttcctctgcagcttc

SEQ ID NO: 171386 - DNA, 16 bp, H. sapiens
tttcctctgcctggaa

SEQ ID NO: 171387 - DNA, 16 bp, H. sapiens
tttcctctgtgccagg

SEQ ID NO: 171388 - DNA, 16 bp, H. sapiens
tttcctctgtttttaa

SEQ ID NO: 171389 - DNA, 16 bp, H. sapiens
tttcctcttcccccag

SEQ ID NO: 171390 - DNA, 16 bp, H. sapiens
tttcctcttctgtaaa

SEQ ID NO: 171391 - DNA, 16 bp, H. sapiens
tttcctcttctgtgaa

SEQ ID NO: 171392 - DNA, 16 bp, H. sapiens
tttcctctttctggaa

SEQ ID NO: 171393 - DNA, 16 bp, H. sapiens
tttcctctttggaaaa

SEQ ID NO: 171394 - DNA, 16 bp, H. sapiens
tttcctctttgtaatt

SEQ ID NO: 171395 - DNA, 16 bp, H. sapiens
tttcctcttttaaaat

SEQ ID NO: 171396 - DNA, 16 bp, H. sapiens
tttcctgaaaaaggaa

SEQ ID NO: 171397 - DNA, 16 bp, H. sapiens
tttcctgaaaacattt

SEQ ID NO: 171398 - DNA, 16 bp, H. sapiens
tttcctgaaaatgaaa

SEQ ID NO: 171399 - DNA, 16 bp, H. sapiens
tttcctgaaacatttt

SEQ ID NO: 171400 - DNA, 16 bp, H. sapiens
tttcctgaaagaaaaa

SEQ ID NO: 171401 - DNA, 16 bp, H. sapiens
tttcctgaaataaata

SEQ ID NO: 171402 - DNA, 16 bp, H. sapiens
tttcctgaaatatttt

SEQ ID NO: 171403 - DNA, 16 bp, H. sapiens
tttcctgaacattaaa

SEQ ID NO: 171404 - DNA, 16 bp, H. sapiens
tttcctgaattctttt

SEQ ID NO: 171405 - DNA, 16 bp, H. sapiens
tttcctgaggagtgtt

SEQ ID NO: 171406 - DNA, 16 bp, H. sapiens
tttcctgaggcttcca

SEQ ID NO: 171407 - DNA, 16 bp, H. sapiens
tttcctgaggcttctc

SEQ ID NO: 171408 - DNA, 16 bp, H. sapiens
tttcctgagttttact

SEQ ID NO: 171409 - DNA, 16 bp, H. sapiens
tttcctgatggtattt

SEQ ID NO: 171410 - DNA, 16 bp, H. sapiens
tttcctgatgttttaa

SEQ ID NO: 171411 - DNA, 16 bp, H. sapiens
tttcctgattttataa

SEQ ID NO: 171412 - DNA, 16 bp, H. sapiens
tttcctgatttttcta

SEQ ID NO: 171413 - DNA, 16 bp, H. sapiens
tttcctgcccagccca

SEQ ID NO: 171414 - DNA, 16 bp, H. sapiens
tttcctgccctgagac

SEQ ID NO: 171415 - DNA, 16 bp, H. sapiens
tttcctgcctcagccc

SEQ ID NO: 171416 - DNA, 16 bp, H. sapiens
tttcctgccttctgct

SEQ ID NO: 171417 - DNA, 16 bp, H. sapiens
tttcctgcctttttaa

SEQ ID NO: 171418 - DNA, 16 bp, H. sapiens
tttcctgctgccatcc

SEQ ID NO: 171419 - DNA, 16 bp, H. sapiens
tttcctgctggcctgg

SEQ ID NO: 171420 - DNA, 16 bp, H. sapiens
tttcctgctttaaaaa

SEQ ID NO: 171421 - DNA, 16 bp, H. sapiens
tttcctgctttatctt

SEQ ID NO: 171422 - DNA, 16 bp, H. sapiens
tttcctggaaattttt

SEQ ID NO: 171423 - DNA, 36 bp, H. sapiens
tttcctggagcttgttttaactgtgggaagcatggt

SEQ ID NO: 171424 - DNA, 16 bp, H. sapiens
tttcctggccttgcta

SEQ ID NO: 171425 - DNA, 16 bp, H. sapiens
tttcctggggtgatgg

SEQ ID NO: 171426 - DNA, 16 bp, H. sapiens
tttcctggtctgtaaa

SEQ ID NO: 171427 - DNA, 16 bp, H. sapiens
tttcctggttagtttt

SEQ ID NO: 171428 - DNA, 16 bp, H. sapiens
tttcctggttctgagg

SEQ ID NO: 171429 - DNA, 16 bp, H. sapiens
tttcctggttttccag

SEQ ID NO: 171430 - DNA, 16 bp, H. sapiens
tttcctgtagagatgg

SEQ ID NO: 171431 - DNA, 16 bp, H. sapiens
tttcctgtattttaaa

SEQ ID NO: 171432 - DNA, 16 bp, H. sapiens
tttcctgtcatagctg

SEQ ID NO: 171433 - DNA, 16 bp, H. sapiens
tttcctgtgctgttct

SEQ ID NO: 171434 - DNA, 16 bp, H. sapiens
tttcctgtggatgtgg

SEQ ID NO: 171435 - DNA, 16 bp, H. sapiens
tttcctgtggcttctg

SEQ ID NO: 171436 - DNA, 16 bp, H. sapiens
tttcctgtttcttcat

SEQ ID NO: 171437 - DNA, 16 bp, H. sapiens
tttcctgttttcaatt

SEQ ID NO: 171438 - DNA, 16 bp, H. sapiens
tttcctgtttttgaaa

SEQ ID NO: 171439 - DNA, 16 bp, H. sapiens
tttccttaaaataatt

SEQ ID NO: 171440 - DNA, 16 bp, H. sapiens
tttccttaaataaatt

SEQ ID NO: 171441 - DNA, 16 bp, H. sapiens
tttccttaaatgtttt

SEQ ID NO: 171442 - DNA, 16 bp, H. sapiens
tttccttaactgtaaa

SEQ ID NO: 171443 - DNA, 16 bp, H. sapiens
tttccttacctctaaa

SEQ ID NO: 171444 - DNA, 16 bp, H. sapiens
tttccttacctgtaaa

SEQ ID NO: 171445 - DNA, 16 bp, H. sapiens
tttccttacttttaaa

SEQ ID NO: 171446 - DNA, 16 bp, H. sapiens
tttccttagctgtaaa

SEQ ID NO: 171447 - DNA, 16 bp, H. sapiens
tttccttagtttttac

SEQ ID NO: 171448 - DNA, 16 bp, H. sapiens
tttccttataaataaa

SEQ ID NO: 171449 - DNA, 16 bp, H. sapiens
tttccttatatataaa

SEQ ID NO: 171450 - DNA, 16 bp, H. sapiens
tttccttatattaaaa

SEQ ID NO: 171451 - DNA, 16 bp, H. sapiens
tttccttatccacaat

SEQ ID NO: 171452 - DNA, 16 bp, H. sapiens
tttccttatctataaa

SEQ ID NO: 171453 - DNA, 16 bp, H. sapiens
tttccttatctggaaa

SEQ ID NO: 171454 - DNA, 16 bp, H. sapiens
tttccttatctgtaaa

SEQ ID NO: 171455 - DNA, 16 bp, H. sapiens
tttccttatttcaaaa

SEQ ID NO: 171456 - DNA, 16 bp, H. sapiens
tttccttatttggaaa

SEQ ID NO: 171457 - DNA, 16 bp, H. sapiens
tttccttatttgtaaa

SEQ ID NO: 171458 - DNA, 16 bp, H. sapiens
tttccttattttgaaa

SEQ ID NO: 171459 - DNA, 16 bp, H. sapiens
tttccttcaaagaaaa

SEQ ID NO: 171460 - DNA, 16 bp, H. sapiens
tttccttcacagcatt

SEQ ID NO: 171461 - DNA, 16 bp, H. sapiens
tttccttcagcatttt

SEQ ID NO: 171462 - DNA, 16 bp, H. sapiens
tttccttcagtctttt

SEQ ID NO: 171463 - DNA, 16 bp, H. sapiens
tttccttcatagcatt

SEQ ID NO: 171464 - DNA, 16 bp, H. sapiens
tttccttcatcttaac

SEQ ID NO: 171465 - DNA, 16 bp, H. sapiens
tttccttcatgtttct

SEQ ID NO: 171466 - DNA, 16 bp, H. sapiens
tttccttcatttctga

SEQ ID NO: 171467 - DNA, 16 bp, H. sapiens
tttccttccagaaaaa

SEQ ID NO: 171468 - DNA, 16 bp, H. sapiens
tttccttccagacttt

SEQ ID NO: 171469 - DNA, 16 bp, H. sapiens
tttccttccttttaag

SEQ ID NO: 171470 - DNA, 16 bp, H. sapiens
tttccttctaacactc

SEQ ID NO: 171471 - DNA, 16 bp, H. sapiens
tttccttctcacttca

SEQ ID NO: 171472 - DNA, 16 bp, H. sapiens
tttccttctccagcct

SEQ ID NO: 171473 - DNA, 16 bp, H. sapiens
tttccttctcctgcat

SEQ ID NO: 171474 - DNA, 16 bp, H. sapiens
tttccttctctgccat

SEQ ID NO: 171475 - DNA, 16 bp, H. sapiens
tttccttctgacagac

SEQ ID NO: 171476 - DNA, 16 bp, H. sapiens
tttccttctgatttct

SEQ ID NO: 171477 - DNA, 16 bp, H. sapiens
tttccttctgtaaaat

SEQ ID NO: 171478 - DNA, 16 bp, H. sapiens
tttccttctttaaaat

SEQ ID NO: 171479 - DNA, 16 bp, H. sapiens
tttccttcttttgaaa

SEQ ID NO: 171480 - DNA, 16 bp, H. sapiens
tttccttgaaagaaaa

SEQ ID NO: 171481 - DNA, 16 bp, H. sapiens
tttccttgaacttatt

SEQ ID NO: 171482 - DNA, 16 bp, H. sapiens
tttccttgaatatttt

SEQ ID NO: 171483 - DNA, 16 bp, H. sapiens
tttccttgctggctgt

SEQ ID NO: 171484 - DNA, 16 bp, H. sapiens
tttccttggaaaaaaa

SEQ ID NO: 171485 - DNA, 16 bp, H. sapiens
tttccttgtctcagat

SEQ ID NO: 171486 - DNA, 16 bp, H. sapiens
tttccttgtgtgtaaa

SEQ ID NO: 171487 - DNA, 16 bp, H. sapiens
tttccttgttttgatg

SEQ ID NO: 171488 - DNA, 16 bp, H. sapiens
tttcctttaaaaaaaa

SEQ ID NO: 171489 - DNA, 16 bp, H. sapiens
tttcctttaaaacata

SEQ ID NO: 171490 - DNA, 16 bp, H. sapiens
tttcctttaagaaaaa

SEQ ID NO: 171491 - DNA, 16 bp, H. sapiens
tttcctttataaatca

SEQ ID NO: 171492 - DNA, 16 bp, H. sapiens
tttcctttatcatgtg

SEQ ID NO: 171493 - DNA, 16 bp, H. sapiens
tttcctttatttgaaa

SEQ ID NO: 171494 - DNA, 16 bp, H. sapiens
tttcctttattttgaa

SEQ ID NO: 171495 - DNA, 16 bp, H. sapiens
tttcctttcaaagaaa

SEQ ID NO: 171496 - DNA, 16 bp, H. sapiens
tttcctttcagcattt

SEQ ID NO: 171497 - DNA, 16 bp, H. sapiens
tttcctttcagttctg

SEQ ID NO: 171498 - DNA, 16 bp, H. sapiens
tttcctttccctcaaa

SEQ ID NO: 171499 - DNA, 16 bp, H. sapiens
tttcctttcctgtgaa

SEQ ID NO: 171500 - DNA, 16 bp, H. sapiens
tttcctttcctttgta

SEQ ID NO: 171501 - DNA, 16 bp, H. sapiens
tttcctttctctggaa

SEQ ID NO: 171502 - DNA, 16 bp, H. sapiens
tttcctttcttataaa

SEQ ID NO: 171503 - DNA, 16 bp, H. sapiens
tttcctttcttctgta

SEQ ID NO: 171504 - DNA, 16 bp, H. sapiens
tttcctttgaggaaaa

SEQ ID NO: 171505 - DNA, 16 bp, H. sapiens
tttcctttgcatttca

SEQ ID NO: 171506 - DNA, 16 bp, H. sapiens
tttcctttgcccattt

SEQ ID NO: 171507 - DNA, 16 bp, H. sapiens
tttcctttgctgattt

SEQ ID NO: 171508 - DNA, 16 bp, H. sapiens
tttcctttgctgtgga

SEQ ID NO: 171509 - DNA, 16 bp, H. sapiens
tttcctttggaaaact

SEQ ID NO: 171510 - DNA, 16 bp, H. sapiens
tttcctttgtaaaaat

SEQ ID NO: 171511 - DNA, 16 bp, H. sapiens
tttcctttgtaatttc

SEQ ID NO: 171512 - DNA, 16 bp, H. sapiens
tttcctttgtcatttc

SEQ ID NO: 171513 - DNA, 16 bp, H. sapiens
tttccttttacaacat

SEQ ID NO: 171514 - DNA, 16 bp, H. sapiens
tttccttttccatttg

SEQ ID NO: 171515 - DNA, 16 bp, H. sapiens
tttccttttctagaat

SEQ ID NO: 171516 - DNA, 16 bp, H. sapiens
tttccttttctctaaa

SEQ ID NO: 171517 - DNA, 16 bp, H. sapiens
tttccttttctgtaaa

SEQ ID NO: 171518 - DNA, 16 bp, H. sapiens
tttccttttgacattt

SEQ ID NO: 171519 - DNA, 16 bp, H. sapiens
tttccttttgatccag

SEQ ID NO: 171520 - DNA, 16 bp, H. sapiens
tttccttttgatttcc

SEQ ID NO: 171521 - DNA, 16 bp, H. sapiens
tttccttttgcttaat

SEQ ID NO: 171522 - DNA, 16 bp, H. sapiens
tttcctttttaaaaga

SEQ ID NO: 171523 - DNA, 16 bp, H. sapiens
tttcctttttaaagct

SEQ ID NO: 171524 - DNA, 16 bp, H. sapiens
tttcctttttaaccat

SEQ ID NO: 171525 - DNA, 16 bp, H. sapiens
tttcctttttcaaaat

SEQ ID NO: 171526 - DNA, 16 bp, H. sapiens
tttcctttttcaaact

SEQ ID NO: 171527 - DNA, 16 bp, H. sapiens
tttcctttttctgaaa

SEQ ID NO: 171528 - DNA, 16 bp, H. sapiens
tttccttttttaaaga

SEQ ID NO: 171529 - DNA, 16 bp, H. sapiens
tttccttttttgagat

SEQ ID NO: 171530 - DNA, 17 bp, H. sapiens
tttcgaattcctgacct

SEQ ID NO: 171531 - DNA, 18 bp, H. sapiens
tttcgccatgttggccag

SEQ ID NO: 171532 - DNA, 16 bp, H. sapiens
tttcgccatgttgtcc

SEQ ID NO: 171533 - DNA, 16 bp, H. sapiens
tttcggaggccgaggc

SEQ ID NO: 171534 - DNA, 16 bp, H. sapiens
tttcggaggctgaggc

SEQ ID NO: 171535 - DNA, 16 bp, H. sapiens
tttcgggtggagagtt

SEQ ID NO: 171536 - DNA, 18 bp, H. sapiens
tttcgtatttttagtaga

SEQ ID NO: 171537 - DNA, 16 bp, H. sapiens
tttcgtcgtgttggcc

SEQ ID NO: 171538 - DNA, 18 bp, H. sapiens
tttcgttcttgttgccca

SEQ ID NO: 171539 - DNA, 16 bp, H. sapiens
tttctaaaaaagaaat

SEQ ID NO: 171540 - DNA, 16 bp, H. sapiens
tttctaaaaaagcaaa

SEQ ID NO: 171541 - DNA, 16 bp, H. sapiens
tttctaaaaacaattt

SEQ ID NO: 171542 - DNA, 16 bp, H. sapiens
tttctaaaaaccagct

SEQ ID NO: 171543 - DNA, 16 bp, H. sapiens
tttctaaaaaccattt

SEQ ID NO: 171544 - DNA, 16 bp, H. sapiens
tttctaaaaagaggaa

SEQ ID NO: 171545 - DNA, 16 bp, H. sapiens
tttctaaaaagtaaaa

SEQ ID NO: 171546 - DNA, 16 bp, H. sapiens
tttctaaaaatcaaat

SEQ ID NO: 171547 - DNA, 16 bp, H. sapiens
tttctaaaaatgattt

SEQ ID NO: 171548 - DNA, 16 bp, H. sapiens
tttctaaaaatgtatt

SEQ ID NO: 171549 - DNA, 16 bp, H. sapiens
tttctaaaaatgtttt

SEQ ID NO: 171550 - DNA, 16 bp, H. sapiens
tttctaaaaattctgt

SEQ ID NO: 171551 - DNA, 16 bp, H. sapiens
tttctaaaacacaaaa

SEQ ID NO: 171552 - DNA, 16 bp, H. sapiens
tttctaaaacacagat

SEQ ID NO: 171553 - DNA, 16 bp, H. sapiens
tttctaaaacatcatt

SEQ ID NO: 171554 - DNA, 16 bp, H. sapiens
tttctaaaagaaaaaa

SEQ ID NO: 171555 - DNA, 16 bp, H. sapiens
tttctaaaagaaaaat

SEQ ID NO: 171556 - DNA, 16 bp, H. sapiens
tttctaaaagaagaaa

SEQ ID NO: 171557 - DNA, 16 bp, H. sapiens
tttctaaaagataaaa

SEQ ID NO: 171558 - DNA, 16 bp, H. sapiens
tttctaaaaggaaata

SEQ ID NO: 171559 - DNA, 16 bp, H. sapiens
tttctaaaataaaagt

SEQ ID NO: 171560 - DNA, 16 bp, H. sapiens
tttctaaaataaacat

SEQ ID NO: 171561 - DNA, 16 bp, H. sapiens
tttctaaaatagattt

SEQ ID NO: 171562 - DNA, 16 bp, H. sapiens
tttctaaaatatacat

SEQ ID NO: 171563 - DNA, 16 bp, H. sapiens
tttctaaaatatgcat

SEQ ID NO: 171564 - DNA, 16 bp, H. sapiens
tttctaaaatattcta

SEQ ID NO: 171565 - DNA, 16 bp, H. sapiens
tttctaaaatgaaaat

SEQ ID NO: 171566 - DNA, 16 bp, H. sapiens
tttctaaaatgcaaat

SEQ ID NO: 171567 - DNA, 16 bp, H. sapiens
tttctaaaatgtaaat

SEQ ID NO: 171568 - DNA, 16 bp, H. sapiens
tttctaaaatgtattt

SEQ ID NO: 171569 - DNA, 16 bp, H. sapiens
tttctaaaatgtttat

SEQ ID NO: 171570 - DNA, 16 bp, H. sapiens
tttctaaaatttcaaa

SEQ ID NO: 171571 - DNA, 16 bp, H. sapiens
tttctaaaatttgaaa

SEQ ID NO: 171572 - DNA, 16 bp, H. sapiens
tttctaaacagcaaag

SEQ ID NO: 171573 - DNA, 16 bp, H. sapiens
tttctaaacataaaat

SEQ ID NO: 171574 - DNA, 16 bp, H. sapiens
tttctaaacatacaat

SEQ ID NO: 171575 - DNA, 16 bp, H. sapiens
tttctaaactataaat

SEQ ID NO: 171576 - DNA, 16 bp, H. sapiens
tttctaaactgattga

SEQ ID NO: 171577 - DNA, 16 bp, H. sapiens
tttctaaagaaaaatt

SEQ ID NO: 171578 - DNA, 16 bp, H. sapiens
tttctaaagaaaagaa

SEQ ID NO: 171579 - DNA, 16 bp, H. sapiens
tttctaaagaaatgaa

SEQ ID NO: 171580 - DNA, 16 bp, H. sapiens
tttctaaagaaatttt

SEQ ID NO: 171581 - DNA, 16 bp, H. sapiens
tttctaaagaagaaaa

SEQ ID NO: 171582 - DNA, 16 bp, H. sapiens
tttctaaagaagaaat

SEQ ID NO: 171583 - DNA, 16 bp, H. sapiens
tttctaaagaatattt

SEQ ID NO: 171584 - DNA, 16 bp, H. sapiens
tttctaaagcatattt

SEQ ID NO: 171585 - DNA, 16 bp, H. sapiens
tttctaaagcattttc

SEQ ID NO: 171586 - DNA, 16 bp, H. sapiens
tttctaaagcattttt

SEQ ID NO: 171587 - DNA, 16 bp, H. sapiens
tttctaaataaagttt

SEQ ID NO: 171588 - DNA, 16 bp, H. sapiens
tttctaaatcataaaa

SEQ ID NO: 171589 - DNA, 16 bp, H. sapiens
tttctaaatctgtgaa

SEQ ID NO: 171590 - DNA, 16 bp, H. sapiens
tttctaaatgacattt

SEQ ID NO: 171591 - DNA, 16 bp, H. sapiens
tttctaaatgtaaaaa

SEQ ID NO: 171592 - DNA, 16 bp, H. sapiens
tttctaaatgtttatt

SEQ ID NO: 171593 - DNA, 16 bp, H. sapiens
tttctaaatttccttc

SEQ ID NO: 171594 - DNA, 16 bp, H. sapiens
tttctaaatttggaaa

SEQ ID NO: 171595 - DNA, 16 bp, H. sapiens
tttctaaattttctgt

SEQ ID NO: 171596 - DNA, 16 bp, H. sapiens
tttctaacaaattccc

SEQ ID NO: 171597 - DNA, 16 bp, H. sapiens
tttctaactaaaattt

SEQ ID NO: 171598 - DNA, 16 bp, H. sapiens
tttctaacttgtattt

SEQ ID NO: 171599 - DNA, 16 bp, H. sapiens
tttctaagaaagcttc

SEQ ID NO: 171600 - DNA, 16 bp, H. sapiens
tttctaagaatgtatc

SEQ ID NO: 171601 - DNA, 16 bp, H. sapiens
tttctaagagattttt

SEQ ID NO: 171602 - DNA, 16 bp, H. sapiens
tttctaagcaaagtgt

SEQ ID NO: 171603 - DNA, 16 bp, H. sapiens
tttctaaggatagcag

SEQ ID NO: 171604 - DNA, 16 bp, H. sapiens
tttctaataaaaatac

SEQ ID NO: 171605 - DNA, 16 bp, H. sapiens
tttctaataactttaa

SEQ ID NO: 171606 - DNA, 16 bp, H. sapiens
tttctaataagaaatc

SEQ ID NO: 171607 - DNA, 16 bp, H. sapiens
tttctaataccattct

SEQ ID NO: 171608 - DNA, 16 bp, H. sapiens
tttctaatgtaatttt

SEQ ID NO: 171609 - DNA, 16 bp, H. sapiens
tttctaatgttttaaa

SEQ ID NO: 171610 - DNA, 23 bp, H. sapiens
tttctaattatgcctgaaagccc

SEQ ID NO: 171611 - DNA, 16 bp, H. sapiens
tttctaattctaaaat

SEQ ID NO: 171612 - DNA, 16 bp, H. sapiens
tttctaattctgtgaa

SEQ ID NO: 171613 - DNA, 16 bp, H. sapiens
tttctaattgagaaaa

SEQ ID NO: 171614 - DNA, 16 bp, H. sapiens
tttctaatttcttgaa

SEQ ID NO: 171615 - DNA, 16 bp, H. sapiens
tttctaatttgcacaa

SEQ ID NO: 171616 - DNA, 16 bp, H. sapiens
tttctaatttgtacaa

SEQ ID NO: 171617 - DNA, 16 bp, H. sapiens
tttctaattttgtata

SEQ ID NO: 171618 - DNA, 16 bp, H. sapiens
tttctacaaagaaaaa

SEQ ID NO: 171619 - DNA, 16 bp, H. sapiens
tttctacaaagaatat

SEQ ID NO: 171620 - DNA, 16 bp, H. sapiens
tttctacactgttgtg

SEQ ID NO: 171621 - DNA, 16 bp, H. sapiens
tttctacattttctaa

SEQ ID NO: 171622 - DNA, 16 bp, H. sapiens
tttctaccaaaaaaaa

SEQ ID NO: 171623 - DNA, 16 bp, H. sapiens
tttctaccaaacattt

SEQ ID NO: 171624 - DNA, 16 bp, H. sapiens
tttctactaaaaatat

SEQ ID NO: 171625 - DNA, 16 bp, H. sapiens
tttctactaaatgtgt

SEQ ID NO: 171626 - DNA, 16 bp, H. sapiens
tttctactctgccatc

SEQ ID NO: 171627 - DNA, 20 bp, H. sapiens
tttctactgaaaatacaaaa

SEQ ID NO: 171628 - DNA, 16 bp, H. sapiens
tttctactgaatgcat

SEQ ID NO: 171629 - DNA, 16 bp, H. sapiens
tttctactgaatgtgt

SEQ ID NO: 171630 - DNA, 16 bp, H. sapiens
tttctacttaaaaaaa

SEQ ID NO: 171631 - DNA, 16 bp, H. sapiens
tttctacttaaaatat

SEQ ID NO: 171632 - DNA, 16 bp, H. sapiens
tttctacttccttgag

SEQ ID NO: 171633 - DNA, 16 bp, H. sapiens
tttctagaaaaatatt

SEQ ID NO: 171634 - DNA, 16 bp, H. sapiens
tttctagaaacaaatg

SEQ ID NO: 171635 - DNA, 16 bp, H. sapiens
tttctagaaagagaaa

SEQ ID NO: 171636 - DNA, 16 bp, H. sapiens
tttctagaaataaaat

SEQ ID NO: 171637 - DNA, 16 bp, H. sapiens
tttctagaaatgtatc

SEQ ID NO: 171638 - DNA, 16 bp, H. sapiens
tttctagaagaaaaca

SEQ ID NO: 171639 - DNA, 16 bp, H. sapiens
tttctagaagttttat

SEQ ID NO: 171640 - DNA, 16 bp, H. sapiens
tttctagaatgtcatg

SEQ ID NO: 171641 - DNA, 16 bp, H. sapiens
tttctagaattatttt

SEQ ID NO: 171642 - DNA, 16 bp, H. sapiens
tttctagacctgccct

SEQ ID NO: 171643 - DNA, 16 bp, H. sapiens
tttctagagagaaaaa

SEQ ID NO: 171644 - DNA, 16 bp, H. sapiens
tttctagagattaaaa

SEQ ID NO: 171645 - DNA, 16 bp, H. sapiens
tttctagatatacagt

SEQ ID NO: 171646 - DNA, 16 bp, H. sapiens
tttctagctgccttta

SEQ ID NO: 171647 - DNA, 16 bp, H. sapiens
tttctagctgtgtgac

SEQ ID NO: 171648 - DNA, 16 bp, H. sapiens
tttctagctgtgtgat

SEQ ID NO: 171649 - DNA, 16 bp, H. sapiens
tttctaggagaaaaac

SEQ ID NO: 171650 - DNA, 16 bp, H. sapiens
tttctaggtattttat

SEQ ID NO: 171651 - DNA, 16 bp, H. sapiens
tttctaggttggggaa

SEQ ID NO: 171652 - DNA, 16 bp, H. sapiens
tttctagtaaattttt

SEQ ID NO: 171653 - DNA, 16 bp, H. sapiens
tttctagtaaccacat

SEQ ID NO: 171654 - DNA, 16 bp, H. sapiens
tttctagtaatttatt

SEQ ID NO: 171655 - DNA, 16 bp, H. sapiens
tttctagttcagtgaa

SEQ ID NO: 171656 - DNA, 16 bp, H. sapiens
tttctagtttcttaaa

SEQ ID NO: 171657 - DNA, 16 bp, H. sapiens
tttctagtttcttgaa

SEQ ID NO: 171658 - DNA, 16 bp, H. sapiens
tttctagtttgtgtgc

SEQ ID NO: 171659 - DNA, 16 bp, H. sapiens
tttctagtttttggct

SEQ ID NO: 171660 - DNA, 16 bp, H. sapiens
tttctataaaatggaa

SEQ ID NO: 171661 - DNA, 16 bp, H. sapiens
tttctataaagaaata

SEQ ID NO: 171662 - DNA, 16 bp, H. sapiens
tttctataacagaata

SEQ ID NO: 171663 - DNA, 16 bp, H. sapiens
tttctatacctcagtt

SEQ ID NO: 171664 - DNA, 16 bp, H. sapiens
tttctatataccaaaa

SEQ ID NO: 171665 - DNA, 16 bp, H. sapiens
tttctatattcaagat

SEQ ID NO: 171666 - DNA, 16 bp, H. sapiens
tttctatattttggat

SEQ ID NO: 171667 - DNA, 16 bp, H. sapiens
tttctatattttgtaa

SEQ ID NO: 171668 - DNA, 16 bp, H. sapiens
tttctatcaccacaga

SEQ ID NO: 171669 - DNA, 16 bp, H. sapiens
tttctatgaaaaatga

SEQ ID NO: 171670 - DNA, 16 bp, H. sapiens
tttctatgaaaatatt

SEQ ID NO: 171671 - DNA, 16 bp, H. sapiens
tttctatgaatatatt

SEQ ID NO: 171672 - DNA, 16 bp, H. sapiens
tttctatgagtttgat

SEQ ID NO: 171673 - DNA, 16 bp, H. sapiens
tttctatgtaaaaaat

SEQ ID NO: 171674 - DNA, 16 bp, H. sapiens
tttctatgtatttata

SEQ ID NO: 171675 - DNA, 16 bp, H. sapiens
tttctatgtctttgct

SEQ ID NO: 171676 - DNA, 16 bp, H. sapiens
tttctattaagaaaaa

SEQ ID NO: 171677 - DNA, 30 bp, H. sapiens
tttctattccacaaaaccgccattgtcatc

SEQ ID NO: 171678 - DNA, 55 bp, H. sapiens
tttctattccacaaaactgccattgtcatcatggcccgttctcaatgagctgttg

SEQ ID NO: 171679 - DNA, 16 bp, H. sapiens
tttctattggcatgga

SEQ ID NO: 171680 - DNA, 16 bp, H. sapiens
tttctattgtaaattt

SEQ ID NO: 171681 - DNA, 16 bp, H. sapiens
tttctatttactttgc

SEQ ID NO: 171682 - DNA, 16 bp, H. sapiens
tttctatttccttcag

SEQ ID NO: 171683 - DNA, 16 bp, H. sapiens
tttctatttctgtcaa

SEQ ID NO: 171684 - DNA, 16 bp, H. sapiens
tttctatttcttcaaa

SEQ ID NO: 171685 - DNA, 16 bp, H. sapiens
tttctatttgaaaatt

SEQ ID NO: 171686 - DNA, 16 bp, H. sapiens
tttctatttgaatatg

SEQ ID NO: 171687 - DNA, 16 bp, H. sapiens
tttctatttgcatgat

SEQ ID NO: 171688 - DNA, 16 bp, H. sapiens
tttctatttgcatttc

SEQ ID NO: 171689 - DNA, 16 bp, H. sapiens
tttctatttggacaat

SEQ ID NO: 171690 - DNA, 16 bp, H. sapiens
tttctatttgtaaaat

SEQ ID NO: 171691 - DNA, 16 bp, H. sapiens
tttctattttaaaagt

SEQ ID NO: 171692 - DNA, 16 bp, H. sapiens
tttctattttagaaaa

SEQ ID NO: 171693 - DNA, 16 bp, H. sapiens
tttctatttttaaaag

SEQ ID NO: 171694 - DNA, 16 bp, H. sapiens
tttctatttttgaaat

SEQ ID NO: 171695 - DNA, 16 bp, H. sapiens
tttctatttttgtaga

SEQ ID NO: 171696 - DNA, 16 bp, H. sapiens
tttctattttttgaaa

SEQ ID NO: 171697 - DNA, 16 bp, H. sapiens
tttctcaaaaaaatat

SEQ ID NO: 171698 - DNA, 16 bp, H. sapiens
tttctcaaaaatatat

SEQ ID NO: 171699 - DNA, 16 bp, H. sapiens
tttctcaaaaatgagt

SEQ ID NO: 171700 - DNA, 16 bp, H. sapiens
tttctcaaaagttaaa

SEQ ID NO: 171701 - DNA, 16 bp, H. sapiens
tttctcaaaatctaaa

SEQ ID NO: 171702 - DNA, 16 bp, H. sapiens
tttctcaaaattaaaa

SEQ ID NO: 171703 - DNA, 16 bp, H. sapiens
tttctcaaaattttca

SEQ ID NO: 171704 - DNA, 16 bp, H. sapiens
tttctcaaactttcct

SEQ ID NO: 171705 - DNA, 16 bp, H. sapiens
tttctcaaagaaataa

SEQ ID NO: 171706 - DNA, 16 bp, H. sapiens
tttctcaaagaacata

SEQ ID NO: 171707 - DNA, 16 bp, H. sapiens
tttctcaaagaggggg

SEQ ID NO: 171708 - DNA, 16 bp, H. sapiens
tttctcaaatataaaa

SEQ ID NO: 171709 - DNA, 16 bp, H. sapiens
tttctcaaccttggta

SEQ ID NO: 171710 - DNA, 16 bp, H. sapiens
tttctcaatcttggca

SEQ ID NO: 171711 - DNA, 16 bp, H. sapiens
tttctcaattgtaaaa

SEQ ID NO: 171712 - DNA, 16 bp, H. sapiens
tttctcaatttaaaaa

SEQ ID NO: 171713 - DNA, 16 bp, H. sapiens
tttctcaatttcaaaa

SEQ ID NO: 171714 - DNA, 16 bp, H. sapiens
tttctcacacttctgg

SEQ ID NO: 171715 - DNA, 16 bp, H. sapiens
tttctcacagaaatag

SEQ ID NO: 171716 - DNA, 16 bp, H. sapiens
tttctcacagtttttg

SEQ ID NO: 171717 - DNA, 16 bp, H. sapiens
tttctcaccattaaat

SEQ ID NO: 171718 - DNA, 16 bp, H. sapiens
tttctcaccattctgg

SEQ ID NO: 171719 - DNA, 16 bp, H. sapiens
tttctcacccataaaa

SEQ ID NO: 171720 - DNA, 16 bp, H. sapiens
tttctcacctgaaaat

SEQ ID NO: 171721 - DNA, 16 bp, H. sapiens
tttctcacctgtaaga

SEQ ID NO: 171722 - DNA, 16 bp, H. sapiens
tttctcactgtcataa

SEQ ID NO: 171723 - DNA, 16 bp, H. sapiens
tttctcacttttaaaa

SEQ ID NO: 171724 - DNA, 16 bp, H. sapiens
tttctcacttttggaa

SEQ ID NO: 171725 - DNA, 16 bp, H. sapiens
tttctcagaaaaaaat

SEQ ID NO: 171726 - DNA, 16 bp, H. sapiens
tttctcagaaaaccaa

SEQ ID NO: 171727 - DNA, 16 bp, H. sapiens
tttctcagaaaccttc

SEQ ID NO: 171728 - DNA, 16 bp, H. sapiens
tttctcagaaatcttc

SEQ ID NO: 171729 - DNA, 16 bp, H. sapiens
tttctcagaagtaaaa

SEQ ID NO: 171730 - DNA, 16 bp, H. sapiens
tttctcagaatttctt

SEQ ID NO: 171731 - DNA, 16 bp, H. sapiens
tttctcagaatttttc

SEQ ID NO: 171732 - DNA, 16 bp, H. sapiens
tttctcagaggttttg

SEQ ID NO: 171733 - DNA, 16 bp, H. sapiens
tttctcagattttaaa

SEQ ID NO: 171734 - DNA, 16 bp, H. sapiens
tttctcagcaatgttt

SEQ ID NO: 171735 - DNA, 16 bp, H. sapiens
tttctcagcatccttg

SEQ ID NO: 171736 - DNA, 16 bp, H. sapiens
tttctcagcatttgct

SEQ ID NO: 171737 - DNA, 16 bp, H. sapiens
tttctcagccttttgg

SEQ ID NO: 171738 - DNA, 16 bp, H. sapiens
tttctcagctgcaaaa

SEQ ID NO: 171739 - DNA, 16 bp, H. sapiens
tttctcaggacctctt

SEQ ID NO: 171740 - DNA, 16 bp, H. sapiens
tttctcaggctggtct

SEQ ID NO: 171741 - DNA, 16 bp, H. sapiens
tttctcagtcttttcc

SEQ ID NO: 171742 - DNA, 16 bp, H. sapiens
tttctcagtgaaataa

SEQ ID NO: 171743 - DNA, 16 bp, H. sapiens
tttctcagttaaaaaa

SEQ ID NO: 171744 - DNA, 16 bp, H. sapiens
tttctcagttccaaga

SEQ ID NO: 171745 - DNA, 16 bp, H. sapiens
tttctcagttgtaaaa

SEQ ID NO: 171746 - DNA, 16 bp, H. sapiens
tttctcagttttctct

SEQ ID NO: 171747 - DNA, 16 bp, H. sapiens
tttctcatatgtaaaa

SEQ ID NO: 171748 - DNA, 16 bp, H. sapiens
tttctcatatttgaaa

SEQ ID NO: 171749 - DNA, 16 bp, H. sapiens
tttctcatcagaaata

SEQ ID NO: 171750 - DNA, 16 bp, H. sapiens
tttctcatccataaaa

SEQ ID NO: 171751 - DNA, 16 bp, H. sapiens
tttctcatctgaaaag

SEQ ID NO: 171752 - DNA, 16 bp, H. sapiens
tttctcatctgtaaaa

SEQ ID NO: 171753 - DNA, 16 bp, H. sapiens
tttctcatctgtcaaa

SEQ ID NO: 171754 - DNA, 16 bp, H. sapiens
tttctcatgcttttct

SEQ ID NO: 171755 - DNA, 16 bp, H. sapiens
tttctcatgtataaaa

SEQ ID NO: 171756 - DNA, 16 bp, H. sapiens
tttctcattaaaatat

SEQ ID NO: 171757 - DNA, 16 bp, H. sapiens
tttctcattgcctctc

SEQ ID NO: 171758 - DNA, 16 bp, H. sapiens
tttctcatttaaaaaa

SEQ ID NO: 171759 - DNA, 16 bp, H. sapiens
tttctcatttaatcct

SEQ ID NO: 171760 - DNA, 16 bp, H. sapiens
tttctcatttgtaaat

SEQ ID NO: 171761 - DNA, 16 bp, H. sapiens
tttctcatttttcaaa

SEQ ID NO: 171762 - DNA, 16 bp, H. sapiens
tttctccaaaagattt

SEQ ID NO: 171763 - DNA, 16 bp, H. sapiens
tttctccaaacaagat

SEQ ID NO: 171764 - DNA, 16 bp, H. sapiens
tttctccaaagaaaac

SEQ ID NO: 171765 - DNA, 16 bp, H. sapiens
tttctccaaagaagac

SEQ ID NO: 171766 - DNA, 16 bp, H. sapiens
tttctccaaagataat

SEQ ID NO: 171767 - DNA, 16 bp, H. sapiens
tttctccaaagatgat

SEQ ID NO: 171768 - DNA, 16 bp, H. sapiens
tttctccaaatataag

SEQ ID NO: 171769 - DNA, 16 bp, H. sapiens
tttctccaaggagcct

SEQ ID NO: 171770 - DNA, 16 bp, H. sapiens
tttctccaattaattt

SEQ ID NO: 171771 - DNA, 16 bp, H. sapiens
tttctccacaaccttg

SEQ ID NO: 171772 - DNA, 16 bp, H. sapiens
tttctccacagcctca

SEQ ID NO: 171773 - DNA, 16 bp, H. sapiens
tttctccacatcctca

SEQ ID NO: 171774 - DNA, 16 bp, H. sapiens
tttctccacatcctcc

SEQ ID NO: 171775 - DNA, 16 bp, H. sapiens
tttctccacatcctct

SEQ ID NO: 171776 - DNA, 16 bp, H. sapiens
tttctccacatcttct

SEQ ID NO: 171777 - DNA, 16 bp, H. sapiens
tttctccacctccttg

SEQ ID NO: 171778 - DNA, 16 bp, H. sapiens
tttctccacctttttg

SEQ ID NO: 171779 - DNA, 16 bp, H. sapiens
tttctccagagaagat

SEQ ID NO: 171780 - DNA, 16 bp, H. sapiens
tttctccagggacccc

SEQ ID NO: 171781 - DNA, 16 bp, H. sapiens
tttctccagtgctgga

SEQ ID NO: 171782 - DNA, 16 bp, H. sapiens
tttctccatagcctca

SEQ ID NO: 171783 - DNA, 16 bp, H. sapiens
tttctccatatcctct

SEQ ID NO: 171784 - DNA, 16 bp, H. sapiens
tttctccatattttaa

SEQ ID NO: 171785 - DNA, 16 bp, H. sapiens
tttctccatgtctttt

SEQ ID NO: 171786 - DNA, 20 bp, H. sapiens
tttctccatgttggtcaggt

SEQ ID NO: 171787 - DNA, 16 bp, H. sapiens
tttctccatgttggtt

SEQ ID NO: 171788 - DNA, 16 bp, H. sapiens
tttctccattcagtat

SEQ ID NO: 171789 - DNA, 16 bp, H. sapiens
tttctccattgtcttt

SEQ ID NO: 171790 - DNA, 16 bp, H. sapiens
tttctccattgtgtgt

SEQ ID NO: 171791 - DNA, 16 bp, H. sapiens
tttctccatttattca

SEQ ID NO: 171792 - DNA, 16 bp, H. sapiens
tttctccatttctgtc

SEQ ID NO: 171793 - DNA, 16 bp, H. sapiens
tttctccatttgtaaa

SEQ ID NO: 171794 - DNA, 16 bp, H. sapiens
tttctccattttaaaa

SEQ ID NO: 171795 - DNA, 16 bp, H. sapiens
tttctcccaaataaat

SEQ ID NO: 171796 - DNA, 16 bp, H. sapiens
tttctcccactctata

SEQ ID NO: 171797 - DNA, 16 bp, H. sapiens
tttctcccagaggatg

SEQ ID NO: 171798 - DNA, 16 bp, H. sapiens
tttctcccagtctttg

SEQ ID NO: 171799 - DNA, 16 bp, H. sapiens
tttctcccagttttta

SEQ ID NO: 171800 - DNA, 16 bp, H. sapiens
tttctcccattatata

SEQ ID NO: 171801 - DNA, 16 bp, H. sapiens
tttctcccatttagaa

SEQ ID NO: 171802 - DNA, 16 bp, H. sapiens
tttctcccatttttaa

SEQ ID NO: 171803 - DNA, 16 bp, H. sapiens
tttctccccaaggcag

SEQ ID NO: 171804 - DNA, 16 bp, H. sapiens
tttctccccaggaaat

SEQ ID NO: 171805 - DNA, 16 bp, H. sapiens
tttctccccatccttg

SEQ ID NO: 171806 - DNA, 16 bp, H. sapiens
tttctccctctgtaaa

SEQ ID NO: 171807 - DNA, 16 bp, H. sapiens
tttctccctgatggac

SEQ ID NO: 171808 - DNA, 16 bp, H. sapiens
tttctcccttctctga

SEQ ID NO: 171809 - DNA, 16 bp, H. sapiens
tttctcccttttgaaa

SEQ ID NO: 171810 - DNA, 16 bp, H. sapiens
tttctcctaaaaatac

SEQ ID NO: 171811 - DNA, 16 bp, H. sapiens
tttctcctagattttc

SEQ ID NO: 171812 - DNA, 16 bp, H. sapiens
tttctcctattattaa

SEQ ID NO: 171813 - DNA, 16 bp, H. sapiens
tttctcctattttaaa

SEQ ID NO: 171814 - DNA, 16 bp, H. sapiens
tttctcctcaaaaaaa

SEQ ID NO: 171815 - DNA, 16 bp, H. sapiens
tttctcctcatcctca

SEQ ID NO: 171816 - DNA, 16 bp, H. sapiens
tttctcctccacttat

SEQ ID NO: 171817 - DNA, 16 bp, H. sapiens
tttctcctctataaaa

SEQ ID NO: 171818 - DNA, 16 bp, H. sapiens
tttctcctgaggcctc

SEQ ID NO: 171819 - DNA, 18 bp, H. sapiens
tttctcctgcctcagcct

SEQ ID NO: 171820 - DNA, 16 bp, H. sapiens
tttctccttagaaaat

SEQ ID NO: 171821 - DNA, 16 bp, H. sapiens
tttctccttcctggga

SEQ ID NO: 171822 - DNA, 16 bp, H. sapiens
tttctccttctcattg

SEQ ID NO: 171823 - DNA, 16 bp, H. sapiens
tttctcctttgcttat

SEQ ID NO: 171824 - DNA, 16 bp, H. sapiens
tttctcctttggcctc

SEQ ID NO: 171825 - DNA, 16 bp, H. sapiens
tttctccttttgagaa

SEQ ID NO: 171826 - DNA, 16 bp, H. sapiens
tttctcctttttggaa

SEQ ID NO: 171827 - DNA, 16 bp, H. sapiens
tttctctaaaaagaaa

SEQ ID NO: 171828 - DNA, 16 bp, H. sapiens
tttctctaaaaatgaa

SEQ ID NO: 171829 - DNA, 16 bp, H. sapiens
tttctctaaagatcag

SEQ ID NO: 171830 - DNA, 16 bp, H. sapiens
tttctctaaccttgtc

SEQ ID NO: 171831 - DNA, 16 bp, H. sapiens
tttctctaataataaa

SEQ ID NO: 171832 - DNA, 16 bp, H. sapiens
tttctctacaacctca

SEQ ID NO: 171833 - DNA, 16 bp, H. sapiens
tttctctacatcctcg

SEQ ID NO: 171834 - DNA, 16 bp, H. sapiens
tttctctacatcctct

SEQ ID NO: 171835 - DNA, 16 bp, H. sapiens
tttctctacctgccct

SEQ ID NO: 171836 - DNA, 16 bp, H. sapiens
tttctctactgcaatg

SEQ ID NO: 171837 - DNA, 16 bp, H. sapiens
tttctctagtttactt

SEQ ID NO: 171838 - DNA, 26 bp, H. sapiens
tttctctatactttgtctctgtgtct

SEQ ID NO: 171839 - DNA, 16 bp, H. sapiens
tttctctatatcctca

SEQ ID NO: 171840 - DNA, 16 bp, H. sapiens
tttctctatcttcaaa

SEQ ID NO: 171841 - DNA, 16 bp, H. sapiens
tttctctatttttgaa

SEQ ID NO: 171842 - DNA, 16 bp, H. sapiens
tttctctcatatatat

SEQ ID NO: 171843 - DNA, 16 bp, H. sapiens
tttctctcatctcaga

SEQ ID NO: 171844 - DNA, 16 bp, H. sapiens
tttctctcattgcttt

SEQ ID NO: 171845 - DNA, 16 bp, H. sapiens
tttctctccaaataaa

SEQ ID NO: 171846 - DNA, 16 bp, H. sapiens
tttctctcctgaaaat

SEQ ID NO: 171847 - DNA, 16 bp, H. sapiens
tttctctcctgctgcc

SEQ ID NO: 171848 - DNA, 16 bp, H. sapiens
tttctctctacctgat

SEQ ID NO: 171849 - DNA, 16 bp, H. sapiens
tttctctctcagactt

SEQ ID NO: 171850 - DNA, 16 bp, H. sapiens
tttctctctcatacac

SEQ ID NO: 171851 - DNA, 16 bp, H. sapiens
tttctctctccagttc

SEQ ID NO: 171852 - DNA, 16 bp, H. sapiens
tttctctctcctgatt

SEQ ID NO: 171853 - DNA, 16 bp, H. sapiens
tttctctctctgccat

SEQ ID NO: 171854 - DNA, 16 bp, H. sapiens
tttctctctctttaaa

SEQ ID NO: 171855 - DNA, 16 bp, H. sapiens
tttctctctgactcct

SEQ ID NO: 171856 - DNA, 16 bp, H. sapiens
tttctctctgatttct

SEQ ID NO: 171857 - DNA, 16 bp, H. sapiens
tttctctcttgttgat

SEQ ID NO: 171858 - DNA, 16 bp, H. sapiens
tttctctgaagatatt

SEQ ID NO: 171859 - DNA, 16 bp, H. sapiens
tttctctgaatatatt

SEQ ID NO: 171860 - DNA, 16 bp, H. sapiens
tttctctgaatatttt

SEQ ID NO: 171861 - DNA, 16 bp, H. sapiens
tttctctgaatttaaa

SEQ ID NO: 171862 - DNA, 16 bp, H. sapiens
tttctctgatgataag

SEQ ID NO: 171863 - DNA, 16 bp, H. sapiens
tttctctgatgtttcc

SEQ ID NO: 171864 - DNA, 16 bp, H. sapiens
tttctctgattctgtg

SEQ ID NO: 171865 - DNA, 16 bp, H. sapiens
tttctctgatttctct

SEQ ID NO: 171866 - DNA, 16 bp, H. sapiens
tttctctgcatccttg

SEQ ID NO: 171867 - DNA, 16 bp, H. sapiens
tttctctgcctctgcc

SEQ ID NO: 171868 - DNA, 16 bp, H. sapiens
tttctctgcctggaat

SEQ ID NO: 171869 - DNA, 16 bp, H. sapiens
tttctctgcttcattt

SEQ ID NO: 171870 - DNA, 16 bp, H. sapiens
tttctctggaaaaaaa

SEQ ID NO: 171871 - DNA, 16 bp, H. sapiens
tttctctggaagcttt

SEQ ID NO: 171872 - DNA, 16 bp, H. sapiens
tttctctggcttccct

SEQ ID NO: 171873 - DNA, 16 bp, H. sapiens
tttctctgggaaaaaa

SEQ ID NO: 171874 - DNA, 16 bp, H. sapiens
tttctctggggacccc

SEQ ID NO: 171875 - DNA, 16 bp, H. sapiens
tttctctggggtcagt

SEQ ID NO: 171876 - DNA, 16 bp, H. sapiens
tttctctggggtcccc

SEQ ID NO: 171877 - DNA, 16 bp, H. sapiens
tttctctgggtctctg

SEQ ID NO: 171878 - DNA, 16 bp, H. sapiens
tttctctgggtttggg

SEQ ID NO: 171879 - DNA, 16 bp, H. sapiens
tttctctggtctgatt

SEQ ID NO: 171880 - DNA, 16 bp, H. sapiens
tttctctgtaaaatat

SEQ ID NO: 171881 - DNA, 16 bp, H. sapiens
tttctctgtacatagt

SEQ ID NO: 171882 - DNA, 16 bp, H. sapiens
tttctctgtagcccag

SEQ ID NO: 171883 - DNA, 16 bp, H. sapiens
tttctctgtatctatt

SEQ ID NO: 171884 - DNA, 16 bp, H. sapiens
tttctctgtattctca

SEQ ID NO: 171885 - DNA, 16 bp, H. sapiens
tttctctgtttcctca

SEQ ID NO: 171886 - DNA, 16 bp, H. sapiens
tttctctgtttttcaa

SEQ ID NO: 171887 - DNA, 16 bp, H. sapiens
tttctcttcacaggac

SEQ ID NO: 171888 - DNA, 16 bp, H. sapiens
tttctcttcagaaaaa

SEQ ID NO: 171889 - DNA, 16 bp, H. sapiens
tttctcttcagtaaat

SEQ ID NO: 171890 - DNA, 16 bp, H. sapiens
tttctcttcatgtctt

SEQ ID NO: 171891 - DNA, 16 bp, H. sapiens
tttctcttccacactg

SEQ ID NO: 171892 - DNA, 16 bp, H. sapiens
tttctcttcctatttg

SEQ ID NO: 171893 - DNA, 16 bp, H. sapiens
tttctcttctaaaata

SEQ ID NO: 171894 - DNA, 16 bp, H. sapiens
tttctcttgactgcaa

SEQ ID NO: 171895 - DNA, 16 bp, H. sapiens
tttctcttgattggaa

SEQ ID NO: 171896 - DNA, 16 bp, H. sapiens
tttctcttgctgccac

SEQ ID NO: 171897 - DNA, 16 bp, H. sapiens
tttctcttgctgctgt

SEQ ID NO: 171898 - DNA, 16 bp, H. sapiens
tttctcttggatatat

SEQ ID NO: 171899 - DNA, 16 bp, H. sapiens
tttctcttgggtaaat

SEQ ID NO: 171900 - DNA, 16 bp, H. sapiens
tttctcttgtctgatt

SEQ ID NO: 171901 - DNA, 16 bp, H. sapiens
tttctcttgtgggtat

SEQ ID NO: 171902 - DNA, 16 bp, H. sapiens
tttctctttaagaaaa

SEQ ID NO: 171903 - DNA, 16 bp, H. sapiens
tttctctttaataaaa

SEQ ID NO: 171904 - DNA, 16 bp, H. sapiens
tttctctttccccaaa

SEQ ID NO: 171905 - DNA, 16 bp, H. sapiens
tttctctttctctaaa

SEQ ID NO: 171906 - DNA, 16 bp, H. sapiens
tttctctttctgaaaa

SEQ ID NO: 171907 - DNA, 16 bp, H. sapiens
tttctctttctgaaat

SEQ ID NO: 171908 - DNA, 16 bp, H. sapiens
tttctctttgaaattt

SEQ ID NO: 171909 - DNA, 16 bp, H. sapiens
tttctctttgatttca

SEQ ID NO: 171910 - DNA, 16 bp, H. sapiens
tttctctttgcagttc

SEQ ID NO: 171911 - DNA, 16 bp, H. sapiens
tttctctttgcatttc

SEQ ID NO: 171912 - DNA, 16 bp, H. sapiens
tttctcttttaaaatg

SEQ ID NO: 171913 - DNA, 16 bp, H. sapiens
tttctcttttccagaa

SEQ ID NO: 171914 - DNA, 16 bp, H. sapiens
tttctcttttctggaa

SEQ ID NO: 171915 - DNA, 16 bp, H. sapiens
tttctcttttcttcag

SEQ ID NO: 171916 - DNA, 16 bp, H. sapiens
tttctcttttgaataa

SEQ ID NO: 171917 - DNA, 16 bp, H. sapiens
tttctcttttgaatat

SEQ ID NO: 171918 - DNA, 16 bp, H. sapiens
tttctcttttgagaca

SEQ ID NO: 171919 - DNA, 16 bp, H. sapiens
tttctctttttaaagt

SEQ ID NO: 171920 - DNA, 16 bp, H. sapiens
tttctctttttagaaa

SEQ ID NO: 171921 - DNA, 16 bp, H. sapiens
tttctctttttgtgac

SEQ ID NO: 171922 - DNA, 16 bp, H. sapiens
tttctgaaaaaaaatt

SEQ ID NO: 171923 - DNA, 16 bp, H. sapiens
tttctgaaaaaaacaa

SEQ ID NO: 171924 - DNA, 16 bp, H. sapiens
tttctgaaaaaaatga

SEQ ID NO: 171925 - DNA, 16 bp, H. sapiens
tttctgaaaaacaaat

SEQ ID NO: 171926 - DNA, 16 bp, H. sapiens
tttctgaaaaactaaa

SEQ ID NO: 171927 - DNA, 16 bp, H. sapiens
tttctgaaaagcaatt

SEQ ID NO: 171928 - DNA, 16 bp, H. sapiens
tttctgaaaataaaaa

SEQ ID NO: 171929 - DNA, 16 bp, H. sapiens
tttctgaaaatatgtt

SEQ ID NO: 171930 - DNA, 16 bp, H. sapiens
tttctgaaaatgaaaa

SEQ ID NO: 171931 - DNA, 16 bp, H. sapiens
tttctgaaaatgaaat

SEQ ID NO: 171932 - DNA, 16 bp, H. sapiens
tttctgaaaatgcaaa

SEQ ID NO: 171933 - DNA, 16 bp, H. sapiens
tttctgaaaatgcttt

SEQ ID NO: 171934 - DNA, 16 bp, H. sapiens
tttctgaaaatgtttt

SEQ ID NO: 171935 - DNA, 16 bp, H. sapiens
tttctgaaaattttca

SEQ ID NO: 171936 - DNA, 16 bp, H. sapiens
tttctgaaacacaaat

SEQ ID NO: 171937 - DNA, 16 bp, H. sapiens
tttctgaaacacagaa

SEQ ID NO: 171938 - DNA, 16 bp, H. sapiens
tttctgaaagataatt

SEQ ID NO: 171939 - DNA, 16 bp, H. sapiens
tttctgaaataagaca

SEQ ID NO: 171940 - DNA, 16 bp, H. sapiens
tttctgaaatattaaa

SEQ ID NO: 171941 - DNA, 16 bp, H. sapiens
tttctgaaatatttta

SEQ ID NO: 171942 - DNA, 16 bp, H. sapiens
tttctgaaatgttttt

SEQ ID NO: 171943 - DNA, 16 bp, H. sapiens
tttctgaaattgcttt

SEQ ID NO: 171944 - DNA, 16 bp, H. sapiens
tttctgaaattgtttt

SEQ ID NO: 171945 - DNA, 16 bp, H. sapiens
tttctgaaccaaacca

SEQ ID NO: 171946 - DNA, 16 bp, H. sapiens
tttctgaagaaaagtt

SEQ ID NO: 171947 - DNA, 16 bp, H. sapiens
tttctgaagatttttt

SEQ ID NO: 171948 - DNA, 16 bp, H. sapiens
tttctgaaggctcctg

SEQ ID NO: 171949 - DNA, 16 bp, H. sapiens
tttctgaagttttaaa

SEQ ID NO: 171950 - DNA, 16 bp, H. sapiens
tttctgaataaaattt

SEQ ID NO: 171951 - DNA, 16 bp, H. sapiens
tttctgaatatatttt

SEQ ID NO: 171952 - DNA, 16 bp, H. sapiens
tttctgaatattttaa

SEQ ID NO: 171953 - DNA, 16 bp, H. sapiens
tttctgaatattttcc

SEQ ID NO: 171954 - DNA, 16 bp, H. sapiens
tttctgaatgtttgtc

SEQ ID NO: 171955 - DNA, 16 bp, H. sapiens
tttctgaattaaaaaa

SEQ ID NO: 171956 - DNA, 16 bp, H. sapiens
tttctgaattatttta

SEQ ID NO: 171957 - DNA, 16 bp, H. sapiens
tttctgaatttcattt

SEQ ID NO: 171958 - DNA, 16 bp, H. sapiens
tttctgaatttgaaaa

SEQ ID NO: 171959 - DNA, 16 bp, H. sapiens
tttctgaatttgttta

SEQ ID NO: 171960 - DNA, 16 bp, H. sapiens
tttctgaattttaaaa

SEQ ID NO: 171961 - DNA, 16 bp, H. sapiens
tttctgaattttgaaa

SEQ ID NO: 171962 - DNA, 16 bp, H. sapiens
tttctgaatttttcta

SEQ ID NO: 171963 - DNA, 16 bp, H. sapiens
tttctgaccttcccct

SEQ ID NO: 171964 - DNA, 16 bp, H. sapiens
tttctgactctgaatt

SEQ ID NO: 171965 - DNA, 16 bp, H. sapiens
tttctgacttcatttc

SEQ ID NO: 171966 - DNA, 16 bp, H. sapiens
tttctgacttctttca

SEQ ID NO: 171967 - DNA, 16 bp, H. sapiens
tttctgagaaaaaaat

SEQ ID NO: 171968 - DNA, 16 bp, H. sapiens
tttctgagaaaatgct

SEQ ID NO: 171969 - DNA, 16 bp, H. sapiens
tttctgagaaactgct

SEQ ID NO: 171970 - DNA, 16 bp, H. sapiens
tttctgagaattttat

SEQ ID NO: 171971 - DNA, 16 bp, H. sapiens
tttctgagacagagcc

SEQ ID NO: 171972 - DNA, 16 bp, H. sapiens
tttctgagacagggtc

SEQ ID NO: 171973 - DNA, 16 bp, H. sapiens
tttctgagatgatttt

SEQ ID NO: 171974 - DNA, 16 bp, H. sapiens
tttctgagcagcaaag

SEQ ID NO: 171975 - DNA, 16 bp, H. sapiens
tttctgagcttcctgg

SEQ ID NO: 171976 - DNA, 16 bp, H. sapiens
tttctgaggagaaact

SEQ ID NO: 171977 - DNA, 16 bp, H. sapiens
tttctgagggtcagga

SEQ ID NO: 171978 - DNA, 16 bp, H. sapiens
tttctgagtcccaaca

SEQ ID NO: 171979 - DNA, 16 bp, H. sapiens
tttctgagtctcaatt

SEQ ID NO: 171980 - DNA, 16 bp, H. sapiens
tttctgagttctccac

SEQ ID NO: 171981 - DNA, 16 bp, H. sapiens
tttctgagtttcagtt

SEQ ID NO: 171982 - DNA, 16 bp, H. sapiens
tttctgatagaattct

SEQ ID NO: 171983 - DNA, 16 bp, H. sapiens
tttctgatatattttg

SEQ ID NO: 171984 - DNA, 16 bp, H. sapiens
tttctgatatgctgtt

SEQ ID NO: 171985 - DNA, 16 bp, H. sapiens
tttctgatattttggt

SEQ ID NO: 171986 - DNA, 16 bp, H. sapiens
tttctgatcctctttc

SEQ ID NO: 171987 - DNA, 16 bp, H. sapiens
tttctgatcctgaaga

SEQ ID NO: 171988 - DNA, 16 bp, H. sapiens
tttctgatgagaattt

SEQ ID NO: 171989 - DNA, 16 bp, H. sapiens
tttctgatgtgctgct

SEQ ID NO: 171990 - DNA, 16 bp, H. sapiens
tttctgatgttagtaa

SEQ ID NO: 171991 - DNA, 16 bp, H. sapiens
tttctgattaataaat

SEQ ID NO: 171992 - DNA, 16 bp, H. sapiens
tttctgattctagatc

SEQ ID NO: 171993 - DNA, 16 bp, H. sapiens
tttctgattgtgtcta

SEQ ID NO: 171994 - DNA, 16 bp, H. sapiens
tttctgatttgtatgc

SEQ ID NO: 171995 - DNA, 16 bp, H. sapiens
tttctgattttagaaa

SEQ ID NO: 171996 - DNA, 16 bp, H. sapiens
tttctgattttcaaat

SEQ ID NO: 171997 - DNA, 16 bp, H. sapiens
tttctgattttcctct

SEQ ID NO: 171998 - DNA, 16 bp, H. sapiens
tttctgcaaaagaaaa

SEQ ID NO: 171999 - DNA, 16 bp, H. sapiens
tttctgcaatattttt

SEQ ID NO: 172000 - DNA, 16 bp, H. sapiens
tttctgcagcaggctt

SEQ ID NO: 172001 - DNA, 16 bp, H. sapiens
tttctgcagctggtca

SEQ ID NO: 172002 - DNA, 16 bp, H. sapiens
tttctgcatatggata

SEQ ID NO: 172003 - DNA, 16 bp, H. sapiens
tttctgcatcttcttt

SEQ ID NO: 172004 - DNA, 16 bp, H. sapiens
tttctgcatgtattga

SEQ ID NO: 172005 - DNA, 16 bp, H. sapiens
tttctgcatttccaaa

SEQ ID NO: 172006 - DNA, 16 bp, H. sapiens
tttctgcattttcaaa

SEQ ID NO: 172007 - DNA, 16 bp, H. sapiens
tttctgccaagaaatc

SEQ ID NO: 172008 - DNA, 16 bp, H. sapiens
tttctgccatgactgt

SEQ ID NO: 172009 - DNA, 16 bp, H. sapiens
tttctgccctgggcag

SEQ ID NO: 172010 - DNA, 16 bp, H. sapiens
tttctgcctccatttt

SEQ ID NO: 172011 - DNA, 16 bp, H. sapiens
tttctgcctctgtgga

SEQ ID NO: 172012 - DNA, 16 bp, H. sapiens
tttctgcctggacatc

SEQ ID NO: 172013 - DNA, 16 bp, H. sapiens
tttctgccttctttat

SEQ ID NO: 172014 - DNA, 16 bp, H. sapiens
tttctgccttggcctc

SEQ ID NO: 172015 - DNA, 16 bp, H. sapiens
tttctgccttttaatt

SEQ ID NO: 172016 - DNA, 16 bp, H. sapiens
tttctgctgaaagatc

SEQ ID NO: 172017 - DNA, 16 bp, H. sapiens
tttctgctgagaagtc

SEQ ID NO: 172018 - DNA, 16 bp, H. sapiens
tttctgctgctgcttc

SEQ ID NO: 172019 - DNA, 16 bp, H. sapiens
tttctgcttcattagt

SEQ ID NO: 172020 - DNA, 16 bp, H. sapiens
tttctgcttgaaaata

SEQ ID NO: 172021 - DNA, 16 bp, H. sapiens
tttctgctttaatttc

SEQ ID NO: 172022 - DNA, 16 bp, H. sapiens
tttctgctttcagttt

SEQ ID NO: 172023 - DNA, 16 bp, H. sapiens
tttctgctttcatctt

SEQ ID NO: 172024 - DNA, 16 bp, H. sapiens
tttctgctttcatttc

SEQ ID NO: 172025 - DNA, 16 bp, H. sapiens
tttctgctttgagatg

SEQ ID NO: 172026 - DNA, 16 bp, H. sapiens
tttctgcttttgcatc

SEQ ID NO: 172027 - DNA, 16 bp, H. sapiens
tttctggaaaatattt

SEQ ID NO: 172028 - DNA, 16 bp, H. sapiens
tttctggaaacaaatg

SEQ ID NO: 172029 - DNA, 16 bp, H. sapiens
tttctggaaagataaa

SEQ ID NO: 172030 - DNA, 16 bp, H. sapiens
tttctggaaagcacca

SEQ ID NO: 172031 - DNA, 16 bp, H. sapiens
tttctggaaaggattt

SEQ ID NO: 172032 - DNA, 16 bp, H. sapiens
tttctggaagaaattg

SEQ ID NO: 172033 - DNA, 16 bp, H. sapiens
tttctggaagacatta

SEQ ID NO: 172034 - DNA, 16 bp, H. sapiens
tttctggaagagactg

SEQ ID NO: 172035 - DNA, 16 bp, H. sapiens
tttctggaagagattg

SEQ ID NO: 172036 - DNA, 16 bp, H. sapiens
tttctggaagagattt

SEQ ID NO: 172037 - DNA, 16 bp, H. sapiens
tttctggaagagtttt

SEQ ID NO: 172038 - DNA, 16 bp, H. sapiens
tttctggactgaacca

SEQ ID NO: 172039 - DNA, 16 bp, H. sapiens
tttctggacttcagtt

SEQ ID NO: 172040 - DNA, 16 bp, H. sapiens
tttctggagaaccctg

SEQ ID NO: 172041 - DNA, 16 bp, H. sapiens
tttctggagaagaaaa

SEQ ID NO: 172042 - DNA, 16 bp, H. sapiens
tttctggagtatttta

SEQ ID NO: 172043 - DNA, 16 bp, H. sapiens
tttctggattctttat

SEQ ID NO: 172044 - DNA, 16 bp, H. sapiens
tttctggcacatggta

SEQ ID NO: 172045 - DNA, 16 bp, H. sapiens
tttctggcactgcttc

SEQ ID NO: 172046 - DNA, 16 bp, H. sapiens
tttctggctacttcct

SEQ ID NO: 172047 - DNA, 16 bp, H. sapiens
tttctgggaagaaatt

SEQ ID NO: 172048 - DNA, 16 bp, H. sapiens
tttctgggacccctct

SEQ ID NO: 172049 - DNA, 16 bp, H. sapiens
tttctgggatgatgga

SEQ ID NO: 172050 - DNA, 16 bp, H. sapiens
tttctgggccaggcat

SEQ ID NO: 172051 - DNA, 16 bp, H. sapiens
tttctgggcctcagtt

SEQ ID NO: 172052 - DNA, 16 bp, H. sapiens
tttctgggcctcattt

SEQ ID NO: 172053 - DNA, 16 bp, H. sapiens
tttctgggctctctgt

SEQ ID NO: 172054 - DNA, 16 bp, H. sapiens
tttctgggctctttgt

SEQ ID NO: 172055 - DNA, 16 bp, H. sapiens
tttctgggctttctat

SEQ ID NO: 172056 - DNA, 16 bp, H. sapiens
tttctggttcaatctt

SEQ ID NO: 172057 - DNA, 16 bp, H. sapiens
tttctggtttaatctt

SEQ ID NO: 172058 - DNA, 16 bp, H. sapiens
tttctggtttatttca

SEQ ID NO: 172059 - DNA, 16 bp, H. sapiens
tttctggttttaaaat

SEQ ID NO: 172060 - DNA, 16 bp, H. sapiens
tttctggttttggtat

SEQ ID NO: 172061 - DNA, 16 bp, H. sapiens
tttctgtaaaacaaag

SEQ ID NO: 172062 - DNA, 16 bp, H. sapiens
tttctgtaaagtattt

SEQ ID NO: 172063 - DNA, 16 bp, H. sapiens
tttctgtaaatctgaa

SEQ ID NO: 172064 - DNA, 16 bp, H. sapiens
tttctgtaaatgaaat

SEQ ID NO: 172065 - DNA, 16 bp, H. sapiens
tttctgtaatgatgga

SEQ ID NO: 172066 - DNA, 16 bp, H. sapiens
tttctgtacccattaa

SEQ ID NO: 172067 - DNA, 16 bp, H. sapiens
tttctgtacctcactt

SEQ ID NO: 172068 - DNA, 16 bp, H. sapiens
tttctgtactttctgt

SEQ ID NO: 172069 - DNA, 16 bp, H. sapiens
tttctgtagtgataag

SEQ ID NO: 172070 - DNA, 16 bp, H. sapiens
tttctgtataaaatat

SEQ ID NO: 172071 - DNA, 16 bp, H. sapiens
tttctgtatacttact

SEQ ID NO: 172072 - DNA, 16 bp, H. sapiens
tttctgtatatatgta

SEQ ID NO: 172073 - DNA, 16 bp, H. sapiens
tttctgtatctataga

SEQ ID NO: 172074 - DNA, 16 bp, H. sapiens
tttctgtatcttaaaa

SEQ ID NO: 172075 - DNA, 16 bp, H. sapiens
tttctgtattctgatg

SEQ ID NO: 172076 - DNA, 16 bp, H. sapiens
tttctgtatttaaaaa

SEQ ID NO: 172077 - DNA, 16 bp, H. sapiens
tttctgtatttaaata

SEQ ID NO: 172078 - DNA, 16 bp, H. sapiens
tttctgtatttatata

SEQ ID NO: 172079 - DNA, 16 bp, H. sapiens
tttctgtatttcctaa

SEQ ID NO: 172080 - DNA, 16 bp, H. sapiens
tttctgtattttccaa

SEQ ID NO: 172081 - DNA, 16 bp, H. sapiens
tttctgtcaccccaaa

SEQ ID NO: 172082 - DNA, 16 bp, H. sapiens
tttctgtcacttgcaa

SEQ ID NO: 172083 - DNA, 16 bp, H. sapiens
tttctgtcattgattt

SEQ ID NO: 172084 - DNA, 16 bp, H. sapiens
tttctgtcatttgcaa

SEQ ID NO: 172085 - DNA, 16 bp, H. sapiens
tttctgtccatgagca

SEQ ID NO: 172086 - DNA, 16 bp, H. sapiens
tttctgtccccaccca

SEQ ID NO: 172087 - DNA, 16 bp, H. sapiens
tttctgtccttttaaa

SEQ ID NO: 172088 - DNA, 16 bp, H. sapiens
tttctgtctccataaa

SEQ ID NO: 172089 - DNA, 16 bp, H. sapiens
tttctgtctctaggaa

SEQ ID NO: 172090 - DNA, 16 bp, H. sapiens
tttctgtctctagtga

SEQ ID NO: 172091 - DNA, 16 bp, H. sapiens
tttctgtctctgaatt

SEQ ID NO: 172092 - DNA, 16 bp, H. sapiens
tttctgtctgctttat

SEQ ID NO: 172093 - DNA, 16 bp, H. sapiens
tttctgtctttataaa

SEQ ID NO: 172094 - DNA, 16 bp, H. sapiens
tttctgtcttttaaaa

SEQ ID NO: 172095 - DNA, 16 bp, H. sapiens
tttctgtgaaaaatat

SEQ ID NO: 172096 - DNA, 16 bp, H. sapiens
tttctgtgaaaatgct

SEQ ID NO: 172097 - DNA, 16 bp, H. sapiens
tttctgtgaaagaaaa

SEQ ID NO: 172098 - DNA, 16 bp, H. sapiens
tttctgtgaagaacat

SEQ ID NO: 172099 - DNA, 16 bp, H. sapiens
tttctgtgaagagtgt

SEQ ID NO: 172100 - DNA, 16 bp, H. sapiens
tttctgtgaaggtatt

SEQ ID NO: 172101 - DNA, 16 bp, H. sapiens
tttctgtgagatgaat

SEQ ID NO: 172102 - DNA, 16 bp, H. sapiens
tttctgtgatgtaaat

SEQ ID NO: 172103 - DNA, 16 bp, H. sapiens
tttctgtgccatcctt

SEQ ID NO: 172104 - DNA, 16 bp, H. sapiens
tttctgtgcctagttt

SEQ ID NO: 172105 - DNA, 16 bp, H. sapiens
tttctgtggaatcagt

SEQ ID NO: 172106 - DNA, 16 bp, H. sapiens
tttctgtggatcagaa

SEQ ID NO: 172107 - DNA, 16 bp, H. sapiens
tttctgtgggaaggaa

SEQ ID NO: 172108 - DNA, 16 bp, H. sapiens
tttctgtgggatctgt

SEQ ID NO: 172109 - DNA, 16 bp, H. sapiens
tttctgtggtgtaaat

SEQ ID NO: 172110 - DNA, 16 bp, H. sapiens
tttctgtgtatatata

SEQ ID NO: 172111 - DNA, 16 bp, H. sapiens
tttctgtgtatttaaa

SEQ ID NO: 172112 - DNA, 16 bp, H. sapiens
tttctgtgtatttgaa

SEQ ID NO: 172113 - DNA, 16 bp, H. sapiens
tttctgtgtatttgta

SEQ ID NO: 172114 - DNA, 16 bp, H. sapiens
tttctgtgtctaaatt

SEQ ID NO: 172115 - DNA, 16 bp, H. sapiens
tttctgtgtctatgga

SEQ ID NO: 172116 - DNA, 16 bp, H. sapiens
tttctgtgtctctgcc

SEQ ID NO: 172117 - DNA, 16 bp, H. sapiens
tttctgtgtctgtccc

SEQ ID NO: 172118 - DNA, 16 bp, H. sapiens
tttctgtgtcttaatt

SEQ ID NO: 172119 - DNA, 16 bp, H. sapiens
tttctgtgtgcacagt

SEQ ID NO: 172120 - DNA, 16 bp, H. sapiens
tttctgtgtgtgtgta

SEQ ID NO: 172121 - DNA, 16 bp, H. sapiens
tttctgtgtttataaa

SEQ ID NO: 172122 - DNA, 16 bp, H. sapiens
tttctgtgttttcaaa

SEQ ID NO: 172123 - DNA, 16 bp, H. sapiens
tttctgttacattagg

SEQ ID NO: 172124 - DNA, 16 bp, H. sapiens
tttctgttagcatttt

SEQ ID NO: 172125 - DNA, 16 bp, H. sapiens
tttctgttcatctctt

SEQ ID NO: 172126 - DNA, 16 bp, H. sapiens
tttctgttcatgtctt

SEQ ID NO: 172127 - DNA, 16 bp, H. sapiens
tttctgttcatgtgtt

SEQ ID NO: 172128 - DNA, 16 bp, H. sapiens
tttctgttcattcatt

SEQ ID NO: 172129 - DNA, 16 bp, H. sapiens
tttctgttccaggatc

SEQ ID NO: 172130 - DNA, 16 bp, H. sapiens
tttctgttccatttta

SEQ ID NO: 172131 - DNA, 16 bp, H. sapiens
tttctgttcctcaaac

SEQ ID NO: 172132 - DNA, 16 bp, H. sapiens
tttctgttcctcagtt

SEQ ID NO: 172133 - DNA, 16 bp, H. sapiens
tttctgttctatagtt

SEQ ID NO: 172134 - DNA, 16 bp, H. sapiens
tttctgttctctggaa

SEQ ID NO: 172135 - DNA, 16 bp, H. sapiens
tttctgttcttctaca

SEQ ID NO: 172136 - DNA, 16 bp, H. sapiens
tttctgttcttggatt

SEQ ID NO: 172137 - DNA, 16 bp, H. sapiens
tttctgttctttgaaa

SEQ ID NO: 172138 - DNA, 16 bp, H. sapiens
tttctgttgagaaatt

SEQ ID NO: 172139 - DNA, 16 bp, H. sapiens
tttctgttgcttacaa

SEQ ID NO: 172140 - DNA, 16 bp, H. sapiens
tttctgttgcttataa

SEQ ID NO: 172141 - DNA, 16 bp, H. sapiens
tttctgttgtttatca

SEQ ID NO: 172142 - DNA, 16 bp, H. sapiens
tttctgttgtttgaag

SEQ ID NO: 172143 - DNA, 16 bp, H. sapiens
tttctgtttaaagatg

SEQ ID NO: 172144 - DNA, 16 bp, H. sapiens
tttctgtttaaattta

SEQ ID NO: 172145 - DNA, 16 bp, H. sapiens
tttctgtttactctga

SEQ ID NO: 172146 - DNA, 16 bp, H. sapiens
tttctgtttataaaat

SEQ ID NO: 172147 - DNA, 16 bp, H. sapiens
tttctgtttcataaat

SEQ ID NO: 172148 - DNA, 16 bp, H. sapiens
tttctgtttctaaaat

SEQ ID NO: 172149 - DNA, 16 bp, H. sapiens
tttctgtttctaataa

SEQ ID NO: 172150 - DNA, 16 bp, H. sapiens
tttctgtttctagatc

SEQ ID NO: 172151 - DNA, 16 bp, H. sapiens
tttctgtttctgaaaa

SEQ ID NO: 172152 - DNA, 16 bp, H. sapiens
tttctgtttctgtaaa

SEQ ID NO: 172153 - DNA, 16 bp, H. sapiens
tttctgtttctgtaag

SEQ ID NO: 172154 - DNA, 16 bp, H. sapiens
tttctgtttctgtgaa

SEQ ID NO: 172155 - DNA, 16 bp, H. sapiens
tttctgtttcttaaaa

SEQ ID NO: 172156 - DNA, 16 bp, H. sapiens
tttctgtttcttcata

SEQ ID NO: 172157 - DNA, 16 bp, H. sapiens
tttctgtttgggatga

SEQ ID NO: 172158 - DNA, 16 bp, H. sapiens
tttctgttttataaat

SEQ ID NO: 172159 - DNA, 16 bp, H. sapiens
tttctgttttcctaac

SEQ ID NO: 172160 - DNA, 16 bp, H. sapiens
tttctgttttctacct

SEQ ID NO: 172161 - DNA, 16 bp, H. sapiens
tttctgttttctgaaa

SEQ ID NO: 172162 - DNA, 16 bp, H. sapiens
tttctgtttttcaaaa

SEQ ID NO: 172163 - DNA, 16 bp, H. sapiens
tttctgtttttctaca

SEQ ID NO: 172164 - DNA, 16 bp, H. sapiens
tttctgtttttggaaa

SEQ ID NO: 172165 - DNA, 16 bp, H. sapiens
tttcttaaaaagtgaa

SEQ ID NO: 172166 - DNA, 16 bp, H. sapiens
tttcttaaaaatacaa

SEQ ID NO: 172167 - DNA, 16 bp, H. sapiens
tttcttaaaaatgaaa

SEQ ID NO: 172168 - DNA, 16 bp, H. sapiens
tttcttaaaacaataa

SEQ ID NO: 172169 - DNA, 16 bp, H. sapiens
tttcttaaaacataaa

SEQ ID NO: 172170 - DNA, 17 bp, H. sapiens
tttcttaaaacattatg

SEQ ID NO: 172171 - DNA, 16 bp, H. sapiens
tttcttaaaagaaaga

SEQ ID NO: 172172 - DNA, 16 bp, H. sapiens
tttcttaaaagaagat

SEQ ID NO: 172173 - DNA, 16 bp, H. sapiens
tttcttaaaagacaaa

SEQ ID NO: 172174 - DNA, 16 bp, H. sapiens
tttcttaaaagtaaaa

SEQ ID NO: 172175 - DNA, 16 bp, H. sapiens
tttcttaaaagtgaaa

SEQ ID NO: 172176 - DNA, 16 bp, H. sapiens
tttcttaaaagtttta

SEQ ID NO: 172177 - DNA, 16 bp, H. sapiens
tttcttaaaataacaa

SEQ ID NO: 172178 - DNA, 16 bp, H. sapiens
tttcttaaaatgaaga

SEQ ID NO: 172179 - DNA, 16 bp, H. sapiens
tttcttaaaatgttaa

SEQ ID NO: 172180 - DNA, 16 bp, H. sapiens
tttcttaaaatgttta

SEQ ID NO: 172181 - DNA, 16 bp, H. sapiens
tttcttaaaatttcaa

SEQ ID NO: 172182 - DNA, 16 bp, H. sapiens
tttcttaaacaaaaca

SEQ ID NO: 172183 - DNA, 16 bp, H. sapiens
tttcttaaactttttg

SEQ ID NO: 172184 - DNA, 16 bp, H. sapiens
tttcttaaagaaaaca

SEQ ID NO: 172185 - DNA, 16 bp, H. sapiens
tttcttaaagtgaaga

SEQ ID NO: 172186 - DNA, 16 bp, H. sapiens
tttcttaaatatgaca

SEQ ID NO: 172187 - DNA, 16 bp, H. sapiens
tttcttaaattataag

SEQ ID NO: 172188 - DNA, 16 bp, H. sapiens
tttcttaagaacattt

SEQ ID NO: 172189 - DNA, 16 bp, H. sapiens
tttcttaatccagttt

SEQ ID NO: 172190 - DNA, 16 bp, H. sapiens
tttcttaatgaaataa

SEQ ID NO: 172191 - DNA, 16 bp, H. sapiens
tttcttacaaaaataa

SEQ ID NO: 172192 - DNA, 16 bp, H. sapiens
tttcttacagatgctg

SEQ ID NO: 172193 - DNA, 16 bp, H. sapiens
tttcttacagtatttt

SEQ ID NO: 172194 - DNA, 16 bp, H. sapiens
tttcttacataaaaat

SEQ ID NO: 172195 - DNA, 16 bp, H. sapiens
tttcttacatgaaaaa

SEQ ID NO: 172196 - DNA, 16 bp, H. sapiens
tttcttaccagactta

SEQ ID NO: 172197 - DNA, 16 bp, H. sapiens
tttcttacctataaaa

SEQ ID NO: 172198 - DNA, 16 bp, H. sapiens
tttcttacttataaaa

SEQ ID NO: 172199 - DNA, 16 bp, H. sapiens
tttcttagaaacattt

SEQ ID NO: 172200 - DNA, 16 bp, H. sapiens
tttcttagaatatatt

SEQ ID NO: 172201 - DNA, 16 bp, H. sapiens
tttcttagaatttcca

SEQ ID NO: 172202 - DNA, 16 bp, H. sapiens
tttcttagaattttct

SEQ ID NO: 172203 - DNA, 16 bp, H. sapiens
tttcttatagagacag

SEQ ID NO: 172204 - DNA, 16 bp, H. sapiens
tttcttatcagtaaaa

SEQ ID NO: 172205 - DNA, 16 bp, H. sapiens
tttcttatctctaaaa

SEQ ID NO: 172206 - DNA, 16 bp, H. sapiens
tttcttatctttgaaa

SEQ ID NO: 172207 - DNA, 16 bp, H. sapiens
tttcttatgaatattt

SEQ ID NO: 172208 - DNA, 16 bp, H. sapiens
tttcttatggttctgg

SEQ ID NO: 172209 - DNA, 16 bp, H. sapiens
tttcttattagaaata

SEQ ID NO: 172210 - DNA, 16 bp, H. sapiens
tttcttatttaagaaa

SEQ ID NO: 172211 - DNA, 16 bp, H. sapiens
tttcttatttctgtga

SEQ ID NO: 172212 - DNA, 16 bp, H. sapiens
tttcttatttgtaaat

SEQ ID NO: 172213 - DNA, 16 bp, H. sapiens
tttcttattttcagta

SEQ ID NO: 172214 - DNA, 16 bp, H. sapiens
tttcttattttccaaa

SEQ ID NO: 172215 - DNA, 16 bp, H. sapiens
tttcttcaaaaaaatt

SEQ ID NO: 172216 - DNA, 16 bp, H. sapiens
tttcttcaaaaaataa

SEQ ID NO: 172217 - DNA, 16 bp, H. sapiens
tttcttcaaagaagac

SEQ ID NO: 172218 - DNA, 16 bp, H. sapiens
tttcttcaaagaatat

SEQ ID NO: 172219 - DNA, 16 bp, H. sapiens
tttcttcaaagaattt

SEQ ID NO: 172220 - DNA, 16 bp, H. sapiens
tttcttcaaagacata

SEQ ID NO: 172221 - DNA, 16 bp, H. sapiens
tttcttcaaataaaat

SEQ ID NO: 172222 - DNA, 16 bp, H. sapiens
tttcttcaaatgcttt

SEQ ID NO: 172223 - DNA, 16 bp, H. sapiens
tttcttcaaatgtgaa

SEQ ID NO: 172224 - DNA, 16 bp, H. sapiens
tttcttcaagaaaaaa

SEQ ID NO: 172225 - DNA, 16 bp, H. sapiens
tttcttcaagaaaaat

SEQ ID NO: 172226 - DNA, 16 bp, H. sapiens
tttcttcaagaatttt

SEQ ID NO: 172227 - DNA, 16 bp, H. sapiens
tttcttcaagtatttt

SEQ ID NO: 172228 - DNA, 16 bp, H. sapiens
tttcttcacaaggcag

SEQ ID NO: 172229 - DNA, 16 bp, H. sapiens
tttcttcacctaaaaa

SEQ ID NO: 172230 - DNA, 16 bp, H. sapiens
tttcttcacctgaaaa

SEQ ID NO: 172231 - DNA, 16 bp, H. sapiens
tttcttcacttacaaa

SEQ ID NO: 172232 - DNA, 16 bp, H. sapiens
tttcttcacttctctg

SEQ ID NO: 172233 - DNA, 16 bp, H. sapiens
tttcttcagatattta

SEQ ID NO: 172234 - DNA, 16 bp, H. sapiens
tttcttcagccctttt

SEQ ID NO: 172235 - DNA, 16 bp, H. sapiens
tttcttcagctataaa

SEQ ID NO: 172236 - DNA, 16 bp, H. sapiens
tttcttcagctataat

SEQ ID NO: 172237 - DNA, 16 bp, H. sapiens
tttcttcagctgtgaa

SEQ ID NO: 172238 - DNA, 16 bp, H. sapiens
tttcttcagctttatt

SEQ ID NO: 172239 - DNA, 16 bp, H. sapiens
tttcttcagttataaa

SEQ ID NO: 172240 - DNA, 16 bp, H. sapiens
tttcttcagttttaat

SEQ ID NO: 172241 - DNA, 16 bp, H. sapiens
tttcttcatatcagca

SEQ ID NO: 172242 - DNA, 16 bp, H. sapiens
tttcttcatatttctg

SEQ ID NO: 172243 - DNA, 16 bp, H. sapiens
tttcttcatcagcaaa

SEQ ID NO: 172244 - DNA, 16 bp, H. sapiens
tttcttcatccattga

SEQ ID NO: 172245 - DNA, 16 bp, H. sapiens
tttcttcatctataaa

SEQ ID NO: 172246 - DNA, 16 bp, H. sapiens
tttcttcatctataca

SEQ ID NO: 172247 - DNA, 16 bp, H. sapiens
tttcttcatctgcaaa

SEQ ID NO: 172248 - DNA, 16 bp, H. sapiens
tttcttcatctgtaaa

SEQ ID NO: 172249 - DNA, 16 bp, H. sapiens
tttcttcatctgtgaa

SEQ ID NO: 172250 - DNA, 16 bp, H. sapiens
tttcttcatgtgcaaa

SEQ ID NO: 172251 - DNA, 16 bp, H. sapiens
tttcttcatgtgtttg

SEQ ID NO: 172252 - DNA, 16 bp, H. sapiens
tttcttcatgttttcc

SEQ ID NO: 172253 - DNA, 16 bp, H. sapiens
tttcttcattaaaaaa

SEQ ID NO: 172254 - DNA, 16 bp, H. sapiens
tttcttcattcattca

SEQ ID NO: 172255 - DNA, 16 bp, H. sapiens
tttcttcattgtaaaa

SEQ ID NO: 172256 - DNA, 16 bp, H. sapiens
tttcttcattgtgtat

SEQ ID NO: 172257 - DNA, 16 bp, H. sapiens
tttcttcatttcaact

SEQ ID NO: 172258 - DNA, 16 bp, H. sapiens
tttcttcatttctctg

SEQ ID NO: 172259 - DNA, 16 bp, H. sapiens
tttcttcatttctgaa

SEQ ID NO: 172260 - DNA, 16 bp, H. sapiens
tttcttcattttccaa

SEQ ID NO: 172261 - DNA, 16 bp, H. sapiens
tttcttccaaaaaaaa

SEQ ID NO: 172262 - DNA, 16 bp, H. sapiens
tttcttccaaaagttt

SEQ ID NO: 172263 - DNA, 16 bp, H. sapiens
tttcttccaagagttt

SEQ ID NO: 172264 - DNA, 16 bp, H. sapiens
tttcttccactctgtg

SEQ ID NO: 172265 - DNA, 16 bp, H. sapiens
tttcttccacttagca

SEQ ID NO: 172266 - DNA, 16 bp, H. sapiens
tttcttccagaaaaca

SEQ ID NO: 172267 - DNA, 16 bp, H. sapiens
tttcttccagtttttc

SEQ ID NO: 172268 - DNA, 16 bp, H. sapiens
tttcttccattaaaaa

SEQ ID NO: 172269 - DNA, 16 bp, H. sapiens
tttcttccattgcttt

SEQ ID NO: 172270 - DNA, 16 bp, H. sapiens
tttcttcccagtctct

SEQ ID NO: 172271 - DNA, 16 bp, H. sapiens
tttcttcccccaaatt

SEQ ID NO: 172272 - DNA, 16 bp, H. sapiens
tttcttccccttgatc

SEQ ID NO: 172273 - DNA, 16 bp, H. sapiens
tttcttccctttaaaa

SEQ ID NO: 172274 - DNA, 16 bp, H. sapiens
tttcttcctcaaatat

SEQ ID NO: 172275 - DNA, 16 bp, H. sapiens
tttcttcctcaggaaa

SEQ ID NO: 172276 - DNA, 16 bp, H. sapiens
tttcttcctctgtaaa

SEQ ID NO: 172277 - DNA, 16 bp, H. sapiens
tttcttcctgattcag

SEQ ID NO: 172278 - DNA, 16 bp, H. sapiens
tttcttcctgctggtg

SEQ ID NO: 172279 - DNA, 16 bp, H. sapiens
tttcttcctggttcag

SEQ ID NO: 172280 - DNA, 16 bp, H. sapiens
tttcttcctggttgaa

SEQ ID NO: 172281 - DNA, 16 bp, H. sapiens
tttcttccttctggaa

SEQ ID NO: 172282 - DNA, 16 bp, H. sapiens
tttcttccttctggca

SEQ ID NO: 172283 - DNA, 16 bp, H. sapiens
tttcttccttgtaaat

SEQ ID NO: 172284 - DNA, 16 bp, H. sapiens
tttcttcctttctgat

SEQ ID NO: 172285 - DNA, 16 bp, H. sapiens
tttcttcctttctgta

SEQ ID NO: 172286 - DNA, 16 bp, H. sapiens
tttcttcctttgtaaa

SEQ ID NO: 172287 - DNA, 16 bp, H. sapiens
tttcttccttttcaaa

SEQ ID NO: 172288 - DNA, 16 bp, H. sapiens
tttcttccttttgaaa

SEQ ID NO: 172289 - DNA, 16 bp, H. sapiens
tttcttccttttgaat

SEQ ID NO: 172290 - DNA, 16 bp, H. sapiens
tttcttccttttgcat

SEQ ID NO: 172291 - DNA, 16 bp, H. sapiens
tttcttctaaaaaata

SEQ ID NO: 172292 - DNA, 16 bp, H. sapiens
tttcttctaaaagttg

SEQ ID NO: 172293 - DNA, 16 bp, H. sapiens
tttcttctaaaatcaa

SEQ ID NO: 172294 - DNA, 16 bp, H. sapiens
tttcttctagaaactt

SEQ ID NO: 172295 - DNA, 16 bp, H. sapiens
tttcttctagaagctt

SEQ ID NO: 172296 - DNA, 16 bp, H. sapiens
tttcttctagatttta

SEQ ID NO: 172297 - DNA, 16 bp, H. sapiens
tttcttctagctattt

SEQ ID NO: 172298 - DNA, 16 bp, H. sapiens
tttcttctaggattct

SEQ ID NO: 172299 - DNA, 16 bp, H. sapiens
tttcttctagtgcttt

SEQ ID NO: 172300 - DNA, 16 bp, H. sapiens
tttcttctatgcattt

SEQ ID NO: 172301 - DNA, 16 bp, H. sapiens
tttcttctattcaggc

SEQ ID NO: 172302 - DNA, 16 bp, H. sapiens
tttcttctattcctag

SEQ ID NO: 172303 - DNA, 16 bp, H. sapiens
tttcttctcagaaaaa

SEQ ID NO: 172304 - DNA, 16 bp, H. sapiens
tttcttctcagcaagg

SEQ ID NO: 172305 - DNA, 16 bp, H. sapiens
tttcttctctaaaaat

SEQ ID NO: 172306 - DNA, 16 bp, H. sapiens
tttcttctctaaaatt

SEQ ID NO: 172307 - DNA, 16 bp, H. sapiens
tttcttctctccagaa

SEQ ID NO: 172308 - DNA, 16 bp, H. sapiens
tttcttctctgcaaaa

SEQ ID NO: 172309 - DNA, 16 bp, H. sapiens
tttcttctcttataaa

SEQ ID NO: 172310 - DNA, 16 bp, H. sapiens
tttcttctgaagcctc

SEQ ID NO: 172311 - DNA, 16 bp, H. sapiens
tttcttctgaatattt

SEQ ID NO: 172312 - DNA, 16 bp, H. sapiens
tttcttctgagaaatg

SEQ ID NO: 172313 - DNA, 16 bp, H. sapiens
tttcttctgagaattt

SEQ ID NO: 172314 - DNA, 16 bp, H. sapiens
tttcttctgaggcctc

SEQ ID NO: 172315 - DNA, 16 bp, H. sapiens
tttcttctgccatctg

SEQ ID NO: 172316 - DNA, 16 bp, H. sapiens
tttcttctgcttactt

SEQ ID NO: 172317 - DNA, 16 bp, H. sapiens
tttcttctggaatttt

SEQ ID NO: 172318 - DNA, 16 bp, H. sapiens
tttcttctggtagctt

SEQ ID NO: 172319 - DNA, 16 bp, H. sapiens
tttcttctgtggcttc

SEQ ID NO: 172320 - DNA, 16 bp, H. sapiens
tttcttctgtgtatat

SEQ ID NO: 172321 - DNA, 16 bp, H. sapiens
tttcttctgttttcaa

SEQ ID NO: 172322 - DNA, 16 bp, H. sapiens
tttcttctgttttcca

SEQ ID NO: 172323 - DNA, 16 bp, H. sapiens
tttcttcttaaaaata

SEQ ID NO: 172324 - DNA, 16 bp, H. sapiens
tttcttcttaaagttt

SEQ ID NO: 172325 - DNA, 16 bp, H. sapiens
tttcttcttcagaaaa

SEQ ID NO: 172326 - DNA, 16 bp, H. sapiens
tttcttcttcaggaaa

SEQ ID NO: 172327 - DNA, 16 bp, H. sapiens
tttcttcttccaaaat

SEQ ID NO: 172328 - DNA, 16 bp, H. sapiens
tttcttcttccatgca

SEQ ID NO: 172329 - DNA, 16 bp, H. sapiens
tttcttcttccccaaa

SEQ ID NO: 172330 - DNA, 16 bp, H. sapiens
tttcttcttcctcagg

SEQ ID NO: 172331 - DNA, 16 bp, H. sapiens
tttcttcttctaaaaa

SEQ ID NO: 172332 - DNA, 16 bp, H. sapiens
tttcttcttctataaa

SEQ ID NO: 172333 - DNA, 16 bp, H. sapiens
tttcttcttgaaattt

SEQ ID NO: 172334 - DNA, 16 bp, H. sapiens
tttcttcttgagtcag

SEQ ID NO: 172335 - DNA, 16 bp, H. sapiens
tttcttctttcaaaat

SEQ ID NO: 172336 - DNA, 16 bp, H. sapiens
tttcttctttgaaaat

SEQ ID NO: 172337 - DNA, 16 bp, H. sapiens
tttcttctttgaaatt

SEQ ID NO: 172338 - DNA, 16 bp, H. sapiens
tttcttctttgagaaa

SEQ ID NO: 172339 - DNA, 16 bp, H. sapiens
tttcttctttgatcta

SEQ ID NO: 172340 - DNA, 16 bp, H. sapiens
tttcttcttttcagag

SEQ ID NO: 172341 - DNA, 16 bp, H. sapiens
tttcttcttttgtaaa

SEQ ID NO: 172342 - DNA, 16 bp, H. sapiens
tttcttgaaaaaaaaa

SEQ ID NO: 172343 - DNA, 16 bp, H. sapiens
tttcttgaaaattttt

SEQ ID NO: 172344 - DNA, 16 bp, H. sapiens
tttcttgaaataattt

SEQ ID NO: 172345 - DNA, 16 bp, H. sapiens
tttcttgaaattcttt

SEQ ID NO: 172346 - DNA, 16 bp, H. sapiens
tttcttgaagaaaaaa

SEQ ID NO: 172347 - DNA, 16 bp, H. sapiens
tttcttgaatcatttt

SEQ ID NO: 172348 - DNA, 16 bp, H. sapiens
tttcttgaatttttaa

SEQ ID NO: 172349 - DNA, 16 bp, H. sapiens
tttcttgagaagaaat

SEQ ID NO: 172350 - DNA, 16 bp, H. sapiens
tttcttgagatggaat

SEQ ID NO: 172351 - DNA, 16 bp, H. sapiens
tttcttgagcaatact

SEQ ID NO: 172352 - DNA, 16 bp, H. sapiens
tttcttgagcagtggt

SEQ ID NO: 172353 - DNA, 16 bp, H. sapiens
tttcttgaggaagaaa

SEQ ID NO: 172354 - DNA, 16 bp, H. sapiens
tttcttgatctgaaaa

SEQ ID NO: 172355 - DNA, 16 bp, H. sapiens
tttcttgattactgta

SEQ ID NO: 172356 - DNA, 16 bp, H. sapiens
tttcttgattttgaaa

SEQ ID NO: 172357 - DNA, 16 bp, H. sapiens
tttcttgatttttcag

SEQ ID NO: 172358 - DNA, 16 bp, H. sapiens
tttcttgcatgagatc

SEQ ID NO: 172359 - DNA, 16 bp, H. sapiens
tttcttgcattcattt

SEQ ID NO: 172360 - DNA, 16 bp, H. sapiens
tttcttgccctctgct

SEQ ID NO: 172361 - DNA, 16 bp, H. sapiens
tttcttgcctcagcct

SEQ ID NO: 172362 - DNA, 16 bp, H. sapiens
tttcttgctcttaaaa

SEQ ID NO: 172363 - DNA, 16 bp, H. sapiens
tttcttgcttgtagtt

SEQ ID NO: 172364 - DNA, 16 bp, H. sapiens
tttcttgctttcttca

SEQ ID NO: 172365 - DNA, 16 bp, H. sapiens
tttcttggagcctttg

SEQ ID NO: 172366 - DNA, 16 bp, H. sapiens
tttcttggaggctttt

SEQ ID NO: 172367 - DNA, 16 bp, H. sapiens
tttcttggctgggcgc

SEQ ID NO: 172368 - DNA, 16 bp, H. sapiens
tttcttgggaaaaaaa

SEQ ID NO: 172369 - DNA, 16 bp, H. sapiens
tttcttgggattttct

SEQ ID NO: 172370 - DNA, 16 bp, H. sapiens
tttcttgggccaggcc

SEQ ID NO: 172371 - DNA, 16 bp, H. sapiens
tttcttgggtctccag

SEQ ID NO: 172372 - DNA, 16 bp, H. sapiens
tttcttgtaaaagttt

SEQ ID NO: 172373 - DNA, 16 bp, H. sapiens
tttcttgtaaatttaa

SEQ ID NO: 172374 - DNA, 16 bp, H. sapiens
tttcttgtataaaaac

SEQ ID NO: 172375 - DNA, 16 bp, H. sapiens
tttcttgtcttaaaaa

SEQ ID NO: 172376 - DNA, 17 bp, H. sapiens
tttcttgtgaatttgtt

SEQ ID NO: 172377 - DNA, 16 bp, H. sapiens
tttcttgtggaatctt

SEQ ID NO: 172378 - DNA, 16 bp, H. sapiens
tttcttgtgtatcctt

SEQ ID NO: 172379 - DNA, 16 bp, H. sapiens
tttcttgttctgaaat

SEQ ID NO: 172380 - DNA, 16 bp, H. sapiens
tttctttaaaaaaaag

SEQ ID NO: 172381 - DNA, 16 bp, H. sapiens
tttctttaaaaagaaa

SEQ ID NO: 172382 - DNA, 16 bp, H. sapiens
tttctttaaaaagaga

SEQ ID NO: 172383 - DNA, 16 bp, H. sapiens
tttctttaaaaagtaa

SEQ ID NO: 172384 - DNA, 16 bp, H. sapiens
tttctttaaaaagttt

SEQ ID NO: 172385 - DNA, 16 bp, H. sapiens
tttctttaaaacaaaa

SEQ ID NO: 172386 - DNA, 16 bp, H. sapiens
tttctttaaaatgtaa

SEQ ID NO: 172387 - DNA, 16 bp, H. sapiens
tttctttaaaatgttt

SEQ ID NO: 172388 - DNA, 16 bp, H. sapiens
tttctttaaagaaaaa

SEQ ID NO: 172389 - DNA, 16 bp, H. sapiens
tttctttaaagaagaa

SEQ ID NO: 172390 - DNA, 16 bp, H. sapiens
tttctttaaagagatg

SEQ ID NO: 172391 - DNA, 16 bp, H. sapiens
tttctttaaaggaaaa

SEQ ID NO: 172392 - DNA, 16 bp, H. sapiens
tttctttaaagttctt

SEQ ID NO: 172393 - DNA, 16 bp, H. sapiens
tttctttaaataaaag

SEQ ID NO: 172394 - DNA, 16 bp, H. sapiens
tttctttaacaataaa

SEQ ID NO: 172395 - DNA, 16 bp, H. sapiens
tttctttaaggatgct

SEQ ID NO: 172396 - DNA, 16 bp, H. sapiens
tttctttaataaaaca

SEQ ID NO: 172397 - DNA, 16 bp, H. sapiens
tttctttaatagatat

SEQ ID NO: 172398 - DNA, 16 bp, H. sapiens
tttctttaatcaaaat

SEQ ID NO: 172399 - DNA, 16 bp, H. sapiens
tttctttaattataag

SEQ ID NO: 172400 - DNA, 16 bp, H. sapiens
tttctttacaaaataa

SEQ ID NO: 172401 - DNA, 16 bp, H. sapiens
tttctttacagaaaaa

SEQ ID NO: 172402 - DNA, 16 bp, H. sapiens
tttctttacccattta

SEQ ID NO: 172403 - DNA, 16 bp, H. sapiens
tttctttacctgaaaa

SEQ ID NO: 172404 - DNA, 16 bp, H. sapiens
tttctttacttgtaaa

SEQ ID NO: 172405 - DNA, 16 bp, H. sapiens
tttctttagaaattat

SEQ ID NO: 172406 - DNA, 16 bp, H. sapiens
tttctttagaatattt

SEQ ID NO: 172407 - DNA, 16 bp, H. sapiens
tttctttagaatttct

SEQ ID NO: 172408 - DNA, 16 bp, H. sapiens
tttctttagagcaatg

SEQ ID NO: 172409 - DNA, 16 bp, H. sapiens
tttctttagccattct

SEQ ID NO: 172410 - DNA, 16 bp, H. sapiens
tttctttataaactgc

SEQ ID NO: 172411 - DNA, 16 bp, H. sapiens
tttctttataagaaaa

SEQ ID NO: 172412 - DNA, 16 bp, H. sapiens
tttctttatatagaaa

SEQ ID NO: 172413 - DNA, 16 bp, H. sapiens
tttctttatatgttac

SEQ ID NO: 172414 - DNA, 16 bp, H. sapiens
tttctttatctaaaaa

SEQ ID NO: 172415 - DNA, 16 bp, H. sapiens
tttctttatctgtaaa

SEQ ID NO: 172416 - DNA, 16 bp, H. sapiens
tttctttatggcttct

SEQ ID NO: 172417 - DNA, 16 bp, H. sapiens
tttctttatgtaaata

SEQ ID NO: 172418 - DNA, 16 bp, H. sapiens
tttctttatgtatata

SEQ ID NO: 172419 - DNA, 16 bp, H. sapiens
tttctttattaaatgt

SEQ ID NO: 172420 - DNA, 16 bp, H. sapiens
tttctttattacagct

SEQ ID NO: 172421 - DNA, 16 bp, H. sapiens
tttctttattcagtat

SEQ ID NO: 172422 - DNA, 16 bp, H. sapiens
tttctttattgaaatt

SEQ ID NO: 172423 - DNA, 16 bp, H. sapiens
tttctttattttgaag

SEQ ID NO: 172424 - DNA, 16 bp, H. sapiens
tttctttcaaaaactt

SEQ ID NO: 172425 - DNA, 16 bp, H. sapiens
tttctttcaaatgttt

SEQ ID NO: 172426 - DNA, 16 bp, H. sapiens
tttctttcaagaaaat

SEQ ID NO: 172427 - DNA, 16 bp, H. sapiens
tttctttcaatgcttt

SEQ ID NO: 172428 - DNA, 16 bp, H. sapiens
tttctttcacaaattt

SEQ ID NO: 172429 - DNA, 16 bp, H. sapiens
tttctttcagatgttt

SEQ ID NO: 172430 - DNA, 16 bp, H. sapiens
tttctttcagcctttt

SEQ ID NO: 172431 - DNA, 16 bp, H. sapiens
tttctttcagctcttg

SEQ ID NO: 172432 - DNA, 16 bp, H. sapiens
tttctttcagtgcttt

SEQ ID NO: 172433 - DNA, 16 bp, H. sapiens
tttctttcataagtgt

SEQ ID NO: 172434 - DNA, 16 bp, H. sapiens
tttctttcattctgta

SEQ ID NO: 172435 - DNA, 16 bp, H. sapiens
tttctttcccagggcc

SEQ ID NO: 172436 - DNA, 16 bp, H. sapiens
tttctttcccccaaat

SEQ ID NO: 172437 - DNA, 16 bp, H. sapiens
tttctttccttattga

SEQ ID NO: 172438 - DNA, 16 bp, H. sapiens
tttctttccttcatgt

SEQ ID NO: 172439 - DNA, 16 bp, H. sapiens
tttctttcctttgaat

SEQ ID NO: 172440 - DNA, 16 bp, H. sapiens
tttctttctaaattca

SEQ ID NO: 172441 - DNA, 16 bp, H. sapiens
tttctttctaagaaaa

SEQ ID NO: 172442 - DNA, 16 bp, H. sapiens
tttctttctcagaaat

SEQ ID NO: 172443 - DNA, 16 bp, H. sapiens
tttctttctcagtatt

SEQ ID NO: 172444 - DNA, 16 bp, H. sapiens
tttctttctctcttga

SEQ ID NO: 172445 - DNA, 16 bp, H. sapiens
tttctttctctggaaa

SEQ ID NO: 172446 - DNA, 16 bp, H. sapiens
tttctttctgattcag

SEQ ID NO: 172447 - DNA, 16 bp, H. sapiens
tttctttctgcatctt

SEQ ID NO: 172448 - DNA, 16 bp, H. sapiens
tttctttctgctctaa

SEQ ID NO: 172449 - DNA, 16 bp, H. sapiens
tttctttctgtataaa

SEQ ID NO: 172450 - DNA, 16 bp, H. sapiens
tttctttctgtatctg

SEQ ID NO: 172451 - DNA, 16 bp, H. sapiens
tttctttcttagaaat

SEQ ID NO: 172452 - DNA, 16 bp, H. sapiens
tttctttcttcactgt

SEQ ID NO: 172453 - DNA, 16 bp, H. sapiens
tttctttcttctgcat

SEQ ID NO: 172454 - DNA, 16 bp, H. sapiens
tttctttctttgaaat

SEQ ID NO: 172455 - DNA, 16 bp, H. sapiens
tttctttctttggagg

SEQ ID NO: 172456 - DNA, 16 bp, H. sapiens
tttctttcttttgaga

SEQ ID NO: 172457 - DNA, 16 bp, H. sapiens
tttctttgaaaagaaa

SEQ ID NO: 172458 - DNA, 16 bp, H. sapiens
tttctttgaagaaaga

SEQ ID NO: 172459 - DNA, 16 bp, H. sapiens
tttctttgaagaaatt

SEQ ID NO: 172460 - DNA, 16 bp, H. sapiens
tttctttgaagacatt

SEQ ID NO: 172461 - DNA, 16 bp, H. sapiens
tttctttgaataaaat

SEQ ID NO: 172462 - DNA, 16 bp, H. sapiens
tttctttgaatttaaa

SEQ ID NO: 172463 - DNA, 16 bp, H. sapiens
tttctttgactagaaa

SEQ ID NO: 172464 - DNA, 16 bp, H. sapiens
tttctttgagcagttt

SEQ ID NO: 172465 - DNA, 16 bp, H. sapiens
tttctttgagcctcag

SEQ ID NO: 172466 - DNA, 16 bp, H. sapiens
tttctttgaggataga

SEQ ID NO: 172467 - DNA, 16 bp, H. sapiens
tttctttgatgggaaa

SEQ ID NO: 172468 - DNA, 16 bp, H. sapiens
tttctttgattttaaa

SEQ ID NO: 172469 - DNA, 16 bp, H. sapiens
tttctttgcaacttcc

SEQ ID NO: 172470 - DNA, 16 bp, H. sapiens
tttctttgcagaaatt

SEQ ID NO: 172471 - DNA, 16 bp, H. sapiens
tttctttgcctggctt

SEQ ID NO: 172472 - DNA, 16 bp, H. sapiens
tttctttgctttaaga

SEQ ID NO: 172473 - DNA, 16 bp, H. sapiens
tttctttggaaataaa

SEQ ID NO: 172474 - DNA, 16 bp, H. sapiens
tttctttgtaaattac

SEQ ID NO: 172475 - DNA, 16 bp, H. sapiens
tttctttgtaataaaa

SEQ ID NO: 172476 - DNA, 16 bp, H. sapiens
tttctttgtacatctg

SEQ ID NO: 172477 - DNA, 16 bp, H. sapiens
tttctttgtagcattt

SEQ ID NO: 172478 - DNA, 16 bp, H. sapiens
tttctttgtattataa

SEQ ID NO: 172479 - DNA, 16 bp, H. sapiens
tttctttgtccagtct

SEQ ID NO: 172480 - DNA, 16 bp, H. sapiens
tttctttgtgaaaaat

SEQ ID NO: 172481 - DNA, 16 bp, H. sapiens
tttctttgtgttaaga

SEQ ID NO: 172482 - DNA, 16 bp, H. sapiens
tttctttgtgttcatg

SEQ ID NO: 172483 - DNA, 16 bp, H. sapiens
tttctttgtgttggga

SEQ ID NO: 172484 - DNA, 16 bp, H. sapiens
tttctttgttgaaatt

SEQ ID NO: 172485 - DNA, 16 bp, H. sapiens
tttctttgttttaaaa

SEQ ID NO: 172486 - DNA, 16 bp, H. sapiens
tttcttttaaaaagta

SEQ ID NO: 172487 - DNA, 16 bp, H. sapiens
tttcttttaaaaagtg

SEQ ID NO: 172488 - DNA, 16 bp, H. sapiens
tttcttttaaaagaag

SEQ ID NO: 172489 - DNA, 16 bp, H. sapiens
tttcttttaaaatatg

SEQ ID NO: 172490 - DNA, 16 bp, H. sapiens
tttcttttaaacataa

SEQ ID NO: 172491 - DNA, 16 bp, H. sapiens
tttcttttaaatatgt

SEQ ID NO: 172492 - DNA, 16 bp, H. sapiens
tttcttttaaatctca

SEQ ID NO: 172493 - DNA, 16 bp, H. sapiens
tttcttttaagaattt

SEQ ID NO: 172494 - DNA, 16 bp, H. sapiens
tttcttttaagagaca

SEQ ID NO: 172495 - DNA, 16 bp, H. sapiens
tttcttttaagatgga

SEQ ID NO: 172496 - DNA, 16 bp, H. sapiens
tttcttttaatgagaa

SEQ ID NO: 172497 - DNA, 16 bp, H. sapiens
tttcttttacaaaaga

SEQ ID NO: 172498 - DNA, 16 bp, H. sapiens
tttcttttacaaaatg

SEQ ID NO: 172499 - DNA, 16 bp, H. sapiens
tttcttttagaacttt

SEQ ID NO: 172500 - DNA, 16 bp, H. sapiens
tttcttttagaattaa

SEQ ID NO: 172501 - DNA, 16 bp, H. sapiens
tttcttttaggtatat

SEQ ID NO: 172502 - DNA, 16 bp, H. sapiens
tttcttttataaaatg

SEQ ID NO: 172503 - DNA, 16 bp, H. sapiens
tttcttttatcaatgt

SEQ ID NO: 172504 - DNA, 16 bp, H. sapiens
tttcttttatgattca

SEQ ID NO: 172505 - DNA, 16 bp, H. sapiens
tttcttttatttgaga

SEQ ID NO: 172506 - DNA, 16 bp, H. sapiens
tttcttttcaaagaaa

SEQ ID NO: 172507 - DNA, 16 bp, H. sapiens
tttcttttcacaatat

SEQ ID NO: 172508 - DNA, 16 bp, H. sapiens
tttcttttcagattgt

SEQ ID NO: 172509 - DNA, 16 bp, H. sapiens
tttcttttcaggcatt

SEQ ID NO: 172510 - DNA, 16 bp, H. sapiens
tttcttttcagtaaat

SEQ ID NO: 172511 - DNA, 16 bp, H. sapiens
tttcttttccaaaatt

SEQ ID NO: 172512 - DNA, 16 bp, H. sapiens
tttcttttccagaaat

SEQ ID NO: 172513 - DNA, 16 bp, H. sapiens
tttcttttccagattg

SEQ ID NO: 172514 - DNA, 16 bp, H. sapiens
tttcttttccattcaa

SEQ ID NO: 172515 - DNA, 16 bp, H. sapiens
tttcttttcctcagaa

SEQ ID NO: 172516 - DNA, 16 bp, H. sapiens
tttcttttcctgaaat

SEQ ID NO: 172517 - DNA, 16 bp, H. sapiens
tttcttttcctgactt

SEQ ID NO: 172518 - DNA, 16 bp, H. sapiens
tttcttttctaaaaaa

SEQ ID NO: 172519 - DNA, 16 bp, H. sapiens
tttcttttctaacaaa

SEQ ID NO: 172520 - DNA, 16 bp, H. sapiens
tttcttttctaacata

SEQ ID NO: 172521 - DNA, 16 bp, H. sapiens
tttcttttctactgca

SEQ ID NO: 172522 - DNA, 16 bp, H. sapiens
tttcttttctcaaaaa

SEQ ID NO: 172523 - DNA, 16 bp, H. sapiens
tttcttttctcaaaag

SEQ ID NO: 172524 - DNA, 16 bp, H. sapiens
tttcttttctccacca

SEQ ID NO: 172525 - DNA, 16 bp, H. sapiens
tttcttttctcctcag

SEQ ID NO: 172526 - DNA, 16 bp, H. sapiens
tttcttttctctagct

SEQ ID NO: 172527 - DNA, 16 bp, H. sapiens
tttcttttctctgcaa

SEQ ID NO: 172528 - DNA, 16 bp, H. sapiens
tttcttttctctgcat

SEQ ID NO: 172529 - DNA, 16 bp, H. sapiens
tttcttttctgagatg

SEQ ID NO: 172530 - DNA, 16 bp, H. sapiens
tttcttttctggagga

SEQ ID NO: 172531 - DNA, 16 bp, H. sapiens
tttcttttgaaaagaa

SEQ ID NO: 172532 - DNA, 16 bp, H. sapiens
tttcttttgaaaatat

SEQ ID NO: 172533 - DNA, 16 bp, H. sapiens
tttcttttgaaagaaa

SEQ ID NO: 172534 - DNA, 16 bp, H. sapiens
tttcttttgaacattt

SEQ ID NO: 172535 - DNA, 16 bp, H. sapiens
tttcttttgaatatat

SEQ ID NO: 172536 - DNA, 16 bp, H. sapiens
tttcttttgaattaaa

SEQ ID NO: 172537 - DNA, 16 bp, H. sapiens
tttcttttgagaccaa

SEQ ID NO: 172538 - DNA, 16 bp, H. sapiens
tttcttttgagctatt

SEQ ID NO: 172539 - DNA, 16 bp, H. sapiens
tttcttttgataaaaa

SEQ ID NO: 172540 - DNA, 16 bp, H. sapiens
tttcttttgattagtg

SEQ ID NO: 172541 - DNA, 16 bp, H. sapiens
tttcttttgcagaaat

SEQ ID NO: 172542 - DNA, 16 bp, H. sapiens
tttcttttgcagcttc

SEQ ID NO: 172543 - DNA, 16 bp, H. sapiens
tttcttttgctctgca

SEQ ID NO: 172544 - DNA, 16 bp, H. sapiens
tttcttttgctgagca

SEQ ID NO: 172545 - DNA, 16 bp, H. sapiens
tttcttttgctgtgca

SEQ ID NO: 172546 - DNA, 16 bp, H. sapiens
tttcttttggaaaata

SEQ ID NO: 172547 - DNA, 16 bp, H. sapiens
tttcttttggaggtga

SEQ ID NO: 172548 - DNA, 16 bp, H. sapiens
tttcttttgggaaaaa

SEQ ID NO: 172549 - DNA, 16 bp, H. sapiens
tttcttttgtaataaa

SEQ ID NO: 172550 - DNA, 16 bp, H. sapiens
tttcttttgtataaat

SEQ ID NO: 172551 - DNA, 16 bp, H. sapiens
tttcttttgtgatgga

SEQ ID NO: 172552 - DNA, 16 bp, H. sapiens
tttcttttgttgtgaa

SEQ ID NO: 172553 - DNA, 16 bp, H. sapiens
tttctttttaaagaag

SEQ ID NO: 172554 - DNA, 16 bp, H. sapiens
tttctttttaaagtaa

SEQ ID NO: 172555 - DNA, 16 bp, H. sapiens
tttctttttaaatctg

SEQ ID NO: 172556 - DNA, 16 bp, H. sapiens
tttctttttaaattga

SEQ ID NO: 172557 - DNA, 16 bp, H. sapiens
tttctttttaagaaat

SEQ ID NO: 172558 - DNA, 16 bp, H. sapiens
tttctttttaagaatt

SEQ ID NO: 172559 - DNA, 16 bp, H. sapiens
tttctttttaaggtga

SEQ ID NO: 172560 - DNA, 16 bp, H. sapiens
tttctttttagagata

SEQ ID NO: 172561 - DNA, 16 bp, H. sapiens
tttctttttataactg

SEQ ID NO: 172562 - DNA, 16 bp, H. sapiens
tttctttttataagta

SEQ ID NO: 172563 - DNA, 16 bp, H. sapiens
tttctttttatagaaa

SEQ ID NO: 172564 - DNA, 16 bp, H. sapiens
tttctttttcagactg

SEQ ID NO: 172565 - DNA, 16 bp, H. sapiens
tttctttttcaggttg

SEQ ID NO: 172566 - DNA, 16 bp, H. sapiens
tttctttttcatggct

SEQ ID NO: 172567 - DNA, 16 bp, H. sapiens
tttctttttccagaat

SEQ ID NO: 172568 - DNA, 16 bp, H. sapiens
tttctttttcccagaa

SEQ ID NO: 172569 - DNA, 16 bp, H. sapiens
tttctttttcctagaa

SEQ ID NO: 172570 - DNA, 16 bp, H. sapiens
tttctttttcctgaaa

SEQ ID NO: 172571 - DNA, 16 bp, H. sapiens
tttctttttcctgaag

SEQ ID NO: 172572 - DNA, 16 bp, H. sapiens
tttctttttctcaagt

SEQ ID NO: 172573 - DNA, 16 bp, H. sapiens
tttctttttctgagat

SEQ ID NO: 172574 - DNA, 16 bp, H. sapiens
tttctttttctggaga

SEQ ID NO: 172575 - DNA, 16 bp, H. sapiens
tttctttttctgtcca

SEQ ID NO: 172576 - DNA, 16 bp, H. sapiens
tttctttttgaaaata

SEQ ID NO: 172577 - DNA, 16 bp, H. sapiens
tttctttttgaaagaa

SEQ ID NO: 172578 - DNA, 16 bp, H. sapiens
tttctttttgaagtga

SEQ ID NO: 172579 - DNA, 16 bp, H. sapiens
tttctttttgagaagg

SEQ ID NO: 172580 - DNA, 16 bp, H. sapiens
tttctttttgagacag

SEQ ID NO: 172581 - DNA, 16 bp, H. sapiens
tttctttttgaggtgg

SEQ ID NO: 172582 - DNA, 16 bp, H. sapiens
tttctttttggagaca

SEQ ID NO: 172583 - DNA, 16 bp, H. sapiens
tttctttttggggtaa

SEQ ID NO: 172584 - DNA, 16 bp, H. sapiens
tttctttttggtaaat

SEQ ID NO: 172585 - DNA, 16 bp, H. sapiens
tttctttttgtcactg

SEQ ID NO: 172586 - DNA, 16 bp, H. sapiens
tttcttttttaaacag

SEQ ID NO: 172587 - DNA, 16 bp, H. sapiens
tttcttttttaagaca

SEQ ID NO: 172588 - DNA, 16 bp, H. sapiens
tttcttttttaataga

SEQ ID NO: 172589 - DNA, 16 bp, H. sapiens
tttcttttttctggaa

SEQ ID NO: 172590 - DNA, 16 bp, H. sapiens
tttcttttttgagaca

SEQ ID NO: 172591 - DNA, 16 bp, H. sapiens
tttcttttttgagata

SEQ ID NO: 172592 - DNA, 16 bp, H. sapiens
tttcttttttgtcaaa

SEQ ID NO: 172593 - DNA, 16 bp, H. sapiens
tttctttttttcaaga

SEQ ID NO: 172594 - DNA, 16 bp, H. sapiens
tttctttttttcagag

SEQ ID NO: 172595 - DNA, 16 bp, H. sapiens
tttctttttttcccag

SEQ ID NO: 172596 - DNA, 16 bp, H. sapiens
tttctttttttggaag

SEQ ID NO: 172597 - DNA, 16 bp, H. sapiens
tttgaaaaaaactttt

SEQ ID NO: 172598 - DNA, 16 bp, H. sapiens
tttgaaaaaaataaca

SEQ ID NO: 172599 - DNA, 16 bp, H. sapiens
tttgaaaaaaatgtat

SEQ ID NO: 172600 - DNA, 16 bp, H. sapiens
tttgaaaaaacaaaat

SEQ ID NO: 172601 - DNA, 16 bp, H. sapiens
tttgaaaaaataagca

SEQ ID NO: 172602 - DNA, 16 bp, H. sapiens
tttgaaaaaataatgg

SEQ ID NO: 172603 - DNA, 16 bp, H. sapiens
tttgaaaaaatactta

SEQ ID NO: 172604 - DNA, 16 bp, H. sapiens
tttgaaaaaatatctt

SEQ ID NO: 172605 - DNA, 16 bp, H. sapiens
tttgaaaaacaaagca

SEQ ID NO: 172606 - DNA, 16 bp, H. sapiens
tttgaaaaacaaataa

SEQ ID NO: 172607 - DNA, 16 bp, H. sapiens
tttgaaaaacaaatta

SEQ ID NO: 172608 - DNA, 16 bp, H. sapiens
tttgaaaaacactatt

SEQ ID NO: 172609 - DNA, 16 bp, H. sapiens
tttgaaaaacactgat

SEQ ID NO: 172610 - DNA, 16 bp, H. sapiens
tttgaaaaacactttt

SEQ ID NO: 172611 - DNA, 16 bp, H. sapiens
tttgaaaaacagtttg

SEQ ID NO: 172612 - DNA, 16 bp, H. sapiens
tttgaaaaacagtttt

SEQ ID NO: 172613 - DNA, 16 bp, H. sapiens
tttgaaaaacatcttt

SEQ ID NO: 172614 - DNA, 16 bp, H. sapiens
tttgaaaaacatgaaa

SEQ ID NO: 172615 - DNA, 16 bp, H. sapiens
tttgaaaaacatttta

SEQ ID NO: 172616 - DNA, 16 bp, H. sapiens
tttgaaaaacattttc

SEQ ID NO: 172617 - DNA, 16 bp, H. sapiens
tttgaaaaactaaaat

SEQ ID NO: 172618 - DNA, 16 bp, H. sapiens
tttgaaaaactgcttt

SEQ ID NO: 172619 - DNA, 16 bp, H. sapiens
tttgaaaaacttaaaa

SEQ ID NO: 172620 - DNA, 16 bp, H. sapiens
tttgaaaaagaagaac

SEQ ID NO: 172621 - DNA, 16 bp, H. sapiens
tttgaaaaagagcaaa

SEQ ID NO: 172622 - DNA, 16 bp, H. sapiens
tttgaaaaagatattt

SEQ ID NO: 172623 - DNA, 16 bp, H. sapiens
tttgaaaaagcatttt

SEQ ID NO: 172624 - DNA, 16 bp, H. sapiens
tttgaaaaaggaaaat

SEQ ID NO: 172625 - DNA, 16 bp, H. sapiens
tttgaaaaaggagaaa

SEQ ID NO: 172626 - DNA, 16 bp, H. sapiens
tttgaaaaagtgaaaa

SEQ ID NO: 172627 - DNA, 16 bp, H. sapiens
tttgaaaaagttttaa

SEQ ID NO: 172628 - DNA, 16 bp, H. sapiens
tttgaaaaataaacat

SEQ ID NO: 172629 - DNA, 16 bp, H. sapiens
tttgaaaaataaagtt

SEQ ID NO: 172630 - DNA, 16 bp, H. sapiens
tttgaaaaataacaaa

SEQ ID NO: 172631 - DNA, 16 bp, H. sapiens
tttgaaaaatatctat

SEQ ID NO: 172632 - DNA, 16 bp, H. sapiens
tttgaaaaatatttct

SEQ ID NO: 172633 - DNA, 16 bp, H. sapiens
tttgaaaaatcatttt

SEQ ID NO: 172634 - DNA, 16 bp, H. sapiens
tttgaaaaatctcatt

SEQ ID NO: 172635 - DNA, 16 bp, H. sapiens
tttgaaaaatgatgtt

SEQ ID NO: 172636 - DNA, 16 bp, H. sapiens
tttgaaaaatgcataa

SEQ ID NO: 172637 - DNA, 16 bp, H. sapiens
tttgaaaaatgtaatt

SEQ ID NO: 172638 - DNA, 16 bp, H. sapiens
tttgaaaaatgtcaaa

SEQ ID NO: 172639 - DNA, 16 bp, H. sapiens
tttgaaaaatgtctgt

SEQ ID NO: 172640 - DNA, 16 bp, H. sapiens
tttgaaaaatgtttct

SEQ ID NO: 172641 - DNA, 16 bp, H. sapiens
tttgaaaaatgttttc

SEQ ID NO: 172642 - DNA, 16 bp, H. sapiens
tttgaaaaattattct

SEQ ID NO: 172643 - DNA, 16 bp, H. sapiens
tttgaaaaattgcttt

SEQ ID NO: 172644 - DNA, 16 bp, H. sapiens
tttgaaaaatttcaaa

SEQ ID NO: 172645 - DNA, 16 bp, H. sapiens
tttgaaaacaaaaatg

SEQ ID NO: 172646 - DNA, 16 bp, H. sapiens
tttgaaaacaaaaatt

SEQ ID NO: 172647 - DNA, 16 bp, H. sapiens
tttgaaaacaagaaaa

SEQ ID NO: 172648 - DNA, 16 bp, H. sapiens
tttgaaaacaatgttt

SEQ ID NO: 172649 - DNA, 16 bp, H. sapiens
tttgaaaacaattttt

SEQ ID NO: 172650 - DNA, 16 bp, H. sapiens
tttgaaaacacaaaat

SEQ ID NO: 172651 - DNA, 16 bp, H. sapiens
tttgaaaacacagaaa

SEQ ID NO: 172652 - DNA, 16 bp, H. sapiens
tttgaaaacatgtttt

SEQ ID NO: 172653 - DNA, 16 bp, H. sapiens
tttgaaaacattatgc

SEQ ID NO: 172654 - DNA, 16 bp, H. sapiens
tttgaaaaccactgct

SEQ ID NO: 172655 - DNA, 16 bp, H. sapiens
tttgaaaaccactggt

SEQ ID NO: 172656 - DNA, 16 bp, H. sapiens
tttgaaaaccagaaca

SEQ ID NO: 172657 - DNA, 16 bp, H. sapiens
tttgaaaactttaaaa

SEQ ID NO: 172658 - DNA, 16 bp, H. sapiens
tttgaaaagaagaaag

SEQ ID NO: 172659 - DNA, 16 bp, H. sapiens
tttgaaaagacatttt

SEQ ID NO: 172660 - DNA, 16 bp, H. sapiens
tttgaaaagacttttt

SEQ ID NO: 172661 - DNA, 16 bp, H. sapiens
tttgaaaagataagta

SEQ ID NO: 172662 - DNA, 16 bp, H. sapiens
tttgaaaagatttatt

SEQ ID NO: 172663 - DNA, 16 bp, H. sapiens
tttgaaaagattttaa

SEQ ID NO: 172664 - DNA, 16 bp, H. sapiens
tttgaaaagcactggt

SEQ ID NO: 172665 - DNA, 16 bp, H. sapiens
tttgaaaaggaaatgt

SEQ ID NO: 172666 - DNA, 16 bp, H. sapiens
tttgaaaaggaaggaa

SEQ ID NO: 172667 - DNA, 16 bp, H. sapiens
tttgaaaaggattaaa

SEQ ID NO: 172668 - DNA, 16 bp, H. sapiens
tttgaaaaggatttta

SEQ ID NO: 172669 - DNA, 16 bp, H. sapiens
tttgaaaagggagaaa

SEQ ID NO: 172670 - DNA, 16 bp, H. sapiens
tttgaaaaggttattt

SEQ ID NO: 172671 - DNA, 16 bp, H. sapiens
tttgaaaagtgtttgt

SEQ ID NO: 172672 - DNA, 16 bp, H. sapiens
tttgaaaagtttaaaa

SEQ ID NO: 172673 - DNA, 16 bp, H. sapiens
tttgaaaataaaagca

SEQ ID NO: 172674 - DNA, 16 bp, H. sapiens
tttgaaaataaaattg

SEQ ID NO: 172675 - DNA, 16 bp, H. sapiens
tttgaaaataaacatg

SEQ ID NO: 172676 - DNA, 16 bp, H. sapiens
tttgaaaataaagttt

SEQ ID NO: 172677 - DNA, 16 bp, H. sapiens
tttgaaaataaatctt

SEQ ID NO: 172678 - DNA, 16 bp, H. sapiens
tttgaaaataaattgt

SEQ ID NO: 172679 - DNA, 16 bp, H. sapiens
tttgaaaataacaaaa

SEQ ID NO: 172680 - DNA, 16 bp, H. sapiens
tttgaaaataataatg

SEQ ID NO: 172681 - DNA, 16 bp, H. sapiens
tttgaaaataatgaga

SEQ ID NO: 172682 - DNA, 16 bp, H. sapiens
tttgaaaataattatg

SEQ ID NO: 172683 - DNA, 16 bp, H. sapiens
tttgaaaatactattt

SEQ ID NO: 172684 - DNA, 16 bp, H. sapiens
tttgaaaatactttct

SEQ ID NO: 172685 - DNA, 16 bp, H. sapiens
tttgaaaatagaattt

SEQ ID NO: 172686 - DNA, 16 bp, H. sapiens
tttgaaaatataaact

SEQ ID NO: 172687 - DNA, 16 bp, H. sapiens
tttgaaaatatagaat

SEQ ID NO: 172688 - DNA, 16 bp, H. sapiens
tttgaaaatatatttg

SEQ ID NO: 172689 - DNA, 16 bp, H. sapiens
tttgaaaatatgtatt

SEQ ID NO: 172690 - DNA, 16 bp, H. sapiens
tttgaaaatatgttta

SEQ ID NO: 172691 - DNA, 16 bp, H. sapiens
tttgaaaatattactg

SEQ ID NO: 172692 - DNA, 16 bp, H. sapiens
tttgaaaatattctat

SEQ ID NO: 172693 - DNA, 16 bp, H. sapiens
tttgaaaatcaattaa

SEQ ID NO: 172694 - DNA, 16 bp, H. sapiens
tttgaaaatctctaat

SEQ ID NO: 172695 - DNA, 16 bp, H. sapiens
tttgaaaatctttttt

SEQ ID NO: 172696 - DNA, 16 bp, H. sapiens
tttgaaaatgaaagga

SEQ ID NO: 172697 - DNA, 16 bp, H. sapiens
tttgaaaatgaaagta

SEQ ID NO: 172698 - DNA, 16 bp, H. sapiens
tttgaaaatgaagaac

SEQ ID NO: 172699 - DNA, 16 bp, H. sapiens
tttgaaaatgaagaat

SEQ ID NO: 172700 - DNA, 16 bp, H. sapiens
tttgaaaatgagtaaa

SEQ ID NO: 172701 - DNA, 16 bp, H. sapiens
tttgaaaatgatatgc

SEQ ID NO: 172702 - DNA, 16 bp, H. sapiens
tttgaaaatgatttaa

SEQ ID NO: 172703 - DNA, 16 bp, H. sapiens
tttgaaaatgcagatt

SEQ ID NO: 172704 - DNA, 16 bp, H. sapiens
tttgaaaatgctttct

SEQ ID NO: 172705 - DNA, 16 bp, H. sapiens
tttgaaaatggagaaa

SEQ ID NO: 172706 - DNA, 16 bp, H. sapiens
tttgaaaatgtacaat

SEQ ID NO: 172707 - DNA, 16 bp, H. sapiens
tttgaaaatgtctgta

SEQ ID NO: 172708 - DNA, 16 bp, H. sapiens
tttgaaaatgtgattt

SEQ ID NO: 172709 - DNA, 16 bp, H. sapiens
tttgaaaatgtgtgtg

SEQ ID NO: 172710 - DNA, 16 bp, H. sapiens
tttgaaaatgttaaaa

SEQ ID NO: 172711 - DNA, 16 bp, H. sapiens
tttgaaaatgttaaat

SEQ ID NO: 172712 - DNA, 16 bp, H. sapiens
tttgaaaattcatttt

SEQ ID NO: 172713 - DNA, 16 bp, H. sapiens
tttgaaaattcttttc

SEQ ID NO: 172714 - DNA, 16 bp, H. sapiens
tttgaaaatttaaaca

SEQ ID NO: 172715 - DNA, 16 bp, H. sapiens
tttgaaaatttgaatt

SEQ ID NO: 172716 - DNA, 16 bp, H. sapiens
tttgaaaattttaaga

SEQ ID NO: 172717 - DNA, 16 bp, H. sapiens
tttgaaaattttactt

SEQ ID NO: 172718 - DNA, 16 bp, H. sapiens
tttgaaaattttcatt

SEQ ID NO: 172719 - DNA, 16 bp, H. sapiens
tttgaaaattttcttt

SEQ ID NO: 172720 - DNA, 16 bp, H. sapiens
tttgaaaattttgaaa

SEQ ID NO: 172721 - DNA, 16 bp, H. sapiens
tttgaaacaaaataat

SEQ ID NO: 172722 - DNA, 16 bp, H. sapiens
tttgaaacaaatcctg

SEQ ID NO: 172723 - DNA, 16 bp, H. sapiens
tttgaaacacaaaaat

SEQ ID NO: 172724 - DNA, 16 bp, H. sapiens
tttgaaacacagtctt

SEQ ID NO: 172725 - DNA, 16 bp, H. sapiens
tttgaaacactatttt

SEQ ID NO: 172726 - DNA, 16 bp, H. sapiens
tttgaaacagcaaaat

SEQ ID NO: 172727 - DNA, 16 bp, H. sapiens
tttgaaacatcatttt

SEQ ID NO: 172728 - DNA, 16 bp, H. sapiens
tttgaaacattttcag

SEQ ID NO: 172729 - DNA, 16 bp, H. sapiens
tttgaaaccaatgaaa

SEQ ID NO: 172730 - DNA, 16 bp, H. sapiens
tttgaaaccatcctgg

SEQ ID NO: 172731 - DNA, 17 bp, H. sapiens
tttgaaaccgatgagaa

SEQ ID NO: 172732 - DNA, 16 bp, H. sapiens
tttgaaactatatttt

SEQ ID NO: 172733 - DNA, 16 bp, H. sapiens
tttgaaactatgtaat

SEQ ID NO: 172734 - DNA, 16 bp, H. sapiens
tttgaaactattccaa

SEQ ID NO: 172735 - DNA, 16 bp, H. sapiens
tttgaaactcagtttt

SEQ ID NO: 172736 - DNA, 16 bp, H. sapiens
tttgaaactgaaaaaa

SEQ ID NO: 172737 - DNA, 16 bp, H. sapiens
tttgaaactgcctttg

SEQ ID NO: 172738 - DNA, 16 bp, H. sapiens
tttgaaactttcaaaa

SEQ ID NO: 172739 - DNA, 16 bp, H. sapiens
tttgaaagaagataaa

SEQ ID NO: 172740 - DNA, 16 bp, H. sapiens
tttgaaagaatgaata

SEQ ID NO: 172741 - DNA, 16 bp, H. sapiens
tttgaaagactctttt

SEQ ID NO: 172742 - DNA, 16 bp, H. sapiens
tttgaaagagaataaa

SEQ ID NO: 172743 - DNA, 16 bp, H. sapiens
tttgaaagagaatttt

SEQ ID NO: 172744 - DNA, 16 bp, H. sapiens
tttgaaagattttaaa

SEQ ID NO: 172745 - DNA, 16 bp, H. sapiens
tttgaaagattttgaa

SEQ ID NO: 172746 - DNA, 16 bp, H. sapiens
tttgaaagcaaaataa

SEQ ID NO: 172747 - DNA, 16 bp, H. sapiens
tttgaaagcattttac

SEQ ID NO: 172748 - DNA, 16 bp, H. sapiens
tttgaaagcattttta

SEQ ID NO: 172749 - DNA, 16 bp, H. sapiens
tttgaaagccactgct

SEQ ID NO: 172750 - DNA, 16 bp, H. sapiens
tttgaaaggaagaaaa

SEQ ID NO: 172751 - DNA, 16 bp, H. sapiens
tttgaaaggaagtcac

SEQ ID NO: 172752 - DNA, 16 bp, H. sapiens
tttgaaaggataaaaa

SEQ ID NO: 172753 - DNA, 16 bp, H. sapiens
tttgaaaggttatttt

SEQ ID NO: 172754 - DNA, 16 bp, H. sapiens
tttgaaagtaaatttt

SEQ ID NO: 172755 - DNA, 16 bp, H. sapiens
tttgaaagttatttga

SEQ ID NO: 172756 - DNA, 16 bp, H. sapiens
tttgaaagttcctttt

SEQ ID NO: 172757 - DNA, 16 bp, H. sapiens
tttgaaataaacaatg

SEQ ID NO: 172758 - DNA, 16 bp, H. sapiens
tttgaaataaactttt

SEQ ID NO: 172759 - DNA, 16 bp, H. sapiens
tttgaaataaatggaa

SEQ ID NO: 172760 - DNA, 16 bp, H. sapiens
tttgaaataaatttgt

SEQ ID NO: 172761 - DNA, 16 bp, H. sapiens
tttgaaataagaaagt

SEQ ID NO: 172762 - DNA, 16 bp, H. sapiens
tttgaaataagtaaat

SEQ ID NO: 172763 - DNA, 16 bp, H. sapiens
tttgaaatacaaaaaa

SEQ ID NO: 172764 - DNA, 16 bp, H. sapiens
tttgaaatacagaaaa

SEQ ID NO: 172765 - DNA, 18 bp, H. sapiens
tttgaaatacatcccatc

SEQ ID NO: 172766 - DNA, 16 bp, H. sapiens
tttgaaatactgattt

SEQ ID NO: 172767 - DNA, 16 bp, H. sapiens
tttgaaatagttttct

SEQ ID NO: 172768 - DNA, 16 bp, H. sapiens
tttgaaatatattctt

SEQ ID NO: 172769 - DNA, 16 bp, H. sapiens
tttgaaatatatttca

SEQ ID NO: 172770 - DNA, 16 bp, H. sapiens
tttgaaatatctttat

SEQ ID NO: 172771 - DNA, 16 bp, H. sapiens
tttgaaatatgattta

SEQ ID NO: 172772 - DNA, 16 bp, H. sapiens
tttgaaatatgttaaa

SEQ ID NO: 172773 - DNA, 16 bp, H. sapiens
tttgaaatatttacat

SEQ ID NO: 172774 - DNA, 16 bp, H. sapiens
tttgaaatatttctta

SEQ ID NO: 172775 - DNA, 16 bp, H. sapiens
tttgaaatatttcttt

SEQ ID NO: 172776 - DNA, 16 bp, H. sapiens
tttgaaatattttctt

SEQ ID NO: 172777 - DNA, 16 bp, H. sapiens
tttgaaatcagaaagt

SEQ ID NO: 172778 - DNA, 16 bp, H. sapiens
tttgaaatcaggaaat

SEQ ID NO: 172779 - DNA, 16 bp, H. sapiens
tttgaaatcagtgaga

SEQ ID NO: 172780 - DNA, 16 bp, H. sapiens
tttgaaatctatgcat

SEQ ID NO: 172781 - DNA, 16 bp, H. sapiens
tttgaaatctttgagt

SEQ ID NO: 172782 - DNA, 16 bp, H. sapiens
tttgaaatgaaaagca

SEQ ID NO: 172783 - DNA, 16 bp, H. sapiens
tttgaaatgaaaatta

SEQ ID NO: 172784 - DNA, 16 bp, H. sapiens
tttgaaatgaaatttt

SEQ ID NO: 172785 - DNA, 16 bp, H. sapiens
tttgaaatgatttcca

SEQ ID NO: 172786 - DNA, 16 bp, H. sapiens
tttgaaatgcagaaat

SEQ ID NO: 172787 - DNA, 16 bp, H. sapiens
tttgaaatgcagtttt

SEQ ID NO: 172788 - DNA, 16 bp, H. sapiens
tttgaaatgcttttta

SEQ ID NO: 172789 - DNA, 16 bp, H. sapiens
tttgaaatggaaaata

SEQ ID NO: 172790 - DNA, 16 bp, H. sapiens
tttgaaatggaaagaa

SEQ ID NO: 172791 - DNA, 16 bp, H. sapiens
tttgaaatggaaatgt

SEQ ID NO: 172792 - DNA, 16 bp, H. sapiens
tttgaaatgtaatcat

SEQ ID NO: 172793 - DNA, 16 bp, H. sapiens
tttgaaatgtaattta

SEQ ID NO: 172794 - DNA, 16 bp, H. sapiens
tttgaaatgtataaag

SEQ ID NO: 172795 - DNA, 16 bp, H. sapiens
tttgaaatgtatcaaa

SEQ ID NO: 172796 - DNA, 16 bp, H. sapiens
tttgaaatgtcatttt

SEQ ID NO: 172797 - DNA, 16 bp, H. sapiens
tttgaaatgtgaagat

SEQ ID NO: 172798 - DNA, 16 bp, H. sapiens
tttgaaatgtgagaat

SEQ ID NO: 172799 - DNA, 16 bp, H. sapiens
tttgaaatgtgcaata

SEQ ID NO: 172800 - DNA, 16 bp, H. sapiens
tttgaaatgtgtttct

SEQ ID NO: 172801 - DNA, 16 bp, H. sapiens
tttgaaatgtttaata

SEQ ID NO: 172802 - DNA, 16 bp, H. sapiens
tttgaaatgtttcttc

SEQ ID NO: 172803 - DNA, 16 bp, H. sapiens
tttgaaatgttttcta

SEQ ID NO: 172804 - DNA, 16 bp, H. sapiens
tttgaaatgttttctt

SEQ ID NO: 172805 - DNA, 16 bp, H. sapiens
tttgaaattaatgaga

SEQ ID NO: 172806 - DNA, 16 bp, H. sapiens
tttgaaattatttcaa

SEQ ID NO: 172807 - DNA, 16 bp, H. sapiens
tttgaaattgaaattt

SEQ ID NO: 172808 - DNA, 16 bp, H. sapiens
tttgaaatttactttt

SEQ ID NO: 172809 - DNA, 16 bp, H. sapiens
tttgaaattttacatt

SEQ ID NO: 172810 - DNA, 16 bp, H. sapiens
tttgaaattttatttc

SEQ ID NO: 172811 - DNA, 16 bp, H. sapiens
tttgaaattttccaaa

SEQ ID NO: 172812 - DNA, 16 bp, H. sapiens
tttgaaattttccaga

SEQ ID NO: 172813 - DNA, 16 bp, H. sapiens
tttgaaatttttcttc

SEQ ID NO: 172814 - DNA, 16 bp, H. sapiens
tttgaacaaaagaaaa

SEQ ID NO: 172815 - DNA, 16 bp, H. sapiens
tttgaacactcagcag

SEQ ID NO: 172816 - DNA, 16 bp, H. sapiens
tttgaacagggtgaga

SEQ ID NO: 172817 - DNA, 16 bp, H. sapiens
tttgaacagttggctg

SEQ ID NO: 172818 - DNA, 16 bp, H. sapiens
tttgaacatgttaaat

SEQ ID NO: 172819 - DNA, 16 bp, H. sapiens
tttgaacattttaaaa

SEQ ID NO: 172820 - DNA, 16 bp, H. sapiens
tttgaacattttaaca

SEQ ID NO: 172821 - DNA, 16 bp, H. sapiens
tttgaaccatgtgaat

SEQ ID NO: 172822 - DNA, 16 bp, H. sapiens
tttgaacccaagaggc

SEQ ID NO: 172823 - DNA, 16 bp, H. sapiens
tttgaacccagatctg

SEQ ID NO: 172824 - DNA, 16 bp, H. sapiens
tttgaacccaggaggc

SEQ ID NO: 172825 - DNA, 16 bp, H. sapiens
tttgaacccaggaggt

SEQ ID NO: 172826 - DNA, 16 bp, H. sapiens
tttgaacccaggagtt

SEQ ID NO: 172827 - DNA, 16 bp, H. sapiens
tttgaacccaggtctt

SEQ ID NO: 172828 - DNA, 16 bp, H. sapiens
tttgaacccgggaagc

SEQ ID NO: 172829 - DNA, 16 bp, H. sapiens
tttgaacccgggaggc

SEQ ID NO: 172830 - DNA, 16 bp, H. sapiens
tttgaacctgggaggc

SEQ ID NO: 172831 - DNA, 16 bp, H. sapiens
tttgaacctgggaggg

SEQ ID NO: 172832 - DNA, 16 bp, H. sapiens
tttgaacctgggaggt

SEQ ID NO: 172833 - DNA, 16 bp, H. sapiens
tttgaactcctggact

SEQ ID NO: 172834 - DNA, 16 bp, H. sapiens
tttgaactccttatat

SEQ ID NO: 172835 - DNA, 16 bp, H. sapiens
tttgaactgttttata

SEQ ID NO: 172836 - DNA, 17 bp, H. sapiens
tttgaacttgagggaga

SEQ ID NO: 172837 - DNA, 16 bp, H. sapiens
tttgaactttttaaat

SEQ ID NO: 172838 - DNA, 16 bp, H. sapiens
tttgaagaaaaaatga

SEQ ID NO: 172839 - DNA, 16 bp, H. sapiens
tttgaagaaaaaatgt

SEQ ID NO: 172840 - DNA, 16 bp, H. sapiens
tttgaagaaaaacaaa

SEQ ID NO: 172841 - DNA, 16 bp, H. sapiens
tttgaagaaaaagacc

SEQ ID NO: 172842 - DNA, 16 bp, H. sapiens
tttgaagaaaaagtgg

SEQ ID NO: 172843 - DNA, 16 bp, H. sapiens
tttgaagaaaaatttt

SEQ ID NO: 172844 - DNA, 16 bp, H. sapiens
tttgaagaaaagaaca

SEQ ID NO: 172845 - DNA, 16 bp, H. sapiens
tttgaagaaaagaggt

SEQ ID NO: 172846 - DNA, 16 bp, H. sapiens
tttgaagaaagtagtg

SEQ ID NO: 172847 - DNA, 16 bp, H. sapiens
tttgaagaaataacag

SEQ ID NO: 172848 - DNA, 16 bp, H. sapiens
tttgaagaaataattg

SEQ ID NO: 172849 - DNA, 16 bp, H. sapiens
tttgaagaaataattt

SEQ ID NO: 172850 - DNA, 16 bp, H. sapiens
tttgaagaaatcattt

SEQ ID NO: 172851 - DNA, 16 bp, H. sapiens
tttgaagaaatttaaa

SEQ ID NO: 172852 - DNA, 16 bp, H. sapiens
tttgaagaacagtttt

SEQ ID NO: 172853 - DNA, 16 bp, H. sapiens
tttgaagaagaaaatg

SEQ ID NO: 172854 - DNA, 16 bp, H. sapiens
tttgaagaataagaaa

SEQ ID NO: 172855 - DNA, 16 bp, H. sapiens
tttgaagaatatttaa

SEQ ID NO: 172856 - DNA, 16 bp, H. sapiens
tttgaagaatgaatga

SEQ ID NO: 172857 - DNA, 16 bp, H. sapiens
tttgaagaatttaaaa

SEQ ID NO: 172858 - DNA, 16 bp, H. sapiens
tttgaagacattttca

SEQ ID NO: 172859 - DNA, 16 bp, H. sapiens
tttgaagacttcattg

SEQ ID NO: 172860 - DNA, 16 bp, H. sapiens
tttgaagactttaaaa

SEQ ID NO: 172861 - DNA, 16 bp, H. sapiens
tttgaagagaaacctc

SEQ ID NO: 172862 - DNA, 16 bp, H. sapiens
tttgaagagaaattta

SEQ ID NO: 172863 - DNA, 16 bp, H. sapiens
tttgaagagagtggtg

SEQ ID NO: 172864 - DNA, 16 bp, H. sapiens
tttgaagagcagaagc

SEQ ID NO: 172865 - DNA, 16 bp, H. sapiens
tttgaagaggaattta

SEQ ID NO: 172866 - DNA, 16 bp, H. sapiens
tttgaagaggagaaaa

SEQ ID NO: 172867 - DNA, 16 bp, H. sapiens
tttgaagatgaagaaa

SEQ ID NO: 172868 - DNA, 16 bp, H. sapiens
tttgaagatggaaaaa

SEQ ID NO: 172869 - DNA, 16 bp, H. sapiens
tttgaagatggaagag

SEQ ID NO: 172870 - DNA, 16 bp, H. sapiens
tttgaagatggagaaa

SEQ ID NO: 172871 - DNA, 16 bp, H. sapiens
tttgaagatggaggca

SEQ ID NO: 172872 - DNA, 16 bp, H. sapiens
tttgaagattatatat

SEQ ID NO: 172873 - DNA, 16 bp, H. sapiens
tttgaagattctacaa

SEQ ID NO: 172874 - DNA, 16 bp, H. sapiens
tttgaagatttttctt

SEQ ID NO: 172875 - DNA, 16 bp, H. sapiens
tttgaagcaaatctca

SEQ ID NO: 172876 - DNA, 16 bp, H. sapiens
tttgaagcacaaatgt

SEQ ID NO: 172877 - DNA, 16 bp, H. sapiens
tttgaagcacagaagt

SEQ ID NO: 172878 - DNA, 16 bp, H. sapiens
tttgaagccaagcatt

SEQ ID NO: 172879 - DNA, 16 bp, H. sapiens
tttgaagccattgtga

SEQ ID NO: 172880 - DNA, 16 bp, H. sapiens
tttgaagctaacagag

SEQ ID NO: 172881 - DNA, 16 bp, H. sapiens
tttgaagctgacttct

SEQ ID NO: 172882 - DNA, 16 bp, H. sapiens
tttgaagctgcaatga

SEQ ID NO: 172883 - DNA, 16 bp, H. sapiens
tttgaagctttgaaac

SEQ ID NO: 172884 - DNA, 16 bp, H. sapiens
tttgaaggaaaaaata

SEQ ID NO: 172885 - DNA, 16 bp, H. sapiens
tttgaaggaaagaagg

SEQ ID NO: 172886 - DNA, 16 bp, H. sapiens
tttgaaggaaataaaa

SEQ ID NO: 172887 - DNA, 16 bp, H. sapiens
tttgaaggaagaaaaa

SEQ ID NO: 172888 - DNA, 16 bp, H. sapiens
tttgaaggaagaaata

SEQ ID NO: 172889 - DNA, 16 bp, H. sapiens
tttgaaggaagtggat

SEQ ID NO: 172890 - DNA, 16 bp, H. sapiens
tttgaaggaatatttt

SEQ ID NO: 172891 - DNA, 16 bp, H. sapiens
tttgaaggagaaaatg

SEQ ID NO: 172892 - DNA, 16 bp, H. sapiens
tttgaaggatattttg

SEQ ID NO: 172893 - DNA, 16 bp, H. sapiens
tttgaaggatgttttc

SEQ ID NO: 172894 - DNA, 16 bp, H. sapiens
tttgaaggcaggtagc

SEQ ID NO: 172895 - DNA, 16 bp, H. sapiens
tttgaagggaaaaaaa

SEQ ID NO: 172896 - DNA, 16 bp, H. sapiens
tttgaaggtaattttt

SEQ ID NO: 172897 - DNA, 16 bp, H. sapiens
tttgaaggtataaaac

SEQ ID NO: 172898 - DNA, 16 bp, H. sapiens
tttgaagtaaatgaaa

SEQ ID NO: 172899 - DNA, 16 bp, H. sapiens
tttgaagtaattgtga

SEQ ID NO: 172900 - DNA, 16 bp, H. sapiens
tttgaagtcaaacaga

SEQ ID NO: 172901 - DNA, 16 bp, H. sapiens
tttgaagtgaataaaa

SEQ ID NO: 172902 - DNA, 16 bp, H. sapiens
tttgaagtggagtctc

SEQ ID NO: 172903 - DNA, 16 bp, H. sapiens
tttgaagtgtgtgtgt

SEQ ID NO: 172904 - DNA, 16 bp, H. sapiens
tttgaagttaagctgc

SEQ ID NO: 172905 - DNA, 16 bp, H. sapiens
tttgaataaaatttct

SEQ ID NO: 172906 - DNA, 16 bp, H. sapiens
tttgaatatatttcat

SEQ ID NO: 172907 - DNA, 16 bp, H. sapiens
tttgaatatgttttct

SEQ ID NO: 172908 - DNA, 16 bp, H. sapiens
tttgaatattgaaaat

SEQ ID NO: 172909 - DNA, 16 bp, H. sapiens
tttgaatatttactat

SEQ ID NO: 172910 - DNA, 16 bp, H. sapiens
tttgaatattttaaga

SEQ ID NO: 172911 - DNA, 16 bp, H. sapiens
tttgaatcctgcctct

SEQ ID NO: 172912 - DNA, 16 bp, H. sapiens
tttgaatcctggctct

SEQ ID NO: 172913 - DNA, 16 bp, H. sapiens
tttgaatcctggtttt

SEQ ID NO: 172914 - DNA, 16 bp, H. sapiens
tttgaatctcaatttt

SEQ ID NO: 172915 - DNA, 16 bp, H. sapiens
tttgaatctcagctct

SEQ ID NO: 172916 - DNA, 16 bp, H. sapiens
tttgaatcttagctct

SEQ ID NO: 172917 - DNA, 16 bp, H. sapiens
tttgaatcttggctct

SEQ ID NO: 172918 - DNA, 16 bp, H. sapiens
tttgaatcttggttct

SEQ ID NO: 172919 - DNA, 16 bp, H. sapiens
tttgaatcttggtttt

SEQ ID NO: 172920 - DNA, 16 bp, H. sapiens
tttgaatctttaaaaa

SEQ ID NO: 172921 - DNA, 16 bp, H. sapiens
tttgaatgaaaaattt

SEQ ID NO: 172922 - DNA, 16 bp, H. sapiens
tttgaatgagaaaaga

SEQ ID NO: 172923 - DNA, 16 bp, H. sapiens
tttgaatgatttttca

SEQ ID NO: 172924 - DNA, 16 bp, H. sapiens
tttgaatgtgtctcag

SEQ ID NO: 172925 - DNA, 16 bp, H. sapiens
tttgaatgttctcatc

SEQ ID NO: 172926 - DNA, 16 bp, H. sapiens
tttgaatgtttgatag

SEQ ID NO: 172927 - DNA, 16 bp, H. sapiens
tttgaatgtttttgtc

SEQ ID NO: 172928 - DNA, 16 bp, H. sapiens
tttgaattaatttttc

SEQ ID NO: 172929 - DNA, 16 bp, H. sapiens
tttgaattacattttt

SEQ ID NO: 172930 - DNA, 16 bp, H. sapiens
tttgaattacttattt

SEQ ID NO: 172931 - DNA, 16 bp, H. sapiens
tttgaattccagctct

SEQ ID NO: 172932 - DNA, 16 bp, H. sapiens
tttgaattccttgtat

SEQ ID NO: 172933 - DNA, 16 bp, H. sapiens
tttgaattctgactct

SEQ ID NO: 172934 - DNA, 16 bp, H. sapiens
tttgaattgaatgaaa

SEQ ID NO: 172935 - DNA, 16 bp, H. sapiens
tttgaattggaaatat

SEQ ID NO: 172936 - DNA, 16 bp, H. sapiens
tttgaattgtatttct

SEQ ID NO: 172937 - DNA, 16 bp, H. sapiens
tttgaatttcagagaa

SEQ ID NO: 172938 - DNA, 16 bp, H. sapiens
tttgaatttcagataa

SEQ ID NO: 172939 - DNA, 16 bp, H. sapiens
tttgaatttccttctg

SEQ ID NO: 172940 - DNA, 16 bp, H. sapiens
tttgaatttctacttt

SEQ ID NO: 172941 - DNA, 16 bp, H. sapiens
tttgaatttctatatt

SEQ ID NO: 172942 - DNA, 16 bp, H. sapiens
tttgaatttctgtaat

SEQ ID NO: 172943 - DNA, 16 bp, H. sapiens
tttgaatttctttgct

SEQ ID NO: 172944 - DNA, 16 bp, H. sapiens
tttgaatttgaaaaat

SEQ ID NO: 172945 - DNA, 16 bp, H. sapiens
tttgaatttgctttca

SEQ ID NO: 172946 - DNA, 16 bp, H. sapiens
tttgaattttaaaaga

SEQ ID NO: 172947 - DNA, 16 bp, H. sapiens
tttgaattttaaaatg

SEQ ID NO: 172948 - DNA, 16 bp, H. sapiens
tttgaattttagaaaa

SEQ ID NO: 172949 - DNA, 16 bp, H. sapiens
tttgaattttagaata

SEQ ID NO: 172950 - DNA, 16 bp, H. sapiens
tttgaattttctgtgt

SEQ ID NO: 172951 - DNA, 16 bp, H. sapiens
tttgaattttctgtta

SEQ ID NO: 172952 - DNA, 16 bp, H. sapiens
tttgaattttctttca

SEQ ID NO: 172953 - DNA, 16 bp, H. sapiens
tttgaattttgatgaa

SEQ ID NO: 172954 - DNA, 16 bp, H. sapiens
tttgaattttggaata

SEQ ID NO: 172955 - DNA, 19 bp, H. sapiens
tttgaatttttagtagaga

SEQ ID NO: 172956 - DNA, 16 bp, H. sapiens
tttgaattttttcaaa

SEQ ID NO: 172957 - DNA, 16 bp, H. sapiens
tttgacaaaaatactg

SEQ ID NO: 172958 - DNA, 16 bp, H. sapiens
tttgacaaaaatatta

SEQ ID NO: 172959 - DNA, 16 bp, H. sapiens
tttgacaaaaatgcta

SEQ ID NO: 172960 - DNA, 17 bp, H. sapiens
tttgacaaaaatgctga

SEQ ID NO: 172961 - DNA, 16 bp, H. sapiens
tttgacaaaaatgttt

SEQ ID NO: 172962 - DNA, 16 bp, H. sapiens
tttgacaaaaattcaa

SEQ ID NO: 172963 - DNA, 16 bp, H. sapiens
tttgacaaaacaaaca

SEQ ID NO: 172964 - DNA, 16 bp, H. sapiens
tttgacaaaatacaac

SEQ ID NO: 172965 - DNA, 17 bp, H. sapiens
tttgacaaaatccagca

SEQ ID NO: 172966 - DNA, 16 bp, H. sapiens
tttgacaaaattcaaa

SEQ ID NO: 172967 - DNA, 17 bp, H. sapiens
tttgacaaaattcaaca

SEQ ID NO: 172968 - DNA, 16 bp, H. sapiens
tttgacaaaattcacc

SEQ ID NO: 172969 - DNA, 16 bp, H. sapiens
tttgacaaaattcagc

SEQ ID NO: 172970 - DNA, 16 bp, H. sapiens
tttgacaaacatctcc

SEQ ID NO: 172971 - DNA, 16 bp, H. sapiens
tttgacaaactgattt

SEQ ID NO: 172972 - DNA, 16 bp, H. sapiens
tttgacaaatacataa

SEQ ID NO: 172973 - DNA, 16 bp, H. sapiens
tttgacaaatatttat

SEQ ID NO: 172974 - DNA, 16 bp, H. sapiens
tttgacaaatgaagaa

SEQ ID NO: 172975 - DNA, 16 bp, H. sapiens
tttgacaaatgtaaaa

SEQ ID NO: 172976 - DNA, 16 bp, H. sapiens
tttgacaaattctttt

SEQ ID NO: 172977 - DNA, 16 bp, H. sapiens
tttgacaaggccaaca

SEQ ID NO: 172978 - DNA, 16 bp, H. sapiens
tttgacaattcttttt

SEQ ID NO: 172979 - DNA, 16 bp, H. sapiens
tttgacacactgattt

SEQ ID NO: 172980 - DNA, 16 bp, H. sapiens
tttgacagatgaaaaa

SEQ ID NO: 172981 - DNA, 16 bp, H. sapiens
tttgacagcacaacag

SEQ ID NO: 172982 - DNA, 16 bp, H. sapiens
tttgacagggtgctga

SEQ ID NO: 172983 - DNA, 16 bp, H. sapiens
tttgacatctggggcc

SEQ ID NO: 172984 - DNA, 16 bp, H. sapiens
tttgacatcttaaaaa

SEQ ID NO: 172985 - DNA, 16 bp, H. sapiens
tttgacatcttcatca

SEQ ID NO: 172986 - DNA, 16 bp, H. sapiens
tttgacatttattaaa

SEQ ID NO: 172987 - DNA, 16 bp, H. sapiens
tttgacatttatttta

SEQ ID NO: 172988 - DNA, 16 bp, H. sapiens
tttgacattttataat

SEQ ID NO: 172989 - DNA, 16 bp, H. sapiens
tttgacattttcagca

SEQ ID NO: 172990 - DNA, 16 bp, H. sapiens
tttgacatttttgtca

SEQ ID NO: 172991 - DNA, 16 bp, H. sapiens
tttgacattttttaaa

SEQ ID NO: 172992 - DNA, 16 bp, H. sapiens
tttgacccagccatca

SEQ ID NO: 172993 - DNA, 16 bp, H. sapiens
tttgacctcttcccat

SEQ ID NO: 172994 - DNA, 16 bp, H. sapiens
tttgaccttctcccat

SEQ ID NO: 172995 - DNA, 16 bp, H. sapiens
tttgaccttggaaaat

SEQ ID NO: 172996 - DNA, 16 bp, H. sapiens
tttgacctttttaaaa

SEQ ID NO: 172997 - DNA, 16 bp, H. sapiens
tttgacgagctgacag

SEQ ID NO: 172998 - DNA, 16 bp, H. sapiens
tttgactatggctgcc

SEQ ID NO: 172999 - DNA, 16 bp, H. sapiens
tttgactattatttta

SEQ ID NO: 173000 - DNA, 16 bp, H. sapiens
tttgactattttaaat

SEQ ID NO: 173001 - DNA, 17 bp, H. sapiens
tttgactccacgtctca

SEQ ID NO: 173002 - DNA, 16 bp, H. sapiens
tttgactctccccaca

SEQ ID NO: 173003 - DNA, 16 bp, H. sapiens
tttgactgcattttga

SEQ ID NO: 173004 - DNA, 16 bp, H. sapiens
tttgactggcttcttt

SEQ ID NO: 173005 - DNA, 16 bp, H. sapiens
tttgactgtttttgac

SEQ ID NO: 173006 - DNA, 16 bp, H. sapiens
tttgacttagaataat

SEQ ID NO: 173007 - DNA, 16 bp, H. sapiens
tttgacttatttcact

SEQ ID NO: 173008 - DNA, 16 bp, H. sapiens
tttgacttccctgggc

SEQ ID NO: 173009 - DNA, 16 bp, H. sapiens
tttgacttcctctctt

SEQ ID NO: 173010 - DNA, 17 bp, H. sapiens
tttgacttcctcttttc

SEQ ID NO: 173011 - DNA, 16 bp, H. sapiens
tttgacttcctgggct

SEQ ID NO: 173012 - DNA, 16 bp, H. sapiens
tttgactttctatttc

SEQ ID NO: 173013 - DNA, 16 bp, H. sapiens
tttgactttctccttt

SEQ ID NO: 173014 - DNA, 16 bp, H. sapiens
tttgactttctgagtt

SEQ ID NO: 173015 - DNA, 16 bp, H. sapiens
tttgactttctgtctt

SEQ ID NO: 173016 - DNA, 16 bp, H. sapiens
tttgactttcttagat

SEQ ID NO: 173017 - DNA, 16 bp, H. sapiens
tttgactttgcttatg

SEQ ID NO: 173018 - DNA, 16 bp, H. sapiens
tttgactttgtttctg

SEQ ID NO: 173019 - DNA, 16 bp, H. sapiens
tttgacttttaaaaaa

SEQ ID NO: 173020 - DNA, 16 bp, H. sapiens
tttgacttttaaaaat

SEQ ID NO: 173021 - DNA, 16 bp, H. sapiens
tttgacttttaaatat

SEQ ID NO: 173022 - DNA, 16 bp, H. sapiens
tttgacttttaaattt

SEQ ID NO: 173023 - DNA, 16 bp, H. sapiens
tttgacttttctagat

SEQ ID NO: 173024 - DNA, 16 bp, H. sapiens
tttgacttttgacaat

SEQ ID NO: 173025 - DNA, 16 bp, H. sapiens
tttgactttttaaaaa

SEQ ID NO: 173026 - DNA, 16 bp, H. sapiens
tttgactttttaaaat

SEQ ID NO: 173027 - DNA, 16 bp, H. sapiens
tttgactttttataat

SEQ ID NO: 173028 - DNA, 16 bp, H. sapiens
tttgactttttgaaaa

SEQ ID NO: 173029 - DNA, 16 bp, H. sapiens
tttgagaaaaaatatt

SEQ ID NO: 173030 - DNA, 16 bp, H. sapiens
tttgagaaaaatgtgt

SEQ ID NO: 173031 - DNA, 16 bp, H. sapiens
tttgagaaaactccaa

SEQ ID NO: 173032 - DNA, 16 bp, H. sapiens
tttgagaaaataaatt

SEQ ID NO: 173033 - DNA, 16 bp, H. sapiens
tttgagaaaatatctg

SEQ ID NO: 173034 - DNA, 16 bp, H. sapiens
tttgagaaaatatttt

SEQ ID NO: 173035 - DNA, 16 bp, H. sapiens
tttgagaaaattaatt

SEQ ID NO: 173036 - DNA, 16 bp, H. sapiens
tttgagaaacaaattt

SEQ ID NO: 173037 - DNA, 16 bp, H. sapiens
tttgagaaacactgcc

SEQ ID NO: 173038 - DNA, 16 bp, H. sapiens
tttgagaaacagaaag

SEQ ID NO: 173039 - DNA, 16 bp, H. sapiens
tttgagaaactgccag

SEQ ID NO: 173040 - DNA, 16 bp, H. sapiens
tttgagaaagaaaaag

SEQ ID NO: 173041 - DNA, 16 bp, H. sapiens
tttgagaaagaaataa

SEQ ID NO: 173042 - DNA, 16 bp, H. sapiens
tttgagaaagaagaaa

SEQ ID NO: 173043 - DNA, 16 bp, H. sapiens
tttgagaaaggaaaaa

SEQ ID NO: 173044 - DNA, 16 bp, H. sapiens
tttgagaaataattta

SEQ ID NO: 173045 - DNA, 16 bp, H. sapiens
tttgagaaatatggaa

SEQ ID NO: 173046 - DNA, 16 bp, H. sapiens
tttgagaaatgaatga

SEQ ID NO: 173047 - DNA, 16 bp, H. sapiens
tttgagaaatgcaaat

SEQ ID NO: 173048 - DNA, 16 bp, H. sapiens
tttgagaaatgctgct

SEQ ID NO: 173049 - DNA, 16 bp, H. sapiens
tttgagaaatgtcatt

SEQ ID NO: 173050 - DNA, 16 bp, H. sapiens
tttgagaaatgtctat

SEQ ID NO: 173051 - DNA, 16 bp, H. sapiens
tttgagaaatttctgt

SEQ ID NO: 173052 - DNA, 16 bp, H. sapiens
tttgagaaattttcag

SEQ ID NO: 173053 - DNA, 16 bp, H. sapiens
tttgagaaattttctt

SEQ ID NO: 173054 - DNA, 16 bp, H. sapiens
tttgagaacagcatgg

SEQ ID NO: 173055 - DNA, 16 bp, H. sapiens
tttgagaacagcctga

SEQ ID NO: 173056 - DNA, 16 bp, H. sapiens
tttgagaacagcttgg

SEQ ID NO: 173057 - DNA, 16 bp, H. sapiens
tttgagaacaggctgg

SEQ ID NO: 173058 - DNA, 16 bp, H. sapiens
tttgagaaccactggc

SEQ ID NO: 173059 - DNA, 16 bp, H. sapiens
tttgagaaccagtgct

SEQ ID NO: 173060 - DNA, 16 bp, H. sapiens
tttgagaaccattgtt

SEQ ID NO: 173061 - DNA, 16 bp, H. sapiens
tttgagaactgctgct

SEQ ID NO: 173062 - DNA, 16 bp, H. sapiens
tttgagaactgtaaca

SEQ ID NO: 173063 - DNA, 16 bp, H. sapiens
tttgagaagatatttt

SEQ ID NO: 173064 - DNA, 16 bp, H. sapiens
tttgagaagcactgaa

SEQ ID NO: 173065 - DNA, 16 bp, H. sapiens
tttgagaagcactgtt

SEQ ID NO: 173066 - DNA, 16 bp, H. sapiens
tttgagaagcatttgt

SEQ ID NO: 173067 - DNA, 16 bp, H. sapiens
tttgagaagctctgct

SEQ ID NO: 173068 - DNA, 16 bp, H. sapiens
tttgagaagctgaggc

SEQ ID NO: 173069 - DNA, 16 bp, H. sapiens
tttgagaaggaaaata

SEQ ID NO: 173070 - DNA, 16 bp, H. sapiens
tttgagaaggagtctc

SEQ ID NO: 173071 - DNA, 16 bp, H. sapiens
tttgagaagtatttgt

SEQ ID NO: 173072 - DNA, 16 bp, H. sapiens
tttgagaagtgctgct

SEQ ID NO: 173073 - DNA, 18 bp, H. sapiens
tttgagaagtgtctgttg

SEQ ID NO: 173074 - DNA, 16 bp, H. sapiens
tttgagaagtgtcttt

SEQ ID NO: 173075 - DNA, 16 bp, H. sapiens
tttgagaatctgatga

SEQ ID NO: 173076 - DNA, 16 bp, H. sapiens
tttgagaatgagtctc

SEQ ID NO: 173077 - DNA, 16 bp, H. sapiens
tttgagaattatctgt

SEQ ID NO: 173078 - DNA, 16 bp, H. sapiens
tttgagacacagtctc

SEQ ID NO: 173079 - DNA, 16 bp, H. sapiens
tttgagacacggtctc

SEQ ID NO: 173080 - DNA, 16 bp, H. sapiens
tttgagacagagtcca

SEQ ID NO: 173081 - DNA, 16 bp, H. sapiens
tttgagacagagtctc

SEQ ID NO: 173082 - DNA, 16 bp, H. sapiens
tttgagacagagttat

SEQ ID NO: 173083 - DNA, 16 bp, H. sapiens
tttgagacaggcctgg

SEQ ID NO: 173084 - DNA, 16 bp, H. sapiens
tttgagacagggtctg

SEQ ID NO: 173085 - DNA, 16 bp, H. sapiens
tttgagacagtttctt

SEQ ID NO: 173086 - DNA, 16 bp, H. sapiens
tttgagaccaagtttc

SEQ ID NO: 173087 - DNA, 16 bp, H. sapiens
tttgagaccagcccgg

SEQ ID NO: 173088 - DNA, 17 bp, H. sapiens
tttgagacgaagtctca

SEQ ID NO: 173089 - DNA, 19 bp, H. sapiens
tttgagacggagtctccct

SEQ ID NO: 173090 - DNA, 17 bp, H. sapiens
tttgagacggagtttct

SEQ ID NO: 173091 - DNA, 16 bp, H. sapiens
tttgagactgaatttc

SEQ ID NO: 173092 - DNA, 16 bp, H. sapiens
tttgagactgacctgg

SEQ ID NO: 173093 - DNA, 16 bp, H. sapiens
tttgagactgatctcc

SEQ ID NO: 173094 - DNA, 16 bp, H. sapiens
tttgagactgggtctc

SEQ ID NO: 173095 - DNA, 16 bp, H. sapiens
tttgagagaaaaataa

SEQ ID NO: 173096 - DNA, 16 bp, H. sapiens
tttgagagaattgact

SEQ ID NO: 173097 - DNA, 16 bp, H. sapiens
tttgagagacagagtt

SEQ ID NO: 173098 - DNA, 16 bp, H. sapiens
tttgagagagaaaaaa

SEQ ID NO: 173099 - DNA, 16 bp, H. sapiens
tttgagagagaaaaag

SEQ ID NO: 173100 - DNA, 16 bp, H. sapiens
tttgagagagaaagtg

SEQ ID NO: 173101 - DNA, 17 bp, H. sapiens
tttgagagagcagggta

SEQ ID NO: 173102 - DNA, 16 bp, H. sapiens
tttgagagcagcctga

SEQ ID NO: 173103 - DNA, 16 bp, H. sapiens
tttgagagcatcctgg

SEQ ID NO: 173104 - DNA, 16 bp, H. sapiens
tttgagagctccagtg

SEQ ID NO: 173105 - DNA, 16 bp, H. sapiens
tttgagaggccaaagc

SEQ ID NO: 173106 - DNA, 16 bp, H. sapiens
tttgagaggccaaagt

SEQ ID NO: 173107 - DNA, 16 bp, H. sapiens
tttgagaggccgagga

SEQ ID NO: 173108 - DNA, 16 bp, H. sapiens
tttgagaggcctaggc

SEQ ID NO: 173109 - DNA, 16 bp, H. sapiens
tttgagaggctgagac

SEQ ID NO: 173110 - DNA, 17 bp, H. sapiens
tttgagaggctgaggca

SEQ ID NO: 173111 - DNA, 16 bp, H. sapiens
tttgagagtttctttt

SEQ ID NO: 173112 - DNA, 16 bp, H. sapiens
tttgagataatttgtt

SEQ ID NO: 173113 - DNA, 16 bp, H. sapiens
tttgagatagagtctc

SEQ ID NO: 173114 - DNA, 16 bp, H. sapiens
tttgagatattttaaa

SEQ ID NO: 173115 - DNA, 16 bp, H. sapiens
tttgagatcagcccag

SEQ ID NO: 173116 - DNA, 16 bp, H. sapiens
tttgagatcaggagtt

SEQ ID NO: 173117 - DNA, 16 bp, H. sapiens
tttgagatgatggaaa

SEQ ID NO: 173118 - DNA, 16 bp, H. sapiens
tttgagatggaatttc

SEQ ID NO: 173119 - DNA, 16 bp, H. sapiens
tttgagatggagcctc

SEQ ID NO: 173120 - DNA, 16 bp, H. sapiens
tttgagatggaggagt

SEQ ID NO: 173121 - DNA, 17 bp, H. sapiens
tttgagatggagtcttg

SEQ ID NO: 173122 - DNA, 16 bp, H. sapiens
tttgagattagcctgg

SEQ ID NO: 173123 - DNA, 16 bp, H. sapiens
tttgagattcatccat

SEQ ID NO: 173124 - DNA, 16 bp, H. sapiens
tttgagatttttatct

SEQ ID NO: 173125 - DNA, 16 bp, H. sapiens
tttgagcatctttaag

SEQ ID NO: 173126 - DNA, 16 bp, H. sapiens
tttgagcccaggaatt

SEQ ID NO: 173127 - DNA, 16 bp, H. sapiens
tttgagcccaggaggt

SEQ ID NO: 173128 - DNA, 16 bp, H. sapiens
tttgagcccaggagtt

SEQ ID NO: 173129 - DNA, 16 bp, H. sapiens
tttgagcccaggggtt

SEQ ID NO: 173130 - DNA, 16 bp, H. sapiens
tttgagcccatgtgtg

SEQ ID NO: 173131 - DNA, 16 bp, H. sapiens
tttgagcctaggagtt

SEQ ID NO: 173132 - DNA, 16 bp, H. sapiens
tttgagctcagcctgg

SEQ ID NO: 173133 - DNA, 16 bp, H. sapiens
tttgagctcaggaatt

SEQ ID NO: 173134 - DNA, 16 bp, H. sapiens
tttgagctcaggagtt

SEQ ID NO: 173135 - DNA, 16 bp, H. sapiens
tttgagctgagacaat

SEQ ID NO: 173136 - DNA, 16 bp, H. sapiens
tttgagcttcccagcc

SEQ ID NO: 173137 - DNA, 16 bp, H. sapiens
tttgaggaaaaaaatg

SEQ ID NO: 173138 - DNA, 16 bp, H. sapiens
tttgaggaaaagcaaa

SEQ ID NO: 173139 - DNA, 16 bp, H. sapiens
tttgaggaaaaggaaa

SEQ ID NO: 173140 - DNA, 16 bp, H. sapiens
tttgaggaaagcaaaa

SEQ ID NO: 173141 - DNA, 16 bp, H. sapiens
tttgaggaaataatca

SEQ ID NO: 173142 - DNA, 16 bp, H. sapiens
tttgaggaaatatttt

SEQ ID NO: 173143 - DNA, 16 bp, H. sapiens
tttgaggaaatgccag

SEQ ID NO: 173144 - DNA, 16 bp, H. sapiens
tttgaggaaattcaaa

SEQ ID NO: 173145 - DNA, 16 bp, H. sapiens
tttgaggaacccccat

SEQ ID NO: 173146 - DNA, 16 bp, H. sapiens
tttgaggaactgcaaa

SEQ ID NO: 173147 - DNA, 16 bp, H. sapiens
tttgaggaagaaaaaa

SEQ ID NO: 173148 - DNA, 16 bp, H. sapiens
tttgaggacctgctgt

SEQ ID NO: 173149 - DNA, 16 bp, H. sapiens
tttgaggacttggtca

SEQ ID NO: 173150 - DNA, 16 bp, H. sapiens
tttgaggagcccttca

SEQ ID NO: 173151 - DNA, 16 bp, H. sapiens
tttgaggaggcagtgt

SEQ ID NO: 173152 - DNA, 16 bp, H. sapiens
tttgaggaggccctgc

SEQ ID NO: 173153 - DNA, 16 bp, H. sapiens
tttgaggagtactggt

SEQ ID NO: 173154 - DNA, 16 bp, H. sapiens
tttgaggcagagtctc

SEQ ID NO: 173155 - DNA, 16 bp, H. sapiens
tttgaggccagcctga

SEQ ID NO: 173156 - DNA, 16 bp, H. sapiens
tttgaggccaggagtt

SEQ ID NO: 173157 - DNA, 16 bp, H. sapiens
tttgaggcctgcctgg

SEQ ID NO: 173158 - DNA, 16 bp, H. sapiens
tttgaggcctgtggtg

SEQ ID NO: 173159 - DNA, 16 bp, H. sapiens
tttgaggctatttcct

SEQ ID NO: 173160 - DNA, 16 bp, H. sapiens
tttgagggcagaaagc

SEQ ID NO: 173161 - DNA, 16 bp, H. sapiens
tttgagggcctctaaa

SEQ ID NO: 173162 - DNA, 16 bp, H. sapiens
tttgaggtcaggagtt

SEQ ID NO: 173163 - DNA, 16 bp, H. sapiens
tttgaggtcgggagtt

SEQ ID NO: 173164 - DNA, 16 bp, H. sapiens
tttgaggtgacagtga

SEQ ID NO: 173165 - DNA, 16 bp, H. sapiens
tttgaggtgtgacctt

SEQ ID NO: 173166 - DNA, 16 bp, H. sapiens
tttgagtagaattggt

SEQ ID NO: 173167 - DNA, 20 bp, H. sapiens
tttgagtagagacggggttt

SEQ ID NO: 173168 - DNA, 16 bp, H. sapiens
tttgagtagagatggg

SEQ ID NO: 173169 - DNA, 16 bp, H. sapiens
tttgagtatcttttca

SEQ ID NO: 173170 - DNA, 16 bp, H. sapiens
tttgagtcctggcttt

SEQ ID NO: 173171 - DNA, 16 bp, H. sapiens
tttgagtcttcatttt

SEQ ID NO: 173172 - DNA, 16 bp, H. sapiens
tttgagtcttctctct

SEQ ID NO: 173173 - DNA, 16 bp, H. sapiens
tttgagtctttttaaa

SEQ ID NO: 173174 - DNA, 16 bp, H. sapiens
tttgagtgaaataaaa

SEQ ID NO: 173175 - DNA, 16 bp, H. sapiens
tttgagtggtgccttt

SEQ ID NO: 173176 - DNA, 16 bp, H. sapiens
tttgagtgttttaaga

SEQ ID NO: 173177 - DNA, 16 bp, H. sapiens
tttgagttcaggagtt

SEQ ID NO: 173178 - DNA, 16 bp, H. sapiens
tttgagttcctgtttt

SEQ ID NO: 173179 - DNA, 16 bp, H. sapiens
tttgagttctggctct

SEQ ID NO: 173180 - DNA, 16 bp, H. sapiens
tttgagttctttgaaa

SEQ ID NO: 173181 - DNA, 16 bp, H. sapiens
tttgagttctttgtaa

SEQ ID NO: 173182 - DNA, 16 bp, H. sapiens
tttgagttggtgctgg

SEQ ID NO: 173183 - DNA, 16 bp, H. sapiens
tttgagtttaatttgc

SEQ ID NO: 173184 - DNA, 16 bp, H. sapiens
tttgagtttcctcaaa

SEQ ID NO: 173185 - DNA, 16 bp, H. sapiens
tttgagtttctcacca

SEQ ID NO: 173186 - DNA, 16 bp, H. sapiens
tttgagttttacattt

SEQ ID NO: 173187 - DNA, 16 bp, H. sapiens
tttgagtttttaaaaa

SEQ ID NO: 173188 - DNA, 16 bp, H. sapiens
tttgataaaatccagt

SEQ ID NO: 173189 - DNA, 16 bp, H. sapiens
tttgataaaattcaac

SEQ ID NO: 173190 - DNA, 16 bp, H. sapiens
tttgataaagaaaatg

SEQ ID NO: 173191 - DNA, 16 bp, H. sapiens
tttgataaggaaaagt

SEQ ID NO: 173192 - DNA, 16 bp, H. sapiens
tttgataatattcaac

SEQ ID NO: 173193 - DNA, 16 bp, H. sapiens
tttgataattttcatt

SEQ ID NO: 173194 - DNA, 17 bp, H. sapiens
tttgatacagacatgca

SEQ ID NO: 173195 - DNA, 16 bp, H. sapiens
tttgatacagagtctt

SEQ ID NO: 173196 - DNA, 16 bp, H. sapiens
tttgatacatgtatat

SEQ ID NO: 173197 - DNA, 16 bp, H. sapiens
tttgatacattcatat

SEQ ID NO: 173198 - DNA, 16 bp, H. sapiens
tttgatacatttaaaa

SEQ ID NO: 173199 - DNA, 16 bp, H. sapiens
tttgatacatttttaa

SEQ ID NO: 173200 - DNA, 16 bp, H. sapiens
tttgatatcagaatga

SEQ ID NO: 173201 - DNA, 16 bp, H. sapiens
tttgatatgcatttct

SEQ ID NO: 173202 - DNA, 16 bp, H. sapiens
tttgatattcatgaac

SEQ ID NO: 173203 - DNA, 16 bp, H. sapiens
tttgatatttgacaaa

SEQ ID NO: 173204 - DNA, 16 bp, H. sapiens
tttgatattttattca

SEQ ID NO: 173205 - DNA, 16 bp, H. sapiens
tttgatattttctgaa

SEQ ID NO: 173206 - DNA, 16 bp, H. sapiens
tttgatcaccaataaa

SEQ ID NO: 173207 - DNA, 16 bp, H. sapiens
tttgatccaagtgctt

SEQ ID NO: 173208 - DNA, 16 bp, H. sapiens
tttgatccagtgctga

SEQ ID NO: 173209 - DNA, 16 bp, H. sapiens
tttgatccattttcag

SEQ ID NO: 173210 - DNA, 16 bp, H. sapiens
tttgatcctttcatta

SEQ ID NO: 173211 - DNA, 16 bp, H. sapiens
tttgatccttttcaaa

SEQ ID NO: 173212 - DNA, 16 bp, H. sapiens
tttgatctctttctct

SEQ ID NO: 173213 - DNA, 16 bp, H. sapiens
tttgatcttcaacaaa

SEQ ID NO: 173214 - DNA, 16 bp, H. sapiens
tttgatcttggacttt

SEQ ID NO: 173215 - DNA, 16 bp, H. sapiens
tttgatgaaaaagagc

SEQ ID NO: 173216 - DNA, 16 bp, H. sapiens
tttgatgaaaaatatt

SEQ ID NO: 173217 - DNA, 16 bp, H. sapiens
tttgatgaacagaaat

SEQ ID NO: 173218 - DNA, 16 bp, H. sapiens
tttgatgaagtccaat

SEQ ID NO: 173219 - DNA, 16 bp, H. sapiens
tttgatgaagttcaat

SEQ ID NO: 173220 - DNA, 16 bp, H. sapiens
tttgatgagctgctgg

SEQ ID NO: 173221 - DNA, 16 bp, H. sapiens
tttgatgaggattttt

SEQ ID NO: 173222 - DNA, 17 bp, H. sapiens
tttgatgatgatgatga

SEQ ID NO: 173223 - DNA, 18 bp, H. sapiens
tttgatgatggtgatgta

SEQ ID NO: 173224 - DNA, 16 bp, H. sapiens
tttgatgattatttct

SEQ ID NO: 173225 - DNA, 16 bp, H. sapiens
tttgatgcattttgag

SEQ ID NO: 173226 - DNA, 16 bp, H. sapiens
tttgatgcctgtgctg

SEQ ID NO: 173227 - DNA, 16 bp, H. sapiens
tttgatgctatcataa

SEQ ID NO: 173228 - DNA, 16 bp, H. sapiens
tttgatgctattatga

SEQ ID NO: 173229 - DNA, 16 bp, H. sapiens
tttgatgggattcttt

SEQ ID NO: 173230 - DNA, 16 bp, H. sapiens
tttgatgggattgttg

SEQ ID NO: 173231 - DNA, 16 bp, H. sapiens
tttgatgggtacagag

SEQ ID NO: 173232 - DNA, 16 bp, H. sapiens
tttgatgtcattaaca

SEQ ID NO: 173233 - DNA, 16 bp, H. sapiens
tttgatgtcttctttg

SEQ ID NO: 173234 - DNA, 16 bp, H. sapiens
tttgatgtgctgccag

SEQ ID NO: 173235 - DNA, 16 bp, H. sapiens
tttgatgtgtcaactt

SEQ ID NO: 173236 - DNA, 16 bp, H. sapiens
tttgatgtttaaaata

SEQ ID NO: 173237 - DNA, 16 bp, H. sapiens
tttgattaataaagat

SEQ ID NO: 173238 - DNA, 16 bp, H. sapiens
tttgattaatgtttgc

SEQ ID NO: 173239 - DNA, 16 bp, H. sapiens
tttgattacatgaata

SEQ ID NO: 173240 - DNA, 16 bp, H. sapiens
tttgattactagtgag

SEQ ID NO: 173241 - DNA, 16 bp, H. sapiens
tttgattagcatttcc

SEQ ID NO: 173242 - DNA, 16 bp, H. sapiens
tttgattatttcaggt

SEQ ID NO: 173243 - DNA, 16 bp, H. sapiens
tttgattattttctga

SEQ ID NO: 173244 - DNA, 16 bp, H. sapiens
tttgattcagcaggtt

SEQ ID NO: 173245 - DNA, 16 bp, H. sapiens
tttgattcatctctct

SEQ ID NO: 173246 - DNA, 16 bp, H. sapiens
tttgattccatttcat

SEQ ID NO: 173247 - DNA, 16 bp, H. sapiens
tttgattctccatttt

SEQ ID NO: 173248 - DNA, 16 bp, H. sapiens
tttgattcttctcaaa

SEQ ID NO: 173249 - DNA, 16 bp, H. sapiens
tttgattcttctctcc

SEQ ID NO: 173250 - DNA, 16 bp, H. sapiens
tttgattgccctgctg

SEQ ID NO: 173251 - DNA, 16 bp, H. sapiens
tttgattgctctgtgg

SEQ ID NO: 173252 - DNA, 16 bp, H. sapiens
tttgattgtttaaaag

SEQ ID NO: 173253 - DNA, 16 bp, H. sapiens
tttgatttaaaaatgt

SEQ ID NO: 173254 - DNA, 16 bp, H. sapiens
tttgatttacatttat

SEQ ID NO: 173255 - DNA, 16 bp, H. sapiens
tttgatttatttctgc

SEQ ID NO: 173256 - DNA, 16 bp, H. sapiens
tttgatttcaaaatat

SEQ ID NO: 173257 - DNA, 16 bp, H. sapiens
tttgatttcacaggct

SEQ ID NO: 173258 - DNA, 16 bp, H. sapiens
tttgatttctctctct

SEQ ID NO: 173259 - DNA, 16 bp, H. sapiens
tttgatttcttcctgg

SEQ ID NO: 173260 - DNA, 16 bp, H. sapiens
tttgatttctttgtag

SEQ ID NO: 173261 - DNA, 16 bp, H. sapiens
tttgatttgaagtgag

SEQ ID NO: 173262 - DNA, 16 bp, H. sapiens
tttgatttgccagtat

SEQ ID NO: 173263 - DNA, 16 bp, H. sapiens
tttgatttgctagtat

SEQ ID NO: 173264 - DNA, 16 bp, H. sapiens
tttgattttaaaaaca

SEQ ID NO: 173265 - DNA, 16 bp, H. sapiens
tttgattttaaaaagt

SEQ ID NO: 173266 - DNA, 16 bp, H. sapiens
tttgattttaaagaaa

SEQ ID NO: 173267 - DNA, 16 bp, H. sapiens
tttgattttagaaaaa

SEQ ID NO: 173268 - DNA, 16 bp, H. sapiens
tttgattttctaatta

SEQ ID NO: 173269 - DNA, 16 bp, H. sapiens
tttgattttctgaaat

SEQ ID NO: 173270 - DNA, 16 bp, H. sapiens
tttgattttcttaata

SEQ ID NO: 173271 - DNA, 16 bp, H. sapiens
tttgatttttaaaggc

SEQ ID NO: 173272 - DNA, 16 bp, H. sapiens
tttgatttttttcccc

SEQ ID NO: 173273 - DNA, 16 bp, H. sapiens
tttgcaaaaaaaaatt

SEQ ID NO: 173274 - DNA, 16 bp, H. sapiens
tttgcaaaaatatttt

SEQ ID NO: 173275 - DNA, 16 bp, H. sapiens
tttgcaaaacaaaaca

SEQ ID NO: 173276 - DNA, 16 bp, H. sapiens
tttgcaaaagacataa

SEQ ID NO: 173277 - DNA, 16 bp, H. sapiens
tttgcaaaagagaaaa

SEQ ID NO: 173278 - DNA, 16 bp, H. sapiens
tttgcaaaagcagttt

SEQ ID NO: 173279 - DNA, 16 bp, H. sapiens
tttgcaaaagtaaaat

SEQ ID NO: 173280 - DNA, 16 bp, H. sapiens
tttgcaaaataaattt

SEQ ID NO: 173281 - DNA, 16 bp, H. sapiens
tttgcaaaatgagaat

SEQ ID NO: 173282 - DNA, 16 bp, H. sapiens
tttgcaaaatgatgaa

SEQ ID NO: 173283 - DNA, 16 bp, H. sapiens
tttgcaaaattatgac

SEQ ID NO: 173284 - DNA, 16 bp, H. sapiens
tttgcaaaattgtttt

SEQ ID NO: 173285 - DNA, 16 bp, H. sapiens
tttgcaaaatttttct

SEQ ID NO: 173286 - DNA, 16 bp, H. sapiens
tttgcaaacaaatcag

SEQ ID NO: 173287 - DNA, 16 bp, H. sapiens
tttgcaaaccatatat

SEQ ID NO: 173288 - DNA, 16 bp, H. sapiens
tttgcaaacctcatgg

SEQ ID NO: 173289 - DNA, 16 bp, H. sapiens
tttgcaaactaagcat

SEQ ID NO: 173290 - DNA, 16 bp, H. sapiens
tttgcaaactctgcat

SEQ ID NO: 173291 - DNA, 16 bp, H. sapiens
tttgcaaactgcccat

SEQ ID NO: 173292 - DNA, 16 bp, H. sapiens
tttgcaaactgtccat

SEQ ID NO: 173293 - DNA, 16 bp, H. sapiens
tttgcaaactgtgtat

SEQ ID NO: 173294 - DNA, 16 bp, H. sapiens
tttgcaaagaagaaaa

SEQ ID NO: 173295 - DNA, 16 bp, H. sapiens
tttgcaaagcaaaaat

SEQ ID NO: 173296 - DNA, 16 bp, H. sapiens
tttgcaaaggcagttt

SEQ ID NO: 173297 - DNA, 16 bp, H. sapiens
tttgcaaaggctgttt

SEQ ID NO: 173298 - DNA, 16 bp, H. sapiens
tttgcaaagtgctttc

SEQ ID NO: 173299 - DNA, 16 bp, H. sapiens
tttgcaaataaattgg

SEQ ID NO: 173300 - DNA, 16 bp, H. sapiens
tttgcaaatacagaat

SEQ ID NO: 173301 - DNA, 16 bp, H. sapiens
tttgcaaatatatttt

SEQ ID NO: 173302 - DNA, 16 bp, H. sapiens
tttgcaaatatgatta

SEQ ID NO: 173303 - DNA, 16 bp, H. sapiens
tttgcaaatatgttct

SEQ ID NO: 173304 - DNA, 16 bp, H. sapiens
tttgcaaatatttctc

SEQ ID NO: 173305 - DNA, 16 bp, H. sapiens
tttgcaaatatttgta

SEQ ID NO: 173306 - DNA, 16 bp, H. sapiens
tttgcaaatattttct

SEQ ID NO: 173307 - DNA, 16 bp, H. sapiens
tttgcaaatgaaaaaa

SEQ ID NO: 173308 - DNA, 16 bp, H. sapiens
tttgcaaatgaaacaa

SEQ ID NO: 173309 - DNA, 16 bp, H. sapiens
tttgcaaatgctgttc

SEQ ID NO: 173310 - DNA, 16 bp, H. sapiens
tttgcaaatgcttttt

SEQ ID NO: 173311 - DNA, 16 bp, H. sapiens
tttgcaaatgtgatta

SEQ ID NO: 173312 - DNA, 16 bp, H. sapiens
tttgcaaattatattt

SEQ ID NO: 173313 - DNA, 16 bp, H. sapiens
tttgcaaattatttat

SEQ ID NO: 173314 - DNA, 16 bp, H. sapiens
tttgcaaattgaattt

SEQ ID NO: 173315 - DNA, 16 bp, H. sapiens
tttgcaacatttttct

SEQ ID NO: 173316 - DNA, 16 bp, H. sapiens
tttgcaaccagcctgg

SEQ ID NO: 173317 - DNA, 16 bp, H. sapiens
tttgcaacttcctatg

SEQ ID NO: 173318 - DNA, 16 bp, H. sapiens
tttgcaacttcctgtg

SEQ ID NO: 173319 - DNA, 16 bp, H. sapiens
tttgcaagatgaagaa

SEQ ID NO: 173320 - DNA, 18 bp, H. sapiens
tttgcaataaatcttgct

SEQ ID NO: 173321 - DNA, 24 bp, H. sapiens
tttgcaataaatcttgctactgct

SEQ ID NO: 173322 - DNA, 16 bp, H. sapiens
tttgcaatatattttt

SEQ ID NO: 173323 - DNA, 20 bp, H. sapiens
tttgcaatctatccatctga

SEQ ID NO: 173324 - DNA, 16 bp, H. sapiens
tttgcaatgaatttcc

SEQ ID NO: 173325 - DNA, 16 bp, H. sapiens
tttgcaattgtgaatt

SEQ ID NO: 173326 - DNA, 16 bp, H. sapiens
tttgcaatttatccat

SEQ ID NO: 173327 - DNA, 16 bp, H. sapiens
tttgcaattttttaaa

SEQ ID NO: 173328 - DNA, 16 bp, H. sapiens
tttgcacaatgatttt

SEQ ID NO: 173329 - DNA, 16 bp, H. sapiens
tttgcacatattttct

SEQ ID NO: 173330 - DNA, 16 bp, H. sapiens
tttgcacatgctgttt

SEQ ID NO: 173331 - DNA, 16 bp, H. sapiens
tttgcacatggatttt

SEQ ID NO: 173332 - DNA, 16 bp, H. sapiens
tttgcacattgatatt

SEQ ID NO: 173333 - DNA, 16 bp, H. sapiens
tttgcacattttattt

SEQ ID NO: 173334 - DNA, 18 bp, H. sapiens
tttgcaccaacctaatat

SEQ ID NO: 173335 - DNA, 16 bp, H. sapiens
tttgcactgatggtgc

SEQ ID NO: 173336 - DNA, 16 bp, H. sapiens
tttgcacttgcttctc

SEQ ID NO: 173337 - DNA, 16 bp, H. sapiens
tttgcactttttaaaa

SEQ ID NO: 173338 - DNA, 16 bp, H. sapiens
tttgcagaaaaaaatg

SEQ ID NO: 173339 - DNA, 16 bp, H. sapiens
tttgcagaaataaaaa

SEQ ID NO: 173340 - DNA, 16 bp, H. sapiens
tttgcagaaatggaaa

SEQ ID NO: 173341 - DNA, 16 bp, H. sapiens
tttgcagaaattgaca

SEQ ID NO: 173342 - DNA, 16 bp, H. sapiens
tttgcagaaattttct

SEQ ID NO: 173343 - DNA, 16 bp, H. sapiens
tttgcagaagtgatta

SEQ ID NO: 173344 - DNA, 16 bp, H. sapiens
tttgcagaatggaaaa

SEQ ID NO: 173345 - DNA, 16 bp, H. sapiens
tttgcagataaggaaa

SEQ ID NO: 173346 - DNA, 16 bp, H. sapiens
tttgcagatcacatga

SEQ ID NO: 173347 - DNA, 16 bp, H. sapiens
tttgcagatcatatat

SEQ ID NO: 173348 - DNA, 16 bp, H. sapiens
tttgcagatgaaatga

SEQ ID NO: 173349 - DNA, 16 bp, H. sapiens
tttgcagatgaagaaa

SEQ ID NO: 173350 - DNA, 16 bp, H. sapiens
tttgcagatgaagaca

SEQ ID NO: 173351 - DNA, 16 bp, H. sapiens
tttgcagatgacaaaa

SEQ ID NO: 173352 - DNA, 17 bp, H. sapiens
tttgcagatgacatgac

SEQ ID NO: 173353 - DNA, 16 bp, H. sapiens
tttgcagatgacatgt

SEQ ID NO: 173354 - DNA, 16 bp, H. sapiens
tttgcagatgagaaga

SEQ ID NO: 173355 - DNA, 16 bp, H. sapiens
tttgcagatgatgaaa

SEQ ID NO: 173356 - DNA, 16 bp, H. sapiens
tttgcagatggagaaa

SEQ ID NO: 173357 - DNA, 16 bp, H. sapiens
tttgcagatggaggaa

SEQ ID NO: 173358 - DNA, 16 bp, H. sapiens
tttgcagatgtaatga

SEQ ID NO: 173359 - DNA, 16 bp, H. sapiens
tttgcagatgtaatta

SEQ ID NO: 173360 - DNA, 16 bp, H. sapiens
tttgcagatgtgatta

SEQ ID NO: 173361 - DNA, 16 bp, H. sapiens
tttgcagattttacaa

SEQ ID NO: 173362 - DNA, 16 bp, H. sapiens
tttgcagcatccctgg

SEQ ID NO: 173363 - DNA, 16 bp, H. sapiens
tttgcagcccatggat

SEQ ID NO: 173364 - DNA, 16 bp, H. sapiens
tttgcagctgaggaaa

SEQ ID NO: 173365 - DNA, 16 bp, H. sapiens
tttgcaggaaaaaaaa

SEQ ID NO: 173366 - DNA, 16 bp, H. sapiens
tttgcaggaaaatgga

SEQ ID NO: 173367 - DNA, 16 bp, H. sapiens
tttgcaggctcatagg

SEQ ID NO: 173368 - DNA, 16 bp, H. sapiens
tttgcagggaaaaaaa

SEQ ID NO: 173369 - DNA, 19 bp, H. sapiens
tttgcagggacatggatgg

SEQ ID NO: 173370 - DNA, 16 bp, H. sapiens
tttgcaggtgaggaaa

SEQ ID NO: 173371 - DNA, 16 bp, H. sapiens
tttgcagtaagttttg

SEQ ID NO: 173372 - DNA, 16 bp, H. sapiens
tttgcagtctgacaat

SEQ ID NO: 173373 - DNA, 18 bp, H. sapiens
tttgcagtgagccaagat

SEQ ID NO: 173374 - DNA, 19 bp, H. sapiens
tttgcagtgagccgagatt

SEQ ID NO: 173375 - DNA, 16 bp, H. sapiens
tttgcagtggagaaac

SEQ ID NO: 173376 - DNA, 16 bp, H. sapiens
tttgcagttgcaaaaa

SEQ ID NO: 173377 - DNA, 16 bp, H. sapiens
tttgcataaaataaat

SEQ ID NO: 173378 - DNA, 16 bp, H. sapiens
tttgcatataattaaa

SEQ ID NO: 173379 - DNA, 16 bp, H. sapiens
tttgcatataatttca

SEQ ID NO: 173380 - DNA, 16 bp, H. sapiens
tttgcatatacataat

SEQ ID NO: 173381 - DNA, 16 bp, H. sapiens
tttgcatatataattt

SEQ ID NO: 173382 - DNA, 16 bp, H. sapiens
tttgcatatatatttt

SEQ ID NO: 173383 - DNA, 16 bp, H. sapiens
tttgcatattatatat

SEQ ID NO: 173384 - DNA, 16 bp, H. sapiens
tttgcatattttaaaa

SEQ ID NO: 173385 - DNA, 16 bp, H. sapiens
tttgcatcctcctctt

SEQ ID NO: 173386 - DNA, 16 bp, H. sapiens
tttgcatccttcaatg

SEQ ID NO: 173387 - DNA, 16 bp, H. sapiens
tttgcatctatgtttg

SEQ ID NO: 173388 - DNA, 16 bp, H. sapiens
tttgcatctccctgat

SEQ ID NO: 173389 - DNA, 16 bp, H. sapiens
tttgcatgcatgcaaa

SEQ ID NO: 173390 - DNA, 16 bp, H. sapiens
tttgcatgcatgtgtg

SEQ ID NO: 173391 - DNA, 16 bp, H. sapiens
tttgcatgcattatct

SEQ ID NO: 173392 - DNA, 16 bp, H. sapiens
tttgcatgtataattt

SEQ ID NO: 173393 - DNA, 16 bp, H. sapiens
tttgcatgtcttgtaa

SEQ ID NO: 173394 - DNA, 16 bp, H. sapiens
tttgcatgttaaattt

SEQ ID NO: 173395 - DNA, 16 bp, H. sapiens
tttgcattacttttaa

SEQ ID NO: 173396 - DNA, 16 bp, H. sapiens
tttgcattatatttac

SEQ ID NO: 173397 - DNA, 16 bp, H. sapiens
tttgcattatttcatt

SEQ ID NO: 173398 - DNA, 16 bp, H. sapiens
tttgcattcacaactt

SEQ ID NO: 173399 - DNA, 16 bp, H. sapiens
tttgcattcattattt

SEQ ID NO: 173400 - DNA, 16 bp, H. sapiens
tttgcattcccaccag

SEQ ID NO: 173401 - DNA, 16 bp, H. sapiens
tttgcattcccctaat

SEQ ID NO: 173402 - DNA, 16 bp, H. sapiens
tttgcattcctgggat

SEQ ID NO: 173403 - DNA, 16 bp, H. sapiens
tttgcattgcatttta

SEQ ID NO: 173404 - DNA, 16 bp, H. sapiens
tttgcattgtgaaggg

SEQ ID NO: 173405 - DNA, 16 bp, H. sapiens
tttgcatttacattta

SEQ ID NO: 173406 - DNA, 16 bp, H. sapiens
tttgcatttatgattt

SEQ ID NO: 173407 - DNA, 16 bp, H. sapiens
tttgcatttattcatt

SEQ ID NO: 173408 - DNA, 16 bp, H. sapiens
tttgcatttcaatttc

SEQ ID NO: 173409 - DNA, 16 bp, H. sapiens
tttgcatttcagaaag

SEQ ID NO: 173410 - DNA, 16 bp, H. sapiens
tttgcatttcattgat

SEQ ID NO: 173411 - DNA, 16 bp, H. sapiens
tttgcatttcctagaa

SEQ ID NO: 173412 - DNA, 16 bp, H. sapiens
tttgcatttctagcaa

SEQ ID NO: 173413 - DNA, 16 bp, H. sapiens
tttgcatttctcttgt

SEQ ID NO: 173414 - DNA, 16 bp, H. sapiens
tttgcatttctgacaa

SEQ ID NO: 173415 - DNA, 16 bp, H. sapiens
tttgcatttctgatga

SEQ ID NO: 173416 - DNA, 16 bp, H. sapiens
tttgcatttctgtaaa

SEQ ID NO: 173417 - DNA, 16 bp, H. sapiens
tttgcatttgcatttc

SEQ ID NO: 173418 - DNA, 16 bp, H. sapiens
tttgcatttgctcttt

SEQ ID NO: 173419 - DNA, 16 bp, H. sapiens
tttgcatttgctgttt

SEQ ID NO: 173420 - DNA, 16 bp, H. sapiens
tttgcatttgggttct

SEQ ID NO: 173421 - DNA, 16 bp, H. sapiens
tttgcatttgtttgct

SEQ ID NO: 173422 - DNA, 16 bp, H. sapiens
tttgcattttaaaata

SEQ ID NO: 173423 - DNA, 16 bp, H. sapiens
tttgcattttaagtag

SEQ ID NO: 173424 - DNA, 16 bp, H. sapiens
tttgcattttacattt

SEQ ID NO: 173425 - DNA, 16 bp, H. sapiens
tttgcattttcatatt

SEQ ID NO: 173426 - DNA, 16 bp, H. sapiens
tttgcattttcccaat

SEQ ID NO: 173427 - DNA, 16 bp, H. sapiens
tttgcattttccttat

SEQ ID NO: 173428 - DNA, 16 bp, H. sapiens
tttgcattttctgatg

SEQ ID NO: 173429 - DNA, 16 bp, H. sapiens
tttgcattttcttaat

SEQ ID NO: 173430 - DNA, 16 bp, H. sapiens
tttgcattttcttgat

SEQ ID NO: 173431 - DNA, 16 bp, H. sapiens
tttgcattttggaaag

SEQ ID NO: 173432 - DNA, 16 bp, H. sapiens
tttgcattttgtaaaa

SEQ ID NO: 173433 - DNA, 16 bp, H. sapiens
tttgcatttttaaatt

SEQ ID NO: 173434 - DNA, 16 bp, H. sapiens
tttgcatttttagtaa

SEQ ID NO: 173435 - DNA, 16 bp, H. sapiens
tttgcatttttataat

SEQ ID NO: 173436 - DNA, 16 bp, H. sapiens
tttgcattttttaaat

SEQ ID NO: 173437 - DNA, 16 bp, H. sapiens
tttgcattttttacat

SEQ ID NO: 173438 - DNA, 16 bp, H. sapiens
tttgccaaaaacaaaa

SEQ ID NO: 173439 - DNA, 16 bp, H. sapiens
tttgccaaaattaaaa

SEQ ID NO: 173440 - DNA, 16 bp, H. sapiens
tttgccaaatactttt

SEQ ID NO: 173441 - DNA, 16 bp, H. sapiens
tttgccaaggctgatg

SEQ ID NO: 173442 - DNA, 19 bp, H. sapiens
tttgccaaggttaaggatg

SEQ ID NO: 173443 - DNA, 23 bp, H. sapiens
tttgccaagttttcttagaatga

SEQ ID NO: 173444 - DNA, 16 bp, H. sapiens
tttgccaatttccatg

SEQ ID NO: 173445 - DNA, 16 bp, H. sapiens
tttgccaattttgttt

SEQ ID NO: 173446 - DNA, 16 bp, H. sapiens
tttgccaattttttcc

SEQ ID NO: 173447 - DNA, 16 bp, H. sapiens
tttgccacatttgttt

SEQ ID NO: 173448 - DNA, 16 bp, H. sapiens
tttgccaccaccaggc

SEQ ID NO: 173449 - DNA, 16 bp, H. sapiens
tttgccaccagcctgg

SEQ ID NO: 173450 - DNA, 16 bp, H. sapiens
tttgccagaagaaaca

SEQ ID NO: 173451 - DNA, 16 bp, H. sapiens
tttgccagaggaaaca

SEQ ID NO: 173452 - DNA, 16 bp, H. sapiens
tttgccagtctgtttc

SEQ ID NO: 173453 - DNA, 16 bp, H. sapiens
tttgccagtttctttt

SEQ ID NO: 173454 - DNA, 16 bp, H. sapiens
tttgccataaaaataa

SEQ ID NO: 173455 - DNA, 16 bp, H. sapiens
tttgccatataaaata

SEQ ID NO: 173456 - DNA, 16 bp, H. sapiens
tttgccatatttgctt

SEQ ID NO: 173457 - DNA, 16 bp, H. sapiens
tttgccatattttatt

SEQ ID NO: 173458 - DNA, 16 bp, H. sapiens
tttgccatctgcatat

SEQ ID NO: 173459 - DNA, 16 bp, H. sapiens
tttgccatggtggcca

SEQ ID NO: 173460 - DNA, 16 bp, H. sapiens
tttgccatgttgccag

SEQ ID NO: 173461 - DNA, 22 bp, H. sapiens
tttgccatgttggccaggctgt

SEQ ID NO: 173462 - DNA, 16 bp, H. sapiens
tttgccattcagtatg

SEQ ID NO: 173463 - DNA, 16 bp, H. sapiens
tttgccatttaaagta

SEQ ID NO: 173464 - DNA, 16 bp, H. sapiens
tttgccatttatttat

SEQ ID NO: 173465 - DNA, 16 bp, H. sapiens
tttgccatttatttgt

SEQ ID NO: 173466 - DNA, 16 bp, H. sapiens
tttgccatttgcccag

SEQ ID NO: 173467 - DNA, 16 bp, H. sapiens
tttgccattttctatt

SEQ ID NO: 173468 - DNA, 16 bp, H. sapiens
tttgccatttttctat

SEQ ID NO: 173469 - DNA, 16 bp, H. sapiens
tttgccatttttttcc

SEQ ID NO: 173470 - DNA, 16 bp, H. sapiens
tttgcccaaagccctg

SEQ ID NO: 173471 - DNA, 16 bp, H. sapiens
tttgcccaaagtcaca

SEQ ID NO: 173472 - DNA, 16 bp, H. sapiens
tttgcccaactgtagg

SEQ ID NO: 173473 - DNA, 16 bp, H. sapiens
tttgcccaatttttat

SEQ ID NO: 173474 - DNA, 16 bp, H. sapiens
tttgcccacttttttt

SEQ ID NO: 173475 - DNA, 16 bp, H. sapiens
tttgcccagcctggag

SEQ ID NO: 173476 - DNA, 16 bp, H. sapiens
tttgcccaggccaatg

SEQ ID NO: 173477 - DNA, 16 bp, H. sapiens
tttgcccaggcctttc

SEQ ID NO: 173478 - DNA, 17 bp, H. sapiens
tttgcccaggctggagc

SEQ ID NO: 173479 - DNA, 16 bp, H. sapiens
tttgcccaggctgttc

SEQ ID NO: 173480 - DNA, 16 bp, H. sapiens
tttgcccagtttttaa

SEQ ID NO: 173481 - DNA, 16 bp, H. sapiens
tttgcccatctcttct

SEQ ID NO: 173482 - DNA, 16 bp, H. sapiens
tttgcccattaaaaaa

SEQ ID NO: 173483 - DNA, 16 bp, H. sapiens
tttgcccattttgaaa

SEQ ID NO: 173484 - DNA, 17 bp, H. sapiens
tttgcccctgccctaga

SEQ ID NO: 173485 - DNA, 16 bp, H. sapiens
tttgccctaagcagtt

SEQ ID NO: 173486 - DNA, 16 bp, H. sapiens
tttgccctctgggtct

SEQ ID NO: 173487 - DNA, 16 bp, H. sapiens
tttgcccttccaccat

SEQ ID NO: 173488 - DNA, 16 bp, H. sapiens
tttgcccttgtcctgt

SEQ ID NO: 173489 - DNA, 16 bp, H. sapiens
tttgccctttgccctt

SEQ ID NO: 173490 - DNA, 16 bp, H. sapiens
tttgcccttttaaaaa

SEQ ID NO: 173491 - DNA, 16 bp, H. sapiens
tttgcctaaggtcaca

SEQ ID NO: 173492 - DNA, 16 bp, H. sapiens
tttgcctacattttag

SEQ ID NO: 173493 - DNA, 16 bp, H. sapiens
tttgcctatatattta

SEQ ID NO: 173494 - DNA, 16 bp, H. sapiens
tttgcctatttttcta

SEQ ID NO: 173495 - DNA, 17 bp, H. sapiens
tttgcctcagcctcccg

SEQ ID NO: 173496 - DNA, 16 bp, H. sapiens
tttgcctcatgtattt

SEQ ID NO: 173497 - DNA, 16 bp, H. sapiens
tttgcctgctgccatc

SEQ ID NO: 173498 - DNA, 16 bp, H. sapiens
tttgcctggacatcca

SEQ ID NO: 173499 - DNA, 16 bp, H. sapiens
tttgcctgtctctcca

SEQ ID NO: 173500 - DNA, 16 bp, H. sapiens
tttgcctgttctagaa

SEQ ID NO: 173501 - DNA, 16 bp, H. sapiens
tttgcctgttctagac

SEQ ID NO: 173502 - DNA, 16 bp, H. sapiens
tttgcctgtttttaaa

SEQ ID NO: 173503 - DNA, 16 bp, H. sapiens
tttgcctgtttttgaa

SEQ ID NO: 173504 - DNA, 16 bp, H. sapiens
tttgccttaattttgt

SEQ ID NO: 173505 - DNA, 16 bp, H. sapiens
tttgccttccaaagtg

SEQ ID NO: 173506 - DNA, 16 bp, H. sapiens
tttgccttccatcatg

SEQ ID NO: 173507 - DNA, 16 bp, H. sapiens
tttgccttctgccagg

SEQ ID NO: 173508 - DNA, 17 bp, H. sapiens
tttgccttctgccatga

SEQ ID NO: 173509 - DNA, 16 bp, H. sapiens
tttgccttctgctgtg

SEQ ID NO: 173510 - DNA, 16 bp, H. sapiens
tttgcctttccatata

SEQ ID NO: 173511 - DNA, 16 bp, H. sapiens
tttgcctttgttttga

SEQ ID NO: 173512 - DNA, 16 bp, H. sapiens
tttgccttttaaagaa

SEQ ID NO: 173513 - DNA, 16 bp, H. sapiens
tttgccttttaaattt

SEQ ID NO: 173514 - DNA, 16 bp, H. sapiens
tttgccttttcagaat

SEQ ID NO: 173515 - DNA, 16 bp, H. sapiens
tttgccttttccagaa

SEQ ID NO: 173516 - DNA, 16 bp, H. sapiens
tttgccttttctagaa

SEQ ID NO: 173517 - DNA, 16 bp, H. sapiens
tttgccttttctggac

SEQ ID NO: 173518 - DNA, 16 bp, H. sapiens
tttgccttttgacttt

SEQ ID NO: 173519 - DNA, 16 bp, H. sapiens
tttgcctttttaaaaa

SEQ ID NO: 173520 - DNA, 16 bp, H. sapiens
tttgcctttttaataa

SEQ ID NO: 173521 - DNA, 16 bp, H. sapiens
tttgcgtctggcttct

SEQ ID NO: 173522 - DNA, 16 bp, H. sapiens
tttgctaaaataaacc

SEQ ID NO: 173523 - DNA, 16 bp, H. sapiens
tttgctaaatatttta

SEQ ID NO: 173524 - DNA, 16 bp, H. sapiens
tttgctaaggataata

SEQ ID NO: 173525 - DNA, 16 bp, H. sapiens
tttgctaatgataatg

SEQ ID NO: 173526 - DNA, 16 bp, H. sapiens
tttgctaatttattta

SEQ ID NO: 173527 - DNA, 16 bp, H. sapiens
tttgctaggattttgt

SEQ ID NO: 173528 - DNA, 16 bp, H. sapiens
tttgctatacaggtaa

SEQ ID NO: 173529 - DNA, 16 bp, H. sapiens
tttgctatatatatgt

SEQ ID NO: 173530 - DNA, 16 bp, H. sapiens
tttgctatcataaata

SEQ ID NO: 173531 - DNA, 16 bp, H. sapiens
tttgctattaaaatta

SEQ ID NO: 173532 - DNA, 16 bp, H. sapiens
tttgctattgaaaata

SEQ ID NO: 173533 - DNA, 16 bp, H. sapiens
tttgctattgcaaaca

SEQ ID NO: 173534 - DNA, 16 bp, H. sapiens
tttgctattgcaaata

SEQ ID NO: 173535 - DNA, 16 bp, H. sapiens
tttgctattgggaaca

SEQ ID NO: 173536 - DNA, 16 bp, H. sapiens
tttgctattgtgaaaa

SEQ ID NO: 173537 - DNA, 16 bp, H. sapiens
tttgctattgttaata

SEQ ID NO: 173538 - DNA, 16 bp, H. sapiens
tttgctcaaaaaaaaa

SEQ ID NO: 173539 - DNA, 16 bp, H. sapiens
tttgctcaaaatcaca

SEQ ID NO: 173540 - DNA, 16 bp, H. sapiens
tttgctcaaagtcaca

SEQ ID NO: 173541 - DNA, 16 bp, H. sapiens
tttgctcaaggaaatt

SEQ ID NO: 173542 - DNA, 16 bp, H. sapiens
tttgctcacatgtttt

SEQ ID NO: 173543 - DNA, 16 bp, H. sapiens
tttgctcatccatgag

SEQ ID NO: 173544 - DNA, 16 bp, H. sapiens
tttgctcattttctaa

SEQ ID NO: 173545 - DNA, 16 bp, H. sapiens
tttgctcctgcatctg

SEQ ID NO: 173546 - DNA, 16 bp, H. sapiens
tttgctcctttgccaa

SEQ ID NO: 173547 - DNA, 16 bp, H. sapiens
tttgctccttttcatt

SEQ ID NO: 173548 - DNA, 16 bp, H. sapiens
tttgctctctgcttgt

SEQ ID NO: 173549 - DNA, 24 bp, H. sapiens
tttgctctgtcacccaggctggag

SEQ ID NO: 173550 - DNA, 16 bp, H. sapiens
tttgctctgttgccca

SEQ ID NO: 173551 - DNA, 16 bp, H. sapiens
tttgctcttgttcccc

SEQ ID NO: 173552 - DNA, 16 bp, H. sapiens
tttgctgaaaataatg

SEQ ID NO: 173553 - DNA, 16 bp, H. sapiens
tttgctgaaaatgatg

SEQ ID NO: 173554 - DNA, 16 bp, H. sapiens
tttgctgaagttcctt

SEQ ID NO: 173555 - DNA, 16 bp, H. sapiens
tttgctgaatgaagaa

SEQ ID NO: 173556 - DNA, 16 bp, H. sapiens
tttgctgaattaatga

SEQ ID NO: 173557 - DNA, 16 bp, H. sapiens
tttgctgaattccttt

SEQ ID NO: 173558 - DNA, 16 bp, H. sapiens
tttgctgaattctttt

SEQ ID NO: 173559 - DNA, 16 bp, H. sapiens
tttgctgacaccttga

SEQ ID NO: 173560 - DNA, 16 bp, H. sapiens
tttgctgacctctgct

SEQ ID NO: 173561 - DNA, 16 bp, H. sapiens
tttgctgacctctgtt

SEQ ID NO: 173562 - DNA, 16 bp, H. sapiens
tttgctgagaaggatg

SEQ ID NO: 173563 - DNA, 16 bp, H. sapiens
tttgctgagagctttc

SEQ ID NO: 173564 - DNA, 16 bp, H. sapiens
tttgctgagaggtttt

SEQ ID NO: 173565 - DNA, 16 bp, H. sapiens
tttgctgagagtgatg

SEQ ID NO: 173566 - DNA, 16 bp, H. sapiens
tttgctgagattgatg

SEQ ID NO: 173567 - DNA, 16 bp, H. sapiens
tttgctgagcagtgtt

SEQ ID NO: 173568 - DNA, 16 bp, H. sapiens
tttgctgaggataacg

SEQ ID NO: 173569 - DNA, 16 bp, H. sapiens
tttgctgaggataatg

SEQ ID NO: 173570 - DNA, 16 bp, H. sapiens
tttgctgagtgttttt

SEQ ID NO: 173571 - DNA, 16 bp, H. sapiens
tttgctgataaaacag

SEQ ID NO: 173572 - DNA, 16 bp, H. sapiens
tttgctgatattttgt

SEQ ID NO: 173573 - DNA, 16 bp, H. sapiens
tttgctgatgaagaaa

SEQ ID NO: 173574 - DNA, 16 bp, H. sapiens
tttgctgatgacatga

SEQ ID NO: 173575 - DNA, 16 bp, H. sapiens
tttgctgattttctct

SEQ ID NO: 173576 - DNA, 16 bp, H. sapiens
tttgctgcacagacca

SEQ ID NO: 173577 - DNA, 16 bp, H. sapiens
tttgctgcacccctca

SEQ ID NO: 173578 - DNA, 16 bp, H. sapiens
tttgctgcaggagcag

SEQ ID NO: 173579 - DNA, 16 bp, H. sapiens
tttgctggacgtggtg

SEQ ID NO: 173580 - DNA, 22 bp, H. sapiens
tttgctggaggtccactccaga

SEQ ID NO: 173581 - DNA, 16 bp, H. sapiens
tttgctgggcatgatg

SEQ ID NO: 173582 - DNA, 16 bp, H. sapiens
tttgctgggcctggtg

SEQ ID NO: 173583 - DNA, 16 bp, H. sapiens
tttgctgtaggttttt

SEQ ID NO: 173584 - DNA, 16 bp, H. sapiens
tttgctgtcttctgta

SEQ ID NO: 173585 - DNA, 16 bp, H. sapiens
tttgctgtgcccatca

SEQ ID NO: 173586 - DNA, 16 bp, H. sapiens
tttgctgtgtgaccct

SEQ ID NO: 173587 - DNA, 16 bp, H. sapiens
tttgctgtgtgacctt

SEQ ID NO: 173588 - DNA, 16 bp, H. sapiens
tttgctgtgttgccca

SEQ ID NO: 173589 - DNA, 16 bp, H. sapiens
tttgctgtgttggcca

SEQ ID NO: 173590 - DNA, 16 bp, H. sapiens
tttgctgttctgaagc

SEQ ID NO: 173591 - DNA, 16 bp, H. sapiens
tttgctgttcttgtga

SEQ ID NO: 173592 - DNA, 16 bp, H. sapiens
tttgctgttgaatggg

SEQ ID NO: 173593 - DNA, 16 bp, H. sapiens
tttgctgttgttattg

SEQ ID NO: 173594 - DNA, 16 bp, H. sapiens
tttgctgttgttggat

SEQ ID NO: 173595 - DNA, 16 bp, H. sapiens
tttgctgtttcctctg

SEQ ID NO: 173596 - DNA, 16 bp, H. sapiens
tttgctgttttgaata

SEQ ID NO: 173597 - DNA, 16 bp, H. sapiens
tttgcttaaaacattt

SEQ ID NO: 173598 - DNA, 16 bp, H. sapiens
tttgcttaaaattgct

SEQ ID NO: 173599 - DNA, 16 bp, H. sapiens
tttgcttaattaaact

SEQ ID NO: 173600 - DNA, 16 bp, H. sapiens
tttgcttactttttaa

SEQ ID NO: 173601 - DNA, 16 bp, H. sapiens
tttgcttagaaggcaa

SEQ ID NO: 173602 - DNA, 16 bp, H. sapiens
tttgcttatgttttaa

SEQ ID NO: 173603 - DNA, 16 bp, H. sapiens
tttgcttatttttgca

SEQ ID NO: 173604 - DNA, 16 bp, H. sapiens
tttgcttcaatgttca

SEQ ID NO: 173605 - DNA, 16 bp, H. sapiens
tttgcttcacattttt

SEQ ID NO: 173606 - DNA, 16 bp, H. sapiens
tttgcttcatatattt

SEQ ID NO: 173607 - DNA, 16 bp, H. sapiens
tttgcttcattaaaaa

SEQ ID NO: 173608 - DNA, 16 bp, H. sapiens
tttgcttcatttaaaa

SEQ ID NO: 173609 - DNA, 16 bp, H. sapiens
tttgcttcatttttaa

SEQ ID NO: 173610 - DNA, 16 bp, H. sapiens
tttgcttcccctttgc

SEQ ID NO: 173611 - DNA, 16 bp, H. sapiens
tttgcttccttttaaa

SEQ ID NO: 173612 - DNA, 16 bp, H. sapiens
tttgcttctgttgcaa

SEQ ID NO: 173613 - DNA, 16 bp, H. sapiens
tttgcttctttttcaa

SEQ ID NO: 173614 - DNA, 16 bp, H. sapiens
tttgcttgatatattt

SEQ ID NO: 173615 - DNA, 16 bp, H. sapiens
tttgcttgctttttaa

SEQ ID NO: 173616 - DNA, 16 bp, H. sapiens
tttgcttggcacttct

SEQ ID NO: 173617 - DNA, 16 bp, H. sapiens
tttgcttgggataatg

SEQ ID NO: 173618 - DNA, 16 bp, H. sapiens
tttgcttgtctggaaa

SEQ ID NO: 173619 - DNA, 16 bp, H. sapiens
tttgcttgtgaagctt

SEQ ID NO: 173620 - DNA, 59 bp, H. sapiens
tttgcttgtgtttcaccaggagaaaatcagcttcctgtttggatacccactagacattt

SEQ ID NO: 173621 - DNA, 16 bp, H. sapiens
tttgcttgtttgggaa

SEQ ID NO: 173622 - DNA, 16 bp, H. sapiens
tttgcttgttttaaaa

SEQ ID NO: 173623 - DNA, 16 bp, H. sapiens
tttgctttaaaaatat

SEQ ID NO: 173624 - DNA, 16 bp, H. sapiens
tttgctttaaaaatgt

SEQ ID NO: 173625 - DNA, 16 bp, H. sapiens
tttgctttaaaacatt

SEQ ID NO: 173626 - DNA, 16 bp, H. sapiens
tttgctttaaaataaa

SEQ ID NO: 173627 - DNA, 16 bp, H. sapiens
tttgctttaaataata

SEQ ID NO: 173628 - DNA, 16 bp, H. sapiens
tttgctttagaaaact

SEQ ID NO: 173629 - DNA, 16 bp, H. sapiens
tttgctttatccattt

SEQ ID NO: 173630 - DNA, 16 bp, H. sapiens
tttgctttattaaaaa

SEQ ID NO: 173631 - DNA, 16 bp, H. sapiens
tttgctttatttcact

SEQ ID NO: 173632 - DNA, 16 bp, H. sapiens
tttgctttcaaatatt

SEQ ID NO: 173633 - DNA, 16 bp, H. sapiens
tttgctttcaatttta

SEQ ID NO: 173634 - DNA, 16 bp, H. sapiens
tttgctttcatttcag

SEQ ID NO: 173635 - DNA, 16 bp, H. sapiens
tttgctttctcatcat

SEQ ID NO: 173636 - DNA, 16 bp, H. sapiens
tttgctttctctgtgc

SEQ ID NO: 173637 - DNA, 16 bp, H. sapiens
tttgctttgtagattt

SEQ ID NO: 173638 - DNA, 16 bp, H. sapiens
tttgcttttaaagaaa

SEQ ID NO: 173639 - DNA, 16 bp, H. sapiens
tttgcttttagaattt

SEQ ID NO: 173640 - DNA, 16 bp, H. sapiens
tttgcttttagttctg

SEQ ID NO: 173641 - DNA, 16 bp, H. sapiens
tttgcttttataaaat

SEQ ID NO: 173642 - DNA, 16 bp, H. sapiens
tttgcttttcaaaact

SEQ ID NO: 173643 - DNA, 16 bp, H. sapiens
tttgcttttccatata

SEQ ID NO: 173644 - DNA, 16 bp, H. sapiens
tttgcttttctaaaaa

SEQ ID NO: 173645 - DNA, 16 bp, H. sapiens
tttgcttttctaccat

SEQ ID NO: 173646 - DNA, 16 bp, H. sapiens
tttgcttttcttaaaa

SEQ ID NO: 173647 - DNA, 16 bp, H. sapiens
tttgcttttctttaaa

SEQ ID NO: 173648 - DNA, 16 bp, H. sapiens
tttgcttttggcatct

SEQ ID NO: 173649 - DNA, 16 bp, H. sapiens
tttgcttttgtaagaa

SEQ ID NO: 173650 - DNA, 16 bp, H. sapiens
tttgcttttgtcacct

SEQ ID NO: 173651 - DNA, 16 bp, H. sapiens
tttgcttttgtggcct

SEQ ID NO: 173652 - DNA, 16 bp, H. sapiens
tttgcttttgttaaaa

SEQ ID NO: 173653 - DNA, 16 bp, H. sapiens
tttgcttttgttccaa

SEQ ID NO: 173654 - DNA, 16 bp, H. sapiens
tttgctttttaaaaaa

SEQ ID NO: 173655 - DNA, 16 bp, H. sapiens
tttgctttttaatata

SEQ ID NO: 173656 - DNA, 16 bp, H. sapiens
tttgctttttagaaat

SEQ ID NO: 173657 - DNA, 16 bp, H. sapiens
tttgctttttcacatt

SEQ ID NO: 173658 - DNA, 16 bp, H. sapiens
tttgctttttctggaa

SEQ ID NO: 173659 - DNA, 16 bp, H. sapiens
tttgctttttgagatg

SEQ ID NO: 173660 - DNA, 16 bp, H. sapiens
tttgcttttttcccat

SEQ ID NO: 173661 - DNA, 16 bp, H. sapiens
tttggaaaaaaataga

SEQ ID NO: 173662 - DNA, 16 bp, H. sapiens
tttggaaaaaatgttt

SEQ ID NO: 173663 - DNA, 16 bp, H. sapiens
tttggaaaaacaaata

SEQ ID NO: 173664 - DNA, 16 bp, H. sapiens
tttggaaaaacagttt

SEQ ID NO: 173665 - DNA, 16 bp, H. sapiens
tttggaaaaacttaaa

SEQ ID NO: 173666 - DNA, 16 bp, H. sapiens
tttggaaaaagaaaga

SEQ ID NO: 173667 - DNA, 16 bp, H. sapiens
tttggaaaaagttttt

SEQ ID NO: 173668 - DNA, 16 bp, H. sapiens
tttggaaaaataaaga

SEQ ID NO: 173669 - DNA, 16 bp, H. sapiens
tttggaaaaataatta

SEQ ID NO: 173670 - DNA, 16 bp, H. sapiens
tttggaaaaatataat

SEQ ID NO: 173671 - DNA, 16 bp, H. sapiens
tttggaaaaatatttg

SEQ ID NO: 173672 - DNA, 16 bp, H. sapiens
tttggaaaaatgaaat

SEQ ID NO: 173673 - DNA, 16 bp, H. sapiens
tttggaaaaatgttta

SEQ ID NO: 173674 - DNA, 16 bp, H. sapiens
tttggaaaacacagaa

SEQ ID NO: 173675 - DNA, 16 bp, H. sapiens
tttggaaaacagcctg

SEQ ID NO: 173676 - DNA, 16 bp, H. sapiens
tttggaaaacataaaa

SEQ ID NO: 173677 - DNA, 16 bp, H. sapiens
tttggaaaacatgtat

SEQ ID NO: 173678 - DNA, 16 bp, H. sapiens
tttggaaaacttgtat

SEQ ID NO: 173679 - DNA, 16 bp, H. sapiens
tttggaaaagaaaaat

SEQ ID NO: 173680 - DNA, 16 bp, H. sapiens
tttggaaaagaaataa

SEQ ID NO: 173681 - DNA, 16 bp, H. sapiens
tttggaaaagaaatct

SEQ ID NO: 173682 - DNA, 16 bp, H. sapiens
tttggaaaagaataaa

SEQ ID NO: 173683 - DNA, 16 bp, H. sapiens
tttggaaaagacaaaa

SEQ ID NO: 173684 - DNA, 16 bp, H. sapiens
tttggaaaagaggaag

SEQ ID NO: 173685 - DNA, 16 bp, H. sapiens
tttggaaaagcaaata

SEQ ID NO: 173686 - DNA, 16 bp, H. sapiens
tttggaaaagtaaaat

SEQ ID NO: 173687 - DNA, 16 bp, H. sapiens
tttggaaaataaaact

SEQ ID NO: 173688 - DNA, 16 bp, H. sapiens
tttggaaaataaacat

SEQ ID NO: 173689 - DNA, 16 bp, H. sapiens
tttggaaaataaggaa

SEQ ID NO: 173690 - DNA, 16 bp, H. sapiens
tttggaaaataatctg

SEQ ID NO: 173691 - DNA, 16 bp, H. sapiens
tttggaaaataatttg

SEQ ID NO: 173692 - DNA, 16 bp, H. sapiens
tttggaaaatagtttg

SEQ ID NO: 173693 - DNA, 16 bp, H. sapiens
tttggaaaatatacaa

SEQ ID NO: 173694 - DNA, 16 bp, H. sapiens
tttggaaaatatagtt

SEQ ID NO: 173695 - DNA, 16 bp, H. sapiens
tttggaaaatgaaaaa

SEQ ID NO: 173696 - DNA, 16 bp, H. sapiens
tttggaaaatgatttg

SEQ ID NO: 173697 - DNA, 16 bp, H. sapiens
tttggaaaatgcaaaa

SEQ ID NO: 173698 - DNA, 16 bp, H. sapiens
tttggaaaatggagaa

SEQ ID NO: 173699 - DNA, 16 bp, H. sapiens
tttggaaaatgtattt

SEQ ID NO: 173700 - DNA, 16 bp, H. sapiens
tttggaaaatgtttat

SEQ ID NO: 173701 - DNA, 16 bp, H. sapiens
tttggaaaatgttttg

SEQ ID NO: 173702 - DNA, 16 bp, H. sapiens
tttggaaaattcttag

SEQ ID NO: 173703 - DNA, 16 bp, H. sapiens
tttggaaaatttccag

SEQ ID NO: 173704 - DNA, 16 bp, H. sapiens
tttggaaaattttaaa

SEQ ID NO: 173705 - DNA, 16 bp, H. sapiens
tttggaaacacaattt

SEQ ID NO: 173706 - DNA, 16 bp, H. sapiens
tttggaaacacacaca

SEQ ID NO: 173707 - DNA, 16 bp, H. sapiens
tttggaaacagggtct

SEQ ID NO: 173708 - DNA, 16 bp, H. sapiens
tttggaaacagtattt

SEQ ID NO: 173709 - DNA, 16 bp, H. sapiens
tttggaaacagttttt

SEQ ID NO: 173710 - DNA, 16 bp, H. sapiens
tttggaaacatttttg

SEQ ID NO: 173711 - DNA, 16 bp, H. sapiens
tttggaaacgggaata

SEQ ID NO: 173712 - DNA, 16 bp, H. sapiens
tttggaaactctcttt

SEQ ID NO: 173713 - DNA, 16 bp, H. sapiens
tttggaaactttgaaa

SEQ ID NO: 173714 - DNA, 16 bp, H. sapiens
tttggaaagaataaaa

SEQ ID NO: 173715 - DNA, 16 bp, H. sapiens
tttggaaagataaaaa

SEQ ID NO: 173716 - DNA, 16 bp, H. sapiens
tttggaaagatgaaaa

SEQ ID NO: 173717 - DNA, 16 bp, H. sapiens
tttggaaagcagtttt

SEQ ID NO: 173718 - DNA, 16 bp, H. sapiens
tttggaaagcattttg

SEQ ID NO: 173719 - DNA, 16 bp, H. sapiens
tttggaaagccaagat

SEQ ID NO: 173720 - DNA, 16 bp, H. sapiens
tttggaaaggaaaaaa

SEQ ID NO: 173721 - DNA, 16 bp, H. sapiens
tttggaaaggaaaaat

SEQ ID NO: 173722 - DNA, 16 bp, H. sapiens
tttggaaaggctcatc

SEQ ID NO: 173723 - DNA, 16 bp, H. sapiens
tttggaaagtttctat

SEQ ID NO: 173724 - DNA, 16 bp, H. sapiens
tttggaaagtttttag

SEQ ID NO: 173725 - DNA, 16 bp, H. sapiens
tttggaaataaaaaca

SEQ ID NO: 173726 - DNA, 16 bp, H. sapiens
tttggaaataacttca

SEQ ID NO: 173727 - DNA, 16 bp, H. sapiens
tttggaaataatttca

SEQ ID NO: 173728 - DNA, 16 bp, H. sapiens
tttggaaataatttta

SEQ ID NO: 173729 - DNA, 16 bp, H. sapiens
tttggaaatactattt

SEQ ID NO: 173730 - DNA, 16 bp, H. sapiens
tttggaaatattttct

SEQ ID NO: 173731 - DNA, 16 bp, H. sapiens
tttggaaatgaaaaaa

SEQ ID NO: 173732 - DNA, 16 bp, H. sapiens
tttggaaatgaaaaat

SEQ ID NO: 173733 - DNA, 16 bp, H. sapiens
tttggaaatgaataaa

SEQ ID NO: 173734 - DNA, 16 bp, H. sapiens
tttggaaatgagtgga

SEQ ID NO: 173735 - DNA, 16 bp, H. sapiens
tttggaaatgcagaaa

SEQ ID NO: 173736 - DNA, 16 bp, H. sapiens
tttggaaatgggtaac

SEQ ID NO: 173737 - DNA, 16 bp, H. sapiens
tttggaaattaaacac

SEQ ID NO: 173738 - DNA, 16 bp, H. sapiens
tttggaaattataaat

SEQ ID NO: 173739 - DNA, 16 bp, H. sapiens
tttggaaattatgaat

SEQ ID NO: 173740 - DNA, 16 bp, H. sapiens
tttggaacaaatggac

SEQ ID NO: 173741 - DNA, 16 bp, H. sapiens
tttggaacagtttcag

SEQ ID NO: 173742 - DNA, 16 bp, H. sapiens
tttggaactcctgggc

SEQ ID NO: 173743 - DNA, 16 bp, H. sapiens
tttggaacttcctaga

SEQ ID NO: 173744 - DNA, 16 bp, H. sapiens
tttggaacttgcccca

SEQ ID NO: 173745 - DNA, 16 bp, H. sapiens
tttggaactttgaact

SEQ ID NO: 173746 - DNA, 16 bp, H. sapiens
tttggaagaaaaaaat

SEQ ID NO: 173747 - DNA, 16 bp, H. sapiens
tttggaagaaaaataa

SEQ ID NO: 173748 - DNA, 16 bp, H. sapiens
tttggaagaaaataaa

SEQ ID NO: 173749 - DNA, 16 bp, H. sapiens
tttggaagaaaatata

SEQ ID NO: 173750 - DNA, 16 bp, H. sapiens
tttggaagaaaatatt

SEQ ID NO: 173751 - DNA, 16 bp, H. sapiens
tttggaagaagaaaaa

SEQ ID NO: 173752 - DNA, 16 bp, H. sapiens
tttggaagaagatgcc

SEQ ID NO: 173753 - DNA, 16 bp, H. sapiens
tttggaagaagctgat

SEQ ID NO: 173754 - DNA, 16 bp, H. sapiens
tttggaagaaggaaag

SEQ ID NO: 173755 - DNA, 16 bp, H. sapiens
tttggaagaagttgat

SEQ ID NO: 173756 - DNA, 16 bp, H. sapiens
tttggaagaattattt

SEQ ID NO: 173757 - DNA, 16 bp, H. sapiens
tttggaagaatttgag

SEQ ID NO: 173758 - DNA, 16 bp, H. sapiens
tttggaagaatttttt

SEQ ID NO: 173759 - DNA, 16 bp, H. sapiens
tttggaagacagcttg

SEQ ID NO: 173760 - DNA, 16 bp, H. sapiens
tttggaagacattttg

SEQ ID NO: 173761 - DNA, 16 bp, H. sapiens
tttggaagagaaaaaa

SEQ ID NO: 173762 - DNA, 16 bp, H. sapiens
tttggaagagaaaaat

SEQ ID NO: 173763 - DNA, 16 bp, H. sapiens
tttggaagagtttaag

SEQ ID NO: 173764 - DNA, 16 bp, H. sapiens
tttggaagatggaaaa

SEQ ID NO: 173765 - DNA, 16 bp, H. sapiens
tttggaagatttaaaa

SEQ ID NO: 173766 - DNA, 16 bp, H. sapiens
tttggaaggaaaaaaa

SEQ ID NO: 173767 - DNA, 16 bp, H. sapiens
tttggaaggcaaaggc

SEQ ID NO: 173768 - DNA, 16 bp, H. sapiens
tttggaaggccaaggc

SEQ ID NO: 173769 - DNA, 16 bp, H. sapiens
tttggaaggccatggc

SEQ ID NO: 173770 - DNA, 20 bp, H. sapiens
tttggaaggccgaggcaggt

SEQ ID NO: 173771 - DNA, 20 bp, H. sapiens
tttggaaggctgaggtgggc

SEQ ID NO: 173772 - DNA, 16 bp, H. sapiens
tttggaaggctttcca

SEQ ID NO: 173773 - DNA, 16 bp, H. sapiens
tttggaagtgttccct

SEQ ID NO: 173774 - DNA, 16 bp, H. sapiens
tttggaagttttaaaa

SEQ ID NO: 173775 - DNA, 16 bp, H. sapiens
tttggaagttttcttt

SEQ ID NO: 173776 - DNA, 16 bp, H. sapiens
tttggaataattttag

SEQ ID NO: 173777 - DNA, 16 bp, H. sapiens
tttggaatatatatat

SEQ ID NO: 173778 - DNA, 16 bp, H. sapiens
tttggaatatattttg

SEQ ID NO: 173779 - DNA, 16 bp, H. sapiens
tttggaatatgaatga

SEQ ID NO: 173780 - DNA, 17 bp, H. sapiens
tttggaatatttgcata

SEQ ID NO: 173781 - DNA, 16 bp, H. sapiens
tttggaatattttgag

SEQ ID NO: 173782 - DNA, 16 bp, H. sapiens
tttggaatcactgttt

SEQ ID NO: 173783 - DNA, 16 bp, H. sapiens
tttggaatcagaaaat

SEQ ID NO: 173784 - DNA, 16 bp, H. sapiens
tttggaatcagaatga

SEQ ID NO: 173785 - DNA, 16 bp, H. sapiens
tttggaatgggaatgt

SEQ ID NO: 173786 - DNA, 16 bp, H. sapiens
tttggaatgggtatat

SEQ ID NO: 173787 - DNA, 16 bp, H. sapiens
tttggaattcaaattt

SEQ ID NO: 173788 - DNA, 16 bp, H. sapiens
tttggaattcagaatt

SEQ ID NO: 173789 - DNA, 16 bp, H. sapiens
tttggaattcattttt

SEQ ID NO: 173790 - DNA, 16 bp, H. sapiens
tttggaattttaagat

SEQ ID NO: 173791 - DNA, 16 bp, H. sapiens
tttggaattttgagtt

SEQ ID NO: 173792 - DNA, 16 bp, H. sapiens
tttggacaaaaaggct

SEQ ID NO: 173793 - DNA, 16 bp, H. sapiens
tttggacaagttattt

SEQ ID NO: 173794 - DNA, 16 bp, H. sapiens
tttggacatttaacat

SEQ ID NO: 173795 - DNA, 17 bp, H. sapiens
tttggactctgggactt

SEQ ID NO: 173796 - DNA, 16 bp, H. sapiens
tttggactgtgaactt

SEQ ID NO: 173797 - DNA, 16 bp, H. sapiens
tttggactgtggttga

SEQ ID NO: 173798 - DNA, 16 bp, H. sapiens
tttggacttctcagcc

SEQ ID NO: 173799 - DNA, 16 bp, H. sapiens
tttggacttctgacct

SEQ ID NO: 173800 - DNA, 16 bp, H. sapiens
tttggacttgaacttt

SEQ ID NO: 173801 - DNA, 16 bp, H. sapiens
tttggactttagactt

SEQ ID NO: 173802 - DNA, 16 bp, H. sapiens
tttggagaaaataatg

SEQ ID NO: 173803 - DNA, 16 bp, H. sapiens
tttggagaaacacaaa

SEQ ID NO: 173804 - DNA, 16 bp, H. sapiens
tttggagaaagagaaa

SEQ ID NO: 173805 - DNA, 16 bp, H. sapiens
tttggagaaataccta

SEQ ID NO: 173806 - DNA, 16 bp, H. sapiens
tttggagaagaggaaa

SEQ ID NO: 173807 - DNA, 16 bp, H. sapiens
tttggagaagtttgtt

SEQ ID NO: 173808 - DNA, 16 bp, H. sapiens
tttggagaatctgatg

SEQ ID NO: 173809 - DNA, 16 bp, H. sapiens
tttggagacaaggtct

SEQ ID NO: 173810 - DNA, 16 bp, H. sapiens
tttggagacacagtct

SEQ ID NO: 173811 - DNA, 16 bp, H. sapiens
tttggagacagaatct

SEQ ID NO: 173812 - DNA, 16 bp, H. sapiens
tttggagacagtctct

SEQ ID NO: 173813 - DNA, 16 bp, H. sapiens
tttggagacagtcttt

SEQ ID NO: 173814 - DNA, 16 bp, H. sapiens
tttggagagacaggat

SEQ ID NO: 173815 - DNA, 16 bp, H. sapiens
tttggagagagggtct

SEQ ID NO: 173816 - DNA, 16 bp, H. sapiens
tttggagagatggggg

SEQ ID NO: 173817 - DNA, 16 bp, H. sapiens
tttggagagatggggt

SEQ ID NO: 173818 - DNA, 16 bp, H. sapiens
tttggagataaggtct

SEQ ID NO: 173819 - DNA, 16 bp, H. sapiens
tttggagatgaagaaa

SEQ ID NO: 173820 - DNA, 16 bp, H. sapiens
tttggagatgaggaaa

SEQ ID NO: 173821 - DNA, 16 bp, H. sapiens
tttggagatggattct

SEQ ID NO: 173822 - DNA, 16 bp, H. sapiens
tttggagatggggtct

SEQ ID NO: 173823 - DNA, 16 bp, H. sapiens
tttggagctctttgag

SEQ ID NO: 173824 - DNA, 16 bp, H. sapiens
tttggaggaaaaaaga

SEQ ID NO: 173825 - DNA, 16 bp, H. sapiens
tttggaggaaaagagg

SEQ ID NO: 173826 - DNA, 16 bp, H. sapiens
tttggaggaaatattt

SEQ ID NO: 173827 - DNA, 16 bp, H. sapiens
tttggaggcagagtct

SEQ ID NO: 173828 - DNA, 16 bp, H. sapiens
tttggaggccaaagtg

SEQ ID NO: 173829 - DNA, 16 bp, H. sapiens
tttggaggccagaaat

SEQ ID NO: 173830 - DNA, 16 bp, H. sapiens
tttggaggctgcagtg

SEQ ID NO: 173831 - DNA, 16 bp, H. sapiens
tttggaggggaagagg

SEQ ID NO: 173832 - DNA, 16 bp, H. sapiens
tttggagtacaaatga

SEQ ID NO: 173833 - DNA, 16 bp, H. sapiens
tttggagtcagacaga

SEQ ID NO: 173834 - DNA, 16 bp, H. sapiens
tttggagtcagggtct

SEQ ID NO: 173835 - DNA, 16 bp, H. sapiens
tttggagtgcagtggt

SEQ ID NO: 173836 - DNA, 16 bp, H. sapiens
tttggagttcattttt

SEQ ID NO: 173837 - DNA, 16 bp, H. sapiens
tttggagttttttcct

SEQ ID NO: 173838 - DNA, 16 bp, H. sapiens
tttggataaaaagaaa

SEQ ID NO: 173839 - DNA, 16 bp, H. sapiens
tttggataccctttat

SEQ ID NO: 173840 - DNA, 16 bp, H. sapiens
tttggatagataccca

SEQ ID NO: 173841 - DNA, 16 bp, H. sapiens
tttggatatataccca

SEQ ID NO: 173842 - DNA, 16 bp, H. sapiens
tttggatatttgtccc

SEQ ID NO: 173843 - DNA, 16 bp, H. sapiens
tttggatccattgttg

SEQ ID NO: 173844 - DNA, 16 bp, H. sapiens
tttggatcctgattca

SEQ ID NO: 173845 - DNA, 16 bp, H. sapiens
tttggatcttctttct

SEQ ID NO: 173846 - DNA, 16 bp, H. sapiens
tttggatgaaagccat

SEQ ID NO: 173847 - DNA, 16 bp, H. sapiens
tttggatgataaatta

SEQ ID NO: 173848 - DNA, 16 bp, H. sapiens
tttggatgcactttat

SEQ ID NO: 173849 - DNA, 16 bp, H. sapiens
tttggatgctttttat

SEQ ID NO: 173850 - DNA, 16 bp, H. sapiens
tttggatggctcagaa

SEQ ID NO: 173851 - DNA, 16 bp, H. sapiens
tttggatggtttccag

SEQ ID NO: 173852 - DNA, 16 bp, H. sapiens
tttggattaaaatatt

SEQ ID NO: 173853 - DNA, 16 bp, H. sapiens
tttggattaggctttg

SEQ ID NO: 173854 - DNA, 16 bp, H. sapiens
tttggattcagcaggt

SEQ ID NO: 173855 - DNA, 16 bp, H. sapiens
tttggattcattgctg

SEQ ID NO: 173856 - DNA, 16 bp, H. sapiens
tttggatttacagaaa

SEQ ID NO: 173857 - DNA, 16 bp, H. sapiens
tttggatttcaaattt

SEQ ID NO: 173858 - DNA, 16 bp, H. sapiens
tttggatttctcttct

SEQ ID NO: 173859 - DNA, 16 bp, H. sapiens
tttggatttctttctg

SEQ ID NO: 173860 - DNA, 16 bp, H. sapiens
tttggatttgtctgat

SEQ ID NO: 173861 - DNA, 16 bp, H. sapiens
tttggattttattcca

SEQ ID NO: 173862 - DNA, 16 bp, H. sapiens
tttggattttgaagca

SEQ ID NO: 173863 - DNA, 16 bp, H. sapiens
tttggattttgtcaaa

SEQ ID NO: 173864 - DNA, 16 bp, H. sapiens
tttggatttttaaaaa

SEQ ID NO: 173865 - DNA, 16 bp, H. sapiens
tttggatttttgtcct

SEQ ID NO: 173866 - DNA, 16 bp, H. sapiens
tttggcacaagggacc

SEQ ID NO: 173867 - DNA, 16 bp, H. sapiens
tttggcagaagaaatt

SEQ ID NO: 173868 - DNA, 16 bp, H. sapiens
tttggcagaaggaaca

SEQ ID NO: 173869 - DNA, 16 bp, H. sapiens
tttggcagcttcttac

SEQ ID NO: 173870 - DNA, 16 bp, H. sapiens
tttggcaggccaaggc

SEQ ID NO: 173871 - DNA, 16 bp, H. sapiens
tttggcagttcctcct

SEQ ID NO: 173872 - DNA, 16 bp, H. sapiens
tttggcagtttctttt

SEQ ID NO: 173873 - DNA, 16 bp, H. sapiens
tttggcatttgaagca

SEQ ID NO: 173874 - DNA, 16 bp, H. sapiens
tttggcattttatatt

SEQ ID NO: 173875 - DNA, 16 bp, H. sapiens
tttggccaatgaaatg

SEQ ID NO: 173876 - DNA, 16 bp, H. sapiens
tttggccacatgtatg

SEQ ID NO: 173877 - DNA, 16 bp, H. sapiens
tttggccagggtggtc

SEQ ID NO: 173878 - DNA, 16 bp, H. sapiens
tttggccagtttcttt

SEQ ID NO: 173879 - DNA, 16 bp, H. sapiens
tttggccatttgtatg

SEQ ID NO: 173880 - DNA, 16 bp, H. sapiens
tttggcccatcccttc

SEQ ID NO: 173881 - DNA, 16 bp, H. sapiens
tttggcccatttttta

SEQ ID NO: 173882 - DNA, 16 bp, H. sapiens
tttggccctctgatgt

SEQ ID NO: 173883 - DNA, 16 bp, H. sapiens
tttggcctaaagctgc

SEQ ID NO: 173884 - DNA, 16 bp, H. sapiens
tttggcctcacaaagt

SEQ ID NO: 173885 - DNA, 16 bp, H. sapiens
tttggcctcccaaagt

SEQ ID NO: 173886 - DNA, 16 bp, H. sapiens
tttggcctccctctcc

SEQ ID NO: 173887 - DNA, 16 bp, H. sapiens
tttggcctgcaggctg

SEQ ID NO: 173888 - DNA, 16 bp, H. sapiens
tttggccttttaaaaa

SEQ ID NO: 173889 - DNA, 18 bp, H. sapiens
tttggcgaattactggaa

SEQ ID NO: 173890 - DNA, 16 bp, H. sapiens
tttggctaaataaatg

SEQ ID NO: 173891 - DNA, 16 bp, H. sapiens
tttggctaatttttaa

SEQ ID NO: 173892 - DNA, 16 bp, H. sapiens
tttggctattatttct

SEQ ID NO: 173893 - DNA, 16 bp, H. sapiens
tttggctattgagaat

SEQ ID NO: 173894 - DNA, 16 bp, H. sapiens
tttggctcacagttct

SEQ ID NO: 173895 - DNA, 16 bp, H. sapiens
tttggctcactgtagc

SEQ ID NO: 173896 - DNA, 16 bp, H. sapiens
tttggctcagaataaa

SEQ ID NO: 173897 - DNA, 16 bp, H. sapiens
tttggctccttcattt

SEQ ID NO: 173898 - DNA, 16 bp, H. sapiens
tttggctctccatttg

SEQ ID NO: 173899 - DNA, 16 bp, H. sapiens
tttggctctctatttg

SEQ ID NO: 173900 - DNA, 16 bp, H. sapiens
tttggctctctgctta

SEQ ID NO: 173901 - DNA, 16 bp, H. sapiens
tttggctctctgtttc

SEQ ID NO: 173902 - DNA, 16 bp, H. sapiens
tttggctcttggcttg

SEQ ID NO: 173903 - DNA, 17 bp, H. sapiens
tttggctgggcacggtg

SEQ ID NO: 173904 - DNA, 16 bp, H. sapiens
tttggctgggcatggt

SEQ ID NO: 173905 - DNA, 16 bp, H. sapiens
tttggcttaggactga

SEQ ID NO: 173906 - DNA, 16 bp, H. sapiens
tttggcttccctgagc

SEQ ID NO: 173907 - DNA, 16 bp, H. sapiens
tttggcttccctggcc

SEQ ID NO: 173908 - DNA, 18 bp, H. sapiens
tttggcttccctgggcca

SEQ ID NO: 173909 - DNA, 16 bp, H. sapiens
tttggctttatgtccc

SEQ ID NO: 173910 - DNA, 16 bp, H. sapiens
tttggctttatttcta

SEQ ID NO: 173911 - DNA, 16 bp, H. sapiens
tttggctttctctggt

SEQ ID NO: 173912 - DNA, 16 bp, H. sapiens
tttggctttgtgggcc

SEQ ID NO: 173913 - DNA, 16 bp, H. sapiens
tttggcttttaaaaat

SEQ ID NO: 173914 - DNA, 16 bp, H. sapiens
tttggcttttattgcc

SEQ ID NO: 173915 - DNA, 16 bp, H. sapiens
tttggctttttgaaaa

SEQ ID NO: 173916 - DNA, 16 bp, H. sapiens
tttggctttttgataa

SEQ ID NO: 173917 - DNA, 16 bp, H. sapiens
tttgggaaaaaacaaa

SEQ ID NO: 173918 - DNA, 16 bp, H. sapiens
tttgggaaaagagaaa

SEQ ID NO: 173919 - DNA, 16 bp, H. sapiens
tttgggaaaataattt

SEQ ID NO: 173920 - DNA, 16 bp, H. sapiens
tttgggaaacagtctg

SEQ ID NO: 173921 - DNA, 16 bp, H. sapiens
tttgggaaagttattt

SEQ ID NO: 173922 - DNA, 16 bp, H. sapiens
tttgggaaagtttgga

SEQ ID NO: 173923 - DNA, 16 bp, H. sapiens
tttgggaaataaaata

SEQ ID NO: 173924 - DNA, 16 bp, H. sapiens
tttgggaaatattttg

SEQ ID NO: 173925 - DNA, 16 bp, H. sapiens
tttgggaaatctccat

SEQ ID NO: 173926 - DNA, 16 bp, H. sapiens
tttgggaaatgctgag

SEQ ID NO: 173927 - DNA, 16 bp, H. sapiens
tttgggaaatgctgat

SEQ ID NO: 173928 - DNA, 16 bp, H. sapiens
tttgggaaattctcag

SEQ ID NO: 173929 - DNA, 16 bp, H. sapiens
tttgggaaccactgct

SEQ ID NO: 173930 - DNA, 16 bp, H. sapiens
tttgggaactccagtg

SEQ ID NO: 173931 - DNA, 16 bp, H. sapiens
tttgggaagaatgtgt

SEQ ID NO: 173932 - DNA, 16 bp, H. sapiens
tttgggaagaggaaaa

SEQ ID NO: 173933 - DNA, 16 bp, H. sapiens
tttgggaagataaaaa

SEQ ID NO: 173934 - DNA, 16 bp, H. sapiens
tttgggaagatgagaa

SEQ ID NO: 173935 - DNA, 16 bp, H. sapiens
tttgggaagatgaggt

SEQ ID NO: 173936 - DNA, 16 bp, H. sapiens
tttgggaagcaggaca

SEQ ID NO: 173937 - DNA, 25 bp, H. sapiens
tttgggaagccaaggcaggtggatc

SEQ ID NO: 173938 - DNA, 16 bp, H. sapiens
tttgggaagccaagtg

SEQ ID NO: 173939 - DNA, 16 bp, H. sapiens
tttgggaagccagggc

SEQ ID NO: 173940 - DNA, 16 bp, H. sapiens
tttgggaagggccagg

SEQ ID NO: 173941 - DNA, 16 bp, H. sapiens
tttgggaagtgatgag

SEQ ID NO: 173942 - DNA, 16 bp, H. sapiens
tttgggaatatttgca

SEQ ID NO: 173943 - DNA, 16 bp, H. sapiens
tttgggaatttttcag

SEQ ID NO: 173944 - DNA, 16 bp, H. sapiens
tttgggactcagactg

SEQ ID NO: 173945 - DNA, 16 bp, H. sapiens
tttgggagaaaaaaat

SEQ ID NO: 173946 - DNA, 16 bp, H. sapiens
tttgggagaagaaaaa

SEQ ID NO: 173947 - DNA, 16 bp, H. sapiens
tttgggagacatttag

SEQ ID NO: 173948 - DNA, 16 bp, H. sapiens
tttgggagaccaaagt

SEQ ID NO: 173949 - DNA, 16 bp, H. sapiens
tttgggagaccaaggt

SEQ ID NO: 173950 - DNA, 17 bp, H. sapiens
tttgggagactagctta

SEQ ID NO: 173951 - DNA, 16 bp, H. sapiens
tttgggagactgagct

SEQ ID NO: 173952 - DNA, 16 bp, H. sapiens
tttgggagaggacaca

SEQ ID NO: 173953 - DNA, 16 bp, H. sapiens
tttgggagatattttt

SEQ ID NO: 173954 - DNA, 16 bp, H. sapiens
tttgggaggacacatt

SEQ ID NO: 173955 - DNA, 16 bp, H. sapiens
tttgggaggaggaggc

SEQ ID NO: 173956 - DNA, 16 bp, H. sapiens
tttgggaggcaattag

SEQ ID NO: 173957 - DNA, 16 bp, H. sapiens
tttgggaggcagagga

SEQ ID NO: 173958 - DNA, 16 bp, H. sapiens
tttgggaggccaaggc

SEQ ID NO: 173959 - DNA, 16 bp, H. sapiens
tttgggaggccaaggt

SEQ ID NO: 173960 - DNA, 20 bp, H. sapiens
tttgggaggccaaggtgggt

SEQ ID NO: 173961 - DNA, 16 bp, H. sapiens
tttgggaggccacagt

SEQ ID NO: 173962 - DNA, 16 bp, H. sapiens
tttgggaggccagggt

SEQ ID NO: 173963 - DNA, 16 bp, H. sapiens
tttgggaggccgaagt

SEQ ID NO: 173964 - DNA, 19 bp, H. sapiens
tttgggaggccgaggtgga

SEQ ID NO: 173965 - DNA, 16 bp, H. sapiens
tttgggaggcctgagg

SEQ ID NO: 173966 - DNA, 16 bp, H. sapiens
tttgggaggcctgggc

SEQ ID NO: 173967 - DNA, 16 bp, H. sapiens
tttgggaggctcaggc

SEQ ID NO: 173968 - DNA, 16 bp, H. sapiens
tttgggaggctgagcc

SEQ ID NO: 173969 - DNA, 16 bp, H. sapiens
tttgggagggaggctg

SEQ ID NO: 173970 - DNA, 22 bp, H. sapiens
tttgggaggtcgaggcaggcag

SEQ ID NO: 173971 - DNA, 16 bp, H. sapiens
tttgggaggtgatcag

SEQ ID NO: 173972 - DNA, 16 bp, H. sapiens
tttgggaggtgattag

SEQ ID NO: 173973 - DNA, 16 bp, H. sapiens
tttgggaggtgccagg

SEQ ID NO: 173974 - DNA, 16 bp, H. sapiens
tttgggagtccaaggc

SEQ ID NO: 173975 - DNA, 16 bp, H. sapiens
tttgggatacagcaaa

SEQ ID NO: 173976 - DNA, 16 bp, H. sapiens
tttgggatgaggataa

SEQ ID NO: 173977 - DNA, 16 bp, H. sapiens
tttgggatgcagctaa

SEQ ID NO: 173978 - DNA, 16 bp, H. sapiens
tttgggatgcccaggc

SEQ ID NO: 173979 - DNA, 16 bp, H. sapiens
tttgggatgtgatcca

SEQ ID NO: 173980 - DNA, 16 bp, H. sapiens
tttgggatgtgtgcat

SEQ ID NO: 173981 - DNA, 16 bp, H. sapiens
tttgggattttttaaa

SEQ ID NO: 173982 - DNA, 16 bp, H. sapiens
tttgggcaaatttctt

SEQ ID NO: 173983 - DNA, 16 bp, H. sapiens
tttgggcaagtttctt

SEQ ID NO: 173984 - DNA, 16 bp, H. sapiens
tttgggcactgatgag

SEQ ID NO: 173985 - DNA, 16 bp, H. sapiens
tttgggcagacaccaa

SEQ ID NO: 173986 - DNA, 16 bp, H. sapiens
tttgggcatgaaaaca

SEQ ID NO: 173987 - DNA, 16 bp, H. sapiens
tttgggccaggtgtgg

SEQ ID NO: 173988 - DNA, 16 bp, H. sapiens
tttggggaaaaaaatg

SEQ ID NO: 173989 - DNA, 16 bp, H. sapiens
tttggggaaaaacaaa

SEQ ID NO: 173990 - DNA, 16 bp, H. sapiens
tttggggaaaagggat

SEQ ID NO: 173991 - DNA, 16 bp, H. sapiens
tttggggaaaatgaag

SEQ ID NO: 173992 - DNA, 16 bp, H. sapiens
tttggggaaataaaaa

SEQ ID NO: 173993 - DNA, 16 bp, H. sapiens
tttggggaagaggtgg

SEQ ID NO: 173994 - DNA, 16 bp, H. sapiens
tttggggactattgtg

SEQ ID NO: 173995 - DNA, 16 bp, H. sapiens
tttggggacttagcca

SEQ ID NO: 173996 - DNA, 16 bp, H. sapiens
tttggggacttagggg

SEQ ID NO: 173997 - DNA, 16 bp, H. sapiens
tttggggagcaggagg

SEQ ID NO: 173998 - DNA, 16 bp, H. sapiens
tttggggagcaggtgg

SEQ ID NO: 173999 - DNA, 16 bp, H. sapiens
tttggggatgatgaaa

SEQ ID NO: 174000 - DNA, 16 bp, H. sapiens
tttggggctattttga

SEQ ID NO: 174001 - DNA, 16 bp, H. sapiens
tttggggctgagatga

SEQ ID NO: 174002 - DNA, 16 bp, H. sapiens
tttgggggaaatgttt

SEQ ID NO: 174003 - DNA, 16 bp, H. sapiens
tttgggggaacaaaat

SEQ ID NO: 174004 - DNA, 16 bp, H. sapiens
tttgggggaagaaaag

SEQ ID NO: 174005 - DNA, 16 bp, H. sapiens
tttgggggacacaatt

SEQ ID NO: 174006 - DNA, 16 bp, H. sapiens
tttgggggctgaggca

SEQ ID NO: 174007 - DNA, 16 bp, H. sapiens
tttggggggaaaaaaa

SEQ ID NO: 174008 - DNA, 16 bp, H. sapiens
tttggggggaacacaa

SEQ ID NO: 174009 - DNA, 16 bp, H. sapiens
tttggggggaacaggt

SEQ ID NO: 174010 - DNA, 16 bp, H. sapiens
tttgggggtgatggaa

SEQ ID NO: 174011 - DNA, 16 bp, H. sapiens
tttggggtcccaagat

SEQ ID NO: 174012 - DNA, 16 bp, H. sapiens
tttggggtcctgagat

SEQ ID NO: 174013 - DNA, 16 bp, H. sapiens
tttggggtgatgaaaa

SEQ ID NO: 174014 - DNA, 16 bp, H. sapiens
tttggggtggtgaaaa

SEQ ID NO: 174015 - DNA, 16 bp, H. sapiens
tttgggtaccagtacc

SEQ ID NO: 174016 - DNA, 26 bp, H. sapiens
tttgggtatatacccagtaatgggat

SEQ ID NO: 174017 - DNA, 17 bp, H. sapiens
tttgggtcactccacca

SEQ ID NO: 174018 - DNA, 16 bp, H. sapiens
tttgggtcatgggggc

SEQ ID NO: 174019 - DNA, 16 bp, H. sapiens
tttgggtctcaatttt

SEQ ID NO: 174020 - DNA, 16 bp, H. sapiens
tttgggtcttcatttt

SEQ ID NO: 174021 - DNA, 16 bp, H. sapiens
tttgggtgacagagca

SEQ ID NO: 174022 - DNA, 16 bp, H. sapiens
tttgggtgattttaaa

SEQ ID NO: 174023 - DNA, 16 bp, H. sapiens
tttgggtggccaaggt

SEQ ID NO: 174024 - DNA, 16 bp, H. sapiens
tttgggtgtataccca

SEQ ID NO: 174025 - DNA, 16 bp, H. sapiens
tttgggtgtataccta

SEQ ID NO: 174026 - DNA, 16 bp, H. sapiens
tttgggttgtttctaa

SEQ ID NO: 174027 - DNA, 16 bp, H. sapiens
tttgggtttcagattt

SEQ ID NO: 174028 - DNA, 16 bp, H. sapiens
tttgggtttctgttcc

SEQ ID NO: 174029 - DNA, 16 bp, H. sapiens
tttgggtttgtctgat

SEQ ID NO: 174030 - DNA, 16 bp, H. sapiens
tttggtaaaaatattt

SEQ ID NO: 174031 - DNA, 16 bp, H. sapiens
tttggtaaaaatttta

SEQ ID NO: 174032 - DNA, 16 bp, H. sapiens
tttggtaaaatgtttt

SEQ ID NO: 174033 - DNA, 16 bp, H. sapiens
tttggtaggctgaggc

SEQ ID NO: 174034 - DNA, 16 bp, H. sapiens
tttggtataaggatga

SEQ ID NO: 174035 - DNA, 16 bp, H. sapiens
tttggtatcagggtat

SEQ ID NO: 174036 - DNA, 16 bp, H. sapiens
tttggtatctgtggga

SEQ ID NO: 174037 - DNA, 16 bp, H. sapiens
tttggtcaaacactag

SEQ ID NO: 174038 - DNA, 16 bp, H. sapiens
tttggtcacactctca

SEQ ID NO: 174039 - DNA, 16 bp, H. sapiens
tttggtcatttaaaaa

SEQ ID NO: 174040 - DNA, 16 bp, H. sapiens
tttggtctaaattatg

SEQ ID NO: 174041 - DNA, 16 bp, H. sapiens
tttggtgaaaaccttg

SEQ ID NO: 174042 - DNA, 16 bp, H. sapiens
tttggtgaatctggca

SEQ ID NO: 174043 - DNA, 16 bp, H. sapiens
tttggtgaccatgaag

SEQ ID NO: 174044 - DNA, 16 bp, H. sapiens
tttggtgagatcatgt

SEQ ID NO: 174045 - DNA, 16 bp, H. sapiens
tttggtgatttctcaa

SEQ ID NO: 174046 - DNA, 16 bp, H. sapiens
tttggtgcatctcatc

SEQ ID NO: 174047 - DNA, 16 bp, H. sapiens
tttggtgccacaaaag

SEQ ID NO: 174048 - DNA, 16 bp, H. sapiens
tttggtggaagaaatt

SEQ ID NO: 174049 - DNA, 16 bp, H. sapiens
tttggtggcttccatg

SEQ ID NO: 174050 - DNA, 16 bp, H. sapiens
tttggtggggacacag

SEQ ID NO: 174051 - DNA, 16 bp, H. sapiens
tttggtggtctgctgc

SEQ ID NO: 174052 - DNA, 16 bp, H. sapiens
tttggtggtgtcagtg

SEQ ID NO: 174053 - DNA, 16 bp, H. sapiens
tttggtgtcttcatca

SEQ ID NO: 174054 - DNA, 16 bp, H. sapiens
tttggtgtgctttcct

SEQ ID NO: 174055 - DNA, 16 bp, H. sapiens
tttggtgttccttggc

SEQ ID NO: 174056 - DNA, 16 bp, H. sapiens
tttggttaaattcatt

SEQ ID NO: 174057 - DNA, 17 bp, H. sapiens
tttggttacatgagtaa

SEQ ID NO: 174058 - DNA, 16 bp, H. sapiens
tttggttactggagcc

SEQ ID NO: 174059 - DNA, 16 bp, H. sapiens
tttggttatttctgtg

SEQ ID NO: 174060 - DNA, 16 bp, H. sapiens
tttggttccagaccat

SEQ ID NO: 174061 - DNA, 17 bp, H. sapiens
tttggttcctaaataag

SEQ ID NO: 174062 - DNA, 16 bp, H. sapiens
tttggttgcctgtgat

SEQ ID NO: 174063 - DNA, 16 bp, H. sapiens
tttggtttaaaaaaaa

SEQ ID NO: 174064 - DNA, 16 bp, H. sapiens
tttggtttaaaaacta

SEQ ID NO: 174065 - DNA, 16 bp, H. sapiens
tttggtttaaaaatta

SEQ ID NO: 174066 - DNA, 16 bp, H. sapiens
tttggtttagaaaggg

SEQ ID NO: 174067 - DNA, 16 bp, H. sapiens
tttggtttcagcagtt

SEQ ID NO: 174068 - DNA, 16 bp, H. sapiens
tttggtttgaatgtct

SEQ ID NO: 174069 - DNA, 16 bp, H. sapiens
tttggtttgctattat

SEQ ID NO: 174070 - DNA, 16 bp, H. sapiens
tttggtttgtttccag

SEQ ID NO: 174071 - DNA, 16 bp, H. sapiens
tttggttttaatttgc

SEQ ID NO: 174072 - DNA, 16 bp, H. sapiens
tttggttttatacatt

SEQ ID NO: 174073 - DNA, 16 bp, H. sapiens
tttggttttatgcatt

SEQ ID NO: 174074 - DNA, 16 bp, H. sapiens
tttggttttctcccag

SEQ ID NO: 174075 - DNA, 16 bp, H. sapiens
tttggttttgatatca

SEQ ID NO: 174076 - DNA, 16 bp, H. sapiens
tttggtttttcaccat

SEQ ID NO: 174077 - DNA, 16 bp, H. sapiens
tttgtaaaaataaaca

SEQ ID NO: 174078 - DNA, 16 bp, H. sapiens
tttgtaaaagaagaaa

SEQ ID NO: 174079 - DNA, 16 bp, H. sapiens
tttgtaaaagccaaaa

SEQ ID NO: 174080 - DNA, 16 bp, H. sapiens
tttgtaaaaggaaaaa

SEQ ID NO: 174081 - DNA, 16 bp, H. sapiens
tttgtaaaataagtat

SEQ ID NO: 174082 - DNA, 16 bp, H. sapiens
tttgtaaaataatttc

SEQ ID NO: 174083 - DNA, 16 bp, H. sapiens
tttgtaaaatatatct

SEQ ID NO: 174084 - DNA, 16 bp, H. sapiens
tttgtaaaatatcttt

SEQ ID NO: 174085 - DNA, 16 bp, H. sapiens
tttgtaaaatcaattt

SEQ ID NO: 174086 - DNA, 16 bp, H. sapiens
tttgtaaaatctgtga

SEQ ID NO: 174087 - DNA, 16 bp, H. sapiens
tttgtaaaatgaagac

SEQ ID NO: 174088 - DNA, 16 bp, H. sapiens
tttgtaaaatgaagag

SEQ ID NO: 174089 - DNA, 16 bp, H. sapiens
tttgtaaaatgaagat

SEQ ID NO: 174090 - DNA, 16 bp, H. sapiens
tttgtaaaatgtgtat

SEQ ID NO: 174091 - DNA, 16 bp, H. sapiens
tttgtaaaatgtttgt

SEQ ID NO: 174092 - DNA, 16 bp, H. sapiens
tttgtaaaatttgtaa

SEQ ID NO: 174093 - DNA, 16 bp, H. sapiens
tttgtaaactataaag

SEQ ID NO: 174094 - DNA, 16 bp, H. sapiens
tttgtaaactctaaag

SEQ ID NO: 174095 - DNA, 16 bp, H. sapiens
tttgtaaactgctttt

SEQ ID NO: 174096 - DNA, 16 bp, H. sapiens
tttgtaaactgtaaag

SEQ ID NO: 174097 - DNA, 16 bp, H. sapiens
tttgtaaagataaggt

SEQ ID NO: 174098 - DNA, 16 bp, H. sapiens
tttgtaaagatggagt

SEQ ID NO: 174099 - DNA, 16 bp, H. sapiens
tttgtaaagattttct

SEQ ID NO: 174100 - DNA, 16 bp, H. sapiens
tttgtaaagcagaaat

SEQ ID NO: 174101 - DNA, 16 bp, H. sapiens
tttgtaaataacaaaa

SEQ ID NO: 174102 - DNA, 16 bp, H. sapiens
tttgtaaatagttgtt

SEQ ID NO: 174103 - DNA, 16 bp, H. sapiens
tttgtaaatatcttct

SEQ ID NO: 174104 - DNA, 16 bp, H. sapiens
tttgtaaatatctttt

SEQ ID NO: 174105 - DNA, 16 bp, H. sapiens
tttgtaaatattatct

SEQ ID NO: 174106 - DNA, 16 bp, H. sapiens
tttgtaaatattctgt

SEQ ID NO: 174107 - DNA, 16 bp, H. sapiens
tttgtaaatatttact

SEQ ID NO: 174108 - DNA, 16 bp, H. sapiens
tttgtaaatatttcaa

SEQ ID NO: 174109 - DNA, 16 bp, H. sapiens
tttgtaaatatttccc

SEQ ID NO: 174110 - DNA, 16 bp, H. sapiens
tttgtaaatattttct

SEQ ID NO: 174111 - DNA, 16 bp, H. sapiens
tttgtaaatgacatga

SEQ ID NO: 174112 - DNA, 16 bp, H. sapiens
tttgtaaatgagaaaa

SEQ ID NO: 174113 - DNA, 16 bp, H. sapiens
tttgtaaatgtaaatt

SEQ ID NO: 174114 - DNA, 16 bp, H. sapiens
tttgtaaatgttaaaa

SEQ ID NO: 174115 - DNA, 16 bp, H. sapiens
tttgtaaattaaaatg

SEQ ID NO: 174116 - DNA, 16 bp, H. sapiens
tttgtaaattatgcat

SEQ ID NO: 174117 - DNA, 16 bp, H. sapiens
tttgtaaatttttact

SEQ ID NO: 174118 - DNA, 16 bp, H. sapiens
tttgtaacaaatattt

SEQ ID NO: 174119 - DNA, 16 bp, H. sapiens
tttgtaacacaaatga

SEQ ID NO: 174120 - DNA, 16 bp, H. sapiens
tttgtaacatattttg

SEQ ID NO: 174121 - DNA, 16 bp, H. sapiens
tttgtaacatttattt

SEQ ID NO: 174122 - DNA, 16 bp, H. sapiens
tttgtaacattttaat

SEQ ID NO: 174123 - DNA, 16 bp, H. sapiens
tttgtaacatttttga

SEQ ID NO: 174124 - DNA, 16 bp, H. sapiens
tttgtaacccccaaat

SEQ ID NO: 174125 - DNA, 16 bp, H. sapiens
tttgtaactttaaaaa

SEQ ID NO: 174126 - DNA, 16 bp, H. sapiens
tttgtaactttagtag

SEQ ID NO: 174127 - DNA, 16 bp, H. sapiens
tttgtaactttttaaa

SEQ ID NO: 174128 - DNA, 16 bp, H. sapiens
tttgtaagaaaagaaa

SEQ ID NO: 174129 - DNA, 16 bp, H. sapiens
tttgtaagaaactacc

SEQ ID NO: 174130 - DNA, 16 bp, H. sapiens
tttgtaagaagctgcc

SEQ ID NO: 174131 - DNA, 16 bp, H. sapiens
tttgtaagtgaagaaa

SEQ ID NO: 174132 - DNA, 16 bp, H. sapiens
tttgtaataatttttc

SEQ ID NO: 174133 - DNA, 16 bp, H. sapiens
tttgtaatagccaaaa

SEQ ID NO: 174134 - DNA, 16 bp, H. sapiens
tttgtaatagtcaaaa

SEQ ID NO: 174135 - DNA, 16 bp, H. sapiens
tttgtaatatacattt

SEQ ID NO: 174136 - DNA, 16 bp, H. sapiens
tttgtaatatagtttg

SEQ ID NO: 174137 - DNA, 16 bp, H. sapiens
tttgtaatctgctttt

SEQ ID NO: 174138 - DNA, 16 bp, H. sapiens
tttgtaattacaaaat

SEQ ID NO: 174139 - DNA, 16 bp, H. sapiens
tttgtaattatttcat

SEQ ID NO: 174140 - DNA, 16 bp, H. sapiens
tttgtaattctgttta

SEQ ID NO: 174141 - DNA, 16 bp, H. sapiens
tttgtaattttgatag

SEQ ID NO: 174142 - DNA, 16 bp, H. sapiens
tttgtaatttttcact

SEQ ID NO: 174143 - DNA, 16 bp, H. sapiens
tttgtacacattttaa

SEQ ID NO: 174144 - DNA, 16 bp, H. sapiens
tttgtacataaaatat

SEQ ID NO: 174145 - DNA, 16 bp, H. sapiens
tttgtacatatatttt

SEQ ID NO: 174146 - DNA, 16 bp, H. sapiens
tttgtacatcttcttt

SEQ ID NO: 174147 - DNA, 16 bp, H. sapiens
tttgtacatggatttt

SEQ ID NO: 174148 - DNA, 16 bp, H. sapiens
tttgtacattgctttt

SEQ ID NO: 174149 - DNA, 16 bp, H. sapiens
tttgtacattttaggg

SEQ ID NO: 174150 - DNA, 16 bp, H. sapiens
tttgtacattttggat

SEQ ID NO: 174151 - DNA, 16 bp, H. sapiens
tttgtacatttttaat

SEQ ID NO: 174152 - DNA, 16 bp, H. sapiens
tttgtacccattaacc

SEQ ID NO: 174153 - DNA, 16 bp, H. sapiens
tttgtacttccctcag

SEQ ID NO: 174154 - DNA, 16 bp, H. sapiens
tttgtactttaaaaaa

SEQ ID NO: 174155 - DNA, 16 bp, H. sapiens
tttgtactttttaata

SEQ ID NO: 174156 - DNA, 16 bp, H. sapiens
tttgtagaaacaaggt

SEQ ID NO: 174157 - DNA, 16 bp, H. sapiens
tttgtagaaatgggat

SEQ ID NO: 174158 - DNA, 16 bp, H. sapiens
tttgtagaaatgtaaa

SEQ ID NO: 174159 - DNA, 16 bp, H. sapiens
tttgtagaatatgtga

SEQ ID NO: 174160 - DNA, 16 bp, H. sapiens
tttgtagaatgagttt

SEQ ID NO: 174161 - DNA, 16 bp, H. sapiens
tttgtagaatgtttct

SEQ ID NO: 174162 - DNA, 16 bp, H. sapiens
tttgtagagacaaaat

SEQ ID NO: 174163 - DNA, 16 bp, H. sapiens
tttgtagagacaggtt

SEQ ID NO: 174164 - DNA, 16 bp, H. sapiens
tttgtagagataggat

SEQ ID NO: 174165 - DNA, 16 bp, H. sapiens
tttgtagagatgaagg

SEQ ID NO: 174166 - DNA, 17 bp, H. sapiens
tttgtagagatgggatc

SEQ ID NO: 174167 - DNA, 16 bp, H. sapiens
tttgtagagatgtgtt

SEQ ID NO: 174168 - DNA, 16 bp, H. sapiens
tttgtagattactttt

SEQ ID NO: 174169 - DNA, 16 bp, H. sapiens
tttgtagccatctgtc

SEQ ID NO: 174170 - DNA, 16 bp, H. sapiens
tttgtagcctaggagc

SEQ ID NO: 174171 - DNA, 16 bp, H. sapiens
tttgtagctattgaaa

SEQ ID NO: 174172 - DNA, 16 bp, H. sapiens
tttgtagcttttaaaa

SEQ ID NO: 174173 - DNA, 16 bp, H. sapiens
tttgtagtaacttttg

SEQ ID NO: 174174 - DNA, 16 bp, H. sapiens
tttgtagtattttctg

SEQ ID NO: 174175 - DNA, 16 bp, H. sapiens
tttgtagtcctccttg

SEQ ID NO: 174176 - DNA, 16 bp, H. sapiens
tttgtagtgatgaggt

SEQ ID NO: 174177 - DNA, 16 bp, H. sapiens
tttgtagtgttttatc

SEQ ID NO: 174178 - DNA, 29 bp, H. sapiens
tttgtagttctccttgaagaggtccttca

SEQ ID NO: 174179 - DNA, 16 bp, H. sapiens
tttgtagttctcttta

SEQ ID NO: 174180 - DNA, 16 bp, H. sapiens
tttgtagttgtccttg

SEQ ID NO: 174181 - DNA, 16 bp, H. sapiens
tttgtagttttccttg

SEQ ID NO: 174182 - DNA, 16 bp, H. sapiens
tttgtataaatagaat

SEQ ID NO: 174183 - DNA, 16 bp, H. sapiens
tttgtatacaaatata

SEQ ID NO: 174184 - DNA, 16 bp, H. sapiens
tttgtatacccatgtt

SEQ ID NO: 174185 - DNA, 16 bp, H. sapiens
tttgtatagcttttta

SEQ ID NO: 174186 - DNA, 16 bp, H. sapiens
tttgtatatacacata

SEQ ID NO: 174187 - DNA, 16 bp, H. sapiens
tttgtatatacatata

SEQ ID NO: 174188 - DNA, 16 bp, H. sapiens
tttgtatatatacata

SEQ ID NO: 174189 - DNA, 16 bp, H. sapiens
tttgtatatcctttgt

SEQ ID NO: 174190 - DNA, 16 bp, H. sapiens
tttgtatatgtaaaat

SEQ ID NO: 174191 - DNA, 16 bp, H. sapiens
tttgtatattaacttt

SEQ ID NO: 174192 - DNA, 16 bp, H. sapiens
tttgtatcagtatcat

SEQ ID NO: 174193 - DNA, 16 bp, H. sapiens
tttgtatccatgtgta

SEQ ID NO: 174194 - DNA, 16 bp, H. sapiens
tttgtatcctgtttta

SEQ ID NO: 174195 - DNA, 16 bp, H. sapiens
tttgtatccttcaatc

SEQ ID NO: 174196 - DNA, 16 bp, H. sapiens
tttgtatctctgtgtc

SEQ ID NO: 174197 - DNA, 16 bp, H. sapiens
tttgtatctttggtag

SEQ ID NO: 174198 - DNA, 16 bp, H. sapiens
tttgtatcttttgtag

SEQ ID NO: 174199 - DNA, 16 bp, H. sapiens
tttgtatgacttgaat

SEQ ID NO: 174200 - DNA, 17 bp, H. sapiens
tttgtatgaggtcacaa

SEQ ID NO: 174201 - DNA, 16 bp, H. sapiens
tttgtatgatactata

SEQ ID NO: 174202 - DNA, 16 bp, H. sapiens
tttgtatgccacagaa

SEQ ID NO: 174203 - DNA, 16 bp, H. sapiens
tttgtatggaaaatgt

SEQ ID NO: 174204 - DNA, 16 bp, H. sapiens
tttgtatggtttttca

SEQ ID NO: 174205 - DNA, 16 bp, H. sapiens
tttgtatgtagaaaat

SEQ ID NO: 174206 - DNA, 16 bp, H. sapiens
tttgtatgtataaaat

SEQ ID NO: 174207 - DNA, 16 bp, H. sapiens
tttgtatgtatgtgta

SEQ ID NO: 174208 - DNA, 16 bp, H. sapiens
tttgtatgtcatcttt

SEQ ID NO: 174209 - DNA, 16 bp, H. sapiens
tttgtatgtctgtggg

SEQ ID NO: 174210 - DNA, 16 bp, H. sapiens
tttgtattcagcaaaa

SEQ ID NO: 174211 - DNA, 16 bp, H. sapiens
tttgtattcagcagtt

SEQ ID NO: 174212 - DNA, 16 bp, H. sapiens
tttgtattcagtgaaa

SEQ ID NO: 174213 - DNA, 16 bp, H. sapiens
tttgtattcttataaa

SEQ ID NO: 174214 - DNA, 16 bp, H. sapiens
tttgtatttatttaca

SEQ ID NO: 174215 - DNA, 16 bp, H. sapiens
tttgtatttgctaaat

SEQ ID NO: 174216 - DNA, 16 bp, H. sapiens
tttgtatttgtagtaa

SEQ ID NO: 174217 - DNA, 16 bp, H. sapiens
tttgtattttcaagaa

SEQ ID NO: 174218 - DNA, 16 bp, H. sapiens
tttgtattttgagaaa

SEQ ID NO: 174219 - DNA, 16 bp, H. sapiens
tttgtattttgtaaca

SEQ ID NO: 174220 - DNA, 16 bp, H. sapiens
tttgtatttttacaaa

SEQ ID NO: 174221 - DNA, 16 bp, H. sapiens
tttgtatttttctaga

SEQ ID NO: 174222 - DNA, 16 bp, H. sapiens
tttgtatttttgtaca

SEQ ID NO: 174223 - DNA, 16 bp, H. sapiens
tttgtattttttacag

SEQ ID NO: 174224 - DNA, 16 bp, H. sapiens
tttgtcaaaactcact

SEQ ID NO: 174225 - DNA, 16 bp, H. sapiens
tttgtcaaaactcata

SEQ ID NO: 174226 - DNA, 16 bp, H. sapiens
tttgtcaaaatatttt

SEQ ID NO: 174227 - DNA, 16 bp, H. sapiens
tttgtcaaagccattt

SEQ ID NO: 174228 - DNA, 16 bp, H. sapiens
tttgtcaaataaatga

SEQ ID NO: 174229 - DNA, 16 bp, H. sapiens
tttgtcaagatcagat

SEQ ID NO: 174230 - DNA, 16 bp, H. sapiens
tttgtcaataaagttt

SEQ ID NO: 174231 - DNA, 16 bp, H. sapiens
tttgtcaatattggct

SEQ ID NO: 174232 - DNA, 16 bp, H. sapiens
tttgtcaatgtttgct

SEQ ID NO: 174233 - DNA, 16 bp, H. sapiens
tttgtcaattaaaaaa

SEQ ID NO: 174234 - DNA, 16 bp, H. sapiens
tttgtcaattatacct

SEQ ID NO: 174235 - DNA, 16 bp, H. sapiens
tttgtcaatttaaaat

SEQ ID NO: 174236 - DNA, 16 bp, H. sapiens
tttgtcacagttctgg

SEQ ID NO: 174237 - DNA, 21 bp, H. sapiens
tttgtcacccaggctggagta

SEQ ID NO: 174238 - DNA, 16 bp, H. sapiens
tttgtcacccagggtg

SEQ ID NO: 174239 - DNA, 16 bp, H. sapiens
tttgtcacctttgtca

SEQ ID NO: 174240 - DNA, 16 bp, H. sapiens
tttgtcagaaaaataa

SEQ ID NO: 174241 - DNA, 16 bp, H. sapiens
tttgtcagaattcttc

SEQ ID NO: 174242 - DNA, 16 bp, H. sapiens
tttgtcagttgtcttt

SEQ ID NO: 174243 - DNA, 16 bp, H. sapiens
tttgtcagttttatct

SEQ ID NO: 174244 - DNA, 17 bp, H. sapiens
tttgtcagttttggctt

SEQ ID NO: 174245 - DNA, 16 bp, H. sapiens
tttgtcataaatatct

SEQ ID NO: 174246 - DNA, 16 bp, H. sapiens
tttgtcatctttaaaa

SEQ ID NO: 174247 - DNA, 16 bp, H. sapiens
tttgtcatgaaatttt

SEQ ID NO: 174248 - DNA, 16 bp, H. sapiens
tttgtcattcattctg

SEQ ID NO: 174249 - DNA, 16 bp, H. sapiens
tttgtcattgttgttg

SEQ ID NO: 174250 - DNA, 16 bp, H. sapiens
tttgtcatttaaaaaa

SEQ ID NO: 174251 - DNA, 16 bp, H. sapiens
tttgtcatttattcat

SEQ ID NO: 174252 - DNA, 16 bp, H. sapiens
tttgtcattttgaaat

SEQ ID NO: 174253 - DNA, 16 bp, H. sapiens
tttgtccaagttcaca

SEQ ID NO: 174254 - DNA, 16 bp, H. sapiens
tttgtccagtgctttt

SEQ ID NO: 174255 - DNA, 16 bp, H. sapiens
tttgtccatattttaa

SEQ ID NO: 174256 - DNA, 16 bp, H. sapiens
tttgtccatccatcca

SEQ ID NO: 174257 - DNA, 16 bp, H. sapiens
tttgtccatctcttct

SEQ ID NO: 174258 - DNA, 16 bp, H. sapiens
tttgtccattaaaaaa

SEQ ID NO: 174259 - DNA, 16 bp, H. sapiens
tttgtccatttaaaaa

SEQ ID NO: 174260 - DNA, 16 bp, H. sapiens
tttgtccattttaaaa

SEQ ID NO: 174261 - DNA, 16 bp, H. sapiens
tttgtccattttatat

SEQ ID NO: 174262 - DNA, 16 bp, H. sapiens
tttgtcccagaggggc

SEQ ID NO: 174263 - DNA, 16 bp, H. sapiens
tttgtcccatgaggtg

SEQ ID NO: 174264 - DNA, 16 bp, H. sapiens
tttgtcctctcttatt

SEQ ID NO: 174265 - DNA, 16 bp, H. sapiens
tttgtccttctgtgac

SEQ ID NO: 174266 - DNA, 16 bp, H. sapiens
tttgtcctttaaaaaa

SEQ ID NO: 174267 - DNA, 17 bp, H. sapiens
tttgtcgcccaggctgg

SEQ ID NO: 174268 - DNA, 16 bp, H. sapiens
tttgtctaattcagaa

SEQ ID NO: 174269 - DNA, 16 bp, H. sapiens
tttgtctatttgggct

SEQ ID NO: 174270 - DNA, 16 bp, H. sapiens
tttgtctcaaaaaata

SEQ ID NO: 174271 - DNA, 16 bp, H. sapiens
tttgtctcaaaatttt

SEQ ID NO: 174272 - DNA, 16 bp, H. sapiens
tttgtctcaataaata

SEQ ID NO: 174273 - DNA, 16 bp, H. sapiens
tttgtctcagataaga

SEQ ID NO: 174274 - DNA, 16 bp, H. sapiens
tttgtctcaggaaaaa

SEQ ID NO: 174275 - DNA, 16 bp, H. sapiens
tttgtctcccaggctg

SEQ ID NO: 174276 - DNA, 16 bp, H. sapiens
tttgtctctctgtgct

SEQ ID NO: 174277 - DNA, 16 bp, H. sapiens
tttgtctctgccaggt

SEQ ID NO: 174278 - DNA, 16 bp, H. sapiens
tttgtctctgtagatt

SEQ ID NO: 174279 - DNA, 16 bp, H. sapiens
tttgtctcttaatgca

SEQ ID NO: 174280 - DNA, 16 bp, H. sapiens
tttgtctcttccagaa

SEQ ID NO: 174281 - DNA, 16 bp, H. sapiens
tttgtctgaaaaaata

SEQ ID NO: 174282 - DNA, 16 bp, H. sapiens
tttgtctgaaaaagat

SEQ ID NO: 174283 - DNA, 16 bp, H. sapiens
tttgtctgaagttttt

SEQ ID NO: 174284 - DNA, 16 bp, H. sapiens
tttgtctgatattact

SEQ ID NO: 174285 - DNA, 16 bp, H. sapiens
tttgtctgcattttct

SEQ ID NO: 174286 - DNA, 16 bp, H. sapiens
tttgtctgcttttgaa

SEQ ID NO: 174287 - DNA, 17 bp, H. sapiens
tttgtctgtaaaatgga

SEQ ID NO: 174288 - DNA, 16 bp, H. sapiens
tttgtctgtgttatct

SEQ ID NO: 174289 - DNA, 16 bp, H. sapiens
tttgtctgtttcatct

SEQ ID NO: 174290 - DNA, 16 bp, H. sapiens
tttgtcttcaaatatt

SEQ ID NO: 174291 - DNA, 16 bp, H. sapiens
tttgtcttcagtttct

SEQ ID NO: 174292 - DNA, 16 bp, H. sapiens
tttgtcttccagctat

SEQ ID NO: 174293 - DNA, 16 bp, H. sapiens
tttgtcttgcaccttg

SEQ ID NO: 174294 - DNA, 16 bp, H. sapiens
tttgtcttgcagcttg

SEQ ID NO: 174295 - DNA, 16 bp, H. sapiens
tttgtcttggccaatt

SEQ ID NO: 174296 - DNA, 16 bp, H. sapiens
tttgtcttgtatccaa

SEQ ID NO: 174297 - DNA, 16 bp, H. sapiens
tttgtctttaaatgtt

SEQ ID NO: 174298 - DNA, 16 bp, H. sapiens
tttgtctttgttagat

SEQ ID NO: 174299 - DNA, 16 bp, H. sapiens
tttgtcttttaaaatt

SEQ ID NO: 174300 - DNA, 16 bp, H. sapiens
tttgtcttttctacct

SEQ ID NO: 174301 - DNA, 16 bp, H. sapiens
tttgtctttttaaaat

SEQ ID NO: 174302 - DNA, 16 bp, H. sapiens
tttgtctttttcagaa

SEQ ID NO: 174303 - DNA, 16 bp, H. sapiens
tttgtctttttgatag

SEQ ID NO: 174304 - DNA, 16 bp, H. sapiens
tttgtgaaaaataagt

SEQ ID NO: 174305 - DNA, 16 bp, H. sapiens
tttgtgaaactgcttt

SEQ ID NO: 174306 - DNA, 16 bp, H. sapiens
tttgtgaaagaaaaaa

SEQ ID NO: 174307 - DNA, 16 bp, H. sapiens
tttgtgaaatgaaaat

SEQ ID NO: 174308 - DNA, 16 bp, H. sapiens
tttgtgaaatgagaat

SEQ ID NO: 174309 - DNA, 16 bp, H. sapiens
tttgtgaaattccttc

SEQ ID NO: 174310 - DNA, 16 bp, H. sapiens
tttgtgaacatatttt

SEQ ID NO: 174311 - DNA, 16 bp, H. sapiens
tttgtgaagatatttc

SEQ ID NO: 174312 - DNA, 16 bp, H. sapiens
tttgtgaagattaaat

SEQ ID NO: 174313 - DNA, 16 bp, H. sapiens
tttgtgaaggtgattt

SEQ ID NO: 174314 - DNA, 16 bp, H. sapiens
tttgtgaagtgtggat

SEQ ID NO: 174315 - DNA, 16 bp, H. sapiens
tttgtgaagtttaaat

SEQ ID NO: 174316 - DNA, 16 bp, H. sapiens
tttgtgaataaaattt

SEQ ID NO: 174317 - DNA, 16 bp, H. sapiens
tttgtgaatatataaa

SEQ ID NO: 174318 - DNA, 16 bp, H. sapiens
tttgtgaatatttttc

SEQ ID NO: 174319 - DNA, 16 bp, H. sapiens
tttgtgaatgaaaaaa

SEQ ID NO: 174320 - DNA, 16 bp, H. sapiens
tttgtgaatgaataaa

SEQ ID NO: 174321 - DNA, 16 bp, H. sapiens
tttgtgaattaaaaat

SEQ ID NO: 174322 - DNA, 16 bp, H. sapiens
tttgtgaattgtgctg

SEQ ID NO: 174323 - DNA, 16 bp, H. sapiens
tttgtgaattttctaa

SEQ ID NO: 174324 - DNA, 16 bp, H. sapiens
tttgtgacaacattga

SEQ ID NO: 174325 - DNA, 16 bp, H. sapiens
tttgtgacagagtttt

SEQ ID NO: 174326 - DNA, 16 bp, H. sapiens
tttgtgaccttggatt

SEQ ID NO: 174327 - DNA, 16 bp, H. sapiens
tttgtgactttggaaa

SEQ ID NO: 174328 - DNA, 16 bp, H. sapiens
tttgtgactttttaaa

SEQ ID NO: 174329 - DNA, 16 bp, H. sapiens
tttgtgagcactttga

SEQ ID NO: 174330 - DNA, 16 bp, H. sapiens
tttgtgaggaaaaaaa

SEQ ID NO: 174331 - DNA, 16 bp, H. sapiens
tttgtgaggaaaaaat

SEQ ID NO: 174332 - DNA, 16 bp, H. sapiens
tttgtgaggccgaggc

SEQ ID NO: 174333 - DNA, 16 bp, H. sapiens
tttgtgagtttttaaa

SEQ ID NO: 174334 - DNA, 16 bp, H. sapiens
tttgtgataaaatatt

SEQ ID NO: 174335 - DNA, 16 bp, H. sapiens
tttgtgatcagcctgg

SEQ ID NO: 174336 - DNA, 16 bp, H. sapiens
tttgtgatcagtgatc

SEQ ID NO: 174337 - DNA, 16 bp, H. sapiens
tttgtgatgaaaacac

SEQ ID NO: 174338 - DNA, 16 bp, H. sapiens
tttgtgatgtgaaaat

SEQ ID NO: 174339 - DNA, 16 bp, H. sapiens
tttgtgatgtttgctt

SEQ ID NO: 174340 - DNA, 16 bp, H. sapiens
tttgtgcacacacaca

SEQ ID NO: 174341 - DNA, 16 bp, H. sapiens
tttgtgcagaggtgtt

SEQ ID NO: 174342 - DNA, 16 bp, H. sapiens
tttgtgcatatatata

SEQ ID NO: 174343 - DNA, 16 bp, H. sapiens
tttgtgcatcttcttt

SEQ ID NO: 174344 - DNA, 16 bp, H. sapiens
tttgtgcatgtttgtg

SEQ ID NO: 174345 - DNA, 16 bp, H. sapiens
tttgtgctatgaattt

SEQ ID NO: 174346 - DNA, 16 bp, H. sapiens
tttgtgctgggaacat

SEQ ID NO: 174347 - DNA, 16 bp, H. sapiens
tttgtgcttccaaatc

SEQ ID NO: 174348 - DNA, 16 bp, H. sapiens
tttgtggaaaaatgga

SEQ ID NO: 174349 - DNA, 16 bp, H. sapiens
tttgtggaaaaggaaa

SEQ ID NO: 174350 - DNA, 16 bp, H. sapiens
tttgtggaaagatttt

SEQ ID NO: 174351 - DNA, 16 bp, H. sapiens
tttgtggaaaggtttt

SEQ ID NO: 174352 - DNA, 16 bp, H. sapiens
tttgtggaaataattt

SEQ ID NO: 174353 - DNA, 16 bp, H. sapiens
tttgtggaagaaaatt

SEQ ID NO: 174354 - DNA, 16 bp, H. sapiens
tttgtggaagattttt

SEQ ID NO: 174355 - DNA, 16 bp, H. sapiens
tttgtggaatctttag

SEQ ID NO: 174356 - DNA, 16 bp, H. sapiens
tttgtggacatgtttt

SEQ ID NO: 174357 - DNA, 16 bp, H. sapiens
tttgtggagacagggc

SEQ ID NO: 174358 - DNA, 16 bp, H. sapiens
tttgtggatgagaaaa

SEQ ID NO: 174359 - DNA, 16 bp, H. sapiens
tttgtggatgaggaaa

SEQ ID NO: 174360 - DNA, 16 bp, H. sapiens
tttgtggccttgggca

SEQ ID NO: 174361 - DNA, 25 bp, H. sapiens
tttgtggctgacttggtacagaaga

SEQ ID NO: 174362 - DNA, 16 bp, H. sapiens
tttgtgggacacagct

SEQ ID NO: 174363 - DNA, 16 bp, H. sapiens
tttgtgggactgtaaa

SEQ ID NO: 174364 - DNA, 16 bp, H. sapiens
tttgtgggactgttgg

SEQ ID NO: 174365 - DNA, 16 bp, H. sapiens
tttgtggggaaaaaaa

SEQ ID NO: 174366 - DNA, 16 bp, H. sapiens
tttgtggggaaaagaa

SEQ ID NO: 174367 - DNA, 16 bp, H. sapiens
tttgtgggggaaaaaa

SEQ ID NO: 174368 - DNA, 16 bp, H. sapiens
tttgtggtagcaggtg

SEQ ID NO: 174369 - DNA, 16 bp, H. sapiens
tttgtggtgatggaaa

SEQ ID NO: 174370 - DNA, 16 bp, H. sapiens
tttgtggtgcagaagc

SEQ ID NO: 174371 - DNA, 16 bp, H. sapiens
tttgtggtttaagaat

SEQ ID NO: 174372 - DNA, 16 bp, H. sapiens
tttgtggtttcatatg

SEQ ID NO: 174373 - DNA, 16 bp, H. sapiens
tttgtggttttcagtg

SEQ ID NO: 174374 - DNA, 16 bp, H. sapiens
tttgtggttttcctca

SEQ ID NO: 174375 - DNA, 16 bp, H. sapiens
tttgtgtaaaatatat

SEQ ID NO: 174376 - DNA, 16 bp, H. sapiens
tttgtgtaaatatgtt

SEQ ID NO: 174377 - DNA, 16 bp, H. sapiens
tttgtgtaagaacact

SEQ ID NO: 174378 - DNA, 16 bp, H. sapiens
tttgtgtataaaaatg

SEQ ID NO: 174379 - DNA, 16 bp, H. sapiens
tttgtgtatccattca

SEQ ID NO: 174380 - DNA, 16 bp, H. sapiens
tttgtgtatctaaaca

SEQ ID NO: 174381 - DNA, 16 bp, H. sapiens
tttgtgtatcttttca

SEQ ID NO: 174382 - DNA, 16 bp, H. sapiens
tttgtgtatgtttaaa

SEQ ID NO: 174383 - DNA, 16 bp, H. sapiens
tttgtgtatttaaaaa

SEQ ID NO: 174384 - DNA, 16 bp, H. sapiens
tttgtgtatttacata

SEQ ID NO: 174385 - DNA, 16 bp, H. sapiens
tttgtgtcataatctt

SEQ ID NO: 174386 - DNA, 16 bp, H. sapiens
tttgtgtccatactct

SEQ ID NO: 174387 - DNA, 47 bp, H. sapiens
tttgtgtccctgggtacttgagattagggagtggtgatgactcttaa

SEQ ID NO: 174388 - DNA, 16 bp, H. sapiens
tttgtgtcctctttta

SEQ ID NO: 174389 - DNA, 16 bp, H. sapiens
tttgtgtcctttgacc

SEQ ID NO: 174390 - DNA, 16 bp, H. sapiens
tttgtgtctatttcct

SEQ ID NO: 174391 - DNA, 16 bp, H. sapiens
tttgtgtctctgtctc

SEQ ID NO: 174392 - DNA, 16 bp, H. sapiens
tttgtgtctctgtgtc

SEQ ID NO: 174393 - DNA, 16 bp, H. sapiens
tttgtgtctggcatct

SEQ ID NO: 174394 - DNA, 16 bp, H. sapiens
tttgtgtctgtgtgta

SEQ ID NO: 174395 - DNA, 16 bp, H. sapiens
tttgtgtctgtgttca

SEQ ID NO: 174396 - DNA, 16 bp, H. sapiens
tttgtgtcttaggttt

SEQ ID NO: 174397 - DNA, 16 bp, H. sapiens
tttgtgtcttggagtt

SEQ ID NO: 174398 - DNA, 16 bp, H. sapiens
tttgtgtcttttaaat

SEQ ID NO: 174399 - DNA, 16 bp, H. sapiens
tttgtgtctttttaaa

SEQ ID NO: 174400 - DNA, 16 bp, H. sapiens
tttgtgtgaacctaag

SEQ ID NO: 174401 - DNA, 16 bp, H. sapiens
tttgtgtgcacacatg

SEQ ID NO: 174402 - DNA, 16 bp, H. sapiens
tttgtgtgcatttgtg

SEQ ID NO: 174403 - DNA, 16 bp, H. sapiens
tttgtgtgctgatttt

SEQ ID NO: 174404 - DNA, 16 bp, H. sapiens
tttgtgtgtacatagt

SEQ ID NO: 174405 - DNA, 16 bp, H. sapiens
tttgtgtgtgagacag

SEQ ID NO: 174406 - DNA, 16 bp, H. sapiens
tttgtgtgtgtagagg

SEQ ID NO: 174407 - DNA, 16 bp, H. sapiens
tttgtgtgtgtggaaa

SEQ ID NO: 174408 - DNA, 16 bp, H. sapiens
tttgtgtgtgtgtcca

SEQ ID NO: 174409 - DNA, 16 bp, H. sapiens
tttgtgtgtgtgtgaa

SEQ ID NO: 174410 - DNA, 16 bp, H. sapiens
tttgtgtgtgtgtgcc

SEQ ID NO: 174411 - DNA, 16 bp, H. sapiens
tttgtgtgtgttttca

SEQ ID NO: 174412 - DNA, 16 bp, H. sapiens
tttgtgttatctgtga

SEQ ID NO: 174413 - DNA, 16 bp, H. sapiens
tttgtgttccctcaaa

SEQ ID NO: 174414 - DNA, 16 bp, H. sapiens
tttgtgttcctccaaa

SEQ ID NO: 174415 - DNA, 16 bp, H. sapiens
tttgtgttgagaacat

SEQ ID NO: 174416 - DNA, 16 bp, H. sapiens
tttgtgttgctataaa

SEQ ID NO: 174417 - DNA, 16 bp, H. sapiens
tttgtgttgggcctca

SEQ ID NO: 174418 - DNA, 16 bp, H. sapiens
tttgtgttgtgagagg

SEQ ID NO: 174419 - DNA, 16 bp, H. sapiens
tttgtgttgtttccac

SEQ ID NO: 174420 - DNA, 16 bp, H. sapiens
tttgtgtttacattta

SEQ ID NO: 174421 - DNA, 16 bp, H. sapiens
tttgtgtttgagacag

SEQ ID NO: 174422 - DNA, 16 bp, H. sapiens
tttgtgtttgtaaaat

SEQ ID NO: 174423 - DNA, 16 bp, H. sapiens
tttgtgtttgtctgat

SEQ ID NO: 174424 - DNA, 16 bp, H. sapiens
tttgtgttttaaaaaa

SEQ ID NO: 174425 - DNA, 16 bp, H. sapiens
tttgtgttttggaaag

SEQ ID NO: 174426 - DNA, 16 bp, H. sapiens
tttgttaaaaataaac

SEQ ID NO: 174427 - DNA, 16 bp, H. sapiens
tttgttaaaaggaaaa

SEQ ID NO: 174428 - DNA, 16 bp, H. sapiens
tttgttaaaatggtat

SEQ ID NO: 174429 - DNA, 16 bp, H. sapiens
tttgttaaacttatct

SEQ ID NO: 174430 - DNA, 16 bp, H. sapiens
tttgttaaacttattt

SEQ ID NO: 174431 - DNA, 16 bp, H. sapiens
tttgttaaagaataca

SEQ ID NO: 174432 - DNA, 16 bp, H. sapiens
tttgttaaataaaatg

SEQ ID NO: 174433 - DNA, 16 bp, H. sapiens
tttgttaatattttgc

SEQ ID NO: 174434 - DNA, 18 bp, H. sapiens
tttgttaatgattggcaa

SEQ ID NO: 174435 - DNA, 16 bp, H. sapiens
tttgttaattcattta

SEQ ID NO: 174436 - DNA, 16 bp, H. sapiens
tttgttaatttactta

SEQ ID NO: 174437 - DNA, 16 bp, H. sapiens
tttgttacacagcagt

SEQ ID NO: 174438 - DNA, 16 bp, H. sapiens
tttgttacagtagcca

SEQ ID NO: 174439 - DNA, 19 bp, H. sapiens
tttgttacataggtaaaca

SEQ ID NO: 174440 - DNA, 18 bp, H. sapiens
tttgttacataggtaaat

SEQ ID NO: 174441 - DNA, 16 bp, H. sapiens
tttgttacatgtatag

SEQ ID NO: 174442 - DNA, 16 bp, H. sapiens
tttgttacctctgtgg

SEQ ID NO: 174443 - DNA, 16 bp, H. sapiens
tttgttactgattcaa

SEQ ID NO: 174444 - DNA, 16 bp, H. sapiens
tttgttagaaaaaaat

SEQ ID NO: 174445 - DNA, 16 bp, H. sapiens
tttgttagaaaagaaa

SEQ ID NO: 174446 - DNA, 16 bp, H. sapiens
tttgttatacatatta

SEQ ID NO: 174447 - DNA, 16 bp, H. sapiens
tttgttatagcagctt

SEQ ID NO: 174448 - DNA, 16 bp, H. sapiens
tttgttatctgtaaaa

SEQ ID NO: 174449 - DNA, 16 bp, H. sapiens
tttgttatgtagataa

SEQ ID NO: 174450 - DNA, 16 bp, H. sapiens
tttgttattatttcag

SEQ ID NO: 174451 - DNA, 16 bp, H. sapiens
tttgttcactcattta

SEQ ID NO: 174452 - DNA, 16 bp, H. sapiens
tttgttcactgttata

SEQ ID NO: 174453 - DNA, 16 bp, H. sapiens
tttgttcactttttaa

SEQ ID NO: 174454 - DNA, 16 bp, H. sapiens
tttgttcagaaaaaaa

SEQ ID NO: 174455 - DNA, 16 bp, H. sapiens
tttgttcagcattttt

SEQ ID NO: 174456 - DNA, 16 bp, H. sapiens
tttgttcaggctggtc

SEQ ID NO: 174457 - DNA, 16 bp, H. sapiens
tttgttcagggctcag

SEQ ID NO: 174458 - DNA, 16 bp, H. sapiens
tttgttcatatattat

SEQ ID NO: 174459 - DNA, 16 bp, H. sapiens
tttgttcattttcaaa

SEQ ID NO: 174460 - DNA, 16 bp, H. sapiens
tttgttcatttttaaa

SEQ ID NO: 174461 - DNA, 16 bp, H. sapiens
tttgttccactgctgg

SEQ ID NO: 174462 - DNA, 16 bp, H. sapiens
tttgttccagttccca

SEQ ID NO: 174463 - DNA, 16 bp, H. sapiens
tttgttccattttatg

SEQ ID NO: 174464 - DNA, 16 bp, H. sapiens
tttgttcccagtttca

SEQ ID NO: 174465 - DNA, 27 bp, H. sapiens
tttgttcctcagggttttcagggacaa

SEQ ID NO: 174466 - DNA, 17 bp, H. sapiens
tttgttccttcagatgt

SEQ ID NO: 174467 - DNA, 16 bp, H. sapiens
tttgttcctttaaaaa

SEQ ID NO: 174468 - DNA, 16 bp, H. sapiens
tttgttcgtttttgag

SEQ ID NO: 174469 - DNA, 16 bp, H. sapiens
tttgttctacttgggt

SEQ ID NO: 174470 - DNA, 16 bp, H. sapiens
tttgttctattaaggc

SEQ ID NO: 174471 - DNA, 16 bp, H. sapiens
tttgttctctcacagt

SEQ ID NO: 174472 - DNA, 16 bp, H. sapiens
tttgttctctttgaag

SEQ ID NO: 174473 - DNA, 16 bp, H. sapiens
tttgttctgggatgca

SEQ ID NO: 174474 - DNA, 16 bp, H. sapiens
tttgttctgttaatgt

SEQ ID NO: 174475 - DNA, 16 bp, H. sapiens
tttgttcttaaaaata

SEQ ID NO: 174476 - DNA, 16 bp, H. sapiens
tttgttctttaaaaaa

SEQ ID NO: 174477 - DNA, 16 bp, H. sapiens
tttgttcttttagctc

SEQ ID NO: 174478 - DNA, 16 bp, H. sapiens
tttgttctttttaaaa

SEQ ID NO: 174479 - DNA, 16 bp, H. sapiens
tttgttgaaaaaaatt

SEQ ID NO: 174480 - DNA, 16 bp, H. sapiens
tttgttgaaaaaatga

SEQ ID NO: 174481 - DNA, 16 bp, H. sapiens
tttgttgaaaacaaaa

SEQ ID NO: 174482 - DNA, 17 bp, H. sapiens
tttgttgaaaatgagtt

SEQ ID NO: 174483 - DNA, 16 bp, H. sapiens
tttgttgaaagaaaaa

SEQ ID NO: 174484 - DNA, 16 bp, H. sapiens
tttgttgaaatataat

SEQ ID NO: 174485 - DNA, 16 bp, H. sapiens
tttgttgaaattctca

SEQ ID NO: 174486 - DNA, 16 bp, H. sapiens
tttgttgaaattgctt

SEQ ID NO: 174487 - DNA, 16 bp, H. sapiens
tttgttgaagaaaaaa

SEQ ID NO: 174488 - DNA, 16 bp, H. sapiens
tttgttgaagaaacca

SEQ ID NO: 174489 - DNA, 16 bp, H. sapiens
tttgttgaagatcaat

SEQ ID NO: 174490 - DNA, 16 bp, H. sapiens
tttgttgaagttgctt

SEQ ID NO: 174491 - DNA, 16 bp, H. sapiens
tttgttgaatatttct

SEQ ID NO: 174492 - DNA, 16 bp, H. sapiens
tttgttgaatgaaaaa

SEQ ID NO: 174493 - DNA, 16 bp, H. sapiens
tttgttgaatgaataa

SEQ ID NO: 174494 - DNA, 16 bp, H. sapiens
tttgttgagaaaaaaa

SEQ ID NO: 174495 - DNA, 16 bp, H. sapiens
tttgttgagaattgtt

SEQ ID NO: 174496 - DNA, 16 bp, H. sapiens
tttgttgatattttgc

SEQ ID NO: 174497 - DNA, 16 bp, H. sapiens
tttgttgatctgttca

SEQ ID NO: 174498 - DNA, 16 bp, H. sapiens
tttgttgatcttttaa

SEQ ID NO: 174499 - DNA, 16 bp, H. sapiens
tttgttgcaattgttt

SEQ ID NO: 174500 - DNA, 16 bp, H. sapiens
tttgttgcagttgttt

SEQ ID NO: 174501 - DNA, 16 bp, H. sapiens
tttgttgccagtgctt

SEQ ID NO: 174502 - DNA, 16 bp, H. sapiens
tttgttgcccaagctg

SEQ ID NO: 174503 - DNA, 16 bp, H. sapiens
tttgttgcccaggctg

SEQ ID NO: 174504 - DNA, 16 bp, H. sapiens
tttgttgcctgtattt

SEQ ID NO: 174505 - DNA, 16 bp, H. sapiens
tttgttgctattgtta

SEQ ID NO: 174506 - DNA, 16 bp, H. sapiens
tttgttgctgctgctg

SEQ ID NO: 174507 - DNA, 16 bp, H. sapiens
tttgttgcttagaaat

SEQ ID NO: 174508 - DNA, 16 bp, H. sapiens
tttgttggcataaaat

SEQ ID NO: 174509 - DNA, 16 bp, H. sapiens
tttgttggcatacagt

SEQ ID NO: 174510 - DNA, 16 bp, H. sapiens
tttgttggctacttgt

SEQ ID NO: 174511 - DNA, 16 bp, H. sapiens
tttgttggttttaaaa

SEQ ID NO: 174512 - DNA, 16 bp, H. sapiens
tttgttgtatatggct

SEQ ID NO: 174513 - DNA, 22 bp, H. sapiens
tttgttgtcccctgcttgagga

SEQ ID NO: 174514 - DNA, 16 bp, H. sapiens
tttgttgtctgtctcc

SEQ ID NO: 174515 - DNA, 16 bp, H. sapiens
tttgttgtgagaacat

SEQ ID NO: 174516 - DNA, 16 bp, H. sapiens
tttgttgttgctgtta

SEQ ID NO: 174517 - DNA, 16 bp, H. sapiens
tttgtttaaaaaattc

SEQ ID NO: 174518 - DNA, 16 bp, H. sapiens
tttgtttaaaaacaaa

SEQ ID NO: 174519 - DNA, 16 bp, H. sapiens
tttgtttaaaaatgaa

SEQ ID NO: 174520 - DNA, 16 bp, H. sapiens
tttgtttaaaacaaaa

SEQ ID NO: 174521 - DNA, 16 bp, H. sapiens
tttgtttaaaacatta

SEQ ID NO: 174522 - DNA, 16 bp, H. sapiens
tttgtttaagttcttg

SEQ ID NO: 174523 - DNA, 16 bp, H. sapiens
tttgtttaatgaatga

SEQ ID NO: 174524 - DNA, 16 bp, H. sapiens
tttgtttacactatga

SEQ ID NO: 174525 - DNA, 16 bp, H. sapiens
tttgtttacactgtga

SEQ ID NO: 174526 - DNA, 16 bp, H. sapiens
tttgtttacatattaa

SEQ ID NO: 174527 - DNA, 16 bp, H. sapiens
tttgtttacatgttta

SEQ ID NO: 174528 - DNA, 16 bp, H. sapiens
tttgtttacattaaaa

SEQ ID NO: 174529 - DNA, 16 bp, H. sapiens
tttgtttactcattca

SEQ ID NO: 174530 - DNA, 16 bp, H. sapiens
tttgtttatcaattca

SEQ ID NO: 174531 - DNA, 16 bp, H. sapiens
tttgtttatccattca

SEQ ID NO: 174532 - DNA, 16 bp, H. sapiens
tttgtttatccattct

SEQ ID NO: 174533 - DNA, 16 bp, H. sapiens
tttgtttatctattga

SEQ ID NO: 174534 - DNA, 16 bp, H. sapiens
tttgtttattcaacaa

SEQ ID NO: 174535 - DNA, 16 bp, H. sapiens
tttgtttatttaaaca

SEQ ID NO: 174536 - DNA, 16 bp, H. sapiens
tttgtttatttctaaa

SEQ ID NO: 174537 - DNA, 16 bp, H. sapiens
tttgtttcaaaaaata

SEQ ID NO: 174538 - DNA, 16 bp, H. sapiens
tttgtttcaaaagaaa

SEQ ID NO: 174539 - DNA, 16 bp, H. sapiens
tttgtttcaaaatatt

SEQ ID NO: 174540 - DNA, 16 bp, H. sapiens
tttgtttcaaagaatt

SEQ ID NO: 174541 - DNA, 16 bp, H. sapiens
tttgtttcaaatgaaa

SEQ ID NO: 174542 - DNA, 16 bp, H. sapiens
tttgtttcaagatatt

SEQ ID NO: 174543 - DNA, 16 bp, H. sapiens
tttgtttcaatttaat

SEQ ID NO: 174544 - DNA, 16 bp, H. sapiens
tttgtttcatatgaat

SEQ ID NO: 174545 - DNA, 16 bp, H. sapiens
tttgtttcattaaaaa

SEQ ID NO: 174546 - DNA, 16 bp, H. sapiens
tttgtttccagaaatt

SEQ ID NO: 174547 - DNA, 16 bp, H. sapiens
tttgtttccaggaatt

SEQ ID NO: 174548 - DNA, 16 bp, H. sapiens
tttgtttcccatctct

SEQ ID NO: 174549 - DNA, 16 bp, H. sapiens
tttgtttcctaaaata

SEQ ID NO: 174550 - DNA, 16 bp, H. sapiens
tttgtttcctctgact

SEQ ID NO: 174551 - DNA, 16 bp, H. sapiens
tttgtttcctgtttca

SEQ ID NO: 174552 - DNA, 16 bp, H. sapiens
tttgtttcctttggat

SEQ ID NO: 174553 - DNA, 16 bp, H. sapiens
tttgtttctaataaaa

SEQ ID NO: 174554 - DNA, 16 bp, H. sapiens
tttgtttctatttcaa

SEQ ID NO: 174555 - DNA, 16 bp, H. sapiens
tttgtttctcaaattt

SEQ ID NO: 174556 - DNA, 16 bp, H. sapiens
tttgtttctcagtttc

SEQ ID NO: 174557 - DNA, 16 bp, H. sapiens
tttgtttctccattta

SEQ ID NO: 174558 - DNA, 16 bp, H. sapiens
tttgtttctcctttca

SEQ ID NO: 174559 - DNA, 16 bp, H. sapiens
tttgtttctctgtatg

SEQ ID NO: 174560 - DNA, 16 bp, H. sapiens
tttgtttctctttgaa

SEQ ID NO: 174561 - DNA, 16 bp, H. sapiens
tttgtttctgaaattt

SEQ ID NO: 174562 - DNA, 16 bp, H. sapiens
tttgtttctgagcttt

SEQ ID NO: 174563 - DNA, 16 bp, H. sapiens
tttgtttctgcattaa

SEQ ID NO: 174564 - DNA, 16 bp, H. sapiens
tttgtttctggaattt

SEQ ID NO: 174565 - DNA, 16 bp, H. sapiens
tttgtttcttgaaaat

SEQ ID NO: 174566 - DNA, 16 bp, H. sapiens
tttgtttcttgtaaat

SEQ ID NO: 174567 - DNA, 16 bp, H. sapiens
tttgtttctttaaaat

SEQ ID NO: 174568 - DNA, 16 bp, H. sapiens
tttgtttctttgaaaa

SEQ ID NO: 174569 - DNA, 16 bp, H. sapiens
tttgtttctttgaata

SEQ ID NO: 174570 - DNA, 16 bp, H. sapiens
tttgtttgaaaatgtt

SEQ ID NO: 174571 - DNA, 16 bp, H. sapiens
tttgtttgaatacctg

SEQ ID NO: 174572 - DNA, 16 bp, H. sapiens
tttgtttgagacaaga

SEQ ID NO: 174573 - DNA, 16 bp, H. sapiens
tttgtttgctttaaaa

SEQ ID NO: 174574 - DNA, 16 bp, H. sapiens
tttgtttgtgccatct

SEQ ID NO: 174575 - DNA, 16 bp, H. sapiens
tttgtttgttggagac

SEQ ID NO: 174576 - DNA, 16 bp, H. sapiens
tttgtttgtttcaaat

SEQ ID NO: 174577 - DNA, 16 bp, H. sapiens
tttgttttaaaaaaag

SEQ ID NO: 174578 - DNA, 16 bp, H. sapiens
tttgttttaaaaagca

SEQ ID NO: 174579 - DNA, 16 bp, H. sapiens
tttgttttaaaaatca

SEQ ID NO: 174580 - DNA, 16 bp, H. sapiens
tttgttttaaaacaaa

SEQ ID NO: 174581 - DNA, 16 bp, H. sapiens
tttgttttaaagcaaa

SEQ ID NO: 174582 - DNA, 16 bp, H. sapiens
tttgttttaaagtaaa

SEQ ID NO: 174583 - DNA, 16 bp, H. sapiens
tttgttttaaataaga

SEQ ID NO: 174584 - DNA, 16 bp, H. sapiens
tttgttttaaatgtgg

SEQ ID NO: 174585 - DNA, 16 bp, H. sapiens
tttgttttaaattctg

SEQ ID NO: 174586 - DNA, 16 bp, H. sapiens
tttgttttaacattaa

SEQ ID NO: 174587 - DNA, 16 bp, H. sapiens
tttgttttaataaaca

SEQ ID NO: 174588 - DNA, 16 bp, H. sapiens
tttgttttaattgaca

SEQ ID NO: 174589 - DNA, 16 bp, H. sapiens
tttgttttaatttcaa

SEQ ID NO: 174590 - DNA, 16 bp, H. sapiens
tttgttttacaaacaa

SEQ ID NO: 174591 - DNA, 16 bp, H. sapiens
tttgttttactataaa

SEQ ID NO: 174592 - DNA, 16 bp, H. sapiens
tttgttttagaaaaat

SEQ ID NO: 174593 - DNA, 16 bp, H. sapiens
tttgttttatagactc

SEQ ID NO: 174594 - DNA, 16 bp, H. sapiens
tttgttttattccaaa

SEQ ID NO: 174595 - DNA, 16 bp, H. sapiens
tttgttttattgcagt

SEQ ID NO: 174596 - DNA, 16 bp, H. sapiens
tttgttttcaaaatat

SEQ ID NO: 174597 - DNA, 16 bp, H. sapiens
tttgttttcaaataat

SEQ ID NO: 174598 - DNA, 16 bp, H. sapiens
tttgttttcaagaaaa

SEQ ID NO: 174599 - DNA, 16 bp, H. sapiens
tttgttttcaatttaa

SEQ ID NO: 174600 - DNA, 16 bp, H. sapiens
tttgttttcagtctat

SEQ ID NO: 174601 - DNA, 16 bp, H. sapiens
tttgttttcataaaat

SEQ ID NO: 174602 - DNA, 16 bp, H. sapiens
tttgttttcattaaat

SEQ ID NO: 174603 - DNA, 16 bp, H. sapiens
tttgttttcattcagt

SEQ ID NO: 174604 - DNA, 16 bp, H. sapiens
tttgttttccatttac

SEQ ID NO: 174605 - DNA, 16 bp, H. sapiens
tttgttttccttcata

SEQ ID NO: 174606 - DNA, 16 bp, H. sapiens
tttgttttccttctaa

SEQ ID NO: 174607 - DNA, 16 bp, H. sapiens
tttgttttcctttgaa

SEQ ID NO: 174608 - DNA, 16 bp, H. sapiens
tttgttttctaattca

SEQ ID NO: 174609 - DNA, 16 bp, H. sapiens
tttgttttctaccaca

SEQ ID NO: 174610 - DNA, 16 bp, H. sapiens
tttgttttctcatagt

SEQ ID NO: 174611 - DNA, 16 bp, H. sapiens
tttgttttctcatctg

SEQ ID NO: 174612 - DNA, 16 bp, H. sapiens
tttgttttctcattaa

SEQ ID NO: 174613 - DNA, 16 bp, H. sapiens
tttgttttctcattca

SEQ ID NO: 174614 - DNA, 16 bp, H. sapiens
tttgttttctgaaaca

SEQ ID NO: 174615 - DNA, 16 bp, H. sapiens
tttgttttctgagata

SEQ ID NO: 174616 - DNA, 16 bp, H. sapiens
tttgttttctgtaaat

SEQ ID NO: 174617 - DNA, 16 bp, H. sapiens
tttgttttctgtgaaa

SEQ ID NO: 174618 - DNA, 16 bp, H. sapiens
tttgttttcttaaaat

SEQ ID NO: 174619 - DNA, 16 bp, H. sapiens
tttgttttcttaaaga

SEQ ID NO: 174620 - DNA, 16 bp, H. sapiens
tttgttttcttcactg

SEQ ID NO: 174621 - DNA, 16 bp, H. sapiens
tttgttttcttctcaa

SEQ ID NO: 174622 - DNA, 16 bp, H. sapiens
tttgttttcttgaaaa

SEQ ID NO: 174623 - DNA, 16 bp, H. sapiens
tttgttttcttgagaa

SEQ ID NO: 174624 - DNA, 16 bp, H. sapiens
tttgttttgaaatact

SEQ ID NO: 174625 - DNA, 16 bp, H. sapiens
tttgttttgacacagg

SEQ ID NO: 174626 - DNA, 16 bp, H. sapiens
tttgttttgagactgg

SEQ ID NO: 174627 - DNA, 16 bp, H. sapiens
tttgttttgaggcaag

SEQ ID NO: 174628 - DNA, 16 bp, H. sapiens
tttgttttggaaaatt

SEQ ID NO: 174629 - DNA, 16 bp, H. sapiens
tttgttttggccaaat

SEQ ID NO: 174630 - DNA, 16 bp, H. sapiens
tttgttttgtgagaca

SEQ ID NO: 174631 - DNA, 16 bp, H. sapiens
tttgttttgtgtgcat

SEQ ID NO: 174632 - DNA, 16 bp, H. sapiens
tttgttttgttgctca

SEQ ID NO: 174633 - DNA, 16 bp, H. sapiens
tttgttttgtttcaag

SEQ ID NO: 174634 - DNA, 16 bp, H. sapiens
tttgtttttaaaaact

SEQ ID NO: 174635 - DNA, 16 bp, H. sapiens
tttgtttttaaaaatc

SEQ ID NO: 174636 - DNA, 16 bp, H. sapiens
tttgtttttaaaacag

SEQ ID NO: 174637 - DNA, 16 bp, H. sapiens
tttgtttttaaacaaa

SEQ ID NO: 174638 - DNA, 16 bp, H. sapiens
tttgtttttaaacaag

SEQ ID NO: 174639 - DNA, 16 bp, H. sapiens
tttgtttttaaagaaa

SEQ ID NO: 174640 - DNA, 16 bp, H. sapiens
tttgtttttaaagact

SEQ ID NO: 174641 - DNA, 16 bp, H. sapiens
tttgtttttaaaggat

SEQ ID NO: 174642 - DNA, 16 bp, H. sapiens
tttgtttttaaagtga

SEQ ID NO: 174643 - DNA, 16 bp, H. sapiens
tttgtttttaaatctg

SEQ ID NO: 174644 - DNA, 16 bp, H. sapiens
tttgtttttaacaaaa

SEQ ID NO: 174645 - DNA, 16 bp, H. sapiens
tttgtttttaacatat

SEQ ID NO: 174646 - DNA, 16 bp, H. sapiens
tttgtttttaaccaaa

SEQ ID NO: 174647 - DNA, 16 bp, H. sapiens
tttgtttttaagaaaa

SEQ ID NO: 174648 - DNA, 16 bp, H. sapiens
tttgtttttaagacag

SEQ ID NO: 174649 - DNA, 16 bp, H. sapiens
tttgtttttacaaaat

SEQ ID NO: 174650 - DNA, 16 bp, H. sapiens
tttgtttttacagaaa

SEQ ID NO: 174651 - DNA, 16 bp, H. sapiens
tttgtttttatggctg

SEQ ID NO: 174652 - DNA, 16 bp, H. sapiens
tttgtttttatgtcag

SEQ ID NO: 174653 - DNA, 16 bp, H. sapiens
tttgtttttattcaaa

SEQ ID NO: 174654 - DNA, 16 bp, H. sapiens
tttgtttttattcagc

SEQ ID NO: 174655 - DNA, 16 bp, H. sapiens
tttgtttttcaaaatt

SEQ ID NO: 174656 - DNA, 16 bp, H. sapiens
tttgtttttcaaagat

SEQ ID NO: 174657 - DNA, 16 bp, H. sapiens
tttgtttttcaagaca

SEQ ID NO: 174658 - DNA, 16 bp, H. sapiens
tttgtttttcacatat

SEQ ID NO: 174659 - DNA, 16 bp, H. sapiens
tttgtttttcagaaat

SEQ ID NO: 174660 - DNA, 16 bp, H. sapiens
tttgtttttcagagcc

SEQ ID NO: 174661 - DNA, 16 bp, H. sapiens
tttgtttttccaaaaa

SEQ ID NO: 174662 - DNA, 16 bp, H. sapiens
tttgtttttccaaaat

SEQ ID NO: 174663 - DNA, 16 bp, H. sapiens
tttgtttttccatatg

SEQ ID NO: 174664 - DNA, 16 bp, H. sapiens
tttgtttttccccaaa

SEQ ID NO: 174665 - DNA, 16 bp, H. sapiens
tttgtttttcctgaag

SEQ ID NO: 174666 - DNA, 16 bp, H. sapiens
tttgtttttctaaaat

SEQ ID NO: 174667 - DNA, 16 bp, H. sapiens
tttgtttttctcagca

SEQ ID NO: 174668 - DNA, 16 bp, H. sapiens
tttgtttttctccaca

SEQ ID NO: 174669 - DNA, 16 bp, H. sapiens
tttgtttttctcctga

SEQ ID NO: 174670 - DNA, 16 bp, H. sapiens
tttgtttttctgcagt

SEQ ID NO: 174671 - DNA, 16 bp, H. sapiens
tttgtttttctggaaa

SEQ ID NO: 174672 - DNA, 16 bp, H. sapiens
tttgtttttcttaaac

SEQ ID NO: 174673 - DNA, 16 bp, H. sapiens
tttgtttttgaaaaag

SEQ ID NO: 174674 - DNA, 16 bp, H. sapiens
tttgtttttgaaaatg

SEQ ID NO: 174675 - DNA, 16 bp, H. sapiens
tttgtttttgagacag

SEQ ID NO: 174676 - DNA, 16 bp, H. sapiens
tttgtttttgagatag

SEQ ID NO: 174677 - DNA, 16 bp, H. sapiens
tttgtttttggaagaa

SEQ ID NO: 174678 - DNA, 16 bp, H. sapiens
tttgtttttgtggcaa

SEQ ID NO: 174679 - DNA, 16 bp, H. sapiens
tttgttttttaaatgc

SEQ ID NO: 174680 - DNA, 16 bp, H. sapiens
tttgttttttaacagt

SEQ ID NO: 174681 - DNA, 16 bp, H. sapiens
tttgttttttaagaga

SEQ ID NO: 174682 - DNA, 16 bp, H. sapiens
tttgttttttagagac

SEQ ID NO: 174683 - DNA, 16 bp, H. sapiens
tttgttttttcacagt

SEQ ID NO: 174684 - DNA, 16 bp, H. sapiens
tttgttttttcagagt

SEQ ID NO: 174685 - DNA, 16 bp, H. sapiens
tttgttttttcagatg

SEQ ID NO: 174686 - DNA, 16 bp, H. sapiens
tttgttttttccaaga

SEQ ID NO: 174687 - DNA, 16 bp, H. sapiens
tttgttttttgaaatc

SEQ ID NO: 174688 - DNA, 16 bp, H. sapiens
tttgttttttgaagaa

SEQ ID NO: 174689 - DNA, 16 bp, H. sapiens
tttgtttttttaacaa

SEQ ID NO: 174690 - DNA, 16 bp, H. sapiens
ttttaaaaaaaactgt

SEQ ID NO: 174691 - DNA, 16 bp, H. sapiens
ttttaaaaaaaagcaa

SEQ ID NO: 174692 - DNA, 16 bp, H. sapiens
ttttaaaaaaaatgca

SEQ ID NO: 174693 - DNA, 16 bp, H. sapiens
ttttaaaaaaacacag

SEQ ID NO: 174694 - DNA, 16 bp, H. sapiens
ttttaaaaaaacctat

SEQ ID NO: 174695 - DNA, 16 bp, H. sapiens
ttttaaaaaaactttg

SEQ ID NO: 174696 - DNA, 16 bp, H. sapiens
ttttaaaaaaagcaac

SEQ ID NO: 174697 - DNA, 16 bp, H. sapiens
ttttaaaaaaaggatt

SEQ ID NO: 174698 - DNA, 16 bp, H. sapiens
ttttaaaaaaatcaag

SEQ ID NO: 174699 - DNA, 16 bp, H. sapiens
ttttaaaaaaatcaga

SEQ ID NO: 174700 - DNA, 16 bp, H. sapiens
ttttaaaaaaatccct

SEQ ID NO: 174701 - DNA, 16 bp, H. sapiens
ttttaaaaaaatctca

SEQ ID NO: 174702 - DNA, 16 bp, H. sapiens
ttttaaaaaaatgaca

SEQ ID NO: 174703 - DNA, 16 bp, H. sapiens
ttttaaaaaaatgagt

SEQ ID NO: 174704 - DNA, 16 bp, H. sapiens
ttttaaaaaaattagc

SEQ ID NO: 174705 - DNA, 16 bp, H. sapiens
ttttaaaaaaattcct

SEQ ID NO: 174706 - DNA, 16 bp, H. sapiens
ttttaaaaaacaatgt

SEQ ID NO: 174707 - DNA, 16 bp, H. sapiens
ttttaaaaaacacact

SEQ ID NO: 174708 - DNA, 16 bp, H. sapiens
ttttaaaaaacacatt

SEQ ID NO: 174709 - DNA, 16 bp, H. sapiens
ttttaaaaaacacttt

SEQ ID NO: 174710 - DNA, 16 bp, H. sapiens
ttttaaaaaacagata

SEQ ID NO: 174711 - DNA, 16 bp, H. sapiens
ttttaaaaaacatttg

SEQ ID NO: 174712 - DNA, 16 bp, H. sapiens
ttttaaaaaaccaaga

SEQ ID NO: 174713 - DNA, 16 bp, H. sapiens
ttttaaaaaaccattt

SEQ ID NO: 174714 - DNA, 16 bp, H. sapiens
ttttaaaaaactaatg

SEQ ID NO: 174715 - DNA, 16 bp, H. sapiens
ttttaaaaaactatca

SEQ ID NO: 174716 - DNA, 16 bp, H. sapiens
ttttaaaaaagacttt

SEQ ID NO: 174717 - DNA, 16 bp, H. sapiens
ttttaaaaaagatcat

SEQ ID NO: 174718 - DNA, 16 bp, H. sapiens
ttttaaaaaagcactg

SEQ ID NO: 174719 - DNA, 16 bp, H. sapiens
ttttaaaaaagcatta

SEQ ID NO: 174720 - DNA, 16 bp, H. sapiens
ttttaaaaaagcttat

SEQ ID NO: 174721 - DNA, 16 bp, H. sapiens
ttttaaaaaaggcaaa

SEQ ID NO: 174722 - DNA, 16 bp, H. sapiens
ttttaaaaaagggaga

SEQ ID NO: 174723 - DNA, 16 bp, H. sapiens
ttttaaaaaagtaaac

SEQ ID NO: 174724 - DNA, 16 bp, H. sapiens
ttttaaaaaagtgtat

SEQ ID NO: 174725 - DNA, 16 bp, H. sapiens
ttttaaaaaataccca

SEQ ID NO: 174726 - DNA, 16 bp, H. sapiens
ttttaaaaaatcacct

SEQ ID NO: 174727 - DNA, 16 bp, H. sapiens
ttttaaaaaatctcaa

SEQ ID NO: 174728 - DNA, 16 bp, H. sapiens
ttttaaaaaatgaaac

SEQ ID NO: 174729 - DNA, 16 bp, H. sapiens
ttttaaaaaatgaact

SEQ ID NO: 174730 - DNA, 16 bp, H. sapiens
ttttaaaaaatgacaa

SEQ ID NO: 174731 - DNA, 16 bp, H. sapiens
ttttaaaaaatgacag

SEQ ID NO: 174732 - DNA, 16 bp, H. sapiens
ttttaaaaaatgactt

SEQ ID NO: 174733 - DNA, 16 bp, H. sapiens
ttttaaaaaatgagat

SEQ ID NO: 174734 - DNA, 16 bp, H. sapiens
ttttaaaaaatgatca

SEQ ID NO: 174735 - DNA, 16 bp, H. sapiens
ttttaaaaaatgcaga

SEQ ID NO: 174736 - DNA, 16 bp, H. sapiens
ttttaaaaaatgctag

SEQ ID NO: 174737 - DNA, 16 bp, H. sapiens
ttttaaaaaatgcttt

SEQ ID NO: 174738 - DNA, 16 bp, H. sapiens
ttttaaaaaatgtatc

SEQ ID NO: 174739 - DNA, 16 bp, H. sapiens
ttttaaaaaatgtgta

SEQ ID NO: 174740 - DNA, 16 bp, H. sapiens
ttttaaaaaatgtgtg

SEQ ID NO: 174741 - DNA, 16 bp, H. sapiens
ttttaaaaaatgttca

SEQ ID NO: 174742 - DNA, 16 bp, H. sapiens
ttttaaaaaatgtttg

SEQ ID NO: 174743 - DNA, 16 bp, H. sapiens
ttttaaaaacaaatct

SEQ ID NO: 174744 - DNA, 16 bp, H. sapiens
ttttaaaaacaaatga

SEQ ID NO: 174745 - DNA, 16 bp, H. sapiens
ttttaaaaacaatgtt

SEQ ID NO: 174746 - DNA, 16 bp, H. sapiens
ttttaaaaacacattt

SEQ ID NO: 174747 - DNA, 16 bp, H. sapiens
ttttaaaaacaccata

SEQ ID NO: 174748 - DNA, 16 bp, H. sapiens
ttttaaaaacaccttt

SEQ ID NO: 174749 - DNA, 16 bp, H. sapiens
ttttaaaaacactttg

SEQ ID NO: 174750 - DNA, 16 bp, H. sapiens
ttttaaaaacagaact

SEQ ID NO: 174751 - DNA, 16 bp, H. sapiens
ttttaaaaacagtgaa

SEQ ID NO: 174752 - DNA, 16 bp, H. sapiens
ttttaaaaacataact

SEQ ID NO: 174753 - DNA, 16 bp, H. sapiens
ttttaaaaacatggct

SEQ ID NO: 174754 - DNA, 16 bp, H. sapiens
ttttaaaaacatgtct

SEQ ID NO: 174755 - DNA, 16 bp, H. sapiens
ttttaaaaacatgttt

SEQ ID NO: 174756 - DNA, 16 bp, H. sapiens
ttttaaaaacattgtt

SEQ ID NO: 174757 - DNA, 16 bp, H. sapiens
ttttaaaaaccaaagt

SEQ ID NO: 174758 - DNA, 16 bp, H. sapiens
ttttaaaaaccatttc

SEQ ID NO: 174759 - DNA, 16 bp, H. sapiens
ttttaaaaacccaaga

SEQ ID NO: 174760 - DNA, 16 bp, H. sapiens
ttttaaaaacctgaaa

SEQ ID NO: 174761 - DNA, 16 bp, H. sapiens
ttttaaaaaccttctt

SEQ ID NO: 174762 - DNA, 16 bp, H. sapiens
ttttaaaaacctttat

SEQ ID NO: 174763 - DNA, 16 bp, H. sapiens
ttttaaaaacctttca

SEQ ID NO: 174764 - DNA, 16 bp, H. sapiens
ttttaaaaactctaca

SEQ ID NO: 174765 - DNA, 16 bp, H. sapiens
ttttaaaaactcttct

SEQ ID NO: 174766 - DNA, 16 bp, H. sapiens
ttttaaaaactgaatt

SEQ ID NO: 174767 - DNA, 16 bp, H. sapiens
ttttaaaaactgattt

SEQ ID NO: 174768 - DNA, 16 bp, H. sapiens
ttttaaaaactgctat

SEQ ID NO: 174769 - DNA, 16 bp, H. sapiens
ttttaaaaactgcttt

SEQ ID NO: 174770 - DNA, 16 bp, H. sapiens
ttttaaaaactggaaa

SEQ ID NO: 174771 - DNA, 16 bp, H. sapiens
ttttaaaaactgtatg

SEQ ID NO: 174772 - DNA, 16 bp, H. sapiens
ttttaaaaactgtttt

SEQ ID NO: 174773 - DNA, 16 bp, H. sapiens
ttttaaaaacttgcat

SEQ ID NO: 174774 - DNA, 16 bp, H. sapiens
ttttaaaaacttgttt

SEQ ID NO: 174775 - DNA, 16 bp, H. sapiens
ttttaaaaactttcat

SEQ ID NO: 174776 - DNA, 16 bp, H. sapiens
ttttaaaaactttgta

SEQ ID NO: 174777 - DNA, 16 bp, H. sapiens
ttttaaaaacttttgt

SEQ ID NO: 174778 - DNA, 16 bp, H. sapiens
ttttaaaaagaaaaca

SEQ ID NO: 174779 - DNA, 16 bp, H. sapiens
ttttaaaaagaaaagg

SEQ ID NO: 174780 - DNA, 16 bp, H. sapiens
ttttaaaaagaactta

SEQ ID NO: 174781 - DNA, 16 bp, H. sapiens
ttttaaaaagaagaag

SEQ ID NO: 174782 - DNA, 16 bp, H. sapiens
ttttaaaaagaaggct

SEQ ID NO: 174783 - DNA, 16 bp, H. sapiens
ttttaaaaagacaaca

SEQ ID NO: 174784 - DNA, 16 bp, H. sapiens
ttttaaaaagacaagg

SEQ ID NO: 174785 - DNA, 16 bp, H. sapiens
ttttaaaaagacccaa

SEQ ID NO: 174786 - DNA, 16 bp, H. sapiens
ttttaaaaagatactt

SEQ ID NO: 174787 - DNA, 16 bp, H. sapiens
ttttaaaaagcaaaaa

SEQ ID NO: 174788 - DNA, 16 bp, H. sapiens
ttttaaaaagcaagag

SEQ ID NO: 174789 - DNA, 16 bp, H. sapiens
ttttaaaaagcaagtt

SEQ ID NO: 174790 - DNA, 16 bp, H. sapiens
ttttaaaaagcaatca

SEQ ID NO: 174791 - DNA, 16 bp, H. sapiens
ttttaaaaagcacaag

SEQ ID NO: 174792 - DNA, 16 bp, H. sapiens
ttttaaaaagcactta

SEQ ID NO: 174793 - DNA, 16 bp, H. sapiens
ttttaaaaagcatcat

SEQ ID NO: 174794 - DNA, 16 bp, H. sapiens
ttttaaaaagccaaag

SEQ ID NO: 174795 - DNA, 16 bp, H. sapiens
ttttaaaaagctactt

SEQ ID NO: 174796 - DNA, 16 bp, H. sapiens
ttttaaaaagctcatt

SEQ ID NO: 174797 - DNA, 16 bp, H. sapiens
ttttaaaaaggaatgt

SEQ ID NO: 174798 - DNA, 16 bp, H. sapiens
ttttaaaaaggacaaa

SEQ ID NO: 174799 - DNA, 16 bp, H. sapiens
ttttaaaaaggcaaaa

SEQ ID NO: 174800 - DNA, 16 bp, H. sapiens
ttttaaaaaggcagta

SEQ ID NO: 174801 - DNA, 16 bp, H. sapiens
ttttaaaaagggaaag

SEQ ID NO: 174802 - DNA, 16 bp, H. sapiens
ttttaaaaaggtaaac

SEQ ID NO: 174803 - DNA, 16 bp, H. sapiens
ttttaaaaaggtattt

SEQ ID NO: 174804 - DNA, 16 bp, H. sapiens
ttttaaaaaggtgaaa

SEQ ID NO: 174805 - DNA, 16 bp, H. sapiens
ttttaaaaagtacatt

SEQ ID NO: 174806 - DNA, 16 bp, H. sapiens
ttttaaaaagtctttt

SEQ ID NO: 174807 - DNA, 16 bp, H. sapiens
ttttaaaaagtgaaca

SEQ ID NO: 174808 - DNA, 16 bp, H. sapiens
ttttaaaaagtgatta

SEQ ID NO: 174809 - DNA, 16 bp, H. sapiens
ttttaaaaagtgtaat

SEQ ID NO: 174810 - DNA, 16 bp, H. sapiens
ttttaaaaagtgtatt

SEQ ID NO: 174811 - DNA, 16 bp, H. sapiens
ttttaaaaagtgttta

SEQ ID NO: 174812 - DNA, 16 bp, H. sapiens
ttttaaaaagtgtttc

SEQ ID NO: 174813 - DNA, 16 bp, H. sapiens
ttttaaaaagttatct

SEQ ID NO: 174814 - DNA, 16 bp, H. sapiens
ttttaaaaagttttca

SEQ ID NO: 174815 - DNA, 16 bp, H. sapiens
ttttaaaaataactca

SEQ ID NO: 174816 - DNA, 16 bp, H. sapiens
ttttaaaaataactgc

SEQ ID NO: 174817 - DNA, 16 bp, H. sapiens
ttttaaaaataacttc

SEQ ID NO: 174818 - DNA, 16 bp, H. sapiens
ttttaaaaataacttg

SEQ ID NO: 174819 - DNA, 16 bp, H. sapiens
ttttaaaaataagctt

SEQ ID NO: 174820 - DNA, 16 bp, H. sapiens
ttttaaaaataatcca

SEQ ID NO: 174821 - DNA, 16 bp, H. sapiens
ttttaaaaatacagaa

SEQ ID NO: 174822 - DNA, 16 bp, H. sapiens
ttttaaaaatacagta

SEQ ID NO: 174823 - DNA, 16 bp, H. sapiens
ttttaaaaatacatgt

SEQ ID NO: 174824 - DNA, 16 bp, H. sapiens
ttttaaaaataccttt

SEQ ID NO: 174825 - DNA, 16 bp, H. sapiens
ttttaaaaatactctt

SEQ ID NO: 174826 - DNA, 16 bp, H. sapiens
ttttaaaaatactttg

SEQ ID NO: 174827 - DNA, 16 bp, H. sapiens
ttttaaaaatcaacta

SEQ ID NO: 174828 - DNA, 16 bp, H. sapiens
ttttaaaaatcaagaa

SEQ ID NO: 174829 - DNA, 16 bp, H. sapiens
ttttaaaaatcaggat

SEQ ID NO: 174830 - DNA, 16 bp, H. sapiens
ttttaaaaatcagttt

SEQ ID NO: 174831 - DNA, 16 bp, H. sapiens
ttttaaaaatcatctt

SEQ ID NO: 174832 - DNA, 16 bp, H. sapiens
ttttaaaaatccaggt

SEQ ID NO: 174833 - DNA, 16 bp, H. sapiens
ttttaaaaatccattc

SEQ ID NO: 174834 - DNA, 16 bp, H. sapiens
ttttaaaaatcccctt

SEQ ID NO: 174835 - DNA, 16 bp, H. sapiens
ttttaaaaatctagaa

SEQ ID NO: 174836 - DNA, 16 bp, H. sapiens
ttttaaaaatctagtt

SEQ ID NO: 174837 - DNA, 16 bp, H. sapiens
ttttaaaaatctcatt

SEQ ID NO: 174838 - DNA, 16 bp, H. sapiens
ttttaaaaatctctgt

SEQ ID NO: 174839 - DNA, 16 bp, H. sapiens
ttttaaaaatctgaat

SEQ ID NO: 174840 - DNA, 16 bp, H. sapiens
ttttaaaaatctgaga

SEQ ID NO: 174841 - DNA, 16 bp, H. sapiens
ttttaaaaatcttgtt

SEQ ID NO: 174842 - DNA, 16 bp, H. sapiens
ttttaaaaatgaactt

SEQ ID NO: 174843 - DNA, 16 bp, H. sapiens
ttttaaaaatgaagat

SEQ ID NO: 174844 - DNA, 16 bp, H. sapiens
ttttaaaaatgacaaa

SEQ ID NO: 174845 - DNA, 16 bp, H. sapiens
ttttaaaaatgacaca

SEQ ID NO: 174846 - DNA, 16 bp, H. sapiens
ttttaaaaatgattgt

SEQ ID NO: 174847 - DNA, 16 bp, H. sapiens
ttttaaaaatgcagat

SEQ ID NO: 174848 - DNA, 16 bp, H. sapiens
ttttaaaaatgcatat

SEQ ID NO: 174849 - DNA, 16 bp, H. sapiens
ttttaaaaatgcatta

SEQ ID NO: 174850 - DNA, 16 bp, H. sapiens
ttttaaaaatgccaaa

SEQ ID NO: 174851 - DNA, 16 bp, H. sapiens
ttttaaaaatgccttt

SEQ ID NO: 174852 - DNA, 16 bp, H. sapiens
ttttaaaaatgcttat

SEQ ID NO: 174853 - DNA, 16 bp, H. sapiens
ttttaaaaatgctttt

SEQ ID NO: 174854 - DNA, 16 bp, H. sapiens
ttttaaaaatggacaa

SEQ ID NO: 174855 - DNA, 16 bp, H. sapiens
ttttaaaaatggtatc

SEQ ID NO: 174856 - DNA, 16 bp, H. sapiens
ttttaaaaatggtctt

SEQ ID NO: 174857 - DNA, 16 bp, H. sapiens
ttttaaaaatgtaaca

SEQ ID NO: 174858 - DNA, 16 bp, H. sapiens
ttttaaaaatgtaact

SEQ ID NO: 174859 - DNA, 16 bp, H. sapiens
ttttaaaaatgtcatt

SEQ ID NO: 174860 - DNA, 16 bp, H. sapiens
ttttaaaaatgtggat

SEQ ID NO: 174861 - DNA, 16 bp, H. sapiens
ttttaaaaatgttcca

SEQ ID NO: 174862 - DNA, 16 bp, H. sapiens
ttttaaaaatgttctc

SEQ ID NO: 174863 - DNA, 16 bp, H. sapiens
ttttaaaaatgttttc

SEQ ID NO: 174864 - DNA, 16 bp, H. sapiens
ttttaaaaattaaagg

SEQ ID NO: 174865 - DNA, 16 bp, H. sapiens
ttttaaaaattagctg

SEQ ID NO: 174866 - DNA, 16 bp, H. sapiens
ttttaaaaattatgca

SEQ ID NO: 174867 - DNA, 16 bp, H. sapiens
ttttaaaaattcaaca

SEQ ID NO: 174868 - DNA, 16 bp, H. sapiens
ttttaaaaattcacaa

SEQ ID NO: 174869 - DNA, 16 bp, H. sapiens
ttttaaaaattcagat

SEQ ID NO: 174870 - DNA, 16 bp, H. sapiens
ttttaaaaattctgat

SEQ ID NO: 174871 - DNA, 16 bp, H. sapiens
ttttaaaaattgagtt

SEQ ID NO: 174872 - DNA, 16 bp, H. sapiens
ttttaaaaattggaaa

SEQ ID NO: 174873 - DNA, 16 bp, H. sapiens
ttttaaaaattgggtt

SEQ ID NO: 174874 - DNA, 16 bp, H. sapiens
ttttaaaaattgtgta

SEQ ID NO: 174875 - DNA, 16 bp, H. sapiens
ttttaaaaattgttga

SEQ ID NO: 174876 - DNA, 16 bp, H. sapiens
ttttaaaaatttagca

SEQ ID NO: 174877 - DNA, 16 bp, H. sapiens
ttttaaaacaaaagaa

SEQ ID NO: 174878 - DNA, 16 bp, H. sapiens
ttttaaaacaaagaaa

SEQ ID NO: 174879 - DNA, 16 bp, H. sapiens
ttttaaaacaaatgat

SEQ ID NO: 174880 - DNA, 16 bp, H. sapiens
ttttaaaacaactttt

SEQ ID NO: 174881 - DNA, 16 bp, H. sapiens
ttttaaaacaaggaaa

SEQ ID NO: 174882 - DNA, 16 bp, H. sapiens
ttttaaaacaatttgt

SEQ ID NO: 174883 - DNA, 16 bp, H. sapiens
ttttaaaacactattt

SEQ ID NO: 174884 - DNA, 16 bp, H. sapiens
ttttaaaacactgaaa

SEQ ID NO: 174885 - DNA, 16 bp, H. sapiens
ttttaaaacactggaa

SEQ ID NO: 174886 - DNA, 16 bp, H. sapiens
ttttaaaacactttca

SEQ ID NO: 174887 - DNA, 16 bp, H. sapiens
ttttaaaacagaaatt

SEQ ID NO: 174888 - DNA, 16 bp, H. sapiens
ttttaaaacagcttta

SEQ ID NO: 174889 - DNA, 16 bp, H. sapiens
ttttaaaacatcattc

SEQ ID NO: 174890 - DNA, 16 bp, H. sapiens
ttttaaaacatcattt

SEQ ID NO: 174891 - DNA, 16 bp, H. sapiens
ttttaaaacatgataa

SEQ ID NO: 174892 - DNA, 16 bp, H. sapiens
ttttaaaacatgtttt

SEQ ID NO: 174893 - DNA, 16 bp, H. sapiens
ttttaaaacattgtat

SEQ ID NO: 174894 - DNA, 16 bp, H. sapiens
ttttaaaacattgttt

SEQ ID NO: 174895 - DNA, 16 bp, H. sapiens
ttttaaaacatttttg

SEQ ID NO: 174896 - DNA, 16 bp, H. sapiens
ttttaaaaccaacaaa

SEQ ID NO: 174897 - DNA, 16 bp, H. sapiens
ttttaaaaccaatttt

SEQ ID NO: 174898 - DNA, 16 bp, H. sapiens
ttttaaaaccagaaaa

SEQ ID NO: 174899 - DNA, 16 bp, H. sapiens
ttttaaaacctcttaa

SEQ ID NO: 174900 - DNA, 16 bp, H. sapiens
ttttaaaaccttgttt

SEQ ID NO: 174901 - DNA, 16 bp, H. sapiens
ttttaaaactagaaaa

SEQ ID NO: 174902 - DNA, 16 bp, H. sapiens
ttttaaaactccaaat

SEQ ID NO: 174903 - DNA, 16 bp, H. sapiens
ttttaaaactctttct

SEQ ID NO: 174904 - DNA, 16 bp, H. sapiens
ttttaaaactgaaaag

SEQ ID NO: 174905 - DNA, 16 bp, H. sapiens
ttttaaaactgaagtt

SEQ ID NO: 174906 - DNA, 16 bp, H. sapiens
ttttaaaactgaattt

SEQ ID NO: 174907 - DNA, 16 bp, H. sapiens
ttttaaaactgaggaa

SEQ ID NO: 174908 - DNA, 16 bp, H. sapiens
ttttaaaactgatttt

SEQ ID NO: 174909 - DNA, 16 bp, H. sapiens
ttttaaaactggcaaa

SEQ ID NO: 174910 - DNA, 16 bp, H. sapiens
ttttaaaactgtaaat

SEQ ID NO: 174911 - DNA, 16 bp, H. sapiens
ttttaaaactgtaatt

SEQ ID NO: 174912 - DNA, 16 bp, H. sapiens
ttttaaaactgtattt

SEQ ID NO: 174913 - DNA, 16 bp, H. sapiens
ttttaaaacttcatct

SEQ ID NO: 174914 - DNA, 16 bp, H. sapiens
ttttaaaacttcatta

SEQ ID NO: 174915 - DNA, 16 bp, H. sapiens
ttttaaaacttgaaaa

SEQ ID NO: 174916 - DNA, 16 bp, H. sapiens
ttttaaaacttgaatt

SEQ ID NO: 174917 - DNA, 16 bp, H. sapiens
ttttaaaacttgagaa

SEQ ID NO: 174918 - DNA, 16 bp, H. sapiens
ttttaaaactttgttt

SEQ ID NO: 174919 - DNA, 16 bp, H. sapiens
ttttaaaagaaaaatc

SEQ ID NO: 174920 - DNA, 16 bp, H. sapiens
ttttaaaagaaacttt

SEQ ID NO: 174921 - DNA, 16 bp, H. sapiens
ttttaaaagaaagaca

SEQ ID NO: 174922 - DNA, 16 bp, H. sapiens
ttttaaaagaaagatt

SEQ ID NO: 174923 - DNA, 16 bp, H. sapiens
ttttaaaagaaagtca

SEQ ID NO: 174924 - DNA, 16 bp, H. sapiens
ttttaaaagaaagtta

SEQ ID NO: 174925 - DNA, 16 bp, H. sapiens
ttttaaaagaaatgga

SEQ ID NO: 174926 - DNA, 16 bp, H. sapiens
ttttaaaagaaatgtt

SEQ ID NO: 174927 - DNA, 16 bp, H. sapiens
ttttaaaagaaattca

SEQ ID NO: 174928 - DNA, 16 bp, H. sapiens
ttttaaaagaaccaaa

SEQ ID NO: 174929 - DNA, 16 bp, H. sapiens
ttttaaaagaagcatt

SEQ ID NO: 174930 - DNA, 16 bp, H. sapiens
ttttaaaagaaggaaa

SEQ ID NO: 174931 - DNA, 16 bp, H. sapiens
ttttaaaagaataaac

SEQ ID NO: 174932 - DNA, 16 bp, H. sapiens
ttttaaaagaatgttt

SEQ ID NO: 174933 - DNA, 16 bp, H. sapiens
ttttaaaagaattaca

SEQ ID NO: 174934 - DNA, 16 bp, H. sapiens
ttttaaaagaatttca

SEQ ID NO: 174935 - DNA, 16 bp, H. sapiens
ttttaaaagacaagat

SEQ ID NO: 174936 - DNA, 16 bp, H. sapiens
ttttaaaagacataat

SEQ ID NO: 174937 - DNA, 16 bp, H. sapiens
ttttaaaagacatttt

SEQ ID NO: 174938 - DNA, 16 bp, H. sapiens
ttttaaaagacctttt

SEQ ID NO: 174939 - DNA, 16 bp, H. sapiens
ttttaaaagactattt

SEQ ID NO: 174940 - DNA, 16 bp, H. sapiens
ttttaaaagactgaca

SEQ ID NO: 174941 - DNA, 16 bp, H. sapiens
ttttaaaagactgttt

SEQ ID NO: 174942 - DNA, 16 bp, H. sapiens
ttttaaaagacttgaa

SEQ ID NO: 174943 - DNA, 16 bp, H. sapiens
ttttaaaagactttta

SEQ ID NO: 174944 - DNA, 16 bp, H. sapiens
ttttaaaagagaagca

SEQ ID NO: 174945 - DNA, 16 bp, H. sapiens
ttttaaaagagagaaa

SEQ ID NO: 174946 - DNA, 16 bp, H. sapiens
ttttaaaagaggattt

SEQ ID NO: 174947 - DNA, 16 bp, H. sapiens
ttttaaaagataaaca

SEQ ID NO: 174948 - DNA, 16 bp, H. sapiens
ttttaaaagatcaaat

SEQ ID NO: 174949 - DNA, 16 bp, H. sapiens
ttttaaaagatgactt

SEQ ID NO: 174950 - DNA, 16 bp, H. sapiens
ttttaaaagatgattc

SEQ ID NO: 174951 - DNA, 16 bp, H. sapiens
ttttaaaagattatct

SEQ ID NO: 174952 - DNA, 16 bp, H. sapiens
ttttaaaagcaaaaag

SEQ ID NO: 174953 - DNA, 16 bp, H. sapiens
ttttaaaagcaaaaat

SEQ ID NO: 174954 - DNA, 16 bp, H. sapiens
ttttaaaagcaaaatg

SEQ ID NO: 174955 - DNA, 16 bp, H. sapiens
ttttaaaagcaaattt

SEQ ID NO: 174956 - DNA, 16 bp, H. sapiens
ttttaaaagcaagcaa

SEQ ID NO: 174957 - DNA, 16 bp, H. sapiens
ttttaaaagcatttta

SEQ ID NO: 174958 - DNA, 16 bp, H. sapiens
ttttaaaagctatttt

SEQ ID NO: 174959 - DNA, 16 bp, H. sapiens
ttttaaaagctcagca

SEQ ID NO: 174960 - DNA, 16 bp, H. sapiens
ttttaaaagcttttaa

SEQ ID NO: 174961 - DNA, 16 bp, H. sapiens
ttttaaaaggaaaaca

SEQ ID NO: 174962 - DNA, 16 bp, H. sapiens
ttttaaaaggaaagaa

SEQ ID NO: 174963 - DNA, 16 bp, H. sapiens
ttttaaaaggacttta

SEQ ID NO: 174964 - DNA, 16 bp, H. sapiens
ttttaaaaggagagaa

SEQ ID NO: 174965 - DNA, 16 bp, H. sapiens
ttttaaaaggatattt

SEQ ID NO: 174966 - DNA, 16 bp, H. sapiens
ttttaaaaggcaaaaa

SEQ ID NO: 174967 - DNA, 16 bp, H. sapiens
ttttaaaaggcaaaca

SEQ ID NO: 174968 - DNA, 16 bp, H. sapiens
ttttaaaaggctaaaa

SEQ ID NO: 174969 - DNA, 16 bp, H. sapiens
ttttaaaaggctgttt

SEQ ID NO: 174970 - DNA, 16 bp, H. sapiens
ttttaaaagggagaaa

SEQ ID NO: 174971 - DNA, 16 bp, H. sapiens
ttttaaaaggtaaatg

SEQ ID NO: 174972 - DNA, 16 bp, H. sapiens
ttttaaaaggtaataa

SEQ ID NO: 174973 - DNA, 16 bp, H. sapiens
ttttaaaaggtacaaa

SEQ ID NO: 174974 - DNA, 16 bp, H. sapiens
ttttaaaagtaggaaa

SEQ ID NO: 174975 - DNA, 16 bp, H. sapiens
ttttaaaagtatatgt

SEQ ID NO: 174976 - DNA, 16 bp, H. sapiens
ttttaaaagtatcttc

SEQ ID NO: 174977 - DNA, 16 bp, H. sapiens
ttttaaaagtcaaaat

SEQ ID NO: 174978 - DNA, 16 bp, H. sapiens
ttttaaaagtcaaatt

SEQ ID NO: 174979 - DNA, 16 bp, H. sapiens
ttttaaaagtcaatat

SEQ ID NO: 174980 - DNA, 16 bp, H. sapiens
ttttaaaagtcaattt

SEQ ID NO: 174981 - DNA, 16 bp, H. sapiens
ttttaaaagtcacttt

SEQ ID NO: 174982 - DNA, 16 bp, H. sapiens
ttttaaaagtcataaa

SEQ ID NO: 174983 - DNA, 16 bp, H. sapiens
ttttaaaagtcatata

SEQ ID NO: 174984 - DNA, 16 bp, H. sapiens
ttttaaaagtcatttt

SEQ ID NO: 174985 - DNA, 16 bp, H. sapiens
ttttaaaagtctgtat

SEQ ID NO: 174986 - DNA, 16 bp, H. sapiens
ttttaaaagtgaaaag

SEQ ID NO: 174987 - DNA, 16 bp, H. sapiens
ttttaaaagtgaattt

SEQ ID NO: 174988 - DNA, 16 bp, H. sapiens
ttttaaaagtgcaaat

SEQ ID NO: 174989 - DNA, 16 bp, H. sapiens
ttttaaaagtggaaaa

SEQ ID NO: 174990 - DNA, 16 bp, H. sapiens
ttttaaaagtgggagt

SEQ ID NO: 174991 - DNA, 16 bp, H. sapiens
ttttaaaagtgtgtgg

SEQ ID NO: 174992 - DNA, 16 bp, H. sapiens
ttttaaaagtgttaaa

SEQ ID NO: 174993 - DNA, 16 bp, H. sapiens
ttttaaaagtgttttc

SEQ ID NO: 174994 - DNA, 16 bp, H. sapiens
ttttaaaagttcaaat

SEQ ID NO: 174995 - DNA, 16 bp, H. sapiens
ttttaaaagttcattt

SEQ ID NO: 174996 - DNA, 16 bp, H. sapiens
ttttaaaagttcttat

SEQ ID NO: 174997 - DNA, 16 bp, H. sapiens
ttttaaaagttcttta

SEQ ID NO: 174998 - DNA, 16 bp, H. sapiens
ttttaaaagttgcttt

SEQ ID NO: 174999 - DNA, 16 bp, H. sapiens
ttttaaaagttttaga

SEQ ID NO: 175000 - DNA, 16 bp, H. sapiens
ttttaaaagttttgct

SEQ ID NO: 175001 - DNA, 16 bp, H. sapiens
ttttaaaataaaagtg

SEQ ID NO: 175002 - DNA, 16 bp, H. sapiens
ttttaaaataaagcaa

SEQ ID NO: 175003 - DNA, 16 bp, H. sapiens
ttttaaaataaagctt

SEQ ID NO: 175004 - DNA, 16 bp, H. sapiens
ttttaaaataaccttt

SEQ ID NO: 175005 - DNA, 16 bp, H. sapiens
ttttaaaataactgaa

SEQ ID NO: 175006 - DNA, 16 bp, H. sapiens
ttttaaaataagacaa

SEQ ID NO: 175007 - DNA, 16 bp, H. sapiens
ttttaaaataagcttt

SEQ ID NO: 175008 - DNA, 16 bp, H. sapiens
ttttaaaatacagaaa

SEQ ID NO: 175009 - DNA, 16 bp, H. sapiens
ttttaaaatacagttt

SEQ ID NO: 175010 - DNA, 16 bp, H. sapiens
ttttaaaataccattt

SEQ ID NO: 175011 - DNA, 16 bp, H. sapiens
ttttaaaatacttcct

SEQ ID NO: 175012 - DNA, 16 bp, H. sapiens
ttttaaaatagacttt

SEQ ID NO: 175013 - DNA, 16 bp, H. sapiens
ttttaaaatagagata

SEQ ID NO: 175014 - DNA, 16 bp, H. sapiens
ttttaaaatagctaaa

SEQ ID NO: 175015 - DNA, 16 bp, H. sapiens
ttttaaaatatatcca

SEQ ID NO: 175016 - DNA, 16 bp, H. sapiens
ttttaaaatatgggaa

SEQ ID NO: 175017 - DNA, 16 bp, H. sapiens
ttttaaaatattactg

SEQ ID NO: 175018 - DNA, 16 bp, H. sapiens
ttttaaaatcaacttt

SEQ ID NO: 175019 - DNA, 16 bp, H. sapiens
ttttaaaatcagagta

SEQ ID NO: 175020 - DNA, 16 bp, H. sapiens
ttttaaaatcaggaaa

SEQ ID NO: 175021 - DNA, 16 bp, H. sapiens
ttttaaaatcagtttt

SEQ ID NO: 175022 - DNA, 16 bp, H. sapiens
ttttaaaatcatcatt

SEQ ID NO: 175023 - DNA, 16 bp, H. sapiens
ttttaaaatcatgttt

SEQ ID NO: 175024 - DNA, 16 bp, H. sapiens
ttttaaaatcatttca

SEQ ID NO: 175025 - DNA, 16 bp, H. sapiens
ttttaaaatccacttt

SEQ ID NO: 175026 - DNA, 16 bp, H. sapiens
ttttaaaatccagaaa

SEQ ID NO: 175027 - DNA, 16 bp, H. sapiens
ttttaaaatcctgatt

SEQ ID NO: 175028 - DNA, 16 bp, H. sapiens
ttttaaaatcctttct

SEQ ID NO: 175029 - DNA, 16 bp, H. sapiens
ttttaaaatctaaagt

SEQ ID NO: 175030 - DNA, 16 bp, H. sapiens
ttttaaaatctaatgt

SEQ ID NO: 175031 - DNA, 16 bp, H. sapiens
ttttaaaatctacaat

SEQ ID NO: 175032 - DNA, 16 bp, H. sapiens
ttttaaaatctctgcc

SEQ ID NO: 175033 - DNA, 16 bp, H. sapiens
ttttaaaatctgaaaa

SEQ ID NO: 175034 - DNA, 16 bp, H. sapiens
ttttaaaatgaaaaca

SEQ ID NO: 175035 - DNA, 16 bp, H. sapiens
ttttaaaatgaagaca

SEQ ID NO: 175036 - DNA, 16 bp, H. sapiens
ttttaaaatgaatgta

SEQ ID NO: 175037 - DNA, 16 bp, H. sapiens
ttttaaaatgacaaaa

SEQ ID NO: 175038 - DNA, 16 bp, H. sapiens
ttttaaaatgacattt

SEQ ID NO: 175039 - DNA, 16 bp, H. sapiens
ttttaaaatgacttct

SEQ ID NO: 175040 - DNA, 16 bp, H. sapiens
ttttaaaatgagaagt

SEQ ID NO: 175041 - DNA, 16 bp, H. sapiens
ttttaaaatgagcaaa

SEQ ID NO: 175042 - DNA, 16 bp, H. sapiens
ttttaaaatgagtaaa

SEQ ID NO: 175043 - DNA, 16 bp, H. sapiens
ttttaaaatgagttaa

SEQ ID NO: 175044 - DNA, 16 bp, H. sapiens
ttttaaaatgataatg

SEQ ID NO: 175045 - DNA, 16 bp, H. sapiens
ttttaaaatgatttct

SEQ ID NO: 175046 - DNA, 16 bp, H. sapiens
ttttaaaatgcaaatt

SEQ ID NO: 175047 - DNA, 16 bp, H. sapiens
ttttaaaatgcagatt

SEQ ID NO: 175048 - DNA, 16 bp, H. sapiens
ttttaaaatgcatttt

SEQ ID NO: 175049 - DNA, 16 bp, H. sapiens
ttttaaaatgctgctt

SEQ ID NO: 175050 - DNA, 16 bp, H. sapiens
ttttaaaatgctgttg

SEQ ID NO: 175051 - DNA, 16 bp, H. sapiens
ttttaaaatgcttgaa

SEQ ID NO: 175052 - DNA, 16 bp, H. sapiens
ttttaaaatgctttgt

SEQ ID NO: 175053 - DNA, 16 bp, H. sapiens
ttttaaaatgggaaat

SEQ ID NO: 175054 - DNA, 16 bp, H. sapiens
ttttaaaatggtttca

SEQ ID NO: 175055 - DNA, 16 bp, H. sapiens
ttttaaaatgtaactt

SEQ ID NO: 175056 - DNA, 16 bp, H. sapiens
ttttaaaatgtacatt

SEQ ID NO: 175057 - DNA, 16 bp, H. sapiens
ttttaaaatgtagaaa

SEQ ID NO: 175058 - DNA, 16 bp, H. sapiens
ttttaaaatgtatact

SEQ ID NO: 175059 - DNA, 16 bp, H. sapiens
ttttaaaatgtcattt

SEQ ID NO: 175060 - DNA, 16 bp, H. sapiens
ttttaaaatgtgcatg

SEQ ID NO: 175061 - DNA, 16 bp, H. sapiens
ttttaaaatgtgtaat

SEQ ID NO: 175062 - DNA, 16 bp, H. sapiens
ttttaaaatgtgtaca

SEQ ID NO: 175063 - DNA, 16 bp, H. sapiens
ttttaaaatgtgtata

SEQ ID NO: 175064 - DNA, 16 bp, H. sapiens
ttttaaaatgttagca

SEQ ID NO: 175065 - DNA, 16 bp, H. sapiens
ttttaaaattaacaca

SEQ ID NO: 175066 - DNA, 16 bp, H. sapiens
ttttaaaattacactt

SEQ ID NO: 175067 - DNA, 16 bp, H. sapiens
ttttaaaattagctag

SEQ ID NO: 175068 - DNA, 16 bp, H. sapiens
ttttaaaattatgact

SEQ ID NO: 175069 - DNA, 16 bp, H. sapiens
ttttaaaattcaaaag

SEQ ID NO: 175070 - DNA, 16 bp, H. sapiens
ttttaaaattcacctt

SEQ ID NO: 175071 - DNA, 16 bp, H. sapiens
ttttaaaattccaatt

SEQ ID NO: 175072 - DNA, 16 bp, H. sapiens
ttttaaaattccttct

SEQ ID NO: 175073 - DNA, 16 bp, H. sapiens
ttttaaaattctgctt

SEQ ID NO: 175074 - DNA, 16 bp, H. sapiens
ttttaaaattctgttt

SEQ ID NO: 175075 - DNA, 16 bp, H. sapiens
ttttaaaattgaggta

SEQ ID NO: 175076 - DNA, 16 bp, H. sapiens
ttttaaaattgattct

SEQ ID NO: 175077 - DNA, 16 bp, H. sapiens
ttttaaaattgcaaat

SEQ ID NO: 175078 - DNA, 16 bp, H. sapiens
ttttaaaattgcaatt

SEQ ID NO: 175079 - DNA, 16 bp, H. sapiens
ttttaaaattgctttt

SEQ ID NO: 175080 - DNA, 16 bp, H. sapiens
ttttaaaattggagaa

SEQ ID NO: 175081 - DNA, 16 bp, H. sapiens
ttttaaaattgtacat

SEQ ID NO: 175082 - DNA, 16 bp, H. sapiens
ttttaaaattgtcatt

SEQ ID NO: 175083 - DNA, 16 bp, H. sapiens
ttttaaaatttactga

SEQ ID NO: 175084 - DNA, 16 bp, H. sapiens
ttttaaaatttcaact

SEQ ID NO: 175085 - DNA, 16 bp, H. sapiens
ttttaaaatttgaatg

SEQ ID NO: 175086 - DNA, 16 bp, H. sapiens
ttttaaaatttgtctt

SEQ ID NO: 175087 - DNA, 16 bp, H. sapiens
ttttaaaatttttgct

SEQ ID NO: 175088 - DNA, 16 bp, H. sapiens
ttttaaacaaaatcat

SEQ ID NO: 175089 - DNA, 16 bp, H. sapiens
ttttaaacaaaatgaa

SEQ ID NO: 175090 - DNA, 16 bp, H. sapiens
ttttaaacaaaatttc

SEQ ID NO: 175091 - DNA, 16 bp, H. sapiens
ttttaaacaaagaatt

SEQ ID NO: 175092 - DNA, 16 bp, H. sapiens
ttttaaacaaatatgt

SEQ ID NO: 175093 - DNA, 16 bp, H. sapiens
ttttaaacaaatgtat

SEQ ID NO: 175094 - DNA, 16 bp, H. sapiens
ttttaaacaaccaaat

SEQ ID NO: 175095 - DNA, 16 bp, H. sapiens
ttttaaacaaccagat

SEQ ID NO: 175096 - DNA, 16 bp, H. sapiens
ttttaaacaatttgaa

SEQ ID NO: 175097 - DNA, 16 bp, H. sapiens
ttttaaacacagaaat

SEQ ID NO: 175098 - DNA, 16 bp, H. sapiens
ttttaaacagaatttt

SEQ ID NO: 175099 - DNA, 16 bp, H. sapiens
ttttaaacagagtttt

SEQ ID NO: 175100 - DNA, 16 bp, H. sapiens
ttttaaacaggaaaaa

SEQ ID NO: 175101 - DNA, 16 bp, H. sapiens
ttttaaacagttaaaa

SEQ ID NO: 175102 - DNA, 16 bp, H. sapiens
ttttaaacagtttttt

SEQ ID NO: 175103 - DNA, 16 bp, H. sapiens
ttttaaacataaaaag

SEQ ID NO: 175104 - DNA, 16 bp, H. sapiens
ttttaaacataaacat

SEQ ID NO: 175105 - DNA, 16 bp, H. sapiens
ttttaaacatacacaa

SEQ ID NO: 175106 - DNA, 16 bp, H. sapiens
ttttaaacatacattt

SEQ ID NO: 175107 - DNA, 16 bp, H. sapiens
ttttaaacatagaaaa

SEQ ID NO: 175108 - DNA, 16 bp, H. sapiens
ttttaaacatgtaaaa

SEQ ID NO: 175109 - DNA, 16 bp, H. sapiens
ttttaaacatgtaaat

SEQ ID NO: 175110 - DNA, 16 bp, H. sapiens
ttttaaacattgaaaa

SEQ ID NO: 175111 - DNA, 16 bp, H. sapiens
ttttaaacattgtttt

SEQ ID NO: 175112 - DNA, 16 bp, H. sapiens
ttttaaacatttagaa

SEQ ID NO: 175113 - DNA, 16 bp, H. sapiens
ttttaaacatttgatt

SEQ ID NO: 175114 - DNA, 16 bp, H. sapiens
ttttaaaccaaatttt

SEQ ID NO: 175115 - DNA, 16 bp, H. sapiens
ttttaaaccaccagat

SEQ ID NO: 175116 - DNA, 16 bp, H. sapiens
ttttaaactaaaaact

SEQ ID NO: 175117 - DNA, 16 bp, H. sapiens
ttttaaactagttttt

SEQ ID NO: 175118 - DNA, 16 bp, H. sapiens
ttttaaactatgaaat

SEQ ID NO: 175119 - DNA, 16 bp, H. sapiens
ttttaaactatgaatt

SEQ ID NO: 175120 - DNA, 16 bp, H. sapiens
ttttaaactatgtaaa

SEQ ID NO: 175121 - DNA, 16 bp, H. sapiens
ttttaaacttattttg

SEQ ID NO: 175122 - DNA, 16 bp, H. sapiens
ttttaaacttgatttt

SEQ ID NO: 175123 - DNA, 16 bp, H. sapiens
ttttaaactttctgaa

SEQ ID NO: 175124 - DNA, 16 bp, H. sapiens
ttttaaacttttagtt

SEQ ID NO: 175125 - DNA, 16 bp, H. sapiens
ttttaaagaaaaagca

SEQ ID NO: 175126 - DNA, 16 bp, H. sapiens
ttttaaagaaaaatgt

SEQ ID NO: 175127 - DNA, 16 bp, H. sapiens
ttttaaagaaaaattg

SEQ ID NO: 175128 - DNA, 16 bp, H. sapiens
ttttaaagaaaagttt

SEQ ID NO: 175129 - DNA, 16 bp, H. sapiens
ttttaaagaaaatcag

SEQ ID NO: 175130 - DNA, 16 bp, H. sapiens
ttttaaagaaacaaaa

SEQ ID NO: 175131 - DNA, 16 bp, H. sapiens
ttttaaagaaacatat

SEQ ID NO: 175132 - DNA, 16 bp, H. sapiens
ttttaaagaaactaaa

SEQ ID NO: 175133 - DNA, 16 bp, H. sapiens
ttttaaagaaacttta

SEQ ID NO: 175134 - DNA, 16 bp, H. sapiens
ttttaaagaaagaagt

SEQ ID NO: 175135 - DNA, 16 bp, H. sapiens
ttttaaagaaagagat

SEQ ID NO: 175136 - DNA, 16 bp, H. sapiens
ttttaaagaaaggaaa

SEQ ID NO: 175137 - DNA, 16 bp, H. sapiens
ttttaaagaaatagtt

SEQ ID NO: 175138 - DNA, 16 bp, H. sapiens
ttttaaagaaatatga

SEQ ID NO: 175139 - DNA, 16 bp, H. sapiens
ttttaaagaaatttcc

SEQ ID NO: 175140 - DNA, 16 bp, H. sapiens
ttttaaagaacaattt

SEQ ID NO: 175141 - DNA, 16 bp, H. sapiens
ttttaaagaacatctt

SEQ ID NO: 175142 - DNA, 16 bp, H. sapiens
ttttaaagaagcaaaa

SEQ ID NO: 175143 - DNA, 16 bp, H. sapiens
ttttaaagaagcatta

SEQ ID NO: 175144 - DNA, 16 bp, H. sapiens
ttttaaagaagtatat

SEQ ID NO: 175145 - DNA, 16 bp, H. sapiens
ttttaaagaagttatt

SEQ ID NO: 175146 - DNA, 16 bp, H. sapiens
ttttaaagaatgaaat

SEQ ID NO: 175147 - DNA, 16 bp, H. sapiens
ttttaaagaatgttga

SEQ ID NO: 175148 - DNA, 16 bp, H. sapiens
ttttaaagacaaaatt

SEQ ID NO: 175149 - DNA, 16 bp, H. sapiens
ttttaaagacaacttt

SEQ ID NO: 175150 - DNA, 16 bp, H. sapiens
ttttaaagacaatgaa

SEQ ID NO: 175151 - DNA, 16 bp, H. sapiens
ttttaaagacagtttt

SEQ ID NO: 175152 - DNA, 16 bp, H. sapiens
ttttaaagacatcttt

SEQ ID NO: 175153 - DNA, 16 bp, H. sapiens
ttttaaagacatgaaa

SEQ ID NO: 175154 - DNA, 16 bp, H. sapiens
ttttaaagagaaaagg

SEQ ID NO: 175155 - DNA, 16 bp, H. sapiens
ttttaaagagaaaatg

SEQ ID NO: 175156 - DNA, 16 bp, H. sapiens
ttttaaagagaagttt

SEQ ID NO: 175157 - DNA, 16 bp, H. sapiens
ttttaaagagacagga

SEQ ID NO: 175158 - DNA, 16 bp, H. sapiens
ttttaaagagacagtg

SEQ ID NO: 175159 - DNA, 16 bp, H. sapiens
ttttaaagagcagaaa

SEQ ID NO: 175160 - DNA, 16 bp, H. sapiens
ttttaaagagttaatt

SEQ ID NO: 175161 - DNA, 16 bp, H. sapiens
ttttaaagataagcaa

SEQ ID NO: 175162 - DNA, 16 bp, H. sapiens
ttttaaagatcaaatt

SEQ ID NO: 175163 - DNA, 16 bp, H. sapiens
ttttaaagatgaaatt

SEQ ID NO: 175164 - DNA, 16 bp, H. sapiens
ttttaaagatgaagga

SEQ ID NO: 175165 - DNA, 16 bp, H. sapiens
ttttaaagatgcagaa

SEQ ID NO: 175166 - DNA, 16 bp, H. sapiens
ttttaaagatggagtt

SEQ ID NO: 175167 - DNA, 16 bp, H. sapiens
ttttaaagatgtaaaa

SEQ ID NO: 175168 - DNA, 16 bp, H. sapiens
ttttaaagatgtcttt

SEQ ID NO: 175169 - DNA, 16 bp, H. sapiens
ttttaaagcaaaatgt

SEQ ID NO: 175170 - DNA, 16 bp, H. sapiens
ttttaaagcaaggaaa

SEQ ID NO: 175171 - DNA, 16 bp, H. sapiens
ttttaaagcaagtttt

SEQ ID NO: 175172 - DNA, 16 bp, H. sapiens
ttttaaagcactttaa

SEQ ID NO: 175173 - DNA, 16 bp, H. sapiens
ttttaaagcatctttt

SEQ ID NO: 175174 - DNA, 16 bp, H. sapiens
ttttaaagcattattt

SEQ ID NO: 175175 - DNA, 16 bp, H. sapiens
ttttaaagcattgttt

SEQ ID NO: 175176 - DNA, 16 bp, H. sapiens
ttttaaagcattttta

SEQ ID NO: 175177 - DNA, 16 bp, H. sapiens
ttttaaagccattatt

SEQ ID NO: 175178 - DNA, 16 bp, H. sapiens
ttttaaagctataaat

SEQ ID NO: 175179 - DNA, 16 bp, H. sapiens
ttttaaagcttcaaaa

SEQ ID NO: 175180 - DNA, 16 bp, H. sapiens
ttttaaagctttcttt

SEQ ID NO: 175181 - DNA, 16 bp, H. sapiens
ttttaaaggaaaaatg

SEQ ID NO: 175182 - DNA, 16 bp, H. sapiens
ttttaaaggaaaaatt

SEQ ID NO: 175183 - DNA, 16 bp, H. sapiens
ttttaaaggaaaacta

SEQ ID NO: 175184 - DNA, 16 bp, H. sapiens
ttttaaaggaaaagat

SEQ ID NO: 175185 - DNA, 16 bp, H. sapiens
ttttaaaggaaagagg

SEQ ID NO: 175186 - DNA, 16 bp, H. sapiens
ttttaaaggaaattaa

SEQ ID NO: 175187 - DNA, 16 bp, H. sapiens
ttttaaaggaaatttt

SEQ ID NO: 175188 - DNA, 16 bp, H. sapiens
ttttaaaggaagaaaa

SEQ ID NO: 175189 - DNA, 16 bp, H. sapiens
ttttaaaggaagaaag

SEQ ID NO: 175190 - DNA, 16 bp, H. sapiens
ttttaaaggaagttaa

SEQ ID NO: 175191 - DNA, 16 bp, H. sapiens
ttttaaaggaatcttt

SEQ ID NO: 175192 - DNA, 16 bp, H. sapiens
ttttaaaggacaattt

SEQ ID NO: 175193 - DNA, 16 bp, H. sapiens
ttttaaaggactccag

SEQ ID NO: 175194 - DNA, 16 bp, H. sapiens
ttttaaaggagaaaaa

SEQ ID NO: 175195 - DNA, 16 bp, H. sapiens
ttttaaaggctatttt

SEQ ID NO: 175196 - DNA, 16 bp, H. sapiens
ttttaaaggctgaata

SEQ ID NO: 175197 - DNA, 16 bp, H. sapiens
ttttaaaggcttattt

SEQ ID NO: 175198 - DNA, 16 bp, H. sapiens
ttttaaagggaaaaaa

SEQ ID NO: 175199 - DNA, 16 bp, H. sapiens
ttttaaaggtaaagaa

SEQ ID NO: 175200 - DNA, 16 bp, H. sapiens
ttttaaaggttaaaaa

SEQ ID NO: 175201 - DNA, 16 bp, H. sapiens
ttttaaaggttcattt

SEQ ID NO: 175202 - DNA, 16 bp, H. sapiens
ttttaaagtaaaaaca

SEQ ID NO: 175203 - DNA, 16 bp, H. sapiens
ttttaaagtaaatgtt

SEQ ID NO: 175204 - DNA, 16 bp, H. sapiens
ttttaaagtacataaa

SEQ ID NO: 175205 - DNA, 16 bp, H. sapiens
ttttaaagtacattat

SEQ ID NO: 175206 - DNA, 16 bp, H. sapiens
ttttaaagtacatttt

SEQ ID NO: 175207 - DNA, 16 bp, H. sapiens
ttttaaagtagaaaag

SEQ ID NO: 175208 - DNA, 16 bp, H. sapiens
ttttaaagtagctttt

SEQ ID NO: 175209 - DNA, 16 bp, H. sapiens
ttttaaagtatatgta

SEQ ID NO: 175210 - DNA, 16 bp, H. sapiens
ttttaaagtatatttc

SEQ ID NO: 175211 - DNA, 16 bp, H. sapiens
ttttaaagtattcatt

SEQ ID NO: 175212 - DNA, 16 bp, H. sapiens
ttttaaagtcaaaatt

SEQ ID NO: 175213 - DNA, 16 bp, H. sapiens
ttttaaagtcacattt

SEQ ID NO: 175214 - DNA, 16 bp, H. sapiens
ttttaaagtcactttt

SEQ ID NO: 175215 - DNA, 16 bp, H. sapiens
ttttaaagtcagaaaa

SEQ ID NO: 175216 - DNA, 16 bp, H. sapiens
ttttaaagtcagattt

SEQ ID NO: 175217 - DNA, 16 bp, H. sapiens
ttttaaagtcatgaaa

SEQ ID NO: 175218 - DNA, 16 bp, H. sapiens
ttttaaagtcatttta

SEQ ID NO: 175219 - DNA, 16 bp, H. sapiens
ttttaaagtcattttg

SEQ ID NO: 175220 - DNA, 16 bp, H. sapiens
ttttaaagtgattaaa

SEQ ID NO: 175221 - DNA, 16 bp, H. sapiens
ttttaaagtggcagtt

SEQ ID NO: 175222 - DNA, 16 bp, H. sapiens
ttttaaagtgtataaa

SEQ ID NO: 175223 - DNA, 16 bp, H. sapiens
ttttaaagttacattt

SEQ ID NO: 175224 - DNA, 16 bp, H. sapiens
ttttaaagttatcttt

SEQ ID NO: 175225 - DNA, 16 bp, H. sapiens
ttttaaagttattctt

SEQ ID NO: 175226 - DNA, 16 bp, H. sapiens
ttttaaagttctcttt

SEQ ID NO: 175227 - DNA, 16 bp, H. sapiens
ttttaaagttcttatt

SEQ ID NO: 175228 - DNA, 16 bp, H. sapiens
ttttaaagttgaaaaa

SEQ ID NO: 175229 - DNA, 16 bp, H. sapiens
ttttaaagtttaactt

SEQ ID NO: 175230 - DNA, 16 bp, H. sapiens
ttttaaagtttaagaa

SEQ ID NO: 175231 - DNA, 16 bp, H. sapiens
ttttaaagtttacttt

SEQ ID NO: 175232 - DNA, 16 bp, H. sapiens
ttttaaagtttccttt

SEQ ID NO: 175233 - DNA, 16 bp, H. sapiens
ttttaaagtttctctt

SEQ ID NO: 175234 - DNA, 16 bp, H. sapiens
ttttaaagtttcttca

SEQ ID NO: 175235 - DNA, 16 bp, H. sapiens
ttttaaagtttgcttt

SEQ ID NO: 175236 - DNA, 16 bp, H. sapiens
ttttaaagtttttcaa

SEQ ID NO: 175237 - DNA, 16 bp, H. sapiens
ttttaaagtttttctg

SEQ ID NO: 175238 - DNA, 16 bp, H. sapiens
ttttaaataaagatgg

SEQ ID NO: 175239 - DNA, 16 bp, H. sapiens
ttttaaataaagcatt

SEQ ID NO: 175240 - DNA, 16 bp, H. sapiens
ttttaaataaagtgtt

SEQ ID NO: 175241 - DNA, 16 bp, H. sapiens
ttttaaataaagttgt

SEQ ID NO: 175242 - DNA, 16 bp, H. sapiens
ttttaaataaatcaga

SEQ ID NO: 175243 - DNA, 16 bp, H. sapiens
ttttaaataaattgct

SEQ ID NO: 175244 - DNA, 16 bp, H. sapiens
ttttaaataacagaat

SEQ ID NO: 175245 - DNA, 16 bp, H. sapiens
ttttaaataacataca

SEQ ID NO: 175246 - DNA, 16 bp, H. sapiens
ttttaaataactgaaa

SEQ ID NO: 175247 - DNA, 16 bp, H. sapiens
ttttaaataagaaaac

SEQ ID NO: 175248 - DNA, 16 bp, H. sapiens
ttttaaataagctttt

SEQ ID NO: 175249 - DNA, 16 bp, H. sapiens
ttttaaataaggaaag

SEQ ID NO: 175250 - DNA, 16 bp, H. sapiens
ttttaaataaggaaat

SEQ ID NO: 175251 - DNA, 16 bp, H. sapiens
ttttaaataatgcatt

SEQ ID NO: 175252 - DNA, 16 bp, H. sapiens
ttttaaatacaacttt

SEQ ID NO: 175253 - DNA, 16 bp, H. sapiens
ttttaaatacacattt

SEQ ID NO: 175254 - DNA, 16 bp, H. sapiens
ttttaaatacagaaaa

SEQ ID NO: 175255 - DNA, 16 bp, H. sapiens
ttttaaatacatggaa

SEQ ID NO: 175256 - DNA, 16 bp, H. sapiens
ttttaaatacatgttt

SEQ ID NO: 175257 - DNA, 16 bp, H. sapiens
ttttaaatacattgaa

SEQ ID NO: 175258 - DNA, 16 bp, H. sapiens
ttttaaatactgcttt

SEQ ID NO: 175259 - DNA, 16 bp, H. sapiens
ttttaaatactgtaaa

SEQ ID NO: 175260 - DNA, 16 bp, H. sapiens
ttttaaatagaaacaa

SEQ ID NO: 175261 - DNA, 16 bp, H. sapiens
ttttaaatagaaactt

SEQ ID NO: 175262 - DNA, 16 bp, H. sapiens
ttttaaatagtttttc

SEQ ID NO: 175263 - DNA, 16 bp, H. sapiens
ttttaaatatacttca

SEQ ID NO: 175264 - DNA, 16 bp, H. sapiens
ttttaaatatagcatt

SEQ ID NO: 175265 - DNA, 16 bp, H. sapiens
ttttaaatatgccttt

SEQ ID NO: 175266 - DNA, 16 bp, H. sapiens
ttttaaatatgcttaa

SEQ ID NO: 175267 - DNA, 16 bp, H. sapiens
ttttaaatatgtcttt

SEQ ID NO: 175268 - DNA, 16 bp, H. sapiens
ttttaaatatgtgaaa

SEQ ID NO: 175269 - DNA, 16 bp, H. sapiens
ttttaaatatgttcaa

SEQ ID NO: 175270 - DNA, 16 bp, H. sapiens
ttttaaatatgtttct

SEQ ID NO: 175271 - DNA, 16 bp, H. sapiens
ttttaaatattgcaaa

SEQ ID NO: 175272 - DNA, 16 bp, H. sapiens
ttttaaatcacagaaa

SEQ ID NO: 175273 - DNA, 16 bp, H. sapiens
ttttaaatcaggtaag

SEQ ID NO: 175274 - DNA, 16 bp, H. sapiens
ttttaaatcatgaatt

SEQ ID NO: 175275 - DNA, 16 bp, H. sapiens
ttttaaatcatttgaa

SEQ ID NO: 175276 - DNA, 16 bp, H. sapiens
ttttaaatcctcattt

SEQ ID NO: 175277 - DNA, 16 bp, H. sapiens
ttttaaatctatatgt

SEQ ID NO: 175278 - DNA, 16 bp, H. sapiens
ttttaaatctcaaatt

SEQ ID NO: 175279 - DNA, 16 bp, H. sapiens
ttttaaatctgatttt

SEQ ID NO: 175280 - DNA, 16 bp, H. sapiens
ttttaaatctgcttta

SEQ ID NO: 175281 - DNA, 16 bp, H. sapiens
ttttaaatctgctttt

SEQ ID NO: 175282 - DNA, 16 bp, H. sapiens
ttttaaatctgtaaat

SEQ ID NO: 175283 - DNA, 16 bp, H. sapiens
ttttaaatgaaaagtt

SEQ ID NO: 175284 - DNA, 16 bp, H. sapiens
ttttaaatgaaacata

SEQ ID NO: 175285 - DNA, 16 bp, H. sapiens
ttttaaatgaacaaat

SEQ ID NO: 175286 - DNA, 16 bp, H. sapiens
ttttaaatgaatacat

SEQ ID NO: 175287 - DNA, 16 bp, H. sapiens
ttttaaatgacaaaat

SEQ ID NO: 175288 - DNA, 16 bp, H. sapiens
ttttaaatgacaatat

SEQ ID NO: 175289 - DNA, 16 bp, H. sapiens
ttttaaatgacatttt

SEQ ID NO: 175290 - DNA, 16 bp, H. sapiens
ttttaaatgaccagat

SEQ ID NO: 175291 - DNA, 16 bp, H. sapiens
ttttaaatgacttttt

SEQ ID NO: 175292 - DNA, 16 bp, H. sapiens
ttttaaatgagcattt

SEQ ID NO: 175293 - DNA, 16 bp, H. sapiens
ttttaaatgatcaaaa

SEQ ID NO: 175294 - DNA, 16 bp, H. sapiens
ttttaaatgatcagat

SEQ ID NO: 175295 - DNA, 16 bp, H. sapiens
ttttaaatgattgata

SEQ ID NO: 175296 - DNA, 16 bp, H. sapiens
ttttaaatgattggaa

SEQ ID NO: 175297 - DNA, 16 bp, H. sapiens
ttttaaatgatttctt

SEQ ID NO: 175298 - DNA, 16 bp, H. sapiens
ttttaaatgattttac

SEQ ID NO: 175299 - DNA, 16 bp, H. sapiens
ttttaaatgcaaaaca

SEQ ID NO: 175300 - DNA, 16 bp, H. sapiens
ttttaaatgcaaaata

SEQ ID NO: 175301 - DNA, 16 bp, H. sapiens
ttttaaatgcacaaaa

SEQ ID NO: 175302 - DNA, 16 bp, H. sapiens
ttttaaatgcatgaaa

SEQ ID NO: 175303 - DNA, 16 bp, H. sapiens
ttttaaatgctctttt

SEQ ID NO: 175304 - DNA, 16 bp, H. sapiens
ttttaaatgctgaaaa

SEQ ID NO: 175305 - DNA, 16 bp, H. sapiens
ttttaaatgcttattt

SEQ ID NO: 175306 - DNA, 16 bp, H. sapiens
ttttaaatgctttgaa

SEQ ID NO: 175307 - DNA, 16 bp, H. sapiens
ttttaaatggaaaata

SEQ ID NO: 175308 - DNA, 16 bp, H. sapiens
ttttaaatggcaaaat

SEQ ID NO: 175309 - DNA, 16 bp, H. sapiens
ttttaaatggctgcat

SEQ ID NO: 175310 - DNA, 16 bp, H. sapiens
ttttaaatgggagaaa

SEQ ID NO: 175311 - DNA, 16 bp, H. sapiens
ttttaaatgggattat

SEQ ID NO: 175312 - DNA, 16 bp, H. sapiens
ttttaaatggtgattt

SEQ ID NO: 175313 - DNA, 16 bp, H. sapiens
ttttaaatgtaaatga

SEQ ID NO: 175314 - DNA, 16 bp, H. sapiens
ttttaaatgtaacatt

SEQ ID NO: 175315 - DNA, 16 bp, H. sapiens
ttttaaatgtaagaat

SEQ ID NO: 175316 - DNA, 16 bp, H. sapiens
ttttaaatgtaatgaa

SEQ ID NO: 175317 - DNA, 16 bp, H. sapiens
ttttaaatgtacagtt

SEQ ID NO: 175318 - DNA, 16 bp, H. sapiens
ttttaaatgtagaaaa

SEQ ID NO: 175319 - DNA, 16 bp, H. sapiens
ttttaaatgtattgag

SEQ ID NO: 175320 - DNA, 16 bp, H. sapiens
ttttaaatgtcataaa

SEQ ID NO: 175321 - DNA, 16 bp, H. sapiens
ttttaaatgtcatgta

SEQ ID NO: 175322 - DNA, 16 bp, H. sapiens
ttttaaatgtctataa

SEQ ID NO: 175323 - DNA, 16 bp, H. sapiens
ttttaaatgtctcttt

SEQ ID NO: 175324 - DNA, 16 bp, H. sapiens
ttttaaatgtgaaatt

SEQ ID NO: 175325 - DNA, 16 bp, H. sapiens
ttttaaatgtgtcttt

SEQ ID NO: 175326 - DNA, 16 bp, H. sapiens
ttttaaatgtgtgtgt

SEQ ID NO: 175327 - DNA, 16 bp, H. sapiens
ttttaaatgtgttgag

SEQ ID NO: 175328 - DNA, 16 bp, H. sapiens
ttttaaatgtgttgct

SEQ ID NO: 175329 - DNA, 16 bp, H. sapiens
ttttaaatgttacttt

SEQ ID NO: 175330 - DNA, 16 bp, H. sapiens
ttttaaatgttatttc

SEQ ID NO: 175331 - DNA, 16 bp, H. sapiens
ttttaaatgttctcag

SEQ ID NO: 175332 - DNA, 16 bp, H. sapiens
ttttaaatgttcttca

SEQ ID NO: 175333 - DNA, 16 bp, H. sapiens
ttttaaatgttgacaa

SEQ ID NO: 175334 - DNA, 16 bp, H. sapiens
ttttaaatgttggctc

SEQ ID NO: 175335 - DNA, 16 bp, H. sapiens
ttttaaatgtttctta

SEQ ID NO: 175336 - DNA, 16 bp, H. sapiens
ttttaaatgttttaca

SEQ ID NO: 175337 - DNA, 16 bp, H. sapiens
ttttaaatgttttcac

SEQ ID NO: 175338 - DNA, 16 bp, H. sapiens
ttttaaattaaaagtg

SEQ ID NO: 175339 - DNA, 16 bp, H. sapiens
ttttaaattaagaagt

SEQ ID NO: 175340 - DNA, 16 bp, H. sapiens
ttttaaattaaggtaa

SEQ ID NO: 175341 - DNA, 16 bp, H. sapiens
ttttaaattacagtat

SEQ ID NO: 175342 - DNA, 16 bp, H. sapiens
ttttaaattagcattt

SEQ ID NO: 175343 - DNA, 16 bp, H. sapiens
ttttaaattatgcttt

SEQ ID NO: 175344 - DNA, 17 bp, H. sapiens
ttttaaattatggccat

SEQ ID NO: 175345 - DNA, 16 bp, H. sapiens
ttttaaattcagaaat

SEQ ID NO: 175346 - DNA, 16 bp, H. sapiens
ttttaaattcagtttg

SEQ ID NO: 175347 - DNA, 16 bp, H. sapiens
ttttaaattcatgttt

SEQ ID NO: 175348 - DNA, 16 bp, H. sapiens
ttttaaattctaaaca

SEQ ID NO: 175349 - DNA, 16 bp, H. sapiens
ttttaaattctgtaat

SEQ ID NO: 175350 - DNA, 16 bp, H. sapiens
ttttaaattcttcaaa

SEQ ID NO: 175351 - DNA, 16 bp, H. sapiens
ttttaaattgccattt

SEQ ID NO: 175352 - DNA, 16 bp, H. sapiens
ttttaaattgcctttg

SEQ ID NO: 175353 - DNA, 16 bp, H. sapiens
ttttaaattgctaaaa

SEQ ID NO: 175354 - DNA, 16 bp, H. sapiens
ttttaaattgctaaat

SEQ ID NO: 175355 - DNA, 16 bp, H. sapiens
ttttaaattgtacttt

SEQ ID NO: 175356 - DNA, 16 bp, H. sapiens
ttttaaattgtcaaaa

SEQ ID NO: 175357 - DNA, 16 bp, H. sapiens
ttttaaattgtcacat

SEQ ID NO: 175358 - DNA, 16 bp, H. sapiens
ttttaaattgtgaaat

SEQ ID NO: 175359 - DNA, 16 bp, H. sapiens
ttttaaattgtgcatt

SEQ ID NO: 175360 - DNA, 16 bp, H. sapiens
ttttaaattgttttca

SEQ ID NO: 175361 - DNA, 16 bp, H. sapiens
ttttaaatttcacaaa

SEQ ID NO: 175362 - DNA, 16 bp, H. sapiens
ttttaaatttcagctt

SEQ ID NO: 175363 - DNA, 16 bp, H. sapiens
ttttaaatttgcaatt

SEQ ID NO: 175364 - DNA, 16 bp, H. sapiens
ttttaaattttctagt

SEQ ID NO: 175365 - DNA, 16 bp, H. sapiens
ttttaaatttttgtca

SEQ ID NO: 175366 - DNA, 16 bp, H. sapiens
ttttaacaaaagaaga

SEQ ID NO: 175367 - DNA, 16 bp, H. sapiens
ttttaacaaaaggagg

SEQ ID NO: 175368 - DNA, 16 bp, H. sapiens
ttttaacaaaggaaaa

SEQ ID NO: 175369 - DNA, 16 bp, H. sapiens
ttttaacaagttattt

SEQ ID NO: 175370 - DNA, 16 bp, H. sapiens
ttttaacaatgttgat

SEQ ID NO: 175371 - DNA, 16 bp, H. sapiens
ttttaacacagaaata

SEQ ID NO: 175372 - DNA, 16 bp, H. sapiens
ttttaacagaaataaa

SEQ ID NO: 175373 - DNA, 16 bp, H. sapiens
ttttaacagctttatt

SEQ ID NO: 175374 - DNA, 16 bp, H. sapiens
ttttaacagtgagaaa

SEQ ID NO: 175375 - DNA, 16 bp, H. sapiens
ttttaacataaaatgt

SEQ ID NO: 175376 - DNA, 16 bp, H. sapiens
ttttaacataaagaaa

SEQ ID NO: 175377 - DNA, 16 bp, H. sapiens
ttttaacatctttgaa

SEQ ID NO: 175378 - DNA, 16 bp, H. sapiens
ttttaacatgcatttt

SEQ ID NO: 175379 - DNA, 16 bp, H. sapiens
ttttaacatgttttat

SEQ ID NO: 175380 - DNA, 16 bp, H. sapiens
ttttaacattcaaaat

SEQ ID NO: 175381 - DNA, 16 bp, H. sapiens
ttttaacattgtaaaa

SEQ ID NO: 175382 - DNA, 16 bp, H. sapiens
ttttaacatttgaaat

SEQ ID NO: 175383 - DNA, 16 bp, H. sapiens
ttttaaccacttttaa

SEQ ID NO: 175384 - DNA, 16 bp, H. sapiens
ttttaaccattttaag

SEQ ID NO: 175385 - DNA, 16 bp, H. sapiens
ttttaacctctctgtg

SEQ ID NO: 175386 - DNA, 16 bp, H. sapiens
ttttaaccttggtgaa

SEQ ID NO: 175387 - DNA, 16 bp, H. sapiens
ttttaactctagaatt

SEQ ID NO: 175388 - DNA, 16 bp, H. sapiens
ttttaactgaatattt

SEQ ID NO: 175389 - DNA, 16 bp, H. sapiens
ttttaactgttttata

SEQ ID NO: 175390 - DNA, 16 bp, H. sapiens
ttttaacttagaaaaa

SEQ ID NO: 175391 - DNA, 16 bp, H. sapiens
ttttaactttataggt

SEQ ID NO: 175392 - DNA, 16 bp, H. sapiens
ttttaacttttcaaag

SEQ ID NO: 175393 - DNA, 16 bp, H. sapiens
ttttaacttttgaaat

SEQ ID NO: 175394 - DNA, 16 bp, H. sapiens
ttttaactttttaagt

SEQ ID NO: 175395 - DNA, 16 bp, H. sapiens
ttttaactttttgaga

SEQ ID NO: 175396 - DNA, 16 bp, H. sapiens
ttttaagaaaaaagca

SEQ ID NO: 175397 - DNA, 16 bp, H. sapiens
ttttaagaaaaacaaa

SEQ ID NO: 175398 - DNA, 16 bp, H. sapiens
ttttaagaaaacaaat

SEQ ID NO: 175399 - DNA, 16 bp, H. sapiens
ttttaagaaaacaata

SEQ ID NO: 175400 - DNA, 16 bp, H. sapiens
ttttaagaaaacattt

SEQ ID NO: 175401 - DNA, 16 bp, H. sapiens
ttttaagaaaaccaaa

SEQ ID NO: 175402 - DNA, 16 bp, H. sapiens
ttttaagaaaatagtt

SEQ ID NO: 175403 - DNA, 16 bp, H. sapiens
ttttaagaaaatcaat

SEQ ID NO: 175404 - DNA, 16 bp, H. sapiens
ttttaagaaactagaa

SEQ ID NO: 175405 - DNA, 16 bp, H. sapiens
ttttaagaaactgaca

SEQ ID NO: 175406 - DNA, 16 bp, H. sapiens
ttttaagaaagaagaa

SEQ ID NO: 175407 - DNA, 16 bp, H. sapiens
ttttaagaaagaatca

SEQ ID NO: 175408 - DNA, 16 bp, H. sapiens
ttttaagaaagtgatt

SEQ ID NO: 175409 - DNA, 16 bp, H. sapiens
ttttaagaaatagttt

SEQ ID NO: 175410 - DNA, 16 bp, H. sapiens
ttttaagaaatattct

SEQ ID NO: 175411 - DNA, 16 bp, H. sapiens
ttttaagaaatggggt

SEQ ID NO: 175412 - DNA, 16 bp, H. sapiens
ttttaagaaattaaag

SEQ ID NO: 175413 - DNA, 16 bp, H. sapiens
ttttaagaagaaaaca

SEQ ID NO: 175414 - DNA, 16 bp, H. sapiens
ttttaagaagaaaaga

SEQ ID NO: 175415 - DNA, 16 bp, H. sapiens
ttttaagaagaaagaa

SEQ ID NO: 175416 - DNA, 16 bp, H. sapiens
ttttaagaagaggaga

SEQ ID NO: 175417 - DNA, 16 bp, H. sapiens
ttttaagaagcatttt

SEQ ID NO: 175418 - DNA, 16 bp, H. sapiens
ttttaagaaggaaaaa

SEQ ID NO: 175419 - DNA, 16 bp, H. sapiens
ttttaagaagggacaa

SEQ ID NO: 175420 - DNA, 16 bp, H. sapiens
ttttaagaagtatctg

SEQ ID NO: 175421 - DNA, 16 bp, H. sapiens
ttttaagaagtctttt

SEQ ID NO: 175422 - DNA, 16 bp, H. sapiens
ttttaagaatgaaaat

SEQ ID NO: 175423 - DNA, 16 bp, H. sapiens
ttttaagaatgaagaa

SEQ ID NO: 175424 - DNA, 16 bp, H. sapiens
ttttaagaattcttta

SEQ ID NO: 175425 - DNA, 16 bp, H. sapiens
ttttaagacaaagtct

SEQ ID NO: 175426 - DNA, 16 bp, H. sapiens
ttttaagacagagtcc

SEQ ID NO: 175427 - DNA, 16 bp, H. sapiens
ttttaagacagtatct

SEQ ID NO: 175428 - DNA, 16 bp, H. sapiens
ttttaagacattttaa

SEQ ID NO: 175429 - DNA, 16 bp, H. sapiens
ttttaagactttttaa

SEQ ID NO: 175430 - DNA, 16 bp, H. sapiens
ttttaagagaaaattt

SEQ ID NO: 175431 - DNA, 16 bp, H. sapiens
ttttaagagatggagt

SEQ ID NO: 175432 - DNA, 16 bp, H. sapiens
ttttaagataaacatt

SEQ ID NO: 175433 - DNA, 16 bp, H. sapiens
ttttaagataacattt

SEQ ID NO: 175434 - DNA, 16 bp, H. sapiens
ttttaagatgggatct

SEQ ID NO: 175435 - DNA, 16 bp, H. sapiens
ttttaagatttccttt

SEQ ID NO: 175436 - DNA, 16 bp, H. sapiens
ttttaagattttaaag

SEQ ID NO: 175437 - DNA, 16 bp, H. sapiens
ttttaagattttctct

SEQ ID NO: 175438 - DNA, 16 bp, H. sapiens
ttttaagatttttctc

SEQ ID NO: 175439 - DNA, 16 bp, H. sapiens
ttttaagcacatttta

SEQ ID NO: 175440 - DNA, 16 bp, H. sapiens
ttttaagcactttaaa

SEQ ID NO: 175441 - DNA, 16 bp, H. sapiens
ttttaagcaggaaagt

SEQ ID NO: 175442 - DNA, 16 bp, H. sapiens
ttttaagcattaaaaa

SEQ ID NO: 175443 - DNA, 16 bp, H. sapiens
ttttaagcatttaaat

SEQ ID NO: 175444 - DNA, 16 bp, H. sapiens
ttttaagcatttttat

SEQ ID NO: 175445 - DNA, 16 bp, H. sapiens
ttttaagccactaggt

SEQ ID NO: 175446 - DNA, 16 bp, H. sapiens
ttttaagcccactgtt

SEQ ID NO: 175447 - DNA, 16 bp, H. sapiens
ttttaagctgatagca

SEQ ID NO: 175448 - DNA, 16 bp, H. sapiens
ttttaagctttttaaa

SEQ ID NO: 175449 - DNA, 16 bp, H. sapiens
ttttaaggaaaaaagt

SEQ ID NO: 175450 - DNA, 16 bp, H. sapiens
ttttaaggaaaataat

SEQ ID NO: 175451 - DNA, 16 bp, H. sapiens
ttttaaggaaagaaaa

SEQ ID NO: 175452 - DNA, 16 bp, H. sapiens
ttttaaggaaatgaaa

SEQ ID NO: 175453 - DNA, 16 bp, H. sapiens
ttttaaggaagaaaat

SEQ ID NO: 175454 - DNA, 16 bp, H. sapiens
ttttaaggaagaaata

SEQ ID NO: 175455 - DNA, 16 bp, H. sapiens
ttttaaggagaaaaat

SEQ ID NO: 175456 - DNA, 16 bp, H. sapiens
ttttaaggcttttgat

SEQ ID NO: 175457 - DNA, 16 bp, H. sapiens
ttttaagggtacagtt

SEQ ID NO: 175458 - DNA, 16 bp, H. sapiens
ttttaagtaaacaaaa

SEQ ID NO: 175459 - DNA, 16 bp, H. sapiens
ttttaagtaacttttt

SEQ ID NO: 175460 - DNA, 16 bp, H. sapiens
ttttaagtactttaaa

SEQ ID NO: 175461 - DNA, 16 bp, H. sapiens
ttttaagtatgttaaa

SEQ ID NO: 175462 - DNA, 16 bp, H. sapiens
ttttaagtatttggct

SEQ ID NO: 175463 - DNA, 16 bp, H. sapiens
ttttaagtcatttaaa

SEQ ID NO: 175464 - DNA, 16 bp, H. sapiens
ttttaagtctaatttt

SEQ ID NO: 175465 - DNA, 16 bp, H. sapiens
ttttaagtctgttttg

SEQ ID NO: 175466 - DNA, 16 bp, H. sapiens
ttttaagtgaaaagaa

SEQ ID NO: 175467 - DNA, 16 bp, H. sapiens
ttttaagtgaagaaaa

SEQ ID NO: 175468 - DNA, 16 bp, H. sapiens
ttttaagtgacttttt

SEQ ID NO: 175469 - DNA, 16 bp, H. sapiens
ttttaagtgcacagtt

SEQ ID NO: 175470 - DNA, 16 bp, H. sapiens
ttttaagtggaaaaaa

SEQ ID NO: 175471 - DNA, 16 bp, H. sapiens
ttttaagtggttaaaa

SEQ ID NO: 175472 - DNA, 16 bp, H. sapiens
ttttaagtgtacagtt

SEQ ID NO: 175473 - DNA, 16 bp, H. sapiens
ttttaagtgtttaaaa

SEQ ID NO: 175474 - DNA, 16 bp, H. sapiens
ttttaagttacaaaaa

SEQ ID NO: 175475 - DNA, 16 bp, H. sapiens
ttttaagttccttgag

SEQ ID NO: 175476 - DNA, 16 bp, H. sapiens
ttttaagttctgggat

SEQ ID NO: 175477 - DNA, 16 bp, H. sapiens
ttttaagttgactttt

SEQ ID NO: 175478 - DNA, 16 bp, H. sapiens
ttttaagttttcaaaa

SEQ ID NO: 175479 - DNA, 16 bp, H. sapiens
ttttaagttttctagt

SEQ ID NO: 175480 - DNA, 16 bp, H. sapiens
ttttaataaaaatggg

SEQ ID NO: 175481 - DNA, 16 bp, H. sapiens
ttttaataaaatgtga

SEQ ID NO: 175482 - DNA, 16 bp, H. sapiens
ttttaataaagtttca

SEQ ID NO: 175483 - DNA, 16 bp, H. sapiens
ttttaataaatgcttt

SEQ ID NO: 175484 - DNA, 16 bp, H. sapiens
ttttaataaatgtcat

SEQ ID NO: 175485 - DNA, 16 bp, H. sapiens
ttttaataacatttgt

SEQ ID NO: 175486 - DNA, 16 bp, H. sapiens
ttttaataagccctcc

SEQ ID NO: 175487 - DNA, 17 bp, H. sapiens
ttttaataatcaccatt

SEQ ID NO: 175488 - DNA, 16 bp, H. sapiens
ttttaataattatgct

SEQ ID NO: 175489 - DNA, 16 bp, H. sapiens
ttttaatacagaaaaa

SEQ ID NO: 175490 - DNA, 16 bp, H. sapiens
ttttaatacagttttt

SEQ ID NO: 175491 - DNA, 16 bp, H. sapiens
ttttaatacattttga

SEQ ID NO: 175492 - DNA, 17 bp, H. sapiens
ttttaatactttaagtt

SEQ ID NO: 175493 - DNA, 16 bp, H. sapiens
ttttaatagacacggg

SEQ ID NO: 175494 - DNA, 16 bp, H. sapiens
ttttaatagactttat

SEQ ID NO: 175495 - DNA, 16 bp, H. sapiens
ttttaatagacttttt

SEQ ID NO: 175496 - DNA, 16 bp, H. sapiens
ttttaatagagacgag

SEQ ID NO: 175497 - DNA, 16 bp, H. sapiens
ttttaatagatacaga

SEQ ID NO: 175498 - DNA, 16 bp, H. sapiens
ttttaatagccttttc

SEQ ID NO: 175499 - DNA, 16 bp, H. sapiens
ttttaatagctaaata

SEQ ID NO: 175500 - DNA, 16 bp, H. sapiens
ttttaataggcatttc

SEQ ID NO: 175501 - DNA, 16 bp, H. sapiens
ttttaatagtagccat

SEQ ID NO: 175502 - DNA, 16 bp, H. sapiens
ttttaatatgcttgtt

SEQ ID NO: 175503 - DNA, 16 bp, H. sapiens
ttttaatatgtctgtt

SEQ ID NO: 175504 - DNA, 16 bp, H. sapiens
ttttaatattagccat

SEQ ID NO: 175505 - DNA, 16 bp, H. sapiens
ttttaatattctgtgt

SEQ ID NO: 175506 - DNA, 16 bp, H. sapiens
ttttaatatttacatg

SEQ ID NO: 175507 - DNA, 16 bp, H. sapiens
ttttaatattttcaga

SEQ ID NO: 175508 - DNA, 16 bp, H. sapiens
ttttaatcaaatgttt

SEQ ID NO: 175509 - DNA, 16 bp, H. sapiens
ttttaatcaccatttt

SEQ ID NO: 175510 - DNA, 16 bp, H. sapiens
ttttaatcatgaatgg

SEQ ID NO: 175511 - DNA, 16 bp, H. sapiens
ttttaatcattgccat

SEQ ID NO: 175512 - DNA, 16 bp, H. sapiens
ttttaatcattttgat

SEQ ID NO: 175513 - DNA, 16 bp, H. sapiens
ttttaatccatatttc

SEQ ID NO: 175514 - DNA, 16 bp, H. sapiens
ttttaatcccaatttt

SEQ ID NO: 175515 - DNA, 16 bp, H. sapiens
ttttaatctatagatt

SEQ ID NO: 175516 - DNA, 16 bp, H. sapiens
ttttaatctcaaaata

SEQ ID NO: 175517 - DNA, 16 bp, H. sapiens
ttttaatctgtatttc

SEQ ID NO: 175518 - DNA, 16 bp, H. sapiens
ttttaatgaaaaagtt

SEQ ID NO: 175519 - DNA, 16 bp, H. sapiens
ttttaatgaaaagaga

SEQ ID NO: 175520 - DNA, 16 bp, H. sapiens
ttttaatgaaaggaaa

SEQ ID NO: 175521 - DNA, 16 bp, H. sapiens
ttttaatgaaatgaaa

SEQ ID NO: 175522 - DNA, 16 bp, H. sapiens
ttttaatgaaatgata

SEQ ID NO: 175523 - DNA, 16 bp, H. sapiens
ttttaatgaacaaatg

SEQ ID NO: 175524 - DNA, 16 bp, H. sapiens
ttttaatgaacataaa

SEQ ID NO: 175525 - DNA, 16 bp, H. sapiens
ttttaatgaagttgtt

SEQ ID NO: 175526 - DNA, 16 bp, H. sapiens
ttttaatgaatttcaa

SEQ ID NO: 175527 - DNA, 16 bp, H. sapiens
ttttaatgaattttca

SEQ ID NO: 175528 - DNA, 16 bp, H. sapiens
ttttaatgactgcata

SEQ ID NO: 175529 - DNA, 16 bp, H. sapiens
ttttaatgaggatttt

SEQ ID NO: 175530 - DNA, 16 bp, H. sapiens
ttttaatgagtaaaaa

SEQ ID NO: 175531 - DNA, 16 bp, H. sapiens
ttttaatgcattaaaa

SEQ ID NO: 175532 - DNA, 16 bp, H. sapiens
ttttaatgctttaaat

SEQ ID NO: 175533 - DNA, 16 bp, H. sapiens
ttttaatggaaaataa

SEQ ID NO: 175534 - DNA, 16 bp, H. sapiens
ttttaatggaaaattt

SEQ ID NO: 175535 - DNA, 16 bp, H. sapiens
ttttaatggaacattt

SEQ ID NO: 175536 - DNA, 16 bp, H. sapiens
ttttaatggagaaaaa

SEQ ID NO: 175537 - DNA, 16 bp, H. sapiens
ttttaatggagttgtt

SEQ ID NO: 175538 - DNA, 16 bp, H. sapiens
ttttaatggtgaaaac

SEQ ID NO: 175539 - DNA, 16 bp, H. sapiens
ttttaatgtaaacaaa

SEQ ID NO: 175540 - DNA, 16 bp, H. sapiens
ttttaatgtaatcatt

SEQ ID NO: 175541 - DNA, 16 bp, H. sapiens
ttttaatgtagctact

SEQ ID NO: 175542 - DNA, 16 bp, H. sapiens
ttttaatgtatagaaa

SEQ ID NO: 175543 - DNA, 16 bp, H. sapiens
ttttaatgtatctatt

SEQ ID NO: 175544 - DNA, 16 bp, H. sapiens
ttttaatgtcattatt

SEQ ID NO: 175545 - DNA, 16 bp, H. sapiens
ttttaatgtctcattt

SEQ ID NO: 175546 - DNA, 16 bp, H. sapiens
ttttaatgtgcttgtt

SEQ ID NO: 175547 - DNA, 16 bp, H. sapiens
ttttaatgtggaaaaa

SEQ ID NO: 175548 - DNA, 16 bp, H. sapiens
ttttaatgtggtatat

SEQ ID NO: 175549 - DNA, 16 bp, H. sapiens
ttttaatgttaacttt

SEQ ID NO: 175550 - DNA, 16 bp, H. sapiens
ttttaatgttaagtct

SEQ ID NO: 175551 - DNA, 16 bp, H. sapiens
ttttaatgttttaact

SEQ ID NO: 175552 - DNA, 16 bp, H. sapiens
ttttaattagagaaaa

SEQ ID NO: 175553 - DNA, 16 bp, H. sapiens
ttttaattatgtacat

SEQ ID NO: 175554 - DNA, 16 bp, H. sapiens
ttttaattatgtgaaa

SEQ ID NO: 175555 - DNA, 16 bp, H. sapiens
ttttaattcaaaacat

SEQ ID NO: 175556 - DNA, 16 bp, H. sapiens
ttttaattcacatttc

SEQ ID NO: 175557 - DNA, 16 bp, H. sapiens
ttttaattcagcaaat

SEQ ID NO: 175558 - DNA, 16 bp, H. sapiens
ttttaattcagtttta

SEQ ID NO: 175559 - DNA, 16 bp, H. sapiens
ttttaattcatcttga

SEQ ID NO: 175560 - DNA, 16 bp, H. sapiens
ttttaattcatttgaa

SEQ ID NO: 175561 - DNA, 16 bp, H. sapiens
ttttaattctaaatgt

SEQ ID NO: 175562 - DNA, 16 bp, H. sapiens
ttttaattctagaatt

SEQ ID NO: 175563 - DNA, 16 bp, H. sapiens
ttttaattctgttgat

SEQ ID NO: 175564 - DNA, 16 bp, H. sapiens
ttttaattcttatgaa

SEQ ID NO: 175565 - DNA, 16 bp, H. sapiens
ttttaattgacaagta

SEQ ID NO: 175566 - DNA, 16 bp, H. sapiens
ttttaattgagcattt

SEQ ID NO: 175567 - DNA, 16 bp, H. sapiens
ttttaattgaggcaga

SEQ ID NO: 175568 - DNA, 16 bp, H. sapiens
ttttaattgaggtata

SEQ ID NO: 175569 - DNA, 16 bp, H. sapiens
ttttaattgcatttcc

SEQ ID NO: 175570 - DNA, 16 bp, H. sapiens
ttttaattgggatatt

SEQ ID NO: 175571 - DNA, 16 bp, H. sapiens
ttttaatttcagaaaa

SEQ ID NO: 175572 - DNA, 16 bp, H. sapiens
ttttaatttcaggaaa

SEQ ID NO: 175573 - DNA, 16 bp, H. sapiens
ttttaatttctcaaaa

SEQ ID NO: 175574 - DNA, 16 bp, H. sapiens
ttttaatttctgaaaa

SEQ ID NO: 175575 - DNA, 16 bp, H. sapiens
ttttaatttctgaatt

SEQ ID NO: 175576 - DNA, 16 bp, H. sapiens
ttttaatttctttaga

SEQ ID NO: 175577 - DNA, 16 bp, H. sapiens
ttttaatttgaaaaca

SEQ ID NO: 175578 - DNA, 16 bp, H. sapiens
ttttaatttgcagttt

SEQ ID NO: 175579 - DNA, 16 bp, H. sapiens
ttttaatttggatttc

SEQ ID NO: 175580 - DNA, 16 bp, H. sapiens
ttttaatttgtgcttc

SEQ ID NO: 175581 - DNA, 16 bp, H. sapiens
ttttaattttcagttc

SEQ ID NO: 175582 - DNA, 16 bp, H. sapiens
ttttaattttcatgta

SEQ ID NO: 175583 - DNA, 16 bp, H. sapiens
ttttaattttctcaga

SEQ ID NO: 175584 - DNA, 16 bp, H. sapiens
ttttaattttgggaaa

SEQ ID NO: 175585 - DNA, 16 bp, H. sapiens
ttttaatttttgtcag

SEQ ID NO: 175586 - DNA, 16 bp, H. sapiens
ttttacaaaaactttt

SEQ ID NO: 175587 - DNA, 16 bp, H. sapiens
ttttacaaaaagaaaa

SEQ ID NO: 175588 - DNA, 16 bp, H. sapiens
ttttacaaaaagaaat

SEQ ID NO: 175589 - DNA, 16 bp, H. sapiens
ttttacaaaagaaaaa

SEQ ID NO: 175590 - DNA, 16 bp, H. sapiens
ttttacaaaagagaaa

SEQ ID NO: 175591 - DNA, 16 bp, H. sapiens
ttttacaaaagggaaa

SEQ ID NO: 175592 - DNA, 16 bp, H. sapiens
ttttacaaaatgtttt

SEQ ID NO: 175593 - DNA, 16 bp, H. sapiens
ttttacaaacaagaaa

SEQ ID NO: 175594 - DNA, 16 bp, H. sapiens
ttttacaaagaaaaca

SEQ ID NO: 175595 - DNA, 16 bp, H. sapiens
ttttacaaagaggaaa

SEQ ID NO: 175596 - DNA, 16 bp, H. sapiens
ttttacaaaggtgcca

SEQ ID NO: 175597 - DNA, 16 bp, H. sapiens
ttttacaaagtatttt

SEQ ID NO: 175598 - DNA, 16 bp, H. sapiens
ttttacaaagtgctga

SEQ ID NO: 175599 - DNA, 16 bp, H. sapiens
ttttacaaataaatgt

SEQ ID NO: 175600 - DNA, 16 bp, H. sapiens
ttttacaaataaggaa

SEQ ID NO: 175601 - DNA, 16 bp, H. sapiens
ttttacaaatatgtat

SEQ ID NO: 175602 - DNA, 16 bp, H. sapiens
ttttacaaatcaataa

SEQ ID NO: 175603 - DNA, 16 bp, H. sapiens
ttttacaaatctcttt

SEQ ID NO: 175604 - DNA, 16 bp, H. sapiens
ttttacaaatgaaaaa

SEQ ID NO: 175605 - DNA, 16 bp, H. sapiens
ttttacaaatggaatt

SEQ ID NO: 175606 - DNA, 16 bp, H. sapiens
ttttacaaatgttatt

SEQ ID NO: 175607 - DNA, 16 bp, H. sapiens
ttttacaacagtgatg

SEQ ID NO: 175608 - DNA, 16 bp, H. sapiens
ttttacaactgcatgt

SEQ ID NO: 175609 - DNA, 16 bp, H. sapiens
ttttacaagttatttt

SEQ ID NO: 175610 - DNA, 16 bp, H. sapiens
ttttacaagttttaaa

SEQ ID NO: 175611 - DNA, 16 bp, H. sapiens
ttttacaatgaaaaaa

SEQ ID NO: 175612 - DNA, 16 bp, H. sapiens
ttttacaattaaaaca

SEQ ID NO: 175613 - DNA, 16 bp, H. sapiens
ttttacaattgagaaa

SEQ ID NO: 175614 - DNA, 16 bp, H. sapiens
ttttacaattgtttta

SEQ ID NO: 175615 - DNA, 16 bp, H. sapiens
ttttacacaaatggta

SEQ ID NO: 175616 - DNA, 16 bp, H. sapiens
ttttacacttacagaa

SEQ ID NO: 175617 - DNA, 16 bp, H. sapiens
ttttacagaaaaaaaa

SEQ ID NO: 175618 - DNA, 16 bp, H. sapiens
ttttacagaaagaaaa

SEQ ID NO: 175619 - DNA, 16 bp, H. sapiens
ttttacagaaataaaa

SEQ ID NO: 175620 - DNA, 16 bp, H. sapiens
ttttacagaaatatat

SEQ ID NO: 175621 - DNA, 16 bp, H. sapiens
ttttacagaagaaaaa

SEQ ID NO: 175622 - DNA, 16 bp, H. sapiens
ttttacagaagaaact

SEQ ID NO: 175623 - DNA, 16 bp, H. sapiens
ttttacagaagacaaa

SEQ ID NO: 175624 - DNA, 16 bp, H. sapiens
ttttacagaagcagaa

SEQ ID NO: 175625 - DNA, 16 bp, H. sapiens
ttttacagaaggaaaa

SEQ ID NO: 175626 - DNA, 16 bp, H. sapiens
ttttacagagagaaaa

SEQ ID NO: 175627 - DNA, 16 bp, H. sapiens
ttttacagaggagaag

SEQ ID NO: 175628 - DNA, 16 bp, H. sapiens
ttttacagaggaggag

SEQ ID NO: 175629 - DNA, 16 bp, H. sapiens
ttttacagataaagga

SEQ ID NO: 175630 - DNA, 16 bp, H. sapiens
ttttacagatagggaa

SEQ ID NO: 175631 - DNA, 16 bp, H. sapiens
ttttacagatatttat

SEQ ID NO: 175632 - DNA, 16 bp, H. sapiens
ttttacagatgaggaa

SEQ ID NO: 175633 - DNA, 16 bp, H. sapiens
ttttacagatgctgaa

SEQ ID NO: 175634 - DNA, 16 bp, H. sapiens
ttttacagatgtagaa

SEQ ID NO: 175635 - DNA, 16 bp, H. sapiens
ttttacagcagaggaa

SEQ ID NO: 175636 - DNA, 16 bp, H. sapiens
ttttacagctgggcct

SEQ ID NO: 175637 - DNA, 16 bp, H. sapiens
ttttacaggaaaaaat

SEQ ID NO: 175638 - DNA, 16 bp, H. sapiens
ttttacaggtgaataa

SEQ ID NO: 175639 - DNA, 16 bp, H. sapiens
ttttacaggtgagaag

SEQ ID NO: 175640 - DNA, 16 bp, H. sapiens
ttttacaggtgaggaa

SEQ ID NO: 175641 - DNA, 16 bp, H. sapiens
ttttacaggttcatag

SEQ ID NO: 175642 - DNA, 16 bp, H. sapiens
ttttacagttaaggaa

SEQ ID NO: 175643 - DNA, 16 bp, H. sapiens
ttttacagttgaagaa

SEQ ID NO: 175644 - DNA, 16 bp, H. sapiens
ttttacagttttcagt

SEQ ID NO: 175645 - DNA, 16 bp, H. sapiens
ttttacataaaaacat

SEQ ID NO: 175646 - DNA, 16 bp, H. sapiens
ttttacataaatagaa

SEQ ID NO: 175647 - DNA, 16 bp, H. sapiens
ttttacatatatttgt

SEQ ID NO: 175648 - DNA, 16 bp, H. sapiens
ttttacatatgtaaaa

SEQ ID NO: 175649 - DNA, 16 bp, H. sapiens
ttttacatatgtaaat

SEQ ID NO: 175650 - DNA, 16 bp, H. sapiens
ttttacatatgtattt

SEQ ID NO: 175651 - DNA, 16 bp, H. sapiens
ttttacatatttgtaa

SEQ ID NO: 175652 - DNA, 16 bp, H. sapiens
ttttacatcactcaca

SEQ ID NO: 175653 - DNA, 16 bp, H. sapiens
ttttacatcttcctca

SEQ ID NO: 175654 - DNA, 16 bp, H. sapiens
ttttacatgaaaaaaa

SEQ ID NO: 175655 - DNA, 16 bp, H. sapiens
ttttacatgaagctgt

SEQ ID NO: 175656 - DNA, 16 bp, H. sapiens
ttttacatgagagaaa

SEQ ID NO: 175657 - DNA, 16 bp, H. sapiens
ttttacatgtcaactt

SEQ ID NO: 175658 - DNA, 16 bp, H. sapiens
ttttacatgtgaatat

SEQ ID NO: 175659 - DNA, 16 bp, H. sapiens
ttttacattgattttg

SEQ ID NO: 175660 - DNA, 16 bp, H. sapiens
ttttacattgttgatg

SEQ ID NO: 175661 - DNA, 16 bp, H. sapiens
ttttacatttagattt

SEQ ID NO: 175662 - DNA, 16 bp, H. sapiens
ttttacatttcaaaac

SEQ ID NO: 175663 - DNA, 16 bp, H. sapiens
ttttacatttctgaat

SEQ ID NO: 175664 - DNA, 16 bp, H. sapiens
ttttacatttgagaaa

SEQ ID NO: 175665 - DNA, 17 bp, H. sapiens
ttttacatttgctgagg

SEQ ID NO: 175666 - DNA, 16 bp, H. sapiens
ttttacattttgaaaa

SEQ ID NO: 175667 - DNA, 16 bp, H. sapiens
ttttacattttgatgt

SEQ ID NO: 175668 - DNA, 16 bp, H. sapiens
ttttaccactgttatt

SEQ ID NO: 175669 - DNA, 16 bp, H. sapiens
ttttaccagtttcttt

SEQ ID NO: 175670 - DNA, 16 bp, H. sapiens
ttttacccattttaaa

SEQ ID NO: 175671 - DNA, 16 bp, H. sapiens
ttttacctcaataaaa

SEQ ID NO: 175672 - DNA, 16 bp, H. sapiens
ttttacctgtccaaaa

SEQ ID NO: 175673 - DNA, 16 bp, H. sapiens
ttttaccttaaaatat

SEQ ID NO: 175674 - DNA, 16 bp, H. sapiens
ttttaccttttcaaaa

SEQ ID NO: 175675 - DNA, 16 bp, H. sapiens
ttttaccttttgaaat

SEQ ID NO: 175676 - DNA, 16 bp, H. sapiens
ttttactacaataaaa

SEQ ID NO: 175677 - DNA, 16 bp, H. sapiens
ttttactactgttaaa

SEQ ID NO: 175678 - DNA, 16 bp, H. sapiens
ttttactagaaatggg

SEQ ID NO: 175679 - DNA, 16 bp, H. sapiens
ttttactagagatgga

SEQ ID NO: 175680 - DNA, 20 bp, H. sapiens
ttttactagagatggggttt

SEQ ID NO: 175681 - DNA, 16 bp, H. sapiens
ttttactataaagaca

SEQ ID NO: 175682 - DNA, 16 bp, H. sapiens
ttttactatgatgtaa

SEQ ID NO: 175683 - DNA, 16 bp, H. sapiens
ttttactgaattaatt

SEQ ID NO: 175684 - DNA, 16 bp, H. sapiens
ttttactgagatataa

SEQ ID NO: 175685 - DNA, 16 bp, H. sapiens
ttttactgtaatattt

SEQ ID NO: 175686 - DNA, 16 bp, H. sapiens
ttttactgtaccattt

SEQ ID NO: 175687 - DNA, 16 bp, H. sapiens
ttttactgtacctttt

SEQ ID NO: 175688 - DNA, 16 bp, H. sapiens
ttttactgtatataaa

SEQ ID NO: 175689 - DNA, 16 bp, H. sapiens
ttttactgtgattctt

SEQ ID NO: 175690 - DNA, 16 bp, H. sapiens
ttttactgtttgtaaa

SEQ ID NO: 175691 - DNA, 16 bp, H. sapiens
ttttacttaaaaacaa

SEQ ID NO: 175692 - DNA, 16 bp, H. sapiens
ttttacttacaaaaat

SEQ ID NO: 175693 - DNA, 16 bp, H. sapiens
ttttacttactgattt

SEQ ID NO: 175694 - DNA, 16 bp, H. sapiens
ttttacttccttgtca

SEQ ID NO: 175695 - DNA, 16 bp, H. sapiens
ttttacttctgggtat

SEQ ID NO: 175696 - DNA, 16 bp, H. sapiens
ttttacttgaaaaact

SEQ ID NO: 175697 - DNA, 16 bp, H. sapiens
ttttacttggaaataa

SEQ ID NO: 175698 - DNA, 16 bp, H. sapiens
ttttactttaagttgt

SEQ ID NO: 175699 - DNA, 16 bp, H. sapiens
ttttactttatgaact

SEQ ID NO: 175700 - DNA, 16 bp, H. sapiens
ttttactttcaaccta

SEQ ID NO: 175701 - DNA, 16 bp, H. sapiens
ttttactttcagttct

SEQ ID NO: 175702 - DNA, 16 bp, H. sapiens
ttttactttcttgata

SEQ ID NO: 175703 - DNA, 16 bp, H. sapiens
ttttactttgaaataa

SEQ ID NO: 175704 - DNA, 16 bp, H. sapiens
ttttactttgcatttc

SEQ ID NO: 175705 - DNA, 16 bp, H. sapiens
ttttactttgtaaaat

SEQ ID NO: 175706 - DNA, 16 bp, H. sapiens
ttttactttgttaata

SEQ ID NO: 175707 - DNA, 16 bp, H. sapiens
ttttacttttctgaaa

SEQ ID NO: 175708 - DNA, 16 bp, H. sapiens
ttttacttttgaggaa

SEQ ID NO: 175709 - DNA, 16 bp, H. sapiens
ttttactttttaagta

SEQ ID NO: 175710 - DNA, 16 bp, H. sapiens
ttttactttttaatgg

SEQ ID NO: 175711 - DNA, 16 bp, H. sapiens
ttttactttttgtaga

SEQ ID NO: 175712 - DNA, 16 bp, H. sapiens
ttttagaaaaaaaatc

SEQ ID NO: 175713 - DNA, 16 bp, H. sapiens
ttttagaaaaaaactt

SEQ ID NO: 175714 - DNA, 16 bp, H. sapiens
ttttagaaaaacatat

SEQ ID NO: 175715 - DNA, 16 bp, H. sapiens
ttttagaaaaacttta

SEQ ID NO: 175716 - DNA, 16 bp, H. sapiens
ttttagaaaaaggaag

SEQ ID NO: 175717 - DNA, 16 bp, H. sapiens
ttttagaaaaagtttt

SEQ ID NO: 175718 - DNA, 16 bp, H. sapiens
ttttagaaaaatgttt

SEQ ID NO: 175719 - DNA, 16 bp, H. sapiens
ttttagaaaacaaata

SEQ ID NO: 175720 - DNA, 16 bp, H. sapiens
ttttagaaaacaattt

SEQ ID NO: 175721 - DNA, 16 bp, H. sapiens
ttttagaaaacagaaa

SEQ ID NO: 175722 - DNA, 16 bp, H. sapiens
ttttagaaaactaata

SEQ ID NO: 175723 - DNA, 16 bp, H. sapiens
ttttagaaaactgttt

SEQ ID NO: 175724 - DNA, 16 bp, H. sapiens
ttttagaaaagaaatt

SEQ ID NO: 175725 - DNA, 16 bp, H. sapiens
ttttagaaaaggaaaa

SEQ ID NO: 175726 - DNA, 16 bp, H. sapiens
ttttagaaaatagttt

SEQ ID NO: 175727 - DNA, 16 bp, H. sapiens
ttttagaaaatcaaat

SEQ ID NO: 175728 - DNA, 16 bp, H. sapiens
ttttagaaaatgcaaa

SEQ ID NO: 175729 - DNA, 16 bp, H. sapiens
ttttagaaacacaaat

SEQ ID NO: 175730 - DNA, 16 bp, H. sapiens
ttttagaaactttttt

SEQ ID NO: 175731 - DNA, 16 bp, H. sapiens
ttttagaaagaaaaca

SEQ ID NO: 175732 - DNA, 16 bp, H. sapiens
ttttagaaagataatt

SEQ ID NO: 175733 - DNA, 16 bp, H. sapiens
ttttagaaagattatt

SEQ ID NO: 175734 - DNA, 16 bp, H. sapiens
ttttagaaagcatttt

SEQ ID NO: 175735 - DNA, 16 bp, H. sapiens
ttttagaaagtccttg

SEQ ID NO: 175736 - DNA, 16 bp, H. sapiens
ttttagaaagtgattt

SEQ ID NO: 175737 - DNA, 16 bp, H. sapiens
ttttagaaatacatat

SEQ ID NO: 175738 - DNA, 16 bp, H. sapiens
ttttagaaatgagaaa

SEQ ID NO: 175739 - DNA, 16 bp, H. sapiens
ttttagaaatgcaaaa

SEQ ID NO: 175740 - DNA, 16 bp, H. sapiens
ttttagaaatgtgaaa

SEQ ID NO: 175741 - DNA, 16 bp, H. sapiens
ttttagaaattaagaa

SEQ ID NO: 175742 - DNA, 16 bp, H. sapiens
ttttagaagaaaatga

SEQ ID NO: 175743 - DNA, 16 bp, H. sapiens
ttttagaagaaacagg

SEQ ID NO: 175744 - DNA, 16 bp, H. sapiens
ttttagaagaaatgaa

SEQ ID NO: 175745 - DNA, 16 bp, H. sapiens
ttttagaagaagaaaa

SEQ ID NO: 175746 - DNA, 16 bp, H. sapiens
ttttagaagaatgtat

SEQ ID NO: 175747 - DNA, 16 bp, H. sapiens
ttttagaagagatggg

SEQ ID NO: 175748 - DNA, 16 bp, H. sapiens
ttttagaagctggaaa

SEQ ID NO: 175749 - DNA, 16 bp, H. sapiens
ttttagaaggaaaaaa

SEQ ID NO: 175750 - DNA, 16 bp, H. sapiens
ttttagaaggaaaact

SEQ ID NO: 175751 - DNA, 16 bp, H. sapiens
ttttagaagtagaatt

SEQ ID NO: 175752 - DNA, 16 bp, H. sapiens
ttttagaataacttta

SEQ ID NO: 175753 - DNA, 16 bp, H. sapiens
ttttagaatatgaaat

SEQ ID NO: 175754 - DNA, 16 bp, H. sapiens
ttttagaatcaacttt

SEQ ID NO: 175755 - DNA, 16 bp, H. sapiens
ttttagaatcataaaa

SEQ ID NO: 175756 - DNA, 16 bp, H. sapiens
ttttagaattaaatga

SEQ ID NO: 175757 - DNA, 16 bp, H. sapiens
ttttagaattttcagc

SEQ ID NO: 175758 - DNA, 16 bp, H. sapiens
ttttagacaaaaaata

SEQ ID NO: 175759 - DNA, 16 bp, H. sapiens
ttttagacagagtctc

SEQ ID NO: 175760 - DNA, 16 bp, H. sapiens
ttttagacagtttcac

SEQ ID NO: 175761 - DNA, 16 bp, H. sapiens
ttttagacttacagaa

SEQ ID NO: 175762 - DNA, 16 bp, H. sapiens
ttttagagaaatggaa

SEQ ID NO: 175763 - DNA, 16 bp, H. sapiens
ttttagagaaggaaaa

SEQ ID NO: 175764 - DNA, 16 bp, H. sapiens
ttttagagaatgaaaa

SEQ ID NO: 175765 - DNA, 16 bp, H. sapiens
ttttagagacagtctt

SEQ ID NO: 175766 - DNA, 16 bp, H. sapiens
ttttagagatgaagaa

SEQ ID NO: 175767 - DNA, 16 bp, H. sapiens
ttttagagatgggaaa

SEQ ID NO: 175768 - DNA, 16 bp, H. sapiens
ttttagagatttaaaa

SEQ ID NO: 175769 - DNA, 16 bp, H. sapiens
ttttagagcagttttg

SEQ ID NO: 175770 - DNA, 16 bp, H. sapiens
ttttagagctggaaag

SEQ ID NO: 175771 - DNA, 16 bp, H. sapiens
ttttagagggcaattt

SEQ ID NO: 175772 - DNA, 16 bp, H. sapiens
ttttagaggtagggtc

SEQ ID NO: 175773 - DNA, 16 bp, H. sapiens
ttttagataaacaaca

SEQ ID NO: 175774 - DNA, 16 bp, H. sapiens
ttttagatattaacct

SEQ ID NO: 175775 - DNA, 16 bp, H. sapiens
ttttagatggagtttc

SEQ ID NO: 175776 - DNA, 16 bp, H. sapiens
ttttagatgtgctgct

SEQ ID NO: 175777 - DNA, 16 bp, H. sapiens
ttttagattcaggaag

SEQ ID NO: 175778 - DNA, 16 bp, H. sapiens
ttttagattccacata

SEQ ID NO: 175779 - DNA, 16 bp, H. sapiens
ttttagattttggaat

SEQ ID NO: 175780 - DNA, 16 bp, H. sapiens
ttttagcactgaaagt

SEQ ID NO: 175781 - DNA, 16 bp, H. sapiens
ttttagcactgctttt

SEQ ID NO: 175782 - DNA, 20 bp, H. sapiens
ttttagcagagacagggttt

SEQ ID NO: 175783 - DNA, 20 bp, H. sapiens
ttttagcagagacggggttt

SEQ ID NO: 175784 - DNA, 16 bp, H. sapiens
ttttagcatttaaaaa

SEQ ID NO: 175785 - DNA, 16 bp, H. sapiens
ttttagcattttttaa

SEQ ID NO: 175786 - DNA, 16 bp, H. sapiens
ttttagcccagtgaga

SEQ ID NO: 175787 - DNA, 16 bp, H. sapiens
ttttagccttttaaaa

SEQ ID NO: 175788 - DNA, 16 bp, H. sapiens
ttttagctattatttc

SEQ ID NO: 175789 - DNA, 16 bp, H. sapiens
ttttagctattttagt

SEQ ID NO: 175790 - DNA, 16 bp, H. sapiens
ttttagctatttttaa

SEQ ID NO: 175791 - DNA, 16 bp, H. sapiens
ttttagctcatcagct

SEQ ID NO: 175792 - DNA, 16 bp, H. sapiens
ttttagctctaataat

SEQ ID NO: 175793 - DNA, 16 bp, H. sapiens
ttttagctcttgcatt

SEQ ID NO: 175794 - DNA, 16 bp, H. sapiens
ttttagcttctttgtg

SEQ ID NO: 175795 - DNA, 16 bp, H. sapiens
ttttagctttataaaa

SEQ ID NO: 175796 - DNA, 16 bp, H. sapiens
ttttaggaaataaata

SEQ ID NO: 175797 - DNA, 16 bp, H. sapiens
ttttaggaagacatga

SEQ ID NO: 175798 - DNA, 16 bp, H. sapiens
ttttaggaaggaaaat

SEQ ID NO: 175799 - DNA, 16 bp, H. sapiens
ttttaggaataaaaca

SEQ ID NO: 175800 - DNA, 16 bp, H. sapiens
ttttaggaattctttt

SEQ ID NO: 175801 - DNA, 18 bp, H. sapiens
ttttaggacaggtaaaat

SEQ ID NO: 175802 - DNA, 16 bp, H. sapiens
ttttaggacagtgaaa

SEQ ID NO: 175803 - DNA, 16 bp, H. sapiens
ttttaggagaaaaaaa

SEQ ID NO: 175804 - DNA, 16 bp, H. sapiens
ttttaggagaaaaaca

SEQ ID NO: 175805 - DNA, 16 bp, H. sapiens
ttttaggagaggctgc

SEQ ID NO: 175806 - DNA, 16 bp, H. sapiens
ttttaggagatggggt

SEQ ID NO: 175807 - DNA, 16 bp, H. sapiens
ttttaggagctctgtg

SEQ ID NO: 175808 - DNA, 16 bp, H. sapiens
ttttagggaggaaaaa

SEQ ID NO: 175809 - DNA, 16 bp, H. sapiens
ttttagggaggcatga

SEQ ID NO: 175810 - DNA, 16 bp, H. sapiens
ttttagggggacacaa

SEQ ID NO: 175811 - DNA, 16 bp, H. sapiens
ttttagggtacctgtg

SEQ ID NO: 175812 - DNA, 16 bp, H. sapiens
ttttaggtattaaaaa

SEQ ID NO: 175813 - DNA, 16 bp, H. sapiens
ttttaggtttacagaa

SEQ ID NO: 175814 - DNA, 16 bp, H. sapiens
ttttaggtttacattt

SEQ ID NO: 175815 - DNA, 16 bp, H. sapiens
ttttagtaaagaccag

SEQ ID NO: 175816 - DNA, 16 bp, H. sapiens
ttttagtaaaggcagg

SEQ ID NO: 175817 - DNA, 16 bp, H. sapiens
ttttagtaaattcaca

SEQ ID NO: 175818 - DNA, 16 bp, H. sapiens
ttttagtaaatttgca

SEQ ID NO: 175819 - DNA, 16 bp, H. sapiens
ttttagtacagatgag

SEQ ID NO: 175820 - DNA, 22 bp, H. sapiens
ttttagtacagatggggtttca

SEQ ID NO: 175821 - DNA, 16 bp, H. sapiens
ttttagtagaatcagg

SEQ ID NO: 175822 - DNA, 16 bp, H. sapiens
ttttagtagagaagag

SEQ ID NO: 175823 - DNA, 16 bp, H. sapiens
ttttagtagagacaga

SEQ ID NO: 175824 - DNA, 20 bp, H. sapiens
ttttagtagagacagagttt

SEQ ID NO: 175825 - DNA, 29 bp, H. sapiens
ttttagtagagacagggtttcaccatctt

SEQ ID NO: 175826 - DNA, 25 bp, H. sapiens
ttttagtagagacagggtttcaccg

SEQ ID NO: 175827 - DNA, 16 bp, H. sapiens
ttttagtagagacatg

SEQ ID NO: 175828 - DNA, 23 bp, H. sapiens
ttttagtagagacgggatttcat

SEQ ID NO: 175829 - DNA, 30 bp, H. sapiens
ttttagtagagacggggtttcaccatgtta

SEQ ID NO: 175830 - DNA, 26 bp, H. sapiens
ttttagtagagacggggtttcaccgt

SEQ ID NO: 175831 - DNA, 25 bp, H. sapiens
ttttagtagagacggggtttcacct

SEQ ID NO: 175832 - DNA, 22 bp, H. sapiens
ttttagtagagacggggtttcg

SEQ ID NO: 175833 - DNA, 20 bp, H. sapiens
ttttagtagagacggtgttt

SEQ ID NO: 175834 - DNA, 23 bp, H. sapiens
ttttagtagagatggggtttcag

SEQ ID NO: 175835 - DNA, 20 bp, H. sapiens
ttttagtagaggtggggttt

SEQ ID NO: 175836 - DNA, 16 bp, H. sapiens
ttttagtagataaggg

SEQ ID NO: 175837 - DNA, 20 bp, H. sapiens
ttttagtagggacggggttt

SEQ ID NO: 175838 - DNA, 16 bp, H. sapiens
ttttagtatatgtgct

SEQ ID NO: 175839 - DNA, 16 bp, H. sapiens
ttttagtccattttgt

SEQ ID NO: 175840 - DNA, 16 bp, H. sapiens
ttttagtgaatttctt

SEQ ID NO: 175841 - DNA, 16 bp, H. sapiens
ttttagtgagaaaaaa

SEQ ID NO: 175842 - DNA, 16 bp, H. sapiens
ttttagtgatatgaag

SEQ ID NO: 175843 - DNA, 16 bp, H. sapiens
ttttagtgatttgaaa

SEQ ID NO: 175844 - DNA, 16 bp, H. sapiens
ttttagtgctaaataa

SEQ ID NO: 175845 - DNA, 16 bp, H. sapiens
ttttagtggagaaggg

SEQ ID NO: 175846 - DNA, 16 bp, H. sapiens
ttttagtggagaatgg

SEQ ID NO: 175847 - DNA, 16 bp, H. sapiens
ttttagtggcttaaaa

SEQ ID NO: 175848 - DNA, 16 bp, H. sapiens
ttttagtgtattcaca

SEQ ID NO: 175849 - DNA, 16 bp, H. sapiens
ttttagttctttcaga

SEQ ID NO: 175850 - DNA, 16 bp, H. sapiens
ttttagtttcagaaaa

SEQ ID NO: 175851 - DNA, 16 bp, H. sapiens
ttttagtttcccagtg

SEQ ID NO: 175852 - DNA, 16 bp, H. sapiens
ttttagttttaaaact

SEQ ID NO: 175853 - DNA, 16 bp, H. sapiens
ttttagttttaacatt

SEQ ID NO: 175854 - DNA, 16 bp, H. sapiens
ttttagttttagaaaa

SEQ ID NO: 175855 - DNA, 16 bp, H. sapiens
ttttagttttcagtgt

SEQ ID NO: 175856 - DNA, 16 bp, H. sapiens
ttttagttttccttca

SEQ ID NO: 175857 - DNA, 16 bp, H. sapiens
ttttagttttgctgtc

SEQ ID NO: 175858 - DNA, 16 bp, H. sapiens
ttttagtttttgagga

SEQ ID NO: 175859 - DNA, 16 bp, H. sapiens
ttttagtttttggaga

SEQ ID NO: 175860 - DNA, 16 bp, H. sapiens
ttttataaaaagagga

SEQ ID NO: 175861 - DNA, 16 bp, H. sapiens
ttttataaaacaagaa

SEQ ID NO: 175862 - DNA, 16 bp, H. sapiens
ttttataaaaggcaaa

SEQ ID NO: 175863 - DNA, 16 bp, H. sapiens
ttttataaaagtatca

SEQ ID NO: 175864 - DNA, 16 bp, H. sapiens
ttttataaaagtgaaa

SEQ ID NO: 175865 - DNA, 16 bp, H. sapiens
ttttataaaatgcatt

SEQ ID NO: 175866 - DNA, 16 bp, H. sapiens
ttttataaaatgcctt

SEQ ID NO: 175867 - DNA, 16 bp, H. sapiens
ttttataaacagtttt

SEQ ID NO: 175868 - DNA, 16 bp, H. sapiens
ttttataaactcaaat

SEQ ID NO: 175869 - DNA, 16 bp, H. sapiens
ttttataaactggttt

SEQ ID NO: 175870 - DNA, 16 bp, H. sapiens
ttttataaagcagttt

SEQ ID NO: 175871 - DNA, 16 bp, H. sapiens
ttttataaaggaagaa

SEQ ID NO: 175872 - DNA, 16 bp, H. sapiens
ttttataaatacagtt

SEQ ID NO: 175873 - DNA, 16 bp, H. sapiens
ttttataaataggagt

SEQ ID NO: 175874 - DNA, 16 bp, H. sapiens
ttttataaatatgtga

SEQ ID NO: 175875 - DNA, 16 bp, H. sapiens
ttttataaatcagaaa

SEQ ID NO: 175876 - DNA, 16 bp, H. sapiens
ttttataaatggaaaa

SEQ ID NO: 175877 - DNA, 16 bp, H. sapiens
ttttataaatgtagaa

SEQ ID NO: 175878 - DNA, 16 bp, H. sapiens
ttttataacaccttaa

SEQ ID NO: 175879 - DNA, 16 bp, H. sapiens
ttttataacagtttta

SEQ ID NO: 175880 - DNA, 16 bp, H. sapiens
ttttataacatgaaaa

SEQ ID NO: 175881 - DNA, 16 bp, H. sapiens
ttttataactcaaatt

SEQ ID NO: 175882 - DNA, 16 bp, H. sapiens
ttttataactgagaaa

SEQ ID NO: 175883 - DNA, 16 bp, H. sapiens
ttttataagcttttta

SEQ ID NO: 175884 - DNA, 16 bp, H. sapiens
ttttataaggaaacat

SEQ ID NO: 175885 - DNA, 16 bp, H. sapiens
ttttataatctgattt

SEQ ID NO: 175886 - DNA, 16 bp, H. sapiens
ttttataatgtgaaaa

SEQ ID NO: 175887 - DNA, 16 bp, H. sapiens
ttttataatttgaggt

SEQ ID NO: 175888 - DNA, 16 bp, H. sapiens
ttttatacaaaagaca

SEQ ID NO: 175889 - DNA, 16 bp, H. sapiens
ttttatacaaatgaat

SEQ ID NO: 175890 - DNA, 16 bp, H. sapiens
ttttatacatacacac

SEQ ID NO: 175891 - DNA, 16 bp, H. sapiens
ttttatacatgaaaat

SEQ ID NO: 175892 - DNA, 16 bp, H. sapiens
ttttatacatgtattt

SEQ ID NO: 175893 - DNA, 16 bp, H. sapiens
ttttatacatttcaaa

SEQ ID NO: 175894 - DNA, 16 bp, H. sapiens
ttttatacattttaga

SEQ ID NO: 175895 - DNA, 16 bp, H. sapiens
ttttatacattttagg

SEQ ID NO: 175896 - DNA, 16 bp, H. sapiens
ttttataccagtatca

SEQ ID NO: 175897 - DNA, 16 bp, H. sapiens
ttttataccttaaaaa

SEQ ID NO: 175898 - DNA, 16 bp, H. sapiens
ttttataccttcagat

SEQ ID NO: 175899 - DNA, 16 bp, H. sapiens
ttttatactgcatttt

SEQ ID NO: 175900 - DNA, 16 bp, H. sapiens
ttttatacttggaaaa

SEQ ID NO: 175901 - DNA, 16 bp, H. sapiens
ttttatactttcaagt

SEQ ID NO: 175902 - DNA, 16 bp, H. sapiens
ttttatagaaaaggaa

SEQ ID NO: 175903 - DNA, 16 bp, H. sapiens
ttttatagaatctgca

SEQ ID NO: 175904 - DNA, 16 bp, H. sapiens
ttttatagacagagaa

SEQ ID NO: 175905 - DNA, 16 bp, H. sapiens
ttttatagacatttta

SEQ ID NO: 175906 - DNA, 16 bp, H. sapiens
ttttatagagaaaggg

SEQ ID NO: 175907 - DNA, 16 bp, H. sapiens
ttttatagagaaggaa

SEQ ID NO: 175908 - DNA, 16 bp, H. sapiens
ttttatagagacagga

SEQ ID NO: 175909 - DNA, 16 bp, H. sapiens
ttttatagagatgagg

SEQ ID NO: 175910 - DNA, 16 bp, H. sapiens
ttttatagaggaggaa

SEQ ID NO: 175911 - DNA, 16 bp, H. sapiens
ttttatagagtgctga

SEQ ID NO: 175912 - DNA, 16 bp, H. sapiens
ttttatagataaagat

SEQ ID NO: 175913 - DNA, 16 bp, H. sapiens
ttttatagatatagaa

SEQ ID NO: 175914 - DNA, 16 bp, H. sapiens
ttttatagatgagaaa

SEQ ID NO: 175915 - DNA, 16 bp, H. sapiens
ttttatagattctgga

SEQ ID NO: 175916 - DNA, 16 bp, H. sapiens
ttttatagctaaatag

SEQ ID NO: 175917 - DNA, 16 bp, H. sapiens
ttttatagctttcatt

SEQ ID NO: 175918 - DNA, 16 bp, H. sapiens
ttttataggaaagaaa

SEQ ID NO: 175919 - DNA, 16 bp, H. sapiens
ttttataggtgagaaa

SEQ ID NO: 175920 - DNA, 16 bp, H. sapiens
ttttatagttaagaaa

SEQ ID NO: 175921 - DNA, 16 bp, H. sapiens
ttttatagttctcctt

SEQ ID NO: 175922 - DNA, 16 bp, H. sapiens
ttttatagtttcagat

SEQ ID NO: 175923 - DNA, 16 bp, H. sapiens
ttttatagtttccagt

SEQ ID NO: 175924 - DNA, 16 bp, H. sapiens
ttttatataaaatggt

SEQ ID NO: 175925 - DNA, 16 bp, H. sapiens
ttttatatactgattt

SEQ ID NO: 175926 - DNA, 16 bp, H. sapiens
ttttatatatgaagaa

SEQ ID NO: 175927 - DNA, 16 bp, H. sapiens
ttttatatgaagaaat

SEQ ID NO: 175928 - DNA, 16 bp, H. sapiens
ttttatatgacaactg

SEQ ID NO: 175929 - DNA, 16 bp, H. sapiens
ttttatatgatcaagt

SEQ ID NO: 175930 - DNA, 16 bp, H. sapiens
ttttatatgcatattt

SEQ ID NO: 175931 - DNA, 16 bp, H. sapiens
ttttatatgcattatt

SEQ ID NO: 175932 - DNA, 16 bp, H. sapiens
ttttatatgcattggg

SEQ ID NO: 175933 - DNA, 16 bp, H. sapiens
ttttatatgcttttaa

SEQ ID NO: 175934 - DNA, 16 bp, H. sapiens
ttttatatggaaccaa

SEQ ID NO: 175935 - DNA, 16 bp, H. sapiens
ttttatatggaatcaa

SEQ ID NO: 175936 - DNA, 16 bp, H. sapiens
ttttatatgtaaagaa

SEQ ID NO: 175937 - DNA, 16 bp, H. sapiens
ttttatattaatggaa

SEQ ID NO: 175938 - DNA, 16 bp, H. sapiens
ttttatattctggaaa

SEQ ID NO: 175939 - DNA, 16 bp, H. sapiens
ttttatattcttgata

SEQ ID NO: 175940 - DNA, 16 bp, H. sapiens
ttttatatttacagaa

SEQ ID NO: 175941 - DNA, 16 bp, H. sapiens
ttttatatttagatct

SEQ ID NO: 175942 - DNA, 16 bp, H. sapiens
ttttatatttcacaaa

SEQ ID NO: 175943 - DNA, 16 bp, H. sapiens
ttttatatttgagaaa

SEQ ID NO: 175944 - DNA, 16 bp, H. sapiens
ttttatatttgcatat

SEQ ID NO: 175945 - DNA, 16 bp, H. sapiens
ttttatatttggaaaa

SEQ ID NO: 175946 - DNA, 16 bp, H. sapiens
ttttatatttgtacat

SEQ ID NO: 175947 - DNA, 16 bp, H. sapiens
ttttatattttctgaa

SEQ ID NO: 175948 - DNA, 16 bp, H. sapiens
ttttatcaaatgaaaa

SEQ ID NO: 175949 - DNA, 16 bp, H. sapiens
ttttatcaatgtttta

SEQ ID NO: 175950 - DNA, 16 bp, H. sapiens
ttttatcactgattca

SEQ ID NO: 175951 - DNA, 16 bp, H. sapiens
ttttatcagaaaaaaa

SEQ ID NO: 175952 - DNA, 16 bp, H. sapiens
ttttatcaggaaaaaa

SEQ ID NO: 175953 - DNA, 16 bp, H. sapiens
ttttatcaggagccca

SEQ ID NO: 175954 - DNA, 16 bp, H. sapiens
ttttatcatcccaaaa

SEQ ID NO: 175955 - DNA, 16 bp, H. sapiens
ttttatcatcttaaaa

SEQ ID NO: 175956 - DNA, 16 bp, H. sapiens
ttttatcatgaaaagg

SEQ ID NO: 175957 - DNA, 16 bp, H. sapiens
ttttatcatgaaagca

SEQ ID NO: 175958 - DNA, 16 bp, H. sapiens
ttttatcattatgtaa

SEQ ID NO: 175959 - DNA, 16 bp, H. sapiens
ttttatcattttgaaa

SEQ ID NO: 175960 - DNA, 16 bp, H. sapiens
ttttatccaaaacaca

SEQ ID NO: 175961 - DNA, 16 bp, H. sapiens
ttttatccaaaataaa

SEQ ID NO: 175962 - DNA, 16 bp, H. sapiens
ttttatccctcacacc

SEQ ID NO: 175963 - DNA, 16 bp, H. sapiens
ttttatccctcaccct

SEQ ID NO: 175964 - DNA, 16 bp, H. sapiens
ttttatccctcacctg

SEQ ID NO: 175965 - DNA, 16 bp, H. sapiens
ttttatctaaagtaaa

SEQ ID NO: 175966 - DNA, 16 bp, H. sapiens
ttttatctacttttga

SEQ ID NO: 175967 - DNA, 18 bp, H. sapiens
ttttatctataagcccct

SEQ ID NO: 175968 - DNA, 16 bp, H. sapiens
ttttatctatgatact

SEQ ID NO: 175969 - DNA, 16 bp, H. sapiens
ttttatctccaaaata

SEQ ID NO: 175970 - DNA, 16 bp, H. sapiens
ttttatctgaaaataa

SEQ ID NO: 175971 - DNA, 16 bp, H. sapiens
ttttatctgatattaa

SEQ ID NO: 175972 - DNA, 16 bp, H. sapiens
ttttatctgcatttta

SEQ ID NO: 175973 - DNA, 16 bp, H. sapiens
ttttatctggggatgt

SEQ ID NO: 175974 - DNA, 16 bp, H. sapiens
ttttatctgtaaaatg

SEQ ID NO: 175975 - DNA, 16 bp, H. sapiens
ttttatctgttttaca

SEQ ID NO: 175976 - DNA, 16 bp, H. sapiens
ttttatcttgaaaata

SEQ ID NO: 175977 - DNA, 16 bp, H. sapiens
ttttatctttaaaatg

SEQ ID NO: 175978 - DNA, 16 bp, H. sapiens
ttttatctttagttga

SEQ ID NO: 175979 - DNA, 16 bp, H. sapiens
ttttatcttttgaaaa

SEQ ID NO: 175980 - DNA, 16 bp, H. sapiens
ttttatcttttgaaat

SEQ ID NO: 175981 - DNA, 16 bp, H. sapiens
ttttatgaaaataact

SEQ ID NO: 175982 - DNA, 16 bp, H. sapiens
ttttatgaaaatgaaa

SEQ ID NO: 175983 - DNA, 16 bp, H. sapiens
ttttatgaaacattta

SEQ ID NO: 175984 - DNA, 16 bp, H. sapiens
ttttatgaaaggaaga

SEQ ID NO: 175985 - DNA, 16 bp, H. sapiens
ttttatgaagataaat

SEQ ID NO: 175986 - DNA, 16 bp, H. sapiens
ttttatgaatgaaaaa

SEQ ID NO: 175987 - DNA, 16 bp, H. sapiens
ttttatgactgcacag

SEQ ID NO: 175988 - DNA, 16 bp, H. sapiens
ttttatgagaaaaata

SEQ ID NO: 175989 - DNA, 16 bp, H. sapiens
ttttatgatgaaaaca

SEQ ID NO: 175990 - DNA, 16 bp, H. sapiens
ttttatgatgaaaatg

SEQ ID NO: 175991 - DNA, 16 bp, H. sapiens
ttttatgatgctttga

SEQ ID NO: 175992 - DNA, 16 bp, H. sapiens
ttttatgatttcatat

SEQ ID NO: 175993 - DNA, 16 bp, H. sapiens
ttttatgcaaaagaaa

SEQ ID NO: 175994 - DNA, 16 bp, H. sapiens
ttttatgcatatttta

SEQ ID NO: 175995 - DNA, 16 bp, H. sapiens
ttttatgcatattttc

SEQ ID NO: 175996 - DNA, 16 bp, H. sapiens
ttttatgccattttaa

SEQ ID NO: 175997 - DNA, 16 bp, H. sapiens
ttttatggaaaaacaa

SEQ ID NO: 175998 - DNA, 16 bp, H. sapiens
ttttatggaagcttca

SEQ ID NO: 175999 - DNA, 16 bp, H. sapiens
ttttatggaggaggaa

SEQ ID NO: 176000 - DNA, 16 bp, H. sapiens
ttttatggatgagtag

SEQ ID NO: 176001 - DNA, 16 bp, H. sapiens
ttttatggctctgtag

SEQ ID NO: 176002 - DNA, 16 bp, H. sapiens
ttttatggctgaggaa

SEQ ID NO: 176003 - DNA, 16 bp, H. sapiens
ttttatggcttagtat

SEQ ID NO: 176004 - DNA, 16 bp, H. sapiens
ttttatggtagtaaat

SEQ ID NO: 176005 - DNA, 16 bp, H. sapiens
ttttatggtttcatgt

SEQ ID NO: 176006 - DNA, 16 bp, H. sapiens
ttttatgtaaattaca

SEQ ID NO: 176007 - DNA, 16 bp, H. sapiens
ttttatgtacctttgg

SEQ ID NO: 176008 - DNA, 16 bp, H. sapiens
ttttatgtagagatgg

SEQ ID NO: 176009 - DNA, 16 bp, H. sapiens
ttttatgtatttcaaa

SEQ ID NO: 176010 - DNA, 16 bp, H. sapiens
ttttatgtattttcca

SEQ ID NO: 176011 - DNA, 16 bp, H. sapiens
ttttatgtcaattaaa

SEQ ID NO: 176012 - DNA, 16 bp, H. sapiens
ttttatgtctaaaaat

SEQ ID NO: 176013 - DNA, 16 bp, H. sapiens
ttttatgtctctctct

SEQ ID NO: 176014 - DNA, 16 bp, H. sapiens
ttttatgtcttgagag

SEQ ID NO: 176015 - DNA, 16 bp, H. sapiens
ttttatgtgaaagaaa

SEQ ID NO: 176016 - DNA, 16 bp, H. sapiens
ttttatgtgaaatttc

SEQ ID NO: 176017 - DNA, 16 bp, H. sapiens
ttttatgtgagagaaa

SEQ ID NO: 176018 - DNA, 16 bp, H. sapiens
ttttatgtgtacatat

SEQ ID NO: 176019 - DNA, 16 bp, H. sapiens
ttttatgttatagaga

SEQ ID NO: 176020 - DNA, 16 bp, H. sapiens
ttttatgttccaggat

SEQ ID NO: 176021 - DNA, 16 bp, H. sapiens
ttttatgttgaaatgt

SEQ ID NO: 176022 - DNA, 16 bp, H. sapiens
ttttatgtttttcaaa

SEQ ID NO: 176023 - DNA, 16 bp, H. sapiens
ttttatgtttttcaga

SEQ ID NO: 176024 - DNA, 16 bp, H. sapiens
ttttattaaaacacag

SEQ ID NO: 176025 - DNA, 16 bp, H. sapiens
ttttattaaaaccaaa

SEQ ID NO: 176026 - DNA, 16 bp, H. sapiens
ttttattaaaaggaaa

SEQ ID NO: 176027 - DNA, 16 bp, H. sapiens
ttttattaactgaatt

SEQ ID NO: 176028 - DNA, 16 bp, H. sapiens
ttttattaactgattt

SEQ ID NO: 176029 - DNA, 16 bp, H. sapiens
ttttattaagagaaaa

SEQ ID NO: 176030 - DNA, 16 bp, H. sapiens
ttttattaatgagaaa

SEQ ID NO: 176031 - DNA, 16 bp, H. sapiens
ttttattacaaaatgt

SEQ ID NO: 176032 - DNA, 16 bp, H. sapiens
ttttattacagaaaat

SEQ ID NO: 176033 - DNA, 16 bp, H. sapiens
ttttattacattgaag

SEQ ID NO: 176034 - DNA, 16 bp, H. sapiens
ttttattaccaacatc

SEQ ID NO: 176035 - DNA, 16 bp, H. sapiens
ttttattaccatttca

SEQ ID NO: 176036 - DNA, 16 bp, H. sapiens
ttttattagaaagaaa

SEQ ID NO: 176037 - DNA, 16 bp, H. sapiens
ttttattaggaaaaaa

SEQ ID NO: 176038 - DNA, 16 bp, H. sapiens
ttttattaggaaaata

SEQ ID NO: 176039 - DNA, 16 bp, H. sapiens
ttttattaggaaatat

SEQ ID NO: 176040 - DNA, 16 bp, H. sapiens
ttttattaggggtttc

SEQ ID NO: 176041 - DNA, 16 bp, H. sapiens
ttttattatagaaatg

SEQ ID NO: 176042 - DNA, 16 bp, H. sapiens
ttttattatcaccatg

SEQ ID NO: 176043 - DNA, 16 bp, H. sapiens
ttttattatgaatgag

SEQ ID NO: 176044 - DNA, 16 bp, H. sapiens
ttttattatggattca

SEQ ID NO: 176045 - DNA, 16 bp, H. sapiens
ttttattatggcagcc

SEQ ID NO: 176046 - DNA, 16 bp, H. sapiens
ttttattatggtaaaa

SEQ ID NO: 176047 - DNA, 16 bp, H. sapiens
ttttattattagattc

SEQ ID NO: 176048 - DNA, 16 bp, H. sapiens
ttttattcaaagaaaa

SEQ ID NO: 176049 - DNA, 16 bp, H. sapiens
ttttattcagatttcc

SEQ ID NO: 176050 - DNA, 16 bp, H. sapiens
ttttattcataattgt

SEQ ID NO: 176051 - DNA, 16 bp, H. sapiens
ttttattcatctttgc

SEQ ID NO: 176052 - DNA, 16 bp, H. sapiens
ttttattcatgtttaa

SEQ ID NO: 176053 - DNA, 16 bp, H. sapiens
ttttattcattgatat

SEQ ID NO: 176054 - DNA, 16 bp, H. sapiens
ttttattcatttgaaa

SEQ ID NO: 176055 - DNA, 16 bp, H. sapiens
ttttattcatttgagt

SEQ ID NO: 176056 - DNA, 16 bp, H. sapiens
ttttattcatttgcat

SEQ ID NO: 176057 - DNA, 16 bp, H. sapiens
ttttattccattctgt

SEQ ID NO: 176058 - DNA, 16 bp, H. sapiens
ttttattcctttgaat

SEQ ID NO: 176059 - DNA, 16 bp, H. sapiens
ttttattctctgcttc

SEQ ID NO: 176060 - DNA, 16 bp, H. sapiens
ttttattctctttgga

SEQ ID NO: 176061 - DNA, 16 bp, H. sapiens
ttttattctggaattt

SEQ ID NO: 176062 - DNA, 16 bp, H. sapiens
ttttattctgtgaaga

SEQ ID NO: 176063 - DNA, 16 bp, H. sapiens
ttttattctttgagaa

SEQ ID NO: 176064 - DNA, 16 bp, H. sapiens
ttttattgaaaaacag

SEQ ID NO: 176065 - DNA, 16 bp, H. sapiens
ttttattgaagaataa

SEQ ID NO: 176066 - DNA, 16 bp, H. sapiens
ttttattgacattttc

SEQ ID NO: 176067 - DNA, 16 bp, H. sapiens
ttttattgagatggag

SEQ ID NO: 176068 - DNA, 16 bp, H. sapiens
ttttattgagcagttt

SEQ ID NO: 176069 - DNA, 16 bp, H. sapiens
ttttattgaggaattt

SEQ ID NO: 176070 - DNA, 16 bp, H. sapiens
ttttattgaggatatt

SEQ ID NO: 176071 - DNA, 16 bp, H. sapiens
ttttattgcatgtatt

SEQ ID NO: 176072 - DNA, 16 bp, H. sapiens
ttttattgcatttgct

SEQ ID NO: 176073 - DNA, 16 bp, H. sapiens
ttttattgcctctatt

SEQ ID NO: 176074 - DNA, 16 bp, H. sapiens
ttttattgctaagtaa

SEQ ID NO: 176075 - DNA, 16 bp, H. sapiens
ttttattgctgatttg

SEQ ID NO: 176076 - DNA, 16 bp, H. sapiens
ttttattgcttttcca

SEQ ID NO: 176077 - DNA, 16 bp, H. sapiens
ttttattggaatatag

SEQ ID NO: 176078 - DNA, 16 bp, H. sapiens
ttttattggacttaca

SEQ ID NO: 176079 - DNA, 16 bp, H. sapiens
ttttattggctttata

SEQ ID NO: 176080 - DNA, 16 bp, H. sapiens
ttttattggtctgttc

SEQ ID NO: 176081 - DNA, 16 bp, H. sapiens
ttttattgtactttaa

SEQ ID NO: 176082 - DNA, 16 bp, H. sapiens
ttttattgtggtaaaa

SEQ ID NO: 176083 - DNA, 16 bp, H. sapiens
ttttattgtttacaaa

SEQ ID NO: 176084 - DNA, 16 bp, H. sapiens
ttttatttaaagaaag

SEQ ID NO: 176085 - DNA, 16 bp, H. sapiens
ttttatttaaaggaaa

SEQ ID NO: 176086 - DNA, 16 bp, H. sapiens
ttttatttaacattgt

SEQ ID NO: 176087 - DNA, 16 bp, H. sapiens
ttttatttaaccctat

SEQ ID NO: 176088 - DNA, 16 bp, H. sapiens
ttttatttaatgcaat

SEQ ID NO: 176089 - DNA, 16 bp, H. sapiens
ttttatttattcagaa

SEQ ID NO: 176090 - DNA, 16 bp, H. sapiens
ttttatttcaaccatt

SEQ ID NO: 176091 - DNA, 16 bp, H. sapiens
ttttatttcagatatt

SEQ ID NO: 176092 - DNA, 16 bp, H. sapiens
ttttatttcaggaaat

SEQ ID NO: 176093 - DNA, 16 bp, H. sapiens
ttttatttcatgtaaa

SEQ ID NO: 176094 - DNA, 16 bp, H. sapiens
ttttatttcattgaat

SEQ ID NO: 176095 - DNA, 16 bp, H. sapiens
ttttatttctaaaatg

SEQ ID NO: 176096 - DNA, 16 bp, H. sapiens
ttttatttctagcatt

SEQ ID NO: 176097 - DNA, 16 bp, H. sapiens
ttttatttctattgga

SEQ ID NO: 176098 - DNA, 16 bp, H. sapiens
ttttatttctcaaaga

SEQ ID NO: 176099 - DNA, 16 bp, H. sapiens
ttttatttctccatca

SEQ ID NO: 176100 - DNA, 16 bp, H. sapiens
ttttatttctcttgag

SEQ ID NO: 176101 - DNA, 16 bp, H. sapiens
ttttatttctgaaaat

SEQ ID NO: 176102 - DNA, 16 bp, H. sapiens
ttttatttctgacatt

SEQ ID NO: 176103 - DNA, 16 bp, H. sapiens
ttttatttctgaggca

SEQ ID NO: 176104 - DNA, 16 bp, H. sapiens
ttttatttctgtagca

SEQ ID NO: 176105 - DNA, 16 bp, H. sapiens
ttttatttctgtgaaa

SEQ ID NO: 176106 - DNA, 16 bp, H. sapiens
ttttatttctgtggct

SEQ ID NO: 176107 - DNA, 16 bp, H. sapiens
ttttatttcttcacca

SEQ ID NO: 176108 - DNA, 16 bp, H. sapiens
ttttatttctttaagg

SEQ ID NO: 176109 - DNA, 16 bp, H. sapiens
ttttatttgaaaaaca

SEQ ID NO: 176110 - DNA, 16 bp, H. sapiens
ttttatttgaaaagaa

SEQ ID NO: 176111 - DNA, 16 bp, H. sapiens
ttttatttgaaaagta

SEQ ID NO: 176112 - DNA, 16 bp, H. sapiens
ttttatttgaaaatag

SEQ ID NO: 176113 - DNA, 16 bp, H. sapiens
ttttatttgaaacaga

SEQ ID NO: 176114 - DNA, 16 bp, H. sapiens
ttttatttgaaataag

SEQ ID NO: 176115 - DNA, 16 bp, H. sapiens
ttttatttgaaatcat

SEQ ID NO: 176116 - DNA, 16 bp, H. sapiens
ttttatttgaagacat

SEQ ID NO: 176117 - DNA, 16 bp, H. sapiens
ttttatttgcagatat

SEQ ID NO: 176118 - DNA, 16 bp, H. sapiens
ttttatttgctacatc

SEQ ID NO: 176119 - DNA, 16 bp, H. sapiens
ttttatttgcttaaaa

SEQ ID NO: 176120 - DNA, 16 bp, H. sapiens
ttttatttgcttaata

SEQ ID NO: 176121 - DNA, 16 bp, H. sapiens
ttttatttggaaaata

SEQ ID NO: 176122 - DNA, 16 bp, H. sapiens
ttttatttggaaataa

SEQ ID NO: 176123 - DNA, 16 bp, H. sapiens
ttttatttggatcttc

SEQ ID NO: 176124 - DNA, 16 bp, H. sapiens
ttttatttgtacaaat

SEQ ID NO: 176125 - DNA, 16 bp, H. sapiens
ttttatttgtcaatta

SEQ ID NO: 176126 - DNA, 16 bp, H. sapiens
ttttattttaaagact

SEQ ID NO: 176127 - DNA, 16 bp, H. sapiens
ttttattttaaattgc

SEQ ID NO: 176128 - DNA, 16 bp, H. sapiens
ttttattttaagaaga

SEQ ID NO: 176129 - DNA, 16 bp, H. sapiens
ttttattttagaatca

SEQ ID NO: 176130 - DNA, 16 bp, H. sapiens
ttttattttagcatat

SEQ ID NO: 176131 - DNA, 16 bp, H. sapiens
ttttattttagcatta

SEQ ID NO: 176132 - DNA, 16 bp, H. sapiens
ttttattttcaagaat

SEQ ID NO: 176133 - DNA, 16 bp, H. sapiens
ttttattttcagaagt

SEQ ID NO: 176134 - DNA, 16 bp, H. sapiens
ttttattttcagattg

SEQ ID NO: 176135 - DNA, 16 bp, H. sapiens
ttttattttcagtaaa

SEQ ID NO: 176136 - DNA, 16 bp, H. sapiens
ttttattttcatgaaa

SEQ ID NO: 176137 - DNA, 16 bp, H. sapiens
ttttattttcatgaag

SEQ ID NO: 176138 - DNA, 16 bp, H. sapiens
ttttattttcccaaat

SEQ ID NO: 176139 - DNA, 16 bp, H. sapiens
ttttattttccccaaa

SEQ ID NO: 176140 - DNA, 16 bp, H. sapiens
ttttattttcctgctg

SEQ ID NO: 176141 - DNA, 16 bp, H. sapiens
ttttattttcctgtaa

SEQ ID NO: 176142 - DNA, 16 bp, H. sapiens
ttttattttctctcag

SEQ ID NO: 176143 - DNA, 16 bp, H. sapiens
ttttattttctgaaaa

SEQ ID NO: 176144 - DNA, 16 bp, H. sapiens
ttttattttctgaata

SEQ ID NO: 176145 - DNA, 16 bp, H. sapiens
ttttattttcttaaga

SEQ ID NO: 176146 - DNA, 16 bp, H. sapiens
ttttattttgaaacaa

SEQ ID NO: 176147 - DNA, 16 bp, H. sapiens
ttttattttgaaggaa

SEQ ID NO: 176148 - DNA, 16 bp, H. sapiens
ttttattttgagatca

SEQ ID NO: 176149 - DNA, 16 bp, H. sapiens
ttttattttgaggtaa

SEQ ID NO: 176150 - DNA, 16 bp, H. sapiens
ttttattttgccaagg

SEQ ID NO: 176151 - DNA, 16 bp, H. sapiens
ttttattttgctaaat

SEQ ID NO: 176152 - DNA, 16 bp, H. sapiens
ttttattttggaaagt

SEQ ID NO: 176153 - DNA, 16 bp, H. sapiens
ttttattttgtcaaat

SEQ ID NO: 176154 - DNA, 16 bp, H. sapiens
ttttatttttactaga

SEQ ID NO: 176155 - DNA, 16 bp, H. sapiens
ttttatttttagcata

SEQ ID NO: 176156 - DNA, 16 bp, H. sapiens
ttttatttttctgaaa

SEQ ID NO: 176157 - DNA, 16 bp, H. sapiens
ttttatttttctgaca

SEQ ID NO: 176158 - DNA, 16 bp, H. sapiens
ttttatttttgaggca

SEQ ID NO: 176159 - DNA, 16 bp, H. sapiens
ttttatttttgcacat

SEQ ID NO: 176160 - DNA, 16 bp, H. sapiens
ttttatttttggaaac

SEQ ID NO: 176161 - DNA, 16 bp, H. sapiens
ttttattttttgcaaa

SEQ ID NO: 176162 - DNA, 16 bp, H. sapiens
ttttcaaaaaatcaag

SEQ ID NO: 176163 - DNA, 16 bp, H. sapiens
ttttcaaaaaatcagc

SEQ ID NO: 176164 - DNA, 16 bp, H. sapiens
ttttcaaaaaattgtt

SEQ ID NO: 176165 - DNA, 16 bp, H. sapiens
ttttcaaaaacaatta

SEQ ID NO: 176166 - DNA, 16 bp, H. sapiens
ttttcaaaaacaattt

SEQ ID NO: 176167 - DNA, 16 bp, H. sapiens
ttttcaaaaacatatt

SEQ ID NO: 176168 - DNA, 16 bp, H. sapiens
ttttcaaaaacattaa

SEQ ID NO: 176169 - DNA, 16 bp, H. sapiens
ttttcaaaaagatttt

SEQ ID NO: 176170 - DNA, 16 bp, H. sapiens
ttttcaaaaagcaaat

SEQ ID NO: 176171 - DNA, 16 bp, H. sapiens
ttttcaaaaagtaaaa

SEQ ID NO: 176172 - DNA, 16 bp, H. sapiens
ttttcaaaaagtatta

SEQ ID NO: 176173 - DNA, 16 bp, H. sapiens
ttttcaaaaatacttt

SEQ ID NO: 176174 - DNA, 16 bp, H. sapiens
ttttcaaaaatataca

SEQ ID NO: 176175 - DNA, 16 bp, H. sapiens
ttttcaaaaatcattt

SEQ ID NO: 176176 - DNA, 16 bp, H. sapiens
ttttcaaaaatgtcta

SEQ ID NO: 176177 - DNA, 16 bp, H. sapiens
ttttcaaaacactgaa

SEQ ID NO: 176178 - DNA, 16 bp, H. sapiens
ttttcaaaacagaaat

SEQ ID NO: 176179 - DNA, 16 bp, H. sapiens
ttttcaaaacataaat

SEQ ID NO: 176180 - DNA, 16 bp, H. sapiens
ttttcaaaacatcttt

SEQ ID NO: 176181 - DNA, 16 bp, H. sapiens
ttttcaaaacatttaa

SEQ ID NO: 176182 - DNA, 16 bp, H. sapiens
ttttcaaaacccaaag

SEQ ID NO: 176183 - DNA, 16 bp, H. sapiens
ttttcaaaactcacat

SEQ ID NO: 176184 - DNA, 16 bp, H. sapiens
ttttcaaaactgaaaa

SEQ ID NO: 176185 - DNA, 16 bp, H. sapiens
ttttcaaaactgctca

SEQ ID NO: 176186 - DNA, 16 bp, H. sapiens
ttttcaaaactgtatt

SEQ ID NO: 176187 - DNA, 16 bp, H. sapiens
ttttcaaaactgtttt

SEQ ID NO: 176188 - DNA, 16 bp, H. sapiens
ttttcaaaagaaacag

SEQ ID NO: 176189 - DNA, 16 bp, H. sapiens
ttttcaaaagaaataa

SEQ ID NO: 176190 - DNA, 16 bp, H. sapiens
ttttcaaaagaagaca

SEQ ID NO: 176191 - DNA, 16 bp, H. sapiens
ttttcaaaagaaggca

SEQ ID NO: 176192 - DNA, 16 bp, H. sapiens
ttttcaaaagaattat

SEQ ID NO: 176193 - DNA, 16 bp, H. sapiens
ttttcaaaagataatt

SEQ ID NO: 176194 - DNA, 16 bp, H. sapiens
ttttcaaaagcaaaat

SEQ ID NO: 176195 - DNA, 16 bp, H. sapiens
ttttcaaaagtaataa

SEQ ID NO: 176196 - DNA, 16 bp, H. sapiens
ttttcaaaagtatttt

SEQ ID NO: 176197 - DNA, 16 bp, H. sapiens
ttttcaaaagttttca

SEQ ID NO: 176198 - DNA, 16 bp, H. sapiens
ttttcaaaataaaaga

SEQ ID NO: 176199 - DNA, 16 bp, H. sapiens
ttttcaaaataagttt

SEQ ID NO: 176200 - DNA, 16 bp, H. sapiens
ttttcaaaataattac

SEQ ID NO: 176201 - DNA, 16 bp, H. sapiens
ttttcaaaataggaaa

SEQ ID NO: 176202 - DNA, 16 bp, H. sapiens
ttttcaaaatattact

SEQ ID NO: 176203 - DNA, 16 bp, H. sapiens
ttttcaaaatcattta

SEQ ID NO: 176204 - DNA, 16 bp, H. sapiens
ttttcaaaatctttct

SEQ ID NO: 176205 - DNA, 16 bp, H. sapiens
ttttcaaaatgaaaat

SEQ ID NO: 176206 - DNA, 16 bp, H. sapiens
ttttcaaaatgacaaa

SEQ ID NO: 176207 - DNA, 16 bp, H. sapiens
ttttcaaaatggctgt

SEQ ID NO: 176208 - DNA, 16 bp, H. sapiens
ttttcaaaatgtaaaa

SEQ ID NO: 176209 - DNA, 16 bp, H. sapiens
ttttcaaaatgtaaat

SEQ ID NO: 176210 - DNA, 16 bp, H. sapiens
ttttcaaaatgtattt

SEQ ID NO: 176211 - DNA, 16 bp, H. sapiens
ttttcaaaatgtttat

SEQ ID NO: 176212 - DNA, 16 bp, H. sapiens
ttttcaaaattagaaa

SEQ ID NO: 176213 - DNA, 16 bp, H. sapiens
ttttcaaaattgtttt

SEQ ID NO: 176214 - DNA, 16 bp, H. sapiens
ttttcaaaatttcaaa

SEQ ID NO: 176215 - DNA, 16 bp, H. sapiens
ttttcaaacaagaaaa

SEQ ID NO: 176216 - DNA, 16 bp, H. sapiens
ttttcaaactcatttt

SEQ ID NO: 176217 - DNA, 16 bp, H. sapiens
ttttcaaactgacttt

SEQ ID NO: 176218 - DNA, 16 bp, H. sapiens
ttttcaaactgcagtt

SEQ ID NO: 176219 - DNA, 16 bp, H. sapiens
ttttcaaactgctttt

SEQ ID NO: 176220 - DNA, 16 bp, H. sapiens
ttttcaaacttaaaaa

SEQ ID NO: 176221 - DNA, 16 bp, H. sapiens
ttttcaaacttttaaa

SEQ ID NO: 176222 - DNA, 16 bp, H. sapiens
ttttcaaacttttaga

SEQ ID NO: 176223 - DNA, 16 bp, H. sapiens
ttttcaaagaaaaaaa

SEQ ID NO: 176224 - DNA, 16 bp, H. sapiens
ttttcaaagaaaagaa

SEQ ID NO: 176225 - DNA, 16 bp, H. sapiens
ttttcaaagaaataaa

SEQ ID NO: 176226 - DNA, 16 bp, H. sapiens
ttttcaaagaaatttt

SEQ ID NO: 176227 - DNA, 16 bp, H. sapiens
ttttcaaagagatttt

SEQ ID NO: 176228 - DNA, 16 bp, H. sapiens
ttttcaaagatgcttt

SEQ ID NO: 176229 - DNA, 16 bp, H. sapiens
ttttcaaagcactttt

SEQ ID NO: 176230 - DNA, 16 bp, H. sapiens
ttttcaaagcagtttt

SEQ ID NO: 176231 - DNA, 16 bp, H. sapiens
ttttcaaaggcaatgc

SEQ ID NO: 176232 - DNA, 16 bp, H. sapiens
ttttcaaagtaatttt

SEQ ID NO: 176233 - DNA, 16 bp, H. sapiens
ttttcaaagtacttta

SEQ ID NO: 176234 - DNA, 16 bp, H. sapiens
ttttcaaagtcctttt

SEQ ID NO: 176235 - DNA, 16 bp, H. sapiens
ttttcaaagtttaaaa

SEQ ID NO: 176236 - DNA, 16 bp, H. sapiens
ttttcaaagttttcag

SEQ ID NO: 176237 - DNA, 16 bp, H. sapiens
ttttcaaataaaagaa

SEQ ID NO: 176238 - DNA, 16 bp, H. sapiens
ttttcaaataaaatct

SEQ ID NO: 176239 - DNA, 16 bp, H. sapiens
ttttcaaataaatatg

SEQ ID NO: 176240 - DNA, 16 bp, H. sapiens
ttttcaaataacattt

SEQ ID NO: 176241 - DNA, 16 bp, H. sapiens
ttttcaaataagaaaa

SEQ ID NO: 176242 - DNA, 16 bp, H. sapiens
ttttcaaatatacaat

SEQ ID NO: 176243 - DNA, 16 bp, H. sapiens
ttttcaaatatatgtt

SEQ ID NO: 176244 - DNA, 16 bp, H. sapiens
ttttcaaatatccttt

SEQ ID NO: 176245 - DNA, 16 bp, H. sapiens
ttttcaaatcaacttt

SEQ ID NO: 176246 - DNA, 16 bp, H. sapiens
ttttcaaatcaggaaa

SEQ ID NO: 176247 - DNA, 16 bp, H. sapiens
ttttcaaatcatgttt

SEQ ID NO: 176248 - DNA, 16 bp, H. sapiens
ttttcaaatctgtttt

SEQ ID NO: 176249 - DNA, 16 bp, H. sapiens
ttttcaaatgaagaca

SEQ ID NO: 176250 - DNA, 16 bp, H. sapiens
ttttcaaatgaccaat

SEQ ID NO: 176251 - DNA, 16 bp, H. sapiens
ttttcaaatgtagaaa

SEQ ID NO: 176252 - DNA, 16 bp, H. sapiens
ttttcaaatgtgaaat

SEQ ID NO: 176253 - DNA, 16 bp, H. sapiens
ttttcaaatgtgtaaa

SEQ ID NO: 176254 - DNA, 16 bp, H. sapiens
ttttcaaatgttattt

SEQ ID NO: 176255 - DNA, 16 bp, H. sapiens
ttttcaaatgtttatt

SEQ ID NO: 176256 - DNA, 16 bp, H. sapiens
ttttcaaatgtttttg

SEQ ID NO: 176257 - DNA, 16 bp, H. sapiens
ttttcaaattctgaaa

SEQ ID NO: 176258 - DNA, 16 bp, H. sapiens
ttttcaaattgaagaa

SEQ ID NO: 176259 - DNA, 16 bp, H. sapiens
ttttcaaattgataaa

SEQ ID NO: 176260 - DNA, 16 bp, H. sapiens
ttttcaaattgctttt

SEQ ID NO: 176261 - DNA, 16 bp, H. sapiens
ttttcaaatttttgta

SEQ ID NO: 176262 - DNA, 16 bp, H. sapiens
ttttcaacaatggtgc

SEQ ID NO: 176263 - DNA, 16 bp, H. sapiens
ttttcaacaatttaaa

SEQ ID NO: 176264 - DNA, 16 bp, H. sapiens
ttttcaacacatgatg

SEQ ID NO: 176265 - DNA, 16 bp, H. sapiens
ttttcaacatgaaaat

SEQ ID NO: 176266 - DNA, 16 bp, H. sapiens
ttttcaacatgccttc

SEQ ID NO: 176267 - DNA, 16 bp, H. sapiens
ttttcaacattgtatt

SEQ ID NO: 176268 - DNA, 16 bp, H. sapiens
ttttcaacattgtttt

SEQ ID NO: 176269 - DNA, 16 bp, H. sapiens
ttttcaacatttcaaa

SEQ ID NO: 176270 - DNA, 16 bp, H. sapiens
ttttcaactttatgat

SEQ ID NO: 176271 - DNA, 16 bp, H. sapiens
ttttcaacttttagat

SEQ ID NO: 176272 - DNA, 16 bp, H. sapiens
ttttcaacttttcact

SEQ ID NO: 176273 - DNA, 16 bp, H. sapiens
ttttcaagaaaaaaaa

SEQ ID NO: 176274 - DNA, 16 bp, H. sapiens
ttttcaagaaaattga

SEQ ID NO: 176275 - DNA, 16 bp, H. sapiens
ttttcaagaaacaaaa

SEQ ID NO: 176276 - DNA, 16 bp, H. sapiens
ttttcaagaaataaaa

SEQ ID NO: 176277 - DNA, 16 bp, H. sapiens
ttttcaagaagaaaaa

SEQ ID NO: 176278 - DNA, 16 bp, H. sapiens
ttttcaagaaggaaaa

SEQ ID NO: 176279 - DNA, 16 bp, H. sapiens
ttttcaagaatacaat

SEQ ID NO: 176280 - DNA, 16 bp, H. sapiens
ttttcaagaatgcaat

SEQ ID NO: 176281 - DNA, 16 bp, H. sapiens
ttttcaagaatttttt

SEQ ID NO: 176282 - DNA, 16 bp, H. sapiens
ttttcaagatattttt

SEQ ID NO: 176283 - DNA, 16 bp, H. sapiens
ttttcaagatcatttt

SEQ ID NO: 176284 - DNA, 16 bp, H. sapiens
ttttcaagattaaaaa

SEQ ID NO: 176285 - DNA, 16 bp, H. sapiens
ttttcaagattcatcc

SEQ ID NO: 176286 - DNA, 16 bp, H. sapiens
ttttcaagatttattc

SEQ ID NO: 176287 - DNA, 16 bp, H. sapiens
ttttcaaggaaaaaca

SEQ ID NO: 176288 - DNA, 16 bp, H. sapiens
ttttcaaggaagaaaa

SEQ ID NO: 176289 - DNA, 16 bp, H. sapiens
ttttcaaggatagttt

SEQ ID NO: 176290 - DNA, 16 bp, H. sapiens
ttttcaaggatatttt

SEQ ID NO: 176291 - DNA, 16 bp, H. sapiens
ttttcaaggtcacaca

SEQ ID NO: 176292 - DNA, 16 bp, H. sapiens
ttttcaaggtttttaa

SEQ ID NO: 176293 - DNA, 16 bp, H. sapiens
ttttcaagtctctgct

SEQ ID NO: 176294 - DNA, 16 bp, H. sapiens
ttttcaagtgctcagt

SEQ ID NO: 176295 - DNA, 16 bp, H. sapiens
ttttcaagtgtatttt

SEQ ID NO: 176296 - DNA, 16 bp, H. sapiens
ttttcaagtgttttat

SEQ ID NO: 176297 - DNA, 16 bp, H. sapiens
ttttcaagttcacatg

SEQ ID NO: 176298 - DNA, 16 bp, H. sapiens
ttttcaagtttacata

SEQ ID NO: 176299 - DNA, 16 bp, H. sapiens
ttttcaatgaaaaaaa

SEQ ID NO: 176300 - DNA, 16 bp, H. sapiens
ttttcaatgcagaatt

SEQ ID NO: 176301 - DNA, 16 bp, H. sapiens
ttttcaatgtaaaaat

SEQ ID NO: 176302 - DNA, 16 bp, H. sapiens
ttttcaatgtacagat

SEQ ID NO: 176303 - DNA, 16 bp, H. sapiens
ttttcaatgtgatttt

SEQ ID NO: 176304 - DNA, 16 bp, H. sapiens
ttttcaattaaagaaa

SEQ ID NO: 176305 - DNA, 16 bp, H. sapiens
ttttcaattaggaaaa

SEQ ID NO: 176306 - DNA, 16 bp, H. sapiens
ttttcaattctctgaa

SEQ ID NO: 176307 - DNA, 16 bp, H. sapiens
ttttcaatttctgaaa

SEQ ID NO: 176308 - DNA, 16 bp, H. sapiens
ttttcaattttgaaaa

SEQ ID NO: 176309 - DNA, 16 bp, H. sapiens
ttttcaatttttggaa

SEQ ID NO: 176310 - DNA, 16 bp, H. sapiens
ttttcacaaaacattt

SEQ ID NO: 176311 - DNA, 16 bp, H. sapiens
ttttcacaaaatgttt

SEQ ID NO: 176312 - DNA, 16 bp, H. sapiens
ttttcacaaatgtttt

SEQ ID NO: 176313 - DNA, 16 bp, H. sapiens
ttttcacaatatttaa

SEQ ID NO: 176314 - DNA, 16 bp, H. sapiens
ttttcacaatggtggc

SEQ ID NO: 176315 - DNA, 16 bp, H. sapiens
ttttcacaattataaa

SEQ ID NO: 176316 - DNA, 16 bp, H. sapiens
ttttcacactgatgat

SEQ ID NO: 176317 - DNA, 16 bp, H. sapiens
ttttcacagaaaaaca

SEQ ID NO: 176318 - DNA, 16 bp, H. sapiens
ttttcacagaactgga

SEQ ID NO: 176319 - DNA, 16 bp, H. sapiens
ttttcacagaattgga

SEQ ID NO: 176320 - DNA, 16 bp, H. sapiens
ttttcacagacagctt

SEQ ID NO: 176321 - DNA, 16 bp, H. sapiens
ttttcacagagaaaga

SEQ ID NO: 176322 - DNA, 16 bp, H. sapiens
ttttcacagatgaaga

SEQ ID NO: 176323 - DNA, 16 bp, H. sapiens
ttttcacagcaccatt

SEQ ID NO: 176324 - DNA, 16 bp, H. sapiens
ttttcacaggtagctt

SEQ ID NO: 176325 - DNA, 16 bp, H. sapiens
ttttcacagtaggcct

SEQ ID NO: 176326 - DNA, 16 bp, H. sapiens
ttttcacataagaaaa

SEQ ID NO: 176327 - DNA, 16 bp, H. sapiens
ttttcacatgcttatt

SEQ ID NO: 176328 - DNA, 16 bp, H. sapiens
ttttcacattgatatt

SEQ ID NO: 176329 - DNA, 16 bp, H. sapiens
ttttcacattgatttt

SEQ ID NO: 176330 - DNA, 16 bp, H. sapiens
ttttcacatttctaaa

SEQ ID NO: 176331 - DNA, 16 bp, H. sapiens
ttttcacatttgattt

SEQ ID NO: 176332 - DNA, 16 bp, H. sapiens
ttttcacatttgcttt

SEQ ID NO: 176333 - DNA, 16 bp, H. sapiens
ttttcacatttgtaaa

SEQ ID NO: 176334 - DNA, 16 bp, H. sapiens
ttttcacattttaaaa

SEQ ID NO: 176335 - DNA, 16 bp, H. sapiens
ttttcacattttacta

SEQ ID NO: 176336 - DNA, 16 bp, H. sapiens
ttttcacattttcctg

SEQ ID NO: 176337 - DNA, 16 bp, H. sapiens
ttttcacatttttagt

SEQ ID NO: 176338 - DNA, 16 bp, H. sapiens
ttttcacatttttatg

SEQ ID NO: 176339 - DNA, 16 bp, H. sapiens
ttttcaccaacagtgt

SEQ ID NO: 176340 - DNA, 16 bp, H. sapiens
ttttcaccatagtcct

SEQ ID NO: 176341 - DNA, 16 bp, H. sapiens
ttttcaccattgacct

SEQ ID NO: 176342 - DNA, 16 bp, H. sapiens
ttttcacccaataaac

SEQ ID NO: 176343 - DNA, 16 bp, H. sapiens
ttttcactagagatgg

SEQ ID NO: 176344 - DNA, 16 bp, H. sapiens
ttttcactatagacct

SEQ ID NO: 176345 - DNA, 16 bp, H. sapiens
ttttcactattacaaa

SEQ ID NO: 176346 - DNA, 16 bp, H. sapiens
ttttcactctcttgat

SEQ ID NO: 176347 - DNA, 16 bp, H. sapiens
ttttcactgtaaaatg

SEQ ID NO: 176348 - DNA, 16 bp, H. sapiens
ttttcactgtattgat

SEQ ID NO: 176349 - DNA, 16 bp, H. sapiens
ttttcactgtgtttgt

SEQ ID NO: 176350 - DNA, 16 bp, H. sapiens
ttttcactgtttttaa

SEQ ID NO: 176351 - DNA, 16 bp, H. sapiens
ttttcacttaaaaaaa

SEQ ID NO: 176352 - DNA, 16 bp, H. sapiens
ttttcacttagggcca

SEQ ID NO: 176353 - DNA, 16 bp, H. sapiens
ttttcacttccttggt

SEQ ID NO: 176354 - DNA, 16 bp, H. sapiens
ttttcacttgcatttc

SEQ ID NO: 176355 - DNA, 16 bp, H. sapiens
ttttcactttcattca

SEQ ID NO: 176356 - DNA, 16 bp, H. sapiens
ttttcagaaaaaaata

SEQ ID NO: 176357 - DNA, 16 bp, H. sapiens
ttttcagaaaaagttt

SEQ ID NO: 176358 - DNA, 16 bp, H. sapiens
ttttcagaaaaataaa

SEQ ID NO: 176359 - DNA, 16 bp, H. sapiens
ttttcagaaaactttt

SEQ ID NO: 176360 - DNA, 16 bp, H. sapiens
ttttcagaaaataaat

SEQ ID NO: 176361 - DNA, 16 bp, H. sapiens
ttttcagaaaatatta

SEQ ID NO: 176362 - DNA, 16 bp, H. sapiens
ttttcagaaaatgaaa

SEQ ID NO: 176363 - DNA, 16 bp, H. sapiens
ttttcagaaactgcat

SEQ ID NO: 176364 - DNA, 16 bp, H. sapiens
ttttcagaaataaaag

SEQ ID NO: 176365 - DNA, 16 bp, H. sapiens
ttttcagaaataaaga

SEQ ID NO: 176366 - DNA, 16 bp, H. sapiens
ttttcagaaatagaaa

SEQ ID NO: 176367 - DNA, 16 bp, H. sapiens
ttttcagaagaaaaaa

SEQ ID NO: 176368 - DNA, 16 bp, H. sapiens
ttttcagaagaaaatg

SEQ ID NO: 176369 - DNA, 16 bp, H. sapiens
ttttcagaagaaataa

SEQ ID NO: 176370 - DNA, 16 bp, H. sapiens
ttttcagaagaagaaa

SEQ ID NO: 176371 - DNA, 16 bp, H. sapiens
ttttcagaagtaaaat

SEQ ID NO: 176372 - DNA, 16 bp, H. sapiens
ttttcagaagtgtctg

SEQ ID NO: 176373 - DNA, 16 bp, H. sapiens
ttttcagaataataaa

SEQ ID NO: 176374 - DNA, 16 bp, H. sapiens
ttttcagaatattttg

SEQ ID NO: 176375 - DNA, 16 bp, H. sapiens
ttttcagaatggcaaa

SEQ ID NO: 176376 - DNA, 16 bp, H. sapiens
ttttcagaattaaaaa

SEQ ID NO: 176377 - DNA, 16 bp, H. sapiens
ttttcagaattatttt

SEQ ID NO: 176378 - DNA, 16 bp, H. sapiens
ttttcagaccacaatg

SEQ ID NO: 176379 - DNA, 16 bp, H. sapiens
ttttcagaccatggtt

SEQ ID NO: 176380 - DNA, 16 bp, H. sapiens
ttttcagacttgtttt

SEQ ID NO: 176381 - DNA, 16 bp, H. sapiens
ttttcagactttaaaa

SEQ ID NO: 176382 - DNA, 16 bp, H. sapiens
ttttcagacttttctt

SEQ ID NO: 176383 - DNA, 16 bp, H. sapiens
ttttcagagaaaaaag

SEQ ID NO: 176384 - DNA, 16 bp, H. sapiens
ttttcagagaaaattt

SEQ ID NO: 176385 - DNA, 16 bp, H. sapiens
ttttcagagcttatat

SEQ ID NO: 176386 - DNA, 16 bp, H. sapiens
ttttcagaggaaaaaa

SEQ ID NO: 176387 - DNA, 16 bp, H. sapiens
ttttcagagtcttgct

SEQ ID NO: 176388 - DNA, 16 bp, H. sapiens
ttttcagagtttttct

SEQ ID NO: 176389 - DNA, 16 bp, H. sapiens
ttttcagataaagaaa

SEQ ID NO: 176390 - DNA, 16 bp, H. sapiens
ttttcagatatgaaaa

SEQ ID NO: 176391 - DNA, 16 bp, H. sapiens
ttttcagatcttttct

SEQ ID NO: 176392 - DNA, 16 bp, H. sapiens
ttttcagatgagggaa

SEQ ID NO: 176393 - DNA, 16 bp, H. sapiens
ttttcagatgatatga

SEQ ID NO: 176394 - DNA, 16 bp, H. sapiens
ttttcagatgcttatt

SEQ ID NO: 176395 - DNA, 16 bp, H. sapiens
ttttcagatggagaaa

SEQ ID NO: 176396 - DNA, 16 bp, H. sapiens
ttttcagatggggaaa

SEQ ID NO: 176397 - DNA, 16 bp, H. sapiens
ttttcagattaggaat

SEQ ID NO: 176398 - DNA, 16 bp, H. sapiens
ttttcagattccacat

SEQ ID NO: 176399 - DNA, 16 bp, H. sapiens
ttttcagattttctat

SEQ ID NO: 176400 - DNA, 16 bp, H. sapiens
ttttcagatttttcat

SEQ ID NO: 176401 - DNA, 16 bp, H. sapiens
ttttcagcaacatccc

SEQ ID NO: 176402 - DNA, 16 bp, H. sapiens
ttttcagcaccacact

SEQ ID NO: 176403 - DNA, 16 bp, H. sapiens
ttttcagcagaaacct

SEQ ID NO: 176404 - DNA, 16 bp, H. sapiens
ttttcagcatcaattg

SEQ ID NO: 176405 - DNA, 16 bp, H. sapiens
ttttcagcatcaattt

SEQ ID NO: 176406 - DNA, 16 bp, H. sapiens
ttttcagcattttcat

SEQ ID NO: 176407 - DNA, 16 bp, H. sapiens
ttttcagccatttaaa

SEQ ID NO: 176408 - DNA, 16 bp, H. sapiens
ttttcagctactattt

SEQ ID NO: 176409 - DNA, 16 bp, H. sapiens
ttttcagctactcagg

SEQ ID NO: 176410 - DNA, 16 bp, H. sapiens
ttttcagctataaaat

SEQ ID NO: 176411 - DNA, 16 bp, H. sapiens
ttttcagctccaggat

SEQ ID NO: 176412 - DNA, 16 bp, H. sapiens
ttttcagcttcagaat

SEQ ID NO: 176413 - DNA, 16 bp, H. sapiens
ttttcagctttaaaaa

SEQ ID NO: 176414 - DNA, 16 bp, H. sapiens
ttttcagcttttctcc

SEQ ID NO: 176415 - DNA, 16 bp, H. sapiens
ttttcagcttttctgt

SEQ ID NO: 176416 - DNA, 16 bp, H. sapiens
ttttcagcttttgccc

SEQ ID NO: 176417 - DNA, 16 bp, H. sapiens
ttttcagcttttgtat

SEQ ID NO: 176418 - DNA, 16 bp, H. sapiens
ttttcagctttttact

SEQ ID NO: 176419 - DNA, 16 bp, H. sapiens
ttttcaggaaaaaaat

SEQ ID NO: 176420 - DNA, 16 bp, H. sapiens
ttttcaggaaaaacaa

SEQ ID NO: 176421 - DNA, 16 bp, H. sapiens
ttttcaggaaaaactg

SEQ ID NO: 176422 - DNA, 16 bp, H. sapiens
ttttcaggaatttttt

SEQ ID NO: 176423 - DNA, 16 bp, H. sapiens
ttttcaggatttgttt

SEQ ID NO: 176424 - DNA, 16 bp, H. sapiens
ttttcaggattttgat

SEQ ID NO: 176425 - DNA, 17 bp, H. sapiens
ttttcagggacatggat

SEQ ID NO: 176426 - DNA, 16 bp, H. sapiens
ttttcaggggaagaat

SEQ ID NO: 176427 - DNA, 16 bp, H. sapiens
ttttcagggttatttt

SEQ ID NO: 176428 - DNA, 16 bp, H. sapiens
ttttcagggttttaaa

SEQ ID NO: 176429 - DNA, 16 bp, H. sapiens
ttttcaggttttgaaa

SEQ ID NO: 176430 - DNA, 16 bp, H. sapiens
ttttcagtaataataa

SEQ ID NO: 176431 - DNA, 16 bp, H. sapiens
ttttcagtagacacgg

SEQ ID NO: 176432 - DNA, 16 bp, H. sapiens
ttttcagtagagacag

SEQ ID NO: 176433 - DNA, 16 bp, H. sapiens
ttttcagtagagaccg

SEQ ID NO: 176434 - DNA, 16 bp, H. sapiens
ttttcagtataaaaat

SEQ ID NO: 176435 - DNA, 16 bp, H. sapiens
ttttcagtataaatat

SEQ ID NO: 176436 - DNA, 16 bp, H. sapiens
ttttcagtataagtat

SEQ ID NO: 176437 - DNA, 16 bp, H. sapiens
ttttcagtatattttc

SEQ ID NO: 176438 - DNA, 16 bp, H. sapiens
ttttcagtattttcca

SEQ ID NO: 176439 - DNA, 16 bp, H. sapiens
ttttcagtgaaagaaa

SEQ ID NO: 176440 - DNA, 17 bp, H. sapiens
ttttcagtgagccaaga

SEQ ID NO: 176441 - DNA, 16 bp, H. sapiens
ttttcagtgatatgaa

SEQ ID NO: 176442 - DNA, 16 bp, H. sapiens
ttttcagtggacagag

SEQ ID NO: 176443 - DNA, 16 bp, H. sapiens
ttttcagtgtacaagt

SEQ ID NO: 176444 - DNA, 16 bp, H. sapiens
ttttcagttattttaa

SEQ ID NO: 176445 - DNA, 16 bp, H. sapiens
ttttcagttgactttt

SEQ ID NO: 176446 - DNA, 16 bp, H. sapiens
ttttcagtttagttat

SEQ ID NO: 176447 - DNA, 16 bp, H. sapiens
ttttcagtttcccttt

SEQ ID NO: 176448 - DNA, 16 bp, H. sapiens
ttttcagtttgttcag

SEQ ID NO: 176449 - DNA, 16 bp, H. sapiens
ttttcagtttttaaaa

SEQ ID NO: 176450 - DNA, 16 bp, H. sapiens
ttttcataaaacattt

SEQ ID NO: 176451 - DNA, 16 bp, H. sapiens
ttttcataaaagaaat

SEQ ID NO: 176452 - DNA, 16 bp, H. sapiens
ttttcataaaaggaaa

SEQ ID NO: 176453 - DNA, 16 bp, H. sapiens
ttttcataaagctaaa

SEQ ID NO: 176454 - DNA, 16 bp, H. sapiens
ttttcataaggaaaat

SEQ ID NO: 176455 - DNA, 16 bp, H. sapiens
ttttcataatatacat

SEQ ID NO: 176456 - DNA, 16 bp, H. sapiens
ttttcataatccagtc

SEQ ID NO: 176457 - DNA, 16 bp, H. sapiens
ttttcataatgttaaa

SEQ ID NO: 176458 - DNA, 16 bp, H. sapiens
ttttcataccagtacc

SEQ ID NO: 176459 - DNA, 16 bp, H. sapiens
ttttcatagaaaaaga

SEQ ID NO: 176460 - DNA, 16 bp, H. sapiens
ttttcatagaaaataa

SEQ ID NO: 176461 - DNA, 16 bp, H. sapiens
ttttcatagagatgga

SEQ ID NO: 176462 - DNA, 16 bp, H. sapiens
ttttcatagatgatat

SEQ ID NO: 176463 - DNA, 16 bp, H. sapiens
ttttcatatactcatt

SEQ ID NO: 176464 - DNA, 16 bp, H. sapiens
ttttcatatatgtgtt

SEQ ID NO: 176465 - DNA, 16 bp, H. sapiens
ttttcatatgcctctt

SEQ ID NO: 176466 - DNA, 16 bp, H. sapiens
ttttcatatgcctgtt

SEQ ID NO: 176467 - DNA, 16 bp, H. sapiens
ttttcatatgcttgtt

SEQ ID NO: 176468 - DNA, 16 bp, H. sapiens
ttttcatatgttggtt

SEQ ID NO: 176469 - DNA, 16 bp, H. sapiens
ttttcatatgttgtgt

SEQ ID NO: 176470 - DNA, 16 bp, H. sapiens
ttttcatcaactttgt

SEQ ID NO: 176471 - DNA, 16 bp, H. sapiens
ttttcatcaccccaaa

SEQ ID NO: 176472 - DNA, 16 bp, H. sapiens
ttttcatcacccccaa

SEQ ID NO: 176473 - DNA, 16 bp, H. sapiens
ttttcatcactccaaa

SEQ ID NO: 176474 - DNA, 16 bp, H. sapiens
ttttcatcagttttgt

SEQ ID NO: 176475 - DNA, 16 bp, H. sapiens
ttttcatcatgaatgg

SEQ ID NO: 176476 - DNA, 16 bp, H. sapiens
ttttcatcattaaaaa

SEQ ID NO: 176477 - DNA, 16 bp, H. sapiens
ttttcatctataaaat

SEQ ID NO: 176478 - DNA, 16 bp, H. sapiens
ttttcatctatgattt

SEQ ID NO: 176479 - DNA, 16 bp, H. sapiens
ttttcatctctgtatt

SEQ ID NO: 176480 - DNA, 16 bp, H. sapiens
ttttcatcttaaaaaa

SEQ ID NO: 176481 - DNA, 16 bp, H. sapiens
ttttcatcttataaaa

SEQ ID NO: 176482 - DNA, 16 bp, H. sapiens
ttttcatcttgaaatc

SEQ ID NO: 176483 - DNA, 16 bp, H. sapiens
ttttcatcttgtgaaa

SEQ ID NO: 176484 - DNA, 16 bp, H. sapiens
ttttcatctttcaaaa

SEQ ID NO: 176485 - DNA, 16 bp, H. sapiens
ttttcatctttgccaa

SEQ ID NO: 176486 - DNA, 16 bp, H. sapiens
ttttcatctttgtgtc

SEQ ID NO: 176487 - DNA, 16 bp, H. sapiens
ttttcatcttttctgc

SEQ ID NO: 176488 - DNA, 16 bp, H. sapiens
ttttcatgaaaagaaa

SEQ ID NO: 176489 - DNA, 16 bp, H. sapiens
ttttcatgaataaata

SEQ ID NO: 176490 - DNA, 16 bp, H. sapiens
ttttcatgcctgctaa

SEQ ID NO: 176491 - DNA, 16 bp, H. sapiens
ttttcatgctgatgat

SEQ ID NO: 176492 - DNA, 16 bp, H. sapiens
ttttcatgctgcttat

SEQ ID NO: 176493 - DNA, 16 bp, H. sapiens
ttttcatggctgcata

SEQ ID NO: 176494 - DNA, 16 bp, H. sapiens
ttttcatggttgcata

SEQ ID NO: 176495 - DNA, 16 bp, H. sapiens
ttttcatgtaattatt

SEQ ID NO: 176496 - DNA, 16 bp, H. sapiens
ttttcatgtatttgca

SEQ ID NO: 176497 - DNA, 16 bp, H. sapiens
ttttcatgtcaataaa

SEQ ID NO: 176498 - DNA, 16 bp, H. sapiens
ttttcatgtctgattt

SEQ ID NO: 176499 - DNA, 16 bp, H. sapiens
ttttcatgtctttcat

SEQ ID NO: 176500 - DNA, 16 bp, H. sapiens
ttttcatgtgaatatt

SEQ ID NO: 176501 - DNA, 16 bp, H. sapiens
ttttcatgtgcttctt

SEQ ID NO: 176502 - DNA, 16 bp, H. sapiens
ttttcatgtggttatt

SEQ ID NO: 176503 - DNA, 16 bp, H. sapiens
ttttcatgtgtctttc

SEQ ID NO: 176504 - DNA, 16 bp, H. sapiens
ttttcatgttaaaatt

SEQ ID NO: 176505 - DNA, 16 bp, H. sapiens
ttttcatgttaataat

SEQ ID NO: 176506 - DNA, 16 bp, H. sapiens
ttttcatgttgctgat

SEQ ID NO: 176507 - DNA, 16 bp, H. sapiens
ttttcatgtttaaaat

SEQ ID NO: 176508 - DNA, 16 bp, H. sapiens
ttttcatgttttcaat

SEQ ID NO: 176509 - DNA, 16 bp, H. sapiens
ttttcattaaaatgaa

SEQ ID NO: 176510 - DNA, 16 bp, H. sapiens
ttttcattaaatgttt

SEQ ID NO: 176511 - DNA, 16 bp, H. sapiens
ttttcattaccacaaa

SEQ ID NO: 176512 - DNA, 16 bp, H. sapiens
ttttcattagaaataa

SEQ ID NO: 176513 - DNA, 16 bp, H. sapiens
ttttcattcaataaat

SEQ ID NO: 176514 - DNA, 16 bp, H. sapiens
ttttcattcagtactt

SEQ ID NO: 176515 - DNA, 16 bp, H. sapiens
ttttcattcccttaac

SEQ ID NO: 176516 - DNA, 16 bp, H. sapiens
ttttcattcttcaaat

SEQ ID NO: 176517 - DNA, 16 bp, H. sapiens
ttttcattcttttgaa

SEQ ID NO: 176518 - DNA, 16 bp, H. sapiens
ttttcattgaaaaaca

SEQ ID NO: 176519 - DNA, 16 bp, H. sapiens
ttttcattgaaatata

SEQ ID NO: 176520 - DNA, 16 bp, H. sapiens
ttttcattgatttaaa

SEQ ID NO: 176521 - DNA, 16 bp, H. sapiens
ttttcattgctgcata

SEQ ID NO: 176522 - DNA, 16 bp, H. sapiens
ttttcattgtaaaata

SEQ ID NO: 176523 - DNA, 16 bp, H. sapiens
ttttcattgtaaagat

SEQ ID NO: 176524 - DNA, 16 bp, H. sapiens
ttttcattgtaaatta

SEQ ID NO: 176525 - DNA, 16 bp, H. sapiens
ttttcattgttttaca

SEQ ID NO: 176526 - DNA, 16 bp, H. sapiens
ttttcatttaaagaaa

SEQ ID NO: 176527 - DNA, 16 bp, H. sapiens
ttttcatttaaagtga

SEQ ID NO: 176528 - DNA, 16 bp, H. sapiens
ttttcatttaagtatt

SEQ ID NO: 176529 - DNA, 16 bp, H. sapiens
ttttcatttagaaaat

SEQ ID NO: 176530 - DNA, 16 bp, H. sapiens
ttttcatttcactgtg

SEQ ID NO: 176531 - DNA, 16 bp, H. sapiens
ttttcatttcatgaaa

SEQ ID NO: 176532 - DNA, 16 bp, H. sapiens
ttttcatttccaaata

SEQ ID NO: 176533 - DNA, 16 bp, H. sapiens
ttttcatttccataaa

SEQ ID NO: 176534 - DNA, 16 bp, H. sapiens
ttttcatttccctgaa

SEQ ID NO: 176535 - DNA, 16 bp, H. sapiens
ttttcatttctaacaa

SEQ ID NO: 176536 - DNA, 16 bp, H. sapiens
ttttcatttctagaat

SEQ ID NO: 176537 - DNA, 16 bp, H. sapiens
ttttcatttctctgga

SEQ ID NO: 176538 - DNA, 16 bp, H. sapiens
ttttcatttctgtata

SEQ ID NO: 176539 - DNA, 16 bp, H. sapiens
ttttcatttcttcctg

SEQ ID NO: 176540 - DNA, 16 bp, H. sapiens
ttttcatttgacttct

SEQ ID NO: 176541 - DNA, 16 bp, H. sapiens
ttttcatttggaaatt

SEQ ID NO: 176542 - DNA, 16 bp, H. sapiens
ttttcatttgtaaaat

SEQ ID NO: 176543 - DNA, 16 bp, H. sapiens
ttttcatttgtagaaa

SEQ ID NO: 176544 - DNA, 16 bp, H. sapiens
ttttcatttgtgaaat

SEQ ID NO: 176545 - DNA, 16 bp, H. sapiens
ttttcattttaaagaa

SEQ ID NO: 176546 - DNA, 16 bp, H. sapiens
ttttcattttaagtgt

SEQ ID NO: 176547 - DNA, 16 bp, H. sapiens
ttttcattttacaagt

SEQ ID NO: 176548 - DNA, 16 bp, H. sapiens
ttttcattttagacat

SEQ ID NO: 176549 - DNA, 16 bp, H. sapiens
ttttcattttagccat

SEQ ID NO: 176550 - DNA, 16 bp, H. sapiens
ttttcattttataatg

SEQ ID NO: 176551 - DNA, 16 bp, H. sapiens
ttttcattttcaaatg

SEQ ID NO: 176552 - DNA, 16 bp, H. sapiens
ttttcattttcaagat

SEQ ID NO: 176553 - DNA, 16 bp, H. sapiens
ttttcattttcactaa

SEQ ID NO: 176554 - DNA, 16 bp, H. sapiens
ttttcattttcctgat

SEQ ID NO: 176555 - DNA, 16 bp, H. sapiens
ttttcattttctcagt

SEQ ID NO: 176556 - DNA, 16 bp, H. sapiens
ttttcattttcttaga

SEQ ID NO: 176557 - DNA, 16 bp, H. sapiens
ttttcattttgattaa

SEQ ID NO: 176558 - DNA, 16 bp, H. sapiens
ttttcattttgcactg

SEQ ID NO: 176559 - DNA, 16 bp, H. sapiens
ttttcattttgcagaa

SEQ ID NO: 176560 - DNA, 16 bp, H. sapiens
ttttcattttgttcca

SEQ ID NO: 176561 - DNA, 16 bp, H. sapiens
ttttcatttttcagat

SEQ ID NO: 176562 - DNA, 16 bp, H. sapiens
ttttcatttttcagtg

SEQ ID NO: 176563 - DNA, 16 bp, H. sapiens
ttttcatttttcatga

SEQ ID NO: 176564 - DNA, 16 bp, H. sapiens
ttttcatttttgcata

SEQ ID NO: 176565 - DNA, 16 bp, H. sapiens
ttttccaaaaaagaga

SEQ ID NO: 176566 - DNA, 16 bp, H. sapiens
ttttccaaaaaggaaa

SEQ ID NO: 176567 - DNA, 16 bp, H. sapiens
ttttccaaaacaaaaa

SEQ ID NO: 176568 - DNA, 16 bp, H. sapiens
ttttccaaaacaaata

SEQ ID NO: 176569 - DNA, 16 bp, H. sapiens
ttttccaaaaccactc

SEQ ID NO: 176570 - DNA, 16 bp, H. sapiens
ttttccaaaagaaaaa

SEQ ID NO: 176571 - DNA, 16 bp, H. sapiens
ttttccaaaagcaaaa

SEQ ID NO: 176572 - DNA, 16 bp, H. sapiens
ttttccaaaaggaaaa

SEQ ID NO: 176573 - DNA, 16 bp, H. sapiens
ttttccaaaataaata

SEQ ID NO: 176574 - DNA, 16 bp, H. sapiens
ttttccaaaatacttt

SEQ ID NO: 176575 - DNA, 16 bp, H. sapiens
ttttccaaaatcattt

SEQ ID NO: 176576 - DNA, 16 bp, H. sapiens
ttttccaaaatgatga

SEQ ID NO: 176577 - DNA, 16 bp, H. sapiens
ttttccaaaatgttat

SEQ ID NO: 176578 - DNA, 16 bp, H. sapiens
ttttccaaaattgtat

SEQ ID NO: 176579 - DNA, 16 bp, H. sapiens
ttttccaaaattgttt

SEQ ID NO: 176580 - DNA, 16 bp, H. sapiens
ttttccaaacaaaaat

SEQ ID NO: 176581 - DNA, 16 bp, H. sapiens
ttttccaaacatttaa

SEQ ID NO: 176582 - DNA, 16 bp, H. sapiens
ttttccaaacattttt

SEQ ID NO: 176583 - DNA, 16 bp, H. sapiens
ttttccaaaccaaaaa

SEQ ID NO: 176584 - DNA, 16 bp, H. sapiens
ttttccaaactgcttt

SEQ ID NO: 176585 - DNA, 16 bp, H. sapiens
ttttccaaacttattt

SEQ ID NO: 176586 - DNA, 16 bp, H. sapiens
ttttccaaacttttat

SEQ ID NO: 176587 - DNA, 16 bp, H. sapiens
ttttccaaagaaaaca

SEQ ID NO: 176588 - DNA, 16 bp, H. sapiens
ttttccaaagaaaata

SEQ ID NO: 176589 - DNA, 16 bp, H. sapiens
ttttccaaagaagaca

SEQ ID NO: 176590 - DNA, 16 bp, H. sapiens
ttttccaaagaggctg

SEQ ID NO: 176591 - DNA, 16 bp, H. sapiens
ttttccaaagatgaca

SEQ ID NO: 176592 - DNA, 16 bp, H. sapiens
ttttccaaagtaattg

SEQ ID NO: 176593 - DNA, 16 bp, H. sapiens
ttttccaaagtggtgg

SEQ ID NO: 176594 - DNA, 16 bp, H. sapiens
ttttccaaagtggttg

SEQ ID NO: 176595 - DNA, 16 bp, H. sapiens
ttttccaaagttttat

SEQ ID NO: 176596 - DNA, 16 bp, H. sapiens
ttttccaaataaaatt

SEQ ID NO: 176597 - DNA, 16 bp, H. sapiens
ttttccaaatataaaa

SEQ ID NO: 176598 - DNA, 16 bp, H. sapiens
ttttccaaatataata

SEQ ID NO: 176599 - DNA, 16 bp, H. sapiens
ttttccaaatatcaaa

SEQ ID NO: 176600 - DNA, 16 bp, H. sapiens
ttttccaaatgaattt

SEQ ID NO: 176601 - DNA, 16 bp, H. sapiens
ttttccaaatgaccaa

SEQ ID NO: 176602 - DNA, 16 bp, H. sapiens
ttttccaaatgtaaaa

SEQ ID NO: 176603 - DNA, 16 bp, H. sapiens
ttttccaaattaaaat

SEQ ID NO: 176604 - DNA, 16 bp, H. sapiens
ttttccaaattcattt

SEQ ID NO: 176605 - DNA, 16 bp, H. sapiens
ttttccaaattgattt

SEQ ID NO: 176606 - DNA, 16 bp, H. sapiens
ttttccaaattggttc

SEQ ID NO: 176607 - DNA, 16 bp, H. sapiens
ttttccaacaggaaaa

SEQ ID NO: 176608 - DNA, 16 bp, H. sapiens
ttttccaaccacaatg

SEQ ID NO: 176609 - DNA, 16 bp, H. sapiens
ttttccaactacatat

SEQ ID NO: 176610 - DNA, 16 bp, H. sapiens
ttttccaactcatttt

SEQ ID NO: 176611 - DNA, 16 bp, H. sapiens
ttttccaagatggctg

SEQ ID NO: 176612 - DNA, 16 bp, H. sapiens
ttttccaatctatgaa

SEQ ID NO: 176613 - DNA, 18 bp, H. sapiens
ttttccaattgtgtgaag

SEQ ID NO: 176614 - DNA, 16 bp, H. sapiens
ttttccaatttcaaaa

SEQ ID NO: 176615 - DNA, 16 bp, H. sapiens
ttttccacaaaagaaa

SEQ ID NO: 176616 - DNA, 16 bp, H. sapiens
ttttccacaattaaaa

SEQ ID NO: 176617 - DNA, 16 bp, H. sapiens
ttttccacacagcagc

SEQ ID NO: 176618 - DNA, 16 bp, H. sapiens
ttttccaccagtctgt

SEQ ID NO: 176619 - DNA, 16 bp, H. sapiens
ttttccaccatgattg

SEQ ID NO: 176620 - DNA, 16 bp, H. sapiens
ttttccactgaaatag

SEQ ID NO: 176621 - DNA, 16 bp, H. sapiens
ttttccagaaaataaa

SEQ ID NO: 176622 - DNA, 16 bp, H. sapiens
ttttccagaaacaaaa

SEQ ID NO: 176623 - DNA, 16 bp, H. sapiens
ttttccagaaagaaaa

SEQ ID NO: 176624 - DNA, 16 bp, H. sapiens
ttttccagaaagtttt

SEQ ID NO: 176625 - DNA, 16 bp, H. sapiens
ttttccagaaatgaaa

SEQ ID NO: 176626 - DNA, 16 bp, H. sapiens
ttttccagaaatttgt

SEQ ID NO: 176627 - DNA, 16 bp, H. sapiens
ttttccagaagaagaa

SEQ ID NO: 176628 - DNA, 16 bp, H. sapiens
ttttccagaagagaaa

SEQ ID NO: 176629 - DNA, 16 bp, H. sapiens
ttttccagaaggtttt

SEQ ID NO: 176630 - DNA, 16 bp, H. sapiens
ttttccagaataattt

SEQ ID NO: 176631 - DNA, 16 bp, H. sapiens
ttttccagaatattat

SEQ ID NO: 176632 - DNA, 16 bp, H. sapiens
ttttccagaatgccat

SEQ ID NO: 176633 - DNA, 16 bp, H. sapiens
ttttccagaatgtttt

SEQ ID NO: 176634 - DNA, 16 bp, H. sapiens
ttttccagatgaagaa

SEQ ID NO: 176635 - DNA, 16 bp, H. sapiens
ttttccagcaccattt

SEQ ID NO: 176636 - DNA, 16 bp, H. sapiens
ttttccagcagtccca

SEQ ID NO: 176637 - DNA, 16 bp, H. sapiens
ttttccagcctctgcc

SEQ ID NO: 176638 - DNA, 16 bp, H. sapiens
ttttccagccttcctt

SEQ ID NO: 176639 - DNA, 16 bp, H. sapiens
ttttccagccttcttt

SEQ ID NO: 176640 - DNA, 16 bp, H. sapiens
ttttccagcctttctt

SEQ ID NO: 176641 - DNA, 16 bp, H. sapiens
ttttccagctattttt

SEQ ID NO: 176642 - DNA, 16 bp, H. sapiens
ttttccagcttctgga

SEQ ID NO: 176643 - DNA, 16 bp, H. sapiens
ttttccagctttactg

SEQ ID NO: 176644 - DNA, 16 bp, H. sapiens
ttttccagctttcctt

SEQ ID NO: 176645 - DNA, 16 bp, H. sapiens
ttttccaggaacacag

SEQ ID NO: 176646 - DNA, 16 bp, H. sapiens
ttttccaggaatttac

SEQ ID NO: 176647 - DNA, 16 bp, H. sapiens
ttttccaggatcatat

SEQ ID NO: 176648 - DNA, 16 bp, H. sapiens
ttttccaggctggagt

SEQ ID NO: 176649 - DNA, 16 bp, H. sapiens
ttttccaggctggtct

SEQ ID NO: 176650 - DNA, 16 bp, H. sapiens
ttttccaggctggttt

SEQ ID NO: 176651 - DNA, 16 bp, H. sapiens
ttttccagtctttttc

SEQ ID NO: 176652 - DNA, 16 bp, H. sapiens
ttttccagtgtagaaa

SEQ ID NO: 176653 - DNA, 16 bp, H. sapiens
ttttccagttaaaaaa

SEQ ID NO: 176654 - DNA, 16 bp, H. sapiens
ttttccagtttctaga

SEQ ID NO: 176655 - DNA, 16 bp, H. sapiens
ttttccagtttctctt

SEQ ID NO: 176656 - DNA, 16 bp, H. sapiens
ttttccagtttcttaa

SEQ ID NO: 176657 - DNA, 16 bp, H. sapiens
ttttccagttttactt

SEQ ID NO: 176658 - DNA, 16 bp, H. sapiens
ttttccagttttcaaa

SEQ ID NO: 176659 - DNA, 16 bp, H. sapiens
ttttccagtttttaaa

SEQ ID NO: 176660 - DNA, 16 bp, H. sapiens
ttttccatagcagctg

SEQ ID NO: 176661 - DNA, 16 bp, H. sapiens
ttttccatatccttgc

SEQ ID NO: 176662 - DNA, 16 bp, H. sapiens
ttttccatatggatat

SEQ ID NO: 176663 - DNA, 16 bp, H. sapiens
ttttccatatttaaaa

SEQ ID NO: 176664 - DNA, 16 bp, H. sapiens
ttttccatctataaaa

SEQ ID NO: 176665 - DNA, 16 bp, H. sapiens
ttttccatgaacattt

SEQ ID NO: 176666 - DNA, 16 bp, H. sapiens
ttttccatggatggtg

SEQ ID NO: 176667 - DNA, 16 bp, H. sapiens
ttttccatggtttgga

SEQ ID NO: 176668 - DNA, 16 bp, H. sapiens
ttttccatgtagacaa

SEQ ID NO: 176669 - DNA, 16 bp, H. sapiens
ttttccatgtggatat

SEQ ID NO: 176670 - DNA, 16 bp, H. sapiens
ttttccattataaaaa

SEQ ID NO: 176671 - DNA, 16 bp, H. sapiens
ttttccattgtatgga

SEQ ID NO: 176672 - DNA, 16 bp, H. sapiens
ttttccatttatagag

SEQ ID NO: 176673 - DNA, 16 bp, H. sapiens
ttttccatttctagaa

SEQ ID NO: 176674 - DNA, 16 bp, H. sapiens
ttttccatttctgatt

SEQ ID NO: 176675 - DNA, 16 bp, H. sapiens
ttttccatttctgtga

SEQ ID NO: 176676 - DNA, 16 bp, H. sapiens
ttttccatttgacttt

SEQ ID NO: 176677 - DNA, 16 bp, H. sapiens
ttttccatttgatatt

SEQ ID NO: 176678 - DNA, 16 bp, H. sapiens
ttttccatttttaaag

SEQ ID NO: 176679 - DNA, 16 bp, H. sapiens
ttttcccaaaaagaaa

SEQ ID NO: 176680 - DNA, 16 bp, H. sapiens
ttttcccaaagaaaat

SEQ ID NO: 176681 - DNA, 16 bp, H. sapiens
ttttcccaaataaaaa

SEQ ID NO: 176682 - DNA, 16 bp, H. sapiens
ttttcccaacttttat

SEQ ID NO: 176683 - DNA, 16 bp, H. sapiens
ttttcccaagttcaca

SEQ ID NO: 176684 - DNA, 16 bp, H. sapiens
ttttcccaataatttt

SEQ ID NO: 176685 - DNA, 16 bp, H. sapiens
ttttcccacagttctg

SEQ ID NO: 176686 - DNA, 16 bp, H. sapiens
ttttcccaccagcctg

SEQ ID NO: 176687 - DNA, 16 bp, H. sapiens
ttttcccacctcagcc

SEQ ID NO: 176688 - DNA, 16 bp, H. sapiens
ttttcccacggtcttc

SEQ ID NO: 176689 - DNA, 16 bp, H. sapiens
ttttcccagatatttt

SEQ ID NO: 176690 - DNA, 16 bp, H. sapiens
ttttcccaggaatatg

SEQ ID NO: 176691 - DNA, 16 bp, H. sapiens
ttttcccattgtgtgt

SEQ ID NO: 176692 - DNA, 16 bp, H. sapiens
ttttcccatttaaaaa

SEQ ID NO: 176693 - DNA, 16 bp, H. sapiens
ttttcccatttctaaa

SEQ ID NO: 176694 - DNA, 16 bp, H. sapiens
ttttcccattttgcag

SEQ ID NO: 176695 - DNA, 16 bp, H. sapiens
ttttccccaaagtttt

SEQ ID NO: 176696 - DNA, 16 bp, H. sapiens
ttttccccaaggcagg

SEQ ID NO: 176697 - DNA, 16 bp, H. sapiens
ttttccccaccatcct

SEQ ID NO: 176698 - DNA, 16 bp, H. sapiens
ttttccccagtgtttt

SEQ ID NO: 176699 - DNA, 16 bp, H. sapiens
ttttccccatcttcat

SEQ ID NO: 176700 - DNA, 16 bp, H. sapiens
ttttccccattttaaa

SEQ ID NO: 176701 - DNA, 16 bp, H. sapiens
ttttcccccaaaatta

SEQ ID NO: 176702 - DNA, 16 bp, H. sapiens
ttttcccccaaataaa

SEQ ID NO: 176703 - DNA, 16 bp, H. sapiens
ttttcccccaaatttc

SEQ ID NO: 176704 - DNA, 16 bp, H. sapiens
ttttcccccagaaatt

SEQ ID NO: 176705 - DNA, 16 bp, H. sapiens
ttttcccccattctgt

SEQ ID NO: 176706 - DNA, 16 bp, H. sapiens
ttttcccccattttgt

SEQ ID NO: 176707 - DNA, 16 bp, H. sapiens
ttttccccccaaatat

SEQ ID NO: 176708 - DNA, 16 bp, H. sapiens
ttttcccctaatattt

SEQ ID NO: 176709 - DNA, 16 bp, H. sapiens
ttttccccttttaaaa

SEQ ID NO: 176710 - DNA, 16 bp, H. sapiens
ttttccctaataaaat

SEQ ID NO: 176711 - DNA, 16 bp, H. sapiens
ttttccctccagtttt

SEQ ID NO: 176712 - DNA, 16 bp, H. sapiens
ttttccctgtatcttt

SEQ ID NO: 176713 - DNA, 16 bp, H. sapiens
ttttcccttcagtttt

SEQ ID NO: 176714 - DNA, 16 bp, H. sapiens
ttttccctttaaatat

SEQ ID NO: 176715 - DNA, 16 bp, H. sapiens
ttttccctttgaataa

SEQ ID NO: 176716 - DNA, 16 bp, H. sapiens
ttttccgggaaagggg

SEQ ID NO: 176717 - DNA, 16 bp, H. sapiens
ttttcctaaaaatgaa

SEQ ID NO: 176718 - DNA, 16 bp, H. sapiens
ttttcctaaaatgaaa

SEQ ID NO: 176719 - DNA, 16 bp, H. sapiens
ttttcctaaatgtatt

SEQ ID NO: 176720 - DNA, 16 bp, H. sapiens
ttttcctaaggaaata

SEQ ID NO: 176721 - DNA, 16 bp, H. sapiens
ttttcctaataaaaaa

SEQ ID NO: 176722 - DNA, 16 bp, H. sapiens
ttttcctaatttgaaa

SEQ ID NO: 176723 - DNA, 16 bp, H. sapiens
ttttcctaggttttct

SEQ ID NO: 176724 - DNA, 16 bp, H. sapiens
ttttcctatggagttg

SEQ ID NO: 176725 - DNA, 16 bp, H. sapiens
ttttcctattaaaata

SEQ ID NO: 176726 - DNA, 16 bp, H. sapiens
ttttcctattctggac

SEQ ID NO: 176727 - DNA, 16 bp, H. sapiens
ttttcctattgaattt

SEQ ID NO: 176728 - DNA, 16 bp, H. sapiens
ttttcctattgatttg

SEQ ID NO: 176729 - DNA, 16 bp, H. sapiens
ttttcctcattctgtg

SEQ ID NO: 176730 - DNA, 16 bp, H. sapiens
ttttcctccctaaaag

SEQ ID NO: 176731 - DNA, 16 bp, H. sapiens
ttttcctccctcagcc

SEQ ID NO: 176732 - DNA, 16 bp, H. sapiens
ttttcctcctgatttt

SEQ ID NO: 176733 - DNA, 16 bp, H. sapiens
ttttcctctaaaaact

SEQ ID NO: 176734 - DNA, 16 bp, H. sapiens
ttttcctctaaatatt

SEQ ID NO: 176735 - DNA, 16 bp, H. sapiens
ttttcctctagaattt

SEQ ID NO: 176736 - DNA, 16 bp, H. sapiens
ttttcctctagtattt

SEQ ID NO: 176737 - DNA, 16 bp, H. sapiens
ttttcctctctgtaaa

SEQ ID NO: 176738 - DNA, 16 bp, H. sapiens
ttttcctctgtattct

SEQ ID NO: 176739 - DNA, 16 bp, H. sapiens
ttttcctctgtgtgtg

SEQ ID NO: 176740 - DNA, 16 bp, H. sapiens
ttttcctcttaaaaat

SEQ ID NO: 176741 - DNA, 16 bp, H. sapiens
ttttcctcttcaaaaa

SEQ ID NO: 176742 - DNA, 16 bp, H. sapiens
ttttcctctttgcatt

SEQ ID NO: 176743 - DNA, 16 bp, H. sapiens
ttttcctgaaagcaaa

SEQ ID NO: 176744 - DNA, 16 bp, H. sapiens
ttttcctgaaagcttt

SEQ ID NO: 176745 - DNA, 16 bp, H. sapiens
ttttcctgaaatattt

SEQ ID NO: 176746 - DNA, 16 bp, H. sapiens
ttttcctgacattttt

SEQ ID NO: 176747 - DNA, 16 bp, H. sapiens
ttttcctgatgagaaa

SEQ ID NO: 176748 - DNA, 16 bp, H. sapiens
ttttcctgatgttttc

SEQ ID NO: 176749 - DNA, 16 bp, H. sapiens
ttttcctgatttgaaa

SEQ ID NO: 176750 - DNA, 16 bp, H. sapiens
ttttcctgcaactgga

SEQ ID NO: 176751 - DNA, 16 bp, H. sapiens
ttttcctgcattttcc

SEQ ID NO: 176752 - DNA, 16 bp, H. sapiens
ttttcctgcttcttgg

SEQ ID NO: 176753 - DNA, 16 bp, H. sapiens
ttttcctggaatttct

SEQ ID NO: 176754 - DNA, 16 bp, H. sapiens
ttttcctggcttattt

SEQ ID NO: 176755 - DNA, 16 bp, H. sapiens
ttttcctggggaaaaa

SEQ ID NO: 176756 - DNA, 16 bp, H. sapiens
ttttcctgtaaaaata

SEQ ID NO: 176757 - DNA, 16 bp, H. sapiens
ttttcctgtatctatt

SEQ ID NO: 176758 - DNA, 16 bp, H. sapiens
ttttcctgtcttctga

SEQ ID NO: 176759 - DNA, 16 bp, H. sapiens
ttttcctgtgatttct

SEQ ID NO: 176760 - DNA, 16 bp, H. sapiens
ttttcctgtgtaattt

SEQ ID NO: 176761 - DNA, 16 bp, H. sapiens
ttttcctgttctagaa

SEQ ID NO: 176762 - DNA, 16 bp, H. sapiens
ttttcctgtttgaatg

SEQ ID NO: 176763 - DNA, 16 bp, H. sapiens
ttttcctgtttggatg

SEQ ID NO: 176764 - DNA, 16 bp, H. sapiens
ttttccttaagaaata

SEQ ID NO: 176765 - DNA, 16 bp, H. sapiens
ttttccttaatgattt

SEQ ID NO: 176766 - DNA, 16 bp, H. sapiens
ttttccttaatttgaa

SEQ ID NO: 176767 - DNA, 16 bp, H. sapiens
ttttccttagaaaata

SEQ ID NO: 176768 - DNA, 16 bp, H. sapiens
ttttccttagaaattt

SEQ ID NO: 176769 - DNA, 16 bp, H. sapiens
ttttccttatccaatc

SEQ ID NO: 176770 - DNA, 16 bp, H. sapiens
ttttccttcatctgaa

SEQ ID NO: 176771 - DNA, 16 bp, H. sapiens
ttttccttcattcctg

SEQ ID NO: 176772 - DNA, 16 bp, H. sapiens
ttttccttcattctgt

SEQ ID NO: 176773 - DNA, 16 bp, H. sapiens
ttttccttcttcaaag

SEQ ID NO: 176774 - DNA, 16 bp, H. sapiens
ttttccttgaaaaaaa

SEQ ID NO: 176775 - DNA, 16 bp, H. sapiens
ttttccttgtagaagt

SEQ ID NO: 176776 - DNA, 16 bp, H. sapiens
ttttccttgtctgtaa

SEQ ID NO: 176777 - DNA, 16 bp, H. sapiens
ttttccttgttaatct

SEQ ID NO: 176778 - DNA, 16 bp, H. sapiens
ttttcctttaaaaata

SEQ ID NO: 176779 - DNA, 16 bp, H. sapiens
ttttcctttaaataaa

SEQ ID NO: 176780 - DNA, 16 bp, H. sapiens
ttttcctttaataaaa

SEQ ID NO: 176781 - DNA, 16 bp, H. sapiens
ttttcctttagaattt

SEQ ID NO: 176782 - DNA, 16 bp, H. sapiens
ttttcctttaggaaaa

SEQ ID NO: 176783 - DNA, 16 bp, H. sapiens
ttttcctttaggtaga

SEQ ID NO: 176784 - DNA, 16 bp, H. sapiens
ttttcctttcacaaag

SEQ ID NO: 176785 - DNA, 16 bp, H. sapiens
ttttcctttcacagat

SEQ ID NO: 176786 - DNA, 16 bp, H. sapiens
ttttcctttcagattt

SEQ ID NO: 176787 - DNA, 16 bp, H. sapiens
ttttcctttccatgtt

SEQ ID NO: 176788 - DNA, 16 bp, H. sapiens
ttttcctttgcagaaa

SEQ ID NO: 176789 - DNA, 16 bp, H. sapiens
ttttcctttgcagttt

SEQ ID NO: 176790 - DNA, 16 bp, H. sapiens
ttttcctttgcattca

SEQ ID NO: 176791 - DNA, 16 bp, H. sapiens
ttttcctttggaaaaa

SEQ ID NO: 176792 - DNA, 16 bp, H. sapiens
ttttcctttggaattt

SEQ ID NO: 176793 - DNA, 16 bp, H. sapiens
ttttcctttgggaatt

SEQ ID NO: 176794 - DNA, 16 bp, H. sapiens
ttttccttttaaaaaa

SEQ ID NO: 176795 - DNA, 16 bp, H. sapiens
ttttccttttaaagaa

SEQ ID NO: 176796 - DNA, 16 bp, H. sapiens
ttttccttttaacagt

SEQ ID NO: 176797 - DNA, 16 bp, H. sapiens
ttttccttttagctta

SEQ ID NO: 176798 - DNA, 16 bp, H. sapiens
ttttccttttcttgaa

SEQ ID NO: 176799 - DNA, 16 bp, H. sapiens
ttttccttttgacatt

SEQ ID NO: 176800 - DNA, 16 bp, H. sapiens
ttttccttttgcttga

SEQ ID NO: 176801 - DNA, 16 bp, H. sapiens
ttttccttttgttgca

SEQ ID NO: 176802 - DNA, 16 bp, H. sapiens
ttttcctttttaaaga

SEQ ID NO: 176803 - DNA, 20 bp, H. sapiens
ttttcggactcagcctgcct

SEQ ID NO: 176804 - DNA, 16 bp, H. sapiens
ttttcgtagagatggg

SEQ ID NO: 176805 - DNA, 16 bp, H. sapiens
ttttctaaaaacataa

SEQ ID NO: 176806 - DNA, 16 bp, H. sapiens
ttttctaaaaagaaaa

SEQ ID NO: 176807 - DNA, 16 bp, H. sapiens
ttttctaaaacacttt

SEQ ID NO: 176808 - DNA, 16 bp, H. sapiens
ttttctaaaagtattt

SEQ ID NO: 176809 - DNA, 16 bp, H. sapiens
ttttctaaaatcaaaa

SEQ ID NO: 176810 - DNA, 16 bp, H. sapiens
ttttctaaaatgtcat

SEQ ID NO: 176811 - DNA, 16 bp, H. sapiens
ttttctaaaattctgt

SEQ ID NO: 176812 - DNA, 16 bp, H. sapiens
ttttctaaaattgctt

SEQ ID NO: 176813 - DNA, 16 bp, H. sapiens
ttttctaaacataaaa

SEQ ID NO: 176814 - DNA, 16 bp, H. sapiens
ttttctaaacatatat

SEQ ID NO: 176815 - DNA, 16 bp, H. sapiens
ttttctaaacatgttt

SEQ ID NO: 176816 - DNA, 16 bp, H. sapiens
ttttctaaagaagaaa

SEQ ID NO: 176817 - DNA, 16 bp, H. sapiens
ttttctaaagaagaat

SEQ ID NO: 176818 - DNA, 16 bp, H. sapiens
ttttctaaaggaaaat

SEQ ID NO: 176819 - DNA, 16 bp, H. sapiens
ttttctaaagttaaat

SEQ ID NO: 176820 - DNA, 16 bp, H. sapiens
ttttctaaatatccaa

SEQ ID NO: 176821 - DNA, 16 bp, H. sapiens
ttttctaaatattcaa

SEQ ID NO: 176822 - DNA, 16 bp, H. sapiens
ttttctaaatgaagaa

SEQ ID NO: 176823 - DNA, 16 bp, H. sapiens
ttttctaaatgctttt

SEQ ID NO: 176824 - DNA, 16 bp, H. sapiens
ttttctaaatggaaaa

SEQ ID NO: 176825 - DNA, 16 bp, H. sapiens
ttttctaaatgtacaa

SEQ ID NO: 176826 - DNA, 16 bp, H. sapiens
ttttctaaatgttatt

SEQ ID NO: 176827 - DNA, 16 bp, H. sapiens
ttttctaaatttgaat

SEQ ID NO: 176828 - DNA, 16 bp, H. sapiens
ttttctaaattttatg

SEQ ID NO: 176829 - DNA, 16 bp, H. sapiens
ttttctaaattttgaa

SEQ ID NO: 176830 - DNA, 16 bp, H. sapiens
ttttctaacaaaaagc

SEQ ID NO: 176831 - DNA, 16 bp, H. sapiens
ttttctaaccttgttt

SEQ ID NO: 176832 - DNA, 16 bp, H. sapiens
ttttctaactctgctt

SEQ ID NO: 176833 - DNA, 16 bp, H. sapiens
ttttctaacttaaaat

SEQ ID NO: 176834 - DNA, 16 bp, H. sapiens
ttttctaagaaagaaa

SEQ ID NO: 176835 - DNA, 16 bp, H. sapiens
ttttctaagaataatg

SEQ ID NO: 176836 - DNA, 16 bp, H. sapiens
ttttctaatgaaaaaa

SEQ ID NO: 176837 - DNA, 16 bp, H. sapiens
ttttctaatgaaaata

SEQ ID NO: 176838 - DNA, 16 bp, H. sapiens
ttttctaatgttttaa

SEQ ID NO: 176839 - DNA, 16 bp, H. sapiens
ttttctaattacaaat

SEQ ID NO: 176840 - DNA, 16 bp, H. sapiens
ttttctaattatgtga

SEQ ID NO: 176841 - DNA, 16 bp, H. sapiens
ttttctaattggattt

SEQ ID NO: 176842 - DNA, 16 bp, H. sapiens
ttttctaatttcagtt

SEQ ID NO: 176843 - DNA, 16 bp, H. sapiens
ttttctaatttgcaca

SEQ ID NO: 176844 - DNA, 16 bp, H. sapiens
ttttctacatacaaaa

SEQ ID NO: 176845 - DNA, 16 bp, H. sapiens
ttttctaccttgtttc

SEQ ID NO: 176846 - DNA, 16 bp, H. sapiens
ttttctaccttttaaa

SEQ ID NO: 176847 - DNA, 16 bp, H. sapiens
ttttctacttagaaaa

SEQ ID NO: 176848 - DNA, 16 bp, H. sapiens
ttttctacttggaaaa

SEQ ID NO: 176849 - DNA, 16 bp, H. sapiens
ttttctagaaatgttt

SEQ ID NO: 176850 - DNA, 16 bp, H. sapiens
ttttctagaacatttt

SEQ ID NO: 176851 - DNA, 16 bp, H. sapiens
ttttctagaattttat

SEQ ID NO: 176852 - DNA, 16 bp, H. sapiens
ttttctagaattttta

SEQ ID NO: 176853 - DNA, 16 bp, H. sapiens
ttttctagatacacag

SEQ ID NO: 176854 - DNA, 16 bp, H. sapiens
ttttctagatgtaaga

SEQ ID NO: 176855 - DNA, 16 bp, H. sapiens
ttttctagattttcta

SEQ ID NO: 176856 - DNA, 16 bp, H. sapiens
ttttctagctattttg

SEQ ID NO: 176857 - DNA, 16 bp, H. sapiens
ttttctagcttgtgtg

SEQ ID NO: 176858 - DNA, 16 bp, H. sapiens
ttttctaggttaaaaa

SEQ ID NO: 176859 - DNA, 16 bp, H. sapiens
ttttctagttaatttg

SEQ ID NO: 176860 - DNA, 17 bp, H. sapiens
ttttctagttctgtgaa

SEQ ID NO: 176861 - DNA, 16 bp, H. sapiens
ttttctagtttcttga

SEQ ID NO: 176862 - DNA, 16 bp, H. sapiens
ttttctagttttctaa

SEQ ID NO: 176863 - DNA, 16 bp, H. sapiens
ttttctagttttgtga

SEQ ID NO: 176864 - DNA, 16 bp, H. sapiens
ttttctataaaatggg

SEQ ID NO: 176865 - DNA, 16 bp, H. sapiens
ttttctataagaatgt

SEQ ID NO: 176866 - DNA, 16 bp, H. sapiens
ttttctataataaatg

SEQ ID NO: 176867 - DNA, 16 bp, H. sapiens
ttttctatgaaataat

SEQ ID NO: 176868 - DNA, 16 bp, H. sapiens
ttttctatgtttagat

SEQ ID NO: 176869 - DNA, 16 bp, H. sapiens
ttttctattatgaaat

SEQ ID NO: 176870 - DNA, 16 bp, H. sapiens
ttttctattattagta

SEQ ID NO: 176871 - DNA, 16 bp, H. sapiens
ttttctattgattggg

SEQ ID NO: 176872 - DNA, 16 bp, H. sapiens
ttttctatttctggga

SEQ ID NO: 176873 - DNA, 16 bp, H. sapiens
ttttctatttgacaaa

SEQ ID NO: 176874 - DNA, 16 bp, H. sapiens
ttttctattttgtaaa

SEQ ID NO: 176875 - DNA, 16 bp, H. sapiens
ttttctatttttgcca

SEQ ID NO: 176876 - DNA, 16 bp, H. sapiens
ttttctcaaaaaatat

SEQ ID NO: 176877 - DNA, 16 bp, H. sapiens
ttttctcaaataatat

SEQ ID NO: 176878 - DNA, 16 bp, H. sapiens
ttttctcaactgtaaa

SEQ ID NO: 176879 - DNA, 16 bp, H. sapiens
ttttctcaagaagaaa

SEQ ID NO: 176880 - DNA, 16 bp, H. sapiens
ttttctcaatgatttt

SEQ ID NO: 176881 - DNA, 16 bp, H. sapiens
ttttctcaattgtaaa

SEQ ID NO: 176882 - DNA, 16 bp, H. sapiens
ttttctcacactctgt

SEQ ID NO: 176883 - DNA, 16 bp, H. sapiens
ttttctcacaggtctg

SEQ ID NO: 176884 - DNA, 16 bp, H. sapiens
ttttctcacctaaaaa

SEQ ID NO: 176885 - DNA, 16 bp, H. sapiens
ttttctcacctgtaaa

SEQ ID NO: 176886 - DNA, 16 bp, H. sapiens
ttttctcactgttctt

SEQ ID NO: 176887 - DNA, 16 bp, H. sapiens
ttttctcacttatttg

SEQ ID NO: 176888 - DNA, 16 bp, H. sapiens
ttttctcactttgtct

SEQ ID NO: 176889 - DNA, 16 bp, H. sapiens
ttttctcagatattta

SEQ ID NO: 176890 - DNA, 16 bp, H. sapiens
ttttctcagatatttt

SEQ ID NO: 176891 - DNA, 16 bp, H. sapiens
ttttctcagattttct

SEQ ID NO: 176892 - DNA, 16 bp, H. sapiens
ttttctcagcatcatt

SEQ ID NO: 176893 - DNA, 16 bp, H. sapiens
ttttctcagcatcttt

SEQ ID NO: 176894 - DNA, 16 bp, H. sapiens
ttttctcagctgtgaa

SEQ ID NO: 176895 - DNA, 16 bp, H. sapiens
ttttctcagtcacttt

SEQ ID NO: 176896 - DNA, 16 bp, H. sapiens
ttttctcagtcatttt

SEQ ID NO: 176897 - DNA, 16 bp, H. sapiens
ttttctcagtttttaa

SEQ ID NO: 176898 - DNA, 16 bp, H. sapiens
ttttctcataataaaa

SEQ ID NO: 176899 - DNA, 16 bp, H. sapiens
ttttctcatcagtaaa

SEQ ID NO: 176900 - DNA, 16 bp, H. sapiens
ttttctcatctgcaaa

SEQ ID NO: 176901 - DNA, 16 bp, H. sapiens
ttttctcatctggaaa

SEQ ID NO: 176902 - DNA, 16 bp, H. sapiens
ttttctcatctgtaaa

SEQ ID NO: 176903 - DNA, 16 bp, H. sapiens
ttttctcatctgtaat

SEQ ID NO: 176904 - DNA, 16 bp, H. sapiens
ttttctcatctgtgca

SEQ ID NO: 176905 - DNA, 16 bp, H. sapiens
ttttctcatctttaaa

SEQ ID NO: 176906 - DNA, 16 bp, H. sapiens
ttttctcatgtataaa

SEQ ID NO: 176907 - DNA, 16 bp, H. sapiens
ttttctcattctgtgg

SEQ ID NO: 176908 - DNA, 16 bp, H. sapiens
ttttctcattgtcttg

SEQ ID NO: 176909 - DNA, 16 bp, H. sapiens
ttttctcatttcaaag

SEQ ID NO: 176910 - DNA, 16 bp, H. sapiens
ttttctcatttccaaa

SEQ ID NO: 176911 - DNA, 16 bp, H. sapiens
ttttctcatttgtaaa

SEQ ID NO: 176912 - DNA, 16 bp, H. sapiens
ttttctcattttgaaa

SEQ ID NO: 176913 - DNA, 16 bp, H. sapiens
ttttctccaaaacaaa

SEQ ID NO: 176914 - DNA, 16 bp, H. sapiens
ttttctccaaatataa

SEQ ID NO: 176915 - DNA, 16 bp, H. sapiens
ttttctccaaatttta

SEQ ID NO: 176916 - DNA, 16 bp, H. sapiens
ttttctccacaacctc

SEQ ID NO: 176917 - DNA, 16 bp, H. sapiens
ttttctccactgattt

SEQ ID NO: 176918 - DNA, 16 bp, H. sapiens
ttttctccagcaggaa

SEQ ID NO: 176919 - DNA, 16 bp, H. sapiens
ttttctccagtgtttt

SEQ ID NO: 176920 - DNA, 16 bp, H. sapiens
ttttctccagttctgt

SEQ ID NO: 176921 - DNA, 16 bp, H. sapiens
ttttctccataggcct

SEQ ID NO: 176922 - DNA, 16 bp, H. sapiens
ttttctccatccctgt

SEQ ID NO: 176923 - DNA, 16 bp, H. sapiens
ttttctccatgtcctt

SEQ ID NO: 176924 - DNA, 16 bp, H. sapiens
ttttctccattcctgt

SEQ ID NO: 176925 - DNA, 16 bp, H. sapiens
ttttctccctgagttt

SEQ ID NO: 176926 - DNA, 16 bp, H. sapiens
ttttctccctttatgt

SEQ ID NO: 176927 - DNA, 16 bp, H. sapiens
ttttctcccttttaaa

SEQ ID NO: 176928 - DNA, 16 bp, H. sapiens
ttttctcctaaaataa

SEQ ID NO: 176929 - DNA, 16 bp, H. sapiens
ttttctcctaaaatca

SEQ ID NO: 176930 - DNA, 16 bp, H. sapiens
ttttctcctagtagtt

SEQ ID NO: 176931 - DNA, 16 bp, H. sapiens
ttttctcctagtttct

SEQ ID NO: 176932 - DNA, 16 bp, H. sapiens
ttttctcctatctcag

SEQ ID NO: 176933 - DNA, 16 bp, H. sapiens
ttttctcctgcccttg

SEQ ID NO: 176934 - DNA, 16 bp, H. sapiens
ttttctcctgtgttat

SEQ ID NO: 176935 - DNA, 16 bp, H. sapiens
ttttctcctgttaatc

SEQ ID NO: 176936 - DNA, 16 bp, H. sapiens
ttttctcctgttaatt

SEQ ID NO: 176937 - DNA, 16 bp, H. sapiens
ttttctccttattatg

SEQ ID NO: 176938 - DNA, 16 bp, H. sapiens
ttttctccttcctggg

SEQ ID NO: 176939 - DNA, 16 bp, H. sapiens
ttttctccttctgtga

SEQ ID NO: 176940 - DNA, 16 bp, H. sapiens
ttttctccttgaagaa

SEQ ID NO: 176941 - DNA, 16 bp, H. sapiens
ttttctctaaataaaa

SEQ ID NO: 176942 - DNA, 16 bp, H. sapiens
ttttctctactgattt

SEQ ID NO: 176943 - DNA, 16 bp, H. sapiens
ttttctctagctgcct

SEQ ID NO: 176944 - DNA, 16 bp, H. sapiens
ttttctctctcacaca

SEQ ID NO: 176945 - DNA, 16 bp, H. sapiens
ttttctctctgaatct

SEQ ID NO: 176946 - DNA, 16 bp, H. sapiens
ttttctctctgattct

SEQ ID NO: 176947 - DNA, 16 bp, H. sapiens
ttttctctctggaaat

SEQ ID NO: 176948 - DNA, 16 bp, H. sapiens
ttttctctcttaaaat

SEQ ID NO: 176949 - DNA, 16 bp, H. sapiens
ttttctctgaagttat

SEQ ID NO: 176950 - DNA, 16 bp, H. sapiens
ttttctctgacctttt

SEQ ID NO: 176951 - DNA, 16 bp, H. sapiens
ttttctctgatattta

SEQ ID NO: 176952 - DNA, 16 bp, H. sapiens
ttttctctgcatttct

SEQ ID NO: 176953 - DNA, 16 bp, H. sapiens
ttttctctggagaaat

SEQ ID NO: 176954 - DNA, 16 bp, H. sapiens
ttttctctgtaaaaat

SEQ ID NO: 176955 - DNA, 16 bp, H. sapiens
ttttctctgtaaaata

SEQ ID NO: 176956 - DNA, 16 bp, H. sapiens
ttttctctgtcttcac

SEQ ID NO: 176957 - DNA, 16 bp, H. sapiens
ttttctctgtgaaaga

SEQ ID NO: 176958 - DNA, 16 bp, H. sapiens
ttttctctgtgggaag

SEQ ID NO: 176959 - DNA, 16 bp, H. sapiens
ttttctcttaaaataa

SEQ ID NO: 176960 - DNA, 16 bp, H. sapiens
ttttctcttaggaaaa

SEQ ID NO: 176961 - DNA, 16 bp, H. sapiens
ttttctcttcagaaaa

SEQ ID NO: 176962 - DNA, 16 bp, H. sapiens
ttttctcttccccaaa

SEQ ID NO: 176963 - DNA, 16 bp, H. sapiens
ttttctcttctgcaaa

SEQ ID NO: 176964 - DNA, 16 bp, H. sapiens
ttttctcttctgtcaa

SEQ ID NO: 176965 - DNA, 16 bp, H. sapiens
ttttctcttgtaaagt

SEQ ID NO: 176966 - DNA, 16 bp, H. sapiens
ttttctctttagctta

SEQ ID NO: 176967 - DNA, 16 bp, H. sapiens
ttttctctttcagctt

SEQ ID NO: 176968 - DNA, 16 bp, H. sapiens
ttttctctttcttgca

SEQ ID NO: 176969 - DNA, 16 bp, H. sapiens
ttttctctttgaaaat

SEQ ID NO: 176970 - DNA, 16 bp, H. sapiens
ttttctctttgaaatg

SEQ ID NO: 176971 - DNA, 16 bp, H. sapiens
ttttctctttgccatt

SEQ ID NO: 176972 - DNA, 16 bp, H. sapiens
ttttctcttttgcaaa

SEQ ID NO: 176973 - DNA, 16 bp, H. sapiens
ttttctctttttgaga

SEQ ID NO: 176974 - DNA, 16 bp, H. sapiens
ttttctgaaaaatttt

SEQ ID NO: 176975 - DNA, 16 bp, H. sapiens
ttttctgaaaacaaaa

SEQ ID NO: 176976 - DNA, 16 bp, H. sapiens
ttttctgaaaactttt

SEQ ID NO: 176977 - DNA, 16 bp, H. sapiens
ttttctgaaaagtgaa

SEQ ID NO: 176978 - DNA, 16 bp, H. sapiens
ttttctgaaaatataa

SEQ ID NO: 176979 - DNA, 16 bp, H. sapiens
ttttctgaaacaaaat

SEQ ID NO: 176980 - DNA, 16 bp, H. sapiens
ttttctgaaacttttt

SEQ ID NO: 176981 - DNA, 16 bp, H. sapiens
ttttctgaaagagaaa

SEQ ID NO: 176982 - DNA, 16 bp, H. sapiens
ttttctgaaagcattt

SEQ ID NO: 176983 - DNA, 16 bp, H. sapiens
ttttctgaaatatatt

SEQ ID NO: 176984 - DNA, 16 bp, H. sapiens
ttttctgaaatatttt

SEQ ID NO: 176985 - DNA, 16 bp, H. sapiens
ttttctgaaatctttt

SEQ ID NO: 176986 - DNA, 16 bp, H. sapiens
ttttctgaaatgttat

SEQ ID NO: 176987 - DNA, 16 bp, H. sapiens
ttttctgaaatttaaa

SEQ ID NO: 176988 - DNA, 16 bp, H. sapiens
ttttctgaaatttcat

SEQ ID NO: 176989 - DNA, 16 bp, H. sapiens
ttttctgaactgtttt

SEQ ID NO: 176990 - DNA, 16 bp, H. sapiens
ttttctgaacttcagt

SEQ ID NO: 176991 - DNA, 16 bp, H. sapiens
ttttctgaacttttat

SEQ ID NO: 176992 - DNA, 16 bp, H. sapiens
ttttctgaagtagaga

SEQ ID NO: 176993 - DNA, 16 bp, H. sapiens
ttttctgaagtgtttt

SEQ ID NO: 176994 - DNA, 16 bp, H. sapiens
ttttctgaatcatttg

SEQ ID NO: 176995 - DNA, 16 bp, H. sapiens
ttttctgaatctattg

SEQ ID NO: 176996 - DNA, 16 bp, H. sapiens
ttttctgaatgatttt

SEQ ID NO: 176997 - DNA, 16 bp, H. sapiens
ttttctgaatttctga

SEQ ID NO: 176998 - DNA, 16 bp, H. sapiens
ttttctgactaaaata

SEQ ID NO: 176999 - DNA, 16 bp, H. sapiens
ttttctgactttgaaa

SEQ ID NO: 177000 - DNA, 16 bp, H. sapiens
ttttctgactttttaa

SEQ ID NO: 177001 - DNA, 16 bp, H. sapiens
ttttctgagatgaagt

SEQ ID NO: 177002 - DNA, 16 bp, H. sapiens
ttttctgagcatattt

SEQ ID NO: 177003 - DNA, 16 bp, H. sapiens
ttttctgaggaaactc

SEQ ID NO: 177004 - DNA, 16 bp, H. sapiens
ttttctgaggagaaat

SEQ ID NO: 177005 - DNA, 16 bp, H. sapiens
ttttctgaggatgatg

SEQ ID NO: 177006 - DNA, 16 bp, H. sapiens
ttttctgaggccttcc

SEQ ID NO: 177007 - DNA, 16 bp, H. sapiens
ttttctgagttcttta

SEQ ID NO: 177008 - DNA, 16 bp, H. sapiens
ttttctgataaaatat

SEQ ID NO: 177009 - DNA, 16 bp, H. sapiens
ttttctgatataaata

SEQ ID NO: 177010 - DNA, 16 bp, H. sapiens
ttttctgatcattttc

SEQ ID NO: 177011 - DNA, 16 bp, H. sapiens
ttttctgatcctgcat

SEQ ID NO: 177012 - DNA, 16 bp, H. sapiens
ttttctgatcctttcc

SEQ ID NO: 177013 - DNA, 16 bp, H. sapiens
ttttctgatgaagaaa

SEQ ID NO: 177014 - DNA, 16 bp, H. sapiens
ttttctgattccaaaa

SEQ ID NO: 177015 - DNA, 16 bp, H. sapiens
ttttctgatttttaaa

SEQ ID NO: 177016 - DNA, 16 bp, H. sapiens
ttttctgcatataaaa

SEQ ID NO: 177017 - DNA, 16 bp, H. sapiens
ttttctgcatctactg

SEQ ID NO: 177018 - DNA, 17 bp, H. sapiens
ttttctgcatctattga

SEQ ID NO: 177019 - DNA, 16 bp, H. sapiens
ttttctgcattatttg

SEQ ID NO: 177020 - DNA, 16 bp, H. sapiens
ttttctgcattttaaa

SEQ ID NO: 177021 - DNA, 16 bp, H. sapiens
ttttctgcctctgcct

SEQ ID NO: 177022 - DNA, 16 bp, H. sapiens
ttttctgccttgatga

SEQ ID NO: 177023 - DNA, 16 bp, H. sapiens
ttttctgcctttaaaa

SEQ ID NO: 177024 - DNA, 16 bp, H. sapiens
ttttctgctagctttg

SEQ ID NO: 177025 - DNA, 16 bp, H. sapiens
ttttctgcttaaaaaa

SEQ ID NO: 177026 - DNA, 16 bp, H. sapiens
ttttctgcttataaat

SEQ ID NO: 177027 - DNA, 16 bp, H. sapiens
ttttctgctttaaaaa

SEQ ID NO: 177028 - DNA, 16 bp, H. sapiens
ttttctgctttttaaa

SEQ ID NO: 177029 - DNA, 16 bp, H. sapiens
ttttctggaaaaagaa

SEQ ID NO: 177030 - DNA, 16 bp, H. sapiens
ttttctggaaaaatat

SEQ ID NO: 177031 - DNA, 16 bp, H. sapiens
ttttctggaaaacaaa

SEQ ID NO: 177032 - DNA, 16 bp, H. sapiens
ttttctggaaaagact

SEQ ID NO: 177033 - DNA, 16 bp, H. sapiens
ttttctggaaaataat

SEQ ID NO: 177034 - DNA, 16 bp, H. sapiens
ttttctggaaagaaaa

SEQ ID NO: 177035 - DNA, 16 bp, H. sapiens
ttttctggaaatgttt

SEQ ID NO: 177036 - DNA, 16 bp, H. sapiens
ttttctggaagaattt

SEQ ID NO: 177037 - DNA, 16 bp, H. sapiens
ttttctggaatcctat

SEQ ID NO: 177038 - DNA, 16 bp, H. sapiens
ttttctggaatgttct

SEQ ID NO: 177039 - DNA, 16 bp, H. sapiens
ttttctggagagacag

SEQ ID NO: 177040 - DNA, 16 bp, H. sapiens
ttttctggattttgtg

SEQ ID NO: 177041 - DNA, 16 bp, H. sapiens
ttttctggcattttct

SEQ ID NO: 177042 - DNA, 16 bp, H. sapiens
ttttctggctgaataa

SEQ ID NO: 177043 - DNA, 16 bp, H. sapiens
ttttctgggaaaataa

SEQ ID NO: 177044 - DNA, 16 bp, H. sapiens
ttttctgggagaaatt

SEQ ID NO: 177045 - DNA, 16 bp, H. sapiens
ttttctgggagagggg

SEQ ID NO: 177046 - DNA, 16 bp, H. sapiens
ttttctgggataaatg

SEQ ID NO: 177047 - DNA, 16 bp, H. sapiens
ttttctgggctggcca

SEQ ID NO: 177048 - DNA, 16 bp, H. sapiens
ttttctggggaaaaat

SEQ ID NO: 177049 - DNA, 17 bp, H. sapiens
ttttctggggagaaatt

SEQ ID NO: 177050 - DNA, 16 bp, H. sapiens
ttttctgggggagaaa

SEQ ID NO: 177051 - DNA, 17 bp, H. sapiens
ttttctggttgacaatt

SEQ ID NO: 177052 - DNA, 16 bp, H. sapiens
ttttctggttgacagt

SEQ ID NO: 177053 - DNA, 16 bp, H. sapiens
ttttctgtaaaaatat

SEQ ID NO: 177054 - DNA, 16 bp, H. sapiens
ttttctgtaaaatggg

SEQ ID NO: 177055 - DNA, 16 bp, H. sapiens
ttttctgtaaactgaa

SEQ ID NO: 177056 - DNA, 16 bp, H. sapiens
ttttctgtaaacttct

SEQ ID NO: 177057 - DNA, 16 bp, H. sapiens
ttttctgtaaagtttt

SEQ ID NO: 177058 - DNA, 16 bp, H. sapiens
ttttctgtaaatattt

SEQ ID NO: 177059 - DNA, 16 bp, H. sapiens
ttttctgtaaattatt

SEQ ID NO: 177060 - DNA, 17 bp, H. sapiens
ttttctgtaagagggaa

SEQ ID NO: 177061 - DNA, 16 bp, H. sapiens
ttttctgtaatattta

SEQ ID NO: 177062 - DNA, 16 bp, H. sapiens
ttttctgtaatgtctt

SEQ ID NO: 177063 - DNA, 16 bp, H. sapiens
ttttctgtacatattt

SEQ ID NO: 177064 - DNA, 16 bp, H. sapiens
ttttctgtacattgtg

SEQ ID NO: 177065 - DNA, 16 bp, H. sapiens
ttttctgtagagacag

SEQ ID NO: 177066 - DNA, 16 bp, H. sapiens
ttttctgtagagatgg

SEQ ID NO: 177067 - DNA, 16 bp, H. sapiens
ttttctgtagctattg

SEQ ID NO: 177068 - DNA, 16 bp, H. sapiens
ttttctgtagtttgaa

SEQ ID NO: 177069 - DNA, 16 bp, H. sapiens
ttttctgtatataaaa

SEQ ID NO: 177070 - DNA, 16 bp, H. sapiens
ttttctgtatatgtat

SEQ ID NO: 177071 - DNA, 16 bp, H. sapiens
ttttctgtatgtataa

SEQ ID NO: 177072 - DNA, 16 bp, H. sapiens
ttttctgtatgttata

SEQ ID NO: 177073 - DNA, 16 bp, H. sapiens
ttttctgtatgtttga

SEQ ID NO: 177074 - DNA, 16 bp, H. sapiens
ttttctgtatttccaa

SEQ ID NO: 177075 - DNA, 16 bp, H. sapiens
ttttctgtattttaaa

SEQ ID NO: 177076 - DNA, 16 bp, H. sapiens
ttttctgtcactgtag

SEQ ID NO: 177077 - DNA, 16 bp, H. sapiens
ttttctgtcattctgt

SEQ ID NO: 177078 - DNA, 16 bp, H. sapiens
ttttctgtctcagcct

SEQ ID NO: 177079 - DNA, 16 bp, H. sapiens
ttttctgtcttcttca

SEQ ID NO: 177080 - DNA, 16 bp, H. sapiens
ttttctgtcttgttaa

SEQ ID NO: 177081 - DNA, 16 bp, H. sapiens
ttttctgtcttgttca

SEQ ID NO: 177082 - DNA, 16 bp, H. sapiens
ttttctgtctttatga

SEQ ID NO: 177083 - DNA, 16 bp, H. sapiens
ttttctgtgaagtttt

SEQ ID NO: 177084 - DNA, 16 bp, H. sapiens
ttttctgtgaccagca

SEQ ID NO: 177085 - DNA, 16 bp, H. sapiens
ttttctgtggctgctt

SEQ ID NO: 177086 - DNA, 16 bp, H. sapiens
ttttctgtgtctggct

SEQ ID NO: 177087 - DNA, 16 bp, H. sapiens
ttttctgtgtttagat

SEQ ID NO: 177088 - DNA, 16 bp, H. sapiens
ttttctgttaaaaact

SEQ ID NO: 177089 - DNA, 16 bp, H. sapiens
ttttctgttaaaattt

SEQ ID NO: 177090 - DNA, 16 bp, H. sapiens
ttttctgttactataa

SEQ ID NO: 177091 - DNA, 16 bp, H. sapiens
ttttctgttatgaaaa

SEQ ID NO: 177092 - DNA, 16 bp, H. sapiens
ttttctgttcacattt

SEQ ID NO: 177093 - DNA, 16 bp, H. sapiens
ttttctgttctccatt

SEQ ID NO: 177094 - DNA, 16 bp, H. sapiens
ttttctgttgcattgt

SEQ ID NO: 177095 - DNA, 16 bp, H. sapiens
ttttctgttgctataa

SEQ ID NO: 177096 - DNA, 16 bp, H. sapiens
ttttctgttgctgctg

SEQ ID NO: 177097 - DNA, 16 bp, H. sapiens
ttttctgtttcagtgt

SEQ ID NO: 177098 - DNA, 16 bp, H. sapiens
ttttctgtttcctgta

SEQ ID NO: 177099 - DNA, 16 bp, H. sapiens
ttttctgtttctgagt

SEQ ID NO: 177100 - DNA, 16 bp, H. sapiens
ttttctgtttgaaaaa

SEQ ID NO: 177101 - DNA, 16 bp, H. sapiens
ttttctgttttaaaaa

SEQ ID NO: 177102 - DNA, 16 bp, H. sapiens
ttttctgttttggaaa

SEQ ID NO: 177103 - DNA, 16 bp, H. sapiens
ttttctgttttgtgaa

SEQ ID NO: 177104 - DNA, 16 bp, H. sapiens
ttttcttaaaaaaaag

SEQ ID NO: 177105 - DNA, 16 bp, H. sapiens
ttttcttaaaaaacaa

SEQ ID NO: 177106 - DNA, 16 bp, H. sapiens
ttttcttaaaaacaaa

SEQ ID NO: 177107 - DNA, 16 bp, H. sapiens
ttttcttaaaaatact

SEQ ID NO: 177108 - DNA, 16 bp, H. sapiens
ttttcttaaaacttaa

SEQ ID NO: 177109 - DNA, 16 bp, H. sapiens
ttttcttaaaagataa

SEQ ID NO: 177110 - DNA, 16 bp, H. sapiens
ttttcttaaaaggaaa

SEQ ID NO: 177111 - DNA, 16 bp, H. sapiens
ttttcttaaaatgcaa

SEQ ID NO: 177112 - DNA, 16 bp, H. sapiens
ttttcttaaagaaatg

SEQ ID NO: 177113 - DNA, 16 bp, H. sapiens
ttttcttaaagggcca

SEQ ID NO: 177114 - DNA, 16 bp, H. sapiens
ttttcttaaataagaa

SEQ ID NO: 177115 - DNA, 16 bp, H. sapiens
ttttcttaaatgaaaa

SEQ ID NO: 177116 - DNA, 16 bp, H. sapiens
ttttcttaaatgcttt

SEQ ID NO: 177117 - DNA, 16 bp, H. sapiens
ttttcttaaattatgt

SEQ ID NO: 177118 - DNA, 16 bp, H. sapiens
ttttcttaaccttgtt

SEQ ID NO: 177119 - DNA, 16 bp, H. sapiens
ttttcttaactgtaaa

SEQ ID NO: 177120 - DNA, 16 bp, H. sapiens
ttttcttaaggcctct

SEQ ID NO: 177121 - DNA, 16 bp, H. sapiens
ttttcttaataacaaa

SEQ ID NO: 177122 - DNA, 16 bp, H. sapiens
ttttcttaatatacaa

SEQ ID NO: 177123 - DNA, 16 bp, H. sapiens
ttttcttaattacaaa

SEQ ID NO: 177124 - DNA, 16 bp, H. sapiens
ttttcttaattgaaaa

SEQ ID NO: 177125 - DNA, 16 bp, H. sapiens
ttttcttaatttccaa

SEQ ID NO: 177126 - DNA, 16 bp, H. sapiens
ttttcttacaaataaa

SEQ ID NO: 177127 - DNA, 16 bp, H. sapiens
ttttcttacaaatata

SEQ ID NO: 177128 - DNA, 16 bp, H. sapiens
ttttcttagaatattt

SEQ ID NO: 177129 - DNA, 16 bp, H. sapiens
ttttcttagaatctgt

SEQ ID NO: 177130 - DNA, 16 bp, H. sapiens
ttttcttatatagggg

SEQ ID NO: 177131 - DNA, 16 bp, H. sapiens
ttttcttatcaatttg

SEQ ID NO: 177132 - DNA, 16 bp, H. sapiens
ttttcttatctgtaaa

SEQ ID NO: 177133 - DNA, 16 bp, H. sapiens
ttttcttatgaaaaat

SEQ ID NO: 177134 - DNA, 16 bp, H. sapiens
ttttcttatgaaaata

SEQ ID NO: 177135 - DNA, 16 bp, H. sapiens
ttttcttatgagaaaa

SEQ ID NO: 177136 - DNA, 16 bp, H. sapiens
ttttcttattctgtaa

SEQ ID NO: 177137 - DNA, 16 bp, H. sapiens
ttttcttattgactta

SEQ ID NO: 177138 - DNA, 16 bp, H. sapiens
ttttcttatttaaatg

SEQ ID NO: 177139 - DNA, 16 bp, H. sapiens
ttttcttatttccaaa

SEQ ID NO: 177140 - DNA, 16 bp, H. sapiens
ttttcttcaaaaacat

SEQ ID NO: 177141 - DNA, 16 bp, H. sapiens
ttttcttcaaaagaaa

SEQ ID NO: 177142 - DNA, 16 bp, H. sapiens
ttttcttcaaatattc

SEQ ID NO: 177143 - DNA, 16 bp, H. sapiens
ttttcttcaagaactt

SEQ ID NO: 177144 - DNA, 16 bp, H. sapiens
ttttcttcacagcact

SEQ ID NO: 177145 - DNA, 16 bp, H. sapiens
ttttcttcacatttca

SEQ ID NO: 177146 - DNA, 16 bp, H. sapiens
ttttcttcagaaaatt

SEQ ID NO: 177147 - DNA, 16 bp, H. sapiens
ttttcttcagaagaaa

SEQ ID NO: 177148 - DNA, 16 bp, H. sapiens
ttttcttcaggaattt

SEQ ID NO: 177149 - DNA, 16 bp, H. sapiens
ttttcttcagtttgaa

SEQ ID NO: 177150 - DNA, 16 bp, H. sapiens
ttttcttcatcagttt

SEQ ID NO: 177151 - DNA, 16 bp, H. sapiens
ttttcttcatccagtc

SEQ ID NO: 177152 - DNA, 16 bp, H. sapiens
ttttcttcatctctgt

SEQ ID NO: 177153 - DNA, 16 bp, H. sapiens
ttttcttcatgtcttc

SEQ ID NO: 177154 - DNA, 16 bp, H. sapiens
ttttcttcattctctg

SEQ ID NO: 177155 - DNA, 16 bp, H. sapiens
ttttcttcattgcatt

SEQ ID NO: 177156 - DNA, 16 bp, H. sapiens
ttttcttcatttgaaa

SEQ ID NO: 177157 - DNA, 16 bp, H. sapiens
ttttcttcattttgaa

SEQ ID NO: 177158 - DNA, 16 bp, H. sapiens
ttttcttccaatagaa

SEQ ID NO: 177159 - DNA, 16 bp, H. sapiens
ttttcttccacaaaac

SEQ ID NO: 177160 - DNA, 16 bp, H. sapiens
ttttcttccacttctg

SEQ ID NO: 177161 - DNA, 16 bp, H. sapiens
ttttcttccagaaaaa

SEQ ID NO: 177162 - DNA, 16 bp, H. sapiens
ttttcttccagaagtt

SEQ ID NO: 177163 - DNA, 16 bp, H. sapiens
ttttcttccagtactt

SEQ ID NO: 177164 - DNA, 16 bp, H. sapiens
ttttcttccagtcttt

SEQ ID NO: 177165 - DNA, 16 bp, H. sapiens
ttttcttccagtgttt

SEQ ID NO: 177166 - DNA, 16 bp, H. sapiens
ttttcttccccaagaa

SEQ ID NO: 177167 - DNA, 16 bp, H. sapiens
ttttcttcctaggcct

SEQ ID NO: 177168 - DNA, 16 bp, H. sapiens
ttttcttcctatttga

SEQ ID NO: 177169 - DNA, 16 bp, H. sapiens
ttttcttcctctgtaa

SEQ ID NO: 177170 - DNA, 16 bp, H. sapiens
ttttcttcctgtgtta

SEQ ID NO: 177171 - DNA, 16 bp, H. sapiens
ttttcttcctttgaaa

SEQ ID NO: 177172 - DNA, 16 bp, H. sapiens
ttttcttctaaaagtt

SEQ ID NO: 177173 - DNA, 16 bp, H. sapiens
ttttcttctaaaatgc

SEQ ID NO: 177174 - DNA, 16 bp, H. sapiens
ttttcttctaaagaaa

SEQ ID NO: 177175 - DNA, 16 bp, H. sapiens
ttttcttctaagactt

SEQ ID NO: 177176 - DNA, 16 bp, H. sapiens
ttttcttctaagagat

SEQ ID NO: 177177 - DNA, 16 bp, H. sapiens
ttttcttctaagattt

SEQ ID NO: 177178 - DNA, 16 bp, H. sapiens
ttttcttctactctgt

SEQ ID NO: 177179 - DNA, 16 bp, H. sapiens
ttttcttctagaaaat

SEQ ID NO: 177180 - DNA, 16 bp, H. sapiens
ttttcttctagaaatg

SEQ ID NO: 177181 - DNA, 16 bp, H. sapiens
ttttcttctagcattt

SEQ ID NO: 177182 - DNA, 16 bp, H. sapiens
ttttcttctcaaagtt

SEQ ID NO: 177183 - DNA, 16 bp, H. sapiens
ttttcttctcagattt

SEQ ID NO: 177184 - DNA, 16 bp, H. sapiens
ttttcttctccaaatt

SEQ ID NO: 177185 - DNA, 16 bp, H. sapiens
ttttcttctctaccac

SEQ ID NO: 177186 - DNA, 16 bp, H. sapiens
ttttcttctctgtgaa

SEQ ID NO: 177187 - DNA, 16 bp, H. sapiens
ttttcttctgaaatgt

SEQ ID NO: 177188 - DNA, 16 bp, H. sapiens
ttttcttctgaagttt

SEQ ID NO: 177189 - DNA, 16 bp, H. sapiens
ttttcttctgaattta

SEQ ID NO: 177190 - DNA, 16 bp, H. sapiens
ttttcttctgacttct

SEQ ID NO: 177191 - DNA, 16 bp, H. sapiens
ttttcttctgagagtt

SEQ ID NO: 177192 - DNA, 16 bp, H. sapiens
ttttcttctgaggttt

SEQ ID NO: 177193 - DNA, 16 bp, H. sapiens
ttttcttctggaaaca

SEQ ID NO: 177194 - DNA, 16 bp, H. sapiens
ttttcttctgggattc

SEQ ID NO: 177195 - DNA, 16 bp, H. sapiens
ttttcttctgtgactt

SEQ ID NO: 177196 - DNA, 16 bp, H. sapiens
ttttcttcttagaaaa

SEQ ID NO: 177197 - DNA, 16 bp, H. sapiens
ttttcttcttagcact

SEQ ID NO: 177198 - DNA, 16 bp, H. sapiens
ttttcttcttccaaaa

SEQ ID NO: 177199 - DNA, 16 bp, H. sapiens
ttttcttcttccccag

SEQ ID NO: 177200 - DNA, 16 bp, H. sapiens
ttttcttcttgaaatt

SEQ ID NO: 177201 - DNA, 16 bp, H. sapiens
ttttcttcttgctgat

SEQ ID NO: 177202 - DNA, 16 bp, H. sapiens
ttttcttctttatgag

SEQ ID NO: 177203 - DNA, 16 bp, H. sapiens
ttttcttctttcagta

SEQ ID NO: 177204 - DNA, 16 bp, H. sapiens
ttttcttgaaaaaaat

SEQ ID NO: 177205 - DNA, 16 bp, H. sapiens
ttttcttgaaaaaatt

SEQ ID NO: 177206 - DNA, 16 bp, H. sapiens
ttttcttgaaaatgtt

SEQ ID NO: 177207 - DNA, 16 bp, H. sapiens
ttttcttgaactttta

SEQ ID NO: 177208 - DNA, 16 bp, H. sapiens
ttttcttgaataaaag

SEQ ID NO: 177209 - DNA, 16 bp, H. sapiens
ttttcttgagaaaatg

SEQ ID NO: 177210 - DNA, 16 bp, H. sapiens
ttttcttgagatgaag

SEQ ID NO: 177211 - DNA, 16 bp, H. sapiens
ttttcttgagcatttt

SEQ ID NO: 177212 - DNA, 16 bp, H. sapiens
ttttcttgataacatt

SEQ ID NO: 177213 - DNA, 16 bp, H. sapiens
ttttcttgattttaaa

SEQ ID NO: 177214 - DNA, 16 bp, H. sapiens
ttttcttgcaaattta

SEQ ID NO: 177215 - DNA, 16 bp, H. sapiens
ttttcttgcctatttc

SEQ ID NO: 177216 - DNA, 16 bp, H. sapiens
ttttcttgcttttgaa

SEQ ID NO: 177217 - DNA, 16 bp, H. sapiens
ttttcttggagacaga

SEQ ID NO: 177218 - DNA, 16 bp, H. sapiens
ttttcttggatgaatt

SEQ ID NO: 177219 - DNA, 16 bp, H. sapiens
ttttcttggcaatgtg

SEQ ID NO: 177220 - DNA, 16 bp, H. sapiens
ttttcttggcatcctt

SEQ ID NO: 177221 - DNA, 16 bp, H. sapiens
ttttcttgggggaaaa

SEQ ID NO: 177222 - DNA, 16 bp, H. sapiens
ttttcttgtaaatatg

SEQ ID NO: 177223 - DNA, 17 bp, H. sapiens
ttttcttgtaaatttga

SEQ ID NO: 177224 - DNA, 17 bp, H. sapiens
ttttcttgtacatttgt

SEQ ID NO: 177225 - DNA, 16 bp, H. sapiens
ttttcttgtatttaaa

SEQ ID NO: 177226 - DNA, 16 bp, H. sapiens
ttttcttgtcttactg

SEQ ID NO: 177227 - DNA, 16 bp, H. sapiens
ttttcttgtgatatct

SEQ ID NO: 177228 - DNA, 16 bp, H. sapiens
ttttcttgttaaaaac

SEQ ID NO: 177229 - DNA, 16 bp, H. sapiens
ttttcttgtttgtaaa

SEQ ID NO: 177230 - DNA, 16 bp, H. sapiens
ttttcttgttttgaaa

SEQ ID NO: 177231 - DNA, 16 bp, H. sapiens
ttttctttaaaaacct

SEQ ID NO: 177232 - DNA, 16 bp, H. sapiens
ttttctttaaaaatgt

SEQ ID NO: 177233 - DNA, 16 bp, H. sapiens
ttttctttaaaagtca

SEQ ID NO: 177234 - DNA, 16 bp, H. sapiens
ttttctttaaaataga

SEQ ID NO: 177235 - DNA, 16 bp, H. sapiens
ttttctttaaaggaaa

SEQ ID NO: 177236 - DNA, 16 bp, H. sapiens
ttttctttaaaggaat

SEQ ID NO: 177237 - DNA, 16 bp, H. sapiens
ttttctttaaatgctt

SEQ ID NO: 177238 - DNA, 16 bp, H. sapiens
ttttctttaaattgag

SEQ ID NO: 177239 - DNA, 16 bp, H. sapiens
ttttctttaacaaaaa

SEQ ID NO: 177240 - DNA, 16 bp, H. sapiens
ttttctttaagaaaac

SEQ ID NO: 177241 - DNA, 16 bp, H. sapiens
ttttctttaagaatgt

SEQ ID NO: 177242 - DNA, 16 bp, H. sapiens
ttttctttaataatgt

SEQ ID NO: 177243 - DNA, 16 bp, H. sapiens
ttttctttaatgaatg

SEQ ID NO: 177244 - DNA, 16 bp, H. sapiens
ttttctttagaaaaat

SEQ ID NO: 177245 - DNA, 16 bp, H. sapiens
ttttctttagaaaata

SEQ ID NO: 177246 - DNA, 16 bp, H. sapiens
ttttctttataagtta

SEQ ID NO: 177247 - DNA, 16 bp, H. sapiens
ttttctttatagaatt

SEQ ID NO: 177248 - DNA, 19 bp, H. sapiens
ttttctttatccagtctac

SEQ ID NO: 177249 - DNA, 16 bp, H. sapiens
ttttctttatgctaga

SEQ ID NO: 177250 - DNA, 16 bp, H. sapiens
ttttctttatggaaaa

SEQ ID NO: 177251 - DNA, 16 bp, H. sapiens
ttttctttattagtcc

SEQ ID NO: 177252 - DNA, 16 bp, H. sapiens
ttttctttcaataaaa

SEQ ID NO: 177253 - DNA, 16 bp, H. sapiens
ttttctttcacaaaaa

SEQ ID NO: 177254 - DNA, 16 bp, H. sapiens
ttttctttcagatatt

SEQ ID NO: 177255 - DNA, 16 bp, H. sapiens
ttttctttcatgtaga

SEQ ID NO: 177256 - DNA, 16 bp, H. sapiens
ttttctttccattaaa

SEQ ID NO: 177257 - DNA, 16 bp, H. sapiens
ttttctttcccaaaca

SEQ ID NO: 177258 - DNA, 16 bp, H. sapiens
ttttctttctatgcct

SEQ ID NO: 177259 - DNA, 16 bp, H. sapiens
ttttctttctcagaat

SEQ ID NO: 177260 - DNA, 16 bp, H. sapiens
ttttctttctcattga

SEQ ID NO: 177261 - DNA, 16 bp, H. sapiens
ttttctttctcccaaa

SEQ ID NO: 177262 - DNA, 16 bp, H. sapiens
ttttctttctcctaaa

SEQ ID NO: 177263 - DNA, 16 bp, H. sapiens
ttttctttctgaaaaa

SEQ ID NO: 177264 - DNA, 16 bp, H. sapiens
ttttctttctgaaaat

SEQ ID NO: 177265 - DNA, 16 bp, H. sapiens
ttttctttctgaatta

SEQ ID NO: 177266 - DNA, 16 bp, H. sapiens
ttttctttcttgaaat

SEQ ID NO: 177267 - DNA, 16 bp, H. sapiens
ttttctttgaaaaaat

SEQ ID NO: 177268 - DNA, 16 bp, H. sapiens
ttttctttgaaagata

SEQ ID NO: 177269 - DNA, 16 bp, H. sapiens
ttttctttgaatatat

SEQ ID NO: 177270 - DNA, 16 bp, H. sapiens
ttttctttgagaaaat

SEQ ID NO: 177271 - DNA, 16 bp, H. sapiens
ttttctttgagacagt

SEQ ID NO: 177272 - DNA, 16 bp, H. sapiens
ttttctttgagataga

SEQ ID NO: 177273 - DNA, 16 bp, H. sapiens
ttttctttgatgggag

SEQ ID NO: 177274 - DNA, 16 bp, H. sapiens
ttttctttgatttaaa

SEQ ID NO: 177275 - DNA, 16 bp, H. sapiens
ttttctttgctctgaa

SEQ ID NO: 177276 - DNA, 16 bp, H. sapiens
ttttctttggaaaatg

SEQ ID NO: 177277 - DNA, 16 bp, H. sapiens
ttttctttggagaaaa

SEQ ID NO: 177278 - DNA, 16 bp, H. sapiens
ttttctttggagaagt

SEQ ID NO: 177279 - DNA, 16 bp, H. sapiens
ttttctttgtccactt

SEQ ID NO: 177280 - DNA, 16 bp, H. sapiens
ttttctttgtggaaag

SEQ ID NO: 177281 - DNA, 16 bp, H. sapiens
ttttctttgtgggaaa

SEQ ID NO: 177282 - DNA, 16 bp, H. sapiens
ttttctttgttctgaa

SEQ ID NO: 177283 - DNA, 16 bp, H. sapiens
ttttctttgttgaaga

SEQ ID NO: 177284 - DNA, 16 bp, H. sapiens
ttttctttgttgagac

SEQ ID NO: 177285 - DNA, 16 bp, H. sapiens
ttttctttgttggaaa

SEQ ID NO: 177286 - DNA, 16 bp, H. sapiens
ttttcttttaaaatgt

SEQ ID NO: 177287 - DNA, 16 bp, H. sapiens
ttttcttttaaagaaa

SEQ ID NO: 177288 - DNA, 16 bp, H. sapiens
ttttcttttaaagaca

SEQ ID NO: 177289 - DNA, 16 bp, H. sapiens
ttttcttttaaagata

SEQ ID NO: 177290 - DNA, 16 bp, H. sapiens
ttttcttttaaagctt

SEQ ID NO: 177291 - DNA, 16 bp, H. sapiens
ttttcttttaaagttc

SEQ ID NO: 177292 - DNA, 16 bp, H. sapiens
ttttcttttaaatatg

SEQ ID NO: 177293 - DNA, 16 bp, H. sapiens
ttttcttttaacactg

SEQ ID NO: 177294 - DNA, 16 bp, H. sapiens
ttttcttttaagaaaa

SEQ ID NO: 177295 - DNA, 16 bp, H. sapiens
ttttcttttaatgaaa

SEQ ID NO: 177296 - DNA, 16 bp, H. sapiens
ttttcttttacagatt

SEQ ID NO: 177297 - DNA, 16 bp, H. sapiens
ttttcttttagaaaat

SEQ ID NO: 177298 - DNA, 16 bp, H. sapiens
ttttcttttatctgaa

SEQ ID NO: 177299 - DNA, 16 bp, H. sapiens
ttttcttttcaagaaa

SEQ ID NO: 177300 - DNA, 16 bp, H. sapiens
ttttcttttcaagatg

SEQ ID NO: 177301 - DNA, 31 bp, H. sapiens
ttttcttttccaaatctctcgtcccacctta

SEQ ID NO: 177302 - DNA, 16 bp, H. sapiens
ttttcttttccttgaa

SEQ ID NO: 177303 - DNA, 16 bp, H. sapiens
ttttcttttctcagtc

SEQ ID NO: 177304 - DNA, 16 bp, H. sapiens
ttttcttttctcagtg

SEQ ID NO: 177305 - DNA, 16 bp, H. sapiens
ttttcttttgaaaaat

SEQ ID NO: 177306 - DNA, 16 bp, H. sapiens
ttttcttttgactgag

SEQ ID NO: 177307 - DNA, 16 bp, H. sapiens
ttttcttttgataaaa

SEQ ID NO: 177308 - DNA, 16 bp, H. sapiens
ttttcttttgattcag

SEQ ID NO: 177309 - DNA, 16 bp, H. sapiens
ttttcttttgcaacag

SEQ ID NO: 177310 - DNA, 16 bp, H. sapiens
ttttcttttgccaaat

SEQ ID NO: 177311 - DNA, 16 bp, H. sapiens
ttttcttttggaaatt

SEQ ID NO: 177312 - DNA, 16 bp, H. sapiens
ttttcttttgtaaaga

SEQ ID NO: 177313 - DNA, 16 bp, H. sapiens
ttttcttttgtaacag

SEQ ID NO: 177314 - DNA, 16 bp, H. sapiens
ttttcttttgttaaaa

SEQ ID NO: 177315 - DNA, 16 bp, H. sapiens
ttttctttttaaggaa

SEQ ID NO: 177316 - DNA, 16 bp, H. sapiens
ttttctttttaatgaa

SEQ ID NO: 177317 - DNA, 16 bp, H. sapiens
ttttctttttagaaaa

SEQ ID NO: 177318 - DNA, 16 bp, H. sapiens
ttttctttttagaaag

SEQ ID NO: 177319 - DNA, 16 bp, H. sapiens
ttttctttttagaaat

SEQ ID NO: 177320 - DNA, 16 bp, H. sapiens
ttttctttttccaaaa

SEQ ID NO: 177321 - DNA, 16 bp, H. sapiens
ttttctttttctccag

SEQ ID NO: 177322 - DNA, 16 bp, H. sapiens
ttttctttttctgaaa

SEQ ID NO: 177323 - DNA, 16 bp, H. sapiens
ttttctttttgaaaat

SEQ ID NO: 177324 - DNA, 16 bp, H. sapiens
ttttctttttgaaatg

SEQ ID NO: 177325 - DNA, 16 bp, H. sapiens
ttttctttttgaggca

SEQ ID NO: 177326 - DNA, 16 bp, H. sapiens
ttttcttttttagaga

SEQ ID NO: 177327 - DNA, 16 bp, H. sapiens
ttttcttttttcaaag

SEQ ID NO: 177328 - DNA, 16 bp, H. sapiens
ttttgaaaaaaacatt

SEQ ID NO: 177329 - DNA, 16 bp, H. sapiens
ttttgaaaaacaaaaa

SEQ ID NO: 177330 - DNA, 16 bp, H. sapiens
ttttgaaaaacaatta

SEQ ID NO: 177331 - DNA, 16 bp, H. sapiens
ttttgaaaaacataat

SEQ ID NO: 177332 - DNA, 16 bp, H. sapiens
ttttgaaaaactggaa

SEQ ID NO: 177333 - DNA, 16 bp, H. sapiens
ttttgaaaaacttcca

SEQ ID NO: 177334 - DNA, 16 bp, H. sapiens
ttttgaaaaacttttt

SEQ ID NO: 177335 - DNA, 16 bp, H. sapiens
ttttgaaaaagaaaag

SEQ ID NO: 177336 - DNA, 16 bp, H. sapiens
ttttgaaaaagaattt

SEQ ID NO: 177337 - DNA, 16 bp, H. sapiens
ttttgaaaaagagaat

SEQ ID NO: 177338 - DNA, 16 bp, H. sapiens
ttttgaaaaagcattt

SEQ ID NO: 177339 - DNA, 16 bp, H. sapiens
ttttgaaaaaggagaa

SEQ ID NO: 177340 - DNA, 16 bp, H. sapiens
ttttgaaaaagtaaag

SEQ ID NO: 177341 - DNA, 16 bp, H. sapiens
ttttgaaaaataaagt

SEQ ID NO: 177342 - DNA, 16 bp, H. sapiens
ttttgaaaaataaatg

SEQ ID NO: 177343 - DNA, 16 bp, H. sapiens
ttttgaaaaatacagt

SEQ ID NO: 177344 - DNA, 16 bp, H. sapiens
ttttgaaaaatagtaa

SEQ ID NO: 177345 - DNA, 16 bp, H. sapiens
ttttgaaaaatatctg

SEQ ID NO: 177346 - DNA, 16 bp, H. sapiens
ttttgaaaaatatttc

SEQ ID NO: 177347 - DNA, 16 bp, H. sapiens
ttttgaaaaatcaaag

SEQ ID NO: 177348 - DNA, 16 bp, H. sapiens
ttttgaaaaatctcca

SEQ ID NO: 177349 - DNA, 16 bp, H. sapiens
ttttgaaaaatgctga

SEQ ID NO: 177350 - DNA, 16 bp, H. sapiens
ttttgaaaaatgcttt

SEQ ID NO: 177351 - DNA, 16 bp, H. sapiens
ttttgaaaaatgttta

SEQ ID NO: 177352 - DNA, 16 bp, H. sapiens
ttttgaaaaattaagt

SEQ ID NO: 177353 - DNA, 16 bp, H. sapiens
ttttgaaaaatttgca

SEQ ID NO: 177354 - DNA, 16 bp, H. sapiens
ttttgaaaacaaatgt

SEQ ID NO: 177355 - DNA, 16 bp, H. sapiens
ttttgaaaacaaattt

SEQ ID NO: 177356 - DNA, 16 bp, H. sapiens
ttttgaaaacatgaaa

SEQ ID NO: 177357 - DNA, 16 bp, H. sapiens
ttttgaaaacattttt

SEQ ID NO: 177358 - DNA, 16 bp, H. sapiens
ttttgaaaaccagaaa

SEQ ID NO: 177359 - DNA, 16 bp, H. sapiens
ttttgaaaaccttcca

SEQ ID NO: 177360 - DNA, 16 bp, H. sapiens
ttttgaaaagaaactt

SEQ ID NO: 177361 - DNA, 16 bp, H. sapiens
ttttgaaaagaagaaa

SEQ ID NO: 177362 - DNA, 16 bp, H. sapiens
ttttgaaaagaatttt

SEQ ID NO: 177363 - DNA, 16 bp, H. sapiens
ttttgaaaagatgttt

SEQ ID NO: 177364 - DNA, 16 bp, H. sapiens
ttttgaaaagcaaatg

SEQ ID NO: 177365 - DNA, 16 bp, H. sapiens
ttttgaaaagcacttt

SEQ ID NO: 177366 - DNA, 16 bp, H. sapiens
ttttgaaaagcatttt

SEQ ID NO: 177367 - DNA, 16 bp, H. sapiens
ttttgaaaagcttttt

SEQ ID NO: 177368 - DNA, 16 bp, H. sapiens
ttttgaaaaggaaaaa

SEQ ID NO: 177369 - DNA, 16 bp, H. sapiens
ttttgaaaaggaattt

SEQ ID NO: 177370 - DNA, 16 bp, H. sapiens
ttttgaaaaggataaa

SEQ ID NO: 177371 - DNA, 16 bp, H. sapiens
ttttgaaaagtaaatt

SEQ ID NO: 177372 - DNA, 16 bp, H. sapiens
ttttgaaaagtctgtt

SEQ ID NO: 177373 - DNA, 16 bp, H. sapiens
ttttgaaaagttcttt

SEQ ID NO: 177374 - DNA, 16 bp, H. sapiens
ttttgaaaataaaaca

SEQ ID NO: 177375 - DNA, 16 bp, H. sapiens
ttttgaaaataaagtt

SEQ ID NO: 177376 - DNA, 16 bp, H. sapiens
ttttgaaaataatact

SEQ ID NO: 177377 - DNA, 16 bp, H. sapiens
ttttgaaaatatgaaa

SEQ ID NO: 177378 - DNA, 16 bp, H. sapiens
ttttgaaaatattact

SEQ ID NO: 177379 - DNA, 16 bp, H. sapiens
ttttgaaaatcaaaag

SEQ ID NO: 177380 - DNA, 16 bp, H. sapiens
ttttgaaaatcaaatg

SEQ ID NO: 177381 - DNA, 16 bp, H. sapiens
ttttgaaaatcatttc

SEQ ID NO: 177382 - DNA, 16 bp, H. sapiens
ttttgaaaatgaactt

SEQ ID NO: 177383 - DNA, 16 bp, H. sapiens
ttttgaaaatgaagaa

SEQ ID NO: 177384 - DNA, 16 bp, H. sapiens
ttttgaaaatgaattt

SEQ ID NO: 177385 - DNA, 16 bp, H. sapiens
ttttgaaaatgatgaa

SEQ ID NO: 177386 - DNA, 16 bp, H. sapiens
ttttgaaaatgattta

SEQ ID NO: 177387 - DNA, 16 bp, H. sapiens
ttttgaaaatgctttt

SEQ ID NO: 177388 - DNA, 16 bp, H. sapiens
ttttgaaaatgtaaat

SEQ ID NO: 177389 - DNA, 16 bp, H. sapiens
ttttgaaaatgtcttt

SEQ ID NO: 177390 - DNA, 16 bp, H. sapiens
ttttgaaaatgtttca

SEQ ID NO: 177391 - DNA, 16 bp, H. sapiens
ttttgaaaatgtttgc

SEQ ID NO: 177392 - DNA, 16 bp, H. sapiens
ttttgaaaattaagtg

SEQ ID NO: 177393 - DNA, 16 bp, H. sapiens
ttttgaaaattacttt

SEQ ID NO: 177394 - DNA, 16 bp, H. sapiens
ttttgaaaattgttca

SEQ ID NO: 177395 - DNA, 16 bp, H. sapiens
ttttgaaaatttgaat

SEQ ID NO: 177396 - DNA, 16 bp, H. sapiens
ttttgaaacaaatttt

SEQ ID NO: 177397 - DNA, 16 bp, H. sapiens
ttttgaaacacatttt

SEQ ID NO: 177398 - DNA, 16 bp, H. sapiens
ttttgaaacagaattt

SEQ ID NO: 177399 - DNA, 16 bp, H. sapiens
ttttgaaacagactct

SEQ ID NO: 177400 - DNA, 16 bp, H. sapiens
ttttgaaacagatttt

SEQ ID NO: 177401 - DNA, 16 bp, H. sapiens
ttttgaaacatttcat

SEQ ID NO: 177402 - DNA, 16 bp, H. sapiens
ttttgaaactgaaaat

SEQ ID NO: 177403 - DNA, 16 bp, H. sapiens
ttttgaaactgaaatt

SEQ ID NO: 177404 - DNA, 16 bp, H. sapiens
ttttgaaactgctttt

SEQ ID NO: 177405 - DNA, 16 bp, H. sapiens
ttttgaaagaaaatta

SEQ ID NO: 177406 - DNA, 16 bp, H. sapiens
ttttgaaagaaagcaa

SEQ ID NO: 177407 - DNA, 16 bp, H. sapiens
ttttgaaagaagagaa

SEQ ID NO: 177408 - DNA, 16 bp, H. sapiens
ttttgaaagaagcaaa

SEQ ID NO: 177409 - DNA, 16 bp, H. sapiens
ttttgaaagctatttt

SEQ ID NO: 177410 - DNA, 16 bp, H. sapiens
ttttgaaagctgtttt

SEQ ID NO: 177411 - DNA, 16 bp, H. sapiens
ttttgaaaggaaaaat

SEQ ID NO: 177412 - DNA, 16 bp, H. sapiens
ttttgaaaggaaaatt

SEQ ID NO: 177413 - DNA, 16 bp, H. sapiens
ttttgaaaggataaaa

SEQ ID NO: 177414 - DNA, 16 bp, H. sapiens
ttttgaaagggaaaaa

SEQ ID NO: 177415 - DNA, 16 bp, H. sapiens
ttttgaaaggtaaaaa

SEQ ID NO: 177416 - DNA, 16 bp, H. sapiens
ttttgaaagtagagct

SEQ ID NO: 177417 - DNA, 16 bp, H. sapiens
ttttgaaagttccttt

SEQ ID NO: 177418 - DNA, 16 bp, H. sapiens
ttttgaaagttcttta

SEQ ID NO: 177419 - DNA, 16 bp, H. sapiens
ttttgaaataaaaagt

SEQ ID NO: 177420 - DNA, 16 bp, H. sapiens
ttttgaaataaaactt

SEQ ID NO: 177421 - DNA, 16 bp, H. sapiens
ttttgaaataaaatga

SEQ ID NO: 177422 - DNA, 16 bp, H. sapiens
ttttgaaataaaattg

SEQ ID NO: 177423 - DNA, 16 bp, H. sapiens
ttttgaaataaagttt

SEQ ID NO: 177424 - DNA, 16 bp, H. sapiens
ttttgaaataatcttt

SEQ ID NO: 177425 - DNA, 16 bp, H. sapiens
ttttgaaatacatata

SEQ ID NO: 177426 - DNA, 16 bp, H. sapiens
ttttgaaatacatatt

SEQ ID NO: 177427 - DNA, 16 bp, H. sapiens
ttttgaaatatataca

SEQ ID NO: 177428 - DNA, 16 bp, H. sapiens
ttttgaaatcacattt

SEQ ID NO: 177429 - DNA, 16 bp, H. sapiens
ttttgaaatcagaaaa

SEQ ID NO: 177430 - DNA, 16 bp, H. sapiens
ttttgaaatcttaaaa

SEQ ID NO: 177431 - DNA, 16 bp, H. sapiens
ttttgaaatgaagaaa

SEQ ID NO: 177432 - DNA, 16 bp, H. sapiens
ttttgaaatgcagaaa

SEQ ID NO: 177433 - DNA, 16 bp, H. sapiens
ttttgaaatgcatatt

SEQ ID NO: 177434 - DNA, 16 bp, H. sapiens
ttttgaaatggagttt

SEQ ID NO: 177435 - DNA, 16 bp, H. sapiens
ttttgaaatggccctg

SEQ ID NO: 177436 - DNA, 16 bp, H. sapiens
ttttgaaatgtaaaaa

SEQ ID NO: 177437 - DNA, 16 bp, H. sapiens
ttttgaaatgtaaaga

SEQ ID NO: 177438 - DNA, 16 bp, H. sapiens
ttttgaaatgtctgtt

SEQ ID NO: 177439 - DNA, 16 bp, H. sapiens
ttttgaaatgtctttg

SEQ ID NO: 177440 - DNA, 16 bp, H. sapiens
ttttgaaatgtctttt

SEQ ID NO: 177441 - DNA, 16 bp, H. sapiens
ttttgaaatgtgagga

SEQ ID NO: 177442 - DNA, 16 bp, H. sapiens
ttttgaaatgtgcaat

SEQ ID NO: 177443 - DNA, 16 bp, H. sapiens
ttttgaaatgtgttta

SEQ ID NO: 177444 - DNA, 16 bp, H. sapiens
ttttgaaatgttcttt

SEQ ID NO: 177445 - DNA, 16 bp, H. sapiens
ttttgaaatgtttctt

SEQ ID NO: 177446 - DNA, 16 bp, H. sapiens
ttttgaaattcaaatt

SEQ ID NO: 177447 - DNA, 16 bp, H. sapiens
ttttgaaattcacttt

SEQ ID NO: 177448 - DNA, 16 bp, H. sapiens
ttttgaaattcatcca

SEQ ID NO: 177449 - DNA, 16 bp, H. sapiens
ttttgaaattctttct

SEQ ID NO: 177450 - DNA, 16 bp, H. sapiens
ttttgaaatttaaaag

SEQ ID NO: 177451 - DNA, 16 bp, H. sapiens
ttttgaaatttcttaa

SEQ ID NO: 177452 - DNA, 16 bp, H. sapiens
ttttgaaatttgaaaa

SEQ ID NO: 177453 - DNA, 16 bp, H. sapiens
ttttgaacaaagaaaa

SEQ ID NO: 177454 - DNA, 16 bp, H. sapiens
ttttgaacaaattttt

SEQ ID NO: 177455 - DNA, 16 bp, H. sapiens
ttttgaacatatttat

SEQ ID NO: 177456 - DNA, 16 bp, H. sapiens
ttttgaacatattttt

SEQ ID NO: 177457 - DNA, 16 bp, H. sapiens
ttttgaactcctgaac

SEQ ID NO: 177458 - DNA, 16 bp, H. sapiens
ttttgaactttataaa

SEQ ID NO: 177459 - DNA, 16 bp, H. sapiens
ttttgaactttatgta

SEQ ID NO: 177460 - DNA, 16 bp, H. sapiens
ttttgaagaaaaaagt

SEQ ID NO: 177461 - DNA, 16 bp, H. sapiens
ttttgaagaaaaacaa

SEQ ID NO: 177462 - DNA, 16 bp, H. sapiens
ttttgaagaaaaattt

SEQ ID NO: 177463 - DNA, 16 bp, H. sapiens
ttttgaagaaacagaa

SEQ ID NO: 177464 - DNA, 16 bp, H. sapiens
ttttgaagaaactcca

SEQ ID NO: 177465 - DNA, 16 bp, H. sapiens
ttttgaagaaagaaaa

SEQ ID NO: 177466 - DNA, 16 bp, H. sapiens
ttttgaagaacaaaag

SEQ ID NO: 177467 - DNA, 16 bp, H. sapiens
ttttgaagaacttcca

SEQ ID NO: 177468 - DNA, 16 bp, H. sapiens
ttttgaagaagaagaa

SEQ ID NO: 177469 - DNA, 16 bp, H. sapiens
ttttgaagaagagaaa

SEQ ID NO: 177470 - DNA, 16 bp, H. sapiens
ttttgaagaatatatt

SEQ ID NO: 177471 - DNA, 16 bp, H. sapiens
ttttgaagaatattta

SEQ ID NO: 177472 - DNA, 16 bp, H. sapiens
ttttgaagaatctgaa

SEQ ID NO: 177473 - DNA, 16 bp, H. sapiens
ttttgaagaatcttca

SEQ ID NO: 177474 - DNA, 16 bp, H. sapiens
ttttgaagacagagtt

SEQ ID NO: 177475 - DNA, 16 bp, H. sapiens
ttttgaagagaaaaat

SEQ ID NO: 177476 - DNA, 16 bp, H. sapiens
ttttgaagagacaggg

SEQ ID NO: 177477 - DNA, 16 bp, H. sapiens
ttttgaagataaaata

SEQ ID NO: 177478 - DNA, 16 bp, H. sapiens
ttttgaagatgaggaa

SEQ ID NO: 177479 - DNA, 16 bp, H. sapiens
ttttgaagattaaatg

SEQ ID NO: 177480 - DNA, 16 bp, H. sapiens
ttttgaagatttagta

SEQ ID NO: 177481 - DNA, 16 bp, H. sapiens
ttttgaagattttctc

SEQ ID NO: 177482 - DNA, 16 bp, H. sapiens
ttttgaagcttttttc

SEQ ID NO: 177483 - DNA, 16 bp, H. sapiens
ttttgaaggaagaaat

SEQ ID NO: 177484 - DNA, 16 bp, H. sapiens
ttttgaaggacagttt

SEQ ID NO: 177485 - DNA, 16 bp, H. sapiens
ttttgaaggacatttt

SEQ ID NO: 177486 - DNA, 16 bp, H. sapiens
ttttgaaggataattt

SEQ ID NO: 177487 - DNA, 16 bp, H. sapiens
ttttgaaggggacaca

SEQ ID NO: 177488 - DNA, 16 bp, H. sapiens
ttttgaaggtttttaa

SEQ ID NO: 177489 - DNA, 16 bp, H. sapiens
ttttgaagtattttct

SEQ ID NO: 177490 - DNA, 16 bp, H. sapiens
ttttgaagtcttcatc

SEQ ID NO: 177491 - DNA, 16 bp, H. sapiens
ttttgaagttaaataa

SEQ ID NO: 177492 - DNA, 16 bp, H. sapiens
ttttgaagttttcaaa

SEQ ID NO: 177493 - DNA, 16 bp, H. sapiens
ttttgaatagaaattt

SEQ ID NO: 177494 - DNA, 16 bp, H. sapiens
ttttgaatatattgaa

SEQ ID NO: 177495 - DNA, 16 bp, H. sapiens
ttttgaatctctcttt

SEQ ID NO: 177496 - DNA, 16 bp, H. sapiens
ttttgaatggaaaaaa

SEQ ID NO: 177497 - DNA, 16 bp, H. sapiens
ttttgaatggtttttc

SEQ ID NO: 177498 - DNA, 16 bp, H. sapiens
ttttgaattaaaaaca

SEQ ID NO: 177499 - DNA, 16 bp, H. sapiens
ttttgaattaaagaaa

SEQ ID NO: 177500 - DNA, 16 bp, H. sapiens
ttttgaattgcatttc

SEQ ID NO: 177501 - DNA, 16 bp, H. sapiens
ttttgaattggattgt

SEQ ID NO: 177502 - DNA, 16 bp, H. sapiens
ttttgaatttcaaaaa

SEQ ID NO: 177503 - DNA, 16 bp, H. sapiens
ttttgaattttgaacc

SEQ ID NO: 177504 - DNA, 16 bp, H. sapiens
ttttgaattttgatga

SEQ ID NO: 177505 - DNA, 16 bp, H. sapiens
ttttgaattttgcatt

SEQ ID NO: 177506 - DNA, 16 bp, H. sapiens
ttttgaattttggaat

SEQ ID NO: 177507 - DNA, 16 bp, H. sapiens
ttttgacaaaaataaa

SEQ ID NO: 177508 - DNA, 16 bp, H. sapiens
ttttgacaaatgtgta

SEQ ID NO: 177509 - DNA, 16 bp, H. sapiens
ttttgacaattatttt

SEQ ID NO: 177510 - DNA, 16 bp, H. sapiens
ttttgacaatttttat

SEQ ID NO: 177511 - DNA, 16 bp, H. sapiens
ttttgacagatgtata

SEQ ID NO: 177512 - DNA, 16 bp, H. sapiens
ttttgacagtgtcttg

SEQ ID NO: 177513 - DNA, 16 bp, H. sapiens
ttttgacagtttttat

SEQ ID NO: 177514 - DNA, 16 bp, H. sapiens
ttttgacatatgtatg

SEQ ID NO: 177515 - DNA, 16 bp, H. sapiens
ttttgacatggagtct

SEQ ID NO: 177516 - DNA, 16 bp, H. sapiens
ttttgaccaatatctc

SEQ ID NO: 177517 - DNA, 16 bp, H. sapiens
ttttgacctataaaaa

SEQ ID NO: 177518 - DNA, 16 bp, H. sapiens
ttttgactatagtcac

SEQ ID NO: 177519 - DNA, 16 bp, H. sapiens
ttttgactccatttca

SEQ ID NO: 177520 - DNA, 16 bp, H. sapiens
ttttgactgaagtatt

SEQ ID NO: 177521 - DNA, 16 bp, H. sapiens
ttttgacttcccaaaa

SEQ ID NO: 177522 - DNA, 16 bp, H. sapiens
ttttgacttgacttgg

SEQ ID NO: 177523 - DNA, 16 bp, H. sapiens
ttttgactttaaaaaa

SEQ ID NO: 177524 - DNA, 16 bp, H. sapiens
ttttgactttcttctg

SEQ ID NO: 177525 - DNA, 16 bp, H. sapiens
ttttgactttttagta

SEQ ID NO: 177526 - DNA, 16 bp, H. sapiens
ttttgagaaaaaatat

SEQ ID NO: 177527 - DNA, 16 bp, H. sapiens
ttttgagaaaatttta

SEQ ID NO: 177528 - DNA, 16 bp, H. sapiens
ttttgagaaacagcag

SEQ ID NO: 177529 - DNA, 16 bp, H. sapiens
ttttgagaaacttcca

SEQ ID NO: 177530 - DNA, 16 bp, H. sapiens
ttttgagaaacttctt

SEQ ID NO: 177531 - DNA, 16 bp, H. sapiens
ttttgagaaagaaaga

SEQ ID NO: 177532 - DNA, 16 bp, H. sapiens
ttttgagaaagaagaa

SEQ ID NO: 177533 - DNA, 16 bp, H. sapiens
ttttgagaaagagaaa

SEQ ID NO: 177534 - DNA, 16 bp, H. sapiens
ttttgagaaataaaat

SEQ ID NO: 177535 - DNA, 16 bp, H. sapiens
ttttgagaaatgtgtt

SEQ ID NO: 177536 - DNA, 16 bp, H. sapiens
ttttgagaaggactct

SEQ ID NO: 177537 - DNA, 16 bp, H. sapiens
ttttgagaaggagttt

SEQ ID NO: 177538 - DNA, 16 bp, H. sapiens
ttttgagaatgaaatg

SEQ ID NO: 177539 - DNA, 16 bp, H. sapiens
ttttgagaattttaaa

SEQ ID NO: 177540 - DNA, 16 bp, H. sapiens
ttttgagaatttttgc

SEQ ID NO: 177541 - DNA, 16 bp, H. sapiens
ttttgagacaaagtct

SEQ ID NO: 177542 - DNA, 16 bp, H. sapiens
ttttgagacaaagttt

SEQ ID NO: 177543 - DNA, 16 bp, H. sapiens
ttttgagacaagatct

SEQ ID NO: 177544 - DNA, 16 bp, H. sapiens
ttttgagacaaggtct

SEQ ID NO: 177545 - DNA, 16 bp, H. sapiens
ttttgagacaagttct

SEQ ID NO: 177546 - DNA, 16 bp, H. sapiens
ttttgagacaatgtct

SEQ ID NO: 177547 - DNA, 16 bp, H. sapiens
ttttgagacacaatct

SEQ ID NO: 177548 - DNA, 18 bp, H. sapiens
ttttgagacagaatctcg

SEQ ID NO: 177549 - DNA, 16 bp, H. sapiens
ttttgagacagaattt

SEQ ID NO: 177550 - DNA, 16 bp, H. sapiens
ttttgagacagacttt

SEQ ID NO: 177551 - DNA, 16 bp, H. sapiens
ttttgagacagagcat

SEQ ID NO: 177552 - DNA, 16 bp, H. sapiens
ttttgagacagaggtt

SEQ ID NO: 177553 - DNA, 16 bp, H. sapiens
ttttgagacagagttt

SEQ ID NO: 177554 - DNA, 16 bp, H. sapiens
ttttgagacaggctct

SEQ ID NO: 177555 - DNA, 16 bp, H. sapiens
ttttgagacaggctgg

SEQ ID NO: 177556 - DNA, 16 bp, H. sapiens
ttttgagacagggcct

SEQ ID NO: 177557 - DNA, 16 bp, H. sapiens
ttttgagacagggtct

SEQ ID NO: 177558 - DNA, 18 bp, H. sapiens
ttttgagacagggtcttt

SEQ ID NO: 177559 - DNA, 16 bp, H. sapiens
ttttgagacagggttt

SEQ ID NO: 177560 - DNA, 16 bp, H. sapiens
ttttgagacagtctca

SEQ ID NO: 177561 - DNA, 16 bp, H. sapiens
ttttgagacagtctta

SEQ ID NO: 177562 - DNA, 16 bp, H. sapiens
ttttgagacagtgtct

SEQ ID NO: 177563 - DNA, 16 bp, H. sapiens
ttttgagaccaagtct

SEQ ID NO: 177564 - DNA, 16 bp, H. sapiens
ttttgagacggaatct

SEQ ID NO: 177565 - DNA, 16 bp, H. sapiens
ttttgagacggagtcc

SEQ ID NO: 177566 - DNA, 17 bp, H. sapiens
ttttgagacggagtcta

SEQ ID NO: 177567 - DNA, 19 bp, H. sapiens
ttttgagacggagtctcgt

SEQ ID NO: 177568 - DNA, 17 bp, H. sapiens
ttttgagacggagtctg

SEQ ID NO: 177569 - DNA, 17 bp, H. sapiens
ttttgagacggagtttc

SEQ ID NO: 177570 - DNA, 16 bp, H. sapiens
ttttgagactattttc

SEQ ID NO: 177571 - DNA, 16 bp, H. sapiens
ttttgagactcagtct

SEQ ID NO: 177572 - DNA, 19 bp, H. sapiens
ttttgagactgagtctcgc

SEQ ID NO: 177573 - DNA, 17 bp, H. sapiens
ttttgagactgagtctt

SEQ ID NO: 177574 - DNA, 16 bp, H. sapiens
ttttgagagaagaaaa

SEQ ID NO: 177575 - DNA, 16 bp, H. sapiens
ttttgagagagaaaat

SEQ ID NO: 177576 - DNA, 16 bp, H. sapiens
ttttgagagagagaga

SEQ ID NO: 177577 - DNA, 16 bp, H. sapiens
ttttgagagagtctct

SEQ ID NO: 177578 - DNA, 16 bp, H. sapiens
ttttgagagagttttg

SEQ ID NO: 177579 - DNA, 16 bp, H. sapiens
ttttgagagggagtct

SEQ ID NO: 177580 - DNA, 16 bp, H. sapiens
ttttgagagtctcact

SEQ ID NO: 177581 - DNA, 16 bp, H. sapiens
ttttgagatactttcc

SEQ ID NO: 177582 - DNA, 21 bp, H. sapiens
ttttgagatcaactggtctga

SEQ ID NO: 177583 - DNA, 16 bp, H. sapiens
ttttgagatgaaatct

SEQ ID NO: 177584 - DNA, 16 bp, H. sapiens
ttttgagatgaggaaa

SEQ ID NO: 177585 - DNA, 16 bp, H. sapiens
ttttgagatgcagtct

SEQ ID NO: 177586 - DNA, 17 bp, H. sapiens
ttttgagatggaatctt

SEQ ID NO: 177587 - DNA, 16 bp, H. sapiens
ttttgagatggagtca

SEQ ID NO: 177588 - DNA, 16 bp, H. sapiens
ttttgagatggagtcc

SEQ ID NO: 177589 - DNA, 17 bp, H. sapiens
ttttgagatggagtctc

SEQ ID NO: 177590 - DNA, 20 bp, H. sapiens
ttttgagatggagtctcaca

SEQ ID NO: 177591 - DNA, 17 bp, H. sapiens
ttttgagatggagtctt

SEQ ID NO: 177592 - DNA, 16 bp, H. sapiens
ttttgagatggagtgt

SEQ ID NO: 177593 - DNA, 16 bp, H. sapiens
ttttgagatggagttt

SEQ ID NO: 177594 - DNA, 16 bp, H. sapiens
ttttgagatggtgtct

SEQ ID NO: 177595 - DNA, 17 bp, H. sapiens
ttttgagatgtagtctc

SEQ ID NO: 177596 - DNA, 16 bp, H. sapiens
ttttgagcaacctcca

SEQ ID NO: 177597 - DNA, 16 bp, H. sapiens
ttttgagcaggagagt

SEQ ID NO: 177598 - DNA, 16 bp, H. sapiens
ttttgagcagttttag

SEQ ID NO: 177599 - DNA, 16 bp, H. sapiens
ttttgagcctcagttt

SEQ ID NO: 177600 - DNA, 16 bp, H. sapiens
ttttgagcctttgtgt

SEQ ID NO: 177601 - DNA, 16 bp, H. sapiens
ttttgagctgagatga

SEQ ID NO: 177602 - DNA, 16 bp, H. sapiens
ttttgagctttaagat

SEQ ID NO: 177603 - DNA, 16 bp, H. sapiens
ttttgaggaaaaagaa

SEQ ID NO: 177604 - DNA, 16 bp, H. sapiens
ttttgaggaaatattt

SEQ ID NO: 177605 - DNA, 16 bp, H. sapiens
ttttgaggaaccccca

SEQ ID NO: 177606 - DNA, 16 bp, H. sapiens
ttttgaggaacctcca

SEQ ID NO: 177607 - DNA, 16 bp, H. sapiens
ttttgaggaagagtct

SEQ ID NO: 177608 - DNA, 16 bp, H. sapiens
ttttgaggaagctcag

SEQ ID NO: 177609 - DNA, 16 bp, H. sapiens
ttttgaggagtatctt

SEQ ID NO: 177610 - DNA, 16 bp, H. sapiens
ttttgaggatgaaatg

SEQ ID NO: 177611 - DNA, 16 bp, H. sapiens
ttttgaggattaaatt

SEQ ID NO: 177612 - DNA, 16 bp, H. sapiens
ttttgaggcagtgtct

SEQ ID NO: 177613 - DNA, 16 bp, H. sapiens
ttttgaggcggggtct

SEQ ID NO: 177614 - DNA, 16 bp, H. sapiens
ttttgaggtgctgctg

SEQ ID NO: 177615 - DNA, 16 bp, H. sapiens
ttttgaggttttggga

SEQ ID NO: 177616 - DNA, 16 bp, H. sapiens
ttttgagtaaataatg

SEQ ID NO: 177617 - DNA, 16 bp, H. sapiens
ttttgagtaattttct

SEQ ID NO: 177618 - DNA, 16 bp, H. sapiens
ttttgagtactttctt

SEQ ID NO: 177619 - DNA, 16 bp, H. sapiens
ttttgagtctcaattt

SEQ ID NO: 177620 - DNA, 16 bp, H. sapiens
ttttgagtgagcagtt

SEQ ID NO: 177621 - DNA, 16 bp, H. sapiens
ttttgagtgtgtttct

SEQ ID NO: 177622 - DNA, 16 bp, H. sapiens
ttttgagttacatttt

SEQ ID NO: 177623 - DNA, 16 bp, H. sapiens
ttttgagttctttgag

SEQ ID NO: 177624 - DNA, 16 bp, H. sapiens
ttttgagtttctgact

SEQ ID NO: 177625 - DNA, 16 bp, H. sapiens
ttttgagttttaaagt

SEQ ID NO: 177626 - DNA, 16 bp, H. sapiens
ttttgagttttacatt

SEQ ID NO: 177627 - DNA, 16 bp, H. sapiens
ttttgataaaacaatt

SEQ ID NO: 177628 - DNA, 16 bp, H. sapiens
ttttgataaaatccag

SEQ ID NO: 177629 - DNA, 16 bp, H. sapiens
ttttgataaacagaaa

SEQ ID NO: 177630 - DNA, 16 bp, H. sapiens
ttttgataactgtgta

SEQ ID NO: 177631 - DNA, 16 bp, H. sapiens
ttttgataatacattt

SEQ ID NO: 177632 - DNA, 16 bp, H. sapiens
ttttgatacattttaa

SEQ ID NO: 177633 - DNA, 16 bp, H. sapiens
ttttgatacattttta

SEQ ID NO: 177634 - DNA, 16 bp, H. sapiens
ttttgatactttaaaa

SEQ ID NO: 177635 - DNA, 16 bp, H. sapiens
ttttgatagggattgt

SEQ ID NO: 177636 - DNA, 16 bp, H. sapiens
ttttgatataagcata

SEQ ID NO: 177637 - DNA, 16 bp, H. sapiens
ttttgatatattttca

SEQ ID NO: 177638 - DNA, 16 bp, H. sapiens
ttttgatatgctgttt

SEQ ID NO: 177639 - DNA, 31 bp, H. sapiens
ttttgatctttgttggtttaaagtctgtttt

SEQ ID NO: 177640 - DNA, 16 bp, H. sapiens
ttttgatgaaaaaaat

SEQ ID NO: 177641 - DNA, 16 bp, H. sapiens
ttttgatgaaagaaaa

SEQ ID NO: 177642 - DNA, 16 bp, H. sapiens
ttttgatgctattgta

SEQ ID NO: 177643 - DNA, 16 bp, H. sapiens
ttttgatgggcttgtt

SEQ ID NO: 177644 - DNA, 16 bp, H. sapiens
ttttgatgtaaaatat

SEQ ID NO: 177645 - DNA, 16 bp, H. sapiens
ttttgatgtactgttg

SEQ ID NO: 177646 - DNA, 16 bp, H. sapiens
ttttgatgtaggtgct

SEQ ID NO: 177647 - DNA, 16 bp, H. sapiens
ttttgatgtatttcaa

SEQ ID NO: 177648 - DNA, 16 bp, H. sapiens
ttttgatgttgatgct

SEQ ID NO: 177649 - DNA, 16 bp, H. sapiens
ttttgattaactcaaa

SEQ ID NO: 177650 - DNA, 16 bp, H. sapiens
ttttgattatgaccat

SEQ ID NO: 177651 - DNA, 16 bp, H. sapiens
ttttgattcatcaggt

SEQ ID NO: 177652 - DNA, 16 bp, H. sapiens
ttttgattccattcca

SEQ ID NO: 177653 - DNA, 16 bp, H. sapiens
ttttgattctaaaatt

SEQ ID NO: 177654 - DNA, 16 bp, H. sapiens
ttttgattcttttaaa

SEQ ID NO: 177655 - DNA, 16 bp, H. sapiens
ttttgattgaaagtga

SEQ ID NO: 177656 - DNA, 16 bp, H. sapiens
ttttgattgatcagtt

SEQ ID NO: 177657 - DNA, 16 bp, H. sapiens
ttttgattggagaatt

SEQ ID NO: 177658 - DNA, 16 bp, H. sapiens
ttttgattggcatttt

SEQ ID NO: 177659 - DNA, 16 bp, H. sapiens
ttttgatttccatttg

SEQ ID NO: 177660 - DNA, 16 bp, H. sapiens
ttttgatttctgtagc

SEQ ID NO: 177661 - DNA, 16 bp, H. sapiens
ttttgatttcttaaaa

SEQ ID NO: 177662 - DNA, 16 bp, H. sapiens
ttttgatttgcatatc

SEQ ID NO: 177663 - DNA, 16 bp, H. sapiens
ttttgatttgcatttc

SEQ ID NO: 177664 - DNA, 16 bp, H. sapiens
ttttgattttacatgc

SEQ ID NO: 177665 - DNA, 16 bp, H. sapiens
ttttgattttagccat

SEQ ID NO: 177666 - DNA, 16 bp, H. sapiens
ttttgcaaaaaagaaa

SEQ ID NO: 177667 - DNA, 16 bp, H. sapiens
ttttgcaaaaacaaaa

SEQ ID NO: 177668 - DNA, 16 bp, H. sapiens
ttttgcaaaagaagaa

SEQ ID NO: 177669 - DNA, 16 bp, H. sapiens
ttttgcaaaataaaat

SEQ ID NO: 177670 - DNA, 16 bp, H. sapiens
ttttgcaaaatacctt

SEQ ID NO: 177671 - DNA, 16 bp, H. sapiens
ttttgcaaaatgttac

SEQ ID NO: 177672 - DNA, 16 bp, H. sapiens
ttttgcaaaatgttat

SEQ ID NO: 177673 - DNA, 16 bp, H. sapiens
ttttgcaaaatgtttt

SEQ ID NO: 177674 - DNA, 16 bp, H. sapiens
ttttgcaaagtggttg

SEQ ID NO: 177675 - DNA, 16 bp, H. sapiens
ttttgcaaataaaatt

SEQ ID NO: 177676 - DNA, 16 bp, H. sapiens
ttttgcaaataaagtt

SEQ ID NO: 177677 - DNA, 16 bp, H. sapiens
ttttgcaaatgtaatt

SEQ ID NO: 177678 - DNA, 16 bp, H. sapiens
ttttgcaacttcttgt

SEQ ID NO: 177679 - DNA, 16 bp, H. sapiens
ttttgcaattaaaagt

SEQ ID NO: 177680 - DNA, 16 bp, H. sapiens
ttttgcacagcaaagg

SEQ ID NO: 177681 - DNA, 16 bp, H. sapiens
ttttgcacattgattt

SEQ ID NO: 177682 - DNA, 28 bp, H. sapiens
ttttgcacattgattttgtatcctgaga

SEQ ID NO: 177683 - DNA, 16 bp, H. sapiens
ttttgcagaaaaataa

SEQ ID NO: 177684 - DNA, 16 bp, H. sapiens
ttttgcagaaaacaaa

SEQ ID NO: 177685 - DNA, 16 bp, H. sapiens
ttttgcagaaattgac

SEQ ID NO: 177686 - DNA, 16 bp, H. sapiens
ttttgcagaatctgca

SEQ ID NO: 177687 - DNA, 16 bp, H. sapiens
ttttgcagaatgtcct

SEQ ID NO: 177688 - DNA, 16 bp, H. sapiens
ttttgcagacaaagaa

SEQ ID NO: 177689 - DNA, 16 bp, H. sapiens
ttttgcagagatgggg

SEQ ID NO: 177690 - DNA, 16 bp, H. sapiens
ttttgcagagcagaaa

SEQ ID NO: 177691 - DNA, 16 bp, H. sapiens
ttttgcagaggagaaa

SEQ ID NO: 177692 - DNA, 16 bp, H. sapiens
ttttgcagatatattt

SEQ ID NO: 177693 - DNA, 16 bp, H. sapiens
ttttgcagatgaggaa

SEQ ID NO: 177694 - DNA, 16 bp, H. sapiens
ttttgcagctgttgga

SEQ ID NO: 177695 - DNA, 16 bp, H. sapiens
ttttgcagctttctct

SEQ ID NO: 177696 - DNA, 16 bp, H. sapiens
ttttgcagggaaaatg

SEQ ID NO: 177697 - DNA, 16 bp, H. sapiens
ttttgcaggggttccc

SEQ ID NO: 177698 - DNA, 16 bp, H. sapiens
ttttgcagtgcagaag

SEQ ID NO: 177699 - DNA, 16 bp, H. sapiens
ttttgcagtgcctggt

SEQ ID NO: 177700 - DNA, 16 bp, H. sapiens
ttttgcatatatgttc

SEQ ID NO: 177701 - DNA, 16 bp, H. sapiens
ttttgcatatatttta

SEQ ID NO: 177702 - DNA, 16 bp, H. sapiens
ttttgcatatgaggaa

SEQ ID NO: 177703 - DNA, 16 bp, H. sapiens
ttttgcatatgtttgt

SEQ ID NO: 177704 - DNA, 16 bp, H. sapiens
ttttgcatattgatat

SEQ ID NO: 177705 - DNA, 16 bp, H. sapiens
ttttgcatattgattt

SEQ ID NO: 177706 - DNA, 16 bp, H. sapiens
ttttgcatcaacctaa

SEQ ID NO: 177707 - DNA, 16 bp, H. sapiens
ttttgcatcactataa

SEQ ID NO: 177708 - DNA, 16 bp, H. sapiens
ttttgcatctcaattt

SEQ ID NO: 177709 - DNA, 16 bp, H. sapiens
ttttgcatctttctca

SEQ ID NO: 177710 - DNA, 16 bp, H. sapiens
ttttgcatgtatttat

SEQ ID NO: 177711 - DNA, 16 bp, H. sapiens
ttttgcatgtgtatat

SEQ ID NO: 177712 - DNA, 16 bp, H. sapiens
ttttgcatgttttaaa

SEQ ID NO: 177713 - DNA, 16 bp, H. sapiens
ttttgcattaaaaata

SEQ ID NO: 177714 - DNA, 16 bp, H. sapiens
ttttgcattaaaagta

SEQ ID NO: 177715 - DNA, 16 bp, H. sapiens
ttttgcattaaatttt

SEQ ID NO: 177716 - DNA, 30 bp, H. sapiens
ttttgcattctttgagttcagtttaaagac

SEQ ID NO: 177717 - DNA, 16 bp, H. sapiens
ttttgcatttaaattt

SEQ ID NO: 177718 - DNA, 16 bp, H. sapiens
ttttgcatttatatta

SEQ ID NO: 177719 - DNA, 16 bp, H. sapiens
ttttgcatttatgtta

SEQ ID NO: 177720 - DNA, 16 bp, H. sapiens
ttttgcatttattaat

SEQ ID NO: 177721 - DNA, 16 bp, H. sapiens
ttttgcatttctaaaa

SEQ ID NO: 177722 - DNA, 16 bp, H. sapiens
ttttgcatttctgact

SEQ ID NO: 177723 - DNA, 16 bp, H. sapiens
ttttgcatttggtttg

SEQ ID NO: 177724 - DNA, 16 bp, H. sapiens
ttttgcattttaaaga

SEQ ID NO: 177725 - DNA, 16 bp, H. sapiens
ttttgcattttcaaat

SEQ ID NO: 177726 - DNA, 16 bp, H. sapiens
ttttgcattttcatat

SEQ ID NO: 177727 - DNA, 16 bp, H. sapiens
ttttgcatttttagtg

SEQ ID NO: 177728 - DNA, 16 bp, H. sapiens
ttttgcatttttggta

SEQ ID NO: 177729 - DNA, 16 bp, H. sapiens
ttttgcatttttgtag

SEQ ID NO: 177730 - DNA, 16 bp, H. sapiens
ttttgcatttttgtca

SEQ ID NO: 177731 - DNA, 16 bp, H. sapiens
ttttgccaaaaataaa

SEQ ID NO: 177732 - DNA, 16 bp, H. sapiens
ttttgccaattttaaa

SEQ ID NO: 177733 - DNA, 16 bp, H. sapiens
ttttgccagcatgcca

SEQ ID NO: 177734 - DNA, 16 bp, H. sapiens
ttttgccatatataaa

SEQ ID NO: 177735 - DNA, 16 bp, H. sapiens
ttttgccatgctgtcc

SEQ ID NO: 177736 - DNA, 16 bp, H. sapiens
ttttgccatgttgacc

SEQ ID NO: 177737 - DNA, 17 bp, H. sapiens
ttttgccatgttgacca

SEQ ID NO: 177738 - DNA, 16 bp, H. sapiens
ttttgccatgttggca

SEQ ID NO: 177739 - DNA, 17 bp, H. sapiens
ttttgccatgttggccg

SEQ ID NO: 177740 - DNA, 16 bp, H. sapiens
ttttgccattaaaagt

SEQ ID NO: 177741 - DNA, 16 bp, H. sapiens
ttttgccattaaaatt

SEQ ID NO: 177742 - DNA, 16 bp, H. sapiens
ttttgccattaaagta

SEQ ID NO: 177743 - DNA, 16 bp, H. sapiens
ttttgccattgaaagt

SEQ ID NO: 177744 - DNA, 23 bp, H. sapiens
ttttgcccattcagtatgatatt

SEQ ID NO: 177745 - DNA, 16 bp, H. sapiens
ttttgcccatttttaa

SEQ ID NO: 177746 - DNA, 16 bp, H. sapiens
ttttgcccccgccgcc

SEQ ID NO: 177747 - DNA, 16 bp, H. sapiens
ttttgcctaataaata

SEQ ID NO: 177748 - DNA, 16 bp, H. sapiens
ttttgcctcatatttt

SEQ ID NO: 177749 - DNA, 16 bp, H. sapiens
ttttgcctgttttgaa

SEQ ID NO: 177750 - DNA, 16 bp, H. sapiens
ttttgccttaaatatt

SEQ ID NO: 177751 - DNA, 16 bp, H. sapiens
ttttgcctttaaaaaa

SEQ ID NO: 177752 - DNA, 16 bp, H. sapiens
ttttgcctttgttgcc

SEQ ID NO: 177753 - DNA, 16 bp, H. sapiens
ttttgccttttggtaa

SEQ ID NO: 177754 - DNA, 16 bp, H. sapiens
ttttgcctttttaata

SEQ ID NO: 177755 - DNA, 16 bp, H. sapiens
ttttgctatgctttag

SEQ ID NO: 177756 - DNA, 16 bp, H. sapiens
ttttgctattacaaaa

SEQ ID NO: 177757 - DNA, 16 bp, H. sapiens
ttttgctattgatttg

SEQ ID NO: 177758 - DNA, 16 bp, H. sapiens
ttttgctattgtgaat

SEQ ID NO: 177759 - DNA, 16 bp, H. sapiens
ttttgctcaacattgt

SEQ ID NO: 177760 - DNA, 16 bp, H. sapiens
ttttgctcagttttta

SEQ ID NO: 177761 - DNA, 16 bp, H. sapiens
ttttgctctctgaaat

SEQ ID NO: 177762 - DNA, 16 bp, H. sapiens
ttttgctctttttaaa

SEQ ID NO: 177763 - DNA, 16 bp, H. sapiens
ttttgctgatgaagaa

SEQ ID NO: 177764 - DNA, 16 bp, H. sapiens
ttttgctgatggaggg

SEQ ID NO: 177765 - DNA, 16 bp, H. sapiens
ttttgctgattaaaaa

SEQ ID NO: 177766 - DNA, 17 bp, H. sapiens
ttttgctgcaattgctt

SEQ ID NO: 177767 - DNA, 16 bp, H. sapiens
ttttgctgcagaaata

SEQ ID NO: 177768 - DNA, 16 bp, H. sapiens
ttttgctgctgctgct

SEQ ID NO: 177769 - DNA, 16 bp, H. sapiens
ttttgctgctgtaaca

SEQ ID NO: 177770 - DNA, 16 bp, H. sapiens
ttttgctggatatact

SEQ ID NO: 177771 - DNA, 16 bp, H. sapiens
ttttgctgttataaat

SEQ ID NO: 177772 - DNA, 16 bp, H. sapiens
ttttgctgttgttgcc

SEQ ID NO: 177773 - DNA, 16 bp, H. sapiens
ttttgcttaaaataat

SEQ ID NO: 177774 - DNA, 16 bp, H. sapiens
ttttgcttaaaatgtt

SEQ ID NO: 177775 - DNA, 16 bp, H. sapiens
ttttgcttatccattt

SEQ ID NO: 177776 - DNA, 16 bp, H. sapiens
ttttgcttcctttaga

SEQ ID NO: 177777 - DNA, 16 bp, H. sapiens
ttttgcttctctctca

SEQ ID NO: 177778 - DNA, 16 bp, H. sapiens
ttttgcttctctgtat

SEQ ID NO: 177779 - DNA, 16 bp, H. sapiens
ttttgctttaaaatgt

SEQ ID NO: 177780 - DNA, 16 bp, H. sapiens
ttttgctttaaataaa

SEQ ID NO: 177781 - DNA, 16 bp, H. sapiens
ttttgctttcaacaaa

SEQ ID NO: 177782 - DNA, 16 bp, H. sapiens
ttttgctttccatctg

SEQ ID NO: 177783 - DNA, 16 bp, H. sapiens
ttttgcttttaaaaat

SEQ ID NO: 177784 - DNA, 16 bp, H. sapiens
ttttgcttttcaaaaa

SEQ ID NO: 177785 - DNA, 16 bp, H. sapiens
ttttgcttttcaaatt

SEQ ID NO: 177786 - DNA, 16 bp, H. sapiens
ttttgcttttcagatt

SEQ ID NO: 177787 - DNA, 16 bp, H. sapiens
ttttgcttttctcact

SEQ ID NO: 177788 - DNA, 16 bp, H. sapiens
ttttgctttttaaaat

SEQ ID NO: 177789 - DNA, 16 bp, H. sapiens
ttttgctttttctaga

SEQ ID NO: 177790 - DNA, 16 bp, H. sapiens
ttttggaaaaaaaatt

SEQ ID NO: 177791 - DNA, 16 bp, H. sapiens
ttttggaaaaaaattt

SEQ ID NO: 177792 - DNA, 16 bp, H. sapiens
ttttggaaaaacaaaa

SEQ ID NO: 177793 - DNA, 16 bp, H. sapiens
ttttggaaaaatattt

SEQ ID NO: 177794 - DNA, 16 bp, H. sapiens
ttttggaaaaatttca

SEQ ID NO: 177795 - DNA, 16 bp, H. sapiens
ttttggaaaacagtgt

SEQ ID NO: 177796 - DNA, 16 bp, H. sapiens
ttttggaaaagaagaa

SEQ ID NO: 177797 - DNA, 16 bp, H. sapiens
ttttggaaaagatttt

SEQ ID NO: 177798 - DNA, 16 bp, H. sapiens
ttttggaaaaggaaat

SEQ ID NO: 177799 - DNA, 16 bp, H. sapiens
ttttggaaaatacaaa

SEQ ID NO: 177800 - DNA, 16 bp, H. sapiens
ttttggaaaatagaaa

SEQ ID NO: 177801 - DNA, 16 bp, H. sapiens
ttttggaaaatataca

SEQ ID NO: 177802 - DNA, 16 bp, H. sapiens
ttttggaaaattaaaa

SEQ ID NO: 177803 - DNA, 16 bp, H. sapiens
ttttggaaaattctta

SEQ ID NO: 177804 - DNA, 16 bp, H. sapiens
ttttggaaagaagaaa

SEQ ID NO: 177805 - DNA, 16 bp, H. sapiens
ttttggaaagatattt

SEQ ID NO: 177806 - DNA, 16 bp, H. sapiens
ttttggaaagattttt

SEQ ID NO: 177807 - DNA, 16 bp, H. sapiens
ttttggaaagcagttt

SEQ ID NO: 177808 - DNA, 16 bp, H. sapiens
ttttggaaagtgatta

SEQ ID NO: 177809 - DNA, 16 bp, H. sapiens
ttttggaaataaaata

SEQ ID NO: 177810 - DNA, 16 bp, H. sapiens
ttttggaaatactttt

SEQ ID NO: 177811 - DNA, 16 bp, H. sapiens
ttttggaaatgaaaaa

SEQ ID NO: 177812 - DNA, 16 bp, H. sapiens
ttttggaacattttct

SEQ ID NO: 177813 - DNA, 16 bp, H. sapiens
ttttggaagaaatttt

SEQ ID NO: 177814 - DNA, 16 bp, H. sapiens
ttttggaagagaaaat

SEQ ID NO: 177815 - DNA, 16 bp, H. sapiens
ttttggaagaggaaaa

SEQ ID NO: 177816 - DNA, 16 bp, H. sapiens
ttttggaagagtttaa

SEQ ID NO: 177817 - DNA, 16 bp, H. sapiens
ttttggaagagtttca

SEQ ID NO: 177818 - DNA, 16 bp, H. sapiens
ttttggaagatatttt

SEQ ID NO: 177819 - DNA, 16 bp, H. sapiens
ttttggaagctggaag

SEQ ID NO: 177820 - DNA, 16 bp, H. sapiens
ttttggaagtttctat

SEQ ID NO: 177821 - DNA, 16 bp, H. sapiens
ttttggaataagtgtg

SEQ ID NO: 177822 - DNA, 16 bp, H. sapiens
ttttggaataataaaa

SEQ ID NO: 177823 - DNA, 16 bp, H. sapiens
ttttggaatacatgtg

SEQ ID NO: 177824 - DNA, 16 bp, H. sapiens
ttttggaatagtttca

SEQ ID NO: 177825 - DNA, 16 bp, H. sapiens
ttttggaatattttga

SEQ ID NO: 177826 - DNA, 16 bp, H. sapiens
ttttggaattttcatc

SEQ ID NO: 177827 - DNA, 16 bp, H. sapiens
ttttggaattttgata

SEQ ID NO: 177828 - DNA, 16 bp, H. sapiens
ttttggacatgttgag

SEQ ID NO: 177829 - DNA, 16 bp, H. sapiens
ttttggacttgcatgg

SEQ ID NO: 177830 - DNA, 16 bp, H. sapiens
ttttggactttctatt

SEQ ID NO: 177831 - DNA, 16 bp, H. sapiens
ttttggagaaaaaaaa

SEQ ID NO: 177832 - DNA, 16 bp, H. sapiens
ttttggagaaaaaaag

SEQ ID NO: 177833 - DNA, 16 bp, H. sapiens
ttttggagaaaaaaat

SEQ ID NO: 177834 - DNA, 16 bp, H. sapiens
ttttggagaaaaatta

SEQ ID NO: 177835 - DNA, 16 bp, H. sapiens
ttttggagaagaaaat

SEQ ID NO: 177836 - DNA, 16 bp, H. sapiens
ttttggagaatatttt

SEQ ID NO: 177837 - DNA, 16 bp, H. sapiens
ttttggagacagattc

SEQ ID NO: 177838 - DNA, 16 bp, H. sapiens
ttttggagagacagag

SEQ ID NO: 177839 - DNA, 16 bp, H. sapiens
ttttggagcatttctg

SEQ ID NO: 177840 - DNA, 16 bp, H. sapiens
ttttggagcattttga

SEQ ID NO: 177841 - DNA, 16 bp, H. sapiens
ttttggaggaagaaaa

SEQ ID NO: 177842 - DNA, 16 bp, H. sapiens
ttttggaggcagcctg

SEQ ID NO: 177843 - DNA, 16 bp, H. sapiens
ttttggaggctctagg

SEQ ID NO: 177844 - DNA, 16 bp, H. sapiens
ttttggaggctggaag

SEQ ID NO: 177845 - DNA, 16 bp, H. sapiens
ttttggaggctttgtt

SEQ ID NO: 177846 - DNA, 16 bp, H. sapiens
ttttggaggtgatgaa

SEQ ID NO: 177847 - DNA, 16 bp, H. sapiens
ttttggagtcctcagt

SEQ ID NO: 177848 - DNA, 18 bp, H. sapiens
ttttggagtccttgttgg

SEQ ID NO: 177849 - DNA, 16 bp, H. sapiens
ttttggagtggctggt

SEQ ID NO: 177850 - DNA, 16 bp, H. sapiens
ttttggagttttaaat

SEQ ID NO: 177851 - DNA, 16 bp, H. sapiens
ttttggataaaaataa

SEQ ID NO: 177852 - DNA, 16 bp, H. sapiens
ttttggataaaagcta

SEQ ID NO: 177853 - DNA, 16 bp, H. sapiens
ttttggataaaatatt

SEQ ID NO: 177854 - DNA, 16 bp, H. sapiens
ttttggataaaatgtt

SEQ ID NO: 177855 - DNA, 16 bp, H. sapiens
ttttggatattaacac

SEQ ID NO: 177856 - DNA, 16 bp, H. sapiens
ttttggatattaatct

SEQ ID NO: 177857 - DNA, 16 bp, H. sapiens
ttttggatttcagatt

SEQ ID NO: 177858 - DNA, 16 bp, H. sapiens
ttttggatttcttcct

SEQ ID NO: 177859 - DNA, 16 bp, H. sapiens
ttttggatttgggaat

SEQ ID NO: 177860 - DNA, 16 bp, H. sapiens
ttttggatttgggatg

SEQ ID NO: 177861 - DNA, 16 bp, H. sapiens
ttttggattttagcca

SEQ ID NO: 177862 - DNA, 16 bp, H. sapiens
ttttggcaaaaagaaa

SEQ ID NO: 177863 - DNA, 16 bp, H. sapiens
ttttggcaaatgtata

SEQ ID NO: 177864 - DNA, 16 bp, H. sapiens
ttttggcaattacaaa

SEQ ID NO: 177865 - DNA, 16 bp, H. sapiens
ttttggcaattacaac

SEQ ID NO: 177866 - DNA, 16 bp, H. sapiens
ttttggcagagacagg

SEQ ID NO: 177867 - DNA, 16 bp, H. sapiens
ttttggcatcttcatc

SEQ ID NO: 177868 - DNA, 16 bp, H. sapiens
ttttggcatcttcttc

SEQ ID NO: 177869 - DNA, 16 bp, H. sapiens
ttttggccaatttctc

SEQ ID NO: 177870 - DNA, 16 bp, H. sapiens
ttttggccagctcctt

SEQ ID NO: 177871 - DNA, 16 bp, H. sapiens
ttttggccattttctc

SEQ ID NO: 177872 - DNA, 16 bp, H. sapiens
ttttggcctaggattg

SEQ ID NO: 177873 - DNA, 16 bp, H. sapiens
ttttggctaagatcaa

SEQ ID NO: 177874 - DNA, 16 bp, H. sapiens
ttttggctattacaaa

SEQ ID NO: 177875 - DNA, 16 bp, H. sapiens
ttttggctgctgtgaa

SEQ ID NO: 177876 - DNA, 16 bp, H. sapiens
ttttggctgttgtgaa

SEQ ID NO: 177877 - DNA, 16 bp, H. sapiens
ttttggcttccctggg

SEQ ID NO: 177878 - DNA, 16 bp, H. sapiens
ttttggctttagttgc

SEQ ID NO: 177879 - DNA, 16 bp, H. sapiens
ttttggcttttgaatt

SEQ ID NO: 177880 - DNA, 16 bp, H. sapiens
ttttgggaaagggcta

SEQ ID NO: 177881 - DNA, 16 bp, H. sapiens
ttttgggaatagtttg

SEQ ID NO: 177882 - DNA, 16 bp, H. sapiens
ttttgggaggaaaaaa

SEQ ID NO: 177883 - DNA, 16 bp, H. sapiens
ttttgggaggacaagg

SEQ ID NO: 177884 - DNA, 16 bp, H. sapiens
ttttgggaggacacag

SEQ ID NO: 177885 - DNA, 16 bp, H. sapiens
ttttgggaggatgagg

SEQ ID NO: 177886 - DNA, 16 bp, H. sapiens
ttttgggaggcagaga

SEQ ID NO: 177887 - DNA, 16 bp, H. sapiens
ttttgggaggccaaag

SEQ ID NO: 177888 - DNA, 16 bp, H. sapiens
ttttgggaggccaaga

SEQ ID NO: 177889 - DNA, 16 bp, H. sapiens
ttttgggaggccaggg

SEQ ID NO: 177890 - DNA, 17 bp, H. sapiens
ttttgggaggccgagga

SEQ ID NO: 177891 - DNA, 16 bp, H. sapiens
ttttgggagggcgagg

SEQ ID NO: 177892 - DNA, 19 bp, H. sapiens
ttttgggctgagacagtgg

SEQ ID NO: 177893 - DNA, 16 bp, H. sapiens
ttttgggctgagatga

SEQ ID NO: 177894 - DNA, 16 bp, H. sapiens
ttttggggaaaaaaat

SEQ ID NO: 177895 - DNA, 16 bp, H. sapiens
ttttggggaagaaaaa

SEQ ID NO: 177896 - DNA, 16 bp, H. sapiens
ttttggggattaaatg

SEQ ID NO: 177897 - DNA, 16 bp, H. sapiens
ttttggggctgggcat

SEQ ID NO: 177898 - DNA, 16 bp, H. sapiens
ttttgggggaaaaaaa

SEQ ID NO: 177899 - DNA, 16 bp, H. sapiens
ttttgggggatggagt

SEQ ID NO: 177900 - DNA, 16 bp, H. sapiens
ttttggggggcagggg

SEQ ID NO: 177901 - DNA, 16 bp, H. sapiens
ttttggggtgataaaa

SEQ ID NO: 177902 - DNA, 16 bp, H. sapiens
ttttgggttaaatctg

SEQ ID NO: 177903 - DNA, 16 bp, H. sapiens
ttttgggttttcagtg

SEQ ID NO: 177904 - DNA, 16 bp, H. sapiens
ttttggtaccagggac

SEQ ID NO: 177905 - DNA, 16 bp, H. sapiens
ttttggtagaaacggg

SEQ ID NO: 177906 - DNA, 16 bp, H. sapiens
ttttggtagagaagga

SEQ ID NO: 177907 - DNA, 16 bp, H. sapiens
ttttggtagagatggg

SEQ ID NO: 177908 - DNA, 16 bp, H. sapiens
ttttggtatctgtggg

SEQ ID NO: 177909 - DNA, 16 bp, H. sapiens
ttttggtatttaaaaa

SEQ ID NO: 177910 - DNA, 16 bp, H. sapiens
ttttggtcaaagacat

SEQ ID NO: 177911 - DNA, 16 bp, H. sapiens
ttttggtgccttaatg

SEQ ID NO: 177912 - DNA, 16 bp, H. sapiens
ttttggtggagacggg

SEQ ID NO: 177913 - DNA, 20 bp, H. sapiens
ttttggtggagacggggttt

SEQ ID NO: 177914 - DNA, 16 bp, H. sapiens
ttttggtggagtcttt

SEQ ID NO: 177915 - DNA, 16 bp, H. sapiens
ttttggtgtcatgtct

SEQ ID NO: 177916 - DNA, 16 bp, H. sapiens
ttttggtgttttacac

SEQ ID NO: 177917 - DNA, 16 bp, H. sapiens
ttttggttattacaaa

SEQ ID NO: 177918 - DNA, 16 bp, H. sapiens
ttttggttattctggg

SEQ ID NO: 177919 - DNA, 16 bp, H. sapiens
ttttggttcagaaaat

SEQ ID NO: 177920 - DNA, 16 bp, H. sapiens
ttttggtttgatgtaa

SEQ ID NO: 177921 - DNA, 16 bp, H. sapiens
ttttggttttcaaatt

SEQ ID NO: 177922 - DNA, 16 bp, H. sapiens
ttttggttttgaaata

SEQ ID NO: 177923 - DNA, 16 bp, H. sapiens
ttttgtaaaacaaaat

SEQ ID NO: 177924 - DNA, 16 bp, H. sapiens
ttttgtaaaacatttt

SEQ ID NO: 177925 - DNA, 16 bp, H. sapiens
ttttgtaaaaggaaaa

SEQ ID NO: 177926 - DNA, 16 bp, H. sapiens
ttttgtaaaatgcatt

SEQ ID NO: 177927 - DNA, 16 bp, H. sapiens
ttttgtaaaatgttct

SEQ ID NO: 177928 - DNA, 16 bp, H. sapiens
ttttgtaaaattttct

SEQ ID NO: 177929 - DNA, 16 bp, H. sapiens
ttttgtaaacaaagtt

SEQ ID NO: 177930 - DNA, 16 bp, H. sapiens
ttttgtaaacattttt

SEQ ID NO: 177931 - DNA, 16 bp, H. sapiens
ttttgtaaactgcttt

SEQ ID NO: 177932 - DNA, 16 bp, H. sapiens
ttttgtaaagcatcaa

SEQ ID NO: 177933 - DNA, 16 bp, H. sapiens
ttttgtaaataaagat

SEQ ID NO: 177934 - DNA, 16 bp, H. sapiens
ttttgtaaatatctat

SEQ ID NO: 177935 - DNA, 16 bp, H. sapiens
ttttgtaaatatcttt

SEQ ID NO: 177936 - DNA, 16 bp, H. sapiens
ttttgtaaatctaaat

SEQ ID NO: 177937 - DNA, 16 bp, H. sapiens
ttttgtaaatctcttt

SEQ ID NO: 177938 - DNA, 16 bp, H. sapiens
ttttgtaaatgaaaaa

SEQ ID NO: 177939 - DNA, 16 bp, H. sapiens
ttttgtaaatgctttt

SEQ ID NO: 177940 - DNA, 16 bp, H. sapiens
ttttgtaaatgttctt

SEQ ID NO: 177941 - DNA, 16 bp, H. sapiens
ttttgtaagagaaaat

SEQ ID NO: 177942 - DNA, 16 bp, H. sapiens
ttttgtaagagaaatt

SEQ ID NO: 177943 - DNA, 16 bp, H. sapiens
ttttgtaataacattt

SEQ ID NO: 177944 - DNA, 16 bp, H. sapiens
ttttgtaatagtttca

SEQ ID NO: 177945 - DNA, 16 bp, H. sapiens
ttttgtaatcagaaaa

SEQ ID NO: 177946 - DNA, 16 bp, H. sapiens
ttttgtaatgaaaatg

SEQ ID NO: 177947 - DNA, 16 bp, H. sapiens
ttttgtaattatcatt

SEQ ID NO: 177948 - DNA, 16 bp, H. sapiens
ttttgtacaatatttt

SEQ ID NO: 177949 - DNA, 16 bp, H. sapiens
ttttgtacataaagtt

SEQ ID NO: 177950 - DNA, 16 bp, H. sapiens
ttttgtaccttttgta

SEQ ID NO: 177951 - DNA, 18 bp, H. sapiens
ttttgtacttttagtaga

SEQ ID NO: 177952 - DNA, 16 bp, H. sapiens
ttttgtagaaaaaaat

SEQ ID NO: 177953 - DNA, 16 bp, H. sapiens
ttttgtagaaacagaa

SEQ ID NO: 177954 - DNA, 16 bp, H. sapiens
ttttgtagaatatgca

SEQ ID NO: 177955 - DNA, 16 bp, H. sapiens
ttttgtagaatatgtg

SEQ ID NO: 177956 - DNA, 16 bp, H. sapiens
ttttgtagaatctgca

SEQ ID NO: 177957 - DNA, 16 bp, H. sapiens
ttttgtagaatgattt

SEQ ID NO: 177958 - DNA, 16 bp, H. sapiens
ttttgtagagacagga

SEQ ID NO: 177959 - DNA, 19 bp, H. sapiens
ttttgtagagacagggttt

SEQ ID NO: 177960 - DNA, 16 bp, H. sapiens
ttttgtagagactggg

SEQ ID NO: 177961 - DNA, 16 bp, H. sapiens
ttttgtagagataggg

SEQ ID NO: 177962 - DNA, 16 bp, H. sapiens
ttttgtagatattgac

SEQ ID NO: 177963 - DNA, 16 bp, H. sapiens
ttttgtagctactgta

SEQ ID NO: 177964 - DNA, 16 bp, H. sapiens
ttttgtaggaaaaaaa

SEQ ID NO: 177965 - DNA, 16 bp, H. sapiens
ttttgtaggagaaaaa

SEQ ID NO: 177966 - DNA, 16 bp, H. sapiens
ttttgtagtaattgtg

SEQ ID NO: 177967 - DNA, 16 bp, H. sapiens
ttttgtagtttcagct

SEQ ID NO: 177968 - DNA, 16 bp, H. sapiens
ttttgtagttttcagt

SEQ ID NO: 177969 - DNA, 16 bp, H. sapiens
ttttgtagtttttcag

SEQ ID NO: 177970 - DNA, 16 bp, H. sapiens
ttttgtataaaacaaa

SEQ ID NO: 177971 - DNA, 16 bp, H. sapiens
ttttgtataagatgta

SEQ ID NO: 177972 - DNA, 16 bp, H. sapiens
ttttgtataagtatgt

SEQ ID NO: 177973 - DNA, 16 bp, H. sapiens
ttttgtatacatttta

SEQ ID NO: 177974 - DNA, 16 bp, H. sapiens
ttttgtatcatgagac

SEQ ID NO: 177975 - DNA, 20 bp, H. sapiens
ttttgtatcctgagacttta

SEQ ID NO: 177976 - DNA, 18 bp, H. sapiens
ttttgtatctttagtaga

SEQ ID NO: 177977 - DNA, 16 bp, H. sapiens
ttttgtattctgagat

SEQ ID NO: 177978 - DNA, 20 bp, H. sapiens
ttttgtattcttagtagaga

SEQ ID NO: 177979 - DNA, 16 bp, H. sapiens
ttttgtatttagaaaa

SEQ ID NO: 177980 - DNA, 18 bp, H. sapiens
ttttgtatttctagtaga

SEQ ID NO: 177981 - DNA, 16 bp, H. sapiens
ttttgtatttggaaat

SEQ ID NO: 177982 - DNA, 16 bp, H. sapiens
ttttgtattttcagat

SEQ ID NO: 177983 - DNA, 20 bp, H. sapiens
ttttgtattttcagtagaaa

SEQ ID NO: 177984 - DNA, 20 bp, H. sapiens
ttttgtattttcagtagaga

SEQ ID NO: 177985 - DNA, 18 bp, H. sapiens
ttttgtattttcagtagg

SEQ ID NO: 177986 - DNA, 16 bp, H. sapiens
ttttgtattttcgtag

SEQ ID NO: 177987 - DNA, 16 bp, H. sapiens
ttttgtattttctaaa

SEQ ID NO: 177988 - DNA, 18 bp, H. sapiens
ttttgtatttttagcaga

SEQ ID NO: 177989 - DNA, 20 bp, H. sapiens
ttttgtatttttagcagaga

SEQ ID NO: 177990 - DNA, 16 bp, H. sapiens
ttttgtcaaaatttta

SEQ ID NO: 177991 - DNA, 16 bp, H. sapiens
ttttgtcaaatatatt

SEQ ID NO: 177992 - DNA, 16 bp, H. sapiens
ttttgtcaaatgtttt

SEQ ID NO: 177993 - DNA, 16 bp, H. sapiens
ttttgtcaaatttgtt

SEQ ID NO: 177994 - DNA, 16 bp, H. sapiens
ttttgtcacatttgct

SEQ ID NO: 177995 - DNA, 16 bp, H. sapiens
ttttgtcagatttgtt

SEQ ID NO: 177996 - DNA, 24 bp, H. sapiens
ttttgtcaggtttgtcaaagatca

SEQ ID NO: 177997 - DNA, 16 bp, H. sapiens
ttttgtcatagcagca

SEQ ID NO: 177998 - DNA, 16 bp, H. sapiens
ttttgtcatctgtaaa

SEQ ID NO: 177999 - DNA, 17 bp, H. sapiens
ttttgtcatgttggcca

SEQ ID NO: 178000 - DNA, 16 bp, H. sapiens
ttttgtcattttaaaa

SEQ ID NO: 178001 - DNA, 16 bp, H. sapiens
ttttgtccagttttct

SEQ ID NO: 178002 - DNA, 16 bp, H. sapiens
ttttgtccccccaaaa

SEQ ID NO: 178003 - DNA, 16 bp, H. sapiens
ttttgtccttcattct

SEQ ID NO: 178004 - DNA, 16 bp, H. sapiens
ttttgtccttttgata

SEQ ID NO: 178005 - DNA, 16 bp, H. sapiens
ttttgtctacttttgg

SEQ ID NO: 178006 - DNA, 16 bp, H. sapiens
ttttgtctgacataag

SEQ ID NO: 178007 - DNA, 16 bp, H. sapiens
ttttgtcttaaaattt

SEQ ID NO: 178008 - DNA, 16 bp, H. sapiens
ttttgtcttaataaaa

SEQ ID NO: 178009 - DNA, 16 bp, H. sapiens
ttttgtcttcaaattt

SEQ ID NO: 178010 - DNA, 16 bp, H. sapiens
ttttgtcttctgtgaa

SEQ ID NO: 178011 - DNA, 16 bp, H. sapiens
ttttgtcttcttctga

SEQ ID NO: 178012 - DNA, 16 bp, H. sapiens
ttttgtcttgcaaaac

SEQ ID NO: 178013 - DNA, 16 bp, H. sapiens
ttttgtctttaaatat

SEQ ID NO: 178014 - DNA, 16 bp, H. sapiens
ttttgtctttccatat

SEQ ID NO: 178015 - DNA, 16 bp, H. sapiens
ttttgtcttttgaaaa

SEQ ID NO: 178016 - DNA, 16 bp, H. sapiens
ttttgtctttttcaaa

SEQ ID NO: 178017 - DNA, 16 bp, H. sapiens
ttttgtgaaaaattaa

SEQ ID NO: 178018 - DNA, 16 bp, H. sapiens
ttttgtgaaaagatca

SEQ ID NO: 178019 - DNA, 16 bp, H. sapiens
ttttgtgaaagaaaga

SEQ ID NO: 178020 - DNA, 16 bp, H. sapiens
ttttgtgaaagagcag

SEQ ID NO: 178021 - DNA, 16 bp, H. sapiens
ttttgtgaaatcttta

SEQ ID NO: 178022 - DNA, 16 bp, H. sapiens
ttttgtgaaatgttta

SEQ ID NO: 178023 - DNA, 16 bp, H. sapiens
ttttgtgaagatcaaa

SEQ ID NO: 178024 - DNA, 16 bp, H. sapiens
ttttgtgaatagtgct

SEQ ID NO: 178025 - DNA, 16 bp, H. sapiens
ttttgtgagatggagt

SEQ ID NO: 178026 - DNA, 16 bp, H. sapiens
ttttgtgagctccaag

SEQ ID NO: 178027 - DNA, 16 bp, H. sapiens
ttttgtgatgagaaca

SEQ ID NO: 178028 - DNA, 16 bp, H. sapiens
ttttgtgattccattt

SEQ ID NO: 178029 - DNA, 16 bp, H. sapiens
ttttgtgatttaaaaa

SEQ ID NO: 178030 - DNA, 16 bp, H. sapiens
ttttgtgctgagaaca

SEQ ID NO: 178031 - DNA, 16 bp, H. sapiens
ttttgtgctttaaaat

SEQ ID NO: 178032 - DNA, 16 bp, H. sapiens
ttttgtgcttttaaaa

SEQ ID NO: 178033 - DNA, 16 bp, H. sapiens
ttttgtgcttttagta

SEQ ID NO: 178034 - DNA, 16 bp, H. sapiens
ttttgtggaaaaaaat

SEQ ID NO: 178035 - DNA, 16 bp, H. sapiens
ttttgtggaagaaaat

SEQ ID NO: 178036 - DNA, 16 bp, H. sapiens
ttttgtggaagataat

SEQ ID NO: 178037 - DNA, 16 bp, H. sapiens
ttttgtggaatgaaaa

SEQ ID NO: 178038 - DNA, 16 bp, H. sapiens
ttttgtggaatttgca

SEQ ID NO: 178039 - DNA, 16 bp, H. sapiens
ttttgtggagacaggt

SEQ ID NO: 178040 - DNA, 16 bp, H. sapiens
ttttgtggatatatat

SEQ ID NO: 178041 - DNA, 18 bp, H. sapiens
ttttgtggatcttcagtt

SEQ ID NO: 178042 - DNA, 16 bp, H. sapiens
ttttgtggatttatct

SEQ ID NO: 178043 - DNA, 16 bp, H. sapiens
ttttgtggcaccaaaa

SEQ ID NO: 178044 - DNA, 16 bp, H. sapiens
ttttgtggcccaggct

SEQ ID NO: 178045 - DNA, 16 bp, H. sapiens
ttttgtggcctgtgct

SEQ ID NO: 178046 - DNA, 16 bp, H. sapiens
ttttgtggctttttaa

SEQ ID NO: 178047 - DNA, 16 bp, H. sapiens
ttttgtgggccaggcc

SEQ ID NO: 178048 - DNA, 16 bp, H. sapiens
ttttgtggtagcaagt

SEQ ID NO: 178049 - DNA, 16 bp, H. sapiens
ttttgtggtgagaaca

SEQ ID NO: 178050 - DNA, 16 bp, H. sapiens
ttttgtggttttcagt

SEQ ID NO: 178051 - DNA, 16 bp, H. sapiens
ttttgtgtatgtctgt

SEQ ID NO: 178052 - DNA, 16 bp, H. sapiens
ttttgtgtattaatct

SEQ ID NO: 178053 - DNA, 16 bp, H. sapiens
ttttgtgtctggcttc

SEQ ID NO: 178054 - DNA, 16 bp, H. sapiens
ttttgtgtggacatgt

SEQ ID NO: 178055 - DNA, 16 bp, H. sapiens
ttttgtgtggctataa

SEQ ID NO: 178056 - DNA, 16 bp, H. sapiens
ttttgtgtgtacatat

SEQ ID NO: 178057 - DNA, 16 bp, H. sapiens
ttttgtgtgtgaacat

SEQ ID NO: 178058 - DNA, 16 bp, H. sapiens
ttttgtgtgtggtaag

SEQ ID NO: 178059 - DNA, 16 bp, H. sapiens
ttttgtgtgtgtaaaa

SEQ ID NO: 178060 - DNA, 16 bp, H. sapiens
ttttgtgtgttctgac

SEQ ID NO: 178061 - DNA, 16 bp, H. sapiens
ttttgtgtttctggta

SEQ ID NO: 178062 - DNA, 16 bp, H. sapiens
ttttgtgttttcagca

SEQ ID NO: 178063 - DNA, 16 bp, H. sapiens
ttttgttaaaaactaa

SEQ ID NO: 178064 - DNA, 16 bp, H. sapiens
ttttgttaaaactttt

SEQ ID NO: 178065 - DNA, 16 bp, H. sapiens
ttttgttaaaggcctt

SEQ ID NO: 178066 - DNA, 16 bp, H. sapiens
ttttgttaaataaatg

SEQ ID NO: 178067 - DNA, 16 bp, H. sapiens
ttttgttacttgggca

SEQ ID NO: 178068 - DNA, 16 bp, H. sapiens
ttttgttacttttaaa

SEQ ID NO: 178069 - DNA, 16 bp, H. sapiens
ttttgttaggaaaaaa

SEQ ID NO: 178070 - DNA, 16 bp, H. sapiens
ttttgttatggaaaat

SEQ ID NO: 178071 - DNA, 16 bp, H. sapiens
ttttgttattgcagcc

SEQ ID NO: 178072 - DNA, 16 bp, H. sapiens
ttttgttatttctaaa

SEQ ID NO: 178073 - DNA, 16 bp, H. sapiens
ttttgttcactgctgc

SEQ ID NO: 178074 - DNA, 16 bp, H. sapiens
ttttgttcactgctgt

SEQ ID NO: 178075 - DNA, 16 bp, H. sapiens
ttttgttcagttatgc

SEQ ID NO: 178076 - DNA, 16 bp, H. sapiens
ttttgttcataaatta

SEQ ID NO: 178077 - DNA, 16 bp, H. sapiens
ttttgttcatcaaaag

SEQ ID NO: 178078 - DNA, 16 bp, H. sapiens
ttttgttcattaaaaa

SEQ ID NO: 178079 - DNA, 16 bp, H. sapiens
ttttgttcattaaaat

SEQ ID NO: 178080 - DNA, 16 bp, H. sapiens
ttttgttcattgctgt

SEQ ID NO: 178081 - DNA, 16 bp, H. sapiens
ttttgttcattttaaa

SEQ ID NO: 178082 - DNA, 16 bp, H. sapiens
ttttgttctatatgaa

SEQ ID NO: 178083 - DNA, 16 bp, H. sapiens
ttttgttctattcagg

SEQ ID NO: 178084 - DNA, 16 bp, H. sapiens
ttttgttctctgatgt

SEQ ID NO: 178085 - DNA, 16 bp, H. sapiens
ttttgttctgtgtccc

SEQ ID NO: 178086 - DNA, 16 bp, H. sapiens
ttttgttgaaaataaa

SEQ ID NO: 178087 - DNA, 16 bp, H. sapiens
ttttgttgaaagcaaa

SEQ ID NO: 178088 - DNA, 16 bp, H. sapiens
ttttgttgaggaattt

SEQ ID NO: 178089 - DNA, 16 bp, H. sapiens
ttttgttgatgctttc

SEQ ID NO: 178090 - DNA, 16 bp, H. sapiens
ttttgttgcagttgct

SEQ ID NO: 178091 - DNA, 16 bp, H. sapiens
ttttgttgctcaagtt

SEQ ID NO: 178092 - DNA, 16 bp, H. sapiens
ttttgttggcagtttt

SEQ ID NO: 178093 - DNA, 16 bp, H. sapiens
ttttgttgtagttgct

SEQ ID NO: 178094 - DNA, 16 bp, H. sapiens
ttttgttgtggtaaaa

SEQ ID NO: 178095 - DNA, 16 bp, H. sapiens
ttttgttgttaaaaaa

SEQ ID NO: 178096 - DNA, 16 bp, H. sapiens
ttttgttgttgaaaaa

SEQ ID NO: 178097 - DNA, 16 bp, H. sapiens
ttttgttgtttaaaag

SEQ ID NO: 178098 - DNA, 16 bp, H. sapiens
ttttgtttaaaaagat

SEQ ID NO: 178099 - DNA, 16 bp, H. sapiens
ttttgtttaaaacatt

SEQ ID NO: 178100 - DNA, 16 bp, H. sapiens
ttttgtttacttaaaa

SEQ ID NO: 178101 - DNA, 16 bp, H. sapiens
ttttgtttacttaaat

SEQ ID NO: 178102 - DNA, 16 bp, H. sapiens
ttttgtttcaaaattt

SEQ ID NO: 178103 - DNA, 16 bp, H. sapiens
ttttgtttcaaataaa

SEQ ID NO: 178104 - DNA, 16 bp, H. sapiens
ttttgtttcacaattt

SEQ ID NO: 178105 - DNA, 16 bp, H. sapiens
ttttgtttcagaaata

SEQ ID NO: 178106 - DNA, 16 bp, H. sapiens
ttttgtttcagatatt

SEQ ID NO: 178107 - DNA, 16 bp, H. sapiens
ttttgtttcatatgaa

SEQ ID NO: 178108 - DNA, 16 bp, H. sapiens
ttttgtttcattgacc

SEQ ID NO: 178109 - DNA, 16 bp, H. sapiens
ttttgtttcattgatc

SEQ ID NO: 178110 - DNA, 16 bp, H. sapiens
ttttgtttccaaagtc

SEQ ID NO: 178111 - DNA, 16 bp, H. sapiens
ttttgtttccatttca

SEQ ID NO: 178112 - DNA, 16 bp, H. sapiens
ttttgtttctaaagaa

SEQ ID NO: 178113 - DNA, 16 bp, H. sapiens
ttttgtttctcttcca

SEQ ID NO: 178114 - DNA, 16 bp, H. sapiens
ttttgtttctggaaaa

SEQ ID NO: 178115 - DNA, 16 bp, H. sapiens
ttttgtttctttaaaa

SEQ ID NO: 178116 - DNA, 16 bp, H. sapiens
ttttgtttgatataag

SEQ ID NO: 178117 - DNA, 16 bp, H. sapiens
ttttgtttgctttgaa

SEQ ID NO: 178118 - DNA, 17 bp, H. sapiens
ttttgtttggctatgcc

SEQ ID NO: 178119 - DNA, 16 bp, H. sapiens
ttttgtttgtaaaatg

SEQ ID NO: 178120 - DNA, 16 bp, H. sapiens
ttttgtttgtctgaaa

SEQ ID NO: 178121 - DNA, 16 bp, H. sapiens
ttttgtttgtttcaaa

SEQ ID NO: 178122 - DNA, 16 bp, H. sapiens
ttttgttttaaaacaa

SEQ ID NO: 178123 - DNA, 16 bp, H. sapiens
ttttgttttaaagtct

SEQ ID NO: 178124 - DNA, 16 bp, H. sapiens
ttttgttttaaataca

SEQ ID NO: 178125 - DNA, 16 bp, H. sapiens
ttttgttttacagatg

SEQ ID NO: 178126 - DNA, 16 bp, H. sapiens
ttttgttttacagatt

SEQ ID NO: 178127 - DNA, 16 bp, H. sapiens
ttttgttttagatgga

SEQ ID NO: 178128 - DNA, 16 bp, H. sapiens
ttttgttttatacaaa

SEQ ID NO: 178129 - DNA, 16 bp, H. sapiens
ttttgttttcaaataa

SEQ ID NO: 178130 - DNA, 16 bp, H. sapiens
ttttgttttcaataaa

SEQ ID NO: 178131 - DNA, 16 bp, H. sapiens
ttttgttttcagaagt

SEQ ID NO: 178132 - DNA, 16 bp, H. sapiens
ttttgttttccaaaca

SEQ ID NO: 178133 - DNA, 16 bp, H. sapiens
ttttgttttccacttg

SEQ ID NO: 178134 - DNA, 16 bp, H. sapiens
ttttgttttctaaatg

SEQ ID NO: 178135 - DNA, 16 bp, H. sapiens
ttttgttttctaataa

SEQ ID NO: 178136 - DNA, 16 bp, H. sapiens
ttttgttttctgagac

SEQ ID NO: 178137 - DNA, 16 bp, H. sapiens
ttttgttttcttgaga

SEQ ID NO: 178138 - DNA, 16 bp, H. sapiens
ttttgttttgaaaaca

SEQ ID NO: 178139 - DNA, 16 bp, H. sapiens
ttttgttttgaaaagt

SEQ ID NO: 178140 - DNA, 16 bp, H. sapiens
ttttgttttgaaagat

SEQ ID NO: 178141 - DNA, 16 bp, H. sapiens
ttttgttttgagaaag

SEQ ID NO: 178142 - DNA, 16 bp, H. sapiens
ttttgttttgaggcag

SEQ ID NO: 178143 - DNA, 16 bp, H. sapiens
ttttgtttttaatgca

SEQ ID NO: 178144 - DNA, 16 bp, H. sapiens
ttttgtttttagaaga

SEQ ID NO: 178145 - DNA, 16 bp, H. sapiens
ttttgtttttcaaaaa

SEQ ID NO: 178146 - DNA, 16 bp, H. sapiens
ttttgtttttcaaaat

SEQ ID NO: 178147 - DNA, 16 bp, H. sapiens
ttttgtttttcaaagt

SEQ ID NO: 178148 - DNA, 16 bp, H. sapiens
ttttgtttttcacaaa

SEQ ID NO: 178149 - DNA, 16 bp, H. sapiens
ttttgtttttcataga

SEQ ID NO: 178150 - DNA, 16 bp, H. sapiens
ttttgtttttctcaaa

SEQ ID NO: 178151 - DNA, 16 bp, H. sapiens
ttttgtttttgagaga

SEQ ID NO: 178152 - DNA, 16 bp, H. sapiens
ttttgtttttgcagag

SEQ ID NO: 178153 - DNA, 16 bp, H. sapiens
ttttgtttttggacag

SEQ ID NO: 178154 - DNA, 16 bp, H. sapiens
ttttgtttttgggaca

SEQ ID NO: 178155 - DNA, 16 bp, H. sapiens
tttttaaaaaaaagac

SEQ ID NO: 178156 - DNA, 16 bp, H. sapiens
tttttaaaaaaacaag

SEQ ID NO: 178157 - DNA, 16 bp, H. sapiens
tttttaaaaaaacctg

SEQ ID NO: 178158 - DNA, 16 bp, H. sapiens
tttttaaaaaaactca

SEQ ID NO: 178159 - DNA, 16 bp, H. sapiens
tttttaaaaaaagagg

SEQ ID NO: 178160 - DNA, 16 bp, H. sapiens
tttttaaaaaaagctt

SEQ ID NO: 178161 - DNA, 16 bp, H. sapiens
tttttaaaaaaatgtc

SEQ ID NO: 178162 - DNA, 16 bp, H. sapiens
tttttaaaaaacaatg

SEQ ID NO: 178163 - DNA, 16 bp, H. sapiens
tttttaaaaaacagaa

SEQ ID NO: 178164 - DNA, 16 bp, H. sapiens
tttttaaaaaacagct

SEQ ID NO: 178165 - DNA, 16 bp, H. sapiens
tttttaaaaaacatga

SEQ ID NO: 178166 - DNA, 16 bp, H. sapiens
tttttaaaaaactgct

SEQ ID NO: 178167 - DNA, 16 bp, H. sapiens
tttttaaaaaactgtt

SEQ ID NO: 178168 - DNA, 16 bp, H. sapiens
tttttaaaaaaggaag

SEQ ID NO: 178169 - DNA, 16 bp, H. sapiens
tttttaaaaaaggaat

SEQ ID NO: 178170 - DNA, 16 bp, H. sapiens
tttttaaaaaaggatt

SEQ ID NO: 178171 - DNA, 16 bp, H. sapiens
tttttaaaaaaggtag

SEQ ID NO: 178172 - DNA, 16 bp, H. sapiens
tttttaaaaaaggtta

SEQ ID NO: 178173 - DNA, 16 bp, H. sapiens
tttttaaaaaaggttt

SEQ ID NO: 178174 - DNA, 16 bp, H. sapiens
tttttaaaaaagtgaa

SEQ ID NO: 178175 - DNA, 16 bp, H. sapiens
tttttaaaaaagtttc

SEQ ID NO: 178176 - DNA, 16 bp, H. sapiens
tttttaaaaaatagct

SEQ ID NO: 178177 - DNA, 16 bp, H. sapiens
tttttaaaaaatcacc

SEQ ID NO: 178178 - DNA, 16 bp, H. sapiens
tttttaaaaaatcctt

SEQ ID NO: 178179 - DNA, 16 bp, H. sapiens
tttttaaaaaatctga

SEQ ID NO: 178180 - DNA, 16 bp, H. sapiens
tttttaaaaaatgact

SEQ ID NO: 178181 - DNA, 16 bp, H. sapiens
tttttaaaaaatgaga

SEQ ID NO: 178182 - DNA, 16 bp, H. sapiens
tttttaaaaaatgcat

SEQ ID NO: 178183 - DNA, 16 bp, H. sapiens
tttttaaaaaatggag

SEQ ID NO: 178184 - DNA, 16 bp, H. sapiens
tttttaaaaaatggca

SEQ ID NO: 178185 - DNA, 16 bp, H. sapiens
tttttaaaaaatgtgt

SEQ ID NO: 178186 - DNA, 16 bp, H. sapiens
tttttaaaaaattccc

SEQ ID NO: 178187 - DNA, 16 bp, H. sapiens
tttttaaaaaattgct

SEQ ID NO: 178188 - DNA, 16 bp, H. sapiens
tttttaaaaacaggaa

SEQ ID NO: 178189 - DNA, 16 bp, H. sapiens
tttttaaaaacataca

SEQ ID NO: 178190 - DNA, 16 bp, H. sapiens
tttttaaaaaccacca

SEQ ID NO: 178191 - DNA, 16 bp, H. sapiens
tttttaaaaaccatat

SEQ ID NO: 178192 - DNA, 16 bp, H. sapiens
tttttaaaaactagat

SEQ ID NO: 178193 - DNA, 16 bp, H. sapiens
tttttaaaaactcaat

SEQ ID NO: 178194 - DNA, 16 bp, H. sapiens
tttttaaaaagaagga

SEQ ID NO: 178195 - DNA, 16 bp, H. sapiens
tttttaaaaagaagtc

SEQ ID NO: 178196 - DNA, 16 bp, H. sapiens
tttttaaaaagactca

SEQ ID NO: 178197 - DNA, 16 bp, H. sapiens
tttttaaaaagacttt

SEQ ID NO: 178198 - DNA, 16 bp, H. sapiens
tttttaaaaagagatg

SEQ ID NO: 178199 - DNA, 16 bp, H. sapiens
tttttaaaaagatcat

SEQ ID NO: 178200 - DNA, 16 bp, H. sapiens
tttttaaaaagcaaac

SEQ ID NO: 178201 - DNA, 16 bp, H. sapiens
tttttaaaaagcaaat

SEQ ID NO: 178202 - DNA, 16 bp, H. sapiens
tttttaaaaagcaata

SEQ ID NO: 178203 - DNA, 16 bp, H. sapiens
tttttaaaaagcacat

SEQ ID NO: 178204 - DNA, 17 bp, H. sapiens
tttttaaaaagcacttt

SEQ ID NO: 178205 - DNA, 16 bp, H. sapiens
tttttaaaaagcagtt

SEQ ID NO: 178206 - DNA, 16 bp, H. sapiens
tttttaaaaagcatat

SEQ ID NO: 178207 - DNA, 16 bp, H. sapiens
tttttaaaaagccaat

SEQ ID NO: 178208 - DNA, 16 bp, H. sapiens
tttttaaaaagctaaa

SEQ ID NO: 178209 - DNA, 16 bp, H. sapiens
tttttaaaaagctgtt

SEQ ID NO: 178210 - DNA, 16 bp, H. sapiens
tttttaaaaagctttt

SEQ ID NO: 178211 - DNA, 16 bp, H. sapiens
tttttaaaaaggaact

SEQ ID NO: 178212 - DNA, 16 bp, H. sapiens
tttttaaaaaggaatc

SEQ ID NO: 178213 - DNA, 16 bp, H. sapiens
tttttaaaaaggcatt

SEQ ID NO: 178214 - DNA, 16 bp, H. sapiens
tttttaaaaaggtcat

SEQ ID NO: 178215 - DNA, 16 bp, H. sapiens
tttttaaaaaggtgat

SEQ ID NO: 178216 - DNA, 16 bp, H. sapiens
tttttaaaaaggtgct

SEQ ID NO: 178217 - DNA, 16 bp, H. sapiens
tttttaaaaaggttat

SEQ ID NO: 178218 - DNA, 16 bp, H. sapiens
tttttaaaaagtaact

SEQ ID NO: 178219 - DNA, 16 bp, H. sapiens
tttttaaaaagtaaga

SEQ ID NO: 178220 - DNA, 16 bp, H. sapiens
tttttaaaaagtagct

SEQ ID NO: 178221 - DNA, 16 bp, H. sapiens
tttttaaaaagtcaaa

SEQ ID NO: 178222 - DNA, 16 bp, H. sapiens
tttttaaaaagtgaaa

SEQ ID NO: 178223 - DNA, 16 bp, H. sapiens
tttttaaaaagtgctt

SEQ ID NO: 178224 - DNA, 16 bp, H. sapiens
tttttaaaaagttgaa

SEQ ID NO: 178225 - DNA, 16 bp, H. sapiens
tttttaaaaagttttc

SEQ ID NO: 178226 - DNA, 16 bp, H. sapiens
tttttaaaaatcaaag

SEQ ID NO: 178227 - DNA, 16 bp, H. sapiens
tttttaaaaatcaaga

SEQ ID NO: 178228 - DNA, 16 bp, H. sapiens
tttttaaaaatcagac

SEQ ID NO: 178229 - DNA, 16 bp, H. sapiens
tttttaaaaatcatga

SEQ ID NO: 178230 - DNA, 16 bp, H. sapiens
tttttaaaaatcatgt

SEQ ID NO: 178231 - DNA, 16 bp, H. sapiens
tttttaaaaatccaat

SEQ ID NO: 178232 - DNA, 16 bp, H. sapiens
tttttaaaaatctcat

SEQ ID NO: 178233 - DNA, 16 bp, H. sapiens
tttttaaaaatctgtt

SEQ ID NO: 178234 - DNA, 16 bp, H. sapiens
tttttaaaaatgacat

SEQ ID NO: 178235 - DNA, 16 bp, H. sapiens
tttttaaaaatgaggt

SEQ ID NO: 178236 - DNA, 16 bp, H. sapiens
tttttaaaaatgcaaa

SEQ ID NO: 178237 - DNA, 16 bp, H. sapiens
tttttaaaaatgcatt

SEQ ID NO: 178238 - DNA, 16 bp, H. sapiens
tttttaaaaatgcttt

SEQ ID NO: 178239 - DNA, 16 bp, H. sapiens
tttttaaaaatggaaa

SEQ ID NO: 178240 - DNA, 16 bp, H. sapiens
tttttaaaaatggatt

SEQ ID NO: 178241 - DNA, 16 bp, H. sapiens
tttttaaaaattagct

SEQ ID NO: 178242 - DNA, 16 bp, H. sapiens
tttttaaaaattgcca

SEQ ID NO: 178243 - DNA, 16 bp, H. sapiens
tttttaaaaattgctt

SEQ ID NO: 178244 - DNA, 16 bp, H. sapiens
tttttaaaaattgtga

SEQ ID NO: 178245 - DNA, 16 bp, H. sapiens
tttttaaaacaaaaga

SEQ ID NO: 178246 - DNA, 16 bp, H. sapiens
tttttaaaacaaaatg

SEQ ID NO: 178247 - DNA, 16 bp, H. sapiens
tttttaaaacaagaaa

SEQ ID NO: 178248 - DNA, 16 bp, H. sapiens
tttttaaaaccaaatt

SEQ ID NO: 178249 - DNA, 16 bp, H. sapiens
tttttaaaacctgttt

SEQ ID NO: 178250 - DNA, 16 bp, H. sapiens
tttttaaaacgttttt

SEQ ID NO: 178251 - DNA, 16 bp, H. sapiens
tttttaaaactaacat

SEQ ID NO: 178252 - DNA, 16 bp, H. sapiens
tttttaaaactcagat

SEQ ID NO: 178253 - DNA, 16 bp, H. sapiens
tttttaaaactgtgaa

SEQ ID NO: 178254 - DNA, 16 bp, H. sapiens
tttttaaaactgtttt

SEQ ID NO: 178255 - DNA, 16 bp, H. sapiens
tttttaaaacttcagt

SEQ ID NO: 178256 - DNA, 16 bp, H. sapiens
tttttaaaacttgttt

SEQ ID NO: 178257 - DNA, 16 bp, H. sapiens
tttttaaaactttgaa

SEQ ID NO: 178258 - DNA, 16 bp, H. sapiens
tttttaaaacttttag

SEQ ID NO: 178259 - DNA, 16 bp, H. sapiens
tttttaaaacttttgt

SEQ ID NO: 178260 - DNA, 16 bp, H. sapiens
tttttaaaactttttg

SEQ ID NO: 178261 - DNA, 16 bp, H. sapiens
tttttaaaagaaaaca

SEQ ID NO: 178262 - DNA, 16 bp, H. sapiens
tttttaaaagaaacat

SEQ ID NO: 178263 - DNA, 16 bp, H. sapiens
tttttaaaagaaatgt

SEQ ID NO: 178264 - DNA, 16 bp, H. sapiens
tttttaaaagaagatg

SEQ ID NO: 178265 - DNA, 16 bp, H. sapiens
tttttaaaagaagcaa

SEQ ID NO: 178266 - DNA, 16 bp, H. sapiens
tttttaaaagacaagt

SEQ ID NO: 178267 - DNA, 16 bp, H. sapiens
tttttaaaagacaggt

SEQ ID NO: 178268 - DNA, 16 bp, H. sapiens
tttttaaaagacattt

SEQ ID NO: 178269 - DNA, 16 bp, H. sapiens
tttttaaaagactgaa

SEQ ID NO: 178270 - DNA, 16 bp, H. sapiens
tttttaaaagacttaa

SEQ ID NO: 178271 - DNA, 16 bp, H. sapiens
tttttaaaagagattt

SEQ ID NO: 178272 - DNA, 16 bp, H. sapiens
tttttaaaagataaac

SEQ ID NO: 178273 - DNA, 16 bp, H. sapiens
tttttaaaagataaag

SEQ ID NO: 178274 - DNA, 16 bp, H. sapiens
tttttaaaagatagaa

SEQ ID NO: 178275 - DNA, 16 bp, H. sapiens
tttttaaaagatgtca

SEQ ID NO: 178276 - DNA, 16 bp, H. sapiens
tttttaaaagattact

SEQ ID NO: 178277 - DNA, 16 bp, H. sapiens
tttttaaaagcaaaaa

SEQ ID NO: 178278 - DNA, 16 bp, H. sapiens
tttttaaaagcaaagt

SEQ ID NO: 178279 - DNA, 16 bp, H. sapiens
tttttaaaagcacatt

SEQ ID NO: 178280 - DNA, 16 bp, H. sapiens
tttttaaaaggaaact

SEQ ID NO: 178281 - DNA, 16 bp, H. sapiens
tttttaaaaggagaga

SEQ ID NO: 178282 - DNA, 16 bp, H. sapiens
tttttaaaaggcagag

SEQ ID NO: 178283 - DNA, 16 bp, H. sapiens
tttttaaaaggctcaa

SEQ ID NO: 178284 - DNA, 16 bp, H. sapiens
tttttaaaaggtgaaa

SEQ ID NO: 178285 - DNA, 16 bp, H. sapiens
tttttaaaagtaagtt

SEQ ID NO: 178286 - DNA, 16 bp, H. sapiens
tttttaaaagtacagt

SEQ ID NO: 178287 - DNA, 16 bp, H. sapiens
tttttaaaagtacttt

SEQ ID NO: 178288 - DNA, 16 bp, H. sapiens
tttttaaaagtctata

SEQ ID NO: 178289 - DNA, 16 bp, H. sapiens
tttttaaaagtttact

SEQ ID NO: 178290 - DNA, 16 bp, H. sapiens
tttttaaaagtttcaa

SEQ ID NO: 178291 - DNA, 16 bp, H. sapiens
tttttaaaagttttct

SEQ ID NO: 178292 - DNA, 16 bp, H. sapiens
tttttaaaataaggtt

SEQ ID NO: 178293 - DNA, 16 bp, H. sapiens
tttttaaaataatgct

SEQ ID NO: 178294 - DNA, 16 bp, H. sapiens
tttttaaaatatctgt

SEQ ID NO: 178295 - DNA, 16 bp, H. sapiens
tttttaaaatcactgt

SEQ ID NO: 178296 - DNA, 16 bp, H. sapiens
tttttaaaatcatgta

SEQ ID NO: 178297 - DNA, 16 bp, H. sapiens
tttttaaaatctaact

SEQ ID NO: 178298 - DNA, 16 bp, H. sapiens
tttttaaaatctagaa

SEQ ID NO: 178299 - DNA, 16 bp, H. sapiens
tttttaaaatgacact

SEQ ID NO: 178300 - DNA, 16 bp, H. sapiens
tttttaaaatgacaga

SEQ ID NO: 178301 - DNA, 16 bp, H. sapiens
tttttaaaatgatgca

SEQ ID NO: 178302 - DNA, 16 bp, H. sapiens
tttttaaaatgcagaa

SEQ ID NO: 178303 - DNA, 16 bp, H. sapiens
tttttaaaatgccttt

SEQ ID NO: 178304 - DNA, 16 bp, H. sapiens
tttttaaaatgctggt

SEQ ID NO: 178305 - DNA, 16 bp, H. sapiens
tttttaaaatggtaat

SEQ ID NO: 178306 - DNA, 16 bp, H. sapiens
tttttaaaatgtacaa

SEQ ID NO: 178307 - DNA, 16 bp, H. sapiens
tttttaaaatgtagaa

SEQ ID NO: 178308 - DNA, 16 bp, H. sapiens
tttttaaaatgtcaag

SEQ ID NO: 178309 - DNA, 16 bp, H. sapiens
tttttaaaatgtctta

SEQ ID NO: 178310 - DNA, 16 bp, H. sapiens
tttttaaaatgtgaat

SEQ ID NO: 178311 - DNA, 16 bp, H. sapiens
tttttaaaattagcca

SEQ ID NO: 178312 - DNA, 16 bp, H. sapiens
tttttaaaattctaca

SEQ ID NO: 178313 - DNA, 16 bp, H. sapiens
tttttaaaattctagt

SEQ ID NO: 178314 - DNA, 16 bp, H. sapiens
tttttaaaattgcatt

SEQ ID NO: 178315 - DNA, 16 bp, H. sapiens
tttttaaaatttaagc

SEQ ID NO: 178316 - DNA, 16 bp, H. sapiens
tttttaaacaaaacat

SEQ ID NO: 178317 - DNA, 16 bp, H. sapiens
tttttaaacaaaatct

SEQ ID NO: 178318 - DNA, 16 bp, H. sapiens
tttttaaacaaaatga

SEQ ID NO: 178319 - DNA, 16 bp, H. sapiens
tttttaaacaaagaag

SEQ ID NO: 178320 - DNA, 16 bp, H. sapiens
tttttaaacaaagaca

SEQ ID NO: 178321 - DNA, 16 bp, H. sapiens
tttttaaacaaagttt

SEQ ID NO: 178322 - DNA, 16 bp, H. sapiens
tttttaaacaaatgag

SEQ ID NO: 178323 - DNA, 16 bp, H. sapiens
tttttaaacaacaaca

SEQ ID NO: 178324 - DNA, 16 bp, H. sapiens
tttttaaacaagtttt

SEQ ID NO: 178325 - DNA, 16 bp, H. sapiens
tttttaaacactgtat

SEQ ID NO: 178326 - DNA, 16 bp, H. sapiens
tttttaaacagaaaat

SEQ ID NO: 178327 - DNA, 16 bp, H. sapiens
tttttaaacagaaaga

SEQ ID NO: 178328 - DNA, 16 bp, H. sapiens
tttttaaacagagtct

SEQ ID NO: 178329 - DNA, 16 bp, H. sapiens
tttttaaacagctttt

SEQ ID NO: 178330 - DNA, 16 bp, H. sapiens
tttttaaacataaatg

SEQ ID NO: 178331 - DNA, 16 bp, H. sapiens
tttttaaacatgaatt

SEQ ID NO: 178332 - DNA, 16 bp, H. sapiens
tttttaaacatgattt

SEQ ID NO: 178333 - DNA, 16 bp, H. sapiens
tttttaaacatgtttt

SEQ ID NO: 178334 - DNA, 16 bp, H. sapiens
tttttaaactatgaaa

SEQ ID NO: 178335 - DNA, 16 bp, H. sapiens
tttttaaactcttaaa

SEQ ID NO: 178336 - DNA, 16 bp, H. sapiens
tttttaaactgtttct

SEQ ID NO: 178337 - DNA, 16 bp, H. sapiens
tttttaaacttgaaaa

SEQ ID NO: 178338 - DNA, 16 bp, H. sapiens
tttttaaacttggttt

SEQ ID NO: 178339 - DNA, 16 bp, H. sapiens
tttttaaacttgtaaa

SEQ ID NO: 178340 - DNA, 16 bp, H. sapiens
tttttaaactttgctt

SEQ ID NO: 178341 - DNA, 16 bp, H. sapiens
tttttaaagaaaaact

SEQ ID NO: 178342 - DNA, 16 bp, H. sapiens
tttttaaagaaaaatg

SEQ ID NO: 178343 - DNA, 16 bp, H. sapiens
tttttaaagaaaacat

SEQ ID NO: 178344 - DNA, 16 bp, H. sapiens
tttttaaagaaaatct

SEQ ID NO: 178345 - DNA, 16 bp, H. sapiens
tttttaaagaaacaaa

SEQ ID NO: 178346 - DNA, 16 bp, H. sapiens
tttttaaagaaacagg

SEQ ID NO: 178347 - DNA, 16 bp, H. sapiens
tttttaaagaaacatc

SEQ ID NO: 178348 - DNA, 16 bp, H. sapiens
tttttaaagaaacatt

SEQ ID NO: 178349 - DNA, 16 bp, H. sapiens
tttttaaagaaagata

SEQ ID NO: 178350 - DNA, 16 bp, H. sapiens
tttttaaagaaagcat

SEQ ID NO: 178351 - DNA, 16 bp, H. sapiens
tttttaaagaaagttt

SEQ ID NO: 178352 - DNA, 16 bp, H. sapiens
tttttaaagaaatcct

SEQ ID NO: 178353 - DNA, 16 bp, H. sapiens
tttttaaagaaatcta

SEQ ID NO: 178354 - DNA, 16 bp, H. sapiens
tttttaaagaaatctt

SEQ ID NO: 178355 - DNA, 16 bp, H. sapiens
tttttaaagaaatgat

SEQ ID NO: 178356 - DNA, 16 bp, H. sapiens
tttttaaagaaatggc

SEQ ID NO: 178357 - DNA, 16 bp, H. sapiens
tttttaaagaaatggg

SEQ ID NO: 178358 - DNA, 16 bp, H. sapiens
tttttaaagaaatgtt

SEQ ID NO: 178359 - DNA, 16 bp, H. sapiens
tttttaaagaacaaag

SEQ ID NO: 178360 - DNA, 16 bp, H. sapiens
tttttaaagaagtata

SEQ ID NO: 178361 - DNA, 16 bp, H. sapiens
tttttaaagaatgaag

SEQ ID NO: 178362 - DNA, 16 bp, H. sapiens
tttttaaagacaataa

SEQ ID NO: 178363 - DNA, 16 bp, H. sapiens
tttttaaagacagaaa

SEQ ID NO: 178364 - DNA, 16 bp, H. sapiens
tttttaaagacagaga

SEQ ID NO: 178365 - DNA, 16 bp, H. sapiens
tttttaaagacatttt

SEQ ID NO: 178366 - DNA, 16 bp, H. sapiens
tttttaaagagaaaac

SEQ ID NO: 178367 - DNA, 16 bp, H. sapiens
tttttaaagagaagtt

SEQ ID NO: 178368 - DNA, 16 bp, H. sapiens
tttttaaagagagaaa

SEQ ID NO: 178369 - DNA, 16 bp, H. sapiens
tttttaaagagttgag

SEQ ID NO: 178370 - DNA, 16 bp, H. sapiens
tttttaaagatacagt

SEQ ID NO: 178371 - DNA, 16 bp, H. sapiens
tttttaaagatctttt

SEQ ID NO: 178372 - DNA, 16 bp, H. sapiens
tttttaaagatgaaaa

SEQ ID NO: 178373 - DNA, 16 bp, H. sapiens
tttttaaagatgagaa

SEQ ID NO: 178374 - DNA, 16 bp, H. sapiens
tttttaaagatgagat

SEQ ID NO: 178375 - DNA, 16 bp, H. sapiens
tttttaaagatgtgaa

SEQ ID NO: 178376 - DNA, 16 bp, H. sapiens
tttttaaagattaaca

SEQ ID NO: 178377 - DNA, 16 bp, H. sapiens
tttttaaagcaaaatt

SEQ ID NO: 178378 - DNA, 16 bp, H. sapiens
tttttaaagcaacaaa

SEQ ID NO: 178379 - DNA, 16 bp, H. sapiens
tttttaaagcaatttt

SEQ ID NO: 178380 - DNA, 16 bp, H. sapiens
tttttaaagcacttta

SEQ ID NO: 178381 - DNA, 16 bp, H. sapiens
tttttaaagcactttt

SEQ ID NO: 178382 - DNA, 16 bp, H. sapiens
tttttaaagcagcttt

SEQ ID NO: 178383 - DNA, 16 bp, H. sapiens
tttttaaagcattctt

SEQ ID NO: 178384 - DNA, 16 bp, H. sapiens
tttttaaagccacaaa

SEQ ID NO: 178385 - DNA, 16 bp, H. sapiens
tttttaaagccctttt

SEQ ID NO: 178386 - DNA, 16 bp, H. sapiens
tttttaaagctaaaaa

SEQ ID NO: 178387 - DNA, 16 bp, H. sapiens
tttttaaagctcccca

SEQ ID NO: 178388 - DNA, 16 bp, H. sapiens
tttttaaagctgtttt

SEQ ID NO: 178389 - DNA, 16 bp, H. sapiens
tttttaaagcttaaat

SEQ ID NO: 178390 - DNA, 16 bp, H. sapiens
tttttaaagcttcttt

SEQ ID NO: 178391 - DNA, 16 bp, H. sapiens
tttttaaagctttatt

SEQ ID NO: 178392 - DNA, 16 bp, H. sapiens
tttttaaaggaaaaat

SEQ ID NO: 178393 - DNA, 16 bp, H. sapiens
tttttaaaggaaaata

SEQ ID NO: 178394 - DNA, 16 bp, H. sapiens
tttttaaaggaagatt

SEQ ID NO: 178395 - DNA, 16 bp, H. sapiens
tttttaaaggaataaa

SEQ ID NO: 178396 - DNA, 16 bp, H. sapiens
tttttaaaggaatatt

SEQ ID NO: 178397 - DNA, 16 bp, H. sapiens
tttttaaaggataaaa

SEQ ID NO: 178398 - DNA, 16 bp, H. sapiens
tttttaaaggcagaga

SEQ ID NO: 178399 - DNA, 16 bp, H. sapiens
tttttaaaggctaaat

SEQ ID NO: 178400 - DNA, 16 bp, H. sapiens
tttttaaagggaaaaa

SEQ ID NO: 178401 - DNA, 16 bp, H. sapiens
tttttaaagggaaaca

SEQ ID NO: 178402 - DNA, 16 bp, H. sapiens
tttttaaaggtaaaat

SEQ ID NO: 178403 - DNA, 16 bp, H. sapiens
tttttaaagtaaactt

SEQ ID NO: 178404 - DNA, 16 bp, H. sapiens
tttttaaagtaaatgt

SEQ ID NO: 178405 - DNA, 16 bp, H. sapiens
tttttaaagtaataag

SEQ ID NO: 178406 - DNA, 16 bp, H. sapiens
tttttaaagtactttc

SEQ ID NO: 178407 - DNA, 16 bp, H. sapiens
tttttaaagtagaaga

SEQ ID NO: 178408 - DNA, 16 bp, H. sapiens
tttttaaagtattgaa

SEQ ID NO: 178409 - DNA, 16 bp, H. sapiens
tttttaaagtcacttt

SEQ ID NO: 178410 - DNA, 16 bp, H. sapiens
tttttaaagtcataaa

SEQ ID NO: 178411 - DNA, 16 bp, H. sapiens
tttttaaagtctgaaa

SEQ ID NO: 178412 - DNA, 16 bp, H. sapiens
tttttaaagtcttctt

SEQ ID NO: 178413 - DNA, 16 bp, H. sapiens
tttttaaagtgcattt

SEQ ID NO: 178414 - DNA, 16 bp, H. sapiens
tttttaaagtgctttt

SEQ ID NO: 178415 - DNA, 16 bp, H. sapiens
tttttaaagttacaaa

SEQ ID NO: 178416 - DNA, 16 bp, H. sapiens
tttttaaagttcccag

SEQ ID NO: 178417 - DNA, 16 bp, H. sapiens
tttttaaagttttcct

SEQ ID NO: 178418 - DNA, 16 bp, H. sapiens
tttttaaagttttgca

SEQ ID NO: 178419 - DNA, 16 bp, H. sapiens
tttttaaataaaagga

SEQ ID NO: 178420 - DNA, 16 bp, H. sapiens
tttttaaataaagaac

SEQ ID NO: 178421 - DNA, 16 bp, H. sapiens
tttttaaataaagatg

SEQ ID NO: 178422 - DNA, 16 bp, H. sapiens
tttttaaataaaggta

SEQ ID NO: 178423 - DNA, 16 bp, H. sapiens
tttttaaataaatcca

SEQ ID NO: 178424 - DNA, 16 bp, H. sapiens
tttttaaataaatgag

SEQ ID NO: 178425 - DNA, 16 bp, H. sapiens
tttttaaataacagaa

SEQ ID NO: 178426 - DNA, 16 bp, H. sapiens
tttttaaataagcatt

SEQ ID NO: 178427 - DNA, 16 bp, H. sapiens
tttttaaataatagtc

SEQ ID NO: 178428 - DNA, 16 bp, H. sapiens
tttttaaataatgcaa

SEQ ID NO: 178429 - DNA, 16 bp, H. sapiens
tttttaaatacagagt

SEQ ID NO: 178430 - DNA, 16 bp, H. sapiens
tttttaaatacaggaa

SEQ ID NO: 178431 - DNA, 16 bp, H. sapiens
tttttaaatactagaa

SEQ ID NO: 178432 - DNA, 16 bp, H. sapiens
tttttaaatacttgtt

SEQ ID NO: 178433 - DNA, 16 bp, H. sapiens
tttttaaataggaaat

SEQ ID NO: 178434 - DNA, 16 bp, H. sapiens
tttttaaatagggaat

SEQ ID NO: 178435 - DNA, 16 bp, H. sapiens
tttttaaatattgctt

SEQ ID NO: 178436 - DNA, 16 bp, H. sapiens
tttttaaatcaaagaa

SEQ ID NO: 178437 - DNA, 16 bp, H. sapiens
tttttaaatcaacaaa

SEQ ID NO: 178438 - DNA, 16 bp, H. sapiens
tttttaaatcagattg

SEQ ID NO: 178439 - DNA, 16 bp, H. sapiens
tttttaaatcagttaa

SEQ ID NO: 178440 - DNA, 16 bp, H. sapiens
tttttaaatcagttta

SEQ ID NO: 178441 - DNA, 16 bp, H. sapiens
tttttaaatcatgttt

SEQ ID NO: 178442 - DNA, 16 bp, H. sapiens
tttttaaatcatttgt

SEQ ID NO: 178443 - DNA, 16 bp, H. sapiens
tttttaaatccaaata

SEQ ID NO: 178444 - DNA, 16 bp, H. sapiens
tttttaaatccattca

SEQ ID NO: 178445 - DNA, 16 bp, H. sapiens
tttttaaatcctaaaa

SEQ ID NO: 178446 - DNA, 16 bp, H. sapiens
tttttaaatctgaatt

SEQ ID NO: 178447 - DNA, 16 bp, H. sapiens
tttttaaatgaaaatg

SEQ ID NO: 178448 - DNA, 16 bp, H. sapiens
tttttaaatgaaagaa

SEQ ID NO: 178449 - DNA, 16 bp, H. sapiens
tttttaaatgaagaaa

SEQ ID NO: 178450 - DNA, 16 bp, H. sapiens
tttttaaatgaaggta

SEQ ID NO: 178451 - DNA, 16 bp, H. sapiens
tttttaaatgacatta

SEQ ID NO: 178452 - DNA, 16 bp, H. sapiens
tttttaaatgaccaaa

SEQ ID NO: 178453 - DNA, 16 bp, H. sapiens
tttttaaatgactaat

SEQ ID NO: 178454 - DNA, 16 bp, H. sapiens
tttttaaatgacttct

SEQ ID NO: 178455 - DNA, 16 bp, H. sapiens
tttttaaatgatgaaa

SEQ ID NO: 178456 - DNA, 16 bp, H. sapiens
tttttaaatgatgtaa

SEQ ID NO: 178457 - DNA, 16 bp, H. sapiens
tttttaaatgcaaata

SEQ ID NO: 178458 - DNA, 16 bp, H. sapiens
tttttaaatgcaagtt

SEQ ID NO: 178459 - DNA, 16 bp, H. sapiens
tttttaaatgccattt

SEQ ID NO: 178460 - DNA, 16 bp, H. sapiens
tttttaaatgcctaaa

SEQ ID NO: 178461 - DNA, 16 bp, H. sapiens
tttttaaatgctgaaa

SEQ ID NO: 178462 - DNA, 16 bp, H. sapiens
tttttaaatggaaaag

SEQ ID NO: 178463 - DNA, 16 bp, H. sapiens
tttttaaatggaaaca

SEQ ID NO: 178464 - DNA, 16 bp, H. sapiens
tttttaaatggaaata

SEQ ID NO: 178465 - DNA, 16 bp, H. sapiens
tttttaaatggacaaa

SEQ ID NO: 178466 - DNA, 16 bp, H. sapiens
tttttaaatggctatt

SEQ ID NO: 178467 - DNA, 16 bp, H. sapiens
tttttaaatggttggg

SEQ ID NO: 178468 - DNA, 16 bp, H. sapiens
tttttaaatgtaaaag

SEQ ID NO: 178469 - DNA, 16 bp, H. sapiens
tttttaaatgtacaat

SEQ ID NO: 178470 - DNA, 16 bp, H. sapiens
tttttaaatgtacaga

SEQ ID NO: 178471 - DNA, 16 bp, H. sapiens
tttttaaatgtagaaa

SEQ ID NO: 178472 - DNA, 16 bp, H. sapiens
tttttaaatgtattct

SEQ ID NO: 178473 - DNA, 16 bp, H. sapiens
tttttaaatgtcagtt

SEQ ID NO: 178474 - DNA, 16 bp, H. sapiens
tttttaaatgtctata

SEQ ID NO: 178475 - DNA, 16 bp, H. sapiens
tttttaaatgtgaaaa

SEQ ID NO: 178476 - DNA, 16 bp, H. sapiens
tttttaaatgttcatt

SEQ ID NO: 178477 - DNA, 16 bp, H. sapiens
tttttaaatgttgaac

SEQ ID NO: 178478 - DNA, 16 bp, H. sapiens
tttttaaattaaccat

SEQ ID NO: 178479 - DNA, 16 bp, H. sapiens
tttttaaattacccag

SEQ ID NO: 178480 - DNA, 16 bp, H. sapiens
tttttaaattactgtt

SEQ ID NO: 178481 - DNA, 16 bp, H. sapiens
tttttaaattattgct

SEQ ID NO: 178482 - DNA, 16 bp, H. sapiens
tttttaaattctggaa

SEQ ID NO: 178483 - DNA, 16 bp, H. sapiens
tttttaaattgacata

SEQ ID NO: 178484 - DNA, 16 bp, H. sapiens
tttttaaattgcattg

SEQ ID NO: 178485 - DNA, 16 bp, H. sapiens
tttttaaattgctctt

SEQ ID NO: 178486 - DNA, 16 bp, H. sapiens
tttttaaattgtcaca

SEQ ID NO: 178487 - DNA, 16 bp, H. sapiens
tttttaaatttcccag

SEQ ID NO: 178488 - DNA, 16 bp, H. sapiens
tttttaaatttggaga

SEQ ID NO: 178489 - DNA, 16 bp, H. sapiens
tttttaaattttcagt

SEQ ID NO: 178490 - DNA, 16 bp, H. sapiens
tttttaacaaaaagaa

SEQ ID NO: 178491 - DNA, 16 bp, H. sapiens
tttttaacaaagaaaa

SEQ ID NO: 178492 - DNA, 16 bp, H. sapiens
tttttaacaaattgtg

SEQ ID NO: 178493 - DNA, 16 bp, H. sapiens
tttttaacatgaaaaa

SEQ ID NO: 178494 - DNA, 16 bp, H. sapiens
tttttaaccaaaatgt

SEQ ID NO: 178495 - DNA, 16 bp, H. sapiens
tttttaacccatttat

SEQ ID NO: 178496 - DNA, 16 bp, H. sapiens
tttttaactaaaatgt

SEQ ID NO: 178497 - DNA, 16 bp, H. sapiens
tttttaactgaagata

SEQ ID NO: 178498 - DNA, 16 bp, H. sapiens
tttttaactgggttat

SEQ ID NO: 178499 - DNA, 16 bp, H. sapiens
tttttaactgttgttg

SEQ ID NO: 178500 - DNA, 16 bp, H. sapiens
tttttaacttaaagaa

SEQ ID NO: 178501 - DNA, 16 bp, H. sapiens
tttttaacttgtaaaa

SEQ ID NO: 178502 - DNA, 16 bp, H. sapiens
tttttaactttgatga

SEQ ID NO: 178503 - DNA, 16 bp, H. sapiens
tttttaactttgtaaa

SEQ ID NO: 178504 - DNA, 16 bp, H. sapiens
tttttaactttgtata

SEQ ID NO: 178505 - DNA, 16 bp, H. sapiens
tttttaagaaaaaaac

SEQ ID NO: 178506 - DNA, 16 bp, H. sapiens
tttttaagaaaacatt

SEQ ID NO: 178507 - DNA, 16 bp, H. sapiens
tttttaagaaaagata

SEQ ID NO: 178508 - DNA, 16 bp, H. sapiens
tttttaagaaacaaaa

SEQ ID NO: 178509 - DNA, 16 bp, H. sapiens
tttttaagaaaggaag

SEQ ID NO: 178510 - DNA, 16 bp, H. sapiens
tttttaagaaatgatt

SEQ ID NO: 178511 - DNA, 16 bp, H. sapiens
tttttaagaacaaaat

SEQ ID NO: 178512 - DNA, 16 bp, H. sapiens
tttttaagaacagaaa

SEQ ID NO: 178513 - DNA, 16 bp, H. sapiens
tttttaagaagaaaat

SEQ ID NO: 178514 - DNA, 16 bp, H. sapiens
tttttaagaagaaaca

SEQ ID NO: 178515 - DNA, 16 bp, H. sapiens
tttttaagaagagttt

SEQ ID NO: 178516 - DNA, 16 bp, H. sapiens
tttttaagaagtagaa

SEQ ID NO: 178517 - DNA, 16 bp, H. sapiens
tttttaagaatgttga

SEQ ID NO: 178518 - DNA, 16 bp, H. sapiens
tttttaagaatttctt

SEQ ID NO: 178519 - DNA, 16 bp, H. sapiens
tttttaagacagactt

SEQ ID NO: 178520 - DNA, 16 bp, H. sapiens
tttttaagactatttt

SEQ ID NO: 178521 - DNA, 16 bp, H. sapiens
tttttaagagaaagaa

SEQ ID NO: 178522 - DNA, 16 bp, H. sapiens
tttttaagagactggg

SEQ ID NO: 178523 - DNA, 16 bp, H. sapiens
tttttaagagatggag

SEQ ID NO: 178524 - DNA, 16 bp, H. sapiens
tttttaagagatggga

SEQ ID NO: 178525 - DNA, 16 bp, H. sapiens
tttttaagaggaaaaa

SEQ ID NO: 178526 - DNA, 16 bp, H. sapiens
tttttaagagtaaatt

SEQ ID NO: 178527 - DNA, 16 bp, H. sapiens
tttttaagagtataaa

SEQ ID NO: 178528 - DNA, 16 bp, H. sapiens
tttttaagagtttaaa

SEQ ID NO: 178529 - DNA, 16 bp, H. sapiens
tttttaagatgaaaat

SEQ ID NO: 178530 - DNA, 16 bp, H. sapiens
tttttaagatggaaaa

SEQ ID NO: 178531 - DNA, 16 bp, H. sapiens
tttttaagatttatcc

SEQ ID NO: 178532 - DNA, 16 bp, H. sapiens
tttttaagcactaaaa

SEQ ID NO: 178533 - DNA, 16 bp, H. sapiens
tttttaaggaaaaaga

SEQ ID NO: 178534 - DNA, 16 bp, H. sapiens
tttttaaggaaaagaa

SEQ ID NO: 178535 - DNA, 16 bp, H. sapiens
tttttaaggaaaatgt

SEQ ID NO: 178536 - DNA, 16 bp, H. sapiens
tttttaaggaaacatt

SEQ ID NO: 178537 - DNA, 16 bp, H. sapiens
tttttaaggaagaaaa

SEQ ID NO: 178538 - DNA, 16 bp, H. sapiens
tttttaaggaagtttt

SEQ ID NO: 178539 - DNA, 16 bp, H. sapiens
tttttaaggaatagaa

SEQ ID NO: 178540 - DNA, 16 bp, H. sapiens
tttttaaggattttga

SEQ ID NO: 178541 - DNA, 16 bp, H. sapiens
tttttaaggctaaaaa

SEQ ID NO: 178542 - DNA, 16 bp, H. sapiens
tttttaaggcttttga

SEQ ID NO: 178543 - DNA, 16 bp, H. sapiens
tttttaagtaaagaaa

SEQ ID NO: 178544 - DNA, 16 bp, H. sapiens
tttttaagtaacttaa

SEQ ID NO: 178545 - DNA, 16 bp, H. sapiens
tttttaagtacaaaaa

SEQ ID NO: 178546 - DNA, 16 bp, H. sapiens
tttttaagtatttcaa

SEQ ID NO: 178547 - DNA, 16 bp, H. sapiens
tttttaagtgagaaaa

SEQ ID NO: 178548 - DNA, 16 bp, H. sapiens
tttttaagtgataaaa

SEQ ID NO: 178549 - DNA, 16 bp, H. sapiens
tttttaagtgcttaaa

SEQ ID NO: 178550 - DNA, 16 bp, H. sapiens
tttttaagtggagaaa

SEQ ID NO: 178551 - DNA, 16 bp, H. sapiens
tttttaagtgtacata

SEQ ID NO: 178552 - DNA, 16 bp, H. sapiens
tttttaagttacaaat

SEQ ID NO: 178553 - DNA, 16 bp, H. sapiens
tttttaagttccttgt

SEQ ID NO: 178554 - DNA, 16 bp, H. sapiens
tttttaagttgacaaa

SEQ ID NO: 178555 - DNA, 16 bp, H. sapiens
tttttaagtttagaaa

SEQ ID NO: 178556 - DNA, 16 bp, H. sapiens
tttttaagtttcaaat

SEQ ID NO: 178557 - DNA, 16 bp, H. sapiens
tttttaataaatgaag

SEQ ID NO: 178558 - DNA, 16 bp, H. sapiens
tttttaataaatgttc

SEQ ID NO: 178559 - DNA, 16 bp, H. sapiens
tttttaataacaaaga

SEQ ID NO: 178560 - DNA, 16 bp, H. sapiens
tttttaataattacca

SEQ ID NO: 178561 - DNA, 16 bp, H. sapiens
tttttaatactgtatt

SEQ ID NO: 178562 - DNA, 16 bp, H. sapiens
tttttaatagaaatga

SEQ ID NO: 178563 - DNA, 16 bp, H. sapiens
tttttaatagagactg

SEQ ID NO: 178564 - DNA, 16 bp, H. sapiens
tttttaatagagaggg

SEQ ID NO: 178565 - DNA, 16 bp, H. sapiens
tttttaatatcaaaag

SEQ ID NO: 178566 - DNA, 16 bp, H. sapiens
tttttaatatctgtat

SEQ ID NO: 178567 - DNA, 16 bp, H. sapiens
tttttaatcaagaaaa

SEQ ID NO: 178568 - DNA, 16 bp, H. sapiens
tttttaatcataaaag

SEQ ID NO: 178569 - DNA, 16 bp, H. sapiens
tttttaatcatgaaat

SEQ ID NO: 178570 - DNA, 16 bp, H. sapiens
tttttaatcatgaata

SEQ ID NO: 178571 - DNA, 16 bp, H. sapiens
tttttaatccaatctg

SEQ ID NO: 178572 - DNA, 16 bp, H. sapiens
tttttaatctctaaaa

SEQ ID NO: 178573 - DNA, 16 bp, H. sapiens
tttttaatctgtaaaa

SEQ ID NO: 178574 - DNA, 16 bp, H. sapiens
tttttaatcttagaaa

SEQ ID NO: 178575 - DNA, 16 bp, H. sapiens
tttttaatcttgagtt

SEQ ID NO: 178576 - DNA, 16 bp, H. sapiens
tttttaatgaaaagaa

SEQ ID NO: 178577 - DNA, 16 bp, H. sapiens
tttttaatgaaacaga

SEQ ID NO: 178578 - DNA, 16 bp, H. sapiens
tttttaatgaacattt

SEQ ID NO: 178579 - DNA, 16 bp, H. sapiens
tttttaatgaaggaaa

SEQ ID NO: 178580 - DNA, 16 bp, H. sapiens
tttttaatgaattcat

SEQ ID NO: 178581 - DNA, 16 bp, H. sapiens
tttttaatgacatttt

SEQ ID NO: 178582 - DNA, 16 bp, H. sapiens
tttttaatgagacaga

SEQ ID NO: 178583 - DNA, 16 bp, H. sapiens
tttttaatgagagaaa

SEQ ID NO: 178584 - DNA, 16 bp, H. sapiens
tttttaatgaggaaaa

SEQ ID NO: 178585 - DNA, 16 bp, H. sapiens
tttttaatgatggcca

SEQ ID NO: 178586 - DNA, 16 bp, H. sapiens
tttttaatgattgcca

SEQ ID NO: 178587 - DNA, 16 bp, H. sapiens
tttttaatgcaatttt

SEQ ID NO: 178588 - DNA, 16 bp, H. sapiens
tttttaatgctgagta

SEQ ID NO: 178589 - DNA, 16 bp, H. sapiens
tttttaatggaaacaa

SEQ ID NO: 178590 - DNA, 16 bp, H. sapiens
tttttaatggcaaaaa

SEQ ID NO: 178591 - DNA, 16 bp, H. sapiens
tttttaatgggaaata

SEQ ID NO: 178592 - DNA, 16 bp, H. sapiens
tttttaatgtaaaagt

SEQ ID NO: 178593 - DNA, 16 bp, H. sapiens
tttttaatgtaacttt

SEQ ID NO: 178594 - DNA, 16 bp, H. sapiens
tttttaatgtacaaaa

SEQ ID NO: 178595 - DNA, 16 bp, H. sapiens
tttttaatgtagagac

SEQ ID NO: 178596 - DNA, 16 bp, H. sapiens
tttttaatgtagtaaa

SEQ ID NO: 178597 - DNA, 16 bp, H. sapiens
tttttaatgtatgcat

SEQ ID NO: 178598 - DNA, 16 bp, H. sapiens
tttttaatgtcaaaat

SEQ ID NO: 178599 - DNA, 16 bp, H. sapiens
tttttaatgtgctgct

SEQ ID NO: 178600 - DNA, 16 bp, H. sapiens
tttttaatgttctaaa

SEQ ID NO: 178601 - DNA, 16 bp, H. sapiens
tttttaatgtttcaaa

SEQ ID NO: 178602 - DNA, 16 bp, H. sapiens
tttttaattaaagcat

SEQ ID NO: 178603 - DNA, 16 bp, H. sapiens
tttttaattcaatgaa

SEQ ID NO: 178604 - DNA, 16 bp, H. sapiens
tttttaattctatgaa

SEQ ID NO: 178605 - DNA, 16 bp, H. sapiens
tttttaattcttgaaa

SEQ ID NO: 178606 - DNA, 16 bp, H. sapiens
tttttaattgaagaaa

SEQ ID NO: 178607 - DNA, 16 bp, H. sapiens
tttttaattgggctgt

SEQ ID NO: 178608 - DNA, 16 bp, H. sapiens
tttttaatttccagaa

SEQ ID NO: 178609 - DNA, 16 bp, H. sapiens
tttttaattttacagg

SEQ ID NO: 178610 - DNA, 16 bp, H. sapiens
tttttaattttgcaaa

SEQ ID NO: 178611 - DNA, 16 bp, H. sapiens
tttttaatttttgcaa

SEQ ID NO: 178612 - DNA, 16 bp, H. sapiens
tttttacaaaaagaaa

SEQ ID NO: 178613 - DNA, 16 bp, H. sapiens
tttttacaaaagaaat

SEQ ID NO: 178614 - DNA, 16 bp, H. sapiens
tttttacaaaatcaaa

SEQ ID NO: 178615 - DNA, 16 bp, H. sapiens
tttttacaaaattgtt

SEQ ID NO: 178616 - DNA, 16 bp, H. sapiens
tttttacaaagaaaat

SEQ ID NO: 178617 - DNA, 16 bp, H. sapiens
tttttacaaataaaga

SEQ ID NO: 178618 - DNA, 16 bp, H. sapiens
tttttacaaatgtata

SEQ ID NO: 178619 - DNA, 16 bp, H. sapiens
tttttacaaattgaag

SEQ ID NO: 178620 - DNA, 16 bp, H. sapiens
tttttacagaaaagaa

SEQ ID NO: 178621 - DNA, 16 bp, H. sapiens
tttttacagaaattga

SEQ ID NO: 178622 - DNA, 16 bp, H. sapiens
tttttacagaaatttt

SEQ ID NO: 178623 - DNA, 16 bp, H. sapiens
tttttacagaatgctg

SEQ ID NO: 178624 - DNA, 16 bp, H. sapiens
tttttacataatgaaa

SEQ ID NO: 178625 - DNA, 16 bp, H. sapiens
tttttacatatacata

SEQ ID NO: 178626 - DNA, 16 bp, H. sapiens
tttttacatatatgtg

SEQ ID NO: 178627 - DNA, 16 bp, H. sapiens
tttttacatgagaaaa

SEQ ID NO: 178628 - DNA, 16 bp, H. sapiens
tttttacatgtaaata

SEQ ID NO: 178629 - DNA, 16 bp, H. sapiens
tttttacattgaaaaa

SEQ ID NO: 178630 - DNA, 16 bp, H. sapiens
tttttacatttagaaa

SEQ ID NO: 178631 - DNA, 16 bp, H. sapiens
tttttacatttgagtt

SEQ ID NO: 178632 - DNA, 16 bp, H. sapiens
tttttacatttgtaaa

SEQ ID NO: 178633 - DNA, 16 bp, H. sapiens
tttttaccacaataaa

SEQ ID NO: 178634 - DNA, 16 bp, H. sapiens
tttttactctattgat

SEQ ID NO: 178635 - DNA, 16 bp, H. sapiens
tttttactcttaaaaa

SEQ ID NO: 178636 - DNA, 16 bp, H. sapiens
tttttactgaaaatta

SEQ ID NO: 178637 - DNA, 16 bp, H. sapiens
tttttactgtaacttt

SEQ ID NO: 178638 - DNA, 16 bp, H. sapiens
tttttactgtgccttt

SEQ ID NO: 178639 - DNA, 16 bp, H. sapiens
tttttacttaaagaaa

SEQ ID NO: 178640 - DNA, 16 bp, H. sapiens
tttttacttctctgtg

SEQ ID NO: 178641 - DNA, 16 bp, H. sapiens
tttttacttgctaaat

SEQ ID NO: 178642 - DNA, 16 bp, H. sapiens
tttttactttagaatt

SEQ ID NO: 178643 - DNA, 16 bp, H. sapiens
tttttacttttagaga

SEQ ID NO: 178644 - DNA, 16 bp, H. sapiens
tttttacttttgaaaa

SEQ ID NO: 178645 - DNA, 16 bp, H. sapiens
tttttacttttgagac

SEQ ID NO: 178646 - DNA, 16 bp, H. sapiens
tttttacttttgtaaa

SEQ ID NO: 178647 - DNA, 16 bp, H. sapiens
tttttagaaaaatcaa

SEQ ID NO: 178648 - DNA, 16 bp, H. sapiens
tttttagaaaagaaat

SEQ ID NO: 178649 - DNA, 16 bp, H. sapiens
tttttagaaaatacaa

SEQ ID NO: 178650 - DNA, 16 bp, H. sapiens
tttttagaaaatgtga

SEQ ID NO: 178651 - DNA, 16 bp, H. sapiens
tttttagaaagtaaaa

SEQ ID NO: 178652 - DNA, 16 bp, H. sapiens
tttttagaaatgtgaa

SEQ ID NO: 178653 - DNA, 16 bp, H. sapiens
tttttagaaattgaag

SEQ ID NO: 178654 - DNA, 16 bp, H. sapiens
tttttagaagagaaaa

SEQ ID NO: 178655 - DNA, 16 bp, H. sapiens
tttttagaagcatttt

SEQ ID NO: 178656 - DNA, 16 bp, H. sapiens
tttttagaatctgcaa

SEQ ID NO: 178657 - DNA, 16 bp, H. sapiens
tttttagacaaacaaa

SEQ ID NO: 178658 - DNA, 16 bp, H. sapiens
tttttagacggagttt

SEQ ID NO: 178659 - DNA, 16 bp, H. sapiens
tttttagactttttaa

SEQ ID NO: 178660 - DNA, 16 bp, H. sapiens
tttttagagaaaaggt

SEQ ID NO: 178661 - DNA, 16 bp, H. sapiens
tttttagagacaaggt

SEQ ID NO: 178662 - DNA, 16 bp, H. sapiens
tttttagagatatggt

SEQ ID NO: 178663 - DNA, 16 bp, H. sapiens
tttttagagatgagga

SEQ ID NO: 178664 - DNA, 16 bp, H. sapiens
tttttagagatggggt

SEQ ID NO: 178665 - DNA, 16 bp, H. sapiens
tttttagagcagattt

SEQ ID NO: 178666 - DNA, 16 bp, H. sapiens
tttttagatgaggaaa

SEQ ID NO: 178667 - DNA, 16 bp, H. sapiens
tttttagatggaattt

SEQ ID NO: 178668 - DNA, 16 bp, H. sapiens
tttttagcaataaaat

SEQ ID NO: 178669 - DNA, 16 bp, H. sapiens
tttttagcaataaagc

SEQ ID NO: 178670 - DNA, 16 bp, H. sapiens
tttttagcaatgtttt

SEQ ID NO: 178671 - DNA, 16 bp, H. sapiens
tttttagcagagacac

SEQ ID NO: 178672 - DNA, 16 bp, H. sapiens
tttttagcagtttaat

SEQ ID NO: 178673 - DNA, 16 bp, H. sapiens
tttttagcagttttat

SEQ ID NO: 178674 - DNA, 16 bp, H. sapiens
tttttagccattctga

SEQ ID NO: 178675 - DNA, 16 bp, H. sapiens
tttttagcctccttaa

SEQ ID NO: 178676 - DNA, 16 bp, H. sapiens
tttttagcttctgcat

SEQ ID NO: 178677 - DNA, 16 bp, H. sapiens
tttttaggaaaaatat

SEQ ID NO: 178678 - DNA, 16 bp, H. sapiens
tttttaggaatttatc

SEQ ID NO: 178679 - DNA, 16 bp, H. sapiens
tttttaggccaggcac

SEQ ID NO: 178680 - DNA, 16 bp, H. sapiens
tttttaggccaggcat

SEQ ID NO: 178681 - DNA, 16 bp, H. sapiens
tttttaggttaaaaaa

SEQ ID NO: 178682 - DNA, 16 bp, H. sapiens
tttttagtaaagacag

SEQ ID NO: 178683 - DNA, 16 bp, H. sapiens
tttttagtaaagatga

SEQ ID NO: 178684 - DNA, 16 bp, H. sapiens
tttttagtaaatttac

SEQ ID NO: 178685 - DNA, 30 bp, H. sapiens
tttttagtagagatggggttttgccatgtt

SEQ ID NO: 178686 - DNA, 16 bp, H. sapiens
tttttagtagaggtgg

SEQ ID NO: 178687 - DNA, 16 bp, H. sapiens
tttttagtagggatgg

SEQ ID NO: 178688 - DNA, 16 bp, H. sapiens
tttttagtatatttca

SEQ ID NO: 178689 - DNA, 16 bp, H. sapiens
tttttagttctccttg

SEQ ID NO: 178690 - DNA, 16 bp, H. sapiens
tttttagtttcaaatt

SEQ ID NO: 178691 - DNA, 16 bp, H. sapiens
tttttagtttcatata

SEQ ID NO: 178692 - DNA, 16 bp, H. sapiens
tttttagtttcttgaa

SEQ ID NO: 178693 - DNA, 16 bp, H. sapiens
tttttagttttcaaat

SEQ ID NO: 178694 - DNA, 16 bp, H. sapiens
tttttagttttcagca

SEQ ID NO: 178695 - DNA, 16 bp, H. sapiens
tttttagttttctgag

SEQ ID NO: 178696 - DNA, 16 bp, H. sapiens
tttttataaaccttcc

SEQ ID NO: 178697 - DNA, 16 bp, H. sapiens
tttttataacacaaaa

SEQ ID NO: 178698 - DNA, 16 bp, H. sapiens
tttttataaggacact

SEQ ID NO: 178699 - DNA, 16 bp, H. sapiens
tttttatacacctgtt

SEQ ID NO: 178700 - DNA, 16 bp, H. sapiens
tttttatactttcagt

SEQ ID NO: 178701 - DNA, 16 bp, H. sapiens
tttttatagagaaaaa

SEQ ID NO: 178702 - DNA, 16 bp, H. sapiens
tttttatagagacatg

SEQ ID NO: 178703 - DNA, 16 bp, H. sapiens
tttttatagagacggg

SEQ ID NO: 178704 - DNA, 16 bp, H. sapiens
tttttatagagatggg

SEQ ID NO: 178705 - DNA, 16 bp, H. sapiens
tttttatagatgaata

SEQ ID NO: 178706 - DNA, 16 bp, H. sapiens
tttttataggttaaaa

SEQ ID NO: 178707 - DNA, 16 bp, H. sapiens
tttttatatacacata

SEQ ID NO: 178708 - DNA, 16 bp, H. sapiens
tttttatataggtaaa

SEQ ID NO: 178709 - DNA, 16 bp, H. sapiens
tttttatatatggcct

SEQ ID NO: 178710 - DNA, 16 bp, H. sapiens
tttttatatgaagata

SEQ ID NO: 178711 - DNA, 16 bp, H. sapiens
tttttatatggaaata

SEQ ID NO: 178712 - DNA, 16 bp, H. sapiens
tttttatattctgaat

SEQ ID NO: 178713 - DNA, 16 bp, H. sapiens
tttttatattgacatt

SEQ ID NO: 178714 - DNA, 16 bp, H. sapiens
tttttatattgcctat

SEQ ID NO: 178715 - DNA, 16 bp, H. sapiens
tttttatattgctgaa

SEQ ID NO: 178716 - DNA, 16 bp, H. sapiens
tttttatatttcagaa

SEQ ID NO: 178717 - DNA, 16 bp, H. sapiens
tttttatatttgtcaa

SEQ ID NO: 178718 - DNA, 16 bp, H. sapiens
tttttatcacagaata

SEQ ID NO: 178719 - DNA, 16 bp, H. sapiens
tttttatcactgattt

SEQ ID NO: 178720 - DNA, 16 bp, H. sapiens
tttttatcagacttaa

SEQ ID NO: 178721 - DNA, 16 bp, H. sapiens
tttttatcagctttgt

SEQ ID NO: 178722 - DNA, 16 bp, H. sapiens
tttttatcatgaaaaa

SEQ ID NO: 178723 - DNA, 16 bp, H. sapiens
tttttatcatgaaagg

SEQ ID NO: 178724 - DNA, 16 bp, H. sapiens
tttttatcatgaaggg

SEQ ID NO: 178725 - DNA, 16 bp, H. sapiens
tttttatcatggaaaa

SEQ ID NO: 178726 - DNA, 16 bp, H. sapiens
tttttatcattttgaa

SEQ ID NO: 178727 - DNA, 16 bp, H. sapiens
tttttatccaaaagaa

SEQ ID NO: 178728 - DNA, 16 bp, H. sapiens
tttttatccattcagt

SEQ ID NO: 178729 - DNA, 16 bp, H. sapiens
tttttatcctgcaact

SEQ ID NO: 178730 - DNA, 16 bp, H. sapiens
tttttatctgaagaaa

SEQ ID NO: 178731 - DNA, 16 bp, H. sapiens
tttttatcttgaaatt

SEQ ID NO: 178732 - DNA, 16 bp, H. sapiens
tttttatcttgtaaaa

SEQ ID NO: 178733 - DNA, 16 bp, H. sapiens
tttttatctttaaatg

SEQ ID NO: 178734 - DNA, 16 bp, H. sapiens
tttttatgaaaaagaa

SEQ ID NO: 178735 - DNA, 16 bp, H. sapiens
tttttatgaaaagaaa

SEQ ID NO: 178736 - DNA, 16 bp, H. sapiens
tttttatgaattcaaa

SEQ ID NO: 178737 - DNA, 16 bp, H. sapiens
tttttatgagaattac

SEQ ID NO: 178738 - DNA, 16 bp, H. sapiens
tttttatgatgaaaat

SEQ ID NO: 178739 - DNA, 16 bp, H. sapiens
tttttatgctattata

SEQ ID NO: 178740 - DNA, 16 bp, H. sapiens
tttttatggacaattt

SEQ ID NO: 178741 - DNA, 16 bp, H. sapiens
tttttatggagtctca

SEQ ID NO: 178742 - DNA, 16 bp, H. sapiens
tttttatggataaata

SEQ ID NO: 178743 - DNA, 16 bp, H. sapiens
tttttatggatgagca

SEQ ID NO: 178744 - DNA, 16 bp, H. sapiens
tttttatggccaaata

SEQ ID NO: 178745 - DNA, 16 bp, H. sapiens
tttttatggctgaata

SEQ ID NO: 178746 - DNA, 49 bp, H. sapiens
tttttatggctgcatagtattccatggtgtatatgtgccacattttctt

SEQ ID NO: 178747 - DNA, 16 bp, H. sapiens
tttttatgtagaaaaa

SEQ ID NO: 178748 - DNA, 16 bp, H. sapiens
tttttatgtgaacata

SEQ ID NO: 178749 - DNA, 16 bp, H. sapiens
tttttattagagaagg

SEQ ID NO: 178750 - DNA, 16 bp, H. sapiens
tttttattatctgaaa

SEQ ID NO: 178751 - DNA, 16 bp, H. sapiens
tttttattatgcataa

SEQ ID NO: 178752 - DNA, 16 bp, H. sapiens
tttttattatggaaaa

SEQ ID NO: 178753 - DNA, 16 bp, H. sapiens
tttttattcaacaaat

SEQ ID NO: 178754 - DNA, 16 bp, H. sapiens
tttttattcaataaag

SEQ ID NO: 178755 - DNA, 16 bp, H. sapiens
tttttattcagaaaat

SEQ ID NO: 178756 - DNA, 16 bp, H. sapiens
tttttattcagtctga

SEQ ID NO: 178757 - DNA, 16 bp, H. sapiens
tttttattcagtttaa

SEQ ID NO: 178758 - DNA, 16 bp, H. sapiens
tttttattcatgaaaa

SEQ ID NO: 178759 - DNA, 16 bp, H. sapiens
tttttattcattcaac

SEQ ID NO: 178760 - DNA, 16 bp, H. sapiens
tttttattcattctgc

SEQ ID NO: 178761 - DNA, 16 bp, H. sapiens
tttttattccaaaaat

SEQ ID NO: 178762 - DNA, 16 bp, H. sapiens
tttttattccataaaa

SEQ ID NO: 178763 - DNA, 16 bp, H. sapiens
tttttattctattcag

SEQ ID NO: 178764 - DNA, 16 bp, H. sapiens
tttttattcttccaaa

SEQ ID NO: 178765 - DNA, 16 bp, H. sapiens
tttttattgaagtaaa

SEQ ID NO: 178766 - DNA, 16 bp, H. sapiens
tttttattgagaaaat

SEQ ID NO: 178767 - DNA, 16 bp, H. sapiens
tttttattgagcactt

SEQ ID NO: 178768 - DNA, 16 bp, H. sapiens
tttttattgcacttat

SEQ ID NO: 178769 - DNA, 16 bp, H. sapiens
tttttattgcagcact

SEQ ID NO: 178770 - DNA, 16 bp, H. sapiens
tttttattgctgaata

SEQ ID NO: 178771 - DNA, 16 bp, H. sapiens
tttttattgctgtata

SEQ ID NO: 178772 - DNA, 16 bp, H. sapiens
tttttattgcttaaaa

SEQ ID NO: 178773 - DNA, 16 bp, H. sapiens
tttttattggatgcca

SEQ ID NO: 178774 - DNA, 16 bp, H. sapiens
tttttattgtctccat

SEQ ID NO: 178775 - DNA, 16 bp, H. sapiens
tttttattgtgagata

SEQ ID NO: 178776 - DNA, 16 bp, H. sapiens
tttttatttaacagaa

SEQ ID NO: 178777 - DNA, 16 bp, H. sapiens
tttttatttcacagat

SEQ ID NO: 178778 - DNA, 16 bp, H. sapiens
tttttatttcacagtt

SEQ ID NO: 178779 - DNA, 16 bp, H. sapiens
tttttatttcagaaat

SEQ ID NO: 178780 - DNA, 16 bp, H. sapiens
tttttatttctgtaag

SEQ ID NO: 178781 - DNA, 16 bp, H. sapiens
tttttatttctgtaga

SEQ ID NO: 178782 - DNA, 16 bp, H. sapiens
tttttatttgaaaact

SEQ ID NO: 178783 - DNA, 16 bp, H. sapiens
tttttatttgaacatt

SEQ ID NO: 178784 - DNA, 16 bp, H. sapiens
tttttatttgagatgg

SEQ ID NO: 178785 - DNA, 16 bp, H. sapiens
tttttatttgctaaat

SEQ ID NO: 178786 - DNA, 16 bp, H. sapiens
tttttatttgtaagga

SEQ ID NO: 178787 - DNA, 16 bp, H. sapiens
tttttatttgtggaga

SEQ ID NO: 178788 - DNA, 16 bp, H. sapiens
tttttattttacagat

SEQ ID NO: 178789 - DNA, 16 bp, H. sapiens
tttttattttcaaatg

SEQ ID NO: 178790 - DNA, 16 bp, H. sapiens
tttttattttcctaag

SEQ ID NO: 178791 - DNA, 16 bp, H. sapiens
tttttattttgcaaaa

SEQ ID NO: 178792 - DNA, 16 bp, H. sapiens
tttttattttgcactg

SEQ ID NO: 178793 - DNA, 16 bp, H. sapiens
tttttcaaaaaaacca

SEQ ID NO: 178794 - DNA, 16 bp, H. sapiens
tttttcaaaaaacatt

SEQ ID NO: 178795 - DNA, 16 bp, H. sapiens
tttttcaaaaaattag

SEQ ID NO: 178796 - DNA, 16 bp, H. sapiens
tttttcaaaaaggaaa

SEQ ID NO: 178797 - DNA, 16 bp, H. sapiens
tttttcaaaaatctct

SEQ ID NO: 178798 - DNA, 16 bp, H. sapiens
tttttcaaaaatggaa

SEQ ID NO: 178799 - DNA, 16 bp, H. sapiens
tttttcaaaaatgtat

SEQ ID NO: 178800 - DNA, 16 bp, H. sapiens
tttttcaaaactttct

SEQ ID NO: 178801 - DNA, 16 bp, H. sapiens
tttttcaaaagaagaa

SEQ ID NO: 178802 - DNA, 16 bp, H. sapiens
tttttcaaaaggaaaa

SEQ ID NO: 178803 - DNA, 16 bp, H. sapiens
tttttcaaaagttttt

SEQ ID NO: 178804 - DNA, 16 bp, H. sapiens
tttttcaaaatcaaaa

SEQ ID NO: 178805 - DNA, 16 bp, H. sapiens
tttttcaaaattgctt

SEQ ID NO: 178806 - DNA, 16 bp, H. sapiens
tttttcaaaattttga

SEQ ID NO: 178807 - DNA, 16 bp, H. sapiens
tttttcaaacagaaaa

SEQ ID NO: 178808 - DNA, 16 bp, H. sapiens
tttttcaaagaaaata

SEQ ID NO: 178809 - DNA, 16 bp, H. sapiens
tttttcaaagagaaaa

SEQ ID NO: 178810 - DNA, 16 bp, H. sapiens
tttttcaaaggatttt

SEQ ID NO: 178811 - DNA, 16 bp, H. sapiens
tttttcaaaggttttt

SEQ ID NO: 178812 - DNA, 16 bp, H. sapiens
tttttcaaagtagaaa

SEQ ID NO: 178813 - DNA, 16 bp, H. sapiens
tttttcaaataggaaa

SEQ ID NO: 178814 - DNA, 16 bp, H. sapiens
tttttcaaatatgctt

SEQ ID NO: 178815 - DNA, 16 bp, H. sapiens
tttttcaaatatgttt

SEQ ID NO: 178816 - DNA, 16 bp, H. sapiens
tttttcaaatggaaat

SEQ ID NO: 178817 - DNA, 16 bp, H. sapiens
tttttcaaatgtttat

SEQ ID NO: 178818 - DNA, 16 bp, H. sapiens
tttttcaactgtaaat

SEQ ID NO: 178819 - DNA, 16 bp, H. sapiens
tttttcaactttaaaa

SEQ ID NO: 178820 - DNA, 16 bp, H. sapiens
tttttcaactttgaaa

SEQ ID NO: 178821 - DNA, 16 bp, H. sapiens
tttttcaagaaaagct

SEQ ID NO: 178822 - DNA, 16 bp, H. sapiens
tttttcaagaatgttt

SEQ ID NO: 178823 - DNA, 16 bp, H. sapiens
tttttcaagacaaaaa

SEQ ID NO: 178824 - DNA, 16 bp, H. sapiens
tttttcaaggaaaaaa

SEQ ID NO: 178825 - DNA, 16 bp, H. sapiens
tttttcaaggttttaa

SEQ ID NO: 178826 - DNA, 16 bp, H. sapiens
tttttcaaggtttttg

SEQ ID NO: 178827 - DNA, 16 bp, H. sapiens
tttttcaagtaaaaat

SEQ ID NO: 178828 - DNA, 16 bp, H. sapiens
tttttcaagtatcttt

SEQ ID NO: 178829 - DNA, 16 bp, H. sapiens
tttttcaagtatttct

SEQ ID NO: 178830 - DNA, 16 bp, H. sapiens
tttttcaagtttctgt

SEQ ID NO: 178831 - DNA, 16 bp, H. sapiens
tttttcaataaaagtt

SEQ ID NO: 178832 - DNA, 16 bp, H. sapiens
tttttcaataaagaaa

SEQ ID NO: 178833 - DNA, 16 bp, H. sapiens
tttttcaataaatggt

SEQ ID NO: 178834 - DNA, 16 bp, H. sapiens
tttttcaatttagaaa

SEQ ID NO: 178835 - DNA, 16 bp, H. sapiens
tttttcacagcaaaag

SEQ ID NO: 178836 - DNA, 16 bp, H. sapiens
tttttcacataattag

SEQ ID NO: 178837 - DNA, 16 bp, H. sapiens
tttttcacattgattt

SEQ ID NO: 178838 - DNA, 16 bp, H. sapiens
tttttcacctataaaa

SEQ ID NO: 178839 - DNA, 16 bp, H. sapiens
tttttcactgttggtg

SEQ ID NO: 178840 - DNA, 16 bp, H. sapiens
tttttcacttaacatt

SEQ ID NO: 178841 - DNA, 16 bp, H. sapiens
tttttcactttgttca

SEQ ID NO: 178842 - DNA, 16 bp, H. sapiens
tttttcacttttcaaa

SEQ ID NO: 178843 - DNA, 16 bp, H. sapiens
tttttcagaaaaaaaa

SEQ ID NO: 178844 - DNA, 16 bp, H. sapiens
tttttcagaaaaagaa

SEQ ID NO: 178845 - DNA, 16 bp, H. sapiens
tttttcagaaacaggg

SEQ ID NO: 178846 - DNA, 16 bp, H. sapiens
tttttcagaaagaaaa

SEQ ID NO: 178847 - DNA, 16 bp, H. sapiens
tttttcagaacttttt

SEQ ID NO: 178848 - DNA, 16 bp, H. sapiens
tttttcagaagagttt

SEQ ID NO: 178849 - DNA, 16 bp, H. sapiens
tttttcagacagagcc

SEQ ID NO: 178850 - DNA, 16 bp, H. sapiens
tttttcagacttgttt

SEQ ID NO: 178851 - DNA, 16 bp, H. sapiens
tttttcagagaaaaat

SEQ ID NO: 178852 - DNA, 16 bp, H. sapiens
tttttcagataatatt

SEQ ID NO: 178853 - DNA, 16 bp, H. sapiens
tttttcagatgaggaa

SEQ ID NO: 178854 - DNA, 16 bp, H. sapiens
tttttcagatgatgaa

SEQ ID NO: 178855 - DNA, 16 bp, H. sapiens
tttttcagattccttt

SEQ ID NO: 178856 - DNA, 16 bp, H. sapiens
tttttcagatttcatt

SEQ ID NO: 178857 - DNA, 16 bp, H. sapiens
tttttcagattttcaa

SEQ ID NO: 178858 - DNA, 16 bp, H. sapiens
tttttcagcaccacaa

SEQ ID NO: 178859 - DNA, 16 bp, H. sapiens
tttttcagcactttaa

SEQ ID NO: 178860 - DNA, 16 bp, H. sapiens
tttttcagcagaaact

SEQ ID NO: 178861 - DNA, 16 bp, H. sapiens
tttttcagctagtttg

SEQ ID NO: 178862 - DNA, 16 bp, H. sapiens
tttttcagctccatta

SEQ ID NO: 178863 - DNA, 16 bp, H. sapiens
tttttcagcttaaaaa

SEQ ID NO: 178864 - DNA, 16 bp, H. sapiens
tttttcagcttcagaa

SEQ ID NO: 178865 - DNA, 16 bp, H. sapiens
tttttcagcttttgga

SEQ ID NO: 178866 - DNA, 16 bp, H. sapiens
tttttcaggaaaatat

SEQ ID NO: 178867 - DNA, 16 bp, H. sapiens
tttttcaggctgctct

SEQ ID NO: 178868 - DNA, 16 bp, H. sapiens
tttttcaggctgggca

SEQ ID NO: 178869 - DNA, 16 bp, H. sapiens
tttttcagggaagaaa

SEQ ID NO: 178870 - DNA, 16 bp, H. sapiens
tttttcagggacagtt

SEQ ID NO: 178871 - DNA, 16 bp, H. sapiens
tttttcaggtaaatca

SEQ ID NO: 178872 - DNA, 16 bp, H. sapiens
tttttcagtaaatatt

SEQ ID NO: 178873 - DNA, 16 bp, H. sapiens
tttttcagtagagacg

SEQ ID NO: 178874 - DNA, 16 bp, H. sapiens
tttttcagtatcaatt

SEQ ID NO: 178875 - DNA, 16 bp, H. sapiens
tttttcagtcataatt

SEQ ID NO: 178876 - DNA, 16 bp, H. sapiens
tttttcagtgatttta

SEQ ID NO: 178877 - DNA, 16 bp, H. sapiens
tttttcagtggctggt

SEQ ID NO: 178878 - DNA, 16 bp, H. sapiens
tttttcagttataaaa

SEQ ID NO: 178879 - DNA, 16 bp, H. sapiens
tttttcagtttcttga

SEQ ID NO: 178880 - DNA, 16 bp, H. sapiens
tttttcagttttcata

SEQ ID NO: 178881 - DNA, 16 bp, H. sapiens
tttttcagttttgaaa

SEQ ID NO: 178882 - DNA, 16 bp, H. sapiens
tttttcataaatgtat

SEQ ID NO: 178883 - DNA, 16 bp, H. sapiens
tttttcataataaaca

SEQ ID NO: 178884 - DNA, 16 bp, H. sapiens
tttttcataatgaaaa

SEQ ID NO: 178885 - DNA, 16 bp, H. sapiens
tttttcatagaattta

SEQ ID NO: 178886 - DNA, 16 bp, H. sapiens
tttttcatagagacgg

SEQ ID NO: 178887 - DNA, 16 bp, H. sapiens
tttttcatagttttca

SEQ ID NO: 178888 - DNA, 16 bp, H. sapiens
tttttcatatatctgt

SEQ ID NO: 178889 - DNA, 16 bp, H. sapiens
tttttcatatgaaaaa

SEQ ID NO: 178890 - DNA, 16 bp, H. sapiens
tttttcatatttctga

SEQ ID NO: 178891 - DNA, 16 bp, H. sapiens
tttttcatcagtgttt

SEQ ID NO: 178892 - DNA, 16 bp, H. sapiens
tttttcatctgaaaat

SEQ ID NO: 178893 - DNA, 16 bp, H. sapiens
tttttcatctgtaaat

SEQ ID NO: 178894 - DNA, 16 bp, H. sapiens
tttttcatctttccaa

SEQ ID NO: 178895 - DNA, 16 bp, H. sapiens
tttttcatgaaaataa

SEQ ID NO: 178896 - DNA, 16 bp, H. sapiens
tttttcatgaaatctt

SEQ ID NO: 178897 - DNA, 16 bp, H. sapiens
tttttcatgaaatttt

SEQ ID NO: 178898 - DNA, 16 bp, H. sapiens
tttttcatgaatattt

SEQ ID NO: 178899 - DNA, 16 bp, H. sapiens
tttttcatggctgcat

SEQ ID NO: 178900 - DNA, 16 bp, H. sapiens
tttttcatggttctgg

SEQ ID NO: 178901 - DNA, 16 bp, H. sapiens
tttttcatgtaaattt

SEQ ID NO: 178902 - DNA, 16 bp, H. sapiens
tttttcattaaaatga

SEQ ID NO: 178903 - DNA, 16 bp, H. sapiens
tttttcattaaaatgt

SEQ ID NO: 178904 - DNA, 16 bp, H. sapiens
tttttcattcaaaatg

SEQ ID NO: 178905 - DNA, 16 bp, H. sapiens
tttttcattcccacca

SEQ ID NO: 178906 - DNA, 16 bp, H. sapiens
tttttcattctgttga

SEQ ID NO: 178907 - DNA, 16 bp, H. sapiens
tttttcatttaagaaa

SEQ ID NO: 178908 - DNA, 16 bp, H. sapiens
tttttcatttacaaaa

SEQ ID NO: 178909 - DNA, 16 bp, H. sapiens
tttttcatttagcatt

SEQ ID NO: 178910 - DNA, 16 bp, H. sapiens
tttttcatttcagaca

SEQ ID NO: 178911 - DNA, 16 bp, H. sapiens
tttttcatttctgtaa

SEQ ID NO: 178912 - DNA, 16 bp, H. sapiens
tttttcatttgcatga

SEQ ID NO: 178913 - DNA, 16 bp, H. sapiens
tttttcattttagaaa

SEQ ID NO: 178914 - DNA, 16 bp, H. sapiens
tttttcattttggcaa

SEQ ID NO: 178915 - DNA, 16 bp, H. sapiens
tttttcatttttaaga

SEQ ID NO: 178916 - DNA, 16 bp, H. sapiens
tttttccaaaatgttt

SEQ ID NO: 178917 - DNA, 16 bp, H. sapiens
tttttccaaactcatt

SEQ ID NO: 178918 - DNA, 16 bp, H. sapiens
tttttccaaagcaaaa

SEQ ID NO: 178919 - DNA, 16 bp, H. sapiens
tttttccaaagcagaa

SEQ ID NO: 178920 - DNA, 16 bp, H. sapiens
tttttccaaagttttc

SEQ ID NO: 178921 - DNA, 16 bp, H. sapiens
tttttccaaatgaaaa

SEQ ID NO: 178922 - DNA, 16 bp, H. sapiens
tttttccaaattactt

SEQ ID NO: 178923 - DNA, 16 bp, H. sapiens
tttttccaacttttaa

SEQ ID NO: 178924 - DNA, 16 bp, H. sapiens
tttttccaagagaaaa

SEQ ID NO: 178925 - DNA, 16 bp, H. sapiens
tttttccaaggttttt

SEQ ID NO: 178926 - DNA, 16 bp, H. sapiens
tttttccacattttca

SEQ ID NO: 178927 - DNA, 16 bp, H. sapiens
tttttccagaagaaaa

SEQ ID NO: 178928 - DNA, 16 bp, H. sapiens
tttttccagagtggct

SEQ ID NO: 178929 - DNA, 16 bp, H. sapiens
tttttccagattttct

SEQ ID NO: 178930 - DNA, 16 bp, H. sapiens
tttttccagcaccatt

SEQ ID NO: 178931 - DNA, 16 bp, H. sapiens
tttttccatatgtata

SEQ ID NO: 178932 - DNA, 16 bp, H. sapiens
tttttccatcctcacc

SEQ ID NO: 178933 - DNA, 16 bp, H. sapiens
tttttccatcttaaaa

SEQ ID NO: 178934 - DNA, 16 bp, H. sapiens
tttttccatgtgaata

SEQ ID NO: 178935 - DNA, 16 bp, H. sapiens
tttttccatgtgtctg

SEQ ID NO: 178936 - DNA, 16 bp, H. sapiens
tttttccatttctatg

SEQ ID NO: 178937 - DNA, 16 bp, H. sapiens
tttttcccaaattaat

SEQ ID NO: 178938 - DNA, 16 bp, H. sapiens
tttttcccaaccattt

SEQ ID NO: 178939 - DNA, 16 bp, H. sapiens
tttttcccagctttat

SEQ ID NO: 178940 - DNA, 16 bp, H. sapiens
tttttcccatagcact

SEQ ID NO: 178941 - DNA, 16 bp, H. sapiens
tttttcccattgattt

SEQ ID NO: 178942 - DNA, 16 bp, H. sapiens
tttttccccaaaaaat

SEQ ID NO: 178943 - DNA, 16 bp, H. sapiens
tttttccccaaaatta

SEQ ID NO: 178944 - DNA, 16 bp, H. sapiens
tttttccccaaagcaa

SEQ ID NO: 178945 - DNA, 16 bp, H. sapiens
tttttccccaaatttt

SEQ ID NO: 178946 - DNA, 16 bp, H. sapiens
tttttccccaagtttt

SEQ ID NO: 178947 - DNA, 16 bp, H. sapiens
tttttccccactgaat

SEQ ID NO: 178948 - DNA, 16 bp, H. sapiens
tttttcccccaaagtt

SEQ ID NO: 178949 - DNA, 16 bp, H. sapiens
tttttcccccagaaat

SEQ ID NO: 178950 - DNA, 16 bp, H. sapiens
tttttccccccaaaat

SEQ ID NO: 178951 - DNA, 16 bp, H. sapiens
tttttccccccttaaa

SEQ ID NO: 178952 - DNA, 16 bp, H. sapiens
tttttccccctttgga

SEQ ID NO: 178953 - DNA, 16 bp, H. sapiens
tttttcccctatctgg

SEQ ID NO: 178954 - DNA, 16 bp, H. sapiens
tttttcccctcaaatt

SEQ ID NO: 178955 - DNA, 16 bp, H. sapiens
tttttcccctcagttt

SEQ ID NO: 178956 - DNA, 16 bp, H. sapiens
tttttcccctgaaaat

SEQ ID NO: 178957 - DNA, 16 bp, H. sapiens
tttttcccctgatttt

SEQ ID NO: 178958 - DNA, 16 bp, H. sapiens
tttttccctctgtaaa

SEQ ID NO: 178959 - DNA, 16 bp, H. sapiens
tttttccctgtaaatt

SEQ ID NO: 178960 - DNA, 16 bp, H. sapiens
tttttccctttaaaaa

SEQ ID NO: 178961 - DNA, 16 bp, H. sapiens
tttttcccttttggaa

SEQ ID NO: 178962 - DNA, 16 bp, H. sapiens
tttttcctatacacac

SEQ ID NO: 178963 - DNA, 16 bp, H. sapiens
tttttcctatagagtt

SEQ ID NO: 178964 - DNA, 16 bp, H. sapiens
tttttcctatggagtt

SEQ ID NO: 178965 - DNA, 16 bp, H. sapiens
tttttcctatttgaaa

SEQ ID NO: 178966 - DNA, 16 bp, H. sapiens
tttttcctcagaaaaa

SEQ ID NO: 178967 - DNA, 16 bp, H. sapiens
tttttcctcagtattt

SEQ ID NO: 178968 - DNA, 16 bp, H. sapiens
tttttcctccagcttt

SEQ ID NO: 178969 - DNA, 16 bp, H. sapiens
tttttcctccttcaaa

SEQ ID NO: 178970 - DNA, 16 bp, H. sapiens
tttttcctctgcccca

SEQ ID NO: 178971 - DNA, 16 bp, H. sapiens
tttttcctcttaagtt

SEQ ID NO: 178972 - DNA, 16 bp, H. sapiens
tttttcctgaaaaaat

SEQ ID NO: 178973 - DNA, 16 bp, H. sapiens
tttttcctgaaaataa

SEQ ID NO: 178974 - DNA, 16 bp, H. sapiens
tttttcctgaaagttt

SEQ ID NO: 178975 - DNA, 16 bp, H. sapiens
tttttcctgatccttt

SEQ ID NO: 178976 - DNA, 16 bp, H. sapiens
tttttcctgatgctcc

SEQ ID NO: 178977 - DNA, 16 bp, H. sapiens
tttttcctgcatctat

SEQ ID NO: 178978 - DNA, 16 bp, H. sapiens
tttttcctgccaaacc

SEQ ID NO: 178979 - DNA, 16 bp, H. sapiens
tttttcctgcctcagc

SEQ ID NO: 178980 - DNA, 16 bp, H. sapiens
tttttcctgcttccat

SEQ ID NO: 178981 - DNA, 16 bp, H. sapiens
tttttcctgttttaaa

SEQ ID NO: 178982 - DNA, 16 bp, H. sapiens
tttttccttaaaataa

SEQ ID NO: 178983 - DNA, 16 bp, H. sapiens
tttttccttaaaatct

SEQ ID NO: 178984 - DNA, 16 bp, H. sapiens
tttttccttaataaaa

SEQ ID NO: 178985 - DNA, 16 bp, H. sapiens
tttttccttctataaa

SEQ ID NO: 178986 - DNA, 16 bp, H. sapiens
tttttccttctgaaaa

SEQ ID NO: 178987 - DNA, 16 bp, H. sapiens
tttttccttctgatgt

SEQ ID NO: 178988 - DNA, 16 bp, H. sapiens
tttttccttctggtgg

SEQ ID NO: 178989 - DNA, 16 bp, H. sapiens
tttttccttcttagaa

SEQ ID NO: 178990 - DNA, 16 bp, H. sapiens
tttttccttgcaaatt

SEQ ID NO: 178991 - DNA, 16 bp, H. sapiens
tttttcctttgagatg

SEQ ID NO: 178992 - DNA, 16 bp, H. sapiens
tttttcctttgtaaat

SEQ ID NO: 178993 - DNA, 16 bp, H. sapiens
tttttccttttaaaca

SEQ ID NO: 178994 - DNA, 16 bp, H. sapiens
tttttccttttatgaa

SEQ ID NO: 178995 - DNA, 16 bp, H. sapiens
tttttccttttccaaa

SEQ ID NO: 178996 - DNA, 16 bp, H. sapiens
tttttcctttttggag

SEQ ID NO: 178997 - DNA, 16 bp, H. sapiens
tttttctaaaaacaaa

SEQ ID NO: 178998 - DNA, 16 bp, H. sapiens
tttttctaaaaacatt

SEQ ID NO: 178999 - DNA, 16 bp, H. sapiens
tttttctaaaaagata

SEQ ID NO: 179000 - DNA, 16 bp, H. sapiens
tttttctaaaacaaaa

SEQ ID NO: 179001 - DNA, 16 bp, H. sapiens
tttttctaaaactaat

SEQ ID NO: 179002 - DNA, 16 bp, H. sapiens
tttttctaaaagcaaa

SEQ ID NO: 179003 - DNA, 16 bp, H. sapiens
tttttctaaaatctaa

SEQ ID NO: 179004 - DNA, 16 bp, H. sapiens
tttttctaaaatgaat

SEQ ID NO: 179005 - DNA, 16 bp, H. sapiens
tttttctaaaatgttt

SEQ ID NO: 179006 - DNA, 16 bp, H. sapiens
tttttctaaacaagaa

SEQ ID NO: 179007 - DNA, 16 bp, H. sapiens
tttttctaaagaaaaa

SEQ ID NO: 179008 - DNA, 16 bp, H. sapiens
tttttctaaagaatat

SEQ ID NO: 179009 - DNA, 16 bp, H. sapiens
tttttctaaaggtttt

SEQ ID NO: 179010 - DNA, 16 bp, H. sapiens
tttttctaaatgggaa

SEQ ID NO: 179011 - DNA, 16 bp, H. sapiens
tttttctaaattgaaa

SEQ ID NO: 179012 - DNA, 16 bp, H. sapiens
tttttctaacagcttt

SEQ ID NO: 179013 - DNA, 16 bp, H. sapiens
tttttctaagagaaag

SEQ ID NO: 179014 - DNA, 16 bp, H. sapiens
tttttctaagagaaat

SEQ ID NO: 179015 - DNA, 16 bp, H. sapiens
tttttctaagagtttt

SEQ ID NO: 179016 - DNA, 16 bp, H. sapiens
tttttctaagcatttt

SEQ ID NO: 179017 - DNA, 16 bp, H. sapiens
tttttctacaaaggaa

SEQ ID NO: 179018 - DNA, 16 bp, H. sapiens
tttttctacatcttca

SEQ ID NO: 179019 - DNA, 16 bp, H. sapiens
tttttctactttgtaa

SEQ ID NO: 179020 - DNA, 16 bp, H. sapiens
tttttctagagaaaaa

SEQ ID NO: 179021 - DNA, 16 bp, H. sapiens
tttttctataaaatga

SEQ ID NO: 179022 - DNA, 16 bp, H. sapiens
tttttctataagaaat

SEQ ID NO: 179023 - DNA, 16 bp, H. sapiens
tttttctatgaaaaaa

SEQ ID NO: 179024 - DNA, 16 bp, H. sapiens
tttttctatgaaaata

SEQ ID NO: 179025 - DNA, 16 bp, H. sapiens
tttttctatgtaaata

SEQ ID NO: 179026 - DNA, 16 bp, H. sapiens
tttttctatgtttaaa

SEQ ID NO: 179027 - DNA, 16 bp, H. sapiens
tttttctattccagaa

SEQ ID NO: 179028 - DNA, 16 bp, H. sapiens
tttttctattgaaaat

SEQ ID NO: 179029 - DNA, 16 bp, H. sapiens
tttttctatttctgaa

SEQ ID NO: 179030 - DNA, 16 bp, H. sapiens
tttttctatttggaaa

SEQ ID NO: 179031 - DNA, 16 bp, H. sapiens
tttttctcaaaaatat

SEQ ID NO: 179032 - DNA, 16 bp, H. sapiens
tttttctcaataaaat

SEQ ID NO: 179033 - DNA, 16 bp, H. sapiens
tttttctcagatttct

SEQ ID NO: 179034 - DNA, 16 bp, H. sapiens
tttttctcatttaaca

SEQ ID NO: 179035 - DNA, 16 bp, H. sapiens
tttttctcatttgaaa

SEQ ID NO: 179036 - DNA, 16 bp, H. sapiens
tttttctccaaaacct

SEQ ID NO: 179037 - DNA, 16 bp, H. sapiens
tttttctccagaaaaa

SEQ ID NO: 179038 - DNA, 16 bp, H. sapiens
tttttctccagtgttt

SEQ ID NO: 179039 - DNA, 16 bp, H. sapiens
tttttctccatagcac

SEQ ID NO: 179040 - DNA, 16 bp, H. sapiens
tttttctccattctgc

SEQ ID NO: 179041 - DNA, 16 bp, H. sapiens
tttttctcccattctg

SEQ ID NO: 179042 - DNA, 16 bp, H. sapiens
tttttctcctctaaaa

SEQ ID NO: 179043 - DNA, 16 bp, H. sapiens
tttttctcctgcctca

SEQ ID NO: 179044 - DNA, 16 bp, H. sapiens
tttttctcctgcctga

SEQ ID NO: 179045 - DNA, 16 bp, H. sapiens
tttttctccttaaaaa

SEQ ID NO: 179046 - DNA, 16 bp, H. sapiens
tttttctccttcagct

SEQ ID NO: 179047 - DNA, 16 bp, H. sapiens
tttttctcctttgaaa

SEQ ID NO: 179048 - DNA, 16 bp, H. sapiens
tttttctccttttgga

SEQ ID NO: 179049 - DNA, 16 bp, H. sapiens
tttttctctaataaaa

SEQ ID NO: 179050 - DNA, 16 bp, H. sapiens
tttttctctcacataa

SEQ ID NO: 179051 - DNA, 16 bp, H. sapiens
tttttctctcctaaaa

SEQ ID NO: 179052 - DNA, 16 bp, H. sapiens
tttttctctcttgcca

SEQ ID NO: 179053 - DNA, 16 bp, H. sapiens
tttttctctgataatt

SEQ ID NO: 179054 - DNA, 16 bp, H. sapiens
tttttctctgccccag

SEQ ID NO: 179055 - DNA, 16 bp, H. sapiens
tttttctctgtagaga

SEQ ID NO: 179056 - DNA, 16 bp, H. sapiens
tttttctcttaaagca

SEQ ID NO: 179057 - DNA, 16 bp, H. sapiens
tttttctcttaagaaa

SEQ ID NO: 179058 - DNA, 16 bp, H. sapiens
tttttctcttgcctga

SEQ ID NO: 179059 - DNA, 16 bp, H. sapiens
tttttctctttgaaat

SEQ ID NO: 179060 - DNA, 16 bp, H. sapiens
tttttctgaaagtttt

SEQ ID NO: 179061 - DNA, 16 bp, H. sapiens
tttttctgaaatgttt

SEQ ID NO: 179062 - DNA, 16 bp, H. sapiens
tttttctgaactttta

SEQ ID NO: 179063 - DNA, 16 bp, H. sapiens
tttttctgaatataat

SEQ ID NO: 179064 - DNA, 16 bp, H. sapiens
tttttctgacatattt

SEQ ID NO: 179065 - DNA, 16 bp, H. sapiens
tttttctgagatagag

SEQ ID NO: 179066 - DNA, 16 bp, H. sapiens
tttttctgagattttc

SEQ ID NO: 179067 - DNA, 16 bp, H. sapiens
tttttctgagcagcag
